United States Patent 9,624,556 (VIRAL AND VIRAL ASSOCIATED MIRNAS AND USES THEREOF) - sequence listing, part 3

SEQ ID NO: 58526 - RNA, 64 nt, Human
uuauagguaaugauggaacuuagacuccucuucccagagucacaaguagccucugggaucugcc

SEQ ID NO: 58527 - RNA, 64 nt, Human
aacuuguuauaagagaaauggcauuugcauguuccagagucagaaccuguacaguauauaaagc

SEQ ID NO: 58528 - RNA, 64 nt, Human
acacagucuacuacggugguuuccauggaagucacagagucaucaucuggcucugggauauucu

SEQ ID NO: 58529 - RNA, 64 nt, Human
uuuuaucaaggagugauaacaagacaaguuauugcagagucagggugcuuuuauauauaagagc

SEQ ID NO: 58530 - RNA, 64 nt, Human
uuuuccuaagaccauuuauaauuauuaguggcaacagagucagugcuaaucuagccaaauuaca

SEQ ID NO: 58531 - RNA, 64 nt, Human
cugcugaacuggccccagucacccaccuaugugccagagucaggccuggccgacacaaggaucu

SEQ ID NO: 58532 - RNA, 64 nt, Human
ucuugcugccggccuugauaccaccccucacccgcagagucacugcauucccucccagccuuug

SEQ ID NO: 58533 - RNA, 64 nt, Human
ugggggggcccagcacgaagucacaucccagccccagagucacuguccagcccccaccccucaa

SEQ ID NO: 58534 - RNA, 64 nt, Human
uuucuguucuaggaguggacuagaaguuuaagcccagagucaguaaacacuguuuugaagucca

SEQ ID NO: 58535 - RNA, 64 nt, Human
guggagggccuccuuccugcaauucuucccucuccagagucagggagggcugcccagcccuggc

SEQ ID NO: 58536 - RNA, 64 nt, Human
gaauaaacauaauuuacaucacagcagugcaccucagagucacauucaugaaaagcacugauaa

SEQ ID NO: 58537 - RNA, 64 nt, Human
ugugacugcagccuguguaggaccauggggaguucagagucaucauacaaggcagccaagaacu

SEQ ID NO: 58538 - RNA, 64 nt, Human
cugugcagcuacguuuacgucgucauuuauuccacagagucaagaccaauauucugccaaaaaa

SEQ ID NO: 58539 - RNA, 64 nt, Human
aaaaggcagauucuuaggcccaacuguagaccuucagagucagaaugucugguuguugggccca

SEQ ID NO: 58540 - RNA, 64 nt, Human
aauaguaaacugaauauuuuuguuguaagccuaucagagucaauccuucguuuggaauuguuuu

SEQ ID NO: 58541 - RNA, 64 nt, Human
ugccgucuaucagguuuugugccuuaagagacuacagagucaaagcucauuuuuaaaggaguag

SEQ ID NO: 58542 - RNA, 64 nt, Human
gguugcuuuucaaagauccccuucagcccccugccagagucacugccccauaaucaccauguca

SEQ ID NO: 58543 - RNA, 64 nt, Human
ugcuccauuuuugccacaucguggcccgcagccccagagucacuguccaugucaccauccuucu

SEQ ID NO: 58544 - RNA, 64 nt, Human
agcccucuucuuuacucuuaauuuuuuuuugagacagagucacccaggcuggagugcaguggug

SEQ ID NO: 58545 - RNA, 64 nt, Human
cuccucccugcugcuuugcauucacuuccuuggccagagucaggggacagggagagagcuccac

SEQ ID NO: 58546 - RNA, 64 nt, Human
agucaaggguuggcuuuggaauugggccucuggacagagucagaaugagggaauaaugaauagg

SEQ ID NO: 58547 - RNA, 64 nt, Human
cuccacagucuuccuugccuuuagagugacccugcagagucacucagccaaaucugucugcugc

SEQ ID NO: 58548 - RNA, 64 nt, Human
uuuaguuuugugauuuugaugaauaauugaaguucagagucacccguggcuccuaaggaaaaaa

SEQ ID NO: 58549 - RNA, 64 nt, Human
ucuccugccaaaugacccuagacccucuguccugcagagucaggguggcuuuuccccugacugu

SEQ ID NO: 58550 - RNA, 64 nt, Human
gcuccuuacccugcagaggcuguuucagcucacacagagucauccacacaaacccacggcuccc

SEQ ID NO: 58551 - RNA, 64 nt, Human
agcaucacuugggagcuuauugaaaugcagaucccagagucaguaaaucugccugugaaguaug

SEQ ID NO: 58552 - RNA, 52 nt, Human
ccaaaucucccggcagcuaaaccagagucagguggcauggacagggagucgu

SEQ ID NO: 58553 - RNA, 64 nt, Human
gcucugcuuuuaaagauauggcugcuucaaaggccagagucacaggaaggacuucuuccaggga

SEQ ID NO: 58554 - RNA, 64 nt, Human
gccacccagcaaaagguuguuccuaaaauaagggcagagucacacgggggcagcugauacaaau

SEQ ID NO: 58555 - RNA, 64 nt, Human
cccccuaccuaggacccuuccuguggggggucuacagagucagggacagaagggaagggaccca

SEQ ID NO: 58556 - RNA, 64 nt, Human
gacuggaguugaaagccgacgaaccgacacgcggcagagucaauaauucaauaaaaaaguuacg

SEQ ID NO: 58557 - RNA, 64 nt, Human
ugaguggcaaguaagggcagaauuuuaggagaaccagagucacccgcuggcucuacugagauug

SEQ ID NO: 58558 - RNA, 64 nt, Human
cccccacccccaccagagacacacugggaaccgucagagucagcuccuucccccucgcaaugca

SEQ ID NO: 58559 - RNA, 64 nt, Human
cugugccucccugcucggccagcggccacggugccagagucaccaccuugccggccacuccucc

SEQ ID NO: 58560 - RNA, 64 nt, Human
gccugcagacggcccgggagcugugugucuccgccagagucacagcagugccgagguguccgcg

SEQ ID NO: 58561 - RNA, 64 nt, Human
cucacugaaacaaguuauuuuugcuucauauagucagagucagacugacaugauaaaauaucau

SEQ ID NO: 58562 - RNA, 64 nt, Human
gccucagagcugaaagcugcggcgccacuggugccagagucagaugucacagauguguugugua

SEQ ID NO: 58563 - RNA, 64 nt, Human
cgagccuccugcagcaggggacgggugcuuuggccagagucacagacugacacguuucccacug

SEQ ID NO: 58564 - RNA, 64 nt, Human
gaaaagggaaggaggagccccaggucauacagggcagagucagaacuaaacccgggucuccugc

SEQ ID NO: 58565 - RNA, 64 nt, Human
ccgagcagcguucucuugaugccagugcagagaccagagucagaugcccgaggacaguggguag

SEQ ID NO: 58566 - RNA, 64 nt, Human
uuuuccuauuuuaauugcuuuagggaagagcaagcagagucaugaccagggacacagcugagag

SEQ ID NO: 58567 - RNA, 64 nt, Human
cucagugcauuuggcaaaugcuuacuuugcuucccagagucagagaauuggcaaagguuccuaa

SEQ ID NO: 58568 - RNA, 64 nt, Human
ggcuuuccugcccugggcagccccaccucacagccagagucaaugccuucaugggaagggcucc

SEQ ID NO: 58569 - RNA, 64 nt, Human
gcccaguugucuccuugugacauucucuguuucucagagucauugccgucgagucucugcuuuu

SEQ ID NO: 58570 - RNA, 64 nt, Human
guucaagccugugggaguagaaaaaucucauucccagagucagaggagaagagacauguaccuu

SEQ ID NO: 58571 - RNA, 64 nt, Human
gucacugucccuuccagcugccccagacaggaagcagagucaccacgcagcagugucccuucuu

SEQ ID NO: 58572 - RNA, 64 nt, Human
cuguaaaggagauguguuguuugugaagauggagcagagucaaaucugugcuucuaacugagau

SEQ ID NO: 58573 - RNA, 64 nt, Human
ucauuaacaagguacaugcaauagucuaaagaaccagagucacuacuauaguggcuuaacauuu

SEQ ID NO: 58574 - RNA, 64 nt, Human
uuucucaggcuccugugagccucaguccugagaccagagucaagaggaaguacacgucccaauc

SEQ ID NO: 58575 - RNA, 64 nt, Human
uccgagucagcguaggagaaaggccacuggaaaccagagucacacugcgcgucugugcaucucu

SEQ ID NO: 58576 - RNA, 64 nt, Human
uccuuacucucugcccuucauucuguacucuuggcagagucaguaaccaaccacuaauaaaauc

SEQ ID NO: 58577 - RNA, 64 nt, Human
ucccaaaggagcccaggcucaggcaggccuggcccagagucacgcuggcaaccacgaguuuggg

SEQ ID NO: 58578 - RNA, 64 nt, Human
cucaggguuccccguccugagcucgggagauguucagagucacacugccgcccggucugccacg

SEQ ID NO: 58579 - RNA, 64 nt, Human
aacuucaagugucccuuguuugaaauaaacuuagcagagucacuuucuaucuuauuuguuuguu

SEQ ID NO: 58580 - RNA, 64 nt, Human
gguccagagaggacauggacacccccagcucugucagagucacacggggcucaguggacggccu

SEQ ID NO: 58581 - RNA, 64 nt, Human
aacucccagccgccagccaaagccacugggugagcagagucacccacagggccagccccucagc

SEQ ID NO: 58582 - RNA, 64 nt, Human
uggaaaagaacuggugugggagagggauaccucucagagucaagggugacuuggggacuuggug

SEQ ID NO: 58583 - RNA, 64 nt, Human
aucucugagggccaagcuaugcccaggaaugugucagagucaccuccauaauggucaguacaga

SEQ ID NO: 58584 - RNA, 64 nt, Human
accagcccuucucccccaauaacuguggucuauacagagucaauauauuuuuucagagaaaguu

SEQ ID NO: 58585 - RNA, 64 nt, Human
uggaaaguauugcaauucugugagagugacucugcagagucacugcaccaucaggcuuggcccu

SEQ ID NO: 58586 - RNA, 64 nt, Human
auccugugaaacuggcuuuauagaguuaacaaaacagagucagagaccacugucuuaacagugg

SEQ ID NO: 58587 - RNA, 64 nt, Human
uccugggguagggaggcaggguuaggaaccggggcagagucagcucugugcugagccuccuggc

SEQ ID NO: 58588 - RNA, 64 nt, Human
agcauaugccugugggggcagugcugauggcauccagagucauugcuguggcugagcuggaagg

SEQ ID NO: 58589 - RNA, 64 nt, Human
aagagugacgugaggugggcaccggccccaagugcagagucaaggcagggagaggccggcugga

SEQ ID NO: 58590 - RNA, 64 nt, Human
uaaagaccuucugcacagcaaaagaaacuaccaucagagucaacaggcaaccuacaaaauggga

SEQ ID NO: 58591 - RNA, 64 nt, Human
caguucugggaggggguuuuuucagugucaccaacagagucaacaaggaaacauaauuagaggg

SEQ ID NO: 58592 - RNA, 64 nt, Human
ggugagcucagggaggggaagaggagaauacaugcagagucagcaccccuguguccagucugac

SEQ ID NO: 58593 - RNA, 64 nt, Human
uuauuccccuuuagguuugcagaggggguaggggcagagucaggggcuggccagagggucugcu

SEQ ID NO: 58594 - RNA, 64 nt, Human
agggaaucaggauucuguggcuguagacugaucacagagucaaggaagcaguggcaauucuaga

SEQ ID NO: 58595 - RNA, 64 nt, Human
ggcagugggcuggcagcuuccugcugcucccugucagagucaaagcacaaauccucaggacggg

SEQ ID NO: 58596 - RNA, 64 nt, Human
gcucagagggugcugguuggaggccagagcucggcagagucacccacccugcccuuccccagga

SEQ ID NO: 58597 - RNA, 64 nt, Human
uuccucagaggagcaggcaacagugugggauaaacagagucacgaucagaggaaccccaggguc

SEQ ID NO: 58598 - RNA, 64 nt, Human
gaccaaagaguuucagggaaacuccaguauauuccagagucagaucuaagcuccaggcacgccu

SEQ ID NO: 58599 - RNA, 64 nt, Human
uugauauagacugcuaaggugagauggggaauaucagagucagcugcugcuugaggaagcagaa

SEQ ID NO: 58600 - RNA, 64 nt, Human
ccggggaagggccgagcaggcuccaggaggccuccagagucagcuggaccuugcugugucgccc

SEQ ID NO: 58601 - RNA, 64 nt, Human
auucuuugcucccaaggcaagaagaaagagaugacagagucaauauaggguugccaaaucggau

SEQ ID NO: 58602 - RNA, 64 nt, Human
cacgggguccaccucuccucuguccuugcugccucagagucagucacugacccuguuaucauug

SEQ ID NO: 58603 - RNA, 64 nt, Human
aagaucugaccucaucuagacuguucugggguagcagagucacagaucacucuagaaucuaaua

SEQ ID NO: 58604 - RNA, 53 nt, Human
aaccaucaagcauuaauugacaucagagucaaaucagcauugaccugaguuug

SEQ ID NO: 58605 - RNA, 64 nt, Human
ugaauuuuccuagaucccuccaaaugccacccaccagagucacuggugaccccagaaaauggau

SEQ ID NO: 58606 - RNA, 64 nt, Human
cuugaauuuucuuauaaucccaugaaaccaucaucagagucacaauaaugaauuuaucuaaucu

SEQ ID NO: 58607 - RNA, 64 nt, Human
agggaaccuucuuuauaccaaguaccacaccagucagagucaagucaggaaauagaaaccacac

SEQ ID NO: 58608 - RNA, 64 nt, Human
uccccauggcaagcagugauuuaguaaaacaccccagagucagggaagccaaccaccuugaaac

SEQ ID NO: 58609 - RNA, 64 nt, Human
uuuguuuuuuguuuguuuguuuguuuuuuugagacagagucaugcucugucacccgggcuggag

SEQ ID NO: 58610 - RNA, 64 nt, Human
uguauuagguuuguucagaagccgggucagcucacagagucacauuuucuugcuuagucaugug

SEQ ID NO: 58611 - RNA, 64 nt, Human
ucccacccccuuccaccuccaucagucaugugugcagagucagugcucgggaucccgggcccag

SEQ ID NO: 58612 - RNA, 64 nt, Human
uacguuagguucugcggauaaaggaggaauaagacagagucaggagaacuguuccuugugguuu

SEQ ID NO: 58613 - RNA, 64 nt, Human
aauuauuaggccaccuucucccuuuccuggaccccagagucauuccuccauuugguuaaaauac

SEQ ID NO: 58614 - RNA, 64 nt, Human
cugagcgugcaggcgcuccagggcaggccugggacagagucaaggcucagagaauaaagguagc

SEQ ID NO: 58615 - RNA, 64 nt, Human
cuguccaagccaucagcuccuugggacugaugaacagagucagaagcccaaaggaauugcacug

SEQ ID NO: 58616 - RNA, 64 nt, Human
ggguaucaugcuucuacuccauggugaacugaagcagagucaagcugaugaaguuaagcacaac

SEQ ID NO: 58617 - RNA, 64 nt, Human
aggagaacaucaucuuaauagccuuuggcucacccagagucagggagagaugaaaauaauaggu

SEQ ID NO: 58618 - RNA, 64 nt, Human
cauucaucugaaauguguaacuuuuucaugucuucagagucacagacuugaguucauuucccag

SEQ ID NO: 58619 - RNA, 64 nt, Human
gcacuggaacacauuccugggggucaccgauggucagagucacuagaaguuaccugaguaucuc

SEQ ID NO: 58620 - RNA, 64 nt, Human
uucauuuuaugugggaggauguucagcagcgcggcagagucauggggguaagugagugcuguca

SEQ ID NO: 58621 - RNA, 64 nt, Human
cgaugccucucccagaugucacaauuagaaguggcagagucagguuuggaaucugggcuuguug

SEQ ID NO: 58622 - RNA, 64 nt, Human
cgggaggccuuggccgggcacugccagugucuuccagagucacacccagggaccacgggaggau

SEQ ID NO: 58623 - RNA, 64 nt, Human
caaggaggcaaaucuauaaaguuaucaucugagacagagucaucauuuucauuaucagcagaca

SEQ ID NO: 58624 - RNA, 64 nt, Human
accuugcccauccccccagggaagucuggggucccagagucauucucugaccccaugagagcca

SEQ ID NO: 58625 - RNA, 64 nt, Human
aacuugccuauccccccagggaagucuggggucccagagucauucucugaccccaugagaguca

SEQ ID NO: 58626 - RNA, 64 nt, Human
gcucugggccacgugccccggaagcagguguguccagagucagcugagggcucuccccacacca

SEQ ID NO: 58627 - RNA, 64 nt, Human
gaggaucagaaguucaagggaccgugaaagcccucagagucagcaccuaguuugagaccaagca

SEQ ID NO: 58628 - RNA, 64 nt, Human
uuucauucuauuuuaaguuuagaccaaaaaaauacagagucauccccuacccccaccccucuag

SEQ ID NO: 58629 - RNA, 64 nt, Human
cggacuuccucucccuucggacucacagccuuugcagagucaagcuccacuugaagcucacuca

SEQ ID NO: 58630 - RNA, 64 nt, Human
gcaagcugggcacccaggacccccaggugcuugacagagucaccccauggugguauggcugaac

SEQ ID NO: 58631 - RNA, 64 nt, Human
aaugugcuccugaucaaguagauuuuuuaaaaaucagagucaauuaauuuuaauugaaaauuuc

SEQ ID NO: 58632 - RNA, 64 nt, Human
uuuuugcacuuuguauccagcugcaagcucagggcagagucaagggccuggguuggaaaaaccu

SEQ ID NO: 58633 - RNA, 64 nt, Human
gcugagaggcugcaggguggaggggccucggccucagagucaugugcccugugaccacugaagg

SEQ ID NO: 58634 - RNA, 64 nt, Human
gggcagaccccucuaccuccuccaggcugggagacagagucaggcuguugcgcucccaccucag

SEQ ID NO: 58635 - RNA, 64 nt, Human
cucucuagucaccacccugccucucccucucacccagagucaguaccaguuuuauggcuuuauu

SEQ ID NO: 58636 - RNA, 64 nt, Human
cagaggcaggccagaggaccuaagugugauggaccagagucacuucuccuccuccuuucuccag

SEQ ID NO: 58637 - RNA, 64 nt, Human
ccuuaaacucugaccaacagugagccugguggaacagagucauauuucucuucuuucaaaagca

SEQ ID NO: 58638 - RNA, 64 nt, Human
gaaaaggccggcuccccugucuuuccuuggcugucagagucaggguaacacacaccaagagugg

SEQ ID NO: 58639 - RNA, 64 nt, Human
acaguuguguuagccucuugcguauuggcuuuuucagagucauuuaugagcagaaaaaaaaaaa

SEQ ID NO: 58640 - RNA, 64 nt, Human
gucuucuugggggcagaccagagagcucaaguuucagagucagaauuaggcacuuggagcguuu

SEQ ID NO: 58641 - RNA, 64 nt, Human
ccccuugcucuuccuggccugaaacacgggaaaccagagucaaaaguuaucucccucucccugu

SEQ ID NO: 58642 - RNA, 64 nt, Human
uacaguguacacauuauacacugcaucuuuaacacagagucaccugugacaggcucuagguuug

SEQ ID NO: 58643 - RNA, 64 nt, Human
cacacacacacacacacacacacacacacacacacagagucaggccguugcuagucaguucucu

SEQ ID NO: 58644 - RNA, 64 nt, Human
ggguauuccauaagcacauauuccauaaagugcucagagucacagguuuuauaauaaauuaugu

SEQ ID NO: 58645 - RNA, 64 nt, Human
ugaagcuuugcuaauuauaaccccucaccuugaccagagucauugauguccugaugugaaacaa

SEQ ID NO: 58646 - RNA, 64 nt, Human
aaggaguguauagcagagaggaaaucccuuucaacagagucagcugcuaacugauuuccuauaa

SEQ ID NO: 58647 - RNA, 64 nt, Human
aaucuguuuccauuuuagucacagaaaagaaaagcagagucagcuacugagagcucuggaaaga

SEQ ID NO: 58648 - RNA, 64 nt, Human
caaaacagaagccuggagaggggagugaccugcucagagucauugcagagccgggauggggacc

SEQ ID NO: 58649 - RNA, 64 nt, Human
augaaagcauucuucccugaaaaguuaggccucucagagucaccacuuccucuguuguagaaaa

SEQ ID NO: 58650 - RNA, 64 nt, Human
agaaacagaugaucuauaggaugugaguggguggcagagucaaaaggaaccucaccuguuccua

SEQ ID NO: 58651 - RNA, 64 nt, Human
gaacccagggugucugacucccagguccaugcuccagagucagauauagaaggcuggagcacag

SEQ ID NO: 58652 - RNA, 64 nt, Human
agaggcaacaaauagaggccuggccuccaggugccggauccagacaccugaccuagaaugccug

SEQ ID NO: 58653 - RNA, 64 nt, Human
ccgaaaccacgugagugagaugagccaacagcaccggauccacagaauguuucuucucugccuu

SEQ ID NO: 58654 - RNA, 64 nt, Human
aaaucaaggugaaggaucuguccgacagucaagacggauccacaguaaucuuucggucuccuua

SEQ ID NO: 58655 - RNA, 64 nt, Human
uauucucacugaugcacugauggcccugaagaagcggauccagucacauaggaaaggaggcugu

SEQ ID NO: 58656 - RNA, 64 nt, Human
ccugcaacaugccagccacugugauagaggcuggcggauccaagcaaauggccaaugagaucau

SEQ ID NO: 58657 - RNA, 64 nt, Human
ccauuuuuuuaaugaaaaaaaaaaacaaaaaaaacggauccaagaagaaaagagaauuuauuuc

SEQ ID NO: 58658 - RNA, 64 nt, Human
acacauacacacacgugcauguaucugagcugcucggauccagaggucauuuuuguuacagugu

SEQ ID NO: 58659 - RNA, 64 nt, Human
uacauuuuuuuacuucuuuccuuuuucuuaaguucggauccaaguuugucuucuuauccaucac

SEQ ID NO: 58660 - RNA, 64 nt, Human
uuccuagaagggcuacugcuccuggaagaguggacggauccauaauaaagacgucccaaauggu

SEQ ID NO: 58661 - RNA, 64 nt, Human
agacgauuaccggcccagcaaagucugcaucuggcggauccaggugucugagggcuuccacgug

SEQ ID NO: 58662 - RNA, 64 nt, Human
aaggggaaaaggcaguuagcucaaggacuugugacggauccacuuugguguucaaggaccugcu

SEQ ID NO: 58663 - RNA, 64 nt, Human
uauccuuguuuccuuagcuugguaugagacagaucggauccaguuucccaugcaccaacccacu

SEQ ID NO: 58664 - RNA, 64 nt, Human
gaggauaaagcccccuccucacaucccucuauugcggauccacaguggccuuacucuuaacuug

SEQ ID NO: 58665 - RNA, 64 nt, Human
caauguaauaaauguacuuccuggaagugucuuucggauccacuauaugccucagcacauggaa

SEQ ID NO: 58666 - RNA, 64 nt, Human
cagagcucugagcagcagcaggcaacuucgagaacggauccagaaaugcagucagaaggacccu

SEQ ID NO: 58667 - RNA, 64 nt, Human
gcugagugcauuuggagggagugaguggcccuuucggauccagggaggcugguccuauggccuc

SEQ ID NO: 58668 - RNA, 64 nt, Human
gcucguccacaaacacuccguggcugagaggcagcggauccaggcagcgaugcugagccaccuc

SEQ ID NO: 58669 - RNA, 64 nt, Human
uguuccagggaagggaugggggcagcagcugcuucggauccacacuguaucugugucaucccca

SEQ ID NO: 58670 - RNA, 64 nt, Human
aggauuucaagaaagcaccaaagaccagggagcucggauccauacucggggggccucagcccuu

SEQ ID NO: 58671 - RNA, 64 nt, Human
aguuauuuccaguuuauaaaaaggaaaagcugaucggauccauguuucucucugcgagucuccu

SEQ ID NO: 58672 - RNA, 64 nt, Human
caacccaggagugccucucacagcuauaugacuacggauccauuagugaggagcgacacacaca

SEQ ID NO: 58673 - RNA, 64 nt, Human
caugucugucaggugggaagaggaguacacggugcggauccagcugcaagaccguguaaaugag

SEQ ID NO: 58674 - RNA, 64 nt, Human
uaagggguugguugagguggaagcccuccuuccacggauccauguagcaggacugaauuguccc

SEQ ID NO: 58675 - RNA, 64 nt, Human
agaagggcagggccauagggagggagauucgcuacggauccaggccauuccugggugagcccuu

SEQ ID NO: 58676 - RNA, 64 nt, Human
ucacauccucccguaggccagugugucucugaaacggauccagcaauuccugagccaagaggaa

SEQ ID NO: 58677 - RNA, 64 nt, Human
uugacaggcugaacuucacacagguagucugccacggauccagagcacggcacucagaggcgag

SEQ ID NO: 58678 - RNA, 64 nt, Human
guuguugcuucuguuauuucugucauugugaagacggauccagacacagaagaacaaagaccca

SEQ ID NO: 58679 - RNA, 64 nt, Human
gcccucacccaccucggagaggcguccccaccaucggauccaggcuugcuagggguccugaacc

SEQ ID NO: 58680 - RNA, 64 nt, Human
uccugggucccugggaaagaggguacuaggggcccggauccaggauucugggaggcuucaguua

SEQ ID NO: 58681 - RNA, 64 nt, Human
ccggagcccuggccucugcagcagccgcagucuccggauccaaagccaaagccgaaugagaacg

SEQ ID NO: 58682 - RNA, 64 nt, Human
ucacagcaguucuguuggagaaacgcuugguuuccggauccagagccacagaaagaaauguagg

SEQ ID NO: 58683 - RNA, 64 nt, Human
ccgccagcgccuacuucugguggcucuagguccccggauccaccacccuucccccacugacucu

SEQ ID NO: 58684 - RNA, 64 nt, Human
ugaccugugagcucuggcucagacagcagcaagccggauccaccaacaccgcagcgccuuauga

SEQ ID NO: 58685 - RNA, 64 nt, Human
auaucuggggaacuuggcauucaacauuaaaaagcggauccaaagacccaggaaugacagguga

SEQ ID NO: 58686 - RNA, 64 nt, Human
aguuuauguaguacuuaauguacaugauaugaaugugaagcauaaaauuaaauaaaauuuuucc

SEQ ID NO: 58687 - RNA, 64 nt, Human
acugcuugggccuugcugagccaggguccucagggugaagcaggacugaggaguggccagcucu

SEQ ID NO: 58688 - RNA, 64 nt, Human
accagugucuacgcaggcggagcugaacggagaggugaagcagggggucuuuauauucccugca

SEQ ID NO: 58689 - RNA, 64 nt, Human
gcccccugggugcugcuggggccuuggggcaggagugaagcagaggugauggggcugggcugag

SEQ ID NO: 58690 - RNA, 64 nt, Human
aaaaggaggguaggucugcauuauaacugucugugugaagcaaucauuuaguuacuuugauuaa

SEQ ID NO: 58691 - RNA, 64 nt, Human
uccuagcacaaauuagaugguuuggagcacaauggugaagcacacuccccucccuccucaccug

SEQ ID NO: 58692 - RNA, 64 nt, Human
auacugucuccucccaauucauccuuaauuccaagugaagcagcacagugcugagaaacaguuc

SEQ ID NO: 58693 - RNA, 64 nt, Human
uuuuaccuuguuuucucuauaggucaugauuucugugaagcaaaaagaugccuuuuaccaugaa

SEQ ID NO: 58694 - RNA, 64 nt, Human
gaugauaccucuuacaaacuuuaccucauagccugugaagcagguuggcauguggauuacaagu

SEQ ID NO: 58695 - RNA, 64 nt, Human
ucacauggcacuuggaauccuugaguuaauuccagugaagcaaaacuugggaagagucaggauu

SEQ ID NO: 58696 - RNA, 64 nt, Human
ccaggcaccuggccugcugggaaccccgcagcccgugaagcagugccucgaggcaccggcgcug

SEQ ID NO: 58697 - RNA, 64 nt, Human
ccaaggucaagccaugugucugaugacauuccuggugaagcaaaggagaggaggaugggucagc

SEQ ID NO: 58698 - RNA, 64 nt, Human
uuaagcaagagaaaaacagcucuaauucgagauugugaagcaacacuucuaaauucaaagacau

SEQ ID NO: 58699 - RNA, 64 nt, Human
uucucuaugaggcuggaaccuccuccuucuuccagugaagcacgaggucuugguuccaggguuc

SEQ ID NO: 58700 - RNA, 64 nt, Human
cauuccucaagaucacuuuuaaaaaagguuagaagugaagcaaauacauucagcuuacugauca

SEQ ID NO: 58701 - RNA, 64 nt, Human
aauucuacucuuuuuugauuagcuacauuaccuugugaagcaguacacauuguccuuuuuuuaa

SEQ ID NO: 58702 - RNA, 64 nt, Human
uuuaaccacaaugaauuguccuuaauuaccaacagugaagcacuacaggaggcaacuguggcau

SEQ ID NO: 58703 - RNA, 64 nt, Human
ccccucuuccccacccugucccuguagaaaaccagugaagcagguacggagcugaggacugggc

SEQ ID NO: 58704 - RNA, 64 nt, Human
ugucuccuaccacuucggagccaugggggcaagugugaagcagccagucccugggucagccaga

SEQ ID NO: 58705 - RNA, 64 nt, Human
ucauuuauuugguuauuuccuaagaauauugaaagugaagcaacuaugugacuguauucuucag

SEQ ID NO: 58706 - RNA, 64 nt, Human
uggaugaugugggaguugacaggccagggagagggugaagcagguaucagagucacuccucugu

SEQ ID NO: 58707 - RNA, 64 nt, Human
cucuucccccaacauacucacuagaguggcuccugugaagcagagaccaaaguucugacuuuuc

SEQ ID NO: 58708 - RNA, 64 nt, Human
uauccaugggaauguucuucaguaccacaaggaugugaagcauaugaacucugcaggaguccug

SEQ ID NO: 58709 - RNA, 64 nt, Human
auaaaauuuuaguuguacacuuuuaguagucauagugaagcaggucuagaaaauaagccuuugg

SEQ ID NO: 58710 - RNA, 64 nt, Human
caagccugguuccacuccucaggggcuccuggcagugaagcaacuucaguucuuuuacugcaaa

SEQ ID NO: 58711 - RNA, 64 nt, Human
acuuugaauugcuugugauuucaaaaauaaagcagugaagcaauacuuguguacacugguacuu

SEQ ID NO: 58712 - RNA, 64 nt, Human
gucaccugccucuuaccuaccucagagggauuuggugaagcaaacuguuaaucuucgaaaacga

SEQ ID NO: 58713 - RNA, 64 nt, Human
ugccagguagagcaaaagacauugguggggguaugugaagcaaaaggggcaggugcacacaccu

SEQ ID NO: 58714 - RNA, 64 nt, Human
aagaggcugccccauuugaggucauuuaaaaucugugaagcaaauccagacuccuugccguuca

SEQ ID NO: 58715 - RNA, 64 nt, Human
uaaaucuguuggguucugucuucuauuggguucugugaagcaaaccacuguagcuuuagcuggg

SEQ ID NO: 58716 - RNA, 64 nt, Human
aguguucauuguuucguaacacagcauuguauaugugaagcaaacucuaaaauuauaaaugaca

SEQ ID NO: 58717 - RNA, 64 nt, Human
gugaccacacauuugagggaagacguggcguuaggugaagcagaagcaaacccugcucuuaggg

SEQ ID NO: 58718 - RNA, 64 nt, Human
gaaguugguguuaguagguauuguaugaucaguggugaagcaaguaggaccacugaugugucua

SEQ ID NO: 58719 - RNA, 64 nt, Human
uuggcuccacaaauguauuuggauuguuuucuaugugaagcaaaccaauuauaauuaaccacau

SEQ ID NO: 58720 - RNA, 64 nt, Human
uugcaauguugaaugacaaaaauaaacaguucaagugaagcacaaggauuaaguuggaaaagcu

SEQ ID NO: 58721 - RNA, 64 nt, Human
gacagugaagugaccucucugucacugcaacucugugaagcaggguaucaacauugacaagagg

SEQ ID NO: 58722 - RNA, 64 nt, Human
augauaggccuucucuguaagaauccuucucauagugaagcacuguugauguuuuguucaccgg

SEQ ID NO: 58723 - RNA, 64 nt, Human
gaguucccuucccacuugcucuccgugggaccgggugaagcacagaccuugccaagcuucaggu

SEQ ID NO: 58724 - RNA, 64 nt, Human
cacgucacauacgauugagcaucuccaucuggucgugaagcaugugguaggcacacuugcagug

SEQ ID NO: 58725 - RNA, 64 nt, Human
cuguugucacaagaaagcuuuguaaaaccagacagugaagcaaaauguugccaacugcuuaacc

SEQ ID NO: 58726 - RNA, 64 nt, Human
gauugucuguuuggccaaccaugaaaauuaaagagugaagcagauguaauggccugacauucca

SEQ ID NO: 58727 - RNA, 64 nt, Human
ugaguuggguuggaguacacaccuggugugcagggugaagcagcucauuuugucugguccugau

SEQ ID NO: 58728 - RNA, 64 nt, Human
gagaguagcuguguuugaaucccuguaggaaauggugaagcauagcucugggucuccuggggga

SEQ ID NO: 58729 - RNA, 64 nt, Human
gaggacgugauguuuucucacagcagcugccugggugaagcaucugcuggacaagucggaccac

SEQ ID NO: 58730 - RNA, 64 nt, Human
augaaaaagcgagcagauacuguuggucuagccugugaagcaauuaaucgaauguuucagaagg

SEQ ID NO: 58731 - RNA, 64 nt, Human
aaaugcaugaguugcagacuugcuacuggcaagagugaagcaagugggugaguaaaacuauuuu

SEQ ID NO: 58732 - RNA, 64 nt, Human
acccuugccccuuuauucucaaggucuuuugauugugaagcaaggcccgaggccuugacuggug

SEQ ID NO: 58733 - RNA, 64 nt, Human
uuuuaggauaagaggugagaacugggcaaaaguugugaagcagcaauucuguuauauggacagu

SEQ ID NO: 58734 - RNA, 64 nt, Human
acgacuccaucucuucucauuccagauuuccagcgugaagcaggcccaagcuagggaaggugag

SEQ ID NO: 58735 - RNA, 64 nt, Human
caaacucaucccuggcacaagaaauuccagucaugugaagcaaacugcccuuuguccucaaaga

SEQ ID NO: 58736 - RNA, 64 nt, Human
acauuuuauccuaccugaaaguaaacgaguaauugugaagcauaagacacugaggcuaauacaa

SEQ ID NO: 58737 - RNA, 64 nt, Human
aaaaguaagggaauaaauuuuugucuuuguuggagugaagcauuuaaaagaguaaggguaaaaa

SEQ ID NO: 58738 - RNA, 64 nt, Human
uuccucuguuuuacaaacugcuuggcagccccaggugaagcaucaaggauuguuugguauuaaa

SEQ ID NO: 58739 - RNA, 64 nt, Human
aguucuuuccucuucauuugaugccgugcacugugugaagcagauguuuuuguccggaaauaaa

SEQ ID NO: 58740 - RNA, 64 nt, Human
ccgguacuuuuaagguuaggaugggacgggaaaagugaagcaggauauuagcuccuuauaccuu

SEQ ID NO: 58741 - RNA, 64 nt, Human
aagugacauucucagugauaauggagguuucacugugaagcaucaccagcagauccuuguuuug

SEQ ID NO: 58742 - RNA, 64 nt, Human
aucucuuagauuuacauuauaacuacauaaagcagugaagcaaaggcaaauuaagauaaagcua

SEQ ID NO: 58743 - RNA, 64 nt, Human
agaaugugaggcauugucaccuuguuacagcuaugugaagcagagcugucacaacuuuuccugu

SEQ ID NO: 58744 - RNA, 64 nt, Human
cugugucuucagcgcccagcccugcguguuccuggugaagcaguuucacaucagucucuccaga

SEQ ID NO: 58745 - RNA, 64 nt, Human
accugagugacacuauuuguaaauauaacuaguugugaagcacacauaccuuuauuuugggaau

SEQ ID NO: 58746 - RNA, 64 nt, Human
guccacugggccauuguggugugagcuucagauggugaagcauucuccccaguguaugucuugu

SEQ ID NO: 58747 - RNA, 64 nt, Human
uuugucuuuuuuaaacuaaaguaauuguauugaugugaagcauaucauuuuuucaaauaugaaa

SEQ ID NO: 58748 - RNA, 64 nt, Human
gauuacagguacaaugauguauaauuaaugcuuagugaagcauaaaguuaccuacaucaauuaa

SEQ ID NO: 58749 - RNA, 64 nt, Human
aaacucacgaaucuacggacauuuugcuuucagggugaagcaagcuugaauuuggauugccugc

SEQ ID NO: 58750 - RNA, 64 nt, Human
gucacaagccacuggcaagcaagugguauagucugugaagcacugcagcgagcagcaccuggau

SEQ ID NO: 58751 - RNA, 64 nt, Human
gaaaauaagacucuaggggcuccagauaauaagggugaagcaagaagcauuucauuugcacauc

SEQ ID NO: 58752 - RNA, 64 nt, Human
aauuauuccauuugcaacuuauccccaacagguggugaagcaguauuuuccaauuugaagauuc

SEQ ID NO: 58753 - RNA, 64 nt, Human
acggggacuccacacccaggccuuuuuuaacggugugaagcauagacagagcugcagucugugc

SEQ ID NO: 58754 - RNA, 64 nt, Human
gucuuucucuuccuuuuauauaaauaucguuagggugaagcauuauggucuaaugauucaaaug

SEQ ID NO: 58755 - RNA, 63 nt, Human
aauuuuguuguauaauucucaaauaaauauuuuggugaagcauacaaguuuuauuuaucagaa

SEQ ID NO: 58756 - RNA, 64 nt, Human
ucauuuuucucuuuuuaauuucuuuuacccuuuugugaagcagcuauacguggcauacauguau

SEQ ID NO: 58757 - RNA, 64 nt, Human
cgagcagacacacugaucugaacaucuggcccaagugaagcauggcauauagugcccuuggaag

SEQ ID NO: 58758 - RNA, 64 nt, Human
ugaugcugccagggcgccaucgccaaguaagaaagugaagcaaaucagaaacuugugaagugga

SEQ ID NO: 58759 - RNA, 64 nt, Human
auagacacagguaccauguuccauuuccgucauggugaagcaaaugaauuggccuggcuaccac

SEQ ID NO: 58760 - RNA, 64 nt, Human
agcaaaugggguuucacaaauaguuguaaauauagugaagcaauuugaaauaauuuucaagcaa

SEQ ID NO: 58761 - RNA, 64 nt, Human
auuucccauugcuguuaguuuuagaacuauacccgugaagcaugacuuauuguaagauguuggc

SEQ ID NO: 58762 - RNA, 64 nt, Human
auugauuaacugcauuuuggcuggagacacccaagugaagcaaucuuguauuuuuaauauuuaa

SEQ ID NO: 58763 - RNA, 64 nt, Human
agguccuaggcauggagaaacuccaagcuccucugugaagcaggucuuucacucacaacacuua

SEQ ID NO: 58764 - RNA, 64 nt, Human
uguaguggaauuauguuuagauuugaauucaucugugaagcauucaaaucaaagcuaaaagccu

SEQ ID NO: 58765 - RNA, 64 nt, Human
aaugcuuuuguaugagcuguggcuuuuucccauugugaagcauugaauaucacauuuuggaaca

SEQ ID NO: 58766 - RNA, 64 nt, Human
gaauagccaauugagugccuaaugagaccucugugugaagcaagugaaguauagcugcuucuuu

SEQ ID NO: 58767 - RNA, 64 nt, Human
uaauauuuuuuaaaacucaccuguuugguucugggugaagcaguuccugaaggaguguuuuguc

SEQ ID NO: 58768 - RNA, 64 nt, Human
acaaacaaacaaaaaaaacaaggguggguggggagugaagcacgaggaauaccuaugaagagcu

SEQ ID NO: 58769 - RNA, 64 nt, Human
caagaaaaugggguggcuuccuuuccaucuaugggugaagcagaugcauggugagggucagcuc

SEQ ID NO: 58770 - RNA, 64 nt, Human
cuugagagaaaaacuuagaucugagugauggaaugugaagcaaaucuucaaaaucaguagacau

SEQ ID NO: 58771 - RNA, 64 nt, Human
ugucagagacucacaucuuuccugauggauagcugugaagcauucucuuacccacccuacugca

SEQ ID NO: 58772 - RNA, 64 nt, Human
ggcacggggccuaugugucucugucgcgucugcugugaagcacaugaugcucuauuuauuguag

SEQ ID NO: 58773 - RNA, 64 nt, Human
cccagcagagacuguuaauggccccuuacccugggugaagcacuuacccuuggaacagaacucu

SEQ ID NO: 58774 - RNA, 64 nt, Human
uauauauuuccuaucauucuaaaaaagugaauuugugaagcaaaguuuugccagauguuaaacu

SEQ ID NO: 58775 - RNA, 64 nt, Human
ucauuguuuuauugacacaucuauauauacauuugugaagcaagaaacaauaaaaaagcuucgu

SEQ ID NO: 58776 - RNA, 64 nt, Human
augacauuuaccuaugugugcugccucauuccuggugaagcaacugcuacuuguucucuaugcc

SEQ ID NO: 58777 - RNA, 64 nt, Human
uaaugacacuuguccccaaauccgaaccuccucugugaagcauucgagacagaaccuuguuauu

SEQ ID NO: 58778 - RNA, 64 nt, Human
cauuuuuucuuaauguuguggauugcuuuucuaugugaagcaugggauuuacuguugcguaacu

SEQ ID NO: 58779 - RNA, 64 nt, Human
ccuguaaugcuagcacuuugggaggccgaggugggugaagcaccugaggucaagaguucgagau

SEQ ID NO: 58780 - RNA, 64 nt, Human
agauucgcugacagccaaaguaucauuuagaaaagugaagcaacaagauuuagguugaugaaag

SEQ ID NO: 58781 - RNA, 64 nt, Human
augaugagaaauaauuaauuggacgggagacagagugaagcaucaaccuacuuagaagcugaaa

SEQ ID NO: 58782 - RNA, 64 nt, Human
cucucucuaauucuaggcacacauuuaguuagaugugaagcauuuaauucauugggagcuaggu

SEQ ID NO: 58783 - RNA, 64 nt, Human
ucuauuuauaauauucagcaaaagugaaagacuugugaagcauaugacauucuauuuuugacuu

SEQ ID NO: 58784 - RNA, 64 nt, Human
uaaucacagcaaaugaaaggugguuuaguuauaagugaagcaugguugaauaccagcuggggag

SEQ ID NO: 58785 - RNA, 64 nt, Human
uuuuccaaguuggcuucagcugaagagcuguuuugugaagcaucccaggcuugcccaggagaga

SEQ ID NO: 58786 - RNA, 64 nt, Human
auuuugggaaguugcauuccuuugucuucaaacugugaagcauuuacagaaacgcauccagcaa

SEQ ID NO: 58787 - RNA, 64 nt, Human
uaaaagggucugggagaaccagaugauguacuaggugaagcauugcauugugggaaucacaaag

SEQ ID NO: 58788 - RNA, 64 nt, Human
aaaagaauacacacuagagaaaaaccuuacaaaugugaagcaucugauaaauccugugaagcgu

SEQ ID NO: 58789 - RNA, 64 nt, Human
uugauguugcuggucuggugucuuauuuccuaaagugaagcaucuuuuuuuaaaaaagaauuug

SEQ ID NO: 58790 - RNA, 64 nt, Human
gaauuaguuuuauaugcuucuguuuuauaauuuugugaagcaaaauuuuuucucuaggaaauau

SEQ ID NO: 58791 - RNA, 64 nt, Human
cuuggccacacaguaccacggaaggaagggcacugugaagcagugaggauuucuugugccauuu

SEQ ID NO: 58792 - RNA, 64 nt, Human
ucguaugagaacuucuuuuccuuuccuuuugucugugaagcacugugauucuguuucuacugga

SEQ ID NO: 58793 - RNA, 64 nt, Human
ccccuacccccaccccagagggaccacagucagcgugaagcaguuauuuucuacgcuaccugug

SEQ ID NO: 58794 - RNA, 64 nt, Human
uaccccaugaagauauuuggugggaguuauaucagugaagcaguuugguuuauauucuuauguu

SEQ ID NO: 58795 - RNA, 52 nt, Human
agcaagagucaucugcuugaaugugaagcaaacacagcaucgugaucacuga

SEQ ID NO: 58796 - RNA, 64 nt, Human
agguuucuuauucuuacaacaugauuguuuauaugugaagcacaucuugcuguugccuuauuuu

SEQ ID NO: 58797 - RNA, 64 nt, Human
gaccacagccuuaguaugacauccugcacaauuugugaagcauuuauucuacugaaggcacagu

SEQ ID NO: 58798 - RNA, 64 nt, Human
uuguuuuccagcugcuuuccugggggaucagacugugaagcaggaagacagauauaauaaauau

SEQ ID NO: 58799 - RNA, 64 nt, Human
gcuccacgaugcgguaaugaauccagcagaaguggugaagcagcgcuugcagauguacaacucg

SEQ ID NO: 58800 - RNA, 64 nt, Human
ccagauguuccugggcuggguaaaagcagcuggagugaagcacucauuuuccauaaagguaaca

SEQ ID NO: 58801 - RNA, 64 nt, Human
auacgauuauucaauguggugacugggguagacugugaagcagcccuccuuaugcccacugccu

SEQ ID NO: 58802 - RNA, 64 nt, Human
cccacugcccauggcaugucuuugggaggugucugugaagcagucauaccugcuccucaucugc

SEQ ID NO: 58803 - RNA, 64 nt, Human
caaaucuugggucuuggggacuaacccaaugccugugaagcagucagcccuuauggccaauaac

SEQ ID NO: 58804 - RNA, 64 nt, Human
agggagaauaacauaggugccuuugcuacgcgaagugaagcacacaguuuuagauuuuugcagg

SEQ ID NO: 58805 - RNA, 64 nt, Human
ugugggugacagacuucuaagcaggaagauagacgugaagcacaugguuacauuugggaacuug

SEQ ID NO: 58806 - RNA, 64 nt, Human
ccauacgcuccaaaagauggcugugauagaucuugugaagcaauuacugagcagaucaagaucu

SEQ ID NO: 58807 - RNA, 64 nt, Human
acauguguaugugcagcuuuacauuuuauuuuacgugaagcaugugauuaggaaaacucauuuu

SEQ ID NO: 58808 - RNA, 64 nt, Human
ggaaaugauauugaaagguagcaaugccuggauagugaagcaugaggcagcacgugcacaaauu

SEQ ID NO: 58809 - RNA, 64 nt, Human
ccucuuuuucuguagaggcaccacagggaggugggugaagcacuucggcucuggaguuacagau

SEQ ID NO: 58810 - RNA, 64 nt, Human
uugucuuaccugccuuuuacuuucguguggauaugugaagcauugggucgggaacuagcuguag

SEQ ID NO: 58811 - RNA, 64 nt, Human
ggguggggggggacccccaggucccggaggggaagugaagcaacagcccagcuggaagggcguc

SEQ ID NO: 58812 - RNA, 64 nt, Human
cuuugucuugauaccuugguuugucccagcugaagugaagcaagagaguuugaauuaauuuuuc

SEQ ID NO: 58813 - RNA, 64 nt, Human
agcgagcacuuuuccuuucccuggagaaugggaugugaagcaguagaccgcagccacgccgaug

SEQ ID NO: 58814 - RNA, 64 nt, Human
augaaaaaguaguaaauaguucuuuguaaccugugugaagcagcagccagccuuaaaguagucc

SEQ ID NO: 58815 - RNA, 64 nt, Human
agacgcauguugguaggucacuggaccagagcuugugaagcaggcaaccucugggguaagacua

SEQ ID NO: 58816 - RNA, 64 nt, Human
acuagcucuagaaaagucccaaaagcagcagaaggugaagcaggaagcacuugguuuucuccuu

SEQ ID NO: 58817 - RNA, 64 nt, Human
gcugagaacaugucauugguuugugaggccuaaggugaagcacuccuggcagccacacugugua

SEQ ID NO: 58818 - RNA, 64 nt, Human
auucuaaugcaagauauuuuuucuuuuuuauagugugaagcaguauucuggaaaguuuuucuaa

SEQ ID NO: 58819 - RNA, 64 nt, Human
acaaauuccagaauuuucuggguuuuaggacguugugaagcaugacugauuaacagaauuuuau

SEQ ID NO: 58820 - RNA, 64 nt, Human
aaaaacaaauuggaagaauaaccaggacagccaagugaagcagccacagggacccaagcagucg

SEQ ID NO: 58821 - RNA, 64 nt, Human
ccccuguccuaggucaugaaggacacucugcagggugaagcaccagggagaggccucggcuguc

SEQ ID NO: 58822 - RNA, 64 nt, Human
ccccuggggguuuggggccggcuucuccccucuugugaagcacaaaguccccuccccaccuacc

SEQ ID NO: 58823 - RNA, 64 nt, Human
cacaccugaaaguucuaaggggccgaggacaucagugaagcagcagugaaaccaggggcucugc

SEQ ID NO: 58824 - RNA, 64 nt, Human
aaaaccuauuccagaauaaguuuuguguuggcuugugaagcauugaugucauuuuuuuuaauug

SEQ ID NO: 58825 - RNA, 64 nt, Human
ggaaaauuuugggaugggggacucaggaggaccugugaagcauguaguuaucuagaucugggua

SEQ ID NO: 58826 - RNA, 64 nt, Human
ugugcuuuucuccaauaucagugcucgagacacagugaagcaaauuaaaaaaaaaaaaaaaaaa

SEQ ID NO: 58827 - RNA, 64 nt, Human
acuugcaauccauuaaaacaacaaacgaaaccuagugaagcaucuuuuuaaaaggcugccagcu

SEQ ID NO: 58828 - RNA, 64 nt, Human
gguaacugcaauauaaaauagccauuauuguuuugugaagcaugguugaaauuagcuagugguc

SEQ ID NO: 58829 - RNA, 64 nt, Human
uuggugcuaauacgggggaccaagcuuuguccaagugaagcaggcuucgacuccuucugagagg

SEQ ID NO: 58830 - RNA, 64 nt, Human
aaguuugacagcgagugaccugaggccaucuucggugaagcaagggugaugaucggagacuacu

SEQ ID NO: 58831 - RNA, 64 nt, Human
gggcauuuucugagcuaagcuuugucauuaguuugugaagcaccuggucagcaaccugccccag

SEQ ID NO: 58832 - RNA, 64 nt, Human
ugguucuagaagaauguacaccaaaauaaaacaugugaagcaguauugauucuuuauugggagu

SEQ ID NO: 58833 - RNA, 64 nt, Human
uagaauuucuuuaauuuugcuucucugacgaguugugaagcaaaauaccugaagugagucuuug

SEQ ID NO: 58834 - RNA, 64 nt, Human
aguugucuuuaaaaaucaguuacucuaauuccaggugaagcaagccgcugguagcaucacccuu

SEQ ID NO: 58835 - RNA, 64 nt, Human
ugauuucaaagugaagaaaauguaacagaagccagugaagcaauggaagcuggagugugacugg

SEQ ID NO: 58836 - RNA, 64 nt, Human
ggggaugggcugcaaguucuugcauauccucccagugaagcauuuauuugcuacuaucagauuu

SEQ ID NO: 58837 - RNA, 64 nt, Human
ugcauacacauuucuggugagggcgacugggugggugaagcaccguguccucgcugaggagaga

SEQ ID NO: 58838 - RNA, 64 nt, Human
uuuggggcuaggcaagccccagguugcagacauggugaagcagagaaacuguucuucugguucc

SEQ ID NO: 58839 - RNA, 64 nt, Human
gaaaaagauauguaaggucuuuuagcuccuuagagugaagcaaaagcaagacuucaaccucaac

SEQ ID NO: 58840 - RNA, 64 nt, Human
agaggccaggcgcagcucacugcggccuaagaaggugaagcaacaugggaacacauccuaagac

SEQ ID NO: 58841 - RNA, 64 nt, Human
aggugcaaauggacuugagagcaucuaugugcuggugaagcaugaggucugaguagaaaagggg

SEQ ID NO: 58842 - RNA, 64 nt, Human
aauggauuuuuuuaaaaaaauagauguuccuuuugugaagcaccuugauuccuugauuuugauu

SEQ ID NO: 58843 - RNA, 64 nt, Human
caacuguucccgauucacguuuuucuggaccaaggugaagcaaauuugugguuguagaaggagc

SEQ ID NO: 58844 - RNA, 64 nt, Human
ugccucggccucccaaagugcugggauuacaggcgugaagcaccacgcccagccugaaauaaua

SEQ ID NO: 58845 - RNA, 64 nt, Human
ggucuaggcccagcuuucacacuguggcagcccagugaagcagacugggccaugaacucuccua

SEQ ID NO: 58846 - RNA, 64 nt, Human
auuccugccccagauggcuuugugauucccuccagugaagcagccuccuuauauuuggcccaaa

SEQ ID NO: 58847 - RNA, 64 nt, Human
guuucuguauauccgucuguacgugugucauugcgugaagcagugugggccugaagugugauuu

SEQ ID NO: 58848 - RNA, 64 nt, Human
ccuuuucuauauuuauaagaagagaagaucuugagugaagcagcacgcgacccaggugugugug

SEQ ID NO: 58849 - RNA, 64 nt, Human
aaaacuagacagaaugaucauucaauggaucacagugaagcaaaggacacaacuuuuuauugua

SEQ ID NO: 58850 - RNA, 64 nt, Human
caguggaagucgggcacagagguagcagacagaugugaagcaguggugaaggccauguagcaag

SEQ ID NO: 58851 - RNA, 64 nt, Human
ucagguucauggcccacuuugcuacagcaucagagugaagcacgccugucuagguucuccagug

SEQ ID NO: 58852 - RNA, 64 nt, Human
cugaggacaggagccugggagaggcggguggagcgugaagcaggcuggaggugccccugcacgg

SEQ ID NO: 58853 - RNA, 64 nt, Human
guucucugucgcugcuaaauuauucuucacuugagugaagcaaauauuuagcuuccaaauaaag

SEQ ID NO: 58854 - RNA, 64 nt, Human
cuaucaccuccagcacaaucccagugaaaaaggugugaagcacccaccauguucuugaacaauc

SEQ ID NO: 58855 - RNA, 64 nt, Human
accacauagaauguauacuagcagauacuauccagugaagcauaaauuagaauuuaauuugaug

SEQ ID NO: 58856 - RNA, 64 nt, Human
uuuuucuggccuucucugugggaccucugcuuuugugaagcaacuauuuauuugaagaccaggg

SEQ ID NO: 58857 - RNA, 64 nt, Human
cggcgucacuucucagacacugaagaacucugcugugaagcaaaacacucaaaccuuuaaggga

SEQ ID NO: 58858 - RNA, 64 nt, Human
cauuaacuguggauuuuacuaaauagaauuacuggugaagcagauuuauccaucgagacuaucu

SEQ ID NO: 58859 - RNA, 64 nt, Human
auggcuuuacauguuucuaaugugaauuaggcaugugaagcaguggguguccacccgugucccu

SEQ ID NO: 58860 - RNA, 64 nt, Human
auuuucucuaggauaagcuugugugguucugccagugaagcagagaaccaccugugcuguugug

SEQ ID NO: 58861 - RNA, 64 nt, Human
auuugucauuuacaguauugggguuuuuaugaaugugaagcaaacaaaaaaaauuuguauguaa

SEQ ID NO: 58862 - RNA, 64 nt, Human
gcaaacuaaauacacaaagcaugccuuaaacccagugaagcaacugaguacaaaggaaacagga

SEQ ID NO: 58863 - RNA, 64 nt, Human
auaaaucacuuaucggaaaugcacauuucauagugugaagcacucauuucuaaaccuuauuauc

SEQ ID NO: 58864 - RNA, 64 nt, Human
agggcugugacgugacuggggugggcccucaguggugaagcaccgcugcccucaggcuugaggg

SEQ ID NO: 58865 - RNA, 64 nt, Human
auuguaugacugucaggauuuuaagauuauacaagugaagcauuaaaagagaaauucucagaga

SEQ ID NO: 58866 - RNA, 64 nt, Human
gguaacuaugcaaagcauccaggcgguucugaaugugaagcacuacacccagcagagucccggu

SEQ ID NO: 58867 - RNA, 64 nt, Human
gaaugaguauugagacugaggagaaugauagagagugaagcagaaacaggagcacagaccucug

SEQ ID NO: 58868 - RNA, 64 nt, Human
uagaggcuucugggaaaugagcugucugcaggaggugaagcaguguuuuccuuggaauguuuga

SEQ ID NO: 58869 - RNA, 64 nt, Human
uuaauauaggaaguauauauucuuccuuaaguaagugaagcauagcaaaucuacuuuaaacugg

SEQ ID NO: 58870 - RNA, 64 nt, Human
acuuggucucaguuguaaagcaacugaauuuauagugaagcaaaucaucuuuaauaaucauuuc

SEQ ID NO: 58871 - RNA, 64 nt, Human
gcaauuuggagucugucaaugaauauagcaaucggugaagcauuacuguacgaagucuguuuuc

SEQ ID NO: 58872 - RNA, 64 nt, Human
ccuugcaccucaacaaaaggcucccuggauggcugugaagcaaaaccaggagcccuggcugaag

SEQ ID NO: 58873 - RNA, 64 nt, Human
uaaaaaguuuauggagacuuaaagucuugauguugugaagcagagguuauuuuguggaaagauu

SEQ ID NO: 58874 - RNA, 64 nt, Human
guuccacaaucaucuauugaguguacauuuaugugugaagcaaauuucuagauaugagaaauau

SEQ ID NO: 58875 - RNA, 64 nt, Human
gguguuugcauguggccauuaccgucauuggccugugaagcauuggacauuuauagauaauuga

SEQ ID NO: 58876 - RNA, 64 nt, Human
auggaggcugcagcgcccggugcucugugucaaggugaagcacauacggcagaccucuuagagu

SEQ ID NO: 58877 - RNA, 64 nt, Human
cuugcacauuaauaugauuauggaaggaaaggcagugaagcauaacuaauaaacaucauaauac

SEQ ID NO: 58878 - RNA, 64 nt, Human
gcuaaaguucaaaguucacaucaguguagccagagugaagcaucuuuguuagcaguuauguggu

SEQ ID NO: 58879 - RNA, 64 nt, Human
augaggagccccucucuuccuuaaguaggaaucugugaagcaaaauguuugcugccaaagacaa

SEQ ID NO: 58880 - RNA, 64 nt, Human
aaccuguucaccacuccugggugcaugauugagggugaagcauccaccagcacuucaagggguc

SEQ ID NO: 58881 - RNA, 64 nt, Human
uggagcagaaucaguauugggagccgguggcggugugaagcaccagugucuggcacacaguagg

SEQ ID NO: 58882 - RNA, 64 nt, Human
gacacucucgugguauguaugggagauggcagcagugaagcagcagccaccagggaguggccau

SEQ ID NO: 58883 - RNA, 64 nt, Human
gcuaagcauguucagguuuacuuuguugauguuugugaagcaaaacaaugggaaacugacauca

SEQ ID NO: 58884 - RNA, 64 nt, Human
uguugccugaaagagccauuaaagucagucgugcgugaagcaucucucuucuaaaggaugugua

SEQ ID NO: 58885 - RNA, 64 nt, Human
cuuuugggaaaguaagguggcuucccugcucucagugaagcauuuuauuaaaagaauaauuaua

SEQ ID NO: 58886 - RNA, 64 nt, Human
gggagccuugugagauccuucacaggcagugcaugugaagcaugcuuugcugcuaugaaaauga

SEQ ID NO: 58887 - RNA, 64 nt, Human
aagggugguggagccaguaaacagaggaguacaggugaagcaccaagcucaaagcguggacagg

SEQ ID NO: 58888 - RNA, 64 nt, Human
guucuggcuuagcaagagccaccaagaacuuugggugaagcaagcagaugacaaugaagaggag

SEQ ID NO: 58889 - RNA, 64 nt, Human
aacacuggguggcauccaagucuuggaaaaccgugugaagcaacuacuauaaacuugagucauc

SEQ ID NO: 58890 - RNA, 64 nt, Human
ugcaguuuuacuaaacagaugguucauaagacaugugaagcaaauucauauuugcaauggguaa

SEQ ID NO: 58891 - RNA, 64 nt, Human
aacucagaaugaaauuuucauuaauauuaaaauugugaagcaaaggucaauaggcuuauauuua

SEQ ID NO: 58892 - RNA, 64 nt, Human
agcuuaccucaguauuucagggcagcaaguguuugugaagcaaggaugagcagcaugaagaugu

SEQ ID NO: 58893 - RNA, 64 nt, Human
caugacccgguuuuaugccaaccuucagaaagcagugaagcaauuccaugaguaaugcuaucgu

SEQ ID NO: 58894 - RNA, 64 nt, Human
ugguuuuaguuggucccuauguuggaaguaaaaagugaagcacuuuauuuugguuguguuugcu

SEQ ID NO: 58895 - RNA, 64 nt, Human
ccaccaugaucugugaaauaaagcccuuagcggugugaagcauccgguccuuugaacagaaggg

SEQ ID NO: 58896 - RNA, 64 nt, Human
ccugccaacauucagucugguaugugaggcgugcgugaagcaagaacuccuggagcuacaggga

SEQ ID NO: 58897 - RNA, 64 nt, Human
auuuaaaccuuggaucuucaaaaaauaaaauaaugugaagcaaaaccaacuaaaaagugauucu

SEQ ID NO: 58898 - RNA, 64 nt, Human
gugacucaccauucaaggccccgagucuuggacugugaagcaucugccauggggaagugcuguu

SEQ ID NO: 58899 - RNA, 64 nt, Human
cauaguugcccuggguucagagcauaaugcauaugugaagcauggggugacauuccuacuguca

SEQ ID NO: 58900 - RNA, 64 nt, Human
ugccaaaagaacaaaccauuugaagcucacaauugugaagcauucacggcgucggaagaggccu

SEQ ID NO: 58901 - RNA, 64 nt, Human
gauacacugcauuugcuggugcuauuuuuauacagugaagcaacagcuuugcagcaaaauaaua

SEQ ID NO: 58902 - RNA, 64 nt, Human
cucccuggcacugaaccuuaggcuuuguaugacagugaagcagcacugugagugguucaagcac

SEQ ID NO: 58903 - RNA, 64 nt, Human
ugguaaaaacccacaggugcugcugcuuauaucugugaagcacuagcuuauucuaggaaugccu

SEQ ID NO: 58904 - RNA, 64 nt, Human
ucaagcugaggagacuaaguuagccaugugggcagugaagcaugccaaugugaucaaucccuag

SEQ ID NO: 58905 - RNA, 64 nt, Human
accaggacuuaugggugggaggggagcauuuuuagugaagcaagaaaggaguuugccaagaagu

SEQ ID NO: 58906 - RNA, 64 nt, Human
cguagggcaggaggcccuccuggccaggccagcagugaagcaguauggcuggcuggaucagcac

SEQ ID NO: 58907 - RNA, 64 nt, Human
ugacugccccaacccccuugggguggggcagaaggugaagcaucccaacugacuagagacucag

SEQ ID NO: 58908 - RNA, 64 nt, Human
cuaaagacaacaaacuaucagauucauucauucagugaagcagccucugauucucuaagaguca

SEQ ID NO: 58909 - RNA, 64 nt, Human
cgguugacccuacuguggauugguggguuucggggugaagcaaguucacuacagcaucaauaga

SEQ ID NO: 58910 - RNA, 64 nt, Human
acucuuuggcuuuguuuguuuguuuucuucuucagugaagcagccuuacuauucauagaagggc

SEQ ID NO: 58911 - RNA, 64 nt, Human
ucauucucuccaucgugaaaauaagugaauaagagugaagcaaaauuacaccuuuaugagaaac

SEQ ID NO: 58912 - RNA, 64 nt, Human
gagcuguagugucaccugacauuccccaaaccuugugaagcacguuggccuaagugugccguga

SEQ ID NO: 58913 - RNA, 64 nt, Human
uuugauuaacauuuggggccugauaggggaaauggugaagcaauggaaaagaacagacaacuaa

SEQ ID NO: 58914 - RNA, 64 nt, Human
cccucuaucacagaccuuucacaaauuagaagcagugaagcauaacuuuaaccuggaagaauac

SEQ ID NO: 58915 - RNA, 64 nt, Human
ggauguacaaugaaacugccuggaacuaaaagcagugaagcaagggaggcaaucacacugaagc

SEQ ID NO: 58916 - RNA, 64 nt, Human
agugcgggagauuguaaggaagcgguggcggcuggugaagcaagucucacaugucggcguucuu

SEQ ID NO: 58917 - RNA, 64 nt, Human
uaauacugaauguuuucuguuccgauagagaaaagugaagcaaauaugugaggaaugaagugau

SEQ ID NO: 58918 - RNA, 51 nt, Human
uagggaaauucaucuuguagagugaagcaugcagagugcuguuucuuuuuu

SEQ ID NO: 58919 - RNA, 64 nt, Human
gauuccaucauuucaguucucaccugcaguuuuggugaagcaggagaugcaccccacagcucua

SEQ ID NO: 58920 - RNA, 64 nt, Human
ggcgcuacuucuggcaaggcauaucaugaggcuagugaagcaccuacaagaaacuuauaacuca

SEQ ID NO: 58921 - RNA, 64 nt, Human
aauuacacuguacuacccaagaagacuguuuauugugaagcauuuaccuuucaaaaaaucauua

SEQ ID NO: 58922 - RNA, 64 nt, Human
gagagugguugaguaauuugcccagcugcuaacugugaagcaaaaauuugaaccuuuugacuug

SEQ ID NO: 58923 - RNA, 64 nt, Human
auuguuuccuuuuagugccagaacuaaggacauugugaagcacuuguuaguaaacuuaaccuug

SEQ ID NO: 58924 - RNA, 64 nt, Human
cagggcccagcggccaccccguaccacuguugaugugaagcaccucuucugagccaggccgagc

SEQ ID NO: 58925 - RNA, 64 nt, Human
ucauucgccugggaaagaacuugauucucaaauagugaagcaacacagcugagagguagugaga

SEQ ID NO: 58926 - RNA, 64 nt, Human
ucagagggcuuuucugaggauuaaauaaauaaaugugaagcacuuagaacugauggccagcaca

SEQ ID NO: 58927 - RNA, 64 nt, Human
cauagacuucauacuggagagaaaccuuacaaaugugaagcaugugacaaaguuuucagucaca

SEQ ID NO: 58928 - RNA, 64 nt, Human
caggaggagcucgggcgcaggccaggcccccuuggugaagcagaggcugaaggaaaggggucug

SEQ ID NO: 58929 - RNA, 64 nt, Human
cugauggagcugaaaaacacagcaugagaacuucgugaagcauacagaagaaaaaccuucagcc

SEQ ID NO: 58930 - RNA, 64 nt, Human
aucagagaguucauacuggaaugaggccuuauaagugaagcaaauuuuggaaauucucuugccc

SEQ ID NO: 58931 - RNA, 64 nt, Human
aacagaaacacaaaacuuugacuugacuugcgaagugaagcaggguuuucauuuuuacucuccu

SEQ ID NO: 58932 - RNA, 54 nt, Human
auacuggagagaaaccuuagaaaugugaagcaugugacaaaguuuccauuugga

SEQ ID NO: 58933 - RNA, 64 nt, Human
cagggucagagacagggcuugguucugcuuccuggugaagcauggcuucggggugcugccucuc

SEQ ID NO: 58934 - RNA, 64 nt, Human
uccuccauaucucccucuucccuaggagaggagugugaagcaaggagcuuagauaagacacccc

SEQ ID NO: 58935 - RNA, 64 nt, Human
gugcugggagccccuagaaguuccaaaagagaaugugaagcagaucaaggaaacuucuguugag

SEQ ID NO: 58936 - RNA, 64 nt, Human
acuuuuuuucuuguaugcuuaaauaaagcaauuagugaagcacuucuauccaaaaugacuuuuu

SEQ ID NO: 58937 - RNA, 64 nt, Human
ucuaggugcuggagaaucugguaaaagcaccauugugaagcagaugaggauccugcauguuaau

SEQ ID NO: 58938 - RNA, 64 nt, Human
uugggugaggaauaaccccuagucuggaaucuuugugaagcauaggguuauugcaaggcaaaug

SEQ ID NO: 58939 - RNA, 64 nt, Human
aagcuuaauagcccucccccucaaccucaccauugugaagcaccuacuaugugcugggugccuc

SEQ ID NO: 58940 - RNA, 64 nt, Human
cagucaaccucccaguguaaaaccaagauucccagugaagcaccugaggccaagcaggggagag

SEQ ID NO: 58941 - RNA, 64 nt, Human
accccucgggcucagagcccuaaagugggcccuggugaagcagggugguccugcguccacuucc

SEQ ID NO: 58942 - RNA, 64 nt, Human
uuuucuuggauuguugucuuuaaaaaggauuuuugugaagcaauugauuuaucaaagcaaaaaa

SEQ ID NO: 58943 - RNA, 64 nt, Human
ggcugauagugaagaaaugaaaaugucuucugaagugaagcauauuuguggcgaagaucaaauu

SEQ ID NO: 58944 - RNA, 64 nt, Human
caagugcauuaaagucuacaauggaaaaaaagcagugaagcauuagaugcugguaaaagcuaga

SEQ ID NO: 58945 - RNA, 64 nt, Human
uccguuuguugaucuguguuuuagaauaguccaagugaagcaaaacgaacugagagagcugauu

SEQ ID NO: 58946 - RNA, 64 nt, Human
uuuucuccuguguaucuuugaaguggcagauaaggugaagcaucagacugguaucaauauuaga

SEQ ID NO: 58947 - RNA, 64 nt, Human
ucugucacguucuggaacauucugucaucaccccgugaagcaaucauuuccccucccgucuucc

SEQ ID NO: 58948 - RNA, 64 nt, Human
uauguacaaaccacaaaucagguacuguauuuuagugaagcauugcuuuaauugcaacagaaua

SEQ ID NO: 58949 - RNA, 64 nt, Human
gucccguccccugcagggcucaguuugcacugcugugaagcaggaaggccagggagguccccgg

SEQ ID NO: 58950 - RNA, 64 nt, Human
ucuuacugggcccuggggaagguauccuacccuggugaagcagcugcuuugcucuacaaauacc

SEQ ID NO: 58951 - RNA, 64 nt, Human
uuuuucauuucaacuugugaacguuucuucugaugugaagcaaaccuucccuuuucagaaaagg

SEQ ID NO: 58952 - RNA, 64 nt, Human
uuaaauaagagagaaaugaugccguuuuuuaaaugugaagcagacuauaauucucagcucucuu

SEQ ID NO: 58953 - RNA, 64 nt, Human
aaucaaguaugugaauggauggaugaauggaauugugaagcacagaugagcucuuucacacucc

SEQ ID NO: 58954 - RNA, 64 nt, Human
ucagcacaccuugccccaccugggaccaucacacgugaagcaccaggcugggagaugaggugca

SEQ ID NO: 58955 - RNA, 64 nt, Human
caaaaagaagauggauguaauucucaugaaagcagugaagcaauuucaguuuuaaaaaugaaga

SEQ ID NO: 58956 - RNA, 64 nt, Human
uacugugucuuugguuugugcuaggcccccgggugugaagcacagaccccuuccagggguuuac

SEQ ID NO: 58957 - RNA, 64 nt, Human
cauuauagcuauucguccuguaaucuguuucuaggugaagcauacuccaguguuuuagggguuu

SEQ ID NO: 58958 - RNA, 64 nt, Human
ugugauaaaauguuaacaauccauuuaaucuucagugaagcaacucauuuggacaaacaguucu

SEQ ID NO: 58959 - RNA, 64 nt, Human
auaugugaaauauuauuaucucaacuuagcacacgugaagcaacauuucuuuccuacagagagg

SEQ ID NO: 58960 - RNA, 64 nt, Human
agguuccauggagaauauguggcaugaucuugacgugaagcauggguguuuccgugacuuagcu

SEQ ID NO: 58961 - RNA, 64 nt, Human
guaaaaggagauaauaaacaccuaccuugcaguagugaagcaaagagaaaauuaaauauauaug

SEQ ID NO: 58962 - RNA, 64 nt, Human
gaaagauuuuucaagaaucuuaaaaucucaagaagugaagcagauucauacagccuugaaaaaa

SEQ ID NO: 58963 - RNA, 64 nt, Human
guggcagugcagcaaccagagcacuguauaccccgugaagcauccaggcacccaaaccccgggg

SEQ ID NO: 58964 - RNA, 50 nt, Human
gcagccuggagaagcccuaggggggcgacccgcggagaccccagcagagg

SEQ ID NO: 58965 - RNA, 64 nt, Human
aacauccucuucacccugcccugccugcaguugagggggcgaagaagaacccuguguucucagg

SEQ ID NO: 58966 - RNA, 64 nt, Human
aaaauuuucuaaaauguauuuuagacuuccuguagggggcgauauacuaaauguauauaguaca

SEQ ID NO: 58967 - RNA, 64 nt, Human
uauauaguacauuuauacuaaauguauuccuguagggggcgauauacuaaauguauuuuagacu

SEQ ID NO: 58968 - RNA, 64 nt, Human
ggcgauauacuaaauguauuuuagacuuccuguagggggcgauaaaauaaaaugcuaaacaacu

SEQ ID NO: 58969 - RNA, 64 nt, Human
gggcgaggcgggggauccuggagccccugugucggggggcgagggaggggagguggccgucgag

SEQ ID NO: 58970 - RNA, 64 nt, Human
gaaggaacauugcagagcuaagcagucgugguaugggggcgacuggggaguccucauugaaucc

SEQ ID NO: 58971 - RNA, 64 nt, Human
gggcuucucuugggugggacagggcuucuccugcgggggcgaggccccucccaguaagggcgug

SEQ ID NO: 58972 - RNA, 64 nt, Human
cucuguagucuucuuuccuguaggugggguuagggggggcgaucagggacaggcagccuucugc

SEQ ID NO: 58973 - RNA, 64 nt, Human
ccccauuuucaccccacccccgccucugauccccgggggcgagauuggcgcgggaguguggccg

SEQ ID NO: 58974 - RNA, 64 nt, Human
gccucugaggaaccuccuuccaggccugggaugagggggcgaugucugcuggcccaggggaagg

SEQ ID NO: 58975 - RNA, 64 nt, Human
gacagugcuguuuuauuugaacaacgucacuggugggggcgagacuguuuucccuguagcagau

SEQ ID NO: 58976 - RNA, 64 nt, Human
accaauggauugauucucuuaauugccacggcaagggggcgauccuaucaugacuuaacaucaa

SEQ ID NO: 58977 - RNA, 64 nt, Human
cccgggcaaccguucugauuccuggcauggaguugggggcgagcucaucaguacccagagcgcc

SEQ ID NO: 58978 - RNA, 64 nt, Human
gggugcguggacaccucugcugugguuugcugcugggggcgaugggagcgccucuccguccugu

SEQ ID NO: 58979 - RNA, 64 nt, Human
cuugaacaucugugcccgauuuuaguaugugcaggggggcgaucugggaaucaguccccugugg

SEQ ID NO: 58980 - RNA, 64 nt, Human
acacuggagacuuggaagaguuggaggguuggcagggggcgaugauaauuuacuuaauggguac

SEQ ID NO: 58981 - RNA, 64 nt, Human
guauaccuccuauauguccauuuaaguuaggagagggggcgauauagagaauaaggcacaaaau

SEQ ID NO: 58982 - RNA, 64 nt, Human
cugcacgggggaacugugugugcaaaggugagcugggggcgagaaaggccucuguggccgucau

SEQ ID NO: 58983 - RNA, 64 nt, Human
ucauugcuguagagcucucccugccucucucucugggggcgauggggaaggucaggaguccagc

SEQ ID NO: 58984 - RNA, 64 nt, Human
cgccagggccuaucccaaaagcaggggccagggagggggcgacuugccugccccugaagcccuu

SEQ ID NO: 58985 - RNA, 64 nt, Human
uggccacccccaggaagggcugauuucaaaaucugggggcgagcaaccucaaggaacacaauuu

SEQ ID NO: 58986 - RNA, 64 nt, Human
ggccaaaaagcugaugggcgaggaggcccuggcggggggcgacaagucagacccgaaccuuaau

SEQ ID NO: 58987 - RNA, 59 nt, Human
cagagaauuacagacucuagcugcugccugggggcgagcagccuaccagaugucgauuu

SEQ ID NO: 58988 - RNA, 64 nt, Human
guaucagcuauuuguagauaaauaaauugcaggugggggcgaauaguaggguauuauaaaggag

SEQ ID NO: 58989 - RNA, 64 nt, Human
gacauggaaacugucacguuagcuacugaauccugggggcgagugaaacuacugaaaauccgag

SEQ ID NO: 58990 - RNA, 64 nt, Human
cuuuaaaacuaccuuuuugcuguugggaggagucgggggcgagccuuagcagcugcaccgccau

SEQ ID NO: 58991 - RNA, 64 nt, Human
aucuaaucugccgugggccugucgugccaguccugggggcgagaucgggguagaaaugcauuuu

SEQ ID NO: 58992 - RNA, 64 nt, Human
ucagcgugggccgcuagggacuccuggggagcuggggggcgagggagagaugagcggaaggugg

SEQ ID NO: 58993 - RNA, 64 nt, Human
aacgagcgggcgccgggccacucggggcugagcugggggcgagcgggggcaggcggcugauguu

SEQ ID NO: 58994 - RNA, 64 nt, Human
gggagccccucucauggggaggaaagagcuuccagggggcgaacgcagcacagaggaagaggcc

SEQ ID NO: 58995 - RNA, 64 nt, Human
gggguccuacagcuacguggccgugggcaguacugggggcgaccuggaccugcuggcucagccc

SEQ ID NO: 58996 - RNA, 64 nt, Human
ugagcgggacgcuggagggaugggaccgugucuggggggcgacguggcgggucggccgguuccc

SEQ ID NO: 58997 - RNA, 64 nt, Human
cggaggggagggggcgcccaggagggguggggaggggggcgaggagagccaagugcagcgaagg

SEQ ID NO: 58998 - RNA, 64 nt, Human
ugcaauaagcccggggguugacccugggcgugccgggggcgagggggucacgguggagacggac

SEQ ID NO: 58999 - RNA, 64 nt, Human
gggauuaagcggcggaagcuucuuagaagaggcagggggcgaagugcaguggcucaugccugua

SEQ ID NO: 59000 - RNA, 64 nt, Human
cuggaaccucaggccuagacuagguugccuuugugggggcgaugaagcagaguccccuggucaa

SEQ ID NO: 59001 - RNA, 64 nt, Human
cuccggaaaucaugcaagacugcucccugcaaaggggggcgacaauguucauuacucacaaauu

SEQ ID NO: 59002 - RNA, 64 nt, Human
ugaguuuaagaagcaguucuuccuccagaaagaagggggcgauagcaugcagguacgugucuga

SEQ ID NO: 59003 - RNA, 64 nt, Human
ccaucauaccccaagccaggcacuagauuuuggagggggcgacuaccccagugccccccccgcu

SEQ ID NO: 59004 - RNA, 64 nt, Human
cuacuaggaggagccagggacuggggcggggggcgggggcgagggagggcgaacugucgaaugu

SEQ ID NO: 59005 - RNA, 64 nt, Human
cccauucugggcgggcccaguggaguuuggggaggggggcgaaagcaacgggacugcugggaga

SEQ ID NO: 59006 - RNA, 64 nt, Human
gauuguggaagagaaaccuuauauuuaccagggugggggcgacuggccuuuuucccaugugugc

SEQ ID NO: 59007 - RNA, 64 nt, Human
ucugggaauggaccacacuacagcagguaguucugggggcgauacugccgaaaggcccgaacac

SEQ ID NO: 59008 - RNA, 64 nt, Human
aguguguuguggaagagaccuguaaguauggggggggggcgauauuuuaucagaccauuuugua

SEQ ID NO: 59009 - RNA, 64 nt, Human
gcagcccagcaccgagauacccaggacgggccuggggggcgagaaaggcccccaugcucauggg

SEQ ID NO: 59010 - RNA, 64 nt, Human
ggagccagaggcagcagccucagccccagggacugggggcgauucuguguggggaaacccaccg

SEQ ID NO: 59011 - RNA, 64 nt, Human
gucaucuguguuuagcucggggagugcccccuaagggggcgaacugaccucaggcauguuuugu

SEQ ID NO: 59012 - RNA, 64 nt, Human
gggcagaaagaguggcaucucuggcuaccgggcugggggcgaccuuuaccauaggaugaaguaa

SEQ ID NO: 59013 - RNA, 64 nt, Human
acugucagagaugagcccacccccacccuucccugggggcgauuagcugcugagucacccaccc

SEQ ID NO: 59014 - RNA, 64 nt, Human
ccagggcuggcgauaaaggaccgagauagauggagggggcgaguagggaaguccucuucuaaaa

SEQ ID NO: 59015 - RNA, 64 nt, Human
gggagggggugcugagcugugaauccccugggcagggggcgacaacuccguguagcauuaaccc

SEQ ID NO: 59016 - RNA, 64 nt, Human
caccuccccguaggagcagagagcacccuggugugggggcgaguggguuccccacaaccccgcu

SEQ ID NO: 59017 - RNA, 64 nt, Human
uaauauauuuguguauuuaacagggaggggaagagggggcgaucgcggcggagcuggccccgcc

SEQ ID NO: 59018 - RNA, 64 nt, Human
ggagguuuuccucucagccccacccugggggcccgggggcgagggcugcccccuccuccccucc

SEQ ID NO: 59019 - RNA, 64 nt, Human
aucaaccgugcgcggccggagggggcaggggggcgggggcgaggggcguuccaaucaaauuucu

SEQ ID NO: 59020 - RNA, 64 nt, Human
uucucaggccugggguggggccccgggugggugcgggggcgauucaaccugugugcugcgaagg

SEQ ID NO: 59021 - RNA, 64 nt, Human
ccaggacucgacaagcuggacccccugcucccgggggggcgagcgcaugacccccccgcccucg

SEQ ID NO: 59022 - RNA, 64 nt, Human
gaaguugcccacacugggggccagagcuaggguggggggcgagggugcugaggagcagccccca

SEQ ID NO: 59023 - RNA, 64 nt, Human
cugcaaccccucuccccagcuuggcgcagucgaggggggcgaugcucucugcccaucccagcug

SEQ ID NO: 59024 - RNA, 64 nt, Human
agccagaucuuauuuauuuauuuauuucaguacugggggcgaaacagccaggugauccccccgc

SEQ ID NO: 59025 - RNA, 64 nt, Human
uggccuggguguggagugaaagagucacuguggugggggcgagaggaggacuugggagcuggag

SEQ ID NO: 59026 - RNA, 64 nt, Human
uccucccucgcccggcccgccuucucuggguuaggggggcgaugcggccggguggcaacgcacg

SEQ ID NO: 59027 - RNA, 64 nt, Human
ggagccgcacucuucgcccgcuccgggcaaaagcgggggcgaguguagagcgauccugggaaau

SEQ ID NO: 59028 - RNA, 64 nt, Human
aaaagcacauccaggcaauggccuaaacuucagagggggcgaagggaucagcccugcccuucag

SEQ ID NO: 59029 - RNA, 64 nt, Human
cggagccugggagcggggcggggccgccgcgcaagggggcgacgcauaaaggccugcuggcuug

SEQ ID NO: 59030 - RNA, 64 nt, Human
gggccggcgccuaccugagggccccugugucccgaacccggagcggaggcgcccaacccggcag

SEQ ID NO: 59031 - RNA, 64 nt, Human
gcuacucgggaggcugaugcagaagaauggcgugaacccggaaggcagagcuugcagugagccg

SEQ ID NO: 59032 - RNA, 64 nt, Human
cuggugggcagggcagaaacaggccacagugcucaacccggacacccucacgaagggucgcaag

SEQ ID NO: 59033 - RNA, 64 nt, Human
caggggcccuguggggacugcuggggccgucaccaacccggacuuguacagagcaaccgcaggg

SEQ ID NO: 59034 - RNA, 64 nt, Human
gcucuucugucugcagugugcacggccuuguucuaacccggaauaaaggugauugauuguauug

SEQ ID NO: 59035 - RNA, 64 nt, Human
aauaccaguuuuuauuccaaaaauuuagagaacaaacccggaauaugaagugcagauuguaaca

SEQ ID NO: 59036 - RNA, 64 nt, Human
caggggcuguuuagaaauauauggccaaaucuguaacccggaaacagcaaaaaacuucuuagca

SEQ ID NO: 59037 - RNA, 64 nt, Human
aaggcacugcaaucccuuccccauaucccugcccaacccggacugcugcccguccucucccugc

SEQ ID NO: 59038 - RNA, 57 nt, Human
ccccccuuuuggcuacguaaggcccuuaacccggacucugcgccccgucccaugccc

SEQ ID NO: 59039 - RNA, 64 nt, Human
agacuuaacagaaucaugaaaacuauagcuuuuuaacccggauuacuguaaauguuugacaaaa

SEQ ID NO: 59040 - RNA, 64 nt, Human
aagauggcacacguggaaaguugaucugcaccagaacccggaugacugucaccuugaagcaucc

SEQ ID NO: 59041 - RNA, 64 nt, Human
gcuacucgggaggcugaggcaggagaauggcaugaacccggaaggcagagcuugcagugagccg

SEQ ID NO: 59042 - RNA, 64 nt, Human
aagguuucagagcaacacacaugagaaagagaguaacccggaauuguacuugucaagcaaaauc

SEQ ID NO: 59043 - RNA, 64 nt, Human
agcuacucaggaggcugaggcggagaauugcuugaacccggaagguggagguugcggugagcug

SEQ ID NO: 59044 - RNA, 64 nt, Human
aacauuguucucccuucaagcgcuguaaagcaccaacccggaaguggcaggcacagaaggaagg

SEQ ID NO: 59045 - RNA, 64 nt, Human
uggacucggggccaugggcuuggcccggacccggaacccggacuuguacucggggccgugggcu

SEQ ID NO: 59046 - RNA, 64 nt, Human
cuacccaggaaggcugaggcggcagaaucacuugaacccggaggcggagguugcgguaagccga

SEQ ID NO: 59047 - RNA, 64 nt, Human
uaggaagaucguuccaccuucuacgcaauugacaaacccggaagaucagaugcaauugcuccca

SEQ ID NO: 59048 - RNA, 64 nt, Human
acucuccugacucuccaucgcucuguccaaggagaacccggagaggcucugggcugauucagag

SEQ ID NO: 59049 - RNA, 64 nt, Human
cacccccgcacaggcccgccuggcuucgaguuggaacccggacacuugccccucacuggugugg

SEQ ID NO: 59050 - RNA, 64 nt, Human
aagcccaugggcagggcuggggggacgaagggggaacccggagcaccuccacuucuagggaaga

SEQ ID NO: 59051 - RNA, 64 nt, Human
aggacugaagaagucgcacucgaguccuucgcugaacccggauacuucuccaaucacugccaaa

SEQ ID NO: 59052 - RNA, 64 nt, Human
cgucaccaaccauggcuaccgcgugcagguggagaacccggaacgcuucuccucggcgcccugc

SEQ ID NO: 59053 - RNA, 64 nt, Human
gccaguugugucuaaaagacucuuggaaucugagaacccggagucgcagcgcccucgggccugg

SEQ ID NO: 59054 - RNA, 64 nt, Human
uagguuuuugaugugaucagacugggccaugucaaacccggaauuuucaccaacaguucacuca

SEQ ID NO: 59055 - RNA, 64 nt, Human
ccccugguacccagaagaggaguucuugcucacuaacccggauccgccucgugccccugccucc

SEQ ID NO: 59056 - RNA, 64 nt, Human
gagggacuugcuggggguuggauuggggguaauaaacccggacggaagcggagcccacggccug

SEQ ID NO: 59057 - RNA, 64 nt, Human
gcuggggaggagaggacugggccugauggaaguuaacccggagcuaagucacccagagcacagg

SEQ ID NO: 59058 - RNA, 64 nt, Human
gcuacucaggaggcugaggcaggagaauggcgugaacccggaaggcggagcuugcaguuagccg

SEQ ID NO: 59059 - RNA, 64 nt, Human
ugggucuugcugcccauccuuccucagcacagggaacccggaagcccguugcacugacagaggc

SEQ ID NO: 59060 - RNA, 64 nt, Human
acacauuccacaaagugcuggcacuuacacccacaacccggaaggcuguggaccgauuccucua

SEQ ID NO: 59061 - RNA, 64 nt, Human
ucucucacggguuuuuaauggucuuguccucacuaacccggagcggugaguuugauuuaucuua

SEQ ID NO: 59062 - RNA, 64 nt, Human
ggccagccccagaaggagccucggccgagcgugcaacccggagccgccuugggcccucccugcg

SEQ ID NO: 59063 - RNA, 64 nt, Human
ucccccaggaucuaauuucagaauuuaccacccaaacccggaacagauggguuuagggcuggug

SEQ ID NO: 59064 - RNA, 64 nt, Human
acacagagcacagcugugcuggaaguguggggagaacccggacagcucaguccugccagcagcc

SEQ ID NO: 59065 - RNA, 64 nt, Human
ucccccucuaauuuagccgcucgacauuuuacacaacccggauauguuguauauuuugacccaa

SEQ ID NO: 59066 - RNA, 64 nt, Human
ccaccucauuuacauguucacucccgacccuggaaacccggauuucgccuccggacagcggcgu

SEQ ID NO: 59067 - RNA, 64 nt, Human
aguggcgugaagugagacguucucuuugguggucaacccggaugggugacaggcuggauggccu

SEQ ID NO: 59068 - RNA, 64 nt, Human
guugaaugacaggccuggagcuguagaaucaggaaacccggaugccuaacagcucaaagauguu

SEQ ID NO: 59069 - RNA, 64 nt, Human
gcuuguuuggagaagggaggcuggcugggggagaaacccggaucccgcugcaucuccgcgccug

SEQ ID NO: 59070 - RNA, 64 nt, Human
ccuggaguagucuuuuaacgaacuuucuucugguaacccggaauauuuuuuaaucauagagcuu

SEQ ID NO: 59071 - RNA, 64 nt, Human
ccacgucauuugcauacgcacucccgaccccagaaacccggauucugccucccgacggcggcgu

SEQ ID NO: 59072 - RNA, 64 nt, Human
ccuggcucccucccacccaaccaacuuuccccccaacccggaaacagacaagcaacccaaacug

SEQ ID NO: 59073 - RNA, 64 nt, Human
cccaaggccacugcgcucuugggaccccagagaaaacccggagcaagcaggagugugcggucaa

SEQ ID NO: 59074 - RNA, 64 nt, Human
ccggcaggaagccccgcccagacgguguucagggaacccggagcccaagcgcuccggcggagcc

SEQ ID NO: 59075 - RNA, 64 nt, Human
aacaccuggccugcuaggaggcuccaauaaagcuaacccggaccagaccugugugccacgugug

SEQ ID NO: 59076 - RNA, 64 nt, Human
ugucugcucuggacuuaucaccccaggagaacugaacccggaccugcucacugcccuggcugga

SEQ ID NO: 59077 - RNA, 64 nt, Human
uguggagagaaggcaaccccagauccccugagcuaacccggaggaaaggcaguccuggacagaa

SEQ ID NO: 59078 - RNA, 64 nt, Human
caccuucccaugcuuccuugcauuaggcuuucuaaacccggagccccuucaaacuuccaauaaa

SEQ ID NO: 59079 - RNA, 64 nt, Human
gcagaucccgggcuacaucgacggugugaacuucaacccggagcacugcagccccaauggcacc

SEQ ID NO: 59080 - RNA, 64 nt, Human
gcaccgugcagcccgccauggccguguagacccuaacccggagggaacccugacuacagaaauu

SEQ ID NO: 59081 - RNA, 64 nt, Human
aucuguccucuugaugugagagagacucugagacuucuuccaucgcaaugaccuguauuaaaca

SEQ ID NO: 59082 - RNA, 64 nt, Human
uuuacaacuucugggagcuacucugugggcugaauucuuccaaaaccgagaaaagccagugcag

SEQ ID NO: 59083 - RNA, 64 nt, Human
ggggcuugggaguugcagugaaugucauuaaaauuucuuccaaaacaaaacuagaaauaauugc

SEQ ID NO: 59084 - RNA, 64 nt, Human
aggaacugugggugacuuuauccucacaucguguuucuuccagaaauucagacgcaacagaggu

SEQ ID NO: 59085 - RNA, 64 nt, Human
gaaaugucauggcucuguucauauuuuugucuuguucuuccaauugguauauacaacuuucaga

SEQ ID NO: 59086 - RNA, 64 nt, Human
cuguaacacaacaggacugagcagaaccaaacacuucuuccaacugacucugcucccugcccuc

SEQ ID NO: 59087 - RNA, 64 nt, Human
auaagucaagcaaacgagaaguacgaacaucugauucuuccagccauguuucccagucugaaga

SEQ ID NO: 59088 - RNA, 64 nt, Human
cauauauagacagcuuugacuggaggguccauuuuucuuccaggaugguguuacugcaguugaa

SEQ ID NO: 59089 - RNA, 64 nt, Human
auaauuauuccuucuuacucuccucuucuagcauuucuuccaauuauuacaguccuucaagauu

SEQ ID NO: 59090 - RNA, 64 nt, Human
ucugggugcucuagccccccagcuuucugguagcuucuuccagccuauacuggcaccaugugag

SEQ ID NO: 59091 - RNA, 64 nt, Human
ucuuguuuuucucacacaggcauacuccaaaugcuucuuccaguucauuuuucagccaucaguu

SEQ ID NO: 59092 - RNA, 64 nt, Human
cagguacuaucauugaaaaccuugacaaugggucuucuuccauuacaccuucuuuauauuuuaa

SEQ ID NO: 59093 - RNA, 64 nt, Human
cugaagcaauacccguuagacaaggauauuuuacuucuuccagacaccagaagaaauggccuuc

SEQ ID NO: 59094 - RNA, 64 nt, Human
aaggaucgucuuuuaugccucuggcuaaggcagguucuuccaugacuccuaagagaguuguaaa

SEQ ID NO: 59095 - RNA, 64 nt, Human
acaguuuggaaaggaugaggguuaucuuccucgauucuuccacccucucacuuuccugccuguu

SEQ ID NO: 59096 - RNA, 64 nt, Human
guuagagacugauuaucucaugugagccaggacauucuuccagcaagguuggccucuggauggu

SEQ ID NO: 59097 - RNA, 64 nt, Human
ccuccuauacccaccuguaaggugaaaucugcucuucuuccaaauauauaaaaaaggaauugcc

SEQ ID NO: 59098 - RNA, 64 nt, Human
aauagaugcggucauauucuucuuuggcuucugguucuuccagcccucaugguuggcaucacau

SEQ ID NO: 59099 - RNA, 64 nt, Human
gacagggagaugcugcaguuccaaaagagaagguuucuuccagagucaucuaccugaguccuga

SEQ ID NO: 59100 - RNA, 64 nt, Human
uaacggcucugcugccaggguuucucugggcucauucuuccacugacuuaauuaugaucuaugc

SEQ ID NO: 59101 - RNA, 64 nt, Human
gucugaagcuuugaagcgcuacuuagcaucuccuuucuuccauggagcucucacgauucaaaca

SEQ ID NO: 59102 - RNA, 64 nt, Human
auagcuguccauaagccauccagaucaacacccuuucuuccauacagaaaagggcuaaccauac

SEQ ID NO: 59103 - RNA, 64 nt, Human
augaaggcuagaggaagacuuccuggaacugccuuucuuccacuaacaggacccugggaccugu

SEQ ID NO: 59104 - RNA, 64 nt, Human
cuggaguuuauuucauuucuuuuugaagaccauuuucuuccauuauuguaguugagcagcacca

SEQ ID NO: 59105 - RNA, 64 nt, Human
aauuaacugacaaauaguuucuuuuuaaaguaguuucuuccaucuuuauucugacuagcuucca

SEQ ID NO: 59106 - RNA, 64 nt, Human
auuauuacucucaguaguaaaauaucacacugaauucuuccauacacaggugugcuucuaguca

SEQ ID NO: 59107 - RNA, 64 nt, Human
auagauuaucugaaucauuugucuaagagguacauucuuccagauggaaucaauaacuuuuuuu

SEQ ID NO: 59108 - RNA, 64 nt, Human
acaauucucauaggauuauucuuuucaugguauuuucuuccauaauaucucauuuuaaaaagaa

SEQ ID NO: 59109 - RNA, 64 nt, Human
aguccuggaugccuccuccuacuggugccuucuuuucuuccagaggauuucucucuccuuccuc

SEQ ID NO: 59110 - RNA, 64 nt, Human
cacucuacauuuucucugcacuuucaaugcccuguucuuccaaaccccuaucccaaguuuuaug

SEQ ID NO: 59111 - RNA, 64 nt, Human
gaacccaaaagaaaaacucuugaaaacaagagauuucuuccaugcacauuuacaauauugaggu

SEQ ID NO: 59112 - RNA, 64 nt, Human
caacauuauagaaauuuugccuuguugccuuaucuucuuccaaauguacuguuaaauaaaaaua

SEQ ID NO: 59113 - RNA, 64 nt, Human
agaaugucuuggcugcccaagacucuuguugccuuucuuccaagccauggccaugcccuuuuuc

SEQ ID NO: 59114 - RNA, 64 nt, Human
agcccagaagugccaccucaucauaauucaaguguucuuccacacagcguugcccccacaacca

SEQ ID NO: 59115 - RNA, 64 nt, Human
uuuucuccccauaucccaaggcgaagcgcugagauucuuccaucuaaaaaacccucgacccgaa

SEQ ID NO: 59116 - RNA, 64 nt, Human
gucuguaaauaaauaauuuuagaacagccuuuuuuucuuccauaaacuacuauugugaucuauu

SEQ ID NO: 59117 - RNA, 64 nt, Human
guggcaccuugauuggaaaauaauauccaugcguuucuuccacugagucuuucuuagauuaaau

SEQ ID NO: 59118 - RNA, 64 nt, Human
gguggccaccaguccuugccaauccccagagcuguucuuccaaagcccccaggcuggcuuagaa

SEQ ID NO: 59119 - RNA, 64 nt, Human
gaacauuagcuagccagcccagcaucuuccccccuucuuccaccacugagucaucugcugucuc

SEQ ID NO: 59120 - RNA, 64 nt, Human
cagccucagccggggccaccagcacugcugccacuucuuccagccccagccaaaggcguggcug

SEQ ID NO: 59121 - RNA, 64 nt, Human
cacagaaaauggaagacagcucuuauauugccauuucuuccacaagagcccaggccuccuacag

SEQ ID NO: 59122 - RNA, 64 nt, Human
aauggcagacaucaguaaucaaucuggaauguuuuucuuccaaaucugaguggaauuuucaaau

SEQ ID NO: 59123 - RNA, 64 nt, Human
aaaugacuuucucuaugaggcuggaaccuccuccuucuuccagugaagcacgaggucuugguuc

SEQ ID NO: 59124 - RNA, 64 nt, Human
cuugauuucuccaaccacucaucccucuuuuucuuucuuccaccacuccccaccccagcuguag

SEQ ID NO: 59125 - RNA, 64 nt, Human
aauacauuuuaagccuuuuguuuuuaaauuucuuuucuuccagagauuguuuaaaaauaaauau

SEQ ID NO: 59126 - RNA, 64 nt, Human
uguuuaccaauguuuuaagaagcuuugugugauauucuuccaaauguaguuaccaaauauaaua

SEQ ID NO: 59127 - RNA, 64 nt, Human
gagggaucaugaguugccaccacucagaaguuuauucuuccagacgaccaguggauacugagga

SEQ ID NO: 59128 - RNA, 64 nt, Human
aucucauaagcugguaccacucaggagaaguuuauucuuccagaugaccagcaguagacaaaug

SEQ ID NO: 59129 - RNA, 64 nt, Human
cucuuguuacucccuguuauuuuucugcccuggguucuuccacagcacaaacacaccucugcca

SEQ ID NO: 59130 - RNA, 64 nt, Human
cuuaaagaaguuugguuauauuucagugaaaauuuucuuccagaguagguuuuuuuucgugggu

SEQ ID NO: 59131 - RNA, 64 nt, Human
cccaggcuggucuugaauuccugggcucaagcaauucuuccaccucagccucccaaagugcuga

SEQ ID NO: 59132 - RNA, 64 nt, Human
acuccagccagccaaauccauccugcucuuccauuucuuccacgauggugcaguguaacgaugc

SEQ ID NO: 59133 - RNA, 64 nt, Human
cuguacccuucucagaucaacucccuggugauguuucuuccacauacaucugugaaaugaacaa

SEQ ID NO: 59134 - RNA, 64 nt, Human
aagaaaguguuggcuaaugaagggaaaggauauuuucuuccaagcaaaggugaagagaccaaga

SEQ ID NO: 59135 - RNA, 64 nt, Human
gggagaaaccucuaguuuugccaauagaaaaugcuucuuccauugaauaaaaguuauuucaaau

SEQ ID NO: 59136 - RNA, 64 nt, Human
auccggacagagcacguuugcagaagggggucucuucuuccagguagcugaaaggggaagaccu

SEQ ID NO: 59137 - RNA, 64 nt, Human
cucacuaccaaaugagugaaagcuugauuaagaguucuuccauauacuagccuccuuggaagaa

SEQ ID NO: 59138 - RNA, 64 nt, Human
uuuuaaacuaccuaucucaugcaaugaaagcauuuucuuccacaaagagcuuaauccucaugau

SEQ ID NO: 59139 - RNA, 64 nt, Human
agccgucgaacagacugugggauuugcagaguguuucuuccaugucuuugaccacaggguuguu

SEQ ID NO: 59140 - RNA, 64 nt, Human
ggucaaccgaugagcccacucacucguacaugccuucuuccacagugggaagcaugaucuggca

SEQ ID NO: 59141 - RNA, 64 nt, Human
auccacaaagagaagagggcuuggaugucaaaaauucuuccauugugggguagguggucgggga

SEQ ID NO: 59142 - RNA, 64 nt, Human
aauaaacuuuuaaaaagcaggcacuaauauauauuucuuccagccuuugauuacaaauuugucc

SEQ ID NO: 59143 - RNA, 64 nt, Human
gaaucuauuucugaugaauaugaaaggaagauuguucuuccauguugguuuuuauugagauauc

SEQ ID NO: 59144 - RNA, 64 nt, Human
acacauuuugacauugccacaguuuacagugucauucuuccacgaauagguaauugauagaguu

SEQ ID NO: 59145 - RNA, 64 nt, Human
cggggaaaguaaagccucaggaaugcccacgccuuucuuccaaagccuuugucucugagaccuc

SEQ ID NO: 59146 - RNA, 64 nt, Human
ccaggggacagucacaacuucuuggggccugggcuucuuccaggccuaugcuccuggaauggau

SEQ ID NO: 59147 - RNA, 64 nt, Human
gucugccugugugacacacaucaauggcaauaacuucuuccaacuccucgcagaagugggagag

SEQ ID NO: 59148 - RNA, 64 nt, Human
cccauuuacccaaaauaacuaguuaugggucuauuucuuccaugauuagaggagagagaacuug

SEQ ID NO: 59149 - RNA, 64 nt, Human
gauauauacaguuacacuuuuugcugcuuuuauuuucuuccaagccaaucaaucagccaguucc

SEQ ID NO: 59150 - RNA, 64 nt, Human
gcuagauuuguuuugagucaaaacugauuuaguguucuuccaaacaacauuuauguguuggccu

SEQ ID NO: 59151 - RNA, 64 nt, Human
cugaacaauuucagucauuugaagccuccgucccuucuuccauucucagccagaagcauaaaca

SEQ ID NO: 59152 - RNA, 64 nt, Human
acauaaaaaauguauggcaucuuuuccuugcaaauucuuccaguuuccaagugagaaggggagc

SEQ ID NO: 59153 - RNA, 64 nt, Human
cgcaccaccagucacaaccuaugcagcgccccacuucuuccaccucaacaccaagcuguaggcc

SEQ ID NO: 59154 - RNA, 64 nt, Human
auccaguggggaaaaaaagguuaacaguaaaaauuucuuccacguaauucaauuucucacaaua

SEQ ID NO: 59155 - RNA, 64 nt, Human
uuuugacauaaugaguaaugcagacauuuacauguucuuccagcuucaaucaguagaccugauu

SEQ ID NO: 59156 - RNA, 64 nt, Human
ggugguggggcacggagggcagucccgggugggcuucuuccagcccccgcgggaacggggguac

SEQ ID NO: 59157 - RNA, 64 nt, Human
guacugauugagaaguucauugucucguuugugauucuuccagaugugaugcuugauauuuucu

SEQ ID NO: 59158 - RNA, 64 nt, Human
guuauuucagaugauucaaauaucaaaaggaagauucuuccauuaaauugccuuuguaauauga

SEQ ID NO: 59159 - RNA, 64 nt, Human
gaggaaucuauagaaguccaaauuauagguuguauucuuccaucuucauugucuuaccucugaa

SEQ ID NO: 59160 - RNA, 64 nt, Human
guuguauaauuucgagauuuguaggaaggucucauucuuccaagcugagagucuagcacucauu

SEQ ID NO: 59161 - RNA, 64 nt, Human
augcuggugaaaagaaagggcgagaucaccaagguucuuccagggcuguauuucugcaguuucg

SEQ ID NO: 59162 - RNA, 64 nt, Human
uuucuuguaagcucucuuccuaacagggcacauauucuuccauaauauaaacacuuuucugccc

SEQ ID NO: 59163 - RNA, 64 nt, Human
ucaccccuguccucacugcucccugaagccagccuucuuccaucccaggacaccacacccagcc

SEQ ID NO: 59164 - RNA, 64 nt, Human
gagggaacuguguagacaagguaccaggucagucuucuuccaugucuauuagcuccacaaagcc

SEQ ID NO: 59165 - RNA, 64 nt, Human
uuuuuaucacuuuuaaauuugcacuuuauuuuuuuucuuccaugcuuguucucuggacauuugg

SEQ ID NO: 59166 - RNA, 64 nt, Human
agccuugggacagagcaggcccacaaugccccccuucuuccagccaagaagagcucacaggagu

SEQ ID NO: 59167 - RNA, 64 nt, Human
ucuaugaaagcagucauuauucaaggugaucguauucuuccagugaaaacaagacugaaauaug

SEQ ID NO: 59168 - RNA, 64 nt, Human
aauuguaugaagaucuucugcagaaucagcaugauucuuccaaggaaauacauaugcagauacu

SEQ ID NO: 59169 - RNA, 64 nt, Human
gcaucuaccuuaccuccuaagaagaaaagccacuuucuuccaauccaagcccacugcagccuug

SEQ ID NO: 59170 - RNA, 64 nt, Human
cagccagaacgauaugucuguccaucuuucuccuuucuuccagcacacacagcuaagagauaag

SEQ ID NO: 59171 - RNA, 64 nt, Human
cucuguauacuuuauauuaaaaaaugcuuugcauuucuuccagugcaaugaaauucauauggug

SEQ ID NO: 59172 - RNA, 64 nt, Human
acuguuuauggccuucuuguuucaguuuuuucuuuucuuccaaugguacuuuagcuguugagug

SEQ ID NO: 59173 - RNA, 64 nt, Human
uggcaaaugaucagacuaaugugugcuaauguuuuucuuccaugcuuucagucagauucaacua

SEQ ID NO: 59174 - RNA, 64 nt, Human
cacuucaaacaugcccucaggcuuggggaugcccuucuuccauucccagacagcagugugaggg

SEQ ID NO: 59175 - RNA, 64 nt, Human
gcgcacgaguuccgggccguuccccuccccgcucuucuuccaacuccuccucgcacgcccgagg

SEQ ID NO: 59176 - RNA, 64 nt, Human
gauauaagaugccaaggguauuugauaaaaauucuucuuccaugccaugucaggaguuaauaca

SEQ ID NO: 59177 - RNA, 64 nt, Human
uuucuuucucacccaggcaaucuugccuucugguuucuuccagccacauugagacuuucuucua

SEQ ID NO: 59178 - RNA, 64 nt, Human
ucuggaaucaugugauaucucuuuugugacuggcuucuuccacugaauguuuucuagggccguc

SEQ ID NO: 59179 - RNA, 64 nt, Human
uucugagaaaaaauagcaugaagccuaaagccauuucuuccaaaaacaacauugcaacccuuuu

SEQ ID NO: 59180 - RNA, 64 nt, Human
aaaucaauacaugccccaauauuggaaagacuuguucuuccacggugacuacaguacaugcuga

SEQ ID NO: 59181 - RNA, 64 nt, Human
agcagagaguccugagccacugccaacauuucccuucuuccaguugcacuauucugagggaaaa

SEQ ID NO: 59182 - RNA, 64 nt, Human
cauacauuuugauauuaagaaauaauuccggggauucuuccacuccugaaaugaguugauuugc

SEQ ID NO: 59183 - RNA, 64 nt, Human
gccacugcugugaccacgacacugcuggggcagcuucuuccacagugaugccuacugaugcuuc

SEQ ID NO: 59184 - RNA, 64 nt, Human
cuaucugaaacaaugucucauuaagaauuuaggguucuuccaugggcuuacugacaguugccca

SEQ ID NO: 59185 - RNA, 64 nt, Human
uuucuuucauuaucagggugaaggucuuuccugauucuuccaagcuuugaggugacucagagcu

SEQ ID NO: 59186 - RNA, 64 nt, Human
cacagcaguggaaggcugcacacaggcacauuccuucuuccacaguggggcaccaaggauucug

SEQ ID NO: 59187 - RNA, 64 nt, Human
uucaacugcugcugccaaaauugguuuucuaaaauucuuccaguagagacuaaaagaagauuca

SEQ ID NO: 59188 - RNA, 64 nt, Human
ccucugcuuucuccuccucuccucccaccaaggauucuuccaccuuaaucuuguuuucauaugc

SEQ ID NO: 59189 - RNA, 64 nt, Human
caccagcagaaaauauucuagcucagcuuuacucuucuuccacacuaggcugggcccagcaaua

SEQ ID NO: 59190 - RNA, 64 nt, Human
gcaccuuaagcucaguuuuuucaggcucauccuguucuuccagaaucuaucccuuuucuuacac

SEQ ID NO: 59191 - RNA, 64 nt, Human
uuuccuuuguaaguuccugggcaaccuuuuugauuucuuccagaaggcaaaaagacauuaccau

SEQ ID NO: 59192 - RNA, 64 nt, Human
cuggcuggaaauaauccaauuauuccugcuuggauucuuccacagggccuguguaagaaugggu

SEQ ID NO: 59193 - RNA, 64 nt, Human
ucccuggaugcuggcuucagguugaagucccugguucuuccaguuccucacggguuagguaggg

SEQ ID NO: 59194 - RNA, 64 nt, Human
cuuauuuuaaaagugauuuuuuuaaggacagaacuucuuccaaaagagagggauggcuuuccca

SEQ ID NO: 59195 - RNA, 64 nt, Human
aggcauuuucucugcacugguuuguuuaaaggacuucuuccagcaauaaguugaaagaauaaac

SEQ ID NO: 59196 - RNA, 64 nt, Human
caccccaugccuuugccauugugugcucucagauuucuuccacuguuugacacccuccuuagag

SEQ ID NO: 59197 - RNA, 64 nt, Human
guuagaaggaggcuagaagaugaauucaggcacuuucuuccaauaaaacuaauuauggcucauu

SEQ ID NO: 59198 - RNA, 64 nt, Human
uaguuucaaccacucuuggugacugucauccuguuucuuccauauucucugauuucaugaauug

SEQ ID NO: 59199 - RNA, 63 nt, Human
uaaaaauaauauuaauuuauuuaauuaaaaagaauucuuccaccucgucgggauccguuuucu

SEQ ID NO: 59200 - RNA, 64 nt, Human
uggaugguggugcauccgugaaugcgcugaucguuucuuccaguuagagucuucaucuguccga

SEQ ID NO: 59201 - RNA, 64 nt, Human
aauuaacuuguuuucuucauccaaaaaaguuuauuucuuccacguacuuaaauuuucugugugg

SEQ ID NO: 59202 - RNA, 64 nt, Human
uagguaauuaacugcuuguuuuaagugauuauauuucuuccacuguuuuugaaaaauaaucaaa

SEQ ID NO: 59203 - RNA, 64 nt, Human
cauuucccuuucgcaguucuuucaauaggcccaguucuuccaaauggaaaaagaaaggucugga

SEQ ID NO: 59204 - RNA, 64 nt, Human
ggaacuuuaguaaguucuucucauuucauuauguuucuuccaaggaaacaggagagacugaauu

SEQ ID NO: 59205 - RNA, 64 nt, Human
ucauggaaccagcugccugcagucaggccccagguucuuccaugggugaacagagcaucugaca

SEQ ID NO: 59206 - RNA, 64 nt, Human
gccaugggagacacugauguaugaggaauuucuguucuuccaucaccuccccccccccgccacc

SEQ ID NO: 59207 - RNA, 64 nt, Human
uagaggcuacagcacuuuacaagcaagguaugcuuucuuccagccccuaggcugugggcacugu

SEQ ID NO: 59208 - RNA, 64 nt, Human
aaugcccguuaccugguuccuugccuggucugcuuucuuccaaguuugccuggggccuagcccu

SEQ ID NO: 59209 - RNA, 64 nt, Human
uuggucuacuggaagcagcuaucaaccgacuuuguucuuccaaguccuaguggaaaagacaaaa

SEQ ID NO: 59210 - RNA, 64 nt, Human
cuaccuugcuucaguuaaaaaugaagcacuugguuucuuccauccuccuccuccccuuaaugga

SEQ ID NO: 59211 - RNA, 64 nt, Human
cauaaaaaauuuuccagacaacuccaaucuguccuucuuccaaguuccuagaggccuuaauuau

SEQ ID NO: 59212 - RNA, 64 nt, Human
cauccuuucagcauauccuuuuaaguuuaguucuuucuuccaguuauacuauguacuaucaguu

SEQ ID NO: 59213 - RNA, 64 nt, Human
auugauacugcuggacuucaaaggcaaaguucauuucuuccauuaacugcuuccagagauguca

SEQ ID NO: 59214 - RNA, 64 nt, Human
cugcagcugcuaaaacuacauguggccagcuccauucuuccacacugcguacuacauuuccugc

SEQ ID NO: 59215 - RNA, 64 nt, Human
ccuguuguguauacuucagaguacuuuucaugaguucuuccacagugaacccuuggauuaccug

SEQ ID NO: 59216 - RNA, 64 nt, Human
gaaagauuuuuugcaugacuuuucucucauuuuauucuuccauaauguauuucuacuauaaaau

SEQ ID NO: 59217 - RNA, 64 nt, Human
cauggaugacucuggcuuccuuaggaaaauauuuuucuuccaaaaucaguaggaaaucuaaacu

SEQ ID NO: 59218 - RNA, 64 nt, Human
gugagcaccaguaaagaucuggccuccgggguuuuucuuccaucugacaucugccagccucucu

SEQ ID NO: 59219 - RNA, 64 nt, Human
uccaacacgaccaucguagggugaagcccacguuuucuuccauggccucaaaggcccuagaacu

SEQ ID NO: 59220 - RNA, 64 nt, Human
gauucuaguucagcugcugucacagucucauuuguucuuccaacugaaagccguaaaaccuuug

SEQ ID NO: 59221 - RNA, 64 nt, Human
uggcgaaguugcugcuccggcauucaguaccugcuucuuccagagaaauaaaguuaguuucuau

SEQ ID NO: 59222 - RNA, 64 nt, Human
accggcacccggugggaccuccuaggacugggccuucuuccagggggccccuggcagcagcugg

SEQ ID NO: 59223 - RNA, 64 nt, Human
cauaagccuccauuuaguucuuuguuauuuuuguuucuuccaaagcacauugaaagagaaccag

SEQ ID NO: 59224 - RNA, 64 nt, Human
caccuguguggcucucaccugcguuuugagucuguucuuccaggaguaauaaauucuggacauc

SEQ ID NO: 59225 - RNA, 64 nt, Human
aaaagacuagccagccaggaagaugaauccuagcuucuuccauuggaaaauuuaagacaaguuc

SEQ ID NO: 59226 - RNA, 64 nt, Human
ggucaguuuucugugcaaacaaaccuguuuaggauucuuccaaauguucuuccuggggucuuug

SEQ ID NO: 59227 - RNA, 64 nt, Human
aaauuaauacaauucccugugaucuauuccaauguucuuccaagauuuuuguucaucuauaauu

SEQ ID NO: 59228 - RNA, 64 nt, Human
uuuuccuacucaauauucucuucaagcauuuuuuuucuuccacugccacucucuuuaccuuuau

SEQ ID NO: 59229 - RNA, 64 nt, Human
auaccuucaagaaguuaacaaaaaaggaauggauuucuuccaugguaauagccaauacuuacuu

SEQ ID NO: 59230 - RNA, 64 nt, Human
aauuuguccugagucuggagggguuaguucagaguucuuccacuguauguuugaagagaugacc

SEQ ID NO: 59231 - RNA, 64 nt, Human
aaauauaccucuucaaaugagaaaaaagaacaguuucuuccaugugcuggcacguggaugauua

SEQ ID NO: 59232 - RNA, 64 nt, Human
guuuauaaaacaguccuguguaaacugcuggaaguucuuccacagucaggucaauuuugucaaa

SEQ ID NO: 59233 - RNA, 64 nt, Human
aaacaaaucacauucuugcacaaaagugaucguuuucuuccaaacaaugugaauuuaaaagguc

SEQ ID NO: 59234 - RNA, 64 nt, Human
gagccuuuuaguagagcugauuuauuccaguaacuucuuccauauuuucucacuaaucucccgu

SEQ ID NO: 59235 - RNA, 64 nt, Human
uaauuuaagagggaaauauaaccuauaaauuuguuucuuccaagcuuagcucuuaaauuuggag

SEQ ID NO: 59236 - RNA, 64 nt, Human
gugucuaaucuccuucugagaaggacgaaaaacuuucuuccaagugaagauccauuuaagaaca

SEQ ID NO: 59237 - RNA, 64 nt, Human
guccucugcuucugauucaggcauacuuuugggauucuuccaucuuuaaaggaaaaaggaagcc

SEQ ID NO: 59238 - RNA, 64 nt, Human
uuuuuucuuuuuuaaaagagauguagcagaauaauucuuccagugcaacaaaaucaauuuuuug

SEQ ID NO: 59239 - RNA, 64 nt, Human
cccccucgcucccgccuaccccgucggcauuuucuucuuccaccagcuuuuacugaacuuuuug

SEQ ID NO: 59240 - RNA, 64 nt, Human
aguugauaacauaaagccauaguuuucuuggauuuucuuccaagauauuguauucccaagaaga

SEQ ID NO: 59241 - RNA, 64 nt, Human
aaagugaauuucaagugaccugauuaauuuccuauucuuccaaaugagaugaaaauggggaucc

SEQ ID NO: 59242 - RNA, 64 nt, Human
cuucagugauccaugcauagaauaugaaaauaaauucuuccaacucaugggauaaaggggacuc

SEQ ID NO: 59243 - RNA, 64 nt, Human
ccuugagggcaagagccacaguauauuucccuguuucuuccacagugccuaauaauacugugga

SEQ ID NO: 59244 - RNA, 64 nt, Human
cauauuacauuuuaugcugaucuucaguucauaauucuuccaggaaaacucagucuuccaacug

SEQ ID NO: 59245 - RNA, 64 nt, Human
guauauuuaacuucuaguugcucuugcuuuggucuucuuccaaugaugcuuacuacagaaagca

SEQ ID NO: 59246 - RNA, 64 nt, Human
cauucauucacaugcucaucugagaagacuuaaguucuuccagcuuuggacaauaacugcuuuu

SEQ ID NO: 59247 - RNA, 64 nt, Human
uuacccuuagguagguaacaucuuacauucuguuuucuuccagucuuugcaguauucacuagag

SEQ ID NO: 59248 - RNA, 64 nt, Human
uacuuauauaccaucuuucaacugaacauuucaguucuuccaagagcuucuuagaguaguauau

SEQ ID NO: 59249 - RNA, 64 nt, Human
uuaucaaggcgguuauaugcauauuacuccagccuucuuccauuucagaaauugucaauagcua

SEQ ID NO: 59250 - RNA, 64 nt, Human
ugggaaugagaacaaggaucugcuucuucucagauucuuccagaugaccagcagugacaauuuu

SEQ ID NO: 59251 - RNA, 64 nt, Human
auaauaauuguuaaaauucucuacagccuucuuuuucuuccauagcuaaucuuccuucuaauag

SEQ ID NO: 59252 - RNA, 64 nt, Human
uucaaugcacugaaaagucaucugaaaaaauagcuucuuccauaucagcuuauauuaaauacug

SEQ ID NO: 59253 - RNA, 64 nt, Human
cugaaaagauaacuggccucuauuucuuaauaaauucuuccaagaaauaaagaacaauaguuuc

SEQ ID NO: 59254 - RNA, 64 nt, Human
auugauacuuuuccacaggcaucucugcaugaauuucuuccacaguaaaaauacguuuuuugua

SEQ ID NO: 59255 - RNA, 64 nt, Human
cuuccacuuuaaaacaaaaugaacacugcuugucuucuuccauugaccauuuaguguugaguac

SEQ ID NO: 59256 - RNA, 64 nt, Human
uuauuuuguccuccacaagauggcucuaugaguauucuuccagggauucuaauauuuauuuaag

SEQ ID NO: 59257 - RNA, 64 nt, Human
guuccagguuuuucuggcauuuucuguuccagguuucuuccacccacgagcacuuuauucuccu

SEQ ID NO: 59258 - RNA, 64 nt, Human
aagaaaugcucgucauacaguaaacucuggaugauucuuccagauaauguccuugcuuuacaaa

SEQ ID NO: 59259 - RNA, 64 nt, Human
acgagucuggccccuugccucgggcuggcugguguucuuccaagagccucugcucacauuguug

SEQ ID NO: 59260 - RNA, 51 nt, Human
aagcagcugcuucugugugauuucuuccaaaauacauguaaaaucuuguac

SEQ ID NO: 59261 - RNA, 64 nt, Human
cuuaaauguaaguauuacaugacaugcauucuguuucuuccagaguucugucugccacacgaaa

SEQ ID NO: 59262 - RNA, 64 nt, Human
uuguuggaagagaauguuuauacaaaaaaugaaauucuuccaacagcagagaaacucuaaaaag

SEQ ID NO: 59263 - RNA, 64 nt, Human
aggaaaugcuuaccaucccccacccccaaccaaguucuuccagacuaaagaauuaagguaacau

SEQ ID NO: 59264 - RNA, 64 nt, Human
acuaagagucccaugguuucucuucuggucacaguucuuccauugguuggaucugauacuuauc

SEQ ID NO: 59265 - RNA, 64 nt, Human
aggcugggaucugggugggaggcuggggcucuucuucuuccaucuccuuggugacacccagccc

SEQ ID NO: 59266 - RNA, 64 nt, Human
aggaaaauuuaauucugucccuggccagcuauuguucuuccacuucguuuucugcugucccaag

SEQ ID NO: 59267 - RNA, 64 nt, Human
auauuuguacccucaguggagcccuucuggucuuuucuuccacuucugcagaauuuccucuagc

SEQ ID NO: 59268 - RNA, 64 nt, Human
ggcacgugagcuccggaauagaugucuucaucacuucuuccacuguguguugacacuguuuucc

SEQ ID NO: 59269 - RNA, 64 nt, Human
auugcaggucucuguacgggccaguuucucugccuucuuccaggaucagggguuagggugcaag

SEQ ID NO: 59270 - RNA, 64 nt, Human
cuuuuuugaggccaguagcaacauccagagaucauucuuccauacuuuacucccuccuuuuuca

SEQ ID NO: 59271 - RNA, 64 nt, Human
aguaucuuccagcaguaguaacagucuggauaacuucuuccauaucccucccucuuuguuuuuu

SEQ ID NO: 59272 - RNA, 64 nt, Human
uauaacugcacuaauaaagagaggcucuuuuuuuuucuuccaguuuguugguuuuuaaugguac

SEQ ID NO: 59273 - RNA, 64 nt, Human
uuuuaugcauugccaguauaauaaacugugaguauucuuccagauaucuaauuguaagcugaug

SEQ ID NO: 59274 - RNA, 64 nt, Human
ccaaaaagaaaauuguuaguuuaaauuguuuucuuucuuccaagaaagaagccacuuaaauaag

SEQ ID NO: 59275 - RNA, 64 nt, Human
gaucuacucuagaucguuuccugacagagaagccuucuuccaggccacuaagguagcauguuau

SEQ ID NO: 59276 - RNA, 64 nt, Human
uaacaagugcaauggaaagaaaacgaucccuuccuucuuccacuuucacagcuuuucucugaac

SEQ ID NO: 59277 - RNA, 64 nt, Human
cuguuuagaauugaaagcugccagcuaacaguaauucuuccauaguugacuugaacuucugaug

SEQ ID NO: 59278 - RNA, 64 nt, Human
uugaacguuuauuaaaaugccaagacccaaccauuucuuccaccugcuugauugugccaguguu

SEQ ID NO: 59279 - RNA, 64 nt, Human
uggguuuucuucuauguguggaauuuauaaggcauucuuccagugugguuucucuuaugucgag

SEQ ID NO: 59280 - RNA, 64 nt, Human
ccucucuaaaaguguccacaagaagggguguuuauucuuccaacacauuucacuuuucuguaaa

SEQ ID NO: 59281 - RNA, 64 nt, Human
acccaguaacucaucugucaccaagccuuggggauucuuccaucugauugugaugugaguugca

SEQ ID NO: 59282 - RNA, 64 nt, Human
aacucuagggauucaugauucugguggagauuccuucuuccagggccugggaggauagggcuaa

SEQ ID NO: 59283 - RNA, 64 nt, Human
uuauucccaaguacuauuauuccauacuacuauauucuuccaaauauuuggaacacucuuagaa

SEQ ID NO: 59284 - RNA, 64 nt, Human
auuacaguaugguaacuuugcaaauggugguuguuucuuccaagacuccagcccugauugcgca

SEQ ID NO: 59285 - RNA, 64 nt, Human
uuacaagccuacucuggacccagcagcugacuccuucuuccaccccucuucuugcuaucuccua

SEQ ID NO: 59286 - RNA, 64 nt, Human
aggcucaacauuucuacacguugcccaucaucccuucuuccauccuuagagggacccuuccaag

SEQ ID NO: 59287 - RNA, 64 nt, Human
augagcuaccgcuguacaguucucggccccggcuuucuuccaagaguugaccaggaacccuaaa

SEQ ID NO: 59288 - RNA, 64 nt, Human
cuagggaaucaaauucuucagagauaagaacuuguucuuccaaguuuccuuguuccuggcuacu

SEQ ID NO: 59289 - RNA, 64 nt, Human
cucagaggcaacaaguauuacaguugcuuguauauucuuccagagaucucugucuauacaagca

SEQ ID NO: 59290 - RNA, 64 nt, Human
uguauuaaggagaaauaaugaacuaucuucuugauucuuccauugagaaaagcauaugaauccu

SEQ ID NO: 59291 - RNA, 64 nt, Human
uugugauacggaaacaauaaauuccugagauacauucuuccaaucugugguaauaauaagaauu

SEQ ID NO: 59292 - RNA, 64 nt, Human
acgcuuaaacaggguucucugucauuuuccuguuuucuuccagagucccaauccuuugcccuag

SEQ ID NO: 59293 - RNA, 64 nt, Human
auacugauguuuuuggaaacagcaauuaaaguuuuucuuccaugaguugaguccuuaagaaaau

SEQ ID NO: 59294 - RNA, 64 nt, Human
uuugugaaauucagaauuuuucuuuuuaauauauuucuuccauggaagaguugucaucacuaaa

SEQ ID NO: 59295 - RNA, 64 nt, Human
uccagguggaagugauuuuaucuucugcucuuucuucuuccacacaugcaaggugaaagggugu

SEQ ID NO: 59296 - RNA, 64 nt, Human
agaaaagcagacacuucucugaaacaugaccuuauucuuccaaacaguaucgcuaguaaaauag

SEQ ID NO: 59297 - RNA, 64 nt, Human
ugucuaagauaguaacaaugaagauaaaaagacauucuuccaaaaagauuuucagaaaauauua

SEQ ID NO: 59298 - RNA, 64 nt, Human
uaacguauuggaccugauauuuuuagugggugcauucuuccagaaagaauucagcaauguuauc

SEQ ID NO: 59299 - RNA, 64 nt, Human
gccaaaugccuagcacagagcucaguggauuugauucuuccauucagauacucauagcgauugc

SEQ ID NO: 59300 - RNA, 64 nt, Human
uuucauuuauucugaauuguccccagcgugcguuuucuuccauguagcugauucuguuuuucac

SEQ ID NO: 59301 - RNA, 64 nt, Human
cgaaacauacggugaauaauucacgcucacgucguucuuccacaguaucuuguuuugaucauuu

SEQ ID NO: 59302 - RNA, 64 nt, Human
uguacggcuucggcgguuaaucuuuucgucaguuuucuuccaauggcccuuuucagggccgccc

SEQ ID NO: 59303 - RNA, 64 nt, Human
uuaaacaaggcaucucaccucuuuucaucuuguuuucuuccaauaauguuagaguucauguaau

SEQ ID NO: 59304 - RNA, 64 nt, Human
uugcaugaugaaaagcuuuccugcuuggcucuuauucuuccacaagagaggacuuucucaggcc

SEQ ID NO: 59305 - RNA, 64 nt, Human
uugcaggaugaaaagcuuuccugcuuggcaguuauucuuccacaagagagggcuuucucaggac

SEQ ID NO: 59306 - RNA, 50 nt, Human
cugucucucccccagacugauucuuccagaccagaguuugaugccagcag

SEQ ID NO: 59307 - RNA, 64 nt, Human
uguuugcacuguguccuuuccaggccuuggccaguucuuccaggggugaggcauguggugcugg

SEQ ID NO: 59308 - RNA, 64 nt, Human
cuucugcacacccuuguaacaauuaaaauugcuuuucuuccauguuucucuuggcagagagaaa

SEQ ID NO: 59309 - RNA, 64 nt, Human
guaaagucuccugaaaugugguaguaagaggauuuucuuccauaaugcaucugaaaaacuguaa

SEQ ID NO: 59310 - RNA, 64 nt, Human
ugccagcucuguuauuucugccccuucuuuacccuucuuccaauuuuuauuaucuucuuauuua

SEQ ID NO: 59311 - RNA, 64 nt, Human
gcguuucgcuuuccuucuucuuggcuuccucuuauucuuccacaaaccauucucaauaaagcca

SEQ ID NO: 59312 - RNA, 64 nt, Human
ucagauagagcaguguacgucuuuucugagguguuucuuccagcguugcucauccaggaguacc

SEQ ID NO: 59313 - RNA, 64 nt, Human
uuuaguguuucuuuguguguuuuguagacuaguguucuuccauccuucaacugagcucaaagua

SEQ ID NO: 59314 - RNA, 64 nt, Human
gaagaaagggcccaagccaggagaucgcuugguuuucuuccagaaguuaaauggggggaucuga

SEQ ID NO: 59315 - RNA, 64 nt, Human
uuuuugaagugcggcuagauucucagauucaccuuucuuccagggaagauaacuuucaaucuau

SEQ ID NO: 59316 - RNA, 64 nt, Human
cccugugucauuucuggauuauauacuaguuaauuucuuccauuccccacuacacagagaggug

SEQ ID NO: 59317 - RNA, 64 nt, Human
ucuaaacucauauauguacacaguucacucuagcuucuuccaaaauaucucuagguaguacaac

SEQ ID NO: 59318 - RNA, 64 nt, Human
cuugcaggacacuacaacgugggacauuguuuguuucuuccauauuuggaagauaaauuuaugu

SEQ ID NO: 59319 - RNA, 64 nt, Human
agaaucagauucuucauuuuuugcagcuacgauguucuuccagggcacugggggcugugacuuc

SEQ ID NO: 59320 - RNA, 64 nt, Human
acuaugaugcguauuuauuuuucugcaccuuccuuucuuccacaaacacauauugauagaugca

SEQ ID NO: 59321 - RNA, 64 nt, Human
uggaaaaauacccaugggaccagauccugccaaauucuuccagcucacuuuauucucagcauuc

SEQ ID NO: 59322 - RNA, 64 nt, Human
uucccccgcuaacuggaggcugauuucuacauauuucuuccauguaucugagaauaucuaacua

SEQ ID NO: 59323 - RNA, 64 nt, Human
auuaaauucuuuccaaauuggaucgcucugggauuucuuccaugguggacuuuuguuucugauc

SEQ ID NO: 59324 - RNA, 64 nt, Human
aaauguugcugugauuauuuauaauugguaguauuucuuccagaagaagcuaaaauaagacugg

SEQ ID NO: 59325 - RNA, 64 nt, Human
guaaaaacaucugaauguagaccaugaucucaaguucuuccauuuucucccccacgaguggaaa

SEQ ID NO: 59326 - RNA, 64 nt, Human
uccacuuuucuguauaaaauguauaaagugggguuucuuccauauugacaaaugagggaacagg

SEQ ID NO: 59327 - RNA, 64 nt, Human
accuucuauaaccuaaauauaccauugaugauucuucuuccauucagugacauccacagauuau

SEQ ID NO: 59328 - RNA, 64 nt, Human
ucagcauuuguucuuugccagucucauuuucaucuucuuccaugguuccacagaagcuuuguuu

SEQ ID NO: 59329 - RNA, 64 nt, Human
uuccaucucuuacccaaguggugcuaaacaauuuuucuuccaauguuugagggaagcagucucc

SEQ ID NO: 59330 - RNA, 64 nt, Human
aacuaucaacauuuuaaaccaaauugccuuauuuuucuuccaaacuucauauaugucuaucagg

SEQ ID NO: 59331 - RNA, 64 nt, Human
ggaggcuuugggaaucugaugaagccuaucaauuuucuuccagaagauauuuauauaagauuau

SEQ ID NO: 59332 - RNA, 64 nt, Human
cuaccaggggucuccuuucuuacccaggacuccuuucuuccauuuuaacacuuccugguugcaa

SEQ ID NO: 59333 - RNA, 64 nt, Human
gcugguucaagacggaaaaggacuuucuucuguuuucuuccaaagugcaaccacaguggagagc

SEQ ID NO: 59334 - RNA, 64 nt, Human
uaaucuguuuaugugaagaaaaagaauuaagucuuucuuccaacucucuccuuggauagccuag

SEQ ID NO: 59335 - RNA, 64 nt, Human
uuucuuggaguggcugcuucugcuauagagaacauucuuccaagauaaauauguguguuuacac

SEQ ID NO: 59336 - RNA, 64 nt, Human
aaauuguacuccuugacaguugauagauuauauauucuuccaucccucaaacuugcauuccacu

SEQ ID NO: 59337 - RNA, 64 nt, Human
aacugcccccaucucaagcaagaauggcguugguuucuuccauuucaaacuaaucagcauucuc

SEQ ID NO: 59338 - RNA, 64 nt, Human
guggugguaaaugcuauucauuauuuucuuuucuuucuuccaagugcauguguguccuugucuu

SEQ ID NO: 59339 - RNA, 64 nt, Human
aaauaaaaagcugcucucacugucagcucucauauucuuccagguuuugcacucuacauaaaau

SEQ ID NO: 59340 - RNA, 64 nt, Human
uucuagcugagcuucuucauucuccuucuucuccuucuuccacaaagacccauaucuggagaag

SEQ ID NO: 59341 - RNA, 64 nt, Human
guuuuggguuuagguuguaauuccuuauauuucuuucuuccacaguguaucggaucugucguuc

SEQ ID NO: 59342 - RNA, 64 nt, Human
uuugcgggacacacuauuaauauuuaagcauagauucuuccagauguuuuguuuuauacagcag

SEQ ID NO: 59343 - RNA, 64 nt, Human
ggagugaaggggguuccuggagucucuagggugcuucuuccagagucugucuucuugcuuccag

SEQ ID NO: 59344 - RNA, 64 nt, Human
agccucucugaacuuuguaaaaaucuguccccaguucuuccaucgguguaguuguugcauuuga

SEQ ID NO: 59345 - RNA, 64 nt, Human
cuuauacugaguccuuuuucuaauguaaaaauauuucuuccaaguuugauuucuguaucagggu

SEQ ID NO: 59346 - RNA, 64 nt, Human
cgauacccaugaagaaucaaaaaguuuauuuuuuuucuuccaacaugugauguguugcucucca

SEQ ID NO: 59347 - RNA, 64 nt, Human
uuuuuuuuucuaauauuucaguugagcugcuguuuucuuccaugcaauauuguauacucaauug

SEQ ID NO: 59348 - RNA, 64 nt, Human
gcaugcccagaucacauuccaguuccuucauuccuucuuccagaacaucuggguccucccuccu

SEQ ID NO: 59349 - RNA, 64 nt, Human
uuaagaauguauaucaggguuuaacaauagguauuucuuccagugauguugaaauuaagcuuaa

SEQ ID NO: 59350 - RNA, 64 nt, Human
cccgcugcagccucugccucuuggguucaagugauucuuccaccucagccucccagguagcugg

SEQ ID NO: 59351 - RNA, 64 nt, Human
ccaagauucuguuuuaaucaucauuuacauuguuuucuuccaaaggcccccucguauacccucc

SEQ ID NO: 59352 - RNA, 64 nt, Human
ugggaugauguuuaccagcccaaaaccagucauguucuuccaaaagcuucucuuugauagaauu

SEQ ID NO: 59353 - RNA, 64 nt, Human
cagagacaugguggucugcacaagccuggacaaguucuuccauauugaugguggagcaaccccu

SEQ ID NO: 59354 - RNA, 64 nt, Human
gacauauuagaagaaaaaaaaaagcuuuguauuauucuuccacauaugcuggcugcuguuuaca

SEQ ID NO: 59355 - RNA, 64 nt, Human
ucuucugugaaauuucaaaagugugaacuuuuuauucuuccaaagaauuguaauccuccccaca

SEQ ID NO: 59356 - RNA, 64 nt, Human
ugaauuuuccgaaccucucaaaguauguuuuccguucuuccacagaaauaugcaaaacaguuca

SEQ ID NO: 59357 - RNA, 64 nt, Human
auuacuguccagguacauuuuagaaaaaguguucuucuuccaguuuguuuuacuaagcaaacuu

SEQ ID NO: 59358 - RNA, 64 nt, Human
caguaugagcuuuaaaucaagauaauuguuagauuucuuccaugcauguauguguuccaggaau

SEQ ID NO: 59359 - RNA, 64 nt, Human
uuguuuucugcaaguucauguuuugcauuuuauguucuuccacaauugaucugauguucaggaa

SEQ ID NO: 59360 - RNA, 64 nt, Human
gugcccuggggggcaggugugcucuaugugguucuucuuccauuggagagcuggcguagagauc

SEQ ID NO: 59361 - RNA, 56 nt, Human
ggauccuuccauaugugugauuugucuucuuccagcugcaaacagcuaaagggaug

SEQ ID NO: 59362 - RNA, 64 nt, Human
cuauaaauuagcuguuagaucugcugagaugacuuucuuccauauaugugguucauuggaaguu

SEQ ID NO: 59363 - RNA, 64 nt, Human
uuugguaaaaagaaaaaugccaugggcugcagucuucuuccaucacuuuucccuaccaggucca

SEQ ID NO: 59364 - RNA, 64 nt, Human
cuacccucgccucgcauccucugccaaauccgaauucuuccagcccagcuucccgggcucuguc

SEQ ID NO: 59365 - RNA, 64 nt, Human
auuuauauguacuaaauguggaaccauuagaaaguucuuccaaaaucucauuccagcauaguuu

SEQ ID NO: 59366 - RNA, 64 nt, Human
gcuggaugugcuuucauccaacuggaaggcuuuauucuuccaaguucauucauacucaaagagg

SEQ ID NO: 59367 - RNA, 64 nt, Human
cuucuaaagugugcauauacuuuuuuaacgucucuucuuccauuacaauguguguuuugcaagg

SEQ ID NO: 59368 - RNA, 64 nt, Human
cugaacuccagucaaguugaguucaagugaaagauucuuccaggguuuuauuuuuuccccuccu

SEQ ID NO: 59369 - RNA, 58 nt, Human
uaucuagcugcaagguauaauugauggauucuuccauccugccggaugagugugggug

SEQ ID NO: 59370 - RNA, 64 nt, Human
gaagucuaaaagcagaaaauaaaggaagcaaguuuucuuccaugauuuuaaauugugaucgagu

SEQ ID NO: 59371 - RNA, 64 nt, Human
caaguagguuacuguaagauguuuaagauaaaaguucuuccagucaguuuuucucuuaagugcc

SEQ ID NO: 59372 - RNA, 64 nt, Human
uaaaguguguaguuaauaugcauguuaucguccuuucuuccauucuuaacaguaugugcccauu

SEQ ID NO: 59373 - RNA, 64 nt, Human
gauguguagaaacguuggguuauggaagacuaguuucuuccauaacccugaauuggagaccuua

SEQ ID NO: 59374 - RNA, 64 nt, Human
acuacuucacaaaugguuauaaagucauauccacuucuuccacaaugaccacagcaaaugacca

SEQ ID NO: 59375 - RNA, 64 nt, Human
ucauuuaaaauauauugugcuaugauaaccaaccuucuuccaaggagugaccauuacugccuac

SEQ ID NO: 59376 - RNA, 64 nt, Human
ucacccauuaucuggaauauugugauucuguuuauucuuccagaaugcugaacuccuuguuagc

SEQ ID NO: 59377 - RNA, 64 nt, Human
caauagcgagcuuggagccuggaggccggcuuaguucuuccauuucacccuugcagccagcugu

SEQ ID NO: 59378 - RNA, 64 nt, Human
ucucuggagccccuccucccccggcugggccuccuucuuccacuucuccaagaauggaagccug

SEQ ID NO: 59379 - RNA, 64 nt, Human
gauugacuaauacauuaucucacacuuucaugaguucuuccauuucaaagacucacuucuauaa

SEQ ID NO: 59380 - RNA, 64 nt, Human
cauugacuaaugcaucaucucacacuuucaugaguucuuccauuucaaagacucacuucuauaa

SEQ ID NO: 59381 - RNA, 64 nt, Human
cucauugacuaauacaucaucucacacuuucauguucuuccauuucaaagacucacuucuauaa

SEQ ID NO: 59382 - RNA, 64 nt, Human; identical to SEQ ID NO: 59379

SEQ ID NO: 59383 - RNA, 64 nt, Human
cauugauuaauacaucaucucacacuuucaugaguucuuccauuucaaagacucacuucuauaa

SEQ ID NO: 59384 - RNA, 64 nt, Human
acgaugcugaaauuguuuuuaaauugaaguuucuuucuuccacaaagcagccguuucuauucaa

SEQ ID NO: 59385 - RNA, 64 nt, Human
gaccucccugcgauuucccacuccuuucuuagucuucuuccagaaacagagaaggggaugugug

SEQ ID NO: 59386 - RNA, 64 nt, Human
gcccccauggcuuugaggagaauccucucugccauucuuccaaucuccccaguggguuuugcua

SEQ ID NO: 59387 - RNA, 64 nt, Human
uuucuguguccaaaauaaguuuuaaggacaucuguucuuccauacgaaauagguuaggcugccu

SEQ ID NO: 59388 - RNA, 64 nt, Human
cuuaucgccuguuguccagauuggcacgaaccuuuucuuccacuuaauuauuuuuuuaggauuu

SEQ ID NO: 59389 - RNA, 64 nt, Human
uauaaauauaacugaauauugggguagcuuucauuucuuccauuaauuacauguguaaaauuaa

SEQ ID NO: 59390 - RNA, 64 nt, Human
ugggcagcaccucccuuuuuaaaaaaauuuuuuuuucuuccaaagacagagucuugcucuuguu

SEQ ID NO: 59391 - RNA, 64 nt, Human
gaaguucaagugaucuuucaauaucauuacuaacuucuuccacuuuuuccagaauuugaauauu

SEQ ID NO: 59392 - RNA, 64 nt, Human
gucuagaaaacgcccacuucauucugauuaaaaauucuuccauguuuuaaauaucagaaccaga

SEQ ID NO: 59393 - RNA, 64 nt, Human
ugaaaggaucacccuuggcaucugugugccuggauucuuccagaaugucuacaaugcuaaucuc

SEQ ID NO: 59394 - RNA, 64 nt, Human
gugaucacuccaguggugaagggugcagcucugguucuuccagagagacugcccccuucccucc

SEQ ID NO: 59395 - RNA, 64 nt, Human
gcaaauuaccacagcaaagguuucauucaggagauucuuccaucugggcaaccugguuuuccaa

SEQ ID NO: 59396 - RNA, 64 nt, Human
uuaaaccuuugugcauuggguuaugaauaaucuuuucuuccaaagauggcaaaagccucgguuu

SEQ ID NO: 59397 - RNA, 64 nt, Human
gaggaaauaagaaaaaucauguuugcucucccgguucuuccagugguuugagacacugguuuac

SEQ ID NO: 59398 - RNA, 64 nt, Human
gccgauuccagaugaccuuccaguguccccaagguucuuccaucuucuagacuguaacccugcc

SEQ ID NO: 59399 - RNA, 64 nt, Human
uucuugcuaugcuuccugcacccaaccagcagaauucuuccaggguggaggaacuaaucagcuu

SEQ ID NO: 59400 - RNA, 64 nt, Human
uagaggguaauggcugacacccccauucccucucuucuuccaccagccuuaugcaucuaagugu

SEQ ID NO: 59401 - RNA, 64 nt, Human
gagaccaggaggcuaggacccuggccgcgcuugguucuuccaaagcgagaagggcuucucuccc

SEQ ID NO: 59402 - RNA, 64 nt, Human
agugauugucaucaugguuaaagcuggucugugcuucuuccauagacagaagcuuagucuguuu

SEQ ID NO: 59403 - RNA, 64 nt, Human
cagacacagaggugcaggcaccaggauucuccacuucuuccagcccugcugggccacaguucua

SEQ ID NO: 59404 - RNA, 64 nt, Human
aguucaaggcucuggggcuggccucacaagaggcuucuuccacggggcuugacaccagagcagc

SEQ ID NO: 59405 - RNA, 64 nt, Human
ucucuaaagauuuagaacuuuagaaaaugccgacuucuuccaucuauuucugaaagguucuuug

SEQ ID NO: 59406 - RNA, 64 nt, Human
auuuuuccagugugguuuuuaacagauaauacauuucuuccacauucagauuaguauucggaca

SEQ ID NO: 59407 - RNA, 64 nt, Human
uugcucauggcauacuuuucauguuuuaauuuuuuucuuccagcaaaauaaacacugaggcccu

SEQ ID NO: 59408 - RNA, 64 nt, Human
cuguuuuuauguugacugcuuuauguugaauauuuucuuccacaacauguaugugcugcuuauu

SEQ ID NO: 59409 - RNA, 64 nt, Human
ugcuuuuuaaauaagaaaaauucagaagaugaauuucuuccaauauuugaauaaauuaaagcuc

SEQ ID NO: 59410 - RNA, 64 nt, Human
aaauguuucuaagguauuaugaugcaucaacuaguucuuccauguaaaauaauuuuagugcaau

SEQ ID NO: 59411 - RNA, 64 nt, Human
gcuaguggauuuuacauguggcccaacacaauucuucuuccaacguggcccagagaagccaaaa

SEQ ID NO: 59412 - RNA, 64 nt, Human
cucugcagggauuugguuaaguuguugagcugauuucuuccauguuuuagaaaaugaggccugu

SEQ ID NO: 59413 - RNA, 64 nt, Human
gaugucaagucuucgagucagcgugacucauucauucuuccaacaguuuggacaccacaaagca

SEQ ID NO: 59414 - RNA, 64 nt, Human
auauugugugcuucccaaagcuauagucauagauuucuuccagaaacuauugucauaauuguca

SEQ ID NO: 59415 - RNA, 64 nt, Human
guuaguguauuuuauguguggcccaagauaauucuucuuccaauguggcccagggaagccaaaa

SEQ ID NO: 59416 - RNA, 64 nt, Human
ucuuugaauuaauaugugguggguucugacauuauucuuccauaagaccauguggguuuccaug

SEQ ID NO: 59417 - RNA, 64 nt, Human
ccgggaggaggccccaagggaacacguggagagcuucuuccagaagauggacagaaacaaggau

SEQ ID NO: 59418 - RNA, 64 nt, Human
ugguuauagacucuuucuuuaaccauuguauauuuucuuccauucuugucauuggucaauaggg

SEQ ID NO: 59419 - RNA, 64 nt, Human
aacaaaaacaagucccauguccuacugacucuaguucuuccagucguuauccucugcugucucu

SEQ ID NO: 59420 - RNA, 64 nt, Human
ucuauuuuaaaguccacucccccaaaauacugauuucuuccauggauuauuuuuauaugauuug

SEQ ID NO: 59421 - RNA, 64 nt, Human
aagaaauagccuaaugguccaacuuugcugucuguucuuccaaauguuuauaauacacauuauu

SEQ ID NO: 59422 - RNA, 64 nt, Human
gaacaauauaaagcacuuaaaggaagaggaugauuucuuccagcuuuuccacacucucuuuaug

SEQ ID NO: 59423 - RNA, 64 nt, Human
aguguauaaauccaauaucaugucuugugcauaauucuuccaaaggaucuuauuuugugaacua

SEQ ID NO: 59424 - RNA, 64 nt, Human
aagagaacauguaaguugagggguaugcuucauguucuuccauccauuuaccuaauaguaugaa

SEQ ID NO: 59425 - RNA, 64 nt, Human
uuuuucaugacugaagggaguuuuauguuauuauuucuuccauaguuuuguuuugguuuauuuu

SEQ ID NO: 59426 - RNA, 64 nt, Human
ugcaugaugagauacaacuucugaaugcugcacauucuuccaaaaugauccuuagcacaaucua

SEQ ID NO: 59427 - RNA, 64 nt, Human
acaccuagaaucuuugugaauaaugugaggccaguucuuccauaaggaaggcugguuauggaua

SEQ ID NO: 59428 - RNA, 64 nt, Human
aauuaaauuuuauuuucagcauuuagcccaggaauucuuccaguaggugcucagcuauuuaaaa

SEQ ID NO: 59429 - RNA, 64 nt, Human
acuucaccauuccucaaaccuguaaguuucucacuucuuccaaauuggcuuuggcucuuucugc

SEQ ID NO: 59430 - RNA, 64 nt, Human
cugagaagcaagaggaggagaaaaagaugucuuuuucuuccaggugaacuggaauuuaguuuug

SEQ ID NO: 59431 - RNA, 64 nt, Human
aucagccauggcccucccagugccuccuagccccuucuuccaaggagcagagagguggccaccg

SEQ ID NO: 59432 - RNA, 64 nt, Human
ggggcagugggcauguuauggggaggggaggggguucuuccagccucaggucccagcugucuca

SEQ ID NO: 59433 - RNA, 64 nt, Human
ggcccccacgagcagcuccaggcuggaguucugguucuuccagguggcucccgcugaggcagcg

SEQ ID NO: 59434 - RNA, 64 nt, Human
gguacagccucugcucauggcacugggccuccaguucuuccacaugugugcacccccagcuugg

SEQ ID NO: 59435 - RNA, 64 nt, Human
acuggauccugguaggggguggcauuuuguuuguuucuuccaaucugcugaaucuuuugacugc

SEQ ID NO: 59436 - RNA, 64 nt, Human
uauugauuccugauccaagaaggguccucugggguucuuccaacaaccuauucuaauagacaaa

SEQ ID NO: 59437 - RNA, 64 nt, Human
gaaacauuacagccuggcauccccagucuuugccuucuuccagcugccucgacacagcacugug

SEQ ID NO: 59438 - RNA, 64 nt, Human
cuucccuuagcaugccaacaagccauuagacugauucuuccaccuauuuuuaugaaccuccagg

SEQ ID NO: 59439 - RNA, 64 nt, Human
gccaccacugacuauaccaacugggccucugauguucuuccagugaggcaucucucugggaugc

SEQ ID NO: 59440 - RNA, 64 nt, Human
uuugcaaaauuguaaccuaauacaaaguguagccuucuuccaacucagguagaacacaccuguc

SEQ ID NO: 59441 - RNA, 64 nt, Human
uuacuacaaaaauucagugacauucauuauaacauucuuccaagugaauugccugacuuugaug

SEQ ID NO: 59442 - RNA, 64 nt, Human
gggaggccuuccuauggcuguacaauuacaucgauucuuccaaauuucauauuucauacauggc

SEQ ID NO: 59443 - RNA, 64 nt, Human
uacuaaauagcaggcacuugaaaauggguguguuuucuuccauugucgucuuuucuauugaggg

SEQ ID NO: 59444 - RNA, 64 nt, Human
ugggcuuugcuagccuguacaaccuacaugucuuuucuuccacugccugaaagacuuggguuga

SEQ ID NO: 59445 - RNA, 64 nt, Human
gaacugugacacccccaucuucgacuucagagucuucuuccaaggucagugaggcccuugccug

SEQ ID NO: 59446 - RNA, 64 nt, Human
cacugccagucucacuuguggccuauuucucugcuucuuccaggaauuugcuuuuauuagucaa

SEQ ID NO: 59447 - RNA, 64 nt, Human
ucccagggcucccggcugguuucagcaggcgacuuucuuccaaugcugggcccagacuucuugc

SEQ ID NO: 59448 - RNA, 64 nt, Human
caaaaaccaaguauccuugugguucaagccuguuuucuuccaucuucaggacucgugccuucug

SEQ ID NO: 59449 - RNA, 64 nt, Human
gucuucuuccuguucugguuucuuuuccccuuuguucuuccaguuucuaccagggggccccgug

SEQ ID NO: 59450 - RNA, 64 nt, Human
cuguuugaacucucaagcuuugaagaccuaccuguucuuccagaagagaacguugaaagugcca

SEQ ID NO: 59451 - RNA, 64 nt, Human
ccaaacugcugucucuuaaaucucuuaaacucucuucuuccauuagaaugcuacaaguaacuca

SEQ ID NO: 59452 - RNA, 64 nt, Human
aucuuaaggacuaaagcagaauguaggagagggauucuuccaaaggccuucaaaucaaauuaga

SEQ ID NO: 59453 - RNA, 64 nt, Human
ggaacucuggagcacuucagagacuucccagagcuucuuccaagggagaagauauucucgugaa

SEQ ID NO: 59454 - RNA, 64 nt, Human
ggggguuuguguuuuguuuuguuuuugguauguuuucuuccagaggugauauacuuucuuuuuu

SEQ ID NO: 59455 - RNA, 64 nt, Human
uuuagggcuuuaccuuaaaagcucauuuuuuucauucuuccaucccuaggaaaguacuuaaaac

SEQ ID NO: 59456 - RNA, 64 nt, Human
cuccuggguuucauguucugugacauccugcuucuucuuccaaaugcaguucauugcagacacc

SEQ ID NO: 59457 - RNA, 64 nt, Human
gugcugagaggcgagcuccuugaagaaggggcuguucuuccaggaggccuuauuuugaacugcc

SEQ ID NO: 59458 - RNA, 64 nt, Human
ugacuugguggcguucccacuugauuuagccauuuucuuccauugugagaccacugccaucuau

SEQ ID NO: 59459 - RNA, 64 nt, Human
agcaaccugggacucaauaauacacuugggaauauucuuccacaccguccagauuucauuugau

SEQ ID NO: 59460 - RNA, 64 nt, Human
gaacaguuugccucccucccagccucaaccacaauucuuccaugcuggggcugaugugggcuag

SEQ ID NO: 59461 - RNA, 64 nt, Human
cuaucuuaauauaguguggaauuuuauuguauuauucuuccauucuuaauacuguaccacauuc

SEQ ID NO: 59462 - RNA, 64 nt, Human
ugcagguuuagaaaaaugguuuucauauucaccauucuuccaccucauugaauugcaugcugua

SEQ ID NO: 59463 - RNA, 64 nt, Human
acaaaauugauaaucauauagcgaaggcauauuuuucuuccaagcucaagucaggauugugacu

SEQ ID NO: 59464 - RNA, 64 nt, Human
gguuuuugcaucuuuccaggagagccucacauucuucuuccagguuguaucacccccgaguuag

SEQ ID NO: 59465 - RNA, 64 nt, Human
aacuucucuucugaaaacugaggaguguccucuguucuuccaguucacgagggcaggggguuua

SEQ ID NO: 59466 - RNA, 64 nt, Human
cuaagcccuaaccccacuuagugaccucaguguuuucuuccauuccuucuuacugcccuguccu

SEQ ID NO: 59467 - RNA, 64 nt, Human
uaugaagcugagauucugaaggacccagcuuagguucuuccacuuaggccucaauucccuuccu

SEQ ID NO: 59468 - RNA, 64 nt, Human
uuaaccagucuuuaagguuuugcaggaaagucccuucuuccaagugguuuuuccaaaucgcaca

SEQ ID NO: 59469 - RNA, 57 nt, Human
auucucaaggaaguuccugaaaagauuuucuuccauuucuaagacuguuauuuacaa

SEQ ID NO: 59470 - RNA, 64 nt, Human
uuuuuuuuccuucauggagacuguuuguuuggcuuucuuccauuguuguuuuuguagcauuuau

SEQ ID NO: 59471 - RNA, 64 nt, Human
augugcuaugaacuaauuuucuggucuauaugacuucuuccaggagggccuaauacacaggaag

SEQ ID NO: 59472 - RNA, 64 nt, Human
ucccuucuacuguguagaauacuuugacuuaauuuucuuccagauacagggggauaccugccug

SEQ ID NO: 59473 - RNA, 64 nt, Human
ggcggcacagccuggggcccugugauccucugguuucuuccauuggggcggagucggggaugga

SEQ ID NO: 59474 - RNA, 64 nt, Human
aggacugacugccugggaggaggguuaggucugcuucuuccacuuauacuuagucucugugcuc

SEQ ID NO: 59475 - RNA, 64 nt, Human
acagugauuuuauuagaaguuucauccgcaaauuuucuuccauuucauugcucagaaaugucau

SEQ ID NO: 59476 - RNA, 64 nt, Human
ugcuuccaacuuugucagucuuuucugccucaacuucuuccagacaucagucaccaugagacug

SEQ ID NO: 59477 - RNA, 64 nt, Human
ugaaacuguccucuaagagaauaagcauuuccuguucuuccagcuccagguccaccuccuguug

SEQ ID NO: 59478 - RNA, 64 nt, Human
caauaacaaggugaaaucaauauuguugagaagauucuuccaucugguaauguugagaagacuu

SEQ ID NO: 59479 - RNA, 64 nt, Human
guuuugauagaagggaagaccugcagugcacgguuucuuccaggcugagguaccuggaucuugg

SEQ ID NO: 59480 - RNA, 64 nt, Human
aaaaagauuuuagaauuuuaaaauuuucaaagauuucuuccauucauaaggagacucaaugauu

SEQ ID NO: 59481 - RNA, 64 nt, Human
aacauccaaguccaaacccuuuuuagguuauccuuucuuccaucacauccccuuuuccaggccu

SEQ ID NO: 59482 - RNA, 64 nt, Human
agaaauagauaagggccuuggauuccaacacaguuucuuccacauccccugacuugggcuagug

SEQ ID NO: 59483 - RNA, 64 nt, Human
uugugaaaaaaaauuuuauagugucuugggaauuuucuuccaaacagaacuauggaaaaaaagg

SEQ ID NO: 59484 - RNA, 64 nt, Human
uucaucugcaccuguaauaguuucaguuccuauuuucuuccauugacccauauuuauaccuuuc

SEQ ID NO: 59485 - RNA, 64 nt, Human
uacuuuuaguaaccauguuccuuguuuccuuuuauucuuccaucugaagccccacucuuaaaaa

SEQ ID NO: 59486 - RNA, 64 nt, Human
uuauauuugaauauccauucucguuuuaggacucuucuuccauauuagugucaucuugccuccc

SEQ ID NO: 59487 - RNA, 64 nt, Human
uucgguaucaccuggggaagccccggaaucuuaguucuuccauucccuacucuuccuuccgagg

SEQ ID NO: 59488 - RNA, 64 nt, Human
acacuggggauuccuggucuguaacuugaauuguuucuuccacauguucuuaaguacuagaguu

SEQ ID NO: 59489 - RNA, 64 nt, Human
gaaaacgcugcuauacuuacucugguuacuacauuucuuccacuccccuuuccccuaccugccu

SEQ ID NO: 59490 - RNA, 64 nt, Human
ggggagcacagacacaggauaggacuccauuucuuucuuccauuccuucaugucuaggauaacu

SEQ ID NO: 59491 - RNA, 64 nt, Human
ugccaugcaagccacagccagccagcccauccacuucuuccacuccuccccgcaggccccaagg

SEQ ID NO: 59492 - RNA, 64 nt, Human
cugauuucuuagcuugaacauuauucacuuagauuucuuccaguauuuuuuaaaaaacuguccu

SEQ ID NO: 59493 - RNA, 64 nt, Human
cugcugcaggcaggaaggcaugugaguguacguuuucuuccaggagacaucaggucccccugga

SEQ ID NO: 59494 - RNA, 64 nt, Human
cugacagguauuuuagaucaugaucucaacaauauucuuccaaaauggcauacaucuuuuguac

SEQ ID NO: 59495 - RNA, 64 nt, Human
gccuucugcucaaacaaaucagauuuauuucacauucuuccauuauuccauuuuccugcugguc

SEQ ID NO: 59496 - RNA, 64 nt, Human
ucaucuguggagagaaucaugcaaauuuuaaaaguucuuccaagagacuuccauguccugguua

SEQ ID NO: 59497 - RNA, 64 nt, Human
agcucuuccagugggcaaagaggacgcccauaauuucuuccauugcuagcucaucugugggacc

SEQ ID NO: 59498 - RNA, 64 nt, Human
auuucuccccaccacggaaccuuccaucuaagauuucuuccagggaaugccagcaaucaggcag

SEQ ID NO: 59499 - RNA, 64 nt, Human
uuggccauaaagugguauuaaaacuggaucucuuuucuuccauggcacuacucucauuuugaag

SEQ ID NO: 59500 - RNA, 64 nt, Human
cacugcagacucagauacagaugcgaaaaauuccuucuuccaccgcccuucucguucuguaaag

SEQ ID NO: 59501 - RNA, 64 nt, Human
uuuauuccaagaauaacacuuagcacauaaacucuucuuccagcucguuagcagcauuagcacc

SEQ ID NO: 59502 - RNA, 64 nt, Human
uggguguguguguauuuggguguguaaauguugguucuuccacuacuggauuuuguaaucuagg

SEQ ID NO: 59503 - RNA, 64 nt, Human
uuaaaugucuacuuaguuaauuaguuagcugauauucuuccacaauuaauauauucaauuuccc

SEQ ID NO: 59504 - RNA, 64 nt, Human
caaugacuaguccucauccauguagcaccacuaauucuuccaugccuggaagaaaccuggggac

SEQ ID NO: 59505 - RNA, 64 nt, Human
agcagccccgccucgcaguguggaagccugaucauucuuccaucagcucugcaccaaaaagcuu

SEQ ID NO: 59506 - RNA, 64 nt, Human
aaauuuagaugcaaauaacauuagaaaaaaaagauucuuccauaauuaacauaagugguuccua

SEQ ID NO: 59507 - RNA, 64 nt, Human
uucagagaugcaucuacaaagaaggcuaaugucauucuuccaguagaaucaagcaaauccuucc

SEQ ID NO: 59508 - RNA, 64 nt, Human
aaugauuuguagaaacuugguuuucuaagcauaguucuuccauaaccaccuuuuguuguuugag

SEQ ID NO: 59509 - RNA, 64 nt, Human
cuuaauagcuuaauuaccauuuuauuuuuuauacuucuuccauuauuaaucuuuaaaucaugau

SEQ ID NO: 59510 - RNA, 64 nt, Human
cugcaggccgaggcccuucuggggguuucuaucuuucuuccaccagacuccaagcccacucucc

SEQ ID NO: 59511 - RNA, 64 nt, Human
ugcccacaguugaacacaagugcugucauugcauuucuuccauugugaauacgaauuuucuucc

SEQ ID NO: 59512 - RNA, 64 nt, Human
uaugaaucggugcugucagcccugcugucagaccuucuuccacagcaaaugagauguaugccca

SEQ ID NO: 59513 - RNA, 64 nt, Human
gagccuuaauggaugcucauucauauuccugccuuucuuccaucagcucucugcaaagaugauu

SEQ ID NO: 59514 - RNA, 64 nt, Human
ucaaacuugauuuucuuuccuuuuucuuuuuuuuuucuuccagaaugucuuauuuaaaaagaaa

SEQ ID NO: 59515 - RNA, 64 nt, Human
aagguucuggcccaucaauauucauuucauuuaauucuuccacagaaccaguuugggcaguagg

SEQ ID NO: 59516 - RNA, 64 nt, Human
uuccauugagaccagacauggagcaacacuuuuuuucuuccagguuauuaaaugggucaaccag

SEQ ID NO: 59517 - RNA, 64 nt, Human
aacagucaacauuuuagauucgguaaccuuuuuuuucuuccaauuauaaucucugcuagccacu

SEQ ID NO: 59518 - RNA, 64 nt, Human
ggccccaacuuugauggcacauuuaauacccaauuucuuccauaauagauauuuuuaauagcag

SEQ ID NO: 59519 - RNA, 64 nt, Human
uagaccugcagauacgaagcaaaccugggauugcuucuuccagguaugggcaccagagagggaa

SEQ ID NO: 59520 - RNA, 64 nt, Human
aauguauguugagaagucaguccaaggagguauguucuuccacaacagccuucucagccucugc

SEQ ID NO: 59521 - RNA, 64 nt, Human
gguucaacauucaggacuguuucuggccgaggacuucuuccaauuaaaacccccaccgugggcu

SEQ ID NO: 59522 - RNA, 64 nt, Human
cacuccugccaaggaggauuccauuuggcagagcuucuuccaggugcccagcuauaccugugcc

SEQ ID NO: 59523 - RNA, 64 nt, Human
aacggcaaggagagcccaagccccaaugccagaauucuuccaaacucccugacucuuugaaguu

SEQ ID NO: 59524 - RNA, 64 nt, Human
ccauuaagucaugggcauauccccagugccauuguucuuccaaaugcuacccaugacuacaaca

SEQ ID NO: 59525 - RNA, 64 nt, Human
aaagccucuaauggacugaccuuaaaacucauccuucuuccacugucucauccacauaagcacu

SEQ ID NO: 59526 - RNA, 64 nt, Human
aacucacccucuauuccuccuuucuccccucccuuucuuccaauucauugucuuuuuuuuccuc

SEQ ID NO: 59527 - RNA, 64 nt, Human
augcauuuaggcauuguagagaucugaaauaguuuucuuccacuacauuguugaaaucaaugaa

SEQ ID NO: 59528 - RNA, 64 nt, Human
cuuugaccauuggugaggauagauauaaaaucacuucuuccaacgaagccuaggugaaaaucua

SEQ ID NO: 59529 - RNA, 64 nt, Human
cccaggccuucucacaugggcaccaugaaacacuuucuuccaggccaccugagccuucguucuu

SEQ ID NO: 59530 - RNA, 64 nt, Human
uggcugcuucaaaggccagagucacaggaaggacuucuuccagggagauuaguggugauggaga

SEQ ID NO: 59531 - RNA, 64 nt, Human
aauucugugaauuagcaccccacccccauaccccuucuuccacccccagacuaaaggaagauac

SEQ ID NO: 59532 - RNA, 64 nt, Human
ucaggcuuagucugaccuuucugguuucuucauuuucuuccauuacuuaggaaagaguggaaac

SEQ ID NO: 59533 - RNA, 64 nt, Human
gcugccaccuaaagacaagagugagagggcugaguucuuccaggucaucagaguuguugcugcc

SEQ ID NO: 59534 - RNA, 64 nt, Human
cuaaccuugauagugauacguuagaggguuccuauucuuccauuguacgauaaugucuuuaaua

SEQ ID NO: 59535 - RNA, 64 nt, Human
uguucagcagauacuucaguaggauacauagcuuuucuuccagugaaacaaaguucauaucauc

SEQ ID NO: 59536 - RNA, 64 nt, Human
cuugccaaugaagauuuaaagacagagcaggagcuucuuccaggaguucugagccuugguugug

SEQ ID NO: 59537 - RNA, 64 nt, Human
agaagcggaaaacuaccuaggguccaacugcuuauucuuccaacuguggaacacaaggggaguc

SEQ ID NO: 59538 - RNA, 64 nt, Human
ugguuuucacugaaauuccuggagggcucauauuuucuuccacgugccucuugaucuguucugu

SEQ ID NO: 59539 - RNA, 64 nt, Human
gggaaguguuagcuuccuuuccuucuuccaucccuucuuccaucuuuccagcugucaaauccaa

SEQ ID NO: 59540 - RNA, 64 nt, Human
ccaguuugaugugggaaguguuagcuuccuuuccuucuuccaucccuucuuccaucuuuccagc

SEQ ID NO: 59541 - RNA, 64 nt, Human
uccuagaagguuuaaauaauacaucaaaguuauuuucuuccaaauguaauuuuaugucugcuuu

SEQ ID NO: 59542 - RNA, 64 nt, Human
gagccggcuggcccgggagcuccuugccugccacuucuuccaggggacagaauaacccagugga

SEQ ID NO: 59543 - RNA, 64 nt, Human
ucacagggaacccaccaagaccaaccuggucacauucuuccauaccgaccucagcgguuaccuc

SEQ ID NO: 59544 - RNA, 64 nt, Human
ggccauucuuuuccugucuuauuucuaaauuuccuucuuccaagaugaaaacaaaagaaaaacu

SEQ ID NO: 59545 - RNA, 64 nt, Human
accagcuggccacaggcacaagggcugcagcugcuucuuccaggaaacugacacagggagcuca

SEQ ID NO: 59546 - RNA, 64 nt, Human
aagagcaaaggcuuuuuuuuucuucaaccccauuuucuuccauuucucccaccuuuuuaaugcc

SEQ ID NO: 59547 - RNA, 64 nt, Human
cuaguuaggccaucaacaagcauucuuuuuauauuucuuccaguauaauaaauuauugauauca

SEQ ID NO: 59548 - RNA, 64 nt, Human
aucaaauaaggggaggagacgaaaauggaaugauuucuuccaugccaccugugccuuuaggaac

SEQ ID NO: 59549 - RNA, 64 nt, Human
cuuagccauguaauggagaaaggagcagucagcauucuuccaauuugccccaccaccaccuccu

SEQ ID NO: 59550 - RNA, 64 nt, Human
uguuucugcagcauggaucagcaaggcucuuucguucuuccagcaaaggcuuccaagguacaac

SEQ ID NO: 59551 - RNA, 64 nt, Human
uagggaguugaaacuaucaacuguaaagcuccuuuucuuccacuuuaauuuaaaaguucauguc

SEQ ID NO: 59552 - RNA, 64 nt, Human
gagagaaaauguucaucugugcagaggaugcauuuucuuccauuaauucuggaaaaaacguuca

SEQ ID NO: 59553 - RNA, 64 nt, Human
auauucagauuuaaaagguuuucaaagaauuacuuucuuccauguucaaagcuagauuuuacua

SEQ ID NO: 59554 - RNA, 64 nt, Human
uauuccucccucccuccuuucucccuuccuuccuuucuuccauucauccuuccuugccuuuuau

SEQ ID NO: 59555 - RNA, 64 nt, Human
ugcuggaccagacucucuggcagaggagguggaguucuuccaugcaggagcacggcauggcggg

SEQ ID NO: 59556 - RNA, 64 nt, Human
auguugcagccaccggaggcugcaaggauguggguucuuccaggugugggcccagccccccucc

SEQ ID NO: 59557 - RNA, 64 nt, Human
ugcagggaggaggcagcagacacuggagaugacauucuuccacacgagacggggcuucagccgg

SEQ ID NO: 59558 - RNA, 64 nt, Human
ccccgccuccuccagccccugcaccugucauuuauucuuccacugcccaauaaauauucauggc

SEQ ID NO: 59559 - RNA, 64 nt, Human
uccccagaccugcagcuugcauggggccccucccuucuuccacacccacccuccguaugguccc

SEQ ID NO: 59560 - RNA, 64 nt, Human
auauauuaugagcauuucccuauaauauacaauauucuuccacauuauguuuaaugguuucauu

SEQ ID NO: 59561 - RNA, 64 nt, Human
uuggacaaagugugaccaaauuagccagucuguuuucuuccauguuuaauuagaagugagaggu

SEQ ID NO: 59562 - RNA, 64 nt, Human
cucggccccaucgccccaccgcagcuacuccccuuucuuccaaacuuuugcagaaaaaacaaaa

SEQ ID NO: 59563 - RNA, 64 nt, Human
aggcaucggggagccgggagccugacccucaucuuucuuccaaacaggcucagaggguguccug

SEQ ID NO: 59564 - RNA, 64 nt, Human
cuuguuuuuccuagauaauucucuaaaaauaugauucuuccauauagaaugcuaagcuuauuuu

SEQ ID NO: 59565 - RNA, 64 nt, Human
ugaugaacagccucauuuccccagcuucccugauuucuuccagaugggacguuuuauuugugug

SEQ ID NO: 59566 - RNA, 64 nt, Human
acacuuggaauaagauuuguaagcucacaaagccuucuuccaaaguugcuugagccaagugcuu

SEQ ID NO: 59567 - RNA, 64 nt, Human
cuggucuacauggaugcccugaacaugcaauucuuucuuccaaaauaaaacauuaaauagagau

SEQ ID NO: 59568 - RNA, 64 nt, Human
ucucaggucagguaccuuggugaucagcuacuaguucuuccagcccucauugagguaacaagau

SEQ ID NO: 59569 - RNA, 64 nt, Human
uauguugguuauuuucuuuaugaaaauaaaccaguucuuccaaggaaguuaaaaggcuugguau

SEQ ID NO: 59570 - RNA, 64 nt, Human
gccugguucccucuuuccugugccaggacucucuuucuuccacuacccucccucgcauccgccu

SEQ ID NO: 59571 - RNA, 64 nt, Human
uccuccuuauaagcccagcucugcuuuuuccagauucuuccacuggcuccacauccaccccacu

SEQ ID NO: 59572 - RNA, 64 nt, Human
gguccgcagaagcagaccucauugauugaguccuuucuuccauccccuuggccugcucccugua

SEQ ID NO: 59573 - RNA, 64 nt, Human
uacauugaacacauuuccuuuacccuccacacacuucuuccaaaaggaagcacccguugagucc

SEQ ID NO: 59574 - RNA, 64 nt, Human
gcacagaucgucaaggcagguacccccucaacccuucuuccacuggagccccugacaccacagg

SEQ ID NO: 59575 - RNA, 64 nt, Human
aagccccccaccccucccugcccccucccuggccuucuuccaccuauccaccccaaugccucuc

SEQ ID NO: 59576 - RNA, 64 nt, Human
auuugggcgggcuggcucuuuugcagcuugugauuucuuccagcuugggaggggcugcuggaag

SEQ ID NO: 59577 - RNA, 64 nt, Human
acaagauacacuggagaacaaagggaacucaagauucuuccagccacaugucaccuguagguag

SEQ ID NO: 59578 - RNA, 64 nt, Human
cgugacuacacagaguuacuggcacaaguuuaucuucuuccagauuuccuuucagaacacucaa

SEQ ID NO: 59579 - RNA, 64 nt, Human
ugaauuuuuuaugcucaggagcauuggaauccucuucuuccagggaggaauuagccugcaaggu

SEQ ID NO: 59580 - RNA, 64 nt, Human
ggcaccagcacgugcuuuucagaggcugcggacuuucuuccagccauuguggcauuggccuuuc

SEQ ID NO: 59581 - RNA, 64 nt, Human
auuggguuuguuuucuguuuguugguuuguuuguuucuuccacguaaggaaaaguaguguaaac

SEQ ID NO: 59582 - RNA, 64 nt, Human
ucuguacucacaaaagagaaucucauuuucuucuuucuuccauucccuuaaauucugaguacug

SEQ ID NO: 59583 - RNA, 64 nt, Human
ggaaaacugcauuuucucuuccaaaaaggaaagguucuuccaggcgagaaaccuguggucuaga

SEQ ID NO: 59584 - RNA, 64 nt, Human
ggaauggcugggcugccaggccagacacgcuagguucuuccaaagagucccaagcccagcaccu

SEQ ID NO: 59585 - RNA, 64 nt, Human
caagacucugucucauaaauaaauacaaagcccauucuuccagagucuugugccuuaaauaaaa

SEQ ID NO: 59586 - RNA, 64 nt, Human
uugauuuuggaauucugucaccuuauguagugaguucuuccaaaauauaauuuuuuuucaauaa

SEQ ID NO: 59587 - RNA, 64 nt, Human
ccuuaucuuacugaauucuuaaacuuugaaccaguucuuccacuuacugacuuguuaccacugc

SEQ ID NO: 59588 - RNA, 64 nt, Human
ccuaucuugacccccaaauccagugagcuccagauucuuccaaggcaaaagagguaagcagauc

SEQ ID NO: 59589 - RNA, 64 nt, Human
acuccuucuccuaccaugccuuucuacguucucuuucuuccaagccuagagccaccagcccagc

SEQ ID NO: 59590 - RNA, 64 nt, Human
augaguccucacucuguguccugagcccgugucauucuuccaaccucccugcccccacacacuu

SEQ ID NO: 59591 - RNA, 64 nt, Human
auucuuugggccuucugaguuuaauggccauauuuucuuccaguuuauuuuccuuccccaugcu

SEQ ID NO: 59592 - RNA, 64 nt, Human
ccauuuggucagcuuccccgccacgggcaccucguucuuccacacccuguccugguggggcugu

SEQ ID NO: 59593 - RNA, 64 nt, Human
augaugauuuugcugacuuccacuccaguaaauuuucuuccauaaacucggacaaaucccuggg

SEQ ID NO: 59594 - RNA, 64 nt, Human
gccccccuuaacuugaggccagggacccucucccuucuuccagccaagccucuccacuccuucc

SEQ ID NO: 59595 - RNA, 64 nt, Human
uuuccuaaauaaggguccccuuauuuuucugcuuuucuuccaaugaauuaagacaaguuauuuu

SEQ ID NO: 59596 - RNA, 64 nt, Human
uccucuguccccaacuucuuaagcacaauugggcuucuuccaucuccagguuuucugccauucu

SEQ ID NO: 59597 - RNA, 64 nt, Human
caaauacaaacacccaggauccuuucuugauugguucuuccaaacaaaugaggcaucagucuga

SEQ ID NO: 59598 - RNA, 64 nt, Human
caauguuaauauugcuuuaugaauuaacagucuguucuuccagaguccagagacauuguuaaua

SEQ ID NO: 59599 - RNA, 64 nt, Human
ugaaagccugcaggacuggucguuuuuuuggcaauucuuccacgugggacuuguccacaagaau

SEQ ID NO: 59600 - RNA, 64 nt, Human
ugacacccugaguccaaacccuugugccucccaguucuuccaagugucuaacuagucuucgcug

SEQ ID NO: 59601 - RNA, 64 nt, Human
gggugggucucagacguuuuuccuauggacuuauuucuuccauguccaggacuuugcacaacuu

SEQ ID NO: 59602 - RNA, 64 nt, Human
ccaaugagacuuuucagccuuuguacauacaaaauucuuccaaaagagagaggagaaaauacag

SEQ ID NO: 59603 - RNA, 64 nt, Human
uggcauuaucaguugaacuguaaauacaaaaugcuucuuccaauuagucucuaugaugauuaag

SEQ ID NO: 59604 - RNA, 64 nt, Human
guaaggaugauuuuaacaacuuuuuaauauguaauucuuccauguggagguauucaauacugua

SEQ ID NO: 59605 - RNA, 64 nt, Human
cccgcccuccugggcagauuggguagaaaggacauucuuccaggaaaguugacugcugacugau

SEQ ID NO: 59606 - RNA, 64 nt, Human
auugacucaaggccugccuaacuggcugggucguuucuuccauccgaccucguuucuuuucuuu

SEQ ID NO: 59607 - RNA, 64 nt, Human
gagauugcauuucuagcagagaauuccuucagccuucuuccaaagcuagcuuggaaucuacaag

SEQ ID NO: 59608 - RNA, 64 nt, Human
ggaauuuguaaacaggguagcaaacaagauauuuuucuuccauguauacaauaauuuuuuuaaa

SEQ ID NO: 59609 - RNA, 64 nt, Human
cgcuucuuguugcauuaguucuccuguauguuccuucuuccacaggaauguauuugugcauaug

SEQ ID NO: 59610 - RNA, 64 nt, Human
acuguugagauaaaaguugagcacauuuugagacuucuuccaaauuggucccuagaaaguuaca

SEQ ID NO: 59611 - RNA, 64 nt, Human
uucguuuuuuaaaaacugauauauucugaauuuauucuuccauugagaaaaaaauguucaguua

SEQ ID NO: 59612 - RNA, 64 nt, Human
ugcuucagaaccuuuuguugucaacugucacuguuucuuccaaaagucacaauuuguacaagaa

SEQ ID NO: 59613 - RNA, 64 nt, Human
agguacuguaauccuaccauaaguagguagguauuucuuccacuguaaaucauagggguuugcu

SEQ ID NO: 59614 - RNA, 64 nt, Human
uuuuuauacuuuauugaaaggggacaccuguacauucuuccaucaucacuguaaagacaaauaa

SEQ ID NO: 59615 - RNA, 64 nt, Human
ucucuucucuucuccugacgucucuccacuccucuucuuccaaauacgaugcuauuuucagagu

SEQ ID NO: 59616 - RNA, 64 nt, Human
gacaucuucagcaaauaaacuaggaaauuuuuuuuucuuccaguuuagaaucagccuugaaaca

SEQ ID NO: 59617 - RNA, 64 nt, Human
uuucucuuaauaagcccacauauaaauguacuuuuucuuccagaaaaauucuccuugaggaaaa

SEQ ID NO: 59618 - RNA, 64 nt, Human
uagauuccagcuaaaccuaacuuggcugucauuuuucuuccauuauagugugaguggagacugc

SEQ ID NO: 59619 - RNA, 64 nt, Human
aguuugagauucagggaaugagaccaccucucauuucuuccagcaugaucgcgcccugcucccg

SEQ ID NO: 59620 - RNA, 64 nt, Human
acgccugugccgccacugucccaaggacuggacauucuuccaaggaaacuguuacuucaugucu

SEQ ID NO: 59621 - RNA, 64 nt, Human
acuucuagugacuuccccgguauccacucucaucuucuuccaauaucaagagaauccagguucu

SEQ ID NO: 59622 - RNA, 64 nt, Human
acuaugaaugcaagcaauguggcaaagcuuucacuucuuccaguucuuuucaauaucaugaaag

SEQ ID NO: 59623 - RNA, 64 nt, Human
ccuaucaauguaagcaaugugcaaaagccuuuauuucuuccacuucuuuucaauaucaugaaag

SEQ ID NO: 59624 - RNA, 64 nt, Human
cuaugaauguaagcaauguggcaaaagcuuucacuucuuccaguucuuuucaauaucaugaaag

SEQ ID NO: 59625 - RNA, 64 nt, Human
ccgcauguguuuggcgcugugcuaggggcgggaguucuuccagacucuuggaccagcccgcccu

SEQ ID NO: 59626 - RNA, 64 nt, Human
ccaggggcugccacacuccugaaugccuuaacauuucuuccauggccccacaccauggcauccg

SEQ ID NO: 59627 - RNA, 64 nt, Human
guuugcuuuuacagauaucugaauggaagaguguuucuuccacaacagaaguauuucuguggau

SEQ ID NO: 59628 - RNA, 64 nt, Human
agggccuugaagguuauggacaggggccugggcuuucuuccaagggcacugggggagccauggc

SEQ ID NO: 59629 - RNA, 64 nt, Human
uaauaaaguuacuugcuuuaggauuugcuuguuuuucuuccacuucagaagcuucugagaggga

SEQ ID NO: 59630 - RNA, 64 nt, Human
auugcuuuuccugggcugggcuccugaguguugguucuuccagcugugcacaggggauuucaaa

SEQ ID NO: 59631 - RNA, 64 nt, Human
auggaccacuauacucggggaggcaggguagcaguucuuccagaaucccaagagcuucucuggg

SEQ ID NO: 59632 - RNA, 64 nt, Human
guauuauuuauucuaugcugagcuuacauagaauuucuuccauguuuucuauagcuauagugua

SEQ ID NO: 59633 - RNA, 64 nt, Human
cauuccugccugccagcucugaagagagcagcaguucuuccagcacagcgcuugagcucugcua

SEQ ID NO: 59634 - RNA, 64 nt, Human
auguaaauucuuggucucacaugacacuuggucauucuuccagccuccaugucaccacguggug

SEQ ID NO: 59635 - RNA, 64 nt, Human
cagucaccaccccaacaugcucagggaggcagaguucuuccauuaguuggaggaaagcacgagu

SEQ ID NO: 59636 - RNA, 55 nt, Human
ccucccgcagcauuccaugaucuacuucuuccaccacuacgagcugccugccauc

SEQ ID NO: 59637 - RNA, 64 nt, Human
uuccuaaucacuugaugggugguaccaccuagaauucuuccagcagccuguaaugggagggcua

SEQ ID NO: 59638 - RNA, 64 nt, Human
ccugcuggccuaccguugccuucaguggcccgcauucuuccaccagccaccacccuccgacccc

SEQ ID NO: 59639 - RNA, 64 nt, Human
uucacuguacccuguuccuccugggcucaagugauucuuccaccuaaauuuuuuuuuuuuuuuu

SEQ ID NO: 59640 - RNA, 64 nt, Human
ugggacaacuuaaaucucccuucugcugucauaguucuuccaacucaguugccuuuuuuuuuuu

SEQ ID NO: 59641 - RNA, 64 nt, Human
ugaaaaagccacaaauuuaugaaacauuagagaauucuuccaaggugacaaauuauauaaugaa

SEQ ID NO: 59642 - RNA, 64 nt, Human
aaagcuuuugaucuuaccuauuauuaucuccauauucuuccaucuguguauauacacacgaagg

SEQ ID NO: 59643 - RNA, 64 nt, Human
cugucuucagguucuagaaacuaccagaagaagcuucuuccaucuuaucuaccuacugcagcug

SEQ ID NO: 59644 - RNA, 64 nt, Human
cuguuucugggagucugauuuuccacuuacacauuucuuccaccuuuccugcuaguucccacuc

SEQ ID NO: 59645 - RNA, 64 nt, Human
gcccagugccaccucuaucuguguacauacucccuucuuccacccagauggguccccuggggua

SEQ ID NO: 59646 - RNA, 64 nt, Human
guugagacaugguggaaauuguguagcucugugauucuuccaggggcauguuauuuuagguucu

SEQ ID NO: 59647 - RNA, 64 nt, Human
caaaauauuccagaguucuugcccuuaacccagcuucuuccaaagauaacaacuuacauaagca

SEQ ID NO: 59648 - RNA, 64 nt, Human
uuuucuuauagguuuauuuugguuuguguugcuguucuuccaauaaacgaucaucuuauuaguu

SEQ ID NO: 59649 - RNA, 64 nt, Human
uguaauaauucuaugcaauuuuguggcaugauguuucuuccacuuguaauuuuaugugcuuuca

SEQ ID NO: 59650 - RNA, 64 nt, Human
guuuucuuuugggggccuuccccuuuuacuccuuuucuuccagagaucaagagcuucucuugca

SEQ ID NO: 59651 - RNA, 64 nt, Human
uuuucuuccagagaucaagagcuucucuugcaucuucuuccacugggcucuggauuaaucaauu

SEQ ID NO: 59652 - RNA, 64 nt, Human
guuuacuucucucauaacuacuuucaagguauuuuucuuccaagcugaaauaaaacuggggcca

SEQ ID NO: 59653 - RNA, 64 nt, Human
ccucuaccucuggccugccccuauuucugaaagcuucuuccagucccugaucuggcucauuccc

SEQ ID NO: 59654 - RNA, 64 nt, Human
ucccaaguucuccuucagaaccuaguugcuuuuauucuuccagcuaccacuugggcacuucaca

SEQ ID NO: 59655 - RNA, 64 nt, Human
uugcuuggguucuugcaagagcgcguggggacaguucuuccagcaggcacugguuuuguugccc

SEQ ID NO: 59656 - RNA, 64 nt, Human
accuuaggaauauagugccccaaaaggcggaugcuucuuccauuaucuuauuuucuuugauacu

SEQ ID NO: 59657 - RNA, 64 nt, Human
acacacguucaugugcacccaagaaccuaugacuuucuuccaguuccuucuaccagguccccau

SEQ ID NO: 59658 - RNA, 64 nt, Human
acaugguguauagcaccaaaaaauggagggauuauucuuccaguaguugaacacugucauccgu

SEQ ID NO: 59659 - RNA, 64 nt, Human
ugcaggaaccuguguaaguauugugaaaacccuuuucuuccagggaaaaauuauuggaaauucc

SEQ ID NO: 59660 - RNA, 64 nt, Human
cccaacaguuggcaaguuguuuauuuuauauuauuucuuccaggaccuacuugcucagaucucc

SEQ ID NO: 59661 - RNA, 60 nt, Human
ugcagacuaaagggagcuagagcccuuuauuucuuccaaccuugcaaggaccacacuccc

SEQ ID NO: 59662 - RNA, 64 nt, Human
uuccuaggcagucucuuccccaaagucucaccuuuucuuccaauagaaaauuccgcuugaccuu

SEQ ID NO: 59663 - RNA, 64 nt, Human
aaacuuuguuugguuacaguuuucaggggagcguuucuuccaugacacacagcaacaucccaaa

SEQ ID NO: 59664 - RNA, 64 nt, Human
cucuuucaccaaaauauacucguauuuuuuauauuucuuccauguggcuggcuauauuccaaga

SEQ ID NO: 59665 - RNA, 64 nt, Human
uaugcuggggacucuaacaugugagcucauuaaauucuuccagcauucuaaaggaggguuugug

SEQ ID NO: 59666 - RNA, 64 nt, Human
caggacuguauuuucauggagaagaaccugcagauucuuccauccucagcuggccauggcccac

SEQ ID NO: 59667 - RNA, 64 nt, Human
uaaaauacaaagacuuuuaagauuuuaaggcccuuucuuccaacagcuuuuauaguuagcagcc

SEQ ID NO: 59668 - RNA, 64 nt, Human
ccagaaacugaaccccaggaauugcuuacacacuuucuuccagcguagcaucucuucaaacaca

SEQ ID NO: 59669 - RNA, 64 nt, Human
uggggucuguuuuguucauuacuuuguucacuccuucuuccauuuauucauucaauaaacauuu

SEQ ID NO: 59670 - RNA, 64 nt, Human
gcuaauuuuuuguauuuuuaguagagacagggguuucuuccauguugcccaggcuggucucgaa

SEQ ID NO: 59671 - RNA, 64 nt, Human
gcugaauccugaggccacugugaauuugcugauguucuuccaacucaguugagugauuuuaagg

SEQ ID NO: 59672 - RNA, 64 nt, Human
ggguccggucauucugaaacugucccuccagagguucuuccagccccacuucuaugcgauguca

SEQ ID NO: 59673 - RNA, 64 nt, Human
uccaagggaaggaggaggaaacugugguguuccuuucuuccaggugacaucaccuaugcacauu

SEQ ID NO: 59674 - RNA, 64 nt, Human
aagacgaagauuccuaggccuuuucaugcuucauuucuuccacuucuccagguagcuacaggau

SEQ ID NO: 59675 - RNA, 56 nt, Human
guacaccaaagaacacauaagaugccuucuuccaucaaaugcacuugcuugugaau

SEQ ID NO: 59676 - RNA, 64 nt, Human
acaugguuugucagccuuucuccuguuuauggguuucuuccagcagaacagagacauugccaac

SEQ ID NO: 59677 - RNA, 64 nt, Human
cggauguccagaugccccgcuugucuugcuggguuucuuccaaccaucucgucauuuaaaggga

SEQ ID NO: 59678 - RNA, 58 nt, Human
uuauuucccuccuguccuaggaauuugauucuuccagaaugaccuucuuauuuaugua

SEQ ID NO: 59679 - RNA, 64 nt, Human
ucccacauuuuccuaggguuaacaccucaccaaguucuuccagcaaaaugcuuauuagaguuuu

SEQ ID NO: 59680 - RNA, 64 nt, Human
gcagcucagcaugggcagacaugggggcuguggauucuuccagggcggggauggcagauggagc

SEQ ID NO: 59681 - RNA, 64 nt, Human
cagagaccuggguugagcagcagaauaaaagaucuucuuccaagaaaugcaaacagaccguuca

SEQ ID NO: 59682 - RNA, 64 nt, Human; identical to SEQ ID NO: 59681

SEQ ID NO: 59683 - RNA, 64 nt, Human
cagagaccuggguugagccucagaauaaaagaucuucuuccaagaaaugcaaacaggcuguuca

SEQ ID NO: 59684 - RNA, 58 nt, Human
cuuucagguaugggcacuaggaaaagacuucuuccaucaagcuuaauuguuuuguuau

SEQ ID NO: 59685 - RNA, 64 nt, Human
gucaacacuugagcguacaauaucuugaacaugcuucuuccaauggguuuuguuucccauuucc

SEQ ID NO: 59686 - RNA, 64 nt, Human
cagaacccacuuuccacugaugugucucuuggauuucuuccaggugauagauacaaaguguaug

SEQ ID NO: 59687 - RNA, 64 nt, Human
uugacccucuugguuuucuccugucucuggccauuucuuccaguuucccuauuucagagucuuc

SEQ ID NO: 59688 - RNA, 64 nt, Human
acggagggauccagggcaucugugaacuggcugcuucuuccagagagaucucuuggcagaguga

SEQ ID NO: 59689 - RNA, 64 nt, Human
agacaacuuuauaaugucauuuguguugugaaaauucuuccacugacccaaaauggaaccguac

SEQ ID NO: 59690 - RNA, 64 nt, Human
auuaauuguccuuucuucuaaaucccaaccgaacuucuuccaaccuccaaacuggcuguaaccc

SEQ ID NO: 59691 - RNA, 64 nt, Human
uagagcaaaggagggaccucaggccuuccguuucuucuuccagggugggguggccugguguucc

SEQ ID NO: 59692 - RNA, 64 nt, Human
aguuuccuacaugauugcaggcgagaacacgaucuucuuccacaucuccagcaaguucucaagc

SEQ ID NO: 59693 - RNA, 64 nt, Human
ugucuggaucuuauaggaaaagauacuuucuuuuuucuuccaucuuuccuuuuuauauuuuuua

SEQ ID NO: 59694 - RNA, 64 nt, Human
guaaagcaguuccugucccacauggccaucuucuuucuuccacccacaaacuccaggcuggaag

SEQ ID NO: 59695 - RNA, 64 nt, Human
aaauuaaguugucuuuguagaaaaugaagagccuuucuuccagcaaaaaucccugcuguaugca

SEQ ID NO: 59696 - RNA, 64 nt, Human
agaugucacauaauauggugggauaucaauuuacuucuuccacacaugugguugugcacaugug

SEQ ID NO: 59697 - RNA, 64 nt, Human
ccacccaccucaagcaguugaacacagccaguuauucuuccauuauuauguguaccuuggaguc

SEQ ID NO: 59698 - RNA, 64 nt, Human
aaaaauggcuaguugaauaguauuuuauguguaauucuuccauuuauucuguuuaauuauacaa

SEQ ID NO: 59699 - RNA, 64 nt, Human
uuuauaaauguacagaaacaucaccaacuuaauuuucuuccauagcaaaacugagaaaauaccu

SEQ ID NO: 59700 - RNA, 64 nt, Human
caucuuguuuuuacucauuucugacuggacaaaguucuuccaaacaauucugagaaacaaaaac

SEQ ID NO: 59701 - RNA, 64 nt, Human
auuuaaagguagaauuauuuaauuuugugauuuguucuuccauaugacauugagcaaauagauc

SEQ ID NO: 59702 - RNA, 64 nt, Human
gauuuucacacuggcauuucuagguagugauauuuucuuccacuuaccugcugaagcacauuua

SEQ ID NO: 59703 - RNA, 64 nt, Human
aaggcugcaaaugacuucugagacuuuaugucuuuucuuccagaccaagaccguagaaggaguc

SEQ ID NO: 59704 - RNA, 64 nt, Human
aucucucucuuucagucucucucucucaaccucuuucuuccaaucucucuuucucaaucucucu

SEQ ID NO: 59705 - RNA, 64 nt, Human
caacaggccaggccucugccuccucuucaucugcuucuuccacgcaccaccaccaccaccacca

SEQ ID NO: 59706 - RNA, 64 nt, Human
uuuuggggugcagaaggguacuggagcuaauuuuuucuuccaguuucccagcuacccugcccca

SEQ ID NO: 59707 - RNA, 64 nt, Human
guggcacaucaaagaaaugugaaauuaaaaagaauucuuccaaaaagcagcuuccauuaaaaug

SEQ ID NO: 59708 - RNA, 64 nt, Human
gauguacccucaaaaaaaaaaaaaugcuaaccaguucuuccauuaagccucggcugagugaggg

SEQ ID NO: 59709 - RNA, 64 nt, Human
uuguguuaauaggaaggaaaaaucacuuuaucuuuucuuccaagccccucccugccugacuuac

SEQ ID NO: 59710 - RNA, 64 nt, Human
uauuauauuuauauaguccauauggcacauuugauucuuccacauauauuuuguguuaauguuu

SEQ ID NO: 59711 - RNA, 64 nt, Human
aggggagggggcaaagggggaggagaagaaaauguucuuccaguuacuuuccaauucuccuuua

SEQ ID NO: 59712 - RNA, 64 nt, Human
uuuauaaauguacagaaacaucaccaacuugauuuucuuccauagcaaaacugagaaaauaccu

SEQ ID NO: 59713 - RNA, 64 nt, Human
ggauggauaccaccuacccucgccucuggaauggccuacccaacccgagaagaaugcaccucau

SEQ ID NO: 59714 - RNA, 64 nt, Human
gguucuaagguuuuaucuuguugcaagagugggaccuacccaagggggaagacaagaugucauc

SEQ ID NO: 59715 - RNA, 64 nt, Human
cagggucccaggaagccggugccuggguggccauccuacccagcguggcccaggccgggaagag

SEQ ID NO: 59716 - RNA, 64 nt, Human
aauucguuuuugcaauaaugacaaaugcccugcaccuacccacaugcacucgugugagacaagg

SEQ ID NO: 59717 - RNA, 64 nt, Human
cccguaccccaaaacaaugucaccaugguuaccaccuacccagaagacuguucccuccucccaa

SEQ ID NO: 59718 - RNA, 64 nt, Human
aggaaccucuagcucugacugucacucggcucucccuacccauuuggcucuggaagcugcuugg

SEQ ID NO: 59719 - RNA, 64 nt, Human
cagugucuggggacucugccacucuacccccagcccuacccaccagcccccaggugaggcuucc

SEQ ID NO: 59720 - RNA, 64 nt, Human
uagaacaacccccuuugauuguaauuuuccuuuaccuacccaaauccuauaaaacggccccacc

SEQ ID NO: 59721 - RNA, 64 nt, Human
gaaucaguguuaacuggguaaggaucauuugcuuccuacccagcucaaucugcccuggccauag

SEQ ID NO: 59722 - RNA, 59 nt, Human
aggcagcagcugaucaguaaacgggccauccuacccauuugcaugcuaaaauucucccg

SEQ ID NO: 59723 - RNA, 64 nt, Human
aggacuauuagaacugguuccccucaccacccaaccuacccaccuaugucauacugucuccucc

SEQ ID NO: 59724 - RNA, 64 nt, Human
uuguuuuuuugaaaggucugaaaaggugaagcccccuacccaauggcaauaugaaaccuuuugu

SEQ ID NO: 59725 - RNA, 64 nt, Human
uuugacucaaaggugcuauuuaccaaacacucucccuacccauuccugccagcucugccuccuu

SEQ ID NO: 59726 - RNA, 64 nt, Human
ccuuuucccugccacagccaaacccccacugcacccuacccacccaccccuagcccaggucagc

SEQ ID NO: 59727 - RNA, 64 nt, Human
aaagauugauaaaguagaugauuuuguuuguaucccuacccaucuccuggcagcccuacugagu

SEQ ID NO: 59728 - RNA, 64 nt, Human
gagcccacagccaccccacuaugccgcaggccgcccuacccaccuucaggcagccuaugggacg

SEQ ID NO: 59729 - RNA, 64 nt, Human
cugaauuucuaaugacuugauuuucuauuuucucccuacccacaauacaguuaucuuuuuuauu

SEQ ID NO: 59730 - RNA, 64 nt, Human
gggauugugcccucuccugugucuguccuccggaccuacccaggucuccaccaucaggacccug

SEQ ID NO: 59731 - RNA, 64 nt, Human
ggcagcagccccccuugccccaccucccccuuccccuacccaacccugcccugccccaccccac

SEQ ID NO: 59732 - RNA, 64 nt, Human
ggcugggugggcccagaacugcccccacugucccccuacccaccgauggagcccccagauagag

SEQ ID NO: 59733 - RNA, 64 nt, Human
aauuguguacccuuugcagaaaugcuuuuggucuccuacccaaauacucacaagggucuuauca

SEQ ID NO: 59734 - RNA, 64 nt, Human
gggaaugggaaaggcuuggugcuuccucccugucccuacccagugucacauccuuggcugucaa

SEQ ID NO: 59735 - RNA, 64 nt, Human
aacagaagauggaacucgaaaucccaaugaaaaaccuacccagcaaagaagcauagcuuuuagc

SEQ ID NO: 59736 - RNA, 64 nt, Human
cagagcccugaaacaaagagaaacaggaucugucccuacccagcacagcaaaugguuguaguaa

SEQ ID NO: 59737 - RNA, 64 nt, Human
agagaggugggacugcaaggagaggauggucagcccuacccaccugcccuguuugaacuuccug

SEQ ID NO: 59738 - RNA, 64 nt, Human
uuuacccaccaucaucuucacuaagagaaacaugccuacccaugaaggcguguuugauuacucc

SEQ ID NO: 59739 - RNA, 64 nt, Human
aggcuccauuaggauuugccccuucccaucucuuccuacccaaccacucaaauuaaucuuucuu

SEQ ID NO: 59740 - RNA, 64 nt, Human
ucuccaggcucccuaccugcuugucuaccugucuccuacccaccuguaucucuuguugggagaa

SEQ ID NO: 59741 - RNA, 64 nt, Human
gggcauccaggcacucagaaggcaaaggaaccacccuacccauuuggccucuggagggggcaga

SEQ ID NO: 59742 - RNA, 64 nt, Human
gccaggcuggucuugaacuccuggacucaagcaaccuacccagcguggccucccaaagugcugg

SEQ ID NO: 59743 - RNA, 64 nt, Human
ccuugucugagaaaccccaaaccaggaaaccccaccuacccaaccauccacccaagggaaaugg

SEQ ID NO: 59744 - RNA, 64 nt, Human
gaaacucaggagugacauucccuucacuccuuuuccuacccaagggggaagacuggagccuaag

SEQ ID NO: 59745 - RNA, 64 nt, Human
cucuuucucaaagcacaguaauguggcacugagcccuacccagcaccucagugaagggggccug

SEQ ID NO: 59746 - RNA, 64 nt, Human
ggcuggcaguuuguugaucuuuuaaguuuccuucccuacccaguccccauuuucugguaagguu

SEQ ID NO: 59747 - RNA, 64 nt, Human
agaacacccacuggccaguccuagagcuccugucccuacccacucuuugcuacaauaaaugcug

SEQ ID NO: 59748 - RNA, 64 nt, Human
cccuggagccugacccucagucuccauucucccuccuacccaggccuccucaaccuucaccucc

SEQ ID NO: 59749 - RNA, 64 nt, Human
gagaugccaaagugaccagccaccccaucccuccccuacccaucugucuggccagaccuguucu

SEQ ID NO: 59750 - RNA, 64 nt, Human
ucuuauguaggguguggucagccuuggggccuuaccuacccaguuccaugauauuucuugcccu

SEQ ID NO: 59751 - RNA, 64 nt, Human
uuuguuaaauuaucucuaggauggugauuuauaaccuacccaaaguuaucgauauucuuacuaa

SEQ ID NO: 59752 - RNA, 64 nt, Human
ucuguaauuauaucucguuuuugcuugacagugaccuacccaauaauugcaucgugcauugcca

SEQ ID NO: 59753 - RNA, 64 nt, Human
aaaagugauaaaaccaaaauaucacugacucaucccuacccauauucuuuucauaaaacccacu

SEQ ID NO: 59754 - RNA, 64 nt, Human
gggcaguauggccauuuucacgauauugauucuuccuacccaugagcauggaauguucuucuau

SEQ ID NO: 59755 - RNA, 64 nt, Human
uccucugaguagggcugccagaaggcccccagcuccuacccacuccccuugaggcugcugccug

SEQ ID NO: 59756 - RNA, 64 nt, Human
uaaaaguaaguguuuuccggcugauaaggcuaacccuacccaggaaaggauugauaacuaaaua

SEQ ID NO: 59757 - RNA, 64 nt, Human
uccagagugacagugaacuuaagcaaauuacccuccuacccaauucuauggaauauuuuauacg

SEQ ID NO: 59758 - RNA, 64 nt, Human
acuugcccucccuugcucccccucccuggcaaacccuacccaaagccagugggccccauuccua

SEQ ID NO: 59759 - RNA, 64 nt, Human
uauucuugugcacuuuaucuugggaccaaaacugccuacccaccccuucccgcccucccccugc

SEQ ID NO: 59760 - RNA, 64 nt, Human
ugugaccugucacacucaccuggcuccagccuccccuacccagggucucugcacagugaccuuc

SEQ ID NO: 59761 - RNA, 64 nt, Human
cagaucuuagccuugauauuaauaguugagaccaccuacccacaaugcagccuauacucccaag

SEQ ID NO: 59762 - RNA, 64 nt, Human
auugaacacuacccuggaauuccugccugguuuuccuacccaaauuguaccacuccuugaagaa

SEQ ID NO: 59763 - RNA, 64 nt, Human
uuuaacauguuuuauaauugauacaucucaaggcccuacccauaaaauuauuugaaaacuuuca

SEQ ID NO: 59764 - RNA, 64 nt, Human
gacaaccaucacacuuaucaauggcacgcuccugccuacccaguuccacuggggcaaggugagu

SEQ ID NO: 59765 - RNA, 64 nt, Human
cugucugcccuucaccccaguggccacucagcuuccuacccacaccucugccagaagauccccu

SEQ ID NO: 59766 - RNA, 64 nt, Human
ucuugguucaucucaccacagaagggcauuuaguccuacccagccaucggcugcguaugacagc

SEQ ID NO: 59767 - RNA, 64 nt, Human
uccacaugaacacaggcuccauccaggcccagcuccuacccaccgccucucugugggccagcug

SEQ ID NO: 59768 - RNA, 64 nt, Human
ucuagcuguuuuacuuagaauguaacauaugcugccuacccaccucaaaaugucuguacugcaa

SEQ ID NO: 59769 - RNA, 64 nt, Human
agacaugugaacauaacggcucccugaaauugcuccuacccauccauauuucuggucaugcuuu

SEQ ID NO: 59770 - RNA, 64 nt, Human
caucgggucuccucuccucucccacgcggcuggcccuacccaggcgccaccuucggucucaguc

SEQ ID NO: 59771 - RNA, 64 nt, Human
cuuuggucuuagcacuuuccuucuccagauccccccuacccaccccagucccaaauccaguccu

SEQ ID NO: 59772 - RNA, 64 nt, Human
gagcaggggagaggcucuugagaccugaugcccuccuacccacaugguucucccacugcccugu

SEQ ID NO: 59773 - RNA, 64 nt, Human
aggcaggggacaguguccccugcuaccgcccgccccuacccauggcccguugcuggaugacugu

SEQ ID NO: 59774 - RNA, 64 nt, Human
acuuagagacucaagauauuuuuuuaggaaaccuccuacccaugucugagguagcaagugcagc

SEQ ID NO: 59775 - RNA, 64 nt, Human
cacugaaaaaaauggggguuguauguauguguguccuacccaaaccuguggccgccacuuuuga

SEQ ID NO: 59776 - RNA, 64 nt, Human
cuuagaaaaaguggacagcuucugccaaccacacccuacccaugguacuguaugcuauuaacuc

SEQ ID NO: 59777 - RNA, 64 nt, Human
uuguuccuauggaaucuggaaugagugcagagcuccuacccacacaugacugccccgccauuuc

SEQ ID NO: 59778 - RNA, 64 nt, Human
cgcacagccuccccguccaggccuucuaaccacaccuacccagggcugccgcauuccugcacuc

SEQ ID NO: 59779 - RNA, 64 nt, Human
agagacuucccuccuguucuccauuaaugaacguccuacccagucuucaacucccgggucagau

SEQ ID NO: 59780 - RNA, 64 nt, Human
aaauauagucugugggagugagaggcaaaccaguccuacccaauuugauuugaauauuuuaaau

SEQ ID NO: 59781 - RNA, 64 nt, Human
ggcagaucacuugaggucaggaguucgcgaccagccuacccaacauggugaaaccccaucucuu

SEQ ID NO: 59782 - RNA, 64 nt, Human
ggaaggagaguccccugaaggucugacacgucugccuacccauucguggugaucaauuaaaugu

SEQ ID NO: 59783 - RNA, 64 nt, Human
uuagauaauaaaagaaucuggauuagaacccagaccuacccagcuaaacaacugaguccuuuuu

SEQ ID NO: 59784 - RNA, 64 nt, Human
augagaccucagcucagcccucaggugcaguggcccuacccagccuggccagcagacacacaca

SEQ ID NO: 59785 - RNA, 64 nt, Human
aucucucuaccuucuggaaaacagggcugguauuccuacccaggaaccuccuuugagcauagag

SEQ ID NO: 59786 - RNA, 64 nt, Human
ugaauaucaugaacucucaauggguagguuucauccuacccauugccacucuguuuccugagag

SEQ ID NO: 59787 - RNA, 64 nt, Human
cugccuucggucugucauuuucccaccugccuccccuacccaccccccacccaccaccuggggc

SEQ ID NO: 59788 - RNA, 64 nt, Human
aaaauguauguuuuuuaagaguagauugauucacccuacccacaggacauucaccaagccacug

SEQ ID NO: 59789 - RNA, 64 nt, Human
ucaauguagacaugacuucagauaccucugaggaccuacccagcagucuaggacccugggccaa

SEQ ID NO: 59790 - RNA, 64 nt, Human
ugccuguagagucuaccuugcaaagccuccugcuccuacccaugcuacaggccaggaaccagag

SEQ ID NO: 59791 - RNA, 64 nt, Human
uuuauaaauaaauguguuagugcaagucaucuucccuacccauauuuaucauccucuugaggaa

SEQ ID NO: 59792 - RNA, 64 nt, Human
uaauugcaacugcuuuucugccgugccucucuucccuacccaaaagugaugaguucugaacaag

SEQ ID NO: 59793 - RNA, 64 nt, Human
uuuguaucuguuucuccuccuuuacgcccauuuuccuacccacagcagcaaaugacaacguguc

SEQ ID NO: 59794 - RNA, 64 nt, Human
cauucuucuucagugaaauuuugggugccaaacaccuacccagaauguccagggcuuucauuuu

SEQ ID NO: 59795 - RNA, 64 nt, Human
gcaaguuuuagcccugcaguuuucaccaccagcaccuacccagcauucugguuuuuauguuuuu

SEQ ID NO: 59796 - RNA, 64 nt, Human
ggauuccggcccuggcuggggacuuggccgcuucccuacccacagggccugacuuuuacagcuu

SEQ ID NO: 59797 - RNA, 64 nt, Human
gccuccguuuccacacugugcaccuuucacuuucccuacccagcuuuccuacaugcugccucuc

SEQ ID NO: 59798 - RNA, 64 nt, Human
gcugaauacaaauugguuuggggggagauccuuuccuacccaaagucauaaauauauucuuuac

SEQ ID NO: 59799 - RNA, 64 nt, Human
cuccuuggcacccccucuucccugacugcuguccccuacccagccuugcccccuucauccuuuu

SEQ ID NO: 59800 - RNA, 64 nt, Human
cacucucugcuggcaggauucuucccgcuccccaccuacccagcugauggggguuggggugcuu

SEQ ID NO: 59801 - RNA, 64 nt, Human
caaggcuugagaagcccccucucccugguccucuccuacccacccauguccucucagaacccca

SEQ ID NO: 59802 - RNA, 64 nt, Human
augaauugucaggaccuuauuuaggaaacccugaccuacccauaacucccugcuaggcuaagua

SEQ ID NO: 59803 - RNA, 64 nt, Human
ugauuacugccaguuauuuccagcaugcuaaaucccuacccacguuccagccucuaggugaguc

SEQ ID NO: 59804 - RNA, 64 nt, Human
auccaucuuccuccuucuuugcuccacacucgugccuacccagccuccugaugaccaaaccauc

SEQ ID NO: 59805 - RNA, 64 nt, Human
ucuccucccaucuguccccaucuuccuccccacaccuacccacccagugggcccugaagcaggg

SEQ ID NO: 59806 - RNA, 64 nt, Human
agaaauaaggggucagauaaugcuggcaaauccuccuacccaaaaaggggucaauuguccagag

SEQ ID NO: 59807 - RNA, 64 nt, Human
auacccagagguugggcagaucagugucucuaguccuacccaguuuuaaaguucaugguaagau

SEQ ID NO: 59808 - RNA, 64 nt, Human
cuguucccccuucacaaagcccaagggaucugguccuacccauccccgcagugugcacuaaggg

SEQ ID NO: 59809 - RNA, 64 nt, Human
aggcagcugaccucuccaguugcuguguuguauuccuacccaauuuccugggcaguugaugcau

SEQ ID NO: 59810 - RNA, 64 nt, Human
cagcugccagaugaguugcaaaaacagaaaaaaaccuacccauugaauaacuucuuugaauuug

SEQ ID NO: 59811 - RNA, 64 nt, Human
uaaguagucaucgccacucaaguaggacaaggguccuacccaaggcuaggaccgcccugcggaa

SEQ ID NO: 59812 - RNA, 64 nt, Human
aagauccaagagaagaacaucuguuacaacuuuuccuacccaguuuagcaaaacaccuguuuua

SEQ ID NO: 59813 - RNA, 64 nt, Human
gacuaaccccaccacacccucccucuacugggagccuacccacccccaggaccccugaguaaaa

SEQ ID NO: 59814 - RNA, 64 nt, Human
acucaccuggcuagggccagugcccauuuucagcccuacccauugaucauuucaagaaaccucu

SEQ ID NO: 59815 - RNA, 64 nt, Human
aaaguugauuuaauugacugacuaaaugaaaaugccuacccacucauauaacauaccucagguc

SEQ ID NO: 59816 - RNA, 64 nt, Human
cacccucuuacuuuggagggagucugggcucccuccuacccagggagggcuggcagggcucugg

SEQ ID NO: 59817 - RNA, 64 nt, Human
agucaagguuggagagucuccuuccagccagugaccuacccaaaccuuuuguucuguaaaacug

SEQ ID NO: 59818 - RNA, 64 nt, Human
guugaauuuucuuuccagccaguuacccuuucaaccuacccauacuuuguacaacucuuacaca

SEQ ID NO: 59819 - RNA, 64 nt, Human
gggacagaaaggguaucugcugaccaccagccugccuacccaugcccaugucuccauuccugcu

SEQ ID NO: 59820 - RNA, 64 nt, Human
cgcugcuccccuccccagacaccucuccacgucuccuacccagggggucgcaucccuagcccuu

SEQ ID NO: 59821 - RNA, 64 nt, Human
gugggcucucucccaucacagaagguggacagggccuacccagguggaggggaccacccugcga

SEQ ID NO: 59822 - RNA, 64 nt, Human
gcccuaugucccagcugucaggggcucagggaauccuacccagccaccuguccugggauggagu

SEQ ID NO: 59823 - RNA, 64 nt, Human
uggcugcagauguuaaauuuugauaccauguaaaccuacccagcuucucagacuugggucuugu

SEQ ID NO: 59824 - RNA, 64 nt, Human
cccuucccauauccuccauucuccgcccugaguuccuacccaggcugccuggccggggccacug

SEQ ID NO: 59825 - RNA, 64 nt, Human
uuagggaagcuuuuccaagccacaaucuuaacuaccuacccaaaggauuugcauuacccccaga

SEQ ID NO: 59826 - RNA, 64 nt, Human
cucugagcuggagggagcccaccauuugcacccaccuacccacccucaccccuguucagaugaa

SEQ ID NO: 59827 - RNA, 64 nt, Human
gugcagggcuguggagcucugagacaccugaaccccuacccauccccugcaccucccuacucuc

SEQ ID NO: 59828 - RNA, 64 nt, Human
cagccguccucucuuggaggauaaacagccucccccuacccaauugccagggcaagguggggug

SEQ ID NO: 59829 - RNA, 64 nt, Human
caguggcaaccaugugguaaguggccaaccaagcccuacccagggucacccaacacacucugcc

SEQ ID NO: 59830 - RNA, 64 nt, Human
ucagcugggccaaugauauugcuccagaccgaguccuacccaccuucccccggaagugucccaa

SEQ ID NO: 59831 - RNA, 64 nt, Human
ccaucuccgaccugggagacuucaggaaugacaaccuacccagccugguggggcuggcaggaug

SEQ ID NO: 59832 - RNA, 64 nt, Human
ggggccaucccuccacacucugcauccuaccccaccuacccaacacacuuuuccaccugggagc

SEQ ID NO: 59833 - RNA, 64 nt, Human
augcguguuccagccaaagcaugccguucugcacccuacccaguugccuccagggccucuccuu

SEQ ID NO: 59834 - RNA, 64 nt, Human
uuuuuagcuugauuucuugaaaugcugcuucuucccuacccacuguaacuggcauucccauagu

SEQ ID NO: 59835 - RNA, 64 nt, Human
cagagagauuauaagaacugauguggccagagugccuacccacuguggccccggugcucugccc

SEQ ID NO: 59836 - RNA, 64 nt, Human
gcaaauuguuuucuuccuucuacccaccccaaccccuacccaucaccuuuuaagaacauaguac

SEQ ID NO: 59837 - RNA, 64 nt, Human
ugugccuaagcaauucuguccucugauucccaccccuacccaccaaaaaaugguagacaugaaa

SEQ ID NO: 59838 - RNA, 64 nt, Human
uuccuuccccagaagcuaagagccagccucagagccuacccaggagcugugaaggggcaagggu

SEQ ID NO: 59839 - RNA, 64 nt, Human
gggcacccaggggcagcccaccccuaaccuggcuccuacccaccucgcccuugaaggaugggcc

SEQ ID NO: 59840 - RNA, 64 nt, Human
ggguccagggccagccugagaugcccgugaaacuccuacccacaguuacagccacaagccugcc

SEQ ID NO: 59841 - RNA, 64 nt, Human
agagacaggcacugugugccuggcagcaggacuuccuacccagaggagguucgagcuaggaucc

SEQ ID NO: 59842 - RNA, 64 nt, Human
gaaaacagucucucccauucucuaguacugcuccccuacccagcagucacuuccaguucauuca

SEQ ID NO: 59843 - RNA, 64 nt, Human
ggccucugugguauggaccugguggcuucuccauccuacccaagguaacagugucuugcuucau

SEQ ID NO: 59844 - RNA, 64 nt, Human
cuggguuggggucccccagcauccagacuggaaaccuacccauuuuccccugagcauccucuag

SEQ ID NO: 59845 - RNA, 64 nt, Human
uccuccuuguccccagccucugcaggaugcccucccuacccaccucucccugggccuucccugu

SEQ ID NO: 59846 - RNA, 64 nt, Human
cugcauucaacggggccauggcaggaaagcugacccuacccaggaaaguaauagcuucuuuaaa

SEQ ID NO: 59847 - RNA, 64 nt, Human
ugaaagaaggauucugcauuucuauuccccucagccuacccacugaagucuuuggguagcucuu

SEQ ID NO: 59848 - RNA, 64 nt, Human
ggcacagccacugccucccccuuggcucccugcuccuacccaggagagcucccuauccgccuuu

SEQ ID NO: 59849 - RNA, 64 nt, Human
aaacuguucuccuccccagccccacucccuguucccuacccauauaggcccuaaauuugggaaa

SEQ ID NO: 59850 - RNA, 64 nt, Human
ugcagauggaaaccucucagugucuugacaucacccuacccaggcggugggucuccaccacagc

SEQ ID NO: 59851 - RNA, 64 nt, Human
auauaaaaauagagccaccauaucaacacuuagcccuacccauuaguaucacccccaguucuua

SEQ ID NO: 59852 - RNA, 52 nt, Human
ccgacaaggagcaguccuaaacccuacccagccugcugccucagcacagcca

SEQ ID NO: 59853 - RNA, 64 nt, Human
ccacgcccuggaugccacccagugcagccuggcaccuacccacccacccuucagcuuaagccac

SEQ ID NO: 59854 - RNA, 64 nt, Human
aaauaguccuuuuucuuggaagcagugacgucucccuacccaaucuuucccauccuaucaaccc

SEQ ID NO: 59855 - RNA, 64 nt, Human
agcuucugaaaggacaguauagcugcccuugcucccuacccacagcaccugaguuaaaaaguga

SEQ ID NO: 59856 - RNA, 64 nt, Human
ggcuuaaaaucaaacacagguguuauuugucugcccuacccauagcaccaaauuccauucccua

SEQ ID NO: 59857 - RNA, 64 nt, Human
cgaucuuccuuucaccucccugccaugcugggguccuacccagccuggaucugagcucugugcc

SEQ ID NO: 59858 - RNA, 64 nt, Human
uuuacuauuucagaggaaauaucuugccaggauaccuacccauccuuauagaacaguuaccuuu

SEQ ID NO: 59859 - RNA, 64 nt, Human
aaaaucccaucacuccagcagcugggaccugaguccuacccaccauucuuaauacuguggcuua

SEQ ID NO: 59860 - RNA, 64 nt, Human
accgugaguaguggaaaccaggacguccccuacaccuacccauggguggaagcuaaagaguccg

SEQ ID NO: 59861 - RNA, 64 nt, Human
aggcaguagguuugcucuguacccauguguacagccuacccaugcagggacugggauucgagga

SEQ ID NO: 59862 - RNA, 64 nt, Human
gcccgcccucuggagcgugugcugucuuuagggcccuacccaaagucacuguaacaguuaagug

SEQ ID NO: 59863 - RNA, 64 nt, Human
cuuugaauuuuguuggcuuucaguggucaugcuaccuacccauacucguacucucagaccuuuu

SEQ ID NO: 59864 - RNA, 64 nt, Human
agugugagucuuucuguaggguagaaagaagccuccuacccagcaaaccaguagacccaaaagu

SEQ ID NO: 59865 - RNA, 64 nt, Human
ucuugguucucccacauucuuauucucccacaucccuacccacguuugagcuggaaaggauguc

SEQ ID NO: 59866 - RNA, 64 nt, Human
accuaagacuuuccugauauugacucucuuuauaccuacccaagcugaacgacccuccuuuucu

SEQ ID NO: 59867 - RNA, 64 nt, Human
ggagucuacccagggccacccagcggcccuggggccuacccaucuucuggacagccaagugcca

SEQ ID NO: 59868 - RNA, 64 nt, Human
uaccgcuuuuaaggacgcuuaugaucacauugcgccuacccagagaacccaggucgucuuucua

SEQ ID NO: 59869 - RNA, 64 nt, Human
ccuuguauuuuccuuaucuuccucuuucaagaccccuacccauuuugccuauccguaggcuggg

SEQ ID NO: 59870 - RNA, 64 nt, Human
aucauuaaauaucaguucuguuuaucugaaggcuccuacccagagauucuacccagugaaacuc

SEQ ID NO: 59871 - RNA, 64 nt, Human
guucaaauaaguugguuuguuagacauucauaugccuacccaucagccauuucguucucccuuc

SEQ ID NO: 59872 - RNA, 64 nt, Human
gucucaggccaauuacuguggagcagcuuucauuccuacccacuugcaaaccuuggcgcuguug

SEQ ID NO: 59873 - RNA, 64 nt, Human
ccuacccugcacccacaucccauacccucuucucccuacccaucccauuccccacaggcccuac

SEQ ID NO: 59874 - RNA, 64 nt, Human
cugaccucagcagcuacaccuaaccccaccgcacccuacccagugucgauauccacaacccagc

SEQ ID NO: 59875 - RNA, 64 nt, Human
cagaugcugcgggaccugcccagcugcccgugugccuacccacuggaggccauggacagcccug

SEQ ID NO: 59876 - RNA, 64 nt, Human
aaggcuuuuuuuucacuuauaaggccugauugguccuacccagcuuaacggggugggguuuuuu

SEQ ID NO: 59877 - RNA, 64 nt, Human
accucaucagucaugcuccuccuccauuuuacccccuacccauccuugaucggucaugccuagc

SEQ ID NO: 59878 - RNA, 64 nt, Human
ggcugcaugaucgugaugucacacgguacaauguccuacccacaacuccucugccgccuccccu

SEQ ID NO: 59879 - RNA, 64 nt, Human
ccaccacccagccaugaugaugcacggaggacccccuacccacccuggaaugacuaugucagca

SEQ ID NO: 59880 - RNA, 64 nt, Human
uuucuuucucaccauuuaucacuucccucacugcccuacccaggcuuucucucccacuucccug

SEQ ID NO: 59881 - RNA, 64 nt, Human
aguuugcuugcuugccaacacaaugaagauaauaccuacccacaaacaucccuauucucuacuu

SEQ ID NO: 59882 - RNA, 64 nt, Human
gagugaggugguccccugcaaucacuguuuguccccuacccacccaaccugucccugccugcuc

SEQ ID NO: 59883 - RNA, 64 nt, Human
gggugauccugccagcagcccuacagcuccacacccuacccacccaucggcagccccucugcug

SEQ ID NO: 59884 - RNA, 64 nt, Human
ggaccaaccccugcuguccaaaacaccacugcuuccuacccagguggcgacugccccccacacc

SEQ ID NO: 59885 - RNA, 64 nt, Human
uucuguuggccagugugacaaggauugcuacuguccuacccacccuccuuucaccacaugugca

SEQ ID NO: 59886 - RNA, 64 nt, Human
ggccagauggcauccuggcuuggggcgggugggaccuacccaggcucugagacuuuacuggccu

SEQ ID NO: 59887 - RNA, 64 nt, Human
uugccaggcacuggagggcgcaucaaagaagaguccuacccaggagggagagcgcagcugcugc

SEQ ID NO: 59888 - RNA, 64 nt, Human
gagccagccccuccuguucaaaacaccacugcuuccuacccagguggcgacugccccccacacc

SEQ ID NO: 59889 - RNA, 64 nt, Human
cugaagccgcaguauguccuugagugggucccccccuacccaucuagcuguugcccccauggua

SEQ ID NO: 59890 - RNA, 64 nt, Human
uaacucagcguccgugacugcaguaacagccagcccuacccagaguauuucugagccaugaggg

SEQ ID NO: 59891 - RNA, 63 nt, Human
aaauggaauguucacccuaacuaccaauggggaccuacccaaaccaauauucauccccaaugg

SEQ ID NO: 59892 - RNA, 64 nt, Human
aucuguuaucccaggacuguguacagaggggcaaccuacccauucaggaaggucagggcuuugg

SEQ ID NO: 59893 - RNA, 64 nt, Human
cuuccucuacaccuucugccaccaccugcaccugccuacccacgacaaggagacagaggagcug

SEQ ID NO: 59894 - RNA, 64 nt, Human
gcaggacauggccaggccugguggacacaggaagccuacccaacacgcugguauuuggccaaca

SEQ ID NO: 59895 - RNA, 64 nt, Human
ugauuaauuuauuauauugacgauaaaacucaaaccuacccagccuuccccccacuccauggaa

SEQ ID NO: 59896 - RNA, 64 nt, Human
ccauguguaaggaaugaacugguucaaggcgcguccuacccagucauuuucuuuaccuuauacu

SEQ ID NO: 59897 - RNA, 64 nt, Human
aggggagggagcaggagugucccucccgucagugccuacccaccugugaggcagccuucugaug

SEQ ID NO: 59898 - RNA, 64 nt, Human
aaaaauucacugccacagacaaaccacccccacuccuacccagccagcccucaaaacacaaagg

SEQ ID NO: 59899 - RNA, 64 nt, Human
gcuugggagccagacacuccagggaucaguaguuccuacccauagucuuugugugcuugcuaaa

SEQ ID NO: 59900 - RNA, 64 nt, Human
accaagccaugcucugucuacuggcaaugggcucccuacccacacuggcuuccugccucccacc

SEQ ID NO: 59901 - RNA, 64 nt, Human
auccuuucucgagcagcugcugccccagcugccuccuacccauugccaagagaggaugcaucug

SEQ ID NO: 59902 - RNA, 64 nt, Human
uuucgcucgggcuucgggugacuucgccgcaggaccuacccagcucgcucacuucgcucgcucc

SEQ ID NO: 59903 - RNA, 64 nt, Human
aauaacuggaacccagccucuccuccuacaccggccuacccaucugggcccaagagcugcacuc

SEQ ID NO: 59904 - RNA, 64 nt, Human
cugggggccagggcuggauggacagacaccucccccuacccauaucccucccgugugugguugg

SEQ ID NO: 59905 - RNA, 64 nt, Human
cagguaucugccaguuuuuccaaaugaccuguacccuacccaguacccugcucccccuuuccca

SEQ ID NO: 59906 - RNA, 64 nt, Human
uccagguuugcuauuuauaaucauauuucaucagccuacccacccuccccaucuuugcugagcu

SEQ ID NO: 59907 - RNA, 64 nt, Human
cugcauggaggaaaaaugacuaaggacugagcccccuacccaacuacccccaccccaaucccac

SEQ ID NO: 59908 - RNA, 64 nt, Human
guggcugccccaccugccgcaugcucccuccucuccuacccacuggucugcuuaaagcuucccu

SEQ ID NO: 59909 - RNA, 64 nt, Human
gcuccuuguaggcauaugauggggagggggugccccuacccaccuccaagaggcuacagcccug

SEQ ID NO: 59910 - RNA, 64 nt, Human
gcauagcauucuuaaaggaaugcagugcucaaaaccuacccaaauucccgcaggauucuaccaa

SEQ ID NO: 59911 - RNA, 64 nt, Human
ugcauuuuauugcuuuacucuucauucuguggcaccuacccacaggggaaguaagaaguuuguu

SEQ ID NO: 59912 - RNA, 64 nt, Human
cuuagaaaaugacugacauuguuuuguuacugcuccuacccaccaaggggauaaagaaggcgag

SEQ ID NO: 59913 - RNA, 64 nt, Human
ggucugguugaucgaugucagucagucaguagaaccuacccacccucacggccuggaguucuug

SEQ ID NO: 59914 - RNA, 64 nt, Human
ugaaguguucuuccucaaucuugauugcccuguaccuacccaaaagcuguagucacacauccua

SEQ ID NO: 59915 - RNA, 64 nt, Human
ucagaaacucaaaagaaggccacuguuugucucaccuacccaugaccugaagccccucccugag

SEQ ID NO: 59916 - RNA, 64 nt, Human
gagaccccgguguguccguucuuuagcaauauaaccuacccagugcgugccgagcaggcuuggu

SEQ ID NO: 59917 - RNA, 64 nt, Human
cugcagcuggaccgaccucauucaucgccugcccccuacccaauucugagcacacgguacugua

SEQ ID NO: 59918 - RNA, 64 nt, Human
ucaggacaccagccuggugcccauccucccgaccccuacccacuuccauucccguggucuccuu

SEQ ID NO: 59919 - RNA, 64 nt, Human
ccucccugccucucaucugccuccccaacccccaccuacccacugcucccaggggucucuccag

SEQ ID NO: 59920 - RNA, 64 nt, Human
aaccuuccuugggggcagcagcccuucccgggggccuacccagugccccacagcagaacccgug

SEQ ID NO: 59921 - RNA, 64 nt, Human
ccacugguuccaauugagcuccagcccugguuuuccuacccaugcaguuagggacuuuaauuua

SEQ ID NO: 59922 - RNA, 64 nt, Human
gggaagcaggaggcagaauggcucugcugagccuccuacccaugacaacaccccaauaaacaga

SEQ ID NO: 59923 - RNA, 64 nt, Human
cuucgggaccaggauuugcacagaagcacaugcaccuacccauacacccccucuucugagcaca

SEQ ID NO: 59924 - RNA, 64 nt, Human
cuccagagaggcucaacaaggaaaaaugccacucccuacccaaugucucccacacccacccuuu

SEQ ID NO: 59925 - RNA, 64 nt, Human
ccauuacaccacagugaguucacagguaauauaaccuacccaccuguguaaugucaaaaaaaau

SEQ ID NO: 59926 - RNA, 64 nt, Human
ggaccaaacagcucuggccuagggauugggccacccuacccaggaucuccacccuggggacagu

SEQ ID NO: 59927 - RNA, 64 nt, Human
ugcacaaugaaguuucagcuucucaaccuucuccccuacccagggcuguggacccagacuggcc

SEQ ID NO: 59928 - RNA, 54 nt, Human
ugggugcgaacucacagugacuguccuacccacccacccaccucuguagagucc

SEQ ID NO: 59929 - RNA, 64 nt, Human
cacagcccgacagguugccugacggccgccugcaccuacccaagcugaacaaccucuaccugcg

SEQ ID NO: 59930 - RNA, 64 nt, Human
caaaaggaaggacaaaaauauauauguaugugacccuacccauaaaaaaugaaauauucacaga

SEQ ID NO: 59931 - RNA, 64 nt, Human
gggugggacaaacugcaagguucuggggccaaggccuacccaggggccucugcccagagaacuc

SEQ ID NO: 59932 - RNA, 64 nt, Human
ccacuccauucccaacuagacauuaccaaagugaccuacccagagauugcuucucauccccagu

SEQ ID NO: 59933 - RNA, 64 nt, Human
guauugggaugccuaugaucuuaucuaggguuuuccuacccauccccaacauucagcucagcug

SEQ ID NO: 59934 - RNA, 64 nt, Human
cagaacccagaacagagacgaaaaggcuaccucuccuacccaaguuaaguguucaaaggggaug

SEQ ID NO: 59935 - RNA, 64 nt, Human
caggccgguuagucuccaguuuccacagagaccaccuacccaccaccuucccaggucaccugcc

SEQ ID NO: 59936 - RNA, 64 nt, Human
agcacuggugguguuuuagggaccguccuucuccccuacccagggaacuggaccuggcagggca

SEQ ID NO: 59937 - RNA, 64 nt, Human
uuaagggguuuaggugugcagaagcuuuccuuucccuacccaguaaccaugugacuacuaacgu

SEQ ID NO: 59938 - RNA, 64 nt, Human
uuugcuguuuagccuucaguuugcuccgcugccuccuacccagagguuugugcgagccuguguu

SEQ ID NO: 59939 - RNA, 51 nt, Human
ccgggaugggcacgcuguaauccuacccagcacccuucccccgcgucaccc

SEQ ID NO: 59940 - RNA, 64 nt, Human
cagcccugcccccagagcugccccccacgggcauccuacccacugccuccccauccccgcuggc

SEQ ID NO: 59941 - RNA, 64 nt, Human
cagggcagccuccuccaaaucccuccuggaggggccuacccagaagccuccuugaaccagucug

SEQ ID NO: 59942 - RNA, 64 nt, Human
cuuguaaccaucucuaagggcaauggcauugcucccuacccauucaucugcaugagcuacucuu

SEQ ID NO: 59943 - RNA, 64 nt, Human
gggccaggccuaagaggcuucuggcagcuuccauccuacccaugaccccuacuuggggcagaaa

SEQ ID NO: 59944 - RNA, 64 nt, Human
ugugcccagugguugaugauaccaccaccaccugccuacccaugggcccaaguuucuguggcuc

SEQ ID NO: 59945 - RNA, 64 nt, Human
aaacaggccugagcgaugggcaucacacccucugccuacccacgugccugcuuaccugccagau

SEQ ID NO: 59946 - RNA, 64 nt, Human
agcaccaaagccccuggcaccccacccacuccauccuacccagggaccccaaguaggcaacugu

SEQ ID NO: 59947 - RNA, 64 nt, Human
uuugcuuuugguaaugugauguugauguucucccccuacccacaaccaugcccuugaggguagc

SEQ ID NO: 59948 - RNA, 64 nt, Human
uggaggagcuggggagcagcuaugcaaaucccuaccuacccagcugggccagaggcacgaggca

SEQ ID NO: 59949 - RNA, 64 nt, Human
augcacgguacccuccccgagagcaggccuguccccuacccaacugggaauaaacuggaagcug

SEQ ID NO: 59950 - RNA, 64 nt, Human
gggcuuucugaaaguuggcuauaauuucucuaucccuacccacaacccugggaaguuggagcaa

SEQ ID NO: 59951 - RNA, 64 nt, Human
ccccucucaggagccaucaucggcuuuccccauuccuacccacuuaggcuuuguagcaagauga

SEQ ID NO: 59952 - RNA, 64 nt, Human
guggguucccaucauuuccugugucagcgccuggccuacccagauuguaucaugugcuagauug

SEQ ID NO: 59953 - RNA, 64 nt, Human
acacuccuucaccuagggauguguuuguugcccuccuacccaauugucaugauuguccuuagua

SEQ ID NO: 59954 - RNA, 59 nt, Human
ccucgguaucgccugcaugaggucugccuccuacccaucccgcccaccggggcuuuggc

SEQ ID NO: 59955 - RNA, 64 nt, Human
uggagaggggacccuaagacuccucggccuggcuccuacccaccgcccuugccgaaccaggagc

SEQ ID NO: 59956 - RNA, 64 nt, Human
gauuccacuguuagagcccuuaccgccugcuuauccuacccaaugacuacauuggcuguugguu

SEQ ID NO: 59957 - RNA, 64 nt, Human
cacguggucagggucaaugcaagaguucucauuuccuacccaucccugcaugaagcagcuuuga

SEQ ID NO: 59958 - RNA, 64 nt, Human
cagcacacagccuggcuauaaagacacgaagcgaccuacccacuguacaguccacuucacagga

SEQ ID NO: 59959 - RNA, 64 nt, Human
ugcaacucaacauccucuucacccugcccugccugcaguugagggggcgaagaagaacccugug

SEQ ID NO: 59960 - RNA, 64 nt, Human
ggaggguccauuuuucuuccaggaugguguuacugcaguugaaagggcaauaugaaguuacuuu

SEQ ID NO: 59961 - RNA, 64 nt, Human
cccaggaccuuuggccaaucccaguucccaggcugcaguugagggucuguccuugucaaaaggc

SEQ ID NO: 59962 - RNA, 64 nt, Human
ggagagaaucauaggcaaaaguuucuuuaaaguggcaguugauuaacauggaaggggaaauaug

SEQ ID NO: 59963 - RNA, 64 nt, Human
acccaaaccuacugggcuacuaauacuucucucagcaguugaucaaauacaauagaccauguaa

SEQ ID NO: 59964 - RNA, 64 nt, Human
uuucugaaaugcuggauuaucuauuuuuaaacaagcaguugacuuaaaacuuucuguggcaacu

SEQ ID NO: 59965 - RNA, 64 nt, Human
uuuauaaugagauguuuacaguuaaauacagauggcaguugagcacuucuguuuuguguuggaa

SEQ ID NO: 59966 - RNA, 64 nt, Human
gccugaaucagaggccgucgggaacgcccucccugcaguugaggaagagccacuuuccugccag

SEQ ID NO: 59967 - RNA, 64 nt, Human
auaucuguaucaggucagcagaagaaggaacugagcaguugaacucugaguucaucaauuguaa

SEQ ID NO: 59968 - RNA, 64 nt, Human
agaggauagaaguugaauguccugauggccaugagcaguugaguggcacagccuggcaccagga

SEQ ID NO: 59969 - RNA, 64 nt, Human
ggaucuaaucugaaaauucaguaacuaauauuaggcaguugauacucccccaccucccccauuu

SEQ ID NO: 59970 - RNA, 64 nt, Human
aauauaaggaaaaaagacuaaagcaagagaucuggcaguugaaaauugugggaaagagaauuug

SEQ ID NO: 59971 - RNA, 64 nt, Human
ucauaagaguaggcuacagaggugaccaggccuggcaguugaaaucucuggaagagggaacaug

SEQ ID NO: 59972 - RNA, 64 nt, Human
gccccagggaaguaugcauuagccuucccauuuugcaguugaggaggcugaguagccucagaag

SEQ ID NO: 59973 - RNA, 64 nt, Human
aaagcaagaucuuugauaucuuucauguuugccugcaguugaacaauacuuuagaguacuuuuu

SEQ ID NO: 59974 - RNA, 64 nt, Human
ggcuuaaaaacuuccaucccuacuuuucaagagugcaguugauucugaaucugaaagcccgccu

SEQ ID NO: 59975 - RNA, 64 nt, Human
aucuggggguuucuucauauuccugcuguuggaagcaguugaccagaaaugcuugccaguacug

SEQ ID NO: 59976 - RNA, 64 nt, Human
cuugaucuacccauauuuaaagcuauaucucaaagcaguugagagaagaggaccuauaugaaug

SEQ ID NO: 59977 - RNA, 64 nt, Human
caugagaaucacuuaaaccugagagguggagguugcaguugagccaagaucacgacacugcacu

SEQ ID NO: 59978 - RNA, 64 nt, Human
uuaagagaugguggcccaauugagaggggaaaaugcaguugaaacuucagacaggguugauaaa

SEQ ID NO: 59979 - RNA, 64 nt, Human
uaaaggcugacuacauuuuuucaucaugaggaaagcaguugaaaugaggcaugaguuacugugc

SEQ ID NO: 59980 - RNA, 64 nt, Human
uuauucauuugcauuagcaaauauucaugcagcagcaguugacugaaaauuuauucuuaugaga

SEQ ID NO: 59981 - RNA, 64 nt, Human
aggaacaaggagaaggggcaacuuuccuuaacuggcaguugagcacauaguacauuuccccucu

SEQ ID NO: 59982 - RNA, 64 nt, Human
agaguagcucauggcuccaggagccugaggccaugcaguugauggugagcugacaucaauucua

SEQ ID NO: 59983 - RNA, 64 nt, Human
gcagcuugcaggccccagcccuguuccaaucaaugcaguugacaauaaaggaaugaguaucguc

SEQ ID NO: 59984 - RNA, 64 nt, Human
uauggugcaagagaaaauuggaucaaaucaaucugcaguugauguccccaaaugcaaacacagg

SEQ ID NO: 59985 - RNA, 64 nt, Human
ccuugccuuguguaugugacuccauaucccgggagcaguugaccuuugccaaacacuuuacagu

SEQ ID NO: 59986 - RNA, 64 nt, Human
uuguuaauuuuuguaaagcagacgcuacucucaagcaguugacaaaacuguuuauuuuugcaau

SEQ ID NO: 59987 - RNA, 64 nt, Human
uaaggcauaagaaaacuaagaaauaugcacaauagcaguugaaacaagaagccacagaccuagg

SEQ ID NO: 59988 - RNA, 64 nt, Human
auaugcaaagcacugacuucuaaguaaaaccacagcaguugaaaagacuccaaagaaauguaag

SEQ ID NO: 59989 - RNA, 64 nt, Human
ugaaauuaaauuuggcucuaaaguugguguagcagcaguugaucagacugaaaaacgguuuuua

SEQ ID NO: 59990 - RNA, 64 nt, Human
uaguuuuaaaacucuuuaucccaucuugauuggggcaguugacuuuuuuuuugcccagagugcc

SEQ ID NO: 59991 - RNA, 64 nt, Human
auagagccacaacacauguuuauuuugcuuggcugcaguugaaaaauagaaauuagugcccuuu

SEQ ID NO: 59992 - RNA, 64 nt, Human
uguagaaugucuccaagauugaagaagaaacugagcaguugaaaaaugcuaaucucuuugacuu

SEQ ID NO: 59993 - RNA, 64 nt, Human
aaagugaggcucugggguuagauuucagcauucagcaguugacacaggcuaagaaauggaaaga

SEQ ID NO: 59994 - RNA, 64 nt, Human
cagcucucacccagcuuggcugcuucaagucugugcaguugacuuggcuguacugaaaagugaa

SEQ ID NO: 59995 - RNA, 64 nt, Human
auacggaaaaaauuguauugaaaacacuuaguaugcaguugauaagaggaauuugguauaauua

SEQ ID NO: 59996 - RNA, 64 nt, Human
uaugcuucuaaauacauuaaaacauuucugaauugcaguugaaugguuggagauugcuggcgau

SEQ ID NO: 59997 - RNA, 64 nt, Human
acugauuguuaacuguagcuucagcgcgugccaagcaguugacuuaauaggaucaucuugugaa

SEQ ID NO: 59998 - RNA, 64 nt, Human
ccacaccucagaggguuccuacagcugcacacaagcaguugagaguugaugaccaggcccauag

SEQ ID NO: 59999 - RNA, 64 nt, Human
uguaugaagccagaagcacaagugccuucagagggcaguugauuccaguccaguugccucccua

SEQ ID NO: 60000 - RNA, 64 nt, Human
uuaauuaacccugcuccuaccaaucuuuuuuaaagcaguugaagcagaauguauaggugucaga

SEQ ID NO: 60001 - RNA, 64 nt, Human
gaaaauaucuauucuuugagucauuguuacugaggcaguugaguguaaggagcuggcugcaguu

SEQ ID NO: 60002 - RNA, 64 nt, Human
aguguuaauauauacacugcaaaagaccaaggaugcaguugaauggaaaauuacucaguguaua

SEQ ID NO: 60003 - RNA, 64 nt, Human
cugaggaggaauagugaaggagggaggccucuuugcaguugagauaagaggaaggcuucugucu

SEQ ID NO: 60004 - RNA, 64 nt, Human
guuuuaaaggaaagagguuaugcuuaucuucuuagcaguugauaaaauauuaaaacucucuugc

SEQ ID NO: 60005 - RNA, 64 nt, Human
ucuuccauccuccuccuccccuuaauggauuguggcaguugaaauaauccaucggaugacccac

SEQ ID NO: 60006 - RNA, 64 nt, Human
acgaaaggcauagaaggagaagacaaagugucacgcaguugacugguuuucggccuuucuugag

SEQ ID NO: 60007 - RNA, 64 nt, Human
acugauuuguugauuuuuuuuuuaagggggguuggcaguugauuauguucuggaugauuccguc

SEQ ID NO: 60008 - RNA, 64 nt, Human
aucauguuuaauuguuuaauuugguugaaaaacugcaguugagaaaucagauagcaauauagac

SEQ ID NO: 60009 - RNA, 64 nt, Human
uugaaggaaggacaagguagaucuguuuaguuuugcaguugaaguuagaugguccuaaacauuu

SEQ ID NO: 60010 - RNA, 64 nt, Human
uuucucccaguacuccagcaauucauuucugaaagcaguugagccacuuuauuccaaaguacac

SEQ ID NO: 60011 - RNA, 64 nt, Human
guuaggucauuuguggguugauucuucagaaacagcaguugauaccuagcagcguuauugaugg

SEQ ID NO: 60012 - RNA, 64 nt, Human
auuuguugcuauguuuucaccccaguggcauggcgcaguugaagucuuuguggacauaucuuug

SEQ ID NO: 60013 - RNA, 64 nt, Human
cauucccaccuggaggguuugggagaggagcaaagcaguugaaaacuaguuaaugagcuacaag

SEQ ID NO: 60014 - RNA, 64 nt, Human
acugggcaagaagaaagaugggaaacugaauaaagcaguugaucagcaucauuggaacaugggg

SEQ ID NO: 60015 - RNA, 64 nt, Human
cuggugggaaauugcuugacccagguagucaaaggcaguugacuagaaucgacaaauuguuacu

SEQ ID NO: 60016 - RNA, 64 nt, Human
cugugauaacucugcaaaggccugggcuggccuggcaguugaacagagggagagacuaaccuug

SEQ ID NO: 60017 - RNA, 64 nt, Human
caccuuuuccaaagcuuccagaagcuaccaaaaggcaguugaaaaauauaccucuucaaaugag

SEQ ID NO: 60018 - RNA, 64 nt, Human
uccuaauauugguuuucaguuuggaauuaauaaagcaguugacauucacuguuaguuacagcaa

SEQ ID NO: 60019 - RNA, 64 nt, Human
uggcccaguagacauaauuguauuaggacuuucugcaguugacauuugcauaaagcugacugac

SEQ ID NO: 60020 - RNA, 64 nt, Human
gccccugcguggccugaguccuggucccucugaggcaguugacggggcagucagauuuuuaaag

SEQ ID NO: 60021 - RNA, 64 nt, Human
ugcuguguaccaggcguggugcucagcccuagaggcaguugacuuacccucugcagcccucccu

SEQ ID NO: 60022 - RNA, 64 nt, Human
ucgucggaagaagaacaggaaaagagaugaaguggcaguugagcuaucacuauggcaaaaacau

SEQ ID NO: 60023 - RNA, 64 nt, Human
gcuagagaaguggagagaaaauacaaaagguaaagcaguugagauucucuacaaccuaaaaaau

SEQ ID NO: 60024 - RNA, 64 nt, Human
caggcacauguguucagaguuccacaguugauuagcaguugaggccaggcuagaauggaaaacu

SEQ ID NO: 60025 - RNA, 64 nt, Human
aaucuuccuaauuuucauguuuauauggaacuaugcaguugaguauugaaagcuuuaaacugag

SEQ ID NO: 60026 - RNA, 64 nt, Human
ugaggugggggugggaggccagcacgguggugaggcaguugagaaaauuugaauguggauuaga

SEQ ID NO: 60027 - RNA, 64 nt, Human
uggggugggggugggaggccagcacgguggugaggcaguugagaaaauuugaauguggauuaga

SEQ ID NO: 60028 - RNA, 64 nt, Human
gguggagggguuugcagugugggaauguggcccugcaguugaccugagcugcuucacaugguug

SEQ ID NO: 60029 - RNA, 64 nt, Human
ucuaauucacaggcaaaccaauacagaauugacugcaguugaacagacuagaaguauuuguggg

SEQ ID NO: 60030 - RNA, 64 nt, Human
cugggcagggucuguggcugcgccccucaggccagcaguugagguccaucgggcuggccccagc

SEQ ID NO: 60031 - RNA, 64 nt, Human
caauacggugauugcuugugugcucaacauaccugcaguugaaacguauuguaucaaugaacau

SEQ ID NO: 60032 - RNA, 64 nt, Human
gguuuaaaggcacaaggucauggccuuugucauagcaguugaaugugcauugacauauuuuucu

SEQ ID NO: 60033 - RNA, 64 nt, Human
aaagucaacuggacugcugagugagagggcaggggcaguugaagggaacaugaauugcuggaac

SEQ ID NO: 60034 - RNA, 64 nt, Human
caaauguaaaacuuacacauggaaagaacuguaugcaguugacuuuacuauguaaauuggaggg

SEQ ID NO: 60035 - RNA, 64 nt, Human
uaggucucaguuugagagaaauaggaagcccuuugcaguugagguguuaggaaccugcugguca

SEQ ID NO: 60036 - RNA, 64 nt, Human
auagcggguuacuuucacauacagcccucccccagcaguugaaugacaacagaagcuucagaag

SEQ ID NO: 60037 - RNA, 64 nt, Human
gugguuuauagagggccaagacuuggcaacagaagcaguugagucgucaucacuuuucagugau

SEQ ID NO: 60038 - RNA, 64 nt, Human
gauguacuuaagcaguaagcguauuuagguaaaagcaguugaauuauguuaaauguugcccuuu

SEQ ID NO: 60039 - RNA, 64 nt, Human
cucauaggagcuauaaagcaggcugcugaucucagcaguugauauggugguugugccucugcug

SEQ ID NO: 60040 - RNA, 64 nt, Human
cugagaccccaggccuaaaccugagacuuccucugcaguugaugugguccuggauccagacacc

SEQ ID NO: 60041 - RNA, 64 nt, Human
caucucaccucuucauucucuuguuacauuugaagcaguugauauaauggguuuauacuuuaaa

SEQ ID NO: 60042 - RNA, 64 nt, Human
acagagcuaauaauaccucaguauaaugucaugagcaguugaaauucaucacaugaaaaguaau

SEQ ID NO: 60043 - RNA, 64 nt, Human
agcuuuuugaggaacagacaaacuguuuuccacagcaguugaaccauuccacauucccaccagc

SEQ ID NO: 60044 - RNA, 64 nt, Human
aguugcuguguuguauuccuacccaauuuccugggcaguugaugcaucucugggaaaaacacca

SEQ ID NO: 60045 - RNA, 64 nt, Human
cacauauucauaaaaaaaaucaaguagcugaugugcaguugagaaaacuagaggacugaaaaaa

SEQ ID NO: 60046 - RNA, 64 nt, Human
cuaacacucauaugcucaguuuuguuuuguuuuggcaguugacaagaaguuaauuugcuuuagu

SEQ ID NO: 60047 - RNA, 64 nt, Human
uuuuaaggaaaaguaacuuaauuggguuuuucaggcaguugauauuugaccuaagcuuuuuuuu

SEQ ID NO: 60048 - RNA, 64 nt, Human
auggauggacauggucgaggaauucggaaagccugcaguugacauucagucuucacuugaaacu

SEQ ID NO: 60049 - RNA, 64 nt, Human
uuuaccacagcagcugaacagccaaaugcauggugcaguugacagcaggugggaaaugguauga

SEQ ID NO: 60050 - RNA, 64 nt, Human
cucucuuccacaagagcuccuccauguuuggauagcaguugaagagguugugugggugggcugu

SEQ ID NO: 60051 - RNA, 64 nt, Human
cuugguuggaccuauugccaggaauguuucagcugcaguugaagagccugacaagugaaguugu

SEQ ID NO: 60052 - RNA, 64 nt, Human
gcucucuggcaucugggguuccugacugauaccagcaguugaaggaagagagugcauggcaccu

SEQ ID NO: 60053 - RNA, 64 nt, Human
cccgaggccagccggccucucgagagccagagcagcaguugaauguaaugcuggggacaggcau

SEQ ID NO: 60054 - RNA, 64 nt, Human
guuuuaaccagugacacuccccuucucguugccagcaguugauuuacaguggucacagggccca

SEQ ID NO: 60055 - RNA, 64 nt, Human
augaacacaaugugaauaucauuuccauuucuaagcaguugaaugacacagucagauucuuugg

SEQ ID NO: 60056 - RNA, 64 nt, Human
cugacuaacuuggcauuugcaggucaagcaggaagcaguugacaagacacauccucagugaauc

SEQ ID NO: 60057 - RNA, 64 nt, Human
ugugcuacccuuucuaaacuguucuaagaagcaggcaguugauguauguuuauauuuuaaguca

SEQ ID NO: 60058 - RNA, 64 nt, Human
uaauuaugaauucauuacagaguccagguggccugcaguugaagaucaucaaccauuuuugccu

SEQ ID NO: 60059 - RNA, 64 nt, Human
augcuuuacccaucuuacuuagugaaagagagcugcaguugaaauuguuuaaaaaguagcaggu

SEQ ID NO: 60060 - RNA, 64 nt, Human
aacuucuuacucauagugugguuuuuaaauauaugcaguugagugaugauuggauacuauucau

SEQ ID NO: 60061 - RNA, 64 nt, Human
caugccuauaaucccagcacuuugggaggcugaggcaguugagaccaggaguucgaguccagcc

SEQ ID NO: 60062 - RNA, 64 nt, Human
acaauuuuuaaaaaguucuuaaaauacugaaaaugcaguugacacuuguguauggcuuaugaag

SEQ ID NO: 60063 - RNA, 64 nt, Human
aaucacauucuagacuugugaguugaaugacaaagcaguugaacaaaaauuauggcauuuaaga

SEQ ID NO: 60064 - RNA, 64 nt, Human
auucuacaggguugcucuaagaacugucuucucagcaguugauccagcuguacggaaauuuagg

SEQ ID NO: 60065 - RNA, 64 nt, Human
uggacgccauaguggcccgggaccgagaccuucagcaguugaggcuggggcuaguggucccagc

SEQ ID NO: 60066 - RNA, 64 nt, Human
ucuacccugaaagugacugccugcagaaagaccagcaguugauauuaaagcgcaaaugaauuca

SEQ ID NO: 60067 - RNA, 64 nt, Human
uccuucgagaaaaaauuuauuuacagcucuuaaugcaguugaaaagagcaggcaaaagaauccu

SEQ ID NO: 60068 - RNA, 64 nt, Human
uguacaaggaguuacaagacuacagcuauaaccugcaguugagcaguuauaaaccuacaaaaug

SEQ ID NO: 60069 - RNA, 64 nt, Human
aguaacuuuuucauauauagcauguugccuguaugcaguugaacuauauaaaguucauugcaaa

SEQ ID NO: 60070 - RNA, 64 nt, Human
aauuuuuuuuaaaaaaguccaaaagcagcuaugggcaguugacaaaagaaaauguaaugacuac

SEQ ID NO: 60071 - RNA, 64 nt, Human
cuugauauuaguccccacacggaaaaagugaacugcaguugauauuugguguuuaagauagcac

SEQ ID NO: 60072 - RNA, 64 nt, Human
guaacuggauguuuucuaaacacuaaugaaaucagcaguugaugaaaaaacuaugcauuuguaa

SEQ ID NO: 60073 - RNA, 64 nt, Human
aaucagcaucucugacuaaugaaaaauggauguagcaguugaugauuuucuaucuuaauaaaug

SEQ ID NO: 60074 - RNA, 64 nt, Human
aaccuguuaagagacuuuaagcaugcuucaagaggcaguugacccacuggaauuucuauaaggc

SEQ ID NO: 60075 - RNA, 64 nt, Human
cuuuuaguguauucaacauugucugccucuuccugcaguugauguaauugcuuuguuugcaaua

SEQ ID NO: 60076 - RNA, 64 nt, Human
auacuugaaguuuaaugcucaguugggucggguggcaguugacuugguggcuggcauguucagc

SEQ ID NO: 60077 - RNA, 64 nt, Human
gcucuuuacauguuuucuguuugaaccuaaaauagcaguugacauggugguccugaagcaaagc

SEQ ID NO: 60078 - RNA, 64 nt, Human
cugucguuuuugaggagggcccauggggguaggagcaguugaaccugggaacaaaccucacuug

SEQ ID NO: 60079 - RNA, 64 nt, Human
gccccaccagccauccuugaagagacaauucagggcaguugaugaauaucagggcugagaugug

SEQ ID NO: 60080 - RNA, 64 nt, Human
gaaaaagaaaauaaagacaaccauauuuagcagugcaguugaguuguguguuaauguuagacua

SEQ ID NO: 60081 - RNA, 64 nt, Human
guuggguaccaugcuuuuucuccccuucacguuugcaguugaugugucuuuuuuuuuuuuuuua

SEQ ID NO: 60082 - RNA, 64 nt, Human
acaacuuuuaagggcauguuauuugaagugcucagcaguugaaagcaaaauaauaacugcuauu

SEQ ID NO: 60083 - RNA, 64 nt, Human
guucaguuucccucacagcagccuguguuagcaugcaguugaaaauacugccgucuaggagaac

SEQ ID NO: 60084 - RNA, 64 nt, Human
ucaccaccugcauccucuugcucagaaugccuuugcaguugaguuuucuggguuucuaugauug

SEQ ID NO: 60085 - RNA, 64 nt, Human
ccacaggggauuuaugcugcuuuacauugacuaugcaguugaagaguugcacaucaccuuuagu

SEQ ID NO: 60086 - RNA, 64 nt, Human
cugccccgcgggucucuggauugggacgcacagugcaguugaggucugcgucgggcuuggcuuu

SEQ ID NO: 60087 - RNA, 64 nt, Human
agagaguuggggugucugguaggcaaacugcaaggcaguugagauaguuggauuaagaggcuag

SEQ ID NO: 60088 - RNA, 64 nt, Human
uuuuguguuuuugugcaccaggcccggcugcguagcaguugagugaugcugguuagcuauuaag

SEQ ID NO: 60089 - RNA, 64 nt, Human
ccuggcuaagggcugggccuggccagcagggagggcaguugaugagagaggguguucccgcugg

SEQ ID NO: 60090 - RNA, 64 nt, Human
aaagacaguuuuaaagggagccaugcucuuaaaggcaguugauuaaagaaccuguuacaucucu

SEQ ID NO: 60091 - RNA, 64 nt, Human
cuccauccucauuugcaaaccucagagggauaaggcaguugaaccugaugagcaagaauuauaa

SEQ ID NO: 60092 - RNA, 64 nt, Human
uuaggaggaugucggggugaagggugguaucuuggcaguugaagcuggggcaagaacucugggc

SEQ ID NO: 60093 - RNA, 64 nt, Human
uucccuugguccccucuguccucccgcccugccugcaguugagauucagaugccuucugacaga

SEQ ID NO: 60094 - RNA, 64 nt, Human
cagagaugggugugugaggggugaggaggcaucagcaguugagccccgaaggagaucaggcagc

SEQ ID NO: 60095 - RNA, 64 nt, Human
aauuaugugaugaugcuguuaagcuuacagauaugcaguugauuuuuuaaaaagcuuaacuagg

SEQ ID NO: 60096 - RNA, 64 nt, Human
uguuugcaggagaaaaguaucaagacguuuaacugcaguugacuuucucccuguuccuuugagu

SEQ ID NO: 60097 - RNA, 64 nt, Human
uuuguauaguugaucagauguuuugggagguuaugcaguugagaaaagagaugucauuggcaaa

SEQ ID NO: 60098 - RNA, 64 nt, Human
augguguuaaugauauuagagaugaaaaacguuagcaguugauuuuuguccaaaagcaagucau

SEQ ID NO: 60099 - RNA, 64 nt, Human
aaaugggaaaagggaaaaggagagagcaauugaggcaguugaccauauucaguuuuauuuauuu

SEQ ID NO: 60100 - RNA, 64 nt, Human
uauuuucuuuugucaccccagaggugaaaaaucagcaguugaagccugacaggccucaguggug

SEQ ID NO: 60101 - RNA, 64 nt, Human
uuguuuggaccugcauauuuagcuguuuuggaacgcaguugauuccuugaguuucauauauaag

SEQ ID NO: 60102 - RNA, 64 nt, Human
accuaagauuucugucuuggggcuuuuggugcaugcaguugauuacuucuuauuuuucuuacca

SEQ ID NO: 60103 - RNA, 64 nt, Human
uaaccuguuccagccaggcuccucaugugaccucgcaguugagaagcccauuaucguggggcau

SEQ ID NO: 60104 - RNA, 64 nt, Human
cugggagguauagggguccugggggcaggccagggcaguugacagguacuuggagggcucaggg

SEQ ID NO: 60105 - RNA, 64 nt, Human
aucuuuucacuuuugacauagguaauguuguugagcaguugagcaauguucaguccaguuguga

SEQ ID NO: 60106 - RNA, 64 nt, Human
gggaagaacuugucccucaggcuuguugcccucugcaguugaucuccaaaguuuuaaaccuguu

SEQ ID NO: 60107 - RNA, 64 nt, Human
cugaccaaugcauuuuuuucagugacagucuguagcaguugaagcugugaaugugcuaggggca

SEQ ID NO: 60108 - RNA, 64 nt, Human
cuaggaggaccccgggcguggaccacccgcccuggcaguugaauggggcggcaauugcggggcc

SEQ ID NO: 60109 - RNA, 64 nt, Human
agaaaaaaauucaugcaucucaacaaagguggcagcaguugaaggaagagauugagcuacuuca

SEQ ID NO: 60110 - RNA, 64 nt, Human
uuugggaggccgagauggguggaucaugaggucagcaguugagaccagccugaacaacauggug

SEQ ID NO: 60111 - RNA, 64 nt, Human
uaacuagaguuaccaaaggcuuguuuuuucuugagcaguugaaaggagagaccaauauuuguga

SEQ ID NO: 60112 - RNA, 64 nt, Human
ucuauaaaacacuauaggacauuuguuuucaaaagcaguugaguaacagcaacauaaaccacau

SEQ ID NO: 60113 - RNA, 64 nt, Human
cgauucuguuuuguucaucuguucgagcagaggggcaguugaagucucguccuggucucugccc

SEQ ID NO: 60114 - RNA, 64 nt, Human
auuuuuccaugcagcaucuggugugaauaaaacagcaguugacugauguuuaccgcugugcuug

SEQ ID NO: 60115 - RNA, 64 nt, Human
guaagaaggcaguaaccuuucaucaugaucauaggcaguugaaaaauuuuuacaccuuuuuuuu

SEQ ID NO: 60116 - RNA, 64 nt, Human
ucuucuaagaaacggauaaagccacauaauuaaagcaguugaacuauagggaaagcacugaaca

SEQ ID NO: 60117 - RNA, 64 nt, Human
augauuaaaaacauagauauugcuuguauauuaugcaguugacugcaugcacacuuuacauuua

SEQ ID NO: 60118 - RNA, 64 nt, Human
agaauuggugggacuggcaucuucccucagacuugcaguugauagaggcugugguguucucacu

SEQ ID NO: 60119 - RNA, 64 nt, Human
gacccuaggagguagagugggaccaugucgugaggcaguugaagaguugaggaaagguuuuucu

SEQ ID NO: 60120 - RNA, 64 nt, Human
uuauuauuauuauuugcuuuucauguagaacucagcaguugacauccaaaucuagccagagccc

SEQ ID NO: 60121 - RNA, 64 nt, Human
cacagaauacaguguguguuauuacgaggagccagcaguugagccuaagguccuucuaccuacc

SEQ ID NO: 60122 - RNA, 64 nt, Human
cucccuguuucuggagcuggauguuccccagcuggcaguugagcugccugagccaaugugucug

SEQ ID NO: 60123 - RNA, 64 nt, Human
gagguugaaagauuuauucaagaucccaaagcuggcaguugauggaucugggauuucaauccag

SEQ ID NO: 60124 - RNA, 64 nt, Human
ggaccugccaagaagauuccuucuaacugaaggugcaguugaauucaguggguucagaaccaag

SEQ ID NO: 60125 - RNA, 64 nt, Human
acauuucaucagacagacaccucccucuggagaugcaguugagugacaaccuuguuacauugua

SEQ ID NO: 60126 - RNA, 64 nt, Human
aaauguugauucagaaaaggaaagcacaggcuaagcaguugaagguuccccaccauucagugag

SEQ ID NO: 60127 - RNA, 64 nt, Human
uccuuucagaauucccaggcugaaaucagccauagcaguugacaaaacagcuauccccacaagu

SEQ ID NO: 60128 - RNA, 64 nt, Human
uugaagugauuuuccuggaggauuaggguauuuagcaguugaagcucuucauucauaguaguua

SEQ ID NO: 60129 - RNA, 64 nt, Human
guaaaguccuauucuuucaucuuccacuuuauuggcaguugacauucccuuacucccaaucaac

SEQ ID NO: 60130 - RNA, 64 nt, Human
aaaacgaccgagaccgaagauuggcuacuguaaagcaguugaaagaauuuauucagcaaccaga

SEQ ID NO: 60131 - RNA, 64 nt, Human
aagacgacagagacugaagauuggucacuguaaagcaguugaaagaauuuauucagcaaccaga

SEQ ID NO: 60132 - RNA, 64 nt, Human
cccgagccgccugccgacugccugcacagggagagcaguugaggcccgggcagggcccccacac

SEQ ID NO: 60133 - RNA, 64 nt, Human
uugaaaguaccaggugaacaaaguuuaccagaaagcaguugagacaagaaaauaagagcucagg

SEQ ID NO: 60134 - RNA, 64 nt, Human
ugcucagggccaaggaagacaaaucuaggucauggcaguugaaaaagggccucauuggagauaa

SEQ ID NO: 60135 - RNA, 64 nt, Human
ucucucucugucacccaggcuggcgugcaauggcgcaguugacucacuacagccucugccuccc

SEQ ID NO: 60136 - RNA, 64 nt, Human
uuucagucaggauauacaguguugaaaucucaaugcaguugaaaucuggucugaugugccuaau

SEQ ID NO: 60137 - RNA, 64 nt, Human
agugcauacugguauaauagaugaucaugcaguugcaguugaguuguaucaccuuuuuuguuug

SEQ ID NO: 60138 - RNA, 64 nt, Human
uuugaguuucagcuggaaacuucuguaaggggcagcaguugaggugggguagugccgcaguggg

SEQ ID NO: 60139 - RNA, 64 nt, Human
uuauguauuuuugugcacuaggcgcaguuguguagcaguugaguaaugcugguuagcuguuaag

SEQ ID NO: 60140 - RNA, 64 nt, Human
acuugccauuuuaugguuaaaaacggcacauuaggcaguugaauaugacguuaccuugcagacu

SEQ ID NO: 60141 - RNA, 64 nt, Human
uuuuggaccacauuauuaaauuaauuguuaagcugcaguugaguuguucaagugagaguuuuga

SEQ ID NO: 60142 - RNA, 64 nt, Human
acugcacacagugaaguguuccaguuuccacugggcaguugagguggcuucuguaaccagggcu

SEQ ID NO: 60143 - RNA, 64 nt, Human
ccuuucuuugcuuguagggcauuuuguauguagagcaguugaaaacagaaccucagaacuuaac

SEQ ID NO: 60144 - RNA, 64 nt, Human
uuguagacauuuucuucuagaggaaaacucugaagcaguugaucaaacuuuguucaacaucagg

SEQ ID NO: 60145 - RNA, 64 nt, Human
ggaccccaagcuccucagccuggccccugggauugcaguugagaguuauucagugaauccauuu

SEQ ID NO: 60146 - RNA, 64 nt, Human
agaacuugcuccaagaagaagucaaaccaaacuugcaguugauuuggggucauguuuaggucag

SEQ ID NO: 60147 - RNA, 64 nt, Human
acaaaauuaacuguacaccaaacuccugcaacaugcaguugacccauguacacauacuccuuga

SEQ ID NO: 60148 - RNA, 64 nt, Human
aucuaaauguuuguggauuccugugucucccugggcaguugaccugcacagacaggaaccucag

SEQ ID NO: 60149 - RNA, 64 nt, Human
augugacuccaccucuuaaaagccgugauuucuagcaguugacuucaccucugugucggccuuu

SEQ ID NO: 60150 - RNA, 64 nt, Human
augugugcugugcugugucugcaccgcuugguuugcaguugagaggggagggcaggaggggugu

SEQ ID NO: 60151 - RNA, 64 nt, Human
uuuuggcauaugcuuuggauuauugguccaaggggcaguugaaagcacuuuuuucggaacacga

SEQ ID NO: 60152 - RNA, 64 nt, Human
cugcugaauccucaauggaaagggucgacugguugcaguugaaaugaccugaaauguagccucu

SEQ ID NO: 60153 - RNA, 64 nt, Human
ucuuuucuuuagaccuauuuuugaaggcauaaaagcaguugaguuucuggagaauuuuuggaug

SEQ ID NO: 60154 - RNA, 64 nt, Human
uucuggcggcggcagcccuggccccggccuccaagcaguugaaaaagcuggcgccuccuugguc

SEQ ID NO: 60155 - RNA, 64 nt, Human
aucagaaauuuuggaaggguucuuugaaauagcagcaguugaaacagagacacuuugccacagu

SEQ ID NO: 60156 - RNA, 64 nt, Human
ccaccuucucuccacagaauguuugcagagcugggcaguugaggaaaggacagccccugguugg

SEQ ID NO: 60157 - RNA, 64 nt, Human
gggguagaaaggggagggguggggcuaccagguagcaguugacaacccaaggucagaggagugg

SEQ ID NO: 60158 - RNA, 64 nt, Human
cauuugauucucguaaaacgcgcaucuggcgugugcaguugagaaacuugguggcacaugggug

SEQ ID NO: 60159 - RNA, 64 nt, Human
acuugguuggcaagugcaggaacucaguuaaaaugcaguugaagaaugucaucucccgaauugc

SEQ ID NO: 60160 - RNA, 64 nt, Human
ucccaggauaggugaaaggguuaaaaugaguaaagcaguugagcaaacaccaacccgagcuucg

SEQ ID NO: 60161 - RNA, 64 nt, Human
cagauuccccuggacgcuccugcugauucugucggcaguugaaggcccgucugaggccccgcaa

SEQ ID NO: 60162 - RNA, 64 nt, Human
guucucaauucauucauauuauuaagcucuuccugcaguugauaucugagcagaguaagauuug

SEQ ID NO: 60163 - RNA, 64 nt, Human
agcgcggcccgcaggucuuccuucucgccgucuugcaguugaagagcuacauacguagucaguu

SEQ ID NO: 60164 - RNA, 64 nt, Human
uaaagggacacuggauccagaagcuauggaaccagcaguugauucuuguauuccugauuaaccu

SEQ ID NO: 60165 - RNA, 64 nt, Human
cugcgaacaucagacugacuugcuggcgucaagagcaguugacucacugaugaaggcccuggug

SEQ ID NO: 60166 - RNA, 64 nt, Human
ucacggagugcuucauaucagacacgucaucggagcaguugacggcagggacaaaugaguacac

SEQ ID NO: 60167 - RNA, 64 nt, Human
cuaucguguuaaaagcucuaauaaugcuaguggagcaguugacauccaggguuuuuuuuccugc

SEQ ID NO: 60168 - RNA, 64 nt, Human
auuuagcugaagggcuugacaccuuugaauuacagcaguugacucagagugcaagaagucuggc

SEQ ID NO: 60169 - RNA, 64 nt, Human
uguuucgcagaaaaaaauccagaaaauuucaaaugcaguugaguauucuuuuuuaaaugcagau

SEQ ID NO: 60170 - RNA, 64 nt, Human
ccacuauaaaucuuaucaaaccaugguuguauaugcaguugaccgaaacauuguuauuggacac

SEQ ID NO: 60171 - RNA, 64 nt, Human
cugccugcacggcuccuauccaccugggggugucgcaguugaggggcuaauucccaggggacug

SEQ ID NO: 60172 - RNA, 64 nt, Human
uaauuuuaaaauaaaugcugcauugguaaagcuggcaguugaaaccaguuggacggcccagcuu

SEQ ID NO: 60173 - RNA, 64 nt, Human
auuuuuaugcuguuaauugguauucauucacaaugcaguugaagggggaaggcuccacugcauu

SEQ ID NO: 60174 - RNA, 64 nt, Human
acuccggaggcagccugggugggugagccauggggcaguugaccugggucuugaaagagucggg

SEQ ID NO: 60175 - RNA, 64 nt, Human
gcuuacgcgaugcggguaguauuguucccguugcgcaguugaggacaccgagguucacggucug

SEQ ID NO: 60176 - RNA, 64 nt, Human
uaucaggaggcagggaucacuguggaccaucuuagcaguugaccuaacacaucuucuuuucaau

SEQ ID NO: 60177 - RNA, 64 nt, Human
aagcaugccuccuucucccucccacccaccucaagcaguugaacacagccaguuauucuuccau

SEQ ID NO: 60178 - RNA, 64 nt, Human
agauuuugauacaauuugagggaggcagaagucugcaguugaagaaaaaaaauaagucuguuug

SEQ ID NO: 60179 - RNA, 64 nt, Human
cccacuucucacccaacucugccacuguucaggagcaguugacuaaacuuuuauccuuccuuua

SEQ ID NO: 60180 - RNA, 64 nt, Human
uaucagugcugccuuuagcuauacucagagagcagcaguugaggaauagguuuuuacucaaaau

SEQ ID NO: 60181 - RNA, 64 nt, Human
uagucuucacgcugagagagcacuacuugagagagcaguugaaaguuucaaaaacuuugguuca

SEQ ID NO: 60182 - RNA, 64 nt, Human
ugucugugagaccguguucccaggagcacugacugcaguugagagagacccauuuugcucuccc

SEQ ID NO: 60183 - RNA, 64 nt, Human
ucccccauguggucguuagagacagagcgacagagcaguugagaggacacucccguuuucggug

SEQ ID NO: 60184 - RNA, 64 nt, Human
caguggauagcuugauaucuucuguuuucccauugcaguugauuugagaagaugaagguuuaaa

SEQ ID NO: 60185 - RNA, 64 nt, Human
ccagccucuguguugagguugccggggguagggguggggccacacaaaucuccaggagccacca

SEQ ID NO: 60186 - RNA, 64 nt, Human
aacgaggcaagacaggacccaccugugcgugcgcuggggccaugggguggccccgccggggcag

SEQ ID NO: 60187 - RNA, 64 nt, Human
uguuccauggccccuaggcgaggugaucagggaguggggccaaugggcccccggcccuggcuuu

SEQ ID NO: 60188 - RNA, 64 nt, Human
uuggucagccauuccuuugauuggaaaggucagcuggggccaguggugccucaggcaggcccac

SEQ ID NO: 60189 - RNA, 64 nt, Human
gggagugccugguuggaucccacacuggcagagauggggccaccccuuccuuccaggcacaucu

SEQ ID NO: 60190 - RNA, 64 nt, Human
accugccaccaggccucaccaaagcccacugccauggggccaucugggccauucagagacugga

SEQ ID NO: 60191 - RNA, 64 nt, Human
aagaagaaacucuccccccaaauccuccaaccucuggggccacagcccugccccuccaguuccu

SEQ ID NO: 60192 - RNA, 64 nt, Human
cccacacaagcuuuucuccuccucuugcagggcauggggccaggcuccacucccaaaugagacu

SEQ ID NO: 60193 - RNA, 64 nt, Human
gauucugcacuccaugaaaaguucacuuggacgcuggggccaaaagcuguugauuuucuuaagu

SEQ ID NO: 60194 - RNA, 64 nt, Human
gcuucugcuccugccccuggccauuggugacuaguggggccaagagaagcuggagcagagagcu

SEQ ID NO: 60195 - RNA, 64 nt, Human
gauuugcuuuuccuugaacauuuguuuuaaauucuggggccaaaaugcaaaggagaaguucuau

SEQ ID NO: 60196 - RNA, 64 nt, Human
ccucccaucccagcugaucccagucacugcuugcuggggccaugccauggaagcuucccaucag

SEQ ID NO: 60197 - RNA, 64 nt, Human
caugcaggggcugggaggguuaggaugaaaaaacuggggccauuggaggcccacuguagguggg

SEQ ID NO: 60198 - RNA, 64 nt, Human
uagaccaggguuucucaaacucguacuugacauuuggggccagauaauucuuuguuguggggcu

SEQ ID NO: 60199 - RNA, 64 nt, Human
cccccaccauuccccucacugcacuuuggaccccuggggccaacaucuccaagacaaaguuuuu

SEQ ID NO: 60200 - RNA, 64 nt, Human
aaaacagcccugagcauggggcuuaaugggacaauggggccaagagugaagcgggcagggcccc

SEQ ID NO: 60201 - RNA, 64 nt, Human
gaugggccgcuggacacucggagggauauggggcuggggccaguuaugauugcaaggaccaccu

SEQ ID NO: 60202 - RNA, 64 nt, Human
ucugugggagagggcagcugccuuguguuaugucuggggccacaguugcugcaaaguccuggau

SEQ ID NO: 60203 - RNA, 64 nt, Human
caaagucaagcaagagacuaguugaagggaguucuggggccaggcucacuggaccauugucaca

SEQ ID NO: 60204 - RNA, 64 nt, Human
gaagagggaucccacgaaguuauucuuacgcagcuggggccaggagggucagaguggugccagg

SEQ ID NO: 60205 - RNA, 64 nt, Human
gagagcagaagaagucaaacaaagaagaagucccuggggccaugccuuucacuuuguagggugg

SEQ ID NO: 60206 - RNA, 64 nt, Human
uaugucaaacugucuuggcuguggggcuaggggcuggggccaaauaaagucucuuccuccaagu

SEQ ID NO: 60207 - RNA, 64 nt, Human
caccucaggggcuuggauauguggaauagugaacuggggccaugucaguuugucacucacccaa

SEQ ID NO: 60208 - RNA, 64 nt, Human
gcugaagagagggacaggcacuccaaaccugucuuggggccacuuucagagcccccagcccugg

SEQ ID NO: 60209 - RNA, 64 nt, Human
accaggcccucacuccccuuccccauguugucgauggggccagagaugaagggaaguggacuaa

SEQ ID NO: 60210 - RNA, 64 nt, Human
guggaggguaggggagugugggugaucagaaggcuggggccaguguaaggcauagggaauaugu

SEQ ID NO: 60211 - RNA, 64 nt, Human
uucaugugacacagggguguugugagagcugggauggggccagagauuauaaguuugacacaac

SEQ ID NO: 60212 - RNA, 64 nt, Human
cauuguaaauauuuaucugucaguuuugacagauuggggccagcuugauguuuuaaaucuucag

SEQ ID NO: 60213 - RNA, 64 nt, Human
ccagggccaaugcccaaaauaaggaguuccaauuuggggccaaaugaggaaggacacagacucu

SEQ ID NO: 60214 - RNA, 64 nt, Human
caaccuggggccccaucuuggaaugggggcuccuuggggccagcccaguguggcucaccacacu

SEQ ID NO: 60215 - RNA, 64 nt, Human
cagcagcugucuugguaaaggagagagagagacauggggccaguaauuccggggugcucagaag

SEQ ID NO: 60216 - RNA, 64 nt, Human
cuagucacuguuauggggugauaagaggacuucuuggggccagaacuguggaggagagcacauu

SEQ ID NO: 60217 - RNA, 64 nt, Human
caggcagcagugucuguaccucgggugggagggauggggccaucuccuucaccguggcuaccau

SEQ ID NO: 60218 - RNA, 64 nt, Human
aagcggcagaggagugcccuggcuuggucaccacuggggccaaggugggguggagagaggccua

SEQ ID NO: 60219 - RNA, 64 nt, Human
uucgcagcuuccgggagaaggggccagagcccgguggggccaguuucucacagagggaggaggu

SEQ ID NO: 60220 - RNA, 64 nt, Human
aacguggcauagaaaagaacauguucagaagccauggggccaagcacaugcggggacggucuca

SEQ ID NO: 60221 - RNA, 64 nt, Human
cugguuauuagaaucaggauaaaaauaaggaaacuggggccauuacaauguaccgagaaggaag

SEQ ID NO: 60222 - RNA, 64 nt, Human
gcaaacugauggaccgggugggccuggccugagcuggggccacaaaucaaagcaagggcuccag

SEQ ID NO: 60223 - RNA, 64 nt, Human
uagagcagggauuaaccucugcacuacugacauguggggccaggucacccuuugcugugaggcu

SEQ ID NO: 60224 - RNA, 64 nt, Human
aaagagucacaguguggguuaaagggaucugcaguggggccaaggaugccaccccacccucagc

SEQ ID NO: 60225 - RNA, 64 nt, Human
agccucuggcaggaacucagggcccuggagcugcuggggccaagccaaggccuccccuaccuca

SEQ ID NO: 60226 - RNA, 64 nt, Human
caaacaaacuacggagcuggggagggcuguggcuuggggccagcucccagggaaauucccagac

SEQ ID NO: 60227 - RNA, 64 nt, Human
ccaauacuuuuuuuaauuugcauuuuuuuucauuuggggccaaaaguccagugaaauuguaagc

SEQ ID NO: 60228 - RNA, 64 nt, Human
cuccuugugccucaguuuccccaucuggaaaaaauggggccaccucuugccagcaguagcaggg

SEQ ID NO: 60229 - RNA, 64 nt, Human
aagagagaaaagaaggguaguaaaaacuagagauuggggccaggcgcaguggcucacgccugua

SEQ ID NO: 60230 - RNA, 64 nt, Human
uggggaaagcugguccagcagcagggguggaggcuggggccacacugcgggacagcagccccuc

SEQ ID NO: 60231 - RNA, 64 nt, Human
gaaggaacaugaucccuccagaagucucccacccuggggccaacucacugccauguucaguguc

SEQ ID NO: 60232 - RNA, 64 nt, Human
agcguggacauagcccugugauacugcaucucacuggggccagaggaagggagggagggugggg

SEQ ID NO: 60233 - RNA, 64 nt, Human
caggggugggaaggguccaucugggcaaggggaauggggccauguuguugacauuagguacuua

SEQ ID NO: 60234 - RNA, 64 nt, Human
uuguccuugccagcucuugggauccuuggauaccuggggccauuuaagaagcuaggggaauuag

SEQ ID NO: 60235 - RNA, 64 nt, Human
aggcccuucuuccucacccaagaugcagggugguuggggccaggaguuuggacccucuaggucu

SEQ ID NO: 60236 - RNA, 64 nt, Human
ggugucuaauguguagugcuacacaccuaacuuauggggccaaaauagcauguccuaaugcuug

SEQ ID NO: 60237 - RNA, 64 nt, Human
acacacacacacguauaucuauuuaugcacauauuggggccaauuugauuugcuaguauuagac

SEQ ID NO: 60238 - RNA, 64 nt, Human
ugcacucccaugggaaugccgcagggagccaggcuggggccaugggcugcugccagaggaccgu

SEQ ID NO: 60239 - RNA, 64 nt, Human
ugucacccuuuuuauaagacuuuuccucauucuguggggccauaaaccuauuuagucuggagcc

SEQ ID NO: 60240 - RNA, 64 nt, Human
ggacagcuccuucccuacucauucccugcccaaguggggccagaccucuuuacacacacauucc

SEQ ID NO: 60241 - RNA, 64 nt, Human
aguuuuaggacaaacagcucaguucuagucucucuggggccacacagaaacucuuuuugggcuc

SEQ ID NO: 60242 - RNA, 64 nt, Human
cgucaugaaaaaagaaccauuucugaagcccgauuggggccaaacauuuacaccuugcuucaua

SEQ ID NO: 60243 - RNA, 64 nt, Human
cguaguucaacccagauagggaccacagagauucuggggccagccaggggcagucaaauuggca

SEQ ID NO: 60244 - RNA, 64 nt, Human
ucagggagguccgaucuggaacacauauuggaauuggggccaacuccaauauaggguggguaag

SEQ ID NO: 60245 - RNA, 64 nt, Human
cugcgcuccuuagauuaggaugcucugguauuccuggggccaguuaaaaugggucagugagggg

SEQ ID NO: 60246 - RNA, 64 nt, Human
uuuaguaucuguucucucugagccuggaugggcuuggggccagaccuuugccugauuccugauu

SEQ ID NO: 60247 - RNA, 64 nt, Human
agcaucaccaccacaccccugccggccuuggccuuggggccagacuggcugcacagcccaacca

SEQ ID NO: 60248 - RNA, 64 nt, Human
aguacaagauggcuaaggagaacaggggggaugauggggccaccgagaggccgaagaaggccaa

SEQ ID NO: 60249 - RNA, 64 nt, Human
cucccuuucuuaaggaggcggaugccaagaaguguggggccaaaccugcaggguccggccuggu

SEQ ID NO: 60250 - RNA, 64 nt, Human
gucaagcaguggucaaaccauaaucucuuuucacuggggccaaacuggagcccagauggguuaa

SEQ ID NO: 60251 - RNA, 59 nt, Human
agccacggccagggagcuagugagggugauggggccaggaccugccccugaccaaugau

SEQ ID NO: 60252 - RNA, 64 nt, Human
cuccccacucccagcucucuugcacugcaggcccuggggccagcccgcacacaccaugccuccu

SEQ ID NO: 60253 - RNA, 64 nt, Human
ucuccugugaucucuguguuuucccuuuucuuucuggggccaggaagucagggucaacucccag

SEQ ID NO: 60254 - RNA, 64 nt, Human
ccgcccgcuggagcaccugccaccgaggcgcgcguggggccacugccguggcggcggcugcccu

SEQ ID NO: 60255 - RNA, 64 nt, Human
ccagaacugcaugguuccauuuucuccggggcuguggggccaaaguagaagccugcgggcugcg

SEQ ID NO: 60256 - RNA, 64 nt, Human
aggaggagguaacauagaugccugggccugaugguggggccauacccaugugucgccucucacu

SEQ ID NO: 60257 - RNA, 64 nt, Human
gagaaaucaccuugucuggugauuuucugccugguggggccauuuguauaacgacacuugugca

SEQ ID NO: 60258 - RNA, 61 nt, Human
acagcgcccaccugucauagggaccucacccuggggccagagugggcucuggucuccacag

SEQ ID NO: 60259 - RNA, 64 nt, Human
cccccgaccuuggggcuugugucgagcccuuggguggggccaggaggaggugauggcgucagag

SEQ ID NO: 60260 - RNA, 64 nt, Human
gucuugaccccgcugccucagccucccaaauaacuggggccacaggugugcaccacaacucuca

SEQ ID NO: 60261 - RNA, 64 nt, Human
uugcccagaauuggggauggggcaguuagcauguuggggccaggaagggacaaguuagauaagg

SEQ ID NO: 60262 - RNA, 64 nt, Human
ggcaccggccucugcacugacucauuucuggucuuggggccagucucaggggaagcuggguggg

SEQ ID NO: 60263 - RNA, 64 nt, Human
gccccugcuuaggauuaggugguccucacagggguggggccaucacagcucccuccugccagcu

SEQ ID NO: 60264 - RNA, 64 nt, Human
aagaugggugguugaaugauuucccacucagggcuggggccaagaggaaaaacagggaaaaaaa

SEQ ID NO: 60265 - RNA, 64 nt, Human
aacagagccugccuaaccaggcccagccaguugguggggccaggccaggaccacacagucccca

SEQ ID NO: 60266 - RNA, 64 nt, Human
cuucacaggaugacacccucccauaccccauagcuggggccagcagguucugcugagggugggg

SEQ ID NO: 60267 - RNA, 64 nt, Human
gugcaguguuggagagugacacugucggggcagcuggggccacaagcaggagccggccucgggc

SEQ ID NO: 60268 - RNA, 64 nt, Human
ugugcccuggacuacuagacucagacagaagggcuggggccauuaaagcugaauuuucuaagca

SEQ ID NO: 60269 - RNA, 64 nt, Human
caccuuuaaggaccagcugggcuguagugauuccuggggccagaguggcauuauguuuuuacaa

SEQ ID NO: 60270 - RNA, 64 nt, Human
ggcacaaugacgacucacugcagccucaaccuccuggggccaagugauccucccaccucagccu

SEQ ID NO: 60271 - RNA, 64 nt, Human
gagcccuggugaggagcugagggggauggguugcuggggccaggagggucucuccuccagcccc

SEQ ID NO: 60272 - RNA, 64 nt, Human
uccuuucaaacccucaugacugacaaaaacuccauggggccaaaucugccugaagaucauuacc

SEQ ID NO: 60273 - RNA, 64 nt, Human
ugagcguguaaaagcuuggcccugugcccuacaauggggccagcugggccgacagcagaauaaa

SEQ ID NO: 60274 - RNA, 64 nt, Human
ugaaacgcaugagccgugagcgcccaguucagacuggggccagggaggggcaguccuuggcacu

SEQ ID NO: 60275 - RNA, 64 nt, Human
ugugauaugguguuuuauacgcuuccucguacgcuggggccaaggcaguauacauuccucugac

SEQ ID NO: 60276 - RNA, 64 nt, Human
aauacaacaaaaacaucucuuaaaaaugcugggauggggccauaucuacuagcagaggccagau

SEQ ID NO: 60277 - RNA, 64 nt, Human
ugaccuggagaggagaugggggacagugcuguuguggggccagcagugaaucuguaugcggaga

SEQ ID NO: 60278 - RNA, 64 nt, Human
caggaaguagaacagaaucgccacaggacuguucuggggccagcuucccuuaacucuguagccu

SEQ ID NO: 60279 - RNA, 64 nt, Human
agcauuuaaaacuccagaugcccacaccacacccuggggccacccaucagaccuucuggaagca

SEQ ID NO: 60280 - RNA, 64 nt, Human
gccacaaccucaccaccaacaaagaggacuuuuguggggccacaaguaagaggucauuucugga

SEQ ID NO: 60281 - RNA, 64 nt, Human
uucccaugagagagugcuccaaaccguuccaagguggggccaguugcgauucuaaaggaagaag

SEQ ID NO: 60282 - RNA, 64 nt, Human
cagcuuuaaccugggcauguuuccuggguaccaguggggccaggagguggcucuggcucagagc

SEQ ID NO: 60283 - RNA, 64 nt, Human
aaucaagguguggcuuccauugaggagcccaggcuggggccacaacccugaauaaacucuguug

SEQ ID NO: 60284 - RNA, 64 nt, Human
guguuacuccucaccaaaacuuggcaguucuuuuuggggccaugggacaccuuucucugaagag

SEQ ID NO: 60285 - RNA, 64 nt, Human
ugugggagucagggaggagggcccguuggguagcuggggccaggcuucucuccccaccaccugc

SEQ ID NO: 60286 - RNA, 64 nt, Human
uugaagcccugcagaaggugcaauguagggguucuggggccacagaggagaggccacuucccac

SEQ ID NO: 60287 - RNA, 64 nt, Human
cuguacagaacuggacagguugggccggcagugguggggccagagggcucugugcucuaggagc

SEQ ID NO: 60288 - RNA, 64 nt, Human
gggggaagcagagggaggugggcugaggccucgguggggccagugcgacgcuggcuuaaggagc

SEQ ID NO: 60289 - RNA, 64 nt, Human
acaauuaacugagcaaauuaauuaggcuucagucuggggccaucuggccccacucucuaggccc

SEQ ID NO: 60290 - RNA, 64 nt, Human
cccagaagcuagcuggcuagaggguuagccuggcuggggccagcucagguccacuucaacagaa

SEQ ID NO: 60291 - RNA, 59 nt, Human
uccgccgcauuguggaguaaugacaugaauggggccauauucuuccuggggcccaaaug

SEQ ID NO: 60292 - RNA, 64 nt, Human
uuaaguuugcaugagauagccuaauaaauggagguggggccaggcaugguggcucacacgugua

SEQ ID NO: 60293 - RNA, 64 nt, Human
ugcccgucagccagugaugccucgggccacgcuguggggccaccucaguccugccuggguccug

SEQ ID NO: 60294 - RNA, 64 nt, Human
ugcggcuuaguucccugaggcaggcagggcuuauuggggccauuucauagaaaggcagauugaa

SEQ ID NO: 60295 - RNA, 64 nt, Human
ccucaaggucauccuggagaugggauccaggacguggggccaugacucucugggaccuugccac

SEQ ID NO: 60296 - RNA, 64 nt, Human
guaacuggcggauucgagggguuccuuccacuucuggggccaccucuggaucccguucagaaaa

SEQ ID NO: 60297 - RNA, 64 nt, Human
ccucuucccaagccuguuucccauaucacagauguggggccauggccucgaugauggucuccac

SEQ ID NO: 60298 - RNA, 64 nt, Human
gggaaucggggcgggugauggagguggacaagaguggggccacucugcgccucugcuguugcgg

SEQ ID NO: 60299 - RNA, 64 nt, Human
cccaacccacccgggccaggaacccccaggaagguggggccacgcugcaggcaggucucacugc

SEQ ID NO: 60300 - RNA, 64 nt, Human
cuccucgccgcuguacaggacguuuacugcugcuuggggccagggcaguccuuugaaagggaag

SEQ ID NO: 60301 - RNA, 64 nt, Human
uacuuuaccaaaggaacccccgccaggacccacauggggccacguguuggcaguggaaucagcc

SEQ ID NO: 60302 - RNA, 64 nt, Human
cauccuucaucuggauuccagagcacugcuccaguggggccaugauugguuucuaggcaguuca

SEQ ID NO: 60303 - RNA, 64 nt, Human
gaaguuggcagcaacagaggggccuaugucaaacuggggccagcccugaccccacauauugugc

SEQ ID NO: 60304 - RNA, 64 nt, Human
gaaaccuuccugcugagccucacagcagugagacuggggccacuacauuugcuccauccuccug

SEQ ID NO: 60305 - RNA, 64 nt, Human
gauugaggaaaacuaaaacugagaggcuacuuccuggggccacacagacugacucucucauggc

SEQ ID NO: 60306 - RNA, 64 nt, Human
uccaauuguucugcucuaacugauaccucaaccuuggggccagcaucucccacugccuccaaau

SEQ ID NO: 60307 - RNA, 64 nt, Human
gccucaagugacagccaggaagagaccugaagguuggggccaccacaaugccaaaucguuucua

SEQ ID NO: 60308 - RNA, 64 nt, Human
aggguuccacaggccccugaccgcacagggaggcuggggccagccuggucucccaggccugagg

SEQ ID NO: 60309 - RNA, 64 nt, Human
gggcucguccagagaucucaaacuccgaugccccuggggccacguauguuguauaaauggauga

SEQ ID NO: 60310 - RNA, 64 nt, Human
caguuccugggucccccagccggcuggguggcucuggggccaaccgaccacaggugucacugau

SEQ ID NO: 60311 - RNA, 64 nt, Human
gucagagguagugaaggccgcuccaaauagugacuggggccaggcaggcggaaaagagaacaga

SEQ ID NO: 60312 - RNA, 64 nt, Human
aacacgauaaaccauggccaauucaguuucacuuuggggccaauuacuugaaguauccacagaa

SEQ ID NO: 60313 - RNA, 64 nt, Human
ccaagcacccuuagcccugacaucugucaagcuuuggggccacaaaauaauuuaauauaacccu

SEQ ID NO: 60314 - RNA, 64 nt, Human
uccaggcucaaugcagaaaccccaaggacacgaguggggccaggugaguuccugaagcuauacc

SEQ ID NO: 60315 - RNA, 64 nt, Human
ccaggccucuauuguuccauguuguaaauaccccuggggccauggugggaugggggugcaggcc

SEQ ID NO: 60316 - RNA, 64 nt, Human
gaacuaggagaaccuggggguggauuuggguggguggggccaaagaggaggcuucuauugauaa

SEQ ID NO: 60317 - RNA, 64 nt, Human
auaaacuggcuugccuguggacccuccccggcucuggggccagucgagagccacugagggaccc

SEQ ID NO: 60318 - RNA, 64 nt, Human
ugccagucccugcguucccuggcccgagcuggucuggggccauuaggcagccuaauuaaugcug

SEQ ID NO: 60319 - RNA, 64 nt, Human
caucucugagguggaccuugucaccugugguuauuggggccaagguggacucagcuccggggag

SEQ ID NO: 60320 - RNA, 64 nt, Human
ugagaugucuagacuggugcguuguggucuccgguggggccagauccccagaacagggagagac

SEQ ID NO: 60321 - RNA, 64 nt, Human
gaaaccacugugugguggggggcacugggcuuguuggggccagaaauguccacguccugagcuu

SEQ ID NO: 60322 - RNA, 64 nt, Human
guggagcugaauuuucuggaaaaugcuucuuggcuggggccacuaccuccuuuccuaucuuuac

SEQ ID NO: 60323 - RNA, 64 nt, Human
ggaccgugagaaauaucugucccauuuagaucucuggggccacugaugggaugcccugggaaga

SEQ ID NO: 60324 - RNA, 64 nt, Human
ugugccuuacccucuguaagauacugauucuuccuggggccaguauuaccuuguaugcaaauau

SEQ ID NO: 60325 - RNA, 64 nt, Human
cacugucugaccauguugcauuuggaaggcuaaauggggccaugaagaaggcuggaagggacag

SEQ ID NO: 60326 - RNA, 57 nt, Human
uagccuggcuucagagcugagagugccuggggccacaggaaaggcaggaacaggacc

SEQ ID NO: 60327 - RNA, 64 nt, Human
aacggcggcacccaggccucccugcagacuccaauggggccagcacuggaggggcccacccaca

SEQ ID NO: 60328 - RNA, 64 nt, Human
gcgccccugcagauuccagcagggucccucugaguggggccaggcccaggacugucacacaagg

SEQ ID NO: 60329 - RNA, 64 nt, Human
aacccacccaggcaggaagaagccgccccuccucuggggccauauuuuucugcugggucacaac

SEQ ID NO: 60330 - RNA, 64 nt, Human
aauguaaaaagccuuuccaaccacugaucagcauuggggccauacuaagguuuguaucuagaug

SEQ ID NO: 60331 - RNA, 64 nt, Human
aauauacccauugaauguauauccugagaaaaauuggggccaaagaagcaggaaaaucucaaag

SEQ ID NO: 60332 - RNA, 53 nt, Human
cgaccuggcuuuccuucugagcguggggccagcuccccccgcgcgcccaccca

SEQ ID NO: 60333 - RNA, 64 nt, Human
cauuguuaugcacuuuuccccaauucauguuugguggggccauccacacccucuccuugucaca

SEQ ID NO: 60334 - RNA, 64 nt, Human
ccccaggcaggcuuuggaguuguuuccauggugauggggccagauguauaguauucaguauaua

SEQ ID NO: 60335 - RNA, 64 nt, Human
acucucugccuucugccccacuacuguggggcaguggggccagagcccaccuccccaacaugug

SEQ ID NO: 60336 - RNA, 64 nt, Human
aguggccccaggggguuagaggaggggugaagauuggggccaguaucgaucuuaugaagcugga

SEQ ID NO: 60337 - RNA, 64 nt, Human
gggugcugagcauugagucacugaucucuugugauggggccaaugagucaauugaauucauggg

SEQ ID NO: 60338 - RNA, 64 nt, Human
uucuggugcccuagggacugcuguggccagagccuggggccagccaguacaguccugagccgag

SEQ ID NO: 60339 - RNA, 64 nt, Human
ucggccugcagugccagacucugagccaagccacuggggccaugcguaugacuggugcagggag

SEQ ID NO: 60340 - RNA, 64 nt, Human
gcuaccuggaccggaaauguccucauccccucccuggggccaggcucugcccuggccuuccucu

SEQ ID NO: 60341 - RNA, 64 nt, Human
caauucgaguuccaagcaacauuugcuccugcccuggggccagcucugccccagcccugagagg

SEQ ID NO: 60342 - RNA, 64 nt, Human
aagggggccuauuuuucuccaaaggccauccuuuuggggccaccuggcuccaagaagcaucgcu

SEQ ID NO: 60343 - RNA, 64 nt, Human
gguggaguuugaagacucuugggaaagccucuccuggggccacuguugggggugggagugagcc

SEQ ID NO: 60344 - RNA, 64 nt, Human
gaguagccugcucccacacugucacuggaugucauggggccaauaaaaucuccugcaauugugu

SEQ ID NO: 60345 - RNA, 64 nt, Human
cuauucauauuaguggccugagagguguuuguuguggggccacccugugcaugguagaauguuc

SEQ ID NO: 60346 - RNA, 64 nt, Human
gaaaaauucucuccagacauagucagaugucuccuggggccauaucaccccuccguuaagaacc

SEQ ID NO: 60347 - RNA, 64 nt, Human
ggugcuggugggaaaugggcuugagucacucaccuggggccagaagaggcccccagggaguugu

SEQ ID NO: 60348 - RNA, 64 nt, Human
aaccauuccugauagaguagccgagggagagucuuggggccaagaagggcccagggugggucag

SEQ ID NO: 60349 - RNA, 64 nt, Human
gcuugcaggagggucugcaagugcagacagcagcuggggccaaagagguguuagguucaaaggc

SEQ ID NO: 60350 - RNA, 64 nt, Human
caacugucggggcuuuccgccggcucacagcaguuggggccagcggggagaagagaggcggaac

SEQ ID NO: 60351 - RNA, 64 nt, Human
ugucccucccugggaaugugacaugagggccgacuggggccaggcucaggggcagaggcuggga

SEQ ID NO: 60352 - RNA, 64 nt, Human
gucuuucuaauccagccaacgucugcucaggaaguggggccagcuccacugggacccauaguuu

SEQ ID NO: 60353 - RNA, 64 nt, Human
ugggaacuuccaggccucagcgcagagcccugcuuggggccagcacggugggcagcugccggcc

SEQ ID NO: 60354 - RNA, 64 nt, Human
caguguuuaaacgcaacaaaaggcuacauuuccauggggccagcacugucaugagccucacuaa

SEQ ID NO: 60355 - RNA, 64 nt, Human
ggagcuccuucugccauuccaacuaguuucuuccuggggccaguuuuggguuuagguuguaauu

SEQ ID NO: 60356 - RNA, 64 nt, Human
ccuuucacagugacagaagaagcagaugucaccguggggccacugaucuuccuggacaggaggg

SEQ ID NO: 60357 - RNA, 64 nt, Human
ucaaggugcaaagaaccuguuuuggaagaaagcuuggggccauuucagcccccuguauucucau

SEQ ID NO: 60358 - RNA, 64 nt, Human
caccugacgagggcacucugagauagcacugcucuggggccaucugaucaccaucgggagcaaa

SEQ ID NO: 60359 - RNA, 64 nt, Human
aagagauacaaacugagacuccagccucuccuccuggggccacccaaguggggagaaccccuag

SEQ ID NO: 60360 - RNA, 64 nt, Human
ccuggcccuggcccuggcauaucaccccgcacuguggggccaggcaccacuagccuggcucaaa

SEQ ID NO: 60361 - RNA, 64 nt, Human
uacccgggagcugucccugucugucacagcacaguggggccacgaggcugacauucucuggccu

SEQ ID NO: 60362 - RNA, 64 nt, Human
ccugacccuggugggcuguucagcuuccugcugcuggggccagcgauuuuugaggauuuaucuu

SEQ ID NO: 60363 - RNA, 64 nt, Human
cugcuuuucagauccacuaugcaagaggggaggguggggccacgugaaaggcagcucuagacau

SEQ ID NO: 60364 - RNA, 64 nt, Human
acaggagccgcuccugagccugccuccagcuggcuggggccaccgugcggggugccaacgggcu

SEQ ID NO: 60365 - RNA, 64 nt, Human
ccuaauggagacaccaggcuacuaggacacuggcuggggccacccccuccugccuaaugccuca

SEQ ID NO: 60366 - RNA, 64 nt, Human
cuccaccugccccagccccugccucugccccaaguggggccagcugcccucacuucuggggugg

SEQ ID NO: 60367 - RNA, 64 nt, Human
gggcuggggggacaggcaccaaguaugaagaggauggggccagcggggccugucuggcucuggc

SEQ ID NO: 60368 - RNA, 64 nt, Human
ucaagggagcagggccaccuuccugcaaguuuacuggggccaguuuguaccaguucagauucug

SEQ ID NO: 60369 - RNA, 60 nt, Human
ucacccucgaguacuccugagcaccccagcuggggccaggcugggucgcccuggacugug

SEQ ID NO: 60370 - RNA, 64 nt, Human
aggcacccucagggagccuccccaucuguccagcuggggccagaggcugggagucccuaccugc

SEQ ID NO: 60371 - RNA, 64 nt, Human
uguggcaucauacucagaaaggaagaccaugccauggggccagaaauucagaaacguaauucuu

SEQ ID NO: 60372 - RNA, 64 nt, Human
cauuugagugagggcacuuuuuuuguacauaugauggggccaaugcacaauacuuuuaucacaa

SEQ ID NO: 60373 - RNA, 64 nt, Human
ccucucugccagaggcuuucaugagccccaaggcuggggccacagcuccuaccccugcccagca

SEQ ID NO: 60374 - RNA, 64 nt, Human
uaaaugccaccaccucaguucaagcccugaagccuggggccagcugggacuugaagggagcacg

SEQ ID NO: 60375 - RNA, 64 nt, Human
uauuuucugagagacagaauucaaguggguauucuggggccauccaauuucucuuuacuugaaa

SEQ ID NO: 60376 - RNA, 64 nt, Human
ucuuucugucaggggcucccacaggaucagaggcuggggccaacuggaaccauuggcagcugca

SEQ ID NO: 60377 - RNA, 64 nt, Human
agccauuggcuuggcugcagaguagacugagagcuggggccacguaucccugugcuggcaccug

SEQ ID NO: 60378 - RNA, 64 nt, Human
uaggccagguggagaugaggauggguaacaguauuggggccagaucccuaagccccccagcugu

SEQ ID NO: 60379 - RNA, 64 nt, Human
cuuuuuuuucuguaccacaggcauuaucuauaccuggggccagauuuucugcacuuugaaaugu

SEQ ID NO: 60380 - RNA, 64 nt, Human
cuuuugauguaucccuuugugaaauuagcacuuuuggggccaauggagaaaugcagcauucacu

SEQ ID NO: 60381 - RNA, 64 nt, Human
gacuuuuuuggugacucaaucccagugucugguuuggggccaaucuacaauggauccaaaagga

SEQ ID NO: 60382 - RNA, 64 nt, Human
uuguuucaacuguuacacagagaugaccagaggauggggccacugcagugcaguucaagaggcu

SEQ ID NO: 60383 - RNA, 64 nt, Human
ugaagaccaaagaacuccuuggaugaaaguccacuggggccagcaauacuccagagcccaguuu

SEQ ID NO: 60384 - RNA, 64 nt, Human
aacugcauccacagagaagccccaagaaggagguuggggccagcucauaaaaagccugaaugcc

SEQ ID NO: 60385 - RNA, 64 nt, Human
acuucugagcccuugggauucaaaguggcagccauggggccacuguugugggcuuugcucagug

SEQ ID NO: 60386 - RNA, 64 nt, Human
cacaaagggcaaguggggcccgaggaagccucucuggggccagggguagcugagcuuaaaggcc

SEQ ID NO: 60387 - RNA, 64 nt, Human
ggcacgcccauagucccucugcagagccucgcacuggggccagggcaggcaccagccccaggcg

SEQ ID NO: 60388 - RNA, 64 nt, Human
ugagcccugugucgggaugucauguccuccaggcuggggccaucuggaugccaccucugcaggg

SEQ ID NO: 60389 - RNA, 64 nt, Human
uggaauuauuagcaccagcuugcuucucugccgguggggccagcgcugaacagaccggggugga

SEQ ID NO: 60390 - RNA, 64 nt, Human
ggcacccaugaggcugcgcugcacuccucugcccuggggccaccucggcugcugcagccugccc

SEQ ID NO: 60391 - RNA, 64 nt, Human
ccgcucugagggcccuccagaccugcucgggugcuggggccaugccgagucgcggcccugcuca

SEQ ID NO: 60392 - RNA, 64 nt, Human
gguggggggguggggcagcggaaucuguccuggauggggccagcuuaaauaauacuggcaacca

SEQ ID NO: 60393 - RNA, 64 nt, Human
aagccuuuuuauuaugaucuugaaugcggacaauuggggccaaacgaggaaggacacagaccca

SEQ ID NO: 60394 - RNA, 64 nt, Human
cauuuggugagagucaaagcugaccauggaucccuggggccaacggcaacagcaugggccucac

SEQ ID NO: 60395 - RNA, 64 nt, Human
gggaaggcagcggaagacgccagcugccagggccuggggccacugggccagcgccuggcgauac

SEQ ID NO: 60396 - RNA, 64 nt, Human
gaaccugcccucagcccuggaagcuagcaucuucuggggccaggggcuugcuuccucgcuccau

SEQ ID NO: 60397 - RNA, 64 nt, Human
cccgagggcacagggacccggggccccgcggggcuggggccagacaaagacucggcaaaggggc

SEQ ID NO: 60398 - RNA, 64 nt, Human
aagccaagcuggccccugccuguuccuguagcucuggggccaggucagccguggccccaccuac

SEQ ID NO: 60399 - RNA, 64 nt, Human
gggcggcucggggcugcugggguuuccgaggaaguggggccagggcgucaagggagggcuggug

SEQ ID NO: 60400 - RNA, 64 nt, Human
uaucgaucaccagcaccaggguggcccgugugcguggggccagcgucgccgggcugcccagccu

SEQ ID NO: 60401 - RNA, 64 nt, Human
ugcacauacaaaggucugagcccagggcagcuucuggggccacugcacaggccaccugcuuggg

SEQ ID NO: 60402 - RNA, 64 nt, Human
uuuuuaaaccacaguuugauuuaguuagccuugcuggggccauaauaugcuucaggguguguaa

SEQ ID NO: 60403 - RNA, 64 nt, Human; identical to SEQ ID NO: 60402

SEQ ID NO: 60404 - RNA, 64 nt, Human
guucaaaggaacaccagcucugaaaacaugaccguggggccaggauguuucuggcaggcccaga

SEQ ID NO: 60405 - RNA, 64 nt, Human
cccaagacuacucugggcagcucccaucccagucuggggccauuugcagacucaggaaaggauu

SEQ ID NO: 60406 - RNA, 64 nt, Human
acacucccuugugcagcuuugagccuaguuuagcuggggccagggaggggugcuacuguuuucc

SEQ ID NO: 60407 - RNA, 64 nt, Human
uggugccuuucuuucuaagaaaagauagaaagaauggggccagguucaugucccaguugucacc

SEQ ID NO: 60408 - RNA, 64 nt, Human
gggcugguaguauggacuaaggugcugcaggaccuggggccagggacauccugugcagaagcuc

SEQ ID NO: 60409 - RNA, 64 nt, Human
ugacuggaggccucuccgcguggguacuuggggguggggccacaaaucuggcgaaaaacuucau

SEQ ID NO: 60410 - RNA, 64 nt, Human
acgaaugggauuaaggcccuuauaagaagagacauggggccaggugcaguggcucacaccugua

SEQ ID NO: 60411 - RNA, 64 nt, Human
ucuagagaguugcgaaucuaaaccugggacaggcuggggccaggaggcagaaacaccagccucu

SEQ ID NO: 60412 - RNA, 64 nt, Human
ucugucagacuuccucuuuguaccacaguggcucuggggccaggccugccugcccacuggccau

SEQ ID NO: 60413 - RNA, 64 nt, Human
uuuggaagcagcugcugguggcuugggacaucaguggggccaaggguucucugucccugguuca

SEQ ID NO: 60414 - RNA, 64 nt, Human
auuuuaauuugcaugcucuccuuuauuuaguugcuggggccaaacacaugaacuuguuacaaca

SEQ ID NO: 60415 - RNA, 64 nt, Human
uuugucagaagggacacaggugguaauuuggagauggggccagagcuucuggcuuuuggauuug

SEQ ID NO: 60416 - RNA, 64 nt, Human
uuuuccacacccuccucgguauccauggagagccuggggccagauaucuggcucaucucuggca

SEQ ID NO: 60417 - RNA, 64 nt, Human
gguccaaaggccuucagccuagauggugcaaagcuggggccagccugucuucaccggcacccuc

SEQ ID NO: 60418 - RNA, 64 nt, Human
auacuuugcuuuuuccuagguugacuauagucaauggggccaauggagccaaguguauggaaac

SEQ ID NO: 60419 - RNA, 64 nt, Human
caggggcugccguccacccguggggcccaggggcuggggccacagccuugccauuuucguugcc

SEQ ID NO: 60420 - RNA, 64 nt, Human
gcugcugggcgcccucuuaccgcucacggggagcuggggccauggaugggacaggagucuuugu

SEQ ID NO: 60421 - RNA, 64 nt, Human
ccccucagcaagaacagccugccugguggccuucuggggccaggaccccuggugggcaacguag

SEQ ID NO: 60422 - RNA, 64 nt, Human
ccugccgucugcgugucucaggcagugggggggcuggggccagggcgcccucugaggacagagc

SEQ ID NO: 60423 - RNA, 64 nt, Human
ccuggugauccugguuuuccuugaccacuggcccuggggccaugggugcauggacucguaaagc

SEQ ID NO: 60424 - RNA, 64 nt, Human
gagugaguuuaggcagcuucucuguaaccgcuucuggggccacaccccaaaacucuacacccuc

SEQ ID NO: 60425 - RNA, 64 nt, Human
guauuucucuugaaacugccagugccugaacuguuggggccaggauuuucccuggucagaugcc

SEQ ID NO: 60426 - RNA, 64 nt, Human
gggccagacgggucggacacggcugugccccaucuggggccaacaccacuugucuguaacaucc

SEQ ID NO: 60427 - RNA, 64 nt, Human
cccuagaggcagaugggcugagauaaaagacuguuggggccaccugaccaguaaacuguggacu

SEQ ID NO: 60428 - RNA, 64 nt, Human
uguuagaaagugaugcuuugugagacuauugucuuggggccaaaaauaaucagggauuuuaaau

SEQ ID NO: 60429 - RNA, 64 nt, Human
ucccucccacccccaauguccuguugguaggagguggggccaagagugggguauggugggccuu

SEQ ID NO: 60430 - RNA, 64 nt, Human
gagcacuggggugggcuuggcacugugccaagccuggggccaaucccugcccagucagcugggg

SEQ ID NO: 60431 - RNA, 64 nt, Human
gugauaaguccccgagggcgaaggccauuggguuuggggccaugguggagggcacuucaggucc

SEQ ID NO: 60432 - RNA, 64 nt, Human
acccaggccagcaggugggguaucaucugcucgguggggccacccacaggugacagcauggacc

SEQ ID NO: 60433 - RNA, 64 nt, Human
cguuuggcuugcacguucccauguggccagaugcuggggccacuuuccuucugucugcugguga

SEQ ID NO: 60434 - RNA, 64 nt, Human
gaggaccaggugaggucagcaucggggacacagguggggccacucacugguacuggcccuuuag

SEQ ID NO: 60435 - RNA, 64 nt, Human
gugccugagcagcucugggugcucuccaugagaauggggccaucugucuucucuccuuggagag

SEQ ID NO: 60436 - RNA, 64 nt, Human
acccucugucacccagucuguugcugcuccaugguggggccaagagucacuucuaauaaacaga

SEQ ID NO: 60437 - RNA, 64 nt, Human
cuucuuccuccuucccccagccagccagcuguccuggggccaggcuuuccuggguggaaagaag

SEQ ID NO: 60438 - RNA, 64 nt, Human
ccccugggaugggggaugcaucugcaccugacuuuggggccacgugcccuguggcaccccagcu

SEQ ID NO: 60439 - RNA, 64 nt, Human
ccccucccccaggugcuagagagccaggcagagcuggggccacagcgugucuggagaagccagg

SEQ ID NO: 60440 - RNA, 64 nt, Human
gugaagcagacugggccaugaacucuccuagcccuggggccagccuguuccacaggcaccccug

SEQ ID NO: 60441 - RNA, 64 nt, Human
ccucggacaccugagcugcuuggccugccacguguggggccaccucuccucagcuggccacccu

SEQ ID NO: 60442 - RNA, 64 nt, Human
ggagacccuguccacauugccgggaccacccugguggggccacuggugggugccagggacaggu

SEQ ID NO: 60443 - RNA, 64 nt, Human
ccaccccugucagucugcuccccaucccccagccuggggccagaacagccuaccccaggacagg

SEQ ID NO: 60444 - RNA, 64 nt, Human
aucaaacaccagaacccuaucaagucaaaagagcuggggccaggcagcugaagucacagguuuc

SEQ ID NO: 60445 - RNA, 64 nt, Human
ccuccaccaccgcccgucugugugugaccccuccuggggccaggccgggccuguacagucuguc

SEQ ID NO: 60446 - RNA, 64 nt, Human
cagccuugauccugaugagcuaugcacucuaauguggggccacucaccagucagccaaucuuuu

SEQ ID NO: 60447 - RNA, 64 nt, Human
uucugccguuaacuagguuaauaaaucacaaccuuggggccacaguugccuuauauguaaauga

SEQ ID NO: 60448 - RNA, 64 nt, Human
cugaggacgcagcaucuggugggcccggggcugcuggggccaaggagggaccuugaccuucugg

SEQ ID NO: 60449 - RNA, 64 nt, Human
augcccaggguccugcccucagcacuagauuuaauggggccaagaggguccaaaccccuugcua

SEQ ID NO: 60450 - RNA, 51 nt, Human
ggcaccagcugaaggccugaguggggccaagggaggcccagggggccgagg

SEQ ID NO: 60451 - RNA, 64 nt, Human
ucugcauguguuccuggcagcugggccugucuccuggggccauggccgggcucaggggccuuug

SEQ ID NO: 60452 - RNA, 64 nt, Human
cgggccaguucaggccgccucccccuccucugccuggggccauugagcccagccuccagggccc

SEQ ID NO: 60453 - RNA, 64 nt, Human
ccuuccucuccaacucuucagcccuguguucugcuggggccaugaaggcagaagguuuagccuc

SEQ ID NO: 60454 - RNA, 64 nt, Human
cuuagagcauggaccuccugcccugggggucaucuggggccagggcucucuggaugccuuccug

SEQ ID NO: 60455 - RNA, 64 nt, Human
acugaccauauugugcuucacaguagagccagcuuggggccaccaaagcugcccacuguuucuc

SEQ ID NO: 60456 - RNA, 64 nt, Human
ggagcgaggacucugcucaaggacccucagcaacuggggccaggggccuggagacacuccaugg

SEQ ID NO: 60457 - RNA, 64 nt, Human
guaauuaccuucuuuuguuuaucauuagauuugauggggccaaaguugagauagaauagagggu

SEQ ID NO: 60458 - RNA, 64 nt, Human
gucuucucagccucggcggugccacccacugcacuggggccagcugggaagccaagcauggccc

SEQ ID NO: 60459 - RNA, 64 nt, Human
cuggcaggcaauaguugaaggacuccuguuccguuggggccagcacaccgggauggauggaggg

SEQ ID NO: 60460 - RNA, 64 nt, Human
uccaccugggucccaagaucuucgccuccuucccuggggccacggacaucagcaguggguuggg

SEQ ID NO: 60461 - RNA, 64 nt, Human
cuauacaguuugucuugucacccugguuucccacuggggccaggucucuucuccagccuccacc

SEQ ID NO: 60462 - RNA, 64 nt, Human
gcaguuucauagaugggucaggagguggacaaguuggggccagagaugauggcaguccagcagc

SEQ ID NO: 60463 - RNA, 64 nt, Human
cuugagacuaaaagucagagcugaagggagucgcuggggccaggacggcaugcaggccuguacc

SEQ ID NO: 60464 - RNA, 51 nt, Human
aucauccagaacauaugugaguggggccagggcccaggccaggccgcuuuu

SEQ ID NO: 60465 - RNA, 64 nt, Human
uggauuugaugaaugugggggaacucagaggaacuggggccaccaagguuggaaaaggguuugg

SEQ ID NO: 60466 - RNA, 64 nt, Human
cuacacuccaucccaaccaagaaacugcauuuccuggggccaggugggagcugccuuugcccca

SEQ ID NO: 60467 - RNA, 64 nt, Human
gcauggaggacagcuuauggaaaaaguuagggcguggggccacaugugugaauuuuacaaugaa

SEQ ID NO: 60468 - RNA, 64 nt, Human
aacccuguccugaaaauucuacugcuuugauggcuggggccagucucuugucacuuuggaaacu

SEQ ID NO: 60469 - RNA, 50 nt, Human
ccgugaccacugagggcugauggggccaguggaaaggggucggguugccc

SEQ ID NO: 60470 - RNA, 64 nt, Human
gagauacauugucuuccucucccuacaaugccucuggggccaaggcacccauucuucuugcuau

SEQ ID NO: 60471 - RNA, 64 nt, Human
caguuucuccacugcuaaauguuagucauugagguggggccaauuuuaaucauaagccuuaaua

SEQ ID NO: 60472 - RNA, 64 nt, Human
uggugcucacaguagguuaauuggagacaccauguggggccauugguguuaugagccccccagg

SEQ ID NO: 60473 - RNA, 64 nt, Human
uaccuaacuuaauuuuuguuuuugaacuucuaauuggggccaguguaaggucgaucccagaggc

SEQ ID NO: 60474 - RNA, 64 nt, Human
acuuagguggggguuggagucgaaaguuggcaaauggggccaaggcugcacaaagucgaaaucc

SEQ ID NO: 60475 - RNA, 64 nt, Human
gugacucagagucucagaaggaaacccugacuccuggggccauuuccuaaugguacuguaagcc

SEQ ID NO: 60476 - RNA, 64 nt, Human
ccaccuccuguugggaggcgguggggggccaaaguggggccacacacucgcuguguccccucuc

SEQ ID NO: 60477 - RNA, 64 nt, Human
gugugcccacugccuaccgcgugagccgcagcccuggggccaguaggaagcggacccgcuccag

SEQ ID NO: 60478 - RNA, 64 nt, Human
cuugaacgaguccccagucugcgggaggcagugguggggccauggacccaugcgggggguucca

SEQ ID NO: 60479 - RNA, 64 nt, Human
cuuuccaucucacuggacugcagacccggccugguggggccagagaguccccagcuagggaccu

SEQ ID NO: 60480 - RNA, 64 nt, Human
ggggugucuggagcuaggcuuggcccuaccauucuggggccauuuccaccacaguuggggcucu

SEQ ID NO: 60481 - RNA, 64 nt, Human
ugacuugggcuagugggcagaggaaugccugugcuggggccagggguucagggaggaguggaug

SEQ ID NO: 60482 - RNA, 64 nt, Human
cagcugugccucugcugccagccaagucuucauuuggggccaaaggggaaacuuuuuuuuggag

SEQ ID NO: 60483 - RNA, 64 nt, Human
guucugaauguugauaugaguaguuaaaaggaaguggggccauuuuauguguuuaucuguguca

SEQ ID NO: 60484 - RNA, 64 nt, Human
augaaaauuaaauguuauaccugaauucuuggguuggggccaaaauauuaagcugaaaauaaug

SEQ ID NO: 60485 - RNA, 64 nt, Human
ccuucccaguagggcugucccaagccccacuccauggggccagguuuccuggccacuuuuguug

SEQ ID NO: 60486 - RNA, 64 nt, Human
ugaagcaccgcugcccucaggcuugaggggugcuuggggccaggcuacgcuccugaccucuucc

SEQ ID NO: 60487 - RNA, 64 nt, Human
guuucauugccgggguuggggcacaauuguggacuggggccaugaggccuucccugguccccac

SEQ ID NO: 60488 - RNA, 64 nt, Human
acauacuccagccaccucaccugauuggcuaucuuggggccauguccccuucuugcugccacag

SEQ ID NO: 60489 - RNA, 64 nt, Human
cagagcccagcuccaaggggaaucagaacucaaauggggccagauccagccuggggucuggagu

SEQ ID NO: 60490 - RNA, 64 nt, Human
ggguuuaguacaugggagggcuagccccgggacuuggggccaauacggaaacccuaccccuucc

SEQ ID NO: 60491 - RNA, 64 nt, Human
ugaggucuuuguucucacuguauucuuuuuauccuggggccacaguucuugauuauuccucuug

SEQ ID NO: 60492 - RNA, 64 nt, Human
gaacucuggccacccaaacaggacaagagcagccuggggccaagcagacgggcaaguggagcca

SEQ ID NO: 60493 - RNA, 64 nt, Human
guggcagcuuugcaaggggcuggggcccucggcguggggccaugccuucuguguguucuguagu

SEQ ID NO: 60494 - RNA, 64 nt, Human
aggucaucggggccucagcucggaggcagugacuuggggccaagggaccucgagacgcuuuccu

SEQ ID NO: 60495 - RNA, 64 nt, Human
gcugccaugccgcagaggaugcgccuagcugggcuggggccacacgacuauuauguuggccuug

SEQ ID NO: 60496 - RNA, 64 nt, Human
acucgcacaauuuuuucccccuuuugaaagccacuggggccaauuugugguuaagaggugguga

SEQ ID NO: 60497 - RNA, 64 nt, Human
aggccuuucucucccaugggcccugcaagccccuuggggccauguuuuccuggggauccucuug

SEQ ID NO: 60498 - RNA, 64 nt, Human
aaugaaagugaagaacagaguccauuuuccuuccuggggccauuggggaugacacucaagauac

SEQ ID NO: 60499 - RNA, 64 nt, Human
guagauauugacagcuauucaccuuucacggugcuggggccagauuagggaucacucccgugag

SEQ ID NO: 60500 - RNA, 64 nt, Human
uaaacucagaguuuuaauaaaggugugaggaggcuggggccaguugacaccagcaugcugccuu

SEQ ID NO: 60501 - RNA, 64 nt, Human
uguaauucauuaugacugcuccaggaagggcuaauggggccaauauauuauugccugucaugug

SEQ ID NO: 60502 - RNA, 64 nt, Human
acagccgggaggagccugggggcuccucaccacguggggccaugcugagagcugggcuuuccuc

SEQ ID NO: 60503 - RNA, 64 nt, Human
aaggaggacugaguucucaggggagaacugggaauggggccagggugcaaaaaugcuuugccca

SEQ ID NO: 60504 - RNA, 64 nt, Human
uucccuccuuccuggagugguggcuacagaagcuuggggccaacccuggcuccucuuuccccag

SEQ ID NO: 60505 - RNA, 64 nt, Human
uucagauauacuggaacccuuuuaaaguugauauuggggccaugaguaaaauagauuuuauaag

SEQ ID NO: 60506 - RNA, 64 nt, Human
cagaaauucauacucuauuauaauaauggcuucuuggggccaugcuuuggggaaguaaaauguc

SEQ ID NO: 60507 - RNA, 64 nt, Human
aggaagucacaccucagcgaggugguuuggcaucuggggccaacuccauuacagcuaugagcuc

SEQ ID NO: 60508 - RNA, 64 nt, Human
ucugcuccuucggugggggccucuggcucagauuuggggccaaggaggccucugucauuuuaaa

SEQ ID NO: 60509 - RNA, 64 nt, Human
aagacuggcugugaaaagucagguggcagaaaccuggggccacauagagccucucucuuuuccu

SEQ ID NO: 60510 - RNA, 60 nt, Human
gcccaggcuccaggaagugaccuugggcaguggggccaggaacacguggccugagagcug

SEQ ID NO: 60511 - RNA, 64 nt, Human
gagcaggucccggagaggcucagccugccccuccuggggccagccuccuugccucugcucugac

SEQ ID NO: 60512 - RNA, 64 nt, Human
cucuaccuucaggaauggcagaaaccucuauuccuggggccagggcagagcuugagguguucug

SEQ ID NO: 60513 - RNA, 51 nt, Human
aauacgagaacacccaguaacuggggccacggggagagaggaguagccccu

SEQ ID NO: 60514 - RNA, 64 nt, Human
ucacacugaugcccugguuucccuaucuguaaaauggggccaaugacaccuaccucacuggguc

SEQ ID NO: 60515 - RNA, 64 nt, Human
acuguguggcagggggauggcagguuggggguccuggggccagcaaugugguuccugugcacug

SEQ ID NO: 60516 - RNA, 59 nt, Human
aggaggcgugucagcagugaccauggguguggggccagcagcugguggggacugguuuc

SEQ ID NO: 60517 - RNA, 64 nt, Human
ugcuggauacuggaguuugagaggagggaggugcuggggccaaaggagacacuagaaaaguggu

SEQ ID NO: 60518 - RNA, 64 nt, Human
ugagaaagugaagcuggugcggcugcggaauccguggggccagguggaguggaacgguucuugg

SEQ ID NO: 60519 - RNA, 64 nt, Human
ucucccuggggccugguggguaggcaaguagcucuggggccaccucaagugaccaaaugcuauu

SEQ ID NO: 60520 - RNA, 64 nt, Human
aaagauuguuacgguuucauuaguaguaugguuguggggccauaaguuaaacagugcugccugg

SEQ ID NO: 60521 - RNA, 64 nt, Human
agccuucuucagcucagcccucuucuauuucuuauggggccaucuuggccucaccauccccaca

SEQ ID NO: 60522 - RNA, 64 nt, Human
augugaaccagccacgccuaccagguggcagagcuggggccauugggacagggggcucaagcca

SEQ ID NO: 60523 - RNA, 64 nt, Human
cccagaaugggccuuucucugccugcccugcccuuggggccaccucugccuccagcaggcuuga

SEQ ID NO: 60524 - RNA, 64 nt, Human
accagguuaggucaggguuggauuggguuuagauuggggccagugcugguguuagugauagugu

SEQ ID NO: 60525 - RNA, 64 nt, Human
gaacacgaccguggugcccggcccuugggagccuuggggccagcuggccugcugcucuccaguc

SEQ ID NO: 60526 - RNA, 64 nt, Human
ucccaagcauucccuuggugaauugucacgugaguggggccaguaagagugaagucugcuccuu

SEQ ID NO: 60527 - RNA, 64 nt, Human
agggaagggcccagccacuuccagcuuuugaucuuggggccagaggccgccuuacacacacccc

SEQ ID NO: 60528 - RNA, 64 nt, Human
uugauuagaaagaccaggccaaugucaggguaccuggggccaaacccaccugcuagugugaauu

SEQ ID NO: 60529 - RNA, 64 nt, Human
gccuagguggaaauagcaaaaacaaggcccaggcuggggccagggccagaggggaaggcccugg

SEQ ID NO: 60530 - RNA, 64 nt, Human
cugggccccaggguguggcaggagacccaguggauggggccagcuggccugcccugauccucug

SEQ ID NO: 60531 - RNA, 64 nt, Human
gcacccugcccugcugguggaauucugugagugcuggggccaguggggcuggggaccggcgggg

SEQ ID NO: 60532 - RNA, 64 nt, Human
ugccugcccugggcccaccucugcaugcugcucauggggccacccugccuccugggcccucacu

SEQ ID NO: 60533 - RNA, 64 nt, Human
ugggagccagcagcccacgccuggggagccugccuggggccaugugaccauggccucucccugg

SEQ ID NO: 60534 - RNA, 64 nt, Human
cacugcacgagagaguccugccccgagcccuagguggggccaggaggugccuuggagaagccag

SEQ ID NO: 60535 - RNA, 64 nt, Human
ugcuggucggcuuuccucuagagagagccgguuuuggggccauuucccuuugaugcuuuggugg

SEQ ID NO: 60536 - RNA, 64 nt, Human
gaugaggaagauuucaccugcuguuuaauagacuuggggccaugugccuccccacacaugggca

SEQ ID NO: 60537 - RNA, 64 nt, Human
gggccggucugagccuaccugagcccaugcagccuggggccacugccaagucaggcccugguuc

SEQ ID NO: 60538 - RNA, 64 nt, Human
auggagaguucaggaagggcugggcagaggaggcuggggccaccucuggaggguguccugcugu

SEQ ID NO: 60539 - RNA, 64 nt, Human
uguggccuccacugggcacuugccgaccugagucuggggccaggggagcccaggcugcccugca

SEQ ID NO: 60540 - RNA, 64 nt, Human
cacgccuggcuaauuuuuguauuuuuaguagagcuggggccacccuggcccggccccgucuucc

SEQ ID NO: 60541 - RNA, 64 nt, Human
cgggaagggacagucaggcuucucccugggaagguggggccagcaggagaugaccaacaggggg

SEQ ID NO: 60542 - RNA, 64 nt, Human
acaaagaccaguuacuuggagugggggguggggguggggccacaaaaggaaaaccggaggagca

SEQ ID NO: 60543 - RNA, 64 nt, Human
ggacagcugcauuccagagcaggaggcagggcucuggggccagaauggcuguccuugucguaga

SEQ ID NO: 60544 - RNA, 64 nt, Human
cccaaucgggagggagagacagagacagagccgauggggccagagcaggcagaacaggcggagc

SEQ ID NO: 60545 - RNA, 64 nt, Human
ugauggggcccugccuccuuugugaggaagccgcuggggccaguuggucccccuuccauggacu

SEQ ID NO: 60546 - RNA, 64 nt, Human
ccugggugauggguagagcccucgaaacuugacauggggccagaagggccuggguugaaguagu

SEQ ID NO: 60547 - RNA, 64 nt, Human
ccccuuccuccacagcugccuucaguggguagaauggggccagggcccagcuuuggccuuagcu

SEQ ID NO: 60548 - RNA, 64 nt, Human
gaccuuggguuuccaacucugcagccuucaggucuggggccaggagugggacccaccauuugug

SEQ ID NO: 60549 - RNA, 64 nt, Human
guggacuggcugggcccuggucccagucccugccuggggccauguguccccccuauuccugugg

SEQ ID NO: 60550 - RNA, 64 nt, Human
gcccaaaaccaggagcacgaaggccugucauccauggggccauugcaggcacucugccgcccga

SEQ ID NO: 60551 - RNA, 64 nt, Human
augccucaagcccaguuugcuuuugccgcagcgauggggccagucucauuccuccccaggagug

SEQ ID NO: 60552 - RNA, 64 nt, Human
ggaggcgcugcagggauuccccauccggucgucuuggggccagcccgucuuauggacucugccu

SEQ ID NO: 60553 - RNA, 64 nt, Human
aaaugccugacucagugaccagugccugugagcauggggccaggaaagucugguaauaaaugug

SEQ ID NO: 60554 - RNA, 64 nt, Human
accccagaccuacagaaucagagucuucaagggauggggccagggaaucugcauuucuaacgcg

SEQ ID NO: 60555 - RNA, 64 nt, Human
gcacaucucucugcccucucccuguguucugggcuggggccaccuuugugcagcuucgaggaca

SEQ ID NO: 60556 - RNA, 64 nt, Human
gccauuggucgcaggaacccaucucuuagagcuauggggccauucuuaguccacgaucauucca

SEQ ID NO: 60557 - RNA, 64 nt, Human
ccucccucuacugcagacccucuaggacuggggguggggccaauccagggcagcccagagggaa

SEQ ID NO: 60558 - RNA, 64 nt, Human
agaaaaauguuugaauuggaccaacugcuggugauggggccagggcccugggcccugugcuguc

SEQ ID NO: 60559 - RNA, 64 nt, Human
aggaaucuguauauauuuauggccgggcaggguguggggccaugccuccucaggagccgaagcc

SEQ ID NO: 60560 - RNA, 64 nt, Human
ggacacucaaaccuuuuuagggcgugugcagggcuggggccaguggaccugacaguaccuuacc

SEQ ID NO: 60561 - RNA, 64 nt, Human
ccgcccaggacccagccguguugagugaagcucuuggggccagcgugcguccugacgcacagga

SEQ ID NO: 60562 - RNA, 52 nt, Human
ugcucauagagaacaagugagcuggggccaggaggcagcagccgugcagagc

SEQ ID NO: 60563 - RNA, 64 nt, Human
cucagugugcggacagaggagaccacucugcuccuggggccagaggccauucaauagccugccu

SEQ ID NO: 60564 - RNA, 64 nt, Human
ggcucugaccucagggcucccagcucggggccuguggggccaguaugcuggucugggagucccu

SEQ ID NO: 60565 - RNA, 64 nt, Human
ccuaaauuauagugcucaacacaagaacuguuuuuggggccaguuuagcauuugugccgccucc

SEQ ID NO: 60566 - RNA, 64 nt, Human
ugccagccauuccugcaagcaccguuucagcucuuggggccaaccccaggaccuuuggcucugu

SEQ ID NO: 60567 - RNA, 64 nt, Human
cuggcagagugguaugggcaccccaccccugggcuggggccaaggcuacauaggggccccauuc

SEQ ID NO: 60568 - RNA, 64 nt, Human
gaccaaagcugacgaggcugggccaagccagggauggggccacagccagaaccccgagcccuac

SEQ ID NO: 60569 - RNA, 64 nt, Human
cuggguguauuaggacuggcuuugucccacagcuuggggccaucgguccugucuccccucugcu

SEQ ID NO: 60570 - RNA, 61 nt, Human
cucaucaggcccucgacugaaaaguucucaguggggccagacuggcuccuggagcugacaa

SEQ ID NO: 60571 - RNA, 64 nt, Human
gaaucuuaaucgaugaauguaaacucgggggugcuggggccagggcagauguggggauguuuug

SEQ ID NO: 60572 - RNA, 64 nt, Human
cugaugucccugggguggcuaggcaggaguggcguggggccaauacccagaccccuucagccac

SEQ ID NO: 60573 - RNA, 64 nt, Human
agcccuugaguguauuuguucucaguccuaacccuggggccagagauugguccgagguugagaa

SEQ ID NO: 60574 - RNA, 64 nt, Human
gcagggagggggguggagacgaggagaugccaaguggggccagggccaagucucaaguggcaga

SEQ ID NO: 60575 - RNA, 64 nt, Human
gagggcuuccuaggagccagucagcagggugggguggggccagaggagcucuccagcccugccu

SEQ ID NO: 60576 - RNA, 64 nt, Human
gcuauauaaacacuaucugacuaucuuugucuuuuggggccaguggcuguuggcauaaucacaa

SEQ ID NO: 60577 - RNA, 64 nt, Human
aggcuuucuuacucagaauuuugauagaaaaccauggggccaagagcucuggaagccuggccgg

SEQ ID NO: 60578 - RNA, 64 nt, Human
guucucagcucccagcgaagccuccacaacagaauggggccacagggcagccgggacucccugu

SEQ ID NO: 60579 - RNA, 50 nt, Human
uugcccugcucaaggcauaauggggccacccgugggcauccacaguuugc

SEQ ID NO: 60580 - RNA, 64 nt, Human
ucuuccaaagagucccaagcccagcaccugcuccuggggccacgaccucccuggccguggccac

SEQ ID NO: 60581 - RNA, 64 nt, Human
uggugaagucaggccagggccuuccagcugcucuuggggccagagccaagagccucucaguaga

SEQ ID NO: 60582 - RNA, 64 nt, Human
gcagcugggccagugcccaggagccauccuggcguggggccaggagcuuguccaaggccacagg

SEQ ID NO: 60583 - RNA, 64 nt, Human
agagccccaacucagccccaaaagcugggcuuccuggggccacagggccuauggcagucagacc

SEQ ID NO: 60584 - RNA, 64 nt, Human
ccgccucccucucuacgucucuguaccgagccucuggggccagauauaagagugccucucugag

SEQ ID NO: 60585 - RNA, 57 nt, Human
ucuuuguggauguuauguagcccacuguggggccaggcugggccgggcgcuccuggu

SEQ ID NO: 60586 - RNA, 64 nt, Human
ucaaaauggcagccuuuuccccagcuacuguuuuuggggccaagauggcugcccuagcagcaau

SEQ ID NO: 60587 - RNA, 64 nt, Human
uucugccucuccugcccugaaaaggaggaaugauuggggccagcaacuuugcucucccugccgu

SEQ ID NO: 60588 - RNA, 64 nt, Human
ggaggcugagaaaccuccagggcagacagaaaguuggggccagagcuagguuuuagagauccua

SEQ ID NO: 60589 - RNA, 64 nt, Human
gcagggcgacccaaaagaugcagaaaagguagacuggggccacugggucuuaagaggagcugug

SEQ ID NO: 60590 - RNA, 64 nt, Human
ggggacuugguggagagggacuacguggaagaccuggggccagccugggaccaagggaugugga

SEQ ID NO: 60591 - RNA, 64 nt, Human
gccucugggagccugacagugcccagcaugaagguggggccagugcuggggguuucuguagguc

SEQ ID NO: 60592 - RNA, 64 nt, Human
uguaggagagcuagugagucgagacuuagaagaauggggccacauagcagcagaggacuggugu

SEQ ID NO: 60593 - RNA, 56 nt, Human
gcaacaccuuuggguacuagauacccuggggccagcagaaguauagcaugaagaca

SEQ ID NO: 60594 - RNA, 64 nt, Human
gagggugaggcucagagagcuaaggacacuuguuuggggccacacagccgggguagaucugagc

SEQ ID NO: 60595 - RNA, 64 nt, Human
uguugcagaccagagucuguuuaugucagggggauggggccauugcauccuuagccauugucac

SEQ ID NO: 60596 - RNA, 64 nt, Human
cgagugaguuucacacagaagaauuucaugugaauggggccagcaagagcugcccuguguccau

SEQ ID NO: 60597 - RNA, 64 nt, Human
ccuccccaaagaauugaaacgucagcucaggauauggggccaaucucugugaguccagcaugua

SEQ ID NO: 60598 - RNA, 64 nt, Human
uguguuuguuuuagauccuccugggggauggggauggggccaggcucaguguacuaggccucuc

SEQ ID NO: 60599 - RNA, 64 nt, Human
uccuggggagaccaggaaccugccaagcccaggcuggggccaaggacucugcugagaggccccu

SEQ ID NO: 60600 - RNA, 64 nt, Human
gugacugcugggaaacccuuugggagaccugaccuggggccaaaaauaaagugagccagcguca

SEQ ID NO: 60601 - RNA, 64 nt, Human
gcuggccccuguaaggucccgcccccaaagacccuggggccagcggggccgaaagcggaguugg

SEQ ID NO: 60602 - RNA, 64 nt, Human
caaaugaaagacugucuccucgugggagagcaccuggggccaucagaaaugucuuuucaucuuu

SEQ ID NO: 60603 - RNA, 64 nt, Human
ucagccagcauugccccuagcucuggguugggcuuggggccaagucucagggggcuucuaggag

SEQ ID NO: 60604 - RNA, 64 nt, Human
cacagcucuucucccuguucucugggccugagccuggggccacccccaagugccgacuuguuuc

SEQ ID NO: 60605 - RNA, 64 nt, Human
aaagaagccguguuucgaugaagaccuggccacauggggccacugggacuucaacccagcccau

SEQ ID NO: 60606 - RNA, 64 nt, Human
caccugugcccgugcguggcguccccgucuccguuggggccauuagaaugaggcagacaccagg

SEQ ID NO: 60607 - RNA, 64 nt, Human
cucggugggcucugacugcggggcucacggggccuggggccauggcuuucuucucggcccccaa

SEQ ID NO: 60608 - RNA, 64 nt, Human
ggagagacaccagcucucagggcagagauuggcuuggggccagaaggacccuccccaacccugg

SEQ ID NO: 60609 - RNA, 64 nt, Human
gccagucccgcccuuuacagagcagcccuuagccuggggccaugggucaggcugaccuucaaca

SEQ ID NO: 60610 - RNA, 64 nt, Human
acuagcagaauagcaagcagaguaucauucaugcuggggccagaaugauggccgguugccagau

SEQ ID NO: 60611 - RNA, 64 nt, Human
uugaaaaaauuggauaaaguauaggaggguuacuuggggccaguaaaucaguagacugaacauu

SEQ ID NO: 60612 - RNA, 64 nt, Human
gucugucuccagaggggagggacaaauccccuacuggggccauuucaaugggguaguuuuugga

SEQ ID NO: 60613 - RNA, 64 nt, Human
uccgugcggaucgagcuuuccuggacucggucauuggggccaccccgugccagcggugcccuuc

SEQ ID NO: 60614 - RNA, 64 nt, Human
accauaccuggggaguuccugguccaggguauccuggggccacccucccugccuccaaaacagg

SEQ ID NO: 60615 - RNA, 64 nt, Human
aguagggccgccucggggcugggcauccggccccuggggccaccccuugucagccgggugggua

SEQ ID NO: 60616 - RNA, 64 nt, Human
uugcugggaaggagaggacuuggggcauggccucuggggccacccuuccuggaacucagagagg

SEQ ID NO: 60617 - RNA, 64 nt, Human
ugcugggcugaguucacccccagggcuggccagauggggccaggagggacagagcaaggggggu

SEQ ID NO: 60618 - RNA, 64 nt, Human
ugucagcuccacccgacaggcagacgaaggccaguggggccaucgcuuccuggggcgacccugg

SEQ ID NO: 60619 - RNA, 64 nt, Human
cgugaaaaguccucugcccacgagagcagggaguuggggccacgcagaaauggccucaagggga

SEQ ID NO: 60620 - RNA, 64 nt, Human
cgcagaaauggccucaaggggacucugcuccacguggggccaggcgugugacugacgcuguccg

SEQ ID NO: 60621 - RNA, 64 nt, Human
cuggccagggaguuggggacucagagggaccacuuggggccagccagacuggccucaauggcgg

SEQ ID NO: 60622 - RNA, 64 nt, Human
cagggcauuguccucagucagauacaacagcauuuggggccaugguaccugcacaccuaaaaca

SEQ ID NO: 60623 - RNA, 64 nt, Human
gaacguggucaggaauagccauucuaggcggggcuggggccaggguggggggcagucacugugg

SEQ ID NO: 60624 - RNA, 64 nt, Human
guugucagccccucaagcccagcugcaaccagucuggggccauucagccagggacagagcccac

SEQ ID NO: 60625 - RNA, 64 nt, Human
ggccucuggcccgccccggagcagggaggguggcuggggccaagccccgagggccccugcaagc

SEQ ID NO: 60626 - RNA, 64 nt, Human
agacugaugucagaggccccauggcgaggccccuuggggccacugccugaggcucacgguacag

SEQ ID NO: 60627 - RNA, 64 nt, Human
ucccuccagcagcacccccuggccccuggagugguggggccauggcaagagacaccguggcguc

SEQ ID NO: 60628 - RNA, 64 nt, Human
ggucuggugaauccaugagcugcgauaccacggcuggggccauauguucaccugcuuuccuguc

SEQ ID NO: 60629 - RNA, 64 nt, Human
gaccuugaacugugcucaacagccuggcccuuucuggggccacccugggauauggcuggcuggc

SEQ ID NO: 60630 - RNA, 58 nt, Human
gccuggccagccuccugugaggccuugauggggccauccagcuccgcagggccugcgc

SEQ ID NO: 60631 - RNA, 64 nt, Human
auauuuauaaaauuauuauuaggaauuauuuaaguggggccaggcaucuugcaacauuuucuga

SEQ ID NO: 60632 - RNA, 64 nt, Human
cuccauuauuggggcaggacucagggaggacacuuggggccaugugucuggagagagggcauag

SEQ ID NO: 60633 - RNA, 64 nt, Human
uuugcacacauuggccgcuucagacacgcacuucuggggccagccccuccccgccuccucccug

SEQ ID NO: 60634 - RNA, 64 nt, Human
gccaggagguucccccgaccagguuggggagacuuggggccagcgcuucuggucugguaaauau

SEQ ID NO: 60635 - RNA, 64 nt, Human
gaaaacagaaaaaugagaucagaaguggagauguuggggccaggcacaguggcccaggccugua

SEQ ID NO: 60636 - RNA, 64 nt, Human
ccuuuuccccccaugccugccccuuccccuguucuggggccaccccuuucccccuuggcucagc

SEQ ID NO: 60637 - RNA, 64 nt, Human
uacagaagggcggagcuuauucacacagcaccuuuggggccaaaaugaauaagcuggacuuucu

SEQ ID NO: 60638 - RNA, 64 nt, Human
uguccgggggacacgcgcauguguuugccagggauggggccaccggguugaugccaacgcuccg

SEQ ID NO: 60639 - RNA, 64 nt, Human
cucuagaccucaucuuggagagagagauguuggauggggccaucuauuccagcuuuauucacac

SEQ ID NO: 60640 - RNA, 64 nt, Human
aauugguagguaggucacugguuguaagaccuacuggggccagguaagaacaguaauuggccca

SEQ ID NO: 60641 - RNA, 64 nt, Human
ccggccagccccccgcccugggccccgucucgccuggggccagcgggagucccgggccuguggc

SEQ ID NO: 60642 - RNA, 64 nt, Human
agccucccccaaugcuggggagcaucccugggccuggggccacaccugcugcccucccucugug

SEQ ID NO: 60643 - RNA, 64 nt, Human
ggcccuggcugugcaccuggggaagugguugcccuggggccagggugcuuguucuguucaaaua

SEQ ID NO: 60644 - RNA, 64 nt, Human
ucacaggguauggcugucaagaggcaggggcuucuggggccaucuuggagucuguccaccccaa

SEQ ID NO: 60645 - RNA, 62 nt, Human
cacucccccugggacgguaagaccgguaggcguggggccaggacagccagccagcccagcgc

SEQ ID NO: 60646 - RNA, 64 nt, Human
guccauccguccacuugcccuccuggcagguggguggggccaccaugcucauccuacaaacggg

SEQ ID NO: 60647 - RNA, 64 nt, Human
agcucagcagcccaaggacgauggugaggggagguggggccaggcccccugccccgcuccaauc

SEQ ID NO: 60648 - RNA, 64 nt, Human
uauguaccaaguaggcacccuugggcgcacccacuggggccaggggucgggggaguguugggag

SEQ ID NO: 60649 - RNA, 64 nt, Human
uugccaaaucagauucuuuggucaagagucaguuuggggccaggcgugguggcucaugccugua

SEQ ID NO: 60650 - RNA, 64 nt, Human
cugccacguggagacgcagaggccgaacccaaacuggggccaccucuguacccucacuucaggg

SEQ ID NO: 60651 - RNA, 58 nt, Human
uguccuauguccagaucuaaucuauuccuggggccauaacucaugggaaaacagaauu

SEQ ID NO: 60652 - RNA, 64 nt, Human
auggcagcaucauaccaaggccuacuguugcacauggggccaaaaccaguaaacagccaccuuc

SEQ ID NO: 60653 - RNA, 60 nt, Human
agauugcucagcagcucugaguggggcggguggggccauaaacgguuccuggugacuccu

SEQ ID NO: 60654 - RNA, 64 nt, Human
auguaaagggguugaccucagaggccuaagcaacuggggccaucccccccauuagaggggcccc

SEQ ID NO: 60655 - RNA, 64 nt, Human
ucucuuccaacacagcccaucccugcacugcuccuggggccaaauaaauauucagcagcuccgg

SEQ ID NO: 60656 - RNA, 64 nt, Human
caagcugucagaacugccacugagcuaaagaugguggggccacaugcugacccagccccacauc

SEQ ID NO: 60657 - RNA, 64 nt, Human
auugugucuuguguuuugguggaugugacagggcuggggccacagucuacucugucucugcugc

SEQ ID NO: 60658 - RNA, 64 nt, Human
acuuuggggaggggugggacaaacugcaagguucuggggccaaggccuacccaggggccucugc

SEQ ID NO: 60659 - RNA, 53 nt, Human
agccugggaccugcaucugaugcuggggccagggacucucccacgcacgagcu

SEQ ID NO: 60660 - RNA, 64 nt, Human
gcaaauccugcuccuuugauuuaaugggguguacuggggccaggggcugauucacuuccuuggg

SEQ ID NO: 60661 - RNA, 64 nt, Human
uucaagguauuuuucuuccaagcugaaauaaaacuggggccacauauuuucagucauuucuucc

SEQ ID NO: 60662 - RNA, 64 nt, Human
cuguggaggaggccauacuccccuaguuggccacuggggccaccacccugaccaccacugugcc

SEQ ID NO: 60663 - RNA, 64 nt, Human
agugaacuguuuuugugccaagaaacccuggaccuggggccaaguauuucccaagccaagcauc

SEQ ID NO: 60664 - RNA, 64 nt, Human
agaggguuugcugggcuggcuuugcuuucccugcuggggccacagcuguguuaaccaaugaggu

SEQ ID NO: 60665 - RNA, 64 nt, Human
gcccugacuucuggagauggauccuuccaucuuguggggccaggaccauggccgaagccccuug

SEQ ID NO: 60666 - RNA, 64 nt, Human
gaaauaucaaccagacacugcauggcaaccuccuuggggccagccuucaaggcuucauggccau

SEQ ID NO: 60667 - RNA, 64 nt, Human
cgagcaaccucuucucaucggcucuuaugcaaguuggggccaggauaggggaggggugcuccuc

SEQ ID NO: 60668 - RNA, 64 nt, Human
guguggcuccucagcccacagaggggagggagcauggggccaggugccagucaucugugaagcu

SEQ ID NO: 60669 - RNA, 64 nt, Human
ugcuuagcauauguaaaguuguagucuauauuuauggggccauugcuuaaagauuauaaauuau

SEQ ID NO: 60670 - RNA, 64 nt, Human
cccgugacccaugacccacagugcuggccuccuguggggccacuauagcagccaccagaagccg

SEQ ID NO: 60671 - RNA, 64 nt, Human
uccugcacuuuucccgggcucugagcuggauugauggggccagucuccccccucccaucuugag

SEQ ID NO: 60672 - RNA, 64 nt, Human
caucuggucuuagucauuggucuccucagauuucuggggccaccugcaagccccauuccauucc

SEQ ID NO: 60673 - RNA, 64 nt, Human
uaaaaugcccaggcuugaugggauaaaauguauuuggggccacuguagggguaaugcuuugaua

SEQ ID NO: 60674 - RNA, 64 nt, Human
uugguuccagcugugcagcugacuucugugagacuggggccagccacacuacucucuaggccuc

SEQ ID NO: 60675 - RNA, 64 nt, Human
gcuggcacagggcugcauggaccucagggggcuguggggccagaagcugggccaagcccuccag

SEQ ID NO: 60676 - RNA, 64 nt, Human
ugcgggcggccagggccgggcgcucugugcggacuggggccaugaucgggcccgggggccugag

SEQ ID NO: 60677 - RNA, 64 nt, Human
ugaucacacuacgggaaucucugugguauauaccuggggccauucuaggcucuuucaagugacu

SEQ ID NO: 60678 - RNA, 64 nt, Human
uagcugggagcuguggacgggagucaccaggugguggggccaagccagggacucaugacuuuug

SEQ ID NO: 60679 - RNA, 64 nt, Human
ccacaccagcucuggacaucaccgccccuggaacuggggccaccagcccugggcacgagauuug

SEQ ID NO: 60680 - RNA, 64 nt, Human
ccccagaacccaagggaacgucauggaggccacauggggccacccggcucccucgggauggcuc

SEQ ID NO: 60681 - RNA, 64 nt, Human
uagaugagaaaacugagaggugaggugacuugccuggggccacauagcucauaagcuguagaac

SEQ ID NO: 60682 - RNA, 64 nt, Human
gccccgcugggcagcccuucaguguggcuggcguuggggccagugaguugccucuuucccuccu

SEQ ID NO: 60683 - RNA, 64 nt, Human
gcugccacuagcuccuccgagaauucagacccuuuggggccaaguuuuucuggauccuccauug

SEQ ID NO: 60684 - RNA, 64 nt, Human
caccuggcccuccuccuuuuccacagccacucacuggggccaccaaaacccagagauggcaggu

SEQ ID NO: 60685 - RNA, 64 nt, Human
cugguggugacguggucacauguccuggcauaucuggggccacgcaguuuagucucuuguccca

SEQ ID NO: 60686 - RNA, 64 nt, Human
gccuggggccgggcuggcuucucccuggacucuguggggccacacguuugccaaauuuuccuuc

SEQ ID NO: 60687 - RNA, 64 nt, Human
ggcaggguucccuggaccucccaguucugcgccuuggggccagccaguacucagagaggaggac

SEQ ID NO: 60688 - RNA, 64 nt, Human
aauguucucagaugcugauguuuguaagguccgguggggccaugaggaagaagaggagcugaag

SEQ ID NO: 60689 - RNA, 64 nt, Human
uaaggggagucggugcaggaugccgcuucugcuuuggggccaaacucuucugucacuaucagug

SEQ ID NO: 60690 - RNA, 64 nt, Human
uggagcucuuuuccuuguccuuccugcccuccgauggggccaccugugucggggcagcaguguc

SEQ ID NO: 60691 - RNA, 64 nt, Human
auucccaccuuaggagggcuaggaggcagcaucguggggccacagaaggccuggguuugcaguc

SEQ ID NO: 60692 - RNA, 64 nt, Human
agacagccagguggcaccugcagcggcugcccucuggggccacuugguaguguccccagccuac

SEQ ID NO: 60693 - RNA, 64 nt, Human
gcaucccgggccugggcaucaggcagggugcagguggggccaucugcggcccugguucgggcag

SEQ ID NO: 60694 - RNA, 64 nt, Human
cuguuucacuuagccuagagggggcaagggcagguggggccacucuggccugccugguccucug

SEQ ID NO: 60695 - RNA, 64 nt, Human
cccagccaugugggccaggugcauucacucagaguggggccacacacccaucuacccaguuucc

SEQ ID NO: 60696 - RNA, 64 nt, Human
ccacagaaccacccccacggcucacuccuuggucuggggccaccuucuugcccuuucuuuuuuu

SEQ ID NO: 60697 - RNA, 64 nt, Human
gcgggcacccugugccuugagacagcagccuaucuggggccacacagccaacccagcccugguc

SEQ ID NO: 60698 - RNA, 64 nt, Human
gggcgcucacacugcccccggagccugcugggaguggggccagccguggacagcugagguuggg

SEQ ID NO: 60699 - RNA, 64 nt, Human
ugcccagaaucacucaggcagcuagugauagagguggggccaagcccaggcugcccgacugcag

SEQ ID NO: 60700 - RNA, 64 nt, Human
aaagggcccuuccuuccuccccaacccuguggucuggggccauggccucaggcuugugucuauc

SEQ ID NO: 60701 - RNA, 64 nt, Human
cccccgacccgccacggcccucaguugccagggauggggccaccacugucacacuguggaauac

SEQ ID NO: 60702 - RNA, 64 nt, Human
gccgugggugaaguccuggggucagggggugggguggggccagaaggccugauagaagggucag

SEQ ID NO: 60703 - RNA, 64 nt, Human
gauguguggcuguugcugucaccuggaguccuuuuggggccaagaugugugugcacccgggguc

SEQ ID NO: 60704 - RNA, 64 nt, Human
uauucccagugcuggagagggugggcugagggacuggggccagcacggaccacccaaggccucu

SEQ ID NO: 60705 - RNA, 64 nt, Human
caggcccgcccccagauacacuaguuucuaggucuggggccagccuaguaauuguuacuaggca

SEQ ID NO: 60706 - RNA, 64 nt, Human
agcucccccagcccagagccagggaagaggaagguggggccagucccaccagugggguggccac

SEQ ID NO: 60707 - RNA, 64 nt, Human
ccauaccaggagucacuggagaaaggggcugugcuggggccagacuggcacaaggcacucgugc

SEQ ID NO: 60708 - RNA, 64 nt, Human
gcggagcuagggcuggagcucugcccaggugcccuggggccagcaaggcagucccaggccugcc

SEQ ID NO: 60709 - RNA, 64 nt, Human
uaguugaaggauaggcacacauucauucuagucuuggggccaggucaaaaggaacacugcuuca

SEQ ID NO: 60710 - RNA, 64 nt, Human
cagucagcggggaaguucaccagauuucggcugcuggggccaggacaggcgucuccuagguugu

SEQ ID NO: 60711 - RNA, 64 nt, Human
accggccccucuaucccuccgcaggccucuugccuggggccacucucccacccucucgaucugu

SEQ ID NO: 60712 - RNA, 64 nt, Human
ucccaggcagggaacccgaucucuuccuuugugcuggggccaggcgaguggagaaacgcccucc

SEQ ID NO: 60713 - RNA, 64 nt, Human
auucucccaggguauggagaccuagaccugucuuuggggccauuagcaucugggguuauagcaa

SEQ ID NO: 60714 - RNA, 64 nt, Human
ggggagggaaauugcugcuucuccaacucuugcuuggggccaagcccugcaccaguugcuuccc

SEQ ID NO: 60715 - RNA, 64 nt, Human
ugcgguggggcugagggguggccaucuccugcccuggggccacuggcuucacauucugggcuga

SEQ ID NO: 60716 - RNA, 64 nt, Human
cguggugcuggccaacugaccaucuaccugcccguggggccaggagcacccaagaccacagaaa

SEQ ID NO: 60717 - RNA, 64 nt, Human
cuggcccaggacgccugcugcaagcccacccagauggggccagagucuguguggacaaccgucc

SEQ ID NO: 60718 - RNA, 64 nt, Human
cacugcaccgccucaggguuuugggguccugggcuggggccaccaucccugauggcagaacucc

SEQ ID NO: 60719 - RNA, 64 nt, Human
ucagaggugaggggcgggagaagguugucuccucuggggccagcauuuggccaagcucggaggc

SEQ ID NO: 60720 - RNA, 64 nt, Human
gcugcuggaaaggcccggagaugcaucuguggccuggggccaucaagaucaaagaaccaggagg

SEQ ID NO: 60721 - RNA, 64 nt, Human
gggcuggcacuauuuccuuggccaggguaccuuauggggccauauccuacagauccucccauuu

SEQ ID NO: 60722 - RNA, 64 nt, Human
cagacaggcagagagaaggucauggccaccgugauggggccaacagcaagggagggguaggggc

SEQ ID NO: 60723 - RNA, 64 nt, Human
uuugagguuggacaggagguucugguccugccuuuggggccaacgcuggcucugaagugucuuu

SEQ ID NO: 60724 - RNA, 64 nt, Human
ccaagggccacucuugcccuggagaucuuggccuuggggccaaagacauuuccauuuccgaucu

SEQ ID NO: 60725 - RNA, 64 nt, Human
ggugggagaguacauugaaggccuggaauuagcuuggggccagggaagggacugggaggggaga

SEQ ID NO: 60726 - RNA, 64 nt, Human
ugccuaaggacacacaaauuugguugggaguugauggggccagaugagccagcauuccagcucu

SEQ ID NO: 60727 - RNA, 64 nt, Human
gcggucccaggggccugaaaaggaaggaccaggcuggggccaggggaccuuccugucuccgccu

SEQ ID NO: 60728 - RNA, 64 nt, Human
cauucagcgcccgcuccguccagugcccgcccuguggggccaaggcggccgugccuuacuacuc

SEQ ID NO: 60729 - RNA, 64 nt, Human
cauuucccaucucuuuuuaagaagugacugcuguuggggccaggggacaucaugggaggugggg

SEQ ID NO: 60730 - RNA, 64 nt, Human
auaccuacacccaagguugucagcuuuggauugcuggggccaggccccauggaggguauacuga

SEQ ID NO: 60731 - RNA, 64 nt, Human
uccauuccaccgccucccgccucagccccaccuguggggccacaucgccacuuccacgcccaug

SEQ ID NO: 60732 - RNA, 64 nt, Human
aggggucuuaccuugaacugaaggccacuugaguuggggccauugcuuaccuugguuggaaggg

SEQ ID NO: 60733 - RNA, 64 nt, Human
gcccugacccaggcacuaggccuuggugacuuccuggggccaagaaacuaaggaaacucggcuu

SEQ ID NO: 60734 - RNA, 64 nt, Human
uaauucuuggcagggaucuuucuggaggaaaagcuggggccagccagggcaggagaggugugaa

SEQ ID NO: 60735 - RNA, 64 nt, Human
accagaggccuuuugggagccacaggcugggggcuggggccaacauaccccagcucugggacca

SEQ ID NO: 60736 - RNA, 64 nt, Human
ugccagugugcguucgacaaauggaaaagcagauuggggccagggagucagcaaggcaccccag

SEQ ID NO: 60737 - RNA, 64 nt, Human
cagagcuuauuggccacugggucucacuccugaguggggccagggugggagggagggacaaggg

SEQ ID NO: 60738 - RNA, 64 nt, Human
cauuuucuauguuuuuauuuaaaaacaugacauuuggggccaggcgcgguggcucacgccugua

SEQ ID NO: 60739 - RNA, 64 nt, Human
uuggcauuagugaugguggugguacaguuggaauuagugccaugucauacacaaauguuccaca

SEQ ID NO: 60740 - RNA, 64 nt, Human
gaaggagaaaaugucagccacauuacugucuguguagugccaggugaaggguuaucagaaggcu

SEQ ID NO: 60741 - RNA, 64 nt, Human
gagccccuugggcaucgcuuccccugcccuuugguagugccaggaccaggccaaugaugcuucu

SEQ ID NO: 60742 - RNA, 64 nt, Human
aaauuuugccaauugcuggaccaauggcaaacauuagugccaaauguauaauacuauauguuag

SEQ ID NO: 60743 - RNA, 64 nt, Human
gccgggagggguacucaccccaccuaaggccaucuagugccaacuccccccccaccauuccccu

SEQ ID NO: 60744 - RNA, 64 nt, Human
aaccugaggcugcucaucugaccacugggcaccuuagugccaaccugaaccaaagagaccuccu

SEQ ID NO: 60745 - RNA, 64 nt, Human
uggcuggaggaaggaaacaacaaaggaagugagguagugccaaugacaggacauuugacaugag

SEQ ID NO: 60746 - RNA, 64 nt, Human
aguccacagguuugcauccuggacuuuaucuaaauagugccaagacacaucacuaagccucguu

SEQ ID NO: 60747 - RNA, 64 nt, Human
ggaagagaauuuucaauauguaacuacggagcuguagugccauuagaaacugugaauuuccaaa

SEQ ID NO: 60748 - RNA, 64 nt, Human
gcucccaaggagguguagcaggugugagcaauauuagugccaugugccuuucacacaggguuug

SEQ ID NO: 60749 - RNA, 64 nt, Human
aucugggguacaaagauaaucuaagcccucaccuuagugccaacagggugugcucccacgagac

SEQ ID NO: 60750 - RNA, 64 nt, Human
ugguggaaauguaccuuucccuuaaguuccuccuuagugccaucacagcaggugaaugggugcc

SEQ ID NO: 60751 - RNA, 64 nt, Human
auacaggcucuacccuccucccccaggaccugccuagugccaguuugguagucccccuuucugg

SEQ ID NO: 60752 - RNA, 57 nt, Human
gagagauggugcuggaguaaauaucauuagugccaaagggauucuucuccaaaacuu

SEQ ID NO: 60753 - RNA, 64 nt, Human
uuuucauuggaugcaguuguauaguuuuacacucuagugccauauauuuuuaagacuuuucuuu

SEQ ID NO: 60754 - RNA, 64 nt, Human
auuucuccaagcagaagugagcgcugggcuguuuuagugccaggcugcggugggcagccaugag

SEQ ID NO: 60755 - RNA, 64 nt, Human
uugggagcaggucuuggccuccuucaugagagucuagugccauguccugucccaugaucuggac

SEQ ID NO: 60756 - RNA, 64 nt, Human
uuaaauugucacuucuauucuuuacagaaccuuguagugccaaaaacuuuuuaaaagguaaaaa

SEQ ID NO: 60757 - RNA, 64 nt, Human
uuuuuccagcaucacucuaaggaagaguguggauuagugccauuauucagggcugguauuaaua

SEQ ID NO: 60758 - RNA, 64 nt, Human
uaacagaguauguaggaacagaauaguaagucuuuagugccauaagaucuuaacaucucacuuc

SEQ ID NO: 60759 - RNA, 64 nt, Human
cccuccuauuuacuuccuuugcugacugccaacuuagugccaagaggaggugugaugacagcua

SEQ ID NO: 60760 - RNA, 64 nt, Human
caacauccuaauuggcucagugcacguuuggcaauagugccagccugucuugucuuuaaugcau

SEQ ID NO: 60761 - RNA, 64 nt, Human
ugagggagcuagaaacagagcuaucuguuccucauagugccaguguguuuacauuuauaggacc

SEQ ID NO: 60762 - RNA, 64 nt, Human
cuggauuagccuuucacauguugcuggcucacauuagugccaguuagugccuucgguguaagau

SEQ ID NO: 60763 - RNA, 64 nt, Human
caaaguagggggcacauuuccauuauagcaauguuagugccaccaccuucugaacacagugggg

SEQ ID NO: 60764 - RNA, 64 nt, Human
cccugauguuuugacagucuccuagugcuccugguagugccacuaagggaaaaccaaggugcgc

SEQ ID NO: 60765 - RNA, 64 nt, Human
auacaccuuuuugaggaggcaguguaacaaccuauagugccauugauccaugagaaaaagauuu

SEQ ID NO: 60766 - RNA, 64 nt, Human
uuguauaacucauuugcagucugaaaauuuuuuuuagugccagucccugaacauaucauugaaa

SEQ ID NO: 60767 - RNA, 64 nt, Human
ggcugaguacagucauucuguugggcuguggagauagugccagggugcggccugagauauuuuu

SEQ ID NO: 60768 - RNA, 64 nt, Human
gaacccaggaggcggagcuugcagugagccaagauagugccacugcacuucagccugggugaca

SEQ ID NO: 60769 - RNA, 64 nt, Human
gugucuguguuuugaaagaauagaacacaguuuguagugccacuguuguuuugggggggcuuuu

SEQ ID NO: 60770 - RNA, 64 nt, Human
gaaccuggcaggcggagguugcagugagccgagauagugccacagcucuccagccugggcgaca

SEQ ID NO: 60771 - RNA, 64 nt, Human
agaacucucccugcccuaccccuuaacuccaccuuagugccagggccgagggcuggucugcaug

SEQ ID NO: 60772 - RNA, 64 nt, Human
uguagguacuggccuuucuaauagucuugguauuuagugccagacucccaucaaucuuuugaau

SEQ ID NO: 60773 - RNA, 64 nt, Human
cagaaugacuuuucagacuuaccaaauguauugauagugccaaaaaaaaaaucucagaaaucuu

SEQ ID NO: 60774 - RNA, 64 nt, Human
gauaaacuucuuaaagagaucuguuauuuucagguagugccauaaucugcacuuagcauuggcu

SEQ ID NO: 60775 - RNA, 64 nt, Human
agauuguaauucagaaaacauaauauaagaaucauagugccauagaugguucucaauuguauag

SEQ ID NO: 60776 - RNA, 64 nt, Human
cuuccaagccuggugucuccggcccuguagucuguagugccagacugugcuggccuggagagug

SEQ ID NO: 60777 - RNA, 64 nt, Human
auacugacacugacuugauacagcaugaaguuucuagugccacacacaguauuuagaaaaccuu

SEQ ID NO: 60778 - RNA, 64 nt, Human
guuagaguucuguuuuguuucuguuuucugugucuagugccaauuagcuaaaucagggagaaag

SEQ ID NO: 60779 - RNA, 64 nt, Human
ggccuaagaauuuccuaagccaugucuuguaccauagugccacauugaugacuuguuuccuuuu

SEQ ID NO: 60780 - RNA, 64 nt, Human
aauccagaaaucuacuuucuccaucuuccacuguuagugccagugagcaauacuguugugcaac

SEQ ID NO: 60781 - RNA, 64 nt, Human
ucuagggguucaucuucaguaaucgacauuccacuagugccauaguuaacuucaugacauguag

SEQ ID NO: 60782 - RNA, 64 nt, Human
guuguuguuccaaccugggcuuugugacuuugguuagugccacuaccuucuucccuccuuuccc

SEQ ID NO: 60783 - RNA, 64 nt, Human
uuucauguuaguuaccuuauaguuacuguguaauuagugccacuuaauguauguuaccaaaaau

SEQ ID NO: 60784 - RNA, 64 nt, Human
augaaaaugggcaauauuuucaucuguuuacuuguagugccauagaggccaauaugcacaauau

SEQ ID NO: 60785 - RNA, 64 nt, Human
cuacguuuugacaacucugaaauguguuaacucuuagugccaucaagaaccccauuugggagua

SEQ ID NO: 60786 - RNA, 64 nt, Human
uuguuuagacacagauauuuggaauuagcuaucuuagugccaacugcuuuuuauuuuuuuacuu

SEQ ID NO: 60787 - RNA, 64 nt, Human
agugaaaaaaaaaaucaaacaguggagucuucuuuagugccaguccuugugguugaauaaaaag

SEQ ID NO: 60788 - RNA, 64 nt, Human
agcaucccugcgagcguucaugggguguucguguuagugccaagauugcuucguuguagagaga

SEQ ID NO: 60789 - RNA, 64 nt, Human
ugucuugugacaauuauguuuuauagaccuacacuagugccaggucacuauuguaagauguuaa

SEQ ID NO: 60790 - RNA, 64 nt, Human
uuaaugaacucuaauucgggagucuguucccuuuuagugccacgcguugaauaguuccacauac

SEQ ID NO: 60791 - RNA, 64 nt, Human
uuaaaaucauaccuacccugaaaaaugcuuaaaguagugccaaaaaucuugaaaucucucucuc

SEQ ID NO: 60792 - RNA, 64 nt, Human
acugauuuaccagguuuagguugaugucaucuaauagugccagaauuuuaauguuugaacuucu

SEQ ID NO: 60793 - RNA, 64 nt, Human
uuuuuugacugaaaguacuaaaagucagcuuuacuagugccaaaccuuuaaauuuucaaaagaa

SEQ ID NO: 60794 - RNA, 64 nt, Human
gaaaucucuccacugccuucuguccaccaacauuuagugccagccuaggcacaacuuguccugg

SEQ ID NO: 60795 - RNA, 64 nt, Human
gauaaaaauuacaucauaccgucuauuuugcccauagugccauuuagagaugaaaaccagcuuu

SEQ ID NO: 60796 - RNA, 64 nt, Human
cuggcccuccacuccucauccccacaaucuggcuuagugccacccaccuuugccacaaagcuag

SEQ ID NO: 60797 - RNA, 64 nt, Human
ugacaaaacaacgagggaagaaggaaccagaccuuagugccacauauuuuucucuugggguugu

SEQ ID NO: 60798 - RNA, 64 nt, Human
acuaaaagagguuuuuaauaaugagguccuucuguagugccaugguagaagaauugaggauguc

SEQ ID NO: 60799 - RNA, 64 nt, Human
agguuuaacuauuuaagaaccauuugcugccgcauagugccauuggauagggaagaacuucaga

SEQ ID NO: 60800 - RNA, 64 nt, Human
caagagggaggacgcugggggccccuggggcugcuagugccaucgugguguguggcaggugggc

SEQ ID NO: 60801 - RNA, 64 nt, Human
aaggugcguuguagggguauugaugugccccagguagugccagcagaguagggaaaacugcauu

SEQ ID NO: 60802 - RNA, 64 nt, Human
agaccuaauggccucaacaccuucugaacguggauagugccagaacacuuaggagggugucuuu

SEQ ID NO: 60803 - RNA, 64 nt, Human
gggaggcgcccugguuuguuuuccccaguuguaauagugccaagcaggccugauucucgcgauu

SEQ ID NO: 60804 - RNA, 64 nt, Human
cccuuguuuuuuaacccauagguuugagugugccuagugccaauauuuuguaauuuagaaauuu

SEQ ID NO: 60805 - RNA, 64 nt, Human
uagucucacaguuugcuugucuauuuauuuuauuuagugccaaauguauuccauuuuaaaagua

SEQ ID NO: 60806 - RNA, 64 nt, Human
cagauuucaugucacuaaacaagaaaucugacaauagugccaggaaacuaauuuccugauacau

SEQ ID NO: 60807 - RNA, 64 nt, Human
uuguucccuaccaauauucuguugcuguuugaaguagugccaggguccccugggaagaugcccc

SEQ ID NO: 60808 - RNA, 64 nt, Human
acuguuguacaagaaaucucucaacaaacaacuguagugccagaaucugauucaaauagucagg

SEQ ID NO: 60809 - RNA, 64 nt, Human
cucuuccuuuucuaaaauugaaagacaagaaauuuagugccaauauuguacagacagaaauucc

SEQ ID NO: 60810 - RNA, 64 nt, Human
gcaggaccucucccuccuccagaucccugccuccuagugccagccccucacacgccuucauccu

SEQ ID NO: 60811 - RNA, 64 nt, Human
guuacauuugugcaguucuuaccuuuuccucauauagugccauugaaauagacugaaauuaucu

SEQ ID NO: 60812 - RNA, 64 nt, Human
aaaaacacacaaaaagucccccuucaaucucguuuagugccaauguuguguguugcacucaagu

SEQ ID NO: 60813 - RNA, 64 nt, Human
agccaauugcucuucaucacagcuaucugucuuuuagugccacaaauaaaagaaaaucaaaucu

SEQ ID NO: 60814 - RNA, 64 nt, Human
ugaccaaagagaagcaaaaucuaccaggucaaaauagugccacuaacgguugaguuuugacugc

SEQ ID NO: 60815 - RNA, 64 nt, Human
uuggaggugggacaagcaggcuuguuuccaccaauagugccaaaaagauauugccuaaugugca

SEQ ID NO: 60816 - RNA, 64 nt, Human
ucuuuuuccaaauguaauggauuauguggaauuguagugccaucgguuuuuacuuagagcccuu

SEQ ID NO: 60817 - RNA, 64 nt, Human
caaaaaauuagcugggcaugguggugcgugccuguagugccagcuacucaggaggccgaggcag

SEQ ID NO: 60818 - RNA, 64 nt, Human
uuauaauuuugucagcaaugcuauuaucucuaauuagugccaccagacuagaccuguaucauuc

SEQ ID NO: 60819 - RNA, 64 nt, Human
auuuuaacaauuuguauagugccuggaucauuacuagugccauaacccugcuucuucaacauuu

SEQ ID NO: 60820 - RNA, 64 nt, Human
uuuugcugaacauuaaaaagugugauagcgauauuagugccaaucaaauggaaaaaagguaguu

SEQ ID NO: 60821 - RNA, 64 nt, Human
acgcaccucccagaggaccggugggaauuguucauagugccaaaguccuacuacugcguuuuca

SEQ ID NO: 60822 - RNA, 64 nt, Human
uguuuuauuaauuuggggaaagggguguuagcauuagugccaugauaucuacuggauuuuaagu

SEQ ID NO: 60823 - RNA, 64 nt, Human
uucccuaccagguccauuaauaugcuuauaacacuagugccaguuauuuuauuugauaaugcuu

SEQ ID NO: 60824 - RNA, 64 nt, Human
gccuagaacuucaacauguuguauaggaauccuguagugccacuaguuaaaugccgaauucuca

SEQ ID NO: 60825 - RNA, 64 nt, Human
cuauaucaucaucgucuauaaacuagcuuuaggauagugccagacaaacauaugauaucauggu

SEQ ID NO: 60826 - RNA, 64 nt, Human
cagaauuuggaagcuagaauggugggaaugucaguagugccagaaagagagaaccaagcuuguc

SEQ ID NO: 60827 - RNA, 64 nt, Human
gugauucugucuagugaaaaugggacauuuuuaauagugccagaaagauugauaaauaaauauu

SEQ ID NO: 60828 - RNA, 64 nt, Human
uuuggcguaauccugccugggaaggagagagguuuagugccauguucagugggcuguuugcuag

SEQ ID NO: 60829 - RNA, 64 nt, Human
cauccauugcuggcaaugagugugccagaguuauuagugccaaguuuuucagaaaguuugaagc

SEQ ID NO: 60830 - RNA, 64 nt, Human
cggcccccagucagggggcaucuugcaagaccuuuagugccacaaauaagcaucgagcaccucc

SEQ ID NO: 60831 - RNA, 64 nt, Human
uuuuuuucuuuuaaagaaaaaaagugaaaauauauagugccaaauuccaaagguacuuccuucc

SEQ ID NO: 60832 - RNA, 64 nt, Human
ccuuccugugucaagccuuauaaaucauguaauuuagugccacucauguaaaucaguaaaauca

SEQ ID NO: 60833 - RNA, 64 nt, Human
aaucuaaaaaaugauguuuauuuccauaguuugauagugccacuuaaaugccaauuaaacaaga

SEQ ID NO: 60834 - RNA, 64 nt, Human
acuacauaauagccugagaauaaugggauuuugauagugccauuuauuguuaaagauuuauuuu

SEQ ID NO: 60835 - RNA, 64 nt, Human
gaggccaggaguucaagguuacagugagcuaugauagugccacugcacuccagccugggugaca

SEQ ID NO: 60836 - RNA, 64 nt, Human
aacagcucucaccuacgcgagucuuacuuugaguuagugccauaacagaccacuguauguuuac

SEQ ID NO: 60837 - RNA, 64 nt, Human
ugauggggauuaauuuuauagcauuccauuuuccuagugccacaugugaaauuggauuuugaug

SEQ ID NO: 60838 - RNA, 64 nt, Human
ucugguuaagauguucuuuuccucaaaggugcccuagugccaugauuuaaauauuuuuauuacc

SEQ ID NO: 60839 - RNA, 64 nt, Human
agccugcaggaaagccggggcgguggggggggcuuagugccacaugcaccccacucauuccaaa

SEQ ID NO: 60840 - RNA, 64 nt, Human
aacuggaaugaccuccuucagauaucgugccucuuagugccaaacccacagugagaccaaaagu

SEQ ID NO: 60841 - RNA, 64 nt, Human
uuugguuuuaauuagaugguucacuaccacuggguagugccauuuuggccggacaugguugggg

SEQ ID NO: 60842 - RNA, 64 nt, Human
gcccccucuucuuauacccuaaaaccuucuacacuagugccaugggaaccaggucugaaaaagu

SEQ ID NO: 60843 - RNA, 64 nt, Human
cuccuggcuggagagggcuguggcaauagaaaauuagugccaacugcagugagucagccuaggu

SEQ ID NO: 60844 - RNA, 64 nt, Human
uguacaugcaaagauuggaccauguuacaugaaauagugccagcuggagguucuuugccagcac

SEQ ID NO: 60845 - RNA, 64 nt, Human
agggcaagugcugugcugcccauuugggccugcauagugccaugauuggaacccaggaacucug

SEQ ID NO: 60846 - RNA, 64 nt, Human
aaacaaacaguuaaaacaagccucaaauguauuuuagugccacccacuggccauagguacaauu

SEQ ID NO: 60847 - RNA, 64 nt, Human
gggaagcagagguugcagugaacugagauagugauagugccacugcaauucagccugggugaca

SEQ ID NO: 60848 - RNA, 64 nt, Human
cacccggugguucuuccuguucugugacuguguauagugccaccacagcuuauggcaucucauu

SEQ ID NO: 60849 - RNA, 64 nt, Human
gagagugugccuauuugaaugacaaaggugccaguagugccaggcacuacacagagaggaagug

SEQ ID NO: 60850 - RNA, 64 nt, Human
aaaauaagaucgaugguaucuuguaaaaugaggguagugccacuucuuaguauuuuugaaagcu

SEQ ID NO: 60851 - RNA, 64 nt, Human
uccucuucauuuguucuuuaugagaaaacccggguagugccagcaccuggauacaguauuuaca

SEQ ID NO: 60852 - RNA, 64 nt, Human
cuaaaaauagagugcuguuacacuuaaggaaaauuagugccauuuuggaaaugagaucuugugc

SEQ ID NO: 60853 - RNA, 64 nt, Human
auuuaugugcggucuccaauuuaggacuuuuccauagugccaaagccauacauauucaguagaa

SEQ ID NO: 60854 - RNA, 64 nt, Human
uuagucacuuagguaugcaauuauaaaugcaaaauagugccagaucuuuaacuguauaucaggg

SEQ ID NO: 60855 - RNA, 64 nt, Human
aaaagguaucuucugaauguucaagagcauccuauagugccaaauaauaaagcaccauuuuuuu

SEQ ID NO: 60856 - RNA, 64 nt, Human
guggcuggaacaaaguucugguuaaggaggaaauuagugccacccacggugagaagcagagaag

SEQ ID NO: 60857 - RNA, 64 nt, Human
cuuucccagaaguggcuacugacuacccucucacuagugccaaugaugugacccucaaucccac

SEQ ID NO: 60858 - RNA, 64 nt, Human
cuauaccuauugcaaggccacagaaaagagcagauagugccaauaucaggaaauaauuuaucca

SEQ ID NO: 60859 - RNA, 64 nt, Human
gaacccuagaggcggaguuugcagugagccgagauagugccauuguacuccagcuugggcaaca

SEQ ID NO: 60860 - RNA, 64 nt, Human
uggaagggcugucugugauugaacgugaaauguguagugccauugggaccacgaagggaauucu

SEQ ID NO: 60861 - RNA, 64 nt, Human
aaguguaugcacaccgcaugcuuccucauccacauagugccagcagcagugccacgcaguuccu

SEQ ID NO: 60862 - RNA, 64 nt, Human
ucugggucuuuugcuacuaaguucacauuagaauuagugccagaauuuuaggaacuucagagau

SEQ ID NO: 60863 - RNA, 64 nt, Human
guccuggcauccgcugggggcgcuguucuuuagcuagugccaguauuaaaacauugucauuacg

SEQ ID NO: 60864 - RNA, 64 nt, Human
caccauuagcuuuugugaucugguuaagaaguauuagugccacaagccugaaaagacaguucuc

SEQ ID NO: 60865 - RNA, 64 nt, Human
uaauucagucuucuguuaauuuuuaaguuuugguuagugccacaaggaauuuaacuuuuugauu

SEQ ID NO: 60866 - RNA, 64 nt, Human
aaguucuauuccauaaucuaaaauguucuguuucuagugccaguucuuaugcuaagcagguuac

SEQ ID NO: 60867 - RNA, 64 nt, Human
uacaggcuguuuugcaccugauuuuauuuaucauuagugccacgccaagaucauuuagacgaug

SEQ ID NO: 60868 - RNA, 64 nt, Human
auguagauucuucuccaucucuccgugugugcaguagugccaguccugcaguaguugauaagcu

SEQ ID NO: 60869 - RNA, 64 nt, Human
ucuauuuuuauuuggggcagaguaauuucauuuauagugccaguagguguaccuuguguucacu

SEQ ID NO: 60870 - RNA, 64 nt, Human
gugucugagcccaacccuucuaaacggugaccuuuagugccaacuuccccucuaacuggacagc

SEQ ID NO: 60871 - RNA, 64 nt, Human
auguuaaugcuauaugacaaaaugcucugauuccuagugccaaagguucaauucaguguauaua

SEQ ID NO: 60872 - RNA, 64 nt, Human
ggauaagcugcuggugccuuagugugaaucaagguagugccaccaaaguguacuuguaguuucu

SEQ ID NO: 60873 - RNA, 64 nt, Human
aggugccauacacuugucaaaucuggaucauucguagugccagcacaguccuaaaagggcugga

SEQ ID NO: 60874 - RNA, 64 nt, Human
acuguuuuguaucugccucuuuacuagucuaccuuagugccauccaccagcuuuacucucugac

SEQ ID NO: 60875 - RNA, 64 nt, Human
uggccgacagucuggaaaugaauccaucauacauuagugccauagaguuuaguaaccguccagc

SEQ ID NO: 60876 - RNA, 64 nt, Human
gaaccugggagacagagguugcaaugaaccgagauagugccauugcacuccggccugggcaaca

SEQ ID NO: 60877 - RNA, 64 nt, Human
gagaaggcaccccuccguguggagcacguggagauagugccagguggcucagugccaccuaugc

SEQ ID NO: 60878 - RNA, 64 nt, Human
auaauaaaagcugucuccauaguuuaaaaucgaauagugccaucaucacaguauauuagucaaa

SEQ ID NO: 60879 - RNA, 64 nt, Human
gagaguccucaucugcuggcauuuugugggguguuagugccaaacuugaauaggggcuggggug

SEQ ID NO: 60880 - RNA, 64 nt, Human
accuagcugugcccccucugguuauuuauuuccuuagugccaggagggcacagcaggggagccc

SEQ ID NO: 60881 - RNA, 64 nt, Human
ugcucuguuuucugugacaucuuggagggggagcuagugccaccaccaugcgcggugcuuagga

SEQ ID NO: 60882 - RNA, 64 nt, Human
auaaccaccccaguuaaaccauuuucauaauuaguagugccagcaauaguggcaaacacugcaa

SEQ ID NO: 60883 - RNA, 64 nt, Human
gcccagggaugggcaucuccagggagcuggggauuagugccaggcagcccugccagccaugccu

SEQ ID NO: 60884 - RNA, 64 nt, Human
cggcucacaaauuccgauuagaccuuuauccagcuagugccaaauaauugaucagaugcugaau

SEQ ID NO: 60885 - RNA, 64 nt, Human
aguaauuuuuaggcaccaaaucucccucaucuucuagugccauucuccucucuguucagguaaa

SEQ ID NO: 60886 - RNA, 64 nt, Human
gaaccugggaggcagagguugcagugagcucagauagugccacugcacuccagccugggugaca

SEQ ID NO: 60887 - RNA, 64 nt, Human
uuugggaauuucuuuuucagccuguuuuuuagcuuagugccauuaugucauuuugauuuguauu

SEQ ID NO: 60888 - RNA, 64 nt, Human
ugaaaaacagugaauacuucuaauuguuuccuuuuagugccagaacuaaggacauugugaagca

SEQ ID NO: 60889 - RNA, 64 nt, Human
uauuuuucuggaauuaacacucugugacucaaaguagugccacugcagugucuuuuuaaacugg

SEQ ID NO: 60890 - RNA, 64 nt, Human
aacugcugccucucccuggauauuccagcucaauuagugccacauaugggggaaacgacacauc

SEQ ID NO: 60891 - RNA, 64 nt, Human
cuuucuagcugagauuuuuauuuuuccacaucuguagugccaugaagcgauucugucuuugacu

SEQ ID NO: 60892 - RNA, 64 nt, Human
caucuccaccaucuauagugagccucuccauaauuagugccaaccauuagucucguucauauuu

SEQ ID NO: 60893 - RNA, 64 nt, Human
cuccccuggguugggagaaguccaucuuuccccuuagugccaccgggcugcugagucacgagga

SEQ ID NO: 60894 - RNA, 64 nt, Human
ugugcggugucaccaugagcaccuccagcuguacuagugccauuggaauaauaaauuugauaag

SEQ ID NO: 60895 - RNA, 64 nt, Human
cgauagacuaugaaugcuauuucuagaaaaagucuagugccaaauuugucuuauuaaauaaaaa

SEQ ID NO: 60896 - RNA, 64 nt, Human
guuaacgauaauccuguuuacuguggauuagguauagugccaacaaauugaaugauaaaacaac

SEQ ID NO: 60897 - RNA, 64 nt, Human
gggaaugauaauccuguuuacuguggauuagguauagugccaacaguuugaaugguaagacaac

SEQ ID NO: 60898 - RNA, 64 nt, Human
ggggucagaggccgggacacugaggcagcagaacuagugccagggguggcugaguuggagggca

SEQ ID NO: 60899 - RNA, 64 nt, Human
guuucacagguaggcuuagcguccucucagaguguagugccagguccuggugccacgcuagcug

SEQ ID NO: 60900 - RNA, 64 nt, Human
uuguuauggcuuccuuuuuuaaaaaauuacccuguagugccaguuuauuaugcaaagcagcuua

SEQ ID NO: 60901 - RNA, 64 nt, Human
uuuuuuauucucaaauguuuguuuugaguaaccguagugccaaaauuucaguucaguaaugggg

SEQ ID NO: 60902 - RNA, 64 nt, Human
uaugcacuuaacauuauauucuauaaacauuaaguagugccaguuaugagauucccaguucuua

SEQ ID NO: 60903 - RNA, 64 nt, Human
agcagcccagguaaaacucuaagcaaguuagcuguagugccauuucagaaacuggccuaaaugg

SEQ ID NO: 60904 - RNA, 64 nt, Human
guccugcuaccuuugucucacgauuccagugcaguagugccaaaaggccccuucccacgucccu

SEQ ID NO: 60905 - RNA, 64 nt, Human
cuaaggacuuucccuucaccauuuuucuaggguauagugccacugacuuacauagcuagauguu

SEQ ID NO: 60906 - RNA, 64 nt, Human
gacaguugggugugagaauaacacuggcuuuggguagugccauggccaggaguggguuucccug

SEQ ID NO: 60907 - RNA, 64 nt, Human
auauccucaauuaucuuggaaaaaugcguagaucuagugccauuauuucuaccauuaaaaucuu

SEQ ID NO: 60908 - RNA, 64 nt, Human
agagcuguauaccugggacaggccagggagccuuuagugccagcagggccuguguccugggaug

SEQ ID NO: 60909 - RNA, 64 nt, Human
guguuaaugcuaugugacaaaacgcccugauuccuagugccaaagguucaacuuaauguauaua

SEQ ID NO: 60910 - RNA, 64 nt, Human
cucuaguuuggauuaaacucuuccccuccugcuuuagugccaccccaaacugcauuuauaauuu

SEQ ID NO: 60911 - RNA, 64 nt, Human
aaggaauguggauguuugguuucuccaaaguucccaccauaaaagauccaaagcaugagaggaa

SEQ ID NO: 60912 - RNA, 64 nt, Human
agcauagaaguaacuuacuuaggugugggggaagcaccauaacuuuguuuagcccaaaaccaag

SEQ ID NO: 60913 - RNA, 64 nt, Human
cuacauaaaaauguuuauaggacaagaaaaaccccaccauaacccaaggcaaacaauguauuga

SEQ ID NO: 60914 - RNA, 64 nt, Human
cauuggccuccccaggggcuuuccacccacacugcaccauaaccgccacacccuucgggggggg

SEQ ID NO: 60915 - RNA, 64 nt, Human
agcgcugugagucgugaagacacgggagaaaauccaccauaauaaaacugacauucaauuuuca

SEQ ID NO: 60916 - RNA, 64 nt, Human
gcucugugcugaaggguggaaggcuacccugacgcaccauaaucuaagcccggggcauaaaacc

SEQ ID NO: 60917 - RNA, 50 nt, Human
gggacagcaaagagaucuagcaccauaaggccagggagcugcugccagaa

SEQ ID NO: 60918 - RNA, 64 nt, Human
ggacuuacccaaacugugauacuaccauaauugucaccauaaucagucaaauaaagugaucugu

SEQ ID NO: 60919 - RNA, 64 nt, Human
ugcccuuagaaucuggaacagaagacuucagacucaccauaauugcugauaauuacccacucuu

SEQ ID NO: 60920 - RNA, 64 nt, Human
cauguguaacuacuguucuuucuucugcuuucuucaccauaauaaacuuuggacaaccaagcaa

SEQ ID NO: 60921 - RNA, 64 nt, Human
ggaagauuaguccagugauuacauaagaguugggcaccauaaauucucuauauuuugccuccca

SEQ ID NO: 60922 - RNA, 64 nt, Human
ucuuucuuaaaaaaauaauacuaugcaggcaagacaccauaaaaguuuaauuccuuacagaaga

SEQ ID NO: 60923 - RNA, 64 nt, Human
aaugugggauaaaacuucuuuaauagcuagaaaucaccauaaauaagaaugcuaaacagaauug

SEQ ID NO: 60924 - RNA, 64 nt, Human
aauugccccagggccugauucaggacugacucuccaccauaaaacuggaagcugcuuccccugu

SEQ ID NO: 60925 - RNA, 64 nt, Human
agaagauaacauauuucccuuauuuugauuuaaucaccauaaaccauaccuauuuaaugagugu

SEQ ID NO: 60926 - RNA, 64 nt, Human
gguguuggaggggcaggccuuuuugagccaaucccaccauaaugugaauaugccagugacugcu

SEQ ID NO: 60927 - RNA, 64 nt, Human
uuaggucauacuggcuagaaugcagcuuuucucccaccauaacaugaaaacaguguaagaacau

SEQ ID NO: 60928 - RNA, 64 nt, Human
gaacuggguuuuuguggagguucagagcaggcaacaccauaaguugcucucagauccuuguucu

SEQ ID NO: 60929 - RNA, 64 nt, Human
gaagagaaagcuucaugaagaacuuucuagcagucaccauaaccgggaaaaagccaaggaaaag

SEQ ID NO: 60930 - RNA, 64 nt, Human
caucuugggcaacuaguuaccaaaugaauugugccaccauaacugauuuuaauuuugcauuauu

SEQ ID NO: 60931 - RNA, 64 nt, Human
uuauucagaccuuaguacagcaagacacucuggccaccauaaaaaacgcagaaaagaaaaaaag

SEQ ID NO: 60932 - RNA, 64 nt, Human
uggucuuagccucagucucugucucuaaauauuccaccauaaaacagcugaguuauuuaugaau

SEQ ID NO: 60933 - RNA, 64 nt, Human
guuacugcuguuugcuuuuacuuacuuucaguagcaccauaacgaaguagcuuuaagugaaacc

SEQ ID NO: 60934 - RNA, 64 nt, Human
ucuaauauauuguuucaaaagauacauuuuuacccaccauaaauguuacaauaucugaauaugc

SEQ ID NO: 60935 - RNA, 64 nt, Human
auaccauggagauauuacaggaucaguuccagaccaccauaauaaaguggauaucgcaauaaag

SEQ ID NO: 60936 - RNA, 64 nt, Human
ugaaacuagcuaaaccugaauguaccuacuagggcaccauaauacugcagcaagaccaaagugg

SEQ ID NO: 60937 - RNA, 64 nt, Human
ugaaagugcucaauagaauuuuuaacguuggcaacaccauaaggauuucuuauguuaaguccca

SEQ ID NO: 60938 - RNA, 64 nt, Human
gacguguguauaguaaaugcaggcccucuggcagcaccauaauuggucgguuacccugagccca

SEQ ID NO: 60939 - RNA, 64 nt, Human
uaaauuguccguguucauacauuugaggggaaaacaccauaagguuucguuucuguauacaacc

SEQ ID NO: 60940 - RNA, 64 nt, Human
ccuauagguugcauacuaacuuaagcauucaugucaccauaaaaugccuuuagcauuucucaau

SEQ ID NO: 60941 - RNA, 64 nt, Human
ucccucuguuagucauuuguaaauucuaaauggucaccauaaaauguauuagguaggagaagau

SEQ ID NO: 60942 - RNA, 64 nt, Human
uccuuauucaaucagauuuuccaaaguaccuuuccaccauaagaaaugaauuuucuacuucuac

SEQ ID NO: 60943 - RNA, 64 nt, Human
acaucucauugaauuugaugguugacuuaauuggcaccauaacuuuguaugauauuauacauua

SEQ ID NO: 60944 - RNA, 64 nt, Human
aggaagugaugucccauuauuauccacccugagccaccauaauaugcuguuuacauuuauuuuc

SEQ ID NO: 60945 - RNA, 64 nt, Human
aaaccaaguaucacacuuuaauguacaugggccgcaccauaaugagaugugagccuugugcaug

SEQ ID NO: 60946 - RNA, 64 nt, Human
aagacaguagggaagacauuauagagcaugaagucaccauaauuuucccuaaagcaugcuuauu

SEQ ID NO: 60947 - RNA, 64 nt, Human
ugcuaaugauguguuuuuauauuauacauuuucccaccauaaacucuguuugcuuauuccacau

SEQ ID NO: 60948 - RNA, 64 nt, Human
ggaaaacaaaguucuagauagguuaaaagaaaaacaccauaaaagugguaguauauuuaagugg

SEQ ID NO: 60949 - RNA, 64 nt, Human
guugccucucuaugcuauuguguucagauacuuacaccauaauuaaacaguaaguuauagacuu

SEQ ID NO: 60950 - RNA, 64 nt, Human
gggagggaccaagguuguaaggauggcuaagucccaccauaagagcuaaaggguccugggagau

SEQ ID NO: 60951 - RNA, 64 nt, Human
gggagggaccaagguuguaaggguggcuaagucccaccauaacagcuaaggggaccugggagau

SEQ ID NO: 60952 - RNA, 64 nt, Human
uuuuuccuccucugugagugaccauccaggcagucaccauaacugcuggagugucugggauugg

SEQ ID NO: 60953 - RNA, 64 nt, Human
ugcauagcagcugaaugccagcccuguaaaagaccaccauaaagagagcuccauguucuuuugc

SEQ ID NO: 60954 - RNA, 64 nt, Human
uuacugcuuuuaguaaaugugacucgcuguaauucaccauaacuggaggccuaggccuuguuga

SEQ ID NO: 60955 - RNA, 64 nt, Human
ccccuagaagaaccaccacaaggaaaaaugcugucaccauaaggaaugugggaaaguuuucagc

SEQ ID NO: 60956 - RNA, 64 nt, Human
cccucaaagaaauccuccaaucaaaaucaccucccaccauaaucccugucuucuuuccaucccc

SEQ ID NO: 60957 - RNA, 64 nt, Human
uguacucaaaauaucauaauuguacaguuuaugccaccauaauuugaggccuauagauuuagcu

SEQ ID NO: 60958 - RNA, 64 nt, Human
gauuuuaaagaauuauauuggauaaggugguuuucaccauaagcuaauuuacucucugcagccg

SEQ ID NO: 60959 - RNA, 64 nt, Human
auuuaaacauucauuugauucagagcuaaauauucaccauaauccaggagggucuccuucccca

SEQ ID NO: 60960 - RNA, 64 nt, Human
uaugaaaugagaguuagaccauaugggcugacaacaccauaaauaacaagaaaagggagugcug

SEQ ID NO: 60961 - RNA, 64 nt, Human
aaaaaaagcaggccaucugcuuaacccuuggcuccaccauaaggcacugggacucggauuucuc

SEQ ID NO: 60962 - RNA, 64 nt, Human
ggugaccucuaagguaucuucuaaccuagaaauucaccauaauuauggugcaaggucagugugu

SEQ ID NO: 60963 - RNA, 64 nt, Human
acagccaggugacuaccaguccuggggacacacucaccauaaacacauccccaggcaggacaga

SEQ ID NO: 60964 - RNA, 64 nt, Human
gucuaggaaaaaauaauguuaaaagugaauaugccaccauaauuacuuaauuauguuaguauag

SEQ ID NO: 60965 - RNA, 64 nt, Human
aacacugaucccaaauuuguccauagcugaaguccaccauaaaguggauuuacuuuuuuucuuu

SEQ ID NO: 60966 - RNA, 64 nt, Human
cagacggugaaaaaagcaaauuaacucauuuggacaccauaacucaugcaauaaaacugauugu

SEQ ID NO: 60967 - RNA, 64 nt, Human
guagcgggcaucgcugccgccauuccugcagcaucaccauaagcagugcagggugucuccaucg

SEQ ID NO: 60968 - RNA, 64 nt, Human
auauauuuaaaucaugcuuuguuaauauuugucccaccauaaugccuccuucagaacauaagug

SEQ ID NO: 60969 - RNA, 64 nt, Human
uuuaaaccaauuuuuaaaacaaaacugcggacaccaccauaaaaauggaaucaaaagaaaguua

SEQ ID NO: 60970 - RNA, 64 nt, Human
caacccacaaguagcuacgacugcaagcaccugccaccauaaagggcugcauuuugccaccaua

SEQ ID NO: 60971 - RNA, 64 nt, Human
caagcaccugccaccauaaagggcugcauuuugccaccauaaagggcugcauuuuuuuaaaaag

SEQ ID NO: 60972 - RNA, 64 nt, Human
ccaguuucggaagauaauaaauguuuguuagauacaccauaauuucagaucaguauauucugaa

SEQ ID NO: 60973 - RNA, 64 nt, Human
gcccaggcuggagugcaauggcgcgaucuuggcucaccauaaccuccgccucccagguucaagc

SEQ ID NO: 60974 - RNA, 64 nt, Human
cugguagaccacugccauaugauuuacauuuccucaccauaagggucccccacucuaaagcaaa

SEQ ID NO: 60975 - RNA, 64 nt, Human
auucacagcauacgauuuuuacucucuccaucuucaccauaagacagauaauuugggguugcua

SEQ ID NO: 60976 - RNA, 64 nt, Human
cuuguuuaucugcuucuuaaagaaucagccgagacaccauaaaagaaauaggcuuuuugugccu

SEQ ID NO: 60977 - RNA, 64 nt, Human
gucacuauugauucugguuauaaagaaaggcugucaccauaaugcaggaucacuacaguuuaau

SEQ ID NO: 60978 - RNA, 64 nt, Human
cggacuguguaaguaaaaguacaaacauuauuuccaccauaaaguauguauugaaaucaaguug

SEQ ID NO: 60979 - RNA, 64 nt, Human
ccuggauuuaagaugguggcuaucccugaggagucaccauaaggagaaaacucaggaauucuga

SEQ ID NO: 60980 - RNA, 64 nt, Human
guuauaccauccuuguaaguaaguuuguaauuuccaccauaaauuaugguaaauauaaaacucc

SEQ ID NO: 60981 - RNA, 64 nt, Human
auuagcucugcccucaugaaguauuauuauaauucaccauaaacagcuaucugucugaauuacu

SEQ ID NO: 60982 - RNA, 64 nt, Human
aggagacaagauguggaagaauugacauguaucccaccauaaaaugguagaagaugaguuuuca

SEQ ID NO: 60983 - RNA, 64 nt, Human
caaccaaucuaaauuggauucuuuaauguuguuucaccauaacacaaaaagcaugaacuuguau

SEQ ID NO: 60984 - RNA, 64 nt, Human
gcugggcucccugaugacacccacccugugccaucaccauaaccucuggggaccccaaccucag

SEQ ID NO: 60985 - RNA, 64 nt, Human
acuaguguucuguuuguuauuguuuuguuaauuacaccauaaugcuaauuuaaagagacuccaa

SEQ ID NO: 60986 - RNA, 64 nt, Human
aagaaucauugugcuuaauaauaccaagacuaagcaccauaaccaagaaauacuaauguaaaga

SEQ ID NO: 60987 - RNA, 64 nt, Human
uuaguagggugagggauaagcaaaagaggauguucaccauaacccaggaaugaagauaccauca

SEQ ID NO: 60988 - RNA, 64 nt, Human
cacgggaaaugcuucucgugaagggcaaauguaacaccauaacaguagggaauaaacugugucc

SEQ ID NO: 60989 - RNA, 64 nt, Human
accucugacucccuaacuccaucagaccucuacgcaccauaagacucugccagaacugagaagc

SEQ ID NO: 60990 - RNA, 64 nt, Human
cugaaaggcaggaguguuagcaucucgcuuuauccaccauaacguaaagaacugcggugugaua

SEQ ID NO: 60991 - RNA, 64 nt, Human
uuagcaccuaaagaucugcaccccaaaccaaugucaccauaaagagggcacgaagaagaguggg

SEQ ID NO: 60992 - RNA, 64 nt, Human
gugacacaaggaagccaguggggugggagggaggcaccauaaucccucccuaaaacccacagaa

SEQ ID NO: 60993 - RNA, 64 nt, Human
ccucugagcugcauuaguguuagugcucagaaaucaccauaaucacgaaaauaauaauaauaaa

SEQ ID NO: 60994 - RNA, 64 nt, Human
accaucuuguaacucacuguguuaguauauaaagcaccauaagaaauccaauggcagauaacca

SEQ ID NO: 60995 - RNA, 64 nt, Human
gaucauuucaagauauaagaaauuuuggaaauuccaccauaaauaaaauuuuuuacuacaagaa

SEQ ID NO: 60996 - RNA, 64 nt, Human
acuuaauaauucaaauucucaggaauuaaggacucaccauaacauugucaguucuaaugaaauu

SEQ ID NO: 60997 - RNA, 64 nt, Human
aaaauacaacuguucaauggaaauagaaaauaaacaccauaaaagagagaagagagguaauuug

SEQ ID NO: 60998 - RNA, 64 nt, Human
gaaugucagauucauuuuucuugauguaauuuaucaccauaaaaaaaaacccaugcaaaccuga

SEQ ID NO: 60999 - RNA, 64 nt, Human
augaacauuuauugaucuucuacauacaagacuucaccauaaggccaggagcaguggcucacac

SEQ ID NO: 61000 - RNA, 64 nt, Human
aauguucaauauuaaaaggauaauucacauuugccaccauaauguucuuuuuuauguaaaaaga

SEQ ID NO: 61001 - RNA, 64 nt, Human
uuaggcauaucucugccaucacauaguauuaugucaccauaaugaacaauugcuauuuaaauag

SEQ ID NO: 61002 - RNA, 64 nt, Human
auuccauucaccuaacuuuagacauucguuuagacaccauaacuggagugauugugcuucuaga

SEQ ID NO: 61003 - RNA, 64 nt, Human
cauugcuagagacccacauccuacaaaauccugacaccauaaccuuaagccaugccuuuccuuc

SEQ ID NO: 61004 - RNA, 64 nt, Human
auuaaggcaguuagacugagauuucuaaugacuucaccauaaagauuauacuucugccuggcgu

SEQ ID NO: 61005 - RNA, 64 nt, Human
aauccacucuuggcaaugcaauaaaaaaaaccgucaccauaagccagugacaccugacugaagc

SEQ ID NO: 61006 - RNA, 64 nt, Human
uuacguaacuacuccuuuacugccaauuaacuaucaccauaaaaguaauaaaaaaugaaauuau

SEQ ID NO: 61007 - RNA, 64 nt, Human
ccagaacuaucacuucagauguuucuauuuugggcaccauaacuauuugagcucauauuuuuau

SEQ ID NO: 61008 - RNA, 64 nt, Human
cucauuaucuugaaauuuuuuuaauguuugagaacaccauaagcagaauauucuaacaccuuug

SEQ ID NO: 61009 - RNA, 64 nt, Human
gccagaugucaacauuaagcugcaacauccuaaccaccauaagccggaggugguuacagcuuau

SEQ ID NO: 61010 - RNA, 64 nt, Human
ggauccuggucccuguacgaccucauugaagaaacaccauaaguggcguggacuaucuaccucc

SEQ ID NO: 61011 - RNA, 64 nt, Human
caucacagcuaacaauugugaagucgucuuaacucaccauaaaaaggaauccacucccaggcag

SEQ ID NO: 61012 - RNA, 64 nt, Human
guaccauaaugcuaaauaaaacuguggcacuuuucaccauaauuuaauuuaguggaaaaagaag

SEQ ID NO: 61013 - RNA, 64 nt, Human
uaaauauacucuuuugagacuggccucuuuuacucaccauaaugccuuuguaauucauccaugc

SEQ ID NO: 61014 - RNA, 64 nt, Human
ugaaagaacuucaaaucuuaccugccaacauauucaccauaauuuuuuuauuuuuuaauaccuu

SEQ ID NO: 61015 - RNA, 64 nt, Human
agaucuuaauggcuauauaggaagaaauaucacucaccauaauuuaaauaaagaauaaaaauac

SEQ ID NO: 61016 - RNA, 64 nt, Human
cuaguuauucauuguuaauauaacugucuuaguacaccauaaacuggguggauuauaaacaaca

SEQ ID NO: 61017 - RNA, 64 nt, Human
acauuguaauauauaaugaaauaauuauacaacucaccauaauguagaaucagcaggagcccug

SEQ ID NO: 61018 - RNA, 64 nt, Human
uggggcuucuaugccuaagaccaacugcguuggacaccauaagccacagccucacaggaagugg

SEQ ID NO: 61019 - RNA, 64 nt, Human
aagcagagcagagugcgagauccugacccaagagcaccauaacauagcuccgaaagggagagca

SEQ ID NO: 61020 - RNA, 64 nt, Human
ccuuucugccagcaguucugguucuuaagaaaaucaccauaaaucagacaugaaaauucuggcu

SEQ ID NO: 61021 - RNA, 64 nt, Human
ccacagccccaucugcgggggcagugcucacccacaccauaagcuacugccauccuggcccagg

SEQ ID NO: 61022 - RNA, 64 nt, Human
ccuuugguccuaagucccugcccccuccccuucacaccauaacuagguaacaguuugauaacua

SEQ ID NO: 61023 - RNA, 64 nt, Human
ggcguccgggcagcugcagcugagaggacuuucacaccauaaggagauuucuguuuuucuuuuu

SEQ ID NO: 61024 - RNA, 64 nt, Human
uuccaggagagaaugggagacaauccuagacuuccaccauaaugcaguuaccuguaggcauaau

SEQ ID NO: 61025 - RNA, 64 nt, Human
ggaaaaaaaacuauugauaaguuuauaggcaaaccaccauaaggggugagucagacaggucuga

SEQ ID NO: 61026 - RNA, 64 nt, Human
ccagaauauuuuaccuuuaaaaaaaugucauuggcaccauaaauaaggacugugagagacuguu

SEQ ID NO: 61027 - RNA, 64 nt, Human
gagaagcaggucuaggacuccccugcaccuuugccaccauaauggcccacacucccugggucca

SEQ ID NO: 61028 - RNA, 64 nt, Human
uugguuguccccgugaagaagccuucaaacccugcaccauaaauacauguguccauauauuauu

SEQ ID NO: 61029 - RNA, 64 nt, Human
cccuugguguggacacacccucucaugcuaccagcaccauaauccagugggggugacugggugc

SEQ ID NO: 61030 - RNA, 64 nt, Human
cagcaugcagguguuucaguuagcuuguuuucaucaccauaacugcaaagauguggcuuaguug

SEQ ID NO: 61031 - RNA, 64 nt, Human
agucauuuguucaucuuuacuuuuagcagauuagcaccauaacuaacuuaaaacuaaguuuguu

SEQ ID NO: 61032 - RNA, 64 nt, Human
uauguccagccuauugcuuuuuguuuuagugugucaccauaaauaucaggggcauaaaaggcua

SEQ ID NO: 61033 - RNA, 64 nt, Human
gaagguuaacaguaggggagauugucgaucucaucaccauaauaaagaguuuccugugcccucc

SEQ ID NO: 61034 - RNA, 64 nt, Human
uacaucaagccaauaccguguggcccaagacccccaccauaaaucacaucauuagcaugaacca

SEQ ID NO: 61035 - RNA, 64 nt, Human
gggagcacugguguucacgugggaccacaggcugcaccauaagacccacucacaauaaaaaaau

SEQ ID NO: 61036 - RNA, 64 nt, Human
uacuggguguauaccuaaaggaauauaaucauuccaccauaaagacaaacacuuguauguucau

SEQ ID NO: 61037 - RNA, 64 nt, Human
cucuuguucuuggaaacuuuguugaggaucaauucaccauaaauauguguguuuccuucuuugc

SEQ ID NO: 61038 - RNA, 64 nt, Human
gggucuggucuggugagcuccugaggccacacagcaccauaaagucucgcaucuacaggccuuu

SEQ ID NO: 61039 - RNA, 64 nt, Human
aaagacccuuguucuuaucccucaagaagaaacccaccauaaccagcccacugucaccccuaau

SEQ ID NO: 61040 - RNA, 64 nt, Human
gcugcccucguuuacucacaguuugcuuauuugccaccauaagaaaugguacaauaaaaauuca

SEQ ID NO: 61041 - RNA, 64 nt, Human
caaaaaaacacauacauaggaacugguuauauuccaccauaacacacacacacacacacacaca

SEQ ID NO: 61042 - RNA, 64 nt, Human
augugggccacucagagcuaaccaaaauguucaacaccauaacuagagacacucaaauugccaa

SEQ ID NO: 61043 - RNA, 64 nt, Human
gucugagccacucagaacucaccaaaauguucaacaccauaacaacagcugcucaaacuguaaa

SEQ ID NO: 61044 - RNA, 64 nt, Human
augugagccacucagaacucaccaaaauguucgacaccauaacaacagcuacucaaacuguaaa

SEQ ID NO: 61045 - RNA, 64 nt, Human
aauuguuucugcagauuccggauauuauaauucacaccauaaagauugugaagugguuauuggc

SEQ ID NO: 61046 - RNA, 64 nt, Human
gagcaagagagggcaaguguucccaaauugacgccaccauaauaaucaucaccacaccgugagc

SEQ ID NO: 61047 - RNA, 64 nt, Human
caugacgugaagaaugagauaggagacaggagaucaccauaagcgucccugauauagcagcaca

SEQ ID NO: 61048 - RNA, 64 nt, Human
acugcugggaaaacagguggugugggacuuaagucaccauaauuuugaagacuugcaugcagag

SEQ ID NO: 61049 - RNA, 64 nt, Human
uccuaguggguuugggggguuggguuccugaaugcaccauaaucgcuguaugaaauauuaaaaa

SEQ ID NO: 61050 - RNA, 64 nt, Human
gggaacucaacuugaaggucugucuuccaucuggcaccauaaaaacaugaacuuauugcauaaa

SEQ ID NO: 61051 - RNA, 64 nt, Human
gcuccuuuuucauguugaucuuuaaauuuucccacaccauaagagaggagcaaaggaaauuacc

SEQ ID NO: 61052 - RNA, 64 nt, Human
guacagguaguuuuugagcugacagcagcaaaggcaccauaagucaaaauauugguuuuggugg

SEQ ID NO: 61053 - RNA, 61 nt, Human
ccucgggcaugaacgcgagcccaaagugccagucugcgauuggaaauuuccagccacuuua

SEQ ID NO: 61054 - RNA, 61 nt, Human
cugccagcacagggcaucucgggcuuggcuggucugcgaggccuugccccuguggaacucu

SEQ ID NO: 61055 - RNA, 61 nt, Human
ucucagccauagugaaggaccagcccuaggagucugcgagagccuccuugguuccaucgug

SEQ ID NO: 61056 - RNA, 61 nt, Human
uuuugcugcuauaauucuauacuguugauucgucugcgauuuuaucuguuaaccaaauaaa

SEQ ID NO: 61057 - RNA, 61 nt, Human
acgugcuccguagcucugcugcugauacugggucugcgaugcagcggcgugaggccugggc

SEQ ID NO: 61058 - RNA, 61 nt, Human
agagagagagaauaugugugugugugugugcgucugcgagcgcacacacaugcacaagugc

SEQ ID NO: 61059 - RNA, 61 nt, Human
cagucauguuagguaggaggugguagagucggucugcgagguaucucguaagaggggaggu

SEQ ID NO: 61060 - RNA, 61 nt, Human
uuugucucuucggaggagcuagcuaugagaugucugcgaucacaucacgguaaagcccaag

SEQ ID NO: 61061 - RNA, 61 nt, Human
caagguuuuagcugucuugugugcauccacagucugcgaagaagacaugauaaggacauca

SEQ ID NO: 61062 - RNA, 61 nt, Human
cuuguugacagggagccaaggcgaggcggcugucugcgaccacagcagccucgaaacacca

SEQ ID NO: 61063 - RNA, 61 nt, Human
aaggauccccagcccccaagaccuagccuuugucugcgauuuuggcuucaucucccacaaa

SEQ ID NO: 61064 - RNA, 61 nt, Human
caaaaggcucaacagacugaauggccucuuggucugcgaaaauucaguugcaaugaggaug

SEQ ID NO: 61065 - RNA, 61 nt, Human
ccaggcacagcugaacaugccgcuguccgaggucugcgagggcuucgacgaggagggccgc

SEQ ID NO: 61066 - RNA, 61 nt, Human
cugcugcuggcaaggaaugggaacaguggcugucugcgaucaggucuggcagcauggggca

SEQ ID NO: 61067 - RNA, 61 nt, Human
aacaaggugcccuuuagccagaugcuaggcugucugcgaagaaggcuaggaguucauagaa

SEQ ID NO: 61068 - RNA, 61 nt, Human
gaaaagucacacugaaaggaugcaaauagccgucugcgauuuuggcggcccuccggauugu

SEQ ID NO: 61069 - RNA, 61 nt, Human
ccaggggaggcggcacuccaaccuaaccugugucugcgaaguccuauggaaacccgagggu

SEQ ID NO: 61070 - RNA, 61 nt, Human
acacagauauaacaaugguuuugauguccuugucugcgaaucuuaucacuugggucaguuu

SEQ ID NO: 61071 - RNA, 61 nt, Human
uggaaguggggaccccucacugcguccacgugucugcgaccuguguggagugucaccgcgu

SEQ ID NO: 61072 - RNA, 61 nt, Human
ccgcuguuccucccucaucuccucugccugugucugcgacccccauccaugugccaaagug

SEQ ID NO: 61073 - RNA, 61 nt, Human
gguucacacaggugcagcuucgaggcccacagucugcgaccuucuuguuuggagaugagaa

SEQ ID NO: 61074 - RNA, 61 nt, Human
gucucccaccugccccaauaagaucugcucugucugcgacaccaagauccagcuggggacu

SEQ ID NO: 61075 - RNA, 61 nt, Human
cccugauucuaccaaaugcaaacacaucugggucugcgauuaugcacagagacuuuggaca

SEQ ID NO: 61076 - RNA, 61 nt, Human
gccugcacuugcaggaguggugaugccccaagucugcgaauccagggugcacguggucaau

SEQ ID NO: 61077 - RNA, 61 nt, Human
cuccucgcccaguuucugaggucagacgagugucugcgaugucuucccgcacucuauuccc

SEQ ID NO: 61078 - RNA, 61 nt, Human
ccugcuuaccugccagauaaccaagugagaugucugcgaguggcuaguuuucacauucuua

SEQ ID NO: 61079 - RNA, 61 nt, Human
gccaagugccuaccuguccaccgccaccggggucugcgauggcacgccagugcuggagccg

SEQ ID NO: 61080 - RNA, 61 nt, Human
gcgggagcggccccacacguguuugcuuaaagucugcgaguccgcaucguguccgccucuc

SEQ ID NO: 61081 - RNA, 61 nt, Human
ccuuucagcaucugagaaccuuaaagccaaugucugcgaucuuuuuuuggauauuuauacu

SEQ ID NO: 61082 - RNA, 64 nt, Human
cuucaaggcuccugcuuaaaguccacacguuauuauggccgaaagcaaccuggugcuucggccu

SEQ ID NO: 61083 - RNA, 64 nt, Human
uuucaagggagcugauaaagaacuucuucccaaaauggccgaagcuggacuguacugcugccau

SEQ ID NO: 61084 - RNA, 64 nt, Human
ccccagagccugccauucacguuugccaaggaagauggccgacacucucugaguguguucacug

SEQ ID NO: 61085 - RNA, 64 nt, Human
ggccgucgucaugguuacuggccccuaggcgccgauggccgaggccgcgccugcccaccgggcg

SEQ ID NO: 61086 - RNA, 64 nt, Human
guggucugcaggguaggcccgcaggaaaugaggaauggccgagcuggagagaagagcugauuuu

SEQ ID NO: 61087 - RNA, 64 nt, Human
gaccaaacugccaucaccucccacuuggaaguguauggccgacagcaugaaauagcugagccca

SEQ ID NO: 61088 - RNA, 64 nt, Human
gugggcagcguacuucuaacucauuguuucccucauggccgaccagggcggggauagcaugccc

SEQ ID NO: 61089 - RNA, 64 nt, Human
uauagcauguaucaguacuacuucauuucuuuuuauggccgaaauuacuccauuguaugauaug

SEQ ID NO: 61090 - RNA, 64 nt, Human
guguguaugauugucuuaaaauuuuuuaauagauauggccgagcgugauggcucaccccuguaa

SEQ ID NO: 61091 - RNA, 64 nt, Human
cggcuagggcuugggggugaugcaggcacagcagauggccgaggcaggacacugcagaggaaga

SEQ ID NO: 61092 - RNA, 64 nt, Human
cuugagaguggaggagcaggccauucuggaugccauggccgaggagacaaggcagaagcaacuu

SEQ ID NO: 61093 - RNA, 64 nt, Human
caccauuaggcuaauagagaaacagaucagccaaauggccgaugacacaguggcagaacuggac

SEQ ID NO: 61094 - RNA, 64 nt, Human
ggcugaaauauuucucguaauagcagaauauuucauggccgaacucuugauagugacaaaucag

SEQ ID NO: 61095 - RNA, 64 nt, Human
cugagccaggcuuuucucaggagcuucaaugaguauggccgacagacauggacaaggagcugug

SEQ ID NO: 61096 - RNA, 64 nt, Human
gaaagacacacugagcugugaugaagaaaaauacauggccgacuccaggguggugacauuuaga

SEQ ID NO: 61097 - RNA, 64 nt, Human
gaaaaugaaauauaacaagugggugaaugugguuauggccgaaaaggauaugcaguaugcuuaa

SEQ ID NO: 61098 - RNA, 64 nt, Human
uauaaucaaugccaauguaaugccagcgggugagauggccgauggagguuucaaagauguagcu

SEQ ID NO: 61099 - RNA, 64 nt, Human
ucaccuuguggggcauguuuguauuuauugcuucauggccgacuggaauccugaguccugggaa

SEQ ID NO: 61100 - RNA, 64 nt, Human
ccaaaccagcccucggcugcuaugaguuggcaagauggccgagucuacuucuucaagggcaaag

SEQ ID NO: 61101 - RNA, 64 nt, Human
cacauugacuauagaaugagauguauccugcaagauggccgaaucuucauuggcaccuuuaagg

SEQ ID NO: 61102 - RNA, 64 nt, Human
ucgaccuugaggaggccucccacgaagggcgaagauggccgagaugauccuaaaaauaaccgaa

SEQ ID NO: 61103 - RNA, 64 nt, Human
uccacaaaggguagccuggcuuuucuggcuggggauggccgauggggcccacauuaggggguuu

SEQ ID NO: 61104 - RNA, 64 nt, Human
aagcagauuuugcuuuuguuuguuaaucauaggcauggccgagcauuguggauuagccugaggc

SEQ ID NO: 61105 - RNA, 64 nt, Human
aauuucaagcagugaggauuuuguggugccugagauggccgagggcacagggagugagcuguau

SEQ ID NO: 61106 - RNA, 64 nt, Human
ggcccgcccccgugacugacugacagaugcagggauggccgaggcagcccucgcuccagcugaa

SEQ ID NO: 61107 - RNA, 64 nt, Human
auguagaaaaaccuucagccaggaggcuggcaagauggccgaauaggaacagcucugaucugca

SEQ ID NO: 61108 - RNA, 64 nt, Human
caucugaugcuuccccugggaaucuaaacugggaauggccgaggaggaaggggcuccgugcacu

SEQ ID NO: 61109 - RNA, 64 nt, Human
gagauggauccuuccaucuuguggggccaggaccauggccgaagccccuuggagagagaggcug

SEQ ID NO: 61110 - RNA, 64 nt, Human
gcccccgacccaucacugccacauucuccgggucauggccgagcuugaccucugcauccauggu

SEQ ID NO: 61111 - RNA, 64 nt, Human
ggagaggagaaauguggacagagggcuugaagacauggccgaauaggcuacugccacccggcuu

SEQ ID NO: 61112 - RNA, 64 nt, Human
auuuuugccugucauaagaaaacucuuagcugaaauggccgaaaacugugagacaugcuaugga

SEQ ID NO: 61113 - RNA, 64 nt, Human
uuuaaugccugcuauaaaaauuugaaauauuagaauggccgaccauggcagugaccaggccuca

SEQ ID NO: 61114 - RNA, 64 nt, Human
ccccgguguccagaucggucccguuggucaccuccguccggaacaccaccuccaccgggcugca

SEQ ID NO: 61115 - RNA, 64 nt, Human
cccaggucccucccgccuccagguccauccaucccguccggaaaagaaggacccagagggaaga

SEQ ID NO: 61116 - RNA, 64 nt, Human
cacgcauggaggggcauugcucuagcccucagagcguccggagcagcaggguacauggguggga

SEQ ID NO: 61117 - RNA, 64 nt, Human
ucagugucuauuucaagauacauuuggagacaaccguccggauuuuccacuucgguucuuucga

SEQ ID NO: 61118 - RNA, 64 nt, Human
augacuguggcuccacugucccugacaaccccuucguccggacccucccccacacaacuauguc

SEQ ID NO: 61119 - RNA, 64 nt, Human
uggggcuuuccugguggccccacuggggcugcuccguccggaaccuagaagaggcuucauggcc

SEQ ID NO: 61120 - RNA, 64 nt, Human
ucaccaagucaccucccuccuuguacaagguuugcguccggaagccgggugccauagugaggac

SEQ ID NO: 61121 - RNA, 64 nt, Human
cuccccacccccgcugggggugggggcggguguccguccggaaaugaaggaauagcccgaggac

SEQ ID NO: 61122 - RNA, 64 nt, Human
guucggagcucccaccuggacgcaucccucaccacguccggauuuccuucuuuggauggaaugu

SEQ ID NO: 61123 - RNA, 64 nt, Human
uacaggagggcagcucugcaguugggaggggcaccguccggaggagaccaggccucuacacacc

SEQ ID NO: 61124 - RNA, 64 nt, Human
gugacugucucguuucugucaugguggugcgucccguccggagccacucuccacuuucucucac

SEQ ID NO: 61125 - RNA, 64 nt, Human
ccagccacacuccagggcggaguuggaugaggcccguccggagggagccaucucuugcucccga

SEQ ID NO: 61126 - RNA, 52 nt, Human
cgggggaggaggaggcauagaccguccggagcagcggggccucugccagccc

SEQ ID NO: 61127 - RNA, 64 nt, Human
gcucauuucauucgacugacccaggccaugcucacguccggaguaacacuacauacaguucacc

SEQ ID NO: 61128 - RNA, 64 nt, Human
auuaauuugggauuucaaaacacaaaugaaaacucacacccacccacccccaagugcaugucuc

SEQ ID NO: 61129 - RNA, 64 nt, Human
uaucacaugagacaccaaaaacuggaaauguagucacacccaguacaguaccauuuuuaugaau

SEQ ID NO: 61130 - RNA, 64 nt, Human
cucccgaguagcuggaauuacaagugcgcacuaccacacccagcuaauuuuugcauuuuuacuu

SEQ ID NO: 61131 - RNA, 64 nt, Human
cccucuuuucuguucacccccaaaagaaaacuuacacacccacacacauacacauuucaugcuu

SEQ ID NO: 61132 - RNA, 64 nt, Human
agcaucaggcuccugcagagccccauccccccgccacacccacacgguggagcugccucuuccu

SEQ ID NO: 61133 - RNA, 64 nt, Human
agguggcagucgcaggauuuggcuaugacaugagcacacccaacgcaccccugcacuacuauga

SEQ ID NO: 61134 - RNA, 64 nt, Human
cugugagccccccacucugccgugcucacacagacacacccagcugcacacaugaggcauccca

SEQ ID NO: 61135 - RNA, 64 nt, Human
agagugaguguauuuuccuuguguauauauuaaacacacccauacaaacauugguaaaguugau

SEQ ID NO: 61136 - RNA, 64 nt, Human
aguuugagaagcaucaucauagagaaguaaacaucacacccaacuuccuuaucuuuccaguggc

SEQ ID NO: 61137 - RNA, 64 nt, Human
cuacucucuucugcaauuuugacaccucaauauucacacccauaaacauuacuaagccccaguu

SEQ ID NO: 61138 - RNA, 64 nt, Human
guauaucuuagcagcacugaguccagugcgagcacacacccacuauacaagaguggcuauagga

SEQ ID NO: 61139 - RNA, 64 nt, Human
uguaguaugauaaagucagcuucuuggauacagacacacccagggcagcugccaaucagaaaug

SEQ ID NO: 61140 - RNA, 64 nt, Human
aggacucaucacaucuauucggauauucuguuuacacacccaugucaucccagagaggugauca

SEQ ID NO: 61141 - RNA, 64 nt, Human
cucccaaagugcugagauuacaggcgugagccaccacacccagcucagggaggcguaguuuucu

SEQ ID NO: 61142 - RNA, 64 nt, Human
ucccucuucucccucuugcaugcuuuaccugucccacacccaugccaaugugccaagucucccu

SEQ ID NO: 61143 - RNA, 64 nt, Human
guaaccuggcuuuaucaaauucucaucccuuucccacacccacuucucuccuaucaccuucccc

SEQ ID NO: 61144 - RNA, 64 nt, Human
aggagagaagggagaaaaaaaaaaaaaaaccacacacacccauacacacauaccagaaaaagaa

SEQ ID NO: 61145 - RNA, 64 nt, Human
gcacuggucagccuguggagcccuggaugcuauccacacccaccuaucccugcagcuaauuuag

SEQ ID NO: 61146 - RNA, 64 nt, Human
agccucucagggcaggaccucuucccaagcccugcacacccaccccugcagcccuuuuggcucc

SEQ ID NO: 61147 - RNA, 64 nt, Human
cagacguguaaauccuuccaccccgacccgcacacacacccacacugcugcccuggcgggggcc

SEQ ID NO: 61148 - RNA, 64 nt, Human
uccauucucuaaaauuaauauaauugcuuuccuccacacccagccacuguaaagagguaacuug

SEQ ID NO: 61149 - RNA, 64 nt, Human
gucaccgaaucuguacuaaggaccuguguucagccacacccagugguagcuccaccaaaucaug

SEQ ID NO: 61150 - RNA, 64 nt, Human
aguuugguuccacccaguugaaagacacccagugcacacccaaacuccuggccuucugugguuu

SEQ ID NO: 61151 - RNA, 64 nt, Human
cucacuggugaaacccaggauguagauagagggccacacccacccuguccagaguagagggcac

SEQ ID NO: 61152 - RNA, 64 nt, Human
guggguuucccagcuaacggacaagcuccccugccacacccagugcccacgcaugcucacauac

SEQ ID NO: 61153 - RNA, 64 nt, Human
ggaauucuuauccuggccacauguccuccgugcacacacccaauggaguuaaccuuggaaguug

SEQ ID NO: 61154 - RNA, 64 nt, Human
cuccugaguagcugggauuacaggcgcccgucaccacacccagguaauuuuuguauuuuuagua

SEQ ID NO: 61155 - RNA, 64 nt, Human
uucuuaagucggccaagauguacuucucugugugcacacccaugcacacucaugcacacagaua

SEQ ID NO: 61156 - RNA, 64 nt, Human
ggaggagcgccaguugccccucgcucacagaccacacacccagcccuccugggccagcccagag

SEQ ID NO: 61157 - RNA, 64 nt, Human
gaggacaggaccaggcgcuuggcaagacaucagacacacccaacccaaaggcguggaccccagg

SEQ ID NO: 61158 - RNA, 64 nt, Human
ucaguguuuccgucugcucaccugccacagagcccacacccaugcccaccaguguuggucuuug

SEQ ID NO: 61159 - RNA, 64 nt, Human
gaucugucuaugggaccaguggcuuggauucugccacacccauaaauccuuguguguuaacuuc

SEQ ID NO: 61160 - RNA, 64 nt, Human
ggggcaggcaucuauuccugcccccaucaugccccacacccaucagucaacacucauuugacaa

SEQ ID NO: 61161 - RNA, 64 nt, Human
ccugaaggaaucugaaggcacuggaaucacuccacacacccaaagccucuggacuucugguucu

SEQ ID NO: 61162 - RNA, 64 nt, Human
ggcccaccuuccugaccuccccucauuguggccccacacccagucugcuucucccuguuacaca

SEQ ID NO: 61163 - RNA, 64 nt, Human
auuucaguauaaagaucacccguuguauucaccccacacccagggcuaguauaaacaugacccu

SEQ ID NO: 61164 - RNA, 64 nt, Human
aauugcaguguccauaaguaaaguuuuauuggggcacacccaugcucacccuuuuaaauauugu

SEQ ID NO: 61165 - RNA, 64 nt, Human
cucccaaguagcugggacuacaggcacacgccaccacacccagcuaauuuuuuguauuuuuagu

SEQ ID NO: 61166 - RNA, 64 nt, Human
agacagcacaagguggcagcaagcaauucugccccacacccagccagcuccuuucccuuuucca

SEQ ID NO: 61167 - RNA, 64 nt, Human
uagcugggauuacagguucccccccaccuucccccacacccagcuaauuuuuguguuuuuagua

SEQ ID NO: 61168 - RNA, 64 nt, Human
gcuaguguguggcagccaugaaaaguuacacauacacacccacauacagacagaccuaccuaua

SEQ ID NO: 61169 - RNA, 64 nt, Human
cacuccauagguaaauaaacugggugaagccacacacacccaaugaacauuuucucccauuugg

SEQ ID NO: 61170 - RNA, 64 nt, Human
ucagcuuugaccugucucauuucccauauuccuucacacccagcuucuggaaggcauggggugg

SEQ ID NO: 61171 - RNA, 64 nt, Human
caccagucccacucaaugcugcucuaacucuacccacacccaccuaauuaggggugcuaauaaa

SEQ ID NO: 61172 - RNA, 64 nt, Human
agccagccucagcacucagugaguucaucagggccacacccaguagagaaggccaagcaaccuc

SEQ ID NO: 61173 - RNA, 64 nt, Human
ggccuaggugggagccaccacuccugccugcccccacacccacuccacaccaguaauaaaaagc

SEQ ID NO: 61174 - RNA, 64 nt, Human
accccaaucacacacagaaacccguaggcacggacacacccagucucaaugcacgaaguuggag

SEQ ID NO: 61175 - RNA, 64 nt, Human
cuugaagguuugaugccaaagcagacauuuuccucacacccaccugcugcuguaugaauagcug

SEQ ID NO: 61176 - RNA, 64 nt, Human
agaauucaguaccaaccaagcuucagcccacuuucacacccacugggcaauaaacuuuccauuu

SEQ ID NO: 61177 - RNA, 64 nt, Human
ugcugccagaggaccguggauaccucaguguccacacacccaccaugcccagcccuggagccau

SEQ ID NO: 61178 - RNA, 64 nt, Human
cuggcagcucugcacccagggaccaugugcucuccacacccaggagucuaggccuugguaacua

SEQ ID NO: 61179 - RNA, 64 nt, Human
gugugcagugcugcaaugcccagacaaacgugagcacacccaccaguuucuaaaauggaauaga

SEQ ID NO: 61180 - RNA, 64 nt, Human
cuccugaguagcugggaucauaggcacgcgccaccacacccagcuaauuuuuuguauuuuuagu

SEQ ID NO: 61181 - RNA, 64 nt, Human
cucacagucuagauuagaaguguuuuaauuucuacacacccauagugcacacuuguauauugaa

SEQ ID NO: 61182 - RNA, 64 nt, Human
ggguggugcuggcccaguuggugggaccccuguccacacccacccuauuuauuuccguugucuc

SEQ ID NO: 61183 - RNA, 64 nt, Human
gcucugcccuggcuggggaggacacucggugccccacacccagugaaccugccaaagaaaccgu

SEQ ID NO: 61184 - RNA, 64 nt, Human
uggucgguucgucucccauuugccauccaggccucacacccacacucgagcccacccggccggc

SEQ ID NO: 61185 - RNA, 64 nt, Human
uuuuauaaauuaaaaaaggcugggugugguggcucacacccauaaucccaacacuuuggcucag

SEQ ID NO: 61186 - RNA, 64 nt, Human
augcuugauauuuucuauaugcgaguuagccauccacacccaggcauagccuggauacaguaua

SEQ ID NO: 61187 - RNA, 64 nt, Human
cucccauauagcuggaacuacaguugugcacuaccacacccagcuaauuuuuugauuucuugug

SEQ ID NO: 61188 - RNA, 64 nt, Human
ucccugaagccagccuucuuccaucccaggacaccacacccagccucaguccuccccucacagc

SEQ ID NO: 61189 - RNA, 64 nt, Human
gcuuuaccugugaaauuccccgccccccugcacacacacccacuuuaguacaguuccugucaau

SEQ ID NO: 61190 - RNA, 64 nt, Human
cagggagccccauaggccaucaucauccuuaucccacacccauuauaaaagagguuucuauugu

SEQ ID NO: 61191 - RNA, 64 nt, Human
uggacccagagacgucccccaucgugggacacgacacacccagaccgcgugccccaccgucuua

SEQ ID NO: 61192 - RNA, 64 nt, Human
ucccagauccucugcugacuccauauggaggccucacacccagaggguagggcagcagaucuuc

SEQ ID NO: 61193 - RNA, 59 nt, Human
ucaacaccaucgacguuugagugaagaaacacacccagaagagagaugcacuaacaacu

SEQ ID NO: 61194 - RNA, 64 nt, Human
caccugaguagcugggauuacacgcacaugccaccacacccagcuaauuuuugcauuuuuagua

SEQ ID NO: 61195 - RNA, 64 nt, Human
caagcaccuccagcggugaugagcuccacacccccacacccauugcagcuguggcgccacgucc

SEQ ID NO: 61196 - RNA, 64 nt, Human
acacacagugcuuuaagaaagggccaggugauaucacacccaaauuucacaagcacugaccccc

SEQ ID NO: 61197 - RNA, 64 nt, Human
uguccccaaaugcaaacacaggcacacacaugcacacacccauaaacacacacacagugcuuua

SEQ ID NO: 61198 - RNA, 64 nt, Human
ucugugaguuacgggcaaccagccucuucagccucacacccauuccccugagagcaagaagccu

SEQ ID NO: 61199 - RNA, 64 nt, Human
uuuuaguuuuaaugaaagcaugcaacagggaucucacacccauguuacuugccauuuaguuauu

SEQ ID NO: 61200 - RNA, 64 nt, Human
auaaacagaagcuguuugcucauguucugugccccacacccaccaauaccuaaaucuguuaagg

SEQ ID NO: 61201 - RNA, 64 nt, Human
gaagaugguuugaaauuuuuguaaucgaguaaggcacacccaaauguaaaaauccuuuugaaug

SEQ ID NO: 61202 - RNA, 64 nt, Human
uugugcccacacugagccagcaaguccugcuguccacacccacaagcuaccuggagggacagga

SEQ ID NO: 61203 - RNA, 64 nt, Human
ugauuuaucagcuaauuuagguagaacagggaagcacacccaaagaauuuucaaaggaaagggu

SEQ ID NO: 61204 - RNA, 64 nt, Human
cuccuuaguagcugggaccacagacaucugucaccacacccagcuaacuuuuuguauuuuuggu

SEQ ID NO: 61205 - RNA, 64 nt, Human
uguuuaggaagacuggcuggaaacuuauuuuaaucacacccaugacaaacucuccagaucuguu

SEQ ID NO: 61206 - RNA, 64 nt, Human
ggcuccgaaucuaagugcugcccacucccaugcucacacccacagaaggucuucccauccccuu

SEQ ID NO: 61207 - RNA, 64 nt, Human
ggugcuauuccaucgcagggugcucacacacccccacacccacccacccacacacaacacuggg

SEQ ID NO: 61208 - RNA, 64 nt, Human
cuccugaguagcugggaccacaggcgacugccaccacacccagcuaauuuuuuguauuuuuagu

SEQ ID NO: 61209 - RNA, 64 nt, Human
agaggccuagggagguuuuagggcccuccccacccacacccacaggucgauuuggucucuuuuu

SEQ ID NO: 61210 - RNA, 64 nt, Human
ugaagccaagaaaggugggccucgaccugugacucacacccaguggacagugcugagcacgggg

SEQ ID NO: 61211 - RNA, 64 nt, Human
cauguuuagaguggauagaaaauuaugcagcuugcacacccaucgucuuuaaccccaaauuucc

SEQ ID NO: 61212 - RNA, 64 nt, Human
gcagacacacugggcauggaccccucaaagcaggcacacccaaaacacaagucuguggcuagaa

SEQ ID NO: 61213 - RNA, 64 nt, Human
gcaggucuugccagugaaccccuggacaacugaccacacccacaaggcauccaaagucuguugg

SEQ ID NO: 61214 - RNA, 64 nt, Human
aaauggcugaagugcaugggucagggugugaggccacacccagaguagccaugaggaggcagag

SEQ ID NO: 61215 - RNA, 64 nt, Human
acacuacaucaucaucaucucaugcccaccugcccacacccagcagagcuucucagugggcaca

SEQ ID NO: 61216 - RNA, 64 nt, Human
cucccaaguagcugggacuacagguguacgccaccacacccagcuaauuuuuguauuuuuagua

SEQ ID NO: 61217 - RNA, 64 nt, Human
cucccaaagugcuggaauuacaggcaugagccaccacacccacacaagacuaucauuuuuaaug

SEQ ID NO: 61218 - RNA, 64 nt, Human
cucccgaguagcugggauuacaggcaugcgcuaacacacccagcuaauuuuguauuuuuaguag

SEQ ID NO: 61219 - RNA, 64 nt, Human
gcacugugccagggcuggggccuucugcugcugccacacccagcucaggccugggccagccccu

SEQ ID NO: 61220 - RNA, 64 nt, Human
gggaaggcuggugccccaugccccauuacaggcucacacccagucugaucaggcugaguuuugu

SEQ ID NO: 61221 - RNA, 64 nt, Human
agccccucagggcuucccaaggauguccagcccccacacccacacguuaacauaaugagucacu

SEQ ID NO: 61222 - RNA, 64 nt, Human
cuccugaguagcugagaccacaggcacccgccaccacacccagcuauuuuuuuguauuuuuagu

SEQ ID NO: 61223 - RNA, 64 nt, Human
aaaaaaucucucagagcccucaacuauucuguuccacacccaaugcugcuccacccucccccag

SEQ ID NO: 61224 - RNA, 64 nt, Human
ggagggggcuuccccuuucagcugcccggccccccacacccacagcuugcucuucuaucuccac

SEQ ID NO: 61225 - RNA, 64 nt, Human
caauguuuccauuaaguagagacucagcuguugucacacccaaagggaugcucugccaaagguu

SEQ ID NO: 61226 - RNA, 64 nt, Human
ccagcaacccuaaugcuggaaaggugcuccugcccacacccagcauggacccaguguguucucc

SEQ ID NO: 61227 - RNA, 64 nt, Human
gucccauaaugaaaugcuguauugccauaguggucacacccaagugguccaguaucucaauggu

SEQ ID NO: 61228 - RNA, 64 nt, Human
aggcuuccucuucagcaugccccccucuucaccccacacccauguguacacucagaguccugcu

SEQ ID NO: 61229 - RNA, 64 nt, Human
gccuccugaguagcuagguacaggcaccugccaccacacccagcuaauuuuuuguauuuuuagu

SEQ ID NO: 61230 - RNA, 64 nt, Human
acaagggcggaggcaccccgaagaaugaaaaguacacacccauggaauucaaggugggagccuu

SEQ ID NO: 61231 - RNA, 64 nt, Human
cuccugaguagcugggacuacaggugccugccaccacacccagcuaauuuuuuuuguauuuuua

SEQ ID NO: 61232 - RNA, 64 nt, Human
uuauucaaaaauaaauaauacacucacauguuuccacacccaaaagauauauagagugaaaagu

SEQ ID NO: 61233 - RNA, 64 nt, Human
cuccugaguagcugggauuauaggcaugcaccaccacacccagcuauuuuuuguauuuuuacug

SEQ ID NO: 61234 - RNA, 64 nt, Human
uuuaucuucugugaggugggauuuuuguguuccucacacccauguaauuauucuuagaauugag

SEQ ID NO: 61235 - RNA, 64 nt, Human
uaguaugggaaaaauaagaugacugggaaaaagacacacccacaccguagaacauauauuaauc

SEQ ID NO: 61236 - RNA, 64 nt, Human
cucccaaagugcugggauuacaggcaugagccaccacacccagccccuuuccaaccauuucuaa

SEQ ID NO: 61237 - RNA, 64 nt, Human
cucccggggagcugggaccacaggcacgugccaccacacccagcucucuuucuugguuuuucau

SEQ ID NO: 61238 - RNA, 64 nt, Human
agaucaaacaugcauggauggguccucacgcagacacacccacagaaggacacuagccugugca

SEQ ID NO: 61239 - RNA, 64 nt, Human
gacucacucagaacugucgcucaccuguggcugacacacccagcccuggaaacggggccccaga

SEQ ID NO: 61240 - RNA, 64 nt, Human
acauacaaggacaugcugccugaacauacacacgcacacccaugcgcagaugugcugccuggac

SEQ ID NO: 61241 - RNA, 64 nt, Human
cacgggacaucacagggugggccucggccccucccacacccaaagcugagccugcagggaagcc

SEQ ID NO: 61242 - RNA, 64 nt, Human
gagcauccagaaacuuccagaccagcccucucaccacacccagaagaggccuuucccaucugga

SEQ ID NO: 61243 - RNA, 64 nt, Human
uucuucuguucugcagacacgccuuccccucagccacacccaggcacuuaagcacaagcagagu

SEQ ID NO: 61244 - RNA, 64 nt, Human
cucccgaguagcugggauuacaggcgugcacuaccacacccagcugauuuuuguauuuuuagua

SEQ ID NO: 61245 - RNA, 64 nt, Human
ucucuucucugauccuucuuccuuaauucacucccacacccaagaagaaaugcuuuccaaaacc

SEQ ID NO: 61246 - RNA, 64 nt, Human
ugcacgagggucucuguguuuccagaaggccccacacacccaagugccccucacaccucgugcc

SEQ ID NO: 61247 - RNA, 64 nt, Human
aggacugucagacgcacacgcgcacgcaccuagacacacccacucauguacaugcucacacaug

SEQ ID NO: 61248 - RNA, 64 nt, Human
ggaagcgccugggagucccggaaggaggagagcgcacacccaggcagcccucugcggaaacuuu

SEQ ID NO: 61249 - RNA, 64 nt, Human
uggugauaacguauagaauaacagacggggacuccacacccaggccuuuuuuaacggugugaag

SEQ ID NO: 61250 - RNA, 64 nt, Human
gaagaacuuugccuuaaguuucccuguguuguuccacacccagaaggacccaagaaaaccuguu

SEQ ID NO: 61251 - RNA, 64 nt, Human
cccccucagaccaggcccuugucugugcccuguccacacccaggagccauccucagugucugug

SEQ ID NO: 61252 - RNA, 64 nt, Human
uuucaugagucagcccccccgcccgcccccaccccacacccacauccucucuuuuccacacaca

SEQ ID NO: 61253 - RNA, 64 nt, Human
cugcuucauugaccuaagucacucucuucaaucccacacccauggacauucuugucaacucaau

SEQ ID NO: 61254 - RNA, 64 nt, Human
cucucgaguagcugggauuacaggcaugcaccaccacacccagcuaauuuuguauuuuuaguag

SEQ ID NO: 61255 - RNA, 64 nt, Human
gauaagaucuauagccucugcagcggaaucuguucacacccaacuugguuuugcuacauaauua

SEQ ID NO: 61256 - RNA, 64 nt, Human
cuccugaguagcuggaauuacaggcacccaccaccacacccagcucauuuuuguauuuuuagua

SEQ ID NO: 61257 - RNA, 64 nt, Human
cuccuggguagcugggauuacaggcacgcgcugccacacccagguaauuuauuuauuuuuuuuu

SEQ ID NO: 61258 - RNA, 64 nt, Human
agcucucucuacagagaggaaauucuccacugugcacacccaccuuuggaaagcucugaccacu

SEQ ID NO: 61259 - RNA, 64 nt, Human
uuuagcaacaaaguauagaaacauguucauugcacacacccaaggagaagagcucaagcgcuug

SEQ ID NO: 61260 - RNA, 64 nt, Human
cucccaaguagcugggacuacaggcaugagccaucacacccagcuaguuuuuuguauuuuuagu

SEQ ID NO: 61261 - RNA, 64 nt, Human
uuucuacagugaggaacaggcguuucccaggccccacacccagauuucucuaucuuugcugugu

SEQ ID NO: 61262 - RNA, 64 nt, Human
cagagcccauccaggacacuccacacugccaggacacacccaggcggcccgcccuugccugucu

SEQ ID NO: 61263 - RNA, 64 nt, Human
agagcccagcauccaucucugucaucaucuucaucacacccaaagaagagccagccuugcagga

SEQ ID NO: 61264 - RNA, 64 nt, Human
ccgggcucuacgucccagggagggaggggcggcccacacccaggcccgcaccgcugggagucug

SEQ ID NO: 61265 - RNA, 64 nt, Human
cacccaaauagcuggaacuacaggcauauaccgccacacccagcuaauuuuauuuuuugaaaag

SEQ ID NO: 61266 - RNA, 64 nt, Human
cugggauacugggccuugguaaagcagaggagggcacacccacaguccucuuauucucuguuuu

SEQ ID NO: 61267 - RNA, 64 nt, Human
aguccccagcaccugcuacagugagcugccauuccacacccaucacauguggcacucuugccag

SEQ ID NO: 61268 - RNA, 64 nt, Human
gggaaauuuggaaacgggacauacacaaaaguuacacacccacauucccuuuuuaucaugacau

SEQ ID NO: 61269 - RNA, 64 nt, Human
cccccaaguagcugggauuacaagugugcgccaccacacccagcuaauuuuuuauuuuuaguag

SEQ ID NO: 61270 - RNA, 64 nt, Human
uguacagaaagacuguaugugugugccuugcacacacacccauaccucucagaaaaaguguuug

SEQ ID NO: 61271 - RNA, 64 nt, Human
cagaaauaaccagugagaggggcaguucucuggccacacccacuuauguacuuuaacuacugug

SEQ ID NO: 61272 - RNA, 64 nt, Human
agcuggacuuccccagggcccucuuccccuccaccacacccagguggacuugcagcccacaagg

SEQ ID NO: 61273 - RNA, 61 nt, Human
gaaaacauucaucaaagugacauccucaggacacacccauguggcuccuggacaauccaag

SEQ ID NO: 61274 - RNA, 64 nt, Human
aguguccauaaacaaaauguuauuagagcauagccacacccauucauuuaugguauugucuggg

SEQ ID NO: 61275 - RNA, 64 nt, Human
gucacguaagagaacaucuuccagcugccuuuuucacacccacuccagcccucugccccaguuu

SEQ ID NO: 61276 - RNA, 64 nt, Human
cucauuuccacccaaccccaggauuuccacagcacacacccacaggccuggaccugggaugaag

SEQ ID NO: 61277 - RNA, 64 nt, Human
ccucccgaguacugggaauauaggugcacgccaccacacccaacaaauuuuuguacuuuuagua

SEQ ID NO: 61278 - RNA, 64 nt, Human
gucacacaagagaacaucuuccagcugccucuuucacacccacuacagaccucagccccaguuu

SEQ ID NO: 61279 - RNA, 64 nt, Human
acugugaggcucuucuaacacccucagucagugacacacccaucccauccaccacuucccccgu

SEQ ID NO: 61280 - RNA, 64 nt, Human
cucccgaauagcugggauuacagacaggcaccaccacacccagcuaauuuuuguauuuuuugua

SEQ ID NO: 61281 - RNA, 64 nt, Human
ccccggccaggaaccacuccuguuguacaaagcucacacccaccgcccaggucuuaacuuucug

SEQ ID NO: 61282 - RNA, 64 nt, Human
cucccaaguagcugggacuacaggcauaugccaucacacccagcuaauuuuuguuuuucuguag

SEQ ID NO: 61283 - RNA, 64 nt, Human
gagcccaggggaaggccaggcuggaccccggcuccacacccacauccagccugcaggccucucu

SEQ ID NO: 61284 - RNA, 64 nt, Human
uucuuuuaccugugccaccagcucuggagacauccacacccauucccagguguccuuccaggcc

SEQ ID NO: 61285 - RNA, 64 nt, Human
gcauccugaagcaguaggaccauuagugugcgugcacacccacguggcacacuguguggugacc

SEQ ID NO: 61286 - RNA, 64 nt, Human
uguuuuuagagaacacuucuaaggcgagccacuccacacccaggggaguuaaagcacaugaaaa

SEQ ID NO: 61287 - RNA, 64 nt, Human
cuggauaugcaacuagugcucagaccaaagaguucacacccacucuaaaaccauguccucugaa

SEQ ID NO: 61288 - RNA, 64 nt, Human
agaggcuagcacugaauucauucuacucauacuacacacccaguuauggaauguccagaguucu

SEQ ID NO: 61289 - RNA, 64 nt, Human
cuauuuuuuuuuugccacuuuaugauuauguggucacacccaagucacagaaauaaaaaacuga

SEQ ID NO: 61290 - RNA, 64 nt, Human
ugacaacgugaccacaccacacaugccuccaacacacacccacagucuaaacaucucuccuucu

SEQ ID NO: 61291 - RNA, 64 nt, Human
cucagugagcccuucucccauuccagaucaucagcacacccacacccaccauaggucucucucc

SEQ ID NO: 61292 - RNA, 64 nt, Human
gagcccuucucccauuccagaucaucagcacacccacacccaccauaggucucucuccuccggu

SEQ ID NO: 61293 - RNA, 64 nt, Human
cucccaaguagcugagacuacaagcacccaccaucacacccagcuaauuuuguauuuuucagua

SEQ ID NO: 61294 - RNA, 64 nt, Human
gcccaguacaacaaaggugacggguguguagguacacacccagagauggagcacugcagaucag

SEQ ID NO: 61295 - RNA, 64 nt, Human
cuccggaguagcugggauuacaggcacaugccaccacacccagugaauuuuuguauuuuuagua

SEQ ID NO: 61296 - RNA, 64 nt, Human
ccgugacccuguggaaggugcgucgggccagggccacacccaagggcccagcugucuugccugc

SEQ ID NO: 61297 - RNA, 64 nt, Human
gacagacagacagacagacagacagacacgcacacacacccaucucugucuagcaagcagccuc

SEQ ID NO: 61298 - RNA, 64 nt, Human
auguaaaccaaaagauggaagacaaaaagacaaacacacccacacgcagucuuugcaguaucug

SEQ ID NO: 61299 - RNA, 64 nt, Human
augcacuauauacaucacguuaaaguaggacuaucacacccagcccauguggcuaaaaaagcug

SEQ ID NO: 61300 - RNA, 64 nt, Human
cucccuaguagcugggacuacagggauguaccaccacacccagcuaaucuucaucuaaucuuaa

SEQ ID NO: 61301 - RNA, 64 nt, Human
guuuaucugagucuguugguaccccaaaugaccccacacccaucuuaaaguacuuuuuuucacc

SEQ ID NO: 61302 - RNA, 64 nt, Human
uggcguuuucuggaggguagauuguguuuguuggcacacccaccuuuucuguucccuagcaucu

SEQ ID NO: 61303 - RNA, 64 nt, Human
cucccgaguagcugggauuacaggugcucaccaccacacccagcuaauuuuuguauuuuuagua

SEQ ID NO: 61304 - RNA, 64 nt, Human
acgcugaaaagaaucagcauuuagucuugccaggcacacccaauaaucagucauguguaauaug

SEQ ID NO: 61305 - RNA, 64 nt, Human
agugaugccagcugggcacgucaggaccuccccacacacccacacgaugccacaggucaggggg

SEQ ID NO: 61306 - RNA, 64 nt, Human
uauuugcaguaugcuauaaaugauaccccccuaccacacccacacacacaguuuuugucuaaug

SEQ ID NO: 61307 - RNA, 64 nt, Human
cucccgaguagcugggacuacaggagcucgccaccacacccagcuaauuuuuuuuuuuuuuuuu

SEQ ID NO: 61308 - RNA, 64 nt, Human
gaguggggagaguugugauggaggggagaggggucacacccacccccugccugguucuaggcug

SEQ ID NO: 61309 - RNA, 64 nt, Human
ugcugccuaggguugcuugggccacugcccucuccacacccaugacugccccuugcuucucaac

SEQ ID NO: 61310 - RNA, 64 nt, Human
uuaaagccaccucucugucuccaccccaugggcccacacccaggugggggaggaggaagccacu

SEQ ID NO: 61311 - RNA, 64 nt, Human
ugaggcuccacuucuguugaauaugagcggcugucacacccaugagcaaguuuccuugauggaa

SEQ ID NO: 61312 - RNA, 64 nt, Human
ccuguuuacucguaccaaaaaugaagacaagccccacacccaccucagcccuugcuuggccaug

SEQ ID NO: 61313 - RNA, 64 nt, Human
cugcaaacguuccuacagccuagaggugcguauacacacccaaguacacgcagccaggcauuca

SEQ ID NO: 61314 - RNA, 64 nt, Human
cugcagagcgggggaggucugcacccuggggaaccacacccaaggcugcuuuccaggugaaccu

SEQ ID NO: 61315 - RNA, 64 nt, Human
cucccaaauagcugggauuacaggugcaugccaccacacccagcuaauuuuuguauuuuuagua

SEQ ID NO: 61316 - RNA, 64 nt, Human
uuaaaucaagccugaggcuggugaacaguagcuacacacccauauuguguguucugugaaugcu

SEQ ID NO: 61317 - RNA, 64 nt, Human
cauuacacacacacacacacacacacaaaugugccacacccagacacgcacagaaucagacacu

SEQ ID NO: 61318 - RNA, 64 nt, Human
gacaaagccucugaaagaugcaucaucucuuccucacacccauuuagugggggauggguccucu

SEQ ID NO: 61319 - RNA, 64 nt, Human
uaaagguagaauaauggaagcccugucuguuugccacacccaggugauuuccucuaaagaaacu

SEQ ID NO: 61320 - RNA, 64 nt, Human
gccugaucucuaaccccgucaugcugcugcugaccacacccagccaaccugccccucccugacc

SEQ ID NO: 61321 - RNA, 64 nt, Human
ggcaguuugggggcgguagagggaaacugaggcgcacacccaugcagccccugauguucuguuc

SEQ ID NO: 61322 - RNA, 64 nt, Human
uaaaaugaaccugcuacuuaaaaaaaauacacaucacacccauuuaaaagugaucuugagaacc

SEQ ID NO: 61323 - RNA, 64 nt, Human
ggaacaccuagcuaacaggagagaggaaugaaaacacacccacgccuuggaaccguccuuuggu

SEQ ID NO: 61324 - RNA, 64 nt, Human
uuccugacuagcugggacuacuggugugcaccaccacacccagcuaauuuucaauuuuucauag

SEQ ID NO: 61325 - RNA, 64 nt, Human
aggggacugggacuggcggugagguuuugauacccacacccagccaucuggagucauggagacc

SEQ ID NO: 61326 - RNA, 64 nt, Human
cagccucacaggccaaagcaucagcaccagaacgcacacccagcccagccccaaagagaaagaa

SEQ ID NO: 61327 - RNA, 64 nt, Human; identical to SEQ ID NO: 61326

SEQ ID NO: 61328 - RNA, 64 nt, Human
gaaugugauuuuuggccuuguggcagcacauccucacacccaaagaaguuuguaaauguuccag

SEQ ID NO: 61329 - RNA, 58 nt, Human
auaucagagaguccacgugaaagagccacacacccauuuuccucacuuucccugaguc

SEQ ID NO: 61330 - RNA, 64 nt, Human
cugcugaguagcugguauacaggcacaucgccgccacacccagcucauuuuuguauuaguggag

SEQ ID NO: 61331 - RNA, 64 nt, Human
cucccagguagcugggacuacaggcgugcaccaccacacccagcuaauuuuuaaguuuuuuuuu

SEQ ID NO: 61332 - RNA, 64 nt, Human
cacgaauaaagaacucagaguugugugugcaaugcacacccagacacacgcacgcacacacacg

SEQ ID NO: 61333 - RNA, 64 nt, Human
uugcucauccacuucccuacacaucuauggguaucacacccaagacuacccaccaagcucauac

SEQ ID NO: 61334 - RNA, 64 nt, Human
acccaagacuacccaccaagcucauacagggaaccacacccaacacuuagacaugcgaacaagc

SEQ ID NO: 61335 - RNA, 64 nt, Human
cagagaugauacccaccacacaccugggggcccccacacccaguccucacccuuaacuucugcc

SEQ ID NO: 61336 - RNA, 64 nt, Human
cugccucagacguugccugagaagaaguggcugccacacccaggggaaggcccugaggcggagg

SEQ ID NO: 61337 - RNA, 64 nt, Human
gcaacagacggugguccucuugguaaguguggcccacacccagccugguggacauggaaaggcu

SEQ ID NO: 61338 - RNA, 64 nt, Human
caugugcagucccuguccccccccgccaguccuccacacccaaacuguuucugauuggcuuuua

SEQ ID NO: 61339 - RNA, 64 nt, Human
uauagacacacacacauaugcacacacacacacacacacccacagagagagagcugcaagagca

SEQ ID NO: 61340 - RNA, 64 nt, Human
ggacagacaccguggacagcgcuguauuuacagacacacccagugcgugaagaccaacaaaguc

SEQ ID NO: 61341 - RNA, 64 nt, Human
uguaaaauauguuuugcuuaauguggacaauuuacacacccaacacauacuguuuccaaaauua

SEQ ID NO: 61342 - RNA, 64 nt, Human
gccgggaagcaaaccgugcccugguauugucagacacacccaggcuugauuuggauccacaggc

SEQ ID NO: 61343 - RNA, 64 nt, Human
gugcccaucuguguuuaguacacaugcaugcauacacacccauacaaacaucugugugagggca

SEQ ID NO: 61344 - RNA, 64 nt, Human
ccucccuaguagcugggacuacagcacccaccaccacacccagcuaauuuuuguauuuuuagua

SEQ ID NO: 61345 - RNA, 64 nt, Human
uugaugccaucaaaccuugacaccgggugcucugcacacccacgcggauguugcaccucauucu

SEQ ID NO: 61346 - RNA, 64 nt, Human
caccccagcgccugggcccgccccacgcucuguccacacccacgcgccccgggagcggggccau

SEQ ID NO: 61347 - RNA, 64 nt, Human
caccgaaggcuaaaagcucucuuggccacuccugcacacccaggaccuugauguugcuugccac

SEQ ID NO: 61348 - RNA, 64 nt, Human
acugagaccuguguguacaguaggaccaugcacucacacccaucuggagagggagcccccggua

SEQ ID NO: 61349 - RNA, 64 nt, Human
auguagacaauaauuaacacagaggacuuucccccacacccagaucacaaacagccuacagcca

SEQ ID NO: 61350 - RNA, 64 nt, Human
acacagagucuuauagcaaaggcauugaaagacacacacccaggcaaccccugaggcugugggg

SEQ ID NO: 61351 - RNA, 64 nt, Human
gccagcguggacagcaggugaggcaggugcuccucacacccagaccugggcaucuucauugagg

SEQ ID NO: 61352 - RNA, 64 nt, Human
cuggaccugccugacaggccacaggagcagacagcacacccaagcccgggccuccggcacacuc

SEQ ID NO: 61353 - RNA, 64 nt, Human
guggugcccagggugcccugccucaggacauguccacacccacgucacaagcaccugaggaguc

SEQ ID NO: 61354 - RNA, 64 nt, Human
aucuguauagaaaaucaagucaaucccccauccucacacccacucaucucugaggagcuaugaa

SEQ ID NO: 61355 - RNA, 64 nt, Human
cccagacccaccagacaccacacagcagacaauacacacccacucgcacaagcuuccauccaca

SEQ ID NO: 61356 - RNA, 64 nt, Human
ugguggcccacaccuaucuucucaccuuggaggccacacccaacuuuccaaagacccugagaca

SEQ ID NO: 61357 - RNA, 64 nt, Human
ggccuggcagcucagcuuccccaacacgcaggagcacacccagcccccacauccugugccucca

SEQ ID NO: 61358 - RNA, 64 nt, Human
uggcucagcagcccccucccgggcagcuucaccccacacccaggggccaggcucucccgggguc

SEQ ID NO: 61359 - RNA, 64 nt, Human
aaaaaucaccaccuuuaauacuccccggccugcacacacccacagucucacugggcuccacccu

SEQ ID NO: 61360 - RNA, 64 nt, Human
caggcaggggggcagguacacacacacccacaggcacacccaccaguacacacgcgugcgcaua

SEQ ID NO: 61361 - RNA, 64 nt, Human
gggagcaucuggcaggcaggggggcagguacacacacacccacaggcacacccaccaguacaca

SEQ ID NO: 61362 - RNA, 64 nt, Human
gaagcgaggcggaugcccuggaagcacccagcaucacacccaggcuugugcggggccaggcugg

SEQ ID NO: 61363 - RNA, 64 nt, Human
guguguucagggacugagccuggggacgcccacccacacccacugcuuccucucggcgcacccc

SEQ ID NO: 61364 - RNA, 64 nt, Human
ggaccccuccacaugcaccugcuaguggggaggccacacccacaagcgcugcgucguggaaguc

SEQ ID NO: 61365 - RNA, 64 nt, Human
cuccuagccgcagcagcgcaggccccgaccagggcacacccaccggcccggccuccugccaccc

SEQ ID NO: 61366 - RNA, 64 nt, Human
gccugggggcuucugcugggccagcccggccucccacacccacuuggagggugagacugcagug

SEQ ID NO: 61367 - RNA, 64 nt, Human
uucuacacagagcaggacugcacagcguccuguccacacccagcucagcauuuccacaccaagc

SEQ ID NO: 61368 - RNA, 64 nt, Human
gggcaccgccuggucccaagugucccucuguacccacacccacccacucacuuguaagcuccuu

SEQ ID NO: 61369 - RNA, 64 nt, Human
aaauguuaaucuccuuuggcaacacccucacagacacacccaggaucaauacguuguauccuuu

SEQ ID NO: 61370 - RNA, 64 nt, Human
gaacaggacagugcccgguccccuugagggccaucacacccagacccaacggguugcagccucc

SEQ ID NO: 61371 - RNA, 64 nt, Human
cucccaaguagcugggauuacaggcacccgccaccacacccagcuaauuuuuuguauauuuagu

SEQ ID NO: 61372 - RNA, 64 nt, Human
augaucacaggugauucacacguacacacauaaacacacccaccagugcagccugaaguaacuc

SEQ ID NO: 61373 - RNA, 64 nt, Human
uccccuuccuccaaaacccucccucccaccuccccacacccauugagucauucacaggcaggag

SEQ ID NO: 61374 - RNA, 64 nt, Human
aucauauuugcaacucuucucucucuuucuuccccacacccaagaggaggauuggugguagggg

SEQ ID NO: 61375 - RNA, 64 nt, Human
accuugcacugcacaaccuuccuucugcuucucccacacccaguauuugcagaagggcaaagcu

SEQ ID NO: 61376 - RNA, 64 nt, Human
cucugaaauugcugggauuacaggcaugagccaccacacccagcccggacagcuucuuugggag

SEQ ID NO: 61377 - RNA, 64 nt, Human
acauaagaucacugccagagauaaacuaaugguccacacccaauuccacucugauagaauuauu

SEQ ID NO: 61378 - RNA, 64 nt, Human
auaaaagagaagccaaacagcaagaagcuguuaccacacccagggcuaugaggauaaugggaag

SEQ ID NO: 61379 - RNA, 64 nt, Human
cuuuccagaucgcuggccccagaacccugucccccacacccaggggcacaugcacuguugaguu

SEQ ID NO: 61380 - RNA, 64 nt, Human
ccaaggaaguuguguaaaugugcacgcgcuacaccacacccaggguggaaaccacaguugcaga

SEQ ID NO: 61381 - RNA, 64 nt, Human
auauuuggaauacagccuuagaacgguuucuguacacacccacgugcacuucacgggugaucag

SEQ ID NO: 61382 - RNA, 64 nt, Human
cuuggggaguagagggaaggagcaggccgcgugucacacccaucauuguauguuauuucccaca

SEQ ID NO: 61383 - RNA, 64 nt, Human
cccaggaguagcugggacuacaggugcccaccaccacacccagcuaauuuuuuuguauuuuuag

SEQ ID NO: 61384 - RNA, 64 nt, Human
ccugaguagccggggagcuacaagcaugcaccaccacacccagcuaauuuuuuuuuuuuuuuug

SEQ ID NO: 61385 - RNA, 64 nt, Human
aagugcuuuauaaauugaguggacugauauauaucacacccagguaucacugugcuguccuuug

SEQ ID NO: 61386 - RNA, 64 nt, Human
acgugaguuagaugagggagaguuuguguaacuccacacccaggaggguaagccacuuuauuau

SEQ ID NO: 61387 - RNA, 64 nt, Human
aagaaauccccaagaucaucugggucucccucuccacacccagaacugaggcuuggauaucuuc

SEQ ID NO: 61388 - RNA, 64 nt, Human
ucccuccaggcuugggcagggagacucgcagaugcacacccacaaguauucaguucucaaacuc

SEQ ID NO: 61389 - RNA, 64 nt, Human
cccuggacuuucacuaacccucugacauacuccccacacccaguugauggcuuuccguaauaaa

SEQ ID NO: 61390 - RNA, 64 nt, Human
cuccugagcagcugggauuacaggcaaacgccaccacacccagcuaaauuuuuuuuuuuuuuuu

SEQ ID NO: 61391 - RNA, 64 nt, Human
cugcucaccacccugucacagccacucccaagcccacacccacaggggcucacugccccacacc

SEQ ID NO: 61392 - RNA, 52 nt, Human
ugauacagaagaucagcuaagacacacccagcccagauucaacaggaaaccg

SEQ ID NO: 61393 - RNA, 64 nt, Human
ucuucagaggagcuggaacugucuaccccagggacacacccauuucguugcuacccaaguggau

SEQ ID NO: 61394 - RNA, 64 nt, Human
cucgauuaucugcucucucuuuuauauacauacacacacccaaacauaacauuuauaauagugu

SEQ ID NO: 61395 - RNA, 64 nt, Human
ccggugugggaaccagcaccucccaccaaccagccacacccagugggggcacagcacagacccc

SEQ ID NO: 61396 - RNA, 64 nt, Human
gcaggaggccccuggcccagcggccccucccacacacacccacacacucgcccgcccacugucc

SEQ ID NO: 61397 - RNA, 64 nt, Human
gugagucauuggcuggguucugauugcuagaugucacacccaccagcaucaccaaagugacucu

SEQ ID NO: 61398 - RNA, 64 nt, Human
uguggcuuguucuagcguguauuaaaacuugacacacacccacacacaaaaacaaaaacaccac

SEQ ID NO: 61399 - RNA, 64 nt, Human
uccugucguucaauggacguggugguggcuguuccacacccauuuuguugcaguuccugugaga

SEQ ID NO: 61400 - RNA, 63 nt, Human
ccuaccgaugacaauguguaaauaaaugcguguucacacccacagcuggcuccguuacucucc

SEQ ID NO: 61401 - RNA, 64 nt, Human
gcccacaccagccuggaccuggguuauuuauugacacacccaaggggcccgaggggcugcgugu

SEQ ID NO: 61402 - RNA, 64 nt, Human
cuuuuucaaccugucaguauccccuucugcuuaacacacccacugagaaaacccuguuuguagu

SEQ ID NO: 61403 - RNA, 64 nt, Human
ggagcacccaggcagacccaguccugguugggaucacacccacgggugcuacugcacguaacac

SEQ ID NO: 61404 - RNA, 64 nt, Human
cuccauuccauaaaucucuuccugugugagccaccacacccagccugggucucucuacuuuuaa

SEQ ID NO: 61405 - RNA, 64 nt, Human
gauauauuauauauacaaauaucaaacaucucaccacacccaccccaaaaguuacacugugugu

SEQ ID NO: 61406 - RNA, 64 nt, Human
ggguguuccuucgagccccuuccacucagagggccacacccagcgaugccagugaagguggcac

SEQ ID NO: 61407 - RNA, 64 nt, Human
auaagcucccacauagauacauguaaaacauauucacacccaugcacgcacacacauacacacu

SEQ ID NO: 61408 - RNA, 64 nt, Human
uagaaaugagacaaucaaagcccccccaggguggcacacccaucuguuugcugggguguggcag

SEQ ID NO: 61409 - RNA, 64 nt, Human
aguguauuaccuuccuucccuccucuucuccccccacacccaacaaaauacaguuuggaauuca

SEQ ID NO: 61410 - RNA, 64 nt, Human
cuggggaagauggagcaggucuuugggaagcucccacacccaccucugccacucuuaacacuaa

SEQ ID NO: 61411 - RNA, 64 nt, Human
ccuccccuccccuggggacgccaaggaggugggccacacccaggaagggaaagcgggcagcccc

SEQ ID NO: 61412 - RNA, 55 nt, Human
aagagacagcagccagcuaaucucccacacccacggcugcauaccugcacuuuca

SEQ ID NO: 61413 - RNA, 64 nt, Human
cucccaaguagcugagacuacaggcacgagccaccacacccagcuaauuuuuaaguuuucuugu

SEQ ID NO: 61414 - RNA, 64 nt, Human
gauaaauuuucccaacaauuaaaucuugccuuuacacacccaaacuuuguaauuuuagucuugg

SEQ ID NO: 61415 - RNA, 64 nt, Human
ugagacagcaagaguguucuuaaucagauggaaccacacccaaaauggacccccacuaccuucc

SEQ ID NO: 61416 - RNA, 64 nt, Human
guggggagcacagaggcggagaggaaucccuuaccacacccacggcccagcuugcucacgagug

SEQ ID NO: 61417 - RNA, 64 nt, Human
uauucuuccuccaucuaucugauuccauuccuuccacacccagcuaaaguuagaggagauacau

SEQ ID NO: 61418 - RNA, 64 nt, Human
gacagauaaggaccguuccagaaaucccaacucucacacccagcccaggcugcagucuccacac

SEQ ID NO: 61419 - RNA, 64 nt, Human
cacaaacacacauguccuguugaacucaugcacgcacacccacgugccuguacuugcccccagg

SEQ ID NO: 61420 - RNA, 64 nt, Human
uguucaaaucugguuaaaagcauggacugugccacacacccagugauccauccaaaaacaagga

SEQ ID NO: 61421 - RNA, 64 nt, Human
caaauguguaaagaaggaagagcaagaacauggccacacccaccgccccacacgagaaauuugu

SEQ ID NO: 61422 - RNA, 64 nt, Human
auaaaaaccaccagcauauacauggacauacacacacacccacacacacaaacacacacacaca

SEQ ID NO: 61423 - RNA, 64 nt, Human
ggaaugcugacuuucucuuucuuucucuuguccccacacccauucccaacccaauacuggggcc

SEQ ID NO: 61424 - RNA, 64 nt, Human
aagaggugacuuugccacccccaaaggugucugccacacccaaguucccaggcccugaguuuua

SEQ ID NO: 61425 - RNA, 64 nt, Human
caugucaucccuugauaugucugcaugcaagguccacacccaaaagugucaauguuugcccccc

SEQ ID NO: 61426 - RNA, 64 nt, Human
cucccaaagugcugggguuacaggcaugagccaccacacccagccuucagcugucaccuuaaac

SEQ ID NO: 61427 - RNA, 64 nt, Human
agacaacuauaugguuaagaauuuccaguaugaccacacccaauaacuguuauuagaguguuaa

SEQ ID NO: 61428 - RNA, 64 nt, Human
acacaaaaagaugagucccaccccccacuaccaccacacccaucaaccagccacauucacgcua

SEQ ID NO: 61429 - RNA, 64 nt, Human
ucacacuucccugccugcagaggaugacucuguucacacccaauccagcgcgguucuaccccac

SEQ ID NO: 61430 - RNA, 64 nt, Human
ucuguacagcugcucuuacccauuuuuuuuaccucacacccaaagcauuuugccuaccuggguc

SEQ ID NO: 61431 - RNA, 64 nt, Human
cucccgaguagcugggauuacaggcaugggccaccacacccagcuaauuuuuuguguuuucuuu

SEQ ID NO: 61432 - RNA, 64 nt, Human
cucggugagcugugcagugccggccccagauccucacacccagggagcagcugcacaucgugaa

SEQ ID NO: 61433 - RNA, 64 nt, Human
cucgucuacaucgaccuccguuuguacauuccaucacacccagcaauagcuguacauuguaguc

SEQ ID NO: 61434 - RNA, 64 nt, Human
cgcaccgccugaaggcacagcuaaccacuucgcacacacccauguaaccacugcacuuuccaau

SEQ ID NO: 61435 - RNA, 64 nt, Human
uucagcauguuggucagagacacggucacugauucacacccagucccugccacagaccgucuca

SEQ ID NO: 61436 - RNA, 64 nt, Human
ucucagacacgcacagugggccugcugcaugauucacacccagucccugccacagaccgucuca

SEQ ID NO: 61437 - RNA, 64 nt, Human; identical to SEQ ID NO: 61436

SEQ ID NO: 61438 - RNA, 64 nt, Human
uccuacauagucagaacuuacacauuacuagaggcacacccaccaaggaguauugugucuacuu

SEQ ID NO: 61439 - RNA, 64 nt, Human
ugcugguauuccacguauuccugcauuaauauugcacacccaaaccagucuaucagggaggcug

SEQ ID NO: 61440 - RNA, 64 nt, Human
cuuguacauaggcaucuuauucacugcacccugucacacccagcaccccccgccccgcacauua

SEQ ID NO: 61441 - RNA, 64 nt, Human
aaagggacccugagaacuccucuuguaauuucaacacacccaaaaucaagggccuggaugccag

SEQ ID NO: 61442 - RNA, 64 nt, Human
cuccccauggggcagaguggucuccuuacgugcucacacccagucagcuugggucccuaucucu

SEQ ID NO: 61443 - RNA, 64 nt, Human
gagcaaaccgauggucagggagagggcuagagcucacacccagcucggaauagaucuucccuga

SEQ ID NO: 61444 - RNA, 64 nt, Human
cccgccauggucacccucaggaacccacccucuccacacccagccugucccacuggcuccuccc

SEQ ID NO: 61445 - RNA, 64 nt, Human
acguagcuccucaggccauuccccaugagucccccacacccaccccauccucggucuuugcaaa

SEQ ID NO: 61446 - RNA, 64 nt, Human
caguugaaaaauaaauaaauaaauaaauaaacaccacacccagcuaauuuuuguauuuuuagua

SEQ ID NO: 61447 - RNA, 64 nt, Human
agugaggaucuucauguaccugcucuucuguuugcacacccagcauagccuccuugcaggcaga

SEQ ID NO: 61448 - RNA, 64 nt, Human
accguccugccuaaccagaugcggucagccucuucacacccaccuggcuugcaucccccauccc

SEQ ID NO: 61449 - RNA, 64 nt, Human
cucccauguggcugggacuauaggugcaugccaccacacccagcuaauuaaaaaaauuuuuugu

SEQ ID NO: 61450 - RNA, 64 nt, Human
cucaguguguguuucucuuccccuucuuagucagcacacccaguccuuuauuuuauucuauucu

SEQ ID NO: 61451 - RNA, 64 nt, Human
cuccugaguagcugggauuauaggcacacaccaccacacccagcuaaucuuuuuguauuuuuuu

SEQ ID NO: 61452 - RNA, 64 nt, Human
cucccaaagugcugggauuacacgcgugagccaccacacccagccuccaucuuuaaacuuuuaa

SEQ ID NO: 61453 - RNA, 64 nt, Human
aaccccagguaaaaaagucucccucucuuccacucacacccauagcgggagagaccucaugcag

SEQ ID NO: 61454 - RNA, 64 nt, Human
cuucugucccucacagcacuaguauuucauguugcacacccacucagcuccgugaacuugugag

SEQ ID NO: 61455 - RNA, 64 nt, Human
cuccugaguagcugggacuacaggugugcaccaccacacccagccaaaacagccauccuccccu

SEQ ID NO: 61456 - RNA, 64 nt, Human
cugcuucuccuuguccugccuggaggcuccaggccacacccagcugguggggcugcuccagugc

SEQ ID NO: 61457 - RNA, 64 nt, Human
ccucuugcagaacuucacacgugauucuucaagccacacccaccugaaaucaaaccaaaggagu

SEQ ID NO: 61458 - RNA, 64 nt, Human
acucauaccuagagacgcugcuggggaaggucagcacacccaagaacuuugggagugugugucu

SEQ ID NO: 61459 - RNA, 64 nt, Human
accuuauugggcuuaacaauucacaaggcacuuucacacccauuaucuaauuuaauccucauaa

SEQ ID NO: 61460 - RNA, 64 nt, Human
gggaggagggagcgugaagguagugacuccugaacacacccagguggaaccaucuuuggggagg

SEQ ID NO: 61461 - RNA, 64 nt, Human
gcagaagacauggguuccaguucugguucugccacacacccaccggccuugaauuucucuggug

SEQ ID NO: 61462 - RNA, 64 nt, Human
uuaauggggguagcagcuggacuacccacguucucacacccaccguccgcccugcuccucccug

SEQ ID NO: 61463 - RNA, 64 nt, Human
ucagccucccaacuagcugggacuacagguacaccacacccagcucauuuuuuuguauuuuuag

SEQ ID NO: 61464 - RNA, 64 nt, Human
cucacccaucccaccccuccauuggcucccaagucacacccacucccuuccccauagauaggcc

SEQ ID NO: 61465 - RNA, 64 nt, Human
cagaccccuagggauuuaaagggacaccccuacacacacccaggcccaugccaaggccucccuc

SEQ ID NO: 61466 - RNA, 64 nt, Human
gagaugggcggccccgccccagcgcagugccggccacacccaugcacugaagcuccucccugcc

SEQ ID NO: 61467 - RNA, 64 nt, Human
aaguggggacaucaggguagcugaaggaaauccacacacccagagcaucucggaguucagacuc

SEQ ID NO: 61468 - RNA, 64 nt, Human
acacauuucugcuaauagggagagggacccaccacacacccacacaugccagaggucccuccuc

SEQ ID NO: 61469 - RNA, 64 nt, Human
cugggcagcagcagccuuaccaguccuccaugaucacacccagggaccugcaugggugagggga

SEQ ID NO: 61470 - RNA, 64 nt, Human
cggggccuccccucccugcuaggaggcaacucgucacacccaagcugcuggccuccagucccau

SEQ ID NO: 61471 - RNA, 64 nt, Human
uacaugcccugcuuccacguggcugccacgcugacacacccacauucaccaaacccacccgcgc

SEQ ID NO: 61472 - RNA, 64 nt, Human
caggucuccauaaauugucuuugggggauuccaccacacccaaugcucuggagccacaaggagu

SEQ ID NO: 61473 - RNA, 64 nt, Human
cuccaaaagugcuggguuuacaggcaugagccaccacacccagcuccucccccucaaacuucug

SEQ ID NO: 61474 - RNA, 64 nt, Human
cugggcgagacccagcaguggacagcaugguccucacacccagcucccugcacacccaggccag

SEQ ID NO: 61475 - RNA, 64 nt, Human
aguggacagcaugguccucacacccagcucccugcacacccaggccagccaccccucccgcucg

SEQ ID NO: 61476 - RNA, 64 nt, Human
aacgcaacagaaugaucuaaacugcaaacauuuucacacccaccaugcugcuugaaagccacuu

SEQ ID NO: 61477 - RNA, 64 nt, Human
cucccaaagugcugggauuacaggugugaaccaccacacccagcccacuucugccauauucugu

SEQ ID NO: 61478 - RNA, 64 nt, Human
cucccgaguagcugggauuacaggcaccugucaccacacccagcuaauuuuuguauuuuuagua

SEQ ID NO: 61479 - RNA, 64 nt, Human
gaggcaugcacauuccucacugaaaaagaaaacacacacccacccacacacacacacacagaag

SEQ ID NO: 61480 - RNA, 64 nt, Human
cgccccagacccuugaaggaaggugcucccuucacacacccaggcuggagagacacugcgcuca

SEQ ID NO: 61481 - RNA, 64 nt, Human
gagccccgcagggccuccagcagggucagccauucacacccauccacucaccucccauucccag

SEQ ID NO: 61482 - RNA, 64 nt, Human
gugugugauuuuuugcauuccugacaaaggagagcacacccagguuuggagguccuaggucauu

SEQ ID NO: 61483 - RNA, 64 nt, Human
cucccaaagugcugagauuacaggcgugagcuaucacacccagccucccccuuuuuuuccuaau

SEQ ID NO: 61484 - RNA, 64 nt, Human
caggagugacagaucacagggugagggccaccuccacacccacccccucuggagaaggccugga

SEQ ID NO: 61485 - RNA, 64 nt, Human
gcugacaggcgagggucagccugcugugcccacacacacccacuaaggagaaagaaguugauuc

SEQ ID NO: 61486 - RNA, 64 nt, Human
acugcacgcccaucgugcacaccugcccaucgugcacacccacccauggugcacaccuguaguc

SEQ ID NO: 61487 - RNA, 64 nt, Human
cacccugccucggacugguuuacguguccugguucacacccaggacuuuucuuugcaagcgaac

SEQ ID NO: 61488 - RNA, 64 nt, Human
aggcaggacagccaugagguggggcugcagccggcacacccagugguggagggccggcgcugcc

SEQ ID NO: 61489 - RNA, 64 nt, Human
aaggucccugcguggggaggugucacaccaggggcacacccagggccaccuggguguaggagag

SEQ ID NO: 61490 - RNA, 64 nt, Human
ggagcauguacagagcucuguguauacacagcuucacacccaccagauuguuacuacagugggu

SEQ ID NO: 61491 - RNA, 64 nt, Human
uaaacugcugaaggucccugacuccuaagagaaccacacccaaaguccucacucuugcaggggu

SEQ ID NO: 61492 - RNA, 64 nt, Human
cccacagucagccuccugucccugcuggugcccccacacccaccuacccugugcuuuuugccgu

SEQ ID NO: 61493 - RNA, 64 nt, Human
caucccaaccuugagccccaggagauaccgcgcccacacccaaucuugggacacucccuaucug

SEQ ID NO: 61494 - RNA, 64 nt, Human
gucccccaacccccagagcuuggagucugggccccacacccagcccugccuuggucccugagcc

SEQ ID NO: 61495 - RNA, 64 nt, Human
gccaccugugccuuuccucuggcccugcugcccccacacccaacuccgagggcccacgcugggg

SEQ ID NO: 61496 - RNA, 60 nt, Human
cugccucccagggucacuaggcgggcagcccacacccaccccagacggccaccacacuga

SEQ ID NO: 61497 - RNA, 64 nt, Human
augauaggaauugacuccggcgugcacacacguacacacccacacacaucuaucuauacauaau

SEQ ID NO: 61498 - RNA, 64 nt, Human
gaccugcagcuugcauggggccccucccuucuuccacacccacccuccguaugguccccugcuc

SEQ ID NO: 61499 - RNA, 64 nt, Human
gcguacgucccacaaaugcagguguccugagcaccacacccagugggaagagugugggggaggc

SEQ ID NO: 61500 - RNA, 64 nt, Human
uucaagauuguuccugcuuuuccccaaguacaaccacacccacacucagauccuccucauucac

SEQ ID NO: 61501 - RNA, 64 nt, Human
caugaguccucagaagguauuuguaauaagguuccacacccagcucucucagcuguuuuuaaau

SEQ ID NO: 61502 - RNA, 64 nt, Human
cagagucaaugccuucaugggaagggcucccagccacacccagaguggcccaaagcuguugaag

SEQ ID NO: 61503 - RNA, 64 nt, Human
ugcccucggagugccacacaugcccagaccuucucacacccacacaaauaggcucugccgugca

SEQ ID NO: 61504 - RNA, 64 nt, Human
cucccgaguagcugggaguacaggcacacaccaccacacccagcuaauuuuuguauuuuuagua

SEQ ID NO: 61505 - RNA, 64 nt, Human
gaaaguggauuacaccaaauuaagucauucuuaucacacccaaucaaaagucaagaagccaggg

SEQ ID NO: 61506 - RNA, 64 nt, Human
gauuggcuggcucucugguagcauuuuguccucacacacccaucuacuauguccaaccggucug

SEQ ID NO: 61507 - RNA, 64 nt, Human
agcacaugaccguacucugcguggggcuccaccucacacccaccccugggcaucuuaggacugg

SEQ ID NO: 61508 - RNA, 64 nt, Human
uuguauggggaggcaagugugggggguccuucuccacacccacuuuguccauuugcaaauauau

SEQ ID NO: 61509 - RNA, 64 nt, Human
acagguccucuuucggggcucaggagggugggcacacacccagcggccugcagaguaagcuuau

SEQ ID NO: 61510 - RNA, 64 nt, Human
cucaggaacucuucuauuuccuucccuaauaccccacacccaaccugucguaauuucuggagaa

SEQ ID NO: 61511 - RNA, 64 nt, Human
cagucccccacccaccuccugcggcucagccuugcacacccacugccccgugugaauguagcuu

SEQ ID NO: 61512 - RNA, 64 nt, Human
cugaagaggcuucugucuuauuugaaggccagcccacacccagcuacuuuaacaccagguuuau

SEQ ID NO: 61513 - RNA, 64 nt, Human
cucccaaguagcugggacuacaggcacacgccaccacacccaacuaauuuuuguauuuuuagua

SEQ ID NO: 61514 - RNA, 64 nt, Human
cucccaaagugcugggauuacaggcaugagccaccacacccagcgagacgggguuucauuaugu

SEQ ID NO: 61515 - RNA, 64 nt, Human
ccaguacucccccuguaccacccauugcugauggcacacccauccuuaagcuaagacaggacga

SEQ ID NO: 61516 - RNA, 64 nt, Human
cccucccaguggcuguggcagugacagugacacccacacccacaguaaagaggagacugaauga

SEQ ID NO: 61517 - RNA, 64 nt, Human
cccucccacaggcaagaaccagaggcccaggcugcacacccauuucagccaucaagaacccaca

SEQ ID NO: 61518 - RNA, 64 nt, Human
uggcgggaacgcgagaagggcaccagcagcauuccacacccagcucuuccucaccuuccugucu

SEQ ID NO: 61519 - RNA, 64 nt, Human
ggcacuguuuuuauuuguuuauguuauuuaaauacacacccagacacacacacacacaguuuuu

SEQ ID NO: 61520 - RNA, 64 nt, Human
cuugagcacuccccagaccagaucacuuuuuggacacacccaggaaggcuuuugaagucaagcc

SEQ ID NO: 61521 - RNA, 64 nt, Human
gguugccugcggaguaccuugucccagggccagacacacccacaccacccacuguccugcagug

SEQ ID NO: 61522 - RNA, 64 nt, Human
uugauaccucagagcuggcugucagguggcagcucacacccagacucacuggccacaccucagc

SEQ ID NO: 61523 - RNA, 64 nt, Human
cuccugaguaggugggauuacagaugcccgccaccacacccaguuaauuuuuguauuuuuagaa

SEQ ID NO: 61524 - RNA, 64 nt, Human
ugugcccaaggccccugaucucugcugaggugcccacacccacguucgaucaccccugccauuc

SEQ ID NO: 61525 - RNA, 64 nt, Human
aaauuuaaaauuaauuuuugaaaucaaagucagacacacccaugguaaaaaaaaaaaaaaaaac

SEQ ID NO: 61526 - RNA, 64 nt, Human
uagcaccuuacaccccaucuuugacucaguuccccacacccaaagaucccagccuagggauggg

SEQ ID NO: 61527 - RNA, 64 nt, Human
cucccgaguagcugggauuacaggugccugccaccacacccagcuaauguuuuguauuuuuagu

SEQ ID NO: 61528 - RNA, 64 nt, Human
uauauauacaauauaucauuuuuguuaaaauaaucacacccauuuauuuuguguuuaugugugu

SEQ ID NO: 61529 - RNA, 64 nt, Human
ccuuguggcucucagccaugccacaucccugucacacacccagggcauccauuccuaagccaga

SEQ ID NO: 61530 - RNA, 64 nt, Human
ucccuaagaggcuuggaggagcugggcucuaucccacacccacccccaccccacccccacccag

SEQ ID NO: 61531 - RNA, 64 nt, Human
cccuccccagucaccaguucuccucuggacuggccacacccaccccauuccuggacuccuccca

SEQ ID NO: 61532 - RNA, 64 nt, Human
guacccuucccugucugcucucccaugccauguacacacccacaacccguccuuccacuuggaa

SEQ ID NO: 61533 - RNA, 64 nt, Human
agugcuuuaaagccguuucaagcuguauaguuugcacacccaucccaguggaggggaaagggga

SEQ ID NO: 61534 - RNA, 57 nt, Human
cucuccccaggucucggugacucugaccacacccagcucaggacuggauucugcccu

SEQ ID NO: 61535 - RNA, 64 nt, Human
gaauaaugcuggacuaccuggguaaaauuugccacacacccagccugaaguucuaaaagaaaaa

SEQ ID NO: 61536 - RNA, 64 nt, Human
acuccccucuccuccccuuccuguuucucguugucacacccauggccucagcccugcucccugc

SEQ ID NO: 61537 - RNA, 64 nt, Human
uccuucgucugggaaggcaccagcaugagucccacacacccagccuucucauuucuagaggcuu

SEQ ID NO: 61538 - RNA, 64 nt, Human
cgugaggccugugagauccugacccaagcucaggcacacccaaggcaccugccucucugagucu

SEQ ID NO: 61539 - RNA, 64 nt, Human
ggccauggcugggucaaggcagaaggccuuggugcacacccaggggccauagucaaugaagcau

SEQ ID NO: 61540 - RNA, 64 nt, Human
agacccgggcgcugccgagaccccucgggggcugcacacccagcagcagcgcacgccuccgaag

SEQ ID NO: 61541 - RNA, 64 nt, Human
aacuggggucccuuggggcgccccacgcugcuuccacacccaccaccucuggccuuggguggug

SEQ ID NO: 61542 - RNA, 64 nt, Human
agcugggccccugcacaggcacacagggcccggccacacccagcggccccccgcacagccaccc

SEQ ID NO: 61543 - RNA, 64 nt, Human
gugagcugcaggcauggcgauggugcgccuguuccacacccagcaggcgcaaccagagucucgu

SEQ ID NO: 61544 - RNA, 64 nt, Human
uccucacccuccccaccacauaaacacauggacacacacccaagccacaagaaaucccaagaga

SEQ ID NO: 61545 - RNA, 64 nt, Human
gccuggcagcagccucaccgaagagaggaaccaccacacccagcagcuccugacagacccccac

SEQ ID NO: 61546 - RNA, 64 nt, Human
cuccugaguagcugggaugacaggcacccgccaccacacccagcuaauuuuuguacuuuuagua

SEQ ID NO: 61547 - RNA, 64 nt, Human
aggugucaugugcuggcccugugauuuugccucccacacccagccacuaccucccagcuuggag

SEQ ID NO: 61548 - RNA, 64 nt, Human
accacuaggugccugcugccuccacagugggguucacacccagggcuccuuggucccccacaac

SEQ ID NO: 61549 - RNA, 64 nt, Human
cuugugccuuaaaaaaccugccuuccugcagccacacacccacccgggguguccuggggaccca

SEQ ID NO: 61550 - RNA, 64 nt, Human
acugagaagggcugcccgggucaccucagcugcccacacccacacucuccagcaucuggcacaa

SEQ ID NO: 61551 - RNA, 64 nt, Human
ucgggcacagggcagcucccacuggucucggcaacacacccagccgccugguacuuccuccagc

SEQ ID NO: 61552 - RNA, 64 nt, Human
guagcuccugaccuccgaccuuauguccaaauuucacacccaugguuuuucauuugacccgccc

SEQ ID NO: 61553 - RNA, 64 nt, Human
gaugccagaaugggggaggcacagcucauagccacacacccagggccugacugaggcccacgca

SEQ ID NO: 61554 - RNA, 64 nt, Human
gcgggugccccugcugcccuugucccuugggggucacacccauccccuggugggcuccugggcg

SEQ ID NO: 61555 - RNA, 64 nt, Human
gacuggggggcuguugccccucccuccaucuccccacacccaccccaccccacagcagggcucc

SEQ ID NO: 61556 - RNA, 64 nt, Human
uggcagccgguuguaagccuugcacgggacagaccacacccaccgcaaccucauccccucagca

SEQ ID NO: 61557 - RNA, 64 nt, Human
cauccacucucaaccccguccccuucgcacugaccacacccaccccguucggccccgccccccg

SEQ ID NO: 61558 - RNA, 64 nt, Human
ccagacagcgcugcccagggguggccgccuaguacacacccaccuggccgagcuguaccuggca

SEQ ID NO: 61559 - RNA, 64 nt, Human
aaggaugagagauguuuugaaaaacuagccaggacacacccacaggauccuacuggcuccuuag

SEQ ID NO: 61560 - RNA, 64 nt, Human
uccacgggucuccccauucccaccaggcccugcacacacccacuccguaaccucuccccuguac

SEQ ID NO: 61561 - RNA, 64 nt, Human
uauguaaaacuauuuaaaauagaauagaaggauacacacccaauuauugauagcauugucucug

SEQ ID NO: 61562 - RNA, 64 nt, Human
caaccggucccuuccaugcccugggaugccucaccacacccaggucucuuccuuugcucugagg

SEQ ID NO: 61563 - RNA, 64 nt, Human
cacccaugauacagggccuaccaaugcuuaaaaccacacccagggagcccacagaggcacucag

SEQ ID NO: 61564 - RNA, 64 nt, Human
cucacuugacucaugcugcuaagaugcacaaccgcacacccauacacaacuacaagggccacaa

SEQ ID NO: 61565 - RNA, 64 nt, Human
cucccgaguagcugggacuacaggugcccgccaccacacccagcuaauuuuuuguauuuuuagu

SEQ ID NO: 61566 - RNA, 64 nt, Human
caaggaaaaaugccacucccuacccaaugucucccacacccacccuuuuuuuggggugccuagg

SEQ ID NO: 61567 - RNA, 64 nt, Human
uuggaaaacuccaaggggguguggcuucccugcucacacccacacuggcugcugauuggcuggg

SEQ ID NO: 61568 - RNA, 64 nt, Human
cuucccuugcucggggaaagcccccaauucugcccacacccauuuauuuccuuccuuccuuccu

SEQ ID NO: 61569 - RNA, 64 nt, Human
ugggauuacaggcaugagccaccgugcccggcuucacacccauuucuuuaaaaaggaucccgua

SEQ ID NO: 61570 - RNA, 64 nt, Human
ggugagggcccaggcuggucagcgucccgucuugcacacccaggggccucccuuucugcuggag

SEQ ID NO: 61571 - RNA, 64 nt, Human
cuccuaaguagcugagacuacagacgugcgccaccacacccaguucauuuuuguauuuuuagua

SEQ ID NO: 61572 - RNA, 64 nt, Human
cucccgaguagcugggauuacaggugggugucaccacacccagcucaguauuguauuuuuagca

SEQ ID NO: 61573 - RNA, 64 nt, Human
uggaaaaacugaagauacggaaaccugccccacucacacccaucugauggaggaacuuuaaacg

SEQ ID NO: 61574 - RNA, 64 nt, Human
cuccugaguagcugggauuacaggugugcgccgccacacccagcuaauuuuguauuuuuaguag

SEQ ID NO: 61575 - RNA, 64 nt, Human
guucaggguuggggugggacgggcagcgguggggcacacccauuccacaugcaaagggcagaag

SEQ ID NO: 61576 - RNA, 64 nt, Human
gugaccaaaggcugagcccccaccccggcccggccacacccaugcccuccuccgugccuuccug

SEQ ID NO: 61577 - RNA, 64 nt, Human
gucacucuggcacaagcugccaccaccagccacccacacccaccccagcacaccucacacggga

SEQ ID NO: 61578 - RNA, 64 nt, Human
cuuaugaguacccaagaaggacugucuaugcaugcacacccacaagccuauacaccauuuauau

SEQ ID NO: 61579 - RNA, 64 nt, Human
agaccccacauccccucagaacgcugcgcccagccacacccacgaucaaguuacacagcuuuau

SEQ ID NO: 61580 - RNA, 64 nt, Human
cuccaaaguagcugggauuacaggcaugcgccaccacacccagcuaauuuuuuguauuugguag

SEQ ID NO: 61581 - RNA, 64 nt, Human
ccuucccuccccaccggcccgggggagaccucuucacacccaaagaugcuuugucaagauggcu

SEQ ID NO: 61582 - RNA, 64 nt, Human
cugcccaggaggcauggauacucaggaaggaacacacacccauuaucugugugugccugggagu

SEQ ID NO: 61583 - RNA, 64 nt, Human
ccagaaguaucugaccgaccuacgccacuggaaacacacccaccgcaaccucaagaaccagacu

SEQ ID NO: 61584 - RNA, 64 nt, Human
accgcaguuugguccuggggaccauucauacccacacacccagcuugugccugugguuaacauc

SEQ ID NO: 61585 - RNA, 64 nt, Human
ucaccuagagucacacaccccuucccucaucaggcacacccaugaagacagugccucccuccuc

SEQ ID NO: 61586 - RNA, 64 nt, Human
accugucacuuccaucauagaacaucagaaaacucacacccaaagaaaauuaaauaaauguggg

SEQ ID NO: 61587 - RNA, 64 nt, Human
cuccaaaggugcugggguuacagguaugagccaccacacccagcccaacucauuauucuugaaa

SEQ ID NO: 61588 - RNA, 64 nt, Human
cugcagacuaaauuucuuucucaauuaugucagacacacccaagucaaucccaacccccuuguu

SEQ ID NO: 61589 - RNA, 64 nt, Human
cauuuggccuacuucauuuuuuuuuuuuuugagacacacccaggcuggaguccaguggugcaau

SEQ ID NO: 61590 - RNA, 64 nt, Human
accccagugugggugugggccucugaauauaacccacacccagcguagggggagucugagccgg

SEQ ID NO: 61591 - RNA, 64 nt, Human
caacuuuccagcacacucccccgacccucgcggacacacccagaugccccagggaccccgggaa

SEQ ID NO: 61592 - RNA, 64 nt, Human
cuccugaguagcugggcugacaggcacccaccaccacacccagcuaauuuuuauguuuuuagua

SEQ ID NO: 61593 - RNA, 64 nt, Human
gggggagauaaggucaugggagaguggguggggacacacccagagacuggcuuugggauugggc

SEQ ID NO: 61594 - RNA, 64 nt, Human
guccccuucccuacacccugaccggccacugccgcacacccacccagagcacgccacccgccau

SEQ ID NO: 61595 - RNA, 64 nt, Human
cauugcaagugccaccgugcggggccuggcucugcacacccaggaaaagucugcagacccccag

SEQ ID NO: 61596 - RNA, 64 nt, Human
cucuguggccuccacuccgggaaagcccucugcccacacccacaggcuucacauucccaccacc

SEQ ID NO: 61597 - RNA, 64 nt, Human
cugagaauaacaaauugcugcugucuaccuuuagcacacccaauaauucuauuuggggcaguga

SEQ ID NO: 61598 - RNA, 64 nt, Human
gucaucagcgucacccuuccagaauguucacguccacacccauucuuggcuaauguaaugaaua

SEQ ID NO: 61599 - RNA, 64 nt, Human
uggugcaaaucuaugaccuucacauuuuuuccaccacacccaccaguagcuguuggugauugca

SEQ ID NO: 61600 - RNA, 64 nt, Human
ccguagguagggacacguguccacgcaccacagacacacccacgacaccugaucucguaucacu

SEQ ID NO: 61601 - RNA, 64 nt, Human
caccagguucaccagacacggccuccacaauagccacacccacaccugagcuguucucagugcu

SEQ ID NO: 61602 - RNA, 64 nt, Human
gccccauggggaucgccccuccugcccccuugugcacacccagcaguccagugcaacgucuccu

SEQ ID NO: 61603 - RNA, 64 nt, Human
cuccugaguagcugggauuacaggcauguaccaccacacccagcuaauuuuguauuuuuaguag

SEQ ID NO: 61604 - RNA, 64 nt, Human
auuccuuuccuuuaggccguccagagcucuaguccacacccaauacuuuagagaucuggguuug

SEQ ID NO: 61605 - RNA, 64 nt, Human
cgcagggcaacagccccaucugcuuggcugaccccacacccaggaccacuguccggcucuaaca

SEQ ID NO: 61606 - RNA, 64 nt, Human
ggcccggcauggcugucgcuggacgccagcugugcacacccagccacaccugcugcacgccgcg

SEQ ID NO: 61607 - RNA, 64 nt, Human
cucaaagcagacaauguaaagagagaacaucucacacacccagcucgccaugccuacucauucc

SEQ ID NO: 61608 - RNA, 64 nt, Human
cccccaaguagcugggacuaaagucaugugccaccacacccagcuuacucugaacuuuuaugac

SEQ ID NO: 61609 - RNA, 64 nt, Human
caaaacccugaauccagccagucgugcacagagacacacccacacuagcccaguggcagugggg

SEQ ID NO: 61610 - RNA, 64 nt, Human
gaaugcuccagcaacccugugggggaaguguuuucacacccacuagguauuugaggacacugcc

SEQ ID NO: 61611 - RNA, 64 nt, Human
gauuuuuuuuuuuccauguccgauucacacgcuacacacccacaugaacacauucgaacuucga

SEQ ID NO: 61612 - RNA, 64 nt, Human
gguuccugucccuccgggagaccuagagaagcugcacacccaggagcuuuccaugacccgggag

SEQ ID NO: 61613 - RNA, 64 nt, Human
uccucugauccuguccggugccucccccaacccccacacccaugcagaacucccaggucacaug

SEQ ID NO: 61614 - RNA, 64 nt, Human
gccuuggccgggcacugccagugucuuccagagucacacccagggaccacgggaggauccugac

SEQ ID NO: 61615 - RNA, 64 nt, Human
aaaugcuaaucucuuccagaaacagccucacagacacacccagacaucugguagaugguaaaac

SEQ ID NO: 61616 - RNA, 64 nt, Human
ccaaacucaacagaauacuuuggcuugaagccggcacacccaggguuacugaggacuuaugcug

SEQ ID NO: 61617 - RNA, 64 nt, Human
aaucucaccacagaaucagaauuuucuaccguuccacacccaaccccuucaaauacacacaacc

SEQ ID NO: 61618 - RNA, 64 nt, Human
cucccaaagugcugggauuacaggugugagccaccacacccagccucuguaguucuuuuuacaa

SEQ ID NO: 61619 - RNA, 64 nt, Human
uuccaaagugcugggauaauaggcauggagccgccacacccagccaaugugccgaagaaagaaa

SEQ ID NO: 61620 - RNA, 64 nt, Human
uuccccaguagcugggaccacaggugcccgccaccacacccaacuaauuuuuguauuuuuagua

SEQ ID NO: 61621 - RNA, 64 nt, Human
ccucuggaguagcugggccuacagugugugcugccacacccagcuaauacagucuuucuacucc

SEQ ID NO: 61622 - RNA, 64 nt, Human
ugugggccaggugcauucacucagaguggggccacacacccaucuacccaguuuccacaagaug

SEQ ID NO: 61623 - RNA, 64 nt, Human
caucuacccaguuuccacaagauguggcuccugccacacccacagggcagccuccuccaaaucc

SEQ ID NO: 61624 - RNA, 64 nt, Human
gaggcuccggguggccccucuggcccccacugcccacacccagagcuuuaauggacaguccgua

SEQ ID NO: 61625 - RNA, 64 nt, Human
cuuuucuaugaaguguugacuuuguaaaucugcccacacccagcuggccauauccaccccucga

SEQ ID NO: 61626 - RNA, 64 nt, Human
ugccucccaaguaacugggacuauagcaugccaccacacccagcugauuaucauauuuuuuuuu

SEQ ID NO: 61627 - RNA, 64 nt, Human; identical to SEQ ID NO: 61626

SEQ ID NO: 61628 - RNA, 64 nt, Human
cugcccccgccccuccccaucuguccccucucuccacacccagccccugcuccugcccaggcug

SEQ ID NO: 61629 - RNA, 64 nt, Human
ggugcuggugguguggcuguaggggaggggagaccacacccaaggugggggcuguggccaugug

SEQ ID NO: 61630 - RNA, 64 nt, Human
ccccaggggaaugccacggcccuuuggggaccugcacacccaccucuccgggggacuugacaag

SEQ ID NO: 61631 - RNA, 64 nt, Human
cucgcgaguaguuggaauuauaggcaugugccaccacacccagcugauuuuugcauuuuuagua

SEQ ID NO: 61632 - RNA, 64 nt, Human
uuuggagaguagcuaggacuacaggcgcagccaccacacccagcuaguuuuuuauuuuaauuuu

SEQ ID NO: 61633 - RNA, 64 nt, Human
cccagccaccucuaccugugcacuccaaccccuucacacccaccccucugaccccugccuuccc

SEQ ID NO: 61634 - RNA, 64 nt, Human
ggaaugaaucugcuacaauuccaccucauucuuucacacccagagccagagccuuaagcaucau

SEQ ID NO: 61635 - RNA, 64 nt, Human
cuauuaccuugugaaguaggugaucuuugugacccacacccacacccuauucauacacucccuc

SEQ ID NO: 61636 - RNA, 64 nt, Human
cugggggucaagacguccccugaggacccaggcccacacccagcccuucugccucccaauucuc

SEQ ID NO: 61637 - RNA, 64 nt, Human
uuggggggugaaguggcccccgaagaauggaacccacacccauagcucuccccacagcugauac

SEQ ID NO: 61638 - RNA, 64 nt, Human
aagauuguacuuccuagagaugccagacuugccucacacccaggagcugccccugcugugccug

SEQ ID NO: 61639 - RNA, 64 nt, Human
ccauugggcaggucuaucaggcugcagguuccuacacacccacgccugagggucauagcaggcu

SEQ ID NO: 61640 - RNA, 64 nt, Human
aaagggcucaagagccccagucuauaaauacagucacacccaggagacuaauaauaguaacccc

SEQ ID NO: 61641 - RNA, 64 nt, Human
ugugugcguguguguuuugaaauacgcacacagccacacccacauauauauuaaaagugguugu

SEQ ID NO: 61642 - RNA, 64 nt, Human
cugcauauuguuccagauaaaaaugaaagcugcucacacccacuugccuccccaaucuguuaaa

SEQ ID NO: 61643 - RNA, 64 nt, Human
agaguaacaguuugauauuuuguaaaaacaaaaacacacccaaacacaccacauugggaaaacc

SEQ ID NO: 61644 - RNA, 64 nt, Human
guggggcaggucacccuggccacgaugcccccggcacacccaggcccccuucauuagugccuug

SEQ ID NO: 61645 - RNA, 64 nt, Human
uacccccacgccagccccaaacuaagauaucccucacacccagcccccauuaccuagggacaag

SEQ ID NO: 61646 - RNA, 64 nt, Human
gggcagggaaaugggccaaugcaugcuucagggccacacccagcaguuucccuguccuguguga

SEQ ID NO: 61647 - RNA, 64 nt, Human
ugcucuugcgugugcuugcacgugcacgcacacacacacccagugcucucuccacccgacccgu

SEQ ID NO: 61648 - RNA, 64 nt, Human
aacagcaaaccaaugcuauugugauuauuggauucacacccagcugacgcgacuaucauucucu

SEQ ID NO: 61649 - RNA, 64 nt, Human
uaagaauuaggguggguugucugucuggaaguguuaaguggaaugggcuuuguccuccaggagg

SEQ ID NO: 61650 - RNA, 64 nt, Human
acuugauauuaaguguucucaacugaguaacuuuuaaguggaaaccaaguuuagauuuggggag

SEQ ID NO: 61651 - RNA, 64 nt, Human
ucucaccuaagcccagagcaaggaacagguauaauaaguggaaaaucuuggaauaaguauaauu

SEQ ID NO: 61652 - RNA, 64 nt, Human
uuugaccaaauagcugggcaucuugugacccaguuaaguggauacauaagauuaacuaucacag

SEQ ID NO: 61653 - RNA, 64 nt, Human
acgaauuguaugauuuaggaaucaaaaacuaaaauaaguggaauuauguaucuuuucuaaaguu

SEQ ID NO: 61654 - RNA, 64 nt, Human
uguaucugcuauugugaugccaaugccgguguuuuaaguggaaaaaaaaugaccucuuugauuu

SEQ ID NO: 61655 - RNA, 64 nt, Human
caggcaauaguguugaggaggggagcaaggcugcuaaguggaagacagagauggcagagccauc

SEQ ID NO: 61656 - RNA, 64 nt, Human
gcaaaauggaaaucuagaccuccuucuucauccauaaguggacugugccaguacaauacaugcc

SEQ ID NO: 61657 - RNA, 64 nt, Human
cauucccuuucuaucccaccccucugaucucccauaaguggaaauggggguacccagggauggg

SEQ ID NO: 61658 - RNA, 64 nt, Human
uaauuuucagcuuaauuauaaacaaaggaacaaauaaguggaagggcagcuauuaccauucgcu

SEQ ID NO: 61659 - RNA, 64 nt, Human
auaaaaguauuuaacaaccgcuauggcaucaauguaaguggaguuugguccuagugccggagcc

SEQ ID NO: 61660 - RNA, 64 nt, Human
acugcacaggcagauguuugccucauaauagucguaaguggaguccuggaauuuggacaagugc

SEQ ID NO: 61661 - RNA, 64 nt, Human
uccuuuugaaaaagagucccuggaaaagaaagaauaaguggauucucccccaggagaauccuuu

SEQ ID NO: 61662 - RNA, 64 nt, Human
ggcugcgaacuaguucuguggcaguggacuagcauaaguggaugucuaagaaauuuuucaguuc

SEQ ID NO: 61663 - RNA, 64 nt, Human
gacagagggaaggucacaggcaagggugccuaucuaaguggaacuaauugcccgagggcucagc

SEQ ID NO: 61664 - RNA, 64 nt, Human
gcugcccgugugcaugaagguacagccauucagauaaguggaacuauugaguuacauaaagaaa

SEQ ID NO: 61665 - RNA, 64 nt, Human
ugaagcacccugaagggugccauccuuacagagcuaaguggagacguuuccagaucagcccaag

SEQ ID NO: 61666 - RNA, 64 nt, Human
cacaggacaugaugggcuguucuauaaagcauucuaaguggagaggagacgauagggcauauga

SEQ ID NO: 61667 - RNA, 64 nt, Human
cuguaacauccauguugucaauacguauaccuuguaaguggauaacuuuucuuuuucccaggcc

SEQ ID NO: 61668 - RNA, 64 nt, Human
caaauggaaaaggggaaguaauuaaggaaauugguaaguggagguagucaggagguucucgugg

SEQ ID NO: 61669 - RNA, 64 nt, Human
gcccagaaaucuaaagaucuuuguucuauaacuguaaguggagaagagaucccuaauaugccuc

SEQ ID NO: 61670 - RNA, 64 nt, Human
agauguucacuguggcauugucuguaaugacaaauaaguggaaaccguguaaauaccugucaau

SEQ ID NO: 61671 - RNA, 64 nt, Human
guaggaggugcgggaaagugcuuguggcuuagauuaaguggaauuuagggcauagcugaaaggg

SEQ ID NO: 61672 - RNA, 64 nt, Human
acuucauuauaugcaaguuuucaauaauuaggucuaaguggaguuuuaagguuacugaugacuu

SEQ ID NO: 61673 - RNA, 64 nt, Human
caagcuuguaaaugguucgucuuuaaaauguacauaaguggaacauuuaauaaaaugaggggaa

SEQ ID NO: 61674 - RNA, 64 nt, Human
auagugcuuuugguccuagaugauuuuuaucaaauaaguggauugauuaguuaaguucagguaa

SEQ ID NO: 61675 - RNA, 64 nt, Human
agcaguguacaugaagugcacaucugggaacuuguaaguggaaagauuauugccacccugcaca

SEQ ID NO: 61676 - RNA, 62 nt, Human
gagaacuuucagagcacugauuuuugauagacuaaguggaaaauuugcagagaaaugauggu

SEQ ID NO: 61677 - RNA, 64 nt, Human
acuaaguggaaaauuugcagagaaaugaugguuguaaguggacaugcaaaccaaaauuggggau

SEQ ID NO: 61678 - RNA, 64 nt, Human
aacugauuaaguagguaugauacugcauuugaaauaaguggacacaaacuauccuuucuccacc

SEQ ID NO: 61679 - RNA, 64 nt, Human
uuaccacuaugacuuaagugguccuggaaggcaguaaguggagguuugcagcauuccugccuuc

SEQ ID NO: 61680 - RNA, 64 nt, Human
agaacucugccuaccuaagaaguucauuguguucuaaguggaaggagaguuacugaagggaaug

SEQ ID NO: 61681 - RNA, 64 nt, Human
ugcaguaagaguugaaaccggcaguuacacuaaguaaguggagggaaugaaaguguuucgaggu

SEQ ID NO: 61682 - RNA, 64 nt, Human
auaggaagcuauugcuuggacagagaacuugaaauaaguggacccauguauaaaagcuuugacu

SEQ ID NO: 61683 - RNA, 64 nt, Human
uccauuuuuguuggugaacaucucagacuauagauaaguggacuggacccugugucuugggggu

SEQ ID NO: 61684 - RNA, 64 nt, Human
ugugaacucuuacuaaaaugaguuuuagguucuguaaguggaaaaaugugcuuuuauuuuaugg

SEQ ID NO: 61685 - RNA, 64 nt, Human
ccaauuguuuuugacugaguaucuaggagagcaguaaguggaacuucagacaagcccacugggu

SEQ ID NO: 61686 - RNA, 64 nt, Human
aacaaaauagucuauaugguacuugaucuacauuuaaguggaaaaauuagcaguauuugaaagc

SEQ ID NO: 61687 - RNA, 64 nt, Human
caggaagcaacuuugcuuaaaauuguauaccugguaaguggaaaaagagggauuugaauauagg

SEQ ID NO: 61688 - RNA, 64 nt, Human
ggagauagcuuuacacuuucugcuuuaauagauuuaaguggaccccaauauuuauuaaaauugc

SEQ ID NO: 61689 - RNA, 64 nt, Human
aguacauauaucuauuucucuagggauauggaaguaaguggagaagggccuaccuuuuuaaagg

SEQ ID NO: 61690 - RNA, 64 nt, Human
caugcuugcugagccauaauuacuaaagagaauguaaguggacggguucccugaauccccgggg

SEQ ID NO: 61691 - RNA, 64 nt, Human
auaaaaucauuagaacaaugguuuuuaaaagacuuaaguggaugcauccuaugcauguaagcau

SEQ ID NO: 61692 - RNA, 64 nt, Human
uaauaaucuggaggagagaauaaugauguaccaauaaguggagauuccuccuuaugauguaugc

SEQ ID NO: 61693 - RNA, 64 nt, Human
uguuuauaaacuuuuuaaauaaaaccagaccuuguaaguggacauuaauaauuguccugccuca

SEQ ID NO: 61694 - RNA, 64 nt, Human
ugcaguucuguauuuauugugcugugucugguccuaaguggagccaauuaaacaaguuucauau

SEQ ID NO: 61695 - RNA, 64 nt, Human
accaugaguaauaagggggcuccaggacucccucuaaguggaauagccucccuguaacuccagc

SEQ ID NO: 61696 - RNA, 64 nt, Human
gguuuuggauuuuuuucucuugugguuuguuuuuuaaguggauuggcagacuccuuguugcuua

SEQ ID NO: 61697 - RNA, 64 nt, Human
uggggguuauguuacugaagaaugaacagaugaguaaguggagguguuauguaaaggcauauug

SEQ ID NO: 61698 - RNA, 64 nt, Human
aguguuaaucuuuucugugacuaaauagcaauaauaaguggaaaauuagaaauuauuuccaggu

SEQ ID NO: 61699 - RNA, 64 nt, Human
ggagcaucuauuuagggguuaauuacuuuaguaauaaguggaaaguaagauaccuugaguaaug

SEQ ID NO: 61700 - RNA, 64 nt, Human
acuuggcuugauugcuucuuuauaguagucccuguaaguggacauaaauguggcuauuugaugu

SEQ ID NO: 61701 - RNA, 64 nt, Human
aauaaauaaauguggauuugugcucuuguauuuuuaaguggauuaaaaaacuuacuaccuuaaa

SEQ ID NO: 61702 - RNA, 64 nt, Human
augguauuuuauucauuucugaccuccaauucccuaaguggagauuaaauguuagaaaccugac

SEQ ID NO: 61703 - RNA, 64 nt, Human
aaaguuaaucuagccaugugauuuuucagaaaaguaaguggaacaugcugccacuuuucaauuc

SEQ ID NO: 61704 - RNA, 64 nt, Human
agcacaaaugcagcaaauccuucacccugcuuuauaaguggagcuggaauaguccuggggcucu

SEQ ID NO: 61705 - RNA, 64 nt, Human
ucaccuucucacuugcugugggugaggggccauuuaaguggacugggagacagugcgcaguuug

SEQ ID NO: 61706 - RNA, 64 nt, Human
acaccaaaucuggcugaaugaaauaaauuggugauaaguggaaaaaagagaaaaaccaaugauu

SEQ ID NO: 61707 - RNA, 64 nt, Human
ucaugcccgucgauguuuuggguauugaaugugguaaguggaggaaauguuggaacucugugca

SEQ ID NO: 61708 - RNA, 64 nt, Human
guuuucaccugaaauuauuuucuucuguggcaacuaaguggauaauuacauccagagaaaaagu

SEQ ID NO: 61709 - RNA, 64 nt, Human
ggugaaaauuguauaaauuacuuugauuccauuuuaaguggagacauauuucagugauuuuuag

SEQ ID NO: 61710 - RNA, 64 nt, Human
uuguuccacugugccuugguuucuccuuuauuucuaaguggaaaaaguauuagccaccaucuua

SEQ ID NO: 61711 - RNA, 64 nt, Human
cugaagacucagggcuucaacauucuagaacugauaaguggaccuucagugugcaagaauggag

SEQ ID NO: 61712 - RNA, 64 nt, Human
uauaguuaauauuuucuuagaauuugagcccauuuaaguggauuaauauucuacaugugugccc

SEQ ID NO: 61713 - RNA, 64 nt, Human
uuccaggugauuuguuuuuucacaguaaaccauguaaguggaagcuuuacugccaauguguuua

SEQ ID NO: 61714 - RNA, 64 nt, Human
gaaacuugccaaccuucgugucaggugcuguguguaaguggagaacuuggggauagaggaggaa

SEQ ID NO: 61715 - RNA, 64 nt, Human
cauucuggcaaaaaaaaaucaguuuuaugaagaguaaguggaaccugggaugcaggaacaaaag

SEQ ID NO: 61716 - RNA, 64 nt, Human
uuuaaaauaguuuugcagauuaaaauugcuuaaauaaguggauuaaaaaacugacaaugcaugc

SEQ ID NO: 61717 - RNA, 64 nt, Human
cauucauacuaguuagaaaaauuauguguugaaauaaguggaaaagugcaauccauccacccuu

SEQ ID NO: 61718 - RNA, 64 nt, Human
uauuacaagcugcauguccugacccucuuugaauuaaguggacuguggcaugacauucugcaau

SEQ ID NO: 61719 - RNA, 64 nt, Human
aaaacaaugucauuuaguagaauauuucaguauuuaaguggaauuucaguauacuguacuaucc

SEQ ID NO: 61720 - RNA, 64 nt, Human
cacaccuuucuuuucuuuuccucuugugccuaguuaaguggaaauguguuuggagauaggggaa

SEQ ID NO: 61721 - RNA, 64 nt, Human
gaaaaggcuccacucaccuauaggagauuauuuuuaaguggaauccauuuaaacucaaaacagu

SEQ ID NO: 61722 - RNA, 64 nt, Human
uuaccacagugucugccacugaauuuccagugacuaaguggaaaaauauaaaacauaugaauau

SEQ ID NO: 61723 - RNA, 64 nt, Human
aguucuugcaaccuuguggaauuugcuuccugaguaaguggauauacaaccucagcaaugacaa

SEQ ID NO: 61724 - RNA, 64 nt, Human
aaaaauaacuuucugaauauuuuuuucuuguguauaaguggaaagggcauuuuucacauauaag

SEQ ID NO: 61725 - RNA, 64 nt, Human
ugugguuuucucauguguauacuugguggaauuguaaguggauuugcaggccagggagaaaaug

SEQ ID NO: 61726 - RNA, 64 nt, Human
ugucuuuucaaucuucuacuuuuaacuaauaaaauaaguggauuuuguauuuuaagauccagaa

SEQ ID NO: 61727 - RNA, 64 nt, Human
uuuuauaacauauauauuaguugauguuuaccuauaaguggaguagauuuucaucugccugcaa

SEQ ID NO: 61728 - RNA, 64 nt, Human
uaaaagaaaaacaccauaaaagugguaguauauuuaaguggaaaauuauguauuuuaaagugug

SEQ ID NO: 61729 - RNA, 64 nt, Human
auugcugggauugggagaaauaaaacaugcaauuuaaguggaagcgaagaaauuuaaagaggau

SEQ ID NO: 61730 - RNA, 64 nt, Human
uaccaauggugacauuaagccuaauuuuccaaacuaaguggagacuuaguuuuugaaguguuga

SEQ ID NO: 61731 - RNA, 64 nt, Human
auaggugcuucuuggauguucuuggguuuggaaauaaguggaaaauacgggauguaccccuggg

SEQ ID NO: 61732 - RNA, 64 nt, Human
uucugcaauacaagcuugugauuuaugcuuacucuaaguggaaaucaggauuguuaugaagacu

SEQ ID NO: 61733 - RNA, 64 nt, Human
uuaaagugcuuuauugcagagaguuauggaaauauaaguggaugauuauucucauuguaaauau

SEQ ID NO: 61734 - RNA, 64 nt, Human
cugucacugcuggagucaaacuuauaaaaagccuuaaguggaaaguguuccagacggagacucu

SEQ ID NO: 61735 - RNA, 64 nt, Human
gcuuaaacuacaacuugucacauaaaggaagucuuaaguggaguucacagaaugauaauguauc

SEQ ID NO: 61736 - RNA, 64 nt, Human
uaaaacacaaauuuuaaacucaaccaagcugugauaaguggaaugguuacuguuuauacugugg

SEQ ID NO: 61737 - RNA, 64 nt, Human
acucugcucugcacauuagagggacagccaaaaguaaguggagcauuuggaaggaaaggaauau

SEQ ID NO: 61738 - RNA, 64 nt, Human
uucuuaggagauggcugacuugauugaucuacgcuaaguggagacauuucacauuuuuaaaacc

SEQ ID NO: 61739 - RNA, 64 nt, Human
aucuacccaucucaucugcucugcacccagcuucuaaguggacaaagccaagcccaggcaugag

SEQ ID NO: 61740 - RNA, 64 nt, Human
aauuugaaaugagggugggccagaugaguauguuuaaguggagagugcuuccagcugagaugau

SEQ ID NO: 61741 - RNA, 64 nt, Human
augucacuuauuucccuaccuuauuaagacuaaauaaguggaacaucauagagcucuuuauuua

SEQ ID NO: 61742 - RNA, 64 nt, Human
auacaacagaaaauggccaauuaaugguccuguauaaguggaaaacuguuaaggaggucucagg

SEQ ID NO: 61743 - RNA, 64 nt, Human
auucauacuuuacuguaaggacaguuucgguaguuaaguggaauuaaaggucuagagugauuug

SEQ ID NO: 61744 - RNA, 64 nt, Human
aaauaguuuuugacucuaauacuguauaugcauuuaaguggaauauuuggugccauuuacaaca

SEQ ID NO: 61745 - RNA, 64 nt, Human
aaugcuugcaaaacgugugugucauucagcauuuuaaguggagacuaugcauuucauaguauau

SEQ ID NO: 61746 - RNA, 64 nt, Human
uaguuaacaauuuuauuuuguauucuugcaguuuuaaguggaugcuaauuuuaggggcauaagc

SEQ ID NO: 61747 - RNA, 64 nt, Human
uuuuagccuucauauugauaucuaauuaauuauuuaaguggaagaggccugcaucacaauugag

SEQ ID NO: 61748 - RNA, 64 nt, Human
uuauuucauaaauaacuugggagaaacugcauccuaaguggaagaacuaguuuguuuuaguuuu

SEQ ID NO: 61749 - RNA, 64 nt, Human
aagaacuguaaccucggcaagugccagaugucucuaaguggaccucagugccugugagugcucc

SEQ ID NO: 61750 - RNA, 64 nt, Human
aaaaaaaaaaaaaugauggagcuccgaaugugcuuaaguggaaagauaucuaugaaauauggug

SEQ ID NO: 61751 - RNA, 64 nt, Human
augaagguccuugcauacaccuugucuguguggauaaguggacacaugcccuuaagaggcuugc

SEQ ID NO: 61752 - RNA, 64 nt, Human
gauaugggcagucaucaauggcugccaaaaccauuaaguggaaagcugauuaaaaaacaaaaau

SEQ ID NO: 61753 - RNA, 64 nt, Human
cacaguauuuaacauucuuggucacaaagcuauuuaaguggacuguauuucggcuaugucucau

SEQ ID NO: 61754 - RNA, 64 nt, Human
aaaaguguuaucuuucuuacaaaaguuuuguaccuaaguggauauagauaacugcauaaaugaa

SEQ ID NO: 61755 - RNA, 64 nt, Human
ugauuuguccauuauguguuaggcaaauauaacuuaaguggagggggaaguuuaugaauauaau

SEQ ID NO: 61756 - RNA, 64 nt, Human
ucagcccagccucgagguccuucuggggagaguguaaguggacagaguccuggucagggggcag

SEQ ID NO: 61757 - RNA, 64 nt, Human
ccaaccuguauagcccauggguugugucuagaauuaaguggagggcagcuaucuggaguuaacu

SEQ ID NO: 61758 - RNA, 64 nt, Human
uaccuuuugaaauugcauguuuaucauauauccuuaaguggacacauacagugccauguugaug

SEQ ID NO: 61759 - RNA, 64 nt, Human
cuuguuaaaaggguucuguuuucauuaacaguacuaaguggaagggaucugcagauuccaaacu

SEQ ID NO: 61760 - RNA, 64 nt, Human
uuuguuuuugugauuauuugacuggaaugcuucuuaaguggaauaacuauacuccguuauccac

SEQ ID NO: 61761 - RNA, 64 nt, Human
aaacguguuguaucuacaguaaugaaauguuuacuaaguggacuggugucauaaacuuucucca

SEQ ID NO: 61762 - RNA, 64 nt, Human
ucagucaaagcauuuuuauuauccacgugauggcuaaguggauaauuuaaaagcuuaguaaugu

SEQ ID NO: 61763 - RNA, 64 nt, Human
cuuuaaauggugaaaaugggcagaugaauagcaauaaguggaccuuuguuacucuucugaguua

SEQ ID NO: 61764 - RNA, 64 nt, Human
ugggaggagaguuacucuugaaaggcaggcagcuuaaguggacaauguuuuguauauaguugag

SEQ ID NO: 61765 - RNA, 64 nt, Human
cauaauuguuaagaacacguguauuaaauucauguaaguggaauaaaaguuuuaugaauggacu

SEQ ID NO: 61766 - RNA, 64 nt, Human
cauuucuuuuuucaucucuauuuagcaacagaauuaaguggaugaagauauucuacuaugcauu

SEQ ID NO: 61767 - RNA, 64 nt, Human
aauaguuaaauguugaguauuguacauauguauuuaaguggauugaauaacugagucuacaugg

SEQ ID NO: 61768 - RNA, 64 nt, Human
uugagugauucaauaguuacgaugaccagugauauaaguggaguuuuuguuguauuuuuguuuu

SEQ ID NO: 61769 - RNA, 64 nt, Human
ggguaaauguuuuuuggaaaagauuugucuuuucuaaguggaaguuaaauuuguuauacugccc

SEQ ID NO: 61770 - RNA, 64 nt, Human
cugaaaucugccuuuuauaaaggaauaguauggauaaguggaauuguacauuuuuuaaacuuga

SEQ ID NO: 61771 - RNA, 64 nt, Human
uuuguauguauuaugcuuuguauccgaaagggucuaaguggauuaauauuaaaacuauguauau

SEQ ID NO: 61772 - RNA, 64 nt, Human
ccccgccuagacgccaggcccacuucacgccgucuaaguggagaagugacggacccucagggcc

SEQ ID NO: 61773 - RNA, 64 nt, Human
cuagaacaguuaggucgcucgucacauaggcaguuaaguggagaaccagguuucaaaaucaggu

SEQ ID NO: 61774 - RNA, 64 nt, Human
gggugagagucuuggcagagccuuugcaacaccuuaaguggacaggacugggaggucuuggugg

SEQ ID NO: 61775 - RNA, 64 nt, Human
auuguuguaaaugcaaugccguaguuuggauuaauaaguggaugguuuuuguuucuaaaaagaa

SEQ ID NO: 61776 - RNA, 64 nt, Human
uguugucuuuuuuuuuucuuuuuuccuuuuuuuuuaaguggaggggaaaagaagagauaaacaa

SEQ ID NO: 61777 - RNA, 64 nt, Human
aaguacuuuuggugucauuauuccaucuucuccauaaguggagaaaugaaaaguaagaacagcu

SEQ ID NO: 61778 - RNA, 64 nt, Human
ucauuuccaaagacccagagucucagagccagguuaaguggaagaaacuuugagagguuucuua

SEQ ID NO: 61779 - RNA, 64 nt, Human
gccaggagccugcccgcuuaccucugcugaagcauaaguggacuuugcuuuuggggcuuaucuc

SEQ ID NO: 61780 - RNA, 64 nt, Human
aaaaaugcagugucucagcuguccccagggaaauuaaguggaauucaacuaagaucuguuaaua

SEQ ID NO: 61781 - RNA, 64 nt, Human
aagugguuauuugcaguuauuucagaacuccaaguaaguggauggcuuuggguucuuucugccu

SEQ ID NO: 61782 - RNA, 64 nt, Human
uaagguaauuagauuuagaaguacucagucacuuuaaguggauaaauguauuaguuaaaacuuu

SEQ ID NO: 61783 - RNA, 64 nt, Human
ggguugguuugauaccacauuuaacauugacauuuaaguggaaaaccaaguuaucauugucuuu

SEQ ID NO: 61784 - RNA, 64 nt, Human
guguauaggaggguuuggcugaguccuucagcguuaaguggaggaaagcuuggggaagccccaa

SEQ ID NO: 61785 - RNA, 64 nt, Human
gggggcaaggagggacagaaaaguaaccucuucuuaaguggaauauucuaauaagcuaccuuuu

SEQ ID NO: 61786 - RNA, 64 nt, Human
ugucuacacaucggggugaccuuaggucgguuuguaaguggauacaauuaauaaaauaaaaucc

SEQ ID NO: 61787 - RNA, 64 nt, Human
ucucucugguuuugacuauucucaguaucucauauaaguggaaucauacagugacuugucuuuu

SEQ ID NO: 61788 - RNA, 64 nt, Human
uuagcuugguaacagcggugaauagaguguaguguaaguggagaaccaggauccugagaugagc

SEQ ID NO: 61789 - RNA, 64 nt, Human
guuuaaaaacagugggaaaauccacaccacacucuaaguggacagcucagaauaauuuagcaua

SEQ ID NO: 61790 - RNA, 64 nt, Human
cccuuuuaucucugcuuuccugaagcagccuuuguaaguggaaggauuguacugaaggcucagc

SEQ ID NO: 61791 - RNA, 64 nt, Human
gagcuaggggugcaaggaacaccugaugaguagauaaguggagcucaugguauuuccugaaaga

SEQ ID NO: 61792 - RNA, 64 nt, Human
ccugaucuuuaccacugcaggggcugcaggccguuaaguggacaggaaguggccccacauagcc

SEQ ID NO: 61793 - RNA, 64 nt, Human
gccuaauuaaggacauagaaaauugaccucuaauuaaguggaucauuauuauggcauuucuuaa

SEQ ID NO: 61794 - RNA, 64 nt, Human
acagaccugacaggugaggucuguuccuuuuauauaaguggacaaauuuugaguugccacagga

SEQ ID NO: 61795 - RNA, 64 nt, Human
ggaaauaacauugcacuuuauaaacacuguauuguaaguggaaaaugcaaugucuuaaauaaaa

SEQ ID NO: 61796 - RNA, 64 nt, Human
gugggaguggcaagaacuggggagacguccuccauaaguggagcacaggguaugggguuaaagc

SEQ ID NO: 61797 - RNA, 64 nt, Human
auuugauacauucagauaguguguaaagaucaaauaaguggaauugggauaucgaucacuuuaa

SEQ ID NO: 61798 - RNA, 64 nt, Human
auguuagcaaguccuaguucagaauccggagcaguaaguggagaagagcucuccacgagugcuc

SEQ ID NO: 61799 - RNA, 64 nt, Human
gccucuucucuucagcucccuuagcuuggcuccguaaguggaucacuugccaaaugcuuuagau

SEQ ID NO: 61800 - RNA, 64 nt, Human
acugcucuccuuccccgcccccagccugcuaaguuaaguggacaggcccacaagaugaccuugc

SEQ ID NO: 61801 - RNA, 64 nt, Human
guuauuuucucugaccgccuacuggaaauauuuuuaaguggaaccaaaauaggcauccuuacaa

SEQ ID NO: 61802 - RNA, 64 nt, Human
aaauuaauuugggcuuagugguuacaaauauguguaaguggauguauauguacuuaaacuggcu

SEQ ID NO: 61803 - RNA, 64 nt, Human
cagucuaauguguagauaaauauuucaaccauaauaaguggauuggcaguauauuuuuuacauu

SEQ ID NO: 61804 - RNA, 64 nt, Human
ggguuuucugcuuccuuucaaccagauaacuuccuaaguggagauggccuguagguagcaaaug

SEQ ID NO: 61805 - RNA, 64 nt, Human
gcucccuuucccuagggcaaaguucgaccucuguuaaguggagggauuugugagauaaaaauuc

SEQ ID NO: 61806 - RNA, 64 nt, Human
aucccaauuaacccaucauaaaguugaaaaauccuaaguggaaccaucaaagccggggaccauc

SEQ ID NO: 61807 - RNA, 64 nt, Human
acuggauuggauuaucauaugaugaaagggaaaguaaguggaaauggauugauaauggcacauc

SEQ ID NO: 61808 - RNA, 64 nt, Human
ccugaggcaaaaacugcuuaaguggaucuguuuguaaguggauucaguucauucgcuuugucug

SEQ ID NO: 61809 - RNA, 64 nt, Human
ugcauuugguaggaagccugaggcaaaaacugcuuaaguggaucuguuuguaaguggauucagu

SEQ ID NO: 61810 - RNA, 64 nt, Human
guaaguuuacauuucaauuucuaucuuauuugacuaaguggaaagagauucuuuaaaauguaua

SEQ ID NO: 61811 - RNA, 64 nt, Human
agucauacaugcauauacauauaccccaaaaugcuaaguggaaacugcaugaauuaaaagaggg

SEQ ID NO: 61812 - RNA, 64 nt, Human
aaucuuguaguuuauuguuguuauuuaacaguauuaaguggauuuuuguauauuucauuuuaac

SEQ ID NO: 61813 - RNA, 64 nt, Human
cuggagaaggcaaggccugaagaugggagauuccuaaguggaggagaacugugccuuacugacc

SEQ ID NO: 61814 - RNA, 64 nt, Human
auuuaauaacuuuguuccguuaauuaguacuaauuaaguggauagauagaaugguuuuccuguu

SEQ ID NO: 61815 - RNA, 64 nt, Human
gugucauagaguaagauauuccuugaaagcccauuaaguggaauagacuuucugaaaauaagag

SEQ ID NO: 61816 - RNA, 64 nt, Human
aaauuuaaacuuacuggaaucuuuuauaauaauguaaguggaauggaggauucuaggaacugag

SEQ ID NO: 61817 - RNA, 64 nt, Human
cugauaauuuauuuuguuauuuaagagcuguuguuaaguggaggaaaguaguuguuaauaaaug

SEQ ID NO: 61818 - RNA, 64 nt, Human
gaggcuguucuuuccuaugcccuguauuucuggauaaguggauuguguacccuuuaguuaaauu

SEQ ID NO: 61819 - RNA, 64 nt, Human
aaauaagauaacuacaaaguuucuauacuuacuauaaguggauuuagaagcgauuuugguuuug

SEQ ID NO: 61820 - RNA, 64 nt, Human
aaggagcauugcagucacuuugacagguuccuuuuaaguggacucucugacaaaguggguacuu

SEQ ID NO: 61821 - RNA, 64 nt, Human
aggggaauuaagucuuuguagucugucauuuuuuuaaguggauccucuuggaugcguuauuuuc

SEQ ID NO: 61822 - RNA, 64 nt, Human
uucauucaguguagcaauuacugucuuuaaaaauuaaguggaagaagaauuacuuuaaucaacu

SEQ ID NO: 61823 - RNA, 64 nt, Human
ugcagauuagauuacuuagcacacuguggaaguuuaaguggaaggagggaauuuaaaaauggga

SEQ ID NO: 61824 - RNA, 64 nt, Human
cucuuagaaaaacaaaguugauaguuaaagaacauaaguggaugauggcauuugaggccacuag

SEQ ID NO: 61825 - RNA, 64 nt, Human
ugaaaaugccacuuucaugcaguuuguuugaaguuaaguggaauccuuucaaaugacgagcugc

SEQ ID NO: 61826 - RNA, 64 nt, Human
uaacaguucaguucuguauuuguugacagguaaauaaguggaguugagugccaucuuugaaaaa

SEQ ID NO: 61827 - RNA, 64 nt, Human
aucuaauuuuagucuuagaaacucaaacuauuaauaaguggaaaaaguuuaaugauaugcaugu

SEQ ID NO: 61828 - RNA, 64 nt, Human
uaugcaguaaaguguauauauuaugcaguuucucuaaguggaaaaacuugacaugacuuuaaua

SEQ ID NO: 61829 - RNA, 64 nt, Human
auggaaacaaaaagccaacagggcagggguuuuguaaguggaacucuggauugacuggucaguu

SEQ ID NO: 61830 - RNA, 64 nt, Human
aaauaauaggaacgucaaagcucuguauaccuacuaaguggaaaacaagaccaucaucuaagug

SEQ ID NO: 61831 - RNA, 64 nt, Human
auauaaagaaccaguuccagcagggagauuucuuuaaguggacuguuuucuuucuucucaaaau

SEQ ID NO: 61832 - RNA, 64 nt, Human
augucaauaagcuugcauuaagccaccugcuuuguaaguggauugauuaauaaauaacuuauau

SEQ ID NO: 61833 - RNA, 64 nt, Human
acugucuuuauucuuauuacuauuauuguuccccuaaguggauuggcuuugugcuuggggcuau

SEQ ID NO: 61834 - RNA, 64 nt, Human
guauuacauuacguuaaagaacgggaugccaagguaaguggagguauacuucgaauuuuucuag

SEQ ID NO: 61835 - RNA, 64 nt, Human
agguaguuucuggagagcacguuuucuucauugauaaguggaggagaaaugcagcacagcuuuc

SEQ ID NO: 61836 - RNA, 64 nt, Human
uuaaauuuauuccuaaauauuuuauucuuuuugauaaguggaguuacuuucuuaauuucauuua

SEQ ID NO: 61837 - RNA, 64 nt, Human
ccugcucccuccagaauggaacucaagcugguuuuaaguggaacugcccuacugggagacuggg

SEQ ID NO: 61838 - RNA, 64 nt, Human
acugaaagaguauauagauagcaauaaaauaacauaaguggacauguuuauaguaaauacucug

SEQ ID NO: 61839 - RNA, 64 nt, Human
uuacauaagaaccaauccguguuucacauugggcuaaguggauuccuuaucccuuuguuauaua

SEQ ID NO: 61840 - RNA, 64 nt, Human
cuguauuugucucaaagcuaccaaguuugugcaauaaguggaagggaugucauccuucuucaau

SEQ ID NO: 61841 - RNA, 64 nt, Human
ggguagacuaguggcagcucucaugugcugcacauaaguggaaucaguaugaauagaagaacuu

SEQ ID NO: 61842 - RNA, 64 nt, Human
uuguucgggugugcaaugucugagugaaccuguauaaguggaggcacuuuagggcuguaaaaug

SEQ ID NO: 61843 - RNA, 64 nt, Human
ggucacuuuugauugaggcaaagggguccuacuguaaguggaaaagacucacuccccuaacaua

SEQ ID NO: 61844 - RNA, 64 nt, Human
cuuggggucuguuucugguauuuuacaaaauugcuaaguggaaugcaugaauugcauuauguuc

SEQ ID NO: 61845 - RNA, 64 nt, Human
gcugauccaagaacggcuuggcagccaguccggcuaaguggagcucagagcggaugggcacaca

SEQ ID NO: 61846 - RNA, 64 nt, Human
cgagcagcagaacuucguuuacggagcacagucauaaguggagguucagggugcugacgaaauc

SEQ ID NO: 61847 - RNA, 64 nt, Human
accauguagcaaguguacuuuguggaguguugaguaaguggaaaauggaaagccaguugcauuu

SEQ ID NO: 61848 - RNA, 64 nt, Human
uauagagagagcagguuccauagcucagcacuuuuaaguggaagaucauuugaaucucagucuu

SEQ ID NO: 61849 - RNA, 64 nt, Human
uauguaaauguuuguaaguauaugggccuaucuguaaguggauaagucuguauguguguaucau

SEQ ID NO: 61850 - RNA, 64 nt, Human
auucacauaguccucagggcucagucuuuugagguaaguggaauuagagggccuugcuucucuu

SEQ ID NO: 61851 - RNA, 64 nt, Human
gacucggccuucaccucccuucuccuccuguguuuaaguggauggccccucuauccauccaggu

SEQ ID NO: 61852 - RNA, 64 nt, Human
uaggaucuucacugucuuacucaagauacuggacuaaguggaacguucucuaccuucaacaugu

SEQ ID NO: 61853 - RNA, 64 nt, Human
aauagucauuaaaaacauagaaaaaugaugucuuuaaguggagaauuguggaaggauuguaaca

SEQ ID NO: 61854 - RNA, 64 nt, Human
gauagaauucaauuaaagcgauuugaaugcacaguaaguggauaaucugaguacaaugaaauuu

SEQ ID NO: 61855 - RNA, 64 nt, Human
ucagugcauagcuuuaagccaguguuggauucacuaaguggacagccagucucccagcucucug

SEQ ID NO: 61856 - RNA, 64 nt, Human
ccuauccuccugccucccuaucuuggaaacugauuaaguggaaacuuuccuuguaucaaauccu

SEQ ID NO: 61857 - RNA, 64 nt, Human
ucuaauaaugcugaagaccccaaagaucucauguuaaguggagaaaggguuuugcaaacugaaa

SEQ ID NO: 61858 - RNA, 64 nt, Human
ccagaaacacaucccugucuccaaauuuguuggcuaaguggagacacuucugagaacugacuag

SEQ ID NO: 61859 - RNA, 64 nt, Human
acaucccgacuuacguuuuucuaccuugcccagauaaguggauacaaccacucuauauuacaag

SEQ ID NO: 61860 - RNA, 64 nt, Human
uuuauggugaaccugugucuuggagcugacuuacuaaguggaaugagccgaggauuugaauauc

SEQ ID NO: 61861 - RNA, 64 nt, Human
uaugcagugcuuguuguccaaauagaaaugaaaauaaguggaagagagaggaagaagucaaacc

SEQ ID NO: 61862 - RNA, 64 nt, Human
aaagauagaguauccuuaugguugaguuuccauauaaguggaccagacacagaaacaaacagaa

SEQ ID NO: 61863 - RNA, 64 nt, Human
ugaauuuuuuggccauuuacauagacauaucuauuaaguggaaagaaggcuuucugaagucugu

SEQ ID NO: 61864 - RNA, 64 nt, Human
uuuuuuuuuuaagcaagauuuguuuuacuauaaauaaguggauuauuucaaugcaggcaaaauu

SEQ ID NO: 61865 - RNA, 64 nt, Human
uggcaagguaaacuaacagcucaaauucccaauauaaguggaccaguuccucauaaacugucaa

SEQ ID NO: 61866 - RNA, 64 nt, Human
ccaaaauucaggaacuacuagagugaaaugauauuaaguggaaaccagagauaaaugcuguuaa

SEQ ID NO: 61867 - RNA, 64 nt, Human
gggcgggguuuuggggcgugaacaaggcuggcaguaaguggacaagcugcuccccuggcuaagg

SEQ ID NO: 61868 - RNA, 64 nt, Human
ucaggaaaugaggaaauaauggaacuauuuuuuuuaaguggagguaguuuguucuccaaggggg

SEQ ID NO: 61869 - RNA, 64 nt, Human
gccaccgccucucugccuaccaccauuccauauuuaaguggagccccuacguagaaaggccccg

SEQ ID NO: 61870 - RNA, 64 nt, Human
uuuuuguuuuuugacuucugccuauacccugggguaaguggaguugggaaauacaagaagagaa

SEQ ID NO: 61871 - RNA, 64 nt, Human
uuucaugucuggaccucagccuauauccugagacuaaguggaagugggaaaagaguacaagaga

SEQ ID NO: 61872 - RNA, 64 nt, Human
guucuagcauuaaucaacaucagugaguccauacuaaguggaaaucauauaaaugaaauguaug

SEQ ID NO: 61873 - RNA, 64 nt, Human
uaucuaugaauuugauauauauuuguaccucauauaaguggauucuacaguauuuaucuuuuga

SEQ ID NO: 61874 - RNA, 55 nt, Human
auuuucguguagggcaguaguuccguaaguggaagcccagcccccucaacaucug

SEQ ID NO: 61875 - RNA, 64 nt, Human
aggacauuaaaauguaacaugcaugaugaaaaucuaaguggagaugguauuugugguuaauuau

SEQ ID NO: 61876 - RNA, 64 nt, Human
agcuggaaacuaaauuggcaacauguugauaauuuaaguggaguguuuuguucauggagacuua

SEQ ID NO: 61877 - RNA, 64 nt, Human
ucaauuaaaugaguaaaggaagcccaaguacuuuuaaguggaggaaaugaaguacugugaauuu

SEQ ID NO: 61878 - RNA, 64 nt, Human
cuuacuggcuuuugacaugacuucucuuggagaauaaguggacuccaagcuaacucuuugcaaa

SEQ ID NO: 61879 - RNA, 64 nt, Human
aaaauguguuucuacaagacuuuauauuuuaagcuaaguggaauaauacaacguaacuaaaaca

SEQ ID NO: 61880 - RNA, 64 nt, Human
uaaguaauaaaguguuuuuauuuguuaaccaguuuaaguggauccugugguaacuuaaacuguu

SEQ ID NO: 61881 - RNA, 64 nt, Human
gagaaagauggaaaaaagacaugggguagggacguaaguggaaaucuauagccacagccugaag

SEQ ID NO: 61882 - RNA, 64 nt, Human
gauuucagauguaagaagcccgauccacauugcauaaguggacccagcugccagaugugugggc

SEQ ID NO: 61883 - RNA, 64 nt, Human
ucaaaagauuccuuuuuaucauccccacgcuguguaaguggaaagggcauuguguuccgugugu

SEQ ID NO: 61884 - RNA, 64 nt, Human
cagcaucucagaucuacagaacaagaaucucugcuaaguggaccuggaaucuuccaucugcauc

SEQ ID NO: 61885 - RNA, 64 nt, Human
ccuggccccaguacccaggguggcacgacugggcuaaguggacacugagcuucaucaggcccuc

SEQ ID NO: 61886 - RNA, 64 nt, Human
ugacuucauugccaagaagagaagaaaaugcauuuaaguggaaaucggaccucuaauccaagca

SEQ ID NO: 61887 - RNA, 64 nt, Human
augguuugugguacaacuucauucuauagaauauuaaguggaagugggugaauucuacuuuuua

SEQ ID NO: 61888 - RNA, 64 nt, Human
ggcaucauccucaucauguuguauuccagcuucuuaaguggaaggaaaagagugcugagaaaug

SEQ ID NO: 61889 - RNA, 64 nt, Human
acauugcccaaacagcaaggguuggagaguggcuuaaguggaaugcuucaggggugguggguug

SEQ ID NO: 61890 - RNA, 64 nt, Human
gaaaaugcugcucuucuaaguccuuuguggcuuguaaguggagaagaauuucauccaaauguua

SEQ ID NO: 61891 - RNA, 64 nt, Human
aguacacaauuaaaucuguggugaagucauuuucuaaguggaagaggaaauuuuaaaguguggu

SEQ ID NO: 61892 - RNA, 64 nt, Human
ggacuuagugguccucuguugcuauugucuucuauaaguggaguuucaugacuuacugcuuaac

SEQ ID NO: 61893 - RNA, 64 nt, Human
uuuuuuuuuugaucgauugaaaucuuuugccaacuaaguggacaucagucuccauuuuuggcua

SEQ ID NO: 61894 - RNA, 64 nt, Human
uuucuguggcuuuuucuauucuggauauuucauauaaguggaauuacacaauauauguggucuu

SEQ ID NO: 61895 - RNA, 64 nt, Human
accuauucucccaccccaggugccuucaggacaauaaguggaacuacauuagagcuggucaggu

SEQ ID NO: 61896 - RNA, 64 nt, Human
ccgucggccacaagauccucagcgggcagcggaagcucgagauggaggggcggcagguggugag

SEQ ID NO: 61897 - RNA, 64 nt, Human
uagaaaugccugugaagaccuuggcagcgacguggcucgagaagcauucaucauuacuguggac

SEQ ID NO: 61898 - RNA, 64 nt, Human
uuucccgggcacaggccugcgccgacccgacccugcucgagagcccgcgcuagagucggggagg

SEQ ID NO: 61899 - RNA, 64 nt, Human
cuggcuuuagacggggagaaacaucuggaaggaugcucgagagaacaaauggagguggugaaaa

SEQ ID NO: 61900 - RNA, 64 nt, Human
caaucaaaauggugggcucuagaaugguuuuggagcucgagaucuucauggguuagacuugcug

SEQ ID NO: 61901 - RNA, 64 nt, Human
gggugaguggguuugcuccacaccguccugugcugcucgagaggaccugggacgugcgagggaa

SEQ ID NO: 61902 - RNA, 64 nt, Human
guggagaguucucucaggucaggucugcagcagagcucgagacagggaucugaaugcacuuggu

SEQ ID NO: 61903 - RNA, 64 nt, Human
aaaaaccauugucuuaccucccaacuggaagacagcucgagauccagaagggaagauuuauuac

SEQ ID NO: 61904 - RNA, 64 nt, Human
ugaccgaucucccuccuccucaccccaagugaaggcucgagacuuccugccccacccagugggu

SEQ ID NO: 61905 - RNA, 64 nt, Human
uucacaauacgguggaauuucaaaagcuggaagagcucgagaucaugccucaggcaaaggcgug

SEQ ID NO: 61906 - RNA, 64 nt, Human
uguugguagauuacaacucuuuuuauuugaaguugcucgagaaguuagacaugcuuuagaauua

SEQ ID NO: 61907 - RNA, 64 nt, Human
uuaacuuaagggaggcuaauuuuuaauuuaaacugcucgagauaugaguucugcaaaagguggu

SEQ ID NO: 61908 - RNA, 64 nt, Human
ccuugagaggagaaaugcaauaacucugggaggggcucgagagggcugguccuuauuuauuuaa

SEQ ID NO: 61909 - RNA, 64 nt, Human
cacaacacugccccagagggugggaccacugcaagcucgagaccuugcuuggugacaugugcca

SEQ ID NO: 61910 - RNA, 64 nt, Human
uucccuggccauguugcaaacagcgcaauuccaagcucgagagcuucagccucaggaaagaacu

SEQ ID NO: 61911 - RNA, 64 nt, Human
ccauaggccgaugcucugaaagaagagacguggggcucgagagauuuaaagauuuuauuuuuac

SEQ ID NO: 61912 - RNA, 64 nt, Human
ccuggugugguggcacacaccuguagucccagcugcucgagaggcugaggcacgagaaucaguu

SEQ ID NO: 61913 - RNA, 64 nt, Human
agcuacaacuccacaucaacuccacaugcgcccagcucgagacugaugaguggaaucagcuucc

SEQ ID NO: 61914 - RNA, 64 nt, Human
uuugggcugagcuguuagaggggcuucuccagaggcucgagagcaggccauuucccaagaagau

SEQ ID NO: 61915 - RNA, 64 nt, Human
cagauggccaggaagggcccuggccucuaaacuggcucgagagcaucuuggccccggccaccuu

SEQ ID NO: 61916 - RNA, 64 nt, Human
ggaaucccuuugcuuaggcccaaccuggucgauagcucgagaaagaauuuuuuccaaggaaaug

SEQ ID NO: 61917 - RNA, 64 nt, Human
cuuuaugccggaugugcuuuucuccaauaucagugcucgagacacagugaagcaaauuaaaaaa

SEQ ID NO: 61918 - RNA, 64 nt, Human
acacuuuuaaaccuaaagagccuuauuauuauuagcucgagaaauaccacaugccagucuuccc

SEQ ID NO: 61919 - RNA, 64 nt, Human
gcaccccagcgcagccuggcgccgcgggacugaagcucgagaagggccugaccuaaaggucagg

SEQ ID NO: 61920 - RNA, 64 nt, Human
gacuuaguucagugcagagagauaggugaggccagcucgagaucuuauaccacucuguauugga

SEQ ID NO: 61921 - RNA, 64 nt, Human
ggaaucgaacaccagucaugccuacuggcucucugcucgagagccaauacccugugcccuccac

SEQ ID NO: 61922 - RNA, 64 nt, Human
uuccugacuuacuaauacuaaagaaguugggggagcucgagagccagacggccagacaggcaga

SEQ ID NO: 61923 - RNA, 64 nt, Human
caaagcaaggucuugcuucuaucugggggacgcugcucgagagaggccaagaggccgcagaaca

SEQ ID NO: 61924 - RNA, 64 nt, Human
gaggcugaggcaggcggaucacuugaggucaggagcucgagaccagccuggccaacacggugaa

SEQ ID NO: 61925 - RNA, 64 nt, Human
gugcaggggucuccugccugugccauccacuggggcucgagacaauuucccacucaccugugag

SEQ ID NO: 61926 - RNA, 64 nt, Human
guguaagccacuagucuguggcauuguuauagcagcucgagaagacuaaggcagaugggcuucc

SEQ ID NO: 61927 - RNA, 64 nt, Human
uaggugaaacccccuacccuccccaacguuaaaugcucgagaggaaucuuccacaaggcagggc

SEQ ID NO: 61928 - RNA, 64 nt, Human
ucugaaggaacgucguaaggaagcugaacggauugcucgagaaagagaggaacucagaaggcaa

SEQ ID NO: 61929 - RNA, 64 nt, Human
gaggccaagguggguggaucaccugaggucaggagcucgagaccagccuggccaacauggugaa

SEQ ID NO: 61930 - RNA, 64 nt, Human
gaggcugagguggguggaucacuugaggucaggagcucgagaccagcuuggccaacauggugag

SEQ ID NO: 61931 - RNA, 64 nt, Human
cacaugcacaccaacaugcaugccgccggcacaugcucgagacguguggacaccccagcgugcg

SEQ ID NO: 61932 - RNA, 64 nt, Human
acagaugccaugguaugggccacaggacacacuugcucgagaaccaaagugcauuugggugaca

SEQ ID NO: 61933 - RNA, 64 nt, Human
gucugaugugaaaauucaaucacgacguuaaccggcucgagagagcgccggccuagaggcucau

SEQ ID NO: 61934 - RNA, 64 nt, Human
uuaaacuuaugaaaauguauuaagaaagagugcagcucgagagagauucagagauggaacacac

SEQ ID NO: 61935 - RNA, 64 nt, Human; identical to SEQ ID NO: 61934

SEQ ID NO: 61936 - RNA, 64 nt, Human; identical to SEQ ID NO: 61934

SEQ ID NO: 61937 - RNA, 64 nt, Human
gaaguugaaacccuagggcacccccaccaccucugcucgagagguccgugggggaggccguggg

SEQ ID NO: 61938 - RNA, 64 nt, Human
gggaggccaaggcggguggaucgcgagaucaggagcucgagaccacccuggccaacauggugaa

SEQ ID NO: 61939 - RNA, 64 nt, Human
aaagcacugauuacccaaugcaccucccuccccagcucgagaucauucuucacucaggacacaa

SEQ ID NO: 61940 - RNA, 50 nt, Human
agcacgugcgccuccacuaagcucgagacccggccugugcugcccugccc

SEQ ID NO: 61941 - RNA, 64 nt, Human
ucacauggcgcccagcacugggcuucagccaggugcucgagagcuuugaggccaugaucucugc

SEQ ID NO: 61942 - RNA, 64 nt, Human
uuguuuuauaauuccuauugcaaccucgugcacugcucgagacacaagugcugcuguaguuagc

SEQ ID NO: 61943 - RNA, 64 nt, Human
ucuucaccccucgcagauggagcggcagcgccucgcucgagagaagcagaugagggaggaggcu

SEQ ID NO: 61944 - RNA, 64 nt, Human
gcuuuggggagaugggcgauaaguguugagguaggcucgagaacugcuccccaaaucagugaga

SEQ ID NO: 61945 - RNA, 63 nt, Human
ucccaccucccaccugaccccagcggcuccgguguccuccacguggcugcccuggggagcaau

SEQ ID NO: 61946 - RNA, 63 nt, Human
gucugucuggaaguguuaaguggaaugggcuuuguccuccaggaggugggggaaugugguaac

SEQ ID NO: 61947 - RNA, 63 nt, Human
ccaucuauuucagccuucugcugccuuugccugguccuccagguugcugggggcaccacagac

SEQ ID NO: 61948 - RNA, 63 nt, Human
caucgaggcucuuuaaagcuucagcuccccacuguccuccaucaaagucccccuccuaacguc

SEQ ID NO: 61949 - RNA, 63 nt, Human
ugcccccguccauccaugagccagcauccguccguccuccacucuccagccucuccccagccu

SEQ ID NO: 61950 - RNA, 63 nt, Human
uucugagccugcuuuugugauugcucauccauuguccuccacuagaggggcuaagcuugacug

SEQ ID NO: 61951 - RNA, 63 nt, Human
ggcucuccagccugucccagucucagcagggauguccuccaggugacagaggguggcaaggug

SEQ ID NO: 61952 - RNA, 63 nt, Human
ccuuuccccagauccaccuguccugacacucuaguccuccaggauagugcuccucccccagcu

SEQ ID NO: 61953 - RNA, 63 nt, Human
ucuucaaggacaaauuccuucuguucagccuugguccuccaacugcaguuuacaauuuuuguu

SEQ ID NO: 61954 - RNA, 63 nt, Human
gaucuucaaaagugguuuguauaacuuuguccuguccuccaccuuucuaucccuauguauuua

SEQ ID NO: 61955 - RNA, 63 nt, Human
uuugcggcaauggaccgaagaacgggccaggaaguccuccaauuuccuuuggucuuuccagga

SEQ ID NO: 61956 - RNA, 63 nt, Human
ugagaaacguacacuaucauugcuaaacuaacaguccuccagaaauuuaauaagauguuuuug

SEQ ID NO: 61957 - RNA, 63 nt, Human
cuugccucuagagggggaauuguucauccauuuguccuccaguuuuauaggaacaagagacua

SEQ ID NO: 61958 - RNA, 63 nt, Human
cagcaaaaacacuuuccuuucuacugacaaccaguccuccacaucacagcauuuagacauaug

SEQ ID NO: 61959 - RNA, 63 nt, Human
gggugcaggcgcaggugcaggcacagggccacuguccuccaggcaggcuuuuuggugcuaggc

SEQ ID NO: 61960 - RNA, 63 nt, Human
cccacacucaggccagcccucuugggaagguggguccuccaugggggucccuucaggaacuuu

SEQ ID NO: 61961 - RNA, 63 nt, Human
ccugucaccagacccgagucaauuaaacagcugguccuccacuuugcugguucagccuucgug

SEQ ID NO: 61962 - RNA, 63 nt, Human
aaggaggauucgagcaucaggcuaagacccuguguccuccaccaugcacucaccccuagcccu

SEQ ID NO: 61963 - RNA, 63 nt, Human
cacccaaaccuuucacuuuccaaagagcuagccguccuccacccaguaccauguccuagccug

SEQ ID NO: 61964 - RNA, 63 nt, Human
agcccuccugugccugcuucccugugugucgggguccuccagggagcugacccagagguggag

SEQ ID NO: 61965 - RNA, 63 nt, Human
auguggugacucucccgguagacccuagcaaggguccuccaugguggugagggacucaggaga

SEQ ID NO: 61966 - RNA, 63 nt, Human
gaggcccucagcaagcccuggccccaacucggaguccuccagugaucuccggagcuaguuccc

SEQ ID NO: 61967 - RNA, 63 nt, Human
uugagggaccaccucacccugcaaaagagacagguccuccaguacccugucuucuagccccac

SEQ ID NO: 61968 - RNA, 63 nt, Human
cuccaucuccugaccucgugauccgcccgccuuguccuccaaagugcugggauuacaggcaug

SEQ ID NO: 61969 - RNA, 63 nt, Human
cacaaugggguccuucuguaggcaaagguggaaguccuccagggauccgcuacauccccuaac

SEQ ID NO: 61970 - RNA, 63 nt, Human
guuuacuuguccugucacuggaucugggcuaaaguccuccaccaccacucuggaccuaagacc

SEQ ID NO: 61971 - RNA, 63 nt, Human
cugaaagcuggggagccugaacauucacuccuuguccuccaugcuguggcuguaucagcuccc

SEQ ID NO: 61972 - RNA, 63 nt, Human
aggggucaaaaaugguauagugaccccguccacguccuccaagcucacgaccuuggagccccg

SEQ ID NO: 61973 - RNA, 63 nt, Human
guuauuuucaagggaagaaccuuuuaaauuaugguccuccauuuacuacuuccacugagagua

SEQ ID NO: 61974 - RNA, 63 nt, Human
cagcaugucacucccagaccaccucccugcccuguccuccagcuuccccucgcuguccugcug

SEQ ID NO: 61975 - RNA, 63 nt, Human
agggaagagcaccgccggggccacaggacgucuguccuccagucacaggccauccuugcugcu

SEQ ID NO: 61976 - RNA, 57 nt, Human
acaugaccuugggcacaugaagaucauguccuccaagccaugaaagugucuacgcuu

SEQ ID NO: 61977 - RNA, 63 nt, Human
guagggacagugcccaggugaaggaugccccugguccuccagggcacugacuuugcccuuuuu

SEQ ID NO: 61978 - RNA, 63 nt, Human
ggaccgcccacaugggaccgcccacauagaaccguccuccaguggugaagcggaaacacuuag

SEQ ID NO: 61979 - RNA, 63 nt, Human
ccugagggaucaggagcaaacagacccugcaagguccuccaggccuggggacaggaaagccac

SEQ ID NO: 61980 - RNA, 63 nt, Human
cuugucaaccaugaccaucuuugagccuuccuaguccuccaccuggcacaguauuugaaaugg

SEQ ID NO: 61981 - RNA, 63 nt, Human
gaaagacaggaugaccuuggacaaggccaaacuguccuccaagacuccuuaaugaggggcagg

SEQ ID NO: 61982 - RNA, 63 nt, Human
agaaagcuaagcucugagcugaggaaacaagguguccuccaucccccagugccuucacaucuu

SEQ ID NO: 61983 - RNA, 63 nt, Human
ucaaaccugaugauucuuggauauuuagcuauuguccuccaaagagucaucguuucacguuuu

SEQ ID NO: 61984 - RNA, 63 nt, Human
uugcaaggagacgcaaaauuuuauuuuaaaacuguccuccauaauaaucaaacggugauucau

SEQ ID NO: 61985 - RNA, 63 nt, Human
accccuucugaagccauccguagaaaguacuuuguccuccaaaaagcuaacauacgguuuuga

SEQ ID NO: 61986 - RNA, 63 nt, Human
gugccagugccugugccagagguggcgaggugaguccuccagagcuuccuggccgggcccucc

SEQ ID NO: 61987 - RNA, 63 nt, Human
aaaguugaucucucccagugggcuguaggcaggguccuccauggguuuccaacccccaucacu

SEQ ID NO: 61988 - RNA, 63 nt, Human
aacaaguuuacaguuguaagugcaaugacccgaguccuccacaugaccuugugaauugugugc

SEQ ID NO: 61989 - RNA, 63 nt, Human
ggcauagagcagcucacucccagggauugauuaguccuccacugcccugggugcaugcguaca

SEQ ID NO: 61990 - RNA, 63 nt, Human
gccuaauugagguugguggauucacacauggggguccuccaggaccucagcugcacccauuuu

SEQ ID NO: 61991 - RNA, 63 nt, Human
uuugcaauuuuucauaauaaaaaaguuuuaaaaguccuccaguuuccaacacacucaagagag

SEQ ID NO: 61992 - RNA, 63 nt, Human
uucucuuguccucuuucuccuauuucuuacccuguccuccaccugccuuccauuuugaagugg

SEQ ID NO: 61993 - RNA, 63 nt, Human
ucccugaagauucuuuucaagauccuguucaggguccuccaggcaucagcuguuguguccucu

SEQ ID NO: 61994 - RNA, 63 nt, Human
acugagggaacucagaggccagcgccggugcggguccuccacaugcugagcgccgguccuggg

SEQ ID NO: 61995 - RNA, 63 nt, Human
acaaacaaggaggcacguuuggcacaaaguguuguccuccagguccaaguggacucuacagag

SEQ ID NO: 61996 - RNA, 63 nt, Human
gauuuuacccagaauacuugccgccugcuuuuuguccuccaggaaaccagaagcccggguaau

SEQ ID NO: 61997 - RNA, 63 nt, Human
cccuaaacuugggcggccuugcccugagagcugguccuccagcgaggcccugucagcggucuu

SEQ ID NO: 61998 - RNA, 63 nt, Human
uuauaaaaccagaggcccucugagaucaugugaguccuccauggcaaggaagcaguuccaggg

SEQ ID NO: 61999 - RNA, 63 nt, Human
gaagaacccucugucccaccccuagccaccaguguccuccaagugcccccucaccucuccagg

SEQ ID NO: 62000 - RNA, 63 nt, Human
uacccagucuucaacucccgggucagauccuguguccuccauaaaaaauuuuccagacaacuc

SEQ ID NO: 62001 - RNA, 63 nt, Human
cugauacagcuggcuauucagggucacccagcaguccuccagcaagguagaaacaccaaauca

SEQ ID NO: 62002 - RNA, 63 nt, Human
aauaucuaaagcaguuuacucaucaauugaaaaguccuccaaaaagagaacuauugggaaacc

SEQ ID NO: 62003 - RNA, 63 nt, Human
gcccccagaugcccaggcucacuucaguguugaguccuccauugaggaugcccacugaggcag

SEQ ID NO: 62004 - RNA, 63 nt, Human
accuggcagcagacugugcaggagccccaaccuguccuccaauuccagcauucacagcugaug

SEQ ID NO: 62005 - RNA, 63 nt, Human
auucaaauuuuucuaacauauggaaagccuuuuguccuccaaagaugaguacuagggaucaug

SEQ ID NO: 62006 - RNA, 63 nt, Human
uggaacugacccuuccuucauccucaaccugcuguccuccagaaagcaccaaggaaaaagcag

SEQ ID NO: 62007 - RNA, 63 nt, Human
cgagagggcucuuccuccaaauccuccccaccuguccuccaagaacagccuucccugcgccca

SEQ ID NO: 62008 - RNA, 63 nt, Human
agaguguguuggggugggauggggcaggccgugguccuccagcaugaagaaggagccaugagg

SEQ ID NO: 62009 - RNA, 63 nt, Human
accacagcugcuggccaggguagacuuggagcuguccuccagaggggucacguguaggaguga

SEQ ID NO: 62010 - RNA, 63 nt, Human
uaccugcuggugcagagcugaagauuuuggaggguccuccacaauaaggucaaugccagagac

SEQ ID NO: 62011 - RNA, 63 nt, Human
acacggcaucaucccaucucuaauuuccccucuguccuccauccagcggcuucuuccgcuuca

SEQ ID NO: 62012 - RNA, 63 nt, Human
ucuuccagcgagcuuaauugcguaaucccuguuguccuccaggguaagcugacacgucuacau

SEQ ID NO: 62013 - RNA, 63 nt, Human
acaccucuuauagagguugauaggacugcuuggguccuccacuguccucugucaaucuaguua

SEQ ID NO: 62014 - RNA, 63 nt, Human
gcuuggcuccuacaaggcccagaaaaccagcagguccuccagcauccccugcagcgguucccu

SEQ ID NO: 62015 - RNA, 63 nt, Human
cgguggcucaguuaaggaaugagaagauagaggguccuccacuuucagcucaugcuuuuuuau

SEQ ID NO: 62016 - RNA, 63 nt, Human
cccuuuccucccuucugauaagacuggaaaauaguccuccaaaacacaagggaggauuuuggg

SEQ ID NO: 62017 - RNA, 63 nt, Human
caggauggcgccaaacucagccuucaggacucuguccuccagcagaguaacauuauuguucuc

SEQ ID NO: 62018 - RNA, 63 nt, Human
uuaaagaaaauguauugugauugaaauuauuuuguccuccacaagauggcucuaugaguauuc

SEQ ID NO: 62019 - RNA, 63 nt, Human
auggaauguuuugauugagcaaugaaauaaacaguccuccauuuuguuucugcuugaguggug

SEQ ID NO: 62020 - RNA, 63 nt, Human
gaugcuacagaugucauuugucucccgcccuaaguccuccagucuccuuagagcuaguacuua

SEQ ID NO: 62021 - RNA, 63 nt, Human
ggcgccccucaguauucgcugccauaugucccuguccuccaggcuguaggggaggagagccug

SEQ ID NO: 62022 - RNA, 63 nt, Human
gagguagcuuucucagagccccuuggugguucuguccuccaaaugcugcuguugggagcgggc

SEQ ID NO: 62023 - RNA, 63 nt, Human
ccucccauagucuagagggaugcccauuccaugguccuccagagaauaguuuugacuuaacau

SEQ ID NO: 62024 - RNA, 63 nt, Human
cagguggacaugccagagagaaaagcaguagagguccuccaugccagccccacggugguccau

SEQ ID NO: 62025 - RNA, 63 nt, Human
auaaaggagggaagagguagaagggaaccauggguccuccagcuagagggggaguuuacuaaa

SEQ ID NO: 62026 - RNA, 63 nt, Human
aaaucacugcucugaaccaguguucuccaccuuguccuccacagaucucauaggaaauguuca

SEQ ID NO: 62027 - RNA, 63 nt, Human
aguagaauguuugcuuucuucuucuuggaaauaguccuccaaaaaguccacuuguaccaguga

SEQ ID NO: 62028 - RNA, 63 nt, Human
caagugcacgagggguuaggcugcugucccugaguccuccauucuguacuggggggcuggcua

SEQ ID NO: 62029 - RNA, 63 nt, Human
gccaaauccugcuuuuccaguuuggcuccacaaguccuccaggacagagcccucaaagcaacu

SEQ ID NO: 62030 - RNA, 63 nt, Human
augaccccaacgagguauagacaugccacggcgguccuccaggcagggaacaagcuucuggac

SEQ ID NO: 62031 - RNA, 63 nt, Human
ccaucuccagggggccuucccagccugaucccuguccuccaaguucuggaggaggccgcugua

SEQ ID NO: 62032 - RNA, 63 nt, Human
cccuggcuguguucuggaaguucaagacacuuaguccuccacaguggguggaagagugcaagg

SEQ ID NO: 62033 - RNA, 63 nt, Human
gcacguaucccuuucaugaguccagggaagaggguccuccaggucuuggaagacagaggggag

SEQ ID NO: 62034 - RNA, 63 nt, Human
aaauuauucaggccuauaguuuccauuacuggaguccuccauuguguggccacacagugucgu

SEQ ID NO: 62035 - RNA, 63 nt, Human
uuuuucuugaacuucuugcaauaguaacugaauguccuccauuucagagucagcuuaaaaccu

SEQ ID NO: 62036 - RNA, 63 nt, Human
aucuguacagagcgcugucucaggucaugcauuguccuccaaacccaaagguuuuuuucaggg

SEQ ID NO: 62037 - RNA, 63 nt, Human
uuuuauuuuuauuaaucucuguauccuuagauaguccuccaacaaccaaagguugggacucug

SEQ ID NO: 62038 - RNA, 61 nt, Human
aacuaaauuuuugauagaauuaaauuuaaauuuguccuccaacuguuugccuuucauuugu

SEQ ID NO: 62039 - RNA, 63 nt, Human
ugcucugccagccccuguucauccaaguuuuaaguccuccacccuguucuaagagacuguucc

SEQ ID NO: 62040 - RNA, 63 nt, Human
gccucagccucccaaguagcucggacuacaggcguccuccaccaugccuggcuaauauuuugu

SEQ ID NO: 62041 - RNA, 63 nt, Human
aggaaaacaugcugcucuggugcacgccugagcguccuccaucuuccaggauggcagcaaugg

SEQ ID NO: 62042 - RNA, 63 nt, Human
acucuuucgauacccaggaccaagccacagcagguccuccaucccaacagccaugcccgcauu

SEQ ID NO: 62043 - RNA, 63 nt, Human
acucccagaggcugccaccggggagaagcagcgguccuccauccagaaccuaagggcugaagc

SEQ ID NO: 62044 - RNA, 63 nt, Human
ccccggaggacgugaugugagacccgcuugugaguccuccacacucguuccccauuggcaaga

SEQ ID NO: 62045 - RNA, 63 nt, Human
gacauuaaauuugguacauuucaaaacuucuagguccuccaaagauugaaagcuuaauaaucu

SEQ ID NO: 62046 - RNA, 63 nt, Human
aagucuuuauucuucacaguagauaaugaaagaguccuccagugucuuggcaaaauguucuag

SEQ ID NO: 62047 - RNA, 63 nt, Human
aacugaauauggguccccaaauguucccagaggguccuccacacccucugccgacuaccacgg

SEQ ID NO: 62048 - RNA, 63 nt, Human
gcuucagcccagagccagagggcugggucccggguccuccacaggugaccccgguggacacac

SEQ ID NO: 62049 - RNA, 63 nt, Human
ucccuucaaucacagccccuuccccuuucugggguccuccauaccuagagaccacucugggag

SEQ ID NO: 62050 - RNA, 63 nt, Human
ccucccggaagcuguggacgaaagggagagcggguccuccagggcaaggggaacgggaaauag

SEQ ID NO: 62051 - RNA, 63 nt, Human
gggcacugccggcgccuugucugcacacuggagguccuccauuacagaggcccagcgcacauc

SEQ ID NO: 62052 - RNA, 63 nt, Human
acuucccugaguccucaccagcccuccccauuuguccuccaagacuccacucaaacaucuccu

SEQ ID NO: 62053 - RNA, 63 nt, Human
gggagaggcccugaacccugugcgggagagcugguccuccagcccuggcaggcccucagccag

SEQ ID NO: 62054 - RNA, 63 nt, Human
cuucccaugugcagucccuguccccccccgccaguccuccacacccaaacuguuucugauugg

SEQ ID NO: 62055 - RNA, 63 nt, Human
uccgaauucuuccagcccagcuucccgggcucuguccuccauaucgaauaauaaugacacaua

SEQ ID NO: 62056 - RNA, 63 nt, Human
guccugcucaucuguggccacugccuucuagccguccuccaccuugcagaaagaaucuagccu

SEQ ID NO: 62057 - RNA, 63 nt, Human
gaucuccuccagcaagucuguccccaccuugucguccuccaccacacacugaaucuguagcuu

SEQ ID NO: 62058 - RNA, 63 nt, Human
gcggcuccuaacgugucugugugaugaccaguuguccuccaaaaaccucacucaccacggagu

SEQ ID NO: 62059 - RNA, 63 nt, Human
gccuguguccacagugcugugaucccgagggaaguccuccagucuaagucacagugcccugac

SEQ ID NO: 62060 - RNA, 63 nt, Human
guccggaagccgggugccauagugaggacccucguccuccagacuggcuggcaggagucaggc

SEQ ID NO: 62061 - RNA, 63 nt, Human
ugccugccccugagcccugugucgggaugucauguccuccaggcuggggccaugugagugccc

SEQ ID NO: 62062 - RNA, 63 nt, Human
uuccuccugggcucuguccccugcucccccuuuguccuccaucccgacuccaucucccccacc

SEQ ID NO: 62063 - RNA, 63 nt, Human
augucuaaacagauggauggugggcacagauggguccuccaugcuggcaaugcguuacagguu

SEQ ID NO: 62064 - RNA, 63 nt, Human
guugucuugcuuuucuucccauugcaccagcuuguccuccaaaaucaugaaugauacacauga

SEQ ID NO: 62065 - RNA, 63 nt, Human
ugcaaauaaccgcagccccagcccagccugccuguccuccagcugucugacuauccauccauc

SEQ ID NO: 62066 - RNA, 63 nt, Human
cugggaggucccuuucucccucggugaaacacaguccuccacaucaauuuccaaacaaugaau

SEQ ID NO: 62067 - RNA, 63 nt, Human
caggccuccuguuguggagggacuccugggacaguccuccacccuguccugugguccugugua

SEQ ID NO: 62068 - RNA, 63 nt, Human
gggagcacuggugugaacucacccugggagccaguccuccacucgacccagaauggagccugc

SEQ ID NO: 62069 - RNA, 63 nt, Human
cugagcaggacguuaggcccgggccccuggcacguccuccaccggugccuccucuggggaagg

SEQ ID NO: 62070 - RNA, 63 nt, Human
aucaaagccuggcgcuccccacgcaccaugcgcguccuccaggcaccucgcccacggccucgc

SEQ ID NO: 62071 - RNA, 63 nt, Human
cuggaguggagguucaggaccaaggggcuucugguccuccagccccuguacucggccaugccc

SEQ ID NO: 62072 - RNA, 63 nt, Human
uugcacaaaggcugcaaagcuggacucaggaauguccuccaaccagcagcgcugaccuaagag

SEQ ID NO: 62073 - RNA, 63 nt, Human
gguuuucacugaauucugagggugccucugcauguccuccaaggcaaaguuuggcaaacugug

SEQ ID NO: 62074 - RNA, 63 nt, Human; identical to SEQ ID NO: 62073

SEQ ID NO: 62075 - RNA, 63 nt, Human
agauuuugugguguuuucuuuaacccaugugauguccuccaaaauguguaggguaaaaauuca

SEQ ID NO: 62076 - RNA, 63 nt, Human
cccuuugcacagaacuaugcuuaucucauguuuguccuccauaaacaaauggccauuuuuuuc

SEQ ID NO: 62077 - RNA, 63 nt, Human
aacuucugcacccucuguccagagucuagggcaguccuccacuggcccagcacuccaguuucc

SEQ ID NO: 62078 - RNA, 63 nt, Human
uuagguccuguaucugauguugugguuaguggaguccuccagcaauugaaugagagcagugga

SEQ ID NO: 62079 - RNA, 63 nt, Human
acugugcugggugaaggccuccccgagcauuagguccuccacggggcugugucaaaugcccuc

SEQ ID NO: 62080 - RNA, 63 nt, Human
acagguagccauauaauugggaaaaaauucaguguccuccaugccaagcagaaaacucauagu

SEQ ID NO: 62081 - RNA, 63 nt, Human
gucaaaauccaugaaaugagaucccccagccguguccuccagcccagcccugaccccuugguu

SEQ ID NO: 62082 - RNA, 63 nt, Human
ccugccccuaagggccuguggccuauggaauauguccuccaggcuuugcucagcugagcuccu

SEQ ID NO: 62083 - RNA, 63 nt, Human
ggccaagguggccgcagucugccuuugcauccuguccuccagccacccuugcuugccacuguu

SEQ ID NO: 62084 - RNA, 63 nt, Human
uucuugccuguggguucccucacccccaugccuguccuccaggcuggggcagguucuuaguuu

SEQ ID NO: 62085 - RNA, 63 nt, Human
cuugccacacugugucgucguuuguuugccuauguccuccagggcacgguggcaggaacaacu

SEQ ID NO: 62086 - RNA, 63 nt, Human
uaaguaaguguucagaagguucuuuuuuauauuguccuccaccuccaucauuuucaauaaaag

SEQ ID NO: 62087 - RNA, 63 nt, Human
gcacagccagcccaaaccuugggcccuggaagaguccuccaccccaucacuagagugcucuga

SEQ ID NO: 62088 - RNA, 63 nt, Human
aggagggugggugaauuccaguguggucagccaguccuccacagcaccucguggcccguacuc

SEQ ID NO: 62089 - RNA, 63 nt, Human
cuuugagcaggaccucaccuuggcucuguugcuguccuccagggcgagcacuuuccacuucca

SEQ ID NO: 62090 - RNA, 50 nt, Human
ggcagaggcagggucgcugaguccuccagguccugggcagccuucauauu

SEQ ID NO: 62091 - RNA, 63 nt, Human
ggcuuaaacugacauaauaaagaucuauuuccuguccuccagcuacacccacgagaguacauu

SEQ ID NO: 62092 - RNA, 63 nt, Human
aacagaauaaccacuuguuuggagccuggcacaguccuccagccugaucaaaaauuauucugc

SEQ ID NO: 62093 - RNA, 63 nt, Human
aggaacuaacuuacccagcuuggucucuccugaguccuccacccuggccugggauuggccagg

SEQ ID NO: 62094 - RNA, 63 nt, Human
uccuggcuuuuuaacuccccuguuucaaucacuguccuccacacaagggaaggacagaaagga

SEQ ID NO: 62095 - RNA, 63 nt, Human
uugacuggcuggagccuucaaagccacugggauguccuccaggcaccugggucccaugaccag

SEQ ID NO: 62096 - RNA, 63 nt, Human
uggcuucugcacuccuuggcgucagccucucagguccuccauucacacgagguccuccucgcu

SEQ ID NO: 62097 - RNA, 58 nt, Human
ccccagcacccucacucugagcccugacguccuccaccaaccacgggcuccaggaccc

SEQ ID NO: 62098 - RNA, 63 nt, Human
ggagaaaggauggcagccucagggcuuccuuauguccuccaccacaagagcuccuugaugaag

SEQ ID NO: 62099 - RNA, 63 nt, Human
ccccgacccaccauaccuacgccuagggagcccguccuccaguauuccgucuguagcaggagc

SEQ ID NO: 62100 - RNA, 63 nt, Human
ucugauugugggaguggcaagaacuggggagacguccuccauaaguggagcacaggguauggg

SEQ ID NO: 62101 - RNA, 63 nt, Human
uguaauuuuucuuuuaugucuuauuuuccaagaguccuccauuuuuugcacccccucaccgcc

SEQ ID NO: 62102 - RNA, 63 nt, Human
uugcucucuaguuuccagaggcuuaaucacaccguccuccacgccauuuccuuuuccuucaag

SEQ ID NO: 62103 - RNA, 63 nt, Human
aucuuuguuaguagucuuaaagcugcugccauaguccuccaagaagaaagcaccaagacaaca

SEQ ID NO: 62104 - RNA, 63 nt, Human
cucaccccauuccagaacaaauccaagaggccaguccuccauaagcacaaauggaauugugca

SEQ ID NO: 62105 - RNA, 63 nt, Human
cccaggcuggucucaaacuccuaggcuuaagcaguccuccagccucagccuucucaaagugcu

SEQ ID NO: 62106 - RNA, 63 nt, Human
ccuuaguggcaucaaauggcaacauggaauauuguccuccaugccccuccagaaggaccuagg

SEQ ID NO: 62107 - RNA, 63 nt, Human
uguuugcucucucaacacacuuccccacccaccguccuccauuccagcccaggcuucuccauc

SEQ ID NO: 62108 - RNA, 63 nt, Human
ugccugugggggucaugcugccacuuuuaauggguccuccacccaacggggucagggaggugg

SEQ ID NO: 62109 - RNA, 63 nt, Human
gcgccccugagugcuuugucauauagcacagaaguccuccacacugccugggacaguguccug

SEQ ID NO: 62110 - RNA, 63 nt, Human
aacuggauuuccucccaucacuguuuuuugaagguccuccaaguccguguuaagguaaauauc

SEQ ID NO: 62111 - RNA, 63 nt, Human
uuaaagcaguaccccccuaccacacacaccccuguccuccagcaccauagagaggcgcuagag

SEQ ID NO: 62112 - RNA, 63 nt, Human
cugcuccaagaagaugggaggaaggggagccccguccuccaagggcagcacccccacuuucaa

SEQ ID NO: 62113 - RNA, 63 nt, Human
uaaccgagaaugaggagcccucccugccccaccguccuccagagaaugcgccccuccugguuc

SEQ ID NO: 62114 - RNA, 63 nt, Human
ucugggugcaauaaauaauauguagaaauuuaaguccuccaauuccagcauauccagugaguu

SEQ ID NO: 62115 - RNA, 63 nt, Human
cuggcuuacuuccaccuccugcggcccagcucuguccuccagagccuagcgucucccucaauc

SEQ ID NO: 62116 - RNA, 63 nt, Human
uucccagccaucuuccgaagaauacaagaucccguccuccaggcagugaccucccaaaccagc

SEQ ID NO: 62117 - RNA, 63 nt, Human
cguuucccuagcuuuuggcaccuggaugccacaguccuccauuaggcugaugacuccaaagau

SEQ ID NO: 62118 - RNA, 63 nt, Human
ccgaagaugaugcuccuacaaaacguaacuccaguccuccacccucucccaacaaaaauaaca

SEQ ID NO: 62119 - RNA, 63 nt, Human
aggaaacucagccaguggacuguggcagagaaaguccuccacucagaggcagagacugaguua

SEQ ID NO: 62120 - RNA, 63 nt, Human
cuuuaaucucccacaaggcaucuguugcuuuggguccuccacgacucuuaggcccgccucaac

SEQ ID NO: 62121 - RNA, 63 nt, Human
caggaccaaggagucgggaggccccugccuucuguccuccauggugagggcacagaugucucc

SEQ ID NO: 62122 - RNA, 63 nt, Human
aagaggugcagugugaucugagccuccaucauuguccuccacaaacauauuuucauauucuuu

SEQ ID NO: 62123 - RNA, 63 nt, Human
uguagcagugguuacccagacuuacagaauuauguccuccagaaaccagcaagaacacuugga

SEQ ID NO: 62124 - RNA, 63 nt, Human
aaauacauuguuuguccugcgagaauauuuuccguccuccaccaucaacauugacacugcgua

SEQ ID NO: 62125 - RNA, 63 nt, Human
gaauggagccugucucaggaaggccagcugcagguccuccagaaaaucaaagaagggaagaaa

SEQ ID NO: 62126 - RNA, 63 nt, Human
gcuuaauuuguuuuccuuguuagggucaaggguguccuccacucuuuaacagcugcuggacag

SEQ ID NO: 62127 - RNA, 63 nt, Human
ccuggccucugccauccucccuguuccccacagguccuccaucaccccugguggcugcaggca

SEQ ID NO: 62128 - RNA, 63 nt, Human
ucacugcaaccucgaccucccgaagcucagaugguccuccaaccucaaccucaguuuuuuuuu

SEQ ID NO: 62129 - RNA, 63 nt, Human
auguuuuaguuuugcuuauuuuuaaauuuggagguccuccauaaugucagauaauauugaccu

SEQ ID NO: 62130 - RNA, 63 nt, Human
uccaccauccaaggaggcacagccgucauuacuguccuccaugccuucagcagccccccucac

SEQ ID NO: 62131 - RNA, 63 nt, Human
acccucaccccaaccuguggcuaccacuguucuguccuccaucucuguaauuuugucauuuca

SEQ ID NO: 62132 - RNA, 63 nt, Human
uggccuccuuuccucagccccuuguucuucccuguccuccacccuggaccccagccggcugcu

SEQ ID NO: 62133 - RNA, 63 nt, Human
gaaaguagguagagugauuuuccuauuuauuuaguccuccagcucuuuuauugagcauccacg

SEQ ID NO: 62134 - RNA, 63 nt, Human
accgugcuugaccuguuuucuuaaaaggccuacguccuccauggaagugccagcucauuacua

SEQ ID NO: 62135 - RNA, 63 nt, Human
guggcccaggcaguggucacuacagccugauugguccuccaggucagaacggugccccacagu

SEQ ID NO: 62136 - RNA, 63 nt, Human
gauggucgccacugggcagcagcagccuuaccaguccuccaugaucacacccagggaccugca

SEQ ID NO: 62137 - RNA, 63 nt, Human
cucccaucugugcguggcccaugagcugggaugguccuccagcugcccacaagguccgccccu

SEQ ID NO: 62138 - RNA, 63 nt, Human
cuuuuuacuuuuuuugagacggggccuuauucuguccuccaggcuggagugcaaugacauggu

SEQ ID NO: 62139 - RNA, 63 nt, Human
aacuguucuucaucauugacacuggagaaagguguccuccaugcccucaggcagcagagaacu

SEQ ID NO: 62140 - RNA, 63 nt, Human
cccccggaggccgcgcccucccggaaaagccggguccuccagaccccgaggccuugcucucag

SEQ ID NO: 62141 - RNA, 63 nt, Human
cauuuccuucuccccucaggcuuuuuuugggugguccuccaaccuccaauacccaggccuggc

SEQ ID NO: 62142 - RNA, 63 nt, Human
aucgugcacacccacccauggugcacaccuguaguccuccaugaggacaugggaagguaggag

SEQ ID NO: 62143 - RNA, 63 nt, Human
ccaggacgccagguagggcagggaaccucaguaguccuccacccagccauucucagagaugaa

SEQ ID NO: 62144 - RNA, 63 nt, Human
uccgccagccgcgcccugcgccaccuacccgggguccuccacagcggaggccugcaggaaugu

SEQ ID NO: 62145 - RNA, 63 nt, Human
aggagcauuggggaacgcuucagcccaauucggguccuccaauuacugaggcauacguaacag

SEQ ID NO: 62146 - RNA, 63 nt, Human
agauugaaccgacccccgccccuccucaucgggguccuccagcgucuguuaccgagcacugcu

SEQ ID NO: 62147 - RNA, 63 nt, Human
uguccuuuucaugugauguggaaaccuacuucuguccuccaaaccaugaaaugugucaucuag

SEQ ID NO: 62148 - RNA, 63 nt, Human
guguaacacuauccugggcaaauguuuuacccuguccuccagccucccugcuucccuucuggc

SEQ ID NO: 62149 - RNA, 63 nt, Human
uauucuguagcuguagaggcauuuuaacccuuuguccuccagcaucccuucacuuccucaucc

SEQ ID NO: 62150 - RNA, 63 nt, Human
gacacccuuuggccucuguuuguccccuuuccaguccuccaccccaccccuggagcccagccu

SEQ ID NO: 62151 - RNA, 63 nt, Human
auucgccgugccucagcgagcagguguguguggguccuccaccacucaccucuugguuagcgg

SEQ ID NO: 62152 - RNA, 63 nt, Human
uuuacacacacuccacagccaagcacugccacgguccuccaggaccugggaagcaaaggcaca

SEQ ID NO: 62153 - RNA, 63 nt, Human
aagguccaagcaugaggaggaccaguuccucagguccuccagacccuuccauccucccuguuc

SEQ ID NO: 62154 - RNA, 63 nt, Human
gguggggcacggccccuacccgagaacaggaggguccuccagagaaugugccaugaucaggga

SEQ ID NO: 62155 - RNA, 63 nt, Human
ucacaguuccagcccuuguuauucuuguccuuaguccuccagggggagcugggguugcagggc

SEQ ID NO: 62156 - RNA, 63 nt, Human
aacuucucuugaaaaauggcauugccuucauggguccuccaagccaggccaugugggcuuuag

SEQ ID NO: 62157 - RNA, 63 nt, Human
cucugaaccccucccuccaucguuuucuucacuguccuccaagccagcgggaauggcagcugc

SEQ ID NO: 62158 - RNA, 63 nt, Human
uucauugacaaucuccuaauaaauugacaaauuguccuccaacauccucccaccucuuugacu

SEQ ID NO: 62159 - RNA, 63 nt, Human
ugcuggcuggagucucaggccaaauugcagaggguccuccaggguccugaagagcacuggacu

SEQ ID NO: 62160 - RNA, 63 nt, Human
uuccaccccucucagcuugagguccuaccugguguccuccaugagaaucauacaagccccgcu

SEQ ID NO: 62161 - RNA, 63 nt, Human
uaacacucaagagaggcucccuaaugugcuccuguccuccauguucugcuuggcuucguuagu

SEQ ID NO: 62162 - RNA, 63 nt, Human
ccagagccaguuuuuccaucuggcguuuccuguguccuccagguuuauaugggaaucgaaaca

SEQ ID NO: 62163 - RNA, 63 nt, Human
cuccugcugccaccaccacccagguccucccuaguccuccagcgucaacacuaucccuuggga

SEQ ID NO: 62164 - RNA, 63 nt, Human
guccuuauccaccacgcuauuauaguuuccguuguccuccaccagcauuucccuuacucugaa

SEQ ID NO: 62165 - RNA, 63 nt, Human
gugugggaugcacggccucgugggggccgggccguccuccagccccgcugcucccuggccagc

SEQ ID NO: 62166 - RNA, 63 nt, Human
cuagugcucuugguauacacuugggaaaauaauguccuccaggagaaaguguuagagggaacu

SEQ ID NO: 62167 - RNA, 63 nt, Human
gacccgcgccgcccccgcccgcccgcccacgcuguccuccacuuaggcuccuccacaaacgcu

SEQ ID NO: 62168 - RNA, 63 nt, Human
cccagccuggucucaaacuccccagcuaaagcaguccuccagccucggccucccaaaguacug

SEQ ID NO: 62169 - RNA, 63 nt, Human
auuuuucuuuaaauccaaagauacuaaaaaaauguccuccaguuuguauuuauuaauucuguc

SEQ ID NO: 62170 - RNA, 63 nt, Human
uuaauuuccauaaguaacguaugagaauucuagguccuccaaauaauuagcaguccuucguag

SEQ ID NO: 62171 - RNA, 63 nt, Human
ccucacuacugccuggagaagggagagauucagguccuccagcagccucccucacccaguaug

SEQ ID NO: 62172 - RNA, 63 nt, Human
agucgugugacucaggaauggggguagauccauguccuccacugucccccauuaguucugucc

SEQ ID NO: 62173 - RNA, 63 nt, Human
aagaucugaacuggcugcaucucccuuuccucuguccuccauccuucucccaggauggugaag

SEQ ID NO: 62174 - RNA, 63 nt, Human
gcaugugugugugugcaaagguccagccaccccguccuccagccugcaaggggugucuggcgc

SEQ ID NO: 62175 - RNA, 63 nt, Human
auccagcccucaccuagccauuucccaacccuaguccuccaccgucccgaagccaacuucacc

SEQ ID NO: 62176 - RNA, 63 nt, Human
caagggggugacagaaccgagaagggggugacaguccuccauccacguggccucucucucucu

SEQ ID NO: 62177 - RNA, 63 nt, Human
ccucugauacugugcccccuuggagauauuuccguccuccacccacgugucuguggcuggaac

SEQ ID NO: 62178 - RNA, 63 nt, Human
gcccccgccccuucccggccccccucgccgcgcguccuccaaaaaauaaaaccuuaaccgcgg

SEQ ID NO: 62179 - RNA, 63 nt, Human
cauccccucccccaaccuuggccacuugaguuuguccuccaaggguaggugucucauuuguuc

SEQ ID NO: 62180 - RNA, 63 nt, Human
auugagcagccuuagcauugucccccuacucccguccuccagguguccccaucccuccccugu

SEQ ID NO: 62181 - RNA, 63 nt, Human
cgugaggccucuccccuggcaccugcuucaguuguccuccacagcacugauuugcagcccaca

SEQ ID NO: 62182 - RNA, 63 nt, Human
ggcacucauggcucucugggucuaaugaauaaaguccuccacagccuagaucuugggugaugu

SEQ ID NO: 62183 - RNA, 63 nt, Human
cccagccucacaccugccucugguucccgccugguccuccagcuucaggaccccaccuccaaa

SEQ ID NO: 62184 - RNA, 63 nt, Human
ucuacucuagaagagggguuacuucuccccuggguccuccaaagacugaaggagcauaugauu

SEQ ID NO: 62185 - RNA, 63 nt, Human
cuuucagaguuugaagguaacugagagcagaugguccuccauuucaacuccagaaguggggcu

SEQ ID NO: 62186 - RNA, 63 nt, Human
cucaccccccagaacacccuccucccagggaggguccuccagcucaccucaugcuucuuauuu

SEQ ID NO: 62187 - RNA, 63 nt, Human
gauuauacuuuuuuugagacagggucugacucuguccuccaggccagaguccaguggugcaau

SEQ ID NO: 62188 - RNA, 63 nt, Human
gggaauugggguccaccauagucuucugcucugguccuccacggguggaccaggauggagucu

SEQ ID NO: 62189 - RNA, 63 nt, Human
gcagauucguccacaggggaucugucaguuuggguccuccaaaugaaaaaugucaagacagaa

SEQ ID NO: 62190 - RNA, 63 nt, Human
uggguuaauaccagcuuaaaggcaguauuuuguguccuccaggagcuucuuguuuccuuguua

SEQ ID NO: 62191 - RNA, 63 nt, Human
gcuggucagaugucccccuacccccaccccacuguccuccaaggcuacaggaccccugcuucu

SEQ ID NO: 62192 - RNA, 63 nt, Human
ugggagaaaagugagccaucugcuggucaggaaguccuccagagaggcagcuuuucccacaau

SEQ ID NO: 62193 - RNA, 63 nt, Human
acuaucggcucccuguauaauaaaucaagccagguccuccaagugguaauucaugaaaaauau

SEQ ID NO: 62194 - RNA, 63 nt, Human
ccagggagacccggagcacagccuccugcagguguccuccacaggcagggcccuggagagacg

SEQ ID NO: 62195 - RNA, 63 nt, Human
ggacuggcuagaguccucacucccaguccaaauguccuccagaagccucuggcuagaggccag

SEQ ID NO: 62196 - RNA, 63 nt, Human
guaucaccgauccacccugcagcccucgcugcaguccuccaugaccuaccucuaugaggacag

SEQ ID NO: 62197 - RNA, 63 nt, Human
agaauaaucaaauacauuuuaagcaaguuaaguguccuccaucaauucuguauuccagacuug

SEQ ID NO: 62198 - RNA, 63 nt, Human
gacuggucugguagcagccugucacuccagacuguccuccaccccagacuuccgcaaacugau

SEQ ID NO: 62199 - RNA, 63 nt, Human
ucugguuguagggaaggacucaaguccuggaauguccuccacuggucuacugaguugcaguca

SEQ ID NO: 62200 - RNA, 63 nt, Human
ucagaggcgcacugugacccccagcuccggccuguccuccaacaccaagcacagcagccuggg

SEQ ID NO: 62201 - RNA, 63 nt, Human
uauuaauuguuuaaaaacagcuuagggauuaauguccuccauuuauaaugaagauuaaaauga

SEQ ID NO: 62202 - RNA, 62 nt, Human
uugccacuuguaaaagcugaacucuagucuguguccuccauucugcccccgcccuuccuccc

SEQ ID NO: 62203 - RNA, 63 nt, Human
gugaguugugaggcacuggggaggcaggcacacguccuccagcccaagacugccuaauuuaac

SEQ ID NO: 62204 - RNA, 63 nt, Human
uuuuuucccuauucagcagcauuuuaaucacauguccuccagcugacugggacucaggcugcg

SEQ ID NO: 62205 - RNA, 63 nt, Human
caccaugcuguguggccaccuggggcugccacuguccuccagcccgcccccagccuguggacg

SEQ ID NO: 62206 - RNA, 63 nt, Human
cccuuuucagugcuaccggccucucaccaagcaguccuccaugugagcaaccccgagacaaaa

SEQ ID NO: 62207 - RNA, 63 nt, Human
ccagcucugccgcgggcacuuuguucucacgguguccuccaugccugcagggcccaugcaugg

SEQ ID NO: 62208 - RNA, 63 nt, Human
cuggagacucuuaaagcccccacagcccuccagguccuccagcucugucagauggagggcucu

SEQ ID NO: 62209 - RNA, 63 nt, Human
agccagaagcaucccauggaccauggggugaguguccuccaagagcccccugagcucagcccu

SEQ ID NO: 62210 - RNA, 63 nt, Human
ggggccuguguucuggguguucaggugcugcugguccuccauuacccacugcuccccaaggcu

SEQ ID NO: 62211 - RNA, 63 nt, Human
gagcagaaguaggguccugucggcccugcugcuguccuccaucccaccccucuuacuccagcc

SEQ ID NO: 62212 - RNA, 63 nt, Human
cuaaaaauguuuuauauauuacucuaaccuguuguccuccacauucuauuguccuaauuguac

SEQ ID NO: 62213 - RNA, 63 nt, Human
uauuuaaucccuuaaacuugcuuuuuagggagaguccuccaucuacauuugccugugcuucag

SEQ ID NO: 62214 - RNA, 63 nt, Human
aaaaggaaaaaaccaaaauauugaugagaaggaguccuccaguuagugaaaggggaguuucgu

SEQ ID NO: 62215 - RNA, 63 nt, Human
ugaucgaguguauugauuuuaguauugcuucguguccuccacacaggaggaggauguauucag

SEQ ID NO: 62216 - RNA, 63 nt, Human
uauggaggguguggcgggacggcccacaccuggguccuccaucgggaacuuuucaugcuucuu

SEQ ID NO: 62217 - RNA, 63 nt, Human
uaccgaccucugccuggagacgcagcagccuguguccuccagggccucugguuuguuguauua

SEQ ID NO: 62218 - RNA, 63 nt, Human
caggaagggaaggggggucagaagagagggugaguccuccagaacucuuccuccaaggacaga

SEQ ID NO: 62219 - RNA, 63 nt, Human
agggugagguggcaugguccauucucaagggacguccuccaacggguggcgcuagaggccaug

SEQ ID NO: 62220 - RNA, 63 nt, Human
acacuguuccccccggucagcccaucuagcccuguccuccauuccucacgccaucuccauccc

SEQ ID NO: 62221 - RNA, 64 nt, Human
agggccgaucuggguguccugacccucagcuggcccugcccagccacccuggacgugaccguau

SEQ ID NO: 62222 - RNA, 64 nt, Human
ucacagggggagggugaggcuuuguaccccagccccugcccaggccacugugagggugggugcu

SEQ ID NO: 62223 - RNA, 64 nt, Human
ucacagggggagggugaggcuuugcaccccagccccugcccaggccacugugagggugggugcu

SEQ ID NO: 62224 - RNA, 64 nt, Human
ggauugugguccccugcccccucugucccgucccccugcccaagugacugaaaccuacugagcu

SEQ ID NO: 62225 - RNA, 64 nt, Human
cgcccgugucuucccucccuucucggccccgccaccugcccagcgugcccuggcucuccagaac

SEQ ID NO: 62226 - RNA, 64 nt, Human
cggugggaugcuuguagcuccucacagcaggauuccugcccacuguuuuuucucuguugggagg

SEQ ID NO: 62227 - RNA, 64 nt, Human
aucagggcggaaccaucuuucacccggccaagcuccugcccagauguugacccucacccagcgu

SEQ ID NO: 62228 - RNA, 64 nt, Human
aacuucauaaagaugucucacagcccuggggacaccugcccagugggccccagcccuacaggga

SEQ ID NO: 62229 - RNA, 64 nt, Human
aagacagagcugcugccuucccggccucacgcacccugcccaccagccccucggaagcauguga

SEQ ID NO: 62230 - RNA, 64 nt, Human
ggcagcacaguggaagugggagccugguccuuccccugcccauggagagcucuuuaagggaucc

SEQ ID NO: 62231 - RNA, 64 nt, Human
cccaccagcccccaggugaggcuuccagcugggaccugcccagacaggcugagccugggcgugg

SEQ ID NO: 62232 - RNA, 64 nt, Human
ccucccugcccccuguccugcuucccacccccugccugcccagccugggcccugcaguguggag

SEQ ID NO: 62233 - RNA, 64 nt, Human
caucaaggauggcuccaguacguacagcaagauuccugcccacaggaagggccacaggcccgcu

SEQ ID NO: 62234 - RNA, 64 nt, Human
ggagauccuaagggaccacacccuuccuccuuccccugcccacagaggcagagggcacaggaaa

SEQ ID NO: 62235 - RNA, 64 nt, Human
gcccugguguuccuggucacgucccccaggggacccugcccacuuccuggacuucgugccuuac

SEQ ID NO: 62236 - RNA, 64 nt, Human
ugcccucaagcuuauacuagagaagagcaacugaccugcccaacuugugugaagucaggagggu

SEQ ID NO: 62237 - RNA, 64 nt, Human
ccacaaccgaguaggggccacccuugacgggauuccugcccaggggagagaggcgcugggaaga

SEQ ID NO: 62238 - RNA, 64 nt, Human
aauggagucuuggacccuuucuuucucugggaucccugcccagcaccuuccuauagagaugacu

SEQ ID NO: 62239 - RNA, 64 nt, Human
caggcaggagguggcacuggcucccacucccaccccugcccaggcuggcaucuagaaggcguca

SEQ ID NO: 62240 - RNA, 64 nt, Human
ccaccacccaccgcuggagccccagcugugagaaccugcccacuucccaccagcggcgcuccug

SEQ ID NO: 62241 - RNA, 51 nt, Human; identical to SEQ ID NO: 13120

SEQ ID NO: 62242 - RNA, 64 nt, Human
caggcuuucauuucugucugcugagaucucagagccugcccaacagcagggaagccaagcaccc

SEQ ID NO: 62243 - RNA, 64 nt, Human
uuccugcagucaaaagcccauuaacgagaaagugccugcccacugcaacggagccgccagcacc

SEQ ID NO: 62244 - RNA, 64 nt, Human
acugaucagucaguagguaucacagcucacauuaccugcccagcgcugcccaaggcucccugga

SEQ ID NO: 62245 - RNA, 64 nt, Human
cccaagcccugcccgccucuccccccacgcucaaccugcccacuuguccaggccuggccucuuu

SEQ ID NO: 62246 - RNA, 64 nt, Human
uuuggcucacucugccaugagaacaggacaccauccugcccagcccagacgggguugcuccugg

SEQ ID NO: 62247 - RNA, 64 nt, Human
gggucaaguagaagguacuggggauggggacauuccugcccauaaaggauuuggggaaagaaga

SEQ ID NO: 62248 - RNA, 64 nt, Human
ggggcucccugagaucuugguagaggaggccccuccugcccagaccuucguuuguuuccccggu

SEQ ID NO: 62249 - RNA, 64 nt, Human
ccccuaagucuuucucuuucccaucauacccuucccugcccaccuuguuuucuguucuccuuuu

SEQ ID NO: 62250 - RNA, 64 nt, Human
cggcucaguggguggccaucgaucuggaccguccccugcccacuugcuccccgugagcacugcg

SEQ ID NO: 62251 - RNA, 64 nt, Human
ggacuucggaaaugccuuaaguuccccucuuuauccugcccauguucacuccauuguaggguug

SEQ ID NO: 62252 - RNA, 64 nt, Human
aauauuucccuuccgucuuccuucuccuucugggccugcccauguuguugagaggucuugguga

SEQ ID NO: 62253 - RNA, 64 nt, Human
cagcucuugagccuacccuccucucacaucuccuccugcccaagauguaaggaagcauuguaag

SEQ ID NO: 62254 - RNA, 64 nt, Human
uggccaggcuagucuugaauuccugaccuccugaccugcccaccucaaccucccaaagugcuga

SEQ ID NO: 62255 - RNA, 55 nt, Human; identical to SEQ ID NO: 13134

SEQ ID NO: 62256 - RNA, 64 nt, Human
ucuauuuuuucugaggaauuaaggguuaccccacccugcccacucccaucccuucaaccccacu

SEQ ID NO: 62257 - RNA, 64 nt, Human
uucucuguaaggcaaaauaaucuaaaaagacuaaccugcccacccacuccuuauauugcuguga

SEQ ID NO: 62258 - RNA, 64 nt, Human
gucucccagccccauguacaaagcucaccaagccccugcccauguacagcccccagacccucug

SEQ ID NO: 62259 - RNA, 64 nt, Human
uaccacucccuuccccagcccgacuucuuggccuccugcccaaccagacaccucaaacucuguc

SEQ ID NO: 62260 - RNA, 64 nt, Human
gcaguaucugcguagcccacagagggcccaggccccugcccagcugcagucucccagccuccac

SEQ ID NO: 62261 - RNA, 64 nt, Human
uucucuauagcccacugagccccgagacagagaaccugcccacagcucuccccgcuacaggcug

SEQ ID NO: 62262 - RNA, 64 nt, Human
ggcagacacagaaagacacaaaacggucgucuuuccugcccaaguaaagcuuacagacuaacug

SEQ ID NO: 62263 - RNA, 64 nt, Human
gacgcuguccccgauaacucccuaggggcuccugccugcccaagcggcugagaaccagcgcccc

SEQ ID NO: 62264 - RNA, 64 nt, Human
acccuuggacuucuuuguguguccaguuuggccuccugcccaaacuguccauuccagcagcucc

SEQ ID NO: 62265 - RNA, 64 nt, Human
aggccagccucgccuuucuacccaggcccccugcccugcccaccucaggcccccacccuccacu

SEQ ID NO: 62266 - RNA, 64 nt, Human
uuuucucaggacaucucuggcaggugcauuugugccugcccagcaguuccagcuguggcaaaag

SEQ ID NO: 62267 - RNA, 64 nt, Human
gcugcggcucuggcccacugagccaccgcgcccuccugcccacgggaggacaagcaauaacucu

SEQ ID NO: 62268 - RNA, 64 nt, Human
ggggcuuaggaaccuucucccuucuugggucugcccugcccauacugagccugccaaagugccu

SEQ ID NO: 62269 - RNA, 64 nt, Human
ccucuuggccagauugggcucauuaaugucguugccugcccaucugcaugaaugacaggcagcu

SEQ ID NO: 62270 - RNA, 64 nt, Human
gaacugucaaauccuugcauacuucugugacaccccugcccauuuucugucuuuaauuaaccaa

SEQ ID NO: 62271 - RNA, 64 nt, Human
accccuuuucugaggaaugaguuugccuccguccccugcccaugcugggagcccacgcucaccc

SEQ ID NO: 62272 - RNA, 64 nt, Human
aaugaacaucugaggcugccuuguagagaugcagccugcccagcugaaucuuggcuucuggacc

SEQ ID NO: 62273 - RNA, 64 nt, Human
cccaucccuggggacagaggccuugugucaccugccugcccaggcagcuguuugcagcugaaga

SEQ ID NO: 62274 - RNA, 64 nt, Human
ggacgggaccggaagacgagagagggcuggacauccugcccaccgugucccagccagggcaggg

SEQ ID NO: 62275 - RNA, 64 nt, Human
gcccccaccccugcggccuuugcucacggguggcccugcccaccccuggcacaaccaaaauccc

SEQ ID NO: 62276 - RNA, 64 nt, Human
ugauucuccuccugccucucccgugagucuccagccugcccagcaccggcagcuguggagcacg

SEQ ID NO: 62277 - RNA, 64 nt, Human
cccgucacagcucuguagagacaaucaacuguguccugcccacccuccaaggugcauugucuuc

SEQ ID NO: 62278 - RNA, 64 nt, Human
agcccugggaucagcuggaagcugccugucaucuccugcccaauccccagaaacccugauucag

SEQ ID NO: 62279 - RNA, 64 nt, Human
acccuggcccugcccugugcccugggaugccuacccugcccaccuccggagguggaaccgggcu

SEQ ID NO: 62280 - RNA, 64 nt, Human
gaguggaggaggcccaggccacaguaccaccccaccugcccaggcagccccucgucaccuacuc

SEQ ID NO: 62281 - RNA, 64 nt, Human
aaccagcaggugugguggcucauggcguaaugggccugcccaaugcuuugggaggccaaggcag

SEQ ID NO: 62282 - RNA, 64 nt, Human
cuacuugugacugaaggggcacaccacugcccugccugcccacuuagccguccauggcaccagc

SEQ ID NO: 62283 - RNA, 64 nt, Human
ccagccuccaagccccacgccagcgagcaggcugccugcccaccccgugcccccagccagcugg

SEQ ID NO: 62284 - RNA, 64 nt, Human
gcuggggacucagggaccggugcugcaggaguguccugcccaugccccagucggccccaucucu

SEQ ID NO: 62285 - RNA, 64 nt, Human
ggcagaucaccuggggucaggaguucaagaccagccugcccaacauggcaaaaccucgucucua

SEQ ID NO: 62286 - RNA, 64 nt, Human
gaagccggacggcagggaugggccccaacuucgcccugcccacuugacuucaccaaaucccuuc

SEQ ID NO: 62287 - RNA, 64 nt, Human
gaagggcaggaggagcugcuuggcagaaggaccuccugcccagaccugaggagugagaggcuuu

SEQ ID NO: 62288 - RNA, 64 nt, Human
acccagugucacauccuuggcugucaaucccaugccugcccacgccacacacucugcgaucugg

SEQ ID NO: 62289 - RNA, 60 nt, Human; identical to SEQ ID NO: 13168

SEQ ID NO: 62290 - RNA, 64 nt, Human
cacaucuaggguuguccugccccuuggcucuaucccugcccagaggugggaacuggaggagugg

SEQ ID NO: 62291 - RNA, 64 nt, Human
gaguccacacauuauagucaugugccaccaccuuccugcccacaggccgagggacagggugagg

SEQ ID NO: 62292 - RNA, 64 nt, Human
caaggaugugacauggcuucuccucagggcaaccccugcccaacccucauccccaucuucucag

SEQ ID NO: 62293 - RNA, 64 nt, Human
acaaccuccugggaccacugccaccugcaagagcccugcccaggagauagaagaccuggacucc

SEQ ID NO: 62294 - RNA, 64 nt, Human
uggguuccuucagguuccuugccaacccuccuccccugcccacaacuucuccaaacaaagcagg

SEQ ID NO: 62295 - RNA, 64 nt, Human
agugcguaggcuuccagugaugguuggggacaauccugcccaaaggcagggcaguggauggaau

SEQ ID NO: 62296 - RNA, 64 nt, Human
auguguauaugcauaugcaaacucgacccccguuccugcccagauaauggcucaauaacucuga

SEQ ID NO: 62297 - RNA, 64 nt, Human
ucagugggacaugggcaccucgggaggcccgggcccugcccagcuacaguuccaccccucagcu

SEQ ID NO: 62298 - RNA, 64 nt, Human
gaaagauaggggaagaagccagaaccccaccuggccugcccacaggacaagaaguggguaaggg

SEQ ID NO: 62299 - RNA, 64 nt, Human
ucuacacagacaccugaaggagcccccacaugcgccugcccauccagcacugcagaugccaccu

SEQ ID NO: 62300 - RNA, 64 nt, Human
ucuagauucccaguucuaaggccuuaucaccuccccugcccauaggccaacaaccauaguuccu

SEQ ID NO: 62301 - RNA, 64 nt, Human
uuguaaguuauuucuuguuuguuuguuuggguauccugcccaguguuguuuguaaauaagagau

SEQ ID NO: 62302 - RNA, 64 nt, Human
ugcagcgaaggcacugcaaucccuuccccauaucccugcccaacccggacugcugcccguccuc

SEQ ID NO: 62303 - RNA, 64 nt, Human
aaaugaaaacgucagccucugccccacccucccuccugcccaaagugaauuugguacucagaaa

SEQ ID NO: 62304 - RNA, 64 nt, Human
cuccacaaggcccaggcgcccagggucccaccgaccugcccaggaaugcaucacauuguucucu

SEQ ID NO: 62305 - RNA, 64 nt, Human
gcuccaugcugaaggcucccauuuucaguucccuccugcccaggacugcauuguuuucuagccc

SEQ ID NO: 62306 - RNA, 64 nt, Human
ggguuguuagagcugagaugacuguacacauaccccugcccaauuuauauagcucuuuguggag

SEQ ID NO: 62307 - RNA, 64 nt, Human
caggacucccccugugucagugcucugcucucacccugcccaagacucaccucccuuccccucu

SEQ ID NO: 62308 - RNA, 64 nt, Human
augacuaagaauguaauggggaagaacugcccugccugcccaucucagagccauaaggucaucu

SEQ ID NO: 62309 - RNA, 64 nt, Human
cccuggugcucuccccaggcucccuccucagccuccugcccacccagggcccuuuacucucuuc

SEQ ID NO: 62310 - RNA, 64 nt, Human
uguuugugauuuuuuuccuuaugcaaaucauacuccugcccaagaaaauacaguaguuccccuu

SEQ ID NO: 62311 - RNA, 64 nt, Human
gguaacuucucuccugcucaugugucagugucuaccugcccaaguaaguggcuuucauacacca

SEQ ID NO: 62312 - RNA, 64 nt, Human
augggugaacccagccccugaccuuccucuauccccugcccauccucccuuuuaccuccucucu

SEQ ID NO: 62313 - RNA, 64 nt, Human
ugacuagaggccucuugugacuggagguaacaacccugcccaguaacugugggagaaggggauc

SEQ ID NO: 62314 - RNA, 64 nt, Human
uucucuuuuauaccuuccucacuggcccccuccaccugcccauagucaccaaauucuguuuuaa

SEQ ID NO: 62315 - RNA, 64 nt, Human
gguuguuccugcaucccgauaccucagcccuggcccugcccagcccauuugggcucugguuuuc

SEQ ID NO: 62316 - RNA, 64 nt, Human
ggaaaaaggaguuugagucacuggcaccuagaagccugcccacgauuccuaggaaggcuggcag

SEQ ID NO: 62317 - RNA, 64 nt, Human
uugagugaaaggagggugaggcugccgaugccuuccugcccagaaguggaugaugugggaguug

SEQ ID NO: 62318 - RNA, 64 nt, Human
acacaacuguccaagcucucagccccacagggaaccugcccagagagcuuuaccuuucccaagc

SEQ ID NO: 62319 - RNA, 64 nt, Human
ggauuaggcccucaagacccuuuuggguuucugcccugcccacccucuggagaaggugggcacu

SEQ ID NO: 62320 - RNA, 64 nt, Human
gcacaagugcacaucagcacuauggggccuauguccugcccagagaccucugcuccuuccugcu

SEQ ID NO: 62321 - RNA, 64 nt, Human
ccacucugagugaggccaccaucacccaccacacccugcccacuccugcgcuuuucaucgccau

SEQ ID NO: 62322 - RNA, 64 nt, Human
cugcucaggccucaccucccagggcuacacagacccugcccaccccaucccuggcugaccugcu

SEQ ID NO: 62323 - RNA, 64 nt, Human
aagggugauuccaagaucauccuucacccgagguccugcccaagcacaggccagaugcaagaau

SEQ ID NO: 62324 - RNA, 64 nt, Human
aaauaucauauuucugugugugucucucucagccccugcccaggcuagagggaaacagcuacug

SEQ ID NO: 62325 - RNA, 64 nt, Human
uauuuguuuggaugucugaucuuuuccuacaguuccugcccaggccuguuuuucucucccuuau

SEQ ID NO: 62326 - RNA, 64 nt, Human
uuccuuaugucccauggaucucuuccugaucuucccugcccauuggguacccaggaaacugcaa

SEQ ID NO: 62327 - RNA, 64 nt, Human
ugccuucuaaggacagcuccuucccuacucauucccugcccaaguggggccagaccucuuuaca

SEQ ID NO: 62328 - RNA, 64 nt, Human
cuuugaaauaaaaauuggcauguagccaauguuuccugcccacacucacuuuuuucuauagacc

SEQ ID NO: 62329 - RNA, 64 nt, Human
cauugcccuggggaucagacagccccuaccuaccccugcccacuccucuggagacugagccuug

SEQ ID NO: 62330 - RNA, 64 nt, Human
cagaaccccugcccuggcagccuggaagaccgugccugcccagcccucgucaccacagggacuc

SEQ ID NO: 62331 - RNA, 64 nt, Human
ccccaccaccccggggucucuggggaacugucaaccugcccacgggacauguacauuuccccuu

SEQ ID NO: 62332 - RNA, 64 nt, Human
cucuaagccuuagggagugagaccaacacccaucccugcccagccaacaguggccggggcuugu

SEQ ID NO: 62333 - RNA, 64 nt, Human
ucucccgggccccgggccuggggcaugcguugcaccugcccagcccgguggcugcgccucccuc

SEQ ID NO: 62334 - RNA, 64 nt, Human
agaugaagcuccgccuccgccgcuuagucccaacccugcccaggaagaagggcccguggggcuu

SEQ ID NO: 62335 - RNA, 64 nt, Human
aggccaguggggggcaggggugcgccuccucugcccugcccaccagccugugauuugauggggu

SEQ ID NO: 62336 - RNA, 64 nt, Human
acccauguuucugggugggugaaaggggcccaacccugcccacuucagcccagcccgcccaagg

SEQ ID NO: 62337 - RNA, 64 nt, Human
augcugccaucacugggaggcucagaggacccuuccugcccaccuucggagacggcuucuggag

SEQ ID NO: 62338 - RNA, 64 nt, Human
auugugacuggccucaggaauucucccuuccacaccugcccaccucaccucacugcaccgcacc

SEQ ID NO: 62339 - RNA, 64 nt, Human
acugccauuccuuucuaaguguguuuuauggcauccugcccacaaagaacucacagucugauua

SEQ ID NO: 62340 - RNA, 64 nt, Human
gcuucacagguugacuaguaucuguggguaccucccugcccagguuauucacucacaagccacc

SEQ ID NO: 62341 - RNA, 64 nt, Human
cucccuguugguucugauuagguaacguauuggaccugcccacaacucccuugcacguaaacuu

SEQ ID NO: 62342 - RNA, 56 nt, Human; identical to SEQ ID NO: 13221

SEQ ID NO: 62343 - RNA, 64 nt, Human
ccuucacaacggucagcacuccucucccagccccccugcccacuguucucaauaaaaugugagu

SEQ ID NO: 62344 - RNA, 64 nt, Human
ugccugggcggggcugggagugggaccugagaucccugcccacucucuccccuucauuggcugc

SEQ ID NO: 62345 - RNA, 64 nt, Human
cgagaaugccaucugacaggagggcccggggcccccugcccacccugcgggggccuccccagug

SEQ ID NO: 62346 - RNA, 64 nt, Human
uauaaagagacuuacgugguaaaaaaugaagucuccugcccacagccacauuagugaaccuaga

SEQ ID NO: 62347 - RNA, 64 nt, Human
ugucgccucugcauucaggaucaaaccccgaccaccugcccaaccugcucuccucuugccacug

SEQ ID NO: 62348 - RNA, 64 nt, Human
ccuccugugacccagggagcagggucgcuaagguccugcccacugaggggacagccuucugggc

SEQ ID NO: 62349 - RNA, 64 nt, Human
auuucauuugccaguuucuauuuaguauuccaugccugcccaauucaucuguuacuguuuaauu

SEQ ID NO: 62350 - RNA, 64 nt, Human
gaagaggcuugugcugugguggguucgauuuaucccugcccaccccacccccacaacuucccuu

SEQ ID NO: 62351 - RNA, 64 nt, Human
gccccagccaucagggcuggccguggacguggccccugcccacucaccugcccgccugcccgcc

SEQ ID NO: 62352 - RNA, 64 nt, Human
ucuucccgagauagccaccuggaaacacuaggugccugcccagggaggaacggaggaggacucg

SEQ ID NO: 62353 - RNA, 64 nt, Human
ggcccugcuaccugacgcgccagaagcacccagcccugcccagcaaccggccccagcagcaggu

SEQ ID NO: 62354 - RNA, 64 nt, Human
ucagcagcugcaccccagaaucuguaugccugcaccugcccaaggauuuauucauagcuuaccu

SEQ ID NO: 62355 - RNA, 64 nt, Human
gcguggcugacuuacaucauguguuggggaagggccugcccaguugcacucaggugacauccuc

SEQ ID NO: 62356 - RNA, 64 nt, Human
guucugucagcacucugaugugcucagaagagcaccugcccaaaguuuuucugguuuuaauuua

SEQ ID NO: 62357 - RNA, 64 nt, Human
ccucaaacgaaucauuggcuauaaccuccagccuccugcccagcacaggaaucgguggucucca

SEQ ID NO: 62358 - RNA, 64 nt, Human
ggcaccucucggaccucgcuguguuucacugccuccugcccacagacccaggccugccggcccg

SEQ ID NO: 62359 - RNA, 64 nt, Human
auagaggugacaugucucuccauuccucuccaacccugcccaccucccuguaccagagcuguga

SEQ ID NO: 62360 - RNA, 64 nt, Human
gccccuccaggaggguccuggggugggccagaugccugcccaccucugucuccugccucugcuc

SEQ ID NO: 62361 - RNA, 64 nt, Human
cuggacccucucccgggaccuccugcuggcuccuccugcccagcuuccuaugcaaggcuuugug

SEQ ID NO: 62362 - RNA, 50 nt, Human; identical to SEQ ID NO: 13241

SEQ ID NO: 62363 - RNA, 57 nt, Human; identical to SEQ ID NO: 13242

SEQ ID NO: 62364 - RNA, 64 nt, Human
uguuacuuugcaauauccacuuuauaaaauagcuccugcccaguggcucuugguuccugucaaa

SEQ ID NO: 62365 - RNA, 64 nt, Human
uuacauggaaaccgggcucagugagaacugauuuccugcccaauauuugucuuugggcugucuc

SEQ ID NO: 62366 - RNA, 64 nt, Human
ggcggaucaccugaggugaggaguucaagaccagccugcccaacauagugaaacuccgucucua

SEQ ID NO: 62367 - RNA, 64 nt, Human
ccaccuccccagcauuccagccccucuggucgcuccugcccacggagucguggggugugcuggg

SEQ ID NO: 62368 - RNA, 64 nt, Human
agcaccggucuuugauccgcagcaggggccagacccugcccacaagucccagcgcggcugcuuc

SEQ ID NO: 62369 - RNA, 64 nt, Human
aacgggguuggggaccgaaaggacagggaugccgccugcccaguguuucugggccucacggugc

SEQ ID NO: 62370 - RNA, 64 nt, Human
auucauccccccggccaccucucuacccguccagccugcccagacccucucagaggaacggggu

SEQ ID NO: 62371 - RNA, 64 nt, Human
agaaggccaagcgagacuagcagucauccagaccccugcccaccuagacuguuuucugagcccu

SEQ ID NO: 62372 - RNA, 64 nt, Human
cagucuugccagguggucuacccccggccccgcuccugcccauuccucugucccugcagacuca

SEQ ID NO: 62373 - RNA, 64 nt, Human
ccucuaguugguucugggcuuugaucucuuccaaccugcccagucacagaaggaggaaugacuc

SEQ ID NO: 62374 - RNA, 64 nt, Human
gcgcuggcguuuguguucugggcaccaccgugacccugcccagauggcuauaauauuauuuuau

SEQ ID NO: 62375 - RNA, 64 nt, Human
auaaucgugcuuuguuuuaugcuacuccucccacccugcccaugauuaaacaucauguauguag

SEQ ID NO: 62376 - RNA, 64 nt, Human
ccgccauugagaaugugcuuuguaagauccacccccugcccacaaaaaauugcuccuaacucca

SEQ ID NO: 62377 - RNA, 64 nt, Human
gcacuuccuugcuuaagguaugguacaagcaaugccugcccauuggagagaaaaaacuuaagua

SEQ ID NO: 62378 - RNA, 64 nt, Human
cuguguguggcugccuccccugggcuuucugcucccugcccagauccuguaggccucaucuuag

SEQ ID NO: 62379 - RNA, 64 nt, Human
acaacuuaguuuggauguaagaugcucugaggacccugcccacaccccugcgugcauuaggaug

SEQ ID NO: 62380 - RNA, 64 nt, Human
cgaguucccugggaggcugacagggucaagccacccugcccaccacccucccacuuccccuccc

SEQ ID NO: 62381 - RNA, 64 nt, Human
ugagcagcgaagaauaaagcaugacucaucucguccugcccaccccucacacuggacuauaaau

SEQ ID NO: 62382 - RNA, 64 nt, Human
uggccucaccaggcaagcugaggccaggagggacccugcccagucugugaaagcuacagagcac

SEQ ID NO: 62383 - RNA, 64 nt, Human
cccgcccucugcccccgcggcaaccgcucccacgccugcccacuuugcuagcccggcugugccc

SEQ ID NO: 62384 - RNA, 64 nt, Human
gaagagucaggaagggaaagccagaaggggcacgccugcccagccucgcaugccagagccuggg

SEQ ID NO: 62385 - RNA, 64 nt, Human
ggcaggaucuggcuuggggugcccggcccucaucccugcccacgcagugagugcucaugugucu

SEQ ID NO: 62386 - RNA, 64 nt, Human
ugccaguccugcgcauuccagcuacgcuaagcgcccugcccaggcacguaacaaaacauagacc

SEQ ID NO: 62387 - RNA, 64 nt, Human
aagcauuuuaauuaaaaaccucaauaaagauggcccugcccacacugugccuuguguuuggggc

SEQ ID NO: 62388 - RNA, 64 nt, Human
uuuaggggcaaacaucacaaaauguaauuuaaugccugcccauuagagaaguauuuaucaggag

SEQ ID NO: 62389 - RNA, 64 nt, Human
uccugagcuucagaccguuuguccugucaucuguccugcccaacacuguaugguuuuucucuag

SEQ ID NO: 62390 - RNA, 64 nt, Human
cuuaugcaggccauaaguuccaaaagauaauuucccugcccacaaaggcauaaacuugaaaaca

SEQ ID NO: 62391 - RNA, 64 nt, Human
cugugcaagcacauucaccaagugcaucgguagcccugcccaccccuccagaccucgguucuua

SEQ ID NO: 62392 - RNA, 64 nt, Human
acugaagccacagcugggcccaccgaggugcuauccugcccaggccagcacuuggcugaguugg

SEQ ID NO: 62393 - RNA, 64 nt, Human
ccuccggagugaacaggcaucccuguugccccugccugcccagauuuacugaccccauuugucg

SEQ ID NO: 62394 - RNA, 64 nt, Human
gaugccuccuauuuguaacaauggguguagcuccccugcccaucuuggaggugcauggcccauc

SEQ ID NO: 62395 - RNA, 64 nt, Human
gauaaguuauuauauucauuucguugguuucucuccugcccaauucuuggcacaggcauuaugu

SEQ ID NO: 62396 - RNA, 64 nt, Human
agaggugagggaagccugaaaaacuaagaugcugccugcccagugcacacaaguguagguauca

SEQ ID NO: 62397 - RNA, 64 nt, Human
guccuuacacuacaucaucaucaucucaugcccaccugcccacacccagcagagcuucucagug

SEQ ID NO: 62398 - RNA, 64 nt, Human
ugaagcaaggggcaaggcugggccccuagcuuguccugcccauuccuccagguguugaucuuga

SEQ ID NO: 62399 - RNA, 64 nt, Human
cuggucccuggcaacaggaaccugggcagcuuauccugcccacagguaagccccugggagcauc

SEQ ID NO: 62400 - RNA, 64 nt, Human
cccucauccuguucugucuacucacccuagcagcccugcccagacucuucagccccugcuccca

SEQ ID NO: 62401 - RNA, 64 nt, Human
ccccagcccaaguccaaauguuuacagggagccuccugcccagucccccaaccccagccgcucg

SEQ ID NO: 62402 - RNA, 64 nt, Human
uggaaaaagggccacaagccguuuugcacaaaugccugcccaccugccccucuuccauccagga

SEQ ID NO: 62403 - RNA, 64 nt, Human
gguccugcaaggcuggacugugaucuucaaucauccugcccaucucugguaccccuauaucacu

SEQ ID NO: 62404 - RNA, 64 nt, Human
ccccacccuugagaauguacuuugugagauccacccugcccacaaaacauugcucuuaacuuca

SEQ ID NO: 62405 - RNA, 64 nt, Human
gagcugagagucugaaagacagaaugucaccaguccugcccaaugccuugacaacagacugaau

SEQ ID NO: 62406 - RNA, 64 nt, Human
ccagcccuugcccgugauggcuccuuggggucugccugcccacccacaugagcccgcgaguaug

SEQ ID NO: 62407 - RNA, 64 nt, Human
gaucuucccuguguggucccucccuucgugugccccugcccagccucuuggcaccuccuguuua

SEQ ID NO: 62408 - RNA, 64 nt, Human
uggaggguuucaaacaagacaaaaggcauuccucccugcccaaucccagugcagucaaggccaa

SEQ ID NO: 62409 - RNA, 64 nt, Human
cugccuccacccugugcccgaggggguguccgguccugcccauccgauacucugguggaaaugu

SEQ ID NO: 62410 - RNA, 64 nt, Human
ccuaugcaaguucauuuaagccucagggcuggucccugcccaaagggcuggacccuccuaaucc

SEQ ID NO: 62411 - RNA, 64 nt, Human
uaggguuucccucccgauaucaaaaagacuguggccugcccagcucucguauccccaagccaca

SEQ ID NO: 62412 - RNA, 64 nt, Human
ugcaaagaauucccacccugagguggguuacauaccugcccaauggccaaaggaaccgccuugu

SEQ ID NO: 62413 - RNA, 64 nt, Human
gcuuaagagaguaaggccuugggcugugcugugaccugcccaagauuugacacuggcuaggagc

SEQ ID NO: 62414 - RNA, 64 nt, Human
agaaccucaagcuccuggccugauccagcuccuuccugcccaaggcagcuuagcccauccagac

SEQ ID NO: 62415 - RNA, 64 nt, Human
cuaagccaugggacccgaggacugccccccggcgccugcccaggcggaggcccuuucagaaagg

SEQ ID NO: 62416 - RNA, 64 nt, Human
gggccaaugauggagggcggccgccagcccagggccugcccauccagaagggacuccccagggc

SEQ ID NO: 62417 - RNA, 64 nt, Human
aaaaaaaaaaaaaaaaaguaaauauccagggaacccugcccagacuaauacuguugguggcaua

SEQ ID NO: 62418 - RNA, 64 nt, Human
ugcagcuuguccuugcuccuggaaccuggcaggcccugcccagccagccaucggaagagagggc

SEQ ID NO: 62419 - RNA, 64 nt, Human
gggcuuucugggcacugcacuucagcguggcccaccugcccaugcccugaggccaguuggcgag

SEQ ID NO: 62420 - RNA, 64 nt, Human
ugaauauccccucccagucaccuuguggcaagccccugcccaucugggaaaauaccccaucauu

SEQ ID NO: 62421 - RNA, 64 nt, Human
cuccaaugaaaccaucaguagagacauugcuguuccugcccaucccagugccagcuacuccuuc

SEQ ID NO: 62422 - RNA, 64 nt, Human
gccuauggcaccuuucccuucugaaagucugguuccugcccagugacccuuggccuugugagcc

SEQ ID NO: 62423 - RNA, 64 nt, Human
gcauccagccccacacccucauuuauaccaauuaccugcccaguaacuguggacuuuugcuucc

SEQ ID NO: 62424 - RNA, 64 nt, Human
caucaccuccaguuuggcuucugagcagagacucccugcccaucaagucugaaacccccaugga

SEQ ID NO: 62425 - RNA, 64 nt, Human
uggaucccagcaacccuaaugcuggaaaggugcuccugcccacacccagcauggacccagugug

SEQ ID NO: 62426 - RNA, 61 nt, Human; identical to SEQ ID NO: 13305

SEQ ID NO: 62427 - RNA, 64 nt, Human
uccugcugcucugacccuuggccucaggcuuggcccugcccaagcuacuuccuguacuuaaaag

SEQ ID NO: 62428 - RNA, 52 nt, Human; identical to SEQ ID NO: 13307

SEQ ID NO: 62429 - RNA, 64 nt, Human
ggagcaaaggcucaccuuuguggagaggauaaaaccugcccaaccuaccucaccaugguuuuuc

SEQ ID NO: 62430 - RNA, 64 nt, Human
ggggcacaagugucaggcgccgcacuuccuuuuaccugcccaaggaugcugucaagcaccugca

SEQ ID NO: 62431 - RNA, 64 nt, Human
agcaaaugcaggagccgaccuggggcugcacaucccugcccauccccagaaagacuguuccugu

SEQ ID NO: 62432 - RNA, 64 nt, Human
gagggccgccacugcaguucugcuaggucugcuuccugcccaggaaggugccugcacaugagag

SEQ ID NO: 62433 - RNA, 64 nt, Human
caauggcccauggaagacacuugguuugagaaacccugcccacuuccaaagaccaaagagauua

SEQ ID NO: 62434 - RNA, 64 nt, Human
aucuuguguucucauacuuuucugucacuguaagccugcccaguaggcaguguuuugcagacuu

SEQ ID NO: 62435 - RNA, 64 nt, Human
acuaugaaucaggguaugaaauucaaaaccuccaccugcccaugcugcuugcaucccuggagaa

SEQ ID NO: 62436 - RNA, 64 nt, Human
cuccuggcagcuuccaugucaccacuuguucauaccugcccagagcuaguuuuagacauggcaa

SEQ ID NO: 62437 - RNA, 64 nt, Human
cugguugcagcugcugauagccuucaggggaggaccugcccagguaugccuuccagugaugccc

SEQ ID NO: 62438 - RNA, 64 nt, Human
gcucuucuuuuguucugugucugaccuacuaauuccugcccaugcuucaaacucaguucagaaa

SEQ ID NO: 62439 - RNA, 64 nt, Human
ggccccugccucccuuccucccuggcgauccucaccugcccagccauggcacacacccuuccug

SEQ ID NO: 62440 - RNA, 64 nt, Human
ugggccuuuccuaugggcaaggcccagugcucuuccugcccaccagggaccauggagcaguggc

SEQ ID NO: 62441 - RNA, 64 nt, Human
gacaccagacugcaauaacuggaggcgccuccuuccugcccacccuucgcucacgccccagcgc

SEQ ID NO: 62442 - RNA, 64 nt, Human
uacuggccccuaggcgccgauggccgaggccgcgccugcccaccgggcggggucgcugguuggc

SEQ ID NO: 62443 - RNA, 64 nt, Human
acugggcucgucucuuuccggagccccagcgucuccugcccaaauucaccgcggaaagggcccg

SEQ ID NO: 62444 - RNA, 64 nt, Human
gcauucccgggagaggcggugugggggcccgggcccugcccagcuacgcagaaagcagccggag

SEQ ID NO: 62445 - RNA, 64 nt, Human
ggggcuacugugaccauggaggccagugccagcaccugcccagugggccccgcugcaggugcau

SEQ ID NO: 62446 - RNA, 64 nt, Human
caaggccaaggcugcgggaggcugggagcccugcccugcccaucccuccugcaccagcgcuguc

SEQ ID NO: 62447 - RNA, 64 nt, Human
cgcccuccagggucagcguuuggcuguuugugugccugcccacccgccucccugugccugggcc

SEQ ID NO: 62448 - RNA, 64 nt, Human
uguugcugcucaacaggacugcacucgucucugcccugcccacccagagccccucuuugugccc

SEQ ID NO: 62449 - RNA, 64 nt, Human
ugucccccagacccaaagcucucuccccacccuaccugcccaccuggggcuccugugcccccuc

SEQ ID NO: 62450 - RNA, 64 nt, Human
uuaucuuccuguguucucuggcuucagaguuucaccugcccacacaggguccguugcuggcaac

SEQ ID NO: 62451 - RNA, 64 nt, Human
ggcccgaggcaccggacgcuggagacccugcgccccugcccagcaccuccuccgugggcagcuc

SEQ ID NO: 62452 - RNA, 60 nt, Human; identical to SEQ ID NO: 13331

SEQ ID NO: 62453 - RNA, 64 nt, Human
gugggcaggugguguccuguggcaccuccauccuccugcccagccggcugugucacacucaucu

SEQ ID NO: 62454 - RNA, 64 nt, Human
ccagcaugucccucguggcucagggugccccaggccugcccagcuagugcuguccucccaucuc

SEQ ID NO: 62455 - RNA, 64 nt, Human
gcacccagaccuccagagcauccagagccucuguccugcccacgcuagccucccugcagggacc

SEQ ID NO: 62456 - RNA, 64 nt, Human
gggcaccaggcagagugggagccuaggucaggccccugcccacugccugacccccaccccccgc

SEQ ID NO: 62457 - RNA, 64 nt, Human
ccaugguagaugcuccuguucuggugauaccaaaccugcccaccccucugagucgucuuugcuc

SEQ ID NO: 62458 - RNA, 64 nt, Human
gggauuuccugggcuuuuauucacuaaaugggcuccugcccaguuuggguacugugcugauuuu

SEQ ID NO: 62459 - RNA, 64 nt, Human
uccagcuuaaccacgugcauuuggccuauguaauccugcccaugguggccgcagcuaaucagaa

SEQ ID NO: 62460 - RNA, 64 nt, Human
gaguuccuggaggccuuccgccuuguggagaaauccugcccagagggcgaugccucagaaugcc

SEQ ID NO: 62461 - RNA, 64 nt, Human
ggaagcuuguugaaaacccagacugucuccacggccugcccagucgaccccaaaggaacacuga

SEQ ID NO: 62462 - RNA, 64 nt, Human
uuggagcauuuguaagcacauggugaaaucagccccugcccaccaaaauaaucuuuauguuacc

SEQ ID NO: 62463 - RNA, 64 nt, Human
agcugcccuccucuuuccgcucccccaucucggcccugcccauacuccaagggucagcucccau

SEQ ID NO: 62464 - RNA, 64 nt, Human
uuguguuggguucuauaccuaaaaauuuucccucccugcccaaggugauuggaaaguacugcaa

SEQ ID NO: 62465 - RNA, 64 nt, Human
uguuuugcaguucugugaaauguuuuauaaugucccugcccagggaccuguuagaaagcacuuu

SEQ ID NO: 62466 - RNA, 64 nt, Human
uuaacgagcccuaaaggcaagaagugugucuucuccugcccauuucucucucccacaguacauc

SEQ ID NO: 62467 - RNA, 64 nt, Human
uaggacccugccaggucccgcgcaccaucccugcccugcccacgugguauugcugggcuccugg

SEQ ID NO: 62468 - RNA, 64 nt, Human
cuguuccugaucagcccguaucaucugaggccugccugcccacccugccacccuccccucccuu

SEQ ID NO: 62469 - RNA, 64 nt, Human
ggccccugggccccgcagauggccauuuccggugccugcccaguggccacucuucuggaagggg

SEQ ID NO: 62470 - RNA, 64 nt, Human
ggguccccagggggcccccugcggccugggccccccugcccacggccagcuuccugcugaugaa

SEQ ID NO: 62471 - RNA, 64 nt, Human
cuucugccucaguguaucacuggagucacaggacccugcccaccugaguucccaauaaagaaaa

SEQ ID NO: 62472 - RNA, 64 nt, Human
aagcaauguuggaaaaugcagggugacugaguucccugcccagcuuucgggaucucuggccccc

SEQ ID NO: 62473 - RNA, 64 nt, Human
aagguagaugccaacuggagggccagaccuguguccugcccauguccuccuugguggacguuuc

SEQ ID NO: 62474 - RNA, 64 nt, Human
acguuucuguuuacucagagcugcuagagaccauccugcccauccgaguucugagauugggacu

SEQ ID NO: 62475 - RNA, 64 nt, Human
gucucugcuaugauggugguauccgaggccuuucccugcccagucuggugccugccccacauug

SEQ ID NO: 62476 - RNA, 64 nt, Human
ccauggggauccaagaccugagauaaagcaacagccugcccagaucccucuguucauccuaucc

SEQ ID NO: 62477 - RNA, 64 nt, Human
uccccagccagccaaaguaaugacacauuccagcccugcccagcaugcugaccuuuggccucua

SEQ ID NO: 62478 - RNA, 64 nt, Human
auucugagagucugcugggauugagcaaucaucuccugcccaaguuuccuccuugcccugagga

SEQ ID NO: 62479 - RNA, 64 nt, Human
ccucagccccccuuucccuggagcaccugccccaccugcccacagagaacacaguggucucccc

SEQ ID NO: 62480 - RNA, 64 nt, Human
accguccuucgguucuuacugagucacagacucgccugcccacuacguguccuggguucucucu

SEQ ID NO: 62481 - RNA, 64 nt, Human
gcuuccuucuggugaaguccaccuccaacauuaaccugcccaccccacccccgucaucccugga

SEQ ID NO: 62482 - RNA, 64 nt, Human
gacaccugccauugccuccucuccauugcagacgccugcccaucaaguauuaccugcggcgacu

SEQ ID NO: 62483 - RNA, 64 nt, Human
ugcuggcucaacuucaccaagaugcauucucauaccugcccacagcuccauuuuggaggcaggc

SEQ ID NO: 62484 - RNA, 64 nt, Human
uggaauguugagauuuaggcuuauuugagcacugccugcccaacugucagugccagugcauagc

SEQ ID NO: 62485 - RNA, 64 nt, Human
auuaaggaagggucaagccagccacugcuguggcccugcccagggcuugguugagggaacggcu

SEQ ID NO: 62486 - RNA, 64 nt, Human
acauagccauacaucugacugccugacauggacuccugcccacuugggggaaaccuuauaccca

SEQ ID NO: 62487 - RNA, 64 nt, Human
cuauugggcuggcagcaggacgacuggcuguccuccugcccacccacacugacggcaucuuccc

SEQ ID NO: 62488 - RNA, 64 nt, Human
cucccaaagugcugagauuacaggugugagccacccugcccagccgucaaaagagucuuaauau

SEQ ID NO: 62489 - RNA, 64 nt, Human
agccucaggcugaaguaacuuuucucugcuucucccugcccagcucagagcugagggccucccc

SEQ ID NO: 62490 - RNA, 63 nt, Human; identical to SEQ ID NO: 13369

SEQ ID NO: 62491 - RNA, 64 nt, Human
uuauuuaacuuauuucaagggugcugugcucagcccugcccauggcugugcagcucccuccgug

SEQ ID NO: 62492 - RNA, 64 nt, Human
ucccagccacaggcuucuuguccaccucuucuccccugcccaccagcugcucagcgcauaagac

SEQ ID NO: 62493 - RNA, 64 nt, Human
cagcaaaaggaaugugugugcacuuggcgagccuccugcccacccuguccacaccuaauaagug

SEQ ID NO: 62494 - RNA, 64 nt, Human
uuaguuaugcacagacugauaauaaaccucuaaaccugcccagcggaaguguguuuuuuuuuaa

SEQ ID NO: 62495 - RNA, 64 nt, Human
ggaccuguccgacugagccacugccagccgcucuccugcccaccucuccccacccugaacccag

SEQ ID NO: 62496 - RNA, 64 nt, Human
acaacauggauccuggaugaaucccaguucuuccccugcccagcuauugggagcuggccuaagu

SEQ ID NO: 62497 - RNA, 64 nt, Human
guggaggcagggcccugccccccucccuuccgcuccugcccagccugggggaaggagaaaggag

SEQ ID NO: 62498 - RNA, 64 nt, Human
cuccccuccugagccugcugucaucuucacugccccugcccaucugucacccaccugcuccuuu

SEQ ID NO: 62499 - RNA, 64 nt, Human
aacuuuuuuuuauggcguuuuucucgucccccucccugcccaaacuccccuucccuggggagcc

SEQ ID NO: 62500 - RNA, 64 nt, Human
acuguauguuaccuuuuuacucaaaggaguccccccugcccaguaacaguccuauuaguguuua

SEQ ID NO: 62501 - RNA, 64 nt, Human
uauuauaguuuuguuaugaaaguauguauuuugcccugcccacauugcagguguuuuguauaua

SEQ ID NO: 62502 - RNA, 64 nt, Human
uauccagaagcacaugaaguuugcaacuuuccacccugcccauuuuuguaaaacugcagucauc

SEQ ID NO: 62503 - RNA, 64 nt, Human
ccuucuuccucaccucucagccuccagaucccuuccugcccaucccuucccuacaaugcccacu

SEQ ID NO: 62504 - RNA, 64 nt, Human
ugaaugugaguggcaaguggcuuaucuggagccaccugcccaagucuuacuaaaaugcagcugu

SEQ ID NO: 62505 - RNA, 64 nt, Human
gucaguauuuuugccggcuggugaauucaaacaaccugcccaaagauugauuuguguguuugug

SEQ ID NO: 62506 - RNA, 64 nt, Human
uuggugaaagaaagcacauccaaagcauaguuuaccugcccacgaguucuggaaagguggccuu

SEQ ID NO: 62507 - RNA, 64 nt, Human
acgaacuuuaggaacacaguuggaggucaccucuccugcccagcucccgcacccugcguuuagg

SEQ ID NO: 62508 - RNA, 64 nt, Human
gccacccaccgacacccccagaacccucugggggccugcccaggggacccccugagccccccga

SEQ ID NO: 62509 - RNA, 64 nt, Human
acuuguaugcucuggaaucuguggagacgccagcccugcccaaucagagaugccaaaaaugggg

SEQ ID NO: 62510 - RNA, 64 nt, Human
ugagggguuuacgggcugugaauggaccuucagcccugcccacccucccuccccacugcugcug

SEQ ID NO: 62511 - RNA, 64 nt, Human
auuggucaucacucuucuguaaugcccaccugccccugcccagaauuccuagcugccuguguca

SEQ ID NO: 62512 - RNA, 64 nt, Human
ccauccaaacagaggaugcucagauuucucacauccugcccaggaucuccucuuaggguagaag

SEQ ID NO: 62513 - RNA, 64 nt, Human
cuggggagaagguggacagauuugggaggccccuccugcccaagugaggcccugggaauuuaca

SEQ ID NO: 62514 - RNA, 53 nt, Human; identical to SEQ ID NO: 13393

SEQ ID NO: 62515 - RNA, 64 nt, Human
gauggugcugugcugaggaaaggggaugcagagcccugcccagcaccaccaccuccuaugcucc

SEQ ID NO: 62516 - RNA, 64 nt, Human
cccugaaggacggggccaaccagccacuggcuuuccugcccaggcuuggccucccaggacaucu

SEQ ID NO: 62517 - RNA, 64 nt, Human
uguuaggaaaaugcuguugugugacaauggagagccugcccaaggacugugcaaccuaucuguu

SEQ ID NO: 62518 - RNA, 64 nt, Human
cccagcaguaccguccgcaccgccaggcucagccccugcccaccccacuuccacauggcccucg

SEQ ID NO: 62519 - RNA, 64 nt, Human
caggcgaaucacgaggucaggaguucgagaccagccugcccaacauggugaaacccugucucua

SEQ ID NO: 62520 - RNA, 64 nt, Human
acccgaggaggucgugcagcacagcgcagaagccccugcccacgggauccggccccccagacac

SEQ ID NO: 62521 - RNA, 64 nt, Human
cuguagugacacguucucugacagcaccuugccgccugcccacgaccuugaccgugaggagcug

SEQ ID NO: 62522 - RNA, 64 nt, Human
ucugagccccccucggaggccccgccacagccaaccugcccagucuuuccucugggcuugaccc

SEQ ID NO: 62523 - RNA, 64 nt, Human
ugggaguacuagggccggcccguccuuccccgccccugcccacauggcggcuccugccaacccu

SEQ ID NO: 62524 - RNA, 64 nt, Human
ccuaagcccagggccccuugaggcccagacucagccugcccacuggugccggagacggagugga

SEQ ID NO: 62525 - RNA, 64 nt, Human
ccugcugcugcagaacgguuuuugcugaggugccccugcccagcccuguccagccuuguccaca

SEQ ID NO: 62526 - RNA, 64 nt, Human
caucucuuuuuccccacacugucccuggccaagcccugcccagagcugaacccuguagcugccc

SEQ ID NO: 62527 - RNA, 64 nt, Human
cugggagaccuaccggcgcggcgagagcggacugccugcccacccugagguccccgacugagcc

SEQ ID NO: 62528 - RNA, 64 nt, Human
caaacaguaguacaagcuccccucagccagccugccugcccagcgaggcccccagguucaaggu

SEQ ID NO: 62529 - RNA, 64 nt, Human
gugccaccugguacagguagguggcgcucacguuccugcccaaaugcagcccaucggggaguca

SEQ ID NO: 62530 - RNA, 64 nt, Human
acauugugaaucuucccgucugaagaacgcccagccugcccagacaaagccccgccuuccccaa

SEQ ID NO: 62531 - RNA, 64 nt, Human
auagaugaccccuucagaucaucugugccuaccuccugcccaucaggcgucuacacugucacuc

SEQ ID NO: 62532 - RNA, 64 nt, Human
gccccacccccacugggcccaggccaggaggggcccugcccaugcccacacuacaggccagggc

SEQ ID NO: 62533 - RNA, 64 nt, Human
ggaucacgauauaaaaaaauuuuuccaaguuauuccugcccauugaccuaacauauggauuaca

SEQ ID NO: 62534 - RNA, 64 nt, Human
ucgaaauggccccugucuucggccgagcugguuuccugcccagccuggggcaaaccuagccgga

SEQ ID NO: 62535 - RNA, 64 nt, Human
ugaauuauccuguaguacaagauuaucuuauuccccugcccaggugugagcacgugcucucgcu

SEQ ID NO: 62536 - RNA, 64 nt, Human
ugcacugcaguuaacuguggcuccugcagggcacccugcccagaaugcccagaagagaaccaug

SEQ ID NO: 62537 - RNA, 64 nt, Human
cucccgucuccaaacagccuccuucgacucggcuccugcccagcucccggcggccuucguaggc

SEQ ID NO: 62538 - RNA, 64 nt, Human
aacugcggaauguggccucugcuuccuccguccuccugcccaaggacgacgaggauugcuccag

SEQ ID NO: 62539 - RNA, 64 nt, Human
guguccgugugccccacccucccucggcuuuacuccugcccagugacugugaccacuguccgug

SEQ ID NO: 62540 - RNA, 64 nt, Human
cagggccugcgacaggugugcucucuuuccaagaccugcccaggauuuaguaagggaaagucaa

SEQ ID NO: 62541 - RNA, 64 nt, Human
guagccaucacugccucuccagggacccuccucuccugcccaggacagacccagccagaaccac

SEQ ID NO: 62542 - RNA, 64 nt, Human
gaucuaauaccauccugcccauuguccuuaccguccugcccauacagacuguggcuccuuccuc

SEQ ID NO: 62543 - RNA, 64 nt, Human
ggaaggagauggcauagagaagaucuaauaccauccugcccauuguccuuaccguccugcccau

SEQ ID NO: 62544 - RNA, 64 nt, Human
auaucuauauuuuugcccaggucuggguauugcuccugcccagacccugacaucccuuuccacu

SEQ ID NO: 62545 - RNA, 64 nt, Human
accucaacaucacacaguauacucagcuaacaaaccugcccauguguuuccugaaucuaaaaua

SEQ ID NO: 62546 - RNA, 64 nt, Human
gggugaaagagucacaccuuagugcuauaacucuccugcccaugauaguguauucuguuucagg

SEQ ID NO: 62547 - RNA, 64 nt, Human
cauguaggucaggaccuuggcuggaccuggaggcccugcccagcccugcucugcccagcccagc

SEQ ID NO: 62548 - RNA, 64 nt, Human
ugugcucaggcaccucuucccccaggaagccuucccugcccaccccaucuaugacuugagccag

SEQ ID NO: 62549 - RNA, 64 nt, Human
ccgagcucugcagcgagcccugggaccacucaucccugcccagccagcuucagugcccggggcc

SEQ ID NO: 62550 - RNA, 64 nt, Human
ggugagcgggggagggugcccggggcacacaaggccugcccagccagccagacucaccugcccu

SEQ ID NO: 62551 - RNA, 64 nt, Human
ugucagcagggggccuggugggaggagcgacugcccugcccaaaugaacugccacagcagggac

SEQ ID NO: 62552 - RNA, 64 nt, Human
gccaagagccuccagaugugccugcagccuagucccugcccaagcuucucccccagccacccuc

SEQ ID NO: 62553 - RNA, 64 nt, Human
gcgggggcucuggagugguggggaagugaugcugccugcccacgagcccugguuuggguggcaa

SEQ ID NO: 62554 - RNA, 64 nt, Human
cuuccugcaugggagagcugucccuccuucuccaccugcccaccgggacacucccccugcucuc

SEQ ID NO: 62555 - RNA, 64 nt, Human
ucuuugccucguccaggucucuaucucccaaagaccugcccaccuccugggcucucccagggaa

SEQ ID NO: 62556 - RNA, 64 nt, Human
cgcacgcacacaagacgggagucacccugugcuuccugcccaagauacugacccauugaacccc

SEQ ID NO: 62557 - RNA, 64 nt, Human
gcagccucucuggccauugcagagcugcuggccuccugcccagguggaggguccuggggacggc

SEQ ID NO: 62558 - RNA, 64 nt, Human
caucugcaugucuguccuuugaacacuuucucucccugcccaaaaggaaacccaaauuauuugu

SEQ ID NO: 62559 - RNA, 64 nt, Human
ucuuccaaaaccgccaucagucccgagagcucacccugcccaccucgccgcaaagcgaaagaaa

SEQ ID NO: 62560 - RNA, 64 nt, Human
aaauaaguucuuaaaaaauuuauacuuaaaaaauccugcccaaaaugugaagcuugguugacug

SEQ ID NO: 62561 - RNA, 54 nt, Human; identical to SEQ ID NO: 13440

SEQ ID NO: 62562 - RNA, 64 nt, Human
cccuacccgcagaauggugcucuccuuugcccucccugcccagcagccugauaggacucuccua

SEQ ID NO: 62563 - RNA, 64 nt, Human
caugagccccaaggcuggggccacagcuccuaccccugcccagcagcccugagcucagcugcag

SEQ ID NO: 62564 - RNA, 64 nt, Human
ccagcccgaguagagggcaucccggagcccccagccugcccacuacauccagccuguggcuuug

SEQ ID NO: 62565 - RNA, 64 nt, Human
ggcuaagcaggggagcagagcaccaggccgggcgccugcccagcaggagcugaugccggaggca

SEQ ID NO: 62566 - RNA, 64 nt, Human
ugacucgggagagcuaccuuacuuugaccaacagccugcccaguguggaugucucuuacagagg

SEQ ID NO: 62567 - RNA, 64 nt, Human
cgagcucagcguucacaccaggcgggcuggguccccugcccaccugccucccugcccccuguga

SEQ ID NO: 62568 - RNA, 64 nt, Human
ggggugccuucacugggccagucaacggggggcuccugcccaggccacagagaaccugaguucc

SEQ ID NO: 62569 - RNA, 64 nt, Human
ccucccaaagugcgggauuacaagcgugaaccacccugcccagccagaaacuagauuuucuuua

SEQ ID NO: 62570 - RNA, 64 nt, Human
aaauauaauaacaguggaagucacaaaaauguccccugcccagcccccucgccgcccuugaccu

SEQ ID NO: 62571 - RNA, 64 nt, Human
gggcccaccguuuacaugugcacgcccugacccaccugcccacgccgacuugggaggauggugg

SEQ ID NO: 62572 - RNA, 64 nt, Human
cgggagccucuggggagcgaggcugaaaccugaaccugcccauggagacaguuguggugagggu

SEQ ID NO: 62573 - RNA, 64 nt, Human
ucuuccucccaggccucccuccuacugccugugcccugcccagggcuccuguccugcagccauu

SEQ ID NO: 62574 - RNA, 64 nt, Human
ugagccccucacgccgcccugcagcccccaugccccugcccaacaugcuggggguccagaaacc

SEQ ID NO: 62575 - RNA, 64 nt, Human
ccgagccccugccccggcuccccgccaaagcaacccugcccacucaggcuucauccugcacaau

SEQ ID NO: 62576 - RNA, 64 nt, Human
cagcaccguggugugaggcccccggaggcgcccaccugcccaguuagcccggccaaggacacug

SEQ ID NO: 62577 - RNA, 64 nt, Human
cuccucugcccuggggccaccucggcugcugcagccugcccagcagcacauuccagucacugcc

SEQ ID NO: 62578 - RNA, 64 nt, Human
ccuucucucuuggccuagccuggcccacucaggaccugcccagccucugccagcuccucuggca

SEQ ID NO: 62579 - RNA, 64 nt, Human
cgaagccaccguuagcgcgagcugcuccguucgcccugcccacggccugcguggcuggggccga

SEQ ID NO: 62580 - RNA, 64 nt, Human
caggcccucccucugcccucccgucugugagcucccugcccagcaccaccuccugcacugcacu

SEQ ID NO: 62581 - RNA, 64 nt, Human
cacuaccaaagccuucugggcugucggggcccaaccugcccaaccccagcacuccccaaagugc

SEQ ID NO: 62582 - RNA, 64 nt, Human
gaccgugauccucacuagacagaggagcuccaaaccugcccaucucaucccaugcaccgacggu

SEQ ID NO: 62583 - RNA, 64 nt, Human
ccuuucucuucuugcuucaauugcuuacccacugccugcccagacuuucuauccagccucacug

SEQ ID NO: 62584 - RNA, 64 nt, Human
gagucagacagaccuggguucaaguccucaguccccugcccacucccuacgugacuuugaucag

SEQ ID NO: 62585 - RNA, 64 nt, Human
agcagugcccaccgcccccccccccaccccccgcccugcccacagagcaccugcugguaacccu

SEQ ID NO: 62586 - RNA, 64 nt, Human
aacccugagaggccuaauagggcagagauggaggccugcccagacuaggaggcagcggggauag

SEQ ID NO: 62587 - RNA, 64 nt, Human
uccacccaccuccgcauccacccccguccgccauccugcccaccaccaggucgguucccgaggc

SEQ ID NO: 62588 - RNA, 64 nt, Human
agcaggaggagggcuagaagccagucccuccccaccugcccagagcuccaggccagcacagaaa

SEQ ID NO: 62589 - RNA, 64 nt, Human
ccgcuuucauguuacuguugcagcuugugcugagccugcccaguuggaggagacugggcacccc

SEQ ID NO: 62590 - RNA, 64 nt, Human
ggggugagcgcucagagggccuggggcccucacuccugcccacgccucccagaccccagaacgg

SEQ ID NO: 62591 - RNA, 64 nt, Human
ggagcccagugcuggcccccuacagguggcagccccugcccacucccaugcugguggcccuggc

SEQ ID NO: 62592 - RNA, 64 nt, Human
gcagcccagcagcccacauguguucaggacccucccugcccacccccucccugccguaucgauc

SEQ ID NO: 62593 - RNA, 64 nt, Human
ccaucaucacagacacagagagcugcaggggaggccugcccacuguuuugucgacucugcccuc

SEQ ID NO: 62594 - RNA, 64 nt, Human
ugcuggugcugaagaccaagggucccccuuguuaccugcccaaacuugugacugcaucccucug

SEQ ID NO: 62595 - RNA, 64 nt, Human
agugagccccaggccaggaggcuguuccaggaguccugcccagcagccucaguggccaagccca

SEQ ID NO: 62596 - RNA, 64 nt, Human
uaacuggcuagagccuccaggcccuaugaugcucccugcccaggccauauccuuuauuccugcu

SEQ ID NO: 62597 - RNA, 64 nt, Human
agaaagccagauggcaccagcugcuccggaugugccugcccacauugggggacagggccgggcc

SEQ ID NO: 62598 - RNA, 51 nt, Human; identical to SEQ ID NO: 13477

SEQ ID NO: 62599 - RNA, 64 nt, Human
ucuggggaggcauccgugugccggcccugcagugccugcccacggucaggcauugaaaacuaag

SEQ ID NO: 62600 - RNA, 64 nt, Human
acaggcuuggacuagcuguggcccagacaucggcccugcccagaauugccaggaggaggcuuug

SEQ ID NO: 62601 - RNA, 64 nt, Human
uugaccaugucuaugauucguguaauuacuuaucccugcccauuucauauucuuucaauucugu

SEQ ID NO: 62602 - RNA, 64 nt, Human
cucugaccuaugccuaccuucucuuucuucguucccugcccacugggcauggcagcugggggug

SEQ ID NO: 62603 - RNA, 64 nt, Human
caaaaagggcuucgggggagugguuacccugcucccugcccagugacaagcccuccuuuccccu

SEQ ID NO: 62604 - RNA, 64 nt, Human
uccuuuccccugggggcccuccuuuccccugcucccugcccagcuacggggcccuccuuucagc

SEQ ID NO: 62605 - RNA, 64 nt, Human
cccacaacccagacccagaaccgcucuccccuucccugcccagugccccuccuccccagcccag

SEQ ID NO: 62606 - RNA, 64 nt, Human
gacuccgucuccaaaaaaaaaagaauuccuggggccugcccagucugugagcugccauguugau

SEQ ID NO: 62607 - RNA, 64 nt, Human
uuucccucuacugccucuuccugccucuccccacccugcccacauccacagaggggagagaagg

SEQ ID NO: 62608 - RNA, 64 nt, Human
ccccaugaugacaucauggggagccagcagaguuccugcccauggucuugagcugaaugagaga

SEQ ID NO: 62609 - RNA, 64 nt, Human
ccaagggggugaugaaaaggggaggggcggagcuccugcccaggagaggggcuguggggcccca

SEQ ID NO: 62610 - RNA, 64 nt, Human
gaagguugugcucagccugucgggucucuuucuuccugcccauauauuauaccaguugcuucug

SEQ ID NO: 62611 - RNA, 64 nt, Human
aaucccugcucagaaugcucccaguucccucgucccugcccaggucucuugucucuugggaagg

SEQ ID NO: 62612 - RNA, 64 nt, Human
ucuuuguaccacaguggcucuggggccaggccugccugcccacuggccaucgccaccuucccca

SEQ ID NO: 62613 - RNA, 64 nt, Human
ugcccaccuccucccugacccuuaacacuccuguccugcccagaccaacagagagagcuguccc

SEQ ID NO: 62614 - RNA, 64 nt, Human
cucuuuguccuggugcccaggagcccuccagcccccugcccacagaagggaaggccugcagagg

SEQ ID NO: 62615 - RNA, 64 nt, Human
cagaagcagugaagguucuucucugugugggugcccugcccacccccuccuuugccuguguccu

SEQ ID NO: 62616 - RNA, 64 nt, Human
cugguccccucagcucugccucugcagcccacugccugcccagugccaucaggaugagcaguac

SEQ ID NO: 62617 - RNA, 64 nt, Human
gcugagggauaugccuccgcaacucacacaccugccugcccacgcuccuucuuuagcucugaca

SEQ ID NO: 62618 - RNA, 64 nt, Human
cacgggaccuccaucugacugcgccgccugcccuccugcccacccucccacccacccgaccagc

SEQ ID NO: 62619 - RNA, 64 nt, Human
uccugagugagacaaauacagaaaugacccauucccugcccaccagaaacucagaggugauugg

SEQ ID NO: 62620 - RNA, 64 nt, Human
cagccuacacgcucauauugugcauauggcagacccugcccagcgugcgcuuugauacagcaaa

SEQ ID NO: 62621 - RNA, 64 nt, Human
ugcagaauuuucuguuuagugggcagguguuauuccugcccacagcaaagcuuggacuugcagc

SEQ ID NO: 62622 - RNA, 64 nt, Human
agggaagcugguuacuuuuggccuccccagcaccccugcccaucuggugccacagccuugcccc

SEQ ID NO: 62623 - RNA, 64 nt, Human
aacaaaauacuuuuuaaagcccucuugccucuucccugcccacuccugcccccugaccagaaga

SEQ ID NO: 62624 - RNA, 64 nt, Human
ccuuuugcuucugauuucuucuccccugcuguuuccugcccaucagagaggccugauacaagca

SEQ ID NO: 62625 - RNA, 64 nt, Human
ggggaagugagggaaaaacguuaggugcuaaccaccugcccagaagaguggaucucacagccca

SEQ ID NO: 62626 - RNA, 64 nt, Human
aggccaggaacccaagccaccccggcuccccucgccugcccaggggccguggugacucacgggc

SEQ ID NO: 62627 - RNA, 64 nt, Human
ugcuggcugucccuguggacccgccauccaccguccugcccacgccgccucagccugccaccuc

SEQ ID NO: 62628 - RNA, 64 nt, Human
ccagaaggucauuuuauacaacaggagauugguuccugcccagaugacagaaaaugggagcucu

SEQ ID NO: 62629 - RNA, 64 nt, Human
cagcugugccuacuguuccccaccucagaagcuuccugcccagagagccagcagccuugggaua

SEQ ID NO: 62630 - RNA, 64 nt, Human
ugccaucucuagaauugccacgagucucucucuuccugcccaguccagggcccuccuuuccuau

SEQ ID NO: 62631 - RNA, 64 nt, Human
cagacgagucggagacuugaggaguccaaaggguccugcccacagcgcccuguaccugcuccca

SEQ ID NO: 62632 - RNA, 64 nt, Human
cuccuggagcaggcacauagugagcccgggcagcccugcccagcucaggccccuuuccuucccc

SEQ ID NO: 62633 - RNA, 64 nt, Human
ucuguacccccacuccaucccccaggggaacaccccugcccagcuacuuuccuaaugaaauaaa

SEQ ID NO: 62634 - RNA, 64 nt, Human
gcugggacuggccuggauggcuguccugggagccccugcccacccugacagagggagcugggcc

SEQ ID NO: 62635 - RNA, 64 nt, Human
gaacucguucccgaaugugcuuuccucccucuccccugcccaccucaaguuuaauaaauaaggu

SEQ ID NO: 62636 - RNA, 64 nt, Human
cccuggcccuucucaguuuucucccacauucaccccugcccagagauucccccuucuccucucc

SEQ ID NO: 62637 - RNA, 64 nt, Human
ggccagauuacuuccuccaccccucccuaucucaccugcccagcccugugcuggggcccugcaa

SEQ ID NO: 62638 - RNA, 64 nt, Human
uccgcacugccacuuguccccccacacccguccaccugcccagagcucagagcuaaccaccauc

SEQ ID NO: 62639 - RNA, 64 nt, Human
ccccuggccuugccagaguggcuucugaggacucccugcccagcccagcuuucacuggggggag

SEQ ID NO: 62640 - RNA, 64 nt, Human
ugggcuuggcacugugccaagccuggggccaaucccugcccagucagcuggggucugguggggg

SEQ ID NO: 62641 - RNA, 64 nt, Human
aaaccccaccugaagcagaaccacuuuggccuccccugcccaaaauggguagugucuacacguc

SEQ ID NO: 62642 - RNA, 64 nt, Human
ccuugucaucucagccugagcccuggaggcugggccugcccacuccagcuccaucccuuauuua

SEQ ID NO: 62643 - RNA, 64 nt, Human
cugcacuggguucucuccuucuucuuccugcuguccugcccaagaacugagggucuccccggcc

SEQ ID NO: 62644 - RNA, 64 nt, Human
cccucugcccugccagagacagacccaugcgcugccugcccaccgugccccuuuguccccaugu

SEQ ID NO: 62645 - RNA, 64 nt, Human
gugcgggacucacccggccgccagacugccugggccugcccagauggccaccucguggugcugc

SEQ ID NO: 62646 - RNA, 64 nt, Human
cuuuccacuuccagagggggccagagggacuuugccugcccagucuuuggagagcucaguacag

SEQ ID NO: 62647 - RNA, 64 nt, Human
ucagaccuucucuuccuuuccuuuccuuuccucuccugcccauuuuccuguucuucuguccuuc

SEQ ID NO: 62648 - RNA, 64 nt, Human
aaacaccuggccucaauguuggcuuguuauguuaccugcccacccucauccuuaccuccuccua

SEQ ID NO: 62649 - RNA, 64 nt, Human
uuuccagccccugaggaaauggaaugaaccacucccugcccauucccuauaagaauaucccaag

SEQ ID NO: 62650 - RNA, 64 nt, Human
ccccacacgccauggaccucagggcacucuccucccugcccacaaagaccuccugggugggaaa

SEQ ID NO: 62651 - RNA, 64 nt, Human
uugaucccggcaggacugugauacagagcccuagccugcccagccagccccaagaucucaggag

SEQ ID NO: 62652 - RNA, 64 nt, Human
agaaggcagcuuucccgcucuggguaccuuacguccugcccagcucugugcaccugaaccccag

SEQ ID NO: 62653 - RNA, 52 nt, Human; identical to SEQ ID NO: 13532

SEQ ID NO: 62654 - RNA, 64 nt, Human
cccuuugcagugcugggagccgcuuccuuccugcccugcccaccuggggaucccccaaagucag

SEQ ID NO: 62655 - RNA, 64 nt, Human
aaauauucagcuguacacacaaagucugguuuuuccugcccaacuucccccuggaagguguacu

SEQ ID NO: 62656 - RNA, 64 nt, Human
gggcugcugaccuccacagcuuccccucucuccuccugcccaccugucaaacaaagccagaagc

SEQ ID NO: 62657 - RNA, 64 nt, Human
caugcaaagacuacugggaggcugcugccuccuuccugcccauggcacccuccucugcugucug

SEQ ID NO: 62658 - RNA, 64 nt, Human
cccucaaugucuaccucugaagccuccuucccugccugcccaccccuccaugcuccacgcaggc

SEQ ID NO: 62659 - RNA, 64 nt, Human
gcccugagacuauuugcugugggcucuccuccagccugcccagggcccacccagaugccucugg

SEQ ID NO: 62660 - RNA, 64 nt, Human
uuaguuccauuucacaggugcacauaaagaccuuccugcccaccuccuauggacauguccaggg

SEQ ID NO: 62661 - RNA, 64 nt, Human
cgacgagacuucccugccguguuugugacccccuccugcccagcaaccugccagcuacaggagc

SEQ ID NO: 62662 - RNA, 64 nt, Human
acugaccacugaugauggggacccugggccagcgccugcccacuuggccucagucuccccaccu

SEQ ID NO: 62663 - RNA, 64 nt, Human
ccuugcccuaacgcgcuuugcugugagccuggccccugcccagggcuugggucuggugagcuga

SEQ ID NO: 62664 - RNA, 64 nt, Human
uggcuuugcaggacucuuaccauggccaggcauuccugcccagccuuuaccuccuuuuccuggc

SEQ ID NO: 62665 - RNA, 64 nt, Human
gcaagagaaauucagugcagcagggggacacagaccugcccaagccaccccacugccguucccu

SEQ ID NO: 62666 - RNA, 64 nt, Human
gcccuggggaaacaucagugaauaaaacacggucccugcccacagugcuuagggccuacugagg

SEQ ID NO: 62667 - RNA, 64 nt, Human
uccuuuggguuccacugacaccccugccccugccccugcccagaaccaagugccauuucucacu

SEQ ID NO: 62668 - RNA, 64 nt, Human
gucaagacuugaggccauugaagcugcaggaagcccugcccagggaugguccugccaugaggag

SEQ ID NO: 62669 - RNA, 64 nt, Human
gccuggccuccaggcccgucuguccaucugcccgccugcccaccugccuggccggccagccagc

SEQ ID NO: 62670 - RNA, 64 nt, Human
gcugacaacaaguuaucccagggccugagguucuccugcccaguccccucuugcagggguugcu

SEQ ID NO: 62671 - RNA, 64 nt, Human
cugccagagcccaagugccaucccacauucggacccugcccauaccccugccuggguuuucuaa

SEQ ID NO: 62672 - RNA, 64 nt, Human
cccaugucuuauguguguccugaaaaaauaagagccugcccaagacuuugggccucuugacaga

SEQ ID NO: 62673 - RNA, 64 nt, Human
ccaagaaggccuaguugcccgcugggccuggggcccugcccaugccugggccagaguggcgcug

SEQ ID NO: 62674 - RNA, 64 nt, Human
ugcucccugcgcgguaaccccaccacuccugaagccugcccagucuccuuccuucccugcuugg

SEQ ID NO: 62675 - RNA, 64 nt, Human
ccaggucguccucaccauagccaaggccuuggggccugcccagggcugcuccccugggcccagc

SEQ ID NO: 62676 - RNA, 64 nt, Human
gcuguuggugucuguccaguccauucaaggcuagccugcccaugcacuguggcagggguuggau

SEQ ID NO: 62677 - RNA, 60 nt, Human; identical to SEQ ID NO: 13556

SEQ ID NO: 62678 - RNA, 64 nt, Human
uucaggcacagaccuugugggacugggccccaggccugcccaggaugugguuuuccaaguccug

SEQ ID NO: 62679 - RNA, 64 nt, Human
ggugaaggugucuccaucaccaccaccagagccuccugcccagcccuggccaguucaaagguuc

SEQ ID NO: 62680 - RNA, 64 nt, Human
gucuccccuucccacccuccagccaaggagcagcccugcccagggggcauuagguguggguacc

SEQ ID NO: 62681 - RNA, 64 nt, Human
uccccucucucuccucccuguuggugcuguucuuccugcccaacaccuguuucucuuuuccuca

SEQ ID NO: 62682 - RNA, 64 nt, Human
agcaggguaggugaaagucuagagaaagaggcuaccugcccagggucacagcaaggcugggacc

SEQ ID NO: 62683 - RNA, 64 nt, Human
cuugaugcugagugauccccuccagggacacuucccugcccaggccaccucccacagcccucca

SEQ ID NO: 62684 - RNA, 64 nt, Human
auacccugaccccagugcugcucuaagcaccgucccugcccagccccacuucuccaucgcagcc

SEQ ID NO: 62685 - RNA, 64 nt, Human
cugccugcccgcacagcagccugcuucccaccucccugcccaggccggccagccucacccuugc

SEQ ID NO: 62686 - RNA, 57 nt, Human; identical to SEQ ID NO: 13565

SEQ ID NO: 62687 - RNA, 64 nt, Human
aacuaacacuugccuccccacugcagccugcgguccugcccaccucccgugaugugugugugug

SEQ ID NO: 62688 - RNA, 64 nt, Human
cuuuccgggcacaagaaaccagaguccugcccagccugcccauccccuucccagucagggcucc

SEQ ID NO: 62689 - RNA, 64 nt, Human
aacuguagucuuuccgggcacaagaaaccagaguccugcccagccugcccauccccuucccagu

SEQ ID NO: 62690 - RNA, 64 nt, Human
ggugggcagggguagaggagggggccgcuguccaccugcccagugcuuggccuggcaguggcuu

SEQ ID NO: 62691 - RNA, 64 nt, Human
aucggggaaacagcauccugccgccuccucucugccugcccacucaccggcaagguugucccuc

SEQ ID NO: 62692 - RNA, 64 nt, Human
gcgucgggccggcaguggugcggcucacuccgucccugcccaccugcgacgggaucccccgacc

SEQ ID NO: 62693 - RNA, 64 nt, Human
guggauggaaguggcuguccccuccucuccagccccugcccacccacugguggaggugcuaacu

SEQ ID NO: 62694 - RNA, 64 nt, Human
uuucuuccauugugagaccacugccaucuauccaccugcccaccuccccuuuuguuucucagua

SEQ ID NO: 62695 - RNA, 64 nt, Human
gggggcacaagggcaccuucucccuugaggcugcccugcccacgugggauucacaggggccuga

SEQ ID NO: 62696 - RNA, 64 nt, Human
gguaaggcaaggaacuggguggaaugucagguugccugcccaaugggagagguaggguuuuucu

SEQ ID NO: 62697 - RNA, 64 nt, Human
aguccaccucagcgggccagcagcccagggaaccccugcccaccaggauugcuggaagugugac

SEQ ID NO: 62698 - RNA, 64 nt, Human
ccgucacaccaagcccuuaucuggggcgcgucuuccugcccagguggaacacuggcauuuuguu

SEQ ID NO: 62699 - RNA, 64 nt, Human
guggcagcuguggcauccacuguggcaucuccguccugcccaccuucuuaagaggcgagaugga

SEQ ID NO: 62700 - RNA, 64 nt, Human
gucucaauuuaaaaugauccauggccacagggcuccugcccaggggcuugucaccuuccccucc

SEQ ID NO: 62701 - RNA, 64 nt, Human
aucaggcuggcacuaggcucagcccccaaaacccccugcccagccccagcuucagggcugccug

SEQ ID NO: 62702 - RNA, 64 nt, Human
cugccauaccuagaggucgggacagacgacgcuaccugcccagacaccaccaaguucucugccu

SEQ ID NO: 62703 - RNA, 64 nt, Human
agaggacacaaggagggugcguggugcccucaccccugcccagagcgagggggcaaggacucug

SEQ ID NO: 62704 - RNA, 64 nt, Human
uauugaauugccuugggauuuccuucucccuuucccugcccacccuguccccuacaauuugugc

SEQ ID NO: 62705 - RNA, 64 nt, Human
acaugugcaaagaagcuaaagaaaaggaauaagcccugcccaguauguagacaaccaauucaaa

SEQ ID NO: 62706 - RNA, 64 nt, Human
agguuguuuuuaccacaguggucuuuuuaaaccaccugcccacucccuuaacaagaguuuuaua

SEQ ID NO: 62707 - RNA, 64 nt, Human
ucuucaccauccgcaagcgggagccaggcggccgccugcccaccuccuccaccugcuucaaccu

SEQ ID NO: 62708 - RNA, 64 nt, Human
cuccccauaccgggccucuggcccagaccuaagcccugcccacaaagacuaauggaugccagug

SEQ ID NO: 62709 - RNA, 64 nt, Human
agggcaaguacagccacuguaaauaacccucgucccugcccaggaacccagacuggacuucagu

SEQ ID NO: 62710 - RNA, 64 nt, Human
gugucaauggcguuagacucccaggaagacuagcccugcccacagggccaccuguugguuugag

SEQ ID NO: 62711 - RNA, 64 nt, Human
gcuucggcucccaggacauggcugacuuugccaaccugcccagcugcugccgcuggaggauccg

SEQ ID NO: 62712 - RNA, 64 nt, Human
ggggccggggcucaggagccaugaccuggugucuccugcccacccuggucccagguaaauguga

SEQ ID NO: 62713 - RNA, 64 nt, Human
acaaccaaggguacacgcaggcaugcacggguuuccugcccagcgacggcuuaagccagccccc

SEQ ID NO: 62714 - RNA, 64 nt, Human
uuccuuucgcccuuguuucccacauucccuucguccugcccaagggcgggacugaagagcugga

SEQ ID NO: 62715 - RNA, 64 nt, Human
agcuggcgucuauucugcccacaccccagcccaaccugcccacguucucuauuguuuugagacc

SEQ ID NO: 62716 - RNA, 64 nt, Human
aaggagcagacugguuccuaacucucucccuccuccugcccacacacaucaaaagaaucuuccc

SEQ ID NO: 62717 - RNA, 64 nt, Human
gucuucucuucuugguuucauaccguucuuaucuccugcccaagcauauaucgucucuuuacuc

SEQ ID NO: 62718 - RNA, 64 nt, Human
ccgaccucguccucccccugccagugccuuaccuccugcccaggagagccagcccucccugucc

SEQ ID NO: 62719 - RNA, 64 nt, Human
ugagaaguugugagugucugcuguccuuggcaccccugcccacuccacacuccuggaauaccuc

SEQ ID NO: 62720 - RNA, 64 nt, Human
cagaugaggaguccucucuuuaauugcuaaccauccugcccauuauagcuacacucaggaguuc

SEQ ID NO: 62721 - RNA, 64 nt, Human
uggagccaauccacuccuuccuuucuaucauuccccugcccaccuccuuccagcacugacugga

SEQ ID NO: 62722 - RNA, 64 nt, Human
caccuuugccuccugaggcgcagcgcacuccuccccugcccaagccuacugccucccgcugccg

SEQ ID NO: 62723 - RNA, 64 nt, Human
ggggcggcgcugcucagcuugggcugguccagggccugcccaggcuggggcaccuuugccuccu

SEQ ID NO: 62724 - RNA, 64 nt, Human
auaaccucucccacagccagugccaaguccucccccugcccauucucauggggcaggaaauggg

SEQ ID NO: 62725 - RNA, 64 nt, Human
uuaguucucaggcagagacaucuuugggccugucccugcccaggccucuggcuuuuuauauuga

SEQ ID NO: 62726 - RNA, 64 nt, Human
gggccagcugccccauucuuuuaacguuguagggccugcccauggagcggacccuccucuuugg

SEQ ID NO: 62727 - RNA, 64 nt, Human
cugcuuuuuaggccucacucccaucagaacccugccugcccaccugcaacucccccccaacaau

SEQ ID NO: 62728 - RNA, 64 nt, Human
uaacuguggucaaaccagguacccaagccaccucccugcccaacgccuuuccggcuuuuccccu

SEQ ID NO: 62729 - RNA, 64 nt, Human
gaacuacugggcucaagccuuccucccgccucagccugcccaguaacugguacuacagaugugc

SEQ ID NO: 62730 - RNA, 64 nt, Human
ccuaccuugcucacugccuuaaucagaccgauuuccugcccaccugaccagcccagcgugguaa

SEQ ID NO: 62731 - RNA, 64 nt, Human
cucucaggcccucagggucaaggccuugguuggaccugcccacuccaaaaacccaguguggggg

SEQ ID NO: 62732 - RNA, 64 nt, Human
gaggacuucucagacaaaggcaaggccucgugccccugcccagcccauucauggagcccugggc

SEQ ID NO: 62733 - RNA, 64 nt, Human
cccacucaguggggaaagcaggggcagaugccacccugcccaggguuggcaugacugucugugc

SEQ ID NO: 62734 - RNA, 64 nt, Human
ucgcccgcuccaucacggauaacaucuccuacggccugcccacugugccuuucgagaugguggu

SEQ ID NO: 62735 - RNA, 64 nt, Human
agaaaggcuguaucuuaauuucugcaccccggacccugcccaccugucugccugccccgccugg

SEQ ID NO: 62736 - RNA, 64 nt, Human
aaauggacucuccucggguggguccagcaggggcccugcccaccagaacacaguccgugcugug

SEQ ID NO: 62737 - RNA, 64 nt, Human
ucgaggguacuaugauauuuugguuuggaauugcccugcccaagucacugucuuuuaacuuuua

SEQ ID NO: 62738 - RNA, 64 nt, Human
aauguugguuucagucaucaacuacccaugaauuccugcccaaggauacuuaaucaggauuaaa

SEQ ID NO: 62739 - RNA, 64 nt, Human
aaccccauucuuuccagcgccccgcaccauagcaccugcccaccugagaaccaggaacgcaccc

SEQ ID NO: 62740 - RNA, 64 nt, Human
gggugcaagcacucggggucccuggagggcaagcccugcccacagaaagccaggagcagcccug

SEQ ID NO: 62741 - RNA, 64 nt, Human
ugagguccuuguguggccgcccuggcuuggcagcccugcccacgcugcccccgcaaacaauggu

SEQ ID NO: 62742 - RNA, 64 nt, Human
uagguucucgcgauucaggacguccuuccauaucccugcccagccuguggugcuugaaacguuu

SEQ ID NO: 62743 - RNA, 64 nt, Human
uaccugcccccagagcugaggccaucugcaagccccugcccauggcccaauggggagccuccag

SEQ ID NO: 62744 - RNA, 64 nt, Human
agucuccuucggaacccgaacugcaagcugagcgccugcccagauucucccauggguauuucac

SEQ ID NO: 62745 - RNA, 64 nt, Human
uuaggaaguauaaguaagccaagagaagucagccccugcccagaagaucugaaacuaauaguag

SEQ ID NO: 62746 - RNA, 64 nt, Human
gcauccuuccccucaagccugggcucauggagccccugcccagggcccucaggugggcggaaag

SEQ ID NO: 62747 - RNA, 64 nt, Human
ucaccuuaacuuaugacucaggauuuauucacguccugcccacucuaggcucacaggaauaaaa

SEQ ID NO: 62748 - RNA, 64 nt, Human
ccuaaagaaagauuacguugaugaaaaagaacauccugcccaggacccaucauacauauuuuca

SEQ ID NO: 62749 - RNA, 64 nt, Human
ccugaugcccccacccaccucgguccagcgcggcccugcccaggaggcggcagccgggcgcacc

SEQ ID NO: 62750 - RNA, 64 nt, Human
cggaugcugcuuccgguagggaggcagccuccagccugcccaagcccaggccacccuaucgccc

SEQ ID NO: 62751 - RNA, 64 nt, Human
ugucuccgguaaaacaccggagacuaauuccugcccugcccaauuuugcagggagcauggcugu

SEQ ID NO: 62752 - RNA, 64 nt, Human
cccugcaguguugucggccgaggccugagcucgcccugcccagcuacugaccucaggucgaggg

SEQ ID NO: 62753 - RNA, 64 nt, Human
agcagacacugcuccuugugcagcucugguaccuccugcccacugcugucacuucaagccacug

SEQ ID NO: 62754 - RNA, 64 nt, Human
ucuagaaccaguauguggcauuccugucaaauggccugcccaugaagcccuggaauuccagcuc

SEQ ID NO: 62755 - RNA, 64 nt, Human
aggaacagagaauauccaaugcagucaaguccacccugcccagacuuugccacugacuucuccc

SEQ ID NO: 62756 - RNA, 64 nt, Human
gauagauuaggaccucuauccgagaugcuuuuucccugcccaacccuguggccuucagggcuca

SEQ ID NO: 62757 - RNA, 62 nt, Human
acugcaggcugcagccaguccagagagaauagagccugcccaggccuuaagaccaccucuca

SEQ ID NO: 62758 - RNA, 64 nt, Human
uugaggccccugacuuccuucuagggcagucuggccugcccacaaacugacuuugugaccuguc

SEQ ID NO: 62759 - RNA, 64 nt, Human
acggaacaaguaauuuaccaguucuacugggguuccugcccaccgucccaaggugggcgaggcc

SEQ ID NO: 62760 - RNA, 64 nt, Human
agcccugccgggcacaugcccgggggacgccugcccugcccagguggccuccuggcccgcccuc

SEQ ID NO: 62761 - RNA, 64 nt, Human
cagacggccggccggaccucugagcacauaguguccugcccacccuaccagcuccuccagcccu

SEQ ID NO: 62762 - RNA, 64 nt, Human
aaccauuuaucauggaugaaagagaucuguaaaaccugcccaggaacuuacagaauuuacuuug

SEQ ID NO: 62763 - RNA, 64 nt, Human
agucaugccuuaagaagcagagcuaccuuacgugccugcccaggcuguuccugccuaaaucucc

SEQ ID NO: 62764 - RNA, 64 nt, Human
caauaucaguauuuuuuuccucccuauacagugcccugcccacccuuaucugcacccaccuccc

SEQ ID NO: 62765 - RNA, 64 nt, Human
ugagauggcugagcuuccagcgccuucuguccugccugcccagucccuucacugcuuuccugcc

SEQ ID NO: 62766 - RNA, 64 nt, Human
cucccacugccuucuaaggagccaaggagaauucccugcccacuuucuguuccuccaugcccaa

SEQ ID NO: 62767 - RNA, 64 nt, Human
cugcuguugcacgggagaacuuuccucacccgccccugcccagacagggugaggaaagggcucc

SEQ ID NO: 62768 - RNA, 64 nt, Human
uccuaaucaaguaucugagccagaugcugcgggaccugcccagcugcccgugugccuacccacu

SEQ ID NO: 62769 - RNA, 64 nt, Human
cauggccacuguggaccgggacccuugggggaagccugcccaugucgggcugugggaggcugau

SEQ ID NO: 62770 - RNA, 64 nt, Human
cgcugccugcccguaaacacgccugcaaacgcugccugcccacacagguucacgugcagcucaa

SEQ ID NO: 62771 - RNA, 64 nt, Human
uaugcgcaauguggcauuggggggccgggcagguccugcccauguguccccucacucugucagc

SEQ ID NO: 62772 - RNA, 64 nt, Human
ggccaguccacccugccugccgucugugcuuccuccugcccagaacgcccgcuccagcgaucuc

SEQ ID NO: 62773 - RNA, 64 nt, Human
agggcagauuccuaagcagcuggccugaccucuuccugcccagcccccaacccagucucuggcc

SEQ ID NO: 62774 - RNA, 64 nt, Human
uucuugggaaguagagauguggcggcuuucccacccugcccacagcaggcccuccugcccagcu

SEQ ID NO: 62775 - RNA, 64 nt, Human
uggcggcuuucccacccugcccacagcaggcccuccugcccagcugcucuugucagcccucugg

SEQ ID NO: 62776 - RNA, 64 nt, Human
uuguuguauacuguuaacgauugucugcccauguccugcccaaaauaccaugauucuuuaugga

SEQ ID NO: 62777 - RNA, 64 nt, Human
aacaguuauucuaucaacuuuuaaagguuuuaaaccugcccagaaauuaccuugguaucugaag

SEQ ID NO: 62778 - RNA, 64 nt, Human
ggggccucuggggugagagcagcuuccgauaggaccugcccagauuucugcaugugcacuuuug

SEQ ID NO: 62779 - RNA, 64 nt, Human
ggguggggcauugagaauggaggcucccagggucccugcccacuucuguuuuccuaauguuuuu

SEQ ID NO: 62780 - RNA, 64 nt, Human
ugccccucaugagguuagggucccccacccuccaccugcccagaggccaacucuguucccuucu

SEQ ID NO: 62781 - RNA, 64 nt, Human
guuugaccugaugaggaggauguuagaauuugacccugcccagcgcaucacacuggccgaggcc

SEQ ID NO: 62782 - RNA, 64 nt, Human
ccaaugcccagagugaccaagcagcaccagcaggccugcccaggaugcugaaagcagauuucuu

SEQ ID NO: 62783 - RNA, 64 nt, Human
auccuugccccacuggugagaggaggaccuugugccugcccagagccugcaggacagcacgccu

SEQ ID NO: 62784 - RNA, 64 nt, Human
cagaugcugcuugcucagaaacaacccgugcaucccugcccauggauucugcaggaccuagaag

SEQ ID NO: 62785 - RNA, 64 nt, Human
ugcacauggcccuuugcuugagggcuccccacucccugcccaccaauacccaggugaggaacag

SEQ ID NO: 62786 - RNA, 64 nt, Human
cauuguccuucuccaucugggccaauuguccuucccugcccauucagaguucaauuugagccuc

SEQ ID NO: 62787 - RNA, 64 nt, Human
uuccuuuuuucaauaugcaagcagcuuuuuauucccugcccaaacccuuaacugacaugggccu

SEQ ID NO: 62788 - RNA, 64 nt, Human
agggaaguccuuccagugccacauggagugaggcccugcccaugcuggggacuuuggggaggaa

SEQ ID NO: 62789 - RNA, 64 nt, Human
gugauuucggaccgaaggugacagccgucccaacccugcccagccugaugccaccuccucuguu

SEQ ID NO: 62790 - RNA, 64 nt, Human
uauuaugaguuuuaaaacuuuuaacccgcuucuaccugcccaacugugaccaacuaaaugacag

SEQ ID NO: 62791 - RNA, 64 nt, Human
ucucccugccugggggcuaugugcacuccagaccccugcccaggcucaggcccaugagguaugg

SEQ ID NO: 62792 - RNA, 64 nt, Human
uggggcagaggccaggaggggaccuggugugucaccugcccaccaccuggcucaucccucaggc

SEQ ID NO: 62793 - RNA, 64 nt, Human
gugcccagcccugagggcagggaaggucaacccaccugcccaucugugcugaggcauguuccug

SEQ ID NO: 62794 - RNA, 64 nt, Human
aggaaaacaggaaaggagguuccagccccacccaccugcccaccccgccccaggcaccaucagg

SEQ ID NO: 62795 - RNA, 54 nt, Human; identical to SEQ ID NO: 13674

SEQ ID NO: 62796 - RNA, 64 nt, Human
cucgggggccuccggagcugggcuuugggccucuccugcccaccucuacuucucugugaagccg

SEQ ID NO: 62797 - RNA, 64 nt, Human
cgugcccgccuggugccuucuggccuguggccucccugcccauguucaccuggcugcugugggu

SEQ ID NO: 62798 - RNA, 58 nt, Human; identical to SEQ ID NO: 13677

SEQ ID NO: 62799 - RNA, 64 nt, Human
cagcagccccucugcacggucaccaucgccugggccugcccacagcacuggugcucaccucuac

SEQ ID NO: 62800 - RNA, 64 nt, Human
agccugacgccugcaccgggcccuccagcccuccccugcccagauagcugguggugggcgcuaa

SEQ ID NO: 62801 - RNA, 64 nt, Human
gccucuauccugucuguccccaccccagcuguccccugcccagggagcuggcauaaaagcacga

SEQ ID NO: 62802 - RNA, 64 nt, Human
ggcagcugcuugagaacagagacugcuaccccauccugcccaugcaggcaggcucuugccagcc

SEQ ID NO: 62803 - RNA, 64 nt, Human
ccgcagagggcagacgccacccuggacugcucucccugcccagcugggccucucuggccuauuc

SEQ ID NO: 62804 - RNA, 64 nt, Human
ccugggcugccccuugacauucaggauguagcuuccugcccaccgcauacccuggcgccucacu

SEQ ID NO: 62805 - RNA, 64 nt, Human
uccacaagcugcuccucucucuguggccccggccccugcccaggugugggugguucuggccagg

SEQ ID NO: 62806 - RNA, 64 nt, Human
cagccgcacaugcucaggcagcuaagggaggacgccugcccacgccugggacagaaggcuucac

SEQ ID NO: 62807 - RNA, 64 nt, Human
ugacagccgacggcagcgccuugcccagaccuccccugcccaccugcuggagcccagccugugc

SEQ ID NO: 62808 - RNA, 64 nt, Human
cgugugaccuggguagucagacaccacuugagccccugcccacaucugcugguuuggggcuuca

SEQ ID NO: 62809 - RNA, 64 nt, Human
uccugguggccuggcaggucugggcccuucucucccugcccagguugucccuggagggcagccc

SEQ ID NO: 62810 - RNA, 63 nt, Human; identical to SEQ ID NO: 13689

SEQ ID NO: 62811 - RNA, 64 nt, Human
agagaguagugacacucaggauccaaaagcuagcccugcccaccccagccccuggaccugcuua

SEQ ID NO: 62812 - RNA, 64 nt, Human
caugcccucccaacccuggaguugucagggagggccugcccaucaccucccucuccccaacauc

SEQ ID NO: 62813 - RNA, 64 nt, Human
cucggagcucgccugcccugcuuggcucugaggaccugcccagcgcucaaagggaacggaagcc

SEQ ID NO: 62814 - RNA, 64 nt, Human
gccuacuugcccuagcaugaggcucugagagccaccugcccaccaaucuggugaggauaauggu

SEQ ID NO: 62815 - RNA, 64 nt, Human
auucagaggagccuguuggcaagagcugguauucccugcccagccgaccaaaugaccucugcau

SEQ ID NO: 62816 - RNA, 64 nt, Human
ggccagagggagugacagaggcagccccauucugccugcccaggccccugccacccuggggaga

SEQ ID NO: 62817 - RNA, 64 nt, Human
acuaauuuuauuuaugauucaaaugugacucgugccugcccaucccuguaauagauggaagguc

SEQ ID NO: 62818 - RNA, 64 nt, Human
aauggggggaaggauuauuauucauguuauuuucccugcccaagacuuuauuuaacccuggacu

SEQ ID NO: 62819 - RNA, 57 nt, Human; identical to SEQ ID NO: 13698

SEQ ID NO: 62820 - RNA, 64 nt, Human
cccacccuccauuccggaccccaugggcccagccccugcccaucuaguugguuuggggacccug

SEQ ID NO: 62821 - RNA, 64 nt, Human
cugacacccugugacugagccuguguccugucugccugcccagccaugcuccaucggcugugag

SEQ ID NO: 62822 - RNA, 64 nt, Human
ucaggaagguagagaguuuuccuguucagauuacccugcccagcaggaacuggaauacaguguu

SEQ ID NO: 62823 - RNA, 64 nt, Human
ccugcacuuccugcuggacucaggccuccagcucccugcccagcgagcggccucagccaccgcc

SEQ ID NO: 62824 - RNA, 64 nt, Human
gcccucuggaucuggguuccaucucugucuccagccugcccacuucccuucaugaauguugggu

SEQ ID NO: 62825 - RNA, 64 nt, Human
gcucugguccauagagagcaagacgcugugcugcccugcccaccuggccucugcacuccccugc

SEQ ID NO: 62826 - RNA, 62 nt, Human; identical to SEQ ID NO: 13705

SEQ ID NO: 62827 - RNA, 64 nt, Human
ccucaggcacaccuugcagaaggcaaggcccugcccugcccaaccucuguggucacccaugcau

SEQ ID NO: 62828 - RNA, 64 nt, Human
aaagcugcaaaccacuguaccugccucagucaggccugcccacuaugggcagaccucucgcuca

SEQ ID NO: 62829 - RNA, 64 nt, Human
ccaggccccgguggguuugucugcacuuggugcuccugcccacaccagccacuuuggugacaau

SEQ ID NO: 62830 - RNA, 64 nt, Human
agcagaacaccugaggacaggaguuugagaccagccugcccaacguggugaaaccccaucucua

SEQ ID NO: 62831 - RNA, 64 nt, Human
ccauccuccuggaaugggggaaccuuccuuauccccugcccacauccccucuccaauaaagcac

SEQ ID NO: 62832 - RNA, 64 nt, Human
ccugggagugaucacugcacgcccaucgugcacaccugcccaucgugcacacccacccauggug

SEQ ID NO: 62833 - RNA, 64 nt, Human
cagaguauugggauuacagacaugagccacugcaccugcccagcuccccaacucccugccauuu

SEQ ID NO: 62834 - RNA, 64 nt, Human
gcuggggggcuguccugagcccccugcacccaccccugcccaggcagucuuugcucaguggauc

SEQ ID NO: 62835 - RNA, 64 nt, Human
augguggcagccgccaggcgagcaggcugcuuucccugcccagucaugcaccucccccucuggg

SEQ ID NO: 62836 - RNA, 64 nt, Human
ugugcuggcaaucagggccgcaguguguucugcgccugcccagagcugacuccugauuuaaccg

SEQ ID NO: 62837 - RNA, 64 nt, Human
uccacugcacuuggaaggauauauuaugccuaacccugcccaacaaauuaagguuugugccuaa

SEQ ID NO: 62838 - RNA, 64 nt, Human
gaucuuguaccaagccaacggcguuccuggcucuccugcccacaggaugaacauuuucggcuuc

SEQ ID NO: 62839 - RNA, 64 nt, Human
uaggguggauccuugccaggcgucccugauccucccugcccaagucuuccuucgugagcuggcc

SEQ ID NO: 62840 - RNA, 64 nt, Human
gggugcacagccucccucccuccagcaagcccucccugcccagaaggaauggguccaggugugg

SEQ ID NO: 62841 - RNA, 64 nt, Human
ggccgugggacugaugcgggaucccgagggccuuccugcccacaugccccgggagaaaccgagg

SEQ ID NO: 62842 - RNA, 64 nt, Human
agccugacgccugcaccgggcccuccggcccuccccugcccaggcagcugguggugggcgcuaa

SEQ ID NO: 62843 - RNA, 58 nt, Human; identical to SEQ ID NO: 13722

SEQ ID NO: 62844 - RNA, 64 nt, Human
ugugcuggggacagguccucaguguccucaggggccugcccagugcacuugcuggaagacgcaa

SEQ ID NO: 62845 - RNA, 64 nt, Human
auaaauguuaaugauuuuuauagguauuuguaacccugcccacauaucuuauuuauuccuccaa

SEQ ID NO: 62846 - RNA, 64 nt, Human
gggaaaauuaaacaaaaccccagguuauuucuucccugcccagagccagccugggauugucagc

SEQ ID NO: 62847 - RNA, 64 nt, Human
cgagaagcccacaagaucugagugaaaaaagucaccugcccaauaaagcuugacaagacacucg

SEQ ID NO: 62848 - RNA, 64 nt, Human
cucaagcccccagcuggaaguuaagagaaagucaccugcccaagaaacaccgagugaggccaua

SEQ ID NO: 62849 - RNA, 64 nt, Human
cuguacuggaacucuggaaagaggggcuccccgaccugcccaucccccaggcucuucugggccu

SEQ ID NO: 62850 - RNA, 64 nt, Human
ugggcuccagcccuccccugcccccagcccguccccugcccagggcacagcggagccauggggg

SEQ ID NO: 62851 - RNA, 64 nt, Human
cuaccuccuuaacuuuguacuagacuggccugggccugcccagcucagcguuaucagucuguuu

SEQ ID NO: 62852 - RNA, 64 nt, Human
ucccaccuguuucuggaagacugcucccggcccgccugcccagacugaugagcacaucucucug

SEQ ID NO: 62853 - RNA, 64 nt, Human
aacugagggccagggacccaggugugccugugcuccugcccaggagcagcuuuuggucuccuug

SEQ ID NO: 62854 - RNA, 64 nt, Human
ccgcagucgagccgggaggaacccaggcugcugcccugcccagcccgacccugccccggcccca

SEQ ID NO: 62855 - RNA, 64 nt, Human
gcaccugcagacgcagggggacugcacaauuccaccugcccaggaccugacccuggcgugugcu

SEQ ID NO: 62856 - RNA, 64 nt, Human
ggaaggauggcucuggccucgguccucccccaacccugcccaagccagacagacagcaccugca

SEQ ID NO: 62857 - RNA, 64 nt, Human
uuucuaucagacgugcucccucccauccuccagcccugcccacccucccuccacuccucucaac

SEQ ID NO: 62858 - RNA, 64 nt, Human
ggaagacccugaccguguacauagcccuggugcuccugcccagccaccccucagaugcguucgc

SEQ ID NO: 62859 - RNA, 64 nt, Human
cgccccucuucaguccugcccuccccuccucaguccugcccaccccgugcagcccaugcugagg

SEQ ID NO: 62860 - RNA, 64 nt, Human
acagggaagcucgggaaggggaagggagacuggcccugcccagccggucucuagccccucagcc

SEQ ID NO: 62861 - RNA, 64 nt, Human
aaagggccccgcagcccuucugcacccagcacagccugcccagcccagcccugcccccgggcac

SEQ ID NO: 62862 - RNA, 64 nt, Human
gagggcaggcugcaugcaguggcggcuacugggcccugcccagccccggaacucugcgcgauau

SEQ ID NO: 62863 - RNA, 64 nt, Human
uggucucagccacagcaccccuuauuccagcugcccugcccaaccugcucaccccacaugaccu

SEQ ID NO: 62864 - RNA, 64 nt, Human
ugccucccccuguauucccccucccagggcagccccugcccagcacaaaaccccaggacccugg

SEQ ID NO: 62865 - RNA, 64 nt, Human
cagagguggcacaugcuuggccacacaucuacucccugcccacaccaucuaugcucuugguugg

SEQ ID NO: 62866 - RNA, 64 nt, Human
cacuugguaccaauccaccaggcagcucagggcuccugcccagcccagcagcuucuguugucua

SEQ ID NO: 62867 - RNA, 64 nt, Human
cuagcuggccuggcccuguugagucugcacagucccugcccagcugugucuucuguuggaagaa

SEQ ID NO: 62868 - RNA, 64 nt, Human
gagcagccuuaggacccugggaccaagggcagacccugcccaaggaugcaggccuaagccgggc

SEQ ID NO: 62869 - RNA, 64 nt, Human
agagugggcaauucucaccuucaaagaguccccgccugcccaggccuuuggcacagaggcugag

SEQ ID NO: 62870 - RNA, 64 nt, Human
ucaccugccccucuguucucuccccucacauccuccugcccagcuccucacauacccacacauu

SEQ ID NO: 62871 - RNA, 64 nt, Human
ccgcgcguuccuucgcacacugugauuuugcccuccugcccacgcagaccugcagcgggcaaag

SEQ ID NO: 62872 - RNA, 64 nt, Human
aacagcacuggggagucuuuguggauucugaggcccugcccaaugagacucuaggguccagugg

SEQ ID NO: 62873 - RNA, 64 nt, Human
aucucagcuggucacccaugauaaccaacuuccaccugcccaaccauauaucacccccuacccc

SEQ ID NO: 62874 - RNA, 64 nt, Human
gaauggggacaggcucuuucccccuuggggguccccugcccagggcacuguccccauuuuccca

SEQ ID NO: 62875 - RNA, 64 nt, Human
cagucuuggcugcugcuuaccccuagccuugaugccugcccagggacccccagcccccucccgu

SEQ ID NO: 62876 - RNA, 64 nt, Human
ucgggguuggcuucuucccaggccuugcaugggcccugcccacaagcacacccucaggccgagg

SEQ ID NO: 62877 - RNA, 64 nt, Human
uuuccagugggguuugaagcagaguucagggaacccugcccaagguccuccuguucagacauuc

SEQ ID NO: 62878 - RNA, 64 nt, Human
ccaaccuuuuccaagauaugcaauggccuuugugccugcccaaaggcuucgcccccuccagugc

SEQ ID NO: 62879 - RNA, 64 nt, Human
acuggacaggcaaagacugcaguauccauaacccccugcccacguccccacccacgggggagac

SEQ ID NO: 62880 - RNA, 64 nt, Human
acaggacugggccgggcccagggccucuggcuucccugcccaauccucccuggagaagggacau

SEQ ID NO: 62881 - RNA, 64 nt, Human
caggaccacuagcuaagcaagccaggagaagaccccugcccaaguggcucuugggacaacgugc

SEQ ID NO: 62882 - RNA, 64 nt, Human
acuccagguguggaccggccgcagcccccacugaccugcccauguccagagggacuggacagcc

SEQ ID NO: 62883 - RNA, 64 nt, Human
ugccuuggcccuuccccucaccacgagcucccggccugcccagacuguggacacuggccgugcc

SEQ ID NO: 62884 - RNA, 64 nt, Human
ugggaaccucucugugacacccuccguguucuugccugcccaucuucuccgcuuuugggaugaa

SEQ ID NO: 62885 - RNA, 64 nt, Human
acgcugucuccagacccccaccccuuccccacugccugcccacccguggagaugggaugcuugc

SEQ ID NO: 62886 - RNA, 64 nt, Human
gccacagaggccaggccagggcuggaaggacaggccugcccaugcaggagaccaucuggacacc

SEQ ID NO: 62887 - RNA, 64 nt, Human
gggaggaggagcgcuacccaccuccagggagcacccugcccaccaagaagcacugggugaccag

SEQ ID NO: 62888 - RNA, 64 nt, Human
cauccugaucaggccccaucucaagguuggcacuccugcccaucacccuuagaaggaucuuuuc

SEQ ID NO: 62889 - RNA, 64 nt, Human
ugcauguuuaucauguuacaauuuaauauuccauccugcccaacccuuccucucccauccucaa

SEQ ID NO: 62890 - RNA, 64 nt, Human
ugggcccgagcucaucgaccugagggggcccaucccugcccaccuccuggguaaaggcccugcu

SEQ ID NO: 62891 - RNA, 64 nt, Human
uagaaagagccuaggagacaaaagggccagucccccugcccagaauggagcagcagcaggacag

SEQ ID NO: 62892 - RNA, 64 nt, Human
uuaaggugggaaaaaaaaaaguguggcauagcuaccugcccauccccaacccucagcaaaguag

SEQ ID NO: 62893 - RNA, 64 nt, Human
gcgaacugggcagcacggggaggguuuggcuaccccugcccaucccugagccagguaccaccau

SEQ ID NO: 62894 - RNA, 64 nt, Human
gggcuugggauggacccucagccccaugguacgcccugcccaguuuccaguugcccuguccacu

SEQ ID NO: 62895 - RNA, 57 nt, Human; identical to SEQ ID NO: 13774

SEQ ID NO: 62896 - RNA, 64 nt, Human
cuggucagaguggcgugagcugcccggcgccugcccugcccaagugaccagggaagugugugug

SEQ ID NO: 62897 - RNA, 64 nt, Human
augaguggccagcgccagggcccaggccauguggccugcccagccucaaugucacuugguggcg

SEQ ID NO: 62898 - RNA, 64 nt, Human
gagcaggguugcggugucuccacggugcucucgcccugcccauggccaccccagacucugaucu

SEQ ID NO: 62899 - RNA, 64 nt, Human
uccagccaacaacucccuacguccuguguggggcccugcccaaguggaugaggcauuccuugag

SEQ ID NO: 62900 - RNA, 64 nt, Human
acauguuggcaacacacgcauccgcaucggccucccugcccacaaagcgccacaacggugacca

SEQ ID NO: 62901 - RNA, 64 nt, Human
accuugucuuucugucuguuuaccugucucccugccugcccaucugcaucuuuugcagcccacu

SEQ ID NO: 62902 - RNA, 64 nt, Human
ggacaccccgaagcccaccugcaaucucccaccuccugcccaucccucucuugagggagcagca

SEQ ID NO: 62903 - RNA, 64 nt, Human
uuuguaauuccagcccccugucgccuguccagggccugcccacccguuggaggccgguggagaa

SEQ ID NO: 62904 - RNA, 64 nt, Human
agugccggcuacugggggcccagcugcaacgccuccugcccagccgguuuccauggaaacaacu

SEQ ID NO: 62905 - RNA, 64 nt, Human
agagcagccucguggagcucgccccuccccucagccugcccaccucucccugcauccugaggcc

SEQ ID NO: 62906 - RNA, 64 nt, Human
ccagugcucugucagcagccuggccuggucugugccugcccagcauguucccaaaucugugcug

SEQ ID NO: 62907 - RNA, 64 nt, Human
uuaaagugggggagauggcagacgcuuucugggaccugcccaagauauguauucucugacacuc

SEQ ID NO: 62908 - RNA, 64 nt, Human
gagcagaggccugaagcggaagcaccacaucgucccugcccaucucacucucucccuugaugau

SEQ ID NO: 62909 - RNA, 64 nt, Human
agcugccacaggcauaugguggagagggggguacccugcccaccuuggggugguggcaccagag

SEQ ID NO: 62910 - RNA, 64 nt, Human
ccccagcacaccucuggcuaacccauaccccacaccugcccagcucuggcuucucuguugagga

SEQ ID NO: 62911 - RNA, 64 nt, Human
agggcccccacuguaagcccccgcacccccacccccugcccagagcaacagccuaaaggccugc

SEQ ID NO: 62912 - RNA, 64 nt, Human
agagaaugugccaugaucagggauaugagcagggccugcccagagccugggcaccuuugggaga

SEQ ID NO: 62913 - RNA, 64 nt, Human
ugggucacacguaggggcuagagccagccugcauccugcccaccgggcuccacuuggagaucag

SEQ ID NO: 62914 - RNA, 64 nt, Human
auauuacaguuaugugauaaaggaaaaauucuuuccugcccaggaccugcgccauccuuuaggc

SEQ ID NO: 62915 - RNA, 64 nt, Human
gugacuagaucaggcagggauccauucccuguccccugcccacuaccuucaggccauuuagagu

SEQ ID NO: 62916 - RNA, 64 nt, Human
auucaguucuugugucguuugugaaaguucuuaaccugcccaaaaacccccuuuuccccaagcu

SEQ ID NO: 62917 - RNA, 64 nt, Human
uggggaauuuauuugcugcuucucccagccuuccccugcccacaccaccugcgcaugccuggca

SEQ ID NO: 62918 - RNA, 64 nt, Human
ggaaucaauaaguacugagagugcagccccuuccccugcccaggguggcaggggagggguaggg

SEQ ID NO: 62919 - RNA, 64 nt, Human
ccuccaaggacccucugaccccaucgaccugggcccugcccacacaacagucugagcaagagac

SEQ ID NO: 62920 - RNA, 64 nt, Human
uccuuucgcgauacuagagccucuguaaacuucuccugcccagccccagcugagcauccccaga

SEQ ID NO: 62921 - RNA, 64 nt, Human
guguggacacagaucccacuggaagauccccucuccugcccaagcacuucacagcuggacccug

SEQ ID NO: 62922 - RNA, 64 nt, Human
agcuccuagaacugagcugccucuaccacagccuccugcccaccagcuggccucaccuccugaa

SEQ ID NO: 62923 - RNA, 64 nt, Human
cuuuccguguccuucugauacaguugaucagaccccugcccaccgcccaggccaggccuguggu

SEQ ID NO: 62924 - RNA, 64 nt, Human
cggcugggaaggucucugaucacacagaagcagcccugcccagccuggucauuugcuguccgcu

SEQ ID NO: 62925 - RNA, 64 nt, Human
acaagcagggaagugaaaggucccaggcacacacccugcccauugcagguggcucuuacagcuc

SEQ ID NO: 62926 - RNA, 64 nt, Human
auggguggggacguccugccaccuggggcagucaccugcccagaucccagaaggaccuccugag

SEQ ID NO: 62927 - RNA, 64 nt, Human
uuaaaaauuggcucacuauugcuuuguaguaaccccugcccagguauuuuuucacuugugaaaa

SEQ ID NO: 62928 - RNA, 64 nt, Human
auuccccugccuggagccuccaaaagaaaccagcccugcccacgccuugacuugagcccauuga

SEQ ID NO: 62929 - RNA, 64 nt, Human
uugugccaagggaaugccucuugccacccaccauccugcccaggcccugagaggcuggaggagg

SEQ ID NO: 62930 - RNA, 64 nt, Human
ugugcaccuaggccucauuccuuaccccccagccccugcccaccuucagcaggaugaggcccug

SEQ ID NO: 62931 - RNA, 64 nt, Human
gcgcuaagugagaaagagagcaggcucgggaggcccugcccaggguaggaggagcuuccugcuu

SEQ ID NO: 62932 - RNA, 64 nt, Human
gcaccauaauccagugggggugacugggugcacaccugcccaggugaacacagcggcugccagu

SEQ ID NO: 62933 - RNA, 64 nt, Human
ucugcauugguuauaauaacaguuaucaguaauuccugcccagaagacuuuuauuuauuuuuuu

SEQ ID NO: 62934 - RNA, 64 nt, Human
cucaacaucuggagauacaggcccaccccucaguccugcccacagagaggcuuggucggucucc

SEQ ID NO: 62935 - RNA, 64 nt, Human
cacgaggcccugcugaaguccagacccucccccuccugcccacugugcucuaaacccugcucag

SEQ ID NO: 62936 - RNA, 64 nt, Human
guuguacccugauacggccuggccaucgaggacaccugcccauccggccucugugucaagaggu

SEQ ID NO: 62937 - RNA, 64 nt, Human
uguguuugacaaacagcagcuggcagcgcugccuccugcccacauuccugccacccgacaucaa

SEQ ID NO: 62938 - RNA, 64 nt, Human
caguggacaaugaugccuccuccgggaagccuucccugcccagcccacgccgccaccgggagga

SEQ ID NO: 62939 - RNA, 64 nt, Human
cuuuagagaaaguuuccuauucucuuccauuuccccugcccaaagugcugacauaggcagugau

SEQ ID NO: 62940 - RNA, 64 nt, Human
ccugucuggccacagacaggggcugccuguggagccugcccaccggcccccggcagugcagucc

SEQ ID NO: 62941 - RNA, 64 nt, Human
cacauacacaugcaucagugucugccugccuccaccugcccagccuguucuucuucuucuucuu

SEQ ID NO: 62942 - RNA, 64 nt, Human
ucuguccuuccucacaccagauuguucccaggggccugcccaccccagugccauccaguggcac

SEQ ID NO: 62943 - RNA, 64 nt, Human
uugguaucaacuagccagugacucgcucaucugcccugcccaggcccacguuuugaaguuggag

SEQ ID NO: 62944 - RNA, 64 nt, Human
uaugaucaguggaucaggaaugcaauugugaauuccugcccauugccucucuuggugaaugugg

SEQ ID NO: 62945 - RNA, 64 nt, Human
ccacagacacccaccagcccggccccucccggcgccugcccacccuccacccacagccucacgg

SEQ ID NO: 62946 - RNA, 64 nt, Human
ugcccacagggcuguguggauggaggaagcugucccugcccagugcaucccccaggucaucacg

SEQ ID NO: 62947 - RNA, 64 nt, Human
ucuagcuccacaaguguguggccccgcccgagccccugcccacgcccuuggagccuuccaccgg

SEQ ID NO: 62948 - RNA, 64 nt, Human
cccugggacccucacugccuccgucuguucaucaccugcccaccggagccgcaugcucuuccug

SEQ ID NO: 62949 - RNA, 50 nt, Human; identical to SEQ ID NO: 13828

SEQ ID NO: 62950 - RNA, 64 nt, Human
uguguguggaggccauccuggaaggaaguuuagaccugcccagguguggagcgaggggcacagg

SEQ ID NO: 62951 - RNA, 64 nt, Human
ccccucaggacuccaaggagacggugcagggcugccugcccaucuagguccccucuccugcauc

SEQ ID NO: 62952 - RNA, 64 nt, Human
ugacguggcgugaacaucugccuggagucccgucccugcccagaacccuuccugagaccucgcc

SEQ ID NO: 62953 - RNA, 64 nt, Human
uggggcugcauucccuggagacucacugcaaguuccugcccaggaggcugagggcaccccaucc

SEQ ID NO: 62954 - RNA, 64 nt, Human
aguagucguacacggagacuggcagcgccgacguccugcccaccacgcacucccggagagcacg

SEQ ID NO: 62955 - RNA, 64 nt, Human
ccucuccauggcucuggucacccugacccucugcccugcccaccgcaggucccccggggucccg

SEQ ID NO: 62956 - RNA, 64 nt, Human
uggaaugggcucaagguuccugagacacccgauuccugcccaaacagcuguauuuauauaaguc

SEQ ID NO: 62957 - RNA, 64 nt, Human
caaauaaggugguucuuuccuugaagggcagccuccugcccaggccccguggcccuggagccuc

SEQ ID NO: 62958 - RNA, 64 nt, Human
agagaugccaccacuugugucuccacaaugugcuccugcccacccggguuccgcacuguccgac

SEQ ID NO: 62959 - RNA, 64 nt, Human
ccaccgcccuccuccacuuggaaacgguauccucccugcccauccgucugucugucgcccuucu

SEQ ID NO: 62960 - RNA, 64 nt, Human
aagggaggcaaugaacccucucccccaccucuucccugcccaaaucugucuccuagaaucuuau

SEQ ID NO: 62961 - RNA, 52 nt, Human; identical to SEQ ID NO: 13840

SEQ ID NO: 62962 - RNA, 64 nt, Human
uuggacauacgaggacccucagaccggaggaacaccugcccaaccccaacacgugcuuauguaa

SEQ ID NO: 62963 - RNA, 64 nt, Human
ucccuccagcugcccacucaugggcccuucaccaccugcccaggaucucacccaguacugacag

SEQ ID NO: 62964 - RNA, 64 nt, Human
gccucagccuccugaguagcugggacuacaggccccugcccagcuaauuuuuuguauuuuuuuu

SEQ ID NO: 62965 - RNA, 64 nt, Human
ccaggagaggggccccucucuccucuauguacccccugcccaccucgggccuaccucagcccuc

SEQ ID NO: 62966 - RNA, 64 nt, Human
acugcccaggucgaucaaguggcuuuuccugggaccugcccagcuuugagaaucucuucucauc

SEQ ID NO: 62967 - RNA, 64 nt, Human
ggcuuguccagaauggggacguggggcagccaccccugcccagcgagagcgcagacaccgugug

SEQ ID NO: 62968 - RNA, 64 nt, Human
accggaagcagcacgugugagcugggccaggagcccugcccaccuccgugcagcugaccugccc

SEQ ID NO: 62969 - RNA, 64 nt, Human
gcacaugcugauacacacuguuguuaggccugcaccugcccauccagaaagcagcagcugccuu

SEQ ID NO: 62970 - RNA, 64 nt, Human
ccugcuccggcucacacacgcccugccugcccucccugcccagcuguaaggaccgggggucucc

SEQ ID NO: 62971 - RNA, 64 nt, Human
gcagauaaacagacccccuucugcuccgcuuccuccugcccagccaggcaacacccucaaccgg

SEQ ID NO: 62972 - RNA, 64 nt, Human
gucguccucuccaucugcuguguuuggacgcguuccugcccagccccuugcugucauccccucc

SEQ ID NO: 62973 - RNA, 64 nt, Human
cgcaugcggggagaggcugcucccuccccuuuuuccugcccagucgcggggcccaagucuuccu

SEQ ID NO: 62974 - RNA, 64 nt, Human
gauaagccccaguccagguccaggaggcucccucccugcccagcgagucuuccagaagggguga

SEQ ID NO: 62975 - RNA, 64 nt, Human
ccccauggccccaugcagccccaggggcuuccccccugcccauggaguagagcccgagauccug

SEQ ID NO: 62976 - RNA, 64 nt, Human
aguuccccuucuagcggggccgguaccccgccucccugcccaucccaccacccggccuuucccu

SEQ ID NO: 62977 - RNA, 64 nt, Human
acagccccccaaggggccccauugccaaagcaugccugcccacccucgcugugccuuagucagu

SEQ ID NO: 62978 - RNA, 64 nt, Human
cucuacccacccccuucccccgcaugcugaucccccugcccaggugagggcccugcccuggaag

SEQ ID NO: 62979 - RNA, 64 nt, Human
uugcuuagcccacaauucuccauuucacuugaccccugcccaccucuccaaccuaacuggcuua

SEQ ID NO: 62980 - RNA, 63 nt, Human; identical to SEQ ID NO: 13859

SEQ ID NO: 62981 - RNA, 64 nt, Human; identical to SEQ ID NO: 62979

SEQ ID NO: 62982 - RNA, 64 nt, Human
uugcuuaacccacaguucuccauuucacuugaccccugcccaccucuccaaccuaacuggcuua

SEQ ID NO: 62983 - RNA, 64 nt, Human
uugcuuagcccacaauucucuauuucacuugaccccugcccaccucuccaaccuaacuggcuua

SEQ ID NO: 62984 - RNA, 64 nt, Human
uugcuuagcccacaguucuccauuucacuugaccccugcccaccucuccaaccuaacuggcuua

SEQ ID NO: 62985 - RNA, 64 nt, Human; identical to SEQ ID NO: 62979

SEQ ID NO: 62986 - RNA, 64 nt, Human
uugcuuagcccacaaguaucuauuucacuugaccccugcccaccucuccaaccuaacuggcuua

SEQ ID NO: 62987 - RNA, 64 nt, Human
gggaagcauguguagcuauguuguacucucuaaaccugcccagggaccuuaccagauucguguc

SEQ ID NO: 62988 - RNA, 64 nt, Human
uccagguaugugggaacugcauaguauuuuucgaccugcccaggucucuugcuagacuucugug

SEQ ID NO: 62989 - RNA, 64 nt, Human
gguuuccugucguaaucaguggugcugcuugacaccugcccagcauguuccugucucuccuuuu

SEQ ID NO: 62990 - RNA, 64 nt, Human
ugggccagggcccacggacccgcagcucagggcgccugcccacgucgucugccggcggugcgcc

SEQ ID NO: 62991 - RNA, 64 nt, Human
cacgguggucagcgugcagcgggacgggacuggcccugcccagccaugaaucgcuuggccaugc

SEQ ID NO: 62992 - RNA, 64 nt, Human
aggccacgcauccaucuccaaguuaacagcccguccugcccaaguucuggggcagguaggagag

SEQ ID NO: 62993 - RNA, 64 nt, Human
gggacacacccugauagcacaaucuccuuggggcccugcccaccuccaggccucucccaccuca

SEQ ID NO: 62994 - RNA, 64 nt, Human
ggaaaccgaggccaccgccccccccuccgcugccccugcccaccccgaggcagggcuggggcuu

SEQ ID NO: 62995 - RNA, 64 nt, Human
ccacaccaguccucccagggaguccucgagucgcccugcccagagcccuggcaccagagacgcc

SEQ ID NO: 62996 - RNA, 64 nt, Human
agacacaaacaaaccaaccagagggagaagagccccugcccacugcacucuuugguucucugcu

SEQ ID NO: 62997 - RNA, 64 nt, Human
gacaguggccgggcucccugcgucccgcuggugaccugcccaccgucccuguccaugccccgcc

SEQ ID NO: 62998 - RNA, 51 nt, Human; identical to SEQ ID NO: 13877

SEQ ID NO: 62999 - RNA, 64 nt, Human
cccugccuuuguggggagcagccagcccucugccccugcccagggcuccccaacuauaggccug

SEQ ID NO: 63000 - RNA, 64 nt, Human
aauagccuaaaaguccaguccuuuggccuccaguccugcccaggcccugggucaccaggucacu

SEQ ID NO: 63001 - RNA, 64 nt, Human
cacucgcuuguugaagaugaauucuugaauucugccugcccacccccggccagaucccuggagc

SEQ ID NO: 63002 - RNA, 64 nt, Human
cauuugcugcaggcauggcugucuccugccccugccugcccaucuggccuauaccccagccgug

SEQ ID NO: 63003 - RNA, 64 nt, Human
gagaggggaagaaacacuuucucuucuuguuucuccugcccacugcugcaguaggggaggagca

SEQ ID NO: 63004 - RNA, 63 nt, Human; identical to SEQ ID NO: 13883

SEQ ID NO: 63005 - RNA, 64 nt, Human
ugugugcuccgcgugcuauagcuuuuggggcggcccugcccaguccccgugcccacggggcucc

SEQ ID NO: 63006 - RNA, 64 nt, Human
gggggcugaggcacacagagaggccaacuuccucccugcccagccuuccuuguaucucuccaga

SEQ ID NO: 63007 - RNA, 63 nt, Human; identical to SEQ ID NO: 13886

SEQ ID NO: 63008 - RNA, 64 nt, Human
uucuguagcccacggcaccccaaacuuggagggaccugcccacuccccucccccauucccaagg

SEQ ID NO: 63009 - RNA, 63 nt, Human; identical to SEQ ID NO: 13888

SEQ ID NO: 63010 - RNA, 64 nt, Human
ggaccugccggccucccgggccagcugccccaccccugcccaugccuguccugcacggcucugc

SEQ ID NO: 63011 - RNA, 64 nt, Human
ucaccuugcccacacaucuccagccagccagggcccugcccagcuucaauuuacagaccugacu

SEQ ID NO: 63012 - RNA, 53 nt, Human; identical to SEQ ID NO: 13891

SEQ ID NO: 63013 - RNA, 64 nt, Human
accaccaucaucacaucccccagcaagccagccaccugcccagccgggccugggaugggccacc

SEQ ID NO: 63014 - RNA, 64 nt, Human
ucccagcaaugaacuguucuagggaaaguggcuuccugcccaaacuggaugggacacgugggga

SEQ ID NO: 63015 - RNA, 64 nt, Human
guaggccaucugcauuuucuuacuguugauguuuccugcccaaaggacacauuugggcagugcc

SEQ ID NO: 63016 - RNA, 64 nt, Human
acgucucucaccuagaccuugccuccccuccucuccugcccagcucugacccugaugcuuaaua

SEQ ID NO: 63017 - RNA, 64 nt, Human
gacaggugcacugaggagaugaaggccgggacccccugcccaaccuguauggcgggucuguacu

SEQ ID NO: 63018 - RNA, 64 nt, Human
uccagguaugugugaacugcauugcaccuuuugcccugcccagggcccaugucagauuuauguc

SEQ ID NO: 63019 - RNA, 64 nt, Human
cucaggaacaaacggucccagaguccuccggaccccugcccagggucucugcaggucucugccc

SEQ ID NO: 63020 - RNA, 64 nt, Human
guuugaguuucuguagggcugaaugacucuuuuuccugcccagggcccauucuugcuucucagg

SEQ ID NO: 63021 - RNA, 64 nt, Human
gcagccuucugugaccccgcugugguaaguccagccugcccagggcugcugagggcugccucuu

SEQ ID NO: 63022 - RNA, 64 nt, Human
uuucuggcucaggcuguaaaaguagcugagccauccugcccauuccuggagguccuacagguga

SEQ ID NO: 63023 - RNA, 64 nt, Human
ucaguauagacguauccaaugggaaaacagcggaccugcccagagcagggaggugucguggaac

SEQ ID NO: 63024 - RNA, 64 nt, Human
ggugcaucgucucaacaccaccaaguuuguaggaccugcccaaguucuaguaguauucaaaacu

SEQ ID NO: 63025 - RNA, 64 nt, Human
ugcccuugccugguuccauauggcuccuuccagcccugcccaccaagugcagcucccacuuucc

SEQ ID NO: 63026 - RNA, 64 nt, Human
gcccugcccaccaagugcagcucccacuuuccauccugcccauacgccccucuucccccgacau

SEQ ID NO: 63027 - RNA, 64 nt, Human
gacugagagggguggauuuggccccuguccuccuccugcccauucuuugucucuuccacauggg

SEQ ID NO: 63028 - RNA, 64 nt, Human
aauaaugacugucauacauccagaggagaccgaaccugcccagcugauguacuguuuuauggaa

SEQ ID NO: 63029 - RNA, 64 nt, Human
agggaagggccaagccccauguagccccagucauccugcccagcccugccuccuggccaugccg

SEQ ID NO: 63030 - RNA, 64 nt, Human
acgccagagcuucagugagguuuccgagccucucccugcccauccucaccacugaggccacgac

SEQ ID NO: 63031 - RNA, 64 nt, Human
agguaccgcucuccaaggugugcuagcagugggcccugcccaacuucaggcagaacagggaggc

SEQ ID NO: 63032 - RNA, 64 nt, Human
cuggaccugcugcagccugcagagccacagucagccugcccacaugccaccgagcaaacgcauc

SEQ ID NO: 63033 - RNA, 64 nt, Human
ccagucccagagaggcucggccuggaaacaguccccugcccagaguccccucagccuccaugac

SEQ ID NO: 63034 - RNA, 64 nt, Human
agcacgggccagauggccagcugucgagagcagcccugcccagauugcggugggggcugugcca

SEQ ID NO: 63035 - RNA, 64 nt, Human
gcucggccugggagucgggcggccccggucaggcccugcccagagagcuccugguuccugaacu

SEQ ID NO: 63036 - RNA, 64 nt, Human
ccucacccacccgaggcucugcccaccgccuggaccugcccaccccugaaagacuggccccugg

SEQ ID NO: 63037 - RNA, 64 nt, Human
accccuccccgcacacacccguccauaccagcucccugcccaugacccucgcucagggaucccc

SEQ ID NO: 63038 - RNA, 64 nt, Human
uuucaccuuucuuuaaauuagaauuacagaagccccugcccagugaacagauaacgauuggucu

SEQ ID NO: 63039 - RNA, 64 nt, Human
gcagugugacaggacugugauugugcuagauguaccugcccaagucugcuggucacauuuggca

SEQ ID NO: 63040 - RNA, 64 nt, Human
cagccucagaaaccagacucguucuucugggaacccugcccacucccaggaccaagauuggccu

SEQ ID NO: 63041 - RNA, 64 nt, Human
guaguuucagauucuugguccauggaugacaccaccugcccaugcuuccuugaauuaggcuuuc

SEQ ID NO: 63042 - RNA, 64 nt, Human
aaguaaacagaauggauugccaguuacauguaugccugcccaguucccuuuuuauuugcagaag

SEQ ID NO: 63043 - RNA, 64 nt, Human
auuccauugaaucucgcacccagucuugcguaugccugcccaguuuucagccucuuaacgggag

SEQ ID NO: 63044 - RNA, 64 nt, Human
uguccaaacagcucaugggcuuaguguccaaaccccugcccagccuucccuuuccaaguuggug

SEQ ID NO: 63045 - RNA, 64 nt, Human
agggcggaugagcagagccggcccugaggacaguccugcccauccacgcggagauguggcugcc

SEQ ID NO: 63046 - RNA, 61 nt, Human; identical to SEQ ID NO: 13925

SEQ ID NO: 63047 - RNA, 64 nt, Human
acccgauccuggagagcugugaggauccauucagccugcccagcucuggcuggucagagacaag

SEQ ID NO: 63048 - RNA, 64 nt, Human
ccgcagcgcccucgcccagccccggcugcguuucccugcccaugacccucucguggggaccccc

SEQ ID NO: 63049 - RNA, 64 nt, Human
ucagcuccaaacgccuccucucccaggucaucugccugcccacacgcuccuguuccaccuucac

SEQ ID NO: 63050 - RNA, 64 nt, Human
uuggcuccaaacaucuccccucccaagacaucugccugcccacaggcuccuguugcuccuucac

SEQ ID NO: 63051 - RNA, 64 nt, Human
ugagagguuccuggcgcccugagguggcucagcaccugcccaggguaggccuggcaugaggggu

SEQ ID NO: 63052 - RNA, 64 nt, Human
ggagcagauggccugccuuuggcugagagggcuaccugcccagccccucccccaacaagaucuc

SEQ ID NO: 63053 - RNA, 59 nt, Human; identical to SEQ ID NO: 13932

SEQ ID NO: 63054 - RNA, 64 nt, Human
cagccgacacggucucggaucaggcucccaggagccugcccagcccccuggucuuugagcuccc

SEQ ID NO: 63055 - RNA, 64 nt, Human
ggaauguggccccugaacaagaauuggaagcugcccugcccaugggagcugguuagaaaugcag

SEQ ID NO: 63056 - RNA, 64 nt, Human
caccaggagaaccacuacaugcagcccaugcccaccugcccaucacaggguugggcccagaucu

SEQ ID NO: 63057 - RNA, 64 nt, Human
ucucucuaguagccuggauuuaucauucucucugccugcccacccccuuuuuuguauagcccaa

SEQ ID NO: 63058 - RNA, 64 nt, Human
cuggggugagagaggaaagaccuacauucccucuccugcccagaugcccuuuggaaagccauug

SEQ ID NO: 63059 - RNA, 64 nt, Human
ccugcccugguauguuuuucuuauagauguuagcccugcccaacagccagggcuacacuacaaa

SEQ ID NO: 63060 - RNA, 64 nt, Human
ucgcagacagcccagagccugccgcuacccucggccugcccaccaccaagcaagcagcaagcaa

SEQ ID NO: 63061 - RNA, 64 nt, Human
aacagauccucaucagcaaagcauuuggcuuuguccugcccaagugggcugcagacugagugcu

SEQ ID NO: 63062 - RNA, 64 nt, Human
uggcccaaggcuuccgcagccgcccguuccgggaccugcccagcguccucccugccuccuuccg

SEQ ID NO: 63063 - RNA, 64 nt, Human
ggggcuguggguggaggccugacuccaggccucuccugcccacacccucugggcugaguuccuu

SEQ ID NO: 63064 - RNA, 64 nt, Human
uguucuuccucagucuggcugugggcaggagcggccugcccagugucacccagggugagugcaa

SEQ ID NO: 63065 - RNA, 64 nt, Human
cuggguuuuguaccagucccugcucucaggccacccugcccaggacccaggcccgccucccccu

SEQ ID NO: 63066 - RNA, 64 nt, Human
agccgggccaagcgcuggccccucagcggugagcccugcccacucuuaccgagcaaggugggug

SEQ ID NO: 63067 - RNA, 64 nt, Human
auagcuuguacacauauacauaugaucaaauacuccugcccaugauccauucccuuuuguuauu

SEQ ID NO: 63068 - RNA, 64 nt, Human
uuuggaauguucugaauugaccaaauuuaaugaaccugcccaaaguuagcuaccguuccauggu

SEQ ID NO: 63069 - RNA, 64 nt, Human
ccugacacaccugcagccucccuccgcggcgggcccugcccacaccuccuggggcgcgugaggc

SEQ ID NO: 63070 - RNA, 64 nt, Human
augugcaaguuguggagagaaggagcaccggguuccugcccagcacugugcuugcgggaggcgg

SEQ ID NO: 63071 - RNA, 64 nt, Human
gcaggaggacagagugcccuggggcauccaccuuccugcccaggggacguggcgcugucggugu

SEQ ID NO: 63072 - RNA, 64 nt, Human
ggaugccccuggcccugccucacugugaccugcuccugcccacgugcagcaccugucaccuuuu

SEQ ID NO: 63073 - RNA, 64 nt, Human
ggauuagcgaagcuguggagacugcacauccggaccugcccaugucucaaaacaaacacaugua

SEQ ID NO: 63074 - RNA, 64 nt, Human
guuucuccucaguguaauccaccuauggguucuuccugcccacugcacagacaaaaccaauuca

SEQ ID NO: 63075 - RNA, 64 nt, Human
uagaucucucgaauuauauuuauagaugcaguguccugcccaguuuuguuugccuccuacauuu

SEQ ID NO: 63076 - RNA, 64 nt, Human
cucucugccauucugugcaggcugcaguggcuccccugcccagccugcucucccuaaccccuug

SEQ ID NO: 63077 - RNA, 64 nt, Human
gcuucucugggagcucuccaguggcacugcuggaccugcccacguuucuguaaaaucaggauac

SEQ ID NO: 63078 - RNA, 64 nt, Human
cuucagaauaaagggcgcccgcggucccccagcaccugcccaagccacaccccuagcuucccuc

SEQ ID NO: 63079 - RNA, 64 nt, Human
gguacgccugggccucuguuccuccaaagaccugccugcccaucugcauaggagaugaaggcug

SEQ ID NO: 63080 - RNA, 64 nt, Human
gcuccugggagacuuuuccucccugccucagcucccugcccagccagccuccugucuccagaga

SEQ ID NO: 63081 - RNA, 64 nt, Human
aucugcgucuggacacccucagauccugucauugccugcccagaguccuucaggggcaccccuc

SEQ ID NO: 63082 - RNA, 64 nt, Human
ccaccugcaggcccagaccacgugggacagaacuccugcccacccuaccccgagggaggcgaac

SEQ ID NO: 63083 - RNA, 62 nt, Human; identical to SEQ ID NO: 13962

SEQ ID NO: 63084 - RNA, 64 nt, Human
gucaggcugcucucggacuccugaucucaggugaccugcccaccucggccucccgaagugcugg

SEQ ID NO: 63085 - RNA, 64 nt, Human
guuugcugggcauaagcuucacaggacgggagaaccugcccaugguggacugucguucuccaca

SEQ ID NO: 63086 - RNA, 64 nt, Human
ccacauggaugccacuccccacacagcccccaggccugcccagcccaccuccucauggcauccu

SEQ ID NO: 63087 - RNA, 64 nt, Human
uucuucuccgagccccaggcagcggugauucagcccugcccaaccugauucugaugacugcgga

SEQ ID NO: 63088 - RNA, 64 nt, Human
ggaggggcgccugcugagcacuuccgccccucacccugcccagccccugccaugagcucugggc

SEQ ID NO: 63089 - RNA, 64 nt, Human
cugcuccucuguccucgcacagcgaaccugggcuccugcccaggacaggcaccagggucauggc

SEQ ID NO: 63090 - RNA, 64 nt, Human
caucuguccccucucuccacacccagccccugcuccugcccaggcugcccugcccagcgccuca

SEQ ID NO: 63091 - RNA, 64 nt, Human
cuccacacccagccccugcuccugcccaggcugcccugcccagcgccucaucagccucugccuu

SEQ ID NO: 63092 - RNA, 64 nt, Human
ugaucuuccccaucaggcugggcucuggcagggaccugcccaggauggagaugagagaggguga

SEQ ID NO: 63093 - RNA, 64 nt, Human
ggccugugcccaggaagagccauucacuccugccccugcccacacggcagguagcagggggagu

SEQ ID NO: 63094 - RNA, 64 nt, Human
acgcuccuccugccccagcccucugguguccacaccugcccacagagaauguaaacccaguggg

SEQ ID NO: 63095 - RNA, 64 nt, Human
cacagcuauggcugagguggggccgggccacaccccugcccaucccagccagggugcugugccc

SEQ ID NO: 63096 - RNA, 50 nt, Human; identical to SEQ ID NO: 13975

SEQ ID NO: 63097 - RNA, 64 nt, Human
caccccacgcacgccccgugcuguguuccugggcccugcccauggccucaauaaacucucugcu

SEQ ID NO: 63098 - RNA, 64 nt, Human
gagcugcuggaggugaggucaggugccucccagcccugcccagaguaugggcacucaggugugg

SEQ ID NO: 63099 - RNA, 64 nt, Human
gagugcgagcuggcugacaauaagaacguggccaccugcccagcuucacaccucccccgacuuc

SEQ ID NO: 63100 - RNA, 64 nt, Human
gcugaggugcuacccggagccccauucacccccaccugcccacuugggaaucugaggcagagga

SEQ ID NO: 63101 - RNA, 64 nt, Human
ucucauccuggccccaccagggccuugggcaaguccugcccaccauaggccucugcuaccugcc

SEQ ID NO: 63102 - RNA, 64 nt, Human
ugggucuugucuaucuugauggagaagagggguuccugcccaggaucuuacaacacagcaagua

SEQ ID NO: 63103 - RNA, 64 nt, Human
auaacuacacgguucaugaacugacauuccacauccugcccacccucugagggccaagcugccu

SEQ ID NO: 63104 - RNA, 64 nt, Human
aagggggacugaaggcaggagagagagcagcuccccugcccaccugccccucaacccuguagcu

SEQ ID NO: 63105 - RNA, 64 nt, Human
aaaagagaaaaaucccagccaggggaacucgccaccugcccacgcuaguuccauccacgcucaa

SEQ ID NO: 63106 - RNA, 64 nt, Human
caggggcagguaucuccuucccguuccucauccaccugcccagugcucaucguuacagcaaacc

SEQ ID NO: 63107 - RNA, 64 nt, Human
ugaggcgggguccgaggucguaccccacagugcaccugcccaggggcuguucagagcuggcaau

SEQ ID NO: 63108 - RNA, 64 nt, Human
gcacugcacuggaguugucucuuaccccacccucccugcccaucaacuguaucugauuucacua

SEQ ID NO: 63109 - RNA, 64 nt, Human
aguggggaggagcgucucaagugaacagugggagccugcccaccuggcacugcacuggaguugu

SEQ ID NO: 63110 - RNA, 64 nt, Human
uggggacuugaggggggucauauucccuccucagccugcccacgcacuggccuucccuccugcc

SEQ ID NO: 63111 - RNA, 64 nt, Human
ccacccuggaauggggcaggggaagggcacacccccugcccaugcaugguagcccacugggugg

SEQ ID NO: 63112 - RNA, 64 nt, Human
acccugcccugccccgccccgccccgcccgcgugccugcccaugccagcacuuccuuaaguucu

SEQ ID NO: 63113 - RNA, 64 nt, Human
cuugauggguguaccuggagagggggucuggcuuccugcccaagaugccucccagcccugccag

SEQ ID NO: 63114 - RNA, 64 nt, Human
gguggaucaccuaaggucaggaguuugagaucagccugcccaacauggugaaaccucgucucua

SEQ ID NO: 63115 - RNA, 64 nt, Human
cccaggcaccugucugccaggaggccacguguguccugcccacccagggggagcuguauuuugg

SEQ ID NO: 63116 - RNA, 64 nt, Human
ucuggaccugaccagacugugggucccugcgucuccugcccacucugaccgggcuuccucccuc

SEQ ID NO: 63117 - RNA, 64 nt, Human
gauggagcugauccaguaaccucggagacgggacccugcccagagcugaguuggggguguggcu

SEQ ID NO: 63118 - RNA, 64 nt, Human
gcaaccugcucuuccgcugcucgcucccggaccaccugcccagcguuggcgaggagccccggga

SEQ ID NO: 63119 - RNA, 64 nt, Human
cuccuugugcuauaaaauaaaugcagacuaauuuccugcccaaaguggucuucuccagcuagcc

SEQ ID NO: 63120 - RNA, 64 nt, Human
cuuacucucugccuaccugccugagccauguucaccugcccacuuguccccugcugccugccca

SEQ ID NO: 63121 - RNA, 64 nt, Human
gagccauguucaccugcccacuuguccccugcugccugcccaaacaccccaccauuggccuguc

SEQ ID NO: 63122 - RNA, 64 nt, Human
uaagagaacugcgacgauuaauuguggaucucccccugcccauugccugcuugaggggcaccac

SEQ ID NO: 63123 - RNA, 64 nt, Human
acauuccuuuuguugccaagauccuuaauucccuccugcccauaucccuacaggcgacggcaga

SEQ ID NO: 63124 - RNA, 64 nt, Human
ggggguagaaguucuuccuuuccuaacccgggccccugcccagcucuccaaagucuuucagaaa

SEQ ID NO: 63125 - RNA, 64 nt, Human
gaugagggugaggaguagggagugcagcccugagccugcccacuccucauuacgaaaugacugu

SEQ ID NO: 63126 - RNA, 64 nt, Human
gacugcuuucugucuguccggccugcacccagccccugcccacaaaaccccagggacagcaguc

SEQ ID NO: 63127 - RNA, 64 nt, Human
uucaagagcaugaagcacucuuggaguuguggguccugcccagaguccagagagcagccucagc

SEQ ID NO: 63128 - RNA, 64 nt, Human
gccggccccugccccacccccacccacgggugucccugcccacucguguggcaagggaggggag

SEQ ID NO: 63129 - RNA, 64 nt, Human
ugcugcacuccuccugccccugccacgcccacccccugcccaccucuccaggcucugcucugca

SEQ ID NO: 63130 - RNA, 64 nt, Human
cauggaggggucagggccgcucccuagggucccuccugcccaacauguggagguggcugguucc

SEQ ID NO: 63131 - RNA, 64 nt, Human
ccccgccuuuucccccacccucccaugagacugcccugcccagguauccugggggaagaggaga

SEQ ID NO: 63132 - RNA, 64 nt, Human
cuuucccagcacuuaaaacaggagccuagagcccccugcccaaacaaaacaggacaucugugac

SEQ ID NO: 63133 - RNA, 56 nt, Human; identical to SEQ ID NO: 14012

SEQ ID NO: 63134 - RNA, 64 nt, Human
acacuuucugcaacucuagcccuauauccagaagccugcccaccuccacccauucuguuugccc

SEQ ID NO: 63135 - RNA, 64 nt, Human
caguccccaccagcuaucagauaaggcaaacuacccugcccaucuuuguugccauucagugcua

SEQ ID NO: 63136 - RNA, 64 nt, Human
ggagaaagcaccugugauauauggcaagugucccccugcccaaacuuuaacaucagacccucuc

SEQ ID NO: 63137 - RNA, 64 nt, Human
ugccuggcuggggccucugcaccccacccucccaccugcccaccuggcccugccuuuguuuucc

SEQ ID NO: 63138 - RNA, 64 nt, Human
gauccaucugcaugauuggcauuaguuaccacagccugcccagagagaaacuaucuucucccaa

SEQ ID NO: 63139 - RNA, 64 nt, Human
ggcggaucaccugaggucaggaguucaagaccagccugcccaacauggugaaaccccaucugga

SEQ ID NO: 63140 - RNA, 64 nt, Human
caagggugcagcuugauucgggaguuccccaccuccugcccauucuccgcguccuuuuacccca

SEQ ID NO: 63141 - RNA, 64 nt, Human
acauaugucacugggaccaucacccagaugauguccugcccacuaaaagaauugugacauaacg

SEQ ID NO: 63142 - RNA, 64 nt, Human; identical to SEQ ID NO: 62221

SEQ ID NO: 63143 - RNA, 64 nt, Human; identical to SEQ ID NO: 62222

SEQ ID NO: 63144 - RNA, 64 nt, Human; identical to SEQ ID NO: 62223

SEQ ID NO: 63145 - RNA, 64 nt, Human; identical to SEQ ID NO: 62224

SEQ ID NO: 63146 - RNA, 64 nt, Human; identical to SEQ ID NO: 62225

SEQ ID NO: 63147 - RNA, 64 nt, Human; identical to SEQ ID NO: 62226

SEQ ID NO: 63148 - RNA, 64 nt, Human; identical to SEQ ID NO: 62227

SEQ ID NO: 63149 - RNA, 64 nt, Human; identical to SEQ ID NO: 62228

SEQ ID NO: 63150 - RNA, 64 nt, Human; identical to SEQ ID NO: 62229

SEQ ID NO: 63151 - RNA, 64 nt, Human; identical to SEQ ID NO: 62230

SEQ ID NO: 63152 - RNA, 64 nt, Human; identical to SEQ ID NO: 62231

SEQ ID NO: 63153 - RNA, 64 nt, Human; identical to SEQ ID NO: 62232

SEQ ID NO: 63154 - RNA, 64 nt, Human; identical to SEQ ID NO: 62233

SEQ ID NO: 63155 - RNA, 64 nt, Human; identical to SEQ ID NO: 62234

SEQ ID NO: 63156 - RNA, 64 nt, Human; identical to SEQ ID NO: 62235

SEQ ID NO: 63157 - RNA, 64 nt, Human; identical to SEQ ID NO: 62236

SEQ ID NO: 63158 - RNA, 64 nt, Human; identical to SEQ ID NO: 62237

SEQ ID NO: 63159 - RNA, 64 nt, Human; identical to SEQ ID NO: 62238

SEQ ID NO: 63160 - RNA, 64 nt, Human; identical to SEQ ID NO: 62239

SEQ ID NO: 63161 - RNA, 64 nt, Human; identical to SEQ ID NO: 62240

SEQ ID NO: 63162 - RNA, 51 nt, Human; identical to SEQ ID NO: 13120

SEQ ID NO: 63163 - RNA, 64 nt, Human; identical to SEQ ID NO: 62242

SEQ ID NO: 63164 - RNA, 64 nt, Human; identical to SEQ ID NO: 62243

SEQ ID NO: 63165 - RNA, 64 nt, Human; identical to SEQ ID NO: 62244

SEQ ID NO: 63166 - RNA, 64 nt, Human; identical to SEQ ID NO: 62245

SEQ ID NO: 63167 - RNA, 64 nt, Human; identical to SEQ ID NO: 62246

SEQ ID NO: 63168 - RNA, 64 nt, Human; identical to SEQ ID NO: 62247

SEQ ID NO: 63169 - RNA, 64 nt, Human; identical to SEQ ID NO: 62248

SEQ ID NO: 63170 - RNA, 64 nt, Human; identical to SEQ ID NO: 62249

SEQ ID NO: 63171 - RNA, 64 nt, Human; identical to SEQ ID NO: 62250

SEQ ID NO: 63172 - RNA, 64 nt, Human; identical to SEQ ID NO: 62251

SEQ ID NO: 63173 - RNA, 64 nt, Human; identical to SEQ ID NO: 62252

SEQ ID NO: 63174 - RNA, 64 nt, Human; identical to SEQ ID NO: 62253

SEQ ID NO: 63175 - RNA, 64 nt, Human; identical to SEQ ID NO: 62254

SEQ ID NO: 63176 - RNA, 55 nt, Human; identical to SEQ ID NO: 13134

SEQ ID NO: 63177 - RNA, 64 nt, Human; identical to SEQ ID NO: 62256

SEQ ID NO: 63178 - RNA, 64 nt, Human; identical to SEQ ID NO: 62257

SEQ ID NO: 63179 - RNA, 64 nt, Human; identical to SEQ ID NO: 62258

SEQ ID NO: 63180 - RNA, 64 nt, Human; identical to SEQ ID NO: 62259

SEQ ID NO: 63181 - RNA, 64 nt, Human; identical to SEQ ID NO: 62260

SEQ ID NO: 63182 - RNA, 64 nt, Human; identical to SEQ ID NO: 62261

SEQ ID NO: 63183 - RNA, 64 nt, Human; identical to SEQ ID NO: 62262

SEQ ID NO: 63184 - RNA, 64 nt, Human; identical to SEQ ID NO: 62263

SEQ ID NO: 63185 - RNA, 64 nt, Human; identical to SEQ ID NO: 62264

SEQ ID NO: 63186 - RNA, 64 nt, Human; identical to SEQ ID NO: 62265

SEQ ID NO: 63187 - RNA, 64 nt, Human; identical to SEQ ID NO: 62266

SEQ ID NO: 63188 - RNA, 64 nt, Human; identical to SEQ ID NO: 62267

SEQ ID NO: 63189 - RNA, 64 nt, Human; identical to SEQ ID NO: 62268

SEQ ID NO: 63190 - RNA, 64 nt, Human; identical to SEQ ID NO: 62269

SEQ ID NO: 63191 - RNA, 64 nt, Human; identical to SEQ ID NO: 62270

SEQ ID NO: 63192 - RNA, 64 nt, Human; identical to SEQ ID NO: 62271

SEQ ID NO: 63193 - RNA, 64 nt, Human; identical to SEQ ID NO: 62272

SEQ ID NO: 63194 - RNA, 64 nt, Human; identical to SEQ ID NO: 62273

SEQ ID NO: 63195 - RNA, 64 nt, Human; identical to SEQ ID NO: 62274

SEQ ID NO: 63196 - RNA, 64 nt, Human; identical to SEQ ID NO: 62275

SEQ ID NO: 63197 - RNA, 64 nt, Human; identical to SEQ ID NO: 62276

SEQ ID NO: 63198 - RNA, 64 nt, Human; identical to SEQ ID NO: 62277

SEQ ID NO: 63199 - RNA, 64 nt, Human; identical to SEQ ID NO: 62278

SEQ ID NO: 63200 - RNA, 64 nt, Human; identical to SEQ ID NO: 62279

SEQ ID NO: 63201 - RNA, 64 nt, Human; identical to SEQ ID NO: 62280

SEQ ID NO: 63202 - RNA, 64 nt, Human; identical to SEQ ID NO: 62281

SEQ ID NO: 63203 - RNA, 64 nt, Human; identical to SEQ ID NO: 62282

SEQ ID NO: 63204 - RNA, 64 nt, Human; identical to SEQ ID NO: 62283

SEQ ID NO: 63205 - RNA, 64 nt, Human; identical to SEQ ID NO: 62284

SEQ ID NO: 63206 - RNA, 64 nt, Human; identical to SEQ ID NO: 62285

SEQ ID NO: 63207 - RNA, 64 nt, Human; identical to SEQ ID NO: 62286

SEQ ID NO: 63208 - RNA, 64 nt, Human; identical to SEQ ID NO: 62287

SEQ ID NO: 63209 - RNA, 64 nt, Human; identical to SEQ ID NO: 62288

SEQ ID NO: 63210 - RNA, 60 nt, Human; identical to SEQ ID NO: 13168

SEQ ID NO: 63211 - RNA, 64 nt, Human; identical to SEQ ID NO: 62290

SEQ ID NO: 63212 - RNA, 64 nt, Human; identical to SEQ ID NO: 62291

SEQ ID NO: 63213 - RNA, 64 nt, Human; identical to SEQ ID NO: 62292

SEQ ID NO: 63214 - RNA, 64 nt, Human; identical to SEQ ID NO: 62293

SEQ ID NO: 63215 - RNA, 64 nt, Human; identical to SEQ ID NO: 62294

SEQ ID NO: 63216 - RNA, 64 nt, Human; identical to SEQ ID NO: 62295

SEQ ID NO: 63217 - RNA, 64 nt, Human; identical to SEQ ID NO: 62296

SEQ ID NO: 63218 - RNA, 64 nt, Human; identical to SEQ ID NO: 62297

SEQ ID NO: 63219 - RNA, 64 nt, Human; identical to SEQ ID NO: 62298

SEQ ID NO: 63220 - RNA, 64 nt, Human; identical to SEQ ID NO: 62299

SEQ ID NO: 63221 - RNA, 64 nt, Human; identical to SEQ ID NO: 62300

SEQ ID NO: 63222 - RNA, 64 nt, Human; identical to SEQ ID NO: 62301

SEQ ID NO: 63223 - RNA, 64 nt, Human; identical to SEQ ID NO: 62302

SEQ ID NO: 63224 - RNA, 64 nt, Human; identical to SEQ ID NO: 62303

SEQ ID NO: 63225 - RNA, 64 nt, Human; identical to SEQ ID NO: 62304

SEQ ID NO: 63226 - RNA, 64 nt, Human; identical to SEQ ID NO: 62305

SEQ ID NO: 63227 - RNA, 64 nt, Human; identical to SEQ ID NO: 62306

SEQ ID NO: 63228 - RNA, 64 nt, Human; identical to SEQ ID NO: 62307

SEQ ID NO: 63229 - RNA, 64 nt, Human; identical to SEQ ID NO: 62308

SEQ ID NO: 63230 - RNA, 64 nt, Human; identical to SEQ ID NO: 62309

SEQ ID NO: 63231 - RNA, 64 nt, Human; identical to SEQ ID NO: 62310

SEQ ID NO: 63232 - RNA, 64 nt, Human; identical to SEQ ID NO: 62311

SEQ ID NO: 63233 - RNA, 64 nt, Human; identical to SEQ ID NO: 62312

SEQ ID NO: 63234 - RNA, 64 nt, Human; identical to SEQ ID NO: 62313

SEQ ID NO: 63235 - RNA, 64 nt, Human; identical to SEQ ID NO: 62314

SEQ ID NO: 63236 - RNA, 64 nt, Human; identical to SEQ ID NO: 62315

SEQ ID NO: 63237 - RNA, 64 nt, Human; identical to SEQ ID NO: 62316

SEQ ID NO: 63238 - RNA, 64 nt, Human; identical to SEQ ID NO: 62317

SEQ ID NO: 63239 - RNA, 64 nt, Human; identical to SEQ ID NO: 62318

SEQ ID NO: 63240 - RNA, 64 nt, Human; identical to SEQ ID NO: 62319

SEQ ID NO: 63241 - RNA, 64 nt, Human; identical to SEQ ID NO: 62320

SEQ ID NO: 63242 - RNA, 64 nt, Human; identical to SEQ ID NO: 62321

SEQ ID NO: 63243 - RNA, 64 nt, Human; identical to SEQ ID NO: 62322

SEQ ID NO: 63244 - RNA, 64 nt, Human; identical to SEQ ID NO: 62323

SEQ ID NO: 63245 - RNA, 64 nt, Human; identical to SEQ ID NO: 62324

SEQ ID NO: 63246 - RNA, 64 nt, Human; identical to SEQ ID NO: 62325

SEQ ID NO: 63247 - RNA, 64 nt, Human; identical to SEQ ID NO: 62326

SEQ ID NO: 63248 - RNA, 64 nt, Human; identical to SEQ ID NO: 62327

SEQ ID NO: 63249 - RNA, 64 nt, Human; identical to SEQ ID NO: 62328

SEQ ID NO: 63250 - RNA, 64 nt, Human; identical to SEQ ID NO: 62329

SEQ ID NO: 63251 - RNA, 64 nt, Human; identical to SEQ ID NO: 62330

SEQ ID NO: 63252 - RNA, 64 nt, Human; identical to SEQ ID NO: 62331

SEQ ID NO: 63253 - RNA, 64 nt, Human; identical to SEQ ID NO: 62332

SEQ ID NO: 63254 - RNA, 64 nt, Human; identical to SEQ ID NO: 62333

SEQ ID NO: 63255 - RNA, 64 nt, Human; identical to SEQ ID NO: 62334

SEQ ID NO: 63256 - RNA, 64 nt, Human; identical to SEQ ID NO: 62335

SEQ ID NO: 63257 - RNA, 64 nt, Human; identical to SEQ ID NO: 62336

SEQ ID NO: 63258 - RNA, 64 nt, Human; identical to SEQ ID NO: 62337

SEQ ID NO: 63259 - RNA, 64 nt, Human; identical to SEQ ID NO: 62338

SEQ ID NO: 63260 - RNA, 64 nt, Human; identical to SEQ ID NO: 62339

SEQ ID NO: 63261 - RNA, 64 nt, Human; identical to SEQ ID NO: 62340

SEQ ID NO: 63262 - RNA, 64 nt, Human; identical to SEQ ID NO: 62341

SEQ ID NO: 63263 - RNA, 56 nt, Human; identical to SEQ ID NO: 13221

SEQ ID NO: 63264 - RNA, 64 nt, Human; identical to SEQ ID NO: 62343

SEQ ID NO: 63265 - RNA, 64 nt, Human; identical to SEQ ID NO: 62344

SEQ ID NO: 63266 - RNA, 64 nt, Human; identical to SEQ ID NO: 62345

SEQ ID NO: 63267 - RNA, 64 nt, Human; identical to SEQ ID NO: 62346

SEQ ID NO: 63268 - RNA, 64 nt, Human; identical to SEQ ID NO: 62347

SEQ ID NO: 63269 - RNA, 64 nt, Human; identical to SEQ ID NO: 62348

SEQ ID NO: 63270 - RNA, 64 nt, Human; identical to SEQ ID NO: 62349

SEQ ID NO: 63271 - RNA, 64 nt, Human; identical to SEQ ID NO: 62350

SEQ ID NO: 63272 - RNA, 64 nt, Human; identical to SEQ ID NO: 62351

SEQ ID NO: 63273 - RNA, 64 nt, Human; identical to SEQ ID NO: 62352

SEQ ID NO: 63274 - RNA, 64 nt, Human; identical to SEQ ID NO: 62353

SEQ ID NO: 63275 - RNA, 64 nt, Human; identical to SEQ ID NO: 62354

SEQ ID NO: 63276 - RNA, 64 nt, Human; identical to SEQ ID NO: 62355

SEQ ID NO: 63277 - RNA, 64 nt, Human; identical to SEQ ID NO: 62356

SEQ ID NO: 63278 - RNA, 64 nt, Human; identical to SEQ ID NO: 62357

SEQ ID NO: 63279 - RNA, 64 nt, Human; identical to SEQ ID NO: 62358

SEQ ID NO: 63280 - RNA, 64 nt, Human; identical to SEQ ID NO: 62359

SEQ ID NO: 63281 - RNA, 64 nt, Human; identical to SEQ ID NO: 62360

SEQ ID NO: 63282 - RNA, 64 nt, Human; identical to SEQ ID NO: 62361

SEQ ID NO: 63283 - RNA, 50 nt, Human; identical to SEQ ID NO: 13241

SEQ ID NO: 63284 - RNA, 57 nt, Human; identical to SEQ ID NO: 13242

SEQ ID NO: 63285 - RNA, 64 nt, Human; identical to SEQ ID NO: 62364

SEQ ID NO: 63286 - RNA, 64 nt, Human; identical to SEQ ID NO: 62365

SEQ ID NO: 63287 - RNA, 64 nt, Human; identical to SEQ ID NO: 62366

SEQ ID NO: 63288 - RNA, 64 nt, Human; identical to SEQ ID NO: 62367

SEQ ID NO: 63289 - RNA, 64 nt, Human; identical to SEQ ID NO: 62368

SEQ ID NO: 63290 - RNA, 64 nt, Human; identical to SEQ ID NO: 62369

SEQ ID NO: 63291 - RNA, 64 nt, Human; identical to SEQ ID NO: 62370

SEQ ID NO: 63292 - RNA, 64 nt, Human; identical to SEQ ID NO: 62371

SEQ ID NO: 63293 - RNA, 64 nt, Human; identical to SEQ ID NO: 62372

SEQ ID NO: 63294 - RNA, 64 nt, Human; identical to SEQ ID NO: 62373

SEQ ID NO: 63295 - RNA, 64 nt, Human; identical to SEQ ID NO: 62374

SEQ ID NO: 63296 - RNA, 64 nt, Human; identical to SEQ ID NO: 62375

SEQ ID NO: 63297 - RNA, 64 nt, Human; identical to SEQ ID NO: 62376

SEQ ID NO: 63298 - RNA, 64 nt, Human; identical to SEQ ID NO: 62377

SEQ ID NO: 63299 - RNA, 64 nt, Human; identical to SEQ ID NO: 62378

SEQ ID NO: 63300 - RNA, 64 nt, Human; identical to SEQ ID NO: 62379

SEQ ID NO: 63301 - RNA, 64 nt, Human; identical to SEQ ID NO: 62380

SEQ ID NO: 63302 - RNA, 64 nt, Human; identical to SEQ ID NO: 62381

SEQ ID NO: 63303 - RNA, 64 nt, Human; identical to SEQ ID NO: 62382

SEQ ID NO: 63304 - RNA, 64 nt, Human; identical to SEQ ID NO: 62383

SEQ ID NO: 63305 - RNA, 64 nt, Human; identical to SEQ ID NO: 62384

SEQ ID NO: 63306 - RNA, 64 nt, Human; identical to SEQ ID NO: 62385

SEQ ID NO: 63307 - RNA, 64 nt, Human; identical to SEQ ID NO: 62386

SEQ ID NO: 63308 - RNA, 64 nt, Human; identical to SEQ ID NO: 62387

SEQ ID NO: 63309 - RNA, 64 nt, Human; identical to SEQ ID NO: 62388

SEQ ID NO: 63310 - RNA, 64 nt, Human; identical to SEQ ID NO: 62389

SEQ ID NO: 63311 - RNA, 64 nt, Human; identical to SEQ ID NO: 62390

SEQ ID NO: 63312 - RNA, 64 nt, Human; identical to SEQ ID NO: 62391

SEQ ID NO: 63313 - RNA, 64 nt, Human; identical to SEQ ID NO: 62392

SEQ ID NO: 63314 - RNA, 64 nt, Human; identical to SEQ ID NO: 62393

SEQ ID NO: 63315 - RNA, 64 nt, Human; identical to SEQ ID NO: 62394

SEQ ID NO: 63316 - RNA, 64 nt, Human; identical to SEQ ID NO: 62395

SEQ ID NO: 63317 - RNA, 64 nt, Human; identical to SEQ ID NO: 62396

SEQ ID NO: 63318 - RNA, 64 nt, Human; identical to SEQ ID NO: 62397

SEQ ID NO: 63319 - RNA, 64 nt, Human; identical to SEQ ID NO: 62398

SEQ ID NO: 63320 - RNA, 64 nt, Human; identical to SEQ ID NO: 62399

SEQ ID NO: 63321 - RNA, 64 nt, Human; identical to SEQ ID NO: 62400

SEQ ID NO: 63322 - RNA, 64 nt, Human; identical to SEQ ID NO: 62401

SEQ ID NO: 63323 - RNA, 64 nt, Human; identical to SEQ ID NO: 62402

SEQ ID NO: 63324 - RNA, 64 nt, Human; identical to SEQ ID NO: 62403

SEQ ID NO: 63325 - RNA, 64 nt, Human; identical to SEQ ID NO: 62404

SEQ ID NO: 63326 - RNA, 64 nt, Human; identical to SEQ ID NO: 62405

SEQ ID NO: 63327 - RNA, 64 nt, Human; identical to SEQ ID NO: 62406

SEQ ID NO: 63328 - RNA, 64 nt, Human; identical to SEQ ID NO: 62407

SEQ ID NO: 63329 - RNA, 64 nt, Human; identical to SEQ ID NO: 62408

SEQ ID NO: 63330 - RNA, 64 nt, Human; identical to SEQ ID NO: 62409

SEQ ID NO: 63331 - RNA, 64 nt, Human; identical to SEQ ID NO: 62410

SEQ ID NO: 63332 - RNA, 64 nt, Human; identical to SEQ ID NO: 62411

SEQ ID NO: 63333 - RNA, 64 nt, Human; identical to SEQ ID NO: 62412

SEQ ID NO: 63334 - RNA, 64 nt, Human; identical to SEQ ID NO: 62413

SEQ ID NO: 63335 - RNA, 64 nt, Human; identical to SEQ ID NO: 62414

SEQ ID NO: 63336 - RNA, 64 nt, Human; identical to SEQ ID NO: 62415

SEQ ID NO: 63337 - RNA, 64 nt, Human; identical to SEQ ID NO: 62416

SEQ ID NO: 63338 - RNA, 64 nt, Human; identical to SEQ ID NO: 62417

SEQ ID NO: 63339 - RNA, 64 nt, Human; identical to SEQ ID NO: 62418

SEQ ID NO: 63340 - RNA, 64 nt, Human; identical to SEQ ID NO: 62419

SEQ ID NO: 63341 - RNA, 64 nt, Human; identical to SEQ ID NO: 62420

SEQ ID NO: 63342 - RNA, 64 nt, Human; identical to SEQ ID NO: 62421

SEQ ID NO: 63343 - RNA, 64 nt, Human; identical to SEQ ID NO: 62422

SEQ ID NO: 63344 - RNA, 64 nt, Human; identical to SEQ ID NO: 62423

SEQ ID NO: 63345 - RNA, 64 nt, Human; identical to SEQ ID NO: 62424

SEQ ID NO: 63346 - RNA, 64 nt, Human; identical to SEQ ID NO: 62425

SEQ ID NO: 63347 - RNA, 61 nt, Human; identical to SEQ ID NO: 13305

SEQ ID NO: 63348 - RNA, 64 nt, Human; identical to SEQ ID NO: 62427

SEQ ID NO: 63349 - RNA, 52 nt, Human; identical to SEQ ID NO: 13307

SEQ ID NO: 63350 - RNA, 64 nt, Human; identical to SEQ ID NO: 62429

SEQ ID NO: 63351 - RNA, 64 nt, Human; identical to SEQ ID NO: 62430

SEQ ID NO: 63352 - RNA, 64 nt, Human; identical to SEQ ID NO: 62431

SEQ ID NO: 63353 - RNA, 64 nt, Human; identical to SEQ ID NO: 62432

SEQ ID NO: 63354 - RNA, 64 nt, Human; identical to SEQ ID NO: 62433

SEQ ID NO: 63355 - RNA, 64 nt, Human; identical to SEQ ID NO: 62434

SEQ ID NO: 63356 - RNA, 64 nt, Human; identical to SEQ ID NO: 62435

SEQ ID NO: 63357 - RNA, 64 nt, Human; identical to SEQ ID NO: 62436

SEQ ID NO: 63358 - RNA, 64 nt, Human; identical to SEQ ID NO: 62437

SEQ ID NO: 63359 - RNA, 64 nt, Human; identical to SEQ ID NO: 62438

SEQ ID NO: 63360 - RNA, 64 nt, Human; identical to SEQ ID NO: 62439

SEQ ID NO: 63361 - RNA, 64 nt, Human; identical to SEQ ID NO: 62440

SEQ ID NO: 63362 - RNA, 64 nt, Human; identical to SEQ ID NO: 62441

SEQ ID NO: 63363 - RNA, 64 nt, Human; identical to SEQ ID NO: 62442

SEQ ID NO: 63364 - RNA, 64 nt, Human; identical to SEQ ID NO: 62443

SEQ ID NO: 63365 - RNA, 64 nt, Human; identical to SEQ ID NO: 62444

SEQ ID NO: 63366 - RNA, 64 nt, Human; identical to SEQ ID NO: 62445

SEQ ID NO: 63367 - RNA, 64 nt, Human; identical to SEQ ID NO: 62446

SEQ ID NO: 63368 - RNA, 64 nt, Human; identical to SEQ ID NO: 62447

SEQ ID NO: 63369 - RNA, 64 nt, Human; identical to SEQ ID NO: 62448

SEQ ID NO: 63370 - RNA, 64 nt, Human; identical to SEQ ID NO: 62449

SEQ ID NO: 63371 - RNA, 64 nt, Human; identical to SEQ ID NO: 62450

SEQ ID NO: 63372 - RNA, 64 nt, Human; identical to SEQ ID NO: 62451

SEQ ID NO: 63373 - RNA, 60 nt, Human; identical to SEQ ID NO: 13331

SEQ ID NO: 63374 - RNA, 64 nt, Human; identical to SEQ ID NO: 62453

SEQ ID NO: 63375 - RNA, 64 nt, Human; identical to SEQ ID NO: 62454

SEQ ID NO: 63376 - RNA, 64 nt, Human; identical to SEQ ID NO: 62455

SEQ ID NO: 63377 - RNA, 64 nt, Human; identical to SEQ ID NO: 62456

SEQ ID NO: 63378 - RNA, 64 nt, Human; identical to SEQ ID NO: 62457

SEQ ID NO: 63379 - RNA, 64 nt, Human; identical to SEQ ID NO: 62458

SEQ ID NO: 63380 - RNA, 64 nt, Human; identical to SEQ ID NO: 62459

SEQ ID NO: 63381 - RNA, 64 nt, Human; identical to SEQ ID NO: 62460

SEQ ID NO: 63382 - RNA, 64 nt, Human; identical to SEQ ID NO: 62461

SEQ ID NO: 63383 - RNA, 64 nt, Human; identical to SEQ ID NO: 62462

SEQ ID NO: 63384 - RNA, 64 nt, Human; identical to SEQ ID NO: 62463

SEQ ID NO: 63385 - RNA, 64 nt, Human; identical to SEQ ID NO: 62464

SEQ ID NO: 63386 - RNA, 64 nt, Human; identical to SEQ ID NO: 62465

SEQ ID NO: 63387 - RNA, 64 nt, Human; identical to SEQ ID NO: 62466

SEQ ID NO: 63388 - RNA, 64 nt, Human; identical to SEQ ID NO: 62467

SEQ ID NO: 63389 - RNA, 64 nt, Human; identical to SEQ ID NO: 62468

SEQ ID NO: 63390 - RNA, 64 nt, Human; identical to SEQ ID NO: 62469

SEQ ID NO: 63391 - RNA, 64 nt, Human; identical to SEQ ID NO: 62470

SEQ ID NO: 63392 - RNA, 64 nt, Human; identical to SEQ ID NO: 62471

SEQ ID NO: 63393 - RNA, 64 nt, Human; identical to SEQ ID NO: 62472

SEQ ID NO: 63394 - RNA, 64 nt, Human; identical to SEQ ID NO: 62473

SEQ ID NO: 63395 - RNA, 64 nt, Human; identical to SEQ ID NO: 62474

SEQ ID NO: 63396 - RNA, 64 nt, Human; identical to SEQ ID NO: 62475

SEQ ID NO: 63397 - RNA, 64 nt, Human; identical to SEQ ID NO: 62476

SEQ ID NO: 63398 - RNA, 64 nt, Human; identical to SEQ ID NO: 62477

SEQ ID NO: 63399 - RNA, 64 nt, Human; identical to SEQ ID NO: 62478

SEQ ID NO: 63400 - RNA, 64 nt, Human; identical to SEQ ID NO: 62479

SEQ ID NO: 63401 - RNA, 64 nt, Human; identical to SEQ ID NO: 62480

SEQ ID NO: 63402 - RNA, 64 nt, Human; identical to SEQ ID NO: 62481

SEQ ID NO: 63403 - RNA, 64 nt, Human; identical to SEQ ID NO: 62482

SEQ ID NO: 63404 - RNA, 64 nt, Human; identical to SEQ ID NO: 62483

SEQ ID NO: 63405 - RNA, 64 nt, Human; identical to SEQ ID NO: 62484

SEQ ID NO: 63406 - RNA, 64 nt, Human; identical to SEQ ID NO: 62485

SEQ ID NO: 63407 - RNA, 64 nt, Human; identical to SEQ ID NO: 62486

SEQ ID NO: 63408 - RNA, 64 nt, Human; identical to SEQ ID NO: 62487

SEQ ID NO: 63409 - RNA, 64 nt, Human; identical to SEQ ID NO: 62488

SEQ ID NO: 63410 - RNA, 64 nt, Human; identical to SEQ ID NO: 62489

SEQ ID NO: 63411 - RNA, 63 nt, Human; identical to SEQ ID NO: 13369

SEQ ID NO: 63412 - RNA, 64 nt, Human; identical to SEQ ID NO: 62491

SEQ ID NO: 63413 - RNA, 64 nt, Human; identical to SEQ ID NO: 62492

SEQ ID NO: 63414 - RNA, 64 nt, Human; identical to SEQ ID NO: 62493

SEQ ID NO: 63415 - RNA, 64 nt, Human; identical to SEQ ID NO: 62494

SEQ ID NO: 63416 - RNA, 64 nt, Human; identical to SEQ ID NO: 62495

SEQ ID NO: 63417 - RNA, 64 nt, Human; identical to SEQ ID NO: 62496

SEQ ID NO: 63418 - RNA, 64 nt, Human; identical to SEQ ID NO: 62497

SEQ ID NO: 63419 - RNA, 64 nt, Human; identical to SEQ ID NO: 62498

SEQ ID NO: 63420 - RNA, 64 nt, Human; identical to SEQ ID NO: 62499

SEQ ID NO: 63421 - RNA, 64 nt, Human; identical to SEQ ID NO: 62500

SEQ ID NO: 63422 - RNA, 64 nt, Human; identical to SEQ ID NO: 62501

SEQ ID NO: 63423 - RNA, 64 nt, Human; identical to SEQ ID NO: 62502

SEQ ID NO: 63424 - RNA, 64 nt, Human; identical to SEQ ID NO: 62503

SEQ ID NO: 63425 - RNA, 64 nt, Human; identical to SEQ ID NO: 62504

SEQ ID NO: 63426 - RNA, 64 nt, Human; identical to SEQ ID NO: 62505

SEQ ID NO: 63427 - RNA, 64 nt, Human; identical to SEQ ID NO: 62506

SEQ ID NO: 63428 - RNA, 64 nt, Human; identical to SEQ ID NO: 62507

SEQ ID NO: 63429 - RNA, 64 nt, Human; identical to SEQ ID NO: 62508

SEQ ID NO: 63430 - RNA, 64 nt, Human; identical to SEQ ID NO: 62509

SEQ ID NO: 63431 - RNA, 64 nt, Human; identical to SEQ ID NO: 62510

SEQ ID NO: 63432 - RNA, 64 nt, Human; identical to SEQ ID NO: 62511

SEQ ID NO: 63433 - RNA, 64 nt, Human; identical to SEQ ID NO: 62512

SEQ ID NO: 63434 - RNA, 64 nt, Human; identical to SEQ ID NO: 62513

SEQ ID NO: 63435 - RNA, 53 nt, Human; identical to SEQ ID NO: 13393

SEQ ID NO: 63436 - RNA, 64 nt, Human; identical to SEQ ID NO: 62515

SEQ ID NO: 63437 - RNA, 64 nt, Human; identical to SEQ ID NO: 62516

SEQ ID NO: 63438 - RNA, 64 nt, Human; identical to SEQ ID NO: 62517

SEQ ID NO: 63439 - RNA, 64 nt, Human; identical to SEQ ID NO: 62518

SEQ ID NO: 63440 - RNA, 64 nt, Human; identical to SEQ ID NO: 62519

SEQ ID NO: 63441 - RNA, 64 nt, Human; identical to SEQ ID NO: 62520

SEQ ID NO: 63442 - RNA, 64 nt, Human; identical to SEQ ID NO: 62521

SEQ ID NO: 63443 - RNA, 64 nt, Human; identical to SEQ ID NO: 62522

SEQ ID NO: 63444 - RNA, 64 nt, Human; identical to SEQ ID NO: 62523

SEQ ID NO: 63445 - RNA, 64 nt, Human; identical to SEQ ID NO: 62524

SEQ ID NO: 63446 - RNA, 64 nt, Human; identical to SEQ ID NO: 62525

SEQ ID NO: 63447 - RNA, 64 nt, Human; identical to SEQ ID NO: 62526

SEQ ID NO: 63448 - RNA, 64 nt, Human; identical to SEQ ID NO: 62527

SEQ ID NO: 63449 - RNA, 64 nt, Human; identical to SEQ ID NO: 62528

SEQ ID NO: 63450 - RNA, 64 nt, Human; identical to SEQ ID NO: 62529

SEQ ID NO: 63451 - RNA, 64 nt, Human; identical to SEQ ID NO: 62530

SEQ ID NO: 63452 - RNA, 64 nt, Human; identical to SEQ ID NO: 62531

SEQ ID NO: 63453 - RNA, 64 nt, Human; identical to SEQ ID NO: 62532

SEQ ID NO: 63454 - RNA, 64 nt, Human; identical to SEQ ID NO: 62533

SEQ ID NO: 63455 - RNA, 64 nt, Human; identical to SEQ ID NO: 62534

SEQ ID NO: 63456 - RNA, 64 nt, Human; identical to SEQ ID NO: 62535

SEQ ID NO: 63457 - RNA, 64 nt, Human; identical to SEQ ID NO: 62536

SEQ ID NO: 63458 - RNA, 64 nt, Human; identical to SEQ ID NO: 62537

SEQ ID NO: 63459 - RNA, 64 nt, Human; identical to SEQ ID NO: 62538

SEQ ID NO: 63460 - RNA, 64 nt, Human; identical to SEQ ID NO: 62539

SEQ ID NO: 63461 - RNA, 64 nt, Human; identical to SEQ ID NO: 62540

SEQ ID NO: 63462 - RNA, 64 nt, Human; identical to SEQ ID NO: 62541

SEQ ID NO: 63463 - RNA, 64 nt, Human; identical to SEQ ID NO: 62542

SEQ ID NO: 63464 - RNA, 64 nt, Human; identical to SEQ ID NO: 62543

SEQ ID NO: 63465 - RNA, 64 nt, Human; identical to SEQ ID NO: 62544

SEQ ID NO: 63466 - RNA, 64 nt, Human; identical to SEQ ID NO: 62545

SEQ ID NO: 63467 - RNA, 64 nt, Human; identical to SEQ ID NO: 62546

SEQ ID NO: 63468 - RNA, 64 nt, Human; identical to SEQ ID NO: 62547

SEQ ID NO: 63469 - RNA, 64 nt, Human; identical to SEQ ID NO: 62548

SEQ ID NO: 63470 - RNA, 64 nt, Human; identical to SEQ ID NO: 62549

SEQ ID NO: 63471 - RNA, 64 nt, Human; identical to SEQ ID NO: 62550

SEQ ID NO: 63472 - RNA, 64 nt, Human; identical to SEQ ID NO: 62551

SEQ ID NO: 63473 - RNA, 64 nt, Human; identical to SEQ ID NO: 62552

SEQ ID NO: 63474 - RNA, 64 nt, Human; identical to SEQ ID NO: 62553

SEQ ID NO: 63475 - RNA, 64 nt, Human; identical to SEQ ID NO: 62554

SEQ ID NO: 63476 - RNA, 64 nt, Human; identical to SEQ ID NO: 62555

SEQ ID NO: 63477 - RNA, 64 nt, Human; identical to SEQ ID NO: 62556

SEQ ID NO: 63478 - RNA, 64 nt, Human; identical to SEQ ID NO: 62557

SEQ ID NO: 63479 - RNA, 64 nt, Human; identical to SEQ ID NO: 62558

SEQ ID NO: 63480 - RNA, 64 nt, Human; identical to SEQ ID NO: 62559

SEQ ID NO: 63481 - RNA, 64 nt, Human; identical to SEQ ID NO: 62560

SEQ ID NO: 63482 - RNA, 54 nt, Human; identical to SEQ ID NO: 13440

SEQ ID NO: 63483 - RNA, 64 nt, Human; identical to SEQ ID NO: 62562

SEQ ID NO: 63484 - RNA, 64 nt, Human; identical to SEQ ID NO: 62563

SEQ ID NO: 63485 - RNA, 64 nt, Human; identical to SEQ ID NO: 62564

SEQ ID NO: 63486 - RNA, 64 nt, Human; identical to SEQ ID NO: 62565

SEQ ID NO: 63487 - RNA, 64 nt, Human; identical to SEQ ID NO: 62566

SEQ ID NO: 63488 - RNA, 64 nt, Human; identical to SEQ ID NO: 62567

SEQ ID NO: 63489 - RNA, 64 nt, Human; identical to SEQ ID NO: 62568

SEQ ID NO: 63490 - RNA, 64 nt, Human; identical to SEQ ID NO: 62569

SEQ ID NO: 63491 - RNA, 64 nt, Human; identical to SEQ ID NO: 62570

SEQ ID NO: 63492 - RNA, 64 nt, Human; identical to SEQ ID NO: 62571

SEQ ID NO: 63493 - RNA, 64 nt, Human; identical to SEQ ID NO: 62572

SEQ ID NO: 63494 - RNA, 64 nt, Human; identical to SEQ ID NO: 62573

SEQ ID NO: 63495 - RNA, 64 nt, Human; identical to SEQ ID NO: 62574

SEQ ID NO: 63496 - RNA, 64 nt, Human; identical to SEQ ID NO: 62575

SEQ ID NO: 63497 - RNA, 64 nt, Human; identical to SEQ ID NO: 62576

SEQ ID NO: 63498 - RNA, 64 nt, Human; identical to SEQ ID NO: 62577

SEQ ID NO: 63499 - RNA, 64 nt, Human; identical to SEQ ID NO: 62578

SEQ ID NO: 63500 - RNA, 64 nt, Human; identical to SEQ ID NO: 62579

SEQ ID NO: 63501 - RNA, 64 nt, Human; identical to SEQ ID NO: 62580

SEQ ID NO: 63502 - RNA, 64 nt, Human; identical to SEQ ID NO: 62581

SEQ ID NO: 63503 - RNA, 64 nt, Human; identical to SEQ ID NO: 62582

SEQ ID NO: 63504 - RNA, 64 nt, Human; identical to SEQ ID NO: 62583

SEQ ID NO: 63505 - RNA, 64 nt, Human; identical to SEQ ID NO: 62584

SEQ ID NO: 63506 - RNA, 64 nt, Human; identical to SEQ ID NO: 62585

SEQ ID NO: 63507 - RNA, 64 nt, Human; identical to SEQ ID NO: 62586

SEQ ID NO: 63508 - RNA, 64 nt, Human; identical to SEQ ID NO: 62587

SEQ ID NO: 63509 - RNA, 64 nt, Human; identical to SEQ ID NO: 62588

SEQ ID NO: 63510 - RNA, 64 nt, Human; identical to SEQ ID NO: 62589

SEQ ID NO: 63511 - RNA, 64 nt, Human; identical to SEQ ID NO: 62590

SEQ ID NO: 63512 - RNA, 64 nt, Human; identical to SEQ ID NO: 62591

SEQ ID NO: 63513 - RNA, 64 nt, Human; identical to SEQ ID NO: 62592

SEQ ID NO: 63514 - RNA, 64 nt, Human; identical to SEQ ID NO: 62593

SEQ ID NO: 63515 - RNA, 64 nt, Human; identical to SEQ ID NO: 62594

SEQ ID NO: 63516 - RNA, 64 nt, Human; identical to SEQ ID NO: 62595

SEQ ID NO: 63517 - RNA, 64 nt, Human; identical to SEQ ID NO: 62596

SEQ ID NO: 63518 - RNA, 64 nt, Human; identical to SEQ ID NO: 62597

SEQ ID NO: 63519 - RNA, 51 nt, Human; identical to SEQ ID NO: 13477

SEQ ID NO: 63520 - RNA, 64 nt, Human; identical to SEQ ID NO: 62599

SEQ ID NO: 63521 - RNA, 64 nt, Human; identical to SEQ ID NO: 62600

SEQ ID NO: 63522 - RNA, 64 nt, Human; identical to SEQ ID NO: 62601

SEQ ID NO: 63523 - RNA, 64 nt, Human; identical to SEQ ID NO: 62602

SEQ ID NO: 63524 - RNA, 64 nt, Human; identical to SEQ ID NO: 62603

SEQ ID NO: 63525 - RNA, 64 nt, Human; identical to SEQ ID NO: 62604

SEQ ID NO: 63526 - RNA, 64 nt, Human; identical to SEQ ID NO: 62605

SEQ ID NO: 63527 - RNA, 64 nt, Human; identical to SEQ ID NO: 62606

SEQ ID NO: 63528 - RNA, 64 nt, Human; identical to SEQ ID NO: 62607

SEQ ID NO: 63529 - RNA, 64 nt, Human; identical to SEQ ID NO: 62608

SEQ ID NO: 63530 - RNA, 64 nt, Human; identical to SEQ ID NO: 62609

SEQ ID NO: 63531 - RNA, 64 nt, Human; identical to SEQ ID NO: 62610

SEQ ID NO: 63532 - RNA, 64 nt, Human; identical to SEQ ID NO: 62611

SEQ ID NO: 63533 - RNA, 64 nt, Human; identical to SEQ ID NO: 62612

SEQ ID NO: 63534 - RNA, 64 nt, Human; identical to SEQ ID NO: 62613

SEQ ID NO: 63535 - RNA, 64 nt, Human; identical to SEQ ID NO: 62614

SEQ ID NO: 63536 - RNA, 64 nt, Human; identical to SEQ ID NO: 62615

SEQ ID NO: 63537 - RNA, 64 nt, Human; identical to SEQ ID NO: 62616

SEQ ID NO: 63538 - RNA, 64 nt, Human; identical to SEQ ID NO: 62617

SEQ ID NO: 63539 - RNA, 64 nt, Human; identical to SEQ ID NO: 62618

SEQ ID NO: 63540 - RNA, 64 nt, Human; identical to SEQ ID NO: 62619

SEQ ID NO: 63541 - RNA, 64 nt, Human; identical to SEQ ID NO: 62620

SEQ ID NO: 63542 - RNA, 64 nt, Human; identical to SEQ ID NO: 62621

SEQ ID NO: 63543 - RNA, 64 nt, Human; identical to SEQ ID NO: 62622

SEQ ID NO: 63544 - RNA, 64 nt, Human; identical to SEQ ID NO: 62623

SEQ ID NO: 63545 - RNA, 64 nt, Human; identical to SEQ ID NO: 62624

SEQ ID NO: 63546 - RNA, 64 nt, Human; identical to SEQ ID NO: 62625

SEQ ID NO: 63547 - RNA, 64 nt, Human; identical to SEQ ID NO: 62626

SEQ ID NO: 63548 - RNA, 64 nt, Human; identical to SEQ ID NO: 62627

SEQ ID NO: 63549 - RNA, 64 nt, Human; identical to SEQ ID NO: 62628

SEQ ID NO: 63550 - RNA, 64 nt, Human; identical to SEQ ID NO: 62629

SEQ ID NO: 63551 - RNA, 64 nt, Human; identical to SEQ ID NO: 62630

SEQ ID NO: 63552 - RNA, 64 nt, Human; identical to SEQ ID NO: 62631

SEQ ID NO: 63553 - RNA, 64 nt, Human; identical to SEQ ID NO: 62632

SEQ ID NO: 63554 - RNA, 64 nt, Human; identical to SEQ ID NO: 62633

SEQ ID NO: 63555 - RNA, 64 nt, Human; identical to SEQ ID NO: 62634

SEQ ID NO: 63556 - RNA, 64 nt, Human; identical to SEQ ID NO: 62635

SEQ ID NO: 63557 - RNA, 64 nt, Human; identical to SEQ ID NO: 62636

SEQ ID NO: 63558 - RNA, 64 nt, Human; identical to SEQ ID NO: 62637

SEQ ID NO: 63559 - RNA, 64 nt, Human; identical to SEQ ID NO: 62638

SEQ ID NO: 63560 - RNA, 64 nt, Human; identical to SEQ ID NO: 62639

SEQ ID NO: 63561 - RNA, 64 nt, Human; identical to SEQ ID NO: 62640

SEQ ID NO: 63562 - RNA, 64 nt, Human; identical to SEQ ID NO: 62641

SEQ ID NO: 63563 - RNA, 64 nt, Human; identical to SEQ ID NO: 62642

SEQ ID NO: 63564 - RNA, 64 nt, Human; identical to SEQ ID NO: 62643

SEQ ID NO: 63565 - RNA, 64 nt, Human; identical to SEQ ID NO: 62644

SEQ ID NO: 63566 - RNA, 64 nt, Human; identical to SEQ ID NO: 62645

SEQ ID NO: 63567 - RNA, 64 nt, Human; identical to SEQ ID NO: 62646

SEQ ID NO: 63568 - RNA, 64 nt, Human; identical to SEQ ID NO: 62647

SEQ ID NO: 63569 - RNA, 64 nt, Human; identical to SEQ ID NO: 62648

SEQ ID NO: 63570 - RNA, 64 nt, Human; identical to SEQ ID NO: 62649

SEQ ID NO: 63571 - RNA, 64 nt, Human; identical to SEQ ID NO: 62650

SEQ ID NO: 63572 - RNA, 64 nt, Human; identical to SEQ ID NO: 62651

SEQ ID NO: 63573 - RNA, 64 nt, Human; identical to SEQ ID NO: 62652

SEQ ID NO: 63574 - RNA, 52 nt, Human; identical to SEQ ID NO: 13532

SEQ ID NO: 63575 - RNA, 64 nt, Human; identical to SEQ ID NO: 62654

SEQ ID NO: 63576 - RNA, 64 nt, Human; identical to SEQ ID NO: 62655

SEQ ID NO: 63577 - RNA, 64 nt, Human; identical to SEQ ID NO: 62656

SEQ ID NO: 63578 - RNA, 64 nt, Human; identical to SEQ ID NO: 62657

SEQ ID NO: 63579 - RNA, 64 nt, Human; identical to SEQ ID NO: 62658

SEQ ID NO: 63580 - RNA, 64 nt, Human; identical to SEQ ID NO: 62659

SEQ ID NO: 63581 - RNA, 64 nt, Human; identical to SEQ ID NO: 62660

SEQ ID NO: 63582 - RNA, 64 nt, Human; identical to SEQ ID NO: 62661

SEQ ID NO: 63583 - RNA, 64 nt, Human; identical to SEQ ID NO: 62662

SEQ ID NO: 63584 - RNA, 64 nt, Human; identical to SEQ ID NO: 62663

SEQ ID NO: 63585 - RNA, 64 nt, Human; identical to SEQ ID NO: 62664

SEQ ID NO: 63586 - RNA, 64 nt, Human; identical to SEQ ID NO: 62665

SEQ ID NO: 63587 - RNA, 64 nt, Human; identical to SEQ ID NO: 62666

SEQ ID NO: 63588 - RNA, 64 nt, Human; identical to SEQ ID NO: 62667

SEQ ID NO: 63589 - RNA, 64 nt, Human; identical to SEQ ID NO: 62668

SEQ ID NO: 63590 - RNA, 64 nt, Human; identical to SEQ ID NO: 62669

SEQ ID NO: 63591 - RNA, 64 nt, Human; identical to SEQ ID NO: 62670

SEQ ID NO: 63592 - RNA, 64 nt, Human; identical to SEQ ID NO: 62671

SEQ ID NO: 63593 - RNA, 64 nt, Human; identical to SEQ ID NO: 62672

SEQ ID NO: 63594 - RNA, 64 nt, Human; identical to SEQ ID NO: 62673

SEQ ID NO: 63595 - RNA, 64 nt, Human; identical to SEQ ID NO: 62674

SEQ ID NO: 63596 - RNA, 64 nt, Human; identical to SEQ ID NO: 62675

SEQ ID NO: 63597 - RNA, 64 nt, Human; identical to SEQ ID NO: 62676

SEQ ID NO: 63598 - RNA, 60 nt, Human; identical to SEQ ID NO: 13556

SEQ ID NO: 63599 - RNA, 64 nt, Human; identical to SEQ ID NO: 62678

SEQ ID NO: 63600 - RNA, 64 nt, Human; identical to SEQ ID NO: 62679

SEQ ID NO: 63601 - RNA, 64 nt, Human; identical to SEQ ID NO: 62680

SEQ ID NO: 63602 - RNA, 64 nt, Human; identical to SEQ ID NO: 62681

SEQ ID NO: 63603 - RNA, 64 nt, Human; identical to SEQ ID NO: 62682

SEQ ID NO: 63604 - RNA, 64 nt, Human; identical to SEQ ID NO: 62683

SEQ ID NO: 63605 - RNA, 64 nt, Human; identical to SEQ ID NO: 62684

SEQ ID NO: 63606 - RNA, 64 nt, Human; identical to SEQ ID NO: 62685

SEQ ID NO: 63607 - RNA, 57 nt, Human; identical to SEQ ID NO: 13565

SEQ ID NO: 63608 - RNA, 64 nt, Human; identical to SEQ ID NO: 62687

SEQ ID NO: 63609 - RNA, 64 nt, Human; identical to SEQ ID NO: 62688

SEQ ID NO: 63610 - RNA, 64 nt, Human; identical to SEQ ID NO: 62689

SEQ ID NO: 63611 - RNA, 64 nt, Human; identical to SEQ ID NO: 62690

SEQ ID NO: 63612 - RNA, 64 nt, Human; identical to SEQ ID NO: 62691

SEQ ID NO: 63613 - RNA, 64 nt, Human; identical to SEQ ID NO: 62692

SEQ ID NO: 63614 - RNA, 64 nt, Human; identical to SEQ ID NO: 62693

SEQ ID NO: 63615 - RNA, 64 nt, Human; identical to SEQ ID NO: 62694

SEQ ID NO: 63616 - RNA, 64 nt, Human; identical to SEQ ID NO: 62695

SEQ ID NO: 63617 - RNA, 64 nt, Human; identical to SEQ ID NO: 62696

SEQ ID NO: 63618 - RNA, 64 nt, Human; identical to SEQ ID NO: 62697

SEQ ID NO: 63619 - RNA, 64 nt, Human; identical to SEQ ID NO: 62698

SEQ ID NO: 63620 - RNA, 64 nt, Human; identical to SEQ ID NO: 62699

SEQ ID NO: 63621 - RNA, 64 nt, Human; identical to SEQ ID NO: 62700

SEQ ID NO: 63622 - RNA, 64 nt, Human; identical to SEQ ID NO: 62701

SEQ ID NO: 63623 - RNA, 64 nt, Human; identical to SEQ ID NO: 62702

SEQ ID NO: 63624 - RNA, 64 nt, Human; identical to SEQ ID NO: 62703

SEQ ID NO: 63625 - RNA, 64 nt, Human; identical to SEQ ID NO: 62704

SEQ ID NO: 63626 - RNA, 64 nt, Human; identical to SEQ ID NO: 62705

SEQ ID NO: 63627 - RNA, 64 nt, Human; identical to SEQ ID NO: 62706

SEQ ID NO: 63628 - RNA, 64 nt, Human; identical to SEQ ID NO: 62707

SEQ ID NO: 63629 - RNA, 64 nt, Human; identical to SEQ ID NO: 62708

SEQ ID NO: 63630 - RNA, 64 nt, Human; identical to SEQ ID NO: 62709

SEQ ID NO: 63631 - RNA, 64 nt, Human; identical to SEQ ID NO: 62710

SEQ ID NO: 63632 - RNA, 64 nt, Human; identical to SEQ ID NO: 62711

SEQ ID NO: 63633 - RNA, 64 nt, Human; identical to SEQ ID NO: 62712

SEQ ID NO: 63634 - RNA, 64 nt, Human; identical to SEQ ID NO: 62713

SEQ ID NO: 63635 - RNA, 64 nt, Human; identical to SEQ ID NO: 62714

SEQ ID NO: 63636 - RNA, 64 nt, Human; identical to SEQ ID NO: 62715

SEQ ID NO: 63637 - RNA, 64 nt, Human; identical to SEQ ID NO: 62716

SEQ ID NO: 63638 - RNA, 64 nt, Human; identical to SEQ ID NO: 62717

SEQ ID NO: 63639 - RNA, 64 nt, Human; identical to SEQ ID NO: 62718

SEQ ID NO: 63640 - RNA, 64 nt, Human; identical to SEQ ID NO: 62719

SEQ ID NO: 63641 - RNA, 64 nt, Human; identical to SEQ ID NO: 62720

SEQ ID NO: 63642 - RNA, 64 nt, Human; identical to SEQ ID NO: 62721

SEQ ID NO: 63643 - RNA, 64 nt, Human; identical to SEQ ID NO: 62722

SEQ ID NO: 63644 - RNA, 64 nt, Human; identical to SEQ ID NO: 62723

SEQ ID NO: 63645 - RNA, 64 nt, Human; identical to SEQ ID NO: 62724

SEQ ID NO: 63646 - RNA, 64 nt, Human; identical to SEQ ID NO: 62725

SEQ ID NO: 63647 - RNA, 64 nt, Human; identical to SEQ ID NO: 62726

SEQ ID NO: 63648 - RNA, 64 nt, Human; identical to SEQ ID NO: 62727

SEQ ID NO: 63649 - RNA, 64 nt, Human; identical to SEQ ID NO: 62728

SEQ ID NO: 63650 - RNA, 64 nt, Human; identical to SEQ ID NO: 62729

SEQ ID NO: 63651 - RNA, 64 nt, Human; identical to SEQ ID NO: 62730

SEQ ID NO: 63652 - RNA, 64 nt, Human; identical to SEQ ID NO: 62731

SEQ ID NO: 63653 - RNA, 64 nt, Human; identical to SEQ ID NO: 62732

SEQ ID NO: 63654 - RNA, 64 nt, Human; identical to SEQ ID NO: 62733

SEQ ID NO: 63655 - RNA, 64 nt, Human; identical to SEQ ID NO: 62734

SEQ ID NO: 63656 - RNA, 64 nt, Human; identical to SEQ ID NO: 62735

SEQ ID NO: 63657 - RNA, 64 nt, Human; identical to SEQ ID NO: 62736

SEQ ID NO: 63658 - RNA, 64 nt, Human; identical to SEQ ID NO: 62737

SEQ ID NO: 63659 - RNA, 64 nt, Human; identical to SEQ ID NO: 62738

SEQ ID NO: 63660 - RNA, 64 nt, Human; identical to SEQ ID NO: 62739

SEQ ID NO: 63661 - RNA, 64 nt, Human; identical to SEQ ID NO: 62740

SEQ ID NO: 63662 - RNA, 64 nt, Human; identical to SEQ ID NO: 62741

SEQ ID NO: 63663 - RNA, 64 nt, Human; identical to SEQ ID NO: 62742

SEQ ID NO: 63664 - RNA, 64 nt, Human; identical to SEQ ID NO: 62743

SEQ ID NO: 63665 - RNA, 64 nt, Human; identical to SEQ ID NO: 62744

SEQ ID NO: 63666 - RNA, 64 nt, Human; identical to SEQ ID NO: 62745

SEQ ID NO: 63667 - RNA, 64 nt, Human; identical to SEQ ID NO: 62746

SEQ ID NO: 63668 - RNA, 64 nt, Human; identical to SEQ ID NO: 62747

SEQ ID NO: 63669 - RNA, 64 nt, Human; identical to SEQ ID NO: 62748

SEQ ID NO: 63670 - RNA, 64 nt, Human; identical to SEQ ID NO: 62749

SEQ ID NO: 63671 - RNA, 64 nt, Human; identical to SEQ ID NO: 62750

SEQ ID NO: 63672 - RNA, 64 nt, Human; identical to SEQ ID NO: 62751

SEQ ID NO: 63673 - RNA, 64 nt, Human; identical to SEQ ID NO: 62752

SEQ ID NO: 63674 - RNA, 64 nt, Human; identical to SEQ ID NO: 62753

SEQ ID NO: 63675 - RNA, 64 nt, Human; identical to SEQ ID NO: 62754

SEQ ID NO: 63676 - RNA, 64 nt, Human; identical to SEQ ID NO: 62755

SEQ ID NO: 63677 - RNA, 64 nt, Human; identical to SEQ ID NO: 62756

SEQ ID NO: 63678 - RNA, 62 nt, Human; identical to SEQ ID NO: 62757

SEQ ID NO: 63679 - RNA, 64 nt, Human; identical to SEQ ID NO: 62758

SEQ ID NO: 63680 - RNA, 64 nt, Human; identical to SEQ ID NO: 62759

SEQ ID NO: 63681 - RNA, 64 nt, Human; identical to SEQ ID NO: 62760

SEQ ID NO: 63682 - RNA, 64 nt, Human; identical to SEQ ID NO: 62761

SEQ ID NO: 63683 - RNA, 64 nt, Human; identical to SEQ ID NO: 62762

SEQ ID NO: 63684 - RNA, 64 nt, Human; identical to SEQ ID NO: 62763

SEQ ID NO: 63685 - RNA, 64 nt, Human; identical to SEQ ID NO: 62764

SEQ ID NO: 63686 - RNA, 64 nt, Human; identical to SEQ ID NO: 62765

SEQ ID NO: 63687 - RNA, 64 nt, Human; identical to SEQ ID NO: 62766

SEQ ID NO: 63688 - RNA, 64 nt, Human; identical to SEQ ID NO: 62767

SEQ ID NO: 63689 - RNA, 64 nt, Human; identical to SEQ ID NO: 62768

SEQ ID NO: 63690 - RNA, 64 nt, Human; identical to SEQ ID NO: 62769

SEQ ID NO: 63691 - RNA, 64 nt, Human; identical to SEQ ID NO: 62770

SEQ ID NO: 63692 - RNA, 64 nt, Human; identical to SEQ ID NO: 62771

SEQ ID NO: 63693 - RNA, 64 nt, Human; identical to SEQ ID NO: 62772

SEQ ID NO: 63694 - RNA, 64 nt, Human; identical to SEQ ID NO: 62773

SEQ ID NO: 63695 - RNA, 64 nt, Human; identical to SEQ ID NO: 62774

SEQ ID NO: 63696 - RNA, 64 nt, Human; identical to SEQ ID NO: 62775

SEQ ID NO: 63697 - RNA, 64 nt, Human; identical to SEQ ID NO: 62776

SEQ ID NO: 63698 - RNA, 64 nt, Human; identical to SEQ ID NO: 62777

SEQ ID NO: 63699 - RNA, 64 nt, Human; identical to SEQ ID NO: 62778

SEQ ID NO: 63700 - RNA, 64 nt, Human; identical to SEQ ID NO: 62779

SEQ ID NO: 63701 - RNA, 64 nt, Human; identical to SEQ ID NO: 62780

SEQ ID NO: 63702 - RNA, 64 nt, Human; identical to SEQ ID NO: 62781

SEQ ID NO: 63703 - RNA, 64 nt, Human; identical to SEQ ID NO: 62782

SEQ ID NO: 63704 - RNA, 64 nt, Human; identical to SEQ ID NO: 62783

SEQ ID NO: 63705 - RNA, 64 nt, Human; identical to SEQ ID NO: 62784

SEQ ID NO: 63706 - RNA, 64 nt, Human; identical to SEQ ID NO: 62785

SEQ ID NO: 63707 - RNA, 64 nt, Human; identical to SEQ ID NO: 62786

SEQ ID NO: 63708 - RNA, 64 nt, Human; identical to SEQ ID NO: 62787

SEQ ID NO: 63709 - RNA, 64 nt, Human; identical to SEQ ID NO: 62788

SEQ ID NO: 63710 - RNA, 64 nt, Human; identical to SEQ ID NO: 62789

SEQ ID NO: 63711 - RNA, 64 nt, Human; identical to SEQ ID NO: 62790

SEQ ID NO: 63712 - RNA, 64 nt, Human; identical to SEQ ID NO: 62791

SEQ ID NO: 63713 - RNA, 64 nt, Human; identical to SEQ ID NO: 62792

SEQ ID NO: 63714 - RNA, 64 nt, Human; identical to SEQ ID NO: 62793

SEQ ID NO: 63715 - RNA, 64 nt, Human; identical to SEQ ID NO: 62794

SEQ ID NO: 63716 - RNA, 54 nt, Human; identical to SEQ ID NO: 13674

SEQ ID NO: 63717 - RNA, 64 nt, Human; identical to SEQ ID NO: 62796

SEQ ID NO: 63718 - RNA, 64 nt, Human; identical to SEQ ID NO: 62797

SEQ ID NO: 63719 - RNA, 58 nt, Human; identical to SEQ ID NO: 13677

SEQ ID NO: 63720 - RNA, 64 nt, Human; identical to SEQ ID NO: 62799

SEQ ID NO: 63721 - RNA, 64 nt, Human; identical to SEQ ID NO: 62800

SEQ ID NO: 63722 - RNA, 64 nt, Human; identical to SEQ ID NO: 62801

SEQ ID NO: 63723 - RNA, 64 nt, Human; identical to SEQ ID NO: 62802

SEQ ID NO: 63724 - RNA, 64 nt, Human; identical to SEQ ID NO: 62803

SEQ ID NO: 63725 - RNA, 64 nt, Human; identical to SEQ ID NO: 62804

SEQ ID NO: 63726 - RNA, 64 nt, Human; identical to SEQ ID NO: 62805

SEQ ID NO: 63727 - RNA, 64 nt, Human; identical to SEQ ID NO: 62806

SEQ ID NO: 63728 - RNA, 64 nt, Human; identical to SEQ ID NO: 62807

SEQ ID NO: 63729 - RNA, 64 nt, Human; identical to SEQ ID NO: 62808

SEQ ID NO: 63730 - RNA, 64 nt, Human; identical to SEQ ID NO: 62809

SEQ ID NO: 63731 - RNA, 63 nt, Human; identical to SEQ ID NO: 13689

SEQ ID NO: 63732 - RNA, 64 nt, Human; identical to SEQ ID NO: 62811

SEQ ID NO: 63733 - RNA, 64 nt, Human; identical to SEQ ID NO: 62812

SEQ ID NO: 63734 - RNA, 64 nt, Human; identical to SEQ ID NO: 62813

SEQ ID NO: 63735 - RNA, 64 nt, Human; identical to SEQ ID NO: 62814

SEQ ID NO: 63736 - RNA, 64 nt, Human; identical to SEQ ID NO: 62815

SEQ ID NO: 63737 - RNA, 64 nt, Human; identical to SEQ ID NO: 62816

SEQ ID NO: 63738 - RNA, 64 nt, Human; identical to SEQ ID NO: 62817

SEQ ID NO: 63739 - RNA, 64 nt, Human; identical to SEQ ID NO: 62818

SEQ ID NO: 63740 - RNA, 57 nt, Human; identical to SEQ ID NO: 13698

SEQ ID NO: 63741 - RNA, 64 nt, Human; identical to SEQ ID NO: 62820

SEQ ID NO: 63742 - RNA, 64 nt, Human; identical to SEQ ID NO: 62821

SEQ ID NO: 63743 - RNA, 64 nt, Human; identical to SEQ ID NO: 62822

SEQ ID NO: 63744 - RNA, 64 nt, Human; identical to SEQ ID NO: 62823

SEQ ID NO: 63745 - RNA, 64 nt, Human; identical to SEQ ID NO: 62824

SEQ ID NO: 63746 - RNA, 64 nt, Human; identical to SEQ ID NO: 62825

SEQ ID NO: 63747 - RNA, 62 nt, Human; identical to SEQ ID NO: 13705

SEQ ID NO: 63748 - RNA, 64 nt, Human; identical to SEQ ID NO: 62827

SEQ ID NO: 63749 - RNA, 64 nt, Human; identical to SEQ ID NO: 62828

SEQ ID NO: 63750 - RNA, 64 nt, Human; identical to SEQ ID NO: 62829

SEQ ID NO: 63751 - RNA, 64 nt, Human; identical to SEQ ID NO: 62830

SEQ ID NO: 63752 - RNA, 64 nt, Human; identical to SEQ ID NO: 62831

SEQ ID NO: 63753 - RNA, 64 nt, Human; identical to SEQ ID NO: 62832

SEQ ID NO: 63754 - RNA, 64 nt, Human; identical to SEQ ID NO: 62833

SEQ ID NO: 63755 - RNA, 64 nt, Human; identical to SEQ ID NO: 62834

SEQ ID NO: 63756 - RNA, 64 nt, Human; identical to SEQ ID NO: 62835

SEQ ID NO: 63757 - RNA, 64 nt, Human; identical to SEQ ID NO: 62836

SEQ ID NO: 63758 - RNA, 64 nt, Human; identical to SEQ ID NO: 62837

SEQ ID NO: 63759 - RNA, 64 nt, Human; identical to SEQ ID NO: 62838

SEQ ID NO: 63760 - RNA, 64 nt, Human; identical to SEQ ID NO: 62839

SEQ ID NO: 63761 - RNA, 64 nt, Human; identical to SEQ ID NO: 62840

SEQ ID NO: 63762 - RNA, 64 nt, Human; identical to SEQ ID NO: 62841

SEQ ID NO: 63763 - RNA, 64 nt, Human; identical to SEQ ID NO: 62842

SEQ ID NO: 63764 - RNA, 58 nt, Human; identical to SEQ ID NO: 13722

SEQ ID NO: 63765 - RNA, 64 nt, Human; identical to SEQ ID NO: 62844

SEQ ID NO: 63766 - RNA, 64 nt, Human; identical to SEQ ID NO: 62845

SEQ ID NO: 63767 - RNA, 64 nt, Human; identical to SEQ ID NO: 62846

SEQ ID NO: 63768 - RNA, 64 nt, Human; identical to SEQ ID NO: 62847

SEQ ID NO: 63769 - RNA, 64 nt, Human; identical to SEQ ID NO: 62848

SEQ ID NO: 63770 - RNA, 64 nt, Human; identical to SEQ ID NO: 62849

SEQ ID NO: 63771 - RNA, 64 nt, Human; identical to SEQ ID NO: 62850

SEQ ID NO: 63772 - RNA, 64 nt, Human; identical to SEQ ID NO: 62851

SEQ ID NO: 63773 - RNA, 64 nt, Human; identical to SEQ ID NO: 62852

SEQ ID NO: 63774 - RNA, 64 nt, Human; identical to SEQ ID NO: 62853

SEQ ID NO: 63775 - RNA, 64 nt, Human; identical to SEQ ID NO: 62854

SEQ ID NO: 63776 - RNA, 64 nt, Human; identical to SEQ ID NO: 62855

SEQ ID NO: 63777 - RNA, 64 nt, Human; identical to SEQ ID NO: 62856

SEQ ID NO: 63778 - RNA, 64 nt, Human; identical to SEQ ID NO: 62857

SEQ ID NO: 63779 - RNA, 64 nt, Human; identical to SEQ ID NO: 62858

SEQ ID NO: 63780 - RNA, 64 nt, Human; identical to SEQ ID NO: 62859

SEQ ID NO: 63781 - RNA, 64 nt, Human; identical to SEQ ID NO: 62860

SEQ ID NO: 63782 - RNA, 64 nt, Human; identical to SEQ ID NO: 62861

SEQ ID NO: 63783 - RNA, 64 nt, Human; identical to SEQ ID NO: 62862

SEQ ID NO: 63784 - RNA, 64 nt, Human; identical to SEQ ID NO: 62863

SEQ ID NO: 63785 - RNA, 64 nt, Human; identical to SEQ ID NO: 62864

SEQ ID NO: 63786 - RNA, 64 nt, Human; identical to SEQ ID NO: 62865

SEQ ID NO: 63787 - RNA, 64 nt, Human; identical to SEQ ID NO: 62866

SEQ ID NO: 63788 - RNA, 64 nt, Human; identical to SEQ ID NO: 62867

SEQ ID NO: 63789 - RNA, 64 nt, Human; identical to SEQ ID NO: 62868

SEQ ID NO: 63790 - RNA, 64 nt, Human; identical to SEQ ID NO: 62869

SEQ ID NO: 63791 - RNA, 64 nt, Human; identical to SEQ ID NO: 62870

SEQ ID NO: 63792 - RNA, 64 nt, Human; identical to SEQ ID NO: 62871

SEQ ID NO: 63793 - RNA, 64 nt, Human; identical to SEQ ID NO: 62872

SEQ ID NO: 63794 - RNA, 64 nt, Human; identical to SEQ ID NO: 62873

SEQ ID NO: 63795 - RNA, 64 nt, Human; identical to SEQ ID NO: 62874

SEQ ID NO: 63796 - RNA, 64 nt, Human; identical to SEQ ID NO: 62875

SEQ ID NO: 63797 - RNA, 64 nt, Human; identical to SEQ ID NO: 62876

SEQ ID NO: 63798 - RNA, 64 nt, Human; identical to SEQ ID NO: 62877

SEQ ID NO: 63799 - RNA, 64 nt, Human; identical to SEQ ID NO: 62878

SEQ ID NO: 63800 - RNA, 64 nt, Human; identical to SEQ ID NO: 62879

SEQ ID NO: 63801 - RNA, 64 nt, Human; identical to SEQ ID NO: 62880

SEQ ID NO: 63802 - RNA, 64 nt, Human; identical to SEQ ID NO: 62881

SEQ ID NO: 63803 - RNA, 64 nt, Human; identical to SEQ ID NO: 62882

SEQ ID NO: 63804 - RNA, 64 nt, Human; identical to SEQ ID NO: 62883

SEQ ID NO: 63805 - RNA, 64 nt, Human; identical to SEQ ID NO: 62884

SEQ ID NO: 63806 - RNA, 64 nt, Human; identical to SEQ ID NO: 62885

SEQ ID NO: 63807 - RNA, 64 nt, Human; identical to SEQ ID NO: 62886

SEQ ID NO: 63808 - RNA, 64 nt, Human; identical to SEQ ID NO: 62887

SEQ ID NO: 63809 - RNA, 64 nt, Human; identical to SEQ ID NO: 62888

SEQ ID NO: 63810 - RNA, 64 nt, Human; identical to SEQ ID NO: 62889

SEQ ID NO: 63811 - RNA, 64 nt, Human; identical to SEQ ID NO: 62890

SEQ ID NO: 63812 - RNA, 64 nt, Human; identical to SEQ ID NO: 62891

SEQ ID NO: 63813 - RNA, 64 nt, Human; identical to SEQ ID NO: 62892

SEQ ID NO: 63814 - RNA, 64 nt, Human; identical to SEQ ID NO: 62893

SEQ ID NO: 63815 - RNA, 64 nt, Human; identical to SEQ ID NO: 62894

SEQ ID NO: 63816 - RNA, 57 nt, Human; identical to SEQ ID NO: 13774

SEQ ID NO: 63817 - RNA, 64 nt, Human; identical to SEQ ID NO: 62896

SEQ ID NO: 63818 - RNA, 64 nt, Human; identical to SEQ ID NO: 62897

SEQ ID NO: 63819 - RNA, 64 nt, Human; identical to SEQ ID NO: 62898

SEQ ID NO: 63820 - RNA, 64 nt, Human; identical to SEQ ID NO: 62899

SEQ ID NO: 63821 - RNA, 64 nt, Human; identical to SEQ ID NO: 62900

SEQ ID NO: 63822 - RNA, 64 nt, Human; identical to SEQ ID NO: 62901

SEQ ID NO: 63823 - RNA, 64 nt, Human; identical to SEQ ID NO: 62902

SEQ ID NO: 63824 - RNA, 64 nt, Human; identical to SEQ ID NO: 62903

SEQ ID NO: 63825 - RNA, 64 nt, Human; identical to SEQ ID NO: 62904

SEQ ID NO: 63826 - RNA, 64 nt, Human; identical to SEQ ID NO: 62905

SEQ ID NO: 63827 - RNA, 64 nt, Human; identical to SEQ ID NO: 62906

SEQ ID NO: 63828 - RNA, 64 nt, Human; identical to SEQ ID NO: 62907

SEQ ID NO: 63829 - RNA, 64 nt, Human; identical to SEQ ID NO: 62908

SEQ ID NO: 63830 - RNA, 64 nt, Human; identical to SEQ ID NO: 62909

SEQ ID NO: 63831 - RNA, 64 nt, Human; identical to SEQ ID NO: 62910

SEQ ID NO: 63832 - RNA, 64 nt, Human; identical to SEQ ID NO: 62911

SEQ ID NO: 63833 - RNA, 64 nt, Human; identical to SEQ ID NO: 62912

SEQ ID NO: 63834 - RNA, 64 nt, Human; identical to SEQ ID NO: 62913

SEQ ID NO: 63835 - RNA, 64 nt, Human; identical to SEQ ID NO: 62914

SEQ ID NO: 63836 - RNA, 64 nt, Human; identical to SEQ ID NO: 62915

SEQ ID NO: 63837 - RNA, 64 nt, Human; identical to SEQ ID NO: 62916

SEQ ID NO: 63838 - RNA, 64 nt, Human; identical to SEQ ID NO: 62917

SEQ ID NO: 63839 - RNA, 64 nt, Human; identical to SEQ ID NO: 62918

SEQ ID NO: 63840 - RNA, 64 nt, Human; identical to SEQ ID NO: 62919

SEQ ID NO: 63841 - RNA, 64 nt, Human; identical to SEQ ID NO: 62920

SEQ ID NO: 63842 - RNA, 64 nt, Human; identical to SEQ ID NO: 62921

SEQ ID NO: 63843 - RNA, 64 nt, Human; identical to SEQ ID NO: 62922

SEQ ID NO: 63844 - RNA, 64 nt, Human; identical to SEQ ID NO: 62923

SEQ ID NO: 63845 - RNA, 64 nt, Human; identical to SEQ ID NO: 62924

SEQ ID NO: 63846 - RNA, 64 nt, Human; identical to SEQ ID NO: 62925

SEQ ID NO: 63847 - RNA, 64 nt, Human; identical to SEQ ID NO: 62926

SEQ ID NO: 63848 - RNA, 64 nt, Human; identical to SEQ ID NO: 62927

SEQ ID NO: 63849 - RNA, 64 nt, Human; identical to SEQ ID NO: 62928

SEQ ID NO: 63850 - RNA, 64 nt, Human; identical to SEQ ID NO: 62929

SEQ ID NO: 63851 - RNA, 64 nt, Human; identical to SEQ ID NO: 62930

SEQ ID NO: 63852 - RNA, 64 nt, Human; identical to SEQ ID NO: 62931

SEQ ID NO: 63853 - RNA, 64 nt, Human; identical to SEQ ID NO: 62932

SEQ ID NO: 63854 - RNA, 64 nt, Human; identical to SEQ ID NO: 62933

SEQ ID NO: 63855 - RNA, 64 nt, Human; identical to SEQ ID NO: 62934

SEQ ID NO: 63856 - RNA, 64 nt, Human; identical to SEQ ID NO: 62935

SEQ ID NO: 63857 - RNA, 64 nt, Human; identical to SEQ ID NO: 62936

SEQ ID NO: 63858 - RNA, 64 nt, Human; identical to SEQ ID NO: 62937

SEQ ID NO: 63859 - RNA, 64 nt, Human; identical to SEQ ID NO: 62938

SEQ ID NO: 63860 - RNA, 64 nt, Human; identical to SEQ ID NO: 62939

SEQ ID NO: 63861 - RNA, 64 nt, Human; identical to SEQ ID NO: 62940

SEQ ID NO: 63862 - RNA, 64 nt, Human; identical to SEQ ID NO: 62941

SEQ ID NO: 63863 - RNA, 64 nt, Human; identical to SEQ ID NO: 62942

SEQ ID NO: 63864 - RNA, 64 nt, Human; identical to SEQ ID NO: 62943

SEQ ID NO: 63865 - RNA, 64 nt, Human; identical to SEQ ID NO: 62944

SEQ ID NO: 63866 - RNA, 64 nt, Human; identical to SEQ ID NO: 62945

SEQ ID NO: 63867 - RNA, 64 nt, Human; identical to SEQ ID NO: 62946

SEQ ID NO: 63868 - RNA, 64 nt, Human; identical to SEQ ID NO: 62947

SEQ ID NO: 63869 - RNA, 64 nt, Human; identical to SEQ ID NO: 62948

SEQ ID NO: 63870 - RNA, 50 nt, Human; identical to SEQ ID NO: 13828

SEQ ID NO: 63871 - RNA, 64 nt, Human; identical to SEQ ID NO: 62950

SEQ ID NO: 63872 - RNA, 64 nt, Human; identical to SEQ ID NO: 62951

SEQ ID NO: 63873 - RNA, 64 nt, Human; identical to SEQ ID NO: 62952

SEQ ID NO: 63874 - RNA, 64 nt, Human; identical to SEQ ID NO: 62953

SEQ ID NO: 63875 - RNA, 64 nt, Human; identical to SEQ ID NO: 62954

SEQ ID NO: 63876 - RNA, 64 nt, Human; identical to SEQ ID NO: 62955

SEQ ID NO: 63877 - RNA, 64 nt, Human; identical to SEQ ID NO: 62956

SEQ ID NO: 63878 - RNA, 64 nt, Human; identical to SEQ ID NO: 62957

SEQ ID NO: 63879 - RNA, 64 nt, Human; identical to SEQ ID NO: 62958

SEQ ID NO: 63880 - RNA, 64 nt, Human; identical to SEQ ID NO: 62959

SEQ ID NO: 63881 - RNA, 64 nt, Human; identical to SEQ ID NO: 62960

SEQ ID NO: 63882 - RNA, 52 nt, Human; identical to SEQ ID NO: 13840

SEQ ID NO: 63883 - RNA, 64 nt, Human; identical to SEQ ID NO: 62962

SEQ ID NO: 63884 - RNA, 64 nt, Human; identical to SEQ ID NO: 62963

SEQ ID NO: 63885 - RNA, 64 nt, Human; identical to SEQ ID NO: 62964

SEQ ID NO: 63886 - RNA, 64 nt, Human; identical to SEQ ID NO: 62965

SEQ ID NO: 63887 - RNA, 64 nt, Human; identical to SEQ ID NO: 62966

SEQ ID NO: 63888 - RNA, 64 nt, Human; identical to SEQ ID NO: 62967

SEQ ID NO: 63889 - RNA, 64 nt, Human; identical to SEQ ID NO: 62968

SEQ ID NO: 63890 - RNA, 64 nt, Human; identical to SEQ ID NO: 62969

SEQ ID NO: 63891 - RNA, 64 nt, Human; identical to SEQ ID NO: 62970

SEQ ID NO: 63892 - RNA, 64 nt, Human; identical to SEQ ID NO: 62971

SEQ ID NO: 63893 - RNA, 64 nt, Human; identical to SEQ ID NO: 62972

SEQ ID NO: 63894 - RNA, 64 nt, Human; identical to SEQ ID NO: 62973

SEQ ID NO: 63895 - RNA, 64 nt, Human; identical to SEQ ID NO: 62974

SEQ ID NO: 63896 - RNA, 64 nt, Human; identical to SEQ ID NO: 62975

SEQ ID NO: 63897 - RNA, 64 nt, Human; identical to SEQ ID NO: 62976

SEQ ID NO: 63898 - RNA, 64 nt, Human; identical to SEQ ID NO: 62977

SEQ ID NO: 63899 - RNA, 64 nt, Human; identical to SEQ ID NO: 62978

SEQ ID NO: 63900 - RNA, 64 nt, Human; identical to SEQ ID NO: 62979

SEQ ID NO: 63901 - RNA, 63 nt, Human; identical to SEQ ID NO: 13859

SEQ ID NO: 63902 - RNA, 64 nt, Human; identical to SEQ ID NO: 62979

SEQ ID NO: 63903 - RNA, 64 nt, Human; identical to SEQ ID NO: 62982

SEQ ID NO: 63904 - RNA, 64 nt, Human; identical to SEQ ID NO: 62983

SEQ ID NO: 63905 - RNA, 64 nt, Human; identical to SEQ ID NO: 62984

SEQ ID NO: 63906 - RNA, 64 nt, Human; identical to SEQ ID NO: 62979

SEQ ID NO: 63907 - RNA, 64 nt, Human; identical to SEQ ID NO: 62986

SEQ ID NO: 63908 - RNA, 64 nt, Human; identical to SEQ ID NO: 62987

SEQ ID NO: 63909 - RNA, 64 nt, Human; identical to SEQ ID NO: 62988

SEQ ID NO: 63910 - RNA, 64 nt, Human; identical to SEQ ID NO: 62989

SEQ ID NO: 63911 - RNA, 64 nt, Human; identical to SEQ ID NO: 62990

SEQ ID NO: 63912 - RNA, 64 nt, Human; identical to SEQ ID NO: 62991

SEQ ID NO: 63913 - RNA, 64 nt, Human; identical to SEQ ID NO: 62992

SEQ ID NO: 63914 - RNA, 64 nt, Human; identical to SEQ ID NO: 62993

SEQ ID NO: 63915 - RNA, 64 nt, Human; identical to SEQ ID NO: 62994

SEQ ID NO: 63916 - RNA, 64 nt, Human; identical to SEQ ID NO: 62995

SEQ ID NO: 63917 - RNA, 64 nt, Human; identical to SEQ ID NO: 62996

SEQ ID NO: 63918 - RNA, 64 nt, Human; identical to SEQ ID NO: 62997

SEQ ID NO: 63919 - RNA, 51 nt, Human; identical to SEQ ID NO: 13877

SEQ ID NO: 63920 - RNA, 64 nt, Human; identical to SEQ ID NO: 62999

SEQ ID NO: 63921 - RNA, 64 nt, Human; identical to SEQ ID NO: 63000

SEQ ID NO: 63922 - RNA, 64 nt, Human; identical to SEQ ID NO: 63001

SEQ ID NO: 63923 - RNA, 64 nt, Human; identical to SEQ ID NO: 63002

SEQ ID NO: 63924 - RNA, 64 nt, Human; identical to SEQ ID NO: 63003

SEQ ID NO: 63925 - RNA, 63 nt, Human; identical to SEQ ID NO: 13883

SEQ ID NO: 63926 - RNA, 64 nt, Human; identical to SEQ ID NO: 63005

SEQ ID NO: 63927 - RNA, 64 nt, Human; identical to SEQ ID NO: 63006

SEQ ID NO: 63928 - RNA, 63 nt, Human; identical to SEQ ID NO: 13886

SEQ ID NO: 63929 - RNA, 64 nt, Human; identical to SEQ ID NO: 63008

SEQ ID NO: 63930 - RNA, 63 nt, Human; identical to SEQ ID NO: 13888

SEQ ID NO: 63931 - RNA, 64 nt, Human; identical to SEQ ID NO: 63010

SEQ ID NO: 63932 - RNA, 64 nt, Human; identical to SEQ ID NO: 63011

SEQ ID NO: 63933 - RNA, 53 nt, Human; identical to SEQ ID NO: 13891

SEQ ID NO: 63934 - RNA, 64 nt, Human; identical to SEQ ID NO: 63013

SEQ ID NO: 63935 - RNA, 64 nt, Human; identical to SEQ ID NO: 63014

SEQ ID NO: 63936 - RNA, 64 nt, Human; identical to SEQ ID NO: 63015

SEQ ID NO: 63937 - RNA, 64 nt, Human; identical to SEQ ID NO: 63016

SEQ ID NO: 63938 - RNA, 64 nt, Human; identical to SEQ ID NO: 63017

SEQ ID NO: 63939 - RNA, 64 nt, Human; identical to SEQ ID NO: 63018

SEQ ID NO: 63940 - RNA, 64 nt, Human; identical to SEQ ID NO: 63019

SEQ ID NO: 63941 - RNA, 64 nt, Human; identical to SEQ ID NO: 63020

SEQ ID NO: 63942 - RNA, 64 nt, Human; identical to SEQ ID NO: 63021

SEQ ID NO: 63943 - RNA, 64 nt, Human; identical to SEQ ID NO: 63022

SEQ ID NO: 63944 - RNA, 64 nt, Human; identical to SEQ ID NO: 63023

SEQ ID NO: 63945 - RNA, 64 nt, Human; identical to SEQ ID NO: 63024

SEQ ID NO: 63946 - RNA, 64 nt, Human; identical to SEQ ID NO: 63025

SEQ ID NO: 63947 - RNA, 64 nt, Human; identical to SEQ ID NO: 63026

SEQ ID NO: 63948 - RNA, 64 nt, Human; identical to SEQ ID NO: 63027

SEQ ID NO: 63949 - RNA, 64 nt, Human; identical to SEQ ID NO: 63028

SEQ ID NO: 63950 - RNA, 64 nt, Human; identical to SEQ ID NO: 63029

SEQ ID NO: 63951 - RNA, 64 nt, Human; identical to SEQ ID NO: 63030

SEQ ID NO: 63952 - RNA, 64 nt, Human; identical to SEQ ID NO: 63031

SEQ ID NO: 63953 - RNA, 64 nt, Human; identical to SEQ ID NO: 63032

SEQ ID NO: 63954 - RNA, 64 nt, Human; identical to SEQ ID NO: 63033

SEQ ID NO: 63955 - RNA, 64 nt, Human; identical to SEQ ID NO: 63034

SEQ ID NO: 63956 - RNA, 64 nt, Human; identical to SEQ ID NO: 63035

SEQ ID NO: 63957 - RNA, 64 nt, Human; identical to SEQ ID NO: 63036

SEQ ID NO: 63958 - RNA, 64 nt, Human; identical to SEQ ID NO: 63037

SEQ ID NO: 63959 - RNA, 64 nt, Human; identical to SEQ ID NO: 63038

SEQ ID NO: 63960 - RNA, 64 nt, Human; identical to SEQ ID NO: 63039

SEQ ID NO: 63961 - RNA, 64 nt, Human; identical to SEQ ID NO: 63040

SEQ ID NO: 63962 - RNA, 64 nt, Human; identical to SEQ ID NO: 63041

SEQ ID NO: 63963 - RNA, 64 nt, Human; identical to SEQ ID NO: 63042

SEQ ID NO: 63964 - RNA, 64 nt, Human; identical to SEQ ID NO: 63043

SEQ ID NO: 63965 - RNA, 64 nt, Human; identical to SEQ ID NO: 63044

SEQ ID NO: 63966 - RNA, 64 nt, Human; identical to SEQ ID NO: 63045

SEQ ID NO: 63967 - RNA, 61 nt, Human; identical to SEQ ID NO: 13925

SEQ ID NO: 63968 - RNA, 64 nt, Human; identical to SEQ ID NO: 63047

SEQ ID NO: 63969 - RNA, 64 nt, Human; identical to SEQ ID NO: 63048

SEQ ID NO: 63970 - RNA, 64 nt, Human; identical to SEQ ID NO: 63049

SEQ ID NO: 63971 - RNA, 64 nt, Human; identical to SEQ ID NO: 63050

SEQ ID NO: 63972 - RNA, 64 nt, Human; identical to SEQ ID NO: 63051

SEQ ID NO: 63973 - RNA, 64 nt, Human; identical to SEQ ID NO: 63052

SEQ ID NO: 63974 - RNA, 59 nt, Human; identical to SEQ ID NO: 13932

SEQ ID NO: 63975 - RNA, 64 nt, Human; identical to SEQ ID NO: 63054

SEQ ID NO: 63976 - RNA, 64 nt, Human; identical to SEQ ID NO: 63055

SEQ ID NO: 63977 - RNA, 64 nt, Human; identical to SEQ ID NO: 63056

SEQ ID NO: 63978 - RNA, 64 nt, Human; identical to SEQ ID NO: 63057

SEQ ID NO: 63979 - RNA, 64 nt, Human; identical to SEQ ID NO: 63058

SEQ ID NO: 63980 - RNA, 64 nt, Human; identical to SEQ ID NO: 63059

SEQ ID NO: 63981 - RNA, 64 nt, Human; identical to SEQ ID NO: 63060

SEQ ID NO: 63982 - RNA, 64 nt, Human; identical to SEQ ID NO: 63061

SEQ ID NO: 63983 - RNA, 64 nt, Human; identical to SEQ ID NO: 63062

SEQ ID NO: 63984 - RNA, 64 nt, Human; identical to SEQ ID NO: 63063

SEQ ID NO: 63985 - RNA, 64 nt, Human; identical to SEQ ID NO: 63064

SEQ ID NO: 63986 - RNA, 64 nt, Human; identical to SEQ ID NO: 63065

SEQ ID NO: 63987 - RNA, 64 nt, Human; identical to SEQ ID NO: 63066

SEQ ID NO: 63988 - RNA, 64 nt, Human; identical to SEQ ID NO: 63067

SEQ ID NO: 63989 - RNA, 64 nt, Human; identical to SEQ ID NO: 63068

SEQ ID NO: 63990 - RNA, 64 nt, Human; identical to SEQ ID NO: 63069

SEQ ID NO: 63991 - RNA, 64 nt, Human; identical to SEQ ID NO: 63070

SEQ ID NO: 63992 - RNA, 64 nt, Human; identical to SEQ ID NO: 63071

SEQ ID NO: 63993 - RNA, 64 nt, Human; identical to SEQ ID NO: 63072

SEQ ID NO: 63994 - RNA, 64 nt, Human; identical to SEQ ID NO: 63073

SEQ ID NO: 63995 - RNA, 64 nt, Human; identical to SEQ ID NO: 63074

SEQ ID NO: 63996 - RNA, 64 nt, Human; identical to SEQ ID NO: 63075

SEQ ID NO: 63997 - RNA, 64 nt, Human; identical to SEQ ID NO: 63076

SEQ ID NO: 63998 - RNA, 64 nt, Human; identical to SEQ ID NO: 63077

SEQ ID NO: 63999 - RNA, 64 nt, Human; identical to SEQ ID NO: 63078

SEQ ID NO: 64000 - RNA, 64 nt, Human; identical to SEQ ID NO: 63079

SEQ ID NO: 64001 - RNA, 64 nt, Human; identical to SEQ ID NO: 63080

SEQ ID NO: 64002 - RNA, 64 nt, Human; identical to SEQ ID NO: 63081

SEQ ID NO: 64003 - RNA, 64 nt, Human; identical to SEQ ID NO: 63082

SEQ ID NO: 64004 - RNA, 62 nt, Human; identical to SEQ ID NO: 13962

SEQ ID NO: 64005 - RNA, 64 nt, Human; identical to SEQ ID NO: 63084

SEQ ID NO: 64006 - RNA, 64 nt, Human; identical to SEQ ID NO: 63085

SEQ ID NO: 64007 - RNA, 64 nt, Human; identical to SEQ ID NO: 63086

SEQ ID NO: 64008 - RNA, 64 nt, Human; identical to SEQ ID NO: 63087

SEQ ID NO: 64009 - RNA, 64 nt, Human; identical to SEQ ID NO: 63088

SEQ ID NO: 64010 - RNA, 64 nt, Human; identical to SEQ ID NO: 63089

SEQ ID NO: 64011 - RNA, 64 nt, Human; identical to SEQ ID NO: 63090

SEQ ID NO: 64012 - RNA, 64 nt, Human; identical to SEQ ID NO: 63091

SEQ ID NO: 64013 - RNA, 64 nt, Human; identical to SEQ ID NO: 63092

SEQ ID NO: 64014 - RNA, 64 nt, Human; identical to SEQ ID NO: 63093

SEQ ID NO: 64015 - RNA, 64 nt, Human; identical to SEQ ID NO: 63094

SEQ ID NO: 64016 - RNA, 64 nt, Human; identical to SEQ ID NO: 63095

SEQ ID NO: 64017 - RNA, 50 nt, Human; identical to SEQ ID NO: 13975

SEQ ID NO: 64018 - RNA, 64 nt, Human; identical to SEQ ID NO: 63097

SEQ ID NO: 64019 - RNA, 64 nt, Human; identical to SEQ ID NO: 63098

SEQ ID NO: 64020 - RNA, 64 nt, Human; identical to SEQ ID NO: 63099

SEQ ID NO: 64021 - RNA, 64 nt, Human; identical to SEQ ID NO: 63100

SEQ ID NO: 64022 - RNA, 64 nt, Human; identical to SEQ ID NO: 63101

SEQ ID NO: 64023 - RNA, 64 nt, Human; identical to SEQ ID NO: 63102

SEQ ID NO: 64024 - RNA, 64 nt, Human; identical to SEQ ID NO: 63103

SEQ ID NO: 64025 - RNA, 64 nt, Human; identical to SEQ ID NO: 63104

SEQ ID NO: 64026 - RNA, 64 nt, Human; identical to SEQ ID NO: 63105

SEQ ID NO: 64027 - RNA, 64 nt, Human; identical to SEQ ID NO: 63106

SEQ ID NO: 64028 - RNA, 64 nt, Human; identical to SEQ ID NO: 63107

SEQ ID NO: 64029 - RNA, 64 nt, Human; identical to SEQ ID NO: 63108

SEQ ID NO: 64030 - RNA, 64 nt, Human; identical to SEQ ID NO: 63109

SEQ ID NO: 64031 - RNA, 64 nt, Human; identical to SEQ ID NO: 63110

SEQ ID NO: 64032 - RNA, 64 nt, Human; identical to SEQ ID NO: 63111

SEQ ID NO: 64033 - RNA, 64 nt, Human; identical to SEQ ID NO: 63112

SEQ ID NO: 64034 - RNA, 64 nt, Human; identical to SEQ ID NO: 63113

SEQ ID NO: 64035 - RNA, 64 nt, Human; identical to SEQ ID NO: 63114

SEQ ID NO: 64036 - RNA, 64 nt, Human; identical to SEQ ID NO: 63115

SEQ ID NO: 64037 - RNA, 64 nt, Human; identical to SEQ ID NO: 63116

SEQ ID NO: 64038 - RNA, 64 nt, Human; identical to SEQ ID NO: 63117

SEQ ID NO: 64039 - RNA, 64 nt, Human; identical to SEQ ID NO: 63118

SEQ ID NO: 64040 - RNA, 64 nt, Human; identical to SEQ ID NO: 63119

SEQ ID NO: 64041 - RNA, 64 nt, Human; identical to SEQ ID NO: 63120

SEQ ID NO: 64042 - RNA, 64 nt, Human; identical to SEQ ID NO: 63121

SEQ ID NO: 64043 - RNA, 64 nt, Human; identical to SEQ ID NO: 63122

SEQ ID NO: 64044 - RNA, 64 nt, Human; identical to SEQ ID NO: 63123

SEQ ID NO: 64045 - RNA, 64 nt, Human; identical to SEQ ID NO: 63124

SEQ ID NO: 64046 - RNA, 64 nt, Human; identical to SEQ ID NO: 63125

SEQ ID NO: 64047 - RNA, 64 nt, Human; identical to SEQ ID NO: 63126

SEQ ID NO: 64048 - RNA, 64 nt, Human; identical to SEQ ID NO: 63127

SEQ ID NO: 64049 - RNA, 64 nt, Human; identical to SEQ ID NO: 63128

SEQ ID NO: 64050 - RNA, 64 nt, Human; identical to SEQ ID NO: 63129

SEQ ID NO: 64051 - RNA, 64 nt, Human; identical to SEQ ID NO: 63130

SEQ ID NO: 64052 - RNA, 64 nt, Human; identical to SEQ ID NO: 63131

SEQ ID NO: 64053 - RNA, 64 nt, Human; identical to SEQ ID NO: 63132

SEQ ID NO: 64054 - RNA, 56 nt, Human; identical to SEQ ID NO: 14012

SEQ ID NO: 64055 - RNA, 64 nt, Human; identical to SEQ ID NO: 63134

SEQ ID NO: 64056 - RNA, 64 nt, Human; identical to SEQ ID NO: 63135

SEQ ID NO: 64057 - RNA, 64 nt, Human; identical to SEQ ID NO: 63136

SEQ ID NO: 64058 - RNA, 64 nt, Human; identical to SEQ ID NO: 63137

SEQ ID NO: 64059 - RNA, 64 nt, Human; identical to SEQ ID NO: 63138

SEQ ID NO: 64060 - RNA, 64 nt, Human; identical to SEQ ID NO: 63139

SEQ ID NO: 64061 - RNA, 64 nt, Human; identical to SEQ ID NO: 63140

SEQ ID NO: 64062 - RNA, 64 nt, Human; identical to SEQ ID NO: 63141

SEQ ID NO: 64063 - RNA, 64 nt, Human
ccccggcagcagccccaugauggcugaauccgaaauccucgauggguccagcuugaugucuuug

SEQ ID NO: 64064 - RNA, 64 nt, Human
uuuaaaggauuuauuuuagaauacaaucuaugcaauccucgaacucagugugcuuuucccugac

SEQ ID NO: 64065 - RNA, 64 nt, Human
uauauguuucuguuucugguaaauaccauauaugauccucgaaaugauaauaucuccagaauau

SEQ ID NO: 64066 - RNA, 64 nt, Human
aauuuaucauuuaguuauaaaaauauauagcgacauccucgaggcccuagcauuucuccuugga

SEQ ID NO: 64067 - RNA, 64 nt, Human
agccacauaacguguaggaaguccuuuaucacuuauccucgauccauaagcauaucuugcagag

SEQ ID NO: 64068 - RNA, 57 nt, Human
uuguagaagaaccuuauuaaaaaaaaaauccucgaaagaacaaaucaugaacuaucu

SEQ ID NO: 64069 - RNA, 64 nt, Human
ugcugacgugacugacccgagaaccucacagagaauccucgaggugcuuccuggcaggagagca

SEQ ID NO: 64070 - RNA, 64 nt, Human
gcugcugcuccagagcguaccguggcccagacugauccucgaggccuccugccguggcuggggu

SEQ ID NO: 64071 - RNA, 64 nt, Human
agggaggcagccccacucccagcaagcagaagugauccucgaggguccugccccuguuggccau

SEQ ID NO: 64072 - RNA, 64 nt, Human
auucguuuugcaguugaaaagagcaggcaaaagaauccucgaagcuuauguauccagccacaga

SEQ ID NO: 64073 - RNA, 64 nt, Human
agucagucagguuuuaauuuauuccaggaggggcauccucgacaucuuauguagaugauccaca

SEQ ID NO: 64074 - RNA, 64 nt, Human
gaagccuccggcggcccaggauucuaaggaugcaauccucgaggaaaauuagucgauucucaga

SEQ ID NO: 64075 - RNA, 64 nt, Human
gaggggcgacaguagugagcgccugagccgaacaauccucgaacuaaaagccuucccuugccca

SEQ ID NO: 64076 - RNA, 64 nt, Human
cugaaacagccuucucuccugcccuguuuauuucauccucgaugggaauucuugcuagguaagc

SEQ ID NO: 64077 - RNA, 64 nt, Human
auucaugacaggccugauaucacucauccuagacauccucgagaggcagggcccaauccuucca

SEQ ID NO: 64078 - RNA, 64 nt, Human
ccuacaagaguuuaccacacuagauguucugugaauccucgagucaguuccauugagaggggcc

SEQ ID NO: 64079 - RNA, 64 nt, Human
ggccaccauccucaaucuggagcgggugaccgagauccucgauuacuggggacccaauuccggc

SEQ ID NO: 64080 - RNA, 53 nt, Human
aaccccaacaaaguucuuaaaauauccucgagagagcugcuaucauguauuau

SEQ ID NO: 64081 - RNA, 64 nt, Human
cuuucaauguaccuuccuucaccucgucguauauauccucgauaaguauuaaaacaguauuuga

SEQ ID NO: 64082 - RNA, 64 nt, Human
uuuaaugacuccaauaauguguguguuuauaaccauccucgaaagugaaauguccuuuucuuug

SEQ ID NO: 64083 - RNA, 64 nt, Human
ccaagggagacuccggcaaccuucagcaacauauauccucgaccagaugcagugcuauaagaac

SEQ ID NO: 64084 - RNA, 64 nt, Human
ugaguggaaucugcaguccagugccuggaacuaaauccucgacugcugcuguuaaaaaacaugc

SEQ ID NO: 64085 - RNA, 64 nt, Human
cugcuucgccggacaaugucgaaguccagucugugccggggaaggcacugguuaggaaggaugu

SEQ ID NO: 64086 - RNA, 64 nt, Human
cagcucuccccgaaaggucuugaccugaaugauggccggggaagccugcgugugccccuuucag

SEQ ID NO: 64087 - RNA, 64 nt, Human
aaccacagggccagagggagcuggaacccgaggggccggggaagcugccagcccagaacacccc

SEQ ID NO: 64088 - RNA, 64 nt, Human
ucggcuuggaaaucaacgugguuguccccgccaggccggggaagguuggagcagcccccaggga

SEQ ID NO: 64089 - RNA, 64 nt, Human
ccacagcuguaagcagcucucugccagccacauggccggggaccgaaaaacucccgugggagau

SEQ ID NO: 64090 - RNA, 64 nt, Human
aagagggacgagggccagacugaagcagcacaaggccggggacacccaugccaagcagugggag

SEQ ID NO: 64091 - RNA, 64 nt, Human
ggccucagaggcuguaggguccuuggguuacagagccggggagaacgaaguucugugacccagg

SEQ ID NO: 64092 - RNA, 64 nt, Human
gcugcguggagaaggaagcggcuaaaagguuugggccggggaguuccccauucguucuccgggg

SEQ ID NO: 64093 - RNA, 64 nt, Human
gcuacugggaggcugaggcgggagaaucgcuugagccggggaggcggagguugcagugaggcga

SEQ ID NO: 64094 - RNA, 64 nt, Human
cuuuggaugguccgggcgucaagagcaggggugggccggggagggguccuuugcggugagcuau

SEQ ID NO: 64095 - RNA, 64 nt, Human
ucuucaaaugaauuuaauauugugagauggaacugccggggauuaaaaagacuacccaaaagau

SEQ ID NO: 64096 - RNA, 64 nt, Human
cccuggcagcgguccugggcuagucggcugccuggccggggaaccugcaggcucccacaggaag

SEQ ID NO: 64097 - RNA, 64 nt, Human
cagccggccuugcgaagccuccucagcucggggggccggggacccagugagccgagaggcccuc

SEQ ID NO: 64098 - RNA, 64 nt, Human
uuggguccugggaagcacugggaaagaagggagagccggggaggauagggcaggagucuggcca

SEQ ID NO: 64099 - RNA, 64 nt, Human
cgguggcccagcgagacggccgccucgagagacggccggggaagaagcucgcuaccuguucucu

SEQ ID NO: 64100 - RNA, 64 nt, Human
uugccacauaccaaaucugggugaaaggaaaggggccggggacaggaggguguccacauauguu

SEQ ID NO: 64101 - RNA, 64 nt, Human
cugccauccgaccaaggucuccugugcugaaguugccggggacaggcagggaaaagggguuggg

SEQ ID NO: 64102 - RNA, 51 nt, Human
ccggcugcuugccccgaugaagccggggacacuccucugcccagcaaggag

SEQ ID NO: 64103 - RNA, 64 nt, Human
cuggcgggcgggcugcgcggaggcucgggagcuggccggggaggggcggauggaggggccuggg

SEQ ID NO: 64104 - RNA, 64 nt, Human
cggagacaccagcgcuggcuucccgggcccgcgggccggggagggaagccucggggcugcgggg

SEQ ID NO: 64105 - RNA, 57 nt, Human
aggccugcggcugcagguagcgcgagggccggggagggggcagccacgcggccgagg

SEQ ID NO: 64106 - RNA, 64 nt, Human
ucauuaggcacaugaccgaugcagggaaggccaugccggggaagcucuuccugcagguauuuuc

SEQ ID NO: 64107 - RNA, 64 nt, Human
aaggaccagagaaagccaggcuggaucgucacaugccggggagcaauguggauggccuggggac

SEQ ID NO: 64108 - RNA, 64 nt, Human
aaggagagggagggggaggauagagcccaucccagccggggagggggagcccucuguacauuug

SEQ ID NO: 64109 - RNA, 59 nt, Human
ucccguuccugggggcguagaggggccgggccggggacgaggccuccugcggacaccag

SEQ ID NO: 64110 - RNA, 64 nt, Human
gacaccagcuccucucuccgccgucaccggggaggccggggauccuugcagggcuucuggggcg

SEQ ID NO: 64111 - RNA, 64 nt, Human
ccagcgccuccagguagaccgcccguccgcccgcgccggggacccucuccaggccgcggggccg

SEQ ID NO: 64112 - RNA, 64 nt, Human
uguggucagcggccuggggacggagcacugugcagccggggagcugaggggcagggccguagac

SEQ ID NO: 64113 - RNA, 64 nt, Human
ccccucccgccccuucccacucaccccggcagacgccggggacagaggccugcccgggcgcggc

SEQ ID NO: 64114 - RNA, 64 nt, Human
aagaaaggcagcccauuuuaccauugccagccaggccggggacacaggagccggugugugcacu

SEQ ID NO: 64115 - RNA, 61 nt, Human
aggagucugaccacaacugagggcugguggggccggggaccuggagccccauggacacaca

SEQ ID NO: 64116 - RNA, 64 nt, Human
aucaagaauggggaucacagagacauuccuccgagccggggaguuucuuuccugccuucuucuu

SEQ ID NO: 64117 - RNA, 64 nt, Human
ugguccuucaccacuuccuguuggcccuggccuggccggggaagguggcagcggcaccggacug

SEQ ID NO: 64118 - RNA, 64 nt, Human
uuccgccuggggaguguuggauccacaucccggugccggggagggaagcccaacauccccuugu

SEQ ID NO: 64119 - RNA, 64 nt, Human
ccaggagugagaccggccagaugaggcuggccaagccggggagcugcucucucaugaaacaaga

SEQ ID NO: 64120 - RNA, 64 nt, Human
ccaacccccgaccugggguagggaggaagagggugccggggaagggaguccgcccuguccaggc

SEQ ID NO: 64121 - RNA, 64 nt, Human
ggcugauggagaacacagaggacuggcggccgcggccggggacaggccagucgcguuccuuccg

SEQ ID NO: 64122 - RNA, 64 nt, Human
agcgaucagccauggcgacacuaaaggaggaggagccggggacucccaggcuggagagcacugc

SEQ ID NO: 64123 - RNA, 64 nt, Human
uuuggacccgcgcucccaucccccaccuucccgggccggggacccacucugcccagccggaggg

SEQ ID NO: 64124 - RNA, 64 nt, Human
cugaugaauauagggcccagauggaccaaguggggccggggagggaugaauaaacacccuaccc

SEQ ID NO: 64125 - RNA, 64 nt, Human
ccuccuucccuaccaggcugugagcaaaguggccgccggggaacgggugguccgaagaccuuca

SEQ ID NO: 64126 - RNA, 53 nt, Human
gagacaugcccaggaccuagcaagccggggaccagccaccaguggcggccagg

SEQ ID NO: 64127 - RNA, 64 nt, Human
cuguccccaccccaauucccuuacaaguaauggagccggggauggaaauaaaugacguccaagg

SEQ ID NO: 64128 - RNA, 64 nt, Human
ugucacgugucccagaugcaguauucggcagccagccggggagggcuaccuccuccuccucacc

SEQ ID NO: 64129 - RNA, 64 nt, Human
ccugaauaaguaacugcgacccgugggaggagaugccggggaccugggccgcgcugccaggacc

SEQ ID NO: 64130 - RNA, 64 nt, Human
agggggcguggcugcgucccgggggccgagggcggccggggagggcgggccuuggccccgagug

SEQ ID NO: 64131 - RNA, 64 nt, Human
acuuucgggaggguggauccacugugcaggaguggccggggaagcuggcagcacucagugaggc

SEQ ID NO: 64132 - RNA, 64 nt, Human
cagauggcaaaaaucaagcaaacccuucuagacagccggggaguguuccucgacauguuucucc

SEQ ID NO: 64133 - RNA, 64 nt, Human
caugucuccauuccugcucaagcgugugugcugggccggggagucccugucucucacagcaucu

SEQ ID NO: 64134 - RNA, 64 nt, Human
uggcaugccguaagugugugguggguagacugcugccggggaaucguacuucuuauuuaguaau

SEQ ID NO: 64135 - RNA, 64 nt, Human
ggcccagggguccccuggcaggggaaacucuggugccggggagggcacgaggcucuagaaaugc

SEQ ID NO: 64136 - RNA, 64 nt, Human
ggguggagcccagugagacugugggugugugcaggccggggaguauuaaagguggugauuuuug

SEQ ID NO: 64137 - RNA, 64 nt, Human
ugcacccccaccccgucuggggccugcccucccggccggggagccuccaggcacacacccgcuu

SEQ ID NO: 64138 - RNA, 64 nt, Human
uccugcggugauguccuuacuguccccagccagggccggggaccgguguuucacugaggaccug

SEQ ID NO: 64139 - RNA, 64 nt, Human
guccaaucagauggcaagggcagugcguggaaaggccggggaggugcagaaaccagagcccagg

SEQ ID NO: 64140 - RNA, 64 nt, Human
cugcuugguuuuauagguauuagggcucaugaaggccggggaacaacucuaauccuuuuggggc

SEQ ID NO: 64141 - RNA, 64 nt, Human
aggacugucucugaggcagaaacgccggcugggcgccggggaggacgauggccccgacccuggc

SEQ ID NO: 64142 - RNA, 64 nt, Human
ugcucugguggggcugccaggggagaccccgggagccggggaaggaggccguccaucccgucga

SEQ ID NO: 64143 - RNA, 64 nt, Human
aaaagagguuuaauuggacuuacaguuccacauggccggggaggccucagaaucauggcgggag

SEQ ID NO: 64144 - RNA, 64 nt, Human
aagauucccucggugccacagcugugcugaggaggccggggacugggaaucggagugggcaccu

SEQ ID NO: 64145 - RNA, 64 nt, Human
uucaagagguucuccugccucagccuccugaguagccggggagcuacaagcaugcaccaccaca

SEQ ID NO: 64146 - RNA, 64 nt, Human
agacguugcaaacaaaucuugggaagcgaggagggccggggaggacacuuccggacacgcucuu

SEQ ID NO: 64147 - RNA, 64 nt, Human
caugggguaugccgggcacugggcaggucccagagccggggaaccagcucaccucugguugcug

SEQ ID NO: 64148 - RNA, 64 nt, Human
ccggugaaagaaccagucccugggccccaaggaugccggggaaacaggaccuucuccuuuccug

SEQ ID NO: 64149 - RNA, 64 nt, Human
cuuaauauacuuaaauucuacuacucauuggauugccggggaugucccuuuaaacagacugcug

SEQ ID NO: 64150 - RNA, 64 nt, Human
aaggacagcccagguggcugaggccugaugggaagccggggaaggccaggguggaagggcggcu

SEQ ID NO: 64151 - RNA, 64 nt, Human
gccucacuuuucugugccuuccugaggggguugggccggggaggaaacccaacccucuccugug

SEQ ID NO: 64152 - RNA, 64 nt, Human
ugucacuuucaaccggccuccccuaccccugcuggccggggauggagacaugucauuuguaaaa

SEQ ID NO: 64153 - RNA, 64 nt, Human
ccagguggaccggcccgcgcuccgcccccagcgagccggggacccacccaccaccccccgcacc

SEQ ID NO: 64154 - RNA, 64 nt, Human
cccggaagccgagcgagcggccggcgcgcucaucgccggggagcccgccagguggaccggcccg

SEQ ID NO: 64155 - RNA, 64 nt, Human
gggguuuucaagugggugacggcgcucuccggcagccggggauggccguguccgcacugaccag

SEQ ID NO: 64156 - RNA, 64 nt, Human
cgcagggguguggcuuagcuggccccgcacccaggccggggaggcucaaguucgccacuuuacu

SEQ ID NO: 64157 - RNA, 64 nt, Human
ggugggauuuggagugaugggaagguuuuuaagggccggggauggaucuuuucuaaauguuauu

SEQ ID NO: 64158 - RNA, 64 nt, Human
cccuuaguuuugggugcccaaguucacggagggugccggggaauagaagcucugucagucucgu

SEQ ID NO: 64159 - RNA, 64 nt, Human
ccucugcuccagggccucagggcccggccuggcagccggggagggccggaggcccaaggagggc

SEQ ID NO: 64160 - RNA, 64 nt, Human
cccccacauacugcuccaccgcugaacuucgggugccggggaggagaaauugggcugaugugag

SEQ ID NO: 64161 - RNA, 64 nt, Human
uugaaagcaccccuaggaccauugaacacccacugccggggaccacuguccagugaauggauug

SEQ ID NO: 64162 - RNA, 64 nt, Human
ucacaaggcagcaaggcccgagcagcugagcagggccggggaacuggccaagcugaggugccca

SEQ ID NO: 64163 - RNA, 64 nt, Human
auaaaguugaaaaauccuaaguggaaccaucaaagccggggaccaucuguauugcuuuguuuuu

SEQ ID NO: 64164 - RNA, 64 nt, Human
uggguggguuuuggguguuggcuggguaaggggagccggggacuucugaaauagagcuggcucc

SEQ ID NO: 64165 - RNA, 64 nt, Human
uguuuaccuggugcucgggaagggaggggaaggggccggggagggggcacggcaggcguguggc

SEQ ID NO: 64166 - RNA, 64 nt, Human
guugugagagaaauugauaagcuuuugcaagacugccggggaaacgacccuguggcugugagaa

SEQ ID NO: 64167 - RNA, 62 nt, Human
ugccccugacgcacaucuagcgccuucgggacgccggggacucugcggcggcgacccacgag

SEQ ID NO: 64168 - RNA, 64 nt, Human
cuaagaagacggguuccugcuuugcagagaaggagccggggaccagcuugaagacuggcucugg

SEQ ID NO: 64169 - RNA, 64 nt, Human
gggauugcccaccccugggcaucauguguguggggccggggagcacaggugugggagcugguga

SEQ ID NO: 64170 - RNA, 64 nt, Human
ccgcauaggucuccaguccccacggggcucccaggccggggaaagguuccccugaggucacucu

SEQ ID NO: 64171 - RNA, 58 nt, Human
agagacacacagagcuguagcucccugugccggggaggaggggguggguucgcugaca

SEQ ID NO: 64172 - RNA, 64 nt, Human
ccuguucauguacgacccuaagaaaagggcgacggccggggacugccuggagagcuccuauuuc

SEQ ID NO: 64173 - RNA, 64 nt, Human
ccccccuuggcacaagucagaugaagcacguucugccggggaggcccucaccuuccagagagga

SEQ ID NO: 64174 - RNA, 64 nt, Human
acucaggcaucauuccaccauggcuaaggcaccagccggggaagacuugaaagaaaggggcagg

SEQ ID NO: 64175 - RNA, 64 nt, Human
guccuggguggagggcaggugaacacaagcugcugccggggacuguccuggguggacggcaggu

SEQ ID NO: 64176 - RNA, 64 nt, Human
gcaccaaggaaacacccagcagggucuccugugagccggggaccaugcagcccgaaaccuccag

SEQ ID NO: 64177 - RNA, 64 nt, Human
uaaugucuuuuaauccaaagguugcaaagugggggccggggaucugcaucuagccugcauauca

SEQ ID NO: 64178 - RNA, 64 nt, Human
agcgguuccugugcagaugcugcugaagagaggugccggggaggggcagagaggaaguggucug

SEQ ID NO: 64179 - RNA, 52 nt, Human
uugcuacagcuuccaguugaaugccggggagaaaccuguccaauuuuagcag

SEQ ID NO: 64180 - RNA, 64 nt, Human
gggaugccagagggcugccucuccagcggcuugggccggggaggggacacuccaguucucuagc

SEQ ID NO: 64181 - RNA, 64 nt, Human
cggaaaagcacgucuggcugcgagggcacacagggccggggaggaggauuaggcuggacugauc

SEQ ID NO: 64182 - RNA, 64 nt, Human
ugaaggggucuccgccagcucagcuggagccggagccggggagacucugaagcaggaaugugac

SEQ ID NO: 64183 - RNA, 64 nt, Human
cuaggaugccccagccccuacccuaagaccuauugccggggaggauuccacacuuccgcuccuu

SEQ ID NO: 64184 - RNA, 64 nt, Human
gaucccaggccagggaaagcccgugucaaugaaugccggggacagagaggggcagguugaccgg

SEQ ID NO: 64185 - RNA, 59 nt, Human
ugcccgcugacccugagugaaggccgccugccggggacucagacacucagggaacaaaa

SEQ ID NO: 64186 - RNA, 64 nt, Human
cagagcccauggucgggacagugcccuggccuuugccggggaggaggaugcucugagauucagg

SEQ ID NO: 64187 - RNA, 64 nt, Human
ucggguguccgcccucagccuccuggggacucgagccggggauccccugacgguuuuucuugcc

SEQ ID NO: 64188 - RNA, 64 nt, Human
gggcuguucccucuccugcccggacuguggccucgccggggagagcgggcgggggagcucgcgc

SEQ ID NO: 64189 - RNA, 64 nt, Human
cgugaugaaaucucucgcuguccggcuccagccggccggggaugugagucaucccuugguccag

SEQ ID NO: 64190 - RNA, 59 nt, Human
acgggaccccucugcccugaccccacggggccggggagggaggggaccccccuccaccc

SEQ ID NO: 64191 - RNA, 64 nt, Human
cagaaccgcuuacucccuuguuaagggggcugaagccggggagccaagugguucccaugcccac

SEQ ID NO: 64192 - RNA, 64 nt, Human
uguucaccacgaguguggcugcuggaucagggcagccggggagguggccaggccaguggccagg

SEQ ID NO: 64193 - RNA, 64 nt, Human
gcgugcgugugcgugccguguucgugugcaaggggccggggaggugggcgugugugugcgugcc

SEQ ID NO: 64194 - RNA, 64 nt, Human
ggccuccagcuuccaaagagcagcgagccgcggagccggggagugcccacagaccccagccccc

SEQ ID NO: 64195 - RNA, 64 nt, Human
uuccugcuucuuguauauugcucuggggacucucgccggggaagauggggcugauuucccaccu

SEQ ID NO: 64196 - RNA, 64 nt, Human
gagcgaggcgacuguccugcguggguagcccucggccggggagugaggccaccaaccaaaguca

SEQ ID NO: 64197 - RNA, 64 nt, Human
agcuguuguuguuuuucucuuugggccgggccgggccggggaagggccgagcaggcuccaggag

SEQ ID NO: 64198 - RNA, 64 nt, Human
cuccaguccugugauccgggcccgcccccuagcggccggggagggaggggccggguccgcggcc

SEQ ID NO: 64199 - RNA, 64 nt, Human
aaucuuugauacagaccuauuugcuaggggugcugccggggauuuggggucagcaucuggcccc

SEQ ID NO: 64200 - RNA, 64 nt, Human
gcgggcccagggugcuguugguguccucagaagugccggggauucuggacuggcucccuccccu

SEQ ID NO: 64201 - RNA, 64 nt, Human
agcuugacuucugcagcuggaggaggccccucaggccggggaucuggggagggcuagcccaaaa

SEQ ID NO: 64202 - RNA, 64 nt, Human
ccggggcugucccuguacuacacggugccauggagccggggagagcggggaagucucugcaucc

SEQ ID NO: 64203 - RNA, 64 nt, Human
acuguauaggacggaggacuauuuuccuguggacgccggggaagcacagcaccacccccgcacc

SEQ ID NO: 64204 - RNA, 64 nt, Human
guuggcaaggcuggcaccaacaagccccccaggugccggggaagaggggccaggccugggggcc

SEQ ID NO: 64205 - RNA, 64 nt, Human
gggccuuccgugugaguucuaguguucacuugaugccggggaauagaauuagagaaaacucuga

SEQ ID NO: 64206 - RNA, 64 nt, Human
aaugaaaaaagcuuuacuggggcuggggaaggaagccggggaagagauccaaagacucuuggga

SEQ ID NO: 64207 - RNA, 64 nt, Human
gagcucucuauucuggaagagcgguccagguggggccggggacuggccacugaauuaugccagg

SEQ ID NO: 64208 - RNA, 64 nt, Human
aagauugggacuuaacacuucagggaagucagcugccggggagaaacuugcuccuaaaugaaca

SEQ ID NO: 64209 - RNA, 64 nt, Human
cuacuuggaaggaugaagugggaggauugcuugagccggggagguggaggcugcagugaacuga

SEQ ID NO: 64210 - RNA, 64 nt, Human
ugaaacaggaaugauuucuccuuaauugcuuaaggccggggagcaaagugucuuaacuucuguc

SEQ ID NO: 64211 - RNA, 64 nt, Human
cccuugcggaagcuggagggcagcaauuggagaugccggggacccuucagcuauugcuuccuga

SEQ ID NO: 64212 - RNA, 64 nt, Human
ucgguggucaugcugagggccggcucccagcucugccggggacggacagggcagagggcagcgg

SEQ ID NO: 64213 - RNA, 64 nt, Human
ggaacugugaggagggccugggcaggcugugggagccggggagggacugagcagugaguggggc

SEQ ID NO: 64214 - RNA, 64 nt, Human
ugucuuuuucccagccgcauccugccuguagauggccggggaaggcucuagaaaaggggcgcau

SEQ ID NO: 64215 - RNA, 64 nt, Human
caggcuuugggguugcucccuguucugccccgaggccggggacgcagggcagcccacgccuccg

SEQ ID NO: 64216 - RNA, 64 nt, Human
uauuuuugcuugauagagaaucaaauuugaaacaauuaaccagccaguagauugucugucagug

SEQ ID NO: 64217 - RNA, 64 nt, Human
acuuaaaaauguuucugggaaauucacuagaaacauuaaccaauaggauuuuggugagcuuagc

SEQ ID NO: 64218 - RNA, 64 nt, Human
ugggguuuguuuuuuagucuuguuuuuuuaauucauuaaccagugguuagcccuuaaggggagg

SEQ ID NO: 64219 - RNA, 64 nt, Human
auuuuauauucagugaaaagauuuuauuuauggaauuaaccauuuaauaaagaaauauuuaccu

SEQ ID NO: 64220 - RNA, 64 nt, Human
uugaaaacaacuuugauuaaaacucaguuuuuaaauuaaccaucaacuuaaaaugaaugguaaa

SEQ ID NO: 64221 - RNA, 64 nt, Human
aggacuucuguuugaucuuugggagacagcauuuauuaaccaaaguuauucuuucuggaucugc

SEQ ID NO: 64222 - RNA, 64 nt, Human
uuccuuucucuucccuuaacccuuucugcuuuucauuaaccacauuccugcacaacucauuucu

SEQ ID NO: 64223 - RNA, 64 nt, Human
gaagcaggacuaaaugucuaguuguaacaccaugauuaaccacuucagcugacuuuucuguccg

SEQ ID NO: 64224 - RNA, 64 nt, Human
aaggcauucccucccccaccacuauucauaaaguauuaaccaacuggcaccaaggaauugccuc

SEQ ID NO: 64225 - RNA, 64 nt, Human
aauugacuaagagaagcaaagguuucuugggguuauuaaccaguaguguggaaauacuaguuuu

SEQ ID NO: 64226 - RNA, 64 nt, Human
ccggcuucuagugggauggaguugggguauagaaauuaaccaggaagauguuuccaccaagccu

SEQ ID NO: 64227 - RNA, 64 nt, Human
cuucugugacaccccugcccauuuucugucuuuaauuaaccaagguguuaggugugacugucac

SEQ ID NO: 64228 - RNA, 64 nt, Human
aauauucuuuggcuacgcaucuguccagcaucuuauuaaccauaauacugugaucauuauuugg

SEQ ID NO: 64229 - RNA, 64 nt, Human
aaagcaaaaagacaacugguaagauuaagaagccauuaaccauuugcaauuuauauuauaguca

SEQ ID NO: 64230 - RNA, 64 nt, Human
guuguugccuauuacaguaugagaguuuaagguuauuaaccauuggcuuagaagucaacaccua

SEQ ID NO: 64231 - RNA, 64 nt, Human
caaggaggaaaauaugguguuuggaauguuagauauuaaccacaauaaggcaugaucuggauua

SEQ ID NO: 64232 - RNA, 64 nt, Human
gcucaucguaaaugucuagucuucucacauagagauuaaccaacaaacuuguguggcugacuuu

SEQ ID NO: 64233 - RNA, 64 nt, Human
uuaucuuuggaagauagcuauaugguaacucaucauuaaccagaacaccucuccccucaaauuc

SEQ ID NO: 64234 - RNA, 64 nt, Human
uucagaagauugaguuuauccugauuuuugaaaaauuaaccagguaucuuuaucacuguguauu

SEQ ID NO: 64235 - RNA, 64 nt, Human
acaauaaaguuguuuaaagcuggcacaaauaagcauuaaccaaggcuguguccaccuucuguga

SEQ ID NO: 64236 - RNA, 64 nt, Human
cauguuuguuaauugccaucauggaagucagagaauuaaccaauuaagugacgguaacuauuuu

SEQ ID NO: 64237 - RNA, 64 nt, Human
cauagugagaccccaucucuacaaaaaauaaaaaauuaaccaggugugguggcacgugccuggg

SEQ ID NO: 64238 - RNA, 64 nt, Human
uauuauuauaaugaccuaauuuauuaaucugaagauuaaccauuuuuuugucuuagaauaucaa

SEQ ID NO: 64239 - RNA, 64 nt, Human
ccaacuuaaaguuuuaguuugguguuuauugaaaauuaaccaaacuuaauacuaggagaagacu

SEQ ID NO: 64240 - RNA, 64 nt, Human
ccugcuugaguucugagggcaucauggcccuaugauuaaccagagugaucuaaccuagacuaaa

SEQ ID NO: 64241 - RNA, 64 nt, Human
ugcguuugggucuacugccaccuuagcaagccucauuaaccauuuuauaaaaauugcguuagua

SEQ ID NO: 64242 - RNA, 62 nt, Human
uuuuauacugauuaaaucaguacugcaguauuugauuaaccaagcuucugcagauuuuguga

SEQ ID NO: 64243 - RNA, 64 nt, Human
aacagcagcccaccaaucagagaagcugguuguuauuaaccaagcuacagauucacacuuucug

SEQ ID NO: 64244 - RNA, 64 nt, Human
auaacuucagucacucccuugaauggugcaaugaauuaaccagcugauuuuucuuagugugaug

SEQ ID NO: 64245 - RNA, 64 nt, Human
uggacuucgauagguugauggaaggaauauuuuuauuaaccaaauagaaucuauuuacaaaaau

SEQ ID NO: 64246 - RNA, 64 nt, Human
uuugaggaggcuguauuuuuuauuccauuucaauauuaaccaaauaggcugagaaauucauagc

SEQ ID NO: 64247 - RNA, 64 nt, Human
cagcgauuccgacccgccaagucucggccuccacauuaaccauaggauguugacucuagaaccu

SEQ ID NO: 64248 - RNA, 64 nt, Human
gucaacucuuuauaaacuuaaaaauaaacaaguaauuaaccacucuaauuguucagaaauuuua

SEQ ID NO: 64249 - RNA, 64 nt, Human
aagugguaaaugagcuugcaauguguuaaagaagauuaaccauuuaaaggcauguguuccauag

SEQ ID NO: 64250 - RNA, 64 nt, Human
cucaagugguaaguuguuugugcuuuaggcaaacauuaaccagcucuaacaagaaaaaugucua

SEQ ID NO: 64251 - RNA, 64 nt, Human
auccaaggcuuuacugcugauagugcuaauuggcauuaaccacaaaaugagaauuauauuuguc

SEQ ID NO: 64252 - RNA, 64 nt, Human
ggucuuccaaguacaggauugaagcuuuagugaaauuaaccaaggaccaugggucagugcccag

SEQ ID NO: 64253 - RNA, 64 nt, Human
uggauuguuuucuaugugaagcaaaccaauuauaauuaaccacauguuguaguaacuggucuuu

SEQ ID NO: 64254 - RNA, 64 nt, Human
ucagauuuuauuuuuguaucugugguaacaaaacauuaaccaaaagauuuucuguccagaagcc

SEQ ID NO: 64255 - RNA, 64 nt, Human
uggacuucgauagguugauggaaggaauacuucuauuaaccaaauagaaucuguuuacaaaaau

SEQ ID NO: 64256 - RNA, 64 nt, Human
ggauuauauuuuuggguuuuguagaauauugcaaauuaaccacacaaaaaauguuuaauuuaug

SEQ ID NO: 64257 - RNA, 64 nt, Human
uuuuaaugaauguauaauuggcauaucauggaaaauuaaccagaaaguaucaguucuuaaaagu

SEQ ID NO: 64258 - RNA, 64 nt, Human
uaggcuauucacaaccacucauucaaaaguugaaauuaaccauagauguagauaaacucagaaa

SEQ ID NO: 64259 - RNA, 64 nt, Human
cuguauuuaaaauguacauuccacauuuuaauaaauuaaccacaagaaaauaaucccacauaua

SEQ ID NO: 64260 - RNA, 64 nt, Human
augcauggauaaacuugcugcaagccuggauacaauuaaccauuuuauauuugccaccuacaaa

SEQ ID NO: 64261 - RNA, 64 nt, Human
gcuugguagaagucaucgccauucuccauucucgauuaaccagggacacaaugcacagcagaaa

SEQ ID NO: 64262 - RNA, 64 nt, Human
gagcaaacgcuccuagacccaagggucucaucuuauuaaccauuucuugccucuaaauaaaaug

SEQ ID NO: 64263 - RNA, 64 nt, Human
guugagaauuagaucccacaucguauaaauaucuauuaaccauucuaaauaaagagaacuccag

SEQ ID NO: 64264 - RNA, 64 nt, Human
auauaaaauauaggcuuuaaaaaagcauagucuuauuaaccaugucuguuggucaaaaucugca

SEQ ID NO: 64265 - RNA, 64 nt, Human
cuuuaagaaauuuuaucuuuugaaacacguucugauuaaccaaggguaagcauguuuugguugc

SEQ ID NO: 64266 - RNA, 64 nt, Human
uccuggauuagggaggugucaacauaaauguauuauuaaccaugaagcugcucgcuauauuuuu

SEQ ID NO: 64267 - RNA, 64 nt, Human
uaacaauucugaucuuuuuaagguucacugguguauuaaccaaacguugucacaaauuacaaau

SEQ ID NO: 64268 - RNA, 64 nt, Human
aucuuuuuuaguguuaaagagauaaagaauaauaauuaaccaaccuuguuuaauagauuugggu

SEQ ID NO: 64269 - RNA, 64 nt, Human
uuugguuucuuauucaaagaugauaauuuaguggauuaaccaguccagacgcacugaucuuugc

SEQ ID NO: 64270 - RNA, 64 nt, Human
uauuucaaaguaccacacugaaaauuagacauuuauuaaccaaauuuaacgugguauuuaaagg

SEQ ID NO: 64271 - RNA, 64 nt, Human
cuucagguguaaacuguggucacggagcaaaaacauuaaccagcugcccaggguucaagcuuga

SEQ ID NO: 64272 - RNA, 64 nt, Human
ucauggucagccugucugacauccagguugugcuauuaaccaagaaggaaacagauacuuggag

SEQ ID NO: 64273 - RNA, 64 nt, Human
uaagauaggucagucaaguugguaaugccuguccauuaaccauuuaugcauacuaauaaaauua

SEQ ID NO: 64274 - RNA, 64 nt, Human
gguuucaucacaagaagggaguguuucuugugccauuaaccauguaguuuguaccaucacuaaa

SEQ ID NO: 64275 - RNA, 64 nt, Human
gacucaacguuacauuuuugaauguaguaaguaaauuaaccaaaaaaguuacaacuuccuaauu

SEQ ID NO: 64276 - RNA, 64 nt, Human
aucuugucaagaaauauccuaguccccuaaagguauuaaccacuucugcgauauuuuuccacau

SEQ ID NO: 64277 - RNA, 64 nt, Human
accaaggauucuuaauuguuaauuugaagaacacauuaaccagaaagcuuaaacauuauuauua

SEQ ID NO: 64278 - RNA, 64 nt, Human
uacaucauguggccaaagaaugagaaaggacagaauuaaccaaggauucuuaauuguuaauuug

SEQ ID NO: 64279 - RNA, 64 nt, Human
acuguucuucgcagcucaucuuuuccugcuuagaauuaaccauugcuaauuuaaaggagcagcu

SEQ ID NO: 64280 - RNA, 64 nt, Human
ucauagcuucuuuuccauuaaacucauaccuuuaauuaaccaauucauggcccaguucuacagu

SEQ ID NO: 64281 - RNA, 64 nt, Human
cuacacagcuggcaaacaccaggcugcggcuuggauuaaccaggaaagaaagcuuuucucacug

SEQ ID NO: 64282 - RNA, 64 nt, Human
gcacguggacaucuguuuuaaucagcacaagugaauuaaccaugcuucuucauuuuuuuacuuu

SEQ ID NO: 64283 - RNA, 64 nt, Human
uuccagcuacaauacuuccauuuauuagaagcacauuaaccauuucuauagcaugauuucuuca

SEQ ID NO: 64284 - RNA, 64 nt, Human
gaacaggagacuugagcuugaccuaaggauaugcauuaaccacucuacagacucccacucagua

SEQ ID NO: 64285 - RNA, 64 nt, Human
uuuauugaguguggauuuugcauacauucaaaacauuaaccacaaaauacagcaagugcaccua

SEQ ID NO: 64286 - RNA, 64 nt, Human
acaaaaagccuuuagccuugaggugccuucugaaauuaaccaaauuucauccauauauccucuu

SEQ ID NO: 64287 - RNA, 64 nt, Human
uucauguauucacauuuuucagugguuucauuuaauuaaccaugcuuuauguuaaacauuuugg

SEQ ID NO: 64288 - RNA, 64 nt, Human
aaaugaucgaauuguuaaguacaaaauuaagcuaauuaaccaauuuguaaccauuuuuucacuc

SEQ ID NO: 64289 - RNA, 64 nt, Human
aggcccucucaagggagcguaagugauguuccauauuaaccacagacuguccucuccaccuuua

SEQ ID NO: 64290 - RNA, 64 nt, Human
ucuguuccccaacuuacccuguagaaaccucguuauuaaccaguguuccagucuuaaaguagac

SEQ ID NO: 64291 - RNA, 64 nt, Human
auggugaaacuccaucucuacuaaaaauacaaaaauuaaccaggcuugauggugugcaccugua

SEQ ID NO: 64292 - RNA, 64 nt, Human
augcaaacaggcaaaauugguaccaaagggaaacauuaaccaugaggaagagcauuuuucuaag

SEQ ID NO: 64293 - RNA, 64 nt, Human
ugaguacuauauugcaauaaaauguagugauauaauuaaccagccauuaaaaauuuacuucuac

SEQ ID NO: 64294 - RNA, 64 nt, Human
cccaucagucguuuaucuguuguuugagauagaaauuaaccaaaaaugacauaaauauucauga

SEQ ID NO: 64295 - RNA, 64 nt, Human
gagagaccccaucucuacaaagaaagauuuaaaaauuaaccaggcaugguggcucgcaccugua

SEQ ID NO: 64296 - RNA, 64 nt, Human
gcaaacaggaaauuccacagcugccuccagaaacauuaaccaccccucucuagucuuacuggua

SEQ ID NO: 64297 - RNA, 64 nt, Human
auugacgagacacuuacugguuuaauuugcacuuauuaaccaucuauugaauacacagcauuau

SEQ ID NO: 64298 - RNA, 64 nt, Human
aggucucagguuuugaaauauaacucaacaguauauuaaccauugacaagaauggauuuuugga

SEQ ID NO: 64299 - RNA, 64 nt, Human
cuacauauuaguacuauauucguaaggauuuuuuauuaaccauuacagauuuuacaaacagcua

SEQ ID NO: 64300 - RNA, 64 nt, Human
guuaaaacugggacaggggagaaccuagggugauauuaaccaggggccaugaaucaccuuuugg

SEQ ID NO: 64301 - RNA, 64 nt, Human
agcacaguuuuuacacuaguggcaucucagugaaauuaaccaaagaugaagcuuuggcuuugcu

SEQ ID NO: 64302 - RNA, 64 nt, Human
cacaagcuccuuuuccugaauuuccuaccuaaauauuaaccauaugccuagucucugaaacuaa

SEQ ID NO: 64303 - RNA, 64 nt, Human
agucagcaguuuuguaaacucuguauauaaaaucauuaaccacacauugugggugaugggaaga

SEQ ID NO: 64304 - RNA, 64 nt, Human
caaguuuuauacuaagauaucuuaccuguuuguuauuaaccaaauauuuuuaaaaauauuuccu

SEQ ID NO: 64305 - RNA, 64 nt, Human
auacugaagagcguuugauuaaaauaaagugacuauuaaccagaaaagaaacauuuuacauaaa

SEQ ID NO: 64306 - RNA, 64 nt, Human
auggagaaacuccgucucuacuaaaaauacaaaaauuaaccaggcuuggugguguaugccugua

SEQ ID NO: 64307 - RNA, 64 nt, Human
uaggcuuggcaggcccugccaagcagaugcauacauuaaccacagcccagggccugcgacaggu

SEQ ID NO: 64308 - RNA, 64 nt, Human
cauucagucugugacuguggaauccuaugcagguauuaaccaaggcagaaagaggugaguaacu

SEQ ID NO: 64309 - RNA, 64 nt, Human
uuuacuuuuaagucacuuuuggguucacuaguggauuaaccagaagugauuguaguugagucca

SEQ ID NO: 64310 - RNA, 64 nt, Human
uuugcaagauuaaaaugugguugagugugccuaaauuaaccauccccauuuuuaucauauuucc

SEQ ID NO: 64311 - RNA, 64 nt, Human
ucugagagugcuuaaaaugggauccccagagaccauuaaccaauacuggaacugguaucuagcu

SEQ ID NO: 64312 - RNA, 64 nt, Human
caaaguuuugggaaucaauucauacauauuugagauuaaccaaaguccaugaucaguucuggac

SEQ ID NO: 64313 - RNA, 64 nt, Human
aauuugagaaaaaacagucaaccugauuugagaaauuaaccaguauggcuaacuauaucacaga

SEQ ID NO: 64314 - RNA, 64 nt, Human
gaaaccauaaauaucgugucauauuuuccccaagauuaaccaaaaauaaucugcuuaucuuuuu

SEQ ID NO: 64315 - RNA, 64 nt, Human
gguugaguuucagaacaaaagauauucauugcacauuaaccauuuagaggucauuuaaauaaca

SEQ ID NO: 64316 - RNA, 64 nt, Human
ucauuaaauuaccuugccaauuaguaaaaaaucaauuaaccauaaugguggaucuguuucugga

SEQ ID NO: 64317 - RNA, 64 nt, Human
uuucccuuaguauuaacagaaauguuucugugucauuaaccaucuuuaaucaaugugacauguu

SEQ ID NO: 64318 - RNA, 64 nt, Human
auaagaaaaauguauaauaaaaauguggugcuuaauuaaccaugacuauguauauauugccaau

SEQ ID NO: 64319 - RNA, 64 nt, Human
aggaagcaagcaucuccgcaucgcauccucuuccauuaaccaguggccgguugccacucuccuc

SEQ ID NO: 64320 - RNA, 64 nt, Human
ugcaucaaagcaucuugcauuaugcaauuuuuauauuaaccagauauauauucaucgguauuca

SEQ ID NO: 64321 - RNA, 64 nt, Human
agguuacauauauauauuuauaaugugucuuuuuauuaaccauuuguacaauaaaugucacuuc

SEQ ID NO: 64322 - RNA, 64 nt, Human
gaagaagaggagcuggcuagucaggaacuuauucauuaaccaccaaaccucuaccucuucucuc

SEQ ID NO: 64323 - RNA, 64 nt, Human
auaagguuguuuaagacgugcuucaaauauccauauuaaccacuauuuuucaaggaaguaugga

SEQ ID NO: 64324 - RNA, 64 nt, Human
ucucccagguuuagauuaccguuuucgacgacagauuaaccaaaaaugccccacacagguuuua

SEQ ID NO: 64325 - RNA, 64 nt, Human
ccccuuaucuguauuuucacuuuacgcaauuuccauuaaccauggucaacuguacuuuaaaguu

SEQ ID NO: 64326 - RNA, 64 nt, Human
uacucugaaccauaaacccagagaagaauuacucauuaaccagcauaaauacugccugaggauc

SEQ ID NO: 64327 - RNA, 64 nt, Human
cagaugagauuuuguuuguaaaguuuuguaguauauuaaccauugguuuaucacucuagauuca

SEQ ID NO: 64328 - RNA, 64 nt, Human
uguauccuuugauccaaucaaguugccacucaguauuaaccaugacaccuucuaagccaucauc

SEQ ID NO: 64329 - RNA, 64 nt, Human
uuaucuucuuaacaaauaagaaguugcuuuaaacauuaaccaauuuucuauauuuagcuauaca

SEQ ID NO: 64330 - RNA, 64 nt, Human
guagaauuuuaucuacuuguuccagaaauaauacauuaaccaaaaaggauuuaauuguucagac

SEQ ID NO: 64331 - RNA, 64 nt, Human
gaucauucuuuuuaucuuauuuguuuuuguacccauuaaccauccccaccucccccugcaaccg

SEQ ID NO: 64332 - RNA, 64 nt, Human
ccacuaacugugaguaaaaaugauauauauaggcauuaaccacacacuuuaauggguauaauuu

SEQ ID NO: 64333 - RNA, 64 nt, Human
auaaagaagauaaaauaaauuauauacccgagccauuaaccacaauuuagugaucacuaguggu

SEQ ID NO: 64334 - RNA, 64 nt, Human
cccuccuguguccucugaagcaaucucaguuuuuauuaaccaccucuucuguguuucugguagc

SEQ ID NO: 64335 - RNA, 64 nt, Human
aauguauaugcuuuugcaaguuugaaaaguucaaauuaaccacuuuugacuagguaagucuuuc

SEQ ID NO: 64336 - RNA, 64 nt, Human
uccaugggaccacaacuauuuucagaugugaaccauuaaccagaucuagucaaucaagucuguu

SEQ ID NO: 64337 - RNA, 64 nt, Human
ggaaguuguuucuuacuucuuuucucucuuauuuauuaaccauggucugagaguuguuuuuguu

SEQ ID NO: 64338 - RNA, 64 nt, Human
aaagggcacauggaguauggaagggggcauguugauuaaccauacauagaaauaaauauucucu

SEQ ID NO: 64339 - RNA, 64 nt, Human
gagucucaguuuuuccauuuguucaguggagagaauuaaccauugauaccuccuggcuggguga

SEQ ID NO: 64340 - RNA, 64 nt, Human
ccugggcaacccugucucuacaaaaaauacaaaaauuaaccaggcaugguggcaugcaccugua

SEQ ID NO: 64341 - RNA, 64 nt, Human
agcaaagaacuugcaaaauaugaagugacuuggaauuaaccauguuguagccuaacgugcuacu

SEQ ID NO: 64342 - RNA, 64 nt, Human
agagccugcccaagacuuugggccucuugacagaauuaaccacuuuuauacaucugaguucucu

SEQ ID NO: 64343 - RNA, 64 nt, Human
uccacagacauccuucuggacuuaaacacuuaacauuaaccacauuauuaauuguugcugaguu

SEQ ID NO: 64344 - RNA, 64 nt, Human
cacuggccaguaccuuuccuaagucuuugcucaaauuaaccagguugugagccaguggcuugag

SEQ ID NO: 64345 - RNA, 64 nt, Human
uucacaugugcuuuauuagacucugggagagaaaauuaaccaagugcuucagaacagguuuuua

SEQ ID NO: 64346 - RNA, 64 nt, Human
ggggauuccaccuacuuauuucagauucaccuccauuaaccaagaaaaccaguggaagauuucu

SEQ ID NO: 64347 - RNA, 64 nt, Human
augcugucuguuaaauaaaaugccauucugcagaauuaaccaucccaccagagcaauauugccc

SEQ ID NO: 64348 - RNA, 64 nt, Human
augacagcuacuaaccuggagacaguaacauuucauuaaccaaagaaagugggucaccugaccu

SEQ ID NO: 64349 - RNA, 64 nt, Human
gcgagauauuagaaauaaaggccagaaaaaauuaauuaaccaugauggaugaaucuauguuauu

SEQ ID NO: 64350 - RNA, 64 nt, Human
uccuuuacaugacaaauuugcaugaaauaagcagauuaaccaaguauuuauuuuucaucuuguu

SEQ ID NO: 64351 - RNA, 64 nt, Human
uuaagucucugguauuuaggcuggcaauauauauauuaaccauauuuuaaaaguaccaauuuug

SEQ ID NO: 64352 - RNA, 64 nt, Human
auccauccgcuuguaggggaaaaaaaggaaaaaaauuaaccagagagggucuguaaucucgcag

SEQ ID NO: 64353 - RNA, 64 nt, Human
augauguaugugaguauuuaucccauuuuaugcaauuaaccaaaucaaccaaaaaaagugacca

SEQ ID NO: 64354 - RNA, 64 nt, Human
aaggaauuuggacaaaggcaaaccgucuaauguaauuaaccaacgaaaaagcuuuccggacuuu

SEQ ID NO: 64355 - RNA, 64 nt, Human
aacuuaaccuucauuucauugguuuaaaugcguuauuaaccaucuuaagugcaaacuaaucauu

SEQ ID NO: 64356 - RNA, 64 nt, Human
aaacaaugugcuuguugaggcacugguaacccugauuaaccagaaccucccauucccaguaucg

SEQ ID NO: 64357 - RNA, 64 nt, Human
uccuuuacaccauacuuuacuucugguaugguuuauuaaccacacacacacacaaaagugaaaa

SEQ ID NO: 64358 - RNA, 64 nt, Human
gaagggcuggugaaagguguuuauacaagguucuauuaaccacuucuaaggguacaccucccuc

SEQ ID NO: 64359 - RNA, 64 nt, Human
acaucugcaucaaacaauauggcaacaucuauuuauuaaccaaguuuccuguccuuucacauug

SEQ ID NO: 64360 - RNA, 64 nt, Human
aaaagguucuaaaaugauauauuuagaugcaauaauuaaccauaugcuagaaugcccaccucua

SEQ ID NO: 64361 - RNA, 64 nt, Human
ccuuccucauuucacagauaaggaaucuuuggggauuaaccaaccuccuuucuguaaugguaau

SEQ ID NO: 64362 - RNA, 64 nt, Human
uugaaguuguuuuuuucuuauauuuuauauuaccauuaaccaauaaaaucuggcagaaagucug

SEQ ID NO: 64363 - RNA, 64 nt, Human
agcaacagaaaugcacuauaaaauauaguaugugauuaaccaauccugcuuccauauuuaagca

SEQ ID NO: 64364 - RNA, 64 nt, Human
uuuguuaaauaggcaaauguggaauuccucacagauuaaccaguauuuuuuaaauguauucauu

SEQ ID NO: 64365 - RNA, 64 nt, Human
agagcaagacccugucucaaaaaaaaaaaaacaaauuaaccaauaaguucuaauaucaaagugc

SEQ ID NO: 64366 - RNA, 64 nt, Human
agcuaccaugggaacgcaaggcagcaacucucuaauuaaccaggucauaaaaacgauucgucuu

SEQ ID NO: 64367 - RNA, 64 nt, Human
uggcgcuuuuguagaucacugagaagcuuaucuuauuaaccaauauaccacuuccuaaauaucc

SEQ ID NO: 64368 - RNA, 64 nt, Human
uguugccauugcuuuuccauugggagaagaaagaauuaaccagucauuaaaccauuugguaagu

SEQ ID NO: 64369 - RNA, 64 nt, Human
gcgucuuucuugugacuaaccacccugauauaguauuaaccacuguguucaagaguaaaaacaa

SEQ ID NO: 64370 - RNA, 54 nt, Human
cuacacuucuagcuuuauaaacagauuaaccaagauggggagaggggagggccu

SEQ ID NO: 64371 - RNA, 64 nt, Human
auguagauagaaagcaccugaauugugcuucugaauuaaccaauccaggaacugcuuuaccuuu

SEQ ID NO: 64372 - RNA, 64 nt, Human
auacaaguaaugccaaaaaccaagucaaagccuaauuaaccaaagcacucauuuaaaaaucauc

SEQ ID NO: 64373 - RNA, 64 nt, Human
ccucccaaauauaaaggcauauggaacauaauguauuaaccaaaguauguuauaaaucaaaaau

SEQ ID NO: 64374 - RNA, 64 nt, Human
ggcucacaucauguaauaguggcuuucauuucuuauuaaccaaauuaaccuuucaggaaaguau

SEQ ID NO: 64375 - RNA, 64 nt, Human
ggcaauuauuuaaagagggauaaucuugaaaaaaauuaaccaaggugauuucuuauauguagau

SEQ ID NO: 64376 - RNA, 64 nt, Human
cuguaacuuccuauaaccuaauauuuucgguaucauuaaccaaaauuucacacucauaguugcu

SEQ ID NO: 64377 - RNA, 64 nt, Human
ggagcagguagaauuuccagcagggccuugguggauuaaccaaggccuuggauuccagaauguu

SEQ ID NO: 64378 - RNA, 64 nt, Human
guuugaaacuacaauuaauuauagaugucaaaacauuaaccagauuaaaguaauauauuuaaga

SEQ ID NO: 64379 - RNA, 64 nt, Human
cacaguaaagggcauacauuuccugcuuucaccaauuaaccacugaauugcuauuuuuuccuuu

SEQ ID NO: 64380 - RNA, 64 nt, Human
aaaauuagucaccugaguaacuuggccacuaauaauuaaccaucuaccucuguuuuuaauuuuc

SEQ ID NO: 64381 - RNA, 64 nt, Human
gagggugaugcucucucuuaugugguacaauaccauuaaccaaagguagguguccaugcagauu

SEQ ID NO: 64382 - RNA, 64 nt, Human
uaucuaugggaugugugguucugguuaacuaaaaauuaaccaguaaacacucuguaguaaccau

SEQ ID NO: 64383 - RNA, 64 nt, Human
ccuaggccucauccuccucuuugccagucaccugauuaaccaauucuccagcauuaggacuuac

SEQ ID NO: 64384 - RNA, 64 nt, Human
gccuuucccucauuuuauaacuuuaaaaacuuggauuaaccacucaauguccacuuucuuugac

SEQ ID NO: 64385 - RNA, 64 nt, Human
guuacacaugcuuuaaaauauguauucaaauguuauuaaccacaaugacgaccugcuuugauuu

SEQ ID NO: 64386 - RNA, 64 nt, Human
caaacaaacaaacaaacaaacagaagagaagaucauuaaccacuguauacuuuguguauauaau

SEQ ID NO: 64387 - RNA, 64 nt, Human
ggaccuauuuauccugaaacaccuucuuguauucauuaaccauaguacuccuccccaccucaag

SEQ ID NO: 64388 - RNA, 64 nt, Human
agagaaagcaggggucuaauccaaaagaaaugucauuaaccaauacuccaaguccuugaguuuu

SEQ ID NO: 64389 - RNA, 64 nt, Human
ccucacuauauuguccaggcugaguggcucuuuuauuaaccagucauuacacugcggaacagcc

SEQ ID NO: 64390 - RNA, 64 nt, Human
agugcaaccaguagaaagcauugaaaugacugucauuaaccacacaguccuggaggcagagaug

SEQ ID NO: 64391 - RNA, 64 nt, Human
gagggauguggagcacaaaagccucucaucccccauuaaccagggcaccaagcccacagguguc

SEQ ID NO: 64392 - RNA, 64 nt, Human
auggcaaaaccccaucucuaccaaaaauacaaaaauuaaccaugcguggugguacacgucuguc

SEQ ID NO: 64393 - RNA, 64 nt, Human
uaaaaguauauuguuuaaaacaguagcuauagccauuaaccaaaggacagaugauauauauaua

SEQ ID NO: 64394 - RNA, 64 nt, Human
acaagcucuuuuauuagagauaauauaaagaaugauuaaccaggugacaguaaagggcaggaag

SEQ ID NO: 64395 - RNA, 64 nt, Human
uucaugaacuagcggaaaauuuauuaaauuaacuauuaaccacauucaccuuguaaaugacugu

SEQ ID NO: 64396 - RNA, 64 nt, Human
cuaucugaucacuucagcguaaagcaguguguuuauuaaccauccacuaagcuaaaacuagagc

SEQ ID NO: 64397 - RNA, 64 nt, Human
cugcugaugcccucaccuauacucaccugccuuuauuaaccagcauucuugauaugauccaccu

SEQ ID NO: 64398 - RNA, 64 nt, Human
auaacacuugauuccauuucauugucauuaguguauuaaccagcaggagaggugaugagccauu

SEQ ID NO: 64399 - RNA, 64 nt, Human
uuuaaaauacguucaaacuauaguguaaaugcuaauuaaccauauugguauauaaccggaauuu

SEQ ID NO: 64400 - RNA, 64 nt, Human
gaggcaacguagccacugccucccuaugcaaaaaauuaaccagaugaugcagauaagacagcau

SEQ ID NO: 64401 - RNA, 64 nt, Human
cuggagaguuuaccaacaaauauugacugcagugauuaaccaagacauuuuuguuaacuaaaaa

SEQ ID NO: 64402 - RNA, 64 nt, Human
caggccugagguguacauaguccuucccggccauauuaaccacacagccugagccuggcccagc

SEQ ID NO: 64403 - RNA, 64 nt, Human
auauugcuaguuuaauauugugucaggucguccuauuaaccaggagcagaugacaguaaaauuu

SEQ ID NO: 64404 - RNA, 64 nt, Human
auuuuuuguuaaaaaaaacuuggcuccaaguucuauuaaccacagguuguguucauucuuuucc

SEQ ID NO: 64405 - RNA, 64 nt, Human
cucauucucuuucauguuccgucugugucucucaauuaaccacucgucaacugcugauucuacu

SEQ ID NO: 64406 - RNA, 64 nt, Human
cagcagaaaaguacuuacuucuugccaguuaucuauuaaccaaaaccuuugauuuguaguuuua

SEQ ID NO: 64407 - RNA, 64 nt, Human
aauuagaaacuaucaaaaauguggcuuaaaagaaauuaaccaccuaggaauuuaauauuguugu

SEQ ID NO: 64408 - RNA, 64 nt, Human
uggucucauuuuaaugcuguuucugaguuauuguauuaaccauuauugagaauaaauuuuuuua

SEQ ID NO: 64409 - RNA, 64 nt, Human
uuccagggccugggaccauuggcugggaccccucauuaaccaaccaagcacuuguaccucccug

SEQ ID NO: 64410 - RNA, 64 nt, Human
acucuuagaaaaaaguaauaugaaguauucugaaauuaaccaaucaguuuauuuaaaucaauuu

SEQ ID NO: 64411 - RNA, 64 nt, Human
aaacaucuuuguauauuuugugcauguugaagcuauuaaccaaggaucaaaacuguaacacauc

SEQ ID NO: 64412 - RNA, 64 nt, Human
cucaauagcaagaaugugugcccuuaaugaaaacauuaaccaggugguauuuguuggaaauuuc

SEQ ID NO: 64413 - RNA, 64 nt, Human
auacguuucacgcguaaguaccuuauucuacaucauuaaccaguaaggacuuuuuaauuaacca

SEQ ID NO: 64414 - RNA, 64 nt, Human
uuauucuacaucauuaaccaguaaggacuuuuuaauuaaccacaauaccacuaucacaccuaau

SEQ ID NO: 64415 - RNA, 64 nt, Human
ucacacaaguguuuuucugauucuaugauaacuaauuaaccaucaucuggugauuaaaagaaca

SEQ ID NO: 64416 - RNA, 64 nt, Human
ggucaccccauuuaggauuaguggaucucaaauuauuaaccaaacaucacuccauuucaaagua

SEQ ID NO: 64417 - RNA, 64 nt, Human
cccugccuguugagccccauucuacauccccaccauuaaccaggccccacccacaagguagaaa

SEQ ID NO: 64418 - RNA, 64 nt, Human
uuaagauugcguauucauguagugagauuuagucauuaaccaacccggucuuugugauguguga

SEQ ID NO: 64419 - RNA, 64 nt, Human
agcuaauugaaagagucaugcaacucaguugggaauuaaccacucaauucaauaguaaaagcca

SEQ ID NO: 64420 - RNA, 64 nt, Human
uaccaucucuucaccagucaaguugacacguaaaauuaaccaucacauugguaaucucauuuaa

SEQ ID NO: 64421 - RNA, 64 nt, Human
acauggcuugccacagcucuugaggaugucaccaauuaaccagaaauccaguuauuuuccgccc

SEQ ID NO: 64422 - RNA, 64 nt, Human
uuuagugacuagggagaccauuaacuaguuuaucauuaaccacuuaucaguguauugauguuaa

SEQ ID NO: 64423 - RNA, 64 nt, Human
caucccggccuggguuuacaacgcuguuaggaaaauuaaccaaugaauaaagcaacguucagug

SEQ ID NO: 64424 - RNA, 64 nt, Human
agcuuuuucuaacuucucaaguucuagagaaagaauuaaccaacugaugacuuaccugccuagu

SEQ ID NO: 64425 - RNA, 64 nt, Human
cuuaauucauaaacacuaugaauuucagacaaaaauuaaccagacagaggagaggagggaggaa

SEQ ID NO: 64426 - RNA, 64 nt, Human
guuaauuuaaaaauuuccacuacacuuauuaucuauuaaccaaagcuuaaaauuuuguauucuu

SEQ ID NO: 64427 - RNA, 64 nt, Human
ugaaccuauagauuuaaagagacuuaagagacauauuaaccaauuguuaauuggaucuuauuug

SEQ ID NO: 64428 - RNA, 64 nt, Human
uuucuuagaaaaaaaugagaacuaaaaaaaaaaaauuaaccacauggagaaauggguguaaaau

SEQ ID NO: 64429 - RNA, 54 nt, Human
aggugggacaacaaaguuaauaugauuaaccaccugccgcugaucagccuuaug

SEQ ID NO: 64430 - RNA, 64 nt, Human
aucuucccugucaugacuuuaaguucuacuuuucauuaaccauggccugauauuaguucuuaga

SEQ ID NO: 64431 - RNA, 64 nt, Human
cuguaagcuguuugguuuuaaaauacuguagauaauuaaccaagguagaaugaccuuguaaugu

SEQ ID NO: 64432 - RNA, 64 nt, Human
auuccuccuuuugucaucuuguuggggggaggggauuaaccaaaggccacccugacuuuguuuu

SEQ ID NO: 64433 - RNA, 64 nt, Human
uugcugguuucagggaaggaguuugauauagcagauuaaccacccuccuuguagcuauuggggc

SEQ ID NO: 64434 - RNA, 64 nt, Human
uuuuuuaaucgacgugaaauucacguaacauagaauuaaccauuuugaagugaacaauuugguu

SEQ ID NO: 64435 - RNA, 64 nt, Human
cuguuuaguuggggaaaccauuuguaaaacagccauuaaccauacagugugaucaacacugaca

SEQ ID NO: 64436 - RNA, 64 nt, Human
agcugugugaagaaauaggaaagaagaaguuaccauuaaccaaggauaugagagaacaaggagu

SEQ ID NO: 64437 - RNA, 64 nt, Human
cuuuacaaggccacgcgugcagcugucccauccagaccccgacuggccaagaccuccacguccc

SEQ ID NO: 64438 - RNA, 64 nt, Human
ccgaaccguccccccaggaacacaccuucagguagaccccgaagccucaaggccggggcuggag

SEQ ID NO: 64439 - RNA, 64 nt, Human
uuugcaggaggaggaugauuacgacgugaugcaggaccccgaguuccuucagaguguccuagag

SEQ ID NO: 64440 - RNA, 64 nt, Human
aacccacuuuguucucagccacgcaaaacucccugaccccgaugugauuuuucuccccggggau

SEQ ID NO: 64441 - RNA, 64 nt, Human
cuuuaaugagugcaccugccuccaccagcaaggggaccccgagaacccugagcaggguccacag

SEQ ID NO: 64442 - RNA, 64 nt, Human
ccaaccaccaucuaccacuacggccaccccaaaggaccccgacgccaacagacagucaaacgcu

SEQ ID NO: 64443 - RNA, 64 nt, Human
acgugugacccugggagauccgggcuggacuguggaccccgaugggccagaguccuuguggccc

SEQ ID NO: 64444 - RNA, 64 nt, Human
gggcaggccuugcugggguccagggcuguuggaggaccccgagggcugaggagcagccaggacc

SEQ ID NO: 64445 - RNA, 64 nt, Human
gcacgcggcacuucagagccccgcccggggccgcgaccccgaccgucccugcugcuccccuagg

SEQ ID NO: 64446 - RNA, 64 nt, Human
uucugcaaaccugccccuucuggguacuucccuugaccccgagaucacucaggagccagacagg

SEQ ID NO: 64447 - RNA, 64 nt, Human
acccagggggccagcgggagcagggccugcaugagaccccgacagaaggugggggggggggggc

SEQ ID NO: 64448 - RNA, 64 nt, Human
uggcaguggugcauauaaacuguggguguggcaagaccccgaagacauuucacaucuuuaucgc

SEQ ID NO: 64449 - RNA, 64 nt, Human
caggccgagugggccgccaggaccaagcgagguggaccccgaaacggacggcccggagcccgca

SEQ ID NO: 64450 - RNA, 52 nt, Human
cguaccaguauguggucugaaggaccccgaccggcauggccacucagacaca

SEQ ID NO: 64451 - RNA, 64 nt, Human
ugcuagauuugacugcaagauugaaggauacccagaccccgagguugucugguucaaagaugac

SEQ ID NO: 64452 - RNA, 64 nt, Human
ugcagagaccuugcgaccauguguagauugcguggaccccgacaaagggaaggcugcuguguag

SEQ ID NO: 64453 - RNA, 64 nt, Human
uuuccugagccccagggcugaauccccccuccuugaccccgaacagugaacucaggcagcuggc

SEQ ID NO: 64454 - RNA, 64 nt, Human
aaacccuugcugcuuuagucccgauaggguauuugaccccgauauauuuuagcauuuuaauucu

SEQ ID NO: 64455 - RNA, 64 nt, Human
acaugagcuaaagcccucccgcgcccccaccccagaccccgagccaccccaggaaaagcacaag

SEQ ID NO: 64456 - RNA, 64 nt, Human
cuucuuccccaucaccgugcgcuguugcgaucuggaccccgagaagaggugagugggguggggc

SEQ ID NO: 64457 - RNA, 64 nt, Human
cccucaaacugcaccgccggccagauacccuccugaccccgaggacuuggucuggucucucugg

SEQ ID NO: 64458 - RNA, 64 nt, Human
cagcccgagcaacagguucugugucaccagccuggaccccgacacgcugccugcuguugccaca

SEQ ID NO: 64459 - RNA, 64 nt, Human
cccgccugcgccccgugcccaccucugcgcggacgaccccgacuuccgugccaucccagacggg

SEQ ID NO: 64460 - RNA, 52 nt, Human
caagugcagacaagucaugagagaccccgacuacuccucagccacaucgcac

SEQ ID NO: 64461 - RNA, 64 nt, Human
cccauuucugccucgcucaccgcuggcccuuagagaccccgagguagggguggggagaugcuuc

SEQ ID NO: 64462 - RNA, 64 nt, Human
guaagucugcccuuugccauacugaacagcuguggaccccgauuggugagggcucugcauaugc

SEQ ID NO: 64463 - RNA, 64 nt, Human
ucugcugggcuggcggccauccccguguuggguggaccccgagcacgguugccugagguccgau

SEQ ID NO: 64464 - RNA, 64 nt, Human
uugagaguggaggcacaauggaaauccucugugggaccccgagcaagacccugcaccucuuugg

SEQ ID NO: 64465 - RNA, 64 nt, Human
ccccuggccugugccaggcucacgggcggcggcggaccccgaccuccaguugccuacaauucca

SEQ ID NO: 64466 - RNA, 64 nt, Human
ucugggcuggcggccugguggcagugcuggagaugaccccgagccccuccccguggggcaccca

SEQ ID NO: 64467 - RNA, 64 nt, Human
gugaggugcugcccguggaagccagggagggauggaccccgaaaggagaaaaguacucccagga

SEQ ID NO: 64468 - RNA, 64 nt, Human
ccugagacacggaggcccccaguauugcaggagcgaccccgacguggaacgcugccucaggcaa

SEQ ID NO: 64469 - RNA, 64 nt, Human
acaaggcccccgauggcccaggagcagaugggaggaccccgaggccagacgcacacuguccgag

SEQ ID NO: 64470 - RNA, 64 nt, Human
accccagccugaaguuugugggggccaaaccugggaccccgagcuuccucgguagcagaggccc

SEQ ID NO: 64471 - RNA, 64 nt, Human
gcaugaugaguguuccagagggagaagcaucgcugaccccgagcgcagguuuugcuagcagauu

SEQ ID NO: 64472 - RNA, 64 nt, Human
gcaugugccccuguagagcgucuccccagaaccagaccccgagccacucgcuuccucugugcug

SEQ ID NO: 64473 - RNA, 64 nt, Human
aggcaugcucagagaagccuaggugggcuaccaugaccccgaggaagagcaggcuuuguuuucc

SEQ ID NO: 64474 - RNA, 50 nt, Human
ucggggcccuggggcugugagaccccgacccucucgaggaacccugccug

SEQ ID NO: 64475 - RNA, 64 nt, Human
gacacauggcuggacaaggcuuugcagccugggagaccccgacuuucucuaacccaguggcugu

SEQ ID NO: 64476 - RNA, 64 nt, Human
ggggagcggcccccagccgggacgggagggcagcgaccccgaggccucguggacgugggagaga

SEQ ID NO: 64477 - RNA, 64 nt, Human
ccugcuggcuugaugagcaccgauggugggaucugaccccgaggggcagagcugucggugacug

SEQ ID NO: 64478 - RNA, 64 nt, Human
uggacgagcaagggcaucccagaaacguguaaaugaccccgagugugacugggaaggagaacuu

SEQ ID NO: 64479 - RNA, 64 nt, Human
gagguugguccgaggcugugugcccucugccagcgaccccgaagcagauaucucagugggguua

SEQ ID NO: 64480 - RNA, 64 nt, Human
ggcccagaggagcugggagccgggccgcagacuugaccccgacgccacagcccagccacggacg

SEQ ID NO: 64481 - RNA, 64 nt, Human
uuuaaaaucgaucuacacacauccacgcacaugcgaccccgaggaaacgaaacccacucuagaa

SEQ ID NO: 64482 - RNA, 64 nt, Human
ggaccccccacccccacacgcacuuuaugagggagaccccgacagaggacgcuugagccagaau

SEQ ID NO: 64483 - RNA, 64 nt, Human
agccccccuccccacugccuccccagcucucagugaccccgacugucuccugacuuagccgagg

SEQ ID NO: 64484 - RNA, 64 nt, Human
aggccgcgcccucccggaaaagccggguccuccagaccccgaggccuugcucucagagcgggag

SEQ ID NO: 64485 - RNA, 64 nt, Human
gcgccacugcacuccagccuggguaacagagcgagaccccgacucaauaaauaaauaaggaugg

SEQ ID NO: 64486 - RNA, 64 nt, Human
aaucuugccugcccccagcucacacucagcgugggaccccgaauguuaagcaaugauaauaaag

SEQ ID NO: 64487 - RNA, 64 nt, Human
acaagcgacugggccggccggcccuggaccccuagaccccgagccgccugccgacugccugcac

SEQ ID NO: 64488 - RNA, 64 nt, Human
cacaccuucguccccuuugcagggaguuacaggagaccccgagacacccucccuccacucggga

SEQ ID NO: 64489 - RNA, 64 nt, Human
gcccuuccagggcggcagcagcgggagccacgcagaccccgaggcgcaccugcuggcucuugug

SEQ ID NO: 64490 - RNA, 64 nt, Human
aggagggagcgcccuguccacccgggcggggagagaccccgagagagacugcacuuggccacag

SEQ ID NO: 64491 - RNA, 55 nt, Human
agagaggaucgcggauguaaacuaagaccccgaaaacuccagaccuucaggagag

SEQ ID NO: 64492 - RNA, 64 nt, Human
uagaauugagucacccccuagauaccaacugucugaccccgaggagcucuguaagucccugcuc

SEQ ID NO: 64493 - RNA, 64 nt, Human
acaccccugucccacccacacagcugcccuagcugaccccgagaagugcucuuggcugaccccu

SEQ ID NO: 64494 - RNA, 64 nt, Human
cccccagaggagcgcagucacuccacuuggccccgaccccgagcuuagccccuaagcccuccuu

SEQ ID NO: 64495 - RNA, 64 nt, Human
ugaagugccgaaguggcccgugccgccgcacagagaccccgacuuuaguuugggcuguuccacg

SEQ ID NO: 64496 - RNA, 64 nt, Human
gccccugaaccgccccucccacagcgcuggccgggaccccgagccuggcuccaaacccucgagg

SEQ ID NO: 64497 - RNA, 64 nt, Human
uggggacuaggaggaagggggcagagagaguuaugaccccgagagggcgcacagaccaagcgug

SEQ ID NO: 64498 - RNA, 64 nt, Human
agcgaagaagacugagccccgacauuccagucucgaccccgagccccucguuccagagcugaga

SEQ ID NO: 64499 - RNA, 51 nt, Human
gggccgugguggccuucugaggaccccgagcggcgcugccggagcccagag

SEQ ID NO: 64500 - RNA, 64 nt, Human
cgagcaucaaggggacgcugugugugcugcaagugaccccgaaaacaaccacagccgucacaug

SEQ ID NO: 64501 - RNA, 64 nt, Human
gauucgcuguccccucguuggaggcgaauggucggaccccgaguggcggcgccccugauaaaag

SEQ ID NO: 64502 - RNA, 64 nt, Human
gagaggcagugauuccccucccgccccgcacagagaccccgacucacugccagccggggcgggg

SEQ ID NO: 64503 - RNA, 64 nt, Human
ccucaccccguuugcauaugcaaugcuagcaugggaccccgaaaauagacgcucugcugcacug

SEQ ID NO: 64504 - RNA, 64 nt, Human
ccaacaaccccaauccacguuuuggaugcacugagaccccgacauuccucgguauuuauugucu

SEQ ID NO: 64505 - RNA, 64 nt, Human
caagacagagcgcgcagcccggcaaggggcaugugaccccgaaggaagaacgcaacagaagagu

SEQ ID NO: 64506 - RNA, 64 nt, Human
guguccaggugggggcuggcagucccuggcugcagaccccgagcuggcccugggccagccgcac

SEQ ID NO: 64507 - RNA, 64 nt, Human
agccuggcuguggggaaagugaccacucugcccugaccccgaucaguuaaggagcugugcaaua

SEQ ID NO: 64508 - RNA, 64 nt, Human
aucuggcuucugcccugugaccccgugaccccgugaccccgaaguggucuggggcugaucuugc

SEQ ID NO: 64509 - RNA, 64 nt, Human
cagccaggagagcuuagggucucagggugucccagaccccgacaccggccaguggcggaaguga

SEQ ID NO: 64510 - RNA, 64 nt, Human
ccuacagcccuggaggccgcugcugaccagcacugaccccgaccucagagaguacucgcagggg

SEQ ID NO: 64511 - RNA, 64 nt, Human
caccuuuaagcuggugcacagggacaucgugggggaccccgagaccgcgcuggcccucugcuaa

SEQ ID NO: 64512 - RNA, 64 nt, Human
gggcaucgcuaaacccaaaugggggcugcuggcagaccccgagggugccuggccaguccacucc

SEQ ID NO: 64513 - RNA, 64 nt, Human
acacggccucccugcagcugcccugccaccgacagaccccgauuaaacccacaccuggccuugg

SEQ ID NO: 64514 - RNA, 64 nt, Human
cuucguggcccuggaugaggaauccuacuccuaugaccccgaagaugaggccagccucagccuc

SEQ ID NO: 64515 - RNA, 64 nt, Human
agcaaggaucuuucacccacagaaagagagcacugaccccgauggcgauggacuacugaagccc

SEQ ID NO: 64516 - RNA, 64 nt, Human
acccccgccacggccacccuccuucccgccgcccgaccccgagucgggaggacuccgggaccau

SEQ ID NO: 64517 - RNA, 64 nt, Human
cucgaacacugcccgccuuacugccgccuaccccgcccgccacgccgccgucgaugccagcgcu

SEQ ID NO: 64518 - RNA, 64 nt, Human
cuccucucggccccuguagacuuucucuaaagccgcccgccagcccaggccgcugcucugcacc

SEQ ID NO: 64519 - RNA, 55 nt, Human
cccaggagccccagagcugaguguugcccgccaccgccccgcccugcccccucca

SEQ ID NO: 64520 - RNA, 64 nt, Human
gccaagccaccaagugaaaccuuccaggauacuagcccgccagcugugggccccagaaagccag

SEQ ID NO: 64521 - RNA, 64 nt, Human
ugccucagccuccagaguagcugggacuacaggugcccgccaccacacccggcuaauuuuuugu

SEQ ID NO: 64522 - RNA, 64 nt, Human
ccguggcugucccggaccccaccucuucccugccgcccgccaccggccgaccgaccgcggcugc

SEQ ID NO: 64523 - RNA, 64 nt, Human
ccgccauccgagcuugagcugggcgcacagaggugcccgccaggaucuguggcccuguaacauu

SEQ ID NO: 64524 - RNA, 64 nt, Human
acaaagugcucccucuuuucagugccuccaggaagcccgccaguggugagacuguguccucaag

SEQ ID NO: 64525 - RNA, 64 nt, Human
ggcaagaucagauccuggaggacuuuccuggccugcccgccagcccugcucuuguuguggagaa

SEQ ID NO: 64526 - RNA, 64 nt, Human
ugccucagccucccuaguagcugggauuacaggcgcccgccaccaugcccggcuaauuuuguau

SEQ ID NO: 64527 - RNA, 64 nt, Human
uucucccucccacaggaugcggaaggauugcaaugcccgccagcacaguggcggcaacauugaa

SEQ ID NO: 64528 - RNA, 64 nt, Human
ucuccucggagagccugccugccugggcgggcccgcccgccaccgcagccucccagcugcucuc

SEQ ID NO: 64529 - RNA, 64 nt, Human
auugucucuguucagccaagugugcaaguaggcugcccgccaagagggggccucugcuacccgc

SEQ ID NO: 64530 - RNA, 64 nt, Human
ugccucagccucccgaguagcugggacuacaggggcccgccaccacaccuggcuaauuuuuuaa

SEQ ID NO: 64531 - RNA, 64 nt, Human
gggaggaaggggcggcugcucagacagauuuagggcccgccagcuaggcuacacccaucaugcg

SEQ ID NO: 64532 - RNA, 64 nt, Human
gccucagcccccccgaguagcugggacuacaggcgcccgccaccacgccuggcuaauuuuuuau

SEQ ID NO: 64533 - RNA, 64 nt, Human
ugccucagccucccaaguagcugggacuacaggugcccgccaccaugccuggcuaauauuuuuu

SEQ ID NO: 64534 - RNA, 64 nt, Human
ugccucagccucccgaguagcugggacuacaggcgcccgccaccaugccuggcuaauuuuuuau

SEQ ID NO: 64535 - RNA, 64 nt, Human
gcacguggcugcccugcccuacugugggcauagcgcccgccaugacagugaguguccuuagggg

SEQ ID NO: 64536 - RNA, 64 nt, Human
cgccgccuguggugccuggucucccggcccuagcgcccgccaaaccuggugguccugggcggcc

SEQ ID NO: 64537 - RNA, 64 nt, Human
ccaccuucugaagccugggaggugugaacccagggcccgccaaccgcugccuuucucgggagua

SEQ ID NO: 64538 - RNA, 64 nt, Human
ugccucagccucccaaguaggugggacuacaggugcccgccaccacacccggcuaauuuuugca

SEQ ID NO: 64539 - RNA, 64 nt, Human
ugccucagccuccugaguagcugggacuacaggcgcccgccaccacgcccggcuaauuuuuuau

SEQ ID NO: 64540 - RNA, 64 nt, Human
ugccucagccucccgaguagcugggauuccaggcgcccgccaccacgccuggcuaauuuuuugu

SEQ ID NO: 64541 - RNA, 64 nt, Human
ccccaggacgcauuaacccuuuggggcugggguggcccgccauccccuggaguaaaugccugug

SEQ ID NO: 64542 - RNA, 64 nt, Human
cguaggcccgugcccucugcuccuuggccugccugcccgccagccacgcgugucagcccuccag

SEQ ID NO: 64543 - RNA, 64 nt, Human
ugccucagccuccugaguagcugggacuacaggcgcccgccaccacacccggcuaauuuuuugu

SEQ ID NO: 64544 - RNA, 64 nt, Human
ugccucagcuucccaagcagcugggauuacaggugcccgccaccacgcccagcuaauuuuugca

SEQ ID NO: 64545 - RNA, 64 nt, Human
gccucagccucucugagaagcugggacuacaggcgcccgccaccacgcccggcuaauuuuuuug

SEQ ID NO: 64546 - RNA, 64 nt, Human
ggcagaaguuuacuaugcgcaaauacugugaaaugcccgccaguguuacagcuuucuguugcag

SEQ ID NO: 64547 - RNA, 64 nt, Human
ccaaagacucccucccuagucugccugccugcccgcccgccacggagcugccugagugucccug

SEQ ID NO: 64548 - RNA, 64 nt, Human
aaagacagcgauaugggagacacccaggggccuggcccgccagcccaaaagauggucaucggga

SEQ ID NO: 64549 - RNA, 64 nt, Human
ugccucagccucccgaguagcugggacuacaggcgcccgccaccacgcccggcuaauuuuuugu

SEQ ID NO: 64550 - RNA, 64 nt, Human
ugccucagcuucccgaguagcugggacuacaggggcccgccaccacgcccggcuaacuuuuugu

SEQ ID NO: 64551 - RNA, 64 nt, Human
cccccgccagcuggggugcccaggggcagggccggcccgccagggagggggccugcauuggcug

SEQ ID NO: 64552 - RNA, 64 nt, Human
gguucaagccuccugaguaacugggacuacaggcgcccgccaccacgcccagcuaauuuuuugu

SEQ ID NO: 64553 - RNA, 64 nt, Human
uaaagcagaaguucuucggcccgggccugucgaugcccgccaggacuguuuucaugcugccugu

SEQ ID NO: 64554 - RNA, 64 nt, Human
ccaccccacuuccacauggcccucgucccuuccugcccgccagaugcugccugcacuuccgcag

SEQ ID NO: 64555 - RNA, 64 nt, Human
ccagagcugcacgccgguccacagacacacucacgcccgccaccugcuccccgcaggauguguc

SEQ ID NO: 64556 - RNA, 64 nt, Human
gccaggagagaggcccuggcacccuggcgugggugcccgccaaacgcccugcgaccgcucagaa

SEQ ID NO: 64557 - RNA, 64 nt, Human
ugccucagccucccgagcagcugggacuacaggcgcccgccaccacgccuggcuaacuuuuuug

SEQ ID NO: 64558 - RNA, 64 nt, Human
ugccucagccucccgaguagcugggacuacaggugcccgccaccaugcccggcugauuucuuuu

SEQ ID NO: 64559 - RNA, 64 nt, Human
ugccucagccuuccaaguagcugggacuacaggugcccgccaccgugcccggcuaauuuuuuug

SEQ ID NO: 64560 - RNA, 64 nt, Human
ccauugggguggggcugcaucagucuccggaguggcccgccaccuccugaagcagggccuggcc

SEQ ID NO: 64561 - RNA, 64 nt, Human
ccugcccugcccccagccugugccagcagcagcugcccgccacagggguacccaucacacacca

SEQ ID NO: 64562 - RNA, 64 nt, Human
ccugccucagccucccauagcugggacuacaggcgcccgccaacacgccuggcuaauuuuuugu

SEQ ID NO: 64563 - RNA, 64 nt, Human
acucugagugaaaggaaauguaauguggauaaaggcccgccaccuccucacauuggucuaucua

SEQ ID NO: 64564 - RNA, 64 nt, Human
gggggaccccagaaguccuuuaucugugcucucugcccgccagugccuuacaauuugcaaacgu

SEQ ID NO: 64565 - RNA, 64 nt, Human
cuacuuuggguguugggucagauccugcccccgugcccgccagggcucagguuccucugagcug

SEQ ID NO: 64566 - RNA, 64 nt, Human
ggcucuguccaccacucuaccccacaggagggccgcccgccaccaagccucaccugggggccac

SEQ ID NO: 64567 - RNA, 64 nt, Human
auagggggaggggggcccggucccaccccgccccgcccgccaggggccuugccggccccuucaa

SEQ ID NO: 64568 - RNA, 64 nt, Human
ucaccugccacucaaccaaagaguccucgagccggcccgccaaggggacugcugcuucuuuuuc

SEQ ID NO: 64569 - RNA, 64 nt, Human
gcccgcccccgcccucgcuccgggugcgugaccggcccgccaccuuguacagaaccagcacucc

SEQ ID NO: 64570 - RNA, 58 nt, Human
cagccugcuauaccuacuaggguccaaugcccgccagccuagcuccagugcuucuagu

SEQ ID NO: 64571 - RNA, 64 nt, Human
ugccucagccuccugaguagcugggacuacaggcgcccgccaucacgccuggcuaauuuuuuuu

SEQ ID NO: 64572 - RNA, 64 nt, Human
cgccuccauggcucugcagauccucugggaagcggcccgccaccugugaccagcagcugaugcc

SEQ ID NO: 64573 - RNA, 64 nt, Human
ggacccaccuggccccuccucugacacagggcuggcccgccagguggccucccagcaagccagc

SEQ ID NO: 64574 - RNA, 64 nt, Human
aacugcagcugacacaucgcccgcccgcccgcccgcccgccaggcgcugcccugcaggugcucu

SEQ ID NO: 64575 - RNA, 64 nt, Human
ucucucggaacucccgcacccuccuuucucaccagcccgccaguuguggcaacccuguccuugu

SEQ ID NO: 64576 - RNA, 64 nt, Human
gcuagggaaacuucccgucccauauccugccucagcccgccaagguagccaucccaugaacaca

SEQ ID NO: 64577 - RNA, 64 nt, Human
agcucgucccggccuccaccaagccagccccgaagcccgccagccacccugccggacucgggcg

SEQ ID NO: 64578 - RNA, 64 nt, Human
ugccucagccucccgaguagcugagauuacaggcgcccgccaccaugcccggcuaauuuuugca

SEQ ID NO: 64579 - RNA, 64 nt, Human
ugccucagccucccaaguagcugggauuacuggcgcccgccaccaugccuggcuaauuuuuuuu

SEQ ID NO: 64580 - RNA, 64 nt, Human
ugcaaagugaaaagaugcuguggcaguuccugaagcccgccagagacagcucaggugcaaggag

SEQ ID NO: 64581 - RNA, 64 nt, Human
gacgugagagcugaauuguugcugcacgugcugggcccgccaaugccgucaucaucaggauuuu

SEQ ID NO: 64582 - RNA, 64 nt, Human
ccuguccucucuguguuccccaaaucagagaauagcccgccaucccccaggucaccugucugga

SEQ ID NO: 64583 - RNA, 64 nt, Human
ucagguggacccuccucuaaucuccuccugcugugcccgccaguccuugcccucccaccagguc

SEQ ID NO: 64584 - RNA, 64 nt, Human
gagaucuuaagauuccauuuuggaaaaugauuaggcccgccaaacuucugaacuuuggaagcug

SEQ ID NO: 64585 - RNA, 64 nt, Human
ccccuccccaugucccuccaggccucagccaccugcccgccacauccucugccugcuguccccu

SEQ ID NO: 64586 - RNA, 64 nt, Human
cagcugugccccugaaucaugggcacggagggccgcccgccacgccccgcgcucaacugcuccc

SEQ ID NO: 64587 - RNA, 64 nt, Human
accccaaccaaagcuaauggccuaguuggguccugcccgccaauaaucacccccacgggucaga

SEQ ID NO: 64588 - RNA, 64 nt, Human
gagggguugcccugaggucugacucuuggggcaagcccgccacccacugugggacuuucuggug

SEQ ID NO: 64589 - RNA, 64 nt, Human
ccgagcgagcggccggcgcgcucaucgccggggagcccgccagguggaccggcccgcgcuccgc

SEQ ID NO: 64590 - RNA, 64 nt, Human
ccuccagcgaaguccacgcucauccugguguguggcccgccaccacuaauccagacggcggcuc

SEQ ID NO: 64591 - RNA, 64 nt, Human
agccagacggccagacaggcagaccccuccagaggcccgccaggugggcauggucccccauuuu

SEQ ID NO: 64592 - RNA, 64 nt, Human
ugccucagccucccuaguagcugggacuacaggugcccgccaccaugcccggcuaaucuuuugc

SEQ ID NO: 64593 - RNA, 64 nt, Human
ugccucagccucccgagcagcugggacuacaggcgcccgccaccucgcccggcuaauauuuugu

SEQ ID NO: 64594 - RNA, 64 nt, Human
ugccucagccucccgaguagcugggauuacgggcgcccgccaccacgcccggcuaauuuuuugu

SEQ ID NO: 64595 - RNA, 64 nt, Human
cucuucccuggccagaugccugaucagaugagaagcccgccaugauacugucacagugccuaga

SEQ ID NO: 64596 - RNA, 64 nt, Human
gugcccagcugcugcuggcugggugggccagggagcccgccagcagaccccacacagcaugucc

SEQ ID NO: 64597 - RNA, 64 nt, Human
ugccucagccucccaaguaggugggauuacaggcgcccgccaccacgcccagcuaauuuuugua

SEQ ID NO: 64598 - RNA, 64 nt, Human
ugccucagccucccaaguagcuggguuuauaggugcccgccaccagacccggcuaauuuuuuag

SEQ ID NO: 64599 - RNA, 64 nt, Human
ccgugcacuuugucggauauaaaauaaaccacgggcccgccauggcguuagcccuuccuuuugc

SEQ ID NO: 64600 - RNA, 64 nt, Human
cugcaucuggaaacguaaccacucacagcaccuggcccgccaagguugggaggauuguacacua

SEQ ID NO: 64601 - RNA, 64 nt, Human
ugccucauucuccccaguagcugggauuacaggugcccgccaccacaccagccuaauuuuugua

SEQ ID NO: 64602 - RNA, 64 nt, Human
ugcaucagccucccgaguagcuaggauuacaggcgcccgccacuacgcccagcuaauuuguggu

SEQ ID NO: 64603 - RNA, 64 nt, Human
ccagacacgucuccuugggauucacuagcccccagcccgccaaaccccaccccagcccuacaca

SEQ ID NO: 64604 - RNA, 64 nt, Human
uucccugcccuccccugucccccucucgccgcccgcccgccaccaccacucucacuccacccag

SEQ ID NO: 64605 - RNA, 64 nt, Human
ucgcccugcccagcuacugaccucaggucgaggggcccgccagccaucagccaggguuggccua

SEQ ID NO: 64606 - RNA, 64 nt, Human
gccgcuagccuccggggcgccgcgucggggccgggcccgccaguucuuuuccggauucuguaga

SEQ ID NO: 64607 - RNA, 64 nt, Human
cuagcccagcgcucugccucaccgcuucccuccugcccgccacacagaccaccauccaccgcug

SEQ ID NO: 64608 - RNA, 50 nt, Human
gcccggccagcucgcccugagcccgccacagccaugagcagccgcuccca

SEQ ID NO: 64609 - RNA, 64 nt, Human
ugccucagccucccgaguagcugggacuacaggugcccgccaccacgcccagcuaauuuuuugu

SEQ ID NO: 64610 - RNA, 64 nt, Human
ccccgccuugggacaucgcaggccgggaagcagugcccgccaggccugggccaggagagcucca

SEQ ID NO: 64611 - RNA, 64 nt, Human
ugucaccuccugccaccugucagauacccagccugcccgccaucagccacccgagugguuccga

SEQ ID NO: 64612 - RNA, 64 nt, Human
caaagugcugggauuacaggcaugagccaccacggcccgccaaaaggcuuuaacccaugaacaa

SEQ ID NO: 64613 - RNA, 64 nt, Human
aacaccucagaccuucugaagcagcccauugcuggcccgccauguuguaauuuugcucauuuuu

SEQ ID NO: 64614 - RNA, 64 nt, Human
cacacacacacacugccucccauccuucccucaugcccgccagugcacagggaagggcuuggcc

SEQ ID NO: 64615 - RNA, 64 nt, Human
cagaacccaccagucuuucugggaacucacaccugcccgccaucuugguacuuuagguuaaucc

SEQ ID NO: 64616 - RNA, 64 nt, Human
gugggaccuuugggcaggguuugcccacugacacgcccgccauggggcacuggcugcauggggc

SEQ ID NO: 64617 - RNA, 64 nt, Human
cgacugcugcucgccgauccguggggcccccugugcccgccacacgcacgcacacacucuuaca

SEQ ID NO: 64618 - RNA, 64 nt, Human
cagccccccagcgacacuaugcaaauccuggagugcccgccaggaucgaagccaugacugggug

SEQ ID NO: 64619 - RNA, 64 nt, Human
ggagguggggcagggcaugguccuuggaucaacagcccgccagcugauuggaugucuaggaaug

SEQ ID NO: 64620 - RNA, 64 nt, Human
uuucugcuucgagugcgugcggggccgcuaugaggcccgccagaggaagugccccaagugcaac

SEQ ID NO: 64621 - RNA, 64 nt, Human
gggccuguugguccccuguucagaauggagugcagcccgccagcggaaaguguucauucugcau

SEQ ID NO: 64622 - RNA, 64 nt, Human
cccggcuccgcccuggcacguguccuugcuggcggcccgccacaggcccccuucaauggccgca

SEQ ID NO: 64623 - RNA, 64 nt, Human
uagcgccgaggaacagugcugggcaccccgccuggcccgccaggacccacccugccaacaucaa

SEQ ID NO: 64624 - RNA, 64 nt, Human
ugccucagccuccgaaguagcugggauuacaggcgcccgccaccaugcccggcuaauuuuuugc

SEQ ID NO: 64625 - RNA, 64 nt, Human
ugccucagccucccgaguagcugggacuacaggcgcccgccaucacgcccggcuaauguuuugu

SEQ ID NO: 64626 - RNA, 64 nt, Human
ugcuucagccuccugaguagcugggacuacaggcgcccgccaccaugcccagcuaauuuuuugu

SEQ ID NO: 64627 - RNA, 64 nt, Human
cccaccagggagaaaagaagccaugagaggcagcgcccgccacccuguguccacagcccccacc

SEQ ID NO: 64628 - RNA, 64 nt, Human
gggagugacccagcuacugaaccagccacgaacagcccgccagaggccugaagcugagcgugua

SEQ ID NO: 64629 - RNA, 64 nt, Human
agcccccugcacugagggagcaaguugcccacaugcccgccagccagggccuaaagcagauggc

SEQ ID NO: 64630 - RNA, 64 nt, Human
ggccucugcggagcacacuggcucacccaguccugcccgccaccguuaucggugucauucaccu

SEQ ID NO: 64631 - RNA, 64 nt, Human
gcugucagucaccagaguggccgcucagugcccagcccgccagccucgcucuuggaggcugcuc

SEQ ID NO: 64632 - RNA, 64 nt, Human
aaaaagaacaaauacacguauguuauaaccaucagcccgccagggucagggaaaggacucaccu

SEQ ID NO: 64633 - RNA, 64 nt, Human
agaaugcagcccaccaggagcaccuggacccccugcccgccacaugguguggccaucacucagc

SEQ ID NO: 64634 - RNA, 64 nt, Human
caccucagccuccugaguaggugggauuacagaugcccgccaccacacccaguuaauuuuugua

SEQ ID NO: 64635 - RNA, 64 nt, Human
ugccucagccuccagaguagcuggaacuacaggugcccgccacuaugcccagcuaauuuuugua

SEQ ID NO: 64636 - RNA, 64 nt, Human
ugggacuauuccccacccccggucccccauugaggcccgccacccccauaacuuugggagcgag

SEQ ID NO: 64637 - RNA, 64 nt, Human
ugaggaaucccgggcgccggcaaggccccccucagcccgccagcugaggggucccacggggcag

SEQ ID NO: 64638 - RNA, 64 nt, Human
cccugggguggagugacaaaccgcauuguccugugcccgccauggcagaagcgcagccuuugua

SEQ ID NO: 64639 - RNA, 64 nt, Human
cggccuaggggaggggugagacgcucgcugccgugcccgccacaccaagauguuggggcugccu

SEQ ID NO: 64640 - RNA, 64 nt, Human
agggcagggcggcuaggccggccagcucccccuugcccgccagccaguggccgaaccccccacu

SEQ ID NO: 64641 - RNA, 57 nt, Human
cccccucggacugcgggugacggcccugcccgccaccagaccccuaaaucuuggcca

SEQ ID NO: 64642 - RNA, 51 nt, Human
gcgagggcacccggcagugacgcccgccaccaccacgcagccgccgccgcc

SEQ ID NO: 64643 - RNA, 64 nt, Human
cugccucagcuccccaguagcugggacuacaggcgcccgccaccacgcccagcuaauuuuuugu

SEQ ID NO: 64644 - RNA, 64 nt, Human
cagccaugaauguagcgccccaggcccugccccagcccgccaugccacaaggugggggaggccc

SEQ ID NO: 64645 - RNA, 64 nt, Human
ccugagcccuggcacccgcuggccgcccacccgcgcccgccacucggggccccugccgcgcauc

SEQ ID NO: 64646 - RNA, 64 nt, Human
ugccucagccucccgaguagcugggacuacaggugcccgccaccacacccagcuaauuuuuugu

SEQ ID NO: 64647 - RNA, 64 nt, Human
agugacuuccgauugaggccaaagaccccaagcugcccgccagcucugacugccccuugcgcuc

SEQ ID NO: 64648 - RNA, 64 nt, Human
acugccucagcuucccuaguaauggauuacaggcgcccgccaccacgccuggcuaauuuuugua

SEQ ID NO: 64649 - RNA, 64 nt, Human
ucuacuaugaaggugcccccaggucaccugugcugcccgccaucugcccacguggcuugcagug

SEQ ID NO: 64650 - RNA, 64 nt, Human
ugccucagccucccgaguagcugggacuacaggcgcccgccaccacgcccggcucauuuuuugu

SEQ ID NO: 64651 - RNA, 64 nt, Human
gggcauggcccaggaggagcggugagugcgagccgcccgccaaggcugcagggagcaccaccag

SEQ ID NO: 64652 - RNA, 64 nt, Human
aggaggagggcucagggagcugagaucccgacaagcccgccagccccagccgcuccuccacgcc

SEQ ID NO: 64653 - RNA, 64 nt, Human
ucccucagacuuccgaguggcugggauuacaggcgcccgccaccacaccagguugauuuuugua

SEQ ID NO: 64654 - RNA, 64 nt, Human
ugccucagccuccugaguagcugggacuacaggcgcccgccaccacgcccggcuaauuuuuuuu

SEQ ID NO: 64655 - RNA, 64 nt, Human
gcauccccuaauugcaguacacgguuccuuuuccgcccgccacccugccuuuccuugggggcag

SEQ ID NO: 64656 - RNA, 64 nt, Human
acgcagggacuccuaggggcccaguaaggacagugcccgccagggaccauguauguaucauggc

SEQ ID NO: 64657 - RNA, 64 nt, Human
ccagccccaggauggggcugcccugcacaccggugcccgccacaugccaacccucaccuccccg

SEQ ID NO: 64658 - RNA, 64 nt, Human
acgagggacuuugaugggcugggcccuccgcacggcccgccagcuggcuucgaggaaccuccag

SEQ ID NO: 64659 - RNA, 64 nt, Human
ugccucagcuuccccaguagcugggaccacaggugcccgccaccacacccaacuaauuuuugua

SEQ ID NO: 64660 - RNA, 64 nt, Human
agugaaguccggagcgcugggcggugcggagcgggcccgccacccuugcccacuucuccuucgc

SEQ ID NO: 64661 - RNA, 64 nt, Human
agucaggucucagugauaaagcgugcaccgugcagcccgccauggccguguagacccuaacccg

SEQ ID NO: 64662 - RNA, 64 nt, Human
uccuuccccggccccgagggccaaggggguccccgcccgccagugccaaagcgcccggucggag

SEQ ID NO: 64663 - RNA, 64 nt, Human
gagaggguguuugccagucugagugucccgcggugcccgccaacccgcuuccugacugaccuga

SEQ ID NO: 64664 - RNA, 64 nt, Human
acccgugguaagcgggacgagacaagcucccgaagcccgccagcuuccugcuccacucagcucc

SEQ ID NO: 64665 - RNA, 64 nt, Human
ggccaggccagguccucccugauggacgccugccgcccgccacccccaucuccaccccaucaug

SEQ ID NO: 64666 - RNA, 64 nt, Human
cguccgcgcgcagcucccucagcuucgcagcgccgcccgccaccccacaccucccacgcuaccg

SEQ ID NO: 64667 - RNA, 53 nt, Human
ccaugaaaauguacuugugaggggcccgccaggucaccuccccaaccugcucc

SEQ ID NO: 64668 - RNA, 64 nt, Human
aaagcaugccacagccacucgccuuccuacccccgcccgccauccccaguugcagggggaucug

SEQ ID NO: 64669 - RNA, 64 nt, Human
ugccucagccucccgaguagcugggauuaugggcgcccgccaccacgcccagcuaauuuuugua

SEQ ID NO: 64670 - RNA, 64 nt, Human
ugccucagccucuugaguagcugggacuacaggugcccgccaccacaccagcuaauuuuuguau

SEQ ID NO: 64671 - RNA, 64 nt, Human
cccagagggcgagggggccucugagcagggcauggcccgccacagccacucaggccuccgugcu

SEQ ID NO: 64672 - RNA, 64 nt, Human
gagcacccacgugagagaaucugccuguggccuugcccgccagccucagugccacuugacauuc

SEQ ID NO: 64673 - RNA, 64 nt, Human
ugccucagccucccaaguagcugggauugcaggcgcccgccaccacgcccggauaauuuuugug

SEQ ID NO: 64674 - RNA, 64 nt, Human
gcggugagcaggggguucagcagcuugaccgaugccccccgagggggcucuccccagcuuaaac

SEQ ID NO: 64675 - RNA, 64 nt, Human
ccgggugacccucuagcucucucugcaucucccaccccccgacacccugggacccucgacccca

SEQ ID NO: 64676 - RNA, 64 nt, Human
ggaaacgccuccuucaugcagcggcggugcugggccccccgaggcugcaccuggcucucggcug

SEQ ID NO: 64677 - RNA, 64 nt, Human
gugaacaaucagauuagacacuauguguuagaguccccccgaccagauccuuuuccaucccacu

SEQ ID NO: 64678 - RNA, 64 nt, Human
uuugggggcguucgggagguuuggggggcaucaaccccccgacugugcugcucgcgaagguccc

SEQ ID NO: 64679 - RNA, 64 nt, Human
cucccaggagcagccccuggaugcccagcaggguccccccgaaccugcacaagagucucucuca

SEQ ID NO: 64680 - RNA, 64 nt, Human
aguggugccccaggugccaacaggauaaccucuaccccccgacuuugucucugggguccuguuc

SEQ ID NO: 64681 - RNA, 64 nt, Human
cgccuccuggguucaagugauucuucugccuccaccccccgaguggcugguauuacaagcacau

SEQ ID NO: 64682 - RNA, 64 nt, Human
gccuuacucgaucuuaccaccaccccucccccggccccccgacugagaacucgggccucucacc

SEQ ID NO: 64683 - RNA, 63 nt, Human
ggucgaguggcauuugguaaaggcauugccaagccccccgagugaggacgcaccgccgccacc

SEQ ID NO: 64684 - RNA, 53 nt, Human
ucaccaagucugcccacuaagcuccccccgaccccugcaggcugucacaugac

SEQ ID NO: 64685 - RNA, 64 nt, Human
agugcugggaaggggcggcugcgagggguaucaaccccccgagucucucccugaaggggagcac

SEQ ID NO: 64686 - RNA, 64 nt, Human
gccgccgcgaccucaguguggcuuuuacaggacuccccccgagcaucagcagggaccccggcgg

SEQ ID NO: 64687 - RNA, 64 nt, Human
gccucccggguucacgccauucuccugccucagcccccccgaguagcugggacuacaggcgccc

SEQ ID NO: 64688 - RNA, 64 nt, Human
gggacugugacuacagcgcucccggcugagcgcgccccccgagccgccgacuugccgucucccc

SEQ ID NO: 64689 - RNA, 64 nt, Human
uuggccuccgcccucgguuccgccccgccccucuccccccgaccuuggggcuugugucgagccc

SEQ ID NO: 64690 - RNA, 64 nt, Human
uagggugguuggagggccuuuuuaauuuaauugaccccccgagguggucuuuuguuuuaaacag

SEQ ID NO: 64691 - RNA, 64 nt, Human
agggugggggccacucaccgacccgacacucucaccccccgaccuggcugagugcgaccaccac

SEQ ID NO: 64692 - RNA, 64 nt, Human
gccucccuggaguggagcagcccugaagccugugccccccgaccugcgggccgcuguuuugguu

SEQ ID NO: 64693 - RNA, 64 nt, Human
gucugucugacggcaggauggggagcuggagagcccccccgacccucagcguacccgccucacc

SEQ ID NO: 64694 - RNA, 64 nt, Human
cguguggccccaggccagugucugucaggaugguccccccgaggcgcucugggcaggcauccug

SEQ ID NO: 64695 - RNA, 64 nt, Human
agcgucagagccugcagacaacggagggcagcgcccccccgagaucaggacgaaggaccaccgu

SEQ ID NO: 64696 - RNA, 64 nt, Human
ggugaaacaggagggcuguuugccucugccccauccccccgacuguguucaggagucccaccuu

SEQ ID NO: 64697 - RNA, 64 nt, Human
gcugccgccgccgccgccgccgcugcccuuggguccccccgagucuccgggacugcccucucga

SEQ ID NO: 64698 - RNA, 64 nt, Human
acccucugggggccugcccaggggacccccugagccccccgaccggcuuagcugugaugggagu

SEQ ID NO: 64699 - RNA, 64 nt, Human
guacuguauauuaccuggugauaguugcuuuucaccccccgaguucaguuucuaggagccaaug

SEQ ID NO: 64700 - RNA, 64 nt, Human
uuacucauggcagccauguuugauugucacagagccccccgaauacucugucuauagugacaca

SEQ ID NO: 64701 - RNA, 64 nt, Human
auauuucauuuguaaacuauauuugaacgacauuccccccgaaaaauugaaauguaaagaugag

SEQ ID NO: 64702 - RNA, 64 nt, Human
gaggauuccuggaccgcuacugccccccaaacugccccccgagcuucuuccccaucaccgugcg

SEQ ID NO: 64703 - RNA, 64 nt, Human
ccccgcuggugacuaagcucgcagcaagcggcuaccccccgaucugcaaaagggccucucccuu

SEQ ID NO: 64704 - RNA, 64 nt, Human
cugcuuucacugcugcacccgcgcccucggccggccccccgagcagccuuuguacucugcuugc

SEQ ID NO: 64705 - RNA, 64 nt, Human
gaucaccaccgagcuggccgagcaccgcucauauccccccgacaagaaggucaaagccaaggac

SEQ ID NO: 64706 - RNA, 64 nt, Human
ccugcccggcccucccuggcgccccagcccagugccccccgaagggccaaaugccaaguccacu

SEQ ID NO: 64707 - RNA, 64 nt, Human
uuggggugcuccuugcaacgucuuaagcaagcgaccccccgacauagcaaaagguggcaaccca

SEQ ID NO: 64708 - RNA, 64 nt, Human
agggaagaagaaggggcucccuccucuucacauuccccccgaccccaaagccagagaaagccag

SEQ ID NO: 64709 - RNA, 64 nt, Human
gaguucuuuacuggauuuuuuaaaaaccugugaaccccccgaaacuguaugugaaaguugagac

SEQ ID NO: 64710 - RNA, 64 nt, Human
agcauaaggagagucgcaucagagcuuuucacagccccccgaaaccccagccugguuuugaugg

SEQ ID NO: 64711 - RNA, 64 nt, Human
ggcugcucucccaggggccagguggagagcagugccccccgacacauguauucucaucuguggu

SEQ ID NO: 64712 - RNA, 64 nt, Human
ggaggaagguucucuuugcgcuugccuucucacaccccccgacuccccacccauauuuugguac

SEQ ID NO: 64713 - RNA, 64 nt, Human
ucgcggaagccgacuggcagccaggccugucgggccccccgacgccgccccauuucccuuccag

SEQ ID NO: 64714 - RNA, 64 nt, Human
gguuggucaaggagggaugugagggaaauagggaccccccgacuugcccuccugccucagucuu

SEQ ID NO: 64715 - RNA, 64 nt, Human
ggaaaaggguugcuuggaggaccugggguggcagccccccgaccagaagcacccuauuuuauag

SEQ ID NO: 64716 - RNA, 64 nt, Human
gagaguuggggagaaacugaagccguguuuuuggccccccgaggcuaacccugauccauagugc

SEQ ID NO: 64717 - RNA, 64 nt, Human
cagggaaguucacccccccccaccacccccccgcccccccgaagccaugucacugaaaaggccu

SEQ ID NO: 64718 - RNA, 64 nt, Human
cacuagacuuguagcaggccugggcugcaggcuuccccccgaccauucccugcagccaugcggc

SEQ ID NO: 64719 - RNA, 64 nt, Human
ugcacuugcccccguggccgccaucauccccccgccccccgacguccagcccgugauugacaag

SEQ ID NO: 64720 - RNA, 64 nt, Human
gcuucucuaccccaccacacaaauuucccauuucccccccgaaaaccuugaucuuacccaugaa

SEQ ID NO: 64721 - RNA, 64 nt, Human
uaguuuucacuccagucaucauuuuccuaucucaccccccgaaacaccacccuaaaguuggauu

SEQ ID NO: 64722 - RNA, 64 nt, Human
aagacauugcaccagaugccauuacauuuauuggccccccgaccuuguagaaaaaccccuaccc

SEQ ID NO: 64723 - RNA, 64 nt, Human
cgagggucuccgcccaccccggccggacuuugauccccccgaagucuucacaggcacugcaucg

SEQ ID NO: 64724 - RNA, 64 nt, Human
auuguagggaugugcagggcugggaguuggcacuccccccgaguggggaggugacagcuuguca

SEQ ID NO: 64725 - RNA, 64 nt, Human
uuccucaagucuagccucaggagaccugccccucccccccgaccuccacccccucagacuccau

SEQ ID NO: 64726 - RNA, 64 nt, Human
ggcaccugcuuucccaccucgaggccgcggccucccccccgauuuauagacaacucugacauug

SEQ ID NO: 64727 - RNA, 64 nt, Human
uuucaaaaauacauccuuuucugugucaugaaaaccccccgaagccauugacuucaucuuaccu

SEQ ID NO: 64728 - RNA, 64 nt, Human
ugccucccuugccccuaccccggcgaagcauguuccccccgacgccccccuuggcacaagucag

SEQ ID NO: 64729 - RNA, 64 nt, Human
gagggauagaaggaaggaaggaaggaacccccccccccccgaaaaaaaaaucaaagcgggaaga

SEQ ID NO: 64730 - RNA, 64 nt, Human
uuuccauguaaucagagcauuagcugcagaaaaaccccccgacagagcccuggcggagaggcag

SEQ ID NO: 64731 - RNA, 64 nt, Human
cugggccuugccugcugugccugcugcugcugggccccccgaucagaccucaaggacaggugaa

SEQ ID NO: 64732 - RNA, 64 nt, Human
uauaggaaaagccucuuuccacagacuuaggaagccccccgaccacgcggacgcucgcugggcu

SEQ ID NO: 64733 - RNA, 64 nt, Human
uuuggggacucggccucagcgucacccugagauuccccccgagacacagugcgcuaguacggcu

SEQ ID NO: 64734 - RNA, 64 nt, Human
acgggggcccagacaguacucuccaguucuggggccccccgagugaggagggaacgggaagucg

SEQ ID NO: 64735 - RNA, 64 nt, Human
ugccggugggacccuguccggcccagugccacugccccccgaggcugcuagauguagguguuag

SEQ ID NO: 64736 - RNA, 64 nt, Human
ugggaucacagcugcaggccacgcccagcuuccuccccccgacuccccccccagagacacgguc

SEQ ID NO: 64737 - RNA, 64 nt, Human
aagaggggucuuggagcuccuauggagcagacugccccccgagcaguguccccagccuagcccu

SEQ ID NO: 64738 - RNA, 64 nt, Human
caggggcccccacccgucaccacgccccaacacuccccccgaaccagagccgugcacuugugcc

SEQ ID NO: 64739 - RNA, 64 nt, Human
gaaacgcgccccaucccuuccgccgccuccuuucccccccgacccuauucagguuuuaagucaa

SEQ ID NO: 64740 - RNA, 64 nt, Human
gggauugcacuuacucuuucaucacggaaacagaccccccgagagaagccccaacgagauuuuc

SEQ ID NO: 64741 - RNA, 64 nt, Human
cguccuuuucaaaaguguuuuggagcuuucugugccccccgacuuucccccgccuccccgcccc

SEQ ID NO: 64742 - RNA, 64 nt, Human
cuacuggacccuuguaaucugauuuggagaccauccccccgaugggaccagcagccccgccggc

SEQ ID NO: 64743 - RNA, 52 nt, Human
cucaugacuucaugaucugaauccccccgagucauucauucuccaugaaguc

SEQ ID NO: 64744 - RNA, 64 nt, Human
cugggggccucccccacgccccccaggacaguguccccccgagugacuccgcagcuucugacac

SEQ ID NO: 64745 - RNA, 58 nt, Human
cugcgccccccgugcccuaggccgggggccccccgaugccuuggcagugccagccacg

SEQ ID NO: 64746 - RNA, 64 nt, Human
acaugggggcuaugcuggggaaagcagccaugcuccccccgaccuccagccgagcauccuucau

SEQ ID NO: 64747 - RNA, 64 nt, Human
cccccucgcuggcacugacuuugccuugaacagaccccccgacccucccccacaagccuuuaau

SEQ ID NO: 64748 - RNA, 64 nt, Human
aacucagagagggcgcggcccccggggauuccccccccccgagggugcccaggacucgacaagc

SEQ ID NO: 64749 - RNA, 64 nt, Human
agcagugggggugucuguggagugcaugacucagccccccgacucgcagccuuaauaaagcgau

SEQ ID NO: 64750 - RNA, 64 nt, Human
ccuggcuuucugaguccaggugagagcuguguggccccccgaugccacucugcccgccggaggg

SEQ ID NO: 64751 - RNA, 64 nt, Human
gguucaggcuaugcugcuuugggcagguggagcaccccccgaggaagccugcaaguccagggca

SEQ ID NO: 64752 - RNA, 64 nt, Human
aacgcuagcugccugcucuuccuuaagauggccuccccccgacccgccacggcccucaguugcc

SEQ ID NO: 64753 - RNA, 64 nt, Human
ugggcccagaguguggcgguccccaugguggcagccccccgacugaucauccagacacaaaggu

SEQ ID NO: 64754 - RNA, 64 nt, Human
cuuuuagaguggaacugggcauguccuccgccuaccccccgagccuguauuuauuuuuguauaa

SEQ ID NO: 64755 - RNA, 64 nt, Human
ggccguuggccacgucuuccuucugccugagcuuccccccgaccacaggcccuuuccucaggca

SEQ ID NO: 64756 - RNA, 64 nt, Human
uugaucuuucaaaggcagcuaauugcuagcaaauccccccgauuccggccuuuucccucuauuu

SEQ ID NO: 64757 - RNA, 64 nt, Human
ucugcaggaggccgagugacagccagcccuggaaccccccgacccccgcagcugcugcagccag

SEQ ID NO: 64758 - RNA, 63 nt, Human
uccaugcucccagaaucaagcauaaaugccagacacggcgauugagaagccaaucagugaacc

SEQ ID NO: 64759 - RNA, 63 nt, Human
uaagauuucaguuugaaaucuuagauuucaguucacggcgauaaagaaguaggugcugcacac

SEQ ID NO: 64760 - RNA, 63 nt, Human
guaccaaaggugugaaggaaagaagacaccgaccacggcgaagcaauagagggggugcuggag

SEQ ID NO: 64761 - RNA, 63 nt, Human
ggcacccacagcuuaaagacgcuuccuucuaaacacggcgaggucaccucucacucuucuguc

SEQ ID NO: 64762 - RNA, 63 nt, Human
gaaccucacucuguaauaacaaugaggaauagccacggcgaucuccagcaccaaucucuccau

SEQ ID NO: 64763 - RNA, 63 nt, Human
ugggacagguggagaaggaaguaggaaugagugcacggcgaccccgugcuccucagggcccuc

SEQ ID NO: 64764 - RNA, 63 nt, Human
ugucuagccaugacgagaagauucccucugcaucacggcgaaccccaggagaugguauugaaa

SEQ ID NO: 64765 - RNA, 63 nt, Human
gccuggaaagggggugaagggaagugucugaugcacggcgagugaacaccguuggcgccgagg

SEQ ID NO: 64766 - RNA, 63 nt, Human
cugauggugccaggaaagccacuggaauugucacacggcgagcacagagggccggccaccagu

SEQ ID NO: 64767 - RNA, 63 nt, Human
ccguguuuccaaaagugccuuuggcccaggcuccacggcgacaguugggcccaaaucagaaag

SEQ ID NO: 64768 - RNA, 63 nt, Human
cccuccuugugccuucuuuguauauaggcuucucacggcgaccaauaaacagcucccaguuug

SEQ ID NO: 64769 - RNA, 63 nt, Human
ggcccucucugcacacauccucaagugaccccgcacggcgagacgcggguggcggcagggcgu

SEQ ID NO: 64770 - RNA, 63 nt, Human
ugggguaaccuggggggcucagcaauggugcugcacggcgagguggugucccccuuuguccuc

SEQ ID NO: 64771 - RNA, 63 nt, Human
ugcuggaugcuuguucuuuggccagccaagguucacggcgauucuccccaugggaucuugagg

SEQ ID NO: 64772 - RNA, 63 nt, Human
augagaucaggagaucgagaccauccuggcuaacacggcgaaaccccgucucuacuaaaaaua

SEQ ID NO: 64773 - RNA, 63 nt, Human
cuuuggcuuugggcagccuggcuguggaguuuccacggcgacacacagccucaguggugcaag

SEQ ID NO: 64774 - RNA, 63 nt, Human
gagccccaccacucucagaacccccgcccagcgcacggcgaccucgcgccucaccggaagacc

SEQ ID NO: 64775 - RNA, 63 nt, Human
agccuuggucuaccgugcugaccagggugaaggcacggcgagggacuccucccagacgugccu

SEQ ID NO: 64776 - RNA, 64 nt, Human
gucucccauguaccagagaaggaaaagucugaucccgaaacagcuugaacgaaaggugguuaac

SEQ ID NO: 64777 - RNA, 64 nt, Human
ucccuguagggagaagccugccaacagugaccuuccgaaacagccuucugaauacaaagaggau

SEQ ID NO: 64778 - RNA, 64 nt, Human
uguuuuguuugugcuaauuugggaauuguguacuccgaaacaaguagaaaagugcuguuugagg

SEQ ID NO: 64779 - RNA, 64 nt, Human
aagacagaaacaagcaaagccgccaccacagagcccgaaacaacccagccggaagggguggugg

SEQ ID NO: 64780 - RNA, 64 nt, Human
gcaagagacaggccccagggcuucuggcuagaacccgaaacaaaaggagcugaaggcagguggc

SEQ ID NO: 64781 - RNA, 64 nt, Human
cuuacacagcuucuuagcaauuuuuuuuuuuuugccgaaacaauaaauugccuuuagcagcagu

SEQ ID NO: 64782 - RNA, 52 nt, Human
augaugagacacauucauaggcccgaaacaccuuaaagacuucugucauuuu

SEQ ID NO: 64783 - RNA, 64 nt, Human
ggauagguguucaucuaagguuacaguuauguuaccgaaacacaaaacugccaaaaucuuacuc

SEQ ID NO: 64784 - RNA, 64 nt, Human
ccccacucaguaggucugaaggccuccauuuguaccgaaacaccccgcucacgcugacagccuc

SEQ ID NO: 64785 - RNA, 64 nt, Human
cggcucacgccuguaaucccagcacuuugggaggccgaaacaggcgaaucacuugagcccagga

SEQ ID NO: 64786 - RNA, 64 nt, Human
cuuaauccaugagcauuggauauugaaaagaaaaccgaaacaaaaccagacccagcccuacacu

SEQ ID NO: 64787 - RNA, 64 nt, Human
gucccuaaccccuuccccagcuugguguuuuaccccgaaacaggaaggaacagggguccuguag

SEQ ID NO: 64788 - RNA, 64 nt, Human
uccaggaugcuggcugguggaacaaccugcuggcccgaaacaaggcugccagguguggauaccu

SEQ ID NO: 64789 - RNA, 64 nt, Human
uuugggguguggggguggugaaagggaaguagaaccgaaacaagauuaguccugaguuaacaau

SEQ ID NO: 64790 - RNA, 64 nt, Human
ucugcagccaggugugugccacacggcagccuucccgaaacauaguauggauuuuaaaaaugug

SEQ ID NO: 64791 - RNA, 64 nt, Human
gggguucauagaaauaagugcaauuucuacacccccgaaacaauucaaagggaagcagcauuuc

SEQ ID NO: 64792 - RNA, 64 nt, Human
ucggcccucaagugcccgggccggccuucgugcuccgaaacaagagaccugggagcccucggga

SEQ ID NO: 64793 - RNA, 64 nt, Human
cgacugcccaggcacacugcccaccaccccacccccgaaacaaugccagcccgcugcuuuuucu

SEQ ID NO: 64794 - RNA, 64 nt, Human
uugccaagaagcauggcguagaaauuucuauguuccgaaacacagaguaguguccacaugugag

SEQ ID NO: 64795 - RNA, 64 nt, Human
cugguugaguucagguagcugccccuggcucugaccgaaacagcgcuggguccaccccauguca

SEQ ID NO: 64796 - RNA, 64 nt, Human
gcuucuccugacccaguccccgugccccgccuccccgaaacaggcuacucuccucggcccccuc

SEQ ID NO: 64797 - RNA, 64 nt, Human
gacaaguccaaggucacgaagacuuucuuggagcccgaaacaccacccucugcuccuccuucuc

SEQ ID NO: 64798 - RNA, 64 nt, Human
auguguaaugcagguuaauuacaacacagauguaccgaaacacuuaauugugaaccgcuaacau

SEQ ID NO: 64799 - RNA, 64 nt, Human
acucuucucaacucuguuuugcuaugcuauaauuccgaaacauacaagacaaaaaaaaugaaga

SEQ ID NO: 64800 - RNA, 64 nt, Human
uuucacuccagucaucauuuuccuaucucaccccccgaaacaccacccuaaaguuggauuuuua

SEQ ID NO: 64801 - RNA, 64 nt, Human
gggauuuaucuggaucucugugguuccuucucagccgaaacagguccaguaucccagucauuuc

SEQ ID NO: 64802 - RNA, 64 nt, Human
guguuaggauuccgaugcaacaccaugcaaaaccccgaaacagcugcuuugccguccguccacu

SEQ ID NO: 64803 - RNA, 64 nt, Human
ccucacccccagcuggaaauuaagaaaaagucgcccgaaacaccaagugaggccauagcaauuc

SEQ ID NO: 64804 - RNA, 64 nt, Human
gugcuaaaguuuucuucccagagagagcauaauuccgaaacaaaacugugacaaucuuuugggu

SEQ ID NO: 64805 - RNA, 64 nt, Human
acuucagcuugggcaacagagcaagacccugucuccgaaacaaauaaaaaauacuguaauaaaa

SEQ ID NO: 64806 - RNA, 64 nt, Human
acacaauuuccuaucagaauaugucccucaacccccgaaacaaggcuucucucagccuccccac

SEQ ID NO: 64807 - RNA, 64 nt, Human
ucugcuagucaggauugauaaacagcugggcacaccgaaacaguguaccaacgaauucaccaac

SEQ ID NO: 64808 - RNA, 64 nt, Human
cgcuucauccccaccgucccacuccacagccuucccgaaacauucccuggcaaacaaaggaaca

SEQ ID NO: 64809 - RNA, 64 nt, Human
cucuuccucaaugcacucugcuucuuccguucuuccgaaacauucagcugacuguauccagggc

SEQ ID NO: 64810 - RNA, 64 nt, Human
ucugaagcugcuuccucuuauaaaauagcuuuugccgaaacauaguuuuuuuuuagcagauccc

SEQ ID NO: 64811 - RNA, 64 nt, Human
ugacccccaagaucuccuucccguggaaugaaauccgaaacaucucguacagugacaaggaggu

SEQ ID NO: 64812 - RNA, 64 nt, Human
aacucuggccccaggcccuguucuguuauccaauccgaaacacggaacaugcugcaauucagga

SEQ ID NO: 64813 - RNA, 64 nt, Human
aaucuuaucaaaccaugguuguauaugcaguugaccgaaacauuguuauuggacacauaacuau

SEQ ID NO: 64814 - RNA, 64 nt, Human
ccuuuggaaaaccaaacuaguaucagaacaaaccccgaaacaguaagaaauuggagugagaagg

SEQ ID NO: 64815 - RNA, 64 nt, Human
guucugagaugaguauuuuauucguguucuguuuccgaaacacuuagcaaagaaggucacagug

SEQ ID NO: 64816 - RNA, 64 nt, Human
ucuucucccaaaggggacccaaggcugugacacuuaccuccacccccauccagcacccuucagc

SEQ ID NO: 64817 - RNA, 64 nt, Human
cuggagacccccaaccuucugauaaaagagucucuaccuccagggaaagccuucuuaccacacu

SEQ ID NO: 64818 - RNA, 64 nt, Human
gcagggggcagaaucuuuuuuucacuuggccugcuaccuccauuaaaaaaccauucucuuacag

SEQ ID NO: 64819 - RNA, 64 nt, Human
ggccacccuaagaggaaaggcuacuucaccucauuaccuccagagggcugggcagggccaagug

SEQ ID NO: 64820 - RNA, 64 nt, Human
cuccauucauccuuccauccaucuuuccauccauuaccuccauccauccuuccaacauauauuu

SEQ ID NO: 64821 - RNA, 64 nt, Human
cccagcgcucccaagccuuccuccuuccagcuucuaccuccaugcuagcauugcugguguuaga

SEQ ID NO: 64822 - RNA, 64 nt, Human
acugauagaaaggacuucaacgccagugacuguguaccuccagcagaagaaaaucaggugucug

SEQ ID NO: 64823 - RNA, 64 nt, Human
uguuauuuacauucugguggguuuuuaaaauucuuaccuccaucaugcaauuuugaaaauugug

SEQ ID NO: 64824 - RNA, 64 nt, Human
guuuuuaaauaacuguacuuguacucacucacccuaccuccagggcauagucagucugggcuga

SEQ ID NO: 64825 - RNA, 64 nt, Human
gacugggauguucacgcagcacuccauuacucaguaccuccauacccagcccuauacgcagacc

SEQ ID NO: 64826 - RNA, 64 nt, Human
uggggucuccccucacauuggggagcuugcccuuuaccuccagggcugcugcugccuggguauc

SEQ ID NO: 64827 - RNA, 64 nt, Human
cauucucugucuccuucucgucggucuaccccacuaccuccaggguuuugcuuuguccuuuugu

SEQ ID NO: 64828 - RNA, 64 nt, Human
ugcucuccuggcacccagagaaaaggagcauccuuaccuccaaaagcacagggacacaaagagg

SEQ ID NO: 64829 - RNA, 64 nt, Human
uucagucucauuuagaugauagucccuuuuuuucuaccuccauauuagagauggagcuccuucc

SEQ ID NO: 64830 - RNA, 64 nt, Human
ucuucaaacucugugagguagaauccuuugucuauaccuccaugaacauugacucguguguuca

SEQ ID NO: 64831 - RNA, 64 nt, Human
aagaugcuccccaucccacugacugcuugaccuuuaccuccaacccuucuguucaucgggaggg

SEQ ID NO: 64832 - RNA, 64 nt, Human
gcucccuuuucccccaguuuugggacacugugcuuaccuccaaaaaucucaucucuucccuggc

SEQ ID NO: 64833 - RNA, 64 nt, Human
uggccuggggaaggaggcggggagggcuccuuucuaccuccagugcccugagccuccaguccgu

SEQ ID NO: 64834 - RNA, 64 nt, Human
gauuauucauccagggccuucucaaugagcacauuaccuccaugaucaauaaccaagaggcugc

SEQ ID NO: 64835 - RNA, 64 nt, Human
gaaggcaggauaagugaccacauauuuaugccacuaccuccaccagggagaguccuucuccaca

SEQ ID NO: 64836 - RNA, 64 nt, Human
gagaggucuauuuaaaaaaaaagucagagacagauaccuccaacccugccgucaccaccacccc

SEQ ID NO: 64837 - RNA, 64 nt, Human
cagugccaacaccaaacugacacaucuccagguguaccuccaacccuagccuucucccacagcu

SEQ ID NO: 64838 - RNA, 64 nt, Human
guuugccagccggaucacauuacauggcuucaucuaccuccaggcuucuccccagguaacacug

SEQ ID NO: 64839 - RNA, 64 nt, Human
augucuucauaaaguacuugaguguaauguuuguuaccuccaacagaacuaaauguucuauggu

SEQ ID NO: 64840 - RNA, 64 nt, Human
ugaucuccuuuuugccuuguacugaaugacacauuaccuccacacucucccggacuaggugguc

SEQ ID NO: 64841 - RNA, 64 nt, Human
uguguguaugugugugcguguuugugugcguguuuaccuccacaggggacacucuacacucagu

SEQ ID NO: 64842 - RNA, 64 nt, Human
ugugacacucaagccccucucauuuuuaucugucuaccuccauucugaagagggagguuuuggu

SEQ ID NO: 64843 - RNA, 64 nt, Human
ucccaaccauuaugcuguacuaucuacccauaaauaccuccaggaaacauuccccucuugguaa

SEQ ID NO: 64844 - RNA, 64 nt, Human
cccuugggccuucaaggugccaggccugccccaguaccuccagagccucaccagacuagccauu

SEQ ID NO: 64845 - RNA, 64 nt, Human
uugaaauaugcaaaagguaugaggaauguuuuaauaccuccaaauuuuuaagaaaagcaucaaa

SEQ ID NO: 64846 - RNA, 64 nt, Human
gguucuaggguggguuuacagcuuuuuguacuuuuaccuccaauaaagggaaaaugaagcuuuu

SEQ ID NO: 64847 - RNA, 64 nt, Human
ggucuggccagccagggcuggugcuguccccgccuaccuccacuuccuuucccuugcucacucu

SEQ ID NO: 64848 - RNA, 64 nt, Human
aaaugagcuagaggaagaugaggggggaugcgaguaccuccaagaagaaaaaucacacucugaa

SEQ ID NO: 64849 - RNA, 64 nt, Human
ggggccacaccaaccuucugaggagcuguugagguaccuccaaggaccggccuuugcaccucca

SEQ ID NO: 64850 - RNA, 64 nt, Human
agacaaaagcaugguuaauauauauacuuaauauuaccuccaaugacucgggaauugccuguaa

SEQ ID NO: 64851 - RNA, 64 nt, Human
cguggggucugaaagcaccaagggucccugccccuaccuccacugccagacccucagccugagg

SEQ ID NO: 64852 - RNA, 64 nt, Human
cuaauaaccuacugggaaagauggaggucuaaauuaccuccaggguuuuucuggggguuuauca

SEQ ID NO: 64853 - RNA, 64 nt, Human
gugcucugcuccagaaacauguguguggcuucccuaccuccacaccaaggagcugccuugcugg

SEQ ID NO: 64854 - RNA, 64 nt, Human
agccauuauggauggaugaaggauaguaaugcaauaccuccaccuuaauuugggugcaugugua

SEQ ID NO: 64855 - RNA, 64 nt, Human
ccauuugacauccucucuggauucccaaggagcauaccuccaaaauccgagaagagcaaaucag

SEQ ID NO: 64856 - RNA, 64 nt, Human
guuaaaauagaaccuccagguaguuuucuuccucuaccuccacauccccccaagacugaaaaga

SEQ ID NO: 64857 - RNA, 64 nt, Human
accacugcggcaagaggaccccagcuggggugcuuaccuccaguaugaagugaauugcaaaucc

SEQ ID NO: 64858 - RNA, 64 nt, Human
ucauaacucugaagauggacucuaaacuuugguuuaccuccauggaaaauaaagauuuagaaac

SEQ ID NO: 64859 - RNA, 64 nt, Human
gcuuuagaaaugucaguauuuuuguaauuauuucuaccuccaaauauauauauauugucuuuca

SEQ ID NO: 64860 - RNA, 64 nt, Human
uuccuccuccgaggcucugggcugcacccacagguaccuccacacuugggaguuaccaucauca

SEQ ID NO: 64861 - RNA, 64 nt, Human
cuuuuuaaggucagguugguuccuggcaaaaauguaccuccaggggccuccaagcauaggauuu

SEQ ID NO: 64862 - RNA, 63 nt, Human
aagagacaaauauugcuuaaaaggcuaugaaguuaccuccagguugguggcaagcugcaaagu

SEQ ID NO: 64863 - RNA, 64 nt, Human
guagaaggagagauuugcuugauuuguuaacuucuaccuccaacccacaaaaaagauauuugau

SEQ ID NO: 64864 - RNA, 64 nt, Human
cuaagagguuuuaaaaccccuacccuccuugguuuaccuccaucauuaaaaaacaacaaugaca

SEQ ID NO: 64865 - RNA, 64 nt, Human
aaagaacaauaguuucaucauaauacauuauguuuaccuccaucauaguugcuuuuuucauagu

SEQ ID NO: 64866 - RNA, 64 nt, Human
augaaaaggugaauccuuaaaaaacuacaucuguuaccuccaacuugucagucaugaucaauca

SEQ ID NO: 64867 - RNA, 64 nt, Human
cugauaacuuauuuguauaauuggaguggagaccuaccuccauaauuagauaaacucuuuuugg

SEQ ID NO: 64868 - RNA, 64 nt, Human
cuacauuucuuuuuuauuauuaugaagaaugggauaccuccagguuccaguaaaauucuucuga

SEQ ID NO: 64869 - RNA, 64 nt, Human
cuuuucuaagggacauuaucuuccuucagguuuuuaccuccacucauccuuagagcccacugac

SEQ ID NO: 64870 - RNA, 64 nt, Human
agggauucuaaacuuuccuuccguccucaauuucuaccuccauagaccggccagaauuuagcuu

SEQ ID NO: 64871 - RNA, 64 nt, Human
guuuuggguuucuggucuacuuugacuuucaaaguaccuccagccuccucauacgcacagcuuu

SEQ ID NO: 64872 - RNA, 64 nt, Human
uaauuuacuguauauaauaucuugaguuuguuuauaccuccaaguuuuuacacugaagauaaac

SEQ ID NO: 64873 - RNA, 64 nt, Human
ucauguauuauaugugcuguaacaucauguacguuaccuccaucuauuuuaggauauuuuccuc

SEQ ID NO: 64874 - RNA, 64 nt, Human
uggggaaaaaagaugaaaaacuugaacuacaaauuaccuccauguauauuauuggccauaguua

SEQ ID NO: 64875 - RNA, 64 nt, Human
uaauacauuuuuagacaagcaaagacucagggguuaccuccaugugcccuuuuuagggaagcug

SEQ ID NO: 64876 - RNA, 64 nt, Human
aaagugcauuuauuuuuauacagaguuacuuaauuaccuccaaaacacauauguuggaaaucgc

SEQ ID NO: 64877 - RNA, 64 nt, Human
ccagcacauuguuagacccaucuuaauuaagccuuaccuccauguaaagaacagcacgucuguu

SEQ ID NO: 64878 - RNA, 64 nt, Human
uccagcuuuuccccuggggcuccaggaccuucccuaccuccaccaccaaaccaagggauuuaua

SEQ ID NO: 64879 - RNA, 64 nt, Human
auauuugacuguugagaauuuuacugccgaaguuuaccuccacuaguucuuuguagcagaguac

SEQ ID NO: 64880 - RNA, 64 nt, Human
ccugcgaggucaagcugcagagaacaugagcuucuaccuccagaugugccagggugcaucucgu

SEQ ID NO: 64881 - RNA, 64 nt, Human
cacccaccugcuccuuugaccccuggacuugguauaccuccauguggaguuguugggcgagagg

SEQ ID NO: 64882 - RNA, 64 nt, Human
auucauauguuaaguggcagaauagccuuagugcuaccuccacuuuuuucuccaguauuugcau

SEQ ID NO: 64883 - RNA, 64 nt, Human
ugcagucugucucaucuguugggaaccugugauauaccuccauuuguccacaagaugguguuua

SEQ ID NO: 64884 - RNA, 64 nt, Human
gauauucuagacuuguuuuaguaauggaaacucuuaccuccacauauuauccuacagauguuuc

SEQ ID NO: 64885 - RNA, 64 nt, Human
cuagauuuguuucuguuuuauagauuuaauucaauaccuccacauagauguuuuuauauuacau

SEQ ID NO: 64886 - RNA, 64 nt, Human
ucuauuaaauugcugccagaauuuuacauccaguuaccuccacuuucuagaacauauucuuuac

SEQ ID NO: 64887 - RNA, 59 nt, Human
aaucugacucuauuauuuaauaucuuacauaccuccaccagacuggacuugcuuuuuga

SEQ ID NO: 64888 - RNA, 64 nt, Human
cccuuauuugacaaaaagucaaauguguauguucuaccuccaacggaaauguuuacaaggucaa

SEQ ID NO: 64889 - RNA, 64 nt, Human
uuagauugugccucaaaguuguaguaccucacaauaccuccacugguuuccuguuguaaaaacc

SEQ ID NO: 64890 - RNA, 64 nt, Human
gcuacugcuaaacuuggcacaguaucaaguauaguaccuccaaggaccagggcugggaagucuu

SEQ ID NO: 64891 - RNA, 64 nt, Human
caagaauaaauaauaggaaagugauuacaaauauuaccuccaggguucaauagaaauccucaau

SEQ ID NO: 64892 - RNA, 64 nt, Human
uugcagaccaagaaaaaauaaagaaaagaugauuuaccuccaaguucagaaacuagacauucca

SEQ ID NO: 64893 - RNA, 64 nt, Human
aacagcugucucaaggucuguguauaucuccacauaccuccauuacuaacaaugaaauaugaau

SEQ ID NO: 64894 - RNA, 64 nt, Human
gagcuuugccaaggacaucgcaucagggauggccuaccuccacuccaugaacaucauccaccga

SEQ ID NO: 64895 - RNA, 64 nt, Human
ucagggcacuucuuguccucucugucccauaaccuaccuccacccucccccuagccagccaggc

SEQ ID NO: 64896 - RNA, 64 nt, Human
uacaggagauucucuuucuucgcugaagugugacuaccuccacucaugucccauuuuagccaag

SEQ ID NO: 64897 - RNA, 64 nt, Human
uaguccugcggugauauucuaucugcaguauuuguaccuccagaauggcagaucccucagcagg

SEQ ID NO: 64898 - RNA, 64 nt, Human
uaucguauucauaaacaauaucuaucaaauggguuaccuccaaauaugaaaaucuauaacaacc

SEQ ID NO: 64899 - RNA, 64 nt, Human
cuauaccucauccgacacaaauggggaugauaccuaccuccaggguuggcgugaggauucaugg

SEQ ID NO: 64900 - RNA, 64 nt, Human
gcugucauuaaggagagggagaaauguagaguguuaccuccaacucauuugauuucccuuacuu

SEQ ID NO: 64901 - RNA, 64 nt, Human
aagcaaacuaagccugcauuuauaucugaauuauuaccuccauauuuuaccaaacauuugaaug

SEQ ID NO: 64902 - RNA, 64 nt, Human
ccacugcagucggccuugccuccuccuccuccucuaccuccagucaggcuggacgggaggguag

SEQ ID NO: 64903 - RNA, 64 nt, Human
aacaggaugaaaguucccccaucaguucccccaguaccuccaagcaaguagcuuuccacauuug

SEQ ID NO: 64904 - RNA, 64 nt, Human
gucuuagccuugcaugcguugugggcaucaaaucuaccuccaaaagacccauccuggggagccc

SEQ ID NO: 64905 - RNA, 64 nt, Human
cauguccucaucugcccacccuccccaacccacauaccuccauuccacuugugacacccccucg

SEQ ID NO: 64906 - RNA, 64 nt, Human
aauuaacaucaagccacacuaaaaaguucugcuguaccuccaguggaugcuguuucucaguauu

SEQ ID NO: 64907 - RNA, 64 nt, Human
cacacuggacuuuucuagagauggacagcuugguuaccuccaccuuccugcacucauucucaaa

SEQ ID NO: 64908 - RNA, 64 nt, Human
auccugguaauuaaaaguuuggguguauuuucuuuaccuccaaggaaagaacuacuagcuacaa

SEQ ID NO: 64909 - RNA, 64 nt, Human
ucccaggaagaugggcagagacuugaguggcgauuaccuccagcacagagacgugccaggcggu

SEQ ID NO: 64910 - RNA, 64 nt, Human
acucccuugggucaagacaguacucaacggccacuaccuccacgcuucccagagccugcggcuu

SEQ ID NO: 64911 - RNA, 64 nt, Human
uucagaauaguuaaguaaaacauuagcuguuuuauaccuccaaaauaucuucugcauuauauau

SEQ ID NO: 64912 - RNA, 64 nt, Human
aaggacucagcugaggggccccucugcccccuucuaccuccaccucagcacccucccccagcuu

SEQ ID NO: 64913 - RNA, 64 nt, Human
uaugguaaucaugagauuaauguuucaugauuucuaccuccaaagugugaagacaaguaaaaca

SEQ ID NO: 64914 - RNA, 64 nt, Human
caccacaaccagcuucuccaggucauaugugccuuaccuccagagagucuuuuuuuuuuuuuuu

SEQ ID NO: 64915 - RNA, 64 nt, Human
agcccccagcccucauccagcucuggcacgcugauaccuccagguacuccccucacugucaaag

SEQ ID NO: 64916 - RNA, 64 nt, Human
aagucauccucucacugcaagcacagcauaccuguaccuccaaaagugacguuuuagugaacag

SEQ ID NO: 64917 - RNA, 64 nt, Human
aaaaccaucguuucauaugauucacccuaauagauaccuccauuauucucuaaaugaaauagaa

SEQ ID NO: 64918 - RNA, 64 nt, Human
ccccuagcugucaguuuggcagauuuucccucguuaccuccaguucgacucagaaccuugacau

SEQ ID NO: 64919 - RNA, 64 nt, Human
acugcaagacccaguaguuggccccugagccuuauaccuccaccacagggggugccgugagacu

SEQ ID NO: 64920 - RNA, 64 nt, Human
guacacuugaagucagacagacauuucaguugcuuaccuccaguacugagccuugcuuugggaa

SEQ ID NO: 64921 - RNA, 64 nt, Human
ccuggagguuuuuaagcaguacgugccuccaaguuaccuccagaucagcaggcacaggugggca

SEQ ID NO: 64922 - RNA, 64 nt, Human
guuuuuuucuguuuucuaaaaagaguaaccaagauaccuccagggugucauuggguuccagcug

SEQ ID NO: 64923 - RNA, 64 nt, Human
aacauccuugccaagacuucuccacccucuugcauaccuccagggacagagagcuuacuaccuc

SEQ ID NO: 64924 - RNA, 64 nt, Human
agcagagagguggccaccggggguggcucuguccuaccuccacucucugccccuaaagauggga

SEQ ID NO: 64925 - RNA, 64 nt, Human
uaaugugccuguuuuuuaacacaacaaaaaagccuaccuccaaaauccccuuuuuguucuuccu

SEQ ID NO: 64926 - RNA, 64 nt, Human
agccccagccugccggagcccacggagcuaccucuaccuccacuccugccaccgccgccgcccu

SEQ ID NO: 64927 - RNA, 64 nt, Human
aaaggugguguaaauuaauauggauaauuuuauuuaccuccaggucuaaaagguagugugaccc

SEQ ID NO: 64928 - RNA, 64 nt, Human
uaccaagcaaagcagacaaucuuuuucuugaaauuaccuccauucuuacuuuguuagcauacgc

SEQ ID NO: 64929 - RNA, 64 nt, Human
caaauguguaauuuugaguacagaauucaacaguuaccuccaaaaaagaaacauuguuaauaua

SEQ ID NO: 64930 - RNA, 62 nt, Human
aaaaagaggaaaacaagugaggacacugguuuuaccuccaggaaacaugaaaaauaauccaa

SEQ ID NO: 64931 - RNA, 64 nt, Human
gaugccccaugaccccagaugccucucccacccuuaccuccaucucacacacuugagcuugcca

SEQ ID NO: 64932 - RNA, 64 nt, Human
uccuuauuguaacccugucuggauccuauccuccuaccuccaaagcuucccacggccuuucuag

SEQ ID NO: 64933 - RNA, 64 nt, Human
aaaaaaacaacaaaaacuuagaauugaggaguuguaccuccauuggcuuccucacuccaaaaua

SEQ ID NO: 64934 - RNA, 64 nt, Human
gacccuucccaccugagcaugcugacccccuuccuaccuccagaauaaagaaucucaaccugga

SEQ ID NO: 64935 - RNA, 64 nt, Human
gacaagcugcugcacugucucaguucugcuugaauaccuccaucgauggggaacucacuuccuu

SEQ ID NO: 64936 - RNA, 64 nt, Human
uucccagccacauugccaggcaacaggacuaaacuaccuccaaagcaagcagucuuuucaguuu

SEQ ID NO: 64937 - RNA, 64 nt, Human
aucccagcacuuugggaggccaaggcggguggauuaccuccaucuguuuaguagaaaugggcaa

SEQ ID NO: 64938 - RNA, 64 nt, Human
aacaaacaggagcuucugcacaucaugaugacuuuaccuccauucccucuacccagaacccuaa

SEQ ID NO: 64939 - RNA, 64 nt, Human
uagcacucaagacccgguuauucgcccacccgaguaccuccagucacacuccccgcgguucaua

SEQ ID NO: 64940 - RNA, 64 nt, Human
ugucuuauugaugcuagaagccucauaacuguucuaccuccaagguuagauuuaauccuuagga

SEQ ID NO: 64941 - RNA, 64 nt, Human
cugggggaauguagcccuugugcuccccacccccuaccuccaccugagccucacccugcuguug

SEQ ID NO: 64942 - RNA, 64 nt, Human
uuuaaggagauggacuaauugacuugcaaagaccuaccuccagacuucaaaaggaaugaacuug

SEQ ID NO: 64943 - RNA, 64 nt, Human
gggcucuccuucugcagacuccucuugcaaggcguaccuccaaacauaauugauucguaucugc

SEQ ID NO: 64944 - RNA, 64 nt, Human
agucacuuccuaaagcaaaaggagaaacauucuuuaccuccaaauguuuuaguuuuaaaaaaaa

SEQ ID NO: 64945 - RNA, 64 nt, Human
augcgguuccucuccacgcaucucgaggcggcguuaccuccagauuccguagaguuagagucac

SEQ ID NO: 64946 - RNA, 64 nt, Human
ccaccccaaucccaaauuuuguuuugguucuaacuaccuccagaauguguucaauaaaaugcuu

SEQ ID NO: 64947 - RNA, 64 nt, Human
cacaggacacauccaccuggaugugacucacagguaccuccaacccaucauguggagauacuca

SEQ ID NO: 64948 - RNA, 64 nt, Human
ugcccacaucagggggcuaccaccaugauuccgcuaccuccaucuugagcucugaguuuacagg

SEQ ID NO: 64949 - RNA, 64 nt, Human
auauucagacagucauggggugaaauaauucacuuaccuccaaaauagcauccuauaugccaau

SEQ ID NO: 64950 - RNA, 64 nt, Human
auauguuuugcugagcauaagauaaacucacuuuuaccuccaucuaaaauuauccuguucugau

SEQ ID NO: 64951 - RNA, 64 nt, Human
cuagucuauacauuuuugccaaauggcgcaaauauaccuccauuuauauuuuguaucuuaaaau

SEQ ID NO: 64952 - RNA, 64 nt, Human
aacaaaacccuuugcuguaucacuguguggaaaauaccuccaaagcugaaagagccagguauuu

SEQ ID NO: 64953 - RNA, 64 nt, Human
aacagcauggaggaaaccgcccccaugauccaguuaccuccaccuggucccacccuugacacgu

SEQ ID NO: 64954 - RNA, 64 nt, Human
gcuuuucuguuacauccaccuuugaggcuggucauaccuccaggaacaauacagagccagucaa

SEQ ID NO: 64955 - RNA, 64 nt, Human
caagaaauggcccgauaguuucacacuauuccuauaccuccagguccggaagacagguaaaaaa

SEQ ID NO: 64956 - RNA, 64 nt, Human
cauccuccaccucuaaucuuggaggcuauuaucuuaccuccaagcacugagcuggguuacugcc

SEQ ID NO: 64957 - RNA, 64 nt, Human
gguugucaugagaaagagacauucuccuugcagcuaccuccaugugagugaauuccuggauaaa

SEQ ID NO: 64958 - RNA, 64 nt, Human
cuaucccaguaaaagauaugauauuuuccauagauaccuccagaauuuuuuucagcaaauggaa

SEQ ID NO: 64959 - RNA, 64 nt, Human
gcucccugccuagcauccaugaccuguuggauguuaccuccaaucaguuuccuguccuaccugc

SEQ ID NO: 64960 - RNA, 64 nt, Human
cauugaagaaacaccauaaguggcguggacuaucuaccuccagacuguuuuacaagagagaaau

SEQ ID NO: 64961 - RNA, 64 nt, Human
caggaucuuccgccagcgccuccaccuucagauguaccuccagccuuucacuccucgguccucc

SEQ ID NO: 64962 - RNA, 64 nt, Human
guagaauuaaaggaggacacgagccugcuucuguuaccuccaagugguaacaggacugaugccg

SEQ ID NO: 64963 - RNA, 54 nt, Human
agaacaaucugcggcacuagguccuaccuccagccaaugaaugggaucauucug

SEQ ID NO: 64964 - RNA, 64 nt, Human
ucugcugugaccaggguguggcugacaccugggcuaccuccaaccuacaugugcaacgcuguug

SEQ ID NO: 64965 - RNA, 64 nt, Human
ggcccagccuccacucuccucgucuagguuucuuuaccuccagggaucagcuguguguguguga

SEQ ID NO: 64966 - RNA, 64 nt, Human
uuggaaguggcuuacucucuucugcccucucuccuaccuccaccuucucagauuagccccaucu

SEQ ID NO: 64967 - RNA, 64 nt, Human
cagaacuuugccucuugacugucccuucucuuccuaccuccauccauggaaaauuaguuauuuu

SEQ ID NO: 64968 - RNA, 64 nt, Human
cucuaccuccuggaguuauacaacuuggcuuguuuaccuccacaugcugaugaugacuauuuuu

SEQ ID NO: 64969 - RNA, 64 nt, Human
cucguggggggucccugcccuugcgacccccagauaccuccacuugcuaccgagucaacgugug

SEQ ID NO: 64970 - RNA, 64 nt, Human
aucuucuucccccuacuuggguaauugauuaaaauaccuccauuuacggccucuuucuauauuu

SEQ ID NO: 64971 - RNA, 64 nt, Human
gcagggugagcuccagcugcugcgcacggcggccuaccuccacaccacaaccaccuucaccugg

SEQ ID NO: 64972 - RNA, 64 nt, Human
gccccccaccccaucagugccgaguccuugucccuaccuccagcuuccuccagccucaaaccgc

SEQ ID NO: 64973 - RNA, 64 nt, Human
aagaauuauaaaacaagaaaucagcaagccugcuuaccuccagagacacaccguuccacuuaca

SEQ ID NO: 64974 - RNA, 64 nt, Human
auucugucagugggaccacccugggccuccuuucuaccuccacucagcacccuguuggccaagg

SEQ ID NO: 64975 - RNA, 64 nt, Human
cugucaugcaggcuuccaggaacauagacuguuuuaccuccacaacccuauuuguuauuaguga

SEQ ID NO: 64976 - RNA, 64 nt, Human
cucacugcccuguucugaugucagugccuguacauaccuccaaaggcaggacuugccugauaaa

SEQ ID NO: 64977 - RNA, 64 nt, Human
cugcuucccagccuggcuuccccggauguuuggcuaccuccaccccuccaucucaaagaaauaa

SEQ ID NO: 64978 - RNA, 62 nt, Human
cuaagaagacaucccacuaggaagagagagacuaccuccacaucaagaauauuuaaguuauu

SEQ ID NO: 64979 - RNA, 64 nt, Human
cuacagcagaaggcugguuaacugccagaaaauguaccuccaggcccugcaugccgucaguaac

SEQ ID NO: 64980 - RNA, 64 nt, Human
acucagcucuauccucaugggccuauauauuuaauaccuccaaagauauuuucaggauaggcuu

SEQ ID NO: 64981 - RNA, 64 nt, Human
ucaagcugggccugcccuccaagugcuuguuauauaccuccacgggugucagcccagaugacuc

SEQ ID NO: 64982 - RNA, 64 nt, Human
guuuacguuacacuaaaaccacaugugcaacaaauaccuccauuaaauggucuaaaauguaaau

SEQ ID NO: 64983 - RNA, 64 nt, Human
uggagagggacacuuccuggccccaccugcuaaauaccuccaaacucugggcaggcgccugcau

SEQ ID NO: 64984 - RNA, 64 nt, Human
gcuccucaggcucucuccccugcucucccaccucuaccuccacccccaccggccugacgcugug

SEQ ID NO: 64985 - RNA, 64 nt, Human
cugaguuguuauguuuauguuaucaccccaccacuaccuccaugguuguucauuuaggaugcuu

SEQ ID NO: 64986 - RNA, 64 nt, Human
ugcucguuccagcaccaucugggacuggguacaguaccuccagccccagggcccugaccugcgc

SEQ ID NO: 64987 - RNA, 64 nt, Human
uacugaaacugcuuugaaaauuuggaauuucugauaccuccagugggccgagagacacgguggg

SEQ ID NO: 64988 - RNA, 64 nt, Human
ccacugucuucccugcaguaacuaucuauacaccuaccuccagugugcacuuagggggugagcg

SEQ ID NO: 64989 - RNA, 64 nt, Human
cauaugagagugugaaaaauaggaacacgugcucuaccuccauuuagggauuugcuugggauac

SEQ ID NO: 64990 - RNA, 64 nt, Human
ccugcuauccugggagaucuaccugaaggagaacuaccuccagaaccgacaguuccagcaaaag

SEQ ID NO: 64991 - RNA, 64 nt, Human
uuuacuaaccuuacuucacauucagguuagauguuaccuccaccuauaugauaguaauuccuaa

SEQ ID NO: 64992 - RNA, 64 nt, Human
cugguaaaagcuagaggagacacaaugagcuuaguaccuccaacuuccuuucuuuccuaccaug

SEQ ID NO: 64993 - RNA, 64 nt, Human
uucuccucugagucuuagcaauggacaauuccaauaccuccacacaggacacuagaguaagaaa

SEQ ID NO: 64994 - RNA, 64 nt, Human
ggacauucccccacagagcuugccccucaguuccuaccuccaagggggaggguccuggaagcgc

SEQ ID NO: 64995 - RNA, 64 nt, Human
gauucaccucuuccucugguuccuuucaucucucuaccuccacccugcauuuuccucuuguccu

SEQ ID NO: 64996 - RNA, 64 nt, Human
aaagaaagagaagaaagaagugauuccuacccccuaccuccagaguuguugaaagcugaaaagc

SEQ ID NO: 64997 - RNA, 64 nt, Human
aaguuuuuuuucuuuuucaugauucgucuuugaguaccuccaggcugaaagacuguuguaccag

SEQ ID NO: 64998 - RNA, 64 nt, Human
ugaccacuuucaacucuugaguuuuucagguauauaccuccauguuucuaaguaauaugcuuau

SEQ ID NO: 64999 - RNA, 64 nt, Human
aauccaaguagcaucuguagcuacauaaccuauauaccuccagcagcuggacauggggaggcga

SEQ ID NO: 65000 - RNA, 64 nt, Human
gugagggcaaaagaagggcucuguaacagaaccuuaccuccaggugcuguugaauucuucuagc

SEQ ID NO: 65001 - RNA, 62 nt, Human
gucaaagcacacaagacauaauaauaaagacauguaccuccaguggcuucuuguucuuggug

SEQ ID NO: 65002 - RNA, 62 nt, Human
cuccacugaagccacccccaccccucgccagcuagcuccauagggaagccugugucuccugc

SEQ ID NO: 65003 - RNA, 62 nt, Human
uuucuuuuuaauaaagccacaggcaggcaucguagcuccacagcccgaggggacacaggaug

SEQ ID NO: 65004 - RNA, 62 nt, Human
ccaggccucuccuccccucugcccccggcucuuagcuccagcugcuccagguaguugguuca

SEQ ID NO: 65005 - RNA, 62 nt, Human
accaagaugggcacaugaggagggugcccuccuagcuccacccucaccaggaugaaggcgug

SEQ ID NO: 65006 - RNA, 62 nt, Human
uuuuuaaucggggaggggggagggggugguuguagcuccauuauuuuuuuuauuaaaaaaua

SEQ ID NO: 65007 - RNA, 62 nt, Human
ugucagguuaaugcuaaaucagugcggaaauauagcuccacuaggaaaauauuauuaaauuu

SEQ ID NO: 65008 - RNA, 62 nt, Human
ucuucuguuggagagaugagacauuugacccuuagcuccaguuuucuucugauguuuccauc

SEQ ID NO: 65009 - RNA, 62 nt, Human
cacucccgcaacacagccauuauuuuauugucuagcuccaguuaucuguauuuuauguaaug

SEQ ID NO: 65010 - RNA, 62 nt, Human
acuaaggaccuguguucagccacacccagugguagcuccaccaaaucaugaacagccuaauu

SEQ ID NO: 65011 - RNA, 62 nt, Human
uguuuuuccagggcugcugauccuuuuccagauagcuccagaguaugaugaccccagcccca

SEQ ID NO: 65012 - RNA, 62 nt, Human
gaguucuaacgcacagaauccugacuuccauguagcuccagucauugugaucagacauccuu

SEQ ID NO: 65013 - RNA, 62 nt, Human
aaagcagaccccuuuagucacuccacaagcaauagcuccaugagaggcauggacugugagac

SEQ ID NO: 65014 - RNA, 62 nt, Human
uuuaaacaguugacaaacugucauucaacaauuagcuccaggaaauaacaguuauuucauca

SEQ ID NO: 65015 - RNA, 62 nt, Human
ggcccucugcugccaacugcucaaaccugcuuuagcuccagccacuuguggcaaacaaccuc

SEQ ID NO: 65016 - RNA, 62 nt, Human
uaauuuuaaugcuguuucuaagaaaauguaguuagcuccauaaaguacaaaugaagaaaguc

SEQ ID NO: 65017 - RNA, 62 nt, Human
uuucuuguuucuguuuuuaguaauguagugaguagcuccaggugccacaucuacucacagau

SEQ ID NO: 65018 - RNA, 62 nt, Human
ccccuuuauguacaggaugcuuugguuauauuuagcuccaaaccuucacacacagacuguug

SEQ ID NO: 65019 - RNA, 62 nt, Human
auuugcugacauggaccuacugcauaaaguuguagcuccagcuaucaggaugucccugaaac

SEQ ID NO: 65020 - RNA, 62 nt, Human
ugcaugugugugugugcguguguguauaguuuuagcuccaagccaagcaaguuuguguuugg

SEQ ID NO: 65021 - RNA, 62 nt, Human
ggaguguggucagucugccugcugcugugcgguagcuccagaaccaccucguuccugguuuu

SEQ ID NO: 65022 - RNA, 62 nt, Human
aagguaccaggucagucuucuuccaugucuauuagcuccacaaagccaaucucaaucccuca

SEQ ID NO: 65023 - RNA, 62 nt, Human
uuuuaaaccuucaggaacaccaguuaggaaaauagcuccagaaaauauagauauauuuuauu

SEQ ID NO: 65024 - RNA, 62 nt, Human
auuuguuacucuaacccugccuaggcuucuuguagcuccagcucuuuagagacucccggaac

SEQ ID NO: 65025 - RNA, 62 nt, Human
cuggucuaagugcugaguuguaugucuuugcauagcuccacucugcugcuaaauaugcaugu

SEQ ID NO: 65026 - RNA, 62 nt, Human
ugauguuccccagucuuccuuggugcauguucuagcuccacacacuaguccuuggaggaagg

SEQ ID NO: 65027 - RNA, 62 nt, Human
ggauguuauguaaauauuuuugcauguaucuguagcuccaucuuaaucaaauuuaugguuaa

SEQ ID NO: 65028 - RNA, 62 nt, Human
uuugcaucauuugucuaggaucuaugcaaauauagcuccacuaaaggaccauagggaagagc

SEQ ID NO: 65029 - RNA, 62 nt, Human
ucaguuccaguaugaagaaagauuauucacucuagcuccacugagaaacauuuuccuaagug

SEQ ID NO: 65030 - RNA, 62 nt, Human
uagugaaggagccguguuagagcuuccgagaauagcuccacuggagagaaguggaauccuau

SEQ ID NO: 65031 - RNA, 62 nt, Human
aacuaugcaacugaaaaacugaggaugauuguuagcuccacgagugcaaacugcagucacca

SEQ ID NO: 65032 - RNA, 62 nt, Human
auuucacccauuuugugggcuggaguuaccaguagcuccagcaguuacccugaagagagauu

SEQ ID NO: 65033 - RNA, 62 nt, Human
gggcuggggugucaaaagugagaugaaguucuuagcuccagguuuugggguaaaccaaggua

SEQ ID NO: 65034 - RNA, 62 nt, Human
ugcugcugauaugcuggugauucccaaauacauagcuccaacccccaacuucccccagacuu

SEQ ID NO: 65035 - RNA, 62 nt, Human
gagcuuugaagauugcuaaauuaaauaauuuauagcuccaaaaacaaaaauauacuuguaua

SEQ ID NO: 65036 - RNA, 62 nt, Human
uaguugguuuucuaguaugaaagagcacccucuagcuccauauucuaagaaucugaaauaug

SEQ ID NO: 65037 - RNA, 62 nt, Human
uguuuuuacuggaaacauagcaaaccuugauuuagcuccaagaaauugaguagggaaauauu

SEQ ID NO: 65038 - RNA, 62 nt, Human
gcagggcuuugaucauucaaaaguaacuaaaguagcuccagaaugccaaguauucguguaaa

SEQ ID NO: 65039 - RNA, 62 nt, Human
ccaaugaagaggaaaaggaaaguaguuauuccuagcuccauuucuuauuuuccaccaaauuu

SEQ ID NO: 65040 - RNA, 62 nt, Human
acccggcccaaguccccacagagcaccuucuguagcuccagcuugucucccuggcuucucuu

SEQ ID NO: 65041 - RNA, 62 nt, Human
aaaguucuguccuagaguucuuuccugaccucuagcuccauacuucugauugccuaauaaau

SEQ ID NO: 65042 - RNA, 62 nt, Human
aaaucauugucuggaauuuuccucaccuuggcuagcuccaccugcucuuugucuaaggcccu

SEQ ID NO: 65043 - RNA, 62 nt, Human
agcuuauuaaagaugaaacugaauuggaaaaauagcuccauuuuuuggugcuugggaagcac

SEQ ID NO: 65044 - RNA, 62 nt, Human
aaccugcugcaacuauuguuauuaacucuguauagcuccaaaccuggaaccuccugaucagu

SEQ ID NO: 65045 - RNA, 62 nt, Human
caauuugguucuaaaaaccagugaucuuacuuuagcuccaucuuaaaauuucaccuuaagua

SEQ ID NO: 65046 - RNA, 62 nt, Human
ugcgauggucuugacuauuagaccagauuuaguagcuccauaucuaagauuuuucuaccugc

SEQ ID NO: 65047 - RNA, 62 nt, Human
agcacaggacaggaaaugggcuuugccacuuuuagcuccaggcuuuucuaaccagacuugau

SEQ ID NO: 65048 - RNA, 62 nt, Human
uguauaguaauuuuguuguuguugggugcugguagcuccagaauuuugugaccacuauugug

SEQ ID NO: 65049 - RNA, 62 nt, Human
aggagcuuauucagguuuccugcccuagcuauuagcuccacuucacaugcuggagaccggcg

SEQ ID NO: 65050 - RNA, 60 nt, Human
agaugcuuuaauuguguggugcuuuuauaguuuagcuccaaaacaaacuauagacauuca

SEQ ID NO: 65051 - RNA, 62 nt, Human
cuuucaaccuagguuauaagacuguuauucuauagcuccaacuuaaggugccuuuuuaauuc

SEQ ID NO: 65052 - RNA, 62 nt, Human
gcaauaaguauguauugaacuguacuguaaaguagcuccaaaacuuaauuacucuccuguuu

SEQ ID NO: 65053 - RNA, 62 nt, Human
cuauauagauauauguaacuuagcuuuauuguuagcuccauaagcugccaguguugcuuuuc

SEQ ID NO: 65054 - RNA, 62 nt, Human
ugugugucccucugcccagcuccugcuguaauuagcuccacguguacccccuucacucccuc

SEQ ID NO: 65055 - RNA, 62 nt, Human
uucugcacacuacacaacaugugggcuuccuguagcuccagggacauguagcuuuggugaaa

SEQ ID NO: 65056 - RNA, 62 nt, Human
acucuaguagggcuauuuguugguaagcucuuuagcuccaauuucccuuaagcaaaguuuuu

SEQ ID NO: 65057 - RNA, 62 nt, Human
gcauuuacugauuaaaaauaagaacugaccaauagcuccaagugucacacaccagaacauua

SEQ ID NO: 65058 - RNA, 62 nt, Human
cuaaugucuuacuaauguggaacaguccauauuagcuccagagagugucaaacccagagaaa

SEQ ID NO: 65059 - RNA, 62 nt, Human
uguuucucacccuucagaaacauauuuuucaguagcuccagguagaugagccuuuuuuuuuu

SEQ ID NO: 65060 - RNA, 62 nt, Human
gagauaaaagaaauugggugagaggagauagguagcuccauaaggcacacaaauucaaauau

SEQ ID NO: 65061 - RNA, 62 nt, Human
aagaagagaaacaguaaccucacuuugaaaauuagcuccacucaagacuaguccacgaacga

SEQ ID NO: 65062 - RNA, 62 nt, Human
agccccucagcagagggcagcacuugaaugcuuagcuccaucccauaguucucuacuucaua

SEQ ID NO: 65063 - RNA, 62 nt, Human
guccacuucugcccuggagaccacaaaucaacuagcuccauuuacagccauuucuaaaaugg

SEQ ID NO: 65064 - RNA, 62 nt, Human
gucaaauacuugacucccacucuugccacuccuagcuccagaagggcucagggccuucccca

SEQ ID NO: 65065 - RNA, 62 nt, Human
ucacaugaacccuuggcuguaguugccuuuccuagcuccacucuaaggcuaagcaucuucaa

SEQ ID NO: 65066 - RNA, 62 nt, Human
gauuguagagaaccuuguuucugcaggaagccuagcuccaagcacgcagucuguagacauuu

SEQ ID NO: 65067 - RNA, 62 nt, Human
uaugaaaugugccuuuucugaagagauuguguuagcuccaaagcuuuuccuaucgcaguguu

SEQ ID NO: 65068 - RNA, 62 nt, Human
uccugaggcacagcucccaggggacagagguguagcuccaaucucccugacugcaccucagg

SEQ ID NO: 65069 - RNA, 62 nt, Human
cuccagguacuuuguggucaaaggaaaucgccuagcuccaggcuguguuaggacaguauuag

SEQ ID NO: 65070 - RNA, 62 nt, Human
ggauuuugacauaaaugaauuugauuuucuuuuagcuccaguaacagaauggaauaagaucu

SEQ ID NO: 65071 - RNA, 62 nt, Human
ugugcaugugcguggaaguguuccugucucaauagcuccaagcuguuaaagauauuuuuauu

SEQ ID NO: 65072 - RNA, 62 nt, Human
ggggcugagucuccagggccccccaacugugguagcuccagcgauggugcugcccaggccuc

SEQ ID NO: 65073 - RNA, 62 nt, Human
gcucucagcuuugugcuuccucccacggguacuagcuccagcugagcuugcaggaaacccac

SEQ ID NO: 65074 - RNA, 62 nt, Human
gaacugcugagugugcccuuagaaagcccuaguagcuccagcugugacuauaucaacugugu

SEQ ID NO: 65075 - RNA, 62 nt, Human
agucaguccagcaggaagaguggcagacuuuguagcuccaugggcacgucaauuacuaaugc

SEQ ID NO: 65076 - RNA, 62 nt, Human
uuuucuauaauauccuacuacuuugguuuuccuagcuccauaccacacaccuaaaccuguau

SEQ ID NO: 65077 - RNA, 62 nt, Human
agagguggguucuguuuuccaggugaaacuuuuagcuccaugacagaccagccuguaguuau

SEQ ID NO: 65078 - RNA, 62 nt, Human
ccugucaggaaacacacggggaccucucucucuagcuccagcagguggcaccucgguaccca

SEQ ID NO: 65079 - RNA, 62 nt, Human
gggugucuaagccacguccaaaugguggacaguagcuccaacagugacaugacagagggagg

SEQ ID NO: 65080 - RNA, 62 nt, Human
ggcucaucugugcaacaaccacaugccaacaauagcuccaggugccucagccccgugcccug

SEQ ID NO: 65081 - RNA, 62 nt, Human
ccgaccagcacucagcuggccucuggggauucuagcuccacaaccaggccgugaggcuggag

SEQ ID NO: 65082 - RNA, 62 nt, Human
cauauaguuacuauuuucaugaguccugcuucuagcuccauuguggaauacagaaaauuaaa

SEQ ID NO: 65083 - RNA, 62 nt, Human
cacagcuugacucacuaacugaggccuuuccauagcuccacagcuucccaccuccuccccac

SEQ ID NO: 65084 - RNA, 62 nt, Human
ccauuguggaaugaugcccuggcuuuaagguuuagcuccacaucaugcuucucuugagaauu

SEQ ID NO: 65085 - RNA, 62 nt, Human
cuauaccuacuaggguccaaugcccgccagccuagcuccagugcuucuaguaggagggcuga

SEQ ID NO: 65086 - RNA, 62 nt, Human
cggcgggaacgggugcugccucuuccuccaguuagcuccagcucaggucugagacccgugcu

SEQ ID NO: 65087 - RNA, 62 nt, Human
uuuccugcauuguugcuaaaauuguuuuauuguagcuccacauucugguguaguuuaaaaug

SEQ ID NO: 65088 - RNA, 62 nt, Human
caucccucagugccaucccuuguauccuggaauagcuccauuuccccuccuccucucuacca

SEQ ID NO: 65089 - RNA, 62 nt, Human
cugcaucgguggacacugguauuuauuuauguuagcuccaagcggaccggugguucaaaagu

SEQ ID NO: 65090 - RNA, 62 nt, Human
acagauuaugauugcucaggcauaccagguuauagcuccaaguuccacaggucugcuaccac

SEQ ID NO: 65091 - RNA, 62 nt, Human
ugggacccaugcaaauuaaaccaaccugguaguagcuccauaguggacucacucacuguugu

SEQ ID NO: 65092 - RNA, 62 nt, Human
cuguuggcaggacucaaccaagcacugcucucuagcuccagggcacuaagccacaggaggca

SEQ ID NO: 65093 - RNA, 62 nt, Human
agcuaaccaccauccauggucaagaccucuccuagcuccacacaagcaguagagucucagcu

SEQ ID NO: 65094 - RNA, 62 nt, Human
ugucagggaccagauguguccugccucaucccuagcuccaaucccuuccccacgugaccggg

SEQ ID NO: 65095 - RNA, 62 nt, Human
agguuggguaacccucccuguucaucccauguuagcuccaaagcauuucccacccuccaucu

SEQ ID NO: 65096 - RNA, 62 nt, Human
gaagacagcccuaugcugagcuuguagccuuuuagcuccacagagccccgccauguguuugc

SEQ ID NO: 65097 - RNA, 62 nt, Human
cucaacaaaauuagaagaauuaaauuuaaaacuagcuccaaaagagcagucgucuuucauuu

SEQ ID NO: 65098 - RNA, 62 nt, Human
ggaacagaacacuucuaggacugggggucuuuuagcuccauaagcaagugagcagaugggac

SEQ ID NO: 65099 - RNA, 62 nt, Human
gugcuucuuuuucucuccuaaaaaucgauaaguagcuccaccugaagagggauggaaccucu

SEQ ID NO: 65100 - RNA, 62 nt, Human
cuuaaagaugaaaugguugcagaaaaucuguuuagcuccaacuuuggcuuaauuuaaaucaa

SEQ ID NO: 65101 - RNA, 62 nt, Human
uagcggggagcggcaugcugucuaacagcuguuagcuccagcugguuguugccaugugggaa

SEQ ID NO: 65102 - RNA, 62 nt, Human
uucugauuuggaaacaguuaaaagccaauuuuuagcuccaguggaaccauagccacauaaaa

SEQ ID NO: 65103 - RNA, 62 nt, Human
agaaacagcaguaaauaaugaggaaaaugaauuagcuccagugcuggaacaacuaacuaacu

SEQ ID NO: 65104 - RNA, 62 nt, Human
ugauuugcuuuaaaaauggccuuccuacacauuagcuccagcuaaaaagacacauuggagag

SEQ ID NO: 65105 - RNA, 62 nt, Human
cuacacaagcuuuuauaaauguugcugcuggguagcuccacaguguuucauaaggccauccu

SEQ ID NO: 65106 - RNA, 62 nt, Human
cucaauauugcuuuaucagcaucuuuucucuguagcuccaggggaaucuuuucucuaaaaca

SEQ ID NO: 65107 - RNA, 62 nt, Human
gcccucauucuuuaccuuuguuguaagaacuuuagcuccagggaacugaggcagaggcccug

SEQ ID NO: 65108 - RNA, 62 nt, Human
gcuacgcuccugaccucuucccaggcagugccuagcuccagagcaggcacagccugccucag

SEQ ID NO: 65109 - RNA, 62 nt, Human
aggcauucccagcccuucacuuaacuccuacuuagcuccaaaauaccuguauccaauuugua

SEQ ID NO: 65110 - RNA, 62 nt, Human
ccuggcuuuauguuuauggggagaggacucaauagcuccaccccuucuggcaccagaugggg

SEQ ID NO: 65111 - RNA, 62 nt, Human
ggugcucuucguaagggguaguuguuguuuuauagcuccaaaugguuuuuuuauucucagug

SEQ ID NO: 65112 - RNA, 62 nt, Human
ugggagagacccgagcauccuccccacccccauagcuccagugcacgccacccccgucuugc

SEQ ID NO: 65113 - RNA, 62 nt, Human
ugcccuccuaaaugucagcuguugucacacaguagcuccaacacuuugagcauuuuuaaggg

SEQ ID NO: 65114 - RNA, 62 nt, Human
ccacgugcugccguccuggucucauccacagauagcuccagcuuuuguuggugggagugguc

SEQ ID NO: 65115 - RNA, 62 nt, Human
aucugcccagggugucacggaaggagauuuucuagcuccacaucugucugcacauaggaagg

SEQ ID NO: 65116 - RNA, 62 nt, Human
gaaaggaaaacggaagcaggguucuugccugguagcuccaggacccagcucugcaggcaccc

SEQ ID NO: 65117 - RNA, 62 nt, Human
gaaaccaaaaugagcccaccuuguguucuuccuagcuccacccuccccgugcugcuguguuc

SEQ ID NO: 65118 - RNA, 62 nt, Human
gaacuuuggcucccuuucccuucucucucugguagcuccaggaggccugugauccagcuccc

SEQ ID NO: 65119 - RNA, 62 nt, Human
agagugugagaccugaaagaauguucagcaucuagcuccaugucccugcaaccacucucugu

SEQ ID NO: 65120 - RNA, 62 nt, Human
cuucgccgugcauuuggagccaugacagcugauagcuccagaccugcauccuccuagcuugg

SEQ ID NO: 65121 - RNA, 62 nt, Human
ggugaggacuucucuggagaggccuggagaccuagcuccauguuccuccuccucucucccca

SEQ ID NO: 65122 - RNA, 62 nt, Human
uggaggcugucuucucaggcucugcccugcccuagcuccacacccucucccaggacccauca

SEQ ID NO: 65123 - RNA, 62 nt, Human
cucuccuaagagguucucuccaagcccccaaauagcuccaggcgcccucggccgcccaucau

SEQ ID NO: 65124 - RNA, 62 nt, Human
ggcccccagcucucguguccuggaggaagagcuagcuccagacauggguugaucaccuagag

SEQ ID NO: 65125 - RNA, 62 nt, Human
ggcagcugaugccaugcacuugucugagggcauagcuccaugucuucugacauuccuggugu

SEQ ID NO: 65126 - RNA, 62 nt, Human
gagagaaggugacuuaacgccuuuuccggcccuagcuccaggcguuuugaggcgucuggugc

SEQ ID NO: 65127 - RNA, 62 nt, Human
aaaaaaaaaacaaaaaaggcugaaggcagcuguagcuccacacagacccuacccuuuccccu

SEQ ID NO: 65128 - RNA, 62 nt, Human
guuuggaacugaaguccagccagcagacucucuagcuccaucuccccugugccacccuaggu

SEQ ID NO: 65129 - RNA, 62 nt, Human
gggaggggccucaguccagaaaccucgaccgcuagcuccaccugccuuggccaccagggcag

SEQ ID NO: 65130 - RNA, 62 nt, Human
gaagaaaacaaaccgacucacaaaccuccaaguagcuccaaaugcaauuuuuaaaauggaaa

SEQ ID NO: 65131 - RNA, 62 nt, Human
uuucugacuaaccagccaccuuuucucucucuuagcuccacgucagcacugagaccagacuc

SEQ ID NO: 65132 - RNA, 62 nt, Human
agcagcaaugaguaucacagcguccaacucaguagcuccaguguaugaaaaugucuccaggg

SEQ ID NO: 65133 - RNA, 62 nt, Human
ccucacucuggagauagaugggcucccucgguuagcuccaucaacauguggauggaacccuc

SEQ ID NO: 65134 - RNA, 62 nt, Human
gugccuauguauuuucacuaaaauauacaugguagcuccauuuacugaugcgguuguaauga

SEQ ID NO: 65135 - RNA, 52 nt, Human
aaggucccagaaagagcuaacuuagcuccauauuugacagaaagauagaaag

SEQ ID NO: 65136 - RNA, 62 nt, Human
ugaauuaaguaauuauaaacauaaauuuccuguagcuccaacaugacuuugaucugaguaau

SEQ ID NO: 65137 - RNA, 62 nt, Human
acgcucuagacucccgagaggcccccaaauccuagcuccaguuccccgguaaggacagggac

SEQ ID NO: 65138 - RNA, 62 nt, Human
guccugucuuccucccgagccauggccucugcuagcuccaccuugaaggagccccccacauc

SEQ ID NO: 65139 - RNA, 62 nt, Human
gggagggaggggagcuuggaaggcuaguccuguagcuccaguccucugucuggccuccacuc

SEQ ID NO: 65140 - RNA, 62 nt, Human
ggucuugaacuccugaugucaggugauucuccuagcuccaaauguuuucauuaucucucccc

SEQ ID NO: 65141 - RNA, 62 nt, Human
cuccacucacgcagacccaaccuaaccuccacuagcuccaaaaucccugcuccugcgucccc

SEQ ID NO: 65142 - RNA, 62 nt, Human
gugccuaugagauugggugcaguguauccuguuagcuccauucucagggcguuugaauguga

SEQ ID NO: 65143 - RNA, 62 nt, Human
cagagcaccaauaucuccuccaucacuuccccuagcuccacucuuguuggccugggaacuuc

SEQ ID NO: 65144 - RNA, 62 nt, Human
auaggcaagaaucucaugagacaccugucauuuagcuccauggccacucacuguugugguca

SEQ ID NO: 65145 - RNA, 62 nt, Human
cucagcugccaacaguggauugaguuuggggguagcuccaagccuucuccugccucugaacu

SEQ ID NO: 65146 - RNA, 62 nt, Human
ugaccagguuccucccuccccaccugcccuccuagcuccagcacugcccccguggcagccca

SEQ ID NO: 65147 - RNA, 62 nt, Human
aagcauaauccacuucaauguaauauuuucuguagcuccaaaggcuaucucuucauauugac

SEQ ID NO: 65148 - RNA, 62 nt, Human
uuccccuuuucuguuugaaaaaccuguucugguagcuccacaagagagaugauacugacuuu

SEQ ID NO: 65149 - RNA, 62 nt, Human
agagugucaugggugacaguuucugguugaaguagcuccacgccuggcuucuguggacagca

SEQ ID NO: 65150 - RNA, 62 nt, Human
ucccgugacugcugccucaucgauaccccauuuagcuccagaaagcaaagaaaacucgagua

SEQ ID NO: 65151 - RNA, 62 nt, Human
ugacaucucaucagcucccuauugucaagaaguagcuccaaagucuuugagcccuuucccag

SEQ ID NO: 65152 - RNA, 62 nt, Human
aaggaagcgaggcccucugggaggagggugcuuagcuccagagcaggaugggacuuccccag

SEQ ID NO: 65153 - RNA, 62 nt, Human
gaauagucucaggugggaacaccuucucuugcuagcuccaggaaggcuuugugggaaaugag

SEQ ID NO: 65154 - RNA, 62 nt, Human
uaaucauuaaacuccuuaaacaguuuagaaauuagcuccagguucuuaaacuaacaaaaaua

SEQ ID NO: 65155 - RNA, 62 nt, Human
agucaacucugaucuuccaggacaggugguauuagcuccacugucuuaacauaguacguggc

SEQ ID NO: 65156 - RNA, 62 nt, Human
ggcagcaagucagaaggccuagguucuaguccuagcuccaucauuuaccaacugugugaccu

SEQ ID NO: 65157 - RNA, 64 nt, Human
cgaaaggcucggccgcagagccggggcccagcgaaucacgcagagaaaucuuacagaaaacagg

SEQ ID NO: 65158 - RNA, 64 nt, Human
gcuuccgcgugccccgugugcuggugcgguucccaucacgcagacaggaaggguguuugcgcac

SEQ ID NO: 65159 - RNA, 64 nt, Human
acugucuacaugcuuucucauucaagaauucgucaucacgcaucacaggccgcgucuuugacgg

SEQ ID NO: 65160 - RNA, 64 nt, Human
acccggcaggcagucagacugaaugggagcuggaaucacgcagcagcugggagccgaguuaacc

SEQ ID NO: 65161 - RNA, 64 nt, Human
cgcugccuuucaccuccgcuggcucaccugggaaaucacgcagacccaguacauccuggagggc

SEQ ID NO: 65162 - RNA, 64 nt, Human
uucucaucuuccuguuuugagaaaugauuauuuuaucacgcaucagagccuucgugcuuugauu

SEQ ID NO: 65163 - RNA, 64 nt, Human
aaguucacugugaccacgaagcagcugacugugcaucacgcagucacaauauuguuuuuagggu

SEQ ID NO: 65164 - RNA, 64 nt, Human
uaacacuguguucuggauaaaaaugugauuaggaaucacgcaaagugcuuacuguguaagccca

SEQ ID NO: 65165 - RNA, 64 nt, Human
aaaagcaugacugcuuuuuccugucuggcauggaaucacgcagucaccuugggcauuuaguuua

SEQ ID NO: 65166 - RNA, 64 nt, Human
guuuugcuuuccagagaucuugcucauacaaugaaucacgcaaccacuaaagcuauccaguuaa

SEQ ID NO: 65167 - RNA, 64 nt, Human
auauaagaucuauuaagcuugacacaucugugucaucacgcacugaagacaggaagcaguucac

SEQ ID NO: 65168 - RNA, 64 nt, Human
ugaaagcagcgagugaaucuuuaaaacagacuugaucacgcacacacaauaagucuuucucucc

SEQ ID NO: 65169 - RNA, 64 nt, Human
uucaguugucuaaguaucaucccuucuguggcccaucacgcagcagaguugcccuacaaauuuc

SEQ ID NO: 65170 - RNA, 64 nt, Human
ccagaucucugauuguauggucacuagguaugcaaucacgcauucaaagaggcucuuuacacca

SEQ ID NO: 65171 - RNA, 64 nt, Human
aguacauucguucauuuguccacuguuucuugucaucacgcagcccuggacccaaagggugaac

SEQ ID NO: 65172 - RNA, 64 nt, Human
acugcaugaaccaaaguucucaccuaaugguaucaucacgcagugcacaaucauuuaucuaugu

SEQ ID NO: 65173 - RNA, 64 nt, Human
cacauaugcagggggugccccacacagcuagagcggccaggagagcgccuccuaaccaccagcc

SEQ ID NO: 65174 - RNA, 64 nt, Human
gcuauuucaaggguuguaagaguuuuuguuuuuaaucacgcauuugguagagucuaaauggaua

SEQ ID NO: 65175 - RNA, 64 nt, Human
agaugcuguguaaacuguaauucuuaauaccauuaucacgcauuacuagaaucauuucauuauu

SEQ ID NO: 65176 - RNA, 64 nt, Human
agggaaagggggggacgcccccagugagauucaaaucacgcaucucuacuccucugcgugagug

SEQ ID NO: 65177 - RNA, 64 nt, Human
uuucuuuuucuauuguacaagucaaugaaauaugaucacgcaacuuauuaaagaauaaaugugu

SEQ ID NO: 65178 - RNA, 64 nt, Human
aggcccucacagaugucuaggcaggccucauuucaucacgcagcaugugcaggccuggaagagc

SEQ ID NO: 65179 - RNA, 64 nt, Human
uucccuggcugcugaguugcaggugggaacugucaucacgcagugcuucagagccucgggcuca

SEQ ID NO: 65180 - RNA, 64 nt, Human
uguuuuauugccauucaacuagggaaaugaagaaaucacgcagccuuuugguuaaauggcaguc

SEQ ID NO: 65181 - RNA, 64 nt, Human
uggcgagugaguggagagccagcucugcggagucaucacgcagccaugguugugccugccguuc

SEQ ID NO: 65182 - RNA, 64 nt, Human
ccaaaucaguaggauauauuuguuuuggcagccuaucacgcagaggcuagugguauauuuaugu

SEQ ID NO: 65183 - RNA, 64 nt, Human
gggucacguggucccauguugcaacagccccaacaucacgcaugucauucacugccuugccacu

SEQ ID NO: 65184 - RNA, 64 nt, Human
acccugcugucuccacggagggaggucacagcccaucacgcaggacacugugauuguguugaug

SEQ ID NO: 65185 - RNA, 64 nt, Human
ccagcaugcaggucuccacaucaccaucuagaguaucacgcacacaucuaccauauauacagau

SEQ ID NO: 65186 - RNA, 64 nt, Human
aacuggcuaagaauagugggccuggugauugucuaucacgcaaggcuuuguuuuguacuguuca

SEQ ID NO: 65187 - RNA, 64 nt, Human
uacuguuacuggaaacuuuuuguacaauaaagcaaucacgcagauuaaagaacauccugcaauc

SEQ ID NO: 65188 - RNA, 64 nt, Human
ccuggcggcuguaaccuauaugccccagugggggaucacgcacuugaacuccuggccuucuugg

SEQ ID NO: 65189 - RNA, 64 nt, Human
aagaugaucaaaagcgaugaugagggaggcagucaucacgcaggugcuuaaagggacauuguag

SEQ ID NO: 65190 - RNA, 64 nt, Human
guccugccuggccguggggacaucagagagugucaucacgcagcuggccagcugaguucuguug

SEQ ID NO: 65191 - RNA, 64 nt, Human
uuucuuccuuucuaauccuaucuggggagcuccuggccaggauaauauauuugcagauaauucu

SEQ ID NO: 65192 - RNA, 64 nt, Human
uaagagauggccuucuuggcugccacaaucagaaaucacgcaggcauuuuggguaggcggccuc

SEQ ID NO: 65193 - RNA, 64 nt, Human
uaaacccgugagguggagguugcagugagcagagaucacgcaacugcacuccagcuugggcaac

SEQ ID NO: 65194 - RNA, 64 nt, Human
cucccagaagcgccucuuccccuggaagcugcacaucacgcagaaggacaacuacagggucuac

SEQ ID NO: 65195 - RNA, 64 nt, Human
cuccugucuccagcagcuuucccuguugauguggaucacgcagugcuuucugcccguguuuuug

SEQ ID NO: 65196 - RNA, 64 nt, Human; identical to SEQ ID NO: 31718

SEQ ID NO: 65197 - RNA, 64 nt, Human; identical to SEQ ID NO: 31719

SEQ ID NO: 65198 - RNA, 64 nt, Human; identical to SEQ ID NO: 31720

SEQ ID NO: 65199 - RNA, 64 nt, Human; identical to SEQ ID NO: 31721

SEQ ID NO: 65200 - RNA, 64 nt, Human; identical to SEQ ID NO: 31722

SEQ ID NO: 65201 - RNA, 64 nt, Human; identical to SEQ ID NO: 31723

SEQ ID NO: 65202 - RNA, 64 nt, Human; identical to SEQ ID NO: 31724

SEQ ID NO: 65203 - RNA, 64 nt, Human; identical to SEQ ID NO: 31725

SEQ ID NO: 65204 - RNA, 64 nt, Human; identical to SEQ ID NO: 31726

SEQ ID NO: 65205 - RNA, 61 nt, Human; identical to SEQ ID NO: 31727

SEQ ID NO: 65206 - RNA, 64 nt, Human; identical to SEQ ID NO: 31728

SEQ ID NO: 65207 - RNA, 64 nt, Human; identical to SEQ ID NO: 31729

SEQ ID NO: 65208 - RNA, 64 nt, Human
cacuuugggaggucgaggugggaggaucgcuugaggccaggaguucgagaccacccugggcaac

SEQ ID NO: 65209 - RNA, 64 nt, Human; identical to SEQ ID NO: 31730

SEQ ID NO: 65210 - RNA, 64 nt, Human; identical to SEQ ID NO: 31731

SEQ ID NO: 65211 - RNA, 64 nt, Human; identical to SEQ ID NO: 31732

SEQ ID NO: 65212 - RNA, 64 nt, Human; identical to SEQ ID NO: 31733

SEQ ID NO: 65213 - RNA, 64 nt, Human; identical to SEQ ID NO: 31734

SEQ ID NO: 65214 - RNA, 64 nt, Human; identical to SEQ ID NO: 31735

SEQ ID NO: 65215 - RNA, 64 nt, Human; identical to SEQ ID NO: 31736

SEQ ID NO: 65216 - RNA, 64 nt, Human; identical to SEQ ID NO: 31737

SEQ ID NO: 65217 - RNA, 64 nt, Human; identical to SEQ ID NO: 31738

SEQ ID NO: 65218 - RNA, 64 nt, Human; identical to SEQ ID NO: 31739

SEQ ID NO: 65219 - RNA, 64 nt, Human; identical to SEQ ID NO: 31740

SEQ ID NO: 65220 - RNA, 64 nt, Human; identical to SEQ ID NO: 31741

SEQ ID NO: 65221 - RNA, 64 nt, Human; identical to SEQ ID NO: 31742

SEQ ID NO: 65222 - RNA, 64 nt, Human; identical to SEQ ID NO: 31743

SEQ ID NO: 65223 - RNA, 64 nt, Human; identical to SEQ ID NO: 31744

SEQ ID NO: 65224 - RNA, 64 nt, Human; identical to SEQ ID NO: 31745

SEQ ID NO: 65225 - RNA, 64 nt, Human; identical to SEQ ID NO: 31746

SEQ ID NO: 65226 - RNA, 64 nt, Human
cacuucggaaggcggaggcaggaggaucgcuugaggccaggaauuuuagaccagccggggcaac

SEQ ID NO: 65227 - RNA, 64 nt, Human; identical to SEQ ID NO: 31747

SEQ ID NO: 65228 - RNA, 64 nt, Human; identical to SEQ ID NO: 31748

SEQ ID NO: 65229 - RNA, 64 nt, Human; identical to SEQ ID NO: 31749

SEQ ID NO: 65230 - RNA, 64 nt, Human; identical to SEQ ID NO: 31750

SEQ ID NO: 65231 - RNA, 64 nt, Human; identical to SEQ ID NO: 31751

SEQ ID NO: 65232 - RNA, 64 nt, Human; identical to SEQ ID NO: 31752

SEQ ID NO: 65233 - RNA, 64 nt, Human; identical to SEQ ID NO: 31753

SEQ ID NO: 65234 - RNA, 62 nt, Human; identical to SEQ ID NO: 31754

SEQ ID NO: 65235 - RNA, 64 nt, Human; identical to SEQ ID NO: 31755

SEQ ID NO: 65236 - RNA, 64 nt, Human; identical to SEQ ID NO: 31756

SEQ ID NO: 65237 - RNA, 64 nt, Human; identical to SEQ ID NO: 31757

SEQ ID NO: 65238 - RNA, 54 nt, Human; identical to SEQ ID NO: 31758

SEQ ID NO: 65239 - RNA, 64 nt, Human; identical to SEQ ID NO: 31759

SEQ ID NO: 65240 - RNA, 64 nt, Human; identical to SEQ ID NO: 31760

SEQ ID NO: 65241 - RNA, 64 nt, Human; identical to SEQ ID NO: 31761

SEQ ID NO: 65242 - RNA, 64 nt, Human; identical to SEQ ID NO: 31762

SEQ ID NO: 65243 - RNA, 64 nt, Human; identical to SEQ ID NO: 31763

SEQ ID NO: 65244 - RNA, 64 nt, Human; identical to SEQ ID NO: 31764

SEQ ID NO: 65245 - RNA, 64 nt, Human; identical to SEQ ID NO: 31765

SEQ ID NO: 65246 - RNA, 64 nt, Human; identical to SEQ ID NO: 31766

SEQ ID NO: 65247 - RNA, 64 nt, Human; identical to SEQ ID NO: 31767

SEQ ID NO: 65248 - RNA, 64 nt, Human; identical to SEQ ID NO: 31768

SEQ ID NO: 65249 - RNA, 64 nt, Human; identical to SEQ ID NO: 31769

SEQ ID NO: 65250 - RNA, 64 nt, Human; identical to SEQ ID NO: 31770

SEQ ID NO: 65251 - RNA, 64 nt, Human; identical to SEQ ID NO: 31771

SEQ ID NO: 65252 - RNA, 64 nt, Human; identical to SEQ ID NO: 31772

SEQ ID NO: 65253 - RNA, 64 nt, Human; identical to SEQ ID NO: 31773

SEQ ID NO: 65254 - RNA, 64 nt, Human; identical to SEQ ID NO: 31774

SEQ ID NO: 65255 - RNA, 64 nt, Human; identical to SEQ ID NO: 31775

SEQ ID NO: 65256 - RNA, 64 nt, Human; identical to SEQ ID NO: 31776

SEQ ID NO: 65257 - RNA, 64 nt, Human; identical to SEQ ID NO: 31777

SEQ ID NO: 65258 - RNA, 64 nt, Human; identical to SEQ ID NO: 31778

SEQ ID NO: 65259 - RNA, 64 nt, Human; identical to SEQ ID NO: 31779

SEQ ID NO: 65260 - RNA, 64 nt, Human; identical to SEQ ID NO: 31780

SEQ ID NO: 65261 - RNA, 64 nt, Human; identical to SEQ ID NO: 31781

SEQ ID NO: 65262 - RNA, 64 nt, Human
uacucgggaggccaagacagaaggaucaccuugaggccaggaguuuaaggccagccugggcaac

SEQ ID NO: 65263 - RNA, 64 nt, Human; identical to SEQ ID NO: 31782

SEQ ID NO: 65264 - RNA, 64 nt, Human; identical to SEQ ID NO: 31783

SEQ ID NO: 65265 - RNA, 64 nt, Human; identical to SEQ ID NO: 31784

SEQ ID NO: 65266 - RNA, 64 nt, Human; identical to SEQ ID NO: 31785

SEQ ID NO: 65267 - RNA, 64 nt, Human; identical to SEQ ID NO: 31786

SEQ ID NO: 65268 - RNA, 64 nt, Human; identical to SEQ ID NO: 31787

SEQ ID NO: 65269 - RNA, 64 nt, Human; identical to SEQ ID NO: 31788

SEQ ID NO: 65270 - RNA, 51 nt, Human; identical to SEQ ID NO: 31789

SEQ ID NO: 65271 - RNA, 64 nt, Human; identical to SEQ ID NO: 31790

SEQ ID NO: 65272 - RNA, 64 nt, Human; identical to SEQ ID NO: 31791

SEQ ID NO: 65273 - RNA, 64 nt, Human; identical to SEQ ID NO: 31792

SEQ ID NO: 65274 - RNA, 64 nt, Human; identical to SEQ ID NO: 31793

SEQ ID NO: 65275 - RNA, 64 nt, Human; identical to SEQ ID NO: 31794

SEQ ID NO: 65276 - RNA, 64 nt, Human; identical to SEQ ID NO: 31795

SEQ ID NO: 65277 - RNA, 64 nt, Human; identical to SEQ ID NO: 31796

SEQ ID NO: 65278 - RNA, 64 nt, Human; identical to SEQ ID NO: 31797

SEQ ID NO: 65279 - RNA, 64 nt, Human; identical to SEQ ID NO: 31798

SEQ ID NO: 65280 - RNA, 64 nt, Human; identical to SEQ ID NO: 31799

SEQ ID NO: 65281 - RNA, 64 nt, Human; identical to SEQ ID NO: 31800

SEQ ID NO: 65282 - RNA, 64 nt, Human; identical to SEQ ID NO: 31801

SEQ ID NO: 65283 - RNA, 64 nt, Human; identical to SEQ ID NO: 31802

SEQ ID NO: 65284 - RNA, 64 nt, Human; identical to SEQ ID NO: 31803

SEQ ID NO: 65285 - RNA, 64 nt, Human; identical to SEQ ID NO: 31804

SEQ ID NO: 65286 - RNA, 64 nt, Human; identical to SEQ ID NO: 31805

SEQ ID NO: 65287 - RNA, 64 nt, Human; identical to SEQ ID NO: 31806

SEQ ID NO: 65288 - RNA, 64 nt, Human; identical to SEQ ID NO: 31807

SEQ ID NO: 65289 - RNA, 64 nt, Human; identical to SEQ ID NO: 31808

SEQ ID NO: 65290 - RNA, 64 nt, Human; identical to SEQ ID NO: 31809

SEQ ID NO: 65291 - RNA, 64 nt, Human; identical to SEQ ID NO: 31810

SEQ ID NO: 65292 - RNA, 64 nt, Human; identical to SEQ ID NO: 31811

SEQ ID NO: 65293 - RNA, 64 nt, Human; identical to SEQ ID NO: 31812

SEQ ID NO: 65294 - RNA, 64 nt, Human; identical to SEQ ID NO: 31813

SEQ ID NO: 65295 - RNA, 64 nt, Human; identical to SEQ ID NO: 31814

SEQ ID NO: 65296 - RNA, 64 nt, Human; identical to SEQ ID NO: 31815

SEQ ID NO: 65297 - RNA, 64 nt, Human; identical to SEQ ID NO: 31816

SEQ ID NO: 65298 - RNA, 64 nt, Human
ccgccagggcucagguuccucugagcugguccugggccaggacgcaucugcauggcgguggugg

SEQ ID NO: 65299 - RNA, 64 nt, Human; identical to SEQ ID NO: 31817

SEQ ID NO: 65300 - RNA, 64 nt, Human; identical to SEQ ID NO: 31818

SEQ ID NO: 65301 - RNA, 64 nt, Human; identical to SEQ ID NO: 31819

SEQ ID NO: 65302 - RNA, 64 nt, Human; identical to SEQ ID NO: 31820

SEQ ID NO: 65303 - RNA, 64 nt, Human; identical to SEQ ID NO: 31821

SEQ ID NO: 65304 - RNA, 64 nt, Human; identical to SEQ ID NO: 31822

SEQ ID NO: 65305 - RNA, 64 nt, Human; identical to SEQ ID NO: 31823

SEQ ID NO: 65306 - RNA, 64 nt, Human; identical to SEQ ID NO: 31824

SEQ ID NO: 65307 - RNA, 64 nt, Human; identical to SEQ ID NO: 31825

SEQ ID NO: 65308 - RNA, 64 nt, Human; identical to SEQ ID NO: 31826

SEQ ID NO: 65309 - RNA, 64 nt, Human; identical to SEQ ID NO: 31827

SEQ ID NO: 65310 - RNA, 64 nt, Human; identical to SEQ ID NO: 31828

SEQ ID NO: 65311 - RNA, 64 nt, Human; identical to SEQ ID NO: 31829

SEQ ID NO: 65312 - RNA, 64 nt, Human; identical to SEQ ID NO: 31830

SEQ ID NO: 65313 - RNA, 64 nt, Human; identical to SEQ ID NO: 31831

SEQ ID NO: 65314 - RNA, 64 nt, Human; identical to SEQ ID NO: 31832

SEQ ID NO: 65315 - RNA, 64 nt, Human; identical to SEQ ID NO: 31833

SEQ ID NO: 65316 - RNA, 64 nt, Human
uauuuucuuuuguauccuggcaaauacuccugcaggccaggaaguauaauagcaaaaaguugaa

SEQ ID NO: 65317 - RNA, 64 nt, Human; identical to SEQ ID NO: 31834

SEQ ID NO: 65318 - RNA, 64 nt, Human; identical to SEQ ID NO: 31835

SEQ ID NO: 65319 - RNA, 64 nt, Human; identical to SEQ ID NO: 31836

SEQ ID NO: 65320 - RNA, 64 nt, Human; identical to SEQ ID NO: 31837

SEQ ID NO: 65321 - RNA, 64 nt, Human; identical to SEQ ID NO: 31838

SEQ ID NO: 65322 - RNA, 64 nt, Human; identical to SEQ ID NO: 31839

SEQ ID NO: 65323 - RNA, 64 nt, Human; identical to SEQ ID NO: 31840

SEQ ID NO: 65324 - RNA, 64 nt, Human; identical to SEQ ID NO: 31841

SEQ ID NO: 65325 - RNA, 64 nt, Human; identical to SEQ ID NO: 31842

SEQ ID NO: 65326 - RNA, 64 nt, Human; identical to SEQ ID NO: 31843

SEQ ID NO: 65327 - RNA, 56 nt, Human; identical to SEQ ID NO: 31844

SEQ ID NO: 65328 - RNA, 64 nt, Human; identical to SEQ ID NO: 31845

SEQ ID NO: 65329 - RNA, 64 nt, Human; identical to SEQ ID NO: 31846

SEQ ID NO: 65330 - RNA, 64 nt, Human; identical to SEQ ID NO: 31847

SEQ ID NO: 65331 - RNA, 64 nt, Human; identical to SEQ ID NO: 31848

SEQ ID NO: 65332 - RNA, 64 nt, Human
agaguguuugcccaccagcugcuagcccuaggaaggccaggagcccaguagccauguggccagu

SEQ ID NO: 65333 - RNA, 59 nt, Human
auguaaagcaucauugaaucaauggaucuguugaagaacucagcugcuggaaaccaugc

SEQ ID NO: 65334 - RNA, 59 nt, Human
uucccuuaacaucgcugaaaugauuuacuguugaagagaugccuugcgguguggccagc

SEQ ID NO: 65335 - RNA, 59 nt, Human
cagcaguuguuuucauugaugcuugucagguugaagaugcuuucagugaugcucucuau

SEQ ID NO: 65336 - RNA, 59 nt, Human
cuuugauucaccgggauguacaguuuacaguugaagagcaaacagaaagguuuucucuu

SEQ ID NO: 65337 - RNA, 59 nt, Human
agacuuugucuaagccucauuauacugaaguugaagaaaccaaaugagcuccacccuca

SEQ ID NO: 65338 - RNA, 59 nt, Human
auauuuauggcauuuucuugaagagugugguugaagaaauauuucuccuuuuguuuuuc

SEQ ID NO: 65339 - RNA, 59 nt, Human
cuuccccuuuugccaaucucaacacccaaguugaagacuuuguuuuuaaaaugguuugu

SEQ ID NO: 65340 - RNA, 59 nt, Human
auuucuaaguuucaauccugcgcuguacaguugaagaagaguguggaggaagcuauuac

SEQ ID NO: 65341 - RNA, 59 nt, Human
aacacuugagcuguucaggccaguucccuguugaagaaacaguucccuguugaagaaag

SEQ ID NO: 65342 - RNA, 59 nt, Human
ccaguucccuguugaagaaacaguucccuguugaagaaaguagagccugacacugcucc

SEQ ID NO: 65343 - RNA, 59 nt, Human
guaugguaguguuuauaggaauccaggauguugaagaaauggcauaaugucuauauuuu

SEQ ID NO: 65344 - RNA, 59 nt, Human
ucagacuguugcacucuaaaccuagggagguugaagaaugagacccuuagguuuuaaca

SEQ ID NO: 65345 - RNA, 59 nt, Human
aaccuucaaaugugggagcuuggaucaauguugaagaauaauuuucaucauagugaaaa

SEQ ID NO: 65346 - RNA, 59 nt, Human
ccuuccaagagagaacaaaggucagagauguugaagauuccagcaaauuucuccucuua

SEQ ID NO: 65347 - RNA, 59 nt, Human
uaaagacacgcauuccaaaguggaaugugguugaagaaagugggccaggugguugaaga

SEQ ID NO: 65348 - RNA, 59 nt, Human
gaaugugguugaagaaagugggccaggugguugaagaaagccaugugggagcucagcaa

SEQ ID NO: 65349 - RNA, 59 nt, Human
gauuaacaugaaaguuauccaggcgcagaguugaagaagcauaagcaagacaaaaacag

SEQ ID NO: 65350 - RNA, 59 nt, Human
ggcccggcaggaacaccagacaugaacagguugaagaacuggagcgaagugcacaccuc

SEQ ID NO: 65351 - RNA, 59 nt, Human
auucugauuuuacauguaaaacaagaaaaguugaagaagauaugugaagaaaaauguau

SEQ ID NO: 65352 - RNA, 59 nt, Human
guccuacaaucggaauggauucaugccacguugaagauaaaauuauccucucucugaaa

SEQ ID NO: 65353 - RNA, 59 nt, Human
aguugguuugaaccaacuuucuagcugcuguugaagaauauauugucagaaacacaagg

SEQ ID NO: 65354 - RNA, 59 nt, Human
ccaacaucugcugcuacucaaaauguccuguugaagagggacagcugugaugcccuuuu

SEQ ID NO: 65355 - RNA, 59 nt, Human
ucagccaucugguucuccucuuaaggccaguugaagauggucccuuacagcuucccaag

SEQ ID NO: 65356 - RNA, 59 nt, Human
cugccccuggcagccccuguucuggcagaguugaagacagagcuacacaggggaaaaga

SEQ ID NO: 65357 - RNA, 59 nt, Human
aagccucgaggugccuucuucagggccugguugaagaagaugaucaguggacagucugc

SEQ ID NO: 65358 - RNA, 59 nt, Human
caucaaaugccugugaaacagcaaagaugguugaagauugugcucauuauguuugugga

SEQ ID NO: 65359 - RNA, 59 nt, Human
auaugucaccuggcacauucauuuucucaguugaagaagagaaaauuugaaaauguccu

SEQ ID NO: 65360 - RNA, 59 nt, Human
auucuguaucuuuuggaaaaaagccgagaguugaagauaguauauuucugguaguacug

SEQ ID NO: 65361 - RNA, 59 nt, Human
auuaaucucuucuagaauauaugcuaacuguugaagauauuuuggguaaaagagauaau

SEQ ID NO: 65362 - RNA, 59 nt, Human
cuugaagauaaggcugccggacaaagcaaguugaagagaugaguaacaguucucacuga

SEQ ID NO: 65363 - RNA, 59 nt, Human
uccaucauuuaaaaccaguauauucaguaguugaagaaagagcucucccugagucaguu

SEQ ID NO: 65364 - RNA, 59 nt, Human
ggacuguaaagauuuguugacagcaaaauguugaagaaaaaagcuuauagaauaaaagc

SEQ ID NO: 65365 - RNA, 59 nt, Human
gauaagugaggaaacugaggcuuacagagguugaagaccaacaagcuaauaaauaaaaa

SEQ ID NO: 65366 - RNA, 59 nt, Human
guaacuuaugucuugaguaucugggaguaguugaagaacagauaauuccuuccaaacau

SEQ ID NO: 65367 - RNA, 59 nt, Human
uauggcauuuuuuuaaagaugcccuaaguguugaagaagaguuugcaaaugcaacaaaa

SEQ ID NO: 65368 - RNA, 59 nt, Human
cauguaacuuaucagugggguggguuacuguugaagagacccuggggcauuuaccucag

SEQ ID NO: 65369 - RNA, 59 nt, Human
agugccucugccagacacacacugccugaguugaagagacacaggccacacauuucagg

SEQ ID NO: 65370 - RNA, 59 nt, Human
uagaaauaaauaaggauggugauagagagguugaagaagaaaugaagaagcaugaaagu

SEQ ID NO: 65371 - RNA, 59 nt, Human
uuaugaauaccagaccauuuguaagugugguugaagagcaaaaugcuaauugacaucuc

SEQ ID NO: 65372 - RNA, 59 nt, Human
guuaggguauugauagauuagagcaggugguugaagagaucuucucuggucagacuugg

SEQ ID NO: 65373 - RNA, 54 nt, Human
uauuauaggaugaacuuugauaauguugaagaugaagaaaaaguuuaaaagaaa

SEQ ID NO: 65374 - RNA, 59 nt, Human
accugaagaacccugucuccaagucuuugguugaagagaagauauaugacuguugagug

SEQ ID NO: 65375 - RNA, 59 nt, Human
guaaaagguacaaaaacaaacuaaccacaguugaagagaagggcuuccggagcuguauu

SEQ ID NO: 65376 - RNA, 59 nt, Human
guauauuaaacaaaguuucagaguauauuguugaagagacagagacaaguaauuucagu

SEQ ID NO: 65377 - RNA, 59 nt, Human
guuaacucuuccaagaacagaagcggcauguugaagaaaaucugggggauugggauggg

SEQ ID NO: 65378 - RNA, 59 nt, Human
ugucuggggcugacuugcacagaaauucuguugaagacaguugagaauuccuuuggaga

SEQ ID NO: 65379 - RNA, 59 nt, Human
uaaaacuaaauguugcguggguggcaugaguugaagaaggcaaaggcuuguaaauuuac

SEQ ID NO: 65380 - RNA, 59 nt, Human
augucacuauuuuuguaaaugagguuuacguugaagaaacaguauacaagaacccuguc

SEQ ID NO: 65381 - RNA, 59 nt, Human
ggaacgaaguaggagugcaacucaaauguguugaagauacugcagucauuuuuguaaag

SEQ ID NO: 65382 - RNA, 59 nt, Human
uuuuugcuuuauucugcaaaagugaacaaguugaagacuuuuguauuuuugacuuugcu

SEQ ID NO: 65383 - RNA, 59 nt, Human
cuugcuguuuaaaaagacagaugaaauaaguugaagaaaccucauguaaugaauccacc

SEQ ID NO: 65384 - RNA, 59 nt, Human
agaguaaguugagaagguaucaguuuaauguugaagaauugaccucagggcucaguuuc

SEQ ID NO: 65385 - RNA, 59 nt, Human
auguggccuguuuacaaaacauucagcacguugaagaaaguguucccaauggaguggaa

SEQ ID NO: 65386 - RNA, 59 nt, Human
guucuccuugauugggacuggggcugaagguugaagaggugagcacggccaacaaagcu

SEQ ID NO: 65387 - RNA, 59 nt, Human
auaugggggggagggcgcuggaugcaaaaguugaagaucgugaugcuaugauguuaguu

SEQ ID NO: 65388 - RNA, 59 nt, Human
ggacguaagacaagaagucucugugaaggguugaagagugacaagcauugguaacagug

SEQ ID NO: 65389 - RNA, 59 nt, Human
ugcuuuugcugccuuuggccagagagcugguugaagauguuuguaaucguuuucagucu

SEQ ID NO: 65390 - RNA, 59 nt, Human
ggaguuuguuaagugcucucuggauuugaguugaagagcauccauuugaguugaaggcc

SEQ ID NO: 65391 - RNA, 59 nt, Human
ggauuucuaaucaaaagggaaaagaagauguugaagaauacaguuaggcaccagaagaa

SEQ ID NO: 65392 - RNA, 59 nt, Human
uggagugucauuaaugggcaggcuuuucuguugaagaguggauuccguauguucuucau

SEQ ID NO: 65393 - RNA, 59 nt, Human
caauguauuuguuugcaaacauuugccauguugaagaguguguauaggaaaggucuaga

SEQ ID NO: 65394 - RNA, 59 nt, Human
gcuaaaauaaacagguuguggcugaugguguugaagauaaauaagcuuaaacaaauaac

SEQ ID NO: 65395 - RNA, 59 nt, Human
ucucuuuuuuuuuccuuuuuuggcccaauguugaagauguagaacuuuguuuuuaaaua

SEQ ID NO: 65396 - RNA, 59 nt, Human
gaguucugacucacugaaaugcguguuggguugaagauaucuuuuuucuuuucugccuc

SEQ ID NO: 65397 - RNA, 59 nt, Human
uuuuuuuucugcuuuuaaacuguaacauaguugaagauuucuuuuuucuguucucauug

SEQ ID NO: 65398 - RNA, 59 nt, Human
gaagaaauugauuacaguuccacuaaauuguugaagauaaauuauuuuuaaagguuaug

SEQ ID NO: 65399 - RNA, 59 nt, Human
ucugacaggaaagguuuagaugcuggagaguugaagagguguaagaagagaucgugccc

SEQ ID NO: 65400 - RNA, 59 nt, Human
aucuuuuuuuaaauaaguauuuuguugagguugaagaauugcuggcaauuaaaagaaua

SEQ ID NO: 65401 - RNA, 59 nt, Human
cuacgcccccguuuuauggguuuggcuuaguugaagaggaaaggguugugcaaggagag

SEQ ID NO: 65402 - RNA, 59 nt, Human
ugcugaugguuucccagagcccacacugaguugaagaaccuauuguucuucuuggcauc

SEQ ID NO: 65403 - RNA, 59 nt, Human
guguaaauggauuguuaagguaacuuucaguugaagauuaaagcaagaugccauuuucc

SEQ ID NO: 65404 - RNA, 59 nt, Human
acccgguucacccagcucgaggaucccagguugaagaguggccccuugaggcccuggaa

SEQ ID NO: 65405 - RNA, 59 nt, Human
ugaaugaaaauaauaauuuucuacuuggaguugaagagggcagaauccgcagcucucau

SEQ ID NO: 65406 - RNA, 59 nt, Human
acaaacugaaaauaauggcucguguuuauguugaagauaaauagcaccauuauuggggg

SEQ ID NO: 65407 - RNA, 59 nt, Human
aagugggcaugauuaccaugauuuuuauaguugaagaaccuaagacacagagaccaagg

SEQ ID NO: 65408 - RNA, 59 nt, Human
ggacauguuauauauaauccaucucagaaguugaagaugugauguugcucggccuuugg

SEQ ID NO: 65409 - RNA, 59 nt, Human
aggacauucagcucaaggcucccugccguguugaagaguucugacugcacaaaccagcu

SEQ ID NO: 65410 - RNA, 59 nt, Human
auaaaccaggcaauguaaguguucgagguguugaagaugggaaggauuugcagggcuga

SEQ ID NO: 65411 - RNA, 59 nt, Human
gaggaaugaaugcaccuauuuggcuuuaaguugaagaugaauuauuucucaugcucauu

SEQ ID NO: 65412 - RNA, 59 nt, Human
uggcugugauuaauuauugaaagugggguguugaagaccccaacuacuauuguagagug

SEQ ID NO: 65413 - RNA, 59 nt, Human
ucacaaauacaagcauaaguagaagauuuguugaagacauagaacccuuauaaagaauu

SEQ ID NO: 65414 - RNA, 59 nt, Human
gcaaguaugaaucacuuaaccugcugauaguugaagaacacuuuaggaguuuuguauuc

SEQ ID NO: 65415 - RNA, 59 nt, Human
auuacaauuuaugggcuagagccaaauagguugaagacaaucauccaaacagaucaaug

SEQ ID NO: 65416 - RNA, 59 nt, Human
uucauggucuuaaaaagauacuuuaugugguugaagaugaaaucauuccuaaauuaacc

SEQ ID NO: 65417 - RNA, 59 nt, Human
uucuugagcgaagcuguuugaguaaaccuguugaagaguguuugugucuuuugugcuuu

SEQ ID NO: 65418 - RNA, 59 nt, Human
gagccaagacuuguggacagcacuucacaguugaagaagggccuucacacacaaaaccu

SEQ ID NO: 65419 - RNA, 59 nt, Human
agcaauaauccuacuccucaaaauagaaaguugaagauugcugaaaaauaugacuuuuc

SEQ ID NO: 65420 - RNA, 59 nt, Human
aaucauggaaguaaacaucugagaaaccuguugaagauuauuucauucgucuuguuguu

SEQ ID NO: 65421 - RNA, 59 nt, Human
ggaaugacuauuacugccauauuuauuuaguugaagaaugucuuuguguuaauucauuc

SEQ ID NO: 65422 - RNA, 59 nt, Human
aaguucagcuuuauguauuuguauggggaguugaagauucagauagagguauuaagaug

SEQ ID NO: 65423 - RNA, 59 nt, Human
aucaucaaauuuucaagugaagauagucuguugaagauugaacaaugaccuugaaagac

SEQ ID NO: 65424 - RNA, 59 nt, Human
guauuauuucuaggaaagauauggaugaaguugaagagaaaucuaaagauguuauaaac

SEQ ID NO: 65425 - RNA, 59 nt, Human
agggaagccaaaagaaugaucuagaguauguugaagaagauggacauguggugguacga

SEQ ID NO: 65426 - RNA, 59 nt, Human
aucuuuaacuauagccuagagaaaagaggguugaagagcaaagcagauuuuuuuuuucc

SEQ ID NO: 65427 - RNA, 58 nt, Human
caagacuaaugcauaauauuaaacaucauguugaagaaauaauuuuaguuucguaauu

SEQ ID NO: 65428 - RNA, 59 nt, Human
ccauugucucugacugcagguuugaauaaguugaagaccagagaaaaguacacacuggg

SEQ ID NO: 65429 - RNA, 59 nt, Human
aauuuaguuuguacucaguggacagugcuguugaagauuugaggacuuguuaaagagca

SEQ ID NO: 65430 - RNA, 59 nt, Human
gaaguaguuaagaaauggcccuuuugaauguugaagauaggaaagaaagccauauauuc

SEQ ID NO: 65431 - RNA, 59 nt, Human
ugccaucuuuggcauaagaaguauuuugaguugaagacaauugagaaaaaaaauagauu

SEQ ID NO: 65432 - RNA, 59 nt, Human
aaaaaaagcagcgcugguugacaaaggguguugaagauuuuugcugcagaaucaguuac

SEQ ID NO: 65433 - RNA, 59 nt, Human
cacauacaacuaauuuauuugaacuauauguugaagacaucuaccaguuucuccaaaug

SEQ ID NO: 65434 - RNA, 59 nt, Human
uugguggagugaacaaagagcaugaaaauguugaagaccacaaccaaaauuuacucaaa

SEQ ID NO: 65435 - RNA, 59 nt, Human
aagaaguuuuguuccguuucuuuaaugugguugaagagcaauguguggcugaagacuuu

SEQ ID NO: 65436 - RNA, 59 nt, Human
cccuuucagagauauaauaagcccaacaaguugaagaagcuggcggaucuagugaccag

SEQ ID NO: 65437 - RNA, 59 nt, Human
gccugacauucuuuaugaaauuuagaauuguugaagaacuauaacauuucaguaggguu

SEQ ID NO: 65438 - RNA, 59 nt, Human
aagagaaacgccaacaaaaaucagcagauguugaagacaggggucucgggggugggcuc

SEQ ID NO: 65439 - RNA, 59 nt, Human
uucucuguucuggcgugaguugugaaagaguugaagacagcuucccaugccgguacaca

SEQ ID NO: 65440 - RNA, 59 nt, Human
acccaucacuguuggucuacacccaguuuguugaagaacugcggguucacgagccauuu

SEQ ID NO: 65441 - RNA, 59 nt, Human
auucaaaaaaugcucuaaacauaggaaugguugaagaggucuugcagucuucagaugaa

SEQ ID NO: 65442 - RNA, 59 nt, Human
aauaugcaugauaguauaauccaguaaugguugaagaauguauuuuacuuaaagaggga

SEQ ID NO: 65443 - RNA, 59 nt, Human
acacggguccuucauuguccuguaaggguguugaagaugcucccuggcggcccccaagc

SEQ ID NO: 65444 - RNA, 59 nt, Human
ugcccgucugugacuuucuacucaccaagguugaagaaaggaaacggggaaaaucaaaa

SEQ ID NO: 65445 - RNA, 59 nt, Human
uccagugaaacuuaugacuuggauauaugguugaagaaucaaaacaaaagcaaaaaaaa

SEQ ID NO: 65446 - RNA, 59 nt, Human
guccaaauaaaaugcaugguguaccagaaguugaagaucggguugaggauuggggcuag

SEQ ID NO: 65447 - RNA, 59 nt, Human
gggcuaauuguaugaauaggugucaguauguugaagauuacuuucuuuugugacuuucu

SEQ ID NO: 65448 - RNA, 59 nt, Human
uaugugucccuccuaaagcugcaugcucaguugaagaggacgagaggacgaccuucucu

SEQ ID NO: 65449 - RNA, 59 nt, Human
auuuacaaguauaaaugcugaguaugucuguugaagacgagcagagauauuaaauuaua

SEQ ID NO: 65450 - RNA, 59 nt, Human
aauucuuucauuuuagggguagcauuuguguugaagagguuuuaaagcuuccauuguug

SEQ ID NO: 65451 - RNA, 59 nt, Human
acuauuauaauauuuuugcugacuacccaguugaagaaaaguuuguuaauuggauggga

SEQ ID NO: 65452 - RNA, 59 nt, Human
cacaagagcuccuccauguuuggauagcaguugaagagguugugugggugggcuguugg

SEQ ID NO: 65453 - RNA, 59 nt, Human
gaccuauugccaggaauguuucagcugcaguugaagagccugacaagugaaguuguaaa

SEQ ID NO: 65454 - RNA, 59 nt, Human
gccgcugaggagcccccagcagagcugggguugaagaggcagcuugucccccgaccuuc

SEQ ID NO: 65455 - RNA, 59 nt, Human
ucauguucauuugccucuuaaaggcaaggguugaagauaaauaagguagcaaugucuau

SEQ ID NO: 65456 - RNA, 59 nt, Human
aagacugcaaccaacggaaaucaauaggaguugaagagauuaaacugacuuuguuuugg

SEQ ID NO: 65457 - RNA, 59 nt, Human
acaugaaaagugagcucaaauuuuuuuuaguugaagauuacauauaaaguugugucuga

SEQ ID NO: 65458 - RNA, 59 nt, Human
gccuaauauaauuguagggaucuuuaaaaguugaagagggaggcaaaagaggaggucag

SEQ ID NO: 65459 - RNA, 59 nt, Human
uuagauguuauuaugcuaauauaguagggguugaagaaaacaaaauagcuuauuauaga

SEQ ID NO: 65460 - RNA, 59 nt, Human
caaggugggaggaucguuugagcccaggaguugaagaccagccugggcaacacagugag

SEQ ID NO: 65461 - RNA, 59 nt, Human
gaccagugaugcuuugugcaauuaugaauguugaagauuaaaguacauaguuacuaauu

SEQ ID NO: 65462 - RNA, 59 nt, Human
aauucauuacagaguccagguggccugcaguugaagaucaucaaccauuuuugccucac

SEQ ID NO: 65463 - RNA, 59 nt, Human
uuucaggagcuagcagaaaauaacucaaaguugaagacucuggaagauuuugcuuuaac

SEQ ID NO: 65464 - RNA, 59 nt, Human
ccuucauuuauaaucagugagauuccccuguugaagaaacuaaauuuuauauagguaaa

SEQ ID NO: 65465 - RNA, 59 nt, Human
gcaaucaggagauaauucauuauggcugaguugaagacuuaagguguaauuucauuaca

SEQ ID NO: 65466 - RNA, 59 nt, Human
auuccaggaggcagaagauaacuaauuguguugaagaaacuuagacuucacccaccagc

SEQ ID NO: 65467 - RNA, 59 nt, Human
auguuaccuaggacauuuugauguguuaaguugaagaaagguaacucguguaugaaccc

SEQ ID NO: 65468 - RNA, 59 nt, Human
acuuuuauauuucaaaguacacuaagaucguugaagagcaauagaaccuuuaagacagu

SEQ ID NO: 65469 - RNA, 59 nt, Human
ccaacucaccucuauuuugucaguucauaguugaagauuuuguuuuauuucaaaaacaa

SEQ ID NO: 65470 - RNA, 59 nt, Human
uuaaguugaugaccuaaaguccagguaguguugaagauaguauguaucuagaauacugg

SEQ ID NO: 65471 - RNA, 59 nt, Human
gggaaaaacaccagcuuugacccgaaguaguugaagagcuacuucauucuuuucugaag

SEQ ID NO: 65472 - RNA, 59 nt, Human
cauuguuuugguauaagguacauauuuugguugaagacaccagacugaaguaaacagcu

SEQ ID NO: 65473 - RNA, 59 nt, Human
uuuuuucuuaauaaaauggaauccacuguguugaagacucuugauaucaugugcuuguc

SEQ ID NO: 65474 - RNA, 59 nt, Human
augucuuggccaaagaugggaaaaccuauguugaagaggcagcccuugaguguuaauuu

SEQ ID NO: 65475 - RNA, 59 nt, Human
uuuccucauaccuuaugcuugaggauauuguugaagaacacuuccuggaacacuucuca

SEQ ID NO: 65476 - RNA, 59 nt, Human
gagcugcugggauguggggggcauaucaaguugaagauggcaacucugaucugacgccu

SEQ ID NO: 65477 - RNA, 59 nt, Human
agauaguaucucuguucauaugugaauaaguugaagauuguggggcuacuuuuucucau

SEQ ID NO: 65478 - RNA, 59 nt, Human
gauuuaaagaagaauauucagauaaggauguugaagauaaugacacuaaaucuauggac

SEQ ID NO: 65479 - RNA, 59 nt, Human
cguggccuuaucgauugcagugggaaguuguugaagacuugaagacgugauuccugcuc

SEQ ID NO: 65480 - RNA, 59 nt, Human
gaaguagauguucuuugcuccuugucagaguugaagaggcugacuuggcccacugcuaa

SEQ ID NO: 65481 - RNA, 59 nt, Human
acuagaaaaugaacagcagcugaaauuauguugaagauccuuuuauaccugaaagaguu

SEQ ID NO: 65482 - RNA, 59 nt, Human
cuuccccugccuaucuguuuguuguuguuguugaagacaguaaaauaaguguuuucaaa

SEQ ID NO: 65483 - RNA, 59 nt, Human
aagaaaugauguugguuuaccuuuuccuaguugaagauaguaauuagguuucuaagcug

SEQ ID NO: 65484 - RNA, 59 nt, Human
ggauuagaaaugauuuauguuagccauguguugaagaugaaauuggcaucaguguagac

SEQ ID NO: 65485 - RNA, 59 nt, Human
agucauauuaacagaacacuccugagacaguugaagaagaaauagcacaaaucaggggu

SEQ ID NO: 65486 - RNA, 59 nt, Human
ugggacuucagugggaguuacacaggaauguugaagaaucauucuucuuuuucaugcau

SEQ ID NO: 65487 - RNA, 59 nt, Human
gucuuugggguugguuccuagaggcagagguugaagauggaagagggagcucuggagug

SEQ ID NO: 65488 - RNA, 59 nt, Human
ucuuggggggcuguacauuuauuuauuuaguugaagauucacugaucccacuuugaaau

SEQ ID NO: 65489 - RNA, 59 nt, Human
gcuacccacuucuaaauagcaauuucgccguugaagaggaagggcaaaaccacuagaac

SEQ ID NO: 65490 - RNA, 59 nt, Human
uaccugauuuccaacaccagcuacaaagaguugaagaugauaccuaugggucgcguuaa

SEQ ID NO: 65491 - RNA, 59 nt, Human
ggaagguuuuguuacagggagcauggucuguugaagauuuuuaaaauguauuuuucuag

SEQ ID NO: 65492 - RNA, 59 nt, Human
uuacucagcaaaagauagcaaaacgggugguugaagauaauucauuuuaaucguaaugu

SEQ ID NO: 65493 - RNA, 59 nt, Human
uucuauuuucuguaauguuuaaguaugauguugaagaaauucacauucucuuauaguuu

SEQ ID NO: 65494 - RNA, 59 nt, Human
ccuugugcccuggagugggguuucuccuuguugaagaagaggcauccuucucugaugug

SEQ ID NO: 65495 - RNA, 59 nt, Human
caagcagcuugauuccaccaaucagagaaguugaagaugaauguugacucccaggagac

SEQ ID NO: 65496 - RNA, 59 nt, Human
caauucaggucccuuauggggugaacacuguugaagacugguuaauuauaaguuaugua

SEQ ID NO: 65497 - RNA, 59 nt, Human
agaggucucucccugcagguggccacaugguugaagagugacguggggcuaggugagag

SEQ ID NO: 65498 - RNA, 59 nt, Human
gcuucugggccaggccauugucacuguuaguugaagaaaaagcaguucccaggugccag

SEQ ID NO: 65499 - RNA, 59 nt, Human
ugccuagaguaguaguaugaaaacuauuuguugaagaaauaaaugaauggaaagacaua

SEQ ID NO: 65500 - RNA, 59 nt, Human
ucucuguggccacaggaacaaagaugcgaguugaagaucccuuugugccgguagaauaa

SEQ ID NO: 65501 - RNA, 59 nt, Human
caacauugaucaaccauuaagacaagauaguugaagacauguauguggacugucaacaa

SEQ ID NO: 65502 - RNA, 59 nt, Human
gauuuaugcugcuuuacauugacuaugcaguugaagaguugcacaucaccuuuaguagu

SEQ ID NO: 65503 - RNA, 59 nt, Human
agaggccaaaucuguaaaaucaaaaugagguugaagacaauuagugaaaguaauguuau

SEQ ID NO: 65504 - RNA, 59 nt, Human
uaacagguacuuugaaggcaagacauaggguugaagaagcacagccagccucugaaauc

SEQ ID NO: 65505 - RNA, 59 nt, Human
auagaaggcaggagggggaauucgacauuguugaagacauaauuuauaccaaguuaugc

SEQ ID NO: 65506 - RNA, 59 nt, Human
cuucgcacugagcacaucacauuuaggacguugaagauuuuuuuuuuuuuuuuuuuuua

SEQ ID NO: 65507 - RNA, 59 nt, Human
accgagucuacuuggcccuagaagagaaaguugaagagucccagaccuacuagcauuuu

SEQ ID NO: 65508 - RNA, 59 nt, Human
uaccuuucccagggguguccaccagaagaguugaagaagaggugagaagaucccaaggu

SEQ ID NO: 65509 - RNA, 59 nt, Human
cauauucuucauauaguaaaaggcaaaguguugaagauacuacggugugguaguaguug

SEQ ID NO: 65510 - RNA, 59 nt, Human
agggauuuuuuucuacagguguauauuuuguugaagagucacuuuccucaaccauuuuu

SEQ ID NO: 65511 - RNA, 59 nt, Human
ucuguauuagacucacacacaucaguccaguugaagaauugguuuaaacuuuuaaauga

SEQ ID NO: 65512 - RNA, 59 nt, Human
cauuuuuuuucuuuuucuuuuuuuuuucuguugaagauuaacacuaauuaucacgucug

SEQ ID NO: 65513 - RNA, 59 nt, Human
accguuaacacauuaaagagucugauuuuguugaagaaaauauuugcaauaaauucaag

SEQ ID NO: 65514 - RNA, 59 nt, Human
gugaaaaaguaacuugagacacgaccuaaguugaagaguuuagacuugcugaguuuuag

SEQ ID NO: 65515 - RNA, 58 nt, Human
uuguguacuuuuuucaauaaaauaucaaaguugaagaacuuuucuucuaaaaccacac

SEQ ID NO: 65516 - RNA, 59 nt, Human
uaauguuuuauugcauugauaauguuucuguugaagaaaccguuauacuugaauucagg

SEQ ID NO: 65517 - RNA, 59 nt, Human
cagauucugccuuguuucauaguaugaggguugaagacggaaaacaaucuaagggucuc

SEQ ID NO: 65518 - RNA, 59 nt, Human
auggccugugcugcucagaaugccagccuguugaagauaaacaacaaaaaugcauuggu

SEQ ID NO: 65519 - RNA, 59 nt, Human
uuucucccugacuaccaaauggagugacgguugaagaaucaagcucauaauaugauaca

SEQ ID NO: 65520 - RNA, 59 nt, Human
gagauuuuuuaguaaagaugagaaagaugguugaagaaaauuagugcauaauuucucag

SEQ ID NO: 65521 - RNA, 59 nt, Human
agcuauuuuuugaagaugaugaacuaaauguugaagacaaguuugagaucuguaaaaug

SEQ ID NO: 65522 - RNA, 59 nt, Human
auguggacugaaucugcuuguugaucaguguugaagaaagugcaaaaggaacuuuuaua

SEQ ID NO: 65523 - RNA, 59 nt, Human
caaguguggucuuuuucuuuccuccuaauguugaagagaaaaaaaaaaaaaaaaguuug

SEQ ID NO: 65524 - RNA, 59 nt, Human
cugagcgcucacagcuucauuuggcccagguugaagacaaggaaagcucugcuguggcu

SEQ ID NO: 65525 - RNA, 59 nt, Human
cuuucccaaaucuugguagucuccuuauaguugaagauaaaauguugagugcacuuauu

SEQ ID NO: 65526 - RNA, 59 nt, Human
uauugaaucugucugauauagaucuuaggguugaagaagcuaucuuugucuauuugggc

SEQ ID NO: 65527 - RNA, 59 nt, Human
uuauuugggccaguuauagcuuauuagguguugaagagaccaagguugcaaggccaggc

SEQ ID NO: 65528 - RNA, 59 nt, Human
acucuagagaagaaaagugaagaagucauguugaagaagauguaagaaugugucaagac

SEQ ID NO: 65529 - RNA, 59 nt, Human
ugacacuugaaaaaagauacuauuuauaaguugaagaaaguuugcuguaccacaaugcg

SEQ ID NO: 65530 - RNA, 59 nt, Human
uaaggguuauacucaguuuuuaacacauuguugaagaaaagguaccagcuuuggaacga

SEQ ID NO: 65531 - RNA, 59 nt, Human
gacuuugaaccacaaguuagcauuuauuuguugaagagaagaauguguggugaugucuu

SEQ ID NO: 65532 - RNA, 59 nt, Human
ccuggucucucagcaaacacuccugagugguugaagaugcuggacauuggauucuagca

SEQ ID NO: 65533 - RNA, 59 nt, Human
cuaacaaauguauacgguuuuaguucaguguugaagaauuuuaauacaauauuaaauua

SEQ ID NO: 65534 - RNA, 59 nt, Human
cagaggcaguuuggaauaagcugcggcaaguugaagaagcuguguuggacgagauugcc

SEQ ID NO: 65535 - RNA, 59 nt, Human
aauaauuuaauauaccauguaauuuaccaguugaagauguucgcuuucagaauauaaua

SEQ ID NO: 65536 - RNA, 59 nt, Human
gccggcggagaggccgcgugugggagcguguugaagauuuuaaguggucucuacaccca

SEQ ID NO: 65537 - RNA, 59 nt, Human
auuccaugaauuuuaagacccauagaaaaguugaagaaugcuuaauuuucuuauccagu

SEQ ID NO: 65538 - RNA, 59 nt, Human
cuaaauuuguaaaaaauuaguuuguuauaguugaagauuaacuuuuccuaacauuguga

SEQ ID NO: 65539 - RNA, 59 nt, Human
aaacuacugucauguacugaaucuuuccuguugaagaaauccauguuauagaaaagaac

SEQ ID NO: 65540 - RNA, 59 nt, Human
uaauggcuauuaguguucaugguuaguguguugaagaugagccagguacauaacgcggc

SEQ ID NO: 65541 - RNA, 59 nt, Human
aggaacuaauccucacuguuccuucuugaguugaagaucuuugacauagguucuucuau

SEQ ID NO: 65542 - RNA, 59 nt, Human
aagcauagagaugguggggugguggugggguugaagaaacuuguugguauaauugucau

SEQ ID NO: 65543 - RNA, 59 nt, Human
cuucgucucaaaaaaaaaaaaaaguuuggguugaagaucaaauucgugauaucucuaua

SEQ ID NO: 65544 - RNA, 59 nt, Human
cagaaauaaauaaggguggugauagaaagguugaagaagaaaugaagaagcacggaagu

SEQ ID NO: 65545 - RNA, 59 nt, Human
ucacauauguagguauucauuuugaguagguugaagaagaaaaaaaauauuuaaaugaa

SEQ ID NO: 65546 - RNA, 59 nt, Human
ccuauuuugauuuuauuuaauuuuuuaaaguugaagaauuaaauauuuuaaugguucua

SEQ ID NO: 65547 - RNA, 59 nt, Human
cacagugggcagauugcuugagcccaggaguugaagaacguggcgaaaccccguaucua

SEQ ID NO: 65548 - RNA, 59 nt, Human
acuugcucuccaaugguauccagugauucguugaagaggaggugcucuguagcagaaac

SEQ ID NO: 65549 - RNA, 59 nt, Human
uacuuuaaguaaaaaaaaaaaaaauucugguugaagauagaggauaugaaaugccauaa

SEQ ID NO: 65550 - RNA, 59 nt, Human
agggggcaaggaaaauugcuaccugauuuguugaagauuuuuccucuugccuuacacau

SEQ ID NO: 65551 - RNA, 59 nt, Human
gagguagagugggaccaugucgugaggcaguugaagaguugaggaaagguuuuucuggg

SEQ ID NO: 65552 - RNA, 59 nt, Human
uugucuaauauauuggagucuuuaaaaguguugaagaauaaaauauuaauuagaacaac

SEQ ID NO: 65553 - RNA, 59 nt, Human
ucuccugaggugaagcuuuuccagguuuuguugaagagauaccugccagcacuucugca

SEQ ID NO: 65554 - RNA, 59 nt, Human
accauuuuguaaauaaaggcagaauuuguguugaagauucuuauaugaauaaccuuccu

SEQ ID NO: 65555 - RNA, 59 nt, Human
uacuuaggcauuuuaucuuggcucaaauuguugaagaaugguggcuuguuucaugguuu

SEQ ID NO: 65556 - RNA, 59 nt, Human
auacuggcauaucugacuguaagcaguagguugaagauaucauuuuaugaauguggaga

SEQ ID NO: 65557 - RNA, 59 nt, Human
uuacaguuccaaaugaguugauaaagauuguugaagagauccaaaaccagaauaagcca

SEQ ID NO: 65558 - RNA, 59 nt, Human
aguucuguagaguuagaauaccuuuuguuguugaagaugugaaugaaguaugcaugugc

SEQ ID NO: 65559 - RNA, 59 nt, Human
aucuccaaacuaaacccucacaaguaacaguugaagaaaaaauggcaagagaucauauc

SEQ ID NO: 65560 - RNA, 59 nt, Human
cuguagguggccgcugacaagugccuuuaguugaagagcacauuucuuucaucucucuu

SEQ ID NO: 65561 - RNA, 59 nt, Human
aaauaccgacagcgccaccugaagguggaguugaagagcuuccuggaggugcuggacgg

SEQ ID NO: 65562 - RNA, 59 nt, Human
gucugggacaucgugggcacugagcugaaguugaagaaggagcucacaggccucaacca

SEQ ID NO: 65563 - RNA, 59 nt, Human
uccgcagacuuggucaucgaccuauuuuuguugaagaaugaaaggcaaugacaaguuua

SEQ ID NO: 65564 - RNA, 59 nt, Human
uaaaaugcuggggcaagaugcaguacaaaguugaagagacuuuauucucaauaaguuga

SEQ ID NO: 65565 - RNA, 59 nt, Human
auaaaguacucucaguaaggaguguuugaguugaagagucaucugauucgaggccacuc

SEQ ID NO: 65566 - RNA, 59 nt, Human
ugucaguaaauacugugcauucaguagaaguugaagaaucauuguuagaagcauuucca

SEQ ID NO: 65567 - RNA, 59 nt, Human
ugugacugggcuccgggccuuuccacuacguugaagaagaaaaccuauuuuuaaaugua

SEQ ID NO: 65568 - RNA, 59 nt, Human
uccauuacuccaugcccccuugaggcacuguugaagaaaucucacuuuucagccagggu

SEQ ID NO: 65569 - RNA, 59 nt, Human
ucccauccuccuccuucauacccaccucuguugaagaacauguaacguacuacugccau

SEQ ID NO: 65570 - RNA, 59 nt, Human
gccagcuuggacucacaucauucuaugggguugaagacaacucauucccucugaggagc

SEQ ID NO: 65571 - RNA, 59 nt, Human
cuucugaaucacuguugaguucugauuguguugaagaaggguuauccuuucauuaggca

SEQ ID NO: 65572 - RNA, 59 nt, Human
guucaugcggccccaggggccucccuccuguugaagacugggggagagcaguggguucu

SEQ ID NO: 65573 - RNA, 59 nt, Human
uuugugcuggggugggauuaugggucaauguugaagaauuuuuaagucuguauuauguu

SEQ ID NO: 65574 - RNA, 59 nt, Human
gguguguagcagcagguauacaggaaaauguugaagagccccagggcuccugugagugg

SEQ ID NO: 65575 - RNA, 59 nt, Human
gugggauaugaaguggaggugccuagaggguugaagauaaugaggacagaugaagaaau

SEQ ID NO: 65576 - RNA, 59 nt, Human
aacuuucucuggaagggucuggacuagguguugaagaccugaaagauaacacuccuuca

SEQ ID NO: 65577 - RNA, 59 nt, Human
uacaagaaaguacgagauuuagucaacuuguugaagagcuauugaaaaucauuugugcu

SEQ ID NO: 65578 - RNA, 59 nt, Human
gugcucuguguucccagaggcaggcggagguugaagaaaggaaccugggaugaggggug

SEQ ID NO: 65579 - RNA, 59 nt, Human
gaggaggccuggaccgagaugugaguccuguugaagacuuccucucuaccccccaccuu

SEQ ID NO: 65580 - RNA, 59 nt, Human
cuucuaaauuuaaagaaaacaaaauuggaguugaagaauaaguagguuuccaauuggcu

SEQ ID NO: 65581 - RNA, 59 nt, Human
ugggucuggcccauuucaggccaucuucaguugaagaaacacccucuuaggcugugcaa

SEQ ID NO: 65582 - RNA, 59 nt, Human
acuguguuucguuuggcucaaugacgaauguugaagaugcuuuuauguucugagccaca

SEQ ID NO: 65583 - RNA, 59 nt, Human
uauacacagaagugauaaaggaauccaaaguugaagagcccaggaaacgggaaacugua

SEQ ID NO: 65584 - RNA, 59 nt, Human
aggcucagaggcuucagcccagcugcauaguugaagauuuauggacagaaggaaaguga

SEQ ID NO: 65585 - RNA, 59 nt, Human
agacucuccuaucuacugcuacagauccuguugaagaaagagcuuaccccuuucccccg

SEQ ID NO: 65586 - RNA, 59 nt, Human
ggaccagaauuucaauguauguuuccauuguugaagauaacauuuucuucaaagagccu

SEQ ID NO: 65587 - RNA, 59 nt, Human
uggauggacucuucaaaacuuaccaaauaguugaagaaaccaggugccuucucaugaug

SEQ ID NO: 65588 - RNA, 59 nt, Human
guauuauuauucgcccauuccgagagaaaguugaagaugacugaagaacuaaaaauaca

SEQ ID NO: 65589 - RNA, 59 nt, Human
gggucuccgggggccacagcuuggggugaguugaagaccucaggggauguggagggguc

SEQ ID NO: 65590 - RNA, 59 nt, Human
ugugccaggccucacagacucccaguuggguugaagaaugguugacugaguuugauucu

SEQ ID NO: 65591 - RNA, 59 nt, Human
caaaauacucauuuuuuaaguguaauuaaguugaagaucaaaaaauggaaauguauaau

SEQ ID NO: 65592 - RNA, 59 nt, Human
aaacagccuaccucauagcucucaagccaguugaagaaaccuugccuuuucagcuugac

SEQ ID NO: 65593 - RNA, 59 nt, Human
ucucccggagccucugcugucacucgcuuguugaagaugaauucuugaauucugccugc

SEQ ID NO: 65594 - RNA, 59 nt, Human
auuauauaaaguauuguaaauagaauaguguugaagauaugaaauauggcuauuuuuaa

SEQ ID NO: 65595 - RNA, 59 nt, Human
augaaugugaggucacuaguaauacagcuguugaagaauuagagggaaauaggaaauga

SEQ ID NO: 65596 - RNA, 59 nt, Human
uucggcuagggaggaagguagaguaagagguugaagauaacagagugcaaaguuuccuu

SEQ ID NO: 65597 - RNA, 59 nt, Human
uuuggagcuguuggagcacuccuugagcuguugaagaucccgugaucauuaccugggga

SEQ ID NO: 65598 - RNA, 59 nt, Human
aagacucaccuaauuugugaccugagacuguugaagaaauagagaggagggggcccguu

SEQ ID NO: 65599 - RNA, 59 nt, Human
agaugucccaguauguuucuuucugccccguugaagaggugcagccucaggcugagaaa

SEQ ID NO: 65600 - RNA, 59 nt, Human
aggauguguuucagcccugagauguuacaguugaagagcuugguuuucauugagcauuu

SEQ ID NO: 65601 - RNA, 59 nt, Human
ugacuuaacuacuuuaucuccauuuuguaguugaagaaauaaguucagagagaaagauu

SEQ ID NO: 65602 - RNA, 59 nt, Human
aggggcuccagaaagaaucuuacacauguguugaagacauugaugucauagggagcggg

SEQ ID NO: 65603 - RNA, 59 nt, Human
cuagugauguguggcaaaucaaaucaacuguugaagaaggggugaguuuucugugcuac

SEQ ID NO: 65604 - RNA, 59 nt, Human
augucccuggggcagacacuaaggcagguguugaagacaagcugcuugucaagaagcau

SEQ ID NO: 65605 - RNA, 59 nt, Human
ggcaagugcaggaacucaguuaaaaugcaguugaagaaugucaucucccgaauugcugu

SEQ ID NO: 65606 - RNA, 59 nt, Human
ccgcaggucuuccuucucgccgucuugcaguugaagagcuacauacguagucaguuucg

SEQ ID NO: 65607 - RNA, 59 nt, Human
uauugcuuuucagggaaaucauggauaggguugaagaagguuacuauuaauuguuuaaa

SEQ ID NO: 65608 - RNA, 59 nt, Human
cuucccuguguggcugcacugagguggguguugaagagcccccuaggggacacacagcu

SEQ ID NO: 65609 - RNA, 59 nt, Human
gcaacugacuucuuguccugggguuaaaaguugaagauauuuucugaugauauuaaaag

SEQ ID NO: 65610 - RNA, 59 nt, Human
guugaagauauuuucugaugauauuaaaaguugaagauauuucugcacuugggcccucc

SEQ ID NO: 65611 - RNA, 59 nt, Human
gugcaaaaaucucauaauguuuuaauaaaguugaagaauuuguguuugggccucauuca

SEQ ID NO: 65612 - RNA, 59 nt, Human
cuaaaauuacagccugaauccuuucuuuaguugaagaaaggguaugugugugcaagugg

SEQ ID NO: 65613 - RNA, 59 nt, Human
uaaaacuuugaagaaauugaacaugaccuguugaagaaauugaacaugaccuguugccu

SEQ ID NO: 65614 - RNA, 59 nt, Human
gauuaauuucuucccccaacuucuugcauguugaagauauuugagcuauuuuucaucua

SEQ ID NO: 65615 - RNA, 59 nt, Human
ugaagauugggaaggcucagaagggcagaguugaagaaggcauaccuuuaagagaagcc

SEQ ID NO: 65616 - RNA, 59 nt, Human
uauuuuucaaauccuugaaucuuuuuuggguugaagaagaagaaagcauagcuuuagaa

SEQ ID NO: 65617 - RNA, 59 nt, Human
gacacccuaaaagucuucuuuucuacauaguugaagacagcaacaucuucacugaaugu

SEQ ID NO: 65618 - RNA, 59 nt, Human
aguuugcuaacauauuuaaagucuugaauguugaagaacucaugugauuuacccuuuuc

SEQ ID NO: 65619 - RNA, 59 nt, Human
ucuuuugaaguugaaauacccaguaaaauguugaagaaggauggaggauuucuucauau

SEQ ID NO: 65620 - RNA, 59 nt, Human
gcuaggguggggucuggucacacacagguguugaagaaauuauaaagauaaagcugccc

SEQ ID NO: 65621 - RNA, 59 nt, Human
gcauaguuuugauguuagugaggaacauuguugaagagcagcauuucccaaaauguguu

SEQ ID NO: 65622 - RNA, 59 nt, Human
uuguuugccucaugccuuuauacuuugcuguugaagaaacuacuaaucucaauuuaaga

SEQ ID NO: 65623 - RNA, 59 nt, Human
aaauauggcucuugaacccauagaccccaguugaagauggaauuuucaggaaagggaaa

SEQ ID NO: 65624 - RNA, 59 nt, Human
ugacucccuugaggcuuauaaugggccaaguugaagacuguugaugaucccuggugggu

SEQ ID NO: 65625 - RNA, 59 nt, Human
uaaaaaucugaaguacuauagaacauuaaguugaagaauggaaauuaagaguacguauu

SEQ ID NO: 65626 - RNA, 59 nt, Human
auacaauuugagggaggcagaagucugcaguugaagaaaaaaaauaagucuguuuguca

SEQ ID NO: 65627 - RNA, 59 nt, Human
cuguggacgcaguagccuugcuguagggaguugaagaguacuccacaacaguaucuuaa

SEQ ID NO: 65628 - RNA, 59 nt, Human
gaaugcagacaggccauucacgagcccaaguugaagagaagagacgcccauccgugaag

SEQ ID NO: 65629 - RNA, 59 nt, Human
ugccaaaaccaagauauccacuuaccugaguugaagaggggagcucaguuuucaacucu

SEQ ID NO: 65630 - RNA, 59 nt, Human
ucaaaccuuugugugcggagucauuuuguguugaagagcagcuccuuccuagccuugca

SEQ ID NO: 65631 - RNA, 59 nt, Human
aaggaaaggacagugcagaauuaaaccguguugaagaccaguggaaauuguauaauuua

SEQ ID NO: 65632 - RNA, 59 nt, Human
caccuguccaaguucaaauuggaaaccauguugaagagcuccaguuugacauuauucau

SEQ ID NO: 65633 - RNA, 59 nt, Human
guaagcacaggaaagagaaaaagaaaucuguugaagaaaggacagaagaggaaaugcuu

SEQ ID NO: 65634 - RNA, 59 nt, Human
cagaauauuagaaaaaugucaugaaaauaguugaagagaaaugcucacugcacaaggag

SEQ ID NO: 65635 - RNA, 59 nt, Human
aaacugaauccauguaagaaaaaauaauuguugaagaaagaaguugauagaauucaaaa

SEQ ID NO: 65636 - RNA, 59 nt, Human
cugucauuaacaacuugaagaaaggagcuguugaagaugugauuucaagaaaugaaauu

SEQ ID NO: 65637 - RNA, 59 nt, Human
uaggugagauuuaaaauaaauaggaugagguugaagaaaaguauauuggagcgcagaua

SEQ ID NO: 65638 - RNA, 59 nt, Human
gauauuugaaauugacuguagagcauuuaguugaagaguuaagcauucaguuccauuag

SEQ ID NO: 65639 - RNA, 59 nt, Human
uuauauaguguaagaauaguugaagacuaguugaagaccuuuugugauuucauuaucau

SEQ ID NO: 65640 - RNA, 59 nt, Human
ucccuaauugauuauauaguguaagaauaguugaagacuaguugaagaccuuuugugau

SEQ ID NO: 65641 - RNA, 59 nt, Human
aauuauauauaccuggcuuugcuuagcuuguugaagaaaguagcagaaauuaaaucuua

SEQ ID NO: 65642 - RNA, 59 nt, Human
auguuuuucuuaccgacaagcacagucagguugaagaccuaaccagggccagaaguagc

SEQ ID NO: 65643 - RNA, 64 nt, Human
guauauuuuguuucgcgggggagugagggggaagaacacggaugaaaaugucaguuuuugaagg

SEQ ID NO: 65644 - RNA, 64 nt, Human
gauuuuccucgguggaggaggcccguggggucccaacacggaagagccaugggccgugugcaug

SEQ ID NO: 65645 - RNA, 64 nt, Human
ggaccacugugaacguaaguaaaaaguauaaaguaacacggagagccuaaugaagaaacuucuu

SEQ ID NO: 65646 - RNA, 64 nt, Human
ucccugaguucgggaguucaagaccagccugaccaacacggagaaaccccgucucuacuaaaaa

SEQ ID NO: 65647 - RNA, 64 nt, Human
ggggaaauaagaccgaucuccugaccccauugggaacacggaagucuauuccaggccaaccagc

SEQ ID NO: 65648 - RNA, 64 nt, Human
gaagggagggaaaaugcaagggccuuccucucuuaacacggaugcucaaguaaaacuagauuca

SEQ ID NO: 65649 - RNA, 64 nt, Human
aacagaucugccaucgaucgcagauuucuguagaaacacggaugugcaugugcagauucccuuu

SEQ ID NO: 65650 - RNA, 64 nt, Human
gaaacuuugucucaugcccugacaugaaguggcaaacacggaaguucauacuugaaugcugaau

SEQ ID NO: 65651 - RNA, 64 nt, Human
acacaaaaauauucuuaagggcucagauuuagcaaacacggaagaauuuuaaaaugagcucucc

SEQ ID NO: 65652 - RNA, 64 nt, Human
ccugaaagaggaaugaaguacucauacauguuacaacacggacgaaccuugaaaacuuuaugcu

SEQ ID NO: 65653 - RNA, 64 nt, Human
guuuuucauuuguugcaagccuacucagacuccaaacacggaacgaauucagacuuccagcacg

SEQ ID NO: 65654 - RNA, 64 nt, Human
ucaccccaggcucaacugaggauguggcuuauuaaacacggaagugcaucgguuguugugguua

SEQ ID NO: 65655 - RNA, 64 nt, Human
uuuauacagccauguaaauccuccuguacaagcgaacacggaauauauacauauauaacucaau

SEQ ID NO: 65656 - RNA, 64 nt, Human
auaagcgacuucugugaggcugagagaggaagaaaacacggagccuucccuccaggugcccagu

SEQ ID NO: 65657 - RNA, 64 nt, Human
ccaucaagucuguuauagaguguacgacuguauuaacacggaggccugccuggcuacuuuuuua

SEQ ID NO: 65658 - RNA, 64 nt, Human
gguugguuuuaguacuguaaacugcuucugagcaaacacggaaauuuagcaaaauuauguaaac

SEQ ID NO: 65659 - RNA, 64 nt, Human
gguggcaggagcuaaccccaaccagcaggcaacuaacacggaauuggccccacaccggacgugg

SEQ ID NO: 65660 - RNA, 64 nt, Human
uuugucucuguaaagguaauauuagcaguuaaagaacacggaugagaaaagaauguguuacaua

SEQ ID NO: 65661 - RNA, 64 nt, Human
uccugaacccugacuuuuuguguacauacuuguaaacacggauuuuucuggguuuugguuugcu

SEQ ID NO: 65662 - RNA, 64 nt, Human
gccuuggauuccuagauuacaucugccuuaaaaaaacacggaagcacaguuggaggugggacga

SEQ ID NO: 65663 - RNA, 64 nt, Human
agcgucccucccuugugcucaguauauuggugugaacacggaacaugaugggggauuuaccuga

SEQ ID NO: 65664 - RNA, 64 nt, Human
ucugccaucagauaaagucacguggcucuuuaguaacacggacaaggcuccucgccaaggaacu

SEQ ID NO: 65665 - RNA, 64 nt, Human
auguuuuauuuuggugugacgguuggcccuccuaaacacggacuuuccucaggcugguucaaga

SEQ ID NO: 65666 - RNA, 64 nt, Human
agcccuucccacccugccccaugcccagcagcacaacacggagugagacaggaugcccacggug

SEQ ID NO: 65667 - RNA, 64 nt, Human
caccugagguugggaguucgagaccagccugaccaacacggagaaacccuaucucuacuaaaaa

SEQ ID NO: 65668 - RNA, 64 nt, Human
aaaauguaaucuaguuggcaaaggugugcgcuaaaacacggaaccgaacaugcauugauuugga

SEQ ID NO: 65669 - RNA, 64 nt, Human
aguugaauaauggcccauucaugccaaccuugccaacacggagagggcagagaugcacuagaag

SEQ ID NO: 65670 - RNA, 64 nt, Human
ccgcaagguuagggcauagaguugucuccuucccaacacggacccagagagcagcccuucccug

SEQ ID NO: 65671 - RNA, 64 nt, Human
ccaguccacucuucugcaguauccucccuggcagaacacggagaaucaggauuucuuaaauacu

SEQ ID NO: 65672 - RNA, 64 nt, Human
agcccucagcagaaaccgaaagagaaagaacggaaacacggaguuugggcucuguuggcuaagg

SEQ ID NO: 65673 - RNA, 64 nt, Human
ucacuuccacauguauguacaaguuaggucaccaaacacggaagugugaguguggaaggaucuu

SEQ ID NO: 65674 - RNA, 60 nt, Human
gauugaagaguaaggaaugagaccugguacaacacggaaaugauucuuauagacuaauac

SEQ ID NO: 65675 - RNA, 64 nt, Human
uaagggaacugugacaaacagccucgggcagaugaacacggaggcucucuguugucugucucug

SEQ ID NO: 65676 - RNA, 64 nt, Human
aguugcuguaaacuauuuugaacaaacagaaaagaacacggaaacauuuuuaacagagcauuua

SEQ ID NO: 65677 - RNA, 64 nt, Human
agagccgugucccagacacgcugucagugccuucaacacggagccgguuuguucauucggugcu

SEQ ID NO: 65678 - RNA, 64 nt, Human
gugucgcugcugugguugccgcuguccgcgguucaacacggaguccgccccgcggguuucagcu

SEQ ID NO: 65679 - RNA, 64 nt, Human
gcaagaguaggccaagcagaaagacugcugagguaacacggaccccagccccugucagggccuc

SEQ ID NO: 65680 - RNA, 64 nt, Human
gaugaaaacaucucaauuggguucagaucacgaaaacacggaagaagucucuaugagaagagcu

SEQ ID NO: 65681 - RNA, 64 nt, Human
ccuuccuggugcucacacaccugucaccuuguaaaacacggacauuagugugaacacaggacag

SEQ ID NO: 65682 - RNA, 64 nt, Human
cgggauuugauuaagcacuuaguauagucuuuugaacacggaaauccuguuguacuuaaagcua

SEQ ID NO: 65683 - RNA, 64 nt, Human
caaguguguuuccuuuggcuguucccuaauacaaaacacggacauauuuuuacucguagcacuc

SEQ ID NO: 65684 - RNA, 64 nt, Human
augguaucucuuaguaacuugcacucguuaaagaaacacggagcugggccaucgucagaacuaa

SEQ ID NO: 65685 - RNA, 64 nt, Human
uguauccuccagcuccuuccuuccuucccccaggaacacggaggccaccgagggggcugggccu

SEQ ID NO: 65686 - RNA, 64 nt, Human
gccaaaacaugaauugaguauguggucacaugaaaacacggaugaaugaauaaaacacucuuug

SEQ ID NO: 65687 - RNA, 64 nt, Human
uagaaauaggagaagauuuaauuaugaggccuugaacacggauuauccccaaacccuugucauu

SEQ ID NO: 65688 - RNA, 64 nt, Human
ggucaagggugaaggaaagcaagcucaccgccugaacacggagauugucuuucugccacagaac

SEQ ID NO: 65689 - RNA, 64 nt, Human
cuacacuaaggaggucuacgugccucaucccagaaacacggaggcuguggaucugaucaccagg

SEQ ID NO: 65690 - RNA, 51 nt, Human
gugauucgggccaccuuuagaaacacggagaggggcgcccuccugaccacc

SEQ ID NO: 65691 - RNA, 64 nt, Human
aaccacagccucagaccagcuauggggagaggacaacacggaggauauccagcuuccccggucu

SEQ ID NO: 65692 - RNA, 64 nt, Human
ggacucgcguucccaaagauccacccaaauaucaaacacggacccauagacagcccugggggag

SEQ ID NO: 65693 - RNA, 64 nt, Human
aagggcgcugguggccucccguacaaacuuggacaacacggagcagggagagcucaccauggaa

SEQ ID NO: 65694 - RNA, 64 nt, Human
agcaacuugcucugaccuauaaugucuuaggugcaacacggaccccaccagagcucuuggauac

SEQ ID NO: 65695 - RNA, 64 nt, Human
uguaaauaauagaaagccuuaauaucuuuucuguaacacggaguaauauuuuaaugucauguuu

SEQ ID NO: 65696 - RNA, 64 nt, Human
ccagguguacaaaggcuacauggaugacccgaggaacacggacaaugccuggaucgagacggug

SEQ ID NO: 65697 - RNA, 64 nt, Human
gaaauauuuugaaucugccaaguacauuuacaaaaacacggaugcugguauuuuaacagaugga

SEQ ID NO: 65698 - RNA, 64 nt, Human
cuggccccaggcccuguucuguuauccaauccgaaacacggaacaugcugcaauucaggagucu

SEQ ID NO: 65699 - RNA, 64 nt, Human
ugaggcucggcaagcauaggcgaguuggcaguggaacacggaucuaaacucagguguguccaag

SEQ ID NO: 65700 - RNA, 64 nt, Human
cuuaggaccuucuugauagcucccugcacuuuggaacacggagcagaugagagagggucggggc

SEQ ID NO: 65701 - RNA, 64 nt, Human
aaaaagacacuuuuaccgaacucgggauuacagaaacacggaguuuccauuuggauuuuaaaca

SEQ ID NO: 65702 - RNA, 64 nt, Human
gcuggacuccugaagccccgcugcugagaugggcgcucccgacacagcgcagacccaccaggag

SEQ ID NO: 65703 - RNA, 64 nt, Human
ggaaccuacagccccagccgucaggagaaggagggcucccgaguggaaauguggaacuugaugc

SEQ ID NO: 65704 - RNA, 64 nt, Human
acucugugcacuucagaccagcagcagcaggagggcucccgagggccuuaugagaaaaccugug

SEQ ID NO: 65705 - RNA, 64 nt, Human
gagucacccugacacuggugccaggcugaccucagcucccgaaggcucgcacagccuccccauc

SEQ ID NO: 65706 - RNA, 64 nt, Human
ggucucucccuuaacugcugcccuuccaagacuugcucccgagauggagugggcguggucuucc

SEQ ID NO: 65707 - RNA, 64 nt, Human
gcagcgucugacccggaaacccuuucacuucucugcucccgagguguccucgggcucauaugug

SEQ ID NO: 65708 - RNA, 64 nt, Human
auuccaucgugcugguagaagagucuuugcuguugcucccgaaagccgugcucuccagccuggc

SEQ ID NO: 65709 - RNA, 64 nt, Human
uagguggauucugauucacugucaaugcuggguugcucccgagcccuagauguuccuggaaguu

SEQ ID NO: 65710 - RNA, 64 nt, Human
gcaauacgaauuaugcaaucacaauacauuuguagcucccgaguguccuaaagggagugcacuu

SEQ ID NO: 65711 - RNA, 64 nt, Human
gugcccaccgcccagcugcccacacccggugcaggcucccgaccagugcugcccuguuugcccu

SEQ ID NO: 65712 - RNA, 64 nt, Human
uuggaaacaugcuccgcgccuccagagaaaaguugcucccgagguccaugccccuggaacgugu

SEQ ID NO: 65713 - RNA, 64 nt, Human
uuuuuuguagagguggucuagccauguugccuaggcucccgaacuccugagcucaagcaauccu

SEQ ID NO: 65714 - RNA, 64 nt, Human
cuggccugccacccuccugcgcaggccaugcauggcucccgaguacaguaguaucugcuuaggu

SEQ ID NO: 65715 - RNA, 64 nt, Human
cacaccacagacccagacacagccaagggagagugcucccgacagguggccccagcuuccucuc

SEQ ID NO: 65716 - RNA, 64 nt, Human
acaaccgguccacuccugccuuuucacucacacagcucccgacugcuucuugcagaggcugaga

SEQ ID NO: 65717 - RNA, 64 nt, Human
acccggggcccccuuuccuccagggcccagucuggcucccgagcucagacacagcccccaggag

SEQ ID NO: 65718 - RNA, 64 nt, Human
cgaguuuucaaugugaauuuguucuuacauuauggcucccgaggggaagcgauuacuuuuuuua

SEQ ID NO: 65719 - RNA, 64 nt, Human
aucaucuuccugacccuggcaccugugucuacuugcucccgagaagaggagcgcucaugucuuu

SEQ ID NO: 65720 - RNA, 64 nt, Human
uuucaccauuugucuuucauuuuaaagguuauuugcucccgauuauaugauucaaguguuauaa

SEQ ID NO: 65721 - RNA, 64 nt, Human
gaauccucgaagcuuauguauccagccacagacagcucccgaugcgcugcccccugagaaaaca

SEQ ID NO: 65722 - RNA, 64 nt, Human
gcuugcuucaugggcuaggagccgccgagcccgggcucccgagagcaaccucgugaccucagca

SEQ ID NO: 65723 - RNA, 64 nt, Human
ucggaccagccagcugguccucugggaacagccagcucccgagcacagccgcacuccuguugac

SEQ ID NO: 65724 - RNA, 64 nt, Human
aaucagugguguggggcacuguagagacuagccagcucccgacggaaggggucugugucuugua

SEQ ID NO: 65725 - RNA, 64 nt, Human
gcuggcuguguauacccacuaggcugccccacgugcucccgagagaugacacuagucagaaaau

SEQ ID NO: 65726 - RNA, 64 nt, Human
auggugcagccaaaggccccgucuagcuuggcuggcucccgaacauguccauauuugaaggcug

SEQ ID NO: 65727 - RNA, 64 nt, Human
uggaagcccugaucccccagagagcuacaggucugcucccgacgggccucgggccugacccguc

SEQ ID NO: 65728 - RNA, 64 nt, Human
ucccagucaccuuugcagacaaagaccaggggcagcucccgagggcacugugaaggcucccaug

SEQ ID NO: 65729 - RNA, 64 nt, Human
agcacagagcaucucaguuggacuggaccacagugcucccgagagccugccuuuccugcccuuc

SEQ ID NO: 65730 - RNA, 64 nt, Human
ucgagagggugucagugagcagacugcaccccaagcucccgacuccagguccccugaucuuggg

SEQ ID NO: 65731 - RNA, 64 nt, Human
uuccaaaucacaauuucuuacaaccaagcuuugugcucccgaguaagcagggauguacuagggg

SEQ ID NO: 65732 - RNA, 64 nt, Human
agggaggacaggcgggaggaggugugaggaggaggcucccgaggggaaggggcggugcccacac

SEQ ID NO: 65733 - RNA, 64 nt, Human
gaacuuugggguacgccucccuaucugagcccccgcucccgaucgugggcugaaccuugccuuc

SEQ ID NO: 65734 - RNA, 64 nt, Human
gggaccucccccaucacccagguuccuacucugggcucccgauucccauggcucccaaaccaug

SEQ ID NO: 65735 - RNA, 64 nt, Human
ugugucugcaccagaagaggcucccacagacucugcucccgagaagccaagugaugcuggggag

SEQ ID NO: 65736 - RNA, 64 nt, Human
agccaugcugugauaccggcggaccaggacugcagcucccgaagccugagcucauccgccgugg

SEQ ID NO: 65737 - RNA, 64 nt, Human
ugagaggcgugaguugagauggguuuucccugaugcucccgacuccccuccccaccaccuccca

SEQ ID NO: 65738 - RNA, 64 nt, Human
caagccugccacuccugugucccugccucccugggcucccgagauaggcaccacuguauccucc

SEQ ID NO: 65739 - RNA, 64 nt, Human
ccgccaguguuggcggugucgccgcaaccugcaggcucccgaguggggccugccuggucucuag

SEQ ID NO: 65740 - RNA, 64 nt, Human
cuguugaccugcccgauccagauucccaggccaggcucccgaccccauccaccuauccaccacc

SEQ ID NO: 65741 - RNA, 64 nt, Human
gcgggugcgcucggugacacuggugguggugcacgcucccgagcucccagaguuaacacuaauc

SEQ ID NO: 65742 - RNA, 64 nt, Human
aaugugcucgcugccccgcggcuucgagccccaagcucccgaggacuuggcgcagcggaguuug

SEQ ID NO: 65743 - RNA, 64 nt, Human
acugagggcagagccuguaggugcagaggcccuggcucccgagguccagccacucucccugggg

SEQ ID NO: 65744 - RNA, 64 nt, Human
cacccacucccuuccccauagauaggccccuggggcucccgaagaaugaacccaagagcaaggg

SEQ ID NO: 65745 - RNA, 64 nt, Human
ccacucacuuaucucaguggacuccaaagcaaaagcucccgacuacuagcucuguuaguuccag

SEQ ID NO: 65746 - RNA, 64 nt, Human
cuaugaaccucugcugggcccagccccugucccagcucccgaccugcacuuccugcuggacuca

SEQ ID NO: 65747 - RNA, 64 nt, Human
ugguuccugggccuuauagccagguuuguguggcgcucccgacuuuugugacugacuggugucu

SEQ ID NO: 65748 - RNA, 64 nt, Human
uuggaugaggcccguccggagggagccaucucuugcucccgaggcugggacaguccuuucugug

SEQ ID NO: 65749 - RNA, 64 nt, Human
ucacagcugucagugcagccauuugcccagggcugcucccgagggggaugaugggaaauucagc

SEQ ID NO: 65750 - RNA, 64 nt, Human
ggggguccugacucacacuuacugcaaaggcuuggcucccgaaugucgcauuugguggacgaga

SEQ ID NO: 65751 - RNA, 64 nt, Human
uaaugacauggacuuggcggggggacaagacaaagcucccgaugcugcauggggcgcugccaga

SEQ ID NO: 65752 - RNA, 64 nt, Human
agggugaacaaaccccgagggaggcccggcccuugcucccgaguuggggggaggggguguggca

SEQ ID NO: 65753 - RNA, 64 nt, Human
ccuccugcccacgcagaccugcagcgggcaaagagcucccgaggaagcacagcuugggucaggu

SEQ ID NO: 65754 - RNA, 64 nt, Human
uaccuugguggugggacuuggaacccaacccugagcucccgauaaagcuaaaguccaucaucug

SEQ ID NO: 65755 - RNA, 64 nt, Human
ccuccccuucgggcccccuccuccugcaaaacccgcucccgaagcggcgcugccgucugcagcc

SEQ ID NO: 65756 - RNA, 64 nt, Human
gcccccuccacuccacucugcuuccacaaagucggcucccgagagcucgaggcugcuucuguuu

SEQ ID NO: 65757 - RNA, 64 nt, Human
guccgacucaguaugcagucgcaauaacaugucugcucccgagguuaacauucaagcguuucua

SEQ ID NO: 65758 - RNA, 64 nt, Human
caggcugccaggauggcgugugugccgugacagggcucccgagucaugcacucaggcagacagc

SEQ ID NO: 65759 - RNA, 64 nt, Human
gaaaguaaaauuguuuuuucuguccgcaacacuggcucccgagcagcuuuuguuaaagcaguag

SEQ ID NO: 65760 - RNA, 64 nt, Human
ucugccggcugccucucccccuccgagcccguccgcucccgagcucggugacuuccacugucgc

SEQ ID NO: 65761 - RNA, 64 nt, Human
ccacccgccaagcauaguucagggccacgcgccugcucccgaugcacggggagaagggcgacuu

SEQ ID NO: 65762 - RNA, 64 nt, Human
cucucugccaaggcuccagcuucuucccccagcugcucccgaccaggagggggagagcagccuc

SEQ ID NO: 65763 - RNA, 64 nt, Human
ccuccgcgggccugagcgugggcgcgccccugcggcucccgaggguccaggccccgcccccaaa

SEQ ID NO: 65764 - RNA, 64 nt, Human
caaguacaccagccaccuccagacaccagugcgugcucccgaugcugcuauggaaggugcuacu

SEQ ID NO: 65765 - RNA, 64 nt, Human
gccugcagugguuggagacgggaguggcccuucggcucccgagcucccucuggggacggcuggc

SEQ ID NO: 65766 - RNA, 64 nt, Human
cacacccagcguagggggagucugagccgggagggcucccgagucucugccuucagcucccaaa

SEQ ID NO: 65767 - RNA, 64 nt, Human
uggcugugcccgaugugcaccucccggaagugcagcucccgaaagucccagagaugaaacuccc

SEQ ID NO: 65768 - RNA, 64 nt, Human
guggcuuuuuaacaugaaaaacacggcagcuguagcucccgagcuacucucuugccagcauuuu

SEQ ID NO: 65769 - RNA, 64 nt, Human
uacuggcgcucacgcugccauccgaccacccucggcucccgaguccacgccugccugggccugu

SEQ ID NO: 65770 - RNA, 64 nt, Human
gcaucugaucuauucgcuaccgggacuccuccaggcucccgagaggagucgggacccuucggcu

SEQ ID NO: 65771 - RNA, 64 nt, Human
cuccagcugcucacagacgccagcaaagcaguaugcucccgaucaaguagauuuuuaaaaaauc

SEQ ID NO: 65772 - RNA, 64 nt, Human
uaagcuagcacccgugguaagcgggacgagacaagcucccgaagcccgccagcuuccugcucca

SEQ ID NO: 65773 - RNA, 64 nt, Human
uucccuggucccuacucaacaaaauaugaugauggcucccgacacaagcgccagggccagggcu

SEQ ID NO: 65774 - RNA, 64 nt, Human
ggacccaggacggagcggggcugcccugccugaggcucccgaggagcuuugugcuuugguguuc

SEQ ID NO: 65775 - RNA, 64 nt, Human
ugagaaccucgggguuugagguggccaugggcagacagccgaaagggagggagggugugggugu

SEQ ID NO: 65776 - RNA, 64 nt, Human
aaccuguacagucauuuuucuacugacuuaauaaacagccgagcugucccuugaugcugagugu

SEQ ID NO: 65777 - RNA, 64 nt, Human
uucucaaagguugaaaaaaugcuuuuaauuuuucacagccgagaaacagugcagcaguauaugu

SEQ ID NO: 65778 - RNA, 64 nt, Human
uguccagggagaauacuggcuucauuacacuuguacagccgaguucuucccgcauuacugcugu

SEQ ID NO: 65779 - RNA, 64 nt, Human
cuuugaucagaggaugcauauuauucagcaucagacagccgacacuggggaggagccuuaucaa

SEQ ID NO: 65780 - RNA, 64 nt, Human
cuggauucuacugaaguagaggccuggugguuuaacagccgaagacacacgccuagggaugagc

SEQ ID NO: 65781 - RNA, 64 nt, Human
cuucagccugccuggggugagaggucagugcaccacagccgaggcuggagcacagggagcuucu

SEQ ID NO: 65782 - RNA, 64 nt, Human
ucacccucuaggcccugugccuggaggugccuccacagccgaccagcagccaccccgccugcuu

SEQ ID NO: 65783 - RNA, 64 nt, Human
ggcagccucugucaggccuucaggguucagcaguacagccgagacucgacucugugccucccuc

SEQ ID NO: 65784 - RNA, 64 nt, Human
gugcuuguggagggccugacuguccugcucacccacagccgaucugcugcaggucagcaacugu

SEQ ID NO: 65785 - RNA, 64 nt, Human
ccuccuccuuccugccugugaugcuccgucucaaacagccgaaaccugucuugcaaugggggga

SEQ ID NO: 65786 - RNA, 64 nt, Human
ccugcgcccagugauguuuccacggugccuguacacagccgagcagcauuuccguugaaggacu

SEQ ID NO: 65787 - RNA, 63 nt, Human
agaugcccaugccuguguagccgccaccgagggacagccgagggaccgauggacgaggggaca

SEQ ID NO: 65788 - RNA, 64 nt, Human
caucauuuaucuugaacauuccgacguguaacucacagccgaagcacuccaucccagauuuguu

SEQ ID NO: 65789 - RNA, 64 nt, Human
guuggagaugcucaacagcuagacacagaugcucacagccgaccuguggccucuugcucugaag

SEQ ID NO: 65790 - RNA, 64 nt, Human
ugaagcgcaggaaagaaaggcccauuccccucgcacagccgagcuuuuacucccugagcacggg

SEQ ID NO: 65791 - RNA, 64 nt, Human
gacaggcccacccugcagcucaggcaccaagaaaacagccgauacuggcagccauugcagcucc

SEQ ID NO: 65792 - RNA, 64 nt, Human
agagagcagcucagugucacacugggagcugggcacagccgaucuccuuccagaaggguucugu

SEQ ID NO: 65793 - RNA, 64 nt, Human
auaagugcuuuuggaagucaccuaccuuuuuaacacagccgaacuagucccaacgcguuugcaa

SEQ ID NO: 65794 - RNA, 64 nt, Human
cccgccacugauucagugagcuggagauuggaucacagccgaaggaguaaaggugcugcaauga

SEQ ID NO: 65795 - RNA, 64 nt, Human
uuuuauauggcaccuuucugagggaggggauuuuacagccgagggaccuccaaagggaacgucc

SEQ ID NO: 65796 - RNA, 64 nt, Human
cuccugccggaggcaugucuacuugugaucccggacagccgaacccaagagcugguggcucuga

SEQ ID NO: 65797 - RNA, 64 nt, Human
acuuacuccaccuuccauuccucgcccuguccccacagccgaguccugcaucagcccuuuaucc

SEQ ID NO: 65798 - RNA, 64 nt, Human
agauccaucucuuggggcuccccugacagagaagacagccgaagucaaagccacauccucuugc

SEQ ID NO: 65799 - RNA, 64 nt, Human
agcuguggaagccagaaguugggcgguuucagggacagccgagaauaauguugaccugucagau

SEQ ID NO: 65800 - RNA, 64 nt, Human
auccaaagcugauucacaaacccacgcucaccugacagccgagggacacgagcaucacucugcu

SEQ ID NO: 65801 - RNA, 64 nt, Human
ccucuaccacugggcacugagacgaagcucccugacagccgagacuggcagcccuccaucuggu

SEQ ID NO: 65802 - RNA, 64 nt, Human
augcagggagccagggugagggcagaguguggugacagccgaacuuggaguaauguccguguag

SEQ ID NO: 65803 - RNA, 64 nt, Human
aacugaggcucaggagagcuagacuaguuugugcacagccgagaaguggucaagcuagaauggg

SEQ ID NO: 65804 - RNA, 64 nt, Human
ggggagugcagggccagauggggacuccauggagacagccgaccggcgacagccuucagcuccg

SEQ ID NO: 65805 - RNA, 64 nt, Human
gguuaauggacuuguuaccaaaccuuaaggauauacagccgaagauugucugagguugcuggcu

SEQ ID NO: 65806 - RNA, 64 nt, Human
gcacacccacucagcuccgugaacuugugagaacacagccgauucaccugagcaggaccucuga

SEQ ID NO: 65807 - RNA, 64 nt, Human
gucagaccaugaggagccaagaccagcaggucccacagccgacagugcccagagcaugcaggga

SEQ ID NO: 65808 - RNA, 64 nt, Human
cugacccacgcuugggcaucaauggcaccuccacacagccgaagcacccggcaucuuggugggg

SEQ ID NO: 65809 - RNA, 64 nt, Human
gaaacuugugccuuuaaacuuuguaaacuuaaacacagccgagaaguugcuucuuuguacuuuu

SEQ ID NO: 65810 - RNA, 64 nt, Human
ugagccaggcaccucuguuuccugcuguuuauugacagccgacggcagcgccuugcccagaccu

SEQ ID NO: 65811 - RNA, 64 nt, Human
uccccaccuuucucggaugcagggccagagugacacagccgaaaaauugcaguuugucuguacu

SEQ ID NO: 65812 - RNA, 64 nt, Human
gugccugggaaccuuccugucuucauccuuagcaacagccgaguggauagaugcccugcuagau

SEQ ID NO: 65813 - RNA, 64 nt, Human
caaggucgcagaaaggcauucuguugacagaugaacagccgaaagcuggccagacccuccugua

SEQ ID NO: 65814 - RNA, 64 nt, Human
accaaccaaaaagaguccaggaccagauggauucacagccgaauucuaccagagguacaaggag

SEQ ID NO: 65815 - RNA, 64 nt, Human
ggccaggacaacgggcuggagggucugggcaacgacagccgagacauguacauggagucugagg

SEQ ID NO: 65816 - RNA, 64 nt, Human
uuuggccuuagucaaugucuaugcccgucacauaacagccgaggcaccgaggcccacagggaag

SEQ ID NO: 65817 - RNA, 64 nt, Human
gccagagauacaucaauuacacccccguggggggacagccgaugggagccagcaccagcaggau

SEQ ID NO: 65818 - RNA, 64 nt, Human
ugacucucgggugaucuuccuuguaucaauaaauacagccgagguugcugagcgcgcuuugaaa

SEQ ID NO: 65819 - RNA, 64 nt, Human
uugagaaaugcauagcauuauuuaacacuauugaacagccgacuuugagcauuguuucuucuaa

SEQ ID NO: 65820 - RNA, 64 nt, Human
gagacccagauguuggacaccaggaaggggccccacagccgagacgacguguccagugaccauc

SEQ ID NO: 65821 - RNA, 64 nt, Human
uggccacauugcugccagccaagaccagaaauaaacagccgaugcugacaucuugaucacugga

SEQ ID NO: 65822 - RNA, 64 nt, Human
ugggcugguucuucccaccacuucccaggcucugacagccgagacucauuuccaaggcacagca

SEQ ID NO: 65823 - RNA, 64 nt, Human
aguucuaccuaacuuacuauguagguguaugucuacagccgaugaccucauuucguuuauuuua

SEQ ID NO: 65824 - RNA, 64 nt, Human
gcgccuuccugcagaacacacagugccuuaugccacagccgaagaauccguggggccggcaagc

SEQ ID NO: 65825 - RNA, 64 nt, Human
gcugaggugccccggggggugaucucuggugcucacagccgaggagccguggcuccauggccag

SEQ ID NO: 65826 - RNA, 64 nt, Human
cuucaauuaggacacagccagauggacaucuaagacagccgaucaucuuuccuugccuaugaca

SEQ ID NO: 65827 - RNA, 64 nt, Human
cccauuuguacuucagcgcuagccccuguuuugcacagccgaguacuggcgaguauguucuaug

SEQ ID NO: 65828 - RNA, 61 nt, Human
ggugagugagugauaggguaacaugggccuucaggaugaccccuuggaacugugccgaguu

SEQ ID NO: 65829 - RNA, 61 nt, Human
gucugucucuuucagcugccaguaaguuuuccaggaugagaggggaaaaagaaagccucca

SEQ ID NO: 65830 - RNA, 61 nt, Human
aaaucauauguaccaaggauguuacaguaaacaggaugaacuauuuaaacccacugggucc

SEQ ID NO: 65831 - RNA, 61 nt, Human
ugugucguagccaaggugggcugagcccuggcaggaugacccugcgaaggggcccuggucc

SEQ ID NO: 65832 - RNA, 61 nt, Human
cacagcccgaggggacacaggauggaaaccccaggaugagaagggagcagggagaguucca

SEQ ID NO: 65833 - RNA, 61 nt, Human
gggaggacucgcagcucucccuuuccccagccaggaugagggaauuagacaauggaagucg

SEQ ID NO: 65834 - RNA, 61 nt, Human
cuccuccugcuguccagauacagggaagacucaggaugagggugcccgggcuggacggcua

SEQ ID NO: 65835 - RNA, 61 nt, Human
cccacaggacagugggaguuacaguucauaucaggaugacccuacauacccaggucagauu

SEQ ID NO: 65836 - RNA, 61 nt, Human
uuaguguuuccugggucaggaacagagccaacaggaugaacgugugcaaaagccuuggacu

SEQ ID NO: 65837 - RNA, 61 nt, Human
auuuauagcaugaagcccuacaugaucacugcaggaugauccuccucccauccuuucccuu

SEQ ID NO: 65838 - RNA, 59 nt, Human
augguagugagggcacaugaaacucacuucaggaugaaaucugggcagagacuuauuaa

SEQ ID NO: 65839 - RNA, 61 nt, Human
cuugcacaacuucaagaaaagcagcucagcucaggaugagucuuccugccugaaacugaga

SEQ ID NO: 65840 - RNA, 61 nt, Human
gaggagggugcccuccuagcuccacccucaccaggaugaaggcgugcaaggggcucagcaa

SEQ ID NO: 65841 - RNA, 61 nt, Human
uguuuacaaucacaaggacauagauaccuaucaggaugaagaacaggcauugcaaggaccc

SEQ ID NO: 65842 - RNA, 61 nt, Human
gcaaagcaggcuccaguggggccucaucauacaggaugacaagacuggggcccuguucacc

SEQ ID NO: 65843 - RNA, 61 nt, Human
cccaguggugucuacugaagaucccuuugaccaggaugacuggggagcuuggcagaaguuc

SEQ ID NO: 65844 - RNA, 53 nt, Human
cuuucaaagggcggacauagagacaggaugaagacaugcuugaggagccacgg

SEQ ID NO: 65845 - RNA, 61 nt, Human
uauuccaaaaaccacuucugucccauuucaccaggaugacuaaggcaagcucccuguggcc

SEQ ID NO: 65846 - RNA, 61 nt, Human
uuguugcugcuucccugaaugaguauuaccccaggaugaggucugccaucagcuuaguuag

SEQ ID NO: 65847 - RNA, 61 nt, Human
cugagcaagcaugugguugcauuggguggcccaggaugacaaugcacagcacagaugccau

SEQ ID NO: 65848 - RNA, 61 nt, Human
caggcagucucaugcaugagagguuacccuucaggaugacagagcugagggucuuuguagg

SEQ ID NO: 65849 - RNA, 61 nt, Human
uugaggaucuugggugagagagagggaccugcaggaugaacaaaugucuacucuaagacag

SEQ ID NO: 65850 - RNA, 61 nt, Human
gggccucucagcucccacaaucucuggccuccaggaugagcuaucccaucuucaggaguua

SEQ ID NO: 65851 - RNA, 61 nt, Human
cugcucaagcaauagcagagguuucacccggcaggaugacacagaccacuucccagggagc

SEQ ID NO: 65852 - RNA, 61 nt, Human
ccagaccugcagacgcccagauuaugagacacaggaugaagcauuuacaacccgguucacu

SEQ ID NO: 65853 - RNA, 61 nt, Human
guggaaggugaaggaagacccacagagugcucaggaugaugcuauugcuggagagcgaaag

SEQ ID NO: 65854 - RNA, 61 nt, Human
gcugggaaaugucucuuucauauuguaaguccaggaugaacuaggagaaagcaauuuguug

SEQ ID NO: 65855 - RNA, 61 nt, Human
auuuaaccuacuagacaaugaugugaguacccaggaugauuuccuggggcacaguggguga

SEQ ID NO: 65856 - RNA, 61 nt, Human
caaaaaaaaaaaaaaaguuuucuagaauaagcaggaugauuguuuaauuugaagauggaac

SEQ ID NO: 65857 - RNA, 61 nt, Human
ucagauguguaacucaaauuauuaugccuuucaggaugaugguagagcaauauuaaacaag

SEQ ID NO: 65858 - RNA, 61 nt, Human
guuucauaaaaguuggaucuguuccuaugcccaggaugauuuugugaaccgugaaguacgu

SEQ ID NO: 65859 - RNA, 61 nt, Human
aauuuguuaauaaugaaaacccuuaagcaugcaggaugagguauuuggguuuuuuuuuuag

SEQ ID NO: 65860 - RNA, 61 nt, Human
agaugguaauuuuuuuuuauggaugauauggcaggaugauugguucugaucuuaccggcua

SEQ ID NO: 65861 - RNA, 61 nt, Human
gccuugaacauagagaaaaauuaaggccucacaggaugagucuccauucucuguaaaugcu

SEQ ID NO: 65862 - RNA, 61 nt, Human
gucuccucauuccuacaccuauuuucugcugcaggaugaggcuaggguuagcauucuagac

SEQ ID NO: 65863 - RNA, 61 nt, Human
gcuccacaggccccuggcaaggccgauggcucaggaugauggggcacagcccgccuuugaa

SEQ ID NO: 65864 - RNA, 61 nt, Human
uuaccguucugcaacaacggacugguacauacaggaugaucacaaugguaaggcacauaaa

SEQ ID NO: 65865 - RNA, 61 nt, Human
cucucaggaccccguggaauugcaucuucugcaggaugaaggagucuccgggaagccaaca

SEQ ID NO: 65866 - RNA, 61 nt, Human
gugcuaagugcuuuacgaacauucgucauaucaggaugaccucgagagcugaggcucuagc

SEQ ID NO: 65867 - RNA, 61 nt, Human
uauguaucgugcccccucuggugucuuugaucaggaugacaugugccauuuuucagaggac

SEQ ID NO: 65868 - RNA, 61 nt, Human
ugucccuccaguucccuccugagggcugugccaggaugacugucucaugcccccucugcau

SEQ ID NO: 65869 - RNA, 61 nt, Human
cugggucacagccacucaggaggggaagggucaggaugagaggcugcagccucgacacuug

SEQ ID NO: 65870 - RNA, 61 nt, Human
ucaaccuguuuugaccucccaggcaucugaacaggaugacaucaucuuauuauaucuuacu

SEQ ID NO: 65871 - RNA, 61 nt, Human
augaggaaaugccucuuucuuccccagacuccaggaugacuuugcacguuaauuuuucuug

SEQ ID NO: 65872 - RNA, 61 nt, Human
ggggaggggagagaagguggucugcaccccacaggaugaacuagccaugacuaggguccuc

SEQ ID NO: 65873 - RNA, 61 nt, Human
ugcuuggugugacccacggaggauccacucccaggaugacgugcuccguagcucugcugcu

SEQ ID NO: 65874 - RNA, 61 nt, Human
cugugugguuaauuuaaugaaccaugaaagacaggaugaccuuggacaaggccaaacuguc

SEQ ID NO: 65875 - RNA, 61 nt, Human
gacaauuuuuccguggaugggggaaugguuucaggaugaacuguuccaccucagaucauca

SEQ ID NO: 65876 - RNA, 61 nt, Human
gcacuuaacggaaguuacaucaggcaaguaccaggaugaaaagaacuaugaaauaaaugaa

SEQ ID NO: 65877 - RNA, 61 nt, Human
ggcauuucuaaagcuuuugggcacuguguaccaggaugaggaagagaagaaaugaggagcc

SEQ ID NO: 65878 - RNA, 61 nt, Human
gcagcugacccaacucagaaucucuuuccuacaggaugaagugccuuuugaauguuauuuu

SEQ ID NO: 65879 - RNA, 61 nt, Human
gucauucccaucgcuuugcaaucacaagccacaggaugagaaguucugacucacucaugcc

SEQ ID NO: 65880 - RNA, 61 nt, Human
uuuaguagagaugggguuucacugcguuggccaggaugaucucgaucucuugaccuuggga

SEQ ID NO: 65881 - RNA, 61 nt, Human
cuuuauccaaaagcacaucuugugcuccaugcaggaugaugacagaauugaucugauguua

SEQ ID NO: 65882 - RNA, 61 nt, Human
uaacagaaccuacgaugaaaugagucugauucaggaugacguggaccuccgugacacacgg

SEQ ID NO: 65883 - RNA, 61 nt, Human
cccuuggauacucuucucccaucucccuucacaggaugacacccucccauaccccauagcu

SEQ ID NO: 65884 - RNA, 61 nt, Human
gaaaggagggccugggccagcuuugaaaaggcaggaugaaauggaaaggucaccacacuua

SEQ ID NO: 65885 - RNA, 61 nt, Human
cauguucagcccagacuccugccacauggaccaggaugaagagggaucaaagagauaauua

SEQ ID NO: 65886 - RNA, 52 nt, Human
uuccauagugcaaguggugacccaggaugaaagagagcagcuguacacaccu

SEQ ID NO: 65887 - RNA, 61 nt, Human
uuuaguagaggcaggguuucaccauguuagccaggaugaucucgaucuccugaccucauga

SEQ ID NO: 65888 - RNA, 61 nt, Human
aagccaauaaguuuuaucuuuuauaaucugucaggaugaaccacuccuuagcuuuuaucca

SEQ ID NO: 65889 - RNA, 61 nt, Human
cuccuguugacagagccaccggauuaugacacaggaugaggaagauuaaggauaaucaauu

SEQ ID NO: 65890 - RNA, 61 nt, Human
auugcauccuguaacuucuguccaaaaagaacaggaugauguacaaauugcucuuccaggu

SEQ ID NO: 65891 - RNA, 61 nt, Human
ccauccaugcguggacgcuguguggagaguccaggaugacgggaucccgcacaagcucccu

SEQ ID NO: 65892 - RNA, 61 nt, Human
uaccugaggucccuacucucacugggguccccaggaugaaaacgacaaugugccuuuuuau

SEQ ID NO: 65893 - RNA, 61 nt, Human
gacaggccauccauccuggagccucauggaacaggaugauggcacugagaaagccaaugac

SEQ ID NO: 65894 - RNA, 61 nt, Human
ccuuccuuuccuuucucaggccuugcucccccaggaugacccacucuuagggggguggugg

SEQ ID NO: 65895 - RNA, 61 nt, Human
aggaaucuucuucuuggcagcugcagucugucaggaugagauaucagauuagguuggauag

SEQ ID NO: 65896 - RNA, 61 nt, Human
ugagaaauauuuagaaguaaaguugacaggacaggaugauugauuaaaagaggggagcaag

SEQ ID NO: 65897 - RNA, 61 nt, Human
uuucaguuguuuuuggaaaaauucuagaaaucaggaugaaaaaugcagcuuuuccaggguu

SEQ ID NO: 65898 - RNA, 61 nt, Human
ccuucacaagauggaaggcaggugaggaugucaggaugagaugggaccagguagccgagga

SEQ ID NO: 65899 - RNA, 61 nt, Human
agcaauaaccucaaagugacuauucaguuuucaggaugauacacuaugaagauguuucaaa

SEQ ID NO: 65900 - RNA, 61 nt, Human
cuagaaaagcugaguggagucuccuuuccaacaggaugaugcauuugcucaauucucaggg

SEQ ID NO: 65901 - RNA, 61 nt, Human
ucagaggucgcacacagugacucuccucucucaggaugacgaggaccugugccuucaacaa

SEQ ID NO: 65902 - RNA, 61 nt, Human
ugguuuacaggaaggcucugguucccccucacaggaugagcaugcucaguugggcgugugu

SEQ ID NO: 65903 - RNA, 61 nt, Human
ggauccucaguucucaaauguguguggcagccaggaugacuagauccuggguuuccauccu

SEQ ID NO: 65904 - RNA, 61 nt, Human
aauuaaugcaggcuauuaucagacacagcagcaggaugaagccaaccugcaguauuaaccu

SEQ ID NO: 65905 - RNA, 61 nt, Human
auguucuucaccccuuuugguagaacaaaagcaggaugauaaccauauccccccagugcuc

SEQ ID NO: 65906 - RNA, 58 nt, Human
augaacaagagggaaaguaguccuccaacaggaugaagcagauuaacagaagagugau

SEQ ID NO: 65907 - RNA, 61 nt, Human
ucauugaguauauugcuucaagguacaaacccaggaugaugauguugucaccacugucucu

SEQ ID NO: 65908 - RNA, 61 nt, Human
cuauugcugcuguuguuuuuuauucuauuuacaggaugauuuuuaaacugucaaaugaagu

SEQ ID NO: 65909 - RNA, 61 nt, Human
agcaaagagcaacuaauauguuuucugaaaccaggaugaugcucauucaggaaauccacua

SEQ ID NO: 65910 - RNA, 61 nt, Human
augucauuuucuccuuucuuuucacguuacucaggaugaacucucugagcagggaccugcu

SEQ ID NO: 65911 - RNA, 61 nt, Human
aggaugccugugaagaaagaucccuggaucccaggaugauuauaggacaaguuguucauaa

SEQ ID NO: 65912 - RNA, 61 nt, Human
agugcuacaggcagcuggaucuguuugcaugcaggaugaagaggguuaaaacacuguuuau

SEQ ID NO: 65913 - RNA, 61 nt, Human
aagccugggaacuugggcaucguugggccagcaggaugagcagcaaagggucugaggacag

SEQ ID NO: 65914 - RNA, 61 nt, Human
aguaaauuaugauccuuaaauauuugagagucaggaugaagcagaucugcuguagacuuuu

SEQ ID NO: 65915 - RNA, 61 nt, Human
aucucaacagaaucgcaccaaacuauacuuucaggaugaauuucuucuuucugccaucuuu

SEQ ID NO: 65916 - RNA, 61 nt, Human
ucacugaccaauugugggacaauuugaacaucaggaugaauaaugacaggagagauuauaa

SEQ ID NO: 65917 - RNA, 61 nt, Human
ggacgccaugggcacugcagggacagucagucaggaugacacuucggcaucaucucuuccc

SEQ ID NO: 65918 - RNA, 61 nt, Human
cuuucuagagggagccacgcacagaauguaacaggaugaaacaguuucaaguaagccuuga

SEQ ID NO: 65919 - RNA, 61 nt, Human; identical to SEQ ID NO: 65911

SEQ ID NO: 65920 - RNA, 61 nt, Human
gauguaugugucacugcauggcuucugaaagcaggaugaauuuucugcagcuguuucaaag

SEQ ID NO: 65921 - RNA, 61 nt, Human
uuuuucuaucacauucucaauaguuccagcucaggaugaaaggauagacacaaaauuguuu

SEQ ID NO: 65922 - RNA, 61 nt, Human
accacgagcuaaaauuuaccaacccauuuaucaggaugaccauugccauuugucaggugac

SEQ ID NO: 65923 - RNA, 59 nt, Human
cuuuuggcauucucuuccagguucugauccaggaugaaaauuuggaggaaaaguggaag

SEQ ID NO: 65924 - RNA, 61 nt, Human
guggacuuggaaugaggccaacaggguucaccaggaugagagaggagagaggaauccacag

SEQ ID NO: 65925 - RNA, 61 nt, Human
gauuagguugugauacaugaagagccaagagcaggaugagguggaggcguuacaacuaccu

SEQ ID NO: 65926 - RNA, 61 nt, Human
gaagaagcaagaaacuucggggcugcagccucaggaugaggcagaaggaaggguaagggaa

SEQ ID NO: 65927 - RNA, 61 nt, Human
agacagggucaccuugggaaggcuugggagccaggaugagugucgggcucucgugugugca

SEQ ID NO: 65928 - RNA, 61 nt, Human
cgagcuuuccuggcauaggucaaucaggucccaggaugaauaauccaggcuucagcaacac

SEQ ID NO: 65929 - RNA, 61 nt, Human
aggagcagugcagauuucaauuuggcuaaaacaggaugauugcuuuugucuguuuacugaa

SEQ ID NO: 65930 - RNA, 61 nt, Human
auucaaggaagaacuuucugccccggcuuugcaggaugaaaagcuuuccugcuuggcaguu

SEQ ID NO: 65931 - RNA, 61 nt, Human
gaaccacagcugcagaguaggcagcugccuccaggaugaguuacuugaaauuugccuugag

SEQ ID NO: 65932 - RNA, 61 nt, Human
cuuaucuuccuaagcggaguuuuaggugacacaggaugaagcagaagagaucuacccaucu

SEQ ID NO: 65933 - RNA, 61 nt, Human
acuugaguuuauugccccauaacuaaaggaucaggaugaugguagaacggagaucuggguu

SEQ ID NO: 65934 - RNA, 61 nt, Human
acaggggaguuaaauggcugggcaggugccacaggaugaggccacugaaagaucugcuuca

SEQ ID NO: 65935 - RNA, 61 nt, Human
gcaauguggaaauucuaaagcucccugagaacaggaugacucguguuugaaggaucuuauu

SEQ ID NO: 65936 - RNA, 61 nt, Human
auugugucuacaauugcaaaaaacacaguaacaggaugaauauuaucugauaucaagucaa

SEQ ID NO: 65937 - RNA, 61 nt, Human
gggucccccauuguuuugcuuccccagcgcccaggaugagcgguuuaccaucgagcuuacc

SEQ ID NO: 65938 - RNA, 61 nt, Human
auuuaccuguuuucgcaccuaccaucagggacaggaugaccuggauaacuuagguggcaag

SEQ ID NO: 65939 - RNA, 61 nt, Human
agaggcaggucaagaucugguuccagaaccgcaggaugaaaaugaagaaaaucaacaaaga

SEQ ID NO: 65940 - RNA, 61 nt, Human
acuuuacaaauaaaaccaaaucuuuugucaacaggaugaaacccaucuuaaaggaaagaaa

SEQ ID NO: 65941 - RNA, 61 nt, Human
guuuccaaagcggagacuuccgacuuccuuacaggaugaggcugggcauugccugggacag

SEQ ID NO: 65942 - RNA, 61 nt, Human
aacaguaucuguguuuguacugugcaguuuucaggaugagaugacagauagcacgacuaca

SEQ ID NO: 65943 - RNA, 61 nt, Human
uuccaguucacguaacaaguaaaugggaaaccaggaugaaaaucaagguuuaucugucauc

SEQ ID NO: 65944 - RNA, 61 nt, Human
cacaugccccaggcucucgcugcccuguggacaggaugaggacagagggcacaugaacagc

SEQ ID NO: 65945 - RNA, 61 nt, Human
cgguguuagcagcagcguucccugccuccugcaggaugacuuagaaaucuagugaguuucu

SEQ ID NO: 65946 - RNA, 61 nt, Human
gcccaaggucagagccacuuggugacagagccaggaugagaacaaagauuccauuugcacc

SEQ ID NO: 65947 - RNA, 61 nt, Human
aaagcuggcagcuuuuguuacagaagauucucaggaugaaggcaggggcugaggccucugc

SEQ ID NO: 65948 - RNA, 61 nt, Human
uuguccuuucguguauuguucauccagcaaccaggaugaucuuguuaaaacauuaaacaga

SEQ ID NO: 65949 - RNA, 61 nt, Human
acagacgggguuuauaaguacugauacuggacaggaugagaagggaguaggaugucauccu

SEQ ID NO: 65950 - RNA, 61 nt, Human
gaagcuuuaggaccaaauuguuagaaagcaucaggaugaccaguuaucucgaguagauuuu

SEQ ID NO: 65951 - RNA, 61 nt, Human
aaaaaauuauaaaaauaaguuuucagucagucaggaugacaucacucccaauguuaugcag

SEQ ID NO: 65952 - RNA, 61 nt, Human
uggauucccuuagaaguaagauuucuauuugcaggaugaguugggcagggaaaagggucag

SEQ ID NO: 65953 - RNA, 61 nt, Human
uggcgugguaccaaccagauaaugacugcaucaggaugaaagcugcugaacucggcauggc

SEQ ID NO: 65954 - RNA, 61 nt, Human
ggacuuugauucaaccaauuuugaggaaucucaggaugaggaugaugcucuuaaugaaauu

SEQ ID NO: 65955 - RNA, 61 nt, Human
gagacgcaggaauggaaagcggaguuccuaacaggaugaaaguucccccaucaguuccccc

SEQ ID NO: 65956 - RNA, 61 nt, Human
aaagagcaaaccuaacaggagaaaggacaaccaggaugaggaugucaccaacugaauuaaa

SEQ ID NO: 65957 - RNA, 61 nt, Human
ggccaaggagaguccuugcacccgugagcgucaggaugaggaaaugacaggaggaagacgu

SEQ ID NO: 65958 - RNA, 61 nt, Human
gauuuccccauuucuguuugcugccugaaagcaggaugaggaaggccaaggagaguccuug

SEQ ID NO: 65959 - RNA, 61 nt, Human
uuuuuuuuuucguuuguuuuagugacuaauucaggaugaaaguuuuuuuguucuuguauuu

SEQ ID NO: 65960 - RNA, 61 nt, Human
ggaccuucccucuaccucccccaguuagugacaggaugaggaaaagaagagccuuugcuga

SEQ ID NO: 65961 - RNA, 61 nt, Human
guauuucaucugccagauuauuugaaucacacaggaugauguguuaacaguauuagggugg

SEQ ID NO: 65962 - RNA, 61 nt, Human
gacugccaguaauuagugcagaaaacuaagacaggaugauacagguuugaggggcugggga

SEQ ID NO: 65963 - RNA, 61 nt, Human
guaugagaccagugggcgccauuuaaaagaacaggaugagaaucuaagauauauuauuaau

SEQ ID NO: 65964 - RNA, 61 nt, Human
auacuauuuuugcugagcaaccaguguguuucaggaugauacaaagaaaaauauagaauag

SEQ ID NO: 65965 - RNA, 61 nt, Human
cccuuugaauuaauaugggaagaaauuaauacaggaugaacuggagagaaggguugagugu

SEQ ID NO: 65966 - RNA, 61 nt, Human
uuuaguagaaacgggguuucaccauguuggccaggaugauccucaaucuccugaccucgug

SEQ ID NO: 65967 - RNA, 61 nt, Human
ugguucccaggcugagacugacggguuuucucaggaugaugucuugggugaggguagggag

SEQ ID NO: 65968 - RNA, 61 nt, Human
ccuaacuucguauuuuuugauacgcacuuugcaggaugaccucagggcuauguggauugag

SEQ ID NO: 65969 - RNA, 61 nt, Human
gggaagagaacugggcugacuccaggaccuccaggaugaggcagaggcaugaugcuuccug

SEQ ID NO: 65970 - RNA, 61 nt, Human
aucuggcccgcacgaugccuugcaggauggacaggaugacagacagggacgaagcagagac

SEQ ID NO: 65971 - RNA, 61 nt, Human
uccagccagugagugggcacccaaugccucucaggaugagaccaguaaaugccggaggugg

SEQ ID NO: 65972 - RNA, 61 nt, Human
cgacgauccccauggaacagcccugcacgcccaggaugaaggggccagaccacgccccugc

SEQ ID NO: 65973 - RNA, 61 nt, Human
agauucccgcggguuccgcaggcagacuacacaggaugaggugguggaguggagugagagc

SEQ ID NO: 65974 - RNA, 61 nt, Human
cugacugccaggggcgggggcucugcauagccaggaugacggcuuucaugucccagagacc

SEQ ID NO: 65975 - RNA, 61 nt, Human
cgucacaugaagaagaaaacuugucgacauccaggaugaucaggagccuucauuaaaacag

SEQ ID NO: 65976 - RNA, 61 nt, Human
caugaggcugguuuaccaacaucuacucccucaggaugagcgugagccagaagcagcugug

SEQ ID NO: 65977 - RNA, 61 nt, Human
cugcaaaaugcaaagagaacuaccucauaugcaggaugagccaauggcagucucaagaaau

SEQ ID NO: 65978 - RNA, 61 nt, Human
caccugcugguaacccugggccuauugaaagcaggaugagaugauaauuuaagacacugaa

SEQ ID NO: 65979 - RNA, 61 nt, Human
cucaaugucccccucacccccaccucaaggucaggaugagaacacacugagugaggagugg

SEQ ID NO: 65980 - RNA, 61 nt, Human
agaaaugcauccuccagcugacagaaaaauccaggaugagaucagaaggauacugguguuu

SEQ ID NO: 65981 - RNA, 61 nt, Human
gacaaagaaggcacagguguaaauauaguagcaggaugaggaaccucaaacuggguaucau

SEQ ID NO: 65982 - RNA, 61 nt, Human
agguaaaucagacuaugaaguuuuuuuuauacaggaugaugacuauggaaagaguacucuu

SEQ ID NO: 65983 - RNA, 61 nt, Human
auauauuaagguucuccuugcccugaagcuucaggaugaaggacaggaagcugaaggagaa

SEQ ID NO: 65984 - RNA, 61 nt, Human
gaacaggccuccuaucuuuagucacuuuguacaggaugauauccaugaguacuuuaguguu

SEQ ID NO: 65985 - RNA, 61 nt, Human
ggcggagcugaggacaggccuuggcuggucccaggaugagcgacgaguuugguuuuagcug

SEQ ID NO: 65986 - RNA, 61 nt, Human
agccagaccucucugagagacauggauaucacaggaugaagguagaacuauaaucugcaau

SEQ ID NO: 65987 - RNA, 61 nt, Human
aaguugcgguauuuaacguaucugccaauaccaggaugagcaacaacaguaacaaucaaac

SEQ ID NO: 65988 - RNA, 61 nt, Human
uuuaaaauauauaucuuuauaaaguaauauucaggaugaugauaaaaauuguuuauauugu

SEQ ID NO: 65989 - RNA, 61 nt, Human
ggcuggucuggcuguggccaccgucacaguccaggaugaagaggaguacaggguccuguga

SEQ ID NO: 65990 - RNA, 61 nt, Human
ccaguauuagaauaaauuaaaacauacaagccaggaugaaugaagccaauaggaaauaaaa

SEQ ID NO: 65991 - RNA, 61 nt, Human
uguugauccaggcagucuuucucugccaauucaggaugagauguuuagguaaguauuuuau

SEQ ID NO: 65992 - RNA, 61 nt, Human
cugguuggucaaacucugggcaaaggguuuucaggaugaggaggucaagacaggaucucca

SEQ ID NO: 65993 - RNA, 61 nt, Human
ccucugcagcccacugccugcccagugccaucaggaugagcaguaccggccaagcauaaug

SEQ ID NO: 65994 - RNA, 61 nt, Human
gccuaggagggggcuggcugccuuuaugucccaggaugacucuuuaugggugggauuacau

SEQ ID NO: 65995 - RNA, 61 nt, Human
guuguuacuuucuuaguauguacagucuucucaggaugagcaguaaaaccuuugaacaaag

SEQ ID NO: 65996 - RNA, 61 nt, Human
aauugcuucauuuucuugagcaauacugaagcaggaugaaguaagaggaaugcauucauuu

SEQ ID NO: 65997 - RNA, 61 nt, Human
cuuacacagcauuuuagggaaagaauacaggcaggaugacacuuuguguuaaaguguuauu

SEQ ID NO: 65998 - RNA, 61 nt, Human
uuuaguauucacuagcagcgccuucggguagcaggaugauuccuuuuccugccugucugcu

SEQ ID NO: 65999 - RNA, 61 nt, Human
uguagucucucauauuuacucaaggagggaccaggaugauacagucaucugagguuaugcu

SEQ ID NO: 66000 - RNA, 61 nt, Human
cccagcacacaaggaagaccagauguagcuacaggaugaugaaacaugguuucaaacgagu

SEQ ID NO: 66001 - RNA, 61 nt, Human
aagaagaaaaagguuugcauucucacauugccaggaugauaaguuccuuuccuuuucuuua

SEQ ID NO: 66002 - RNA, 61 nt, Human
agucacucauaucggagccuggacuggccuccaggaugaggauggggguggcaaugacacc

SEQ ID NO: 66003 - RNA, 61 nt, Human
gcacucuugcagcuccccagucucuaccugucaggaugacuccaggaagacagcuggagua

SEQ ID NO: 66004 - RNA, 61 nt, Human
caggcuucauuacacaggcuuuucauguaugcaggaugacucaauguuaaagcauuuaaau

SEQ ID NO: 66005 - RNA, 61 nt, Human
uaggaugagaaagauuuauauuauuagauuucaggaugauuuauaauaauucaaaaaugaa

SEQ ID NO: 66006 - RNA, 61 nt, Human
uuaaaucaugcaacaacgagaguaucacagccaggaugacccuugggucccauuccuaaga

SEQ ID NO: 66007 - RNA, 61 nt, Human
uacuuaaugggaagggaagaacauuuguuuccaggaugacuuucuggccagaauaccggaa

SEQ ID NO: 66008 - RNA, 61 nt, Human
ccguuugacuuugguugugacaucuuccuuucaggaugauggaauuagaugcagucugucu

SEQ ID NO: 66009 - RNA, 61 nt, Human
cuaucaguguuugccucccaaaucccaggaccaggaugacaucaaaaaucagguagaguag

SEQ ID NO: 66010 - RNA, 61 nt, Human
gccucuuguaggugcuggcuaagggccaggccaggaugaguuuccccauggugaauguuac

SEQ ID NO: 66011 - RNA, 61 nt, Human
ggacaaacugcuaggcuguaucccauaauuucaggaugagaaacauuaacaauaaaaauuu

SEQ ID NO: 66012 - RNA, 61 nt, Human
uuuaguagagacgggguuucaccguguuagccaggaugaucucgaucuccugaccucguga

SEQ ID NO: 66013 - RNA, 61 nt, Human
cagugacccugcccccaugaccuuggccaggcaggaugauuccagagcccguacugugggg

SEQ ID NO: 66014 - RNA, 61 nt, Human
ccgauacacugggaccaccccuuaccccggacaggaugaauggaucaaaggagugagguug

SEQ ID NO: 66015 - RNA, 61 nt, Human
gucuaagacccagauucugccaacauuugggcaggaugagagggcugacccugggcuccaa

SEQ ID NO: 66016 - RNA, 61 nt, Human
gacugcugaggaccaagguggcauccuagggcaggaugaacuggcucugagcacccugccg

SEQ ID NO: 66017 - RNA, 61 nt, Human
uugugggacuucccccaggcaacuaaaccugcaggaugaaaaugcuauauuuucuuucaug

SEQ ID NO: 66018 - RNA, 61 nt, Human
uuuuggucacccuuuaaguguccuucucucccaggaugagugaggagcugugcugauguug

SEQ ID NO: 66019 - RNA, 61 nt, Human
auagauaugaaaagauuggcagaggccauugcaggaugaaucacuugucacuuuucuucug

SEQ ID NO: 66020 - RNA, 61 nt, Human
uggucccuggaggguggcuucuccugacuggcaggaugaccuuagccaagauauuccucug

SEQ ID NO: 66021 - RNA, 61 nt, Human
ugagcugcagaagaugacccgggggcagcuucaggaugaguuagagaaaggugaacgggac

SEQ ID NO: 66022 - RNA, 61 nt, Human
ccuuuuaaacgacaacaauacugcuagcuuucaggaugauuuuuaaaaaauagauucaaau

SEQ ID NO: 66023 - RNA, 61 nt, Human
ugaggucagaggucaggagcagggcuggggucaggaugacgaggccugggguccugguguu

SEQ ID NO: 66024 - RNA, 61 nt, Human
caccucucccucaacaagggagagacuuuaucaggaugaacccaggacugcuucugaaugc

SEQ ID NO: 66025 - RNA, 61 nt, Human
caccucucccucaacaagggagagaccucaucaggaugaacccaggacgcuucugaaugcu

SEQ ID NO: 66026 - RNA, 61 nt, Human
aucuuggggccauguccccuucuugcugccacaggaugaauaaaguguugagauuugucua

SEQ ID NO: 66027 - RNA, 61 nt, Human
gccuuuacuugcuccaucagaaacaacuuugcaggaugacgccaauauuuaggacaccacg

SEQ ID NO: 66028 - RNA, 61 nt, Human
cccuccacuaucccaugggcucucucugccccaggaugaucuucugugcugggacagggac

SEQ ID NO: 66029 - RNA, 61 nt, Human
aaaaccaguaguacguuuuagucauauuagucaggaugagaaacuauaagauguguguaac

SEQ ID NO: 66030 - RNA, 61 nt, Human
gguuuuauaccaauauuauaugcagaaaucacaggaugaauuuagaauuaaaucucaauua

SEQ ID NO: 66031 - RNA, 61 nt, Human
acccccacauucucucacugaaguuucccaccaggaugaccccacagccagagucccuugg

SEQ ID NO: 66032 - RNA, 61 nt, Human
auaccuuguaugcaaacgaugauaaacuagucaggaugagcagagcugccugaccucuuga

SEQ ID NO: 66033 - RNA, 61 nt, Human
gcaggcggccagggcggccagggacccaaagcaggaugaccacgcaccuccacgccacugc

SEQ ID NO: 66034 - RNA, 61 nt, Human
uuuguccgcuagcgucugucugcagaacuuucaggaugacuauuaauuccucucagauguc

SEQ ID NO: 66035 - RNA, 61 nt, Human
uguuuugcugaguuauuugugauuagcuaaccaggaugaaaaauaacagauuauauauagu

SEQ ID NO: 66036 - RNA, 61 nt, Human
uuagguuaccuauauagucuccuaggaagaucaggaugaaagaccuagaugauaccccuga

SEQ ID NO: 66037 - RNA, 61 nt, Human
auauauucaaagaugugauucccaaccaacucaggaugaaguaacuaguguuacaacugag

SEQ ID NO: 66038 - RNA, 61 nt, Human
aaacaggcuccaagaggcugaggacuuugcccaggaugacauagccaauggacaagcagug

SEQ ID NO: 66039 - RNA, 61 nt, Human
aggagaagcaggcaccuuuuucacagggcggcaggaugaaaaugacugccagcaguggaaa

SEQ ID NO: 66040 - RNA, 61 nt, Human
cucucuguuuucauuucuuuuucuguaaaugcaggaugaaaacaauauguaucuccuagga

SEQ ID NO: 66041 - RNA, 54 nt, Human
acgggcaccagugggcauagggcacaggaugagccuccagcucuguccugcauc

SEQ ID NO: 66042 - RNA, 61 nt, Human
acugcggccuggcugcugagggacgagagaccaggaugauuucgagguuggccuuagagga

SEQ ID NO: 66043 - RNA, 61 nt, Human
aaagaccaagaggaaaugacugugccuggaacaggaugaaauagacaaguagagauuuaau

SEQ ID NO: 66044 - RNA, 61 nt, Human
ucagacugucagucauuaaaaacagcauuagcaggaugaggauagcaauggggaaggguug

SEQ ID NO: 66045 - RNA, 61 nt, Human
guaaaguucccaguuuuccugccuucugugacaggaugaaugagguggguauggacagugg

SEQ ID NO: 66046 - RNA, 61 nt, Human
gaaaacaaacacauuuaaaauugguuuaccucaggaugacgugcagaaaaaugggugaagg

SEQ ID NO: 66047 - RNA, 61 nt, Human
gcauucccaugagcuuaggcauucuaagucacaggaugagacaggaggucagcacaagaua

SEQ ID NO: 66048 - RNA, 61 nt, Human
caagcaaggcuugggguccuuuauggaaccccaggaugacucagcaauaaaauauuuuugg

SEQ ID NO: 66049 - RNA, 61 nt, Human
aucaugagaaaccuuccagggaaacugagcacaggaugaacuguuaguuguuuuuaaaagu

SEQ ID NO: 66050 - RNA, 61 nt, Human
cucuuccaggcacuggcaaugcagugaugaacaggaugacaagauucaugccaucaggggc

SEQ ID NO: 66051 - RNA, 61 nt, Human
uguaaauaaagugaguaauugguaugacuugcaggaugauguacauguuaguuuguagcuc

SEQ ID NO: 66052 - RNA, 61 nt, Human
ugcaggaugauguacauguuaguuuguagcucaggaugauuguuaagcaauagauuugcuc

SEQ ID NO: 66053 - RNA, 61 nt, Human
ucccgaguccccagauggagaccccuuucuacaggaugaccccuugauauuugcacaggga

SEQ ID NO: 66054 - RNA, 61 nt, Human
gguccuggcuagcagcagcaccguggugaugcaggaugaguccuucccugccugcaagauu

SEQ ID NO: 66055 - RNA, 61 nt, Human
aaaaacaagacagaacuucugguacucuaaucaggaugauuccuaacaagucagucauuug

SEQ ID NO: 66056 - RNA, 61 nt, Human
gagaggggucagucuagaagcuagauccuaucaggaugaggagcagcagcccagggcuugu

SEQ ID NO: 66057 - RNA, 61 nt, Human
aagcccgcaguggacugaugccuucgaugggcaggaugaaggccaggggcacuggagugag

SEQ ID NO: 66058 - RNA, 61 nt, Human
gggccuccucacaacauggugucuggauucccaggaugagcaucccaggaucgcaagagcc

SEQ ID NO: 66059 - RNA, 61 nt, Human
cuuugcucugccaacuucuucagagcugacacaggaugaaggcaaugccauccucaaacac

SEQ ID NO: 66060 - RNA, 50 nt, Human
agcaggagaggcuucggcaacaggaugagaggcuguggcagcaggagacu

SEQ ID NO: 66061 - RNA, 61 nt, Human
aguuaaugaacaugagguaguguuccacuggcaggaugacuuuucaauagcucaaaucaau

SEQ ID NO: 66062 - RNA, 61 nt, Human
agaugccuucucucuccaucuaccuuccagucaggaugacgguauuaugcuucuuggaguc

SEQ ID NO: 66063 - RNA, 61 nt, Human
gcagacacauccaguaucuccuucuggagcacaggaugaaauaagggagcuguauuauuuc

SEQ ID NO: 66064 - RNA, 61 nt, Human
ccuccaaggaugagcugguccagagauacaacaggaugaauaccaucccccagguauugga

SEQ ID NO: 66065 - RNA, 61 nt, Human
ugcccuggcuguggggguggagggaccuugccaggaugaaccccccagucccaggcacccu

SEQ ID NO: 66066 - RNA, 61 nt, Human
auugcgggucucuguagaagucccaaagcuucaggaugagaagauggaggggcugguuucc

SEQ ID NO: 66067 - RNA, 61 nt, Human
gucccaacaaccccagcugccccccgcugcucaggaugaaccuggaggcccaccucaagga

SEQ ID NO: 66068 - RNA, 61 nt, Human
ggugggcgacccugacaaguaccgccugucucaggaugaccgcgauggccugcagcaacuc

SEQ ID NO: 66069 - RNA, 60 nt, Human
ucauaauaaagagaguguauacugacaugggcaggaugauaaaaaucaugguuuaauauu

SEQ ID NO: 66070 - RNA, 54 nt, Human
guaguggcuucagccucugacagucaggaugaagccccaugccacuccacacug

SEQ ID NO: 66071 - RNA, 61 nt, Human
aagccaacggcguuccuggcucuccugcccacaggaugaacauuuucggcuuccuuaggag

SEQ ID NO: 66072 - RNA, 61 nt, Human
ucauuaacugaaaaguagcagcuucucuauccaggaugaugagucaacagguuucacuaau

SEQ ID NO: 66073 - RNA, 61 nt, Human
agccaaagcaaauucuccuauuaacacuuagcaggaugaauuuaauauucauucaaaaagg

SEQ ID NO: 66074 - RNA, 61 nt, Human
agaaagcaguugagacaagaaaauaagagcucaggaugagggaaaagaaaaagauugagag

SEQ ID NO: 66075 - RNA, 61 nt, Human
uuccuggguuccaccaagcagcgaaaacugccaggaugaaugaggaaaaaacccagcccca

SEQ ID NO: 66076 - RNA, 61 nt, Human
agaccuguucuuucacagaugugagaagccccaggaugauugaccaugguguucaggagcg

SEQ ID NO: 66077 - RNA, 61 nt, Human
aguugacugucuugauaauuagccugaccagcaggaugaaugcaagacugacagugaugga

SEQ ID NO: 66078 - RNA, 61 nt, Human
ccacuuuugaaguuaauccuuuugugugauacaggaugaacuugggauguuugaacccugg

SEQ ID NO: 66079 - RNA, 61 nt, Human
ucaggccagcgagagauggagcuaccguguccaggaugaagcugcaggucugggggacacu

SEQ ID NO: 66080 - RNA, 61 nt, Human
gacccagcauccuuugcauuacuuuuuccuucaggaugaucuagagcagcauggagcuguu

SEQ ID NO: 66081 - RNA, 61 nt, Human
cuccucuuccucucccauuucuuuuuuaagacaggaugaaacagguucagagaggggaagu

SEQ ID NO: 66082 - RNA, 61 nt, Human
ccgccuccuccagcugcuucaggcuaaaacccaggaugaggaggaacagguaagggcagga

SEQ ID NO: 66083 - RNA, 61 nt, Human
ggugaauguguccacaguugagagguuggagcaggaugagggaauccugucaccaucaaua

SEQ ID NO: 66084 - RNA, 61 nt, Human
gagcacuuccucccguuggcaaacagaaguucaggaugagacccugcuggccugguccugg

SEQ ID NO: 66085 - RNA, 61 nt, Human
uuguauacaaaggggcccuccuuaaaagggacaggaugaccuucccgaggaacucauuggc

SEQ ID NO: 66086 - RNA, 61 nt, Human
cuagggguucuuagucucuggggcuacuaggcaggaugaauuugacugggucgguaggagc

SEQ ID NO: 66087 - RNA, 61 nt, Human
aggcuucgugaauugcaagaagggacccuuccaggaugacacuaggaacagggcuagggca

SEQ ID NO: 66088 - RNA, 61 nt, Human
cauuuguacuuaagucauuccaucuuucacucaggaugaaugcgaaaagugacuguucaca

SEQ ID NO: 66089 - RNA, 61 nt, Human
uccuuaccccccagccccugcccaccuucagcaggaugaggcccuggguugccgugcucuc

SEQ ID NO: 66090 - RNA, 61 nt, Human
cauuagagauguaucaccaccuugucaccaacaggaugaugucaccagguaauaaaccuuc

SEQ ID NO: 66091 - RNA, 61 nt, Human
aucuggaagggaaagcacaugccuucacgggcaggaugaucaagcggugcugauucacgag

SEQ ID NO: 66092 - RNA, 61 nt, Human
gcugacugcaugaugagucugaaggcauuugcaggaugagccugaacugguugugcagaac

SEQ ID NO: 66093 - RNA, 61 nt, Human
cagacaaagcaccccugcaccuccuauggcucaggaugagggaggcccccaggcccuucug

SEQ ID NO: 66094 - RNA, 61 nt, Human
ggcuccagugagcgcgccugcuuuagagacacaggaugauucagaccggaaacagaccucg

SEQ ID NO: 66095 - RNA, 61 nt, Human
ccacgccccucgcuggcuuccccaccucucucaggaugaaagcccaagucaucaggguggc

SEQ ID NO: 66096 - RNA, 61 nt, Human
ugaaggauaagagaaacaggcccggggggaccaggaugacaccuccauuucucuccaggaa

SEQ ID NO: 66097 - RNA, 61 nt, Human
cugagccccucugccugguccccuuugcccccaggaugaauacgacgacauugugguucac

SEQ ID NO: 66098 - RNA, 61 nt, Human
guccuugcuuaugccugccucuuucgcuuggcaggaugaugcugucauuaguauuucacaa

SEQ ID NO: 66099 - RNA, 61 nt, Human
agcccagagcaggaggacgcugcacaccaugcaggaugacaugggggaugcgcucgggauu

SEQ ID NO: 66100 - RNA, 61 nt, Human
uucauuuaaccuuggucacauugagucauuccaggaugaguggcucaaguauuuccucagg

SEQ ID NO: 66101 - RNA, 61 nt, Human
aaguuguggguuaggguuucucccccucccucaggaugacgcuaguuagcugacacagaug

SEQ ID NO: 66102 - RNA, 61 nt, Human
acagauggucaccuccauuaccaaguagagucaggaugaacuaugugugacuguucaacua

SEQ ID NO: 66103 - RNA, 61 nt, Human
accacaaugugcugucacucuagacagucaccaggaugauuaaauuuaaaucacaauaaca

SEQ ID NO: 66104 - RNA, 61 nt, Human
uacuucacucagaaugaaggaacaaguaucucaggaugaaaucucaaugaaaaacacuuau

SEQ ID NO: 66105 - RNA, 61 nt, Human
ggcugcagagggagccuccugcucccugcuccaggaugaaaccaagagggggaugucagcc

SEQ ID NO: 66106 - RNA, 61 nt, Human
cuguccugggaagaccaaaagaaaagcauuucaggaugagggaauggcaugcgcaaaggcc

SEQ ID NO: 66107 - RNA, 61 nt, Human
cauucucagacaguggaggcauucuaagucacaggaugagacaggagguccguacaagaua

SEQ ID NO: 66108 - RNA, 61 nt, Human
auaauuaggcaaugucaagugaacacaaauucaggaugacagacugcaaaguaacauccau

SEQ ID NO: 66109 - RNA, 61 nt, Human
uaacguggggauaauaauaauagcugcuucacaggaugaaaugaaguuugaggugagaagc

SEQ ID NO: 66110 - RNA, 61 nt, Human
ucugccucuggaggagggugggguauucuggcaggaugaaucgcaggauggcgcguacuga

SEQ ID NO: 66111 - RNA, 61 nt, Human
ugcuugugucugcugucucagaggccuuggucaggaugaaguuggcugacacagcuuagcu

SEQ ID NO: 66112 - RNA, 61 nt, Human
uucaacaucucaggcuguggcuggaacaggacaggaugaucuaaaacacacguaccauugg

SEQ ID NO: 66113 - RNA, 61 nt, Human
ucagcccuacagaguagggaguugaugcugacaggaugaagauuuaggaauaaauaugccu

SEQ ID NO: 66114 - RNA, 61 nt, Human
aggagaacuguggcguguaggaggaauacuucaggaugagugaaggcuggagccagggagc

SEQ ID NO: 66115 - RNA, 61 nt, Human
accuuuauaugcauguguuauguccauuuugcaggaugaacugaguuuaaaagaauuuuuu

SEQ ID NO: 66116 - RNA, 54 nt, Human
caucccaagacuucaauugaagaccaggaugagcuguccucucuucuucaaguc

SEQ ID NO: 66117 - RNA, 61 nt, Human
ugcuauuuucuuagaucuugguacauccagacaggaugaggguggagggagagcuauuuaa

SEQ ID NO: 66118 - RNA, 61 nt, Human
ccccauucccagcuccccccaacccuggccucaggaugagagcugucaccugagacaguga

SEQ ID NO: 66119 - RNA, 61 nt, Human
caugagcaccugggcacagguuggggcucugcaggaugaggaagacaggccaaucccuucc

SEQ ID NO: 66120 - RNA, 61 nt, Human
uguuugauuuucuuguaucugguucuacucccaggaugaaauuauccaacuacauauauau

SEQ ID NO: 66121 - RNA, 61 nt, Human
gauuugcaccaggugccuuguugccuccgcucaggaugaaagaggagcugagagaagugcu

SEQ ID NO: 66122 - RNA, 61 nt, Human
auuaccaagaauucuccaaaacaauuuucugcaggaugauuguacagaaucauugcuuaug

SEQ ID NO: 66123 - RNA, 59 nt, Human
accccggacgccgagacugagaagcuuaucaggaugaaggaugaggaaguauguggggc

SEQ ID NO: 66124 - RNA, 61 nt, Human
acugcaaaaguggcugcuuuggaugccagcccaggaugaguaguuccuguucucagggagg

SEQ ID NO: 66125 - RNA, 61 nt, Human
ugcgucauauggagccuccugggacaagccucaggaugaaaaggacacagaaggccagaug

SEQ ID NO: 66126 - RNA, 61 nt, Human
cugggcuguggccguggagagacacugcccccaggaugacacaggcaagagccccugaggc

SEQ ID NO: 66127 - RNA, 61 nt, Human
uuuucagauaucagaaauccccuugggggagcaggaugagaccuuuggauagaacagaagc

SEQ ID NO: 66128 - RNA, 61 nt, Human
gucugugaguaaaacugggggcucaaaugcccaggaugaggggaucagugacugucuagga

SEQ ID NO: 66129 - RNA, 61 nt, Human
cugacaagcaauccagggacaagauacucaccaggaugaggaagaggacuuugggggacgg

SEQ ID NO: 66130 - RNA, 61 nt, Human
uuccugugcaagggggagcuuugcuccaggacaggaugacugucuucccuauucuuaggga

SEQ ID NO: 66131 - RNA, 61 nt, Human
agacauuuuuuugacaguaugagacagacugcaggaugaaaauauuugucaaaaucuuaac

SEQ ID NO: 66132 - RNA, 61 nt, Human
gcaggugcucuguggaugagaggaaccaucgcaggaugacagcucccggguccccaaaccu

SEQ ID NO: 66133 - RNA, 61 nt, Human
cggccgauauuuaaacaugggcagcuuccuucaggaugaucaccgaggcucccgugacuuu

SEQ ID NO: 66134 - RNA, 61 nt, Human
caguggcuccaggccucacuaguggcaagggcaggaugaggcugcaccgcugggaagaguc

SEQ ID NO: 66135 - RNA, 61 nt, Human
acccuucagcuauugcuuccugaaccgagggcaggaugaagauggugaggaagaagaggag

SEQ ID NO: 66136 - RNA, 61 nt, Human
cacugguagaaggccuuuaaugaucugggcccaggaugauuuccugcccuuuuaucauggg

SEQ ID NO: 66137 - RNA, 61 nt, Human
aaugcaccauuagaagauauuagucuuggggcaggaugauuuuggccucauuacuuuacca

SEQ ID NO: 66138 - RNA, 61 nt, Human
aauacuguuuuucuucuaucuguaguuaguacaggaugaauuuaaauguguuuuuccugag

SEQ ID NO: 66139 - RNA, 61 nt, Human
uuuucuaguucauaugaaaauaaccauaguacaggaugauuucuguccacacaaagguuaa

SEQ ID NO: 66140 - RNA, 61 nt, Human
aggccuagacucagcugaaggaucuucaaagcaggaugaagaccuagacuuaccugaaggc

SEQ ID NO: 66141 - RNA, 61 nt, Human
aggccuagacucagcugaaggaucuucaaagcaggaugaagaccuagacuuaccugaagga

SEQ ID NO: 66142 - RNA, 61 nt, Human
agaccuaggcuuaccugaaggaucuucaaagcaggaugaagaccuagacuuaccugaagga

SEQ ID NO: 66143 - RNA, 61 nt, Human
gucugcgcuuuccucucccgccugccuagcccaggaugaagggcuggguggccacaacugg

SEQ ID NO: 66144 - RNA, 61 nt, Human
gacucauccuugcccaggugagggaaggagacaggaugaggucucgacccuguccccuagg

SEQ ID NO: 66145 - RNA, 61 nt, Human
ggacuuucccacccaggaaaggaggaccagucaggaugaggccccgccuuuucccccaccc

SEQ ID NO: 66146 - RNA, 61 nt, Human
agaccuagacucaucugcagaaucuucaaagcaggaugaagaccuacaauuaccugaagga

SEQ ID NO: 66147 - RNA, 61 nt, Human
uuauucuucaucccccgcuagagcuggaaggcaggaugaggagagguaugaaggagccuga

SEQ ID NO: 66148 - RNA, 61 nt, Human
uggccuuuguuugagagucagccagccugcucaggaugaaaaugaggcgccuggcuuuuag

SEQ ID NO: 66149 - RNA, 61 nt, Human
gcuuuuaaaacugauagguauuguuggaaagcaggaugaagccugagccaguggaaaagcu

SEQ ID NO: 66150 - RNA, 61 nt, Human
gcaccaaguaacaccacacacacgcagcacccaggaugaugguuucacuucagucuucccc

SEQ ID NO: 66151 - RNA, 61 nt, Human
cauuuuugucuaacgagagacaucaguuucucaggaugauccucaagaacguuauggaguc

SEQ ID NO: 66152 - RNA, 64 nt, Human
acacgacgcucaccgcggcucgggccguggggccgucagagaaaccuuuuuaaaaaauggagau

SEQ ID NO: 66153 - RNA, 64 nt, Human
gcucuauuagaaagggucaggguacgguuccauggucagagagguuuggaaaacuguucuggcc

SEQ ID NO: 66154 - RNA, 64 nt, Human
augucacuuuacguuugaauuucugagcuaaagagucagagagauuagucacauaguugccuaa

SEQ ID NO: 66155 - RNA, 64 nt, Human
cugcugccccauuugaucaagagaccauggaagugucagagauucagaauccaagauugucuuu

SEQ ID NO: 66156 - RNA, 64 nt, Human
ggcaaaaggugcuuuaccuugagccauuauuugugucagagaacaaaagaaacagaaucaauau

SEQ ID NO: 66157 - RNA, 64 nt, Human
aauuacauaaaaauuaauauucugggucugaucugucagagaauaaauaucaaaucuaaauuua

SEQ ID NO: 66158 - RNA, 64 nt, Human
cuuuuccuuuguuuugggauucagaaaacugcuugucagagacuguuuauuuuuuauuaaaaau

SEQ ID NO: 66159 - RNA, 64 nt, Human
cuccucuggcaauaaaagucagugaaugguggaagucagagaccaacccuggggauugggugcc

SEQ ID NO: 66160 - RNA, 64 nt, Human
aguccaaaccaagcccuuccaagagagaacaaaggucagagauguugaagauuccagcaaauuu

SEQ ID NO: 66161 - RNA, 64 nt, Human
cugcaaaccuucaacucccaucuuuccccaagaagucagagaugcuguuacuugaaugauuuag

SEQ ID NO: 66162 - RNA, 64 nt, Human
ugcugucaucuauauagaagccuuucugauacaugucagagagugacaugaagucuccccucuu

SEQ ID NO: 66163 - RNA, 64 nt, Human
aaaucaauccuuuauuuaauuuuauuuccaaccugucagagaauguucuuaggcaucaaaaucc

SEQ ID NO: 66164 - RNA, 64 nt, Human
gaauuaaguuuuccccaagcaaggaaggcagguggucagagagaucaaacgcugaggcgugggg

SEQ ID NO: 66165 - RNA, 64 nt, Human
gcugguaaaaugugaaguaauagugaaccuaacagucagagacaggcagcaugcucuuaacuag

SEQ ID NO: 66166 - RNA, 64 nt, Human
aaagcuuccuccuuguaagaaaccccuguccccagucagagauaacauccaacuaacuccagaa

SEQ ID NO: 66167 - RNA, 64 nt, Human
caaucuucugagauggcuucugggucuuuccauggucagagaagaucuauaguccguccugagg

SEQ ID NO: 66168 - RNA, 64 nt, Human
cucccacagaugccuccugcuuggauucugaguggucagagaucuguaaagcaugacuuucaag

SEQ ID NO: 66169 - RNA, 64 nt, Human
gacagcaaagucuccuuauguauaaugaaacaaggucagagacagauuugauauuaaaaaauua

SEQ ID NO: 66170 - RNA, 64 nt, Human
uacacacuugguuuccagagcucccaguggacaugucagagacaacacuucccagcaucugaga

SEQ ID NO: 66171 - RNA, 64 nt, Human
guggguggagcugccugcugcacucagcagugcggucagagaagggcuuuuggucuugaagucc

SEQ ID NO: 66172 - RNA, 64 nt, Human
uuugcaagagauuaaugaucugccuuauauuagagucagagacuaaugguggcuuaaaugcacg

SEQ ID NO: 66173 - RNA, 64 nt, Human
uggauuucuccuuuuccccugcuggcuggugacugucagagaccccaucacugaguuuugugug

SEQ ID NO: 66174 - RNA, 64 nt, Human
ucaaaggccaggacccuggggccccucaacugcagucagagagcaagccccccaaaaaaaagaa

SEQ ID NO: 66175 - RNA, 64 nt, Human
ggucuggccugacccccaacaaagaagccuggaggucagagaagcaaaugcggagccugcuccc

SEQ ID NO: 66176 - RNA, 64 nt, Human
ucaaaugagauuaaaaacaaggaagcagagaauggucagagaaugggauucagauugggaacuu

SEQ ID NO: 66177 - RNA, 64 nt, Human
uuggagccagcugagaggucuauuuaaaaaaaaagucagagacagauaccuccaacccugccgu

SEQ ID NO: 66178 - RNA, 64 nt, Human
gaaaaugcuggaaaaccaccaccgccacccagcagucagagaggaccuuucgaggugaugcacu

SEQ ID NO: 66179 - RNA, 64 nt, Human
uuucugcuccuuggcuucuagauggcaccauguugucagagaagucuuuuaaggacugccacuc

SEQ ID NO: 66180 - RNA, 64 nt, Human
auaagaaacagccuccaagaacauucaagcagcagucagagagaaaaauguuucgacagccaag

SEQ ID NO: 66181 - RNA, 64 nt, Human
agugaucccauguuuguuaauugccaucauggaagucagagaauuaaccaauuaagugacggua

SEQ ID NO: 66182 - RNA, 56 nt, Human
gaucagcagaucgauucugauuucaagucagagacuuuuuaucuugccuuuggacu

SEQ ID NO: 66183 - RNA, 64 nt, Human
guguugaaggaugauuuuuuuuccccucaucuuggucagagaguggauuuuguauuuuguauuu

SEQ ID NO: 66184 - RNA, 64 nt, Human
cccuguuuuaaauuauaagaugucauccccuugugucagagacagaccccuuggcuuuugcuug

SEQ ID NO: 66185 - RNA, 64 nt, Human
aucccccagcacugauguuguuacugauucuccugucagagaucugggaggucuccacugagga

SEQ ID NO: 66186 - RNA, 64 nt, Human
gaguuaaugaaaacugauucaaccaaauggcgaagucagagacuaucgggggccauggagacac

SEQ ID NO: 66187 - RNA, 64 nt, Human
ggugccccguguaggcaucgucggucgguuugccgucagagauggcgcaucucgcugcaucccc

SEQ ID NO: 66188 - RNA, 64 nt, Human
ugaucgucuuuccuuuguauuggagaaggacugggucagagaucuguuggagagagagaauaaa

SEQ ID NO: 66189 - RNA, 64 nt, Human
caguuuaaucacaagaaggaggcaggaagggagagucagagagagaauggaagauaccaugcuu

SEQ ID NO: 66190 - RNA, 64 nt, Human
gucgagggaaagagacccagaaaggacacaacccgucagagaccugggagcaggggcaaugacc

SEQ ID NO: 66191 - RNA, 64 nt, Human
uuuuauauccagaaagucuucucuauguagagaagucagagagacuagaugcuuucacuaggga

SEQ ID NO: 66192 - RNA, 64 nt, Human
ucuacaccccugugccccuccuaggggcccaugagucagagaggcuugccccaagucacagcca

SEQ ID NO: 66193 - RNA, 64 nt, Human
agggcaagaggacugaggccagagcaaggccaaugucagagacccccgggauggggccucacac

SEQ ID NO: 66194 - RNA, 64 nt, Human
caccacguguaaggugaugugcacauaucaagaagucagagaaaacacuuuccuggauaaaaaa

SEQ ID NO: 66195 - RNA, 64 nt, Human
cagucauguuuuuuaaaaucuuccuuuauaucaagucagagaguauacuucuauaaauuucacu

SEQ ID NO: 66196 - RNA, 64 nt, Human
cuaagaaguuuucuaaaaauuuuguaaaggcacugucagagaaucuggaguugaaugauuauuc

SEQ ID NO: 66197 - RNA, 64 nt, Human
ugcacuacaacagauucuuaccgucuccacaaaggucagagauuguaaauggucaauacugacu

SEQ ID NO: 66198 - RNA, 64 nt, Human
uccuuuguaaaccccgucuccuuucauucagagagucagagacgguaucuccuccuccugccuc

SEQ ID NO: 66199 - RNA, 64 nt, Human
acacacuuauugugguuuacccgguuuuaauuaugucagagauugcaucauccuucugcuuguu

SEQ ID NO: 66200 - RNA, 64 nt, Human
agagaagagcucuaaggagaagaaaccccauagcgucagagaggauaugucuggcuuccaagag

SEQ ID NO: 66201 - RNA, 64 nt, Human
ggaaugacaaggcuagaaaccuggcuggcugugagucagagagagagaggauggacgugggaga

SEQ ID NO: 66202 - RNA, 64 nt, Human
aggacugggacguacguggaggcugcuggaccuggucagagacugaugugccuuagcggcaaug

SEQ ID NO: 66203 - RNA, 64 nt, Human
aaagggcaaaaaacaaaaaaaaagguuuuauaaugucagagacuaguauuaaagaaaacugaaa

SEQ ID NO: 66204 - RNA, 64 nt, Human
uuuagguauuuucauuauaugaaagcuaccaugugucagagaugauuuaaucuauuuaaguguu

SEQ ID NO: 66205 - RNA, 64 nt, Human
aucagccaaaggacugagaaggaguuaccuuaaggucagagaaaaccaagagagugugguguuc

SEQ ID NO: 66206 - RNA, 64 nt, Human
gcugagaccugucaggccauacugacaagcagaggucagagacacugguggggagcuggcaaug

SEQ ID NO: 66207 - RNA, 64 nt, Human
gcagaacugggguggauuuggguuggaagugagggucagagaggagucagagagaaucccuagu

SEQ ID NO: 66208 - RNA, 64 nt, Human
guggauuuggguuggaagugagggucagagaggagucagagagaaucccuagucuucaagcaga

SEQ ID NO: 66209 - RNA, 64 nt, Human
acucugagcucauuuggggaccacagaggcuguggucagagagggaagcugaggcccauggcca

SEQ ID NO: 66210 - RNA, 64 nt, Human
guggcagcauccuccaaaacuuagacccaugcuggucagagacggcagaaaacagagccugccu

SEQ ID NO: 66211 - RNA, 64 nt, Human
acagacuuuagcuuucugagcaagaggauuuugcgucagagaaaugucuguccauuuuuauuca

SEQ ID NO: 66212 - RNA, 64 nt, Human
cuuuuuuaaagcaguugaagcagaauguauaggugucagagaagaaaccuagucagccagacgu

SEQ ID NO: 66213 - RNA, 64 nt, Human
uggugacuuugcuucuuuauguguguguaugugugucagagaaagagagagagagagagagaag

SEQ ID NO: 66214 - RNA, 64 nt, Human
cugcuccaggaaaaucggaaaccugugagucagagucagagaaacuuacccaagcaacguaauu

SEQ ID NO: 66215 - RNA, 64 nt, Human
ccagugcugcccuguuugcccugagaaacaagaugucagagacuugccagggcugccaaggagc

SEQ ID NO: 66216 - RNA, 64 nt, Human
uccccuucuccucuaacuauuggaacgccagaaagucagagaaagccuuccauuauucucagca

SEQ ID NO: 66217 - RNA, 50 nt, Human
aaaagacuucggaaaauuaagucagagaugguauuaccuuuuaaaaaaug

SEQ ID NO: 66218 - RNA, 64 nt, Human
aaggccuuuugcaagugggcccacaucagucaacgucagagaacuuaaacugcgaaaagacauu

SEQ ID NO: 66219 - RNA, 64 nt, Human
augacauuaaauguaguagaugcuauuagcgcuugucagagaggugguuuucuucaaucaguac

SEQ ID NO: 66220 - RNA, 64 nt, Human
guguuaugcucugaugugcuaugcuuagcuaucugucagagauuaguaaauuauaaaacucaug

SEQ ID NO: 66221 - RNA, 64 nt, Human
caacaugaaagugguguucagccuggaaugcuuugucagagauggguguggauuuagguuauac

SEQ ID NO: 66222 - RNA, 64 nt, Human
gaaaaagaucuauaaccuagguaaagcauaaucugucagagaagcgcgugagaaauuugaaaug

SEQ ID NO: 66223 - RNA, 64 nt, Human
ucuucuuuaaucaaaucacaucuuauauacagcagucagagaugaguauacuagaaucauggau

SEQ ID NO: 66224 - RNA, 64 nt, Human
auaaaauauaaaauuucuuagagaacaccucuuugucagagauaaacaagaacaaauacucuaa

SEQ ID NO: 66225 - RNA, 64 nt, Human
uuuuacacaagcauuggcuagccuuuuuaaccuggucagagaaggcagguggucacugacauuu

SEQ ID NO: 66226 - RNA, 64 nt, Human
ugucguucaugaaacagagcugcucugcuuuucugucagagauggcaagggcuuuuucagcauc

SEQ ID NO: 66227 - RNA, 64 nt, Human
cacaaaguaauuuagcuuuccauacauuuuuagagucagagauaacuuugaaauuucauaaguu

SEQ ID NO: 66228 - RNA, 64 nt, Human
gcacaggcuacucagacuuggccacaggucauaggucagagaauuuuuucuucaaauguagaaa

SEQ ID NO: 66229 - RNA, 64 nt, Human
agaagccucugccucccuagcuuuucugcuauaggucagagaugggcugaacugagccuagcua

SEQ ID NO: 66230 - RNA, 64 nt, Human
ugaaguuauuucauuucagguuauauuaucuugggucagagaaugaaugguucucaggcuuuuc

SEQ ID NO: 66231 - RNA, 64 nt, Human
ucaauguagcacaugucuguaggguuauacagaugucagagagcuaacugcucuguaaacuacu

SEQ ID NO: 66232 - RNA, 64 nt, Human
auuuuacacuacagcagcaggauggaguaguugugucagagacuauguaucccacaaagcauag

SEQ ID NO: 66233 - RNA, 64 nt, Human
ucuuggauuugcugagcaugaucccuauucugaugucagagauuagguuuaaauggaauagagc

SEQ ID NO: 66234 - RNA, 64 nt, Human
acaugcuccauuuauuuuccauggaagacacagggucagagaucugucagaggaaaauggucuc

SEQ ID NO: 66235 - RNA, 64 nt, Human
uuccaugguagcugaaugugcucagaugugagcagucagagacugacagccaugcuuuccuaua

SEQ ID NO: 66236 - RNA, 64 nt, Human
ugacaggcagccuggacauagagagggagaagaagucagagagggugacaagauagagagcuau

SEQ ID NO: 66237 - RNA, 64 nt, Human
gugacacaauaguccaccucccugcaaaggcucugucagagacucacaucuuuccugauggaua

SEQ ID NO: 66238 - RNA, 64 nt, Human
aacagauuugucagcugucagggugcagugggacgucagagacuaugugguccaucgccuucau

SEQ ID NO: 66239 - RNA, 64 nt, Human
ccugggcuggccggcgccguacugccugcguugugucagagaauaggaaaagcagcuuuguuug

SEQ ID NO: 66240 - RNA, 64 nt, Human
gcucggguuugagcagggagcaggcagagcugcagucagagacauuagaaaaccagucugaauu

SEQ ID NO: 66241 - RNA, 64 nt, Human
agaggaccggcagcaaucgauuugccaagggcaugucagagaccuuugagacauuacacaaccu

SEQ ID NO: 66242 - RNA, 64 nt, Human
uguguggacauuaugugauuuacuauauaaggaggucagagauggacuguggccaggcuuccac

SEQ ID NO: 66243 - RNA, 64 nt, Human
ucagccccacaccagcucuauuucaggggugagagucagagagcacugcaauaugugcuucaug

SEQ ID NO: 66244 - RNA, 64 nt, Human
uuucuuaaugacugaaagauaaguggguagcaccgucagagagaaaauguuggaucugcccuag

SEQ ID NO: 66245 - RNA, 64 nt, Human
cugcaaugaguuaccaucucuuaccagucacaaagucagagaugguggugaggcugcagagcaa

SEQ ID NO: 66246 - RNA, 64 nt, Human
auucuuuuaacgucaaggaaaugaauaacagcuugucagagacuuccuauggaagaaagaauuu

SEQ ID NO: 66247 - RNA, 64 nt, Human
ugugugugugugugugugugaguggaguugaggugucagagaaaaugaauuuuuuccagauuug

SEQ ID NO: 66248 - RNA, 64 nt, Human
gcugaaauauaucagcccauguuagacagaagaagucagagaagugaagagagauguguggaaa

SEQ ID NO: 66249 - RNA, 64 nt, Human
gggaaugucuaaagacccacugcucugagauguggucagagagguuucuguggacugcagauga

SEQ ID NO: 66250 - RNA, 64 nt, Human
gaacguguuagccuuaacuuugagguucuauauagucagagacuaugacaccacuaagguucag

SEQ ID NO: 66251 - RNA, 64 nt, Human
aauuguucauccuaauuguuccuguuuucaucuagucagagauucaguaagugccuuggaacaa

SEQ ID NO: 66252 - RNA, 64 nt, Human
gccuuugauugugauguaugggaaaagaacuccagucagagagcacaucuaguucaacaucaga

SEQ ID NO: 66253 - RNA, 64 nt, Human
ucuguacauggaaagagcuaauaauuaucccucugucagagaugagauuuuuaaaugcuuauga

SEQ ID NO: 66254 - RNA, 64 nt, Human
cucaccugaggaaagaggcuccagcauggggugggucagagaugugcuugcaagguccagggac

SEQ ID NO: 66255 - RNA, 64 nt, Human
cucaaacacugaccaaggaacagaggaagaugcagucagagaaagcagcaggauagagacgccg

SEQ ID NO: 66256 - RNA, 64 nt, Human
aucccaaagcaaggagaucauuuggagcucuugggucagagaaaaugagaaaggacagagccag

SEQ ID NO: 66257 - RNA, 64 nt, Human
ccaaauuugaaaggccuguacugcaauuuuauaugucagagauugccuguggcucuaauaugca

SEQ ID NO: 66258 - RNA, 64 nt, Human
cucauuuauaauaugggaauaaaaauuugugcaagucagagaagggugccuuaaaaauguugug

SEQ ID NO: 66259 - RNA, 64 nt, Human
gucuacuggcaacuaauucucuuaauuuugguuugucagagagucuuuuacuucuacuuuauuu

SEQ ID NO: 66260 - RNA, 64 nt, Human
cccgucucagcagguccacagcaccugggcagaggucagagaccaggggaggccgggccuugcc

SEQ ID NO: 66261 - RNA, 64 nt, Human
uugucagaguuuucuaccaacuggcaucugugaugucagagaucauuguaaaaauggcuuuuag

SEQ ID NO: 66262 - RNA, 64 nt, Human
cuucuccaaucacugccaaagucaagcguaacgugucagagaggaaggaucaccgaccugaaac

SEQ ID NO: 66263 - RNA, 64 nt, Human
uccauaaaggacgacaaaagaauuggacugaugggucagagaugagaaagccuccgauuucucu

SEQ ID NO: 66264 - RNA, 64 nt, Human
caccagcuucuuucucgguggcagaaauuuugaagucagagagaaacgguccuuuguuggcuuc

SEQ ID NO: 66265 - RNA, 64 nt, Human
ggccgggaagggcaguaacugcacacgcggcgcugucagagaugggggugggggaugcuucugg

SEQ ID NO: 66266 - RNA, 64 nt, Human
cugauucuaugccuguauuuccaacaaacuuacugucagagaauaugaccuaaauccauuuucu

SEQ ID NO: 66267 - RNA, 64 nt, Human
acuccuuugguauuucacugaauuucaaacauuugucagagaagaaaaacgugaggacucagga

SEQ ID NO: 66268 - RNA, 64 nt, Human
cuggauggaaggggcccuccacacuuccugggaggucagagacaaacuguuucagagagucaga

SEQ ID NO: 66269 - RNA, 64 nt, Human
ugggcucuuggccaagcggccuuggauggaugaagucagagagguggggugagggugagcuuac

SEQ ID NO: 66270 - RNA, 64 nt, Human
ccucuuuggggcagggacucuaguagaucuucuugucagagaagcugcaugguuucugcagagc

SEQ ID NO: 66271 - RNA, 64 nt, Human
cccagcccagccugcucugcggcccccugcggcugucagagagcggugagaccuggagcgaggu

SEQ ID NO: 66272 - RNA, 64 nt, Human
auauuaacaaagucaccuaguuauacaaacaauugucagagaauucuggauuuggaggguauug

SEQ ID NO: 66273 - RNA, 64 nt, Human
gagccugcagcugagucugugcccgagacaggcugucagagauuccagaagccucuccuccccg

SEQ ID NO: 66274 - RNA, 64 nt, Human
acucuggaauucucuauucuccuggucggggacagucagagaugaugggggagaugaccggugg

SEQ ID NO: 66275 - RNA, 64 nt, Human
aauguucaguguuuuguguuuccccacacgauuugucagagagaaaugaaagcaagccugaaac

SEQ ID NO: 66276 - RNA, 64 nt, Human
caucucuguuauaaauggagcuucagcccucugggucagagacugacaacccuccuucuucuuc

SEQ ID NO: 66277 - RNA, 64 nt, Human
caggcccagugaaauggaccugacagcccaaacugucagagaggaggaaagcaggcauuugauu

SEQ ID NO: 66278 - RNA, 64 nt, Human
aguaauuacaggagggaguuguaggagcuuugaagucagagagggagguagaggccuuuuuacc

SEQ ID NO: 66279 - RNA, 64 nt, Human
uaaaagaucuugaaaagguaguuguuacuucguugucagagaaaaacacuugcccuuuuuccug

SEQ ID NO: 66280 - RNA, 64 nt, Human
gagggcauuguguauccguaauaauguccuugaagucagagacuggaaauguugaucucuuagu

SEQ ID NO: 66281 - RNA, 64 nt, Human
guguuaugauaucuuccaguuuuugcuuucauaggucagagaucuaucuugugugugcguuaga

SEQ ID NO: 66282 - RNA, 64 nt, Human
ugcuguggcucaacaaugccuuccaggauguggagucagagaacgucaacguggugaagcggcu

SEQ ID NO: 66283 - RNA, 64 nt, Human
uauccacaaaaaaggggaacagggaugauuccuagucagagauugggagaaauacaagaugagc

SEQ ID NO: 66284 - RNA, 64 nt, Human
agguuuaccagaucuggaacauuacuuauuugaggucagagaacaaaacaagaaccuggccagg

SEQ ID NO: 66285 - RNA, 64 nt, Human
uuuaauuucuuugcagacaaggucuagaugcggagucagagaugggacugaauggggagggauc

SEQ ID NO: 66286 - RNA, 64 nt, Human
ggcccaggcuagcuuccagaaagcaccccaggaugucagagaaauugggacaguaacauaucuu

SEQ ID NO: 66287 - RNA, 64 nt, Human
cacuccauccccgcuaccguccuggccagcuaccgucagagagaaccagagcuccaagucuuua

SEQ ID NO: 66288 - RNA, 64 nt, Human
cagagcucuugucucagagauguguguucuuuuugucagagauaugguugaugagaaucuuaaa

SEQ ID NO: 66289 - RNA, 64 nt, Human
ggagcaggcagccacacacgggccuugcaaccuugucagagaaaaggcgaacagggcccucacc

SEQ ID NO: 66290 - RNA, 64 nt, Human
ggugguagcuccagaggcaggcagaggaaauauugucagagacuggugggaggaagccugggga

SEQ ID NO: 66291 - RNA, 64 nt, Human
uuucuuuaaagucaaaucucaccuaccuguuugggucagagagauguguuuuaaaagcccccaa

SEQ ID NO: 66292 - RNA, 64 nt, Human
gcuuccaaggaggccuuggcaucuugcaguugcugucagagaugggcucauaucugcuugggga

SEQ ID NO: 66293 - RNA, 64 nt, Human
ucuugucuugcauaguuaagccggacauuuuucugucagagaaaaggcaucauuguccgcucca

SEQ ID NO: 66294 - RNA, 64 nt, Human
uguuaugaacaccaaauuuaaagauuuuuaacaugucagagagaagagaguuaaaauuuaaaaa

SEQ ID NO: 66295 - RNA, 64 nt, Human
acaggcggcugaaagccagcagcacgaacugcccgucagagaagugcacagccugggccagaua

SEQ ID NO: 66296 - RNA, 64 nt, Human
gcugggagcaaaaacuagaaugauacaaagaaaggucagagaaaugcaugggaauauuuuuucc

SEQ ID NO: 66297 - RNA, 64 nt, Human
guuccucuuuugauaaggcuguuaacauuacaaggucagagagaggaauggaaucgacaguaua

SEQ ID NO: 66298 - RNA, 64 nt, Human
ccaaaauuuuaaaaaacugguauuuuguaaaugugucagagacacaugggacagaacccuacuu

SEQ ID NO: 66299 - RNA, 64 nt, Human
cacagaccaccccggaggacacguggaugauggggucagagaucacugagcugccccucaaggg

SEQ ID NO: 66300 - RNA, 64 nt, Human
ccugauuagauccagucaauguuuuaaagguauugucagagaaaaacagagggucuguacuagc

SEQ ID NO: 66301 - RNA, 64 nt, Human
uucaguccaucacaguucaucuucuaacccaagagucagagauggggcuggucauguuccuuug

SEQ ID NO: 66302 - RNA, 64 nt, Human
guuggguccugcccgccaauaaucacccccacgggucagagacaggcuccuugccggggucugg

SEQ ID NO: 66303 - RNA, 64 nt, Human
augccguguggcucuuaugugcccaggugguguggucagagaguggaugggcuuccucccgccc

SEQ ID NO: 66304 - RNA, 64 nt, Human
cuccugccuuuuuauuuucuuggguuauuuacaugucagagacauuuauaaaaagugaaaggau

SEQ ID NO: 66305 - RNA, 64 nt, Human
uuuuaagaaguuguaacuuuuugugucuugucaugucagagaauaaauaaauauucuaaguaga

SEQ ID NO: 66306 - RNA, 64 nt, Human
ccacggaaaccauguucuugcuuaagccauuaaagucagagaugaauucuggagugcagcugag

SEQ ID NO: 66307 - RNA, 64 nt, Human
cccgucucauuccuccaccugccguggacuuggggucagagacugcuguguuugagcucugcag

SEQ ID NO: 66308 - RNA, 64 nt, Human
cccuugcccaugguggggaggacaucuggucugagucagagaucugugcacacuuucuaaacag

SEQ ID NO: 66309 - RNA, 64 nt, Human
ccucgugccaccucaugcuuauaauaaagccggcgucagagaccgcugcuucccucaccugccu

SEQ ID NO: 66310 - RNA, 64 nt, Human
cgauggcucaugucacaggccuaccugauacggugucagagaaagugguggggaaaggaucugg

SEQ ID NO: 66311 - RNA, 64 nt, Human
uguccugauguuuuucuguguuacuuauauuagagucagagaucuugguaugggcuguucuguu

SEQ ID NO: 66312 - RNA, 64 nt, Human
auauagacauauauccucuuuuuguucuuucucugucagagaagccacugcaagaugcugccga

SEQ ID NO: 66313 - RNA, 64 nt, Human
gggcugguuucugcccuuuaagagcacccggucagucagagaacagagaucacacacaccaaac

SEQ ID NO: 66314 - RNA, 64 nt, Human
gauggaggucuacccuggacacuaagccaagugugucagagacagaagggagcuggggauuggc

SEQ ID NO: 66315 - RNA, 64 nt, Human
gcuuccuggaggcuucccagggccuuggggaagggucagagaugccagcccccugggaccuccc

SEQ ID NO: 66316 - RNA, 64 nt, Human
cacuuucuguuugaaccccugucaugaucacagugucagagacgcguccucuuucuuggggaag

SEQ ID NO: 66317 - RNA, 64 nt, Human
acuccaggagcagggaucuugagucaaugcaucagucagagaagaacucucauggcugcuggag

SEQ ID NO: 66318 - RNA, 64 nt, Human
auagaugaugcugaaugggggaggggggcagcacgucagagaauuuacuauuaaucccagaguu

SEQ ID NO: 66319 - RNA, 64 nt, Human
ugggaagggagagcggggcagucucggguggcuagucagagagaguguuuggggguuccgugau

SEQ ID NO: 66320 - RNA, 64 nt, Human
augaauacauggguuucagcaaugccacauuccagucagagaaggaaacaggggaucggaauua

SEQ ID NO: 66321 - RNA, 64 nt, Human
uagauuuugaaauguuuuuuuaaugaaaaugaaggucagagagaauaauugcccugaccacauu

SEQ ID NO: 66322 - RNA, 64 nt, Human
uuaaugugcuuaccacacugccacauuuuaaugagucagagaaaaauuaauuuuucuucaauac

SEQ ID NO: 66323 - RNA, 64 nt, Human
ucuauauuuguggauuuuauauguaaucaccuaugucagagaaagaaaaccuuucaaccaaaug

SEQ ID NO: 66324 - RNA, 64 nt, Human
cuccuguaugcauuguauauugcaauuuauuacugucagagauuuguagacaguuucuuauuuu

SEQ ID NO: 66325 - RNA, 64 nt, Human
uugcuacucaacuuugaggaaagacagggccuuggucagagagagaaugcucugaacucugcua

SEQ ID NO: 66326 - RNA, 64 nt, Human
gugaauaacagguggcuuuucauggaugucucuagucagagaaaaaugauaaaggcuuaaauug

SEQ ID NO: 66327 - RNA, 64 nt, Human
ccaucuccuuaagguuucacccaaagcccccagugucagagacuugggaugggaagaacagucg

SEQ ID NO: 66328 - RNA, 64 nt, Human
uuuaccucacacccaaagcauuuugccuaccugggucagagagaggaguccuuuuugucaugcc

SEQ ID NO: 66329 - RNA, 64 nt, Human
uucaguuuguugcacccaguguuaacacaucuuugucagagaagacuggcgucagcagccaaaa

SEQ ID NO: 66330 - RNA, 64 nt, Human
auguguguuuauuguuccuaagaauuuggcacaagucagagauaauugccuauacuaagaaucu

SEQ ID NO: 66331 - RNA, 64 nt, Human
uuaauaaauuaucaauuuguaauucagcauguuggucagagacacggucacugauucacaccca

SEQ ID NO: 66332 - RNA, 64 nt, Human
aucuuucuaacauuaagcuaccaagauccugaaugucagagauguacucagaggguuaacagac

SEQ ID NO: 66333 - RNA, 64 nt, Human
guuuugauaaaagauuuuccuauuccuugguucugucagagaaccuaauaagugcuacuuugcc

SEQ ID NO: 66334 - RNA, 64 nt, Human
aggagaggggguacagacuuccuucuuagagagugucagagaauaugcucccaaugguggaaag

SEQ ID NO: 66335 - RNA, 64 nt, Human
agaucugucuggcuuuaucaccaggaugucacaugucagagaguaucauuaaaagaagacgcuc

SEQ ID NO: 66336 - RNA, 64 nt, Human
aaguaugaaguuuugcagaaauugacugugaaaugucagagaaaaauaaaagucacuuacuuga

SEQ ID NO: 66337 - RNA, 64 nt, Human
aucuuauguuagcaggacaacccaugaaaaacaagucagagagugaaggcuuuuuccccuaauc

SEQ ID NO: 66338 - RNA, 64 nt, Human
caaguccucgcugagcagagagggagccguucaugucagagacucacugccagaaaagccuuac

SEQ ID NO: 66339 - RNA, 64 nt, Human
gaauuauuuauccuucaacaagauaaauauugcugucagagaagguuuucauuuucauuuuuaa

SEQ ID NO: 66340 - RNA, 64 nt, Human
ggccuuuucuuucuucuuuucucuuugggugauagucagagagugguguuuuuguucagguggg

SEQ ID NO: 66341 - RNA, 64 nt, Human
aaacuuuacgacaaaaugucucuggacaaagagagucagagaagagaagcaaaaggacacuaau

SEQ ID NO: 66342 - RNA, 64 nt, Human
ucuugggggacucacucacuggugccaguucuaagucagagacaaaauuccacugucuguuccu

SEQ ID NO: 66343 - RNA, 64 nt, Human
aggcuccaccaggccuuggaugcccucuaguugagucagagacccuggaaacacacugagaucu

SEQ ID NO: 66344 - RNA, 64 nt, Human
gucgagucccaauucuuggcuuaagccuguuuuagucagagaccacccaacuuagcgugcaggu

SEQ ID NO: 66345 - RNA, 64 nt, Human
uguacaguaauucacucccccauuucacaucuuugucagagaauaguucuuguucauacugagu

SEQ ID NO: 66346 - RNA, 64 nt, Human
ucugagcaguggacucaaaagcauuuucaggcaugucagagaagggaggacucacuagaauuag

SEQ ID NO: 66347 - RNA, 64 nt, Human
uuuauuuauuauaugugcacuucaagaagucacugucagagaaauaaagaauugucuuaaaugu

SEQ ID NO: 66348 - RNA, 64 nt, Human
cgaaaaccauguauaaaaugggccuaucacccuugucagagauauaaauuaccacauuugccuu

SEQ ID NO: 66349 - RNA, 64 nt, Human
uguuugauauauuuguuuaaacucuuuguauaaugucagagacucauguuuaauacauagguga

SEQ ID NO: 66350 - RNA, 64 nt, Human
aaaggcauuggaucuaucuuggauaucauacauggucagagaagccuuuaggagaagaaucaga

SEQ ID NO: 66351 - RNA, 64 nt, Human
gaguccgaggagacugcugggagccgccgugugggucagagauggagaaggcugagugcagcaa

SEQ ID NO: 66352 - RNA, 64 nt, Human
cacagcacacguucuguaggagaugcgccuugaagucagagaagugucccguggacaacgucaa

SEQ ID NO: 66353 - RNA, 64 nt, Human
auagccugaagacagaggauaaauaguugucaaugucagagacagugcuauuaauguauaugug

SEQ ID NO: 66354 - RNA, 64 nt, Human
auugaagggaggucaaguuguuugucaaugauuugucagagaaccuguugaaaugugaauuaag

SEQ ID NO: 66355 - RNA, 64 nt, Human
gcgugcgucugugugugccugugugcgagucugagucagagauuuggagaugucucuguguguu

SEQ ID NO: 66356 - RNA, 64 nt, Human
aggaaguauuuaauaaaaaaugaagucuaaaugugucagagaauuuaugugagaaaggacuaaa

SEQ ID NO: 66357 - RNA, 64 nt, Human
cucuuccagcucccuggggguugaccaggagccggucagagauggaccuggccagaugucugac

SEQ ID NO: 66358 - RNA, 64 nt, Human
ccccgccccaauugccuugagaucucugcucuuugucagagauuugcaaagacucacguuuuug

SEQ ID NO: 66359 - RNA, 64 nt, Human
gugcauuuggcaaaugcuuacuuugcuucccagagucagagaauuggcaaagguuccuaaaugg

SEQ ID NO: 66360 - RNA, 64 nt, Human
cauccucccggccugccugagcccugaugcugcugucagagaaggacacugcguccccacggcc

SEQ ID NO: 66361 - RNA, 64 nt, Human
gucaggggcguuugcgccaccugcaagggcgugggucagagaguuuuuaugggggucuguuguu

SEQ ID NO: 66362 - RNA, 64 nt, Human
caguaccaaauggugcuucagcucuaacauggaggucagagaaagggacuuggaccaauaaaau

SEQ ID NO: 66363 - RNA, 64 nt, Human
gcugagacccuuagaucuuugggccuaggagggagucagagagggggaugucugaagauggucc

SEQ ID NO: 66364 - RNA, 64 nt, Human
guaauaccugauugaucacacaguguuagugcuggucagagagaccucauccugcucuuuugug

SEQ ID NO: 66365 - RNA, 64 nt, Human
ccagcacgccucaagguagauggaauccccacuggucagagaaaaagcuaugcggacacuccag

SEQ ID NO: 66366 - RNA, 64 nt, Human
gcaggagaagcaaacacccagaacucuuuugcuggucagagauucccugagugucuguccucac

SEQ ID NO: 66367 - RNA, 64 nt, Human
gcauugaaucucuaaaaugcuguucucaaucauugucagagauguuuucaaguugcagucagaa

SEQ ID NO: 66368 - RNA, 64 nt, Human
uggaaaagugagcucuggguucugcucugagauggucagagaagaugcgggccaggagacuuac

SEQ ID NO: 66369 - RNA, 64 nt, Human
uugggagcuccugaagaaauggcucagauauugagucagagaaauaaaaaguaggaucaguuag

SEQ ID NO: 66370 - RNA, 64 nt, Human
ccucguuuuaucauucccaguccauugucaucacgucagagaaaaaucuucaggggugcuaauc

SEQ ID NO: 66371 - RNA, 64 nt, Human
auguaaauucauguguuuccacuucucagauauagucagagaauuauucauuugcccaaaagga

SEQ ID NO: 66372 - RNA, 64 nt, Human
gcaccagcugucccaccuccaggguccugaccaggucagagauguccccugccaugcagagcag

SEQ ID NO: 66373 - RNA, 64 nt, Human
gauaugagggcugaggaggacucaaaccguugcagucagagagacaccuauuuuggugaauauu

SEQ ID NO: 66374 - RNA, 64 nt, Human
cuguuuauaugugcagggcccgggcgggugaagggucagagagacggacacaaggagccggcag

SEQ ID NO: 66375 - RNA, 64 nt, Human
aagcugagaccucauaugacguggccuucguguugucagagagugucuggaagcugcuguugcc

SEQ ID NO: 66376 - RNA, 64 nt, Human
gagucaggccucagguggagagccgcaugucacugucagagaugagcccacccccacccuuccc

SEQ ID NO: 66377 - RNA, 64 nt, Human
acgcgaggggaaaggccuguggggagccgagggcgucagagagacccgggaaggaaggcucucg

SEQ ID NO: 66378 - RNA, 64 nt, Human
ggccagcuuuuguacugaaggcaagaacuggacagucagagaacaguggagggggcaagugacu

SEQ ID NO: 66379 - RNA, 64 nt, Human
uuacaguauucaauuuauugcaguuauagaauuggucagagagcauuuucauagugugcucauu

SEQ ID NO: 66380 - RNA, 64 nt, Human
ugugaaacuggcuuuauagaguuaacaaaacagagucagagaccacugucuuaacaguggaaga

SEQ ID NO: 66381 - RNA, 64 nt, Human
ucuaucauauugacaugaaaauugaaaauguauagucagagaaauuuucaugaauuauuccaug

SEQ ID NO: 66382 - RNA, 64 nt, Human
aggagcucagcaggcagacgaaugaggaauaaaggucagagaaggucagagcugagugacguuu

SEQ ID NO: 66383 - RNA, 64 nt, Human
aguauuuaaaauggaugcagcccuaacugcaaaagucagagaggcugacaaggaccaaugcuuc

SEQ ID NO: 66384 - RNA, 64 nt, Human
ccuuaucauuguaaucaaugugggaaagcuuucagucagagacaaaaucuucuugagcaugaaa

SEQ ID NO: 66385 - RNA, 64 nt, Human
ggcaggacccgagccagcgguggggagagauauagucagagaacccagcaauacagauccgucc

SEQ ID NO: 66386 - RNA, 64 nt, Human
aaagacuggagaaucugggggacugggagugggggucagagaggcagauuccuuccccucccgu

SEQ ID NO: 66387 - RNA, 64 nt, Human
aaaaccugaaagcaagcaacaaaacauacacuuugucagagaagaaaaaaaugccuuaacuaua

SEQ ID NO: 66388 - RNA, 64 nt, Human
uugcauauguugauuaacuuaauauggacuuacagucagagaugaccuuaaauaugauggagua

SEQ ID NO: 66389 - RNA, 64 nt, Human
acagcacuuuuaacaccuuucuaaccuucuuaacgucagagaauuuuuguagaaauguaguccu

SEQ ID NO: 66390 - RNA, 64 nt, Human
augugcaccuccccgaggugcagcugccgaaagugucagagauucggcugccggaaaugcaagu

SEQ ID NO: 66391 - RNA, 64 nt, Human
aggugcggcuuccagagguacagcugccgaaagugucagagaugaaacucccagaggugucaga

SEQ ID NO: 66392 - RNA, 64 nt, Human
aggugcggcuuccagagguagagcugcccaaagugucagagaugaaacucccaaaggugccaga

SEQ ID NO: 66393 - RNA, 64 nt, Human
agguucgacucccagagguggagcuccccaaggugucagagaugaaacucccaaaggugccaga

SEQ ID NO: 66394 - RNA, 64 nt, Human
uguuuauuuagugaucaguuacuucauguuuugugucagagaaaacauguacaaaacauuugag

SEQ ID NO: 66395 - RNA, 64 nt, Human
aacuuuugcaguuagaauucauuccuuugacaacgucagagaauuuaugccugagagauuccuu

SEQ ID NO: 66396 - RNA, 64 nt, Human
aagcaacuuaaaggagggccugcaagcagccagggucagagacagggcuugguucugcuuccug

SEQ ID NO: 66397 - RNA, 64 nt, Human
accacagaugauaggaccagcccaaugagccacagucagagaguagauugugcaugugugagca

SEQ ID NO: 66398 - RNA, 64 nt, Human
gugaggauccauucagccugcccagcucuggcuggucagagacaaggcagaacuuuuggaaaaa

SEQ ID NO: 66399 - RNA, 64 nt, Human
agaccucucuggagacccagauccccuagagcaggucagagaccauccagaaucccagaauucu

SEQ ID NO: 66400 - RNA, 64 nt, Human
uguuaguguuuaugauguuuuuaucauaaaggaugucagagaaacuuuaugcauauuaaaaaug

SEQ ID NO: 66401 - RNA, 64 nt, Human
gcuguugacauacucauugccuacuuuaacaccugucagagaaacgugauaugggguaaggagg

SEQ ID NO: 66402 - RNA, 64 nt, Human
aucuuaucccuuuucucuguaugcaguuggacucgucagagauaguaaaaucaucuuuuagugu

SEQ ID NO: 66403 - RNA, 64 nt, Human
cuucugcaaugugugaucacagcuagaaggcacugucagagaagagaaacugguccucaccaga

SEQ ID NO: 66404 - RNA, 64 nt, Human
ugugcugggacgcuguacagagaccagcucagucgucagagaaaccaugaggugguguccugca

SEQ ID NO: 66405 - RNA, 64 nt, Human
gcaccaguuguuuuaccccugccgauaaccagcagucagagauucuuuuuuaauccuuggagac

SEQ ID NO: 66406 - RNA, 64 nt, Human
uugugguuccuuuaaacacacucacacacacuuggucagagaugcugugcuucuuggaagcaag

SEQ ID NO: 66407 - RNA, 64 nt, Human
caagaauacucauuuugacauaauagguccucuugucagagauccucuaccacagacauuaaua

SEQ ID NO: 66408 - RNA, 64 nt, Human
gaagaggacacgguauccccucuggccagaguaugucagagaaggaagaguagggcuuuuuugu

SEQ ID NO: 66409 - RNA, 64 nt, Human
caccuccccgcguggguaaccaaauuuuuaaguagucagagacauaucgagguaguuacauaaa

SEQ ID NO: 66410 - RNA, 64 nt, Human
uuauaaaaauuauaaaaugaucucuguuuuuccugucagagauuuaaaaaacugaaaagguaua

SEQ ID NO: 66411 - RNA, 64 nt, Human
cuaugugguugagcucaggccucucgugccuggugucagagaaggcagagcccacaguaggugc

SEQ ID NO: 66412 - RNA, 64 nt, Human
aagccgaggugcuggcacugaagauggcugaggagucagagaggaggugagggggcaccgggca

SEQ ID NO: 66413 - RNA, 64 nt, Human
ugcuuuggaagggaagggaggugggcagcagugggucagagauagaccuuuguucucuuauuuc

SEQ ID NO: 66414 - RNA, 64 nt, Human
ggugguggaaggagcacugggcuaggggucaggggucagagauucuguccugcuccugggaugc

SEQ ID NO: 66415 - RNA, 64 nt, Human
ugucccugcagccaggguguccgggggcuggccagucagagaaagggggccauggacugcugug

SEQ ID NO: 66416 - RNA, 64 nt, Human
aagugucauccuaaguaccuugaaaugagaccacgucagagacauguacugccccucacauuuu

SEQ ID NO: 66417 - RNA, 64 nt, Human
cauggccaagugaacuguggcagguccagaaccagucagagacuugccccuaagagggauguac

SEQ ID NO: 66418 - RNA, 64 nt, Human
ucggcugcugaugucuagaugaguccccuguagggucagagacaaugucaaacuguguaaguga

SEQ ID NO: 66419 - RNA, 64 nt, Human
cuucccuuggauggagcugcccugcuggugccuggucagagaagaggccucugugcccagccug

SEQ ID NO: 66420 - RNA, 64 nt, Human
cucacagaagauugagaaagugccugaugcccgcgucagagaccagaggagccaacugagauga

SEQ ID NO: 66421 - RNA, 64 nt, Human
gugcuggggguggagggguauaagaggagggagagucagagagaguguguauggguguguguga

SEQ ID NO: 66422 - RNA, 64 nt, Human
aagcgagccuaugcugcagggucacuuuuggcuggucagagaaggaauaaugauaucaccuucu

SEQ ID NO: 66423 - RNA, 64 nt, Human
auucccuugugagugccugguagcuaauacacuggucagagaucugguacuuguaagacuauuu

SEQ ID NO: 66424 - RNA, 64 nt, Human
aauucccuaacuguggaguuuuaggaagucaguugucagagacagguggggaggguggggguag

SEQ ID NO: 66425 - RNA, 64 nt, Human
gaggcaacagauagaguguccuugguaauaagaagucagagauuuacaauaugacuuuaacauu

SEQ ID NO: 66426 - RNA, 64 nt, Human
gcacagcugauaccaggagggaacauccugaagugucagagaaaaguaaggcauauggcucaca

SEQ ID NO: 66427 - RNA, 64 nt, Human
agcauuugacgccuagaacuaugaccaccucauggucagagaugagaauguagccuuugugacc

SEQ ID NO: 66428 - RNA, 64 nt, Human
cgggugugagaauucagagauucuggccuccagcugucaccacaccguaacggggccauguaac

SEQ ID NO: 66429 - RNA, 64 nt, Human
uccccaucaugaccaccucugaugucugugcugcugucaccaggcaccuuuguuuuucaagaca

SEQ ID NO: 66430 - RNA, 64 nt, Human
gggauuguuacugguugaagugggggcagaugccugucaccaagguguugacugugugagaaaa

SEQ ID NO: 66431 - RNA, 64 nt, Human
cccgccauccuuccccaagugacguccacugccuugucaccagcgaccugccugucaugcccac

SEQ ID NO: 66432 - RNA, 64 nt, Human
caucacauuaaugaaugacgagauuggaguacacugucaccaagggcaggcaaagaugcccucu

SEQ ID NO: 66433 - RNA, 64 nt, Human
ccuccuggcuguugcgacgcgggcuucuggagcuugucaccauuggacagucucccugauggac

SEQ ID NO: 66434 - RNA, 64 nt, Human
cuuccugccagugccuccccguaccccaaaacaaugucaccaugguuaccaccuacccagaaga

SEQ ID NO: 66435 - RNA, 64 nt, Human
uuauacuuuuuuuuuuugaaacggagucucacucugucaccaggcuggagugcagugccgcaau

SEQ ID NO: 66436 - RNA, 64 nt, Human
cguucaucgggggccuaaacguuucccucagcucugucaccaacucacuucucucggcuucguu

SEQ ID NO: 66437 - RNA, 64 nt, Human
ugagggaugcugaaucucccagagagcucacacuggccaggaaugcugagaguagcagaugcuu

SEQ ID NO: 66438 - RNA, 64 nt, Human
aauacaaaaugauggccauucaugugcagcucuuugucaccaugggccggaugaguugugcucc

SEQ ID NO: 66439 - RNA, 64 nt, Human
uucagaaaacagucugucagacaaaaaggccuuaugucaccacugguaccucaguuuccucauc

SEQ ID NO: 66440 - RNA, 64 nt, Human
gccucuuauguuuggaggggaaggguguugagauugucaccauccuucaagcugagacuccugg

SEQ ID NO: 66441 - RNA, 64 nt, Human
agaucugguuucuaagaguuuuggggggcggggcugucaccacgugcaguaucucaagauauuc

SEQ ID NO: 66442 - RNA, 64 nt, Human
ugggacuuccuuccucuguccggagaggcacaggugucaccaguuccagccaaaggcuccucac

SEQ ID NO: 66443 - RNA, 64 nt, Human
cgguguucaaugucaucaauggcaguucucaugcugucaccaagcuggccaugcaggaguucau

SEQ ID NO: 66444 - RNA, 64 nt, Human
augucucuuacguaacauacucuaagaaugaaacugucaccacagguaaauccuuguuagcaag

SEQ ID NO: 66445 - RNA, 64 nt, Human
ucauuaacauacauaugauacggagucucuuuguugucaccaagugaacauacuucucauggug

SEQ ID NO: 66446 - RNA, 64 nt, Human
cucagccucccgaguagcugggauuacaggcgugugucaccacgccuggcuaauuuuuuuguau

SEQ ID NO: 66447 - RNA, 64 nt, Human
ucuugaagcugggcugucucucuccauguuggccugucaccagacccgagucaauuaaacagcu

SEQ ID NO: 66448 - RNA, 64 nt, Human
cucagccuccagaguagcugggacuacaaacgugugucaccaggcccagcuaauuuuuguauuu

SEQ ID NO: 66449 - RNA, 64 nt, Human
aagcucaaccacaugcuauuuaguuagcaucaguugucaccaacagucuuucugcaaagggcag

SEQ ID NO: 66450 - RNA, 64 nt, Human
uagccucucuugucauucuuuguugccccuuuucugucaccagccaaccacauagccuugggac

SEQ ID NO: 66451 - RNA, 57 nt, Human
uggagaacacaguugucuaaggcugccugucaccacuguggccucuccaagcguccu

SEQ ID NO: 66452 - RNA, 64 nt, Human
aauguaguugcuagaccacuuuacaaauuguucuugucaccagauguguucagacauugcugug

SEQ ID NO: 66453 - RNA, 64 nt, Human
cauucaugauggcuuuguuuugguuuggggcagcugucaccagcuaaagcaauguuguuaaaau

SEQ ID NO: 66454 - RNA, 64 nt, Human
aauccugucggucuccaguugguuaucugaauagugucaccaauuccaccaagacagugcugag

SEQ ID NO: 66455 - RNA, 64 nt, Human
aaaaaaaaaauacaagaugcugcuuuauuaugucugucaccaugaaaacuuagcugcaucuuuu

SEQ ID NO: 66456 - RNA, 64 nt, Human
gauggcuauggagagggcuugaaauguguacaggugucaccaucauuucuaguauauuaggaaa

SEQ ID NO: 66457 - RNA, 64 nt, Human
ucauccacauacccugaccuggcccccucaguguugucaccagaucugauuuguaacccacuga

SEQ ID NO: 66458 - RNA, 64 nt, Human
caagaaucuaagucaucccugacuccagugucuuugucaccaggcccuuuggacucuaccucag

SEQ ID NO: 66459 - RNA, 64 nt, Human
uguuuuguuuuguuuggagacagagucucgcuauugucaccagggcuggaaugauuucagcuca

SEQ ID NO: 66460 - RNA, 64 nt, Human
guuuauuauauaaccaagguuucagguauccuccugucaccaccucuacuauucaggaggccua

SEQ ID NO: 66461 - RNA, 64 nt, Human
ccuggacuuacccaaacugugauacuaccauaauugucaccauaaucagucaaauaaagugauc

SEQ ID NO: 66462 - RNA, 64 nt, Human
auuuaggucauuucccacacugucuuagagaacuugucaccagaaaccacauguauuugcaugu

SEQ ID NO: 66463 - RNA, 64 nt, Human
aaagaaauacuauaauauuucuagaaucuggaacugucaccaugaugaauggcccuuucaaugc

SEQ ID NO: 66464 - RNA, 64 nt, Human
uaacguuuucaaggaaauucuaggcaaucauuccugucaccaaagaacuaaaauuuugguugac

SEQ ID NO: 66465 - RNA, 64 nt, Human
agcccauucuuccuugucagucuuggcccaaagaugucaccauuccuaguuauuugucaccaca

SEQ ID NO: 66466 - RNA, 64 nt, Human
ucuuggcccaaagaugucaccauuccuaguuauuugucaccacauaauugguguugauuggaaa

SEQ ID NO: 66467 - RNA, 64 nt, Human
gggagauccuggaaaagaucccuucaguuuggggugucaccaagacuucuacacaacccaggac

SEQ ID NO: 66468 - RNA, 64 nt, Human
cuaaggguuuuacaggaaguagauuaauugauccugucaccaaccauaugaaguaggcacuguu

SEQ ID NO: 66469 - RNA, 64 nt, Human
gacagagcaggucugcaggccaccagcugcuggaugucaccaagaaggggcucgagugccccug

SEQ ID NO: 66470 - RNA, 64 nt, Human
uccagcuucuacugcaaggggacacacggcaucaugucaccacuggccaaaaagaagcuccugg

SEQ ID NO: 66471 - RNA, 64 nt, Human
guaguacaaacaaucucugugaugauuaacaguaugucaccacuucauuuuuuaaaaaggauca

SEQ ID NO: 66472 - RNA, 64 nt, Human
uacauuguuauuaaauuuuuuuaacacaaguaagugucaccauuuuaugacaugaaauaaaagg

SEQ ID NO: 66473 - RNA, 64 nt, Human
cccaguucuaagagauacgaucuguaagucccuaugucaccacauugcuugagaugaucauuca

SEQ ID NO: 66474 - RNA, 64 nt, Human
uucaguauuauucgauuuuuaauuauugaaaguaugucaccauugaccacauguaacuaacaau

SEQ ID NO: 66475 - RNA, 64 nt, Human
guacuugauggggaagaugaauauuacaaaucucugucaccaguggacuguaucccugaggaga

SEQ ID NO: 66476 - RNA, 64 nt, Human
guccccaucugcccuucuuguugcuccugucaugugucaccaucuucccuccugucugccuucu

SEQ ID NO: 66477 - RNA, 64 nt, Human
gguugccccugguugcaucccagaagcaucugacugucaccacugccaguggcuguggaacagu

SEQ ID NO: 66478 - RNA, 64 nt, Human
uuguauuucuuggguaaggacaggccagaaugagugucaccaguggguaauugaaucaacuucu

SEQ ID NO: 66479 - RNA, 64 nt, Human
gggaaaggagaagagaaguugucucugaguccccugucaccaguuggauucauuucuuggaaga

SEQ ID NO: 66480 - RNA, 64 nt, Human
gaggaucccggaucaucagcacaauugugaaacuugucaccacacaauaaaaagcagucuuaga

SEQ ID NO: 66481 - RNA, 64 nt, Human
ucagaaugcaaccaaaaucagcugaguugaaguuugucaccaagaacgauggauauguacacau

SEQ ID NO: 66482 - RNA, 64 nt, Human
acagaaguaacgaagcuaagaauaugagagugcuugucaccagcacaccuguuuuuuuucuuuu

SEQ ID NO: 66483 - RNA, 64 nt, Human
cucagccuccuuaguagcugggaccacagacaucugucaccacacccagcuaacuuuuuguauu

SEQ ID NO: 66484 - RNA, 64 nt, Human
gauccaggggaccugguuccaaucucagcccugcugucaccaccuugucaugcaccaucaagca

SEQ ID NO: 66485 - RNA, 64 nt, Human
cauguagcuaaguauuauccugcuuccagaccuaugucaccaguaccaaucagucagugucauc

SEQ ID NO: 66486 - RNA, 64 nt, Human
ugacuuuccauuguuaucaugguguauauauuuuugucaccauucccacaaguauacuugaugu

SEQ ID NO: 66487 - RNA, 64 nt, Human
cucagccucccaaguaacugggauuacaggcaugugucaccaugcccagcuaauuuuuuuguau

SEQ ID NO: 66488 - RNA, 64 nt, Human
gugggccagggaggaaaaccagagcacacaguuuugucaccauggaacaccccaaaugccauuc

SEQ ID NO: 66489 - RNA, 64 nt, Human
augccaucaaaugcccaggaaauugacuuugcagugucaccacugguguaagcuacuauauaug

SEQ ID NO: 66490 - RNA, 64 nt, Human
gcuuucuuuacaguaucagaguccaagaacaggaugucaccauagauaaaagccucauacaaag

SEQ ID NO: 66491 - RNA, 64 nt, Human
ugagacuuucaguccuaauuugaggggaaauuacugucaccacuaguuuuaauauaguacaaug

SEQ ID NO: 66492 - RNA, 64 nt, Human
gccaccacuagagcugagagucugaaagacagaaugucaccaguccugcccaaugccuugacaa

SEQ ID NO: 66493 - RNA, 64 nt, Human
cagagcauuaaguuguaacugagauugcaauaccugucaccaugcagccgcugauaguucucug

SEQ ID NO: 66494 - RNA, 64 nt, Human
aacaacaacaaaaaacaaccauuugaaaaauuuuugucaccagcaaaacuuuucacuaauuagu

SEQ ID NO: 66495 - RNA, 64 nt, Human
ggcuacccaaccuuugccgcugccuguucccacgugucaccagcacgcugcacuccagaugaaa

SEQ ID NO: 66496 - RNA, 64 nt, Human
gugguagaccuggaucaggggagaaauggccagcugucaccagaccuggggcagcucuccugac

SEQ ID NO: 66497 - RNA, 64 nt, Human
aacacuaaaguuuagaaagauaucaucaacguucugucaccagucucugaugccacuauguucu

SEQ ID NO: 66498 - RNA, 64 nt, Human
uguaucagaguuuggauacuaguguuagugguggugucaccacuacuuaauugggagauaauga

SEQ ID NO: 66499 - RNA, 64 nt, Human
caaggugggauuggccuuccuuaggcuggcuacuugucaccaucaccgacaucacuguugccug

SEQ ID NO: 66500 - RNA, 64 nt, Human
augccuuguuuuugauaccuccuggcagcuuccaugucaccacuuguucauaccugcccagagc

SEQ ID NO: 66501 - RNA, 64 nt, Human
gaacuaugagucuccugcauggcaacaaaaugugugucaccaucaggccaacaggccagcccuu

SEQ ID NO: 66502 - RNA, 64 nt, Human
gcaaagcaagugaugaagcagaguggauguccacugucaccaagcuggauggcaagcugcggcc

SEQ ID NO: 66503 - RNA, 64 nt, Human
cgguaucacuguaucaucuuggucuuguucuggcugucaccaagcaugacccaggucaacuuuu

SEQ ID NO: 66504 - RNA, 64 nt, Human
cugaaucaacugcagaucuaauuugguucuaaguugucaccaaagcuauagccuucauaagcaa

SEQ ID NO: 66505 - RNA, 64 nt, Human
ccaccuaguacugugaagcuggauaacaaaagcuugucaccaaaagaaagaggugguauucccc

SEQ ID NO: 66506 - RNA, 64 nt, Human
aguucacgaucaucuuacgauaucaagcugaaaaugucaccacuaccuggacaguugcacaugu

SEQ ID NO: 66507 - RNA, 64 nt, Human
cacaaucuucuaccuuuuaaaggaucauuaagacugucaccacauuaggagcucuuucucucac

SEQ ID NO: 66508 - RNA, 64 nt, Human
gcagaaguuucauuuucuugaggcuuaaaaccaaugucaccacuugggcuuaacuggguaauuu

SEQ ID NO: 66509 - RNA, 64 nt, Human
ugcccuauagguugcauacuaacuuaagcauucaugucaccauaaaaugccuuuagcauuucuc

SEQ ID NO: 66510 - RNA, 64 nt, Human
aguuacuacauuuaagcucugauucuauauaaaaugucaccaaaaaguugacuuugaauuuguu

SEQ ID NO: 66511 - RNA, 64 nt, Human
auuuuuuuuuuuuuuuugagacagagucuugcucugucaccaggcuggagugcaguggcaugau

SEQ ID NO: 66512 - RNA, 64 nt, Human
ccuaacuccccaccccaacaucucccucccacauugucaccauuucaaagggcccacagugacu

SEQ ID NO: 66513 - RNA, 64 nt, Human
ccccauuucguuuugcuuuugguugccugaauguugucaccaagugaaaaaauuauuuaacuau

SEQ ID NO: 66514 - RNA, 64 nt, Human
ggcuaauuuuuuuguauuuuuaguagaaacagggugucaccauguuggccagacuggucucaaa

SEQ ID NO: 66515 - RNA, 64 nt, Human
cucagccucccaaguagcugggacuacaggugugugucaccacgcccggcuaauuuuuguauuu

SEQ ID NO: 66516 - RNA, 64 nt, Human
uaccuuuuauuauuauuuuuuggacagaugcuuuugucaccaagacaugaaaagcugccauucu

SEQ ID NO: 66517 - RNA, 64 nt, Human
gcaucagacaacuugauuccuaagguuuccagugugucaccaacaaaaagugcauugauaggga

SEQ ID NO: 66518 - RNA, 64 nt, Human
guaaagacuguccagcauuugguuuuauaauguuugucaccagauuuuuauuaauguaaaaaaa

SEQ ID NO: 66519 - RNA, 64 nt, Human
gcaguauuuugaugacauucaauguuuacuacagugucaccaccugacugauguccuaacaaug

SEQ ID NO: 66520 - RNA, 64 nt, Human
gaagggaaauuucaauaaccuuucacuuaaguauugucaccaggauuacuagucaaacaaaaaa

SEQ ID NO: 66521 - RNA, 64 nt, Human
aagguucacuguguuucugccgcuguccuggaguugucaccacugacugggcaaggcuucuugg

SEQ ID NO: 66522 - RNA, 64 nt, Human
auugcuucaagguacaaacccaggaugaugauguugucaccacugucucuuaauuuugaauaau

SEQ ID NO: 66523 - RNA, 64 nt, Human
caaucccugucccaagccacagcuauggcauuaaugucaccaguguucucacccucuaggcccu

SEQ ID NO: 66524 - RNA, 64 nt, Human
auaauaugaaauagccuguacauuuuaaaaauguugucaccaaguuauauaaauccacaucucu

SEQ ID NO: 66525 - RNA, 64 nt, Human
uuccagcagcuuacucccguggccgcacuuugaaugucaccaccuugaguuucucuuucuggua

SEQ ID NO: 66526 - RNA, 64 nt, Human
caauuggaaagacuauccaacuuaacaugaaacuugucaccaugagauagcauuagcugcccag

SEQ ID NO: 66527 - RNA, 64 nt, Human
uuuuuuuuuuuuuuuuugagauggagucucacucugucaccagacuggagugcaguggugccau

SEQ ID NO: 66528 - RNA, 64 nt, Human
cucagccuccugaguagcugggauuacaagcacgugucaccacgccuggcuaauuuuuguauuu

SEQ ID NO: 66529 - RNA, 64 nt, Human
ucgaucuaguauauuggggaaugcagguggggggugucaccauauuuuuucugagcuggccuuu

SEQ ID NO: 66530 - RNA, 64 nt, Human
cucagccuccagaguaucugggacuacaguugcaugucaccacguucggcuaauuuuuguauuu

SEQ ID NO: 66531 - RNA, 64 nt, Human
ucgcuuuuuuuuuuuuugagacagaaucucacuuugucaccaggcuggagugcaguggugcaau

SEQ ID NO: 66532 - RNA, 64 nt, Human
gagcuggcgucuucuguucacccugccuagcaguugucaccauucacaaguggcauuauuuaug

SEQ ID NO: 66533 - RNA, 64 nt, Human
uuccuuguaaccuugagacgagaauuccaaggagugucaccaucagaggcuucucuucauugug

SEQ ID NO: 66534 - RNA, 64 nt, Human
cuuaagggaagccggcauguacccuucaaggcccugucaccaccuauuuccugaucaguuggua

SEQ ID NO: 66535 - RNA, 64 nt, Human
agagguguggcuuuccucauccccuggcaaacauugucaccaaggugggauguugcugcuaaug

SEQ ID NO: 66536 - RNA, 64 nt, Human
uacuugacuauuuuugguucaauacuacuacuguugucaccauuuaugauucugaauuuuaaag

SEQ ID NO: 66537 - RNA, 64 nt, Human
uaauuuuuuauaucuuuaugagacgaucucacucugucaccagguuggaguacagugguacaau

SEQ ID NO: 66538 - RNA, 64 nt, Human
ugaguagugccuuuuuagcuuuuucacauuacuuugucaccauauccuuuguguucucuaaaua

SEQ ID NO: 66539 - RNA, 64 nt, Human
auucagaacuguaagaugaucgcgcagggcaucaugucaccaugucagguccggaggggaggua

SEQ ID NO: 66540 - RNA, 64 nt, Human
uuauauuuguuguaaaguuguaaaaauauugugaugucaccaauuuuccuuccaucuccacauc

SEQ ID NO: 66541 - RNA, 64 nt, Human
acauguguagcugcuucuggcugaguguguuuccugucaccaauggccuguuuggcuggacgau

SEQ ID NO: 66542 - RNA, 64 nt, Human
aaaauggcuagacacccauuuucacauucccaucugucaccaauugguuaaucuuuccugaugg

SEQ ID NO: 66543 - RNA, 55 nt, Human
gaaaacacagcagccccuagcaccuugucaccacucuggggcucuguggaagaaa

SEQ ID NO: 66544 - RNA, 64 nt, Human
ugagcaacauaggaaaaggggaagagaggcugagugucaccaagguccaaacuccauuuauaaa

SEQ ID NO: 66545 - RNA, 64 nt, Human
aggagggggcagcaacaacggcaagacucccgugugucaccagugccacaaggucauccggugg

SEQ ID NO: 66546 - RNA, 64 nt, Human
gugacaugugccacuuuggccaccacccacagucugucaccacguggcuugggaacuucuggag

SEQ ID NO: 66547 - RNA, 50 nt, Human
guguggagggcagguucugaugucaccacuucacucaggcugcagcccuc

SEQ ID NO: 66548 - RNA, 64 nt, Human
gcuccccaacagauguuugugauguuuuuguggcugucaccauggugggauucuuucagaauga

SEQ ID NO: 66549 - RNA, 64 nt, Human
ugaauccucucucuguguuacccaguaacucaucugucaccaagccuuggggauucuuccaucu

SEQ ID NO: 66550 - RNA, 64 nt, Human
cucagccucuugaauagcugagaccacaggcuugugucaccaugcccagguaauuuuuaauuuu

SEQ ID NO: 66551 - RNA, 64 nt, Human
cuggcccccaggauucccccagccaaacugucuuugucaccacguggggcucacuuuucauccu

SEQ ID NO: 66552 - RNA, 64 nt, Human
cucccaacugaccucaggccucugagucacugaaugucaccaggagaggugggggagggaaagu

SEQ ID NO: 66553 - RNA, 64 nt, Human
aaaaaagcaaagaccauuugauaaaagccugaguugucaccauuaugucuuaagcuguuagucu

SEQ ID NO: 66554 - RNA, 64 nt, Human
cauuuaagaauauggcaaagaacauaaaagauggugucaccagauuuuggucaccaaugaguac

SEQ ID NO: 66555 - RNA, 64 nt, Human
auuuuuuuuuuuuuuuugagaccgagucucacucugucaccaggcuggagugcaguggugcgau

SEQ ID NO: 66556 - RNA, 64 nt, Human
aggggacaauggcagaacagguguuggugacaauugucaccaauuggauaaagcagcucagguu

SEQ ID NO: 66557 - RNA, 64 nt, Human
uuucggccugaugggaauuagugcagagaagccaugucaccauagaaggcaacuccuacuugug

SEQ ID NO: 66558 - RNA, 64 nt, Human
caaggagacccgggggaggaaccgcaguguccccugucaccacacggaauagugaauguggagu

SEQ ID NO: 66559 - RNA, 64 nt, Human
gggauuucauuucugcuuuuuacuagugcagcgaugucaccaggguguugugguggacagggaa

SEQ ID NO: 66560 - RNA, 64 nt, Human
uucccccuagaagaaccaccacaaggaaaaaugcugucaccauaaggaaugugggaaaguuuuc

SEQ ID NO: 66561 - RNA, 64 nt, Human
uuucccucuagguccugugccucaucacugcuccugucaccaugauucuguccagccagcagga

SEQ ID NO: 66562 - RNA, 64 nt, Human
auucguuagugaugagcagcugccagcugagcucugucaccagggguacuccacaggaggagca

SEQ ID NO: 66563 - RNA, 64 nt, Human
aauggccagaauuuuguguuugguguaauaguugugucaccauucuuguugcuuuuuaaaaauc

SEQ ID NO: 66564 - RNA, 64 nt, Human
uuuuuaacuuuaccaugcucaaugaaaaggugauugucaccaugaucacuuaucaguuugcuaa

SEQ ID NO: 66565 - RNA, 64 nt, Human
uuugauuagaagguaaugucauggaauagaaugcugucaccagaaaaugcucucccacugcuag

SEQ ID NO: 66566 - RNA, 64 nt, Human
uuauuuuuauauuaguuaauaaaugacuuuaaauugucaccaauugaaaaucuugucacucuuu

SEQ ID NO: 66567 - RNA, 64 nt, Human
cauuaauaguauuuuaaaaaaauuguuuuucaaaugucaccaauaaaaguuuuggcaggaagcu

SEQ ID NO: 66568 - RNA, 64 nt, Human
uugaguggauuccuggguacagcuuuuguaaaaaugucaccauggcuuucauccaauggaauga

SEQ ID NO: 66569 - RNA, 60 nt, Human
agcagaaacugaaugacugacucagggaggugucaccauccgaagggaaccuuggggaac

SEQ ID NO: 66570 - RNA, 64 nt, Human
gaaggcaggcuggaucuuugccuugagagcuccgugucaccaggauggaagggggugccucucg

SEQ ID NO: 66571 - RNA, 64 nt, Human
aaauccaacacacauuucuuucagggaaaaacaaugucaccaaauuuucagaguucuaaacucc

SEQ ID NO: 66572 - RNA, 64 nt, Human
cuggcuguggcuggaaucugccuuuuaucacagcugucaccauucucacgugauucuugugaga

SEQ ID NO: 66573 - RNA, 64 nt, Human
ugacaucuuaacucauguugaguuugugcuguggugucaccagaauuccagauaaacacacagc

SEQ ID NO: 66574 - RNA, 64 nt, Human
aaggggaagaaaggaauugcgaauacauguaaaaugucaccagacauuuguauuauuuuuauca

SEQ ID NO: 66575 - RNA, 64 nt, Human
aaaacguggcacacacugaccacacauuaggcugugucaccauugugugguguaccugcuggaa

SEQ ID NO: 66576 - RNA, 64 nt, Human
uuuaccccaagcccggcggggacacgcucacagaugucaccacagcccugcccuucaugcccag

SEQ ID NO: 66577 - RNA, 64 nt, Human
aacacacacacaccucuaagcugcuggccgaagaugucaccaaggccaaagacacaguauuaug

SEQ ID NO: 66578 - RNA, 64 nt, Human
ugaucacucucccugacauccaccuguaugacuuugucaccaaaugcugucuucucuuucucca

SEQ ID NO: 66579 - RNA, 64 nt, Human
acgugcuguuugcugugcguggaaugcccuucacugucaccacccugcucauccacucuacuaa

SEQ ID NO: 66580 - RNA, 64 nt, Human
gcccuucagucccugagcagucuacuucugugucugucaccacaucuugucuuuuccccucauu

SEQ ID NO: 66581 - RNA, 64 nt, Human
acgccccagacuuccgccgggucuaccugccuuaugucaccaaccagaccuaucaggaacgcac

SEQ ID NO: 66582 - RNA, 64 nt, Human
accagauuuacucuuugcuuacuagguuuuccauugucaccauuggaugaaccucugguuuagc

SEQ ID NO: 66583 - RNA, 64 nt, Human
guaaaaauuuauaaauauuaagaauguauauacaugucaccauggauuggaacuguuuugcaua

SEQ ID NO: 66584 - RNA, 64 nt, Human
gaaaaaauagcucauuucuccuugucagucuccuugucaccacucuuuuugagacuguuuuugc

SEQ ID NO: 66585 - RNA, 64 nt, Human
gggguagaagaagaaaacuuugaaggcuuaacgaugucaccauuucuaccugccacgcgucggu

SEQ ID NO: 66586 - RNA, 64 nt, Human
aaccuguugaauaauuugauuggcaaauacuaucugucaccaagucccuuuuugucaucuauuu

SEQ ID NO: 66587 - RNA, 64 nt, Human
uccacccacuguccagcccgagcaacagguucugugucaccagccuggaccccgacacgcugcc

SEQ ID NO: 66588 - RNA, 64 nt, Human
aaaaucauugggguuuguagucccaacuugcugcugucaccaccaaacucaaucauuuuuuucc

SEQ ID NO: 66589 - RNA, 64 nt, Human
acaaggcuuucuucuaucaguagcguuuacccuuugucaccaguggcuuugguauuuccauguc

SEQ ID NO: 66590 - RNA, 64 nt, Human
gaacagauuuuguaggaaggcauacugaauucuuugucaccagcacuuuugauaugaacaguau

SEQ ID NO: 66591 - RNA, 64 nt, Human
uuuuuuuuuuuuuuuuuuugauggagucucgcucugucaccaggcuggagugcaguagcacaau

SEQ ID NO: 66592 - RNA, 54 nt, Human
ugagagccucuuuccauuaaaaauugucaccaaugaacucccccaaacauggcu

SEQ ID NO: 66593 - RNA, 64 nt, Human
uccuguccccauuuuuaaccucagccuucccuacugucaccaacaaccaagcuaaauaaaguca

SEQ ID NO: 66594 - RNA, 64 nt, Human
uauuccaguguccauguuggccuccaguccuuaaugucaccaugcuuguggccaaugcauccaa

SEQ ID NO: 66595 - RNA, 64 nt, Human
aaccuaacaggagaaaggacaaccaggaugaggaugucaccaacugaauuaaacuuaaguccag

SEQ ID NO: 66596 - RNA, 64 nt, Human
ggcccugccggcagccacugacaagaggccagugugucaccagcccucagcagaaaccgaaaga

SEQ ID NO: 66597 - RNA, 64 nt, Human
caguguucacaucuuguuccccauuucucacuugugucaccagcuguuugugccauuuuuagug

SEQ ID NO: 66598 - RNA, 64 nt, Human
aaaaauuccacauaucagugauacaauuucuugcugucaccaauuuuuuauaauagcagagugg

SEQ ID NO: 66599 - RNA, 64 nt, Human
cacaagauuaccuuccuguuuuagccuucugucuugucaccaaccauucuuacuugguggccau

SEQ ID NO: 66600 - RNA, 64 nt, Human
caggcaggggcuucccacagccucuuccuccccaugucaccacaacaaagugcuuccuuuucag

SEQ ID NO: 66601 - RNA, 64 nt, Human
uccucaaagcagcuccugaaggucuguguugcacugucaccagucucaagcuaugccucuaauu

SEQ ID NO: 66602 - RNA, 64 nt, Human
uuucuucccugagccaggugugacaagccaacucugucaccauucgugaggggagaguugcagu

SEQ ID NO: 66603 - RNA, 64 nt, Human; identical to SEQ ID NO: 66472

SEQ ID NO: 66604 - RNA, 64 nt, Human
gguguguuugaaaucaucggagucagccaggagcugucaccaaggaaacgcuaccucucugucc

SEQ ID NO: 66605 - RNA, 64 nt, Human
aguggaaaacagaauaaugauucaaagagucuucugucaccaugucauauugugguucuuucag

SEQ ID NO: 66606 - RNA, 64 nt, Human
ggacuucucucccucccccaucuacacagaagacugucaccaugcugacagaagccuguccuug

SEQ ID NO: 66607 - RNA, 64 nt, Human
cucagccucgcgaguagcuaggacuacaggcgcaugucaccaagcccggcuaauuuuuguauuu

SEQ ID NO: 66608 - RNA, 64 nt, Human
uuagaaauuugaauggcuuggugaggaaaguaguugucaccagggccucauuuuguaguugagc

SEQ ID NO: 66609 - RNA, 64 nt, Human
ugccaccgcuggccuccgcugcuuccaucagcccugucaccaccugguccuucaugaagagcag

SEQ ID NO: 66610 - RNA, 64 nt, Human
cugccccugcucacaccuggaggcuggacacaagugucaccacuucccugaaccccccuaggug

SEQ ID NO: 66611 - RNA, 64 nt, Human; identical to SEQ ID NO: 66472

SEQ ID NO: 66612 - RNA, 64 nt, Human
uaagucacuauugauucugguuauaaagaaaggcugucaccauaaugcaggaucacuacaguuu

SEQ ID NO: 66613 - RNA, 64 nt, Human
gccuucuuaggugacaaugucccccauaucuguaugucaccaggauggcagagagccagggcag

SEQ ID NO: 66614 - RNA, 64 nt, Human
agacuuuuuuucccccuuguccucgugauaaguaugucaccaauauaugauuuaaaccgagcac

SEQ ID NO: 66615 - RNA, 64 nt, Human
aauacacauauauucaguucucagauguugaagcugucaccagcagcuuugcucuuaggagaaa

SEQ ID NO: 66616 - RNA, 64 nt, Human
uguccagggcaccagggaugcaauuccauguggaugucaccaaaccccaguguggaggcaggga

SEQ ID NO: 66617 - RNA, 64 nt, Human
uugucucugagaacagacguuaccaauuauggagugucaccagcugccaaaaucguagguguug

SEQ ID NO: 66618 - RNA, 64 nt, Human
auuauaaaaagcaaagagaagacuuuguacacacugucaccaggguuauuugcauccaagggag

SEQ ID NO: 66619 - RNA, 64 nt, Human
ccagauguuuuccacugaagcaugcacaugccacugucaccaaaacaaacaacuaccacuuucc

SEQ ID NO: 66620 - RNA, 64 nt, Human
uugagaaacguucauaggcaagucugcuguucuaugucaccaucuuuugucuccccuagucccc

SEQ ID NO: 66621 - RNA, 64 nt, Human
auaucagaguaggaugaacacccagauucaaauaugucaccaaaguugguggugguccuucccu

SEQ ID NO: 66622 - RNA, 64 nt, Human
uguguauacguaggaauuuuuuccuuuuguguucugucaccaacugaaguggcuaaagagcuuu

SEQ ID NO: 66623 - RNA, 64 nt, Human
uacacccaucccuuugcaaaaucccuauggagccugucaccacuccccucccuauauaccccca

SEQ ID NO: 66624 - RNA, 64 nt, Human
cccaugaaccuacuacccagguuaagaaaauaaaugucaccagguacuugagaaaccccucgau

SEQ ID NO: 66625 - RNA, 64 nt, Human
ccaggcagggcucugcagguccauaugggcucaaugucaccacccucugcauggcccugugugc

SEQ ID NO: 66626 - RNA, 64 nt, Human
uaugccuuuuacgagugcuaaguguaggauauuuugucaccagaacacaaugcuaccgccccaa

SEQ ID NO: 66627 - RNA, 64 nt, Human
guuccucaagggcagauauuggacacuccuuauuugucaccaaaggaugacuguaggccgugug

SEQ ID NO: 66628 - RNA, 54 nt, Human
uugaauaucacacugaauagcaggugucaccaccuccugagauaagaaacauag

SEQ ID NO: 66629 - RNA, 64 nt, Human
augaacauuuucaaaaacacacagcuucaacaauugucaccauauggccaauuugcaacaaugg

SEQ ID NO: 66630 - RNA, 64 nt, Human
gagagaauguucuuauuuggaagcagcuguggcuugucaccaauguucaaggaguguuacuguu

SEQ ID NO: 66631 - RNA, 64 nt, Human
uauuaacugaaucuuaauacuuucuuuucacaggugucaccaccccaauaaacuuagacaauga

SEQ ID NO: 66632 - RNA, 64 nt, Human
caggauacauauucaguaccuguggggaaauaacugucaccacccacaaauuagacauuuuuua

SEQ ID NO: 66633 - RNA, 64 nt, Human
ugcccucagcuuugcagaaugaagccuugaggucugucaccacccacagccacccuacagcagc

SEQ ID NO: 66634 - RNA, 64 nt, Human
ugugcacccugagagcucacaguaacacugugugugucaccauauaacugcaccucacccccgc

SEQ ID NO: 66635 - RNA, 64 nt, Human
aaaaaauaaacagaaaacucagcucaggcacaauugucaccaaggaguuaaaagcuucuucuuc

SEQ ID NO: 66636 - RNA, 64 nt, Human
gucaguggggcauugcagcuuggaaucuauuuuaugucaccaguugguccucaucaaauaaaau

SEQ ID NO: 66637 - RNA, 64 nt, Human
ugcugagauuucaaauaguccuccccaccucaacugucaccacugcuaagggacucuauccauu

SEQ ID NO: 66638 - RNA, 64 nt, Human
uuuuuccccaggaagucuggagaaaaaguccucaugucaccaauuucucuguugcaugaauuuu

SEQ ID NO: 66639 - RNA, 64 nt, Human
ggcaugugacuggucccugcaaggguccuuucuuugucaccagccaaggcauugauaaccaagu

SEQ ID NO: 66640 - RNA, 64 nt, Human
uugccucccccuccucucaaagagccucugacugugucaccaaggggcucacaucuuaugucug

SEQ ID NO: 66641 - RNA, 64 nt, Human
acggcuggauaccugugugucuccauaaaaguccugucaccaaggacguuaaaggcauuuuauu

SEQ ID NO: 66642 - RNA, 64 nt, Human
caacuuuuuuuuuuuuugagauggggucucgcucugucaccaggcuggagugcaguggcgcgau

SEQ ID NO: 66643 - RNA, 64 nt, Human
aggcagcagggcccucaagccacagacauuguggugucaccauccacgaagcugcugucucugg

SEQ ID NO: 66644 - RNA, 64 nt, Human
uuuuuuuuuuuuuuucugagauggagucucgcucugucaccaggcuggagugcaguggcgcgau

SEQ ID NO: 66645 - RNA, 64 nt, Human
ccuauuccuauucuuugccaccuuuuggguguggugucaccagccuguuuagccaaguagcuuu

SEQ ID NO: 66646 - RNA, 64 nt, Human
agccaccacugaugccucccacugugacaggcccugucaccaccaauaucuuauuucaaccuca

SEQ ID NO: 66647 - RNA, 64 nt, Human
aggggaggugcagggaagaggggccggccucagcugucaccagcacuuuugaccaaguccugcu

SEQ ID NO: 66648 - RNA, 64 nt, Human
cuuucuugagacagacuauacugagacaacaaguugucaccagcagaagauagauaauaugacc

SEQ ID NO: 66649 - RNA, 64 nt, Human
ugaagaagaggugagaagaucccaaggugaagccugucaccacgcagacagaacugcccccuau

SEQ ID NO: 66650 - RNA, 64 nt, Human
cuagaaguuagauuauuugcuacugugagaauauugucaccacuggaaguuacuuuaguucauu

SEQ ID NO: 66651 - RNA, 64 nt, Human
ugcuucccucaccugccugccugucucccuccucugucaccaccagccucuccaagcucaagua

SEQ ID NO: 66652 - RNA, 64 nt, Human
aguccucacccagacccccugcuggugccguggaugucaccagucggacugugcuguggcuaac

SEQ ID NO: 66653 - RNA, 64 nt, Human
cagaauuaaaggucgcacauagacguuucagaucugucaccaccuucagcaucuggaguugagu

SEQ ID NO: 66654 - RNA, 64 nt, Human
ccuuuagcaccuaaagaucugcaccccaaaccaaugucaccauaaagagggcacgaagaagagu

SEQ ID NO: 66655 - RNA, 64 nt, Human
auucauguaauuguaugucuguguguguuuuaugugucaccaccuuucauguuuuugauugccc

SEQ ID NO: 66656 - RNA, 64 nt, Human
uacuuuauuuggauuuuauuuuaaugugacuagaugucaccacuucaaaaaaucaauuuguucu

SEQ ID NO: 66657 - RNA, 64 nt, Human
auuauuuuggacauagaaacagaucuuuguaucuugucaccaaauaaucuuaccucuagucuac

SEQ ID NO: 66658 - RNA, 64 nt, Human
uacagcuuuuuagaggaaaaguuguggugcguuaugucaccaugcaguugccagugugauuagu

SEQ ID NO: 66659 - RNA, 64 nt, Human
uucuuuuuuauuuuuuugagaucgagucucgcucugucaccaggcuggagugcagugacacgau

SEQ ID NO: 66660 - RNA, 64 nt, Human
cccuccauuaagcagaggcuggcacggcuacagcugucaccagauuuuaccuucacugcuggcc

SEQ ID NO: 66661 - RNA, 64 nt, Human
auuccuagaaugucaucauaugguccuaauuccaugucaccaacaacacagacaagacccuguu

SEQ ID NO: 66662 - RNA, 64 nt, Human
uaaaaauucaaaauguuggccugaggccugagagugucaccaaagacagagggagcuucacuga

SEQ ID NO: 66663 - RNA, 64 nt, Human
cucugagaggcccuggaucagcguggccuuguucugucaccaauguacccaccgggccacuccu

SEQ ID NO: 66664 - RNA, 64 nt, Human
aacugcuccugugaggcagacaggacagugagguugucaccacucagacuucaccuauucagca

SEQ ID NO: 66665 - RNA, 64 nt, Human
caugcacacauuacauuagccaugggagcaauaaugucaccacacacacuucaugaagccucug

SEQ ID NO: 66666 - RNA, 64 nt, Human
gccuguggaucccaacgaacccaccuauugccuuugucaccaggucuccuauggagagaugauu

SEQ ID NO: 66667 - RNA, 64 nt, Human
uuagaaccuaacuuuuauagguuaucaaaacuguugucaccauugcacaauuuuguccuaauau

SEQ ID NO: 66668 - RNA, 64 nt, Human
uugccucaucuauaacaugcauuugucuuuguaaugucaccaccuucccagcucucccucuggc

SEQ ID NO: 66669 - RNA, 64 nt, Human
aaacagccucacagaagaauaugacagcugucccugucaccaagcucacaguuccucgcccugg

SEQ ID NO: 66670 - RNA, 64 nt, Human
uuauguccccugccagggccugucucugacuaggugucaccauacacauucuuagauugaaucu

SEQ ID NO: 66671 - RNA, 64 nt, Human
ccccccaauuucuuguccccucuuaaagagcaguugucaccaccugaacaccaaggcauuguau

SEQ ID NO: 66672 - RNA, 64 nt, Human
gacaguuucucagaacugguucauagaccaccugugucaccaacagccagauaccuaaucccug

SEQ ID NO: 66673 - RNA, 64 nt, Human
ccucuccuuaaauaaccaugccaagaagggacauugucaccaagaaccaggaucucuggagaaa

SEQ ID NO: 66674 - RNA, 64 nt, Human
ucaaaccuguauuccuucuuuauacucaggaaaaugucaccaagcacccuccuccccaguucac

SEQ ID NO: 66675 - RNA, 64 nt, Human
aaauuaggcauaucucugccaucacauaguauuaugucaccauaaugaacaauugcuauuuaaa

SEQ ID NO: 66676 - RNA, 64 nt, Human
ggagaauacuuugcauuuaaaaacccuguccaccugucaccagcacaagagaauuagagcuuca

SEQ ID NO: 66677 - RNA, 64 nt, Human
uguccauugugcucuauuaaucuugucagaaaacugucaccaaaacaaaacuugaguuuguccu

SEQ ID NO: 66678 - RNA, 64 nt, Human
cagggggcccgaacagggacuuguuuagagagccugucaccagagcuucucugggcugaaugua

SEQ ID NO: 66679 - RNA, 64 nt, Human
uggcuaacuuuggaauccauuagagaaaaauccuugucaccagauucauuacaauucaaaucga

SEQ ID NO: 66680 - RNA, 64 nt, Human
accaauuuucaucuaaaagguuauauucuaguugugucaccaaaucaucaaaaaaccuuaaaaa

SEQ ID NO: 66681 - RNA, 64 nt, Human
gggggaacagaguucacuguacaaauuugacaacugucaccaaaauucauaaaaaacaauagua

SEQ ID NO: 66682 - RNA, 64 nt, Human
agaaaaauggaacaaauuuuuaucuaaaaauuccugucaccacaagagggcaucagcugcuccu

SEQ ID NO: 66683 - RNA, 64 nt, Human
aaauccuguggugaauggugguguacuuuaaagcugucaccauguuauauuuucuuuuaagacu

SEQ ID NO: 66684 - RNA, 64 nt, Human
ucugaugccaaucucaacauugucuuuuuaauacugucaccagauauugccauuuuucuuuuug

SEQ ID NO: 66685 - RNA, 64 nt, Human
ugagcgugagcagcuggaggcaacuuguccccagugucaccagaccuucugugugcgcugcaag

SEQ ID NO: 66686 - RNA, 64 nt, Human
auuuugguuuauccaggacccagggcagcacagcugucaccaagcaggagaguuaaggauucac

SEQ ID NO: 66687 - RNA, 64 nt, Human
uucugggauauuuaacuauaggcuucuuccuucuugucaccaguuaaaagcauuuuaauacuaa

SEQ ID NO: 66688 - RNA, 64 nt, Human
caaacuuugaugugaugacuggugacucugggauugucaccaguuguaccaauuugaagaaccu

SEQ ID NO: 66689 - RNA, 64 nt, Human
acaucguggcccgcagccccagagucacuguccaugucaccauccuucuccuccuuuggaaucc

SEQ ID NO: 66690 - RNA, 64 nt, Human
cucgguaauuugcauguuuuguggagcauuuuuaugucaccaaccagacaguauuuccugcaug

SEQ ID NO: 66691 - RNA, 64 nt, Human
cucuucugguuuuggaaaauuuccagauaagacaugucaccauuaauucucaacgacugcucua

SEQ ID NO: 66692 - RNA, 64 nt, Human
gcuacaacccaaagagagaaagauugagucuuccugucaccauaggcaauaccuuuuuucuuag

SEQ ID NO: 66693 - RNA, 64 nt, Human
uagcaacacugaaagagcgugggaagguggagggugucaccagacccacacagagcaagggaga

SEQ ID NO: 66694 - RNA, 64 nt, Human
cuugagggcagagaauacugaccucaccuugggaugucaccaaaggcagagcagaugggacugu

SEQ ID NO: 66695 - RNA, 64 nt, Human
uuuuauuuuuuaaaugggagcaacauaucagucgugucaccagcugguauauuguguaaauauu

SEQ ID NO: 66696 - RNA, 64 nt, Human
caggaucagaccuuggggucuucuggccagagcuugucaccagccccauggccucuccaggcgu

SEQ ID NO: 66697 - RNA, 64 nt, Human
ugcauuaaguucauucugggucgcagccaugaagugucaccaguaucuacuacugugaagucag

SEQ ID NO: 66698 - RNA, 64 nt, Human
cccucacucugucagccagccgcccugggcugucugucaccagcuaucugucaucucucugggg

SEQ ID NO: 66699 - RNA, 64 nt, Human
ccuugccuccugaguagcugggauuacaggcgugugucaccacgcucggcuaauuuuuguauuu

SEQ ID NO: 66700 - RNA, 64 nt, Human
uuuaaaacaugagugauuugccagguccuuauguugucaccauagagcaacaaagguauagggc

SEQ ID NO: 66701 - RNA, 64 nt, Human
aacaugccccagcccaccccuaagcauggucccuugucaccaggcaaccaggaaacugcuacuu

SEQ ID NO: 66702 - RNA, 64 nt, Human
gggugguuucagcugcacuaucuguaugaaauggugucaccaaaacccuuuucuucaguaucga

SEQ ID NO: 66703 - RNA, 64 nt, Human
gugccccuagauccuucagguccccacccucagcugucaccaccacccuccccaggggacucca

SEQ ID NO: 66704 - RNA, 64 nt, Human
acuuugugcuucuaguggcuuugccauaauucagugucaccaauaaggcacagcccaguuagca

SEQ ID NO: 66705 - RNA, 64 nt, Human
guuagaaugucacgagggacuguacuguccccucugucaccagggaagccacaaugagagcuug

SEQ ID NO: 66706 - RNA, 64 nt, Human
aacaaagaugccuccccagcccugauauucuugaugucaccagugauacccacugcccugaccc

SEQ ID NO: 66707 - RNA, 64 nt, Human
cccauggcauuuuauaggcauaccuccuauggguugucaccaagcuaggugcuauuugucaucu

SEQ ID NO: 66708 - RNA, 64 nt, Human
gguuauucuaaauuauaguagccucaacucauucugucaccaguagaauucagcaguuaauaua

SEQ ID NO: 66709 - RNA, 64 nt, Human
uccuagucucuggccuguggauccagugcuauucugucaccaaccuaagaaucccaauugcacc

SEQ ID NO: 66710 - RNA, 64 nt, Human
gucauccaguagaagcauaguuagcaucagaaaaugucaccauauuuucgcuagcucaagcagu

SEQ ID NO: 66711 - RNA, 64 nt, Human
uuaccuccaagugguaacaggacugaugccgaaaugucaccagguccuuucagucuucacagug

SEQ ID NO: 66712 - RNA, 64 nt, Human
ugcggauaaauauuugccacgaaugaguaacuccugucaccacucugaagguccagacagaagg

SEQ ID NO: 66713 - RNA, 64 nt, Human
acccagucccgcccagacuaguggacagaccuggugucaccaguuuuuccuagcaucaguccga

SEQ ID NO: 66714 - RNA, 64 nt, Human
acagcugcuuccagcagccagcauucaguggccuugucaccaagcuccacaccuccuccuggug

SEQ ID NO: 66715 - RNA, 64 nt, Human
cucagccucccgaguagcugggauuacaggcaccugucaccacacccagcuaauuuuuguauuu

SEQ ID NO: 66716 - RNA, 64 nt, Human
ccugagugauggcucaggggcgcacuaccuauuuugucaccagagcugacucaggcuuccugga

SEQ ID NO: 66717 - RNA, 64 nt, Human
ugguggcucucaccccagggaccuaggaacagccugucaccacacaauuacuuuuauaacccug

SEQ ID NO: 66718 - RNA, 64 nt, Human
ccuaccuccagccaaugaaugggaucauucuggaugucaccagcccaauaggcucagcucauga

SEQ ID NO: 66719 - RNA, 64 nt, Human
uugaggaggggacauaguggccucugggcugccaugucaccaccugaacauuccccaaacagag

SEQ ID NO: 66720 - RNA, 64 nt, Human
ucuuggcacaugcacagcaggcuccccauagcuuugucaccacaaagggcacuguucuauucac

SEQ ID NO: 66721 - RNA, 64 nt, Human
cgugcuggggugguuuggggagagggcugagauuugucaccagugagcccuuggcacggucucu

SEQ ID NO: 66722 - RNA, 64 nt, Human
caauacugaugaccuggaaggugauccauaugauugucaccacaaagugcuuuuacacaaaaac

SEQ ID NO: 66723 - RNA, 64 nt, Human
gcacaguugugaguguuaaacaagccaauguucuugucaccaaagugcccaacucuggcacggg

SEQ ID NO: 66724 - RNA, 64 nt, Human
aagcuuucacucgcgaguggaggggaaggauuuaugucaccaguggggaucagugcgggugggg

SEQ ID NO: 66725 - RNA, 64 nt, Human
aggagcgcuauuuauugcauauuuauuguuuggaugucaccaucagagacgaagggaaggguag

SEQ ID NO: 66726 - RNA, 64 nt, Human
cauugccaucugggguccuuugggguuuccagguugucaccaugcugucccauuugggaauccc

SEQ ID NO: 66727 - RNA, 64 nt, Human
cucagccucccaaguagcuaggaccacaggugcgugucaccaugcuuggcuaauuuuuuugcag

SEQ ID NO: 66728 - RNA, 64 nt, Human
uccuccugugagacagggagacaagugaaugagaugucaccaggauaagaccacagggaagcaa

SEQ ID NO: 66729 - RNA, 64 nt, Human
ccugugugcaggacuguccacacgguucacaccuugucaccaucaggccuuucuggcuccugau

SEQ ID NO: 66730 - RNA, 64 nt, Human
cucagugacauguagaugacugacugccaauacuugucaccauucccuggaagcagcuaccuag

SEQ ID NO: 66731 - RNA, 64 nt, Human
ccacgaacuccuccuccauuuccuuuuugggauuugucaccauccuucuauucucuggucuucu

SEQ ID NO: 66732 - RNA, 64 nt, Human
auccuuccucccccacccaccauuguaaaguuuaugucaccagaauauuucuuucaugucuaau

SEQ ID NO: 66733 - RNA, 64 nt, Human
gagcucaaggccuucaccugcucuaggccagcccugucaccaccuccacugccaugaccaggcc

SEQ ID NO: 66734 - RNA, 64 nt, Human
ggaucccugccacaaguuccuugggcaguggccaugucaccauugagaugaagauauacaacag

SEQ ID NO: 66735 - RNA, 64 nt, Human
ucaccguuugcaggguugcuaaucagauaccugcugucaccacacuugggucaggaacccuaau

SEQ ID NO: 66736 - RNA, 64 nt, Human
acaguugagagguuggagcaggaugagggaauccugucaccaucaauaaucacuuguggagcgc

SEQ ID NO: 66737 - RNA, 64 nt, Human
cauucuacaaccugaugguuuuuacugcucaaacugucaccaucaucuuuugcaauguguugcu

SEQ ID NO: 66738 - RNA, 64 nt, Human
cuccuucccauccucugaaaugggacccugugucugucaccagcccacccucuguguucaugaa

SEQ ID NO: 66739 - RNA, 64 nt, Human
uuuaaaacauuuuccuccccucuggccaguggguugucaccagagcacuugcugugggcccauc

SEQ ID NO: 66740 - RNA, 64 nt, Human
cgggcacagcccucagcgucagacagcaaggaacugucaccagccgcacgcgugguaaaugacc

SEQ ID NO: 66741 - RNA, 64 nt, Human
ggaggccugcagccuaccugaccaucucuuuagcugucaccaagaaaauaaaccccacugucuc

SEQ ID NO: 66742 - RNA, 62 nt, Human
gagauguaucaccaccuugucaccaacaggaugaugucaccagguaauaaaccuucauccuc

SEQ ID NO: 66743 - RNA, 64 nt, Human
ugagggaagucccauuagagauguaucaccaccuugucaccaacaggaugaugucaccagguaa

SEQ ID NO: 66744 - RNA, 64 nt, Human
cccaguuuauuuucuaagacugcaaagaucacuuugucaccagcccugggaccugagaccaagg

SEQ ID NO: 66745 - RNA, 64 nt, Human
guaaauucugaagguuuuaagauuuacuucagcuugucaccaguuucaaauaaaucccuaauag

SEQ ID NO: 66746 - RNA, 64 nt, Human
gaaauauaaacggagaggcuuucuguugagacauugucaccaaaacaauuuuuugaaauguucc

SEQ ID NO: 66747 - RNA, 64 nt, Human
uguccuggcuuacugggacagucuguaugaggcaugucaccacacugucgccucauagcugcaa

SEQ ID NO: 66748 - RNA, 64 nt, Human
gcacgcacacaugcucugcaggauguggccauccugucaccagguaguuuuucccugccagaga

SEQ ID NO: 66749 - RNA, 64 nt, Human
uaguauguccagccuauugcuuuuuguuuuagugugucaccauaaauaucaggggcauaaaagg

SEQ ID NO: 66750 - RNA, 64 nt, Human
ugcugagacucugggacccaggcagcugccaccuugucaccaugagagaauuuggggagugcuu

SEQ ID NO: 66751 - RNA, 64 nt, Human
gucucacagcccuggccacugacagaucagcagaugucaccacaugggcuucugagaaagcucu

SEQ ID NO: 66752 - RNA, 64 nt, Human
ugcgacugggaccaggucaaccacgccaggggggugucaccagccuuuucuuuuuuucuuucuu

SEQ ID NO: 66753 - RNA, 64 nt, Human
cugcaggcugauccuucuuuucacuuucugucaaugucaccagggauaaggugggacaaugggg

SEQ ID NO: 66754 - RNA, 64 nt, Human
ugaaagcuuccggaauugacugugaccacuuggaugucaccacugucagccccugccuugaugu

SEQ ID NO: 66755 - RNA, 64 nt, Human
guaacuuuugauuuucggucaauuuaaguucuuuugucaccaaauauuaauaaacaguuuugac

SEQ ID NO: 66756 - RNA, 64 nt, Human
gguuccgcacuguccgaccccugcacaccacucaugucaccacggcgugcaucauguucauccc

SEQ ID NO: 66757 - RNA, 64 nt, Human
aauacuuuacagacaagcaaaugcugagagauuuugucaccaccaggccugcccuaaaagagcu

SEQ ID NO: 66758 - RNA, 64 nt, Human
aaugggaggcaguucugggaggggguuuuuucagugucaccaacagagucaacaaggaaacaua

SEQ ID NO: 66759 - RNA, 64 nt, Human
uuuuuguuuuuguuuuuuugagauggagucucacugucaccaggcuggagugcaguggugcaau

SEQ ID NO: 66760 - RNA, 64 nt, Human
cucagccucccgaguagcugggauuacaggugggugucaccacacccagcucaguauuguauuu

SEQ ID NO: 66761 - RNA, 64 nt, Human
uuugucagauacauccuggaguccagaugcagcuugucaccaucugcauuuucuccguggguug

SEQ ID NO: 66762 - RNA, 64 nt, Human
aacaggugaaccugcauauguauaugcagguaguugucaccauggauugaguccagucguagua

SEQ ID NO: 66763 - RNA, 64 nt, Human
augcauauauguagggaugugugacuuucacaguugucaccauggacuuaggcuugauuaaaau

SEQ ID NO: 66764 - RNA, 64 nt, Human
cucacaugacacuuggucauucuuccagccuccaugucaccacguggugaauggcugccucaca

SEQ ID NO: 66765 - RNA, 64 nt, Human
gggucccaccagcccagggcugaucccagcugugugucaccagcagcuuucccagcuucucugu

SEQ ID NO: 66766 - RNA, 64 nt, Human
gugucgcaccagcccugggcugaucccagcugugugucaccagaagcuuucccggcuucucugu

SEQ ID NO: 66767 - RNA, 64 nt, Human
agaugauuucuagcaggcaggaaguccugugcggugucaccaugagcaccuccagcuguacuag

SEQ ID NO: 66768 - RNA, 64 nt, Human
auaggccugggucccacucacccaugccggcagcugucaccaugugauuuauucuuggauaccu

SEQ ID NO: 66769 - RNA, 64 nt, Human
acuaguuaugcagagcaguugccuugggucccacugucaccaaggcaaccaguccugcugcuac

SEQ ID NO: 66770 - RNA, 64 nt, Human
aacccacccuguccucugacgucccuuucccaacugucaccaaacagaccaucuucccaggccu

SEQ ID NO: 66771 - RNA, 64 nt, Human
accaaguguuccugcaaggagagccucccacagcugucaccaugcuccaacucccacacaaacg

SEQ ID NO: 66772 - RNA, 64 nt, Human
auuuauuuauuuauuuugagauagagccuugcucugucaccaggccggagugcaguggugucau

SEQ ID NO: 66773 - RNA, 64 nt, Human
aggcacugaaugaggcgagggacccuuccuacauugucaccauccccaguaaaccuugggucau

SEQ ID NO: 66774 - RNA, 64 nt, Human; identical to SEQ ID NO: 66773

SEQ ID NO: 66775 - RNA, 64 nt, Human
caagcuauccuccaaccucagccugccaaguagcugucaccauagcuguucaucaccaugccua

SEQ ID NO: 66776 - RNA, 64 nt, Human
ccuucugcgacagcugcaguggcuuccucuggggugucaccaagcaaggcuaccgcugucgggg

SEQ ID NO: 66777 - RNA, 64 nt, Human
caucuacccaacugucaccaucuuugcaccaaacugucaccaucuuugcagcagaaggucacua

SEQ ID NO: 66778 - RNA, 64 nt, Human
gguccccagcucuaauuccauccaucuacccaacugucaccaucuuugcaccaaacugucacca

SEQ ID NO: 66779 - RNA, 64 nt, Human
caauaaaaguugagaaauguaccggcuuccauccugucaccaugacuuccucacauggucugcu

SEQ ID NO: 66780 - RNA, 64 nt, Human
gcguuuucuccccaccaagcccccacccuugcugugucaccaucacuacucaagaccggaggca

SEQ ID NO: 66781 - RNA, 64 nt, Human
agcuuuaagaaaucuuaacacauauauugauucaugucaccaccaccguaaucgagauucagaa

SEQ ID NO: 66782 - RNA, 64 nt, Human
aagauucagucacguuaccauaucaagcugaaaaugucaccacuaucuggagaguuggacaugu

SEQ ID NO: 66783 - RNA, 64 nt, Human
uuuuuuuuuuuuuuuuugagauggagucuugcucugucaccaggcuggaaugcaguggcgcaau

SEQ ID NO: 66784 - RNA, 64 nt, Human
uacuccauuucagccuguucugaauuggugacucugucaccaauaacgacugcggagaacugua

SEQ ID NO: 66785 - RNA, 64 nt, Human
uuauccagcacagccuucacguuuugcccucugcugucaccacuuggucagaaacuuccaaacg

SEQ ID NO: 66786 - RNA, 64 nt, Human
cauguccauacaccaugucacuuuacucuucauuugucaccaucuuuucccaugcacgcauacu

SEQ ID NO: 66787 - RNA, 64 nt, Human
auauuugaauagagcagauuguagaaugucgugcugucaccagaaagcugcuguuuuggguucu

SEQ ID NO: 66788 - RNA, 64 nt, Human
uauugaggcuagcccugaucaugcuuuuugugccugucaccaggucucccaagugcacucaucc

SEQ ID NO: 66789 - RNA, 64 nt, Human
aauuggaaccaugccacucuugagccacaauaccugucaccagccuguuguuuuaagagagaaa

SEQ ID NO: 66790 - RNA, 64 nt, Human
uugccagaagcugggguugccaucccgggguacaugucaccaguccucuugggguuuuguacca

SEQ ID NO: 66791 - RNA, 64 nt, Human
cuucuaagaugccagcauauacugaagucuuuucugucaccaaauuuguaccucuaaguacaua

SEQ ID NO: 66792 - RNA, 64 nt, Human
gaggagagaacagggcaagacguuugguuucauuugucaccauuuuuaaaacucuguaugcuag

SEQ ID NO: 66793 - RNA, 64 nt, Human
aauucuuccagcauucuaaaggaggguuugugauugucaccauuuacugaugaggaaacuaagg

SEQ ID NO: 66794 - RNA, 64 nt, Human
aggacucccuugaggcugaacccucucaaagggcugucaccaucaccugcugcuaggacacuac

SEQ ID NO: 66795 - RNA, 64 nt, Human
cagcugaaaccagucugaucaauuuuaugcuaccugucaccaagaaauuaacucuaaauuuuug

SEQ ID NO: 66796 - RNA, 64 nt, Human
uggcccuuccacccauuuuuaauugugagagauuugucaccaaucaucacugguuccuccuuaa

SEQ ID NO: 66797 - RNA, 64 nt, Human
ccagugagcggcccagaccccaccucugcgccauugucaccagggcccuguccuggcugcccuc

SEQ ID NO: 66798 - RNA, 64 nt, Human
uguaugauuuggucauaaguaaggacuauauuuaugucaccauuauuagauauauguacuuuug

SEQ ID NO: 66799 - RNA, 64 nt, Human
ggcagccaggagccagcugcguccguguguggucugucaccacggggccugcuucuuaucugac

SEQ ID NO: 66800 - RNA, 64 nt, Human
aguugauauauuuauuuaucagguaucuugcaguugucaccaaauacuguaguuuucuuauguu

SEQ ID NO: 66801 - RNA, 64 nt, Human
gggcuguccccugggcucuagaaagaacauucugugucaccagcacaggcucuugcugggugcc

SEQ ID NO: 66802 - RNA, 64 nt, Human
augccugagggcacgggggacacuuggaggcugcugucaccacugugcguccaaggccaugcuc

SEQ ID NO: 66803 - RNA, 64 nt, Human
cggccgagacauggcuugccacagcucuugaggaugucaccaauuaaccagaaauccaguuauu

SEQ ID NO: 66804 - RNA, 64 nt, Human
gccugggcguguuguggacucaggcacuggggccugucaccaaggcuccuccaacaugcgggag

SEQ ID NO: 66805 - RNA, 64 nt, Human
acaccccaaggaagccgacgauccaaaugccgugugucaccaaccccgcuucugccacuggcgg

SEQ ID NO: 66806 - RNA, 64 nt, Human
ggaagacaccgacaaugagaagaguuggucacccugucaccacugaaccuugauuuaacagagg

SEQ ID NO: 66807 - RNA, 64 nt, Human
gugugagugcagacuggaccugugguucauaccuugucaccacccgggaagcugaaggccacuu

SEQ ID NO: 66808 - RNA, 64 nt, Human
cucguuuucccugauccgugguguugcaguccguugucaccagccuuguuucuaguguguauau

SEQ ID NO: 66809 - RNA, 64 nt, Human
ucugugucguguucagugucacaaagcuaccaccugucaccagagccuacugcugcucuccacu

SEQ ID NO: 66810 - RNA, 64 nt, Human
ccuccaauguacaacuuccgcguguagugggcguugucaccacccacccuaccugcagaguuac

SEQ ID NO: 66811 - RNA, 63 nt, Human
gggagaaaacuuccaaauguuuauaaagaaagucugucaccacaguggucuggcuguguuucc

SEQ ID NO: 66812 - RNA, 64 nt, Human
uauauaauaaaagugccuuagcauguguugcagcugucaccacuacaguaagcugguuuacaga

SEQ ID NO: 66813 - RNA, 64 nt, Human
uagugcauagauaugaagacuugaugaaaccugaugucaccaaccuuggcuaaacacaaaugag

SEQ ID NO: 66814 - RNA, 64 nt, Human
cuggcagaggacagaaauguccagucaccuccgcugucaccacauccugagcacucggccccau

SEQ ID NO: 66815 - RNA, 64 nt, Human
augcauaagagcguaucucuccauucgaucaguuugucaccaucuuugcucuguuuugaaaguc

SEQ ID NO: 66816 - RNA, 64 nt, Human
uuuaauuugauguuuaccuaagccuuuaaggcugugucaccaagguauggccacaaggaagaau

SEQ ID NO: 66817 - RNA, 64 nt, Human
uaauuccaauaauuagggaaaauugauaaauaucugucaccaaaccacaagaaauccaaaauca

SEQ ID NO: 66818 - RNA, 64 nt, Human
acgccauagacagcggcaucuaccugaccacgcaugucaccaagucagcuaccucuucaguguu

SEQ ID NO: 66819 - RNA, 64 nt, Human
uuaagcugaaugcagaaaauuccaaaauaaaugaugucaccacaaugguguauacucaggaaug

SEQ ID NO: 66820 - RNA, 64 nt, Human
uccuacucccacccccaccacccccagucaccauugucaccacacucacccaucccaccccacc

SEQ ID NO: 66821 - RNA, 64 nt, Human
cuguuucccaggcuccuuuuuguguuuuuauaacugucaccaguuagccacuguuuaaauugua

SEQ ID NO: 66822 - RNA, 64 nt, Human
aggucacgaucauguuaccauaucaagcugaaaaugucaccacuaucuggagauuucgacgugu

SEQ ID NO: 66823 - RNA, 64 nt, Human
ggggguggauaggguggggucuccaucuacuuuuugucaccaucaucugaaauggggaaauaug

SEQ ID NO: 66824 - RNA, 64 nt, Human
uugcccgccagccucagugccacuugacauuccuugucaccagcaacaucucgagcccccugga

SEQ ID NO: 66825 - RNA, 64 nt, Human
gugccucugccucucugugucaggggacagcuugugucaccacgcccggcuaauuuuuguauuu

SEQ ID NO: 66826 - RNA, 64 nt, Human
guguuucucacggauggaauucuagucagcugcaggcgggaagccaggcggguggagcccaugg

SEQ ID NO: 66827 - RNA, 64 nt, Human
gaacuguuuaugaggcucuaguuguugcuguuguggcgggaaaguuaagaaacauagcccuuaa

SEQ ID NO: 66828 - RNA, 64 nt, Human
ggaaugggaaaaaagaaaacagauccugggagggggcgggaaauacaaggaauauuuuuuaaag

SEQ ID NO: 66829 - RNA, 64 nt, Human
auuaugcggcuauaaugcagagcccuacaauuaaggcgggaaugaggggcuggaggcagcaaac

SEQ ID NO: 66830 - RNA, 64 nt, Human
cuggucugggugccccguccacggcucuagguggggcgggaaagccagugacuccaggagagga

SEQ ID NO: 66831 - RNA, 64 nt, Human
caccaccagccagcggaagagcagcccucuggugggcgggaaaccaguguccccaccaucagcc

SEQ ID NO: 66832 - RNA, 64 nt, Human
uuuaguauccaaggaagagaccaaggagccagcuggcgggaaggggugggggugugcagucugc

SEQ ID NO: 66833 - RNA, 64 nt, Human
aaggcuaugguuuauugcaggggauugggaggggggcgggaaaacauggagaauuaagucagau

SEQ ID NO: 66834 - RNA, 64 nt, Human
ucaagaccagugaugggccggcuccgaggcuccgggcgggaaugggaccugcgcuccagggugg

SEQ ID NO: 66835 - RNA, 64 nt, Human
gcaucaggcccagacagagccuggcaggcauccuggcgggaaggaccagguccccucugggugg

SEQ ID NO: 66836 - RNA, 64 nt, Human
ccuucuccgagacgcugagagagcaggcauugcaggcgggaagaugccagaaauuaugcaagaa

SEQ ID NO: 66837 - RNA, 64 nt, Human
cucuggagugagaggcuccacccacuacagcacaggcgggaauagcacagcugcccucccaugc

SEQ ID NO: 66838 - RNA, 64 nt, Human
ugggagggaaguccuuguuggcagagggauguggggcgggaaugaggaaaggggagggcaugau

SEQ ID NO: 66839 - RNA, 64 nt, Human
cgcccugcgcuggacugguucaagcuuccgccucggcgggaacgcuguacauagucagguccgu

SEQ ID NO: 66840 - RNA, 64 nt, Human
cucacaauuugaagaugaaacuugucauuagguuggcgggaaugagacuaaagauugcgcugug

SEQ ID NO: 66841 - RNA, 64 nt, Human
ggcacaccguccuuuugucucugccuuugagguuggcgggaacugaaacugguacggucuuuuu

SEQ ID NO: 66842 - RNA, 64 nt, Human
acaccaguacuguaguucauaaugaguagguacaggcgggaaacugaauaauaagaagucauaa

SEQ ID NO: 66843 - RNA, 64 nt, Human
gagucaucaguaugaggggaacccccaccgcgucggcgggaagcgugggagguguagcuccuac

SEQ ID NO: 66844 - RNA, 64 nt, Human
uaauuacgauaaggaagaaacagaagagagaaggggcgggaauauuguuucuuuaucaccuggc

SEQ ID NO: 66845 - RNA, 64 nt, Human
caguauuggggauuacauuucaacuugagguuugggcgggaacaaauagucaaauuauauuacc

SEQ ID NO: 66846 - RNA, 64 nt, Human
gggagggguuuuuguuuguuuguuuguuuucuuaggcgggaacugcaaacagacucuuuucuga

SEQ ID NO: 66847 - RNA, 64 nt, Human
uagagauagggugggggagcuggggaagggugcaggcgggaagagugggcugucuuucccaggg

SEQ ID NO: 66848 - RNA, 64 nt, Human
aaacaaacggccuuuucgugugaaacaucuucagggcgggaaaggggccacuucuggcuuuguu

SEQ ID NO: 66849 - RNA, 64 nt, Human
acaggaggaggcaugcccgaggcagccaggacugggcgggaaggugcucccuggauauacucug

SEQ ID NO: 66850 - RNA, 64 nt, Human
auaggcuccuggcguggacaaggggucugugaagggcgggaacugggugagcaccuggggcagg

SEQ ID NO: 66851 - RNA, 64 nt, Human
uccagaauguccuuuuucacacagaggaagagauggcgggaaaacacugacugacuccuugggu

SEQ ID NO: 66852 - RNA, 64 nt, Human
auuuuucuuucugaugucaaaaaugucuuggguaggcgggaaggaggguuagggagggguaaaa

SEQ ID NO: 66853 - RNA, 62 nt, Human
uaaggaaguaucaucuauaagggagggcugggggcgggaaaagaaaaaaaaaagucauuuug

SEQ ID NO: 66854 - RNA, 64 nt, Human
aucuucucuuuuagugucauuacgagggagugauggcgggaaucucagucgcacucaagcucug

SEQ ID NO: 66855 - RNA, 64 nt, Human
gguggggcuggacggggacgaggcgcggagaggcggcgggaaagagcuucggcugggccacggg

SEQ ID NO: 66856 - RNA, 64 nt, Human
gggcccgggaacgccgagugcgcgccgucggggaggcgggaacgcgggcccgcgcgcggacuuu

SEQ ID NO: 66857 - RNA, 64 nt, Human
gugagaaggagcaggcacugggccuggaauggaaggcgggaaugaaugggccucugauggugag

SEQ ID NO: 66858 - RNA, 64 nt, Human
aagccuugaaaggcaggcuucacagugccgaguuggcgggaaaagcaaauucuuuugaagucuu

SEQ ID NO: 66859 - RNA, 64 nt, Human
uacaaaaagguuuucauguauuuguggcugagagggcgggaaauaauuguguacauaaaauuag

SEQ ID NO: 66860 - RNA, 64 nt, Human
agcagggggccuuuagcuaguuucucccgagaggggcgggaaguacagcugguggagacagugc

SEQ ID NO: 66861 - RNA, 64 nt, Human
cauuguguguggaaugucgcagacuccuccacguggcgggaaugagcuguguaaauacuucaau

SEQ ID NO: 66862 - RNA, 64 nt, Human
gaaggacgcccccugacuccaggccccugagccuggcgggaaguggcugcggcccaggcagcca

SEQ ID NO: 66863 - RNA, 64 nt, Human
gaaguggucaggaacaaucaucagcccuccucugggcgggaaucagagcagucaguccagcagg

SEQ ID NO: 66864 - RNA, 64 nt, Human
ucacaccgguaaucccagcacuuugagaggcugaggcgggaagaucacuugaggccagaaguuc

SEQ ID NO: 66865 - RNA, 64 nt, Human
gucccagcuacuugggaggcugaggcaggagaauggcgggaaccugggaggcggagcuuacagu

SEQ ID NO: 66866 - RNA, 64 nt, Human
uuaggaugagucuucuuuaaucaaucauauauugggcgggaaaaacaccagcuuugacccgaag

SEQ ID NO: 66867 - RNA, 64 nt, Human
gccugagacagagagggccaggcaccaaccacaaggcgggaaaguccauggguagacccucccc

SEQ ID NO: 66868 - RNA, 64 nt, Human
uguggcuguuuagaggcagcuggauccucuuucaggcgggaaugggagggcgggcacagggagg

SEQ ID NO: 66869 - RNA, 64 nt, Human
uuuggaccaagugggaaacaagaacacucggaggggcgggaaucagaagagccuggaaaaagac

SEQ ID NO: 66870 - RNA, 64 nt, Human
gcugugcagucagaggcccaggguccagcagcccggcgggaacgggugcugccucuuccuccag

SEQ ID NO: 66871 - RNA, 64 nt, Human
caugugggucagggaucugggggcccccccagcuggcgggaaccccaaauggacacaaacugua

SEQ ID NO: 66872 - RNA, 64 nt, Human
ccacuccgcaagauggacagggagccagcaggcaggcgggaagggccaaguacaggcaaucacc

SEQ ID NO: 66873 - RNA, 64 nt, Human
acgucugucugggcgaaggguagggguggguaggggcgggaagccugagugcaaaugucauuuc

SEQ ID NO: 66874 - RNA, 64 nt, Human
gggccugggugcugaaagccaggauuuggggcuaggcgggaagauguucgcccaauugcuuggg

SEQ ID NO: 66875 - RNA, 64 nt, Human
aaucacgggcuaugcccggggagcugucgggaguggcgggaaucggggccaugcccggggagcu

SEQ ID NO: 66876 - RNA, 64 nt, Human
gaaucggggccaugcccggggagcugucgggaguggcgggaaucggggccaugcccggggagcu

SEQ ID NO: 66877 - RNA, 64 nt, Human
gaaucggggccaugcccggggagcugucgggaguggcgggaaauggggggcaucaccaugccug

SEQ ID NO: 66878 - RNA, 64 nt, Human
gcgagguggcuggacagcaccagcagcgcaucccggcgggaacccagaaaaggcuucuuacaca

SEQ ID NO: 66879 - RNA, 64 nt, Human
ggagagauccaggacugagccagccucaggccagggcgggaaagcaggcuguccaggcugggcu

SEQ ID NO: 66880 - RNA, 64 nt, Human
cacccucuguaauuuuaagauguaugugguggccggcgggaagaccagccccgacagcaccucc

SEQ ID NO: 66881 - RNA, 64 nt, Human
ggaaacagaaaagagaagaaagaagcacucugcuggcgggaauacucuuggucaccucaaauuu

SEQ ID NO: 66882 - RNA, 64 nt, Human
uccuggccacuaggccaagaggcccuaugaagguggcgggaacucagcuucaaccucgaugucu

SEQ ID NO: 66883 - RNA, 64 nt, Human
ccccugucuggaagacguggcucugggugagguaggcgggaaaggauggaguguuuuaguucuu

SEQ ID NO: 66884 - RNA, 64 nt, Human
agacgcagccgaggugggagcacgggcaggcucaggcgggaagaaggaggcaucguccaguaag

SEQ ID NO: 66885 - RNA, 64 nt, Human
aaaaacaguuagccagacuguuuuuaaagcaccuggcgggaagcagaagguuggauccaagccc

SEQ ID NO: 66886 - RNA, 64 nt, Human
aaccucagccgcagccuccgggggacaggcccagggcgggaaauggagccggagaagcuugagc

SEQ ID NO: 66887 - RNA, 64 nt, Human
uccaucucccagcauccaucugcauucagcuaagggcgggaaacugaccuagugccuguguugc

SEQ ID NO: 66888 - RNA, 64 nt, Human
aagccugagggaaauggggcccuaggagggugggggcgggaaggaggggcaaggucuuucagga

SEQ ID NO: 66889 - RNA, 64 nt, Human
ccuccuucccuuccagcucuguccuaggagcauaggcgggaaaucugaguagagucugacugca

SEQ ID NO: 66890 - RNA, 64 nt, Human
ggauugccuuuccuguggaaccacugcuuccccaggcgggaagaaagagggaguucuggccacc

SEQ ID NO: 66891 - RNA, 64 nt, Human
cugcauguuggcccagaccucaggugcuagggaaggcgggaaccuuggguugaguaaugcucgu

SEQ ID NO: 66892 - RNA, 64 nt, Human
ucacaccuguaaucccagcacuuugggaggcugaggcgggaagaucacuugaguucaggaguuu

SEQ ID NO: 66893 - RNA, 64 nt, Human
uccauagcugcucugcagggcggaagacaccuggggcgggaaagcaccccugaguuccaucuuc

SEQ ID NO: 66894 - RNA, 64 nt, Human
uuuuuuuugagacggggccuugcugugucccccaggcgggaauacagugccaugaucauagcuc

SEQ ID NO: 66895 - RNA, 64 nt, Human
ucuccucucuccgccaccggcuucugaacagccuggcgggaaauguagucccaagcuuucacuc

SEQ ID NO: 66896 - RNA, 64 nt, Human
gcugcuuccucucugcuccuacgcauccuguccuggcgggaagagagcgucuggguccauucaa

SEQ ID NO: 66897 - RNA, 64 nt, Human
gcauccuugucccccucacccacccagagcuaggggcgggaacagcccaccuuuugguuggcac

SEQ ID NO: 66898 - RNA, 64 nt, Human
ggagguggaugguucuuauucuguggagaagaagggcgggaagaacuuccuuucaggaggaagc

SEQ ID NO: 66899 - RNA, 64 nt, Human
ucaugcccauaaucccagcacuuugggagauggaggcgggaaaaucauuugaggucagaaguuc

SEQ ID NO: 66900 - RNA, 64 nt, Human
gcggggccguacugcggggcuggggcggggagcgggcgggaaauggaacugugacggucccggc

SEQ ID NO: 66901 - RNA, 64 nt, Human
uacugcugaugucucuguuggggaucagagggcuggcgggaacgcgagaagggcaccagcagca

SEQ ID NO: 66902 - RNA, 64 nt, Human
caauugcaggucggcuuggcugggagagauggauggcgggaaaggggcagcagucuugaggagc

SEQ ID NO: 66903 - RNA, 64 nt, Human
gucgucggcauccaggccugugccggcuucacguggcgggaagacccucugcaagggggacagg

SEQ ID NO: 66904 - RNA, 64 nt, Human
auuaauacucugcagugauuagaaggggugggguggcgggaauccuauuuaucagacucuguaa

SEQ ID NO: 66905 - RNA, 64 nt, Human
ugccauucuuaaccaaggcugccucuuccaacagggcgggaaucagaccuacuccccuagguca

SEQ ID NO: 66906 - RNA, 64 nt, Human
caggagagagggagcuggcggugcccagcgcaagggcgggaaggaggggcccaggcugcggaga

SEQ ID NO: 66907 - RNA, 64 nt, Human
gucccagcuacuugguaggcugaggcaggagaauggcgggaacccgggaggcagagguugcagu

SEQ ID NO: 66908 - RNA, 64 nt, Human
ccugcagcgggccggccagagggggccccgggggggcgggaacugggagggaagggugagacgg

SEQ ID NO: 66909 - RNA, 64 nt, Human
cugagcagacccacuccagcuuucuggugucacaggcgggaauguuaguuaguagguagacuua

SEQ ID NO: 66910 - RNA, 64 nt, Human
ugcugguacccacugcccacccuggcugccgcugggcgggaaccccaacagggccccgggaggg

SEQ ID NO: 66911 - RNA, 64 nt, Human
uggaggcggggcucggccccgggccacuucacggggcgggaaggggaggggaagaagagucuca

SEQ ID NO: 66912 - RNA, 64 nt, Human
ccaauuuuuuuuccugccuuauuuagaauucuuuggcgggaaggguaugauggguucccagaga

SEQ ID NO: 66913 - RNA, 64 nt, Human
ccucuggggcccuuuucuuacaguaacugaguguggcgggaagggugggcccuggaggggccca

SEQ ID NO: 66914 - RNA, 64 nt, Human
ggcccuccucagcacggugccuccgagguuuugaggcgggaacccucuggggcccuuuucuuac

SEQ ID NO: 66915 - RNA, 64 nt, Human
ccgcugcucggcggaucccagcugcgguggcgacggcgggaaggcgcuuuccgcuguuccucag

SEQ ID NO: 66916 - RNA, 64 nt, Human
cugcagccgcuccuggauuggagcagugugcucuggcgggaagggcccaucccguuggucgagg

SEQ ID NO: 66917 - RNA, 64 nt, Human
uccucaaagcuuuuuuuuuuuuuccuggcuggggggcgggaagggcagacugcaaacugggggg

SEQ ID NO: 66918 - RNA, 64 nt, Human
uccucaggcaaggucuggccucaggugggccgcaggcgggaaaagcagcccuuggccagaaguc

SEQ ID NO: 66919 - RNA, 64 nt, Human
gggggcugucaugcgguuuccaaggugcacauuuuccacggaaacagaacucgaugcacugacc

SEQ ID NO: 66920 - RNA, 64 nt, Human
uguuaaaaugcagaggaaucuggaaauauuuauauccacggaguccuuggauccagugcuacgu

SEQ ID NO: 66921 - RNA, 64 nt, Human
gggaacacauuccgggagagaugccuggccaggcuccacggaucccgccagaaacaccaacaga

SEQ ID NO: 66922 - RNA, 64 nt, Human
aagaaugcagaagcaaaggaaggacuaaaaagccuccacggacaucgauaaucaagagauuauu

SEQ ID NO: 66923 - RNA, 64 nt, Human
ccccucugaauccugaaaccccucuugccucucuuccacggaagagggccugggccccguggag

SEQ ID NO: 66924 - RNA, 64 nt, Human
uuuagggauagugagguuccugccuucacuaggauccacggauaugagaccauuuuugucauuu

SEQ ID NO: 66925 - RNA, 64 nt, Human
caguagguaauggcuccggcccggguguucgcuguccacggaacauggcagaggggcaccccgg

SEQ ID NO: 66926 - RNA, 64 nt, Human
cagccccgacucucagcacugugccucagauggcuccacggagacccuggccaugguuguggua

SEQ ID NO: 66927 - RNA, 64 nt, Human
ggaggcgauggccaccccagaggccaccuuuugcuccacggaggugggagaaaaucugggcaca

SEQ ID NO: 66928 - RNA, 64 nt, Human
ggccgggcgugcgggcggggacaugguaaccugguccacggagggcggccgccacccucgcgua

SEQ ID NO: 66929 - RNA, 64 nt, Human
ggcuguuauguaugaaaugugccucugacccaaauccacggacuuugcgaaaaucaccaaggag

SEQ ID NO: 66930 - RNA, 64 nt, Human
ucccacugcugauuauugagaaaaauauccuuucuccacggaauugucuuggcauccuugcuaa

SEQ ID NO: 66931 - RNA, 64 nt, Human
ccacugagagaucugcugucagucugcuuauccuuccacggacucaaguuucuucaaucugaag

SEQ ID NO: 66932 - RNA, 64 nt, Human
ggcagggcagcaggaggcuuucugggcucuggacuccacggaugcgugggcagaggaauguggg

SEQ ID NO: 66933 - RNA, 64 nt, Human
cacgaccagaacuaaaaugcaauauacaguuaaguccacggauacucccauuaaugagaaauaa

SEQ ID NO: 66934 - RNA, 64 nt, Human
agcaggguguccccggaggagagguuugggaagcuccacggagaggaacgcucucugcuuccag

SEQ ID NO: 66935 - RNA, 64 nt, Human
gagggaguggcuguguugguuuggggaacuaauuuccacggacggcugcccguggacaccaggu

SEQ ID NO: 66936 - RNA, 64 nt, Human
ccagcauugguuauagucaugggaaaggaagguguccacggaggcacacuuaacaagaaagcau

SEQ ID NO: 66937 - RNA, 64 nt, Human
uggccgcggugguggaggcguucuuauaccacguuccacggaggagugaggagcccaggaacga

SEQ ID NO: 66938 - RNA, 52 nt, Human
ccaagauggagaagaucugaccuccacggagccgcuguccccgccccccugc

SEQ ID NO: 66939 - RNA, 64 nt, Human
aacacugcaguguuauuuucuuugaaauucauccuccacggacccauucauacuaaauaaaaca

SEQ ID NO: 66940 - RNA, 64 nt, Human
cuuccauaaucaaguaaauuuuaauuuucaucauuccacggagauucagucugucuggaauccc

SEQ ID NO: 66941 - RNA, 64 nt, Human
cagaggagaucaaaccccguucgugugucuuuccuccacggauaagcuugggaggucauuguuu

SEQ ID NO: 66942 - RNA, 64 nt, Human
gcacagaaaccauugggggggauucagaggugcauccacggaucuucuugagcugugacguguu

SEQ ID NO: 66943 - RNA, 64 nt, Human
uauugguaucggagggcgguccuggaaccaagcauccacggauacugaggggugacauuucaug

SEQ ID NO: 66944 - RNA, 64 nt, Human
gacagaccuucggggccugucugaagccauagccuccacggagagcccuguggccgacucugca

SEQ ID NO: 66945 - RNA, 64 nt, Human
uauuuaugagaaaccucgggccuuuggcgagagcuccacggaaagugaugaggaggaagaagag

SEQ ID NO: 66946 - RNA, 64 nt, Human
ggagaaggccaggggaaugaauucaagagagauguccacggacgaaacauacggugaauaauuc

SEQ ID NO: 66947 - RNA, 64 nt, Human
ggccgucagacuuggauacaucguaaacuccgccuccacggaacgucucgccuugcgagcaagc

SEQ ID NO: 66948 - RNA, 64 nt, Human
cugaaagggggggcuauggaagagcgguagggaguccacggagaagaugcagugaaugcuugca

SEQ ID NO: 66949 - RNA, 64 nt, Human
ugcugaucaauuucucauuaccccuacacaucucuccacggagcccagaccccagcacagauau

SEQ ID NO: 66950 - RNA, 64 nt, Human
cggacacagcgggacgcggccggcggccucagaguccacggagcucgcggcgaggacgacuucu

SEQ ID NO: 66951 - RNA, 64 nt, Human
gauggacaagcacauggcaaucucaaggcagcuuuccacggagcaggcuguucugcaagagucg

SEQ ID NO: 66952 - RNA, 64 nt, Human
gagcagaggaaaccccuuccugggccugcugcccuccacggagcagcagcacccuccagcaggc

SEQ ID NO: 66953 - RNA, 64 nt, Human
gcaggcccuggugggaccacccagccugguauuguccacggacagcguuguucacccagagccu

SEQ ID NO: 66954 - RNA, 64 nt, Human
auuggagcuccaauucgugacccacucagccuuauccacggagcuggagccaaccuacgugcca

SEQ ID NO: 66955 - RNA, 64 nt, Human
gggcagcagcugcagauccacuuaggccccaggguccacggauggccccaaaggcugagggccc

SEQ ID NO: 66956 - RNA, 64 nt, Human
ggccauuauuguacuugccuuauuagagugucuuuccacggagccacuccucugacucagggcu

SEQ ID NO: 66957 - RNA, 64 nt, Human
gaauauacagauuuaggugcuaaaccauuuauuuuccacggaugagucacaaucugaagaauca

SEQ ID NO: 66958 - RNA, 64 nt, Human
agccuggaacgcagagaggucuuuacugcugggauccacggaaaacaugucuguccuagccaag

SEQ ID NO: 66959 - RNA, 64 nt, Human
ucuuguauuauuuaaacgguugugguuuccuuuuuccacggagguucaauagaagccgcugcag

SEQ ID NO: 66960 - RNA, 64 nt, Human
ggucuaagggguugguugagguggaagcccuccuuccacggauccauguagcaggacugaauug

SEQ ID NO: 66961 - RNA, 64 nt, Human
cuuccaagagaacgggacuccggaagaagacgucuccacggagcccucgggaccugcugcacca

SEQ ID NO: 66962 - RNA, 64 nt, Human
gcaggugacacucgcggccuggaaggagaagguguccacggagcccccacccauccucggcggu

SEQ ID NO: 66963 - RNA, 64 nt, Human
auuuacauccuagcaagaaucaacacuguaucaguccacggaccugcugagcugcagccacuug

SEQ ID NO: 66964 - RNA, 64 nt, Human
gaugugcucccggggccugccuccugcacggggcuccacggagcccagcucccagacacgcuac

SEQ ID NO: 66965 - RNA, 64 nt, Human
uuggcaacagcaaaaucaugggacaacaccucucuccacggaaaggucacaguggacagcccgg

SEQ ID NO: 66966 - RNA, 64 nt, Human
aguccccaaccuuuuuggcaucagggacaguuuuuccacggaugggugacaggggaugguuuug

SEQ ID NO: 66967 - RNA, 64 nt, Human
cuccgcaggcagcccuggucuucagccccucccauccacggagugagcuggggcugaaguuguc

SEQ ID NO: 66968 - RNA, 64 nt, Human
gagcgcauuccccaggcaguucccaugcaggugauccacggaccacauguugagaaacugcagu

SEQ ID NO: 66969 - RNA, 64 nt, Human
ggcccaggcuauguccucgugagagguacugggguccacggauauguguuguggggcagacagu

SEQ ID NO: 66970 - RNA, 64 nt, Human
uuuuguaguaacaacuauuggguccugucagaccuccacggacagcaaagugguuuuaaugcaa

SEQ ID NO: 66971 - RNA, 64 nt, Human
augagcagucccccuucccccauacccugcugucuccacggagggaggucacagcccaucacgc

SEQ ID NO: 66972 - RNA, 64 nt, Human
uuggccuccaggacaucugcacccccuccccaccuccacggaccucggaccuccaggcggcuca

SEQ ID NO: 66973 - RNA, 64 nt, Human
ugagcaguaccagugugcuugcccaccacagcgauccacggagcugaagcugggagcuacaggg

SEQ ID NO: 66974 - RNA, 64 nt, Human
ggucuagaauugauucuccuuuccugaguuuuacuccacggagucuuagguaccugguaaaaag

SEQ ID NO: 66975 - RNA, 64 nt, Human
agucauuccuacucaaauguaauaaaauugaggcuccacggaggcccguguccacaucagcugc

SEQ ID NO: 66976 - RNA, 64 nt, Human
gagacgggauggagacacggggcaggaccuuccuuccacggagccugcggcugccgggcgggug

SEQ ID NO: 66977 - RNA, 64 nt, Human
ucugugagcucgcaccuuacugggugcaaaagaauccacggaacuugggagaaguccaguuccu

SEQ ID NO: 66978 - RNA, 64 nt, Human
ggcacggagccagauggccagucuccaggccugguccacggacuggcagggaccccaggcacaa

SEQ ID NO: 66979 - RNA, 64 nt, Human
cccuucgaggaaggugucaccuggaccccuucauuccacggaggaagcugaggccacagggagc

SEQ ID NO: 66980 - RNA, 64 nt, Human
cagggagcggccaucgccauugggaaggggcgacuccacggaaagcccagacgggcuucugcau

SEQ ID NO: 66981 - RNA, 64 nt, Human
gggccucccaccccagccucccugaggcccauacuccacggagaggagccccaugcccagccug

SEQ ID NO: 66982 - RNA, 64 nt, Human
agccauaugccggccagccgcgccuccuccucuguccacggaaccgcugcccaucuaaccuucg

SEQ ID NO: 66983 - RNA, 64 nt, Human
cacuggccggcacccccugcugggucuccugcauuccacggagccccugcugccagggcggugu

SEQ ID NO: 66984 - RNA, 64 nt, Human
gcgugucguccaaacagcagugccugcgucccgcuccacggagucuuccagaacaccucccucu

SEQ ID NO: 66985 - RNA, 64 nt, Human
gaaucugagggcgucggggcagcgaaccuuugcauccacggacuccuccuucccuaguccugcu

SEQ ID NO: 66986 - RNA, 64 nt, Human
augacugaagacugguggucgugugugugcggaguccacggaagccucggggagguggagcugc

SEQ ID NO: 66987 - RNA, 64 nt, Human
ccuucagaagguggaugugguggccgagaccccguccacggagggugauggccuuucccuucug

SEQ ID NO: 66988 - RNA, 64 nt, Human
uccugggagucuggugugucuccuacaugcaauuuccacggacccagcucuguggagggcauga

SEQ ID NO: 66989 - RNA, 64 nt, Human
gcugucuuuguaccacugcagcaucccccacuucuccacggaagccccaucccaaagcugcugc

SEQ ID NO: 66990 - RNA, 64 nt, Human
cacgcugcucaugaaaguuuccacccacgcugucuccacggaacagccuccgucugcuggcucu

SEQ ID NO: 66991 - RNA, 64 nt, Human
uguaaaaagagaagaaaguggcagguuuuccagguccacggaaagguuuggccugacgcuggag

SEQ ID NO: 66992 - RNA, 59 nt, Human
gcaggcccauguccuguugaucaaagcaguccacggauauuuugauccaagagagaauu

SEQ ID NO: 66993 - RNA, 64 nt, Human
aaaugaaaacucuauuguuaccucugaguuguguuccacggaaaaugcuauccagcagaucauu

SEQ ID NO: 66994 - RNA, 64 nt, Human
acccagagugaccccugccccaccccugugcauuuccacggacuggagagauguucccgucugg

SEQ ID NO: 66995 - RNA, 64 nt, Human
uggaauuguggguaaauuauuauguacgauggaauccacggaugagaccucagguaucuuuuug

SEQ ID NO: 66996 - RNA, 64 nt, Human
accuccgaggaugaaaagauggcugccugcagcuuccacggaaucccucccucacugccagagc

SEQ ID NO: 66997 - RNA, 64 nt, Human
cugcaaagccaagacccuucugcagccacgaauguccacggagcccgccggcaggaaggaagac

SEQ ID NO: 66998 - RNA, 64 nt, Human
uauugugaagaaauaauguuaauauaaguaucuggugaaggaccaaaaccgugugauaagguug

SEQ ID NO: 66999 - RNA, 64 nt, Human
ucaaaggauaggccuuugaguguuagagaaaggagugaaggaggcaggugggaaaugguauuuc

SEQ ID NO: 67000 - RNA, 64 nt, Human
ucucuucuagcuugguaaugaaguauauuuauuggugaaggaaacagcugcugcugcuucuccu

SEQ ID NO: 67001 - RNA, 64 nt, Human
gacauuacagguuaugcuuugagaucucuuuggggugaaggauugaaauuaaacccugagccac

SEQ ID NO: 67002 - RNA, 64 nt, Human
gauugauuuugauuuucacugccaagccaaucaugugaaggacagaagcuuuugccaugggccc

SEQ ID NO: 67003 - RNA, 64 nt, Human
gcuuccucaguuugcuaacuccccaugcaucuuugugaaggacaguaucuaguuuaucuguagg

SEQ ID NO: 67004 - RNA, 64 nt, Human
gauacagugaaaugagccagggcgaggagggagggugaaggaacggagggcgggcggcuccgag

SEQ ID NO: 67005 - RNA, 64 nt, Human
caaaguacauguauuuuuaauauaugcaucccuggugaaggaucuugccugcaugaaacauguu

SEQ ID NO: 67006 - RNA, 64 nt, Human
acaacugucuaaugacacgguaggccaagcugaagugaaggagaaaggagccggaccaagaugg

SEQ ID NO: 67007 - RNA, 64 nt, Human
gggauugaggauuaucuucucucagaaaggcauugugaaggaauugagccagaucucucucccu

SEQ ID NO: 67008 - RNA, 64 nt, Human
ccaagaagucuggcuccugcuuuucuacaugccugugaaggagacuuuucaugaaacugaauaa

SEQ ID NO: 67009 - RNA, 64 nt, Human
aaagauaagaaaaaggcuauuaauaucauacuaagugaaggacaggaaaggguuuuauucauaa

SEQ ID NO: 67010 - RNA, 64 nt, Human
ggcaccaggaugcagagaaucagacuggccugaggugaaggagcacacagcccugagggcuugg

SEQ ID NO: 67011 - RNA, 64 nt, Human
gcaguccuagcguagcgaacguuccuggaguggggugaaggauaucaauauacuaaguuuuaac

SEQ ID NO: 67012 - RNA, 64 nt, Human
aauuaucugaacuggagaagcaauaaaaauuaaagugaaggaaaauacugaacucugucugagu

SEQ ID NO: 67013 - RNA, 64 nt, Human
uuaagaaaagagaaagagaaaaggaauuaauucagugaaggaugauuuugcuccuaguuuugga

SEQ ID NO: 67014 - RNA, 64 nt, Human
ugucuuccagcaacaacccucacauaugcacugagugaaggaugaauguauggacacaucuggg

SEQ ID NO: 67015 - RNA, 64 nt, Human
uuucgguccaacaacaggaaaccugacuggggcagugaaggaagggauggcauagcguuaugug

SEQ ID NO: 67016 - RNA, 64 nt, Human
uugucuuuuauucugccacauuuauugauaaacagugaaggaauuuuuaaaaaauuuuuaagaa

SEQ ID NO: 67017 - RNA, 64 nt, Human
cauauacccaagaacaagagauaccuuuaagccagugaaggauacuugcgauagaaucauccgc

SEQ ID NO: 67018 - RNA, 64 nt, Human
ccaggaugucacauguucccuuaccccuguaccugugaaggauuggcagugcuugugccugacc

SEQ ID NO: 67019 - RNA, 64 nt, Human
cuuucuccuggauccugcccugcucucagccauagugaaggaccagcccuaggagucugcgaga

SEQ ID NO: 67020 - RNA, 64 nt, Human
gggaggcugggaagaggugggaggaggggcagaagugaaggaagaauaggaaggauauuaccuc

SEQ ID NO: 67021 - RNA, 64 nt, Human
uucugccacuaucaaaguuccagcuaccugcaaggugaaggaaggcaucccuuuuggggcaugc

SEQ ID NO: 67022 - RNA, 64 nt, Human
uuuauucuauuuaugguucccgggaaguuguuuggugaaggaagccccucccugggcauuuucu

SEQ ID NO: 67023 - RNA, 64 nt, Human
gaugccucaggaggagaacccuccccaguguacugugaaggaugacacagcacuucuuccuaau

SEQ ID NO: 67024 - RNA, 64 nt, Human
uguguggcauuaucaaaaugaagaggagcaaggagugaaggagugggguuaugaaucugccaaa

SEQ ID NO: 67025 - RNA, 64 nt, Human
uggggguggacagggcauggauucuucauugcaagugaaggagccucccagcucagccacgugg

SEQ ID NO: 67026 - RNA, 64 nt, Human
aauagcaauguguuuugcaacauauuaagaguaugugaaggaagcagggaugucgcaggaaucc

SEQ ID NO: 67027 - RNA, 64 nt, Human
uccaucaauccaagaaagaguugcuuuguggaaggugaaggaagacccacagagugcucaggau

SEQ ID NO: 67028 - RNA, 64 nt, Human
uaaauccucaugucuuugagggaucccaccacaggugaaggaaguaaagaccacuucuccccca

SEQ ID NO: 67029 - RNA, 64 nt, Human
ggcaggggagagagggaaaugccaaaaacuuggagugaaggaugaugcuauuuuuuauuuuuaa

SEQ ID NO: 67030 - RNA, 64 nt, Human
cguggagcuugcgaggcagcguggacuggugacugugaaggaaggcccccgugguagaaugagc

SEQ ID NO: 67031 - RNA, 64 nt, Human
ugccgcccugcuccacgcagucugcuucagugcagugaaggaaccguggagcaugcaacacauc

SEQ ID NO: 67032 - RNA, 64 nt, Human
cagacucaguggcagaacaugcagcagaaaagcugugaaggaaggaaauuuacgugauuguaau

SEQ ID NO: 67033 - RNA, 64 nt, Human
cccugcacuccagcucgccccuuucccgcgcgaagugaaggaugcgucacuuuucugagcggcc

SEQ ID NO: 67034 - RNA, 64 nt, Human
uugggggaaaaugcaauaauuuuugaugagaugggugaaggacaagaagugaguugugucaauu

SEQ ID NO: 67035 - RNA, 64 nt, Human
uggaaucacugccuccugugauuugaaggccauugugaaggaaaacaaugcagugaaagaaagu

SEQ ID NO: 67036 - RNA, 64 nt, Human
ugcgcgcggugccggcugggucuguaccaaaggugugaaggaaagaagacaccgaccacggcga

SEQ ID NO: 67037 - RNA, 64 nt, Human
ggcuugucuagacaugguuuuaagaauagcugacgugaaggaagaggauuuauugcugcaguac

SEQ ID NO: 67038 - RNA, 64 nt, Human
cuaaaaguaucgagaacagcuuucuuucccaggggugaaggauggcgcucgggggugacuccua

SEQ ID NO: 67039 - RNA, 64 nt, Human
auuaggauuucaugauuuuuuuuuuucaguccccgugaaggagagcccuucauuuggagauuau

SEQ ID NO: 67040 - RNA, 64 nt, Human
cugggagacuuacugcauugccgacagcacagaugugaaggacaugagacuaagagaaaccuug

SEQ ID NO: 67041 - RNA, 64 nt, Human
uuccucacuccuuuuacucacugggcucaugacagugaaggagaugcuccaucugcuucucccc

SEQ ID NO: 67042 - RNA, 64 nt, Human
auacgcaacauaauucacauaauuuguaugcagugugaaggagcagaaggcaucuucucacugu

SEQ ID NO: 67043 - RNA, 64 nt, Human
caagaaaaaaacaaacaaccccaucaaaaagugggugaaggacaugaacagacacuucucaaaa

SEQ ID NO: 67044 - RNA, 64 nt, Human
caacaacaacaaaccacaaaauuauuugaguacugugaaggauuauuugucuaacaguucauuc

SEQ ID NO: 67045 - RNA, 64 nt, Human
ucaaagggaggcaucaggaauagaaugaaacugugugaaggauaagauuguucgcaucaagauc

SEQ ID NO: 67046 - RNA, 64 nt, Human
uugcugaaaucaagcacauauuuugaaauggacugugaaggaaaaggggacaggaacaaaggac

SEQ ID NO: 67047 - RNA, 64 nt, Human
cggaggcagcuuuaaccagcccccagggaugauugugaaggaggccccuccccuugugaggagg

SEQ ID NO: 67048 - RNA, 64 nt, Human
ggagagggcugugccccguagggacagugcccaggugaaggaugccccugguccuccagggcac

SEQ ID NO: 67049 - RNA, 64 nt, Human
ucacggugggcucuuccccuugguuuguaacgaagugaaggaggagaacuugggagccagguuc

SEQ ID NO: 67050 - RNA, 64 nt, Human
uucugacauuuccuaggaagcuaggaaaaggaaagugaaggaauggucuaaagaaaugaccauu

SEQ ID NO: 67051 - RNA, 64 nt, Human
cagguagaaaaucagggcaggagagaauauaauugugaaggagucagggcuaacaccuggaucu

SEQ ID NO: 67052 - RNA, 64 nt, Human
auuguuuucugucauuugccuacuggggaagaaagugaaggaggggaaacuguuuaauaucaca

SEQ ID NO: 67053 - RNA, 64 nt, Human
ggaagaaaaggcugccgcaacaucucagcgaggagugaaggacccaugucccaggaaccgcgcu

SEQ ID NO: 67054 - RNA, 64 nt, Human
auuuaagauaccgaagucuuaaagugaccuggacgugaaggaaaaaguaagaugagaaauaaag

SEQ ID NO: 67055 - RNA, 64 nt, Human
acacaauuuuaggccucaauuuuuuuuuuuuucugugaaggaacuugaagugaugcauguguga

SEQ ID NO: 67056 - RNA, 64 nt, Human
agguaguuacuguuuucaccagaaaagguaaugagugaaggaaagaauaguagcagaaagcaca

SEQ ID NO: 67057 - RNA, 64 nt, Human
cauuuagucagucccccaaacagucaugccaacugugaaggaaugucccacaaaacauuuccau

SEQ ID NO: 67058 - RNA, 64 nt, Human
aauaaaugcacacuucugacuauaauuuugagcagugaaggaaggaugacugccuguuacacag

SEQ ID NO: 67059 - RNA, 64 nt, Human
uugauuagagguuugggcauauaaccagauuaaagugaaggaacuuucuguuguuuuuguagca

SEQ ID NO: 67060 - RNA, 64 nt, Human
gugugugcauucugagaccucuuguauucaaucugugaaggauauguguauuaauccguacacc

SEQ ID NO: 67061 - RNA, 64 nt, Human
cacagaguacaaaauaguuguaggggaaaucaaggugaaggaucuguccgacagucaagacgga

SEQ ID NO: 67062 - RNA, 64 nt, Human
uccuugaagccuuuacuuuuuuuuuuuuuuggaagugaaggaaaaagaaacuauuuacagcacu

SEQ ID NO: 67063 - RNA, 64 nt, Human
ucucccacccuuucugccagggauggcaguggcugugaaggaguaaugggauaugggguuacuu

SEQ ID NO: 67064 - RNA, 64 nt, Human
ucuggugcuuagagacuaucaacucccuccuuuagugaaggagccguguuagagcuuccgagaa

SEQ ID NO: 67065 - RNA, 64 nt, Human
uugcaacuggaugacacaagauuuuacuugaacagugaaggacaaaaaucaugauuguggaaga

SEQ ID NO: 67066 - RNA, 64 nt, Human
ugcacccucugcccgccuuggggucugcugggcugugaaggagaauaaagaguuaaacugucag

SEQ ID NO: 67067 - RNA, 64 nt, Human
uugcguaagaaacagaguagauagacuaaauucagugaaggaaaggaauugagagauuuuucuu

SEQ ID NO: 67068 - RNA, 64 nt, Human
gaagggauucuauggcucagaggcccaggguguggugaaggaccuggagccggaacugcugcgg

SEQ ID NO: 67069 - RNA, 64 nt, Human
gacagagacagagcgugcacacguagaguggcuagugaaggacgccuuuuugacucuucuuggu

SEQ ID NO: 67070 - RNA, 64 nt, Human
cagugaaagcccaaguccuuggaagcuuuccccagugaaggacugacugggggccucacgcuua

SEQ ID NO: 67071 - RNA, 64 nt, Human
gaaaaaaaauuuuuuaaauaaguuuaauuauaaagugaaggaccaguuggaccacggaccccua

SEQ ID NO: 67072 - RNA, 64 nt, Human
gccucaacugagaaggugaaaugugagcaaagacgugaaggaagccagggagguagcagguagc

SEQ ID NO: 67073 - RNA, 64 nt, Human
ucuuguuugaaggagguggugaugguggauagaggugaaggagguagggagugcccuccaagug

SEQ ID NO: 67074 - RNA, 64 nt, Human
gacaccuguaaagggucggugcugaggaggaauagugaaggagggaggccucuuugcaguugag

SEQ ID NO: 67075 - RNA, 64 nt, Human
uuauuauuuuucuuauaggcuuuuuguuaaaauagugaaggaacaaauguuaaaggguaagaua

SEQ ID NO: 67076 - RNA, 64 nt, Human
uuuuuagcuguagccuggaauccauauauauaaagugaaggagggcagaccacacgcccucuca

SEQ ID NO: 67077 - RNA, 64 nt, Human
gcacauuuuauaauuuggaagacacaaaucaaaugugaaggauuugauuuucuacauuuaaaau

SEQ ID NO: 67078 - RNA, 64 nt, Human
caugacugccccgccauuucauccuaggcauucugugaaggagauugguuaguccaaacuugcu

SEQ ID NO: 67079 - RNA, 64 nt, Human
aaagggaacaaauaauguuucauccuauggaaaugugaaggaugaauugagcuccuggcccuuc

SEQ ID NO: 67080 - RNA, 64 nt, Human
uauaugggaguauuaaaauagcuuaaaauuucucgugaaggacauguggcuaaagggucaaaaa

SEQ ID NO: 67081 - RNA, 64 nt, Human
aacauuuaaaagcagauuuuuucaaaaucgauaugugaaggacuacagaaucaccuccucuuga

SEQ ID NO: 67082 - RNA, 64 nt, Human
uuguguaguaaagggacucaaguaauguuugacagugaaggauacaacuucauuccuugccugc

SEQ ID NO: 67083 - RNA, 64 nt, Human
gagaaucaaccaaaggugauucuccuaaagagcagugaaggaaaugucagguuagcaggaccca

SEQ ID NO: 67084 - RNA, 64 nt, Human
cuuguacccgaucauaauaaaaauggauaauaaugugaaggaagaaaagagccgcuugaaucgc

SEQ ID NO: 67085 - RNA, 64 nt, Human
cagcuugaaggagccaaccauggauuugaggcgugugaaggaauauuucuccuggcucuacuau

SEQ ID NO: 67086 - RNA, 64 nt, Human
cagagaggagaacuaacccacacaggaucauuucgugaaggagcaaggcugaagaaccagaccu

SEQ ID NO: 67087 - RNA, 64 nt, Human
gagaucgccaccagaaccauuugugaacugauuugugaaggaaaagucagucuuacuccaaaga

SEQ ID NO: 67088 - RNA, 64 nt, Human
aguacauuaagaaugacuacacuguuccucguaugugaaggaggcagugcugacuccgugagug

SEQ ID NO: 67089 - RNA, 64 nt, Human
gucaaagagagggcuuuaauuuuuuuaaccaaaggugaaggaauauauggcagaguuguaaaua

SEQ ID NO: 67090 - RNA, 64 nt, Human
uggcuggucaccuggauguacagaagucuaacuggugaaggaauaucauuuacagacauuaaac

SEQ ID NO: 67091 - RNA, 64 nt, Human
acaaaaaucaguauuguuauuuuuuuccaagagugugaaggaaaauggggcauuccuuuccacu

SEQ ID NO: 67092 - RNA, 64 nt, Human
aaugaguaaagccaucacacagaagagggcuguggugaaggaccagcauggaaaacgcauugac

SEQ ID NO: 67093 - RNA, 64 nt, Human
ccaauaggucuuuuuauuaggcagccagaauguagugaaggacaauuuauuauacuuuaugacc

SEQ ID NO: 67094 - RNA, 64 nt, Human
gaccuugcccaucuucacucuagccuucguauuugugaaggacucagccaccuuccuucuucac

SEQ ID NO: 67095 - RNA, 64 nt, Human
acuuugacuacauagacuaaaauauuccaugguggugaaggauguacaagcuugugaauaugua

SEQ ID NO: 67096 - RNA, 64 nt, Human
uucuuaucaaccuugaaugacuacagauuauuuugugaaggaggaugaaguaauguguguucuu

SEQ ID NO: 67097 - RNA, 64 nt, Human
uuggggagcccagcccggcagggaagaggccagcgugaaggaccugggcucuuggccguggcau

SEQ ID NO: 67098 - RNA, 64 nt, Human
ccaggcagcaccaggccagggguugauuugaaacgugaaggauuggguuuucaggcccucugcu

SEQ ID NO: 67099 - RNA, 64 nt, Human
aaccauaaacuagcagaggacauugcauucuuuagugaaggacauuuauuuagagucugacaac

SEQ ID NO: 67100 - RNA, 64 nt, Human
aaccagcacugcagaaaccacuccaggcaaaguagugaaggaaaaaagccugcucuccaguagc

SEQ ID NO: 67101 - RNA, 64 nt, Human
augguuuugugacuuucaacuuuuguacaguuaugugaaggaugaaaggugggugaaaggacca

SEQ ID NO: 67102 - RNA, 64 nt, Human
cuggcuggcagggaaggaaagaacuugcauguuggugaaggaagaagugggguggaagaagugg

SEQ ID NO: 67103 - RNA, 64 nt, Human
guuuugcuuuuguuuuuuuccucauguaacauuggugaaggauccaggaauaugacacaaaggu

SEQ ID NO: 67104 - RNA, 64 nt, Human
uuauuuugaugucuuuucuuuuggucggaagugagugaaggagccaggucgcccugaagguuuu

SEQ ID NO: 67105 - RNA, 64 nt, Human
aaguguguuugaacauuaugccaaauaucaagaugugaaggacuaauucaggaugcaaaaacgu

SEQ ID NO: 67106 - RNA, 64 nt, Human
gccuaaugaaagggaaagucagcuuucagagccagugaaggagccacgugaauggcccuagaac

SEQ ID NO: 67107 - RNA, 64 nt, Human
aggccuuccuuucuaaugacaaugacagguauuggugaaggagcuaauguuuaauauuugaccu

SEQ ID NO: 67108 - RNA, 64 nt, Human
cugguaaaggaaauccucugauggacaggucagagugaaggaagguugugcugguaagacaucu

SEQ ID NO: 67109 - RNA, 64 nt, Human
uaggacauuugaagaacugguaugcuacucacuggugaaggacagucaggugaaggacuguaag

SEQ ID NO: 67110 - RNA, 64 nt, Human
acugguaugcuacucacuggugaaggacagucaggugaaggacuguaagcccacacaagcucuu

SEQ ID NO: 67111 - RNA, 64 nt, Human
cugccacggcuucagucagggccaggaggaacacgugaaggagaaagagaaaugcaggagccgc

SEQ ID NO: 67112 - RNA, 64 nt, Human
aacguuuuugcuuagauuuuguucuaaucaccacgugaaggaaugagauuagcaccacaaguuu

SEQ ID NO: 67113 - RNA, 64 nt, Human
uuuaugccucucgccuuuugauaauaguuguucagugaaggaagucagcugccagaauauuaag

SEQ ID NO: 67114 - RNA, 64 nt, Human
aguuuuuguuuacaagaauaauuagcaauacugagugaaggauguuggccaaaagcugcuuucc

SEQ ID NO: 67115 - RNA, 64 nt, Human
guaacgugagacugcagaguuuguuuuucuauaugugaaggauuacaacacaaaaaguuauccu

SEQ ID NO: 67116 - RNA, 64 nt, Human
cacagacuguacggcaaggcggcuacaugccucagugaaggacuaguaguuccugcuacaacuu

SEQ ID NO: 67117 - RNA, 64 nt, Human
uaaugguucuguuggccaaggcuucucccugucggugaaggaucauguucaggcacuccaagug

SEQ ID NO: 67118 - RNA, 64 nt, Human
ugagcccuggggacuguuccaaagccagugaaaugugaaggaaagugggguccuucggggcgau

SEQ ID NO: 67119 - RNA, 64 nt, Human
cacaggucuucaugggcagggguuguggguccuggugaaggaagugcauccucaggccugggcu

SEQ ID NO: 67120 - RNA, 64 nt, Human
aggagcugcaguucuuguggaagacacuugcugagugaaggaaaugaaucuuugacugaagccg

SEQ ID NO: 67121 - RNA, 64 nt, Human
gggcaacucuacagucccucccuccuuucggaaggugaaggauacuggguuuuuagaugccuug

SEQ ID NO: 67122 - RNA, 64 nt, Human
uugaaauaggaaggugggauuucuggggaggcuggugaaggagggcaggguucuuuucucuacg

SEQ ID NO: 67123 - RNA, 64 nt, Human
gcuggcagagaaggcuuccuccagcggcuggguggugaaggacccuggcucuucucucggggcg

SEQ ID NO: 67124 - RNA, 64 nt, Human
ccaggggcagacccugucgcugcguuucugaacugugaaggagcccauucgggugggagacuuc

SEQ ID NO: 67125 - RNA, 64 nt, Human
acagcugagaggcacuauggauuagucuucugaagugaaggaaauauagaugucaccuaaguga

SEQ ID NO: 67126 - RNA, 64 nt, Human
gagaggcagaagugggaguccagagccaggaacagugaaggaugguuccuggccccucugagug

SEQ ID NO: 67127 - RNA, 64 nt, Human
ucaucgacugacugcuugauucaggcuguucaaggugaaggauucaugagucuauauaaaggcu

SEQ ID NO: 67128 - RNA, 64 nt, Human
gcccucccugaggauugacuucugcacuaauccagugaaggaggcugugucaaaagaagggcuc

SEQ ID NO: 67129 - RNA, 64 nt, Human
auacuuuaauaauguugcgauggauugccacagugugaaggaaaugcaguguggggauaggacu

SEQ ID NO: 67130 - RNA, 64 nt, Human
cuauagaaaguacuuugugggaaccuuuauuacugugaaggagaaaaauagcuauuucuugaca

SEQ ID NO: 67131 - RNA, 64 nt, Human
agagcuggagacuacuuuugugcuuuacaaaacugugaaggauuguggucaccuggaacagguc

SEQ ID NO: 67132 - RNA, 64 nt, Human
agcgaguauugugauuuugcugaaaagacaaggugugaaggagcaacuucaguugacacaaaau

SEQ ID NO: 67133 - RNA, 64 nt, Human
ggauuugaauguguguguuuccguuuaacuuguggugaaggaagugugugacucagcuuggcug

SEQ ID NO: 67134 - RNA, 64 nt, Human
ucaaaagggaagaguuuuugugaugggggagagggugaaggaggucaggccccacuccuuccug

SEQ ID NO: 67135 - RNA, 64 nt, Human
cucacucccugcucccaccuggaaccuugccagcgugaaggaggcuuccagguacuucacccug

SEQ ID NO: 67136 - RNA, 64 nt, Human
cgucuguccuucaggagaggacaccagggugggggugaaggagacacuacugcccccaccccug

SEQ ID NO: 67137 - RNA, 64 nt, Human
uuccugcaaggucuccagaaccccuuuggaaauggugaaggaaccagcccaauagaaguacaga

SEQ ID NO: 67138 - RNA, 64 nt, Human
ucuaguugaaaguucccuucuccacccaggggcagugaaggaggaggggcuuauagagcuggga

SEQ ID NO: 67139 - RNA, 64 nt, Human
ucccugucuucugagcccgagccccucauuaccagugaaggacaugcuugagggguucgggaag

SEQ ID NO: 67140 - RNA, 64 nt, Human
acucccuuugugugggugggguuuguggguaguggugaaggaccgauaucagaaaaaugccuuc

SEQ ID NO: 67141 - RNA, 64 nt, Human
acugcugcauggcugucugcaugaaccacgccuggugaaggagccugggugagaaacaccaucc

SEQ ID NO: 67142 - RNA, 64 nt, Human
agggggauaaucuagaggcaggauuuuggacauugugaaggaaaugugcuccuucucagcucac

SEQ ID NO: 67143 - RNA, 64 nt, Human
uaaaugaaaggacucuuuacccuagaaggaagaggugaaggaucuggcuuguuuuuaaagcuuu

SEQ ID NO: 67144 - RNA, 64 nt, Human
aauuuugacccugguuuuuggauuaaauuaguuugugaaggauuauggaaaaauaaaacuguca

SEQ ID NO: 67145 - RNA, 64 nt, Human
aguauuuuggugacaaccuacuuugcuuggcugagugaaggaaugauauucauauauucauuua

SEQ ID NO: 67146 - RNA, 64 nt, Human
gggccugcuauugcagaaugaagccauuuagagggugaaggagaaauacccauguuacuucucu

SEQ ID NO: 67147 - RNA, 64 nt, Human
ugcagauggccccgggcggcccagguccucuacugugaaggagcagggagcugccgagggacac

SEQ ID NO: 67148 - RNA, 64 nt, Human
gggaauaaacaaaauugcugcaccaaugcacugagugaaggaagagagacagaggaucaagggc

SEQ ID NO: 67149 - RNA, 64 nt, Human
aacacacugcuuccuuccuccagaaggucuuacugugaaggaaaaaaugucaguugaacuaaau

SEQ ID NO: 67150 - RNA, 64 nt, Human
caaagagugggccgcuguguuuggagacggccaagugaaggagccagugcccacuauggcccug

SEQ ID NO: 67151 - RNA, 64 nt, Human
uuguuaaguuuauugaaguuuauucccuuaaucagugaaggacaacccuuauuuauuaccuaga

SEQ ID NO: 67152 - RNA, 64 nt, Human
uuuguugauugaauaaauguuagcucuucucauugugaaggacucacuuuuacugggauaaaca

SEQ ID NO: 67153 - RNA, 64 nt, Human
cucugggccagugguacugagucuaagcacugcagugaaggaguuaguagaaaacagucuggau

SEQ ID NO: 67154 - RNA, 64 nt, Human
uuugacaggaggagaauaaggcugaaagccucaagugaaggaucuugcagcuuguaaaagcaau

SEQ ID NO: 67155 - RNA, 64 nt, Human
aaucucgcacuacaucugauaucaggaaauaucugugaaggacuuggugauuaccugaaagccc

SEQ ID NO: 67156 - RNA, 64 nt, Human
acaggagagaguaggugguggugacgugagggcugugaaggauccagagacaagacuuagaugu

SEQ ID NO: 67157 - RNA, 64 nt, Human
caaguuucccauuucccuuucuuagauugcaccagugaaggagauguuuugcaaagauucagag

SEQ ID NO: 67158 - RNA, 64 nt, Human
ucucuguuccagcucuguaaaggucacaggaaucgugaaggagcugagaaaucuuccucuccgg

SEQ ID NO: 67159 - RNA, 64 nt, Human
ucuauccaaacagacguucacugccacuuguaaagugaaggauguaaacgaggauauauaacug

SEQ ID NO: 67160 - RNA, 64 nt, Human
uuaaccuauuaucuuuuauuuuuguuuguuuuuggugaaggauaagagugguguuucuuuugcc

SEQ ID NO: 67161 - RNA, 64 nt, Human
acauguugaaagcuccuuuguugacugggucaaagugaaggaauuucaaucuccaucaguguac

SEQ ID NO: 67162 - RNA, 64 nt, Human
gagucugaaugauuggggugaagacaucccuggagugaaggacuccucagcauggggggcagug

SEQ ID NO: 67163 - RNA, 64 nt, Human
cacaguagggugaguuaaguaugugcccucaggugugaaggagcacaggugagggggugccugc

SEQ ID NO: 67164 - RNA, 64 nt, Human
cacugaugggcccucccaggcccgucaagcccuggugaaggagcuuagcuugucuucuuggcaa

SEQ ID NO: 67165 - RNA, 64 nt, Human
auaugcauagugggaggagaucagaccuuuacaagugaaggaaagcaacuucagaaaugaauua

SEQ ID NO: 67166 - RNA, 64 nt, Human
ggagagaugaaaaccagggcgguagaacuucagggugaaggacagaguccuggguggggcagcg

SEQ ID NO: 67167 - RNA, 64 nt, Human
uuggccuggggugugacagcccugggagagccaugugaaggaggcagcuggcgccaucgcuccg

SEQ ID NO: 67168 - RNA, 64 nt, Human
uucuugcuggguuuuaaugaggaaacaggaaagggugaaggaaauccuugucuaaggacugcac

SEQ ID NO: 67169 - RNA, 64 nt, Human
ccuccaugcgccugggagcacaaaggccccgguagugaaggaaccccccgucuccugagagugg

SEQ ID NO: 67170 - RNA, 64 nt, Human
caugaacacagacacgcagggagaaggcagccgugugaaggagucggagaucagagugagggac

SEQ ID NO: 67171 - RNA, 64 nt, Human
ucacugcuggcauuuaaugugcaguagugaaugagugaaggacuguaaucauaauaugcucacu

SEQ ID NO: 67172 - RNA, 64 nt, Human
uuuuuauuuuaguguuaaauguuuacaaaagacagugaaggauucuuaucacauaaugugcagg

SEQ ID NO: 67173 - RNA, 64 nt, Human
agcggcgcccuggacuugguacaguugcaggagcgugaaggacuuagccgacugcgcugcuuuu

SEQ ID NO: 67174 - RNA, 64 nt, Human
aaauaaagaagaguaaacuuauuuuuuauagagggugaaggaugcuggaaggguaaggauuuag

SEQ ID NO: 67175 - RNA, 64 nt, Human
acccuauugcaauuugguccaacuauaucuucuggugaaggaaauuaaugauguaagaaaaugc

SEQ ID NO: 67176 - RNA, 64 nt, Human
uauucaugaguuucuacuugagugagaaaacugggugaaggaauagaauuuuaaauaguaauaa

SEQ ID NO: 67177 - RNA, 64 nt, Human
agauucuuagacuggcugccaaaggaugaagcuagugaaggagaaaaagcuuaaauuccaucuu

SEQ ID NO: 67178 - RNA, 64 nt, Human
aggcugcccuaccugggaaggcaccccagcaccugugaaggacauuuacugcucauccucaccu

SEQ ID NO: 67179 - RNA, 64 nt, Human
cuucccaaccuacagcauugacgccaacuuggcugugaaggaagaggaaaggaucuggccuugu

SEQ ID NO: 67180 - RNA, 64 nt, Human
agcugggcucugaguguaaacuacaugguagguugugaaggaugcaaauaucgaaucaaucauu

SEQ ID NO: 67181 - RNA, 64 nt, Human
agaauuuccaggacaaacaucuuuggaauugugagugaaggauauaguggcaggcuugucccuc

SEQ ID NO: 67182 - RNA, 64 nt, Human
aauuaacagccaccuauagaagaguccaucugcugugaaggagagacagagaacucuggguucc

SEQ ID NO: 67183 - RNA, 64 nt, Human
aaacaguuuuagcugacaaagaagaaauuucagagugaaggaauuuuaaaaaucuggcugacgg

SEQ ID NO: 67184 - RNA, 64 nt, Human
agguuuggaagccacaggcgauucuauggucaaugugaaggacuagaaauaaaaacccacaugu

SEQ ID NO: 67185 - RNA, 64 nt, Human
cuuccagucaacagugcuucccaaaguggguggugugaaggaagaggagguacauuaagagcua

SEQ ID NO: 67186 - RNA, 64 nt, Human
uggauuguggauguguuuagaagguagauucgaugugaaggaugaaucuggcuugaccuucugg

SEQ ID NO: 67187 - RNA, 64 nt, Human
gcuuagagaaagcacagaaucccagauccagcuggugaaggagggaaggcuucaggccuuuaag

SEQ ID NO: 67188 - RNA, 64 nt, Human
uaagagacguaucagauuauguaaaauuaaauuugugaaggauguauagagucucaaacacuga

SEQ ID NO: 67189 - RNA, 64 nt, Human
gaacgugcaggucugcggaggggaaguguccugagugaaggaggggacccccauccugggggau

SEQ ID NO: 67190 - RNA, 64 nt, Human
gaagcacuuugaccacuauauccgcuucuguuuugugaaggaugaagccacgcuccaggccaug

SEQ ID NO: 67191 - RNA, 64 nt, Human
cagcggaugcugccaggggcagugaaguguuuaggugaaggacaaguagguaagaggacgccuu

SEQ ID NO: 67192 - RNA, 64 nt, Human
cugggugaccucaggccuagucccuuucccuugcgugaaggacacgccccacagaaggcuacgg

SEQ ID NO: 67193 - RNA, 64 nt, Human
cagcugggcugcucccgccccagcccggcccagggugaaggaagaggcacgugcuccucagagc

SEQ ID NO: 67194 - RNA, 64 nt, Human
caagcaagaugcccacacaacaggcuuauuuucugugaaggaaccaacugaucucccccacccu

SEQ ID NO: 67195 - RNA, 64 nt, Human
aaacaacgguuugcaagccaccaaauaccagggagugaaggauagugauucuugagagggcaaa

SEQ ID NO: 67196 - RNA, 64 nt, Human
auagaaccagagaaacgaaagccauucccacaaagugaaggaacaguuuccaaaaccccugcga

SEQ ID NO: 67197 - RNA, 64 nt, Human
gaaacucggggaaaccagcccagcuaaguccggagugaaggagccucucugcuuuagcuaaaga

SEQ ID NO: 67198 - RNA, 64 nt, Human
guucuguuagcauaucauaaaguaagccuuucuggugaaggaagguugcuaugaaacuuuuuuu

SEQ ID NO: 67199 - RNA, 64 nt, Human
cacuugacuacugagcaguuacaccaaggagagcgugaaggagaugauugagccagagaagaaa

SEQ ID NO: 67200 - RNA, 64 nt, Human
cacaaggugauauuuguauuguaaaacaauaauggugaaggaaauaaaaaggcuuuuaaaauuu

SEQ ID NO: 67201 - RNA, 64 nt, Human
cagugucuucccucuugccaaaaggccuggggaggugaaggaagagagacuuuaggcaagcagc

SEQ ID NO: 67202 - RNA, 64 nt, Human
uuccggccccagaaggaucuuccuggaugccaacgugaaggaaagcuacugcccccuagugccc

SEQ ID NO: 67203 - RNA, 64 nt, Human
gaugaguccagaaccccugucacacagggaauaggugaaggaacuagggauauuuaacuggagc

SEQ ID NO: 67204 - RNA, 64 nt, Human
aaauguuuggaaccuuuagcacagauuugcuuuggugaaggacacgugucuucuaguucugccu

SEQ ID NO: 67205 - RNA, 64 nt, Human
ccuggacugagaauaguugaacaccgggggcuuugugaaggagucugggccaagguuugcccuc

SEQ ID NO: 67206 - RNA, 64 nt, Human
uugcuggucuagguauuaaccccaggacucagaagugaaggagaaauggguuuuuuguggucuu

SEQ ID NO: 67207 - RNA, 64 nt, Human
agaaguuguauuuuaaacguguuaggcuuuauaggugaaggacuuguuuugacuuaaguagaag

SEQ ID NO: 67208 - RNA, 64 nt, Human
gacuacuguugggucccugauuccaggcuggccugugaaggauugccccagguguccccuuuca

SEQ ID NO: 67209 - RNA, 64 nt, Human
cuuugcuuuaucaguucauuccagcucccuguuagugaaggacacugcuguuagugaaggaaca

SEQ ID NO: 67210 - RNA, 64 nt, Human
uccagcucccuguuagugaaggacacugcuguuagugaaggaacaaagucuaugaguccuaaaa

SEQ ID NO: 67211 - RNA, 64 nt, Human
cuuccuacauuaccacuacuacaugcuggcaaaggugaaggaucagaggacugaaaaaugauuc

SEQ ID NO: 67212 - RNA, 64 nt, Human
ccaggcccccugggccagcuccgagaaggcgccagugaaggaccagggaccaggccagggugcg

SEQ ID NO: 67213 - RNA, 64 nt, Human
ucccuuugcugcugaugggcaucauuguuuaggggugaaggaggggguucuuccucaccuugua

SEQ ID NO: 67214 - RNA, 64 nt, Human
ggaaaagcuuccuugaugugagcucugggggagugugaaggaugcaucucuagcccccgaguaa

SEQ ID NO: 67215 - RNA, 64 nt, Human
uauagagcccucaggcagacugaauucuaaaucugugaaggaucuaaggagacacaugcaccgg

SEQ ID NO: 67216 - RNA, 64 nt, Human
aauuagucucagcacaggaauugaggugggucaggugaaggaagaguguauguuccuauuuuua

SEQ ID NO: 67217 - RNA, 64 nt, Human
cuucaagaucccggagugguagcgcugucuccuggugaaggaguauuugucacacuggaaugug

SEQ ID NO: 67218 - RNA, 64 nt, Human
uucgauccucuuaaggcauuaucagugagcaaaugugaaggaaauggugucuggaagaaaguuc

SEQ ID NO: 67219 - RNA, 64 nt, Human
acgcaauccuugggggugcaggguggagcagaaagugaaggagggacacgugcaagaguggugu

SEQ ID NO: 67220 - RNA, 64 nt, Human
cggcuacacuuuaaggaaagauugaaucuaagcugugaaggacaguauagaagacugcaccaag

SEQ ID NO: 67221 - RNA, 64 nt, Human
guaacugcacacaacaggccugggagcgaacugugugaaggaccuuaauucaaaucagagaaaa

SEQ ID NO: 67222 - RNA, 64 nt, Human
cgccuguuguuccugcaccacaucagauaagcaugugaaggagggccaacuggcagcugcggga

SEQ ID NO: 67223 - RNA, 64 nt, Human
ucuggcugaagcuuuugcaaguaggcuuugaggggugaaggagauugguggaggagaguaaaua

SEQ ID NO: 67224 - RNA, 64 nt, Human
uaauagaaagcugcuauuauguauauugucauuugugaaggaaguuggagagucacagcuuuac

SEQ ID NO: 67225 - RNA, 64 nt, Human
gccagugcauauuaguggacagcacuuaguagcugugaaggaaggugcagagucagaagaugaa

SEQ ID NO: 67226 - RNA, 64 nt, Human
auuaaaacagcuggagcauuuccuucccuuuccagugaaggagcagcauagugaaauccuggca

SEQ ID NO: 67227 - RNA, 64 nt, Human
gaugggccuucuccgggaugaggcccuggcagaggugaaggacauggagcagcugcuggcccuu

SEQ ID NO: 67228 - RNA, 64 nt, Human
gcuccugaauccagcugugcacuuugcccaaguggugaaggaaugccgggcaguggucauugcg

SEQ ID NO: 67229 - RNA, 64 nt, Human
acccagcugagguagaggccagacuccuccaacagugaaggaaaaggcacaggugagaguauag

SEQ ID NO: 67230 - RNA, 57 nt, Human
cauuugucccaugucucuaauuaauaugugaaggaaaauguuuucaaagguugagaa

SEQ ID NO: 67231 - RNA, 64 nt, Human
uaaguuauuauuaauauuuugaacacagguggaugugaaggauuuucauuuaaaaaccaagugg

SEQ ID NO: 67232 - RNA, 64 nt, Human
caugccuucaggaaguugugccagacccuagauugugaaggacccacuguucuucuguuguacg

SEQ ID NO: 67233 - RNA, 64 nt, Human
guaauggaaaguaauuguugaccuccugcuuugggugaaggagacuguaagcugguacuugaga

SEQ ID NO: 67234 - RNA, 64 nt, Human
agaaccaaaccagguguguucuacaccugcaugagugaaggauuuccacguagacaccuaggaa

SEQ ID NO: 67235 - RNA, 64 nt, Human
ccauuaugcuacuugugaggcagaagaguuuucugugaaggaaaaaagcccauuagaguucuuc

SEQ ID NO: 67236 - RNA, 64 nt, Human
gcugaugucacugaaccagaaggguuuauacugagugaaggaaagguaaaaaguaguauuuugu

SEQ ID NO: 67237 - RNA, 64 nt, Human
ugagccaaguucgugccaucggacuccagccugggugaaggagugagacccugucuccaaaaac

SEQ ID NO: 67238 - RNA, 64 nt, Human
auuucuaaagguaggaccaacacccaggggaucagugaaggaagagaaggccagcagaucacug

SEQ ID NO: 67239 - RNA, 64 nt, Human
ggguaggguagggccucugaggaggagggaaaaagugaaggagaggcuuuggaccuggugacag

SEQ ID NO: 67240 - RNA, 64 nt, Human
gugaggagcuggggaucccucccccccaugcacugugaaggacccuuguuuacacauacccucu

SEQ ID NO: 67241 - RNA, 64 nt, Human
accccaacugaaaugaggagcuuccucucuuccugugaaggauaugacaguccagcaucgaugc

SEQ ID NO: 67242 - RNA, 64 nt, Human
gcauaccuaaggacuaauuuaaacacauaucaaugugaaggacuaauuuaaauuacuaucauuu

SEQ ID NO: 67243 - RNA, 64 nt, Human
aauuaacccuggagaucugcaaauggagggaggggugaaggaggaaucuuaagaccgagggaga

SEQ ID NO: 67244 - RNA, 64 nt, Human
gcaaagagcuauuagccaaacugauucuaugcaggugaaggaugcacuaaaguucucacuuuag

SEQ ID NO: 67245 - RNA, 64 nt, Human
aagaacauuuuauaaaacauacgaaaaagugauugugaaggauuuuuauuugcaugauuauagu

SEQ ID NO: 67246 - RNA, 64 nt, Human
uuauccacucaauugccuuauuccugaggauguagugaaggaagaaaaaguuuucuggaauucc

SEQ ID NO: 67247 - RNA, 64 nt, Human
acuuccaaguuuguuuucacuuuuuugugugugcgugaaggagucugugucacccaggcugugu

SEQ ID NO: 67248 - RNA, 64 nt, Human
ucucuuuguuaucuaaauguuucagaauucaaucgugaaggaacaggcauuuuacacuaugaag

SEQ ID NO: 67249 - RNA, 64 nt, Human
cauucaacaaauauuuaccaaguuccuaauauaagugaaggaccacuucucauauuagauuacu

SEQ ID NO: 67250 - RNA, 64 nt, Human
gugcugccuuaguugcuaguuuaguagccuuacugugaaggaauaauuaagauuguuucagacu

SEQ ID NO: 67251 - RNA, 64 nt, Human
gaaccuuaccuucaaggagcaagugaagaacucugugaaggauggaacuuucagauaucaacua

SEQ ID NO: 67252 - RNA, 64 nt, Human
ggacagaguuuccuuacgaggagacuuggucacugugaaggagaaagagugagggcaaugaagg

SEQ ID NO: 67253 - RNA, 64 nt, Human
uugguuuaccucaggaugacgugcagaaaaaugggugaaggauaaaccguugagacguggcccc

SEQ ID NO: 67254 - RNA, 64 nt, Human
auuaucauggcaugacuuaagggaacauugguuugugaaggaaaaacagauuaucuaaagccau

SEQ ID NO: 67255 - RNA, 64 nt, Human
uuuauuuugugauuuaugugauuucuuuugcugagugaaggaaaggagaaauuguugcuauugu

SEQ ID NO: 67256 - RNA, 64 nt, Human
caccaccaaaaauaaaaucaaacaaaacuaaguugugaaggaagggagggaaggucauagccuu

SEQ ID NO: 67257 - RNA, 64 nt, Human
gacugaaggggaugcuaaaggagauaaagccaaggugaaggaugaaucacagagaagaucugcg

SEQ ID NO: 67258 - RNA, 64 nt, Human
ugaauuuugucaauuaaaaaagcgugggagcagugugaaggagaagaggcaagaacgaccccug

SEQ ID NO: 67259 - RNA, 64 nt, Human
aucaacuaagaaccaaaauccagggcacucauaugugaaggauaagaaccucacuuccuuacuc

SEQ ID NO: 67260 - RNA, 64 nt, Human
ggaggagggaggaaagaugaaaaaccacuuaaaugugaaggaacaacagcaacaagaccaguau

SEQ ID NO: 67261 - RNA, 64 nt, Human
ggccccagagaguuuggaguguaggauucccucugugaaggaaucaucucuacuucucugagga

SEQ ID NO: 67262 - RNA, 64 nt, Human
aagaggaaguuuuaaaagaccuuaagcuggcauugugaaggaacaccaugguagacucuuuuug

SEQ ID NO: 67263 - RNA, 52 nt, Human
uacuugaagacagaaacuaaaugugaaggacauuggucuuggacugagcguu

SEQ ID NO: 67264 - RNA, 64 nt, Human
gccuuauugggugaggggacgagaugggguucaugugaaggaggaagcgaugccgagguaggaa

SEQ ID NO: 67265 - RNA, 64 nt, Human
cacgcauacaggcucuagucaagaaugaauuagagugaaggaaagcugugugacaccuggcauu

SEQ ID NO: 67266 - RNA, 64 nt, Human
cagcuucugagaauuguguuauuucacuugccaagugaaggacccccuccccaacaugccccag

SEQ ID NO: 67267 - RNA, 64 nt, Human
agaggacguuuuggcuaugaucaucugauggcaagugaaggagaaaugagugauagggcuuugc

SEQ ID NO: 67268 - RNA, 64 nt, Human
ugauuaaaccgagguuauagaaggucaggggagagugaaggagucagugaccuaugucugccau

SEQ ID NO: 67269 - RNA, 64 nt, Human
cuaagugagaaugagaacugcugugauagggagagugaaggagggauaugugguagagcacuug

SEQ ID NO: 67270 - RNA, 64 nt, Human
acccagcuucccacuugccacucuccugucgagagugaaggaaguugaugcacagaauuuaccu

SEQ ID NO: 67271 - RNA, 64 nt, Human
aguuugggaugagaacagcucugacggccgguaugugaaggagaacugcaaaccucugaagguc

SEQ ID NO: 67272 - RNA, 64 nt, Human
ccccaggccagagccacccaaugaacagugcaaugugaaggaaggcaggagccugcaggggagc

SEQ ID NO: 67273 - RNA, 64 nt, Human
uucaucuuuguaggaaggucuggccuggggucgggugaaggagggcccaggucaguucuggggu

SEQ ID NO: 67274 - RNA, 64 nt, Human
ugcuuugccaccaaaaggcuuuucccugagaacagugaaggauguaugucauuuuguggugguu

SEQ ID NO: 67275 - RNA, 64 nt, Human
caggcauacaggcucuagucaagaaugaauuagagugaaggaaagcugugugacaccuggcauu

SEQ ID NO: 67276 - RNA, 64 nt, Human; identical to SEQ ID NO: 67275

SEQ ID NO: 67277 - RNA, 64 nt, Human
uccagcggauggacagcuuggcucucccagagaggugaaggagcaccuggccuuaggaauccug

SEQ ID NO: 67278 - RNA, 64 nt, Human
gggaucuguguugacucuggcauuuaguggcuuugugaaggaaagaaaccauuaaaugaccuga

SEQ ID NO: 67279 - RNA, 64 nt, Human
cugcccugccugacgauguaucgaaaagaugagagugaaggagacuuugugcagcaggaaacgg

SEQ ID NO: 67280 - RNA, 64 nt, Human
aaacauuuggaaaauaguaacauugauauuucuugugaaggagaaguagaaaguaacagugacu

SEQ ID NO: 67281 - RNA, 64 nt, Human
gggcccaauccuuccagacccaccagcuggaaaagugaaggaagcauguccacugacaaacggg

SEQ ID NO: 67282 - RNA, 64 nt, Human
uagcuagagugccuugaaaaaauguguuggcuaugugaaggaauauuucaacuaaaauggaaug

SEQ ID NO: 67283 - RNA, 64 nt, Human
cuccccccaugguguuuucauaugagguacuacugugaaggaucugguuccucauucacuguuu

SEQ ID NO: 67284 - RNA, 64 nt, Human
uaaaagcugccuuuaaauaucccuaggagacagggugaaggagacccuugacagccccagccua

SEQ ID NO: 67285 - RNA, 64 nt, Human
acucccagucagcccgcucgauccugaagaucgugugaaggaagcguucuuggugcuacacaca

SEQ ID NO: 67286 - RNA, 64 nt, Human
cacuuucaccucuggcccaggagacugacccaaagugaaggacauugccgggagaggccugcag

SEQ ID NO: 67287 - RNA, 64 nt, Human
agugagcaaggcacgacccucagaucucagucuagugaaggagagaaaacuguaauaacacuac

SEQ ID NO: 67288 - RNA, 64 nt, Human
uccccugggaaggggacccaaggaugaauuggcugugaaggauccucccugagacuggcaaggg

SEQ ID NO: 67289 - RNA, 64 nt, Human
cuguggcaggaggcaaagaguaggguguaauugagugaaggaauccuggguagagaccauucuc

SEQ ID NO: 67290 - RNA, 64 nt, Human
aucuacugacaaguugcucuaguaacccaaagaagugaaggagaaagcagcugccucaccgccc

SEQ ID NO: 67291 - RNA, 64 nt, Human
uuuuucaauauaaaaggcacagcuguuggccaaagugaaggaaucuuuuuucaguuuuauugga

SEQ ID NO: 67292 - RNA, 64 nt, Human
caaauaugcaaaugugaaauaaccgaucuauaacgugaaggaggcagacaugagcuguacuacu

SEQ ID NO: 67293 - RNA, 64 nt, Human
ggcccguggaggagcccaccagccccuucuucuugugaaggaaaucccguuuuuuucuagacag

SEQ ID NO: 67294 - RNA, 64 nt, Human
cauccuccacaagaagguguuucccuguuguuaagugaaggaggccgccccugcccccaccuga

SEQ ID NO: 67295 - RNA, 64 nt, Human
cagagagcaucaaaaggagcccacaccuucagcagugaaggauucuaacacagggaaucugcag

SEQ ID NO: 67296 - RNA, 64 nt, Human
cccaacaccauggccugcaaccccagggucaagggugaaggaaagcaagcucaccgccugaaca

SEQ ID NO: 67297 - RNA, 64 nt, Human
cuuauucuuaaagccaugguaaaaauagggaucugugaaggaaauuucuaaaauuggauguauu

SEQ ID NO: 67298 - RNA, 64 nt, Human
gaaaaaaaaaacacuuggcauacaaaauauuuaagugaaggagaagucuaacgcugaacugaca

SEQ ID NO: 67299 - RNA, 64 nt, Human
auacuaaaacugaugaaaugcuaagacaugucuugugaaggaagguuucuuggagaccacuuuu

SEQ ID NO: 67300 - RNA, 64 nt, Human
uuuuugauauucagguuuccucaauuuagccuuagugaaggagggguuguacacacugccauuu

SEQ ID NO: 67301 - RNA, 64 nt, Human
gaagguggguggcauauuggggaccugggaaugugugaaggaggagaucaaauuucaguggcuu

SEQ ID NO: 67302 - RNA, 64 nt, Human
uugagcugauggccuugguugagcugauggacaagugaaggaggccauggggcugugcuguccu

SEQ ID NO: 67303 - RNA, 64 nt, Human
gcagaagagcuugaaugggacgugcagcgagaaugugaaggauggagcagguagcucaucuggc

SEQ ID NO: 67304 - RNA, 64 nt, Human
ugauuguauuuaccuucuaccucuuggcugccuugugaaggaauuauucccaugaguuggcugg

SEQ ID NO: 67305 - RNA, 64 nt, Human
gggcgaaaauguccgaggagaacugcuggcccuggugaaggaccugccgagucagcuggcugag

SEQ ID NO: 67306 - RNA, 64 nt, Human
uauucucuggucuucuauuuuugguguuguucaagugaaggaagagauguucccucuaauuucu

SEQ ID NO: 67307 - RNA, 64 nt, Human
uuuaagccccuuuacccugguccuguacugaucagugaaggaaaccgugguuacugaggcccug

SEQ ID NO: 67308 - RNA, 64 nt, Human
gaggaagaaggagacgccccuccaacuggcgggugugaaggaagccgcccagggguccgggcug

SEQ ID NO: 67309 - RNA, 64 nt, Human
uuccguguucgucgggaaucaggauuauugagaggugaaggagccagguggcuucauucuggcg

SEQ ID NO: 67310 - RNA, 64 nt, Human
ggcugcauggcuuucgcaaagucacuagcuuuuggugaaggaucugccaggguguccugggcag

SEQ ID NO: 67311 - RNA, 64 nt, Human
gaggggucguugauuucaacuggauugagagacugugaaggaacucgguuacaaauccauaaca

SEQ ID NO: 67312 - RNA, 64 nt, Human
uguggugaacucuuaaggacuuuucccuucaagugugaaggaaggugugaugaaugcuguggag

SEQ ID NO: 67313 - RNA, 64 nt, Human
acugaauucaugguaggaucacucgcaaggccuugugaaggagucuuaccuaaaacgaaagaaa

SEQ ID NO: 67314 - RNA, 64 nt, Human
caggccucuguccccagcggugagguugcagugagugaaggagaggaggugaucuguucucccu

SEQ ID NO: 67315 - RNA, 64 nt, Human
agaaaucacugugaaauuucaugauuggcuuaaagugaaggaaauaaagguaaaaucacuucag

SEQ ID NO: 67316 - RNA, 64 nt, Human
uuucaaaacugccaugccccccugugaugcucccgugaaggaaugcacuuugccuuguaaguuc

SEQ ID NO: 67317 - RNA, 64 nt, Human
ggcacagugcauccagagcaugacccgccugguggugaaggaacggaaucgcaaguaugaccag

SEQ ID NO: 67318 - RNA, 64 nt, Human
caaacuuggcaaggauuacauucuagagcuaaaagugaaggaaacgucucaagugacuuugguc

SEQ ID NO: 67319 - RNA, 64 nt, Human
ucuaauauccccaaauuagggcaauuggaacaaagugaaggacauagagguauauuggaagagg

SEQ ID NO: 67320 - RNA, 64 nt, Human
gauacuugucacauauuugaagaaauuccauacagugaaggaaauuugagucuguauugcugcu

SEQ ID NO: 67321 - RNA, 64 nt, Human
gccccucucugcugccuugggguuggcagaacacgugaaggauccgaggagcgagaggaauguc

SEQ ID NO: 67322 - RNA, 64 nt, Human
aggaaauaagcccugcugcuuucuagaaauaagugugaaggauaaauuuucuuuguugaccuau

SEQ ID NO: 67323 - RNA, 64 nt, Human
gaaucccugaaaauggugaggaggguggggggaagugaaggaaagacaagcagggcuaauucca

SEQ ID NO: 67324 - RNA, 64 nt, Human
uccaauauguagcagucucucuggauggcggagagugaaggagacggagaaacgcgccccaucc

SEQ ID NO: 67325 - RNA, 64 nt, Human
ugaggcucgcucuugcgcggugccugagaagagggugaaggagcuggggcaggccccauccugg

SEQ ID NO: 67326 - RNA, 64 nt, Human
gcuuggguugggauuuugguuucuuccuuuccucgugaaggauaagagaaacaggcccgggggg

SEQ ID NO: 67327 - RNA, 64 nt, Human
ggggccauauguucaccugcuuuccuguccguuggugaaggaauuucagaauucauuuuauauc

SEQ ID NO: 67328 - RNA, 64 nt, Human
agaauuucauauccagccaaacuaagcuucauaagugaaggagaaauaaaauacuuuacagaca

SEQ ID NO: 67329 - RNA, 64 nt, Human
ccaaaagaucuuucagaaaauauuauccuuuaaagugaaggagaguauuuauauuaaagaugaa

SEQ ID NO: 67330 - RNA, 64 nt, Human
aggagcuagcugaguaugcugaaauccgggucaagugaaggagcugggggcagccugcguggcu

SEQ ID NO: 67331 - RNA, 64 nt, Human
ugccaggcccaguacggaggacgcuggggaaauggugaaggaaacagaaaaaaggucccugccc

SEQ ID NO: 67332 - RNA, 64 nt, Human
caugcuuuuuuuuguacggaauagauaauuaagagugaaggaguugaaacuuuucuuguuagug

SEQ ID NO: 67333 - RNA, 64 nt, Human
uuuucugggacauuguuggucucauguuaugccugugaaggauuuguccagccuucauguuacu

SEQ ID NO: 67334 - RNA, 64 nt, Human
gguguugggggggaaaguacugugaauaaugugugugaaggacuuuauuccgacuaauacucuu

SEQ ID NO: 67335 - RNA, 64 nt, Human
ccagaaaucacugaaauuucaugauuggcuuaaagugaaggaaguaaagguaaaaucacuucag

SEQ ID NO: 67336 - RNA, 64 nt, Human
aaggaucauugauugggugaagaucauugauuaggugaaggauuauuucuauccaauuugugaa

SEQ ID NO: 67337 - RNA, 64 nt, Human
ucuuucuucaguguuauggcuauagagagccuuugugaaggagccgucugccuaaaguuaaacc

SEQ ID NO: 67338 - RNA, 64 nt, Human
guuagagaugaggaggaguaaaagugaaauuuuugugaaggacuuaaauuauccaguguuucuu

SEQ ID NO: 67339 - RNA, 64 nt, Human
cagugauggugguuucugaagccccaugucccuggugaaggaggacugaaccaaggacucugug

SEQ ID NO: 67340 - RNA, 64 nt, Human
accccgggaggggcuuauguuacaaggugaucaagugaaggaaaaaccugagccuaucuggcug

SEQ ID NO: 67341 - RNA, 64 nt, Human
aaugacuccucuugguuugguuugaaguuuuucagugaaggaaaaggccugagauaggaagcag

SEQ ID NO: 67342 - RNA, 64 nt, Human
ugggccuugaaaauccuugcccuuaucauuuggggugaaggagacauuucuguccuuggcuucc

SEQ ID NO: 67343 - RNA, 64 nt, Human
uucucagaaacagacugaauuugaucugauuaaugugaaggacuggccagucugggaaaccgcc

SEQ ID NO: 67344 - RNA, 64 nt, Human
uuugggguuggcgggaccugcuggugacgugcaggugaaggacaggaaggggcaugugagcgua

SEQ ID NO: 67345 - RNA, 64 nt, Human
ugcaauacggaacacugucaauggacugcaccuugugaaggaaaaacaugcuuaagggggugua

SEQ ID NO: 67346 - RNA, 64 nt, Human
gucacccagcuggucucauacauagacagcacuugugaaggauugaaugcagguuccaggugga

SEQ ID NO: 67347 - RNA, 64 nt, Human
ccugugccgcuggcaugagggccguguccccacugugaaggaugaagagcaaggcccucaggac

SEQ ID NO: 67348 - RNA, 64 nt, Human
uauuuaaagaguaaauuauuuguggcuuugcugagugaaggaaggggagcaagggguggugccc

SEQ ID NO: 67349 - RNA, 64 nt, Human
cgccuccccucccucuucagucauugcugugcgugugaaggaagagcaucuagacguggccucg

SEQ ID NO: 67350 - RNA, 64 nt, Human
ucugccgcccgcccacuccguuucccugugguccgugaaggacggccucaggccuuggcauccu

SEQ ID NO: 67351 - RNA, 64 nt, Human
acacggcaugaggacagagggaggggcacggggagugaaggagggggcccuggggcaaggcucg

SEQ ID NO: 67352 - RNA, 64 nt, Human
ccuuuaaaccuuucccuggccuuucccauagcuggugaaggacaccuccauccauuccacgcag

SEQ ID NO: 67353 - RNA, 64 nt, Human
cucagagaaugaucacccugaauucauugucucagugaaggaagaaccuguagaagaugaccuc

SEQ ID NO: 67354 - RNA, 64 nt, Human
gcugccccgguagccucgagagcaccccuugccggugaaggaugcggcaggugcucuguggaug

SEQ ID NO: 67355 - RNA, 64 nt, Human
accccaugacuuacagccgguucuuaccucuuaggugaaggagaugacauguuuuuagaauugc

SEQ ID NO: 67356 - RNA, 64 nt, Human
guuccgaccccuuucccagcccacagggcuugaagugaaggaacagaggcagggggugggccag

SEQ ID NO: 67357 - RNA, 64 nt, Human
gcccggggagcagggucaugaacuuuuuucuuuagugaaggaggaauacaaucaaggguuuugu

SEQ ID NO: 67358 - RNA, 64 nt, Human
gucccucuuccuaaggacagggguaacagucaaagugaaggaaugauggguucuugccugucuu

SEQ ID NO: 67359 - RNA, 64 nt, Human
uaaaagggacaggcaguaguguucaacagugcaugugaaggaaaguucuguuuuccaugguuuu

SEQ ID NO: 67360 - RNA, 64 nt, Human; identical to SEQ ID NO: 67102

SEQ ID NO: 67361 - RNA, 64 nt, Human
uugugguuaaagagggcagucacuguuccaaggagugaaggacuggguguuacuggagggaaca

SEQ ID NO: 67362 - RNA, 64 nt, Human
aaggaaaaugcucugauucucuguuuaggcauuugugaaggauuccagagccuuucccaaagug

SEQ ID NO: 67363 - RNA, 64 nt, Human
guacauuuguauauuacauauauggacauaacuugugaaggaugaaagaaaguacagccucucg

SEQ ID NO: 67364 - RNA, 64 nt, Human
uauacugugugcuaaaacaagcacuaaacaaagagugaaggauuuauguuuaauucugaaagca

SEQ ID NO: 67365 - RNA, 64 nt, Human
uuaaaugacuugucugagauuaguuuucaggcaugugaaggacuuauacucacaugcuagcccu

SEQ ID NO: 67366 - RNA, 64 nt, Human
aaugugguguuacuguaggaauuuucuugaaacugugaaggaacucugcaguuaaauaguggaa

SEQ ID NO: 67367 - RNA, 64 nt, Human
uuuuuuuuaagugaaauuuauugaggaaaaauaugugaaggaccuucacucuaagauguuauau

SEQ ID NO: 67368 - RNA, 64 nt, Human
gguggacacuaacacacaggcacucaaugaaugagugaaggaaauaaaagucaccccguuggug

SEQ ID NO: 67369 - RNA, 64 nt, Human
cagagaaaaacggugguagccauggaaaucgggagugaaggagcacugcuucauuguggcucag

SEQ ID NO: 67370 - RNA, 64 nt, Human
auuauuuuaugugagccuucaguaaaaucuuugugugaaggauuggaaaaggcuauuuuccaac

SEQ ID NO: 67371 - RNA, 64 nt, Human
ucaaagcccuuuaagagucaugguaaggagaugggugaaggaaaauuuagcaacagguaauuga

SEQ ID NO: 67372 - RNA, 64 nt, Human
gcccaucccugugaaggaguaggccacucuuuaagugaaggauuggaugauuguucauaauaca

SEQ ID NO: 67373 - RNA, 64 nt, Human
gggcuggagggcuauggauucccagcccaucccugugaaggaguaggccacucuuuaagugaag

SEQ ID NO: 67374 - RNA, 64 nt, Human
acgagcccaaguugaagagaagagacgcccauccgugaaggagcagaccauccauccgauccuc

SEQ ID NO: 67375 - RNA, 64 nt, Human
cuuugcauuuuaaaguauuucggguaaaggugaagugaaggauuuucgucuuuauaauuucugu

SEQ ID NO: 67376 - RNA, 64 nt, Human
uuuuuaagaugaucaucuaauuuuauuuugugaagugaaggauuuguguuuuaguuggcaguug

SEQ ID NO: 67377 - RNA, 64 nt, Human
gguggugguggauacuaauacaguucuguacgaugugaaggaugugucuuugcuauuucuuguc

SEQ ID NO: 67378 - RNA, 64 nt, Human
gaagcaacaagcauguccuuguaguacagguacagugaaggauagaacacacuuucguugauac

SEQ ID NO: 67379 - RNA, 64 nt, Human
gguucaacugaguuucguuuuguuaaacaguucagugaaggagaaagcaccugugauauauggc

SEQ ID NO: 67380 - RNA, 64 nt, Human
cuccgaguccuugcagcuggucuuuggcauugacgugaaggaagcggaccccaccagcaacacc

SEQ ID NO: 67381 - RNA, 64 nt, Human
gacauagauuucauaguauuuuucugagaauccugugaaggaacgcugucucuuugcaaaguaa

SEQ ID NO: 67382 - RNA, 64 nt, Human
ggaagggaaaggcuaccgcgaagaggucuugaccgugaaggaaauuaccugagacccagagggu

SEQ ID NO: 67383 - RNA, 63 nt, Human
uugagauggcccguguucauaacucaguuuccuguuuugcacgauguaaaaacccugucuuuu

SEQ ID NO: 67384 - RNA, 63 nt, Human
uaaauaaaacugauuuaaauaauaugugucuuuguuuugcagcccugaaugcaaagaauucau

SEQ ID NO: 67385 - RNA, 63 nt, Human
auggggaccagucaggggaauccccuuauuucuguuuugcauaugaggaacccuagagcagcc

SEQ ID NO: 67386 - RNA, 63 nt, Human
cucugccugggcugggaaaggggccuuucuuuuguuuugcagauagauccacccacugaggaa

SEQ ID NO: 67387 - RNA, 63 nt, Human
uaagcagggagaauaaagauaauuguauuuuauguuuugcacacaaacgcagaauuuguauaa

SEQ ID NO: 67388 - RNA, 63 nt, Human
ggacaucagacggagacuuccagcaaucuguugguuuugcaagucugaagcuccgggcagagc

SEQ ID NO: 67389 - RNA, 63 nt, Human
aagguucuuucacuuggaauuacuaagaucggaguuuugcagagguugauuaaagcaaccaua

SEQ ID NO: 67390 - RNA, 63 nt, Human
cugaaauuaagcaugaugcuuagauugcaguuuguuuugcauuugcuauaauuuucaaaauua

SEQ ID NO: 67391 - RNA, 63 nt, Human
ccguauuuuguaguggaguucauaucacauuauguuuugcaaaauaaaacuuguuuugucaca

SEQ ID NO: 67392 - RNA, 63 nt, Human
gaccaaaagguuacaaguaauuagacaaaagugguuuugcaccaauuuuaugucaaguaaaac

SEQ ID NO: 67393 - RNA, 63 nt, Human
aguuuucuuaagaccugucgucaaacuuaaaagguuuugcagagggcaguaucaaaagaaagu

SEQ ID NO: 67394 - RNA, 63 nt, Human
cuauuguuuuuguugcugagccaauuugaguuaguuuugcauccuggggggcuuuaaaauaca

SEQ ID NO: 67395 - RNA, 63 nt, Human
cauugccugcaaggagaggagacccuuggaauuguuuugcacaggugugucuggugaggaguu

SEQ ID NO: 67396 - RNA, 63 nt, Human
uacaucuaaggaacuuuaucuuacuaucaguagguuuugcauugauauuucuuuuuaaauaaa

SEQ ID NO: 67397 - RNA, 63 nt, Human
cagcucuccugccgcucccugcagaggaugcucguuuugcagagaaggcaguguuccucuauu

SEQ ID NO: 67398 - RNA, 63 nt, Human
gaugguugacaacccaugguugagaugggcaccguuuugcaggaaacaccauauuaauagaca

SEQ ID NO: 67399 - RNA, 63 nt, Human
uuccaccaguguaaaaauugaguaaaaccugaaguuuugcauaaaaugcaaaucggugccugu

SEQ ID NO: 67400 - RNA, 63 nt, Human
uuucaugaaauucaccagcaguuugcaagcacaguuuugcaaggcugcauaagaacuggugaa

SEQ ID NO: 67401 - RNA, 63 nt, Human
cauaaaagcucagaugaugguaucugugaguauguuuugcaaauucaaaauauaguuugguaa

SEQ ID NO: 67402 - RNA, 63 nt, Human
cgggugucuuuuuuuugaguaacugcucucugaguuuugcacacgaaguugcccucaucugcu

SEQ ID NO: 67403 - RNA, 63 nt, Human
aauagucccaacuaagauucagucaguauguuuguuuugcaaguuugggagaguaaguuggcu

SEQ ID NO: 67404 - RNA, 63 nt, Human
uuuucuuguauugaaaauaaccuaugauuguauguuuugcauuccuagaaguagguuaacugu

SEQ ID NO: 67405 - RNA, 63 nt, Human
aaaagguuuuuagcucauuugccuggccggcaaguuuugcaaauagcucuuccccaccuccuc

SEQ ID NO: 67406 - RNA, 63 nt, Human
uuuuaguuaauggaagaauucaccaauuuuaaaguuuugcaacauuaaauaagugacuuggug

SEQ ID NO: 67407 - RNA, 63 nt, Human
cacaacaauuuugaucauauuaacuguacuucaguuuugcauuuuuauucaaauguuaucucu

SEQ ID NO: 67408 - RNA, 63 nt, Human
acgaugagggcauucuuucuacauagacugcuuguuuugcacaagaagugauuuugugaaugu

SEQ ID NO: 67409 - RNA, 63 nt, Human
agaaucccauccauauauccaauuugcaauugaguuuugcaugguucucugauuauguccaug

SEQ ID NO: 67410 - RNA, 63 nt, Human
agaaaaguagaauucaguauguauggaggcacaguuuugcacaguauguugcaugcggcaaaa

SEQ ID NO: 67411 - RNA, 63 nt, Human
aauucuuuaccuccuaaacuuuuaguugcaauuguuuugcaguguaaaauuguacauguguua

SEQ ID NO: 67412 - RNA, 63 nt, Human
aaaaaaaaaagaguuuaaguggcuaaagucauaguuuugcaagagauuaaugaucugccuuau

SEQ ID NO: 67413 - RNA, 63 nt, Human
ucucccugcugcuucauacugaaacaggugccuguuuugcaagugggcugcauucucucagcu

SEQ ID NO: 67414 - RNA, 63 nt, Human
gcagugaguguucagaaauuagaucuacaagaaguuuugcaaacagacccucagggccaggca

SEQ ID NO: 67415 - RNA, 63 nt, Human
uuuaaaagaaaagcaaaaugccaauaagugccaguuuugcauuuucauaucauuugcauugag

SEQ ID NO: 67416 - RNA, 63 nt, Human
gacgaguuuuucauaucucaugaauggugcgcuguuuugcauauaaauaaagguaucaaauaa

SEQ ID NO: 67417 - RNA, 63 nt, Human
uggacauucuuuugucuucauuuggugcuuuugguuuugcaccucuccgugauuguagcccua

SEQ ID NO: 67418 - RNA, 63 nt, Human
aggggugucaaaguuucuauuuuuauuuguucuguuuugcacgucuuuaucauuuugcuuuau

SEQ ID NO: 67419 - RNA, 63 nt, Human
auaugaaacaaggggggaggguaauagcaauguguuuugcaacauauuaagaguaugugaagg

SEQ ID NO: 67420 - RNA, 63 nt, Human
auccccaccuugcuaaauuugcuuguguugcuaguuuugcaaaucguuucucugaugaccaua

SEQ ID NO: 67421 - RNA, 63 nt, Human
gagccuggccccaaguuccagagucaaaucccaguuuugcagucaacuauuaaccuggggccc

SEQ ID NO: 67422 - RNA, 63 nt, Human
ccccgacugcagugcaagguggccuugggcacaguuuugcaaccaaccuacuccccuggaaag

SEQ ID NO: 67423 - RNA, 63 nt, Human
gagauuaguagauggcucacuagacauguuuuuguuuugcagacauuauauccauuccagucc

SEQ ID NO: 67424 - RNA, 63 nt, Human
uaccccuauuagaugguaagaacaauuaaugcaguuuugcacaaauauuuuuacauucugauc

SEQ ID NO: 67425 - RNA, 63 nt, Human
uaaacacugggauuuuuggauaacagacugacaguuuugcauaauuauaaucggcauuguaca

SEQ ID NO: 67426 - RNA, 63 nt, Human
ccccagcugugucucccaaccucccuucguguuguuuugcauggcuuugcaguuauggagaaa

SEQ ID NO: 67427 - RNA, 63 nt, Human
cgaggcuggugccaggcgcguguaaaugguuuuguuuugcacguuugguuugcgcaguaguuu

SEQ ID NO: 67428 - RNA, 63 nt, Human
ccucucuuccuccccucugcacuuuguuuacuuguuuugcacagacgugggccugggccuucu

SEQ ID NO: 67429 - RNA, 63 nt, Human
ugcuuuacaaagcauuucagccuuucccccucaguuuugcauugauuuuuugacaagucugua

SEQ ID NO: 67430 - RNA, 63 nt, Human
uggcuaauuauuugaaugaaugaauggauggauguuuugcaugcucaauuucuagguccuuug

SEQ ID NO: 67431 - RNA, 63 nt, Human
gcaauuguucugaaaaugucaaacgaggcuucuguuuugcaccugcagaucaccgaguugguu

SEQ ID NO: 67432 - RNA, 63 nt, Human
uucuauuuuuacaguaaccuugaauucuucugaguuuugcauguauuaaauucaauuaaugcu

SEQ ID NO: 67433 - RNA, 63 nt, Human
cauauacaucaguaagagcucaucuuggaaccuguuuugcaguuucuugcaguuucaaaaauu

SEQ ID NO: 67434 - RNA, 63 nt, Human
aaauacuaauuaauuuccaucauuuguagacuuguuuugcaaugggauauauuuuuacuuaua

SEQ ID NO: 67435 - RNA, 63 nt, Human
aggaagcacuuuggagaaugugggaguccuacuguuuugcacuagucuguaauuuguuaccuc

SEQ ID NO: 67436 - RNA, 63 nt, Human
aacuguagacaaacacaguacgagucucagcacguuuugcauuuauuguacugcccaaauugu

SEQ ID NO: 67437 - RNA, 63 nt, Human
gaagacuauguaaagaugaaggcagagaucggaguuuugcagccacaagcuaagaaacaccaa

SEQ ID NO: 67438 - RNA, 63 nt, Human
ucugugcauauguuaccauacauguccaaagagguuuugcaaaugugauuauguuaaggaucu

SEQ ID NO: 67439 - RNA, 63 nt, Human
gaggucaaaggguugguuuccugggagaaauuaguuuugcauuaaaguaggaguagugcaugu

SEQ ID NO: 67440 - RNA, 63 nt, Human
uuuuuuucuuuuucucauuuucaaugcacauuaguuuugcaucuguuuugugaccuguuagau

SEQ ID NO: 67441 - RNA, 63 nt, Human
acuguggauauuguuacguagccuaaggcuccuguuuugcacagccaaauuuaaaacuguugg

SEQ ID NO: 67442 - RNA, 63 nt, Human
auguuauuacaaauaucuuaauuuucaguaauuguuuugcacuuucaaagauuguaaauaguu

SEQ ID NO: 67443 - RNA, 63 nt, Human
aaaauguauuugcauaggcucuugcuuaucuuuguuuugcaaaauuguucuacuuagaaaaca

SEQ ID NO: 67444 - RNA, 63 nt, Human
auguuaacuuuuuguuuuguuuuguuuuguuuuguuuugcauuuuuaacuccagauauccuaa

SEQ ID NO: 67445 - RNA, 63 nt, Human
uacuaauuuucuagauuuucuacuuuauuaauuguuuugcacuuuuuuauaagagcuaaaguu

SEQ ID NO: 67446 - RNA, 63 nt, Human
uaugcuuccauauuuuuaaauuuuguuuuuuaaguuuugcacuuuuguuuagucucgcuaaag

SEQ ID NO: 67447 - RNA, 63 nt, Human
gguucaauuggacaauuauuuuugcucugcucuguuuugcauggaguauuauuauuuuaaaaa

SEQ ID NO: 67448 - RNA, 63 nt, Human
uugccuacauacugguauuguccuuuccuugaaguuuugcaguagggucuccugucccagggg

SEQ ID NO: 67449 - RNA, 63 nt, Human
gacgcagcugucauuuggcugugcgugcugacaguuuugcaacaggcagagcugugucgcaca

SEQ ID NO: 67450 - RNA, 63 nt, Human
agacuugugcacauauauuccgcuuucagaauaguuuugcaaauuguacacaaacaaacaaaa

SEQ ID NO: 67451 - RNA, 63 nt, Human
ugaaggagcacagagaacauuuguugaaguauaguuuugcaauucauauacuguuuucuaaaa

SEQ ID NO: 67452 - RNA, 63 nt, Human
auguaacucuuuuuuuaccucauguuuuuguuuguuuugcacauuucucauaccacagguauu

SEQ ID NO: 67453 - RNA, 63 nt, Human
ugagcaaagaccuguuguuaaucuucaagcuagguuuugcaguucccaaccacaacauucuuc

SEQ ID NO: 67454 - RNA, 63 nt, Human
agaaaaaaaaaggaaaaaaaaaaaaaaaccaauguuuugcaguuuuuuucauugccaaaaacu

SEQ ID NO: 67455 - RNA, 63 nt, Human
aggauacuagugaaguaagaaauuuugcuuguuguuuugcaaaccaaauaguuuccucaaaca

SEQ ID NO: 67456 - RNA, 63 nt, Human
aucccggugcuugguguccuugcaugacauggaguuuugcauguagaucaauuuaaaauguac

SEQ ID NO: 67457 - RNA, 63 nt, Human
aauuugugcuucuggagcuucucaagggauuguguuuugcagguacagaaaacugccuguuau

SEQ ID NO: 67458 - RNA, 63 nt, Human
acaccacaggcuuucugaccauccauucguuggguuuugcauuugacccaacccucugccuac

SEQ ID NO: 67459 - RNA, 63 nt, Human
ucugaucaauugugcuuuaggaaauuauugacaguuuugcacagguucuugaaaacguuauuu

SEQ ID NO: 67460 - RNA, 63 nt, Human
agggagauugcuaguggaaauuggagggaauuuguuuugcaucauuugucuaggaucuaugca

SEQ ID NO: 67461 - RNA, 63 nt, Human
auacauugauuuugguauaauaaaugugaggcuguuuugcaaacuuaacuugcaggaauggua

SEQ ID NO: 67462 - RNA, 63 nt, Human
aaauaauucaacuucaaaugaacuuaccagaauguuuugcauaucaacaaaaaaaguggcuug

SEQ ID NO: 67463 - RNA, 63 nt, Human
uauuccaaggccugugaauggcagccugaggaaguuuugcaugcaggcuguguuuucgagcag

SEQ ID NO: 67464 - RNA, 63 nt, Human
gauaugucuggcuuccaagagaaaggaggcuccguuuugcaaaguggaggagggacgagggac

SEQ ID NO: 67465 - RNA, 63 nt, Human
agugaggaguucuuuaaugggugaagaguuucaguuuugcaaaaugaaaaaguucuggagauc

SEQ ID NO: 67466 - RNA, 63 nt, Human
cugcagaauuaccuacuuuuggagccacaggguguuuugcacugaaacgcagaacgcugcaac

SEQ ID NO: 67467 - RNA, 63 nt, Human
ucuuacagcgugacugcaaagaaaaagacuuuuguuuugcaaaagaaaagcagcucggugacu

SEQ ID NO: 67468 - RNA, 63 nt, Human
uuuaguacaauuguaugguuucuugaugauucuguuuugcaauagguagccuaguugcuuuau

SEQ ID NO: 67469 - RNA, 63 nt, Human
caaucugcaaggacauuucucaagggccaugugguuuugcagacaacccuguccucaggccug

SEQ ID NO: 67470 - RNA, 63 nt, Human
acacagagcagcuacuucuaagccauaucgacuguuuugcagaggauuugugugugcugccuc

SEQ ID NO: 67471 - RNA, 63 nt, Human
gacaugucacagguggaaaaagggccacaagccguuuugcacaaaugccugcccaccugcccc

SEQ ID NO: 67472 - RNA, 63 nt, Human
uauuacuguguauuuuagaaaucauucuuuacaguuuugcauugcugaggagagagaaaaaac

SEQ ID NO: 67473 - RNA, 63 nt, Human
ugagaauuacaauaagcaagaggaaauuaagguguuuugcaagagcuguauuuauauuacagu

SEQ ID NO: 67474 - RNA, 63 nt, Human
guuuuucaagugccauuuauucuaguuuaucauguuuugcauguuugaaaguaugaaugugcu

SEQ ID NO: 67475 - RNA, 63 nt, Human
gagcuggcuuuagacauuggugggaccaaggauguuuugcaggaugcccugauccuaagaagg

SEQ ID NO: 67476 - RNA, 63 nt, Human
cuuucuugaauucuuauuuugguuugccuggauguuuugcagaucccaaucuuucuuuuaagc

SEQ ID NO: 67477 - RNA, 63 nt, Human
caucuauagccaaauugauaagguuauuacuguguuuugcacaaaguauauuagcaaaaguau

SEQ ID NO: 67478 - RNA, 63 nt, Human
agagaacuauuggacucuaauugcuuugaacuaguuuugcaguuugacuuuacgucuuauaca

SEQ ID NO: 67479 - RNA, 63 nt, Human
auuauauauauuuuguuucuuuaaauuucaaauguuuugcaaacaucacugaguuaggugggg

SEQ ID NO: 67480 - RNA, 63 nt, Human
aaauauuuauucuguuagaaaaaaaaauuuucuguuuugcaauagaaggauguggagaaaugc

SEQ ID NO: 67481 - RNA, 63 nt, Human
ucagaagcagcucuuggaggagaugagcauuuuguuuugcacaggaagaugcugcugcugccc

SEQ ID NO: 67482 - RNA, 63 nt, Human
gugcaggggacucaggggcuuggcccuaagaauguuuugcacugacagugggaggggauaagg

SEQ ID NO: 67483 - RNA, 63 nt, Human
uuucugucacuguaagccugcccaguaggcaguguuuugcagacuuuggggaguggucuaugu

SEQ ID NO: 67484 - RNA, 63 nt, Human
uuuauuucauuuaaaaucaugugacgcagaauaguuuugcaauguguauauaguugcaggcaa

SEQ ID NO: 67485 - RNA, 63 nt, Human
gcuuuucuuucuuucauucucucuuccugcaguguuuugcauacaucagaagcuagguacaua

SEQ ID NO: 67486 - RNA, 63 nt, Human
auuccaucacaucacauuuaaauugcagacaguguuuugcacaucauguaucuguuuuguccc

SEQ ID NO: 67487 - RNA, 63 nt, Human
ugguuugaaggaaggacaagguagaucuguuuaguuuugcaguugaaguuagaugguccuaaa

SEQ ID NO: 67488 - RNA, 63 nt, Human
cuaaauagccuagucuggggagucuuccauaaaguuuugcauggagcaaacaaacaggauuaa

SEQ ID NO: 67489 - RNA, 63 nt, Human
cuuauauagcaaugaguuuuauuuuguuuauuuguuuugcaauaaaggauaugaagguggcug

SEQ ID NO: 67490 - RNA, 63 nt, Human
uuuauuguaaguguagaaaaucacagagaagcaguuuugcaccagccuuauuccugugccuug

SEQ ID NO: 67491 - RNA, 63 nt, Human
caccugaucacaacuuucuaaggcagcuauuuuguuuugcaaugagauauuugcagugguuuc

SEQ ID NO: 67492 - RNA, 63 nt, Human
auguauguguccaguauguacuauuuuguuuuuguuuugcaagaagaguugaacuauuuuuga

SEQ ID NO: 67493 - RNA, 63 nt, Human
uacauuuuguaagcuuugucagugaaaccaucaguuuugcaggagcuuccuuuccuagucaag

SEQ ID NO: 67494 - RNA, 63 nt, Human
uaguuauuuuuguggcaugguuagauuugacugguuuugcagaagauuacaguuauguacugc

SEQ ID NO: 67495 - RNA, 63 nt, Human
aagagaaaccagaucugaacauguauuuguugaguuuugcaaaauaaaauuaauuuuguaagu

SEQ ID NO: 67496 - RNA, 63 nt, Human
acugcugaagcaaaugugaaugccaaagacuacguuuugcaguuuugcuuuccucccaauaaa

SEQ ID NO: 67497 - RNA, 63 nt, Human
uuuuuuuaauuguuuucagauugugcuggguuaguuuugcaagcaauugauaauuuuuaaaaa

SEQ ID NO: 67498 - RNA, 63 nt, Human
uuaaauuucuuaaaccuuuaagcuuuuuguucuguuuugcaacauuuuguaguauuucuuccc

SEQ ID NO: 67499 - RNA, 63 nt, Human
uuuguuccaaguuaaguguuuucagaaaaguauguuuugcauguauuuuuuuacagucuaaau

SEQ ID NO: 67500 - RNA, 63 nt, Human
gcaucugcuaauaaaacccaacagauacuggaaguuuugcauuuauggucaacacuuaagggu

SEQ ID NO: 67501 - RNA, 63 nt, Human
aaggcaaaugaugccccagagcucuaaccaaagguuuugcagccgccgaaaaacaggaaaguu

SEQ ID NO: 67502 - RNA, 63 nt, Human
uauuuacaggcauauaaaaugaaauugugagauguuuugcaagcuucuuuuuacuuugaguag

SEQ ID NO: 67503 - RNA, 63 nt, Human
uuucuggauugugugcuccucgucaguugacuuguuuugcacacuuuucuuuacuucaugucc

SEQ ID NO: 67504 - RNA, 63 nt, Human
gacuuugguuauccaaaaucacagaaaugaaccguuuugcagcugcgcagucuaaagggcagg

SEQ ID NO: 67505 - RNA, 63 nt, Human
cucaauuuuuggaauuuagagaagaaaucaguaguuuugcaauguuaauuauuuagauauuua

SEQ ID NO: 67506 - RNA, 63 nt, Human
ccagauugucagggauggggggaugguccuugaguuuugcaugcucuccucccucccacuucu

SEQ ID NO: 67507 - RNA, 63 nt, Human
guaagggcaaaaacggauugaaaugaacauagcguuuugcacuaaugauaagauaaccugaga

SEQ ID NO: 67508 - RNA, 63 nt, Human
uguuaugauguuaaguugaaguugaaacaugauguuuugcauuaaauuuaagauaugcaaauu

SEQ ID NO: 67509 - RNA, 63 nt, Human
uucauucuaaguucaaaaguuugaaaauuauuaguuuugcaagaucacacacuaauguaacca

SEQ ID NO: 67510 - RNA, 63 nt, Human
uuuaauguuacuuuaaaaauccauaaucugcuaguuuugcauguacuuauaugaaaacagugc

SEQ ID NO: 67511 - RNA, 63 nt, Human
gcuaccaauaagccaccaucaucuuuuccugggguuuugcauucacugguuguguuaccuagu

SEQ ID NO: 67512 - RNA, 63 nt, Human
cuugagagagccaguugugugcaucucuuuccaguuuugcauccagugacgucugcuuggcau

SEQ ID NO: 67513 - RNA, 63 nt, Human
ggcuuucacaaauuuuguauugcuuuuuuuccaguuuugcagaaaauuuacauucuaguucuc

SEQ ID NO: 67514 - RNA, 63 nt, Human
auuuuuauaaagggaauuuuaaaaaauaaauguguuuugcacaaagcuguuuauuacaaaacc

SEQ ID NO: 67515 - RNA, 63 nt, Human
uaccagagcuaauauauuuauugccuauggcuuguuuugcacuuaauaaaauaauuuguuuuu

SEQ ID NO: 67516 - RNA, 63 nt, Human
acacuguagcucauacuggaaaagucgaucaauguuuugcaguuuauugaaaguaguucuaua

SEQ ID NO: 67517 - RNA, 63 nt, Human
uccuuugauaaaaaguguguauaauguaaaguaguuuugcauauucuugugcugcacaugggc

SEQ ID NO: 67518 - RNA, 63 nt, Human
ccucuuccagcuccaaaguuuuggacccugucaguuuugcaacuacauuauacauuauuauaa

SEQ ID NO: 67519 - RNA, 63 nt, Human
uuacauaugugagauagaaacaaugguuccuuaguuuugcacugggaagaaaauauuuuguaa

SEQ ID NO: 67520 - RNA, 63 nt, Human
aacauuaacaacuccacucauaguaucaacauuguuuugcaaauacucagaauauuuuggcuu

SEQ ID NO: 67521 - RNA, 63 nt, Human
aacauuaagaaguccacugacaguaucaguacuguuuugcaaauacucagcauacuuuggauc

SEQ ID NO: 67522 - RNA, 63 nt, Human
cuuuauagaauugggccaagauaaaucuauguuguuuugcauggcuauuguuaagcuccaaag

SEQ ID NO: 67523 - RNA, 63 nt, Human
uuuugcagaauuuuuccuaauuuuguuuaucacguuuugcacaaagcagagccacugucuaac

SEQ ID NO: 67524 - RNA, 63 nt, Human
uaccuucugaaacuguaccuuuauaaaucaauuguuuugcaaagaaguuauggccuacuuaga

SEQ ID NO: 67525 - RNA, 63 nt, Human
uguuacuucguucuugaauucguacgcuguuaaguuuugcaacuugaaaccuagacacaaggu

SEQ ID NO: 67526 - RNA, 63 nt, Human
ccugcuaugugaaaaaaacauacacuuagcuauguuuugcaacucuuuuuggggcuagcaaua

SEQ ID NO: 67527 - RNA, 63 nt, Human
ccagcuguacauauguggauaagcugauuaaugguuuugcaacuguaauaguagcuguaucgu

SEQ ID NO: 67528 - RNA, 63 nt, Human
accuguugucugguuuugaaaaacaauuaucuuguuuugcaaauuguggaaugauguaagcaa

SEQ ID NO: 67529 - RNA, 63 nt, Human
caccauguguuacuggccuggaaacugaagggaguuuugcaagugaaaauuuagauuucuauu

SEQ ID NO: 67530 - RNA, 63 nt, Human
gcucacuguuuaggacaauuuuucuuuaaaauaguuuugcagauuaaaauugcuuaaauaagu

SEQ ID NO: 67531 - RNA, 63 nt, Human
auagaauccuaauuguuucuguaugugucugguguuuugcacaugcaaaaaaaaaaaaaaaag

SEQ ID NO: 67532 - RNA, 63 nt, Human
aaaacuaaggcuuucacucuagaaugcaaagcuguuuugcagcuguuuucccuuaaagauguc

SEQ ID NO: 67533 - RNA, 63 nt, Human
uuggauguaguguucuuugauuguaucaauuuuguuuugcaguucugugaaauguuuuauaau

SEQ ID NO: 67534 - RNA, 63 nt, Human
aacuaaaaggcuaacuggagcauaauccuuacaguuuugcacucaggggauuaaguuugaaac

SEQ ID NO: 67535 - RNA, 63 nt, Human
auuguaauaaaccauuuuuacugagauugcaacguuuugcacugauaaacaugagaaucugga

SEQ ID NO: 67536 - RNA, 63 nt, Human
uacauuauaacucacagcauuguuccauugcagguuuugcaauguuuggggguaaagacagua

SEQ ID NO: 67537 - RNA, 63 nt, Human
ccaccaacuuaaaaaaaaaaaguacaauucauuguuuugcaaaaguguaugguaggggcuuaa

SEQ ID NO: 67538 - RNA, 63 nt, Human
cagaauaauuuuagguucuuuuguuauucaguaguuuugcagacuuaaaaguguaaauuuaga

SEQ ID NO: 67539 - RNA, 63 nt, Human
aaacaguuaaaaaaagugaaguaguugcaaaguguuuugcacuguugaacuaaguaacugugu

SEQ ID NO: 67540 - RNA, 63 nt, Human
uggcgguagcagcuacuccgagcgccguuuacaguuuugcacagugaucuuccccauugucca

SEQ ID NO: 67541 - RNA, 63 nt, Human
ccaaaucauaaucauguuuucuugcugugauagguuuugcaagccuuuucauuauuuuuuagc

SEQ ID NO: 67542 - RNA, 63 nt, Human
uucacauguauggacgugugugaaugguuguacguuuugcacauuuuguggcuguugagaugu

SEQ ID NO: 67543 - RNA, 63 nt, Human
caaaugccuucaagccaauccuuuuugcuguauguuuugcagccuacuguaguagauacgcaa

SEQ ID NO: 67544 - RNA, 63 nt, Human
cuuacaugcucuuauagugaggcacaucucacuguuuugcagcagaauuugaauugugcaacu

SEQ ID NO: 67545 - RNA, 63 nt, Human
uacagagaucuauaaaaccuugauuauuuguuaguuuugcaauucaaaacagcuaaugucugg

SEQ ID NO: 67546 - RNA, 63 nt, Human
aauuucaaaauagaaaaaaaaaaacuguguccuguuuugcacauagaaagaagcagaucagau

SEQ ID NO: 67547 - RNA, 63 nt, Human
cauaugguagugcccacaagaaagaggacacaaguuuugcacaaaauugcaagucacuuccua

SEQ ID NO: 67548 - RNA, 63 nt, Human
gauugaugacugucucacuuugacuauacccauguuuugcaugcaaugacucaugcaugguuu

SEQ ID NO: 67549 - RNA, 63 nt, Human
aaaugggagguggagccuccuggcugagaaauuguuuugcaaauggaucuauuuuuguaugaa

SEQ ID NO: 67550 - RNA, 63 nt, Human
ccagacccgugcccaaucuccucucccucuguuguuuugcaugaacgugaggagcagcaguuu

SEQ ID NO: 67551 - RNA, 63 nt, Human
caugaagaaaccacugucucuagaagaaagcuuguuuugcaguauuagugaaucacugaauag

SEQ ID NO: 67552 - RNA, 63 nt, Human
accaccacaauggccauuuuuuuuuuagauggaguuuugcaguggugcaaucauagcucauug

SEQ ID NO: 67553 - RNA, 63 nt, Human
guguacucuuuauuucuagcagagugaggauguguuuugcacgucuugcuauuugagcaugca

SEQ ID NO: 67554 - RNA, 63 nt, Human
agcauauauauguuaacuauugagaaaaaacaaguuuugcauuuuauaauuggauauagucaa

SEQ ID NO: 67555 - RNA, 63 nt, Human
gaggaaauaugaaaggauucuugaagauuuccaguuuugcaacugcauaauagcuaugcccaa

SEQ ID NO: 67556 - RNA, 63 nt, Human
gugucugaauguuuuauuuguucuuuagcugaaguuuugcaauuuuuaugucaaaauucaauu

SEQ ID NO: 67557 - RNA, 63 nt, Human
auuaccaaauaguugggguguugacuccuguguguuuugcaagaaugugugguaagccugggu

SEQ ID NO: 67558 - RNA, 63 nt, Human
aucuuuaaguucccagaccaauauacauuaagaguuuugcauggucuaaauuguguuuauucc

SEQ ID NO: 67559 - RNA, 63 nt, Human
gaggucaagaacaugcaagaccaguauucuaaaguuuugcaacaauuaagugcuuuaccuaag

SEQ ID NO: 67560 - RNA, 63 nt, Human
gaggccaagaacuugcaauaccaauguucuaaaguuuugcaacaauaaaguacuuuaccuaag

SEQ ID NO: 67561 - RNA, 63 nt, Human
gaggcuaagaacaugcaagaccaauauucuaaaguuuugcaacaaugaagugcuuuacuuaag

SEQ ID NO: 67562 - RNA, 63 nt, Human
uuaaaauauauauauuuuaauuauauuugacagguuuugcaucuaaauugaccuauuuauuca

SEQ ID NO: 67563 - RNA, 63 nt, Human
ugauuaguaggucugugauuaaguucuuaaauuguuuugcagucuuuuauguuuauuaucaua

SEQ ID NO: 67564 - RNA, 63 nt, Human
guagcaaagggggacucgaaccagaugucguguguuuugcaugcaugcuucuuuuccccaugc

SEQ ID NO: 67565 - RNA, 63 nt, Human
aaaaaugauaaccaguuacuuacuucuuuuguuguuuugcaggccaccuagaaauacaaaaug

SEQ ID NO: 67566 - RNA, 63 nt, Human
acauugaucuuuugcuaaugcaauuagcauuauguuuugcauguaugacuuaauaaauccuug

SEQ ID NO: 67567 - RNA, 63 nt, Human
auuccuucauauuaaaaugacuuuuugucaguuguuuugcauuaaaaauauggcaugccuaag

SEQ ID NO: 67568 - RNA, 63 nt, Human
cccaguaagagagagagagagccaaagcuguccguuuugcagauggacaggaaggagccagga

SEQ ID NO: 67569 - RNA, 63 nt, Human
ugacaugucaauguggcuaguuuuauuuuucuuguuuugcauuauguguauggccugaagugu

SEQ ID NO: 67570 - RNA, 63 nt, Human
aguccugucggcugggcccuuggacggcugucaguuuugcacaugauguuccuauuguaacuc

SEQ ID NO: 67571 - RNA, 63 nt, Human
caugcccgcauuagcucuuagacccacagacugguuuugcaacguuuacaccgacuagccagg

SEQ ID NO: 67572 - RNA, 50 nt, Human
aagauuguggucucuuuuaaguuuugcaguucaugguaaaaugcauuuuc

SEQ ID NO: 67573 - RNA, 63 nt, Human
acauauuauuguaauuuagguauguuuuguuuuguuuugcacaacuguaacccuguuguuacu

SEQ ID NO: 67574 - RNA, 63 nt, Human
gguacuucaaauccuugaagauuuaccacuuguguuuugcaagccagauuuuccugaaaaccc

SEQ ID NO: 67575 - RNA, 63 nt, Human
gaauguauauacaugucaccauggauuggaacuguuuugcauaucagggaaaucauagccaag

SEQ ID NO: 67576 - RNA, 63 nt, Human
cugcucucacugucagcucucauauucuuccagguuuugcacucuacauaaaauuauuucuac

SEQ ID NO: 67577 - RNA, 63 nt, Human
uacuuucuuguuauccauaucauucuuuugugaguuuugcagcagucuugaauaauacagauu

SEQ ID NO: 67578 - RNA, 63 nt, Human
ucuaucuacuuaaacauguuuaaaguauguuuuguuuugcagacuuuuugcauacuuauuucu

SEQ ID NO: 67579 - RNA, 63 nt, Human
gaaccaaauuggauccauuuuuuuaaaaaaaugguuuugcauggaaccuggaccaaggcaaau

SEQ ID NO: 67580 - RNA, 63 nt, Human
cccacccaacagccaauuuuagcagacauccuaguuuugcaggugagaagagcugagguacga

SEQ ID NO: 67581 - RNA, 63 nt, Human
acaaccuagagaacaccugaguacuaagcagcaguuuugcaaggaugggagacugggauagcu

SEQ ID NO: 67582 - RNA, 63 nt, Human
uuugaagacuuuaaaacauuucauacuacuauuguuuugcaaagacuaaaauauuuggggacu

SEQ ID NO: 67583 - RNA, 62 nt, Human
auacaaauaauuuauuucuaauaauaaaggaauguuuugcaaauguugagaguuguuucguu

SEQ ID NO: 67584 - RNA, 63 nt, Human
auaaccaugcucaaaagagcuguucuaaucugcguuuugcauguuaaguguuaauaucaaaca

SEQ ID NO: 67585 - RNA, 63 nt, Human
gagugcccuccuacauaaauaagcaauugcaguguuuugcaugcaaaauauaaaaaauuuaaa

SEQ ID NO: 67586 - RNA, 63 nt, Human
uucccuuucuuagauugcaccagugaaggagauguuuugcaaagauucagagaacuaauuuuu

SEQ ID NO: 67587 - RNA, 63 nt, Human
gaaucaggugugaauguguugagauuuuuuacuguuuugcaugauaggaaaauugagaaagaa

SEQ ID NO: 67588 - RNA, 63 nt, Human
guucacagcaucagcauucaugguguaagaacaguuuugcaguauaacacgaucugauaauca

SEQ ID NO: 67589 - RNA, 63 nt, Human
aaucauguuuaucuauugauuuaaacuucaucaguuuugcauccuacugagaaauguuaguga

SEQ ID NO: 67590 - RNA, 63 nt, Human
ccccugcguuccccacuguggccuagaccguggguuuugcauuguguuucuagcaccgaggau

SEQ ID NO: 67591 - RNA, 63 nt, Human
cacccgaucgcagaggguaauuuucuggaguuuguuuugcagggauagcugggaguauggcca

SEQ ID NO: 67592 - RNA, 63 nt, Human
ucuugagcccucauaaggaaguacuggugcuagguuuugcaagauuuuguauacacuuugcuc

SEQ ID NO: 67593 - RNA, 63 nt, Human
ccaggauuuuggugaggguuggcuguggcugucguuuugcaccucccagauuucaaagaauua

SEQ ID NO: 67594 - RNA, 63 nt, Human
uauacuggucucugugcuauaguggaaucuuugguuuugcaucauaguaaaauaaaauaaacc

SEQ ID NO: 67595 - RNA, 63 nt, Human
aaauagcaauacaguagauuugaauaccuugauguuuugcauuacuucauuuauguuuacauc

SEQ ID NO: 67596 - RNA, 63 nt, Human
uuaagaaauuuaagagaauuguguuuucauuaaguuuugcauaucuuuuguuaugccauguaa

SEQ ID NO: 67597 - RNA, 63 nt, Human
aagcuauuuacccaaagugagcuuucaguuuuaguuuugcauggcuguuugacugccuuuccg

SEQ ID NO: 67598 - RNA, 63 nt, Human
agugcuguauuuucucacguuuucuaaguuuccguuuugcaaggccuaggugacuuuuucaug

SEQ ID NO: 67599 - RNA, 63 nt, Human
uauaugagucucuacauaaguaguuucacuugaguuuugcaguuugaaaucuuaaaggagcuu

SEQ ID NO: 67600 - RNA, 63 nt, Human
cccggcuaauuuuuguauuuuuaguagagauggguuuugcaauguuggccaggcuggucucaa

SEQ ID NO: 67601 - RNA, 63 nt, Human
gaaaguauauauuuaucauauaaaacuugaugcguuuugcacuacucuuuccauuuauaugcu

SEQ ID NO: 67602 - RNA, 63 nt, Human
ugguccgccuuuggcauuguguguacaucugcaguuuugcaugguggguuguuaauauuucaa

SEQ ID NO: 67603 - RNA, 63 nt, Human
aaugggauuggcucuuguuuucugcaaguucauguuuugcauuuuauguucuuccacaauuga

SEQ ID NO: 67604 - RNA, 63 nt, Human
ggaguuuuagcuauuugagaucguggaccaucaguuuugcacuuuagagaguguuucugacuc

SEQ ID NO: 67605 - RNA, 63 nt, Human
uaauuuaccuguuugacuuuauaauguguuuuaguuuugcagaagaacacuguuguaguuuag

SEQ ID NO: 67606 - RNA, 63 nt, Human
cuucaaauuucuaauguuuugcaguguuaaaauguuuugcaaauacaugccaauaacacagau

SEQ ID NO: 67607 - RNA, 63 nt, Human
ccuuuucccaugcccagucuucaaauuucuaauguuuugcaguguuaaaauguuuugcaaaua

SEQ ID NO: 67608 - RNA, 63 nt, Human
auaggaugaaguuauuuauuuucuauuuucacuguuuugcauauugcuguuaauaagcauugu

SEQ ID NO: 67609 - RNA, 63 nt, Human
uauucuuguucagggagaagaucauuuagauuuguuuugcauuccuuagaauggagggcaaca

SEQ ID NO: 67610 - RNA, 63 nt, Human
ucauaggcuuccucagcccucugucauauggcuguuuugcaaaccuguggagucuguuacugu

SEQ ID NO: 67611 - RNA, 63 nt, Human
uuuuuuaacgucucuucuuccauuacaauguguguuuugcaaggacagguucauuuuuuuuag

SEQ ID NO: 67612 - RNA, 63 nt, Human
ugcauuguugcugcauuaguguaauguggugugguuuugcacuuaaaagagguauucauaugc

SEQ ID NO: 67613 - RNA, 63 nt, Human
uaugacaacuguuacuagaaauacaggcuacugguuuugcauagaucauucaucuuaauuuug

SEQ ID NO: 67614 - RNA, 63 nt, Human
uuuugguauugcauugguuuuuaugguaacuagguuuugcaugcaauuaaaaauccuuauuuc

SEQ ID NO: 67615 - RNA, 63 nt, Human
gacuuugcuuaguauugacaacugcacaugaaaguuuugcaaagggaaacaggcuaaaugcac

SEQ ID NO: 67616 - RNA, 63 nt, Human
ugcacccucauugcuguucagauuaaagccucuguuuugcaccugucacuugugugagguaug

SEQ ID NO: 67617 - RNA, 63 nt, Human
acauuguugccucuaucuaguccuacaaguaggguuuugcauacuguguuugccccuaggguu

SEQ ID NO: 67618 - RNA, 63 nt, Human
acacaacagaugcugaaggagaaggaggguaguguuuugcaaaagaaaaagaaaagaaccaac

SEQ ID NO: 67619 - RNA, 63 nt, Human
gagcaguggugucuccaaugaacuuguuuccugguuuugcaucuugugaaauguuuuuuugua

SEQ ID NO: 67620 - RNA, 63 nt, Human
aaugguuauuuuuauugguaguaacugaacaguguuuugcaauuugugaaacaguguauugug

SEQ ID NO: 67621 - RNA, 63 nt, Human
uguggaagggauguuuuguaagaacuaccaacaguuuugcacgaacaaugucuuuuaaauuaa

SEQ ID NO: 67622 - RNA, 63 nt, Human
ugccaacugcugcuguggccuccagcuuggcugguuuugcaggccgccagcaggaaggcgaag

SEQ ID NO: 67623 - RNA, 63 nt, Human
aaggccauugcugaguuugagguggugccaccaguuuugcagguggcaucagaggcuggcaug

SEQ ID NO: 67624 - RNA, 63 nt, Human
auucuuagucuauaauauuaggagacaucuucuguuuugcaaaugucugugaaucugagcaac

SEQ ID NO: 67625 - RNA, 63 nt, Human
ccgcgguugccucuccucggcacccuugauuggguuuugcacuaaagaggucagcugggccaa

SEQ ID NO: 67626 - RNA, 63 nt, Human
aguauuuccaacuugucacuugccagucacuccguuuugcaaaagguggcccuucacugucca

SEQ ID NO: 67627 - RNA, 63 nt, Human
agcugccggaagauucuggagccacuaacauuaguuuugcacauauuuucuugggaguguuac

SEQ ID NO: 67628 - RNA, 63 nt, Human
uaaaucaugacagugagacggugagauggauucguuuugcacacaacauucaaaacacuucau

SEQ ID NO: 67629 - RNA, 63 nt, Human
uuuccgguaucuauuuuugccauacauuuugcuguuuugcaaaguuuguauaagaacacauaa

SEQ ID NO: 67630 - RNA, 63 nt, Human
uugcaccugaucaagagcagugcuucuccauuuguuuugcagagaaauguuuuucauuucccg

SEQ ID NO: 67631 - RNA, 63 nt, Human
auuugagaagauaauaaguaggauuuuuguuuuguuuugcauuuugcaguacaaaggagaaau

SEQ ID NO: 67632 - RNA, 63 nt, Human
gguauccacacauagcacuuuuauuccugacuaguuuugcacacuugaaaauuguuuacuuau

SEQ ID NO: 67633 - RNA, 63 nt, Human
gaaagucuuuuccuugaccaagggggacagucaguuuugcaaaaggacucuaauaccuguuua

SEQ ID NO: 67634 - RNA, 63 nt, Human
ucgccucuaucuuugaaucauauuuuggccuugguuuugcaaugguuuuaugucauccuacag

SEQ ID NO: 67635 - RNA, 63 nt, Human
cccuuccucugcuccuuaaggucacugaccccuguuuugcacaaugguauaauccccacuguc

SEQ ID NO: 67636 - RNA, 63 nt, Human
cagagauaugguugaugagaaucuuaaaugcuuguuuugcacuaucacuuaguaccuguuuga

SEQ ID NO: 67637 - RNA, 63 nt, Human
ugguaguuccugugauucauaauacauauguagguuuugcauaucucagugcaauccaugauu

SEQ ID NO: 67638 - RNA, 63 nt, Human
cagguucugccggugcucggagaagagcgcaguguuuugcaagugcuggagucuccugaggac

SEQ ID NO: 67639 - RNA, 63 nt, Human
guaagugccauguuuauuaucuaaucauuccaaguuuugcauugaugucugacugccacuccu

SEQ ID NO: 67640 - RNA, 63 nt, Human
uuuucccggccuuugaacauuuugccuaugagaguuuugcauauauuuuauacuugaguagac

SEQ ID NO: 67641 - RNA, 63 nt, Human
uuuuauauuugggaaggcaaaaaugaaucuauuguuuugcaauauagguuauaaacaggcaaa

SEQ ID NO: 67642 - RNA, 63 nt, Human
auuuaaaaaaccugacuuuuccagaguaauuuuguuuugcacauucauguuuauugaagugga

SEQ ID NO: 67643 - RNA, 63 nt, Human
aacauguaucagguacuuaauugcauagaguuaguuuugcagcacaaugguguugcuuuaaug

SEQ ID NO: 67644 - RNA, 63 nt, Human
aauguuuuuguaaaauuuucaaaugucagucaaguuuugcauuagggacacauuuauauauag

SEQ ID NO: 67645 - RNA, 63 nt, Human
acaggaaggaaaccuuucagaagucauacuuuuguuuugcaacauagaagucacacaggagaa

SEQ ID NO: 67646 - RNA, 63 nt, Human
cagggcagggccccaggcauugccaagggcuuuguuuugcacacuuugccauauuuucaccau

SEQ ID NO: 67647 - RNA, 63 nt, Human
ugaaguugcuauuaaauggacuucgugauuuuuguuuugcacuaaaguuucugugauuuaaca

SEQ ID NO: 67648 - RNA, 63 nt, Human
cugcccugccuuucauggaauaagaaaggcaacguuuugcagcuuccaaauuucugaagaaac

SEQ ID NO: 67649 - RNA, 63 nt, Human
gauaacaguauuuuguuaucuugcuucucuguaguuuugcaucagcuguuuaacuuugagcug

SEQ ID NO: 67650 - RNA, 63 nt, Human
ggggcaccuccgagagccccuuuuugugauaauguuuugcacuuuuucguacagggugggcgg

SEQ ID NO: 67651 - RNA, 63 nt, Human
agaguuccaguaguugccaacccugcuaacaugguuuugcacaucuagcauccagaacaguga

SEQ ID NO: 67652 - RNA, 63 nt, Human
uguuuauauuccuucaucccucuuguuucccagguuuugcagggaaaaaaagucuggaauuau

SEQ ID NO: 67653 - RNA, 63 nt, Human
uacacacacuguuucauuuugagguaacguucaguuuugcauuuuguuuaaauauugaaggcc

SEQ ID NO: 67654 - RNA, 63 nt, Human
ucuaacuggcuauguuauuauuauuaaauuuauguuuugcaacuuagaaaccagcuacaguau

SEQ ID NO: 67655 - RNA, 63 nt, Human
agcaacacuuccagaggcuucuaaaacacuacuguuuugcagggcaggaguauucuggaaucu

SEQ ID NO: 67656 - RNA, 63 nt, Human
uauguccuaauaauaucccacugggagaaaggaguuuugcaaagugcaaggaccuaaaacauc

SEQ ID NO: 67657 - RNA, 63 nt, Human
caagagaauauacuuuugcauauacaggugaaaguuuugcaauuuauguauacaagaaauugu

SEQ ID NO: 67658 - RNA, 63 nt, Human
ucuguguuuccuguugucaaaugcuaaguguguguuuugcagucaugaacuaaagcacaaaaa

SEQ ID NO: 67659 - RNA, 63 nt, Human
uuuccuuuuuguuauuguugccgaaggugaguaguuuugcauuucugaugacagccuuggaaa

SEQ ID NO: 67660 - RNA, 63 nt, Human
uuuauguuuuguuuuaaucccaaaugucugaauguuuugcaguguguagggguuugagccccu

SEQ ID NO: 67661 - RNA, 63 nt, Human
caagucuuggcacauaugugauggaaauaaaguguuuugcaaucuuuucugcuuugccuaguu

SEQ ID NO: 67662 - RNA, 63 nt, Human
uggucuucacugccaugccucaagaacaccuuuguuuugcacugacaagauggaaaauaaauu

SEQ ID NO: 67663 - RNA, 63 nt, Human
agccaggagcuaaaaccuuagauaucugguucuguuuugcacccagcuuggcagauguggauu

SEQ ID NO: 67664 - RNA, 63 nt, Human
auaugaaagcagcauaagaguagucacaaacauguuuugcaacaaaguuuuaauuagaaugua

SEQ ID NO: 67665 - RNA, 63 nt, Human
gaacggauauaaucagucuggccucuacaacaaguuuugcauuguagaauuguauuuagcuuu

SEQ ID NO: 67666 - RNA, 63 nt, Human
auuccuuccucccccucgguaggaaacaaccuuguuuugcauaguauucagucaccuggaggg

SEQ ID NO: 67667 - RNA, 63 nt, Human
caugauauuugguaaauaacaaggacuccauacguuuugcaaagaguaaauucucucccuccc

SEQ ID NO: 67668 - RNA, 63 nt, Human
cuccugauaagaguugcuggacucgauguuuuuguuuugcauuuucuccucuccuuccccacu

SEQ ID NO: 67669 - RNA, 63 nt, Human
uccuccuuaacugugacucuccgggucuucugaguuuugcaugcugcgggugucuaggacaga

SEQ ID NO: 67670 - RNA, 63 nt, Human
ggggcuguagaagggauagagggcaaaaggaugguuuugcaucuuccucaccgcaguaaacca

SEQ ID NO: 67671 - RNA, 63 nt, Human
uaaugggcuguguauuaaaugguuuuauuuucaguuuugcagcacagaacacuguugaaauau

SEQ ID NO: 67672 - RNA, 63 nt, Human
cucacugacuagaacuuaaucugguacuuuacaguuuugcaccaacucugccaagccacugga

SEQ ID NO: 67673 - RNA, 63 nt, Human
uuccuaggcccuguaauuuaaccagucuuuaagguuuugcaggaaagucccuucuuccaagug

SEQ ID NO: 67674 - RNA, 63 nt, Human
uuuuuggagcucaguuaagccaauacauuuaaaguuuugcaugaggaacacugacuuuauuaa

SEQ ID NO: 67675 - RNA, 63 nt, Human
cucuagaucugguuaaaugcagaaugcagguuuguuuugcaugcuggacuagagcauauugaa

SEQ ID NO: 67676 - RNA, 63 nt, Human
aaggaguccucaggccccucgcagcauaaggauguuuugcaacuuuccagaaucuggcccaga

SEQ ID NO: 67677 - RNA, 63 nt, Human
ugccuugucuccuccccaccccagggggaugccguuuugcaguguggacacguguuugaagca

SEQ ID NO: 67678 - RNA, 63 nt, Human
cgccguugaggauguguuucauucugguggucuguuuugcaagcuugauaacagaauguccgu

SEQ ID NO: 67679 - RNA, 63 nt, Human
uauugcuuaucugaaaugcuugaaaccagaauuguuuugcauuuuuugaauauuuguauacac

SEQ ID NO: 67680 - RNA, 63 nt, Human
agcaccugccucagcaauugucuacauucaguuguuuugcauaacgucugccuucuuuccuuu

SEQ ID NO: 67681 - RNA, 63 nt, Human
uuucacaugcaucagaaccaugauuuagauguaguuuugcagagacaaaaauccaugagugaa

SEQ ID NO: 67682 - RNA, 63 nt, Human
auacgacccagagauaacacgaugcguauuuuaguuuugcaaagaagggguuuggucucugug

SEQ ID NO: 67683 - RNA, 63 nt, Human
caagugauucacccaccuuggccucauaaaccuguuuugcagaacucauuuauucagcaaaua

SEQ ID NO: 67684 - RNA, 63 nt, Human
guuaaauguuggcauuuacuuguauugaccaaaguuuugcagcucuacuauauucugugcuca

SEQ ID NO: 67685 - RNA, 63 nt, Human
gucugaauuugggcccccuuucugacuaaugcaguuuugcacaagguagaaguuagugacccu

SEQ ID NO: 67686 - RNA, 63 nt, Human
aagaagggagaaaugaucauaggacugggaauuguuuugcaaacguucuaggagaugugagag

SEQ ID NO: 67687 - RNA, 63 nt, Human
aaaacagugguccugaaaacucuugccaaaucaguuuugcaagccaaaucauuauuaaaagug

SEQ ID NO: 67688 - RNA, 63 nt, Human
uccagucuuugcauuccaaagccuuuugcuaaaguuuugcacuuuuuuuuuuucauuucccau

SEQ ID NO: 67689 - RNA, 63 nt, Human
cccacuuaaucuacugugguguuuuguuuauuaguuuugcauaauuucagcuucuauauauug

SEQ ID NO: 67690 - RNA, 63 nt, Human
uaacucgaguuucucaacuguucaaccucacugguuuugcacugauuuuugagagcggagacc

SEQ ID NO: 67691 - RNA, 63 nt, Human
augcagaaagcuguaugcaggaugcucacugauguuuugcacuuuaaaacugaaauucaacuc

SEQ ID NO: 67692 - RNA, 63 nt, Human
gaauauuuauauuucuuguuuuuuucuuuauauguuuugcauuuuaauauguugagccacugg

SEQ ID NO: 67693 - RNA, 63 nt, Human
ucuguucauucuuuaaguaucuauauuucauuuguuuugcacauaugcauaugugcccauuua

SEQ ID NO: 67694 - RNA, 63 nt, Human
guuuuaauaguuuuuguuugcaguccucuguuaguuuugcauaguugcacuacaagaagaaug

SEQ ID NO: 67695 - RNA, 63 nt, Human
acuguccuguuacugaacacuguucuaugguuaguuuugcagguuugcauccagcugugugau

SEQ ID NO: 67696 - RNA, 63 nt, Human
uuauguauuuaaugauacacuguuuaauugacaguuuugcauaguuugucuaacuuuagagaa

SEQ ID NO: 67697 - RNA, 63 nt, Human
uagauaguuucacuuuuuaaaaaauccauuacuguuuugcauuucaaaaguuggauuaaaggg

SEQ ID NO: 67698 - RNA, 63 nt, Human
ugccacaaguauauaauaagcuauauuaauuguguuuugcauaaaauugccaaaacacaguaa

SEQ ID NO: 67699 - RNA, 63 nt, Human
uuccaucaaguuuguacacucuuuucucucccuguuuugcagcaacaaauugcgaagugcuuu

SEQ ID NO: 67700 - RNA, 63 nt, Human
uggaacuuacaaagggucuaucuuguaaauauuguuuugcauugucuguuggcaaauuuguga

SEQ ID NO: 67701 - RNA, 63 nt, Human
aaacuugaagugauaugcagcaguaaucuauuuguuuugcauuguucuugguguuuuguguuu

SEQ ID NO: 67702 - RNA, 63 nt, Human
cagacacuuaacucaauuucuugguauuauucuguuuugcacaguuaguugugaaagaaagcu

SEQ ID NO: 67703 - RNA, 63 nt, Human
uuaugcguaagaguggaguuguuggcuugucaaguuuugcaaaauaaugccagguauuuucca

SEQ ID NO: 67704 - RNA, 63 nt, Human
aaugcuagguaauaaggacacuuuguacaggcuguuuugcaccugauuuuauuuaucauuagu

SEQ ID NO: 67705 - RNA, 63 nt, Human
uuggcaaugaugaauuguuauguaugcauuaauguuuugcagcccaaaaguuguucacauuuu

SEQ ID NO: 67706 - RNA, 63 nt, Human
uagcaaaugugaauucuuuugagaaaguaugaaguuuugcagaaauugacugugaaaugucag

SEQ ID NO: 67707 - RNA, 63 nt, Human
cuuuuauguuuagcuuccaaguauuuuucuaauguuuugcauuucaagugguaucacuguuaa

SEQ ID NO: 67708 - RNA, 63 nt, Human
uuugaaugaaggaaaugagguuuuguuucaccuguuuugcagcaguaagagaaacuagugcug

SEQ ID NO: 67709 - RNA, 63 nt, Human
cagaagagaugaucaauaacuaaaauguuuuucguuuugcacaugguaaaauuuuagguagag

SEQ ID NO: 67710 - RNA, 63 nt, Human
aaaacauuuucccauuuaaaggaaaacacucuaguuuugcaaguauaugcauacaagagacuu

SEQ ID NO: 67711 - RNA, 63 nt, Human
ggacuucuuuuuaauuugguaggauuuugacugguuuugcaacaauaggucuauuauuagagu

SEQ ID NO: 67712 - RNA, 63 nt, Human
guaggccgugaagaaagaaugugaguaacuguuguuuugcaaggauuuguaggguuaugggca

SEQ ID NO: 67713 - RNA, 63 nt, Human
guaagagucuaacauaggcuuagcuacagugaaguuuugcauugcuuuugaagacaagaagau

SEQ ID NO: 67714 - RNA, 63 nt, Human
uggguuaaaauauaacaucacuauuuggcuuuuguuuugcaugauuuuuaaaagcaguacucc

SEQ ID NO: 67715 - RNA, 63 nt, Human
ggacuacaggcaugugccaccacgcccagcuaaguuuugcauuaucaguagagacgggguuuc

SEQ ID NO: 67716 - RNA, 63 nt, Human
uguaaaguuuuccuguguuuagcuuguugaaauguuuugcaucugucaauuaaggaaaaaaaa

SEQ ID NO: 67717 - RNA, 63 nt, Human
uacugaaauaccagagaucucacuuuugauacuguuuugcacuucauaugugcuucuauguau

SEQ ID NO: 67718 - RNA, 63 nt, Human
gcuccccauggcuccucaccaccgagacaguugguuuugcaugucugcaugaaggucuaccug

SEQ ID NO: 67719 - RNA, 63 nt, Human
aauauuuaaagauuguuuccuuagugucuugaaguuuugcacaaaauucuuuuuuuugagaug

SEQ ID NO: 67720 - RNA, 63 nt, Human
cuuuuauacacaacguuuuuguuaggcaucacaguuuugcaaccucugcuccaaagagaaaaa

SEQ ID NO: 67721 - RNA, 63 nt, Human
aaaaaaaaaaguuuuugcuucaaguguuuugguguuuugcacuucuguaaacuuacuagcuuu

SEQ ID NO: 67722 - RNA, 63 nt, Human
aaauaucuuucauauuuguuugcuguaaagaugguuuugcaagaauaagucaugaccaagaca

SEQ ID NO: 67723 - RNA, 63 nt, Human
auggauaauuauuuuaacaaugcuaauauuugaguuuugcaguauauuauagaauauagucca

SEQ ID NO: 67724 - RNA, 63 nt, Human
aauaaaacauagcguggaacucauucagguaauguuuugcauuucauugcuuuuggaugaaca

SEQ ID NO: 67725 - RNA, 63 nt, Human
uucuuauaugaauaaccuuccuggauuuguuuaguuuugcaccaauaaaacuguguacuacug

SEQ ID NO: 67726 - RNA, 63 nt, Human
ggagcacuuuaauuacaacugaaaaaucagauuguuuugcaguccuuccuaucuuacacuaau

SEQ ID NO: 67727 - RNA, 63 nt, Human
ccucuaaacccaucccgggcacauaccacccguguuuugcauguauuucucauuucauuuuag

SEQ ID NO: 67728 - RNA, 63 nt, Human
gccucauugcacucuacccaauugcguuagucuguuuugcaggaauaccugaggcuggguaau

SEQ ID NO: 67729 - RNA, 63 nt, Human
acaaaauccuucugugggcaaaacuuuguuuuuguuuugcacaguaagaaacaauaggcaagc

SEQ ID NO: 67730 - RNA, 63 nt, Human
gucuucucuccacuucuggagaugaauuucuauguuuugcaccuggucacagacauggcuugc

SEQ ID NO: 67731 - RNA, 63 nt, Human
aacaaacaaaacaaaaaagccccacacauaacuguuuugcacgugcaaaaauguauuggguca

SEQ ID NO: 67732 - RNA, 63 nt, Human; identical to SEQ ID NO: 67718

SEQ ID NO: 67733 - RNA, 63 nt, Human
cuauugagaauguggauaaaugaacaauuguaaguuuugcaucauaaacugagaacuuucuuu

SEQ ID NO: 67734 - RNA, 63 nt, Human
auucacuuuugugccauuuuuguaaauacaguaguuuugcacaaccucucacaaaugucugua

SEQ ID NO: 67735 - RNA, 63 nt, Human
ggagcagugcguuuuaccucagccagucaguauguuuugcauacuguaauuuauauugcccuu

SEQ ID NO: 67736 - RNA, 63 nt, Human
gaaguuauuaggcucagcuucagucauguguaaguuuugcaguguaauacauauguagucugg

SEQ ID NO: 67737 - RNA, 63 nt, Human
gcaaguuguaaggaguugaacaguaaagaggaaguuuugcacacccaguuccauaacguuguu

SEQ ID NO: 67738 - RNA, 63 nt, Human
gagguuucaaagaaaaggugucauuggagcaguguuuugcagaaugagccagaguucaccaag

SEQ ID NO: 67739 - RNA, 63 nt, Human
gcuauucauuugugcucuccucuuuuuuguuuuguuuugcacuuugucaaucauuuggggaaa

SEQ ID NO: 67740 - RNA, 63 nt, Human
aacaaagaugguuguauuccucacuuugauguuguuuugcaagauguuuguggaaauguucau

SEQ ID NO: 67741 - RNA, 63 nt, Human
guggccuguggcuccguccacaagucaugcugaguuuugcagccucugugacuuggagauguc

SEQ ID NO: 67742 - RNA, 63 nt, Human
cuuaggcaguaauagacaucacaaacugccaugguuuugcacuaugauuauaauaccugcauu

SEQ ID NO: 67743 - RNA, 63 nt, Human
gcuguuggccucuggggcugucauggcccacgcguuuugcaaaguuugugacucaccauucaa

SEQ ID NO: 67744 - RNA, 63 nt, Human
agaauagccuucuguaaugaggcguuuguuagaguuuugcaugagauucuaauacuucaguag

SEQ ID NO: 67745 - RNA, 63 nt, Human
gaaccaaggccagugaauaagcaacuuucuacaguuuugcaccacggcaagaaaaccaaaaac

SEQ ID NO: 67746 - RNA, 63 nt, Human
cacauauuuuaaaauuuguucuuguauuuauugguuuugcagaagaaggcaucgucaugcaca

SEQ ID NO: 67747 - RNA, 63 nt, Human
accaauacagccccuuuuauaaggauuuugaauguuuugcaaauguauuggucccuguguugu

SEQ ID NO: 67748 - RNA, 63 nt, Human
aguccaaagaauuuaggucccuauugucacuuuguuuugcaauguuuuuuauaaaaaugcaau

SEQ ID NO: 67749 - RNA, 63 nt, Human
uuucacaauuagugguuauucuuuucuguguuuguuuugcacuuuaaaaaagagagaacacau

SEQ ID NO: 67750 - RNA, 63 nt, Human
agcaguuuugaaacuagucauccugguacaaaaguuuugcagcauugccuaaauuauagugcu

SEQ ID NO: 67751 - RNA, 63 nt, Human
cagcgauggcaagcaggcggcguugcugggacuguuuugcacuggagccagcaucaggauguc

SEQ ID NO: 67752 - RNA, 63 nt, Human
cucaagagagagaagagaaaaugaaagcagcugguuuugcagaagugugugucgcaugcgcca

SEQ ID NO: 67753 - RNA, 63 nt, Human
aaagauguuuuguuaauagaaggauuuuaauacguuuugcaaaugcaucaugcaaugaauuuu

SEQ ID NO: 67754 - RNA, 63 nt, Human
gauauugagggcuucagcugcugcuauuaugauguuuugcaaaggaaaauaaucaaaccaaag

SEQ ID NO: 67755 - RNA, 63 nt, Human
auguauauagauuuuuuuaaaagaauaaauguuguuuugcaaauguagguucuuagaguccac

SEQ ID NO: 67756 - RNA, 63 nt, Human
cgcccaggaggggccgcagggcguguaugagcaguuuugcaaacagaacacaaccacaaugau

SEQ ID NO: 67757 - RNA, 63 nt, Human
ugccccgcaccgcuuccacaaaauagcaaugugguuuugcagcucugacuucugcucccagua

SEQ ID NO: 67758 - RNA, 63 nt, Human
uuucacaauuaguggugguucuuuuccauguuuguuuugcacuuuaaaaaagagagaacacau

SEQ ID NO: 67759 - RNA, 63 nt, Human
uccaccucugucauuccgucaauucucaggaaaguuuugcaggaaucucucccguuacuugaa

SEQ ID NO: 67760 - RNA, 63 nt, Human
gggccaaaauugaaugcuaugcuuagauuagggguuuugcaaccugaggucuauaaacaaagu

SEQ ID NO: 67761 - RNA, 63 nt, Human
gaccccaaagaucucauguuaaguggagaaaggguuuugcaaacugaaagaucuguagagagu

SEQ ID NO: 67762 - RNA, 63 nt, Human
cugagugccagccaccgugugaacucuuuggagguuuugcauuuuagguaaauaacugucugu

SEQ ID NO: 67763 - RNA, 63 nt, Human
aaaaccgauccauagaagggcuucccaaaccuuguuuugcaacaucccaaauugucuccaguu

SEQ ID NO: 67764 - RNA, 63 nt, Human
cugccugggacucuauuuauucugauuaaagggguuuugcaaaugggcuugucccuuggggcu

SEQ ID NO: 67765 - RNA, 63 nt, Human
uccauggccuuuauuucuccucuuccagugggaguuuugcaggcucuucucuguggaaacuuc

SEQ ID NO: 67766 - RNA, 63 nt, Human
uuuuuagcugagggguaaguauccuagcugagaguuuugcaucuuugggcuggguuugcagug

SEQ ID NO: 67767 - RNA, 63 nt, Human
uuugcaucuuugggcuggguuugcagugguuguguuuugcauaaaaugucuagucuuugccac

SEQ ID NO: 67768 - RNA, 63 nt, Human
uguuguagugcuuguagaguguaaagugaaacaguuuugcauuuuccaucauuuauuauuuau

SEQ ID NO: 67769 - RNA, 63 nt, Human
aucguggguucuuauuuaauuauuuuuauaguuguuuugcauuuuuaauuauaauuuauuuau

SEQ ID NO: 67770 - RNA, 63 nt, Human
aaggaagcagcugucuaaaaugcagugggguuuguuuugcaauguuuuaaacagaguuuuagu

SEQ ID NO: 67771 - RNA, 63 nt, Human
ugugcaaauuguuuaaaaauuagauguguugcaguuuugcauguaaucgguuauaccuuuauu

SEQ ID NO: 67772 - RNA, 63 nt, Human
aucuggaacaaaggagcuucuuuuuuuuucuagguuuugcaggcaugaaauagugauuauauc

SEQ ID NO: 67773 - RNA, 63 nt, Human
agauaaauguuaauguucccaauagucaagcuuguuuugcaguagugaaaagcuuagaugagu

SEQ ID NO: 67774 - RNA, 63 nt, Human
uucuaaagagccaaaugcuauuccuucaagccuguuuugcaggcagaaaauaccagcaguguc

SEQ ID NO: 67775 - RNA, 63 nt, Human
uaaaacgaagguguuuauccugugagccugugcguuuugcauacuggguugguuugcuggggc

SEQ ID NO: 67776 - RNA, 63 nt, Human
uuuugcuggguugguuuuuuuuuuaauuaaaaaguuuugcaucuuuuaaaaaaaaucacagca

SEQ ID NO: 67777 - RNA, 63 nt, Human
uucuggguugccugucggcuuucuuaucugccuguuuugcaagcaccuucuccuguguccuug

SEQ ID NO: 67778 - RNA, 63 nt, Human
uaagugguuauaacuuuugagucagugguuuauguuuugcauuuuuuuuguuuugagacaaag

SEQ ID NO: 67779 - RNA, 63 nt, Human
cacagcacagccuggucaguccugcgcacuauaguuuugcaaguggcuugaagaggaguuuca

SEQ ID NO: 67780 - RNA, 63 nt, Human
ucggagucugugcccgucgcguccccugcuugaguuuugcacuuggaagaacccugcaccggc

SEQ ID NO: 67781 - RNA, 63 nt, Human
ugugauaaucuuguuugauaaaaaaguaaaccuguuuugcaauugaagccuccauuuucuaug

SEQ ID NO: 67782 - RNA, 63 nt, Human
ugguucucagggcagcauuuuccaggcggguuuguuuugcauuucuuggagccucuccgagca

SEQ ID NO: 67783 - RNA, 63 nt, Human
ccucgcucccagccccaggaccugcggagcuacguuuugcagggcucaguacgaggcugcccg

SEQ ID NO: 67784 - RNA, 63 nt, Human
gugcgaacgaguuccauagggccacaucgggcuguuuugcauuuagugguagcaccaggaccc

SEQ ID NO: 67785 - RNA, 63 nt, Human
augcagagaaaaguuuuugacuggaaauacacuguuuugcaucaagcuggaguacuggaugga

SEQ ID NO: 67786 - RNA, 63 nt, Human
agaggggauauaaguuagggacugauugugcagguuuugcaaggcucagagagcaaaagugga

SEQ ID NO: 67787 - RNA, 63 nt, Human
ugaccugccuuuuauauguaugaauauuucauaguuuugcauaucagauguaggcauacagac

SEQ ID NO: 67788 - RNA, 63 nt, Human
auguuguuaauaaaugucugcuuuguaaaagcaguuuugcaauuuuuuaaagaucuauuucug

SEQ ID NO: 67789 - RNA, 63 nt, Human
guccgauuauauuggugcguuuuuacaguuaggguuuugcaauaacuucuauauuuuaauaga

SEQ ID NO: 67790 - RNA, 63 nt, Human
gaaguuuagggucccaucucccagauguaaguuguuuugcaaacucaguuugccaggauuucu

SEQ ID NO: 67791 - RNA, 63 nt, Human
aauggacuuucugaaagggaaaaaccaaaagcuguuuugcagugcuugccaauuucucuagug

SEQ ID NO: 67792 - RNA, 63 nt, Human
agcagcacacauuuucacguuuccacuuaaaucguuuugcacaaagucuugcuucgcucagau

SEQ ID NO: 67793 - RNA, 63 nt, Human
aagaacaguucugugaaugcaaacaccuccugaguuuugcaauugagaaaaugauuuggagaa

SEQ ID NO: 67794 - RNA, 63 nt, Human
cucuguuuuucacauucuuggaaauauaucauuguuuugcaaauuucuauaucuaauucaggg

SEQ ID NO: 67795 - RNA, 63 nt, Human
guauguagcccugucacaggacagcucacugugguuuugcacacugccuaaggguuaaauugu

SEQ ID NO: 67796 - RNA, 63 nt, Human
ugucucaaacagggacuugugaguacuuggcaaguuuugcagccuauuuuuguauucuuaauu

SEQ ID NO: 67797 - RNA, 63 nt, Human
ccauauguacauaaucuagauuuuguuuucauaguuuugcacuuuuauagccuauuuuugaag

SEQ ID NO: 67798 - RNA, 63 nt, Human
agggugggcccucuggggaggcccaagcagcuuguuuugcaaaggcccaaguccuccugcuag

SEQ ID NO: 67799 - RNA, 63 nt, Human
uaaauggauaauguauuuguccuuuaaaccucaguuuugcaauauguuucacagcuugucucc

SEQ ID NO: 67800 - RNA, 63 nt, Human
gaagggccauguuugaguuuugcuuuguauguuguuuugcaaguaucugccugguacuuugau

SEQ ID NO: 67801 - RNA, 63 nt, Human
uguauauauauauucuucauaauggaggacaauguuuugcaauauauaaaucauucuauuuuu

SEQ ID NO: 67802 - RNA, 63 nt, Human
cuaacgucagguaacaaauagacagcaagaaagguuuugcaccauccucuuacggccuagaga

SEQ ID NO: 67803 - RNA, 63 nt, Human
acaaaauaaauaaaugacuucuuugcuauuuugguuuugcaaaaagacccacuaucaaggaau

SEQ ID NO: 67804 - RNA, 63 nt, Human
ucaauguugcucuggucugggaagaauguauuuguuuugcacuauaauaaaugcgauuaaguc

SEQ ID NO: 67805 - RNA, 63 nt, Human
caacaccaccgagaucucccucaggcuggccagguuuugcagcuggaauucuccucuuggucc

SEQ ID NO: 67806 - RNA, 63 nt, Human
gcagugcugugcggaggccuuaacuugaguucuguuuugcaccuggauuuaccagcacaucaa

SEQ ID NO: 67807 - RNA, 63 nt, Human
agcuaagggguggugcuugggcucaggccugagguuuugcaucuguucaauagcagaggagag

SEQ ID NO: 67808 - RNA, 63 nt, Human
uuggaagugaggccuuuuauuaaaaauaaaaggguuuugcaguuugaaaaacuuuaaaguccc

SEQ ID NO: 67809 - RNA, 63 nt, Human
cagcaauauaggaggcaauaaucuuuuaacaguguuuugcaaacaaacaaaaagagaaaaauc

SEQ ID NO: 67810 - RNA, 63 nt, Human
uaagcaaauccaauagagauguuucuggggaagguuuugcagcccacuccccaucuuccugcu

SEQ ID NO: 67811 - RNA, 63 nt, Human
ugguggggagggagggagggggagggcugaauuguuuugcagaggaagauggcaucugugcuu

SEQ ID NO: 67812 - RNA, 63 nt, Human
aggugauuuuaugacaggaaagugaaagaauuaguuuugcaaaaaaacaaaaacaaaaaaaga

SEQ ID NO: 67813 - RNA, 63 nt, Human
aaccacaucucaggcggcagugaaguccagauaguuuugcagauuguuuugcuacuuuuucau

SEQ ID NO: 67814 - RNA, 63 nt, Human
gcuguagacaccguuccucaugcugccggguggguuuugcagaagcucccuuagugauuucau

SEQ ID NO: 67815 - RNA, 63 nt, Human
aaugcagaaauguuccuuccgccacucacugaaguuuugcauucuggcuugugcaguuuuuau

SEQ ID NO: 67816 - RNA, 63 nt, Human
uuguuguuguuguuguuguugagacagagucuuguuuugcagcccaggcuggagugcaguggc

SEQ ID NO: 67817 - RNA, 63 nt, Human
uggggaaauuuaugccucuuacugguacuacuuguuuugcauugaagcugacugguugaguuc

SEQ ID NO: 67818 - RNA, 63 nt, Human
cuccuuuuuuaagaaaacgaguuaaguuuaacaguuuugcauuacaggcuugugauucaugcu

SEQ ID NO: 67819 - RNA, 63 nt, Human
aaugacagggcaagugauuucuaacuuaguugaguuuugcaacaguaccuguguuguuauuuc

SEQ ID NO: 67820 - RNA, 63 nt, Human
auuuuacauuuuagucaugcaaagauucaaguaguuuugcaauaaguacuuaucuuuauuugu

SEQ ID NO: 67821 - RNA, 63 nt, Human
cuugcuguagcugagacuugucuagaguccuuuguuuugcacuuuugacccaccccuuccugg

SEQ ID NO: 67822 - RNA, 63 nt, Human
gggacccuugccuuccacacuugcaggugucacguuuugcagggagguguuugggccuugggc

SEQ ID NO: 67823 - RNA, 63 nt, Human
uuaaaauauuuaaaaaguggauauuccaggaauguuuugcagcuuuguacaaguaacauaaau

SEQ ID NO: 67824 - RNA, 63 nt, Human
auaaucaggauuacaacuuuuaggaauuacuugguuuugcacauuaagaggcccauaaguuua

SEQ ID NO: 67825 - RNA, 63 nt, Human
uuuuucccugcauggagagugucauaaguuauuguuuugcauaucuacugcaugccaagcacu

SEQ ID NO: 67826 - RNA, 63 nt, Human
acacacacacacaaaacuuugaggcagcgcauuguuuugcauccuuuuggcgugauauccaua

SEQ ID NO: 67827 - RNA, 63 nt, Human
ucaaucugcuacuuaacccugaaaacaaaaucaguuuugcauauuaccacuaacacuaauaca

SEQ ID NO: 67828 - RNA, 63 nt, Human
uauuagauauuugacuuaaacuaucucaauaaaguuuugcagcuuucaccaaagaagucuugc

SEQ ID NO: 67829 - RNA, 63 nt, Human
caugcagccacuuaggacaaaucugcaaagcauguuuugcauguaaaagccuaggucuauuug

SEQ ID NO: 67830 - RNA, 63 nt, Human
gaaugaagguuuuuguaaagauuucuguucagcguuuugcaagguaaaauuuuaggcaaguuu

SEQ ID NO: 67831 - RNA, 63 nt, Human
uauuaaaauuguuguccgguuuacuuuaacuuaguuuugcauaguucuagugcagcugaaauu

SEQ ID NO: 67832 - RNA, 63 nt, Human
ggaauccuuuuggaaauacugugugacugcuguguuuugcagcaugaauuauaguaaaauggu

SEQ ID NO: 67833 - RNA, 63 nt, Human
uauaauauauuugauggaugccuauaaauguggguuuugcaaauauuguuuaaaaaccaaacu

SEQ ID NO: 67834 - RNA, 63 nt, Human
cacaugcaucugucuaacgcaugccucguguucguuuugcaaacaugccugugguggagggug

SEQ ID NO: 67835 - RNA, 63 nt, Human
cuuaaggcaguagucugcauuaggacuguuugaguuuugcagacuugggguugggagaacauc

SEQ ID NO: 67836 - RNA, 63 nt, Human
cguuuucccauuuguacuucagcgcuagccccuguuuugcacagccgaguacuggcgaguaug

SEQ ID NO: 67837 - RNA, 59 nt, Human
ggaagcuguuccuggacugacugcuggcuggcgaggaggcugcgagcguggaaucggaa

SEQ ID NO: 67838 - RNA, 64 nt, Human
uguauuuuuaguagagaugggguuucaccguaucggcgaggaugaucucuaucucuugaccucg

SEQ ID NO: 67839 - RNA, 64 nt, Human
aaggagcagaggggugcggguaaacgaggaguggggcgaggaaagcgggaugggaacaaguggc

SEQ ID NO: 67840 - RNA, 64 nt, Human
ugcacacucagggccagacccaccauccuggacuggcgaggaagaucagugccuccugcucugc

SEQ ID NO: 67841 - RNA, 59 nt, Human
ccucccuguccaagaagugacuguugagaggcgaggagguagugggugaggcuaccuga

SEQ ID NO: 67842 - RNA, 64 nt, Human
ucaaggagaguugagauacagugaaaugagccagggcgaggagggagggugaaggaacggaggg

SEQ ID NO: 67843 - RNA, 58 nt, Human
augaugagaucgccguguaggugccgagggcgaggagauggaggcggcggcguggcug

SEQ ID NO: 67844 - RNA, 64 nt, Human
ggaggaagaggaggaggaggaggaggaggaggaaggcgaggacaguggcacuucagcugccagc

SEQ ID NO: 67845 - RNA, 64 nt, Human
gcagaggaccacaguggguggcaccuccugagaaggcgaggagagugguuguugccaacuaagc

SEQ ID NO: 67846 - RNA, 64 nt, Human
ccccacgaaggccagaaagggggaaagggaccugggcgaggagaggauuuguggugcuuggaag

SEQ ID NO: 67847 - RNA, 64 nt, Human
accuggacuuuaauugcacccaugaauguggcuaggcgaggagcuggaguggcuguucuuaaug

SEQ ID NO: 67848 - RNA, 64 nt, Human
cccaaaugcgcccggaggccguuaggcuguggagggcgaggaaggcgguccagaggcggccggc

SEQ ID NO: 67849 - RNA, 64 nt, Human
auucuucaucauucaaguucuaccuggacacaaaggcgaggacccugggguuccaacaaagcuc

SEQ ID NO: 67850 - RNA, 64 nt, Human
cuucuuccuuccuuccccgagaaggccucaauguggcgaggaagaugcuggggccgguagggcu

SEQ ID NO: 67851 - RNA, 64 nt, Human
uggcacaagggauggggacgcgagggggaggggaggcgaggaacaaggagaaggggcaacuuuc

SEQ ID NO: 67852 - RNA, 64 nt, Human
accguuccaacagcauucacugccaguucuaauaggcgaggaaaaugcccgaggcgcugucuuc

SEQ ID NO: 67853 - RNA, 64 nt, Human
aaauuacauuuauguuccuauauauuacaacaucggcgaggaaaugaaagcgauucuccuugag

SEQ ID NO: 67854 - RNA, 64 nt, Human
aagugccguaagaaaaagaaacuauuugcuccuuggcgaggacuccaagaacucacugaugcac

SEQ ID NO: 67855 - RNA, 64 nt, Human
agggcgcguuuggguuugauggcgaguuucuaaaggcgaggaaaugguuuguaagaggggaaag

SEQ ID NO: 67856 - RNA, 64 nt, Human
caggaauguuugcaugaccuaccucaggaggggaggcgaggaagaguaauauuuagcauucagg

SEQ ID NO: 67857 - RNA, 64 nt, Human
cucggcaguaggcagcugugcagcuucaccucuuggcgaggaggcgugugcugcagcuacgggc

SEQ ID NO: 67858 - RNA, 64 nt, Human
aggacggagcugcagacgaaggcaggggacccauggcgaggaggaauggccagcaccccaggca

SEQ ID NO: 67859 - RNA, 64 nt, Human
ugauaguauaaaaaaugguuaaugacaauucagaggcgaggagauucuguaaacuuaaaauuac

SEQ ID NO: 67860 - RNA, 64 nt, Human
gagacucuuuuaggaucagaucugugagcacguuggcgaggaaaaacaaaacaaacaaaaaaaa

SEQ ID NO: 67861 - RNA, 64 nt, Human
ccaaucauccaccagucagacugaauguguagcuggcgaggaauuacuuccacuucuggcccag

SEQ ID NO: 67862 - RNA, 64 nt, Human
aauuuggagugaccaaaggugugcccuguacacaggcgaggacccugcaccuggaugggggucc

SEQ ID NO: 67863 - RNA, 64 nt, Human
ccaccuggacggggaggcggccaaaaagcugaugggcgaggaggcccuggcggggggcgacaag

SEQ ID NO: 67864 - RNA, 64 nt, Human
aacaugaaaaaugaugggcuccuccuaauaggaaggcgaggagaggagaaggccaggggaauga

SEQ ID NO: 67865 - RNA, 64 nt, Human
gucugucuccaggcuggggagagaagggugaccaggcgaggagggagccgagacgucaacugug

SEQ ID NO: 67866 - RNA, 64 nt, Human
cucuacucccuuaacaguguugaauucaacugaaggcgaggaauguuggugaugaagcugaguu

SEQ ID NO: 67867 - RNA, 64 nt, Human
acuguggccgaccgcagcugugccguggcacgauggcgaggaagccagccccaaggaaacacug

SEQ ID NO: 67868 - RNA, 64 nt, Human
uucuucaggccuugaaucaaaagccacuuuguuaggcgaggauuucccagaccacucaucacau

SEQ ID NO: 67869 - RNA, 64 nt, Human
gcagagcggggagcugcagcacagcaacagugauggcgaggacuuccccguggcgcuguuuggg

SEQ ID NO: 67870 - RNA, 64 nt, Human
aggaugggguugggggcuaaauuaauuggaguggggcgaggagagagccagaaaacauagaucc

SEQ ID NO: 67871 - RNA, 64 nt, Human
ucgacuccugcggugcggggcuggcugucuggcuggcgaggagcugcugcgcuuccuucacaug

SEQ ID NO: 67872 - RNA, 64 nt, Human
cgcggccggcggccucagaguccacggagcucgcggcgaggacgacuucugcuuuuguuguugu

SEQ ID NO: 67873 - RNA, 64 nt, Human
acuccuaaaccaaaagugcuuuaaaaaccagccuggcgaggacagcccuggacccacuccacug

SEQ ID NO: 67874 - RNA, 64 nt, Human
cgggguuccuuguguuagggacuuaagaaucugaggcgaggacccccaggcuuaccuguaggac

SEQ ID NO: 67875 - RNA, 64 nt, Human
gggcugcggggucaggggcuccagcauccgagcuggcgaggaaacaguacagggucugaguucu

SEQ ID NO: 67876 - RNA, 64 nt, Human
auuuuacaaaaauuauaaaaaaugaauuaguacuggcgaggacuaaaugaaacaauaauuuuuc

SEQ ID NO: 67877 - RNA, 64 nt, Human
ggacgggugguccggagggaggcuggagcggggaggcgaggagggggcugugaguccucagagg

SEQ ID NO: 67878 - RNA, 64 nt, Human
cccccuggugccugcaggccacccagggaccacgggcgaggacgugaagccucccgaacacgca

SEQ ID NO: 67879 - RNA, 64 nt, Human
uccccuccacuuggcugcaagucgccugccauggggcgaggaggccugcaccccaguauaaggg

SEQ ID NO: 67880 - RNA, 64 nt, Human
cagcucacucgaggccuggggaaggggacucaggggcgaggaggaugacuggguccggucgcca

SEQ ID NO: 67881 - RNA, 64 nt, Human
cuggaaagcaggagggaacaaaggugaacaugaaggcgaggaugcuggggcccugcagugcgcu

SEQ ID NO: 67882 - RNA, 64 nt, Human
agagccugaaaaacugccccaaugccacgguaaaggcgaggaagucuuggcuggcguugcugac

SEQ ID NO: 67883 - RNA, 64 nt, Human
aggggagggggcgcccaggagggguggggaggggggcgaggagagccaagugcagcgaagggac

SEQ ID NO: 67884 - RNA, 64 nt, Human
cuaggauugaaaggugcauuuuccccauaaaaaaggcgaggaaaacccauggcugcuuuguguc

SEQ ID NO: 67885 - RNA, 64 nt, Human
cauccaggcugucaacaccagccccgagcggggaggcgaggaggcccugcaugccuuccugcuc

SEQ ID NO: 67886 - RNA, 64 nt, Human
ggccucuacugcccuggcugcagucagugcccagggcgaggaauguggccaggggauccaggac

SEQ ID NO: 67887 - RNA, 64 nt, Human
gcggccggagggcggguacaaggcugucugguuuggcgaggacaucgggacggaggcagacgug

SEQ ID NO: 67888 - RNA, 64 nt, Human
ggagcugcugugcccaggacguggguucagcgugggcgaggaaagccuggcgagcguggcccug

SEQ ID NO: 67889 - RNA, 64 nt, Human
uuaaccugcagaaacaguacuuagguaauuguagggcgaggauuauaaaugaaauuugcaaaau

SEQ ID NO: 67890 - RNA, 64 nt, Human
ggugggugggagacagggcuuuuucucucccucuggcgaggacucucaggauguagggacuugg

SEQ ID NO: 67891 - RNA, 64 nt, Human
caaggcccgauguggugugcagagguggggagguggcgaggauggggacagaaagcgcacagaa

SEQ ID NO: 67892 - RNA, 64 nt, Human
aaacuuguagguguuuaagaauugguuuugggagggcgaggacugggccagguuagaggcagau

SEQ ID NO: 67893 - RNA, 64 nt, Human
gccacggugagggcuuggaaggagacaggaauggggcgaggaaggagccaggcccggcaugagg

SEQ ID NO: 67894 - RNA, 64 nt, Human
ugcccccuccuccccggccaaggcgccuggaccuggcgaggacgcugcccgccgagcggacuga

SEQ ID NO: 67895 - RNA, 64 nt, Human
gaaugaccaacucuuaaaagccugauaggcucucggcgaggagcuuugaacgugucugaagggu

SEQ ID NO: 67896 - RNA, 64 nt, Human
uucucuggagcuuugggccucagggcgccuagaaggcgaggacgcagaccugaaggcggccggu

SEQ ID NO: 67897 - RNA, 64 nt, Human
uuaauauuaccaacuacauuggaagccugagcagggcgaggaccaauaauuuuaauuauuuaua

SEQ ID NO: 67898 - RNA, 64 nt, Human
ccagcugcagccuaggcaggggaugcacagcccaggcgaggaagccuggcuucucugugagcac

SEQ ID NO: 67899 - RNA, 64 nt, Human
acugauuauagagaaggcuacuaagugacucaugggcgaggagcauagacaguguggagacauu

SEQ ID NO: 67900 - RNA, 64 nt, Human
auagaaugaaugaccccaaaauaggguuuucuugggcgaggaugugcuggauuaggaaagguga

SEQ ID NO: 67901 - RNA, 64 nt, Human
cuauguacagaacuuuaaacaauauaguauuuauggcgaggacagcuguagucuguugugauau

SEQ ID NO: 67902 - RNA, 64 nt, Human
aaucggggugguggcaauggucguggaggccgagggcgaggaggacccaugggccguggaggcu

SEQ ID NO: 67903 - RNA, 64 nt, Human
agaaucacugaggcaccaauggcugagcaggaagggcgaggagacaccuugaucagcgucccag

SEQ ID NO: 67904 - RNA, 64 nt, Human
ugccgcagaggccggagaccuccuggacuaguucggcgaggagacuggccacuggggguggcug

SEQ ID NO: 67905 - RNA, 64 nt, Human
ugaagcuggacaagagccucaauaaggacacccuggcgaggaagcuggcagugcucaccccagg

SEQ ID NO: 67906 - RNA, 64 nt, Human
aauccauaacugauuuccaagcugguguguucaaggcgaggacgguguguggguggccccuuaa

SEQ ID NO: 67907 - RNA, 57 nt, Human
cacaggaaacuucgcagugaugcaccaggcgaggaaacgagaccucuuucguuccuu

SEQ ID NO: 67908 - RNA, 64 nt, Human
gauccgggaauaaagaauguccgccucuccauggggcgaggacuucgcguuucaggggagggcc

SEQ ID NO: 67909 - RNA, 64 nt, Human
uugcagagcuggccagcccccuccuuagggggugggcgaggagccucugggcagacccaagaac

SEQ ID NO: 67910 - RNA, 64 nt, Human
ugggcacagcacagccagggcgcucuuccaggcaggcgaggauaacuugagaguuuccuagggc

SEQ ID NO: 67911 - RNA, 64 nt, Human
uuaggacuugaagagggaagguauuuaauaacugggcgaggaugggugugguggcucacaccug

SEQ ID NO: 67912 - RNA, 59 nt, Human
accccuacgugugggacugagucagcgguggcgaggagaggcgggcggauuuggggagg

SEQ ID NO: 67913 - RNA, 64 nt, Human
cccgccauuacuuucuuuucuggagugccaugcuggcgaggauccggaugcggcagcacccucu

SEQ ID NO: 67914 - RNA, 64 nt, Human
aucaugaaggugugcaaaugauucuuacggcaugggcgaggauuuuucaauuuauuuuuuaaag

SEQ ID NO: 67915 - RNA, 64 nt, Human
uagccaggaaaggggugagagugauuguguugugggcgaggaggcguuuccacccccuggugcc

SEQ ID NO: 67916 - RNA, 64 nt, Human
gcgaaggaaauggucacaccccccgcccaccccaggcgaggauccuggugacaugcuccucucc

SEQ ID NO: 67917 - RNA, 64 nt, Human
uucuuucugugaggagauugaguacucugcagcuggcgaggaguugguugaggcacuucuucaa

SEQ ID NO: 67918 - RNA, 64 nt, Human
gccuccugacaccagcagaggaauuuuguacccaggcgaggacuucuugaacuucugcguaucu

SEQ ID NO: 67919 - RNA, 64 nt, Human
agccgaggccgagcgcccccugcuggcccgcggcggcgaggagcagagggagcggaggaggggc

SEQ ID NO: 67920 - RNA, 64 nt, Human
uccccagcucugucccuguagucaccugccggugggcgaggauccucucccugggauaagcacu

SEQ ID NO: 67921 - RNA, 64 nt, Human
cuacgacgaggccgauggcccgggcagcgggggcggcgaggaggccauggccggggccuacgac

SEQ ID NO: 67922 - RNA, 64 nt, Human
gaggucugugaagagcgggcaggaggcaugagcaggcgaggagcuggccugucccgggaagcag

SEQ ID NO: 67923 - RNA, 64 nt, Human
cccacccugaagguuguggguuuacuggaacgagggcgaggaacaccuggcccacccagggcgg

SEQ ID NO: 67924 - RNA, 64 nt, Human
cuggucccugccuuggucccuugccugggaagagggcgaggaggccagugguggggacgcagag

SEQ ID NO: 67925 - RNA, 64 nt, Human
acugcauccagccuggggcugaggcugaggcacuggcgaggagagggcgcuccucucugcacac

SEQ ID NO: 67926 - RNA, 64 nt, Human
gguccagugaggggugacugcagccggucaggugggcgaggagaaggggggcugccccuuuccu

SEQ ID NO: 67927 - RNA, 64 nt, Human
ccacuaccuccuccgcugcgcuuuugcaugcccgggcgaggaccgaagcacacaccuccacgcg

SEQ ID NO: 67928 - RNA, 64 nt, Human
ccccaggcccaggccccaccccggcggcgguggcggcgaggaggccucgguccuuauggugguu

SEQ ID NO: 67929 - RNA, 64 nt, Human
cuggcaggaacugggguggcuaucaauauuggauggcgaggacagcguggcacuggcugcgagu

SEQ ID NO: 67930 - RNA, 64 nt, Human
gacagguggucggcgucggggugcgguggguaggggcgaggacaacgcagggugcgcuggguug

SEQ ID NO: 67931 - RNA, 64 nt, Human
cuggggagacgaggguaugaguggaaagaggaugggcgaggaggccgggcuuaccuggacacua

SEQ ID NO: 67932 - RNA, 64 nt, Human
ccgcugcucgcucccggaccaccugcccagcguuggcgaggagccccgggaggugcuucugcgg

SEQ ID NO: 67933 - RNA, 64 nt, Human
cugacaaauuaugcuagagcaauuagacacccauggcgaggagaaaaaagaaccucuacuuaaa

SEQ ID NO: 67934 - RNA, 64 nt, Human
agucaugcaggaugggaucuguggucaaaggacaggcgaggagcugugggcgcagggccugccg

SEQ ID NO: 67935 - RNA, 64 nt, Human
uaacauuguaggaaagaaaaaagucuugguugugaaaaacgauuugcauuuggguaaaauaaag

SEQ ID NO: 67936 - RNA, 64 nt, Human
uguaugcuucuauuccaaaucauucauuaccaauaaaaacgaaauaccacccuuuccauuuuau

SEQ ID NO: 67937 - RNA, 64 nt, Human
ggucuccuagccaaaaaaaucaaaggauuuucaaaaaaacgaaucuguauguugaggcaaaagg

SEQ ID NO: 67938 - RNA, 64 nt, Human
ugaauacccaguugaaucaaacugucaaccuaccaaaaacgauauuguggcuuauggguauugc

SEQ ID NO: 67939 - RNA, 64 nt, Human
acugcaguaccaaaaauuacacucaacugaugaaaaaaacgaauuguaugauuuaggaaucaaa

SEQ ID NO: 67940 - RNA, 64 nt, Human
gucauggucugcuagguugcaggcuguaguuuacaaaaacgaauauugcagugaauaugugauu

SEQ ID NO: 67941 - RNA, 64 nt, Human
cuuaaaccuaugauucaguaacuucuuaccauauaaaaacgauaauugcuuuauuuggaaaaga

SEQ ID NO: 67942 - RNA, 64 nt, Human
aaaguguaaauaaccaauucagaaaacaaaauggaaaaacgaccccuuguuaccuugauucacu

SEQ ID NO: 67943 - RNA, 64 nt, Human
gguucaugcccaagcccugagaguggguacuagaaaaaacgagauugcacaguuggagagagca

SEQ ID NO: 67944 - RNA, 64 nt, Human
acaguggugaaauggggagugggugcccauucugaaaaacgaggcauuccugcucauucccucu

SEQ ID NO: 67945 - RNA, 64 nt, Human
aauuucagagaagagccuucuaacuuguuuacacaaaaacgaguaugauuuagcauucauacua

SEQ ID NO: 67946 - RNA, 64 nt, Human
uacuaaguauaaauuagucaaguuuaucagucuaaaaaacgaagggaugugcaacugcagcucu

SEQ ID NO: 67947 - RNA, 64 nt, Human
uagaggacauggaaaauaaagccaggaaagucaaaaaaacgaaagagaaggagaagaaaaagga

SEQ ID NO: 67948 - RNA, 64 nt, Human
cuuauaaccuaguuaaagaaaggaaaagaaaacaaaaaacgaaugaaaauaacugaauuuggag

SEQ ID NO: 67949 - RNA, 64 nt, Human
ucugagugacagagugagacuccaucucauuaaaaaaaacgaaaacaaaaacaaaaaaaacaca

SEQ ID NO: 67950 - RNA, 64 nt, Human
uggaauucuccuaaaugucuuccagacacuaguaaaaaacgaccugaaaauuguuuguggaacg

SEQ ID NO: 67951 - RNA, 64 nt, Human
uaauuaguccauuugcuagaagaguggucaagggaaaaacgagagaugaaauuuaguuaagucu

SEQ ID NO: 67952 - RNA, 64 nt, Human
gacagcgaacuggaggggggagaaauuuucaaagaaaaacgagggaaaugggaggggugcaaaa

SEQ ID NO: 67953 - RNA, 64 nt, Human
guuuuguuuuuucaaauaaguagagacuauuguaaaaaacgagaaaggaaaaugaaaugugcgu

SEQ ID NO: 67954 - RNA, 64 nt, Human
uuuuuuuuacuguagacacaaguuuggcccuaucaaaaacgaugaggaaaaaagauugcacucc

SEQ ID NO: 67955 - RNA, 64 nt, Human
aaacugauuuuuguaguuuugguauuuaaagcaaaaaaacgaaaaacaaaaaacaaaaacaaac

SEQ ID NO: 67956 - RNA, 64 nt, Human
aguaagugcgaagacugagccagauuggccaauuaaaaacgaaaaccugacuagguucuguaga

SEQ ID NO: 67957 - RNA, 64 nt, Human
aauaauauauaauuuuacaccaaaaguuucaggaaaaaacgaguuuguuggaguuaguuuauac

SEQ ID NO: 67958 - RNA, 64 nt, Human
aaagaagcagaagccaaagcugcucuugaagaagaaaaacgaagacaacagguaaccaaacaaa

SEQ ID NO: 67959 - RNA, 64 nt, Human
cccaccuagugaaacuuuguaagaacuccagggcaaaaacgaaccacuugcaacccacauguuu

SEQ ID NO: 67960 - RNA, 64 nt, Human
cauuguguuacagagcuagaaaauuuuauguaugaaaaacgauaauagccuuacacugaguaca

SEQ ID NO: 67961 - RNA, 64 nt, Human
augaaaaacuuagaauagugaacuauuaauauuuaaaaacgagaaauacaacauuuaaaaaauu

SEQ ID NO: 67962 - RNA, 64 nt, Human
gagcuuaucugaacagauuuaucuaagaaaaaaaaaaaacgacauaaaauaagugaaacaacua

SEQ ID NO: 67963 - RNA, 64 nt, Human
agcugugcugcugggaaucaggagaauagaagcaaaaaacgaaagaguucuguucagacuucug

SEQ ID NO: 67964 - RNA, 64 nt, Human
caaaggaccuacuguucggacaaaaaaaguagggaaaaacgaagcugucuuagagugggaccaa

SEQ ID NO: 67965 - RNA, 64 nt, Human
agucaauuuuacaauuuguagaacucuaaugaagaaaaacgagcaugaaaauucgguuugagcc

SEQ ID NO: 67966 - RNA, 64 nt, Human
cugcagggcugagauguggcaggagcucccagggaaaaacgaagugcauuugauugguguguau

SEQ ID NO: 67967 - RNA, 64 nt, Human
uuuuuaacuguauuagggguguaugaaccaguuuaaaaacgagguuuuauuuacuguagagaug

SEQ ID NO: 67968 - RNA, 64 nt, Human
aaacuuuacugcacacuacugagagaaugagaugaaaaacgauuaauguuucauuauuauuauu

SEQ ID NO: 67969 - RNA, 64 nt, Human
uugucuuggcagccuacuagggaccuggggaagcaaaaacgaaagcugggcaacaugccugcuu

SEQ ID NO: 67970 - RNA, 64 nt, Human
gucucauguccucauucuccccuauaugacaugcaaaaacgaucuuucuuugaaaucccucugg

SEQ ID NO: 67971 - RNA, 64 nt, Human
ccuccuaauuugaucacaguggcgagaggagaggaaaaacgaucgcugugaaaaugaggaggau

SEQ ID NO: 67972 - RNA, 64 nt, Human
ugacaugaaugcugcuaaaggacuggacucaaacaaaaacgaggucaaucaugccauugaccga

SEQ ID NO: 67973 - RNA, 64 nt, Human
gaggaacuuagggauuucaccccuggcuuuuaaaaaaaacgaaauaccgacaagccacaaggac

SEQ ID NO: 67974 - RNA, 64 nt, Human
aagaaaaaacaccaauacccagauuuaaaaaaaaaaaaacgaucauagucuuaggaguucauuu

SEQ ID NO: 67975 - RNA, 64 nt, Human
ugcuuugaugauauagugagaaugcaucacuugcaaaaacgaucucaaaagugucagccuuaga

SEQ ID NO: 67976 - RNA, 64 nt, Human
uuagcucauguuaauaggaugguuguguauuauaaaaaacgaguuacgugugugugugcacgca

SEQ ID NO: 67977 - RNA, 64 nt, Human
agaugauguauuuugcuugggcaccaacagaauuaaaaacgaaaaacaaaaaaaaacucgaaug

SEQ ID NO: 67978 - RNA, 64 nt, Human
acgcuguugcccauuuuuguagccagagaaauugaaaaacgacuguggcuugauguugauacac

SEQ ID NO: 67979 - RNA, 64 nt, Human
guugcagugaaaaaagaagcuagccuucuagcugaaaaacgaguauuccccaauggacuccaga

SEQ ID NO: 67980 - RNA, 64 nt, Human
ucauuuauauauauauauauaggcuuuguugaugaaaaacgacaauugaagagaggacguugag

SEQ ID NO: 67981 - RNA, 64 nt, Human
ugcuuauuucucaaaaaagagggacagugaaaacaaaaacgacauugggacaugcugcucaagg

SEQ ID NO: 67982 - RNA, 64 nt, Human
caaccugggcaauagagcgagacccugucucuuaaaaaacgaugaugaugaacacagaggacgg

SEQ ID NO: 67983 - RNA, 64 nt, Human
gguaucuuggcugaaaauuuuguuuuacauagagaaaaacgaucuuuuaagggucccuuuugcu

SEQ ID NO: 67984 - RNA, 64 nt, Human
aguucaccaccucugauggaucccuguuuuaaauaaaaacgauucacuuuaaagccuaucaaag

SEQ ID NO: 67985 - RNA, 64 nt, Human
aauacauuauauauuaucuuuauguacucuuaagaaaaacgagcaaggaagaguaucuucauua

SEQ ID NO: 67986 - RNA, 64 nt, Human
cuccucugccuggcguagacaugcgcuuugggaaaaaaacgaguuuauaauccuauaaugaaga

SEQ ID NO: 67987 - RNA, 64 nt, Human
uucguacuaaaauuugauuccuuuuuuucuuaugaaaaacgaacucaguuuaaaaguauuuuua

SEQ ID NO: 67988 - RNA, 64 nt, Human
ggaacucugguuauuaugguguuaguuaucgaauaaaaacgacuucagaaugcagcuucccuac

SEQ ID NO: 67989 - RNA, 64 nt, Human
ccauagagcacaaggucaaggaagcuagagucugaaaaacgaacaauucacuuccaggucuuca

SEQ ID NO: 67990 - RNA, 64 nt, Human
aggggaucccugaaauaacauuagaacauacaggaaaaacgaggcaggcagaucacuuuagguc

SEQ ID NO: 67991 - RNA, 64 nt, Human
uggccacaguaugugcuguuuuugaagcauuuuuaaaaacgaauuguaguuguuuuucuucauu

SEQ ID NO: 67992 - RNA, 64 nt, Human
cuuguauuauguguguuuuaaaaugagaaaucuaaaaaacgaaaagucuccaaagucucuggaa

SEQ ID NO: 67993 - RNA, 64 nt, Human
cggacgacuacuuggagccauaaguaaccucagcaaaaacgaggccucugcaagccacuuuucc

SEQ ID NO: 67994 - RNA, 64 nt, Human
cuaauagaggaguagagauuguugaccauuuuuaaaaaacgauagccacucuuuuucuuuuaug

SEQ ID NO: 67995 - RNA, 64 nt, Human
ucuucagugccucaugacugaaaacaaaaaacaaaaaaacgaaagcaucuucacaaugaagcuu

SEQ ID NO: 67996 - RNA, 64 nt, Human
ccuucccaccugucauacugguaacuguaacaagaaaaacgacaucacuuaucauugugucgug

SEQ ID NO: 67997 - RNA, 64 nt, Human
aguucuucaaacacccauuuuugcucuaugggaaaaaaacgauuuaccaauuaauauuacucag

SEQ ID NO: 67998 - RNA, 64 nt, Human
accauguuagguuaaaacaaaaugaccaucucacaaaaacgaguuuaguugaaugcucaauucc

SEQ ID NO: 67999 - RNA, 64 nt, Human
uuccaaacccaaucuaguaggauguucucauuuuaaaaacgaggggaaaagaccagaguuuuuc

SEQ ID NO: 68000 - RNA, 64 nt, Human
cccuaagcgucacccaagcacacucacuuaaagaaaaaacgaguucuuucguucugugcgcagc

SEQ ID NO: 68001 - RNA, 64 nt, Human
agauagaaauuuucaaaaacauaaagcuaguucaaaaaacgaguugcagagcauauaauaaauu

SEQ ID NO: 68002 - RNA, 64 nt, Human
aauaaguuuauauucuugcuagguaaaacaaaacaaaaacgacaguaauaccaaggaaucuccc

SEQ ID NO: 68003 - RNA, 64 nt, Human
uauuuauaugaccuuuguaaccauuuaaaaauguaaaaacgaccugacuuaguaaugcgaaccu

SEQ ID NO: 68004 - RNA, 64 nt, Human
uugaggggagaggaaaucuuaagauuacaagauaaaaaacgaauccccuaaacaaaaagaacaa

SEQ ID NO: 68005 - RNA, 64 nt, Human
uuaaaauuauuauuuuaaguaaaagccaauaaacaaaaacgaaaaggcaaguuacgagacugac

SEQ ID NO: 68006 - RNA, 64 nt, Human
aaaaaagaagaagaagaagaaaagagaagaagaaaaaaacgaaaacagucaaccaaccccaucg

SEQ ID NO: 68007 - RNA, 64 nt, Human
uuuuucuucuguuaaaauuauucuuaaugucuguaaaaacgauuuucuucuguagaauguuuga

SEQ ID NO: 68008 - RNA, 64 nt, Human
gcaacauagggagacccugucucugcaaaaaaauaaaaacgaauacauaaaaauuagcugugug

SEQ ID NO: 68009 - RNA, 64 nt, Human
uucugcuuccacuauuugguguugggcacuggagaaaaacgaagccaagagaauaugaaauuug

SEQ ID NO: 68010 - RNA, 64 nt, Human
auagccaaauagauaacacuaaugcuuuguuuaaaaaaacgaaaaaaacaaaacaaaacaaaaa

SEQ ID NO: 68011 - RNA, 64 nt, Human
uauuaacaugggcagccuuugacacauguauuccaaaaacgaguuuauauuuucaaacgguuuu

SEQ ID NO: 68012 - RNA, 64 nt, Human
uuauguacauaguuuucuaaaaagccuuucuucuaaaaacgaaaaaagaccccccacccaaaau

SEQ ID NO: 68013 - RNA, 64 nt, Human
cuuuuuaaaacaaggaaaagggaaaaaaaggagaaaaaacgaugcaucaagcuuguuugucaaa

SEQ ID NO: 68014 - RNA, 64 nt, Human
caccuccccaacccuacacgcacgaacugagucgaaaaacgaaaaccaaacgagcgagaaguug

SEQ ID NO: 68015 - RNA, 64 nt, Human
cgcaaggcagcaacucucuaauuaaccaggucauaaaaacgauucgucuucuauguagacauca

SEQ ID NO: 68016 - RNA, 56 nt, Human
ccaugaggacagugaucugauugaaaaaaaacgacagucuggggaagcgaucacau

SEQ ID NO: 68017 - RNA, 64 nt, Human
cccauccaggaugcucagaagcagauuccaguguaaaaacgagaaaaacaaaaugaaagagggg

SEQ ID NO: 68018 - RNA, 64 nt, Human
acaaaaaggacuuuucuaaggacugaagauuggcaaaaacgaaaagcuucuuccuccaagagcc

SEQ ID NO: 68019 - RNA, 64 nt, Human
cucaucugaucaaaguuccgagaggcauagaaggaaaaacgaagggccuuagaggggccuacaa

SEQ ID NO: 68020 - RNA, 64 nt, Human
aagcucuuuguacagugucaauuuguaaaaaagaaaaaacgaaaaaaaaucucaaauaaaacau

SEQ ID NO: 68021 - RNA, 64 nt, Human
gcuucuaauccuuccuuugcuaaaucucaccuuuaaaaacgaaggugacucacuuugcuuuuuc

SEQ ID NO: 68022 - RNA, 64 nt, Human
ccaccaucaucaaagagcugcucaagaaauuuuuaaaaacgaaacaaaguuaugggguuaaucu

SEQ ID NO: 68023 - RNA, 64 nt, Human
gucaugaauaauaacgucugcuccucuuacauagaaaaacgauauuaaaagaagaucuucucuu

SEQ ID NO: 68024 - RNA, 64 nt, Human
uguuuuuauuuuucugugauuguacaaaaacaacaaaaacgaagugcucucagucagguuuuuc

SEQ ID NO: 68025 - RNA, 64 nt, Human
cggcaggugggacgagccccacagcccccuccucaaaaacgaccaccuccaggacucagugauc

SEQ ID NO: 68026 - RNA, 64 nt, Human
auauuagaaacuuauucaucccacucaggacaauaaaaacgaauguacaaaaagcccuuccauu

SEQ ID NO: 68027 - RNA, 64 nt, Human
cuucuucuguaacaugacuugcgaauauuuauauaaaaacgaguguuacaaugagacccccggc

SEQ ID NO: 68028 - RNA, 64 nt, Human
auaguuuguuuuaauagccagggguucucaauggaaaaacgaaugcucuuacacugaauguaca

SEQ ID NO: 68029 - RNA, 64 nt, Human
acgaauaaacuaagaaaaagguaagaacugucucaaaaacgaaagcacaccacccaagacacag

SEQ ID NO: 68030 - RNA, 64 nt, Human
gcaaggcagaggacagguuuucucagguuaagagaaaaacgaaauuuuaaaaacuuuaaaaaau

SEQ ID NO: 68031 - RNA, 64 nt, Human
acaucucgugcagaucugcuggcagaggacaaucaaaaacgacaacaagcuucuucccagggug

SEQ ID NO: 68032 - RNA, 64 nt, Human
ccccuacagacuccguauuuuauuuuuuuaaauaaaaaacgaucgaaaccauuucacuuuuagg

SEQ ID NO: 68033 - RNA, 64 nt, Human
uacccauauuauggaacagugugagaguaauuuuaaaaacgacuuauaucuaugcuagcugauu

SEQ ID NO: 68034 - RNA, 64 nt, Human
ugcuauguuaaaugaaaagaucgauugggaauuuaaaaacgaauuguauuuucucucuccugga

SEQ ID NO: 68035 - RNA, 64 nt, Human
cuaacugggggauuuuauuuauaagggcucuagaaaaaacgaguuauucacaccagcaucaucu

SEQ ID NO: 68036 - RNA, 64 nt, Human
uucgagggaaggaucaaugcuuauuaccauuuggaaaaacgaagaucagaagguaaaugaucuu

SEQ ID NO: 68037 - RNA, 64 nt, Human
cccugccagaaauauucugagaccaaauuuacaaaaaaacgaaaaaaauaaggauugacugggc

SEQ ID NO: 68038 - RNA, 64 nt, Human
aacaugucacaaaaaguuaaugugauuaagauuuaaaaacgaaaaguaugccuugccuugugaa

SEQ ID NO: 68039 - RNA, 64 nt, Human
gaugaagucaucaagacagaaaagcaaaaccgagaaaaacgacgggcaccuggaaccagucacg

SEQ ID NO: 68040 - RNA, 64 nt, Human
uuggagaugguucugcccacucugguuucucugaaaaaacgagguaauucccugagcccaaccc

SEQ ID NO: 68041 - RNA, 64 nt, Human
uagcaaggugccgggucacccugcagguucccauaaaaacgauuugcagccagaaggaggagga

SEQ ID NO: 68042 - RNA, 64 nt, Human
gggaaauaaacuuaaaaaaaaaucaggaauuuaaaaaaacgagcaauuugaagagaaucuuuug

SEQ ID NO: 68043 - RNA, 64 nt, Human
aacuuuaacuuauuaaaaaaaaaaaaagaaaaagaaaaacgauuuaaaaaaaaaaaaaaaagca

SEQ ID NO: 68044 - RNA, 64 nt, Human
ccaaaaguagcguaaccaacauuuaagcuugcuuaaaaacgaaaaccaaccgccuugcauccag

SEQ ID NO: 68045 - RNA, 64 nt, Human
aguuuuccauugaauauaugcuuaugguuaaaagaaaaacgaaugguuuuauaauucuguguau

SEQ ID NO: 68046 - RNA, 64 nt, Human
uuuuacuugugggggugggaguuagauguauuaaaaaaacgaaacuacaaaauccuuuuaagaa

SEQ ID NO: 68047 - RNA, 64 nt, Human
cuucuaaagggaauguuuuuuucugagauaaaauaaaaacgagccacaucguguuuuaagcuug

SEQ ID NO: 68048 - RNA, 64 nt, Human
cagagauauauagacacuggaguacuggaaauugaaaaacgaaaaucguguguguuugaaaaga

SEQ ID NO: 68049 - RNA, 64 nt, Human
uuuugguuuuuaguauuuccuaaaacauaggggaaaaaacgaggucauuucuacuaagcacuag

SEQ ID NO: 68050 - RNA, 64 nt, Human
caagagcgcaccauugcacuccagccugggcgacaaaaacgaaacuccaucucaaaacaaaaca

SEQ ID NO: 68051 - RNA, 64 nt, Human
uguuguuucauacuuuaaauuuauauggcuguggaaaaacgaauuaaaauguuuugaggagaaa

SEQ ID NO: 68052 - RNA, 64 nt, Human
guuuauuaaauguaguggauuaagugucugucaacaaauacaccaaaaccauuuuuuauagaaa

SEQ ID NO: 68053 - RNA, 64 nt, Human
uaggaaugaguucuuaucuaguguugcaggccagcaaauacagaggugguuuaaucaaacagcu

SEQ ID NO: 68054 - RNA, 64 nt, Human
uuuauguaaacuaguaaccaguugaucucugugccaaauacauuauaucaggauuacacaaaaa

SEQ ID NO: 68055 - RNA, 64 nt, Human
gucauccacuuuguuuuccuguuuaggcuuugcacaaauacaauugcuuucaggaauccuaaag

SEQ ID NO: 68056 - RNA, 64 nt, Human
aacaauguaaauauuuuauggaauaauggcuuuucaaauacauuucuuaaggaacuguuuauga

SEQ ID NO: 68057 - RNA, 64 nt, Human
cuauuugccucuacuuuguauuguucagaaauggcaaauacaauauaaaagugauauaugguuu

SEQ ID NO: 68058 - RNA, 64 nt, Human
cucaaguuuuuacaaaauacuaugugggacaccucaaauacauaccuacugacugaugacaaac

SEQ ID NO: 68059 - RNA, 64 nt, Human
ccucuucauacacuccugcugaaaaauguuaauccaaauacacauuuaaacuuagggucggucc

SEQ ID NO: 68060 - RNA, 64 nt, Human
aauuuucaaacauuaaauccaacuucaacggaaacaaauacacucaagggaaguuauuuuuaaa

SEQ ID NO: 68061 - RNA, 64 nt, Human
gccuagacucaagguauuguaaaugacaagauaccaaauacaagauuuuaaaagcaaccauggg

SEQ ID NO: 68062 - RNA, 64 nt, Human
guaauuucuaucacaguuagaaggaaaugauagucaaauacacguuuagauuaaaacuaguuua

SEQ ID NO: 68063 - RNA, 64 nt, Human
ucucccccucggugaaugauggcugcuucuaaaacaaauacaaccaaaacucagcagugugauc

SEQ ID NO: 68064 - RNA, 64 nt, Human
uacugggcuacuaauacuucucucagcaguugaucaaauacaauagaccauguaagcuggggcc

SEQ ID NO: 68065 - RNA, 64 nt, Human
agcacagaaauuaaggcaaaaaaccaaagcaaaacaaauacauggugcugaaauuaacuugaug

SEQ ID NO: 68066 - RNA, 64 nt, Human
gcaaacccuguuuccaaacaaacaaacaaacaaacaaauacacagacagaaguaguuaaacauc

SEQ ID NO: 68067 - RNA, 55 nt, Human
aggagucugaggauaacuaaaacuucaaauacacaaaaugaaacaaaagaaacaa

SEQ ID NO: 68068 - RNA, 64 nt, Human
caacucuuaucaaggauuaauuuaauuuuuaaaacaaauacaaguuauugauucacucuucuca

SEQ ID NO: 68069 - RNA, 64 nt, Human
guagcuuaugucagacagacauuaagcaaacucacaaauacauaaaauaugcucauaaaaggcc

SEQ ID NO: 68070 - RNA, 64 nt, Human
agaggaaugacuuaauuaugagacuguauauaaucaaauacaguguggguuaggaccuguggca

SEQ ID NO: 68071 - RNA, 64 nt, Human
ggcgacagagcaagacucugucucaaaacaaacacaaauacaguauccaaacauuggagauuag

SEQ ID NO: 68072 - RNA, 64 nt, Human
ucaagaucacuuuuaaaaaagguuagaagugaagcaaauacauucagcuuacugaucacuauag

SEQ ID NO: 68073 - RNA, 64 nt, Human
ucuguagagaagaggcacaucuauggcuacuguucaaauacauaaagauaaauuuauuuucaca

SEQ ID NO: 68074 - RNA, 64 nt, Human
uugcuuccuaauuuaaacccauuuuugucauuuccaaauacauccuguccauuggcuaagacag

SEQ ID NO: 68075 - RNA, 64 nt, Human
aagcaaaaauucucccugugagagcucaacaucucaaauacaaccacaggaaaaauggcccaau

SEQ ID NO: 68076 - RNA, 64 nt, Human
aauugacacuggauuaaacaaauucacauaaugccaaauacacaauguauuuauagcaacguau

SEQ ID NO: 68077 - RNA, 64 nt, Human
uagaaauaacacucuuuucuuugaagaucugauucaaauacaccuuagaagaguuuaaaaucuc

SEQ ID NO: 68078 - RNA, 64 nt, Human
ugaaauacaauuagguuuuugagauuuuuauaaccaaauacauuucaguguaacauauuagcag

SEQ ID NO: 68079 - RNA, 64 nt, Human
uugcucaccuggaacaccugauggugaaaccaaacaaauacaaaauccuucuccagaccccaga

SEQ ID NO: 68080 - RNA, 64 nt, Human
gugcaagcacccugaucucacucccagcucugaccaaauacagaauuuuagagaacaucugaag

SEQ ID NO: 68081 - RNA, 64 nt, Human
gugggggacaccacuaaagaaacaucugagcaaacaaauacagucaguaaaacuccuaccaaac

SEQ ID NO: 68082 - RNA, 64 nt, Human
aacuguuuguuuuguuguuguuuuuuuuucaagccaaauacaugacauaagaucaauaaagagg

SEQ ID NO: 68083 - RNA, 64 nt, Human
guugggaucucaaaagauuugguucagauccaaacaaauacacauucuguguuuuagcucagug

SEQ ID NO: 68084 - RNA, 64 nt, Human
ggcugguaauuuuuaugagcauuuucagcuuuugcaaauacaaaauauaauucuuuacaaaaau

SEQ ID NO: 68085 - RNA, 64 nt, Human
auagccuugaugccacugggcacaagccaccugccaaauacaggaguggccucucccagccugg

SEQ ID NO: 68086 - RNA, 64 nt, Human
aaagaggguauuauggguggguggugugggcuugcaaauacaagcuuggaggugagacauggcc

SEQ ID NO: 68087 - RNA, 64 nt, Human
uagucaaccaucugggggagaaguugcucacugucaaauacagcaugcacgguccuagcugaua

SEQ ID NO: 68088 - RNA, 64 nt, Human
uucaacccaguugauguaaccaccucauuuuuuacaaauacagaaucuauucuacucaggcuau

SEQ ID NO: 68089 - RNA, 64 nt, Human
ccaccuuucacccucaugaaaacacacauacacgcaaauacacuccaguuuuuguuuuugcaug

SEQ ID NO: 68090 - RNA, 64 nt, Human
guguaggaaaguacuuaauuuucccagauuuccucaaauacaugaaacgaaucaaacuggagau

SEQ ID NO: 68091 - RNA, 64 nt, Human
ggcgauaauagcuugauuuauuugguuucuacaccaaauacauucuccugaccacuaaugggag

SEQ ID NO: 68092 - RNA, 64 nt, Human
uuuguuuucuucaauagucuuauuuucagucucucaaauacagccaacuuaaaguuuuaguuug

SEQ ID NO: 68093 - RNA, 64 nt, Human
uuauaaaguugcuaugaugguaacacaaguucuucaaauacaauaauaaauaucaucaucugga

SEQ ID NO: 68094 - RNA, 64 nt, Human
ugaaauauuuaaaacauauuuguaaccagugaggcaaauacagaaguugaugucggcaguaaau

SEQ ID NO: 68095 - RNA, 64 nt, Human
gggaaggaaacugacaacgugugaaaguuagaggcaaauacauagguguagcuuggagugcugg

SEQ ID NO: 68096 - RNA, 64 nt, Human
aggagaguaaaaauucauauaaagugcaauugcacaaauacaagccaagcuagaaggaagcacc

SEQ ID NO: 68097 - RNA, 64 nt, Human
gagcuuucaaacuggaaaaaaaaaugaaacaaaacaaauacaccaagaccaaaauaggcaauag

SEQ ID NO: 68098 - RNA, 64 nt, Human
uuuuccuuucuagccacaugacuguggcauugcacaaauacagucucuguagggauuuuaaaag

SEQ ID NO: 68099 - RNA, 64 nt, Human
cugaagcauuuuaauauggguagaaacucuacaccaaauacacuaaacauuuuggugcuuagug

SEQ ID NO: 68100 - RNA, 64 nt, Human
gcuacuaguuucucugucuauucacacauauguacaaauacaugaacacagccugucugugcuc

SEQ ID NO: 68101 - RNA, 64 nt, Human
aaaugaaccccacugggugggcagagguucauuucaaauacaucuuugauacuuguucaaaaua

SEQ ID NO: 68102 - RNA, 64 nt, Human
gaaaaaugauacuucucuuuuuuugcuguuccaccaaauacaauucaaaugcuuuuuguuuuau

SEQ ID NO: 68103 - RNA, 64 nt, Human
ccuuuagaagcaaauagugugauuuucaagacuucaaauacaaauuuaguuuaaguguuugaac

SEQ ID NO: 68104 - RNA, 64 nt, Human
aucaauuuuuauuauuggaauaguuuuaaccuuucaaauacauguucuguccuggagcaggauu

SEQ ID NO: 68105 - RNA, 64 nt, Human
uuguuuuaugcaugaguuaauaccacuggcucagcaaauacaaguuaguuugcuuuaagcaggu

SEQ ID NO: 68106 - RNA, 64 nt, Human
uuuauaagguuuuaaguuguuugcaugugaaaaucaaauacauacuuugguagucuuugaauac

SEQ ID NO: 68107 - RNA, 64 nt, Human
auggggccugccugugagaaacagugggucccuucaaauacauaguggauagcucaucccuagg

SEQ ID NO: 68108 - RNA, 64 nt, Human
cucaguaccugagccucaaucaagccuuauccaccaaauacacagggaagggugaugcagggaa

SEQ ID NO: 68109 - RNA, 64 nt, Human
cuagagaacgucucagaugugcuuauaaagcuuccaaauacaacuccaguaagacaucccuuuc

SEQ ID NO: 68110 - RNA, 64 nt, Human
auguuuauuuguuaauccuaaccaguauaauaagcaaauacacuauaauagauccacguuacug

SEQ ID NO: 68111 - RNA, 64 nt, Human
ucaguacuguuagcucauuugaaguuggcaaaaacaaauacaaacaagcaaaaaaccucaaauu

SEQ ID NO: 68112 - RNA, 64 nt, Human
uaccaacuuuuuacauauuggaaaauagaaauugcaaauacauacauguauggaaacauauuca

SEQ ID NO: 68113 - RNA, 64 nt, Human
aaauacuccauuauuuuauuuuauagucucaaaucaaauacauacaaccuauguaauuuuuaaa

SEQ ID NO: 68114 - RNA, 64 nt, Human
aaccuuaugaauguauacuagcauacaaggaucucaaauacauuaauuauucucaguuuuagga

SEQ ID NO: 68115 - RNA, 64 nt, Human
guucauucugggccuaaccuuaaaggcucaauaacaaauacaacaaauguaaauauguuuacau

SEQ ID NO: 68116 - RNA, 64 nt, Human
cuuucuauucuuggaaccacgaaugagguaggcacaaauacauuccuuuuagaguuaagaacua

SEQ ID NO: 68117 - RNA, 64 nt, Human
augacuugggagcgcuaugggccugccccauggacaaauacauccacaagcgcugggcccucgu

SEQ ID NO: 68118 - RNA, 64 nt, Human
gggcccaacauauccauuuuuaaacccuuucccccaaauacacugcguccugguuccuguuuag

SEQ ID NO: 68119 - RNA, 64 nt, Human
uucugguuguuuuuaaacaauaaagcaauaagaacaaauacaauacauaggaaguuaaaagcac

SEQ ID NO: 68120 - RNA, 57 nt, Human
uccacaggcaagcaucuugagaucuugcaaauacaagucucacucuucacacugagc

SEQ ID NO: 68121 - RNA, 64 nt, Human
uauucuggaaagaaagccugccaggaaauaaauucaaauacaguaugagcugcggggauauuuu

SEQ ID NO: 68122 - RNA, 64 nt, Human
uuuuugugucuacaccagguuugaaauaaguaaacaaauacaagagguucauauaaaagggcaa

SEQ ID NO: 68123 - RNA, 64 nt, Human
aaccaccuucugcacuuaaagaagucuaacaguacaaauacacuaucuaucuuagauagauaua

SEQ ID NO: 68124 - RNA, 64 nt, Human
cuaguuucaacaguguucuuucauauuuacucugcaaauacaaaaaaccaaaaccugcagccag

SEQ ID NO: 68125 - RNA, 64 nt, Human
ccuauuuuguacuccuggcuagaaugcuguggaacaaauacaaagugaaaaaaguucucuguag

SEQ ID NO: 68126 - RNA, 64 nt, Human
aaaucuccauccacaucagggagcuuuccccaggcaaauacaaaccgccccguggccugcaggc

SEQ ID NO: 68127 - RNA, 63 nt, Human
aagcaacuccugacaauuaagcauuuuuuucuccaaauacaaaguauauucucuuuauuggaa

SEQ ID NO: 68128 - RNA, 64 nt, Human
uguccucaauugcugcugauaugcuggugauucccaaauacauagcuccaacccccaacuuccc

SEQ ID NO: 68129 - RNA, 64 nt, Human
cauaaauuaugagauuuuuuuuaaaaguuguuaccaaauacacauuucacauugaaucauguag

SEQ ID NO: 68130 - RNA, 64 nt, Human
uuaaaacuaaauuucacuacuagauugacuaacucaaauacacauuugcuacuguuguaagaau

SEQ ID NO: 68131 - RNA, 64 nt, Human
gcaaaccaagcacuuuguuaaucuccagagagagcaaauacagcaaucuagaguuuagccuuuu

SEQ ID NO: 68132 - RNA, 64 nt, Human
auugauaaacauuuaacuuguuuccaauguuuagcaaauacauauuuuauagaacuuccaucug

SEQ ID NO: 68133 - RNA, 64 nt, Human
aucauaguugcuaaaaaaaaugguuuucaaaugucaaauacaugaguaucucccuccauggacu

SEQ ID NO: 68134 - RNA, 64 nt, Human
ccagccugggcaacauagugagacccugucucuacaaauacaaaauaaaauaauuagcugggug

SEQ ID NO: 68135 - RNA, 64 nt, Human
accuaaugcacucugggucuggccagggcuuccucaaauacaugcacagucauacaagucaugg

SEQ ID NO: 68136 - RNA, 64 nt, Human
aaagaaugcauuccuaaguuuucauuugaguacccaaauacacaaaaggugucccuuuaaggaa

SEQ ID NO: 68137 - RNA, 64 nt, Human
ucaccaccccaagccccauuugugcccugccacacaaauacaccuacagcuuuuggucccuugc

SEQ ID NO: 68138 - RNA, 64 nt, Human
aaaguuaaacacgcuuuuuuuccugccuaaaacacaaauacaacugccaguauguauuuuuaau

SEQ ID NO: 68139 - RNA, 64 nt, Human
ccaucaagugucugaaauucaauauugguuuaugcaaauacagcaaacuuuuauuuaaguagau

SEQ ID NO: 68140 - RNA, 64 nt, Human
ugauuugauaugauuguuucauuuauaauuugcccaaauacauggagcacaaaauuuagugaau

SEQ ID NO: 68141 - RNA, 64 nt, Human
uuuguuuuuaaauuaugcaccuucugauaacccccaaauacagaaauguucuacaucucugaau

SEQ ID NO: 68142 - RNA, 64 nt, Human
guacaccguucauuuuauauagacuagggagauucaaauacagugcauuuucuauugguauuug

SEQ ID NO: 68143 - RNA, 64 nt, Human
acuaguuaucagcaagugacaauacauuccaccacaaauacacucuuguucuucuagcuuuuag

SEQ ID NO: 68144 - RNA, 64 nt, Human
cgauauauauauucuugugccuaguacuuuaccacaaauacaguguaauaucaucaguccaaaa

SEQ ID NO: 68145 - RNA, 64 nt, Human
caagacaagggccaaccuauuacuucacacaccucaaauacaaaaagugccugggaacgucgau

SEQ ID NO: 68146 - RNA, 64 nt, Human
accgcacagacauugacaagcacgcacacacacgcaaauacaugccuuuccagugcugcucccu

SEQ ID NO: 68147 - RNA, 64 nt, Human
gaccaguuucugucugcauguaauuuggauuucucaaauacauucauuaguaauuuaucaguaa

SEQ ID NO: 68148 - RNA, 64 nt, Human
uauauaaugugauuuuuacacauacauacacacacaaauacacaaucucuaggguaagccagaa

SEQ ID NO: 68149 - RNA, 64 nt, Human
uuucuuaaagcaaacuaugauuuauuuuggugcacaaauacaaaguggaaacuuaccaaaauug

SEQ ID NO: 68150 - RNA, 64 nt, Human
cuuugcuuguuugaaguccuguggauuccaaagccaaauacauuuuauaaaugauuuuggaauu

SEQ ID NO: 68151 - RNA, 64 nt, Human
cuauuaauaacaaugcauuauugaaaguauauugcaaauacauguuuccucaugaaaucuaagu

SEQ ID NO: 68152 - RNA, 64 nt, Human
gcugccugaaugcaacaguaauuuauauccaggacaaauacagucugggcgucacuauccuacc

SEQ ID NO: 68153 - RNA, 64 nt, Human
cagaagugagagauuguuauauuuaggauauaggcaaauacaguaaaaguuaaaaaaaaaaaac

SEQ ID NO: 68154 - RNA, 64 nt, Human
guaaaacuacauuuagacuucuuucucaagaaaucaaauacagcuuuuuuucaaagcugauuca

SEQ ID NO: 68155 - RNA, 51 nt, Human
uggguggcaaucaaaaauaaucaaauacaguccuuauuuguauaacaaaug

SEQ ID NO: 68156 - RNA, 64 nt, Human
gugucguaaaacauuccucaaacauuuuuucaugcaaauacacacuucuuuccccaaacaucau

SEQ ID NO: 68157 - RNA, 64 nt, Human
gaguucccucaucugaaaucauguaucugucucacaaauacaagcauaaguagaagauuuguug

SEQ ID NO: 68158 - RNA, 64 nt, Human
aagaauaugcauacuaauguuuguuucuauaaaucaaauacacaugugauaauaugcauguaaa

SEQ ID NO: 68159 - RNA, 64 nt, Human
aauauucucuguaauauuucaguccuuuacaagccaaauacaugugucaauguuucuaguauuu

SEQ ID NO: 68160 - RNA, 64 nt, Human
ccuaaguuuaccaacauguuaauaaacaggaacacaaauacauuucaguuggauaaucuucacc

SEQ ID NO: 68161 - RNA, 64 nt, Human
aaugucaaaauagugcucuuuaaaauucuggcaccaaauacaacuuacccugaaucacacaccu

SEQ ID NO: 68162 - RNA, 64 nt, Human
uaugcuguggucacaggggugucuugucugagaacaaauacaauucagucuucucuuugggguu

SEQ ID NO: 68163 - RNA, 64 nt, Human
uuuuaaaagucuaugaucuggacuuccuauaauacaaauacacaauccuccaagaauuugacuu

SEQ ID NO: 68164 - RNA, 64 nt, Human
auguguguacuaagcaaaaauauauaaauagugacaaauacacauuaccaagcuuaucuugcaa

SEQ ID NO: 68165 - RNA, 64 nt, Human
cugguauucucaguguuuuaaaauuuuagucauucaaauacauagacaguuguaucacaucaug

SEQ ID NO: 68166 - RNA, 64 nt, Human
caaacuuuguagcauggaaaaaauuuuccauccacaaauacaaacaugaauaaauacauucaga

SEQ ID NO: 68167 - RNA, 64 nt, Human
caugaauaaaauuaagaaaauagccauauacaaucaaauacacuauggcauuuuuauuugaaua

SEQ ID NO: 68168 - RNA, 64 nt, Human
ggaaaacgucuuuaccaugugguucccuccuccccaaauacauaaagcaaauaagcaggauggg

SEQ ID NO: 68169 - RNA, 64 nt, Human
accugcugccaaagucccugugcuaaugggauuacaaauacaaaaaguggaaaaaaauuuucgu

SEQ ID NO: 68170 - RNA, 64 nt, Human
ugaggugccuguaaaguaguauuuuugaucacuucaaauacauacucuucaagucaagaaauaa

SEQ ID NO: 68171 - RNA, 64 nt, Human
agagcugugcccaugggcuuguuagugggaaaagcaaauacaacaauguuuuaccaaacauuua

SEQ ID NO: 68172 - RNA, 64 nt, Human
ugcugccuaggugccauuuccuuuccuccucagucaaauacaggcugcacauuuugucacuuaa

SEQ ID NO: 68173 - RNA, 64 nt, Human
uauuuuaagaaucauauuuuaggauuauuuuuggcaaauacagugagcacuuauguaaccagau

SEQ ID NO: 68174 - RNA, 64 nt, Human
aggcaaaaaaacaaaacaaaacaaaacaaccaaacaaauacaaucuaacuuuuacccaaucuac

SEQ ID NO: 68175 - RNA, 64 nt, Human
auucucacccugugaaacgucccacacuuugaagcaaauacaauucacagcacaguacacacaa

SEQ ID NO: 68176 - RNA, 64 nt, Human
guaugugaaaaugagaucacauacuuuuuaaauccaaauacaaaagcauagucucugcaagauu

SEQ ID NO: 68177 - RNA, 64 nt, Human
gcuuggggaagagaauuccauacugaaagaagagcaaauacaaaagccugaaggaaagaaaagu

SEQ ID NO: 68178 - RNA, 64 nt, Human
ugagacucuuaaaagcaucagucuguaacuagaacaaauacagucuuagauuuacccaagugcc

SEQ ID NO: 68179 - RNA, 64 nt, Human
gccagacuggguuugcguuccaaccugcaaaacacaaauacauuuuuuaaaaucaagaaaauuu

SEQ ID NO: 68180 - RNA, 64 nt, Human
uuccuaacuuuuuuuugccaguuugaguucaaaucaaauacaccuuaaguucugguuucauguu

SEQ ID NO: 68181 - RNA, 64 nt, Human
ugccuguaucaaaacaucucacguaccucauaaacaaauacaccuauguacccacaaaaauuuu

SEQ ID NO: 68182 - RNA, 64 nt, Human
cuucuccuagcugaguauuuuuuaucaguaaguacaaauacaaugcagagcucauuuucaguua

SEQ ID NO: 68183 - RNA, 64 nt, Human
ucuuuccagugcccaguaugcuguuuugaggugucaaauacaaauaaaucugggcuuagggaag

SEQ ID NO: 68184 - RNA, 64 nt, Human
cugcugcuuuccaacacacaauuaacuccguuuccaaauacauuccaguguauuuucuguguug

SEQ ID NO: 68185 - RNA, 64 nt, Human
uguugcguccccgucuuuccagccccucccaucacaaauacagaagaaccccuucuaccaagcu

SEQ ID NO: 68186 - RNA, 64 nt, Human
aggaacuaaaacuuagcaaaucuauaaucacaugcaaauacacagaauggauuguuacaaccaa

SEQ ID NO: 68187 - RNA, 64 nt, Human
ucacccuggaccaugcccuaaaauaaccucaccccaaauacaauaaagggacgaagcacuuaua

SEQ ID NO: 68188 - RNA, 64 nt, Human
gagguauccaaaugcuacagaaaaauuuaugacccaaauacaaaucucaauuugacugggacag

SEQ ID NO: 68189 - RNA, 64 nt, Human
cacauuacauuucaaaaacuauuuugguaccuuucaaauacaguguuuaaauuaaaauagaaaa

SEQ ID NO: 68190 - RNA, 64 nt, Human
acugauauuugaccuggaaaguuaaucauggcaacaaauacauacaggauucuuuguuaugaau

SEQ ID NO: 68191 - RNA, 64 nt, Human
aucauacaucauuauuguccagugaauucaagaccaaauacaauaucgggagaaaauacaaacu

SEQ ID NO: 68192 - RNA, 64 nt, Human
cauggagucacaggcacacuaugacuucugcucccaaauacauaugaccauauguaaauaccac

SEQ ID NO: 68193 - RNA, 64 nt, Human
caaauauaggggaaaaucuuugaaaugaaagcuacaaauacaugugagaagaaaaaaauggauu

SEQ ID NO: 68194 - RNA, 64 nt, Human
ugugcaugcacucaggugcccuuuguuucaugaacaaauacauuucauuguacauguuuucugu

SEQ ID NO: 68195 - RNA, 64 nt, Human
agacccugccacacauggaagagacagcucaggccaaauacaggcaugauuucuuugccaaguu

SEQ ID NO: 68196 - RNA, 64 nt, Human
uuuuaaauaaguuuuuagguccugacacugacaucaaauacaugcacaccagaaaggcauuucc

SEQ ID NO: 68197 - RNA, 64 nt, Human
uuuuaauuaaacaaucuguaacagaaucaagaaacaaauacauuuuaauuaaacaaucuauaug

SEQ ID NO: 68198 - RNA, 64 nt, Human
ugcuuuucaaguguggguuuugcccugauuguugcaaauacaauuuccaccuucuggaaaggua

SEQ ID NO: 68199 - RNA, 64 nt, Human
agauucuuugagauagcccaucuuccugagcuagcaaauacaggaguuuucacuuucuuuagga

SEQ ID NO: 68200 - RNA, 64 nt, Human
caagacaacacaagaauuauuuuauuuuugagugcaaauacagguacuguuggaguugaugggc

SEQ ID NO: 68201 - RNA, 64 nt, Human
acacacaacucacugugaucuaugggagugauaucaaauacaaacgauguuguguuccuucucu

SEQ ID NO: 68202 - RNA, 64 nt, Human
acuauaguaauauggcuuggauaucugauguuuucaaauacaaaaauguacaauuuauccuuug

SEQ ID NO: 68203 - RNA, 64 nt, Human
acucuuagcagcauggaagagaaguguaaccaugcaaauacaaugagcuuaauaugcuaacuuu

SEQ ID NO: 68204 - RNA, 64 nt, Human
ugucucuugcauaggaagugucaccuucaggauacaaauacaugagcagaggcagaguuaggca

SEQ ID NO: 68205 - RNA, 64 nt, Human
guccagcagccugacaugacagagcacagcugcccaaauacaaaguucuuuagagcacugaaag

SEQ ID NO: 68206 - RNA, 64 nt, Human
uacauugaagccucuuuuacaugucaacuugugacaaauacaaacaugugagauuuuauauuuu

SEQ ID NO: 68207 - RNA, 64 nt, Human
uagugugaaacuugcucuacucucugaaaugauucaaauacacuaauuuuccauacuuuauacu

SEQ ID NO: 68208 - RNA, 64 nt, Human
cugacugguuuucuguauauugcacaacaguccucaaauacacugauguaugaaacuauucaua

SEQ ID NO: 68209 - RNA, 64 nt, Human
uuuagaaauuuuauucacaaacuucuguuugguacaaauacagugucauuguuuugugcauucu

SEQ ID NO: 68210 - RNA, 64 nt, Human
ugaguuuugagcuacuggauucuuauuaguuccccaaauacaaaguuagagaacuaaacuaguu

SEQ ID NO: 68211 - RNA, 64 nt, Human
accacugccucuagacuaaggucagcagauuuagcaaauacagacugccccaguucauugaauu

SEQ ID NO: 68212 - RNA, 64 nt, Human
cacaggaaagcauuuauacuucagaaagauuguacaaauacaaggaauguggaaaagccauuau

SEQ ID NO: 68213 - RNA, 64 nt, Human
cuagaagcgaugcuuuaguggccuaacccagggucaaauacagcucuuucuagcaaaaucaggc

SEQ ID NO: 68214 - RNA, 64 nt, Human
gagaucaguucuacugaaauggcaacaacaacuccaaauacaucucucccuucuugaaaucccu

SEQ ID NO: 68215 - RNA, 64 nt, Human
acuuuaauuuuccuccaacugucuaaaauuagagcaaauacauuggcaauacagcugcuuuugc

SEQ ID NO: 68216 - RNA, 64 nt, Human
ggcacaagucuacaauaagcuaaaucagaauuuacaaauacaagugucccagguagcauugacu

SEQ ID NO: 68217 - RNA, 64 nt, Human
cucccuccuccuccuccuccgagcugcuagcugacaaauacaauucugaaggaauccaaaugug

SEQ ID NO: 68218 - RNA, 64 nt, Human
uuauacagaagauauaauuuauuggaagaacugccaaauacauuuuguccuucuaaaaauaugg

SEQ ID NO: 68219 - RNA, 64 nt, Human
uuuuauccucaaauauguauuuuuguguauguuucaaauacaaguauuaggcugcuuuguucuu

SEQ ID NO: 68220 - RNA, 64 nt, Human
ccauuccugccaaggccauuacaucccacaaacccaaauacaaagcagcugacuucccuggauc

SEQ ID NO: 68221 - RNA, 64 nt, Human
auuguuccugaucucuuagucccauaaaugggaacaaauacagcuuucugcuucuuucuuuuug

SEQ ID NO: 68222 - RNA, 64 nt, Human
cucauaaucacuugcaauuucauuguaaaaugaacaaauacauaaauauuuuaagaaaaauuua

SEQ ID NO: 68223 - RNA, 64 nt, Human
uuucuguuuuuaaaucuagaagaucuucuaagcacaaauacagcuacaaugaaauauuuuacag

SEQ ID NO: 68224 - RNA, 64 nt, Human
cucucuaccuaccuagauguuuuucagaggccuacaaauacaaguaucuuucuuauaugcacau

SEQ ID NO: 68225 - RNA, 64 nt, Human
aaaaugaaugcuugacuucaacuuuuuaguugaccaaauacaaacauccuaaaguagagcuuag

SEQ ID NO: 68226 - RNA, 64 nt, Human
uggagaauuuucugaagauguaaccagaucuuuccaaauacaaagauuagauaaauugucuuau

SEQ ID NO: 68227 - RNA, 64 nt, Human
gcagcuucagacuguuaucuauaggcuuaucguucaaauacagcacuugaauaucccaaguagu

SEQ ID NO: 68228 - RNA, 64 nt, Human
auuuuagacuuuguuucucagcucuguacaaacacaaauacacacccccacaaaacuaaaauca

SEQ ID NO: 68229 - RNA, 64 nt, Human
cacagcccuuucauuuccuccccaccccacuccccaaauacagaggucugcuuugaagcggaga

SEQ ID NO: 68230 - RNA, 64 nt, Human
aaaaguguuuuugguuuguguauauauacauauacaaauacaacauuuacaauaaauaaaauac

SEQ ID NO: 68231 - RNA, 64 nt, Human
accaaaaaugaaugucugucauauauuuauauuacaaauacauuauauuuauguucuauucauc

SEQ ID NO: 68232 - RNA, 64 nt, Human
caguuuaagugcuuuguguugaugccaugcuuaucaaauacaugcacaagcuaaacauaauuug

SEQ ID NO: 68233 - RNA, 64 nt, Human
cgauguucauggaauugguuuaaacuuuuaugcgcaaauacaaaaugauugucuuuuuccuaug

SEQ ID NO: 68234 - RNA, 64 nt, Human
caaaauauuauauuauuucauaaauaauuucaagcaaauacagacauccacaauguagaacaug

SEQ ID NO: 68235 - RNA, 64 nt, Human
ucccacagaaaaauuccaagucaaauuaucaaaucaaauacaaaaauaagucuuaccucuugua

SEQ ID NO: 68236 - RNA, 64 nt, Human
agcugagaaaucagacucaaaguuccaccaaaaacaaauacaaggggacuucaaaaguucacga

SEQ ID NO: 68237 - RNA, 64 nt, Human
auuugcucugaucccuggaauagguguugcguaucaaauacagaugaagaaggaaaagagaaac

SEQ ID NO: 68238 - RNA, 64 nt, Human
gcccuucagcaagagaguuuaauuauaaucauuacaaauacaugcauucauguaagugugcaca

SEQ ID NO: 68239 - RNA, 64 nt, Human
aaacaaaucuaaaagugaaacaaaaaccaaccaacaaauacaacacaaagcaauuauucuuccu

SEQ ID NO: 68240 - RNA, 64 nt, Human
acaagugacaauauugguguagauuuguacuuagcaaauacaaacacauccaaaugaaaaauuu

SEQ ID NO: 68241 - RNA, 64 nt, Human
aauuucuaauguuuugcaguguuaaaauguuuugcaaauacaugccaauaacacagaucaaaua

SEQ ID NO: 68242 - RNA, 64 nt, Human
acacacauacuuaaaucuugcccugcaugaaauucaaauacauggaggcacaucuucagggcac

SEQ ID NO: 68243 - RNA, 64 nt, Human
ugcgaccaggguagagaguguugaaauucaauaccaaauacaguaaaaacaaauguaaauaaaa

SEQ ID NO: 68244 - RNA, 64 nt, Human
aucauccuuugucuuuccauaugguuuucauaaccaaauacaugacuauagcaugguuauuuuu

SEQ ID NO: 68245 - RNA, 64 nt, Human
cauuugaguguccaaaauagccaauuaacacaaccaaauacaacugggccaauauaaacauguu

SEQ ID NO: 68246 - RNA, 64 nt, Human
ugcacaugugcacauaaucuauuaugauccaaugcaaauacagcuccaaaaauauuaaauguau

SEQ ID NO: 68247 - RNA, 64 nt, Human
guuucucguugauuguacucaccuuuauggaauccaaauacauccaaaaggguaaggcaguuuu

SEQ ID NO: 68248 - RNA, 64 nt, Human
gccuggccaacauggcgaaacccugucucuaccacaaauacagaaaauuagcugggcguggugg

SEQ ID NO: 68249 - RNA, 64 nt, Human
ucugauuaugcaugguucuaaaugguuucaguggcaaauacauaacauuguacuacugauuaaa

SEQ ID NO: 68250 - RNA, 64 nt, Human
auguuaaauuaaugcuucucuucuuacaguaguucaaauacaaaacugaaaugaaaucccauug

SEQ ID NO: 68251 - RNA, 64 nt, Human
gagugggggucuccaucuguuuucucuucucccucaaauacaggcuguuuucaucgugucuagu

SEQ ID NO: 68252 - RNA, 64 nt, Human
aacagauauuucuccaaagaagauauacaaauggcaaauacauacguugaaagauccuuaauau

SEQ ID NO: 68253 - RNA, 64 nt, Human
aagaugguuguaagcuuugggaauuaaaaacaaacaaauacauuuuaguaaauauauauuuuua

SEQ ID NO: 68254 - RNA, 64 nt, Human
uuauguucuuugcauuauauugagcaagcagguucaaauacaguaacugacacuccucgguagu

SEQ ID NO: 68255 - RNA, 64 nt, Human
ucaaauauuuguuaccuggaauggaacuugaaagcaaauacauuuggauuucaaauuucugugg

SEQ ID NO: 68256 - RNA, 64 nt, Human
uuccauaauucacugcacuuaaauaaguuuaaaucaaauacaguuauuuuaguuacagguuagg

SEQ ID NO: 68257 - RNA, 64 nt, Human
uauaggcuauuugaaauuuuauuucugauuaugucaaauacaccuuccauuuugucauuuuugu

SEQ ID NO: 68258 - RNA, 64 nt, Human
ccagaaacauucuauagugugccagagcaaaaggcaaauacacaaaauauuauuuaaaucagga

SEQ ID NO: 68259 - RNA, 64 nt, Human
aaaacuagcaaauauaugaaaagacccuuaguaccaaauacacucaauugccuuuuuaaugaau

SEQ ID NO: 68260 - RNA, 64 nt, Human
uuagugguccguugccucugaagauguaaacaaacaaauacacuauuucugggaacauuuauau

SEQ ID NO: 68261 - RNA, 64 nt, Human
ucuccaagacagccuguguggccucuacucugaacaaauacacugaugagucaucagugaaauu

SEQ ID NO: 68262 - RNA, 64 nt, Human
uuauaaccaaaguguucaauuauccuugcaaguucaaauacagcauuuuucuuaauuuugagcg

SEQ ID NO: 68263 - RNA, 64 nt, Human
gcagucauccauucauaugcauggggucugaucgcaaauacacuaaauguggaguguaggaacc

SEQ ID NO: 68264 - RNA, 64 nt, Human
uucuaugcuuugcucaacaggaaagagaggaaaucaaauacaaauuauuuauaugcauuaauuu

SEQ ID NO: 68265 - RNA, 64 nt, Human
acagagucuuggaucagauugaauuccuagacaccaaauacagugugggaauacacaaccuacu

SEQ ID NO: 68266 - RNA, 64 nt, Human
augggaucauguuaaguagaaguagcuuuuuaugcaaauacaugcauuuaugcaauauuaaugu

SEQ ID NO: 68267 - RNA, 64 nt, Human
auaaauugucacaaauuauacaugaaauugauuacaaauacauuugaaaaacauaugccucuac

SEQ ID NO: 68268 - RNA, 64 nt, Human
uaauguauuuaaaucaacgcaaauguaugaauaacaaauacaguucugaccuuuuuuguccagu

SEQ ID NO: 68269 - RNA, 64 nt, Human
guuagcgugggucacacuuccaagauauuuaaagcaaauacaaaacagaacagaggauucaaac

SEQ ID NO: 68270 - RNA, 64 nt, Human
ucagccauccacgucuagguaucagagaggaccacaaauacaacauucuccaucugcuuucaga

SEQ ID NO: 68271 - RNA, 64 nt, Human
guuguuauagauagaauuuacuguuucugaaacccaaauacaguuaucaguuuaagguuaaaaa

SEQ ID NO: 68272 - RNA, 64 nt, Human
ucuguagaaacauucagaucccucuuccuuuacucaaauacaguuucaaaaggaagacucauga

SEQ ID NO: 68273 - RNA, 64 nt, Human
ugguuucucuauggaaagcuuuguuugcuuccuacaaauacaugcuuauuccuuaagggaugug

SEQ ID NO: 68274 - RNA, 64 nt, Human
uagucaacacuguuaacuuuuacuguguaauugccaaauacacuuuuccaaauuugucccaaca

SEQ ID NO: 68275 - RNA, 64 nt, Human
uucagcuacaaucuuugcucucucuguguaucagcaaauacauagagagauucuguacauuuau

SEQ ID NO: 68276 - RNA, 64 nt, Human
ccuuuuguuguugguuuuaaaauacauucacacacaaauacaaauugacaggucaaaauccaug

SEQ ID NO: 68277 - RNA, 64 nt, Human
auguuuaucggccucucuuagauccugagugagacaaauacagaaaugacccauucccugccca

SEQ ID NO: 68278 - RNA, 64 nt, Human
caggaaaaggcaguuucuuacaaguuccgaauuccaaauacagagacuggugguguuacauuua

SEQ ID NO: 68279 - RNA, 64 nt, Human
cuuggauauaccuagauuccauacagugacaauacaaauacaaaggaagaacaucuggauuuca

SEQ ID NO: 68280 - RNA, 64 nt, Human
acaucaucacaguuauccugaguugaguuuaagccaaauacaugcauagaaaagggucuuccua

SEQ ID NO: 68281 - RNA, 64 nt, Human
ccauccgcuguggcugcagcuuggaccgcaagggcaaauacacccugaccccacgguagggccc

SEQ ID NO: 68282 - RNA, 64 nt, Human
cuacgaauuuguauuaaacacaucagaauauuuccaaauacaacauaguauaguccugaauaug

SEQ ID NO: 68283 - RNA, 64 nt, Human
guuguaaaucauguuucccuuaucagaucauuugcaaauacauuuaaaugaucucaugguaaau

SEQ ID NO: 68284 - RNA, 64 nt, Human
auuuauacuauuaauuugcucagugcacuuuuuucaaauacagaaaaaagauucuccauuauag

SEQ ID NO: 68285 - RNA, 64 nt, Human
guaagcaagauuuaacuguuugauuauaacugugcaaauacagaaaaaaagaaggcuggcugaa

SEQ ID NO: 68286 - RNA, 64 nt, Human
uggccaacauggugaaacccugucucuacuaaaacaaauacaaaacuucgcugggcacaguggc

SEQ ID NO: 68287 - RNA, 64 nt, Human
aaguaacuggccuuuagcagaucuguuucaaaaacaaauacaaaaaugagaaugaaaaguuugc

SEQ ID NO: 68288 - RNA, 64 nt, Human
ggagagggcagacugugcacauuucacuaggguccaaauacagaagggcccagggcccaggggc

SEQ ID NO: 68289 - RNA, 64 nt, Human
cacuuuucccuacuuccucugcaaaaagauuuaacaaauacauucauaaggaaauguguguugu

SEQ ID NO: 68290 - RNA, 64 nt, Human
ugagauuuaucaccugcuaaugugaggucauuuucaaauacaaaggagagguuauuauguuaaa

SEQ ID NO: 68291 - RNA, 64 nt, Human
aaauagucaagauaugaacuaagaaauuuuaaugcaaauacauacauuccugaaagacggggaa

SEQ ID NO: 68292 - RNA, 64 nt, Human
gaaaacacuagaguucauacuaaaagauauuuugcaaauacacuaaaugggaaaaauaagcaag

SEQ ID NO: 68293 - RNA, 64 nt, Human
aauuaugcauuaucuuucuuuucuccaguccucacaaauacagaaacaauaacugaaauuaacu

SEQ ID NO: 68294 - RNA, 64 nt, Human
aaauuuccuugaauaauccaugaaaggaauaauucaaauacagauaaacagaguuggcaguaua

SEQ ID NO: 68295 - RNA, 64 nt, Human
ccugaaccagaugaacagcuacuaguuauuuuaucaaauacagaugacauuuaaaaauucuuaa

SEQ ID NO: 68296 - RNA, 64 nt, Human
ccucugucaccaccagccucuccaagcucaaguacaaauacagccgggucucauuuguuuuuuc

SEQ ID NO: 68297 - RNA, 64 nt, Human
uaacuguauuuaauuugcuuucaaaauuaaaagucaaauacaguuuuuaacaguccuaauccuc

SEQ ID NO: 68298 - RNA, 64 nt, Human
uucuacauauuuuagggaggcaugaggcaucaaucaaauacauuuaaggaguguaggggguggg

SEQ ID NO: 68299 - RNA, 64 nt, Human
uauuuuuauugguuccugaagacgggacaaggaacaaauacauacguuaauaugagagaucagc

SEQ ID NO: 68300 - RNA, 64 nt, Human
cuucaaaaaaguaauauccucacuuggagagugucaaauacauacuuugaggauugacuuuaua

SEQ ID NO: 68301 - RNA, 64 nt, Human
guuggagauuaguuugcaaauaagcauaucauaucaaauacaauauuccagccaaccaguuaau

SEQ ID NO: 68302 - RNA, 64 nt, Human
aaaucaaaugaugaccuaaauuucccuuaauuugcaaauacaguaguaauuaagguacaucucu

SEQ ID NO: 68303 - RNA, 64 nt, Human
ccuagggccugucucugaguaauuuuaauuuugccaaauacacugacauuuaaaauagugaucc

SEQ ID NO: 68304 - RNA, 64 nt, Human
cauauuagacagugcagaucuauacucauuccuucaaauacauuacucuguuaaucucaaagug

SEQ ID NO: 68305 - RNA, 64 nt, Human
gcaagaguauuuggagcaagaagcugcaaugcgccaaauacacaauaggccuuuucuuuaucau

SEQ ID NO: 68306 - RNA, 64 nt, Human
aauggcucacauucuuucaaaaggucuaauuugacaaauacauaagacccauuauuuccuagaa

SEQ ID NO: 68307 - RNA, 64 nt, Human
cagaccaagaaaugagugagcugggaaguguuuccaaauacaguuagugccuaaaauagugucc

SEQ ID NO: 68308 - RNA, 64 nt, Human
uuuguaauguuggcauacuuggggaauuuaguggcaaauacauuccccagcaggccuuuuguug

SEQ ID NO: 68309 - RNA, 64 nt, Human
caguggcagcacuagcagugguauuagcuuaugccaaauacagcuuuggaaggaucuuuuuuuc

SEQ ID NO: 68310 - RNA, 64 nt, Human
agcaaaaaguauaauguucuucacuugaacuaaucaaauacaauagauuauaaauuguguauug

SEQ ID NO: 68311 - RNA, 64 nt, Human
acuguaccuuagagauuuuccucuagugcucaaacaaauacaaaauaagauccccaagguuuaa

SEQ ID NO: 68312 - RNA, 64 nt, Human
auacuggugaaaauuuaccuaaaaccuugguuaucaaauacaucuccaguacauuccguucuuu

SEQ ID NO: 68313 - RNA, 64 nt, Human
guuucacuugcugagauuuccuguacauugcaaacaaauacagaaugcaaacccucaaagcugu

SEQ ID NO: 68314 - RNA, 64 nt, Human
uguaaauaugaaagccaaaguauuccugaauggucaaauacagcaauaaaggcagaagaauuaa

SEQ ID NO: 68315 - RNA, 64 nt, Human
uauguauagucauguauuccugcauauguacauacaaauacagagauauauaaaguacauagaa

SEQ ID NO: 68316 - RNA, 64 nt, Human
aacaagcuggauccaguagaugcguauggaauuucaaauacacauagacgaugcacaaaaaacc

SEQ ID NO: 68317 - RNA, 64 nt, Human
gcaaccuagaccguugguuccaucacugccgucccaaauacaguuuccgucgccuugacgacaa

SEQ ID NO: 68318 - RNA, 64 nt, Human
guuaaugccaaacguuauguuaaaguuauuuuuucaaauacaggauuuggggagagaagccaau

SEQ ID NO: 68319 - RNA, 64 nt, Human
uuaggauggagaaugucagaucaaguuagaaagucaaauacaagcacauccugugaacggugau

SEQ ID NO: 68320 - RNA, 64 nt, Human
cagaaauuggcagucacuucccagauuguaccagcaaauacacaaggaauucuuuuuguuuguu

SEQ ID NO: 68321 - RNA, 64 nt, Human
agaccucagccucaaaaggcuuggaaagaaaaaacaaauacaacaagcaaacaacaauaucaac

SEQ ID NO: 68322 - RNA, 64 nt, Human
ccuugaaaaggggugguauuucuuuuggggucaacaaauacacauaucaguuucacuccuaacc

SEQ ID NO: 68323 - RNA, 64 nt, Human
ucuccaauuucuuagucacuucuguccuaccaugcaaauacacagauuaugccaagagguacca

SEQ ID NO: 68324 - RNA, 64 nt, Human
agacuuguuuuauaucuauaaaucuagguuauuacaaauacaagaauuuuguaccuuaaauaag

SEQ ID NO: 68325 - RNA, 64 nt, Human
acccugagaccaucuuaccacccuggaccugguccaaauacagacuuacacaguggaccauucu

SEQ ID NO: 68326 - RNA, 64 nt, Human
caccuuugagugaucuuacucccucguacaugcacaaauacacacucaugcacacacacacuca

SEQ ID NO: 68327 - RNA, 64 nt, Human
cucauuagcugaauugagcuagaaaucacaagaacaaauacacuuuauuaauauaaccauaaau

SEQ ID NO: 68328 - RNA, 64 nt, Human
cuuguuuuuguuuuugcagcuaaaauaaaaauuucaaauacaauuuuaguucuuacaagauaau

SEQ ID NO: 68329 - RNA, 64 nt, Human
aagguauauauucuauuuguauggaauucuuauucaaauacaguucuauuaaagaguauacucc

SEQ ID NO: 68330 - RNA, 64 nt, Human
uuuucuguuacuuucguugucaaaaugccauacccaaauacacagcaaugaauggcacacaagu

SEQ ID NO: 68331 - RNA, 64 nt, Human
aacaauaucaggauuuuauauaaccaaauaguuucaaauacaacaaaauucccuuuaugaacuu

SEQ ID NO: 68332 - RNA, 64 nt, Human
uaucuguaucuggacaaugcaguagaaauuauaacaaauacaaaguucuuugugcuuuucugcu

SEQ ID NO: 68333 - RNA, 64 nt, Human
ccauuauucuauguagugguuuuaggauacuuaacaaauacauucaaauucuuuuuuuauuauu

SEQ ID NO: 68334 - RNA, 64 nt, Human
aaugaaauaccuauacuuugauacugaagacugccaaauacauaggaauuuucuuucuuaaaaa

SEQ ID NO: 68335 - RNA, 64 nt, Human
uuguuuuuagagaacuauucugguacuaucagaacaaauacauaaaauaacuucccauagagaa

SEQ ID NO: 68336 - RNA, 64 nt, Human
aaagugaauugguuaaaagagugcaauaaggauccaaauacagugacuuuuuuuucauacauuu

SEQ ID NO: 68337 - RNA, 64 nt, Human
gcauuaaauauugcauuuaaaaauuauacuguagcaaauacauuuaaaaauuaaucacaacguu

SEQ ID NO: 68338 - RNA, 64 nt, Human
auaugcuuguaacuaaaauaauuuuguaauguaucaaauacauuuaaaacauuaaaauauaauc

SEQ ID NO: 68339 - RNA, 64 nt, Human
acucuaauaugauaugcuuucuggaaggauaaaacaaauacauaugggaaaaaguacuugagac

SEQ ID NO: 68340 - RNA, 64 nt, Human
auuuucaucaucagaacuaauaaaucaaguguuccaaauacaauuugcauuaaaaagauuggca

SEQ ID NO: 68341 - RNA, 64 nt, Human
aauguuuuauguaaaaaguguuuaucuucagcaccaaauacaugauaaauguaucaaucacuau

SEQ ID NO: 68342 - RNA, 64 nt, Human
aauagaauguggccacuuauuucacuaucuucuucaaauacaaaguaaauacaagacuguugug

SEQ ID NO: 68343 - RNA, 64 nt, Human
caauuauuucuguuauuaaugguuguagaaaguucaaauacauacgcagaguuggaaagacgag

SEQ ID NO: 68344 - RNA, 64 nt, Human
uugaauaaguacuucauauuuuuccaucauuagacaaauacaaaauggacuaaauaauuuuaag

SEQ ID NO: 68345 - RNA, 64 nt, Human
cuaagcuuuaauccacuguguuaggucaaaacuucaaauacaugcauuuuucaauauaggguau

SEQ ID NO: 68346 - RNA, 64 nt, Human
auuggaaaugcacgugguuucuuaggcuuuuaaacaaauacauggaaugguugaaagauuuauu

SEQ ID NO: 68347 - RNA, 64 nt, Human
uuuaauacaaaaacaaaaucuuguaaaagguguccaaauacauaguaaucuuuuccaguuaugu

SEQ ID NO: 68348 - RNA, 64 nt, Human
aaaccaaguacuguuuaauuucaaucagaagaugcaaauacauacuuugaucuauguuugauuu

SEQ ID NO: 68349 - RNA, 64 nt, Human
acuucaguggaauuuacuuuagauauucauucaucaaauacaugggacuucacaaacaauuuuc

SEQ ID NO: 68350 - RNA, 64 nt, Human
ggguagaaaggagagaaaaacccacugaaggguucaaauacaugugaauucuacugcuuuaaga

SEQ ID NO: 68351 - RNA, 64 nt, Human
cuucuuucuaaaauucaagagugcaauuuuguuucaaauacaguauauugucuauuuuuaaggc

SEQ ID NO: 68352 - RNA, 64 nt, Human
gcgaggauucugauauuuggcauacuuguaaaaacaaauacauaaguaaccauugaacauuaau

SEQ ID NO: 68353 - RNA, 64 nt, Human
auuaccaauuaaacuuuaacugaacuaaggcuaccaaauacauucccuguuaucuaaauuauaa

SEQ ID NO: 68354 - RNA, 64 nt, Human
gagugagaagagcauuuuuacuuuuuuaaaaaagcaaauacauauauacacauacguaugcaaa

SEQ ID NO: 68355 - RNA, 64 nt, Human
agguugugguaacuaaauaggaguccuauaaaaucaaauacauugucaaccuuuucugcacauc

SEQ ID NO: 68356 - RNA, 64 nt, Human
uagugcucgagucacauucugcuuaaaguuguaacaaauacagaugaguuaaaagauauugugu

SEQ ID NO: 68357 - RNA, 64 nt, Human
aguaguggagcugcucuguuuaggugaaucuccucaaauacaaugaagugcccacugcaauaaa

SEQ ID NO: 68358 - RNA, 64 nt, Human
uuguuccucaaaccccaucugucagaccacugaacaaauacacauacuaggccucaagugugcu

SEQ ID NO: 68359 - RNA, 64 nt, Human
acacacaggagucagugcccauguguauggaagacaaauacacauacauauauacauuuugcag

SEQ ID NO: 68360 - RNA, 64 nt, Human
ucuauuuuuugcaaauuuguaaacuuugcuucuccaaauacaaguacuagguuguccauuuaug

SEQ ID NO: 68361 - RNA, 64 nt, Human
aacauuucauacaacacgauuguauuuuggcaagcaaauacacacacacacacauacucucaca

SEQ ID NO: 68362 - RNA, 64 nt, Human
aagauucauaaguuucugaacucguauguacuaucaaauacauaaagguguaaaauuacaacaa

SEQ ID NO: 68363 - RNA, 64 nt, Human
uagaguugauccuugaagucucuccugguucauucaaauacaagcugugugagucuggugguuu

SEQ ID NO: 68364 - RNA, 64 nt, Human
cauuaggcuuacguacuacuuguuucaaaugugucaaauacaaaaaugguaacuagguugacag

SEQ ID NO: 68365 - RNA, 64 nt, Human
cacugggacacacaaacacccaaacagaaaaauacaaauacacguaccccaggaaggggucccu

SEQ ID NO: 68366 - RNA, 64 nt, Human
agauuccuccuuuagggcagagacagaccacugacaaauacacagauagacaaggaauuuccca

SEQ ID NO: 68367 - RNA, 64 nt, Human
gggaugguccacugucacuguuucucugcuguugcaaauacauggauaacacauuugauucugu

SEQ ID NO: 68368 - RNA, 64 nt, Human
gggaugguccacucucacucuuucucugcuguugcaaauacauggauaacaccguuaauuccau

SEQ ID NO: 68369 - RNA, 64 nt, Human
uuggcauguguguuaaucccugauccaaaaagaacaaauacacguauguuauaaccaucagccc

SEQ ID NO: 68370 - RNA, 64 nt, Human
aauaaaacugcuuuaacggagaugaugucagguacaaauacacuauagagucaaaauaccauuu

SEQ ID NO: 68371 - RNA, 64 nt, Human
auaaaaagcauuaauugcacagcuaccauccacacaaauacauaguuuuucugacuucacauuu

SEQ ID NO: 68372 - RNA, 64 nt, Human
ugccuccuuuuuccguucugguuuuuaauuagugcaaauacaagcugcguuucuuuaauagaaa

SEQ ID NO: 68373 - RNA, 64 nt, Human
uccggauaauauauauacuguucauguacauccacaaauacaccuuguaccaaauaaugcuuuc

SEQ ID NO: 68374 - RNA, 64 nt, Human
cgugauuuagcucuuuuauugugcuuacuugguccaaauacaucugugggguguuuugucauuu

SEQ ID NO: 68375 - RNA, 64 nt, Human
auguuuguacccgucacaguuuucauagugcuuucaaauacaccuuuuugaucauuaaaauaaa

SEQ ID NO: 68376 - RNA, 64 nt, Human
ucacacacacagaaauuaguauauccauguaugucaaauacagguuaaaauaucagggcauuua

SEQ ID NO: 68377 - RNA, 64 nt, Human
ucgagagaacuggcaugaggaguuagguucaucacaaauacacacacacugcccccaacccucu

SEQ ID NO: 68378 - RNA, 64 nt, Human
acuuuuugucauaaacaaacaggccaucugccgccaaauacauccacuccccaugccacugaca

SEQ ID NO: 68379 - RNA, 64 nt, Human
cauaaacccaggcugaaaauauuuuuuaacuccucaaauacaaauaaauuaaugaacccaugag

SEQ ID NO: 68380 - RNA, 64 nt, Human
cccaggcccagggucuggcugaaaaggcuuucugcaaauacaugcccuaaaguuucucagagcc

SEQ ID NO: 68381 - RNA, 64 nt, Human
ucuucacagugcagugaauuggaagacuugacugcaaauacaaacacccaggauccuuucuuga

SEQ ID NO: 68382 - RNA, 64 nt, Human
auuaacaucagguauauuuuguaaauuuaguuaacaaauacauaaauuuuaaaauuauucuucc

SEQ ID NO: 68383 - RNA, 64 nt, Human
gaaaagcuuguauauacuuugccacuggaaaggacaaauacauuuccagguaacucaacuauga

SEQ ID NO: 68384 - RNA, 64 nt, Human
gagguuccuuggcguuguuuaaggucaacuccaccaaauacagcaaccagcuggggcuugaaug

SEQ ID NO: 68385 - RNA, 64 nt, Human
ucuuaacaauucaagcaguagacaaaguugcucacaaauacagaaaacaucuuuuugucuacuu

SEQ ID NO: 68386 - RNA, 64 nt, Human
auuuuagaaucucuauucaagaugauguucacuccaaauacacuacagaauuuagucaacauuu

SEQ ID NO: 68387 - RNA, 64 nt, Human
uuuagauuuuuuucacuauagcaugaaauauauucaaauacauaccuuauuuuaugcaauaaau

SEQ ID NO: 68388 - RNA, 64 nt, Human
cuguuguggauuuuagauguaacaaauguuuauacaaauacauacauguacaccauguuucaaa

SEQ ID NO: 68389 - RNA, 64 nt, Human
uaugguuucuuacuguguguugcauuuuugugcccaaauacauaguuuucauauuaaaaagccu

SEQ ID NO: 68390 - RNA, 64 nt, Human
gaggguuauaaauuuuagcaaguugguaaauucacaaauacauaaccuugaauaaugaggauca

SEQ ID NO: 68391 - RNA, 64 nt, Human
aucuucauuguauuaauuauuacauaaagauuaacaaauacauugcaaaugcaaauuauaggau

SEQ ID NO: 68392 - RNA, 64 nt, Human
cauugucccuuucuugaaaguuucuuuuuuaagacaaauacauuauuucugcauugaucauuga

SEQ ID NO: 68393 - RNA, 64 nt, Human
caggcaccuccuuccucaggaaaaugcugguguacaaauacacacaaagcucuucaggcagcug

SEQ ID NO: 68394 - RNA, 64 nt, Human
augugagaaagccuuaaguacuuucagcuucuuacaaauacauaagagacucacacugaaaaaa

SEQ ID NO: 68395 - RNA, 64 nt, Human
augugggaggggcuuuuauucugccaagucauuucaaauacaugaaaaaucuuacacuggagag

SEQ ID NO: 68396 - RNA, 64 nt, Human
auguagaaaagcauuccauaauuucucuucuuugcaaauacaugaaaggaugcacagaggagag

SEQ ID NO: 68397 - RNA, 64 nt, Human
auguggaaaagcguuccauaauuucucuucuuuucaaauacaugaaaguugcacagaggagagg

SEQ ID NO: 68398 - RNA, 64 nt, Human
acaugggaaagcuuucaaucauuuuaguuccuuucaaauacaugaaagaacucaucauggagaa

SEQ ID NO: 68399 - RNA, 64 nt, Human
uaaaagaaggagguaugaacuguauuucucauugcaaauacaaaauaaaaauuaguuguuaccu

SEQ ID NO: 68400 - RNA, 64 nt, Human
gcuggcccugccguuuccccuccuuggcuuuaugcaaauacaaucagcccagugcaaacggcuc

SEQ ID NO: 68401 - RNA, 64 nt, Human
aggcacugggcauuaccauagagaacaaaauagacaaauacaucugcccucauggaaggugacg

SEQ ID NO: 68402 - RNA, 64 nt, Human
ugcuguguguccuguuccauguuccgguuccauccaaauacacuuucuggaacaaaugcauggc

SEQ ID NO: 68403 - RNA, 64 nt, Human
ggccagcacaugagggcucaccaaguguaagccacaaauacacaucagcuauagcacaaauaua

SEQ ID NO: 68404 - RNA, 61 nt, Human
aucagaaaauucauuuuugagauaacuguuccaaauacagugacuauagaagaucauaaag

SEQ ID NO: 68405 - RNA, 64 nt, Human
aauuuucccugagaauauuuuguauauauuuacacaaauacauuugaucagacuaggaacaagu

SEQ ID NO: 68406 - RNA, 64 nt, Human
auccuuggaauuuucuauauagaaaugucaucugcaaauacagaccauuuuuuaucuuucaucu

SEQ ID NO: 68407 - RNA, 64 nt, Human
guuacaugacacuucuagaaggauucuuaaaagacaaauacacccuuucuucccccuuccuauu

SEQ ID NO: 68408 - RNA, 64 nt, Human
cugugggaaagccuucaguugucaacguucuuuccaaauacauggaaggacucacacuggagau

SEQ ID NO: 68409 - RNA, 64 nt, Human
uaguaaagccuuaauuuuaagccucaguuucuuucaaauacaguuauccccuaauauuugcagg

SEQ ID NO: 68410 - RNA, 64 nt, Human
auguggugaaggcuuaagugauuucaguuuauuucaaauacaguuuuccccugacauaugcagg

SEQ ID NO: 68411 - RNA, 64 nt, Human
uacacucgguuacucuggccuugauucugaucuccaaauacauuauauuuuuuauuugggacca

SEQ ID NO: 68412 - RNA, 64 nt, Human
ccccauuauuaacagauacucccauaauaacccccaaauacagaccccaugucacccagaaaga

SEQ ID NO: 68413 - RNA, 64 nt, Human
acucuggggacugggaacccaugaaauugacccccaaauacauccugcggaaggaauucaggaa

SEQ ID NO: 68414 - RNA, 64 nt, Human
cuaauuuaaauaaauuaacuauuuaaagacccuccaaauacaguaaccuucugagauauugaga

SEQ ID NO: 68415 - RNA, 64 nt, Human
aaagauaacaacuuacauaagcauaguucauuaccaaauacaggaaagugaaauuguuacaaua

SEQ ID NO: 68416 - RNA, 64 nt, Human
uucaacuaauuuuuggugcuauuauucuauucugcaaauacacugaauauguuuauuaguucca

SEQ ID NO: 68417 - RNA, 64 nt, Human
aaugugacaaaguuuucauucacaaauccagcuucaaauacauaggagaauucacacuggagaa

SEQ ID NO: 68418 - RNA, 64 nt, Human
aacaucagagaauucauucuugagacaauucuuacaaauacagugacuguggcaaacuccugau

SEQ ID NO: 68419 - RNA, 64 nt, Human
uaguuaacacugaaugaaggccuuacuagugugacaaauacaggauauuuauccagaagucugg

SEQ ID NO: 68420 - RNA, 64 nt, Human
aaguuaacccaguugagauuuuuaaaaaguuuuacaaauacauauaacacuuaugugcugggcu

SEQ ID NO: 68421 - RNA, 52 nt, Human
ugaagacacagucuacauaaaucaaauacaauuucguuuucacuugcuucuc

SEQ ID NO: 68422 - RNA, 64 nt, Human
ucauaguuuugcauaucagauguaggcauacagacaaauacauaaaccaaugaauauauuacau

SEQ ID NO: 68423 - RNA, 64 nt, Human
ugugaggggcuugcagcuauccuuccuguguauacaaauacaguauuuuccaugguucugccug

SEQ ID NO: 68424 - RNA, 64 nt, Human
ggugaagggugaugauggccugcuucagaacagccaaauacacuuuuuuuuuuuuuccugaaac

SEQ ID NO: 68425 - RNA, 64 nt, Human
acaugauuuuaaucugcucacauuauaacaggaccaaauacacaagagcguaaucaaaucaucu

SEQ ID NO: 68426 - RNA, 64 nt, Human
auauuuuuuggugugcccuguguguguguguguacaaauacauguguauauuccuuuuaaagaa

SEQ ID NO: 68427 - RNA, 64 nt, Human
uggaugauauuuuuuaucauaaaugcagaauaaucaaauacauuuuaagcaaguuaaguguccu

SEQ ID NO: 68428 - RNA, 64 nt, Human
ugucucuaaacuuuauuuucaaaagcuuaaggcccaaauacaaacuucucuggaauaaacgugg

SEQ ID NO: 68429 - RNA, 64 nt, Human
uccauuuugugucugugaacauaggugugcuucccaaauacauuaacaagcucuuacuuccccc

SEQ ID NO: 68430 - RNA, 64 nt, Human
acaagaccagcuggaacugagcaugagacgcugucaaauacagacaaaggauuugagauguucu

SEQ ID NO: 68431 - RNA, 64 nt, Human
ucagaauuuucuaccguuccacacccaaccccuucaaauacacacaaccuuguuacuuuucacu

SEQ ID NO: 68432 - RNA, 64 nt, Human
gcaacugcauggcaugugcuguuuugguugaaaucaaauacauuccguuugauggacagcuguc

SEQ ID NO: 68433 - RNA, 64 nt, Human
gugccccaacaucuucugagcgccacccuugcaacaaauacaggcgccugcacagccuggccca

SEQ ID NO: 68434 - RNA, 64 nt, Human
uggagaaaagccuggaacugccaaaacaaaaaaacaaauacaaacaaaccucgucaccacgguc

SEQ ID NO: 68435 - RNA, 64 nt, Human
caucuagcagcacuaaaacuuauucaacuuuggccaaauacaaaugcgaaauuagaaaaaaauu

SEQ ID NO: 68436 - RNA, 64 nt, Human
auuuagucauguugggagaaaaauagauggguuacaaauacaucagauaucgagcaaaugguuu

SEQ ID NO: 68437 - RNA, 64 nt, Human
ucuauuuuuguuuagaguuuguacacaaaaucuacaaauacauuacucuaaaauagcaccuaua

SEQ ID NO: 68438 - RNA, 64 nt, Human
ucucuuuuuaaaaacuuuuuaucaugaaaacuuucaaauacaaaaauaaaaugguagagugaac

SEQ ID NO: 68439 - RNA, 64 nt, Human
auagcaaaugaaggaugaaguauaucucuagaugcaaauacauugaguuuaaaagugccucaaa

SEQ ID NO: 68440 - RNA, 64 nt, Human
uuuggcagagcuuuuaccuguuauucuuugcccucaaauacaguauuguggucauuuugaugau

SEQ ID NO: 68441 - RNA, 64 nt, Human
aguaguauucacuuuacauugaagaccucauucacaaauacagggugcucugugcuuauauccu

SEQ ID NO: 68442 - RNA, 64 nt, Human
gcugcuccuggcguggaaacuuaagugagaccaccaaauacauugguccuguccaauucuacug

SEQ ID NO: 68443 - RNA, 64 nt, Human
cuugucucaaaaaccauuacaaaaucuuaaccuucaaauacauucuaaaucacuuuaauuuaga

SEQ ID NO: 68444 - RNA, 64 nt, Human
uguaaaugggaaaauauauauuaaaauugauugucaaauacagcauuucuuuggaaaccaccuu

SEQ ID NO: 68445 - RNA, 64 nt, Human
uaggcuguuaccaaaggguguucaguaaaaauaacaaauacauguaacuguagauaaaaccaua

SEQ ID NO: 68446 - RNA, 64 nt, Human
aguuucacuuauguuaaauguugcucuuauaccacaaauacauugaaaacuucggaugcauguu

SEQ ID NO: 68447 - RNA, 64 nt, Human
aaaggcaagcacuuuguucugagucuuuuaucuccaaauacauaguugucucaaaccaagcaag

SEQ ID NO: 68448 - RNA, 64 nt, Human
ccacauuuguuaucucaaauuuugaugauauucucaaauacaaauauacuuuuuuauauuucac

SEQ ID NO: 68449 - RNA, 64 nt, Human
aucagcauuaucucauagauuggaaaauuuucuccaaauacaauagaggagaauauguaaaggg

SEQ ID NO: 68450 - RNA, 64 nt, Human
ugauuauuugaaacuuuacaacacaauugcaucccaaauacaaauuguauugcuuauucauuau

SEQ ID NO: 68451 - RNA, 64 nt, Human
gacaaacacaaacccuguuaauuauagaauggaccaaauacauuuuuaaaagaaaacugagacc

SEQ ID NO: 68452 - RNA, 64 nt, Human
ucauaguuuaauuggucuaccaaguaagacaucucaaauacaguaguauaauguaugaauuuug

SEQ ID NO: 68453 - RNA, 64 nt, Human
uuuaaaaaauugagcucaucaaaaauauugucaucaaauacaggugguuaaucugacauacauu

SEQ ID NO: 68454 - RNA, 64 nt, Human
ggagcaccaaacuccgccccaaaaaggagaguaacaaauacacaauucacacauaacacuaagc

SEQ ID NO: 68455 - RNA, 64 nt, Human
caauuuuccagaguaaggauagaggagucaaauucaaauacagguuuucugacauuaacuuaug

SEQ ID NO: 68456 - RNA, 64 nt, Human
uuucucuagagagcugacuaaugaugaacggaagcaaauacaucagauugcccagaaguauggu

SEQ ID NO: 68457 - RNA, 64 nt, Human
cauugacgacauagcggcccccgcguccggguuacaaauacaucuacagauauuuucagggauu

SEQ ID NO: 68458 - RNA, 64 nt, Human
uaggcuguuaccaaaggguguucaguaaaaauaacaaauacauguaacuguagauaaaaccaca

SEQ ID NO: 68459 - RNA, 64 nt, Human
ccuuacacuugguagaagaaauugaaggguuacucaaauacaguugcaaucugcaaucugcugu

SEQ ID NO: 68460 - RNA, 64 nt, Human
gagacccaagcugccuccccucuccuuccuguguguccaaaacugccucaggaggcaggaccuu

SEQ ID NO: 68461 - RNA, 64 nt, Human
uuccaccaagguaccuacauucuaccacgccuggguccaaaaccacggugcuggccuguuugug

SEQ ID NO: 68462 - RNA, 64 nt, Human
ggacuguuuuuuauaauauggccuaauuuuaaagguccaaaauaacuuguuuuuaaaguuugcc

SEQ ID NO: 68463 - RNA, 64 nt, Human
ggauuugucaauguaaguauuugucauaucugagguccaaaaccacaaugaaagugcucugaag

SEQ ID NO: 68464 - RNA, 64 nt, Human
uucucuucuggauauuuuguuuauuuuuucugaaguccaaaaaauuaucauuacaguguaccau

SEQ ID NO: 68465 - RNA, 64 nt, Human
guaagaugaugaaagagacaauguaauacuguugguccaaaagcauuuaaaaucaauagaucug

SEQ ID NO: 68466 - RNA, 64 nt, Human
auggauucagagaaagcucugggaaugacuuaugguccaaaaaagugacccaauggcaacaaau

SEQ ID NO: 68467 - RNA, 64 nt, Human
uagaugcaucugaaucuucauaucgguauauuaaguccaaaagaugguccgggcugccccucac

SEQ ID NO: 68468 - RNA, 64 nt, Human
agaacggguauuccagacacuucuuaugaugaaaguccaaaaguggcauccaauuuaaggcccc

SEQ ID NO: 68469 - RNA, 64 nt, Human
ucgucugggcaccucagcaucuguggacuugagcguccaaaaacccugagugugauucugggca

SEQ ID NO: 68470 - RNA, 64 nt, Human
cagcaguucugaacuuuuuaguauuuuauaaaugguccaaaaaaugccuguuucagaaguuuuu

SEQ ID NO: 68471 - RNA, 64 nt, Human
ccuaugcaauggggugguaaggcaggcacgaagaguccaaaaaaucuagguggccucucagcuc

SEQ ID NO: 68472 - RNA, 64 nt, Human
uggucugggagcucguuaacuaugcugggaaacgguccaaaagaaucagaauuugagguguuuu

SEQ ID NO: 68473 - RNA, 64 nt, Human
gauuuuggagacuaccaggguaagauuccaacuuguccaaaagcuuucuggccuuacauauuuu

SEQ ID NO: 68474 - RNA, 64 nt, Human
auguggauacuaacuucauacauuuaucggcauuguccaaaauauuuuauucuuuaauggaaaa

SEQ ID NO: 68475 - RNA, 64 nt, Human
gauguuuguaguuacuauaaaucaagcuuuggaaguccaaaaagaauaaaagacugccuuccuu

SEQ ID NO: 68476 - RNA, 64 nt, Human
agacugggaauggaaagaacuacagagggacgauguccaaaacaaaaaauggcaucaccuguca

SEQ ID NO: 68477 - RNA, 64 nt, Human
uuagcuaaagacagccuaaauuucccaauuuucuguccaaaauauuugugauuuacuuguauau

SEQ ID NO: 68478 - RNA, 64 nt, Human
augcagauaauagccuacuucuuagaauaugccuguccaaaauugcagacuugaaaaguuuguu

SEQ ID NO: 68479 - RNA, 64 nt, Human
cuucucuugacaguuuuaauugauaaagaccagaguccaaaauggaaaccagcugaucuaaaag

SEQ ID NO: 68480 - RNA, 64 nt, Human
gaacccacagaccaggugaauuacugauuucuaaguccaaaaacuauagagcagaagaauugag

SEQ ID NO: 68481 - RNA, 64 nt, Human
gucacaggccagagcugccuugguauguuguuaaguccaaaacuucuucucugggcuaccuauc

SEQ ID NO: 68482 - RNA, 64 nt, Human
caagugugugugcaauguuccguucaucugaggaguccaaaauaucgagugaauucaaaaucau

SEQ ID NO: 68483 - RNA, 64 nt, Human
agacaacuauaaucauucaaaaauuccaaguuggguccaaaaugucaaagguagguauuggacu

SEQ ID NO: 68484 - RNA, 64 nt, Human
uccuuuuauuugcuuccuccaacuauuuaaagugguccaaaaacacuuuucuguaaguuucuau

SEQ ID NO: 68485 - RNA, 64 nt, Human
guuucuucauguuuucccaacucuuucauccaguguccaaaauauauaaguaaauagcuguaga

SEQ ID NO: 68486 - RNA, 64 nt, Human
uuagaauaaugcgcaauuucauguuaugccuuaaguccaaaaagguaaacuuugaagauuguuu

SEQ ID NO: 68487 - RNA, 64 nt, Human
uuacgggaugccuaaauugcauccuguaacuucuguccaaaaagaacaggaugauguacaaauu

SEQ ID NO: 68488 - RNA, 64 nt, Human
uguuuuguggacuggcuggcucuguuagaacucuguccaaaaagugcauggaauauaacuugua

SEQ ID NO: 68489 - RNA, 64 nt, Human
aaggcacaugcuuuuauccgugaccagauuuuuaguccaaaaaaauguauuuuuuuguguguuu

SEQ ID NO: 68490 - RNA, 64 nt, Human
ccauccuccaaaacgccuccauaacaccaguaaaguccaaaaccucuaccgaagaccucaugaa

SEQ ID NO: 68491 - RNA, 64 nt, Human
acacacauguauauucuuccuugauuguguagcuguccaaaauaauaacauauauagagggagc

SEQ ID NO: 68492 - RNA, 64 nt, Human
aaagaagaaaaacauguauaaaauaguuuuaguaguccaaaaugucaacuaucuguagcugcuu

SEQ ID NO: 68493 - RNA, 64 nt, Human
aguacuuuaccacaaauacaguguaauaucaucaguccaaaacugcauuacuuuuguaaaaaca

SEQ ID NO: 68494 - RNA, 64 nt, Human
acccuggcagcgaugggucuccaggcaaguccccguccaaaaagaagaagaaguuccguacccc

SEQ ID NO: 68495 - RNA, 64 nt, Human
gcccuggucuaauccaggacauagccguggauacguccaaaaauccccagaaccuagugagccc

SEQ ID NO: 68496 - RNA, 64 nt, Human
ccccacaggcacauuaacuguugcacuuuugaauguccaaaauuuauauuuuagaaauaauaaa

SEQ ID NO: 68497 - RNA, 60 nt, Human
uuggcagacucguauuuugauccugagagaguccaaaaugcacuggucacgaaacgucua

SEQ ID NO: 68498 - RNA, 53 nt, Human
auccucaagaauuacuauaauguguccaaaauaucacugcauacaauaucugg

SEQ ID NO: 68499 - RNA, 64 nt, Human
guaguucauccuuaauccugacacccauguaaauguccaaaauguugaucuuccacugcaaauu

SEQ ID NO: 68500 - RNA, 64 nt, Human
uuauugguuuuccucacuaaucuuuuuuuuuuuaguccaaaagccaaaaauauuuaucuugguu

SEQ ID NO: 68501 - RNA, 64 nt, Human
aucugauuguuucuuuaacuuaggauccaaacauguccaaaauaaugcagaguacauaugcaau

SEQ ID NO: 68502 - RNA, 64 nt, Human
uuuaaaaaggauugagcauuauucuuggcgcacaguccaaaauacaaauuggacagaagaucua

SEQ ID NO: 68503 - RNA, 64 nt, Human
cagauuugaaaguucaauguguuugaucucaggaguccaaaauaaguuguugcuucuagugucc

SEQ ID NO: 68504 - RNA, 64 nt, Human
acauuuuagcuuuuauuguuuuuuuuuucccauuguccaaaaaguuaagcaacaaguggccaca

SEQ ID NO: 68505 - RNA, 64 nt, Human
ugaauuaugaccuguuaggcugagcucaggaauuguccaaaaaggaaaaagcaaaauaauuaau

SEQ ID NO: 68506 - RNA, 64 nt, Human
ggcuuuuuuuuucaccugaaacacuuuuucucgaguccaaaaucauuccccccgugaagucugc

SEQ ID NO: 68507 - RNA, 64 nt, Human
agaaaaaaauacuauuuaagaugugaaaauuacaguccaaaauacuguucuuuccaggcuaugu

SEQ ID NO: 68508 - RNA, 64 nt, Human
auuuauugagcagcuucuggaauauaaugugcauguccaaaaugaacucagcgcuucaaaagga

SEQ ID NO: 68509 - RNA, 64 nt, Human
cuacuguuuaauucagugacuugaucuuuuuaauguccaaaauccauuucuuauugaucuuuaa

SEQ ID NO: 68510 - RNA, 64 nt, Human
cuuacuagauucauaaugcaauuagauagaaaagguccaaaacuguacccuauguucacuccgg

SEQ ID NO: 68511 - RNA, 64 nt, Human
aauguuguccagguucuauugccaagaauguguuguccaaaaugccuguuuaguuuuuaaagau

SEQ ID NO: 68512 - RNA, 64 nt, Human
cagaccuaauuuaaauuucauuuuagcuuuacaaguccaaaaacacagaauuuauauauucaga

SEQ ID NO: 68513 - RNA, 64 nt, Human
agcuugcagcagguucuugaugaaugugcuuuguguccaaaaugccuccccauuguacacaggu

SEQ ID NO: 68514 - RNA, 64 nt, Human
uguuuaaacucaguccucccauauuuuaaaagguguccaaaauuccauacacaagggaaaguga

SEQ ID NO: 68515 - RNA, 64 nt, Human
cauagggauaguggaaugaguuuuaauagauucuguccaaaagggguuuguuccucuuauuucc

SEQ ID NO: 68516 - RNA, 59 nt, Human
gaagaaggagaaaauucugaauuucuaggguccaaaaguugacaaaaccauuaguagga

SEQ ID NO: 68517 - RNA, 64 nt, Human
cuggaaacccaaguucucuuugacuccucuuuuuguccaaaagugaucuggucggaucucacaa

SEQ ID NO: 68518 - RNA, 64 nt, Human
ucuuucaaauguuauaauugcaaaaaaucucaauguccaaaagggaaugagugaaacuaaauua

SEQ ID NO: 68519 - RNA, 64 nt, Human
gaaaaaaaaaaaaaaaaaaaaaaaaaaaguuaauguccaaaaaugacagauuuacaaguguaag

SEQ ID NO: 68520 - RNA, 64 nt, Human
gauuggcuuguguuguuauuauuaagucuaacaaguccaaaagcuggagugugaggcaggaggc

SEQ ID NO: 68521 - RNA, 64 nt, Human
agaccugcugugaugacuugccauuaaaagcauuguccaaaauccccuguuguguggacuuuga

SEQ ID NO: 68522 - RNA, 64 nt, Human
uguuuuauguucauauaggaaauauuuucauugaguccaaaauaccacuguuuuguugauggac

SEQ ID NO: 68523 - RNA, 64 nt, Human
aggcuacuggaaaaccaaacccaacagaauucacguccaaaaauccacauucuccaucgcuucu

SEQ ID NO: 68524 - RNA, 64 nt, Human
agaaaauauccaaaaagcaguauuucuagaaaguguccaaaaagcaguauuucuuucccuuggu

SEQ ID NO: 68525 - RNA, 64 nt, Human
uagaugcuuagucccucaugcaaaucaauuacugguccaaaagauugcugaaauuuuauaugcu

SEQ ID NO: 68526 - RNA, 64 nt, Human
ccugcagccgugacaacacuccugucauauuggaguccaaaacuugaauucuggguugaauuuu

SEQ ID NO: 68527 - RNA, 64 nt, Human
cugggcugaugggugcccuuuccuggcagucucaguccaaaaguguugacugugucauuagucc

SEQ ID NO: 68528 - RNA, 64 nt, Human
guaccgcugcagcuagaauccaaaucugcccuagguccaaaaaauggugucuauaucaagaucg

SEQ ID NO: 68529 - RNA, 64 nt, Human
gugaauacagaauagacauugagagguuauauauguccaaaacucaucuguccagcagucaccg

SEQ ID NO: 68530 - RNA, 64 nt, Human
ugaauuuccaagaacaacuugauaucauucagcuguccaaaaaauaauaagagcauucauuaaa

SEQ ID NO: 68531 - RNA, 64 nt, Human
ugugcugacaggaagugcucuguggcuaaaacaaguccaaaaagcacccacagagaggcaaugg

SEQ ID NO: 68532 - RNA, 64 nt, Human
aagcuauaaaagcccaugcuuaaauaaaaauuauguccaaaagccauugaaguucauuggucuu

SEQ ID NO: 68533 - RNA, 64 nt, Human
uguugaaauugcaaccauuucacaccauuguaaaguccaaaaaucagaagcugaggacugucug

SEQ ID NO: 68534 - RNA, 64 nt, Human
acaugcgcguggaguucaaguccgacaacaccguguccaaaaagggcuucaaggcccacuucuu

SEQ ID NO: 68535 - RNA, 64 nt, Human
uacuuuaauaaagaaguauuucgaggagauaucuguccaaaaagguuugacuggccuccagauu

SEQ ID NO: 68536 - RNA, 64 nt, Human
cuguauuuaaauugagcuuuaauaaauugcuucaguccaaaaauuacaggaaagguguauucuu

SEQ ID NO: 68537 - RNA, 64 nt, Human
augugaaacuuuauuugcucuuacuucaaaauuaguccaaaauguuggaaauaaaauauaagac

SEQ ID NO: 68538 - RNA, 64 nt, Human
gagacuggaacucuggaggaagacuuuugccuccguccaaaagauuccuccaaaaaaagauuua

SEQ ID NO: 68539 - RNA, 64 nt, Human
accucaccuuccuguggguguucuuuccugcccuguccaaaagcgcccucacuauucuuggacc

SEQ ID NO: 68540 - RNA, 64 nt, Human
auggauauguguguauacacauauacacaucucuguccaaaauuuccucaaagauauggggauu

SEQ ID NO: 68541 - RNA, 64 nt, Human
agaacuagcugcggauguaauuuuuuuuaaaaaaguccaaaagcagcuaugggcaguugacaaa

SEQ ID NO: 68542 - RNA, 64 nt, Human
auaacaacugcacaguguucugacacauuugaguguccaaaauagccaauuaacacaaccaaau

SEQ ID NO: 68543 - RNA, 64 nt, Human
agacaugaagaugaccagacugggcaaauuauguguccaaaacuuggccucagaugauguuucc

SEQ ID NO: 68544 - RNA, 64 nt, Human
uuggugcuuucuuuucucauuuguuaaaggcaguguccaaaagccauuccagaugccaagacca

SEQ ID NO: 68545 - RNA, 64 nt, Human
agugucaaauaggacacccaucuuaccggccaauguccaaaauuacgguuugaacauaauugga

SEQ ID NO: 68546 - RNA, 64 nt, Human
aaacacuuauuuuaaaccaaauuuuaauuucuguguccaaaauaaguuuuaaggacaucuguuc

SEQ ID NO: 68547 - RNA, 64 nt, Human
cucugaucucuuagcacauuucuuaggauuaaggguccaaaaaugcugaucuaagggguugcca

SEQ ID NO: 68548 - RNA, 64 nt, Human
acaagcaccugaggaguccggccggggcacugugguccaaaagguccugccgccuccgcaucug

SEQ ID NO: 68549 - RNA, 64 nt, Human
gaaaccagaugaagaugaaugcaggaagaauuguguccaaaaugcaaccuucagaguguaucaa

SEQ ID NO: 68550 - RNA, 64 nt, Human
cuccgccuguuuuuuaaacuuuuccaccaccugcguccaaaaagaauguuauagcgagugcucu

SEQ ID NO: 68551 - RNA, 64 nt, Human
aaugauguuggagaagggaaguugaacgagcauaguccaaaaagcuccuggggcguccaggccg

SEQ ID NO: 68552 - RNA, 64 nt, Human
agcugauuuuucuuucuugcuuucauuuuaauuaguccaaaauuaaguuuuaaagauuuuuccu

SEQ ID NO: 68553 - RNA, 64 nt, Human
uagaagaaaaaucuccgaagagcucucucuagaaguccaaaauggcuagccauuaugcuucuuu

SEQ ID NO: 68554 - RNA, 64 nt, Human
uaaccucuggccucaacggaauuuacaguucagaguccaaaauagcaaggaaguggugggaaga

SEQ ID NO: 68555 - RNA, 64 nt, Human
guucagguaauuuacuugacuguucuauuuguuuguccaaaagauaaaaugaugagagagauuc

SEQ ID NO: 68556 - RNA, 64 nt, Human
agucaaguacaauucagacaaacugcuuucuccuguccaaaagcaaaaaggcaaaggaaagaaa

SEQ ID NO: 68557 - RNA, 64 nt, Human
gaaagaaagaaacaaacaaaauauauauauauauguccaaaaacagacaaauccaaggguguga

SEQ ID NO: 68558 - RNA, 64 nt, Human
caucugauagucuagcagguaauuaaacuuauauguccaaaaccauauucuucccugucucuuc

SEQ ID NO: 68559 - RNA, 64 nt, Human
uugggaguauuaaaaauugggucuaugacauauuguccaaaaggaaugcuguucuuaaagcauu

SEQ ID NO: 68560 - RNA, 64 nt, Human
uggccaacacaaaaggguaacagggcccaugcaaguccaaaauucagcagggcagucaaauuuu

SEQ ID NO: 68561 - RNA, 64 nt, Human
gugucaagucugcccauggcccacccuccccacaguccaaaaccacacagcccugguucuccag

SEQ ID NO: 68562 - RNA, 64 nt, Human
uuucauggauagggagagcuccucucggugaacaguccaaaacuaaaauagauguuuauauaga

SEQ ID NO: 68563 - RNA, 64 nt, Human
accucagcccccuacugagaaguuaauuaauucaguccaaaaugaaauuauagggcaguuuggu

SEQ ID NO: 68564 - RNA, 64 nt, Human
ucggagccugugacauuuguugacacugugaacuguccaaaagucucuuaacugcaccuuguga

SEQ ID NO: 68565 - RNA, 64 nt, Human
uuuugguuuuguguaucuguacucucugcagaugguccaaaauuguaauggagucuguauuaga

SEQ ID NO: 68566 - RNA, 64 nt, Human
uuucuaccuugccuuauuuuuaauuggauucacuguccaaaaugcagagguuugcuuugcuuuu

SEQ ID NO: 68567 - RNA, 64 nt, Human
gauagugaagucauauuuacaaaacugagaacauguccaaaauggauucuugucuccucuucag

SEQ ID NO: 68568 - RNA, 64 nt, Human
acauugauaauaaaaucgcuacuuuaagggguuuguccaaaauaaauauuguggccuuauauau

SEQ ID NO: 68569 - RNA, 64 nt, Human
uaucuacaccacccaaaguuaggccuccuauaauguccaaaacauuccuuucagccuuuuuauu

SEQ ID NO: 68570 - RNA, 64 nt, Human
cagauaccacuugcuguaggcuacggaccaagauguccaaaauuauucuugagcacugauauaa

SEQ ID NO: 68571 - RNA, 64 nt, Human
cuccuugacuuacaucucaauaaacccaucguaaguccaaaauauuggaaguugaaaaugcauu

SEQ ID NO: 68572 - RNA, 64 nt, Human
guuaagcagacagacaauugaaaauacugggcagguccaaaaggauaguuccaggccauaggaa

SEQ ID NO: 68573 - RNA, 64 nt, Human
acuaagagacuuaagaggucgugguuccuauaucguccaaaaaauaggcuguuacauauccuaa

SEQ ID NO: 68574 - RNA, 64 nt, Human
uuuaauaagaaauuucaaauauucucuuaucccgguccaaaaggauuaagcgauuaaagaacgu

SEQ ID NO: 68575 - RNA, 64 nt, Human
gaaagaaaaacuggcuaugcauuaccuaaaaccaguccaaaaugaaacagaccaacacacacac

SEQ ID NO: 68576 - RNA, 64 nt, Human
uucuaccacguguaggauaaucauucauugguguguccaaaaauggggucugcuccugcuaccu

SEQ ID NO: 68577 - RNA, 64 nt, Human
ccagagucuucaggacagacuccgcaugggacuuguccaaaaaaacucuaaucaaaagaggaaa

SEQ ID NO: 68578 - RNA, 64 nt, Human
uuuccugucuuccuugaccaaagcucucuuugagguccaaaaaaggcugcccugggccauaugu

SEQ ID NO: 68579 - RNA, 64 nt, Human
uugcuuuaaaaugcauaucuuuaauuggguguugguccaaaauuaaaauuuuugcugucuguuu

SEQ ID NO: 68580 - RNA, 64 nt, Human
uauuagagaugaaaaacguuagcaguugauuuuuguccaaaagcaagucauggcuagaguaucc

SEQ ID NO: 68581 - RNA, 64 nt, Human
acugcccuuccagaaacugugcuaaaaagagaaaguccaaaagacucuaaacaaaaaccucgac

SEQ ID NO: 68582 - RNA, 64 nt, Human
uagaacauucacagcaaagaagaauccugugaauguccaaaagccuuccagaagucaagucucu

SEQ ID NO: 68583 - RNA, 64 nt, Human
cugauuuguuuaucaccuuagcagaaaaaccacaguccaaaagacaagcaaauuaagaauggag

SEQ ID NO: 68584 - RNA, 64 nt, Human
ggggaaaaccuauggaaccuacugcaaaaagauuguccaaaaugccuaagaaaauacuccucug

SEQ ID NO: 68585 - RNA, 64 nt, Human
agcuacaaaacaauucaauugcuuuuuuuuuuugguccaaaauaaaaccucagcuagcucugcc

SEQ ID NO: 68586 - RNA, 64 nt, Human
gguuuuuggguuuuuucuuuccugaauuguauuaguccaaaagaacuaaauuaggguacuugug

SEQ ID NO: 68587 - RNA, 64 nt, Human
aguugucugcaacauuuuuguuuucuuuuuuaauguccaaaagugggggaaagugcuauuuccu

SEQ ID NO: 68588 - RNA, 64 nt, Human
ugcuucuguuuauuaaaaaaagaaaccuuccaauguccaaaacugcuaacccucgacguggccg

SEQ ID NO: 68589 - RNA, 64 nt, Human
uaacacuggcauguucaaagccacauuauuucuaguccaaaauuacaaguaaucaagggucauu

SEQ ID NO: 68590 - RNA, 64 nt, Human
aacacccuuccuuguccuggaguauggacuguccguccaaaagugagccuaugcuauaaguuua

SEQ ID NO: 68591 - RNA, 64 nt, Human
cuguauuuuuaaaaaguugccuucuccaguggcaguccaaaagcagaaaugagaggaaauuauu

SEQ ID NO: 68592 - RNA, 64 nt, Human
gcagaaaucacaauuuuccuguggaauaaagaugguccaaaaauagucaaaaauuaaauauaua

SEQ ID NO: 68593 - RNA, 64 nt, Human
uucuuuucagaguuguccagcccuuuuuuccuuuguccaaaaugauucuaaauagaaucuaaua

SEQ ID NO: 68594 - RNA, 64 nt, Human
augccacuuuggauuuuucuacaaaggcagugguguccaaaauaaaaucucugcccuaaauuuu

SEQ ID NO: 68595 - RNA, 64 nt, Human
cuggcaguagggaugaaggcuaguuccagccccaguccaaaauaguucauagggcuagggagaa

SEQ ID NO: 68596 - RNA, 64 nt, Human
auuagauggaagaugauguugaacagcuguuaacguccaaaaaacuuucagaaaaagcuguguu

SEQ ID NO: 68597 - RNA, 64 nt, Human
cacaugcccuacucuccacuaauuauacuuaaaaguccaaaaauuuuuucuuuaguaacagacu

SEQ ID NO: 68598 - RNA, 64 nt, Human
uuggauuuuuuucugagguacagcauuaauacuaguccaaaaaaugucauaaacugaacuaaaa

SEQ ID NO: 68599 - RNA, 64 nt, Human
gggugaaauacuugcaauaccaggucacucugugguccaaaaggucacauucaguugucaucag

SEQ ID NO: 68600 - RNA, 64 nt, Human
cacacugagacaugugccuuaaacagacuuuuuaguccaaaauuacauagcauugaagaauaua

SEQ ID NO: 68601 - RNA, 64 nt, Human
ggauuacaggugugagccaccacgccuggccccaguccaaaauauuuaaagauuguuuccuuag

SEQ ID NO: 68602 - RNA, 64 nt, Human
aacugcuuguucagguaucgugaugggccacucgguccaaaaucagccaggccaucuuuuccau

SEQ ID NO: 68603 - RNA, 64 nt, Human
gaagcaacaugaauuagggggccucuuggccuugguccaaaauugucaaucagaaaugaacaua

SEQ ID NO: 68604 - RNA, 64 nt, Human
ggccaccugggucacuggaggaccaaccccugcuguccaaaacaccacugcuuccuacccaggu

SEQ ID NO: 68605 - RNA, 64 nt, Human
uggggagucugagaaagccuggcuuguauuaucuguccaaaaggaagccucuucaucucccggu

SEQ ID NO: 68606 - RNA, 64 nt, Human
caauggcucugcuggaaauuucuauaaauaaaauguccaaaauggugacugcguuuaacuuuca

SEQ ID NO: 68607 - RNA, 64 nt, Human
ugguuaguccagcucuuuacucuaaacccuuucuguccaaaaugagucauuuucaguuguaccu

SEQ ID NO: 68608 - RNA, 64 nt, Human
uuuuuuuucccaucacucuuuacaugguggugauguccaaaagauacccaaauuuuaauauucc

SEQ ID NO: 68609 - RNA, 64 nt, Human
guccuuuguaagaagucaggaaaucugaugcuguguccaaaauuaugcacuguuuguugaagua

SEQ ID NO: 68610 - RNA, 64 nt, Human
caauuagauggcaaaggagaggacaccgccagugguccaaaaaggcugcucucuuccaccuggc

SEQ ID NO: 68611 - RNA, 64 nt, Human
gggccacugaggaaggaaauguucauuuucauuuguccaaaaccaccuuaaguuuuaaguauau

SEQ ID NO: 68612 - RNA, 64 nt, Human
uguugguuuucugacuuacaauugaaagaguucuguccaaaaagccaaaagguggccaggcuug

SEQ ID NO: 68613 - RNA, 64 nt, Human
cucuuguuaaaugagcuuaaugucuuuguguuuuguccaaaacuguauugaaaaaauauuguuu

SEQ ID NO: 68614 - RNA, 64 nt, Human
uagaagggaaagcccauaugcuaccaccagcuguguccaaaaccgccagcucuguucuuccuca

SEQ ID NO: 68615 - RNA, 64 nt, Human
ucucaguuaaguauaaaaguuuuuccacuacuuaguccaaaaaaaacuauuaaaucuuaaugaa

SEQ ID NO: 68616 - RNA, 64 nt, Human
uuagaaaaccaaaguguggguagaaaccccaaauguccaaaagcccuuuucuggugggugaccc

SEQ ID NO: 68617 - RNA, 64 nt, Human
aaggguaugagacacggcuagggguaaacucuuaguccaaaacccaagcaugcaauaaauaaaa

SEQ ID NO: 68618 - RNA, 64 nt, Human
uucucugcccacucuggguccuuaaagaaacaaaguccaaaagucacuuuugaaugugaacaaa

SEQ ID NO: 68619 - RNA, 64 nt, Human
aaauuuacaaauaaacuuguuuauccaacuaaguguccaaaaccuaaauugaauguacuaaguu

SEQ ID NO: 68620 - RNA, 64 nt, Human
aauaccacaauuccugcugaaaaacacucuuccaguccaaaagcuucuugauacagaaaaaaga

SEQ ID NO: 68621 - RNA, 64 nt, Human
aauuauguauuucaauaguucuucuauuuuuaguguccaaaauuuacuaauacagaagcuugac

SEQ ID NO: 68622 - RNA, 64 nt, Human
ugagagagauuuuuuaaaaaagauuuugcauuuuguccaaaaucaugugcuucuucugaucaau

SEQ ID NO: 68623 - RNA, 64 nt, Human
ccucuacuuuauuagaauuggaaggcaaauuuuuguccaaaaaccuacagacaaguacuuugag

SEQ ID NO: 68624 - RNA, 64 nt, Human
ugcaguugggauuuuucauuucucuuguaccaauguccaaaacaagaaagaaugcaaugcuuuu

SEQ ID NO: 68625 - RNA, 64 nt, Human
gucaggauggcuugaccugcagaagauacccaagguccaaaagcacaaggucugcggaaaguuc

SEQ ID NO: 68626 - RNA, 64 nt, Human
uauuugacagaaagauagaaagcuuaaccacauuguccaaaaagaaauugcauuucaagcagug

SEQ ID NO: 68627 - RNA, 64 nt, Human
uuuucuuccagaaaaauucuccuugaggaaaaauguccaaaauaagaugaaucacuuaauaccg

SEQ ID NO: 68628 - RNA, 64 nt, Human
uauuucuuuuuuuuggaaaugaaacaaauaugcaguccaaaauucaggaacuacuagagugaaa

SEQ ID NO: 68629 - RNA, 64 nt, Human
aucaaagaauauuauuaaauuuaacauagucuauguccaaaaggcuuaguugcuucuuaugcag

SEQ ID NO: 68630 - RNA, 64 nt, Human
ccuucaccuguguccucccugugugggugcugguguccaaaauuuccccuuuucguagugacac

SEQ ID NO: 68631 - RNA, 64 nt, Human
uuuuuggaauuuauccacuucuuuugguuccccaguccaaaacacagucauuucaccuggacua

SEQ ID NO: 68632 - RNA, 64 nt, Human
aaaaaugaagcugaaacuuaaaguggcgguguuuguccaaaauaacggggcuccugcucugcca

SEQ ID NO: 68633 - RNA, 64 nt, Human
gugccaauaggaaaaagcuaccuagacuaggcauguccaaaauggcggcuccaaguucccuucu

SEQ ID NO: 68634 - RNA, 64 nt, Human
auuaggaggacaucauaaccuaugaaugauggaaguccaaaaugaugguaacugacaguagugu

SEQ ID NO: 68635 - RNA, 64 nt, Human
ucauucuuccucaaaguauuuaccaucagcuacaguccaaaauugcuuuuuguucaaggagauu

SEQ ID NO: 68636 - RNA, 64 nt, Human
ugauucuuccucaaaguauuuaaaaucagcuacaguccaaaauugcuuuuucuucaaggagauu

SEQ ID NO: 68637 - RNA, 64 nt, Human
ugauucuuccucaaacuacuuacaaucaccuacaguccaaaauugcuuuuucuucaaggagauu

SEQ ID NO: 68638 - RNA, 51 nt, Human
agcuguucccaugggaauaacguccaaaacacucuggaucuuauauggaga

SEQ ID NO: 68639 - RNA, 64 nt, Human
aaaucacaucagcacuggaaaauaacuccuaaauguccaaaaagaacaugagauuuauggugcu

SEQ ID NO: 68640 - RNA, 64 nt, Human
ucuuaauauugacagcuuccccguucuauuuaauguccaaaaauguuucccaaaauuucaaacu

SEQ ID NO: 68641 - RNA, 64 nt, Human
caggucaauaaacuuagaggaaaaugaguauuugguccaaaaaaaggaaaaauaaucaagauuu

SEQ ID NO: 68642 - RNA, 64 nt, Human
gagcaagauaugcauuaaucaccgguuuuauacuguccaaaaugaagcauccccgugacaaacc

SEQ ID NO: 68643 - RNA, 64 nt, Human
uuuuucuguuacaguuuugcuaauuuaucagaagguccaaaagucugacauaacuauuucauuu

SEQ ID NO: 68644 - RNA, 64 nt, Human
caaaccaauaaaaauaccaucugaggguguuacuguccaaaaguaaagaauaagaugcaucacu

SEQ ID NO: 68645 - RNA, 64 nt, Human
uugacuggccauccaauuaccauuuuuucuuucaguccaaaauaguuagacccuugcauacaga

SEQ ID NO: 68646 - RNA, 64 nt, Human
uauuucaaaaauagguauuagagcacuaucagugguccaaaauuaguuuuagcuacuuauuuug

SEQ ID NO: 68647 - RNA, 64 nt, Human
uugaguucuaguuaaaucuuaaccauguucuuaaguccaaaauaggaagaaguggaguaguuug

SEQ ID NO: 68648 - RNA, 64 nt, Human
uucagggcaccuuuccucagugagcuuugauaugguccaaaaacagccuuaaaucaagaauauu

SEQ ID NO: 68649 - RNA, 64 nt, Human
cguguugaaccuuccaaaacaaaaauaaagaccuguccaaaaguuuugacaaaaauacugauug

SEQ ID NO: 68650 - RNA, 64 nt, Human
ggacucugugaaguuuagaguacaguuuguugggguccaaaagacaccaucucuaccccaccca

SEQ ID NO: 68651 - RNA, 64 nt, Human
uguuuguaacuuaugaacacacgugaaguguugaguccaaaagacaaaggggcaucggcauguc

SEQ ID NO: 68652 - RNA, 64 nt, Human
uaccaaaagucucaacccauuauaucaauccuaaguccaaaauuucauucaaauaucaucgguu

SEQ ID NO: 68653 - RNA, 64 nt, Human
cugcauuccagccugggugacagagugagacccuguccaaaaaaaaaaaaaaaaaaaaagaagg

SEQ ID NO: 68654 - RNA, 64 nt, Human
cuaugaaaaacugauuuguuaaaacaugcuacauguccaaaaauaaagaccagaaugacauuuu

SEQ ID NO: 68655 - RNA, 64 nt, Human
uucuuuucuuacaucucuauaugaagauaccuguguccaaaauuuuugaagauauauauuguau

SEQ ID NO: 68656 - RNA, 64 nt, Human
auauggaugcauuuauucacaagcaaccccaaaaguccaaaaauguaauaauuuugacaaggcc

SEQ ID NO: 68657 - RNA, 64 nt, Human
guuacuuguaaugucaaguuuaucuguuaaauauguccaaaaggcaaaaucauuuuuguugcau

SEQ ID NO: 68658 - RNA, 64 nt, Human
gguauccaguuucugaaugugcaaaaugguuaacguccaaaacgcuuaacgucuuuuuuuaaag

SEQ ID NO: 68659 - RNA, 64 nt, Human
auuuuggagggagcaggggaugaggcuuggcauaguccaaaauuuaagucuccaauaauuaauu

SEQ ID NO: 68660 - RNA, 64 nt, Human
gucagguuucauguaaccgaguguccucuugcguguccaaaaguagcccagggcuguagcacag

SEQ ID NO: 68661 - RNA, 64 nt, Human
ugucucucucuaccugucccuuuuucucuaacauguccaaaagugcuguuuuuccauagauguu

SEQ ID NO: 68662 - RNA, 63 nt, Human
uucuacuggccaaguucaagugaguaagccgcgucccccaacuacagcuggagacggggccag

SEQ ID NO: 68663 - RNA, 63 nt, Human
cccaaugcuaacuccuuggauugucaacccccaucccccaaauggaaauuccgaaggaggccu

SEQ ID NO: 68664 - RNA, 63 nt, Human
ugacuugcucugcguggggagguggggucucauucccccaacuuccucagggaggaccccugc

SEQ ID NO: 68665 - RNA, 63 nt, Human
ggccuuuaaggacugcugaugcccccucaggccucccccaaguuugcugggcuuugguggaag

SEQ ID NO: 68666 - RNA, 63 nt, Human
uggcuaaccccucuuccuauuaccuugaucucuucccccaacuuccuaacacuuauuaauuua

SEQ ID NO: 68667 - RNA, 63 nt, Human
guagggaacacucagacauucugugcauguuguucccccaaagcauggucaucacaaaguccu

SEQ ID NO: 68668 - RNA, 63 nt, Human
cacagcccugccccuccaguuccuuggcaguucucccccaaaccaggucuguacagguguucu

SEQ ID NO: 68669 - RNA, 63 nt, Human
ucccugucauuccuaaccuaaccuuagagucccucccccaaugcaggccacuucuccucccuc

SEQ ID NO: 68670 - RNA, 63 nt, Human
uuaaacguugaggagaaaaaaaaaaaaggcuuuucccccaaaguaucaugugugaaccuacaa

SEQ ID NO: 68671 - RNA, 63 nt, Human
uacagugccauuccaagucccagaugucccucuucccccaaacuugaccuugaccaugucacu

SEQ ID NO: 68672 - RNA, 63 nt, Human
cacccguuccuaccuggugccuugggcgccccaucccccaacagaacucccgggccccaaucc

SEQ ID NO: 68673 - RNA, 63 nt, Human
cuuacccacccaccagccccaaggcccgaccccucccccaaaggggcaguccccuucuugcag

SEQ ID NO: 68674 - RNA, 63 nt, Human
gcugccccacagguguguuucccaucccacugcucccccaacacaaacccccacuccagcucc

SEQ ID NO: 68675 - RNA, 63 nt, Human
uguccugcauggggcagaggcuuccguguccucucccccaacccccugcaagaagcgccgacu

SEQ ID NO: 68676 - RNA, 63 nt, Human
gguccccuccuuuaccccugaguuccuuacuguucccccaagccugggagcagucuauccccc

SEQ ID NO: 68677 - RNA, 63 nt, Human
ccuuacuguucccccaagccugggagcagucuaucccccaacccugccaucucccuuacucau

SEQ ID NO: 68678 - RNA, 63 nt, Human
gacugaguucccuggauuauggaaacuucgcugucccccaacacugagcaaguaugcugugga

SEQ ID NO: 68679 - RNA, 63 nt, Human
cuucugucuuggaguucagaggcccaaaacuucucccccaaagccaagccauuuaaugaccuc

SEQ ID NO: 68680 - RNA, 63 nt, Human
gagucccauuugccuugcaauuagcauucugucucccccaaaaaagaaugugcuaugaagcuu

SEQ ID NO: 68681 - RNA, 63 nt, Human
guauuggggcagaggcuccccaaauuggggugaucccccaaggagugauacauauauugugua

SEQ ID NO: 68682 - RNA, 63 nt, Human
cuuggcacccgguuguuacccccuggcagcuucucccccaaacucuccuaccauguggcccug

SEQ ID NO: 68683 - RNA, 63 nt, Human
cccuuucccacacccacuucucuccuaucaccuucccccaagauuaccugaacaggguccaug

SEQ ID NO: 68684 - RNA, 63 nt, Human
ugauucaccuuucugauccuuuucaaccaguuuucccccaaggggggaaauuuuacuuaaccu

SEQ ID NO: 68685 - RNA, 63 nt, Human
ucaaugguuaucaccuucaauaguuucaauaugucccccaaaguuauguguuugaaacuugca

SEQ ID NO: 68686 - RNA, 63 nt, Human
auccuuuagauauuuuguaugcaaagauggcucucccccaaaucccaguuuuucagcucagga

SEQ ID NO: 68687 - RNA, 63 nt, Human
cccucaccgucuuggugaccuggccucggccccucccccaagucucuucugugcaaggcccgc

SEQ ID NO: 68688 - RNA, 63 nt, Human
agcaagaacaccauccuacauaauacccaggauucccccaacacacguucuuuucuaaaugcc

SEQ ID NO: 68689 - RNA, 63 nt, Human
gaggaguauuaagaaugcagauuccugggccugucccccaagguuuuggagucaguaggucca

SEQ ID NO: 68690 - RNA, 63 nt, Human
uggccuagaguggcaaauggaacuucucugaucucccccaacuagacuggagcccccgaagga

SEQ ID NO: 68691 - RNA, 51 nt, Human
aggcaccuccuggugucuaacucccccaaagacaaugaguuaagggagaga

SEQ ID NO: 68692 - RNA, 63 nt, Human
uguccccccuggguccagccaagcugugccccaucccccaagccuccugggaggauccagcca

SEQ ID NO: 68693 - RNA, 63 nt, Human
auuguuucuggaaggggcuggccugaguuucuuucccccaaaugucugugcagugucagggcu

SEQ ID NO: 68694 - RNA, 63 nt, Human
gaaacccuucuguacucguugguaaauaucuacucccccaagugacuccaggugccccccacc

SEQ ID NO: 68695 - RNA, 63 nt, Human
uuggaucguguccucucccccucgccgcccucuucccccaaucugagccauugcaggccucug

SEQ ID NO: 68696 - RNA, 63 nt, Human
ucauuuguguuuuuuaauuaaggauuuagaaguucccccaauuacaaacugguuuuaaauauu

SEQ ID NO: 68697 - RNA, 63 nt, Human
cuagucuuugaaaagcaguuugugcuauacuuuucccccaacccuccaauaaaucuuaaauuu

SEQ ID NO: 68698 - RNA, 63 nt, Human
uggucugaguuguuuguuuggacuucccugucuucccccaaagaguugaaaucuuaaaucuau

SEQ ID NO: 68699 - RNA, 63 nt, Human
ugaucucuccucaccaugcccuuccugcauccuucccccaaccacccaccagaggaguucugg

SEQ ID NO: 68700 - RNA, 63 nt, Human
cauuuucugacagacacacagaccugccuuuucucccccaaguauaccguacccuccugugag

SEQ ID NO: 68701 - RNA, 63 nt, Human
auuccugggcucccagccuuaaaacucacugccucccccaagggcccccucuaaggagggugu

SEQ ID NO: 68702 - RNA, 63 nt, Human
acaggccuucuguacccagcguuuguacuugccucccccaacagugggccuguucuacccgug

SEQ ID NO: 68703 - RNA, 63 nt, Human
ccucuucuauguuaccuauucuguccguugagaucccccaacuugggccaaagccaagagauc

SEQ ID NO: 68704 - RNA, 63 nt, Human
aucucauucucgccccuccagaagaagcaguugucccccaaauacucugcucccucacugcug

SEQ ID NO: 68705 - RNA, 63 nt, Human
auccuugaauccuuuaucccuuuccucuuucauucccccaacuucugucgcaugcagugccug

SEQ ID NO: 68706 - RNA, 63 nt, Human
ugcuaggcaaggucuggccaggccccccuuuuuucccccaagugaagaggcagaaaccuaaga

SEQ ID NO: 68707 - RNA, 63 nt, Human
cccacacuugacacaguuccuggaguacccucuucccccaaccccagaccugcuuucagagca

SEQ ID NO: 68708 - RNA, 63 nt, Human
aaggaauccccagaaguggucccuaugaugaacucccccaaagcaacgccguuuuuggaggaa

SEQ ID NO: 68709 - RNA, 63 nt, Human
ugggguggaaggggggucuggggcagccucucuucccccaacauacucacuagaguggcuccu

SEQ ID NO: 68710 - RNA, 63 nt, Human
caauuuuguaccuuuguggagaaaugugucaccucccccaacccgauucacucuuuucuccug

SEQ ID NO: 68711 - RNA, 63 nt, Human
ggcaccuguguuaagagcaugaugguuaggaaaucccccaagucaugucaacucucauuaaag

SEQ ID NO: 68712 - RNA, 63 nt, Human
caucaauguuccugccugacaacuccccagcuaucccccaaccccaggcucggacuguggugc

SEQ ID NO: 68713 - RNA, 63 nt, Human
ccugccgacuccuggguugagcuguugccucagucccccaacagaugcuuuucugucucugcc

SEQ ID NO: 68714 - RNA, 63 nt, Human
uauaugaggaauuaaaaccuucaaaucucuauuucccccaaauacugacccauucuggacuuu

SEQ ID NO: 68715 - RNA, 63 nt, Human
ggaaucuacaaggcaaacucccauauauuugcuucccccaaauugcugccccuacagacucaa

SEQ ID NO: 68716 - RNA, 63 nt, Human
ggaacacaucccugccuccgggaaguguggcucucccccaacccuccccaccguccccccuuc

SEQ ID NO: 68717 - RNA, 63 nt, Human
uuuuuuucuuuuugagacggaguuucgcuuuugucccccaagcuggaguacaaugacaggauc

SEQ ID NO: 68718 - RNA, 63 nt, Human
ucagcuucccagccaugcccaggacguccuaucucccccaacccaccucuggcccuguguagg

SEQ ID NO: 68719 - RNA, 63 nt, Human
gggccgcccaugcagacuuuuggccuggcgcgaucccccaagaaccccuccagggccggccug

SEQ ID NO: 68720 - RNA, 63 nt, Human
ucuucugaaacacaccaacccauauuccucugcucccccaaagcuguuucugauccugcuggg

SEQ ID NO: 68721 - RNA, 63 nt, Human
cucugagaucaccccacuuccaucauuuccuucucccccaacccaacgcuuuuuuggaucagc

SEQ ID NO: 68722 - RNA, 63 nt, Human
gggcagauggcagggcugaggaugggcucugcaucccccaaagccaucccuucccuacuuccc

SEQ ID NO: 68723 - RNA, 63 nt, Human
aauaggaacuuaguguuacucaccuuuauccauucccccaacacucaacaaauugccuuugcu

SEQ ID NO: 68724 - RNA, 63 nt, Human
aauuaucacucuuuuaccuucauauaaaaugucucccccaaaccuuuuucccuucuuugucau

SEQ ID NO: 68725 - RNA, 63 nt, Human
agucagacaugauccuccagauugacagacaagucccccaaaugaguacacaucuccagcuau

SEQ ID NO: 68726 - RNA, 63 nt, Human
acauuugauguuuuuacuuaugaaauauucuccucccccaagaaaauuuaaacuuuuucucuc

SEQ ID NO: 68727 - RNA, 63 nt, Human
aaauuuauuuuaacuugacaguauguuuuuaguucccccaauuuaauuaauggaccaugugca

SEQ ID NO: 68728 - RNA, 63 nt, Human
auauagcacccacagagcuccaaguaaccaaauucccccaaagacaggagguguggcugaugg

SEQ ID NO: 68729 - RNA, 63 nt, Human
ucaauauuacaaccucuucuucucuuaaccuccucccccaaacacuagagguuuaauaagacu

SEQ ID NO: 68730 - RNA, 63 nt, Human
ccucuucugucuccucucaaaguccggcuggcgucccccaagcccugagaugcucugucaccu

SEQ ID NO: 68731 - RNA, 63 nt, Human
cacuauucaaaaccaaucaugccuuccuaacagucccccaaagucuuaacucuuuucagcauu

SEQ ID NO: 68732 - RNA, 63 nt, Human
ggacaagacugguugcuagcacauacuuuauuaucccccaaggauggucagccauuucuuccc

SEQ ID NO: 68733 - RNA, 63 nt, Human
ucagcuuugggggccccagggaauuggaacucuucccccaagacagagcaggggugaacugua

SEQ ID NO: 68734 - RNA, 63 nt, Human
gaugggugggugguaaaaagggaaggaugaggcucccccaaugucacauuaaauucaugguuu

SEQ ID NO: 68735 - RNA, 63 nt, Human
aggacucacccuggaagagaauauucgcuuaauucccccaaccugaccaccucauucuuaucu

SEQ ID NO: 68736 - RNA, 63 nt, Human
agugucuuauauguaauccuguagguugguacuucccccaaacugauuauagguaacaguuua

SEQ ID NO: 68737 - RNA, 63 nt, Human
uaaaugcagaugugugauaaagcauuuagucagucccccaaacagucaugccaacugugaagg

SEQ ID NO: 68738 - RNA, 63 nt, Human
uuagguauaucuccuaaugcuaucccuccccccucccccaacccacaacaguccccguugugu

SEQ ID NO: 68739 - RNA, 63 nt, Human
ccauucacccacaaaaugcagcccaccacccagucccccaauuccagagagaaacacaucacu

SEQ ID NO: 68740 - RNA, 63 nt, Human
gggccguggcauggccacaccccaccccacuucucccccaaaaccagagccaccugccagccu

SEQ ID NO: 68741 - RNA, 63 nt, Human
uguaauaacaaaggcaguccgcauucuucccuuucccccaaauuccuagggcaaaacuuuuuu

SEQ ID NO: 68742 - RNA, 63 nt, Human
uuguaaaaagcuucauucucacucugcuuugcaucccccaaacuucuuguucaaaacgggggg

SEQ ID NO: 68743 - RNA, 63 nt, Human
ugcugagggaggggagugagucacaggagccugucccccaacaggugugacugcucugacaac

SEQ ID NO: 68744 - RNA, 63 nt, Human
ggacaccaagcagaauucugcauggugacagucucccccaaacauggccugcugggcccaagu

SEQ ID NO: 68745 - RNA, 63 nt, Human
aaacaguggaauccuaaauuuaugacuaaaaauucccccaaaagaugaaagaucuacaauguu

SEQ ID NO: 68746 - RNA, 63 nt, Human
agaaggaacaaguguggcuguguccaucucugcucccccaaaggcccgcucuaggccuuaucc

SEQ ID NO: 68747 - RNA, 63 nt, Human
aguccaaauguuuacagggagccuccugcccagucccccaaccccagccgcucggaggcccca

SEQ ID NO: 68748 - RNA, 63 nt, Human
cacugggcccaacauauccauuuuuaaacccuuucccccaaauacacugcguccugguuccug

SEQ ID NO: 68749 - RNA, 63 nt, Human
cagccugcauucugcacacagcaucugcucccaucccccaagucugacgcagccaccacucuc

SEQ ID NO: 68750 - RNA, 63 nt, Human
caagacuggacuugaacuccugggcucaagccaucccccaaccuuggccucucgaguagaugg

SEQ ID NO: 68751 - RNA, 63 nt, Human
uuuccuggcuaugguggggugggaaccucaguuucccccaaagucuucccuggaugcuggcuu

SEQ ID NO: 68752 - RNA, 63 nt, Human
ugaauaaaacauucucaacuccucuugaaucuaucccccaagaaaccaucuuaucccuguaau

SEQ ID NO: 68753 - RNA, 63 nt, Human
uugccauugaauagcucuagcaacuauuauuauucccccaaacccuaaaauucuaccuauuag

SEQ ID NO: 68754 - RNA, 63 nt, Human
aggccugaaacauuucuuuucuuucuuuuuuccucccccaauuuacccugggccuggagcagc

SEQ ID NO: 68755 - RNA, 63 nt, Human
agugggaggguugguugccccucaccucagagcucccccaaaggccaguaauggauccccggc

SEQ ID NO: 68756 - RNA, 63 nt, Human
caccauguaggccaccacuccaggccguggacuucccccaacuuggggacagccuuauuccca

SEQ ID NO: 68757 - RNA, 63 nt, Human
ccauugaauuugccuuccucaugaauuaaaaccucccccaagcagagcuuccucagagaaagu

SEQ ID NO: 68758 - RNA, 63 nt, Human
ucuuaaugccucucuggcauuucagagccagcaucccccaacucccaccccucugccaucacc

SEQ ID NO: 68759 - RNA, 63 nt, Human
aggaucagaagggaccuuggcacagcgaccucaucccccaaguggacacgguuugccugcuaa

SEQ ID NO: 68760 - RNA, 63 nt, Human
ugagcaagucaggcuccuggcucuggguguggcucccccaaacgaaguacugacuucagccug

SEQ ID NO: 68761 - RNA, 63 nt, Human
guacgugaggggucugagaggagugggugcuugucccccaaaccugcaugaagcaagaacaac

SEQ ID NO: 68762 - RNA, 63 nt, Human
gcacagcucuucacaccauucauucuggucauuucccccaaaggcaucccagccugggggcca

SEQ ID NO: 68763 - RNA, 63 nt, Human
ggugccuuggucucuccacaaucaaauggaggaucccccaagcagcuucauuacagagugaua

SEQ ID NO: 68764 - RNA, 63 nt, Human
ccucccuuaugcucuguauacaacacuucuccaucccccaacuggugucuuaccccaaaucag

SEQ ID NO: 68765 - RNA, 63 nt, Human
uuuaaggcaaagaaaggcuguuaauucccucccucccccaaacacaugauuuuuaauauucua

SEQ ID NO: 68766 - RNA, 63 nt, Human
gggaggggccccggguccucucagucuuuccccucccccaacgauguagcguuuuucguuguu

SEQ ID NO: 68767 - RNA, 63 nt, Human
auccaccaguuuuucuaagcuagaaccuuugagucccccaaacugccugaagacuuaaguuuu

SEQ ID NO: 68768 - RNA, 63 nt, Human
aaccuugacgaggauacaaaagugaaagcaucaucccccaaaggaucacugcacaguccuacu

SEQ ID NO: 68769 - RNA, 63 nt, Human
cuguuugucuuucuacuguuucauccccuaacuucccccaacccucaaauuaaaacuagaacu

SEQ ID NO: 68770 - RNA, 63 nt, Human
uuucauguaucuaucaaagcccaguucaccuccucccccaaacacacacacacacacacacac

SEQ ID NO: 68771 - RNA, 63 nt, Human
acggaacaacucuuacuuuuaaaaauuacuuguucccccaaauuguugagugccgccguuugg

SEQ ID NO: 68772 - RNA, 63 nt, Human
guugaugagggacuuucccugcuccaccgucacucccccaacucugcccgccucuguccccgc

SEQ ID NO: 68773 - RNA, 63 nt, Human
accaccagccacaccauuauaccagaaggcggaucccccaagaccacagugagagcuuuuucc

SEQ ID NO: 68774 - RNA, 63 nt, Human
uuauuauugaaaauaaaaucuugaucucaacuaucccccaaaugcauccuauaaguccauccu

SEQ ID NO: 68775 - RNA, 63 nt, Human
ugaagccaaccugcaguauuaaccucaguccugucccccaaggucuugacucaaucaacucua

SEQ ID NO: 68776 - RNA, 63 nt, Human
gugacggccgcaccucccccaugcaccccacccucccccaaagcccggaucccgagaaagauu

SEQ ID NO: 68777 - RNA, 63 nt, Human
gaagacaguccaguagacuugguagcgacccccucccccaaccccucucccuuuucagauaau

SEQ ID NO: 68778 - RNA, 63 nt, Human
aagaagcaguuguuuuauugucaauguuuuuuuucccccaagcauauuuucuuguauuucugu

SEQ ID NO: 68779 - RNA, 63 nt, Human
cuccauuucaacaucuccccccaggcgauguucucccccaagacgaccagaaaauuguuuauu

SEQ ID NO: 68780 - RNA, 63 nt, Human
auuguguuugacuugugucuguccaagaacuuuucccccaaagauguguauaguuauugguua

SEQ ID NO: 68781 - RNA, 63 nt, Human
cuaggagcuccccuguuugcaugagaaaaguagucccccaaauuaacaucagugucuguuuca

SEQ ID NO: 68782 - RNA, 63 nt, Human
uacgacuaauuguauuuuuaauuuuuucuuuucucccccaauuuuuuuuuuuuuuuugagacc

SEQ ID NO: 68783 - RNA, 63 nt, Human
uuauuuuguggcauuuccaugccaauguuuauuucccccaauuuguguguauguaauauugua

SEQ ID NO: 68784 - RNA, 63 nt, Human
ugaccucuuggccucuccuuugauucucaaucuucccccaaagcaugguuuggugccagcccc

SEQ ID NO: 68785 - RNA, 63 nt, Human
guugggucuggagcaagaucugagacugagaugucccccaagggugacaggucagauuuauuu

SEQ ID NO: 68786 - RNA, 63 nt, Human
gccaaacgcucucaucugauuuuuccucccuucucccccaaccuccaaucacccugagucacc

SEQ ID NO: 68787 - RNA, 63 nt, Human
ccaaccaaggagacagacagacuugggucucuuucccccaacuuuuccacauggucaucguga

SEQ ID NO: 68788 - RNA, 63 nt, Human
guauccacagaaaauguaaacugcucgccuuauucccccaaacuuuuuguucauguggcaggg

SEQ ID NO: 68789 - RNA, 63 nt, Human
gguuuuuaagagcaaauucugucccccccucacucccccaagugacaagauacuaaugaagaa

SEQ ID NO: 68790 - RNA, 63 nt, Human
auuucccucuacugaguaaacccuaucugugauucccccaaacaucuggcauggcucccuuuu

SEQ ID NO: 68791 - RNA, 63 nt, Human
uucacacuggggaaacucauuuuccccugcagcucccccaaggugcaggagggcaggauccag

SEQ ID NO: 68792 - RNA, 63 nt, Human
uguggcuggccacaccaagcaggaagcacaaacucccccaagcugacucauccuaacuaacag

SEQ ID NO: 68793 - RNA, 63 nt, Human
ccggauucucucuuuaacccuccccuucguguuucccccaauguuuaaaauguuuggaugguu

SEQ ID NO: 68794 - RNA, 63 nt, Human
aauauagcucuuucuuuuauuaacuguucucugucccccaaccaucuccugauauuugguaga

SEQ ID NO: 68795 - RNA, 63 nt, Human
caccagucacuugauuucgugaccuugauuucuucccccaaauuuaauaaagacagaggguuc

SEQ ID NO: 68796 - RNA, 63 nt, Human
agaaacauaaccgugaagcucuuccuacccuccucccccaaaaacccaccaaaauuaguuuua

SEQ ID NO: 68797 - RNA, 63 nt, Human
ucguucaaaacauuccaagaaagguuaaggaguucccccaaccaucuucacuggcuuccauca

SEQ ID NO: 68798 - RNA, 63 nt, Human
uccucauugccuccuguucugcccacgauccccucccccaagauacucuuuguggggaagagg

SEQ ID NO: 68799 - RNA, 63 nt, Human
cuauaaaauuauuuucuguuuucucacucuaguucccccaaagcuguagucccaaucaaucaa

SEQ ID NO: 68800 - RNA, 63 nt, Human
gagaccccucccuuccagaauccaggccccaucucccccaacuccacagccccucccgagccu

SEQ ID NO: 68801 - RNA, 63 nt, Human
agaauuaaagggguagcuuggccaucagcuccuucccccaaaaccaggcucagagcucuccuc

SEQ ID NO: 68802 - RNA, 63 nt, Human
ccucccuuccguaaagugcugggauauuuugaaucccccaaguucccuuggaccuacugauga

SEQ ID NO: 68803 - RNA, 63 nt, Human
auaaugggcauauuuauuugccuguauuucauuucccccaaugaaugucacaaggagaugggc

SEQ ID NO: 68804 - RNA, 63 nt, Human
uaguccuuugauuucuucccucucccuggugucucccccaagaccccaaauaaagcaauacac

SEQ ID NO: 68805 - RNA, 63 nt, Human
augaaucuuagucacugaauauucauauacauuucccccaaaaccuuagacauucauaguaga

SEQ ID NO: 68806 - RNA, 63 nt, Human
cuucaaaggaacuugguggcaucagcaccccccucccccaaugaggacaccuuuuauauauaa

SEQ ID NO: 68807 - RNA, 63 nt, Human
guuuucccuuuuguuucaaaaaauguaauauuuucccccaagcguuuuauauuuauguauuuu

SEQ ID NO: 68808 - RNA, 63 nt, Human
auaauuaacuaagcuucuaaaugccuagcucccucccccaaaggcgcuuucccccgauggagg

SEQ ID NO: 68809 - RNA, 63 nt, Human
uugucucuuccuuuuugacauuuucugauuuuuucccccaaaacucaguuaauauuuacccac

SEQ ID NO: 68810 - RNA, 63 nt, Human
uaccagacacaaagaugaagugugccagcugguucccccaagccagcucaugcugcugaccac

SEQ ID NO: 68811 - RNA, 63 nt, Human
acuuaaauacuguaaagcauaucuauuaauaauucccccaauuuuuuaaacuaacaaaaugga

SEQ ID NO: 68812 - RNA, 63 nt, Human
cuuuucuugcuuuggugcucaaagugguuuuuuucccccaauaaaauuauuuaauugaaaugc

SEQ ID NO: 68813 - RNA, 63 nt, Human
caggcuggaaggccuuccugguuuuaagauggaucccccaaaaugaaggguugugaguuuagu

SEQ ID NO: 68814 - RNA, 63 nt, Human
agggucccuuuacaggcuuuuuuuuccuuuuuuucccccaaaaucucuuaaaaugaggaaucu

SEQ ID NO: 68815 - RNA, 63 nt, Human
ucccagugaacucggccccuccucaaugggcuuucccccaacucaggacagaacaguguuuaa

SEQ ID NO: 68816 - RNA, 63 nt, Human
ucuggugcugcugggguauguucugggcuuaauucccccaagcagaagaccagauccaagaug

SEQ ID NO: 68817 - RNA, 63 nt, Human
ucccacccaccccugccuugcuuuucuuccucuucccccaaccuaacuucugccaugggaacu

SEQ ID NO: 68818 - RNA, 63 nt, Human
aaacacuacaugaaguuauuuuaguuaaagcccucccccaaaaguuauaaaaccauuuuauca

SEQ ID NO: 68819 - RNA, 63 nt, Human
aaauacaugagcagaggcagaguuaggcaaaauucccccaaugcugguuguaaugccacuucu

SEQ ID NO: 68820 - RNA, 63 nt, Human
auuucucuuugaaauuuauuagauacuguuaugucccccaaggguacaggaggggcaucccuc

SEQ ID NO: 68821 - RNA, 63 nt, Human
ggauucuaccugaacugaaaggacugugugaccucccccaagccaaccacuuucaccugggau

SEQ ID NO: 68822 - RNA, 63 nt, Human
ccccaugggacacccgguggucuuucccaaaccucccccaaaacacaccuggagccagagccu

SEQ ID NO: 68823 - RNA, 63 nt, Human
cugcagucaucucagagccccuucccgggccucucccccaaggcucccugccccuccucaugc

SEQ ID NO: 68824 - RNA, 63 nt, Human
cgggggcuggggguaagagaaaucuaacugcgcucccccaaccccucgcccugccaucuuccc

SEQ ID NO: 68825 - RNA, 63 nt, Human
gcccaugcccaggccucggccggggcgcagcgaucccccaaagccagcgccguggaguucgug

SEQ ID NO: 68826 - RNA, 63 nt, Human
gugcaauacaguuucauuaacuccuucccccgcucccccaaaaauuugaauuuuuuuuucaac

SEQ ID NO: 68827 - RNA, 63 nt, Human
aaauuauauguaacuucuacuaguuuuacuuucucccccaagucuuuuuuaacucaugauuuu

SEQ ID NO: 68828 - RNA, 63 nt, Human
ccggcgcccgagagaccggcacgccacggccccucccccaaggaacagagcaaaggauggugg

SEQ ID NO: 68829 - RNA, 63 nt, Human
ugagccuucgugcccccccuucccccuuuuuugucccccaacuugagauguaugaaggcuuuu

SEQ ID NO: 68830 - RNA, 63 nt, Human
ggugaaggugacagcagucgguuggagcgagcaucccccaaaguucacaauguggccgaggac

SEQ ID NO: 68831 - RNA, 63 nt, Human
cccguuugggguaggaguguggauggagaacccucccccaaggcuggugucuguaccauugca

SEQ ID NO: 68832 - RNA, 63 nt, Human
uucuccuucugucccuuuucucaaaagcaucuuucccccaaauguaugucucuaggacauuuu

SEQ ID NO: 68833 - RNA, 63 nt, Human
cagguccccagcuuuggcuaugagggccuugagucccccaaaacaccggguuccagcaccaca

SEQ ID NO: 68834 - RNA, 63 nt, Human
aaacaaaaaaagcucuagguucuucagcacauuucccccaaaacaaaauaaaauugagggcau

SEQ ID NO: 68835 - RNA, 62 nt, Human
aagugaggggugggcuugggcaauaaaggcaccucccccaacagccuggaguccagcgcagc

SEQ ID NO: 68836 - RNA, 63 nt, Human
acguucccgggugccgagcacugccuccgggcuucccccaagaccacgcuuagcgguggcuuc

SEQ ID NO: 68837 - RNA, 63 nt, Human
gcggcgggugccgcgccgugccgccuggcccucucccccaacgcccaggucuuggccuuggcc

SEQ ID NO: 68838 - RNA, 63 nt, Human
gcucaggggcucuuuaaaugggguaucuccucuucccccaacccaucuugggauccccaagaa

SEQ ID NO: 68839 - RNA, 63 nt, Human
guauaugcccugacaacuucuguaagccccccuucccccaacaggcaaugccucuaaaaauca

SEQ ID NO: 68840 - RNA, 63 nt, Human
cuauaacggucaaccauuucugucucuucuuuuucccccaaccucccccuccuguccccucug

SEQ ID NO: 68841 - RNA, 63 nt, Human
gggauaugaucaaguuauaacauguacccugcuucccccaacccugccuucuucacuaaauaa

SEQ ID NO: 68842 - RNA, 63 nt, Human
uugucuucaaauauuuucuaagagaaugaauuaucccccaaaaugcauuuagaaaacagucuu

SEQ ID NO: 68843 - RNA, 56 nt, Human
uacaggaaacucaaauaugacuccccucccccaaaaaacuuauaaaaugcaauaga

SEQ ID NO: 68844 - RNA, 63 nt, Human
caucuagugauuucuuuaguagacaguuuaauuucccccaagauuaggagacacuucugugca

SEQ ID NO: 68845 - RNA, 63 nt, Human
uacgguaaagaaauuuaaaguguagaauuuuccucccccaaaaagucauguguugauaguaga

SEQ ID NO: 68846 - RNA, 63 nt, Human
gcuguuuggaugcuacuugugguugaauuguguucccccaaaauauauggugaagucuuaacc

SEQ ID NO: 68847 - RNA, 63 nt, Human
guaaaagaagcuuuauugucuaguuguuuuuuuucccccaagacaaaggcaaguuucccuaag

SEQ ID NO: 68848 - RNA, 63 nt, Human
accggccacugcaacccaugagcguccaggugaucccccaaacagcaugugcucagccccaga

SEQ ID NO: 68849 - RNA, 63 nt, Human
gccucuuuccauuaaaaauugucaccaaugaacucccccaaacauggcuguggagagacaaca

SEQ ID NO: 68850 - RNA, 63 nt, Human
gggcuucacuaaccuucccuaggcauugaaacuucccccaaaucugauggaccuagaagucug

SEQ ID NO: 68851 - RNA, 63 nt, Human
cauuuuggagaguccacaccacggaccagguuuucccccaaggcuuggcuuuguguagcuacu

SEQ ID NO: 68852 - RNA, 63 nt, Human
agugugggcagagagaauuauguggccucauccucccccaaggcugugcuugcagcccgggca

SEQ ID NO: 68853 - RNA, 63 nt, Human
ucaggagggucacccuggccugccagucugccuucccccaaccccguguccugugguuugguu

SEQ ID NO: 68854 - RNA, 63 nt, Human
ccuggaccccugcccccaaaauauuuucaucuuucccccaaaccuccuuuaaaggagcaugca

SEQ ID NO: 68855 - RNA, 63 nt, Human
augggcugccgaguccugcccucucgccacauuucccccaaguuacauucccaggaggaccuu

SEQ ID NO: 68856 - RNA, 63 nt, Human
caaacagcacuugcaagaaauauaacccucccuucccccaauacacagaaccaccgccaccac

SEQ ID NO: 68857 - RNA, 63 nt, Human
aaagauacauauacuuaaauagaagugugacuuucccccaaaaguauuucaauucuacuucau

SEQ ID NO: 68858 - RNA, 63 nt, Human
aaguaguucuaaaaaaaaugcauauuaauuucuucccccaaagccggauucuuaauucucugc

SEQ ID NO: 68859 - RNA, 63 nt, Human
cugaaagauuaccagccagcaauagcccagggcucccccaaaagaauugguucagauuguaau

SEQ ID NO: 68860 - RNA, 63 nt, Human
gugacaauuaaagaucuaaaaaagagaggagauucccccaaacaacaauauuuaauuuucuua

SEQ ID NO: 68861 - RNA, 63 nt, Human
caugaccagcgugugcgcagggccuggucuuccucccccaagccaggccccuguccccacccc

SEQ ID NO: 68862 - RNA, 63 nt, Human
gaggaugauucuguuuuguugacucuugaaugcucccccaacauuccuuugguuuuccuauaa

SEQ ID NO: 68863 - RNA, 63 nt, Human
uggagccaaagccucucacagugcugauuuaccucccccaaaaugcccccaaacccccaugca

SEQ ID NO: 68864 - RNA, 63 nt, Human
auuacuaaaacacauuguuuauucucaguaguuucccccaaaaugcuuuuuucuuugcugaac

SEQ ID NO: 68865 - RNA, 63 nt, Human
agaauaggucauugguaugggcugaacuguguaucccccaauucauuuguugagguccuaacu

SEQ ID NO: 68866 - RNA, 63 nt, Human
ccaccaggacgcugugcucggccauggcgcgccucccccaagggcucaucugugcaacaacca

SEQ ID NO: 68867 - RNA, 63 nt, Human
cacuguugcaguggccuggccguucagccugucucccccaacaccccgccugccuccuggcuc

SEQ ID NO: 68868 - RNA, 63 nt, Human
caaugaggagcuggggccuccucaauuugcagaucccccaaguacaggcgcuaauuguuguga

SEQ ID NO: 68869 - RNA, 63 nt, Human
gcugugaggucccuccgcaucacccagcucacgucccccaaaacgugcauggugagaaccugc

SEQ ID NO: 68870 - RNA, 63 nt, Human
acaguacagacccuaaauuuuauuauuuguugcucccccaaucugauaccaaauguuuaaagu

SEQ ID NO: 68871 - RNA, 63 nt, Human
uacauuuggcuguuuuauagccuuuuucuucccucccccaaagaauucuguuugccuaacucc

SEQ ID NO: 68872 - RNA, 63 nt, Human
gggcuugcagcagcagcaguguggccaucuccaucccccaaagcacacuugcucucucaauau

SEQ ID NO: 68873 - RNA, 63 nt, Human
acuuuuuuaaaggggauuaaaaaacacagccucucccccaaaggguguccguucuuaauuccc

SEQ ID NO: 68874 - RNA, 63 nt, Human
gggaggagcagcuguguguccccggcaccucacucccccaaaaugacacccaccgucgucagg

SEQ ID NO: 68875 - RNA, 63 nt, Human
ugccccucuucugaccaacacacacacgaccccucccccaacacccccaaauucaagagugga

SEQ ID NO: 68876 - RNA, 63 nt, Human
guuagaugguuuuugaucugcagucuucccuagucccccaaauaaguaauaauaacuuccaug

SEQ ID NO: 68877 - RNA, 63 nt, Human
ugcccccuacuaaagccucugcucucagcacuuucccccaaguccuuguaacuugcuugaagg

SEQ ID NO: 68878 - RNA, 63 nt, Human
cagugggcggacgacuggcuggugcaccugaucucccccaauguguaccgcacgcccaccgag

SEQ ID NO: 68879 - RNA, 63 nt, Human
ccccguuucccuggugcccagagaacccaccucucccccaagggccucagccuggcugugggc

SEQ ID NO: 68880 - RNA, 63 nt, Human
ccuggccgaguuuccucugccccuucuugcuggucccccaaagggcgcuccgcucccugcccu

SEQ ID NO: 68881 - RNA, 63 nt, Human
acccaggacaucugugccaggcuucccaugcccucccccaacagucccucagcuucacccagc

SEQ ID NO: 68882 - RNA, 63 nt, Human
uuuaggggccgacgggggcagcugccccaucccucccccaaccccuguauccccaccccguac

SEQ ID NO: 68883 - RNA, 63 nt, Human
cagaggcugcaugaccuccccucccggcgucccucccccaaccuccuuccgcaacugggcuuc

SEQ ID NO: 68884 - RNA, 63 nt, Human
gugcagaagaauaaggcagcugagaaucuuguuucccccaagagaguuuuacaggcugagugu

SEQ ID NO: 68885 - RNA, 63 nt, Human
ucccaaauugguguuucugaaugacaucaacauucccccaacauuacuccauuacuaaagaca

SEQ ID NO: 68886 - RNA, 63 nt, Human
cugguauuuccccgcaugucuuauucuugcccuucccccaaccaguuuguuaaucaaacaaua

SEQ ID NO: 68887 - RNA, 63 nt, Human
uauauuuccauugugaccagcagcaggcuuuuuucccccaagaagaugaucaaaacaaaggau

SEQ ID NO: 68888 - RNA, 63 nt, Human
uuugggggagaauccacccucccaucaucugcuucccccaaggccucccacaggugacagaau

SEQ ID NO: 68889 - RNA, 63 nt, Human
ccccacccggcccugugcauaugaagucuuucuucccccaacucuugaacgaugaugauauuc

SEQ ID NO: 68890 - RNA, 63 nt, Human
uuaaaaaaauggcagugaugaauuuuaaggguuucccccaacauauaaaauaaugcaaagaau

SEQ ID NO: 68891 - RNA, 63 nt, Human
ucauacggaguugaaucagaccugguucccgccucccccaaggcucaugguccuuggaggacc

SEQ ID NO: 68892 - RNA, 63 nt, Human
cacauuucaaaaccaaucaugccuucccaacagucccccaaagucuuaacucauuucagcauu

SEQ ID NO: 68893 - RNA, 63 nt, Human
ucccuaccaauuuuaugucauaagagauuuuuuucccccaaaucuagaacaauguauaauaca

SEQ ID NO: 68894 - RNA, 63 nt, Human
ucuugggguauaacacauuuucauuuacuuuucucccccaaaaucaucuuauccaauuuuauu

SEQ ID NO: 68895 - RNA, 63 nt, Human
gggaucccaaacuuggauagagccaguucaaccucccccaauccauacacauacauaccuagg

SEQ ID NO: 68896 - RNA, 63 nt, Human
aucauuggguagggcaaacugauuuuuuuccuuucccccaaaagaguaugaaaaauaaauguc

SEQ ID NO: 68897 - RNA, 63 nt, Human
gagcagaggggcugaauagcagaagguugcaccucccccaaccuuagauguucuaagucuuuc

SEQ ID NO: 68898 - RNA, 63 nt, Human
ucccagaguuucucucggcucuuuuuuuaaaagucccccaacaaauaggauucuugcugggaa

SEQ ID NO: 68899 - RNA, 63 nt, Human
cacccccgucaagagugaauucccucacucgucucccccaacagcuggacccugaccagcucc

SEQ ID NO: 68900 - RNA, 63 nt, Human
uucagaggggacccuccagaagcccagccggcuucccccaaggacucccccuucgcugggagu

SEQ ID NO: 68901 - RNA, 63 nt, Human
uaauuauguauuauaguggagugaucauacaguucccccaaaugugauguuucaguguauuua

SEQ ID NO: 68902 - RNA, 63 nt, Human
uauuacaaaauuauguucuauuuuaaaguccacucccccaaaauacugauuucuuccauggau

SEQ ID NO: 68903 - RNA, 63 nt, Human
uugcuuucugaucaaggccuuauuggaaagcagucccccaacuacccccagcugugcuuaugg

SEQ ID NO: 68904 - RNA, 63 nt, Human
caggugaggauggugcaccagacaggguagcugucccccaaaaugugcccugugcgggcagug

SEQ ID NO: 68905 - RNA, 63 nt, Human
cuucaaguucucuugauuucuuuguucccacugucccccaagaaacuaguaucucuggccucc

SEQ ID NO: 68906 - RNA, 63 nt, Human
gcuggggugcuuugaagauaaucccuaccccucucccccaaaugcagcugaagcauuuuacag

SEQ ID NO: 68907 - RNA, 63 nt, Human
gggagggacaagggauucugggaagcuugagccucccccaaagcaaugugagucccagagccc

SEQ ID NO: 68908 - RNA, 63 nt, Human
aagagcagucucuucugagccagccucugcgggucccccaauaagguucaucuccucacagca

SEQ ID NO: 68909 - RNA, 63 nt, Human
guaagaugcugggguauagaacgcuaagaauuuucccccaaggacucuugcuuccuuaagccc

SEQ ID NO: 68910 - RNA, 63 nt, Human
ccaguuucccaccuuccuccugcuggugcuccaucccccaauaccaggcugggccaccacucu

SEQ ID NO: 68911 - RNA, 63 nt, Human
uuaugccgugaaacagcccccagcccccgucugucccccaacccaggcuagccagccuuuuaa

SEQ ID NO: 68912 - RNA, 63 nt, Human
cauuuugaaaguguuuuucucauucuccauaccucccccaagcucuccuccagcccuucccag

SEQ ID NO: 68913 - RNA, 63 nt, Human
caggaugcacguccucagagggagcagccuaucucccccaagcuggaggcggcagaggacugg

SEQ ID NO: 68914 - RNA, 63 nt, Human
ggaagguagggugugagcugcugcugaaggcugucccccaaccccacuccugagacauagggc

SEQ ID NO: 68915 - RNA, 63 nt, Human
cucggguccccuccugcuucccuuccccacuuaucccccaagugccuucccucaugccugggc

SEQ ID NO: 68916 - RNA, 63 nt, Human
ggcugacaguaucagguggaucccgcuucccccucccccaagaagucagccaacacgcagcug

SEQ ID NO: 68917 - RNA, 63 nt, Human
gaauccuaaguucuuagcugcugaugcaaguugucccccaaggccaucacaaagcaguggggc

SEQ ID NO: 68918 - RNA, 63 nt, Human
agccgcuuccuuccugcccugcccaccuggggaucccccaaagucagacacagagcaagaguc

SEQ ID NO: 68919 - RNA, 63 nt, Human
auccuggcccugagccagcccugugcuccucccucccccaacacucccuaccaacccccuaau

SEQ ID NO: 68920 - RNA, 61 nt, Human
gauugaggaauugugaugggucauucccaagaaucccccaaggggcaucccaaaucccuga

SEQ ID NO: 68921 - RNA, 63 nt, Human
ucuuccgaggucucccugaaaugaauguauuucucccccaaaagagcugauauuuaauguuuu

SEQ ID NO: 68922 - RNA, 63 nt, Human
gggaaaaagcuauuuucauugguacauuuaaagucccccaacuauggggagguaccaauucug

SEQ ID NO: 68923 - RNA, 63 nt, Human
aaaaaaauggucaauaaagcuccuuuggcagaaucccccaaagaaccaggguauucuuuuucc

SEQ ID NO: 68924 - RNA, 63 nt, Human
gggcagggacagggagccgagugccccucagagucccccaaacacaagcacaucacaccuccc

SEQ ID NO: 68925 - RNA, 63 nt, Human
cggcacggagacccugccagcagcucccucccgucccccaaccucuccugcucauaaauccag

SEQ ID NO: 68926 - RNA, 63 nt, Human
cagaggcuacagguuggagcuuuuuuuccccugucccccaaccccauccccaccuccacuuca

SEQ ID NO: 68927 - RNA, 63 nt, Human
cagaccuccacccuucuuuccuccaccccuccaucccccaaugcuuguagaccuuccauucau

SEQ ID NO: 68928 - RNA, 63 nt, Human
cccacuccauugauaccaacucuuucccuucauucccccaacauccuguugcucuaacuggag

SEQ ID NO: 68929 - RNA, 63 nt, Human
gaccgcuuguggggacccaggcuccgcccuuagucccccaacucugagcccauguucugcccc

SEQ ID NO: 68930 - RNA, 63 nt, Human
cucaucucucuugggccaagccagcugccuaggucccccaagcaugggggaccccuucccaca

SEQ ID NO: 68931 - RNA, 63 nt, Human
gggcucugucuuccuggucauaggcucacucuuucccccaaaucuuccucuggagcuuugcag

SEQ ID NO: 68932 - RNA, 63 nt, Human
ugaagagacuggacaaaguccccaggaugggcaucccccaagucacuacagcaucuggagccc

SEQ ID NO: 68933 - RNA, 63 nt, Human
ccaggccuauagacguuucucuccaaggcccuaucccccaauguugucagcagaugccuggac

SEQ ID NO: 68934 - RNA, 63 nt, Human
agguuguccaugagauuugaauagauuuuuaguucccccaagguuuaaauacaaacauaguca

SEQ ID NO: 68935 - RNA, 63 nt, Human
uuuguauucauaauggcuuuuuaucuaccuuccucccccaacaaaucauuauccaccccccuc

SEQ ID NO: 68936 - RNA, 63 nt, Human
agaacuauauaggcugugaaaacgcacuuucuuucccccaaagagcugggaauuuaugaaguu

SEQ ID NO: 68937 - RNA, 63 nt, Human
uagcuccacaguguuucauaaggccauccuguuucccccaacucccccauuuuugguuuguuu

SEQ ID NO: 68938 - RNA, 63 nt, Human
ggacucgcccccaggaacgcucuccucgagcccucccccaaacagacucgcuagcacucaaga

SEQ ID NO: 68939 - RNA, 63 nt, Human
cuccauuucguaaccaucuguguuccaccuucuucccccaaaucuccuccuuccacaccugcu

SEQ ID NO: 68940 - RNA, 63 nt, Human
ucacaagcucugccucuuucuggccucacccucucccccaacccgggcacccucggcccuccc

SEQ ID NO: 68941 - RNA, 63 nt, Human
uuuuugcuuucugcuuuauugaucuuuugcaugucccccaaagccagaaucugcucauggagg

SEQ ID NO: 68942 - RNA, 63 nt, Human
uguguccuggggacuuccucagagcgagaaaccucccccaaugucuucaagacuuuucucucc

SEQ ID NO: 68943 - RNA, 61 nt, Human
ugcagucugccccuuccuagccccuguucccucccccaacccuaucccuccuaccucaccc

SEQ ID NO: 68944 - RNA, 63 nt, Human
aagugcugcaguuugcccucccauucccaucuaucccccaaguccuuugcaauuucuucccug

SEQ ID NO: 68945 - RNA, 63 nt, Human
guccccacuccaagaugaguugacacaaccccuucccccaauuuuuguggaucuccagagagg

SEQ ID NO: 68946 - RNA, 63 nt, Human
guaaaaauaaagauaauucuucaaaugaagucuucccccaaggagcagaagaaagaauguguu

SEQ ID NO: 68947 - RNA, 63 nt, Human
guuuguuaccucacuugagugggguuuuccuuuucccccaauucuaagagaauauaaugugua

SEQ ID NO: 68948 - RNA, 63 nt, Human
guuauguaaugucuuaugaugugugccucucccucccccaaaccuguuuacagucaauuauaa

SEQ ID NO: 68949 - RNA, 63 nt, Human
aaagauucacaccauacaggccaaauuauagaaucccccaaccccaagacacugcacccuaug

SEQ ID NO: 68950 - RNA, 63 nt, Human
gcugcccgugggggccccuucgcgcugccagccucccccaaccaccugcccuccccgccuucu

SEQ ID NO: 68951 - RNA, 63 nt, Human
acugcucuccagccugggaggcacagcaaacugucccccaaaaaaaaaaaagaguccuuacca

SEQ ID NO: 68952 - RNA, 63 nt, Human
cuaaagguggccacaaauucuuugacacucaagucccccaagaccuaaggguuuuaucuccuc

SEQ ID NO: 68953 - RNA, 63 nt, Human
uccucccugccugcuuuuucuguacucucaaguucccccaaagccccaaagaguuggaggcca

SEQ ID NO: 68954 - RNA, 63 nt, Human
aggggauauaggagaggaaaaguaaggugcaguucccccaaccucagacuuaccaggaagcag

SEQ ID NO: 68955 - RNA, 63 nt, Human
gauugcacuuuauauguccagccucuuccucagucccccaaaccaaagcuacacagccagauu

SEQ ID NO: 68956 - RNA, 63 nt, Human
uccuaugcgaaagacacuggcucuuuuuuuuaaucccccaaauaaauuuugcccccuuuuagg

SEQ ID NO: 68957 - RNA, 63 nt, Human
gagaaaggcaacugugaugauaaaauuuaacguucccccaaacacugagucaaugagauuuuu

SEQ ID NO: 68958 - RNA, 63 nt, Human
uaguucccuauuuuaaccucaauuaugcauuugucccccaaccccacugagaacuaaaugcug

SEQ ID NO: 68959 - RNA, 63 nt, Human
ucccuaaugccaccucaguuuguuucuuucuguucccccaaagcuuaucugucucugagccuu

SEQ ID NO: 68960 - RNA, 63 nt, Human
uguagcacaggauggaguuugauuuaucccuccucccccaacaccuaggaacugaaucuuuuu

SEQ ID NO: 68961 - RNA, 63 nt, Human
gcuuugccugguguggggaaggauugggucuugucccccaacacagcuucuguggcugacugu

SEQ ID NO: 68962 - RNA, 63 nt, Human
ucugcuugcuuggcccuucugaucauguaugcaucccccaaggaugaaaucagauuuuaacua

SEQ ID NO: 68963 - RNA, 63 nt, Human
agcuccuuguguauaugaaugcauuuguaagcaucccccaaauuauucugaagguuuuuugau

SEQ ID NO: 68964 - RNA, 63 nt, Human
aaacuguguauuuuguacuuaucacuacacguaucccccaaaugcuuacaugggaguuugagg

SEQ ID NO: 68965 - RNA, 63 nt, Human
uuuccuucacuuaauucuauccacagucaaaaaucccccaaggaggaaagcugaaagaugcac

SEQ ID NO: 68966 - RNA, 63 nt, Human
aauaaguuugauaacauuuaaaagaugggcguuucccccaaugaaauacacaaguaaacauuc

SEQ ID NO: 68967 - RNA, 63 nt, Human
aggaaaggaaaaucagguagauggugcuuuuuuucccccaaaucuaaguauucuaugucaugg

SEQ ID NO: 68968 - RNA, 63 nt, Human
cucaaugaucccuuccuccccauaugccacccuucccccaaagcugauagggcagaggugcac

SEQ ID NO: 68969 - RNA, 63 nt, Human
uaucaaguaacaauaugauuauuauuuuuuuauucccccaaagcgggcuugcugcuucacccu

SEQ ID NO: 68970 - RNA, 63 nt, Human
gaacggcccugcaggagcagggcggcugccgacucccccaaccaaggaaggagccccugaguc

SEQ ID NO: 68971 - RNA, 63 nt, Human
ucaccaugcaugguggcgaaugcccccaaacucucccccaaauguauuucucccuucgcuggg

SEQ ID NO: 68972 - RNA, 63 nt, Human
cuagcuuaacccuuugagacucugagauuuuuuucccccaaauuuguguaaaacaguuucauc

SEQ ID NO: 68973 - RNA, 63 nt, Human
auccuuugucuacagagagaaaaauugccuucaucccccaagaggaugcggugaaguuuaaac

SEQ ID NO: 68974 - RNA, 63 nt, Human
uauacucauauagauauauugucauugaaauauucccccaaaauauucucagacuaaaccuga

SEQ ID NO: 68975 - RNA, 63 nt, Human
ucucucacuucuacuuguagauggccgcccugcucccccaaugaaaggccagcuucgaagaaa

SEQ ID NO: 68976 - RNA, 63 nt, Human
gcuucacccgggucucccugucucagcaccuccucccccaauucccaggucucacaucccacc

SEQ ID NO: 68977 - RNA, 63 nt, Human
uuuauaagucuagucauucugcaacgugacauaucccccaaaaugaaguuaccuuccaaguug

SEQ ID NO: 68978 - RNA, 63 nt, Human
cccugcaauggggcccugagcccucccucuucaucccccaaggccucaacuagaggguggucc

SEQ ID NO: 68979 - RNA, 63 nt, Human
agaaccaaaucaaaguguaauucucccuccagcucccccaaaccccagaguuuugggguugug

SEQ ID NO: 68980 - RNA, 63 nt, Human
uauucugugauugauuuugguccuccuccgcugucccccaacacccaggaaugggaaucuggc

SEQ ID NO: 68981 - RNA, 63 nt, Human
auucugguuuuauuagcuuuguguguguccucuucccccaaacccccuuuuggugagaacauc

SEQ ID NO: 68982 - RNA, 63 nt, Human
ccgccuuauaccucaccaucggagaacuuaccaucccccaaauauauccugcuggcacuacac

SEQ ID NO: 68983 - RNA, 63 nt, Human
cuagaccagcuccucuccaauccugagggccccucccccaacccaacucgacccucccucccc

SEQ ID NO: 68984 - RNA, 63 nt, Human
aucccacagaaauguuuuggagagcgggagguuucccccaaucuccuccaaguucuucucccu

SEQ ID NO: 68985 - RNA, 63 nt, Human
agucuccggcccaccuaccaccgccagccaggaucccccaaagugugcagagggcucagcaga

SEQ ID NO: 68986 - RNA, 63 nt, Human
cugcagagggagguggaaaugaacccugagggcucccccaacuugccaugcccugucccuuag

SEQ ID NO: 68987 - RNA, 63 nt, Human
ggccuguuuggccucucuauccucucuuccucuucccccaagauugagcucucugcccuugau

SEQ ID NO: 68988 - RNA, 63 nt, Human
aucccaacauuugacaccccagcaaugugugacucccccaacauuccacuaugccauccugca

SEQ ID NO: 68989 - RNA, 63 nt, Human
cagcaaauuucagggguuuucugggaccaguucucccccaacaggaaacuuguuuuuuuaacg

SEQ ID NO: 68990 - RNA, 63 nt, Human
auuuuaaaaggggaaauuuuguucucuagguuuucccccaaauaaacauugcuuuauuucuaa

SEQ ID NO: 68991 - RNA, 63 nt, Human
uucuuacugugugacuuggcuagaguugggaguucccccaaaauaaacguguccccauuuuac

SEQ ID NO: 68992 - RNA, 63 nt, Human
uuuuuuaauuuacacuauagagugauuuuuuuuucccccaacgucaaguuuuuaccuugcaug

SEQ ID NO: 68993 - RNA, 63 nt, Human
gauugagcuucagagcuaaaaugccuucacccuucccccaaguuggaauauauccucccccaa

SEQ ID NO: 68994 - RNA, 63 nt, Human
gccuucacccuucccccaaguuggaauauauccucccccaaauuaaggacccauuugucuucu

SEQ ID NO: 68995 - RNA, 63 nt, Human
gguucucuggagcagaguucucugaauaccccaucccccaacugcugauuuuacagccccagg

SEQ ID NO: 68996 - RNA, 63 nt, Human
gaaaaacaaauauagauagguagaacuauauuuucccccaaucagaaucaucauaucauaggu

SEQ ID NO: 68997 - RNA, 63 nt, Human
gaaguccauuccccuuuucccuccugugcucugucccccaaggagucauggaacucaggguac

SEQ ID NO: 68998 - RNA, 63 nt, Human
acauaguuuauguuccuggccaccccgaccgcuucccccaaguucugcuguuggacucuggac

SEQ ID NO: 68999 - RNA, 63 nt, Human
gucacacccaagcugcuggccuccagucccaucucccccaacacaugugcccccaaaaaguga

SEQ ID NO: 69000 - RNA, 63 nt, Human
gagcucuucucagugggguccccuuugauguucucccccaaguugggcagccuagagguguug

SEQ ID NO: 69001 - RNA, 63 nt, Human
uuaaggucuuuuaccaccucccccccaaaaaaaucccccaaaacugauucagauuuucauacu

SEQ ID NO: 69002 - RNA, 63 nt, Human
cugggcguggggggggcuguccuggcucugcugucccccaagagggugcuucgagggugagga

SEQ ID NO: 69003 - RNA, 63 nt, Human
gcagaagcuuccuacuuggcugacagccccgguucccccaacauguucccguucacucugccc

SEQ ID NO: 69004 - RNA, 63 nt, Human
uuuuuuuguaauauaaauauauacauuuguguuucccccaaaacuguuucauaguuaaaaaau

SEQ ID NO: 69005 - RNA, 63 nt, Human
uugguuccuccccgaaaacccccagcauuacgaucccccaaguguccuggacccuggccuaaa

SEQ ID NO: 69006 - RNA, 63 nt, Human
auguaaaguggggacgggggcugcuucuccaccucccccaaacccugcuucugcugcccugau

SEQ ID NO: 69007 - RNA, 63 nt, Human
cuauuuauguguauuuauuguuauuuauaugccucccccaacacuacccuuggggucugggca

SEQ ID NO: 69008 - RNA, 63 nt, Human
ugcugugagggguccuugcguggcccccauccuucccccaaugcagaacuccaugggcaggga

SEQ ID NO: 69009 - RNA, 63 nt, Human
aagucuuccuucgugagcuggccuugcuccccaucccccaagugccucaccagucccccagac

SEQ ID NO: 69010 - RNA, 63 nt, Human
cagcagaaccacaugccccaagaccccagggcuucccccaaaauucugagugagcugcagggu

SEQ ID NO: 69011 - RNA, 63 nt, Human
aggcccugagccccaugcccagcccugccuuggucccccaacccccagagcuuggagucuggg

SEQ ID NO: 69012 - RNA, 63 nt, Human
cuagggcugaggggccugcgcccagagcuggccucccccaacaccugcugcgcuugguaggug

SEQ ID NO: 69013 - RNA, 63 nt, Human
agccgugcagugaggacccccaagaggcccauuucccccaauaaaagagauuugggagucugc

SEQ ID NO: 69014 - RNA, 63 nt, Human
uuuugguagggccaccacucacuggguuuagggucccccaauacacugugaccucaucuuaac

SEQ ID NO: 69015 - RNA, 63 nt, Human
ugcaaauaaaaacguguguaucaaguaugauguucccccaacguggacacacucaguuccuca

SEQ ID NO: 69016 - RNA, 63 nt, Human
ucacuccugccucuccacgcugccccgucccucucccccaacagggaggaggucggauuaggg

SEQ ID NO: 69017 - RNA, 63 nt, Human
cccacgccucagguguggcugccugugggaccaucccccaaccccuuuccucgcaccuccuug

SEQ ID NO: 69018 - RNA, 63 nt, Human
ucaagaaagagacugccuugucauuguuucuuaucccccaacuucauguucccugcaauuuau

SEQ ID NO: 69019 - RNA, 63 nt, Human
ccccagcuccauccuccacuuauucugccuguuucccccaaagacaauggcuggacccugcau

SEQ ID NO: 69020 - RNA, 63 nt, Human
ggacauuagggagcccugccuuuuucuacugguucccccaauguuugaaagaggcauuaggcu

SEQ ID NO: 69021 - RNA, 63 nt, Human
ccuggguucguccccagugagaccggaggaugaucccccaaggacugcgcagcaucagcucuu

SEQ ID NO: 69022 - RNA, 63 nt, Human
cgugacaugaugauaggucuucuccuuggggccucccccaauaaaucuguaauaaaccugaaa

SEQ ID NO: 69023 - RNA, 63 nt, Human
ugccuggaggaaggauggcucuggccucgguccucccccaacccugcccaagccagacagaca

SEQ ID NO: 69024 - RNA, 63 nt, Human
uucauuuucugaaagcacuuuaaugauuccccuucccccaaacuccagggaauggagggggga

SEQ ID NO: 69025 - RNA, 63 nt, Human
ugccccugguggccuccaaauccuuccugggauucccccaaacccacacugaugcgaagcugu

SEQ ID NO: 69026 - RNA, 63 nt, Human
uguuuuaggacauugcaaaucuucuagaaguucucccccaaaucaggucaaugugugcccucc

SEQ ID NO: 69027 - RNA, 63 nt, Human
cacccaggcaucuccagugcucaugaucaugugucccccaacuccaccccucacaguuugggc

SEQ ID NO: 69028 - RNA, 63 nt, Human
gaaaagacuugcuuuuacccagggaggggacauucccccaauccugugucugggcagcuugcc

SEQ ID NO: 69029 - RNA, 63 nt, Human
aaaucuaugcauuguaugggacuuuccuuuggaucccccaaucaaaggauaagcaaugcguaa

SEQ ID NO: 69030 - RNA, 63 nt, Human
ucucagccccuuaggacgcgggucuccuugggcucccccaaggguucugcgaagaggcagugg

SEQ ID NO: 69031 - RNA, 63 nt, Human
uuugggaugaaauaacuaucuccccuuccucugucccccaacuggggagucuccccaggcugc

SEQ ID NO: 69032 - RNA, 63 nt, Human
ucuuggccacagagggcagcaucgcccgccccuucccccaaaugcugcuugcagcacccaccc

SEQ ID NO: 69033 - RNA, 63 nt, Human
aauaauuuuucuuucaaguagguuagcuagcucucccccaauaaaaauaccacuaucagagua

SEQ ID NO: 69034 - RNA, 63 nt, Human
aaaaaugcuacuuuuaucuucucuaaaauuauuucccccaagguagugaaguaauuggaauga

SEQ ID NO: 69035 - RNA, 63 nt, Human
uacccuccaucuguggauuuuucagcauuggaaucccccaaccagagauguuaaagugagccu

SEQ ID NO: 69036 - RNA, 63 nt, Human
ccacaggagcuuauuggccaggagggaauaaugucccccaauacugccuguugagggaccaga

SEQ ID NO: 69037 - RNA, 63 nt, Human
ggugaugccagccaggcccaggagugcccagcaucccccaacugaugacacaguagcacugau

SEQ ID NO: 69038 - RNA, 63 nt, Human
uucuguuugcaggcaaaugcuucagcucacaugucccccaagacucaauagucuugguuggga

SEQ ID NO: 69039 - RNA, 63 nt, Human
cuccucaccugggacggaagcugccagcucgcuucccccaagcugccucauggcccgcacgcc

SEQ ID NO: 69040 - RNA, 63 nt, Human
uucuugggauucuuuuagcccuugacauucuugucccccaaaccuguaaguaggugaauuccu

SEQ ID NO: 69041 - RNA, 63 nt, Human
cucuccauuguguuccgauccauuucuguguguucccccaaccuuuauuuccaagugacauuu

SEQ ID NO: 69042 - RNA, 63 nt, Human
acagugccugacuacuuguggcccaggcaggcuucccccaacacaggaacgcucauggacacc

SEQ ID NO: 69043 - RNA, 63 nt, Human
accacuuguugauuauuuucuuguuugagccccucccccaauaaagaauuuuuaucggguuuu

SEQ ID NO: 69044 - RNA, 63 nt, Human
ccgaggagucugcccugccuagagaagggccucucccccaacccucagccguuccuccaccuc

SEQ ID NO: 69045 - RNA, 63 nt, Human
ggaagcaacacccauuugggguuaccauguccaucccccaaggggggcccugccccucgaguc

SEQ ID NO: 69046 - RNA, 63 nt, Human
ccuuuugguacgcaaaaccugcucucaauaaauucccccaaagcucugaccucuugugcauug

SEQ ID NO: 69047 - RNA, 63 nt, Human
aacuggcuucauacacacaaacauauuuguuuaucccccaaauguaggcaccuggcuccuccu

SEQ ID NO: 69048 - RNA, 63 nt, Human
ggagucaaguauguacuuaaggugacucgacagucccccaacuccuauguggugaucaugaau

SEQ ID NO: 69049 - RNA, 63 nt, Human
uaauacagcugcuuuucucggugccaaccucccucccccaagcucagauccuccucuuaugcc

SEQ ID NO: 69050 - RNA, 63 nt, Human
ugauucugccucagcuccugucuugcugagcccucccccaacccacgcuccaacacacacaca

SEQ ID NO: 69051 - RNA, 63 nt, Human
aaugaaaguuuccgccuguuguaaaaucuauuuucccccaaggaaaguccuugcacagacacc

SEQ ID NO: 69052 - RNA, 63 nt, Human
acccuacugcaguaaacugaagacaagaucucuucccccaagaaaaaguguacagacagcugg

SEQ ID NO: 69053 - RNA, 63 nt, Human
gaaugucccccuucuugcuucucucuccuucuuucccccaagccucauucauucuugggauug

SEQ ID NO: 69054 - RNA, 63 nt, Human
gcccaggcccuggcucuguaaccauuaaccucuucccccaacuaacaccaaugaaaacaccau

SEQ ID NO: 69055 - RNA, 63 nt, Human
aaaaaauaggauaauuuaaccuaccagcccuucucccccaauaacuguggucuauacagaguc

SEQ ID NO: 69056 - RNA, 63 nt, Human
ccauuucugccacugguguucagcuccuucucuucccccaacacucccaaagauacccacagg

SEQ ID NO: 69057 - RNA, 63 nt, Human
ggugccucuagacacuugacuuacgaucguuauucccccaauucaucauauuuuguuuguuau

SEQ ID NO: 69058 - RNA, 63 nt, Human
ugcagucuucuuccugauguuucaaacugugguucccccaagcucucuaacacuuggaagucu

SEQ ID NO: 69059 - RNA, 63 nt, Human
ggcggcccggccggagggcaggacccucaccucucccccaaggccacugcgcucuugggaccc

SEQ ID NO: 69060 - RNA, 63 nt, Human
aggcucccaggccuccacagagucuucagcgcaucccccaacagcagccccugccagucccuc

SEQ ID NO: 69061 - RNA, 63 nt, Human
ccaccaaggaaugagauauguggaccucacugcucccccaacccagcgucaggcugggacacg

SEQ ID NO: 69062 - RNA, 63 nt, Human
ugcuggauuaguuccuuugauauuuguaaaaauucccccaagagccgcauaugaaucugcccu

SEQ ID NO: 69063 - RNA, 63 nt, Human
augcaguguugcacugaugacuugaccagccccucccccaauaaacucgccucuuggaaaugg

SEQ ID NO: 69064 - RNA, 63 nt, Human
gacaaccuaaucugagcccagcccugaccagccucccccaacagaacgccugugccgccacug

SEQ ID NO: 69065 - RNA, 63 nt, Human
cugagggcagggcccgagccccgacacaucccuucccccaaaaagcaacaccugugcuugcag

SEQ ID NO: 69066 - RNA, 63 nt, Human
aauaaaggagcaauaaagucacgagaacuuucgucccccaaucgagagcccgaggggcacccc

SEQ ID NO: 69067 - RNA, 63 nt, Human
ucaccucugucuaguuacagaacgguuucuuucucccccaaagaaaccccaucgccaucagca

SEQ ID NO: 69068 - RNA, 63 nt, Human
uuuuuaagugggaaagaacucaccuugccuuccucccccaaaugugcaaccuguaaaaggucu

SEQ ID NO: 69069 - RNA, 63 nt, Human
uuuaaaugauagagguuuuugugggaaucaaaaucccccaaauguuaagguauaugguaaaaa

SEQ ID NO: 69070 - RNA, 63 nt, Human
auaaacuuuguuuuaacauaauuaguacuguuuucccccaaaaguacaaguuuuugaguagca

SEQ ID NO: 69071 - RNA, 63 nt, Human
cugcugucccucuccaggccuuggcaaugacgaucccccaaagagcccgucugcaccccagac

SEQ ID NO: 69072 - RNA, 63 nt, Human
uggagccagggcugccgguccgagucuccuaccucccccaacccugcccgccccugaaggcua

SEQ ID NO: 69073 - RNA, 63 nt, Human
acuuguuuucaugucccacguucucugcugacaucccccaauaaaggacccuaacuuucgaua

SEQ ID NO: 69074 - RNA, 63 nt, Human
gauucuccuagcuccaaauguuuucauuaucucucccccaacaaaacccauaccuaucaagcu

SEQ ID NO: 69075 - RNA, 63 nt, Human
aaaggcaggcucuggccccuuuccaugccaaagucccccaagaucuggauaucuggggacaag

SEQ ID NO: 69076 - RNA, 63 nt, Human
agcuccucuccagcccuggccacauccccauccucccccaaccuccagccccaacacccauca

SEQ ID NO: 69077 - RNA, 63 nt, Human
acagucccccagacccuccuuagaaugccacagucccccaacccuccacagagcccccagacc

SEQ ID NO: 69078 - RNA, 63 nt, Human
aauacuccuugguuuucucugaagcccacccuuucccccaacucugguccaggagaaaccaga

SEQ ID NO: 69079 - RNA, 63 nt, Human
uacagagggaucuuguguacccuucacccagccucccccaauggcaacaucuugcaaaacuac

SEQ ID NO: 69080 - RNA, 63 nt, Human
cgcguuccugcccagccccuugcugucauccccucccccaaccuuggccacuugaguuugucc

SEQ ID NO: 69081 - RNA, 63 nt, Human
uguguugucacaucuguccccucauuuuugagaucccccaauucucuggaacuauucugcugc

SEQ ID NO: 69082 - RNA, 63 nt, Human
gaaagcugauuaauuacaggagguuuguucaggucccccaaaccaccgucagauuugaugauu

SEQ ID NO: 69083 - RNA, 63 nt, Human
cccaacgccuuccuauuccuuuccaacuccuuuucccccaaauuucacuuuccuucucagguc

SEQ ID NO: 69084 - RNA, 63 nt, Human
gacguagacaggaugccaggggccuggccagccucccccaaugcuggggagcaucccugggcc

SEQ ID NO: 69085 - RNA, 63 nt, Human
ccucccaucuccccucuguacauaggucacccgucccccaaucaaaucuaaagguuuuuuaag

SEQ ID NO: 69086 - RNA, 63 nt, Human
gcccgccgcccacccccacugacccccgcugccucccccaacaccgacacccuccucggccuc

SEQ ID NO: 69087 - RNA, 63 nt, Human
ccucccaacgaaagcauggaagcccuaagcuuaucccccaaccccuggcccugcuuuuccucg

SEQ ID NO: 69088 - RNA, 63 nt, Human
ggagcaccccgauccccauccggcaccccccaaucccccaacacgccugucccucccgcaugg

SEQ ID NO: 69089 - RNA, 63 nt, Human
caagauuauccacaccccagcccuuaauccccaucccccaaaucacuggauccugcagcccca

SEQ ID NO: 69090 - RNA, 63 nt, Human
uacacagcuuuauuggcccccagcagccacaguucccccaagggggcuuugggacagggaggg

SEQ ID NO: 69091 - RNA, 63 nt, Human
ggcuucagggaccccagaagugccuuccaagcuucccccaagauccacaucacccacgacccu

SEQ ID NO: 69092 - RNA, 63 nt, Human
uuuccugauucuuuggcuuguuaaucgagaauaucccccaaaucacuugucucuguuccucag

SEQ ID NO: 69093 - RNA, 63 nt, Human
ggucggaacucuuuaggccucuggccuccacccucccccaacagcagggaugggucagguggc

SEQ ID NO: 69094 - RNA, 63 nt, Human
augccuccaccuagaagcugaauagugacgcccucccccaagcccacccagccgcacacaggc

SEQ ID NO: 69095 - RNA, 63 nt, Human
gcagcugccccucucccugccaaagaggagucaucccccaaaaagacagagggggagccccaa

SEQ ID NO: 69096 - RNA, 63 nt, Human
gucaccuguugucgggaggggagccacuccuucucccccaacucccagcccugccuguggccc

SEQ ID NO: 69097 - RNA, 63 nt, Human
cucccuuuccccucuucccugucuuccccaccuucccccaacuacccgggccugacccggccc

SEQ ID NO: 69098 - RNA, 63 nt, Human
aauugcugcucuguugcugugccuagucuagugucccccaaagcaucggggggccacgcaagu

SEQ ID NO: 69099 - RNA, 63 nt, Human
cuggccagcccucaccucuucuggauagaggauucccccaacuccccaacuuucuccaugagg

SEQ ID NO: 69100 - RNA, 63 nt, Human
uauuuugacaccaaauuaugguguagacagcccucccccaaccccaggccagucaggcacaau

SEQ ID NO: 69101 - RNA, 63 nt, Human
aaccagcaguucuugucuggggagcucagaacaucccccaaucucuuacagcucccuccccaa

SEQ ID NO: 69102 - RNA, 63 nt, Human
ccagguuccugggcuccccuucucucuaccuucucccccaacgucugucccauccauauuugu

SEQ ID NO: 69103 - RNA, 63 nt, Human
cagccccgccugacauggaacagaacggagccaucccccaagacccuguccaaggcccagaug

SEQ ID NO: 69104 - RNA, 61 nt, Human
gccugucuacaccccgcugagcccaaaugugucccccaacuucaucuggaaguuaaaguga

SEQ ID NO: 69105 - RNA, 63 nt, Human
gcgagcaaauccuggcaagugacccagcucuucucccccaaacccacgcguguucugaaggug

SEQ ID NO: 69106 - RNA, 63 nt, Human
agaggccguuaggcaggcacccccuauuccugcucccccaacuggaucagguagaacaacaaa

SEQ ID NO: 69107 - RNA, 63 nt, Human
aauaacuugccuucuaaaugaucaauuuacuucucccccaauuuuaaagaaguauguguauau

SEQ ID NO: 69108 - RNA, 63 nt, Human
agggggcaagaggaauuacgugcucugugggucucccccaacgcgccucgccggaucugaggg

SEQ ID NO: 69109 - RNA, 63 nt, Human
cuggugugggucuuuuggcugcuuuucaaggugucccccaauguggcccucaagagccauccc

SEQ ID NO: 69110 - RNA, 63 nt, Human
uauaauacucuuuaggcaggagcacucuugccuucccccaaaauuuacacugcuaaagcccuc

SEQ ID NO: 69111 - RNA, 63 nt, Human
caggaaggggcuggccucugcugagcugggucuucccccaacagaacuauuucuugcugcuca

SEQ ID NO: 69112 - RNA, 63 nt, Human
gguaccagaggaaagcuggcagcaggcgccuccucccccaacgcaucccagccagugccaugu

SEQ ID NO: 69113 - RNA, 63 nt, Human
uauuuaacauguaaaaaugucccccccgcuccgucccccaaacauguuguacauuucaccaug

SEQ ID NO: 69114 - RNA, 63 nt, Human
ucagcugcuggcagccugccuggcccauagacaucccccaaguagucucaggccucugacaug

SEQ ID NO: 69115 - RNA, 63 nt, Human
augauuucccaccgagcgauuacgagaaccucuucccccaauaguagacacaucuccaauaca

SEQ ID NO: 69116 - RNA, 63 nt, Human
ggaguugcguguguuuuucuuaauugaaagacuucccccaaaaggaaguggucuuuucacuac

SEQ ID NO: 69117 - RNA, 63 nt, Human
gccuuuggcugagagggcuaccugcccagccccucccccaacaagaucucuuggacucaggcc

SEQ ID NO: 69118 - RNA, 63 nt, Human
ugauggccaagaacaccgugugggauuuuuuuuucccccaaggauuuucacacacggaaggag

SEQ ID NO: 69119 - RNA, 63 nt, Human
cgaggguccuggcuccugaggggcaucugccccucccccaacccccaccccacacuuguucca

SEQ ID NO: 69120 - RNA, 63 nt, Human
ggcaggggugguggguaccagagaaugcugccuucccccaagccugccccucugccucauuuu

SEQ ID NO: 69121 - RNA, 63 nt, Human
uccauauccucucuugccagcuuuuucccgugcucccccaacuauguaucagauaagauucuu

SEQ ID NO: 69122 - RNA, 63 nt, Human
ucagccaagaguucucuuuauucccuuugauccucccccaaggugagggcuuaggcagcugua

SEQ ID NO: 69123 - RNA, 63 nt, Human
gcugacauauaugaauacuggcuucuaagacccucccccaacagucugaccuuggcaguuccu

SEQ ID NO: 69124 - RNA, 63 nt, Human
acgcguuucccccgcggacccccuuuccugcccucccccaacccucccuuggcggcuggacgg

SEQ ID NO: 69125 - RNA, 63 nt, Human
ugcucacacuacuugagaaaaugcaggagagcuucccccaaggcugaugcauucccggugcag

SEQ ID NO: 69126 - RNA, 63 nt, Human
ccuuuguguccauugaugucauucagcagucagucccccaauaauccuuaaacuagcuaaaac

SEQ ID NO: 69127 - RNA, 63 nt, Human
gacagccccagccaccaccuucagccuagccugucccccaaggauggugaagcucagcagggg

SEQ ID NO: 69128 - RNA, 63 nt, Human
ugcccccaguguccucugauccuguccggugccucccccaacccccacacccaugcagaacuc

SEQ ID NO: 69129 - RNA, 63 nt, Human
auguguauuucauuuauuuauggcccaccagucucccccaaauuaguacagaaauauccauga

SEQ ID NO: 69130 - RNA, 63 nt, Human
uccgguuccccaaagcccugcugcauucgagugucccccaaccccgggcagguggcaccuggu

SEQ ID NO: 69131 - RNA, 63 nt, Human
uugugcugaaagguuuucucgggguccguggugucccccaaaggugccaccgugcgggucucc

SEQ ID NO: 69132 - RNA, 63 nt, Human
aauccagaagagagaaauguuucacgcaagcagucccccaacucccaacacacacucccuuuc

SEQ ID NO: 69133 - RNA, 63 nt, Human
aggugaugggccgguuuugugagaugaauuguaucccccaaaaagacagguaccuucaaugug

SEQ ID NO: 69134 - RNA, 63 nt, Human
aauuuaauuucugaaaagcaccauuagcccauuucccccaaauuaaacguaaauguuuuuuuu

SEQ ID NO: 69135 - RNA, 63 nt, Human
ggagcacaggccacagagcgcagccucugggggucccccaaggcacagcauauacagcauggu

SEQ ID NO: 69136 - RNA, 63 nt, Human
ugggguggccagguggggcgggaccccagcaccucccccaacugacccuggacguccaggugg

SEQ ID NO: 69137 - RNA, 63 nt, Human
cucucuguccuggccagggguggacaacuggggucccccaaaacucaguccuggcaccucaac

SEQ ID NO: 69138 - RNA, 63 nt, Human
ugucauucuccugggaagcccagucucagucccucccccaacacuguccacacugccccuccc

SEQ ID NO: 69139 - RNA, 63 nt, Human
gaggacaaaguguguaaagcccgucugcugucuucccccaaauccucagcucagagccuuccg

SEQ ID NO: 69140 - RNA, 63 nt, Human
agccaucgcugaucucccgcgcagaccguuguuucccccaaggccucacccugagcacugggc

SEQ ID NO: 69141 - RNA, 63 nt, Human
auauauauagcugacuggaagagauuaauuucuucccccaacuucuugcauguugaagauauu

SEQ ID NO: 69142 - RNA, 63 nt, Human
cucuggggaggugcugaccccucagaaaccccuucccccaacuugaccccaggcugaacagac

SEQ ID NO: 69143 - RNA, 63 nt, Human; identical to SEQ ID NO: 68906

SEQ ID NO: 69144 - RNA, 63 nt, Human
ccucagcugucccuccuucuacccaagguggagucccccaaagucccuucugucuggccuauc

SEQ ID NO: 69145 - RNA, 63 nt, Human
aauggaagcuuuacauagaaccuuagguagaacucccccaaaucgccauauuuaaaaauuauu

SEQ ID NO: 69146 - RNA, 63 nt, Human
augccauauacgaaaggaaaaagggcaggggguucccccaaacuuucgaaguaggcccuggca

SEQ ID NO: 69147 - RNA, 63 nt, Human
ggaaggguauaaaugcauguuccugaggugcccucccccaaagaauguaccugcacucaaacc

SEQ ID NO: 69148 - RNA, 63 nt, Human
ugaaugaugguuucaugagucacaagcaagcguucccccaacugcugagucugugggauuaag

SEQ ID NO: 69149 - RNA, 63 nt, Human
ccccccaguucacgauucuggcgcggacuucgcucccccaagacaacacucggaagccagggc

SEQ ID NO: 69150 - RNA, 63 nt, Human
ucucggaacccuggcgucucuccaccagccagaucccccaaucccagauccgcauguucgacc

SEQ ID NO: 69151 - RNA, 63 nt, Human
caaugagaugcaugauuuuguuuucaucccauuucccccaagccccuguaaaucagggaaaau

SEQ ID NO: 69152 - RNA, 63 nt, Human
agcgccugugcuguggucuuauccuauguggaaucccccaaagucucugguuuaauucuuugc

SEQ ID NO: 69153 - RNA, 63 nt, Human
uucccugccaguuuucucauuuauuacagccuaucccccaacccuaccccugugcccugccua

SEQ ID NO: 69154 - RNA, 63 nt, Human
agaaacugccacauacaccacaaaaaccaaacaucccccaaugaccuuagccccauugcucca

SEQ ID NO: 69155 - RNA, 63 nt, Human
guucuuuuguuguaaagaguuguguuguucuuuucccccaaagugguuucagcaauauuuaag

SEQ ID NO: 69156 - RNA, 63 nt, Human
cucugaucacuccaucccucuccuaccccucccucccccaacccucaauguauaaauugcuuc

SEQ ID NO: 69157 - RNA, 63 nt, Human
acuuuaggcccaaaguuucuuauguaucacacaucccccaaauaagugauuuuuucccagugc

SEQ ID NO: 69158 - RNA, 63 nt, Human
aacauauccguauauauccccucuacucuuacuucccccaaauuuaaagaaguaugggaaaug

SEQ ID NO: 69159 - RNA, 63 nt, Human
acauauacaugagaacuuagacacaagggaccaucccccaaacucuacucuuauacccagaaa

SEQ ID NO: 69160 - RNA, 63 nt, Human
agggugccagaugccugggucucccaagaggggucccccaacucaccguucccgggacaggcu

SEQ ID NO: 69161 - RNA, 63 nt, Human
aacgaggagcgccuccgggcccccccgcccccgucccccaaccagaacaacaacgccauagac

SEQ ID NO: 69162 - RNA, 63 nt, Human
gcagugugggcaccugguggccaagccucaguuucccccaaaugagcaaaggggauaaagagg

SEQ ID NO: 69163 - RNA, 63 nt, Human
acacuuucuccucaccagaugccaguugcacccucccccaaguugagacaaccaaaaaugucu

SEQ ID NO: 69164 - RNA, 63 nt, Human
cacgugcccccuagccuuacugggaaccuucugucccccaagauccccugugcuaucaggaaa

SEQ ID NO: 69165 - RNA, 63 nt, Human
ucaagccaauuuuuuuuguuucuucauuuccccucccccaauccaugaaagccuaaauguaaa

SEQ ID NO: 69166 - RNA, 63 nt, Human
ccacuuucuggggaucauuuugauguugaauguucccccaaagcauucugacaaguuuggucc

SEQ ID NO: 69167 - RNA, 63 nt, Human
ucaugaugauuuuuaacaugcauuuugcaugcaucccccaauaagaagagaugagacucggcc

SEQ ID NO: 69168 - RNA, 63 nt, Human
ucccacaauagccccaauguuugccuauccaccucccccaagccccuuuaccuaugcugcugc

SEQ ID NO: 69169 - RNA, 63 nt, Human
ggaaaagggacugugcauugaguugguuccugcucccccaaaccauguuaaacguggcuaaca

SEQ ID NO: 69170 - RNA, 63 nt, Human
ccuugggaaucugcaagaaccuccccuuucccuucccccaauaagaccauuuaaguguguguu

SEQ ID NO: 69171 - RNA, 63 nt, Human
cagauuuccuucccuuggaugcuuucgguccccucccccaaccccucccccuggggcuggccu

SEQ ID NO: 69172 - RNA, 63 nt, Human
agggcugcugguuuccgcagccacugcuccaccucccccaaaucgucauggaaaggguggaga

SEQ ID NO: 69173 - RNA, 63 nt, Human
gaauuucagagcugauguguucaccugggcagaucccccaaauccggaagucaaaguucucau

SEQ ID NO: 69174 - RNA, 63 nt, Human
caaaagacacaggggacacccagaaacgccacaucccccaauccaucagugccaaacuagcca

SEQ ID NO: 69175 - RNA, 63 nt, Human
ccacccaccuagcacuccucucauuuuugcugcucccccaaaagccagcgcuguucuacaaua

SEQ ID NO: 69176 - RNA, 64 nt, Human
aaccuaggucuuagguacauccuaaagggagcacagaacccaucauuucacacauaggcucuga

SEQ ID NO: 69177 - RNA, 64 nt, Human
gcuuggggcuggccaauggggagcuggauugagcagaacccagacccugaguccuugggccagc

SEQ ID NO: 69178 - RNA, 64 nt, Human
caggccucaagcguggagggguagagugaagaguagaacccaggucugaugccaaagcugcuuu

SEQ ID NO: 69179 - RNA, 64 nt, Human
uuccagcagagccaggccagccuccuccacaugcagaacccacccuuugagccaacuagugugg

SEQ ID NO: 69180 - RNA, 64 nt, Human
gccuuggagcucugugucaaggccuuugaggcccagaacccagaccccaaagcgccuguggugc

SEQ ID NO: 69181 - RNA, 64 nt, Human
uucacuaggcccccuagcuacaccuggaaguuucagaacccacuuuggggggccuccugccugg

SEQ ID NO: 69182 - RNA, 64 nt, Human
uugucaacaagaauguuaacugaugaaaguggauagaacccauacaugaauuaaaugaugcaca

SEQ ID NO: 69183 - RNA, 64 nt, Human
caccugccauuaccuucagggccuccucuggaagagaacccauucucagagugcagccagggag

SEQ ID NO: 69184 - RNA, 64 nt, Human
agccaagccuuaacugccugccugacccugaaccagaacccagcugaacugccccuccaaggga

SEQ ID NO: 69185 - RNA, 64 nt, Human
aauaaugaauacagucacugguaagggagaaccuagaacccaguagguguauauuuucaggaaa

SEQ ID NO: 69186 - RNA, 64 nt, Human
ugagacucuucccccugacucccccauuguguuaagaacccagcaacccaggagccuaguacaa

SEQ ID NO: 69187 - RNA, 64 nt, Human
ugcaaaagaaaagucuagguuuuaaggcugugccagaacccaucccaauaaagagaccgagucu

SEQ ID NO: 69188 - RNA, 64 nt, Human
uguccuuuacaccaccuucucaacacugcugaaaagaacccaagagaauugucacacaugacac

SEQ ID NO: 69189 - RNA, 64 nt, Human
cauuuuuguucuuuacuccuaaguuauuucucauagaacccagccuacucuagaauuucagcag

SEQ ID NO: 69190 - RNA, 64 nt, Human
ggcauagguuucaggggccuccuuuguugucaucagaacccagaggaauucuucuccuaaaaaa

SEQ ID NO: 69191 - RNA, 64 nt, Human
aggagguaggauauuuuauauucugccgcaggauagaacccacgcaaggauuuucuuuaaauug

SEQ ID NO: 69192 - RNA, 64 nt, Human
gaaaaaagggaagggggagaggggcuggucagggagaacccagcuugggcagagugcaccugag

SEQ ID NO: 69193 - RNA, 64 nt, Human
gcuggaagagaggcgccuccuggccuggcucugcagaacccaggggcacgcucugggccugggc

SEQ ID NO: 69194 - RNA, 64 nt, Human
gggaaugcuuccgagcacgcuguaggguaugggaagaacccagcaccacuaauaaagcugcugc

SEQ ID NO: 69195 - RNA, 64 nt, Human
cuggaggucaucuggcggaggucucugggagcccagaacccacauaaaagccccagcuuggcuc

SEQ ID NO: 69196 - RNA, 64 nt, Human
guacaggggcuggggucagggaaggaagaucuaaagaacccacugugggucaggggaaugggac

SEQ ID NO: 69197 - RNA, 64 nt, Human
uacagggguggggcagaaggaaaggggacaagauagaacccaggaugugaggguggggguggag

SEQ ID NO: 69198 - RNA, 64 nt, Human
ugcagaacucggcaaggggcagcuuacccuccccagaacccaggaucauccugucuggcugcag

SEQ ID NO: 69199 - RNA, 57 nt, Human
aagaagugucugacagcuagcaaacuaagaacccaaacuauugauacacgguuuccu

SEQ ID NO: 69200 - RNA, 64 nt, Human
ccaggcaaugccagcauuucaugggggcugaggcagaacccaggagcuccaagaaaggccaccc

SEQ ID NO: 69201 - RNA, 64 nt, Human
ccaggugacucugugaggucugcagagggagaaaagaacccacaagggaagagguggaggucag

SEQ ID NO: 69202 - RNA, 64 nt, Human
ucaacacacaaagugccaccaccuucccugacucagaacccacauccacucaaugugaacucua

SEQ ID NO: 69203 - RNA, 64 nt, Human
caagaucagagggguucauuauaccccuggcuagagaacccagcuacugacaugcaagcagcuu

SEQ ID NO: 69204 - RNA, 64 nt, Human
ugaaauuucaacuacauacaaggaggagaaaauaagaacccagucauaacagaggaauucuaua

SEQ ID NO: 69205 - RNA, 64 nt, Human
caugccacaucacuccaaccugggcaacagaacaagaacccaucucaaacaaacaaacaaacaa

SEQ ID NO: 69206 - RNA, 64 nt, Human
cugacuggauguucucagccccuuguucugggcaagaacccagagcuccccaguguggauacua

SEQ ID NO: 69207 - RNA, 64 nt, Human
cagcuuacacugucaggauucaguugcagauuaaagaacccaucuggaaugguuuacagagaga

SEQ ID NO: 69208 - RNA, 64 nt, Human
uauagaugagacagagcucugcggugucagggcgagaacccaucuuccaaccccggcuauuugg

SEQ ID NO: 69209 - RNA, 64 nt, Human
ugccacaucccaucucauccuggccucugagucaagaacccagugaacugacuuucuaguucua

SEQ ID NO: 69210 - RNA, 64 nt, Human
cuccuccuacaaauauuauuggaugauaggcccuagaacccaauaaaggagcuccaaaugucgu

SEQ ID NO: 69211 - RNA, 64 nt, Human
auggcuccuuauaccaaagaugcuggcacauagcagaacccagugcacguccuccccuucccac

SEQ ID NO: 69212 - RNA, 64 nt, Human
gacauccuccccagcucaagucuauucuuaccauagaacccagggcagggagagaagaaccuag

SEQ ID NO: 69213 - RNA, 64 nt, Human
ugucgugccagcaccauuccuggucacgcaaaacagaacccaguuagcagcagggagacgagaa

SEQ ID NO: 69214 - RNA, 64 nt, Human
gauucccaagucuuugucuuggcuuaaucccuaaagaacccaguucugcugguaucgaauaguu

SEQ ID NO: 69215 - RNA, 64 nt, Human
uaccaaagagcgaagucagugccacugaaaauacagaacccauuaauaucguggcuaucugauu

SEQ ID NO: 69216 - RNA, 64 nt, Human
caaauggagccauucugauucugacaaaaaguccagaacccauaaacauagcccagagaagaga

SEQ ID NO: 69217 - RNA, 64 nt, Human
uggcacauuuacuucugguaagcauaaagcagagagaacccagguuagaaggaugggaagagaa

SEQ ID NO: 69218 - RNA, 64 nt, Human
cagcuuauaccacccaguguucagggaucucugaagaacccacagaccaggugaauuacugauu

SEQ ID NO: 69219 - RNA, 64 nt, Human
cccagaacuucaagaugagccugggcucauagugagaacccaucuauacaaaaaauuuuuaaaa

SEQ ID NO: 69220 - RNA, 64 nt, Human
guugcuucuauuggccuaaacccacuacugccaaagaacccagcaacaaaccucccggcuagga

SEQ ID NO: 69221 - RNA, 64 nt, Human
cagaaguuagcauccugggccaguuuguucucucagaacccagaaucuuugaggguaagguuau

SEQ ID NO: 69222 - RNA, 64 nt, Human
uauuggcacgaagauacuuguuuuaaguuccuugagaacccaugauggacaguugacagaaugc

SEQ ID NO: 69223 - RNA, 64 nt, Human
ggaacaguuuaccucauuguagguagggaacaagagaacccaucuauuaaaauugccuuagauc

SEQ ID NO: 69224 - RNA, 64 nt, Human
gguaagaguuucaguuuguuggaaaguaacugugagaacccaguuucccguccaucucccuuag

SEQ ID NO: 69225 - RNA, 64 nt, Human
gcccaggaaaagacuuaacugugaaaaaguacugagaacccaccugacccaggcuugccccaag

SEQ ID NO: 69226 - RNA, 64 nt, Human
agcuuguucacuguuagaaagaaacuaacaaaagagaacccagagcaaucuagaaucuuugagu

SEQ ID NO: 69227 - RNA, 64 nt, Human
ucuugagcacuugaacaaugacugaugugauugaagaacccaucuuucaauucaauuaaauuua

SEQ ID NO: 69228 - RNA, 64 nt, Human
acuucugccugugggucugaggaagggagaaggcagaacccauaggcagucccugggcaaggga

SEQ ID NO: 69229 - RNA, 64 nt, Human
cucauaguugguugcuagccuaaaacaucagaauagaacccaaagggcuuaggaaggccugcca

SEQ ID NO: 69230 - RNA, 64 nt, Human
aggccacugaagaugguaggcaggauucuuuccaagaacccaaacugccuuugccucagcuuua

SEQ ID NO: 69231 - RNA, 64 nt, Human
cacaugaaaggaauacauggggaagaaauaaaguagaacccaagaguucuuuuaaguuuucuuu

SEQ ID NO: 69232 - RNA, 64 nt, Human
cagggaggugacccgaauuauaaaggccagcgccagaacccagauuuccuaacucuggugcucu

SEQ ID NO: 69233 - RNA, 64 nt, Human
uugcagaugucuagcagcuucagacauuugguuaagaacccaugggaaaaaaaaaauccuugcu

SEQ ID NO: 69234 - RNA, 64 nt, Human
uguuccuaaagcuugcccuuugaguauuaucuggagaacccaagcugucucuggauuggcaccc

SEQ ID NO: 69235 - RNA, 64 nt, Human
cuucugccccacuucaaauuacaagauuauggggagaacccaauuagguaggaaacaugaaaaa

SEQ ID NO: 69236 - RNA, 64 nt, Human
cugagguugcuuagauaauaaaagaaucuggauuagaacccagaccuacccagcuaaacaacug

SEQ ID NO: 69237 - RNA, 64 nt, Human
uaaagccguuuuuuauuuuuuucuaaauaaaaagagaacccaugcuuuuauggacacuagguaa

SEQ ID NO: 69238 - RNA, 64 nt, Human
uacuugauguuacauuauucccagguuuaaugaaagaacccaacuuaguuuuucagugaauuug

SEQ ID NO: 69239 - RNA, 64 nt, Human
agacacuauaccaaaauaccaagcaacuguuuugagaacccagacuuaaaauuuuauguauuau

SEQ ID NO: 69240 - RNA, 64 nt, Human
uuaaaaacaaaaauaaaaacaaaaccacacaaggagaacccaauuuuguuucaacaauuuuuga

SEQ ID NO: 69241 - RNA, 64 nt, Human
ggaugccacaguaguauguaaaacccaaacaaguagaacccaagcaaauaaaauuauuuaaaau

SEQ ID NO: 69242 - RNA, 64 nt, Human
gaucgucagcgcuaagggaacugagaccagagaaagaacccaagagaacuacaguuaugucagc

SEQ ID NO: 69243 - RNA, 64 nt, Human
uuguuugaugcucuucauggcucaucugcuucucagaacccacccguugaguuuguggguaacc

SEQ ID NO: 69244 - RNA, 64 nt, Human
uuuagaaaucacaacaaacugaauuaaacaugaaagaacccaagacaucauguaucgcauauua

SEQ ID NO: 69245 - RNA, 64 nt, Human
cuuuacucaugacauuucgcagugcagagaaggcagaacccaagaaaaacgucaucuuugagac

SEQ ID NO: 69246 - RNA, 64 nt, Human
agaggacaugcuaauauuuuguaaagcugggaccagaacccaaguacugguacuugcuuugugu

SEQ ID NO: 69247 - RNA, 64 nt, Human
uuuauaacucauggcaggcaucuguaagaaguagagaacccagaugaucucuuaggaagccuuu

SEQ ID NO: 69248 - RNA, 64 nt, Human
agagcuggccaccagcacaggcuuagggcaguucagaacccacuuguuucccuaucagagggac

SEQ ID NO: 69249 - RNA, 64 nt, Human
uuaaaaaucaguaagaaaaaugucuugagcuagaagaacccauagaggaagauuuuguaaugcg

SEQ ID NO: 69250 - RNA, 64 nt, Human
caaagguagcauuauuaaauagcaaagaauaauuagaacccacauaucuuuuuuuguguggaug

SEQ ID NO: 69251 - RNA, 64 nt, Human
uuuggacuggacuguugcugagccuguguccugcagaacccagaugucuguuaggcuggcuggc

SEQ ID NO: 69252 - RNA, 64 nt, Human
uccugugaacacuggagucuugcaagacccagggagaacccacugcuuuucccaggaggcucca

SEQ ID NO: 69253 - RNA, 64 nt, Human
uguaccaagcagacugggcccuaagaccccuggcagaacccagccucugcucacacccgcccca

SEQ ID NO: 69254 - RNA, 64 nt, Human
cgcggggugugagguggauacuuugaacauucugagaacccaauaaaacuagaaggagccagcu

SEQ ID NO: 69255 - RNA, 64 nt, Human
gagaccaaggcgcagggugcuucagaugagcaagagaacccagucgaaccagauaccccaggug

SEQ ID NO: 69256 - RNA, 64 nt, Human
agaaauagaugugagaaugguggaacuuuuuaaaagaacccagucaaauguauuuucugcugaa

SEQ ID NO: 69257 - RNA, 64 nt, Human
uacccacauuccccaaucaauacacacacacugcagaacccagaacagaaggccacaggcuggc

SEQ ID NO: 69258 - RNA, 64 nt, Human
acucaguuaaguuguucuguuugggaccuggaaaagaacccaaagaaaaccugaguggacaggu

SEQ ID NO: 69259 - RNA, 64 nt, Human
ggacuagaggcucaguggugggagagaucccugcagaacccaccaaccagaacgugguuugccu

SEQ ID NO: 69260 - RNA, 64 nt, Human
cguggggcccgucagccuggucccacccccauggagaacccaaagucuuacuguauauaacucc

SEQ ID NO: 69261 - RNA, 64 nt, Human
caaaauacauagaaguauuauuugccuucauaauagaacccaagagucuguuucaauuuaugaa

SEQ ID NO: 69262 - RNA, 64 nt, Human
guuuuauuuugcuucuuggucaagaaaggaggggagaacccagcgcaccccucccccccuuuuu

SEQ ID NO: 69263 - RNA, 64 nt, Human
cguucuuuuccacccuguuucuucccccauaggaagaacccaccuguagcccugagguucuuuu

SEQ ID NO: 69264 - RNA, 64 nt, Human
cagagauccugaaauucugacuugcugcuauuccagaacccagccuccuggguuuccccagucc

SEQ ID NO: 69265 - RNA, 64 nt, Human
uggggagaaggagaggcugaaaagaaagcagaggagaacccaggucccugccucagccuucagc

SEQ ID NO: 69266 - RNA, 64 nt, Human
uucuaccacucuuaaauuuacucccuccccacccagaacccagaugggguggagggggccaccg

SEQ ID NO: 69267 - RNA, 64 nt, Human
uccaugcaccucccuucccucccugaggcaggugagaacccagagagaggggccugcaggugag

SEQ ID NO: 69268 - RNA, 64 nt, Human
ucaaguaaguucauuuccaucugcucagggcaccagaacccacauagacagccugugcuauuga

SEQ ID NO: 69269 - RNA, 64 nt, Human
uucucaggcaggcaguucugcuucagcuuagagcagaacccauaaaauacucaaguacugggau

SEQ ID NO: 69270 - RNA, 64 nt, Human
ugugucuuugaaguugguaauauagcuuuuaaggagaacccaugaauaaccugauuugggcagu

SEQ ID NO: 69271 - RNA, 64 nt, Human
gaaguaaagagcuuuccgggaggccaauuuggaaagaacccaaaggcucuuuuaagagccaccc

SEQ ID NO: 69272 - RNA, 64 nt, Human
gcuauaaauguagucuguugcauuuuuaaccaacagaacccacaguagaggggucucaugucuc

SEQ ID NO: 69273 - RNA, 64 nt, Human
gcgcagcaggcaccuccagaaagguaaugguggcagaacccacaguggagucgaccuaggccuu

SEQ ID NO: 69274 - RNA, 64 nt, Human
uggugaugcaucuaacaccuuuugcugcucacugagaacccagcuuugaacuuacaagauuaca

SEQ ID NO: 69275 - RNA, 64 nt, Human
gagggaaaccuuuggcuacacaauuggaagucuaagaacccauggaaaaaugccaucaaaugaa

SEQ ID NO: 69276 - RNA, 64 nt, Human
ccuuuaguuauaacucagccuuuaggaacaccggagaacccacaauaauagaaaucuuuucgug

SEQ ID NO: 69277 - RNA, 63 nt, Human
ucuucucuuggcagguuugagacaguuccagaaagaacccaagcucaagacgcaggacgagcu

SEQ ID NO: 69278 - RNA, 64 nt, Human
ucgauggugucacguuggggaacaaguguccuucagaacccagagaaggccgccguucuguaaa

SEQ ID NO: 69279 - RNA, 64 nt, Human
aacaggcccuggggugcagaggcccggcacguagagaacccagauagacgccggugguggaacu

SEQ ID NO: 69280 - RNA, 64 nt, Human
accuuacgcuucuagaagcagagccacuccagccagaacccauuuugcagucuucucuucgcuc

SEQ ID NO: 69281 - RNA, 64 nt, Human
auggauggaugcggacgauggaaccguucaguaaagaacccaagguugagugcaacugggguug

SEQ ID NO: 69282 - RNA, 64 nt, Human
cuaaucuuaaaaauacaauuucuaagcacuuguaagaacccaguggguuggagccucccacuuu

SEQ ID NO: 69283 - RNA, 64 nt, Human
cuaaacuugaccugcuuaauacauucuagggcagagaacccaggaugggacacuaaaaaaaugu

SEQ ID NO: 69284 - RNA, 64 nt, Human
auuuuaaagcuaaacaauggagaaggguuugagaagaacccaacaaugugggagugcuacagca

SEQ ID NO: 69285 - RNA, 64 nt, Human
ccagcagucuacaggcuggaagaaggcccucaccagaacccaacccuuggacuucagccuccag

SEQ ID NO: 69286 - RNA, 64 nt, Human
cagacagaggcauaauaaagugacugauguuuacagaacccaaaugaugucuuccucucucuca

SEQ ID NO: 69287 - RNA, 64 nt, Human
gacaaagugaauuaggguuggcauuccuagcagaagaacccacuuccugcuuaguugagauagu

SEQ ID NO: 69288 - RNA, 64 nt, Human
ggauugcacaguauguuacaauacaauuucaaagagaacccacauuugugagauuuacagacca

SEQ ID NO: 69289 - RNA, 64 nt, Human
aacuuagguuguugccaacaggguccuuuuaggcagaacccagaaaccagucaaaucuguagag

SEQ ID NO: 69290 - RNA, 64 nt, Human
uccuggguggggcagcggcugcagggcgcaccagagaacccagccagagggguugugaguacca

SEQ ID NO: 69291 - RNA, 64 nt, Human
acuuacuugccucacuggacucuuuauccuuagaagaacccaagaaauuauaaauaaauaucuc

SEQ ID NO: 69292 - RNA, 64 nt, Human
uaggcucuuugucaucuuauaggaaaauauaugaagaacccaucauuuuaucgagagaaccuuc

SEQ ID NO: 69293 - RNA, 64 nt, Human
uucaaacuuggauuuugaacugcagaccuguaugagaacccaaugucauaggaaauaugguuug

SEQ ID NO: 69294 - RNA, 64 nt, Human
aaaagaacacagauauuugcugcuuuuaagauagagaacccaaaguuuuguaccugguuauuuu

SEQ ID NO: 69295 - RNA, 64 nt, Human
acguggugggacuccagcucguguguccucauggagaacccaggggacagcuggugcaaauuca

SEQ ID NO: 69296 - RNA, 64 nt, Human
caauuuuuuucuaggaaaguuaaaagaauaaaucagaacccagggcaacaaugccauuucaugu

SEQ ID NO: 69297 - RNA, 64 nt, Human
gauuucuagccagaggucccagaugccugggcugagaacccagcgauaagggggcguucccaaa

SEQ ID NO: 69298 - RNA, 64 nt, Human
gaaagacuggacccccauugcuuucauuguucagagaacccaggagacaugaagaugaccagac

SEQ ID NO: 69299 - RNA, 64 nt, Human
augccagccacguccuccgccacuuggagagaugagaacccaguggggucacguaaaggaauug

SEQ ID NO: 69300 - RNA, 64 nt, Human
ggccagcguaggagucauugacaacaaaaagccgagaacccagggccagcaguggagccucagc

SEQ ID NO: 69301 - RNA, 64 nt, Human
aagggacaggaggacagggguucuccuucaccacagaacccaaaccucaggucucaccccugug

SEQ ID NO: 69302 - RNA, 64 nt, Human
cgaggccuggccuuucccucuccugcugagaaccagaacccaccaggagcaccacagaguccuc

SEQ ID NO: 69303 - RNA, 64 nt, Human
uggcacagugcuuggggucuaguauguagcuuccagaacccacccugccccucuaccugggagg

SEQ ID NO: 69304 - RNA, 64 nt, Human
augccaacccccaccccguuucccuggugcccagagaacccaccucucccccaagggccucagc

SEQ ID NO: 69305 - RNA, 64 nt, Human
gccacaggcucugucuuuuggggaauccaggauaagaacccauuauacagaaguguucaauaau

SEQ ID NO: 69306 - RNA, 64 nt, Human
cucaaaagagaauauaucuuucacauucacauucagaacccagcaaccuggaguccaauuuuca

SEQ ID NO: 69307 - RNA, 64 nt, Human
aggaaacaguucucacugggaagaagcaagggcaagaacccaagugccucaccucgaaaggagg

SEQ ID NO: 69308 - RNA, 64 nt, Human
gacagguuuucacauaaaugcagcccauuucuccagaacccauuugagggguggggggguguua

SEQ ID NO: 69309 - RNA, 64 nt, Human
cagauccgacuucuccuaugugucacuuauuccaagaacccaacuaugcccuuagguagaaaga

SEQ ID NO: 69310 - RNA, 64 nt, Human
cuuaaguggcuuccaauuuuuggccaugaggaagagaacccacgaacauuccuggacuugucuu

SEQ ID NO: 69311 - RNA, 64 nt, Human
ccuugcagggaacagcuuuggggcugggggaacuagaacccacauguuggucuaaacccugaga

SEQ ID NO: 69312 - RNA, 64 nt, Human
agcaaauaacuugcucaaagccacauagcugcucagaacccaagauuguaagcucccccuaggg

SEQ ID NO: 69313 - RNA, 64 nt, Human
gcacgugcacauguacaccugagccaaaaacacgagaacccacugaucucaccacuggggcaag

SEQ ID NO: 69314 - RNA, 64 nt, Human
aaaugaaaagagagacagagagaaaaaaaaaaagagaacccacaugaagcucugaaaccaaaca

SEQ ID NO: 69315 - RNA, 64 nt, Human
uugcccugucugcucacuucuagcuauuuaagagagaacccagcuugguucuuuuuugcuccaa

SEQ ID NO: 69316 - RNA, 64 nt, Human
gaugauaaaaaaaaauaacaacuagggacaauacagaacccauuccauuuaucuuucuacaggg

SEQ ID NO: 69317 - RNA, 64 nt, Human
ugccaggaccuaauguucuuaggucccucuggccagaacccacacccggccccuucccaccugu

SEQ ID NO: 69318 - RNA, 64 nt, Human
uauggcauaauuuugaauaucauggacaauauuuagaacccaaauuuuggagugcuugggcaga

SEQ ID NO: 69319 - RNA, 64 nt, Human
uucucacauucuguauacuguauccauuuucuagagaacccaguagcuuuuauacagucucuuc

SEQ ID NO: 69320 - RNA, 64 nt, Human
agggagccgagacccuggauggggcuuccagcucagaacccaucccucugguggguaccucugg

SEQ ID NO: 69321 - RNA, 64 nt, Human
uuucccucugcccaccaaguccucauaucugcagagaacccauugaucaccuugugcccucuuu

SEQ ID NO: 69322 - RNA, 64 nt, Human
ccucagguaaaauuuaggacccugcuagcugugcagaacccaauugcccuuugcacagaaacca

SEQ ID NO: 69323 - RNA, 64 nt, Human
gacaauaaaugagucagaugagcaagaaggccccagaacccaugccccaaggcacaaagaggag

SEQ ID NO: 69324 - RNA, 64 nt, Human
gagugcuuccuuauggagcuggagcagcccgccuagaacccagucuaaugagaacuccagaaag

SEQ ID NO: 69325 - RNA, 64 nt, Human
ggcacuggcaagguagggggcagauggggcauggagaacccagaggaucuaggcccuguugggg

SEQ ID NO: 69326 - RNA, 64 nt, Human
aagguuguccccagaccuugcuugcagugguuggagaacccagggggcugccuugggcccucug

SEQ ID NO: 69327 - RNA, 64 nt, Human
cagucuguaucaaacccacgauuuucuccagcucagaacccagggcucugccccagucguuaga

SEQ ID NO: 69328 - RNA, 64 nt, Human
ucacugcgcugggaggugggcggggagcaucaccagaacccaggcgcugccccagcaccuucuc

SEQ ID NO: 69329 - RNA, 64 nt, Human
uucuuugaggacccaguggguauggaguauagacagaacccaggguugagaacagaaggugggc

SEQ ID NO: 69330 - RNA, 64 nt, Human
gccaagucccagagaaaacccuuuuacucuggggagaacccacugauggcucauuagaucuguc

SEQ ID NO: 69331 - RNA, 64 nt, Human
uggcagcucuaugaguagaaagucuucggaauuuagaacccaucuaugagagaaaguucaguca

SEQ ID NO: 69332 - RNA, 64 nt, Human
cugaugaugaaacugaugcuugagccccgaccguagaacccacgugccugagacaucugcugcu

SEQ ID NO: 69333 - RNA, 64 nt, Human
cuuauuggauuauuaguuauucagacagucaagcagaacccacagccuuauuacaccugucuac

SEQ ID NO: 69334 - RNA, 64 nt, Human
uuaagacucaccaggagaggucugagggccauucagaacccacuccugagugggugggugggug

SEQ ID NO: 69335 - RNA, 64 nt, Human
acccaaaucuaguucuuugaccaccucuaccaccagaacccagcagacacucacaucuccugau

SEQ ID NO: 69336 - RNA, 64 nt, Human
uagaagaggcaagugguagggaugaggucugauaagaacccaggguggagagggagacuccugg

SEQ ID NO: 69337 - RNA, 64 nt, Human
aauaaugguuuugguuaccugggaaggcaggcccagaacccauuuccuugacuugcaguuccgg

SEQ ID NO: 69338 - RNA, 64 nt, Human
aaugacuucuccaggcagaggcagaucugagucuagaacccaggcuucuaaauuucuaggccag

SEQ ID NO: 69339 - RNA, 64 nt, Human
gggcucagggcugcugccuuccuguccucuggagagaacccagccaggcgcggugccccuuccu

SEQ ID NO: 69340 - RNA, 64 nt, Human
cagggccaguaggagcaauaggauuuuaauaaacagaacccaucccaaagccaugacuacgaca

SEQ ID NO: 69341 - RNA, 64 nt, Human
ucugaaauuguuagugucucaguaauccugauuuagaacccaggcuuuuuguaacaauguguuu

SEQ ID NO: 69342 - RNA, 64 nt, Human
aagaaagaauuaagccuuaaaaaucuauugugcaagaacccaacuuuuacucaggagcugagaa

SEQ ID NO: 69343 - RNA, 64 nt, Human
aagcuccucagugagcugguguauaauccaggacagaacccaggucuccugacuccuggccuuc

SEQ ID NO: 69344 - RNA, 64 nt, Human
guuuuaaguugcuguggacacuuuuaagaaacuuagaacccauggaacccuuguuuaucgccau

SEQ ID NO: 69345 - RNA, 64 nt, Human
guuucugacccuuucugucggaguggucucugguagaacccaaggacuucuggguacugagaag

SEQ ID NO: 69346 - RNA, 64 nt, Human
augauuucuugauaauuguguaguaauguuuuuuagaacccagcaguuaccuuaaagcugaauu

SEQ ID NO: 69347 - RNA, 64 nt, Human
ucagguuucccacagcauggccccugcugacacgagaacccaaaguuuucccaaaucuaaauca

SEQ ID NO: 69348 - RNA, 64 nt, Human
gggccaaccccaguuggugaucccagcuggagggagaacccaaagagacagcucuucuacuacc

SEQ ID NO: 69349 - RNA, 64 nt, Human
acucucuuaaagaagguggggagcugcccagggcagaacccacugguguucaugacuaccccug

SEQ ID NO: 69350 - RNA, 64 nt, Human
aguucugcagcagucgcuauuagaugcucgugguagaacccaucaaucaucugguccucugggu

SEQ ID NO: 69351 - RNA, 64 nt, Human
uguuuugaggcuuucucagcuacuuggcucccacagaacccaaggcagguacacaaaggaccuu

SEQ ID NO: 69352 - RNA, 64 nt, Human
acuguccuguaggauauucucuuccugauggugcagaacccagaauuagaaguuugugguuaca

SEQ ID NO: 69353 - RNA, 64 nt, Human
augcaaagaaaaaauaaaaauuaucuauaaucucagaacccagaaauagccacuauuaacauuu

SEQ ID NO: 69354 - RNA, 64 nt, Human
aaaauauaugaaguaugcuuuguugauuauagugagaacccaugacauaguuaaccaaagaaua

SEQ ID NO: 69355 - RNA, 64 nt, Human
ucuuaauaaaggcugacaguucuguuggcagccaagaacccacaccaugaagacagggagugag

SEQ ID NO: 69356 - RNA, 64 nt, Human
gcugcuucgucuucuuuggaccuccugaaccgagagaacccagaggaacccccaccccaccccc

SEQ ID NO: 69357 - RNA, 64 nt, Human
ccauagccuuauggggagugagagagagggcacgagaacccaaagggaauagagauucuccagg

SEQ ID NO: 69358 - RNA, 64 nt, Human
cacuuuaccucugugguccuccuccccagaacucagaacccaagucugaucaggagaaaaacau

SEQ ID NO: 69359 - RNA, 64 nt, Human
aaguugcugaaguacuguacaggguuguacaaugagaacccaaugccaaggcaaaaagaacgag

SEQ ID NO: 69360 - RNA, 64 nt, Human
cacacguauccuaauuacccuccucuuccucagcagaacccauuugagauucuaaaugaauacu

SEQ ID NO: 69361 - RNA, 64 nt, Human
uuacuuucaucuauguugguuucugucucguuccagaacccacagccuccacccguggcuggcg

SEQ ID NO: 69362 - RNA, 64 nt, Human
gggcuugagaggagagcgcuggccaugccaggagagaacccacgcacaugcacaccacaacaca

SEQ ID NO: 69363 - RNA, 64 nt, Human
uaaggacgcuuaugaucacauugcgccuacccagagaacccaggucgucuuucuauuuucaggu

SEQ ID NO: 69364 - RNA, 64 nt, Human
agcuugacuguguagagacauuuuccacacagccagaacccagggauuggagucuuaggcaucu

SEQ ID NO: 69365 - RNA, 64 nt, Human
gccauuagacuguugaauacuguuacuuuuauauagaacccaaggaaugccuuccugucauauu

SEQ ID NO: 69366 - RNA, 64 nt, Human
aaucagugaguugaaaguaaaauuucuuauuuaaagaacccaucuguuaauguaguaaauguug

SEQ ID NO: 69367 - RNA, 64 nt, Human
augcuucugagaaagucuuuuccuaguauuuaacagaacccaagugaacagaggagaaaugaga

SEQ ID NO: 69368 - RNA, 64 nt, Human
acuugugugagucuucucgaaggaggguugacucagaacccagagacaauacaaaaccccucac

SEQ ID NO: 69369 - RNA, 64 nt, Human
uucuaagugcuaaagaaggcugcuucuacuguauagaacccagggcucugaaacagcucuagcc

SEQ ID NO: 69370 - RNA, 64 nt, Human
caaugcugaagacacagcuccgcuugggagccugagaacccaggcuucccaggccagagugugg

SEQ ID NO: 69371 - RNA, 64 nt, Human
cauuaggcagauaggccacaggaagaagguguggagaacccaccugaaccagauugagacucaa

SEQ ID NO: 69372 - RNA, 64 nt, Human
cacugaggaguugagcaaaucuguucuauucugcagaacccauaggacaaauaagaguucuacu

SEQ ID NO: 69373 - RNA, 64 nt, Human
uauuuaaagauagagccaguuuuuuuuuuuaaauagaacccaaauuguguaaaaauguuaauug

SEQ ID NO: 69374 - RNA, 64 nt, Human
gcaaaaauugacaauacauuucuugcccgaaauaagaacccauuauuuccagugaguuacugaa

SEQ ID NO: 69375 - RNA, 64 nt, Human
cuugcuucccuaacaggaagguguccaguucaagagaacccacccagagacugggagugguggc

SEQ ID NO: 69376 - RNA, 64 nt, Human
gaccacccuccccacaguaugcacucagccccacagaacccaccagucuuucugggaacucaca

SEQ ID NO: 69377 - RNA, 64 nt, Human
auaaugcuuaagaauggaauuuccucucugugacagaacccaggaauuaauuccuaaauacaua

SEQ ID NO: 69378 - RNA, 64 nt, Human
uaaacauuuuuuuacuauuuuuuguaaagcaaacagaacccaaugccucccuuugcuccuggau

SEQ ID NO: 69379 - RNA, 64 nt, Human
agcaaagacaagcaaggcaagcacgucuggaaacagaacccauuuugagccuuagaagagucaa

SEQ ID NO: 69380 - RNA, 64 nt, Human
acagugcauuugccuugucaccugugagcuggagagaacccagauguuguuuauugaaucuaca

SEQ ID NO: 69381 - RNA, 64 nt, Human
aucccccacgcaggaccaacuaccuccgucagcaagaacccaagcccacauccaaaccugccug

SEQ ID NO: 69382 - RNA, 64 nt, Human
uucuggccacccugggugggguguggucggggugagaacccaagcguuggaacuguagacccgu

SEQ ID NO: 69383 - RNA, 64 nt, Human
ugauuuucugaugagacuagagugacaguguuucagaacccaaauguccucagguaguuuggag

SEQ ID NO: 69384 - RNA, 64 nt, Human
ugggcagcagcaucugguugaccagauggccaccagaacccacuguucauucuuaucuucugcu

SEQ ID NO: 69385 - RNA, 64 nt, Human
ugacagccucagugacccuggcuccuugugccagagaacccagcccacccccggcagcagcccc

SEQ ID NO: 69386 - RNA, 64 nt, Human
ugcccacuaugggcagaccucucgcucagccugcagaacccagcugggacuuacuuccaaccuc

SEQ ID NO: 69387 - RNA, 64 nt, Human
cccauugcuaucaagggaggaggggguagucuguagaacccaugugugacagucaugugcacac

SEQ ID NO: 69388 - RNA, 64 nt, Human
cccuugcccaggguaucuccuacgguaccucuucagaacccaagggcucugcaaaugccaguuu

SEQ ID NO: 69389 - RNA, 64 nt, Human
uauauuuugcauauuuggacucagccauccauuaagaacccauguuguccucuggacauauuua

SEQ ID NO: 69390 - RNA, 64 nt, Human
acacacacacacacacacacgcuuguucacacucagaacccaggacagccacagccaccgcuua

SEQ ID NO: 69391 - RNA, 64 nt, Human
uggacuaagcaauuuccccccucgugcgcaucucagaacccaucgguaggcaaaggaaaauacg

SEQ ID NO: 69392 - RNA, 64 nt, Human
uagaguccagcagaagaccuuagacaaaaaaagcagaacccacuggaguagaaaaggaagcaug

SEQ ID NO: 69393 - RNA, 64 nt, Human
aguauaaucucuguuaaucaacaggacuaccccaagaacccaugugcucucccgaguaacccag

SEQ ID NO: 69394 - RNA, 64 nt, Human
ucucagcguuucuggcugucuuagggcuggccucagaacccagcauuccuguuauuugcuucua

SEQ ID NO: 69395 - RNA, 64 nt, Human
aaggaacaacugauauacuugagugugcaagcaaagaacccauuugccaugcugcuaugaagac

SEQ ID NO: 69396 - RNA, 64 nt, Human
acuaauucaggaauuugaguagagauggggaacaagaacccagaugcuguccccucacccccuc

SEQ ID NO: 69397 - RNA, 64 nt, Human
guaugaagagcugucuuccccugagaguuuccucagaacccacagugagaggggagggcuccug

SEQ ID NO: 69398 - RNA, 64 nt, Human
agaggcccaggcugcacacccauuucagccaucaagaacccacacagacggcagggaaggugga

SEQ ID NO: 69399 - RNA, 64 nt, Human
ucugguuguuucuguuucugaguggaccaacagcagaacccacgaggauuuguuuugaguaugg

SEQ ID NO: 69400 - RNA, 64 nt, Human
agguggacggacgcuguggccgcauggaaccuugagaacccagggacgagccagugccgggaag

SEQ ID NO: 69401 - RNA, 64 nt, Human
gggggugggggugggggaggggagagggguaccuagaacccagagaacauuggcuuaugccaga

SEQ ID NO: 69402 - RNA, 64 nt, Human
aagccaggacauccagaauucauugcuuuaauaaagaacccaggccgggugcaguggcucaugc

SEQ ID NO: 69403 - RNA, 64 nt, Human
agacacuucuccugccuucccacccugacccggcagaacccaccaagugccugugugcagccuc

SEQ ID NO: 69404 - RNA, 64 nt, Human
uuuuuucaauuuggcuaaugaagggcaaccacccagaacccagaaaaugcagauucacucaguu

SEQ ID NO: 69405 - RNA, 64 nt, Human
uggugagaauggagguucuagaagggguaaggccagaacccagggauccaggagucggcucuca

SEQ ID NO: 69406 - RNA, 64 nt, Human
gcaccugccucagccccacuccagaauagccaagagaacccaaaccaauaaaguuuaugcuaag

SEQ ID NO: 69407 - RNA, 64 nt, Human
agaugaaaugccagaauuaaaaccaaucauaaguagaacccacuucaaaauaaaaaaacagcau

SEQ ID NO: 69408 - RNA, 64 nt, Human
ucucguacauaagaugauuggugacacuuuuuguagaacccauguuguauacaguuuuccuuua

SEQ ID NO: 69409 - RNA, 64 nt, Human
ccccccaaaguagagaugcuaagccaaauccagaagaacccauagaugaagaugaagauauuca

SEQ ID NO: 69410 - RNA, 64 nt, Human
ggagggggauaaaugggaugcccuugccccagagagaacccaguucuagguacugucugggccu

SEQ ID NO: 69411 - RNA, 64 nt, Human
uauuguucuuucaagaacccuuuuuuuagcuuauagaacccauggguccaguuuaguaacgagu

SEQ ID NO: 69412 - RNA, 64 nt, Human
gcgcaagggcgggaaggaggggcccaggcugcggagaacccaggugggauccugaaggcacuag

SEQ ID NO: 69413 - RNA, 64 nt, Human
aagcccucauagcugguaaguggcuuugcauauuagaacccaaauauuuugcucucuaaaucua

SEQ ID NO: 69414 - RNA, 64 nt, Human
cacuuuacagaugaggggaggggccgcagugcgcagaacccaccccaccccccagugcagacuu

SEQ ID NO: 69415 - RNA, 64 nt, Human
cccggagcccagcccccugccccggcccugcuccagaacccagcccagaucggaggacaaguuc

SEQ ID NO: 69416 - RNA, 64 nt, Human
aacccagcccagaucggaggacaaguuccucucuagaacccaauccaauuuggagccccagccc

SEQ ID NO: 69417 - RNA, 64 nt, Human
aacccaauccaauuuggagccccagcccaacuccagaacccaacccuucucuagaauccagccc

SEQ ID NO: 69418 - RNA, 64 nt, Human
ggcuuugcagcuuccagcgguacuggaacaguggagaacccaacaauagcgggaaugaagacug

SEQ ID NO: 69419 - RNA, 64 nt, Human
ccuggugcuucuuacauuauaaaguacguuuuaaagaacccacaaacuauuauacauaaguuua

SEQ ID NO: 69420 - RNA, 64 nt, Human
ccaugccuccucuggagccuucgccuggggagacagaacccagagagaaacaagagaguccaga

SEQ ID NO: 69421 - RNA, 64 nt, Human
gagcuacucaggagguugaggcaggggaaucacuagaacccaggaggcacuccagccugggaga

SEQ ID NO: 69422 - RNA, 64 nt, Human
acacagagggaagacaggaugggaguguagccacagaacccaccugcacccugacaggcacacc

SEQ ID NO: 69423 - RNA, 64 nt, Human
ucagcagucuacagugcaaaagagggccuucaccagaacccaagcaugcuggcaccuugaccuu

SEQ ID NO: 69424 - RNA, 64 nt, Human
gacccgagccagcgguggggagagauauagucagagaacccagcaauacagauccguccuuggg

SEQ ID NO: 69425 - RNA, 64 nt, Human
ggccccagccggggugaaucaucaguccuggggaagaacccaggcgccugagccccagcuccgg

SEQ ID NO: 69426 - RNA, 64 nt, Human
ccugucagcugugacccauuugaccuguguccccagaacccaguuuuuuguuuguuuguuugag

SEQ ID NO: 69427 - RNA, 64 nt, Human
aaaaaaagacacauagaucaauggaauagguaagagaacccagaaauaaaggcauauaccuaca

SEQ ID NO: 69428 - RNA, 64 nt, Human
guuagggcauggacuugacccagcuuugugccagagaacccaauaugaguguuguuggcagcuu

SEQ ID NO: 69429 - RNA, 64 nt, Human
cucgccgccccaccccugcacuccgugaccucugagaacccagcuggccccucguuagccccag

SEQ ID NO: 69430 - RNA, 64 nt, Human
aggaagggccgcugucgccaagguuuucucucccagaacccacagugggaaagcggucuugcca

SEQ ID NO: 69431 - RNA, 64 nt, Human
auacauuacucuugcagguuuccagauacaugaaagaacccacacuggagagaaaccuuaugaa

SEQ ID NO: 69432 - RNA, 64 nt, Human
cagaaaacaaaaucuagaugcaacagcgaaacaaagaacccauuuccuuccuggcacccuccuu

SEQ ID NO: 69433 - RNA, 64 nt, Human
ggcgaggggcugggcucagagggccagggcaucaagaacccagugaacaagugaguguggccuu

SEQ ID NO: 69434 - RNA, 64 nt, Human
uaccaccuaauccuucuggcaagccugucuucagagaacccacuagaagcaacuaggaaaauca

SEQ ID NO: 69435 - RNA, 64 nt, Human
cccccccccacuucaccccaugucccagagccucagaacccacccucccugggggacccucgaa

SEQ ID NO: 69436 - RNA, 64 nt, Human
ugaagagcuuucccauccaggggugacuuuuuuaagaacccaccucuugugcuccccaucccgc

SEQ ID NO: 69437 - RNA, 64 nt, Human
acuugcaggaagcugcuaccacccuuagggcuggagaacccagggaagcuaagaggagggugca

SEQ ID NO: 69438 - RNA, 64 nt, Human
gagcaaguuggaguguuucagguguauauuuuguagaacccaaaagauuggagccuuaacaaua

SEQ ID NO: 69439 - RNA, 64 nt, Human
cuaggaccgucuugcuuugucauugggcauggagagaacccauuucuccagacuuuuaccuacc

SEQ ID NO: 69440 - RNA, 64 nt, Human
cagcugcucaguucccagggcacauuucuggaucagaacccaugggaaacaggagguacuaagu

SEQ ID NO: 69441 - RNA, 64 nt, Human
uuucaagucacaugucucucagaccccuggauucagaacccaaggccacaaaucauaggcauga

SEQ ID NO: 69442 - RNA, 64 nt, Human
uguuuaccuauauuucuggaggcuccuguauucuagaacccaaucucucaccugcuugguugca

SEQ ID NO: 69443 - RNA, 64 nt, Human
ucagucugcugugccuccagacugcagagcucucagaacccagaacagagacgaaaaggcuacc

SEQ ID NO: 69444 - RNA, 64 nt, Human
cuuccuuguccucuguucccacccuccccugaacagaacccagcccauaagagacauucucaga

SEQ ID NO: 69445 - RNA, 64 nt, Human
guuuugagcuuugaauacuuaaggcuuuagagggagaacccaauuuucaauuauguuggcuuuu

SEQ ID NO: 69446 - RNA, 64 nt, Human
aacuccuuuccaagcugaccucaguuuucucacaagaacccaguuagcugauguuuuauuguaa

SEQ ID NO: 69447 - RNA, 64 nt, Human
ggaauuuucaggucuguccccugcauggggacucagaacccagguuugcaggugggcauacgug

SEQ ID NO: 69448 - RNA, 64 nt, Human
ggugaauauggagcaguagcagaagccucauuccagaacccaucuggccagagaagcagcagca

SEQ ID NO: 69449 - RNA, 64 nt, Human
aacuacccuucucuauccgaagugagucagaaacagaacccagguuucuugauucccacuccug

SEQ ID NO: 69450 - RNA, 64 nt, Human
aguagauguaauggaagccaaauuaaauugauacagaacccauuucucagagucuuuuuuuuuu

SEQ ID NO: 69451 - RNA, 64 nt, Human
agucuuuuuaaaaaaaacauccuauacuaagggcagaacccacugccccggccucaauuaccuu

SEQ ID NO: 69452 - RNA, 64 nt, Human
ccuccucggaagcucgcugcccagagccauguccagaacccagccggccaucuccauggugcca

SEQ ID NO: 69453 - RNA, 64 nt, Human
cagcuggugccuggccuucggcuccugcguccccagaacccaagggaacgucauggaggccaca

SEQ ID NO: 69454 - RNA, 64 nt, Human
uccuaccccacauccugucuuagccgcagucuccagaacccaugaugaacugugaucugccgug

SEQ ID NO: 69455 - RNA, 64 nt, Human
aaaugcauauauucacauucacagaaacauuggcagaacccaguuuuaaugguacagaggagua

SEQ ID NO: 69456 - RNA, 64 nt, Human
gugggucauugaggagacccaggaaucucaucugagaacccacucucugccggagaaccccaug

SEQ ID NO: 69457 - RNA, 64 nt, Human
acaagggagcccaccgggcccagauagagacuucagaacccacuccugagaacagcggagccag

SEQ ID NO: 69458 - RNA, 64 nt, Human
gccaugguccccagcugaggagcaggugucccugagaacccaaacuucccagagaguaugugag

SEQ ID NO: 69459 - RNA, 62 nt, Human
gacuucuggugacauaguaauaaagugaagacucagaacccaccagcgauugcaaguguguc

SEQ ID NO: 69460 - RNA, 64 nt, Human
uaguggccauugucccaugccuugaaauugacccagaacccacuuuccacugaugugucucuug

SEQ ID NO: 69461 - RNA, 64 nt, Human
agaaaaagaauuauuuuugcauaugaaagaggccagaacccacaggaaaaacuucaaaacuuga

SEQ ID NO: 69462 - RNA, 64 nt, Human
agucccucagaaucccagaggcagucccagccucagaacccaggauaggaaauggguguguuua

SEQ ID NO: 69463 - RNA, 64 nt, Human
caggccacucagugggcucccugguccugauggcagaacccacccgaucccugggguagggcac

SEQ ID NO: 69464 - RNA, 64 nt, Human
gccacaauccccagcugaggagcaggugucccugagaacccaaacuucccagagaguaucugag

SEQ ID NO: 69465 - RNA, 64 nt, Human
caccugccuuccggcccggcucccuggcggagccagaacccagggaguugcccgcgugcugucc

SEQ ID NO: 69466 - RNA, 64 nt, Human
ggauucccaagaugugagcuuuuuacauaaugaaagaacccagcaauucugucucuuaaugcaa

SEQ ID NO: 69467 - RNA, 64 nt, Human
cucugaggacaggauuuaauucgaugguaucauuagaacccagcacauggcccuuagacugaga

SEQ ID NO: 69468 - RNA, 64 nt, Human
gcaggaagguggcauagcuguuuugucugacaccagaacccaucucaccacacugcuuuacagu

SEQ ID NO: 69469 - RNA, 64 nt, Human
gacauuuaaaaaaauaaaaaugaaaaaaaaacccagaacccauuucucagggcacuuuccagaa

SEQ ID NO: 69470 - RNA, 64 nt, Human
uuuaucgauugucagaauuguuuuugaaagccuaagaacccagcuuuuuagaaaggauuuucac

SEQ ID NO: 69471 - RNA, 64 nt, Human
aggaacagacacauacgucaauggaacagaugagagaacccagaaauaaacccauauaaauaug

SEQ ID NO: 69472 - RNA, 64 nt, Human
uuccauugcguagccagccuuaggaaaaacaaacagaacccaaaccagauggcaauguccaauc

SEQ ID NO: 69473 - RNA, 64 nt, Human
cagaggcuaggaauagugauccugcuauaaugugagaacccaaaucauguuuauaaaauaggac

SEQ ID NO: 69474 - RNA, 64 nt, Human
cuccaucauggcugcuugauuuuguagagaaauuagaacccauaaccauacacaggcuaucaac

SEQ ID NO: 69475 - RNA, 64 nt, Human
aacccaggucaagacauugccaaaucuugaacucagaacccaaguguuccaugccccugugugg

SEQ ID NO: 69476 - RNA, 64 nt, Human
uacagaggucagcacacauuauuuggcuuaaaccagaacccaguguuuccacacuuaaauucuc

SEQ ID NO: 69477 - RNA, 64 nt, Human
gggacuccuccaggggucuucagaccauacuuugagaacccaugggcuagcgacuaccuugaga

SEQ ID NO: 69478 - RNA, 64 nt, Human
cgaggacugugacacauagcccauucuggccaccagagcccacuuggccccaccccucaauaaa

SEQ ID NO: 69479 - RNA, 64 nt, Human
gacauuccagagagccugauccacauccagcagcagagcccacuuguggcugcagcuuuaugcc

SEQ ID NO: 69480 - RNA, 64 nt, Human
cuugagcuuggcagcugaacuauuggagggugggagagcccagccauuaccauggagacaagaa

SEQ ID NO: 69481 - RNA, 64 nt, Human
cccaugugagacaugaacaacaggagggagggaaagagcccaggugggacgugggacaggcuua

SEQ ID NO: 69482 - RNA, 64 nt, Human
gccaugcgugucgguguauauaggaaccauguacagagcccagagaagcccccuacaucccccc

SEQ ID NO: 69483 - RNA, 64 nt, Human
guuacuuuuaagaaagcagugugauguaguggagagagcccaugggucuuauuuaugggauaug

SEQ ID NO: 69484 - RNA, 64 nt, Human
uuauaguuggcggcaguauuaaaauggugaguaaagagcccagguuugcuccuguuuguaacua

SEQ ID NO: 69485 - RNA, 64 nt, Human
guggaacaaucugcaaugucuaaaucgccuuaaaagagcccauuucuuagcugcugaaaucagu

SEQ ID NO: 69486 - RNA, 64 nt, Human
gggggguugggcagcucucuccaaggcaguaccuagagcccagcugaacaacaaggcuuugggu

SEQ ID NO: 69487 - RNA, 64 nt, Human
ccuugugagguguuuugucuguugucauggcccaagagcccauccuggauccugaucuuaccuu

SEQ ID NO: 69488 - RNA, 64 nt, Human
agguuggucugagguuggcaccucaaucuacaccagagcccagggagucccagaggcaaguuuc

SEQ ID NO: 69489 - RNA, 64 nt, Human
ggcauggagucccaaaggcccugggcacaggcagagagcccaccggcuggucaugagggccucu

SEQ ID NO: 69490 - RNA, 64 nt, Human
uugcuggcuuaaaggacaauucucuucauuggugagagcccaggccauuaacaccuacacagug

SEQ ID NO: 69491 - RNA, 64 nt, Human
acugcuuaugcagucggaagcuccagaagaacaaagagcccaauuaccagaaccacauuaaguc

SEQ ID NO: 69492 - RNA, 64 nt, Human
uugugacuagagggugguggagguaaggccuuccagagcccauggcuucaggagagggucucuc

SEQ ID NO: 69493 - RNA, 64 nt, Human
uugaagcuuuaacaugguucaggcccuuggugugagagcccagggggaggacagcuugucugcu

SEQ ID NO: 69494 - RNA, 64 nt, Human
auagauaggaacuuggauugcugaauucaaaaacagagcccauucuuaagaucacuuggugccu

SEQ ID NO: 69495 - RNA, 64 nt, Human
uguggacaucccuugguguacacuaagacagagcagagcccagcgcucccaagccuuccuccuu

SEQ ID NO: 69496 - RNA, 64 nt, Human
agccccaagggccagccagccuguacucugggcaagagcccaaaauggcuaggaauguuugacu

SEQ ID NO: 69497 - RNA, 64 nt, Human
ggaggagagggcucugccucaacuuuccuaggaaagagcccaccucggagauagcuacgguuuu

SEQ ID NO: 69498 - RNA, 64 nt, Human
gcggggagaagaagcggccaggcggggcgccccaagagcccaaaagagggcacaccgccauccu

SEQ ID NO: 69499 - RNA, 64 nt, Human
caaccauuguaucucuuucucuucaguaugguuuagagcccagaucaguuaguaggcuuucguu

SEQ ID NO: 69500 - RNA, 64 nt, Human
ucacauggaggacgaggcccagcucagcugggccagagcccagaagugccaccucaucauaauu

SEQ ID NO: 69501 - RNA, 64 nt, Human
acagggcugccuggccucucccucgugcuccucaagagcccaguccauacacuguggaugucau

SEQ ID NO: 69502 - RNA, 64 nt, Human
cagacacacugacacacuccgccacgagugcuccagagcccacgaggcuugcagaucgggggca

SEQ ID NO: 69503 - RNA, 64 nt, Human
accacaucaguguuuccgucugcucaccugccacagagcccacacccaugcccaccaguguugg

SEQ ID NO: 69504 - RNA, 64 nt, Human
ccugggaagacacauucccuucccuguuccccagagagcccaccuccgcccugggcaggagccc

SEQ ID NO: 69505 - RNA, 64 nt, Human
agggacagggugaggguauacccaaagcugaugcagagcccauuagccuaaaagcaacugcagg

SEQ ID NO: 69506 - RNA, 64 nt, Human
ggaagacagcucuuauauugccauuucuuccacaagagcccaggccuccuacagcuugaccgug

SEQ ID NO: 69507 - RNA, 64 nt, Human
gacgucugugcugccugguuugcauccggcucacagagcccagacugcuggaacagccaaggac

SEQ ID NO: 69508 - RNA, 64 nt, Human
gcucucccagacaggagccaggguugagcaauggagagcccagcccccacgucuuacagucgcc

SEQ ID NO: 69509 - RNA, 64 nt, Human
cuagaaaaauaaaugagcccaggcauagaggacuagagcccaggugcacgguuagcuucacagc

SEQ ID NO: 69510 - RNA, 64 nt, Human
cccuucaccuaguugacucagcccucgauagucuagagcccacccccuccucaggaacucaaga

SEQ ID NO: 69511 - RNA, 64 nt, Human
aagcccuuccaccagaaaagcuagucuaggugugagagcccacauugucuguagccaucaaaaa

SEQ ID NO: 69512 - RNA, 64 nt, Human
uuuucacguguaagaugagaauggcugauggcugagagcccaccaaccuuccccaccccguauc

SEQ ID NO: 69513 - RNA, 64 nt, Human
ucagguagcucuaggagcaccauccugcccuagcagagcccaggccuugcccucaugaagcauc

SEQ ID NO: 69514 - RNA, 64 nt, Human
uucuaacucacaggcauagagugaccuuuuaaucagagcccagggaagacacaugauuaaugau

SEQ ID NO: 69515 - RNA, 64 nt, Human
uugcauuauuuugaccugauuuauuuauuguacaagagcccaagucccugaauuauauucuuaa

SEQ ID NO: 69516 - RNA, 64 nt, Human
agacaaagaagagacaucgaaucaaccaauaagaagagcccaaauaagcauccucaaaucuuuu

SEQ ID NO: 69517 - RNA, 64 nt, Human
cugcuaugcagaugucuaagacaggaggaucacaagagcccaggagguugagaaugcagugagc

SEQ ID NO: 69518 - RNA, 64 nt, Human
uggggagauggaucaagcucagagacuggcagugagagcccagaaggaccuguauaaaaugaau

SEQ ID NO: 69519 - RNA, 64 nt, Human
aaaagguguaggccugccuuaccgagagccaaacagagcccagggagacuccgcugugggaaac

SEQ ID NO: 69520 - RNA, 64 nt, Human
aguguuggucaugacuccaagagcagagcagggaagagcccaagcauagacuuggugccguggu

SEQ ID NO: 69521 - RNA, 64 nt, Human
uccuccccuacaccaacaaagaggaauggcugcaagagcccagaucacccauuccggguucacu

SEQ ID NO: 69522 - RNA, 64 nt, Human
aaauuccaacuccuauaccuuaccagagcauggaagagcccagaucugaauguaaaacgucucu

SEQ ID NO: 69523 - RNA, 64 nt, Human
ugaacaaacauuuccugauggcaacuccugcggcagagcccaggcuggggaagugaacuaccca

SEQ ID NO: 69524 - RNA, 64 nt, Human
gguugcccuuuucugagaucagacuggccuuaacagagcccaacuuucuuggaaggacacagcu

SEQ ID NO: 69525 - RNA, 64 nt, Human
ggccuuaacccuggcuccugaggcugcggccagcagagcccaggccagggcucuguucuugcca

SEQ ID NO: 69526 - RNA, 64 nt, Human
gucgccagccuagaacauccugcucugaaugaacagagcccagauggggguccagagcuaagug

SEQ ID NO: 69527 - RNA, 64 nt, Human
gcuggccugcuguacaagcuucaaaaagugucccagagcccacacggcucggugucagauggug

SEQ ID NO: 69528 - RNA, 64 nt, Human
cuuuguuuugaacuuccuuucccacuugguagaaagagcccagaagcagcccuggcccuguaag

SEQ ID NO: 69529 - RNA, 64 nt, Human
cacagccuuauuucugccggggccuccccaccggagagcccagggggccggccggguuccuggu

SEQ ID NO: 69530 - RNA, 64 nt, Human
uguucagcaggugugugggccuagaggagagagcagagcccagaaaugucuuuugcaggcccac

SEQ ID NO: 69531 - RNA, 64 nt, Human
gggccccacaugucccugcaggguuggcagggacagagcccagaccauggugccagccagggag

SEQ ID NO: 69532 - RNA, 64 nt, Human
ugggacgaguggaggccgcggccuggcuggcacgagagcccacgcccgcuucuguaucucccuc

SEQ ID NO: 69533 - RNA, 64 nt, Human
cuuuucuggggcccaggaagcccacacuaugcacagagcccaaugcauagagcccuggccagcc

SEQ ID NO: 69534 - RNA, 64 nt, Human
ugccauauucuuguuggagaugaaccguagcaccagagcccauucuuccuugucagucuuggcc

SEQ ID NO: 69535 - RNA, 64 nt, Human
cucucuguugcagaguuggaaguauuggccaagaagagcccacggcggcugcucaagacccugg

SEQ ID NO: 69536 - RNA, 64 nt, Human
agcuuguauggguucuggcuacaccagagcaccaagagcccacuugccugggauggccccacac

SEQ ID NO: 69537 - RNA, 64 nt, Human
agcacauaaggguucuucagugaaaagcaggagaagagcccacugcaaggauagcucauuaggc

SEQ ID NO: 69538 - RNA, 64 nt, Human
gaaagauuuucaucaggaaaggagcacugugggaagagcccaguauucacauuuuuuccccauu

SEQ ID NO: 69539 - RNA, 64 nt, Human
uguacuaucuccuuggggguuagggaugcuaagaagagcccacaaauagaggauuacucuuccc

SEQ ID NO: 69540 - RNA, 64 nt, Human
gaggaagggaaggaaggagagggagggggaggauagagcccaucccagccggggagggggagcc

SEQ ID NO: 69541 - RNA, 64 nt, Human
caagaccuuagggauugacaccugggccucaggcagagcccagcccugggcuggggggcuccuc

SEQ ID NO: 69542 - RNA, 64 nt, Human
cgcuugaggagcucuggguacagggcagcaacccagagcccaugggcccucccgggacaucugg

SEQ ID NO: 69543 - RNA, 64 nt, Human
uuccuccccgccuccucccacugggacucccagcagagcccaccagccagcccuggcccacccc

SEQ ID NO: 69544 - RNA, 64 nt, Human
gcgggcugcgggagcggcucucacccuaggagccagagcccaaugugucuuauuccccguggac

SEQ ID NO: 69545 - RNA, 64 nt, Human
gcuccuguccuuccaggaaaucacaauuuucaucagagcccaagagauuauuugagacucagga

SEQ ID NO: 69546 - RNA, 64 nt, Human
acuucgaauuaguuugcacuuccuguuggaagguagagcccacugcucauuguauaagccccga

SEQ ID NO: 69547 - RNA, 64 nt, Human
guuucauuuaaaaaguuggaggaucugaacauacagagcccacauuuccacaccagaacuggaa

SEQ ID NO: 69548 - RNA, 64 nt, Human
caaaaccuaucuuggcaaaaaaaggaagugagucagagcccauuuucaggaggcauuggugaug

SEQ ID NO: 69549 - RNA, 50 nt, Human
ccuuccugccaguggucugaagagcccagaggaggaguuuggccaggugg

SEQ ID NO: 69550 - RNA, 64 nt, Human
uuauuuuauauaaaaaguguuucugugauucuucagagcccaggagucagugcuggugguugga

SEQ ID NO: 69551 - RNA, 64 nt, Human
uugcucccaggcccagcaccgagcagaacagaccagagcccaccacaccacaaagagcagcacc

SEQ ID NO: 69552 - RNA, 64 nt, Human
ggaugaggcagaccugacucucuuaaggaggcugagagcccaaacugcugucccaaacaugcac

SEQ ID NO: 69553 - RNA, 64 nt, Human
auuaauucuaauaacguauuugcuauugcagugcagagcccacugcaacugcuaggacugaaag

SEQ ID NO: 69554 - RNA, 64 nt, Human
augaacauuucaaauugaauuugcacgguuugugagagcccagucauuguacuguuuuuaaugu

SEQ ID NO: 69555 - RNA, 64 nt, Human
aggagcuugaccagugugccccaaggaguggaguagagcccaaucuaaguauuccuugcugcuu

SEQ ID NO: 69556 - RNA, 64 nt, Human
gcccagccucgcaugccagagccuggggcaucccagagcccagggcaucccaugggggugcugc

SEQ ID NO: 69557 - RNA, 64 nt, Human
gaugagcagcccuuggucuccgguuccaggacugagagcccagcugccucugcccacccuuccc

SEQ ID NO: 69558 - RNA, 64 nt, Human
ccccaaaccagggagaggaagagcucccacagggagagcccaggcucucuuugcagccuuuccc

SEQ ID NO: 69559 - RNA, 64 nt, Human
acaucauugaaguggagcccggcacaggggucauagagcccagugaggucggggauuuugaguu

SEQ ID NO: 69560 - RNA, 64 nt, Human
gucagccagcucccagccacauggcgcaugaaggagagcccagucucccuccaggaaaggccug

SEQ ID NO: 69561 - RNA, 64 nt, Human
cacucagcaguguuaugaaaggcacguaguauauagagcccaaagcccugggauugcacccuga

SEQ ID NO: 69562 - RNA, 64 nt, Human
aacugagguuuaccuggaucuggcuacugaggcuagagcccacagcagaaugggguugggccug

SEQ ID NO: 69563 - RNA, 64 nt, Human
agccugaccagaggggagguggauggcacuuuccagagcccagguucuuauggcauuucccagg

SEQ ID NO: 69564 - RNA, 64 nt, Human
gaugugcccacugcccgugcagccuccuucagccagagcccagagcauagacaggaguguagga

SEQ ID NO: 69565 - RNA, 64 nt, Human
uuugggcuguggacgcugccacacaagccugaguagagcccaugcaaaggaagggaugggguga

SEQ ID NO: 69566 - RNA, 64 nt, Human
uuuauaccaggcagucagagcuggaaguguauggagagcccagcccaccagguccugccuuuug

SEQ ID NO: 69567 - RNA, 64 nt, Human
acaaaaaauaaaaaauuagcugggcaugacggccagagcccauggucccagcuacucgagaggc

SEQ ID NO: 69568 - RNA, 64 nt, Human
acucaucugucagagccccaagcccuuuagacccagagcccaaggaccaugccuuugggacauu

SEQ ID NO: 69569 - RNA, 64 nt, Human
cguggaacacagaagcuuccacugucagcucucaagagcccauggccaggaaggcccaugcuga

SEQ ID NO: 69570 - RNA, 64 nt, Human
agggauaaccugcaccccucccugcaagggguucagagcccagcacaggagcuuucucuggcag

SEQ ID NO: 69571 - RNA, 64 nt, Human
aauaauaguucuacugcccgugucuccagaauguagagcccaucaauauuuuuauuuuaggagg

SEQ ID NO: 69572 - RNA, 64 nt, Human
ucgcagccaacucagccaguguugggacuggcucagagcccaugggggcuggaggggggcagcu

SEQ ID NO: 69573 - RNA, 64 nt, Human
agaaguguuccguacccacugcugaugguuucccagagcccacacugaguugaagaaccuauug

SEQ ID NO: 69574 - RNA, 64 nt, Human
cuugacucccauuugcucucagugaccccagggcagagcccagagaaguguuccguacccacug

SEQ ID NO: 69575 - RNA, 64 nt, Human
ccuuaggccuggacuaguccuagaugcaaacucaagagcccaaggccaaggggauguggggaag

SEQ ID NO: 69576 - RNA, 64 nt, Human
aacagauagcaaaugugucugguuagaucucagcagagcccauucugcaagaccuggcugagcc

SEQ ID NO: 69577 - RNA, 64 nt, Human
ugauuaacaccuucuggagccagcucaucagcucagagcccagggucaggaguucguucaguaa

SEQ ID NO: 69578 - RNA, 64 nt, Human
cagcaaagcuuggugucuuggcacuguuagugacagagcccagcaucccuucugcccccguucc

SEQ ID NO: 69579 - RNA, 64 nt, Human
ucugagcagggggacaggauugaugaggcuugaaagagcccacugagccacucucugaauaugu

SEQ ID NO: 69580 - RNA, 64 nt, Human
gaggcaggauuuggaaucaggccaugucuucuccagagcccacauccauccuuucucuauauug

SEQ ID NO: 69581 - RNA, 64 nt, Human
ucuugacauacccaguaaguaugcagggacacucagagcccauaguggauagucucuuccaaca

SEQ ID NO: 69582 - RNA, 64 nt, Human
caaagauaggaugaaucugaacaucucuccaucuagagcccaaugaaggaagcuucaaaugaga

SEQ ID NO: 69583 - RNA, 64 nt, Human
uaauaguuguucugaaacguguuuuaucagguuuagagcccauguugagucuucuuuucauggg

SEQ ID NO: 69584 - RNA, 64 nt, Human
auugcaccacuguacuccagacuggauaacagcaagagcccaucuuuuaaaaaaaguaaaaauu

SEQ ID NO: 69585 - RNA, 64 nt, Human
ucuccuuaaaggacgguguuccaaugaauucaguagagcccacuuuccuccacuguggaggaag

SEQ ID NO: 69586 - RNA, 64 nt, Human
uuuuaauguuguggaugaaugccagcuuucagacagagcccacuuagcuuguccacauggaucu

SEQ ID NO: 69587 - RNA, 64 nt, Human
uagaggucagucaagggaucccugacgagaauaaagagcccagaaacagguccauguuuauaug

SEQ ID NO: 69588 - RNA, 64 nt, Human
aucuuccuucagguuuuuaccuccacucauccuuagagcccacugacugcuccccuuuauaccu

SEQ ID NO: 69589 - RNA, 64 nt, Human
gcaugguuuggugccagccccuucaccuccuuccagagcccaagaucaaugcucaaguuuugga

SEQ ID NO: 69590 - RNA, 64 nt, Human
aagccaaauggcuggcagaugauguggauuucaaagagcccagaaugaacucaucacuggcuua

SEQ ID NO: 69591 - RNA, 64 nt, Human
aaaagcaucuuaucuaaaagaaaggcuauccaguagagcccagugcucccuugucccucuuuua

SEQ ID NO: 69592 - RNA, 64 nt, Human
accaaaagcccauggccuggggagcugggcagguagagcccaagcuccaggugaggccuggccc

SEQ ID NO: 69593 - RNA, 64 nt, Human
cuguggggguuucucugccagcagggggcugagcagagcccauccaggacacuccacacugcca

SEQ ID NO: 69594 - RNA, 64 nt, Human
ccccuggauguccuucgaaggaaccaggacccucagagcccagcauccaucucugucaucaucu

SEQ ID NO: 69595 - RNA, 64 nt, Human
cuccugcuccuacccaugcuacaggccaggaaccagagcccaucaucucagaggccccuggaug

SEQ ID NO: 69596 - RNA, 59 nt, Human
gccagggcagcuccaggugaaggcgggacagagcccaccugucuuugcuaccugaacgc

SEQ ID NO: 69597 - RNA, 64 nt, Human
guuguggccguuuucugaugccuaaguauuauacagagcccacaauggccaguuuacuaccaga

SEQ ID NO: 69598 - RNA, 64 nt, Human
aaaaagcucuuacacuacauuagaacacugcauuagagcccauuucaauucucaaaagaaaagg

SEQ ID NO: 69599 - RNA, 64 nt, Human
uguuuguuccuguuaaauguauagcauuguaaugagagcccaucaaauccugagugucaguuug

SEQ ID NO: 69600 - RNA, 64 nt, Human
uuguuaccuugaccacgcuguacaguaacauccaagagcccauucuacagugggugguuuuggu

SEQ ID NO: 69601 - RNA, 64 nt, Human
ucuugcugcggcugcaauggaggcaaggggcugcagagcccaggugcacugugugaugauggga

SEQ ID NO: 69602 - RNA, 64 nt, Human
guccuaucagugccccccagaguagagagcaauaagagcccagcccagugcagucccggcugug

SEQ ID NO: 69603 - RNA, 64 nt, Human
uuuaauugagauauuggcaagucaacugccaugcagagcccagggcacugguuauauucaguag

SEQ ID NO: 69604 - RNA, 64 nt, Human
guucuuuuccagccugauuuuuuuucccacaggaagagcccacauguagcccugagguuuccuu

SEQ ID NO: 69605 - RNA, 64 nt, Human
cuguggacaccuugcacucugccuggcccuucccagagcccaaagaguaaaaauguucugguuc

SEQ ID NO: 69606 - RNA, 64 nt, Human
ucugacugacccacccuacaggacugcugaacagagagcccagugugacuagggauccugaguu

SEQ ID NO: 69607 - RNA, 64 nt, Human
aauucauguguucucuccuuucuaccagagggauagagcccaugccucaaccuauccagaguuc

SEQ ID NO: 69608 - RNA, 64 nt, Human
cuugauucccgaguguuaaucugugguuuugaccagagcccagauggguaauccugugcauuug

SEQ ID NO: 69609 - RNA, 64 nt, Human
ucaugauuauuuuauuuaguaaauaaaauaauagagagcccagaaaucaaccugcacaccuacc

SEQ ID NO: 69610 - RNA, 64 nt, Human
acaugucuuuaguuccucauguuaacacgaagccagagcccacaugaacuguuggaugucuucc

SEQ ID NO: 69611 - RNA, 64 nt, Human
aaacgggcagucugcucugcugcucugaccuuccagagcccaaggucagggaggggcaaccaac

SEQ ID NO: 69612 - RNA, 64 nt, Human
gagcuggaguucucauccagggcugcuuguccccagagcccagguuuauacuaccucccugggg

SEQ ID NO: 69613 - RNA, 64 nt, Human
gggaacucaauuuauuccugggaaccuaacgaggagagcccaggccuaggcaggaggccuggaa

SEQ ID NO: 69614 - RNA, 64 nt, Human
gccuucugccccacuacuguggggcaguggggccagagcccaccuccccaacaugugaagacag

SEQ ID NO: 69615 - RNA, 64 nt, Human
ggggcugcuccucccuccuguccugggaccgcgcagagcccacgcucucacugcugccuccugc

SEQ ID NO: 69616 - RNA, 64 nt, Human
ugggcucagcauguuuggggucagucaguguuggagagcccacauaugggauugccacuagcuu

SEQ ID NO: 69617 - RNA, 64 nt, Human
agaaaaaccuuuacuuagaauuguccaccuagucagagcccaagaaagaauuuucaguggaaaa

SEQ ID NO: 69618 - RNA, 64 nt, Human
cccccuaccaccaggaugggcaguaauaugugacagagcccaaagcaaggcuggaacgcagucc

SEQ ID NO: 69619 - RNA, 64 nt, Human
aguggaaauucaugagaggaacuauacuaccaaaagagcccaaaugaccaaauccauggauaau

SEQ ID NO: 69620 - RNA, 64 nt, Human
uccuuuccucugucccagauucaaaugaggaguaagagcccagacgagaggaaggcaggcugga

SEQ ID NO: 69621 - RNA, 64 nt, Human
cggucaccaaagcaggugcuggcccucggaccugagagcccagccagggcccauguggucugca

SEQ ID NO: 69622 - RNA, 64 nt, Human
guggcaagagagccucacaccucacuaggugcagagagcccaggccuuauguuaaaaucaugca

SEQ ID NO: 69623 - RNA, 64 nt, Human
ucuucuguuuucuuccaaagugcaaccacaguggagagcccacggugggcuuagccugccuagg

SEQ ID NO: 69624 - RNA, 64 nt, Human
gcuuucgcugugucuccuguguguguuagaauccagagcccagaggaagugcaagcggguccuc

SEQ ID NO: 69625 - RNA, 64 nt, Human
gaaacaggcuucacuguauaaauaggagaggaugagagcccagagguaacagaacagcuucagg

SEQ ID NO: 69626 - RNA, 64 nt, Human
cucaguuuccgucggcacuuggcuuucuguuccuagagcccaucccgcaccagcauuuuggaac

SEQ ID NO: 69627 - RNA, 64 nt, Human
agacccugucucaaaaaaaaaaagauucugugucagagcccagcccaggaguuugaggcugcaa

SEQ ID NO: 69628 - RNA, 64 nt, Human
cguguaagggggccugccccucaucugcgaaagaagagcccagacaccgggaaccccugaccca

SEQ ID NO: 69629 - RNA, 64 nt, Human
cccuggguccccucuuucaugucccacaggccacagagcccaguguguccaaccagcuguucuc

SEQ ID NO: 69630 - RNA, 64 nt, Human
aaacauaaauuauguuuuguauuauaugacuuuaagagcccacauuagguuuuaugauucauuu

SEQ ID NO: 69631 - RNA, 64 nt, Human
ucacuggagaagucaggguagaaauugagccuucagagcccaacucaaggcuucuacauccugg

SEQ ID NO: 69632 - RNA, 64 nt, Human
agcuucucccccagccacccucugccccugugguagagcccacuauaggcccaggcgccuuacg

SEQ ID NO: 69633 - RNA, 64 nt, Human
acugccgacuggagggucuugcuuuuucaaacucagagcccagaggaaaugcaaggguggauaa

SEQ ID NO: 69634 - RNA, 64 nt, Human
cccuccccagaaucaagcuuuugcuugauccagaagagcccauaucacuaagauggcauauaug

SEQ ID NO: 69635 - RNA, 64 nt, Human
ugcauuagaaauagacaguauauuuauagucacaagagcccagcagggccucaaaguuggggca

SEQ ID NO: 69636 - RNA, 64 nt, Human
acauuggaucaugacaugucgggcgaugcuuggaagagcccagcauguauguaugcacacauug

SEQ ID NO: 69637 - RNA, 64 nt, Human
agaagacugcaguggauuucugaaacuugaacucagagcccagugggaagccagaggucuugaa

SEQ ID NO: 69638 - RNA, 64 nt, Human
gacaggaucaggugccagcggaccaucggcuggcagagcccagcggccaccacccgucaacccu

SEQ ID NO: 69639 - RNA, 64 nt, Human
ccuggcuucucacugccaccucacacccgcugccagagcccaccucuccuccuaggccucgagu

SEQ ID NO: 69640 - RNA, 64 nt, Human
cugccgcagaaccaccaucccugggaggcccugcagagcccaccuguggggaaagagaaggggc

SEQ ID NO: 69641 - RNA, 61 nt, Human
cagcugcuggucgccaguaauaaguauccugagagcccagaaaagguacacuuugccuugc

SEQ ID NO: 69642 - RNA, 64 nt, Human
uuggaugaaaguccacuggggccagcaauacuccagagcccaguuucugcuggaucccaugggu

SEQ ID NO: 69643 - RNA, 64 nt, Human
acagacuuucccuuccucccagcagcagcagugcagagcccaccuggagggaugugggggcugu

SEQ ID NO: 69644 - RNA, 64 nt, Human
auggggcauguccuuuccaucuguccacauccccagagcccagcucuugcucucuugugacgug

SEQ ID NO: 69645 - RNA, 64 nt, Human
ccaggaagaugcugacauccaggugggaggugucagagcccagcucaugcacaucagcuggugg

SEQ ID NO: 69646 - RNA, 64 nt, Human
uucccagcacagcagcccccgggucugcaccuccagagcccacccuaccaccagacacagagcc

SEQ ID NO: 69647 - RNA, 64 nt, Human
gugacagccacccagcccuccugaagauagccagagagcccaugagaccgucccccagcauccc

SEQ ID NO: 69648 - RNA, 64 nt, Human
gaaacccacgauuccuuucgaguagaugugggaaagagcccauuggaggauaugagguccugug

SEQ ID NO: 69649 - RNA, 64 nt, Human
uggcuggagacaggcaggcuucucugcccugggaagagcccacucagcuuaauugcucugccau

SEQ ID NO: 69650 - RNA, 64 nt, Human
ggcuuggcuggguuggacacccacagguguauccagagcccagcccggugcugggaaagcuuug

SEQ ID NO: 69651 - RNA, 64 nt, Human
ccuuguauauacccugcaccagcagugaccgggcagagcccaacccccuccacgggggucccag

SEQ ID NO: 69652 - RNA, 64 nt, Human
ccaccucccugcacauggcacuacccagacugccagagcccaggcuggccucaucugcaccaug

SEQ ID NO: 69653 - RNA, 64 nt, Human
gggauccaauuuguagcuuccugccuggcuucagagagcccagcaaccuucuaggccugcuuuc

SEQ ID NO: 69654 - RNA, 64 nt, Human
auggaaggggaaucccuuauaggggagagggaacagagcccagugaaauggcagucagaauguu

SEQ ID NO: 69655 - RNA, 64 nt, Human
cuuuccccuucagcacaccccagcuucugaccucagagcccaggagcugcguggacaguguggg

SEQ ID NO: 69656 - RNA, 64 nt, Human; identical to SEQ ID NO: 69646

SEQ ID NO: 69657 - RNA, 64 nt, Human
gaccccuggggccucagaccucugagugggccccagagcccagcugaggaagccacacagccuc

SEQ ID NO: 69658 - RNA, 64 nt, Human
caggacuagugggaaggcggaggugggcccccacagagcccacaggcagcugcgucccggaugc

SEQ ID NO: 69659 - RNA, 64 nt, Human
gcaccugaggagcagggucugcccuggcaugagcagagcccaggauggggucagggucaggccc

SEQ ID NO: 69660 - RNA, 64 nt, Human
gucacuugaccuugauaagaggccgccugcacacagagcccaguuaauucuccgcaccucgguu

SEQ ID NO: 69661 - RNA, 64 nt, Human
gugucucgacacguaccacguacguggaaacacaagagcccaccacuugaauuucuaagaccau

SEQ ID NO: 69662 - RNA, 64 nt, Human
cagugcguggaaaggccggggaggugcagaaaccagagcccagggcaauggugucuguccagcc

SEQ ID NO: 69663 - RNA, 64 nt, Human
gguuauguuaacaccugaauugcugggucuugagagagcccaaggaguucugggagagggacca

SEQ ID NO: 69664 - RNA, 64 nt, Human
gcccagccccuuccuuuccaaaccaugcaauggaagagcccagaugggugaagauugauuuugc

SEQ ID NO: 69665 - RNA, 64 nt, Human
aaaguggcuucuaagguacugucuucuggaccucagagcccacucuccuuggcacccugacacc

SEQ ID NO: 69666 - RNA, 64 nt, Human
aagaucccacauucacacugacuugggcagugacagagcccagagcaaacagggccaggccagc

SEQ ID NO: 69667 - RNA, 64 nt, Human
ggggacccugugagccuucuggccggcugcgugcagagcccacugggcacgguggucggccugg

SEQ ID NO: 69668 - RNA, 64 nt, Human
cacacacagacacagaccagagacucccagcagcagagcccaagcacuggcuucgccccucagu

SEQ ID NO: 69669 - RNA, 64 nt, Human
gugucaucuuuguccaccugaaguccaccucuggagagcccaacaucccuugacuuugguuuau

SEQ ID NO: 69670 - RNA, 64 nt, Human
cucuuuggagaaaccaaccagauacaucugcuggagagcccaggugggcacagagaagggugga

SEQ ID NO: 69671 - RNA, 64 nt, Human
agccuugaagggcaaggagggaaacaguguuaccagagcccaguaagaacugcugucaugaagg

SEQ ID NO: 69672 - RNA, 64 nt, Human
ccacugaucacaaaaacaugguggguccaugggcagagcccaagggaauucggugugcaccagg

SEQ ID NO: 69673 - RNA, 64 nt, Human
gauugcagcuuggcuauuugguugaagggauuacagagcccaauaaaggauuuaaaauauauuc

SEQ ID NO: 69674 - RNA, 64 nt, Human
gcaugccucaauaaauggaaugcucugaaugggaagagcccauaacagaaugaccuauauuaca

SEQ ID NO: 69675 - RNA, 64 nt, Human
cugaccugggccguggcugccucgugagccucccagagcccaggccuccguggccuccuccugu

SEQ ID NO: 69676 - RNA, 64 nt, Human
agaacugggauuugaacccccgccauccuucaccagagcccaugcucaaccacuguggcguucu

SEQ ID NO: 69677 - RNA, 64 nt, Human
ccagccgguccaagcacauggccucccaucugggagagcccacugucccacucccacaugucug

SEQ ID NO: 69678 - RNA, 64 nt, Human
ggaaaggacagaaugaggaaaggccuggggcagaagagcccaacuccuucucauagcugacccu

SEQ ID NO: 69679 - RNA, 64 nt, Human
acagugacuucaauucaggaagaaugcuuccaaaagagcccaguggggaaaucugacaucacag

SEQ ID NO: 69680 - RNA, 64 nt, Human
uacuuaguugccacacucaugcuuacauagaaagagagcccaagaauauuagauuuccucauga

SEQ ID NO: 69681 - RNA, 64 nt, Human
ucaggaauucaagaccagccuggguaauauggcaagagcccaacucuacuaaaaauacaaaaag

SEQ ID NO: 69682 - RNA, 64 nt, Human
gcaugcuguuuuguggagaaacuugcauucaugaagagcccauuaucaacuuuuaaaagugaau

SEQ ID NO: 69683 - RNA, 64 nt, Human
ugucacccuccccaagcgccugcaccgcggugcaagagcccagcccaggggcgcuggacgugac

SEQ ID NO: 69684 - RNA, 64 nt, Human
cugacccaggacuuccccaaccuccagggcagaaagagcccaggcuccgggguccacagcacag

SEQ ID NO: 69685 - RNA, 58 nt, Human
cgcgcaagaggcugcggugagccaauuuagagcccaaagagccccgagggaaccugcc

SEQ ID NO: 69686 - RNA, 64 nt, Human
uacccucacccacccacccaguuuaauugugcuuagagcccaagaagauugggaucuagcacua

SEQ ID NO: 69687 - RNA, 64 nt, Human
gauucauugauuucucaaguauggauuaugugaaagagcccagggacauuauccauuacaguuu

SEQ ID NO: 69688 - RNA, 56 nt, Human
ucguccgugcagacaagugaccugccagagcccaagugccaucccacauucggacc

SEQ ID NO: 69689 - RNA, 64 nt, Human
gaaagccuucccagaagucucacugcguguguugagagcccaucaggagggcaugcaugacucu

SEQ ID NO: 69690 - RNA, 64 nt, Human
agcaguuccugcuccucugucagggaagccaggcagagcccacagagcaugguccauccagagu

SEQ ID NO: 69691 - RNA, 64 nt, Human
acagcccuucugcaacguuuacccacccugguucagagcccagcuucuccuggagagccggacc

SEQ ID NO: 69692 - RNA, 64 nt, Human
gugggcaggcaggaccugggcccucccacccaucagagcccacucaggaccagcguucggagcu

SEQ ID NO: 69693 - RNA, 64 nt, Human
cucuggaggcugggaaguccauaguggagggcccagagcccagugaggacccuucugcaucuuc

SEQ ID NO: 69694 - RNA, 64 nt, Human
uuuucauugccaacacuuacuguacccacuccgcagagcccagcugggccugggccccagggcc

SEQ ID NO: 69695 - RNA, 64 nt, Human
uugcucaccacccaagaaccucaggacagaagcgagagcccauugcuccugcucagcucagccc

SEQ ID NO: 69696 - RNA, 64 nt, Human
gucuccccucccccacguuggggacgccccucccagagcccaggucaccuccgggcuuccgcag

SEQ ID NO: 69697 - RNA, 64 nt, Human
gaggagccucaguuuccucaucuguaaacuggagagagcccagcacuuggcagguguccaguac

SEQ ID NO: 69698 - RNA, 64 nt, Human
ggcuauggaauguuucugcaacccuaaggcacagagagcccaacccugagugucucagaggccc

SEQ ID NO: 69699 - RNA, 64 nt, Human
caagggugccaagcugugaugagagggccaccgcagagcccaggaggcagcaucuccagagcug

SEQ ID NO: 69700 - RNA, 64 nt, Human
gguacgaaaggugugggcugugauaggagagggcagagcccauguuuccugacauagcucuaca

SEQ ID NO: 69701 - RNA, 64 nt, Human
gaguguccauagauggauggaggagguggagcccagagcccaaggaagagcugggaauucuugc

SEQ ID NO: 69702 - RNA, 64 nt, Human
ucccugccgugggcucucauugccaauauggaacagagcccagggccaggcagacuggggcagu

SEQ ID NO: 69703 - RNA, 64 nt, Human
caucacccuccuuucuauucugggggcuucugagagagcccagccugaugccagaacaaaggac

SEQ ID NO: 69704 - RNA, 64 nt, Human
gaccuuuucacaauggaaaaccugggggauggucagagcccagucgagaccucacacacggcug

SEQ ID NO: 69705 - RNA, 64 nt, Human
aaaucaaaauguuaacacaaagcuaagauucaucagagcccacccuauucuaaggaaccacaau

SEQ ID NO: 69706 - RNA, 64 nt, Human
guaacucugguaaagcauccuguggagggagaggagagcccagucauuugcuuagaugguguuu

SEQ ID NO: 69707 - RNA, 64 nt, Human
ugggccagagaaaaugaaggaaggccacaagcucagagcccacaucaacacugccccccuccca

SEQ ID NO: 69708 - RNA, 64 nt, Human
gcgcucaccuugccagaaagucugguggcagcgcagagcccaaucauuccaaccaaagcagggu

SEQ ID NO: 69709 - RNA, 64 nt, Human
uaaaauaucuuagaauuaaugaucucuuuggaagagagcccagauuuguaugaaaacuuguuuu

SEQ ID NO: 69710 - RNA, 64 nt, Human
augccccauggcaauugucaaggcucuugaugcaagagcccagggggcuauuguaaaaacuugg

SEQ ID NO: 69711 - RNA, 64 nt, Human
ccagguugggcaauagucugcuuccacggugaucagagcccacuagcaggcuaagauuucuaaa

SEQ ID NO: 69712 - RNA, 64 nt, Human
ugcugcucccaauaccucagcaugguaaggggacagagcccagcagaucccagcugugaagagg

SEQ ID NO: 69713 - RNA, 64 nt, Human
gagcuagagcuugccucacccgcuguagccgccgagagcccaggauguacuggcggauggggcc

SEQ ID NO: 69714 - RNA, 64 nt, Human
ccuguccaggucccgcucccgguccccucggaggagagcccacuccccugagagacggagggaa

SEQ ID NO: 69715 - RNA, 64 nt, Human
cuucauucugaaccuuaucaagaggaucugacugagagcccacugcaguuagagcugagcacuu

SEQ ID NO: 69716 - RNA, 64 nt, Human
agcaccccuucuccagcggugggaagugaugcagagagcccacccgugcagagggcagaagagg

SEQ ID NO: 69717 - RNA, 64 nt, Human
uaagcuauucuuugucacuugggugccaaacaugagagcccagaaaacugucauuuagcuggcu

SEQ ID NO: 69718 - RNA, 64 nt, Human
acaccccuguccuccagcaccauagagaggcgcuagagcccauuccucuuucuccaccgucacc

SEQ ID NO: 69719 - RNA, 64 nt, Human
ccagaaaacacucaaauuuauuuugcaacaagugagagcccaggagaccuccuuauuauccugu

SEQ ID NO: 69720 - RNA, 64 nt, Human
cugucucacucucaggacuauucuguaagaguccagagcccaccuccucaguuccuguggauag

SEQ ID NO: 69721 - RNA, 64 nt, Human
uuagccuaaacagggcacauagaucucucccacuagagcccagagggaugagaggagagagcaa

SEQ ID NO: 69722 - RNA, 64 nt, Human
augccacacaaggauagaugcuggcccagggcccagagcccagcuccaaggggaaucagaacuc

SEQ ID NO: 69723 - RNA, 64 nt, Human
ggaggaggcaggcagcaccagcagggguccaccaagagcccagaccagccccucugcccuccua

SEQ ID NO: 69724 - RNA, 64 nt, Human
gcaggaaauggggggaucacuuuccaagugccaaagagcccagagggacucuaagaaccuaagg

SEQ ID NO: 69725 - RNA, 64 nt, Human
guauuuggagucaaaugcaagucugucuaaaucuagagcccauguucuuuaacugcaacacuau

SEQ ID NO: 69726 - RNA, 64 nt, Human
uccaguaaguggccuuugcucuuuuuuguaccaaagagcccagaugauuccuacagucccuuuc

SEQ ID NO: 69727 - RNA, 64 nt, Human
ccuuucaacucuaaaaauugacccuaucaacuggagagcccacaaggcauagggaauagagaaa

SEQ ID NO: 69728 - RNA, 64 nt, Human
uacgacggcuacuuacuuuuauggcaauggcaucagagcccaaugccuacaaguugcaaaaaca

SEQ ID NO: 69729 - RNA, 64 nt, Human
cagccauucagacaaagggggccuggagauacagagagcccaaauaaugccugcuggauugucu

SEQ ID NO: 69730 - RNA, 64 nt, Human
cuguccuccauggugagggcacagaugucuccccagagcccagcgcuggcagaauggauucugc

SEQ ID NO: 69731 - RNA, 64 nt, Human
ugggacuggcuuuccacaggaaguaaacugcuucagagcccacaguccccugcucaguguccgg

SEQ ID NO: 69732 - RNA, 64 nt, Human
caauuaguaaaaauaagaacauugaggagcagucagagcccaguguuaaucuccggcagagaug

SEQ ID NO: 69733 - RNA, 64 nt, Human
cccaaaauguuucgagucaacaaauuuaagagacagagcccauuuucuccauaaauuuguaaca

SEQ ID NO: 69734 - RNA, 57 nt, Human
ccagcagccugaguuucugauggaacaagagcccaggcuaccagagcaccugucccu

SEQ ID NO: 69735 - RNA, 64 nt, Human
aucucauuuugaauguuccagagggagcaucauaagagcccagagcuccgauuuccaaagagug

SEQ ID NO: 69736 - RNA, 64 nt, Human
gugugauucaaguucuggcagagcuuguaaggcuagagcccaggucugccgacacccugugcuu

SEQ ID NO: 69737 - RNA, 64 nt, Human
gaaaaugcucuuaaacccaaaggggcuucacugaagagcccacuuccaagucaauaaaaagcaa

SEQ ID NO: 69738 - RNA, 64 nt, Human
gauuaaguaggaggagagggguuucuugcucuccagagcccaaagggacaaauagggacuuugu

SEQ ID NO: 69739 - RNA, 64 nt, Human
gaagauuggcaaaaacgaaaagcuucuuccuccaagagcccauugaagaagcccagugaugaga

SEQ ID NO: 69740 - RNA, 64 nt, Human
cccugaggucaugcauuguaaucaucauagaaggagagcccaggccugcccucacgcucuccau

SEQ ID NO: 69741 - RNA, 64 nt, Human
agaaccuggagaaugagaaaaauuuacauggcaaagagcccauaaauccugaccaauccaacuc

SEQ ID NO: 69742 - RNA, 64 nt, Human
auggccaccugagugcaggugacaaggaccugacagagcccaugcagggcuuuagauuuggaca

SEQ ID NO: 69743 - RNA, 64 nt, Human
aauuuuguguugcuaaaaaaagugcaugauggugagagcccaaguuaucuuucccucuucggug

SEQ ID NO: 69744 - RNA, 64 nt, Human
cgagguugucugcuaaaccugcuccuccaaagccagagcccaagccuaaaaaggccccugcaaa

SEQ ID NO: 69745 - RNA, 64 nt, Human
aaaaaguauaguuuuggaacuuaaccuuggagugagagcccagggacaggucccuggaaaccaa

SEQ ID NO: 69746 - RNA, 64 nt, Human
agggcaaggcagaugcauucuccuggcugcugggagagcccaugggaaccuugcuuagcgccca

SEQ ID NO: 69747 - RNA, 64 nt, Human
gaagugcuucugaaaacaaaccuuucuggacggcagagcccaaguuucaagcuuucccugucca

SEQ ID NO: 69748 - RNA, 64 nt, Human
cagggcuguguccagacagcacaaaacggcaaggagagcccaagccccaaugccagaauucuuc

SEQ ID NO: 69749 - RNA, 64 nt, Human
gacaguagccauggagucccaccugugccaggucagagcccacccggcagguuucagagugguc

SEQ ID NO: 69750 - RNA, 64 nt, Human
ggcaaaggccaucuccuaauggaccaaggaccccagagcccaccugugugacgcugccuuuuua

SEQ ID NO: 69751 - RNA, 64 nt, Human
ugguagcuggaggugguagaauuuguaugcucuuagagcccaacagccaaggcagggucaagaa

SEQ ID NO: 69752 - RNA, 64 nt, Human
aggaaguugaugcacagaauuuaccucaucucacagagcccacgucgacgagcaccauuuggcc

SEQ ID NO: 69753 - RNA, 64 nt, Human
cccugauguaggaggggcacacagcugggggugcagagcccaccuggguaccugacccccaggg

SEQ ID NO: 69754 - RNA, 64 nt, Human
gcuagaacucacugucuauggcagaaggacauccagagcccauucuggaguuuuguuuuuuccu

SEQ ID NO: 69755 - RNA, 64 nt, Human
gugcuuuuguuuuuuuuuauggugcuuaaaguaaagagcccauccuuugcaagucauccauguu

SEQ ID NO: 69756 - RNA, 64 nt, Human
uaaugcccugcucucucccuggcccaccuuauagagagcccaaagagcuccuguaagagggaga

SEQ ID NO: 69757 - RNA, 64 nt, Human
aggaggcugggauccucuggcugagaaucuccucagagcccagugcagaagcugugaugcuuag

SEQ ID NO: 69758 - RNA, 64 nt, Human
gaguugaggcccuaacaaauuucaggcccagccaagagcccaugaauggaggcugcaggaggcu

SEQ ID NO: 69759 - RNA, 64 nt, Human
agggccuugaaguagcagccuuggcugacuuuccagagcccagucccaagccuggcaccaagcc

SEQ ID NO: 69760 - RNA, 64 nt, Human
aaacuugacuaaaugcagcgaugcucccagcccaagagcccaugggucggggaguggguuugga

SEQ ID NO: 69761 - RNA, 64 nt, Human
gugcccugggggucaccccuccccuccccuccucagagcccacccugagaggcagcagugaccc

SEQ ID NO: 69762 - RNA, 64 nt, Human
ggccaguggggcuggggaccggcgggggaccggcagagcccaccugggggccccacccuuugcc

SEQ ID NO: 69763 - RNA, 64 nt, Human
gcucccacgggauggagggugugguccuguggucagagcccaagcagcacucaggagaggggag

SEQ ID NO: 69764 - RNA, 64 nt, Human
guggggccccaccuucaggucuuagugguucacaagagcccagcagccaggcuggcuuuuucau

SEQ ID NO: 69765 - RNA, 64 nt, Human
uuuuguuuuuccagaguucguggagguggacugcagagcccagagcccuucaucucucugaggg

SEQ ID NO: 69766 - RNA, 64 nt, Human
aggcguucgccucuaguuucucagggauggagcgagagcccagccagagaacaguaagaggagc

SEQ ID NO: 69767 - RNA, 64 nt, Human
uacacacacauacacacacacgcgugcacacaccagagcccaccuuggcucaaguccucuuuuc

SEQ ID NO: 69768 - RNA, 64 nt, Human
cucaucaucuugggaaagguguuugugacuuuucagagcccagauuccuguugucuauuaaaac

SEQ ID NO: 69769 - RNA, 64 nt, Human
auagagcacugcagacaggcccuggcucagaaucagagcccagaaaguggcugcagacaaaauc

SEQ ID NO: 69770 - RNA, 64 nt, Human
gcggugcuaucucccccagccccauccucuguacagagcccacgcccccacuggugacaugucu

SEQ ID NO: 69771 - RNA, 64 nt, Human
acccagucugccccuggucucugcccauccaaucagagcccacccuccuggaagagacccccgu

SEQ ID NO: 69772 - RNA, 64 nt, Human
agugaccugacugggggugagggagaaggaggagagagcccauguguggugugugugccccuga

SEQ ID NO: 69773 - RNA, 64 nt, Human
gcugggcgggcccagccaaacccuccuucuuccuagagcccagccagcaggcaggaguuccugg

SEQ ID NO: 69774 - RNA, 64 nt, Human
ggucucagcccaccgcccuuggugccuucuuuguagagcccaccgcuaccucccucuccccguu

SEQ ID NO: 69775 - RNA, 64 nt, Human
aacaggccaccgccaaagccauggcccgccgccgagagcccaggccccacccgcaccuccucac

SEQ ID NO: 69776 - RNA, 64 nt, Human
guguagucccuggcauucugucuguauccaaaccagagcccagccaucccuccgguaucggggu

SEQ ID NO: 69777 - RNA, 64 nt, Human
aggcucuugaucugcuucccuaaauuacuuuuuuagagcccaaaccccagguuuagggugaggg

SEQ ID NO: 69778 - RNA, 64 nt, Human
acucccuucuaaucagcaaguccaguggccacuuagagcccagcuccuaccucuucauucacuu

SEQ ID NO: 69779 - RNA, 64 nt, Human
cccauuaaggacugggagaggcagagcaagccucagagcccaggccucaguggucauuaagaug

SEQ ID NO: 69780 - RNA, 64 nt, Human
cuuggccucuggcuccaucugaguccccugggagagagcccagcacccaagauccagcagggga

SEQ ID NO: 69781 - RNA, 64 nt, Human
augccuggcccugugcuggggcagacaacgcugcagagcccagggagccuggcgcuaggacgug

SEQ ID NO: 69782 - RNA, 64 nt, Human
ugugaugagauugggaagcccacuguaacacuggagagcccagguuauaucagacaccacuagu

SEQ ID NO: 69783 - RNA, 64 nt, Human
cacguaaaacaucgauaugcuaagaagaacaaaaagagcccaaucucugauguuauugagcucc

SEQ ID NO: 69784 - RNA, 64 nt, Human
cugccccggggaggccuggccaaguaguacagcuagagcccagggucccugcagggccuggccu

SEQ ID NO: 69785 - RNA, 64 nt, Human
aaaaaaagcauuaaaauuuauuugaaaccaaaaaagagcccaaaaagccaaagcaauccuaagc

SEQ ID NO: 69786 - RNA, 64 nt, Human
gucuuuuggaggcuccaagccucaaagugcccgcagagcccaccuugaggguuuugcuaguugg

SEQ ID NO: 69787 - RNA, 64 nt, Human
gggaauguguagaggagaaauugccucuuuauaaagagcccaguugucuccuugugacauucuc

SEQ ID NO: 69788 - RNA, 64 nt, Human
auucacuugaaugagaaacguguuuaguaucaaaagagcccaagaagacacuggugugaaaggu

SEQ ID NO: 69789 - RNA, 60 nt, Human
ugaaggcccgaauggacuaacccuguucccagagcccacuuuuuuuucuuuuuuugaaau

SEQ ID NO: 69790 - RNA, 64 nt, Human
cucgcagucaggggcagcugaccauggaagauugagagcccaagguuuaaacuucucugaaggg

SEQ ID NO: 69791 - RNA, 64 nt, Human
aaaaggucagcuccaccgaaggggcugccauggaagagcccaagaggagaucagcgcaauuguc

SEQ ID NO: 69792 - RNA, 64 nt, Human
cccugucugcgccgcugugcuguugucugccgugagagcccaaucacugccuauaccccucauc

SEQ ID NO: 69793 - RNA, 64 nt, Human
aggcuagugcuaagagggaaggcccagguuugagagagcccagaggggcagagcccagagccuu

SEQ ID NO: 69794 - RNA, 64 nt, Human
gggaaggcccagguuugagagagcccagaggggcagagcccagagccuuguuuggcccugaucu

SEQ ID NO: 69795 - RNA, 64 nt, Human
gucucaggcugccugagucgugaccugcuaggccagagcccacuccaucugguagaagggaaag

SEQ ID NO: 69796 - RNA, 64 nt, Human
acaacgaugacucugccucuugucagcccagccaagagcccagacgaccccucuguccucguuc

SEQ ID NO: 69797 - RNA, 64 nt, Human
ucuccucugugcccucugguggcucauuguccucagagcccagacaguuccagccacuaggagg

SEQ ID NO: 69798 - RNA, 64 nt, Human
ccauccccaucggcccuguccccuggagugugucagagcccaggggagaaugcagcccaccagg

SEQ ID NO: 69799 - RNA, 64 nt, Human
cuguugaucuacccgugccugggccccuccccucagagcccaugguaacgaaccccuagaaagg

SEQ ID NO: 69800 - RNA, 64 nt, Human
ccgggggcugggggcuggcaccgagaguucaaggagagcccaggagccagucucuggcuguggc

SEQ ID NO: 69801 - RNA, 64 nt, Human
ggcaaaucuuaaugggaccagugggggauaccccagagcccauggccugacugcacagccugcc

SEQ ID NO: 69802 - RNA, 64 nt, Human
augcuuuggcagaagagugaaagaacuccugccaagagcccagaccucuacaaacguuguaugu

SEQ ID NO: 69803 - RNA, 64 nt, Human
agaccagaggaucaagcugaagugaagccagugaagagcccaccuguggaaggacauggcgggg

SEQ ID NO: 69804 - RNA, 64 nt, Human
aggucuuuaagucuauuguuuaacuguaccauccagagcccaccagaagcuauugaucauuaaa

SEQ ID NO: 69805 - RNA, 55 nt, Human
cagcuccuggccaucuguaggagucagagcccacauggccgggcccucuguagcu

SEQ ID NO: 69806 - RNA, 64 nt, Human
ggcuucccguuauccacgaggauuugugggugucagagcccauaggcaucacucuucagcaccu

SEQ ID NO: 69807 - RNA, 64 nt, Human
caauccucugucuccuugcuccaauggaggcagaagagcccaggacccaagcgucuuggcaggg

SEQ ID NO: 69808 - RNA, 64 nt, Human
cauccaaaccucaaggcucaggaucccauagaccagagcccaccuuuuugauaaacuuaguaaa

SEQ ID NO: 69809 - RNA, 64 nt, Human
uuaacccuuguagcccaauccccucucuucgcgcagagcccaggcccagggucuggcugaaaag

SEQ ID NO: 69810 - RNA, 64 nt, Human
cagcuacuugggaggcugaggcgggaggaucgccagagcccaggaguuugaggcugcagugagc

SEQ ID NO: 69811 - RNA, 64 nt, Human
acugaggcucagccccaccccagggcagccagggagagcccaggagcuccccuccccaacugac

SEQ ID NO: 69812 - RNA, 64 nt, Human
cagugcugguauuugaaccaggcauccuggcuccagagcccauucuuuuaaucagagagacaga

SEQ ID NO: 69813 - RNA, 64 nt, Human
cugcauauuuuuuaaaauauugaauccaaggaagagagcccaaggguaggggagaaacccccca

SEQ ID NO: 69814 - RNA, 64 nt, Human
gaaaacacagguuccaaagucuaccuggugccugagagcccagggcccuuccuccguuuuaagg

SEQ ID NO: 69815 - RNA, 64 nt, Human
gccucugccuuuucugucucagcgggcagugcccagagcccacgcccccccaagagcccucgau

SEQ ID NO: 69816 - RNA, 64 nt, Human
ugcuuauuuugcuuugcauaauuggcucuuuuuaagagcccaagaaaguguuucuaaaauugcu

SEQ ID NO: 69817 - RNA, 64 nt, Human
ccaagggccgugguccacgguacuugaagaagccagagcccacauccugugcacugcugaagga

SEQ ID NO: 69818 - RNA, 64 nt, Human
aagucccagaagcagucccugacccccagcuuucagagcccagccaccagcuuggggcuggaug

SEQ ID NO: 69819 - RNA, 64 nt, Human
uauacacagaagugauaaaggaauccaaaguugaagagcccaggaaacgggaaacuguauccau

SEQ ID NO: 69820 - RNA, 64 nt, Human
aauccagcccagaucugaggccaagcuaugugcuagagcccaggccagcucugagaccaagccc

SEQ ID NO: 69821 - RNA, 64 nt, Human
gcucauaaugacacccagcuccuuugagaggaucagagcccauugcacaagaagagccgcugcc

SEQ ID NO: 69822 - RNA, 64 nt, Human
gcugcaaccagucuggggccauucagccagggacagagcccacagagcccauacaccugucucc

SEQ ID NO: 69823 - RNA, 64 nt, Human
agucuggggccauucagccagggacagagcccacagagcccauacaccugucucccaccagcgg

SEQ ID NO: 69824 - RNA, 64 nt, Human
ccccaggaccagaagcucccccagcaaagcccccagagcccaggcucggccugcccccacccca

SEQ ID NO: 69825 - RNA, 56 nt, Human
aggaggagaaucuggccugagaucuuagagcccagcccccuaaggacagggaacca

SEQ ID NO: 69826 - RNA, 64 nt, Human
cuccucgagccccuguggcauuggcuuggguggcagagcccacuuguuucagggaccccaggag

SEQ ID NO: 69827 - RNA, 64 nt, Human
aaacacuacuuuaaaguucauauggaaccaaaaaagagcccacauugccaagucaauccuaagc

SEQ ID NO: 69828 - RNA, 64 nt, Human
aaguggagcaggugguugcgggcaagcguugugcagagcccauagccagcugggcagggggcug

SEQ ID NO: 69829 - RNA, 64 nt, Human
cgaggacccuuuguguaucuccuccagcuaccgcagagcccacaaacccaggcaucuaucaaag

SEQ ID NO: 69830 - RNA, 64 nt, Human
cauacaacugaagacaacuaacccuuuccccaacagagcccaccagcagugguggagaugucgg

SEQ ID NO: 69831 - RNA, 64 nt, Human
accuauuuuuguaugaauaugaccaguuucaagcagagcccaaaaugucacaguugucaagaga

SEQ ID NO: 69832 - RNA, 64 nt, Human
acaccagccuccgggugccucccucugcuuguacagagcccauggucgggacagugcccuggcc

SEQ ID NO: 69833 - RNA, 64 nt, Human
uugagcaguugugacaggagaccauguggccugcagagcccaaauaucuacugucugauccuac

SEQ ID NO: 69834 - RNA, 64 nt, Human
uagaccugauuugucuggauuuuagaguuauuugagagcccauauuucaccuugaggagggugc

SEQ ID NO: 69835 - RNA, 64 nt, Human
cgggugccucccaagagcuucccaucucccuagaagagcccaagcguccccgucccguggaguc

SEQ ID NO: 69836 - RNA, 64 nt, Human
aggcagagggggacccucaccaaaucuugguggaagagcccaggggcuggucccagaacaggca

SEQ ID NO: 69837 - RNA, 64 nt, Human
ccugacacugccggaagagcacagggacacagccagagcccacggagggcccuucccgcaaagc

SEQ ID NO: 69838 - RNA, 64 nt, Human
ggacaucacugcaguccagugcaaagccgcccccagagcccagguguccccccaaccuaaccag

SEQ ID NO: 69839 - RNA, 64 nt, Human
uggaggcuuggaacaugugggucccuaugaguguagagcccauauccccauagagucuaccuag

SEQ ID NO: 69840 - RNA, 64 nt, Human
gcacagggcaucuaggcccuuaguggguucucccagagcccaaguaaaaacuuuauccuguggg

SEQ ID NO: 69841 - RNA, 64 nt, Human
ugaaugucaggaaugcagcaaggccuuuaagcagagagcccaucuuagucaacaucaaaauauu

SEQ ID NO: 69842 - RNA, 64 nt, Human
uuuauaaaauugagacugaugaaacaucaauacuagagcccaugaggaugaaagaaauuaucaa

SEQ ID NO: 69843 - RNA, 64 nt, Human
uuccagcucccccacucgcccuccacuaccucugagagcccagccacgccuuggagggaggggc

SEQ ID NO: 69844 - RNA, 64 nt, Human
guaaacugagagcuuaucuucacagaugugggaaagagcccaucccucugcacaccugagucaa

SEQ ID NO: 69845 - RNA, 64 nt, Human
gugccggggguguuugcugagggcuuccugugccagagcccagccagagagcaggugcaggugu

SEQ ID NO: 69846 - RNA, 64 nt, Human
cuaccuagcaucccccuccuaaagcuuuagacucagagcccagggucccccacaagccucaagg

SEQ ID NO: 69847 - RNA, 64 nt, Human
cauuuuccauauccuggugccccccaccccuggaagagcccagucuguugaguuaguuaaguug

SEQ ID NO: 69848 - RNA, 64 nt, Human
aacagagccaggauucaaacccagguguggcuccagagcccauccucuucccacugcuacccua

SEQ ID NO: 69849 - RNA, 64 nt, Human
caaaugcugcaguuuuaauaaucugugacuccugagagcccaugguuuuuugaccuugugguuc

SEQ ID NO: 69850 - RNA, 64 nt, Human
accccagagcuggcuggguuauggcuuuuguagcagagcccauacagccuauggaagaacuaga

SEQ ID NO: 69851 - RNA, 64 nt, Human
aauuuaaaaaaaacagucgcuaguuaacagcgacagagcccagcacccuggggucuuugugaau

SEQ ID NO: 69852 - RNA, 64 nt, Human
acuccaccuccacccacuguccgccucugcccgcagagcccacgcccgacuagcaggcaugccg

SEQ ID NO: 69853 - RNA, 64 nt, Human
cccuggagaaaacgaugucauuguucagcagcugagagcccaggcguccgcggcgacuugccgu

SEQ ID NO: 69854 - RNA, 64 nt, Human
ggcguggaccugcccauggugccugucagcccgcagagcccaucuacgcccaacacagagcuca

SEQ ID NO: 69855 - RNA, 64 nt, Human
gcuucuccagggagccuccucuuggcuuuggaaaagagcccagggacuuaacgugcugccuguu

SEQ ID NO: 69856 - RNA, 64 nt, Human
uuuaaugguuuuagcuuuuuauaauacccuugugagagcccauucccaccauucuaccugaggc

SEQ ID NO: 69857 - RNA, 64 nt, Human
ggguuucugaaaaacagcaggauuaaguacugaaagagcccaacacaauuacccuguaaacucu

SEQ ID NO: 69858 - RNA, 64 nt, Human
ugagagaauuguggagaccaacuaccacauagcaagagcccagcucuugggagcauugagaugu

SEQ ID NO: 69859 - RNA, 64 nt, Human
cccuagaucccaccaacucggggaacaucaccccagagcccagccuuauccagcagcgccuucc

SEQ ID NO: 69860 - RNA, 64 nt, Human
cagagaauucaagaagguacagcuuuggcccucaagagcccacuguaugcuggggaaauggaac

SEQ ID NO: 69861 - RNA, 64 nt, Human
ggcuccuucaggagcucucuacccaggggcaaggagagcccagagagaagcgcccuggucucuu

SEQ ID NO: 69862 - RNA, 64 nt, Human
cugccuucugcagagaggcaccuaagcuguuuaaagagcccagugauuguggcugcuccuccua

SEQ ID NO: 69863 - RNA, 64 nt, Human
cuuugaaauuagacuaacaaagcuccagacagcaagagcccaggugcacugcucacacccccac

SEQ ID NO: 69864 - RNA, 64 nt, Human
aucacagacaccggcugcaccaucagcgggaagcagagcccauguccaggaugccuccugcugc

SEQ ID NO: 69865 - RNA, 64 nt, Human
cgggcuccugguccgcaguggcagagcgccaggcagagcccaaucagggucucgugcugcccuu

SEQ ID NO: 69866 - RNA, 64 nt, Human
ucauggaagagcugaggccugugcuugguguuccagagcccaggguugagcauccugaaggagc

SEQ ID NO: 69867 - RNA, 64 nt, Human
aaccuguaugugccacauggaaaaacaggacaccagagcccaccagacagugccggccagcaga

SEQ ID NO: 69868 - RNA, 64 nt, Human
gcucaggccucucgugccuggugucagagaaggcagagcccacaguaggugcacggugcaaggc

SEQ ID NO: 69869 - RNA, 57 nt, Human
ucuuuaaaagcaaaggcugaagagcagagagcccacgugcaggaguucuuugcuucc

SEQ ID NO: 69870 - RNA, 64 nt, Human
gccggcucugacugggcagcucagccccucccccagagcccagggucuugcacaccccucccug

SEQ ID NO: 69871 - RNA, 64 nt, Human
agacggcgacagaaccugacccguggagacugggagagcccagcaggcaccuguauugcagggc

SEQ ID NO: 69872 - RNA, 64 nt, Human
cuuccucuggcccguccugggaaggggggugucuagagcccaggaaacuucuucuuccguggcu

SEQ ID NO: 69873 - RNA, 64 nt, Human
cgugggagcuccagaacuuuccccagcugagugaagagcccagccccucuuaugugcaauugcc

SEQ ID NO: 69874 - RNA, 64 nt, Human
gagcugcccacacccccaccugccaaggccccacagagcccaaaacagaagggggcugccccag

SEQ ID NO: 69875 - RNA, 64 nt, Human
cccugcuccgggcccaugccccaaggagcccuucagagcccacacugccagucgaggccuggcu

SEQ ID NO: 69876 - RNA, 64 nt, Human
aagacugagguucuugggguccauaaggcucuucagagcccaagagaguugugcuaagauggcc

SEQ ID NO: 69877 - RNA, 64 nt, Human
aaauugggucauucauguccuacgcagcuaaaacagagcccaggagccagggaggaaaagcagu

SEQ ID NO: 69878 - RNA, 64 nt, Human
ccugcgucugagguggcccaggaccccaagcugcagagcccagggaagagcagcuccagagccc

SEQ ID NO: 69879 - RNA, 64 nt, Human
uauguggaaaggcccauuuccagguuugcguagaagagcccagaaaacagagucucaagacccc

SEQ ID NO: 69880 - RNA, 64 nt, Human
cugaggggccccgggaguggccuuggcucccuggagagcccacgucucagccacaguucuccac

SEQ ID NO: 69881 - RNA, 64 nt, Human
cuccuccucuaggaccagcuugccacgguuucucagagcccaggugcccucugaccugccaugc

SEQ ID NO: 69882 - RNA, 64 nt, Human
cagaggcuccugcugacuucggaggggcggaugcagagcccagggcccccaccggaagaugugu

SEQ ID NO: 69883 - RNA, 64 nt, Human
gacauucauuucuucagcagcccauuagcaacugagagcccagggauguccuacaggauaguuu

SEQ ID NO: 69884 - RNA, 64 nt, Human
ugcccaaggucguaagcaagcuacuggcauggcaagagcccagcuuccugacggagcgcaacau

SEQ ID NO: 69885 - RNA, 64 nt, Human
ccucccuccugucuggcuccuggggcccaugcuuagagcccaggcuccagcccugagugcuucc

SEQ ID NO: 69886 - RNA, 64 nt, Human
ccccugcaaagcagggcccaccuccuggacucagagagcccagggcaacugccaagcaggggga

SEQ ID NO: 69887 - RNA, 64 nt, Human
aaaacaugccuacuacuaccagcagaaagggagcagagcccagagcaucaccaggagugccugc

SEQ ID NO: 69888 - RNA, 64 nt, Human
ccagcauaggcgcagacaguugggacgaaacuucagagcccaggcagucccugaaugaccaggc

SEQ ID NO: 69889 - RNA, 64 nt, Human
cucccauuacucaaaaugcaggacagaucaggucagagcccaggaauucucacagguucaccca

SEQ ID NO: 69890 - RNA, 64 nt, Human
gcuccccgaaacugggguguccaggcggaacagcagagcccaggucccgcggccuauacggugc

SEQ ID NO: 69891 - RNA, 64 nt, Human
ggccuggggaaaccauggcaaaguggauccaguuagagcccauuaaucuugaucauuccgguuu

SEQ ID NO: 69892 - RNA, 64 nt, Human
ugcugcauaacuacauaaacagcagagguguuuaagagcccagaaaaacauaauuugauuuuaa

SEQ ID NO: 69893 - RNA, 64 nt, Human
ugccccuaccacccaagggugccauggucccgggagagcccaaaccaccuguugggcauagcca

SEQ ID NO: 69894 - RNA, 64 nt, Human
gagaccuuuuuuauuagggugcuguuuguuauugagagcccaaucucugcaugaauaacagaaa

SEQ ID NO: 69895 - RNA, 64 nt, Human
cugguacauggaugcuuugaaagauauggaagacagagcccaggccauaauugacaccacagau

SEQ ID NO: 69896 - RNA, 64 nt, Human
uguuuggauuuucaauaucgacuuugcuuaaaacagagcccaccugcauaguaacuguguuuug

SEQ ID NO: 69897 - RNA, 64 nt, Human
agagagguggcuauugcauugcgcagaacgcuacagagcccaugcucuucccagagcagcaccc

SEQ ID NO: 69898 - RNA, 64 nt, Human
gucuuuuggccccaugucaguuucuauugcauugagagcccaagagccccuggucagucaggcu

SEQ ID NO: 69899 - RNA, 64 nt, Human
gcagcauugauagaaguauggagggguucaagacagagcccaccugaucaagaucaucagcuac

SEQ ID NO: 69900 - RNA, 64 nt, Human
cugugggacuguggaucucacuggaagcuauccaagagcccacugucaccuucuagaccacaug

SEQ ID NO: 69901 - RNA, 64 nt, Human
caaacuggccgcgggggcaggggaggccaucuggagagcccagaguccccccacucccagcauc

SEQ ID NO: 69902 - RNA, 64 nt, Human
cuuaccaacuuccccccaaaaaagggaacauaaaagagcccaucuuugucaguuuacaccaaua

SEQ ID NO: 69903 - RNA, 64 nt, Human
ugcgcuuccucagugaccgaaagaacccggugugccgggagauggcugugguacugcuggccaa

SEQ ID NO: 69904 - RNA, 54 nt, Human
cugccuggggcaggagcugagugaccgggagaucccacugacccccguugacca

SEQ ID NO: 69905 - RNA, 64 nt, Human
uuucccugccucugcgccucucggggaacacauuccgggagagaugccuggccaggcuccacgg

SEQ ID NO: 69906 - RNA, 64 nt, Human
aaugugcacugccgaggagaaugccagccagggcccgggagagugugagguuucaggaaaguau

SEQ ID NO: 69907 - RNA, 64 nt, Human
ucuuguauauuccccacaaagccguucgcagcuuccgggagaaggggccagagcccgguggggc

SEQ ID NO: 69908 - RNA, 64 nt, Human
aggggaccauucuguucagugcgauccugaugguccgggagaugaggguuuccggggcuaguga

SEQ ID NO: 69909 - RNA, 64 nt, Human
acgaugaaaucaacaaccuguaucugguaucaggccgggagacagaugaggcgagaggaggagg

SEQ ID NO: 69910 - RNA, 64 nt, Human
gcgacagguaacgcagugcgggguuagggauuccccgggagagaggacgaagcgaggagaguuc

SEQ ID NO: 69911 - RNA, 64 nt, Human
cgaagacagcccgguaggcugcgucgcccgagccccgggagagaggagcgaagauccggaacuc

SEQ ID NO: 69912 - RNA, 64 nt, Human
acuugggaggcugaggcaggagaauugcuugagcccgggagagggagguugcagugaggcgaga

SEQ ID NO: 69913 - RNA, 64 nt, Human
uuguaaaugcugcugaggaacaaaugaaggucauccgggagagaaaugaagaaaucucuggagc

SEQ ID NO: 69914 - RNA, 64 nt, Human
gguaaaaaggucaguccauugcaggaauauauauccgggagagcuaggucccuuggggcucugg

SEQ ID NO: 69915 - RNA, 64 nt, Human
uccauccucagugagaacaccagagaacccggggccgggagaaggugguucuucaagccgagag

SEQ ID NO: 69916 - RNA, 64 nt, Human
aaaccuggacaucccucaaggggcgaagaggcggccgggagacugcagaaguggcuccuuuuca

SEQ ID NO: 69917 - RNA, 64 nt, Human
augcaggggauagcagugaggucagaagucuuucccgggagagagauggccuggguuaucauug

SEQ ID NO: 69918 - RNA, 64 nt, Human
gacagccggggcugggugcugcaggggcuucagcccgggagagggggugggcguguucuuugug

SEQ ID NO: 69919 - RNA, 64 nt, Human
ggcgccuuccucgccccgggcugagagcugggucccgggagauggaagccucccaggcgcgcga

SEQ ID NO: 69920 - RNA, 64 nt, Human
uacccgcuucccaucaccggaggagcuuccccggccgggagaccaguguuagaggauccaagcg

SEQ ID NO: 69921 - RNA, 64 nt, Human
cuacuuggcaggcuaacgcaggagaaucacuugaccgggagacagagguugcagugagcugaga

SEQ ID NO: 69922 - RNA, 64 nt, Human
ggggcugggggccccacgaccugcagcgucgaguccgggagagagcccggagcggcgugccauc

SEQ ID NO: 69923 - RNA, 64 nt, Human
ucuaguuccaaguuuuaaauacauggaaggaaguccgggagaaccauaugaaggagcaggagga

SEQ ID NO: 69924 - RNA, 64 nt, Human
aucuuuagaaacaucaguuuuuguauggaagccaccgggagauuucuggaugguggugcauccg

SEQ ID NO: 69925 - RNA, 64 nt, Human
ugccuuuccagcgaggucagccgagaugacgcugccgggagagcagucuucucuguaguccccg

SEQ ID NO: 69926 - RNA, 64 nt, Human
gcccccgcuccucggcuccagagcgcccgcauucccgggagaggcggugugggggcccgggccc

SEQ ID NO: 69927 - RNA, 64 nt, Human
cucagguaucaugggcguaaugaucacccaggcuccgggagaucucauggaugauuacuguaug

SEQ ID NO: 69928 - RNA, 64 nt, Human
ccccucacaccaccgccaggagaggccuuucccaccgggagagaaacuuccagaccagccccuc

SEQ ID NO: 69929 - RNA, 64 nt, Human
ccccucacaccacagccaggagaggccuuucccaccgggagagaaacuuccagaccagcccucu

SEQ ID NO: 69930 - RNA, 64 nt, Human
gcccucucacuacagccagaagaggccuuucccaccgggagaggaacuuccagaccagccccuc

SEQ ID NO: 69931 - RNA, 64 nt, Human
aucuuggcaagguucagucugaauggcauggagaccgggagauagagggguuuuagauuuuuaa

SEQ ID NO: 69932 - RNA, 64 nt, Human
gcagugaacugugauggcacaacugcauuucagcccgggagacagcaagauucugucucaaaaa

SEQ ID NO: 69933 - RNA, 64 nt, Human
cagggaggcugagugaggccacgcagccgccugcccgggagaacccugccugaagcucuggaaa

SEQ ID NO: 69934 - RNA, 64 nt, Human
cagagagauucgacagucagccuuguguccuaggccgggagagcuucgcuucagggaaacauua

SEQ ID NO: 69935 - RNA, 64 nt, Human
aauuauugaccuggggaacuagccacacaggaggccgggagacagggacuggugagaauggggc

SEQ ID NO: 69936 - RNA, 64 nt, Human
gagaaacauccuucaaaggacaguguuguuuugaccgggagaucuagagagugcucagaauuag

SEQ ID NO: 69937 - RNA, 64 nt, Human
gccccugagagccgccuggcuuucccuuccaguuccgggagagcggcugcccgacucagguccg

SEQ ID NO: 69938 - RNA, 64 nt, Human
aagaguuuugucaacacaacacuuuguccccgcuccgggagaugagucagaugguggcuugagu

SEQ ID NO: 69939 - RNA, 64 nt, Human
ccgcgggagcccggcgggggcacgcgccacguggccgggagacgcacagggcgccagcgucgcc

SEQ ID NO: 69940 - RNA, 64 nt, Human
acuugggaggcugaggcauaagaauuguuugagcccgggagacagagguugcagugagccaaga

SEQ ID NO: 69941 - RNA, 64 nt, Human
acuugggaggcugaggcaggagaaucacuugaacccgggagaugaagguugcagugagcugagg

SEQ ID NO: 69942 - RNA, 64 nt, Human
ccucagggucucacaccuugggguugucagguucccgggagaaggcggugaggacucggccaaa

SEQ ID NO: 69943 - RNA, 64 nt, Human
auugacauguaaaugcaccugcaccguuucugagccgggagaguguuuacuuaaaaucaugccc

SEQ ID NO: 69944 - RNA, 64 nt, Human
gggcaacucggagagggcugcgagcauuucccucccgggagaggagaucagggcgaccugcacg

SEQ ID NO: 69945 - RNA, 64 nt, Human
cuuuacugauuaaaguuuucuuuuauuuggguggccgggagagacccagggagguucuggaggu

SEQ ID NO: 69946 - RNA, 64 nt, Human
cccaggacucacccuccacaaagcaaaggcagucccgggagaaaagacggauggcaggauccaa

SEQ ID NO: 69947 - RNA, 64 nt, Human
acuggccuaggggccagggcuuugggaugggaggccgggagaggaugucuuuuuuaaggcucug

SEQ ID NO: 69948 - RNA, 64 nt, Human
gcagugggcagguggccgccccugaggcuucacgccgggagaagccaccuucccaccccuucau

SEQ ID NO: 69949 - RNA, 64 nt, Human
ccgcccacucacccaggagcuggcugggccaggaccgggagagggagcacugcugcccuccugg

SEQ ID NO: 69950 - RNA, 64 nt, Human
cauguuaguaauggcagagcagucuaaacagaguccgggagaaugcuggcaaaggcuggcugug

SEQ ID NO: 69951 - RNA, 64 nt, Human
acagggggccucucugccuccagccccaccuuccccgggagaagcuuuccccaauccccagguc

SEQ ID NO: 69952 - RNA, 64 nt, Human
agaggcugcagaggcggggacacaccuguguccuccgggagaggcccccuccucuccccagacc

SEQ ID NO: 69953 - RNA, 64 nt, Human
acucgggaggcugaggcaggagaauugcuugaacccgggagacggagguugcagugagcugaga

SEQ ID NO: 69954 - RNA, 64 nt, Human
accuguccuggggcuguugagcagcauaauaaucccgggagaaugauuccccucauagaaagac

SEQ ID NO: 69955 - RNA, 64 nt, Human
uaccacagggagacagagggagguaagccaucccccgggagaccuugcugcugaccauccuagg

SEQ ID NO: 69956 - RNA, 64 nt, Human
aggguagccuaaagcucucuguggaaaccaccuuccgggagaccugaggaguguaacguggagg

SEQ ID NO: 69957 - RNA, 64 nt, Human
accggcagcugcuggcugaaguucaggcccugagccgggagaacagggagcuccuggagcgcag

SEQ ID NO: 69958 - RNA, 64 nt, Human
gagguggagagaccccuucagagcagggauugugccgggagagugccucugacuuugggacauu

SEQ ID NO: 69959 - RNA, 64 nt, Human
ccccauucucacugcuaucuggggagugauuaccccgggagacugaacugcaggguucaagccu

SEQ ID NO: 69960 - RNA, 64 nt, Human
ccucggggaacuagaaccuuccaggaucuggagcccgggagagccacacugugggcuuaaugug

SEQ ID NO: 69961 - RNA, 64 nt, Human
gggcgggacccaggcaccugcauuuuaaagcgccccgggagacucugaaucuuuuucagaaaca

SEQ ID NO: 69962 - RNA, 53 nt, Human
ggcuggcggcugcugucugagccccgggagaccaggugggggcaggacugugg

SEQ ID NO: 69963 - RNA, 64 nt, Human
gaggcacgcgaacugucagucuuuccuaaggcccccgggagacgcaggcaauggggccucgcag

SEQ ID NO: 69964 - RNA, 55 nt, Human
accaacaguauaaagccuaaagaagccgggagacacucuaggucagugggggagc

SEQ ID NO: 69965 - RNA, 64 nt, Human
acauuucucacugccuucugucugcccaguuucaccgggagaagucggccucuuccugaugggc

SEQ ID NO: 69966 - RNA, 64 nt, Human
ggccaggagcccuggcccgcaagagggacagagcccgggagagacucgcucacucccauguugg

SEQ ID NO: 69967 - RNA, 64 nt, Human
ccgcgcuuuccccuccucccugggauggacgcugccgggagacugccaguggagacggaaucug

SEQ ID NO: 69968 - RNA, 64 nt, Human
aggugauuaaagauacggagucccuguucaaaacccgggagaaggaguaucaggagaccauuga

SEQ ID NO: 69969 - RNA, 64 nt, Human
acuuaguccgggauaagggccuccccaguccucuccgggagaugauuugggaaauuuuauaaug

SEQ ID NO: 69970 - RNA, 64 nt, Human
uuacgggagaauguugauuucgcgggugcgagggccgggagacagauacuuggcugugaugagc

SEQ ID NO: 69971 - RNA, 64 nt, Human
gaaaaaaagcaaaaagcaagggagaaaagagaaaccgggagaaggcaugagaaagaauuugaga

SEQ ID NO: 69972 - RNA, 53 nt, Human
gaaccccgucccgccucugaggaccgggagacagcccacaggccagaguuggg

SEQ ID NO: 69973 - RNA, 64 nt, Human
gguggguggaggaaccccgucccgccucugaggaccgggagacagcccacaggccagaguuggg

SEQ ID NO: 69974 - RNA, 64 nt, Human
ggucugucggaagcuguccucgugcuuuccuggaccgggagagucccgguccccucgggaggga

SEQ ID NO: 69975 - RNA, 64 nt, Human
gugcagcuggaauggaacccagcauuggagagagccgggagagagccgcagcuccguccacagc

SEQ ID NO: 69976 - RNA, 64 nt, Human
gauccucugcuguaacugcagggucacaggcaucccgggagaaugggccuccacccucagccag

SEQ ID NO: 69977 - RNA, 64 nt, Human
uaccagagccagaggucagugcugaagacguggaccgggagaaugaguacauaagcaggcuggc

SEQ ID NO: 69978 - RNA, 64 nt, Human
aggcaggugaugcugugggcacgcucucccaacuccgggagagccucgccuggaugcuggggcg

SEQ ID NO: 69979 - RNA, 64 nt, Human
ggcccaggagacugacccaaagugaaggacauugccgggagaggccugcagcaucccuggauuu

SEQ ID NO: 69980 - RNA, 64 nt, Human
uugugcgugggugaagccgcugcuggguuuuccuccgggagaggggacggucaauccugugggu

SEQ ID NO: 69981 - RNA, 64 nt, Human
ugcgggaucccgagggccuuccugcccacaugccccgggagaaaccgaggccccucccuccucc

SEQ ID NO: 69982 - RNA, 64 nt, Human
cagccgcagcgcagccgccgggcaggccugcgugccgggagaggacucugccuuuuuucacagc

SEQ ID NO: 69983 - RNA, 64 nt, Human
gugcugcuccuuugcuucggaccuccgccucugcccgggagaaagcccaggccagccugcugga

SEQ ID NO: 69984 - RNA, 64 nt, Human
cacugucacccugacugcaggaggcacagggacuccgggagacucagagggcgaagagcacugg

SEQ ID NO: 69985 - RNA, 64 nt, Human
cuugaaucucuacguggccacugaacugcugggcccgggagacuggacuacaacaccucacacu

SEQ ID NO: 69986 - RNA, 64 nt, Human
agccguaagggaaaaggguguccagaacuagcgaccgggagagcuuuucuuuaacgauaucaac

SEQ ID NO: 69987 - RNA, 64 nt, Human
agccggcaggagggcggagcgaggauguccuuucccgggagacaagucgggaaagccuggcugg

SEQ ID NO: 69988 - RNA, 64 nt, Human
ucuccaccaugucagucuaaagagucuaaaggggccgggagaagcaugagcgaggggcagauuc

SEQ ID NO: 69989 - RNA, 64 nt, Human
ugggccacauggcagcccagggggcaggagaagcccgggagaggcccacuggcuaccagacuca

SEQ ID NO: 69990 - RNA, 64 nt, Human
acuugggaggcugaggcaggagaauggugugaacccgggagauggcgcuugcagugagcugaga

SEQ ID NO: 69991 - RNA, 64 nt, Human
gaggcucgggccgggcguaggaggcggcaccgggccgggagagcuucccugacgggagucgcgg

SEQ ID NO: 69992 - RNA, 64 nt, Human
aagccagccugggccagccccgcuucggccccucccgggagauccgugcgcccgaccagcacca

SEQ ID NO: 69993 - RNA, 64 nt, Human
ccuguccuacccccuuuccccaccgagagcugggccgggagaggaccgcagggcagguggcgug

SEQ ID NO: 69994 - RNA, 64 nt, Human
ccaguagggggccaggccucccacuccucccagcccgggagaugcuccgcguggcaccacccuc

SEQ ID NO: 69995 - RNA, 64 nt, Human
agggaggggaggacccauggcucuccccccuagcccgggagaccagggccuuccucuuccucug

SEQ ID NO: 69996 - RNA, 64 nt, Human
cccuucauuucccaggucuggaucgauucacuugccgggagagacuuuuuacaacucaucugca

SEQ ID NO: 69997 - RNA, 64 nt, Human
gccuugggaacagaucugaugaugccaggagguuccgggagacaauuuagggcugaugcuaucu

SEQ ID NO: 69998 - RNA, 64 nt, Human
cgcccuccccgcgugugcgccaggcuugggguccccgggagagcagagcuugcgccucgggcau

SEQ ID NO: 69999 - RNA, 64 nt, Human
ucggggagcccuacccgccaaaccugcuguuggcccgggagagccccagaggcucccggagacu

SEQ ID NO: 70000 - RNA, 64 nt, Human
ccacccccgugcaacccaggacggcugucugaggccgggagaugccuuagacgcaggaugggcc

SEQ ID NO: 70001 - RNA, 64 nt, Human
gaaagggaggugacuucgcccgguggcaauaguuccgggagaauuggccauugguaaaaagacu

SEQ ID NO: 70002 - RNA, 64 nt, Human
ccgccaugcccgcagcuuccuggcacuaccugagccgggagacccaggacuggcggccgccaug

SEQ ID NO: 70003 - RNA, 64 nt, Human
cugugggaagccagcacuagcucucaucccccauccgggagauaccaccaguccugguccccuu

SEQ ID NO: 70004 - RNA, 64 nt, Human
cacagaacugggguaagaagacaaagaguagccaccgggagaggcuuccuuuguuacagcuggg

SEQ ID NO: 70005 - RNA, 64 nt, Human
caggacccugaggguuuccaccuuggcgcgcagcccgggagauccgcccugggcucuggguucg

SEQ ID NO: 70006 - RNA, 64 nt, Human
ccggggucgagggaauacgcagguuccugucccuccgggagaccuagagaagcugcacacccag

SEQ ID NO: 70007 - RNA, 64 nt, Human
acacgcagccugcucuggagccugcagaugagauccgggagacugacacgaagccagcagaggu

SEQ ID NO: 70008 - RNA, 64 nt, Human
gaaggaagaugcaaacugugcagugugcgacagcccgggagaccucuuagaucaguucuuuugu

SEQ ID NO: 70009 - RNA, 64 nt, Human
ccucuacauuuuaaagggggagagggaaaaguaaccgggagacaaauugagccacauauuuuca

SEQ ID NO: 70010 - RNA, 58 nt, Human
agcagauguacagcuacugagcugcguuccgggagacucggggcaagaacugcagagg

SEQ ID NO: 70011 - RNA, 64 nt, Human
uccugugaggugcacgcuccgcagcccagcccagccgggagaccacguggccauugcggucucc

SEQ ID NO: 70012 - RNA, 64 nt, Human
gcacaccuccaagucagggcaccacaacacgccaccgggagagaugcugagaaaaacccaagac

SEQ ID NO: 70013 - RNA, 64 nt, Human
cucuacccacgcgcaugacucacccacucccuucccgggagacgaggagggcgggcagggaggu

SEQ ID NO: 70014 - RNA, 64 nt, Human
gggccgcccuucccggggaggcaagauugagggcccgggagagggaggcccgagcugccaccgg

SEQ ID NO: 70015 - RNA, 64 nt, Human
agcugccacggucccuccugucauucucacgacuccgggagaaacugugcuguaugauacagau

SEQ ID NO: 70016 - RNA, 64 nt, Human
uauucuacuccaagagauucugccucccuuguguccgggagaacaucaaugcuuuuccucagga

SEQ ID NO: 70017 - RNA, 64 nt, Human
agggcuuucuggaggacgcgcuggggccgggaccccgggagacucaaagggagaggucucagug

SEQ ID NO: 70018 - RNA, 64 nt, Human
agcaaugccccuaccacccaagggugccauggucccgggagagcccaaaccuaucaccaccugu

SEQ ID NO: 70019 - RNA, 64 nt, Human
aggacugacuccugggggagaacagcauucccgccgccuccagccucuccccucuggcaggcgc

SEQ ID NO: 70020 - RNA, 64 nt, Human
gcgagagucugucucaaaagaaaaaaaaaagcaccgccuccaaaugccaacuuguccuuuugua

SEQ ID NO: 70021 - RNA, 64 nt, Human
aucuacuugugagcuaucugccccaggcaggccucgccuccagcagccccaccugcccccagcc

SEQ ID NO: 70022 - RNA, 64 nt, Human
cgcugucugugggucccuugccccggagcugacucgccuccagugaguccauaccccagguuuc

SEQ ID NO: 70023 - RNA, 64 nt, Human
guacaguggugcaaucuuggcucacugcaaccuccgccuccagggcgcagccuccugaguagcu

SEQ ID NO: 70024 - RNA, 64 nt, Human
gccuccccaagaggguaguuagggguggggaagccgccuccacccagggggcguggugggggcg

SEQ ID NO: 70025 - RNA, 64 nt, Human
uccuuuugcuucaucuggagucccuccucccccacgccuccauccacacacagcagcuccaacc

SEQ ID NO: 70026 - RNA, 64 nt, Human
uuuccuggaauuuggccugggcguaugcagaggccgccuccacaccccucucccaggggcuugg

SEQ ID NO: 70027 - RNA, 64 nt, Human
guucagccccucagcucggccccagccuauuucccgccuccauuugauguuuccagguuuucaa

SEQ ID NO: 70028 - RNA, 64 nt, Human
cauugagggcacaggcuggacacaggaaugggggcgccuccagagggucucuccguccucaugc

SEQ ID NO: 70029 - RNA, 64 nt, Human
acaggaaccggcagcagcuaggcagucaccggcccgccuccauccaaaaucacgcucgcgugcu

SEQ ID NO: 70030 - RNA, 64 nt, Human
ccggccuggccgccaccaccgccaccgagagccccgccuccagcagccggugagcaggggugug

SEQ ID NO: 70031 - RNA, 64 nt, Human
cugggggggaagacaacggagaccggugucgcgccgccuccacgcucgacauccugcacacccu

SEQ ID NO: 70032 - RNA, 64 nt, Human
ggguuauggaccaacucagugcuucaggucuuaacgccuccauaccucuuccucaccaacuuua

SEQ ID NO: 70033 - RNA, 64 nt, Human
aagagaccugccuuguagguggcuuccuuaucugcgccuccauuuucuaucugcacuuuuugau

SEQ ID NO: 70034 - RNA, 64 nt, Human
cccagccagcugggccugggacuucugccucugccgccuccagaguggccuggcagcuuugcca

SEQ ID NO: 70035 - RNA, 64 nt, Human
ugaugaaggggauacgcuggaguugcccugccaucgccuccaucagccagacgagguccucaca

SEQ ID NO: 70036 - RNA, 64 nt, Human
uauacauugccagauuucuccuagggggcaaaaucgccuccauuugagaaccacaacucuaaag

SEQ ID NO: 70037 - RNA, 64 nt, Human
aggacuuaaugucuucuuccucucaagccaaauucgccuccacccacucccucugaagaacugg

SEQ ID NO: 70038 - RNA, 64 nt, Human
cacuggggacuuaggggugcggggaggggaaggacgccuccaagcccgcucccugcucaggagc

SEQ ID NO: 70039 - RNA, 64 nt, Human
gccuguggcccuguguccaguggcccacaggacacgccuccaccauaugcucauccuuccugcc

SEQ ID NO: 70040 - RNA, 64 nt, Human
gucuccuucuugucuccccggcccaggucccucccgccuccagguccauccaucccguccggaa

SEQ ID NO: 70041 - RNA, 64 nt, Human
gacgaggggugucuugggcagagcuggcucugagcgccuccauccaaggccagguucuccguua

SEQ ID NO: 70042 - RNA, 64 nt, Human
cauggcuucccagagcucccucugccccagccagcgccuccaggcccagcugaggagcugugag

SEQ ID NO: 70043 - RNA, 64 nt, Human
ucacucuuugcucauggcaugacacagcggagaccgccuccaacaacgaauuuggggcuacgaa

SEQ ID NO: 70044 - RNA, 64 nt, Human
cccacuccugcagggccagaaguucaggcugccccgccuccacugggggaucgcaccugugaau

SEQ ID NO: 70045 - RNA, 64 nt, Human
cccuagcauuggcugggauuccuguuccugggugcgccuccaccucccuucugauguuuccugg

SEQ ID NO: 70046 - RNA, 64 nt, Human
cugcugccucaguccugcaaccuaaagcuguagucgccuccaauagccauccaugccaucccug

SEQ ID NO: 70047 - RNA, 64 nt, Human
ggcuggucucgaacuccugaccuugugaucugcccgccuccauuuuuguuguuauuuuuugaga

SEQ ID NO: 70048 - RNA, 64 nt, Human
aguaggugguacaggggauuggaaacaugcuccgcgccuccagagaaaaguugcucccgagguc

SEQ ID NO: 70049 - RNA, 64 nt, Human
gggugaggauggcagagggacacagugccugucucgccuccaucagggagagcagccaugccag

SEQ ID NO: 70050 - RNA, 64 nt, Human
cagggcacccuugagaagccccucaccccuaggccgccuccaggugcuacccaggaguccccuc

SEQ ID NO: 70051 - RNA, 64 nt, Human
gcacgccaaagcaaaggauaaccauccuccaaaacgccuccauaacaccaguaaaguccaaaac

SEQ ID NO: 70052 - RNA, 64 nt, Human
aguggagcugaguggggucugggcucugccccugcgccuccacugcagugccugggcuccccuu

SEQ ID NO: 70053 - RNA, 64 nt, Human
uggagcagagcaagucugcaggugcaccacuucccgccuccaugacucgugcucccuccuuuuu

SEQ ID NO: 70054 - RNA, 64 nt, Human
caacucugcccgccucuguccccgccucaguccccgccuccauccccgccucuguccccuggcc

SEQ ID NO: 70055 - RNA, 64 nt, Human
aaugagagggagggcagccuucugccaccugugucgccuccacuggcagucacgccaccagagc

SEQ ID NO: 70056 - RNA, 64 nt, Human
augugauaggagcagcuuaacaggcagggagaagcgccuccaaccucacagccucguagagcuu

SEQ ID NO: 70057 - RNA, 64 nt, Human
cuauuucaagucaacaacacugaaaacugcuuuucgccuccacucuuacagcugugccuaauaa

SEQ ID NO: 70058 - RNA, 64 nt, Human
agacagguggccuagcaggcacaggacaccuggccgccuccaggagccuacccccugaaaguga

SEQ ID NO: 70059 - RNA, 64 nt, Human
ucugccuccugggcucaagagaccagcccaccuccgccuccaaguagcugggacuacaggcgug

SEQ ID NO: 70060 - RNA, 64 nt, Human
ugcugacuugacagcuucacuucugccuaagaugcgccuccacugucaccuguaccaagugcca

SEQ ID NO: 70061 - RNA, 64 nt, Human
aaauuagcuuacaaauguuauuuuucugacuucucgccuccacuccacuuacccugucaggaaa

SEQ ID NO: 70062 - RNA, 64 nt, Human
auccucccccuuccucccccgccccguucccuaccgccuccacuccugccagcucauuuccuuc

SEQ ID NO: 70063 - RNA, 64 nt, Human
cucuauaagcaccgccccagcucugacaaaaccccgccuccaggucggcaggcuccgccuucuu

SEQ ID NO: 70064 - RNA, 64 nt, Human
cuggggccgucagacuuggauacaucguaaacuccgccuccacggaacgucucgccuugcgagc

SEQ ID NO: 70065 - RNA, 64 nt, Human
ugucugcagcucagucccugccagcccccaggagcgccuccagggccccgcccacucucccacc

SEQ ID NO: 70066 - RNA, 64 nt, Human
uaccccggggccucccccgugacagugacggcugcgccuccaccccgacugcucagugcaucua

SEQ ID NO: 70067 - RNA, 64 nt, Human
uccuucuacugccuuauagugcuuaaacauucuccgccuccagggugcagauucagagcuggcc

SEQ ID NO: 70068 - RNA, 64 nt, Human
ugugacaccuucucaaccaggaggcaaguaaccccgccuccacaaucuuaguauuuuuuuuaaa

SEQ ID NO: 70069 - RNA, 64 nt, Human
ucccugccgaagugaauuguuggagaauguaaaccgccuccacguggcggcagacuuccuaagg

SEQ ID NO: 70070 - RNA, 64 nt, Human
cccagguucugcucuucccuggggacccuaaccucgccuccagcugaccugcccuguccucucc

SEQ ID NO: 70071 - RNA, 64 nt, Human
auggugcugcccaggccucucggugcuccaucuccgccuccacacugaccaagugcuggcccac

SEQ ID NO: 70072 - RNA, 64 nt, Human
auuaaauacuuggaauaaaucaagcaggucucaacgccuccacuauccugucuguaugcccugu

SEQ ID NO: 70073 - RNA, 64 nt, Human
gucuccugcuguggcuugggugccgggcgucucccgccuccaggaucuccucucaccugccccc

SEQ ID NO: 70074 - RNA, 64 nt, Human
uagaagggaaggaaggaaagaucaaggaaccaagcgccuccacgggaggcgagggaggcucugu

SEQ ID NO: 70075 - RNA, 64 nt, Human
uucaggacacacacacacacacacacacaccacucgccuccacugaaucuacacacagauuuua

SEQ ID NO: 70076 - RNA, 64 nt, Human
uuuugaaccuguaccaccuaauguagaaaaggcccgccuccagugcccuucuuuccaaaacagc

SEQ ID NO: 70077 - RNA, 64 nt, Human
uaagucacucugaaagggaguuguggagaggagacgccuccagacucucagaaguuuugaggac

SEQ ID NO: 70078 - RNA, 58 nt, Human
gugaccuguaaacccaacagcucaccuccgccuccaggaagaccagacucccacccuu

SEQ ID NO: 70079 - RNA, 64 nt, Human
uagacuuuugacaagcagggauuucaugcagggacgccuccaccuuucagccugcccucggucu

SEQ ID NO: 70080 - RNA, 64 nt, Human
gugcaguggcacgaucuuggcucacugcaaccuccgccuccaggguucaagcaauucuccugcc

SEQ ID NO: 70081 - RNA, 64 nt, Human
guccugauucgagguccuccuggccugagcgcagcgccuccacccugcccugcugagcacagac

SEQ ID NO: 70082 - RNA, 64 nt, Human
guaccucaucagcaagcgacucaagagcaggcaccgccuccaggacaacgugcgcgaggaccuc

SEQ ID NO: 70083 - RNA, 64 nt, Human
caugacagccuuugacccacaacggccacacagccgccuccagaccagcacucggacugcccug

SEQ ID NO: 70084 - RNA, 64 nt, Human
gcuccgugaccuacacccuggcccagcuccccugcgccuccauggcucugcagauccucuggga

SEQ ID NO: 70085 - RNA, 64 nt, Human
aaaaaucuauccuguacaugugaagaucuaggcucgccuccauguuacucccuuucucuuccua

SEQ ID NO: 70086 - RNA, 64 nt, Human
cugacauuucacaggcagagaggugccaucaguucgccuccauuccuugccaccaugaccagcc

SEQ ID NO: 70087 - RNA, 64 nt, Human
cccaucucaugccccagggaccgccacugcccaccgccuccagcagccaugcaugugcgcccgc

SEQ ID NO: 70088 - RNA, 64 nt, Human
gaggagcaggggugcccaggcccugauacccagccgccuccagcuugcagugguccccagccug

SEQ ID NO: 70089 - RNA, 64 nt, Human
ggggugcaugggagagcugggugcgagaacauggcgccuccagggggcgggaggagcacuaggg

SEQ ID NO: 70090 - RNA, 64 nt, Human
uuccccugcgcccccauccucucacgucccgccccgccuccacuuggggacccugccucguguc

SEQ ID NO: 70091 - RNA, 64 nt, Human
agacgcuccuccaccccuuccagaccaagcucaacgccuccaagaccagcaggccaaggccaag

SEQ ID NO: 70092 - RNA, 64 nt, Human
agaccccgacccucucgaggaacccugccugagacgccuccauuaccacugcgcagugagauga

SEQ ID NO: 70093 - RNA, 64 nt, Human
gggcaacguagccacaggaacaggccccguccaccgccuccacgccgcaccuggaggccuccuc

SEQ ID NO: 70094 - RNA, 64 nt, Human
gcauccggagcuuccugaggacacaccagcaggucgccuccagccugaccagcaucggccuggc

SEQ ID NO: 70095 - RNA, 64 nt, Human
ucuccgccccugagcccacugugcguggggcucccgccuccaaccccucgcccagucccagcag

SEQ ID NO: 70096 - RNA, 64 nt, Human
cuccccaaagcagcaggccucugguugccucccccgccuccagucaugguacuaccccagccau

SEQ ID NO: 70097 - RNA, 64 nt, Human
ccaugguagcccagggcgcuggcagaccaugcuccgccuccaccagggccacagaggagcggag

SEQ ID NO: 70098 - RNA, 64 nt, Human
cugggcacugguaaucccaagaucugugcagccccgccuccaggccacauggggcugggcagcu

SEQ ID NO: 70099 - RNA, 60 nt, Human
agagcugcacccuccugugagcgucccacccgccuccaacgggucacacagagaaaccug

SEQ ID NO: 70100 - RNA, 64 nt, Human
uccucuacuuuccuucuuuagucccucucagggacgccuccauccccggcuccccuaaagguag

SEQ ID NO: 70101 - RNA, 64 nt, Human
cucacgcagacgccggccacaccauccaccuggccgccuccauggacccuugguggcuuuugua

SEQ ID NO: 70102 - RNA, 64 nt, Human
ccccaaccaaggaaggagccccugaguccgccugcgccuccauccaucuguccguccagagccg

SEQ ID NO: 70103 - RNA, 64 nt, Human
gaacuuacuguagccucagaugauuuccccccuccgccuccaggaagaaagaauguuacugccu

SEQ ID NO: 70104 - RNA, 64 nt, Human
cugcuugaguggcugccgcccugucagcuccagccgccuccagcucagcccuuucugugagagu

SEQ ID NO: 70105 - RNA, 64 nt, Human
accccccaacucccaugcacacggcuaguccaggcgccuccacgcugcaccgugaggacugcag

SEQ ID NO: 70106 - RNA, 64 nt, Human
gcaaagcugcugcccuccaggauguauaugcagacgccuccauuggcaacgugacgggcagcaa

SEQ ID NO: 70107 - RNA, 64 nt, Human
cagggacaggcugguccaguggcuuuggugagggcgccuccauuugugaacgcugggauuccuc

SEQ ID NO: 70108 - RNA, 64 nt, Human
cucacagcuaagguacauaccaccccuucugccgcgccuccaccccuggcaccaaggucuucug

SEQ ID NO: 70109 - RNA, 64 nt, Human
gacgcccuggauccugugcaagggggacuggagccgccuccacgcugugcucccucccaacaac

SEQ ID NO: 70110 - RNA, 64 nt, Human
cuccaguuugcccauuaacugggagagguacuuucgccuccaaggacugaauuuugccaauuac

SEQ ID NO: 70111 - RNA, 64 nt, Human
agcagcaccugcagaaggacuucuuccuguacaacgccuccaaggccaggagcaaaaccuacau

SEQ ID NO: 70112 - RNA, 64 nt, Human
ucggcuuccccccagccuggcagcagcgucccagcgccuccacauugccccucucaccucccag

SEQ ID NO: 70113 - RNA, 64 nt, Human
ccaccagccuuuccgucugauggacagcagaccccgccuccagcaccaagcagugucccuacac

SEQ ID NO: 70114 - RNA, 64 nt, Human
gugggccaccuaguccggcaggaucuuccgccagcgccuccaccuucagauguaccuccagccu

SEQ ID NO: 70115 - RNA, 64 nt, Human
gguauccccuggaguagagggcaagaggagagagcgccuccagucuagaaggcauaagccaaua

SEQ ID NO: 70116 - RNA, 64 nt, Human
gggcccugcacgccgggacgccaccuccgccagccgccuccacccgccccacaccacaaucgcu

SEQ ID NO: 70117 - RNA, 64 nt, Human
acggcagcaaccccagccuucccaaagcagcaggcgccuccaggcuggggcccaaccuagaagg

SEQ ID NO: 70118 - RNA, 64 nt, Human
cacugcccugccucaacaggguccauugccuccucgccuccagaacuuggagcagggaaguggg

SEQ ID NO: 70119 - RNA, 64 nt, Human
cccccuccccgacccgcccgacggccucaggccccgccuccaaggcaucaggccccgcccaacg

SEQ ID NO: 70120 - RNA, 64 nt, Human
cgcugacugagucucugaggggcuaccaggaaagcgccuccaacccuagcaaaagugcaagaug

SEQ ID NO: 70121 - RNA, 64 nt, Human
agaagcacuuccugggcacggccaccagcucucccgccuccagugugggccggcuccugcaggg

SEQ ID NO: 70122 - RNA, 64 nt, Human
gagagaccccgagagagacugcacuuggccacagcgccuccaucccuuccagacugguccagac

SEQ ID NO: 70123 - RNA, 64 nt, Human
ucacagaggggcucgguggcccagguggugguuccgccuccaggggcagggccuuguccugggu

SEQ ID NO: 70124 - RNA, 64 nt, Human
gcagaggaaggcuacuugagccggacaccaagcccgccuccagcaccaagggcgggcagcaccc

SEQ ID NO: 70125 - RNA, 64 nt, Human
gccauuggaauguauccccugacaggcccccuuccgccuccaccucaacccaggucuuggauuu

SEQ ID NO: 70126 - RNA, 64 nt, Human
cccuaccucucccaugcccuuugcccuccucccucgccuccaguggaggcugagcugacccugg

SEQ ID NO: 70127 - RNA, 64 nt, Human
ucccaugguguguucugccccucccaccuguccccgccuccaacugcggaggaccaguuccugg

SEQ ID NO: 70128 - RNA, 64 nt, Human
acacuugaucgauccccaccgacgcccccugcaccgccuccaaccaguuccaccacccucuagc

SEQ ID NO: 70129 - RNA, 64 nt, Human
ccauguauguaggugugauaguacuuucaaacagcgccuccaccuggccuacucuguuauuucc

SEQ ID NO: 70130 - RNA, 64 nt, Human
ucccggggccaggacagacaaaccagagccucugcgccuccacagggaaaaggcaaggcuucca

SEQ ID NO: 70131 - RNA, 64 nt, Human
gccuggcugcaggugcuuucccgcccccugaggacgccuccacgccauucgccaucccgcgcac

SEQ ID NO: 70132 - RNA, 64 nt, Human
gcacccagggccacccggcagcacacucaucccgcgccuccagaggcccaccccucaugcaaca

SEQ ID NO: 70133 - RNA, 64 nt, Human
ggagggagcgaggggcucacaccugacauguauucgccuccagggggcgcugucucccuccuuu

SEQ ID NO: 70134 - RNA, 64 nt, Human
cgcagugggggcuggggacuggcgcagccccaggcgccuccaagggaagcagugaggaaagaug

SEQ ID NO: 70135 - RNA, 64 nt, Human
gggaagccgggguguaacuuccugcugcacccugcgccuccagagguccuccguagggucuuuc

SEQ ID NO: 70136 - RNA, 64 nt, Human
gccuggccucuggccgugcauccucacucccacccgccuccagcagcccucugucggccuccuc

SEQ ID NO: 70137 - RNA, 64 nt, Human
gacuagcgaggggcagagcacaccccagugcuuacgccuccaccccugcagccuccuggcccgc

SEQ ID NO: 70138 - RNA, 64 nt, Human
cggcugugcugucagcggggccuggcgguggaagcgccuccagugugcaugagcgugucugaag

SEQ ID NO: 70139 - RNA, 64 nt, Human
cgcagccacaugcccuggcugccaugggccagaccgccuccaccucccccgcccgccuggccug

SEQ ID NO: 70140 - RNA, 64 nt, Human
cacaagccugaccguggauuucagggacacauaccgccuccagcggggagcacgggugcugccu

SEQ ID NO: 70141 - RNA, 56 nt, Human
agugcugccagaaccugugaccccugcgccuccacccagcgugcgugcacguccuc

SEQ ID NO: 70142 - RNA, 64 nt, Human
agggauggccgaggcagcccucgcuccagcugaacgccuccauugcugcuuguucuggagaccc

SEQ ID NO: 70143 - RNA, 64 nt, Human
gacgccuggaagcugcgacgcccugcacugcucccgccuccaccagcgccucccacugaugucg

SEQ ID NO: 70144 - RNA, 64 nt, Human
gguuccagaacagcccucggccuccgaggcuccccgccuccacucuaguucuagaugaguggga

SEQ ID NO: 70145 - RNA, 64 nt, Human
acgggccacgugggcccccagccucccccucggccgccuccacgacccggaguaggggggcucg

SEQ ID NO: 70146 - RNA, 64 nt, Human
accucccaggugccccucgagcaaaaaccucuggcgccuccaauccagacccaccacagcugga

SEQ ID NO: 70147 - RNA, 64 nt, Human
ugaccaccucaucccuugccugccacugugccuucgccuccauggccccggagccccauccugg

SEQ ID NO: 70148 - RNA, 64 nt, Human
ggggucucccucuccaucuccccaguggccuccccgccuccaacccugccugcggccucccccc

SEQ ID NO: 70149 - RNA, 64 nt, Human
ccaugccccgcccuuccagcugaggacaggcuggcgccuccacccacccuccugccucaccccu

SEQ ID NO: 70150 - RNA, 64 nt, Human
aggggagggaucagccaaauugggcggccacccccgccuccaccacuuuccaccaucagcugcc

SEQ ID NO: 70151 - RNA, 64 nt, Human
uucagucccugcugggugacucagggcguccuaacgccuccauggccucaguuuccccaucuga

SEQ ID NO: 70152 - RNA, 64 nt, Human
caaggguccugucccggcugccccugcccgccggcgccuccagcugccucggcugcguguacga

SEQ ID NO: 70153 - RNA, 64 nt, Human
auaaccucuggagcagauuugaaagccaggauggcgccuccagaccgaggacagcuguccgcca

SEQ ID NO: 70154 - RNA, 64 nt, Human
ccagguccugccagcugggaagugccagcaugaacgccuccaacuucguggaagccaggguccc

SEQ ID NO: 70155 - RNA, 63 nt, Human
aaacgaccguaacaucauaauaaccacugcuaucgccuccaccaacucagagaaauaucauuu

SEQ ID NO: 70156 - RNA, 64 nt, Human
ucacgugguucugaauuuucucugggcuuuggugcgccuccagcugggccugacccuccauguc

SEQ ID NO: 70157 - RNA, 64 nt, Human
gugcaaugucgugaucuuggcucacugcaacccccgccuccaggguucaagugauucuccugcc

SEQ ID NO: 70158 - RNA, 64 nt, Human
ccagggcaggccucagacacccugccuguggccccgccuccacuucauccugcccggaaugcca

SEQ ID NO: 70159 - RNA, 64 nt, Human
ucaaaucacuuccacuuuccugugcccccacccccgccuccaguuuuccgcuaguauccggcaa

SEQ ID NO: 70160 - RNA, 64 nt, Human
cucacccgcuucagugcggcucugucccugcugccgccuccaguccugagggaggggcuugccc

SEQ ID NO: 70161 - RNA, 64 nt, Human
ugccuggcggaaggacagugagggcggcccuagccgccuccacccucuugcgccucugcccucu

SEQ ID NO: 70162 - RNA, 64 nt, Human
ccugguguggacccaucggcgggagagagugccacgccuccacagcuugccccaagcgcucugc

SEQ ID NO: 70163 - RNA, 64 nt, Human
uuuuucacuuacuuacuuccccagaccccgggcucgccuccacaaaggagaaaagacugcccug

SEQ ID NO: 70164 - RNA, 64 nt, Human
cccagccccugccaugagcucugggcugggucuccgccuccaggguucugcucuuccaggcagg

SEQ ID NO: 70165 - RNA, 64 nt, Human
auuuuuagaucuggacuggaacugccaggaccaccgccuccagggagucgcugggcaccuggag

SEQ ID NO: 70166 - RNA, 64 nt, Human
auggcagggcuccuuacugcaaggcaucucucagcgccuccagcagccuggaacccacgccucc

SEQ ID NO: 70167 - RNA, 64 nt, Human
ucuggguggaagagggaagagauccuaauggaggcgccuccaucugcaaccacaguuguaaggc

SEQ ID NO: 70168 - RNA, 64 nt, Human
cccugcagugcagccugcauggggacaccccgcacgccuccaaccucucccucgcucucaagua

SEQ ID NO: 70169 - RNA, 64 nt, Human
gacccuggguuuuuggccuaaacauccaagauuccgccuccaaguuuagcccaaguuuguggag

SEQ ID NO: 70170 - RNA, 64 nt, Human
ccccaugggagugggagggaugacaagcggcccccgccuccauacccgggcccagggaagcccg

SEQ ID NO: 70171 - RNA, 64 nt, Human
cccauucgggccaguuucucccucuucaccccugcgccuccaccccuaccccgcacauccaacu

SEQ ID NO: 70172 - RNA, 64 nt, Human
ggggcggagggggguucccgcgugcacacgagugcggcuggacgugccgacacgcggugaugua

SEQ ID NO: 70173 - RNA, 64 nt, Human
gucuacacauuauuuuuaaaacacaaaaauuguucggcuggaacugacccaggcuggacuugcg

SEQ ID NO: 70174 - RNA, 64 nt, Human
ccccacugacccucugaccuccuuccugggccugcggcuggaggagaagaucacagagccauuc

SEQ ID NO: 70175 - RNA, 64 nt, Human
agugacugaggcccugcauuccccaucccacccccggcuggacugcccucuccuucuuggugau

SEQ ID NO: 70176 - RNA, 64 nt, Human
cccgccugcgcuccgccgacgcccuuggaacaaucggcuggagcccugaaacccgacguggacc

SEQ ID NO: 70177 - RNA, 64 nt, Human
cuggcucacuggcaggugugggaucuggggagagcggcuggagaaagaugcaguccucaggaag

SEQ ID NO: 70178 - RNA, 64 nt, Human
acagccaaaccacugacauuccuccauguccucacggcuggauuucucucuggaaaggauuuuc

SEQ ID NO: 70179 - RNA, 64 nt, Human
acagcagccaacccugaucuggaagacagggccccggcuggacacacguggaaccaagccaggg

SEQ ID NO: 70180 - RNA, 64 nt, Human
uuuggucacugauauguaaaugacugcuagcccacggcuggaccacuucucaaucagcaaauaa

SEQ ID NO: 70181 - RNA, 64 nt, Human
caaccacacaaugguuugucucaaucugacccagcggcuggacccuccguaaauuguugacgcu

SEQ ID NO: 70182 - RNA, 64 nt, Human
ggccaccaucucacugagcgacagugaccugcugcggcuggagggugacucgcguaccgugcgg

SEQ ID NO: 70183 - RNA, 64 nt, Human
gcgcucuagccuccgcuucucuaucuccuacaggcggcuggaccgcccuaccaggauccgcuuc

SEQ ID NO: 70184 - RNA, 64 nt, Human
ggacccugaggaccgugcagggaugccaagcagccggcuggacuuucggacucuuggacuuuug

SEQ ID NO: 70185 - RNA, 64 nt, Human
gagacacagggaaauugagccauauuuuggcuaucggcuggaaccagcaguucagagaucugcc

SEQ ID NO: 70186 - RNA, 64 nt, Human
ccacccucccccagacacagcccaggucccuccgcggcuggagcgaagccuucugcagcaggaa

SEQ ID NO: 70187 - RNA, 64 nt, Human
ucugucuucauauuugcauuucauguuuaaccuccggcuggaaauagaaagcauucccuuagag

SEQ ID NO: 70188 - RNA, 64 nt, Human
acggccgcuccagggguggcuggagacgggugggcggcuggagaccaugcagagcgccgugagu

SEQ ID NO: 70189 - RNA, 64 nt, Human
cccacggagggcacagaaccaccagcaaagccggcggcuggacuggcgccccucagagaccugc

SEQ ID NO: 70190 - RNA, 64 nt, Human
aacaccacaccacccuccaggccccccugcccuccggcuggaaacugcagcucuguaaaugccu

SEQ ID NO: 70191 - RNA, 64 nt, Human
aacugcccaggcggacgggagggaggcacccggccggcuggacuaaucugggaucgcggugauu

SEQ ID NO: 70192 - RNA, 64 nt, Human
ugcacgccuguuaucacagcuacuugggaagcagcggcuggagaauugcuugaaccugggaagu

SEQ ID NO: 70193 - RNA, 64 nt, Human
gugugugcugucccuucccacagucccuggcaggcggcuggaaggccaggccuggucaucuguc

SEQ ID NO: 70194 - RNA, 64 nt, Human
ggaaaucuagccggaugguucuccaauuguuccucggcuggauuuucaucaucagauauuucaa

SEQ ID NO: 70195 - RNA, 64 nt, Human
gcagccucuggugcugucuccgcggaagucagggcggcuggauuccaggacaggagugaaugua

SEQ ID NO: 70196 - RNA, 64 nt, Human
gagagggugacaagauagagagcuauuuaauggccggcuggaaaugcugggcugacggugcagu

SEQ ID NO: 70197 - RNA, 64 nt, Human
gcuccacugagggcaccuagacucuacagccaggcggcuggaauugaauucccugccuggaucu

SEQ ID NO: 70198 - RNA, 64 nt, Human
gcaggagauucacgagcugcgagggcgccuggagcggcuggagcaggugagccaagccugcugg

SEQ ID NO: 70199 - RNA, 64 nt, Human
ccaauuaaaugaucacagcacgcgugacaguuaccggcuggagagccggaggugggaccgggag

SEQ ID NO: 70200 - RNA, 64 nt, Human
uuagaauauggagaguguuucagccucgucuguccggcuggagcuucgggauggaaagugcuau

SEQ ID NO: 70201 - RNA, 64 nt, Human
uuuguuuuugagauguagcuucccucuguugccccggcuggagugcacuggcaugaucucagcu

SEQ ID NO: 70202 - RNA, 64 nt, Human
uggccaggccacguggagacaccacggucgacgacggcuggagggacguuucagaggcgagucc

SEQ ID NO: 70203 - RNA, 64 nt, Human
uguuguccugaauaaggagauccagagccagcagcggcuggagagccuguccgagacacccggg

SEQ ID NO: 70204 - RNA, 56 nt, Human
acuucaagcauaaaccuuagcgagugcggcuggaggaccacggacauuggacucac

SEQ ID NO: 70205 - RNA, 64 nt, Human
ccagaagccuucuggcugauuguuccgaugugcccggcuggaaaacaugucuuuagggcugucu

SEQ ID NO: 70206 - RNA, 64 nt, Human
gaaugaggcugcuuuccaaagccaaugugaacagcggcuggacuuggagguagcuuugaggugg

SEQ ID NO: 70207 - RNA, 58 nt, Human
cagcaaauccacuccucuaagacuccagcggcuggaauuggguggggggcuucauaca

SEQ ID NO: 70208 - RNA, 64 nt, Human
cuccgcgagggccuggacuaacucagauggugcucggcuggacaaggggacugggggaggggcc

SEQ ID NO: 70209 - RNA, 64 nt, Human
accagagguuaaauccucaucaagagagaccaggcggcuggaggacaagcggcucuaacccugg

SEQ ID NO: 70210 - RNA, 64 nt, Human
cgagccagcagcugaagucucuuuuucuuccucucggcuggaagaacaucaagauaccuuugcg

SEQ ID NO: 70211 - RNA, 64 nt, Human
ucauuagccaccugugccuguccccgccuuggcccggcuggaugaagcggcuuccccgcagggc

SEQ ID NO: 70212 - RNA, 64 nt, Human
ggacacgcugguggugcugcaccgggccggggcgcggcuggacgugcgcgaugccuggggccgu

SEQ ID NO: 70213 - RNA, 64 nt, Human
ggacacgcugguggugcugcaccgggccggggcgcggcuggacgugcgcgaugccuggggucgu

SEQ ID NO: 70214 - RNA, 64 nt, Human
guagggcagaaggcagcggaggccaggucugucccggcuggagaacagcguccacgcaguccug

SEQ ID NO: 70215 - RNA, 64 nt, Human
ccugccuggcacugcucaccgcccaaggcgacgccggcuggaccaggcacugcuggccuuucuc

SEQ ID NO: 70216 - RNA, 64 nt, Human
acgccuguaaucccagcacuuugggaggcuuaggcggcuggaucaccugaggucaggaguucaa

SEQ ID NO: 70217 - RNA, 64 nt, Human
cuagaaaaggugucagugaccuguugcggcccagcggcuggagcagcagacguuugccauuucu

SEQ ID NO: 70218 - RNA, 64 nt, Human
cucucagaaacaucugauuugggguuaaacuaggcggcuggaggauguuuacagcuuugaggcu

SEQ ID NO: 70219 - RNA, 64 nt, Human
uugucaccuacuauuucccuuuaguuuuuagcagcggcuggaugugauaugucuaguuuaacca

SEQ ID NO: 70220 - RNA, 64 nt, Human
gugagucagggauggucggcugggugggccuggacggcuggaugggccugggcugggugggccu

SEQ ID NO: 70221 - RNA, 64 nt, Human
gggugaacgcggggagcuacggggccggcuggcgcggcuggagcuggagcgggcacagcuggag

SEQ ID NO: 70222 - RNA, 64 nt, Human
cccucuucccuagguucgggccagcaggaggugccggcuggagucuccaccauagacucagugg

SEQ ID NO: 70223 - RNA, 64 nt, Human
cccaggauccggcugccagcccugaggccaagcacggcuggagacccacgaccuggccugccgu

SEQ ID NO: 70224 - RNA, 64 nt, Human
gaaaggaccaguuucuugaaguccaguguuuccacggcuggauaccugugugucuccauaaaag

SEQ ID NO: 70225 - RNA, 64 nt, Human
acaacuccagcuggcuguacugauucacacaccucggcuggaaguacagcucaggcuucguuac

SEQ ID NO: 70226 - RNA, 64 nt, Human
gugcccauuccuguggggucccugggugaggagacggcuggagccccaccaugccccaggcugc

SEQ ID NO: 70227 - RNA, 64 nt, Human
aaaaaacuagauugacuauuuauacaaaugggggcggcuggaaagaggagaaggagagggagua

SEQ ID NO: 70228 - RNA, 64 nt, Human
caucgaggguugggggagggguugguccugcccucggcuggaguuccuuucucaccccugugau

SEQ ID NO: 70229 - RNA, 64 nt, Human
ccggacccucuaaccucgcccucuccuuuguucccggcuggacggguuagacagccaaaggcug

SEQ ID NO: 70230 - RNA, 64 nt, Human
agguuucuguugcuuauaagcgauucauuugcuacggcuggaauaugggaaaauuaauuugggc

SEQ ID NO: 70231 - RNA, 64 nt, Human
cuuccuuuccacccagguggacaaacacauucggcggcuggacacagaccuggcccguuuugag

SEQ ID NO: 70232 - RNA, 64 nt, Human
ggccuaaggcugagugaggugugauugggcccuccggcuggauguucugggggaggaggcaauc

SEQ ID NO: 70233 - RNA, 52 nt, Human
agucggaggucucagaguaaggcggcuggaccccaggaaccccagggcacuc

SEQ ID NO: 70234 - RNA, 64 nt, Human
cuucaugaggcacuuaaagcuuauaaaagaacugcggcuggaacucaucuggugcuccccauga

SEQ ID NO: 70235 - RNA, 64 nt, Human
cccgaagccucuccuggaccuguggcgaaguugccggcuggacagggaagcgguuccccucagc

SEQ ID NO: 70236 - RNA, 64 nt, Human
caaacguggcuuucaaacuaugcuuaaaaaguuccggcuggacacgguggcucacaccuauaau

SEQ ID NO: 70237 - RNA, 64 nt, Human
ccuucuaaacauuuugggguuagaccugggaccacggcuggauacucugaggcuguauguuuga

SEQ ID NO: 70238 - RNA, 64 nt, Human
uuccuguguccacaucuaacaaagucaagauucccggcuggacuuuugcagcuuccuuccaagu

SEQ ID NO: 70239 - RNA, 64 nt, Human
caggagccuaccuggacaucccugcucagccccgcggcuggaccuuccuucugcauuguuuaca

SEQ ID NO: 70240 - RNA, 64 nt, Human
aaauccugggauuacaggcgcgagccaccacacccggcuggaaguaaacauuuuuaaagcuacu

SEQ ID NO: 70241 - RNA, 64 nt, Human
uuuuuuuuuggagacaguuuugcucuugucuccccggcuggagugcaguggcaugaucucaacu

SEQ ID NO: 70242 - RNA, 64 nt, Human
uuuuuuuuuuugugguggagucuugcugucuccccggcuggagcgcaguggcacgaucgcggcu

SEQ ID NO: 70243 - RNA, 64 nt, Human
gcugccucuaggcagagaggaggagagguguugccggcuggagggccaaccagugaacaccagc

SEQ ID NO: 70244 - RNA, 64 nt, Human
agagagugggugcgguguagaggaugcucuuggccggcuggagcaagaccuggcucccaccaga

SEQ ID NO: 70245 - RNA, 64 nt, Human
cggauggguguaggggcgaggcgccucccgcccucggcuggagacgaggccgcagaccccuucu

SEQ ID NO: 70246 - RNA, 64 nt, Human
cuucccgcccaguggggcuggaauguggcccagccggcuggaaccucaagggccccacccaccg

SEQ ID NO: 70247 - RNA, 64 nt, Human
aaagggaggaagucuacacagaggagcaccaggacggcuggaauuuccauaugugcuucacauu

SEQ ID NO: 70248 - RNA, 64 nt, Human
ccaugaagaagaucucucaaaugaggaacugaugcggcuggaacaggagcuggcagugggggag

SEQ ID NO: 70249 - RNA, 64 nt, Human
ggguggggggagggcaagcuggauuuacaggucacggcuggacugaaugggccuuuuuaucuuc

SEQ ID NO: 70250 - RNA, 64 nt, Human
uagcuuuuaugaagagucaccguagcagcccccacggcuggaaagaggccuguacguucuggac

SEQ ID NO: 70251 - RNA, 64 nt, Human
gcaagagaggugaagaaaguggaugcgcagaguucggcuggaaaagaggacaugcuccuaagca

SEQ ID NO: 70252 - RNA, 64 nt, Human
auccccuucagccccuagcucuuuuauucuaccacggcuggagaguugauaccugcagucagcc

SEQ ID NO: 70253 - RNA, 64 nt, Human
agcccuggagcccagagcgguggccuugcucuuccggcuggagacugggacaucccugauaggu

SEQ ID NO: 70254 - RNA, 64 nt, Human
gcgcuucuaugcagccacaucacggcaacugaagcggcuggaaucagucagccgcucaccuauc

SEQ ID NO: 70255 - RNA, 64 nt, Human
ggcucuaccccaaaaggcuucaggccagcugccacggcuggaagcagaggccuucguaggugau

SEQ ID NO: 70256 - RNA, 64 nt, Human
agcggaggcuggacugcgagccucgucugggacucggcuggagcuggccuagggaggccugggg

SEQ ID NO: 70257 - RNA, 64 nt, Human
ccaggaguaccaggugcuccuggacgugaaggcccggcuggagggugagaucaacacguacugg

SEQ ID NO: 70258 - RNA, 64 nt, Human
ucccuguguguuucaagcugagagaugugggcuccggcuggauuuggguuuugugggaggugca

SEQ ID NO: 70259 - RNA, 64 nt, Human
uucaccgcagcucccaccacgcggcgcuucaguacggcuggauccuccgcaggcgagcggaagg

SEQ ID NO: 70260 - RNA, 64 nt, Human
ggcccccagccaggcagugugggcauugccacugcggcuggacggggcugcgcgcucgcgcucu

SEQ ID NO: 70261 - RNA, 64 nt, Human
gagaguggccugagcccaagccgcaccggagcagcggcuggauugaacgccccagauuggggcc

SEQ ID NO: 70262 - RNA, 64 nt, Human
aguuuaacggaacgggacagcggcgugcccccggcggcuggacugcuccggccgcgggucuccc

SEQ ID NO: 70263 - RNA, 64 nt, Human
cggccccaagugcagagucaaggcagggagaggccggcuggagccaggcccccucgcacgcagc

SEQ ID NO: 70264 - RNA, 64 nt, Human
ccuuucggauaucacaugggacagaggaagagcccggcuggaaucugacuuaccuggaccgcug

SEQ ID NO: 70265 - RNA, 64 nt, Human
cccuccccggcaucauuuccccucccgcuuccuccggcuggaccugggguccccccucccugua

SEQ ID NO: 70266 - RNA, 64 nt, Human
ucuugaagugaucauuucacacccuuuugugagacggcuggaaauucuuauuuccccuuuccaa

SEQ ID NO: 70267 - RNA, 61 nt, Human
aguggcagucgucuaucugagccccuccucccggcuggacuggagccuggcuccccucuuc

SEQ ID NO: 70268 - RNA, 64 nt, Human
uccgcucagcacacgccuuguuacgagcaagugccggcuggacccaagcccugcauccccacau

SEQ ID NO: 70269 - RNA, 64 nt, Human
gugaggacccgccggaugacagccacccucaccgcggcuggaugggggcucugcacccagcccc

SEQ ID NO: 70270 - RNA, 64 nt, Human
acgccccccuccgcggugggggcuuggaggugggcggcuggacucaauccacccuggggggcuc

SEQ ID NO: 70271 - RNA, 64 nt, Human
cccacagcugcccgccguggaaauugaggaagggcggcuggagaugauagagacaaaagucaag

SEQ ID NO: 70272 - RNA, 64 nt, Human
ggagggggacgcgcacacacaccggucaccgagacggcuggaccugcacgccaccgcugccuuu

SEQ ID NO: 70273 - RNA, 64 nt, Human
accugccagguugcccgaugcccuguugggucaccggcuggaccugcugcagccugcagagcca

SEQ ID NO: 70274 - RNA, 64 nt, Human
cacuguccauucuuccucccauucaggaugcccacggcuggagcugccucucucauccacuuuc

SEQ ID NO: 70275 - RNA, 64 nt, Human
aguggcuuuuugagaauggcccauacuucuggcccggcuggaugaagggaaugccgacccuuug

SEQ ID NO: 70276 - RNA, 64 nt, Human
auggacauuugagucuucgucuucugcugcugcucggcuggaccagcuucuuuaacagcaagca

SEQ ID NO: 70277 - RNA, 64 nt, Human
cccccuuuccugcccucccccaacccucccuuggcggcuggacggaggggggacuugcuaggag

SEQ ID NO: 70278 - RNA, 64 nt, Human
gcaggugcagaguuuuacagacacccggucagcccggcuggagcccgcccuccccuccccuagc

SEQ ID NO: 70279 - RNA, 64 nt, Human
gggugugcagagguuugugucuccagggaacccacggcuggagagaaauagggagaugcaggaa

SEQ ID NO: 70280 - RNA, 64 nt, Human
gucuucaacgaauuaugaaaucuguaccaaccaacggcuggaaaugcaaaguaaguuguuuacu

SEQ ID NO: 70281 - RNA, 64 nt, Human
gacggccuccugccugcgcagccagucccgagaccggcuggaucgcggccggccccggggggcc

SEQ ID NO: 70282 - RNA, 64 nt, Human
ccagaauagcucuguuggguuguguugggagaagcggcuggaguucauucucucacccccuuau

SEQ ID NO: 70283 - RNA, 64 nt, Human
ccgaggacgacugagggccucugggccacccucccggcuggagagcucaggugcuggucccguc

SEQ ID NO: 70284 - RNA, 64 nt, Human
uuggggguggggcugcauccaaggcuuuguaaaccggcuggaccacgucucccuggccccagug

SEQ ID NO: 70285 - RNA, 64 nt, Human
cggugucuccgggcccgcagcaccggaagccccgcggcuggaguuucgggauccggcacucgga

SEQ ID NO: 70286 - RNA, 64 nt, Human
ggggccccagcuguacggagucuucccagagggccggcuggaacaguacaucccaguacgggcc

SEQ ID NO: 70287 - RNA, 64 nt, Human
agaaucuucuuuguucauugggugguuuuucagucggcuggaauucuaucuucugggggccuuc

SEQ ID NO: 70288 - RNA, 64 nt, Human
gcucugcagccagugagggagguccccgccaugccggcuggaagaagaaccucgcaucuuuugg

SEQ ID NO: 70289 - RNA, 64 nt, Human
uaagguacugcagaagccgucgaaaccgacugcucggcuggauuaggcguguuggcuacaucuu

SEQ ID NO: 70290 - RNA, 64 nt, Human
guucuaagccacagaccgaggccccagcaggcagcggcuggagggaugccacaccccucacagg

SEQ ID NO: 70291 - RNA, 64 nt, Human
gaugcauuuugagaagaacaaagugugcacucagcggcuggaaaggaaauaagugcauuucugc

SEQ ID NO: 70292 - RNA, 64 nt, Human
acguucauacaggcuucauucaaccuggcguuccccuccauaauuaagaugaaacauuccgguu

SEQ ID NO: 70293 - RNA, 64 nt, Human
cccagcccugaaaaaaagagcaggaggggacaccccuccauaugcccccccccaucuccugcuu

SEQ ID NO: 70294 - RNA, 64 nt, Human
aggaggagcuuagcaagucugcagcccagccccaccuccauaggguccugcaggccugugcuga

SEQ ID NO: 70295 - RNA, 64 nt, Human
caagcauccuggcugcuggggcuacuucauucccccuccauaaaguuucagccauuaugggcac

SEQ ID NO: 70296 - RNA, 64 nt, Human
cggugggcuaagauagguccuacugcaaaccaccccuccauauuuccguaccauuuacaauuca

SEQ ID NO: 70297 - RNA, 64 nt, Human
gcccugguagggaagagguaagggggaugauucaccuccauauuuccuaagcagguuguauagg

SEQ ID NO: 70298 - RNA, 64 nt, Human
ccacuccuuccacuaacaaucucccuggacuccuccuccauacuguaugugcaugcauucacac

SEQ ID NO: 70299 - RNA, 64 nt, Human
accauccaguguagggcacaacccuggggacugcccuccauagccugucccgacugccgacucc

SEQ ID NO: 70300 - RNA, 64 nt, Human
aagguuaaagaaggcucaucagucuauccuucugccuccauauauccugaacaucaaacuaucc

SEQ ID NO: 70301 - RNA, 64 nt, Human
caggaaaaaguagaagaaaagccacccccugcacccuccauagccaccaaaccuguuagaacug

SEQ ID NO: 70302 - RNA, 64 nt, Human
gcaacagggagcaccugucuggauuguuuuuaaaccuccauacucaagcugucucuucggcagg

SEQ ID NO: 70303 - RNA, 64 nt, Human
guuauggaccaacucagugcuucaggucuuaacgccuccauaccucuuccucaccaacuuuacu

SEQ ID NO: 70304 - RNA, 64 nt, Human
caccugcccucacauucugcucuuuuccccucucccuccauaccagagauguggugagcucugu

SEQ ID NO: 70305 - RNA, 64 nt, Human
cugggauguucacgcagcacuccauuacucaguaccuccauacccagcccuauacgcagaccca

SEQ ID NO: 70306 - RNA, 64 nt, Human
cuuugaaaugaagaauauaguuuaaaagcuuccuccuccauagggacacauuuucucuaacccu

SEQ ID NO: 70307 - RNA, 64 nt, Human
uauguugucugucaaguuuuaaauacuuaucuugccuccauaucaauccauucucaugaaccuc

SEQ ID NO: 70308 - RNA, 64 nt, Human
uagaaaccccgggccaucccacuagcagcuuuggccuccauauugcucucauuucaagcagauc

SEQ ID NO: 70309 - RNA, 64 nt, Human
acacuaacuuggcccuuuccugauggaaauauuuccuccauagcagaaguuguguucugacaag

SEQ ID NO: 70310 - RNA, 64 nt, Human
gcccagggaagacacaugauuaaugauuuagcucccuccauaccucgaacaucaguugggaucc

SEQ ID NO: 70311 - RNA, 64 nt, Human
cagucucauuuagaugauagucccuuuuuuucuaccuccauauuagagauggagcuccuuccuu

SEQ ID NO: 70312 - RNA, 64 nt, Human
uagccaggcuaugaaaucauccugugaguuauuuccuccauaauaacccugcauuucccauuaa

SEQ ID NO: 70313 - RNA, 64 nt, Human
ccuuuguguuaauaucagaaguguauuuguagccccuccauagugaacaaugaaauaaacuauu

SEQ ID NO: 70314 - RNA, 64 nt, Human
uuuagcagcaagacuaugaagcagcuuucagauuccuccauagguuccugaugaguuucuuucu

SEQ ID NO: 70315 - RNA, 64 nt, Human
cccucggucgcugcugugaugaggauaugugcaaccuccauaaauaugucgguggacggggcgu

SEQ ID NO: 70316 - RNA, 64 nt, Human
accucucccaccugcccuucucuucagggacaacccuccauaaaugugugccaagagggucucc

SEQ ID NO: 70317 - RNA, 64 nt, Human
ucucuuugggaaaaaauagaaauaaaacaaucucccuccauaaugugagcaauauuaccucgug

SEQ ID NO: 70318 - RNA, 64 nt, Human
ugggucacaaggacccuaggcccagcggcccucuccuccauagggaccagaagccugacucugg

SEQ ID NO: 70319 - RNA, 64 nt, Human
ugugguucaugcaaacaaugugcagaugauagcaccuccauauuacuaauaaaaauaugauaac

SEQ ID NO: 70320 - RNA, 64 nt, Human
ugcaaggagacgcaaaauuuuauuuuaaaacuguccuccauaauaaucaaacggugauucaucu

SEQ ID NO: 70321 - RNA, 64 nt, Human
cugcugaccccaggccuggugauucugggccccuccuccauaccccgaggucugggauuccccc

SEQ ID NO: 70322 - RNA, 64 nt, Human
cugccucugugccuucucucauucuccuucucucccuccauaccccacuuuugagguucugugg

SEQ ID NO: 70323 - RNA, 64 nt, Human
agaauaaauguuuccugacucagaaacaauuuugccuccauauuucagugcaaauauauuuuga

SEQ ID NO: 70324 - RNA, 64 nt, Human
cucacccaaaugggaccacgucuguuaccagcauccuccauaucaaagacccuaagaaucaggu

SEQ ID NO: 70325 - RNA, 64 nt, Human
cagccuacucagauuuuuucagguuuuucuagcuccuccauaaccucacucccucccgaggucu

SEQ ID NO: 70326 - RNA, 64 nt, Human
aacucagcagcagaaccaagaugggccccaggcuccuccauauggcccagggcuuaccacccua

SEQ ID NO: 70327 - RNA, 64 nt, Human
cgcauucucuauccaacauuuaauuguuugaaagccuccauauaguuagauugugcuuuguaau

SEQ ID NO: 70328 - RNA, 64 nt, Human
uacagccaccuagcaugaacuaacccagcuuccaccuccauaaaguuaccuagaguuguugagu

SEQ ID NO: 70329 - RNA, 64 nt, Human
gggaguuuuggggccuccagggcagcaggcaccaccuccauaucccggcccacauccagcugga

SEQ ID NO: 70330 - RNA, 64 nt, Human
acccagucuucaacucccgggucagauccuguguccuccauaaaaaauuuuccagacaacucca

SEQ ID NO: 70331 - RNA, 64 nt, Human
acgccaaagcaaaggauaaccauccuccaaaacgccuccauaacaccaguaaaguccaaaaccu

SEQ ID NO: 70332 - RNA, 64 nt, Human
auuuucugaaccgacccugcugucugcaaaccuuccuccauagccauaucuagagugaucucuc

SEQ ID NO: 70333 - RNA, 64 nt, Human
uaaugacuguuaucaagaacaugaacauuggcuuccuccauagagaagaaaucaguaucugagu

SEQ ID NO: 70334 - RNA, 64 nt, Human
uccuccugacugugagguggguguucauucauuuccuccauaaacaccaacuucucgaagcgug

SEQ ID NO: 70335 - RNA, 64 nt, Human
aaaugaauuuucuauaaagggaaaaaaguuugcuccuccauagauuuuugcugccuucggguca

SEQ ID NO: 70336 - RNA, 64 nt, Human
ggcucccaaagcccguucuugcuguguugugcugccuccauauccgucaggaagagccuuucca

SEQ ID NO: 70337 - RNA, 64 nt, Human
uauagcuuaaaguugcucuuuugguuuuuaacuuccuccauacauaagcuucaaggacaauaag

SEQ ID NO: 70338 - RNA, 64 nt, Human
ccuccugaagugcuuaugaaggggcguccauucuccuccauacauccccaucccucuacuuucc

SEQ ID NO: 70339 - RNA, 64 nt, Human
gauaacuuauuuguauaauuggaguggagaccuaccuccauaauuagauaaacucuuuuuggau

SEQ ID NO: 70340 - RNA, 64 nt, Human
aggggccuagacaaggcuccaggccccaccuccuccuccauacguucagaggugcagcuggagg

SEQ ID NO: 70341 - RNA, 64 nt, Human
uagacuuuucagaugaaauuguucauucucguaaccuccauauuuucaggauuuuugaagcugu

SEQ ID NO: 70342 - RNA, 64 nt, Human
ccuuugccuuuuuugcacuuuggugaauuacgugccuccauaaccugaacugugccgacuccac

SEQ ID NO: 70343 - RNA, 64 nt, Human
cccuccccgcacccaccuccugucucccucccucccuccauaggaguggggggccccuagaagu

SEQ ID NO: 70344 - RNA, 64 nt, Human
ggauucuaaacuuuccuuccguccucaauuucuaccuccauagaccggccagaauuuagcuuca

SEQ ID NO: 70345 - RNA, 64 nt, Human
uggugggauuacaggcgugagccaccgcacccggccuccauaucccccuuuuaaaauucuguag

SEQ ID NO: 70346 - RNA, 64 nt, Human
ugacaguuuugaguuggauagugaaaaaguggagccuccauaaucagugugguugccuucagac

SEQ ID NO: 70347 - RNA, 64 nt, Human
uuuuuuuaaagaaaacuguuccuucccccuuuccccuccauaauguaagaagcuuugguggcag

SEQ ID NO: 70348 - RNA, 64 nt, Human
cuccauuucccuaucuggcucuuucucucuugucccuccauaugauccgccccgacgccgucuu

SEQ ID NO: 70349 - RNA, 64 nt, Human
ugccgauuccagugccuuaacuacuuaccggaucccuccauauuaucauggguguuguauuuuu

SEQ ID NO: 70350 - RNA, 64 nt, Human
cagccuacagaugagcuguugugcgauuucuuagccuccauaaucacaugagccaaucuccuua

SEQ ID NO: 70351 - RNA, 64 nt, Human
cagcucaucuguuuuccuuuccucuaaccccucuccuccauagccuucugaggcuucaccugcu

SEQ ID NO: 70352 - RNA, 64 nt, Human
cuuggagugucuuggcuauucuuagccaacuguuccuccauauuacuucuagaauuagaccaac

SEQ ID NO: 70353 - RNA, 60 nt, Human
acuacguggaggcuaucuagaggcccccucccuccauacucccgucacuccuccccacug

SEQ ID NO: 70354 - RNA, 64 nt, Human
cacagcccacacagcccugggacacugcccuggcccuccauacucugcucccuacuggcugucu

SEQ ID NO: 70355 - RNA, 64 nt, Human
ucuucaguggaccaaaucucuacccuuccccaacccuccauaaaaaaacaaaaauggaaaugaa

SEQ ID NO: 70356 - RNA, 64 nt, Human
auauuccugaacuugcagcugccuauagcauucuccuccauaaggcuagaggagagcuggauau

SEQ ID NO: 70357 - RNA, 64 nt, Human
gaagggcacauauuuugaugcaaucauuacugauccuccauaugguaucagagaaucuacaaga

SEQ ID NO: 70358 - RNA, 64 nt, Human
uaaaauuuacagucaaucuaugaggguuuuuuucccuccauaaguuuaacuuuaaaacuguauu

SEQ ID NO: 70359 - RNA, 64 nt, Human
uugcuuucuuuuccuuauaauaaaugacccuuuuccuccauaacuuuugauuucuaaggaaaau

SEQ ID NO: 70360 - RNA, 64 nt, Human
agcagacugauguacuggaaacagaaaaguauuuccuccauacuauaaguuguaguuguuugga

SEQ ID NO: 70361 - RNA, 64 nt, Human
cccucagcugugagaugcaaggggcgccuugcagccuccauaauauacauuugacuuugcaaac

SEQ ID NO: 70362 - RNA, 64 nt, Human
uuaagugccuuuucacugggagaaucuggaaaaaccuccauaagguauauagcaaucuuugauc

SEQ ID NO: 70363 - RNA, 64 nt, Human
caacucucuccuuggauagccuagcacagugcagccuccauaaccaugacauucccgcccaagc

SEQ ID NO: 70364 - RNA, 64 nt, Human
ccaggaccucggaugaccauacucagacgugugaccuccauacugggcuaaggaaguaucagca

SEQ ID NO: 70365 - RNA, 64 nt, Human
gugccgaggacaugcaugacacuuccaaagacucccuccauagcgacacccuuucuguuuggac

SEQ ID NO: 70366 - RNA, 64 nt, Human
guuuguuauuaaccaaauauuuuuaaaaauauuuccuccauaaauauucauuuaauauuagguu

SEQ ID NO: 70367 - RNA, 64 nt, Human
cccuucaaucacagccccuuccccuuucugggguccuccauaccuagagaccacucugggaggu

SEQ ID NO: 70368 - RNA, 64 nt, Human
augcaccccaguguccacuuuugggcacagccucccuccauaacugagugguccacagauuugc

SEQ ID NO: 70369 - RNA, 64 nt, Human
gcaaacuaagccugcauuuauaucugaauuauuaccuccauauuuuaccaaacauuugaauguc

SEQ ID NO: 70370 - RNA, 64 nt, Human
cagcuugcagacagccuaugggaggacuucucagccuccauaagugugugggccaguucgccua

SEQ ID NO: 70371 - RNA, 64 nt, Human
gucggcuuguucuugcagcauucccgcucccuucccuccauagccacgcuccaaaccccagggu

SEQ ID NO: 70372 - RNA, 64 nt, Human
aaguuaaguaggugccagaaccauugcuguuuucccuccauagcccugccacccacuguaaaaa

SEQ ID NO: 70373 - RNA, 64 nt, Human
ccgaauucuuccagcccagcuucccgggcucuguccuccauaucgaauaauaaugacacauauc

SEQ ID NO: 70374 - RNA, 64 nt, Human
ccaacaacugugcuuauaccaagcagauccucauccuccauauaaucaucuuuguuauucgugg

SEQ ID NO: 70375 - RNA, 64 nt, Human
uuugcuuucccaaauccuguuugguuaauuguagccuccauacaguggggucuucucuguggcu

SEQ ID NO: 70376 - RNA, 64 nt, Human
cucaggcugccuggcucuccgagugaggacgcagccuccauauuuggugcacucaggcauggcu

SEQ ID NO: 70377 - RNA, 64 nt, Human
uugcacagagguacugcccccacaccuccugacaccuccauauaccccagcuauaucugcuuua

SEQ ID NO: 70378 - RNA, 64 nt, Human
aagagcagggcuaggacuugucccagcaucugugccuccauaccaauccucuuucucacagaga

SEQ ID NO: 70379 - RNA, 64 nt, Human
uugugugaagugguucacccuugaggaccaggagccuccauauccugacugaaaaccuuuucug

SEQ ID NO: 70380 - RNA, 64 nt, Human
caagauggaggcuguggagcagcauuucccguugccuccauagcaagaagaguuuuuguuuguu

SEQ ID NO: 70381 - RNA, 64 nt, Human
ggugaggguggccugaccugggccucucccugccccuccauagguggguuuguagggucuugug

SEQ ID NO: 70382 - RNA, 64 nt, Human
uaacaagguccuuauauaaaauuuccaccccgccccuccauaguucaggauagaggcucccaca

SEQ ID NO: 70383 - RNA, 64 nt, Human
ccuuugcacagaacuaugcuuaucucauguuuguccuccauaaacaaauggccauuuuuuucuu

SEQ ID NO: 70384 - RNA, 64 nt, Human
uugaggguagcaaccuauuagggugggggagggaccuccauaaggcuuuuccucccuucucugg

SEQ ID NO: 70385 - RNA, 64 nt, Human
ggcuuagguaccucagguggcccaggagguccccccuccauaaggacgucaaacuuccaggagg

SEQ ID NO: 70386 - RNA, 64 nt, Human
ggaggaggcucuugaugaucccaggucuccucgaccuccauacaccacacaggcauuuguaagc

SEQ ID NO: 70387 - RNA, 64 nt, Human
uugguguguuccugugggaaaaagcaggacugugccuccauaauuuggucauuuggcagccccu

SEQ ID NO: 70388 - RNA, 64 nt, Human
aauuggauauuagaaauuuccagccacaagucagccuccauaaugccucagagucuucacacug

SEQ ID NO: 70389 - RNA, 64 nt, Human
ucuuugaucccagcaucucagucccccucccaacccuccauauggcucucaauggugcucacuu

SEQ ID NO: 70390 - RNA, 64 nt, Human
ggccuuuuauuaauaacacuacuaaauuuugguuccuccauagaauuaguuuugaaacacuuga

SEQ ID NO: 70391 - RNA, 64 nt, Human
ugucuuuuggaaaaggagcugcauggccucagugccuccauaaaaagcuuaaguugaguucaug

SEQ ID NO: 70392 - RNA, 64 nt, Human
uacccuagauguucccaccuucagugcuccacgcccuccauagaccuucagagaaggugaaacc

SEQ ID NO: 70393 - RNA, 64 nt, Human
uaaauucaagucaaauuugcagaacccuguaucuccuccauagauucuuaguauuccauggaac

SEQ ID NO: 70394 - RNA, 64 nt, Human
cucccuauuggacuacuaggaggggcuggcagggccuccauagcacagaauugccccaaagccu

SEQ ID NO: 70395 - RNA, 64 nt, Human
aacugguugcugucagguuuaucucauccuaacaccuccauaauauuuucugcuaaaggaguga

SEQ ID NO: 70396 - RNA, 64 nt, Human
uugcccacccugaagguggauaagccaaccaugcccuccauagagguccccuauccuuaaauaa

SEQ ID NO: 70397 - RNA, 64 nt, Human
guuggcuuaacugaauauuguaugaaaagacaugccuccauaugugccuuucuguuagcuuucu

SEQ ID NO: 70398 - RNA, 64 nt, Human
acaagcaacaccccucuggagccagcacagugcuccuccauaucaccagucauacacagccuca

SEQ ID NO: 70399 - RNA, 64 nt, Human
cugauugugggaguggcaagaacuggggagacguccuccauaaguggagcacaggguauggggu

SEQ ID NO: 70400 - RNA, 64 nt, Human
aggaaggcaggugagguaagggccaaaucacucuccuccauagcaggaagccauuugggcagcu

SEQ ID NO: 70401 - RNA, 64 nt, Human
ucaccccauuccagaacaaauccaagaggccaguccuccauaagcacaaauggaauugugcaac

SEQ ID NO: 70402 - RNA, 64 nt, Human
cacagacgucgcuuccugggauuccagcacgaugccuccauaguugaaagacuacacaaaaagc

SEQ ID NO: 70403 - RNA, 64 nt, Human
cugauacuuuugaaacagauaugaaaaaaaguggccuccauauaaaaagacauacugacuucaa

SEQ ID NO: 70404 - RNA, 64 nt, Human
uccuguguccauuaagacucugauaauugucuccccuccauaggaauuucucccaggaaagaaa

SEQ ID NO: 70405 - RNA, 64 nt, Human
uaagaaacagaguccaagcagagaagguaggaacccuccauagcucucugcccugauguguggg

SEQ ID NO: 70406 - RNA, 64 nt, Human
uuauagauuucgaagcaacaugucacaacaauaaccuccauagcaccuccccuucccaaaccaa

SEQ ID NO: 70407 - RNA, 64 nt, Human
aauguauucauuucccuggccccacagaugcuucccuccauacuuuuuauuugcucuguuuccu

SEQ ID NO: 70408 - RNA, 64 nt, Human
aucaagguauagaugccgucaccccaaaaaguucccuccauaucccuuugcagucaguucaucc

SEQ ID NO: 70409 - RNA, 64 nt, Human
uaaguuucugaauggaagcacuuccagaacuucaccuccauaucagaagugccaauaaucguca

SEQ ID NO: 70410 - RNA, 56 nt, Human
gacggccaaccgccaugugauguaagccuccauacgaaagcacuguugcagauaga

SEQ ID NO: 70411 - RNA, 64 nt, Human
ugcuguuuccugcuugcccggccaccacccaugcccuccauagggugagguggagccauggugg

SEQ ID NO: 70412 - RNA, 64 nt, Human
gauccuauuacaauacuaaaaauagaaaauuucaccuccauauuccugagguguaauuucauua

SEQ ID NO: 70413 - RNA, 64 nt, Human
acuaauuuuuccaguuuccuauuacugaggaaaaccuccauacacugaggcagaaacuuguguc

SEQ ID NO: 70414 - RNA, 64 nt, Human
acucccuccagugaguguccugcagcccuuauucccuccauagaaagcauccucagagcaccuu

SEQ ID NO: 70415 - RNA, 64 nt, Human
agaguugaaauauuuuguugcugcagccgagugaccuccauaaauacuggacugaaaaaacauu

SEQ ID NO: 70416 - RNA, 64 nt, Human
uguuuuaguuuugcuuauuuuuaaauuuggagguccuccauaaugucagauaauauugaccugc

SEQ ID NO: 70417 - RNA, 64 nt, Human
ucagucucccaggacucugcugccucagccagagccuccauaugcuugaagugcugauuaccua

SEQ ID NO: 70418 - RNA, 64 nt, Human
guaauuguuuuaguucagagaucuucccgcucagccuccauaaaucuaaugucauuuuuuuuuu

SEQ ID NO: 70419 - RNA, 64 nt, Human
caagaagcaggcuacacugacacugguauuccugccuccauauuuucuuuaaaagacaaaucaa

SEQ ID NO: 70420 - RNA, 64 nt, Human
cuucaagaauguguuuucaugcccggccuuuguuccuccauaaauguguccuuuaguuucaaac

SEQ ID NO: 70421 - RNA, 64 nt, Human
auaucaggcaugcauguggcuuggaauuuuguuuccuccauaaaauguggaagugaauuaaaca

SEQ ID NO: 70422 - RNA, 64 nt, Human
ggucaccuuacgcaagagccaggcugaaacauccccuccauacucagcucuuuaacuuuucuuu

SEQ ID NO: 70423 - RNA, 64 nt, Human
caacaaaaacgaagugcucucagucagguuuuucccuccauauuuuuggucacuuuugauaagu

SEQ ID NO: 70424 - RNA, 64 nt, Human
gaagguuuguugcuguguugugaaugaugagcugccuccauagggaacccacugccaccugggc

SEQ ID NO: 70425 - RNA, 64 nt, Human
ugcccacuggucucacuaagagcuuucagauuucccuccauaggacagguuaccauagacuugg

SEQ ID NO: 70426 - RNA, 64 nt, Human
agauucaaucccaggauguacaaggacagccccuccuccauaguaugggacuggccucugcuga

SEQ ID NO: 70427 - RNA, 64 nt, Human
ucacagcaugacagagauuugacaccagggagauccuccauagcuggcuuugaggacacgggga

SEQ ID NO: 70428 - RNA, 64 nt, Human
aacgucaggccuggacuuaaaagauuuuuuaaaaccuccauaaguaguccaggggcgguggcuc

SEQ ID NO: 70429 - RNA, 64 nt, Human
cauaggggcaggaccuuccccuacucugccucuuccuccauacuagguuggaaaaaucugguuu

SEQ ID NO: 70430 - RNA, 64 nt, Human
cccuccacuggccccagggcuggagcugcccugcccuccauaggcaacuggugcagggacuggg

SEQ ID NO: 70431 - RNA, 64 nt, Human
cagccucccaaguagcugggauuacaggcacaugccuccauaccgggcuaauuuuuguauuuuu

SEQ ID NO: 70432 - RNA, 64 nt, Human
gucugcagacccuucuccuugccccaaacacuggccuccauaauuccugccugcagaucuccca

SEQ ID NO: 70433 - RNA, 64 nt, Human
ccugagcccggaugcuucuccaugagacacaucuccuccauacucaggacuccucuccgcaguu

SEQ ID NO: 70434 - RNA, 64 nt, Human
ccugagccuggaugcuucuccaugagccgcaucuccuccauacucaggacuccucuccgcaguu

SEQ ID NO: 70435 - RNA, 61 nt, Human
agaacuggacugacggaugacucucacgucuccuccauagccccgggaccguguugcucca

SEQ ID NO: 70436 - RNA, 64 nt, Human
agccccagccucaccaccgcaucccaccuccugcccuccauaccucuaguugugucugaugcuc

SEQ ID NO: 70437 - RNA, 64 nt, Human
ccccaagcacacacacaugguccgugccaugucaccuccauagggaaaggcuucucuccaagug

SEQ ID NO: 70438 - RNA, 61 nt, Human
agccugagaagacagacugagcagggcagcaccuccauaggaagccuuccuuucuggccaa

SEQ ID NO: 70439 - RNA, 64 nt, Human
gggccaagcuaugcccaggaaugugucagagucaccuccauaauggucaguacagagaagagaa

SEQ ID NO: 70440 - RNA, 64 nt, Human
gcauauugggacucguauguaggaaucaaauaucccuccauacaguguacucuuauucuuggca

SEQ ID NO: 70441 - RNA, 64 nt, Human
uuugggcugggggccaggguugggugguccugucccuccauaucauguccuacccuaugguccu

SEQ ID NO: 70442 - RNA, 64 nt, Human
cacagcucaagcacaccccuuaguuaagaaagaaccuccauauacauuaauuuuuuucugccua

SEQ ID NO: 70443 - RNA, 64 nt, Human
ggggcuggcacaggagcccugcugccagaacaggccuccauaccaggcauguguuucucucuaa

SEQ ID NO: 70444 - RNA, 64 nt, Human
aauaaaggccuuaucuuaugaaagcacacaagagccuccauacuauuaauaucaaguuaauuuc

SEQ ID NO: 70445 - RNA, 64 nt, Human
uuugcuaauaucaacugcauggauuaaaguagucccuccauacauggggaaguguuuggagcaa

SEQ ID NO: 70446 - RNA, 64 nt, Human
ugcugaggccccacagacuuacagaagaaguggcccuccauagacauguguagcaucaaaacac

SEQ ID NO: 70447 - RNA, 64 nt, Human
agcccacugccuccccucugaggggcuuccuuccccuccauagggccaggcauuuuuuucugga

SEQ ID NO: 70448 - RNA, 64 nt, Human
gcugaggcccccagcugccuuggacuguguuuuuccuccauaaauuauggcauuuuucugggag

SEQ ID NO: 70449 - RNA, 64 nt, Human
uauuugaaaagauucuucaaauugcguacuuacuccuccauauucuuucaacccacaugagucu

SEQ ID NO: 70450 - RNA, 64 nt, Human
uaagcugccauauauuuuguagacaaguauggcuccuccauaucucccucuucccuaggagagg

SEQ ID NO: 70451 - RNA, 64 nt, Human
cuagauagauggacgucggcaacucccggcccagccuccauacugcggucuuuuuacucguucu

SEQ ID NO: 70452 - RNA, 64 nt, Human
ccuugugcacacccagcaguccagugcaacgucuccuccauagcucuggguucuuagaucuugg

SEQ ID NO: 70453 - RNA, 64 nt, Human
gcauuucgccaaggguuuuauagcaagucuccuuccuccauagggacagcagcaccagcccugu

SEQ ID NO: 70454 - RNA, 64 nt, Human
auuagauuuucaguuuucuuucaaacuggaaaugccuccauaaauaugaucuaugauuuugcuu

SEQ ID NO: 70455 - RNA, 64 nt, Human
gagggaaaaggguguucaccaugauaaccuagugccuccauagagggguuuggaaaaauuccag

SEQ ID NO: 70456 - RNA, 64 nt, Human
ccuacaccaaauccagcccuugauuucccugcugccuccauaaacagaaagaggucugcuggau

SEQ ID NO: 70457 - RNA, 64 nt, Human
uaucccauaaagguuuguuacuucccucacuucaccuccauaagaaccuguguuuccauaagua

SEQ ID NO: 70458 - RNA, 52 nt, Human
aggaugggucuauaguauagagccuccauaugucucaucugugcucuccgug

SEQ ID NO: 70459 - RNA, 64 nt, Human
ccugucuuuccuucuaggugaccucauacauuugccuccauaccuuagaauggacuuuuuguua

SEQ ID NO: 70460 - RNA, 64 nt, Human
ucaucuugccccuuuaguucucaugcacagaauuccuccauagcaggcuguuggcauagcuggc

SEQ ID NO: 70461 - RNA, 64 nt, Human
gacgggcuccugacacggcuuuaaucaggaguuuccuccauaaacuauuauuuucagaauaaua

SEQ ID NO: 70462 - RNA, 64 nt, Human
ccauaaugcaugaccuuccuaaaaauauccacagccuccauaggcaaggugagcuuucugugcu

SEQ ID NO: 70463 - RNA, 64 nt, Human
ugcugggauuacaggccugagccaccgcguccggccuccauaaaugacuuuuaaagggguugua

SEQ ID NO: 70464 - RNA, 64 nt, Human
uuggggggugaagcugucaaugccaccaguuggaccuccauacauucugagcuaacccagaauc

SEQ ID NO: 70465 - RNA, 64 nt, Human
cccuaaucacaugugcugcaaauagccuuccugaccuccauaugcuguacaugacaucaaaaug

SEQ ID NO: 70466 - RNA, 64 nt, Human
cuauuuugguauuuugccuuuaaauaaaaagccuccuccauauggcugugcagccuugcucugu

SEQ ID NO: 70467 - RNA, 64 nt, Human
ccgaggucuugacccugaugaucaaccugccuccccuccauagucuuguuggagaagcccagag

SEQ ID NO: 70468 - RNA, 64 nt, Human
ugauaaagugaauguacauguauauacacacacaccuccauauauacauguguguaucaguuug

SEQ ID NO: 70469 - RNA, 64 nt, Human
ccaugggagugggagggaugacaagcggcccccgccuccauacccgggcccagggaagcccgcg

SEQ ID NO: 70470 - RNA, 64 nt, Human
cugccagauguuucuauguggauucuguaauguuccuccauacaguuaaaacauccuaacuugu

SEQ ID NO: 70471 - RNA, 64 nt, Human
ggcccccaagugcccacccccggcgguuaugucuccuccauagauuggucugcuucucuggagg

SEQ ID NO: 70472 - RNA, 64 nt, Human
agaguuauggaguaucagaaucuuuccauggaaaccuccauauggccuuucuauauauauucuc

SEQ ID NO: 70473 - RNA, 64 nt, Human
uguguuacuuuuuuuaaauucccuguuaaguuccccuccauaauuuuuauguucuugugaggaa

SEQ ID NO: 70474 - RNA, 64 nt, Human
agacuacuucaauuaguuccccuacuacacuuugcuagugaaacugcccaggcaaagugcaccu

SEQ ID NO: 70475 - RNA, 64 nt, Human
gcacagaacugaggaacaucugcaggaggcccaacuagugaaaggcuuugccuccggggggcag

SEQ ID NO: 70476 - RNA, 64 nt, Human
gcaaagagggcacugggcacuucucacaaacuuucuagugaacaaaaggugccuauucuuuuuu

SEQ ID NO: 70477 - RNA, 64 nt, Human
cacagcauuuagacauauggguaaaauguuauuucuagugaauuguuuguaucaguuucauguc

SEQ ID NO: 70478 - RNA, 64 nt, Human
uaaagaagguuaaagcaaauguuuauugccuuuucuagugaacuaacucguagagauguucuca

SEQ ID NO: 70479 - RNA, 64 nt, Human
uccuggaugugcaauugguuuaaguguucauguucuagugaacacagcuuguucaggaacaaac

SEQ ID NO: 70480 - RNA, 64 nt, Human
ugaauacuauugcuuggcauucuguauguauauacuagugaaacauauuuaaugauuuaaauuu

SEQ ID NO: 70481 - RNA, 64 nt, Human
cuuugggacauuuuuucugaacauucuaagcauucuagugaaaguucccauguuccaacagaac

SEQ ID NO: 70482 - RNA, 64 nt, Human
gugagaagaugagaaagaaaugaugcugagggaccuagugaaaucaaugaaacucuugagucuu

SEQ ID NO: 70483 - RNA, 64 nt, Human
acaauuuauuuaaaaucuaagauugcucuaacgucuagugaaaaaaauauuuuuaaaauuucag

SEQ ID NO: 70484 - RNA, 64 nt, Human
uauuucauuguuuuaauuugcauuuauuuuauuucuagugaaacuuuuauauacguaucgguca

SEQ ID NO: 70485 - RNA, 64 nt, Human
aacgccuuugcccugauccaaauguuagcacuugcuagugaacgucuacuuaucucaaguucua

SEQ ID NO: 70486 - RNA, 64 nt, Human
uagaugugcauaagguagcuuuagcaauuaaauucuagugaaguugauauagucucauuuuuaa

SEQ ID NO: 70487 - RNA, 64 nt, Human
cgcaacuaaacauuugucuuuguuuuauuagaaacuagugaaacaaagcagguugucccacaug

SEQ ID NO: 70488 - RNA, 64 nt, Human
auagcgaaucaucucaaauccuugagcacucagucuagugaagauguugucauuauguacaaua

SEQ ID NO: 70489 - RNA, 64 nt, Human
ccugcagaaguccuucaacaaaacuaauaauagacuagugaaaccuacuccucacauggguaag

SEQ ID NO: 70490 - RNA, 64 nt, Human
caucuuuccuccugucuuagaagaacagaccuaacuagugaauguauuaaugaaaaugcaucua

SEQ ID NO: 70491 - RNA, 64 nt, Human
cagagccuagcacagggcuugguagaggguauaucuagugaauggagaauacauggagaaacuu

SEQ ID NO: 70492 - RNA, 64 nt, Human
auauuuuccauauuaacaauuuaacagagaaucucuagugaauuuuuuaaaugaaagaaguugu

SEQ ID NO: 70493 - RNA, 64 nt, Human
ccgcugacaagaugaaugggcacugccugcccuucuagugaaaaggcuuggcuauggcccugug

SEQ ID NO: 70494 - RNA, 64 nt, Human
acuucuaaaaauuuagcaauauuagaauaggauacuagugaaguaagaaauuuugcuuguuguu

SEQ ID NO: 70495 - RNA, 64 nt, Human
agacugacuacuaaggccuuguugcuggaagaaacuagugaagagagguuaaauucuggcaaua

SEQ ID NO: 70496 - RNA, 64 nt, Human
augacucccuacugggaugaugaaggauggcauccuagugaagaagcagcucaaacauuuugau

SEQ ID NO: 70497 - RNA, 64 nt, Human
aaacacauggacuuacuauaaaagccuuuuuguacuagugaaaagaaucuucagcuauauagaa

SEQ ID NO: 70498 - RNA, 64 nt, Human
guaaaugugcuuuuaaaaaaaaauacugauguuccuagugaaagaggcagcuugaaacugagau

SEQ ID NO: 70499 - RNA, 64 nt, Human
aauugcaagaggagaccucacauucaggacuggccuagugaacguaauccaugcuuuaaacugg

SEQ ID NO: 70500 - RNA, 64 nt, Human
aauuaguauuuuguugaaaauacuuuaaagaugccuagugaaaagccuacuaaagugcugugag

SEQ ID NO: 70501 - RNA, 64 nt, Human
cuuagccauauuuaaaucuugaauuuaauagagucuagugaaaaaaaugagugggaagaaugaa

SEQ ID NO: 70502 - RNA, 64 nt, Human
cacuauucagaauaugcuggguaaauugacuugccuagugaaaagcaaaauguuaaagaaagaa

SEQ ID NO: 70503 - RNA, 64 nt, Human
cuauauucuaaauugagcuuuggaucaaacuuuaggccaggaccagcucaugcguucucauucu

SEQ ID NO: 70504 - RNA, 64 nt, Human
auggacagagacagagcgugcacacguagaguggcuagugaaggacgccuuuuugacucuucuu

SEQ ID NO: 70505 - RNA, 64 nt, Human
gucuaaaucuuuuaaaauauacugagauccacaucuagugaaaugucagugucaaaauauuaua

SEQ ID NO: 70506 - RNA, 64 nt, Human
cgcuuccuaauagcagcuuggcguguaucugguccuagugaagaggaaggccuguguagcagaa

SEQ ID NO: 70507 - RNA, 64 nt, Human
gaacuuaaacugcgaaaagacauuuugacaaaaacuagugaagaaaaucuuuuggccacaggaa

SEQ ID NO: 70508 - RNA, 64 nt, Human
gauugaaauuugaucucuacauuucaaaaucaaacuagugaauacaguuugucuuucaagagaa

SEQ ID NO: 70509 - RNA, 64 nt, Human
uuuuauugucucuuguuuaaaaagugaacagugccuagugaaguuaggugacuuuuacaccuuu

SEQ ID NO: 70510 - RNA, 64 nt, Human
auuuguccuuuuaaagauaguuuugcuguugcuccuagugaaagaaaaaucucuguacaaagga

SEQ ID NO: 70511 - RNA, 64 nt, Human
uuauuaacuucuaaauuuuauucgccaugacuuucuagugaauuauuaccauaaauaacaauuu

SEQ ID NO: 70512 - RNA, 64 nt, Human
ggaaaagaaugaagagcagcaguaaaagaaauaucuagugaaaaaacaggaagcguauugaagc

SEQ ID NO: 70513 - RNA, 64 nt, Human
guacagaguauuuggaaguuaagaauugauuagacuagugaauuuaggaguauuugaggugggu

SEQ ID NO: 70514 - RNA, 64 nt, Human
ccaccucggagcaugguguuuucauucccccuuccuagugaaccacagguuuuagcauugucuu

SEQ ID NO: 70515 - RNA, 64 nt, Human
cacacacacagagaagaguguggccccaccccuccuagugaacuaacgcugcguccuuggaaug

SEQ ID NO: 70516 - RNA, 64 nt, Human
caggugcuuuccccaagauagaucuagauauuagcuagugaaaugcuaaauuuugaagaguuuu

SEQ ID NO: 70517 - RNA, 64 nt, Human
uccaucugaccauagcagaaaaaccuagacccaccuagugaaacuuuguaagaacuccagggca

SEQ ID NO: 70518 - RNA, 64 nt, Human
accucauauaauaccuggagcaugugagauucuucuagugaaaaagaacagucuucccugaaga

SEQ ID NO: 70519 - RNA, 64 nt, Human
gagaauauauuuauucagcuucacuugcagaucacuagugaaugugagauuuagagcucauuga

SEQ ID NO: 70520 - RNA, 64 nt, Human
gauaaccuaugggaauguuuggaugccaguugggcuagugaaucgccacuguacuguaauaaug

SEQ ID NO: 70521 - RNA, 64 nt, Human
cacugugggaggccgacgcaggaggauugcuugaggccaggaguucaaggccagccuggacaac

SEQ ID NO: 70522 - RNA, 64 nt, Human
augggggaaaugaaucauuuagcuaggccaggaucuagugaaagccacagaguuuaaaaccaug

SEQ ID NO: 70523 - RNA, 64 nt, Human
ucuucuaggauuuguuuggcugacuggcaguaaccuagugaauuucugaaagaugaguaauuuc

SEQ ID NO: 70524 - RNA, 64 nt, Human
cuguacacauaagccaaaacugagcauaaguccucuagugaauguaggcuggcuuucagaguag

SEQ ID NO: 70525 - RNA, 64 nt, Human
cuuuaaaauaaucagaagucacugagacccaaagcuagugaauaauucaagugacuaagcuaga

SEQ ID NO: 70526 - RNA, 64 nt, Human
uguuaagucaaaaacggcuccuuuuuugcgccuccuagugaaacuuaaccagcuagaccauuug

SEQ ID NO: 70527 - RNA, 64 nt, Human
gauaaaauuugcuaguaagauuuuuaaaaacuggcuagugaaaggaaaguaccucugaaagaaa

SEQ ID NO: 70528 - RNA, 64 nt, Human
ugauuguuuuucugucgcuauuucuuucauuugucuagugaaucagaaaggcuuagccaaggcc

SEQ ID NO: 70529 - RNA, 64 nt, Human
ucuuaggaucuuucagguaaaugaugcucuugcacuagugaaauugucuaaagaaacuaaaggg

SEQ ID NO: 70530 - RNA, 64 nt, Human
agcauacuggguaugcucacacugacggggggaccuagugaauggucuuuacuguugcuaugua

SEQ ID NO: 70531 - RNA, 64 nt, Human
gcgggaccugugccauuuaaaccuuggaacgcaacuagugaacaagcgccuaugcagugcuuau

SEQ ID NO: 70532 - RNA, 64 nt, Human
uauuaagauucuugacuuauauuuugaauggguucuagugaaaaaggaaugauauauucuugaa

SEQ ID NO: 70533 - RNA, 64 nt, Human
aaguuuggccaguuugggcuucagaagucuaagucuagugaagguacccugacccccauauaaa

SEQ ID NO: 70534 - RNA, 64 nt, Human
uacaaucauaugagaacaaaaauaugaaaucuugcuagugaagacguauuuuuucuucuuccca

SEQ ID NO: 70535 - RNA, 64 nt, Human
aagcauuagccugugucaaguucuuugagugauacuagugaaaccaaauagaaaacuauuguug

SEQ ID NO: 70536 - RNA, 64 nt, Human
uugauguaacauuuugaaaguauuuugacaacuccuagugaacuuggacuugguugcuaaauuu

SEQ ID NO: 70537 - RNA, 64 nt, Human
gcacaugggucauaacucgcaugucgagcccccucuagugaaggguaggagagcucagccucgg

SEQ ID NO: 70538 - RNA, 64 nt, Human
uguuauuggccaguuuuuagccaauccaacugaccuagugaagguucagaugcaaauggaagga

SEQ ID NO: 70539 - RNA, 64 nt, Human
gggccuccggcuugagcucaccaccuaccucuuuggccaggacccuugaccagccaggccugaa

SEQ ID NO: 70540 - RNA, 64 nt, Human
auugggauaagaaaaaauauauauugcucuucaacuagugaaugaaagaaacuucagaaagcua

SEQ ID NO: 70541 - RNA, 64 nt, Human
aaauaugguuaacuauggaauauauuuacuuccucuagugaauguccuuuauauaaugacuaau

SEQ ID NO: 70542 - RNA, 64 nt, Human
uguguuugccucucagucuuucauucauagccugcuagugaaaaggaaguaaaugagauucuuu

SEQ ID NO: 70543 - RNA, 64 nt, Human
uucuucacagagcagccuuugaauagacuauguccuagugaagacaucaaccuccgccuuaagc

SEQ ID NO: 70544 - RNA, 64 nt, Human
cuagcuuauccucaguucuuaguaacuuuacccacuagugaagagauacugucuauuuucaaug

SEQ ID NO: 70545 - RNA, 64 nt, Human
uacuuauaguauaccacuaauuuucgcuuaguaacuagugaaauguucaagucaugccugaguc

SEQ ID NO: 70546 - RNA, 64 nt, Human
ucaacucaagagaaguuuaggagggggagcaucccuagugaauacucacaccacaagaaggaca

SEQ ID NO: 70547 - RNA, 64 nt, Human
aaaugucaaucagccuaguugaucagcuuauugucuagugaaacucguuaauuuguaguguugg

SEQ ID NO: 70548 - RNA, 64 nt, Human
ugccucaugucaguuuaugcuucuagagcaaugucuagugaaacuuaucugauggcauuuauug

SEQ ID NO: 70549 - RNA, 64 nt, Human
gaugcugaucucuuuauucuuucaaguaagagugcuagugaacaaauuguguuacuugccuugg

SEQ ID NO: 70550 - RNA, 64 nt, Human
uauaguuuaguuauagcaaaaauauggauaauuucuagugaaugcauaaauuagguugcguuuc

SEQ ID NO: 70551 - RNA, 64 nt, Human
cagauuaauuaguaacauauuuuucucccauaaccuagugaaccuggaaauacaacuuugcuuc

SEQ ID NO: 70552 - RNA, 64 nt, Human
guaaaggcaaacauaaauauuaccaugaugaauucuagugaaaugaccccuugacuuugcuuuu

SEQ ID NO: 70553 - RNA, 64 nt, Human
uuacguuuuuguuauuaaaaaacuucauuggccacuagugaaguuagucaauaaaagacuuguu

SEQ ID NO: 70554 - RNA, 64 nt, Human
gucuuucagugaaagaggaaggaaaggaguagggcuagugaauguaucugccaggucuuagaag

SEQ ID NO: 70555 - RNA, 64 nt, Human
cugacaauuaugaaaaaauguucaaauucacguucuagugaaacugcauuauuuguugacuaga

SEQ ID NO: 70556 - RNA, 64 nt, Human
uggugacaguuuccagaugcuaucacagacucugcuagugaaaagaacuaguuucuaggagcac

SEQ ID NO: 70557 - RNA, 64 nt, Human
guguugcaucucaaggaaaagaaacaacaaaaugcuagugaaaaugugcuuauuuugauagcaa

SEQ ID NO: 70558 - RNA, 64 nt, Human
gaucccaaagaaguuuucuaagugaaaggaaauacuagugaaucacccacaaggaaaagccacu

SEQ ID NO: 70559 - RNA, 64 nt, Human
ccccaacaccauuucugggcuccuggggcucagccuagugaacugcaaccucaaaggagcaagc

SEQ ID NO: 70560 - RNA, 64 nt, Human
aaacuagcuucuauaaagauuuuuucacuguuuacuagugaaaugagaaaagcaaagcuauuua

SEQ ID NO: 70561 - RNA, 64 nt, Human
cagagauucuuagacuggcugccaaaggaugaagcuagugaaggagaaaaagcuuaaauuccau

SEQ ID NO: 70562 - RNA, 64 nt, Human
cauagggauuacuguaaaucaagucaucucaagucuagugaagacagccaacagaaacaaaacc

SEQ ID NO: 70563 - RNA, 64 nt, Human
uuaugauugaguggguauaccuuugugauucugucuagugaaaaugggacauuuuuaauagugc

SEQ ID NO: 70564 - RNA, 64 nt, Human
gcugaaauaggaacagaaaaaucaaccccuauaacuagugaacaccaagggaaaauaccacaau

SEQ ID NO: 70565 - RNA, 64 nt, Human
gugugaagcaguauucuggaaaguuuuucuaagacuagugaagaacugaaggaguccugcaucu

SEQ ID NO: 70566 - RNA, 64 nt, Human
caucacuugugaggauauucauugugagguucuacuagugaaauauuugaagaaacuaaaugua

SEQ ID NO: 70567 - RNA, 64 nt, Human
uuuacuugcaauccauuaaaacaacaaacgaaaccuagugaagcaucuuuuuaaaaggcugcca

SEQ ID NO: 70568 - RNA, 64 nt, Human
accugucaucucacauuuucccuucccugaagaucuagugaacauucgaccuccauuacggaga

SEQ ID NO: 70569 - RNA, 64 nt, Human
cuguucaauuuaaccaaacuggcuuuuuuuuuuucuagugaaguuaaacaaacauugggauacc

SEQ ID NO: 70570 - RNA, 64 nt, Human
ugggggugccaggaccagucaaccugggcaaagccuagugaaggcuucucucugugggauggga

SEQ ID NO: 70571 - RNA, 64 nt, Human
ugcacguaugcuuuugguugaaauugaacauacucuagugaaugugccuuaaaaaucaagacac

SEQ ID NO: 70572 - RNA, 64 nt, Human
cauauugucaaccuaauuuucucucguacucucucuagugaaugaugugcuaccaaguauaugc

SEQ ID NO: 70573 - RNA, 64 nt, Human
uuccucuuugaaaagaaaaggggaaugugucccacuagugaaaggaaaacuuuucaacacuauc

SEQ ID NO: 70574 - RNA, 64 nt, Human
aacaucuuuggaggaacuaccuggccaaaacacuggccaggaugcagcaagcagcagcaggggc

SEQ ID NO: 70575 - RNA, 64 nt, Human
uccauuuugaauccuacaaaaauacugcaaaagacuagugaauguuuaaaauuacacuagauua

SEQ ID NO: 70576 - RNA, 64 nt, Human
aaaggacaaaaaaaaaaucuaaagcauuuaaaaucuagugaaauaacugaagggccugcucuuu

SEQ ID NO: 70577 - RNA, 64 nt, Human
auaccuucuguaacaguggcauucccuuaauuuucuagugaaaguuagagauaacugaacagac

SEQ ID NO: 70578 - RNA, 64 nt, Human
uuuguuaucuuuuuguauugcaagaaauuucuugcuagugaaucaagaaaacauccagguugac

SEQ ID NO: 70579 - RNA, 64 nt, Human
cagagacugcaagcugcuugcccaagucacacagcuagugaagaccagagcaguuucaucuggu

SEQ ID NO: 70580 - RNA, 64 nt, Human
acaagggcaaacuuuuuccuuuucccuguguauucuagugaaugaaucucaagauucaguagac

SEQ ID NO: 70581 - RNA, 64 nt, Human
aguaagaaauacuaugccauaguguucuccaucucuagugaagacagaaccagagggaauaagg

SEQ ID NO: 70582 - RNA, 64 nt, Human
ccaaggcagcucuucuggaguuucucuaaagucacuagugaacaauucggugguaaaaguacca

SEQ ID NO: 70583 - RNA, 64 nt, Human
uuaguugaacacacuaugaagaauuccagguguacuagugaauguaauuuauaguugccaaaaa

SEQ ID NO: 70584 - RNA, 64 nt, Human
ucucaucaacuccccuguaauagcuagcgucuuucuagugaaagagaagaauuccuagaacuua

SEQ ID NO: 70585 - RNA, 64 nt, Human
cccagcuuuaacuuaguuguguguguuuuaaauccuagugaaguauguacauacagagaaaccu

SEQ ID NO: 70586 - RNA, 64 nt, Human
gagagugaaaugcuauuuuguuccccaaauggcgcuagugaaucacuaggagggucccacugau

SEQ ID NO: 70587 - RNA, 64 nt, Human
uucuccucggcguccucacaacucuuaauugggccuagugaaaaugggggcaggugagaagucc

SEQ ID NO: 70588 - RNA, 64 nt, Human
gccuuuccuggacuuuuuuggccacugcccuggacuagugaaagaauggacucuaucuuuaucu

SEQ ID NO: 70589 - RNA, 64 nt, Human
auguaaggucagucauuaugacuuauacuaauuccuagugaaggccuaaugcacuuguaaaaca

SEQ ID NO: 70590 - RNA, 64 nt, Human
agcauucugggguuauuuaacaauagcaauaguucuagugaaugugugaaaccaagaaacacuc

SEQ ID NO: 70591 - RNA, 64 nt, Human
gaaguauuuuuagaauaagaauuugcauacuuaccuagugaaacuuuucuagaauuauuuuuca

SEQ ID NO: 70592 - RNA, 64 nt, Human
guggguucccgcccacucacccaggagcuggcugggccaggaccgggagagggagcacugcugc

SEQ ID NO: 70593 - RNA, 64 nt, Human
uuaguuuuauauagucacaacggaaauauauuuucuagugaauucuuauuggaagccaggucuc

SEQ ID NO: 70594 - RNA, 64 nt, Human
cuuugcucucaacauuuaaaauaaugcaguugcucuagugaauggggcguuaggggccugucuc

SEQ ID NO: 70595 - RNA, 64 nt, Human
ccagcugcaaagacaauguugcucuccgccuacacuagugaauuaaucugaaaggcacuguguc

SEQ ID NO: 70596 - RNA, 64 nt, Human
aaaagagugacuaagaagacuccuagccagcaugcuagugaaacgacuagcagcgaugcuaugc

SEQ ID NO: 70597 - RNA, 64 nt, Human
gugggauugucagaggucuaggggcacugugggccuagugaagccuacugugaggaggcuucac

SEQ ID NO: 70598 - RNA, 64 nt, Human
auguauuuacucaaaacacaauuugcacuguacacuagugaauugacguuuaugauuuauguua

SEQ ID NO: 70599 - RNA, 64 nt, Human
aaagaacauaaguggaugauggcauuugaggccacuagugaaaguauguuuucucuaaaauauu

SEQ ID NO: 70600 - RNA, 64 nt, Human
auagauuuuuuuuuaauauaggauuauaaaucagcuagugaaagaccucagagcaguuguaagu

SEQ ID NO: 70601 - RNA, 64 nt, Human
uuauguggacugggccacgauaggguggagugagcuagugaagaaggcagagggagacuuggcu

SEQ ID NO: 70602 - RNA, 64 nt, Human
aaagucuguuugccucaggagugugaggacuacacuagugaaagcgccuggcgggcagccggcg

SEQ ID NO: 70603 - RNA, 64 nt, Human
agggugucaggaaggcaggggugccaggucccaccuagugaaguaauaaaccguggguggugau

SEQ ID NO: 70604 - RNA, 64 nt, Human
gaagauauaucagguugugccucauguaccgcuucuagugaaauguagaggaaggcucaaagga

SEQ ID NO: 70605 - RNA, 64 nt, Human
cccuagccuaaggggccugcugucccucugaggccuagugaaaaagcugcaggaggugcauccu

SEQ ID NO: 70606 - RNA, 64 nt, Human
agugcaaugggagacaucagagacuuuaaaaauacuagugaagccucuuguguuugugugcaga

SEQ ID NO: 70607 - RNA, 64 nt, Human
uuuucagaaucuuuaaaauauaagacagugcuaucuagugaauaaaaaaauuaguuugaaagau

SEQ ID NO: 70608 - RNA, 64 nt, Human
ggaaaaacacauaacuguuaacuaaggguugccucuagugaaaaggauuggaagacaauuuauc

SEQ ID NO: 70609 - RNA, 64 nt, Human
aacuauggaaaaugagcagcauuuuaaaugcuuucuagugaaaaauuauaaucuacuuaaacuc

SEQ ID NO: 70610 - RNA, 64 nt, Human
gcugucuggggagagcccuucuucccuucuccaccuagugaagggagaacagaaggggaguccu

SEQ ID NO: 70611 - RNA, 64 nt, Human
cuuguaaaaauagcaaaauauuaucugaacuggacuagugaaaaaucuaguauuuguauccugg

SEQ ID NO: 70612 - RNA, 64 nt, Human
aggaaaagaguuuucugccgucuuuugaggaaaucuagugaagaggucgccauaaaauauuaga

SEQ ID NO: 70613 - RNA, 64 nt, Human
ggccuuuugauugcacaagccuuuguuuucaguccuagugaauaaaguuguguuuucuggagcg

SEQ ID NO: 70614 - RNA, 64 nt, Human
uccagugagcaaggcacgacccucagaucucagucuagugaaggagagaaaacuguaauaacac

SEQ ID NO: 70615 - RNA, 64 nt, Human
acucugccgcccgaccuugagggcugugccaauccuagugaaccaaaaugcaaacaacucacac

SEQ ID NO: 70616 - RNA, 64 nt, Human
uuauaaguagggaugcaaaauccgugucacuaaacuagugaaugaacccaggauuugaacucag

SEQ ID NO: 70617 - RNA, 64 nt, Human
uaggggaaaggaguuugaaugugucuauuuuuuucuagugaauguauuuuaaccacaguguccu

SEQ ID NO: 70618 - RNA, 64 nt, Human
gggggcugccagcgucuguuguggaaaguagcugcuagugaaauggcuggggccgcuggggucc

SEQ ID NO: 70619 - RNA, 64 nt, Human
ugcuaggggcagccuggaaaagauggggaaccugcuagugaacuaggagggagacuuccauagc

SEQ ID NO: 70620 - RNA, 64 nt, Human
guuguugauguuuuaacucuaucugucauacauccuagugaauguaaaaugcaaaauccuggug

SEQ ID NO: 70621 - RNA, 64 nt, Human
uuguaccacuugccgcccuguuucugucaaauaccuagugaaaaaggccuaaacaauuguaaug

SEQ ID NO: 70622 - RNA, 64 nt, Human
uguccaaggggccauguuauugcugcucggaucacuagugaaaauccagaugagguaacccauc

SEQ ID NO: 70623 - RNA, 64 nt, Human
acuugggcugacugccugcagaagucccaagacccuagugaaaauacagcaggcagaacucucc

SEQ ID NO: 70624 - RNA, 64 nt, Human
ugcuuacuaccugugacaacccaagugggugacacuagugaaccuucuccagucugcaggcugg

SEQ ID NO: 70625 - RNA, 64 nt, Human
uuuaaagcauauucuucuaugagcacagguccuccuagugaagcuuaguuugacaaaggguguc

SEQ ID NO: 70626 - RNA, 64 nt, Human
ucaggcgcuacuucuggcaaggcauaucaugaggcuagugaagcaccuacaagaaacuuauaac

SEQ ID NO: 70627 - RNA, 64 nt, Human
uuacuaccuucuuucuuauaauauguuguaguuacuagugaauucuuuuaaaagcaauaccuag

SEQ ID NO: 70628 - RNA, 64 nt, Human
uagaauuuucugauagugauuaugauuuguagcucuagugaauaugaauuuuauauugaguugu

SEQ ID NO: 70629 - RNA, 64 nt, Human
ccagcccugucccugccaccccuccuaguggggacuagugaaugacuugaccugugaccucaau

SEQ ID NO: 70630 - RNA, 64 nt, Human
aggggcucaagcugugaugcugcugguuuuaucucuagugaaauaaagucaaaaguuauuuaau

SEQ ID NO: 70631 - RNA, 64 nt, Human
auugaacuguauuuuguucacuuuauuguaaauacuagugaacagugaauaaaugguuguauau

SEQ ID NO: 70632 - RNA, 64 nt, Human
aagauuguacuuauugggcuucagaauauccacacuagugaaagucuucugaguacagcaaaug

SEQ ID NO: 70633 - RNA, 64 nt, Human
uaggggaaaacucagagaggagagaugcacauuccuagugaaauugcacaggcuuccagcaugc

SEQ ID NO: 70634 - RNA, 64 nt, Human
gacccugccucccucaggcaccagauccaguguccuagugaaacgcuggauccuagauccccaa

SEQ ID NO: 70635 - RNA, 64 nt, Human
aguaacugaauuugugcacaaaacauucuaaacacuagugaagccuguuucguugaacuaauuc

SEQ ID NO: 70636 - RNA, 64 nt, Human
cuccaugugucauguggaaaccuccacaggucugcuagugaagaaugcauguaugugagauuuu

SEQ ID NO: 70637 - RNA, 64 nt, Human
gagccaagaaaguccaguuuaugacacguauguacuagugaacaccguccucgaucuguacgaa

SEQ ID NO: 70638 - RNA, 64 nt, Human
uaaugauugguuguaagccaagggacauuuuaagcuagugaagaguuuuuucuggaauugauuu

SEQ ID NO: 70639 - RNA, 64 nt, Human
uucccaagaacucaaauuccuuucucauuggagccuagugaaaccaaaugaacgggaccugcug

SEQ ID NO: 70640 - RNA, 64 nt, Human
aacaaguuggucuuaaauuguugcaacucauuagcuagugaagauauucauguaaauauauuuu

SEQ ID NO: 70641 - RNA, 64 nt, Human
ggggcuugagacaaauccuuucugccccccagggcuagugaaguggccucuuggauaccagcuc

SEQ ID NO: 70642 - RNA, 64 nt, Human
uggccuuccgaaacuaaaagagugggugggaagacuagugaaacccaguucacggauggggaaa

SEQ ID NO: 70643 - RNA, 64 nt, Human
agugcagaguagggaaccagagcugguuaagggccuagugaaggguuugugugcccagugucug

SEQ ID NO: 70644 - RNA, 64 nt, Human
aaagcuuccuuugcccuugcuuucuagggcaucccuagugaaggggcaaaccugagauuucucc

SEQ ID NO: 70645 - RNA, 64 nt, Human
gaugucugugacuacagggagauuagcacuucgucuagugaaacuccuuucaucucuguccuau

SEQ ID NO: 70646 - RNA, 64 nt, Human
cacagaguguagccaggucccccugcagcuaguccuagugaaccucaccccgaggcccugcaug

SEQ ID NO: 70647 - RNA, 64 nt, Human
cucuugaguuuggacuggaauuagugacuugguucuagugaauagaaugaggcagagguaaugg

SEQ ID NO: 70648 - RNA, 64 nt, Human
augaagcugguuccccaaccacagaaacuuuguacuagugaaagaaagggggucccugggcuac

SEQ ID NO: 70649 - RNA, 64 nt, Human
cauuugccuaucacacguaaaauuaauauuuacucuagugaagugguuugagcacuaaccuugu

SEQ ID NO: 70650 - RNA, 64 nt, Human
augauuguguuuuguuauaucuucaaaaauauagcuagugaaauauugugcuuaauuuuuuucu

SEQ ID NO: 70651 - RNA, 64 nt, Human
agucuccaggaagaagagaaagaaaccacacuggcuagugaagaagcaggagcuucuuguuuua

SEQ ID NO: 70652 - RNA, 64 nt, Human
cugucuucuuuacagagaauccauuguuaucaaucuagugaagaauucaaggaagacacaagac

SEQ ID NO: 70653 - RNA, 64 nt, Human
uuggauaaaaaaaaaacucgcugacauaaucucccuagugaaaacuuggguaauauauguaaga

SEQ ID NO: 70654 - RNA, 64 nt, Human
aaaauguuacacaaagcaguaaaguuuuugagaacuagugaaguacuaauuaucaaggacauuu

SEQ ID NO: 70655 - RNA, 64 nt, Human
uaacugauucaaacucuguuuauuucauacuaaacuagugaauaagugaaauaaaggaaacucg

SEQ ID NO: 70656 - RNA, 64 nt, Human; identical to SEQ ID NO: 58062

SEQ ID NO: 70657 - RNA, 64 nt, Human; identical to SEQ ID NO: 58063

SEQ ID NO: 70658 - RNA, 64 nt, Human; identical to SEQ ID NO: 58064

SEQ ID NO: 70659 - RNA, 64 nt, Human; identical to SEQ ID NO: 58065

SEQ ID NO: 70660 - RNA, 64 nt, Human; identical to SEQ ID NO: 58066

SEQ ID NO: 70661 - RNA, 64 nt, Human; identical to SEQ ID NO: 58067

SEQ ID NO: 70662 - RNA, 64 nt, Human; identical to SEQ ID NO: 58068

SEQ ID NO: 70663 - RNA, 64 nt, Human; identical to SEQ ID NO: 58069

SEQ ID NO: 70664 - RNA, 64 nt, Human; identical to SEQ ID NO: 58070

SEQ ID NO: 70665 - RNA, 64 nt, Human; identical to SEQ ID NO: 58071

SEQ ID NO: 70666 - RNA, 64 nt, Human; identical to SEQ ID NO: 58072

SEQ ID NO: 70667 - RNA, 64 nt, Human; identical to SEQ ID NO: 58073

SEQ ID NO: 70668 - RNA, 64 nt, Human; identical to SEQ ID NO: 58074

SEQ ID NO: 70669 - RNA, 64 nt, Human; identical to SEQ ID NO: 58075

SEQ ID NO: 70670 - RNA, 64 nt, Human; identical to SEQ ID NO: 58076

SEQ ID NO: 70671 - RNA, 64 nt, Human; identical to SEQ ID NO: 58077

SEQ ID NO: 70672 - RNA, 64 nt, Human; identical to SEQ ID NO: 58078

SEQ ID NO: 70673 - RNA, 64 nt, Human; identical to SEQ ID NO: 58079

SEQ ID NO: 70674 - RNA, 64 nt, Human; identical to SEQ ID NO: 58080

SEQ ID NO: 70675 - RNA, 64 nt, Human; identical to SEQ ID NO: 58081

SEQ ID NO: 70676 - RNA, 64 nt, Human; identical to SEQ ID NO: 58082

SEQ ID NO: 70677 - RNA, 64 nt, Human; identical to SEQ ID NO: 58083

SEQ ID NO: 70678 - RNA, 64 nt, Human; identical to SEQ ID NO: 58084

SEQ ID NO: 70679 - RNA, 64 nt, Human; identical to SEQ ID NO: 58085

SEQ ID NO: 70680 - RNA, 64 nt, Human; identical to SEQ ID NO: 58086

SEQ ID NO: 70681 - RNA, 64 nt, Human; identical to SEQ ID NO: 58087

SEQ ID NO: 70682 - RNA, 59 nt, Human; identical to SEQ ID NO: 15772

SEQ ID NO: 70683 - RNA, 64 nt, Human; identical to SEQ ID NO: 58089

SEQ ID NO: 70684 - RNA, 64 nt, Human
ugucucaguucugcuuuuggcauuagugaugguggugguacaguuggaauuagugccaugucau

SEQ ID NO: 70685 - RNA, 64 nt, Human
cuggaagauugggaauuagucuaaacaggaaauggugguacacagaggcuaggagaggcugggc

SEQ ID NO: 70686 - RNA, 64 nt, Human
auguaaacgucaugugacagaucuaacagggcaagugguacaggagggaaccaggcgcuacaga

SEQ ID NO: 70687 - RNA, 64 nt, Human
gggcccuuauugcagcugucucacagccugagcugugguacagagaaauggggguucuccuuuu

SEQ ID NO: 70688 - RNA, 64 nt, Human
uuaaagacuaccaguauggaguucauaggacaaugugguacaccugguauuacagccuuugccu

SEQ ID NO: 70689 - RNA, 64 nt, Human
uguuuacucaaaauacaaaaauuggcugggugcggugguacaugccuguagucccagcuacuug

SEQ ID NO: 70690 - RNA, 64 nt, Human
ggaguuuuguucuuuuugccuaggcuggagugcagugguacaaucucggcucacugcaaccucc

SEQ ID NO: 70691 - RNA, 64 nt, Human
ggcacauaggcuacccaagagagccuuggauucagugguacacuccuugggcccaagggcuuua

SEQ ID NO: 70692 - RNA, 64 nt, Human
cuugcaucauaacaccaaaaguuuauaaaggcaugugguacaaugaucaaaaucauguuuuuuc

SEQ ID NO: 70693 - RNA, 64 nt, Human
gagaguuuugcucugucacccaggcuggagugaggugguacaaucucggcucacugcaaccucc

SEQ ID NO: 70694 - RNA, 64 nt, Human
cagacuggggaaugcucaagaugugaugggccuggugguacaggugugacauuuguuaccaccc

SEQ ID NO: 70695 - RNA, 64 nt, Human
ugagggauuuuauuaaaucuuuuuuuaauggaaugugguacaaauuguucauguuaccaaagca

SEQ ID NO: 70696 - RNA, 64 nt, Human
cucuggaccaacccuguuuccugaguuugggauugugguacaaucucaaauucucaaccuacca

SEQ ID NO: 70697 - RNA, 64 nt, Human
cacccccucaacauguagacuaaugcagccauuggugguacauuuauuuuagccacggauaauu

SEQ ID NO: 70698 - RNA, 64 nt, Human
aucucuacuaaaaauacaaaacuagccggguauggugguacaugccuguaaucccagcuacuca

SEQ ID NO: 70699 - RNA, 64 nt, Human
gcggcuggccauggagaaagcugacuuggcuggugugguacagagaagccagcuuguuuacaug

SEQ ID NO: 70700 - RNA, 64 nt, Human
augagugauuuguuagcuugguacuuuuaaguuugugguacagauccuccaaacccauacucug

SEQ ID NO: 70701 - RNA, 64 nt, Human
aacaugguaauuuugauacaguuauacuuuuacagugguacauaauccaaggacuaguauagaa

SEQ ID NO: 70702 - RNA, 64 nt, Human
uagccucccaccacuaucaguaucccacaccagagugguacauuuguuacaaucaauaaaccuc

SEQ ID NO: 70703 - RNA, 64 nt, Human
auaaggacugcaauagagagggcaauuuacccuggugguacacggaaccuagauucacuccugc

SEQ ID NO: 70704 - RNA, 64 nt, Human
auagcucaugcucccugccgagaaaguggaggacgugguacaggguugcagauguuuaguuuua

SEQ ID NO: 70705 - RNA, 64 nt, Human
acauaaaggucaugugauuuguaauaaauuuauugugguacaguaauaugcauaaaauaaaccc

SEQ ID NO: 70706 - RNA, 64 nt, Human
augagacaauugauuuucuuauuuucuauguagggugguacauuuccucauuuugagauauuuc

SEQ ID NO: 70707 - RNA, 64 nt, Human
acugaaauaaaaauagaaguucuuacgcuuuuuugugguacagaugcuuucgacaauuuaaaga

SEQ ID NO: 70708 - RNA, 64 nt, Human
ucagggcugucggugugcugucagccucccacaggugguacagccgugcacaccagugucgugu

SEQ ID NO: 70709 - RNA, 64 nt, Human
uuuuuuuuucuuuuucauuuuuuuaaaagauugagugguacacuaauaaaugagaguuugaaau

SEQ ID NO: 70710 - RNA, 64 nt, Human
cuagcucucauucugucacccaggcuggaauacagugguacagucacggcucacaaaagccuug

SEQ ID NO: 70711 - RNA, 64 nt, Human
cugauuagaagaauacuugauguuuaugaugauugugguacaagauaguuuuaaguauguucua

SEQ ID NO: 70712 - RNA, 64 nt, Human
ucuagaauuaugagaccaccuuggagaaaggugugugguacaugacauuggguuacaucauaac

SEQ ID NO: 70713 - RNA, 64 nt, Human
gauaauuuauagaaauauaacccuaauuggacaugugguacaggaucuauaaguugcuguguuu

SEQ ID NO: 70714 - RNA, 64 nt, Human
ugcccaaugcaggguggcucuggggggcaaguaggugguacaggggauuggaaacaugcuccgc

SEQ ID NO: 70715 - RNA, 64 nt, Human
agagaucugccuuauaaacauuuaaaaccgguuugugguacacaaagaggaaccagugugggaa

SEQ ID NO: 70716 - RNA, 64 nt, Human
cugagaggccccauuuaaaaaagaaagaacaugggugguacauugaggaguauuuacauuuuau

SEQ ID NO: 70717 - RNA, 64 nt, Human
gcaacagauuuucacagcucauccacaaggaguggugguacagccagccgcagcagugacuaca

SEQ ID NO: 70718 - RNA, 64 nt, Human
uagaaacaaguuuacuuuaucugcuuugccucuggugguacaagguuuuuaacauggaugguaa

SEQ ID NO: 70719 - RNA, 64 nt, Human
ggugagcuuauauuucccuuggaagagagcauuugugguacaauaugcuaugugccaaaugagu

SEQ ID NO: 70720 - RNA, 64 nt, Human
gagagauguguuuuguucaaaauuuaaauuuguugugguacacuaucuuauguaaccugucugg

SEQ ID NO: 70721 - RNA, 64 nt, Human
uuuauaagaaccaguauggauacauccauucacugugguacauuuuaaaauaaaauauuuuagc

SEQ ID NO: 70722 - RNA, 64 nt, Human
uucaauuaauaaaaaauggaaagaaucuaauagagugguacagcacuguuauuuuucaaagaug

SEQ ID NO: 70723 - RNA, 64 nt, Human
gucacuaucuuggguaacaaauuuauacaggacagugguacagaaauacaucuuugcucugaga

SEQ ID NO: 70724 - RNA, 64 nt, Human
gugaagauuuaaaacgauugauggauuuaaggaagugguacauaaauaugucuguuauuaugca

SEQ ID NO: 70725 - RNA, 64 nt, Human
auauauauauuauauuauauaauuuuccuaaaaugugguacaacucaguugguuuuuaaaugga

SEQ ID NO: 70726 - RNA, 64 nt, Human
aagacuaugaguaguucuccuucauccuauuuaugugguacagguugugaaguaucucuauaua

SEQ ID NO: 70727 - RNA, 64 nt, Human
ucgcugaagcuccacuguuggcaaagucuuggcagugguacauuauucaucguguuugcauucu

SEQ ID NO: 70728 - RNA, 64 nt, Human
accuaauuuuccucuuaguugggcuguaugcugugugguacaggaucuuacaguuuccuaggaa

SEQ ID NO: 70729 - RNA, 64 nt, Human
ggcaaugacugugagcgagccuggcaggugccccgugguacauucacagcacgggcacagcugc

SEQ ID NO: 70730 - RNA, 64 nt, Human
gagcucagacugggaacagggcccaggaaucugugugguacaaaccugcaugguguuuaugcac

SEQ ID NO: 70731 - RNA, 64 nt, Human
ucuguugcuucuuauugauagauggcauuggaaugugguacaaaguuagcucugaagaauaugg

SEQ ID NO: 70732 - RNA, 64 nt, Human
agggggacaugugucccucagcucagcagaggcugugguacaacaugguccuuggugaagaccu

SEQ ID NO: 70733 - RNA, 64 nt, Human
acaaaacacuucgagcacuguccaguauucuaccgugguacacaguggcuacagacaccaaguu

SEQ ID NO: 70734 - RNA, 64 nt, Human
aguuguugcuuauuauuuuauacucaguaauaaugugguacacuguuaauuuuuuugcuuuugu

SEQ ID NO: 70735 - RNA, 64 nt, Human
acauuuagaaauccuuaauguacugguuaggucagugguacaacuguuugacuuaauuaucaca

SEQ ID NO: 70736 - RNA, 64 nt, Human
agacgaucucacucugucaccagguuggaguacagugguacaaucacaacucaccguagccuca

SEQ ID NO: 70737 - RNA, 64 nt, Human
ccccggaggcguggaggagaggagacuguuugaugugguacaggggcagucaguggagggcgag

SEQ ID NO: 70738 - RNA, 64 nt, Human
cuuuauguuacuacaugcacuuggcugcauaaaugugguacaagcauucugucuugaagggcag

SEQ ID NO: 70739 - RNA, 64 nt, Human
uucugacucuccuuccaccuccccacuguacacugugguacagauaguuggcacuauccuaguu

SEQ ID NO: 70740 - RNA, 64 nt, Human
ugcugauagggauaaaucuugaggcugagggcgggugguacagauguguaugggaaaccccaac

SEQ ID NO: 70741 - RNA, 64 nt, Human
gugccagcaugcuaugggcuccugcgugaggccugugguacacagagauuagguugugauacau

SEQ ID NO: 70742 - RNA, 64 nt, Human
uggaugggcccaguucugggagaggacagaaaaggugguacaggguugucugccccuuuaaaag

SEQ ID NO: 70743 - RNA, 64 nt, Human
cuuuucaugaaugggagaagaaccuauuuuuguugugguacaacaguugagagcagcaccaagu

SEQ ID NO: 70744 - RNA, 64 nt, Human
gugcccaacaacaguaaauucaaugaaaaaaaaugugguacauagauacgauggaaaacuaugc

SEQ ID NO: 70745 - RNA, 64 nt, Human
uuguauuccuauggcaaugcauccuuuuaugaaagugguacaccuuaaagcuuuuauaugacug

SEQ ID NO: 70746 - RNA, 64 nt, Human
ugcaucacgagucuuguauuccaagaaaaucaaagugguacaauuuguuuguuuacacuaugau

SEQ ID NO: 70747 - RNA, 64 nt, Human
cugaaugaagagugcuugucaaugaucaacucuugugguacaucagggaacucacauaggugaa

SEQ ID NO: 70748 - RNA, 64 nt, Human
ucuaacucugccgcauaaacuauaaaucuguaaggugguacacagcgugucuuguuagcaaaau

SEQ ID NO: 70749 - RNA, 64 nt, Human
accccaucucuacaaaaaaaauuagcuggguguggugguacauaccuguagucccagcuacuca

SEQ ID NO: 70750 - RNA, 64 nt, Human
cucucugcagccgucuacauucuucacaaaucaugugguacauugaagccucuuuuacauguca

SEQ ID NO: 70751 - RNA, 64 nt, Human
uguagaaaaguaaucuggcaugcagaacauucuugugguacaauuaauguucguuuaugaucuu

SEQ ID NO: 70752 - RNA, 64 nt, Human
auacaaguauagagaccuaggagguggucuuguggugguacauuugguuaacccauugcuggca

SEQ ID NO: 70753 - RNA, 64 nt, Human
uguuuuuuaaaauauacauuuuauuuuugaaggugugguacaguguaaauuaaauauauucaau

SEQ ID NO: 70754 - RNA, 64 nt, Human
caucucuacuaaaaacacaaauuagccaggcguggugguacaugccuguaaucccagcuacuca

SEQ ID NO: 70755 - RNA, 64 nt, Human
uacaaacauggaaaacagaguauuucuggcagcugugguacaaaugugauaauauauugcuaaa

SEQ ID NO: 70756 - RNA, 64 nt, Human
acugcccaucagugacagacuggauuaaaaaaaugugguacauacacaccagggaauacuauac

SEQ ID NO: 70757 - RNA, 64 nt, Human
gaccgaaguguacggcagugccaucugguggcaagugguacaaagacaacgcugagggguagug

SEQ ID NO: 70758 - RNA, 64 nt, Human
aucuucuuaaacaugaagcugcuccugaucauaggugguacacguuaauaacacuaguaaaaau

SEQ ID NO: 70759 - RNA, 64 nt, Human
cauggucuugcucuauugcccaggcuggagugcagugguacaaucuuagcucacugcagccucc

SEQ ID NO: 70760 - RNA, 64 nt, Human
auaaucuaaucccuuagcaucagcuccucccucagugguacaugcgucaagauuuguagcagua

SEQ ID NO: 70761 - RNA, 64 nt, Human
auuguguggaaaauguugugaaggguguguaggugugguacauguguaugucacuaacaagugg

SEQ ID NO: 70762 - RNA, 64 nt, Human
uagagucucacucugucacccaggcuggagggcagugguacagucuuggcuaauugcagccucc

SEQ ID NO: 70763 - RNA, 64 nt, Human
agugcaugcaguaauuccaaugugacugcaugacgugguacagacauuacagguguuguagaca

SEQ ID NO: 70764 - RNA, 64 nt, Human
gaugauaacccaguagcaaaaacauuuguacugagugguacaagccuuggggacugaaaaaaaa

SEQ ID NO: 70765 - RNA, 64 nt, Human
aguacagucaguacaucaaagacugagcaguucagugguacauaaauuuaucucgcccugcaua

SEQ ID NO: 70766 - RNA, 64 nt, Human
ugauucugaacaguuggaauagaaucauaguuaagugguacagccauggcuaucgucaggccug

SEQ ID NO: 70767 - RNA, 64 nt, Human
gguuuuuauuuguucgguauuguuuuuuuacacugugguacauauaagcaacuuuaauagguga

SEQ ID NO: 70768 - RNA, 64 nt, Human
aacaugcuuguuuugaaaacucgagaugaugagggugguacaugcaguguguucucucuuuauu

SEQ ID NO: 70769 - RNA, 64 nt, Human
aguguccaucaacagaugaauggauaaagaaaacgugguacauauacacaauggaguacucuuc

SEQ ID NO: 70770 - RNA, 64 nt, Human
auuuaagaaccuucaccaagauacaauguauacugugguacaaugacagccauuguuucauaug

SEQ ID NO: 70771 - RNA, 64 nt, Human
agaauucuguuugccuaacucccaaacuguuggggugguacauuccuuuaggaccaauuaaaac

SEQ ID NO: 70772 - RNA, 64 nt, Human
uaaaaagaagcaaaucauuugcacucuauaauuugugguacaguauugcuuauugugacuuugg

SEQ ID NO: 70773 - RNA, 64 nt, Human
caacauuaaagcuaagaggaacacuucaacauaugugguacaaauuuauauugaagaucuaaau

SEQ ID NO: 70774 - RNA, 64 nt, Human
aauuguuuuguuacucugguuguugugccaaauugugguacacuuagaaaauucuacagucguc

SEQ ID NO: 70775 - RNA, 64 nt, Human; identical to SEQ ID NO: 70747

SEQ ID NO: 70776 - RNA, 64 nt, Human
accauuauauuuuacuaucugcaugcuguuaacugugguacacugugaaauauguugauuacaa

SEQ ID NO: 70777 - RNA, 64 nt, Human
cagagucuugcucuguugcccaagcuggagugaagugguacaaucuggcucacugcagccuccg

SEQ ID NO: 70778 - RNA, 64 nt, Human
cuucagucagaaacugauguuucagcuaggcacagugguacaugccuguaaucccagcuacuug

SEQ ID NO: 70779 - RNA, 64 nt, Human
auuugagucucucgugcaaaugagacuauucuuugugguacaauuccaccuaucauaugugaaa

SEQ ID NO: 70780 - RNA, 64 nt, Human
uaaaauaaguucuugacuuuucucaugugugguugugguacaucauauuggaaggguuaaccug

SEQ ID NO: 70781 - RNA, 64 nt, Human
auaaagcucccuccuuauuuuuuccucccuggucgugguacagauuccaggguuggaucuuugg

SEQ ID NO: 70782 - RNA, 64 nt, Human
aaggaccaggcaguggggaaggaggagguccuccgugguacauacugggucaggcacuagcaug

SEQ ID NO: 70783 - RNA, 64 nt, Human
ucucaaucccagcaguucuuuguagucauuccaagugguacacgucugugcccugaaggaacac

SEQ ID NO: 70784 - RNA, 64 nt, Human
aagaguuguauaaucuuguagaauuucucauucugugguacaacccagggguaaacuauuauuc

SEQ ID NO: 70785 - RNA, 64 nt, Human
augcucuuuucccaggggacaugaguaaagcagugugguacacuccagggacuugggaaaauga

SEQ ID NO: 70786 - RNA, 64 nt, Human
gagugucccccucccagaagcauaucccagaugagugguacauuauauaaggauuuuuuuuaag

SEQ ID NO: 70787 - RNA, 64 nt, Human
ccucgugggcuuugugacggcccaguggcucugcgugguacaugacugagaagagaaaaacaaa

SEQ ID NO: 70788 - RNA, 52 nt, Human
caaaugccacuagcaccugagugugguacaggaggaauguuugguugggaga

SEQ ID NO: 70789 - RNA, 64 nt, Human
uuaggaaggugaaauacauucacugucucuguuggugguacaucuuguugaauucaauauuaga

SEQ ID NO: 70790 - RNA, 64 nt, Human
uuggcuaagaauguuguuaccaucuucuuuguuugugguacaauauuuucagugcaaaagagau

SEQ ID NO: 70791 - RNA, 64 nt, Human
gugaugucugccauggaugcaguagaggaaaguggugguacaagugccaugauugauuagcaau

SEQ ID NO: 70792 - RNA, 64 nt, Human
ccaaaaacaaacaaaaaaggagcagagaaagacagugguacagcuaaccugaacaagggaacug

SEQ ID NO: 70793 - RNA, 64 nt, Human
cuaggaaaaaguugcagguaauuuaaacugucuagugguacauaguaacuaaauuucuauuccu

SEQ ID NO: 70794 - RNA, 64 nt, Human
agaauccuggcccucuguguuggcccaagcucuugugguacacacagauuacugcccaauaugc

SEQ ID NO: 70795 - RNA, 64 nt, Human
aggcaagauucuuucccccucccugcugaagcaugugguacagaggcaagagcagagccugaga

SEQ ID NO: 70796 - RNA, 64 nt, Human
ccagauucauuccuucuucauucuuugcaaaacagugguacagacauggagucuagaauugacc

SEQ ID NO: 70797 - RNA, 64 nt, Human
aauaaaacaauugcagauugcuaaguagcuguuggugguacaaguuugauauuuagcuugagaa

SEQ ID NO: 70798 - RNA, 64 nt, Human
uuuaagugggaugauuagauauacacaacaccaagugguacaucugcagagauaauucaaaauu

SEQ ID NO: 70799 - RNA, 64 nt, Human
uuauuuggugucucaaagcuguauuuccaagacagugguacaaggugacccuuaauuacccgua

SEQ ID NO: 70800 - RNA, 64 nt, Human
uccauuaacauccucacuguuuagacacauaacugugguacaguguauuggaaauuuuauaaac

SEQ ID NO: 70801 - RNA, 64 nt, Human
cuagauuguaauauuuaaggucgaauuucgaccugugguacacagcugugcuguggcucaguca

SEQ ID NO: 70802 - RNA, 64 nt, Human
auacuacugugaguaaaaguaauacuuuaauaaugugguacaaauuuuaaaguuuaauauugaa

SEQ ID NO: 70803 - RNA, 64 nt, Human
ccucggcacacacugugccccacaaaacuucagugugguacaagguggagaaagcauaucccac

SEQ ID NO: 70804 - RNA, 64 nt, Human
cucugcccgggggacuccggacacugacagccgcgugguacaaaauaaacguguauuuguuguu

SEQ ID NO: 70805 - RNA, 64 nt, Human
ugccucuuuccugugauauguagacuagcacagagugguacauccuaaaaacuugggaaacaca

SEQ ID NO: 70806 - RNA, 64 nt, Human
acuuuguuuugaugagggugaugcucucucuuaugugguacaauaccauuaaccaaagguaggu

SEQ ID NO: 70807 - RNA, 64 nt, Human
cucugcccuggagacuccggacacugacagccgcgugguacagaauaaacguuauuuauuuuuu

SEQ ID NO: 70808 - RNA, 64 nt, Human
ggaggcauuaaaauucacugugcccagcacaugggugguacacuaauuaugacuucccccagcu

SEQ ID NO: 70809 - RNA, 64 nt, Human
uucccaaggagauggaggaagaccuggggugggggugguacaggguagggagaggaggggcaga

SEQ ID NO: 70810 - RNA, 64 nt, Human
ugcugugccuaugggguucuagagaguguugagugugguacauuaacucuccauuuuagccaga

SEQ ID NO: 70811 - RNA, 64 nt, Human
aucuauacaagaauuuaaaaauaagcugggcguggugguacacaccuguggucccagcuacuag

SEQ ID NO: 70812 - RNA, 64 nt, Human
ugccagcugacgucacagucuaagaugggaaacugugguacagauagacaugaagagagcuuag

SEQ ID NO: 70813 - RNA, 64 nt, Human
gaguugcuggaaugaaguagaggugacucucucugugguacacauugaauguacuauguauguu

SEQ ID NO: 70814 - RNA, 64 nt, Human
gucucuacuaaaaauacaaaauuagccagguguggugguacaugccuguaaucccagcuacuag

SEQ ID NO: 70815 - RNA, 64 nt, Human
cccccaucacuugaugggccacacaaguuugagagugguacaagggagaaguuugggaaaagcc

SEQ ID NO: 70816 - RNA, 64 nt, Human
caaccaccccaggcuccccugggaggcugcaguugugguacacguccccggugcuggguuggcc

SEQ ID NO: 70817 - RNA, 64 nt, Human
ucucuaccaaaaauacaaaaauuaaccaugcguggugguacacgucugucaucccagcagcucu

SEQ ID NO: 70818 - RNA, 64 nt, Human
auauuuuauagccuuaauaugccuuauaucagaggugguacaaaaugcauuugaaacucaugca

SEQ ID NO: 70819 - RNA, 64 nt, Human
cucaggaguggugcccagaaaaggaaagggcuuggugguacaugaagugggggcagugggcagg

SEQ ID NO: 70820 - RNA, 64 nt, Human
aagaaauauuggcuauuucaauguaaguuauaaggugguacauuccuaaggguauuuauaguug

SEQ ID NO: 70821 - RNA, 64 nt, Human
agaaagcaacaaagugaauuguucuuuagcccaagugguacagugaauuugcuuuaacagaugu

SEQ ID NO: 70822 - RNA, 64 nt, Human
cacucaggauagaaacuuuauguguauagggaaugugguacagccuuuagccaggagucauacu

SEQ ID NO: 70823 - RNA, 64 nt, Human
cugucuggggugauuccuagaagaucauuaaacugugguacauuuuuuugucuaugaauguuga

SEQ ID NO: 70824 - RNA, 64 nt, Human
gauuucuggucuaagugggccuccuggggauggggugguacacugagcuucugagccucauugu

SEQ ID NO: 70825 - RNA, 64 nt, Human
uguuuuuaacaugucaaucuguccguucacaugugugguacaugguguuuguggccuuggcuga

SEQ ID NO: 70826 - RNA, 64 nt, Human
cagggugucacuuugucccccaggcuggagugcagugguacaagcacaguucacuguacccugu

SEQ ID NO: 70827 - RNA, 64 nt, Human
gaugcucagaauaacugcugucucccaugauggugugguacagcgagcuguugucuggcuaugg

SEQ ID NO: 70828 - RNA, 64 nt, Human
gggcgaggccaugcgcugcccccagugccagaucgugguacagaagaaggacggcugcgacugg

SEQ ID NO: 70829 - RNA, 64 nt, Human
gcagugacauaaaaggcaaagaggagcuggcauggugguacagaagguaucagucaagcgcagg

SEQ ID NO: 70830 - RNA, 64 nt, Human
guuuauuguacaugauggguuagguggggugaaugugguacaggaauguccuguaugcccaagu

SEQ ID NO: 70831 - RNA, 64 nt, Human
gguuauuuuccgccagaccucaaccugggucaaagugguacaggaaggcuugcaguaugauggc

SEQ ID NO: 70832 - RNA, 64 nt, Human
cuauaaacuuuauagaaguacaguauuaaagucagugguacacagacauucuguacauauccug

SEQ ID NO: 70833 - RNA, 64 nt, Human
guaacuuuucccccuguguaaguuacuaugguuugugguacaacuucauucuauagaauauuaa

SEQ ID NO: 70834 - RNA, 61 nt, Human
augccuggaccuggggcuagaggagggugcugugguacauggcagccaggggcuucauuuc

SEQ ID NO: 70835 - RNA, 64 nt, Human
augacccucugagcuuuucauuuauucaagcucugugguacagccuuuuuuuaaaauaaauuaa

SEQ ID NO: 70836 - RNA, 64 nt, Human
auuauacacaaaaguguaugauauguacaacugagugguacagauaugacauggaagaucuggg

SEQ ID NO: 70837 - RNA, 64 nt, Human
gggccguucuuucuaaggugucgguauguggggagugguacaaaauggucugaugcuccuucaa

SEQ ID NO: 70838 - RNA, 64 nt, Human
ugcaaacaaacaugauugauagcuggacagacaugcucgucaugaaaaaagaaccauuucugaa

SEQ ID NO: 70839 - RNA, 64 nt, Human
aagcuaggaucucuaacaaacgcagaaggcuuuggcucgucauuuccucuuaaaaaggaggagc

SEQ ID NO: 70840 - RNA, 64 nt, Human
gcuuccucuucggcaagaggagcuuuuccagcgcgcucgucauuuccggacucucugcugcgga

SEQ ID NO: 70841 - RNA, 64 nt, Human
ugaaugagcucaccauggaugaugauaccgccgugcucgucauugacaacggcucuggcaugug

SEQ ID NO: 70842 - RNA, 64 nt, Human
gugcuguagaugcugggcccagggcccuagguuugcucgucacaguguggggaagcccauuccu

SEQ ID NO: 70843 - RNA, 64 nt, Human
auugacaccaaaaugaaccuugcuaucaagaaaugcucgucauacaguaaacucuggaugauuc

SEQ ID NO: 70844 - RNA, 64 nt, Human
acauggaugucgagggugguuuguguggagcugugcucgucagcugggucugcccucuuccccc

SEQ ID NO: 70845 - RNA, 64 nt, Human
acccacguuuuugacaagccagcauauugccaaugcucgucaaagacauuuauguuucuuuuac

SEQ ID NO: 70846 - RNA, 64 nt, Human
auauggucacauuggcgccuagaacaguuaggucgcucgucacauaggcaguuaaguggagaac

SEQ ID NO: 70847 - RNA, 64 nt, Human
ggauggggugccaguuugaaugcagucuguccaggcucgucauuggaggugaacaagcaaaccc

SEQ ID NO: 70848 - RNA, 64 nt, Human
ccaacgccuacauuuaauuccugguaagagcagugcucgucaaguuucugguuuuucucugcuc

SEQ ID NO: 70849 - RNA, 64 nt, Human
auggagcugcugcugaagggacuuguagggagaggcucgucaacaagcacuguucuggaaccuu

SEQ ID NO: 70850 - RNA, 64 nt, Human
ugaaugagcucaccauggaugaugauacugccgugcucgucauugacaacggcucuggcaugug

SEQ ID NO: 70851 - RNA, 64 nt, Human; identical to SEQ ID NO: 70850

SEQ ID NO: 70852 - RNA, 64 nt, Human
ggagcgcaggcagcgcagggcuggcacgugacaggcucgucagccaccugggaacacaguucug

SEQ ID NO: 70853 - RNA, 64 nt, Human
uuggggaccucucugagcaggcucucgugaaucagcucgucaucagauggcuuuggugcauggc

SEQ ID NO: 70854 - RNA, 64 nt, Human
cugggcuuccuguguguagcccuggcauagacuugcucgucaggguguucgacucugggaugcu

SEQ ID NO: 70855 - RNA, 64 nt, Human
uccuuggggcgugguuccuguggaccccagcucagcucgucaagcugcaggggcggggcuccug

SEQ ID NO: 70856 - RNA, 64 nt, Human
ucuuaaagauaauuaaaaaugaaacaaagugagugcucgucacuggguucaucagagcagugug

SEQ ID NO: 70857 - RNA, 64 nt, Human
ccacccccagcugcuugugucccuccugggaucugcucgucaucauuuuuccuucccuucucca

SEQ ID NO: 70858 - RNA, 64 nt, Human
gucacuuuuuuuuuuuuuuuugagauggaauuuugcucgucacccaggcuggagugcaauugug

SEQ ID NO: 70859 - RNA, 53 nt, Human
agaggcaaguguuggccugagacgcucgucaguucuuagaucuugggggccua

SEQ ID NO: 70860 - RNA, 64 nt, Human
auguggcuguugauuaauuugacugcuucucguugcucgucaccuccaugccaggcacugugcu

SEQ ID NO: 70861 - RNA, 64 nt, Human
ugggcacaaacuuccugagccucugaaaugggaggcucgucaauuucagaccaaccucuuuuca

SEQ ID NO: 70862 - RNA, 64 nt, Human
agggccuagugaaggguuugugugcccagugucugcucgucaucuguggcugcaggggucagac

SEQ ID NO: 70863 - RNA, 64 nt, Human
cuucugcuucccccauucccuuccacagcucauagcucgucaucucggcccuuguccacacucu

SEQ ID NO: 70864 - RNA, 64 nt, Human
cccuaccugcugcaucgucaggcucccacgcuuuguccgugaugccccccuacccccucacucu

SEQ ID NO: 70865 - RNA, 64 nt, Human
gcucguuccccuuccuuccgcagcuccuagucucguccgugacuuuccgguugcccuggaucuc

SEQ ID NO: 70866 - RNA, 64 nt, Human
acugagucuuucuuagauuaaaucucucccaguuguccgugaagagaaagacaguauuugcagu

SEQ ID NO: 70867 - RNA, 64 nt, Human
gauuuacugucuucaucuguuuaaugaguagaauguccgugaugccuaccucacaggguuguug

SEQ ID NO: 70868 - RNA, 64 nt, Human
aggccauaguuaaaaaguaccagcucuggcugggguccgugaagcccaggccaggcagccaaau

SEQ ID NO: 70869 - RNA, 64 nt, Human
gcccccgcccgucaccaccaccggccaccugaguguccgugagcgggccgaggcgcucaucagg

SEQ ID NO: 70870 - RNA, 64 nt, Human
uuacccuaauagcaugaagaucgugggucuguguguccgugaagugagucccgucugccaggag

SEQ ID NO: 70871 - RNA, 64 nt, Human
uaaucccacccccugcccugagacagugaauguaguccgugaagggagugccucucugggaccc

SEQ ID NO: 70872 - RNA, 64 nt, Human
uuuuccaucuccccacuucuuugaucagucauguguccgugaccucguuccaugacaucaggau

SEQ ID NO: 70873 - RNA, 64 nt, Human
cacuuagcaacaaaguaccuucuaauuuccaauaguccgugaaaguuggggcugaaguaccuaa

SEQ ID NO: 70874 - RNA, 64 nt, Human
ccgagggaaacuuaagaacguuuaaaauauaggaguccgugauuucccuguguuuucaguuucu

SEQ ID NO: 70875 - RNA, 64 nt, Human
uaguuagguagaguuuuaaaaaauacuugagccuguccgugauaaagcuauaaaauucaauaac

SEQ ID NO: 70876 - RNA, 64 nt, Human
ucugcuuuuccaagaaugugaaucuugccaagcuguccgugagagacacgggcuccccucgagg

SEQ ID NO: 70877 - RNA, 64 nt, Human
ccuccagcacucccuuuugucaucuugaguuucaguccgugacuuggguggcacccuaucuucu

SEQ ID NO: 70878 - RNA, 64 nt, Human
gaagaacagagcaguggcacuggaccuccugucuguccgugaggcugcagaacacaaggcagcu

SEQ ID NO: 70879 - RNA, 64 nt, Human
gaucaacaacacuacuucccugccggaaugaacuguccgugaauggucucugucaagcgggccg

SEQ ID NO: 70880 - RNA, 64 nt, Human
auuugcucauaaguaaaugucuucauguugauguguccgugaaaguugugaucuguuguaauau

SEQ ID NO: 70881 - RNA, 64 nt, Human
uccagaggcuguaacacauuuguaauacuuuaggguccgugacuaccaucugcaugguuuaagu

SEQ ID NO: 70882 - RNA, 64 nt, Human
ccacuaccuccacgcuucccagagccugcggcuuguccgugagcuccgugcacuucaccaaagc

SEQ ID NO: 70883 - RNA, 64 nt, Human
agccagggcacaguuaggccuggauguuugccugguccgugagaugccgcggguccuguuuccu

SEQ ID NO: 70884 - RNA, 64 nt, Human
agcacugauuuguggauguggaugggggcacguuguccgugauaaaaguacaagugccccucac

SEQ ID NO: 70885 - RNA, 64 nt, Human
uccugccuccuucccaggacuuuguggcugguuuguccgugauucuucggggaacuguagauga

SEQ ID NO: 70886 - RNA, 64 nt, Human
guauccuuucuaggcuuggagauggcuuugguugguccgugaauguaguuaugagagugcugcc

SEQ ID NO: 70887 - RNA, 64 nt, Human
ugaccuguccucuuugugauaauucucaguaguuguccgugauaaucguguccugaaaauccuc

SEQ ID NO: 70888 - RNA, 64 nt, Human
uuauucaguccuucagcucacggaagggaugcuaguccgugaaggugaccucacaguacugguu

SEQ ID NO: 70889 - RNA, 64 nt, Human
ugacugcguugugugaacaaucugcaauuuuucaguccgugagauccugcccuuccaccucuuu

SEQ ID NO: 70890 - RNA, 64 nt, Human
agcuuguccuucaaucauguuuccucucagaugcguccgugaugccuccuaauguggaacuggu

SEQ ID NO: 70891 - RNA, 64 nt, Human
gaaagaaccacucauugucuuugaggaagaagauguccgugagaacaucauuacuuaugaugau

SEQ ID NO: 70892 - RNA, 64 nt, Human
ugggggccagaccaccccauuguccauccuuguuguccgugaguccuuggccuccaccaagcac

SEQ ID NO: 70893 - RNA, 64 nt, Human
acuuuccugacguacucucuguacauaacucagcguccgugacugcaguaacagccagcccuac

SEQ ID NO: 70894 - RNA, 64 nt, Human
gcuuugcaacccuccccaaccaaguccaccgaaaguccgugaagaaaggcuuugacuuuacccu

SEQ ID NO: 70895 - RNA, 64 nt, Human
gcucuaaaagaaaaaggaacuaggucaaaaaucuguccgugaccuaucaguuauuaauuuuuaa

SEQ ID NO: 70896 - RNA, 64 nt, Human
acguccaucugagcagccugcguggccgucuggaguccgugagacugaaaggacccgugcaucu

SEQ ID NO: 70897 - RNA, 64 nt, Human
gcaguccacuuugggucaugcuugcugcgagcacguccgugaacgucagcugugggccucgugc

SEQ ID NO: 70898 - RNA, 64 nt, Human
gagauacugcucccaggggccuagguagcugccaguccgugauuuuaauugcugucuugaaguu

SEQ ID NO: 70899 - RNA, 64 nt, Human
auacgauggggugcuugguggaugggccauggagguccgugagcuggaacugggcacacgccau

SEQ ID NO: 70900 - RNA, 64 nt, Human
uauucuuucauauacagcuuauuaccuucaucauguccgugagucuaaucauuaguacgugugg

SEQ ID NO: 70901 - RNA, 64 nt, Human
gcgcguggccaggaugcccgggcuggagcggagcguccgugagcgcuuccucccugugcacuga

SEQ ID NO: 70902 - RNA, 64 nt, Human
ccagcuucuccuucucccucugcauaaaaucacaguccgugagucuuccagcugccaccacggc

SEQ ID NO: 70903 - RNA, 64 nt, Human
guucucugccgcccgcccacuccguuucccugugguccgugaaggacggccucaggccuuggca

SEQ ID NO: 70904 - RNA, 64 nt, Human
acuuuccccccauguauuuuguaugcauaugauuguccgugauaauuggcuacuuuuccauugu

SEQ ID NO: 70905 - RNA, 64 nt, Human
auuacacacaugugcgcauuacacacacacaauacacauacaugcauauagacgcaucuauugg

SEQ ID NO: 70906 - RNA, 64 nt, Human
cacacgcacacacgcacacacacacacguacacacacauacaaaaucccucugcaguuuugggg

SEQ ID NO: 70907 - RNA, 64 nt, Human
uuuaaacacacacacacacacacacacacacacacacauacacagacaaaaacacaaaaacucu

SEQ ID NO: 70908 - RNA, 64 nt, Human
uguucacccccaaaagaaaacuuacacacccacacacauacacauuucaugcuuggagugucuc

SEQ ID NO: 70909 - RNA, 64 nt, Human
auauauacgaacaaaacacacgcgcgcacacacacacauacacgaaagagagagaaacaaacuu

SEQ ID NO: 70910 - RNA, 64 nt, Human
agaucucaucggggagguucuccugccucuccucggccaggaggcugaggccugcacugcagau

SEQ ID NO: 70911 - RNA, 64 nt, Human
cacacauauauauacacacacauacguauacacacacauacauauauauaaauauaccugaugc

SEQ ID NO: 70912 - RNA, 64 nt, Human
ugcccacucccacuccauccuguccccaaggacucacauacagugccuggagaaagccaaagac

SEQ ID NO: 70913 - RNA, 64 nt, Human
auugaauucugccucuuuuugaaaaaaauguauucacauacaaaucuucacauggacacauguu

SEQ ID NO: 70914 - RNA, 64 nt, Human
uaaggucccgaagguggaacaugcuucauggucacacauacaggcacaaaaacagcauuaugug

SEQ ID NO: 70915 - RNA, 64 nt, Human
gcaguuuaaauagcccuguucucauuacucugaccacauacaucauagggugcuaaaguugaug

SEQ ID NO: 70916 - RNA, 64 nt, Human
aacccaaacauuugcuacuaacauaggaaacacacacauacagacacccccacucagacagugu

SEQ ID NO: 70917 - RNA, 64 nt, Human
uguguguguguguguguauguguauguguauguacacauacauauauauaguugacacuugaaa

SEQ ID NO: 70918 - RNA, 64 nt, Human
uccuguuucuguccaucuuguuccuguggcuuagcacauacagaccucagaucuuacuugguag

SEQ ID NO: 70919 - RNA, 64 nt, Human
aacuacugccuuucaaagugcacacacacgcguccacauacacugcauucguugcuccaguaua

SEQ ID NO: 70920 - RNA, 64 nt, Human
agcuccccugccacacccagugcccacgcaugcucacauacauacagcagaccacaacccuguu

SEQ ID NO: 70921 - RNA, 64 nt, Human
acacacacacacauauacacacacacacacuucacacauacacaccacucccaccaccgucaug

SEQ ID NO: 70922 - RNA, 64 nt, Human
aagauucaaccaaauaaauauauauauacacacacacauacauauacaccuauauaugugugua

SEQ ID NO: 70923 - RNA, 64 nt, Human
guugaaaguaaguuaauuuguuucugcauauaugcacauacauacguaaggaucuuaaacccag

SEQ ID NO: 70924 - RNA, 64 nt, Human
cugagaaaaugcaaauauuuguugugacaagaaucacauacauuuacuuuaaauauaguugccu

SEQ ID NO: 70925 - RNA, 64 nt, Human
aucaacguauuuauaugguacugcugugacgcggcacauacaccccagccgcacagaugcgugu

SEQ ID NO: 70926 - RNA, 64 nt, Human
ccugcugcccccaaugacucuugguuucgucucccacauacagaagcaggguggaggggaaggg

SEQ ID NO: 70927 - RNA, 64 nt, Human
cuuggcuggcaacacacacacacacacacacacacacauacacacacgacugaaucagaucgga

SEQ ID NO: 70928 - RNA, 64 nt, Human
ucucccuugaggagcacucacucuugaaggcacacacauacacauauuuucagugaaauauauu

SEQ ID NO: 70929 - RNA, 64 nt, Human
ucauguacacacgcagacacagacaccacacacacacauacacacacacacacacacacaccug

SEQ ID NO: 70930 - RNA, 64 nt, Human
caccuuuuguugcuuaaaaagaaacaaaacaaaucacauacauacauuuaaaaaaaaaacaaca

SEQ ID NO: 70931 - RNA, 64 nt, Human
ccugucccagcuucaucuuguccugagauuuauccacauacaggaaacaggcgggacacagugg

SEQ ID NO: 70932 - RNA, 64 nt, Human
cauggagaggaagaucuugacuuauauucuguaccacauacacuucuguggacuuuuagcauuu

SEQ ID NO: 70933 - RNA, 64 nt, Human
uauuccaguacacugaauacaugaggaauuuaaccacauacaucauugaagacaagggauagca

SEQ ID NO: 70934 - RNA, 64 nt, Human
uaauaaaacaaauuguuuuaaauguuuaguuucacacauacauaguaccaugauuuucuuugaa

SEQ ID NO: 70935 - RNA, 64 nt, Human
uacagacagaccuaccuauacauacgugcacacacacauacauauucauacacaauucauacac

SEQ ID NO: 70936 - RNA, 64 nt, Human
guguggcagccaugaaaaguuacacauacacacccacauacagacagaccuaccuauacauacg

SEQ ID NO: 70937 - RNA, 64 nt, Human
ggagaugcuaguguguggcagccaugaaaaguuacacauacacacccacauacagacagaccua

SEQ ID NO: 70938 - RNA, 64 nt, Human
cugaucagagacacauauccauacacaggugaaacacauacagacucaacagcaaucaugcagu

SEQ ID NO: 70939 - RNA, 64 nt, Human
uucuccccuacaguccuccaugauaacaagcugacacauacagaccucaagccugaaaauauuc

SEQ ID NO: 70940 - RNA, 64 nt, Human
cuuugugacagaagacauguacacacacaccacacacauacauacacacucucucacucugucu

SEQ ID NO: 70941 - RNA, 64 nt, Human
ccuucucagaucaacucccuggugauguuucuuccacauacaucugugaaaugaacaaggaagu

SEQ ID NO: 70942 - RNA, 64 nt, Human
ucaugccucccaacuguggugguauauguguacacacauacacaggguggauggagaagagguu

SEQ ID NO: 70943 - RNA, 64 nt, Human
caagcaugugaauaaucuuccaucuuccccgccacacauacacacacacacuuuuuguuucuuu

SEQ ID NO: 70944 - RNA, 64 nt, Human
cacacacgcacacaugcgugugcacccgcgcacgcacauacacacacacauauagcaguagcag

SEQ ID NO: 70945 - RNA, 64 nt, Human
gaggaaugucuucgaacagucgaaugcuauaauccacauacagaucacugguccuuucuugcuc

SEQ ID NO: 70946 - RNA, 64 nt, Human
acucagcaguccuagcuuggugacugggaacugccacauacagggccaggccuacccuccuucc

SEQ ID NO: 70947 - RNA, 64 nt, Human
auccucugggccaucccuggcccuguagcacagacacauacaaguuccuuggacuugucacacu

SEQ ID NO: 70948 - RNA, 64 nt, Human
ucaccccucgccaccuuucacccucaugaaaacacacauacacgcaaauacacuccaguuuuug

SEQ ID NO: 70949 - RNA, 64 nt, Human
uuccauggcagcaggaugcagggauuaauaaggacacauacacauuauuccaccaauugacuuu

SEQ ID NO: 70950 - RNA, 64 nt, Human
ggccagccagacugccuguccacaugcgugucagcacauacagccgcuuccuggaagccgccug

SEQ ID NO: 70951 - RNA, 64 nt, Human
cagcuguugaaacgaaaacuguacuuuguacccucacauacaaagggaucaaauuugaccuggu

SEQ ID NO: 70952 - RNA, 64 nt, Human
guauauaauauauauauauacauauauauuuauacacauacaauuuauguuuuccuguugaaug

SEQ ID NO: 70953 - RNA, 64 nt, Human
accuucuaauuauaguuugaaaauagauucccuacacauacauacauauguaugcacagauagg

SEQ ID NO: 70954 - RNA, 64 nt, Human
agaacaaaccgaaaucaggauacccaaccauacacacauacaaguccacacacacucccacccc

SEQ ID NO: 70955 - RNA, 64 nt, Human
aagauguaaacauauauuaagcuauauuaaaucucacauacaguucuucugugcucuauuauac

SEQ ID NO: 70956 - RNA, 64 nt, Human
uuuucauuauucugauagauuguauacauauguacacauacauauacacauaugcacagucaag

SEQ ID NO: 70957 - RNA, 64 nt, Human
ggguucucuaaucuaaucaggacaggacagguuucacauacaauugucccaguucgcaucccag

SEQ ID NO: 70958 - RNA, 64 nt, Human
aucaucagaaugggcagagaugaucuugaagugucacauacacuaaaguccaaacacuauguca

SEQ ID NO: 70959 - RNA, 64 nt, Human
cauuaaauacuauuuugcuccuuuucugguguuacacauacacacucauacgugugugugugug

SEQ ID NO: 70960 - RNA, 64 nt, Human
ugguaggauugcagccgugggccugcuggacacacacauacaccaaagauguauuuggaucugg

SEQ ID NO: 70961 - RNA, 64 nt, Human
acaugaugugucacuagcucugugggaugauugccacauacauggaacaccugggagugcugga

SEQ ID NO: 70962 - RNA, 64 nt, Human
auuuugacugcauacaaacuaugucucugacaugcacauacacugcuuuauaaugaaaaugagg

SEQ ID NO: 70963 - RNA, 64 nt, Human
guguuaccccucuacacguccacaccacucaccacacauacauacacaugcacacacacacaca

SEQ ID NO: 70964 - RNA, 64 nt, Human
uguguauguauacacacauauacauauauauauacacauacauacacauacauacauacauaca

SEQ ID NO: 70965 - RNA, 64 nt, Human
uacacacauauacauauauauauacacauacauacacauacauacauacauacauauauaucug

SEQ ID NO: 70966 - RNA, 64 nt, Human
uuuuuuaaucacucauaugguagaauuuuauaaacacauacaugauaccauccaaauucuugcu

SEQ ID NO: 70967 - RNA, 64 nt, Human
aaaaaacggauagaacaggauuuucuaggaguuacacauacauuuuauccugucauaccucgag

SEQ ID NO: 70968 - RNA, 64 nt, Human
aaaugagcucaaguacaugaauguuaguuguuaucacauacagcaaauuccuuuuuuuuucuuu

SEQ ID NO: 70969 - RNA, 64 nt, Human
uagucauaaggacaaagccuuaguauauuuuugccacauacauguuauguauaaauuuuacugu

SEQ ID NO: 70970 - RNA, 64 nt, Human
auguucuucuaaaacauauacauauauacauacacacauacacauauucuucaggucucuaagc

SEQ ID NO: 70971 - RNA, 64 nt, Human
uaugcacacacgcauacacacaugcacgcacacacacauacacacaugcacgcacgcacgcaug

SEQ ID NO: 70972 - RNA, 64 nt, Human
uuugguaucucuugcuccuuucuaucuguggucacacauacacgcucuauuaacuuugccuaau

SEQ ID NO: 70973 - RNA, 64 nt, Human
uauuacugagagugcaaauuguacaagguauuuacacauacaacuucauauaacugagaugaau

SEQ ID NO: 70974 - RNA, 64 nt, Human
guagcauucuuuggaguuaaaaugcacauauagacacauacacccaaacacuuacaccaaacua

SEQ ID NO: 70975 - RNA, 64 nt, Human
uuauaaucuuuucucccugaaauacucacauucccacauacauucacuauuuucacacacacac

SEQ ID NO: 70976 - RNA, 64 nt, Human
uaauauaaacuuauuuacuuuccuuuuuaugaagcacauacaaaagaagacagggaaugcaauc

SEQ ID NO: 70977 - RNA, 64 nt, Human
ugaaaguguaauuccccucugacacaauaucccucacauacaagauggugauguaccacucccg

SEQ ID NO: 70978 - RNA, 64 nt, Human
aacaauuuguauacagggguuggacuuaaaaacacacauacaaacaaaacucuuuucauucuga

SEQ ID NO: 70979 - RNA, 64 nt, Human
uaauaugguguacauucuuccugauuauuuucuacacauacauguaaaauaugucuuucuuuuu

SEQ ID NO: 70980 - RNA, 64 nt, Human
aacgcucuguuuaguauguauaacuuaaaaggaacacauacaauuaaaaguaauugaaagacau

SEQ ID NO: 70981 - RNA, 64 nt, Human
gguuguugcaguucagacaaauguaacacacacacacauacacacacacacacacacacagaga

SEQ ID NO: 70982 - RNA, 64 nt, Human
gcaaugugaacuguauuuacauaaacgugcaaggcacauacauaaugacuuucuuuuuccuuaa

SEQ ID NO: 70983 - RNA, 64 nt, Human
uuccagggaaauaaucauuuuguacuauuuacuccacauacaauguaagugcuuuuaauggcug

SEQ ID NO: 70984 - RNA, 64 nt, Human
auacccuucuuuaaaucaaaagcugcuugacuaucacauacaauuugcacuguuacuuuuuagu

SEQ ID NO: 70985 - RNA, 64 nt, Human
cuuuaaaguuuuguuuaauauuuacagaaaaauccacauacaguauugguaaaaugcaggauug

SEQ ID NO: 70986 - RNA, 64 nt, Human
uccaaagcugaauacauucugcuuucaucuuggucacauacaauuauuuuuacaguucucccaa

SEQ ID NO: 70987 - RNA, 64 nt, Human
cacacacacauauacacacacucacagacccacacacauacacacugucaugcacucaacuaua

SEQ ID NO: 70988 - RNA, 64 nt, Human
guacccacaccauacauacauacauauauauauacacauacauacaaaccugugugccaaguga

SEQ ID NO: 70989 - RNA, 64 nt, Human
guaucguguguaguuaccauuauguaacuauacacacauacagcuacggauauaaugaaaauua

SEQ ID NO: 70990 - RNA, 64 nt, Human
uuuucauacacuuaauaguacuguaacugcaauucacauacaaaaugucugauuuuaaugugcu

SEQ ID NO: 70991 - RNA, 64 nt, Human
agcugguuauauuuaauucagccccucugaaaagcacauacagucuauacuuuguuuauaaaua

SEQ ID NO: 70992 - RNA, 64 nt, Human
guuuacuuuuuuccuccacacguuugauuuuugacacauacaccccuaauucccucaacagcag

SEQ ID NO: 70993 - RNA, 64 nt, Human
auaaaccuaaaagcauuugaacaugacacccgaacacauacauauauguucacuuauuuguggc

SEQ ID NO: 70994 - RNA, 64 nt, Human
guccaggcugccugcugagauccugucuuuagcucacauacauuccacggugggggacaccauu

SEQ ID NO: 70995 - RNA, 64 nt, Human
gcaaaaauacuguauagaacuuauuuguaaauagcacauacauugauagauggggugugggacc

SEQ ID NO: 70996 - RNA, 64 nt, Human
uuuaacaaugugcccucuuaagugugcacagauacacauacacgguauucccaagagugguggc

SEQ ID NO: 70997 - RNA, 64 nt, Human
ugccaaggagcaacagaauccuuccaggaccguucacauacaaagaaaaguagugguauuuugg

SEQ ID NO: 70998 - RNA, 64 nt, Human
aagccuccugccccaaagcuugugggcacaugggcacauacagacucacauacagacacacaca

SEQ ID NO: 70999 - RNA, 64 nt, Human
ccaaagcuugugggcacaugggcacauacagacucacauacagacacacacauauauguacaga

SEQ ID NO: 71000 - RNA, 64 nt, Human
ggcucugacagaaagcagauaccucacccugcuacacauacaggauuugaacucagaucugucu

SEQ ID NO: 71001 - RNA, 64 nt, Human
ugaugaaaaaauauacauaaaaggguaaaauucacacauacagcaaacaaaaaugcacaaagcc

SEQ ID NO: 71002 - RNA, 64 nt, Human
agauuugcaguucugguuuauauaauaccaaagucacauacagguaauuucccaccauugaacc

SEQ ID NO: 71003 - RNA, 64 nt, Human
gccacacaaacguauguaaauguauauacccacacacauacacacauaugucauauauuacuag

SEQ ID NO: 71004 - RNA, 64 nt, Human
gccaugcagguagaauugucaucucccaaguggccacauacagcaacccacuccaggccauggg

SEQ ID NO: 71005 - RNA, 64 nt, Human
acucucagaaauaaaucacagaugcauauagacacacauacauaaugguacucccaaacugaca

SEQ ID NO: 71006 - RNA, 64 nt, Human
accucuguauuuuucaaguuuucuauaaggaauacacauacacccacaugcacacaccauaguu

SEQ ID NO: 71007 - RNA, 64 nt, Human
aacuuagauauaguuucuuaauaggauagauacccacauacaguauaauauaucccauucaggu

SEQ ID NO: 71008 - RNA, 64 nt, Human
uacauaguguugguuugauguggaaguguuuauccacauacaaaguacaaaacaagccaugaac

SEQ ID NO: 71009 - RNA, 64 nt, Human
uuguaaauauuucagacuguguggaccaaaaggccacauacagucucugucauaacuacucaac

SEQ ID NO: 71010 - RNA, 64 nt, Human
aauaaaguaggcaugaauaaauguucaggacacacacauacacucacacacaucacaguaucag

SEQ ID NO: 71011 - RNA, 64 nt, Human
ccacaaacacaaauuauauauauacauauccacacacauacauuacauauaucuguguauauaa

SEQ ID NO: 71012 - RNA, 64 nt, Human
cugaguguguucacuguuggcugcauuggacaaucacauacaaacccuggcauguccuuccaga

SEQ ID NO: 71013 - RNA, 64 nt, Human
ugcacacaugcacccccucacucucacacuugcacacauacacacacacacacacgaaaugguu

SEQ ID NO: 71014 - RNA, 64 nt, Human
uuauugugguaggccuuuuaacauuuuguucuuacacauacaguuuuaugcucuuuuuuacuca

SEQ ID NO: 71015 - RNA, 64 nt, Human
uacauauauacauauauauguauauauauacacacacauacauauguguguguauaguauauau

SEQ ID NO: 71016 - RNA, 64 nt, Human
gugaauucugacugcaauaggcaccagugcccaacacauacagccccaccaucauccccuucuc

SEQ ID NO: 71017 - RNA, 64 nt, Human
gugugacaccaaaaccuucuggucagccacagaacacauacagaaaacagacaugacagaacug

SEQ ID NO: 71018 - RNA, 64 nt, Human
ccucuggugcugcaggccucucaggcuuacaucgcacauacagccaggacuguagcuuuaaaaa

SEQ ID NO: 71019 - RNA, 64 nt, Human
uaaauguguguacauauacauauauacauaucuacacauacauauauacacauauaugugugua

SEQ ID NO: 71020 - RNA, 64 nt, Human
aauaccuaacaggcaggcucuggaaguuggaaaucacauacacacacacacacacacagacaca

SEQ ID NO: 71021 - RNA, 64 nt, Human
uucgagugaagaauuaaugcaguaaguaugacaacacauacacacuugccucuccccaucucca

SEQ ID NO: 71022 - RNA, 64 nt, Human
gcuuuuucuuucuagauguauuccccaacaugcucacauacacagaucuuucccuuuccuuacu

SEQ ID NO: 71023 - RNA, 64 nt, Human
gaucauuuguuuuuaaaacuacuuagguaugauucacauacaaaaagcugcacauauuuaaugu

SEQ ID NO: 71024 - RNA, 64 nt, Human
caaggccaagcaggcccaucucacaacccugaagcacauacaagcacccugguggaagaagcuu

SEQ ID NO: 71025 - RNA, 64 nt, Human
ugcuuugcuuuuuaauugaggacagccugguuuucacauacacucaaacaaucaugagucagac

SEQ ID NO: 71026 - RNA, 64 nt, Human
ucuggucucaauggcuucgggaaacacacauauacacauacaccaugcccuugaacucaaagca

SEQ ID NO: 71027 - RNA, 64 nt, Human
uuuaugugcacacucacacaugcacacacacacacacauacacacucuucucuaaccaguggaa

SEQ ID NO: 71028 - RNA, 64 nt, Human
ugcuuuuggaaguuaaaauuuaaauggcuuuugccacauacauagaucuucaugaugugugagu

SEQ ID NO: 71029 - RNA, 64 nt, Human
aaaggagcaaaaaagaacucaguguaagagaaggcacauacauaguuaagaauacuaaaguauu

SEQ ID NO: 71030 - RNA, 64 nt, Human
ugugugauaaucuguuuuuacugguauuaauaaacacauacaaugaagaaaacagauaacaaau

SEQ ID NO: 71031 - RNA, 64 nt, Human
uuguuugggaaguaauuuuguuugaaaaugcucucacauacaggaauuagggccuagauuguaa

SEQ ID NO: 71032 - RNA, 64 nt, Human
uguaaaaauuguauuguauauaaugugauuuuuacacauacauacacacacaaauacacaaucu

SEQ ID NO: 71033 - RNA, 64 nt, Human
uuuccuugcuuucuugacauuuccaugacuguuucacauacaaacuauugggugagguuuuuca

SEQ ID NO: 71034 - RNA, 64 nt, Human
ccgcuuccuugcaccccgaaacccugcacaaagacacauacauucaccgcccccccgccccccc

SEQ ID NO: 71035 - RNA, 64 nt, Human
ucuguguguaugucagcauguuuguucacauaugcacauacacauacucauaaccccuauaugc

SEQ ID NO: 71036 - RNA, 64 nt, Human
aaaucauucucauaaauucaguguguacucagaacacauacacaacaacauagggaguuguaug

SEQ ID NO: 71037 - RNA, 64 nt, Human
uuuuuaaagguauucauggugacucaggaauacacacauacacacacacacacacacacacaca

SEQ ID NO: 71038 - RNA, 64 nt, Human
cacauacacacacacacacacacacacacacacacacauacacacauauaauuugaaagaggug

SEQ ID NO: 71039 - RNA, 64 nt, Human
uauaaaaucccacaguccuugggaaguuggggaccacauacacuguugggauguacauugauac

SEQ ID NO: 71040 - RNA, 64 nt, Human
aacauauauacauguagauguacauauacauguacacauacacauaaauauuauugcaauuaag

SEQ ID NO: 71041 - RNA, 64 nt, Human
uguguauauguguauauauauacacauauauauacacauacacaaauauaugcauauuucaaau

SEQ ID NO: 71042 - RNA, 64 nt, Human
cucuaauuuuuggugacuuuucuacacacacacacacauacagucacauagauauucuuauccu

SEQ ID NO: 71043 - RNA, 64 nt, Human
auucuuucaguggcuaccuacauacaauuccaaacacauacaggaagguagaaauaucugaaaa

SEQ ID NO: 71044 - RNA, 64 nt, Human
ggagaugugcaauaaauauuuguguuauuaacuacacauacagcacucuauaggagauauucca

SEQ ID NO: 71045 - RNA, 64 nt, Human
aaucaacagaaucacucacacauacaaguacacucacauacauaaacuaauuauuucucuggau

SEQ ID NO: 71046 - RNA, 64 nt, Human
uugccucuaaugcagaaaucaacagaaucacucacacauacaaguacacucacauacauaaacu

SEQ ID NO: 71047 - RNA, 64 nt, Human
uaagcaauauauuuuccuaguagauauauauauacacauacauauauacacauauacaaaugua

SEQ ID NO: 71048 - RNA, 64 nt, Human
cuuucacuacaaguauuucuaacaguugcaaggacacauacacaaacaaauguuugacuggaua

SEQ ID NO: 71049 - RNA, 64 nt, Human
uucuuuuuuguuguuguggguuuuuucacauaaacacauacauugccaauuuuccagggcucaa

SEQ ID NO: 71050 - RNA, 64 nt, Human
auugccuuauucauacuagcaugcucaugaccaacacauacacgucauagaagaaaauaguggu

SEQ ID NO: 71051 - RNA, 64 nt, Human
ugaaauaagguauaaggaucuuuuguaaaugagacacauacaaaaaaaaucuuuaaugguuaau

SEQ ID NO: 71052 - RNA, 64 nt, Human
auuguuauuuaaaucaaaccagauguaaaacacucacauacaaguucauacuuuaaaagaggaa

SEQ ID NO: 71053 - RNA, 64 nt, Human
cagaucauuacucuuacacacacacacacacacacacauacacacacacacacuccuucucuaa

SEQ ID NO: 71054 - RNA, 64 nt, Human
caacuguaacuguacuuuagcuauuguuugccugcacauacauguuguaauaugcacagugauu

SEQ ID NO: 71055 - RNA, 64 nt, Human
auaucuggaguacaaggguagaccucuggcuuaccacauacacuaugcuaaagucaucagccac

SEQ ID NO: 71056 - RNA, 64 nt, Human
guuucuggacccuuauaaaauccugugcaauagacacauacaugucacauuuagcugugcucag

SEQ ID NO: 71057 - RNA, 64 nt, Human
ucuuuuuuucuuugguuuaauuuaaagccacaaccacauacaacacaaagagaaaaagaaaugc

SEQ ID NO: 71058 - RNA, 64 nt, Human
cccagccuugagcgcacgcgcgcacacacacacacacauacacacacgcauuaauuuuuguacu

SEQ ID NO: 71059 - RNA, 64 nt, Human
agucuaauuugguuaauccuugugacauuaaaaacacauacacuuuuuaaaaaauuacucuuua

SEQ ID NO: 71060 - RNA, 64 nt, Human
uuuuccuguaguuaaaguuuuauugucacauagccacauacauucauuuacauguuuucugauu

SEQ ID NO: 71061 - RNA, 64 nt, Human
gugugacccacuggaugggagggcaaugagugugcacauacaaauggggcagugugcaugcaac

SEQ ID NO: 71062 - RNA, 64 nt, Human
uuuaaaauacacuaacuaguuccuuagcuaccuucacauacauucuauaggccuucuuaaauua

SEQ ID NO: 71063 - RNA, 64 nt, Human
auuuccauugugaguucugacaagaaugaaauuccacauacaacauaacuguaaauuguuggua

SEQ ID NO: 71064 - RNA, 64 nt, Human
agaauccauaauggacuagaauauaaauuacaaacacauacacacaucuucacuuaaaguuguu

SEQ ID NO: 71065 - RNA, 64 nt, Human
uauaaaauguuugccauguauacaccuguaugugcacauacacacauuacacacacacacagaa

SEQ ID NO: 71066 - RNA, 64 nt, Human
cuguaucugaaggacgguucuggggcauaggaaacacauacacuuccauaaauagcuuuaacgu

SEQ ID NO: 71067 - RNA, 64 nt, Human
guaacugagcacaaaguacuuuagggagcagccacacauacaggaagcucuuagaaaagaacuu

SEQ ID NO: 71068 - RNA, 64 nt, Human
uguacuguauauguguauguuauacagacauauacacauacauacauugacccacaggacauug

SEQ ID NO: 71069 - RNA, 64 nt, Human
gguuaaaaaauagaaagguguauguguauagauucacauacacauauguauauacaggcugacu

SEQ ID NO: 71070 - RNA, 64 nt, Human
cacacacgaacacacacacacacacacacacgcacacauacacacuuauuuccuauucccauug

SEQ ID NO: 71071 - RNA, 64 nt, Human
ccccacccccacacacacacacacaugcacacaacacauacacacacacgcacagaggugaaca

SEQ ID NO: 71072 - RNA, 64 nt, Human
cucuugucucucccucugaagauggacucggccccacauacacauuuuuguguuacagucauug

SEQ ID NO: 71073 - RNA, 64 nt, Human
guguaucaauauauauugauauguauuacacuuacacauacaaacacauauaagagggggugaa

SEQ ID NO: 71074 - RNA, 64 nt, Human
ugucuuucucucuggccugcugcucucucaacaucacauacagcuucagcugccuggaggccag

SEQ ID NO: 71075 - RNA, 64 nt, Human
uccuuaaaggcaccaucuaauagcggguuacuuucacauacagcccucccccagcaguugaaug

SEQ ID NO: 71076 - RNA, 64 nt, Human
agaggccucaguccccaagacugccaccagucuacacauacagcagcccccuggacagaaucag

SEQ ID NO: 71077 - RNA, 64 nt, Human
aguuuguccauugugacaguuuguuuaauaaaaccacauacacacuuuauuuaagauuaaaauc

SEQ ID NO: 71078 - RNA, 64 nt, Human
gauucugauugugaauccccucaacucuagcagacacauacacaccccugaaauggggcugcag

SEQ ID NO: 71079 - RNA, 64 nt, Human
gaacauguuaaguuuuccagacuacuacccuucccacauacaccugagccacugugguggguca

SEQ ID NO: 71080 - RNA, 64 nt, Human
guauggacaguuccccuucagucccaucccccuacacauacacccagccggggccaaauuuaua

SEQ ID NO: 71081 - RNA, 64 nt, Human
uacacacacacacacacacacacacacacacacacacauacauacacacacacauauauauaca

SEQ ID NO: 71082 - RNA, 64 nt, Human
cacacacacacacacacacacacacacacacacacacauacauccugcuuucccuccccaaacc

SEQ ID NO: 71083 - RNA, 64 nt, Human
gagaagacuccuuggauauuucccaagaaccccccacauacaccccucacaagccaccccuccu

SEQ ID NO: 71084 - RNA, 64 nt, Human
cuacaugauaguauuuuuaugcacucuucucccacacauacacacacgugcauguaucugagcu

SEQ ID NO: 71085 - RNA, 64 nt, Human
cagaucugaaguagacgauaggaauguggaagaacacauacauagugcuuaagaaauacauuua

SEQ ID NO: 71086 - RNA, 64 nt, Human
gauuggcuuuggaagaauuauauuagguagaauacacauacaaucaaaauuuuaaaaaaaaaag

SEQ ID NO: 71087 - RNA, 64 nt, Human
ccacaauucaguaugggauaggcuuuuuaaaaagcacauacagaccaggcgugguggcucaugc

SEQ ID NO: 71088 - RNA, 64 nt, Human
aaugcaagagagguugaaagaggauucaguaguacacauacaacuaauuuauuugaacuauaug

SEQ ID NO: 71089 - RNA, 64 nt, Human
ccuuaugucaucauuguucaaaauuggagauguacacauacauacccuauaccaagagggccga

SEQ ID NO: 71090 - RNA, 64 nt, Human
ugugaaaauggagagcuggcuucagaaaauuaaucacauacaauguauguguccucuuuugacc

SEQ ID NO: 71091 - RNA, 64 nt, Human
gacuugggaaauaacauucaagcuucuggguaaacacauacaaacaguggcaaagaccaaguac

SEQ ID NO: 71092 - RNA, 64 nt, Human
gugauuaaacaccucuaucucccuugggaauaagcacauacaggcuuaagcucuaagauagaua

SEQ ID NO: 71093 - RNA, 64 nt, Human
uguugugugugugcaugccuugggcacaaacaagcacauacacuauaucccauaugggagaagu

SEQ ID NO: 71094 - RNA, 64 nt, Human
guuacauauuuagguauacacacacacacacacacacauacacacacacggaccaaaauacuua

SEQ ID NO: 71095 - RNA, 64 nt, Human
guuuguauagcacuuucucaagagcugucagucccacauacagaaucauuucuuuuacaaaaug

SEQ ID NO: 71096 - RNA, 64 nt, Human
cauauauauauauauauacauauauauacauacacacauacauauaauuuuuuuuuuuuuugag

SEQ ID NO: 71097 - RNA, 64 nt, Human
cauauauacacacacacacacacacacacacacacacauacauacauacauauauauauauaua

SEQ ID NO: 71098 - RNA, 64 nt, Human
uacaguuuugucacuuuucaaguacuuucugacucacauacaguagaucacuuuuuacucugug

SEQ ID NO: 71099 - RNA, 64 nt, Human
cacguaucuauauguauauauaaaugcauuauuacacauacauuucucucaccccuuaaugcau

SEQ ID NO: 71100 - RNA, 64 nt, Human
aacaugugcacaggcacgcacaugugugcacgcacacauacaaucuggguuaucuuugugcuau

SEQ ID NO: 71101 - RNA, 64 nt, Human
guaaacguauacauauguguauauaugauacauacacauacacacacacgagagacagaaggaa

SEQ ID NO: 71102 - RNA, 64 nt, Human
gguggcaugcagauacauuggauaguguuaacaucacauacauuugucauuuuuaaggaaguuu

SEQ ID NO: 71103 - RNA, 64 nt, Human
uaaagcugugugaugguauuauaacuguuauauacacauacauauaauuuuguuuuccuuuuua

SEQ ID NO: 71104 - RNA, 64 nt, Human
cuuuacuguaaaggcaagccagcauguguguccacacauacauaggauggcuggcucugcaccu

SEQ ID NO: 71105 - RNA, 64 nt, Human
auauuuucagccuacaguuauguucagucacacacacauacaaaauguuccuuuugcuuuuaaa

SEQ ID NO: 71106 - RNA, 64 nt, Human
acagcacccucaucaauauaaaauaugacuucuucacauacagauucucuguaguguuugcaug

SEQ ID NO: 71107 - RNA, 64 nt, Human
ucauuccuuuucccacagcagcauauuuuagaggcacauacaaaaccuacauucucuaguuggg

SEQ ID NO: 71108 - RNA, 64 nt, Human
gcaaacuuuugaaucuuucuuuuauugcuauuuacacauacauacacacauacaaaaccuuuaa

SEQ ID NO: 71109 - RNA, 64 nt, Human
aucuuucuuuuauugcuauuuacacauacauacacacauacaaaaccuuuaaauuuugggaucu

SEQ ID NO: 71110 - RNA, 60 nt, Human
ccaggaggggaacaccaugaagacuaacgacacauacaugaaauuuagcugguuaacggu

SEQ ID NO: 71111 - RNA, 64 nt, Human
ccuuagacugauuuuggaccuuugagacuuuuaccacauacagauggaugaaacuacuuacuga

SEQ ID NO: 71112 - RNA, 64 nt, Human
gaaauuucacaaaacugccuggcacacaagcacacacauacauagacacauuuuaagugauaau

SEQ ID NO: 71113 - RNA, 64 nt, Human
ucagcacauugggucuuucugccacaggcccuugcacauacaugcuuuucccucuguacaugug

SEQ ID NO: 71114 - RNA, 64 nt, Human
uuucaaacauuauuucagagaacacagggcaagacacauacagugccuucagauauuaagcauu

SEQ ID NO: 71115 - RNA, 64 nt, Human
gacaauuacacauuguagacagguagcaaaauaucacauacacccccaaaauauguacaaauau

SEQ ID NO: 71116 - RNA, 64 nt, Human
ucaccugguagcaaaugacacaugcacgcacacacacauacacgcacaagcgccagugcgcacg

SEQ ID NO: 71117 - RNA, 64 nt, Human
cuggagucucugaacucuuaauaggaugcagccucacauacauaaugucacccauuuuauguug

SEQ ID NO: 71118 - RNA, 64 nt, Human
agugacugugccauaggaaagcagccccuccucacacauacaugugcacaugcacacacaugca

SEQ ID NO: 71119 - RNA, 64 nt, Human
ugcacaugcacacacaugcaugcacacacaugcacacauacacgcacaugcacacauacacaug

SEQ ID NO: 71120 - RNA, 64 nt, Human
caugcacacacaugcacacauacacgcacaugcacacauacacaugcaugcacacauacacagg

SEQ ID NO: 71121 - RNA, 64 nt, Human
cauacacgcacaugcacacauacacaugcaugcacacauacacaggcauacaugcaugcacaca

SEQ ID NO: 71122 - RNA, 64 nt, Human
caugcacacacacaugcacgcacacacacaugcacacauacacgugcacacauacacaggcaca

SEQ ID NO: 71123 - RNA, 64 nt, Human
ugcacgcacacacacaugcacacauacacgugcacacauacacaggcacacaugcaugcacaca

SEQ ID NO: 71124 - RNA, 64 nt, Human
cacgugcacacauacacaggcacacaugcaugcacacauacacaugcacacacacaugcacaca

SEQ ID NO: 71125 - RNA, 64 nt, Human
cauauccaugcacacaaacacauauauacacaugcacauacacagauuuuucugcuggccaggu

SEQ ID NO: 71126 - RNA, 64 nt, Human
ugcagaacuguuuuuuuuuuuuuuuuaucuuaaacacauacacaccuccaguuuuugcucuuuu

SEQ ID NO: 71127 - RNA, 64 nt, Human
aaacccuccauguucauuuccagacuuggucaggcacauacauaguaaauuauaaucaaucaug

SEQ ID NO: 71128 - RNA, 64 nt, Human
cuggauccccuuuuaaauuacacacacucucacacacauacauguauguuuauagaugcugcug

SEQ ID NO: 71129 - RNA, 64 nt, Human
gaaauugcauguuuaucauauauccuuaaguggacacauacagugccauguugaugugccucuc

SEQ ID NO: 71130 - RNA, 64 nt, Human
guuguauguaugugaaugugugugaguguguauucacauacacauauauacuggaaccuauagu

SEQ ID NO: 71131 - RNA, 64 nt, Human
uuacuguuuucaugcuuauacauauauuuucaaucacauacaaguacauagaauuucacauuuu

SEQ ID NO: 71132 - RNA, 64 nt, Human
agacaaugauuaacagggcccuauauguucuuaccacauacagaggaugcauuuauuuuugcuc

SEQ ID NO: 71133 - RNA, 64 nt, Human
aaauggaugguuuuggacauacgagucuucuccgcacauacaugucuaaaguugaguuuuauac

SEQ ID NO: 71134 - RNA, 64 nt, Human
aauuuaagguaagauaguaauagcuucaaaagaacacauacagaguaauccugagaguaagcaa

SEQ ID NO: 71135 - RNA, 64 nt, Human
caacaugacuuguuuguggggcuugugggaggggcacauacaucggccccaggauucuaacauc

SEQ ID NO: 71136 - RNA, 64 nt, Human
auaucuauauauguaucuacaauacauauaucuacacauacagaaagaagcaguucucacaaug

SEQ ID NO: 71137 - RNA, 64 nt, Human
uguuggcgugugggagacaugugugcucgugccgcacauacacauccuggccgugcacggcucu

SEQ ID NO: 71138 - RNA, 64 nt, Human
agcagaucaauacucugcagacucgaaaaaacaucacauacauucuuggaacuucccagugguu

SEQ ID NO: 71139 - RNA, 64 nt, Human
aauuucuguaccuuuauuguuaaacaccaaguuucacauacaagagguuucuuucauugucaaa

SEQ ID NO: 71140 - RNA, 64 nt, Human
gacaaacauaugauaucaugguguaaaaaacacacacauacacaaauauuuguaacauauugug

SEQ ID NO: 71141 - RNA, 64 nt, Human
aaaaucuucucugacaggaccgaggugaugaguucacauacacuggaagcggugguaaaaaucu

SEQ ID NO: 71142 - RNA, 64 nt, Human
aguuuuuccagcauacaauacaugcacgugcacacacauacacacacauccauuaauauacuuc

SEQ ID NO: 71143 - RNA, 64 nt, Human
uacccaucuccaugccacaccuuauccaguuagacacauacauaccaaucauuagaagaacaag

SEQ ID NO: 71144 - RNA, 64 nt, Human
uucucucacuuaguacugaggaauuuucaugugccacauacaaugcuagguuacaguggagaag

SEQ ID NO: 71145 - RNA, 64 nt, Human
gagcaggcuguucagaccgacguugccaucaaaacacauacacccagaaagaaacaacagaaac

SEQ ID NO: 71146 - RNA, 64 nt, Human
agaguaccccuuuaaacacacacacacacacaugcacauacacacacacacacacacacacaca

SEQ ID NO: 71147 - RNA, 64 nt, Human
aaaaauacacauaauacaaacauacaugcaugcacacauacauacauauguauacacacacaua

SEQ ID NO: 71148 - RNA, 64 nt, Human
uccauaauucauuauuaagcucugaaauucaggacacauacauuuauagagugugaggcugugc

SEQ ID NO: 71149 - RNA, 64 nt, Human
ccuggccuggagaaggccuuuuacacacacacaacacauacacacacacacacacacacacaua

SEQ ID NO: 71150 - RNA, 64 nt, Human
caucuccauuuucagacugagggguggcaggcuucacauacagugggaauggaguaauuacagg

SEQ ID NO: 71151 - RNA, 64 nt, Human
uacaagaagaaauuuaaacucuacguuugguuuucacauacagcagcucuauugaauaacaugc

SEQ ID NO: 71152 - RNA, 64 nt, Human
cggucagcccuucccuaauuacaccuauccccuacacauacaugcacauagacacacacaugaa

SEQ ID NO: 71153 - RNA, 64 nt, Human
ccaccagacuccuaacauagaaaacuugaauugucacauacauuuuacaguuuggacuuuuaag

SEQ ID NO: 71154 - RNA, 64 nt, Human
agcuaugaguauacaaaagguaaauccacuuaaucacauacagaagagcaacaacaaacugcuu

SEQ ID NO: 71155 - RNA, 64 nt, Human
acgucuuaagagcagauaagugacuaagacugaacacauacauuuuguggaguauauaguuuuc

SEQ ID NO: 71156 - RNA, 64 nt, Human
uuaggauucauaucuaagauagaguuaugcauugcacauacacaaauaaacuuuuauuagauag

SEQ ID NO: 71157 - RNA, 64 nt, Human
agaccuugucuugaaaaaaaaaaaaacaaaaaaccacauacaggaaaaaagagagggauggagu

SEQ ID NO: 71158 - RNA, 64 nt, Human
cgcccuuccggccacagaaacacaccauuacacacacauacacagaaagacacacacagacaca

SEQ ID NO: 71159 - RNA, 64 nt, Human
gcuggagguccaauugccagagccucccacacugcacauacaaaggucugagcccagggcagcu

SEQ ID NO: 71160 - RNA, 64 nt, Human
gcugcucuccaagacagggcccuggaaaggcccacacauacagcccagggcugcccagggcugu

SEQ ID NO: 71161 - RNA, 64 nt, Human
agaagaccagaugugcauagaagccagucucugucacauacaccgcagguggucaccgaguuau

SEQ ID NO: 71162 - RNA, 64 nt, Human
auuuaauuuaggaguauaugugugucuauacacacacauacauaaauauaccacauauacaccu

SEQ ID NO: 71163 - RNA, 64 nt, Human
uccuccacauacugcagccucccuccaugcaucccacauacaagcacucccccacuccccagcg

SEQ ID NO: 71164 - RNA, 64 nt, Human
uacauauuuuuuucaaguacaccaucaccuaauucacauacagcauacgcacacaucuggaaaa

SEQ ID NO: 71165 - RNA, 64 nt, Human
ucugccauuguagugcaaaagcagccauagacaacacauacaugaacgaacguggcuguauucc

SEQ ID NO: 71166 - RNA, 64 nt, Human
uccaggauggaaagaaaugcagaacuaucauagucacauacauauaagagggaugguguuuugu

SEQ ID NO: 71167 - RNA, 64 nt, Human
aaucaccaacacucuccgcuucccccagcacacacacauacaacacagaucauuucccaguuag

SEQ ID NO: 71168 - RNA, 55 nt, Human
auggcaggcccucagccugagccuucacauacaucaugacgaggauggcagcucu

SEQ ID NO: 71169 - RNA, 64 nt, Human
aaauugccuguuucagccagaagacuggugaaaacacauacaucagacuauguugugagccagg

SEQ ID NO: 71170 - RNA, 64 nt, Human
uggauagagccaguucaaccucccccaauccauacacauacauaccuaggucauccuaucaccc

SEQ ID NO: 71171 - RNA, 64 nt, Human
ugcucuccaagacagggcccuggaaagaggcccacacauacagcccaguugcugcccagggcug

SEQ ID NO: 71172 - RNA, 64 nt, Human
aaaucucaagcaaacagcuucacaaauucucacacacauacauaccuauauacucacuuucuag

SEQ ID NO: 71173 - RNA, 64 nt, Human
auugcuucucuguaaauuaaaauguuacagcacacacauacacacacagagagcauuucaaggc

SEQ ID NO: 71174 - RNA, 64 nt, Human
acaacaacacaaaccacacacacucgcacacacacacauacacagagacucuuucauuuuucuu

SEQ ID NO: 71175 - RNA, 64 nt, Human
augugcggaacccugaggccgaggagaugaaggccacauacaucaaccucaagccagccagaaa

SEQ ID NO: 71176 - RNA, 64 nt, Human
acugcuguacccagaugccuacaaccaucccugccacauacaggugcucaauaaacacuuguag

SEQ ID NO: 71177 - RNA, 64 nt, Human
caaccacacauagagguuuccuucucacuucagacacauacaucacuuucacaccacuugggga

SEQ ID NO: 71178 - RNA, 64 nt, Human
uacugcuuaauccaaauguguaccauuggugagacacauacaaugcucugaauacacuacgaau

SEQ ID NO: 71179 - RNA, 64 nt, Human
acagaaaaaaagaaauauagugagcccuaaaggacacauacauugaauaaauaauuggaacaug

SEQ ID NO: 71180 - RNA, 64 nt, Human
uuucuuugcaaaacaaggaaaucacacauaugcacacauacauauuuaugguuacuaugauugu

SEQ ID NO: 71181 - RNA, 64 nt, Human
cacaugucacuguagccucuugguguagcaagcucacauacaaaauacuuuuguauaugcauaa

SEQ ID NO: 71182 - RNA, 64 nt, Human
agggccugcucuuuccauuguggaucacagcacacacauacauacacccuccaccuccccaucc

SEQ ID NO: 71183 - RNA, 64 nt, Human
guauuaaucacaucacuuccauggcauggauguucacauacagacucuuaacccugguuuacca

SEQ ID NO: 71184 - RNA, 64 nt, Human
caaaguugcacuuucacugggaagaugagauuugcacauacaaaaggcuagagcgauggucuau

SEQ ID NO: 71185 - RNA, 64 nt, Human
gccaaccagagacuggguuccaaucucaccccaccacauacagagcccucaucugugaaaugag

SEQ ID NO: 71186 - RNA, 64 nt, Human
gugagccgccgugcccagccauugcauuuuuauucacauacacauuguuaauguggaacaauuu

SEQ ID NO: 71187 - RNA, 64 nt, Human
uucuguauuuaucugcacuuuguguauauauacacacauacauaugccaacauguaaauaaccu

SEQ ID NO: 71188 - RNA, 64 nt, Human
aacaguauaucucagugugugagauauauaaauacacauacaccccaugugcuuuuuuguuggu

SEQ ID NO: 71189 - RNA, 64 nt, Human
cucgugaugcucccucccucuccggagugacaggcacauacaugagaacaggccaucucagccc

SEQ ID NO: 71190 - RNA, 64 nt, Human
ggggccgugauugacccuaaaaauugcagaccagcacauacacuggacacugcaggcaaggugu

SEQ ID NO: 71191 - RNA, 64 nt, Human
cucucuccuuccucauaagacaugcacacuaauacacauacacaccaaaaaauuacacauuuua

SEQ ID NO: 71192 - RNA, 64 nt, Human
gugaauuuguuaauuuuguuguuuuucugugaaacacauacauuggauaugggagguaaaggag

SEQ ID NO: 71193 - RNA, 64 nt, Human
guccggucuugcccacagggccugugcugcgacgcacauacauacguguugugucugucaauaa

SEQ ID NO: 71194 - RNA, 64 nt, Human
uuuucuuucuuuuuuuuuuauuaugguuagcugucacauacaacuuuuuuuuuuuuugagaugg

SEQ ID NO: 71195 - RNA, 64 nt, Human
cacacauacacaccccugaacacacacacagacacacauacacccaugaugugagcaaacacac

SEQ ID NO: 71196 - RNA, 64 nt, Human
cacccugaaaacacacacagacacacaacacacacacauacacaccccugaacacacacacaga

SEQ ID NO: 71197 - RNA, 64 nt, Human
uugccacuuagaaaaauucagaaaagcacacacucacauacacacacacaaaaucacucucuua

SEQ ID NO: 71198 - RNA, 64 nt, Human
gauccaaaauauggauaugauuggauguauguaacacauacauggaguauggaggaaauuuucu

SEQ ID NO: 71199 - RNA, 64 nt, Human
ccaauaaauagauuccauguuuucuuguuuaucacacauacaaguaucuuucccuauauauuug

SEQ ID NO: 71200 - RNA, 64 nt, Human
cuuuaauugugauuuacaacccuaauaucccaggcacauacaaaacuuaugaauuacccagcac

SEQ ID NO: 71201 - RNA, 64 nt, Human
ccugucuucaucucugugucccaucucuacaacccacauacagacacacacacucucucucucu

SEQ ID NO: 71202 - RNA, 64 nt, Human
agaggagacuuuuuuuuuucauguuaugagcuagcacauacacccccuuguaguauaauuucaa

SEQ ID NO: 71203 - RNA, 64 nt, Human
uauauauauauauauauauauauacacacacacacacauacacaaauauuccaggauacaaaaa

SEQ ID NO: 71204 - RNA, 64 nt, Human
acauguaaaacauauucacacccaugcacgcacacacauacacacugaaggccacgauugcugg

SEQ ID NO: 71205 - RNA, 64 nt, Human
auauucauucucucuucuccaucacccauacccacacauacaucuaguauguuuaggguucugu

SEQ ID NO: 71206 - RNA, 64 nt, Human
aggccgguagggcaggggcugcuaguggcugucucacauacaccaguaauccuguuaaagggcu

SEQ ID NO: 71207 - RNA, 64 nt, Human
cuacucuuaaccucccaaaaagcaguaucuaagucacauacaugaugucuugggcauuuucuca

SEQ ID NO: 71208 - RNA, 64 nt, Human
cguucucuuuccccagcgcaaccgaaauaaaugacacauacaaaugugauuuuuuuccuccuuu

SEQ ID NO: 71209 - RNA, 64 nt, Human
ugcagauuuuguacaaaaaaaaaaaagacacacacacauacaugauaaugauucccagcccagg

SEQ ID NO: 71210 - RNA, 64 nt, Human
auccugcaccaccucacuguuccccaugcgcacacacauacacacaccccaaaacacauacauu

SEQ ID NO: 71211 - RNA, 64 nt, Human
uccccaugcgcacacacauacacacaccccaaaacacauacauugaaagugccucaucugaaua

SEQ ID NO: 71212 - RNA, 64 nt, Human
uguguguauacauauauacacauauauacacacacacauacauauacauguguauauauauacc

SEQ ID NO: 71213 - RNA, 64 nt, Human
uguggacuuggaggaauuauuagcuguggcacaacacauacagcauugguuccucuagaucugg

SEQ ID NO: 71214 - RNA, 64 nt, Human
guucacguccuauaacgguuaaaaaacacacacacacauacacaaaccguuucuaugagagauu

SEQ ID NO: 71215 - RNA, 64 nt, Human
uugcuuuaaaacuacgacucagcauacauuuucccacauacauuuuuacauuguaccuuaggac

SEQ ID NO: 71216 - RNA, 64 nt, Human
ccugcugcucuucucacuguguacacaccaugcccacauacaacauaccuaucagaaaugguuu

SEQ ID NO: 71217 - RNA, 64 nt, Human
guacauacaugugauuacuucuguuuuuuacacccacauacaguacaaaagauuauuaaaaaua

SEQ ID NO: 71218 - RNA, 64 nt, Human
ugggauugggcuaaggacuguggucuuaucuguccacauacagccaaaaugccuauccagaaau

SEQ ID NO: 71219 - RNA, 64 nt, Human
uaaguuguuccauggguguacacguagacagacacacauacacccaaauuauugcauuaagaau

SEQ ID NO: 71220 - RNA, 64 nt, Human
cagagaauuucauauauauauacauauauauauacacauacauauauauauauauauauguaug

SEQ ID NO: 71221 - RNA, 64 nt, Human
aaagagaauggauuuauagcuacccuuacccucacacauacacuugaaaaaacuuucagccuag

SEQ ID NO: 71222 - RNA, 64 nt, Human
uaucucugauggcacuuugagggaaaagaauguccacauacaguuuuugaaagaucuucucucc

SEQ ID NO: 71223 - RNA, 64 nt, Human
gccugcaccugcagcgcgcacacgcacgcacacacacauacagagcucucugagggugaugggg

SEQ ID NO: 71224 - RNA, 64 nt, Human
uucgugccgcaguaacagacacaguauuuaauugcacauacagauguuugcuggguauauucac

SEQ ID NO: 71225 - RNA, 64 nt, Human
acaaaacaugaacacagugccauaugaauaauuucacauacagaaccuuuuuuucucugaaguc

SEQ ID NO: 71226 - RNA, 64 nt, Human
aauucaucuugaaaagagcuuuuuucccuccuaccacauacaccauucuuagggagcaaugagg

SEQ ID NO: 71227 - RNA, 64 nt, Human
aaacuucuugcugaaugguacucagaugugcauucacauacagauguguuuugaagugggugua

SEQ ID NO: 71228 - RNA, 64 nt, Human
guucgguuguguugucaacaacuguugaguugaucacauacauccaaaaguauaguuucauugu

SEQ ID NO: 71229 - RNA, 64 nt, Human
gugccuguugcacaccugcacacacgcccuggcacacauacacacaugcgugcaggcuugugca

SEQ ID NO: 71230 - RNA, 64 nt, Human
guaauucuuacaaauuuaaacuauuguacagauccacauacauguuguuaaguaccuaauguuu

SEQ ID NO: 71231 - RNA, 64 nt, Human
caggaaacuauaaauaccagugcuaucacagccacacauacacacacacagacauaaaauaacc

SEQ ID NO: 71232 - RNA, 64 nt, Human
accuuugaacuauauguauguguauaaggguauacacauacauauauggcauauaacaagugua

SEQ ID NO: 71233 - RNA, 64 nt, Human
uauauauauauacacacacacacacacauauguacacauacauauauauacauauauauguaua

SEQ ID NO: 71234 - RNA, 64 nt, Human
aaacuuuaauacaaguacauacauauuauauauacacauacauauauauacuauauauggauga

SEQ ID NO: 71235 - RNA, 64 nt, Human
cuucuguuucuucagcacauugacccauagcacacacauacacaccaccaccaacaacgcuugu

SEQ ID NO: 71236 - RNA, 64 nt, Human
aaaccaauaccuggugaaucuauggacagucauacacauacaucaggggaaaauguguguguac

SEQ ID NO: 71237 - RNA, 64 nt, Human
aacuuuuaauguacaucacacacacacucacacucacauacacacacacacacacacucugacu

SEQ ID NO: 71238 - RNA, 64 nt, Human
aggauuacaggcgugagacagacacacauacacacacauacacacacacagagucuuuauugca

SEQ ID NO: 71239 - RNA, 64 nt, Human
aaugagugcuaggauuacaggcgugagacagacacacauacacacacauacacacacacagagu

SEQ ID NO: 71240 - RNA, 64 nt, Human
ccuguaggucacggcacucccaaaagcacacaagcacauacagacauaugcauccccacacacg

SEQ ID NO: 71241 - RNA, 64 nt, Human
gggacaauaugugccaaucaauagcaccccuacucacauacacacacaccuagccagcugucaa

SEQ ID NO: 71242 - RNA, 64 nt, Human
caauucauauuguaguguagauuuuuuuaaaguucacauacacuuuuuuguaaaaugagaauaa

SEQ ID NO: 71243 - RNA, 64 nt, Human
aaagaaguuacuuuguaauuuuuggggaaaaaagcacauacauuaaaacuagguaauguuuugu

SEQ ID NO: 71244 - RNA, 64 nt, Human
aaauguaaacuugacauuuuagggucuucaguuacacauacaccuguuauaagguguuuaauau

SEQ ID NO: 71245 - RNA, 64 nt, Human
gugucuccaugaggguuuuccuguugaggggcaccacauacaauagugugaaguagguaugagg

SEQ ID NO: 71246 - RNA, 64 nt, Human
ugaauucccagcuccccauccccauaaaugcauacacauacaugcacacacacacguuauccca

SEQ ID NO: 71247 - RNA, 64 nt, Human
ccuugcagauguagcccuugcccaucuucacagacacauacacccaucuuggcacccugauuau

SEQ ID NO: 71248 - RNA, 64 nt, Human
aggauagacagauauacacaccacacacacacaccacauacaccacacacacacguucccaucc

SEQ ID NO: 71249 - RNA, 64 nt, Human
aaaguaaggggugagcaguuaaugguauucauuccacauacaauaucuguguaaaacgauuucc

SEQ ID NO: 71250 - RNA, 64 nt, Human
gccaaggugccaccacccugcccccccuaagagacacauacagagugggccccgggcuggagaa

SEQ ID NO: 71251 - RNA, 64 nt, Human
ucccaccuuucagcauuuauagaacaugcugccccacauacaaagucaagaccacuuacuuuua

SEQ ID NO: 71252 - RNA, 64 nt, Human
gaaugcugagcugaagaaauuauacguacauacacacauacauacauacauacaaauauaugua

SEQ ID NO: 71253 - RNA, 64 nt, Human
gcaugaagguagaacagucuauauacucuugugacacauacaaucccuaccuugugcugccaag

SEQ ID NO: 71254 - RNA, 64 nt, Human
ggacagugcugaaccuuauauauauuuuuuccuacacauacauaccuaugauaaaguuuaauuu

SEQ ID NO: 71255 - RNA, 64 nt, Human
gaaauaauacuucagccaccagguuuuucugucucacauacauaagcagcauuucauugcagau

SEQ ID NO: 71256 - RNA, 64 nt, Human
agcuuaaaaagaaaacauauauuuuauguaaaaacacauacauggccaaaugcaauacugaaga

SEQ ID NO: 71257 - RNA, 64 nt, Human
cagcccuccacacacacucacccccacucccacacacauacacacacacacacacauaccccau

SEQ ID NO: 71258 - RNA, 64 nt, Human
gguggccagcuuggaggauggacauuucuggauacacauacacauacaaaacagaaaacauuuu

SEQ ID NO: 71259 - RNA, 64 nt, Human
cagcuuggaggauggacauuucuggauacacauacacauacaaaacagaaaacauuuuuuaaaa

SEQ ID NO: 71260 - RNA, 64 nt, Human
aggagucagugcccauguguauggaagacaaauacacauacauauauacauuuugcagcuaugg

SEQ ID NO: 71261 - RNA, 64 nt, Human
cauuucuuaccucccucaugcaagggugcguguacacauacacacacacacacaccuggcccca

SEQ ID NO: 71262 - RNA, 64 nt, Human
aguacccacucuggagcauuucucaucaguaguucacauacaaaucauccauccuugccaauag

SEQ ID NO: 71263 - RNA, 64 nt, Human
auccagccuaacccauaguuuauauguauaugcacacauacauacauauauguuguguauaaau

SEQ ID NO: 71264 - RNA, 64 nt, Human
ccuuaguuccagguagauuaaaaagcugcuagcucacauacaggacagccagcaguaggcugug

SEQ ID NO: 71265 - RNA, 64 nt, Human
caauaaaucugauguacacagacugaaacauacacacauacacccuaaucaaaacguuggggaa

SEQ ID NO: 71266 - RNA, 64 nt, Human
gaucaggcacguugagaguauacgguguccucagcacauacaccugugggaaaacggaccgcuc

SEQ ID NO: 71267 - RNA, 64 nt, Human
cacaugugcacaugcacgugugugcacguacacacacauacacacacacgcgugcacacaccag

SEQ ID NO: 71268 - RNA, 64 nt, Human
ccaggcuuucuaccucgacucucaccacagccagcacauacaccuaggcuguuuuuccuuccuc

SEQ ID NO: 71269 - RNA, 64 nt, Human
augugcaaguguaugcacgugugcacacacaccacacauacacacacacaagcuuuuuuacaca

SEQ ID NO: 71270 - RNA, 64 nt, Human
ggguggaagcagccgcaggagcaagggccccucccacauacacaggaggaguauuucauuucuc

SEQ ID NO: 71271 - RNA, 64 nt, Human
agcaguaaaagacugaagauaauguuugaacagccacauacaccaugccugaagcuaaaaauau

SEQ ID NO: 71272 - RNA, 64 nt, Human
cacuguggugaaauggcuccagaggucuguacaucacauacauaugcacacaggcacacauggc

SEQ ID NO: 71273 - RNA, 60 nt, Human
ccccuguuauccuggucuaauaaccccccacacauacaccucuggugaccuauuugcaca

SEQ ID NO: 71274 - RNA, 64 nt, Human
ucccucccccuggagacccuggaagugguguguucacauacagugacccuuggccaccagacca

SEQ ID NO: 71275 - RNA, 64 nt, Human
cucuauucuguuucuuccuccucacauggggguacacauacacagcuuccucuuuugguuccau

SEQ ID NO: 71276 - RNA, 64 nt, Human
aauaaauguguauguguguacauauauauacacacacauacacauauauuaugcauguggugaa

SEQ ID NO: 71277 - RNA, 64 nt, Human
gaguuuagaaaaauaaauauacaauaaaaguaaacacauacacacaaaacagcaaacuucaggu

SEQ ID NO: 71278 - RNA, 64 nt, Human
gccaccaccuuuggcugguagcagcaggcucaggcacauacaccucgucaagagcaugcacaug

SEQ ID NO: 71279 - RNA, 64 nt, Human
uucucagccaagacauaaaaacuaggacucagagcacauacaaaaccaguuauguuucggaaag

SEQ ID NO: 71280 - RNA, 64 nt, Human
gcguggucucccugcucuguccccacacguuccucacauacaggcaagaggcacugccgggucc

SEQ ID NO: 71281 - RNA, 64 nt, Human
gaccuaucaguguuuuguguguguaggugacucccacauacacaguugccauuuuucucucuaa

SEQ ID NO: 71282 - RNA, 64 nt, Human
aggcccagaaaagaaaacaaaaacaaaaacccagcacauacaagaaacauacaguguaccucaa

SEQ ID NO: 71283 - RNA, 64 nt, Human
guaaaccagaugggcgucaccccaguucugcagacacauacacaacccguuugcugcagagccg

SEQ ID NO: 71284 - RNA, 64 nt, Human
gcaguguccagauccccagagccacacauacauacacauacacacccuuacccccauccacucu

SEQ ID NO: 71285 - RNA, 64 nt, Human
gugagggagggcaguguccagauccccagagccacacauacauacacauacacacccuuacccc

SEQ ID NO: 71286 - RNA, 64 nt, Human
uuucauauugggcagugguucacuuuaaaacacacacauacacacacaaaacaauuuuuuaaga

SEQ ID NO: 71287 - RNA, 64 nt, Human
aggacauaagaaaagugggucaccacgugguguucacauacauuuucuaauuguuaacuaauug

SEQ ID NO: 71288 - RNA, 64 nt, Human
cacacauacucacaaacacacacacaagcacuugcacauacauacaaacacaugcaaacauacc

SEQ ID NO: 71289 - RNA, 64 nt, Human
guuuuuuuuucaaucuguauuuuuugguuuugugcacauacagcauuuccuaggauaaaaauaa

SEQ ID NO: 71290 - RNA, 64 nt, Human
aagcaauuauuuaaagaaagugaaaaauguaaaacacauacaaaagaauuaaacccacaagcug

SEQ ID NO: 71291 - RNA, 64 nt, Human
cugcaaagacgaauugggugcacagcaccccaaccacauacacgaggaagaagaugcggucagc

SEQ ID NO: 71292 - RNA, 64 nt, Human
uauauauaaauauauauauacauauauauauacacacauacauaucuagaauguguauccgcgg

SEQ ID NO: 71293 - RNA, 64 nt, Human
aaagagcuuccaucugggcuggacccaguucuugcacauacaagacaccgcugcagucagcuag

SEQ ID NO: 71294 - RNA, 64 nt, Human
cugauuuuucaugagccuuacagacacacagagacacauacacauugaucuuaaaauuuuucuc

SEQ ID NO: 71295 - RNA, 64 nt, Human
gcccucuggccaccuacccgagagaucguagggucacauacauccaacuucaccacuuggcugc

SEQ ID NO: 71296 - RNA, 64 nt, Human
acccgcauucauguucugugugccucuucuauugcacauacacugauuuuuagcauugucuauu

SEQ ID NO: 71297 - RNA, 64 nt, Human
cucugggggcugcugagaugaaugacacacaccgcacauacacaugcaucagugucugccugcc

SEQ ID NO: 71298 - RNA, 64 nt, Human
uucuucccaaaggacauguauauuugcagagcuccacauacagaaacacauuauuuugcagaaa

SEQ ID NO: 71299 - RNA, 64 nt, Human
auggugucuaaaugccucagucagugccuaacugcacauacaaaaauaaaaccuucuuucugua

SEQ ID NO: 71300 - RNA, 64 nt, Human
cuaugguuugaauggaugccaucacucuuuucuccacauacagugcagagagcugucuggaguc

SEQ ID NO: 71301 - RNA, 64 nt, Human
acgcugcuuuguaagccacuuuuuaguacucugacacauacaugugguuaucuuuugcccuguu

SEQ ID NO: 71302 - RNA, 64 nt, Human
cuaaguaaugggggaaaaccugugcaaauuaauucacauacaugguucagaaaauucacagcag

SEQ ID NO: 71303 - RNA, 64 nt, Human
acacagagccaggagcagaagcaaagagcagacacacauacagccugaaacagaccuggacaga

SEQ ID NO: 71304 - RNA, 64 nt, Human
caaaacugacaccuuuguuagccaccuccccacccacauacauuucugccaguguucacaauga

SEQ ID NO: 71305 - RNA, 64 nt, Human
acguggaaagcggccccugcugccccuccacacacacauacacacucacugaucuacagccccu

SEQ ID NO: 71306 - RNA, 64 nt, Human
auggauaggagugcguuuuaggcacagcaaauggcacauacaagggccagggagcaagagagag

SEQ ID NO: 71307 - RNA, 64 nt, Human
guucaguauacacaaaucaauaaaugugauuuaucacauacacagaacuaaaaacaaaaaccac

SEQ ID NO: 71308 - RNA, 64 nt, Human
acaaaauugggagaacaaaagaaaagcgucuugucacauacagaaggucccugauaaaguuagu

SEQ ID NO: 71309 - RNA, 64 nt, Human
gccacauuggaagaagaaaaauugucuugugccacacauacaauacacuaacauuaacaauagc

SEQ ID NO: 71310 - RNA, 64 nt, Human
gucggucuccccccuccccgcccccuucucuuuucacauacagucacauugagguuuggaacuu

SEQ ID NO: 71311 - RNA, 64 nt, Human
auguggcagaacuuccagaggaaaucgacaucuccacauacaucgagcagagccgguaaccacc

SEQ ID NO: 71312 - RNA, 64 nt, Human
aauuuauucauccauucaucacauaugugaugagcacauacagacacaccucagagauauugca

SEQ ID NO: 71313 - RNA, 64 nt, Human
ucuaccucaaucaaaaaaauuugcuauuuuaucucacauacauuuuuuuucuguccagguuguu

SEQ ID NO: 71314 - RNA, 64 nt, Human
ugcacuguggugcuucaguggccaccagccucgucacauacaccagcaucuuucuguaccuccu

SEQ ID NO: 71315 - RNA, 64 nt, Human
uuggagguuaugauuugccacagauugguuggaucacauacauuuaaggaucauauuauuaaau

SEQ ID NO: 71316 - RNA, 64 nt, Human
uuuauuuugauacaacauauuccccccaaaaaaacacauacauaggaacugguuauauuccacc

SEQ ID NO: 71317 - RNA, 64 nt, Human
accaucauuguuuuccccauccucuuccucaacacacauacaugcacaacacauauacaauacu

SEQ ID NO: 71318 - RNA, 64 nt, Human
ugugauacacaggcaaauuugauguuaaccuaagcacauacacagcaauugcucgacuguguca

SEQ ID NO: 71319 - RNA, 64 nt, Human
auaccaaaccaagguucucuccccucuuuccucucacauacaugcucugucuccucucuuggaa

SEQ ID NO: 71320 - RNA, 64 nt, Human
cccucuccuucuccaucucacccucccucucucacacauacacacacaaacacauacacacaac

SEQ ID NO: 71321 - RNA, 64 nt, Human
cucacccucccucucucacacauacacacacaaacacauacacacaacacuaagugccuagacu

SEQ ID NO: 71322 - RNA, 64 nt, Human
uauauguacccacuuagucauguaagugcauauacacauacacacacaugaguguagacaugug

SEQ ID NO: 71323 - RNA, 64 nt, Human
cacucaccccuguccucagagugauaaacuaagucacauacagauaaagcacugaaaacaccac

SEQ ID NO: 71324 - RNA, 64 nt, Human
ggucuuacccggcucacucccucccuuguccuuacacauacaggaagacaagaccugaguggug

SEQ ID NO: 71325 - RNA, 64 nt, Human
gcaaaucuuaaucuguuuaguuuacucagguggccacauacagucucuguuguauauucuuggu

SEQ ID NO: 71326 - RNA, 64 nt, Human
caggucuugccuuuaaauuaccccucccugcacacacauacacagauacacacacacaaauaua

SEQ ID NO: 71327 - RNA, 64 nt, Human
uugccuuucccgggguugugcagaguuagauaugcacauacaugugguauaagcacauguacag

SEQ ID NO: 71328 - RNA, 64 nt, Human
uauauauauauauacacacacacacacacacauacacauacaauccauauacauauggaguaug

SEQ ID NO: 71329 - RNA, 64 nt, Human
ugcaaauauauauauauauacacacacacacacacacauacacauacaauccauauacauaugg

SEQ ID NO: 71330 - RNA, 64 nt, Human
cacaugcacacacguguagcucacacacaguauacacauacacaagugcacagaccacacacag

SEQ ID NO: 71331 - RNA, 64 nt, Human
caucccuacgugcccacuggcacacacacgugcucacauacauguccgcauacaggcguacaca

SEQ ID NO: 71332 - RNA, 64 nt, Human
auuuaaaagaaauauuuauauauacacauauauacacauacacacauguauauauauauucuuc

SEQ ID NO: 71333 - RNA, 64 nt, Human
gggagggcugugaugcucggcacauccugccuggcacauacacgugucugcaggccacaccgug

SEQ ID NO: 71334 - RNA, 64 nt, Human
ggauguuucuuccuggguguggcugggcugcucucacauacagaggccgaggggccaauucguu

SEQ ID NO: 71335 - RNA, 64 nt, Human
cagacacuuguuaccauauuuuaaaaucuggcuucacauacacagagucuuugcuaugcaccau

SEQ ID NO: 71336 - RNA, 64 nt, Human
aacacacaggcacauacacucauauacauagacacacauacacaccucaaucuagaaagaacuu

SEQ ID NO: 71337 - RNA, 64 nt, Human
ccauccugcacacaucucccugaaaacacacaggcacauacacucauauacauagacacacaua

SEQ ID NO: 71338 - RNA, 64 nt, Human
gcucugacagcuggagaugaaggcacacucauaccacauacaagggaggauuuggagcuuuuaa

SEQ ID NO: 71339 - RNA, 64 nt, Human
cauacgugaccgcucguagaacacaguaaccaaacacauacauggauuuugccaagugcugcca

SEQ ID NO: 71340 - RNA, 64 nt, Human
gcgggaccaucugaugugaugugaauacucuucccacauacauuaaacacacuuaagugagugu

SEQ ID NO: 71341 - RNA, 64 nt, Human
aaacuuuucuuucucuuacacaaaugauaguagucacauacacuacacacacugugccacguuu

SEQ ID NO: 71342 - RNA, 64 nt, Human
accgcugcccugucuguugcgacacccucccccccacauacacacgcagcguuuugauaaauua

SEQ ID NO: 71343 - RNA, 64 nt, Human
ugaugcccugggcuuuggccuugccagggaacuucacauacagaugagaauggggaaaggguaa

SEQ ID NO: 71344 - RNA, 64 nt, Human
aucauauauauaguuaugcauacauacacacacacacauacaguauauucuuuccucaaaaggg

SEQ ID NO: 71345 - RNA, 64 nt, Human
uccuaaaaggaaauaugcagcacguggaggggaacacauacaugucuugaaaauaaacugcuag

SEQ ID NO: 71346 - RNA, 64 nt, Human
cagaaaauucauuuuaaagccaaucagucucauucacauacaauacuguauauugauuuaugcu

SEQ ID NO: 71347 - RNA, 64 nt, Human
gauacacacacauauauauguguguauauauauacacauacauauauauacacacacgcauuug

SEQ ID NO: 71348 - RNA, 64 nt, Human
uauccuuacacucccccagccccagagaaacugccacauacaccacaaaaaccaaacauccccc

SEQ ID NO: 71349 - RNA, 64 nt, Human
ugagaaauuuuauaaauguguauuucuguguauucacauacauauauauauacacacauauaua

SEQ ID NO: 71350 - RNA, 64 nt, Human
uacauauauauauacacacauauauauguacauacacauacauacauauuaccauacugaaggg

SEQ ID NO: 71351 - RNA, 64 nt, Human
ggugaagauagagacauagagaggcugugaaacacacauacagcccuguuaggucuuuugaauu

SEQ ID NO: 71352 - RNA, 64 nt, Human
cugaaauuucacaguccuauccgaucugaaaacacacauacacaaaugcacacacaugcacaca

SEQ ID NO: 71353 - RNA, 64 nt, Human
uaaaacaggcaaagcagaaucacaugugcacacacacauacacauguaaacauuggaaugcaua

SEQ ID NO: 71354 - RNA, 64 nt, Human
gaagaaacacagcaugcauuuagcaugaguucugcacauacagaugguguccugcauguaugcc

SEQ ID NO: 71355 - RNA, 64 nt, Human
caaggaaaacugugacccaaagaaguuuaagaaucacauacagugcugcuggcuuuuugugcuu

SEQ ID NO: 71356 - RNA, 64 nt, Human
uaauaucuaacauaaaauuguuaauuuauacacacacauacacucauacauagagagagauuuu

SEQ ID NO: 71357 - RNA, 64 nt, Human
aauuuaauacuguuuuuuuucuugaaggaauacucacauacaugguuugaaaugugcauagaua

SEQ ID NO: 71358 - RNA, 64 nt, Human
uaucaucuuggacucuucugaguccauuaucuuucacauacaguuuucaugaggcaaguuuuac

SEQ ID NO: 71359 - RNA, 64 nt, Human
gaaacuuuugucacggcuuuauugagauuaaguucacauacaauuuguauccauuuaaagugua

SEQ ID NO: 71360 - RNA, 64 nt, Human
uaauugcugcuuuuuucagggguaauuuccaacacacauacaugcacacaaacaaaauguuuua

SEQ ID NO: 71361 - RNA, 64 nt, Human
aaaccccuaaaaacaaaacaaacacacacacacacacauacacacacacacacaaaacuuugag

SEQ ID NO: 71362 - RNA, 64 nt, Human
aguauaaaugguaauaaguuguucccuaacccuccacauacauuugccuaucacacguaaaauu

SEQ ID NO: 71363 - RNA, 64 nt, Human
aagccgggugcgaugagcucagccuuuacucauucacauacaccaucacacuuuaauuccaauc

SEQ ID NO: 71364 - RNA, 64 nt, Human
uauacacacacacacacacagagacccuugaguacacauacacacacacacacacagacacaca

SEQ ID NO: 71365 - RNA, 64 nt, Human
uccacacugucucccuccucaacacacacacacacacauacacacacauauacauagacacaca

SEQ ID NO: 71366 - RNA, 64 nt, Human
gcaaaaccacugaagaacaaguguuccuuuuuaccacauacauauuauguuuugaucacugcug

SEQ ID NO: 71367 - RNA, 64 nt, Human
aaauucugcccacacacacacaaacacauacacacacauacacacacacagacacacacacacg

SEQ ID NO: 71368 - RNA, 64 nt, Human
aaauuaaaagaaauucugcccacacacacacaaacacauacacacacauacacacacacagaca

SEQ ID NO: 71369 - RNA, 64 nt, Human
gguuugguguuuuuaaaguguguauacauacauacacauacacacaugcacauaugucaaauau

SEQ ID NO: 71370 - RNA, 64 nt, Human
auuuuuaacaacaaaaaagaaagucuggguuccacacauacauagaaaaagauuauuauguucu

SEQ ID NO: 71371 - RNA, 64 nt, Human
acuaaacugaaaacauucauuccauaucuacuuacacauacaccagcaacaguauaaauguaag

SEQ ID NO: 71372 - RNA, 62 nt, Human
gguuucuucaguaaugaguuaaauaaaacauugacacauacaaacaaaugccuuugagaauu

SEQ ID NO: 71373 - RNA, 64 nt, Human
ugcaaaccuuuaguuuucugaugaucuacacacacacauacacacacacacacacacacgugca

SEQ ID NO: 71374 - RNA, 64 nt, Human
cacacccuucaggcugcacccgggcaggccucagaacggugaggggccagggcaaagggugugc

SEQ ID NO: 71375 - RNA, 64 nt, Human
ccuacccuguaucuaacauaggaguuucauauaaaacggugauaucaugcagaugcagucugaa

SEQ ID NO: 71376 - RNA, 64 nt, Human
ggacgcagcaccaucaaagcccagaauuucugaaaacggugacaagguuaacauaaggacaaca

SEQ ID NO: 71377 - RNA, 64 nt, Human
uuggcauguccaacagaaauaguuuuugcuguugaacggugauuucuguccaagugcagauuuc

SEQ ID NO: 71378 - RNA, 64 nt, Human
aagucuugauagcaagcguuauuuuggugguagaaacggugaaaucucuagccucuuuguguuu

SEQ ID NO: 71379 - RNA, 64 nt, Human
aauuuuauuuuaaaacuguccuccauaauaaucaaacggugauucaucuaaaugacuucuagca

SEQ ID NO: 71380 - RNA, 64 nt, Human
aggccugaacucaccauagagacccaugucagcaaacggugaccagcaaauccucuucccuuau

SEQ ID NO: 71381 - RNA, 64 nt, Human
gaggugcuacugacuuucucagccucugaauaugaacggugagcauuguggcugucagcaggaa

SEQ ID NO: 71382 - RNA, 64 nt, Human
acccgcucugcucacucugcaccugccagagacgaacggugaucugugacccgguggugugccc

SEQ ID NO: 71383 - RNA, 64 nt, Human
gagacgguccuuucuggauacagagaaaugaaacaacggugaccucuccaggucggcacuuucc

SEQ ID NO: 71384 - RNA, 64 nt, Human
uggccucccgucgccagaacggucauauguguucaacggugacuuuguggaucgaggcaaggau

SEQ ID NO: 71385 - RNA, 64 nt, Human
aucaauuaccacaccaucucccaugaagaaagggaacggugaaguacuaagcgcuagaggaagc

SEQ ID NO: 71386 - RNA, 64 nt, Human
cacgaggucaggagaucgagaccaucccggcuaaaacggugaaaccccgucucuacuaaaaaua

SEQ ID NO: 71387 - RNA, 64 nt, Human
auacuggcacagagcauuaaucauacaccuuauuaacggugaggugaauaacuuugaaauaaag

SEQ ID NO: 71388 - RNA, 64 nt, Human
agucaaagcguuuaucugagaguucguguuccugaacggugagaagcauuuaggcauuagaguc

SEQ ID NO: 71389 - RNA, 64 nt, Human
uuuuuuuuggcuugacucaggauuuaaaaacuggaacggugaaggugacagcagucgguuggag

SEQ ID NO: 71390 - RNA, 64 nt, Human
cuguuuucuggaaaggcugcaggauuccuuuccuaacggugaccuucuucuugcucccagugac

SEQ ID NO: 71391 - RNA, 64 nt, Human
ugagcuagcaaauguucccaguacauuggaccuaaacggugacucucauucuuuaacaggauua

SEQ ID NO: 71392 - RNA, 64 nt, Human
agcugagauuacgccacugcacucuagccugggcaacggugagacccugccucaaaaaaaauaa

SEQ ID NO: 71393 - RNA, 64 nt, Human
aucuguaaaauggagaccaccccccgccacgcugaacggugauucugugacugguaagagaugc

SEQ ID NO: 71394 - RNA, 64 nt, Human
gucaggauggcugcgggcaaugaagccuuaguaaaacggugaaaaguacucccagacggacgcg

SEQ ID NO: 71395 - RNA, 64 nt, Human
ggugucuauuccuauggagaagccaguaguuagaaacggugagaauuccaacacuguucaugua

SEQ ID NO: 71396 - RNA, 64 nt, Human
aaguucuuuuggcaacugaaggaccaagaagggaaacggugaugagagagacugcucauuguaa

SEQ ID NO: 71397 - RNA, 64 nt, Human
acaaaggcagcugugucugagcccaacccuucuaaacggugaccuuuagugccaacuuccccuc

SEQ ID NO: 71398 - RNA, 64 nt, Human
cagccugcugcggguccuggccaggggucuggcuaacggugagggcugacucugaacugucucu

SEQ ID NO: 71399 - RNA, 64 nt, Human
ggcgagaaguacgaggggagcgagacgaaaggagaacggugauuauucaugacaggccugauau

SEQ ID NO: 71400 - RNA, 64 nt, Human
ucaguuucucuuugguuuuccagauuuucuuuagaacggugacugacccuccuacuugaggccg

SEQ ID NO: 71401 - RNA, 64 nt, Human
ucuaauauuagacauacaaguugcugccuguuauaacggugaauuauaccuuugugcaugccua

SEQ ID NO: 71402 - RNA, 64 nt, Human
uuaaugguccaaaggacaaaucuaaaaugcaaagaacggugauguaguauggccugacagcucu

SEQ ID NO: 71403 - RNA, 64 nt, Human
aaugggggcagggguccugaccuaccucagguggaacggugagcagggaacaugucggaguccu

SEQ ID NO: 71404 - RNA, 64 nt, Human
uauuauaaucucauuugauugcucugcaguugggaacggugaucuucuugaaugauguuucagu

SEQ ID NO: 71405 - RNA, 64 nt, Human
gcucuguuucgguugacccaggucauggaauggaaacggugaggccccaguggcuguucuggaa

SEQ ID NO: 71406 - RNA, 64 nt, Human
gaggcgcucuguacuagaaacugcucuuaauaauaacggugauuauugguugcugcauugcugu

SEQ ID NO: 71407 - RNA, 64 nt, Human
auccgcaucggccucccugcccacaaagcgccacaacggugaccagccggagcagccggagcug

SEQ ID NO: 71408 - RNA, 64 nt, Human
cacagcgccaucaccaauggccaaaacuccucucaacggugaccucuggguaguccuggcaugc

SEQ ID NO: 71409 - RNA, 64 nt, Human
gcaacuuuuuccuuaaaauaacugcuuuuguaagaacggugauauuggagugauuaguauaaau

SEQ ID NO: 71410 - RNA, 64 nt, Human
cuuuaaagguguaaaaaagauguuucacuaauguaacggugaaagagaaucccuguuguacuuu

SEQ ID NO: 71411 - RNA, 64 nt, Human
guggggaugccuguuuacacuagcgcugacucccaacggugacggcucccuuccccacuccaug

SEQ ID NO: 71412 - RNA, 64 nt, Human
cacuggcaccuggccccaggagcggggccgugugaacggugaugaauguugaaaaugcgucuca

SEQ ID NO: 71413 - RNA, 64 nt, Human
aagccuuggagauuagcccuuccuugccagugagaacggugaccgccuccugcucugcacgguc

SEQ ID NO: 71414 - RNA, 64 nt, Human
ggggugaggacggcuuggagggagaccagcaguuaacggugagggagguaggugcacuuacccu

SEQ ID NO: 71415 - RNA, 64 nt, Human
aucaggugcauagcaagugaaagcaaguguucacaacggugaaacuugagcgucauuuuucuua

SEQ ID NO: 71416 - RNA, 64 nt, Human
gcgagaguccagguggccuuggagaggaaagaggaacggugaagacaagcugcgagagcuggga

SEQ ID NO: 71417 - RNA, 64 nt, Human
aucacuuuuuguggauuuguguauccggucaccaaacggugaauauuauagaagaaugggggaa

SEQ ID NO: 71418 - RNA, 64 nt, Human
auggagaaaccaaauuggacaaauccucaccaccaacggugaugauuacaauaaaaucaaguuu

SEQ ID NO: 71419 - RNA, 64 nt, Human
aacugucaacaaaugauaccuuuggauauccauccuccucgacuuauaguacagugguguauag

SEQ ID NO: 71420 - RNA, 64 nt, Human
ccccauuugucaccucgcacacuuauagcguuuccuccucgaaauucuaccaagacuggucaaa

SEQ ID NO: 71421 - RNA, 64 nt, Human
gucaaguucuuggaaauggacaaagggcucuguccuccucgacccuagugggggaucaagaagg

SEQ ID NO: 71422 - RNA, 64 nt, Human
ggagcaagagauauuuugggcaugugggcuucaacuccucgacaucacuguucaugcuggcgag

SEQ ID NO: 71423 - RNA, 64 nt, Human
gucaaccuaucuguuucccccacuagacugugagcuccucgagggcaggauugucuuuuuuuuu

SEQ ID NO: 71424 - RNA, 64 nt, Human
uugaaacuuucaacaaucucuggagugacuuuuucuccucgaauugaaacaagucuauggcaaa

SEQ ID NO: 71425 - RNA, 64 nt, Human
ggaacucuucuaaccuccuugggcuauauuuucucuccucgaguugcuccucauggcugggcuc

SEQ ID NO: 71426 - RNA, 64 nt, Human
acuauaauugcacaaggucuuguuauauugaucucuccucgaacucaacuaacuauaucuugaa

SEQ ID NO: 71427 - RNA, 64 nt, Human
cugcugccagcggaggcgacagcagcguugggagcuccucgaugucagcuuuuugugcuggacu

SEQ ID NO: 71428 - RNA, 64 nt, Human
gagaugccaaggccugugccagguucccugugcccuccucgaggugggcagccaucaccagcca

SEQ ID NO: 71429 - RNA, 64 nt, Human
cuuaaaguucuuuauuuuaggucaaggucagcaucuccucgacgaucaagaucuaucucucuuc

SEQ ID NO: 71430 - RNA, 64 nt, Human
gaggggcugcuccugcuugccaauacugacccuccuccucgaugccuucggagccucugagcuc

SEQ ID NO: 71431 - RNA, 64 nt, Human
cagagcugugauuuuugcaaaguauuuuaccaaccuccucgauggcuuugauaaagguuagauu

SEQ ID NO: 71432 - RNA, 64 nt, Human
acgagcauaccccaugcccaccguggagcugcaacuccucgacagcacugaguuugauagucuc

SEQ ID NO: 71433 - RNA, 64 nt, Human
uaggaguugaguuguuugcuccaggguuauucuccuccucgagucacagucacacgaauaccug

SEQ ID NO: 71434 - RNA, 64 nt, Human
ucuggacuuuuuaugccugccauacccgcuaaugcuccucgaggugcaggagcagguugcugag

SEQ ID NO: 71435 - RNA, 64 nt, Human
gaggcucccuccugucucuaagucaauuccaccccuccucgaagucccggcuuccaccccucuc

SEQ ID NO: 71436 - RNA, 64 nt, Human
gucguuaaaugccugucuccccgcggaucaugggcuccucgaggacagggacuggccugucugu

SEQ ID NO: 71437 - RNA, 64 nt, Human
uaguaaggaggaggagaaggggggcuccuucccucuccucgaaugacguuaugggcacaugccu

SEQ ID NO: 71438 - RNA, 64 nt, Human
aggagccgagcguccucgggcaccgcccucacaccuccucgagugcccugggaccacugggcca

SEQ ID NO: 71439 - RNA, 64 nt, Human
auggcuguaucauagcgauauuuaucucuuccugcuccucgauaggccacuggcccugcacccu

SEQ ID NO: 71440 - RNA, 64 nt, Human
acagccagagggaaagcgacccagacagcagccccuccucgacaggcccacccugcagcucagg

SEQ ID NO: 71441 - RNA, 64 nt, Human
uguguuuaggacauuugauuugcauauccaauaucuccucgaaaccuucagaaaaugguuuuau

SEQ ID NO: 71442 - RNA, 64 nt, Human
uaugagggcugcagggccagugcugccccucggacuccucgagggguugggugcuaagcgcgag

SEQ ID NO: 71443 - RNA, 64 nt, Human
gccaccagagcagccucucugcacaugcagcccucuccucgagcacgucacacacaguaagugu

SEQ ID NO: 71444 - RNA, 64 nt, Human
guugcuuauauuaacaagaagacucacgcaauaacuccucgauaacucucagugaugguaucug

SEQ ID NO: 71445 - RNA, 64 nt, Human
cugcccauggaggaggcucuugaugaucccaggucuccucgaccuccauacaccacacaggcau

SEQ ID NO: 71446 - RNA, 64 nt, Human
caaggggccugccacccagccccuccagugcccucuccucgaugccucgcuccuuccugccccc

SEQ ID NO: 71447 - RNA, 64 nt, Human
gagucagucaguggugccgggaccccagggcagccuccucgacuccugaagaaaaggcagugcc

SEQ ID NO: 71448 - RNA, 64 nt, Human
cacgggcugggucauaaggacacuucuccuuccccuccucgaagcugguuggcaaggugaaggc

SEQ ID NO: 71449 - RNA, 64 nt, Human
cgaucuuccccugacuccccaccgaggagagccucuccucgacccugcacgggcucugaggcca

SEQ ID NO: 71450 - RNA, 64 nt, Human
uguuuauuauguuuucucuccaucagaaugaaagcuccucgagggcagggacuuuggucuauug

SEQ ID NO: 71451 - RNA, 64 nt, Human
uccaucuggcacuggccuggacuccuccucugcccuccucgaggccugcacagcuguggccgug

SEQ ID NO: 71452 - RNA, 64 nt, Human
cuguuccuguggaggaugucuacgcccaggcgagcuccucgaccucugagggaccaucuccccg

SEQ ID NO: 71453 - RNA, 64 nt, Human
ugaggcgcugcgcggacucgcccccaggaacgcucuccucgagcccucccccaaacagacucgc

SEQ ID NO: 71454 - RNA, 64 nt, Human
aaaauccgaugugcuuccuucccuggcgcagucgcuccucgagccgcugccccccacccacccu

SEQ ID NO: 71455 - RNA, 64 nt, Human
guuuuacuaaaauuuuauauaucuccccuuccuucuccucgagucacauaauaucaguaccuug

SEQ ID NO: 71456 - RNA, 64 nt, Human
aucgggaggugccaucggcacuuccucccccgcccuccucgagugccaagaagguguuggacca

SEQ ID NO: 71457 - RNA, 64 nt, Human
cuggggacuuaguuagguagauuaauaucuggagcuccucgagggaccaaaucuccaacuuuuu

SEQ ID NO: 71458 - RNA, 64 nt, Human
cccauucggacugcugugccgcgucccacgucuccuccucgaagccaugugcugcggucacuca

SEQ ID NO: 71459 - RNA, 64 nt, Human
cagguagauggggcugaccuggccucuccaaugucuccucgaacuagcaaaagccgcaugucca

SEQ ID NO: 71460 - RNA, 64 nt, Human
auucucugucuccucucucuccuccuuugaccuucuccucgaccagccaucaugacauuuacca

SEQ ID NO: 71461 - RNA, 64 nt, Human
cauggccacgccagcugcggggacgcacuugggacuccucgagaggggacucgcggccgcgaug

SEQ ID NO: 71462 - RNA, 64 nt, Human
cuagagacuugcuugggggcugcagaagugcccucuccucgaauccugccaguugcauucuucc

SEQ ID NO: 71463 - RNA, 64 nt, Human
cugcucccccagccgcaggccucaccugcaggugcuccucgauguccuugcggucguaggugau

SEQ ID NO: 71464 - RNA, 64 nt, Human
ggagcaugcgcagaggccaguuaaaguagaucaccuccucgaacccacuccgguuccccgcaac

SEQ ID NO: 71465 - RNA, 64 nt, Human
aggugccuuuggccacaugugcugugcuguuugucuccucgacagggagccuguccaccagcag

SEQ ID NO: 71466 - RNA, 64 nt, Human
gagcucuuguugcacuaaaaaguggauuacaaaucuccucgacugcuuuaguggggaaaggaau

SEQ ID NO: 71467 - RNA, 64 nt, Human
cccccugugccuugucacgccagacuucccacggcuccucgagaucccaacacugccagcauuu

SEQ ID NO: 71468 - RNA, 64 nt, Human
ggcccagggacucaugggacaccuuucccacagccuccucgauugcugugagcagaggccacuc

SEQ ID NO: 71469 - RNA, 64 nt, Human
aaggggcucuggggacuucuccuucuaugaaagccuccucgagccaggugcuccugggcaccuu

SEQ ID NO: 71470 - RNA, 64 nt, Human
aacacccccauucuccaccuguugguggggggugcuccucgacccacccagauuugaccguuca

SEQ ID NO: 71471 - RNA, 64 nt, Human
gccguggccaugggaagauguuccacgcugccuccuccucgaguuuuccucggaaacacucuug

SEQ ID NO: 71472 - RNA, 64 nt, Human
ggcuagcucaugcugcucuugucagccucugguucuccucgaguccuuggggacguggcagaug

SEQ ID NO: 71473 - RNA, 64 nt, Human
auucuuuccuucaagugaagaugugacugacuaccuccucgaguugucaugaggaugaaagaau

SEQ ID NO: 71474 - RNA, 64 nt, Human
ugccugccccucucugccuuuuccucgggugucccuccucgagccccuguggcauuggcuuggg

SEQ ID NO: 71475 - RNA, 64 nt, Human
cuuacuccuccauauucuuucaacccacaugagucuccucgagaagugaggagaggcaguuugg

SEQ ID NO: 71476 - RNA, 64 nt, Human
aggagccacugggacagggugaggcucccagacgcuccucgaggugcccagcucuccagggagc

SEQ ID NO: 71477 - RNA, 64 nt, Human
ucccugcagggcaucuagcagccccggccggcgccuccucgagguuccaaaagaugccgccugg

SEQ ID NO: 71478 - RNA, 64 nt, Human
gguuccccauaugucuuccuuacuagacugugagcuccucgagggcagggaccgugccuuaugu

SEQ ID NO: 71479 - RNA, 64 nt, Human
auccugaccccagccaacagcugagcugccgggccuccucgaggccccuaagccacccccagag

SEQ ID NO: 71480 - RNA, 64 nt, Human
agggccaggggcugugugacggcugccugaaguucuccucgaucccccggugagcuuccugcag

SEQ ID NO: 71481 - RNA, 64 nt, Human
acuugagaaggggacuugugaacucaaccacaaucuccucgagacauucauccagagaccaugu

SEQ ID NO: 71482 - RNA, 64 nt, Human
ugccugggacagccacuggaaacuuuugggaacucuccucgaaugugugggcccaaggccccca

SEQ ID NO: 71483 - RNA, 64 nt, Human
uggcucaccuuucucuccucagcagaacaugucucuccucgaguccuuuggguuucagauuguu

SEQ ID NO: 71484 - RNA, 64 nt, Human
gccuugguggggaccaagcagccuuucccguccccuccucgacccguacaguugagagccaggg

SEQ ID NO: 71485 - RNA, 64 nt, Human
aggcuucccagaucccugagucucucuuuccuuccuccucgaucuuuaguuguccacggucaau

SEQ ID NO: 71486 - RNA, 64 nt, Human
aggcaugacuggcuucugaaaaauuccagcacaccuccucgaaccucauugucagcagagaggg

SEQ ID NO: 71487 - RNA, 64 nt, Human
cccccagccccugcugccccagccugugucuguucuccucgagggcuccagcauccucugcuuc

SEQ ID NO: 71488 - RNA, 64 nt, Human
cuuuuaaauauucauguugagugugccuaauacucuccucgacaagucaugcuguuuuaugcag

SEQ ID NO: 71489 - RNA, 64 nt, Human
ggucauuucuucauaagauagcaaauuuaaaucucuccucgaucagcuuuuaaaaaauguguac

SEQ ID NO: 71490 - RNA, 64 nt, Human
cugagauggcaccacuuauugcacuccagcccgggcgacagagcgagacuccaucuaccagauc

SEQ ID NO: 71491 - RNA, 64 nt, Human
gugagccaagauugcaccauugcacuccagccuggcgacagagcaagacucugucucaaaaaaa

SEQ ID NO: 71492 - RNA, 64 nt, Human
ggagccgagaucacgccacugcacuccagccugggcgacagagcgagagucugucucaaaagaa

SEQ ID NO: 71493 - RNA, 64 nt, Human
ugagcugagaucacaccacugcacuccggccugggcgacagagcgagacugucucaaaaaaaca

SEQ ID NO: 71494 - RNA, 64 nt, Human
ugagccgagaucccgccacugcacuccagccugggcgacagagcgagacuccgucucaaaaaaa

SEQ ID NO: 71495 - RNA, 64 nt, Human
ugaggcgagauugugccacugcacuccagcuugggcgacagagugagacuccgucucaaaaaag

SEQ ID NO: 71496 - RNA, 64 nt, Human
uccaggcuggaguacaccaacuacuccagccugagcgacagaguaagaccuuaucuuuuaaaaa

SEQ ID NO: 71497 - RNA, 64 nt, Human
ugcgguuaccugcuugagugauccugaacuuguugcgacagagggacucacuggacucuguucg

SEQ ID NO: 71498 - RNA, 64 nt, Human
ugagcuaugacugugccacugcacuccagccugggcgacagagcaaacccuguuuccaaacaaa

SEQ ID NO: 71499 - RNA, 64 nt, Human
ugagccucgauuguaccacugcacuccagccugggcgacagagcaagacucugucucaaaacaa

SEQ ID NO: 71500 - RNA, 64 nt, Human
ugagucgagaucgcgccacugcacuccagccugggcgacagagcgaaacuccgucucaaaaaaa

SEQ ID NO: 71501 - RNA, 64 nt, Human
ugagccgagaucacaucacugcacuccagccugggcgacagagcgagacuccaucucaaaaaaa

SEQ ID NO: 71502 - RNA, 64 nt, Human
ugagcugagaucgugcuauugcacuccagccugggcgacagagcaagacgccaucucaaaaaca

SEQ ID NO: 71503 - RNA, 64 nt, Human
ugagccgagaucaugccauugcacuccagccugggcgacagagugagacucugucucaaaaaaa

SEQ ID NO: 71504 - RNA, 64 nt, Human
agaggauacuaaagagaggggaacgggaaugcccgcgacagaguccacauugccuguuucuugu

SEQ ID NO: 71505 - RNA, 64 nt, Human
gcuugcagugagccgagacugugcuccagccugggcgacagagcgagacuccgucucaaaaaaa

SEQ ID NO: 71506 - RNA, 64 nt, Human
gugagcugagauugagcaacuguacuccagcuuggcgacagagcaagacccccucucaaaaaua

SEQ ID NO: 71507 - RNA, 64 nt, Human
uaaaacucucugugcaucuaaauacuucuggagggcgacagauucaugccacggauaaaugagg

SEQ ID NO: 71508 - RNA, 64 nt, Human
ugagccaagauugugccaccacacuccagccugggcgacagaaugagacccugucucaaaaaaa

SEQ ID NO: 71509 - RNA, 64 nt, Human
uaaacauauuucugaaauauuuuuugccuuucaagcgacagaugccucauuuugugaaaacuua

SEQ ID NO: 71510 - RNA, 64 nt, Human
ugagcugagaucgcgccacugcacugcagccuaggcgacagagcaagacugccucaaaaaaaaa

SEQ ID NO: 71511 - RNA, 64 nt, Human
ugagccgagauagugccacagcucuccagccugggcgacagagugagacuccaucucaaacaac

SEQ ID NO: 71512 - RNA, 64 nt, Human
ugagccgaggucaugccacugcacugcagccugggcgacagagcgagauucugccucaaaaaua

SEQ ID NO: 71513 - RNA, 64 nt, Human
uguggaauaauagcaggugaagacuucauagaaggcgacagauugauagggaggcuauugaagc

SEQ ID NO: 71514 - RNA, 64 nt, Human
ugagcugagauugugccacugcacuccagccugggcgacagagcgagacuucgucucaaacaaa

SEQ ID NO: 71515 - RNA, 64 nt, Human
ugagcugagaucgcaccacugcacuccagccugggcgacagagugagacuuugucucaaaaaca

SEQ ID NO: 71516 - RNA, 64 nt, Human
ucaaauccuuacucuccuaaaggcagcugaguccgcgacagaaauuugcccuaugugaguaaaa

SEQ ID NO: 71517 - RNA, 64 nt, Human
aacaccauuaauuuugaguauaauuuguuacauagcgacagauaacuauacagcucaacaacua

SEQ ID NO: 71518 - RNA, 64 nt, Human
ugagcuaugauuacgacacugcacuccagccuaggcgacagagcaagaccccauucucuuacaa

SEQ ID NO: 71519 - RNA, 64 nt, Human
agagccaagaucgcaccacugcacuacagccugggcgacagaacgagacccugucuccaaagga

SEQ ID NO: 71520 - RNA, 64 nt, Human
cgucagcagugugguauuaucuaugagaacuugagcgacagaguauuucuugaugaauuuauag

SEQ ID NO: 71521 - RNA, 64 nt, Human
ugagguacgaucaagccacugcacuccagccugggcgacagagcaagaucguuucucuaaaauu

SEQ ID NO: 71522 - RNA, 64 nt, Human
ugagccaagaucaugccacuccacuccagucugggcgacagagcaagacucugacucaaaaaaa

SEQ ID NO: 71523 - RNA, 64 nt, Human
aggggaugacggcguggacgaggaacagcugagggcgacagaggaucuaggcuaacaggagaga

SEQ ID NO: 71524 - RNA, 64 nt, Human
uguaacauggcuuagaggaaagaguguagacccagcgacagaucaucagucacucaaauccugg

SEQ ID NO: 71525 - RNA, 64 nt, Human
guguggugagaucaugccacuacacuccagccuggcgacagagcgagacuugguuucaaaaaaa

SEQ ID NO: 71526 - RNA, 64 nt, Human
ugagccgagauugugccacugcacuccagccuaggcgacagagugagacuccaucucaaauugg

SEQ ID NO: 71527 - RNA, 64 nt, Human
aguaaacaccugagcacagcuggccuacacaggagcgacagauucuccuugaugguacacuuuc

SEQ ID NO: 71528 - RNA, 64 nt, Human
ugagccgagaucgugccacugcacucuagccugggcgacagagcgagacuccaucucaaaaaaa

SEQ ID NO: 71529 - RNA, 64 nt, Human
cauuggugagaguccaacagacacaauuuauacugcgacagaacuucagcauuguaauuaugua

SEQ ID NO: 71530 - RNA, 64 nt, Human
ugagcugagaucgcacuacugcacuccagccugggcgacagagcaagaccaccaucuccaaaaa

SEQ ID NO: 71531 - RNA, 64 nt, Human; identical to SEQ ID NO: 71494

SEQ ID NO: 71532 - RNA, 64 nt, Human
gugagccgagaucacgccacugcacuccagccuggcgacagagcgagacucccucucaaaaaaa

SEQ ID NO: 71533 - RNA, 64 nt, Human
ugagccaagauaacaccauugcacuccagccugggcgacagagugagacuaucucaaaaauaaa

SEQ ID NO: 71534 - RNA, 64 nt, Human
ugagccgagaucgcaccacugcacuccagccugggcgacagagcgagacucugccucaaaaaac

SEQ ID NO: 71535 - RNA, 64 nt, Human
ugagccaagaucguaccacugcacuccagucugggcgacagagugagacuccaucucaaaacaa

SEQ ID NO: 71536 - RNA, 64 nt, Human
ugagccgagaucgugccacugcacuccagccugggcgacagagcaagacucagucucaaaaaaa

SEQ ID NO: 71537 - RNA, 64 nt, Human
ugagcggacaucgcgccacugcacuccagccugggcgacagagcaagacuccgucucaaaaaaa

SEQ ID NO: 71538 - RNA, 64 nt, Human
acuuacaugaucguuuuccuaauacaggaauacagcgacagaccuaucugaaaagucuguuugg

SEQ ID NO: 71539 - RNA, 64 nt, Human
gugagccaagauugcaccagugcacuccagcugggcgacagagcgagacuccaucucggaaaaa

SEQ ID NO: 71540 - RNA, 64 nt, Human
ugagcugagaucaugccacugcacuccagccugggcgacagagcgagacuccaccucaaaaaau

SEQ ID NO: 71541 - RNA, 64 nt, Human
ugagccaagauugugccacugcacuccagccugggcgacagagugaaacuacaucucagaaaaa

SEQ ID NO: 71542 - RNA, 64 nt, Human
gugagacgagaucgcgccacugcacuccagccuggcgacagagcgagacgccgucucaaaaaaa

SEQ ID NO: 71543 - RNA, 64 nt, Human
auuccauaaacaguuuucgugcuuccuccugacagcgacagaaaaccucaagggcuuucccacg

SEQ ID NO: 71544 - RNA, 64 nt, Human
ugagccaagauuguaccacugcauuccaaccugggcgacagagccagaccuugucucaaaaaaa

SEQ ID NO: 71545 - RNA, 64 nt, Human
gugagcugagaucacgccauugcacucaagccuggcgacagagcgagacuccgucucaaaaaaa

SEQ ID NO: 71546 - RNA, 64 nt, Human
ccugcugagaucgcgccacugcacuccagccugggcgacagagcaagacuccaucucaaaaaaa

SEQ ID NO: 71547 - RNA, 64 nt, Human
ugagccgagauugcaccacugcacuccagccugggcgacagagcaggacucucucucaaaaaaa

SEQ ID NO: 71548 - RNA, 64 nt, Human
ugagccgaggucgugccacugcacuccagccugggcgacagagcaagacuccgucucaaaaaaa

SEQ ID NO: 71549 - RNA, 64 nt, Human
gugaccuauaaugagccguugugcuccagccugggcgacagaaggugagaucucuuagaaaaaa

SEQ ID NO: 71550 - RNA, 64 nt, Human
ugagccaagaucgcgccacugcacuccagccugggcgacagagugagacuccaucucagaaaaa

SEQ ID NO: 71551 - RNA, 64 nt, Human
ugagccaagaucacaccauugcacuccagccugggcgacagagucuccaucuggggaaaaaaau

SEQ ID NO: 71552 - RNA, 64 nt, Human
agauugcgccacugcaguccgcaguccggccugggcgacagagcgagacuccgucucaaaaaaa

SEQ ID NO: 71553 - RNA, 64 nt, Human
ggcaaugggugagacaggaauccccucacagugggcgacagaucugaagugaagacaggagaug

SEQ ID NO: 71554 - RNA, 64 nt, Human
uccccacuugccuagagggcaucccucugggguagcgacagacaaucccagaaacacgcauaau

SEQ ID NO: 71555 - RNA, 64 nt, Human
ugagcugagaucguaccauggcacuccagccugggcgacagagcaagacucuaucuaaaaaaaa

SEQ ID NO: 71556 - RNA, 64 nt, Human
ugagccgagaucacgucacugcauuucagccugagcgacagagugaaacugucucaaaaaagag

SEQ ID NO: 71557 - RNA, 64 nt, Human
ugggccgagauugugccacugcgcuccagcgugggcgacagagugagacuccaucucaaaaaaa

SEQ ID NO: 71558 - RNA, 64 nt, Human
ugagccgagaucgcaccacugcacuccagccugggcgacagaccgagacuccgucucaaaaaaa

SEQ ID NO: 71559 - RNA, 64 nt, Human
ggcggagguuguagugagccaagauccagccugggcgacagagccagacucuugucucgagggg

SEQ ID NO: 71560 - RNA, 64 nt, Human
uaagccgagauugcaccacugcacuccagccuaggcgacagagcgagacucugucucaaaaaaa

SEQ ID NO: 71561 - RNA, 64 nt, Human
ggucacuguaaguuuuacucuuuugaaugagggugcgacagaaugcaguuagaaucaguucaua

SEQ ID NO: 71562 - RNA, 64 nt, Human
cuuaguaucuuuuuguucagauugagaaccuaaggcgacagagaggucaaggggaaguauuuuc

SEQ ID NO: 71563 - RNA, 64 nt, Human
acguggagagcuucaauugucagauaaacaggaagcgacagaugaccgcuuucuaacgcucucu

SEQ ID NO: 71564 - RNA, 64 nt, Human
ggcugcagugaaccaugauugcacuccaaccugggcgacagagacccugucucaaaaaaaaaaa

SEQ ID NO: 71565 - RNA, 64 nt, Human
ugggcugagaucacgccauugcacuccagccugggcgacagagugagacucugucucaaaaaaa

SEQ ID NO: 71566 - RNA, 64 nt, Human
ugagccgaaauggcgccacuguacuccaaccugggcgacagagcaagacuccaucucauaaauu

SEQ ID NO: 71567 - RNA, 64 nt, Human
ugagccgagaucgcgccacugcacuccagccugggcgacagagcgagacuccgucucaaaaaaa

SEQ ID NO: 71568 - RNA, 64 nt, Human
ugagcugagauuaagccaccgcacuccagccugggcgacagagcaagauuccguucccaagaaa

SEQ ID NO: 71569 - RNA, 64 nt, Human
uucaguguguggggaagcuguccugggggcuggggcgacagauagcacauaggcuguuucuggg

SEQ ID NO: 71570 - RNA, 64 nt, Human
uaagcugagaucacgccacugcauuccagccugggcgacagagcaagacuccaucucaaaaaua

SEQ ID NO: 71571 - RNA, 64 nt, Human
ugaggcgagauugugccauugcacuccaaccugggcgacagagugagacuccaucucaaaaaaa

SEQ ID NO: 71572 - RNA, 64 nt, Human
ugagccgagaucgugccacugcacuccagccugggcgacagagcaagacugcaucucaaaaaaa

SEQ ID NO: 71573 - RNA, 64 nt, Human
uauauuuuuaauuuuaagaauaggauuucggaaggcgacagaaaauuuaguucuuagacauuua

SEQ ID NO: 71574 - RNA, 64 nt, Human
gugagccgagaucauaccacugcacuccagccuggcgacagagcaagacuccaucucaaaaaua

SEQ ID NO: 71575 - RNA, 64 nt, Human
ugagccaagaucaugccacugcacuccagccugggcgacagagcgagacuccaucucaaaaaaa

SEQ ID NO: 71576 - RNA, 64 nt, Human
ugagcugagaucacgccauuguacuccagccugggcgacagagcaagacuccauuucaaaaaaa

SEQ ID NO: 71577 - RNA, 64 nt, Human
ugagccgagaucacgccacugcacuccagccugggcgacagagcaaggcucugucucaaaaaaa

SEQ ID NO: 71578 - RNA, 64 nt, Human
ugagccgagaucacgccacugcacuccagccugggcgacagagagagacuccaucucaaaacaa

SEQ ID NO: 71579 - RNA, 64 nt, Human
ugagccaagaucguaccacugcacuccagccugggcgacagagcaagacacugucucucucucu

SEQ ID NO: 71580 - RNA, 64 nt, Human
ugacugcagcaucuucccaccagugcugcaggaggcgacagaagucaaauauauccugcaaugc

SEQ ID NO: 71581 - RNA, 64 nt, Human
ugagccgagaucgugccacugcacuccagccugggcgacagagcaagacucugucucaaaaaaa

SEQ ID NO: 71582 - RNA, 64 nt, Human
uaagucgagauugugucacugcacucuagccugggcgacagaaaaagaaaauuuagguggggaa

SEQ ID NO: 71583 - RNA, 64 nt, Human
cggccucgcugcgcugauucgucgagcccauccggcgacagaggacagccagaagcccagccag

SEQ ID NO: 71584 - RNA, 64 nt, Human
ugaacuaugaucacaccacugcacuccagccucggcgacagagcaagaccuuguuucucaaaaa

SEQ ID NO: 71585 - RNA, 64 nt, Human
gugagcugagaucacaccacugcacuccagccuggcgacagagagagacuccaucucaaaacaa

SEQ ID NO: 71586 - RNA, 64 nt, Human
uuguaccuauuucugaugaugucggucuugcaaagcgacagauucauaaaguaaugaugaaauc

SEQ ID NO: 71587 - RNA, 64 nt, Human
gagcugauuaucaugcuguugcacuccagcuugggcgacagagcgagacuuugucucaaaaaag

SEQ ID NO: 71588 - RNA, 60 nt, Human
agucuuguaaauguagcugagaccccacgugcgacagagagaggggagagagaaccacca

SEQ ID NO: 71589 - RNA, 64 nt, Human
ugagccaagaucgcaccacugcacuccagcccuggcgacagagugagacuccaucucaaaaaau

SEQ ID NO: 71590 - RNA, 64 nt, Human
aagaguuuaauuuuuuuuuuuuuuuugagccugggcgacagagugagacuccgucucaaaaaaa

SEQ ID NO: 71591 - RNA, 64 nt, Human
uucugcugucuccagacugucuaccaaagagaaggcgacagaugccuccuggguuuggaagggg

SEQ ID NO: 71592 - RNA, 64 nt, Human
cgugccaaggguaagcuggccugcugagcccagggcgacagaggggcacugguuuacacuuugc

SEQ ID NO: 71593 - RNA, 64 nt, Human
gugagccaagguuccaccacugcacuccagccuggcgacagagcaaggcuccacucaaaaaaaa

SEQ ID NO: 71594 - RNA, 64 nt, Human
gccaagaucacgccacugcacuccagcacccugggcgacagagugagacccugucucaaaaaaa

SEQ ID NO: 71595 - RNA, 64 nt, Human
ugagccaagauugcaccagugcacuccagcuugggcgacagaucaagacucugucacacacaaa

SEQ ID NO: 71596 - RNA, 64 nt, Human
ugagccgagauugcaccacugcacuccagccugggcgacagagcgagacucugucucgaaaaaa

SEQ ID NO: 71597 - RNA, 64 nt, Human
ugaggugugauugcgccacugcauuccagcuugggcgacagagcgagacccagucucaaaaaaa

SEQ ID NO: 71598 - RNA, 64 nt, Human
uaagccaagaucgcgccacugcacuccagccugggcgacagagccagacugucucaaauaaaua

SEQ ID NO: 71599 - RNA, 64 nt, Human
aggcaggagaauggcguaaaccccuccagccugggcgacagaaccagacuccgucucaaaaaaa

SEQ ID NO: 71600 - RNA, 64 nt, Human
aaucacgagauugcgccacugcacuccagccugggcgacagagccagacuccgucucaaaaaaa

SEQ ID NO: 71601 - RNA, 64 nt, Human
ugagccaagaucgcgccacugcacuccagccugggcgacagagugagacuccgucucaaaaaaa

SEQ ID NO: 71602 - RNA, 64 nt, Human
ugagccaagaucgugccacugcacuccagccugggcgacagagcaagacuccgucucaaaaaau

SEQ ID NO: 71603 - RNA, 64 nt, Human
uuuuguuuucauucuggaaccauacuaucaaauggcgacagacuguuccguuccacccccguga

SEQ ID NO: 71604 - RNA, 64 nt, Human; identical to SEQ ID NO: 71567

SEQ ID NO: 71605 - RNA, 64 nt, Human
ugagccgagaucacaccaccguacuccagucugagcgacagagcaagaaucugucucaaaaaaa

SEQ ID NO: 71606 - RNA, 64 nt, Human
agaaccagcuggccgagauccgcugcgaccuggagcgacagaaccaggaguaccaggugcuccu

SEQ ID NO: 71607 - RNA, 64 nt, Human
ugagccgagaucgugccacugcacuccagccugggcgacagagugagacuccaucucaaaaaaa

SEQ ID NO: 71608 - RNA, 64 nt, Human
ugaacugagauugcgccaccgcacuccagccugggcgacagagcgagacuccaucuuuaaaaaa

SEQ ID NO: 71609 - RNA, 64 nt, Human
uucacaugaggugagcuucagccugagauagcaggcgacagacuucuugcguuucaaaacugcc

SEQ ID NO: 71610 - RNA, 64 nt, Human; identical to SEQ ID NO: 71567

SEQ ID NO: 71611 - RNA, 64 nt, Human
ugagccgagaucgcgccaaugcacuccagccugggcgacagagaaaaaaaaaaaaaaagaagga

SEQ ID NO: 71612 - RNA, 64 nt, Human
uuggccuuagcccaagacuuggagucgaccccaagcgacagagugaccagaaacccuuuuacag

SEQ ID NO: 71613 - RNA, 64 nt, Human
ugagccaugaaugccccacugcacuccagccugggcgacagaacgagaccccaucucaaaaaaa

SEQ ID NO: 71614 - RNA, 64 nt, Human
gugaguggagaugcgccacugcacuccagccugggcgacagagcgagacuccgccucaaaaaaa

SEQ ID NO: 71615 - RNA, 64 nt, Human
ugagccgagauugagccacugcacuccaaucugugcgacagagugagacccugucucaaaaaca

SEQ ID NO: 71616 - RNA, 64 nt, Human
ugagccaagaucgugccacugcauuccagccugggcgacagagcaagacucugucucaaaaaaa

SEQ ID NO: 71617 - RNA, 64 nt, Human
agauugcgccacugcaguccgcagucuggccugggcgacagagcgagacuccgucucaaaaaaa

SEQ ID NO: 71618 - RNA, 64 nt, Human
ccagccugcucagagaagcuggcaggacugggaggcgacagaugggccccucuuggccucuguc

SEQ ID NO: 71619 - RNA, 64 nt, Human
ugagccgagaucgcgccacugcacuccagccugggcgacagagugagacucccucucaaaagaa

SEQ ID NO: 71620 - RNA, 64 nt, Human
ucccccauuucugcguccaccccugaacuccugagcgacagaagccccaggccuccaccagccu

SEQ ID NO: 71621 - RNA, 64 nt, Human
ggagccgagaucgugccacugcacuccaggcugggcgacagagugagagucugucucaaaaaaa

SEQ ID NO: 71622 - RNA, 64 nt, Human
gugagccaagaucgcaccacugcucuccagccuggcgacagagggagacuccaucucaaauuaa

SEQ ID NO: 71623 - RNA, 64 nt, Human
ugcuaaauuucuuuuuuuuuuuuuuugagccugggcgacagagcgagacuccaucucaaaaaaa

SEQ ID NO: 71624 - RNA, 64 nt, Human
ugagcugagaucacgccauugcacuccagccugggcgacagagcaagacucugucucaagaaga

SEQ ID NO: 71625 - RNA, 64 nt, Human
ugagccaaggucgcgccauugcacuccagccugggcgacagagugacacuucucaaaaaacaaa

SEQ ID NO: 71626 - RNA, 64 nt, Human
uacccucugccagccgcuggaagugggaaugcuggcgacagacuguguccucuuucccaccuuc

SEQ ID NO: 71627 - RNA, 64 nt, Human
ugagccaagaucgugccacugcacucuagccugggcgacagagcaagacugucucaaaaaaauu

SEQ ID NO: 71628 - RNA, 64 nt, Human
ugagcugagaucacgccacugcacuccagccugggcgacagagcgagacuccgucucaaaaaaa

SEQ ID NO: 71629 - RNA, 64 nt, Human
uuuuuugaugagucucacucugcacuccagccuggcgacagagcaagacuccaucuaaaaaaaa

SEQ ID NO: 71630 - RNA, 64 nt, Human
cagcugccacuguguacucgguccgggacccuuggcgacagaagacagccuccgagagcgcggg

SEQ ID NO: 71631 - RNA, 64 nt, Human
gcagugagccaagaugcacugcaccccagccugggcgacagagccagacccugucucaaaaaaa

SEQ ID NO: 71632 - RNA, 64 nt, Human
ugagccgacaucaugccacugcacuccagccugggcgacagagcaagacacugucucaaaaaag

SEQ ID NO: 71633 - RNA, 64 nt, Human
ugagcugagaucacgccacugcauuccagccugugcgacagaaugagacacugucucaagaaaa

SEQ ID NO: 71634 - RNA, 64 nt, Human
ugagccgagaucacgccacugcacucaagccugggcgacagagcgagacuccgucucaaaaaaa

SEQ ID NO: 71635 - RNA, 64 nt, Human
ugagcugagaucacgccacugcacuccagccugggcgacagagcgagauucugucucaaaaaau

SEQ ID NO: 71636 - RNA, 64 nt, Human
uuucccgauugggucugucgucucucuccgccuagcgacagauuccuucuauuaagggauuggc

SEQ ID NO: 71637 - RNA, 64 nt, Human
ugagccgagaucgcgccacugcacuccagccugggcgacagagugggacuccaucucaaaaaaa

SEQ ID NO: 71638 - RNA, 64 nt, Human
gugagccgagauugcaccacugcauuccagccuggcgacagagugagacuccaucucaaaaaaa

SEQ ID NO: 71639 - RNA, 64 nt, Human
caguuaauuuaaaaaaaacagucgcuaguuaacagcgacagagcccagcacccuggggucuuug

SEQ ID NO: 71640 - RNA, 64 nt, Human
ugaacugagacugcgccacggcacuccagccugggcgacagagcaagacucugucucaauaaau

SEQ ID NO: 71641 - RNA, 64 nt, Human
ugagccgaaguugcaccauugcacuccacccugggcgacagagcaagauucuaucaaaaaaaaa

SEQ ID NO: 71642 - RNA, 64 nt, Human
ugagccgagaucgcgccacugcacuccaggcugggcgacagagcgagacuccgucucaaaaaaa

SEQ ID NO: 71643 - RNA, 64 nt, Human
ugagccgagaucgcgccacugcacuccagccugggcgacagagcgagacuccaucucaaaaaaa

SEQ ID NO: 71644 - RNA, 64 nt, Human
gggcuaagggcccgggacgggcggcgcccauccugcgacagaacacguucggguuuugguuuug

SEQ ID NO: 71645 - RNA, 64 nt, Human
cucugcuccucacguccguggccacagaagcagagcgacagagcgacacauccacaggcgcccc

SEQ ID NO: 71646 - RNA, 64 nt, Human
agggagccauagaagucggcuguguuuugagacggcgacagaaccugacccguggagacuggga

SEQ ID NO: 71647 - RNA, 64 nt, Human
acgcugguuuugguggccacaggggguggcccgugcgacagaggcacaugcugaggccugcugg

SEQ ID NO: 71648 - RNA, 64 nt, Human
uguccuaaggacauggccaccuggguccacuccagcgacagaccccugacaagagcaggucucu

SEQ ID NO: 71649 - RNA, 64 nt, Human
caaaccuuucccccauguggucguuagagacagagcgacagagcaguugagaggacacucccgu

SEQ ID NO: 71650 - RNA, 64 nt, Human
aacacgggauggcgcccaaacuccggcguucacaagaggagacgugacguggugggcugagguu

SEQ ID NO: 71651 - RNA, 64 nt, Human
acggcauaauuauggaauuuuuauuuacugguagagaggagacgagaggcuuuuucagugggcc

SEQ ID NO: 71652 - RNA, 64 nt, Human
cccaggcccccuaaaaaucagggccucagcaagcagaggagacacagcagugagggaggcguca

SEQ ID NO: 71653 - RNA, 64 nt, Human
aauaggcuacuuuggcaagcccuccguaaaagucagaggagagaucaguacagagcuaagagug

SEQ ID NO: 71654 - RNA, 64 nt, Human
gucuggcugccuguggccuggagggacccccucaagaggagacaaagccuaaguuuggggauug

SEQ ID NO: 71655 - RNA, 64 nt, Human
uccaggcugagagcacuggacguggcaacuguucagaggagaggcagucuucaaguucuacauu

SEQ ID NO: 71656 - RNA, 64 nt, Human
uuccaugguaacacaucccuaauuuuaccagggaagaggagaguacucacuuuaccaucuuuga

SEQ ID NO: 71657 - RNA, 64 nt, Human
agagcuaauguuuguccuaaauuuucaggacccuagaggagagcuuuauacaauuaccgaugug

SEQ ID NO: 71658 - RNA, 64 nt, Human
accgugacaucuccccuaggcuccccagcagccaagaggagaggaaugucagguagcugccccu

SEQ ID NO: 71659 - RNA, 64 nt, Human
uagugcugaaugagcaggggcauugccugcaaggagaggagacccuuggaauuguuuugcacag

SEQ ID NO: 71660 - RNA, 64 nt, Human
ugcccucuucggcagccaagggugaaggccccauagaggagaggauccaaaggagcauugagga

SEQ ID NO: 71661 - RNA, 64 nt, Human
agggauuuuagcagagacuuuagucuuuggggcaagaggagaacaggaaugcugggcuguuuac

SEQ ID NO: 71662 - RNA, 64 nt, Human
cuccaggaucugguauacuguucucauaaaacugagaggagaaaaaaagugaaagaaagcagcu

SEQ ID NO: 71663 - RNA, 64 nt, Human
gaagacuuaccaaaugaauuuuagaucauucuccagaggagauuuuuuuugcucuucucaucuu

SEQ ID NO: 71664 - RNA, 64 nt, Human
uuuuagcuucuguuuguggaguugucuccagauaagaggagaugugccuucccaauaacucuuu

SEQ ID NO: 71665 - RNA, 64 nt, Human
agguggcuuauagaacagaagcagauggauaugaagaggagaggggaccagaccaucuccgcaa

SEQ ID NO: 71666 - RNA, 64 nt, Human
gguugcaggaccucaggugagaagcagaggaaggagaggagaggggcacagggucucuaccauc

SEQ ID NO: 71667 - RNA, 64 nt, Human
aucccaaaagcuguuuucagguauaaggacaaggagaggagacaagugacgacagccauucccc

SEQ ID NO: 71668 - RNA, 64 nt, Human
gggccagagccuggcuggggcaucucugcggggcagaggagaaggcuuucacagcuguucccug

SEQ ID NO: 71669 - RNA, 64 nt, Human
uuuuguauuuauuugucccaagugucuuuuuguaagaggagaauaaacaauaaggaauuacuga

SEQ ID NO: 71670 - RNA, 64 nt, Human
cuggcuaccucaccgggcuguuauugcuggaaucagaggagauaacauauauggaagauaaagu

SEQ ID NO: 71671 - RNA, 64 nt, Human
aaagggaauuuuagugacaccuuaugccauuucaagaggagaaaugcaggcuggcagagcaauu

SEQ ID NO: 71672 - RNA, 64 nt, Human
gcacagcugggccugcugugaccacugggagggaagaggagaggaggucagaggaccuggguga

SEQ ID NO: 71673 - RNA, 64 nt, Human
ugccagggcuuaaagcccgcugcuccuuuucgguagaggagaggcccaucacuggugugguggg

SEQ ID NO: 71674 - RNA, 64 nt, Human
uguugguggugcagccccaggaccaagcuuaaggagaggagagcaucugcucugagacggaugg

SEQ ID NO: 71675 - RNA, 64 nt, Human
gugaccccaucucugcugcuucugggccugauggagaggagaacacuagacaugccaacucggg

SEQ ID NO: 71676 - RNA, 64 nt, Human
gccccugggguggguuuagcaggcugcagcaggcagaggagaguaccccccugagagcaugugg

SEQ ID NO: 71677 - RNA, 64 nt, Human
aggguuugaguuucuucuuccccuugagcuucagagaggagaguuggcaugguuaaaucugaau

SEQ ID NO: 71678 - RNA, 64 nt, Human
caugaaacugaauaaaagaaauccuuuccgagauagaggagauuuguaggugaaugcagaagug

SEQ ID NO: 71679 - RNA, 64 nt, Human
gcauuacccaaauaaacugugcauaugaaaugggagaggagaugccaaaacgccagaugaaagc

SEQ ID NO: 71680 - RNA, 64 nt, Human
gagucagagcggguuuggggcugaccaguuugggagaggagaaaagaucugagaauguccuucu

SEQ ID NO: 71681 - RNA, 64 nt, Human
ggggcugcuggggcaugugugccuguggcagaaaagaggagacccuggaauucagcacccuggg

SEQ ID NO: 71682 - RNA, 64 nt, Human
guggaacuaauugcccgagggcucagcaaggccaagaggagacagccgugacgguaaacuuccc

SEQ ID NO: 71683 - RNA, 64 nt, Human
guggccacagaaaauucuucuccacuuucuagccagaggagagaggacccccugaauuucucac

SEQ ID NO: 71684 - RNA, 64 nt, Human
cugaaaagccacucuggaccuagccugucccagaagaggagaaugcacaaguguaacuccuggu

SEQ ID NO: 71685 - RNA, 64 nt, Human
gcugagggcggccggcgcccgcccggcgugccggagaggagaaagggcccgacugcccgccgga

SEQ ID NO: 71686 - RNA, 64 nt, Human
ugugcaauuguuggggaggguagggggaaaggcgagaggagauacuuauuggucuuuuuguuua

SEQ ID NO: 71687 - RNA, 64 nt, Human
uagcccucucccucuaggcucugccuucgaggucagaggagagauagccuguggcccuguccug

SEQ ID NO: 71688 - RNA, 64 nt, Human
caugaugggcuguucuauaaagcauucuaaguggagaggagacgauagggcauaugaaauucac

SEQ ID NO: 71689 - RNA, 64 nt, Human
agagaauucaaauuguuaaaacauuggcauuugaagaggagaacaaaauguagcaugauguauu

SEQ ID NO: 71690 - RNA, 64 nt, Human
uccauucuccauauccuggguaagaauguaaauaagaggagaaggaagagucuaauaguaauua

SEQ ID NO: 71691 - RNA, 64 nt, Human
agaagaaaugaguaccaacaggaaggaauggaagagaggagaggggcuaagacauugcugaucu

SEQ ID NO: 71692 - RNA, 64 nt, Human
acaaacuggccaccguccgaauaacagacagcccagaggagauagugcagaaauuccgcaaggc

SEQ ID NO: 71693 - RNA, 64 nt, Human
uguuuuuggaaagaaauucugaagagaguggaggagaggagaaauguccucauauuugaggacc

SEQ ID NO: 71694 - RNA, 64 nt, Human
gucacuuuaagcucuggggaaaaaggagaaagugagaggagaguucucugcauccucccuccuu

SEQ ID NO: 71695 - RNA, 64 nt, Human
gacuuuucaccuuaaugcauauuccccucuccauagaggagaggaaaagguguaggccugccuu

SEQ ID NO: 71696 - RNA, 64 nt, Human
aucucuguuuaggugccucuacuugggagcgggaagaggagaugacaggaagcgacgccucugg

SEQ ID NO: 71697 - RNA, 64 nt, Human
ucccuccaggccagaaaguuuucuuugaggaaggagaggagaggguggcaaugaugccuuugau

SEQ ID NO: 71698 - RNA, 64 nt, Human
ggaaagggaagaaaaagaagagguggcaccaugaagaggagaagaugggggucuuggaggaagg

SEQ ID NO: 71699 - RNA, 64 nt, Human
ggcagaaauggccucuccccaaagccucuuuuugagaggagagggaagccuauuuuguuaacug

SEQ ID NO: 71700 - RNA, 64 nt, Human
uggagacggaaaaacuggaauucuaacaaggaggagaggagacuaaaucacaucaauuugcaac

SEQ ID NO: 71701 - RNA, 64 nt, Human
gggaaggauguuuagcaguggcuggugcccaugaagaggagauuggccagugagaagcugaggc

SEQ ID NO: 71702 - RNA, 64 nt, Human
uauuuuuuggcuccaaaacuggauugcaaaagaaagaggagaagaauauuuuguguguuccugg

SEQ ID NO: 71703 - RNA, 64 nt, Human
ucuaccugggagacuaguuagcaguccacauucaagaggagacuuggaguuuauuguuuuuuaa

SEQ ID NO: 71704 - RNA, 64 nt, Human
auauaauacuuguucaugagcacugaaauccugaagaggagagauuugguuauaaauuaaaaag

SEQ ID NO: 71705 - RNA, 64 nt, Human
ccccagucaccuaagcaaucacugggcccagaggagaggagacagacacacacuggcuccugga

SEQ ID NO: 71706 - RNA, 64 nt, Human
ugucaccccagucaccuaagcaaucacugggcccagaggagaggagacagacacacacuggcuc

SEQ ID NO: 71707 - RNA, 64 nt, Human
uccucacagagguccggguuuaguauaugucuugagaggagacuugugaauucccagacucugc

SEQ ID NO: 71708 - RNA, 64 nt, Human
aagggacuggacgcccucauucagcugccuccuuagaggagagggcauccccuuuccagggagg

SEQ ID NO: 71709 - RNA, 64 nt, Human
accuguggcuaucuuaugugaggacuagaggugaagaggagauggacacugccucuggagccag

SEQ ID NO: 71710 - RNA, 64 nt, Human
ccugucagugugcaaagcuguaaucucauggacuagaggagagggggccaaggggauggacagg

SEQ ID NO: 71711 - RNA, 64 nt, Human
gucgcacauuuuccacaauacauugcuaaaauaaagaggagaaaggcuuaggaaguuuuuuugc

SEQ ID NO: 71712 - RNA, 64 nt, Human
cccuccugaacugcacuacaagacacuuuguagaagaggagaugagaguuucuagucauuuucc

SEQ ID NO: 71713 - RNA, 64 nt, Human
ggcacagaugucuguucagcaggugugugggccuagaggagagagcagagcccagaaaugucuu

SEQ ID NO: 71714 - RNA, 64 nt, Human
gugcuauugugcaguaacuaauaguacucuuaccagaggagaaauuauauuaacgacccugcua

SEQ ID NO: 71715 - RNA, 64 nt, Human
ugucacaacauucuccaagcagugauauuucuaaagaggagauacauguugaaaacgguuuuaa

SEQ ID NO: 71716 - RNA, 64 nt, Human
ugguccuguguugcuuuuaaaaacaccuuauaaaagaggagaguauuugauaagcaauuuucau

SEQ ID NO: 71717 - RNA, 64 nt, Human
uuuuauaaucaggauugcauuugugcuggguaaaagaggagagcugugcuuucuaccccaaagu

SEQ ID NO: 71718 - RNA, 64 nt, Human
agucacauguauguauuaaacauugaggcucuguagaggagagaggauguaccucucuggugcu

SEQ ID NO: 71719 - RNA, 64 nt, Human
aauaacuaguuaugggucuauuucuuccaugauuagaggagagagaacuugauucaagauacug

SEQ ID NO: 71720 - RNA, 64 nt, Human
auuauuauucaaaaacauaacugaguuuuuuaaaagaggagaaaauuuauaucuggguuaagug

SEQ ID NO: 71721 - RNA, 63 nt, Human
ggcgguuccaggucuugugagcccaggaaugaaagaggagaagaaacgcaacuaccugcgccc

SEQ ID NO: 71722 - RNA, 64 nt, Human
cugagugcuggacacugcguuccagaaaugaggaagaggagagagaagagauggacagaccuca

SEQ ID NO: 71723 - RNA, 64 nt, Human
cuguacauaguugguguuuaaugaguguuuauggagaggagaguucuaaggucaccucuggcug

SEQ ID NO: 71724 - RNA, 64 nt, Human
aaagucgggguuuauuacuuuauauguaaugcugagaggagacuguugggaacaguuaugucaa

SEQ ID NO: 71725 - RNA, 64 nt, Human
cucacuggugggugggaauaaaauggaagugcacagaggagaugucagaagaccaaaacuuggu

SEQ ID NO: 71726 - RNA, 64 nt, Human
aaacauuucugcagucaggugagacuuuuacaaaagaggagaaaaucaaugccuccuugaacau

SEQ ID NO: 71727 - RNA, 64 nt, Human
guuuccuuguaugaaaaggagaggacacagagacagaggagaugcggggaagacuauguaaaga

SEQ ID NO: 71728 - RNA, 64 nt, Human
accuugugccuccugugggaggcugaggacugcaagaggagagcuagcagauaugccuguucac

SEQ ID NO: 71729 - RNA, 64 nt, Human
ggggucuuuuaaaaauauaaagcuugugauaaagagaggagaauaugggacuccaugaaccagu

SEQ ID NO: 71730 - RNA, 64 nt, Human
cccuccccaccuuucccaccccagcccucuugcaagaggagaggcacgguagggaaaagaacug

SEQ ID NO: 71731 - RNA, 64 nt, Human
agggcaaauugaaagucaaggagaaaaagcgcaaagaggagaaugaagauccagaaaggaaaau

SEQ ID NO: 71732 - RNA, 64 nt, Human
uuucuuuggucugugagcaacucaaagaggcagaagaggagaaugacuuuuccagaauagaagu

SEQ ID NO: 71733 - RNA, 64 nt, Human
uuguaacuggucaccacuggacgggaaggagaacagaggagagggaaagagaagcccaaccucu

SEQ ID NO: 71734 - RNA, 64 nt, Human
gacagugagacucugucucaguccaugaagauguagaggagaaacuggaacucucgagcguugc

SEQ ID NO: 71735 - RNA, 64 nt, Human
ucuuggcaaggcagcaucgccuuggcucuugggaagaggagauuggaccacaugaucuuauagg

SEQ ID NO: 71736 - RNA, 64 nt, Human
agaaggagagaaagugggugagaugcuggagaagagaggagaggagagaggcagagagcggucu

SEQ ID NO: 71737 - RNA, 64 nt, Human
gagagaaagugggugagaugcuggagaagagaggagaggagagaggcagagagcggucucaggc

SEQ ID NO: 71738 - RNA, 64 nt, Human
agcuuguaacucugacugcggagagugaguggagagaggagaggcaacgaaguccuuagcacug

SEQ ID NO: 71739 - RNA, 64 nt, Human
guuuggaggaggccaagugaaugugcagcuucaaagaggagaguucguugucucccuggaugau

SEQ ID NO: 71740 - RNA, 64 nt, Human
ccucgcuuuaccggaguagggggugggagagggaagaggagagaaaauacagggacuuugaacc

SEQ ID NO: 71741 - RNA, 64 nt, Human
ucugagguuccaacucagucauucuuuguccagcagaggagaaucagaaaugagcccuucagga

SEQ ID NO: 71742 - RNA, 64 nt, Human
cugugaccuuauacauguugggguuugcucuuaaagaggagagcaggaagaaagguugguuuca

SEQ ID NO: 71743 - RNA, 64 nt, Human
guguaugucuugccuucuccgcgucauuguuggaagaggagagaugcaucgagcagucccagcu

SEQ ID NO: 71744 - RNA, 64 nt, Human
gugaggacaggcuccugauuccucuuccuucuuuagaggagaagcggggaguggguuaacuaac

SEQ ID NO: 71745 - RNA, 64 nt, Human
cguuuuucaucuuuugaagagcaaagggaaaucaagaggagacccccaggcagaggggcguucu

SEQ ID NO: 71746 - RNA, 64 nt, Human
cuuuaaaaaaauguaaauuuuuuaaaaaguccacagaggagaauuugcugguuagcacaaaaca

SEQ ID NO: 71747 - RNA, 64 nt, Human
ggagguccugaugucaucacugcacgcaggugugagaggagagaccucuucugcaccgccuggc

SEQ ID NO: 71748 - RNA, 57 nt, Human
uugaugguaacaguaagugauuuggguagaggagaggacauaaauaaauacaugguu

SEQ ID NO: 71749 - RNA, 64 nt, Human
aaaugacagcagaagccauggcacagacuuguauagaggagaaaaaauguacagagagcaccca

SEQ ID NO: 71750 - RNA, 64 nt, Human
caguuuuuguacuaauguuuguuuuuguucgggaagaggagauuugcuuuuaauccuuccaaaa

SEQ ID NO: 71751 - RNA, 64 nt, Human
gcauuacuuuccacuucuacuuacaguaauugcaagaggagaccucacauucaggacuggccua

SEQ ID NO: 71752 - RNA, 64 nt, Human
uccccugcccugguuacagacagcuucgagaaccagaggagaagagcauagggucauggagcag

SEQ ID NO: 71753 - RNA, 64 nt, Human
ccuuucugggcuuuguuagucagagcaggggaucagaggagacugaagcagaaacccugcacac

SEQ ID NO: 71754 - RNA, 64 nt, Human
cuuguguaguugggccccuccaggguugaaggcaagaggagaaaggcacagcguuugggaaaca

SEQ ID NO: 71755 - RNA, 64 nt, Human
cauguugggaaagagauggauguuggggaggaagagaggagauggauuucaguugggaguuagg

SEQ ID NO: 71756 - RNA, 64 nt, Human
acuucuauuagcagugaugauggaaggcgagcuaagaggagacuuagauccagugggaaaaaaa

SEQ ID NO: 71757 - RNA, 64 nt, Human
ucugcacuccugauaggaguuccccagcaaaaguagaggagacuuccccucuaggaaaugcacg

SEQ ID NO: 71758 - RNA, 64 nt, Human
ggaaaagagaggcuuuucuucaucgagagcuaccagaggagauauuaucuguccucuguguggc

SEQ ID NO: 71759 - RNA, 64 nt, Human
guaaguuugccuaggcuguugguguacagagaccagaggagagagacacacuaggacuaacaau

SEQ ID NO: 71760 - RNA, 64 nt, Human
agaaggcauaugacaguagagaggacuggaauauagaggagaauauaagcauguagaugaggau

SEQ ID NO: 71761 - RNA, 64 nt, Human
aucuuggugucuacguuaccaggcaggaaggcugagaggagagagacuccagcuggguuggaaa

SEQ ID NO: 71762 - RNA, 56 nt, Human
uuuuuucucuuucuuuagaguaaaugagaggagacauacaaagcugcucugaagga

SEQ ID NO: 71763 - RNA, 64 nt, Human
guccuuugaaaggguauucuagaaaucacuggaaagaggagaggaaagaaccagguaggcaaau

SEQ ID NO: 71764 - RNA, 64 nt, Human
ccucccuguaacuccagcucugcuccguaugccaagaggagacuuuaauucucuuacugcuucu

SEQ ID NO: 71765 - RNA, 64 nt, Human
auaacugcacugugaugaagaagcuguuccccacagaggagaagcucugcuuucuuucucucca

SEQ ID NO: 71766 - RNA, 64 nt, Human
guuggcccaaucggccuauuggcucaaugggaagagaggagagggagaaaaauaaaaugaaagg

SEQ ID NO: 71767 - RNA, 64 nt, Human
gucucuuaacuccugcccucaagugauccaccagagaggagauccucggccuccccaagugcug

SEQ ID NO: 71768 - RNA, 64 nt, Human
uaagugucucuacuaucuuugccuccagauuucaagaggagaaauuuaguuuuaaaccugaaua

SEQ ID NO: 71769 - RNA, 64 nt, Human
caaagaaaaacgagggaaaugggaggggugcaaaagaggagaguaagaaacagcauggagaaaa

SEQ ID NO: 71770 - RNA, 64 nt, Human
uucaugaaucugguaaaacagucucuuguucuuaagaggagauguagaaaaauguguacaaugu

SEQ ID NO: 71771 - RNA, 64 nt, Human
caagaucauaccacugcacuccagcccuggugacagaggagaccccgucucaaaaauugauuga

SEQ ID NO: 71772 - RNA, 64 nt, Human
cuaaauggacaucauguuuucuggugaugcccaaagaggagagaggaagcucucuuucccagau

SEQ ID NO: 71773 - RNA, 64 nt, Human
ccugucgagggugccaguuagcugaugcgaggguagaggagagacguggguugagaauagugua

SEQ ID NO: 71774 - RNA, 64 nt, Human
auggaugcuguuuuuauugggcaugucaucuaagagaggagaaauagcuggguuuugggucuaa

SEQ ID NO: 71775 - RNA, 64 nt, Human
uggcuuuuauugccugaaccuuaugcugaccuggagaggagaugggggacagugcuguuguggg

SEQ ID NO: 71776 - RNA, 64 nt, Human
cauauugucaguccuacaaaaauaaaaggcuuccagaggagaguggccugggucccagggcugg

SEQ ID NO: 71777 - RNA, 64 nt, Human
gcuugcucuucuaucuccacaacgugagccuggaagaggagaaaauguggcuccucuggagcuu

SEQ ID NO: 71778 - RNA, 64 nt, Human
uaccccuggagaaguuccuuagcagggaggaggaagaggagaggaggaagcaaagaaucacaag

SEQ ID NO: 71779 - RNA, 64 nt, Human
gguagcagguagcucucuagggagaguugcaggcagaggagauugggucuugacugguguccuc

SEQ ID NO: 71780 - RNA, 64 nt, Human
caacuuaggcugugcgguuagccagccuguaaugagaggagagaggccugagucaccuagcaua

SEQ ID NO: 71781 - RNA, 64 nt, Human
gggccuuaucgggcuccagccaucucaugaggggagaggagacggaggggaguagagaaguuac

SEQ ID NO: 71782 - RNA, 64 nt, Human
gcgggcagacauccugugaagcaggaccugcugaagaggagacuuucuaugcccuugguccgua

SEQ ID NO: 71783 - RNA, 64 nt, Human
gucugcuuccugcccaggaaggugccugcacaugagaggagagaaauacacgucugauaagacu

SEQ ID NO: 71784 - RNA, 64 nt, Human
ggcauaaacuuucaaucaaaugaagaguuugccuagaggagacuaauucucuuucuagcccauc

SEQ ID NO: 71785 - RNA, 64 nt, Human
uuucagaucauguaaccuauuacgaaggaguggaagaggagacaauuugaaugaauccucauga

SEQ ID NO: 71786 - RNA, 64 nt, Human
uaacuuuccuauguaaaaugugcugacucccaaaagaggagaaaugcaauggcuugagcuugca

SEQ ID NO: 71787 - RNA, 64 nt, Human
caggcuuccaagaaagaggaggagaguugaaaagagaggagaagacucggaauucccugagucc

SEQ ID NO: 71788 - RNA, 64 nt, Human
uuccucuugcaguuguucuuuaaucuccuuuacuagaggagauaaauauuuugcauauaaugaa

SEQ ID NO: 71789 - RNA, 64 nt, Human
ugcagaaggugcaauguagggguucuggggccacagaggagaggccacuucccaccaggacccc

SEQ ID NO: 71790 - RNA, 64 nt, Human
uggucccaggagcucaggaggaggaccccaggggagaggagagcugugagagcaccggcacccc

SEQ ID NO: 71791 - RNA, 64 nt, Human
ggaaaaaaaugucuugcaaugugcuguaaucacaagaggagaaaauaacuuguuuccuugaucu

SEQ ID NO: 71792 - RNA, 64 nt, Human
ucuuuauuuugcagaugaggaaacagcaacccagagaggagaacuaacccacacaggaucauuu

SEQ ID NO: 71793 - RNA, 64 nt, Human
gcgucacaaauaucccccauccugggcuuuucccagaggagaugggggcuucugaagauggacu

SEQ ID NO: 71794 - RNA, 64 nt, Human
cagucugaagaccucgucaccugugaguugauguagaggagagccaccugacagcugaccaggu

SEQ ID NO: 71795 - RNA, 64 nt, Human
acugcaaaaauacaauggccuacauuggauuuguagaggagaaaggagcccuguauugugagcu

SEQ ID NO: 71796 - RNA, 64 nt, Human
uuauucacuaaaauuuucagcagacucaaaauagagaggagacuuuaaacuuacauguuagcau

SEQ ID NO: 71797 - RNA, 64 nt, Human
ucccguuagccaaaauaugccagaaaugggaaagagaggagaaaaagucauuaacauuaacacc

SEQ ID NO: 71798 - RNA, 64 nt, Human
auauuuuggaacuuuaguuccucugugagacgaaagaggagagcuauguuuuguggcacauugu

SEQ ID NO: 71799 - RNA, 64 nt, Human
uccuguggcaugaaaaauagcucccaagauauagagaggagaggagugaagaaaaggcuguggu

SEQ ID NO: 71800 - RNA, 64 nt, Human
guaauuuucaggaagaugauuuguucuuuccagaagaggagacaaaagcaagauagccaaaugu

SEQ ID NO: 71801 - RNA, 64 nt, Human
uguguuuuugauacaucuccaugaaguucuuuugagaggagaggcuauuuugauguuuuuauac

SEQ ID NO: 71802 - RNA, 64 nt, Human
aagagauaagugcaucaugaauuacauguacaugagaggagauagugauaucagcauaaugauu

SEQ ID NO: 71803 - RNA, 64 nt, Human
accauuagggaaaagaaauuccugcacaaugggaagaggagaaugguguggauaugguucugag

SEQ ID NO: 71804 - RNA, 64 nt, Human
uaaagauguuaacgucaggcaguggguuuuuccuagaggagagauuaguaccuauucauuaaca

SEQ ID NO: 71805 - RNA, 64 nt, Human
cuaggacaagggagaacaaaagcaagccagaagcagaggagacuaaucaaaggcaaacaaaggc

SEQ ID NO: 71806 - RNA, 64 nt, Human
uggaugaaaaugagucaugaacacagaaagucuaagaggagaaauaugauggaugaagagcucu

SEQ ID NO: 71807 - RNA, 64 nt, Human
uucugaaaaaaagcauacaucaugauuauggcaaagaggagagaaagaaauuuauuuuacauug

SEQ ID NO: 71808 - RNA, 64 nt, Human
ccuuucaucuucaggauuuacagugcauucugaaagaggagacaucaaacagaauuaggaguug

SEQ ID NO: 71809 - RNA, 64 nt, Human
uaaaacagguuuccaccaguauuuucccugagcuagaggagaagucuuagauuuuaagaguaau

SEQ ID NO: 71810 - RNA, 64 nt, Human
uccauuucguuuagcugaauaaugaguuguuccuagaggagacagccugucucuccuuguugcc

SEQ ID NO: 71811 - RNA, 64 nt, Human
uuugcuauuuucauuuccuguucgucaaagcagcagaggagaucaaaccccguucgugugucuu

SEQ ID NO: 71812 - RNA, 64 nt, Human
cgcgugauagaagaaaagcacugggagaacuaacagaggagaaaggugaaacacacacacauuc

SEQ ID NO: 71813 - RNA, 64 nt, Human
agaagaggaugacauuagauccaggagauacaacagaggagauaaucuccaggaugccugugaa

SEQ ID NO: 71814 - RNA, 64 nt, Human
caguggagccaaagaaaagcaaguugaaaaagaaagaggagacaauuuaacgagcccuaaaggc

SEQ ID NO: 71815 - RNA, 64 nt, Human
uguuauugaucugcuaaaacuaacccucuuuuuaagaggagauuuaaggaagacgucaaucaaa

SEQ ID NO: 71816 - RNA, 64 nt, Human
ugcaucaguacugcaagaaaagaagucaaucagcagaggagagcauuugauaacuaagaggaag

SEQ ID NO: 71817 - RNA, 64 nt, Human
cagaggguagcccuugguacugugggucccucaaagaggagaguggggugcagaaaugccucag

SEQ ID NO: 71818 - RNA, 64 nt, Human
cugggcccagcuaaggaagccaucuguucccagcagaggagagcugcugcgcugaccugcagag

SEQ ID NO: 71819 - RNA, 64 nt, Human
ccucuuugggcagccccagagaugaggggucagcagaggagagcucugggguuggggauggguu

SEQ ID NO: 71820 - RNA, 64 nt, Human
agugggagacuguccccaucaguuguccuuacuuagaggagacagagaggccaaucagguccca

SEQ ID NO: 71821 - RNA, 64 nt, Human
ccaagaggauccaaacuuccugcaacauuuucuuagaggagagagagaaauauuaaaagagaaa

SEQ ID NO: 71822 - RNA, 64 nt, Human
uucuugcaacaaaaacaaaagugauuaugucacgagaggagaggcuggagggccaugggaguuc

SEQ ID NO: 71823 - RNA, 64 nt, Human
caggagagagggacagguucuguugggggugacaagaggagacagggacagguucugucggggg

SEQ ID NO: 71824 - RNA, 64 nt, Human
agauauaaacauaauucaaauauuuaaauauuuaagaggagaaaaguaacuagaaaaccaauga

SEQ ID NO: 71825 - RNA, 64 nt, Human
aagguguuuuacuuucaggcucuuguuuugguucagaggagauuuuaaauauugaaugacacuu

SEQ ID NO: 71826 - RNA, 64 nt, Human; identical to SEQ ID NO: 71813

SEQ ID NO: 71827 - RNA, 64 nt, Human
ccucgccuaguccacugggaucauucagcagagcagaggagaauuguacauuuggggagcugau

SEQ ID NO: 71828 - RNA, 64 nt, Human
gacugugggaggaguaaacaacccagcccaguuaagaggagaugccgaauuuaaugaacccuau

SEQ ID NO: 71829 - RNA, 64 nt, Human
gcgucuucccuugaguuggccaagggaauaagcaagaggagacauuuccucccugccccagcac

SEQ ID NO: 71830 - RNA, 64 nt, Human
cucuucacaucccauugggacuccaugcuccuugagaggagaaaugcaauaacucugggagggg

SEQ ID NO: 71831 - RNA, 64 nt, Human
augaauccugccacacaugcucaucccaaaagcuagaggagauugcucuggggcuugcuauuaa

SEQ ID NO: 71832 - RNA, 64 nt, Human
augggguuggaguggaggaggagcugucucagcaagaggagaccuggggcugugcaucuggaug

SEQ ID NO: 71833 - RNA, 64 nt, Human
agcagauacuguuucucuguguccugaagucgccagaggagaagggaaucauuguuuacacaug

SEQ ID NO: 71834 - RNA, 64 nt, Human
cgcgcaggcagggagaagggccgggggggguaggagaggagaaaaaaaaagugaaaaaaagaaa

SEQ ID NO: 71835 - RNA, 64 nt, Human
aggugagacuucccagaccccggaggcguggaggagaggagacuguuugaugugguacaggggc

SEQ ID NO: 71836 - RNA, 64 nt, Human
cuuauuucuucaaucaggggagagacaugaagacagaggagaaaugaaugcauaaaauaacuga

SEQ ID NO: 71837 - RNA, 64 nt, Human
uuggaaugaggccaacaggguucaccaggaugagagaggagagaggaauccacaggaccaccag

SEQ ID NO: 71838 - RNA, 64 nt, Human
uuggaaugaggccuacaggguucaccaggauguaagaggagagaggaauccacaggaccaccag

SEQ ID NO: 71839 - RNA, 64 nt, Human
uguaagaggagagaggaauccacaggaccaccagagaggagagggaaccagauaugcagaucag

SEQ ID NO: 71840 - RNA, 64 nt, Human
uaucgcaaauuuucuaagccacguccuauaggacagaggagacuggccccacuucuaugggucu

SEQ ID NO: 71841 - RNA, 64 nt, Human
gagcagggaugaagggucaggcagaaagcgugauagaggagagaauuuuugacaaaacucaaaa

SEQ ID NO: 71842 - RNA, 64 nt, Human
auacuucggaaguuaaacaauaaagucagcuuggagaggagaucaugaucuuuauacugugaau

SEQ ID NO: 71843 - RNA, 64 nt, Human
aagagagggacagagagauaaaagaaauugggugagaggagauagguagcuccauaaggcacac

SEQ ID NO: 71844 - RNA, 64 nt, Human
gaauguggggagaaggagaggcugaaaagaaagcagaggagaacccaggucccugccucagccu

SEQ ID NO: 71845 - RNA, 64 nt, Human
guauacugccacaucaguguuugagucaguccccagaggagaggggaacccuccuccaucuuuu

SEQ ID NO: 71846 - RNA, 64 nt, Human
uuugggaacuguguucagagagauuccgaggaauagaggagaguguaagggaguagggggugca

SEQ ID NO: 71847 - RNA, 64 nt, Human
ggagaagcagccuccuaauuugaucacaguggcgagaggagaggaaaaacgaucgcugugaaaa

SEQ ID NO: 71848 - RNA, 64 nt, Human
uccccagccacaccgugcacgaagggggcacaggagaggagaggggcugugccccaggcucccc

SEQ ID NO: 71849 - RNA, 64 nt, Human
uuacauccucucaugaaugaaaugcaguguagggagaggagauggcaggacacagcaaacagga

SEQ ID NO: 71850 - RNA, 64 nt, Human
agaagaguaguuaagcagaugugggggcagggcaagaggagacagcaccuuguugccagagauu

SEQ ID NO: 71851 - RNA, 64 nt, Human
ugcagcugccuauagcauucuccuccauaaggcuagaggagagcuggauauaagcagagaucgu

SEQ ID NO: 71852 - RNA, 64 nt, Human
ggaaaugaugucuuaucuaaugauuugcuucucuagaggagaaaccgaguaaaugugcuccagc

SEQ ID NO: 71853 - RNA, 64 nt, Human
acacuacuuaaugcagugggaaagaaaauauuucagaggagaauuuuuucuuaaagaagcugca

SEQ ID NO: 71854 - RNA, 64 nt, Human
uggcuuuuuucuuuuauuuuuaaaaaacucacauagaggagacaaucagaaauuuaccauaguc

SEQ ID NO: 71855 - RNA, 64 nt, Human
guugcugagcacaaugguuuugucgccguuccugagaggagaaacacaugguaaggcggccugu

SEQ ID NO: 71856 - RNA, 64 nt, Human
aaaaugaugggcuccuccuaauaggaaggcgaggagaggagaaggccaggggaaugaauucaag

SEQ ID NO: 71857 - RNA, 64 nt, Human
uuggcugcauguugaaaaugugauuaaaguuaauagaggagaugaaauaaguauuugagauuuu

SEQ ID NO: 71858 - RNA, 64 nt, Human
agauguaacuaaacuuuuaaaguagcuccuuuggagaggagauuaugaugugaaagauuaugcc

SEQ ID NO: 71859 - RNA, 64 nt, Human
uaaaagucauauagaaauauuaaauaagacggacagaggagaauuugcacuggaagacaauugc

SEQ ID NO: 71860 - RNA, 64 nt, Human
aggagagagacuggaaacguuccuggacugcugaagaggagacccaguuggcuucacuuuuuga

SEQ ID NO: 71861 - RNA, 64 nt, Human
uucucuuuucccagagaccuucugaucuccaaaaagaggagaugacuacauuuagccccucucu

SEQ ID NO: 71862 - RNA, 64 nt, Human
gaccaacugggacucauuauggaagaauggggugagaggagacaugaggaaagacccucuuauu

SEQ ID NO: 71863 - RNA, 64 nt, Human
cugccacuguucugcgcuuuaauugugggagaagagaggagaggagggcucagcgguggggcag

SEQ ID NO: 71864 - RNA, 64 nt, Human
ggaagcagaagcauugaccauuuuuucccagagaagaggagaaaucuguagugagcaaaggaca

SEQ ID NO: 71865 - RNA, 64 nt, Human
cguucucaccacccuucagcuuggguacacacacagaggagaccucagccucacaccagaaaua

SEQ ID NO: 71866 - RNA, 64 nt, Human
ggagaagaugaugcauaaagcugugauacuaaggagaggagagauuaugucauaugcaacugcu

SEQ ID NO: 71867 - RNA, 64 nt, Human
gaaugggucaugaaagcugccauggggugaggaaagaggagacagugggagaggacaaugacua

SEQ ID NO: 71868 - RNA, 64 nt, Human
aagaagcaacucuuaccaugaggugauuucuguuagaggagacauauaaauaagcucaucuagg

SEQ ID NO: 71869 - RNA, 64 nt, Human
cccugggaaagcguuuuugcgucagcuuccuuuuagaggagaugauggaauauuugaugacaau

SEQ ID NO: 71870 - RNA, 64 nt, Human
ugagaaauagguaucaaaauaguuuaggaaaaugagaggagaacaguaggauugcuguggccua

SEQ ID NO: 71871 - RNA, 64 nt, Human
auuugauuugacugcaaaacuuuuuccuccucuaagaggagaugaugucugcuuuaagcuguaa

SEQ ID NO: 71872 - RNA, 64 nt, Human
agcugaucuucuugggggugggaaaaucgaagggagaggagaaaggcgcugcacuuuaaaucca

SEQ ID NO: 71873 - RNA, 64 nt, Human
acggucugagcuagcuagcgcaccgccgaguuaaagaggagaaggaaaacaugcugcucuggug

SEQ ID NO: 71874 - RNA, 64 nt, Human
ccagggaccccuccucaugaacucuggagcccugagaggagaggggcagccccccaccuuguca

SEQ ID NO: 71875 - RNA, 64 nt, Human
ucaccucauuucaccccacgcucugcuggcuggcagaggagaaggcagucguuuccucucugaa

SEQ ID NO: 71876 - RNA, 64 nt, Human
cuucagacaauacgaagacccucugagaugcuacagaggagaggaagcggaguuucacaucugg

SEQ ID NO: 71877 - RNA, 64 nt, Human
auuuaaaaauauucacuuuaguucucugugaagaagaggagaaaagcaauccuccugauuguau

SEQ ID NO: 71878 - RNA, 64 nt, Human
uacaggaaacaagcccuguacuuaccaaggagaaagaggagagacagcagugcugggagauucu

SEQ ID NO: 71879 - RNA, 64 nt, Human
uugauauccuguggugcuaaaguacaguagaaagagaggagaaguguauacauguuuuauuuua

SEQ ID NO: 71880 - RNA, 64 nt, Human
uucaagccauuuucaaauaacuaucuugggggugagaggagaaggagggagggaaaagggguca

SEQ ID NO: 71881 - RNA, 64 nt, Human
aaaaccugggcuggaagucaaagccgucgguuacagaggagacugacagaggaauuccagaaug

SEQ ID NO: 71882 - RNA, 64 nt, Human
auaaagaagaaaggaccaagaaaaccaaaacggaagaggagaaacucaauacaaagacaaguac

SEQ ID NO: 71883 - RNA, 64 nt, Human
cccagcgagaaagaaagcauuuagccauucuuacagaggagaaauuaacccuguaauguguuuc

SEQ ID NO: 71884 - RNA, 64 nt, Human
uucucagagcacugaaaagaaaggaaggguuugcagaggagaguguagaaaucccagugguagc

SEQ ID NO: 71885 - RNA, 64 nt, Human
ggcgagcugggcuggggagagccugugaggaccgagaggagaaaugagaagaaggaacaaaaau

SEQ ID NO: 71886 - RNA, 64 nt, Human
uccccaccuggcacugaggagaaugguagagaggagaggagagagagagagaaugugauuuuug

SEQ ID NO: 71887 - RNA, 64 nt, Human
aucuguccccaccuggcacugaggagaaugguagagaggagaggagagagagagagaaugugau

SEQ ID NO: 71888 - RNA, 64 nt, Human
gaccuuggagaaguuacucuguaggcaugacagcagaggagaaaaucauuuggcaucuugaggu

SEQ ID NO: 71889 - RNA, 64 nt, Human
cauggucuguauagaguguuauacuugguaauauagaggagaugaccaaaucagugcuggggaa

SEQ ID NO: 71890 - RNA, 64 nt, Human
gaggacuggcauugucuggagacggcuuccuggaagaggagacuccagcagagcccugaagugu

SEQ ID NO: 71891 - RNA, 51 nt, Human
uguauagcacaugcuuguaacagaggagaauaaaaaauggcugaggugaac

SEQ ID NO: 71892 - RNA, 64 nt, Human
gggagggucgagccgaagucuccggcgggccgcaagaggagaagggggcguggcugcgucccgg

SEQ ID NO: 71893 - RNA, 64 nt, Human
ucucaggccucggauaggaagcugccugccagcaagaggagacugaugugccccgggugcaccc

SEQ ID NO: 71894 - RNA, 64 nt, Human
acucggagagggcugcgagcauuucccucccgggagaggagaucagggcgaccugcacgcacug

SEQ ID NO: 71895 - RNA, 64 nt, Human
aagcugaguguucccaccaggaagucacgcgcagagaggagagucuuacggagggcugggagcu

SEQ ID NO: 71896 - RNA, 64 nt, Human
cuauccacaggagaaaagugugugcuuuaguauuagaggagauaggcagagaagucuugcuuag

SEQ ID NO: 71897 - RNA, 64 nt, Human
cgagggcaugcaagaguuucucuuccagaagccaagaggagaacaaagguccuaaugcuguacu

SEQ ID NO: 71898 - RNA, 64 nt, Human
ucauugggaaacuuaaagucuauucuacuuugcaagaggagaaauguguuuuaugaacgauaga

SEQ ID NO: 71899 - RNA, 64 nt, Human
aauguguuccucagcgacaguguagcgucauguuagaggagacgaucugacccaccaguuugua

SEQ ID NO: 71900 - RNA, 64 nt, Human
uggggaccaaaagggagagagccuggggucuacaagaggagacacaucaucaaauguuugaaug

SEQ ID NO: 71901 - RNA, 64 nt, Human
augcaacauuuuccuaucaugaaaucucuuucagagaggagaauacaacaucuuaguccagaca

SEQ ID NO: 71902 - RNA, 64 nt, Human
agguagaucuucauagauuuuuuuuucuuuuguuagaggagagcuugaugugauuaucuucaaa

SEQ ID NO: 71903 - RNA, 64 nt, Human
aagcaaguagcuuuccacauuugucacagaaaucagaggagagacgguguugggagcccuuugg

SEQ ID NO: 71904 - RNA, 64 nt, Human
aguuucuaggaaugcuaaaauaucagaaggcaggagaggagauaggcuuauuaugauacuagug

SEQ ID NO: 71905 - RNA, 64 nt, Human
ggcuguuugggggaugauggaggugacaucaggcagaggagagugcagccucacagugacuuuc

SEQ ID NO: 71906 - RNA, 64 nt, Human
cuuagagaaggcuuuuaguggcaacaaaggaugaagaggagagaaaaggaacucacauuuauug

SEQ ID NO: 71907 - RNA, 64 nt, Human
guuuccggggaacaaugacggggugggagaggggagaggagagaguuugggaaagggagaugga

SEQ ID NO: 71908 - RNA, 64 nt, Human
aacuucuggccgacgagaagaugaagcagcucacagaggagacggaggugcuggcacaugagau

SEQ ID NO: 71909 - RNA, 64 nt, Human
uggaggaauagagauggucaauuaacaaucaaaaagaggagauuaaccucuuguuuuuuuacca

SEQ ID NO: 71910 - RNA, 64 nt, Human
aucaggguagcaaacucaaaugcugacaggggccagaggagauauggggaaggagcaucagaaa

SEQ ID NO: 71911 - RNA, 64 nt, Human
acaugcaucaucuguacuugaagaggccagugggagaggagaggagggggaggucauuuaucug

SEQ ID NO: 71912 - RNA, 64 nt, Human
caaugcccaguaaaauuucaggauuaacuaaagaagaggagaaaaagaagaaaagauucuucuu

SEQ ID NO: 71913 - RNA, 64 nt, Human
uuucuaagcugugaacauuucaagauaaauuaacagaggagaggaaaaagauggcucagcuauu

SEQ ID NO: 71914 - RNA, 64 nt, Human
gacuugagaggugacaauuaaagaucuaaaaaagagaggagauucccccaaacaacaauauuua

SEQ ID NO: 71915 - RNA, 64 nt, Human
cuuaauuccuaaacuaccuuagcugcauaguggaagaggagagcaugaagcaaagaauuccagg

SEQ ID NO: 71916 - RNA, 64 nt, Human
ccaucugaaggucucuuugcauuucuccaugcaaagaggagaaagcuuuugcuuucacacuguc

SEQ ID NO: 71917 - RNA, 64 nt, Human
uuggcugguucucucauugaauuaucagaccccaagaggagauauuggaacaggcucccuucau

SEQ ID NO: 71918 - RNA, 64 nt, Human
cugggagcagaauggcuggccugcugugagcaggagaggagauucuaagaaggauagucccccc

SEQ ID NO: 71919 - RNA, 64 nt, Human
ccgggugccuuuaggcccguccaggaguuggagcagaggagaagacccagacugugcauaguuc

SEQ ID NO: 71920 - RNA, 64 nt, Human
aaaauucauaucugauuaacauuuuuaauaacuuagaggagauuuuaacuuuauuuaaaaauag

SEQ ID NO: 71921 - RNA, 64 nt, Human
auguauuuuuauguauuuaugccuugugacuaggagaggagauuuucaugggucacaaaauucu

SEQ ID NO: 71922 - RNA, 64 nt, Human
cccaucucuaagucacucugaaagggaguuguggagaggagacgccuccagacucucagaaguu

SEQ ID NO: 71923 - RNA, 64 nt, Human
gcuucguccgagaaacgccaggacagacgauggcagaggagagggcuccugugacggcggcgag

SEQ ID NO: 71924 - RNA, 64 nt, Human
uuguggaaaaggaacacgcaaagggagaagugugagaggagaaacaaaauaugagcguuuaaaa

SEQ ID NO: 71925 - RNA, 64 nt, Human
agcaagccugaaaccaagcaauugagagugagaaagaggagagagacuauucuccaaaccuuuu

SEQ ID NO: 71926 - RNA, 64 nt, Human
auauauucuccuuuuaaugguggggggcuacuggagaggagagacagcaaguccacccuaacuu

SEQ ID NO: 71927 - RNA, 64 nt, Human
agugaacaccaagggaaaauaccacaaugauuucagaggagacucugcaaaaucgucccuugug

SEQ ID NO: 71928 - RNA, 64 nt, Human
ucccagccaagaguaugagaacauccagucgagcagaggagauucauggccugugcucggugag

SEQ ID NO: 71929 - RNA, 64 nt, Human
cgaugauggcucaggcucagccugggcacgccccagaggagagagauggaguggggccucaaag

SEQ ID NO: 71930 - RNA, 64 nt, Human
cuucucugcccucaagggaaccccacaguaucuuagaggagacaaucaugucggugagauggug

SEQ ID NO: 71931 - RNA, 64 nt, Human
aaagaagggaaaacuggcaugacaaaagcuacagagaggagagugaaauauagaaguguuugaa

SEQ ID NO: 71932 - RNA, 64 nt, Human
ccuacccaauugccagggcaagguggggugugagagaggagaaaagucaacucauguacuuaaa

SEQ ID NO: 71933 - RNA, 64 nt, Human
auaauugagaugggaaagaauagugcagcuccauagaggagacggacuguagacaaugagauua

SEQ ID NO: 71934 - RNA, 64 nt, Human
agaccuauggagggacaguuuugaccugaccccuagaggagacaguuuugaccucuucagcacc

SEQ ID NO: 71935 - RNA, 64 nt, Human
uaggccacccagccugugggaccucaggagggucagaggagaagcagccuccgcccagccgcua

SEQ ID NO: 71936 - RNA, 64 nt, Human
ggccacuguuggguggagagcagcacauucuuacagaggagauggagcguuaugagcauaguau

SEQ ID NO: 71937 - RNA, 64 nt, Human
uugugcagaguaguuuauuccuucugaccaucauagaggagacauuaaauaaauuaugcauuua

SEQ ID NO: 71938 - RNA, 64 nt, Human
gucuauaagauaauauauguugaucccuugcuguagaggagaauuuagaguaauuugggguuug

SEQ ID NO: 71939 - RNA, 64 nt, Human
caugcauggacaccagaagacgauucagaacacaagaggagaaugagcuggagcgccagcacca

SEQ ID NO: 71940 - RNA, 64 nt, Human
ccuucccagaagguugauucuuggccugggugguagaggagauauccugacccuaaagucuucc

SEQ ID NO: 71941 - RNA, 64 nt, Human
gcaauauuaugugucccuuuggaccagucucccaagaggagaggggcaggcaggaaagaguggg

SEQ ID NO: 71942 - RNA, 64 nt, Human
caucucuagugacuucaauaaagaaaaaacuagaagaggagaaaaaggauuuccucaaauuuua

SEQ ID NO: 71943 - RNA, 64 nt, Human
uuuuuuuguuguuguuguuggggucaaguuggugagaggagagcucauuguuugaagaaaaacc

SEQ ID NO: 71944 - RNA, 64 nt, Human
ucuagaaacaggguugaaguucccagauucccugagaggagaauguguauaggaggguuuggcu

SEQ ID NO: 71945 - RNA, 64 nt, Human
cuuugguaucguaucgccucuguguccuuuuaagagaggagaguucaguaccccgugcuuucuu

SEQ ID NO: 71946 - RNA, 64 nt, Human
gccggggaggacgauggccccgacccuggcagcgagaggagaccaggaggcuaggacccuggcc

SEQ ID NO: 71947 - RNA, 64 nt, Human
cugauaccuagcuccccaagcugacugggcuggcagaggagaacauguugagacaagggaggca

SEQ ID NO: 71948 - RNA, 64 nt, Human
ggcagauuuucaugcaaaaguucucauaugaguuagaggagaaaaagcuuaaugauucugauau

SEQ ID NO: 71949 - RNA, 64 nt, Human
acagcuuuccuucacuuaguuauuugagugugggagaggagaccaggucacccgauucccgcca

SEQ ID NO: 71950 - RNA, 64 nt, Human
guaauugaaugagaugaagaaauaugucauaauuagaggagauaaaucuccuuguuaucacaau

SEQ ID NO: 71951 - RNA, 64 nt, Human
caggcugggacugaucagaggugaagggacagagagaggagaggaggaagauugagcugggggc

SEQ ID NO: 71952 - RNA, 64 nt, Human
caaaacuaaaauagauguuuauauagaaagcccaagaggagacuuuugccaugccugaguucuu

SEQ ID NO: 71953 - RNA, 64 nt, Human
aagacuacucagcuaacagaauaaacgacucugaagaggagaagcccccaguuaggagaagaca

SEQ ID NO: 71954 - RNA, 64 nt, Human
uggacuguccaacagaaagaugucaacaaggaaaagaggagagccaagcgcuagcaugccuuuu

SEQ ID NO: 71955 - RNA, 64 nt, Human
caaguuucaacaauuguaaauauuucuuccuugaagaggagagcuuggguggggguuggguggg

SEQ ID NO: 71956 - RNA, 64 nt, Human
ugcccacgccgccucagccugccaccucccaccuagaggagaccaugggcccugccccacccac

SEQ ID NO: 71957 - RNA, 64 nt, Human
ugcagaagaauccgaguguuugccaggcuuaaggagaggagaaacugagaaaugaaugcugaga

SEQ ID NO: 71958 - RNA, 64 nt, Human
cacuaagccugaccucucccaaauugggaagaccagaggagaaagugcaaaacuguccccauuu

SEQ ID NO: 71959 - RNA, 64 nt, Human
ucuggaauuuuggucacaagagggaaggacuuggagaggagaauuaguuuucuaggcucauugg

SEQ ID NO: 71960 - RNA, 64 nt, Human
cccugaggccaucaucaaacaggacagaguuggaagaggagacugggaggcagcaagagggguc

SEQ ID NO: 71961 - RNA, 64 nt, Human
gccagcuauugacacagcugcgaagugcccaggaagaggagaaccggcagcugcuggcugaagu

SEQ ID NO: 71962 - RNA, 64 nt, Human
agcccugcuguccugagcgucuccugggccagagagaggagaugggggugggagggacugaguu

SEQ ID NO: 71963 - RNA, 64 nt, Human
uuccugcaccucagcagccagggaagcagggcccagaggagacccaucaacucaucugguucuc

SEQ ID NO: 71964 - RNA, 64 nt, Human
uaaacugguccuguacauagaagguuuguuugacagaggagaaaaauuagccaaggaagauugu

SEQ ID NO: 71965 - RNA, 64 nt, Human
cugucuuguaaaagcccagaucacugugggcuggagaggagaaggaaagggucugcgccagccc

SEQ ID NO: 71966 - RNA, 64 nt, Human
agcugaugcuuauuaaaacaaaugauguauggggagaggagaaggaagggcaaggaaggaauug

SEQ ID NO: 71967 - RNA, 64 nt, Human
auuccuuccacccugaggcuugcuguggacucagagaggagacuuaccugaugagagcucaaac

SEQ ID NO: 71968 - RNA, 64 nt, Human
aguucccaaggcguccgcgcgccagcacagaaacagaggagagucccagagcaggaggccccug

SEQ ID NO: 71969 - RNA, 64 nt, Human
acugaacguagcauaagggcuucuggaacccagaagaggagacaguuuaccauccucaagauca

SEQ ID NO: 71970 - RNA, 64 nt, Human
uauggaacuaggaauacuuucuuuaacuaguccaagaggagagagaggaauagguugcaagcua

SEQ ID NO: 71971 - RNA, 64 nt, Human
ggcugaauucaggaccugggaauacaggguucagagaggagaggaggaagauggugacaugauu

SEQ ID NO: 71972 - RNA, 64 nt, Human
gccucuucagauuccuuauaaaauuuaaaccaagagaggagaggaaaggguaaauuuucuguua

SEQ ID NO: 71973 - RNA, 64 nt, Human
gaugguuuauugaggagagauaggaguugaagggagaggagacagcaugaacaccugcuugucc

SEQ ID NO: 71974 - RNA, 64 nt, Human
ugagacauagggucacuagagacccuucugggucagaggagagagacugaauuggacuaaaccc

SEQ ID NO: 71975 - RNA, 64 nt, Human
ugaaggccaggcaggguuggaggccgggggugugagaggagaggcccauagggcugaguggggu

SEQ ID NO: 71976 - RNA, 64 nt, Human
ugggagcucugcaccacgagcuucagucaccccgagaggagaggagguaacgaggagggcggac

SEQ ID NO: 71977 - RNA, 64 nt, Human
gaggugcauggccugagcauuguuugucuggcccagaggagagagcuuggguucccauaguccu

SEQ ID NO: 71978 - RNA, 64 nt, Human
uccagagaagccaggagccaaaagcugggguaggagaggagaaagcagagcagccuccuggaag

SEQ ID NO: 71979 - RNA, 64 nt, Human
aaaaguucaaggaauaaagauuguuugacucuggagaggagaaagcuguugagauaguuugcua

SEQ ID NO: 71980 - RNA, 64 nt, Human
aagugaaaaugccacucucuccaccccauuuuacagaggagaacaccaaggcccagaggaaguu

SEQ ID NO: 71981 - RNA, 64 nt, Human
uuuuucuuggcaggagagaagcaaggccacuaaaagaggagaugguggagacggaggcucagca

SEQ ID NO: 71982 - RNA, 64 nt, Human
uaccuuagugggacaucuucaccggacacauuucagaggagagaaaaaaaguaauauugaaucu

SEQ ID NO: 71983 - RNA, 64 nt, Human
gauugacuauuuauacaaaugggggcggcuggaaagaggagaaggagagggaguacaaagacag

SEQ ID NO: 71984 - RNA, 64 nt, Human
accugccaugcucugggacgugugggcccuggggagaggagagaaagggcucccaccugccagu

SEQ ID NO: 71985 - RNA, 64 nt, Human
ccccauguugcauaucagggugcucaaggauuggagaggagacaaaaccaggagcagcacagug

SEQ ID NO: 71986 - RNA, 64 nt, Human
accccuccaguacugcacaaauuccuaagggggaagaggagaggguauggggcggcagacccua

SEQ ID NO: 71987 - RNA, 64 nt, Human
gcgugcgcgugugccuagaauauauauuacucucagaggagauucuguugcuuuugaauaggaa

SEQ ID NO: 71988 - RNA, 64 nt, Human
gagaauauguaugccugcaauaugggaacaaauuagaggagacuuuuuuuuuucauguuaugag

SEQ ID NO: 71989 - RNA, 64 nt, Human
ggucaggggcacacauggcuuaagugacaaagccagaggagaagacaacccugacagcaucacg

SEQ ID NO: 71990 - RNA, 64 nt, Human
aauuauagggaggacgcuccuucccuccccuccuagaggagaggaaagggagucauuaacaacu

SEQ ID NO: 71991 - RNA, 64 nt, Human
ugacccugugagcccaagcaggccugcugaacucagaggagaaagccugagugaguaacaccuc

SEQ ID NO: 71992 - RNA, 64 nt, Human
aauaaaguauauuuuguucugaacuggcaguuuaagaggagauaccguagucuagauugucuuu

SEQ ID NO: 71993 - RNA, 64 nt, Human
caucaguaacucugguaaagcauccuguggagggagaggagagcccagucauuugcuuagaugg

SEQ ID NO: 71994 - RNA, 64 nt, Human
aaggauaaauaucuuacgcacgauaucuagugacagaggagaaaguggaaaaugaccucaagga

SEQ ID NO: 71995 - RNA, 64 nt, Human
augguguugagaagaaucaggagagggauacaagagaggagauggggucccggcacccaucugu

SEQ ID NO: 71996 - RNA, 64 nt, Human
ccauauuguucaacaggaaacaaagcuuagcaggagaggagagccagagaagugacagggaagc

SEQ ID NO: 71997 - RNA, 64 nt, Human
aagucuuuaaagucuuguauagcaauaugcuuggagaggagaauacuuaucucuggcgcacauc

SEQ ID NO: 71998 - RNA, 64 nt, Human
guugguggaauaagcaguggaauuugaacaaggaagaggagaaaagggaauuuugucuuuaugg

SEQ ID NO: 71999 - RNA, 64 nt, Human
ucugauuccauuccuuccacacccagcuaaaguuagaggagauacauauagaaucuauuuuaga

SEQ ID NO: 72000 - RNA, 64 nt, Human
uccuauaccuuguccuuccugcuugccuaggggaagaggagaagaggguaagggggcuucacuc

SEQ ID NO: 72001 - RNA, 64 nt, Human
acguggauggacccccaugucugagaggggugaaagaggagaccaauggcaguucagguucaag

SEQ ID NO: 72002 - RNA, 64 nt, Human
cccuccaugacacacccccgauuccuggacaaccagaggagauacagcugcuuagaaaggaggc

SEQ ID NO: 72003 - RNA, 64 nt, Human
gaggcccuaaaauuacacucaugucaaaaaucagagaggagagagaccaaccauauuugggaug

SEQ ID NO: 72004 - RNA, 64 nt, Human
gccggcgaccagacuccugccacgccuuccauccagaggagaaugcccaggacugcggcggcgc

SEQ ID NO: 72005 - RNA, 64 nt, Human
uuuaaagaucagaugccaucuuucuuccuggagaagaggagauuuucucuuuugagagugguug

SEQ ID NO: 72006 - RNA, 64 nt, Human
caguaauucuacaauaaugcguuuuucuucugggagaggagaaugugcauuuuugaccucaaca

SEQ ID NO: 72007 - RNA, 64 nt, Human
cacagagagaggaauguccaggucaucuucacccagaggagaagccucaucauugaauggagaa

SEQ ID NO: 72008 - RNA, 64 nt, Human
ccugggucuagaaugggaacuggagaggacccugagaggagacgggcugggcggcgacccccac

SEQ ID NO: 72009 - RNA, 63 nt, Human
uuccaccccuuccuaaguaaaaaaagaaaaagaagaggagaaaaaaacuucuuuaaaaaaaca

SEQ ID NO: 72010 - RNA, 64 nt, Human
aagaucacuuugucuuggaaaugacuagagaggcagaggagaaggguuuccagaguugcuaggu

SEQ ID NO: 72011 - RNA, 64 nt, Human
gggccgugccagcugugcccuagugauaaggguaagaggagagaugucaggcucacugcccuua

SEQ ID NO: 72012 - RNA, 64 nt, Human
acauagaucucucccacuagagcccagagggaugagaggagagagcaacuguucuuucuuuuuu

SEQ ID NO: 72013 - RNA, 64 nt, Human
uuuuauaguauuggauaaaguuugguguuuuuacagaggagaagcaaugggucuuagcucuuuc

SEQ ID NO: 72014 - RNA, 64 nt, Human
ugcaaaucuuugggucagugagcuccuggagaagagaggagacaugucaggaauagauuaggca

SEQ ID NO: 72015 - RNA, 64 nt, Human
cgccagaaguggaguugggcagcccugugaagccagaggagauggacuggucugagcuauaccc

SEQ ID NO: 72016 - RNA, 64 nt, Human
agcagucagucaguagucagugauggagagaacaagaggagagaugccuggccucugcccaaga

SEQ ID NO: 72017 - RNA, 64 nt, Human
ugagugaagggagccagguacacggcagcagggcagaggagacuauggggagcccaccgccuac

SEQ ID NO: 72018 - RNA, 64 nt, Human
ucacaacagacauuuccuagagaaagagagagagagaggagaaagagagagaaggagagagaca

SEQ ID NO: 72019 - RNA, 57 nt, Human
ugauggaaaaaccuuucuaggauguucagaggagacuuaacaaguguacugcagaau

SEQ ID NO: 72020 - RNA, 64 nt, Human
aguguaauauauguuuaacuggagucccagaaggagaggagaaaaugaagaggcaugaagaagu

SEQ ID NO: 72021 - RNA, 64 nt, Human
gccuagggccacuugcuugauuuaucaugagagaagaggagagagagagagacugagcgcuagg

SEQ ID NO: 72022 - RNA, 64 nt, Human
aaguaccaauuaaggugucuuaaauuuggcgcauagaggagagaaggaaaccugaggaguagug

SEQ ID NO: 72023 - RNA, 64 nt, Human
acuugccauuugagccucacugcaaaauuagugcagaggagaaaacaauuuuuaauguaaucuu

SEQ ID NO: 72024 - RNA, 64 nt, Human
agaagauuuuaauuaggaaacaaagcuuagcaggagaggagagccagagaagugacagggaagc

SEQ ID NO: 72025 - RNA, 64 nt, Human
gugucuagaggccugaaggaaccgcugaagaaccagaggagaucuccucuuccaagacacguuu

SEQ ID NO: 72026 - RNA, 64 nt, Human
aaucaguuaagauaccuugagaaaaacugcagugagaggagauaaauauccuuuuucaggagga

SEQ ID NO: 72027 - RNA, 64 nt, Human
uacccauacugagauggagcuaccaagagcagacagaggagaagaugggccaaaggggcuugga

SEQ ID NO: 72028 - RNA, 64 nt, Human
ugccucucgcuacagcguccuccucaccggccgaagaggagaaacucauugaaauccuggaaca

SEQ ID NO: 72029 - RNA, 64 nt, Human
aggacguggaccagcuggagcugcugcccagcacagaggagagucgccgcagaugaccuagcug

SEQ ID NO: 72030 - RNA, 64 nt, Human
cgacucaguugauugagcugcucucugaagaggaagaggagaaagccagagagucacucuuacc

SEQ ID NO: 72031 - RNA, 64 nt, Human
ggacuugggagagugagacccaguggagggagcaagaggagagggaugucggggggguggggca

SEQ ID NO: 72032 - RNA, 64 nt, Human
ggcuucauaaucauggcucuuagaaacucaggaaagaggagauaauguggauuaaaaccuuaag

SEQ ID NO: 72033 - RNA, 64 nt, Human
ucacuacaaauaaugcaaacuguuuucaauaaaaagaggagacuguuaauguguacuuauaaau

SEQ ID NO: 72034 - RNA, 64 nt, Human
caccucuaugccucaugaugcaauuaucuuacucagaggagauuugccaggaaauucucuccgu

SEQ ID NO: 72035 - RNA, 64 nt, Human
gauugcuagccagcauuccauauugggaauauguagaggagaaccuggauguacuuaagagugg

SEQ ID NO: 72036 - RNA, 64 nt, Human
aaucccccucaauucagaccuucugauugagugcagaggagacuagacagucuccucuagacag

SEQ ID NO: 72037 - RNA, 64 nt, Human
uucucagggaagauggaauuuaguuuuaaggaaaagaggagaacuucauacucacaaugaaaua

SEQ ID NO: 72038 - RNA, 64 nt, Human
uccuaagcagauugcuuaggcagauacagaaugaagaggagacuugaguguugcugcugaagca

SEQ ID NO: 72039 - RNA, 64 nt, Human
cacaagugccacugcccgagcuggugcauuacagagaggagaaacacaucuucccuagaggguu

SEQ ID NO: 72040 - RNA, 64 nt, Human
ugaccaugggcugggaggagguggaggaggaggaagaggagaaggaaaagugacgaagagagag

SEQ ID NO: 72041 - RNA, 64 nt, Human
ggaaagaggagcauucaucacaaguuuccuagagagaggagacaaaucggugugccauugacaa

SEQ ID NO: 72042 - RNA, 64 nt, Human
cuucugcuacugguccuugggcugggugguugguagaggagauguugacacuaugagcuaaggg

SEQ ID NO: 72043 - RNA, 64 nt, Human
agacgcucuggccaggaagcugaggccgggcuugagaggagagcgcuggccaugccaggagaga

SEQ ID NO: 72044 - RNA, 64 nt, Human
accuuugacuugcaugcucaacagggaguggaggagaggagacaaggcucuggacagccggucc

SEQ ID NO: 72045 - RNA, 64 nt, Human
auuacugccuucccucccagggaggccccuucagagaggagaggccacaggagcugcauugugg

SEQ ID NO: 72046 - RNA, 64 nt, Human
acaucugucagaugagaaguuuugguccuguuagagaggagaaagacuguaaugaaacuacuag

SEQ ID NO: 72047 - RNA, 64 nt, Human
auauaaaaacaauauauuugucauaugcuccuagagaggagaaaggggugauugaaagaaaaaa

SEQ ID NO: 72048 - RNA, 64 nt, Human
aguugauaagcugaauagaaagauaagguuuucgagaggagaagugcgccaauguugucuuuuc

SEQ ID NO: 72049 - RNA, 64 nt, Human
uucucuaagaggccaucucuaagaugucagauguagaggagagagagcgagagaacaucuuccu

SEQ ID NO: 72050 - RNA, 64 nt, Human
ucuuuuccuaguauuuaacagaacccaagugaacagaggagaaaugagauugccagaaagugau

SEQ ID NO: 72051 - RNA, 64 nt, Human
aaaacuugaagcucuuuagaccaauagacuggugagaggagaaaggagcuuaucccccagaccc

SEQ ID NO: 72052 - RNA, 64 nt, Human
gugucugguaaggucaugggggaagggagaugagagaggagauaggcagauguggguauggggc

SEQ ID NO: 72053 - RNA, 64 nt, Human
gguucugcuucacuagguuaaauguagguuuuguagaggagaucugcacuggagcaagucuccc

SEQ ID NO: 72054 - RNA, 64 nt, Human
cagggcucagagggcuaggcacggagggaaggucagaggagaaggcaggcagggcccagugaga

SEQ ID NO: 72055 - RNA, 64 nt, Human
agcauuuuugcugaggaaaaggucacuuguaaacagaggagaaagggaaagaguacaaagcccu

SEQ ID NO: 72056 - RNA, 64 nt, Human
gaaggacuucuuccagggagauuaguggugauggagaggagaguuaaaaugaccucauguccuu

SEQ ID NO: 72057 - RNA, 64 nt, Human
uaacaaagacccaugugaugcugggggcagagacagaggagaagcuguuugaugcccccuuguc

SEQ ID NO: 72058 - RNA, 64 nt, Human
ugccuggccucccccugcauuccugucugggugaagaggagacguguuacggcagagcaggugg

SEQ ID NO: 72059 - RNA, 64 nt, Human
cacaccuacuccaaagaacagcuggacggagcugagaggagacccuagcaucuccauguccauc

SEQ ID NO: 72060 - RNA, 64 nt, Human
gguugcuggagcaagaggagaggaugcuggagcaagaggagaggcugcuggagcuugaguggaa

SEQ ID NO: 72061 - RNA, 64 nt, Human
ccugaaccaagagcaggaagagguugcuggagcaagaggagaggaugcuggagcaagaggagag

SEQ ID NO: 72062 - RNA, 64 nt, Human
gguuguuggagcaagaggagagguugcuggagcaagaggagagguugcuggagcugcaggagag

SEQ ID NO: 72063 - RNA, 64 nt, Human
gauuguuggaacaagacgagagguuguuggagcaagaggagagguugcuggagcaagaggagag

SEQ ID NO: 72064 - RNA, 64 nt, Human
gguugcuggagcaagaggagagguugcuggagcaagaggagaggcuacuggagcugcaggagag

SEQ ID NO: 72065 - RNA, 64 nt, Human
aguugcuggagcaagaggagagguugcuggagcaagaggagagguugcuggagcaagaggagag

SEQ ID NO: 72066 - RNA, 64 nt, Human
gguuguuggagcaagaggagaaguugcuggagcaagaggagagguugcuggagcaagaggagag

SEQ ID NO: 72067 - RNA, 64 nt, Human
agagcaggaagagguugcucagguuguuggagcaagaggagaaguugcuggagcaagaggagag

SEQ ID NO: 72068 - RNA, 64 nt, Human
uucuuuaaaaagcaaaacuuaaaaaaaaaaaaaaagaggagagagauagaggaaggugaauuag

SEQ ID NO: 72069 - RNA, 64 nt, Human
aaggaaauguaauacaagucaaaccaggcaauacagaggagaagggaaaggcagagggugugau

SEQ ID NO: 72070 - RNA, 56 nt, Human
cccccaaagugcuggagugaggcuccagaggagacuuugaguugaugggggccagg

SEQ ID NO: 72071 - RNA, 64 nt, Human
uuuagggagaugguauccccuggaguagagggcaagaggagagagcgccuccagucuagaaggc

SEQ ID NO: 72072 - RNA, 64 nt, Human
cucacaaugagugugacauuagaaaacuccuugcagaggagaguuucuccaggcucuuccuggg

SEQ ID NO: 72073 - RNA, 64 nt, Human
cacacacccacacaugccagaggucccuccucacagaggagagggccugugucuguagaagguu

SEQ ID NO: 72074 - RNA, 64 nt, Human
agauggagauccuuucagggagagagagagagagagaggagaagacagagagauuaaagaaaaa

SEQ ID NO: 72075 - RNA, 64 nt, Human
agaccggggcugccaaaggggcagagggugguggagaggagagggagaaagggaagucccaggg

SEQ ID NO: 72076 - RNA, 64 nt, Human
uggcggcaccagcaccuucgcuuugcaucucgguagaggagaaacggcagcacagcccaaggac

SEQ ID NO: 72077 - RNA, 64 nt, Human
uucucaugcugcccuugggugggcaucuguuaacagaggagaacgucuggguggcggcagcagc

SEQ ID NO: 72078 - RNA, 64 nt, Human
cccuguccuagcccuucaguaagaccuugccaggagaggagaaggaugccugggugccaggcaa

SEQ ID NO: 72079 - RNA, 64 nt, Human
guugugcccaacacuguggaucagcaaacacgauagaggagaccagucaguacuucuuggaggg

SEQ ID NO: 72080 - RNA, 64 nt, Human
agguggaugcccagcugcugacugugcagaagcuagaggagaaggagcgagccuugcagggcag

SEQ ID NO: 72081 - RNA, 64 nt, Human
ccuucugugcaucuggccugggggcuguuagcucagaggagaggagcaaacaggaaaaugacuu

SEQ ID NO: 72082 - RNA, 64 nt, Human
ccucugucuaguguccaagcaucuuagcuguucaagaggagagggcagcauaacuuccugacca

SEQ ID NO: 72083 - RNA, 64 nt, Human
guccuuuacguguggauggaguucacaggcgaauagaggagaggaccaggggacguggcuuguc

SEQ ID NO: 72084 - RNA, 64 nt, Human
cuugguuauugguccccuuugaccaggaaacccaagaggagacaccucagucagcagaaaggcc

SEQ ID NO: 72085 - RNA, 64 nt, Human
ggacauuucuuaaccauggggcugugaugggaggagaggagaggcugggaaagccgggucucug

SEQ ID NO: 72086 - RNA, 64 nt, Human
uguguuucuggaguccuuuggaaacaugugucccagaggagaagagguuugacuugcguguaga

SEQ ID NO: 72087 - RNA, 64 nt, Human
aagccgucucccugcuugacucgacugcugucccagaggagaguccugugcgaccugagcgggg

SEQ ID NO: 72088 - RNA, 64 nt, Human
gcccuggcacacagggcuggcucagugugcggacagaggagaccacucugcuccuggggccaga

SEQ ID NO: 72089 - RNA, 64 nt, Human
aaguaagcuaaauguaucuuacugccccgaaaugagaggagacuggucuugaagccucuggugc

SEQ ID NO: 72090 - RNA, 64 nt, Human
ucccauuaucacucucucugcccccauuccuucaagaggagacccuuuggggacaaggccguuu

SEQ ID NO: 72091 - RNA, 64 nt, Human
gugggccuagccccuccccccuuuucuccauuugagaggagagugcuuggggcuugaaccccuu

SEQ ID NO: 72092 - RNA, 64 nt, Human
guagcaguagccacuugguucuuagggggccccaagaggagaggagaagugcugagguugaugu

SEQ ID NO: 72093 - RNA, 64 nt, Human
aguagccacuugguucuuagggggccccaagaggagaggagaagugcugagguugauguuacga

SEQ ID NO: 72094 - RNA, 64 nt, Human
agcuggggaaggcccaaggccgcccagggcagagagaggagacgaagaguuugggacagugggg

SEQ ID NO: 72095 - RNA, 64 nt, Human
agcacugacuccucacccgcuagucuggcuguuaagaggagaaagugcacugccuuccagccca

SEQ ID NO: 72096 - RNA, 64 nt, Human
ccgcagccaucucuagaugaaagggggaauguguagaggagaaauugccucuuuauaaagagcc

SEQ ID NO: 72097 - RNA, 64 nt, Human
aaaaaaaaaaaccaaaaaggauugcuuuacuccaagaggagagauugucuuaggauaaaccucc

SEQ ID NO: 72098 - RNA, 64 nt, Human
ccugugggaguagaaaaaucucauucccagagucagaggagaagagacauguaccuugaccauc

SEQ ID NO: 72099 - RNA, 64 nt, Human
aauguuaccaccugaacaguccucggugaaucugagaggagaggaugggguaaggcagaagcac

SEQ ID NO: 72100 - RNA, 64 nt, Human
gggaugagguccaggagccaacuaaaacaauggcagaggagacaucucugguguucccaccacc

SEQ ID NO: 72101 - RNA, 64 nt, Human
gaauagauuucccuuucuuccugaccccaaggucagaggagacuauauauuccauggcugccuc

SEQ ID NO: 72102 - RNA, 64 nt, Human
agcuccaccgaaggggcugccauggaagagcccaagaggagaucagcgcaauugucagcuaaac

SEQ ID NO: 72103 - RNA, 64 nt, Human
guagaaaaccagagugcacguaggugucuaacacagaggagaguaggaacagggcggauaccug

SEQ ID NO: 72104 - RNA, 64 nt, Human
gacagacgcguuggcacaguucaugguuuccuccagaggagacauuggcuuaucauggggaaaa

SEQ ID NO: 72105 - RNA, 64 nt, Human
gugaucaggccccuggggcggucaauaauuguggagaggagagaaugagagaguguggaaaaaa

SEQ ID NO: 72106 - RNA, 64 nt, Human
uguucugcccacucuggggaauagggaggggaggagaggagaggagagggaggauccuggagga

SEQ ID NO: 72107 - RNA, 64 nt, Human
ugcccacucuggggaauagggaggggaggagaggagaggagagggaggauccuggaggacuggg

SEQ ID NO: 72108 - RNA, 64 nt, Human
cuccagauggguuuucucuggaggacaagcaguuagaggagaaaaaggaauggagcagagccug

SEQ ID NO: 72109 - RNA, 64 nt, Human
accaauucuggacagacagauguugggaggauacagaggagaugccacuucucacucaccacua

SEQ ID NO: 72110 - RNA, 64 nt, Human
guggcagugacagugacacccacacccacaguaaagaggagacugaaugagacuggccuggcug

SEQ ID NO: 72111 - RNA, 64 nt, Human
aagggguucauaucuuuuuuagcugagggggacaagaggagaagucaguggacacauggaaguu

SEQ ID NO: 72112 - RNA, 64 nt, Human
auguauuuuggaagacauauauuauauauagaaaagaggagaggaaaacuauuccauguuuuaa

SEQ ID NO: 72113 - RNA, 64 nt, Human
ccuaccuggggauuucuugguuugugaaaacaggagaggagaaauaucucauacaagugaaagg

SEQ ID NO: 72114 - RNA, 64 nt, Human
uggguucaucucacccacagagggaggaucuuuaagaggagaaaaaagccaagagggaaagcca

SEQ ID NO: 72115 - RNA, 64 nt, Human
cggcuuccacaaugcagcugcucugggccucgggagaggagagaccccaguccccugggcugcc

SEQ ID NO: 72116 - RNA, 64 nt, Human
cgggguugaaacggguuucccagaccagggguucagaggagacuauuuacccuucaugaucuuu

SEQ ID NO: 72117 - RNA, 64 nt, Human
guuuccagagaguggagagagcagggcuaaauaaagaggagauaagguggcuucucacggccug

SEQ ID NO: 72118 - RNA, 64 nt, Human
ggccggagcuuccuuccuuagccgggaagcuggcagaggagagccgugcccgggaauaggagga

SEQ ID NO: 72119 - RNA, 64 nt, Human
ucccucccuccaccggggaagggcaugggcuagaagaggagaggggggucgggaauggggggaa

SEQ ID NO: 72120 - RNA, 64 nt, Human
auaccccuguuaaucuccuuuuuucuuggauuggagaggagagaaucuggacauggcuuuggac

SEQ ID NO: 72121 - RNA, 64 nt, Human
gagagagacagaggaggcagagagggagagaaacagaggagacagagagggagagagagacaga

SEQ ID NO: 72122 - RNA, 64 nt, Human
cagugcuggggguuucuguaggucccacucccacagaggagagaggcucagccacacaggaaga

SEQ ID NO: 72123 - RNA, 64 nt, Human
uuggggcauguuaucaugggagggaagucaaauaagaggagagaaaagaacucaagggggaaac

SEQ ID NO: 72124 - RNA, 64 nt, Human
ggcagcucagcagggggaacuuguccccauggucagaggagacccagcuguccugcacccccuu

SEQ ID NO: 72125 - RNA, 64 nt, Human
guuccucugggugugcacauauguuuggagaaauagaggagagaaaagagggccacguaacuga

SEQ ID NO: 72126 - RNA, 64 nt, Human
ccucaagcuggacuguggguuccaaauuacucauagaggagaaaaccagagaaagaugaagagg

SEQ ID NO: 72127 - RNA, 64 nt, Human
cgcuucaggguaggugggcacaggcuuggacuagagaggagaaagauugguguaaucugcuuuc

SEQ ID NO: 72128 - RNA, 64 nt, Human
gcaccguugcuaccgagugucugucuaagaacacagaggagaauuuauuaucauugaagaauag

SEQ ID NO: 72129 - RNA, 64 nt, Human
ugcuguuuuacacagagaaacagguagaccccacagaggagaaggaggggauucaacagcuuua

SEQ ID NO: 72130 - RNA, 64 nt, Human
cacccguaccgcggcuggcuggcggggacaggcuagaggagacagcaagucccaguccccggag

SEQ ID NO: 72131 - RNA, 64 nt, Human
cagccuuuguacauacaaaauucuuccaaaagagagaggagaaaauacagcucugauggcauca

SEQ ID NO: 72132 - RNA, 64 nt, Human
aaauuguguuuugcuaagaaaagccucaacugacagaggagaagucaaguguguggacaggcaa

SEQ ID NO: 72133 - RNA, 64 nt, Human
aaguuggaacauccuuggaaauuggaagagcacaagaggagauccagggcaaggccauugggau

SEQ ID NO: 72134 - RNA, 64 nt, Human
cagggcagaagauggacugggggagggggcagagagaggagaccaaaaugaggugguggcacag

SEQ ID NO: 72135 - RNA, 64 nt, Human
cuuuuccaucccaagugccugcggagcgccgaggagaggagagagcugacuggacgcuuacguu

SEQ ID NO: 72136 - RNA, 64 nt, Human
ccuaaucccaguaaggaagaaagcguagugugggagaggagagagcugaugacugcaguucuca

SEQ ID NO: 72137 - RNA, 64 nt, Human
cauaauagagaucuucuggccagagaaucaggggagaggagaggccugauggggcagagcugga

SEQ ID NO: 72138 - RNA, 64 nt, Human
uuuugugauugacaauauuucaugcucuguagugagaggagauuuccgaaacucuguugcuagu

SEQ ID NO: 72139 - RNA, 64 nt, Human
agaaacuuuuguauaaguaguuucaaacuauuugagaggagaauuaaagacaugcuuguuuugu

SEQ ID NO: 72140 - RNA, 64 nt, Human
uuugucaaaccuuguuucccaaauucaauuaaagagaggagagaauugaauggcguuuagagaa

SEQ ID NO: 72141 - RNA, 64 nt, Human
ucugguccccagucgcacaacuucccacauacccagaggagagcauaugccugugggggcagug

SEQ ID NO: 72142 - RNA, 64 nt, Human
ccccaggcccuccccagccgacgacagccaccggagaggagaucggaacacgauugucucagau

SEQ ID NO: 72143 - RNA, 64 nt, Human
gacgccgggccggcugacauuuggaccccaucccagaggagaugcuggcuaccagcuggggcga

SEQ ID NO: 72144 - RNA, 64 nt, Human
ccucggucugguguaagcacacaugcacgauuaaagaggagacgccgggacccccugcccgauc

SEQ ID NO: 72145 - RNA, 64 nt, Human
guuuugcggggguuggcaguggagagcaggcuggagaggagauggcuaauagcuguuuaaugga

SEQ ID NO: 72146 - RNA, 64 nt, Human
uuucucuucuuugcaaauacaugaaaggaugcacagaggagagaagcucugugaauguaagcau

SEQ ID NO: 72147 - RNA, 64 nt, Human
auuucucuucuuuucaaauacaugaaaguugcacagaggagaggcgcccuaagaauguaagcau

SEQ ID NO: 72148 - RNA, 64 nt, Human
gacuccauuuacccugaaauagcagcuucucuugagaggagagugacauggaagcaacuccguc

SEQ ID NO: 72149 - RNA, 64 nt, Human
gcgaaagagcgacucugucuccaaaaaaaagagaagaggagaggacacagagacacacagagaa

SEQ ID NO: 72150 - RNA, 64 nt, Human
uugguucugacccaaauccugcucuggacucuggagaggagauugaaauauaauugcacccuca

SEQ ID NO: 72151 - RNA, 64 nt, Human
auuuucacuaguguuauuuuagagaauuugcaugagaggagaguacuuaugaguauaaugaaua

SEQ ID NO: 72152 - RNA, 64 nt, Human
gguggcuggggcuggggugagcucagggaggggaagaggagaauacaugcagagucagcacccc

SEQ ID NO: 72153 - RNA, 64 nt, Human
cagugggaugacugggggaggguugcugcagggaagaggagagcccccugcccugcccugcccc

SEQ ID NO: 72154 - RNA, 64 nt, Human
cugagagggaugacaggcuuaggggaaaacucagagaggagagaugcacauuccuagugaaauu

SEQ ID NO: 72155 - RNA, 54 nt, Human
ccccggaggagaagaaguagggggagaggagaggacucagcgggccccgucucu

SEQ ID NO: 72156 - RNA, 64 nt, Human
cccaggacuggucuguugucuuuucaucuguucaagaggagauugaaacugaaaacaaaaugag

SEQ ID NO: 72157 - RNA, 64 nt, Human
ccgcuccucagcucccucagcuccuagagggggaagaggagagacccccaacaaggggacagga

SEQ ID NO: 72158 - RNA, 64 nt, Human
guguguguguguguguguuugcgugcgcauguguagaggagagagcagggucccugagauaaug

SEQ ID NO: 72159 - RNA, 64 nt, Human
ccucagugccagccaauccgggcaggacccucgaagaggagaccgagggucccagaggaccaau

SEQ ID NO: 72160 - RNA, 64 nt, Human
gcggaugccgccucaagggucuucaggggaggccagaggagagcugcugggccccgagccacga

SEQ ID NO: 72161 - RNA, 64 nt, Human
uuuuagcccuuuuuguuggggguggggugggggcagaggagaggcggauacagaaacuugugag

SEQ ID NO: 72162 - RNA, 64 nt, Human
aaauguuuacuuaagaaacacccuguuuacagccagaggagaaacacccaacacugaguggaga

SEQ ID NO: 72163 - RNA, 64 nt, Human
uacagcacaaauaaauaaugacugucauacauccagaggagaccgaaccugcccagcugaugua

SEQ ID NO: 72164 - RNA, 64 nt, Human
ggaucccaguuggucucuggcagugggauccuggagaggagaaauccuggccucugcucaugcg

SEQ ID NO: 72165 - RNA, 64 nt, Human
ccgcuggucuaggcugguggucggggccccugggagaggagacagggcauuccuccccacucug

SEQ ID NO: 72166 - RNA, 64 nt, Human
ucugcccacugaagauuugagggaggggagauggagaggagagguggacaaaguacuugguuug

SEQ ID NO: 72167 - RNA, 64 nt, Human
ccuccugcuccucaccccuguagggaaaccuuggagaggagaguggcaggugggcugccugcug

SEQ ID NO: 72168 - RNA, 64 nt, Human
uaaagucacagcacagauacugcccagugccuuaagaggagacaugaucucuaccagggacucu

SEQ ID NO: 72169 - RNA, 64 nt, Human
gggucugaggauucaggauuguggcguuauucaaagaggagacuuugaaauuccccgauggcug

SEQ ID NO: 72170 - RNA, 64 nt, Human
cuucucacuaaaaugaucacgaagaccuuugacaagaggagagauaugcacugugauauuaaau

SEQ ID NO: 72171 - RNA, 64 nt, Human
cuuuuuaaagaugggaggucaggagguggaagugagaggagaucccaucucacacaacacacuu

SEQ ID NO: 72172 - RNA, 64 nt, Human
agugagaccaugagaauuccaggcucacaaagggagaggagagaacagggcaagacguuugguu

SEQ ID NO: 72173 - RNA, 64 nt, Human
cuggaguacccuggggucagcagcaagagaaagaagaggagauuuucuguuuguuuuuccccuc

SEQ ID NO: 72174 - RNA, 64 nt, Human
cgacugccugcucaccccugggcugagggaagggagaggagaggaacaagggccuccgaaaccc

SEQ ID NO: 72175 - RNA, 64 nt, Human
ccuggagaagguggaguagucagaaaacuuucuuagaggagauggagguggccuuugagccagg

SEQ ID NO: 72176 - RNA, 64 nt, Human
aguugagaagcugacugggcaagagugggagagaagaggagagggcuuggauagaguugaggag

SEQ ID NO: 72177 - RNA, 64 nt, Human
aaaagucuucauacagaguacaagugcagccgccagaggagaaaauugagauucuugacccuuu

SEQ ID NO: 72178 - RNA, 64 nt, Human
aucacaccccaaguggauaaaggcaacuugcaggagaggagagccagccaagaagaaaauuuua

SEQ ID NO: 72179 - RNA, 64 nt, Human
ugccuuggaggagagacuuuugggugagguccaaagaggagagcuguucagcuuaccugccaca

SEQ ID NO: 72180 - RNA, 64 nt, Human
guguuguauccuccacucacuauggcccgaggggagaggagaguuuggggcagggaggaacaga

SEQ ID NO: 72181 - RNA, 64 nt, Human
aggaaggggcaugugagcguaaauagaggugaccagaggagagcaugagggguggggcuuuggg

SEQ ID NO: 72182 - RNA, 64 nt, Human
aaaagcagugaagcauuagaugcugguaaaagcuagaggagacacaaugagcuuaguaccucca

SEQ ID NO: 72183 - RNA, 64 nt, Human
aaauucuaaauuaccauuuacuuccagauagagcagaggagaaacaccucacugcaguuucaac

SEQ ID NO: 72184 - RNA, 64 nt, Human
agucagaccuccaggacuaagaugaagugagccgagaggagaucguaucauaagaaugcuucug

SEQ ID NO: 72185 - RNA, 64 nt, Human
caagggccguguguaaauacgaacugcgccauggagaggagaggcacugccggagcccuugcca

SEQ ID NO: 72186 - RNA, 64 nt, Human
cccgguguugguccugccacccacgugcugugugagaggagaaucccugaccccugcccugggc

SEQ ID NO: 72187 - RNA, 64 nt, Human
caccaugcacaugucugaggcugagcaagggcugagaggagaggcuugggccucaguuucccuc

SEQ ID NO: 72188 - RNA, 64 nt, Human
agugaggggacaccagcaaaaaccuucagcucucagaggagauugggaccaggaaaaccuggga

SEQ ID NO: 72189 - RNA, 64 nt, Human
gcucaggccugagguuuugcaucuguucaauagcagaggagagagggguguacugucuguggcc

SEQ ID NO: 72190 - RNA, 64 nt, Human
uguguacccacuggguauccguuagagguaagggagaggagaggauugauagaguguugcaaaa

SEQ ID NO: 72191 - RNA, 64 nt, Human
uguuuauuugcucagggcgggcagccuauggugaagaggagacagaggcgaugggcgugcuucg

SEQ ID NO: 72192 - RNA, 64 nt, Human
ugcuccaggcaggucagagcagugcagggggaggagaggagaaagggaggaagcugggcugugu

SEQ ID NO: 72193 - RNA, 64 nt, Human
cagccaguccuggucggccacaccagugucccaaagaggagagcgcagcagagccaggggucug

SEQ ID NO: 72194 - RNA, 64 nt, Human
uacucucaauacuaccacagacugauuuuuccagagaggagaacugacaggguuuggcuugcag

SEQ ID NO: 72195 - RNA, 64 nt, Human
uccagcagcaaagccccaggagaacaggcuggacagaggagaaggagguugacuguugcaccca

SEQ ID NO: 72196 - RNA, 64 nt, Human
aagcccuuacuccugguucagugccacgcagggcagaggagagcagcugucaagaagcagcccu

SEQ ID NO: 72197 - RNA, 64 nt, Human
uauuuuuucaggaaaaacaaacuuuaaaaaaaaaagaggagaaauaaaaccuuuucuccccuuu

SEQ ID NO: 72198 - RNA, 64 nt, Human
uaaggggauggggaagaagggacaagauucccagagaggagaggaggcuguugguaggaaagug

SEQ ID NO: 72199 - RNA, 64 nt, Human
aacacuaugaauuucagacaaaaauuaaccagacagaggagaggagggaggaagagcugggcga

SEQ ID NO: 72200 - RNA, 64 nt, Human
uuuggccacagccccaaacaagcgccaccgugggagaggagaggcugcugucacugguaccgga

SEQ ID NO: 72201 - RNA, 64 nt, Human
gcugucuuggucacugcugagacccacaggucuaagaggagaggcagagccagugugccaccag

SEQ ID NO: 72202 - RNA, 64 nt, Human; identical to SEQ ID NO: 71728

SEQ ID NO: 72203 - RNA, 64 nt, Human
auacggguaacuagaacuacccagcgagucguccagaggagaggaucagguuugagucaggagg

SEQ ID NO: 72204 - RNA, 64 nt, Human
ugaaccgagggcaggaugaagauggugaggaagaagaggagaggggagaggccaccguccaggu

SEQ ID NO: 72205 - RNA, 64 nt, Human
auacacagugaaauugucuuuauaucacuuugacagaggagaagauugagggaggggggaggga

SEQ ID NO: 72206 - RNA, 64 nt, Human
aaaucuaccugaucauaauaauuuaccaggaagcagaggagagcuacuuguuuaaaaauccaca

SEQ ID NO: 72207 - RNA, 64 nt, Human
gaauggugaaagagaguggagauacggaagggggagaggagaggagaaauguggacagagggcu

SEQ ID NO: 72208 - RNA, 64 nt, Human
gugaaagagaguggagauacggaagggggagaggagaggagaaauguggacagagggcuugaag

SEQ ID NO: 72209 - RNA, 64 nt, Human
gaauuccaggagagggaaagaucguaaggaugagagaggagaccauccaagccagaaauuauuu

SEQ ID NO: 72210 - RNA, 64 nt, Human
aagaaaagugaguuuucaagaguggcagguugagagaggagaaugcuggaaagaggacaaguuu

SEQ ID NO: 72211 - RNA, 64 nt, Human
agggcagcaaagccaugcucccuccagaggcucuagaggagaaucuuuccuugccacguccacc

SEQ ID NO: 72212 - RNA, 64 nt, Human
ucucauagauuggaaaauuuucuccaaauacaauagaggagaauauguaaaggguauacauuaa

SEQ ID NO: 72213 - RNA, 64 nt, Human
cauuccugcaaacagguuuuucucagcuucaggcagaggagacaacauggaagaagauucccac

SEQ ID NO: 72214 - RNA, 64 nt, Human
auacagaguugagaguuuuagacaaucucuagguagaggagacaagauguagacccagacagaa

SEQ ID NO: 72215 - RNA, 64 nt, Human
cuuucucuuguuuuguaacagccuucuucuacaaagaggagaugugagcaaauuaaaucuuguu

SEQ ID NO: 72216 - RNA, 64 nt, Human
uuuuucuucuuuguuuuucagugugggagugggaagaggagauuauagugacugaagaaagaau

SEQ ID NO: 72217 - RNA, 64 nt, Human
cggaggcuggggggggcucugucagcaggacccuagaggagacucucauucgauuuuaaagaag

SEQ ID NO: 72218 - RNA, 64 nt, Human
auaauuggagcauuugcacugagaccccugccagagaggagaaaacccuuucaagggaaauuuu

SEQ ID NO: 72219 - RNA, 64 nt, Human
gaagggaaggagggagagacgggagggaggagagagaggagaagggaggcaggggaggggcagc

SEQ ID NO: 72220 - RNA, 64 nt, Human
ggagcaggcgucuuguggcaggagaaggaccaagagaggagaggaagagccgcacacuuuuaaa

SEQ ID NO: 72221 - RNA, 64 nt, Human
aaguuuuuguugaaagcugugcucagaggaggugagaggagaggaaggagaaaacugcaucaua

SEQ ID NO: 72222 - RNA, 64 nt, Human
uucggcagcagguauacuaaaauuggaaugacacagaggagauuagcauggcccccugcgcgag

SEQ ID NO: 72223 - RNA, 64 nt, Human
uucaaagcuucucucacccuagccaaagguccuaagaggagacagcugugaaguugggcgugcu

SEQ ID NO: 72224 - RNA, 64 nt, Human
aaaagucuugauagcacaacacaaauuccauccaagaggagaaucuuccccaggguuuaguccu

SEQ ID NO: 72225 - RNA, 64 nt, Human
auauauaaacaaacaaacaaaaauugcucaaaaaagaggagaaaagcucaagaggaaaagcuaa

SEQ ID NO: 72226 - RNA, 64 nt, Human
caaagauguaguuuccaucagucaauaaaaccugagaggagagaugaggacugagaguaucucc

SEQ ID NO: 72227 - RNA, 64 nt, Human
ccaugagacugcccugcccagguauccugggggaagaggagaugugaucaggccccaccccugu

SEQ ID NO: 72228 - RNA, 64 nt, Human
cagacauguuccuagcucaacuugauuauagagaagaggagagaggacagugaaugggguaggg

SEQ ID NO: 72229 - RNA, 64 nt, Human
aauauaggaaacauuuuuuggaaaggauggauuuagaggagagauucuaaauccauuuuggaug

SEQ ID NO: 72230 - RNA, 62 nt, Human
uucaaagaaggugcuuuuaaagauccuugagcagaggagacaucuugaagugucagauuaca

SEQ ID NO: 72231 - RNA, 64 nt, Human
cuccagcaggcccaugggaggcuggaguuggggcagaggagaacuugcugccucggauccccuu

SEQ ID NO: 72232 - RNA, 64 nt, Human
cagcuugaccuggguuugcuuccacacccucagaagaggagagccggcacagcagaggcaccgg

SEQ ID NO: 72233 - RNA, 64 nt, Human
auuuuucuuaaaagcuggaaauuaaaaaaaaaaaagaggagagaggcuuucgguggacacguuu

SEQ ID NO: 72234 - RNA, 64 nt, Human; identical to SEQ ID NO: 72222

SEQ ID NO: 72235 - RNA, 64 nt, Human
aaaugccaugacagguguccuuccaagagacagaagaggagacacagacacagagcaggaggac

SEQ ID NO: 72236 - RNA, 64 nt, Human
augggcccaauccagugucccuaugagagacggaagaggagacacagacacaaagcaggaggcc

SEQ ID NO: 72237 - RNA, 64 nt, Human
caugcaauaauacaacuaucauaccuggacccaaagaggagagauauuuugauucucauugcca

SEQ ID NO: 72238 - RNA, 64 nt, Human
gucccucacaccugggcccgggcaggccagcuucgugcuggaggaacuugcugcugugccugcg

SEQ ID NO: 72239 - RNA, 64 nt, Human
uggaacaucuccuauguaccaggcacugugcuaagugcuggaauacauuaucucauugaauuau

SEQ ID NO: 72240 - RNA, 64 nt, Human
ggcuggaggaguaaguggcuuugcaauaaaaugggugcuggagucuaaaaugauacccugggug

SEQ ID NO: 72241 - RNA, 64 nt, Human
ucuaggccagguaggcaacacagagccaaggcgggugcuggaagccagacggaacaguguuggg

SEQ ID NO: 72242 - RNA, 64 nt, Human
gcagggcggccccaggccucugcccuccucucaggugcuggaggagcugaaggcuucgccacag

SEQ ID NO: 72243 - RNA, 64 nt, Human
accucaagugaucugcccgccucggccucccaaagugcuggaaccacaggccugagccacugug

SEQ ID NO: 72244 - RNA, 64 nt, Human
agaaauacuugagcaauuucagaaaaccaucuaagugcuggaggaaccacgcuuccuaacugcu

SEQ ID NO: 72245 - RNA, 64 nt, Human
ccucauuccagaaucuccuacccccagaaaaggggugcuggaaggaggccccaguggacucuuu

SEQ ID NO: 72246 - RNA, 64 nt, Human
gacacauauugcaguugcuugguugaaagugccugugcuggaacuggccuguacucacucaugg

SEQ ID NO: 72247 - RNA, 64 nt, Human
aaauacuuuagggacuguuguaauuucucauauggugcuggaaaugguugggcuuuguaacauu

SEQ ID NO: 72248 - RNA, 64 nt, Human
uccuggccugaguggguagacgcaggcggcagaggugcuggaccacaucuccgccaagucacug

SEQ ID NO: 72249 - RNA, 64 nt, Human
uaaauagaagacgucacuguggcugcuucuggaagugcuggaagcaucaccccaauuggcucca

SEQ ID NO: 72250 - RNA, 64 nt, Human
uuugcuguugcuuuacugcugucuguaugugccagugcuggaacagaauuuggaagauucugaa

SEQ ID NO: 72251 - RNA, 64 nt, Human
caaagaaaagccagaguuccauguuuguacuccugugcuggacuguuuccugaguaccagcagg

SEQ ID NO: 72252 - RNA, 64 nt, Human
gcuuucgaaaagccaaagucuuucugaagaaucugugcuggacagacauaauucccuuucucau

SEQ ID NO: 72253 - RNA, 64 nt, Human
uguaggcuuggagguaaagaacugaagauaacuggugcuggauagaggagccuuauuuuuuauu

SEQ ID NO: 72254 - RNA, 64 nt, Human
uuuaccuuuuuccccccuuuuuuuuaaauggagugugcuggaugucucuauaauuuuauucaga

SEQ ID NO: 72255 - RNA, 64 nt, Human
uaaaacauuccccuccccacuccucucccacagagugcuggacuguuccaggcccuccaguggg

SEQ ID NO: 72256 - RNA, 64 nt, Human
acgggccgcuggggcuggugugggugggccuugugugcuggauuuguagcuuaucuuccguguu

SEQ ID NO: 72257 - RNA, 64 nt, Human
cgggcagcggaagcucgagauggaggggcggcaggugcuggaggucaagaugcagguggaguac

SEQ ID NO: 72258 - RNA, 64 nt, Human
ugaccuugugauccacccaccucggccucccaaagugcuggaauuacaggcaugagccaccgcg

SEQ ID NO: 72259 - RNA, 64 nt, Human
aacguccaggagagacgcauggcccgaagucaaagugcuggaauuuuccaaaacagccuguucu

SEQ ID NO: 72260 - RNA, 64 nt, Human
aaggcuuugauaucagaaugaacugucaagggaggugcuggagagggauuaaccugugcugccu

SEQ ID NO: 72261 - RNA, 64 nt, Human
gccaaaggcguggcugucagggcugggcccuguagugcuggacucucccgggccacaauaggga

SEQ ID NO: 72262 - RNA, 64 nt, Human
ugaaacucugggaagcaggaaggcccaagaccuggugcuggauacuaugugucuguccacugac

SEQ ID NO: 72263 - RNA, 64 nt, Human
acuuccagccgucagggucucagcuaagcagaaggugcuggaaggcugguuagucugggaggag

SEQ ID NO: 72264 - RNA, 64 nt, Human
gaagugccaucucaauugugcuuuguaucagucagugcuggagaaaucuugaauagcuuaugua

SEQ ID NO: 72265 - RNA, 64 nt, Human
aauaacuuugaccuuuuuuguuccuguuccugaagugcuggaggcaguuauggaaggagcugcu

SEQ ID NO: 72266 - RNA, 64 nt, Human
ugugcuuacagauaacacuuacuugugccuggcugugcuggaugguauauucugugucauuuuu

SEQ ID NO: 72267 - RNA, 64 nt, Human
guaggccccaggccagacuaacugggcucaaggggugcuggaaggcgcagagauuggagugccc

SEQ ID NO: 72268 - RNA, 64 nt, Human
aggacagguuggggaggguuggggagggcugccugugcuggacugaggcuugugccacugggcc

SEQ ID NO: 72269 - RNA, 64 nt, Human
aaccugcccacgggacauguacauuuccccuuuugugcuggaagugugagugacacuugcuggg

SEQ ID NO: 72270 - RNA, 64 nt, Human
ccagcacggcgcuccgacuggcuuccucucucaggugcuggauugugggguuaguggcauuucc

SEQ ID NO: 72271 - RNA, 64 nt, Human
cgacaucauugccuguuuuuuuuuuuuuuuuuuugugcuggaagucuguaucuugacaauuuua

SEQ ID NO: 72272 - RNA, 64 nt, Human
accucaggugaucugcccaccucggcuucccaaagugcuggaauuacaggccugagccacccca

SEQ ID NO: 72273 - RNA, 64 nt, Human
guacaugacuauaacccagugaugcugaggucaugugcuggaaugcuguauuuggaccacacau

SEQ ID NO: 72274 - RNA, 64 nt, Human
auagaaugagccaaaaggcuacaucauguugagggugcuggagauuuuacauuuugacaauugu

SEQ ID NO: 72275 - RNA, 64 nt, Human
agaagacaccgaccacggcgaagcaauagagggggugcuggagcgcgagaggcuggcugauugu

SEQ ID NO: 72276 - RNA, 64 nt, Human
ggucauccccagcccaucccugugucagcccugagugcuggacacugcguuccagaaaugagga

SEQ ID NO: 72277 - RNA, 64 nt, Human
ugggaugauugccacauacauggaacaccugggagugcuggaaauguacugugaucgaagugac

SEQ ID NO: 72278 - RNA, 64 nt, Human
agcagcguugggagcuccucgaugucagcuuuuugugcuggacuuggcacacgcucugaaaacu

SEQ ID NO: 72279 - RNA, 64 nt, Human
gauuuuuugucaccuaaggaaaugcauuugaugagugcuggaaacuucuuaagugcuuuacagu

SEQ ID NO: 72280 - RNA, 64 nt, Human
ggauuggagagggggcaccgcguuccagggcccagugcuggaggacugggaaagcggaaacaaa

SEQ ID NO: 72281 - RNA, 64 nt, Human
ugccucuucccagauggcaaucuguccuaucucugugcuggaagaugcuagaucugaaagacag

SEQ ID NO: 72282 - RNA, 64 nt, Human
uaaacuucaaagugauucuggaguucuuugaaaugugcuggaagacuuaaauuuauuaaucuua

SEQ ID NO: 72283 - RNA, 64 nt, Human
cuugauuucauauuaacgccuaaggauugccugugugcuggaaauauauuugaaacucaaccag

SEQ ID NO: 72284 - RNA, 64 nt, Human
caccggcagaaaacggagagugcuuggguggugggugcuggaggauuuuccaguucugacacac

SEQ ID NO: 72285 - RNA, 64 nt, Human
ccuuggcuguuggcagugagugagccuggcucuugugcuggauggagcccaggcgggagcggug

SEQ ID NO: 72286 - RNA, 64 nt, Human
agaaagcaggggcuacaagagggaauccccgaaggugcuggaggugggagcaggagauugagaa

SEQ ID NO: 72287 - RNA, 64 nt, Human
uuuuaauucauuugaauaaauaccaagagcuucagugcuggaucauaugguuugucucguuuga

SEQ ID NO: 72288 - RNA, 64 nt, Human
aagguuucauugcccccagggcacuucacagagugugcuggaggacugaguaagaaaugcugcc

SEQ ID NO: 72289 - RNA, 64 nt, Human
acugaccucuucucauagauuuuguauaaaugaagugcuggacuuuaccugaaagcugcaaaaa

SEQ ID NO: 72290 - RNA, 64 nt, Human
gugaagcugcauuguuggguaaaagccccguggagugcuggagaaaugcacuagcagagugcag

SEQ ID NO: 72291 - RNA, 64 nt, Human
cauuccucuaauguuguguguuuuuuuuuugugugugcuggagggaggggauuuaauuuuaauu

SEQ ID NO: 72292 - RNA, 64 nt, Human
uucauuuuuuuaaauuuuuuuuuuggcagcgcuugugcuggaacuuacucauuguaacugaauc

SEQ ID NO: 72293 - RNA, 64 nt, Human
uguuggcgcaauccucccaccucagacucccaaagugcuggaauuacaguugggagccacugug

SEQ ID NO: 72294 - RNA, 64 nt, Human
agagcuauaggcacugguguggauggcccaggaggugcuggagcuaggucuccaggugggccug

SEQ ID NO: 72295 - RNA, 64 nt, Human
cuccucccccagagcaguccucaacacuaugucagugcuggaaaugcagccacuggcagaucug

SEQ ID NO: 72296 - RNA, 64 nt, Human
auccuacguuugugccucugcuuuuaaaggugcugugcuggacaguuggcaugccaggguucga

SEQ ID NO: 72297 - RNA, 64 nt, Human
uguguucuuguaggaagaucuguugaaauuccaggugcuggaucauagcacuuggacuguuggg

SEQ ID NO: 72298 - RNA, 64 nt, Human
gggaaacaggacagcagcucugcuagcuuggcuagugcuggagaaaguaccgggaagaaggagg

SEQ ID NO: 72299 - RNA, 64 nt, Human
accauaccuccuuccccgagugacucuggauuuggugcuggaaccagcucucuccuaauauucc

SEQ ID NO: 72300 - RNA, 64 nt, Human
agcucaaaugauccuccugccuuggccucccaaagugcuggaauuacaggcaugagccaccaca

SEQ ID NO: 72301 - RNA, 64 nt, Human
ccguguccucccucuccccgcgccuggcucaggagugcuggaaaagcucacgccucggccuggg

SEQ ID NO: 72302 - RNA, 64 nt, Human
uuuguuuguuuuuagaacauagaguggcauggccgugcuggaaugacaaauaacuggcgugcuu

SEQ ID NO: 72303 - RNA, 64 nt, Human
guguguuaagugcuacggcagcaaauugcuacaugugcuggauaucucuuguuuuccccuccag

SEQ ID NO: 72304 - RNA, 64 nt, Human
ggauccccacaaccucacacuugucuguucuucagugcuggagguccuggcagggucaggcugg

SEQ ID NO: 72305 - RNA, 64 nt, Human
cggaccucucgcgugucaacagacgaccagaggagugcuggagcuccagcagccccaaccacag

SEQ ID NO: 72306 - RNA, 64 nt, Human
aguggacaaagugaaucagagaagagcagagggagugcuggauugggagaucagucgugauuuu

SEQ ID NO: 72307 - RNA, 64 nt, Human
caggaccacgguggacccacgggagaagcuggaggugcuggagaggacauacggggaaauugag

SEQ ID NO: 72308 - RNA, 64 nt, Human
uugaggcagcaucuguugggccacccccggcucagugcuggaauguugcaguguagguuuccca

SEQ ID NO: 72309 - RNA, 64 nt, Human
gcuuccuaaacccaucaucuaaggugacagagcagugcuggaauagcaucuccuuucacuuucc

SEQ ID NO: 72310 - RNA, 64 nt, Human
uuugggggagucuggagagagacuggacaggggagugcuggaaccgcggaguuuggcucaccgc

SEQ ID NO: 72311 - RNA, 64 nt, Human
aguuuugucacagcuugugaauucuguucaccaagugcuggaaucuaaucugcugugccccuaa

SEQ ID NO: 72312 - RNA, 64 nt, Human
cagaacacuggauuuguguguguggcgcuuuagggugcuggacuguauggcugagggcugguug

SEQ ID NO: 72313 - RNA, 64 nt, Human
cccuauagagaaaccauugccaucauuguagcaagugcuggaaugucccuuuuuuccuaugcaa

SEQ ID NO: 72314 - RNA, 64 nt, Human
uuggagggaggcaggaaauuucuuuugaaauaaagugcuggagcugaauucugcauuauuuauc

SEQ ID NO: 72315 - RNA, 64 nt, Human
ucugccauuauuagguccaauagaaaaaguuggugugcuggagcuaccucaccucagcuugaga

SEQ ID NO: 72316 - RNA, 64 nt, Human
ugauaaagcaguauuuggggucauauuguuuccugugcuggagcaaaagucauuacacuuugaa

SEQ ID NO: 72317 - RNA, 64 nt, Human
ugaccucgugauccgccgaccucggccucccaaagugcuggaauuacaggcgugagccacugcg

SEQ ID NO: 72318 - RNA, 64 nt, Human
cuucccugcugccaugaaacuuugccuuaagaaggugcuggauuccaagguuuguaaaggcauc

SEQ ID NO: 72319 - RNA, 64 nt, Human
aucccucuccccacugagccccuugagcuggacagugcuggaugcaggccguccaggugggucu

SEQ ID NO: 72320 - RNA, 64 nt, Human
gcacucacagacugcgugcuuucauguacuuccagugcuggagcaugguaugaccagauuuuau

SEQ ID NO: 72321 - RNA, 64 nt, Human
augcuaaaauauuuucacaaccagaguagaaaacgugcuggaacaaaauugcgaaggcuuuugc

SEQ ID NO: 72322 - RNA, 64 nt, Human
augaguagcaugugacuuuccaagaguuuagguugugcuggaggagagguuuccuucagauugc

SEQ ID NO: 72323 - RNA, 64 nt, Human
gcugcgauccggcagccucucuucacugcuacaugugcuggaaggacaaauaaauaauuguggu

SEQ ID NO: 72324 - RNA, 64 nt, Human
acauuauuugucuccaugauaccacucaagcagugugcuggaccuaaaauacugacuuuaguua

SEQ ID NO: 72325 - RNA, 64 nt, Human
cacaaggcugcuuggccucagugggugcuuggcugugcuggaugauauguugaucuguauugga

SEQ ID NO: 72326 - RNA, 64 nt, Human
uuguuagauguuuaaguuguuuucaagcuucucagugcuggaaaaaauacugagauagacaugu

SEQ ID NO: 72327 - RNA, 64 nt, Human
uuuuuaauucccuacaguuuuauggguguuaucagugcuggagaaucauguaguuaaucccauu

SEQ ID NO: 72328 - RNA, 64 nt, Human
gaauguguaccaucugugugccugcagcuguguagugcuggacagugacaacccuuucucucca

SEQ ID NO: 72329 - RNA, 64 nt, Human
acuucuugcuuuuaugcuagaaaucauuaugauagugcuggacacugaagcaaauaccauacug

SEQ ID NO: 72330 - RNA, 64 nt, Human
ggguggggggaagaacgcaccaaaaacguggugugugcuggaguugucugaaccgauauuucuu

SEQ ID NO: 72331 - RNA, 64 nt, Human
gaggccugugcucugggggucccuugcuuagccugugcuggaccagcuggccuggggucccucu

SEQ ID NO: 72332 - RNA, 64 nt, Human
agccgucaccugauuuuucaguguuucuaccugugugcuggagcucaugaguauuuuauaaacu

SEQ ID NO: 72333 - RNA, 64 nt, Human
uuagcuucugugaagugggauuuauugauccaaagugcuggacacgguauuaggagggaaugcc

SEQ ID NO: 72334 - RNA, 64 nt, Human
accucaagugaucuuccggccucagccucccaaagugcuggauuacaggcgugagccacugagc

SEQ ID NO: 72335 - RNA, 64 nt, Human
cuauaacuggguguauagaguucuucccuuuuuugugcuggaagauauuucacucuggugacua

SEQ ID NO: 72336 - RNA, 64 nt, Human
gacuccuacucccccagagcgugacccggagcaggugcuggacacagagccugucucagcagag

SEQ ID NO: 72337 - RNA, 64 nt, Human
agccaaaaugacuuugaacugaaacuuuucuaaagugcuggaacuuuagugaaacauaauaaua

SEQ ID NO: 72338 - RNA, 64 nt, Human
guaccaccaagggaucugccauugggacccuccagugcuggauuugaugaguuaacugugaaau

SEQ ID NO: 72339 - RNA, 64 nt, Human
gcgcccuugucucagucauugcuguuguauguucgugcuggaguuuuguuggugugaaaauaca

SEQ ID NO: 72340 - RNA, 64 nt, Human
aacucuuuaaaggauucaaacgcaacucaaaucugugcuggacuuuaaaaaaacaauucaggac

SEQ ID NO: 72341 - RNA, 64 nt, Human
ucuggguuguggaaggaaaaugugaaugaaaguagugcuggaugcaauuacuccugaaccccac

SEQ ID NO: 72342 - RNA, 64 nt, Human
ggcucuuuucagagccacccaccuuuucuguaaagugcuggaauacacauacgaugccugaaau

SEQ ID NO: 72343 - RNA, 64 nt, Human
gaagaaaaucgguuuugaaucucaugaaccuugagugcuggagcaucugaucugucucuaugcc

SEQ ID NO: 72344 - RNA, 64 nt, Human
ugaccuuguguuccacccgccuuggccucccaaagugcuggaauuacaggcaugagccaccgcg

SEQ ID NO: 72345 - RNA, 64 nt, Human
ggcaaugugggaaagacucccuauucgaaaauuagugcuggaauaucuggccaaccauaugcag

SEQ ID NO: 72346 - RNA, 64 nt, Human
aggggaaaaguaagcuccuccaaaguugcuugcagugcuggaaauagaucucauuuuuagguuu

SEQ ID NO: 72347 - RNA, 64 nt, Human
gaggcaacuuuccgucuguccuaaagggaagugggugcuggauuuauuagauauuggguuccug

SEQ ID NO: 72348 - RNA, 64 nt, Human
aauauauauguggauccaagcucugauaguucaggugcuggagggaagagagaccuguguguuu

SEQ ID NO: 72349 - RNA, 64 nt, Human
guuccugagaccagaaauacauauuaugaagcaggugcuggaacaggcccuggccccuacuugu

SEQ ID NO: 72350 - RNA, 64 nt, Human
gcugcugcucgagggcgccgagacggugacuccagugcuggacccggccaggagacaaggguac

SEQ ID NO: 72351 - RNA, 64 nt, Human
gcuucccaccuuccaugagugcagcacacagguagugcuggaaaaacgcaucaguuucugauuc

SEQ ID NO: 72352 - RNA, 64 nt, Human
aguaucgaucuuaugaagcuggaggacuugugcagugcuggacucacccaggacuucccaaacc

SEQ ID NO: 72353 - RNA, 64 nt, Human
acauccugaaguaacacuguuuuaaacuuucuuagugcuggaguaaaaggucaaguccaacacc

SEQ ID NO: 72354 - RNA, 64 nt, Human
cauuugccucuuucacaucaugaauuugcuuuaugugcuggaaaaaacaucacauagcuaucac

SEQ ID NO: 72355 - RNA, 64 nt, Human
gcgcccugcuggucucugugagcgccacgcugcugugcuggaaaugccgcuuuaaaaagggaua

SEQ ID NO: 72356 - RNA, 64 nt, Human
uuccguugaaggacuugcauccccauugcgggcagugcuggacgugucccggagacccaccggg

SEQ ID NO: 72357 - RNA, 64 nt, Human
ugaagcucacuuuucagugccauugaugugagaugugcuggaguggcuauuaaccuuuuuuucc

SEQ ID NO: 72358 - RNA, 64 nt, Human
caucuucccaugaccacuccugcccuccugccccgugcuggaucuucccuccccagcugggauc

SEQ ID NO: 72359 - RNA, 64 nt, Human
ugucaagggauauauuucuaucccugccagcacagugcuggacauagugaguacugaacaccua

SEQ ID NO: 72360 - RNA, 64 nt, Human
cugauuacaguucagagcauugauccuggaaugugugcuggagaaauuuaaaauacugggguuu

SEQ ID NO: 72361 - RNA, 64 nt, Human
gugggagucgcagugggcugggggugccugccuagugcuggaguaggggacaaugggaauccua

SEQ ID NO: 72362 - RNA, 64 nt, Human
ccugaaacaggaagaggacggcaccaaguugggggugcuggaugaaagagacgaggggugaucu

SEQ ID NO: 72363 - RNA, 64 nt, Human
gcucuugaauugcucauacagaacaauucugcuggugcuggagucugaagaauauuuucauuug

SEQ ID NO: 72364 - RNA, 64 nt, Human
ucugucuucaggcucugcccaggaacucgcaccugugcuggagcccuguuccucccucccacac

SEQ ID NO: 72365 - RNA, 64 nt, Human
acaucagccuucaagaaucagaagaaaggccaaggugcuggacuguuacugacuuggaucccaa

SEQ ID NO: 72366 - RNA, 64 nt, Human
uggagagagccagaaaacagaucuggaggcagcagugcuggauggaauugucuaggcuguggca

SEQ ID NO: 72367 - RNA, 54 nt, Human
uggggaaggcugaccuuugagccugugcuggacuugagccaaggacaccaucag

SEQ ID NO: 72368 - RNA, 64 nt, Human
gguugcauagucuagaaaggagugugaccugacagugcuggagccuccuaguuucccccuauga

SEQ ID NO: 72369 - RNA, 64 nt, Human
cugugagugagugagcucauaucuccauuugucagugcuggacugguaccagaucguaaccuuc

SEQ ID NO: 72370 - RNA, 64 nt, Human
uguaugcacagaugcagucuggggcaugguuugugugcuggacuuucucauggccaucaucagu

SEQ ID NO: 72371 - RNA, 64 nt, Human
ggcucagucaguccccccaucucacccuccccaagugcuggaauuacaggcgugagcuacugug

SEQ ID NO: 72372 - RNA, 64 nt, Human
caacagagcaguuugugucacugagcuccagucugugcuggauuauugauauuguugguggcgg

SEQ ID NO: 72373 - RNA, 64 nt, Human
gcuccuggccugcucccuggagucccgggauguggugcuggagcucauguccuacuuccucuac

SEQ ID NO: 72374 - RNA, 64 nt, Human
gcacuguggcagccacgagagucugugcacgucugugcuggaaaggguauggaugggaaucaag

SEQ ID NO: 72375 - RNA, 64 nt, Human
uuacuuaacagaacagucaccgacaacaugcugugugcuggagacacucggagcggcgggcccc

SEQ ID NO: 72376 - RNA, 64 nt, Human
uauguaaaauuacacuuugaacuacuagaaaauugugcuggaaauggacacagucuaacaaauu

SEQ ID NO: 72377 - RNA, 64 nt, Human
agggaaauaaaucauuuuuaauccccagaagaaagugcuggaaauagcuucuauauagucagca

SEQ ID NO: 72378 - RNA, 64 nt, Human
uauacuguauuaagagugaaaauugucuucuucugugcuggagauguuuuagaguuaacaauga

SEQ ID NO: 72379 - RNA, 54 nt, Human
cacucaacacaucaucuuaaaguggugcuggaugggugguggccaggugacauu

SEQ ID NO: 72380 - RNA, 64 nt, Human
accucaggugaucugcccgccucagccucccaaagugcuggaauuacaggcgugagccaccacg

SEQ ID NO: 72381 - RNA, 64 nt, Human
ucugccaaaggaugugauauauaaguguacauaugugcuggaauucuaacaagucauagguuaa

SEQ ID NO: 72382 - RNA, 64 nt, Human
augauugcuggucuuaacuuuagguaacucugcugugcuggagaucaucuuuaagggcaaagga

SEQ ID NO: 72383 - RNA, 64 nt, Human
aaugugccacagaggccccaccugaaggguggaugugcuggagggguggcccagagccauacug

SEQ ID NO: 72384 - RNA, 64 nt, Human
cuugcaguugcucugacguagaaagauccuucgggugcuggaagucuccaugaagagcuugugu

SEQ ID NO: 72385 - RNA, 64 nt, Human
ugccggaagggccgcccuucccggcccuggcggggugcuggacacuggccauuuucacuagagu

SEQ ID NO: 72386 - RNA, 64 nt, Human
uucccaagaauucugggcuggcggccugguggcagugcuggagaugaccccgagccccuccccg

SEQ ID NO: 72387 - RNA, 64 nt, Human
uuggggcucacugcagaaaucaugugacugucacgugcuggaaaauaaagugauacaucuugaa

SEQ ID NO: 72388 - RNA, 64 nt, Human
gaggacagcagucuccuucccgugaagcucccaugugcuggaauggcauggacuugcugaucaa

SEQ ID NO: 72389 - RNA, 64 nt, Human
agcacccaggcagugucuugcuggugugucgugagugcuggauguccaagucccugcuggccac

SEQ ID NO: 72390 - RNA, 64 nt, Human
gggccuggagccaagggaugagguuguccaggcugugcuggacagcaccaccuucuucccugaa

SEQ ID NO: 72391 - RNA, 64 nt, Human
ccugcaggagcuggagccggucaucucccgcgcggugcuggacaacccgcaccgugagucuggc

SEQ ID NO: 72392 - RNA, 64 nt, Human
cgccaaggagggcuugcggcacuuucuggaccgcgugcuggaggggcgggcgcagccacagcug

SEQ ID NO: 72393 - RNA, 64 nt, Human
agaauauguaaaaugucuggagagccgaguugcagugcuggaaguccagaacaagaagcuuaua

SEQ ID NO: 72394 - RNA, 64 nt, Human
cuaggucgcucaguacauuaaguuugaaaugccggugcuggacaguuuuguugaaaaauuaaaa

SEQ ID NO: 72395 - RNA, 64 nt, Human
aacuuuacuggcaaaaggguccauguaccaccaugugcuggagcaucuguucuacauguggaua

SEQ ID NO: 72396 - RNA, 64 nt, Human
cccagccaaaucucauguugaacuguaauccccagugcuggagguggggccugcuacgaggugu

SEQ ID NO: 72397 - RNA, 64 nt, Human
aaguacuuuccagccuguguuucaggagaggacugugcuggaucaugcuugcccuccacaggga

SEQ ID NO: 72398 - RNA, 64 nt, Human
gauagaauugugauuucauaauaacacuugaaaagugcuggaguaacaaaauaucucaguugga

SEQ ID NO: 72399 - RNA, 64 nt, Human
gccggugcucggagaagagcgcaguguuuugcaagugcuggagucuccugaggacacgcgcguc

SEQ ID NO: 72400 - RNA, 64 nt, Human
cacuaccaaacacucaguccacuguugagccccagugcuggaagggaggaaggccuuucuucug

SEQ ID NO: 72401 - RNA, 64 nt, Human
gggcucaaugucaccacccucugcauggcccugugugcuggaugguccugaaaccagacaagac

SEQ ID NO: 72402 - RNA, 64 nt, Human
uucuccucgcugauuagcuuccugccugcugucagugcuggacgaagugcuauaacuacuuuau

SEQ ID NO: 72403 - RNA, 64 nt, Human
guagagaugaggucuccugccucagccucccaaagugcuggaauuuacagguaggaccaccaca

SEQ ID NO: 72404 - RNA, 64 nt, Human
ggagacaggccugaagcuggcccuguguggaacggugcuggaccaccuggucggggaggagacc

SEQ ID NO: 72405 - RNA, 64 nt, Human
acaaccauuaguccugaugagugagcugacgcuggugcuggaaccugcuggcaccucacuggcc

SEQ ID NO: 72406 - RNA, 64 nt, Human
gagggagccagaggaguccuauaggcaggcuacugugcuggagcaucccccagcugcucccauc

SEQ ID NO: 72407 - RNA, 64 nt, Human
aucaucauggccagcuggaggcaggggcuuccuggugcuggagguuggaucuugauguaaggau

SEQ ID NO: 72408 - RNA, 64 nt, Human
gccaucuccauuagcucacuuuuaaacaacuagggugcuggaagaaccuuugucugaggguagu

SEQ ID NO: 72409 - RNA, 64 nt, Human
aaagucguuucauuugguuuccacuguguggacugugcuggagcuuggcgccugccagaaaaau

SEQ ID NO: 72410 - RNA, 64 nt, Human
gcacacacuuacagagcacaaaugcaguauauaggugcuggauguauguaaauauauucaaauu

SEQ ID NO: 72411 - RNA, 64 nt, Human
ccuuaauuccaaugugagagacagaaucccuggggugcuggacuggcccuccagaggguaagcc

SEQ ID NO: 72412 - RNA, 64 nt, Human
guacgugcccagcucaggccggcugaccgugguggugcuggaggcucgaggccugcguccagga

SEQ ID NO: 72413 - RNA, 64 nt, Human
gaagcucguggagaagaucauggaccaauaccgcgugcuggagccugugccccugccccggacc

SEQ ID NO: 72414 - RNA, 64 nt, Human
aauaaccacccacggccaggagggccaaggccccgugcuggauauuuaaauuuaggggccgguc

SEQ ID NO: 72415 - RNA, 64 nt, Human
gugaggaagggcaucuuccugacuccucugcccagugcuggaaggagcaugccuggguuagugg

SEQ ID NO: 72416 - RNA, 64 nt, Human
cuaucuguuccccuguccugugaauggaagcaaagugcuggauuguccuuggaggaaacuuaag

SEQ ID NO: 72417 - RNA, 64 nt, Human
cgccucaagcaauucgccccccucggccuccaaagugcuggaauuauaggcaugagcugccgug

SEQ ID NO: 72418 - RNA, 64 nt, Human
uuuuggagugcuugggcagaaaguuguaaaguuugugcuggagaaagguuuauuuggacuuuga

SEQ ID NO: 72419 - RNA, 64 nt, Human
ugguucugccccaccacaaaguuuucuguggcaagugcuggaacauaguuguaggcugaggcuc

SEQ ID NO: 72420 - RNA, 64 nt, Human
aagagcagguguucucagccucacaugcccugccgugcuggacucaggacugaagugcuguaaa

SEQ ID NO: 72421 - RNA, 64 nt, Human
ccugcaggugacccagcuaaggguguucgugucagugcuggacgucaaugacaaugcccccgaa

SEQ ID NO: 72422 - RNA, 64 nt, Human
ugaccucgugauucgcccgccucggccucccaaagugcuggaauuacuggcgugagccaccaug

SEQ ID NO: 72423 - RNA, 64 nt, Human
gugagucagccuagguuaaauagagaguguaagagugcuggacaggaaccuccacccucauguc

SEQ ID NO: 72424 - RNA, 64 nt, Human
acucaggaccuaggauuagaaaauggcagaguuggugcuggauccaccuugcacuucuaucaag

SEQ ID NO: 72425 - RNA, 64 nt, Human
gccugaaaugauccacccacguccaccuaccaaagugcuggaauugcaggcaugagccaccacu

SEQ ID NO: 72426 - RNA, 64 nt, Human
gaaagagagccuauucucacacaugaucuucagagugcuggaaacacacuccugcagaagcugu

SEQ ID NO: 72427 - RNA, 64 nt, Human
ugcccuagcguaaacaguauagcagaaacuuacugugcuggacucuuuaccuuauaauauuaca

SEQ ID NO: 72428 - RNA, 64 nt, Human
auuucuccccugugcuccaaaugacuuuguacaagugcuggaguuagcaccucccucugcccuu

SEQ ID NO: 72429 - RNA, 64 nt, Human
agagacugacacacuccuagcagcugguaaaggggugcuggaggccauggaggagcucuagaaa

SEQ ID NO: 72430 - RNA, 60 nt, Human
gucagaccaacagccagugauccucagauggugcuggaucugggucaucaauucuugcaa

SEQ ID NO: 72431 - RNA, 64 nt, Human
cuagaugauugauuaccaagugccggacuagcaagugcuggagucgggacuaacccaggucccu

SEQ ID NO: 72432 - RNA, 64 nt, Human
agcaguaaauaaugaggaaaaugaauuagcuccagugcuggaacaacuaacuaacuugguguua

SEQ ID NO: 72433 - RNA, 64 nt, Human
uccucaagugauccucccaccucagccuuucaaagugcuggaauuacaggugugagccacucug

SEQ ID NO: 72434 - RNA, 64 nt, Human
uguggacuaagguaaggacagcauuuaaauauuugugcuggagugaggggaagaagcuguuaca

SEQ ID NO: 72435 - RNA, 64 nt, Human
ugcaugauccucaguaugagaaucuaucuguucugugcuggacuucuaauauauagaacuguga

SEQ ID NO: 72436 - RNA, 64 nt, Human
ggaaacauuugagaaccugccucuaucccagaaugugcuggagauuugacacucaaaucagugu

SEQ ID NO: 72437 - RNA, 64 nt, Human
cgccuuuccucucuauauuucgggucgggggcaggugcuggagcacugggcucccgggccccac

SEQ ID NO: 72438 - RNA, 64 nt, Human
uucuuuacaaaccaaaacagaacagaaagguguggugcuggaacaucgaugaaggagcccuacu

SEQ ID NO: 72439 - RNA, 64 nt, Human
cuccagcucagccagaaaaagcccagaaacccaggugcuggaccagggcccucagggaggggac

SEQ ID NO: 72440 - RNA, 64 nt, Human
caacugcugccccugguugaauguucucuugauagugcuggacccuuugucuauuuuaaagcga

SEQ ID NO: 72441 - RNA, 64 nt, Human
gaacuuguaaguucucaacuugggaaagacagaggugcuggaggguaggccucagaccaggggg

SEQ ID NO: 72442 - RNA, 64 nt, Human
cuuaauuuugaaucuuauguaagaggcuugagaugugcuggagagggcaggaagaggaaaguau

SEQ ID NO: 72443 - RNA, 64 nt, Human
agcacugucugaggagggcagagccauggguucugugcuggagggugcacggccaagaucucca

SEQ ID NO: 72444 - RNA, 64 nt, Human
agcucaggugauccacccgucuuggccucccaaagugcuggauuacaggcauaagccacugugc

SEQ ID NO: 72445 - RNA, 64 nt, Human
gccuaugcaggggcugguguauaccauaaccgaugugcuggagcuacacgacuggaugugcacu

SEQ ID NO: 72446 - RNA, 64 nt, Human
guuugggcuuaguuuucucauugguaaaaugugggugcuggauuggaucuuaaagaucccuucc

SEQ ID NO: 72447 - RNA, 64 nt, Human
ugcuaccccaaagcucugaaagaguaagguugaagugcuggaacaugcucagauuguuuuuuag

SEQ ID NO: 72448 - RNA, 64 nt, Human
aggauucugccccugccuguccacagacuccuuugugcuggaaccugggcuccuccagcugcca

SEQ ID NO: 72449 - RNA, 64 nt, Human
uggcauuuaaagggagcucguuugcaggagagaggugcuggagcccuguuugguuccuucucuu

SEQ ID NO: 72450 - RNA, 64 nt, Human
gcugagcaccguggagcacgcgcaccucauuguggugcuggacaagggccgcguagugcagcag

SEQ ID NO: 72451 - RNA, 64 nt, Human
guuuauuauaugguggaugaugauuucaucucacgugcuggacgcuguucuguucagugugcuc

SEQ ID NO: 72452 - RNA, 64 nt, Human
ucauaaugcagcuccuuguggucugguaagaggggugcuggaggacauggacagcgacaaaccu

SEQ ID NO: 72453 - RNA, 64 nt, Human
gaccucaggugauccugagccucagccucccaaagugcuggaauuauaggcgugaaccaccgcc

SEQ ID NO: 72454 - RNA, 64 nt, Human
uuaaagaaccugcuucuuucugcaguagaagcgugugcuggaacccaaagaguacuccuuuguu

SEQ ID NO: 72455 - RNA, 64 nt, Human
cagaugaaugccgagugcuuggucauucugacaggugcuggaugccacaguucccugcagccaa

SEQ ID NO: 72456 - RNA, 64 nt, Human
gcuucuuucucuugggaaaacgggcaaaauaauugugcuggauucucacacacacagaaauauc

SEQ ID NO: 72457 - RNA, 64 nt, Human
cuguuaaaaggauugauuugcuuuuauaguccuugugcuggaugaguggcugccucaguagcaa

SEQ ID NO: 72458 - RNA, 64 nt, Human
ucccgaugccucccuugaggguuugagagcccgcgugcuggagaauugacugaagcacagcacc

SEQ ID NO: 72459 - RNA, 64 nt, Human
agugaaggcgugucuagagugugggcuggcuguugugcuggaaagcuggggacagguugauggu

SEQ ID NO: 72460 - RNA, 64 nt, Human
cuaaucuauuggguucauuauuggaauuaaccuggugcuggauauuuucaaauuguaucuagug

SEQ ID NO: 72461 - RNA, 64 nt, Human
ccucccagcagugccgcagcguuucgaggggcgugugcuggaccccaccacuguggguugcagg

SEQ ID NO: 72462 - RNA, 64 nt, Human
guccagaugaauccugcagggccaaggucugggggugcuggaggccaugcucccuccaggcuug

SEQ ID NO: 72463 - RNA, 64 nt, Human
uccuauacaaauuucuuaaauuguuaggaccaaagugcuggauuacaggugugagccaccgugc

SEQ ID NO: 72464 - RNA, 64 nt, Human
cugucuccuuuagagagacaugaaacuaucacaggugcuggaugacaauaaaaguuuauguucc

SEQ ID NO: 72465 - RNA, 64 nt, Human
cuaugaagaccucaggccagggggugaggaauuagugcuggauuugaagcuacgcacucagccu

SEQ ID NO: 72466 - RNA, 64 nt, Human
aagagaaaagcugaugcuggcaaggagcgggaaggugcuggagaucccaagugaagugugugca

SEQ ID NO: 72467 - RNA, 64 nt, Human
gcaagcucaaauucaguucccugaauggagucaggugcuggaggccguggcagcggaggguggu

SEQ ID NO: 72468 - RNA, 64 nt, Human
gccuccucaaaggcagugcugggcacccacgggugugcuggauacuggaguuugagaggaggga

SEQ ID NO: 72469 - RNA, 64 nt, Human
gaaugacccugccaauggcgagccaagccgggcugugcuggaugcccugcuggagggcaaggcc

SEQ ID NO: 72470 - RNA, 64 nt, Human
accucaggugauccuccugcauuggccucccaaagugcuggaauuccaggcaugagccacugcg

SEQ ID NO: 72471 - RNA, 64 nt, Human
auuuaguccuccagcucuuuuauugagcauccacgugcuggacgauacuuauuuacaauuccua

SEQ ID NO: 72472 - RNA, 64 nt, Human
gguagcuaccccagccgguuuggauuacaggccugugcuggaacaucaucucaguuggccaccu

SEQ ID NO: 72473 - RNA, 64 nt, Human
agcucucagcaucacugaagguaccacaguguaagugcuggacugcaggcugcagugaucccuc

SEQ ID NO: 72474 - RNA, 64 nt, Human
augaccccaaaauaggguuuucuugggcgaggaugugcuggauuaggaaaggugacaugacaca

SEQ ID NO: 72475 - RNA, 64 nt, Human
auaccuuucauaacugguaacugcaaagccuuuugugcuggacccaggaauccuuaccauggag

SEQ ID NO: 72476 - RNA, 64 nt, Human
auuuauaauccacaguaaaguucauccuuugacugugcuggagaauuccaguuguauuugaaga

SEQ ID NO: 72477 - RNA, 64 nt, Human
ugucagaugccagauguaacauuuaccuuguugggugcuggauauuucuguauuccuguaagua

SEQ ID NO: 72478 - RNA, 64 nt, Human
caaacaucggacggcggaauguggcagaugaaaugugcuggaggaaaaaaaugacauuucugac

SEQ ID NO: 72479 - RNA, 64 nt, Human
aaaauacuuuuuaaggccauuuuauauuaagccagugcuggaaaacugaauuuuuuuuauuaug

SEQ ID NO: 72480 - RNA, 64 nt, Human
ggggccgcauuuaaaaggagggaaagauuguuuggugcuggaacauuccagggaaaaggagacu

SEQ ID NO: 72481 - RNA, 64 nt, Human
cucugggccccacacuagccacagcgcgggccuugugcuggaguuugagccugggacagggaga

SEQ ID NO: 72482 - RNA, 64 nt, Human
ccaccugaagguggaguugaagagcuuccuggaggugcuggacgggaagauugacgaccugcau

SEQ ID NO: 72483 - RNA, 64 nt, Human
gccaagagugaaaauagagggaagugucaugcaagugcuggacagaaggcggcaggugggacga

SEQ ID NO: 72484 - RNA, 64 nt, Human
aagggaggagcaugaagaguuguauguuuuuggagugcuggagugacuugugaauuucugaaua

SEQ ID NO: 72485 - RNA, 64 nt, Human
ccugcugguguccaccucguccaacagagucguggugcuggaugcugugucgggccgcaucauc

SEQ ID NO: 72486 - RNA, 64 nt, Human
ccagauagcugguggugggcgcuaauccuccugagugcuggaccucauuaaagugcauggaaau

SEQ ID NO: 72487 - RNA, 64 nt, Human
gcgagagcgccgaggcaggacacagagcacagcugugcuggaaguguggggagaacccggacag

SEQ ID NO: 72488 - RNA, 64 nt, Human
gcgggacuggcaggcagcuccaccugcugccccagugcuggauccacugggugaagccagcugg

SEQ ID NO: 72489 - RNA, 64 nt, Human
ucauuuuuggauggugacagcauuuuuccccucugugcuggauacagacuucucccaggauccu

SEQ ID NO: 72490 - RNA, 64 nt, Human
cuuucccaagaaucccuuguuguggaaguuuccagugcuggaaaagcagcgagccagcguuggu

SEQ ID NO: 72491 - RNA, 64 nt, Human
aucauggaaccagucagcccucuguggagucauugugcuggaccucugaaaagaucugcagggg

SEQ ID NO: 72492 - RNA, 64 nt, Human
cucucugcucugacccuucucaggcccgccugaugugcuggaccaucccccugcugccacggcc

SEQ ID NO: 72493 - RNA, 64 nt, Human
gaucuggccaaggugucuaggguggcccacgggggugcuggaauuggcacuucagggccaggcu

SEQ ID NO: 72494 - RNA, 64 nt, Human
accgccggcgauggacguccaggucccggcuccugugcuggaaagcguugauggggagcgucgg

SEQ ID NO: 72495 - RNA, 64 nt, Human
gcaugggagggucggagggugcugcccgcccuuggugcuggaggcgggcuugguguccggcuca

SEQ ID NO: 72496 - RNA, 64 nt, Human
ccaggcagcugguggugggcgcuaauccuccugagugcuggaccucauuaaagugcauggaaau

SEQ ID NO: 72497 - RNA, 64 nt, Human
cgugcaucucuugucuguuggcagcgagcacaucgugcuggagacacgaguuucuaagcagcug

SEQ ID NO: 72498 - RNA, 64 nt, Human
aaggugaacagaaaccacaaguguccagcccucggugcuggaguggacguuaauugucagccac

SEQ ID NO: 72499 - RNA, 64 nt, Human
gggggcucccacucuuaucaccucuccccagcaagugcuggaccccagguagccucuuggagau

SEQ ID NO: 72500 - RNA, 64 nt, Human
uuuuccucuggggagaagcaaauucaugaugugugugcuggagaucuggcacucauggccagug

SEQ ID NO: 72501 - RNA, 64 nt, Human
auguuuauuaaucacucacugugugccaggcaccgugcuggacaucagaaaugcagugguaagu

SEQ ID NO: 72502 - RNA, 64 nt, Human
accucaggugauccacccgccuuggccucccaaagugcuggaauuacaggugugagccacugug

SEQ ID NO: 72503 - RNA, 64 nt, Human
ugacugaggccugcuucccccucccccuccugcugugcuggaauuccacagggaccagggccac

SEQ ID NO: 72504 - RNA, 64 nt, Human
acccucgccagggccacuucugcacuagggcucugugcuggaacccaggcaugcugccagccuu

SEQ ID NO: 72505 - RNA, 64 nt, Human
uccauucugcuguccucagccucgacccucuucugugcuggacuuccacccacccacccuuuuc

SEQ ID NO: 72506 - RNA, 64 nt, Human
uagugccugggccugggacccacccagagcaccugugcuggaggaugccgagcagggacucucg

SEQ ID NO: 72507 - RNA, 64 nt, Human
aggauucugucuuccaggcccaguccacuggggagugcuggaauggggaccugggguggggagg

SEQ ID NO: 72508 - RNA, 64 nt, Human
augagggcugacguggacuguccacaguguucaugugcuggagucagggacggccgcaccugcc

SEQ ID NO: 72509 - RNA, 64 nt, Human
cuguuuuccccaccaacuuagcucucggaaagaugugcuggagggacccucuuguuaagaaggu

SEQ ID NO: 72510 - RNA, 64 nt, Human
aagcacaagaagugggagugggagaggaagccacgugcuggagaguagacaucccccuccuugc

SEQ ID NO: 72511 - RNA, 64 nt, Human
cuggggagacgaugcuguugcuuugcagaucacagugcuggaagcaggaacccaggguaagugc

SEQ ID NO: 72512 - RNA, 64 nt, Human
ccagaccaaagagaagaugguuaccauggugucagugcuggaggaucugauuggcaagcuuacc

SEQ ID NO: 72513 - RNA, 64 nt, Human
ggcacggguggggcggggccgggccgcagagcaugugcuggaucuguucugugugucugucugu

SEQ ID NO: 72514 - RNA, 64 nt, Human
ccucuggguguacguguacguggacccaaacaaugugcuggacgccgagaaggccuuugugucu

SEQ ID NO: 72515 - RNA, 64 nt, Human
gaguggggagaguggauggacuagacugugcugugugcuggaaaaugaucccggggccaggaca

SEQ ID NO: 72516 - RNA, 64 nt, Human
cuggucugugccugcccagcauguucccaaaucugugcuggacaagcugugggaagcguucuug

SEQ ID NO: 72517 - RNA, 64 nt, Human
gaggacaucagcagucagccugcucagagcgggggugcuggagcgcgugcagacacagcucuuc

SEQ ID NO: 72518 - RNA, 64 nt, Human
gugcgccaccuuacuuuggaagucucuggcuugugugcuggaugaggcugccagaacuuguugg

SEQ ID NO: 72519 - RNA, 64 nt, Human
ucuguggaguccucagucacucugcuguuggagagugcuggaggaaaugcacuuuuacugugcu

SEQ ID NO: 72520 - RNA, 64 nt, Human
uccaccucauucccgugacucguggcaugcgcaggugcuggagcuuggcagccgcgcaggagca

SEQ ID NO: 72521 - RNA, 64 nt, Human
uagggucacugugccucucagcuaguuggcgggggugcuggacuggacucuuguucacuuuacc

SEQ ID NO: 72522 - RNA, 64 nt, Human
acaaggaacagcaagcucaggugggauggccccagugcuggaaagaagcaagagcccccuaugc

SEQ ID NO: 72523 - RNA, 64 nt, Human
caccccccacccuccuccaggacaccacuagguggugcuggaugcuuguucuuuggccagccaa

SEQ ID NO: 72524 - RNA, 64 nt, Human
ucgccucuccugugcguaugggaacaccuagcacgugcuggaugggcugccucugacucagagg

SEQ ID NO: 72525 - RNA, 64 nt, Human
ucccuccuguugccacacuuucacuggggaucccgugcuggaagacuuagaucugagcccuccc

SEQ ID NO: 72526 - RNA, 64 nt, Human
uguggcccuccuggcuggguccccuugguuuuucgugcuggaacauccccaccagagccucucu

SEQ ID NO: 72527 - RNA, 64 nt, Human
ccgaggaggaggaagaaaaacaggccgagugaaggugcuggaaagggagggaggacgcgagggg

SEQ ID NO: 72528 - RNA, 64 nt, Human
gaaaugugucaucuugccaggcaccuggcugagugugcuggagugaggaucuugaacagaaacu

SEQ ID NO: 72529 - RNA, 64 nt, Human
caccagguuuuggggaugcagucaacaacacagagugcuggaagccuguggcagaauacauuga

SEQ ID NO: 72530 - RNA, 64 nt, Human
ucaggugaaauuuugggauugcuaggacccaauggugcuggaaaaaguucaucuauuagaauga

SEQ ID NO: 72531 - RNA, 64 nt, Human
ggagaaaccccccacaacugaccccugccucccugugcuggaauugacuuuccugagcauggac

SEQ ID NO: 72532 - RNA, 64 nt, Human
uggugccugccgaggucugggcguguuugggccggugcuggagccuguccagcuggcccgggcc

SEQ ID NO: 72533 - RNA, 64 nt, Human
accaauauacccccuuuauuuuacuguggaauaugugcuggaaaaauugcaacaacacuuuacu

SEQ ID NO: 72534 - RNA, 64 nt, Human
gcuaucuggccuuacucuuaguaguuuuuaguacgugcuggacaccacuuuuaaaaagcaauca

SEQ ID NO: 72535 - RNA, 64 nt, Human
aaguugggguaaguuugguuggucagagggaguugugcuggagauugugaaaaauggguucuug

SEQ ID NO: 72536 - RNA, 64 nt, Human
cggacaaggugcagccaaccacacgagcaauacugugcuggagagugagaaugggggugagcag

SEQ ID NO: 72537 - RNA, 64 nt, Human
cacacugucccauagccucauugggcucccagacgugcuggaaagguugagcccagaguggccg

SEQ ID NO: 72538 - RNA, 64 nt, Human
caccgugaagugaauucucugagcuggugguguggugcuggaaggaagguuauuuuuggagcca

SEQ ID NO: 72539 - RNA, 64 nt, Human
cguccauaagucaccgaggugugccacccagcaggugcuggaggugcccaaugcucccuccuag

SEQ ID NO: 72540 - RNA, 64 nt, Human
gccuggucagcagagccgccccguguccccccaggugcuggaggcagacucgagggccgaauug

SEQ ID NO: 72541 - RNA, 64 nt, Human
uggaccgucaguggcuggagggagcuucgugucugugcuggagcugcagccugcucgccaucug

SEQ ID NO: 72542 - RNA, 64 nt, Human
cuguuuaauaaccugucuucccagccaauugguggugcuggaauccccuaggagccuucagucu

SEQ ID NO: 72543 - RNA, 64 nt, Human
ugaccucgugauccaucugccucggccucccaacgugcuggaauuacaggcaugagccaccaug

SEQ ID NO: 72544 - RNA, 64 nt, Human
aaaccccuccugugugcuggcccugugcuagacagugcuggagacauaguuggggguggagaac

SEQ ID NO: 72545 - RNA, 64 nt, Human
ccagcaauacagauccguccuugggcaaggcgcggugcuggaugaugggugcggaggaauuugg

SEQ ID NO: 72546 - RNA, 64 nt, Human
aucauugacccaugccuacuccaugccaggcccagugcuggacacagagacaugaagcucuguc

SEQ ID NO: 72547 - RNA, 64 nt, Human
gaagaaaacccaggaaaugccauucuggacauaagugcuggaaaagacuuaaugaugaacaccc

SEQ ID NO: 72548 - RNA, 64 nt, Human
ucaauucuuauaggguauauacucagaaaugguggugcuggaucauauaggauuucuauuuuuu

SEQ ID NO: 72549 - RNA, 64 nt, Human
gccuccagugauccuccauccucggccucccaaagugcuggaaucacaggggugagccaccgca

SEQ ID NO: 72550 - RNA, 64 nt, Human
uggaaacacguagccgcugcaguuggacagcugcgugcuggaguucuguccccaaaccaacugc

SEQ ID NO: 72551 - RNA, 64 nt, Human
ugagaagaaccgcaagcucuuugaucucuuggaugugcuggaguuuaaccaggugauacuucca

SEQ ID NO: 72552 - RNA, 64 nt, Human
gacugucagcaccaucagccugggcucccacaccgugcuggacuucuacgagccgcggcggcca

SEQ ID NO: 72553 - RNA, 64 nt, Human
gcugagccgucccgggccccuacagcgugcacaggugcuggacaaguucauucacguggcacag

SEQ ID NO: 72554 - RNA, 56 nt, Human
cgccggggccagggcgcugagcccucgugcuggaaugguugucugguaucugaacu

SEQ ID NO: 72555 - RNA, 64 nt, Human
aguugucggacagcuaugcagucccuguccgguggugcuggaggcuccacucuccuuagguuca

SEQ ID NO: 72556 - RNA, 64 nt, Human
aaaccaaaacaaauaaagaaacacaaaacccucagugcuggagaagagucagugagaccagcac

SEQ ID NO: 72557 - RNA, 64 nt, Human
ugccccauuucucccaccuccuggaaggggaggggugcuggagauuagauuagacaaugagauu

SEQ ID NO: 72558 - RNA, 64 nt, Human
cacaugaaaaaucaggcagggaaucgaaacgacagugcuggaggagacucaggaagcagaggcg

SEQ ID NO: 72559 - RNA, 64 nt, Human
gggccgugagcaggugggccguugaguuaccucugugcuggaucccgugcccccacuugccuac

SEQ ID NO: 72560 - RNA, 64 nt, Human
uuacugcauggggaaagagauccaggaagcaugagugcuggauauuuuacuaccaaugccaaga

SEQ ID NO: 72561 - RNA, 64 nt, Human
ccagcuucccagugcucacagauggcuggcccaugugcuggaagaugacacaguugccuucucu

SEQ ID NO: 72562 - RNA, 64 nt, Human
aaucucagcuacuugggaggcugaagcaggagaggugcuggaaccugggaggcggagguugaag

SEQ ID NO: 72563 - RNA, 64 nt, Human
gcuggggagaaugaagagcuaaaauagauccuaggugcuggaugcuuugucauccaugcgugca

SEQ ID NO: 72564 - RNA, 64 nt, Human
cuccauucuagaugcuucccuuguauccagugaugugcuggagcuggcuuugccaagcuuguga

SEQ ID NO: 72565 - RNA, 64 nt, Human
gccguccagauucuccuuguuuucauggauucaggugcuggagaaucugguaaaagcaccauug

SEQ ID NO: 72566 - RNA, 64 nt, Human
cacaauagccacacccacaccugagcuguucucagugcuggaacuugaccauccuggaacaccc

SEQ ID NO: 72567 - RNA, 64 nt, Human
guaccacaguauuaaucgcuauuguucauguaucgugcuggaagucugaacugacucuagagga

SEQ ID NO: 72568 - RNA, 64 nt, Human
gugcccguggcucccaccccagggucuggccggugugcuggaugcaugcccaagggugcugggc

SEQ ID NO: 72569 - RNA, 64 nt, Human
cccauucuucacacgccugccagaagcuggaggggugcuggagacccauagagcugaugggagc

SEQ ID NO: 72570 - RNA, 64 nt, Human
gugccuccgcugggcugucuccucaccccucccugugcuggagccugucccaaaaaggugccaa

SEQ ID NO: 72571 - RNA, 64 nt, Human
ggcuuuucccaccuucaccuuugucgcugggucagugcuggaaagcgccccucacuccugcgcu

SEQ ID NO: 72572 - RNA, 64 nt, Human
gaagcagagccaggugccgagcgcgacccugcaggugcuggacgcggugcagcaggucacgagg

SEQ ID NO: 72573 - RNA, 64 nt, Human
cagccgcgcugccgucgggacggcugguccccuggugcuggaggaguggccuccuguuggcucc

SEQ ID NO: 72574 - RNA, 64 nt, Human
uguugucugggcucgaguuucugccccagguugugugcuggaaucgggggguggcucuccugcc

SEQ ID NO: 72575 - RNA, 64 nt, Human
cacggaggaggagaagcgccugauggagcagaaggugcuggaagccgaggugcuggcacugaag

SEQ ID NO: 72576 - RNA, 64 nt, Human
accugcuuacucacucagcaguuacccggccccugugcuggagauaccaagggcaugggugguc

SEQ ID NO: 72577 - RNA, 64 nt, Human
ucaugaugccuuuuuauauuuaaaccccgagauagugcuggaacacugcugagguuuuauacuc

SEQ ID NO: 72578 - RNA, 64 nt, Human
uugaaaaagaaaaauaagcauaaauauauucccagugcuggagagggugggcugagggacuggg

SEQ ID NO: 72579 - RNA, 64 nt, Human
ccucaggugauccacucgccccuuggcucccaaagugcuggaauuacaggcauuagccaccaug

SEQ ID NO: 72580 - RNA, 64 nt, Human
ggagcgccugugagauggucagcguggagcgcaagugcuggacagguggcccgugugccccaca

SEQ ID NO: 72581 - RNA, 64 nt, Human
agucuuuggagcaaggcugcugcccgugccuugggugcuggaguuggaggaggcuguucucagc

SEQ ID NO: 72582 - RNA, 64 nt, Human
guagcuugauucugccuaccauccaggaaaacuugugcuggaauugcugauggaaacaauuaaa

SEQ ID NO: 72583 - RNA, 64 nt, Human
caccccucugaccccugccuucccaggcaggguggugcuggagguggcugcagagagccacuug

SEQ ID NO: 72584 - RNA, 64 nt, Human
gccucccuuaaucugccagaaacuucuagcgucagugcuggagggagaagcugucagggaccca

SEQ ID NO: 72585 - RNA, 64 nt, Human
ccuuuaguuagggacucugguggcacuacacggggugcuggauucaaaucucaccucuauggau

SEQ ID NO: 72586 - RNA, 64 nt, Human
cacgguucugggagcucugcaaaaucaguagcaagugcuggaaaaggcacaugccgaagauacu

SEQ ID NO: 72587 - RNA, 64 nt, Human
guccaccgccaccggggucugcgauggcacgccagugcuggagccgcagccaggcgaggccacu

SEQ ID NO: 72588 - RNA, 64 nt, Human
gcaucuaagauuugggcauuugguuauuaauagcgugcuggacuauucaggaauaaggaaaaug

SEQ ID NO: 72589 - RNA, 64 nt, Human
cacacuccuacaccuaacucaccuaacucauacugugcuggagccacuaacuagagcagcccug

SEQ ID NO: 72590 - RNA, 64 nt, Human
gcucagugggggucagguccagguccccgaagaggugcuggagaggaaagcagggagccacugc

SEQ ID NO: 72591 - RNA, 64 nt, Human
ugccaaggcaagugacuagacucgcgcuaauacagugcuggacaacacauucaccuuuucugug

SEQ ID NO: 72592 - RNA, 64 nt, Human
acauccagaacaaaagggccccucuaguagcugugugcuggauuauucaggacugauuaacuca

SEQ ID NO: 72593 - RNA, 64 nt, Human
aagugagcugcucacaguguggucagggcugcgcgugcuggaggcccuccugccugggccuugu

SEQ ID NO: 72594 - RNA, 64 nt, Human
auguguaauuacuuaaggauaugaagaugagauugugcuggauuauuaagcacccuaaaugcca

SEQ ID NO: 72595 - RNA, 64 nt, Human
ucgagcugugcccugggcaucacugagcagaggggugcggcagcuucaggaggcagaaacgaga

SEQ ID NO: 72596 - RNA, 64 nt, Human
ucuguuuguuuaacgauuaaguccaaaucuccaagugcggcacugcaaagagacgcuucaagug

SEQ ID NO: 72597 - RNA, 64 nt, Human
ugcgugguuccucaccaggcugguccugccauacgugcggcaccugaagggggaggaugacaag

SEQ ID NO: 72598 - RNA, 64 nt, Human
cccagccuuccccuucucccccggggcagggacagugcggcauauucagauucagaccucuuug

SEQ ID NO: 72599 - RNA, 64 nt, Human
gugaagguauagcaccaccccagguccuccugcagugcggcauccccuuggcagcugccgucag

SEQ ID NO: 72600 - RNA, 64 nt, Human
gcugcucaucagcuuuuuuaccauugagccaggagugcggcaggcaguaccugccugacccuuc

SEQ ID NO: 72601 - RNA, 64 nt, Human
uuuaaaacacaagugaaaguuuagccaugguuuugugcggcaucauaguuaugucaauaaaguu

SEQ ID NO: 72602 - RNA, 64 nt, Human
gagugucagggucucugggcaacguccauucagggugcggcauggcugucacaaagcuuuauuu

SEQ ID NO: 72603 - RNA, 64 nt, Human
cggggauggauuggccuccagggcgcaggggagggugcggcagggcaggagcuuggcagagaga

SEQ ID NO: 72604 - RNA, 64 nt, Human
uugaggggaccaagguggcacggugguacugggggugcggcagggacacccgaccacaccagag

SEQ ID NO: 72605 - RNA, 64 nt, Human
uuuuagucuguguaguuaauuuaauuugcaguuugugcggcagauugcucugccaagauacuug

SEQ ID NO: 72606 - RNA, 64 nt, Human
gagaccagcucuccagccuggcaggaaagagggggugcggcagccaagggggacugcaagggac

SEQ ID NO: 72607 - RNA, 64 nt, Human
uuuucggugggacagccccagggcccuaacgggggugcggcaggagcaggaacagagacucugg

SEQ ID NO: 72608 - RNA, 64 nt, Human
ugaacagcucaguucugucauccaggacauggccgugcggcagcaccugcucacuaaccuggua

SEQ ID NO: 72609 - RNA, 64 nt, Human
caggguuucccaggaggaggaggccccugaaggggugcggcagcaggggggugggaagggaggg

SEQ ID NO: 72610 - RNA, 64 nt, Human
uuuugacugcauuggagucaugcagucacguuuggugcggcaacuccaugcaagcuguugacca

SEQ ID NO: 72611 - RNA, 64 nt, Human
gcacaccuggguguugcagggacccgcagcucccgugcggcaccggcccuagccaggccuuacu

SEQ ID NO: 72612 - RNA, 64 nt, Human
ccaugucuggaagugacuaugccugagucccagggugcggcagguaggaaacauucacagauga

SEQ ID NO: 72613 - RNA, 64 nt, Human
ccucacaagugggacucugggccucugaccagcugugcggcaugggcuaagucacucugcccuu

SEQ ID NO: 72614 - RNA, 64 nt, Human
ucugcacuuaacaagcucccaggccgagaagccagugcggcagguucacaggcgaggccuggag

SEQ ID NO: 72615 - RNA, 64 nt, Human
uggugcucucuuacucuuucauccacgugcacuugugcggcaucugcaguuuacaggaacggcu

SEQ ID NO: 72616 - RNA, 64 nt, Human
ggaggacagagcaagugggaaggggguauggugagugcggcaaucccucauccucuuagaagca

SEQ ID NO: 72617 - RNA, 64 nt, Human
cuauuauauauauauuuuuugcaaaucucacaaagugcggcaagcccagcuggucaggaaagag

SEQ ID NO: 72618 - RNA, 64 nt, Human
uuacccagaugguucugggggagacagaaaagaggugcggcaggacucuuaucuuaaaaaguaa

SEQ ID NO: 72619 - RNA, 64 nt, Human
ugacccaggaccuacaaccacacugaaggcuccagugcggcagagccucgugcaagcaggagag

SEQ ID NO: 72620 - RNA, 64 nt, Human
cacuucggcagccaacucgaaagcaggcgguugugugcggcagcaguuggcguuugcuuugcac

SEQ ID NO: 72621 - RNA, 64 nt, Human
gggaccuucccgaaaacguucuggcucucaucuggugcggcauguguccacuuugccuuuaagg

SEQ ID NO: 72622 - RNA, 64 nt, Human
ucauaucuucacauauggcccuuucugaaucaaagugcggcaaaguaaauauugucuaagcuuu

SEQ ID NO: 72623 - RNA, 64 nt, Human
cagacaggauucagaauaaggagagaaugacaucgugcggcaggguccuggaggccacuugcgc

SEQ ID NO: 72624 - RNA, 64 nt, Human
acuggugcucaccucuaccuccuguccucaggccgugcggcacgacauggccagcacgcagaag

SEQ ID NO: 72625 - RNA, 64 nt, Human
ccacaucuuggagauugacugucagcgcauggucgugcggcaugcccgccgccugcuccccaca

SEQ ID NO: 72626 - RNA, 64 nt, Human
uccaguuuguauucuuaggaaucauucuuaggcagugcggcagaagcaggccucugugaagugu

SEQ ID NO: 72627 - RNA, 64 nt, Human
cuggagaaaugcuuacuucuagagggagaagacugugcggcacaggaaacagcaaacagugggg

SEQ ID NO: 72628 - RNA, 61 nt, Human
acagugacgaggagaacugagggcacguggggugcggcagcgggcuagggcccagggcagc

SEQ ID NO: 72629 - RNA, 64 nt, Human
accugugucuaaagaauuaaaagaauuuggccgggugcggcagcucaugccuguaaucccaaca

SEQ ID NO: 72630 - RNA, 64 nt, Human
cggcgagacgcggguggcggcagggcgucccagggugcggcaccgcggcuccaguccuuggaaa

SEQ ID NO: 72631 - RNA, 64 nt, Human
gacccuguggguuucuguccccagggagcagacugugcggcacccaggcccaguggcaccauuu

SEQ ID NO: 72632 - RNA, 64 nt, Human
gugugaacuuuauagaauccucucuguacuggaugugcggcagagggguggcuccgagccucgg

SEQ ID NO: 72633 - RNA, 64 nt, Human
gcuggugacagggccaggguuaugcaggaagguggugcggcauugccuuccacauauguaaguc

SEQ ID NO: 72634 - RNA, 57 nt, Human
cucccucuguuuccagauagcugccuggugcggcagcggcggccaaaucuuccgucc

SEQ ID NO: 72635 - RNA, 64 nt, Human
gugcaggcugccugugaggcuccaggcgguggaggugcggcagcugcugcucaggugccaugcc

SEQ ID NO: 72636 - RNA, 64 nt, Human
auaggaaaagggccucuaacaaggagaaauuagugugcggcaaaaggcaguuuucuuuguucuc

SEQ ID NO: 72637 - RNA, 64 nt, Human
uuuuauuuuuguagagacagaaucuugcuauguugugcggcaagcuagucuugaacucauggcc

SEQ ID NO: 72638 - RNA, 64 nt, Human
aggagcacuggccgucuuuugaaaacuugcugaagugcggcauggagguauuccuggccuguuu

SEQ ID NO: 72639 - RNA, 56 nt, Human
uccgcaggauccagcagugaacaggggugcggcacggaggagcgcaugcgugcuua

SEQ ID NO: 72640 - RNA, 64 nt, Human
ucggcugcugucggaugaggacguagcgcucauggugcggcaggcucguggccuccccucccag

SEQ ID NO: 72641 - RNA, 64 nt, Human
gcaaugaggaggaguggaaaacaaaacccagaaagugcggcaggaccagccugacgcacacgcu

SEQ ID NO: 72642 - RNA, 64 nt, Human
gggagggcgagugggucuccauuccccgagaagccgggggcagggugggauggggaagaccagg

SEQ ID NO: 72643 - RNA, 64 nt, Human
cugccuccccccccauccugucaggcacaggugacgggggcagcccaugcgagcccuucuccug

SEQ ID NO: 72644 - RNA, 64 nt, Human
cugccaggcucaccuucuuccugguaacggguaacgggggcagcgcccaggaucacccagagcu

SEQ ID NO: 72645 - RNA, 64 nt, Human
gcauuucacuggaacagagucuuaugugcugcaccgggggcaaaacaacacuuugucagugcuu

SEQ ID NO: 72646 - RNA, 64 nt, Human
uaaugaagcuuaacccuauguagaaagucucuuucgggggcagaggcuuucucugggugccaag

SEQ ID NO: 72647 - RNA, 64 nt, Human
gacucagccaccgccggggggagggugaggcggccgggggcauuaacugaccucugaguacagc

SEQ ID NO: 72648 - RNA, 64 nt, Human
caccuuccagugugcagaaguuagaagggucuggcgggggcagugccuuacacaugcuugauuc

SEQ ID NO: 72649 - RNA, 64 nt, Human
cacgagugcuccagagcccacgaggcuugcagaucgggggcauaggaauuuggaauccaagagc

SEQ ID NO: 72650 - RNA, 64 nt, Human
ucugcgugauucaagcuuuccugaacuggaacgucgggggcaaagcauacacacacacuccaau

SEQ ID NO: 72651 - RNA, 64 nt, Human
cuggguucuggggcaaacgcugcuucguggcccccgggggcacaagacaccggccccucccacc

SEQ ID NO: 72652 - RNA, 64 nt, Human
cugguccccagagcucacccagaaagcaucuugccgggggcagggcauucccucggaaguccug

SEQ ID NO: 72653 - RNA, 64 nt, Human
ccagcugcugggcaaggaauuccagugccuccuacgggggcagcacacuuagauauuccuggac

SEQ ID NO: 72654 - RNA, 64 nt, Human
ggugagacugggcugagguuggagaaggggcagccgggggcacugcugaggguuugccgugcac

SEQ ID NO: 72655 - RNA, 64 nt, Human
ugaacugugcuauuuuguucaaauguugacucuccgggggcacuggcucauuccaagacuguuc

SEQ ID NO: 72656 - RNA, 64 nt, Human
aucucucccugcgcaccaggcugagccgaagcugcgggggcaggccgggccugcugucaccucg

SEQ ID NO: 72657 - RNA, 64 nt, Human
gaaaucacuacuguguuuugcugcguaucuggggcgggggcagguuggggggcacaaaguuaac

SEQ ID NO: 72658 - RNA, 64 nt, Human
gaugcccggccacccugggaggcuugccagaugccgggggcagucagcauuaaugaaacucaug

SEQ ID NO: 72659 - RNA, 64 nt, Human
cgugggcaccaaggacuucccagacggagagcuucgggggcacguggcugcccugcccuacugu

SEQ ID NO: 72660 - RNA, 64 nt, Human
cagacugggaaauacugagcagagacggcuggggcgggggcaggaggaggggcugcucucugag

SEQ ID NO: 72661 - RNA, 64 nt, Human
caacccuccuccagguggcuggcugcaagugugacgggggcaccuucggccgcuacugcgaggg

SEQ ID NO: 72662 - RNA, 64 nt, Human
ccuaaugagaaccaaucaucauggaagucaguugcgggggcagcccauaaggaaagggaaagug

SEQ ID NO: 72663 - RNA, 64 nt, Human
gcuuucagaagaauguauaucaucgggaaaaguucgggggcagagugggggaaucaggcuuuau

SEQ ID NO: 72664 - RNA, 64 nt, Human
agcugauccauguugccuucaaguuuguuuuucucgggggcaucucucucaucagauaagacag

SEQ ID NO: 72665 - RNA, 64 nt, Human
aaucucccguagaaagguuugguuugaaaugccccgggggcagcaaacugacaugguugaauga

SEQ ID NO: 72666 - RNA, 64 nt, Human
ggccgcucaugggccuucuuucugccucagaggacgggggcagagaagugaugaagggaaaugu

SEQ ID NO: 72667 - RNA, 64 nt, Human
aagugugaugggugggggggugggaggcaugggccgggggcaguucucuccucacuuguaaacu

SEQ ID NO: 72668 - RNA, 60 nt, Human
gccgccagaccguggcguagccugcaggcucgggggcauagccggagccacucugcuugg

SEQ ID NO: 72669 - RNA, 64 nt, Human
gggccccaccuacagagagggcucagggcuggaccgggggcauugugugcuugggccgacccgg

SEQ ID NO: 72670 - RNA, 64 nt, Human
acagcacccaaggggagggcugggggcaccggcacgggggcagcgugcagcccugcccugucag

SEQ ID NO: 72671 - RNA, 64 nt, Human
ugaagaugucuuccucucggacccucugcugccccgggggcagcguguuccccuguaccugucc

SEQ ID NO: 72672 - RNA, 64 nt, Human
gcccagucgccagggggcgcccgcgggagcccggcgggggcacgcgccacguggccgggagacg

SEQ ID NO: 72673 - RNA, 64 nt, Human
cugucagcccaagcagagugauucaggggcuccccgggggcagacaccugugcaccccaugagu

SEQ ID NO: 72674 - RNA, 64 nt, Human
ccuccaccugugucugaaugcaacagggguguugcgggggcaacaugagagccccucaccccca

SEQ ID NO: 72675 - RNA, 64 nt, Human
ggggccuuccgaccacucagcugucagggcacugcgggggcagacaccucuggccugaagucac

SEQ ID NO: 72676 - RNA, 64 nt, Human
gaggagugagauguggauguugcuuuugcaccuacgggggcaucugaguccagcuccccccaag

SEQ ID NO: 72677 - RNA, 56 nt, Human
uucaguccguguuuaagugauucucccgggggcaggguggggagggagccucgggu

SEQ ID NO: 72678 - RNA, 64 nt, Human
uguugggcuuuggguauaaaggagggggauucuacgggggcaguagcucaacaaggaauagagg

SEQ ID NO: 72679 - RNA, 64 nt, Human
gaggaacuuaaacgagucuaccagugucuagacacgggggcaggucuguccggcacagcagcuc

SEQ ID NO: 72680 - RNA, 64 nt, Human
gagagggucucaagaguugucccuggaaggagggcgggggcagucugcaucuauuucagguugu

SEQ ID NO: 72681 - RNA, 64 nt, Human
accccgaccccagcccccagccucagccccgguccgggggcagccaggccucucggguucucuc

SEQ ID NO: 72682 - RNA, 64 nt, Human
ggcugguaggcagggaagagaaagggcaccccagcgggggcauguguggaggcagcacggaaca

SEQ ID NO: 72683 - RNA, 64 nt, Human
cugguguggcuucagcuugaaagcaaccuggagucgggggcacagccuuuggggccuggcuggg

SEQ ID NO: 72684 - RNA, 64 nt, Human
gcgccgggccacucggggcugagcugggggcgagcgggggcaggcggcugauguuuuauaaauu

SEQ ID NO: 72685 - RNA, 64 nt, Human
cccgcccagcagcaccacggaccccagccacucucgggggcagacgucagaauccguuccugag

SEQ ID NO: 72686 - RNA, 57 nt, Human
agcugccaagcaccauuuaggggccgacgggggcagcugccccaucccucccccaac

SEQ ID NO: 72687 - RNA, 64 nt, Human
auuaucaccagcagacacugccgggccucccucccgggggcacugccugaaggcgagugugggc

SEQ ID NO: 72688 - RNA, 64 nt, Human
augagcggccccgcccguagaucauccccgagggcgggggcaacgauucacagccuccgcggac

SEQ ID NO: 72689 - RNA, 64 nt, Human
gaagggcguccaugccaaggccccauaccugggccgggggcagcacggccuggcuuucccccgc

SEQ ID NO: 72690 - RNA, 64 nt, Human
aaagcgugugcagcacggggcgaaguccgcgcugcgggggcagcggccccggcuccuucuugua

SEQ ID NO: 72691 - RNA, 64 nt, Human
gaauggagcuuacaagaucugucuuuccaauggccgggggcauuugguccccaaauuaaggcua

SEQ ID NO: 72692 - RNA, 64 nt, Human
aacugagaggcugcucuuagggagggcaaagguucgggggcagccagugucucccaucagugcc

SEQ ID NO: 72693 - RNA, 64 nt, Human
cagauuggugcuguucgcagaguaggccuuugcccgggggcagacuuagaaggaaggggagaga

SEQ ID NO: 72694 - RNA, 64 nt, Human
ugcauggcucuggcauauagaaacaauuuauugccgggggcaauagggguaagagaagccagaa

SEQ ID NO: 72695 - RNA, 64 nt, Human
ccugauggagugugcagacagccaugcguggccacgggggcagugugaggaccucccugucucc

SEQ ID NO: 72696 - RNA, 64 nt, Human
ggcggcuugggagaaugagcugcagaagaugacccgggggcagcuucaggaugaguuagagaaa

SEQ ID NO: 72697 - RNA, 64 nt, Human
ucagcugggaucuucugccaccaucagggacaaacgggggcaggaggaaagucacugaugccca

SEQ ID NO: 72698 - RNA, 64 nt, Human
uuuccuuuucgccuuuccucucuauauuucgggucgggggcaggugcuggagcacugggcuccc

SEQ ID NO: 72699 - RNA, 64 nt, Human
ggcuccucccagaaccugucuggaggcucagaaacgggggcagugacaguggagucagcugcuc

SEQ ID NO: 72700 - RNA, 64 nt, Human
acgaaaagaggggaagagacuuggaaaugggagacgggggcagagagggacccuccaccaccuc

SEQ ID NO: 72701 - RNA, 64 nt, Human
ccagcacuccugggucucggggucggggaggggacgggggcacccacuuccuugucugugacgg

SEQ ID NO: 72702 - RNA, 64 nt, Human
gaacccaauaugggcauaaauguaacaccuguagcgggggcagauucucuguauguucaguuaa

SEQ ID NO: 72703 - RNA, 64 nt, Human
uuaaaauagaguuaaagggaagugauguacauuucgggggcauuaggguagggagaugaaucaa

SEQ ID NO: 72704 - RNA, 64 nt, Human
aaaagguuguuccuaaaauaagggcagagucacacgggggcagcugauacaaauugcagacugu

SEQ ID NO: 72705 - RNA, 64 nt, Human
uccagcacacucuuccauccuguccuguccaaugcgggggcacugcagaacucucuagaaaugu

SEQ ID NO: 72706 - RNA, 64 nt, Human
gcauuccacccccaacaucggcacugagggacaucgggggcaaguuugcaguggggccggaaaa

SEQ ID NO: 72707 - RNA, 64 nt, Human
ccacugccagcacugggguggcagccugccacaucgggggcaccacccuccaugccuuugcagg

SEQ ID NO: 72708 - RNA, 64 nt, Human
ugcucugcaccugcaaccaggugucguccacgggcgggggcaugguaacagugguccuguugau

SEQ ID NO: 72709 - RNA, 64 nt, Human
ugccuuuccuggaagagggcacgggcgaucccgacgggggcauuccugcgggugagagccgucc

SEQ ID NO: 72710 - RNA, 64 nt, Human
cuacgaucaggugcaggggcugcccaggacaaagcgggggcaggggaaagacaccacccucgcc

SEQ ID NO: 72711 - RNA, 64 nt, Human
auuaggugcuggggucuuagcguccagcgcagcccgggggcauccuggaggcucugcuccuuag

SEQ ID NO: 72712 - RNA, 64 nt, Human
gugaaacacgucucuucucuaccagcugccgcggcgggggcaaagcccccagagccucacuggc

SEQ ID NO: 72713 - RNA, 64 nt, Human
uuuccaaccggcuuuguggcacuggggcaggggccgggggcagucugagagaggccauucuuuc

SEQ ID NO: 72714 - RNA, 64 nt, Human
acuccggcccuccagagccccacagccccaucugcgggggcagugcucacccacaccauaagcu

SEQ ID NO: 72715 - RNA, 64 nt, Human
ccagagagguggggauccugccuaagguugucuacgggggcacuuggaggaccuggcgugcuca

SEQ ID NO: 72716 - RNA, 64 nt, Human
agggagccauggaaggugccagaaggaagguuggcgggggcacgugugggccguggcuugggcu

SEQ ID NO: 72717 - RNA, 64 nt, Human
uccaaaguuaaagcucuggggucaggggaggggccgggggcaggaaacuaccucuggcuuaauu

SEQ ID NO: 72718 - RNA, 64 nt, Human
cucaccucccgucgggcacuggcgggagcaaggucgggggcaggcgcugcccagcuggccgcac

SEQ ID NO: 72719 - RNA, 64 nt, Human
cccaugagccaguucagcccuacugggggcugagcgggggcauccccuccuuuguacauagucu

SEQ ID NO: 72720 - RNA, 64 nt, Human
uaucguagcugcccuaauguugcauauuaggcggcgggggcagagauaagggccaucucucugu

SEQ ID NO: 72721 - RNA, 59 nt, Human
auggggccgugcucugguagcccuggccccgggggcaggaggcucugguuccucacucc

SEQ ID NO: 72722 - RNA, 64 nt, Human
gggccuucccggcgggggggaaggaggugggcaucgggggcauggggccuggccucuggccgug

SEQ ID NO: 72723 - RNA, 64 nt, Human
cccccgagguuguguccagggugaugaguguggacgggggcaccagucaguucucccuugaagu

SEQ ID NO: 72724 - RNA, 64 nt, Human
agucacucccaagcccccuccuugucugugcauccgggggcagcucuggaggggguuugcuggg

SEQ ID NO: 72725 - RNA, 64 nt, Human
acccccccaaaacaacccaacccacgaggaccaucgggggcagagucguuggagacugaagagg

SEQ ID NO: 72726 - RNA, 64 nt, Human
ccaugaaccucagggucagggaaugagccaggcacgggggcaugggcagagagggccacggggc

SEQ ID NO: 72727 - RNA, 64 nt, Human
agccaaguggguccaggccaggagauggggggggcgggggcagcugugucaucuuucuggggcc

SEQ ID NO: 72728 - RNA, 64 nt, Human
ccagccucccucccugugccagaccucaaaacgacgggggcaggugcaaguucauaggucucca

SEQ ID NO: 72729 - RNA, 64 nt, Human
cccugggggcuggugucauguugggcuccuggggcgggggcacggccuggcauuucacgcauug

SEQ ID NO: 72730 - RNA, 64 nt, Human
gcugucagccuucugagcacccagcgaggaggggcgggggcaggggcugcagcccccagcgcug

SEQ ID NO: 72731 - RNA, 64 nt, Human
gaagacaggccguccagcccgugcccgccugcggcgggggcacccagcaagcccgcccaccgcc

SEQ ID NO: 72732 - RNA, 64 nt, Human
gggaaggcucuguccagaaaggauugaaugugaacgggggcacccccuuuucuugccaaaauau

SEQ ID NO: 72733 - RNA, 64 nt, Human
gaggcugacgugcuccacugacugugccgaggggcgggggcaggaggacggcaagaccuauuua

SEQ ID NO: 72734 - RNA, 64 nt, Human
ugggaugggcccuccaagcccaagccuccugcuccgggggcagaccagacucugacucuccucu

SEQ ID NO: 72735 - RNA, 62 nt, Human
aagaaaucauggagaacugagcccgcgcgccacgggggcaccuuggaagaccaagagaggcc

SEQ ID NO: 72736 - RNA, 64 nt, Human
cauccagcuccuccccuagagcaaugcugaggagcgggggcaugguagcagggcugucugguuu

SEQ ID NO: 72737 - RNA, 64 nt, Human
ccgcccccggcuccuccagguccugcuggcuccucgggggcaggguucccuggaccucccaguu

SEQ ID NO: 72738 - RNA, 64 nt, Human
ucauagcagggauuaccugaaggccagcaggagccgggggcaggcccaggauccucagaggaag

SEQ ID NO: 72739 - RNA, 64 nt, Human
acagcccaggggcagaugaaggggcugcggaagacgggggcaguccugggggugcugcggcuac

SEQ ID NO: 72740 - RNA, 64 nt, Human
aggaagaaagauaauugaggggcgugucugggggcgggggcaggaggggagcgggguggaggga

SEQ ID NO: 72741 - RNA, 64 nt, Human
gcagugacugugaagugacuccaggacggaccugcgggggcacccagagguccuaagccccagg

SEQ ID NO: 72742 - RNA, 64 nt, Human
aggcagcccuguguguuuaccguucaucaccacucgggggcaccgggccgcccacccacuccca

SEQ ID NO: 72743 - RNA, 64 nt, Human
gacugaugagaaaagugaccacgugggggucagucgggggcaaggggcucagccccacuggacu

SEQ ID NO: 72744 - RNA, 64 nt, Human
ggugugacuccugagugccccgcggcuguggugccgggggcagggugcgugggaggacggagcc

SEQ ID NO: 72745 - RNA, 64 nt, Human
accacccaguuuggggacccagugggaccaggugcgggggcagagggugacuuaccaagagcca

SEQ ID NO: 72746 - RNA, 64 nt, Human
ccagccuucugcccgccccaucgaggaggccccucgggggcagcacaucuuccuccucgcagga

SEQ ID NO: 72747 - RNA, 64 nt, Human
uuguucagacuaaaugaauguaucugggaggggucgggggcacgaguugauuccaagcacaugc

SEQ ID NO: 72748 - RNA, 64 nt, Human
gaggcagggugggauuuuagaguuagugucugugcgggggcagcccugagccuggaguugagac

SEQ ID NO: 72749 - RNA, 64 nt, Human
cccgggccccgacggcccggaaguuccgcguguccgggggcaccgggggauuggccggggcgcg

SEQ ID NO: 72750 - RNA, 64 nt, Human
agagcagccucagcugagcacagguccgagggggcgggggcagggccaagaguucaaaagaagc

SEQ ID NO: 72751 - RNA, 64 nt, Human
cuccaaccgggaugggagccgggcaaacuggccgcgggggcaggggaggccaucuggagagccc

SEQ ID NO: 72752 - RNA, 64 nt, Human
cccucccaaggcugugcguuccugagggccaggucgggggcaggcauggaggggaggaaaggcg

SEQ ID NO: 72753 - RNA, 64 nt, Human
uggggagcaguuguccuuccugucgucgucugccgugugccaucuuuccuggaucuuguagugg

SEQ ID NO: 72754 - RNA, 64 nt, Human
ugagauuucccaagugcauccucagaagcucugggugugccagaggacccccagaacuaagaag

SEQ ID NO: 72755 - RNA, 64 nt, Human
cgccucggccucccaaagugcugggauuacaggcgugugccacugcgcucggccucagauucca

SEQ ID NO: 72756 - RNA, 64 nt, Human
caccuggaacggggccugggggaccuggggucuggugugccaggcaccaggcugccucugcucu

SEQ ID NO: 72757 - RNA, 64 nt, Human
caggggaugggggugggggggcgguucucgaggugugugccagcuacacguguguucuguaugg

SEQ ID NO: 72758 - RNA, 64 nt, Human
cuugccucagccucucaaagugcugggauuacaggugugccaccgcgcccggccaagaugggag

SEQ ID NO: 72759 - RNA, 64 nt, Human
caaaaugcuaaaacaugaugauuaagugcacaccgugugccauagaauggcacaugucauugcc

SEQ ID NO: 72760 - RNA, 64 nt, Human
ugcugcugggcggggcaggagaggagccuggccagugugccacauuaaauacccgugcaggcgc

SEQ ID NO: 72761 - RNA, 64 nt, Human
gucgcuuucccuuggauaccuagaccguuauaaagugugccacauggacuuaccgagcauggag

SEQ ID NO: 72762 - RNA, 64 nt, Human
cuguguggccaaggugaauagcacagguuagggugugugccacaccccaugcaccucagggcca

SEQ ID NO: 72763 - RNA, 64 nt, Human
cuagugcuaaguauuauggugagcuaucauuaaagugugccaucuuggauaaaggccuuuugcc

SEQ ID NO: 72764 - RNA, 64 nt, Human
uaucuggcuugguuuuaauuauguucuuaaauuugugugccaauaauugcauauagauuuuuuu

SEQ ID NO: 72765 - RNA, 64 nt, Human
ugccucagccuucugaguagcugcgacuaugggcgugugccaccaugcccagcuaauuuuugca

SEQ ID NO: 72766 - RNA, 64 nt, Human
aggcuaccugcuccaaggcggagggugggagcaggugugccagggcucagggcucagacuuggg

SEQ ID NO: 72767 - RNA, 64 nt, Human
ucugccucagccucccgaguagcugggacuacaggugugccaccacgccuggcugauuuuugua

SEQ ID NO: 72768 - RNA, 64 nt, Human
aaggcaaucaagagcuuccagaaaugccacacuugugugccacagaguuccccgcugacccuug

SEQ ID NO: 72769 - RNA, 64 nt, Human
cauccuuccaacauauauuuauugaguaccuacugugugccaggggcuggugggacagugguga

SEQ ID NO: 72770 - RNA, 64 nt, Human
uucucugggacccuggaauccuagguacccacaugugugccaaagccuaccccaccuggcaggu

SEQ ID NO: 72771 - RNA, 64 nt, Human
gcacuuccucucucggagcccucagacaucuccagugugccagacaaauaggagugaguguaug

SEQ ID NO: 72772 - RNA, 58 nt, Human
cccaucagcucuacaucugagggacauggugugccacaggcugcaagcugcagggaau

SEQ ID NO: 72773 - RNA, 64 nt, Human
gguccuuugcggugagcuauguuuacaugacacagugugccaaagugacuuacugcgguugcgu

SEQ ID NO: 72774 - RNA, 64 nt, Human
acacauuagaagaugaugauguuagaugcccaucgugugccacaagugguuuuuucauuaugua

SEQ ID NO: 72775 - RNA, 64 nt, Human
ugccucagccuucugaguagcugggauuacacgcgugugccaccacgcucggcuaauuuuugua

SEQ ID NO: 72776 - RNA, 64 nt, Human
gccacuuaggccaugacuggauuuaaugucaguggugugccacagugcagaggcuagacaacug

SEQ ID NO: 72777 - RNA, 64 nt, Human
uguccagagggaguaaaacagcagagaacaguuugugugccauuaaaacagagauuccucagaa

SEQ ID NO: 72778 - RNA, 64 nt, Human
agccagacaggaucccacauagcagcagcgggaagugugccaaggaagcucuguggcguugugu

SEQ ID NO: 72779 - RNA, 64 nt, Human
guggauggaauaacuccuuguggcauucugaagugugugccaggcucuggacuaggugcuaggu

SEQ ID NO: 72780 - RNA, 64 nt, Human
uugccaccacuuugccuuagauaacugugugugugugugccaguuugaacucugacaccacauu

SEQ ID NO: 72781 - RNA, 64 nt, Human
uccuaaagccuugauauuauauucuuuauaaggcgugugccagccuguauaguauauaagagag

SEQ ID NO: 72782 - RNA, 64 nt, Human
cagccucucaaguaauauagcugagacuacaagugugugccaccaugccucacuaauuuuugua

SEQ ID NO: 72783 - RNA, 64 nt, Human
accucauuccagccaauguaugguuauccacucugugugccaaaaccaaucaugccuuucacgg

SEQ ID NO: 72784 - RNA, 64 nt, Human
gaaugaaaaauauaauguugauaauauauauuaagugugccaaaucaguuugacuacucucugu

SEQ ID NO: 72785 - RNA, 64 nt, Human
cuucuucugagauuuuucaagcugugcuuugugugugugccaguagacuuacgcaaggacaggg

SEQ ID NO: 72786 - RNA, 64 nt, Human
uggaucagcaaaagccaaagaauuagcauacacugugugccaggaggugaagaaauuggugggu

SEQ ID NO: 72787 - RNA, 64 nt, Human
agaaccuuuuauguucccaaccacuuuuugaauggugugccauuuaaaaauccaggccagaucc

SEQ ID NO: 72788 - RNA, 64 nt, Human
gaaggugcauauuaucacggaugcaauuuauguugugugccagucuggucccaaacaucaauuu

SEQ ID NO: 72789 - RNA, 64 nt, Human
aaaggcucaguguuagcauggcuugugcuggccggugugccauauucuuguuggagaugaaccg

SEQ ID NO: 72790 - RNA, 64 nt, Human
uaaguuuauuuucuuuuuucguuuuauaaauucagugugccaaaugaaacuuuuuuccuaagua

SEQ ID NO: 72791 - RNA, 64 nt, Human
acuaaaaauacaaaaauuagccaggcaugguggcgugugccaguaaucccagcuacuugggagg

SEQ ID NO: 72792 - RNA, 64 nt, Human
cugcccuucucuucagggacaacccuccauaaaugugugccaagagggucuccuuuccugucuu

SEQ ID NO: 72793 - RNA, 64 nt, Human
ugccucagccucccgaguagcugggacuacaggugugugccacuaugccuggcuaauuuuugua

SEQ ID NO: 72794 - RNA, 64 nt, Human
accucagccuccagaguagcuaggacuacaggcagugugccaccacauccagcuaauuuuuuaa

SEQ ID NO: 72795 - RNA, 64 nt, Human
cuaggaaguaaaauauauuuagaauuuaaacauugugugccagugguccucgcgcuugacugca

SEQ ID NO: 72796 - RNA, 64 nt, Human
gggugcugaagaacuguuggauuuacccuggcacgugugccacuugccagcuucuugggcacac

SEQ ID NO: 72797 - RNA, 64 nt, Human
gugacccucuugccauggccugaagcagccacaggugugccaagcacccucgagugccaucccu

SEQ ID NO: 72798 - RNA, 64 nt, Human
gcuucuucaggacagcacugccagagaugccugggugugccacagaccuuccuacuuggccugu

SEQ ID NO: 72799 - RNA, 64 nt, Human
uucugaaugccuaccuggcgguguauaccaggcagugugccaguuuaaaaagaugaaaaagaau

SEQ ID NO: 72800 - RNA, 64 nt, Human
cccuuaauuagacugcaaaugucacuugugaugagugugccauuccaggauaacagcuugcacc

SEQ ID NO: 72801 - RNA, 64 nt, Human
acauacauauauauauacacauacauacaaaccugugugccaagugacagcuauuuuuuuauau

SEQ ID NO: 72802 - RNA, 64 nt, Human
ugauaugcauugcggaaguaacauuuuacccagggugugccauugcagugauauaaauauauuu

SEQ ID NO: 72803 - RNA, 64 nt, Human
caacuagaaggaagucacaagauugccuucuacagugugccauuuccaaauggaucuguuguug

SEQ ID NO: 72804 - RNA, 64 nt, Human
caagugauucucuugccucagccuccugaguagugugugccaccacgcccagcuaauuuuuuaa

SEQ ID NO: 72805 - RNA, 64 nt, Human
uaaagacaaaaaggcaacaugugccucacugguggugugccacuguucucaugcugccuccuaa

SEQ ID NO: 72806 - RNA, 64 nt, Human
ugugucagccuccugaguagcugggauuacaggcgugugccaccaugccuggcuaacuuuugua

SEQ ID NO: 72807 - RNA, 64 nt, Human
aagauucaaacaccaucuauugagcaccuacauugugugccagguaguaaaauaggugcuuuca

SEQ ID NO: 72808 - RNA, 64 nt, Human
ggccaggcccaaggagaggacucggccccauggggugugccagucuugcaguccgccccagcug

SEQ ID NO: 72809 - RNA, 64 nt, Human
ugccucagccucccgaguagcugggauuacaggugugugccaccacacccggcuaauuuuugua

SEQ ID NO: 72810 - RNA, 64 nt, Human
ucauuaagaaaaaaacugaaagcaaucuauccuugugugccacugguguucuuuccacuuuaua

SEQ ID NO: 72811 - RNA, 64 nt, Human
augccgcaaguaagagcuaauucauucauuccaugugugccacuaaauaaagagauugagcaag

SEQ ID NO: 72812 - RNA, 64 nt, Human
aagaaucacuugaacccaggaggcggagguugcagugugccaagaucauaccacugcacuccag

SEQ ID NO: 72813 - RNA, 64 nt, Human
caucugagccucccgaguagcuggggcuacaggugugugccacccugccagcuaauuuuuuaua

SEQ ID NO: 72814 - RNA, 50 nt, Human
ugggcaaccucgggcaguaggugugccacaccccagagccuucuuagugu

SEQ ID NO: 72815 - RNA, 64 nt, Human
uuuuuaauagcaauguguuuuuauuaaacaugcugugugccacaggccaguguuguuggugaaa

SEQ ID NO: 72816 - RNA, 64 nt, Human
ccagccguccagccucgggguguagguuucugaggugugccauuggggccucagccuucucugg

SEQ ID NO: 72817 - RNA, 64 nt, Human
aacuagaagccuagugugugugcuuucuuaaugugugugccaaugguggaucuuugcuacugaa

SEQ ID NO: 72818 - RNA, 64 nt, Human
caagucuaagaaacucagugugugauguugggcagugugccauccugaagccuuccuccuggau

SEQ ID NO: 72819 - RNA, 53 nt, Human
agagccguucaaaagacuaaacagugugccaaacaccagcuaaaccaagagag

SEQ ID NO: 72820 - RNA, 64 nt, Human
ugccucagcguucugaguagcugggauuagaggcgugugccacuacacccggcuaauuuuugua

SEQ ID NO: 72821 - RNA, 64 nt, Human
ugccucagccuccccaguagcugggacuacagacgugugccaccacgccuggcuaaaucuuuuu

SEQ ID NO: 72822 - RNA, 64 nt, Human
uccacccugagccugaccuuucugagugacaugggugugccaggcuagacuaggagguuccggu

SEQ ID NO: 72823 - RNA, 64 nt, Human
gugugaaaugaauacuuggaauucuaauuguuuugugugccaggggcaguaaugucccugccuc

SEQ ID NO: 72824 - RNA, 64 nt, Human
gcaauauuugagaacuguucuuuuuuuuucuugugugugccaucuuuccauuguuggcuacguc

SEQ ID NO: 72825 - RNA, 64 nt, Human
uccaucaggcuuaagccagagcuaucuggugcuggugugccagccccucccccagccugccuag

SEQ ID NO: 72826 - RNA, 64 nt, Human
aaacagcuguauuuuauguaugcuuuacugauaagugugccaauaauaaacuguguuaaugacc

SEQ ID NO: 72827 - RNA, 64 nt, Human
caccucagccuccugaguagcugggacuacaggugugugccaccaugcccagcuaauuuuuaau

SEQ ID NO: 72828 - RNA, 64 nt, Human
uuaaagauggguuucagaaaucauaaacuuugacgugugccauacaugguaacaugcuaugcuu

SEQ ID NO: 72829 - RNA, 64 nt, Human
uuuccagacauagauguugaauuguuuguggggggugugccaggccacgucucguguguccgua

SEQ ID NO: 72830 - RNA, 64 nt, Human
ugguaaccaaaaaauaauuugucaauuaauaguugugugccaagcacuccuaauuuguuuuauu

SEQ ID NO: 72831 - RNA, 64 nt, Human
uuauuuuuaaguuuguuacagccaaaggguuggagugugccagugcacagguagacuaaggaaa

SEQ ID NO: 72832 - RNA, 64 nt, Human
agucucagccaacaguaccaaaagugauuuuugagugugccaggguaaaggcuuccaguucagc

SEQ ID NO: 72833 - RNA, 64 nt, Human
ccugucauguguagaagcuuguauuuguguacaggugugccagcccaugcagguguacacagac

SEQ ID NO: 72834 - RNA, 64 nt, Human
ugaacgcaccacccucuggccuaggcuggcuccagugugccaugcccagccaaaacaaacacag

SEQ ID NO: 72835 - RNA, 64 nt, Human
cgccucagcuuccugaguagcuggaacuacaggcgugugccaccacacccggcuaauuuuucgu

SEQ ID NO: 72836 - RNA, 64 nt, Human
auuuguugacauauuuauguauggugcaccuacugugugccaagccauguuagagauacagugg

SEQ ID NO: 72837 - RNA, 64 nt, Human
uuaaaaagacacaaaauuauuuuuuuccagacuagugugccauggauuucugauaagaauuaac

SEQ ID NO: 72838 - RNA, 64 nt, Human
uggcaagauguauuuuuacuuuccaagaugccgugugugccaagaauaaaugaaaugauguuaa

SEQ ID NO: 72839 - RNA, 64 nt, Human
gacauccauguuuguaaaacuacacaucccuaaugugugccauagaguuuaacacaaguccugu

SEQ ID NO: 72840 - RNA, 64 nt, Human
aauguaaaugugccaguguggaguggccacgugugugugccaguauauggcccuggcucugcau

SEQ ID NO: 72841 - RNA, 64 nt, Human
uaauucuugcaacaugcauucuugauuaccuacugugugccaaacaagauuuuguagaauauug

SEQ ID NO: 72842 - RNA, 64 nt, Human
cuguguacugugaaaguauuuucauauuuuuucugugugccagagugaaaaaggacagcuucug

SEQ ID NO: 72843 - RNA, 64 nt, Human
ugcccuggccucccauguagcugcaacuauaggugugugccacuacaccuggcuaauguuuuua

SEQ ID NO: 72844 - RNA, 64 nt, Human
ugaaauggcuuugcuuuggcugucgucuucugccgugugccagaugagcuugugaucugggaag

SEQ ID NO: 72845 - RNA, 64 nt, Human
ccucagccuccugaguagcugggacuacaguuucgugugccaccaugccuggcuaauuuuuaga

SEQ ID NO: 72846 - RNA, 64 nt, Human
ugaccaaucgcaugguucuccuggcaggccugcugugugccaaaaacucccacccaaggucccu

SEQ ID NO: 72847 - RNA, 64 nt, Human
cgccucagccucccaaguagcugggauuauaggugugugccacugugccaagcuaauuuuuuua

SEQ ID NO: 72848 - RNA, 64 nt, Human
uggcucguuggcuagauuaaccuucucuguccgagugugccacacgagaaccugaaggggaagg

SEQ ID NO: 72849 - RNA, 64 nt, Human
ggaaauugaaguggugcauaacauugccaaaauagugugccacuagaaaugguguaaaggcugu

SEQ ID NO: 72850 - RNA, 64 nt, Human
cuuucuaauuuaaaggagaguuacuuuguuguaugugugccacuaaaauaggggcugcccuugc

SEQ ID NO: 72851 - RNA, 64 nt, Human
aguguucacacgcacucgaaauggaguauauggugugugccaguuaugaguugaccauuuggga

SEQ ID NO: 72852 - RNA, 64 nt, Human
uuggccgcucgaugaggucucguguugagauauugugugccacaacccccacagucuucaccuc

SEQ ID NO: 72853 - RNA, 64 nt, Human
aacguuccaguuggaagguuccuaugccuagccugugugccauuucauggcagauauguaagaa

SEQ ID NO: 72854 - RNA, 64 nt, Human
uuguuucugugucccuaccagacacaaagaugaagugugccagcugguucccccaagccagcuc

SEQ ID NO: 72855 - RNA, 64 nt, Human
ugccucagccucccgaguagcugggauuagaggcgugugccaccaugccuggcuaauuuuugua

SEQ ID NO: 72856 - RNA, 64 nt, Human
cacuggguugucuccauugucauuaugggcagaugugugccauccccagccgacgccacucacu

SEQ ID NO: 72857 - RNA, 64 nt, Human
acccuacggccucccaugcaucuguacucccccugugugccacaaaugcacuacguuauuaaau

SEQ ID NO: 72858 - RNA, 64 nt, Human
aggaagggaguuaaagacccuccuggggcucucagugugccauagaggacagcaacuggugauu

SEQ ID NO: 72859 - RNA, 64 nt, Human
cgugugaaugggugaggcugauguggaugucugugugugccagcaggugggugggggauguggg

SEQ ID NO: 72860 - RNA, 64 nt, Human
aagauacaccuauagaaccauuaccuucugcuaugugugccaggccucaucuacuccuguacau

SEQ ID NO: 72861 - RNA, 64 nt, Human
agauuucccccguuugcaagcuccuccccucugugugugccaugucagaguuuuaugucuuucu

SEQ ID NO: 72862 - RNA, 64 nt, Human
caccugcuagucgccccucagagcaugaugggaggugugccagaaaguccccccucgccccaaa

SEQ ID NO: 72863 - RNA, 64 nt, Human
aacuguccgcuagaagucuguccaaauuuaaaaugugugccauauucugguucuugaaaauaag

SEQ ID NO: 72864 - RNA, 64 nt, Human
ugccucagccuccugaguagcugggauaaugggcgugugccaccaugcccagcuaauuuuugua

SEQ ID NO: 72865 - RNA, 64 nt, Human
guaaaugcccccauccgguuccucuucuucccaggugugccaaggaauuaaucuugguuucacu

SEQ ID NO: 72866 - RNA, 64 nt, Human
uucuccuaccuccugaguaacugggauuacagucgugugccaccacgcucagcccugaguuagu

SEQ ID NO: 72867 - RNA, 64 nt, Human
ggaaaggagaagaugcugugucgcugcgcagcucgugugccaaggaaauguguuuugccucuga

SEQ ID NO: 72868 - RNA, 64 nt, Human
aaaauguccccccacccgccaucugcagccaggugugugccacacggcagccuucccgaaacau

SEQ ID NO: 72869 - RNA, 64 nt, Human
ugccucagccucccgaguagcugggacuaaaggcgugugccaccaugcccagcuaauucuugua

SEQ ID NO: 72870 - RNA, 64 nt, Human
gaaggguggggauaucagggcacagucuccaugugugugccaagcccuggcccccacagcgcuc

SEQ ID NO: 72871 - RNA, 64 nt, Human
uaucaaaguguuuuucaagccuguuauauucagugugugccacaggauugaaauaaaugacaau

SEQ ID NO: 72872 - RNA, 64 nt, Human
gguccauuguggcgccccuuuccaguguuugacagugugccauucgacaacacauuguuauagc

SEQ ID NO: 72873 - RNA, 64 nt, Human
gauguagaacgcagcgugugcccacgcucagcaggugugccauccuuccaccugcuggggcacc

SEQ ID NO: 72874 - RNA, 64 nt, Human
agcccuaguagcuccagcugugacuauaucaacugugugccaagugugacuuuguacaguuuua

SEQ ID NO: 72875 - RNA, 64 nt, Human
ugccucuaaaauuguuuuauagauuacuuaugcugugugccaaguguuuaaagguuuauuugcc

SEQ ID NO: 72876 - RNA, 64 nt, Human
ugccucauccuccugaguagcugggauuacaggcgugugccaccaugcccaaccuauuuuugua

SEQ ID NO: 72877 - RNA, 64 nt, Human
uggcggcuucugggggccauguuuggggagggaggugugccagcagccuggagagccucagucc

SEQ ID NO: 72878 - RNA, 64 nt, Human
gcaggcaauauccugugcacauccacgcccuccugugugccaccuuacagcucaugcagaacug

SEQ ID NO: 72879 - RNA, 64 nt, Human
cuucaguccagugccaugccuuagauggaauugagugugccaguccuaggaccuuucuacgaga

SEQ ID NO: 72880 - RNA, 53 nt, Human
ggaaacaggcccaccccugaagugugugccaucgguaagggacuguaggcaag

SEQ ID NO: 72881 - RNA, 64 nt, Human
ccccugugaugaaaaugaugugccagcuaaaauugugugccauuuaaaaacugaaaauauuuua

SEQ ID NO: 72882 - RNA, 64 nt, Human
uuaaccuaaaaaccagaggugcuuuuccuugucugugugccaguugcuggcuguuuuaguugcu

SEQ ID NO: 72883 - RNA, 64 nt, Human
agaaagaaauuuuguauuuuuguauaacuugauugugugccauuuuauauaacagguccuguuu

SEQ ID NO: 72884 - RNA, 64 nt, Human
ccauucaagagaugagucugaccauucacuuucugugugccagagaagagagaucauggguaua

SEQ ID NO: 72885 - RNA, 64 nt, Human
cagagaacgcugucccccgacaucccacuccaaagugugccaccuccagugagccuccuuguca

SEQ ID NO: 72886 - RNA, 64 nt, Human
gguggagcaggccuggccuuggagaacgagaccugugugccaggggcagauggccuggaggcuc

SEQ ID NO: 72887 - RNA, 64 nt, Human
uauacaucuugcccuauuaauauguucucuuaacgugugccauuguucucuuugaccauuuucc

SEQ ID NO: 72888 - RNA, 64 nt, Human
gaaaaagaaaugggagcuggucacacagggccuugugugccagacuaagggguuuguaguauau

SEQ ID NO: 72889 - RNA, 64 nt, Human
gguuucccggugacacauccauugcuggcaaugagugugccagaguuauuagugccaaguuuuu

SEQ ID NO: 72890 - RNA, 64 nt, Human
cacaaauagagcagauugucauauuguaacaugcgugugccagacaccgggcaguacacuuugg

SEQ ID NO: 72891 - RNA, 64 nt, Human
cuaaguagagagagggugcccauugccuaggugagugugccaagcucaggauuccaacuggugc

SEQ ID NO: 72892 - RNA, 64 nt, Human
ugguuuggauuuguaacuccagaaacauucuauagugugccagagcaaaaggcaaauacacaaa

SEQ ID NO: 72893 - RNA, 64 nt, Human
ggcuugguggccaucccugucuccaucuucuauagugugccacaucagaagcacuuugaccacu

SEQ ID NO: 72894 - RNA, 64 nt, Human
uucauaaauucuguaguaaaguaucaucuuggcagugugccaaaggugaaaaugaugcuuucuc

SEQ ID NO: 72895 - RNA, 64 nt, Human
ugcuaaaugcaaacacuguguauuuauuaguuaggugugccaaacuaccguucccaaauuggug

SEQ ID NO: 72896 - RNA, 64 nt, Human
cauguuaauugcaagcacucauuucacucucccugugugccaggcaauagcauaagcacuggaa

SEQ ID NO: 72897 - RNA, 64 nt, Human
cuucauuccucagaguaaaccaaccuugggagcugugugccaguuccaguguaagcaguaauac

SEQ ID NO: 72898 - RNA, 64 nt, Human
auaaaaacaacuuucacuucuuccuauuguaaucgugugccauggaucugaucuguaccaugac

SEQ ID NO: 72899 - RNA, 64 nt, Human
aacuguguagcaucugcauugcccagucuuucaugugugccaaggcugaugcaggauuuguucu

SEQ ID NO: 72900 - RNA, 64 nt, Human
ucgggaguucuuccgugagggcugccaggggguggugugccaggaccucaggcugggccuuugu

SEQ ID NO: 72901 - RNA, 64 nt, Human
aguuaggaaggaaaaaccaauagcuuuaaaaccugugugccauuuuaagaguuacuuaauguuu

SEQ ID NO: 72902 - RNA, 64 nt, Human
uuaggccugucuuccaccccuccugacccguauagugugccacaggaccugggucggucuagaa

SEQ ID NO: 72903 - RNA, 64 nt, Human
cuaugugaacuugacuuugaaagacagagcucuagugugccagccugcuaaguccuguaagaau

SEQ ID NO: 72904 - RNA, 59 nt, Human
ucaucauccucacuuguugaggacguccugugugccaagugguuuauaugcccagccuc

SEQ ID NO: 72905 - RNA, 64 nt, Human
ggucccugggccaccgggcagccuggggcggugugugugccaugucacagcauggccucucggc

SEQ ID NO: 72906 - RNA, 64 nt, Human
uugggauuuuauuuuauaucugaugacuccgagugugugccauccauuuguuaaguaacuggcc

SEQ ID NO: 72907 - RNA, 64 nt, Human
auaacauuucaauggggguaaacaggccagaagagugugccaaguuguuugugaaucauuccaa

SEQ ID NO: 72908 - RNA, 64 nt, Human
cuaaaaccagaauacacuaagaaguuucuaguuugugugccaaaacagaagcuucuccaagcau

SEQ ID NO: 72909 - RNA, 64 nt, Human
ugaaacugaggcuccagcucccuguguugugugugugugccauccaugggcuugggugucaguu

SEQ ID NO: 72910 - RNA, 64 nt, Human
auugaaagccugaaagcauuuccugcuucuacaagugugccacaucaauccgguaaugccccag

SEQ ID NO: 72911 - RNA, 64 nt, Human
ugccucagccucccgaguagcuaggacuacaggcgugugccaccucucccggcuaauuuuuuug

SEQ ID NO: 72912 - RNA, 64 nt, Human
agauccuccaugcaggaucuaggagagugacugggugugccaaaauaugcccaggguccugccc

SEQ ID NO: 72913 - RNA, 64 nt, Human
uuuaaaucaggcccaauaucaguauucuuuuugugugugccaauuuuguuaucacaucccuaug

SEQ ID NO: 72914 - RNA, 64 nt, Human
guuagaggcugcguucuuugucgccgccuccccugugugccagcccugugugcacggccucugc

SEQ ID NO: 72915 - RNA, 64 nt, Human
uggacgggugcugugccgcaugucgaggccgauugugugccaggcggugcgggacgugccuccc

SEQ ID NO: 72916 - RNA, 64 nt, Human
uaagggaugcucccccaccccacaucuuaagucagugugccaaguacugagaugauuuuaggga

SEQ ID NO: 72917 - RNA, 64 nt, Human
gaucauuuauuuagcauucccuugcuagaagcccgugugccaggcacugugcuaggcguggugg

SEQ ID NO: 72918 - RNA, 64 nt, Human
ugcagccucccauaaacaugugagcauguucugagugugccaugaugugaguggaccuggcugg

SEQ ID NO: 72919 - RNA, 64 nt, Human
ucaucuguuagauguggcuguuuugcguagcaucgugugccaccccugccccuccccgaucccu

SEQ ID NO: 72920 - RNA, 64 nt, Human
caccuguuuuaaggauugagauuguucauuuacugugugccacauauuagacaauaaauggaaa

SEQ ID NO: 72921 - RNA, 64 nt, Human
ugaauuccaguuaauuuauaaagaggcgauuuuugugugccauucacacuggucuuuuucacau

SEQ ID NO: 72922 - RNA, 64 nt, Human
auucugcuauguuuguucuucacuaugauuuacugugugccaaaggaguuuugacaggguacag

SEQ ID NO: 72923 - RNA, 64 nt, Human
aaccauucuaguuuuaucuuccuuggcuuuaagagugugccauggaaagugauaagaaaugaac

SEQ ID NO: 72924 - RNA, 64 nt, Human
ccugcacuucccccagcgccuggggcaagcuggcgugugccagggcucgagucccacgugcugc

SEQ ID NO: 72925 - RNA, 64 nt, Human
aggcagcuguccugugaugucagcggugcagcgugugugccaccucauuauuaucuagcuaagc

SEQ ID NO: 72926 - RNA, 64 nt, Human
ucuuucacuugcugaucugugggcgcucccacccgugugccagcgugacggcucgggguguccg

SEQ ID NO: 72927 - RNA, 64 nt, Human
ugccucggccuccugaguagcugggauuacaggcgugugccacuacacucaacuaauuuuugua

SEQ ID NO: 72928 - RNA, 64 nt, Human
auauuaacucaaaaguugagauuuuggggugguggugugccaagacauuaauuuuuuuuuuaaa

SEQ ID NO: 72929 - RNA, 64 nt, Human
caccaaccacucucugcagauggcuggagaaagggugugccaacucuucaccuucuuuccucag

SEQ ID NO: 72930 - RNA, 64 nt, Human
uucuggcaaacagcuccucuuccagaggggaguugugugccaaugauggcaugacaauccagag

SEQ ID NO: 72931 - RNA, 64 nt, Human
gagggugaggauuaaguacucgugccuuauauuugugugccaauuaaugccuaauaaauaccau

SEQ ID NO: 72932 - RNA, 64 nt, Human
agguucauuuuaguuuuuuuuuuucuuucaaccagugugccaucuccaauauuucuauaguaua

SEQ ID NO: 72933 - RNA, 64 nt, Human
gccuuuauuaauuguucuugaguuaauauucugagugugccauuuauuuucugugccaucuguu

SEQ ID NO: 72934 - RNA, 64 nt, Human
uuuaucaagucaucuuaccucuaauucuuuuccagugugccaacuccaaagucaacauuaaaaa

SEQ ID NO: 72935 - RNA, 64 nt, Human
gauuuuuauacagcugccaggcuccccuaauucagugugccagcuuacaauguggaaaugaaag

SEQ ID NO: 72936 - RNA, 64 nt, Human
caccucagccucccgaguagcugggacuacaggcgugugccaccaugcccagcuaauuuuuugu

SEQ ID NO: 72937 - RNA, 64 nt, Human
aacagauuaaaauaaguauuauuaauaaaauuuggugugccagacugacuacuucccuugcuaa

SEQ ID NO: 72938 - RNA, 64 nt, Human
cuaccucagcucccaaguagcugagaugacaggcgugugccaccacgcccagcuaauuuuugua

SEQ ID NO: 72939 - RNA, 64 nt, Human
caucacaaguuuccuagagagaggagacaaaucggugugccauugacaacaugagccaggguaa

SEQ ID NO: 72940 - RNA, 64 nt, Human
auggucacauuaagguaaagguuuuggcuggucagugugccaagaccucuccagcuucucauuc

SEQ ID NO: 72941 - RNA, 64 nt, Human
cucaucagccgucgcgcaagcacacacgagggacgugugccagagcccccucccucaccuuccc

SEQ ID NO: 72942 - RNA, 64 nt, Human
gagcaaugagaccaggucccugcucugaggagacgugugccagcgaaguuucucucccacguga

SEQ ID NO: 72943 - RNA, 64 nt, Human
ugccucagccuccccaguagcuggaacuacaggugugugccaucacaccuggcuuuacauuuuu

SEQ ID NO: 72944 - RNA, 64 nt, Human
aauuguguauaucuuugugugucuuccuguuuaugugugccaagggaguauuuucacaaaguuc

SEQ ID NO: 72945 - RNA, 64 nt, Human
uucacugugaugugguugcggucucuguaggugugugugccacccuuguccucuguccucuggg

SEQ ID NO: 72946 - RNA, 64 nt, Human
gugaggccacagcuccucagauucacugcccgcugugugccaguacucaggcagcuggagagaa

SEQ ID NO: 72947 - RNA, 64 nt, Human
uccuauccugggcugcucaguguucccaggcccugugugccagaggccaggucucuccaagugc

SEQ ID NO: 72948 - RNA, 64 nt, Human
guacgugcuuugagaaaacauuucuuaaaacagugugugccaccuaaggcuggaugggaaagug

SEQ ID NO: 72949 - RNA, 64 nt, Human
aaaaucacucuauguugccccacuuuagagcccugugugccacccuguguuccugugauugcaa

SEQ ID NO: 72950 - RNA, 64 nt, Human
guugguagggcagcugguagaggaguaccagcuggugugccaauuccccaggccccugcuggau

SEQ ID NO: 72951 - RNA, 64 nt, Human
caccucagccucccaaguagcugggauuacagacgugugccaccauaccuggguaauuuuugca

SEQ ID NO: 72952 - RNA, 64 nt, Human
ggacuggaccagaugcuccuguaaacauccaggggugugccaggcccacccucacaacugcuug

SEQ ID NO: 72953 - RNA, 64 nt, Human
caccucagccucccaaagugcuaggauuacaggcgugugccaccgcgcccggcugacccuuuua

SEQ ID NO: 72954 - RNA, 64 nt, Human
guguucuagguuccagcacaccugcaaagauaaagugugccaagacuguauuuauauuucauac

SEQ ID NO: 72955 - RNA, 64 nt, Human
ugccucagccuccugaguagcugggauuacaggugugugccaccacgccuggguaauuuuuuuu

SEQ ID NO: 72956 - RNA, 64 nt, Human
ggccuacuggccuucaagacagaggccugccccagugugccacagauccauguggauggagccu

SEQ ID NO: 72957 - RNA, 64 nt, Human
cgucacuccaggugggagccaccccggugagggggugugccacuuguccccagggcacuccucu

SEQ ID NO: 72958 - RNA, 64 nt, Human
ccgcaugggccuugucuuugcugggacugggccugugugccacguggcagcugcugcuuggcuu

SEQ ID NO: 72959 - RNA, 64 nt, Human
cugccucagcuucccagauagcugggccacaggcgugugccaccacaccuggcuaacuuuuuuu

SEQ ID NO: 72960 - RNA, 64 nt, Human
acccccaagucacaggugacucagcagugacccugugugccaggccagauccaaacugagaggg

SEQ ID NO: 72961 - RNA, 64 nt, Human
uggccuggcccagcuuccagagggacccugggccgugugccagcucccagacacuaccugggua

SEQ ID NO: 72962 - RNA, 64 nt, Human
caccccagccucccaaguagcugggauuacaggugugugccacuacggcuggcuaauuuuugua

SEQ ID NO: 72963 - RNA, 64 nt, Human
cgucagcugggaugugaagucucuggguggaagugugugccaagagcuacucccacagcagccc

SEQ ID NO: 72964 - RNA, 62 nt, Human
uuuauuuauguuucucccaauaaaaacccagccugugugccagcugcccacguggggauccu

SEQ ID NO: 72965 - RNA, 64 nt, Human
auaaaauuauuaaaaggagcacuaaaggaaaacugugugccaagcaucauauccuaaggcauac

SEQ ID NO: 72966 - RNA, 59 nt, Human
auucaacaaauguuuauuaaucacucacugugugccaggcaccgugcuggacaucagaa

SEQ ID NO: 72967 - RNA, 64 nt, Human
caggaagagggagaaacuucugcucagaccgagcgugugccacuggaccucaguccucgccugg

SEQ ID NO: 72968 - RNA, 64 nt, Human
gcagggaguaaguuacugcuaaauuaaauuaaaugugugccaggccgggugcgguggcucaugc

SEQ ID NO: 72969 - RNA, 64 nt, Human
gacuugaccuugugguauuuuucuuggccuaguugugugccauggauauuaaaaaaaaaaaaaa

SEQ ID NO: 72970 - RNA, 64 nt, Human
ccccgucuugaugcagagaagccacccacguggggugugccaggcacccccagauacaaaugca

SEQ ID NO: 72971 - RNA, 64 nt, Human
aggccuugcuucccuaucaggcuugggcauaggggugugccaggccacuuugguaucagaaauu

SEQ ID NO: 72972 - RNA, 64 nt, Human
cuagagagguccggugugcacagccggccucccagugugccaaaaugaacugcucucagcugau

SEQ ID NO: 72973 - RNA, 64 nt, Human
caccucagccuccugaguagcugagaccacaggcgugugccaccacgccuagcuaauuuuuuau

SEQ ID NO: 72974 - RNA, 64 nt, Human
uccucauuuggugcaucuguauuccagccaauaggugugccaguuuucauguaaucuuuacugg

SEQ ID NO: 72975 - RNA, 64 nt, Human
uugguggccgggggugggggccugcugugggucagugugccacccucugcagggcagccugugg

SEQ ID NO: 72976 - RNA, 64 nt, Human
cagacugucaucacaugcaugcauaaaccggcaugugugccaaugcacacgagugugccacuca

SEQ ID NO: 72977 - RNA, 64 nt, Human
augcauaaaccggcaugugugccaaugcacacgagugugccacucaccaccauuccuuggccag

SEQ ID NO: 72978 - RNA, 64 nt, Human
uaacugguuuaaaaaacaaagacuguaagccugugugugccacuguuugcuucaacaguauauc

SEQ ID NO: 72979 - RNA, 64 nt, Human
ccccagauaccuccacuugcuaccgagucaacgugugugccaucuucccugguccaggcaccac

SEQ ID NO: 72980 - RNA, 64 nt, Human
auuguucccgugccgugccaugguuucacccuaugugugccacaauggacguuagcagcugcuu

SEQ ID NO: 72981 - RNA, 64 nt, Human
gauaaagguucagcuccagggguaguaccugagugugugccaugccccuucagaccagcugcuu

SEQ ID NO: 72982 - RNA, 64 nt, Human
gagucuggagaggcagaugagguuccugccuacugugugccaccccaagaagguagccccccaa

SEQ ID NO: 72983 - RNA, 64 nt, Human
caugucaccuccauagggaaaggcuucucuccaagugugccaggccaggacagcccucccagcc

SEQ ID NO: 72984 - RNA, 64 nt, Human
cuagggguucuuuuaugugauuuuuagcuaaguggugugccagguuuucagugacauaccaaau

SEQ ID NO: 72985 - RNA, 64 nt, Human
cagaggauuggugcagucccagcugaagcccacugugugccaaaggaagaagcucccagggcug

SEQ ID NO: 72986 - RNA, 64 nt, Human
ggaggcaagccagucggguuuccuggagcaaugggugugccagcccucagcaugacucugccaa

SEQ ID NO: 72987 - RNA, 64 nt, Human
uccccagcaucccagcugggccagagagagccgagugugccaacaaggacuggggccugcccgg

SEQ ID NO: 72988 - RNA, 64 nt, Human
cuggcggugucaucguccgucacuuauaccaugagugugccacuuucauuggacccugacugua

SEQ ID NO: 72989 - RNA, 64 nt, Human
uugugcugagaauggcaccuggugagagccugcugugugccaggcuuugugcugagugcuguac

SEQ ID NO: 72990 - RNA, 64 nt, Human
gaaagauagcuugaauuuaaugaaauagaauucagugugccaggaguuagguucauaccaggug

SEQ ID NO: 72991 - RNA, 64 nt, Human
uccuuuaaguagggauguuuaggauaaguuagaugugugccacuaugauuuauuggguuucuua

SEQ ID NO: 72992 - RNA, 64 nt, Human
auauauuguacuuuuuuauuucuguaagccaacugugugccauuuucacuggacuuuuaaaucu

SEQ ID NO: 72993 - RNA, 64 nt, Human
gacauuucaagaaacacauguguugaccaccucugugugccaagcacugggugaggaguggucg

SEQ ID NO: 72994 - RNA, 64 nt, Human
gccugcgagggcugcccucugcagagcgcucucugugugccagagagccagagacccaagacag

SEQ ID NO: 72995 - RNA, 64 nt, Human
uuguuuuaaaaauaugaaucaaaauuccuguguugugugccaagguauaaaguggagaaguuag

SEQ ID NO: 72996 - RNA, 64 nt, Human
aaacuuuuaaaagauacccucauugugucaaagagugugccaaucuauuuuuguaucagcauug

SEQ ID NO: 72997 - RNA, 64 nt, Human
auauauguucauaucuaugggaaaaaucuaaaaugugugccagaugcccuguugguuucacaga

SEQ ID NO: 72998 - RNA, 62 nt, Human
ucucccagcugaaggacuaggccaagcccucugugugccaucuccaaugagaaggaauccug

SEQ ID NO: 72999 - RNA, 64 nt, Human
cacaucgugucugaagagauggcaccagggaaaggugugccauaagcugcuccagagcuuuugg

SEQ ID NO: 73000 - RNA, 64 nt, Human
ggagcuccagacaggacguccauaagucaccgaggugugccacccagcaggugcuggaggugcc

SEQ ID NO: 73001 - RNA, 64 nt, Human
caucucagccucucgaguagcugggaccacaguugugugccaccacacuuggcuaacuuuuuaa

SEQ ID NO: 73002 - RNA, 64 nt, Human
ucagcgacgcuguccgccccccgucagaucccaugugugccauguuuaucaucaguguuuugua

SEQ ID NO: 73003 - RNA, 64 nt, Human
guccccacuucuucccugccacgcgugugugugcgugugccacgugagugccaaaguccccugc

SEQ ID NO: 73004 - RNA, 64 nt, Human
cacucuacucccuccacccucccucccugaucccgugugccaccaggagggaguggcagcuaua

SEQ ID NO: 73005 - RNA, 64 nt, Human
gcccccguggcucccggucuccugugggccugcugugugccaaaccugagcuaccugcacccga

SEQ ID NO: 73006 - RNA, 64 nt, Human
acuucuucaugccacaaguguuuauugagcaccugugugccaggccucacagacucccaguugg

SEQ ID NO: 73007 - RNA, 64 nt, Human
ccccuucaaccaaccgcguugauggacacccacugugugccaggccccagcggggcccaugggg

SEQ ID NO: 73008 - RNA, 64 nt, Human
gaucuuucccuuuuggaugugcgugugugucugcgugugccaugugcguggcacgcauaugagu

SEQ ID NO: 73009 - RNA, 64 nt, Human
aguagggugcaggccuccagcagguccuaauccugugugccagggcaggcagugccccaggggc

SEQ ID NO: 73010 - RNA, 64 nt, Human
cuuccugacugucuccagcugggagguggucucugugugccacuccucugugucucuauuacag

SEQ ID NO: 73011 - RNA, 64 nt, Human
ugccuuggccucccaaguagcugggauuacaggugugugccaccacacccggcuaauuuuuaua

SEQ ID NO: 73012 - RNA, 64 nt, Human
gaaaauuuaaagggaaaacccucaggccugaggugugugccacucagagacuucaccuaacuag

SEQ ID NO: 73013 - RNA, 64 nt, Human
acugcggugcuacgagggccugcgggccuuugcugugugccacccucccuguaagucuauuuaa

SEQ ID NO: 73014 - RNA, 64 nt, Human
gagucccagacacaggcagagagggccacauaucgugugccagaggcugagagacugagaggga

SEQ ID NO: 73015 - RNA, 64 nt, Human
cacagucgaggcacgucaucgggcagccuucccugugugccaacgccagccuucgcuucugaaa

SEQ ID NO: 73016 - RNA, 64 nt, Human
ugccucagccucccgaguagcugagacuacaggcgugugccacuacgcccggcuaauuguugua

SEQ ID NO: 73017 - RNA, 64 nt, Human
ccuccugcuggccuuggagaagcaaaaagccagggugugccaggagaagggcaugaagcgagga

SEQ ID NO: 73018 - RNA, 64 nt, Human
gccgcggcccugcagccgcucauggcggugaggugugugccaagcccacccggggugcagggcg

SEQ ID NO: 73019 - RNA, 64 nt, Human
agaggggcugcuccagugggcagggguagcuagcgugugccaggcagauccucuggacacguaa

SEQ ID NO: 73020 - RNA, 64 nt, Human
acugccaucgauaaugucagccugcagcacugaagugugccaggcaaggacuguggauuucaag

SEQ ID NO: 73021 - RNA, 64 nt, Human
uacacagcugugugcaucgacguucuccuggggugugugccaagcgaaacccaggggugaauug

SEQ ID NO: 73022 - RNA, 64 nt, Human
augagucccuggggggagugaucccccaggcaucgugugccauguugcacuucugcccaggcag

SEQ ID NO: 73023 - RNA, 64 nt, Human
uugugauggugcuuuuagcgcuaaauugugccucgugugccaaagaaacauagacaacuguaga

SEQ ID NO: 73024 - RNA, 64 nt, Human
ugccucagucucccaaguagcugacacuacaguugugugccaccacaccuggguaauuuuuugu

SEQ ID NO: 73025 - RNA, 64 nt, Human
gcaccacauuauuauauuuccacaucaguuucuugugugccaaauaagacccaugcuuugcauc

SEQ ID NO: 73026 - RNA, 64 nt, Human
aagggaucgcagggccuaggugccuggacccagggugugccagcccgucucugugcagucccug

SEQ ID NO: 73027 - RNA, 64 nt, Human
ucguugcucccuggggcaccacuucuggauuacagugugccagguccuuuggaggcccuacccc

SEQ ID NO: 73028 - RNA, 64 nt, Human
ugucucagccuuccgaguagcugggauuacaggugugugccaucaugccugacuaauuuuguau

SEQ ID NO: 73029 - RNA, 64 nt, Human
auuguuagaacaauagaaaaauagagcaguguaugugugccaaaacucaucauuacucaaagga

SEQ ID NO: 73030 - RNA, 64 nt, Human
cugccucuaauucacagaaugcacuuucuacccugugugccauggagaccuccuauggaaaaau

SEQ ID NO: 73031 - RNA, 64 nt, Human
cagccucucugugcacuugcugucugcggagccagugugccauucucugcacaugggcagccag

SEQ ID NO: 73032 - RNA, 64 nt, Human
cagagucgcccagguuagcccacaggauuccuuugugugccauggaaugcugaaagauggguga

SEQ ID NO: 73033 - RNA, 64 nt, Human
ugcgccucuucccucuacccccgcaccaccugcugugugccagccugagacgguuccugccugu

SEQ ID NO: 73034 - RNA, 64 nt, Human
gcucauccuggguuugcuucugaccuugucaugugugugccaccaaacacguuauuggcaccuu

SEQ ID NO: 73035 - RNA, 64 nt, Human
guccuuugaucaagagugucugaggcugucaaaugugugccacccuuuauaauacagcuaugaa

SEQ ID NO: 73036 - RNA, 64 nt, Human
aaugcuuccuacucagcgugacccaacuuuucuagugugccacggccccaccaccuccugcagu

SEQ ID NO: 73037 - RNA, 64 nt, Human
gacuuccuucagcaaauauucacuggcaccuggugugugccaggcucuguccuguacacaggua

SEQ ID NO: 73038 - RNA, 64 nt, Human
guagaugacagggaguugccuuggggaaccuuuggugugccaagaggagguggguagaugggag

SEQ ID NO: 73039 - RNA, 64 nt, Human
ggugacccaugaccagaggggauccuaugguuaugugugccaggcuggcuggcaggaacugggg

SEQ ID NO: 73040 - RNA, 64 nt, Human
ggaaauacccucacugccaaguggagacuggggcgugugccacauugccagccaccaggaaagc

SEQ ID NO: 73041 - RNA, 64 nt, Human
aaaacgugcagguuggcaauguccugagugcaaagugugccagaacugcaaguaaguuuucauu

SEQ ID NO: 73042 - RNA, 64 nt, Human
uuuggccugccucagcagcaccaguugacugcucgugugccagcgguguggggaggacggggca

SEQ ID NO: 73043 - RNA, 64 nt, Human
ccugcuguugccucccugugaccuggaggacagugugugccaugucucccauacuagagauaaa

SEQ ID NO: 73044 - RNA, 64 nt, Human
cccagaaaggaucaguguuagaaugggaaauagagugugccaucuugcucuuuuguuggcagau

SEQ ID NO: 73045 - RNA, 64 nt, Human
uguagcagacaacacacaaaauaaugcaguuguggugugccaugcuaugugcacagccccuugg

SEQ ID NO: 73046 - RNA, 64 nt, Human
ugccucagccucccgaguagcugggacuacaggcgugugccaccaugccuggcuaauuuuugua

SEQ ID NO: 73047 - RNA, 64 nt, Human
cgugcccacuuggcuauuuacuuauuuauuuauugugugccagugauggugggugggggcuggg

SEQ ID NO: 73048 - RNA, 64 nt, Human
caucuucuacuucuccaucuagagauuuuugugugugugccaucaagguuagcaaacuuuauac

SEQ ID NO: 73049 - RNA, 64 nt, Human
cccgccccgccgcuggcgucaaguucagcuccacgugugccaucaguggauccgauccguccag

SEQ ID NO: 73050 - RNA, 64 nt, Human
gcacggcgagggacuccucccagacgugccucuugugugccagcuggcuguggcucgggagcag

SEQ ID NO: 73051 - RNA, 64 nt, Human
ugaagaaaggguaugugugugcaagugggugugugugugccaguuuuucuugucucagguagau

SEQ ID NO: 73052 - RNA, 64 nt, Human
acuugggaaucugaggcagaggagggugaggccugugugccaaccuuguucacauaccaccuuc

SEQ ID NO: 73053 - RNA, 64 nt, Human
cagaagggccuggaugcaagguuacccuugagcugugugccacagucuggugcccagucuggca

SEQ ID NO: 73054 - RNA, 59 nt, Human
aagggacuguccuuucaugagcacuuguugugugccagguccugugcuugggaccuguu

SEQ ID NO: 73055 - RNA, 64 nt, Human
gagacccacaggucuaagaggagaggcagagccagugugccaccaggcugggcagggacaacca

SEQ ID NO: 73056 - RNA, 64 nt, Human
cacaacagugaaaaguugagcgucauuuuucuuagugugccaagaguucgauguuggcguuucc

SEQ ID NO: 73057 - RNA, 64 nt, Human
uucgauguuggcguuuccguuguauuuucuugcagugugccauucuguuagacauuagcauuuu

SEQ ID NO: 73058 - RNA, 64 nt, Human
ucacaacggugaaacuugagcgucauuuuucuuagugugccaagaguucgauguuaguguuucc

SEQ ID NO: 73059 - RNA, 64 nt, Human
uucgauguuaguguuuccauuguauuuucuuacagugugccauucuguuagauacuauccuuau

SEQ ID NO: 73060 - RNA, 64 nt, Human
agugguuagagcuguagauagacauuguggggaagugugccaggguggcuuccagcuaccccug

SEQ ID NO: 73061 - RNA, 64 nt, Human
cacaacagugaaaaguugagcgucauuuuucuuagugugccaagaguucgauguuaguguuucc

SEQ ID NO: 73062 - RNA, 64 nt, Human
cacaacagugaaaaguugagcgucauuuuucuuagugugccaagaguucgauguuagcguuuac

SEQ ID NO: 73063 - RNA, 64 nt, Human
cuuaaaucacugugucuagaucauuuuuuacauugugugccauagacuuacccaugggacaaca

SEQ ID NO: 73064 - RNA, 64 nt, Human
acccacaaaagcaagcauugauuuugugcucagugugugccaagcacugugcagaggguacaca

SEQ ID NO: 73065 - RNA, 64 nt, Human
ugcgccucccugcgcuucccccuucaggaagggugugugccaccucguugcacuggaucccagu

SEQ ID NO: 73066 - RNA, 64 nt, Human
aaugccuucguguuuucugagcagaauguacgaggugugccaucccaaaaccagcugcuacccu

SEQ ID NO: 73067 - RNA, 64 nt, Human
uucgauguuaguguuucuguuguauuuuguuacagugugccauucuguuagauauuagcguuuu

SEQ ID NO: 73068 - RNA, 64 nt, Human
cacaacagugaaaaguugagcgucauuuuucuuagugugccaagaguucgauguuaguguuucu

SEQ ID NO: 73069 - RNA, 64 nt, Human
uucacaacagugaaaaguugagcuucauuuuuuagugugccaagaguucgauguuaguguuucc

SEQ ID NO: 73070 - RNA, 64 nt, Human
cacaacagugaaaaguugagcgucauuuuucuuagugugccaagaguacgauauuagcguuucc

SEQ ID NO: 73071 - RNA, 64 nt, Human
uucgauguuggcguuuccgcuguauuuucuugcagugugccauucuguuagacauuagcguuuu

SEQ ID NO: 73072 - RNA, 64 nt, Human; identical to SEQ ID NO: 73056

SEQ ID NO: 73073 - RNA, 64 nt, Human
uucgauguuaguguuuccauuguauuuucuuacagugugccauucuguuagauauuagcguuuu

SEQ ID NO: 73074 - RNA, 64 nt, Human
ucaaccaaagaagucacguaccacuggugguacugugugccauaauuuggcaaaugcuggccuu

SEQ ID NO: 73075 - RNA, 54 nt, Human
gggaggaagaccuggacugagcucgugugccauccauauccaucuuucacauca

SEQ ID NO: 73076 - RNA, 64 nt, Human
aggggccugagcuucagcucaauggaagccugcugugugccacaagacggaaaaguggaagaag

SEQ ID NO: 73077 - RNA, 64 nt, Human
uucuuguuucuuaaagauguguuaguuuccuaaugugugccaaugaaauauuuaccccauagua

SEQ ID NO: 73078 - RNA, 64 nt, Human
auuucaaaggguauauauaaaagguaaaaaacuagugugccaaaugguauaggaacaacuguac

SEQ ID NO: 73079 - RNA, 64 nt, Human
uggaaccccccgacccccgcagcugcugcagccagugugccagugugcguucgacaaauggaaa

SEQ ID NO: 73080 - RNA, 64 nt, Human
gccagccccuucccaggcugggagacggcagaagagauagaaucagggcugcccccacagagug

SEQ ID NO: 73081 - RNA, 64 nt, Human
uuucgaaguuaaauuuacagcuaaugauccaagcagauagaaagggaucaauguauggugggag

SEQ ID NO: 73082 - RNA, 64 nt, Human
ugagcaaggucuuaccagaaaaauugucauaucaagauagaacuccaaguccaaucaauccaga

SEQ ID NO: 73083 - RNA, 64 nt, Human
uucuaugaauguuaaguuuuuuugagcuaaugauagauagaaaugcccacucaaagaaaaauaa

SEQ ID NO: 73084 - RNA, 64 nt, Human
cauggaugucauacccaugaagugcauuuggaugagauagaagaaauuguuuuuuaaaaaguuu

SEQ ID NO: 73085 - RNA, 64 nt, Human
augaguuaacauuuuuucauagaacuuauuuccuagauagaauuuuuuacuguuuuuuacuguu

SEQ ID NO: 73086 - RNA, 53 nt, Human
uguccccuuccucuaauuaaaaaagauagaaacugucuuuuucaauaaaaagc

SEQ ID NO: 73087 - RNA, 64 nt, Human
aaaaauagccccagaaagagccuaagcuauguucagauagaagccucgaaauuccuguaaauug

SEQ ID NO: 73088 - RNA, 64 nt, Human
gauacaaguguucuagaguguacacacaacccaaagauagaaauaaaaagaggagcagugucgg

SEQ ID NO: 73089 - RNA, 64 nt, Human
aucuccgcaaccacagcccagagcuccagucaccagauagaaaauugauuugauuucauccaau

SEQ ID NO: 73090 - RNA, 64 nt, Human
acauguuuauggacagugcucuagaugugaaaacagauagaacugguuugugggacaggggcag

SEQ ID NO: 73091 - RNA, 64 nt, Human
caguaucuagucaggggaaaagacugcauuuaggagauagaaaauaguuuggauuacuuaaagg

SEQ ID NO: 73092 - RNA, 64 nt, Human
gucuccccaccugcacuccauccagcuacaggagagauagaagccucucgucccgucccucccu

SEQ ID NO: 73093 - RNA, 64 nt, Human
ccacaacuaaugagggaaaucuguaaagccaguuagauagaagaauuuuauuuuucuguggguu

SEQ ID NO: 73094 - RNA, 64 nt, Human
aaauggcauggaguauagugcaaauucauuuuuaagauagaacacaaaacuugaaagaaguuuu

SEQ ID NO: 73095 - RNA, 64 nt, Human
guccuugucccugucauaaguaccucccuauuguagauagaagggaaggaaacuguugacuuga

SEQ ID NO: 73096 - RNA, 64 nt, Human
agaacuguuaaccuagaaauguagcuugcuaauaagauagaaugauacaaaagugaaguaguag

SEQ ID NO: 73097 - RNA, 64 nt, Human
aggcuacagggguggggcagaaggaaaggggacaagauagaacccaggaugugagggugggggu

SEQ ID NO: 73098 - RNA, 64 nt, Human
gggaccacugccaccugcaagagcccugcccaggagauagaagaccuggacuccagcccaccgu

SEQ ID NO: 73099 - RNA, 64 nt, Human
auucaggccucuguuggaaauggccuauuucgauagauagaaaguuuucuauagcucuaaaggu

SEQ ID NO: 73100 - RNA, 64 nt, Human
gcucuggauuuuaagcccagacuucaguggacccagauagaaaauauaaagucucugaucuaua

SEQ ID NO: 73101 - RNA, 64 nt, Human
uacgccaugguaauucagucacuaaaauauguaaagauagaaaauuuuuuaauuuaaagaagug

SEQ ID NO: 73102 - RNA, 64 nt, Human
agguuuuccuguggaaaguuauagcuugauugggagauagaaguugaauugaguucuuucuugc

SEQ ID NO: 73103 - RNA, 64 nt, Human
uuauuguaggaucuuaaaaaaucucaagggugggagauagaaagguuaauagaguuggaggagu

SEQ ID NO: 73104 - RNA, 64 nt, Human
uaaagcauuuuacaagaucuugcaugcuacucuuagauagaagaugggaaaaccaugguaauaa

SEQ ID NO: 73105 - RNA, 64 nt, Human
agaugcauuuacuacaguuggcuucuaaugcuucagauagaauacaguugggucucacauaacc

SEQ ID NO: 73106 - RNA, 64 nt, Human
ugugguaugagaacaggcaaaaagagaugccccgagauagaaggggagccuuguguuucuuucc

SEQ ID NO: 73107 - RNA, 64 nt, Human
cuuacuagcuuuuaagaaauuaaauacuugccugagauagaaauacuuuauuuuuguaacuuua

SEQ ID NO: 73108 - RNA, 64 nt, Human
acucugugagguggauaccaauauucuauuuugcagauagaauuuggcccagagagguuaacua

SEQ ID NO: 73109 - RNA, 64 nt, Human
ggaagcaguggaggaaagaaugcauuacuaccacagauagaaauaggggacucauagaacucuc

SEQ ID NO: 73110 - RNA, 64 nt, Human
gaaaaaagagggaggaaaaaaaagaaccuacuuaagauagaacaugguuuuggcuauggcuuga

SEQ ID NO: 73111 - RNA, 64 nt, Human
caggagaagucaugcagaaucuaagcaggaaugcagauagaacacaucuaggcucuuuucccca

SEQ ID NO: 73112 - RNA, 64 nt, Human
augauagacaaauagugcaaauuugccagcuuggagauagaaaggaauucaacaauauaucaaa

SEQ ID NO: 73113 - RNA, 64 nt, Human
uagugauucuuguuuucagaagggagagugguauagauagaaaaugacaaagauggcaauauac

SEQ ID NO: 73114 - RNA, 64 nt, Human
guaguauucuaccuacuuuuaagucuaauuuuacagauagaauaauggaaauugaaaauuuaac

SEQ ID NO: 73115 - RNA, 64 nt, Human
uaugauaaagaauaauuuggaguaauaaguaacaagauagaauuagaaaaauguugaauuucug

SEQ ID NO: 73116 - RNA, 64 nt, Human
ggcauuugguggaugauaaugagcagccccucccagauagaaugucaauauuugagcaguagga

SEQ ID NO: 73117 - RNA, 64 nt, Human
agguuaaguuauuuuuugaucguguauaccaagcagauagaauacugugcuuaguggaacccgc

SEQ ID NO: 73118 - RNA, 64 nt, Human
ccuguguauaccuagauauuagucaguuggugccagauagaagacagguuguguuuuuauccug

SEQ ID NO: 73119 - RNA, 64 nt, Human
auggauuugcccuugauucuauuuugcuaauggaagauagaaaggagagaagguuuuuuuuuuu

SEQ ID NO: 73120 - RNA, 64 nt, Human
ggagauaagggauugguuuggucuuuuucaauaaagauagaaguugcugaaguuuucugaauua

SEQ ID NO: 73121 - RNA, 64 nt, Human
uuacacgaugagauucugauucaugaagaaaagcagauagaagugguugaaaaaaugaauucug

SEQ ID NO: 73122 - RNA, 64 nt, Human
acuuggacuucuucuucuuuuuuuuuuucuuuuuagauagaagugacugugugguuggucucug

SEQ ID NO: 73123 - RNA, 64 nt, Human
gcaaggggaaaaucucagcaaugauuacucuuugagauagaagaacugcaaagguaauaauaca

SEQ ID NO: 73124 - RNA, 64 nt, Human
auguuuagaagccauauaaguggcuuuuuuuaacagauagaauuuguauuuuuauuguacuuua

SEQ ID NO: 73125 - RNA, 64 nt, Human
uauucuuauuugguuccuaacacaaacugggaagagauagaauucaucuauacuuucuuuuuuc

SEQ ID NO: 73126 - RNA, 64 nt, Human
gagugcccuuuccuggaagguguuuuuaucuggaagauagaauccaaguauuuauaacucauug

SEQ ID NO: 73127 - RNA, 64 nt, Human
augaaaagucaccucaguuuaaaagcaaaaaggaagauagaaaaucauuacucuuuuaaguucc

SEQ ID NO: 73128 - RNA, 64 nt, Human
uaagaaggugcaauccuagauaacacagcuagccagauagaagacacuuuuuucuccaaaauga

SEQ ID NO: 73129 - RNA, 64 nt, Human
auaccaaugaaaucuuacuuuucagugacugaaaagauagaauuuauuugcuaauaaucauuua

SEQ ID NO: 73130 - RNA, 64 nt, Human
agugaaaagauaauucaccaaacaaugauuaaucagauagaaguucuagucaagagggauauug

SEQ ID NO: 73131 - RNA, 64 nt, Human
uuguuuuuacaauucugaaauauaugaaaaacuuagauagaauaugucauauguuauuauaaca

SEQ ID NO: 73132 - RNA, 64 nt, Human
cauccuuacuuuuauuucacacaguuuuauauauagauagaagacuguacaauuugagccgggu

SEQ ID NO: 73133 - RNA, 64 nt, Human
aggaaagcuuauuuucugcauggugucuuuucaaagauagaauauuugaagcauguuuucuagc

SEQ ID NO: 73134 - RNA, 64 nt, Human
aauuagaucgacuggagaagaaaaaaaagaaaaaagauagaaaaaagaaaaaguuucagaagag

SEQ ID NO: 73135 - RNA, 64 nt, Human
ucaucauauaucaucaucauuauuauggugguaaagauagaaucuuuuuucuuuuuugucauuc

SEQ ID NO: 73136 - RNA, 64 nt, Human
cuuuucgcuuucuuucugcaugacuauuguaacuagauagaacauuaagagauuuucaagauca

SEQ ID NO: 73137 - RNA, 64 nt, Human
ugaaccagcaguaaguuucuaaaaaucagaaucuagauagaaguucugcaauaugaaaugagca

SEQ ID NO: 73138 - RNA, 64 nt, Human
aaaaugcauauuuauauguguauaccauauguggagauagaaaagaccuuuaagacaauaaaag

SEQ ID NO: 73139 - RNA, 64 nt, Human
ccuuccuguagggcacacugcaggauuuccauguagauagaagaacuauagggccuaguacaga

SEQ ID NO: 73140 - RNA, 64 nt, Human
accaaccuaaauuuggggaaauuaggagaggcagagauagaaccuggagccacuucuaucuggg

SEQ ID NO: 73141 - RNA, 64 nt, Human
cuagggagggauuaggaaauuagaggucuugacaagauagaaacuccagcauggugagggguug

SEQ ID NO: 73142 - RNA, 64 nt, Human
cuuuaccagggaagaaaagcaauuauuucauuucagauagaaauacaaaaaaaaaaaaaauacu

SEQ ID NO: 73143 - RNA, 64 nt, Human
auucacuagcuuugccugguuuugucuuuuaugcagauagaaucaaucaguauguauucuuuug

SEQ ID NO: 73144 - RNA, 64 nt, Human
uacauuuacaauagugcuuguacaagcuugccaaagauagaauauggaucgccagucuuuacau

SEQ ID NO: 73145 - RNA, 64 nt, Human
agacuaauaaucucuauuuauaacuaaaucauugagauagaaaaagauucccauugacuguaga

SEQ ID NO: 73146 - RNA, 64 nt, Human
cuuugguuccucaugcagcagaaggaagacagaaagauagaaauugauuauuuuuaugauagca

SEQ ID NO: 73147 - RNA, 64 nt, Human
aggaauccaaauccugaacauuuggaaugagcccagauagaaauaucgaaugcaaagcuacugg

SEQ ID NO: 73148 - RNA, 64 nt, Human
ucuguucgagaugccucuucucugucuccuuaucagauagaaauggagucaugugcugcugcuu

SEQ ID NO: 73149 - RNA, 64 nt, Human
uccacaaacacuuaguggcccacaauauauagagagauagaaaagguaguuauaacuugaagca

SEQ ID NO: 73150 - RNA, 64 nt, Human
aaaaacaaacaucgaaaggcuuaugccaaauggaagauagaauauaaaauaaaacguuacuugu

SEQ ID NO: 73151 - RNA, 64 nt, Human
acccaagucauaguccaaucucuucaaggacccaagauagaauuuaggaauuuugugaagcugc

SEQ ID NO: 73152 - RNA, 64 nt, Human
guaggaaaugaaucauaggguaaaauggaugaguagauagaagucucucauuuaaaaagugucu

SEQ ID NO: 73153 - RNA, 64 nt, Human
ucccaccucacagugauguuguggggauccagugagauagaauacauguaagugugguuuugua

SEQ ID NO: 73154 - RNA, 64 nt, Human
uugagguagucaccugcuuacagauaacagccaaagauagaauuccaaguuauaaagcauaaaa

SEQ ID NO: 73155 - RNA, 64 nt, Human
cucuccagaugaacaaagacaucuaaauaucuguagauagaaacauuuaucuaucuaaauauau

SEQ ID NO: 73156 - RNA, 64 nt, Human
ggaggcuuagaugacuucugcaggauuuauauucagauagaaaacaucaaauauuuucagggga

SEQ ID NO: 73157 - RNA, 64 nt, Human
ccuucuguuaucuuuuuuaauacuauuuuuguuuagauagaaguuucaaagaagauaaaaaugc

SEQ ID NO: 73158 - RNA, 64 nt, Human
aaauaugaaagcucuaaauuuaaaauaaauuuagagauagaaucaugguacauuauuguuucag

SEQ ID NO: 73159 - RNA, 64 nt, Human
ggugucaagggacuauguauacaugauuaggguaagauagaauguauuauauauauauauauau

SEQ ID NO: 73160 - RNA, 64 nt, Human
gaacuuaucuguuaugcuccugauagccaauagcagauagaagcuugcaaucaagaggguagga

SEQ ID NO: 73161 - RNA, 64 nt, Human
gcuugcuugauuuuuuggcuucuuauuucuaaguagauagaaagcaauaaaaauacuaugaaau

SEQ ID NO: 73162 - RNA, 64 nt, Human
gaaaaauuauuuuaaaagaacucagcauucaguuagauagaauacacaccauccuggaaaguug

SEQ ID NO: 73163 - RNA, 64 nt, Human
gcaagugaagucauuaaagaacuuuacauaugugagauagaaacaaugguuccuuaguuuugca

SEQ ID NO: 73164 - RNA, 64 nt, Human
ugguagcugguaggguuggauguguguaguuucaagauagaaaguuggucaagaaguuauagug

SEQ ID NO: 73165 - RNA, 64 nt, Human
aaguuaguucaauccugauucauauuuaauuugaagauagaagguuugcagauauucucuaguc

SEQ ID NO: 73166 - RNA, 64 nt, Human
aauucauuaaacucucaaauuuucuauagaaucaagauagaaccuuuagauacuccaacucacc

SEQ ID NO: 73167 - RNA, 64 nt, Human
aagccacuaaaucacaguaauuuguuauagcagcagauagaaaacuaauauacucccuuuaaua

SEQ ID NO: 73168 - RNA, 64 nt, Human
ccauuauauuuugggguuauguuuugcuucuuuaagauagaaaucccaguucucuaauuugguu

SEQ ID NO: 73169 - RNA, 64 nt, Human
gaagcaaaagcuaaacugucuuugacccuaagauagauagaaagcuauuuauuugucuucagug

SEQ ID NO: 73170 - RNA, 64 nt, Human
uaauuauugcuugucuuaaaauaaugaacacuacagauagaaaauaugauauauugcuguuauc

SEQ ID NO: 73171 - RNA, 64 nt, Human
gguccaaacgcccaaccuucagaaagaggaagucagauagaaauagucccugagagcacacugu

SEQ ID NO: 73172 - RNA, 60 nt, Human
ugagucuuaguagugauuaauugagaagguagauagaagaaugucuagccaauagguuaa

SEQ ID NO: 73173 - RNA, 64 nt, Human
guagugguauccuuacuagauucauaaugcaauuagauagaaaagguccaaaacuguacccuau

SEQ ID NO: 73174 - RNA, 64 nt, Human
ugccgacuccacaaaacgauuauguacucuucugagauagaagaugcuguucuucugagagaua

SEQ ID NO: 73175 - RNA, 64 nt, Human
auguaggaugaaggguuauuuaaaauggaacuaaagauagaaggaggacuguaggaagaaaugg

SEQ ID NO: 73176 - RNA, 64 nt, Human
uuuguuuuauaucaguuaaaauucacaauaauguagauagaacaaauuacagacaaggaaagaa

SEQ ID NO: 73177 - RNA, 64 nt, Human
aucauuuuucacauugauauucaagaauugagauagauagaagccaaaguggguaucugacaag

SEQ ID NO: 73178 - RNA, 64 nt, Human
uggaaguuucauauauuguuugauaugaaguguuagauagaauuuccaauauuggagcauauca

SEQ ID NO: 73179 - RNA, 64 nt, Human
ggguagggccaagaugaccagugugaaaacucucagauagaaaggagccaugcauauuaaauga

SEQ ID NO: 73180 - RNA, 64 nt, Human
gauacauucuuuucagcuucuuauugaugauuguagauagaaaaauccuuguuuauucuucuug

SEQ ID NO: 73181 - RNA, 64 nt, Human
ggccgcucucuccucuccccuccucagagggggcagauagaaacugggacggauucaagucaca

SEQ ID NO: 73182 - RNA, 64 nt, Human
uauagguccaauauugagcuuuuacuuaaaauuuagauagaacuuuuuuuuggauacagcacaa

SEQ ID NO: 73183 - RNA, 64 nt, Human
uggugccuguuggugguguucuugucuuaacccuagauagaaucuaaugaacucagaggcuuag

SEQ ID NO: 73184 - RNA, 64 nt, Human
ccucccaugucagguagggugagagaggcccugaagauagaagccaggcccgaaggccagaauu

SEQ ID NO: 73185 - RNA, 64 nt, Human
aagcacuauuaucaguucugccuagguaaauguaagauagaauuaaauggcagugcaaaauuuc

SEQ ID NO: 73186 - RNA, 64 nt, Human
aucuuacauuuuauaccaaguucaaaacacuuucagauagaagucuuucuaugcaaagauuaaa

SEQ ID NO: 73187 - RNA, 64 nt, Human
uaaaguaauguuuuuucuuaugagaaaaagguuuagauagaauuggguuuuauuaauauuaauu

SEQ ID NO: 73188 - RNA, 64 nt, Human
ccuuauucucaucuuuaagguaaggaggaaguagagauagaaggaaauacgugauuuggugaag

SEQ ID NO: 73189 - RNA, 64 nt, Human
aacuguuuaaguauuuaaacaucugagccaaagcagauagaaguuauuguauaauuguuaauca

SEQ ID NO: 73190 - RNA, 64 nt, Human
ccccagaaaauauuaaaaugggaucauacacagaagauagaaaaaucuagcaaaacuucucuuu

SEQ ID NO: 73191 - RNA, 64 nt, Human
caggcaugagccaccaugcccggcuguuuuuuuaagauagaaaaauauacuucauguauagccu

SEQ ID NO: 73192 - RNA, 64 nt, Human
agggaaauuaauuaaugagauuugauaaaucaguagauagaaugagguccccauucugaaauau

SEQ ID NO: 73193 - RNA, 64 nt, Human
cugccugucccaucagucguuuaucuguuguuugagauagaaauuaaccaaaaaugacauaaau

SEQ ID NO: 73194 - RNA, 64 nt, Human
aauguacuuuggauuauuuauuguugaacuugagagauagaaauaacaucagauauauuuuuuc

SEQ ID NO: 73195 - RNA, 64 nt, Human
gcaugaaauggauacuuauauggaaauucugcucagauagaaugacaguccgucaaaacagauu

SEQ ID NO: 73196 - RNA, 64 nt, Human
auguggacucggaaaaaaagacuuauaaguaggaagauagaacaaugaugccaguugucaggcu

SEQ ID NO: 73197 - RNA, 64 nt, Human
caagguaaguuucaguggagcucagaggacggggagauagaacuguggcacuuaggggagauga

SEQ ID NO: 73198 - RNA, 64 nt, Human
aauagagugucuuucaaggguugcaggaucuuagagauagaaaguaccuuggugaucaucucca

SEQ ID NO: 73199 - RNA, 64 nt, Human
uuuuuucguagaaguacuauaauuauaagauuucagauagaacaugcaauuagccuuuugaaau

SEQ ID NO: 73200 - RNA, 64 nt, Human
aaauggguagagccuguuugucuugcuuccccagagauagaaugugaagacacgcgcuagaaau

SEQ ID NO: 73201 - RNA, 64 nt, Human
aaaaaugguaucaaaauuacauauacuacagucaagauagaaagggugcugccacggaguggug

SEQ ID NO: 73202 - RNA, 64 nt, Human
aacaaauaaaccuucuacugagaaaauacaucacagauagaagauuaucugcuaaguccaggca

SEQ ID NO: 73203 - RNA, 64 nt, Human
ucuuccacaguuuggaauaauuuuauaauuguaaagauagaaauuauauugauaaguaaauaug

SEQ ID NO: 73204 - RNA, 64 nt, Human
aauaccuucuauacaaaccuuuuuuucuacuuuuagauagaaaugucuacuuuuucagcaguuc

SEQ ID NO: 73205 - RNA, 64 nt, Human
ugcacacucaaguccugcagucaccccugccuaaagauagaauggcuucucuguuuuucuucug

SEQ ID NO: 73206 - RNA, 64 nt, Human
ucaaguagugaaugugaucucuuugcagagcuauagauagaaacagcuggaaaacuaaaggaaa

SEQ ID NO: 73207 - RNA, 64 nt, Human
acauaggcgcuacaagguaaaauaucuuugaaaaagauagaaggugggcaaggggagcuugaga

SEQ ID NO: 73208 - RNA, 64 nt, Human
aguccgcagagguggggauggaagaucucuccuuagauagaaccugucuuccucccuggcauug

SEQ ID NO: 73209 - RNA, 64 nt, Human
gucagccagagagauaaauauccauguauaaaauagauagaaaacuuugcuugguaauuuaaaa

SEQ ID NO: 73210 - RNA, 64 nt, Human
guguacugggugaugcacccauugugauuguggaagauagaauucaauuugaacucagguuguu

SEQ ID NO: 73211 - RNA, 64 nt, Human
cugaguauguguaacaggauacaggugacagugaagauagaagaaccacgaugaccacagacuc

SEQ ID NO: 73212 - RNA, 64 nt, Human
aaauuccuucauaaaacauguaacacugaucuucagauagaaaaagcaaucuguuuauuuaccu

SEQ ID NO: 73213 - RNA, 64 nt, Human
aaaaugcucuggcuuuguauuuucuuuacagcauagauagaaaaaugcacauuuuuccacacuc

SEQ ID NO: 73214 - RNA, 64 nt, Human
gucacauucuuuucaguuggagagaauugggcuaagauagaaaauaacaugauuuguuccuuau

SEQ ID NO: 73215 - RNA, 64 nt, Human
accuauucauauugcugugaaugcuuuaucuuggagauagaaaauauaaugauaaauucaucau

SEQ ID NO: 73216 - RNA, 64 nt, Human
ucugggauaaagguuuugguauuugcccacuucuagauagaaugaaugaaaacaacacaagcgu

SEQ ID NO: 73217 - RNA, 64 nt, Human
ucauuuuguuuucuuuaauuggguugaauggaguagauagaaauauuuaugguuuagguaacag

SEQ ID NO: 73218 - RNA, 64 nt, Human
uaacuaacaugugguauguaugguccccuauauuagauagaagucuuugcuacauguaauucaa

SEQ ID NO: 73219 - RNA, 64 nt, Human
gacuugcauuucugacuuuauccuguuguuaggaagauagaaacuagguuuugaaagauuacau

SEQ ID NO: 73220 - RNA, 64 nt, Human
aaagccaaugaaagacuucuuuguugauuuuuuaagauagaaagauuaaaaagaaagaaagaug

SEQ ID NO: 73221 - RNA, 64 nt, Human
uggaguaggagacuuucacaagugguuuccauggagauagaaugaagcauucuguggucaagua

SEQ ID NO: 73222 - RNA, 64 nt, Human
uuacaagaugagauucugacuacuaaacagaagcagauagaaguggccgaaaaaaaaaugaauu

SEQ ID NO: 73223 - RNA, 57 nt, Human
acagacucugcugucgcugagcuuccuagauagaaaccaaagcagugcaagauucag

SEQ ID NO: 73224 - RNA, 64 nt, Human
cucugcuuuugcccuuugucaucaccaacacaacagauagaauuuaaauauaaguauauggugu

SEQ ID NO: 73225 - RNA, 64 nt, Human
ucccaagugaacuugagcccuguuugggcucaggagauagaagacaaaaucugucucccacguc

SEQ ID NO: 73226 - RNA, 64 nt, Human
gggagcccuggaugugaggucugugggagucugcagauagaaagcauuacauuguuuaaagaau

SEQ ID NO: 73227 - RNA, 64 nt, Human
uaaauugaagaaaacaagaugcugccauauauuaagauagaauauaauuaacuccaugagaaug

SEQ ID NO: 73228 - RNA, 64 nt, Human
guuugccacaaaacauugcuugaagcacauacuuagauagaaauuggucuuaauuuauauaauc

SEQ ID NO: 73229 - RNA, 64 nt, Human
auuuaagaggcagaagauuaagauaagaaauauaagauagaaaagcuuuguuccuaacauaucu

SEQ ID NO: 73230 - RNA, 64 nt, Human
auacugauaggcuuuuaagcuucuuuuaagaaguagauagaaauacgaagauuaugauaagaaa

SEQ ID NO: 73231 - RNA, 64 nt, Human
ggagccucuuucacuccucuagacacacugccugagauagaaguuugcaucuuauuggcugugg

SEQ ID NO: 73232 - RNA, 64 nt, Human
cccuauucauucucuguccagaguuuuuugcuaaagauagaauuauuaaugauacaucaaguag

SEQ ID NO: 73233 - RNA, 64 nt, Human
uuccuacucuuuaaggaaugauuucuuuagccucagauagaaggaccuuuaugaucuggccaua

SEQ ID NO: 73234 - RNA, 64 nt, Human
uauauuauaaggauaugcacguuuguucuggaaaagauagaauuugucucuaaaagacuugaaa

SEQ ID NO: 73235 - RNA, 64 nt, Human
ccucuccagcugcuccuucaaaagauacaucaaaagauagaaacucugggcugggcacaguggc

SEQ ID NO: 73236 - RNA, 64 nt, Human
ugcuaucacaauaugcuaagagcucacaaaaauaagauagaauuuccaggacaaacaucuuugg

SEQ ID NO: 73237 - RNA, 64 nt, Human
gauuugguggugauggggggauagagguagaagcagauagaagguaauuuuaaaguuaauuuau

SEQ ID NO: 73238 - RNA, 64 nt, Human
cucgaccccgcgccgggcaccuguggcuugggacagauagaagggaugguuggggauacuuccc

SEQ ID NO: 73239 - RNA, 64 nt, Human
aguuuauuucuauacuugaguucuuaaguacagaagauagaagugauuuaaauggcauaguaua

SEQ ID NO: 73240 - RNA, 64 nt, Human
aucuucaguuucuaugacuguggaauaaauguucagauagaaacuucacuuuuggauguacugc

SEQ ID NO: 73241 - RNA, 64 nt, Human
ccuggguucaucuaaugugguuuuccuuaggaagagauagaaggcacagaagaucacagcuaga

SEQ ID NO: 73242 - RNA, 64 nt, Human
aauucuuccuacuuauauaagaaaucucacacugagauagaauugugauuucauaauaacacuu

SEQ ID NO: 73243 - RNA, 64 nt, Human
acaaaaccauuuuugaauuaaggcuaugauauuaagauagaaauuuggacuguuguucugcuuu

SEQ ID NO: 73244 - RNA, 64 nt, Human
ccuuagaaaucuguagcuagauuuuuguuguuauagauagaauuuacuguuucugaaacccaaa

SEQ ID NO: 73245 - RNA, 64 nt, Human
ucuuaguccaacuaaugcagucgauacaaugcguagauagaagaagccccacgggagccaggau

SEQ ID NO: 73246 - RNA, 64 nt, Human
uuuucuuuuucauggugccuuucuuucuaagaaaagauagaaagaauggggccagguucauguc

SEQ ID NO: 73247 - RNA, 64 nt, Human
ucugccuguuccucugaagcagcgugauugcuguagauagaacaacgcuccuucgagucccuuc

SEQ ID NO: 73248 - RNA, 64 nt, Human
gguuugcuagacaccuucgcuuguuaucuugucaagauagaaaagauaguaucauuucacccuu

SEQ ID NO: 73249 - RNA, 64 nt, Human
uaggaaaucuaggacuuccagcuucccucaugucagauagaaaaaaagucaggaaaccagcucg

SEQ ID NO: 73250 - RNA, 64 nt, Human
aacuuuagauuugggauuuaaaaugccuauuguaagauagaauaauugugaggcuggauucacu

SEQ ID NO: 73251 - RNA, 64 nt, Human
uauucuaauguaucccaaaccuaaucuuuuuaaaagauagaagauacuuuuaagacaacuuggc

SEQ ID NO: 73252 - RNA, 64 nt, Human
guuuucugucuucuguuaaguguguuuucucuggagauagaauguaaaccauauuaaaaggaaa

SEQ ID NO: 73253 - RNA, 64 nt, Human
uggcauugggagaguucccccaugaugagggccaagauagaaucuguaccacucagugcuacca

SEQ ID NO: 73254 - RNA, 64 nt, Human
caaaccuccuagguuaaaauaguuucuuuauuuaagauagaauaauuuccagaaauuguacuuu

SEQ ID NO: 73255 - RNA, 64 nt, Human
cagaugggcauuuauuacuggcaguggaaacaccagauagaagaucuuaggagaggcccagaaa

SEQ ID NO: 73256 - RNA, 64 nt, Human
gccauggagcccuccccuggccaugucuggggacagauagaaccuguugggggaaauauucccu

SEQ ID NO: 73257 - RNA, 64 nt, Human
aucuagaaaugcauauauuuagcggguauuugaaagauagaagcauuauuuauaacugaagagu

SEQ ID NO: 73258 - RNA, 64 nt, Human
uaggucaagcuauuucucuggaucuaugauuuuaagauagaacaggcugguucugaguucuggu

SEQ ID NO: 73259 - RNA, 64 nt, Human
gaaugaaauaucagcauaacuaugugggcaaaauagauagaauuaaaugcaugaauuuuccuca

SEQ ID NO: 73260 - RNA, 64 nt, Human
uuucuccauaauauggggauagaaaauggaauaaagauagaagggauguagaauaugcuuuccu

SEQ ID NO: 73261 - RNA, 64 nt, Human
ugaagcaaguuaacacucuaagagaauuauuuugagauagaagugaagcuaagcuaaacuucac

SEQ ID NO: 73262 - RNA, 64 nt, Human
uuauaaauguuaaacacaaaaacuacaugacugaagauagaagagaaugcgauggauuuuauua

SEQ ID NO: 73263 - RNA, 64 nt, Human
cuaaaagaagaucugacaggaaagcuguauaaugagauagaaaaacgucagguauggaaggcuu

SEQ ID NO: 73264 - RNA, 64 nt, Human
cugugccaucuuggagccucaggcggggcuccggagauagaagacaggucgccggaggcucccc

SEQ ID NO: 73265 - RNA, 64 nt, Human
cgcagaagaaacagaagaacucaugcugccagauagauagaaaaagaagcauggauccuugagg

SEQ ID NO: 73266 - RNA, 64 nt, Human
gugcuaucuuguauggcucuagaucuuuucuuugagauagaaauuuucaaaaacauaaagcuag

SEQ ID NO: 73267 - RNA, 64 nt, Human
auguggcauuugugaucaugagauugaugcaaugagauagaagauguuugcuaccugaacacuu

SEQ ID NO: 73268 - RNA, 64 nt, Human
gggcaguauacuaagguguggcugucuuggauucagauagaacuaaggguucccgacucugaau

SEQ ID NO: 73269 - RNA, 64 nt, Human
uuguuuaucauuagauuugauggggccaaaguugagauagaauagagggugaugacgguaagag

SEQ ID NO: 73270 - RNA, 64 nt, Human
uucuuuuugaauacuuguuucuuuagcacuuugaagauagaaaaaccacuuuuuaaguacuaag

SEQ ID NO: 73271 - RNA, 64 nt, Human
auuuucaguuauaggggaaaaaauauuuucucuaagauagaagaaguuauuucaguauuagcua

SEQ ID NO: 73272 - RNA, 64 nt, Human
uaugaaaucuaaagauuuuuuuuccugucuugggagauagaauaaugaugugccuuacaaugga

SEQ ID NO: 73273 - RNA, 64 nt, Human
gaugggcagggaaaaacuaguuuugagugucuuuagauagaaacaugagacuaagguuugauuu

SEQ ID NO: 73274 - RNA, 64 nt, Human
agucaaguaaccaaaaaagggggaggcauuuugaagauagaaccucuauuuuaaaaagagaagu

SEQ ID NO: 73275 - RNA, 64 nt, Human
caguguggaauaguucugaauuaugcuguucuacagauagaaaaaaaguccaaaugccuuuaaa

SEQ ID NO: 73276 - RNA, 64 nt, Human
ucauuuuuuuaauguggaguucacguaacuuugaagauagaaaugaaaaaaaugaacaaacuac

SEQ ID NO: 73277 - RNA, 64 nt, Human
uaugugggugggugggagggcuggggcaggggccagauagaaauuauugguuuuguuuuuuaau

SEQ ID NO: 73278 - RNA, 64 nt, Human
ucacccaagaaugugcuuuccuggaaauuuuucuagauagaauauuauguaauuuguuuugaag

SEQ ID NO: 73279 - RNA, 64 nt, Human
gaggaagaacaaauaauagaagaaaauaaaaaugagauagaagaaaaguaagaaccaagauuca

SEQ ID NO: 73280 - RNA, 64 nt, Human
cauguguaacuuccacaacuguaaauauugggcuagauagaacaacuuucucuacauuguguuu

SEQ ID NO: 73281 - RNA, 64 nt, Human
gaggugucaggagauaggaguugguuaagaugauagauagaaaaacggaaggguucagcugcug

SEQ ID NO: 73282 - RNA, 64 nt, Human
uuaacuguuguaaccaguuagcuguuguguuuuaagauagaaaggaacaagacuaaaauuguaa

SEQ ID NO: 73283 - RNA, 64 nt, Human
guauuuuuaaagcacauaucugaauaaauugccuagauagaaaaaaaauuaucacgaguaaaau

SEQ ID NO: 73284 - RNA, 64 nt, Human
uugguuucuuggcuuuccgaaggccaugaucuagagauagaaaaaucccuacuaagucccaaca

SEQ ID NO: 73285 - RNA, 64 nt, Human
gauuauuuuaauauggaggugggagugugguuggagauagaaaggcuccuccccaccauguaau

SEQ ID NO: 73286 - RNA, 64 nt, Human
cuugaacuaagaucaguuuugaaguuucuaaaggagauagaaugauuuuaaccucaaugaguug

SEQ ID NO: 73287 - RNA, 64 nt, Human
aguucaucgaaaugcagcuuuuucugaacuucaaagauagaaucccauuuuuaaugaacugaag

SEQ ID NO: 73288 - RNA, 64 nt, Human
uuaaaccaugucacagcugugaagaucuggcacaagauagaaugguaaaaaaaaaaaaaauuuu

SEQ ID NO: 73289 - RNA, 64 nt, Human
cucaguucaagauggccaccacugguagacguguagauagaaaagaggacuggucuugggaaca

SEQ ID NO: 73290 - RNA, 64 nt, Human
cuuuguuccguuaauuaguacuaauuaaguggauagauagaaugguuuuccuguuugucccucc

SEQ ID NO: 73291 - RNA, 64 nt, Human
uguuguuuccugugcauucucaaacucauuuauuagauagaacaaucuuucuauauuuaauuuu

SEQ ID NO: 73292 - RNA, 64 nt, Human
ugugauguaagccuccauacgaaagcacuguugcagauagaagaagaggugguugcugcucaug

SEQ ID NO: 73293 - RNA, 64 nt, Human
cacacauauauauauuuagaaacgugaguguuaaagauagaauuuguuuuaggacaaauuuuaa

SEQ ID NO: 73294 - RNA, 64 nt, Human
aaguauucguacucuagccuuuuuaaucauucauagauagaagucuuuguacccacuccuuaug

SEQ ID NO: 73295 - RNA, 64 nt, Human
gcaagguuuacacugcggaagccaaaggcagcuaagauagaaagcuggacugaccaaagacugc

SEQ ID NO: 73296 - RNA, 64 nt, Human
ucuagguugagaacuuuuacacacacuaagauaaagauagaaaucugacaugcucacucaauuc

SEQ ID NO: 73297 - RNA, 64 nt, Human
aaacaauuauaauuucuuuacauacucaaaaccaagauagaaaaaggugcuaucguucaacuuc

SEQ ID NO: 73298 - RNA, 64 nt, Human
aguuagccguaaacagguucuggaagacacaccuagauagaacucggcccgucaguucugagug

SEQ ID NO: 73299 - RNA, 64 nt, Human
uuacaagaugagauucugauucaugaagaaaagcagauagaaguggcugaaaaugaauucugag

SEQ ID NO: 73300 - RNA, 64 nt, Human
uguuuuaguauuagacuuuuuuuucaaugccaaaagauagaagauuaaauauucuugaauaaag

SEQ ID NO: 73301 - RNA, 64 nt, Human
aucaaucauucuccccuuccucaucagcaaugguagauagaaauguccuaaacuuuucuaaauc

SEQ ID NO: 73302 - RNA, 64 nt, Human
uauacuaagaaaagauacgacuuuauuuucugguagauagaaauaaauagcuauauccauguac

SEQ ID NO: 73303 - RNA, 64 nt, Human
gagcuugaugcugccuggccaaaugaggugacucagauagaaucugaucccauucagagcuugg

SEQ ID NO: 73304 - RNA, 64 nt, Human
uggcaggccaagaaugggaggcugacucaaaacuagauagaaaaauauaaaauaaucuucgacc

SEQ ID NO: 73305 - RNA, 64 nt, Human; identical to SEQ ID NO: 73299

SEQ ID NO: 73306 - RNA, 64 nt, Human
guuauguacggauauauauauauauagucuuccaagauagaaguuuacuuuuuccucuucuggu

SEQ ID NO: 73307 - RNA, 64 nt, Human
augugacuaaacgcaguaguuuuuuuaaaaggggagauagaaaauaaaugguuuuguuggagug

SEQ ID NO: 73308 - RNA, 64 nt, Human
gaugaaagcuaucacacugagaauagugggauguagauagaaagcaccugaauugugcuucuga

SEQ ID NO: 73309 - RNA, 64 nt, Human
auuuuaaagcaacuuauguguucgaucauguaugagauagaaaaauuuuuauuacucaaaguaa

SEQ ID NO: 73310 - RNA, 64 nt, Human
auaaacucagugguuugguuuuuauuauuaauagagauagaacuauuguguguuaauauuagca

SEQ ID NO: 73311 - RNA, 64 nt, Human
gagcgcgcauucuauuuccuccgcagggaaugccagauagaaaguugcgggcaacacuuuucuc

SEQ ID NO: 73312 - RNA, 64 nt, Human
aaagacgaauuguaucaguuguaaagauacauugagauagaauuaaggaaaaacuuuaaugaag

SEQ ID NO: 73313 - RNA, 64 nt, Human
gucccugccacaguuccagaguuaucaguaggcuagauagaaggugaccucuccucauaaggac

SEQ ID NO: 73314 - RNA, 64 nt, Human
cacuuccaucagaagugaagauaggaagcucaucagauagaacaucagcccaugagauguuugc

SEQ ID NO: 73315 - RNA, 64 nt, Human
uuuuuuaauuuaauuuuaaauuaucccagcuauuagauagaagggauguuacugcacuuaugug

SEQ ID NO: 73316 - RNA, 64 nt, Human
gaaacaucuaucaagcaacacagccccuuaucccagauagaaaagugucucaaaugcauucuac

SEQ ID NO: 73317 - RNA, 64 nt, Human
uaaaauuguaagauaagaaacaguuucuuagagcagauagaaaaaugcuuauuuaaaucuuugc

SEQ ID NO: 73318 - RNA, 64 nt, Human
agagacagaguggugguggggagagugaagaaagagauagaauacaggugguaccuguugugga

SEQ ID NO: 73319 - RNA, 64 nt, Human
agggagaaggaagggaagaaaggggaggaagaauagauagaaauagggauuggagacaguaacc

SEQ ID NO: 73320 - RNA, 64 nt, Human
cuggagagcccagguuauaucagacaccacuaguagauagaaguucuaacaacuugagcucugu

SEQ ID NO: 73321 - RNA, 64 nt, Human
cccagggcaagacaacaggaucagagaacuugccagauagaaaagacuuaaauggagaaccagc

SEQ ID NO: 73322 - RNA, 64 nt, Human
uaguagacaggaugcccaguuaaguuugaauuucagauagaaaauaauuuuagaauaaauaugu

SEQ ID NO: 73323 - RNA, 64 nt, Human
cuccaguuuucuccucugcuucuuugccucccucagauagaaaacagcccccacuccaguccac

SEQ ID NO: 73324 - RNA, 64 nt, Human
agcucauucgugucacccugucugugagucauuuagauagaauaguccuccuugggucucccac

SEQ ID NO: 73325 - RNA, 64 nt, Human
aucucuuuaugcaugugcauucaaaaggaagaguagauagaauuuuguaaaacagauguuguau

SEQ ID NO: 73326 - RNA, 64 nt, Human
uccuucaagaaggauuuuuccauacuauuuuuuaagauagaagauaauuugugggcaggggugg

SEQ ID NO: 73327 - RNA, 64 nt, Human
acuuggaacaaccauuuaaaugaaggauuuugugagauagaauucaauuaaagcgauuugaaug

SEQ ID NO: 73328 - RNA, 63 nt, Human
cugcuuuuuuaaucuacagaaagaauggagggaagauagaaauggagaauuuaaaagaaaagu

SEQ ID NO: 73329 - RNA, 64 nt, Human
ucacuggaaauccaauuaacaauuuuacaacauaagauagaauggagaccugaauaauucugug

SEQ ID NO: 73330 - RNA, 64 nt, Human
uccauguaacucuuuagaacaagaggaauaggucagauagaagaagcuguguaauguauuaaua

SEQ ID NO: 73331 - RNA, 64 nt, Human
uguuuuaucuuaguuuuauacauaauuuaccaucagauagaacuuuaugguucuaguacagaua

SEQ ID NO: 73332 - RNA, 64 nt, Human
ucccacagggugcugggugggcaucucaguuaggagauagaagaagauugggcgccggccgggg

SEQ ID NO: 73333 - RNA, 64 nt, Human
ucuaggugucaggagaaaguuuuguugauuuagaagauagaaauaguugguuccuaagaaugug

SEQ ID NO: 73334 - RNA, 64 nt, Human
aucacagcagauaaugaagcugauuuuuuagcugagauagaagcuuuggagaaaaugaaugaag

SEQ ID NO: 73335 - RNA, 64 nt, Human
uaacugcuuuggagcaaaucucuucuguuuagagagauagaaguuaugacauauguaauacaca

SEQ ID NO: 73336 - RNA, 64 nt, Human
ugguuugugaggaaacaugcaugcagcugugggaagauagaaagcugucuaggacucacggggu

SEQ ID NO: 73337 - RNA, 64 nt, Human
agaaagagcuaacuuagcuccauauuugacagaaagauagaaagcuuaaccacauuguccaaaa

SEQ ID NO: 73338 - RNA, 64 nt, Human
uaaagagaggagagaauugaauggcguuuagagaagauagaaaagaaucacagucauauauuua

SEQ ID NO: 73339 - RNA, 64 nt, Human
ugagcuggcucagaagacaaaccaauuaagauguagauagaaauuaauuuaaggucuuuucuua

SEQ ID NO: 73340 - RNA, 64 nt, Human
gggauugugccuggagacaugcccauggcugcacagauagaagaaccuccagcccauucaggua

SEQ ID NO: 73341 - RNA, 64 nt, Human
uguagggaaguauucuuuaauguuauuucauuucagauagaaauaauucucauuggagauaaac

SEQ ID NO: 73342 - RNA, 64 nt, Human
gccauagguggaauaauccaacauaaauugccauagauagaagguaucuguaauauauauauau

SEQ ID NO: 73343 - RNA, 64 nt, Human
auaaggaucaagacagacaaugucgagggacaaaagauagaagauggaggaggaaagacauuau

SEQ ID NO: 73344 - RNA, 64 nt, Human
ucaaaacagaauuuaucuuguuaauaauuccucuagauagaauaauguagaaacauuuuauuug

SEQ ID NO: 73345 - RNA, 64 nt, Human
caaugcuuugauucggauguuauauuaaaaacauagauagaaugaaccaauaugaacugcaggc

SEQ ID NO: 73346 - RNA, 64 nt, Human
gaugagucugaucuggaguaaaucagaaguacuaagauagaaaugcugaauucuguuccacuag

SEQ ID NO: 73347 - RNA, 64 nt, Human
caagccaaggaacacacggggcuaccagaagccgagauagaagcauggaacauauguucuagua

SEQ ID NO: 73348 - RNA, 64 nt, Human
aaaaggaaguauuuaaaggaugauagagaccaucagauagaagcagggaagguagauaacuuuu

SEQ ID NO: 73349 - RNA, 64 nt, Human
uuauugcagaacauuguaucacauuuuaguccagagauagaauaaaguugaauaaccuugacuu

SEQ ID NO: 73350 - RNA, 64 nt, Human
gcugguucaggcucuucaaaagauguagaaaaagagauagaaggaaccaccuaugcuuaaaaua

SEQ ID NO: 73351 - RNA, 64 nt, Human
guggaugaguggaucgauggauguauugauaaauagauagaaccagucaucugaagcaacuuaa

SEQ ID NO: 73352 - RNA, 64 nt, Human
guuguuauuuagugauauuguggguaacgugagaagauagaacaaugcuauaauauauaaugaa

SEQ ID NO: 73353 - RNA, 64 nt, Human
agugaucgcauauucauugaugaggguuugcuugagauagaaaaugguggcuccuuucugucuu

SEQ ID NO: 73354 - RNA, 64 nt, Human
auacuuuuguguauagaaaauauguauaguagguagauagaaaaguauaaaauguuuguugaag

SEQ ID NO: 73355 - RNA, 64 nt, Human
gugagguguaucaguaaggugggauuauggggguagauagaaaaggaguugaaucaucagagua

SEQ ID NO: 73356 - RNA, 64 nt, Human
ugaaaaaucccuccaagugauucuuuuacaucccagauagaaaacccuaaauuaaaggugaaaa

SEQ ID NO: 73357 - RNA, 64 nt, Human
agccuugacccccaggggcugacauucuagggggagauagaaggagacaaacguagaagguaga

SEQ ID NO: 73358 - RNA, 64 nt, Human
ccugacuaacaugcugaaaccccaugucuacuaaagauagaaaaauuagcuggacaugguggca

SEQ ID NO: 73359 - RNA, 64 nt, Human
gugcucuuaacaguuuuaagauaaacuauaggauagauagaaugguuauuuuaugcaagaaaua

SEQ ID NO: 73360 - RNA, 64 nt, Human
auuuacauuuuuuuuaaagaagagacugauguguagauagaaaacccuuuuuuugcuucauuag

SEQ ID NO: 73361 - RNA, 64 nt, Human
aaaauaacuccacaguaaaauagguagaaucugaagauagaaagggaagaaaaguaaaaguugc

SEQ ID NO: 73362 - RNA, 64 nt, Human
aaugaaugaaugaauuuagaaccacacaaugccaagauagaauuaauuuaaagccuuaaacaaa

SEQ ID NO: 73363 - RNA, 64 nt, Human
uuaugcguugugaagucagaaaguaaaaaaggguagauagaaguauucgaaguauaguuccauu

SEQ ID NO: 73364 - RNA, 64 nt, Human
aaaaggacacuaaaaacuggaguuauagauauccagauagaaacaguaguuaucuuuggguaga

SEQ ID NO: 73365 - RNA, 60 nt, Human
agauuauugaaacaauguaaaaugagccagagauagaacauuuuaagccaucuucaaacu

SEQ ID NO: 73366 - RNA, 64 nt, Human
auggaauucauucuggucucucuauuaccacugaagauagaagaaaaaagaaugucagaaaaac

SEQ ID NO: 73367 - RNA, 64 nt, Human
ucugcucuuuucacuugauauccaguacuauguaagauagaaggugcaugucuucuguauucug

SEQ ID NO: 73368 - RNA, 64 nt, Human
uuuuuucuccuuucuuaacucacuacagagugagagauagaaagggauacuugaaacugggaaa

SEQ ID NO: 73369 - RNA, 64 nt, Human
acagcucaucauucuguagaaaugugcaguuugcagauagaacacugcacacagaaauguuuuu

SEQ ID NO: 73370 - RNA, 64 nt, Human
auucauaacaguuuuuccaaaguucuuuccugccagauagaaauugugcacagcacagcaucaa

SEQ ID NO: 73371 - RNA, 64 nt, Human
auacacauuaguccucaguuauaaagugaaucucagauagaaauuaaaagugcaguuguguuaa

SEQ ID NO: 73372 - RNA, 64 nt, Human
gugucuaaaaauauugcugaaguuauucuugaucagauagaauuuaaccuaaaaugugaacucu

SEQ ID NO: 73373 - RNA, 64 nt, Human
uuagaaaaagauucuggauaucaucccccuugaaagauagaaagcauucaggaugucccaguua

SEQ ID NO: 73374 - RNA, 64 nt, Human
guaggcccaagugucaagaaccacaccagauuggagauagaaaagaauagcugaaauuauguca

SEQ ID NO: 73375 - RNA, 64 nt, Human
uuugauagauaaaaauggaagguaagauguuucuagauagaauguuuucauacaauuucagcuu

SEQ ID NO: 73376 - RNA, 64 nt, Human
agggcuggugcccggcccagggugcccagcggggccaugccauggcagauaaagcucaggacgu

SEQ ID NO: 73377 - RNA, 64 nt, Human
ggaaagugggcauggcucuauuccuauucucagaccaugccaguggccaccugugcucagucug

SEQ ID NO: 73378 - RNA, 64 nt, Human
ggagagaaugacuagcauuuaucuucuuuuccuuccaugccaaagguuggagucugcuggugcg

SEQ ID NO: 73379 - RNA, 64 nt, Human
uguuuuccuuuuaaagaaggauauauaauaauucccaugccagagugaaaugauuaaguauaag

SEQ ID NO: 73380 - RNA, 64 nt, Human
ccucccaaagugcugggauuacaggcaugagccaccaugccagacuucccauuuuacuuucugc

SEQ ID NO: 73381 - RNA, 64 nt, Human
cagaggguggggcacugcaccuuaccccacccauccaugccagcacuucugcacuacggccauu

SEQ ID NO: 73382 - RNA, 64 nt, Human
caucccagcugaucccagucacugcuugcuggggccaugccauggaagcuucccaucagucucc

SEQ ID NO: 73383 - RNA, 64 nt, Human
caagucaccuuuguagcuagcaccagugccagcuccaugccauugcaccuucuuuagucuugau

SEQ ID NO: 73384 - RNA, 64 nt, Human
cacaaacgggcucagcaaaagaugcuucucacugccaugccagcuuaucucaggggugugcggc

SEQ ID NO: 73385 - RNA, 64 nt, Human
gggccagacugaagcagcacaaggccggggacacccaugccaagcagugggagcacgcaggaca

SEQ ID NO: 73386 - RNA, 64 nt, Human
cuucucccucuugcaugcuuuaccugucccacacccaugccaaugugccaagucucccuugggg

SEQ ID NO: 73387 - RNA, 64 nt, Human
ggagacaggaggaguaggaggaggcagggccucuccaugccagccucugugguccuugcccaaa

SEQ ID NO: 73388 - RNA, 64 nt, Human
acauauuugaacuaauagaggaacucugagucacccaugccagcaucagcuucagccccagacc

SEQ ID NO: 73389 - RNA, 64 nt, Human
agaaucugaugccaugcaauuggcaugacaccugccaugccacuaucuuuggcauccauggggc

SEQ ID NO: 73390 - RNA, 64 nt, Human
cccaagacauaccaacagugaagccaggacagcaccaugccaucggcgcuccagucugucuggc

SEQ ID NO: 73391 - RNA, 64 nt, Human
aaauaaaaauaaaggguuaccccaugcaaucacaccaugccauguuuuccuuccuggagggcag

SEQ ID NO: 73392 - RNA, 64 nt, Human
guggcuagaaauucaccaugucuauucucaagauccaugccagggagcucuuugacucucgugg

SEQ ID NO: 73393 - RNA, 64 nt, Human
gugcauuuauaacaaacuucuaauugcacaaaacccaugccagcucagaguuuagguguacaca

SEQ ID NO: 73394 - RNA, 64 nt, Human
gucccuggagcgcggccuccagcugccgcaauuuccaugccaggauauuuuuccgcaaaucagu

SEQ ID NO: 73395 - RNA, 64 nt, Human
agcggcgacccaguguacgucccgccccggccaaccaugccaagccugccugccaggccucugc

SEQ ID NO: 73396 - RNA, 64 nt, Human
aggggacacgaaggaggagugacugggaagccucccaugccaaggaggugggaggugcccugga

SEQ ID NO: 73397 - RNA, 64 nt, Human
ggagaggacacuggccccucgcacuccagaaaagccaugccagcugggcucguugacaaagggu

SEQ ID NO: 73398 - RNA, 64 nt, Human
gcugcucugccccuugggcauccacccagugcugccaugccacugccaggcaccuggccugcug

SEQ ID NO: 73399 - RNA, 64 nt, Human
gugcccccagccagcuggcugugccagggcagagccaugccacaucuguauauagaugggguuu

SEQ ID NO: 73400 - RNA, 64 nt, Human
caacuguggaaacuucagucccucaggcuggcagccaugccaguaccugccugggggugggggg

SEQ ID NO: 73401 - RNA, 64 nt, Human
acucaccggaacuccuauaaugucuccacuuuguccaugccauuuagcaaucucaucuccuaaa

SEQ ID NO: 73402 - RNA, 64 nt, Human
uauauuuuuaaacaugaacaaacucccaugggagccaugccaguguaguggaaaaguaguacau

SEQ ID NO: 73403 - RNA, 64 nt, Human
ggugcccacggccauuggcauugccagccucauuccaugccacuaugagucaacucaggaaaac

SEQ ID NO: 73404 - RNA, 64 nt, Human
gggcacagccgcgacucugcaggcagcuucccccccaugccagggcucugcgccgucaugugag

SEQ ID NO: 73405 - RNA, 64 nt, Human
acaccagauuggaaauggagugaaacaagcccucccaugccaugucuccgugggccacgccuua

SEQ ID NO: 73406 - RNA, 64 nt, Human
guucaguuccuucuggcagagagguuuucuuucuccaugccauauggaugugacucaaaugagg

SEQ ID NO: 73407 - RNA, 64 nt, Human
aagaugccaaggguauuugauaaaaauucuucuuccaugccaugucaggaguuaauacaaauga

SEQ ID NO: 73408 - RNA, 64 nt, Human
guucucagaaucaugcugagagagcuggaggcacccaugccaucucaaccucuuccccgcccgu

SEQ ID NO: 73409 - RNA, 64 nt, Human
agagugugcuggaggacugaguaagaaaugcugcccaugccaccgcuuccggcuccugugcuuu

SEQ ID NO: 73410 - RNA, 64 nt, Human
cuuaaugaggggcaggagucccagggaaagagaaccaugccaugcugaaaaagacaaaauugaa

SEQ ID NO: 73411 - RNA, 62 nt, Human
aauguuucucuuuaccuuagcaccucaaaauaccaugccauuuaaagcuuauuaaaacucau

SEQ ID NO: 73412 - RNA, 64 nt, Human
aaguauaugugucaacuggacuucaagaggagguccaugccaaacugacuguuuuaacaaauac

SEQ ID NO: 73413 - RNA, 64 nt, Human
uagcaucuggugagggccuuugugcuuugucaucccaugccagaaggcagaaggguaagagagg

SEQ ID NO: 73414 - RNA, 64 nt, Human
auuccuauuauaauugacacaguacauuaacaauccaugccaacggugcuaauacgauaggcug

SEQ ID NO: 73415 - RNA, 64 nt, Human
ccucccauccgguuuuuugauggagccucaggcaccaugccaaaaauaauuuaaagggauucuu

SEQ ID NO: 73416 - RNA, 64 nt, Human
cagcccacgaccgggucgaccccccaggggacgcccaugccaggcccggggaccugugccacac

SEQ ID NO: 73417 - RNA, 64 nt, Human
caucuugaaccagaccuuaacgaccaaacccagaccaugccaaaguccagucugaaaugaaagg

SEQ ID NO: 73418 - RNA, 64 nt, Human
ggaauggagcuguauaacugugcagagacuuuauccaugccaauaguugcuguccccuuccagg

SEQ ID NO: 73419 - RNA, 64 nt, Human
aggauccagguccucucucaccucugacccagcuccaugccagagcaggagccccggucaauuu

SEQ ID NO: 73420 - RNA, 64 nt, Human
uaacacaugacaaguggucucaaugcagcuaggaccaugccagaaaccuggaucucuuaagaga

SEQ ID NO: 73421 - RNA, 64 nt, Human
accacagauaaugacaguuacaugguagaacugcccaugccacaaauauuuauuuggaaaagua

SEQ ID NO: 73422 - RNA, 64 nt, Human
ggaaauuuucuacccugcucuugagccugauaacccaugccaggucuuauagauuccugaucua

SEQ ID NO: 73423 - RNA, 64 nt, Human
ucugugaagcgagaaugucugaaaauaaauaggaccaugccauggguucucagugcgccuuccc

SEQ ID NO: 73424 - RNA, 64 nt, Human
cuuugaccauacugacacugggaaaagcccauucccaugccaugaagacaccaaggcagcccua

SEQ ID NO: 73425 - RNA, 64 nt, Human
ggaucauucucugaauggucuaaggaagcgguagccaugccaugcaaugauguaggaguucucu

SEQ ID NO: 73426 - RNA, 64 nt, Human
gucucagucuggcaagacgcugggucuucaggcuccaugccaacagagccccuggugcaaugcg

SEQ ID NO: 73427 - RNA, 64 nt, Human
auucuaaaagguaugcaguacagcaguauagaauccaugccaauacagagcauagggaaagguc

SEQ ID NO: 73428 - RNA, 64 nt, Human
uuaauuguguucuguuuuuugcagucuuuaagugccaugccaauuguucuuauauucuauagaa

SEQ ID NO: 73429 - RNA, 64 nt, Human
cuuuguaucuuuaugaaagacugagcuggaccacccaugccaaggagcgagccuuuaaacagca

SEQ ID NO: 73430 - RNA, 64 nt, Human
gcaaccuaaagcuguagucgccuccaauagccauccaugccaucccugccugugccuagaucag

SEQ ID NO: 73431 - RNA, 64 nt, Human
ccucccgaguagcugggaccacaggugccuaccaccaugccaggcuaauuuuuguauuuuuagu

SEQ ID NO: 73432 - RNA, 64 nt, Human
uuuucuuuuuaugaaacuuagauuuaccucagauccaugccaccaaacaucucccaccgaguua

SEQ ID NO: 73433 - RNA, 64 nt, Human
ggucacucgcccugcaagagucacuaggcacccaccaugccaauaaggcucuccgcuggcuccc

SEQ ID NO: 73434 - RNA, 64 nt, Human
acagugccugucucgccuccaucagggagagcagccaugccagggaugacuagcucuuugagcc

SEQ ID NO: 73435 - RNA, 64 nt, Human
aagagcccuugguuacccuaagugggcauaucccccaugccacucagcccugcccuauccccuc

SEQ ID NO: 73436 - RNA, 64 nt, Human
aaucaauguuggauuuggcuuuccugucccuuccccaugccagccccccagaguguucugccuu

SEQ ID NO: 73437 - RNA, 64 nt, Human
uuguaucccuaagcauauuauuuuauagugucugccaugccauguggaaauacuuuauuuuuaa

SEQ ID NO: 73438 - RNA, 64 nt, Human
gucauuccaggcccuccagugugugugauagucaccaugccaugcagggauauucuugaagcca

SEQ ID NO: 73439 - RNA, 64 nt, Human
ugugcauacugucugccacugcuuucucccugccccaugccagagagcccugucccugccaggc

SEQ ID NO: 73440 - RNA, 64 nt, Human
agcugccuugagcuaaccccaagcugccucugggccaugccaggccagagggcaguggcccucc

SEQ ID NO: 73441 - RNA, 64 nt, Human
caaaugagggcugcaguugcugagggccgaccacccaugccaagggaauccacccagaaugcac

SEQ ID NO: 73442 - RNA, 64 nt, Human
ccuuauuucuacuaaggacccagagcaggccuguccaugccauuccuucgcacagaugaaacug

SEQ ID NO: 73443 - RNA, 64 nt, Human
uuauauacaacuacaaggaaaaaaaugcauuuaaccaugccaccuaugagugccagugacuuau

SEQ ID NO: 73444 - RNA, 64 nt, Human
ugcagggguuuggagggcacacgaugugugcuccccaugccacuggucggcacuuugccacugu

SEQ ID NO: 73445 - RNA, 64 nt, Human
ugccuggccaugucaccuggcugcuaggccagagccaugccaggcugcgucccuccgagcuugg

SEQ ID NO: 73446 - RNA, 64 nt, Human
ugaggcccagagacaugcagcucucuguccacaaccaugccacuugcaugggagcccugaaggc

SEQ ID NO: 73447 - RNA, 64 nt, Human
cacagauuggcaugaaggauccugaccugacuauccaugccauccauggcccccagacugacuc

SEQ ID NO: 73448 - RNA, 64 nt, Human
uggcuuugucacuuuuccuuuucuuaaaacaaagccaugccaauaaagugaucuguguucaaaa

SEQ ID NO: 73449 - RNA, 64 nt, Human
gucaacucuugauuauccacguguggauuauccaccaugccaggaagacccauaacugguuuua

SEQ ID NO: 73450 - RNA, 64 nt, Human
agcacuacgauguauuccgcuucugaacaggaucccaugccaguguggaacaccuucccaaucu

SEQ ID NO: 73451 - RNA, 64 nt, Human
aaaacauuuaguauacauuugaauguauuuuaaaccaugccaaacuacugcuuuaaugucaagu

SEQ ID NO: 73452 - RNA, 64 nt, Human
gagaacugaaggagaucaaugguuuaacaguuauccaugccaagucccauugucagaaauauuc

SEQ ID NO: 73453 - RNA, 64 nt, Human
uacgugucucgaggaugaucugcucagagcucuuccaugccauucuccacaccaagaagcuuua

SEQ ID NO: 73454 - RNA, 64 nt, Human
aauacuaaagguuuggugcuuaaauuuauuuuucccaugccagagaaagcaagcuuugguaugg

SEQ ID NO: 73455 - RNA, 64 nt, Human
gccugaagauuuacugaagcuucugaacaugccaccaugccaaagcuauguuucucaaacccag

SEQ ID NO: 73456 - RNA, 64 nt, Human
uuuaagacuguucaaguagcauuccaaucuguagccaugccacagaauaucaacaagaacacag

SEQ ID NO: 73457 - RNA, 64 nt, Human
guucaccuugauucaggaaagcugggugcugucuccaugccaugaaucaugagagcaaaggauc

SEQ ID NO: 73458 - RNA, 64 nt, Human
ccuccugaguagcugggacuacaggcacgcaccaccaugccaggcuaauuuuuuuguauuuuag

SEQ ID NO: 73459 - RNA, 64 nt, Human
gcagcuggaaaucuucucgcuccagcaagcucgaccaugccaagagacuggccgggacaagaua

SEQ ID NO: 73460 - RNA, 64 nt, Human
ccucccaaguagcugggauuacaggugucugccaccaugccaggcuaauuuuuguauuuucagu

SEQ ID NO: 73461 - RNA, 64 nt, Human
uuacauuccauagguauuuuauuuuguggcauuuccaugccaauguuuauuucccccaauuugu

SEQ ID NO: 73462 - RNA, 64 nt, Human
acccgacgucccacagccagauauacacccagcuccaugccagcccuucauguuuaccuuuugc

SEQ ID NO: 73463 - RNA, 64 nt, Human
ucccucuguucauccuaucccuuccaagguugguccaugccaacauaaccucugggcaucagac

SEQ ID NO: 73464 - RNA, 64 nt, Human
uggacaugccagagagaaaagcaguagagguccuccaugccagccccacggugguccaugacug

SEQ ID NO: 73465 - RNA, 64 nt, Human
ccugggcacucccuccucccugcgcccacagcccccaugccaaucuccgucagcucuuucugug

SEQ ID NO: 73466 - RNA, 64 nt, Human
ucucucugggcagagaugccacuugccucccccaccaugccaucucugaagaauauuacagacc

SEQ ID NO: 73467 - RNA, 64 nt, Human
accuuaguacuuuagacuaauuguguuuguccguccaugccaugaaugagugggcuguaguugg

SEQ ID NO: 73468 - RNA, 64 nt, Human
uagccuugcugaagccaucacagaugggagaaggccaugccagccacguccgccgaggggcgcc

SEQ ID NO: 73469 - RNA, 64 nt, Human
aaauauuuaugauguauuuacucugcaccaggucccaugccaagcacuggggacacaguuaugg

SEQ ID NO: 73470 - RNA, 60 nt, Human
uccuggcggcccagaaguagagccauccauccaugccauaccacuugucagggcacaggg

SEQ ID NO: 73471 - RNA, 64 nt, Human
uccacaacccaaguuuagaguuggcccccaccucccaugccauggacugagcagcaggggccca

SEQ ID NO: 73472 - RNA, 51 nt, Human
aaaacauccuaucacagugacccaugccauacaugccagaguuggugcuca

SEQ ID NO: 73473 - RNA, 64 nt, Human
ucugcuguagccagugcagaccucacugucguguccaugccacccccggcauggcuccaggugg

SEQ ID NO: 73474 - RNA, 64 nt, Human
gcuguuuccuguguggauggggucagguugugggccaugccaggccugucagcugcguugacug

SEQ ID NO: 73475 - RNA, 64 nt, Human
ugcaguauugaguuaugacuuguuaaaucuauucccaugccagaaucuuaucaauacauaagaa

SEQ ID NO: 73476 - RNA, 64 nt, Human
uuaaucugaaguuugaaagcucagauuaagcaagccaugccaagaaacuggacgauguguaagc

SEQ ID NO: 73477 - RNA, 64 nt, Human
gaggcaguuuugaggagguccucagcuccacggcccaugccagugcccagagcuuggcaggagg

SEQ ID NO: 73478 - RNA, 64 nt, Human
agaagucuugcaauaggcugcagacauuuuaauaccaugccagagaagaguauucugcugaaac

SEQ ID NO: 73479 - RNA, 64 nt, Human
uacauuuucuguaaauaccaaacgcuacugauucccaugccaaaauacaugaguauuaugggau

SEQ ID NO: 73480 - RNA, 64 nt, Human
cccugucaucuaaccaucagggaauucccugcucccaugccacacauuugucuauuauggcuau

SEQ ID NO: 73481 - RNA, 64 nt, Human
guuaaauuuccacauuuggaaugggaaggcaucuccaugccagcagggugccuuuuauaugagu

SEQ ID NO: 73482 - RNA, 57 nt, Human
uauauacuaauucccacuagaagcuguccaugccauacagaagaucuauuaaaaaug

SEQ ID NO: 73483 - RNA, 64 nt, Human
aaaaaaaaguugaacuuaaaaauaacagauuggcccaugccaaucaaaguauaauagaaagcau

SEQ ID NO: 73484 - RNA, 64 nt, Human
uucucuagacucuaguggaagaccuuuggaaaggccaugccaaccgugcuuguacugcuagaag

SEQ ID NO: 73485 - RNA, 64 nt, Human
caaagaaucguauauuuaggagggaggccauacgccaugccauagcuugugcuaucuguaaaua

SEQ ID NO: 73486 - RNA, 64 nt, Human
cucuuuuuuuaguuaaguagaaauguucuggucaccaugccaguaguccuagguuauuguguag

SEQ ID NO: 73487 - RNA, 64 nt, Human
uuggggagcuccuccaaaacauuuguucucuuuaccaugccagauggacaccagcuucuuugug

SEQ ID NO: 73488 - RNA, 64 nt, Human
agagucccuucgccacacuuagggucccaguaagccaugccagcauuaccuuuugcguaguuaa

SEQ ID NO: 73489 - RNA, 64 nt, Human
cguccucgccacugcaccucggcauaugccaccuccaugccacugccagagcuggccuagcaag

SEQ ID NO: 73490 - RNA, 64 nt, Human
agaagugaaaagcuucgguggaucucagccuuggccaugccaagagaggaguuggaccuucugg

SEQ ID NO: 73491 - RNA, 64 nt, Human
gggacggauuccacagacgggagccucauucguaccaugccaaacgcauucacucggggcagua

SEQ ID NO: 73492 - RNA, 64 nt, Human
gggguggugggaagaauuggccacguuggagaccccaugccaccccaccauggugagugcucug

SEQ ID NO: 73493 - RNA, 64 nt, Human
aggcaagcacaucuagaagaguugguacagaaggccaugccacauguccagaauauucaagaau

SEQ ID NO: 73494 - RNA, 64 nt, Human
ccagcccuguucacacaaauuuuaugcuagggccccaugccagucaguguccccaucauggugg

SEQ ID NO: 73495 - RNA, 64 nt, Human
ucuuuacugugagcucuaacagaccgauuugcacccaugccauagaaacugaggccauuauuuc

SEQ ID NO: 73496 - RNA, 64 nt, Human
cauauguggcaacccucccacgaaggaccugccaccaugccauauagggacacaccucagaaac

SEQ ID NO: 73497 - RNA, 64 nt, Human
cugcucccaagcucagauggaagucccuuaacccccaugccacauugccccccuccuccuuucc

SEQ ID NO: 73498 - RNA, 64 nt, Human
cagagccaggaugagaacaaagauuccauuugcaccaugccacacugcuguguucacaugugcc

SEQ ID NO: 73499 - RNA, 64 nt, Human
uaucugucucucuccugcaagaaucuaccugagaccaugccacuagcuuuuaagggcuaccaag

SEQ ID NO: 73500 - RNA, 64 nt, Human
aguaggcugagggcugcaccucccacgguggucaccaugccaaugaaggaaguucagucuuguc

SEQ ID NO: 73501 - RNA, 64 nt, Human
gguuuuaaacaaauucugaugcccagguugcaccccaugccaaugaaaucauuucugggcguca

SEQ ID NO: 73502 - RNA, 64 nt, Human
gggaaaauuaagugacuguguuacacugcuucucccaugccagagaauaaacucuuucaagcau

SEQ ID NO: 73503 - RNA, 64 nt, Human
cuucugcugcacuacacaggccaggaguggcauuccaugccacuaguuggcauccuuuugaacu

SEQ ID NO: 73504 - RNA, 64 nt, Human
cuuccaaaagcuucucuuugauagaauuuugaggccaugccaccucccuuccaguccacaugga

SEQ ID NO: 73505 - RNA, 64 nt, Human
ggagcuccuaguuuguggggggaagcuuugauauccaugccacguccauccaccccaccccuuu

SEQ ID NO: 73506 - RNA, 64 nt, Human
ccuuguaaaauaauaauaauaauguugugaaucuccaugccaagugaaaaaggccuaaagauga

SEQ ID NO: 73507 - RNA, 64 nt, Human
acucuuacagagccuugagagacccagcugcagaccaugccagacccacugaaaugaccaagac

SEQ ID NO: 73508 - RNA, 64 nt, Human
acucacaccagcagcggacugcaggccuuagaggccaugccauuugggugaggauuugauucca

SEQ ID NO: 73509 - RNA, 64 nt, Human
ugcccuguccaaaagcgcccucacuauucuuggaccaugccagauucugccucucuggaaagag

SEQ ID NO: 73510 - RNA, 64 nt, Human
uggggagaaggagggaggucucgggaguguagcaccaugccaaccagcccugcgcgaagacaga

SEQ ID NO: 73511 - RNA, 64 nt, Human
cuccaggaaugccuccucccugggcagaaaguggccaugccacccuguuuucagcuaaagccca

SEQ ID NO: 73512 - RNA, 64 nt, Human
gcacaauauguggcaucauacucagaaaggaagaccaugccauggggccagaaauucagaaacg

SEQ ID NO: 73513 - RNA, 64 nt, Human
aauuaucuaguuaaauuuuuuuuauuucacguuaccaugccauuucacauuaccauaccaucag

SEQ ID NO: 73514 - RNA, 64 nt, Human
accucuccacuccucaucccaccucuacccaucuccaugccacaccuuauccaguuagacacau

SEQ ID NO: 73515 - RNA, 64 nt, Human
agggccugaggcccuccucuucucgcccuucccaccaugccagaaugggaaguugugacguugc

SEQ ID NO: 73516 - RNA, 64 nt, Human
gagguuucuuaaucaauuccuucuaucucucaaaccaugccaguaacuuccuuggugaaaaaau

SEQ ID NO: 73517 - RNA, 64 nt, Human
cuuuuuaguuagauuguaggcuuccuggggccucccaugccaggacugcaaagugauccagccc

SEQ ID NO: 73518 - RNA, 64 nt, Human
gagagcaggggaaacaaggggcuucgagcacgcuccaugccaggaggcaucuguugauuucuga

SEQ ID NO: 73519 - RNA, 64 nt, Human
acaugguuuucccaacauguggaacaauaaauauccaugccaauggacaggacuguaccuuagc

SEQ ID NO: 73520 - RNA, 64 nt, Human
uuugcaagugcuucugacaucaccagagccagccccaugccaggaacuaaggaugucauguaga

SEQ ID NO: 73521 - RNA, 64 nt, Human
aaucaaaagguaaugcacauccucauucacuaagccaugccaugcccaggagacugguuucccg

SEQ ID NO: 73522 - RNA, 64 nt, Human
guugauauacuaaugagaaaauauacuagccuggccaugccaauaaguuuccugcugugucugu

SEQ ID NO: 73523 - RNA, 64 nt, Human
guuacucccuuucucuuccuaccuguggcucaugccaugccaugaagugccuaggguacauaug

SEQ ID NO: 73524 - RNA, 64 nt, Human
agaugauuccuagauuuagcacaauggagagauuccaugccaucuuuacuauguggaugguggu

SEQ ID NO: 73525 - RNA, 64 nt, Human
cucagcaaaaacgaggccucugcaagccacuuuuccaugccaagcauccacccggcccacaggc

SEQ ID NO: 73526 - RNA, 64 nt, Human
acgaguugauuuccucccucugccccucccccagccaugccagcuggccuuuguaagugcagga

SEQ ID NO: 73527 - RNA, 64 nt, Human
gugucuggucuucccuuucuggcuucuaggacauccaugccaggugaggugccugggucccugu

SEQ ID NO: 73528 - RNA, 64 nt, Human
uugucugucacacuuaacucuugcaucuccuuguccaugccauagcugguuucuacuuauguau

SEQ ID NO: 73529 - RNA, 64 nt, Human
uuagaaugcucaguguagaggacauuccugucauccaugccaacuaccuaacucguuaucagag

SEQ ID NO: 73530 - RNA, 64 nt, Human
ccaggggcagcucccgagggcacugugaaggcucccaugccacacagugagaacuguagccucu

SEQ ID NO: 73531 - RNA, 64 nt, Human
guuacucccuuucucuuacuaccuguggcucaucccaugccaugaacugccugggguacauaug

SEQ ID NO: 73532 - RNA, 64 nt, Human
guagccauauaauugggaaaaaauucaguguccuccaugccaagcagaaaacucauagucaaua

SEQ ID NO: 73533 - RNA, 64 nt, Human
gcugaggugagaggaucacuugagcccuggaauuccaugccagccuaugcaacaucaugaaacc

SEQ ID NO: 73534 - RNA, 64 nt, Human
cacuucagaccucggugggcauucacaccaccccccaugccaccggcuccacuuuccccuuuua

SEQ ID NO: 73535 - RNA, 64 nt, Human
ggguucuuguuauagaaugcuugguauagaaaaaccaugccaucauuaauggcuaacaacacgu

SEQ ID NO: 73536 - RNA, 64 nt, Human
ccuuuuuacaggacucccggaaggccacucauggccaugccaggagcuuucucagaaacaguca

SEQ ID NO: 73537 - RNA, 64 nt, Human
acucuuucucuugcuggagguggaggaagggcguccaugccaaggccccauaccugggccgggg

SEQ ID NO: 73538 - RNA, 64 nt, Human
gaucaugcaccauauccacaggagguuggaaaaaccaugccauuuucuggaauuuaaggguguu

SEQ ID NO: 73539 - RNA, 64 nt, Human
gugggugggugugaagggaugagaauaauucuuuccaugccacgagaucaacacacacucccac

SEQ ID NO: 73540 - RNA, 64 nt, Human
gguguucaacagcuagcagcuuaugugauucaccccaugccacguuagugucacaaauuuuaug

SEQ ID NO: 73541 - RNA, 51 nt, Human
ccaccaucaaacucuccuaggccaugccaagacccaggacauaggacggac

SEQ ID NO: 73542 - RNA, 64 nt, Human
gcccagagguccugcgaggggcagaacuggacccccaugccagugcugcugcaggagggcccau

SEQ ID NO: 73543 - RNA, 64 nt, Human
uaguggcacugacauuaaguaguggggggacaguccaugccaggacacccuggaguagccuucc

SEQ ID NO: 73544 - RNA, 64 nt, Human
gugguuaugcgauagggucucccuucccuccagcccaugccagaggagcuuguaacucuuuauc

SEQ ID NO: 73545 - RNA, 64 nt, Human
acugugucaccaaggggcucacaucuuaugucugccaugccaggggugucgccauccagaugug

SEQ ID NO: 73546 - RNA, 64 nt, Human
uuccaucccuagccauucuggaucuugugacccuccaugccaaccagcuucccuacuccuaccc

SEQ ID NO: 73547 - RNA, 64 nt, Human
uggauucucuccaggccaugggauuugggaaccaccaugccaaucuacaggcacucauugcuac

SEQ ID NO: 73548 - RNA, 64 nt, Human
cuuuauuuuccuagaguuguggaaugacaacagcccaugccauugaugcugaucagagaaaaac

SEQ ID NO: 73549 - RNA, 64 nt, Human
ugaaauagugccagcuggagguucuuugccagcaccaugccaagugaaauaauauauuuacucu

SEQ ID NO: 73550 - RNA, 64 nt, Human
cuccccugggguuuggcauauuugacauggagccccaugccaagggaugcagcuguuggugucu

SEQ ID NO: 73551 - RNA, 64 nt, Human
uaguguuuugucaucugguagcagguuuccauuaccaugccaucagagcagaccucagccaggg

SEQ ID NO: 73552 - RNA, 64 nt, Human
guaucccgaccuggaagcuuugaugggucaugggccaugccauacccccuguggcaauggagug

SEQ ID NO: 73553 - RNA, 64 nt, Human
uaccuauguggacuauaauaaccugucuccaaaaccaugccauaauaauauaagugcuuuagaa

SEQ ID NO: 73554 - RNA, 54 nt, Human
ugagguccuaucaguacugagaggccaugccaugguccugggauugacugagau

SEQ ID NO: 73555 - RNA, 64 nt, Human
gagggcccgcgccgcggccggccgccaggccuccccaugccaccacaaaggcccuuuuaagggc

SEQ ID NO: 73556 - RNA, 64 nt, Human
aaagaggcugggccgcuguguagccaggacaugcccaugccaccgccuauugaacaguucauag

SEQ ID NO: 73557 - RNA, 64 nt, Human
uuggccuccucccacagccucccucggaggcaugccaugccaagcacucuuucugucucuguuc

SEQ ID NO: 73558 - RNA, 64 nt, Human
uacucacacccugagaauucugggagccagucugccaugccaggagucacuggacauguucauc

SEQ ID NO: 73559 - RNA, 64 nt, Human
uuccuccagcugcaccagagcaaccucucacuccccaugccacguuccacaguugccaccaccu

SEQ ID NO: 73560 - RNA, 64 nt, Human
aagugaacaguucugugacaggaaacaucucuguccaugccagcauaguaguuguauggacuuc

SEQ ID NO: 73561 - RNA, 64 nt, Human
ccccucaaguagcugggacuacaggugcaugccaccaugccaggcuaauuuuugguguuuuuug

SEQ ID NO: 73562 - RNA, 64 nt, Human
cagggacccaagcgcuugcuuaagccccagugcuccaugccagcacuugaacugucugggguuu

SEQ ID NO: 73563 - RNA, 64 nt, Human
ggggugggugugagcagguggaaggagccucagcccaugccauuaccuccugcuuccuuaucag

SEQ ID NO: 73564 - RNA, 64 nt, Human
auaggccaccaugccuggucagcaccaauucaagccaugccaggaaucugccuaccugccaggu

SEQ ID NO: 73565 - RNA, 54 nt, Human
ugggcccaaccucuccuuaaauaaccaugccaagaagggacauugucaccaaga

SEQ ID NO: 73566 - RNA, 64 nt, Human
ucugagcauaugccuggcuguccucagaucaucaccaugccacaucccugcucccuacuuccug

SEQ ID NO: 73567 - RNA, 64 nt, Human
cagaauuacacgcacgaccauccaaacauuggcuccaugccagggcugugacugcagccugugu

SEQ ID NO: 73568 - RNA, 64 nt, Human
acucacuucuuuucuuacacucuuggacaauggaccaugccacaaaaacuuaccguuuucuaug

SEQ ID NO: 73569 - RNA, 64 nt, Human
ccagacuucauccagcuugacaagauugagaggcccaugccaacagucuaaucuaagagauuag

SEQ ID NO: 73570 - RNA, 64 nt, Human
guugugaggucuuccaggccaagguggaugggccccaugccaaggaauacaacuuuucccugga

SEQ ID NO: 73571 - RNA, 64 nt, Human
cccauccugggccacuguauccaggacaucacucccaugccagcccucccuggcagcccauguu

SEQ ID NO: 73572 - RNA, 64 nt, Human
ggagcagaggugagcugagugcagugagccaagaccaugccauuacacucaagcuugggcaacg

SEQ ID NO: 73573 - RNA, 64 nt, Human
uuuuuguauagaguuauaugugaucuuucuauaaccaugccauucacuuaaauaauucaugaag

SEQ ID NO: 73574 - RNA, 64 nt, Human
aacaagcagaucuuguaucaaggcagaggugaugccaugccauacuuuuaggaagucugagaug

SEQ ID NO: 73575 - RNA, 64 nt, Human
cugguggaagagcugcagcuuuaucaggcccaauccaugccauaaugaacagggaccaaggaga

SEQ ID NO: 73576 - RNA, 64 nt, Human
acgaguucuuuucuggugggaggacuauauugccccaugccauuaguugucaaaauugauaagu

SEQ ID NO: 73577 - RNA, 64 nt, Human
uagcucccugccccucgcccugcagagaagagaaccaugccaggggagaaggcacccagccauc

SEQ ID NO: 73578 - RNA, 64 nt, Human
guguccccccagagacaaagcugcagagcacauuccaugccagacgcucuggccaggaagcuga

SEQ ID NO: 73579 - RNA, 64 nt, Human
gaagcugaggccgggcuugagaggagagcgcuggccaugccaggagagaacccacgcacaugca

SEQ ID NO: 73580 - RNA, 64 nt, Human
ucaagacaggccccagauccccucccaguggcacccaugccaccugcuuugagggguuggaucu

SEQ ID NO: 73581 - RNA, 64 nt, Human
cucucugccggccccgggcgucugagcagucauuccaugccagcaccucugcagccugcugggc

SEQ ID NO: 73582 - RNA, 64 nt, Human
aaauguaaccuuuugccuuccaaauuaaagaacuccaugccacuccuccauaugccucuggcuc

SEQ ID NO: 73583 - RNA, 64 nt, Human
gccagccccuccuccagcccccucugguggcaugccaugccaagagcaacguguaaaggaacag

SEQ ID NO: 73584 - RNA, 64 nt, Human
aaguagguucccuuuguuggaacaauuacacuggccaugccauaauguugaauaaaacucucuu

SEQ ID NO: 73585 - RNA, 64 nt, Human
agcuuccucuaaagcuuucucguguaugucuucuccaugccacuacucugaggccuccuguguu

SEQ ID NO: 73586 - RNA, 64 nt, Human
augugaacuuccugucucccaccucagcacuaguccaugccaggacaccagcugacaauuucuu

SEQ ID NO: 73587 - RNA, 64 nt, Human
ucuggaugggaggugaggggugugcguauggcugccaugccagugucugugcacaucccugucu

SEQ ID NO: 73588 - RNA, 64 nt, Human
agcccccaucagccuccuugugcaaacugggcccccaugccacagucuggcuuucccuccaucu

SEQ ID NO: 73589 - RNA, 64 nt, Human
aacauuuucauuuguguggaugauuucucgaaagccaugccagaagcagucuuccaggucaucu

SEQ ID NO: 73590 - RNA, 64 nt, Human
cccggucagacugaaguguuccaggacaugcugcccaugccaggagauccaacccaggggacug

SEQ ID NO: 73591 - RNA, 64 nt, Human
aggauuuaauuauccugguuugcaaaagagccucccaugccaguaccgcccagccuuggaggcc

SEQ ID NO: 73592 - RNA, 64 nt, Human
gaggcggagguugcagugagcuuagaucaugccaccaugccacugcacuccagccugggugaca

SEQ ID NO: 73593 - RNA, 64 nt, Human
aagccccccuggagcaucuucccggcuggcaggaccaugccaucucuguggagaaggugcuggg

SEQ ID NO: 73594 - RNA, 64 nt, Human
caucuuuuaagaucgaacuuucucaucuguucuaccaugccacgaagguguauggugucucagu

SEQ ID NO: 73595 - RNA, 64 nt, Human
ccaauuaauagaauuguacaaaucaguggcaauuccaugccaagaggaaguggcuccggauuua

SEQ ID NO: 73596 - RNA, 64 nt, Human
ggauuuaaagggacaccccuacacacacccaggcccaugccaaggccucccucaggcucugugg

SEQ ID NO: 73597 - RNA, 64 nt, Human
ucuggguagcacugguuugcauuaguuuauguuuccaugccagaguuugugugggcgggcgcau

SEQ ID NO: 73598 - RNA, 54 nt, Human
acgccuguccccgggacugagcugccaugccagccugcccacagcagccuccua

SEQ ID NO: 73599 - RNA, 64 nt, Human
auaaggggaggagacgaaaauggaaugauuucuuccaugccaccugugccuuuaggaacugccc

SEQ ID NO: 73600 - RNA, 64 nt, Human
caucugagccugccuggaggagaaggaggaacccccaugccaauguccaggucacaggcauccg

SEQ ID NO: 73601 - RNA, 64 nt, Human
ucuccugaagcccucuuguggcaagaacuguggaccaugccagucccgucugguuuccauccca

SEQ ID NO: 73602 - RNA, 64 nt, Human
ugaccuuggguccugaagugaccucacuggccugccaugccaguaacugugcuguacugagcac

SEQ ID NO: 73603 - RNA, 64 nt, Human
aguggcuucagccucugacagucaggaugaagccccaugccacuccacacugcugggacauggc

SEQ ID NO: 73604 - RNA, 64 nt, Human
cuguaugccguggacaagagaugccugggcgucaccaugccacagcuacccacuuguugccacc

SEQ ID NO: 73605 - RNA, 64 nt, Human
ggacucuucccucucgcuccccucugccggucccccaugccaccacccaccccaaacuuccagg

SEQ ID NO: 73606 - RNA, 64 nt, Human
aagaaagagagaaggaaaagagaccauauuaaguccaugccaguugcuuggcuagaauaugauc

SEQ ID NO: 73607 - RNA, 64 nt, Human
cuuccuaaguaguugggacucaaggcuugagucaccaugccaggcucuguuuuuucagucugug

SEQ ID NO: 73608 - RNA, 64 nt, Human
caagaagggcagagggcagucauggggcccaggaccaugccacuggcccugcucccccagccgc

SEQ ID NO: 73609 - RNA, 64 nt, Human
cugugggucugccaggucccaccuccucugucccccaugccacaaccugggcuccuggcuacag

SEQ ID NO: 73610 - RNA, 64 nt, Human
uuagaauucccuuucucuuuuuuuagugcaucguccaugccaaagugugcggcccuuccugaca

SEQ ID NO: 73611 - RNA, 64 nt, Human
aagccgcccucugcuagggaaaaccccugguucuccaugccacaccucucuccaggugcccucu

SEQ ID NO: 73612 - RNA, 64 nt, Human
gggccccauucaccuggaggcaucucaggccaggccaugccaggcucagccacugcccacagcu

SEQ ID NO: 73613 - RNA, 64 nt, Human
gggagggcccuccgaccacuuccaggggaaccugccaugccaggaaccuguccuaaggaaccuu

SEQ ID NO: 73614 - RNA, 64 nt, Human
caucuuccccgugcauuguagauggaaggagcacccaugccauucacaucuagacuuugaguuc

SEQ ID NO: 73615 - RNA, 64 nt, Human
gagauguggagucuucgguguuuaaagucaacaaccaugccagggauugaggaggacuacuauu

SEQ ID NO: 73616 - RNA, 64 nt, Human
ccuccucaguagcuaggacuaccggcgugcaccaccaugccaggcuaauuuuuauauuuuuaga

SEQ ID NO: 73617 - RNA, 64 nt, Human
guuuaaguggauggccccucuauccauccaggucccaugccaagaaccagugauucuaguggcc

SEQ ID NO: 73618 - RNA, 64 nt, Human
cccgggccgcuggcuggugggcccccaaugacacccaugccagagagguggggauccugccuaa

SEQ ID NO: 73619 - RNA, 64 nt, Human
ucagcgagcauagcgaguggcuguaagaaauuguccaugccaccaauuccacugcuacuugccc

SEQ ID NO: 73620 - RNA, 64 nt, Human
ugccacccugccugggacaucgcuggaaccugcaccaugccaggaucaugggaccaggcgagag

SEQ ID NO: 73621 - RNA, 64 nt, Human
acccagcucgcucacuucgcucgcuccgcgucccccaugccagcccccaacgcagggcgcccgg

SEQ ID NO: 73622 - RNA, 64 nt, Human
gccacagcaauaggaaagccagggccagagcgagccaugccagcccuacugccgaugccaaaua

SEQ ID NO: 73623 - RNA, 64 nt, Human
aacuuugaugaugccuuugcugggcauuauguguccaugccagggaugccacagggggccccag

SEQ ID NO: 73624 - RNA, 64 nt, Human
ccaacuccuuacaagggggccuuguggcucucagccaugccacaucccugucacacacccaggg

SEQ ID NO: 73625 - RNA, 64 nt, Human
aauaaacaucuucuacagaauaucugucauucaaccaugccaaggaguuugugccagccuuuuc

SEQ ID NO: 73626 - RNA, 64 nt, Human
aaacaggccaucugccgccaaauacauccacuccccaugccacugacauccuaugggucagcca

SEQ ID NO: 73627 - RNA, 64 nt, Human
cagauccuccucuuaugcccuugauugugccagcccaugccacccccauccugggcacaguuac

SEQ ID NO: 73628 - RNA, 64 nt, Human
auugugacuaaagagcuucuaugcuuccuuguuuccaugccaacaugcugagcaugcucacaaa

SEQ ID NO: 73629 - RNA, 64 nt, Human
gacaaugacagcugauauuuauuggacauuugcaccaugccaagcauucggcuuggauuauccc

SEQ ID NO: 73630 - RNA, 64 nt, Human
ucaugccccuugguacccuucccugucugcucucccaugccauguacacacccacaacccgucc

SEQ ID NO: 73631 - RNA, 64 nt, Human
auuuuccuacccguggcccaggucugugccuuccccaugccaaggacucuaggucaaaugucaa

SEQ ID NO: 73632 - RNA, 64 nt, Human
gcccccggccucgggagaggugccgcccagcuucccaugccagcccggagcccacagugcugcc

SEQ ID NO: 73633 - RNA, 64 nt, Human
cggagcggcgccccggacugccugacugccagccccaugccaugguaggaggcagagucucuag

SEQ ID NO: 73634 - RNA, 64 nt, Human
ggcuccuggggagguggcccucguggcccacgcuccaugccaguggcucacgcucugcuccugg

SEQ ID NO: 73635 - RNA, 64 nt, Human
ucaggugugcagcccugagcuccaaggcucugcaccaugccacacacuugcuguaaggcuagaa

SEQ ID NO: 73636 - RNA, 64 nt, Human
cgggccgggggcggggccgucauccagaccaaagccaugccauugcgcugccccggccgccagu

SEQ ID NO: 73637 - RNA, 64 nt, Human
cucucacuuucuguuucuugccguccaccccgggccaugccagugugucccucugggucccucc

SEQ ID NO: 73638 - RNA, 64 nt, Human
ucuccugaguagcugggacuacaggcaugcgccaccaugccaggcuaauuuuuuguauuuuuua

SEQ ID NO: 73639 - RNA, 64 nt, Human
cagguggaaaugaguagggacacuauuguucccuccaugccagcuuuuuuuuuugcuggaaaug

SEQ ID NO: 73640 - RNA, 64 nt, Human
uuaaccaagugauuauuagagaaauguaucaacuccaugccaucucccaaaauaauugucuaag

SEQ ID NO: 73641 - RNA, 64 nt, Human
ucgugcauuugugugaacacauugcguucccaguccaugccauaaaugaugcucucaagcaaaa

SEQ ID NO: 73642 - RNA, 64 nt, Human
augaauguagcgccccaggcccugccccagcccgccaugccacaaggugggggaggcccugggc

SEQ ID NO: 73643 - RNA, 64 nt, Human
caugugccugugaaaggcaggcucuggccccuuuccaugccaaagucccccaagaucuggauau

SEQ ID NO: 73644 - RNA, 64 nt, Human
uuauucaauaaacaaucauugacccaugccuacuccaugccaggcccagugcuggacacagaga

SEQ ID NO: 73645 - RNA, 64 nt, Human
cccccaggcgagagcuaguggggugcagagggccccaugccagacagcccuuggggcucguugc

SEQ ID NO: 73646 - RNA, 64 nt, Human
ggcugaccuucuugucugagccaggccaccaaagccaugccacgacaaggacaagaugagcagc

SEQ ID NO: 73647 - RNA, 64 nt, Human
gugcugagcucacauccacaccccuugcagccguccaugccacagccccccaaggggccccauu

SEQ ID NO: 73648 - RNA, 64 nt, Human
ccaggcccagugucccccaggccgucuguccacuccaugccaccuuucucagcaucaggacggg

SEQ ID NO: 73649 - RNA, 64 nt, Human
ucuguaaauacggccccaggguggugagagagucccaugccacccguccccuugugaccucccc

SEQ ID NO: 73650 - RNA, 64 nt, Human
auaaucuccccaguuucauuccuugguccuuacuccaugccaggacuugugcacaucuuuuugg

SEQ ID NO: 73651 - RNA, 64 nt, Human
ucccccugccccccaccuccccaggcucaccuugccaugccaggugguuuggggaccaagaugu

SEQ ID NO: 73652 - RNA, 64 nt, Human
aguguagucggcucaacacccuccaccuuccccuccaugccaauaaaauaaccaauccagaugc

SEQ ID NO: 73653 - RNA, 64 nt, Human
cccccggagcuccugucccauccacaccagcuccccaugccagcugugguaagaccuagagcac

SEQ ID NO: 73654 - RNA, 64 nt, Human
aggggaacacagauuucuuuggggguccuagaccccaugccagccauuguaagaguuccacaga

SEQ ID NO: 73655 - RNA, 64 nt, Human
ccucccaaguagcugggacuacaauugugagccaccaugccaggcucauuguuauauuuuuagu

SEQ ID NO: 73656 - RNA, 64 nt, Human
gccuggcuggggcugcccccgcaggacacuguggccaugccacggagggggcaguggacaaaac

SEQ ID NO: 73657 - RNA, 64 nt, Human
ugugucuuuagggagacccaauaaagaaugcaauccaugccauaagcaggaguugauacaccac

SEQ ID NO: 73658 - RNA, 64 nt, Human
cuaaguuaccucaucaguaagugccaugucucuaccaugccaucagaggcuaauuuccuguaaa

SEQ ID NO: 73659 - RNA, 64 nt, Human
cagugcaugaaaaaguauuccgcugggaauugagccaugccaccaaagccaagaggagcgcaug

SEQ ID NO: 73660 - RNA, 64 nt, Human
gauuaauuugacugcuucucguugcucgucaccuccaugccaggcacugugcuugcuaauugcu

SEQ ID NO: 73661 - RNA, 64 nt, Human
agggaauaggccaggcuccauccggaggcagggaccaugccaggaggagccccuguggucacgg

SEQ ID NO: 73662 - RNA, 64 nt, Human
ucgggacagcaccaucccagccccgaagccagggccaugccagcaggccccaccauggaaauca

SEQ ID NO: 73663 - RNA, 64 nt, Human
cuccccgcagccuuguugagagccacacuucugcccaugccaggagccagcugugugaccaucc

SEQ ID NO: 73664 - RNA, 64 nt, Human
cauggagccggggagagcggggaagucucugcauccaugccacccaccccagucgggucucacu

SEQ ID NO: 73665 - RNA, 64 nt, Human
ggggaccucuuugaggguaauaacagaauuggaaccaugccacucuugagccacaauaccuguc

SEQ ID NO: 73666 - RNA, 64 nt, Human
ggggugcugcauaucggucaccaggcacccagggccaugccagggaaaggaagagcuccccuga

SEQ ID NO: 73667 - RNA, 64 nt, Human
caguaaaaagcagccucccuucuaggucagggaaccaugccauugagacuaguaacgggcguuc

SEQ ID NO: 73668 - RNA, 64 nt, Human
cggccccagcggggaggaggagcaaggacauguaccaugccagcaagagugccaagcgggcccu

SEQ ID NO: 73669 - RNA, 64 nt, Human
uugggauugaucaaggcaagagaaguggcuuuaaccaugccagccagaaugaagcaucaugggu

SEQ ID NO: 73670 - RNA, 64 nt, Human
caggagggagggggcuauagcuacaggaagcaccccaugccaaagcuaggguggcccuugcagu

SEQ ID NO: 73671 - RNA, 64 nt, Human
ccacccccuuuuuuguauagcccaagaaccacuuccaugccauacuguaacauuccaacaucuu

SEQ ID NO: 73672 - RNA, 64 nt, Human
cucacucagacacauugggacaaacccuggacagccaugccagagagaggccuuugaccggccc

SEQ ID NO: 73673 - RNA, 64 nt, Human
auucagugugacuuuaauauuauaaaaugauuucccaugccauaauuuuucugucuauuaaaug

SEQ ID NO: 73674 - RNA, 64 nt, Human
uacagaccgacggcacaacagacagcugcccaucccaugccaugcucuacccucugccucucac

SEQ ID NO: 73675 - RNA, 64 nt, Human
agaguaguggccaucagcacccgccuaacgggcaccaugccaagcacuuucaucauuauuuaua

SEQ ID NO: 73676 - RNA, 64 nt, Human
gaucugagaguguguacaaguuuuaguauacaugccaugccagaagauaguguaugcaagaagu

SEQ ID NO: 73677 - RNA, 64 nt, Human
cacgcugcucauccgucuccauguguguuuagauccaugccauucacugacucacuaacaccug

SEQ ID NO: 73678 - RNA, 64 nt, Human
gccagccaugcccacgccccuccccagcccccacccaugccagcgcagcgccagggcucagaug

SEQ ID NO: 73679 - RNA, 64 nt, Human
cgggcuguccaucgugacauuccgccuccuuccaccaugccagccucucccacacggggcccug

SEQ ID NO: 73680 - RNA, 64 nt, Human
gaggagcacccaggcuggguagggacugcaugccccaugccacaguugaaggagggagagaaca

SEQ ID NO: 73681 - RNA, 51 nt, Human
aaagaucugggcgauucugagccaugccauuuuuaccuuaugucugcuaga

SEQ ID NO: 73682 - RNA, 64 nt, Human
guggcgcucaccuaggcugucacaggacccaccuccaugccaggcaacagagggccacagaacc

SEQ ID NO: 73683 - RNA, 64 nt, Human
gacaucauucauuuccaccugggaauuucuggugccaugccagaaagaaugaggaaccuguauu

SEQ ID NO: 73684 - RNA, 64 nt, Human
cucuggaccuaauagcuguuccuuaggccccacuccaugccacccccaccagcuggaggaccca

SEQ ID NO: 73685 - RNA, 64 nt, Human
gagaagcucugggacuggggcagcagcaaggcgcccaugccacacaccgucucucgaggaaacg

SEQ ID NO: 73686 - RNA, 64 nt, Human
ugcccgcgugggaccccaauagaacucagcccuuccaugccagcccuuccugcugccucccucc

SEQ ID NO: 73687 - RNA, 64 nt, Human
uuucucucucacagauagugagggucugacaugcccaugccaccuaugccacagugccuaaggg

SEQ ID NO: 73688 - RNA, 64 nt, Human
agugauggccacugguauagucaucgcucucccuccaugccaaggacaggacuuggaccgcuuc

SEQ ID NO: 73689 - RNA, 64 nt, Human
gcccugccccgccccgccccgcccgcgugccugcccaugccagcacuuccuuaaguucucacau

SEQ ID NO: 73690 - RNA, 64 nt, Human
gucucuugccucuauagaccacagaugacucaagccaugccagaaccaagcagcccaugccugg

SEQ ID NO: 73691 - RNA, 64 nt, Human
gguuugaaugguuuaauuuugcaauggaucauguccaugccagguguuacaauucuuaacuucc

SEQ ID NO: 73692 - RNA, 64 nt, Human
aacagcaugcagguugaauugccaaggaugcucgccaugccagccuuucuguuuuccucaccuu

SEQ ID NO: 73693 - RNA, 64 nt, Human
ugugaacccaucauuccuaaacccuggguaggcuccaugccaaguaacagcagagggaguuaag

SEQ ID NO: 73694 - RNA, 64 nt, Human
gucaccgggacuccaggcacccgcuccccugcgaccaugccaggcacgcugggaggaggacggc

SEQ ID NO: 73695 - RNA, 50 nt, Human
uuggcuuagaggaggaauaaccaugccaguuuuggucaauucucuaugau

SEQ ID NO: 73696 - RNA, 64 nt, Human
cugugcccacucccuucucuacucuuccccagcaccaugccaaaaggucuuaucugaaagguaa

SEQ ID NO: 73697 - RNA, 64 nt, Human
uucccaaguagcugggauuuacaggugugcaccgccaugccaggcuaauuuuuguguuuuuagu

SEQ ID NO: 73698 - RNA, 64 nt, Human
ggacgcuuuucuuccuucugcccaaguaaagugaccaugccaguggccagcacugggggcacac

SEQ ID NO: 73699 - RNA, 64 nt, Human
ugugggcauaggcaggcagaguggaacccugccuccaugccagcaucugggggcaaggaaggcu

SEQ ID NO: 73700 - RNA, 64 nt, Human
ggccugccagucaucgaguggcccaacaggggcuccaugccagccgaccuugaccucacucaga

SEQ ID NO: 73701 - RNA, 64 nt, Human
guucaggucagacaucuaagauccccaggccaaaccaugccacacacgugucuguuccgagguc

SEQ ID NO: 73702 - RNA, 64 nt, Human
auguuucuguuacaauacugcuuuaagaucuaaaccaugccaacagauguuucgugugacuagg

SEQ ID NO: 73703 - RNA, 64 nt, Human
ggccucgccuggcugcagccugcgccaccgcccagagacccaagcugccuccccucuccuuccu

SEQ ID NO: 73704 - RNA, 64 nt, Human
gcaccauuagccuuaccugcccugcccugauugugagacccaaauguguaggcucuaaauucca

SEQ ID NO: 73705 - RNA, 64 nt, Human
uugagccuacaauacugagcgcaacaaggcuguggagacccauggugaggagcauggaguuaac

SEQ ID NO: 73706 - RNA, 64 nt, Human
gaccaaugcaaacucaaauggugcuucaaagggagagacccacugacucuccuuccuuuacucu

SEQ ID NO: 73707 - RNA, 64 nt, Human
caacgggagggcuucucaaggcuuagcucucccugagacccagcuggcuuuuacccuugaccug

SEQ ID NO: 73708 - RNA, 64 nt, Human
cuaccugucuuuccugaguguuugaggggagagagagacccacaucuccccaaagagaugagcu

SEQ ID NO: 73709 - RNA, 64 nt, Human
gguuccuaccagcagcacuggugugaaugaaagagagacccagccgcgucucacacagguggaa

SEQ ID NO: 73710 - RNA, 64 nt, Human
cagaaaauguagcccauuaccacauguagccuuggagacccaggcaaggacaaguacacgugua

SEQ ID NO: 73711 - RNA, 64 nt, Human
uccacuaaaaaggggaggaaggcagaccuccugggagacccacgaaggguuuuuagccagggaa

SEQ ID NO: 73712 - RNA, 64 nt, Human
auccuuaacuccaggauuagcucccaagugcgcugagacccagccagcacacuucuggcccuuc

SEQ ID NO: 73713 - RNA, 64 nt, Human
gucugcagcacccuccacuucucuccuaggcaaugagacccaguggcuagaaauucaccauguc

SEQ ID NO: 73714 - RNA, 64 nt, Human
gaggagcaucgcgcaggagugaggcccaggcgccgagacccaaggcgccacugagggcaccgcg

SEQ ID NO: 73715 - RNA, 64 nt, Human
guugguggguaacagcuggaccccuggcuaccccgagacccaggaggcgcucugcccgcaggug

SEQ ID NO: 73716 - RNA, 64 nt, Human
acacuaagagggcagacugugaacuugacugggugagacccaaagcggucccugucccucuagu

SEQ ID NO: 73717 - RNA, 64 nt, Human
ggaguggggaacaagcaguagagugggacugggggagacccaggccccgggcugagcacuguga

SEQ ID NO: 73718 - RNA, 64 nt, Human
acugcugaccagucugugcuuuaugggcagagaugagacccaggcccgugucugccagcugacc

SEQ ID NO: 73719 - RNA, 64 nt, Human
acacuacccuagggcacuuucucuuugagguggagagacccauaaagccuugaccacaucacuc

SEQ ID NO: 73720 - RNA, 64 nt, Human
caaagcaugugaauucuggcauuagcucucauaggagacccaugugcuuccuugcucagugcaa

SEQ ID NO: 73721 - RNA, 64 nt, Human
uuuuuaguuuggggguuuugcuguuuccuuuuaugagacccauuccuauuucuuauagucaaug

SEQ ID NO: 73722 - RNA, 64 nt, Human
cuggaaggaacuguuugcaguuguaugcacaaaggagacccaugcaggcaugcaccccagaugg

SEQ ID NO: 73723 - RNA, 64 nt, Human
aguacuuuuuaaagcuuccagguguucuaauguugagacccacugauguuccacaaucuggaag

SEQ ID NO: 73724 - RNA, 64 nt, Human
augucagcaucaagccccacaguucuuaauacaggagacccaacaaugaguggacaagucaugg

SEQ ID NO: 73725 - RNA, 64 nt, Human
uggucagucauuucagaggcagcagaugcccagggagacccaagaaagagucagguuagggagc

SEQ ID NO: 73726 - RNA, 64 nt, Human
gggcagagccagcucgggugaggggugaguggaggagacccauggcggacaaucacucucucug

SEQ ID NO: 73727 - RNA, 64 nt, Human
cuacuaaugagaggcagggagagcaugggcaauggagacccaccaaugauccccaaccccggug

SEQ ID NO: 73728 - RNA, 64 nt, Human
ggagccuguccuuccaugcccuugucgagggaaagagacccagaaaggacacaacccgucagag

SEQ ID NO: 73729 - RNA, 64 nt, Human
uuacuuuucaauccauucagaaucugccccaguggagacccaggaguuccuuuccugcacucuu

SEQ ID NO: 73730 - RNA, 64 nt, Human
uccaaucugguaauggugucccaaagguaagucugagacccaucagcggcgcgcccugcagagg

SEQ ID NO: 73731 - RNA, 64 nt, Human
augguuuuguaagaaacuuuaaauauacuuuuaggagacccacaaucauuuacaguuuuaucuu

SEQ ID NO: 73732 - RNA, 64 nt, Human
agaacacugucuugaagacaauggcuuacuccaggagacccacagguaugaccuucuaggaagc

SEQ ID NO: 73733 - RNA, 64 nt, Human
agcgcuuauaaaauaaaaauguuuaguucaagaagagacccaagcuggguaugguggugugaga

SEQ ID NO: 73734 - RNA, 64 nt, Human
uguagcucaaagaagggguuaaugaugcuaacuagagacccagaacgucugaaaacguccugau

SEQ ID NO: 73735 - RNA, 64 nt, Human
uguggaccuguaguuuaagaaugacaggugguuagagacccagauauuuaaaaauagguguuca

SEQ ID NO: 73736 - RNA, 64 nt, Human
agaucuaggcuucaucauuuuccagugagaagcagagacccaaagggccuguuacuugugcuug

SEQ ID NO: 73737 - RNA, 64 nt, Human
gugggcaccacgaguccuuugaggcuccuggacagagacccacaucaagaucggaagcccuuug

SEQ ID NO: 73738 - RNA, 64 nt, Human
gcucugggggcagguggagagggcgggcaggggagagacccagcggcacugaucgccuugugac

SEQ ID NO: 73739 - RNA, 64 nt, Human
acugacuugcuccccucuccuuuucuucucuuuagagacccagcccagggcccucccacccuug

SEQ ID NO: 73740 - RNA, 64 nt, Human
aauucaauggggcccaaauuagaaugcuuauaaugagacccaaucuccaggaaaacaacacuca

SEQ ID NO: 73741 - RNA, 64 nt, Human
uagugugugcucuuuucacuguagacacuaucacgagacccagauuaauuucugugguuguuac

SEQ ID NO: 73742 - RNA, 64 nt, Human
ugcaggcugcccucucccauggccacccuagacagagacccacccgugauacucugagggagcc

SEQ ID NO: 73743 - RNA, 64 nt, Human
ucccuuugcaaaccaggcugugaccaacacaugugagacccaguccuguuugguuuucuuccgu

SEQ ID NO: 73744 - RNA, 64 nt, Human
aaagugauacuucacuuuuggaaaacuguuaccugagacccaggggagaauuuacuggccauuu

SEQ ID NO: 73745 - RNA, 64 nt, Human
agacaacccuguccucaggccugaacucaccauagagacccaugucagcaaacggugaccagca

SEQ ID NO: 73746 - RNA, 64 nt, Human
agccucuguggccuuaaauguggcucaguggagggagacccagcauagccaggccaguauggag

SEQ ID NO: 73747 - RNA, 64 nt, Human
cccuguuguuuaggucuaauuuaaguuuuacauagagacccauguaugacugcagcccauuggc

SEQ ID NO: 73748 - RNA, 64 nt, Human
gcccugugggccgcuguuacuuacccucuccugcgagacccaggggcuuuucccuacuguuccc

SEQ ID NO: 73749 - RNA, 64 nt, Human
gggaggugcguuggaaauucuaggcccuucagcagagacccauuugugcccagaccacaauauu

SEQ ID NO: 73750 - RNA, 64 nt, Human
cacucccauacaccaggcgcugguguguuugccagagacccagcagggaccagaacagaugaaa

SEQ ID NO: 73751 - RNA, 64 nt, Human
ccugccccgaagacuccuaauaggucaagagagagagacccagacaagcaaacucaaaauaaag

SEQ ID NO: 73752 - RNA, 64 nt, Human
agaggaacacaggcgcugaguauggagcagccuggagacccaccccaccugcagggcugcccug

SEQ ID NO: 73753 - RNA, 64 nt, Human
gacuuccuagugcccaaaugcccugugaggcugagagacccaggccccuguggcuuucaacaca

SEQ ID NO: 73754 - RNA, 64 nt, Human
gcagggccccucuuuucagcacuuuggacaccuggagacccagcccuguuauuuaaugguagug

SEQ ID NO: 73755 - RNA, 64 nt, Human
cccauuuuucuucuucagaaggccuuuccugugugagacccacauauuuuaaccuuuugcuccu

SEQ ID NO: 73756 - RNA, 64 nt, Human
cccuuugagucugaauccccggccucugucaccugagacccaaccccuagcugggccaacucca

SEQ ID NO: 73757 - RNA, 64 nt, Human
uauccaaguagcuuagcccagcuaaguucuaucagagacccaaauuauauuuuuuaaaaauuua

SEQ ID NO: 73758 - RNA, 64 nt, Human
agcgcuuuugugccaaacccauaggucugaaacugagacccagagaggcugaaugacaugcuca

SEQ ID NO: 73759 - RNA, 64 nt, Human
ggggcucugcacagagcagcagagcuagagccaugagacccacagacuuggugccugagcgcag

SEQ ID NO: 73760 - RNA, 64 nt, Human
acacauuucuguggcuugauuucuugaauaugcugagacccaauuuggacuacauuuggcagaa

SEQ ID NO: 73761 - RNA, 64 nt, Human
agacagagguaaugauggggacgaagugagaacagagacccagaaggagaaucaauggaccaua

SEQ ID NO: 73762 - RNA, 64 nt, Human
cgcagcccucuccacccagaggucucccuauaccgagacccaccauccuuccauccugaggacc

SEQ ID NO: 73763 - RNA, 64 nt, Human
acaucugcucaguccuaucccucgucagcguguggagacccagcuccugcagcccuccugcucc

SEQ ID NO: 73764 - RNA, 64 nt, Human
uaguuuggcauuuugauucagaaaguggggagcagagacccagccaaauccaaacuuuuuuuuu

SEQ ID NO: 73765 - RNA, 53 nt, Human
uauuaggggucaguccuugaauugagacccauguuaucuuugggauguauagc

SEQ ID NO: 73766 - RNA, 64 nt, Human
uaaggcaaaagcuaaaauaguucacuccucaacugagacccaaagaauuauagauauuuuucau

SEQ ID NO: 73767 - RNA, 64 nt, Human
acagccuaaccuggcguguuguuuagggcugauggagacccaugugagccuuugcuuuccucug

SEQ ID NO: 73768 - RNA, 64 nt, Human
ugaauuugacacuuuaaaauaaucagaagucacugagacccaaagcuagugaauaauucaagug

SEQ ID NO: 73769 - RNA, 64 nt, Human
aaaacuguuaucaauucacauucaucaucagcacgagacccauuuccuugugcuccugccagcu

SEQ ID NO: 73770 - RNA, 64 nt, Human
gccgccuccaggagccuacccccugaaagugacagagacccagaucucauggaaacuggccagg

SEQ ID NO: 73771 - RNA, 64 nt, Human
cuugauuucaguguuuggcagguaacaaaaaauugagacccagacacuggucaacaggaaaaca

SEQ ID NO: 73772 - RNA, 64 nt, Human
augcugcuaccucucuccuugaagggagcauggcgagacccauuggauggauuggggugaacag

SEQ ID NO: 73773 - RNA, 64 nt, Human
ccaguauggcuuuccaggcuaaucacuuagggcagagacccagccuuauucaucucuacuuccu

SEQ ID NO: 73774 - RNA, 64 nt, Human
gccugugucccagacagauccccuaggccuaucugagacccauacaggcccacaccugagcucc

SEQ ID NO: 73775 - RNA, 64 nt, Human
gugcccuggcuccuugcagcagggcugggccugcgagacccaaggcucacugcagcgcgcuccu

SEQ ID NO: 73776 - RNA, 64 nt, Human
cugaucaguugguauaaacugaggguggcuuuuagagacccagacuugguuggcagcgcugcca

SEQ ID NO: 73777 - RNA, 64 nt, Human
gcccuaauauuuaaaauuuacacuucuaagacuagagacccacauuuuuuaaaaaucauuuuau

SEQ ID NO: 73778 - RNA, 64 nt, Human
auuuuauagcugcgugcgaaaggcuuccagaugggagacccaucucucuugugcuccagacuuc

SEQ ID NO: 73779 - RNA, 64 nt, Human
caagauugguaaagcugcguccuggcgauuccaggagacccagcuggaaaccuggcuucuccau

SEQ ID NO: 73780 - RNA, 64 nt, Human
gggaaaauugguuuugcuuucuuuguacacaccagagacccaucugaggucaucugauuauaag

SEQ ID NO: 73781 - RNA, 64 nt, Human
uccugaggcccuacaaauaguaacccuaggcucagagacccaauuuuuuaagcccccagacucc

SEQ ID NO: 73782 - RNA, 64 nt, Human
gcccgucaggugauucugauuuacaguacaguuugagacccacuggcuagaacauauccuccag

SEQ ID NO: 73783 - RNA, 64 nt, Human
ccuguuaaagucugagcucuguugcagauaaccagagacccaacaaccaaaggcaaagcguaag

SEQ ID NO: 73784 - RNA, 64 nt, Human
gcucagauaacucugugcauuuaagcuacuuguagagacccaggccuggagaguagacauuuug

SEQ ID NO: 73785 - RNA, 64 nt, Human
cuuauaaaauuuucccccuuguaccucuguaguagagacccaguugcuugcaguuuggcccugc

SEQ ID NO: 73786 - RNA, 64 nt, Human
uuauuauuaaucucauuguacaagugagaaaacugagacccagagagcuuaagugacuuccucg

SEQ ID NO: 73787 - RNA, 64 nt, Human
gagagacuggaaacguuccuggacugcugaagaggagacccaguuggcuucacuuuuugagaag

SEQ ID NO: 73788 - RNA, 64 nt, Human
ugcaaucucacauaucugccugugagacuggauugagacccauucguuucuaugaauguccgug

SEQ ID NO: 73789 - RNA, 64 nt, Human
cuuuugggguacaaaggaaaggacagaggugugggagacccaagguggucuugagauugacaga

SEQ ID NO: 73790 - RNA, 64 nt, Human
ucccuuuccacaucaaggcacaucagacuucucagagacccacuuuauucaguucuguacauau

SEQ ID NO: 73791 - RNA, 64 nt, Human
aaacaacuugaccaaaaauuugucacagaauuuugagacccauuaaaaaaguuaaaugagaaac

SEQ ID NO: 73792 - RNA, 64 nt, Human
cauccccauugcgggcagugcuggacgugucccggagacccaccgggagggcgccgccaugccu

SEQ ID NO: 73793 - RNA, 61 nt, Human
cccgcacugccaucuucuaguggccauggcugagacccaaucccugggcgccccugguauc

SEQ ID NO: 73794 - RNA, 64 nt, Human
gcgucgugucucuuugugcuuuuguuuguggaaggagacccaaaugccuuuacuuuauucucug

SEQ ID NO: 73795 - RNA, 64 nt, Human
gauggugaugaaggagcugauccgguucgacgaggagacccagaggacguuccucaaggagguc

SEQ ID NO: 73796 - RNA, 64 nt, Human
gccacacagagacacauacuugguuucugggacugagacccaggccuggcaggaccgugccuac

SEQ ID NO: 73797 - RNA, 64 nt, Human
uacuuacccuauucuugcuuggaacaugagccuggagacccauggcaguccauaugccucccua

SEQ ID NO: 73798 - RNA, 64 nt, Human
cacaguguugauggggcagugaccagacaguccugagacccagaaggcccagguggcccaagug

SEQ ID NO: 73799 - RNA, 64 nt, Human
acuuaaagaguacauucugccuugcuguagugaagagacccacuccaaauaaaaaaggggccac

SEQ ID NO: 73800 - RNA, 64 nt, Human
gucggggcuuggugggggugacuuuuggcagcccgagacccagaguuuguagaguuuagaucuc

SEQ ID NO: 73801 - RNA, 64 nt, Human
caggguggagaucgcugcaucccugcagcucaacgagacccaagugaagaucugguuccagaac

SEQ ID NO: 73802 - RNA, 64 nt, Human
uuuugauacccacacccagccaucuggagucauggagacccaccacgucucuaugccggaugac

SEQ ID NO: 73803 - RNA, 64 nt, Human
auuaccuagaugccucuuaaaaaugaagauuucagagacccauucuaaacaagggcauucacuc

SEQ ID NO: 73804 - RNA, 64 nt, Human
guccuuuguugcucaugcuguuuaagugcaggcugagacccagccucuuuguaaguacaguaaa

SEQ ID NO: 73805 - RNA, 64 nt, Human
uuguucacugcucagcugaugggagugauucccugagacccaguaugaaagagcaguggcugca

SEQ ID NO: 73806 - RNA, 64 nt, Human
gcgccucaccugcucuucaagaaacagcgagagggagacccagggggcugaaacuugaacucug

SEQ ID NO: 73807 - RNA, 64 nt, Human
cugccugcuccagacauuuuguucuugaaucugugagacccagaaggggcccacugagcccacu

SEQ ID NO: 73808 - RNA, 64 nt, Human
cacaucuucuuggucuugcauaaggcaguuccuggagacccagcacucugguucucucucugcc

SEQ ID NO: 73809 - RNA, 64 nt, Human
cugcccuccgcaggcccagggcugggcacucccugagacccaaagacccaccucaacgacgagu

SEQ ID NO: 73810 - RNA, 64 nt, Human
ccuggaacacuccucuacucuuacagagccuugagagacccagcugcagaccaugccagaccca

SEQ ID NO: 73811 - RNA, 64 nt, Human
cagcauggagcccacuuaccguguggccagccgcgagacccauggccacgcaccuucucucagg

SEQ ID NO: 73812 - RNA, 64 nt, Human
ggggcaauugacuuccuccaauccccacuccuccgagacccaggagacaaacagcccuuccuug

SEQ ID NO: 73813 - RNA, 64 nt, Human
agccacugggguugaggagggggaggagaccccugagacccagaggugccccuuccucagcugg

SEQ ID NO: 73814 - RNA, 64 nt, Human
ugauuaaaguuuucuuuuauuuggguggccgggagagacccagggagguucuggagguuccuuu

SEQ ID NO: 73815 - RNA, 64 nt, Human
ugaugcgggacugcuggcaugcagugcccucacagagacccaccuucaagcagcugguggaaga

SEQ ID NO: 73816 - RNA, 64 nt, Human
aauaacuaagauccgagcagaacugaaggagauagagacccaaaaaacccuucaaaaaaucaau

SEQ ID NO: 73817 - RNA, 64 nt, Human
ugauuugaaacaucuggcugcguugccauuggcugagacccaccagguccaguuuugguuggug

SEQ ID NO: 73818 - RNA, 64 nt, Human
uugccggccccuucaagcaauagggucccgaggggagacccaccccgagcccccuccccucccc

SEQ ID NO: 73819 - RNA, 64 nt, Human
ugcucuguccuccccuauugcgcucucaagaccagagacccaacagcagugaucucagggcaga

SEQ ID NO: 73820 - RNA, 64 nt, Human
aacccagccugaggggaagccacaggaucggcccgagacccaggccaugcccacuggggacaca

SEQ ID NO: 73821 - RNA, 64 nt, Human
cagauucauggaacuuagaguccaauaggaaagugagacccagacaaugacaaugagauaaaug

SEQ ID NO: 73822 - RNA, 64 nt, Human
agcagggauauccaugcuuauguauccaaacacagagacccaugggaacaaaugagacacauau

SEQ ID NO: 73823 - RNA, 64 nt, Human
agaaaguuuucccaauucuacacauggcaaaauggagacccagagucacuugcccaaggucgca

SEQ ID NO: 73824 - RNA, 64 nt, Human
ccccucuuagccccagucuucucuuuucuauaaugagacccaccccagcuugccucccucccug

SEQ ID NO: 73825 - RNA, 64 nt, Human
ccgcccccugaaacaugugccccugccaaggccggagacccacagcccugaaacgagaagugcc

SEQ ID NO: 73826 - RNA, 64 nt, Human
ugggcaggggguguggcaggagcucccagcacuggagacccacggacucaacccaguuaccuca

SEQ ID NO: 73827 - RNA, 64 nt, Human
cagauguuugugauguccugaaacaauuuaaaaggagacccacagagcuaauguuuauccauuu

SEQ ID NO: 73828 - RNA, 64 nt, Human
aaacaguacgugccuuugccucuuuaugcacacagagacccagggugagggaguauuuguuccc

SEQ ID NO: 73829 - RNA, 64 nt, Human
auucugcucuggaagagaaggaacagggagcagagagacccaacugggagccagagauggaacu

SEQ ID NO: 73830 - RNA, 64 nt, Human
ggaccccaggcccacucaggggucacugaggccugagacccaggacuccuccccacccuccugg

SEQ ID NO: 73831 - RNA, 64 nt, Human
agaagaacuaguuucccuguauagccugcugggagagacccacuucuaggguaugggggaugca

SEQ ID NO: 73832 - RNA, 64 nt, Human
aggugaagaagaggcccacuagaggcuucauacugagacccagaugggggaaaacagcuuccuc

SEQ ID NO: 73833 - RNA, 64 nt, Human
aauaauggcuaauguuacaaaaaguuauacuccagagacccaaagcuugacauuuaccuaaugu

SEQ ID NO: 73834 - RNA, 64 nt, Human
ugaggaaagaaauaauacaaauuggcuuucaagugagacccaaaggaagaacuggauaaaaucu

SEQ ID NO: 73835 - RNA, 64 nt, Human
cagguguuugucguguccugaaacaauuuaaauagagacccacagagcuaauguuuauccauuu

SEQ ID NO: 73836 - RNA, 64 nt, Human
gagcugaggcagcagugugaggccagggcagagugagacccagcccucaucccgagcaccucca

SEQ ID NO: 73837 - RNA, 64 nt, Human
uggcggcagucccaggggagagacaccacagaaggagacccagacaucccgaggaaguucccag

SEQ ID NO: 73838 - RNA, 64 nt, Human
gagcuggagaacgaaagaaucuucacuauaaacagagacccauucauuuauuuccauuggcugu

SEQ ID NO: 73839 - RNA, 64 nt, Human
gcuggcuugaagacaaauggucuuagaauucauugagacccauagcuucauauggcugcuccag

SEQ ID NO: 73840 - RNA, 64 nt, Human
agucuuugccuuuguagcauuuacaguacagcuggagacccaugaugauuacauauaaaguuca

SEQ ID NO: 73841 - RNA, 64 nt, Human
aggcaggggguggucugagucuccucacagcagagagacccaccggagcccccucaacuuugca

SEQ ID NO: 73842 - RNA, 64 nt, Human
cuucucccccacacccucaggccgagauccgugagagacccacuuugcuccaacaacuugaaac

SEQ ID NO: 73843 - RNA, 64 nt, Human
acagcgcgguuuuuuccacgcagcacccuucucggagacccauugcgauggccgcuccguguuc

SEQ ID NO: 73844 - RNA, 64 nt, Human
ugccccgggaugcaccgguuauuugggggggcgugagacccagugcacuccggucccaaaugua

SEQ ID NO: 73845 - RNA, 64 nt, Human
aaugacaccugagguccguagaagcuaagcuccugagacccagggggaccugccacugguaccg

SEQ ID NO: 73846 - RNA, 64 nt, Human
ccccuguuccuugguccauaacuggugagcuauggagacccaggccaacaaauuauccccagug

SEQ ID NO: 73847 - RNA, 64 nt, Human
auccggcugccagcccugaggccaagcacggcuggagacccacgaccuggccugccguugcccu

SEQ ID NO: 73848 - RNA, 64 nt, Human
caggccucccccaggagccuccaggauggagauggagacccagcagcccccagacuacuucuau

SEQ ID NO: 73849 - RNA, 64 nt, Human
ccugcaagucggcgcacacaguggaugaaggcaggagacccagaaagcagugcagugcagcucu

SEQ ID NO: 73850 - RNA, 64 nt, Human
ugcaccucagcagccagggaagcagggcccagaggagacccaucaacucaucugguucucacca

SEQ ID NO: 73851 - RNA, 64 nt, Human
gagaagagcuuacuggguaguuagaguucaucaggagacccaacccuuagauuucauaaguacc

SEQ ID NO: 73852 - RNA, 64 nt, Human
uuucgccacugcacaccagccugggugacagugugagacccagccucaaaaaaaaaaaaaaaaa

SEQ ID NO: 73853 - RNA, 64 nt, Human
ggagccacugccaccuucagagggguuccuugcugagacccacauugcuucaccuggccccacc

SEQ ID NO: 73854 - RNA, 64 nt, Human
ggauaguguguuuggaauuugacuuuccauuucugagacccaagggggcguagauguaguggca

SEQ ID NO: 73855 - RNA, 64 nt, Human
cuacuugguugauucauauccucuuuccuuuauggagacccauuuccugaucucugagacuguu

SEQ ID NO: 73856 - RNA, 64 nt, Human
cucuugccgaggagccaggcaacuucaguccugggagacccauguaaauaccagacugcagguu

SEQ ID NO: 73857 - RNA, 64 nt, Human
ggacuucugcggggccugaggcaagccauggagugagacccaggagccggacacuucucaggaa

SEQ ID NO: 73858 - RNA, 64 nt, Human
acuugugguaguggaccauaccuggggaccaaaagagacccacuguaauugaugcauuguggcc

SEQ ID NO: 73859 - RNA, 64 nt, Human
caucuccuucugaguguuugggacucuggaaucugagacccauguucacauuguaagaacaucc

SEQ ID NO: 73860 - RNA, 64 nt, Human
auuccaggauacaaaaaaaaacauuuaaaaauccgagacccagaacacuucuggucccaagcau

SEQ ID NO: 73861 - RNA, 64 nt, Human
uucaaggggaccagcuaacugauccugcccuucagagacccaggaguugggagcuuucgcuccu

SEQ ID NO: 73862 - RNA, 64 nt, Human
cccacagcccucacauccccuggccuggacccaggagacccaggagaaagcacccucccuuagg

SEQ ID NO: 73863 - RNA, 64 nt, Human
gaacuucaucgcccucugaucgccgaucaccucugagacccaccuugcucauaaacaaaaugcc

SEQ ID NO: 73864 - RNA, 64 nt, Human
gagccucuugcuugaaugugauuucuuucucccugagacccauaagguucaucuuaugggaccu

SEQ ID NO: 73865 - RNA, 64 nt, Human
gagcagaggggcggccacggcgggcgguggccuagagacccaggaccugggcgccugggaaaau

SEQ ID NO: 73866 - RNA, 64 nt, Human
ucacuggagcaccaggcacgaacccaccugcugagagacccaaggaggaaaaacagacaaaaac

SEQ ID NO: 73867 - RNA, 64 nt, Human
cguccaccugggaggcauuugggguugcaggaccgagacccacauccucucacucacuucucca

SEQ ID NO: 73868 - RNA, 64 nt, Human
aggagaagccuagcaggauuucagaugcaggagagagacccaggaagcccggcagagcccugag

SEQ ID NO: 73869 - RNA, 64 nt, Human
aggaggccgcuaugcaggguagcacugggaacaggagacccaccugaggcucagcccuagcccu

SEQ ID NO: 73870 - RNA, 64 nt, Human
aaucaagauuaugugacugaaaaacauaaaggaagagacccaucuagauaacagcaaucaaccu

SEQ ID NO: 73871 - RNA, 64 nt, Human
caggagugcggucuacuuggggaacuggaauggagagacccagguacuaaaaucccagcuaacg

SEQ ID NO: 73872 - RNA, 64 nt, Human
uaggaacgcggggcuucuugguggggccggagccgagacccagccggagcgagcaacagguacg

SEQ ID NO: 73873 - RNA, 64 nt, Human
ggcagcacccagcugugggggcaguggggugggggagacccacauugaugacuuuuuuuuuuuc

SEQ ID NO: 73874 - RNA, 64 nt, Human
aaccucacugguuuugcacugauuuuugagagcggagacccauuaccaccuccuauggcuacag

SEQ ID NO: 73875 - RNA, 64 nt, Human
ggagagaaggucuuggaaucaccuucagucuuuggagacccagcugccuuuguggaagggagga

SEQ ID NO: 73876 - RNA, 64 nt, Human
ugaaacaaaauuauccuauuauugaccauugcuagagacccacauccuacaaaauccugacacc

SEQ ID NO: 73877 - RNA, 64 nt, Human
ucaguacucuguauguauccacaaaagggaacuugagacccacaguuauucuuaauuucugaua

SEQ ID NO: 73878 - RNA, 64 nt, Human
ggugguggccaugguaccggggacuugggagagugagacccaguggagggagcaagaggagagg

SEQ ID NO: 73879 - RNA, 64 nt, Human
gccaggaguuugagaccagccugggcaacauagggagacccagucucuacaaaaaaauuuaaaa

SEQ ID NO: 73880 - RNA, 64 nt, Human
cagaagaguccucuggggaggaccccaagggccggagacccaaagaucaugauauuccaaaugg

SEQ ID NO: 73881 - RNA, 64 nt, Human
aagcaauucuguccccaucaaggggucagcuggagagacccaagacccuaucuguucaccaggg

SEQ ID NO: 73882 - RNA, 64 nt, Human
ggguuucucuguggcuccaggccaaagugccggugagacccauggcuguguugguguggcccau

SEQ ID NO: 73883 - RNA, 64 nt, Human
uuacuuaaguccauuaacaauucagguuucuaacgagacccauccuaaaauucuguuucuagau

SEQ ID NO: 73884 - RNA, 64 nt, Human
uccugggcuggcacauugacugggaaaccugagugagacccagcaacugcuucucucccuucuc

SEQ ID NO: 73885 - RNA, 64 nt, Human
uccuguacauguguucauguucccagccagcucugagacccaggaaccaaauauuccauuuugg

SEQ ID NO: 73886 - RNA, 64 nt, Human
gguggauucagagggacccccgggacaagggucugagacccaaaggcacaguuuagaggauugg

SEQ ID NO: 73887 - RNA, 64 nt, Human
cuaccccaucccuggauccacaggggcuaucgaggagacccagugagaauguagcauuuuguuc

SEQ ID NO: 73888 - RNA, 64 nt, Human
aagaguagcagagauggccugccaagaguugcaggagacccaggaaagggaguugcugagggca

SEQ ID NO: 73889 - RNA, 64 nt, Human
cacaugcucaaaaucaaaugauacauauuccugagagacccagcaauaccauaagaauuacuaa

SEQ ID NO: 73890 - RNA, 64 nt, Human
cuuauuaaaauauaaauauuagaaaauuacuuuggagacccaaguaaauauuucucauacauau

SEQ ID NO: 73891 - RNA, 64 nt, Human
ugaugggggccaggacaccaguccagguaguguugagacccaggccuguggccccaccgagcug

SEQ ID NO: 73892 - RNA, 52 nt, Human
guaggaauugcauaaaaugagggagacccaccugcauguuguuuuguaagca

SEQ ID NO: 73893 - RNA, 64 nt, Human
uuuaacaccccuuuucccccugcuggcccagagggagacccaggacugaacucuccaggccucc

SEQ ID NO: 73894 - RNA, 64 nt, Human
ugggcaggggugccugggccccaggguguggcaggagacccaguggauggggccagcuggccug

SEQ ID NO: 73895 - RNA, 64 nt, Human
caggugcacguucaucgggaaccaggacacuuacgagacccaccuggagacuugccgcuucgag

SEQ ID NO: 73896 - RNA, 64 nt, Human
cgguggcuccgagcaugagguccgccuccugggcgagacccagcaguggacagcaugguccuca

SEQ ID NO: 73897 - RNA, 64 nt, Human
gacccuccucuuguacgucucaucacagcugguagagacccaggagugccugauugucccacag

SEQ ID NO: 73898 - RNA, 54 nt, Human
caucggaaaugccuaccugagagagagacccaaacuuuacucugggagguaggc

SEQ ID NO: 73899 - RNA, 64 nt, Human
ugcggcugcagcucacccagccccaggggcagaagagacccaaccacuucuauuuuuugaggcu

SEQ ID NO: 73900 - RNA, 64 nt, Human
ggcauccgucgggcuauugucacagagaaaagaagagacccacccacucgggcugcaaaaggug

SEQ ID NO: 73901 - RNA, 64 nt, Human
aaccuaggaacacaaaguauauuggccucaaacggagacccaggguugccaguuuuccgugggc

SEQ ID NO: 73902 - RNA, 64 nt, Human
augucugggaguuuuucuguguggggaggagacagagacccauaacuaaauaugcucuguguaa

SEQ ID NO: 73903 - RNA, 64 nt, Human
cugggaagggccguucugggcucaccuggccugggagacccaucuggucccugcguccucugcc

SEQ ID NO: 73904 - RNA, 64 nt, Human
ugcuuaaaggcaccauggggaccuggguugcccugagacccaagccauuguuagcagcuagcca

SEQ ID NO: 73905 - RNA, 64 nt, Human
gagccccugcccugcccuagcugaggcacacagggagacccagugaggauaagcacagauugaa

SEQ ID NO: 73906 - RNA, 64 nt, Human
uugcgccacugcauuccagcuugggcgacagagcgagacccagucucaaaaaaaaaaaaaagua

SEQ ID NO: 73907 - RNA, 64 nt, Human
accagaaccaguuaagagacaacuaucaauucuugagacccaaauuauaagggcccugcccugu

SEQ ID NO: 73908 - RNA, 64 nt, Human
cucucuuaagagcuaugugccuuccaaccagagggagacccaguagaaagaaaaacauccuggg

SEQ ID NO: 73909 - RNA, 64 nt, Human
ggguuuggcucugcuguauccaucuauagugguagagacccaccagggcucaaguggaguccau

SEQ ID NO: 73910 - RNA, 63 nt, Human
cuccagaccccuuuccuugaagacuggaggguugagacccaggcccccugccaguugaaguga

SEQ ID NO: 73911 - RNA, 64 nt, Human
gaaauacacuggauguucucucuuugcuucaauggagacccaaggagcugggaggucucuuaag

SEQ ID NO: 73912 - RNA, 64 nt, Human
auucuacuccccagauccucuccccuggacacaggagacccacagggcaggacccuaagaucug

SEQ ID NO: 73913 - RNA, 64 nt, Human
ccccuggaugggaaaggcagggucagggcccacugagacccaugcagaguuuccaggugugcac

SEQ ID NO: 73914 - RNA, 64 nt, Human
acagaagguuccuugagcacccggaaacggucacgagacccagaggaagaauuauaacccagaa

SEQ ID NO: 73915 - RNA, 64 nt, Human
ugguggggugccacccucccacaagggcugggcugagacccagcugagugcagcguggcguuuc

SEQ ID NO: 73916 - RNA, 64 nt, Human
aaaaguugcaaaacuguucugaagcuuaauauuagagacccaaguaagauuguuuuuagucuug

SEQ ID NO: 73917 - RNA, 64 nt, Human
gucagcagcuguuagucuccuuccuuuggcucuugagacccacacauaucacuuuagcccuaac

SEQ ID NO: 73918 - RNA, 64 nt, Human
cagcuggaaggccgaugacuggguggucgggagggagacccagcucuccuuucugucccguuug

SEQ ID NO: 73919 - RNA, 64 nt, Human
acugggagaggcuaucagccaguccugggacuuggagacccagcauccuuugcauuacuuuuuc

SEQ ID NO: 73920 - RNA, 64 nt, Human
gcggcuuggagguuaaagcagcagugccaauaaugagacccagcugggaaggacucggugauac

SEQ ID NO: 73921 - RNA, 64 nt, Human
cucucuuaagagcuaugugccuuccacccagagggagacccaguagaaagaaaaacauccuggg

SEQ ID NO: 73922 - RNA, 64 nt, Human
ucuugcagucagcgagaugauccgccacccguaugagacccagucugacagcuucuacuucgug

SEQ ID NO: 73923 - RNA, 64 nt, Human
ccucgcgggagaccagaacucuuggagcuuaggggagacccacgucgcuccagcggaggcugga

SEQ ID NO: 73924 - RNA, 64 nt, Human
gggucguugguuuaggcauccugugugcugacaggagacccagagagcuagggcuggagggaca

SEQ ID NO: 73925 - RNA, 64 nt, Human
gcucagcagggggaacuuguccccauggucagaggagacccagcuguccugcacccccuugcag

SEQ ID NO: 73926 - RNA, 64 nt, Human
cccuaagcccccagggccuccagggcccagguucgagacccaaacccccaaaauccaaaacuuc

SEQ ID NO: 73927 - RNA, 64 nt, Human
cuuuuaucuaaaugcaaauaaggauguguucucugagacccaugaucaggggauguggcggggg

SEQ ID NO: 73928 - RNA, 64 nt, Human
uugggggaugggauccuagguagggccaggggaggagacccauaaauguucccuuggggguguu

SEQ ID NO: 73929 - RNA, 64 nt, Human
cccaccaacgccuuggacuccucucuuugcugaagagacccaagucucuugacaccucagagug

SEQ ID NO: 73930 - RNA, 64 nt, Human
aagagcugugugccuuccacccagagccuugugggagacccaguagaaagaaacagcauccugg

SEQ ID NO: 73931 - RNA, 64 nt, Human
cccccugccccacaaagaaaugaacaguuguagggagacccagcagcaccuuuccuccacacac

SEQ ID NO: 73932 - RNA, 64 nt, Human
cucugcagagcgcucucugugugccagagagccagagacccaagacagggcccgggcucuggac

SEQ ID NO: 73933 - RNA, 64 nt, Human
gaguguacuccagggugaaggcagagugggauuugagacccagguuaggcacgacccaggcuga

SEQ ID NO: 73934 - RNA, 64 nt, Human
gcgggcuccccucucgccaacccgccaaccgcgagagacccaggcuggcccccagggugaggac

SEQ ID NO: 73935 - RNA, 64 nt, Human
auugagauuuugaugaauuuauauugguuuuaaugagacccaaaugacucucucuuaacaauuc

SEQ ID NO: 73936 - RNA, 64 nt, Human
uaccgcugacuuuugucccuuguucccgguguaggagacccaaggcaucuugaaucccaucuau

SEQ ID NO: 73937 - RNA, 64 nt, Human
ggaaggaaagcugcuucauuuuugaaagaugauggagacccaccacuacuauaugaugaauagc

SEQ ID NO: 73938 - RNA, 64 nt, Human
ucccauaaccaaagagcucaaugggcuggagggugagacccagccaauccuugggagcaagcag

SEQ ID NO: 73939 - RNA, 64 nt, Human
agcuacugguacccaauguguuccugggagccgagagacccauggucacuccaacuccuuccuu

SEQ ID NO: 73940 - RNA, 64 nt, Human
gacaacagaagggagguggccgggcugagcacgggagacccaccgugcaggggccuuucauggg

SEQ ID NO: 73941 - RNA, 64 nt, Human
ccuugcuaaucucuuuuauuuuguaacugaagaugagacccaaagaaagggaaagcugagauuu

SEQ ID NO: 73942 - RNA, 64 nt, Human
guccaccagcgccaacagccguggggaagccaaggagacccaagggguccaggaggugggcgcc

SEQ ID NO: 73943 - RNA, 64 nt, Human
cagacccagacagacagaccgacgcagccugaaagagacccagacagagagacaggcagacaca

SEQ ID NO: 73944 - RNA, 64 nt, Human
ggcccgagcuguucuuucagcugcuccaaggauugagacccaagucaucaugaaaaaggcccaa

SEQ ID NO: 73945 - RNA, 64 nt, Human
cccauucccgcagugggagcaaacugcaugcccagagacccagcggacacacgcgguuugguuu

SEQ ID NO: 73946 - RNA, 58 nt, Human
ggguggagccccugagcugaguucugcagagacccacucugaccccacuaaaaugacc

SEQ ID NO: 73947 - RNA, 64 nt, Human
acgggauccagggaagucgcacccaagcugcguggagacccaggagccucgggggaucuggaaa

SEQ ID NO: 73948 - RNA, 64 nt, Human
uagggcuucccccuucuccccaucccggucuccagagacccagcuucugagagacagggugugg

SEQ ID NO: 73949 - RNA, 64 nt, Human
guuuuaauucacguuguuacacuagccugccgaugagacccagacacaggcagaccuggcgcuc

SEQ ID NO: 73950 - RNA, 64 nt, Human
ucuccuccaauguccugaaacaugaacccaaaaagagacccacaauaaacucgugacuuguccc

SEQ ID NO: 73951 - RNA, 64 nt, Human
acccagguccucagcuccagacugggugaugcuggagacccaggagcaagucagcacaggcucu

SEQ ID NO: 73952 - RNA, 64 nt, Human
caggaugaagucgucuucuucggugaccacuuccgagacccaacccugcacgcccagcuccagu

SEQ ID NO: 73953 - RNA, 64 nt, Human
agccucugagggaaggagggauggggcauagugggagacccagccaagagcugaggguaagggc

SEQ ID NO: 73954 - RNA, 64 nt, Human
ccccucucuagucaugguccccaagaggggcuuggagacccacuuagcaggugaaagcaauggc

SEQ ID NO: 73955 - RNA, 64 nt, Human
gccuuauucuccaucugauaauuuauccuggagagagacccagugguuauugugcacauaggag

SEQ ID NO: 73956 - RNA, 64 nt, Human
gucuuauucuacaucugauaauucacccaugaaagagacccagugguuacugugcacuuaggaa

SEQ ID NO: 73957 - RNA, 64 nt, Human
gucuuauucuccaccugagaauucacccaugagagagacccagugguugcuaugcacuuaggaa

SEQ ID NO: 73958 - RNA, 64 nt, Human
cugcggcugaagccuuuucaucacuacccgcugggagacccacagagugugcaucagucaccac

SEQ ID NO: 73959 - RNA, 64 nt, Human
ggccccggcaccccggucggcagccugccccugugagacccacccucccgagcggccaaucgca

SEQ ID NO: 73960 - RNA, 64 nt, Human
acccuaccccuccuccaugggcccugcaggaggggagacccaccuugaagugggggaucaguag

SEQ ID NO: 73961 - RNA, 64 nt, Human
uccccuuggugccuaacccaggacuuuguccccagagacccacugugugcccccuggagcuccu

SEQ ID NO: 73962 - RNA, 64 nt, Human
gccugagcccgggaagaaccagaggcccucccgagagacccagucacacgucucugcuuuaagc

SEQ ID NO: 73963 - RNA, 64 nt, Human
aaccucugagagucugcgcuuggccuuaguccuggagacccagccuccagggacugaaccgugc

SEQ ID NO: 73964 - RNA, 64 nt, Human
auaagagauggcuacacccaggggggccaguucagagacccacucccaggugugcauucucuuu

SEQ ID NO: 73965 - RNA, 64 nt, Human
uucuucugcgccucaggcugcuggggccucagacgagacccaagggcagagcauuuaagaguga

SEQ ID NO: 73966 - RNA, 64 nt, Human
uuugagaugucugucccuccucccuggagcuccagagacccaccccucuccagguuaucccaga

SEQ ID NO: 73967 - RNA, 64 nt, Human
cucccagaauaugcuguaaucuaauuuuggugaagagacccagcguuuccuccugagcagugcc

SEQ ID NO: 73968 - RNA, 58 nt, Human; identical to SEQ ID NO: 73946

SEQ ID NO: 73969 - RNA, 64 nt, Human
acccauuucugauauacugaaugguaaauuuuuagagacccagaucucggaggcuacauuccau

SEQ ID NO: 73970 - RNA, 64 nt, Human
ccaucagcccaccuccaccucuggaggguccccagagacccacgcccgacgcagacccggagga

SEQ ID NO: 73971 - RNA, 64 nt, Human
gagaauggcauuaucuauagaggcugaugcaggagagacccagccuccggcugugacccccagc

SEQ ID NO: 73972 - RNA, 64 nt, Human
ggagggcauuggcaugcggcgcugugcauggggugagacccagagcgguaucuuugccaggaug

SEQ ID NO: 73973 - RNA, 64 nt, Human
caaacaaaaagagccagugggggagggagggacagagacccagagggcagcgucagacacccag

SEQ ID NO: 73974 - RNA, 64 nt, Human
cagaaaaaggaagagguggaaacccagagagacagagacccaaagggagagaaacagagacuca

SEQ ID NO: 73975 - RNA, 64 nt, Human
augauagagggacagagccaaaaggauagagaaagagacccagaaaaaggaagagguggaaacc

SEQ ID NO: 73976 - RNA, 64 nt, Human
cgucucgcuguuagauugugaguucccaugggcagagacccacugucguuccccgugugucccc

SEQ ID NO: 73977 - RNA, 64 nt, Human
uagagacccagcuuuauucaccugacuguuuccagagacccagcuaaagucaccugccuguucu

SEQ ID NO: 73978 - RNA, 64 nt, Human
cagagacccagcuacaguucccuggcuguuucuagagacccagcuuuauucaccugacuguuuc

SEQ ID NO: 73979 - RNA, 64 nt, Human
gcuccuuggacagacuguuucucaguuauuuccagagacccagcuacaguucccuggcuguuuc

SEQ ID NO: 73980 - RNA, 64 nt, Human
caugcccgcagcuuccuggcacuaccugagccgggagacccaggacuggcggccgccaugcccg

SEQ ID NO: 73981 - RNA, 64 nt, Human
gcugagggcugccucuugacagugcagucuuaucgagacccaaugccucagucugcucauccgu

SEQ ID NO: 73982 - RNA, 64 nt, Human
aaaaagcuuuaaaaaauaaagcugugucuuuagggagacccaauaaagaaugcaauccaugcca

SEQ ID NO: 73983 - RNA, 64 nt, Human
gcgcucaugaaugggauuagugcccuuauauaaagagacccagagagcuccaucaccccuucug

SEQ ID NO: 73984 - RNA, 64 nt, Human
cuccaccccggcccccgaacugugccuucgcuuggagacccacaaagagagugcgcccugcacu

SEQ ID NO: 73985 - RNA, 64 nt, Human
caggaaaccugcuccacuugucagggucucuucggagacccaggauuuagggucacaugcugca

SEQ ID NO: 73986 - RNA, 64 nt, Human
ugugguuuuagcaggggaggggaccugcuaagcugagacccauaguccugcucagaguuauccc

SEQ ID NO: 73987 - RNA, 64 nt, Human
ccaggcaaagucaaccagaugccuagcuccugcugagacccagguccuauggcagcuccucauu

SEQ ID NO: 73988 - RNA, 64 nt, Human
ccucgccuuccccaccuccccaccgagaacuccagagacccagauguuggacaccaggaagggg

SEQ ID NO: 73989 - RNA, 64 nt, Human
ggguccacuucugagugacugaccuccacuggaggagacccauugcugggaggagcugaggggg

SEQ ID NO: 73990 - RNA, 64 nt, Human
ggagagggucacuuuuguagcugagaccucucuggagacccagauccccuagagcaggucagag

SEQ ID NO: 73991 - RNA, 64 nt, Human
cuucacacgccugccagaagcuggaggggugcuggagacccauagagcugaugggagcagcugg

SEQ ID NO: 73992 - RNA, 64 nt, Human
gagugcuucaagcagagcauggugggucauugaggagacccaggaaucucaucugagaacccac

SEQ ID NO: 73993 - RNA, 64 nt, Human
guccaucccccccucaggcuugaaaguccucaaagagacccacuaucccauaucacugcccaga

SEQ ID NO: 73994 - RNA, 64 nt, Human
cacacuuugguuccuucuccgggcggcucucucugagacccaaggcugcagucccucagugcug

SEQ ID NO: 73995 - RNA, 64 nt, Human
uuuucccuaugaaggcuccuuuugaaugugucuugagacccaaauugagcauguugcuguuauu

SEQ ID NO: 73996 - RNA, 64 nt, Human
auucccagacugaggcagggcagguuugcagagagagacccagagugcacgugacccgcagugu

SEQ ID NO: 73997 - RNA, 64 nt, Human
gugucuuuggggcaugcaaguugggguuauaguggagacccagaggaugagaaaacuucucugc

SEQ ID NO: 73998 - RNA, 64 nt, Human
cauugccaaaugucccgugugaacauccccuauugagacccacugcuuuagcgagagaggguuu

SEQ ID NO: 73999 - RNA, 64 nt, Human
guuccagcaagucaggcuagggaccuggggggaggagacccauggacuucacccauacucagug

SEQ ID NO: 74000 - RNA, 64 nt, Human
ugcugaccccugccaggccacgaauaucaggcuagagacccauggccaucuuuguggcuguggg

SEQ ID NO: 74001 - RNA, 64 nt, Human
cuggaaggcagggccugcaggugcuccccgcccugagacccaggccccaaaucagcaauaauga

SEQ ID NO: 74002 - RNA, 64 nt, Human
gucacccugagagucccaucgccugcagcaccuggagacccaccucccaccccagugcacucuu

SEQ ID NO: 74003 - RNA, 64 nt, Human
gcggauucaguccuggaagagaguaucauauaaugagacccacaggcacuggcacccuuggguu

SEQ ID NO: 74004 - RNA, 64 nt, Human
guccacuucuugacacauucucacacuguggcuggagacccauuuuuuccaucccauguggaau

SEQ ID NO: 74005 - RNA, 64 nt, Human
auucugguuuuuuuagauuuugaugggcaugaaugagacccagcugauugcacuaaguaagugu

SEQ ID NO: 74006 - RNA, 64 nt, Human
uggcaacugugagcagucauggugacugaggacagagacccagagugaccccugccccaccccu

SEQ ID NO: 74007 - RNA, 64 nt, Human
gagcagauguguggugggguuggacucucuucuggagacccagacaauucagucuccagauuuc

SEQ ID NO: 74008 - RNA, 64 nt, Human
gagggcgcgguccccgggggcggggcggggcggggagacccagacccuccgcugggagaccuuc

SEQ ID NO: 74009 - RNA, 64 nt, Human
ggaggcuguugguaggaaaguggcagggcugggggagacccagccccaaggguccggggcggag

SEQ ID NO: 74010 - RNA, 64 nt, Human
agccuggagguagggggcugucuuggucacugcugagacccacaggucuaagaggagaggcaga

SEQ ID NO: 74011 - RNA, 64 nt, Human
gcgggagggggacucucgggagccacagacgcccgagacccacgccgggcgggaccggccaggg

SEQ ID NO: 74012 - RNA, 64 nt, Human
uauacguauuuagcaccucugaggcuuugccauggagacccauuucuguagggcuaaggaaaca

SEQ ID NO: 74013 - RNA, 64 nt, Human
gggucagugcugaaggucugggcagaagaccugcgagacccagaugacuuggacuucagcaacc

SEQ ID NO: 74014 - RNA, 64 nt, Human
cguacuuguugaguacaaacugcaccaagcccuggagacccauuaccaccguuaacccucaaua

SEQ ID NO: 74015 - RNA, 64 nt, Human
gaauuuugcuacauggggucugggugggggcaaagagacccagucaauuacauguuugguacca

SEQ ID NO: 74016 - RNA, 64 nt, Human
aaauuuuacacaaggacuaauccugggugucucugagacccaucuccugccuagacauccaccu

SEQ ID NO: 74017 - RNA, 64 nt, Human
ugcuuuaaauuucuaagaauuuauaucauaacuagagacccaaauaucuuucacagaauuuugu

SEQ ID NO: 74018 - RNA, 64 nt, Human
cugcucugcccaggcaaggaacagaagugaggaugagacccagccccuuccccugggaacucuc

SEQ ID NO: 74019 - RNA, 64 nt, Human
uaucugccaucaucugccauaggaaagauacccagagacccaucauguucucuuuuuguuguua

SEQ ID NO: 74020 - RNA, 64 nt, Human
uacaguuaacucugcuguuugcugcaugcugcaugagacccaggguccugguaagcuugauuaa

SEQ ID NO: 74021 - RNA, 64 nt, Human
accguguucccaggagcacugacugcaguugagagagacccauuuugcucucccuuaccgcccc

SEQ ID NO: 74022 - RNA, 64 nt, Human
ugucaccccuuccuuuacagguccugggguccaggagacccagaaugaaggugucaguugggca

SEQ ID NO: 74023 - RNA, 64 nt, Human
ggccuguggccuuucuugugaccaucagggccuggagacccagcaaggaguugccugggugcug

SEQ ID NO: 74024 - RNA, 64 nt, Human
cgcgaagaggucuugaccgugaaggaaauuaccugagacccagaggguguaggaauggcaugga

SEQ ID NO: 74025 - RNA, 64 nt, Human
cuagagccuccagggggaacuggaggaugcguaagagacccagaacuuccacagaaggaggaaa

SEQ ID NO: 74026 - RNA, 64 nt, Human
gcacuguguucucagguacaugagcaaucucagggauagccagcagcagcuccaggucugcgca

SEQ ID NO: 74027 - RNA, 64 nt, Human
auggucauuuguguuagauuacaucaaacugauggauagccauugguauucaucuauuuuaacu

SEQ ID NO: 74028 - RNA, 64 nt, Human
uauugaguuguguuuucagcacuauauuggucaagauagccaagcaguuuguauaauuucuguc

SEQ ID NO: 74029 - RNA, 64 nt, Human
uauuuaugaccugauauucaaagacucuggcauugauagccaguguguuuucuuauuuaacucc

SEQ ID NO: 74030 - RNA, 64 nt, Human
caucaaaacaacaacaauggaaauuuauguuggcgauagccaagaccacaagcaaaagcacaua

SEQ ID NO: 74031 - RNA, 64 nt, Human
ccgcacagcgccaucucucccugagaauaaagccgauagccacccuccuccggcuccgagccug

SEQ ID NO: 74032 - RNA, 64 nt, Human
aaacauuuuugaggggcacauguggggucaaaaagauagccaauuuccauuacauggguuuaca

SEQ ID NO: 74033 - RNA, 64 nt, Human
aaaagaaauaaaaagaaaguaaaaguccccuagugauagccacuauucacagcuucucauuugu

SEQ ID NO: 74034 - RNA, 64 nt, Human
agcuggagaggaauaaccaucccuacaacucgaggauagccaucaggagcacuguuggaaucag

SEQ ID NO: 74035 - RNA, 64 nt, Human
agaucuucuguggguuucuaaagcugccagccgagauagccaaggccaaaggaagcacaugccu

SEQ ID NO: 74036 - RNA, 64 nt, Human
uccccaagcagggagccugggaugggcagggagugauagccaaacuccuuggucaccugcucca

SEQ ID NO: 74037 - RNA, 64 nt, Human
acccugcacuacccuguucuguaguuauucugaugauagccagugagguucuuaaaguuugcag

SEQ ID NO: 74038 - RNA, 64 nt, Human
agaagggaagcauggcaaaagcuggccuggaagggauagccagagggauagaaugacucucucu

SEQ ID NO: 74039 - RNA, 64 nt, Human
uguucuguuuccauguuaaauuuaauuuaaccuggauagccacauuaaugaauuggugcuguca

SEQ ID NO: 74040 - RNA, 64 nt, Human
auuggcugcuguuucuaauauaauuauuuucuaagauagccagauaguuagaaaaagauuuuca

SEQ ID NO: 74041 - RNA, 64 nt, Human
cagacagagagagagagcacuugauucuucccgagauagccaccuggaaacacuaggugccugc

SEQ ID NO: 74042 - RNA, 64 nt, Human
auggaguaaugaaauucuugccaugugcugaggagauagccagcauuaggugacaaucuuccag

SEQ ID NO: 74043 - RNA, 64 nt, Human
augagcuauagauaaggcagcuaaauuucugaaagauagccagaguaaguaagcagccacugca

SEQ ID NO: 74044 - RNA, 64 nt, Human
ggagguucaccuuugugacugauuggugauaaaagauagccaagugucuuacaagcagcuucug

SEQ ID NO: 74045 - RNA, 64 nt, Human
uuucuuggaauuucuugcuuguaucaauccugaugauagccauccugaacagaugcuucugguc

SEQ ID NO: 74046 - RNA, 64 nt, Human
augaccaaaaucaagauugcucaaaaggguaaaugauagccacaguauugcucccuaaaauaug

SEQ ID NO: 74047 - RNA, 64 nt, Human
ugcucauggagcuuacauucuacagggagaaagagauagccaauacauaggaauaaauauauac

SEQ ID NO: 74048 - RNA, 64 nt, Human
uucaagugaugagcagacgccuagucgggaugaugauagccaguccaggaguccaaguagaucu

SEQ ID NO: 74049 - RNA, 64 nt, Human
agagggugggagggggcuucuccuuuuggaagcagauagccaugcagguagaauugucaucucc

SEQ ID NO: 74050 - RNA, 64 nt, Human
guucggccuacuuucuagccucacucagcccagggauagccaguguugggagacagaguugccu

SEQ ID NO: 74051 - RNA, 64 nt, Human
ggugugagguggguggggaccugugucagguguggauagccauuucugcucaaccacacauucu

SEQ ID NO: 74052 - RNA, 64 nt, Human
augcugccugugucuaugggguucugucuucuuugauagccaucuauucaucuggaucauggga

SEQ ID NO: 74053 - RNA, 64 nt, Human
acacuuccccuggguugcauccuggauguuuuaugauagccaugcucugauuuuugccugcuau

SEQ ID NO: 74054 - RNA, 64 nt, Human
agggaagccucaggaaccagcaccuggaggccaggauagccaagcccugggugagcgagaggcu

SEQ ID NO: 74055 - RNA, 64 nt, Human
ucagccaaacuuaaccuuggugggguuuggauuugauagccaauuaguucugugcugguugcaa

SEQ ID NO: 74056 - RNA, 64 nt, Human
cuuuugcuuuuaaaauaguuacaauauuuuucaugauagccacaguauugccacaguuuauuau

SEQ ID NO: 74057 - RNA, 64 nt, Human
uggagaacuccauguacuuuggaaucuccuccaagauagccagaguuuaauacaucuucauucu

SEQ ID NO: 74058 - RNA, 64 nt, Human
acaaaccuacugugggcuccagccuuuguccugagauagccaagcgggagaaugggcaguuucu

SEQ ID NO: 74059 - RNA, 64 nt, Human
uaacuuggucuagaauaugacacuuauugugguggauagccaagcacauugggaucuccacauc

SEQ ID NO: 74060 - RNA, 64 nt, Human
auggaguuaguaaauucugggcugucauauguaggauagccacuuuuuagguauauguacauuu

SEQ ID NO: 74061 - RNA, 64 nt, Human
uuucauaauaugucaugcuaauaauaaauauauugauagccaagucauggugccuaaaaugcca

SEQ ID NO: 74062 - RNA, 64 nt, Human
gcaaagaggcgaacgcucgcccagagcaagaaaugauagccagucauauacucucagacccuug

SEQ ID NO: 74063 - RNA, 64 nt, Human
aauucagcaauaugagaaaaccagccccuaaaaugauagccacaagagauuaauuguguuuuuu

SEQ ID NO: 74064 - RNA, 64 nt, Human
uggaaggaccuuagaacuuaucuguuaugcuccugauagccaauagcagauagaagcuugcaau

SEQ ID NO: 74065 - RNA, 64 nt, Human
gauuuguucuuuccagaagaggagacaaaagcaagauagccaaaugugacaucaagcuccauug

SEQ ID NO: 74066 - RNA, 64 nt, Human
ucucaauaagccucagcuuucuaagaucuaacaagauagccaccgagauccuuaucgaaacuca

SEQ ID NO: 74067 - RNA, 64 nt, Human
aagucuauauucuagccucauuugcaugaagucagauagccagaagaaauuccauugcugguuu

SEQ ID NO: 74068 - RNA, 64 nt, Human
aaaaagguuggccuuaguagucaaaaacaaagcugauagccagacacguucugauuucugcccu

SEQ ID NO: 74069 - RNA, 64 nt, Human
gacuuugguaugugauaccauagaauacugauuggauagccauccuagucacuuaccaauacug

SEQ ID NO: 74070 - RNA, 64 nt, Human
gaaaaguacacacugggcuacaaaggaauuuggagauagccaaggaacaggauuuccccuagca

SEQ ID NO: 74071 - RNA, 64 nt, Human
gccccaagccauggugacacacagcagcacugcagauagccagacacauggcuauccuagagag

SEQ ID NO: 74072 - RNA, 64 nt, Human
uuuuaaaguaacaggauauuuaauaagaguccuagauagccagcggagacuuuaagaaucauug

SEQ ID NO: 74073 - RNA, 64 nt, Human
ugcauagguauaaagaggaucauuucuaccuagggauagccaaagcauggguuucaacacguuu

SEQ ID NO: 74074 - RNA, 64 nt, Human
uguguuugcaacuggggagacagaaacugugguugauagccagucacugccuuaagaacauuug

SEQ ID NO: 74075 - RNA, 64 nt, Human
uuuuuuuuauuucuuacuuucccauauuaggggugauagccaaagggguucugguaagagaaag

SEQ ID NO: 74076 - RNA, 64 nt, Human
aacucaguauuuuaacucaaaauucauguaacaagauagccaaaagcauaggauuucuuaaaau

SEQ ID NO: 74077 - RNA, 64 nt, Human
uagccaucaucgaaacuaauggggggacagacuugauagccaaggucccuucugguccaguuuu

SEQ ID NO: 74078 - RNA, 64 nt, Human
aagugacuuuguuuauucuugucucagucuccuugauagccacuucacucugcuacuacucaac

SEQ ID NO: 74079 - RNA, 64 nt, Human
aagagauaguucuuuuaaugugacuaugcaacaugauagccaauggugagggaaaaggagguuu

SEQ ID NO: 74080 - RNA, 64 nt, Human
cuauugagggugacagccacccagcccuccugaagauagccagagagcccaugagaccgucccc

SEQ ID NO: 74081 - RNA, 64 nt, Human
guaaaggucacaaacuagcugugucaaggcccgugauagccagaaagcggcaguuucaguccau

SEQ ID NO: 74082 - RNA, 64 nt, Human
gccccuuauuugaucaccauguacuaggagcucugauagccagcucagcuccuaauccuugagg

SEQ ID NO: 74083 - RNA, 64 nt, Human
gaggaguagagauuguugaccauuuuuaaaaaacgauagccacucuuuuucuuuuauguuuaaa

SEQ ID NO: 74084 - RNA, 64 nt, Human
gaucaauauagcuuggugagacagugccgagauagauagccaugucugccuugggcacgggaga

SEQ ID NO: 74085 - RNA, 64 nt, Human
gguggggguuggcuguggccuggcaguaucuugggauagccagcacugggaauaaagauggcca

SEQ ID NO: 74086 - RNA, 64 nt, Human
uuacaauggagucugcagugaggggagaugcugggauagccauuuccauggcucuguuaugcaa

SEQ ID NO: 74087 - RNA, 64 nt, Human
ggaguugguaguccuuguguuuuucauagcccaagauagccaugugaccuggaacuuuuaaaaa

SEQ ID NO: 74088 - RNA, 64 nt, Human
gcacugauggugccaaagggcccugagucaaaaggauagccaaggguggaguggaaaaagauau

SEQ ID NO: 74089 - RNA, 64 nt, Human
agaguuaccuuacagaguuuuggaucuuuccagggauagccaaugauuuuaucccccagaaucc

SEQ ID NO: 74090 - RNA, 64 nt, Human
acaagaaucaaucagaccuucucccugaacuuaagauagccacaaucagaaaaaggacaaggac

SEQ ID NO: 74091 - RNA, 64 nt, Human
uugcacuucuaacauguagccaauaaaucuauuugauagccaucaaaggaauaaaaagcuggcc

SEQ ID NO: 74092 - RNA, 64 nt, Human
cucugcucauaaaccucuuacugagaugcuuccugauagccaggcuggccagagaggggugcag

SEQ ID NO: 74093 - RNA, 64 nt, Human
gcaaugcagaaaaaaaggugaaauaaauggaagagauagccauggacucuggaucuuuuaaaaa

SEQ ID NO: 74094 - RNA, 64 nt, Human
gggggaagacagcaaucaaaacuaacuuuuuguagauagccauuucauuucuuuaaacuguuuc

SEQ ID NO: 74095 - RNA, 64 nt, Human
cuaaugacagggcaacugaacagauugcacaugggauagccaaacuggacuuucuuuguuuccu

SEQ ID NO: 74096 - RNA, 64 nt, Human
ucacaguucuuagcaaaugcaguuacaauccauagauagccagcaguggauguuacuccaggaa

SEQ ID NO: 74097 - RNA, 64 nt, Human
guggagcauuagagaaaagccuagacuuuuaguugauagccaguugaaauaucauugauagaau

SEQ ID NO: 74098 - RNA, 64 nt, Human
ugacaacacuagggcuguuguacaaaauaguaaugauagccauggaaguuuuaccuuauucugu

SEQ ID NO: 74099 - RNA, 64 nt, Human
ugauaaaggccaauuccagguagcucuugaaggugauagccaucuacuuuccaguggcugccaa

SEQ ID NO: 74100 - RNA, 64 nt, Human
uaucuguaccuuuggcuuuuuacuuguuuuuuuggauagccaucccaccauaggauguguacau

SEQ ID NO: 74101 - RNA, 64 nt, Human
guauaaauaugcuaugguuuguuuguuaugaacagauagccaccaguuacggccguugugugua

SEQ ID NO: 74102 - RNA, 64 nt, Human
agccagaaaguauucauacugcuacuccuuaugagauagccaagaagcaucaugucaguaacug

SEQ ID NO: 74103 - RNA, 64 nt, Human
aauuguuucccaugcugccagggacuuccaacuagauagccaugugacguccuggugacuuggg

SEQ ID NO: 74104 - RNA, 64 nt, Human
uguauagcuauguagcgcucuguagagccauguagauagccacucacaugugcgcacacgugug

SEQ ID NO: 74105 - RNA, 64 nt, Human
auugcacuuuuguuuaacuagaauacaccuaugagauagccaaaguuucaaacacaguuaucuu

SEQ ID NO: 74106 - RNA, 64 nt, Human
gaccccucaggaguuuccacacugcuguggacgggauagccagggcagaccugcaucccagagc

SEQ ID NO: 74107 - RNA, 64 nt, Human
gccugcccaucuucuccgcuuuugggaugaagaugauagccagggcuguuguuuuggggcccuu

SEQ ID NO: 74108 - RNA, 64 nt, Human
ugaguguaaagacucacaggugaccugcuaucgagauagccagagggucaggagagaauggggg

SEQ ID NO: 74109 - RNA, 64 nt, Human
acuacaguucagaggcagccugcaguccucccaugauagccagggagagccgcacaacauacaa

SEQ ID NO: 74110 - RNA, 64 nt, Human
ucccuuuuuuauaccuuagauugcaaacauccuagauagccaugcagcuacauugaaccggaaa

SEQ ID NO: 74111 - RNA, 64 nt, Human
agagccuccccgacccacuaccuggagauagccagauagccagaugcccugcuccuggccaccu

SEQ ID NO: 74112 - RNA, 64 nt, Human
gcagucucagagccuccccgacccacuaccuggagauagccagauagccagaugcccugcuccu

SEQ ID NO: 74113 - RNA, 64 nt, Human
gaauuuuaguacauauugaaguuauauggaagaagauagccauaaucuguaagaaaguaccgca

SEQ ID NO: 74114 - RNA, 64 nt, Human
aaauuacauaaucccucugauuccacuauccagagauagccauuauuauuaauauuugguaugu

SEQ ID NO: 74115 - RNA, 64 nt, Human
ucugagucaggauuuugggggaaagcuaguuacugauagccacaggaaguugagacuucugccc

SEQ ID NO: 74116 - RNA, 64 nt, Human
ucaguuauacaucuuauuuugugcuacuaccacagauagccaauauuccaugcaguccugggcu

SEQ ID NO: 74117 - RNA, 64 nt, Human
uagaaacaagaacuuuauguuauccaaguucugggauagccaugagcuccaauuaccucagagc

SEQ ID NO: 74118 - RNA, 64 nt, Human
ccaaacuuggcuccagccauugcggugguuucuagauagccaggcccaccaagagauauugccc

SEQ ID NO: 74119 - RNA, 64 nt, Human
gguuggaaagacagcugaauuaguaguuaagucugauagccaaguaaguuuuaaaaaccaaagc

SEQ ID NO: 74120 - RNA, 64 nt, Human
gcuuuuauaguuagcagccauucuuuauuuucuggauagccagguuuuaucacgcuucuaguca

SEQ ID NO: 74121 - RNA, 64 nt, Human
cccacugggugccaagcucagagggggaaaaaaagauagccagagagagaccuggcccucaaaa

SEQ ID NO: 74122 - RNA, 64 nt, Human
caccucccucuucauuuaggaucuccagauacuggauagccagcauccucucauucccagggag

SEQ ID NO: 74123 - RNA, 64 nt, Human
aacaacagaagaaaaccuucaguuggauccuccagauagccacugccuuuuccucaagggagca

SEQ ID NO: 74124 - RNA, 64 nt, Human
acagugauguggagucgccgcacccaucuuugaagauagccagugucccuggaugaggugauga

SEQ ID NO: 74125 - RNA, 64 nt, Human
gaaaagcuccuuuucucuucacuguuuuggaaaggauagccauuagcaugacugcuuugugucc

SEQ ID NO: 74126 - RNA, 64 nt, Human
ggcgaguggccgguccccgcugugccaggugggcaggcaggagcaaggccugcgagggaggaac

SEQ ID NO: 74127 - RNA, 64 nt, Human
ccucuccuuccuguguguccaaaacugccucaggaggcaggaccuucgggcugugcccggggaa

SEQ ID NO: 74128 - RNA, 64 nt, Human
cacgugccuguagucccagcuacuugggaggcugaggcaggagaaucacuugaccccagguggu

SEQ ID NO: 74129 - RNA, 64 nt, Human
cgcauaacuauaaucccagcuacuugggaggcugaggcaggagaaucgcuugaacccgggaggc

SEQ ID NO: 74130 - RNA, 64 nt, Human
ugggcuccuguagucccagcuacuugggaggcugaggcaggagaaucgcuugaaccugggaggc

SEQ ID NO: 74131 - RNA, 64 nt, Human
cacaugccuguaauuccagcugcuugggagccugaggcaggagaacugcuugaacccaggaggc

SEQ ID NO: 74132 - RNA, 64 nt, Human
uaaagcacgccuuuaaauaagcaaaaacuuuaaaaggcaggaaagagaauucuuaggcaaauuc

SEQ ID NO: 74133 - RNA, 64 nt, Human
ccauccugugucugggucagccagagguuccuccaggcaggagcugagcauggggugggcagug

SEQ ID NO: 74134 - RNA, 64 nt, Human
aggugccuguaaucccagcuacuggggaaagcugaggcaggagaauugcuucaaucuggaaggc

SEQ ID NO: 74135 - RNA, 64 nt, Human
aacaacccuaaaaccagaccacuccacgcaggacaggcaggagagauucuuccuaaagccuccc

SEQ ID NO: 74136 - RNA, 64 nt, Human
caugugccuguagucccagcuacucaggaggcugaggcaggagaaucacuugaacccgggaggu

SEQ ID NO: 74137 - RNA, 64 nt, Human
gcgcaggaggacaggcaccaccggaugccacaccaggcaggaggagguguggacagugauggua

SEQ ID NO: 74138 - RNA, 64 nt, Human
gggaaacaccagcuuuuggggugauagcacuuucaggcaggagcuaugguuccuuccucaggag

SEQ ID NO: 74139 - RNA, 64 nt, Human
gugugugcucccgccuccuggguauacagagagaaggcaggaaucaggaguuccagaagcauau

SEQ ID NO: 74140 - RNA, 64 nt, Human
cagcccuuacuaagcugagagaugucauugcugcaggcaggacguauaggcacauguagguuug

SEQ ID NO: 74141 - RNA, 64 nt, Human
uccuuccaggcacaucucacauugccauguacagaggcaggagucacguuuggucaccauggaa

SEQ ID NO: 74142 - RNA, 64 nt, Human
aacugaggacuugccuuggaaauggaaucuggggaggcaggaauacaaggacaguggggguugg

SEQ ID NO: 74143 - RNA, 64 nt, Human
gcccccuaccuuauaaggguugcugggcauuugaaggcaggaagauuuuuaaagauagauugag

SEQ ID NO: 74144 - RNA, 64 nt, Human
ccacaggaagggccacaggcccgcuaagccccaaaggcaggaucuaggugagucccugugggcg

SEQ ID NO: 74145 - RNA, 64 nt, Human
cacacgccuauagucccagcuacucaggaggcugaggcaggagaaucacuugaacccaggaggc

SEQ ID NO: 74146 - RNA, 64 nt, Human
uaacucgcacuggucacacaucuguaagugggagaggcaggauucaacagaucugucugucuug

SEQ ID NO: 74147 - RNA, 64 nt, Human
aggaaaaagcugaugguccuguccaaaggcuauuaggcaggaagaauucucuuagggcagaguu

SEQ ID NO: 74148 - RNA, 64 nt, Human
uaagucugguucccgccucccugucugagagaggaggcaggagccccagggccggcuuguguuu

SEQ ID NO: 74149 - RNA, 64 nt, Human
cucauggggcucuuuauaaggaguugggggguagaggcaggaaaugggaaccgagcugaagcag

SEQ ID NO: 74150 - RNA, 64 nt, Human
caucacccaagugccugaugccucaggugacagaaggcaggacguuccaugccgaggcugcccc

SEQ ID NO: 74151 - RNA, 64 nt, Human
caugugccuguggucccagcuacucaggaggcugaggcaggaggaucacuugagcacaggaguu

SEQ ID NO: 74152 - RNA, 64 nt, Human
gcccuagcuggagacucuggggaucuggagcugcaggcaggagguggcacuggcucccacuccc

SEQ ID NO: 74153 - RNA, 64 nt, Human
acacaggcacuuuuccaaugggcaagcccaguggaggcaggaugggagagcccccugggugcug

SEQ ID NO: 74154 - RNA, 64 nt, Human
gccccaguguccgggauguguggccagcugcugcaggcaggacuccagcgucaggauguugcca

SEQ ID NO: 74155 - RNA, 64 nt, Human
ugccaggcauucaauccucaggucuccaccaaggaggcaggauucuucccauggauaggggagg

SEQ ID NO: 74156 - RNA, 64 nt, Human
caggugcuuguaaucccagcuacuugggaggcugaggcaggagaaucacuugaaccaggaaggc

SEQ ID NO: 74157 - RNA, 64 nt, Human
acaauaauuggcccaaaugcagacaucaagaagcaggcaggaaaauggaaaaacugagauaaua

SEQ ID NO: 74158 - RNA, 64 nt, Human
uagcaugguagaucagaaaauccucuuagguuuuaggcaggaaggaauauuuaaacauugcuuu

SEQ ID NO: 74159 - RNA, 64 nt, Human
cucaugccuguaaucccgacacuuugggaggccaaggcaggaggauggcuugaagccaguaguu

SEQ ID NO: 74160 - RNA, 64 nt, Human
ugcacaccuguaguccuagcuacuugggaggcugaggcaggaggaucccuugaguccaggaggu

SEQ ID NO: 74161 - RNA, 64 nt, Human
gggucagccacugccaauccugccuuacucaggaaggcaggaggaaagagacugccucuccaga

SEQ ID NO: 74162 - RNA, 64 nt, Human
uggaccagaugaucccuuccaauguggugcuagcaggcaggaucccuucuccaccuccaaaggc

SEQ ID NO: 74163 - RNA, 64 nt, Human
cacacgccuguagucccaguuacuugggaggcugaggcaggagaauugcuugaaccugggaggu

SEQ ID NO: 74164 - RNA, 64 nt, Human
caccugccuguaaucccagcuacuugggaggcugaggcaggagaaucgcuugaacccgggaggc

SEQ ID NO: 74165 - RNA, 64 nt, Human
gcagaucggucagcaccagaagucaacugaguuaaggcaggaaaagaaauaagcccaaccaacu

SEQ ID NO: 74166 - RNA, 64 nt, Human
caggcaguguguuaugggcugaggaugcagaaacaggcaggacacagugcuguccuagcagugc

SEQ ID NO: 74167 - RNA, 64 nt, Human
ccaggcaugguggcccacgcacuucgggaggucgaggcaggaggaucacuugaguccagaaguu

SEQ ID NO: 74168 - RNA, 64 nt, Human
gcugcuugaggcaacucaucuuagguuggcaaaaaggcaggauggccgggcgcgguggcucacg

SEQ ID NO: 74169 - RNA, 64 nt, Human
cacaugccuguaaucccagauacuugggaggcugaggcaggagaauugcuugaacccaggaggu

SEQ ID NO: 74170 - RNA, 64 nt, Human
acaaucccaaaucaaaucugucuccaggcuggagaggcaggagcccuggggugagaaaagcaaa

SEQ ID NO: 74171 - RNA, 64 nt, Human
uacaguggagugagaucuuacagguaucaggcacaggcaggaagagagagagagagguucuggg

SEQ ID NO: 74172 - RNA, 64 nt, Human
agaacaaacucagaucucaucaggguagcagcagaggcaggaccagaaggcaaucaagagcuuc

SEQ ID NO: 74173 - RNA, 64 nt, Human
cacacgccuguaaucucagcuacucaggaggcugaggcaggagaauugcuugaaccugugagga

SEQ ID NO: 74174 - RNA, 64 nt, Human
auaucaugcucacugcaguguuauuuaaaauaaaaggcaggaaauaaccuaaauguccauucau

SEQ ID NO: 74175 - RNA, 64 nt, Human
ccugccacuaugagcuagugcucaugugacuuggaggcaggauccaggcacagcuccccucacu

SEQ ID NO: 74176 - RNA, 64 nt, Human
ggucuguuucucuucagugaugagacucuuaggaaggcaggaauggauaggauagggggaggag

SEQ ID NO: 74177 - RNA, 64 nt, Human
uggccauccaggaaauuucguacagcugaaauauaggcaggauguucaacaucaguuuacuugc

SEQ ID NO: 74178 - RNA, 64 nt, Human
ugcaugccuguaaucccagcugcuugggaggcugaggcaggagaaucacuugaacacaggaggc

SEQ ID NO: 74179 - RNA, 64 nt, Human
ugcaugccugaaaucccagcuacuugggaggcugaggcaggagaauugcuugaacccgggaggc

SEQ ID NO: 74180 - RNA, 64 nt, Human
cgggcgccuguagucccagcuacuugggaggcugaggcaggagaauggugugaacccgggaggc

SEQ ID NO: 74181 - RNA, 64 nt, Human
ugagagagacagucuugugagggagaucugggggaggcaggaagcuccucagauuuucucacag

SEQ ID NO: 74182 - RNA, 64 nt, Human
caggcgccuguagucccagcuacucaggaggcugaggcaggagaauggcgugaacccgggaggc

SEQ ID NO: 74183 - RNA, 64 nt, Human
uacaugccuguagucccagcuacuugggaggcugaggcaggagaauugcuugaacccuggaggc

SEQ ID NO: 74184 - RNA, 64 nt, Human
aaccugcagcaccagagaaaccuuuccaagugcuaggcaggagaacugaagaacucuuucagug

SEQ ID NO: 74185 - RNA, 64 nt, Human
guucccccugcaggagcagguucuugggagcgugaggcaggaagacacuaggugcugaaucucc

SEQ ID NO: 74186 - RNA, 64 nt, Human
uaugugccuguaaucccagcuacuugggaggcugaggcaggagacucgcuugaaccugggaggc

SEQ ID NO: 74187 - RNA, 64 nt, Human
caggagccuguagucccagcuacucgggaggcugaggcaggagaauugcuugaaccggggaggc

SEQ ID NO: 74188 - RNA, 64 nt, Human
cgggcgccuguaaucccagcuacuugggaggcugaggcaggagaauggcaugaaccugggaggc

SEQ ID NO: 74189 - RNA, 64 nt, Human
ugggcaccuguagucccagcuacucagggggcugaggcaggagaauggcgugaauccgggaggc

SEQ ID NO: 74190 - RNA, 64 nt, Human
acaggacugauggguauaacugacccccacagggaggcaggaaaacagccagaagccaccuuga

SEQ ID NO: 74191 - RNA, 64 nt, Human
augcagaaagcaucccucacccauccuagaggccaggcaggagcccuucuauacccacccagaa

SEQ ID NO: 74192 - RNA, 64 nt, Human
ugggugccuguaaucccagcuauucaggaggcugaggcaggagaaucacuuggaccugggaggc

SEQ ID NO: 74193 - RNA, 64 nt, Human
ugggcaccuguagucccagcuacucgggaggcugaggcaggagaaaggcaugaauccaagaggc

SEQ ID NO: 74194 - RNA, 64 nt, Human
agaaacagaccugggcgcaaacaacuccaggacaaggcaggacaugauaaagauuauaaagcag

SEQ ID NO: 74195 - RNA, 64 nt, Human
ccaccagggagggagacacacaagccuuuucugcaggcaggaguuucagacccuauccugagaa

SEQ ID NO: 74196 - RNA, 64 nt, Human
ugcaugccuguagucccagcuguuugggaggcugaggcaggaggaucuuugagccuaggaugcu

SEQ ID NO: 74197 - RNA, 64 nt, Human
cagcuuggugaggauuggggcuucuagauugucuaggcaggaggugaaacuuaggccagaguca

SEQ ID NO: 74198 - RNA, 64 nt, Human
cacacgccuguagucccagcuacucaggaggcugaggcaggagaaucgcuugaaccugggaggc

SEQ ID NO: 74199 - RNA, 64 nt, Human
aaggaacaucagagaagcuguggggcugccugccaggcaggaucauggcugccaucaagccuuu

SEQ ID NO: 74200 - RNA, 64 nt, Human
guccauuuccagcagacacaauggaggcugacagaggcaggagccuaccccuggccacaccacc

SEQ ID NO: 74201 - RNA, 64 nt, Human
ugggugccuguaaucccagcuacucgagaggccaaggcaggagaauugcuagaaccugggggug

SEQ ID NO: 74202 - RNA, 64 nt, Human
uauuauuugagacagagucucacucuuaucacccaggcaggagugcaguggugcgaucaaggcc

SEQ ID NO: 74203 - RNA, 64 nt, Human
ccuguuccccgaucagagcuccucugcaggaaacaggcaggaugccccucccaaccccucaguc

SEQ ID NO: 74204 - RNA, 64 nt, Human
cuugugccuguagucccagcuacuugggaggcugaggcaggaggguugcuugagacuagccuag

SEQ ID NO: 74205 - RNA, 64 nt, Human
cgugugccuguagucccagcuacuugcgaggcugaggcaggagaauugcuugaaccugggaggc

SEQ ID NO: 74206 - RNA, 64 nt, Human
agccauauggugaggcuggggaguucacauccucaggcaggaacuagcaguuguuuauccagca

SEQ ID NO: 74207 - RNA, 64 nt, Human
ugggcaccuguaaucccagcuacucgggaggcugaggcaggagaaucgcuugaacucgggaggu

SEQ ID NO: 74208 - RNA, 64 nt, Human
uacacacgaggcuuucucaggaaguggcucugccaggcaggacuaugugggaaaggguuuuucc

SEQ ID NO: 74209 - RNA, 64 nt, Human
agcccuauacgcagacccacagguggggaaacugaggcaggaacaggguucugcccucccagag

SEQ ID NO: 74210 - RNA, 64 nt, Human
aggggcaggcgaggccuccaggggcaggguccugaggcaggaacucgacucuccaacccuccug

SEQ ID NO: 74211 - RNA, 64 nt, Human
cacgcgccuguagucccagcuacacgggaggcugaggcaggagaauggcgugaacccaggaggc

SEQ ID NO: 74212 - RNA, 64 nt, Human
cacucgccuguaaucucagcuacuugggaggcugaggcaggagaaucgcuugaacccgggaggc

SEQ ID NO: 74213 - RNA, 64 nt, Human
cacacgccuguagucccagcuacuugggaggcugaggcaggagaauugcuugagcccaagaggu

SEQ ID NO: 74214 - RNA, 64 nt, Human
uggguaccuauaaucccagcuacuugggaggcugaggcaggagaaucgcuugaaccugggaggu

SEQ ID NO: 74215 - RNA, 64 nt, Human
ugagggagcgguaugcucuacccuuguguauuuaaggcaggacagagaaauugaggaugccccu

SEQ ID NO: 74216 - RNA, 64 nt, Human
caugugccuauagucccagcuacucaggaggcugaggcaggagaauugcuugaaccugggaggc

SEQ ID NO: 74217 - RNA, 64 nt, Human
cacacgccuguaaacccagcuacuugggaggcugaggcaggagaauugcuugagcccgggagag

SEQ ID NO: 74218 - RNA, 64 nt, Human
cagcccuuacuaagccgagaggugucauuccugcaggcaggaccuauaggcaccugaagauuug

SEQ ID NO: 74219 - RNA, 64 nt, Human
cuucugucuuuucuuucucaguaaacaguucugaaggcaggaguggaacccgggaguauuuuca

SEQ ID NO: 74220 - RNA, 64 nt, Human
ccagcagaucaaaaagcacaaagagcuggggcagaggcaggaagcaggggcccuccuggcagcu

SEQ ID NO: 74221 - RNA, 64 nt, Human
uuuuuucuuuugagacagggucuugcucuugcccaggcaggaguacaguagugcaaucacagcu

SEQ ID NO: 74222 - RNA, 64 nt, Human
cguacgccuguagucccagcuacucaggaggcugaggcaggagaauugcuugaacccaggagga

SEQ ID NO: 74223 - RNA, 64 nt, Human
ugggcgccuguaaucccagcuacucaggaggcugaggcaggagaaucgcuugaacccgggaggc

SEQ ID NO: 74224 - RNA, 64 nt, Human
ucuagauucugaggggguugguggauauugggcaaggcaggaaaccucuggagaccucauuuuc

SEQ ID NO: 74225 - RNA, 64 nt, Human
ugagcacccucuccgguuuggguugggauaacagaggcaggaguggcagcuguccccucucccu

SEQ ID NO: 74226 - RNA, 64 nt, Human
caggggcagccgaagcacgggguccugagaccucaggcaggauuggagaucaaaccagaggggg

SEQ ID NO: 74227 - RNA, 64 nt, Human
cacuguguuauuuucacaguggagacacguggcaaggcaggagggcccucagcuccuagggcug

SEQ ID NO: 74228 - RNA, 64 nt, Human
guaucaggcugaugcuggcuucauagaaugaguuaggcaggagcccuuccuccuugauuuuuug

SEQ ID NO: 74229 - RNA, 64 nt, Human
gaacaucuggagucagcagaaccauugggaccugaggcaggagugucaccugcgggagaagucu

SEQ ID NO: 74230 - RNA, 64 nt, Human
ugcaccccuaaaaucccagcuacuugagagacugaggcaggagaaucgcuugaacccaggaggu

SEQ ID NO: 74231 - RNA, 64 nt, Human
uccuaaauaaauggauaaguagaauuaaugguugaggcaggaccauacagagugugggaacugc

SEQ ID NO: 74232 - RNA, 64 nt, Human
auccuguaaaugauaauauguguacagacugagaaggcaggaauauaaaguaauugaaaucucu

SEQ ID NO: 74233 - RNA, 64 nt, Human
uuagacacauuccuguaccugagaacaaccacauaggcaggaccagauccacaucgugcagucg

SEQ ID NO: 74234 - RNA, 64 nt, Human
ugugugccugcaguccuagcuacuugggugguugaggcaggaggauuguuugagcgagggaagu

SEQ ID NO: 74235 - RNA, 64 nt, Human
ccaaggggcagauggccagaugcacugcccaguaaggcaggaagccaaagaggcagugcccagc

SEQ ID NO: 74236 - RNA, 64 nt, Human
ccuggcagauugggguauccacccagucauguaaaggcaggagaccugcucugggccugacuca

SEQ ID NO: 74237 - RNA, 64 nt, Human
cuccucuggaacugggauuaaacagauacccaagaggcaggaaaaacgcgagugucugaagacc

SEQ ID NO: 74238 - RNA, 64 nt, Human
cacgcaccaguaaucccagcuacuugggaggcugaggcaggagaaucacuugaacccgggaggc

SEQ ID NO: 74239 - RNA, 64 nt, Human
ugcaugccuguaauccaagauacucaggaggcugaggcaggagaaucgcuugaaccugggaggc

SEQ ID NO: 74240 - RNA, 64 nt, Human
cgggcaccuguaaucccagcuacuugggagacugaggcaggagaaucgcuugaaccugggaguu

SEQ ID NO: 74241 - RNA, 64 nt, Human
gauugauagcagaacagcucuuguuggucugagaaggcaggauaagugaccacauauuuaugcc

SEQ ID NO: 74242 - RNA, 64 nt, Human
uuuugggcuccuuuuucucccucuggaucaaaguaggcaggaccaugggaccaggucuuggagc

SEQ ID NO: 74243 - RNA, 64 nt, Human
caggcgccuguagucccagcuacuugggaggcugaggcaggagaauggugugaaccugggaggc

SEQ ID NO: 74244 - RNA, 64 nt, Human
ggacuccuuggguccuggcagugcaugugccagcaggcaggacaaacucuguguaccugugccc

SEQ ID NO: 74245 - RNA, 64 nt, Human
gagagaccucguggcagcaugugaucuggaaggcaggcaggacgggggcguuggggagccaaag

SEQ ID NO: 74246 - RNA, 64 nt, Human
auauagaaauaggggaggagcucaggucugcgccaggcaggaagaaggcaggcuucuggcuucc

SEQ ID NO: 74247 - RNA, 64 nt, Human
caguggcuucucagagccuggggcauacagaagaaggcaggaguugauuuuuguguuggguuug

SEQ ID NO: 74248 - RNA, 64 nt, Human
ccugugaagggacacagagaacaggcaggaggaaaggcaggagccaguccgugcaggcacacuc

SEQ ID NO: 74249 - RNA, 64 nt, Human
acggggugucauccugugaagggacacagagaacaggcaggaggaaaggcaggagccaguccgu

SEQ ID NO: 74250 - RNA, 64 nt, Human
cacggggagcucagagguccaugccgaggagaccaggcaggaccucccgaggcugcgccccggc

SEQ ID NO: 74251 - RNA, 64 nt, Human
ugcgcaacuguagucccagcuacucgggaggcugaggcaggagaaucucuugaaccuggcaagu

SEQ ID NO: 74252 - RNA, 64 nt, Human
caucuuugacguggagcugcucaacuuagagugaaggcaggaaggaacucaagguggcuggaga

SEQ ID NO: 74253 - RNA, 64 nt, Human
agggacaggcaggcagcaggaggggcgagcugggaggcaggaggcagcggccugucagucugca

SEQ ID NO: 74254 - RNA, 64 nt, Human
ugaacaaggugauaucuucauagugggcuauuacaggcaggaaaauguuuuaacugguuuacaa

SEQ ID NO: 74255 - RNA, 64 nt, Human
aaaauccaucaauacuugugucauucccuguaaaaggcaggagacaugugauuaugaucaggaa

SEQ ID NO: 74256 - RNA, 64 nt, Human
ccagcuacuguaaucucagcuacuugggaggcugaggcaggagaauugccucaaccgggaggcg

SEQ ID NO: 74257 - RNA, 64 nt, Human
ggaaaugaauuacaggcagcuguucaaacucuucaggcaggauuccuguggacuuugagauuca

SEQ ID NO: 74258 - RNA, 64 nt, Human
agaucccuuguagucccagcuacucgggaggcugaggcaggagaauagcuugaacccgggaggu

SEQ ID NO: 74259 - RNA, 64 nt, Human
cacacgccuguaaucccagcuacaccugaggcugaggcaggagaauugcuugaaccggggagac

SEQ ID NO: 74260 - RNA, 64 nt, Human
cucacgccacuaaucccaacauuuuaggaggccuaggcaggagcaaucacuugugccugggagu

SEQ ID NO: 74261 - RNA, 64 nt, Human
uuauccuugugggcucaguuuaaucacaagaaggaggcaggaagggagagucagagagagaaug

SEQ ID NO: 74262 - RNA, 64 nt, Human
agucuguaauaagcuuagaaguucagauaaaucuaggcaggauacugcauuuuugugguuuuaa

SEQ ID NO: 74263 - RNA, 64 nt, Human
caggcgccuguggucccagcuacucgggaggcugaggcaggagaauagugugaacccaggaggc

SEQ ID NO: 74264 - RNA, 64 nt, Human
cacacaccuguagucccagauacuugggaggccaaggcaggaggauugcuugagaccuagcaau

SEQ ID NO: 74265 - RNA, 64 nt, Human
cacaugccaguaaccccagcuacuagggaggcugaggcaggagaaucacuugaacccgggaggc

SEQ ID NO: 74266 - RNA, 64 nt, Human
uagguauuuuugcuacuuuuucauuuucuggggaaggcaggaggcagaaagacggguguuuuau

SEQ ID NO: 74267 - RNA, 64 nt, Human
ugggcgccuguagucccagcuacucaggaggcuaaggcaggagaaucucuugaacccgagaggu

SEQ ID NO: 74268 - RNA, 64 nt, Human
cauauaccuguaaccccaacuacuuggguggcugaggcaggagaauuguuugaaccugggaggc

SEQ ID NO: 74269 - RNA, 64 nt, Human
ggcuuggcucccccagcucugagcgugggggcauaggcaggaccccccuuguggugccauauaa

SEQ ID NO: 74270 - RNA, 64 nt, Human
guugaaagcccaguuucugacacacaggccuggcaggcaggacuccuugugcucccagcagcuc

SEQ ID NO: 74271 - RNA, 64 nt, Human
gccagacgggccucauggucugcugugcagagagaggcaggaaggaucccugaagagucuugga

SEQ ID NO: 74272 - RNA, 64 nt, Human
ugggcgccuguaaucccagccacuccagaggcugaggcaggagaaucgcuugaaccugcgaggc

SEQ ID NO: 74273 - RNA, 64 nt, Human
ugaucuuuaacaaauguuuuaagcaauuuuaaaaaggcaggauguuauugacauuauacacuga

SEQ ID NO: 74274 - RNA, 64 nt, Human
cgcacaccuguaaucccagcuacuugggaggcugaggcaggagaauugcuugaaccugggaggu

SEQ ID NO: 74275 - RNA, 64 nt, Human
auucuuuuucuuaaaagagagaggugacgaaggaaggcaggaaugaagaagcacugcguggccu

SEQ ID NO: 74276 - RNA, 64 nt, Human
ccuugaggaaugggaaaaugaaccucagcccauuaggcaggaaaaguugauauuuaauaaacaa

SEQ ID NO: 74277 - RNA, 59 nt, Human
gucgucagaagauauacugacccccaugcaggcaggauguggggggcaagaucaggaga

SEQ ID NO: 74278 - RNA, 64 nt, Human
acugauucagggccccugaagugaccccagcuccaggcaggaaaccccgagaaggaauggugcu

SEQ ID NO: 74279 - RNA, 64 nt, Human
cgugcaccuguagucccagcuacuagauaggcugaggcaggagaauugcuugaauccgggaggc

SEQ ID NO: 74280 - RNA, 64 nt, Human
cauaugccuguaaucccaacuacucagaaggccgaggcaggagaauuacuugaacgcaggagaa

SEQ ID NO: 74281 - RNA, 64 nt, Human
cucacaccugcaaucccagcaccuuaggaggccgaggcaggaggauccuugaggucaggaguuc

SEQ ID NO: 74282 - RNA, 64 nt, Human
uucaugccuauaaucccagugcuuuacaaggcugaggcaggaggcucucuugagaauaggaguu

SEQ ID NO: 74283 - RNA, 64 nt, Human
cucugguccaaguuguaugugcacugaacuaaucaggcaggaaaaaagcccagccacugucuca

SEQ ID NO: 74284 - RNA, 64 nt, Human
cuccucuccuuggccguggcuucugucugugaggaggcaggagcuggggagugggagccuauga

SEQ ID NO: 74285 - RNA, 64 nt, Human
auaaauuuuuuuuguuucauauugaugugugucuaggcaggaccuguggccaaguucuuaguug

SEQ ID NO: 74286 - RNA, 64 nt, Human
cgggugccuguaaucccagcuacucaggaggcugaggcaggagaaucgcuugaaucugggaggc

SEQ ID NO: 74287 - RNA, 64 nt, Human
cacgugccuguagucccagcuacuccggaggcugaggcaggagaauggcgugaacccgggaggc

SEQ ID NO: 74288 - RNA, 64 nt, Human
cacacaccuguagucccagguacuugggaggcugaggcaggaggaucgcuugaacccaggaagc

SEQ ID NO: 74289 - RNA, 64 nt, Human
ugcgugccuguagucccagcuacuugggaggcugaggcaggagaaucgcuugaaccugggaggc

SEQ ID NO: 74290 - RNA, 64 nt, Human
augaaagauuaaccuuccccacuggugaugaccuaggcaggaaucaucucuugaaauaaauacu

SEQ ID NO: 74291 - RNA, 64 nt, Human
agaagcaccugcuccggcauccagcgcugccuggaggcaggaaggagaggcagggcaggacacg

SEQ ID NO: 74292 - RNA, 64 nt, Human
gggagaaucagggcucgggaagccacgccugggaaggcaggacacaggacacagcagcuuucuu

SEQ ID NO: 74293 - RNA, 64 nt, Human
aguccaggcuggagagguuggggccgggguagggaggcaggagccaugucaguucugaaggagg

SEQ ID NO: 74294 - RNA, 64 nt, Human
gccaccgugccuggcugauucagcauuuuuuaucaggcaggaccagguggcacuuccaccucca

SEQ ID NO: 74295 - RNA, 64 nt, Human
cagggacacagggcaagaccagccuugcuuauggaggcaggacaccacaaucuggcccauggcu

SEQ ID NO: 74296 - RNA, 64 nt, Human
aaagcaucucucuuuuccugucuuuuaucccaggaggcaggacaacacugagacugggauaugu

SEQ ID NO: 74297 - RNA, 64 nt, Human
cgcaugccuguaaucccagcuacuagagaggcugaggcaggagaaucacuugaaucccugaggc

SEQ ID NO: 74298 - RNA, 64 nt, Human
gauucacagugugaaucuuggugucuacguuaccaggcaggaaggcugagaggagagagacucc

SEQ ID NO: 74299 - RNA, 64 nt, Human
aggcagggauacaaggcagucuggaaagaagggaaggcaggaguuucagucuugggcucuugac

SEQ ID NO: 74300 - RNA, 64 nt, Human
uacuuucccugcacccaucugcucaccagaucucaggcaggaaagccccucucuguugaaguca

SEQ ID NO: 74301 - RNA, 64 nt, Human
cagacugaaaggagggccugggccagcuuugaaaaggcaggaugaaauggaaaggucaccacac

SEQ ID NO: 74302 - RNA, 64 nt, Human
acuccucgccuggcuaauuuuuuauuuuuuguacaggcaggaucuugccaccuugcccaggcug

SEQ ID NO: 74303 - RNA, 64 nt, Human
cgggcaccuguagucccagcuacucaggaggcugaggcaggagaagggugggaacccgggaggc

SEQ ID NO: 74304 - RNA, 64 nt, Human
cacacaccuguagucccagcuacuugggaggcugaggcaggagaaucacaaggauugaaacuau

SEQ ID NO: 74305 - RNA, 64 nt, Human
gcagagggauauuugccuccuaaaucuuuggcagaggcaggaguaaggaagccauuucuggagu

SEQ ID NO: 74306 - RNA, 64 nt, Human
uucagaaaauagaugugguauugcucugaggaccaggcaggaggaacucuacaaccugaguuug

SEQ ID NO: 74307 - RNA, 64 nt, Human
gugugugccuauagucccacuacuuguggggcuaaggcaggaggaucacuugagccccggaggu

SEQ ID NO: 74308 - RNA, 64 nt, Human
cucacaccuguaauccuugcauuuuggaaggcugaggcaggaggaucacuuuaggccuggugug

SEQ ID NO: 74309 - RNA, 64 nt, Human
cucgcaucugggcaauguugacauuugagguggcaggcaggaugccugccuucuaauauauuug

SEQ ID NO: 74310 - RNA, 64 nt, Human
ugcacaucuguaguccuaccaacuugggaggcugaggcaggagaaucgcuugagccccaggcuu

SEQ ID NO: 74311 - RNA, 64 nt, Human
ugcccauucucaacaaacacucuugucuggagacaggcaggacaauggagagcuaccuuguccu

SEQ ID NO: 74312 - RNA, 64 nt, Human
uguuuccuuauucaagagaaugaauaaaacauuuaggcaggagacuuucuauugugugccccgu

SEQ ID NO: 74313 - RNA, 64 nt, Human
acaagcagaggcccccucgaugggagggaguggcaggcaggagaagguggcgcugccaggugcc

SEQ ID NO: 74314 - RNA, 64 nt, Human
ugugugccuguaauuccagcuacucgggaggcugaggcaggaagaaucacuugaacccaggagg

SEQ ID NO: 74315 - RNA, 64 nt, Human
gugugaugugucugaacuaauaaaguggcugaagaggcaggauggcuuggggcugccugggccc

SEQ ID NO: 74316 - RNA, 64 nt, Human
ggcauaauauaaaauguaucuccaugggaggcugaggcaggagaaucaguugaaccugggaggc

SEQ ID NO: 74317 - RNA, 64 nt, Human
uacauaccugcgguuccagcuacucaagaggcugaggcaggaggacugcuugagcccaggaguu

SEQ ID NO: 74318 - RNA, 64 nt, Human
ggacuaaaaccauuuuuuuugcacccaaaaaaaaaggcaggaaaaugaucaucagaaacuaaau

SEQ ID NO: 74319 - RNA, 64 nt, Human
uucgggguccugucaucacauccccugggaggggaggcaggaggaggccgagggccccaggaug

SEQ ID NO: 74320 - RNA, 64 nt, Human
ucaucugcuguggucccaguuacucaggaggcugaggcaggaggaucacuugagcccaggaggu

SEQ ID NO: 74321 - RNA, 64 nt, Human
ugugccccuccugggugcucaccgccugcuacacaggcaggaaugcgguugggaggcaggucgg

SEQ ID NO: 74322 - RNA, 64 nt, Human
cgugcgccuguagucccagcuacuugggaggcugaggcaggagaaucgcuuaaaccugggagac

SEQ ID NO: 74323 - RNA, 64 nt, Human
ugggcacccguaaucccagcuacucaggaggcugaggcaggagaauugcuugaacccaggaagc

SEQ ID NO: 74324 - RNA, 64 nt, Human
caguugccuguaauccuagcuacucaggaggcugaggcaggagaaucgcuugaaccugggaggu

SEQ ID NO: 74325 - RNA, 64 nt, Human
cuggcugggcacaguggcucacuuugggaggcugaggcaggaaggcugcuggaaacugagaguu

SEQ ID NO: 74326 - RNA, 64 nt, Human
uauuuaaacagugguucuagugugggaccaagagaggcaggagcugggucuuggggcagcuuua

SEQ ID NO: 74327 - RNA, 64 nt, Human
gagaagcuggacugagcgcagggccuccuugcccaggcaggaggcuggggugcugugugggggc

SEQ ID NO: 74328 - RNA, 64 nt, Human
gugcaugccuguaaucccagcuacucagaggcugaggcaggagaauugcuugaaccugggaggc

SEQ ID NO: 74329 - RNA, 64 nt, Human
uuauacugagccaugugucagaggauggggagacaggcaggaccuugucucaccugugggcugg

SEQ ID NO: 74330 - RNA, 64 nt, Human
cccuacugaggccagcugagguacaggcaggggcaggcaggaccaccagcagggggcugccucu

SEQ ID NO: 74331 - RNA, 64 nt, Human
gggcaggagacccuuaggauagauugugggacccaggcaggaacagguguccacaagaacucag

SEQ ID NO: 74332 - RNA, 64 nt, Human
aagaaccaaaacucucuucuugauuuucagcuaaaggcaggagacuacuuuccaacuccuuuug

SEQ ID NO: 74333 - RNA, 64 nt, Human
caggcaccuguaaucccagcuacucgggaggcugaggcaggagaauugcuugaacuggggaggc

SEQ ID NO: 74334 - RNA, 64 nt, Human
cacuucugggucaauggaauaauaaauuaaguacaggcaggaauuugguugggagcaucuugua

SEQ ID NO: 74335 - RNA, 64 nt, Human
aagugcuuugugcccagaggccacugaagaugguaggcaggauucuuuccaagaacccaaacug

SEQ ID NO: 74336 - RNA, 64 nt, Human
gcugguuggcauuugcuggccuggcagggggugaaggcaggaguugggggcaggucaggaccag

SEQ ID NO: 74337 - RNA, 64 nt, Human
uuggacugugagccacuuccacuucucgccccccaggcaggagcacccucacuccaagggcuug

SEQ ID NO: 74338 - RNA, 64 nt, Human
cgugguggugcaugccuguaaucucggaaggcugaggcaggaggaucauuugagcucaugaggg

SEQ ID NO: 74339 - RNA, 64 nt, Human
uuaacuuugccuaaaaauauugcagugacuuuuuaggcaggagugccaaaggacacuaugaacu

SEQ ID NO: 74340 - RNA, 64 nt, Human
cacaugcuuguaguccuagcuacuugggaggcugaggcaggaggauugcuugagucuaggaguu

SEQ ID NO: 74341 - RNA, 64 nt, Human
gugaagcagagcugucacaacuuuuccugucuacaggcaggaaaaccaggauggagaagggcaa

SEQ ID NO: 74342 - RNA, 64 nt, Human
gcaucuaucagagucccagcuacucaggaggcugaggcaggagaaucgcuugaaccugggaggu

SEQ ID NO: 74343 - RNA, 64 nt, Human
uguugggcuccaugcaagaacuuggaagaaaaacaggcaggaaugcauuugcauaaugacccag

SEQ ID NO: 74344 - RNA, 64 nt, Human
ugggugccuguagucccagcuacucuggaggcugaggcaggagaauggcgugaacccgggaggc

SEQ ID NO: 74345 - RNA, 64 nt, Human
cacauuccuguaaucccagcuacucgggaggcugaggcaggagauucgccugaacccgggaggc

SEQ ID NO: 74346 - RNA, 64 nt, Human
agaauaaacccagagacaaagaacccucggacucaggcaggacauggcaggauguucuggcaca

SEQ ID NO: 74347 - RNA, 64 nt, Human
cucacaccuguaaucccagcacuuugggaggcugaggcaggaggauuguuugaggccagaaauu

SEQ ID NO: 74348 - RNA, 64 nt, Human
caggcaccuguaaucccagcuacucgggaggcugaggcaggagaauugcuugaaccaagguggc

SEQ ID NO: 74349 - RNA, 64 nt, Human
caggugccuguaaucccagcuacuugggacacugaggcaggagaaucacuugaacccgggaggc

SEQ ID NO: 74350 - RNA, 64 nt, Human
guauuguagauacuacacuaauuuccaacauaagaggcaggaagaguuuugauucuauccuuuu

SEQ ID NO: 74351 - RNA, 64 nt, Human
gccccgcccugccaugagguuuuccuccccaggcaggcaggaggccgcggggagcacguggaaa

SEQ ID NO: 74352 - RNA, 64 nt, Human
ugggugccuguaaucccagcuacucgggaggcuaaggcaggagaaucacuugaaccugggaggg

SEQ ID NO: 74353 - RNA, 64 nt, Human
cgugugccuguaaucccagcuacuugggaggcugaggcaggagaaccgcuuaaaccugggaggu

SEQ ID NO: 74354 - RNA, 64 nt, Human
cuguaaaguggguuagaaauauuuauaauuuuacaggcaggacagcauuugacuuuuauuuaaa

SEQ ID NO: 74355 - RNA, 64 nt, Human
cgggcaccuguaaucccagccacuugggaggcugaggcaggagaauugcuugaacccgggaggu

SEQ ID NO: 74356 - RNA, 64 nt, Human
guucaguuagagagacguauuuaaggagaagggaaggcaggauacccagaacuagcagccuagg

SEQ ID NO: 74357 - RNA, 64 nt, Human
gauaugccugcaggcccagcuacacgggaggccaaggcaggaggaucacuugaaaucaagaguu

SEQ ID NO: 74358 - RNA, 64 nt, Human
auggucaaagggugcaaaaucucacacaagacugaggcaggagaauaggguacagagauaggga

SEQ ID NO: 74359 - RNA, 64 nt, Human
cacagagaccaaggcccaugagcucauagggcugaggcaggauuuggaaucaggccaugucuuc

SEQ ID NO: 74360 - RNA, 64 nt, Human
ggcgugccuguagucccauguacuugggaggcugaggcaggaaaauucuugaacccaggagacg

SEQ ID NO: 74361 - RNA, 64 nt, Human
cccaagcuaccuccucacccugcaucuuggagggaggcaggaaauuucuuuugaaauaaagugc

SEQ ID NO: 74362 - RNA, 64 nt, Human
caggcgccuguaaucccagcuacucaggaggcugaggcaggagaauugcuugaacccgggaggu

SEQ ID NO: 74363 - RNA, 64 nt, Human
uuccugggaaggccgcggauuccggcccuggaagaggcaggauccuggagcaguuuugugaggc

SEQ ID NO: 74364 - RNA, 64 nt, Human
ccggcgccuguagucccagcuacucaugagguugaggcaggagaauggcgugaaccgaggaggc

SEQ ID NO: 74365 - RNA, 64 nt, Human
cgggcaccuguaaucccaguuacuugggaagcugaggcaggagaaucccuugaaccugggaggc

SEQ ID NO: 74366 - RNA, 64 nt, Human
uguguaccuguagucccagcuacccaggaagcuaaggcaggagaaucgcuugaauccaggaggc

SEQ ID NO: 74367 - RNA, 64 nt, Human
gccuccuggcuccagaggcagcugggcugggccaaggcaggaaggcgcccccauguguguggcc

SEQ ID NO: 74368 - RNA, 64 nt, Human
gccgucaggguggcuggggcuggcacgggugucgaggcaggaaggauuguuucuggugacugca

SEQ ID NO: 74369 - RNA, 64 nt, Human
guucgcucauggaacuauaacaccuuagagcaagaggcaggaauuccagggccuccugccccuc

SEQ ID NO: 74370 - RNA, 64 nt, Human
gugacgcgcccccaugcccccaccccaccacaagaggcaggagggcccagucaugacccucguc

SEQ ID NO: 74371 - RNA, 64 nt, Human
caggcaccuauaaugccagcuacucgggaggcugaggcaggagaaucgcuugaacccgggaggc

SEQ ID NO: 74372 - RNA, 64 nt, Human
cccuaaggcugagggaaagaauccuaacaaggaaaggcaggaaugaggguuucagaauucacug

SEQ ID NO: 74373 - RNA, 64 nt, Human
ggagcagucaguacauaccaguuucugauguuucaggcaggagugggguaaauaagugugacca

SEQ ID NO: 74374 - RNA, 64 nt, Human
cgcauaccuguaauuccagcuacucaggaggcugaggcaggagaauugcuugaacccaggaggu

SEQ ID NO: 74375 - RNA, 64 nt, Human
cgcaugccugcaaucccagcuacuuggaaggcugaggcaggagaaucacuugaacccaggaggu

SEQ ID NO: 74376 - RNA, 64 nt, Human
cacaugcugguaaucucagcuauugaggaggcugaggcaggagaauugcuugaacccgggaggc

SEQ ID NO: 74377 - RNA, 64 nt, Human
ccucuggcugugggaccacagaugagucuuucagaggcaggauccauuuuugcagauagcuaug

SEQ ID NO: 74378 - RNA, 64 nt, Human
cacaugccuguggucucagcuacuugggaggcugaggcaggagaaucauuugagcccaggaggu

SEQ ID NO: 74379 - RNA, 64 nt, Human
cgggcgccuguagucccagcuacuugggaggcugaggcaggagaauggcgugaacccgggaggc

SEQ ID NO: 74380 - RNA, 64 nt, Human
ugaaagaguaaaggaaaugauugaggagugaggaaggcaggaagagagcaugagaggaaagaaa

SEQ ID NO: 74381 - RNA, 64 nt, Human
caggauggugucucuucuuuagaacagggaaaauaggcaggaagcccaauugcuggaguacuua

SEQ ID NO: 74382 - RNA, 64 nt, Human
uccugugagcaaagugcagguuaugcaagucgccaggcaggaggccauuccaggagugggauua

SEQ ID NO: 74383 - RNA, 64 nt, Human
uuaugucuauaaucccagcacuuuugagaggccaaggcaggaggauugcuugaguucaggaguu

SEQ ID NO: 74384 - RNA, 64 nt, Human
ugcaugccuguagucccagcuacuugggaugcugaggcaggaagaauugcuugaaccugggagg

SEQ ID NO: 74385 - RNA, 64 nt, Human
cacacgccuguaaucccagcuacucagauggcugaggcaggagaacuacuugaaccugggaggu

SEQ ID NO: 74386 - RNA, 64 nt, Human
caggcaccuguagucccagcuacucgggaggcugaggcaggagacuggcgugaacccaggaggc

SEQ ID NO: 74387 - RNA, 64 nt, Human
cgggugccuguaaucccagcuacucgggaggcugaggcaggagaaucgcuugaacccaggaggc

SEQ ID NO: 74388 - RNA, 64 nt, Human
gucugauuuuugaaacacauaagcuuugcucuuuaggcaggaaugaucuuuucaaaucauuagc

SEQ ID NO: 74389 - RNA, 64 nt, Human
cgcacaccuguagucccagcuacuccggaggcugaggcaggagaaucucuugaaccugggaggc

SEQ ID NO: 74390 - RNA, 64 nt, Human
cgcacaccuguaaucccagcuacucaggaagcugaggcaggaaaaucgcuugaaccugggaggu

SEQ ID NO: 74391 - RNA, 64 nt, Human
uccaugccuauaaucccggcuacucgggaggcugaggcaggagaaucaccugaacccgggaggc

SEQ ID NO: 74392 - RNA, 64 nt, Human
cgcaugccuguagucccaacuacuagggaggcugaggcaggagaaucacuugaacccaggaggu

SEQ ID NO: 74393 - RNA, 64 nt, Human
cacaugcuuguaaucccagcuacucgggaggcugaggcaggagaaucgcuugaacccaggaggu

SEQ ID NO: 74394 - RNA, 64 nt, Human
cgggcgccuguagucccagcuacucuggaggcugaggcaggagaauggcaugaacccaggaggc

SEQ ID NO: 74395 - RNA, 64 nt, Human
cacgcgccuguagucccagcuacucaggaggcugaggcaggagaauuacuugaacccgggaggc

SEQ ID NO: 74396 - RNA, 64 nt, Human
ucuaggccuggaggccucucucgcagagcauggaaggcaggagaggugggcuggccuagggcag

SEQ ID NO: 74397 - RNA, 64 nt, Human
cucacgccugucaucccagcacuuugggaggccgaggcaggaggaucaccugaggucaggaguu

SEQ ID NO: 74398 - RNA, 64 nt, Human
ccuguaagaaauacaggauuugauaauauuuugaaggcaggaaaaacccaaauuguuucuucuu

SEQ ID NO: 74399 - RNA, 64 nt, Human
ugcaugccugugauuccagcuacuugggagguugaggcaggagaaucauuugaacucaggaggc

SEQ ID NO: 74400 - RNA, 64 nt, Human
cucguuguucucaccaggaaaguacacgggccugaggcaggauugggccacagacagccucuca

SEQ ID NO: 74401 - RNA, 64 nt, Human
ucagguccucugcacguguacacaugacuaggauaggcaggaguaagggugggucuggguauau

SEQ ID NO: 74402 - RNA, 64 nt, Human
ugggcgccuguagucccagcuacucgggaggcugaggcaggagaauggcaugaacccgggaggc

SEQ ID NO: 74403 - RNA, 64 nt, Human
uggaggaaauagucggauaaguaggugacgugaaaggcaggaccuggucaccccagcaagugcu

SEQ ID NO: 74404 - RNA, 64 nt, Human
cacauaccuguaaucccagcuacucaggaggcugaggcaggagaauuugcuugauccugggagg

SEQ ID NO: 74405 - RNA, 64 nt, Human
cacaugccuguaaugccagcuacucgggaggcugaggcaggagaauugcuugaacccgggaggc

SEQ ID NO: 74406 - RNA, 64 nt, Human
ugcaugccuguaaucccagcuacuagggaggcugaggcaggagaauugcuugaaccugggagac

SEQ ID NO: 74407 - RNA, 64 nt, Human
caugugccuguagucuuagcuacuugagaggcugaggcaggagaaucgcuugaaccugggaggc

SEQ ID NO: 74408 - RNA, 64 nt, Human
cgggcgccugcagucccagcuacucaggaggcugaggcaggagaauggcgugaaccugggaggc

SEQ ID NO: 74409 - RNA, 64 nt, Human; identical to SEQ ID NO: 74384

SEQ ID NO: 74410 - RNA, 64 nt, Human
gaagacuggaacauaauaugcaagauugguaaacaggcaggagccagguugugcagugcugugu

SEQ ID NO: 74411 - RNA, 64 nt, Human
cauuaggaaaaacaaacuacccgcaucuucuguuaggcaggaucuguacaauaauaauuaugag

SEQ ID NO: 74412 - RNA, 64 nt, Human
cgggugccuguauugccagcuacucggaaggcugaggcaggagaauggcgugaaccugggaggu

SEQ ID NO: 74413 - RNA, 64 nt, Human
gaggcugaggggugccagcgugggugggcuucucaggcaggaggacaucuuggcagugcuggcu

SEQ ID NO: 74414 - RNA, 64 nt, Human
guccucuggcagaacagaugccacggaguaucacaggcaggaaaggguggccuucuuggguagc

SEQ ID NO: 74415 - RNA, 64 nt, Human
cgcaugccuguaauccuagcuacuugggagucugaggcaggagaauugcuugaacucaggaggu

SEQ ID NO: 74416 - RNA, 64 nt, Human
cucaugcuuguggucccagcuguucaggaggaugaggcaggaggaucucuugagcccaggaggu

SEQ ID NO: 74417 - RNA, 64 nt, Human
ccucugcccucuacucgugccaggcccacuugccaggcaggagcccuccccaagccuucagggc

SEQ ID NO: 74418 - RNA, 64 nt, Human
ugggugccuguaaucccaguuacuugggaggcugaggcaggagaaucgcuugaaccugggaggu

SEQ ID NO: 74419 - RNA, 64 nt, Human
cugcccaagagagccugcuacagacacaaccccgaggcaggagagugacuguggccaaccgagc

SEQ ID NO: 74420 - RNA, 64 nt, Human
acccccaguuaauauuuuuuuuaauuuuuuuuagaggcaggaucuugcuguccaauuuuuuuua

SEQ ID NO: 74421 - RNA, 64 nt, Human
caggugccuguagucccagcuacucuggaggcugaggcaggagaauggcgugaacccaggaggc

SEQ ID NO: 74422 - RNA, 64 nt, Human
guaggggccuguaacccagcuacucgugaggccaaggcaggagaauugcuugagccugcagcag

SEQ ID NO: 74423 - RNA, 64 nt, Human
cgggcaccuguagucccagcuacucgggaggcugaggcaggagaauggcaugaacccggaaggc

SEQ ID NO: 74424 - RNA, 64 nt, Human
ugggcaccuauaauaccagcuacuccggaggcugaggcaggagaaucgcuugaacccaggaggc

SEQ ID NO: 74425 - RNA, 64 nt, Human
agacacagcaggaaggggccugagaggcugacagaggcaggaugggugcaaggcagggguggag

SEQ ID NO: 74426 - RNA, 64 nt, Human
uccccuucucaccuugaggagauaaaaauucucuaggcaggaaaagaaauggaagccaguuaga

SEQ ID NO: 74427 - RNA, 64 nt, Human
gcuucagagcugagagugccuggggccacaggaaaggcaggaacaggaccuucucucucccagg

SEQ ID NO: 74428 - RNA, 64 nt, Human
guacuagguuggacagcccccuucgguuacaggaaggcaggaggggugaguccccuacucccuc

SEQ ID NO: 74429 - RNA, 64 nt, Human
ccagugcagaagccucucucuccagccuuuccccaggcaggaguugggguugggggccucuguc

SEQ ID NO: 74430 - RNA, 64 nt, Human
cgcgugccuguagucccagcuacucgagaggcuaaggcaggaaaaucgcuugaacccaggaggc

SEQ ID NO: 74431 - RNA, 64 nt, Human
gcagugagcaggguggggucugggagggggugagaggcaggaaugggggucagaagaaguggga

SEQ ID NO: 74432 - RNA, 64 nt, Human
ugcacgccuguaaucccagcuacucaggaggcuaaggcaggagaaucacuugaacccaggaggc

SEQ ID NO: 74433 - RNA, 64 nt, Human
cucacaccuauaaucccaauacuuugggaggccaaggcaggaggauugcuugaggucaggaguu

SEQ ID NO: 74434 - RNA, 64 nt, Human
cgggcaucuguagucccagcuacucaggaggcugaggcaggagaaucacuugaacccuggaggu

SEQ ID NO: 74435 - RNA, 64 nt, Human
uaauaacaaaucaaccccagcaccaaacccacccaggcaggaagaagccgccccuccucugggg

SEQ ID NO: 74436 - RNA, 64 nt, Human
agaauauguuuuuaacccugagaucaaguuuaguaggcaggacuugaucucaaguggucacaaa

SEQ ID NO: 74437 - RNA, 64 nt, Human
cgggcaccuguaaucccaccuacucgggaggcugaggcaggagaauugcuugaauccgggaagc

SEQ ID NO: 74438 - RNA, 64 nt, Human
uaguucccuaccaauaauuugaagccuuugcuuuaggcaggaggcauguggcuaugaauaggga

SEQ ID NO: 74439 - RNA, 64 nt, Human
uuaucugugccuagacccaaacugaaagugucucaggcaggaaguuccaagggauguauguuua

SEQ ID NO: 74440 - RNA, 64 nt, Human
ugcgugccugcaaucccagcuacucaggaagcugaggcaggagaaucgcuugaaccugggaggu

SEQ ID NO: 74441 - RNA, 64 nt, Human
gcgcagcccuggcugaggucacuaggcuggccagaggcaggacaggcagucuugaauuuccucu

SEQ ID NO: 74442 - RNA, 64 nt, Human
ccaggagccccccaggcugccugccugcgugcagaggcaggagaggaccguggagcguuuccgg

SEQ ID NO: 74443 - RNA, 64 nt, Human
gacaauccaggggacauaauagcagugugcaugcaggcaggaggcagggaaaugugaaauggca

SEQ ID NO: 74444 - RNA, 64 nt, Human
cccugucuucuuuccauccccuagaaauccugggaggcaggauccaauaauuuuccugugacac

SEQ ID NO: 74445 - RNA, 64 nt, Human
caugcaccugucaucccagcuacucgggaggcugaggcaggagaaucgcuugaacccgggaggc

SEQ ID NO: 74446 - RNA, 64 nt, Human
cagcgagucuuccccguguguccucaucugcggcaggcaggagagggggagcaaacaggaaauu

SEQ ID NO: 74447 - RNA, 64 nt, Human
gaccuccguccucuccccagccuggcacaggccgaggcaggaggagcccggacggcggguagga

SEQ ID NO: 74448 - RNA, 64 nt, Human
uuccuccaguaaguaauacugaagagcaaaagagaggcaggauuggggucacagccgcuucuuc

SEQ ID NO: 74449 - RNA, 64 nt, Human
gagccucagauuuccucaccugugaaaugggcugaggcaggaaaugggaaaaaguguuagugcu

SEQ ID NO: 74450 - RNA, 64 nt, Human
auuccugggaaccuaacgaggagagcccaggccuaggcaggaggccuggaacccucuuggcuaa

SEQ ID NO: 74451 - RNA, 64 nt, Human
ugggcacugguaaucccagguacucaagaggcugaggcaggagaaucgcuugaaccugggaggc

SEQ ID NO: 74452 - RNA, 64 nt, Human
cacgugccuguaaucccagcuacucaggaggcugaggcaggagaauugcgugaacccgggcccg

SEQ ID NO: 74453 - RNA, 64 nt, Human
caaaacaauagcaguagggcagaaacuugaaagaaggcaggagaucauggugacaguggauggg

SEQ ID NO: 74454 - RNA, 64 nt, Human
caggcaccuguaaucccagcuacucgggaggcugaggcaggagaaucgcuugaaccuagaaggc

SEQ ID NO: 74455 - RNA, 64 nt, Human
uuuuuuuuugagacagagucuugcucuuuugcccaggcaggaaugcaguggcgccaucucggcu

SEQ ID NO: 74456 - RNA, 64 nt, Human
uggggcaguuccccuucuuacgguucacgcucuaaggcaggauguggcuuaugagauacuuugc

SEQ ID NO: 74457 - RNA, 64 nt, Human
aaaagucauuuagaaggucagggggauaaucuagaggcaggauuuuggacauugugaaggaaau

SEQ ID NO: 74458 - RNA, 64 nt, Human
uugguugauguaaacgaaagugccauuuuaguaaaggcaggaaaaaaauagcaauauuugaguu

SEQ ID NO: 74459 - RNA, 64 nt, Human
uuacuaagcagauggucgggcacugcagggcaccaggcaggauccuagggcgccucuuauucug

SEQ ID NO: 74460 - RNA, 64 nt, Human
ggcaugccuauagucccagcuacuugagaggcugaggcaggaggauuguugagcccaggaguuu

SEQ ID NO: 74461 - RNA, 64 nt, Human
ucugaaacgagcguuagagugccgccuuagacggaggcaggaguuucguuagaaagcggacgcu

SEQ ID NO: 74462 - RNA, 64 nt, Human
gucucauggcaggcaccuguaaucccaucuacugaggcaggagaauugcuugacccaggaggca

SEQ ID NO: 74463 - RNA, 64 nt, Human
ugaaguagacagugaggauaauaacaaaguugcuaggcaggaaaaaaaaucaggaaaaaagcuu

SEQ ID NO: 74464 - RNA, 64 nt, Human
caggcaucuauaaucccagcuacuugggaggcugaggcaggagaauugcucaaacccgggaggc

SEQ ID NO: 74465 - RNA, 64 nt, Human
uauuaagucuaacaaguccaaaagcuggagugugaggcaggaggcuggaaacccaggaaagcug

SEQ ID NO: 74466 - RNA, 64 nt, Human
gaccccacaggccgucccggaucucagcggacacaggcaggagcgccccaucauuugacgguga

SEQ ID NO: 74467 - RNA, 64 nt, Human
cgugagccuguaguccuagcuacucaggaggcugaggcaggagaauagccugaaccugggaauc

SEQ ID NO: 74468 - RNA, 64 nt, Human
guguucacagaucuugugucucaaagguaggcagaggcaggaaaagcaaggagccagaauuaag

SEQ ID NO: 74469 - RNA, 64 nt, Human
guggauuaggcucuggcuucugugauggugcaagaggcaggauggucuccagacaccuucuugc

SEQ ID NO: 74470 - RNA, 64 nt, Human
ggugggcucagugaccccuuggaauggcugagggaggcaggagagccuggaaagauucgaagug

SEQ ID NO: 74471 - RNA, 64 nt, Human
gggcuuugcaggcaguccagcagcccacaccugcaggcaggaugcugucgucaaugagcugagg

SEQ ID NO: 74472 - RNA, 64 nt, Human
cacacaccuguaguaccagcuacucuggaggcugaggcaggaggaucacuugagcccaggagau

SEQ ID NO: 74473 - RNA, 64 nt, Human
cagagccaggggugaagggagaagcucuuggagcaggcaggaugcccaccgcugcuucagcugc

SEQ ID NO: 74474 - RNA, 64 nt, Human
ugucaguaccugagcuaguuuaccucaguuccgcaggcaggacagccgguccgggaacccugag

SEQ ID NO: 74475 - RNA, 64 nt, Human
ugcuggggacuggggacugggcagagacugagccaggcaggaaggcagcagccuucagccucuc

SEQ ID NO: 74476 - RNA, 64 nt, Human
gagccccacgcggcugcccggcaguaccuccuccaggcaggagccgggacugucacuuuggaga

SEQ ID NO: 74477 - RNA, 64 nt, Human
cucuugucuguaaucccagcgcucugggaggcugaggcaggaggaucacuugaggucaggaguu

SEQ ID NO: 74478 - RNA, 64 nt, Human
gaaaccaggagagauugcuugcuucacuuguacaaggcaggaacgguggcauggggugggggaa

SEQ ID NO: 74479 - RNA, 64 nt, Human
gccaccccgcugccccauggcuggcuggguggccaggcaggaagugcccagcccgagaggcugg

SEQ ID NO: 74480 - RNA, 64 nt, Human
augccuguuguagccccagcuacucaagaggcugaggcaggagaauugcuugaacgcgggaggu

SEQ ID NO: 74481 - RNA, 64 nt, Human
cuuaugccuguaauugcagcacuuuuagaggcugaggcaggagaauugguugaacccaggaggc

SEQ ID NO: 74482 - RNA, 64 nt, Human
ugcaugccuguaaucccagcuacucgggaggcugaggcaggagaauugcuugaacucgggaggu

SEQ ID NO: 74483 - RNA, 64 nt, Human
agcugggauugaaaguaaucagucgugagcaggcaggcaggagguccuguuagcccugccuucc

SEQ ID NO: 74484 - RNA, 64 nt, Human
cacgcgccuguaaucccagcuacucaggaggcugaggcaggagaacugcuugaaccugggaggc

SEQ ID NO: 74485 - RNA, 64 nt, Human
ugggcaccuguaaucccagcuacuugggaggcugaggcaggagaaucacuugaacccaggaggc

SEQ ID NO: 74486 - RNA, 64 nt, Human
ugccugaggagugcgagcuccacagcaacauggcaggcaggagguccucagaaggugucaggag

SEQ ID NO: 74487 - RNA, 64 nt, Human
agccucucuccccucccucgucccacccccacccaggcaggaagcccaggaggagugcgggcag

SEQ ID NO: 74488 - RNA, 64 nt, Human
cugggguuggggccucaccccucuggagggccggaggcaggagguggaaaccccaggggcuggc

SEQ ID NO: 74489 - RNA, 64 nt, Human
gaaugggcagugaauggccucuucugccagccacaggcaggaugcuccuugaucacggcauccc

SEQ ID NO: 74490 - RNA, 64 nt, Human
uccccuuuucccacugaagguuuuagaagcuaggaggcaggaaaaugugacccagaugggggug

SEQ ID NO: 74491 - RNA, 64 nt, Human
uccuggcccuggccuuucacuccaguucugggugaggcaggagcugggagggguggggaggggg

SEQ ID NO: 74492 - RNA, 64 nt, Human
caugcgccuagaaucccagcuacucggaaggccaaggcaggaggaccgcuugaguccagggauu

SEQ ID NO: 74493 - RNA, 64 nt, Human
ugcaugccuguaaucccagcuacuugggaggccgaggcaggagaauugcuugaacccgggaggc

SEQ ID NO: 74494 - RNA, 64 nt, Human
uaugugccuguagucccagguacucaggaggcugaggcaggaggauugccugagcccaggaggu

SEQ ID NO: 74495 - RNA, 64 nt, Human
cgggcgccuguagucccagcuauuugggaggcuaaggcaggagaauggcgugaacccgggaggc

SEQ ID NO: 74496 - RNA, 64 nt, Human
ugugcgccuguagucccagcuacucaggaggcugaggcaggagaauugcuugaacccgagaggc

SEQ ID NO: 74497 - RNA, 64 nt, Human
caugcaccuguagucccagcuaccugggaggcugaggcaggagaauugcuugaaccugggaggc

SEQ ID NO: 74498 - RNA, 64 nt, Human
cacaucugagcauuguuuuccucuuccuaaaauuaggcaggaaaaucagucuaguucuguuauc

SEQ ID NO: 74499 - RNA, 64 nt, Human
caggcaccuguaaucccagcuacucgggaggcugaggcaggagaaucgcuugaaccugggaggc

SEQ ID NO: 74500 - RNA, 64 nt, Human
gggacgagggccugggccgcggugaggccaccagaggcaggaguggcccugggggucccgggca

SEQ ID NO: 74501 - RNA, 64 nt, Human
guccuggggacacacucaccauaaacacauccccaggcaggacagaucggggaaggggugugua

SEQ ID NO: 74502 - RNA, 64 nt, Human
uguacccuaggcacguggcuccagcaagagccccaggcaggacaaagggagcaggcagcagcug

SEQ ID NO: 74503 - RNA, 64 nt, Human
cgcaugccuauaaucccagguacucaggaggcugaggcaggagaaucacuugaaccugggaggc

SEQ ID NO: 74504 - RNA, 64 nt, Human
cgugcaugugcagucccagcuacucaggaggcugaggcaggaggaucacagugaccuauaauga

SEQ ID NO: 74505 - RNA, 57 nt, Human
cuguaaucccagcauuuuaggaggccaaggcaggaggaucacuuggagccaggaguu

SEQ ID NO: 74506 - RNA, 64 nt, Human
uuccaggugcuagcucuggacagcagcugauuuuaggcaggaaaguuucuucaucguuguccuc

SEQ ID NO: 74507 - RNA, 64 nt, Human
uacaugccuguaaucccagcuacucaggaggcugaggcaggagaaucacuugaccccaggagac

SEQ ID NO: 74508 - RNA, 64 nt, Human
ugcacaccuguaaucccagcuacucuggaggcugaggcaggagaaucacuugaacccuggaggc

SEQ ID NO: 74509 - RNA, 64 nt, Human
ccagcaccuagacaagaucuuggcuuucccacagaggcaggaguccuaccucgggccaacacuc

SEQ ID NO: 74510 - RNA, 64 nt, Human
gagaagcugccugcguaaaaagugccacccacggaggcaggacacaggcagcguguggcccauu

SEQ ID NO: 74511 - RNA, 64 nt, Human
cucaagccuauaaucccagcacuucggaaggcggaggcaggaggaucgcuugaggccaggaauu

SEQ ID NO: 74512 - RNA, 64 nt, Human
caggcgccuauaaucccagcuacuggggaggcugaggcaggagaaucacuugaacccgggggac

SEQ ID NO: 74513 - RNA, 64 nt, Human
ccccaacccaucuugggauccccaagaagagggaaggcaggaggggccuacagcuccuaccuug

SEQ ID NO: 74514 - RNA, 64 nt, Human
cgggcgccuguagucccagcuacuugggaggcugaggcaggagaauggcgugaacccgggaagc

SEQ ID NO: 74515 - RNA, 64 nt, Human
acucuuagagaagaagaaauggaaaaaugaaagaaggcaggaaggaaagaaaggauauaggaag

SEQ ID NO: 74516 - RNA, 64 nt, Human
uguaugccuguaaucccagcuacuugggaggcugaggcaggagaaucgcuugaucccaggaagg

SEQ ID NO: 74517 - RNA, 64 nt, Human
cugcucgcugcucccaggaaggggguggcgugacaggcaggaaccugcgaaguccagaguccag

SEQ ID NO: 74518 - RNA, 64 nt, Human
cacaugccugcagucccaguuacuugggugccugaggcaggagaaucucuuaaaccaggaaggc

SEQ ID NO: 74519 - RNA, 64 nt, Human
ggacucgccuguaaucucacuacacaggaggcugaggcaggagaaucacuugaaccugggaggc

SEQ ID NO: 74520 - RNA, 64 nt, Human
ggacacugcagaggaagauaaugaagagaucucuaggcaggaaauccacagcuccuccugcacc

SEQ ID NO: 74521 - RNA, 64 nt, Human
ggcuugggggugaugcaggcacagcagauggccgaggcaggacacugcagaggaagauaaugaa

SEQ ID NO: 74522 - RNA, 64 nt, Human
cgcaugccuguaaucccagcuacuugggaggcugaggcaggagaaucacuugaacccgggagau

SEQ ID NO: 74523 - RNA, 64 nt, Human
auguacaacagaacaugauagcccauugagaaggaggcaggauaccuggagauuuguggaauac

SEQ ID NO: 74524 - RNA, 64 nt, Human
gcaugcuuguggucccagcuacuuugggagguugaggcaggaggaucgcuugagcccaggaggc

SEQ ID NO: 74525 - RNA, 64 nt, Human
gggcugggaggagagcaagcaggaacagggauggaggcaggaggagcagcccuuuuauucacuc

SEQ ID NO: 74526 - RNA, 64 nt, Human
ugcgugccuguagugccagcuacucaggaggccgaggcaggagaauugcuggaacccaggaggu

SEQ ID NO: 74527 - RNA, 64 nt, Human
cgcacgccuguagucccagcuacucgggaggcugaggcaggagaauugcuugaacccaggaggc

SEQ ID NO: 74528 - RNA, 57 nt, Human
ggccucaggcgaugacauagccgcagcaggcaggaggcguccucuucagcguagcuc

SEQ ID NO: 74529 - RNA, 64 nt, Human
cacacaccuguaaucccagcuauuugggaggccaaggcaggagaauugccugaacccgggaggc

SEQ ID NO: 74530 - RNA, 64 nt, Human
ugcacgccuguagucccagcuacucaggaggcuaaggcaggagaaucgcuugaacccgggaggu

SEQ ID NO: 74531 - RNA, 64 nt, Human
gccugggauugagcuaaccugaaacaaagguagcaggcaggaccuaaugaccagagguuaaauc

SEQ ID NO: 74532 - RNA, 64 nt, Human
caacauuggugucccuguccccagagggaggagcaggcaggagagagaggggaaggagguauga

SEQ ID NO: 74533 - RNA, 64 nt, Human
caggcaccuguaaucccagcuacuugggaggcugaggcaggagaauugcuugaacucgggaggc

SEQ ID NO: 74534 - RNA, 64 nt, Human
cuuauuccuguaaucccaacacuguggaaggccgaggcaggaggaucacuugaguccaggaguu

SEQ ID NO: 74535 - RNA, 64 nt, Human
caugcgccuguaaucccagcuacucgggagguugaggcaggagaaucgcuuaaacccaggcggc

SEQ ID NO: 74536 - RNA, 64 nt, Human
cacaugccuauaaucccagcuacuugggaggcuaaggcaggagaaucgcuugaacccgggaggc

SEQ ID NO: 74537 - RNA, 64 nt, Human
caugccuauaaaauuccagcacuuugggaggccaaggcaggaggaucacuugagccuaugaguu

SEQ ID NO: 74538 - RNA, 64 nt, Human
augaccucacugucuugaccaaagccagaauagaaggcaggauuccugaauucuaucuuaaaau

SEQ ID NO: 74539 - RNA, 64 nt, Human
ggcgccuguagaaucccagcuacucgggaggcugaggcaggagaauugcuugaaccugggaggu

SEQ ID NO: 74540 - RNA, 64 nt, Human
gcaggcgccuguaauccagcuacucgggaggcugaggcaggagaaucacuugaacccaggaggu

SEQ ID NO: 74541 - RNA, 64 nt, Human
cgggcgccuguagucccagcuacuugggaggcugaggcaggagaauggcgggaaccugggaggc

SEQ ID NO: 74542 - RNA, 64 nt, Human
ccugugcggugucacagauugcaggguucugacaaggcaggacagucaagaguggggacacuuu

SEQ ID NO: 74543 - RNA, 64 nt, Human
ugcaugccuguaaucccagcuacuuggaaggcugaggcaggagaaugucuugaaccuaggaggu

SEQ ID NO: 74544 - RNA, 64 nt, Human
gggcucuaguuucuaggaaugcuaaaauaucagaaggcaggagaggagauaggcuuauuaugau

SEQ ID NO: 74545 - RNA, 64 nt, Human
agugagccccgcugaccccgggccagcacuuggcaggcaggaggugcggucuccagaguggugg

SEQ ID NO: 74546 - RNA, 64 nt, Human
ggacgcccagaggccggggccaggcucugggucaaggcaggaaggagacagacagcuggcaguu

SEQ ID NO: 74547 - RNA, 64 nt, Human
uguuaauauuauuauuauuauuauuaauaaagugaggcaggaaaaugcuucuccuuuuaaaauc

SEQ ID NO: 74548 - RNA, 64 nt, Human
acuuuuguuucauuucaugccuuacuuaucaaaaaggcaggaaaguagguaugaucucuaaagu

SEQ ID NO: 74549 - RNA, 64 nt, Human
acuagucauaucauuagguccaguaauuguugacaggcaggaacgggggaccauugcauugugc

SEQ ID NO: 74550 - RNA, 64 nt, Human
ggaguggcaugguccugugccccgaccccaccugaggcaggagggcaugugcagacacucaaga

SEQ ID NO: 74551 - RNA, 64 nt, Human
uggaagccuguagucccagcuacuccggaggcugaggcaggagaauggcgugaacccgggaggc

SEQ ID NO: 74552 - RNA, 64 nt, Human
caaggacugccagaaaaccaccagcugcccggagaggcaggacaggauccuucccuaaagccuu

SEQ ID NO: 74553 - RNA, 64 nt, Human
ugggcaccuguagucccagcuacucaggaggcugaggcaggagaauggugugaaccugggaggu

SEQ ID NO: 74554 - RNA, 64 nt, Human
cuauaauucugucuugcugguguggauagaaaccaggcaggacaguagaucccuaugguuggau

SEQ ID NO: 74555 - RNA, 64 nt, Human
cucacaccugaaaucccagcacuuugggaggccgaggcaggaagaucauugagcucaggaguuu

SEQ ID NO: 74556 - RNA, 64 nt, Human
ugugcgccuguaaucccagcuacucgggaggcugaggcaggacgauuacuugagcuugggaaau

SEQ ID NO: 74557 - RNA, 64 nt, Human
cgcauaccuguagucccagcuacuugggaggcugaggcaggagaaucacuugaacucgggaggc

SEQ ID NO: 74558 - RNA, 64 nt, Human
ugcgugccuguagucucagcuacucaggaggcugaggcaggagaaucgccugaacccgggcggc

SEQ ID NO: 74559 - RNA, 64 nt, Human
cucaugccuguaaucccagcuacucaggaggcugaggcaggaggauugcuugaacccuggaggc

SEQ ID NO: 74560 - RNA, 64 nt, Human
cuugcaccuguaaucccaguuaccugggaggcugaggcaggagaaucucuugagcccaggaggc

SEQ ID NO: 74561 - RNA, 64 nt, Human
cccugaaagagagaugaaauucaagcugugagccaggcaggagcucaguauggcaaagguucuu

SEQ ID NO: 74562 - RNA, 64 nt, Human
aagaagaucaccacugcuggaggcauaauguacaaggcaggaaaagggauggaauugaugguga

SEQ ID NO: 74563 - RNA, 64 nt, Human
ccaaacaaccuugccagccuuggcugucaaaaggaggcaggagcaguucucaacacaccaagcc

SEQ ID NO: 74564 - RNA, 64 nt, Human
ccaaauagcaucuuuacagaggaagugggaucagaggcaggaaguguggaaaguugcuaagaag

SEQ ID NO: 74565 - RNA, 64 nt, Human
uacacgacuacaguacuucaaauggcacauagauaggcaggauauuacauagguaagcaggaau

SEQ ID NO: 74566 - RNA, 64 nt, Human
ugcaugccuguaaucccagcuacucgggaggcugaggcaggagaaucacuugaacucgggaggu

SEQ ID NO: 74567 - RNA, 64 nt, Human
ugggcgccuguaaucccagcuacucagaaggcugaggcaggagaaucacuugaaccuaggaggc

SEQ ID NO: 74568 - RNA, 64 nt, Human
ugcauaccuauaguccuggcuauuugggaggcugaggcaggaggauugcuuuagcccuggaggu

SEQ ID NO: 74569 - RNA, 64 nt, Human
ugcaugccuguaaucccagcuacucgggaggcugaggcaggagaaucgcuugaacccaggaggc

SEQ ID NO: 74570 - RNA, 64 nt, Human
gcuuccuggucuuaucauggacaauuugggcuagaggcaggaaggaagugggaugaccucagga

SEQ ID NO: 74571 - RNA, 64 nt, Human
gugacacuccaccaaccagagugagagggcagauaggcaggauucuaugagugguuauacuuaa

SEQ ID NO: 74572 - RNA, 64 nt, Human
uacacacuauuuauuuuuugguuuugucagaggcaggcaggauuuuggagcuggaagaaucugc

SEQ ID NO: 74573 - RNA, 64 nt, Human
ucguguuucacagugggcggcuucccugcgacggaggcaggaccaggcauuuagcuaguuagag

SEQ ID NO: 74574 - RNA, 64 nt, Human
cuuuggugaaauccggguucgaaugaauaucucaaggcaggagaugcaucuauuuuaagaugcu

SEQ ID NO: 74575 - RNA, 64 nt, Human
ggccucagcugcgcccccgcucaggugagcccgaaggcaggagccgggaggcacuccucccaaa

SEQ ID NO: 74576 - RNA, 64 nt, Human
gcgggcccugcagaguuacugauguucuuucagaaggcaggacugaauggcagagcuagcuuug

SEQ ID NO: 74577 - RNA, 64 nt, Human
guggugugaaacagccaaggcauuuauucuucagaggcaggauaauauuucaggauacaaaagc

SEQ ID NO: 74578 - RNA, 64 nt, Human
cuuccaacugaggcagugcauguguggcagagagaggcaggaagcuggcaguggcagcuucugu

SEQ ID NO: 74579 - RNA, 64 nt, Human
cucuccuuuccauucucucuauggggaggggagcaggcaggaggagcagaaauugccaacauug

SEQ ID NO: 74580 - RNA, 64 nt, Human
gugugguggcgggucccagcuacucgggaggcugaggcaggagaauggcaugaaccagggaggc

SEQ ID NO: 74581 - RNA, 64 nt, Human
cgggcgccuguaguccuagcuacucgggaggcugaggcaggagaaucucuuucuuaauuggcca

SEQ ID NO: 74582 - RNA, 64 nt, Human
agccauagcuugauugcucagagaaauaugcagaaggcaggaucaaagacacacaggaguccuu

SEQ ID NO: 74583 - RNA, 64 nt, Human
ggcgccauaggcauccgucuccagagcccccaggaggcaggaaccaggauaaggguggcuucuc

SEQ ID NO: 74584 - RNA, 64 nt, Human
gcgaagguagaggauguguuccagaaacauuagaaggcaggauuaauucaguuaguuaguucuc

SEQ ID NO: 74585 - RNA, 64 nt, Human
cuagaaacaccauucuggaaguuuggcugcccacaggcaggaggagaagcaugaagagaaaacc

SEQ ID NO: 74586 - RNA, 64 nt, Human
ggaagcaacagagaaguggggaauccagucugcuaggcaggaaagaugccucuaaguucuuguc

SEQ ID NO: 74587 - RNA, 64 nt, Human
ucugaagggcaguccuccuucucuagguuacaugaggcaggaauaagaagucagacagagacag

SEQ ID NO: 74588 - RNA, 64 nt, Human
auuagcugggcgugguagugcaagcugaaggcugaggcaggagaaucacucgaacccgggaggc

SEQ ID NO: 74589 - RNA, 64 nt, Human
caugugccuguauucccagcuacucaugaggcugaggcaggagaauggcgugaacccgggaggu

SEQ ID NO: 74590 - RNA, 64 nt, Human
cucaugccuguaaucccagcacuuugggaagcugaggcaggaggauccccugaggucaggaguu

SEQ ID NO: 74591 - RNA, 64 nt, Human
ggggcucccaucuucuuacacagagaggcagcugaggcaggacaguggggcuaacuguagacca

SEQ ID NO: 74592 - RNA, 64 nt, Human
cacgugccuguaaucccagcuacucgggaggcugaggcaggagaaucgcuugaaccugggaggu

SEQ ID NO: 74593 - RNA, 64 nt, Human
cgggcacuuguaaucccagcuacucccaaggcugaggcaggagaauugcuugagcccaggaguu

SEQ ID NO: 74594 - RNA, 64 nt, Human
ccuguuuucagguguuccuagcauuucugccuccaggcaggacggcaggggugagcagcuuugg

SEQ ID NO: 74595 - RNA, 64 nt, Human
ggcaggugcccccaucccccccgcauucuggccuaggcaggagaggaugggcgcagcccugcca

SEQ ID NO: 74596 - RNA, 64 nt, Human
cacaugccuguaaucccagcugcucaggaggcugaggcaggagaauugcuugaacccaagaggc

SEQ ID NO: 74597 - RNA, 64 nt, Human
ugcacaccuguaauuucaacuacuugggaggcugaggcaggagaauugcuugaacccaggaggu

SEQ ID NO: 74598 - RNA, 64 nt, Human
gauuuguguuugguuugguuuuugcacugcacuaaggcaggaggguuggagggcugggugcagc

SEQ ID NO: 74599 - RNA, 64 nt, Human
ugguuuauagcuggaauacugaguucaguucagaaggcaggaaagacagucacaccgacguguc

SEQ ID NO: 74600 - RNA, 64 nt, Human
caugcgcuuguagucucagcuacuccggaggcugaggcaggagaauugcuugaaccuggaaggc

SEQ ID NO: 74601 - RNA, 64 nt, Human
ugggugucuguaaucccagcuauucgggaggcugaggcaggagaaucgcuugaacccaggaggu

SEQ ID NO: 74602 - RNA, 64 nt, Human
cacacaccuguagucccggcuacucgggaggcugaggcaggagaauugcuugaacccgggagac

SEQ ID NO: 74603 - RNA, 64 nt, Human
cgcaugccuguagucgcagcuacucgcgagguugaggcaggagaauugcuugaacccaggaagu

SEQ ID NO: 74604 - RNA, 64 nt, Human
cacacgccuguagucccagcuacucaggaggcugaggcaggagaaucacuugaauucaggaggc

SEQ ID NO: 74605 - RNA, 64 nt, Human
ugggcaccuguagucccagcuacucgggaggcugaggcaggagaauggugugaaccugggaggu

SEQ ID NO: 74606 - RNA, 64 nt, Human
ucaagguucucauuucucaggugacgugauucuaaggcaggaauuugagaguucacagaaggau

SEQ ID NO: 74607 - RNA, 64 nt, Human
cugucuuugacuuggaccuuguuuacucuaaucaaggcaggagaugcagcaguccuacuuauug

SEQ ID NO: 74608 - RNA, 64 nt, Human
cucacgccuguaaucccaacacuuugggaggcccaggcaggaggaucguuugagaauauaucuc

SEQ ID NO: 74609 - RNA, 64 nt, Human
auggaaagaguacucuuguuuccuuauauuauggaggcaggaguuucguuuucaaaauuguuac

SEQ ID NO: 74610 - RNA, 64 nt, Human
guuuaugagauagcuagagcuucuuuguuaucucaggcaggaggcguuuacauaacagauguuu

SEQ ID NO: 74611 - RNA, 64 nt, Human
ugaagccucuggaggcaguugguugggggcgggcaggcaggaggcccucccuccacccccccac

SEQ ID NO: 74612 - RNA, 64 nt, Human
ccuccucugacccauccacauccuugcggcuggcaggcaggauguuuugaaauggugcagccaa

SEQ ID NO: 74613 - RNA, 64 nt, Human
acagagacgacugaacuuuugggguggagacuagaggcaggagcugagggacugauuccugugg

SEQ ID NO: 74614 - RNA, 64 nt, Human
ucccuuuggaccagucucccaagaggagaggggcaggcaggaaagaguggggauccuaagguua

SEQ ID NO: 74615 - RNA, 64 nt, Human
ggcaccaugguaggccuccagggaaagagcugggaggcaggaauggcacacugggcaggcuugc

SEQ ID NO: 74616 - RNA, 64 nt, Human
uacuuucugccacccucaguaagaacacacgaggaggcaggaccucccaccuucaggucugcau

SEQ ID NO: 74617 - RNA, 64 nt, Human
cuggcaccuguagucccagcuacuugggaggcugaggcaggagaauggcgugaaccuggaagga

SEQ ID NO: 74618 - RNA, 64 nt, Human
cugcuggccuacagcuugucuguuucucaagcagaggcaggaagagcuagucuuagcauuuaua

SEQ ID NO: 74619 - RNA, 64 nt, Human
ccugggcauguagucccagcuacucgggaggcugaggcaggagaaucgcuugaaccugggaggc

SEQ ID NO: 74620 - RNA, 64 nt, Human
ccucccaccuccccacacccauugagucauucacaggcaggagggagacugaucauuccucugg

SEQ ID NO: 74621 - RNA, 64 nt, Human
ggccauaugugcucagggacgugcuucucuuguaaggcaggaggacagaagaggaccaagaagg

SEQ ID NO: 74622 - RNA, 64 nt, Human
cagcaugguggcccuguucugggggagcaggguaaggcaggaggaagugggugagcuccgagau

SEQ ID NO: 74623 - RNA, 64 nt, Human
ugacucauuuuucuguguagagacucgguggcccaggcaggaggugaaagcagccauccggaag

SEQ ID NO: 74624 - RNA, 64 nt, Human
cgcaugcguguaaucccagcuacuugggaggcugaggcaggagaauugcuugaaccugggaggc

SEQ ID NO: 74625 - RNA, 64 nt, Human
ccucuucuacccuccccaagaaaaagggccuucaaggcaggaaugagaaagcaaagccaaucuc

SEQ ID NO: 74626 - RNA, 64 nt, Human
cucaccaaggaccuuggaagagcaagggacagugaggcaggagaagaacaagaaauggauguaa

SEQ ID NO: 74627 - RNA, 64 nt, Human
ugggcgccuguaaucccagcuccucaggaggcugaggcaggagaauugcuugaaaccaggaggc

SEQ ID NO: 74628 - RNA, 64 nt, Human
cauccccuccucagagaucaauuucagcagggccaggcaggaccuggguuuccgcacuuuuaau

SEQ ID NO: 74629 - RNA, 64 nt, Human
cugcagccuuggaaggaggcaccgacacgacaccaggcaggagugagccucaggccccgucccu

SEQ ID NO: 74630 - RNA, 64 nt, Human
cuuugaguuggacgggaaugggacucugcagccaaggcaggauaagaaaaucuugcaaucccgu

SEQ ID NO: 74631 - RNA, 64 nt, Human
ugggcgccuguagucccagcuacucaggaggcugaggcaggagaaugcugugaacccuggaggc

SEQ ID NO: 74632 - RNA, 64 nt, Human
cauacgccuguaguccuagccacucaggaggcugaggcaggaggauugcuugagcccaggaguu

SEQ ID NO: 74633 - RNA, 64 nt, Human
ugcgugccuguaguuccagcuacuugggaggcugaggcaggagaaucgcuugaaccaggcaguc

SEQ ID NO: 74634 - RNA, 64 nt, Human
cucaugccuguaaucccagcuacgcaggaggccaaggcaggagaaucacuugaaccugggaggu

SEQ ID NO: 74635 - RNA, 64 nt, Human
cgugugccuguagucccagcugcuugggaggcugaggcaggagaaucgcuugaaccugagaggu

SEQ ID NO: 74636 - RNA, 64 nt, Human
caugcgccuguagucccagcugcucaggaggcugaggcaggagaauugauugaacccgggaggc

SEQ ID NO: 74637 - RNA, 64 nt, Human
ugggugccuguaauuccagccacucgagaggcugaggcaggagaauugcuugaacccaggaggc

SEQ ID NO: 74638 - RNA, 64 nt, Human
caggugcuuauaaucccagcuacucugggggccaaggcaggagaauugcuugagccugggagau

SEQ ID NO: 74639 - RNA, 64 nt, Human
ugcacaccuguagucccagcugcucaggaggcugaggcaggaggaucucuugagcccaggauuu

SEQ ID NO: 74640 - RNA, 64 nt, Human
gcaagccauuuugguuacauaucuacugguugcaaggcaggaaauauuggugaaaugcuagcaa

SEQ ID NO: 74641 - RNA, 64 nt, Human
uuuauggaccacgaagggaagcccaccuuccuggaggcaggaccuucggccuaagaaacacagg

SEQ ID NO: 74642 - RNA, 64 nt, Human
uagguguaaauugaugccaucguaggcaaggugcaggcaggauuugaaggcaaaagucaauuca

SEQ ID NO: 74643 - RNA, 64 nt, Human
ugcgugccuguagucccaacuacucggaaggcugaggcaggagaauugcuugaacccgggaggc

SEQ ID NO: 74644 - RNA, 64 nt, Human
cgagcgccuguagucccagcuacucgggaggcugaggcaggagaauggcaugaaccuggaaggc

SEQ ID NO: 74645 - RNA, 64 nt, Human
uuuaaaaccaccgacagcccuuggguuggcaagaaggcaggaguauguaugagguccauccugg

SEQ ID NO: 74646 - RNA, 64 nt, Human
cagagaugcagucccucccaggaaccuguuggagaggcaggaccugcugcuuuagagugcggcu

SEQ ID NO: 74647 - RNA, 64 nt, Human
augccuguaaucccaucaucuacucaggaggcugaggcaggagaauugcuugaacccaggaggc

SEQ ID NO: 74648 - RNA, 64 nt, Human
cucacgccuguaaucccagcacuuugggaagccaaggcaggaggauuaccugaggccaggaguu

SEQ ID NO: 74649 - RNA, 64 nt, Human
ggucuuaggugauacgggagagaaagaacgugccaggcaggaggcccccugaagucuguguacu

SEQ ID NO: 74650 - RNA, 64 nt, Human
uccaauuucuugcugguggucaggaggcauagggaggcaggagggaaggaagcuuuaccuguaa

SEQ ID NO: 74651 - RNA, 64 nt, Human
cgggcgccuguaaucccagcuacuugggaggcugaggcaggagaaucacuugaacgugggaggc

SEQ ID NO: 74652 - RNA, 64 nt, Human
gaguuccuuacacagcauuuuagggaaagaauacaggcaggaugacacuuuguguuaaaguguu

SEQ ID NO: 74653 - RNA, 64 nt, Human
guaucuaugaguaugucuguuccacagacagaugaggcaggagugauggggcacucaagaaagu

SEQ ID NO: 74654 - RNA, 64 nt, Human
acaucaaacagaguucaaauuccacacagauaagaggcaggauauauaagcgccagugguaguu

SEQ ID NO: 74655 - RNA, 64 nt, Human
cgggcaccuguagucccagcuacuugggaggcugaggcaggagaauggugugaacccgggagcg

SEQ ID NO: 74656 - RNA, 64 nt, Human
cagucaccuguagucccagcuacuugggaggcugaggcaggagaaucgcuucaaccugggaggc

SEQ ID NO: 74657 - RNA, 64 nt, Human
cgcuagcaccccaguugcguggccagccgggcccaggcaggagcagguggcccugugggcaccu

SEQ ID NO: 74658 - RNA, 64 nt, Human
cacaggccuuuaauuccagcuacuugggaggcugaggcaggagaauuacuugaacccaggaggu

SEQ ID NO: 74659 - RNA, 64 nt, Human
acacaacagugacaauuuuuuuuaaaagaauagaaggcaggagggggaauucgacauuguugaa

SEQ ID NO: 74660 - RNA, 64 nt, Human
gucagaggaagagacuucuucuguucucuggagaaggcaggaggaaagcaaagaccuccauuuc

SEQ ID NO: 74661 - RNA, 64 nt, Human
ucugaccugcaaucaaggcuggggagggguuugcaggcaggaauaugcugaccuuucacccugc

SEQ ID NO: 74662 - RNA, 64 nt, Human
auuuuuuuugagacggagucuugcucuguugcccaggcaggagugcaguggcgcaucucggcuc

SEQ ID NO: 74663 - RNA, 64 nt, Human
cucaugcuuguaaucacagcacuuuaggaggcugaggcaggaggacuguuugagcccaggaguu

SEQ ID NO: 74664 - RNA, 64 nt, Human
gaggaggggcuagaacaagggcccaggggacuggaggcaggaugguggcuuucccuaccugaca

SEQ ID NO: 74665 - RNA, 64 nt, Human
cagccaggccaggcaaccaguggcccccaaaggcaggcaggauccucaggccccagccgcggga

SEQ ID NO: 74666 - RNA, 64 nt, Human
gccccaggauccugcucacagucaccgcaggugcaggcaggaagcagcccugggggacuggacg

SEQ ID NO: 74667 - RNA, 64 nt, Human
cgcaugccuguaaucccagcuacucaggaggcuaaggcaggagaaucgcuugaacccgggaggu

SEQ ID NO: 74668 - RNA, 64 nt, Human
ugcagguccugccagaccuccuuccugaccucugaggcaggagaggaauaaagacgguccgccc

SEQ ID NO: 74669 - RNA, 64 nt, Human
cgucauggaagaggcggccaugcuguggccagccaggcaggaagagaccuuuccucugacggac

SEQ ID NO: 74670 - RNA, 64 nt, Human
ucucauccugcaagucggcgcacacaguggaugaaggcaggagacccagaaagcagugcagugc

SEQ ID NO: 74671 - RNA, 64 nt, Human
aagcacgaggccucaggucggcccuguggcggguaggcaggaaggacugucccagacgaggggc

SEQ ID NO: 74672 - RNA, 64 nt, Human
cucgugccuguaaucucagcuauuugggaggcugaggcaggagaaucacuugaaccugggaggc

SEQ ID NO: 74673 - RNA, 64 nt, Human
cucauucugacugugaacuaagcaagcuuugaggaggcaggagauuccgugggucccugugaca

SEQ ID NO: 74674 - RNA, 64 nt, Human
gggacuugcaugugcaaguuggguggaugcugggaggcaggaggcucaugcuccugucugccug

SEQ ID NO: 74675 - RNA, 64 nt, Human
gcucaugcauguaauucuagcacuuuggaggccaaggcaggaggacugcuugagcccaggaguu

SEQ ID NO: 74676 - RNA, 64 nt, Human
gcacgcaccucuacucccagcuacuaggaggcugaggcaggagaaucguuugaacccaggaggu

SEQ ID NO: 74677 - RNA, 64 nt, Human
ugggugccuguaaucccagcuacucgggaggcugaggcaggagaaucgcuugaacccgggaggu

SEQ ID NO: 74678 - RNA, 64 nt, Human
cucaugccuguaauuccagcacuuugggaggccgaggcaggaagacugcuugagcccaggaguu

SEQ ID NO: 74679 - RNA, 64 nt, Human
uaccgugucuucacucuccagccugagguggugaaggcaggaugcucucucuaagccagaccag

SEQ ID NO: 74680 - RNA, 64 nt, Human
cacgcgccuguagucccagcuacucgggaggcugaggcaggaagaaucgcuugaacccgggagg

SEQ ID NO: 74681 - RNA, 64 nt, Human
cucuuuucccuguucaccucccgccugccagggaaggcaggacccgcucugccaagggcccucu

SEQ ID NO: 74682 - RNA, 64 nt, Human
uaugugaaacacuuugccgcaggccgccuggcagaggcaggaaaugcuccagcaguggcucagu

SEQ ID NO: 74683 - RNA, 64 nt, Human
agaacugggagugagggcuccucaggcagccacaaggcaggaaaacuggcgcaaauuuccuggg

SEQ ID NO: 74684 - RNA, 64 nt, Human
gccacacccggugggggcacagcacagaccccagaggcaggaaccucucagccgaugccccccg

SEQ ID NO: 74685 - RNA, 64 nt, Human
uguucacaccuguagucccggccacucggggcugaggcaggaggaucacuggaaccugggaggu

SEQ ID NO: 74686 - RNA, 64 nt, Human
cucaccccuauaaucccaggacuuugggaggccaaggcaggaggaucacuugaguccagaaauu

SEQ ID NO: 74687 - RNA, 64 nt, Human
cagaugcucccugggcgcuacccugcagggugccaggcaggaguggucucagaacgugcgcuuc

SEQ ID NO: 74688 - RNA, 64 nt, Human
uguaguccuguagucccagcuacucgggaggcugaggcaggagaauggugugaacccgggaggc

SEQ ID NO: 74689 - RNA, 64 nt, Human
cacacaccuguaaucccagcuaccggggaggcugaggcaggagaaucgcuagaaccugggaggc

SEQ ID NO: 74690 - RNA, 64 nt, Human
uaugcaggcugcccuugcagcugcagcugacaacaggcaggaugguggggacagcagggggcua

SEQ ID NO: 74691 - RNA, 64 nt, Human
gcgcuggggccucggcuucccuuuggcuccuggaaggcaggaggguccccugcccugccccagu

SEQ ID NO: 74692 - RNA, 64 nt, Human
uaccugcagugacccugcccccaugaccuuggccaggcaggaugauuccagagcccguacugug

SEQ ID NO: 74693 - RNA, 64 nt, Human
gcccggacacagggaggacgcucccggggcccagaggcaggacuguggcgggccgggccucgcc

SEQ ID NO: 74694 - RNA, 64 nt, Human
uggacuuccucaggcggagagcuucugagaacacaggcaggauggaaaaagacuacuagccacu

SEQ ID NO: 74695 - RNA, 64 nt, Human
guugugaggccaccaucaccugaccugggggucaaggcaggaggacuccgaaggugcuacccgu

SEQ ID NO: 74696 - RNA, 64 nt, Human
ucaugccuguaaucccaacacuuuugggagguccaggcaggaggaucacuugggcccaggaggu

SEQ ID NO: 74697 - RNA, 64 nt, Human
cacgcgccuguaaucccagcuacccaggaggcugaggcaggagaaucgcuugaaccggggaggu

SEQ ID NO: 74698 - RNA, 64 nt, Human
gacacgcgcccuggcauguggggccugggugggcaggcaggaccugggcccucccacccaucag

SEQ ID NO: 74699 - RNA, 64 nt, Human
uggguaccuguagucccagcuacuccggaggcugaggcaggagaauggcgugaacccgggaggc

SEQ ID NO: 74700 - RNA, 64 nt, Human
gaggauccgggcuuuggacuccuuguuugccuuuaggcaggaagucaggagccagcagggcggg

SEQ ID NO: 74701 - RNA, 64 nt, Human
cgggcgccuguaaucccagcuacuugggaggcugaggcaggagaauuacuugaaccugggaggc

SEQ ID NO: 74702 - RNA, 64 nt, Human
agcucugcagggccccgcagaugaggaaauccguaggcaggagcgguugagugauuuuccuaag

SEQ ID NO: 74703 - RNA, 64 nt, Human
cucacaucuguaauaccagcgcuuugggaggcugaggcaggaggauugcuugaggccaggaguu

SEQ ID NO: 74704 - RNA, 64 nt, Human
ugggcaccuguagucccagcuacucgggaggcugaggcaggagaauugcuugaaccuaggaggc

SEQ ID NO: 74705 - RNA, 64 nt, Human
gggcagaggaaguacuuagggagguuggugucagaggcaggagugggggaucagggaaggugga

SEQ ID NO: 74706 - RNA, 64 nt, Human
caugaggaccguuccuaggaugggacagugggucaggcaggacaaggagaaagcagggcagaau

SEQ ID NO: 74707 - RNA, 64 nt, Human
cauuugccuguaaucccagcuacucgggaggcugaggcaggagaaucacuugaaccugggaggc

SEQ ID NO: 74708 - RNA, 64 nt, Human
cacacaccuguagucccagcuacucaggaggcugaggcaggagaauugcuugaaccugggaggu

SEQ ID NO: 74709 - RNA, 64 nt, Human
cgcaugcccucaaucccagcuacucaagaggcugaggcaggagaaucacuugcacuccggaggu

SEQ ID NO: 74710 - RNA, 64 nt, Human
ugaaacuuucauuccuucagauuuggcuugacaaaggcaggagguacaaaagaagggcugguau

SEQ ID NO: 74711 - RNA, 64 nt, Human
ccgucagagucuuuuguggugcugugcuucucagaggcaggauccaagcagaucagcccagccu

SEQ ID NO: 74712 - RNA, 64 nt, Human
cgugugccuguaaucccagcuauuugggaggcugaggcaggagaaucgcuugagcccgggaagc

SEQ ID NO: 74713 - RNA, 64 nt, Human
gagaaagggcucccaccugccagucccuggggggaggcaggaggcacaugugaggguccccaga

SEQ ID NO: 74714 - RNA, 64 nt, Human
ucagggugccaguagugggcauggggugggggcaaggcaggacaaaacauacaagucugagcaa

SEQ ID NO: 74715 - RNA, 64 nt, Human
gacguagcguagacaacagcagucauaaauaauuaggcaggaacuuaacccaaaucuaguucuu

SEQ ID NO: 74716 - RNA, 64 nt, Human
cccguaaaccauguagaaagcucccagcacugaaaggcaggaguguuagcaucucgcuuuaucc

SEQ ID NO: 74717 - RNA, 64 nt, Human
ugguggcguacgccuguaaucccagcuacucaggaggcaggagaaucgcuugagccugggaggc

SEQ ID NO: 74718 - RNA, 64 nt, Human
ccuucuuacaccgugaggccaagauccccucagaaggcaggagugcugcccucucccauggugc

SEQ ID NO: 74719 - RNA, 64 nt, Human
caugugccuguaaucccagcuacucaggaggcuaaggcaggagaaucgcuuaaacccaggaggc

SEQ ID NO: 74720 - RNA, 64 nt, Human
ccuccagucaucagccccacucugucuuggagacaggcaggaggugggggaagagcugaaucuc

SEQ ID NO: 74721 - RNA, 64 nt, Human
gaaaggagcugaggaggagaagccaaagaggaggaggcaggagaagcaggcagccugccccuuc

SEQ ID NO: 74722 - RNA, 64 nt, Human
uggacaccuguagucccagcuacuugggaggcugaggcaggagacuagcuggaaccagggaggu

SEQ ID NO: 74723 - RNA, 64 nt, Human
caggcaccuguagucccagcuacuugggaggcugaggcaggagaaucaccugaaccugagaggc

SEQ ID NO: 74724 - RNA, 64 nt, Human
cgugugccuguaaucucagcuacucaggaggcugaggcaggagaaucgcuugaacccaggaggc

SEQ ID NO: 74725 - RNA, 64 nt, Human
gcuugccccagcucccaccccacagcccacucucaggcaggaacaauccucagaggggaagugc

SEQ ID NO: 74726 - RNA, 64 nt, Human
gaggugagaauggggaggcaagaucucaggcaccaggcaggaggugccuuguaagcuaacuggg

SEQ ID NO: 74727 - RNA, 64 nt, Human
ugggcaccuguagucccagcuacucaggaggcugaggcaggagaauggcgugaacccggaaggc

SEQ ID NO: 74728 - RNA, 64 nt, Human
cgcaugccuguaaucccagcuacucgggaggcugaggcaggagaaucacuugaacccgggaggc

SEQ ID NO: 74729 - RNA, 64 nt, Human
ugcgugccuguauucccagccacucaggaggcugaggcaggagaaucgcuggaaccugggaugu

SEQ ID NO: 74730 - RNA, 64 nt, Human
augugauugggaucuacugugauguugucuucaaaggcaggagaaaauaauguucacaauaaaa

SEQ ID NO: 74731 - RNA, 64 nt, Human
gucuuaaguuugcacaauggcuagugucagcaaaaggcaggagaggguuuuuguuuuuuuuuua

SEQ ID NO: 74732 - RNA, 64 nt, Human
ugcacaccuguagucucagcuacucggaaggcugaggcaggaggaucacuugagccugggaauu

SEQ ID NO: 74733 - RNA, 64 nt, Human
cuucaccuguucuuguuuguuagccuugacugugaggcaggacuucccucgcuugaacuguuac

SEQ ID NO: 74734 - RNA, 64 nt, Human
ugggguugacaaggugcucacaccaugagaauggaggcaggaauugagcugacugagggaagau

SEQ ID NO: 74735 - RNA, 64 nt, Human
ugccucccccgacgccccagccugugccccggagaggcaggaucgcaguggucagaauccacgu

SEQ ID NO: 74736 - RNA, 64 nt, Human
aaggauagggcuaagguuuucaccuuaacugugaaggcaggaggaauaggugacugcuuccucc

SEQ ID NO: 74737 - RNA, 64 nt, Human
cuccugccuauaaucccagcacuuugggaggcugaggcaggaggaucacuugagcccaggaguu

SEQ ID NO: 74738 - RNA, 64 nt, Human
aacuugacagcuagacuugaugcuugcugaaaugaggcaggaaucauaauagaaaacucagccu

SEQ ID NO: 74739 - RNA, 64 nt, Human
ccaugucuagcccaucauccugcuuggagcaaguaggcaggagcucaauaaauguuuguugcau

SEQ ID NO: 74740 - RNA, 64 nt, Human
cacgugccuguagucccagcuacucgggaggcugaggcaggagaaucacuugaaccugggaggc

SEQ ID NO: 74741 - RNA, 64 nt, Human
caggcaccuguaaucccagcuacuugggaggcugaggcaggagaaucgcuugaacccaggaggu

SEQ ID NO: 74742 - RNA, 64 nt, Human
cacgugccuguaaucccagcuacucgggaggcugaggcaggagaaucaauugaaccugggaggc

SEQ ID NO: 74743 - RNA, 64 nt, Human
aaugaaauggaucacaaugucauuuccuaauacaaggcaggauaugugggaagaauauguacaa

SEQ ID NO: 74744 - RNA, 64 nt, Human
acacaggaaccuacugaauagcguagauauaggaaggcaggaugguuauauggaauaaaaggcg

SEQ ID NO: 74745 - RNA, 64 nt, Human
cgggcgugguggcgggugccuguacaggaggcugaggcaggagaauggcgugaacccgcgaggc

SEQ ID NO: 74746 - RNA, 64 nt, Human
gcauguaggagaauccaagcgaggucaacagagaaggcaggaauguguggcagauuuagugaaa

SEQ ID NO: 74747 - RNA, 64 nt, Human
auugucuuccuguaagaccuucgggucaaggcagaggcaggaaacuaacuggugugagucaaau

SEQ ID NO: 74748 - RNA, 64 nt, Human
guguggagcugagcagagaggccuaaccaggaucaggcaggagggcagggaugguggcagccau

SEQ ID NO: 74749 - RNA, 64 nt, Human
uuucuuuguucuagccccucuguucauucuucacaggcaggaaccucaugcucugaggaagucu

SEQ ID NO: 74750 - RNA, 64 nt, Human
ggaggaagaagugguggagccucagggccagggcaggcaggagcaggcacugaugcuagagggu

SEQ ID NO: 74751 - RNA, 64 nt, Human
cacgcaccugcagucccagcuacuugggaggcugaggcaggagaaucacucgaacccaggaggc

SEQ ID NO: 74752 - RNA, 64 nt, Human
cguaaagauggauuucuaaacccacuggguggcaaggcaggaccuuccuaauccuugcaacaac

SEQ ID NO: 74753 - RNA, 64 nt, Human
cuccgcccauucugacccagggccuaggacggauaggcaggaacauacagacacauuuacacua

SEQ ID NO: 74754 - RNA, 64 nt, Human
aggggguugaaggauccugacagaccauggacagaggcaggaaguaaggaaacugauguuaaac

SEQ ID NO: 74755 - RNA, 64 nt, Human
aaagggaacaaggaaggugaugugugagucuggcaggcaggagaagggguguucauagaagcag

SEQ ID NO: 74756 - RNA, 64 nt, Human
caggcaccuguaaucccagcuacuugggaggcugaggcaggagaaaucgccugaacccagaagg

SEQ ID NO: 74757 - RNA, 64 nt, Human
ugcaugccuguaaucccagcuacuggggaggcugaggcaggagaaucgcuugaaccugggaggc

SEQ ID NO: 74758 - RNA, 64 nt, Human
cgggcgccuguagucccagcuacucaggaggcugaggcaggagaauggcgugaaccugugaggc

SEQ ID NO: 74759 - RNA, 64 nt, Human
agccccuugucccaccacucccgccaucugcugcaggcaggaaggcaugugaguguacguuuuc

SEQ ID NO: 74760 - RNA, 64 nt, Human
ugggugccuguagucccagcuacucaggaggcugaggcaggagaauggugugaacccgggaggc

SEQ ID NO: 74761 - RNA, 64 nt, Human
cgggcgccuguagucccagcuacuuggaaggcugaggcaggagaauggcgugaacccgggaggc

SEQ ID NO: 74762 - RNA, 64 nt, Human
ccacccaaagugguagaauuacagaggaaggcugaggcaggaggauugcuuaaacgcaggaguc

SEQ ID NO: 74763 - RNA, 64 nt, Human
gcucaugcuuguaaucugaacauuugggaggcugaggcaggaagaucgcuugagguccagaguu

SEQ ID NO: 74764 - RNA, 64 nt, Human
ggaugaagcccagccacauuucagccgagguccaaggcaggaggccauuuacuugagacagauu

SEQ ID NO: 74765 - RNA, 64 nt, Human
cgcacgccuguaaucccaucuucuugggaggcugaggcaggagaaucgcuagaaacugggaggu

SEQ ID NO: 74766 - RNA, 64 nt, Human
cgcacgccuguaguuccagcuacucaggaggcugaggcaggagaaucgcuugaacccgggaggu

SEQ ID NO: 74767 - RNA, 64 nt, Human
ccuuugugcuggaaccugggcuccuccagcugccaggcaggagucgguaggacugugccugugc

SEQ ID NO: 74768 - RNA, 64 nt, Human
ugacugaagccgcuuagugcuguggccucacugcaggcaggagccccgccccuccugccggggg

SEQ ID NO: 74769 - RNA, 64 nt, Human
cuuugaaaaacuuaaaaagcccccguuuacauguaggcaggacugugauaacagugcaagcucu

SEQ ID NO: 74770 - RNA, 64 nt, Human
gucccccagcaagaaagagggacaggagcaccccaggcaggaccaaggagucgggaggccccug

SEQ ID NO: 74771 - RNA, 64 nt, Human
gugcaugccuguaauccagcuacuugggaggcugaggcaggaaaauggcuugaacccgggaggu

SEQ ID NO: 74772 - RNA, 64 nt, Human
gugaggccuguaaucccagcuacucaggaggcugaggcaggagaaucgcuugcacccaggaggu

SEQ ID NO: 74773 - RNA, 51 nt, Human
ggccgcaggaaccacgaugagaggcaggagcugcuccuggcugaggggcuu

SEQ ID NO: 74774 - RNA, 64 nt, Human
cacgugccuguaaucccagcuacucaggaggcugaggcaggagaaucgcuugaacccgggaggc

SEQ ID NO: 74775 - RNA, 64 nt, Human
caugugccuguagucccagcuacuugggaggcugaggcaggagaaucgcuugagcccaagaggu

SEQ ID NO: 74776 - RNA, 64 nt, Human
gaaauaaagagaaaagggaaccuuggagcugggaaggcaggaaaccggcuagaugaccaucaca

SEQ ID NO: 74777 - RNA, 64 nt, Human
cgugcaccuguaaucccagcuacucuggaggcugaggcaggagaaucaccugaaccugggaggu

SEQ ID NO: 74778 - RNA, 64 nt, Human
ugggcaccuguaguccuagcuacucgagaggcugaggcaggagaauggcgugaacccgggaggu

SEQ ID NO: 74779 - RNA, 64 nt, Human
agggacuuuuguaaaaucaaaucauccugucacaaggcaggaggagcugauaaugaacuuuauu

SEQ ID NO: 74780 - RNA, 64 nt, Human
caugcgccuguaaucccagcuacccaggaggcugaggcaggagaauugcugaaacccgggaguc

SEQ ID NO: 74781 - RNA, 64 nt, Human
uggcaagugccuuuaaucccaccucaggaggcugaggcaggagaaucgcuugaaccugggaggc

SEQ ID NO: 74782 - RNA, 64 nt, Human
cggaugccuguaaucccagcuacuugggaggcugaggcaggagaaucgcuugaaccugggaggc

SEQ ID NO: 74783 - RNA, 64 nt, Human
auuucuaauacucuuacgaaaacuauucuaaaggaggcaggagccaaggccaaaagugaacgua

SEQ ID NO: 74784 - RNA, 64 nt, Human
cacaugccuguaaucccagcuacucaggaggcugaggcaggagauucgcuugaacucaggagac

SEQ ID NO: 74785 - RNA, 64 nt, Human
caaagcccucauugacagaggaggaaacaggccaaggcaggacauggcuggaccauggugauac

SEQ ID NO: 74786 - RNA, 64 nt, Human
ggugcgcuuguaaucccagcuacucaggaggcugaggcaggagaaucgcuuaaacucgggaggu

SEQ ID NO: 74787 - RNA, 64 nt, Human
ccccaucugaauguguugggggcucugcacuugaaggcaggacccucagaccucgcugguaaag

SEQ ID NO: 74788 - RNA, 64 nt, Human
ugggucuuuaggguaggacaggcugugguaugagaggcaggagucuccacaaggcuucaugugg

SEQ ID NO: 74789 - RNA, 64 nt, Human
cgggugccuguaaucucagcuacuugagaggcugaggcaggagaaucgcuugaacuugggagca

SEQ ID NO: 74790 - RNA, 64 nt, Human
cgggcgccuguaaucccagcuacucgggaagcugaggcaggagaauggugugaacccagugagc

SEQ ID NO: 74791 - RNA, 64 nt, Human
cuuuguucuguaacggugccuuuucuuaggguccaggcaggaaugaagccaauaauuuauugcu

SEQ ID NO: 74792 - RNA, 64 nt, Human
gcucaugccuguaacccuggcacuuaaggggccaaggcaggaggaucacuugaggccagugagc

SEQ ID NO: 74793 - RNA, 64 nt, Human
gcagaaaacccaagggcagguggagaguccagggaggcaggauggaucaccagacaccuaaccu

SEQ ID NO: 74794 - RNA, 64 nt, Human
guaggguuguccugccuggggccccacuugaaggaggcaggacagaggcaccgaggccagggag

SEQ ID NO: 74795 - RNA, 64 nt, Human
acucucuccaguuugaauaugcaauuguuuucacaggcaggaugucuguuuucugccuguauuu

SEQ ID NO: 74796 - RNA, 60 nt, Human
ccccaccaccccccugcugagggggccuccaggcaggacgagacuccucgggcaagggcc

SEQ ID NO: 74797 - RNA, 64 nt, Human
ugugcaguuauagucccagcuacuugggaggccaaggcaggaggauuacuugagcccaggaguu

SEQ ID NO: 74798 - RNA, 64 nt, Human
ccugguggcucccaccugaccccaggccuuuuauaggcaggagccccacugcuuccagccucug

SEQ ID NO: 74799 - RNA, 64 nt, Human
gguccuuuuugugccuuucuugaccuggagggggaggcaggaggauugcugucagccuaguuuc

SEQ ID NO: 74800 - RNA, 64 nt, Human
caggccuucuugauuaucuuuggcuuuguaccugaggcaggagagaagagauguccaaccagug

SEQ ID NO: 74801 - RNA, 64 nt, Human
cacgugccuguaaucccagcuacucgcaaggcugaggcaggagaaucgcuugaaccugggaggc

SEQ ID NO: 74802 - RNA, 64 nt, Human
cgggcaccuauaaucccaccuacuugguaggcugaggcaggagaaucgcuugaacccaggaggc

SEQ ID NO: 74803 - RNA, 64 nt, Human
ggugggcacccacagugacucagaggacagggcuaggcaggagaccugcugcuccucauugggg

SEQ ID NO: 74804 - RNA, 64 nt, Human
ugggcgccuguaaucccagcuacucgggagguuuaggcaggagaaucgcuugaacccuggaggu

SEQ ID NO: 74805 - RNA, 64 nt, Human
ugggcgccuauaaucccagcuauucuggaggcugaggcaggaaucgcuugaaauuggaaagcag

SEQ ID NO: 74806 - RNA, 64 nt, Human
cgggcgacuguagucccagcuacucgcgaggcugaggcaggagaauggcgugaauccgggaggc

SEQ ID NO: 74807 - RNA, 64 nt, Human
cgugcgccuguagucccagcuacuugggaggcugaggcaggagaauugcuugaacccaggaggc

SEQ ID NO: 74808 - RNA, 64 nt, Human
gggauuacgggcgugagccaccgugcucggcccaaggcaggagaaucucuugaagccaggaggc

SEQ ID NO: 74809 - RNA, 64 nt, Human
cuauuaauuuccauccuuuagcaggcugggcccuaggcaggaagcuggcuucugggagaggagu

SEQ ID NO: 74810 - RNA, 64 nt, Human
cagagccacccaaugaacagugcaaugugaaggaaggcaggagccugcaggggagcagacuugg

SEQ ID NO: 74811 - RNA, 64 nt, Human
caguccaaggaaaccacagcugcuggagacuccuaggcaggacaugcugaagccaaagccaaua

SEQ ID NO: 74812 - RNA, 64 nt, Human
cgcgcgccuguaaucccaguuacuuaggaggcugaggcaggagaaucacaucaaccugggaggc

SEQ ID NO: 74813 - RNA, 64 nt, Human
accuccuguuaagggcccacuugacccuagaauaaggcaggagagugucuaaaaucuagcugcu

SEQ ID NO: 74814 - RNA, 64 nt, Human
acccucaaccgcggccccuguaggccaaggcgccaggcaggacgacagcagcagcagcgcgucu

SEQ ID NO: 74815 - RNA, 64 nt, Human
ccugcugccacagcuuugcaugcugagcugugccaggcaggauccagccaaggccucucccucu

SEQ ID NO: 74816 - RNA, 64 nt, Human
ucguuugagcagcuauggcugcauagcaaguaguaggcaggaggccaaagacuucugagaccug

SEQ ID NO: 74817 - RNA, 64 nt, Human
ucuggccagacgaagaacauuguguccuaaugguaggcaggagaccaaggagcagaaggcuugc

SEQ ID NO: 74818 - RNA, 64 nt, Human
ugggcgccuguaaucccagcugcucaggaggcugaggcaggagaaucgcuugaacccgggaggc

SEQ ID NO: 74819 - RNA, 64 nt, Human
ugugugccuguaaucccagcuacucaggaggaugaggcaggagaccugcuugaaccuggaggug

SEQ ID NO: 74820 - RNA, 64 nt, Human
gaauauugacccagacaauuauacaaaugagaaaaggcaggagacuauguucuacaauugcagu

SEQ ID NO: 74821 - RNA, 64 nt, Human
gggcgccuguagucccagcuacucggagaggcugaggcaggagaauggcgugaacccgggaggu

SEQ ID NO: 74822 - RNA, 64 nt, Human
uggauaagcaggacaaaggggugauucacaucccaggcaggacagagcaggagaucaugagauu

SEQ ID NO: 74823 - RNA, 64 nt, Human
caugcucccguagucccagcuacucgggaggcugaggcaggagaaucacuugagccugggaggc

SEQ ID NO: 74824 - RNA, 64 nt, Human
caagcgccuguagucccagcuacucuggaggcugaggcaggagaauggcgugaacccaggaggc

SEQ ID NO: 74825 - RNA, 64 nt, Human
ugcacaccuguagucccagcuacuggggaggcugaggcaggagaaugguguaaaacccaggagg

SEQ ID NO: 74826 - RNA, 64 nt, Human
uccugggaacaucacauuccucugcccuuccugcaggcaggaacaaacagggcugccuucuggc

SEQ ID NO: 74827 - RNA, 64 nt, Human
aaagcauauguguguuuccccucauggugacgugaggcaggagcagugcguuuuaccucagcca

SEQ ID NO: 74828 - RNA, 64 nt, Human
cucucuaggaggggccugggggucugguuggggcaggcaggagcagugugguaguacugggggu

SEQ ID NO: 74829 - RNA, 50 nt, Human
ccauccuggaggucaaguagaggcaggaagguccagccugagcuggauuc

SEQ ID NO: 74830 - RNA, 64 nt, Human
acaaaacggaagcugggaagcuucccuugagggcaggcaggagguggaguugcagcuguuggcc

SEQ ID NO: 74831 - RNA, 64 nt, Human
uucuuggccugcagcuucauuugcgagagcgccgaggcaggacacagagcacagcugugcugga

SEQ ID NO: 74832 - RNA, 64 nt, Human
ugccuguagucccagcuacucgggaggcugagugaggcaggaggaucacuugagaccaggaggu

SEQ ID NO: 74833 - RNA, 64 nt, Human
cgggcgccuguagucccagcuacucuggaggcugaggcaggagaaucaauugaacccgggaggc

SEQ ID NO: 74834 - RNA, 64 nt, Human
guugcucauacaaacagaucagcaugaggacagaaggcaggagacuuuggucaguuaccuggga

SEQ ID NO: 74835 - RNA, 64 nt, Human
ggcaugccuguggucucagcuauucaggaggcugaggcaggagaaucacuugagaccaggaagu

SEQ ID NO: 74836 - RNA, 64 nt, Human
ugcaugccuguaacuccagauacuugggaugcugaggcaggagaaucgcuugaauaugagaggc

SEQ ID NO: 74837 - RNA, 64 nt, Human
cacaugccuguaauaucagcuacucaggaggcugaggcaggagaauugcuugaacccaggaggu

SEQ ID NO: 74838 - RNA, 64 nt, Human
cucccgccucagucucccaaagcgcugggauuacaggcaggagccacugagcccagccaagacu

SEQ ID NO: 74839 - RNA, 64 nt, Human
cgcaugcuuguaaucccagcuacucaggaggcagaggcaggagaaucacuugaacccgggaggu

SEQ ID NO: 74840 - RNA, 64 nt, Human
cuauuugagaugcacuuuuguacucaggaggccaaggcaggaggauugcuugagcccaggaguu

SEQ ID NO: 74841 - RNA, 64 nt, Human
cacgcgccuguaaucccagcuacuuaggaggcugaggcaggagaaucgcuugaacccaggaagu

SEQ ID NO: 74842 - RNA, 64 nt, Human
ucaugccuguaaucuccagcacuuugggaggcggaggcaggaggaucucuugaagucaagaguu

SEQ ID NO: 74843 - RNA, 64 nt, Human
ucauagauagauuaccagggaugcagugguguuuaggcaggauaggucuuuacuggcccugacu

SEQ ID NO: 74844 - RNA, 64 nt, Human
gccaaacccuccuucuuccuagagcccagccagcaggcaggaguuccuggacccucaggacagu

SEQ ID NO: 74845 - RNA, 64 nt, Human
ugcaugccuguaaucccagcuacucgggaggcugaggcaggaaaaucacuugaacccgggaggc

SEQ ID NO: 74846 - RNA, 64 nt, Human
ugcccaccugugaucccagcuacucaggaggcugaggcaggagaauuacuugaaccugggaggc

SEQ ID NO: 74847 - RNA, 64 nt, Human
gauuccuggacccaggagcucucaacuaacaaggaggcaggagaggucaacccuugucccaugc

SEQ ID NO: 74848 - RNA, 64 nt, Human
cacauggcugugguccuaguuacuugggaggcugaggcaggagaauggcuugaacuggggaagc

SEQ ID NO: 74849 - RNA, 64 nt, Human
cgggcgccuguaaucccagcuacuugggaggcugaggcaggagaaucgcuugaaucugggaggc

SEQ ID NO: 74850 - RNA, 64 nt, Human
caggcacuuuuaaucccagcuacucgggaggcugaggcaggagaauugcuugaaccugggaggc

SEQ ID NO: 74851 - RNA, 64 nt, Human
caaauuuuucaaaucauuccuuagauaccuugaaaggcaggaagggaagcguauauacuuaaga

SEQ ID NO: 74852 - RNA, 63 nt, Human
gcuacaccgaagccuggugaagcucccagcucaaggcaggaagacguuugcaaccgcgacaaa

SEQ ID NO: 74853 - RNA, 64 nt, Human
auggccgguugcgguuguaggagaguugugacuuaggcaggagucgaccuccucaaguaaugga

SEQ ID NO: 74854 - RNA, 64 nt, Human
agggcuggcgagggugggggcgggcaagggaugcaggcaggacagccaugagguggggcugcag

SEQ ID NO: 74855 - RNA, 64 nt, Human
ugaaagcaaacagugcugcucuuuauuccagacaaggcaggaaagucugaguugggagugacag

SEQ ID NO: 74856 - RNA, 64 nt, Human
ugggcaccugucgucccagcuacuagggaggcugaggcaggagaauggugugaacccaggaggc

SEQ ID NO: 74857 - RNA, 64 nt, Human
caggaaccuguaaucccagcuacaggggaggcugaggcaggagaaucgcuugaacccgggaggu

SEQ ID NO: 74858 - RNA, 64 nt, Human
uucuggguccagggaggggucccugcaaaacuccaggcaggacuucucaccagcagucgugggg

SEQ ID NO: 74859 - RNA, 64 nt, Human
aaccccaagacccagagaggaagggucaaccuggaggcaggaaaaaguuggcuuggauccaugu

SEQ ID NO: 74860 - RNA, 64 nt, Human
uggacaccuguaaucccagcuacuagggaggcugaggcaggagaauugcuugaaccugggaggc

SEQ ID NO: 74861 - RNA, 64 nt, Human
cgggcgccuguagucccagcuacucgggaggcugaggcaggagaauggcgugaacccaggaggc

SEQ ID NO: 74862 - RNA, 64 nt, Human
cucaugccgauaaucccagcaauucagaaagcugaggcaggaggauuacuugaggccagacugg

SEQ ID NO: 74863 - RNA, 64 nt, Human
caggcgccuguaaucccagcuacucgggaggccaaggcaggagaauugcucgaacucagggggu

SEQ ID NO: 74864 - RNA, 64 nt, Human
gaggggccccccaugggggcuguggccccuccgcaggcaggacaucccaaccccuggcugggac

SEQ ID NO: 74865 - RNA, 64 nt, Human
caaacgccuguaaucccaacuacuugggaggcugaggcaggagaaucucuugaacccaggaggu

SEQ ID NO: 74866 - RNA, 64 nt, Human
cucacgcuuguaaucgcagcacuuugggaggcugaggcaggaggaucacuugagcccaggaguu

SEQ ID NO: 74867 - RNA, 64 nt, Human
gcucguagccggaagggaggcagggagagggcgaaggcaggaaggggagugagaaagaggcuga

SEQ ID NO: 74868 - RNA, 64 nt, Human
ggagcccuggugaagggcuggaccugacccauggaggcaggaggaagaccuggcuuucuugguu

SEQ ID NO: 74869 - RNA, 64 nt, Human
caacaccaaggccacaaggggaccccggccuaggaggcaggaagccaaggugcagagagcagcc

SEQ ID NO: 74870 - RNA, 64 nt, Human
cugcagccuaguggaaggugcugagggggcccugaggcaggaccgcccuccugaccccugguag

SEQ ID NO: 74871 - RNA, 64 nt, Human
ccauucagaccccauuaagaagguuggcuuggccaggcaggaugggcuguguccggcccugcag

SEQ ID NO: 74872 - RNA, 64 nt, Human
cgcacaccuguaauccuagcuacucgggaggcugaggcaggagaauugcuugaacccaggaggc

SEQ ID NO: 74873 - RNA, 64 nt, Human
ugcaugccuguagucccagcuacuugggaggcugaggcaggagaauuuuuugagcccaggaugc

SEQ ID NO: 74874 - RNA, 64 nt, Human
aaaagcaugaacuguguauaaaauggggaaauggaggcaggagacuuugagguaacauggucug

SEQ ID NO: 74875 - RNA, 64 nt, Human
ccauccggaguugccuaagaugcauguccagcauaggcaggauugcucgguggugagaagguua

SEQ ID NO: 74876 - RNA, 64 nt, Human
caccacuaagaugauuuuuuaaggagcugggggaaggcaggagccuuccuuucuccugccccaa

SEQ ID NO: 74877 - RNA, 64 nt, Human
cagaagucucacugguggggcugggggugggggcaggcaggaggcauggaugggaaccugagua

SEQ ID NO: 74878 - RNA, 54 nt, Human
uuauccgccuccuggcauagacugaggcaggagcuggccgggcaagggugggaa

SEQ ID NO: 74879 - RNA, 64 nt, Human
aaggugguuaauagaaacucaggcucccgugacaaggcaggacaagagccuguuucgcuuuccu

SEQ ID NO: 74880 - RNA, 64 nt, Human
ucaggcagcgcgcacaggcucuggcagccgucucaggcaggacugggcaccaagcuugcagccg

SEQ ID NO: 74881 - RNA, 64 nt, Human
cgugcgccuguagucccagcuacucgggaggcugaggcaggaggaucgcuugagcccaagaguu

SEQ ID NO: 74882 - RNA, 64 nt, Human
cuggguuuucagcauaaaugggaacugauguagaaggcaggauuuagcccuucuaggcaaaaga

SEQ ID NO: 74883 - RNA, 64 nt, Human
uacaugccuguaaucccagcuacuagggaggcugaggcaggagaaucacucgaacccgggaggc

SEQ ID NO: 74884 - RNA, 64 nt, Human
guaaggggccagagccuuggaggacacuaagaggaggcaggaggagcaacucaaauccccaaga

SEQ ID NO: 74885 - RNA, 64 nt, Human
uucaaaagucuggcccacugugcaguggagcagaaggcaggaccaugaggccuccugccaugua

SEQ ID NO: 74886 - RNA, 64 nt, Human
uugcuaaguggccggaaaacaagccugagggaggaggcaggaguuggaguuaccuuaggccccu

SEQ ID NO: 74887 - RNA, 64 nt, Human
ccuacuucgccugacacugccauccuggacagaaaggcaggagcucugaguccucagguccacc

SEQ ID NO: 74888 - RNA, 64 nt, Human
ccgggggaaggguggggaggugcaaugggaugggaggcaggaugcuugcccagaaaggugcuuu

SEQ ID NO: 74889 - RNA, 64 nt, Human
ugcacaccuguaguccuagcuacuugggaggcugaggcaggagaauugcuugaacccaggaggu

SEQ ID NO: 74890 - RNA, 64 nt, Human
cacgcgccuguagucccagcugcucaggaggcugaggcaggagaauggcguaaaccccuccagc

SEQ ID NO: 74891 - RNA, 64 nt, Human
cucaugcccauaaucccagcccuuugggaagcugaggcaggaggauugagaccaggaguucgag

SEQ ID NO: 74892 - RNA, 64 nt, Human
augaaggagaaggaggguuugggaugggugucuaaggcaggaguugacaucgggcaaccaaaga

SEQ ID NO: 74893 - RNA, 64 nt, Human
agggaccacuaaaucuccaagaccuggugugcggaggcaggagcauguaugucugcaggugucu

SEQ ID NO: 74894 - RNA, 64 nt, Human
gggcuccuccccagccggugacuuacuguacagcaggcaggagggugggcaggcaaccuccccg

SEQ ID NO: 74895 - RNA, 64 nt, Human
acaugccuguaaucccagcuacccggggaggcugaggcaggagaauugcuugaacucagaaggc

SEQ ID NO: 74896 - RNA, 64 nt, Human
cugucgccuguaaugccagcgcuuugggaggcggaggcaggaggaucgcucaagccccggaguu

SEQ ID NO: 74897 - RNA, 64 nt, Human
caggcaccuguagucccagcuacucgggaggcugaggcaggagaauggcgugaacccaggaggc

SEQ ID NO: 74898 - RNA, 64 nt, Human
ugcgugccuguaaucccagcuacucaggaggcugaggcaggagaaucacuugaacccaggaggc

SEQ ID NO: 74899 - RNA, 64 nt, Human
aaagagccagcacccugaugucccugggguggcuaggcaggaguggcguggggccaauacccag

SEQ ID NO: 74900 - RNA, 64 nt, Human
gaggaaugauggagaaucuaguguagcagccuccaggcaggauucagcacaacacuggggaguc

SEQ ID NO: 74901 - RNA, 64 nt, Human
gugggugccuguaauccagcuacuugggagacugaggcaggagaauugcuugaacccaggaggc

SEQ ID NO: 74902 - RNA, 64 nt, Human
uaguccccuguagucccagcuacucgggaggcugaggcaggagaaucguuugaaccugggaggu

SEQ ID NO: 74903 - RNA, 64 nt, Human
uucuaccaggacgacgauuucagcuaggaggcugaggcaggagaaucacuggaaccugggagcc

SEQ ID NO: 74904 - RNA, 64 nt, Human
caggcgccuguaaucccagcuacuggggaggcugaggcaggagaauggcaugaacccgggaggu

SEQ ID NO: 74905 - RNA, 64 nt, Human
cggguaccuguaguccuagcuacuugggaggcugaggcaggagaauggcgugaaccugggaggu

SEQ ID NO: 74906 - RNA, 64 nt, Human
aguuggagguguaguauucaaaaacggggaaugaaggcaggaaggaggcuggaauaaauaaaaa

SEQ ID NO: 74907 - RNA, 64 nt, Human
cacgugccuguaauccuagcugcucgggaggcugaggcaggagaaucacuugaacuugggaggu

SEQ ID NO: 74908 - RNA, 64 nt, Human
cacacgccuguaaucccagcuacucaggaggcugaggcaggagaaucgccugaaccugggaggu

SEQ ID NO: 74909 - RNA, 64 nt, Human
agccgcccuucaggcugggguagcaggucaguccaggcaggaagcagcaccugccccccgcgcc

SEQ ID NO: 74910 - RNA, 64 nt, Human
cucaccagugccaccugcgggggagggacggggcaggcaggagucugggaggcggguccgcucc

SEQ ID NO: 74911 - RNA, 64 nt, Human
uggagacugagcuggggcuggccgggacgugacaaggcaggacagaggcggccccuccgcugcu

SEQ ID NO: 74912 - RNA, 64 nt, Human
ccugugugucccagccuuuugagcagaaacugccaggcaggaccugcugggccgugcggggcac

SEQ ID NO: 74913 - RNA, 64 nt, Human
ugcacgccuguaaucccagcuacucgggaggcugaggcaggagaauugcuucaaccugggaggu

SEQ ID NO: 74914 - RNA, 64 nt, Human
ugcacgccucuaaucccagcuacucgggaggcugaggcaggagaaucacuugaacccgggaagu

SEQ ID NO: 74915 - RNA, 64 nt, Human
agaacaggauccccagaagcaggcugaagaggaaaggcaggaggaaccugaguaugagaauguu

SEQ ID NO: 74916 - RNA, 64 nt, Human
cggacgccuguauucacagcuacucgggagguugaggcaggagaauggggugaacccgggagga

SEQ ID NO: 74917 - RNA, 64 nt, Human
ugggcaccuguaaucccagcuacuugggaggcugaggcaggagaaucucuugaacccaggaggc

SEQ ID NO: 74918 - RNA, 64 nt, Human
cgcaugccuguaaucccagcuacucaggaggcugaggcaggaaaaucacuugaacucgggaggc

SEQ ID NO: 74919 - RNA, 64 nt, Human
ccggcugguuggcauggccuggggcaggaggcagaggcaggagaccaagauggcagguggaggc

SEQ ID NO: 74920 - RNA, 64 nt, Human
cgggcgccuauaaucccagcuacuugggaggcugaggcaggagaauugauugaaccugggaggc

SEQ ID NO: 74921 - RNA, 64 nt, Human
gaagccuaggagagccgaaucaguguuugugaagaggcaggacuggccagagugacagacauac

SEQ ID NO: 74922 - RNA, 64 nt, Human
ucaggaccaaaaugugggugauuugucuggguccaggcaggagacagaaaucacacaagcucuu

SEQ ID NO: 74923 - RNA, 64 nt, Human
ugugcgccuguagacccggcuacucaggaggcugaggcaggagaauugcuugaacccgggaggc

SEQ ID NO: 74924 - RNA, 64 nt, Human
ggaauaaagaggugccuucagcuggugggccgagaggcaggaagcagccuuccuuggagcaguu

SEQ ID NO: 74925 - RNA, 64 nt, Human
cccacgccuguaaucccagcuacucgggaggcuaaggcaggaaaauuguuugaacccaggaggu

SEQ ID NO: 74926 - RNA, 64 nt, Human
cgggcgccuguagucccagcuacucgggaggcugaggcaggagaauggcgugaacccgggaggc

SEQ ID NO: 74927 - RNA, 64 nt, Human
ugugcaccuguagucccagcuacucaggaggcugaggcaggagaauugcuugaacccaggaggc

SEQ ID NO: 74928 - RNA, 64 nt, Human
cucacgccuguagucccagguacuugggagccugaggcaggaggauugcuugagcucaggaguu

SEQ ID NO: 74929 - RNA, 64 nt, Human
cuguucugaugucagugccuguacauaccuccaaaggcaggacuugccugauaaauauuuuucc

SEQ ID NO: 74930 - RNA, 64 nt, Human
caggcaugguggcacacaccuguaaucguagcugaggcaggagaaucgccugaacccaggaggc

SEQ ID NO: 74931 - RNA, 64 nt, Human
caggcgccugaaaucccagcuacucaagaggcugaggcaggagaaucgcuugaaccugggaggc

SEQ ID NO: 74932 - RNA, 64 nt, Human
ugggcgccuguagucccagcuacucgggaggcugaggcaggagaaucgcuugaaccugagaggc

SEQ ID NO: 74933 - RNA, 64 nt, Human
ucccucuucccagcacaggcagggguagaagcaaaggcaggaggugggugagcggguggggugc

SEQ ID NO: 74934 - RNA, 64 nt, Human
ucucugccugacugaccccugccagggcacagauaggcaggaccccagagagggcaggcagcca

SEQ ID NO: 74935 - RNA, 64 nt, Human
ggggcgcuagggguucuuagucucuggggcuacuaggcaggaugaauuugacugggucgguagg

SEQ ID NO: 74936 - RNA, 64 nt, Human
cgccggccgggggucucucgcuguguccccuauuaggcaggaguuacaaaguuugcaaaguccc

SEQ ID NO: 74937 - RNA, 64 nt, Human
cgggugccuguagucccagcuacucgggaggcugaggcaggagaaugacgugaacccaggaggc

SEQ ID NO: 74938 - RNA, 64 nt, Human
ugggcgccuguagucccagcuacuugggaggcugaggcaggagaauggugugaacccgggagau

SEQ ID NO: 74939 - RNA, 64 nt, Human
gauucucugccugccacugucaggguuaagcggcaggcaggauugggcuuuucuggcuucugcc

SEQ ID NO: 74940 - RNA, 64 nt, Human
cacgcaccuguagucccagcuacuugggagccugaggcaggagaaucgcuugaaccugggaagu

SEQ ID NO: 74941 - RNA, 64 nt, Human
uccaccuuuuuauacacucagccuucccucucccaggcaggaggacccccagacccuguucccc

SEQ ID NO: 74942 - RNA, 64 nt, Human
cuucaagggcccuccccagcuacucgggaggcugaggcaggagaaucgcuugaacucaggaggu

SEQ ID NO: 74943 - RNA, 64 nt, Human
caggcgccuguagucccagcuacuugggaggcugaggcaggagaauggccugaacccgggaggc

SEQ ID NO: 74944 - RNA, 64 nt, Human
cugugcugaacuugcuguucaucuguugaucuggaggcaggacagcuucugggacacacaaaaa

SEQ ID NO: 74945 - RNA, 64 nt, Human
cauuuccauucacuaauuuuggcucaaacuuaugaggcaggaaauaggggccaacaguaaaugg

SEQ ID NO: 74946 - RNA, 64 nt, Human
cgggcaccuguagucccagcuacuugggaggcugaggcaggagaauggcgugaacccgggaggu

SEQ ID NO: 74947 - RNA, 64 nt, Human
acagaagagggagaaaugucaugagacguuggacaggcaggauugaugauagcaugaccauagc

SEQ ID NO: 74948 - RNA, 64 nt, Human
uguaugccuguagucccagccacucagaaggcugaggcaggaggaucgcuugagaccaagaguu

SEQ ID NO: 74949 - RNA, 64 nt, Human
uuacguuuauguacuaaaucuaaucaggaaaguaaggcaggaaaaguugaugguauucauuagg

SEQ ID NO: 74950 - RNA, 64 nt, Human
ugguagcaagugccuauaauaccagcugaggcugaggcaggagaaucccuugagcccgggaggc

SEQ ID NO: 74951 - RNA, 64 nt, Human
auggagguuccacgucuuucuuuaggcagggaccaggcaggacuucagaaaaacccucaugagc

SEQ ID NO: 74952 - RNA, 64 nt, Human
cgaaugacuguaaucccagcuacucaggaggcugaggcaggagaaucgcuugaauccaggaggc

SEQ ID NO: 74953 - RNA, 64 nt, Human
cacacaccuguaaucccagcuacucaggaggcugaggcaggagaauuacuuuaaccugcggggg

SEQ ID NO: 74954 - RNA, 64 nt, Human
cgggcaccuguagucccagcuacacgggaggcugaggcaggagaauggcaugaaccugggaggc

SEQ ID NO: 74955 - RNA, 64 nt, Human
caggcgccuguaaucccagcuacucaggaggcugaggcaggagaauaacuugaacccaggaggc

SEQ ID NO: 74956 - RNA, 64 nt, Human
guuacuuuuauuuuauuccuuguaauuaagucacaggcaggacccaguuuccagagagcaggcg

SEQ ID NO: 74957 - RNA, 64 nt, Human
gucugugccuccacugguugaggguggaaccuccaggcaggaaccggcucgccacccucugccc

SEQ ID NO: 74958 - RNA, 64 nt, Human
ugggcgccuguagucccaacuacucaggaggcugaggcaggagaauggugugaacccgggaggu

SEQ ID NO: 74959 - RNA, 64 nt, Human
ucccuggggaacugggugcggguggaguacugggaggcaggagguggcccggggaggccuugug

SEQ ID NO: 74960 - RNA, 64 nt, Human
aggcugccauagguucugcgaugagaggugcaggaggcaggagccuggcccagggggugcuggu

SEQ ID NO: 74961 - RNA, 64 nt, Human
ugcaugccuguaaucccagcuacucgggaggcugaggcaggagaacugcuugaacccaggaggc

SEQ ID NO: 74962 - RNA, 64 nt, Human
auaauuugcuuauauuaaaaacaaaaaauggcugaggcaggaguuugggaccagccugggcuau

SEQ ID NO: 74963 - RNA, 64 nt, Human
gugcuugcagccaggucaggcccagcugcagcccaggcaggagcagucgccuuucccacccaca

SEQ ID NO: 74964 - RNA, 64 nt, Human
cugacgccuguaaucccagcacuuugggaggccgaggcaggagaaucgcuugagcccaggaguu

SEQ ID NO: 74965 - RNA, 64 nt, Human
cgggcaccuguagucccagcuacucgggaggcugaggcaggagaauggugugaacccgggaagc

SEQ ID NO: 74966 - RNA, 64 nt, Human
cacgugccugugaucccagcuacuugggaggcugaggcaggaggaucgccugagcccaggaggu

SEQ ID NO: 74967 - RNA, 64 nt, Human
cucacaccuguaaucccagcacuuugggaggcugaggcaggaggaucacuugaggucaggaguu

SEQ ID NO: 74968 - RNA, 64 nt, Human
gcugcugggggaaauccugggguccuugagacagaggcaggacccucguguucccagcugccuc

SEQ ID NO: 74969 - RNA, 64 nt, Human
caugcaccuguaaucccagcuacuugggaggcugaggcaggagaauucuuugaacccaggaggc

SEQ ID NO: 74970 - RNA, 64 nt, Human
ugugugccuguauucacagcugcuuggauggcugaggcaggagaaucgcuugaacccaggaguc

SEQ ID NO: 74971 - RNA, 64 nt, Human
cgccugccuguagucccagcuacucgggaggcugaggcaggaggaucgcuugaacccaggaagu

SEQ ID NO: 74972 - RNA, 64 nt, Human
ugcacgccuuuaaucccagcuacucgggaggcugaggcaggagaaucacaugaauccaggaggu

SEQ ID NO: 74973 - RNA, 64 nt, Human
cgcaugccuguagucccagcuaacugggaggcugaggcaggaggaucacuugagcccaggagau

SEQ ID NO: 74974 - RNA, 64 nt, Human
cuccugaaugacuacuggguacauaacgaaaugaaggcaggaauaaagauguucuuugaaaccc

SEQ ID NO: 74975 - RNA, 64 nt, Human
ugcaugccuguaaucccagcuacucgggaggcugaggcaggagaauugcuugaacccgggaggc

SEQ ID NO: 74976 - RNA, 64 nt, Human
cacgugccuguauucccaucuacucgggaggcuuaggcaggauaaucacuugaaccugggaggu

SEQ ID NO: 74977 - RNA, 64 nt, Human
acuuuggauucgaacuaaacccaggcaacaggcgaggcaggacagaggcugaguggaaaggugg

SEQ ID NO: 74978 - RNA, 64 nt, Human
gggacaucgaacuaagaccugaacuaugagaaauaggcaggaagaaguuguaccugacucauuu

SEQ ID NO: 74979 - RNA, 64 nt, Human
gccugggcgauagacucuuccucagcagccuggcaggcaggaaacagacauaggaccccagccc

SEQ ID NO: 74980 - RNA, 64 nt, Human
cacacaccuguagucccagcuacucgggaggcugaggcaggagaaucguuugaaccugggaggc

SEQ ID NO: 74981 - RNA, 64 nt, Human
ggggugccuguaaucccagcuacucaggaggcugaggcaggaaaauugcaugaaccuaaguggc

SEQ ID NO: 74982 - RNA, 64 nt, Human
cgcgcaccuguagucccaguuacucgggaggcugaggcaggagaaucgcuugaacccgggaggu

SEQ ID NO: 74983 - RNA, 64 nt, Human
gggcgccugugguggccagcuacucaggaggcugaggcaggagaauggcgugaacccgggaggc

SEQ ID NO: 74984 - RNA, 64 nt, Human
cucacgcuugcaaucccagugcuuugggagacugaggcaggaggaucacuuaaggccaggaguu

SEQ ID NO: 74985 - RNA, 64 nt, Human
cacaugccuguaauccgagugcuuugggaggcugaggcaggaggaucacucgagcucaagaauu

SEQ ID NO: 74986 - RNA, 64 nt, Human
ccaguauucccagcuacucuggaggcugaggcggaggcaggauugcuugauaugagggagauug

SEQ ID NO: 74987 - RNA, 64 nt, Human
cccagaguggcccaagacucccagaucagcuaccaggcaggauauuccaagggcuuagagauga

SEQ ID NO: 74988 - RNA, 64 nt, Human
gugggggugggaagguaaggauggucguggaagaaggcaggauggaacucggccucauccccga

SEQ ID NO: 74989 - RNA, 64 nt, Human
cacaugccuguaaucccagcuacuccggaagcugaggcaggagaauggcuugaacccaggaggu

SEQ ID NO: 74990 - RNA, 64 nt, Human
agagagaaggucccagcgggggccagugaagcucaggcaggaucugccuagggugugcugguuu

SEQ ID NO: 74991 - RNA, 64 nt, Human
cuuaugcuuguaaucccagcacuuugggaggccaaggcaggaggaucguuugaggccaggaggu

SEQ ID NO: 74992 - RNA, 64 nt, Human
gcagugccuguaaucccagcuauuugggaggcugaggcaggagaaucgcuugaaccagggaguc

SEQ ID NO: 74993 - RNA, 64 nt, Human
ugggcuccuguaaucccagcugcucgggaggcugaggcaggagaaucacuugaaucuaggaggc

SEQ ID NO: 74994 - RNA, 64 nt, Human
gcgugugccuguaaucccagcugcuggggggcugaggcaggaggaucaguugaacgugggaggc

SEQ ID NO: 74995 - RNA, 64 nt, Human
cgugcauuuguaaucccagcuacacaggaggcugaggcaggagaauugcuugaaccuggggggc

SEQ ID NO: 74996 - RNA, 64 nt, Human
caugcgccuauagucccagccacuugggaggcugaggcaggagaaucgcuugaacccagaaggc

SEQ ID NO: 74997 - RNA, 64 nt, Human
cgggcuccuguagucccagcuacucaggaggcugaggcaggagaauggcgcgaacaugggaggc

SEQ ID NO: 74998 - RNA, 64 nt, Human
ggggaaaggaacacgcggguagaugauuucuagcaggcaggaaguccugugcggugucaccaug

SEQ ID NO: 74999 - RNA, 64 nt, Human
guguuugugcuucacccccagacgucagccucgaaggcaggacugugggguguucgugcugugu

SEQ ID NO: 75000 - RNA, 64 nt, Human
ugggcaccuguagucccagcaacucgggaggcugaggcaggagaauggcgugaacuugggaggc

SEQ ID NO: 75001 - RNA, 64 nt, Human
cugcagagggaagcggggacaaugccgggguuucaggcaggagacacgaggagggccugcccgg

SEQ ID NO: 75002 - RNA, 64 nt, Human
cgcgugccuauaaucccagcuacucgggaggcugaggcaggagaaucgcuugaacccgggaggu

SEQ ID NO: 75003 - RNA, 64 nt, Human
cgggcgccuguagucccagcuacuugguaggcugaggcaggagaauggcgggaacccgggaggc

SEQ ID NO: 75004 - RNA, 64 nt, Human
ugcaugccuguaaucccagcuacuugggaagcugaggcaggagaaucgcuugaaccagagaguc

SEQ ID NO: 75005 - RNA, 64 nt, Human
gugccugccuguaauccagcuacucaggaggcugaggcaggauaauuuugcuuaaacccgggag

SEQ ID NO: 75006 - RNA, 64 nt, Human
acgcagacauaugcccauagcaucccacaggcccaggcaggaggucccaccccagacccugccc

SEQ ID NO: 75007 - RNA, 64 nt, Human
cacaugccuguaaucccagcuacucaggaggcugaggcaggauaaucacuugaauccgggaggc

SEQ ID NO: 75008 - RNA, 64 nt, Human
cacgcgucugugguccuagcuccucgggaggcugaggcaggagaaucgcuugaacucgggaggc

SEQ ID NO: 75009 - RNA, 64 nt, Human
gaaaugcugccggcugcacccagagggagcagugaggcaggacagauggacagguuccuccugc

SEQ ID NO: 75010 - RNA, 64 nt, Human
ucaugcccuguaauccuagcacuuugggagggugaggcaggaggauggcucaagcccaggaguu

SEQ ID NO: 75011 - RNA, 64 nt, Human
caccugccuguaaucccagcuacuugggaggcugaggcaggagaaucacuugagcccaggaggu

SEQ ID NO: 75012 - RNA, 64 nt, Human
cgggugccuguaaucccagcuacuggggaggcugaggcaggagaaucacuugaauucaggaggu

SEQ ID NO: 75013 - RNA, 64 nt, Human
ugcacaccugucgucucagcuacucgggaggcagaggcaggagaauggcuugaaccugggaagc

SEQ ID NO: 75014 - RNA, 64 nt, Human
ugcaugccucuaaucccagcuacucaggaggcuaaggcaggagaaucacuugaaccuggagaca

SEQ ID NO: 75015 - RNA, 64 nt, Human
cacgugccuguagucucagcuacuugggacgcugaggcaggaaaauccguugaacccaggaggc

SEQ ID NO: 75016 - RNA, 64 nt, Human
cgggcgccuguagucccagcuaugcgagaggcugaggcaggagaauggcgugaacccgggaggc

SEQ ID NO: 75017 - RNA, 64 nt, Human
ugcaugccuguaaucccagcuacuugggaggcuaaggcaggagaaucacuugaauccaggaggc

SEQ ID NO: 75018 - RNA, 64 nt, Human
ugugcaccuguaauuccagcuacucgggaggcugaggcaggagaauugcuugagcccgggaggc

SEQ ID NO: 75019 - RNA, 64 nt, Human
ccuccagcucucaguuacaagugcaggcgacuggaggcaggacuccugggucccugggaaagag

SEQ ID NO: 75020 - RNA, 64 nt, Human
ugggugccuguaauccuagcuacuugggaggcugaggcaggagaauugcuugaacuugggaggu

SEQ ID NO: 75021 - RNA, 64 nt, Human
ggugcgcuuguaaucccagcuacucgggaggcugaggcaggagaauugcuugaacccaugaggu

SEQ ID NO: 75022 - RNA, 64 nt, Human
aggcccgacugcacccuccccuucugguagucauaggcaggauugagugacgguugggaagggg

SEQ ID NO: 75023 - RNA, 64 nt, Human
guuucaccgccuucucuacucaccuucucuucggaggcaggagaguugguaagaggauugggaa

SEQ ID NO: 75024 - RNA, 64 nt, Human
ugccugcaaacauggagggcauuuggccacagauaggcaggaggagcucaguugucggacagcu

SEQ ID NO: 75025 - RNA, 64 nt, Human
aagguaggcagacccuggacccagccucagauccaggcaggagcacgaggucuggccaaggugg

SEQ ID NO: 75026 - RNA, 64 nt, Human
cgggcaccuguagucccagcuacucgggaggcugaggcaggagaauggcaugaaccugggaggc

SEQ ID NO: 75027 - RNA, 64 nt, Human
ccugugaucucaaucucagcuacucgggaggcugaggcaggagaaucacuugaacccaggaggu

SEQ ID NO: 75028 - RNA, 64 nt, Human
cucacaccuguaaucucagcacuuugggaggccaaggcaggaagaucacuugagcccgcaaguu

SEQ ID NO: 75029 - RNA, 64 nt, Human
caggugccuguaguccuagcugcuugggaggcugaggcaggagaauggugugaauccuggagac

SEQ ID NO: 75030 - RNA, 64 nt, Human
ugggcgccuguagucccagcuacucaggaggcugaggcaggagaauggcaugaaccgaggaggu

SEQ ID NO: 75031 - RNA, 64 nt, Human
ugcaugccuguagucucagcuacuugggaggcugaggcaggagaauugcuugaauccaagaggc

SEQ ID NO: 75032 - RNA, 64 nt, Human
caggugccuguaaucccagcuacuugggaggcugaggcaggagagugcuugaacccaggaggcg

SEQ ID NO: 75033 - RNA, 64 nt, Human
cgugcgccuguaaucccagcuauauaggaggcugaggcaggagaaucacuugaacccaggaggc

SEQ ID NO: 75034 - RNA, 64 nt, Human
ugcacgccuguaaucccagcuacucgggaggcugaggcaggagaaucacuugaaccugggaggc

SEQ ID NO: 75035 - RNA, 64 nt, Human
cgggcaccuguagucccagcuacucaggaggcugaggcaggagaaucgcuugaacccgggaggu

SEQ ID NO: 75036 - RNA, 64 nt, Human
aucaugucuguaauccuagcacugugggaggccaaggcaggaggaucgcuugagcccaggaguu

SEQ ID NO: 75037 - RNA, 64 nt, Human
uuugggucuggaguucuggcuacuugaggaccaaaggcaggaaggauccugccuugauuuuacu

SEQ ID NO: 75038 - RNA, 64 nt, Human
augcagaaagaaacaggcuggggccuggauucugaggcaggaaggaauuugggucuggaguucu

SEQ ID NO: 75039 - RNA, 64 nt, Human
cgugugccuauggucccagcuacucaggaggcugaggcaggagaauugcuucaauccaggaggu

SEQ ID NO: 75040 - RNA, 64 nt, Human
cucacaccugucauccuagcacuuugggaggcagaggcaggaggaucgcuugagcucaggaguu

SEQ ID NO: 75041 - RNA, 64 nt, Human
ugguuaggaaccgcucaccccaacaugugucuuaaggcaggacgacuuggaaaaaaaggcggcg

SEQ ID NO: 75042 - RNA, 64 nt, Human
ugggcaccuguaaucccagcuacccgggaggcugaggcaggagaauugcuugaaccugggaggu

SEQ ID NO: 75043 - RNA, 64 nt, Human
caggugccuguagucccagcuacucgggaggcugaggcaggagaauggcgugaaccugggaggc

SEQ ID NO: 75044 - RNA, 64 nt, Human
ugugcaucuguagucucagcaacuuaggagccugaggcaggagaaugguuugaacacagggaug

SEQ ID NO: 75045 - RNA, 64 nt, Human
gucacacuuguaaucccacuacuuugggaggccaaggcaggaagauugcuugagcucaggaguu

SEQ ID NO: 75046 - RNA, 64 nt, Human
ugggugccuguagucccagcugcuugggaggcugaggcaggagaauucguuaaaccugggaggc

SEQ ID NO: 75047 - RNA, 64 nt, Human
ugugugccuguaaucccagcuacuugggaagcugaggcaggagaauugcuugaaccugggaggu

SEQ ID NO: 75048 - RNA, 64 nt, Human
guguuacuccauugucagaggaggaaacggggucaggcaggaaagcaacuuaaaggagggccug

SEQ ID NO: 75049 - RNA, 64 nt, Human
aaagcuucgauggagagcagggaagggggacccaaggcaggagguacaccagcuggacaaauug

SEQ ID NO: 75050 - RNA, 64 nt, Human
cagaguggcacuacugcccggccaguccaggcucaggcaggaaucggacgcuggggcccgggcu

SEQ ID NO: 75051 - RNA, 64 nt, Human
cacaugccuauagucucagcuacuugugaggcugaggcaggaggauucuuugagcccaggaguu

SEQ ID NO: 75052 - RNA, 64 nt, Human
gugguuucauugaaaagaaauuagaagggguuaaaggcaggaauagcaaagagugcaaacuugg

SEQ ID NO: 75053 - RNA, 64 nt, Human
cacaugccuguauucccagcugcuugggaggcugaggcaggagaauggcuugaaccugggaggu

SEQ ID NO: 75054 - RNA, 64 nt, Human
cugggguuauuuaugaaaggagugauccuggggcaggcaggaggcagugggcuucauggcuccu

SEQ ID NO: 75055 - RNA, 64 nt, Human
cuguauacagaauaucauugauauaauacucuuuaggcaggagcacucuugccuucccccaaaa

SEQ ID NO: 75056 - RNA, 64 nt, Human
guagcugccgggucaucagcaagaaaugaauuggaggcaggaagaguccaagccugaauaauaa

SEQ ID NO: 75057 - RNA, 64 nt, Human
cugcgcagcgagcaggcgugugcguguguggggcaggcaggauguggugcaggcagguuccauc

SEQ ID NO: 75058 - RNA, 64 nt, Human
cucauaccuguaauccuagcacucugggaggccgaggcaggaggaucccuuuagcccaggaguu

SEQ ID NO: 75059 - RNA, 64 nt, Human
acugggaggugccccgccagcccugggcagugucaggcaggacucacucaccgcugagcagaug

SEQ ID NO: 75060 - RNA, 64 nt, Human
ugcgugcaucuagucccaacuauuugggaggcugaggcaggaggaucgcuugagcccaggaguu

SEQ ID NO: 75061 - RNA, 64 nt, Human
gacacgccuguaaucccagcuacucaagaggcugaggcaggagaauagcuugaacccgggaggc

SEQ ID NO: 75062 - RNA, 64 nt, Human
ugcauaccuguaaucccagcuacucgggaaccugaggcaggagaauggcuugaacccaggagac

SEQ ID NO: 75063 - RNA, 64 nt, Human
aucagcaacugcagugugaggacagcgucucgggaggcaggacccuagggagacccgggugugc

SEQ ID NO: 75064 - RNA, 64 nt, Human
ccugaugcaggagggugcgauagcggacguggccaggcaggaggggccggguucaggagcugag

SEQ ID NO: 75065 - RNA, 64 nt, Human
accgcagaggccacgugaacccacggccacagagaggcaggacggcagagccaugauuucccac

SEQ ID NO: 75066 - RNA, 64 nt, Human
cuccagagauuacaaaaauguagcuucucaggggaggcaggaagaaaggaaggaaggaaagaag

SEQ ID NO: 75067 - RNA, 64 nt, Human
ugagcccaggacccacuggagccagccccacccuaggcaggaagaccccugcugagggcccccc

SEQ ID NO: 75068 - RNA, 64 nt, Human
aaggagccucucuuguuuuuucuauaaaauggguaggcaggagaaaagcaggugcccuaagauu

SEQ ID NO: 75069 - RNA, 64 nt, Human
ugcaugccuguaaucccaguuacucgagaggcugaggcaggaaaaucgcuugaacccgggaggc

SEQ ID NO: 75070 - RNA, 64 nt, Human
ugcacaccuguaguccuagcuucuugggaggcugaggcaggauugcuugagcccaggaguuuga

SEQ ID NO: 75071 - RNA, 64 nt, Human
uugagagagacugagacaggagucuuccggagucaggcaggaaggagaagcacagcaauauaca

SEQ ID NO: 75072 - RNA, 64 nt, Human
gccagaagugcaauuaaccucuuagguggcaaggaggcaggaagugccucuuuaguucuuacau

SEQ ID NO: 75073 - RNA, 64 nt, Human
acagcuaugggagccccagggucuucccuaccucaggcaggaagggcaggaaggagagccugcu

SEQ ID NO: 75074 - RNA, 64 nt, Human
guggugagugucagcaucuacaguacagccaggcaggcaggaccuugaggaaucagacuaucug

SEQ ID NO: 75075 - RNA, 64 nt, Human
gcugggcacuauuuacauaaaccagagcugagccaggcaggaauuugcugauuaauuuauuuuu

SEQ ID NO: 75076 - RNA, 64 nt, Human
uuucauacucuuuucuuugguauucaggacacuaaggcaggaggaccacaugaguucugguugg

SEQ ID NO: 75077 - RNA, 64 nt, Human
aaaacccagacgccaggaaaagaagaaacaacaaaggcaggagaacagccacuuucagacuuga

SEQ ID NO: 75078 - RNA, 64 nt, Human
ccaggauucccagagagacgcugugauuggcaggaggcaggauauccccagggaaacccaucuu

SEQ ID NO: 75079 - RNA, 64 nt, Human
ucaaagggucagugcgucagugccuuuucuucugaggcaggaaacaggugccaucuuggccacc

SEQ ID NO: 75080 - RNA, 64 nt, Human
ugcugaaguugacuugaaaacacacuugacccucaggcaggagggcacugaccacaccccacac

SEQ ID NO: 75081 - RNA, 64 nt, Human
cgggcgccuguaaucccagcuacuugggaggcugaggcaggagaaucgcuugacuccaggaggc

SEQ ID NO: 75082 - RNA, 64 nt, Human
gcaugugccuuuaaucccagcuacagggaggcugaggcaggagaaucacuugaaccugggaggc

SEQ ID NO: 75083 - RNA, 64 nt, Human
aagaaaaggaaaauaguagcaagagcugcaaagcaggcaggaagggaggaggagagccagguga

SEQ ID NO: 75084 - RNA, 64 nt, Human
cgcaugccuauaaucccagcuacucgagugccugaggcaggagaauugcaugaacccgggagga

SEQ ID NO: 75085 - RNA, 64 nt, Human
cgcgcgccuguugucuuagcuacucaggaggcugaggcaggagaaucgcuugaaaacaggaggu

SEQ ID NO: 75086 - RNA, 64 nt, Human
uugcuacuggggauuacccauggauauccuuaauaggcaggaagucugggaauucugguggccu

SEQ ID NO: 75087 - RNA, 64 nt, Human
acugaaaaccagguuauauucuaaagaagaaagaaggcaggauagugcuuuugaacaagccuau

SEQ ID NO: 75088 - RNA, 64 nt, Human
cucaugccuguaaucccagcuacucgggaggcugaggcaggagaauggcuagaacccgggaggc

SEQ ID NO: 75089 - RNA, 64 nt, Human
cccauccugaccagcugcuccgaggacccaggaaaggcaggauugaaaauguccaggaaagugg

SEQ ID NO: 75090 - RNA, 64 nt, Human
cuaaaaacuaauugucgagaagccaagggugaggaggcaggaagcaccuccgguuggaggcacc

SEQ ID NO: 75091 - RNA, 64 nt, Human
gaagaccuggcuuccgcgagagccuuguuccuggaggcaggagcgccccgccauccuggguacc

SEQ ID NO: 75092 - RNA, 64 nt, Human
cacaugccuguaaucccagcuacucgggaggcugaggcaggagaauugcuugaaccugggaggc

SEQ ID NO: 75093 - RNA, 64 nt, Human
agaaggccgcggaggagccggaugcugagccgggaggcaggaagaagacggaggagccgggcga

SEQ ID NO: 75094 - RNA, 64 nt, Human
ugggcgccuguagucccagcuacuugggaggcugaggcaggagaaugguaugaaccagggaggc

SEQ ID NO: 75095 - RNA, 64 nt, Human
ucuugccuggaauaaaaugccucuacucagaaacaggcaggaaagaauugcuccaaggaauacu

SEQ ID NO: 75096 - RNA, 64 nt, Human
aacucuaagaguuuaguugcuaccucagguccacaggcaggacuuccuccaacccucuuguccc

SEQ ID NO: 75097 - RNA, 64 nt, Human
ggaaacuucagaguacaaauugguggaugguggaaggcaggacacguaucucugucugacggaa

SEQ ID NO: 75098 - RNA, 64 nt, Human
ugcagcuggcccugaguacagggaaguggaacauaggcaggauuuuggauuaauagagaaauuu

SEQ ID NO: 75099 - RNA, 64 nt, Human
uguguguaucuaguuccagcuacuugagaggcugaggcaggaggauugcuugaguccagaaagu

SEQ ID NO: 75100 - RNA, 64 nt, Human
gucccgggaggugcccugggcccggggaccucacaggcaggacggcgacacuaaugcagggaga

SEQ ID NO: 75101 - RNA, 64 nt, Human
cgggcgccuguagucccagcuacucugaagacugaggcaggagaauggcgugaacccaggaggc

SEQ ID NO: 75102 - RNA, 64 nt, Human
ugcacgccuguagucucagcuacucaggaggcugaggcaggagaaucgcuugaacccgggaggc

SEQ ID NO: 75103 - RNA, 64 nt, Human
cucaugccuguaaucccagcacuuuaagaggcugaggcaggaggaucacuugagcucaggaauu

SEQ ID NO: 75104 - RNA, 64 nt, Human
cacaugccuguaguccuagcuacuugggaggcugaggcaggagaauugcuugaaucugggaggc

SEQ ID NO: 75105 - RNA, 64 nt, Human
acucuggcuagagagacacaugugucuugugucaaggcaggaggauaaccuggaugaccuucug

SEQ ID NO: 75106 - RNA, 64 nt, Human
gcauuuaacccccuacucugucaucucagaccccaggcaggaggcccaguguuccaacacccaa

SEQ ID NO: 75107 - RNA, 64 nt, Human
cgcgugccuguaaucccagcuacuugguaggccgaggcaggagaaucgcuuaaacccgugaggu

SEQ ID NO: 75108 - RNA, 64 nt, Human
ccgcacagccggucagaacugugugacucacuugaggcaggaccgagagugacauccaguugca

SEQ ID NO: 75109 - RNA, 64 nt, Human
cccuccggccacccuagaccaggguccgagaggcaggcaggagccacucaugucuuccccauug

SEQ ID NO: 75110 - RNA, 64 nt, Human
ugccggucggcguagccaggccuggaggccccccaggcaggaggccgcccaaaggcggggccgg

SEQ ID NO: 75111 - RNA, 64 nt, Human
agggguuaaugcagauggcagugcagcaaggagaaggcaggaacauuggagccugcaauaaggg

SEQ ID NO: 75112 - RNA, 64 nt, Human
cgggcgccuguaguuccagcuaacugggcggcugaggcaggagaauggcgugaaccugggaggu

SEQ ID NO: 75113 - RNA, 64 nt, Human
cuuauaccuguaauuucagcacuuggggaggccaaggcaggaggcuugcuugaggcaaggaguu

SEQ ID NO: 75114 - RNA, 64 nt, Human
cacacacauucaggaaccuguuuugauguauuauaggcaggaaguguuuuugcuaccgugaaac

SEQ ID NO: 75115 - RNA, 64 nt, Human
cucaugccuguagucccagcuacuugggaggcugaggcaggaggaucacuuaagcccagaaggc

SEQ ID NO: 75116 - RNA, 64 nt, Human
cgggcgccuguagucccagcuacucuggaggcugaggcaggagaguagcgugaacccgggaggc

SEQ ID NO: 75117 - RNA, 64 nt, Human
ugugcgugguggucccuggguagcgggggaggguaggcaggauuggggaagagagccugcagga

SEQ ID NO: 75118 - RNA, 64 nt, Human
caggcgccuauaaucccagcuacucgggaggcugaggcaggagaauaacuuaaacccgggaggc

SEQ ID NO: 75119 - RNA, 64 nt, Human
cggaugccuguagucccagcuacucaggaggcugaggcaggagaauggcgugaacccagaaggc

SEQ ID NO: 75120 - RNA, 64 nt, Human
gcuggaaauaugacccugugcagacugcugggggaggcaggaggaugccugccuggacccuguu

SEQ ID NO: 75121 - RNA, 64 nt, Human
ugcaugccuguaaucccagcuauucggaaggcugaggcaggagaaucacuugaacccaggaggc

SEQ ID NO: 75122 - RNA, 64 nt, Human
aaucuagugugcagggcauucaccucagccccccaggcaggagccaagcacagcaggagcuucc

SEQ ID NO: 75123 - RNA, 64 nt, Human
cacaugccuguaaucccagcuacucgggaagcugaggcaggagaauugcuugaaccagggaguu

SEQ ID NO: 75124 - RNA, 64 nt, Human
cacaugacuguaaucccagcuacucaggaggcugaggcaggaggaucacuugaaccugggaggc

SEQ ID NO: 75125 - RNA, 64 nt, Human
cacaugccaguaauuccaucuacucgggaggcugaggcaggagaaucgucuaagcccgggaggu

SEQ ID NO: 75126 - RNA, 64 nt, Human
cagucgguguggaaugucacucuugcagucuuugaggcaggauaaguauuuuuacauauuuuaa

SEQ ID NO: 75127 - RNA, 64 nt, Human
cgagugccuguaaucuuagcuacucaggaggcuaaggcaggagaaucacuugaaccugggacac

SEQ ID NO: 75128 - RNA, 64 nt, Human
gggcuauucccauauuccucacagcuggcuuguaaggcaggagcuggcccaggccacagcaccu

SEQ ID NO: 75129 - RNA, 64 nt, Human
uucucaagacucaucugccuagggagggucacagaggcaggauguaagacacacuguguugcau

SEQ ID NO: 75130 - RNA, 64 nt, Human
aauguuauauauugacaccccagugucaucagucaggcaggagccaaacaaugaaugccccucu

SEQ ID NO: 75131 - RNA, 64 nt, Human
cgugcaccuguaaucccagcuacucaggaggcugaggcaggagaaucgcuuguacccaggaggc

SEQ ID NO: 75132 - RNA, 50 nt, Human
ucaucaccaagggggacugaaggcaggagagagagcagcuccccugccca

SEQ ID NO: 75133 - RNA, 64 nt, Human
gggguuaaugcagauggcaagugcaccaaggagaaggcaggaaugcuggagccuggaauaaggg

SEQ ID NO: 75134 - RNA, 64 nt, Human
gggguuaaugcagauggcaagugcaccaaggagaaggcaggaacacuggagccugcaauaaggg

SEQ ID NO: 75135 - RNA, 64 nt, Human
guucucaucccuucaaugcccccucccuuucugaaggcaggaaggaguuggcacagaggccccc

SEQ ID NO: 75136 - RNA, 64 nt, Human
caugugcuuguaaucccagcuacucuggaggcugaggcaggagaauugcuugaacccaggaggc

SEQ ID NO: 75137 - RNA, 64 nt, Human
ggugcuuagcuccagagcaggaugggacuuccccaggcaggaagcacuugauggagagcugccc

SEQ ID NO: 75138 - RNA, 64 nt, Human
guggacacagucccuuuccuuccugcagaugccuaggcaggaggagggcuuccugccuguuugg

SEQ ID NO: 75139 - RNA, 64 nt, Human
cucacaccuguaauccuagcaucuugggaggcccaggcaggaggguugaagucagaauuucacg

SEQ ID NO: 75140 - RNA, 64 nt, Human
accagagacucauguuuccaggggucagucugucaggcaggaaggacccaggauuugaacccag

SEQ ID NO: 75141 - RNA, 64 nt, Human
gcgcucagugagugccccgggccuucuagacaacaggcaggaaggaugaaccucagggcacccc

SEQ ID NO: 75142 - RNA, 64 nt, Human
ggacgcaagauacucuauagccaagucagcuuggaggcaggauggguugcugagugaagucgcc

SEQ ID NO: 75143 - RNA, 64 nt, Human
ugugagcucuggaaugucugcuuagaauucugagaggcaggaacugcucugucuuuguaacuac

SEQ ID NO: 75144 - RNA, 64 nt, Human
cgcacgccuguaaucucagcuacuagggaugcugaggcaggagaaucgcuugaacccaagaaag

SEQ ID NO: 75145 - RNA, 64 nt, Human
ugagugacuggugggaagaguacaucuaccuucgaggcaggagcccucucauggugaacagcaa

SEQ ID NO: 75146 - RNA, 64 nt, Human
acaccuggcgcagauugcagcgcagcuguguuggaggcaggacugggcuguuuccucagccuuu

SEQ ID NO: 75147 - RNA, 64 nt, Human
guucucuguauugucuauuauuuagaaaugaacaaggcaggaaacaaaagauucccuugaaauu

SEQ ID NO: 75148 - RNA, 64 nt, Human
auucauacaaauaaugagcccuacacagggaacaaggcaggaaguuagcuguuaacuccuugug

SEQ ID NO: 75149 - RNA, 64 nt, Human
ccaggggccuggaaacacuaggauucaggaagguaggcaggacgugagagaagggagaugggag

SEQ ID NO: 75150 - RNA, 64 nt, Human
cauuuucaugccugucaauccccaccccaccacaaggcaggaaggggguggugccugcuggggc

SEQ ID NO: 75151 - RNA, 64 nt, Human
uguacgccuguaaucccagugacuugggaggcugaggcaggagaaucgcuugaacccgggaggc

SEQ ID NO: 75152 - RNA, 64 nt, Human
ccucagggagcugcaaaacucauccaggagaaaaaggcaggagcagcaagugaccccucccaag

SEQ ID NO: 75153 - RNA, 64 nt, Human
caggcaccuguagucccagauacucgggaggcuaaggcaggagaaucgcuugacgggaagcgga

SEQ ID NO: 75154 - RNA, 64 nt, Human
cgggggccuguaauccuagcuacuuggggugcugaggcaggagaaucaacugaacccgggaggc

SEQ ID NO: 75155 - RNA, 64 nt, Human
gcucauggccaaaugugcgcacucuacauaaaggaggcaggaguuccuauaggcuauuuaaugu

SEQ ID NO: 75156 - RNA, 64 nt, Human
uuucauuuacaucaaaguuaucucacaaaagagaaggcaggaaacguuuugugagugccuauuc

SEQ ID NO: 75157 - RNA, 64 nt, Human
cccaaaccuaguccugguagcugagcacccuguaaggcaggagcaggcagcucagcuugagcag

SEQ ID NO: 75158 - RNA, 64 nt, Human
ugcaugccuguaaucccagcuacuugggaggcugaggcaggagaaucgcuugaacccaggaggu

SEQ ID NO: 75159 - RNA, 64 nt, Human
ggccaguccuaguucuugguccagggagaagucuaggcaggauaaaucauaucuuaccucaaaa

SEQ ID NO: 75160 - RNA, 64 nt, Human
caugcaucuguagucccaccuauucaggagauuaaggcaggaggaucacuugagcccaggaggu

SEQ ID NO: 75161 - RNA, 64 nt, Human
cgggcgccuguagucccagcuacucgggaggcugaggcaggagaauggugugaacccgggaggc

SEQ ID NO: 75162 - RNA, 64 nt, Human
uccgaacaauccuuguagaguauguaccauccaaaggcaggagggccucgccguggccggcucu

SEQ ID NO: 75163 - RNA, 64 nt, Human
ccaugacacacaccaguagucccagcuacuagggaggcaggaggaucacuugagcccaggaguu

SEQ ID NO: 75164 - RNA, 64 nt, Human
cgggcaccuguaauccuggcuacucgggaggcugaggcaggagaaucgcuugaacccgggaggc

SEQ ID NO: 75165 - RNA, 64 nt, Human
ugcacuccuguaacccugggacuuugggaagcugaggcaggaagauugagccuaggaguucgag

SEQ ID NO: 75166 - RNA, 64 nt, Human
cgugcaccuguaauccuagcuacucaggaggcugaggcaggagaaucgcuugaaccugggaggu

SEQ ID NO: 75167 - RNA, 64 nt, Human
cgcgugccuguaauuccaucuacucgggaggcugaggcaggagaaucgcuugauccugggaguu

SEQ ID NO: 75168 - RNA, 64 nt, Human
uguucuuuauucuucaucccccgcuagagcuggaaggcaggaugaggagagguaugaaggagcc

SEQ ID NO: 75169 - RNA, 64 nt, Human
gaccaguggaaauuguauaauuuaacuuggauuuaggcaggaagugaaauaugggaggaguaaa

SEQ ID NO: 75170 - RNA, 64 nt, Human
ugggcgccuguaaucccaguuacucgggaggcugaggcaggagaaucacuugaacccgggaggc

SEQ ID NO: 75171 - RNA, 64 nt, Human
aagcacuucugaaagcagauaugagucaccagacaggcaggaucuuacaaaacucacgggccuc

SEQ ID NO: 75172 - RNA, 64 nt, Human
cucacgccuguaaucccagcacuuugggaggccaaggcaggaggaucgcuggagcccaguaggu

SEQ ID NO: 75173 - RNA, 64 nt, Human
cccacucccaaccacguugggacagggaggugugaggcaggagagacaguuggauucuuuagag

SEQ ID NO: 75174 - RNA, 64 nt, Human
cggacgcccaucaucccagcuacuugggaggcugaggcaggagaauugcuugaacccgugaggc

SEQ ID NO: 75175 - RNA, 64 nt, Human
cccagggacaccuggagcccccaggagcugggagaggcaggaaggauccuccccuagagccucc

SEQ ID NO: 75176 - RNA, 64 nt, Human
cccagggaugccuggaguccccaggagcugggagaggcaggaaggacccuccccuagagucucu

SEQ ID NO: 75177 - RNA, 64 nt, Human
acaguggccaaaauuugcaagugccuugugaacacccaccgagacagcgccuucauauuccuca

SEQ ID NO: 75178 - RNA, 64 nt, Human
agccaagccaauccuuuuucuuuuuuuuggaggucccaccgagauagauaggaacuuggauugc

SEQ ID NO: 75179 - RNA, 64 nt, Human
gggugggcccagaacugcccccacugucccccuacccaccgauggagcccccagauagagcugg

SEQ ID NO: 75180 - RNA, 64 nt, Human
gcauuacauggccaggugagcugucccccgacaucccaccgaaucugaugcugcugcugccuuu

SEQ ID NO: 75181 - RNA, 64 nt, Human
gcaccucucuccacaaggcccaggcgcccagggucccaccgaccugcccaggaaugcaucacau

SEQ ID NO: 75182 - RNA, 64 nt, Human
gcccuuaacucuaucccuauuaggaaccuuguuucccaccgaauaagaguuaagguaagaggua

SEQ ID NO: 75183 - RNA, 64 nt, Human
aacuaaaauagacguggagcaagagaaaugcauucccaccgaggccgcuuuuuuaggccuaguu

SEQ ID NO: 75184 - RNA, 64 nt, Human
uggaccccgccggccgcgggucucccggcccaaccccaccgacccagaccaagaccgcgccgag

SEQ ID NO: 75185 - RNA, 64 nt, Human
agcccccaucuucaagggcugcuucuacacccaccccaccgaggugcugaagccugucagccag

SEQ ID NO: 75186 - RNA, 64 nt, Human
guuagagcuggugagagaggagucagguggccuucccaccgaugguccuggccuccaccugccc

SEQ ID NO: 75187 - RNA, 64 nt, Human
aaacuaaaaacuaggaaaguguuaacuaucguugcccaccgaauuugagguagcaaaaaaaaaa

SEQ ID NO: 75188 - RNA, 64 nt, Human
uuugacagugauuccccacguguguucaucugcacccaccgagccaggcagaggccagcccucc

SEQ ID NO: 75189 - RNA, 64 nt, Human
agggcugcccacccacagccagaauccacaggaucccaccgagaaggagagccaggugugccga

SEQ ID NO: 75190 - RNA, 64 nt, Human
ggacucuacccacggcuaaggucuucauuucccucccaccgaaccuugauuucaagguggcacc

SEQ ID NO: 75191 - RNA, 64 nt, Human
uguguuccucaaucacacugaagccacagcugggcccaccgaggugcuauccugcccaggccag

SEQ ID NO: 75192 - RNA, 64 nt, Human
uuuuguuuggagagcacaccuaucuuagugguuccccaccgaaguggacuggccccugggucag

SEQ ID NO: 75193 - RNA, 64 nt, Human
ccggcuggccugugcccagccugugcgugucaaccccaccgacugcugcaaacaguguccaggu

SEQ ID NO: 75194 - RNA, 64 nt, Human
augccaaaagagggugcugccccuagccugggcccccaccgacagacugcagcugcguuacugu

SEQ ID NO: 75195 - RNA, 64 nt, Human
aaaguucaggcauuuauggggagaaaaggcccuccccaccgacccgccaccugccaccucugac

SEQ ID NO: 75196 - RNA, 64 nt, Human
uagauuuaccucagauccaugccaccaaacaucucccaccgaguuauuuggugggauuugcagg

SEQ ID NO: 75197 - RNA, 64 nt, Human
uuuuuauauccauuccuugaugucauuggccucucccaccgauuucauuacggugccacgcagu

SEQ ID NO: 75198 - RNA, 64 nt, Human
uguuaggaaugcagauucucaggccccccuaagacccaccgacucugugcuagaacaagcgccc

SEQ ID NO: 75199 - RNA, 64 nt, Human
uuugccaagaugggaggaggccagugcccacuugcccaccgaccugagccugaguaaguggcug

SEQ ID NO: 75200 - RNA, 64 nt, Human
caaaagagcagaauccucccaccgcccugcccuccccaccgaguccuguggccauucagagcgg

SEQ ID NO: 75201 - RNA, 64 nt, Human
gucuugaaagaauucuacaaauaccacacagccucccaccgagucuugcucugucgccaggcug

SEQ ID NO: 75202 - RNA, 64 nt, Human
uccagucucggcagcagcuccgcucccggcgccacccaccgacacccccagaacccucuggggg

SEQ ID NO: 75203 - RNA, 64 nt, Human
aaagaaggucugagaacuccccucccucccuggacccaccgaugccucucgaagcccuggagac

SEQ ID NO: 75204 - RNA, 64 nt, Human
ucuugcaggcuagcucccgcccugccugcccggccccaccgaggccugagcacguucccgggug

SEQ ID NO: 75205 - RNA, 62 nt, Human
ucauggauccgcucuacugaucuucuccgaggcccaccgaaggguacugaagagccucaccu

SEQ ID NO: 75206 - RNA, 64 nt, Human
gcccaccccgcucugcaugcggcccagcccggcucccaccgaggcgcgggggccguuuucaacg

SEQ ID NO: 75207 - RNA, 64 nt, Human
aauaugaccaugagccauuucacagaaaaaccaucccaccgaagauauugucuaucaccccagg

SEQ ID NO: 75208 - RNA, 64 nt, Human
cccuuugggagcccgccuuguggauccaccacaccccaccgagcacuagaagcugcauaagcua

SEQ ID NO: 75209 - RNA, 64 nt, Human
gucucuugaggucccuugaaucuuccgcuuccuccccaccgauuucagcguguccacaucacag

SEQ ID NO: 75210 - RNA, 64 nt, Human
agaagaacuuucagccaauaaagcuugugcuucccccaccgagcucacgcugucucuuuguucc

SEQ ID NO: 75211 - RNA, 64 nt, Human
acaccgcuggcuccgcaugguucauuuucugaugcccaccgaggagccccagccccgucccaga

SEQ ID NO: 75212 - RNA, 64 nt, Human
aaggcucugcucagcccugagagucccuuccugccccaccgauacuggcacuuuaaaaaggaag

SEQ ID NO: 75213 - RNA, 64 nt, Human
ggugcaccugaucucccccaauguguaccgcacgcccaccgaggcucuggcguccuuugacuac

SEQ ID NO: 75214 - RNA, 64 nt, Human
uuuggugguggguggcuuggcauugccccuuuuucccaccgauucgguggcuggugaagguggg

SEQ ID NO: 75215 - RNA, 64 nt, Human
auccuuggaacugccuaguccccaugacugugugcccaccgagcuccugaguguucucauuccu

SEQ ID NO: 75216 - RNA, 64 nt, Human
accugcaagugcccgcccugccccugccccaacccccaccgaagagcccugagcucaggcugag

SEQ ID NO: 75217 - RNA, 64 nt, Human
acauucaauuccagagaaccaaaaaucccaccuucccaccgaacacuacuaaggggcuuguguu

SEQ ID NO: 75218 - RNA, 64 nt, Human
cgcccaggcacggccgaccccgccccgggcaccgcccaccgagccauccugccucgccuccccc

SEQ ID NO: 75219 - RNA, 64 nt, Human
cagauucaacaggaaaccgaucuuccccugacuccccaccgaggagagccucuccucgacccug

SEQ ID NO: 75220 - RNA, 64 nt, Human
uuucuuccuccaggcuuuacuccccuuuuuaugccccaccgauacacugggaccaccccuuacc

SEQ ID NO: 75221 - RNA, 64 nt, Human
gccaacuggcagcugcgggacccuuggcuugucccccaccgacaagucccaccugcugggugag

SEQ ID NO: 75222 - RNA, 64 nt, Human
cccucccagacaggcccucccugucuccagggcccccaccgagguucccagggcuggagacuuc

SEQ ID NO: 75223 - RNA, 64 nt, Human
ugcgcuugagaccuucuccacgcagcaggaagaucccaccgacccuuccuggccuaauccuuua

SEQ ID NO: 75224 - RNA, 64 nt, Human
auagguauuuauccguuuccacuggcuuuuuguacccaccgagccccugagccuugcgugugug

SEQ ID NO: 75225 - RNA, 52 nt, Human
ugcaguggcgcgucauuuaguacccaccgagagcuguggggagcagcauggg

SEQ ID NO: 75226 - RNA, 64 nt, Human
cucuguucauuguuugucucagggaaaaucuucccccaccgagcuuguaaaaaacuuuaauaau

SEQ ID NO: 75227 - RNA, 64 nt, Human
gcugccuccuggaagcuuuuccaagugugagcgccccaccgacugugugcugaucagagacugg

SEQ ID NO: 75228 - RNA, 64 nt, Human
gccugugccuuugucagcucuucuuucaaaagaccccaccgacagaccgcauuccacccccaac

SEQ ID NO: 75229 - RNA, 64 nt, Human
caguccagguaguguugagacccaggccuguggccccaccgagcuggagcggagaggaagccag

SEQ ID NO: 75230 - RNA, 64 nt, Human
gugcagaggaaacagaaacucccaacuguccuuacccaccgacaucacagccccuaugaagaaa

SEQ ID NO: 75231 - RNA, 64 nt, Human
ggaaggccaagugggaggcugggaggcugccccacccaccgacucuaccaagucucucuuccuc

SEQ ID NO: 75232 - RNA, 64 nt, Human
uauaaggaaauccagccccauagaaaacaaucugcccaccgacccccuuucuaaggauagccuu

SEQ ID NO: 75233 - RNA, 64 nt, Human
cagagccuucaggugccaaagccauacucaggcccccaccgacauuguccacccuggccagaag

SEQ ID NO: 75234 - RNA, 64 nt, Human
uugucucccuaagcaauggggcaaggucugagggcccaccgaugagagagaugguggcagccgc

SEQ ID NO: 75235 - RNA, 64 nt, Human
cgcgcugugcugccugucuucgcgccacuguugucccaccgaauggacagcuuugcaggugcug

SEQ ID NO: 75236 - RNA, 64 nt, Human
uguggcccagccggcuggaaccucaagggccccacccaccgagauugcagcggcucuggcuaau

SEQ ID NO: 75237 - RNA, 64 nt, Human
gaacagggagauggacaaccacuucaaagaaagacccaccgaaugcaguuucugcuugacugac

SEQ ID NO: 75238 - RNA, 64 nt, Human
accuggccaggugaugcucugggggcagcaucuccccaccgagagaagcgggcuccuaaugagg

SEQ ID NO: 75239 - RNA, 64 nt, Human
gguuguccucugacaggccuggcacggaggagggcccaccgaguggucccaugaaacacuaagg

SEQ ID NO: 75240 - RNA, 64 nt, Human
agcacauuccagcucuauuuaaaaaguaaagacacccaccgacuccugaucccccucuuuuucu

SEQ ID NO: 75241 - RNA, 64 nt, Human
ggcccccugcccgcacccggacacuugaucgauccccaccgacgcccccugcaccgccuccaac

SEQ ID NO: 75242 - RNA, 64 nt, Human
guuugcuuuguccuuccaaagcaggugagucagccccaccgagagccaggcagcuuugaguggc

SEQ ID NO: 75243 - RNA, 64 nt, Human
caccuccuuagggacagacccuggcaggucgcugcccaccgagauuuccucaagugugcauaga

SEQ ID NO: 75244 - RNA, 64 nt, Human
aaaugaagaccuuucccuccaccacugaugcagucccaccgaaagccuccaucugcuccagggg

SEQ ID NO: 75245 - RNA, 64 nt, Human
gggccgggagagcuucccugacgggagucgcggccccaccgaggcgucggccgcccgaagagcc

SEQ ID NO: 75246 - RNA, 64 nt, Human
acugacuacuucccuuucuuuucucaggccuccccccaccgacuuuugaggccaggguuggcca

SEQ ID NO: 75247 - RNA, 64 nt, Human
aggggcuucggugccgcgugggcaguacgcaggucccaccgacacucaccugggagcacggcgc

SEQ ID NO: 75248 - RNA, 64 nt, Human
gcgccucugccggacacggaccggccccucagcccccaccgaggacgcagccacuggggggaaa

SEQ ID NO: 75249 - RNA, 64 nt, Human
uugagaauggaaaaaucccccagcccagcccagccccaccgaaaagcaaaaauuacacgucguc

SEQ ID NO: 75250 - RNA, 64 nt, Human
ccggcccucugccccuccuguccuacccccuuuccccaccgagagcugggccgggagaggaccg

SEQ ID NO: 75251 - RNA, 64 nt, Human
ggcagcguggccuguggcaccgugaggguugggacccaccgaggcgcagaggcggcccgaaugc

SEQ ID NO: 75252 - RNA, 64 nt, Human
uccagagagggggcaccuccccacacaccccccccccaccgaggccuaggccccugccaccccc

SEQ ID NO: 75253 - RNA, 64 nt, Human
agcacuacccuaacccucagccgacagucucagccccaccgacccacuuucuuggcauauagcc

SEQ ID NO: 75254 - RNA, 64 nt, Human
gcuccucaagaggaagaaaccgagaggcccgcgccccaccgaggaagccccgccccggugccuu

SEQ ID NO: 75255 - RNA, 64 nt, Human
ucucacccucagacccccucgccuuccccaccuccccaccgagaacuccagagacccagauguu

SEQ ID NO: 75256 - RNA, 64 nt, Human
cugacaguucaaaaucucuuucagcugcgcucuucccaccgagccgagcuuacugugagugugg

SEQ ID NO: 75257 - RNA, 64 nt, Human
gccacagagaggcaggacggcagagccaugauuucccaccgagcgauuacgagaaccucuuccc

SEQ ID NO: 75258 - RNA, 64 nt, Human
ccugugaaauggcuugucuccucccccaucagggcccaccgaaagcucaggggagcacagaagc

SEQ ID NO: 75259 - RNA, 64 nt, Human
ugcauuguaguuauuauuuuaaaauagaaacuaccccaccgacucaucuuuccuucucuaagca

SEQ ID NO: 75260 - RNA, 64 nt, Human
uggcagggcuggcugugcuggguuccagcucgcucccaccgagggacuagcuuggccuuugcgc

SEQ ID NO: 75261 - RNA, 64 nt, Human
ggagguggccccagaugcccacugugcgcaucuccccaccgaggccccggcagcagucuuguuc

SEQ ID NO: 75262 - RNA, 64 nt, Human
ucugcucuguugucuguucuuucccugacucccucccaccgaaggccugauggcuacucacccc

SEQ ID NO: 75263 - RNA, 64 nt, Human
gcccucccucccucuccccacccucagaaggauccccaccgauggggaccugugcuggccugug

SEQ ID NO: 75264 - RNA, 64 nt, Human
aggcagaagcucccagagccccugucucgggcuccccaccgacuggcagcugcacuauccccaa

SEQ ID NO: 75265 - RNA, 64 nt, Human
caucagggagugguguagucaguugaaggcaguucccaccgaguuuuccgagccucagaaucca

SEQ ID NO: 75266 - RNA, 64 nt, Human
gcuaaccuggcagcuguggggcccuuaggagccccccaccgaggguggacacagucccuuuccu

SEQ ID NO: 75267 - RNA, 64 nt, Human
accccagcgcugcgccgcguccgaacgucgagaccccaccgagggcgggagggggacucucggg

SEQ ID NO: 75268 - RNA, 64 nt, Human
aaauuaugucaguggugaaaugucacuccauugacccaccgaaaaaagaaaagaaaucuguuuc

SEQ ID NO: 75269 - RNA, 64 nt, Human
gccauuauuaagucccuguaacucaaaugucaaccccaccgaggcacccccccgucccccagaa

SEQ ID NO: 75270 - RNA, 64 nt, Human
uguggcuuggauccgccaugcagagauguggccgggcacccaucuuccuucccuccucuguccc

SEQ ID NO: 75271 - RNA, 64 nt, Human
gucccgaacucccugaggccuccccucccuucagggcacccacugguucccaggcuggaaccag

SEQ ID NO: 75272 - RNA, 64 nt, Human
auucuucuccaggcuggcccgcccccucugacuaggcacccaaagugagcaucugggcauuggg

SEQ ID NO: 75273 - RNA, 64 nt, Human
gacaucguggcuguccaguugggcugugagcuguggcacccaggacuggcgcuggcccuucaga

SEQ ID NO: 75274 - RNA, 64 nt, Human
cccugagcguccuguucugagggcccagggcccgggcacccacaagcccgugacagaugccaac

SEQ ID NO: 75275 - RNA, 64 nt, Human
uccugccucagccuccaaaguagcugggauuacaggcacccaccacaucuggcuaauuuuuugu

SEQ ID NO: 75276 - RNA, 64 nt, Human
agccuguaucagacaaagguaaaucagccagccaggcacccacagccucagcuccugugcaguu

SEQ ID NO: 75277 - RNA, 64 nt, Human
aauaaagauuuccuccaagccacaugaggacucuggcacccacccacaaagcaagaccuguauu

SEQ ID NO: 75278 - RNA, 64 nt, Human
gggcuggagucaagauagcggggcccuggccuggggcacccacugcacacucagggccagaccc

SEQ ID NO: 75279 - RNA, 53 nt, Human
ugaaggugcggcccgccuagacgggccaggaccccuccacaugcaccugcuag

SEQ ID NO: 75280 - RNA, 64 nt, Human
cagggaagggucugccccugcccuggcacacacaggcacccauucccucccccugcugacaugu

SEQ ID NO: 75281 - RNA, 64 nt, Human
uccucccucagccucccaaguagcugggauuacaggcacccacgagcaugcccggcuaauuuuu

SEQ ID NO: 75282 - RNA, 64 nt, Human
gagagggaggucacuggaaaggggagagccugcuggcacccaccguggaggaggaaggcaagag

SEQ ID NO: 75283 - RNA, 64 nt, Human
ccagccugcacauggguagaagaggccaaauugaggcacccaagugauccacuggccccacguc

SEQ ID NO: 75284 - RNA, 64 nt, Human
gguggauguggcugggguuuccugguauuguggaggcacccagguuguccaugcuugggauucu

SEQ ID NO: 75285 - RNA, 64 nt, Human
agggacuaggcuugcaggugagauaaugggccagggcacccaguccagaaggagcaauggcacc

SEQ ID NO: 75286 - RNA, 64 nt, Human
cugauuagccaggccuggucaggguccuggggacggcacccagauaugcagagucacccugaca

SEQ ID NO: 75287 - RNA, 64 nt, Human
accagugagggcuugagggugacguccuuccugcggcacccagcuggggccugucugugccccu

SEQ ID NO: 75288 - RNA, 64 nt, Human
cagggcucccuucuccucugccugguuagacucgggcacccaggaaagccuggccagggcuccu

SEQ ID NO: 75289 - RNA, 64 nt, Human
cgaggccagccuccuccagcugcuggcaggggcuggcacccaugggacacccucugcccccagc

SEQ ID NO: 75290 - RNA, 64 nt, Human
cccucaaucccugaccguuccaggcacugagcugggcacccacggaaggacaugcuguccagac

SEQ ID NO: 75291 - RNA, 64 nt, Human
ggcuucccgugcgccucugccgcaggugcuucugggcacccauccucugcguuucauuugcagu

SEQ ID NO: 75292 - RNA, 64 nt, Human
cuucagccaaguuuucauuugggagcuacccaagggcacccaugagcuccuaucaagaagugau

SEQ ID NO: 75293 - RNA, 64 nt, Human
ccaggacugguuccagugagagaaaccaaccacaggcacccaagcacuaccagacaaagcguau

SEQ ID NO: 75294 - RNA, 64 nt, Human
uuccaugagaugcucgaggagcaccugcugguggggcacccagcacucugcugggcaucacccu

SEQ ID NO: 75295 - RNA, 64 nt, Human
agcuagaagaaaaggcucaccuggccacuguuuaggcacccagacauaauuuauggacgaaaug

SEQ ID NO: 75296 - RNA, 64 nt, Human
cccacugcugcccucugcagagccaucugcuccaggcacccaccugccucugcuugcuuucuca

SEQ ID NO: 75297 - RNA, 64 nt, Human
cugccccuggguuccugccuucccuccucaagcaggcacccaggcuuuagagaaguauaggggg

SEQ ID NO: 75298 - RNA, 64 nt, Human
uccugugucagucuccugaguagcugggauuacaggcacccaccacuaugcccagcuaauuuuu

SEQ ID NO: 75299 - RNA, 64 nt, Human
auugaauaggaucaaauucuacaacuuuuccuaaggcacccacaaauaaaugacaagugagaca

SEQ ID NO: 75300 - RNA, 64 nt, Human
gaucauaagacugucauguaagaggugcucuccuggcacccagagaaaaggagcauccuuaccu

SEQ ID NO: 75301 - RNA, 64 nt, Human
ggcuuuaucauuccuuuccaguucauaaacaacaggcacccacaaccagaggaaucuauaguuu

SEQ ID NO: 75302 - RNA, 64 nt, Human
ucugggucugcugggggcacaguaaaucagucuuggcacccacauccagggcagagaggucugu

SEQ ID NO: 75303 - RNA, 64 nt, Human
ggcggaagccuuaaagcagcagcgggugugcccaggcacccagaugauuccuauggcaccagcc

SEQ ID NO: 75304 - RNA, 64 nt, Human
caucagcugaccaagacaccugaggacacaucuuggcacccagaggagcagcagcaacaggcug

SEQ ID NO: 75305 - RNA, 64 nt, Human
cuuaagaguccaacucacuuccagugcccaaaagggcacccaccagaaauuccaguaaauccuc

SEQ ID NO: 75306 - RNA, 64 nt, Human
uccugccucagccucccgaguagcugggacuacaggcacccaccaucaugcuuggcuaauuuuu

SEQ ID NO: 75307 - RNA, 64 nt, Human
uuucuucaugguguccauuuuauuuagcaaggacggcacccacacacaaagaggaugauuuccc

SEQ ID NO: 75308 - RNA, 64 nt, Human
uccugccucagccucccaaguagcugggauuacaggcacccaccaccucacccagcuaauuuuu

SEQ ID NO: 75309 - RNA, 64 nt, Human
agccauuuguaccuguuugcuucccaucccacuuggcacccacucugaccucuugucaguuucc

SEQ ID NO: 75310 - RNA, 64 nt, Human
cuguccccaacagcugggguggcacucugcccugggcacccaugacccucugcugucucucccu

SEQ ID NO: 75311 - RNA, 64 nt, Human
uauccaucgaagcagaugcucugaacccugagcaggcacccacuucccugcaggacaguauucc

SEQ ID NO: 75312 - RNA, 61 nt, Human
uuacagaugugacccuauaauauggaacucuggcacccaggcaugaagcacguuggccagu

SEQ ID NO: 75313 - RNA, 64 nt, Human
cauccuucucaucgcuaacaccaccaccuccaucggcacccaagcgggcaucauccccccacac

SEQ ID NO: 75314 - RNA, 64 nt, Human
guggaucaggcaggcucucuccccggggacaugaggcacccauaccuaggacccccugcgccuu

SEQ ID NO: 75315 - RNA, 64 nt, Human
ugacacggacuuguaucuccuucagagcucggcuggcacccagccucccuucuccuuccacucc

SEQ ID NO: 75316 - RNA, 64 nt, Human
cccaggaggcugacugagcucaaaggaacaggauggcacccagagccgcaggacggagacuggg

SEQ ID NO: 75317 - RNA, 64 nt, Human
gcagaguucucagaaucaugcugagagagcuggaggcacccaugccaucucaaccucuuccccg

SEQ ID NO: 75318 - RNA, 64 nt, Human
cugcuuccugguucucagucccaccccaaaaccuggcacccagaacaguuggaaguguggaaag

SEQ ID NO: 75319 - RNA, 64 nt, Human
cauagucuucugccugcaguuuuauaguuugaggggcacccauauuuguggguuagaguuagua

SEQ ID NO: 75320 - RNA, 64 nt, Human
gcccggcccugaggguccagaagggccagggccuggcacccaccuggagaagcccccgcacccg

SEQ ID NO: 75321 - RNA, 64 nt, Human
ugacacucggcucuggcucugagaugaggcagacggcacccaggcugugaucuguccugggcgg

SEQ ID NO: 75322 - RNA, 64 nt, Human
ucauuucccucccaccgaaccuugauuucaagguggcacccagcauccugaagccaagaaaggu

SEQ ID NO: 75323 - RNA, 64 nt, Human
cuggcuuugauuugaaauuuuguaaaaauuucauggcacccaagguuucugauucugacccagc

SEQ ID NO: 75324 - RNA, 64 nt, Human
ugggcagggcuccagaaagucagcagugugccugggcacccaccccauccucuaccugccacac

SEQ ID NO: 75325 - RNA, 64 nt, Human
ugaccaggcccagaaggaaccagccaugagguucggcacccaggucuccggaggagacacaguu

SEQ ID NO: 75326 - RNA, 64 nt, Human
uuguacaaccugugaucaagcaauaauaauuuuaggcacccauccuagagaaaacuugaauuca

SEQ ID NO: 75327 - RNA, 64 nt, Human
ucuugaacagcccaaaguaucauucucagauaggggcacccaagcuaaggguauuagccaaaga

SEQ ID NO: 75328 - RNA, 64 nt, Human
ggagccagggcugcggcacaugugcugugaaacuggcacccaccuggcgugcugcugccgccac

SEQ ID NO: 75329 - RNA, 64 nt, Human
uccugccucagccuccugaguagcugauacuacaggcacccaccaccacgcccagcuaauuuuu

SEQ ID NO: 75330 - RNA, 64 nt, Human
gcugccacccgcuuuccgggcacccauccauccaggcacccaacucacccaagcagcaacgagc

SEQ ID NO: 75331 - RNA, 64 nt, Human
cgcccucauggaccccgcugccacccgcuuuccgggcacccauccauccaggcacccaacucac

SEQ ID NO: 75332 - RNA, 64 nt, Human
uuugagcagcugugagcugagcgcccacuagaggggcacccaccaguugcugcugccccacuac

SEQ ID NO: 75333 - RNA, 64 nt, Human
uagcugagggucacucgcccugcaagagucacuaggcacccaccaugccaauaaggcucuccgc

SEQ ID NO: 75334 - RNA, 64 nt, Human
gcccagccucucuggcucagcccgggauccugauggcacccacacagaggaccucuuuggggca

SEQ ID NO: 75335 - RNA, 64 nt, Human
uagcccagacacagaagaggcugguucuuacgauggcacccagugagcacucccaagucuacag

SEQ ID NO: 75336 - RNA, 64 nt, Human
guguaagggcagacaaacaggugagggugaguguggcacccagagacugcucuuccugcccuca

SEQ ID NO: 75337 - RNA, 64 nt, Human
uggggagucccaaagcgggacgccgcagguguuuggcacccaaaucacaucucaccuccgaacu

SEQ ID NO: 75338 - RNA, 64 nt, Human
uccugccucaaccucccgaauggcugggacuacaggcacccaccaccacgccuggcuaacuaac

SEQ ID NO: 75339 - RNA, 64 nt, Human
auccuugaggcucagggaugagagggcaccgcaaggcacccagccuuaccccacaagcaggaau

SEQ ID NO: 75340 - RNA, 51 nt, Human
aucgaagagcugaaauguagcggcacccaauuucuagacaacgcucagcca

SEQ ID NO: 75341 - RNA, 64 nt, Human
ggguucugacuggcgugugggagacccuguggccggcacccaccuccacacgaggacuaagcuc

SEQ ID NO: 75342 - RNA, 64 nt, Human
ucuuuuacuuaagaagaaacuugguaaucauuguggcacccacagcaagcaguugccuuaccag

SEQ ID NO: 75343 - RNA, 64 nt, Human
agaggaccauucuuaguggcacuggggaaaucuuggcacccagaagaauucaacugcgcucacu

SEQ ID NO: 75344 - RNA, 64 nt, Human
uguagcuccuggccucagagccccugcugacccuggcacccagggaccugccugggggcagaga

SEQ ID NO: 75345 - RNA, 64 nt, Human
cucugggcuuuuuaaugagaggcuuggcgcaugcggcacccagcggcugcuucccugcaagcca

SEQ ID NO: 75346 - RNA, 64 nt, Human
aagcauuaccuaacauggugaucugcaaguaguaggcacccaauaaauauuuguugaauuuagu

SEQ ID NO: 75347 - RNA, 64 nt, Human
gcccugugggggccugguccucuccucaggggugggcacccaucccucuccccacugagccccu

SEQ ID NO: 75348 - RNA, 64 nt, Human
cugcgucucaugaggccgcugccgcugcugcaggggcacccagaccuccagagcauccagagcc

SEQ ID NO: 75349 - RNA, 64 nt, Human
uucccucuuagaaaaucucagaagaaugauuaggggcacccaaaguucugguuaucuaugaaua

SEQ ID NO: 75350 - RNA, 64 nt, Human
uuuagaauucuuuccuucaugugccaucucuacaggcacccaucagaaaaagcauacugccguu

SEQ ID NO: 75351 - RNA, 64 nt, Human
auacuucucagcugcaaauauuauggagaauuggggcacccacaggaaugaagagagaaagcag

SEQ ID NO: 75352 - RNA, 64 nt, Human
uccugccucagccuccugaguagcuggaauuacaggcacccaccaccacacccagcucauuuuu

SEQ ID NO: 75353 - RNA, 64 nt, Human
uccugccucugccucccaaguagcugggauuacaggcacccaccaccaugcccagcuaauuuuu

SEQ ID NO: 75354 - RNA, 64 nt, Human
uccucuugaccugugucugacuugcuccuggaugggcacccacacucagaggcuacauauggcc

SEQ ID NO: 75355 - RNA, 60 nt, Human
aaaagguggaugagaaguagcugggcauggggcacccaugugccgagagccuugcagacc

SEQ ID NO: 75356 - RNA, 64 nt, Human
ggccaggcccgacaccuacacucucaccagcuuuggcacccaccaaggacaggcagaagccgga

SEQ ID NO: 75357 - RNA, 64 nt, Human
agccauaccuguucuggaagggagaggggcuggaggcacccacaggcacaagcugaaggcagca

SEQ ID NO: 75358 - RNA, 64 nt, Human
gcauguuuucuguuuuaaagaccagaaguuugaaggcacccaaauccuugucgccaaucuccug

SEQ ID NO: 75359 - RNA, 64 nt, Human
cucgugagaugggggauccugugcaggcugaugaggcacccaugagaaaagccgaaaaagcaug

SEQ ID NO: 75360 - RNA, 64 nt, Human
ucaaggccaugaacucacuggauuuccauuuuuaggcacccauagggauguuuuuaggauguaa

SEQ ID NO: 75361 - RNA, 64 nt, Human
gagcuucugggugaugccaggcccaagucuuuguggcacccagcuccaugcuuugaauacuaug

SEQ ID NO: 75362 - RNA, 64 nt, Human
caaacuccugggcucaagugauucucccaccucaggcacccaaauagcuggaacuacaggcaua

SEQ ID NO: 75363 - RNA, 64 nt, Human
uugugaaggucaguuugaggcaucacaaauuuaaggcacccagacauaagggucaacaggguua

SEQ ID NO: 75364 - RNA, 64 nt, Human
cagcugagaacauagcacaggcccacguggugagggcacccacagcuuaaagacgcuuccuucu

SEQ ID NO: 75365 - RNA, 64 nt, Human
gaauugugccuacuaaauuauagcaggggacuuuggcacccaaggaguucugacuuucugggau

SEQ ID NO: 75366 - RNA, 64 nt, Human
accccaccuccagcccccgccaccgggcucccugggcacccagcaagaucuggggcugcagaga

SEQ ID NO: 75367 - RNA, 64 nt, Human
gcccgccgugccugcauucgcagcagcuccgccuggcacccacuccggauuccggcccuggcug

SEQ ID NO: 75368 - RNA, 64 nt, Human
uuaauuuuuuuagcugccauuuaagcauuccuguggcacccaucaccauuucaauuuaauuguu

SEQ ID NO: 75369 - RNA, 64 nt, Human
caagugccgcauucuucaggaaggaagagaccugggcacccaagaccugguuuccuuucauuca

SEQ ID NO: 75370 - RNA, 64 nt, Human
uagucccauuccccuuugaucucacagcaggcagggcacccaggccuuauaggaauucacccug

SEQ ID NO: 75371 - RNA, 54 nt, Human
ucuacaaggacauguacuaacggcggcacccaggccucccugcagacuccaaug

SEQ ID NO: 75372 - RNA, 64 nt, Human
uugaacuccugagcucaagugaucuuccugccuuggcacccaaaguguugagauuuacaggugu

SEQ ID NO: 75373 - RNA, 64 nt, Human
ugccaucauuggcugaagcaccaccaggauucacggcacccaacugcuucaggguacuucguag

SEQ ID NO: 75374 - RNA, 64 nt, Human
gcugaaggggcccugcuccccauccccuaccaugggcacccaugugcuggcacagaacaguucc

SEQ ID NO: 75375 - RNA, 64 nt, Human
agaauaaaagcggagauauauuuuuugacacagaggcacccaaagaaauacaaacauugccuag

SEQ ID NO: 75376 - RNA, 64 nt, Human
uccugccuuagccucccgaguagcugggauuauaggcacccaccaccacgcccagcuaauuuuu

SEQ ID NO: 75377 - RNA, 64 nt, Human
gaggccuguguucgggagggccugggagaaggagggcacccagcaccccggcgucucuggcccu

SEQ ID NO: 75378 - RNA, 64 nt, Human
gcugccacccucaggccugggccccagagcucagggcacccagugucuuaaggaaccauuugga

SEQ ID NO: 75379 - RNA, 64 nt, Human
guucccuuccuggcuaauagggagacccuucgcaggcacccacuguuucaacuugacccuccca

SEQ ID NO: 75380 - RNA, 64 nt, Human
uccaugggagcuugaggcaguaagggggaucccaggcacccaucucaaggaguggcugggaguc

SEQ ID NO: 75381 - RNA, 64 nt, Human
gauguugaagacaggggucucgggggugggcuccggcacccacauccuggagucaggacuuucc

SEQ ID NO: 75382 - RNA, 64 nt, Human
acacccaagggcccagcugucuugccugcccgugggcacccacggacguggcuuggugcugagg

SEQ ID NO: 75383 - RNA, 64 nt, Human
ggcaggccaccucugggcaggaccaccugcgucuggcacccaggaggugaggcagacaccaugg

SEQ ID NO: 75384 - RNA, 64 nt, Human
ggaggaggggguaggugaugggggacgagggccaggcacccacauccccaauaaagccgcgucc

SEQ ID NO: 75385 - RNA, 64 nt, Human
gugggcucacagaccccggccucggagcccgucuggcacccagagugaccacaaguccagcagg

SEQ ID NO: 75386 - RNA, 64 nt, Human
accaggacucagcaugauggacaguggaugggggggcacccacaccuuccgcgcagucgucaua

SEQ ID NO: 75387 - RNA, 64 nt, Human
cucgccaggugauggcagggccaggguggccuggggcacccagcggaaugugcuuaguauuugg

SEQ ID NO: 75388 - RNA, 64 nt, Human
aacucacugguacaguggggagaccuguaaccagggcacccagaagagucugguguacggccuc

SEQ ID NO: 75389 - RNA, 56 nt, Human
guaagaagaggaugucuuaggaggagggcacccagaaguaucgagccauagcuauc

SEQ ID NO: 75390 - RNA, 64 nt, Human
uuaaaaucuagccuauaaacaaaaacuaguuugaggcacccaagcauuuagugagagauugaga

SEQ ID NO: 75391 - RNA, 64 nt, Human
cacaacuaugucuggucaccagcucccuccugcuggcacccagagacccggacccgcagggccu

SEQ ID NO: 75392 - RNA, 64 nt, Human
ccucucccuuccccucccaccugcccccugcguaggcacccagacuuggagagacccgucugcu

SEQ ID NO: 75393 - RNA, 64 nt, Human
cggcuccggcggugcccaccccucaggcuggcccggcacccaagacuggccacagccagcucug

SEQ ID NO: 75394 - RNA, 64 nt, Human
ggaguuaucuucccacugugguaaccccccauguggcacccagggacugaaggacacagugcgu

SEQ ID NO: 75395 - RNA, 64 nt, Human
uuccauggcauaacacuaaggcgcagacuccuaaggcacccacuggcugcaugucaggguguca

SEQ ID NO: 75396 - RNA, 64 nt, Human
auugaucauuucaagaaaccucuguuuacuguguggcacccaggcaaaacaugcuccacaaauu

SEQ ID NO: 75397 - RNA, 64 nt, Human
ccagggucauaaguggggagagagcccuucccagggcacccaggcaggugcagggaagugcaga

SEQ ID NO: 75398 - RNA, 64 nt, Human
uuccaccucagccucccagguagcugggauuacaggcacccaccaccacgccuggcuaauuuuu

SEQ ID NO: 75399 - RNA, 64 nt, Human
ucagagcuguuuuuaauugacugaguuaccuacaggcacccaaucuagacccuaauucuguggu

SEQ ID NO: 75400 - RNA, 64 nt, Human
cuaccucgggaggaaggucucacaucugucucugggcacccaugcuggccagcaguuucccagg

SEQ ID NO: 75401 - RNA, 64 nt, Human
acacucacagaggcccccucugucaucacuccuuggcacccaccaacuuccugcacacacuggc

SEQ ID NO: 75402 - RNA, 64 nt, Human
cagcacgugcugagggcauggggccugcccccugggcacccauccacaagcugggccacggagc

SEQ ID NO: 75403 - RNA, 64 nt, Human
aggagaccccaucgcagacgucaguggucucuggggcacccacacgcgccuccgugauacccuc

SEQ ID NO: 75404 - RNA, 64 nt, Human
cuuuagccccggagcuccaggcccagcggaugcuggcacccaagcgcagcugggggaccccuca

SEQ ID NO: 75405 - RNA, 64 nt, Human
ugcugauggccacuucagggacagccugggcccaggcacccagggggauggcggcagcuuccug

SEQ ID NO: 75406 - RNA, 64 nt, Human
ucgugccucagccucccgaguagcugggauuacaggcacccaccaccacgcccagcuaauuuuu

SEQ ID NO: 75407 - RNA, 64 nt, Human
ggaguggcaccuuagugugggucggcccgcagauggcacccaaggccgggaagggcaguaacug

SEQ ID NO: 75408 - RNA, 64 nt, Human
ggacggggagugagguugggcagugugguggaugggcacccaggaaggguugaccagggaagga

SEQ ID NO: 75409 - RNA, 64 nt, Human
aggugccguggagcagcaggcuggcuuugguaggggcacccaucacccggcuugccugugcagu

SEQ ID NO: 75410 - RNA, 64 nt, Human
uccugccucagcuuccuaaguagcuggguuuacaggcacccaccaccaugcccagcuaauuuuu

SEQ ID NO: 75411 - RNA, 64 nt, Human
ggauggccacagggcggggcugccaggcucugcaggcacccaggguggggaggccacccuuccu

SEQ ID NO: 75412 - RNA, 64 nt, Human
acacauuugugugccugauuugaaaggaagcuggggcacccagcgaguuuagccuuuaaguuuc

SEQ ID NO: 75413 - RNA, 64 nt, Human
uuaccuggggaaguugacaacuuguugguaguuaggcacccaugaaugucuccagagacauccu

SEQ ID NO: 75414 - RNA, 64 nt, Human
ucuggauugaugaucacugaggaucuguaugugaggcacccauaacaguaguuuugccugugag

SEQ ID NO: 75415 - RNA, 64 nt, Human
agacgugcuggccccaggaggauacaggcacacgggcacccagccccucucagagccaggcgug

SEQ ID NO: 75416 - RNA, 64 nt, Human
gccagugugguucuggggaccugaggagcccuguggcacccacagggggcaccuaugucugccg

SEQ ID NO: 75417 - RNA, 64 nt, Human
cccaugaaccagcccagcauccagccagugagugggcacccaaugccucucaggaugagaccag

SEQ ID NO: 75418 - RNA, 64 nt, Human
ccguggaccuuugugcuccuggggcagagccuccggcacccaguggccucccccagacagagcc

SEQ ID NO: 75419 - RNA, 64 nt, Human
gggcuaaugagccaauaaagcucacacuugggcuggcacccacuggagguggguauguuugcac

SEQ ID NO: 75420 - RNA, 64 nt, Human
agugcuggagaugaccccgagccccuccccguggggcacccaggagggcccugccggaaugugc

SEQ ID NO: 75421 - RNA, 64 nt, Human
gccagccucagccucccuaguagcugggacuacaggcacccacuaccacgccuggcuaauucuu

SEQ ID NO: 75422 - RNA, 64 nt, Human
cuccaggucagcucugcaaggggcuugucucuguggcacccacacuccugcccugccagggagg

SEQ ID NO: 75423 - RNA, 64 nt, Human
aucagcagcccagugagcaccagggguggcauagggcacccaugaggcugcgcugcacuccucu

SEQ ID NO: 75424 - RNA, 64 nt, Human
cuuuaaggaguuuucccuggcuccaaaggccauuggcacccacccaaguauuaugggaaaccuc

SEQ ID NO: 75425 - RNA, 64 nt, Human
ggagcuagccagaggacugugaugcccugcccuuggcacccaagaccucagggcacaaagaugg

SEQ ID NO: 75426 - RNA, 64 nt, Human
ggcagcccugccccugaagacccucuaggagcagggcacccaguggcccugcugcuguccagcc

SEQ ID NO: 75427 - RNA, 64 nt, Human
uggcacacaccguggccuaccuggggaagcugcgggcacccauccgcuccgugaccuacacccu

SEQ ID NO: 75428 - RNA, 64 nt, Human
aagccuugcaugcaaaauuugaaauuuuaacauuggcacccaaaaccuacauggaauguauguc

SEQ ID NO: 75429 - RNA, 64 nt, Human
ggcccuccaggacggacaccgggugaccccuuagggcacccaggcaagaucccuaagaggcacc

SEQ ID NO: 75430 - RNA, 64 nt, Human
gaccccuuagggcacccaggcaagaucccuaagaggcacccaaugcccaggccaggggggcugc

SEQ ID NO: 75431 - RNA, 64 nt, Human
ugugggcauagcauuagcugcuuccuccccuccuggcacccacuguggccuggcaucgcaucgu

SEQ ID NO: 75432 - RNA, 64 nt, Human
uucugccucagccucccgaguagcugggauuaccggcacccaccaccacgccuggcuaauuuuu

SEQ ID NO: 75433 - RNA, 64 nt, Human
uucacuguauaugauucgguauuggggguuuggaggcacccagacccuggcaauauuauguguc

SEQ ID NO: 75434 - RNA, 64 nt, Human
cugacuuugagaacucugugagacaagguccuuaggcacccagauaucagccacuuucacauuu

SEQ ID NO: 75435 - RNA, 64 nt, Human
cuuuucaaauguccaucaauugauggggaaggcuggcacccaccaagaaguggaaguccucaga

SEQ ID NO: 75436 - RNA, 64 nt, Human
agcaagcuaaccuuauccugcauuguuagcacuaggcacccagcugccaccucuccauccugcu

SEQ ID NO: 75437 - RNA, 64 nt, Human
guguggggguuggaagcugucuguggcccacuugggcacccacgcuucuguccacuucugguug

SEQ ID NO: 75438 - RNA, 64 nt, Human
gcagcagauaucagugggaagggcugggggagggggcacccagcugccuuuccucccucacagg

SEQ ID NO: 75439 - RNA, 64 nt, Human
acaaugccagaccgcagagaggcucauccuguagggcacccaaaacucaagcaagaugagcugu

SEQ ID NO: 75440 - RNA, 64 nt, Human
uccugccucagcaucccaaguagcugggauuacaggcacccaccaccaugcccaacuaauuuuu

SEQ ID NO: 75441 - RNA, 64 nt, Human
ucuaguggaaaaccuaagccucccucucuccuccggcacccauuaccucucccuggaggcaacu

SEQ ID NO: 75442 - RNA, 64 nt, Human
ccucucaugcugccuccucugcccauggguccugggcacccaggccugcccugccugcuggcua

SEQ ID NO: 75443 - RNA, 64 nt, Human
gcuuggggcuggggcaggcuugggcucaauccugggcacccaggggcagcccaccccuaaccug

SEQ ID NO: 75444 - RNA, 64 nt, Human
acaggggcucacugccccacacccgcuccaggcaggcacccagcugggcauuucaccugcuguc

SEQ ID NO: 75445 - RNA, 64 nt, Human
uggccucccgugacccccaggccgaggguccccgggcacccaggucggucaagucucggcccuc

SEQ ID NO: 75446 - RNA, 64 nt, Human
gcagggaggcagaugggacaggguccccuuccccggcacccaugcgccgggcccagagcucccu

SEQ ID NO: 75447 - RNA, 64 nt, Human
uccuugaugcaggagguggccuugccuggacgcgggcacccagccaacugccaugguguucccu

SEQ ID NO: 75448 - RNA, 64 nt, Human
cuuuaggaaguaagugaaaguaccuaaaauagcaggcacccaauugaugauuuuauaucuuccu

SEQ ID NO: 75449 - RNA, 64 nt, Human
cagcucagaacccaucccucugguggguaccucuggcacccaucugcaaauaucucccucucuc

SEQ ID NO: 75450 - RNA, 64 nt, Human
gagaucuggacucaccaaaucccugaggauagauggcacccauggcccccacccacggaaggac

SEQ ID NO: 75451 - RNA, 64 nt, Human
caauauccuaaaugugggggagggcccagagaauggcacccaagagccugcggggaugcccauc

SEQ ID NO: 75452 - RNA, 64 nt, Human
ggacucaucuccugccuaacuggacaggaagccuggcacccacuucugucuuccccuggaacug

SEQ ID NO: 75453 - RNA, 64 nt, Human
ggcacagcccugacuugaacucugggugacccugggcacccacagaacugggagugagggcucc

SEQ ID NO: 75454 - RNA, 64 nt, Human
ucccugaugcgggagguguccucgccuggacgcaggcacccagccgacugccacgauguucccu

SEQ ID NO: 75455 - RNA, 64 nt, Human
agagcuccuggccgguccugagcccucccucccaggcacccagcacuuuaagccugcuccaugg

SEQ ID NO: 75456 - RNA, 64 nt, Human
gaaguggcguuggugcucccuguggacuugcgucggcacccagaggccuuggagggacaaggca

SEQ ID NO: 75457 - RNA, 64 nt, Human
gaggugggcugagagguagaggguggaugcccagggcacccaaaccucccuucccuuucguguc

SEQ ID NO: 75458 - RNA, 64 nt, Human
ggaggggagacgcgaagggauugccuggucuaagggcacccagcagcagagcuaggacuuccgc

SEQ ID NO: 75459 - RNA, 64 nt, Human
uaggaguucuaagaacagaggcuggggugaggguggcacccaggcagcugcaucuggucuguuu

SEQ ID NO: 75460 - RNA, 64 nt, Human
uuuacagagcauaaggcugucuuggaucccaacaggcacccagcccugcauggggggagccugg

SEQ ID NO: 75461 - RNA, 64 nt, Human
gguucucccccuucccccucccccaggcugcccuggcacccaaauugcugccaugcuggcaucu

SEQ ID NO: 75462 - RNA, 64 nt, Human
caggagagggauacaagagaggagauggggucccggcacccaucuguaucaucagugccucuuu

SEQ ID NO: 75463 - RNA, 64 nt, Human
ugucuuccucucccuacaaugccucuggggccaaggcacccauucuucuugcuauccuccaucc

SEQ ID NO: 75464 - RNA, 64 nt, Human
gugcaaguucagauucuguggcagagauuuggaaggcacccaccuccagacugcuucccgucca

SEQ ID NO: 75465 - RNA, 64 nt, Human
uaaaucagaugccagcuguacugccggcucugccggcacccacagcaacgguacgagcuugugg

SEQ ID NO: 75466 - RNA, 64 nt, Human
cccugaccccggccgcugcugccagccucagaaaggcacccaggugugcaggggagcacacagg

SEQ ID NO: 75467 - RNA, 64 nt, Human
cagugggaaaggccacccuagaaagaaguccgcuggcacccauaggaaggggccucaggagcag

SEQ ID NO: 75468 - RNA, 64 nt, Human
gcaguaucccuguucagcccaccuuaaagguguaggcacccacugggucuaccaguaugcaggu

SEQ ID NO: 75469 - RNA, 64 nt, Human
aagugaccauaaaggcauggcauuuguugugacuggcacccaauguuugauuuuuuuuuuaaaa

SEQ ID NO: 75470 - RNA, 64 nt, Human
cauuuagaaagaaaauccccucagaaggcugucuggcacccaguguccuagccaggccaaguau

SEQ ID NO: 75471 - RNA, 64 nt, Human
ccaagagcaaaacucgccuguuuuuguccucaauggcacccaugagcuuuccaauaguauaguu

SEQ ID NO: 75472 - RNA, 64 nt, Human
cacuccugggucucggggucggggaggggacgggggcacccacuuccuugucugugacggcgug

SEQ ID NO: 75473 - RNA, 51 nt, Human
gaaagaaacgcugcugcuaauggcacccaguccacugcagagacugcacug

SEQ ID NO: 75474 - RNA, 64 nt, Human
uggcuugaagucacuguggaucgagcucacagggggcacccauccuguugucaacagagucuga

SEQ ID NO: 75475 - RNA, 64 nt, Human
gcugggccuaucaggaggacacaggcugcagccuggcacccaccccucccaucuccaccccaca

SEQ ID NO: 75476 - RNA, 64 nt, Human
aggucuggaggggccucaggggugcccccagcccggcacccagcgcuuucgccccucguccacc

SEQ ID NO: 75477 - RNA, 64 nt, Human
uguggugcuggacaagggccgcguagugcagcagggcacccaccagcagcugcuggcccagggc

SEQ ID NO: 75478 - RNA, 64 nt, Human
cuccugaguagcugggauuacagacacccgccauggcacccagcuaauuuuguauuuuuaguag

SEQ ID NO: 75479 - RNA, 64 nt, Human
uccuaccucagcuucccgaguagcugggauuauaggcacccaccaccacaccuggcuaauuuuu

SEQ ID NO: 75480 - RNA, 64 nt, Human
uguccagcugagcguaagagcuggaucucuuagcggcacccaauucagcagggcugaauccccu

SEQ ID NO: 75481 - RNA, 64 nt, Human
agagacugauucaaagaacaauggucucuuuaauggcacccaauacaguauugaaaaucagauc

SEQ ID NO: 75482 - RNA, 64 nt, Human
ggcccugugagggggcagggaaggggaggcagccggcacccacaagugccacugcccgagcugg

SEQ ID NO: 75483 - RNA, 64 nt, Human
gcagcccugggcucuucucuggccucuucaccagggcacccauccaaggaaccuccgaacagcc

SEQ ID NO: 75484 - RNA, 64 nt, Human
gcccugcagagaagagaaccaugccaggggagaaggcacccagccauccugacccagcgaggag

SEQ ID NO: 75485 - RNA, 64 nt, Human
caggagacucucagcucagcugagcuaguugccuggcacccaccugucgcgcgcggagaggggg

SEQ ID NO: 75486 - RNA, 64 nt, Human
ugggauauuuuuuacuucacauugaauauagccaggcacccaagaagucugauggccaccugag

SEQ ID NO: 75487 - RNA, 64 nt, Human
acggcucaagacaggccccagauccccucccaguggcacccaugccaccugcuuugagggguug

SEQ ID NO: 75488 - RNA, 64 nt, Human
ucugguucccagcaccugccugagaccugccccaggcacccauaaccuggaauucccuguuucc

SEQ ID NO: 75489 - RNA, 64 nt, Human
augcuucugucuccacucggcuuucccaaaaggcggcacccagcuccucaaucgaagcaucugc

SEQ ID NO: 75490 - RNA, 64 nt, Human
agagacugcccucagaaguuccuuguccagggugggcacccacagugacucagaggacagggcu

SEQ ID NO: 75491 - RNA, 64 nt, Human
uucuugccugguagcuccaggacccagcucugcaggcacccaaagacccucugugcccagccuc

SEQ ID NO: 75492 - RNA, 64 nt, Human
uuagguagaaggagccuccucaaaggcagugcugggcacccacgggugugcuggauacuggagu

SEQ ID NO: 75493 - RNA, 64 nt, Human
uccugccucagccucccaaguagcugggauuacaggcacccaccaccaugcccagcuaauuuuu

SEQ ID NO: 75494 - RNA, 64 nt, Human
uaggaaaggugacaugacacaggcagagcagaguggcacccaccacagaauacaguguguguua

SEQ ID NO: 75495 - RNA, 64 nt, Human
gugaccuggaucugaccucacaccaucagcagggggcacccaccaugcacaccugucucggagu

SEQ ID NO: 75496 - RNA, 64 nt, Human
guugugaguggacacccaacugggcacaggcucaggcacccauccuuuuuccaaacagggauau

SEQ ID NO: 75497 - RNA, 64 nt, Human
gcagcgaccccuccuagacgcucccuggccccucggcacccagaaugccacauucuuguguuuu

SEQ ID NO: 75498 - RNA, 64 nt, Human
uccuuuagcccgugugccuguaacucugagggggggcacccaguggggugcugagugggcagaa

SEQ ID NO: 75499 - RNA, 64 nt, Human
caggcucugccagcccucggccacacguggcuccggcacccauggucccagugccuuggaugga

SEQ ID NO: 75500 - RNA, 64 nt, Human
uccugucucagccuccccaguagcugggauuacaggcacccaccaccaugcccagcuaauuguu

SEQ ID NO: 75501 - RNA, 64 nt, Human
ccugaacacauuccucagugagaugcaggcaucuggcacccagcugcuauaaccaaguguccac

SEQ ID NO: 75502 - RNA, 64 nt, Human
accacuguccccucauccaccucggccugcauggggcacccacuuccuucuggguggggcuucc

SEQ ID NO: 75503 - RNA, 64 nt, Human
uuuucuuaagaaccagaacugcuggcagaaagggggcacccacacgcuuagauagccgaugucu

SEQ ID NO: 75504 - RNA, 64 nt, Human
uucugcuucagccucccgaguagcugggacuacaggcacccaccaucaugucuggcuaauuuuu

SEQ ID NO: 75505 - RNA, 64 nt, Human
aggccaggcaaggggcugguccaugaugucaucaggcacccagguuccuacugucuugccaugu

SEQ ID NO: 75506 - RNA, 64 nt, Human
uccugccucagcuucccgaguaacugagauuacaggcacccaccaccaugcccagcugcuuuuu

SEQ ID NO: 75507 - RNA, 64 nt, Human
cgugcugggcugugccucagacagugcaucaccgggcacccagaggcuugccuggcuauuccug

SEQ ID NO: 75508 - RNA, 64 nt, Human
gcuuugauauuucacuuacagcacccccaacccuggcacccagggugggaagggcuacaccuua

SEQ ID NO: 75509 - RNA, 64 nt, Human
gcacucugcauccucugucauuuuaaccucagguggcacccagggcgaauggggcccagggcag

SEQ ID NO: 75510 - RNA, 64 nt, Human
ugaccuuugccuugucgcccaggaaguggggcucggcacccauaacuaacaccucccacccuug

SEQ ID NO: 75511 - RNA, 64 nt, Human
aagacuuggggcucuuucugugacugaggacacaggcacccaggauaaggacaagguccugccu

SEQ ID NO: 75512 - RNA, 64 nt, Human
gacaaggaauuggaucacaaucauguagcagaauggcacccagaccacugcccaccagugacgg

SEQ ID NO: 75513 - RNA, 64 nt, Human
acgcuaagaacaugacuucugucugagcuaagcuggcacccaucccagggcuccucuggagcua

SEQ ID NO: 75514 - RNA, 64 nt, Human
cugguguguuaacaugucgcuagccagugcuccaggcacccagcuuugucuguggguuaguauu

SEQ ID NO: 75515 - RNA, 64 nt, Human
ggcccacaggugcugcccuugcugcugcuggucgggcacccaagugcgugaggggcuucagccu

SEQ ID NO: 75516 - RNA, 64 nt, Human
ccugaaucucuucuaaaccaauaauugaccucuaggcacccaccguaauacugcuaccuucagg

SEQ ID NO: 75517 - RNA, 64 nt, Human
aaccagggucuuccuguuccuagcacugagaaugggcacccagugguccaagaacacuuucugg

SEQ ID NO: 75518 - RNA, 64 nt, Human
ccaguguuuaaaacuucaguuucacagaaaauaaggcacccaucugucugccaaccuaaaacuc

SEQ ID NO: 75519 - RNA, 64 nt, Human
caguugcugcaugcccagggcagggugugguacuggcacccaaguucagcauggcagagcuggc

SEQ ID NO: 75520 - RNA, 64 nt, Human
aacagagacaagaaaggcagacacaccgcggccaggcacccaugugggcgcccacccugggcuc

SEQ ID NO: 75521 - RNA, 64 nt, Human
gacaucccuuugaccacaucgcucuaggauaacuggcacccagagaaaaggacuccucagaaaa

SEQ ID NO: 75522 - RNA, 64 nt, Human
ugagcuccagaagagacugugcuggguguggcuuggcacccaggggaugagagcccugagcuuu

SEQ ID NO: 75523 - RNA, 64 nt, Human
uaguggcagccccagauccagaccuaggccuccuggcacccaguccacuggcaguggaauugcu

SEQ ID NO: 75524 - RNA, 64 nt, Human
ucucacaucugaaauggaggcauugcaaugaaaaggcacccacagcaucaugcaaguggcaucu

SEQ ID NO: 75525 - RNA, 64 nt, Human
acuguuugaucugcgggcacuuguugcauugccuggcacccaauauucaggguccaugacuaag

SEQ ID NO: 75526 - RNA, 64 nt, Human
aaggcuguaggcacaccgcggccagcaggcaccuggcacccaccuucccugcugccaggaugcc

SEQ ID NO: 75527 - RNA, 64 nt, Human
ggggccuaagugccacccuccucccuccaagccuggcacccaccgucucggcccugaaccacga

SEQ ID NO: 75528 - RNA, 64 nt, Human
ugagacugcgacggcaaggcuguccugucccccaggcacccaaggauccugccagacagcacac

SEQ ID NO: 75529 - RNA, 64 nt, Human
ggcccugccggccacuguggacgcccuggggcuuggcacccaccucuggagaaacucggggcca

SEQ ID NO: 75530 - RNA, 64 nt, Human
caggugaccucggccauacucacugccccccuugggcacccacucacccuagaauaaacuuaac

SEQ ID NO: 75531 - RNA, 64 nt, Human
ggcugucugugaauccgccucugccgcccugccuggcacccacgcuggcucucuccugccgcgg

SEQ ID NO: 75532 - RNA, 64 nt, Human
cuguggguuucuguccccagggagcagacugugcggcacccaggcccaguggcaccauuuccca

SEQ ID NO: 75533 - RNA, 64 nt, Human
uccucaacagccccaugacuucagcuccaccuggggcacccagcaccccaccacagggcuagag

SEQ ID NO: 75534 - RNA, 64 nt, Human
uacugucuuuaagaugcagaguggaggggaggugggcacccacccugcgauucuccacccuuuc

SEQ ID NO: 75535 - RNA, 64 nt, Human
gcccuaggcuccgucaguaucaggccugccagacggcacccacccagcacccagcaacuccaac

SEQ ID NO: 75536 - RNA, 64 nt, Human
caccuccuccaccgcaguccagcucccucagucuggcacccacugcuacacucagccucaugag

SEQ ID NO: 75537 - RNA, 64 nt, Human
aggccagauacugauugcuaguagagagacacccggcacccaguccgaagcccucccucaaagg

SEQ ID NO: 75538 - RNA, 64 nt, Human
ggggcugccccuccaccuggccaggacccccuucggcacccaguugcccuuggccaccaccugu

SEQ ID NO: 75539 - RNA, 64 nt, Human
uccugccucagccuccugaguagcugggauuacaggcacccaccaccacaccuggcuaauuuuu

SEQ ID NO: 75540 - RNA, 64 nt, Human
cuuuuuccggcuagugcuucugugauauggaaagggcacccagagcagcaggaccuauagccac

SEQ ID NO: 75541 - RNA, 57 nt, Human
ccaacaccagccucaccuaggcccccaggcacccacccagcugggguguuuuugggg

SEQ ID NO: 75542 - RNA, 64 nt, Human
gauggcucaggaggacuuguggggagaggcugggggcacccauguggugggcucugugcagcau

SEQ ID NO: 75543 - RNA, 64 nt, Human
agcccccuaaggacagggaaccaggucccugcacggcacccacgcaggugucccggucugcaua

SEQ ID NO: 75544 - RNA, 64 nt, Human
acgccucccacugggguccagggagcaggcggugggcacccacccugggaccuaggggcgccgc

SEQ ID NO: 75545 - RNA, 64 nt, Human
uccugucucagccucccaaguagcugggauuacaggcacccaccaccacauccagcuaauuguu

SEQ ID NO: 75546 - RNA, 64 nt, Human
ccccuucccucucccugcugaccugggagucgcaggcacccaccagcugccaagagaaucccug

SEQ ID NO: 75547 - RNA, 64 nt, Human
acaggagaaggugcccuugcuggcugccccagcaggcacccaccucccugccaggccaagccag

SEQ ID NO: 75548 - RNA, 64 nt, Human
cuggggaguccguuuaaggcuuuccuugguauuuggcacccaagccccccaucuccuauuccug

SEQ ID NO: 75549 - RNA, 64 nt, Human
uuguacccccagcccuugccuucccuggauuuugggcacccaggacuuugcucugccuggugga

SEQ ID NO: 75550 - RNA, 57 nt, Human
aggacccugccccggccugaaggccagggcacccagaugugcugcucaagggagccc

SEQ ID NO: 75551 - RNA, 64 nt, Human
ccaacagguggggagagacagagaagugggcaggggcacccaaguugggauuucauuucaggug

SEQ ID NO: 75552 - RNA, 64 nt, Human
cccagcuuugagaaucucuucucauccacccucuggcacccagccucugagggaaggagggaug

SEQ ID NO: 75553 - RNA, 64 nt, Human
acaggccguccagcccgugcccgccugcggcgggggcacccagcaagcccgcccaccgcccgcu

SEQ ID NO: 75554 - RNA, 64 nt, Human
cuacaaaaaaauuuagaaauuagcugggcaugguggcacccaucuguaguccuaacugcucagg

SEQ ID NO: 75555 - RNA, 64 nt, Human
uccugccacagccuccugaguaccugagauuacaggcacccaccaccaugcccagcuaauuuuu

SEQ ID NO: 75556 - RNA, 64 nt, Human
ggccuuucccacccacccucagccagcgccacacggcacccacagacugggugccccggcggcg

SEQ ID NO: 75557 - RNA, 64 nt, Human
uaggaaggggcuccggguggcugcucugggacugggcacccacaagggcucagugggcccaaac

SEQ ID NO: 75558 - RNA, 64 nt, Human
ugccucgguuucccuucuguuuaguggcgacacaggcacccagcuuugggguggugcugacgcu

SEQ ID NO: 75559 - RNA, 64 nt, Human
ccaguuccacacgaacuagggcaguggucacuguggcacccaggugugggccuggcuagcuggg

SEQ ID NO: 75560 - RNA, 64 nt, Human
ucaggaaaacggcugcggccucggccucccuucgggcacccaggaaugcgggggucugcucagu

SEQ ID NO: 75561 - RNA, 64 nt, Human
uccugccucagccuccccagcagcugggacuacaggcacccaccgucacacccggcuaauuuuu

SEQ ID NO: 75562 - RNA, 64 nt, Human
guggccacagcccugccugggccugucucucaagggcacccagcuugcucggccuccuacaugu

SEQ ID NO: 75563 - RNA, 64 nt, Human
gcucccacaggccacagccgggcuccccacccccggcacccagcucucuacggcagguccggga

SEQ ID NO: 75564 - RNA, 64 nt, Human
ucuucccucccccucaucacaguggccuucucauggcacccaaaccuuucccgccguucuccug

SEQ ID NO: 75565 - RNA, 64 nt, Human
accucacccuggagggcacugggcccugggaacuggcacccauggggccccacccaugagugau

SEQ ID NO: 75566 - RNA, 64 nt, Human
agcaccagggaauuaauucccccagucaaccaauggcacccagagagggcauggaggcuccacg

SEQ ID NO: 75567 - RNA, 64 nt, Human
uccugccucagccuccuaaguagcugggauuacaggcacccaccaccaugcccagcuaauuuuu

SEQ ID NO: 75568 - RNA, 64 nt, Human
cagccugcuggucagcacuccaguagcgagagacggcacccagaaucagaucccagcuucggca

SEQ ID NO: 75569 - RNA, 64 nt, Human
auagucuguugaauuuugguguauuggccucacaggcacccacaaauguacacaaagagauaua

SEQ ID NO: 75570 - RNA, 64 nt, Human
caguucgaccucuuacucucucuugugguuuugaggcacccacaccccccgcuuuccuuuaucu

SEQ ID NO: 75571 - RNA, 64 nt, Human
ccucucaucuugagagcccuaauacuaaaagaugggcacccacccccaccaagggaagacugcc

SEQ ID NO: 75572 - RNA, 64 nt, Human
ucgugccucagccuccugaguagcugggcugacaggcacccaccaccacacccagcuaauuuuu

SEQ ID NO: 75573 - RNA, 64 nt, Human
agcugagggguggggucccucugucuggggcacuggcacccacagcaggacuccgccagucuga

SEQ ID NO: 75574 - RNA, 64 nt, Human
ggugaagggcaucgcugccccaggccucaagccgggcacccaacccuggaugccaccccccagc

SEQ ID NO: 75575 - RNA, 64 nt, Human
gaauuaugggggcugugccccagggugggugucuggcacccagcugccagccuucuguccuggg

SEQ ID NO: 75576 - RNA, 64 nt, Human
acagguuugccaaaggaaaagccuggcucuguuaggcacccaggagccccaggucggcgggugu

SEQ ID NO: 75577 - RNA, 55 nt, Human
cccucugcugcucaacaugaaacugggcacccaaaacucaugggggcacaauccu

SEQ ID NO: 75578 - RNA, 64 nt, Human
cuccuggacauggacuagcuugagccaaggcaguggcacccaaaaaccaggcugcaguggggac

SEQ ID NO: 75579 - RNA, 64 nt, Human
cauaaagacacugccugucuucuaggaaugaccaggcacccagcucccacuggacuccaauuuu

SEQ ID NO: 75580 - RNA, 64 nt, Human
aguucugcccaggggugcugcauaucggucaccaggcacccagggccaugccagggaaaggaag

SEQ ID NO: 75581 - RNA, 64 nt, Human
cacagaaauggugaacagacuuaguuguuacccaggcacccauggauuguguugagugugcaga

SEQ ID NO: 75582 - RNA, 64 nt, Human
agccagagaagaccuuccucuuacaucacauuaaggcacccacucacuaccuuggcgucguuuu

SEQ ID NO: 75583 - RNA, 64 nt, Human
cauccucagagcuuugaacuccccauuccaaaggggcacccacauuuuuuugaaagacuggacu

SEQ ID NO: 75584 - RNA, 64 nt, Human
gagcuggcaccuuguggggcucuugggaugggcgggcacccaagcccuggcuuguccuucccag

SEQ ID NO: 75585 - RNA, 64 nt, Human
agguggcagagagcucacugggacugaggggcugggcacccaacccuuuuccaccugugcuuau

SEQ ID NO: 75586 - RNA, 64 nt, Human
cucccaaagugcugggauuacaggugugagccacggcacccagccuagcucucagaucucuauu

SEQ ID NO: 75587 - RNA, 64 nt, Human
cucccaaagugcugggauuacaagcaugcaccacggcacccagcagaauuccagucuugagaaa

SEQ ID NO: 75588 - RNA, 64 nt, Human
uuauagaagcacauuucugccaccuccccugggaggcacccagaagccugccacucuuuaccua

SEQ ID NO: 75589 - RNA, 64 nt, Human
gcccccuggcaaucugggaaggguucagaaggugggcacccagccaacagcaugaacucagagc

SEQ ID NO: 75590 - RNA, 64 nt, Human
gguucccaagccagccccaacacccuucccacuuggcacccagagggggcuguggguggaggcc

SEQ ID NO: 75591 - RNA, 64 nt, Human
aagggugaggaggcaggaagcaccuccgguuggaggcacccaggcuugccagccacagagcgcc

SEQ ID NO: 75592 - RNA, 64 nt, Human
ugacugugaagugacuccaggacggaccugcgggggcacccagagguccuaagccccaggacug

SEQ ID NO: 75593 - RNA, 64 nt, Human
ugugaaacgcuaacugcacacgaagccgccugacggcacccagcgcuguggcugucauucuccc

SEQ ID NO: 75594 - RNA, 64 nt, Human
guccccuuacggacaggucccagagauggacagaggcacccagggcccccaccguccuucugac

SEQ ID NO: 75595 - RNA, 64 nt, Human
ucagcccucacggcauuccugcugagcaccguggggcacccagggagcaggggcgucagggauc

SEQ ID NO: 75596 - RNA, 52 nt, Human
gccgcuuccccagcagcugaaaggcacccagacuucaaggacccagacccac

SEQ ID NO: 75597 - RNA, 64 nt, Human
ucaaccacaggccuuugacuuugccacauggcaaggcacccagcagaagaugaggaugacgggu

SEQ ID NO: 75598 - RNA, 64 nt, Human
gcaaggaauaggcccaagaucacuuggcaagcugggcacccaggacccccaggugcuugacaga

SEQ ID NO: 75599 - RNA, 64 nt, Human
gucacuggaucaggauccaggggagggagauggaggcacccaaacuggaacuucauuugucuua

SEQ ID NO: 75600 - RNA, 64 nt, Human
augugacaauugacaaucuggacuaccccaagauggcacccaaguguuuggcuucuggcuaccu

SEQ ID NO: 75601 - RNA, 64 nt, Human
ggcucagaguccagcaaugaggcccccuggccugggcacccagcugcaggccccugcccuacgu

SEQ ID NO: 75602 - RNA, 64 nt, Human
cuguggaugccgcgagggacggacacacguccggggcacccacgaggagggcccccagccuggg

SEQ ID NO: 75603 - RNA, 64 nt, Human
ggcccucgggcccucucuccgccccggacaggguggcacccaccacucucaggaccacccugcc

SEQ ID NO: 75604 - RNA, 64 nt, Human
gaugaugacgaccuggguggaaaccuacccugugggcacccauguccgagcccccuggcauuuc

SEQ ID NO: 75605 - RNA, 64 nt, Human
uccccuucuagcccuccucccauccacacacacaggcacccacccacaccaggucggcuuguuu

SEQ ID NO: 75606 - RNA, 64 nt, Human
cuguccacaacugcagccgggcccucugccuaugggcacccaauccaagcagcugcuccaccuu

SEQ ID NO: 75607 - RNA, 64 nt, Human
uuuuucaaccuccacauggguugaauuccaguguggcacccauggcugccuucccauccccccc

SEQ ID NO: 75608 - RNA, 52 nt, Human
acgaauuugagucuauguaaugggcacccagccucuagggaccccuccuccc

SEQ ID NO: 75609 - RNA, 64 nt, Human
cagauaucacccacacacaccucgcuggggcaggggcacccagcaucagcccuggggagagagg

SEQ ID NO: 75610 - RNA, 64 nt, Human
ggccccaacacuauaccuugggccggccaggcagggcacccagacggggggcuggaggacaccc

SEQ ID NO: 75611 - RNA, 64 nt, Human
acuuuagaaguggugaaagaauacaaaauuaugaggcacccaaugauaggaaucugugauuaau

SEQ ID NO: 75612 - RNA, 64 nt, Human
caaccagagcacuguauaccccgugaagcauccaggcacccaaaccccggggcuccccuucgcg

SEQ ID NO: 75613 - RNA, 56 nt, Human
ugaacccccacaagcucugagcccugggcacccaccuccacccccgccacggccac

SEQ ID NO: 75614 - RNA, 64 nt, Human
gggggagggugaggcuuuguaccccagccccugcccaggccacugugagggugggugcuggcug

SEQ ID NO: 75615 - RNA, 64 nt, Human
gggggagggugaggcuuugcaccccagccccugcccaggccacugugagggugggugcuggcug

SEQ ID NO: 75616 - RNA, 64 nt, Human
ggcccaaagauuuccaagguucccaaagucaaggccaggccaaggccugguuggguccuugggg

SEQ ID NO: 75617 - RNA, 64 nt, Human
gcugggggcuuccccuucauguggcaccuuugugccaggccaccaggcagacucuucccaccuu

SEQ ID NO: 75618 - RNA, 64 nt, Human
ucaccccaaaaguaggcccucccauuggcuuuggccaggccagacacuucacaucguuuacaug

SEQ ID NO: 75619 - RNA, 64 nt, Human
ugucuaagguacagagggguuggcauuucaggaaccaggccaucacagaaacagguucaugggc

SEQ ID NO: 75620 - RNA, 64 nt, Human
ugucgcugcuucucugugcucacugaagggugagccaggccagugcuuccccagccccugggcc

SEQ ID NO: 75621 - RNA, 64 nt, Human
cuggugcccugcaccagacaggccguggucaggcccaggccaccggccggguucugccacagcu

SEQ ID NO: 75622 - RNA, 64 nt, Human
ugaggagggguaggccugcauccacagagaggauccaggccaaggcacuggcugucaguggcag

SEQ ID NO: 75623 - RNA, 64 nt, Human
ccuccuuguauauccuuaaaccuguacucuauuaccaggccacugugccuguggagcacuguaa

SEQ ID NO: 75624 - RNA, 64 nt, Human
gaaugguguucccuuugcuuggcuggggagccccccaggccagguuugcuggccauagauaccu

SEQ ID NO: 75625 - RNA, 64 nt, Human
aggacagccuugccgccacacaguuccagcagagccaggccagccuccuccacaugcagaaccc

SEQ ID NO: 75626 - RNA, 64 nt, Human
caaaggaaggaugggagcccuggagugggcaagaccaggccaccugcugaggucgcuguggagc

SEQ ID NO: 75627 - RNA, 64 nt, Human
guaaggggcaaaaaagaggcccacaccuugauauccaggccauaccaggguaucccuugucccu

SEQ ID NO: 75628 - RNA, 50 nt, Human
agaucccugccaugauguagccaggccaaaggacaagccagguugcauga

SEQ ID NO: 75629 - RNA, 50 nt, Human
gcgguggcgcugccgccugaccaggccauccggcccccagagcgccccuc

SEQ ID NO: 75630 - RNA, 64 nt, Human
uggcagggaugagugaggcccugcagagagcaucccaggccaagguucccacucagccugcccc

SEQ ID NO: 75631 - RNA, 64 nt, Human
gcaucgcuuccccugcccuuugguagugccaggaccaggccaaugaugcuucucaguagccuua

SEQ ID NO: 75632 - RNA, 64 nt, Human
cucaaaaaaaaaaaagaagaagguggaucuccaaccaggccagagaagauucucacagaagguu

SEQ ID NO: 75633 - RNA, 64 nt, Human
gggggcuuccggaaaagggaacccugcgguacccccaggccaaagcaaguaagcgguuagcacc

SEQ ID NO: 75634 - RNA, 64 nt, Human
cgcagaagcccugccugguccaguccgggggcggccaggccaacugcaagauucuggacuguuu

SEQ ID NO: 75635 - RNA, 64 nt, Human
cuguuaacaccccuuugcuuuuucuaugggaccuccaggccaccauauuuagaacuaguuaccu

SEQ ID NO: 75636 - RNA, 64 nt, Human
uucugcacccaacuuucuccuuguauuucaaaggccaggccauguacacuaacguccuugaaau

SEQ ID NO: 75637 - RNA, 64 nt, Human
augggaucccgaaggagcaagcagucggcagcacccaggccacaggagacuccgcuuuuacuuc

SEQ ID NO: 75638 - RNA, 64 nt, Human
agggccaagcgggggcguggcuggccuuucagguccaggccagugggccugguagcacaugucu

SEQ ID NO: 75639 - RNA, 64 nt, Human
gcccaaggagcuuacccaagcuguggcagccgucccaggccacccccauggaagcaauaaagcu

SEQ ID NO: 75640 - RNA, 64 nt, Human
uugcauccaacaugaauuuccagccgaugauaauccaggccaaagguuuaguuguuguuauuuc

SEQ ID NO: 75641 - RNA, 64 nt, Human
ccuggcuugggggcuugacgcccuuccccuugccccaggccaucaucuccccaccucuccuccc

SEQ ID NO: 75642 - RNA, 64 nt, Human
ugcacccuccucucacucccuuccaugccggaacccaggccagggacccaccggccugugguuu

SEQ ID NO: 75643 - RNA, 64 nt, Human
aggccuggccucuuucuugagguggccaccaggcccaggccaggcccuuugcccaagaagagag

SEQ ID NO: 75644 - RNA, 64 nt, Human
agaaauauuguguaaaaugggugcugccaaaauuccaggccauuuugcagggacucugaaguga

SEQ ID NO: 75645 - RNA, 64 nt, Human
aagccauucgaaaugcuaugggcucccuggccucccaggccaccaaggacggcaagaaggacaa

SEQ ID NO: 75646 - RNA, 64 nt, Human
augguggccacggccacagccacuaaucaggaggccaggccacccugccucuacccaaccaggg

SEQ ID NO: 75647 - RNA, 64 nt, Human
agguaauggaguaguuuguuauugguagucuacuccaggccaggcaguguguuaugggcugagg

SEQ ID NO: 75648 - RNA, 64 nt, Human
cggguaguagaggaggauaagggcaaaaccaggcccaggccagugccuggcuuggucuggaugg

SEQ ID NO: 75649 - RNA, 64 nt, Human
cuccgccagccuccucuggacggcaggcucacugccaggccagccuccgagagggagagagaga

SEQ ID NO: 75650 - RNA, 64 nt, Human
uuugaugagcaaaugagcuacuuuucccuagacaccaggccagcucucucuuaucugacuucug

SEQ ID NO: 75651 - RNA, 64 nt, Human
ggcuuaaaggacaauucucuucauuggugagagcccaggccauuaacaccuacacaguguuauu

SEQ ID NO: 75652 - RNA, 64 nt, Human
aacagaauccagccgcuuaggcuuugaugaacucccaggccaaaaugaggaguuauugaagcaa

SEQ ID NO: 75653 - RNA, 64 nt, Human
gagccuccguucccaccucugaggacucuggaccccaggccauaccaggugcuagggugccugc

SEQ ID NO: 75654 - RNA, 64 nt, Human
ucucccugggaagcagcacagcugagacugggcaccaggccaccucuguugggacccacaggaa

SEQ ID NO: 75655 - RNA, 64 nt, Human
acuuucugaagccucacuuaugagaugccugaagccaggccauggcuauaaacaauuacauggc

SEQ ID NO: 75656 - RNA, 61 nt, Human
agaccuacgccacggacuaaugcuguugggcccaggccaguccuuguugcuggccuccaag

SEQ ID NO: 75657 - RNA, 64 nt, Human
cugugacugagucccuucaggcgugcaagcuggcccaggccaaugguuggugugucauggugcc

SEQ ID NO: 75658 - RNA, 64 nt, Human
auuuuucaguagagaccgggucuugccaugcugcccaggccagucucaaacuccuggccucaug

SEQ ID NO: 75659 - RNA, 64 nt, Human
ugggggcccucagguggagagagcugcgauccauccaggccaagaccacagcucugugauccuu

SEQ ID NO: 75660 - RNA, 64 nt, Human
cgauuuggcugaguggcuuugugugaccguggccccaggccaaggggaucauggcccuggcugg

SEQ ID NO: 75661 - RNA, 64 nt, Human
ugcgcuuugccggacuggauggaguggaggaggcccaggccacaguaccaccccaccugcccag

SEQ ID NO: 75662 - RNA, 64 nt, Human
augaguuucacagugcuguaggggccuacacguuccaggccaguggccaggccuugugccgugg

SEQ ID NO: 75663 - RNA, 64 nt, Human
ccacaggggcaggccugggacccagcuacucuguccaggccacuguggccagagcuggaaggca

SEQ ID NO: 75664 - RNA, 64 nt, Human
ccagcuuaaccccugccaucccaugcugggcccuccaggccaagagucucagcuggccgagagu

SEQ ID NO: 75665 - RNA, 64 nt, Human
ggcuggguccucuggcuauuuggcugagaaggggccaggccaagggccggguggggaugggcac

SEQ ID NO: 75666 - RNA, 64 nt, Human
agugguucucccaaauaggagaccuggggccuggccaggccaggguuugggccuaauggcuuug

SEQ ID NO: 75667 - RNA, 64 nt, Human
ggagucauuuuagugaugagcugccaguccauucccaggccaggcugucgcuggccauccauuc

SEQ ID NO: 75668 - RNA, 64 nt, Human
ucggccuguuaccguuaguaccuguguucccucaccaggccauccugucaaacgagcccauuuu

SEQ ID NO: 75669 - RNA, 64 nt, Human
uaucccagaaacuugucuucuaaaagggaggacuccaggccaucaauaaagauguccaggcagu

SEQ ID NO: 75670 - RNA, 64 nt, Human
ccacuaggacccugcaagcaacucugcucugugaccaggccaggauuccuggagcuggccugag

SEQ ID NO: 75671 - RNA, 64 nt, Human
ccccgcagcugcagggccucgcgcucggcccucgccaggccagccccacuccuuguaccaagug

SEQ ID NO: 75672 - RNA, 64 nt, Human
cacacccugucugguacccgagaagaaagcagggccaggccagaagcugguguccaacagacac

SEQ ID NO: 75673 - RNA, 64 nt, Human
uucucagacagcccagcagugugaacacacaaugccaggccaggaacugggaccaccaucuugc

SEQ ID NO: 75674 - RNA, 64 nt, Human
ucuuuacuagagcugaaaggcccccuugacacauccaggccaaccucccauggaauagguaggc

SEQ ID NO: 75675 - RNA, 64 nt, Human
gggagcagcccagggccaagccccgcugccuuccccaggccacagugcguccagucuccugucc

SEQ ID NO: 75676 - RNA, 64 nt, Human
accuagcaggagugccaggccacagccggaacagccaggccaugacccaggggagccagcgcug

SEQ ID NO: 75677 - RNA, 64 nt, Human
gucgcucccacccuccgugcaccuagcaggagugccaggccacagccggaacagccaggccaug

SEQ ID NO: 75678 - RNA, 64 nt, Human
cguauaccuuguaaguggauaacuuuucuuuuucccaggccagagaauucaaauuguuaaaaca

SEQ ID NO: 75679 - RNA, 64 nt, Human
gucuguucauaaaacauggacugaugggucugcuccaggccacauuuguuuuuuaacaguaacg

SEQ ID NO: 75680 - RNA, 64 nt, Human
cccaacccggacugcugcccguccucucccugcuccaggccacuaggccucccuugcagccaac

SEQ ID NO: 75681 - RNA, 64 nt, Human
cggggcuggccuggcauuagucauuauuuaguuuccaggccaaccauccagauagagauucccu

SEQ ID NO: 75682 - RNA, 64 nt, Human
ucuggcgagcccgggggcucgcaggggggauuuuccaggccaggagaaccucguggagacaccc

SEQ ID NO: 75683 - RNA, 64 nt, Human
aacgagcagacugcaggggaggccaugggauuccccaggccagugucugugcugauccuucaag

SEQ ID NO: 75684 - RNA, 64 nt, Human
caaccacuuuuugaauggugugccauuuaaaaauccaggccagauccuauuauaaccaacucuc

SEQ ID NO: 75685 - RNA, 64 nt, Human
uaucagaaggucuccuuuuuagcccagcacaggcccaggccacuuugucguguuuguuuuaacu

SEQ ID NO: 75686 - RNA, 64 nt, Human
uccauucuugggguauaugacuguccuguuucccccaggccacuuuuuuuuuuuuuuucuuuug

SEQ ID NO: 75687 - RNA, 64 nt, Human
ugcccugcccugagcugaguccuuucccugggagccaggccaccuuagaaugggguuuggaagu

SEQ ID NO: 75688 - RNA, 64 nt, Human
ucuccugaccccauugggaacacggaagucuauuccaggccaaccagcccaaaauuauuucauc

SEQ ID NO: 75689 - RNA, 64 nt, Human
uguggguuuuggagucugagccucaggcucaaauccaggccaagugaucuugggcaaguuaauc

SEQ ID NO: 75690 - RNA, 64 nt, Human
agccccuggccuuucaguucuuaacuauuucccuccaggccagaaaguuuucuuugaggaagga

SEQ ID NO: 75691 - RNA, 64 nt, Human
gggcgagagucggccuggacuucccuggggugcuccaggccagagcucuuucauuggggcgagu

SEQ ID NO: 75692 - RNA, 64 nt, Human
gaauucuuucuucauccccgcauucccaauauacccaggccacaagaguggacgugaaccacag

SEQ ID NO: 75693 - RNA, 64 nt, Human
auggucugaguucuuguguccugguaauuccucuccaggccagaauaauuggcaugucuccuca

SEQ ID NO: 75694 - RNA, 64 nt, Human
agcugucacaucagcaaauauguagucaaggcagccaggccaacuagaccacacuuauuggucu

SEQ ID NO: 75695 - RNA, 64 nt, Human
aaugcacgaaguuggagaaccugacagggcugguccaggccacagaggaugggguuaggcuuca

SEQ ID NO: 75696 - RNA, 64 nt, Human
uaacccuggcuccugaggcugcggccagcagagcccaggccagggcucuguucuugccacaccu

SEQ ID NO: 75697 - RNA, 64 nt, Human
gguguccagaacucaggaaugggccugguaggccccaggccagacuaacugggcucaaggggug

SEQ ID NO: 75698 - RNA, 64 nt, Human
aaaaaguaccagcucuggcugggguccgugaagcccaggccaggcagccaaaucuugccugugc

SEQ ID NO: 75699 - RNA, 64 nt, Human
gugugaaccgaggggcucaggaaaacgggaccggccaggccaccuccagaaacggccauucagc

SEQ ID NO: 75700 - RNA, 64 nt, Human
ccccccacccaucugguauggaaaccugccggcuccaggccagacccaggagccaagagaaggc

SEQ ID NO: 75701 - RNA, 64 nt, Human
cuccuggaggaguccuguugccucuccugccccuccaggccacugaguguuuuggccacuugga

SEQ ID NO: 75702 - RNA, 64 nt, Human
acaucgugaugggccccucagccagggcugccagccaggccacucggguaaggggcugggcagg

SEQ ID NO: 75703 - RNA, 64 nt, Human
cgacgaggaggacagaggcugcugcugcugcaaaccaggccacuugccucaccugcuguccugc

SEQ ID NO: 75704 - RNA, 64 nt, Human
ggggcacagguuggguuugccaaacgccuaauuaccaggccaggaagcaugccaacaaagccac

SEQ ID NO: 75705 - RNA, 64 nt, Human
ucuggguauugauuuccuuuuccagugacuggcuccaggccaugucuaaugaccagcucgauuc

SEQ ID NO: 75706 - RNA, 64 nt, Human
cauguccacugucuauuuauugcauucccuugccccaggccaccuccucccccucccaccuggu

SEQ ID NO: 75707 - RNA, 64 nt, Human
uaacuacugugucuucugugucacaaacagcacuccaggccagcucaagaagcaaagcaggcca

SEQ ID NO: 75708 - RNA, 64 nt, Human
gaucccugcccacucucuccccuucauuggcugcccaggccacuggccccaguucucagugucc

SEQ ID NO: 75709 - RNA, 64 nt, Human
cuggcccaggaaauagccuauuaaaaaaugcuguccaggccaggcacaguggcucacaccugua

SEQ ID NO: 75710 - RNA, 64 nt, Human
aggggccgaguccaggagccccagccagcccuucccaggccagcgaggcgaggcugccucuggg

SEQ ID NO: 75711 - RNA, 64 nt, Human
cccugcuacuccacugaccuggaagagcuggguaccaggccacccacuguggggcaagccugag

SEQ ID NO: 75712 - RNA, 64 nt, Human
gcagaaguuuugugcccgccugcccccauccccuccaggccacguuuuagauggcccuuguagu

SEQ ID NO: 75713 - RNA, 64 nt, Human
uggccuaaacccuaaugggaugaggcuuuucaccccaggccaugcugguggugauuuuuuagcc

SEQ ID NO: 75714 - RNA, 64 nt, Human
accccccucuucaggcugcugcaggaggccaggcccaggccagagaccccaggcagccugagcu

SEQ ID NO: 75715 - RNA, 64 nt, Human
ggcaggacucucuggccuucuguggccugcaaugccaggccaugugccccucugcccucuaguu

SEQ ID NO: 75716 - RNA, 64 nt, Human
aaaaauaugugcaguaucucauccucccccuguaccaggccauagcuuugaaguguauuuugua

SEQ ID NO: 75717 - RNA, 64 nt, Human
uaaaauaucuguuuuuaauguuuuguuucucccuccaggccaguauaaagggacuugaaguauu

SEQ ID NO: 75718 - RNA, 64 nt, Human
aaacuguugugaaugagccugaucauaaaacggaccaggccauucauuauuccucaaguguuaa

SEQ ID NO: 75719 - RNA, 64 nt, Human
uauccccaggcuggugccccgggagggcuggagaccaggccaugggcccucacggagaggaagg

SEQ ID NO: 75720 - RNA, 64 nt, Human
caaaacccagugccuuccaaaugagcugcaguccccaggccaugagccucccgggaauguuuaa

SEQ ID NO: 75721 - RNA, 64 nt, Human
guccuugugcgguggggaccggggccggcgggcuccaggccagcacaccuaacccauggaugug

SEQ ID NO: 75722 - RNA, 64 nt, Human
cuugaagaacugcaggcccuggccuccccugccaccaggccaccuccccagcauuccagccccu

SEQ ID NO: 75723 - RNA, 64 nt, Human
cuguggauccauccagaacagcgguaucugaagcccaggccauacucccugccuccuuucuucu

SEQ ID NO: 75724 - RNA, 64 nt, Human
guugacucaggaccccgccucuguccucacugugccaggccauagccagaggccacccuguagu

SEQ ID NO: 75725 - RNA, 64 nt, Human
caccaaacuacugaaugaagcaguauuuugguaaccaggccauuuuuggugggaauccaagauu

SEQ ID NO: 75726 - RNA, 64 nt, Human
accaacuggacaagggauggcggcagaccaggggccaggccaaagcacuggcaggacucaggug

SEQ ID NO: 75727 - RNA, 60 nt, Human
ucagcaucuauuaccacugaugcacaggcgccaggccaagggggaaaugcucuuugaaag

SEQ ID NO: 75728 - RNA, 64 nt, Human
cagucucagaaauuaacaugguaugaagguguuuccaggccaggcgcgguggcucacgccugua

SEQ ID NO: 75729 - RNA, 64 nt, Human
ugaaguaaaaguacaacagcuugaaguguugauaccaggccacagcccucuaacucaugugauc

SEQ ID NO: 75730 - RNA, 64 nt, Human
ugcagugcggcauccccuuggcagcugccgucagccaggccagccccagggagcuuaaaacaga

SEQ ID NO: 75731 - RNA, 64 nt, Human
ggagugagaccagcuucuggcaacugccccagcuccaggccaucccauagccccuccucuucug

SEQ ID NO: 75732 - RNA, 64 nt, Human
cuugcuccuaugguucccauaggcacaccuauucccaggccaaggagaguccuuccucuccccu

SEQ ID NO: 75733 - RNA, 64 nt, Human
uuuuagcagcugugauguugguaccuggugcagaccaggccaaaguucuggaaagcuccuuuug

SEQ ID NO: 75734 - RNA, 64 nt, Human
augaccaggcccauagggcucccacagcugguucccaggccagugagugcugugagaauacagu

SEQ ID NO: 75735 - RNA, 64 nt, Human
cccuggucuaaguuacucaaaggccauaucuucaccaggccagagauucaguuuuaaaccucag

SEQ ID NO: 75736 - RNA, 64 nt, Human
ucccugggagcugaaagugaggauacuccgugcuccaggccacagggugaauguggccaugccu

SEQ ID NO: 75737 - RNA, 64 nt, Human
agccacagcugggcccaccgaggugcuauccugcccaggccagcacuuggcugaguuggguugg

SEQ ID NO: 75738 - RNA, 64 nt, Human
uaaggagagcucugauugcagcacagagcaguggccaggccacccaaaggagcuccgccuggac

SEQ ID NO: 75739 - RNA, 64 nt, Human
agcuggacuacggcggcaguauggaauuccagugccaggccagugaccucauucccgagcagcc

SEQ ID NO: 75740 - RNA, 64 nt, Human
uggaauugaguggccaaguauggggucauggauuccaggccacaaauuccaggccuaguucagu

SEQ ID NO: 75741 - RNA, 64 nt, Human
cuaguucagucugggggcagggucaguccuucucccaggccagcccuugacauuaaaaaaaaug

SEQ ID NO: 75742 - RNA, 64 nt, Human
uaaauguggcucaguggagggagacccagcauagccaggccaguauggagcaccucacgcacag

SEQ ID NO: 75743 - RNA, 64 nt, Human
cugagucacuggcccaucucuuugcucuugugccccaggccagaauaaagaauagaguguagag

SEQ ID NO: 75744 - RNA, 64 nt, Human
agccugccuaaccaggcccagccaguugguggggccaggccaggaccacacaguccccagacuc

SEQ ID NO: 75745 - RNA, 64 nt, Human
agaugggugggggcuccugguggccuucugcugcccaggccacagccgccuuuggguuccaucu

SEQ ID NO: 75746 - RNA, 64 nt, Human
gccucuccucacuauggccccagugccuugaggcccaggccagggcagccaguggcucuagcuc

SEQ ID NO: 75747 - RNA, 64 nt, Human
ucaucucccaaguggccacauacagcaacccacuccaggccauggggaccaccacucaggguuc

SEQ ID NO: 75748 - RNA, 64 nt, Human
agcauaggugguuugugaaacucacaggugguccccaggccaagaugggcaggugucacaaaga

SEQ ID NO: 75749 - RNA, 64 nt, Human
ggccugagcaugaccucaauuauuucacuuaaccccaggccauuaucauauccagauggucuuc

SEQ ID NO: 75750 - RNA, 51 nt, Human
cugucgagcucaccggcuagcccaggccacagccagccugucguguccagc

SEQ ID NO: 75751 - RNA, 64 nt, Human
agagcaagaagucacuuaucaccaaggggauggcccaggccauucaugagggauccaccuuugu

SEQ ID NO: 75752 - RNA, 64 nt, Human
ccuggauugagccaggcccccagaaccccuggcuccaggccagggggccagucccugaggcagg

SEQ ID NO: 75753 - RNA, 64 nt, Human
aauuucuuguagagaugagaucucgcuauguugcccaggccagucucaaacuccuggacucaag

SEQ ID NO: 75754 - RNA, 64 nt, Human
acaccaacugaucaccacuaacucagagccuccuccaggccaaacagccccaaagucaauuaaa

SEQ ID NO: 75755 - RNA, 64 nt, Human
ggaauuagacuuuggagucuuuucucugaagucaccaggccaggggucaggagagagauggauu

SEQ ID NO: 75756 - RNA, 64 nt, Human
cuggaacaagccccuccagaugagugccccggccccaggccagcuucacugccgucucuucaca

SEQ ID NO: 75757 - RNA, 64 nt, Human
ugaaagaaccagagcugggaagauggcugggaagccaggccaaagugggggcaacagcuugcuu

SEQ ID NO: 75758 - RNA, 64 nt, Human
uuuagcugugcaagauaaaagcagccugggucacccaggccacaaggccaugguuaauucuuaa

SEQ ID NO: 75759 - RNA, 64 nt, Human
cucccauggagccccuccaccgggcgcaugccucccaggccaccucagucucaccugccggcuc

SEQ ID NO: 75760 - RNA, 64 nt, Human
ucuuccauaugaccucaugcaucuccaccugcucccaggccaguaagggaaauagaaaaacccu

SEQ ID NO: 75761 - RNA, 64 nt, Human
cugguuuugagggcuugagaaugggucagggacuccaggccaaguccaacagagaccccaaacc

SEQ ID NO: 75762 - RNA, 64 nt, Human
aggcagcugcugugagcuggccuaccugccugccccaggccaugccugccuuuguuguggggaa

SEQ ID NO: 75763 - RNA, 64 nt, Human
ucaagggcugugguccgcucagggucucauuuccccaggccaaguucaaggcagcagcccuuug

SEQ ID NO: 75764 - RNA, 64 nt, Human
ccuugagcuaaccccaagcugccucugggccaugccaggccagagggcaguggcccuccaccuu

SEQ ID NO: 75765 - RNA, 64 nt, Human
agcuggagaguccaggcccugggaaugggaggaaccaggccacauuccuuccaucgugcccuga

SEQ ID NO: 75766 - RNA, 64 nt, Human
aggugggggcaucucacagccugacuucccuuccccaggccaggguugcugggaugccugcccc

SEQ ID NO: 75767 - RNA, 64 nt, Human
uuagcacauuuugacacaauguugcacugaaaacccaggccacaaaugugucccagugaacagu

SEQ ID NO: 75768 - RNA, 64 nt, Human
auccucuaaaccagggaucagcaaacuauaacccccaggccaaaucuagcccacucccuguuuu

SEQ ID NO: 75769 - RNA, 64 nt, Human
cagagcagggacuggaggcacccccagcccugccccaggccacagcaggacaggccgggacagg

SEQ ID NO: 75770 - RNA, 64 nt, Human
gcagagacaaucacgggcgguccugcacagauucccaggccagggcugggucacaggaaggaaa

SEQ ID NO: 75771 - RNA, 64 nt, Human
ucacuggccaaagguuggcagauagaggcaacucccaggccagugagcuuuacuugccguguaa

SEQ ID NO: 75772 - RNA, 64 nt, Human
ugcuucagggccgcaccgcccagacuggcucagcccaggccaccaacuucaucgccuuugcggc

SEQ ID NO: 75773 - RNA, 64 nt, Human
uggucuuucagccaugcugaugaccacaccccguccaggccagacaccaccccccaccccacug

SEQ ID NO: 75774 - RNA, 64 nt, Human
aguuugaugcuauggcgcuggacccagggcccucccaggccaucucuguuccucuggggugguc

SEQ ID NO: 75775 - RNA, 64 nt, Human
cacugggccuaggugauggcaguccauguggcugccaggccaaggcagucacaggggcccugac

SEQ ID NO: 75776 - RNA, 64 nt, Human
cugccaggccaaggcagucacaggggcccugaccccaggccacacagacggacaugggcccaca

SEQ ID NO: 75777 - RNA, 64 nt, Human
ccccacggcccugucagagccgccacuccuauccccaggccaggucccuggaccagccuccugu

SEQ ID NO: 75778 - RNA, 64 nt, Human
uuggcccucuuggaaaggaggggcucguguggccccaggccagugucugucaggaugguccccc

SEQ ID NO: 75779 - RNA, 64 nt, Human
cgcucccgcgggaagccagcccgugcaacggaagccaggccaacugccccgcgucuucagcugu

SEQ ID NO: 75780 - RNA, 64 nt, Human
uucacuaacuacacucuacaagugaacuccuugcccaggccaguuagaaaaucccuuggggaac

SEQ ID NO: 75781 - RNA, 64 nt, Human
uucagcguuagaagggaucuuagagguagauuauccaggccauccccuacugcuuacauucccc

SEQ ID NO: 75782 - RNA, 64 nt, Human
gauuugcagcugaagugggccagccuugcaccagccaggccagaccaccauggugaaggcuucu

SEQ ID NO: 75783 - RNA, 64 nt, Human
ugggaucucagugugccccuaccuguucuccccuccaggccaccugucucuguaaaggaugucu

SEQ ID NO: 75784 - RNA, 64 nt, Human
cuugaccugaauuuggaaauccgaaauuacuaauccaggccaggugugguggcucaugccugua

SEQ ID NO: 75785 - RNA, 64 nt, Human
aaggggugcgaaacccuggcagucccaggcagcaccaggccagggguugauuugaaacgugaag

SEQ ID NO: 75786 - RNA, 64 nt, Human
cgcccaacacgaucuuguaagauggauuucacccccaggccaaugcagcuaauuuugauagcug

SEQ ID NO: 75787 - RNA, 64 nt, Human
uugcagcccacuggagagaaguuugcuggcuugcccaggccagagcaggaccacagauacugga

SEQ ID NO: 75788 - RNA, 64 nt, Human
gucaauguuuccugacucccaggccccuacuauuccaggccaucacacuggccuguuccggaga

SEQ ID NO: 75789 - RNA, 64 nt, Human
cuaacuccagagaucuauaaagcauauccuuuacccaggccauuccuaucauauaguaagcaga

SEQ ID NO: 75790 - RNA, 64 nt, Human
ggcagaucacuugaggucagaaguuugagaccagccaggccaacauggugaaacuucaucucua

SEQ ID NO: 75791 - RNA, 64 nt, Human
gggguggccuuucauuuggggugcccuuucacucccaggccaagcccuggagcaaucuucuuca

SEQ ID NO: 75792 - RNA, 64 nt, Human
agacauagauguugaauuguuuguggggggugugccaggccacgucucguguguccguaugcag

SEQ ID NO: 75793 - RNA, 64 nt, Human
cucuuuuuuuuaagacagaguguugcucugucgcccaggccagagugcagugguaugaucucgg

SEQ ID NO: 75794 - RNA, 64 nt, Human
cagggauuggccugugcuucagcgaccaggauggccaggccagagcugcagcugggggcucuuu

SEQ ID NO: 75795 - RNA, 64 nt, Human
ugccagcagggagcucacagaaggggagggagcaccaggccagcugagcugcacccacaguccc

SEQ ID NO: 75796 - RNA, 64 nt, Human
ggagcagcugggacuacaggugugcacuaccacaccaggccaauuuuuguuuuuuuuuuuuggu

SEQ ID NO: 75797 - RNA, 58 nt, Human
gcaagaaggagaagaaguaacauggaggccaggccaagagccacagggcggccucucc

SEQ ID NO: 75798 - RNA, 64 nt, Human
ggucagcggagccccagcaggaagggugggccagccaggccauucuuagucccuggguugggga

SEQ ID NO: 75799 - RNA, 64 nt, Human
uuuuuuccuuuuuucuuuuuuaagagacagucauccaggccagagugcaguuugaugauagcuu

SEQ ID NO: 75800 - RNA, 64 nt, Human
auggggaaaggcuguuauuaccuagaguuuacucccaggccagggggcugccaucuucuucaca

SEQ ID NO: 75801 - RNA, 63 nt, Human
uugcagaaucaggacuuuaguagagacugaguaccaggccacgggcugcagauccugaaugga

SEQ ID NO: 75802 - RNA, 64 nt, Human
ucauggguccucagagugggggcuccuuaagccuccaggccagcagcaucagcaucaccuggga

SEQ ID NO: 75803 - RNA, 64 nt, Human
gucccucaacaagcucacccccaaucccuugcagccaggccacaaugggggaggugaguccagc

SEQ ID NO: 75804 - RNA, 64 nt, Human
gccgcgggacuggccccggggggcccccuggaucccaggccagcgcuuugcucuccugcuccgu

SEQ ID NO: 75805 - RNA, 64 nt, Human
gguaaauaaacuaagauauuccgagggaagggacccaggccaccucccuuccgcaggucugcag

SEQ ID NO: 75806 - RNA, 64 nt, Human
ugcuacccccaguuucugcuguuacuugcugccuccaggccaggggagcaggagaugcucagcu

SEQ ID NO: 75807 - RNA, 64 nt, Human
uaaaacacuggcucuggaaucuggaauguuaaguccaggccagcagugacaaaaguuauuguaa

SEQ ID NO: 75808 - RNA, 64 nt, Human
aaaaaguaaggaagcuaaacuaagacuauacucaccaggccauuuagaaguuuuaaauaaugcc

SEQ ID NO: 75809 - RNA, 64 nt, Human
aaagugcugggacuacaggcaugagccacuacguccaggccaccucuaccuucuaaccauucuc

SEQ ID NO: 75810 - RNA, 64 nt, Human
acucuagaucguuuccugacagagaagccuucuuccaggccacuaagguagcauguuauccacu

SEQ ID NO: 75811 - RNA, 64 nt, Human
ucgacuauugccacccugcuucuccaagagcagaccaggccaccucauccguaaggacucgguu

SEQ ID NO: 75812 - RNA, 64 nt, Human
aggaucuggaccaguuucccugcugugcuguggcccaggccagagccugugggcaggcaggcag

SEQ ID NO: 75813 - RNA, 64 nt, Human
cggauuuauugacaaugaauaaagggcacgaaggccaggccagggccugggccucuugugcuaa

SEQ ID NO: 75814 - RNA, 64 nt, Human
gcaccugcaucuucugaaucaccuggcccagaagccaggccagcagcccgagaccauccuccuu

SEQ ID NO: 75815 - RNA, 64 nt, Human
aaccagugagccgaggcccgcgccgaggaccuggccaggccagccacuccugaagccccgggag

SEQ ID NO: 75816 - RNA, 64 nt, Human
ugaggcgugaggcuggaagauaauacagaaugucccaggccauggcagagcucguuccauucac

SEQ ID NO: 75817 - RNA, 64 nt, Human
augcugacaucuaaaacuaaauaaauagaaaacaccaggccagaacuauagucauacucacaca

SEQ ID NO: 75818 - RNA, 64 nt, Human
cccccaaccacugcuuaggccucccaacuucuccccaggccaaguauggggcccuggcuguguu

SEQ ID NO: 75819 - RNA, 64 nt, Human
ugcuugccucauaccucugugcuccacacugcggccaggccagcugagucccuccauccgugga

SEQ ID NO: 75820 - RNA, 64 nt, Human
caguucauucccagaaguccacaggacgcacagcccaggccacagccagggcuccacggggcgc

SEQ ID NO: 75821 - RNA, 64 nt, Human
ggagccuugggaucauaaacaccccagcgucuucccaggccagagaaaguggaagagaccacaa

SEQ ID NO: 75822 - RNA, 64 nt, Human
cgcacaugcuggugcccgucuuccuccuaaggggccaggccacauccaagugggccucugucgg

SEQ ID NO: 75823 - RNA, 64 nt, Human
aaaccagucugaauugggucugucuuugagaugcccaggccagcagaaagcagcucagaaguau

SEQ ID NO: 75824 - RNA, 64 nt, Human
acacccaguguccuuccaucuucacacugguuugccaggccaauguugcugauggcccccugca

SEQ ID NO: 75825 - RNA, 64 nt, Human
aaaguguugagauuuacaggugugagccaccacaccaggccagagcuauauuuccaaaggcugc

SEQ ID NO: 75826 - RNA, 64 nt, Human
ggugcuuucagagaauugauucagccaucugcgcccaggccacgugucccgaucugggauuaga

SEQ ID NO: 75827 - RNA, 64 nt, Human
ccucauggagagucagcagcuugggcagccacuuccaggccagggugguggcuucucugcagac

SEQ ID NO: 75828 - RNA, 64 nt, Human
uuuacaacagcaucugagcaccucucaaguuuuuccaggccagcuccaguuucagugaggagag

SEQ ID NO: 75829 - RNA, 64 nt, Human
uugcuuggacugucuuugaacucugcaccuccuuccaggccaucuugugagacuugguguuaau

SEQ ID NO: 75830 - RNA, 64 nt, Human
ggaagagagggaaggacaccaagcaaaaaauguuccaggccaggauucggauucuugaauuacu

SEQ ID NO: 75831 - RNA, 64 nt, Human
agccagacagagcaggugcggggaagggaagggcccaggccagacccaucccaaacggaugaug

SEQ ID NO: 75832 - RNA, 64 nt, Human
ggaaagugcuaugugucccugcauauaagaaucaccaggccaguguuucuggguuugcuugucu

SEQ ID NO: 75833 - RNA, 64 nt, Human
gacagguguacgucugcacccaucacccucagcaccaggccacccugcaguccacuuacuguac

SEQ ID NO: 75834 - RNA, 64 nt, Human
ccccauuauguacagaauaggaccuauccaguagccaggccaguaggcaguuggggaagguggg

SEQ ID NO: 75835 - RNA, 64 nt, Human
aaugcugaaaauaaacaaaauccacugaggcuucccaggccauuuaaagccuggaguaccagcg

SEQ ID NO: 75836 - RNA, 64 nt, Human
aauaguccguauccccaacuauuaaggauuugucccaggccaauggugaacaugcugcauuuua

SEQ ID NO: 75837 - RNA, 64 nt, Human
gaccacagugagagcugccuuauauuccuacauuccaggccagaaccagcacaggacugaacac

SEQ ID NO: 75838 - RNA, 64 nt, Human
ugaacacaguggaaggcagaggguuuacuacaggccaggccauggacaccccacccagguacug

SEQ ID NO: 75839 - RNA, 64 nt, Human
agaaaggugugauuugacugguuuuauuuuucucccaggccagaaguauuacuccacuagauca

SEQ ID NO: 75840 - RNA, 64 nt, Human
uuccuuuuuuagagacagggucucacuguaucacccaggccagaguguaguggcacaaucauug

SEQ ID NO: 75841 - RNA, 64 nt, Human
ccaggcccaccgguacugaccagcucccguugggccaggccagcccagcccagagcacaggcuc

SEQ ID NO: 75842 - RNA, 64 nt, Human
ccuugugacaccguucauccccagaucacugaggccaggccauguuuggggccuuguucugaca

SEQ ID NO: 75843 - RNA, 64 nt, Human
guuguacugcuagaaacuucucuaagauaagaggccaggccagucaguuuggcccagcaaacau

SEQ ID NO: 75844 - RNA, 53 nt, Human
acgaguucgaggcccuguaacagccaggccaggaccaagggcagaggggugcu

SEQ ID NO: 75845 - RNA, 55 nt, Human
gccccaucgagcuggacugaacuggccaggccacguggagacaccacggucgacg

SEQ ID NO: 75846 - RNA, 64 nt, Human
cagaagagggagaggaggggcugggggugaggggccaggccauggccaaggggccagcugcccc

SEQ ID NO: 75847 - RNA, 64 nt, Human
uccagcaccuuccccugguuaugacagggagcucccaggccaggccacaugaccccacagguag

SEQ ID NO: 75848 - RNA, 64 nt, Human
caccuuccccugguuaugacagggagcucccaggccaggccacaugaccccacagguaggcuga

SEQ ID NO: 75849 - RNA, 64 nt, Human
agugccaagacacagcagggccaacaaccugugcccaggccagcuucgagcuacaugcaucuag

SEQ ID NO: 75850 - RNA, 64 nt, Human
uguagucccagcuacuugggcacacgccuguaguccaggccacucgagcacacaccuguaguac

SEQ ID NO: 75851 - RNA, 64 nt, Human
gagccaagugggggccccuuuuccgaagccacuuccaggccaaggcagucgccagggcuucuug

SEQ ID NO: 75852 - RNA, 64 nt, Human
cuccucugggccuggggugcauccuccucagcccccaggccaggugagguccaccggccccugg

SEQ ID NO: 75853 - RNA, 64 nt, Human
aaucucguugagcguucggcguggauccacggggccaggccacccugcgggagcgccacacgca

SEQ ID NO: 75854 - RNA, 64 nt, Human
ugcuagccuagucccuggaggagggaguccggccccaggccagggacuaaggagcaaugaccau

SEQ ID NO: 75855 - RNA, 64 nt, Human
agaucuggaacuaauggccccacccccacugggcccaggccaggaggggcccugcccaugccca

SEQ ID NO: 75856 - RNA, 64 nt, Human
agccauccguuauuauuuccaauggagaccuagcccaggccaagguaaaguuaguuaauagcau

SEQ ID NO: 75857 - RNA, 64 nt, Human
gauccuggaaaugguuuaccuaaaagcuacagaaccaggccaauauauuuugaaauauugaugc

SEQ ID NO: 75858 - RNA, 64 nt, Human
cugacaagcacugcuaggcgagugccaggacuccccaggccaggccaccaggauggcccuuccc

SEQ ID NO: 75859 - RNA, 64 nt, Human
aagcacugcuaggcgagugccaggacuccccaggccaggccaccaggauggcccuucccacugg

SEQ ID NO: 75860 - RNA, 64 nt, Human
ugugcccaucaucucugccuuugagugugggacuccaggccagcuccuuuucugugaagcccuu

SEQ ID NO: 75861 - RNA, 64 nt, Human
aaaggcuguccugaaaacccuguggaagaagaguccaggccaggucuucauccugcugccaagu

SEQ ID NO: 75862 - RNA, 64 nt, Human
ugcagugguggcguggaagcccugucaccccaccccaggccacccucucccagaggacgccauc

SEQ ID NO: 75863 - RNA, 64 nt, Human
acuuuuuaagagagagacaggcucacucugucacccaggccagagugcaguggcacgaucauag

SEQ ID NO: 75864 - RNA, 64 nt, Human
cggucucuggaaagucaggcugagaaauccuuucccaggccaggccgcugcgguacacuggaug

SEQ ID NO: 75865 - RNA, 64 nt, Human
gcugcgaugugaacugccccuccccucgcaucccccaggccaccaacggcaguccuucugccuu

SEQ ID NO: 75866 - RNA, 64 nt, Human
aagaaguuucugaagucuucacagcucuuaaaagccaggccaguacugacuguguggugguaaa

SEQ ID NO: 75867 - RNA, 64 nt, Human
uaucuaucuuuggcuucccaaacaguaacucacuccaggccaagugugccuuagcacgagugac

SEQ ID NO: 75868 - RNA, 64 nt, Human
uaccacuaacaaaaugguauaaagaaucucccagccaggccaacauggugaaacccugucucua

SEQ ID NO: 75869 - RNA, 64 nt, Human
ggcaaaggcgggcgaguagaugccugggcagggaccaggccagcgcugcaaccuccuucggcuu

SEQ ID NO: 75870 - RNA, 64 nt, Human
aggugggagauguggaaaagccaagaggcugcagccaggccacuggccccugagaucucugcag

SEQ ID NO: 75871 - RNA, 64 nt, Human
cucaccagcuagucugggguuuccucucccugccccaggccagaacugccuucuucauuuccac

SEQ ID NO: 75872 - RNA, 64 nt, Human
acaccaccaccaccaccgcgagcuggagcgcgcaccaggccauccagcgugcagccuugccucg

SEQ ID NO: 75873 - RNA, 64 nt, Human
gcaggaggaaaguuuaaucccccauuccaaaaguccaggccaaauggugggcuuagccucuuug

SEQ ID NO: 75874 - RNA, 64 nt, Human
ucaggaucuuaggccucagcaggcagggacccuuccaggccacaguaggcugaagcagcaccag

SEQ ID NO: 75875 - RNA, 64 nt, Human
augaugagaaaagcucaccgcaucagcugguugcccaggccaggaccugaaggguuguguggag

SEQ ID NO: 75876 - RNA, 64 nt, Human
gggccccugucccucucuucuggcccugugguacccaggccacacguugugcccgcucuugggg

SEQ ID NO: 75877 - RNA, 64 nt, Human
aggcuggagguggcagcuucacagaacuggagaaccaggccaaguccccuccccaaccuaauua

SEQ ID NO: 75878 - RNA, 64 nt, Human
cagcaaaagcguagaggcagaauuagaggccucuccaggccagcuccucugcccacaugucaua

SEQ ID NO: 75879 - RNA, 64 nt, Human
ccaggaacauauuccucagucagcuuuuccauuaccaggccauuuuacuuaaaucuguauuaaa

SEQ ID NO: 75880 - RNA, 64 nt, Human
auccaucacagacggauacuggggaguaaacggcccaggccaggugcccaggaaaggacggcug

SEQ ID NO: 75881 - RNA, 64 nt, Human
gcccugugggagccgcagagccugacgcucagccccaggccagcugcggccaggccugcgggcc

SEQ ID NO: 75882 - RNA, 64 nt, Human
ccgccuacacacgauccuggcccuccaccugccuccaggccacgaaaugggaauuccagcacua

SEQ ID NO: 75883 - RNA, 64 nt, Human
gagugagcugauggcuccgagacuggucaggagcccaggccagugagauggggccuggagccuu

SEQ ID NO: 75884 - RNA, 64 nt, Human
gcccagagaacucuccugggaggcugugggugagccaggccaacauuggugucccuguccccag

SEQ ID NO: 75885 - RNA, 64 nt, Human
caaaaucacugccaugguucaauguucccaggccccaggccauccacuugccggcccccaccag

SEQ ID NO: 75886 - RNA, 64 nt, Human
uugucaggggccaggacuggccccacugcagugcccaggccagucuugagcagcagggagggcu

SEQ ID NO: 75887 - RNA, 50 nt, Human
gccccuaugacggugugugaccaggccagcccagugaccuuucuccugcu

SEQ ID NO: 75888 - RNA, 64 nt, Human
ugugcagggucccagacccaggccccagagcagcccaggccaugacccugccgagcacggugug

SEQ ID NO: 75889 - RNA, 64 nt, Human
ggggcaagccaggaugcccugugguuguggcgccccaggccaucccaaacccaguggcagagga

SEQ ID NO: 75890 - RNA, 64 nt, Human
gugggauggaaguuuuugcuacauguuauccaccccaggccagguggaaguaacugaauuauuu

SEQ ID NO: 75891 - RNA, 64 nt, Human
uuguuguuuaguuacauuaggcuuugcuauauccccaggccaaauagcaugugacacaggacag

SEQ ID NO: 75892 - RNA, 64 nt, Human
cgaaagugcugggauuacaggcgugagccaccagccaggccaagcuauucuuuuaaaguaagcu

SEQ ID NO: 75893 - RNA, 64 nt, Human
cccauccuccccuggggucaggagaggccgagccccaggccacugucacucuuugugggagggg

SEQ ID NO: 75894 - RNA, 64 nt, Human
ccggauuacuuucuuggcagcuuaaguggcgcagccaggccaagcuguguaaguuaagggcagu

SEQ ID NO: 75895 - RNA, 64 nt, Human
ugccucccucccagcagggaaaccccgcccgcugccaggccauccucucugccagaggcuuuca

SEQ ID NO: 75896 - RNA, 64 nt, Human
cagccuggccaccagccucccuuucugccugaccccaggccaccccucuucucucccacaugca

SEQ ID NO: 75897 - RNA, 64 nt, Human
cccagccuggccaccagcuucccucugccugaccccaggccaccugucuucucucccacgugca

SEQ ID NO: 75898 - RNA, 64 nt, Human
ucugagucccaggcagcuggacaucuccaggaaaccaggccaucugggcaggaggccuggggau

SEQ ID NO: 75899 - RNA, 64 nt, Human
uggggggagugggagggagguggggagagcuagcccaggccaggggucaauguucaugucacua

SEQ ID NO: 75900 - RNA, 64 nt, Human
gccuucacugggccagucaacggggggcuccugcccaggccacagagaaccugaguucccggga

SEQ ID NO: 75901 - RNA, 64 nt, Human
uauuuuuaguagagacaggauuucaccauguuggccaggccagucucaaacuccugaccucagg

SEQ ID NO: 75902 - RNA, 64 nt, Human
ggacuucccggccgccacugggcccugccggucaccaggccacugugcagugggcgcagagcau

SEQ ID NO: 75903 - RNA, 64 nt, Human
acccuccccacagugccacccaugcagcugcuccccaggccaccccgcugauggagccccaccu

SEQ ID NO: 75904 - RNA, 64 nt, Human
agccugaggggaagccacaggaucggcccgagacccaggccaugcccacuggggacacacugug

SEQ ID NO: 75905 - RNA, 64 nt, Human
cgucgggcuaggaggggccaagccgaagagccacccaggccacaguuccugugccugccuuccc

SEQ ID NO: 75906 - RNA, 64 nt, Human
uuggagcugcuccuugcaggggcgggucaguuucccaggccaugccgggguggccaucuauggu

SEQ ID NO: 75907 - RNA, 64 nt, Human
cgcagaugaggacacugagggcggcgucccucacccaggccacgcagcuggugcggcuguucgg

SEQ ID NO: 75908 - RNA, 64 nt, Human
ccccgcucccaccuagugccccagacugagcucuccaggccaggugggaacggcugauguggac

SEQ ID NO: 75909 - RNA, 64 nt, Human
guucaggcucacugaccuggcucugacgaggaccccaggccacucugagaagaccuuggaguag

SEQ ID NO: 75910 - RNA, 64 nt, Human
aaugccggagguggagcugggcagcuguggagccccaggccacaggccagucucgcuuggcucu

SEQ ID NO: 75911 - RNA, 64 nt, Human
cugaaggugggggugacacugggaggugggagggccaggccaacuggcugcggccaucacagcu

SEQ ID NO: 75912 - RNA, 64 nt, Human
cacucagaggcucccagcuggguuggugggacagccaggccagaugaccugauuccagcaaaaa

SEQ ID NO: 75913 - RNA, 64 nt, Human
ucccgacuccaucucccccaccaggcuggucaccccaggccagcgucuguugaaggaugaagca

SEQ ID NO: 75914 - RNA, 64 nt, Human
agugaaguggcgugaccuuggcucacugcaaccuccaggccagccucagccucccuaguagcug

SEQ ID NO: 75915 - RNA, 64 nt, Human
gagaugccagcuccuugagagcagugggggugucccaggccagagcagccucuuccucuccugg

SEQ ID NO: 75916 - RNA, 64 nt, Human
cucucgucugaucguggagcugcggcggcugcacccaggccacgugcugcccgacgaggagcug

SEQ ID NO: 75917 - RNA, 64 nt, Human
cuuaauuggccaaauauaaguuggugucguaacuccaggccacagugaguuaugggcaaagcuu

SEQ ID NO: 75918 - RNA, 64 nt, Human
cagcacagggagggcuuaaguuggggauguuugaccaggccaccuccugcaacugcuguuucuc

SEQ ID NO: 75919 - RNA, 64 nt, Human
gaggaggugggaagggccaccaggcccccagcugccaggccagcugaccccagccuuccuggaa

SEQ ID NO: 75920 - RNA, 64 nt, Human
aggcagaugggugggugggugggcagguggccugccaggccaggagugggcuggagcugcugag

SEQ ID NO: 75921 - RNA, 64 nt, Human
aagugccuggcagaaugcccugccugccugccugccaggccaaggccugcgucucucugcugua

SEQ ID NO: 75922 - RNA, 64 nt, Human
caucguggcacggcagucucaaugggucagaaacccaggccagcugggcucuaagccuggcauc

SEQ ID NO: 75923 - RNA, 64 nt, Human
acuuccacugacucauucugaacccccuaagcacccaggccagaggcaagaaccugggcuguaa

SEQ ID NO: 75924 - RNA, 64 nt, Human
cuagaagccagucccuccccaccugcccagagcuccaggccagcacagaaauuccugaggccaa

SEQ ID NO: 75925 - RNA, 64 nt, Human
uccgggcuccagguuucugguugggaagggaaggccaggccaaaagcuccaccggccguauaga

SEQ ID NO: 75926 - RNA, 64 nt, Human
acucucugagugguguccucggccccccugauggccaggccaugcaggaaaggccaggggccuc

SEQ ID NO: 75927 - RNA, 64 nt, Human
agggagaacuugaaacagauucaggccagcccagccaggccaacagcaccuccccgcugggaag

SEQ ID NO: 75928 - RNA, 64 nt, Human
acuaaucugugcuggcgcaggaugaagccacgcuccaggccauggacgagaagcugcggaagug

SEQ ID NO: 75929 - RNA, 64 nt, Human
gcucagccccggccacucccugccaacuccaugaccaggccaccaucuguacccugcuucccaa

SEQ ID NO: 75930 - RNA, 64 nt, Human
uuuuaaaaggcucccaugugagucccugugauggccaggccaggggaccccugccaguucucug

SEQ ID NO: 75931 - RNA, 64 nt, Human
gccaacccuugccauugaccguggccaccuggacccaggccaggcccggcccggcgagugguca

SEQ ID NO: 75932 - RNA, 64 nt, Human
gucucugucaucccgucgccccuuaccccccaccccaggccacugggccccucccacaccaccu

SEQ ID NO: 75933 - RNA, 64 nt, Human
agaguuucugcaaaguguaugugaccaucauuucccaggccauuaggguugccucacuguagca

SEQ ID NO: 75934 - RNA, 64 nt, Human
ggcugguagccaagcacuuauggaccagaguggcccaggccagcugggcgccuuccucccaccu

SEQ ID NO: 75935 - RNA, 64 nt, Human
cccaacagucccucagcuucacccagcggggcuuccaggccagccuguguccccucccgcaggc

SEQ ID NO: 75936 - RNA, 64 nt, Human
uuacucuucuagaugugaaaagagggugcagaguccaggccagauagucuuccccacacacuuu

SEQ ID NO: 75937 - RNA, 64 nt, Human
agauaauccugaauugaggucaugaggaggccccccaggccagacaguccugaaccccucugac

SEQ ID NO: 75938 - RNA, 64 nt, Human
cucugccccauugcgcagcuccacccauugugccccaggccagcccgcgucaccuacacuuccu

SEQ ID NO: 75939 - RNA, 64 nt, Human
cacccaggcaagaucccuaagaggcacccaaugcccaggccaggggggcugcagcccucagccc

SEQ ID NO: 75940 - RNA, 64 nt, Human
aguacuaagcaaaauucucaucacagaauguagcccaggccaauuuauaacuaaaucucuauuu

SEQ ID NO: 75941 - RNA, 64 nt, Human
auaaucuaaugugcuucuaguaggcacagggcucccaggccaggccucauucuccucuggccuc

SEQ ID NO: 75942 - RNA, 64 nt, Human
uuccucucuccuuccuuuccuuccuuuuucucuaccaggccauuuuucaaauuuacaucaaaga

SEQ ID NO: 75943 - RNA, 64 nt, Human
gcacugaggguggugggaggggaucaccuggguuccaggccauccuugcugagcaucuuugagc

SEQ ID NO: 75944 - RNA, 64 nt, Human
ugucccugugcuccaagcugcccccggcugcagcccaggccauggacaugugcaccaguaugua

SEQ ID NO: 75945 - RNA, 64 nt, Human
ucuggagacaagcucuuccggagugcucugggagccaggccagggugugagggaggugcagagg

SEQ ID NO: 75946 - RNA, 64 nt, Human
cgaaccaagugagccugccacccuggagugagccccaggccaggaggcuguuccaggaguccug

SEQ ID NO: 75947 - RNA, 64 nt, Human
cagcuuagcuggggcugugcagccaggggcuuacccaggccaguggaggugccacagcccuggg

SEQ ID NO: 75948 - RNA, 64 nt, Human
ggcuagagccuccaggcccuaugaugcucccugcccaggccauauccuuuauuccugcugagcu

SEQ ID NO: 75949 - RNA, 64 nt, Human
gcauuuguggaauuaugaguucaugcaaaacucuccaggccaaguaggggucuagccuuuaaug

SEQ ID NO: 75950 - RNA, 64 nt, Human
acuugggcagugacagagcccagagcaaacagggccaggccagcccaaauccagugaccuccuc

SEQ ID NO: 75951 - RNA, 64 nt, Human
ugcagcguagcugguauuaacaaccguggggacaccaggccacucuuuuucuaccaguuguuuu

SEQ ID NO: 75952 - RNA, 64 nt, Human
caugucugggagggguggaggaggcagagggacuccaggccagagggcuguucucacaaccuca

SEQ ID NO: 75953 - RNA, 64 nt, Human
cuugaaauccauugccaagaaacacagucgaagcccaggccaggucgcccugcgcuaccagcug

SEQ ID NO: 75954 - RNA, 64 nt, Human
ccaaccucugcugcaaaggaaucucuugcugaguccaggccaccaaucaggcaaauagcccaua

SEQ ID NO: 75955 - RNA, 64 nt, Human
agcgcccuaauuggaauuggaaacagaaaauucgccaggccauacugcuggagcccauucagau

SEQ ID NO: 75956 - RNA, 64 nt, Human
ggguaauauagggauaauuacuggcaccugccucccaggccauucugacguguaaccgcauaua

SEQ ID NO: 75957 - RNA, 64 nt, Human
aacggacacaacuccgggaagccuuugagcagcuccaggccaagguacacccaggggucuugag

SEQ ID NO: 75958 - RNA, 64 nt, Human
gauguggaccacgggauuuguagccagccagcucccaggccaacgcccaaagcccugaugaccu

SEQ ID NO: 75959 - RNA, 64 nt, Human
agugcccugagccagggucuccagaaagccccacccaggccaggcauguggcagggguuagagc

SEQ ID NO: 75960 - RNA, 64 nt, Human
cacagaauauaagugacuacagggcaccugggccccaggccauccagccuuugccuuugagccc

SEQ ID NO: 75961 - RNA, 64 nt, Human
ggcuguguugccccucuccuccucacuauucucaccaggccaugggacuuugggggcagugaga

SEQ ID NO: 75962 - RNA, 64 nt, Human
cugcacugagccaguucagucacuagugcgccagccaggccaggagggagugcagagcaugucu

SEQ ID NO: 75963 - RNA, 64 nt, Human
gggggugucuucugagcucaagccugcuucugggccaggccauugucacuguuaguugaagaaa

SEQ ID NO: 75964 - RNA, 64 nt, Human
cccauacuagaguucauggauauguuauacugaaccaggccagagcaaacagaaaaagaagguu

SEQ ID NO: 75965 - RNA, 64 nt, Human
agguuucuaagagccguguucuucauggaauuuuccaggccacuuggcagcuugguuuaccgau

SEQ ID NO: 75966 - RNA, 64 nt, Human
gacugaggaagggcagagccagaagcaagccgugccaggccaucugccugcucaugggguccua

SEQ ID NO: 75967 - RNA, 64 nt, Human
cuugcucuaaaaacaggacugucccugaugggagccaggccacagggaggaggcuucuuugugg

SEQ ID NO: 75968 - RNA, 64 nt, Human
ccuggaguucuagaaggauggagagugaggggauccaggccauucaccugcauggcuuugcccu

SEQ ID NO: 75969 - RNA, 64 nt, Human
ugccaaacagcagccugccgggcagggagcagccccaggccagagaggccucccgguccagcuc

SEQ ID NO: 75970 - RNA, 64 nt, Human
aaggaccuggcagggccagacgcuguaccaucacccaggccagggaugggggugggggucccug

SEQ ID NO: 75971 - RNA, 64 nt, Human
ucgucugccaagccucgccuccuaccacaccacaccaggccaccccagcugcaagugccuuccu

SEQ ID NO: 75972 - RNA, 64 nt, Human
ggucuccagaguuuuccuguccucuagaggcaagccaggccagggagcugggagcgagcaagcu

SEQ ID NO: 75973 - RNA, 64 nt, Human
uugguuuuguggggagaggggaaggaucagggggccaggccagcagcucgggggccacaaggag

SEQ ID NO: 75974 - RNA, 64 nt, Human
uauuguacaaaccaugugagcccggccggcccagccaggccaucucacguguacauaaucagag

SEQ ID NO: 75975 - RNA, 64 nt, Human
uucauggcugagugcugggaagggcugagcucacccaggccagcaggugggguaucaucugcuc

SEQ ID NO: 75976 - RNA, 64 nt, Human
guuccuugguccauaacuggugagcuauggagacccaggccaacaaauuauccccagugauaug

SEQ ID NO: 75977 - RNA, 64 nt, Human
caccgccauggcuuccaagguggucugcucgggcccaggccaucuuccagguggggugaggcag

SEQ ID NO: 75978 - RNA, 64 nt, Human
cuccuguccucucccaguucauuccuggaaccagccaggccaggcaaccaguggcccccaaagg

SEQ ID NO: 75979 - RNA, 64 nt, Human
gaccuccugugacaccacgccagaucacagggcaccaggccagagauagucuucuuuuuguccu

SEQ ID NO: 75980 - RNA, 64 nt, Human
ggcugacugagaugcaaggucugaccccacaaggccaggccaauguugcucagugaucacuaag

SEQ ID NO: 75981 - RNA, 64 nt, Human
cagcuccgagaaggcgccagugaaggaccagggaccaggccagggugcgggcaggcaucacugu

SEQ ID NO: 75982 - RNA, 64 nt, Human
cggaagcauuccugauggaacacccacuggccagccaggccauggcuucucccgacccucuggc

SEQ ID NO: 75983 - RNA, 64 nt, Human
ggugggaaggagucacacgguaaaugggcgaaauccaggccaggagccucagagacugaagcag

SEQ ID NO: 75984 - RNA, 64 nt, Human
ggcagugcugccucuuguaggugcuggcuaagggccaggccaggaugaguuuccccauggugaa

SEQ ID NO: 75985 - RNA, 64 nt, Human
cugagauuuguuuuagcaaacagauggauucucuccaggccaugggauuugggaaccaccaugc

SEQ ID NO: 75986 - RNA, 64 nt, Human
cccauguguuucagguggaacaggaggaacugguccaggccaggccucauccuccuggacccag

SEQ ID NO: 75987 - RNA, 52 nt, Human
auucugcgcaguuccacuaacaccaggccacacccugccggacaacuccagc

SEQ ID NO: 75988 - RNA, 64 nt, Human
uggggaguggggggcagggucgggaagggacaugccaggccaggccuggggccccggggccuga

SEQ ID NO: 75989 - RNA, 64 nt, Human
cccuucuccgcagggcccuguggcucuggcagccccaggccauggcguugccagccucccugug

SEQ ID NO: 75990 - RNA, 64 nt, Human
gacauaguccagaccacccagguaugggcagcucccaggccagcagcagcagcagccuacgcua

SEQ ID NO: 75991 - RNA, 64 nt, Human
cacugguaaucccaagaucugugcagccccgccuccaggccacauggggcugggcagcuaccau

SEQ ID NO: 75992 - RNA, 64 nt, Human
auuggaguuugaggccccuaagcuggcaucaaccccaggccacgcucgcucuuuccuucccucc

SEQ ID NO: 75993 - RNA, 64 nt, Human
gcccuaauaaaacccucugccaggucugggagucccaggccaucugcucaacgcucugugguuu

SEQ ID NO: 75994 - RNA, 55 nt, Human
ugccggaagcggggccuugagugggccaggccacucccccgagcuccagcugccu

SEQ ID NO: 75995 - RNA, 64 nt, Human
ccagccccacugccagcagcagcaggugauuggaccaggccauucugccgcccccuccugaacc

SEQ ID NO: 75996 - RNA, 64 nt, Human
gaccagaggguucagagugggaggcggggccagcccaggccaggagcgccucaucuucccaggc

SEQ ID NO: 75997 - RNA, 64 nt, Human
ucuuuaagaagaacaaguaguugggggcaaggucccaggccaacucccucccuccguucaggaa

SEQ ID NO: 75998 - RNA, 64 nt, Human
agccuucaacagaagcugugcugccacggcaggcccaggccagccagugcccgaggccaggaag

SEQ ID NO: 75999 - RNA, 64 nt, Human
gggucagcccuccuugacugugucccagccagcaccaggccagcagccucaucccugccauuca

SEQ ID NO: 76000 - RNA, 64 nt, Human
acuuccagggaccauuugcccuucccaaaucccuccaggccagaacugacuggagcaggcaugg

SEQ ID NO: 76001 - RNA, 64 nt, Human
aguccuuuggagacaauuuaccuguauuaggagcccaggccacgcuacacucugcccacacugg

SEQ ID NO: 76002 - RNA, 64 nt, Human
gccuacugucccucucagugccuucucucagcucccaggccaacaguagccaaaccccuagaga

SEQ ID NO: 76003 - RNA, 64 nt, Human
ugcugagugauccccuccagggacacuucccugcccaggccaccucccacagcccuccacuggu

SEQ ID NO: 76004 - RNA, 64 nt, Human
gccuugagaucaagaaaaccuaaucuucugacucccaggccaggauguuuuauuucucacauca

SEQ ID NO: 76005 - RNA, 64 nt, Human
auugaaaauacugggcagguccaaaaggauaguuccaggccauaggaauggcuuggugcaguua

SEQ ID NO: 76006 - RNA, 64 nt, Human
uacuguuuauaucuucacccuguaaugguugggaccaggccaaucccuucuccacuuacuauaa

SEQ ID NO: 76007 - RNA, 64 nt, Human
cagcgcagaguagcugcuuccuggacgugcgcgcccaggccagugcugugagcaggcggggagg

SEQ ID NO: 76008 - RNA, 63 nt, Human
aucauccagaacauaugugaguggggccagggcccaggccaggccgcuuuuuuaccccagugg

SEQ ID NO: 76009 - RNA, 64 nt, Human
uaugcaggaaacucuuuugaaauaacuuuggugcccaggccaaguagaaugagaugagacugag

SEQ ID NO: 76010 - RNA, 64 nt, Human
ugccccuggcccuagaacagauccagggcaacguccaggccaaugugccagcuggaggccaggc

SEQ ID NO: 76011 - RNA, 64 nt, Human
uugucccauucacuucugugauccauuuuaauuuccaggccacaagacaguagugaugcucuga

SEQ ID NO: 76012 - RNA, 64 nt, Human
gccuucuuuucucuuuccagaaaauagucccuuuccaggccaaggaccugaauucuguuuacuu

SEQ ID NO: 76013 - RNA, 64 nt, Human
gacaccauguggggccauugguguuaugagccccccaggccacacugcuucucagaaaugagcu

SEQ ID NO: 76014 - RNA, 64 nt, Human
ucauguccuggguuuuggcucuuuaaugauuacuccaggccagcauuuagucguuugagaauug

SEQ ID NO: 76015 - RNA, 64 nt, Human
acaugggaugcagcuaacugcaguugggucgcccccaggccaacgcuccucucaauccugggcu

SEQ ID NO: 76016 - RNA, 64 nt, Human
ugggugccugcugcugccugccuuggccugauggccaggccagagugcugccaguccucugcau

SEQ ID NO: 76017 - RNA, 64 nt, Human
accccuccccguguuaaucuguaacuugcagcccccaggccaaaguccuuucucacacuccacu

SEQ ID NO: 76018 - RNA, 64 nt, Human
uccccggcuguggcccuucuguggaugugggagcccaggccaggcagggagcagaugcagggac

SEQ ID NO: 76019 - RNA, 64 nt, Human
gaagauauaucccuagagcaggggaccccaacccccaggccaugggccacacagcaggaagagg

SEQ ID NO: 76020 - RNA, 64 nt, Human
gaaacaacuagcaaaaagaauagccauaagaaaaccaggccaagauugaaaaauguggaucgga

SEQ ID NO: 76021 - RNA, 64 nt, Human
ugagucaaaugcccccugagugacugcccccagcccaggccagaagaccucccuucaggugccg

SEQ ID NO: 76022 - RNA, 64 nt, Human
aacagcaggaguuaauagcagaguugaggcggcgccaggccaaggaacaccggccuguuuauga

SEQ ID NO: 76023 - RNA, 64 nt, Human
cugagucccugagggcagacacagcuccagggacccaggccagcugccacacccccgacacucc

SEQ ID NO: 76024 - RNA, 64 nt, Human
gggagcgugcagccagcaugugcaguggccaacuccaggccaguggaaaguuacuguguggaua

SEQ ID NO: 76025 - RNA, 64 nt, Human
gauguucugggggaggaggcaaucgcuguagcugccaggccagccccaucuggaaggagucccu

SEQ ID NO: 76026 - RNA, 64 nt, Human
agaaccugacucgucugacuguguguggaggaguccaggccauggaggcagaauccuggcccuc

SEQ ID NO: 76027 - RNA, 64 nt, Human
ccuucuggguggaggcgccauccuaaccauccagccaggccacccacaacccgagaaucaggga

SEQ ID NO: 76028 - RNA, 64 nt, Human
cccucagaaggcugucuggcacccaguguccuagccaggccaaguauaugagaaagguaagucc

SEQ ID NO: 76029 - RNA, 64 nt, Human
cccagcccgcuccugacccuuaucuucccagagaccaggccaggaaggcccgagauggagagca

SEQ ID NO: 76030 - RNA, 64 nt, Human
uggaguuugggggaaggggauggcuggaugugcuccaggccaugcuggagguacccccgaggca

SEQ ID NO: 76031 - RNA, 64 nt, Human
gcuuuacagugggggcaccaagaccccaaagggcccaggccaggagacuguuaaagugaaaagg

SEQ ID NO: 76032 - RNA, 64 nt, Human
aaacugcuguauuuggaaaccccuucuuuacuucccaggccagcaagcucuucacugaaacugg

SEQ ID NO: 76033 - RNA, 64 nt, Human
ucccaggucuucaccaguuuuacaaugaguuaucccaggccagacgugguagcucacaccugua

SEQ ID NO: 76034 - RNA, 64 nt, Human
aagcugccccugcccugaauuagggggaaacauuccaggccaacucuagcuccuuucucaagcu

SEQ ID NO: 76035 - RNA, 64 nt, Human
cccugcccaccugucugccugccccgccuggagcccaggccaguguuguuuccagccucaggcc

SEQ ID NO: 76036 - RNA, 64 nt, Human
gcccuggccacgagcuuuggccuuggucuaccugccaggccaggcaaagcgccuuuacacaggc

SEQ ID NO: 76037 - RNA, 64 nt, Human
ccacugaccacccugacuguccaaaccugugaccccaggccagggaacggggaggaaaccaaag

SEQ ID NO: 76038 - RNA, 64 nt, Human
ccagaggggacaaagacgugcacucaaccuucuaccaggccacucucaggcucaccuuaaaauc

SEQ ID NO: 76039 - RNA, 64 nt, Human
gauguucagagggagccagcucuuuauguuggccccaggccaguacuaagcaaauuaaaaagac

SEQ ID NO: 76040 - RNA, 64 nt, Human
auaaugaaaaaacugaagagauacgugaaugaaaccaggccauagcugucauaaaucuuugacu

SEQ ID NO: 76041 - RNA, 64 nt, Human
gaggaagggaagaccccaguggugggacccuggaccaggccauggaugaaggacaaagaccagg

SEQ ID NO: 76042 - RNA, 56 nt, Human
acagugccaaaaaguugugaggucuuccaggccaagguggaugggccccaugccaa

SEQ ID NO: 76043 - RNA, 64 nt, Human
augcacugaaaacuuagccagaguuagguugucuccaggccaugauggccuuacacugaaaaug

SEQ ID NO: 76044 - RNA, 64 nt, Human
gugcagcagcauuggaaggcuggggccgggcaggccaggccaagccaagcagggggccacaggg

SEQ ID NO: 76045 - RNA, 64 nt, Human
gcuauuuauggaaacuaacuuuuuuguuuuuaauccaggccaacauguauguaaauuaaauuuu

SEQ ID NO: 76046 - RNA, 64 nt, Human
gugugaagcuggggcagaguaugcuacgaagggaccaggccaggccacagggcucuccucccag

SEQ ID NO: 76047 - RNA, 64 nt, Human
aagcuggggcagaguaugcuacgaagggaccaggccaggccacagggcucuccucccagucuuu

SEQ ID NO: 76048 - RNA, 64 nt, Human
cacauagcccuguugaccugcccgauccagauucccaggccaggcucccgaccccauccaccua

SEQ ID NO: 76049 - RNA, 64 nt, Human
agaagggaggccaagcaccaguccaucaccccucccaggccagccucuguaaguuggccacacu

SEQ ID NO: 76050 - RNA, 64 nt, Human
gcagcagagggacaugggccauuccaugacgugcccaggccaacgucgcaggacaguugugaaa

SEQ ID NO: 76051 - RNA, 64 nt, Human
uccgguagggaggcagccuccagccugcccaagcccaggccacccuaucgcccccuacgcgccu

SEQ ID NO: 76052 - RNA, 64 nt, Human
gucaugggccuggggcccagggccaggguggggcccaggccacuggcuccagagcccugcccua

SEQ ID NO: 76053 - RNA, 63 nt, Human
ccgagagguuccugaucuaggccccagaccuggccaggccagccucccugugcgugugcgucu

SEQ ID NO: 76054 - RNA, 64 nt, Human
acccucuucuguaccucuccugagugccaacuguccaggccauuugacacaccaucuguuaacc

SEQ ID NO: 76055 - RNA, 64 nt, Human
cccgcacccaccagacaacagccagggcuggaguccaggccacuuucagcugcuccuuucuccg

SEQ ID NO: 76056 - RNA, 64 nt, Human
ugcugucugccggccagagccucucccaucugacccaggccaggcguucccaccucuccuccuu

SEQ ID NO: 76057 - RNA, 64 nt, Human
gaaaauucccaaauauuacaacaaguccuugaacccaggccaugugguuagacguugguguuaa

SEQ ID NO: 76058 - RNA, 64 nt, Human
uccuuuuauuccucacucggguuucucuguggcuccaggccaaagugccggugagacccauggc

SEQ ID NO: 76059 - RNA, 64 nt, Human
uuccuccugcuucuccuuguccugccuggaggcuccaggccacacccagcugguggggcugcuc

SEQ ID NO: 76060 - RNA, 64 nt, Human
gccccuccccgcccagaacugugaauggccugcuccaggccauggcugggggcagggagugagg

SEQ ID NO: 76061 - RNA, 64 nt, Human
cccgcucuuggacagaggaucugggagguggaagccaggccagaggacuuggggaaaaugagau

SEQ ID NO: 76062 - RNA, 64 nt, Human
agcacaggcaagaguguucuuuucuggugauucuccaggccauuuaauacccugcaauguaauu

SEQ ID NO: 76063 - RNA, 64 nt, Human
agcaggcuggcagggagugguugaggucugggggccaggccacauggcuggagaggaauuucag

SEQ ID NO: 76064 - RNA, 64 nt, Human
cuugccuggggagccccauguguggcccaccccaccaggccauccccauaccuucugguuugaa

SEQ ID NO: 76065 - RNA, 64 nt, Human
ccagccccuugacuccagccucgaccgccaggccccaggccagagccacccaaugaacagugca

SEQ ID NO: 76066 - RNA, 64 nt, Human
gccuucucacaugggcaccaugaaacacuuucuuccaggccaccugagccuucguucuucagcc

SEQ ID NO: 76067 - RNA, 64 nt, Human
gagggcacaccacugccaggggucagccucgcacccaggccaggcagaagcugugcucugaagc

SEQ ID NO: 76068 - RNA, 64 nt, Human
guccuuacauagaccuuaaaaagagcucacccuuccaggccaaugcugaagacacagcuccgcu

SEQ ID NO: 76069 - RNA, 64 nt, Human
cagcuccgcuugggagccugagaacccaggcuucccaggccagaguguggcuucuuaaacggca

SEQ ID NO: 76070 - RNA, 64 nt, Human
aggugcaggccauuggagagaaggucuccuuggcccaggccaagauugagaagaucaagggcag

SEQ ID NO: 76071 - RNA, 64 nt, Human
uuauacaaaccuagaugggacaccuaugacccacccaggccagaugguacagccuguugcuccu

SEQ ID NO: 76072 - RNA, 64 nt, Human
gcugcugcacagcuggccaccauggcacccugcaccaggccaucagcaccacgugccaaggagc

SEQ ID NO: 76073 - RNA, 64 nt, Human
gugggaaggaaaaguagagaaagaaaugccaauuccaggccaaagcguuauuugccaaguuuuc

SEQ ID NO: 76074 - RNA, 64 nt, Human
agaaguuggucaacagaucuggugagggaaguccccaggccagacgcuggacuccugcaaugag

SEQ ID NO: 76075 - RNA, 64 nt, Human
gcugccuuggacgcugcagcccccuccucaacggccaggccagagucugagacaggacccaggc

SEQ ID NO: 76076 - RNA, 64 nt, Human
uuuuuugagacagaaucucaucacacucugucacccaggccaaguucaauggugcaaucuggcu

SEQ ID NO: 76077 - RNA, 64 nt, Human
auggcuggcuugagaugaguugaaaauaacuucgccaggccaguguguagaacagcugguccaa

SEQ ID NO: 76078 - RNA, 64 nt, Human
gugcccaucaaacaggagugugcgcuauggaaaaccaggccagagggucacugucugguuugug

SEQ ID NO: 76079 - RNA, 64 nt, Human
ucuggggcagaaacacucaaguugauuagaaagaccaggccaaugucaggguaccuggggccaa

SEQ ID NO: 76080 - RNA, 64 nt, Human
agguaucgugaugggccacucgguccaaaaucagccaggccaucuuuuccaucaucucacuuca

SEQ ID NO: 76081 - RNA, 64 nt, Human
cccacaggccagcuacggauuuugcacuuuugcuccaggccacuuguguguguaugugugugug

SEQ ID NO: 76082 - RNA, 64 nt, Human
cagaggaagcuauuccuggcuuuuccacuccaacccaggccacccuuugucucugccccagagu

SEQ ID NO: 76083 - RNA, 64 nt, Human
uuuagaguggcuuagugugacacacaggcaucucccaggccaagcacacacaggcugcgcccag

SEQ ID NO: 76084 - RNA, 64 nt, Human
ccuuacccggugcccucuccuugccagcuucuccccaggccagagcggccaucgcguagaaaga

SEQ ID NO: 76085 - RNA, 64 nt, Human
cagauguggucaccucaguccagcucuggggccuccaggccauguggcuguucccacggcccag

SEQ ID NO: 76086 - RNA, 64 nt, Human
gccuccuaaaggccacacccuccccacgcacuucccaggccagaauccaaacaucgggaacccu

SEQ ID NO: 76087 - RNA, 64 nt, Human
aggagggcucgagcuggacacuccuggcuggacgccaggccagugccgccuacguggagacugu

SEQ ID NO: 76088 - RNA, 64 nt, Human
ccuggcugggcaucccugugccugucccuggcggccaggccauugccuucccacuaugcagcca

SEQ ID NO: 76089 - RNA, 64 nt, Human
ccuuucucugcagguuuggacuugcuaacaggauccaggccaggcugugguuuccccugaacca

SEQ ID NO: 76090 - RNA, 64 nt, Human
caagucacaggugacucagcagugacccugugugccaggccagauccaaacugagagggaaggu

SEQ ID NO: 76091 - RNA, 64 nt, Human
uuuuuuuguagagauggggaucuccuuauguuguccaggccagucuugaacucuugggcucaag

SEQ ID NO: 76092 - RNA, 64 nt, Human
uuccguugcucccccgccacccaccuccuccuccccaggccacccaacuugggcaccucccugg

SEQ ID NO: 76093 - RNA, 64 nt, Human
gcaggggcuuucuggcccccucccacucccguuuccaggccaugaccacucugcccuguccugg

SEQ ID NO: 76094 - RNA, 64 nt, Human
acagcaugguccucacacccagcucccugcacacccaggccagccaccccucccgcucgugcac

SEQ ID NO: 76095 - RNA, 64 nt, Human
ugucccagcuuccccugggguucaccccuggcugccaggccacugaggaugggcaggggucucu

SEQ ID NO: 76096 - RNA, 64 nt, Human
ggccuucucugaaggacauugcggacagccacggccaggccagagggagugacagaggcagccc

SEQ ID NO: 76097 - RNA, 64 nt, Human
ggugcccucuccaaagggucgggaggguagcucuccaggccagagcuuguguccuucaacagag

SEQ ID NO: 76098 - RNA, 64 nt, Human
cucucccauaacagugcagugauagucagcugguccaggccaggcaaggggcugguccaugaug

SEQ ID NO: 76099 - RNA, 64 nt, Human
cagcuaaugaggcugacuggauguccagagcuggccaggccacugggcccugagccagagacaa

SEQ ID NO: 76100 - RNA, 64 nt, Human
cccuguugaagcucuggugacaccagccuuucucccaggccaggcuccuuccugucuuccugca

SEQ ID NO: 76101 - RNA, 64 nt, Human
gggguguggggcugcccuggggcccgugcccccaccaggccagccccugcuggguucagaggcc

SEQ ID NO: 76102 - RNA, 64 nt, Human
ggggaggguccuugcaauuccagcgaaucggaggccaggccaggacguccuugcucccugcacc

SEQ ID NO: 76103 - RNA, 64 nt, Human
ggccagaagcucugugccuggucuguaacaguuuccaggccagcuggagaauguucacugguuc

SEQ ID NO: 76104 - RNA, 64 nt, Human
ggaagcagcuuuccccaugucucgacucauccauccaggccauuccccgucucugguuccuccc

SEQ ID NO: 76105 - RNA, 64 nt, Human
gggcuuccuuuguuggagucaacuguugaugcuuccaggccaaacuggcuuccucuccuccucu

SEQ ID NO: 76106 - RNA, 64 nt, Human
uuccugaugcuucuucagagacuccugcaggcagccaggccacaagacccuuguggucccaccc

SEQ ID NO: 76107 - RNA, 64 nt, Human
gggugcucagguggugggugcucagggcccugccccaggccacugggccguuuugaugaccucg

SEQ ID NO: 76108 - RNA, 64 nt, Human
cacacugccuguggcccccgagcccggcccagccccaggccagucagccgcagacuuuggaaag

SEQ ID NO: 76109 - RNA, 64 nt, Human
caaggaccuggguggccucgcuuacuguuccagcccaggccaagcacagggucuggcucguggc

SEQ ID NO: 76110 - RNA, 64 nt, Human
ggccuuaggaagagccuuccacccaggggcagccccaggccaaaggggaccuggaagggaggug

SEQ ID NO: 76111 - RNA, 64 nt, Human
ggcagggccauagggagggagauucgcuacggauccaggccauuccugggugagcccuugggca

SEQ ID NO: 76112 - RNA, 64 nt, Human
cacucugggccuggggacccaaacccccugcagcccaggccagucagacgccaggcaccacagc

SEQ ID NO: 76113 - RNA, 64 nt, Human
cuucugcaggcucugccaugcacgcaccucacugccaggccauuaaaaucagcacccagcaugc

SEQ ID NO: 76114 - RNA, 64 nt, Human
ggcggaucaccugaggccaggaguuggagaccagccaggccaccauggugaaacccugucucua

SEQ ID NO: 76115 - RNA, 64 nt, Human
agguguaagguuuuuaucuuauaugccagaggcaccaggccagaugugccgcacagucauguaa

SEQ ID NO: 76116 - RNA, 64 nt, Human
ggcccuucucuucugugggucuguaccagguacuccaggccagcccaugggcccggggccugac

SEQ ID NO: 76117 - RNA, 64 nt, Human
gccacagcugugcaugcucagcccugccgaggucccaggccaggcuuuguugcuuccguucaug

SEQ ID NO: 76118 - RNA, 64 nt, Human
ccagccagcugucaaaaguauuucaagauaaaauccaggccaagcaaagccuuuaaguucccgu

SEQ ID NO: 76119 - RNA, 64 nt, Human
uggucacugcaugauccgcucuggucaaacccuuccaggccagccagaguggggauggucugug

SEQ ID NO: 76120 - RNA, 64 nt, Human
caucaccccagaggccuugucauccucccuugccccaggccagguagcaagagagcagcgccca

SEQ ID NO: 76121 - RNA, 64 nt, Human
guggcagccacguggaagcagggcauguagcaggccaggccacgggcuugcagcuccucugagg

SEQ ID NO: 76122 - RNA, 64 nt, Human
cccaccaauacacacaaauuuuuuaaucccaugaccaggccacggucaaggcuguuuuugagua

SEQ ID NO: 76123 - RNA, 64 nt, Human
cacccuguccugaguagggguugugcucauuaccccaggccagugguagcuuccucaggagccu

SEQ ID NO: 76124 - RNA, 64 nt, Human
ugaggugggaaagccacggcaggcagcgagcagcccaggccagcuuucugcauggauggucagu

SEQ ID NO: 76125 - RNA, 64 nt, Human
agcucuucagccagggcauuggaggggagcaggcccaggccaaguuugacagcugccuuucuga

SEQ ID NO: 76126 - RNA, 64 nt, Human
gagaccaugagaaggagaguucaggggucccaaaccaggccauccuagaccagccagcuccagc

SEQ ID NO: 76127 - RNA, 64 nt, Human
ugcuucggaccuccgccucugcccgggagaaagcccaggccagccugcuggacaagcagagacc

SEQ ID NO: 76128 - RNA, 64 nt, Human
ccugacgcacaggagagagcugaagguggguggcccaggccagggugugaacuuucucccaugg

SEQ ID NO: 76129 - RNA, 64 nt, Human
aguagaucucauggguacaggaggccagcagggaccaggccagucagccaugcucaggaccccu

SEQ ID NO: 76130 - RNA, 64 nt, Human
uugcuucccuaucaggcuugggcauaggggugugccaggccacuuugguaucagaaauugccac

SEQ ID NO: 76131 - RNA, 64 nt, Human
uccucgggcucuucuggaccuugcaccguggauaccaggccaugugccaugguauuuggguccu

SEQ ID NO: 76132 - RNA, 64 nt, Human
caggcucagggcaaagaaguggccuccuggggggccaggccacgagggccagggcuucugccug

SEQ ID NO: 76133 - RNA, 64 nt, Human
agcgcuuugcuuaccaaaagcucagggcccugugccaggccaaagauccccccagacccccauu

SEQ ID NO: 76134 - RNA, 64 nt, Human
uugcgcaaaacccagaagauguauucagagccacccaggccacugaccucccacuuuggggaac

SEQ ID NO: 76135 - RNA, 64 nt, Human
cauaggggccccauucaccuggaggcaucucaggccaggccaugccaggcucagccacugccca

SEQ ID NO: 76136 - RNA, 64 nt, Human
aagcaccagggaagaucuaacauuugagucccuuccaggccaucagaggccuagucagccacau

SEQ ID NO: 76137 - RNA, 64 nt, Human
agcugucuuucccagucagccagggagcuccccgccaggccacgccccagccacuuugcucccu

SEQ ID NO: 76138 - RNA, 64 nt, Human
guuugucucagcguagggcaggaggcccuccuggccaggccagcagugaagcaguauggcuggc

SEQ ID NO: 76139 - RNA, 64 nt, Human
cugccuucacccugaacauuuaguacccugcaggccaggccagcuuccccucacuuaaccaccc

SEQ ID NO: 76140 - RNA, 64 nt, Human
ugacucucuccaccgccucaguguagggaaggguccaggccagggaaggagcacccucuagugg

SEQ ID NO: 76141 - RNA, 64 nt, Human
uguuagcugggugggugucaucagccccugccucccaggccagaaccugagaacgggcccaggg

SEQ ID NO: 76142 - RNA, 64 nt, Human
accugugggggccuugcccauuugaccauguggcccaggccaaagcccaguguuggccuuacgc

SEQ ID NO: 76143 - RNA, 64 nt, Human
acccaucugggugacccggggcaggccacagaggccaggccagggcuggaaggacaggccugcc

SEQ ID NO: 76144 - RNA, 64 nt, Human
uugaugucuugacagauugaccaucugucuccagccaggccaccccuuuccaaaauucccucuu

SEQ ID NO: 76145 - RNA, 64 nt, Human
uuucagagucuguuuuuccauccaaauauaagccccaggccauuccacuuagugucuuuucaau

SEQ ID NO: 76146 - RNA, 64 nt, Human
gacuauaucuugaccgagggcuugcagugcaaagccaggccaguguugcgcauuacuuacaaua

SEQ ID NO: 76147 - RNA, 64 nt, Human
gaauccccgcaggacccauggagcuaugaccacaccaggccauucaaauggcucugcauuaucu

SEQ ID NO: 76148 - RNA, 64 nt, Human
ccaagcgcauuacccacuuguggccaaucaguggccaggccaaccuuggcuaaauggagcagcg

SEQ ID NO: 76149 - RNA, 64 nt, Human
gccccacccccaccaccuguccccacccagugucccaggccacaggagcuuauuggccaggagg

SEQ ID NO: 76150 - RNA, 64 nt, Human
acaacagugaccaacagacaggcagcuggguuucccaggccaucccucuguugccaucagcuug

SEQ ID NO: 76151 - RNA, 64 nt, Human
gauuuugaaggaaaugaguggccagcgccagggcccaggccauguggccugcccagccucaaug

SEQ ID NO: 76152 - RNA, 64 nt, Human
agucccucgcuuuuggggggggggucucucacccccaggccacauagggccagugguagggguu

SEQ ID NO: 76153 - RNA, 64 nt, Human
uggucgcggacggacccugccuccccagcuuaucccaggccagaggcugcaugccacugucccc

SEQ ID NO: 76154 - RNA, 64 nt, Human
gaagcgugucagauagcggcgugacccgggcccaccaggccacggccgccugcuguacauagug

SEQ ID NO: 76155 - RNA, 51 nt, Human
agcucauuucauucgacugacccaggccaugcucacguccggaguaacacu

SEQ ID NO: 76156 - RNA, 64 nt, Human
gccauccugaccagccgugggaauggcugggcugccaggccagacacgcuagguucuuccaaag

SEQ ID NO: 76157 - RNA, 64 nt, Human
gccucugcgccuccacagggaaaaggcaaggcuuccaggccaguuggcccaggccccuggcagu

SEQ ID NO: 76158 - RNA, 64 nt, Human
gaggaaccugaguaugagaauguuguacccaucuccaggccaccagaacccugaugaccuugaa

SEQ ID NO: 76159 - RNA, 64 nt, Human
ucucacccaccagcuccacacauuccagccaggcccaggccagcccccccacccacccccaggc

SEQ ID NO: 76160 - RNA, 64 nt, Human
caccuccauagggaaaggcuucucuccaagugugccaggccaggacagcccucccagccaugaa

SEQ ID NO: 76161 - RNA, 64 nt, Human
gcuggccguaugaucuguguggauggcaaacuccccaggccauucugggaccuaaguuuaagaa

SEQ ID NO: 76162 - RNA, 64 nt, Human
gugaucgauuucacuagaugucucacucaucagaccaggccauugggccuaagugguaaaugug

SEQ ID NO: 76163 - RNA, 64 nt, Human
ugggugggguuucuuagugagccccccggaggguccaggccacguccuuggucaccuccccagc

SEQ ID NO: 76164 - RNA, 64 nt, Human
caugccucugggcaguccaaccacuucccuguuuccaggccagugaucuacuucuuuuucacua

SEQ ID NO: 76165 - RNA, 64 nt, Human
accccaucgugggugaggguauccccugugugucccaggccaauaaaaucuaccugccacugcc

SEQ ID NO: 76166 - RNA, 64 nt, Human
gcagcagcacagcgugggguccuggcacugcaggccaggccaggaugcccaccccgcccucuac

SEQ ID NO: 76167 - RNA, 64 nt, Human
ucuucuuccgagaugaccgcuacuggcgccucgaccaggccaaacugcaggcaaccaccucggg

SEQ ID NO: 76168 - RNA, 64 nt, Human
caauuccucaccgcaggagccucugaagcucccaccaggccagcucuccucccacaacagcuuc

SEQ ID NO: 76169 - RNA, 64 nt, Human
ugaaaaauggcauugccuucauggguccuccaagccaggccaugugggcuuuaggggauaagau

SEQ ID NO: 76170 - RNA, 64 nt, Human
ucucaacaggggagagugugguguuuccugcaggccaggccagcugccuccgcgugaucaaagc

SEQ ID NO: 76171 - RNA, 64 nt, Human
uucugauacaguugaucagaccccugcccaccgcccaggccaggccuguggucaucaaugcccc

SEQ ID NO: 76172 - RNA, 64 nt, Human
aaaaaauacgguggggguagggggcuggaggagcccaggccaggacucugcagccucagagaca

SEQ ID NO: 76173 - RNA, 64 nt, Human
ccccgcuaggucaaccccacuguagacaggaaagccaggccaggagaguccgaaugagaauuua

SEQ ID NO: 76174 - RNA, 64 nt, Human
cucugcugagaggccccuagagacaacacccuucccaggccacuggcugcuggacuguuccuca

SEQ ID NO: 76175 - RNA, 64 nt, Human
gaaucacuggugcuauagaaauugagaugcccccccaggccagcaaauguuccuuuuuguucaa

SEQ ID NO: 76176 - RNA, 64 nt, Human
ucucauggaguuggcuccgacagcccgucugccaccaggccaugguuccuugccccaugguguc

SEQ ID NO: 76177 - RNA, 64 nt, Human
uuccugccugguccaguggggaacaggucccacgccaggccagcaggcgggcuccuuuguacag

SEQ ID NO: 76178 - RNA, 64 nt, Human
cacccccuuugacucuggggugcagcuucacccaccaggccagcucaggaauucccuggaaaag

SEQ ID NO: 76179 - RNA, 64 nt, Human
uaugcagcccccgccagcugcccucgaaucccguccaggccaauuccagauucuaaacugauuu

SEQ ID NO: 76180 - RNA, 64 nt, Human
aggaaccugugcaagacacuggcucagcaguuccccaggccacaguaucagcaagauaaaagug

SEQ ID NO: 76181 - RNA, 64 nt, Human
gggccuggguccucuccccaggggcugccagcauccaggccaggaagccuggagccaagaaccu

SEQ ID NO: 76182 - RNA, 64 nt, Human
agaguggaagcgcccagcggccuuuccucgcucaccaggccagucucagggccucaccguauuu

SEQ ID NO: 76183 - RNA, 64 nt, Human
ggucuaggaucgaaauguuaacaccgggagcucuccaggccacucacccagcgacgcucguggg

SEQ ID NO: 76184 - RNA, 64 nt, Human
cgucuccguuggggccauuagaaugaggcagacaccaggccacucuagaagccgagccgucaca

SEQ ID NO: 76185 - RNA, 64 nt, Human
cugacggacccauggcagcugcucccagugcaucccaggccagcaggagcuuugugagcugcag

SEQ ID NO: 76186 - RNA, 64 nt, Human
cccaaauucccgcaggauucuaccaaacccuuccccaggccagcuuuuguacugaaggcaagaa

SEQ ID NO: 76187 - RNA, 64 nt, Human
cagaaugcuaauccuccaaguggacaagauguccccaggccaaaaagcccuguuuuccuuucug

SEQ ID NO: 76188 - RNA, 64 nt, Human
ugaggacgagcuugaaaucccagucuccuggcccccaggccagggucuguccaccauagaaugu

SEQ ID NO: 76189 - RNA, 64 nt, Human
ucuggagcuggucccgccauccuccuuugccuucccaggccagcugcucaggcucggcaggucu

SEQ ID NO: 76190 - RNA, 64 nt, Human
ugagcucacugugacccauccuuacucuacuuggccaggccacaguaaaacaagugaccuucag

SEQ ID NO: 76191 - RNA, 64 nt, Human
uccuggcgggugggacccgcagccuccacgcggcccaggccagccugccacccucugggccucc

SEQ ID NO: 76192 - RNA, 64 nt, Human
cccaccccccagugcagacuucggggucuccaccccaggccagcagcgcccacugggcuacagc

SEQ ID NO: 76193 - RNA, 64 nt, Human
gucuuuccacgccccugaguucagagucggggacccaggccaggucgggagcacagccgcuccc

SEQ ID NO: 76194 - RNA, 64 nt, Human
gugccugguguuuccugggcucgguacugggcccccaggccauccaggcuuugccacggccagu

SEQ ID NO: 76195 - RNA, 64 nt, Human
agcccagaucugaggccaagcuaugugcuagagcccaggccagcucugagaccaagcccagcau

SEQ ID NO: 76196 - RNA, 64 nt, Human
accauugucuuccaagauaggaagccaaguggguccaggccaggagauggggggggcgggggca

SEQ ID NO: 76197 - RNA, 64 nt, Human
ggacugggaaggaccgggugagugcaccggggacccaggccaggugccccccggagccugcugg

SEQ ID NO: 76198 - RNA, 64 nt, Human
cacuguuuucugucguguguguugggaugggaucccaggccagggaaagcccgugucaaugaau

SEQ ID NO: 76199 - RNA, 60 nt, Human
agaacuuugaugacgagugaugccaggaagccaggccaccgaagcccccacccuacccuu

SEQ ID NO: 76200 - RNA, 64 nt, Human
ccucccagccucugcccagggaccccugccuuccccaggccaucugcucugccgucgacacucg

SEQ ID NO: 76201 - RNA, 64 nt, Human
gguggcaucugccacgaaggaagcgccagccucgccaggccagcaggggcgucguuuuguugcc

SEQ ID NO: 76202 - RNA, 64 nt, Human
gcccucccugcugaauggaggagccgggggucccccaggccaacuggaaaaucucccaggcuag

SEQ ID NO: 76203 - RNA, 64 nt, Human
gugguuuaauggcagauaagcuccgucugcaguuccaggccagccagaaacuccuguguccaca

SEQ ID NO: 76204 - RNA, 64 nt, Human
uugcuggcugccccagcaggcacccaccucccugccaggccaagccagguguccucuugcagcu

SEQ ID NO: 76205 - RNA, 52 nt, Human
ccuaucugccccaguacugaccccaggccagccagccugccugccugccugc

SEQ ID NO: 76206 - RNA, 64 nt, Human
ugcccucuccuggacgaucgcgggucgcagaagcccaggccagcgagcccuacagagugaggac

SEQ ID NO: 76207 - RNA, 64 nt, Human
cuuugcucugaggucccuucaaggccuccccaauccaggccaaagccccaugugccuuguccag

SEQ ID NO: 76208 - RNA, 64 nt, Human
ccaguggggggugggaggguaaccucacucuucuccaggccaggccuccuuggacuccccuggg

SEQ ID NO: 76209 - RNA, 64 nt, Human
cucuguaaaucaucacuucagcuccugauuggucccaggccaagcugaauagcccuuaggaaua

SEQ ID NO: 76210 - RNA, 61 nt, Human
agcuggugccaacuuccugauggguccugggccaggccagccagggagaagacaaggcccc

SEQ ID NO: 76211 - RNA, 64 nt, Human
cgcgcccuccugaggcccugauggcagcucugcgccaggccacagcagccgcccgcugccgcug

SEQ ID NO: 76212 - RNA, 64 nt, Human
uuuuuugauuuuuuauuuggguagguuuugggguccaggccauuuuuuuuaccccuuggaggaa

SEQ ID NO: 76213 - RNA, 51 nt, Human
uggcugaccuucuugucugagccaggccaccaaagccaugccguaagcaua

SEQ ID NO: 76214 - RNA, 64 nt, Human
caggacaggggcaacugguuuggcaaccccacauccaggccaauaaagaugugugagcugggug

SEQ ID NO: 76215 - RNA, 64 nt, Human
gcagcacggacuuugaccgcacgcuggagagugcccaggccaaccuugccgggcuguuucccga

SEQ ID NO: 76216 - RNA, 64 nt, Human
aaggccagcucaaugccugguaucugcccccaguccaggccaggcggaggggaggggcuguccg

SEQ ID NO: 76217 - RNA, 64 nt, Human
uguggcugcuggaucagggcagccggggagguggccaggccaguggccaggcccuguggagaca

SEQ ID NO: 76218 - RNA, 64 nt, Human
acaccgcccucccuccguggggauagccgcagccccaggccaucaucugcugcuggggcccccc

SEQ ID NO: 76219 - RNA, 64 nt, Human
gugaaugagugaagauccuggaggacccugggccccaggccagcucccaucgcugggggacggu

SEQ ID NO: 76220 - RNA, 64 nt, Human
ugugcucgugggcuggugacugggucuugggaucccaggccacgcgccagccaggcugugggca

SEQ ID NO: 76221 - RNA, 64 nt, Human
ccggccaccguguccgaggcgcaacgcuaggccuccaggccacgcauccaucuccaaguuaaca

SEQ ID NO: 76222 - RNA, 64 nt, Human
ccucaccccucucccacccuccccagggguaaccccaggccaagcacagauagcucagcugcga

SEQ ID NO: 76223 - RNA, 64 nt, Human
uccugccugggcaucccuggugcuggggacugugccaggccaugcuugcugugacuccgccccu

SEQ ID NO: 76224 - RNA, 64 nt, Human
ccaucugucguggcugagcggggagcuugaacacccaggccagggacaccccuccccagcuccc

SEQ ID NO: 76225 - RNA, 64 nt, Human
uccccgggagccucagggcucugagagcugugcuccaggccagggguuacaccugcccuccgug

SEQ ID NO: 76226 - RNA, 64 nt, Human
aaugcaaaaucgaugaaauggggaguucucugggccaggccacauucacauuccccucccccug

SEQ ID NO: 76227 - RNA, 64 nt, Human
ggcggaacaccugaggucagguguucgagaccagccaggccaacauggugaaaccccgucucua

SEQ ID NO: 76228 - RNA, 64 nt, Human
uugggggacuacuuguuucccaccccagguuccuccaggccaagucauggggugaugaggaguu

SEQ ID NO: 76229 - RNA, 64 nt, Human
caagaaggaaagcaguuguugaagcuacagaagcccaggccagggcucccacuggcuguagcug

SEQ ID NO: 76230 - RNA, 64 nt, Human
cucugcccugcccgccccaggggcaccccgacauccaggccacccccucauggugcuacagacc

SEQ ID NO: 76231 - RNA, 64 nt, Human
ugagagauuccagcccaagccuggccccccaccgccaggccauagggcauaauuugcaucucaa

SEQ ID NO: 76232 - RNA, 64 nt, Human
gacuuggggcuuccacgucccuggggggcaggggccaggccaggggggagggggcucagccccu

SEQ ID NO: 76233 - RNA, 64 nt, Human
gcccccuucccucaacucuaggggcagcauagccccaggccacccuagcccagccccugcauug

SEQ ID NO: 76234 - RNA, 64 nt, Human
ucugagggcaccucauggaccaggggcugguggcccaggccagggagggaacccugggcagggc

SEQ ID NO: 76235 - RNA, 64 nt, Human
ggaacccuuuuucgacugccccaacucuuggacaccaggccaacuagaacacccaacaccaaac

SEQ ID NO: 76236 - RNA, 64 nt, Human
accaaauuaugguguagacagcccucccccaaccccaggccagucaggcacaauccccccaccc

SEQ ID NO: 76237 - RNA, 64 nt, Human
gguagggggagcaaaaccaucaaccaccaggcagccaggccaucagcccaccuccaccucugga

SEQ ID NO: 76238 - RNA, 64 nt, Human
cucuccacugcuuuccagacacuaaccaaggcuuccaggccagggauugcccaacacuccuagg

SEQ ID NO: 76239 - RNA, 64 nt, Human
auuuauuuauugagacggagucuugcucuguagcccaggccagagugcaguggcgcgaucucag

SEQ ID NO: 76240 - RNA, 64 nt, Human
auacuuuuuuugagacagggucugacucuguccuccaggccagaguccaguggugcaaucucag

SEQ ID NO: 76241 - RNA, 64 nt, Human
cugacagcauggcagucccuacccccaauuuuucccaggccaggcacugaguaggaguuaucuc

SEQ ID NO: 76242 - RNA, 64 nt, Human
gggccgugccuuugcccagacccugcacuuucaaccaggccaguccggcucuggggagcagggg

SEQ ID NO: 76243 - RNA, 64 nt, Human
ggacggacacugacagacaguacucccagcaggcccaggccagccagggcuucgucaggccugc

SEQ ID NO: 76244 - RNA, 64 nt, Human
gcaggauggcgcguacugaagccacgauguucauccaggccaaagcaggguguccugggauagg

SEQ ID NO: 76245 - RNA, 64 nt, Human
uccaggcuuuguuguguuuaagcuauugagagccccaggccacaccaggacuugcagugguggg

SEQ ID NO: 76246 - RNA, 64 nt, Human
cuuugauugaguucaucaugagccguugcuaaugccaggccaguaaaaguauaacagcaaauaa

SEQ ID NO: 76247 - RNA, 64 nt, Human
gaauugaaugcucuaagaggcuccuacaggcgcuccaggccacucucagagacucccaggaguu

SEQ ID NO: 76248 - RNA, 64 nt, Human
cuccuuccccaugagcccucccugucugcacugcccaggccagaggguagagcacagggguuuc

SEQ ID NO: 76249 - RNA, 64 nt, Human
ccagaaaaugccuggcgugagagccagcagacagccaggccaggguaggcagugccugcuucug

SEQ ID NO: 76250 - RNA, 64 nt, Human
aggagggagaugccuggggaggggcuccuggaauccaggccagcccaacagcccuggcugggga

SEQ ID NO: 76251 - RNA, 64 nt, Human
cagccucuucucugagcuccaugucccagauaaaccaggccagacugagaaggcuccccagagg

SEQ ID NO: 76252 - RNA, 59 nt, Human
cccgguggaaguccaucugacaaccccacccaggccagggucgaaucuggaaugggagg

SEQ ID NO: 76253 - RNA, 64 nt, Human
uaagagcugagacuagaauucaggguccucacucccaggccaccgaaccaugcagccccuucuu

SEQ ID NO: 76254 - RNA, 60 nt, Human
cacugucaccagugugguagcccuggcugcccaggccagugcugcagcucugcagaaugu

SEQ ID NO: 76255 - RNA, 64 nt, Human
caugcuuggagaguccucagcaggguagccgaggccaggccacuucugcugaggauggggcagg

SEQ ID NO: 76256 - RNA, 64 nt, Human
uguggcauugucaccuucacagcagacagagcugccaggccaugaugggcuggcgacagcccgg

SEQ ID NO: 76257 - RNA, 64 nt, Human
ccacacucuacugggccguggagguaacgaucacccaggccagucuccucugccugggaugcgc

SEQ ID NO: 76258 - RNA, 64 nt, Human
gaccccagccuccccuccucccucccauccucacccaggccaaggcccaggggcucugccagga

SEQ ID NO: 76259 - RNA, 64 nt, Human
gcugaggggguuggcugggucugagugccaccccccaggccacagugauaccaucccagugcca

SEQ ID NO: 76260 - RNA, 64 nt, Human
gcucaggaggguugggucccugggaggccggcagccaggccacagaauccacacguggaccauu

SEQ ID NO: 76261 - RNA, 64 nt, Human
cguggaccauugugggucccugggaggccggcagccaggccacggaauccacacguggaccauu

SEQ ID NO: 76262 - RNA, 64 nt, Human
uguuggguggugauggggauuguuaggauggagcccaggccacauggaugaugaugauucuccc

SEQ ID NO: 76263 - RNA, 64 nt, Human
cucaucuucaguaauacggaugccaugggaguggccaggccagauugaaggugaauauggagca

SEQ ID NO: 76264 - RNA, 64 nt, Human
uuuugguggcucucaacuggaauugguaguguuuccaggccaagggucgacugcagguuguuug

SEQ ID NO: 76265 - RNA, 59 nt, Human
ccaggugucaagaagccuaggggucugugccaggccagucacaccgaccaccacccacu

SEQ ID NO: 76266 - RNA, 59 nt, Human
ccaggugucaagaauccuagggaucugugccaggccauucgcaccagccaccacccacu

SEQ ID NO: 76267 - RNA, 64 nt, Human
aggcugggccugagcugggugccccgucgcccucccaggccacuaggcucugacucuuccagca

SEQ ID NO: 76268 - RNA, 64 nt, Human
gggcagugccugcucccagaaucuggugcucugaccaggccagguggggaggcuuuggcuggcu

SEQ ID NO: 76269 - RNA, 58 nt, Human
acaacccauacccugugugagggcacaaccaggccacgggaccuucuauccucuguau

SEQ ID NO: 76270 - RNA, 64 nt, Human
ggugcuggggacaagccugugccugccaaagcucccaggccaaguuugggggcugguguuuggg

SEQ ID NO: 76271 - RNA, 64 nt, Human
aggucaauggucauccugucuacccacccugccuccaggccagggggcuggggaggcaaauaga

SEQ ID NO: 76272 - RNA, 64 nt, Human
ucccuucagagccuggucacacaaggggcgagcaccaggccagccugggacuggccagagcugg

SEQ ID NO: 76273 - RNA, 64 nt, Human
cucguuuccagagguaauuaugagcgccuaccagccaggccacccagccgugggaggaaggggg

SEQ ID NO: 76274 - RNA, 54 nt, Human
gugcgcuggccuuggccuagguccccaggccagcccaugucaggggaacagccu

SEQ ID NO: 76275 - RNA, 64 nt, Human
uuggacucacaaggaagaccaggcugaggccccuccaggccaggguccuggggcaggcaucuca

SEQ ID NO: 76276 - RNA, 64 nt, Human
aguggucuggggcugaucuugccuugaggaagacccaggccauguucccaaaggccagcggggg

SEQ ID NO: 76277 - RNA, 64 nt, Human
cagggagcugcagcggagcccuccagcccucaccccaggccagccccaccccggccucuuugag

SEQ ID NO: 76278 - RNA, 64 nt, Human
ccagugaugcucggccuugcgcccguuccaccucccaggccacccuuccugggcuucugggcca

SEQ ID NO: 76279 - RNA, 64 nt, Human
guuacagggagagaacaauaucacagucauucauccaggccacguuuccucugcggaguguagc

SEQ ID NO: 76280 - RNA, 64 nt, Human
caccaccauggacaacaagccuuggguaaccggaccaggccaagggucuacaauucuccaacga

SEQ ID NO: 76281 - RNA, 64 nt, Human
gcugagccuuuuccuuccacgccgccucucacugccaggccagcggcuuccgcugagacucgcu

SEQ ID NO: 76282 - RNA, 64 nt, Human
gggccugggcgacguggauccuccuuaccacccaccaggccagauuuacaggagagagaaaucc

SEQ ID NO: 76283 - RNA, 64 nt, Human
cuaugaaaaaacaaaccaaaauaugcucuugcgcccaggccaguggugaguuagagguaugcua

SEQ ID NO: 76284 - RNA, 64 nt, Human
cacagagcccccucaccucccuggggaugaggggccaggccaugacccugaaagccuagcccug

SEQ ID NO: 76285 - RNA, 64 nt, Human
ccgccacaugugcccccgagggucccacgagcugccaggccaaggcugccugccgugcaccacc

SEQ ID NO: 76286 - RNA, 64 nt, Human
gcccacugccaucacccagcaccccagaucaccgccaggccagcccccaaugguccccuuacgg

SEQ ID NO: 76287 - RNA, 64 nt, Human
gcuaugcgcaugccuauggcagugggugcaccugccaggccaagggucagggugcccagagccu

SEQ ID NO: 76288 - RNA, 64 nt, Human
caagucccccauuggugggggcagagaaguaggaccaggccauccuuggcuccagagcucgaag

SEQ ID NO: 76289 - RNA, 64 nt, Human
auggcuuggaugcccucaggggugcugaccccugccaggccacgaauaucaggcuagagaccca

SEQ ID NO: 76290 - RNA, 64 nt, Human
uggcugacaauccuggaaaucuguucuccagaauccaggccaaaaaguucacagucaaaugggg

SEQ ID NO: 76291 - RNA, 64 nt, Human
cacagcccugaugggagcagcuuggcugugagcaccaggccaagacuccugagaacaggcagcc

SEQ ID NO: 76292 - RNA, 64 nt, Human
agaggcugagggugguggcggccccugaggcagaccaggccaggcuuccccuccuaccuggacu

SEQ ID NO: 76293 - RNA, 64 nt, Human
cugaggcuucugugcuccuggcuucuuacgccguccaggccaagguaggcucaaagaagaaaaa

SEQ ID NO: 76294 - RNA, 64 nt, Human
aagccgauucuuuggaaguucagcagaugaaagcccaggccagggaggagaaggcuagaaagca

SEQ ID NO: 76295 - RNA, 64 nt, Human
uggcaugcagcgaagcagcccagcccggcggaucccaggccagcacgccugccggcuucucauc

SEQ ID NO: 76296 - RNA, 64 nt, Human
cacagccccacacugucagugccaagaggcugcgccaggccacucucucagcccagggccugcc

SEQ ID NO: 76297 - RNA, 64 nt, Human
guaugagaacaaguaguuccuuggaggcccccauccaggccagaaggaccagguccacccagca

SEQ ID NO: 76298 - RNA, 64 nt, Human
guugaccagauguuccugagucuggagcaagcacccaggccagaauaacagagcuuucuuaguu

SEQ ID NO: 76299 - RNA, 64 nt, Human
agguuaucuguuggccugaagagugaaaccuguaccaggccaaaggugagggcgugagugaggg

SEQ ID NO: 76300 - RNA, 64 nt, Human
cuacugcugcucuccacucaacuggccucugcugccaggccacugccugucucugcuuccgacu

SEQ ID NO: 76301 - RNA, 64 nt, Human
agaagugccaagucacuggccguuaacucagcacccaggccaagcccccgccucccacuugaag

SEQ ID NO: 76302 - RNA, 64 nt, Human
cacacccuuagccuccagcaccccccgcccccgcccaggccaucaccacagcugcagccaaccc

SEQ ID NO: 76303 - RNA, 64 nt, Human
ccugggcgccuccgacuggcuggagcugcccccuccaggccaguuugaagacuacaugaacacg

SEQ ID NO: 76304 - RNA, 64 nt, Human
ccaagccagccgggcggccgacccguggggcaggccaggccagguccucccugauggacgccug

SEQ ID NO: 76305 - RNA, 64 nt, Human
uuccucacagcuggcuuguaaggcaggagcuggcccaggccacagcaccugcuggggugggaaa

SEQ ID NO: 76306 - RNA, 64 nt, Human
gucucacguugucuuugaccagugguccccaguaccaggccagcgaagacaacuuuauaauguc

SEQ ID NO: 76307 - RNA, 64 nt, Human
aucuuccuccucgcaggagggaccaggcggggcuccaggccacucagugggcucccugguccug

SEQ ID NO: 76308 - RNA, 64 nt, Human
ccaguggcuagagguggggugggaagagaggaggccaggccaggcccucaggaauucccugguu

SEQ ID NO: 76309 - RNA, 64 nt, Human
cugauccggggguccagggaauggagcucaggucccaggccagccccgaagucgccacguggcc

SEQ ID NO: 76310 - RNA, 64 nt, Human
ccuucaggcagugcuccaggaauccuggggggucccaggccaccucugcuuccaccuucacuau

SEQ ID NO: 76311 - RNA, 64 nt, Human
ccggccccagcugaccucguccauucagccccugccaggccaagcccagccacugcccucccgg

SEQ ID NO: 76312 - RNA, 64 nt, Human
ccaaguaggcaacuguuauggcaguggguccagcccaggccagcacugccagccuccucucccu

SEQ ID NO: 76313 - RNA, 64 nt, Human
ggcccagaguguuccccaugcuccaccugguggcccaggccacagcugcugcuuguauuucggu

SEQ ID NO: 76314 - RNA, 64 nt, Human
acgaaacuucagagcccaggcagucccugaaugaccaggccaguguugucacugaguggucccc

SEQ ID NO: 76315 - RNA, 64 nt, Human
ccccaaaacccacuaacaauuuuagcaaaacaguccaggccaaagaggaagcauuucauguuca

SEQ ID NO: 76316 - RNA, 64 nt, Human
cugaaggucuuggccaagaaauguagaccuuuccccaggccagggugauuguucauuugacaug

SEQ ID NO: 76317 - RNA, 64 nt, Human
gacaaaaaagacgagaaaaugaauaaauaaaaaaccaggccaggcgugguggcucacgccugua

SEQ ID NO: 76318 - RNA, 64 nt, Human
uccuguguagccuuuggccacgcacugacacugcccaggccaagcaaaagcagagugugguuaa

SEQ ID NO: 76319 - RNA, 64 nt, Human
ggaagggccaaggucugagcacuggaguggcucgccaggccaaaucacccuuagaaggcugcag

SEQ ID NO: 76320 - RNA, 64 nt, Human
caguuuucaugacaggucuauauuucuaccugggccaggccaggaaagagacuauuuaagaaaa

SEQ ID NO: 76321 - RNA, 64 nt, Human
auuccuuauguguagugucccuggcaggcauuuaccaggccaugugcuuuaacguuacgguaau

SEQ ID NO: 76322 - RNA, 64 nt, Human
ucaaugaauacaugacaagacagaacguuccuugccaggccaggcaaaagccaaggcccauuag

SEQ ID NO: 76323 - RNA, 64 nt, Human
acauggaugcuuugaaagauauggaagacagagcccaggccauaauugacaccacagaugaugc

SEQ ID NO: 76324 - RNA, 64 nt, Human
cuguggacuuugagcugaacaugcccacuggcccccaggccacaugggaccuggaggagccuac

SEQ ID NO: 76325 - RNA, 64 nt, Human
cacagguauuucaggugugaaagaaucaguaggaccaggccaccgcuagugcuuguggagauca

SEQ ID NO: 76326 - RNA, 64 nt, Human
cucuccucccuucucuccccaguucugguccuggccaggccaugcuacacuaaccccugccccc

SEQ ID NO: 76327 - RNA, 64 nt, Human
cauagaaaguaaauaaaaggacugugauuugaauccaggccacucuuagcccaugcuguuuucc

SEQ ID NO: 76328 - RNA, 64 nt, Human
ugaaguggcaaaggccauggccauaucuguugucccaggccaaagacuaacaacugccuuggga

SEQ ID NO: 76329 - RNA, 64 nt, Human
ggcauauggcucacagugaugaugccagucagagccaggccagauggaaauuguuuucugaugu

SEQ ID NO: 76330 - RNA, 64 nt, Human
accugcgagcuggccuaaugugguggccugcaagccaggccaucccugggcgccacagacgagc

SEQ ID NO: 76331 - RNA, 64 nt, Human
uucuacaauaguucaggucagacaucuaagauccccaggccaaaccaugccacacacgugucug

SEQ ID NO: 76332 - RNA, 64 nt, Human
uucugccucccucugcguugguaucugcuacaucccaggccaccaccuccgaggaugaaaagau

SEQ ID NO: 76333 - RNA, 64 nt, Human
ugcugugaccaagggacugaauugcugacaugggccaggccaggcacuguuuuguggcccaugc

SEQ ID NO: 76334 - RNA, 64 nt, Human
cuuguguuagaguauauucugaaaccaacuugucccaggccacaggaguguauauguuucauaa

SEQ ID NO: 76335 - RNA, 64 nt, Human
cugagaugagaggaucacuugagccugaggagguccaggccacagugaucugagaucacaccau

SEQ ID NO: 76336 - RNA, 64 nt, Human
agcaagcuguaguuuuuaaaaauguuuuuaguuaaacguugaggagaaaaaaaaaaaaggcuuu

SEQ ID NO: 76337 - RNA, 64 nt, Human
aguaaguuacccacauugaccaaaaugcagcuucaacguugaguaaagggauuucugagagcug

SEQ ID NO: 76338 - RNA, 64 nt, Human
auaggggggcuugauucaacaaagccacagacuuaacguugaaauuuucuucaggaauuuucua

SEQ ID NO: 76339 - RNA, 64 nt, Human
ucccuuucugccuuuccccucucacuucuuccccaacguugagacccugcuuguccaauauuau

SEQ ID NO: 76340 - RNA, 64 nt, Human
caagucucuuuacuccuacagcagcugugucuccaacguugagacuuugcagauggcacagacu

SEQ ID NO: 76341 - RNA, 64 nt, Human
cugauuugacuagaaacaucaaggaagaaugaagaacguugacuuuuuuccaggauaaauuauc

SEQ ID NO: 76342 - RNA, 64 nt, Human
ucccuauccaggucacuccagaaaaggguauugaaacguugaaaucuaaagcaaauuugcaauu

SEQ ID NO: 76343 - RNA, 64 nt, Human
auaagaaauuuucuagaaucauguuugaauucuaaacguugauauucuuaaguaccauuucuga

SEQ ID NO: 76344 - RNA, 64 nt, Human
gaaaagggaaagacaaaguagugggagcugaucaaacguugaguuccuuggguuggggaaccug

SEQ ID NO: 76345 - RNA, 64 nt, Human
uuaaauauuuaaagucuccaaaauaaaacaccccaacguugaccuuacccggcugaugguuagc

SEQ ID NO: 76346 - RNA, 64 nt, Human
caacaaagacagacuuuccguagcagcuuagauuaacguugauuucauuccaugcacuuagagu

SEQ ID NO: 76347 - RNA, 64 nt, Human
gugggcaagugauggcccgguuuggggcugcgaaaacguugaccccuuucccccaccccagagu

SEQ ID NO: 76348 - RNA, 64 nt, Human
auuaucacccauauaaaagagggacauggacuauaacguugauuucuuauugcuguacauugcg

SEQ ID NO: 76349 - RNA, 64 nt, Human
cugucuaguucccuucugugucuaaauuuuccaaaacguugauuugcauaauacagugguaugu

SEQ ID NO: 76350 - RNA, 64 nt, Human
agaauaaucgcugcaguuuuguuuuuaugugugaaacguugagaacaaucuaaauguuuaucag

SEQ ID NO: 76351 - RNA, 64 nt, Human
gcacagagaagcucugauagcacagaucagcaccaacguugaacagcuaaugaguaugugcuca

SEQ ID NO: 76352 - RNA, 64 nt, Human
ccaggaagagggccugagguucuccuagugcaggaacguugaauauuggcaaugauuccugguu

SEQ ID NO: 76353 - RNA, 64 nt, Human
uucauaacaacaucucaaaaauuuggggaaacacaacguugaaaacuuccuaagaaaaggaauc

SEQ ID NO: 76354 - RNA, 64 nt, Human
ugaacccaggaggucaagugggcuauuaaaaucuaacguugaguaaaugugauagugaugagaa

SEQ ID NO: 76355 - RNA, 64 nt, Human
ugaucagcaaugaagaacuggucggacaaaauuuaacguugauguaaugaaauuccagauguag

SEQ ID NO: 76356 - RNA, 64 nt, Human
gggcaguggugggugucugaaaccucagaaacauaacguugaacuuuuaagggucucagucccc

SEQ ID NO: 76357 - RNA, 64 nt, Human
caaguacaaggccgaccacaauggaugcugcaaaaacguugacuggggcaaaggauuuuuuauu

SEQ ID NO: 76358 - RNA, 64 nt, Human
uauggggcugggaguaguugucuuuccuggcacuaacguugagccccuggaggcacugaagugc

SEQ ID NO: 76359 - RNA, 64 nt, Human
aggcaguuucuaaacaacacuuagacuggggucuaacguugacaaauccuucuagaauuugccu

SEQ ID NO: 76360 - RNA, 64 nt, Human
cacauagggugaaaguacccuuacucucuugaaaaacguugaguuaacacaguuggagguaaua

SEQ ID NO: 76361 - RNA, 64 nt, Human
uuggauugcgacugguuuuauacggccugccuauaacguugaaaauccauguacuacauaauaa

SEQ ID NO: 76362 - RNA, 64 nt, Human
aaucuuauuuuaaaauuuggccuuuuucaacacuaacguugaguaccgguagcuugugaucaaa

SEQ ID NO: 76363 - RNA, 64 nt, Human
gcuugauguagauuuuacucuauguacagaauuuaacguugaauauauuaaaauaacaaaucug

SEQ ID NO: 76364 - RNA, 61 nt, Human
ugucuaaaucagaugacugaaaucugccuaaaacguugaaggagaaucaauucuucaacuc

SEQ ID NO: 76365 - RNA, 64 nt, Human
ucugucagauaaugccuaagaaugaccgcugaagaacguugacccauuugaguacccggucuca

SEQ ID NO: 76366 - RNA, 64 nt, Human
ugcaauggauguagaaaauaaaauucaagaaaagaacguugaaccaaauauuagcuuugauggc

SEQ ID NO: 76367 - RNA, 64 nt, Human
gaaaacaaauuauucauucauaugaugcuuucuuaacguugaaauugcacauucacauuggacu

SEQ ID NO: 76368 - RNA, 64 nt, Human
aagcuuugaagaccuaccuguucuuccagaagagaacguugaaagugccauguuuccuuuugcg

SEQ ID NO: 76369 - RNA, 64 nt, Human
ccaguuagaggcuuucaaagcugugaaaaaucaaaacguugaucacuuuagcagguugcagcuu

SEQ ID NO: 76370 - RNA, 64 nt, Human
auuugguguuuuggaggagaucacacacuaagagaacguugauugccucggcuauugugcuggc

SEQ ID NO: 76371 - RNA, 64 nt, Human
ggaacacaccacuuuuuacuguugaaaccaacacaacguugaaauccaggcuuauacgcagacu

SEQ ID NO: 76372 - RNA, 64 nt, Human
uuccuguuuuaauaauuuuaaaaugagcacaaagaacguugaaguucagauuaaucucuucuga

SEQ ID NO: 76373 - RNA, 64 nt, Human
aaaacuuuucuccauuuuaaaaagcccuguuauaaacguugaacuuucacaauguuaaaauguu

SEQ ID NO: 76374 - RNA, 64 nt, Human
aauguugcauuuaugaugcaguuucaaguaccaaaacguugaauugaugaugcaguuuucauau

SEQ ID NO: 76375 - RNA, 64 nt, Human
aacauucacauugcccugccucugucccccuuuaaacguugacccauuuuaaagacaaacauga

SEQ ID NO: 76376 - RNA, 64 nt, Human
cagauaaucuuauucugaugaagcgagaacuaugaacguugaaacaaggacaauuuguguugga

SEQ ID NO: 76377 - RNA, 64 nt, Human
uuauuaaaaauccuuauuuucuccaagcccagcaaacguugacuucugggcaaaccugaaaacc

SEQ ID NO: 76378 - RNA, 64 nt, Human
uuuauacugcagguagguauuuccagugaauggaaacguugaaauuuauagaugggacaaugca

SEQ ID NO: 76379 - RNA, 64 nt, Human
accuagaaggcaggggucaaucuaacaaaacccuaacguugacuuuuuucccugguggggcuuc

SEQ ID NO: 76380 - RNA, 64 nt, Human
ccaagauaugcaaaagaugcauucaguaagcuguaacguugagaaauguaacugugaaaucagc

SEQ ID NO: 76381 - RNA, 64 nt, Human
auguaacugaaguuccccugucuucaagcacuaaaacguugaucuuaaccuuuuuuuugaagug

SEQ ID NO: 76382 - RNA, 64 nt, Human
uguuaacuauuagagcuccauucuuuugguucaaaacguugauacuuacuuagauguucccuga

SEQ ID NO: 76383 - RNA, 64 nt, Human
ccaucaucucaucucuggaugcuguggugcccagaacguugaucuaacaccaucuugaagcaca

SEQ ID NO: 76384 - RNA, 64 nt, Human
ucacaaugaaaagacgauucugcuguauuuguuaaacguugacauuugguucuagggccuugag

SEQ ID NO: 76385 - RNA, 64 nt, Human
cuucuuacuggugcuauuuuguagaauaaggaacaacguugacaaguuuuguggggcuuuuuau

SEQ ID NO: 76386 - RNA, 64 nt, Human
aacucuggagugucuguaguucuugugaaaccaaaacguugacuaccugccucuuuccucgggc

SEQ ID NO: 76387 - RNA, 64 nt, Human
uaccuaggguacaguccuugacagaauugacuauaacguugaacaguccuguaucaaaacugaa

SEQ ID NO: 76388 - RNA, 64 nt, Human
uagaugcaauaagcccacguauuuuuacacuggaaacguugauuguuuuaaaugacaaagacau

SEQ ID NO: 76389 - RNA, 64 nt, Human
caguucgaaucugguaaacauagaccaaaauggaaacguugaauacauguccagcuuccagaau

SEQ ID NO: 76390 - RNA, 51 nt, Human
uagaagaccguacucaguaacaggccggaaaauugugcucuagaagaauaa

SEQ ID NO: 76391 - RNA, 64 nt, Human
gcuugacacagucagcaugcuucccagagggagcaggccggaaccacagggccagagggagcug

SEQ ID NO: 76392 - RNA, 64 nt, Human
gaauaggucaccaggaggagcccuucauccuggcaggccggauuguggagggacuucccucccc

SEQ ID NO: 76393 - RNA, 64 nt, Human
ccucucggugcagcccagccgggcccccuuccccaggccggagcgccccucuuccuuccagcuu

SEQ ID NO: 76394 - RNA, 64 nt, Human
cuugcccuggccagaacugcugucgaagaaaaucaggccggaaggccaagaaggcgcuaagggg

SEQ ID NO: 76395 - RNA, 64 nt, Human
cccugcaugguuacaauggcucaggugucaggggaggccggaggguuuuccagcauuugccuca

SEQ ID NO: 76396 - RNA, 64 nt, Human
cacucaacgacuucaucuguggcagggagagaggaggccggaagaacaaccccugaacaaugga

SEQ ID NO: 76397 - RNA, 64 nt, Human
ugguuugaccucuucagcccguccgguggccuggaggccggaggcucuccugagugucugcccc

SEQ ID NO: 76398 - RNA, 64 nt, Human
acgacuggccgaaaagccgcauucccugccucacaggccggaagucccagcccaguccccgcgc

SEQ ID NO: 76399 - RNA, 64 nt, Human
cauccucagauucaccgcgugcucugcgcggccgaggccggagcaccacauccaccucgcccca

SEQ ID NO: 76400 - RNA, 64 nt, Human
caguacauaaaggaauauguguagcuggguucccaggccggacaaaacagauggugaccagauu

SEQ ID NO: 76401 - RNA, 64 nt, Human
auagauuuuuauuuaaauuacagaaacauguuaaaggccggacaaaggaaagacaauaaaauca

SEQ ID NO: 76402 - RNA, 64 nt, Human
uaauuuuaggaauguaacuccauuggggcuuuccaggccggaugccauaguggaacauccagaa

SEQ ID NO: 76403 - RNA, 64 nt, Human
uuugauauugcugugagccuugcaugacaucaugaggccggaugaaacuucucaguccagcagu

SEQ ID NO: 76404 - RNA, 64 nt, Human
ggcauggaagagacagucuacagagagcuuuaagaggccggagaaaggaaaagacauuaucagg

SEQ ID NO: 76405 - RNA, 64 nt, Human
augcgucgguggcugggcugcccugcuccuggucaggccggagcccguccuaagacacacgcuu

SEQ ID NO: 76406 - RNA, 64 nt, Human
ccguagagaaugauagagcagcugcucacacaggaggccggauauucugagaagcagcuuuaug

SEQ ID NO: 76407 - RNA, 64 nt, Human
uuuauuuuuuggacagagucucccuuugucacccaggccggagugcaguggcaugaucaugguu

SEQ ID NO: 76408 - RNA, 64 nt, Human
uuauagguaccuuggaggggccaggggcugaggaaggccggacccagguuccaggggcgcaggc

SEQ ID NO: 76409 - RNA, 64 nt, Human
uguuccauauucacuuauuggcgauuuggggaaaaggccggaacaagagauuguuacgagagug

SEQ ID NO: 76410 - RNA, 64 nt, Human
aggguuuugccccaaguccucauuuaaaagcauaaggccggacgcaucucaaaacagagggcug

SEQ ID NO: 76411 - RNA, 64 nt, Human
cucgcaccuguauucccagccacuggggaggcugaggccggaggagugcuugagcccaggaguu

SEQ ID NO: 76412 - RNA, 64 nt, Human
gucacgaccucuccagccagggagucuggucucaaggccggauggggaggaagauguuuuguaa

SEQ ID NO: 76413 - RNA, 64 nt, Human
cuuugcugccugagaggaaccagagcagacgcacaggccggaaaaggcgcaucuaacgcguauc

SEQ ID NO: 76414 - RNA, 64 nt, Human
ccggcagugugagcccaaguccgggcuggagccgaggccggagcagcugucugggagucaaggc

SEQ ID NO: 76415 - RNA, 64 nt, Human
acuaaagauccaagaaggccuucauggccccagcaggccggaucgguacuguaucaagucaugg

SEQ ID NO: 76416 - RNA, 64 nt, Human
uaauggggcucuuuuagcccacugaugcuuacuuaggccggagagcaggggacacggugcuagg

SEQ ID NO: 76417 - RNA, 64 nt, Human
gcguggaauucaggccgaggcgagccggcagagcaggccggacgcagcagcccucuggcuccag

SEQ ID NO: 76418 - RNA, 64 nt, Human
agggggccaacuguagcucaggagccucguucucaggccggacgcugugucaccccucauucug

SEQ ID NO: 76419 - RNA, 64 nt, Human
gugaugcucgggucugcccccgacccccugccacaggccggaagccgcagggggcaccgugggg

SEQ ID NO: 76420 - RNA, 64 nt, Human
cuugguuugcaaaacccauauccccgguaaaaugaggccggacagaggggcuguuaggacagca

SEQ ID NO: 76421 - RNA, 64 nt, Human
gcugucuuccguagguggaggcugcauggcuggaaggccggauccggcaggaguuugauaagcu

SEQ ID NO: 76422 - RNA, 64 nt, Human
agcacgccugccaucuucuccccgaggcugccccaggccggagcccagauacgggggcugugac

SEQ ID NO: 76423 - RNA, 64 nt, Human
augaggacaugcagagcaccugcagaggagcaggaggccggagcugagccugcagaccccgguu

SEQ ID NO: 76424 - RNA, 64 nt, Human
ccggagacuuuccccucgacccaguggagccgucaggccggagccucagagccuugacacccaa

SEQ ID NO: 76425 - RNA, 64 nt, Human
cccuccccgcccccugaaacaugugccccugccaaggccggagacccacagcccugaaacgaga

SEQ ID NO: 76426 - RNA, 64 nt, Human
ucguugccauacccucuugccuuacucgcgguggaggccggauuugcacgggcagacgugcacc

SEQ ID NO: 76427 - RNA, 64 nt, Human
guggaccccuaugcccgggucagcgucuccacccaggccggacacagacaugagacaaaagugc

SEQ ID NO: 76428 - RNA, 64 nt, Human
gcugaguuccugcuuucugaccuggaggcugagcaggccggaguggauggaugcuguccagacg

SEQ ID NO: 76429 - RNA, 64 nt, Human
cucugucuccucccugcugugcuuccugaggagcaggccggauguaaguuaucaacuauaaaua

SEQ ID NO: 76430 - RNA, 64 nt, Human
acuuaugaaacuucuuauaagagagaguaaucucaggccggacaugcuggcucauaccuguaau

SEQ ID NO: 76431 - RNA, 64 nt, Human
cagggaggccuuuccgcggugggauguugagcugaggccggaggagaaguagcagucgcuggca

SEQ ID NO: 76432 - RNA, 64 nt, Human
uccuggagccuuugaauaaaaaugcacguagcugaggccggaugcgguggcucacgccuguaau

SEQ ID NO: 76433 - RNA, 64 nt, Human
gcacauaccuguaauccaagcugcccaggagcugaggccggagaaucgcuugaaccugggaggu

SEQ ID NO: 76434 - RNA, 64 nt, Human
gucuuuaacaaagugauuaagagcuuggucuguaaggccggaugaucuggauuucaguaggcac

SEQ ID NO: 76435 - RNA, 64 nt, Human
cagacugcugggguugcugggugagcagagugggaggccggagacugcccuugaccggcaaaug

SEQ ID NO: 76436 - RNA, 64 nt, Human
uguauggaaugcgcuuauuuuuugaaaggauauuaggccggaugugguggcucacgccuguaau

SEQ ID NO: 76437 - RNA, 64 nt, Human
cagccccacccucugcccuucagccuacugggccaggccggaccugcccccucagugucucucc

SEQ ID NO: 76438 - RNA, 64 nt, Human
aaggggugcugugaggcuugcccaggagcaagugaggccggagaggaguucaggaacccuucuc

SEQ ID NO: 76439 - RNA, 64 nt, Human
acgucccuaagcugagcuaggaggcaccacgcacaggccggaggcaccacgcacaggccagagu

SEQ ID NO: 76440 - RNA, 64 nt, Human
aagagccucccaugccaguaccgcccagccuuggaggccggaaugcucauggccccuguggucu

SEQ ID NO: 76441 - RNA, 64 nt, Human
uguccgcuggcuauguggacgcuggggcagagccaggccggagucgaaugaucagccaggaaga

SEQ ID NO: 76442 - RNA, 64 nt, Human
uuacagcgggaaugggcgggccaacauggucuggaggccggacacaggugggggccaagagccu

SEQ ID NO: 76443 - RNA, 64 nt, Human
cugccccuuaagugucggugaauagugaggcuggaggccggaaucucagccagccuccagcacc

SEQ ID NO: 76444 - RNA, 64 nt, Human
ggugcgcggguggggggagggcugggcggaccaaaggccggagggguggggccuggggauagcg

SEQ ID NO: 76445 - RNA, 64 nt, Human
gcugcacuguaggagccccuuucugggcuggccaaggccggagccagcucccucagcuugcggg

SEQ ID NO: 76446 - RNA, 64 nt, Human
agggaagguguugcauccccaggggcugccgcagaggccggagaccuccuggacuaguucggcg

SEQ ID NO: 76447 - RNA, 64 nt, Human
agcgcaccgcacugucugccccaaugucuaacaaaggccggaggcgacucuuccugcgaggucu

SEQ ID NO: 76448 - RNA, 64 nt, Human
ggccgggaggcuggucuggcuuagcugggccgagaggccggagggccgaguuagagcggccggc

SEQ ID NO: 76449 - RNA, 64 nt, Human
gccgcccaugcaaagaguagggucagccauggcaaggccggaaguugaacuuucagucccugcc

SEQ ID NO: 76450 - RNA, 64 nt, Human
guguugguugaggaaaaccucgggccugagggccaggccggagcccaggucucugcugacaaug

SEQ ID NO: 76451 - RNA, 64 nt, Human
cucgugcccugcuggggaaggccucacccagcgaaggccggagaagcgguugggcccuggcaca

SEQ ID NO: 76452 - RNA, 64 nt, Human
gccuuucugagagcgggcuaggccggcacuggagaggccggagccuuuggaacaaaccgugcgg

SEQ ID NO: 76453 - RNA, 64 nt, Human
uccccggaucggauuccuuucccuucgaucccgcaggccggaggcgcagaccuguggugaggac

SEQ ID NO: 76454 - RNA, 64 nt, Human
ugcaugccuguaaucccagcuacucaggaggcugaggccggagaaucgcuugagcccgagaggu

SEQ ID NO: 76455 - RNA, 61 nt, Human
acggugagaccaccgugugagggacgcccccaggccggaaccgcgcggcgcuuuccuccgc

SEQ ID NO: 76456 - RNA, 64 nt, Human
agcccuggcugcuuguccuccucgcaacccccccaggccggagcuuccuuccuuagccgggaag

SEQ ID NO: 76457 - RNA, 64 nt, Human
ggagcagguggucggaggccccuggcuuugugcaaggccggaucugggccagguggcgaaaggg

SEQ ID NO: 76458 - RNA, 64 nt, Human
cuggggaugcucagggugcaggcagaggcucgggaggccggacucaggggucagaagcagggac

SEQ ID NO: 76459 - RNA, 64 nt, Human
guccaccaugauuucuccauauaauuuugaucauaggccggagugagucauuccaccugcaccu

SEQ ID NO: 76460 - RNA, 64 nt, Human
aagcugcucagagaggguguccagcacaguggagaggccggaagugagacgggcagacggcacc

SEQ ID NO: 76461 - RNA, 64 nt, Human
aaaggaaaauuuuggaagucaagaaaguccauuuaggccggacgcgguggcuuacgcuuguaau

SEQ ID NO: 76462 - RNA, 64 nt, Human
gccccggaaccgcggcgacuggaggcuggauucgaggccggaaacgccgggaccccuggacccg

SEQ ID NO: 76463 - RNA, 64 nt, Human
cugggcggccugcgcagaugggccacagaagggcaggccggagcugcacacucuccccacgaag

SEQ ID NO: 76464 - RNA, 64 nt, Human
gagucuguccccagacauugcaccuggcgcuguuaggccggaauuaaaguggcuuuuugagguu

SEQ ID NO: 76465 - RNA, 64 nt, Human
guuuuguccugccucuuguuucugugccccggcgaggccggagagcuggugacuuuggggacag

SEQ ID NO: 76466 - RNA, 51 nt, Human
ucggcggugaagagcugugacaggccggacggggaggcccagcagggagag

SEQ ID NO: 76467 - RNA, 64 nt, Human
uucuuuaaaaaaaaaaaauuccaacagaagccacaggccggagccccugggagcccucgcaccg

SEQ ID NO: 76468 - RNA, 64 nt, Human
uauuuauuuugagauagagccuugcucugucaccaggccggagugcaguggugucaucucagau

SEQ ID NO: 76469 - RNA, 64 nt, Human
accccagucucagcagccuccugauuucauaaccaggccggaccacgugcaauaggguggaaac

SEQ ID NO: 76470 - RNA, 64 nt, Human
cucaugccuguaaucccaacacuuugggaggcugaggccggaggauugcuugagcccaggaguu

SEQ ID NO: 76471 - RNA, 64 nt, Human
gagggucacccgucggccgccgccaccccaggcgaggccggaggaaggaucaucugagacgcag

SEQ ID NO: 76472 - RNA, 64 nt, Human
cacccaggaugugucuaguccgaaugaagcaggaaggccggagugggaaguacaugugucguau

SEQ ID NO: 76473 - RNA, 64 nt, Human
cccuggaggcugcaacauaccucaauccugucccaggccggauccuccugaagcccuuuucgca

SEQ ID NO: 76474 - RNA, 64 nt, Human
auccugagcuucggucuguccagccgacccgaggaggccggacucagacacauaggcggggggc

SEQ ID NO: 76475 - RNA, 64 nt, Human
gcucuguacugggugugugaagccccagcagagaaggccggagggagggcuugggugccugggc

SEQ ID NO: 76476 - RNA, 64 nt, Human
gcugaagucuggccccaccaugaguccuguguccaggccggacauggcugggggaccaacuacu

SEQ ID NO: 76477 - RNA, 64 nt, Human
aaaauuaacugaaaagcaguuuagagacugggggaggccggaucucuagagccauccugcugag

SEQ ID NO: 76478 - RNA, 64 nt, Human
ccgccuugcacugcgccugccccacgguguccccgccgggaagcagccccggcuccugaaucac

SEQ ID NO: 76479 - RNA, 64 nt, Human
agaaccucaggcuuccuuggcaucacagggcagagccgggaagcgaugaauuuggagacucugu

SEQ ID NO: 76480 - RNA, 64 nt, Human
ugccuggguggccauccuacccagcguggcccaggccgggaagagccaccuggcagggcucaca

SEQ ID NO: 76481 - RNA, 64 nt, Human
gccucuguuccugaauuacauaagaauguaccaugccgggaagccagagaccugcaggggccuc

SEQ ID NO: 76482 - RNA, 64 nt, Human
uaaaacaacaacgcccccucccuuccagcccugagccgggaaccaucucccaggaccuugcccu

SEQ ID NO: 76483 - RNA, 64 nt, Human
cccccaaggugugugggugcuggcugagcuuugggccgggaaggcagccugggaaucugaggcu

SEQ ID NO: 76484 - RNA, 64 nt, Human
acacaccugagucuccacggcagugaggaagccagccgggaagagagguugagucacccauccc

SEQ ID NO: 76485 - RNA, 64 nt, Human
augaucacaguucuguguucuggccuguggcagggccgggaagggccgcuggcuuccgaacaga

SEQ ID NO: 76486 - RNA, 64 nt, Human
guucacauuugauaaguauaugccaaaaaaugaagccgggaaggaggacaaggcccaugggugg

SEQ ID NO: 76487 - RNA, 64 nt, Human
guuugcggagggaggggggagggggguaggcugggccgggaacuguccgaggugcugagcuggg

SEQ ID NO: 76488 - RNA, 64 nt, Human
gaaggcauaucagucucugagggcuuccuuuggggccgggaacuugcggguuugaggauaggag

SEQ ID NO: 76489 - RNA, 64 nt, Human
guuuuaugggccaccuuucccgcugcgggaccaagccgggaaugagcuugugugcccugauacc

SEQ ID NO: 76490 - RNA, 64 nt, Human
cagcgcaacgcacuggugaccagacuguccccacgccgggaaccaagcaggagacgacaggcga

SEQ ID NO: 76491 - RNA, 64 nt, Human
guaugcaccccaaagacuaauggggagagggagggccgggaagccaggaaagcuugguguuuuc

SEQ ID NO: 76492 - RNA, 64 nt, Human
uuucucaaguuuaaagucaugucagagguuuggagccgggaaagcuguuuuuccguggauuugg

SEQ ID NO: 76493 - RNA, 64 nt, Human
gugggccugagaccaaggcccccgggccgacggagccgggaaagaagagccggagccuccagcu

SEQ ID NO: 76494 - RNA, 64 nt, Human
aagauguuccaugucaucagagaugguaaaauaggccgggaaaaaaaaaucuuugguaccaaag

SEQ ID NO: 76495 - RNA, 64 nt, Human
ggugaugcccuucuguaagugcccaccgcgggaugccgggaaggggcauuauuugugcacugag

SEQ ID NO: 76496 - RNA, 64 nt, Human
uggaagauuaugcagaagaaaauagaagagcuuugccgggaaguaaagcuuuggaggaaaauca

SEQ ID NO: 76497 - RNA, 64 nt, Human
agcgacaggaggccagcuccugggguuccugggagccgggaacagauuggcuacggaacgcccc

SEQ ID NO: 76498 - RNA, 64 nt, Human
caagccaguguccuucgaggaacccacccggcuggccgggaaguuuuacagcaaggcgccugcc

SEQ ID NO: 76499 - RNA, 64 nt, Human
uccgacuaaggacucugggcuggcagggccuucugccgggaaagcuagaaacacuagguucuuc

SEQ ID NO: 76500 - RNA, 64 nt, Human
gcuuccugcagaggaagcaggacuggguagcagagccgggaagguggguggcccauuacagggg

SEQ ID NO: 76501 - RNA, 64 nt, Human
cuuagugugggucggcccgcagauggcacccaaggccgggaagggcaguaacugcacacgcggc

SEQ ID NO: 76502 - RNA, 64 nt, Human
aaaaggagguuucucuagaagagucugaugaaaggccgggaaccaagguuuuugagaagucugc

SEQ ID NO: 76503 - RNA, 64 nt, Human
aacucaagcuguagccaaacaguagagauggagggccgggaagcaaaccgugcccugguauugu

SEQ ID NO: 76504 - RNA, 64 nt, Human
gagucccagacucacgcacccugggccacagggagccgggaaucggggccugcugcuccugcug

SEQ ID NO: 76505 - RNA, 64 nt, Human
ggagaacaggucacgccuguccuggagacagugugccgggaaaagggaacgugguacucacugg

SEQ ID NO: 76506 - RNA, 64 nt, Human
gaaaaccaaaagaacaagaauuucuugguaagaagccgggaacagacaacagaagucaugaagc

SEQ ID NO: 76507 - RNA, 63 nt, Human
ugcugcuguucagaaacugaccuguucaccucugccgggaaguuccuguguugugcugaugau

SEQ ID NO: 76508 - RNA, 64 nt, Human
agggucucagaugguuaggacaaaguggauggaugccgggaaguuuaaccugagccuuaggauc

SEQ ID NO: 76509 - RNA, 64 nt, Human
guauuaggugaggauggaugcgggcgcuguccuugccgggaagucacuguugaaguugcagugg

SEQ ID NO: 76510 - RNA, 64 nt, Human
acaccaucuggugaggaaccaaggccaccucugugccgggaaagacaucacauaccuucagcac

SEQ ID NO: 76511 - RNA, 64 nt, Human
uguaggguguggccagaggccaggcggcuccuaagccgggaaccuaggucagggccacccucca

SEQ ID NO: 76512 - RNA, 64 nt, Human
ggggcugggacuggagcuggagcaggcacuugcagccgggaaagccagggugugccgggccaag

SEQ ID NO: 76513 - RNA, 64 nt, Human
guuauuuggugacuagaaaggcaagggaggcauagccgggaauuaacucuucgguuaauggguc

SEQ ID NO: 76514 - RNA, 64 nt, Human
aacgucaaaaccuauacccacuaaagggaaggcugccgggaaggcaaauggaacaggaauggag

SEQ ID NO: 76515 - RNA, 64 nt, Human
uucuuaaugaauucacuggcaugaguaauuuuaugccgggaaaaucugauuuguggucuauuua

SEQ ID NO: 76516 - RNA, 64 nt, Human
accaaugcaacauacucucagcaccuaaaauagugccgggaacauaguaagggcucaguaaaua

SEQ ID NO: 76517 - RNA, 64 nt, Human
uuuccaguacaucuaucagaaucaucaagucuuggccgggaacacagacagggugucuacccaa

SEQ ID NO: 76518 - RNA, 64 nt, Human
aucuggacuccuuccccgccuugggacaucgcaggccgggaagcagugcccgccaggccugggc

SEQ ID NO: 76519 - RNA, 64 nt, Human
ugucagcugagcucauucuggggcagauguuugggccgggaacaauuuuucaagguuguaaagc

SEQ ID NO: 76520 - RNA, 64 nt, Human
cuuuggcucaggaaaaagauccacuggaaacuaggccgggaagcagcagccccuccaagggcca

SEQ ID NO: 76521 - RNA, 64 nt, Human
cucucuguggggaaaggggacugcagggggaagagccgggaagggacagucaggcuucucccug

SEQ ID NO: 76522 - RNA, 64 nt, Human
gcugaacugagggcuccugcuggauuccgaaaaggccgggaagccagucuccuucccugaagca

SEQ ID NO: 76523 - RNA, 64 nt, Human
cgucacgcauccuuucugggguaguaccuguggagccgggaagggucuccugcagugccauucu

SEQ ID NO: 76524 - RNA, 64 nt, Human
gcacaggcagcuagaagggccggugggcaccggggccgggaagcccccaccucaccaccugagg

SEQ ID NO: 76525 - RNA, 64 nt, Human
ucccacccccuaccccaccuaacacauuugcacugccgggaauggacacuggaagugccaggag

SEQ ID NO: 76526 - RNA, 64 nt, Human
ggauggagcagguagcucaucuggccuuguaggugccgggaacgggcaagacauguuuugaaau

SEQ ID NO: 76527 - RNA, 64 nt, Human
ggauggguucugccuuaaauugggaggacuccaagccgggaaggaaaauucccuuuuccaaccu

SEQ ID NO: 76528 - RNA, 64 nt, Human
acugcaccagugugacaucuacaacuccaagauugccgggaagcuccuggggugagugcccucu

SEQ ID NO: 76529 - RNA, 64 nt, Human
ucgcaacccccccaggccggagcuuccuuccuuagccgggaagcuggcagaggagagccgugcc

SEQ ID NO: 76530 - RNA, 64 nt, Human
gcauggaaccuugagaacccagggacgagccagugccgggaaggaacugccgggacucaccgag

SEQ ID NO: 76531 - RNA, 64 nt, Human
aggcucucccggggggcgcagucggguccugagggccgggaagccgaagaguccacaggcccag

SEQ ID NO: 76532 - RNA, 64 nt, Human
uguguccugugcucccuccuagcgcaguggccaagccgggaaagccucuaacuugccuuugcug

SEQ ID NO: 76533 - RNA, 64 nt, Human
ugcaugucuguccacuugguggcugcuggguggggccgggaacaagggccccugacccugugug

SEQ ID NO: 76534 - RNA, 58 nt, Human
ccacgccaaguaccaagugaccagggaugccgggaacacugucgaagaacggaaggca

SEQ ID NO: 76535 - RNA, 64 nt, Human
cccuugcugcguuuguguccccucugucucgcgggccgggaaacugcucugaugggaaaauaaa

SEQ ID NO: 76536 - RNA, 64 nt, Human
gagucagaaaaaccagaacgggguccccggaucugccgggaaggcuucugaggggcugcccuga

SEQ ID NO: 76537 - RNA, 64 nt, Human
ggacagaggauuugcucuggacagagauggaagagccgggaacagagaaguguggggaagagau

SEQ ID NO: 76538 - RNA, 64 nt, Human
uguggcaggaaggaauggggggccccagccccaggccgggaaggagccagcggccgacaaagca

SEQ ID NO: 76539 - RNA, 64 nt, Human
gagugcacacaccgaccgccacaugugcuuuucugccgggaaucccuggggugaacgcauguuu

SEQ ID NO: 76540 - RNA, 64 nt, Human
gguucaccugagaggccggcauggugccugggcugccgggaaccucaucugccuggggccucac

SEQ ID NO: 76541 - RNA, 64 nt, Human
cgcccccaccccaccggcagcguccaggugcggggccgggaaccacacaccccacugggccggc

SEQ ID NO: 76542 - RNA, 64 nt, Human
gcggccggcgaacggggcucgaaggguccuuguagccgggaaugcugcugcugcugcugcugcu

SEQ ID NO: 76543 - RNA, 64 nt, Human
ucccucagccaugagaaccagcuuuggggaggaggccgggaaucaaagcgaguccaguugaucu

SEQ ID NO: 76544 - RNA, 64 nt, Human
ucgauacuuugccaauucaaggcccugguggcuggccgggaagguggauucgccuuggcuaggu

SEQ ID NO: 76545 - RNA, 64 nt, Human
ccacugggcccuuaguggauguuucagacgcucggccgggaacgagugaguggucaacaaugcu

SEQ ID NO: 76546 - RNA, 64 nt, Human
gaucccaguccaccugugugcaugucagggcucggccgggaagaagccagcaaagucccccgug

SEQ ID NO: 76547 - RNA, 64 nt, Human
cccccacccccuuuuuuaaacaaguguuacuugugccgggaaaauuuugcugucuuuguaauuu

SEQ ID NO: 76548 - RNA, 64 nt, Human
ggaucucaccaggcagccucugggggguggccaggccgggaaaaagcccaccauuuggcauccc

SEQ ID NO: 76549 - RNA, 64 nt, Human
ugcuggugggccggagugauguggugggagggaagccgggaauguauccuuuucagacaaaauu

SEQ ID NO: 76550 - RNA, 64 nt, Human
accugcgggaggcagcgacggcccccacgcagacgccgggaacgcaggccgcuuuauuccucug

SEQ ID NO: 76551 - RNA, 64 nt, Human
ggaggucucuguaaaagcagacccaccucccagcgccgggaagcccgucuuggguccucgcugc

SEQ ID NO: 76552 - RNA, 64 nt, Human
cugggagccccacugcccugccauccccaguacugccgggaagugucggccguccuugucauua

SEQ ID NO: 76553 - RNA, 64 nt, Human
ucaggugauccgcgggaggggccuccacgccagcgccgggaaggcugcuggggccuccacaccu

SEQ ID NO: 76554 - RNA, 64 nt, Human
aaacuauuuugaaugcuuccaacuggcucaauuggccgggaaaacaugggagcaagagaagcug

SEQ ID NO: 76555 - RNA, 64 nt, Human
aauccugauaugaaacaagucauguagucucauggccgggaaucucuccacagauacuaacaac

SEQ ID NO: 76556 - RNA, 64 nt, Human
auuuaucguuuguaauuuaauuauugcuacaagugccgggaacugaacaauauuuauggauaaa

SEQ ID NO: 76557 - RNA, 58 nt, Human
cuagggcagauagauuguaacacgggaagccgggaagugagagaaaaggggaugagug

SEQ ID NO: 76558 - RNA, 64 nt, Human
gcugggagugggguggccugggggacccuagacagccgggaaggcuguugugcccguugccuuu

SEQ ID NO: 76559 - RNA, 64 nt, Human
cuggcguccucugccuuccccgcuuccccaugagcgucugcaaaacacuugccugaauacauau

SEQ ID NO: 76560 - RNA, 64 nt, Human
ggagagagaaaggaaaggauagaaucacaggcugcgucugcaccugaaaagugacccgcggaaa

SEQ ID NO: 76561 - RNA, 64 nt, Human
guggaccuggugcagcugggaagcuugggacucucgucugcacugcguguccucugaagcagug

SEQ ID NO: 76562 - RNA, 64 nt, Human
cauuuauuuaaccaacuauaccacugcauugggacgucugcacuugagcuucuacaaucugaua

SEQ ID NO: 76563 - RNA, 64 nt, Human
agaagaaaucguucaucauaagaaggagauugagcgucugcagaaagaaauugagcgccauaag

SEQ ID NO: 76564 - RNA, 64 nt, Human
ccaugggcucaggugacucgggguggagugagcacgucugcagggcccucucauacacgccuga

SEQ ID NO: 76565 - RNA, 64 nt, Human
guuugaagcuugucggucuuugaagucuggaagacgucugcagaggacccuuuuggcagcacaa

SEQ ID NO: 76566 - RNA, 64 nt, Human
aggggagggaggcgggaggccgucacuggaguggcgucugcagcagcugcugccccagcacccg

SEQ ID NO: 76567 - RNA, 64 nt, Human
gucuuuggaggaacagcucccuaguggcuuccuccgucugcaaugucccuugcacagcccacac

SEQ ID NO: 76568 - RNA, 64 nt, Human
gcgcacccacucauuuuauuugacccucgauggccgucugcagcgaauaagugcaggucuccga

SEQ ID NO: 76569 - RNA, 64 nt, Human
gagacaaugggguuuucuagauauacagucaugucgucugcaaacagggacaauuugacuuccu

SEQ ID NO: 76570 - RNA, 64 nt, Human
aguaugaaacuaauuucacauuaaauguugcaaacgucugcaauucuccaguuuuuaguuugca

SEQ ID NO: 76571 - RNA, 64 nt, Human
ggccccaccucccugcgcccuugaggggccccagcgucugcagggugacgccugagacagcacc

SEQ ID NO: 76572 - RNA, 64 nt, Human
cacugccaccauuccauccugugccccgcccccgcgucugcaccucugugguuccugcccucag

SEQ ID NO: 76573 - RNA, 50 nt, Human
uccucuuugcuccguacuaacgucugcaaaccccaagacguuugaggcca

SEQ ID NO: 76574 - RNA, 64 nt, Human
gcguccagggcagauggcagaggaucugccucggcgucugcaggcgggaccacgucagggaggg

SEQ ID NO: 76575 - RNA, 64 nt, Human
cucucaauuccuggagaugccaacuucacagacacgucugcagcagcuggacaucacauuucau

SEQ ID NO: 76576 - RNA, 64 nt, Human
guugggauuaucacagguuaagccuuuuguuccccgucugcaccugaaggguugucgccuggcc

SEQ ID NO: 76577 - RNA, 64 nt, Human
gguaguuaagagugcagacacaucuggggugcaacgucugcaucauccugguggcuagccagug

SEQ ID NO: 76578 - RNA, 53 nt, Human
gcagugaugaaucagauuaaaaucgucugcaaaaucuaugaagaauacugguu

SEQ ID NO: 76579 - RNA, 64 nt, Human
cagccucugcucccuccuggggacccacagcagacgucugcaagccacugcugagacccuuccc

SEQ ID NO: 76580 - RNA, 64 nt, Human
auugaguguggagaucaccggggccgccgcgggccgucugcacuucuguuccagguuuuucugg

SEQ ID NO: 76581 - RNA, 64 nt, Human
agguuccagguugcagcaggcgugaggcacugugcgucugcagaggggcuacgaaccaggugca

SEQ ID NO: 76582 - RNA, 64 nt, Human
gcgaggccccugagccugcaccuggacagguguacgucugcacccaucacccucagcaccaggc

SEQ ID NO: 76583 - RNA, 64 nt, Human
acccucgcacgccgugccaggccugccccagacgcgucugcaggccgcuugcccuccugucccc

SEQ ID NO: 76584 - RNA, 64 nt, Human
uaggauuggcuguccccugccaagcuugguggagcgucugcaccuuggcugcgccgccugugca

SEQ ID NO: 76585 - RNA, 64 nt, Human
acugcagcccccaccuuuguguccuagagcucagcgucugcagucaagucucuuguauucggug

SEQ ID NO: 76586 - RNA, 64 nt, Human
gcuccccuugcguggggcauguaggugggggaggcgucugcaggucaccuggggggcccagccc

SEQ ID NO: 76587 - RNA, 64 nt, Human
ucccaaacaguccacaggucccaugcccacuuugcgucugcacugugaucgugacaaaucuucc

SEQ ID NO: 76588 - RNA, 64 nt, Human
gagacugcacaaacuauccucccccagguugagacgucugcagaguggcaagcugacuuguaga

SEQ ID NO: 76589 - RNA, 64 nt, Human
ugcuuccccggggccacucaccccugccccaccccgucugcaugcucacauggacgcggacgga

SEQ ID NO: 76590 - RNA, 64 nt, Human
uguggaggaaguuccucugguuaauucucaucagcgucugcagaaaagaaggaaagagggcacc

SEQ ID NO: 76591 - RNA, 64 nt, Human
cgacaccagaacccuggugcuggugggccacuagcgucugcagccuaagcaggugcuggcucag

SEQ ID NO: 76592 - RNA, 64 nt, Human
uuuugggggagcuuaacugcuuguugcucccugucgucugcaccauaguaaaugccacaagggu

SEQ ID NO: 76593 - RNA, 64 nt, Human
agaagguugucaccuaugaccacauugggcccaacgucugcaugggagaccacaaggugacaua

SEQ ID NO: 76594 - RNA, 64 nt, Human
ccucgccaucguggguaaaaucggccccacagcacgucugcaccagcgggccguuacucccaug

SEQ ID NO: 76595 - RNA, 64 nt, Human
cgugguuccugcccugcaccuucucagauggcuacgucugcauucaagcucaguaccacggggc

SEQ ID NO: 76596 - RNA, 64 nt, Human
aauguauagaaugcauacugccuaggcccccagucgucugcaguaauucaaaagcugguauuuu

SEQ ID NO: 76597 - RNA, 64 nt, Human
aauugagagcaguucacaucgauuuccugguaggcgucugcauucccuguuguguuccugcuuc

SEQ ID NO: 76598 - RNA, 64 nt, Human
gcgagccgcccuccgggaggaaggcgcccggcugcgucugcagaggcggggagaggaggcggcg

SEQ ID NO: 76599 - RNA, 64 nt, Human
gagcugauaauauauuauacgguaaauauaguaucgucugcauuccagcaaaaauaucaacucg

SEQ ID NO: 76600 - RNA, 64 nt, Human
gaccacaggggaagcuaucuuugcccucccaacucgucugcagugcuuagccuaacuuuuguuu

SEQ ID NO: 76601 - RNA, 64 nt, Human
acggcccccuugcccuugcagaggcagaagccugcgucugcaccugcaccucugaccguuucag

SEQ ID NO: 76602 - RNA, 64 nt, Human
gauggaaauguauagaauaauauuuaggcaauaacgucugcaucuucuaaaucaugaaauuaaa

SEQ ID NO: 76603 - RNA, 64 nt, Human
acaccuggcaacagcagugugggcugcagggcuccgucugcacguggacuugcccuggaccuug

SEQ ID NO: 76604 - RNA, 64 nt, Human
gccgcauuguucguggcaguagaccacaucuguucgucugcacagcugugaggcgaugcuguuc

SEQ ID NO: 76605 - RNA, 64 nt, Human
uguguuucuauucagcaagggaaaccggaccaagcgucugcaugugugugaucagaugugggcc

SEQ ID NO: 76606 - RNA, 64 nt, Human
ggacuggagcuuuguggacaaagaugagaaggcccgucugcagcaccaggucacugaggaugga

SEQ ID NO: 76607 - RNA, 64 nt, Human
cuagaguuagcaacaccagguguuccucccaacucgucugcaaggggcuggcuccuuggaugcu

SEQ ID NO: 76608 - RNA, 64 nt, Human
agcucuuauuucauuuuguaaucuuauuuucuuucgucugcauguucacaauaccaagcauuaa

SEQ ID NO: 76609 - RNA, 64 nt, Human
gagaggccacgugaggacacagugagaagguggccgucugcaagccgaggagggggccucagga

SEQ ID NO: 76610 - RNA, 64 nt, Human
gccugccccguucucuuaacucuuggacccuccucgucugcaugguaacuccgucugagucuac

SEQ ID NO: 76611 - RNA, 64 nt, Human
gccccgugggcugugccaagugugcccagggcugcgucugcaaaggggcaucggagaagugcag

SEQ ID NO: 76612 - RNA, 64 nt, Human
caugggcuguaaucauuuguaguuuccaaagacacgucugcauuugaauuucuagauuuucgag

SEQ ID NO: 76613 - RNA, 64 nt, Human
aauucuguauggaggaaggugggguaauugcauucgucugcaguagacacgaguuccucggacc

SEQ ID NO: 76614 - RNA, 64 nt, Human
cacagcaccccaaaagccuguggcuucaguccugcgucugcaccacacauucaaaaggaucguu

SEQ ID NO: 76615 - RNA, 64 nt, Human
ccuguccaccagcaggcugcggucccagcgggugcgucugcagcuccuccccuugggcagccug

SEQ ID NO: 76616 - RNA, 64 nt, Human
cacaccaaaggacacacacaggggggaagcccuacgucugcagagagugugggagggcuuuagc

SEQ ID NO: 76617 - RNA, 64 nt, Human
cacugaggacgcagaagugacuucugcuugaggacgucugcagcuccuccuacaccagcacacu

SEQ ID NO: 76618 - RNA, 64 nt, Human
cugagaccgagggaagggcucagcugaaggaccccgucugcaggagagucgggggaccagguuu

SEQ ID NO: 76619 - RNA, 64 nt, Human
aggccgacguuuucuccgcauuggaagagcccgccgucugcaggggccuggaggaaucacuggg

SEQ ID NO: 76620 - RNA, 64 nt, Human
aagcagccaacagcccaggagcuuuucagaauagcgucugcagcagaaccaguuuccauucaga

SEQ ID NO: 76621 - RNA, 64 nt, Human
ccuccugcaaaacccgcucccgaagcggcgcugccgucugcagccacgcgggggcgcgcgggag

SEQ ID NO: 76622 - RNA, 64 nt, Human
augaaaaugacuauuucuugcuguuuuuauccaacgucugcauuuucccccuuuaaagcugcgg

SEQ ID NO: 76623 - RNA, 64 nt, Human
agaauacaguguuuggaaccuaaaucuguuugugcgucugcaucaaaggaacauuugcuucacu

SEQ ID NO: 76624 - RNA, 62 nt, Human
agagcgagguccuucccuagggcgggucugggcgucugcaccuggggccuagggaacugaca

SEQ ID NO: 76625 - RNA, 64 nt, Human
gggccacaagcguggguaggccuuucacguauuccgucugcacaggcaaccaaggccaguagaa

SEQ ID NO: 76626 - RNA, 64 nt, Human
caagccauacaucgcagguaggaaaccacagaaccgucugcaaggagcaagcaacgguggcccu

SEQ ID NO: 76627 - RNA, 64 nt, Human
ccaccccuaccgacgcuagcccgcggcgccgcgacgucugcacggcccagacccaggauuccaa

SEQ ID NO: 76628 - RNA, 64 nt, Human
gcccugcccggccucucugcagacccucaagcgucgucugcaugagugagcaggcgugggugga

SEQ ID NO: 76629 - RNA, 64 nt, Human
cugcaagccccacccuccuugagacuggagcuggcgucugcauacgagagacuugguugaacuu

SEQ ID NO: 76630 - RNA, 64 nt, Human
caccggagccgcaugcucuuccuggaacugcccacgucugcacagaacagaccaccagacgcca

SEQ ID NO: 76631 - RNA, 64 nt, Human
guuuccugugccugcaccagcccugcccccauugcgucugcacaccccugcguguaacugcauu

SEQ ID NO: 76632 - RNA, 64 nt, Human
aggaagaacuguacuggccaagccugggaccacacgucugcagagauccugcucugcuggccug

SEQ ID NO: 76633 - RNA, 64 nt, Human
gugcaccugcagugguuuaauggcagauaagcuccgucugcaguuccaggccagccagaaacuc

SEQ ID NO: 76634 - RNA, 64 nt, Human
aacuuugcgccggccgucagggcauuaccgcuaacgucugcaggagcuuuauucccuauuaaua

SEQ ID NO: 76635 - RNA, 64 nt, Human
gccccggggccuguuggggcgggguuggaagagccgucugcagcuacuucagaggagcuguuua

SEQ ID NO: 76636 - RNA, 64 nt, Human
ccaggccuuggcaaugacgaucccccaaagagcccgucugcaccccagacccagggccucaggc

SEQ ID NO: 76637 - RNA, 64 nt, Human
auucgcacuccauggccuccuguccuggaccccacgucugcaaggaaacccuaggaccauggau

SEQ ID NO: 76638 - RNA, 64 nt, Human
gcgugcccuucccccaucccuccaaucugugccccgucugcagggcagaggcagauguggcaug

SEQ ID NO: 76639 - RNA, 64 nt, Human
uauuccagggggccugauggacaccuuucccgggcgucugcagcugcccugcccgugcccgccu

SEQ ID NO: 76640 - RNA, 64 nt, Human
gagacccagagcgguaucuuugccaggaugggggcgucugcagaacuagauuaagaaggaagag

SEQ ID NO: 76641 - RNA, 64 nt, Human
guggaucaaaggagaagccaggagucuacaccaacgucugcagauacacgaacuggauccaaaa

SEQ ID NO: 76642 - RNA, 64 nt, Human
uuauggcuuuuacuguguuacuuuuuuagacucccgucugcacaaaaugcaauaaaaauaauuu

SEQ ID NO: 76643 - RNA, 64 nt, Human
ugugacauguugguuaccuguucgcccagugccacgucugcaugugaagcgugcucauuucaug

SEQ ID NO: 76644 - RNA, 64 nt, Human
gccaugcucccuggucaccccacuucccggucgccgucugcagcacuccuggagcagccugggc

SEQ ID NO: 76645 - RNA, 64 nt, Human
gaacccugccucccgcgcccgcccugcucguccgcgucugcagucagcguccccaaccugugcg

SEQ ID NO: 76646 - RNA, 64 nt, Human
uucuuugucucugcauccuaacuugcugccuuaucgucugcaaguguucuccaagggaaggagg

SEQ ID NO: 76647 - RNA, 64 nt, Human
ggcugcucgccuucuccguggcuuccgcagcuaccgucugcacggugagagggcacgggcacac

SEQ ID NO: 76648 - RNA, 64 nt, Human
ggauggauggguggauggaggguggcagguggggcgucugcagggccacucuuggcagagacuu

SEQ ID NO: 76649 - RNA, 64 nt, Human
uagugauauugcagcagacaaggucuggguugggcgucugcaggaggacaccuugugggacauc

SEQ ID NO: 76650 - RNA, 64 nt, Human
uauguuugugucucuguguguguauguggccaagcgucugcaggugaggguggcacauggaacu

SEQ ID NO: 76651 - RNA, 64 nt, Human
acggaaucuuuaagaauccgccagcacuugguagcgucugcagccacccagguagcauacgcuc

SEQ ID NO: 76652 - RNA, 64 nt, Human
guaugcauauguauguagauauguuuauaucuaucgucugcaucacucuccucaguguugaugu

SEQ ID NO: 76653 - RNA, 64 nt, Human
uaaaaacaaccaccaccauccaacaaaaggauuacgucugcaucuuuucuaacuuacuauuuuc

SEQ ID NO: 76654 - RNA, 64 nt, Human
gugacaucucccucuccuugcuggcuccaucuuucgucugcacuaccaauucaaugcccuucau

SEQ ID NO: 76655 - RNA, 64 nt, Human
guagggagcuggcuccccugagagccaugcagggcgucugcagcccaggccucuggcagcagcu

SEQ ID NO: 76656 - RNA, 64 nt, Human
ccuccagcccgcccacugcccguugccuucgugcuucgucaacguucuguggccuuggagcucu

SEQ ID NO: 76657 - RNA, 64 nt, Human
ugaaaaauaugccauuucauaaagucugaggauuuucgucaaccuuacugaaacacacuggugc

SEQ ID NO: 76658 - RNA, 64 nt, Human
uuuaggcggaaaugcucuccccaggcccauugcguucgucaaguucuuggaaauggacaaaggg

SEQ ID NO: 76659 - RNA, 64 nt, Human
agggaagaagcagaacuugaggccaacaguguguuucgucaaaaguaggugucccagugcaaug

SEQ ID NO: 76660 - RNA, 64 nt, Human
ccucuuuucucuucguuaguugucagaauaugccuucgucaaggcucagagguaacaagacaga

SEQ ID NO: 76661 - RNA, 64 nt, Human
acuaccucuuguuacaguagccagggaguggaauuucgucaaccgguacuuuuaagguuaggau

SEQ ID NO: 76662 - RNA, 64 nt, Human
cuguuccuucgcgguuugcuauuuucauuuccuguucgucaaagcagcagaggagaucaaaccc

SEQ ID NO: 76663 - RNA, 64 nt, Human
ggucauuauuuaugcuuugagaguuucaauauuguucgucaaguuaacuuauggcauaauuuaa

SEQ ID NO: 76664 - RNA, 64 nt, Human
ccucggauggccaacauucaguuguucagguucauucgucaaaguuaaguuuuagaacuauuug

SEQ ID NO: 76665 - RNA, 64 nt, Human
uggagaggaccagaugaaaacauuagggccaaucuucgucaauaugguuuagagaaguauuacc

SEQ ID NO: 76666 - RNA, 64 nt, Human
guagcagagugaugggagcaaaauaggcacugaauucgucaacucuuuuuugugagccuacuug

SEQ ID NO: 76667 - RNA, 64 nt, Human
aaucuucuguugauuuacaccuuugacauuuguauucgucaacccuguggcuuguuagcaucag

SEQ ID NO: 76668 - RNA, 64 nt, Human
ccgccucccaggcuggcccaaggggagugccuccuucgucaagcuccaagucaaggucagagcg

SEQ ID NO: 76669 - RNA, 64 nt, Human
ggcagugggcauuuggaaccaauucuauucagacuucgucaaagccaaagucagucugguguug

SEQ ID NO: 76670 - RNA, 64 nt, Human
auacucuucaccaaacacacuugagaacuguaacuucgucaagcacuuucuguccugaagcuuu

SEQ ID NO: 76671 - RNA, 64 nt, Human
gccuggagcuguggaugagcccuaugacagacgcuucgucaaguggaugaucaagaacaaggug

SEQ ID NO: 76672 - RNA, 64 nt, Human
ugaugcauccuccucacauaagcauccauauggcuucgucaagggaggugaacauuguugcuga

SEQ ID NO: 76673 - RNA, 64 nt, Human
agcccuuccguucugaggucagacacacaaaaccuucgucaauugcacaccggugcuguuggga

SEQ ID NO: 76674 - RNA, 64 nt, Human
gaugggaacuccaagcugguuggcagugcccagauucgucaagugaggguccaggaaagcucuu

SEQ ID NO: 76675 - RNA, 64 nt, Human
aggguggggguugggggaagcuugaccuugugucuucgucaauaaacucacauuuacacaaaau

SEQ ID NO: 76676 - RNA, 64 nt, Human
uuaccuucuccauugucuuaguucugucacccauuucgucaagugaccucucaucuucuauaaa

SEQ ID NO: 76677 - RNA, 64 nt, Human
cuuggaugugcuggaguuuaaccaggugauaaucuucgucaagucagugcagcgcugcauggcc

SEQ ID NO: 76678 - RNA, 64 nt, Human
uucucuaaaaccuuuaaauguuugcaugcagccauucgucaaaugucaaauauucucucuuugg

SEQ ID NO: 76679 - RNA, 64 nt, Human
accugcugugagaguuuugacagagcacuuuauuuucgucaaguuucaagucugaguucaaaac

SEQ ID NO: 76680 - RNA, 64 nt, Human
guaggaucugaagaaggcacaggugcaaguaaaauucgucaauuaaaccacuauuuugauuacg

SEQ ID NO: 76681 - RNA, 64 nt, Human
gcaauggggaauacaaguuccaguucugcaaagauucgucaacuuucuuagcucaagagagagg

SEQ ID NO: 76682 - RNA, 64 nt, Human
caggccuuuaaggacugcugaugcccccucaggccucccccaaguuugcugggcuuugguggaa

SEQ ID NO: 76683 - RNA, 64 nt, Human
ggggcggugcugccagcccuaagugccaugugggcucccccaggggcacguguggcuccugccc

SEQ ID NO: 76684 - RNA, 64 nt, Human
ucucucuacuccuaccucagccuagacccuccuccucccccagagggguggguuccucuucccc

SEQ ID NO: 76685 - RNA, 64 nt, Human
acgcaggacaggcaggagagauucuuccuaaagccucccccauaaaaagggagcuguggaucca

SEQ ID NO: 76686 - RNA, 64 nt, Human
aucuucccaucugccugagccagggaaggacccccucccccacccaccucucuggcuuccaugc

SEQ ID NO: 76687 - RNA, 64 nt, Human
gccacagcccugccccuccaguuccuuggcaguucucccccaaaccaggucuguacagguguuc

SEQ ID NO: 76688 - RNA, 64 nt, Human
acucccugucauuccuaaccuaaccuuagagucccucccccaaugcaggccacuucuccucccu

SEQ ID NO: 76689 - RNA, 64 nt, Human
cccuuacccacccaccagccccaaggcccgaccccucccccaaaggggcaguccccuucuugca

SEQ ID NO: 76690 - RNA, 64 nt, Human
acacacacacacacacucuugaucccuugcuucccucccccagugcguucugugaucgccaagu

SEQ ID NO: 76691 - RNA, 64 nt, Human
uuguaggaagauuuuuuaaugguuuugguugcuccucccccagcugccaccccccaccuuaccc

SEQ ID NO: 76692 - RNA, 64 nt, Human
cagcugccccacagguguguuucccaucccacugcucccccaacacaaacccccacuccagcuc

SEQ ID NO: 76693 - RNA, 64 nt, Human
aucccuggccucugcccacuagacaucagaagcacucccccaguugugacaaccaaaaauaucu

SEQ ID NO: 76694 - RNA, 64 nt, Human
aauguccugcauggggcagaggcuuccguguccucucccccaacccccugcaagaagcgccgac

SEQ ID NO: 76695 - RNA, 62 nt, Human
gagccacaaaucuucaauaaacguggggagggcucccccacguugccucuacuuuaucaauu

SEQ ID NO: 76696 - RNA, 64 nt, Human
auauaaggauaucuguauguggaaggauuaagaucucccccaggcagcuauaagaauauuuuag

SEQ ID NO: 76697 - RNA, 64 nt, Human
uuucugcccuuccucacccccacgccccaccccacucccccagaguacuccccacugugaaaag

SEQ ID NO: 76698 - RNA, 64 nt, Human
augaggcauugucacccuagaccccucuuccucucucccccaccauagugugcaauaaaguguc

SEQ ID NO: 76699 - RNA, 64 nt, Human
aguugugcuccuccuggcucaccauuucccccugcucccccacagccgguucugcacuuaucac

SEQ ID NO: 76700 - RNA, 64 nt, Human
ggcagagggugaaaaagagaaaugugagcauccgcucccccaccaccccgcccagccccuagcc

SEQ ID NO: 76701 - RNA, 64 nt, Human
uucuucugucuuggaguucagaggcccaaaacuucucccccaaagccaagccauuuaaugaccu

SEQ ID NO: 76702 - RNA, 64 nt, Human
augagucccauuugccuugcaauuagcauucugucucccccaaaaaagaaugugcuaugaagcu

SEQ ID NO: 76703 - RNA, 64 nt, Human
aaguccucagcccccuggccccuuccgcaaucuccucccccagucucccaaagagccauuucaa

SEQ ID NO: 76704 - RNA, 64 nt, Human
uucucuacucuagggaaaaaccagcgugugacuacucccccaggugguuauggagagggugucc

SEQ ID NO: 76705 - RNA, 64 nt, Human
cagauccauccuuuugcuucaucuggagucccuccucccccacgccuccauccacacacagcag

SEQ ID NO: 76706 - RNA, 64 nt, Human
uccuuccccuguuuacagcaauaagcacguccuccucccccacucccacuuccaggauuguggu

SEQ ID NO: 76707 - RNA, 64 nt, Human
cucuuggcacccgguuguuacccccuggcagcuucucccccaaacucuccuaccauguggcccu

SEQ ID NO: 76708 - RNA, 64 nt, Human
auaucaggacauccugugagacucuucccccugacucccccauuguguuaagaacccagcaacc

SEQ ID NO: 76709 - RNA, 64 nt, Human
gauccauggggacauuaauaguccaaggcauucccucccccaccacuauucauaaaguauuaac

SEQ ID NO: 76710 - RNA, 64 nt, Human
uguccugacacucuaguccuccaggauagugcuccucccccagcuccagggcuccuggaugucc

SEQ ID NO: 76711 - RNA, 64 nt, Human
aacuccugggcucaagcauuccuccugccucagccucccccauagcugggacuaggggugcaug

SEQ ID NO: 76712 - RNA, 64 nt, Human
cccuucccaauuccaucaccacugccaacaacuccucccccagagaucuggcuggagcccagaa

SEQ ID NO: 76713 - RNA, 64 nt, Human
gggaggaagagaggccaaguucagagcucucugucucccccagccagacaccugcaucccuggc

SEQ ID NO: 76714 - RNA, 64 nt, Human
augugucuaaagacuugguguccccuucucucuccucccccacccgccacuccuggguacaucu

SEQ ID NO: 76715 - RNA, 64 nt, Human
ccuugcaguaauuuauuuucuguauggacugucccucccccagaggcuuccccacccuccauug

SEQ ID NO: 76716 - RNA, 64 nt, Human
aaacaacaaugcgguggauugcaaccaagugcagcucccccagucggacagcucucuacagagc

SEQ ID NO: 76717 - RNA, 64 nt, Human
gaccagccacugugggaccaacaccccucccacacucccccagacugcucgucuaucaccagga

SEQ ID NO: 76718 - RNA, 64 nt, Human
cacccagcccugccccucaccugccugcccuccccucccccacucuauacuagggacuggaucu

SEQ ID NO: 76719 - RNA, 64 nt, Human
aaagagucccuggaaaagaaagaauaaguggauucucccccaggagaauccuuuuugcaaagau

SEQ ID NO: 76720 - RNA, 64 nt, Human
ugggcacucugcccuggauacaggcucuacccuccucccccaggaccugccuagugccaguuug

SEQ ID NO: 76721 - RNA, 64 nt, Human
acaacucagcuucggggccggugaggggaggggccucccccagcacagaugaggagcagcuggg

SEQ ID NO: 76722 - RNA, 64 nt, Human
gcauccuuuagauauuuuguaugcaaagauggcucucccccaaaucccaguuuuucagcucagg

SEQ ID NO: 76723 - RNA, 64 nt, Human
ccauagcuccuucgacuauugggcuuaagcgauccucccccaccucagccuuccaaguaacugg

SEQ ID NO: 76724 - RNA, 64 nt, Human
ggggagcuuccucacaucucugcugaagaagggccucccccaggcccccagcugaggccggcaa

SEQ ID NO: 76725 - RNA, 64 nt, Human
ccacuccuccuggggugcugccugccaccgagagcucccccaccuguaccaccaugugggacuc

SEQ ID NO: 76726 - RNA, 64 nt, Human
ugcccucaccgucuuggugaccuggccucggccccucccccaagucucuucugugcaaggcccg

SEQ ID NO: 76727 - RNA, 64 nt, Human
agcacccccugccaucagggggguugaaaucccucucccccaggagcccugcugcuuugcuugg

SEQ ID NO: 76728 - RNA, 64 nt, Human
uguggguagaacccugagcgacccugccuccacucucccccagcugccuggaggggcaaagguc

SEQ ID NO: 76729 - RNA, 64 nt, Human
agcccggggccgcucaggucugcuuggaggaugccucccccaggagggcagugagggaugccgc

SEQ ID NO: 76730 - RNA, 64 nt, Human
acucuccuucgugucucucccaccccggccuccacucccccaccugacaauggcagcuagacug

SEQ ID NO: 76731 - RNA, 64 nt, Human
cuuggccuagaguggcaaauggaacuucucugaucucccccaacuagacuggagcccccgaagg

SEQ ID NO: 76732 - RNA, 50 nt, Human
aggcaccuccuggugucuaacucccccaaagacaaugaguuaagggagag

SEQ ID NO: 76733 - RNA, 64 nt, Human
caucccacauugucccuucagcucagcugcucuucucccccacccacccugggaugugggugcu

SEQ ID NO: 76734 - RNA, 64 nt, Human
gcuauaccucaugccuuucccagcagccacugaacucccccaucccagggcucagccuccugau

SEQ ID NO: 76735 - RNA, 64 nt, Human
cccacacacacuccuuccccuugucccuggggcacucccccaggauugugcaauagucagagug

SEQ ID NO: 76736 - RNA, 64 nt, Human
uacccuuccucaucugugccugucuguccaaccccucccccacgucucucugccugcugggcuc

SEQ ID NO: 76737 - RNA, 64 nt, Human
gacccucggggacccaaguggggcuuucaacccucucccccaccacccagcccacugcacugaa

SEQ ID NO: 76738 - RNA, 64 nt, Human
cagaaacccuucuguacucguugguaaauaucuacucccccaagugacuccaggugccccccac

SEQ ID NO: 76739 - RNA, 64 nt, Human
uggacaugcacccauccccaguccaggaaaccaucucccccaggaccuucugucugggacucag

SEQ ID NO: 76740 - RNA, 64 nt, Human
auaaguaaaaaaaaaaaaaaaacacuucaacucccucccccauuuagauuauuuauuaacauau

SEQ ID NO: 76741 - RNA, 64 nt, Human
auguaccugaugcuauggucagguuauacuccuccucccccagcuaucuauauggaauugcuua

SEQ ID NO: 76742 - RNA, 64 nt, Human
ccaucuccccaccccuagaaacagggcuggaaaucucccccacagcagugugacuggugaaaau

SEQ ID NO: 76743 - RNA, 64 nt, Human
aguaacuaauauuaggcaguugauacucccccaccucccccauuuagauacacuacuguauuag

SEQ ID NO: 76744 - RNA, 64 nt, Human
ugaaaauucaguaacuaauauuaggcaguugauacucccccaccucccccauuuagauacacua

SEQ ID NO: 76745 - RNA, 64 nt, Human
aggugggagcaucuccagugcuccccaauuauaucucccccacuccacuacucucuuccuccac

SEQ ID NO: 76746 - RNA, 64 nt, Human
gagcagccagggaagcccuagacacuccccgcgucucccccaugcacaggggaaggauguugac

SEQ ID NO: 76747 - RNA, 64 nt, Human
gccauuuucugacagacacacagaccugccuuuucucccccaaguauaccguacccuccuguga

SEQ ID NO: 76748 - RNA, 64 nt, Human
uuccagccaagcugccuuaacucgccccucggggcucccccagagacugugccccgggcgggcc

SEQ ID NO: 76749 - RNA, 64 nt, Human
ugauuccugggcucccagccuuaaaacucacugccucccccaagggcccccucuaaggagggug

SEQ ID NO: 76750 - RNA, 64 nt, Human
ugacaggccuucuguacccagcguuuguacuugccucccccaacagugggccuguucuacccgu

SEQ ID NO: 76751 - RNA, 64 nt, Human
acuuaaaggagcagagaugcagccagugucugggcucccccaguggugaaaugaucuggaagcu

SEQ ID NO: 76752 - RNA, 64 nt, Human
agauugaugaucaggugccccuguucucccuucccucccccaguuguggggaauaggaaggaaa

SEQ ID NO: 76753 - RNA, 64 nt, Human
cuguccugaaagucuggacuuuggugguacccuccucccccagcccaucuguugcacauuauac

SEQ ID NO: 76754 - RNA, 64 nt, Human
cagagaagaugucuguguggcuuucccucccugccucccccagcucccacacuggccuuuguaa

SEQ ID NO: 76755 - RNA, 64 nt, Human
agguuggagcaucaaguuccagccggccccuucacucccccaucuugcuuuucuguggaaccuc

SEQ ID NO: 76756 - RNA, 64 nt, Human
guccugucaccucugaggugccugcuggcauccucucccccaugcuuacuaauacauucccuuc

SEQ ID NO: 76757 - RNA, 63 nt, Human
ugcgcaucagcaaugucugaugaccuguucccacucccccauuccucuggucucuuuuccucu

SEQ ID NO: 76758 - RNA, 64 nt, Human
uaaaggaauccccagaaguggucccuaugaugaacucccccaaagcaacgccguuuuuggagga

SEQ ID NO: 76759 - RNA, 64 nt, Human
aucccaccacaggugaaggaaguaaagaccacuucucccccagucucugcuuucugcagugcuc

SEQ ID NO: 76760 - RNA, 64 nt, Human
ucugcuccucgcucgcaccugccuccggccugcacucccccaguucccgggcccuccugggcac

SEQ ID NO: 76761 - RNA, 64 nt, Human
ucucugccugugucuggagcaucccuucccaccucucccccacuucuucccuccagccugcaug

SEQ ID NO: 76762 - RNA, 64 nt, Human
aucuuugagcgcccacuagacccacuggacucaccucccccaucucuucuggguuccuuccucu

SEQ ID NO: 76763 - RNA, 64 nt, Human
ggcaauuuuguaccuuuguggagaaaugugucaccucccccaacccgauucacucuuuucuccu

SEQ ID NO: 76764 - RNA, 64 nt, Human
augcagcugguugcaccccgaggggagaugccuucucccccaccucccaggaccugcaucccag

SEQ ID NO: 76765 - RNA, 64 nt, Human
cagugacgggcgugcggccgggcggggaggcuggcucccccacaccucccaccugcauugcucu

SEQ ID NO: 76766 - RNA, 64 nt, Human
ugagcguucggguggugccaugggagcacucucccucccccagguaaugaaagaguggccaagu

SEQ ID NO: 76767 - RNA, 64 nt, Human
uacccuaccucggggaccugguggcagcggcggccucccccagccuggaccccgccggccgcgg

SEQ ID NO: 76768 - RNA, 64 nt, Human
cuggaacacaucccugccuccgggaaguguggcucucccccaacccuccccaccguccccccuu

SEQ ID NO: 76769 - RNA, 64 nt, Human
aaaaaaaguaaggaaaauuggagaugcuaacauccucccccaucccaacugcaccuuaaaauau

SEQ ID NO: 76770 - RNA, 64 nt, Human
cccagugggaccccgcacaacaucccucaccacucucccccagcacccccaucuccgacugugc

SEQ ID NO: 76771 - RNA, 64 nt, Human
acuuuagcagaugugguuucaaaguaaaggccuccucccccaccccuuaggccccguggugaca

SEQ ID NO: 76772 - RNA, 64 nt, Human
ugucagcuucccagccaugcccaggacguccuaucucccccaacccaccucuggcccuguguag

SEQ ID NO: 76773 - RNA, 64 nt, Human
gaucucuauuauuaggcuagauguauagccucuacucccccagcuucuugcucuugacccugca

SEQ ID NO: 76774 - RNA, 64 nt, Human
uuuugguuucaccuucccucgacuugacccuuuccucccccagcgucaguuucacucccucuug

SEQ ID NO: 76775 - RNA, 64 nt, Human
ccucuucugaaacacaccaacccauauuccucugcucccccaaagcuguuucugauccugcugg

SEQ ID NO: 76776 - RNA, 64 nt, Human
agccaaggccgcccuccucccucuccuuccccuccucccccacuccuuccccuccgccuccuag

SEQ ID NO: 76777 - RNA, 64 nt, Human
uauuccagguauuguuuuuagucugaaaaacaaacucccccaugugguauuaauauaccuucaa

SEQ ID NO: 76778 - RNA, 64 nt, Human
agcucugagaucaccccacuuccaucauuuccuucucccccaacccaacgcuuuuuuggaucag

SEQ ID NO: 76779 - RNA, 64 nt, Human
cucugaugucuccuuccuucagaaucuaccaccccucccccaggcugggagaaggggcuccugg

SEQ ID NO: 76780 - RNA, 64 nt, Human
ccauuuggacaucuggggaaguggagauuaaccccucccccagacucgugccuugccucucagg

SEQ ID NO: 76781 - RNA, 64 nt, Human
caaauuaucacucuuuuaccuucauauaaaaugucucccccaaaccuuuuucccuucuuuguca

SEQ ID NO: 76782 - RNA, 64 nt, Human
gcugggagcuucucugcugcuuaaauuguucguccucccccacucccuccuaucguugguuugu

SEQ ID NO: 76783 - RNA, 64 nt, Human
auaaauucugagauuuggagcucaguccacgguccucccccacuggauggugcuacugcugugg

SEQ ID NO: 76784 - RNA, 64 nt, Human
gacuuguaugaaagauggcugugccucugccugucucccccaccgggcugggagcucugcagag

SEQ ID NO: 76785 - RNA, 64 nt, Human
uuugagggacaacagacuucacuucccugaaugccucccccaucuccaucaggaaaaauacacc

SEQ ID NO: 76786 - RNA, 64 nt, Human
uauaugguugacauucuuacucucaacaccuuggcucccccagaucagggccauuggugacaau

SEQ ID NO: 76787 - RNA, 64 nt, Human
ucccaccuuugcugggcuuuucuaucacucccaccucccccagagucagggcuccauugcugag

SEQ ID NO: 76788 - RNA, 64 nt, Human
caacauuugauguuuuuacuuaugaaauauucuccucccccaagaaaauuuaaacuuuuucucu

SEQ ID NO: 76789 - RNA, 64 nt, Human
cgagugaaauaaucagauuuuugucauucacacucucccccaguuuuggaauaacuuggaagua

SEQ ID NO: 76790 - RNA, 64 nt, Human
gccgccacacucagugccauggggaagcgggcgucucccccaccagccccaccaggcgguguag

SEQ ID NO: 76791 - RNA, 64 nt, Human
ucagacuucugccuuaaccagccccggggcuuggcucccccagcucugagcgugggggcauagg

SEQ ID NO: 76792 - RNA, 64 nt, Human
gggggaugucaaguggugaugucguugugcuccccucccccagagcgggugggcggggggugaa

SEQ ID NO: 76793 - RNA, 57 nt, Human
ucaucugcgggguggugugaggcccuccucccccagaacccccugccguguuccucu

SEQ ID NO: 76794 - RNA, 64 nt, Human
gcgagugagggcacagcggggccccagggcuacccucccccaggaggucgaccccaaagccccu

SEQ ID NO: 76795 - RNA, 64 nt, Human
cacugcguagccucuuuuucuucugacuugagagcucccccagucagaucucaggcuugucccc

SEQ ID NO: 76796 - RNA, 64 nt, Human
acucaauauuacaaccucuucuucucuuaaccuccucccccaaacacuagagguuuaauaagac

SEQ ID NO: 76797 - RNA, 64 nt, Human
auauauacagcccuauacaguuucauagcuuuuccucccccauuuauguguauuggugacagug

SEQ ID NO: 76798 - RNA, 64 nt, Human
uggaugggugggugguaaaaagggaaggaugaggcucccccaaugucacauuaaauucaugguu

SEQ ID NO: 76799 - RNA, 64 nt, Human
agaguguguuuccuuucgugucugcccaccucuucucccccaccucccgggucccuucugucgg

SEQ ID NO: 76800 - RNA, 64 nt, Human
auaauuauuauaauuauuauaauuauuuuauccccucccccaccgccucgcugcccccgcccag

SEQ ID NO: 76801 - RNA, 64 nt, Human
cauuagguauaucuccuaaugcuaucccuccccccucccccaacccacaacaguccccguugug

SEQ ID NO: 76802 - RNA, 64 nt, Human
cggagcccccaucccuuaucuuacccccaccgcgcucccccaggagcgcucccucagcucucuc

SEQ ID NO: 76803 - RNA, 64 nt, Human
gcaguuauugaccucccggucccgccugcccgcccucccccacguggccccuugacccgggcgg

SEQ ID NO: 76804 - RNA, 64 nt, Human
ggaaucagcagcauaggcuuuaucucccuacuuccucccccacccuaccgcguucaauuugugu

SEQ ID NO: 76805 - RNA, 64 nt, Human
gugggccguggcauggccacaccccaccccacuucucccccaaaaccagagccaccugccagcc

SEQ ID NO: 76806 - RNA, 64 nt, Human
gccacaccuugugcuucuuaucuguccacugccacucccccaguucaaauccuuacccugcaga

SEQ ID NO: 76807 - RNA, 64 nt, Human
ccaauguuucauccaccggcugcacaggcacaaacucccccacccaggacggcugugaugaggu

SEQ ID NO: 76808 - RNA, 64 nt, Human
cggcccagccacagaagcacaauggcccuucgcucucccccagccccaccaugaugcccccaug

SEQ ID NO: 76809 - RNA, 64 nt, Human
auacuaacauaacuuauuaaaggaggggucccuccucccccagagcaguccucaacacuauguc

SEQ ID NO: 76810 - RNA, 64 nt, Human
uucucccaggagcuucucugcagacugacacacccucccccaccccggguaguggagaugcugg

SEQ ID NO: 76811 - RNA, 64 nt, Human
ucggacaccaagcagaauucugcauggugacagucucccccaaacauggccugcugggcccaag

SEQ ID NO: 76812 - RNA, 64 nt, Human
ccagaaggaacaaguguggcuguguccaucucugcucccccaaaggcccgcucuaggccuuauc

SEQ ID NO: 76813 - RNA, 64 nt, Human
cgccggagguacaguuuuuccaggugcuuaagcccucccccacugugccacccuugugaccuuc

SEQ ID NO: 76814 - RNA, 64 nt, Human
uguucagaaaggcacaauguggagccuggggugucucccccaccccaggaccgucagguuuacc

SEQ ID NO: 76815 - RNA, 64 nt, Human
aggggaagggcuagggguaccuggaauguaggaucucccccaugccuggccuaccacccuaaug

SEQ ID NO: 76816 - RNA, 64 nt, Human
agcucugagcccugcuagccuugaggcgcggacccucccccauaccucccacaguaucccagcg

SEQ ID NO: 76817 - RNA, 64 nt, Human
cugcuaggccacggucugcgcccuggggccucaucucccccagcccacuuguuuuccccccuuu

SEQ ID NO: 76818 - RNA, 64 nt, Human
aaccugaauucugccucccuguuauagucccugucucccccacagagaccugugggugcuccca

SEQ ID NO: 76819 - RNA, 64 nt, Human
ugccccacccuaacugaucaauguacuuuguaaucucccccacccuuaagaagguacuuuguaa

SEQ ID NO: 76820 - RNA, 64 nt, Human
cccugucugcucugcugcuacagaggggcagggccucccccagcccacgcuuaggaaugcuugg

SEQ ID NO: 76821 - RNA, 62 nt, Human
gcaugguucagucucccugaguguccggugaccucccccagggccuccuugcccagcccagu

SEQ ID NO: 76822 - RNA, 64 nt, Human
ccaucuguuggccaccugcaggccagucucaacccucccccaggugggcaggcacuugauggcu

SEQ ID NO: 76823 - RNA, 64 nt, Human
aggcuucaugguggguggaguggggguggcugggcucccccaggacagaggggacccugagguu

SEQ ID NO: 76824 - RNA, 59 nt, Human
ucuuuguggaugugaugugagcagggccccucccccagcuccauuccgcucccacccca

SEQ ID NO: 76825 - RNA, 64 nt, Human
ccaggccugaaacauuucuuuucuuucuuuuuuccucccccaauuuacccugggccuggagcag

SEQ ID NO: 76826 - RNA, 64 nt, Human
agccacccuccuccacagguccaggugccgcucccucccccaccacacaucagugucuccuccc

SEQ ID NO: 76827 - RNA, 64 nt, Human
ggagugggaggguugguugccccucaccucagagcucccccaaaggccaguaauggauccccgg

SEQ ID NO: 76828 - RNA, 64 nt, Human
agccauugaauuugccuuccucaugaauuaaaaccucccccaagcagagcuuccucagagaaag

SEQ ID NO: 76829 - RNA, 64 nt, Human
aacuauucuguuccacacccaaugcugcuccacccucccccagacacagcccaggucccuccgc

SEQ ID NO: 76830 - RNA, 64 nt, Human
ggaaucauucaagaucccuccucagugcccaugucucccccaccucagggugcugucaacccuc

SEQ ID NO: 76831 - RNA, 64 nt, Human
ccugagcaagucaggcuccuggcucuggguguggcucccccaaacgaaguacugacuucagccu

SEQ ID NO: 76832 - RNA, 61 nt, Human
agggucccaugacaaccuagacugcccagggcucccccacccaggcccccacccucuugcu

SEQ ID NO: 76833 - RNA, 64 nt, Human
cacuguacauagagucacuggcaugaugcccucgcucccccaugcccccacaucccaguggggc

SEQ ID NO: 76834 - RNA, 64 nt, Human
gggccuuucccuuccuuuccuuucucaggccuugcucccccaggaugacccacucuuagggggg

SEQ ID NO: 76835 - RNA, 64 nt, Human
gucauacagcagccaacaacacccauguuuguagcucccccaccaaagacccagcggcuucuuc

SEQ ID NO: 76836 - RNA, 64 nt, Human
cuuccucuccccugcugucucuggggcugccacccucccccacaguccaggcccuucagccaag

SEQ ID NO: 76837 - RNA, 64 nt, Human
uccauaacuauggggguaaaugaagucaucccuucucccccaguccacccccaagugcucuuag

SEQ ID NO: 76838 - RNA, 64 nt, Human
ucuccguacaccccagcuccuaggucucagagaacucccccaccugugguuuuaccugcagcca

SEQ ID NO: 76839 - RNA, 64 nt, Human
uauaaguaauucggagacuccaauucaccugccccucccccaucccagguuguggaggcucgag

SEQ ID NO: 76840 - RNA, 64 nt, Human
caucuagcauuagguauaucucccaaugcuaucccucccccaucccccgaccccaccacagucc

SEQ ID NO: 76841 - RNA, 64 nt, Human
auuuuaaggcaaagaaaggcuguuaauucccucccucccccaaacacaugauuuuuaauauucu

SEQ ID NO: 76842 - RNA, 64 nt, Human
ggagccugauuuccuacugacuuccaauuuagugcucccccaguaugcuaaauagaaagcccuc

SEQ ID NO: 76843 - RNA, 64 nt, Human
cuugucgccaaauaaaagagaggcccauugauuccucccccaccccaacacuuuucuuuuaaag

SEQ ID NO: 76844 - RNA, 64 nt, Human
uuuuuucauuguguucucuauugcugcucucucacucccccaugagguacagcagaaaggagaa

SEQ ID NO: 76845 - RNA, 64 nt, Human
auagcacaguaucuucuucauggagccuuuuuuccucccccauccccugcagcugccuuuuuuu

SEQ ID NO: 76846 - RNA, 64 nt, Human
agaguuuuggggaccuggcccuucucccacugggcucccccauccugggccaaggccagaacuu

SEQ ID NO: 76847 - RNA, 64 nt, Human
caggccacacaaagucccuacgccucccugcugccucccccagaugcaugugguggcaucacca

SEQ ID NO: 76848 - RNA, 64 nt, Human
auggcucagugcagucccugggccagugagaggccucccccaugccucccugcccucugcacua

SEQ ID NO: 76849 - RNA, 64 nt, Human
cagggaggggccccggguccucucagucuuuccccucccccaacgauguagcguuuuucguugu

SEQ ID NO: 76850 - RNA, 64 nt, Human
agucucugggauggaggccagagagcuggucaggcucccccaucugcccagcacggccugcacu

SEQ ID NO: 76851 - RNA, 64 nt, Human
gggccugggggacugggagccgcagcagcucccccucccccacugccauaaaacauuaagaaaa

SEQ ID NO: 76852 - RNA, 64 nt, Human
cauuucauguaucuaucaaagcccaguucaccuccucccccaaacacacacacacacacacaca

SEQ ID NO: 76853 - RNA, 64 nt, Human
uaguugaugagggacuuucccugcuccaccgucacucccccaacucugcccgccucuguccccg

SEQ ID NO: 76854 - RNA, 64 nt, Human
uaugaggcuuuucccaccagcucccaacagaggccucccccagccaggaccaccucguccucgu

SEQ ID NO: 76855 - RNA, 64 nt, Human
ucauguccccaucaacaaccguccugcuccccaccucccccaggaaauaaggggccugcuccuc

SEQ ID NO: 76856 - RNA, 64 nt, Human
cuggaaaagcacuuuacagaugagauucccucuccucccccaccuucaagcacccuguucccuc

SEQ ID NO: 76857 - RNA, 64 nt, Human
acagugggaagauuuuaguucacacuuagucuaacucccccauuuuacagauuucucacuauau

SEQ ID NO: 76858 - RNA, 64 nt, Human
ucuguaggaccaucucucucccacuucuucuccccucccccaccgcaucuggccagauggacug

SEQ ID NO: 76859 - RNA, 64 nt, Human
cagagagaagaaguagguacgggccuuugguucccucccccagccccagcuuucuccuacaggg

SEQ ID NO: 76860 - RNA, 64 nt, Human
ugauuuaauuccugguugggauuuggccuccccucucccccaugcuaauuauuuacccuuguaa

SEQ ID NO: 76861 - RNA, 64 nt, Human
uggcauuuccuucugcuguuugcugcuuuugugccucccccacuuuccaucaccucuggagucc

SEQ ID NO: 76862 - RNA, 64 nt, Human
gauggaugcacguucacuacugugacggccgcaccucccccaugcaccccacccucccccaaag

SEQ ID NO: 76863 - RNA, 64 nt, Human
cugugacggccgcaccucccccaugcaccccacccucccccaaagcccggaucccgagaaagau

SEQ ID NO: 76864 - RNA, 64 nt, Human
caaaaauggagcccgcucuguggggaagccccgacucccccacgagaaacggucccacggugcg

SEQ ID NO: 76865 - RNA, 64 nt, Human
aagccagagcuaucuggugcuggugugccagccccucccccagccugccuagaaagggguggcu

SEQ ID NO: 76866 - RNA, 64 nt, Human
cuguugcagggaccggagcugaugggagcugcuucucccccaugccucacuggucccagaucag

SEQ ID NO: 76867 - RNA, 64 nt, Human
gaccacugagaaaugggugugggcacugacaguucucccccauuauuuggccaggaauugagcu

SEQ ID NO: 76868 - RNA, 64 nt, Human
augaagacaguccaguagacuugguagcgacccccucccccaaccccucucccuuuucagauaa

SEQ ID NO: 76869 - RNA, 64 nt, Human
ucuuucucucucucuccccuucucauacacaugccucccccaccaaagaauauaauguaaauua

SEQ ID NO: 76870 - RNA, 64 nt, Human
uuccuuucugugucuuacuccccccacacucucccucccccaucaccaucuucaauucuaauaa

SEQ ID NO: 76871 - RNA, 64 nt, Human
uauuauuuauuucgaccuuuuaggggagaaggaacucccccauucuuucaagagauuaaaaaua

SEQ ID NO: 76872 - RNA, 64 nt, Human
auaagaaauauaaccuuuuaagcuauuccaccuccucccccagccuaucucaaacugguggaau

SEQ ID NO: 76873 - RNA, 64 nt, Human
gaaugaacacuucauaaagauaaauugccccccucucccccacuuaccccuggcaaaggacuca

SEQ ID NO: 76874 - RNA, 64 nt, Human
ccgagccccugaaguagcugcccuccucuuuccgcucccccaucucggcccugcccauacucca

SEQ ID NO: 76875 - RNA, 64 nt, Human
ggcuccauuucaacaucuccccccaggcgauguucucccccaagacgaccagaaaauuguuuau

SEQ ID NO: 76876 - RNA, 64 nt, Human
gccucagcagauaauggcuccuggcugcgucagccucccccaccccucugcagacugccccgcg

SEQ ID NO: 76877 - RNA, 64 nt, Human
auuacagcaaacagcuggggaaggacaugcaguccucccccagcucugucaaugacuaugaccu

SEQ ID NO: 76878 - RNA, 64 nt, Human
cugacccuuuucuggcagugaauguaagcucuagcucccccaucuacuauaaagaaaugucuuc

SEQ ID NO: 76879 - RNA, 64 nt, Human
cuccuccgagacccccuuuucuuccccuuccucucucccccaccagggggcgcgcuuaaauuuc

SEQ ID NO: 76880 - RNA, 64 nt, Human
ggcugaacugagccuagcuaccuucucuacccaucucccccaucccccacugccacacccuccc

SEQ ID NO: 76881 - RNA, 64 nt, Human
caggcugcaaggagaaggaugccagccacccauccucccccaguucccagccuuuccccuguug

SEQ ID NO: 76882 - RNA, 64 nt, Human
aauacgacuaauuguauuuuuaauuuuuucuuuucucccccaauuuuuuuuuuuuuuuugagac

SEQ ID NO: 76883 - RNA, 64 nt, Human
cugccaaacgcucucaucugauuuuuccucccuucucccccaaccuccaaucacccugagucac

SEQ ID NO: 76884 - RNA, 64 nt, Human
agggacaccccacggcuccucccugccccugccccucccccagccuugaggugcccugcccggc

SEQ ID NO: 76885 - RNA, 64 nt, Human
cuccagggaaggaggcuggggugggaacacuggccucccccagaauaaaaccauguuuucuacc

SEQ ID NO: 76886 - RNA, 64 nt, Human
uccaggguuggugcccacgaguuagaggcacgcccucccccagcggcccucaggcuuuucucag

SEQ ID NO: 76887 - RNA, 64 nt, Human
ccuccucagugacuuuaacuagcucagaaacguacucccccaccaaccccaccucaccgccccc

SEQ ID NO: 76888 - RNA, 64 nt, Human
uuguguauucucucugggcagagaugccacuugccucccccaccaugccaucucugaagaauau

SEQ ID NO: 76889 - RNA, 64 nt, Human
agaccuggaguugccaaguucugucagacuccaucucccccagguucaaugaaggauaauaauc

SEQ ID NO: 76890 - RNA, 64 nt, Human
gacgcaugcacugcacuucuucguuuucuucuugcucccccauuggccugaguuucuugugcau

SEQ ID NO: 76891 - RNA, 64 nt, Human
caaauccaaggcugagacagucgugcgacuccuacucccccagagcgugacccggagcaggugc

SEQ ID NO: 76892 - RNA, 64 nt, Human
cgaauuugacuuuaugcaguguucugcagcaugccucccccacaucucauagcaccagguugug

SEQ ID NO: 76893 - RNA, 64 nt, Human
ggagugacagagucaacuucugcagcaccugcuucucccccacugucccuuccaucuuggaaug

SEQ ID NO: 76894 - RNA, 64 nt, Human
uggguuuuuaagagcaaauucugucccccccucacucccccaagugacaagauacuaaugaaga

SEQ ID NO: 76895 - RNA, 64 nt, Human
ucucaauuucagaugauaggugaauucccugccccucccccaccacugagaagcuagacuuuca

SEQ ID NO: 76896 - RNA, 64 nt, Human
cucuccauggcaggcaucccugccuugggcugcccucccccagaccccugaccacccccugggu

SEQ ID NO: 76897 - RNA, 64 nt, Human
uaccugugagcccccuacuggccggccggccccccucccccagccgccggccagcucccaaaug

SEQ ID NO: 76898 - RNA, 64 nt, Human
accaucuaauagcggguuacuuucacauacagcccucccccagcaguugaaugacaacagaagc

SEQ ID NO: 76899 - RNA, 64 nt, Human
aguucacacuggggaaacucauuuuccccugcagcucccccaaggugcaggagggcaggaucca

SEQ ID NO: 76900 - RNA, 64 nt, Human
cuagaacuucucucuuuagcuggccaucugaauacucccccaucacuaauuguuaaaaaaagaa

SEQ ID NO: 76901 - RNA, 64 nt, Human
cauguggcuggccacaccaagcaggaagcacaaacucccccaagcugacucauccuaacuaaca

SEQ ID NO: 76902 - RNA, 64 nt, Human
cuguuuacuucuagaccuggucaggcuccauccccucccccaccugccccugauuccccucguc

SEQ ID NO: 76903 - RNA, 64 nt, Human
cuacagcuuucuugcucccuucagcccccagccccucccccaucucccacccuguaccucaucc

SEQ ID NO: 76904 - RNA, 64 nt, Human
gaguucucccuguugucucaaagcgguacccauccucccccagaagcuguccccagcgagccuc

SEQ ID NO: 76905 - RNA, 64 nt, Human
aagugcuuguuuuaucauacuuccugccucuccccucccccaguuucuccuccccuaaaauaaa

SEQ ID NO: 76906 - RNA, 64 nt, Human
gcagaaacauaaccgugaagcucuuccuacccuccucccccaaaaacccaccaaaauuaguuuu

SEQ ID NO: 76907 - RNA, 64 nt, Human
agaaugugcagugaaccucaggcauuuaagacaccucccccaccgcccgccccccgcccccccc

SEQ ID NO: 76908 - RNA, 64 nt, Human
auuuccaaccuccccuguacuuaccuguuuucuccucccccaucccuacccuuguccacaggcu

SEQ ID NO: 76909 - RNA, 54 nt, Human
cagucaagacgauucgcugauucccucccccaccuguccugcagucuuugacuu

SEQ ID NO: 76910 - RNA, 64 nt, Human
ucccagagcggggugagggggcuuaugccccccccucccccaguguguugggugggguggaauu

SEQ ID NO: 76911 - RNA, 64 nt, Human
ggggggaacuuacucuaggaaaagccaugucucucucccccaggguggggggaccuguguugga

SEQ ID NO: 76912 - RNA, 64 nt, Human
cauccucauugccuccuguucugcccacgauccccucccccaagauacucuuuguggggaagag

SEQ ID NO: 76913 - RNA, 64 nt, Human
gaccggugggacuggaggaggaacggucacccuccucccccauggagguuuccagggguccccc

SEQ ID NO: 76914 - RNA, 64 nt, Human
agguucauuucuaggugacuguccuaggcuacugcucccccaggagacucaacacuaaauaaag

SEQ ID NO: 76915 - RNA, 64 nt, Human
cccagacagaggccagcccacaaccuaugacccccucccccaggacaccaccucccacccacag

SEQ ID NO: 76916 - RNA, 64 nt, Human
cuuggagcuaauuaagguuugcccugccugcagccucccccacaaauaaugaacagcagaaaga

SEQ ID NO: 76917 - RNA, 64 nt, Human
gugagaccccucccuuccagaauccaggccccaucucccccaacuccacagccccucccgagcc

SEQ ID NO: 76918 - RNA, 64 nt, Human
ccuccccccaaccaccagcagcagcagggcccuccucccccaccagcucuccccacagggcccc

SEQ ID NO: 76919 - RNA, 64 nt, Human
gccaagcugcuaagccaaagauggccccugacaccucccccagccccagcacaccagccugcac

SEQ ID NO: 76920 - RNA, 64 nt, Human
uuguuucacuccaccaucacucacucacuccccacucccccacccauggggaggagaccuuuga

SEQ ID NO: 76921 - RNA, 64 nt, Human
ucguucgcccaccaggccuaggcuacgcuccaugcucccccagcaaucucugccuacaccuccu

SEQ ID NO: 76922 - RNA, 64 nt, Human
cauuaagguauuuaaacuuggggguuucacugcucucccccaugauggagggagggagcccccc

SEQ ID NO: 76923 - RNA, 64 nt, Human
cguguuuacugcagcagugggaccuccgugcccacucccccagcucagaggcuuucucuuuuuu

SEQ ID NO: 76924 - RNA, 64 nt, Human
uauaguccuuugauuucuucccucucccuggugucucccccaagaccccaaauaaagcaauaca

SEQ ID NO: 76925 - RNA, 64 nt, Human
guggguuggagaagccagagccauuccaccuccccucccccagcaucucucagagaugugaagc

SEQ ID NO: 76926 - RNA, 64 nt, Human
ggcuucaaaggaacuugguggcaucagcaccccccucccccaaugaggacaccuuuuauauaua

SEQ ID NO: 76927 - RNA, 64 nt, Human
aaauaauuaacuaagcuucuaaaugccuagcucccucccccaaaggcgcuuucccccgauggag

SEQ ID NO: 76928 - RNA, 64 nt, Human
ggaagacgacguaauggcucucauguacccuugccucccccacccccuucuuuuuuuuuuuuua

SEQ ID NO: 76929 - RNA, 64 nt, Human
cauuccuuuuuugucucuucugcuuccucugccccucccccagccacgcagcacgggugccagu

SEQ ID NO: 76930 - RNA, 64 nt, Human
gauuugaguucuggaacacacaucauccccaccccucccccagcgugggcucaccauucuuagu

SEQ ID NO: 76931 - RNA, 64 nt, Human
cucccacuugcaacuauucuguuucucuccugggcucccccacuuucccuuccccaccccacuu

SEQ ID NO: 76932 - RNA, 64 nt, Human
ggcaggcacugccugcuacuugagggccaggaugcucccccagggaagaaacggaauagugugg

SEQ ID NO: 76933 - RNA, 64 nt, Human
uuuugcuucccaucugaagaguggaaauggggaacucccccagagguggauacuggggggcagg

SEQ ID NO: 76934 - RNA, 64 nt, Human
ggggcauuuuucuacaagaagcagucagccuucucucccccauaaggacuggcuguaaccuuaa

SEQ ID NO: 76935 - RNA, 64 nt, Human
augugacuuucgggugucggggcagcaugcccuucucccccacuuccuuacuuuagcgggcugc

SEQ ID NO: 76936 - RNA, 64 nt, Human
aagacugaagugcagaggcuggacuuggggcucucucccccagcuucuacaccugggcuccaag

SEQ ID NO: 76937 - RNA, 64 nt, Human
uccuucacucaagggccauuuccccagucccuaucucccccauccccucccggcuuauaggccc

SEQ ID NO: 76938 - RNA, 64 nt, Human
gugacaaauuugauuucaaagagcaaugcaucuucucccccagaucaucacagaaaucacuuuc

SEQ ID NO: 76939 - RNA, 64 nt, Human
cauguucagccagcagccuccuaagcccaccuuccucccccauuagagaacacccauccuaggu

SEQ ID NO: 76940 - RNA, 64 nt, Human
ucaaacacuacaugaaguuauuuuaguuaaagcccucccccaaaaguuauaaaaccauuuuauc

SEQ ID NO: 76941 - RNA, 64 nt, Human
aaggauucuaccugaacugaaaggacugugugaccucccccaagccaaccacuuucaccuggga

SEQ ID NO: 76942 - RNA, 64 nt, Human
ccaggcccugugugcggugcccaggcccuaggagcucccccagcccccagguccuccugaccac

SEQ ID NO: 76943 - RNA, 64 nt, Human
cuccugguuuacccccccggccugggcaucugaccucccccaccccagugugauuuaacaucca

SEQ ID NO: 76944 - RNA, 64 nt, Human
ugugcucucuuuuaugcccccucuauucuccucucucccccaggggauuuucaucucaacaaca

SEQ ID NO: 76945 - RNA, 64 nt, Human
gaauguagaccaugaucucaaguucuuccauuuucucccccacgaguggaaaauagacuucuac

SEQ ID NO: 76946 - RNA, 64 nt, Human
agccccaugggacacccgguggucuuucccaaaccucccccaaaacacaccuggagccagagcc

SEQ ID NO: 76947 - RNA, 64 nt, Human
aguagugcggugguggugaguguggcugcccuggcucccccagcucaccguggugcuguccuug

SEQ ID NO: 76948 - RNA, 64 nt, Human
cccugcagucaucucagagccccuucccgggccucucccccaaggcucccugccccuccucaug

SEQ ID NO: 76949 - RNA, 64 nt, Human
aacgggggcuggggguaagagaaaucuaacugcgcucccccaaccccucgcccugccaucuucc

SEQ ID NO: 76950 - RNA, 64 nt, Human
cuccggcagcucagggaguguuuuccugugaggccucccccaucaguggaccagagggagaagc

SEQ ID NO: 76951 - RNA, 64 nt, Human
uugugcaauacaguuucauuaacuccuucccccgcucccccaaaaauuugaauuuuuuuuucaa

SEQ ID NO: 76952 - RNA, 64 nt, Human
ugcagaguauaugaggcuugacagagucugcccccucccccacugcaccccaagagagagagcc

SEQ ID NO: 76953 - RNA, 64 nt, Human
acuccucaggcagugcccuuuccucccacuuuuccucccccauagccacaggccucugcuccug

SEQ ID NO: 76954 - RNA, 64 nt, Human
caaaauuauauguaacuucuacuaguuuuacuuucucccccaagucuuuuuuaacucaugauuu

SEQ ID NO: 76955 - RNA, 64 nt, Human
ggagggcugggagacccuccaggacauucccacccucccccaugcugccaaguuguagcuauag

SEQ ID NO: 76956 - RNA, 64 nt, Human
cuccacugucccugacaaccccuucguccggacccucccccacacaacuaugucuggucaccag

SEQ ID NO: 76957 - RNA, 64 nt, Human
ggaccuauagaccugugugaccagcccccaguuccucccccaguuccucccaggaagcccagga

SEQ ID NO: 76958 - RNA, 64 nt, Human
cuuuuuauuuaagugaauaauuuaaagucuucuccucccccacugccccugcaguaaagugcuu

SEQ ID NO: 76959 - RNA, 64 nt, Human
ucccggcgcccgagagaccggcacgccacggccccucccccaaggaacagagcaaaggauggug

SEQ ID NO: 76960 - RNA, 64 nt, Human
agcccguuugggguaggaguguggauggagaacccucccccaaggcuggugucuguaccauugc

SEQ ID NO: 76961 - RNA, 64 nt, Human
cagaaagaagccauagccagaaaggacagaaucucucccccacucccuugccccauaaccaaac

SEQ ID NO: 76962 - RNA, 64 nt, Human
ccaagugaggggugggcuugggcaauaaaggcaccucccccaacagccuggaguccagcgcagc

SEQ ID NO: 76963 - RNA, 64 nt, Human
acagccauuccccaggcuaugaagugacauaggccucccccacggugccuguguacggagccug

SEQ ID NO: 76964 - RNA, 64 nt, Human
aggcggcgggugccgcgccgugccgccuggcccucucccccaacgcccaggucuuggccuuggc

SEQ ID NO: 76965 - RNA, 64 nt, Human
caaacucaaucauuuuuuucccuuguaaaugccccucccccagcugcugccuucauauugaagg

SEQ ID NO: 76966 - RNA, 55 nt, Human
uacaggaaacucaaauaugacuccccucccccaaaaaacuuauaaaaugcaauag

SEQ ID NO: 76967 - RNA, 64 nt, Human
ccuggggcuacacuccugcauugcugcaauacugcucccccagccucuccccugccccucaacc

SEQ ID NO: 76968 - RNA, 64 nt, Human
cagcacagccucaucaaaaugcagcuggcaacuucucccccaggugccuucccccugcugccgg

SEQ ID NO: 76969 - RNA, 64 nt, Human
uauacgguaaagaaauuuaaaguguagaauuuuccucccccaaaaagucauguguugauaguag

SEQ ID NO: 76970 - RNA, 64 nt, Human
ccucuguguuagaggggagacugcacaaacuauccucccccagguugagacgucugcagagugg

SEQ ID NO: 76971 - RNA, 64 nt, Human
agacugcugugugcugcccgccugccugcuggcucucccccagccccacauccccucuggaaga

SEQ ID NO: 76972 - RNA, 64 nt, Human
cuccaaauucagggcgcgaucuggcaaaggcucccucccccacccucuuacuuuggagggaguc

SEQ ID NO: 76973 - RNA, 64 nt, Human
gggggcuccccagggcugacccugcagcuuugggcucccccauagugacugugccauaggaaag

SEQ ID NO: 76974 - RNA, 64 nt, Human
gagccucuuuccauuaaaaauugucaccaaugaacucccccaaacauggcuguggagagacaac

SEQ ID NO: 76975 - RNA, 64 nt, Human
agagugugggcagagagaauuauguggccucauccucccccaaggcugugcuugcagcccgggc

SEQ ID NO: 76976 - RNA, 64 nt, Human
agaugugccugcagccuagucccugcccaagcuucucccccagccacccucugccccuguggua

SEQ ID NO: 76977 - RNA, 64 nt, Human
aggacuucaggcuggauccaccacugggcucucccucccccagccuggagcacgggaggggagg

SEQ ID NO: 76978 - RNA, 64 nt, Human
accaagcucacaccuguccuucucaggcuggcaucucccccacccugugccccuuuucauggua

SEQ ID NO: 76979 - RNA, 64 nt, Human
cgaaggggagugagcuugagccuuugauaucuugcucccccacccuuccugaaacucuugaaau

SEQ ID NO: 76980 - RNA, 64 nt, Human
aguaccuggaccuguccaugccccuggaccaguacucccccagcuuucccgacacccggagcuc

SEQ ID NO: 76981 - RNA, 64 nt, Human
cggccuccagggcgcagaggcgccccccuccauccucccccaucccgggggccacggcaggggg

SEQ ID NO: 76982 - RNA, 64 nt, Human
uccugaaagauuaccagccagcaauagcccagggcucccccaaaagaauugguucagauuguaa

SEQ ID NO: 76983 - RNA, 64 nt, Human
auggcacuguccagcucugggcuagccagaucaacucccccacccgucuucuuccucuguccca

SEQ ID NO: 76984 - RNA, 64 nt, Human
caaggcuuuggugguaauccugugauuuuuuuuucucccccauccccucacuggcccaucccuc

SEQ ID NO: 76985 - RNA, 64 nt, Human
uccaugaccagcgugugcgcagggccuggucuuccucccccaagccaggccccuguccccaccc

SEQ ID NO: 76986 - RNA, 62 nt, Human
ugggcccugugcccuccuagaggagcaggcaccucccccagacuuggggugggggcccugcc

SEQ ID NO: 76987 - RNA, 61 nt, Human
ucagcccugugcaggccuagggcggcggggccucccccagccaggucggcucucagcaaua

SEQ ID NO: 76988 - RNA, 64 nt, Human
agaaucgcccggcccagcccuggagcccccuccacucccccaggccccuggccccggcgcuccc

SEQ ID NO: 76989 - RNA, 64 nt, Human
gcggagacuuauguaggagggaccuucccucuaccucccccaguuagugacaggaugaggaaaa

SEQ ID NO: 76990 - RNA, 64 nt, Human
aagaggaugauucuguuuuguugacucuugaaugcucccccaacauuccuuugguuuuccuaua

SEQ ID NO: 76991 - RNA, 64 nt, Human
uguggagccaaagccucucacagugcugauuuaccucccccaaaaugcccccaaacccccaugc

SEQ ID NO: 76992 - RNA, 64 nt, Human
uuucuggagaguugggcuaggccugaagcucccccucccccaccucugcuaggcagcccaggcc

SEQ ID NO: 76993 - RNA, 64 nt, Human
ucagcacuccagucccaucaccugaaccuucagucucccccaucuguuacacuagagggcugca

SEQ ID NO: 76994 - RNA, 64 nt, Human
ccauccccagcacccccugcuacaccucagcagccucccccaugcaaaaaggaaagagaaaaau

SEQ ID NO: 76995 - RNA, 64 nt, Human
uugguaaacaacucaauuuuccuuugagggaacccucccccacccuuugaagaguucaaguucu

SEQ ID NO: 76996 - RNA, 64 nt, Human
cuggccagaggacucugucccgggggaccguguccucccccauguccugccuaggcccucagag

SEQ ID NO: 76997 - RNA, 64 nt, Human
aaguuuucagaauucucucaauuuuuaaguuuuucucccccauauuuugugaaaagcaguggua

SEQ ID NO: 76998 - RNA, 64 nt, Human
aaaauaaaagcgaagcagacaaaaagaaccuuaccucccccacaauacaacauugggcugcuga

SEQ ID NO: 76999 - RNA, 64 nt, Human
cucagcucuaggcuguucuguagcuuaucugccccucccccacuuucaagacagaugagcagga

SEQ ID NO: 77000 - RNA, 64 nt, Human
ggaucccauggguggcacauugggacuucucucccucccccaucuacacagaagacugucacca

SEQ ID NO: 77001 - RNA, 64 nt, Human
ugaggagacuucaccacgcccuccccucccugcccucccccaucuccccggucucccuuguucu

SEQ ID NO: 77002 - RNA, 64 nt, Human
caccaccaggacgcugugcucggccauggcgcgccucccccaagggcucaucugugcaacaacc

SEQ ID NO: 77003 - RNA, 64 nt, Human
cucacuguugcaguggccuggccguucagccugucucccccaacaccccgccugccuccuggcu

SEQ ID NO: 77004 - RNA, 64 nt, Human
cugccuggacggcuguucugugacuugacaguggcucccccagccccaaagccagcccccuuca

SEQ ID NO: 77005 - RNA, 64 nt, Human
gccugagcuccugagccagcggggccuggccuaccucccccauccccugcuucccuuggaggca

SEQ ID NO: 77006 - RNA, 64 nt, Human
aggaggucaggaccacgccccuggccucuccccacucccccauccuccucccuggguggcugcc

SEQ ID NO: 77007 - RNA, 64 nt, Human
ccccucugcccccuucuaccuccaccucagcacccucccccagcuugauguuugggucucccca

SEQ ID NO: 77008 - RNA, 64 nt, Human
caccucucucccagggccagacagcccuuccuggcucccccaucccccuaugggcucccagccc

SEQ ID NO: 77009 - RNA, 64 nt, Human
cuaggacugcacgcuggccccacgguaacccccccucccccaccaacauccugcagggaugggg

SEQ ID NO: 77010 - RNA, 64 nt, Human
caaggguggcaggucacugucacugccgacaucccucccccagcagaauggaggcaggggacaa

SEQ ID NO: 77011 - RNA, 64 nt, Human
ucacacaucugggugcccugaaagggcccuuccccucccccacuccucuaagacaaaguagauu

SEQ ID NO: 77012 - RNA, 64 nt, Human
uggcagugagggcugcccagauccccggcacacacucccccaccugcuguuuacaugacccagg

SEQ ID NO: 77013 - RNA, 64 nt, Human
ugcuccuggggcagagccuccggcacccaguggccucccccagacagagccaccccugccgugg

SEQ ID NO: 77014 - RNA, 64 nt, Human
ccugcucccccuuuguccuccaucccgacuccaucucccccaccaggcuggucaccccaggcca

SEQ ID NO: 77015 - RNA, 64 nt, Human
agcaccacggggucgggggaggagcacccccagccucccccaggcugcgccugcccgcccgccg

SEQ ID NO: 77016 - RNA, 64 nt, Human
ccccuugaccccacacgccggggcuggcccugcccucccccacggccgucccugacuucccagc

SEQ ID NO: 77017 - RNA, 64 nt, Human
accccacugcagccucugcccagccagcccugcgcucccccacccugacagugagcuguguccu

SEQ ID NO: 77018 - RNA, 64 nt, Human
uaacaguacagacccuaaauuuuauuauuuguugcucccccaaucugauaccaaauguuuaaag

SEQ ID NO: 77019 - RNA, 64 nt, Human
ugaggcaaaaaacuauggguuuuuucaggugaaccucccccauuuaaauacucagaagauaagg

SEQ ID NO: 77020 - RNA, 64 nt, Human
aguacauuuggcuguuuuauagccuuuuucuucccucccccaaagaauucuguuugccuaacuc

SEQ ID NO: 77021 - RNA, 64 nt, Human
acacuuuuuuaaaggggauuaaaaaacacagccucucccccaaaggguguccguucuuaauucc

SEQ ID NO: 77022 - RNA, 64 nt, Human
gcgggaggagcagcuguguguccccggcaccucacucccccaaaaugacacccaccgucgucag

SEQ ID NO: 77023 - RNA, 64 nt, Human
ggugccccucuucugaccaacacacacacgaccccucccccaacacccccaaauucaagagugg

SEQ ID NO: 77024 - RNA, 64 nt, Human
ggucuccuugggaggugccaucucucaucugucccucccccagccaugaaagcccauuccccua

SEQ ID NO: 77025 - RNA, 64 nt, Human
ccgggaccuucucucaauuuucauggcggaaugucucccccagcugccacacacacauuuugua

SEQ ID NO: 77026 - RNA, 64 nt, Human
ggcagugggcggacgacuggcuggugcaccugaucucccccaauguguaccgcacgcccaccga

SEQ ID NO: 77027 - RNA, 64 nt, Human
cugugagggugccugaggcugaauggcuccaccccucccccagcccugcuucugaccuguggcu

SEQ ID NO: 77028 - RNA, 64 nt, Human
caccccguuucccuggugcccagagaacccaccucucccccaagggccucagccuggcuguggg

SEQ ID NO: 77029 - RNA, 62 nt, Human
ugcucccacccaccugacuccaaauaaaguccuucucccccagcucugggcaggccuaucug

SEQ ID NO: 77030 - RNA, 64 nt, Human
aaacccaggacaucugugccaggcuucccaugcccucccccaacagucccucagcuucacccag

SEQ ID NO: 77031 - RNA, 64 nt, Human
cccuucagugcaggccagccuggcagcuggaagccucccccacgccgaggcuuuggagugaaca

SEQ ID NO: 77032 - RNA, 64 nt, Human
auaagugcucuuggggguggcucuaccccauuaccucccccagccacaacuccuggccuucgac

SEQ ID NO: 77033 - RNA, 64 nt, Human
ucugcagccacucuggcucccaagacuucccugacucccccacuccccuccuugccaggggcac

SEQ ID NO: 77034 - RNA, 64 nt, Human
acuccucccggcuuccaaauaccacucuguccggcucccccagcucucacucagcccgggaagc

SEQ ID NO: 77035 - RNA, 64 nt, Human
cauuuaggggccgacgggggcagcugccccaucccucccccaaccccuguauccccaccccgua

SEQ ID NO: 77036 - RNA, 64 nt, Human
cacagaggcugcaugaccuccccucccggcgucccucccccaaccuccuuccgcaacugggcuu

SEQ ID NO: 77037 - RNA, 64 nt, Human
gcccacagggcaagaacccggggccucccgccuccucccccaucccccugccuccccugggcac

SEQ ID NO: 77038 - RNA, 64 nt, Human
aucucccucucaaccucaacccaccugcaugcaucucccccagaggaaacacugaggguagggg

SEQ ID NO: 77039 - RNA, 64 nt, Human
cagacaggccggcguucagccuccaaggggcucacucccccaguugccaaacacuguggaucuc

SEQ ID NO: 77040 - RNA, 64 nt, Human
ugcagccucccuccaugcaucccacauacaagcacucccccacuccccagcguggccucacugu

SEQ ID NO: 77041 - RNA, 64 nt, Human
uucaccccaacuugugacugcucacuuaugacgucucccccaguacccuccaucucaaauaggc

SEQ ID NO: 77042 - RNA, 64 nt, Human
agccccuauuuuuuccaagcacgaagccaccagucucccccagggagcaucaggaagggacaug

SEQ ID NO: 77043 - RNA, 64 nt, Human
ccuggauagacgaguugauuuccucccucugccccucccccagccaugccagcuggccuuugua

SEQ ID NO: 77044 - RNA, 64 nt, Human
cucacaggcuucugccgccccccucaucuccacccucccccauaucuguuugcauuaggaguuc

SEQ ID NO: 77045 - RNA, 64 nt, Human
cuaggccuauaugggacaaucaauucugacugagcucccccauuccccucgggugaggaugacu

SEQ ID NO: 77046 - RNA, 64 nt, Human
aaggagugccuguguccuguacugcccucgcugucucccccaccacccuacuugacagcguggg

SEQ ID NO: 77047 - RNA, 64 nt, Human
gugcuugaaguggcaugccuccucugcugcagggcucccccacccccacacggccucuaaagau

SEQ ID NO: 77048 - RNA, 64 nt, Human
aacaggcuuauuuucugugaaggaaccaacugaucucccccacccuuggauuagaguuccugcu

SEQ ID NO: 77049 - RNA, 64 nt, Human
gcugaaaucaaacauaccccaaguuaaaaugaagcucccccacccccacucccggccccgguuc

SEQ ID NO: 77050 - RNA, 64 nt, Human
ggucauacggaguugaaucagaccugguucccgccucccccaaggcucaugguccuuggaggac

SEQ ID NO: 77051 - RNA, 64 nt, Human
cacagauaaguggcucuuacccagcucucagugacucccccacaaaacagcaacagccuccacc

SEQ ID NO: 77052 - RNA, 64 nt, Human
cugcugcuggagcaggcaccuugggcugggccugcucccccagggcccagggccccccagcuua

SEQ ID NO: 77053 - RNA, 64 nt, Human
gaucuugggguauaacacauuuucauuuacuuuucucccccaaaaucaucuuauccaauuuuau

SEQ ID NO: 77054 - RNA, 64 nt, Human
acgggaucccaaacuuggauagagccaguucaaccucccccaauccauacacauacauaccuag

SEQ ID NO: 77055 - RNA, 64 nt, Human
uggagcagaggggcugaauagcagaagguugcaccucccccaaccuuagauguucuaagucuuu

SEQ ID NO: 77056 - RNA, 64 nt, Human
uucuccucuggagaucuugcacguaucuguuuuccucccccaugaacuagaaaaccacuuacuc

SEQ ID NO: 77057 - RNA, 64 nt, Human
guaagagccaguuuaaaucugcacucugcugcuccucccccacccccaccuuccacuccauaca

SEQ ID NO: 77058 - RNA, 64 nt, Human
guuugacuuuguuauaaaaauagggcucccccaccucccccauuucuguguccuuuauuguagc

SEQ ID NO: 77059 - RNA, 64 nt, Human
cacagaucuguuugacuuuguuauaaaaauagggcucccccaccucccccauuucuguguccuu

SEQ ID NO: 77060 - RNA, 64 nt, Human
aggagcuuugacucaggagccugugacauacccccucccccaccguugucucaugccaguaaca

SEQ ID NO: 77061 - RNA, 64 nt, Human
ggcacccccgucaagagugaauucccucacucgucucccccaacagcuggacccugaccagcuc

SEQ ID NO: 77062 - RNA, 64 nt, Human
ccucaaguggaguuagaaggaagguagaggggcucucccccaggauuuugguguuuugacuaac

SEQ ID NO: 77063 - RNA, 64 nt, Human
augcuuaaauccaaguuguuucuccagcugucaccucccccaggagaucaggauuccacugacg

SEQ ID NO: 77064 - RNA, 64 nt, Human
cuacacucuguaaggaccuggggcaggauaucuucucccccagggaucuucuauuuaaguggcu

SEQ ID NO: 77065 - RNA, 64 nt, Human
cccucacagcccccugucuccagugugagucaugcucccccaggaguuccaggagaacucagcc

SEQ ID NO: 77066 - RNA, 64 nt, Human
agacccaccccaaucccagacuucacacaguauucucccccacgccguccuaugaccaaaggcc

SEQ ID NO: 77067 - RNA, 64 nt, Human
uuuauuacaaaauuauguucuauuuuaaaguccacucccccaaaauacugauuucuuccaugga

SEQ ID NO: 77068 - RNA, 64 nt, Human
aacacacccugcccugaggggcuguccaggccuucucccccacacccucaggccgagauccgug

SEQ ID NO: 77069 - RNA, 64 nt, Human
acucggacccugacugaggauggcagcucuucugcucccccaucaggacuggugcugcuuccag

SEQ ID NO: 77070 - RNA, 64 nt, Human
ccugugcaccugggggguccuggccccugugaugcucccccauccccacccacuucuacaucca

SEQ ID NO: 77071 - RNA, 64 nt, Human
acucccacccacaccugccucccucuuaccccugcucccccacacugcaggaggauuugucucu

SEQ ID NO: 77072 - RNA, 64 nt, Human
aaccuugaggggcuagguucagcuuucucgcgcccucccccaugggggugagacccucgcagac

SEQ ID NO: 77073 - RNA, 64 nt, Human
gagcuggggugcuuugaagauaaucccuaccccucucccccaaaugcagcugaagcauuuuaca

SEQ ID NO: 77074 - RNA, 64 nt, Human
agguacugccgaaugcggugcaaaauuucccccucucccccaguucgcagugccuggagccgcu

SEQ ID NO: 77075 - RNA, 64 nt, Human
cuucucuuagagguuaagcagggucauuaacauccucccccagucccuaacaucacauuguccu

SEQ ID NO: 77076 - RNA, 64 nt, Human
uggggagggacaagggauucugggaagcuugagccucccccaaagcaaugugagucccagagcc

SEQ ID NO: 77077 - RNA, 64 nt, Human
uuccugugaaguuuaauugucucaacgccucccccucccccauucccuccauuuuucucccaag

SEQ ID NO: 77078 - RNA, 64 nt, Human
uucucccuuucuccucuccuuuuucucuucacaucucccccauagcacccugcccucaugggac

SEQ ID NO: 77079 - RNA, 64 nt, Human
agaagcagcugugggggucccaguggagaugagccucccccaugccuccagcagccugacccuc

SEQ ID NO: 77080 - RNA, 64 nt, Human
ccuccagggggacugcuccaacaggaaagagccccucccccacuucuaagcacugaguuaggag

SEQ ID NO: 77081 - RNA, 64 nt, Human
agaggcccagaggcugcccucugagguccccacucucccccagggcugccccuccaggugagcc

SEQ ID NO: 77082 - RNA, 64 nt, Human
cuggaauccugguccccagcaggagagccuaguccucccccagccccuccagccaccagggugu

SEQ ID NO: 77083 - RNA, 64 nt, Human
uucauuuugaaaguguuuuucucauucuccauaccucccccaagcucuccuccagcccuuccca

SEQ ID NO: 77084 - RNA, 64 nt, Human
ggggggcagccccaccccuagucugcccuccccucucccccaggcucuuucuccagcccugucu

SEQ ID NO: 77085 - RNA, 64 nt, Human
uacaugaggcuuuagcucucuuuugucagcaacccucccccaucccuaguuauuagguuaaaaa

SEQ ID NO: 77086 - RNA, 64 nt, Human
cccaggaugcacguccucagagggagcagccuaucucccccaagcuggaggcggcagaggacug

SEQ ID NO: 77087 - RNA, 64 nt, Human
ggccccagacaccagccagacccaggcugcaggccucccccaggagccuccaggauggagaugg

SEQ ID NO: 77088 - RNA, 64 nt, Human
ccacgggugagcacugaggccccagguguccucccucccccacugucugggacacaggacaggu

SEQ ID NO: 77089 - RNA, 64 nt, Human
gccuacggaaggggcuuaaugcaugugccugccccucccccagcuguuuuuaaugaaacugaaa

SEQ ID NO: 77090 - RNA, 64 nt, Human
uuuaugcugcucuuugcgguuuguugauccccuccucccccacucucaauaccuagagagugaa

SEQ ID NO: 77091 - RNA, 64 nt, Human
ugggcugacaguaucagguggaucccgcuucccccucccccaagaagucagccaacacgcagcu

SEQ ID NO: 77092 - RNA, 64 nt, Human
guuagagcggagagggcuagcccugagcccggcccucccccagcuccuuggcugcagccauccc

SEQ ID NO: 77093 - RNA, 64 nt, Human
agauccuggcccugagccagcccugugcuccucccucccccaacacucccuaccaacccccuaa

SEQ ID NO: 77094 - RNA, 60 nt, Human
gccggaaguuccuaaacuaaagcugcucuucucccccaguguuggagugcaaggaggcgg

SEQ ID NO: 77095 - RNA, 64 nt, Human
gguggguccaggcucauucugcuucugauuuccccucccccagggcucauuuucccccuuuuuc

SEQ ID NO: 77096 - RNA, 64 nt, Human
uggaggggaccccuugggcccucuggggcuuccccucccccaccugguugggguagagcaaaag

SEQ ID NO: 77097 - RNA, 64 nt, Human
acucuuccgaggucucccugaaaugaauguauuucucccccaaaagagcugauauuuaauguuu

SEQ ID NO: 77098 - RNA, 64 nt, Human
ucucucggggaaaccaaggcccagccccuccccccucccccaggugcuagagagccaggcagag

SEQ ID NO: 77099 - RNA, 64 nt, Human
cucucccccagccgcacgggcacuggaggucucgcucccccagccuccgacccgaggcagaaua

SEQ ID NO: 77100 - RNA, 64 nt, Human
gaugacuccuacaucuaaguggccccuccacccucucccccagccgcacgggcacuggaggucu

SEQ ID NO: 77101 - RNA, 64 nt, Human
uccaguuuuuguacccguguccuugucuccccuccucccccaucuggggaugugucuguguucc

SEQ ID NO: 77102 - RNA, 64 nt, Human
gcuugacagcaugagguguugugcauuuguucagcucccccaggcuguucuccaggcuucacag

SEQ ID NO: 77103 - RNA, 64 nt, Human
aaggaaguaacaugugaggcucuccccuccuccccucccccaucauaaagauauuuugaaaucc

SEQ ID NO: 77104 - RNA, 64 nt, Human
cuuggagccagguucacggggcuguuuccuccuccucccccagauguccccccugucaccgggc

SEQ ID NO: 77105 - RNA, 64 nt, Human
gagagagauguuggagccacccaucaggcaugcucucccccaccucuguccagcccgccucacg

SEQ ID NO: 77106 - RNA, 64 nt, Human
ggcccuccuagcccauggcagacccagaccucuucucccccaggaauuagaaguggcaggagag

SEQ ID NO: 77107 - RNA, 64 nt, Human
ucccaagcaacacagaccacucuuccccuugccccucccccagagggacuugacuuucuuucug

SEQ ID NO: 77108 - RNA, 64 nt, Human
gcagaggaggcugccugcugugauacccccuuaccucccccagugccuucuucagaauaucugc

SEQ ID NO: 77109 - RNA, 64 nt, Human
ggcuaguuccuaguuguucuuacccugcuucuuucucccccagaaucgacauaguccagaccac

SEQ ID NO: 77110 - RNA, 64 nt, Human
auuaccgaauccugacugcaaggcccaccugccccucccccacagagccuccagagcuagcuga

SEQ ID NO: 77111 - RNA, 64 nt, Human
gccccuucucuuucccuuauuuaggagcccugaacucccccagagucuauccauucaugccucu

SEQ ID NO: 77112 - RNA, 64 nt, Human
ugcuggggucacuucuuugcccacgggcucccugcucccccaguuuuuuuucucucuuuguuaa

SEQ ID NO: 77113 - RNA, 64 nt, Human
ucugcaauaacuggaccagggggagcugcugucacucccccauccccgaggcagcccagucccu

SEQ ID NO: 77114 - RNA, 64 nt, Human
ccagcacuucucccacuuugucccgagccuccuucucccccagcaggggcacaggccuggcacc

SEQ ID NO: 77115 - RNA, 64 nt, Human
caucucugccccaucccaacugcaccagcacugccucccccagggauccucucacaucccacac

SEQ ID NO: 77116 - RNA, 64 nt, Human
agucccgcgcugucuucaaaggccccugucuccccucccccacguuggggacgccccucccaga

SEQ ID NO: 77117 - RNA, 64 nt, Human
ccaccagcaaacagacccuguggccccugcccggcucccccacccauucugcuccccuagagac

SEQ ID NO: 77118 - RNA, 64 nt, Human
gccgcaaaacacacagucaggcuuccagcacauucucccccauuuggaggauacucgaauguca

SEQ ID NO: 77119 - RNA, 64 nt, Human
uuuaccaggaaaacaaagaauguguuaagggaugcucccccaccccacaucuuaagucagugug

SEQ ID NO: 77120 - RNA, 64 nt, Human
uucuuccuuccccucccucccucacuuccucccucucccccauccuuccauucuuccccucccu

SEQ ID NO: 77121 - RNA, 64 nt, Human
uaugaugcugccggcacagcugggauacacacggcucccccaggccugagcugcuucacuaggg

SEQ ID NO: 77122 - RNA, 64 nt, Human
cuuagaaucuccuccagaggacucauagagcugccucccccaggauggugaaguugggagcaaa

SEQ ID NO: 77123 - RNA, 64 nt, Human
aaaauugugcccuuguaccgaugcagcucucuuucucccccaccucuugcgagauaagagggau

SEQ ID NO: 77124 - RNA, 64 nt, Human
gaaucuggggggagagaggaaggacaggucaggucucccccagccccuucugcuccugucuccu

SEQ ID NO: 77125 - RNA, 64 nt, Human
gggguugguuccauuucggccaccaggacugccccucccccacuccucccaauuccuauggagc

SEQ ID NO: 77126 - RNA, 64 nt, Human
aggcugcuucauguggaccuugucaagcugcucccucccccagcgucaaauuguuaucaggugc

SEQ ID NO: 77127 - RNA, 64 nt, Human
gcaggugucacggugcaagucucccccugcaccccucccccagcuugagccgugucaccccccu

SEQ ID NO: 77128 - RNA, 64 nt, Human
agacuugagucugaggccccaggcccuaggauuccucccccagagccacuaccuuuguccaggc

SEQ ID NO: 77129 - RNA, 64 nt, Human
caggucucucuuccuuguccccccugcuuuucuccucccccaugcccaaccccuguggccgccg

SEQ ID NO: 77130 - RNA, 64 nt, Human
uauuuguauucauaauggcuuuuuaucuaccuuccucccccaacaaaucauuauccaccccccu

SEQ ID NO: 77131 - RNA, 64 nt, Human
gucucaggauagcagagucugaaaauaccuuggucucccccauuaugugagcccuuacuugaga

SEQ ID NO: 77132 - RNA, 64 nt, Human
acaguguuucauaaggccauccuguuucccccaacucccccauuuuugguuuguuucuuuuuaa

SEQ ID NO: 77133 - RNA, 64 nt, Human
cugcacucucuucucggcugcacuaaagcuggcacucccccagccguucucaugcaaaauaccu

SEQ ID NO: 77134 - RNA, 64 nt, Human
gcggacucgcccccaggaacgcucuccucgagcccucccccaaacagacucgcuagcacucaag

SEQ ID NO: 77135 - RNA, 64 nt, Human
aaucacaagcucugccucuuucuggccucacccucucccccaacccgggcacccucggcccucc

SEQ ID NO: 77136 - RNA, 64 nt, Human
uguccucagaaaccucugguucucccccuucccccucccccaggcugcccuggcacccaaauug

SEQ ID NO: 77137 - RNA, 64 nt, Human
aguuucccuggugcccuucccuggaggucucucccucccccagagccccucaugccacaguggu

SEQ ID NO: 77138 - RNA, 64 nt, Human
aguguguccuggggacuuccucagagcgagaaaccucccccaaugucuucaagacuuuucucuc

SEQ ID NO: 77139 - RNA, 64 nt, Human
gacucuacagauugcccuccaagugaggacuuggcucccccacuccuucgacgcccccaccccc

SEQ ID NO: 77140 - RNA, 64 nt, Human
guuugaugucaucagcaccauccaucaggacuggcucccccaucugcuccaagggagcgugguc

SEQ ID NO: 77141 - RNA, 64 nt, Human
uggggaagggucagagaugccagcccccugggaccucccccauccuuuuugccuccaaguuucu

SEQ ID NO: 77142 - RNA, 60 nt, Human
ugcagucugccccuuccuagccccuguucccucccccaacccuaucccuccuaccucacc

SEQ ID NO: 77143 - RNA, 64 nt, Human
uguggcugcucuuaaggugggggauagaggaugccucccccacagacccuaccccaagaccccu

SEQ ID NO: 77144 - RNA, 64 nt, Human
uuuuuaaauuuuaacuuauaucagucacuugccacucccccacccuccuguccacaacuccuuu

SEQ ID NO: 77145 - RNA, 64 nt, Human
ccuaaaaaacuuucuccucuuuguccuccuuuuucucccccacucugagguuuccccaagagaa

SEQ ID NO: 77146 - RNA, 64 nt, Human
uguuuugucaaucaauauaaaauauuuaugaggucucccccacccccaggagguuauaugauug

SEQ ID NO: 77147 - RNA, 64 nt, Human
acaaggccucucuuccacaugaucauuugcaaaccucccccagccccuaccauccaauguggaa

SEQ ID NO: 77148 - RNA, 64 nt, Human
gguguggccuucccuucuaccuagcgggauggggcucccccaggggcugucccggaggcggugg

SEQ ID NO: 77149 - RNA, 64 nt, Human
uuguuauguaaugucuuaugaugugugccucucccucccccaaaccuguuuacagucaauuaua

SEQ ID NO: 77150 - RNA, 64 nt, Human
cagcugcccgugggggccccuucgcgcugccagccucccccaaccaccugcccuccccgccuuc

SEQ ID NO: 77151 - RNA, 64 nt, Human
gcagugaaugcaaggguuacuuuucucuggggaccucccccaucacccagguuccuacucuggg

SEQ ID NO: 77152 - RNA, 64 nt, Human
ugcauuguuauuccaaagagcagccaacaguggccucccccaggcccuacccugcaaugggauu

SEQ ID NO: 77153 - RNA, 64 nt, Human
ucuaucugggaacucacccccagcgcacacacaucucccccagggucccaaggccccgcagcuu

SEQ ID NO: 77154 - RNA, 64 nt, Human
acaaaagcaucuuuuuuguuauuuguuugcaucccucccccacacccugguguuuuaaaaugaa

SEQ ID NO: 77155 - RNA, 64 nt, Human
cagucuacaacugauaaaaccuuaugauucuuuucucccccauuaugccccuauauauaucaag

SEQ ID NO: 77156 - RNA, 64 nt, Human
acucugggagauacucugcaaguugaccuggccucucccccacaggaacaaaacacugccucca

SEQ ID NO: 77157 - RNA, 64 nt, Human
acugcaacuucuguauccuuccuuccccuccacccucccccacaaaauucaagggaaaguaaag

SEQ ID NO: 77158 - RNA, 64 nt, Human
ugcccacucggggagccuucucuguuucuggggccucccccaccauagcucugauucccacccc

SEQ ID NO: 77159 - RNA, 64 nt, Human
ccuccucggaucaccgagaguagccgagagccugcucccccacccccuccccaggggagagggu

SEQ ID NO: 77160 - RNA, 64 nt, Human
cgcaccaaggggugcuguaugcucuaggcauccccucccccaggggauuuucuaaguagauggg

SEQ ID NO: 77161 - RNA, 64 nt, Human
uggugcgcacuccuuaaagaggacuauuuagccucucccccagugcuucagccccacccgauaa

SEQ ID NO: 77162 - RNA, 64 nt, Human
acuggccacucacucagcccagagucccuaagugcucccccacuuaucucugcaucucuccaau

SEQ ID NO: 77163 - RNA, 64 nt, Human
uaaagagaugcccucuguuucauuagcucuaguucucccccagcaucacuaacaaauaugcuug

SEQ ID NO: 77164 - RNA, 64 nt, Human
gcagaguucacccugugcccuccguuauaagucccucccccagcccugucaugugccuugggcu

SEQ ID NO: 77165 - RNA, 64 nt, Human
uccacugcacaacucgggcgggggugugacaccucucccccacccccgacuccgugguuuccgu

SEQ ID NO: 77166 - RNA, 64 nt, Human
gcuguagcacaggauggaguuugauuuaucccuccucccccaacaccuaggaacugaaucuuuu

SEQ ID NO: 77167 - RNA, 64 nt, Human
cccuacucugccccuaagcuggcuguaccuguuccucccccauaaaaugauccugccaaucuaa

SEQ ID NO: 77168 - RNA, 64 nt, Human
aucugggguagggggcaccccuacagugggaccccucccccauuauucuuucuguccagccccu

SEQ ID NO: 77169 - RNA, 64 nt, Human
ucuauuuuaaaauaauaauaacacaaaaaugccccucccccauuuuuuuuuaaaguucaguaug

SEQ ID NO: 77170 - RNA, 64 nt, Human
cccugauacuuccaauuccuggaaccccagcccacucccccaucccuccucccuaucaaacuag

SEQ ID NO: 77171 - RNA, 64 nt, Human
gagucuccuccccauguacccaaggaagauggagcucccccaucccacacgcacugcacugcca

SEQ ID NO: 77172 - RNA, 64 nt, Human
cucuuccucacaugugcugcgaccucucucagggcucccccagccauuccuucuuuccuuccug

SEQ ID NO: 77173 - RNA, 64 nt, Human
cacccaguccacugcagagacugcacugcggucccucccccagcccgaggcccacggagguucc

SEQ ID NO: 77174 - RNA, 64 nt, Human
cccacccacugccaucccccuucugugugucccucucccccaguuaugaggcccagggccugag

SEQ ID NO: 77175 - RNA, 64 nt, Human
aggaacggcccugcaggagcagggcggcugccgacucccccaaccaaggaaggagccccugagu

SEQ ID NO: 77176 - RNA, 64 nt, Human
aagccucggccucagcuccguuuccgccuguucccucccccaggauaaugaaugguuacugcac

SEQ ID NO: 77177 - RNA, 64 nt, Human
cuuccacccgcaggccucccaugcuccaagcagccucccccagcacuugcggccgcucagcccu

SEQ ID NO: 77178 - RNA, 64 nt, Human
aagugcaagaaaugaccgacaucacguggcucaacucccccagucagguggcgguagugcccug

SEQ ID NO: 77179 - RNA, 64 nt, Human
cuucccccuccccccuccucccacugucucucaccucccccaccccccacucucucucaucucu

SEQ ID NO: 77180 - RNA, 64 nt, Human
acuagcuuuccuagaauuccauuaauaaaugcugcucccccauauagucuucccuucuguauaa

SEQ ID NO: 77181 - RNA, 64 nt, Human
caucaccaugcaugguggcgaaugcccccaaacucucccccaaauguauuucucccuucgcugg

SEQ ID NO: 77182 - RNA, 64 nt, Human
aaucgagaauguuugugaacucuauccacauccccucccccaccugccaaauaaccuguucaaa

SEQ ID NO: 77183 - RNA, 64 nt, Human
ccaugcuuucucuacucccugccucaaaccaccccucccccagaugguacuucaguuuggaucu

SEQ ID NO: 77184 - RNA, 64 nt, Human
uuuuuucuacuuguuauuuacuauggccgcccugcucccccaaugaaaggccagcuucgaagaa

SEQ ID NO: 77185 - RNA, 64 nt, Human
cucaagccugucucaccaguggccugcccucucgcucccccacccagcccacccauugaagucu

SEQ ID NO: 77186 - RNA, 64 nt, Human
cccagcuucugucugucucacugucuucccuccccucccccagcugagguguggcccucaggcc

SEQ ID NO: 77187 - RNA, 64 nt, Human
cagcuucacccgggucucccugucucagcaccuccucccccaauucccaggucucacaucccac

SEQ ID NO: 77188 - RNA, 64 nt, Human
uaugucuugccaucacuuuaaaggacuagccccacucccccauguguauacacaaggaaauugc

SEQ ID NO: 77189 - RNA, 64 nt, Human
guauuaaguaaccuguuuugaauccagacauucacucccccacuugcuaugacuacccuccuuu

SEQ ID NO: 77190 - RNA, 64 nt, Human
ccuuugaccccagcagcuuggauggggugccgggcucccccauaguucacugacugucuccuuu

SEQ ID NO: 77191 - RNA, 64 nt, Human
cuccaccuccaaggagaggcuccucagugugcaccucccccacauccguccucucugccggccc

SEQ ID NO: 77192 - RNA, 64 nt, Human
aucucuuagggacccagaccccuaaauucuccuccucccccauuuugauguuaagguggagagg

SEQ ID NO: 77193 - RNA, 64 nt, Human
cccuuguugcccuagagugggacccagcccucaccucccccagagcuaaccugggaggugcuga

SEQ ID NO: 77194 - RNA, 64 nt, Human
cuagaaccaaaucaaaguguaauucucccuccagcucccccaaaccccagaguuuugggguugu

SEQ ID NO: 77195 - RNA, 64 nt, Human
gacuuaggauccuuuuaucacaaaucgggauucucucccccaccccgaauucugucugcuuaaa

SEQ ID NO: 77196 - RNA, 64 nt, Human
cagacuuugccacugacuucucccacccuucugucucccccauaauaguuuauuugguuggucu

SEQ ID NO: 77197 - RNA, 64 nt, Human
uggagagguugauaugcaccuguacaguaauucacucccccauuucacaucuuugucagagaau

SEQ ID NO: 77198 - RNA, 64 nt, Human
cccuagaccagcuccucuccaauccugagggccccucccccaacccaacucgacccucccuccc

SEQ ID NO: 77199 - RNA, 64 nt, Human
cacccgccccugcccagacagggugaggaaagggcucccccagugagguugguccgaggcugug

SEQ ID NO: 77200 - RNA, 64 nt, Human
ucaguaccuguugaaaaaaacugguucuccaccccucccccauacaaaauccacaacaaagcgc

SEQ ID NO: 77201 - RNA, 64 nt, Human
agggucuccccuccugcacacagggcaguccuuacucccccaccacucaggccacaguggggcu

SEQ ID NO: 77202 - RNA, 64 nt, Human
augagacccccuccaccaggcauuagagguccaccucccccaggaaugcguccaccaagaccuu

SEQ ID NO: 77203 - RNA, 64 nt, Human
ggcugcagagggagguggaaaugaacccugagggcucccccaacuugccaugcccugucccuua

SEQ ID NO: 77204 - RNA, 64 nt, Human
cugaaagagccgcccucccuuccccaaggauccacucccccagcuccuuuagagaauggcuacu

SEQ ID NO: 77205 - RNA, 64 nt, Human
acaucccaacauuugacaccccagcaaugugugacucccccaacauuccacuaugccauccugc

SEQ ID NO: 77206 - RNA, 64 nt, Human
uucagcaaauuucagggguuuucugggaccaguucucccccaacaggaaacuuguuuuuuuaac

SEQ ID NO: 77207 - RNA, 64 nt, Human
gguccaucccugcacccugguccucucccagccucucccccacauugucccugacucuaggggc

SEQ ID NO: 77208 - RNA, 64 nt, Human
aggaaggacaugucccacuccaucccccuuccugcucccccauuuccuaacucccccaguguga

SEQ ID NO: 77209 - RNA, 64 nt, Human
acuccaucccccuuccugcucccccauuuccuaacucccccagugugaauucucagggucacuu

SEQ ID NO: 77210 - RNA, 64 nt, Human
ugaaauuuuaaagggaggggguccauguccuucccucccccaccccgccucauucuuuaaucaa

SEQ ID NO: 77211 - RNA, 64 nt, Human
augccuucacccuucccccaaguuggaauauauccucccccaaauuaaggacccauuugucuuc

SEQ ID NO: 77212 - RNA, 64 nt, Human
cagugguaucaggcugggagcggccuccucuggccucccccaucaguuugcaggagcaggggug

SEQ ID NO: 77213 - RNA, 64 nt, Human
agggccuggggauuugggucaguuguaguugccucucccccacccucuuuucccuucccaaagg

SEQ ID NO: 77214 - RNA, 64 nt, Human
aagauuguucugugucucauucccucuuaagccacucccccacccugcccuuuuaaaaauaauu

SEQ ID NO: 77215 - RNA, 64 nt, Human
gggcuccagacccaaccuggucacagaagagccucucccccaugcauacucauccaccucccuc

SEQ ID NO: 77216 - RNA, 64 nt, Human
aacgcuuucucggcguuugucccuuggcucucaucucccccauuccugugccuacuuugccuga

SEQ ID NO: 77217 - RNA, 64 nt, Human
gggaagugggcccuucccugggucucugcacugacucccccacuccugacccuggugauggucg

SEQ ID NO: 77218 - RNA, 64 nt, Human
gaccagguccugugaggaagccuggagcaagggucucccccagcaggauggguggggccugcuc

SEQ ID NO: 77219 - RNA, 64 nt, Human
ucgucacacccaagcugcuggccuccagucccaucucccccaacacaugugcccccaaaaagug

SEQ ID NO: 77220 - RNA, 64 nt, Human
cugagcucuucucagugggguccccuuugauguucucccccaaguugggcagccuagagguguu

SEQ ID NO: 77221 - RNA, 64 nt, Human
uugggcuggguagggacagaggaggccgaaaucccucccccaugcuuccugacccuuguuggcc

SEQ ID NO: 77222 - RNA, 64 nt, Human
gcccagcagcagcaugucagcugagccuccugcccucccccaggaacaugcacgcucacucugc

SEQ ID NO: 77223 - RNA, 64 nt, Human
cagucuccgcagauucuugggauuuggggguuuucucccccaccucuccacuaguuggaccaag

SEQ ID NO: 77224 - RNA, 64 nt, Human
aguugccagucaccccggccaccugcggugcuaucucccccagccccauccucuguacagagcc

SEQ ID NO: 77225 - RNA, 64 nt, Human
ucuagcacauuccucuagcuuccuggaggacucacucccccaggaagccuucccugccuucucu

SEQ ID NO: 77226 - RNA, 64 nt, Human
uggcagggaggguaagggcuggcuccagauaccccucccccacagauuccuagcaaugaaaauc

SEQ ID NO: 77227 - RNA, 64 nt, Human
cugaaccaaaaguauuuuccucaguguaucucuucucccccagccccuauugggaaaaauuacc

SEQ ID NO: 77228 - RNA, 64 nt, Human
ccauguaaaguggggacgggggcugcuucuccaccucccccaaacccugcuucugcugcccuga

SEQ ID NO: 77229 - RNA, 64 nt, Human
cuaaugcucucucgucugucugucugucugcccacucccccacccaccacugugcguuucugau

SEQ ID NO: 77230 - RNA, 64 nt, Human
cccuauuuauguguauuuauuguuauuuauaugccucccccaacacuacccuuggggucugggc

SEQ ID NO: 77231 - RNA, 64 nt, Human
acuccaugggcagggagcuggggggacaucucaccucccccauggcacagagcccuccacaccc

SEQ ID NO: 77232 - RNA, 64 nt, Human
ugggccccuuuuauuuuuaccugccacccagcaucucccccaccugccccuucugggugacaca

SEQ ID NO: 77233 - RNA, 64 nt, Human
agucauggggcccaggaccaugccacuggcccugcucccccagccgcaggccucaccugcaggu

SEQ ID NO: 77234 - RNA, 64 nt, Human
cacuagggcugaggggccugcgcccagagcuggccucccccaacaccugcugcgcuugguaggu

SEQ ID NO: 77235 - RNA, 64 nt, Human
ccucacuccugccucuccacgcugccccgucccucucccccaacagggaggaggucggauuagg

SEQ ID NO: 77236 - RNA, 64 nt, Human
uggcuuccuuuucccugucuucagcccucccugucucccccacuuccuggccagggcucucauu

SEQ ID NO: 77237 - RNA, 64 nt, Human
agaucuacacacagaaaccccucuucuccccgcccucccccagcuccuaccugccucccacgcc

SEQ ID NO: 77238 - RNA, 64 nt, Human
cucugcgcacucccauuuccaaaaauaaacucgccucccccauuccaguugcaguaaucaagaa

SEQ ID NO: 77239 - RNA, 64 nt, Human
agauggcugcagcagcuccagcaaccucagaggacucccccauccaggguccuugugagcuccu

SEQ ID NO: 77240 - RNA, 64 nt, Human
aggaaagggaaccaaaucucauuaauuaauuguucucccccauuaccccacugaaugaauggcc

SEQ ID NO: 77241 - RNA, 64 nt, Human
uuaggggccccuacggccggcgggaucggccucccucccccacgacucagcaauacccgcccca

SEQ ID NO: 77242 - RNA, 64 nt, Human
ggcuuuugcagcuggaaugggguucagugaacaucucccccauuccucucuugcuacaaauaag

SEQ ID NO: 77243 - RNA, 64 nt, Human
aaaaccaacacauccucuucuuucugccaauccucucccccacgggacaccucucugguucggg

SEQ ID NO: 77244 - RNA, 64 nt, Human
cccgugacaugaugauaggucuucuccuuggggccucccccaauaaaucuguaauaaaccugaa

SEQ ID NO: 77245 - RNA, 64 nt, Human
uuguguaauggauggaaaacgcagcauacuuggccucccccaccucccugcccuuccuggccag

SEQ ID NO: 77246 - RNA, 64 nt, Human
cugauuuaaaaaaucacuccucuccagcaccgagcucccccagggcugcccaucaucuuaaugu

SEQ ID NO: 77247 - RNA, 64 nt, Human
agugccuggaggaaggauggcucuggccucgguccucccccaacccugcccaagccagacagac

SEQ ID NO: 77248 - RNA, 64 nt, Human
uuuuauagcuggagaucugaacccagcugugccccucccccaggggcgugaggcugaucagcga

SEQ ID NO: 77249 - RNA, 64 nt, Human
accccccaccgccauuggcauccccaccaagcuccucccccagaacccugaggccaagggggcc

SEQ ID NO: 77250 - RNA, 64 nt, Human
gucauccuuguuuuuuuuuuaaaaauacacuccccucccccaccgccacacaccuuacaguuca

SEQ ID NO: 77251 - RNA, 64 nt, Human
aggccagucagccaugcucaggaccccucggcuccucccccagccucuagcuacccuguaucga

SEQ ID NO: 77252 - RNA, 64 nt, Human
cuggaagcuucuucaaccaaucccuucacacucucucccccauccccccaagauacacacugga

SEQ ID NO: 77253 - RNA, 64 nt, Human
uuuccuaaagucucugcugcuaaggcucuauuuccucccccaguuaaacccccuacauuaguau

SEQ ID NO: 77254 - RNA, 64 nt, Human
gcagacggccccucucuucccagcacuucccugccucccccaggccucaggcccagcacccagu

SEQ ID NO: 77255 - RNA, 64 nt, Human
gggcucccgccugugccccuucuccucaccaugucucccccacccugccucaguucuccguucc

SEQ ID NO: 77256 - RNA, 64 nt, Human
acauaaauacaguauucccacucuuaucuuacaacucccccaccgcccacucuccaccucacua

SEQ ID NO: 77257 - RNA, 64 nt, Human
ccccauggcuuuucaccuaaguggguccugcccccucccccaugaccuucaggagcaccccaua

SEQ ID NO: 77258 - RNA, 64 nt, Human
guucuguccauucaucugaccccaucuccucauccucccccagcccuugaauagguugguccuc

SEQ ID NO: 77259 - RNA, 64 nt, Human
uguguuuuaggacauugcaaaucuucuagaaguucucccccaaaucaggucaaugugugcccuc

SEQ ID NO: 77260 - RNA, 64 nt, Human
ucucuuugaucuacuugccucauuucccuaucuucucccccacgguauccuaaacuuuagacuu

SEQ ID NO: 77261 - RNA, 64 nt, Human
uuguuuuucuugcaugguuuggagcugaucgcuucucccccacccccuaggguaccagcaggca

SEQ ID NO: 77262 - RNA, 64 nt, Human
aagggaagucaggcuugggcacgggagguuagaacucccccaggcccugccauuggguugucug

SEQ ID NO: 77263 - RNA, 64 nt, Human
cuucugcugccuagguucuguuaccccauccucccucccccagccaccacccucaggugccucc

SEQ ID NO: 77264 - RNA, 64 nt, Human
aggaucuggugcauagaugaacaucuauccccuccucccccauacacaccuaggcuugaaaugc

SEQ ID NO: 77265 - RNA, 64 nt, Human
ggcauccucauccuguaccuauagaguucgugcacucccccauccaugcuaccuaccuccccgu

SEQ ID NO: 77266 - RNA, 64 nt, Human
uuucucagccccuuaggacgcgggucuccuugggcucccccaaggguucugcgaagaggcagug

SEQ ID NO: 77267 - RNA, 64 nt, Human
gagcuugaagaaaagcuuauuuauuuuccccaaccucccccaggugcagugugacauuauuuua

SEQ ID NO: 77268 - RNA, 64 nt, Human
gggggugggggugcugggagccagccacccugaccucccccagggcuccuccccagccggugac

SEQ ID NO: 77269 - RNA, 64 nt, Human
cacaucuucaucaccagcaaacgccaggacuuggcucccccauccucagaacucacaagccauu

SEQ ID NO: 77270 - RNA, 64 nt, Human
aauuccagcuccugacauucccccaguccugccucucccccauccuaucagggacauuuggcuc

SEQ ID NO: 77271 - RNA, 64 nt, Human
ucccuccagugaauucagaacagaagccauguaucucccccacaccagggcccaccauggagcu

SEQ ID NO: 77272 - RNA, 64 nt, Human
cugaggggauaucccuaugucccagccccugguacucccccagcccucaguuuucagucaaguu

SEQ ID NO: 77273 - RNA, 64 nt, Human
aucacacuguguuugugauugucugugugucugucucccccaccagacugugagcuccaugagg

SEQ ID NO: 77274 - RNA, 64 nt, Human
uagaacaugccguuucaugucaccugcuacagcucucccccagcuaguaugaugauccuguuuu

SEQ ID NO: 77275 - RNA, 64 nt, Human
gccuguggaggugaccuguuaggucucaugcccacucccccaggagcagcuggcacugacagcc

SEQ ID NO: 77276 - RNA, 64 nt, Human
cgucugucuucaagggcuuacacguggaggaaugcucccccauccuccccuucccugcaaacau

SEQ ID NO: 77277 - RNA, 64 nt, Human
guugagacuguccccagaacccuuggucuugccacucccccacuccuucuucccucucucccuu

SEQ ID NO: 77278 - RNA, 64 nt, Human
auacuacugacguccucccugaucccacccccuccucccccaguguccccuuucuuccuauuua

SEQ ID NO: 77279 - RNA, 64 nt, Human
uccuuggcuuucagagccagccuggcucugcccccucccccaugggcuguguccuaaggcccau

SEQ ID NO: 77280 - RNA, 64 nt, Human
aaguucaaagagcugaaccucaccaauaucuacgcucccccauugccuucacuggcacugccuu

SEQ ID NO: 77281 - RNA, 64 nt, Human
agaauaauuuuucuuucaaguagguuagcuagcucucccccaauaaaaauaccacuaucagagu

SEQ ID NO: 77282 - RNA, 64 nt, Human
uaaaaaccuugcugagccuccuugucuauccuuccucccccacccaccauuguaaaguuuaugu

SEQ ID NO: 77283 - RNA, 64 nt, Human
guuaagagcucuacccacaccugucaaccccucucucccccaguuuagguucugagcaguauug

SEQ ID NO: 77284 - RNA, 64 nt, Human
aucaugggaccaggcgagagggcacccucccuuccucccccaugugauaaauggguccagggcu

SEQ ID NO: 77285 - RNA, 64 nt, Human
cacagcagcaagugacccuucuccggccugcagccucccccaggguggaagccguggggucccu

SEQ ID NO: 77286 - RNA, 64 nt, Human
gccaaauguccccacuaccccagggaucccccagcucccccagccccuggcuuccugacccugc

SEQ ID NO: 77287 - RNA, 64 nt, Human
uggugcccccuccagggcucuggaggauggaugccucccccaggggcucuccaagcugggcauu

SEQ ID NO: 77288 - RNA, 64 nt, Human
gcccggaagcagagcgccacacucgcugcuuaagcucccccagcucuuuccagaaaacauuaaa

SEQ ID NO: 77289 - RNA, 64 nt, Human
gugggcagucaccacccagcccuuccuugggcgucucccccagagugcugucgggaccacaucu

SEQ ID NO: 77290 - RNA, 64 nt, Human
cagggggcuggggacugcagccccacucccgccccucccccaucgugcugcaugaccuccacgc

SEQ ID NO: 77291 - RNA, 64 nt, Human
gucccaaaucucucucccaguacaccaguuguuccucccccaccucagcccucuccugcauccu

SEQ ID NO: 77292 - RNA, 64 nt, Human
cgacacuggagcuuagccugagaggguucuuggccucccccaggaaagauuucaaaggcaagcg

SEQ ID NO: 77293 - RNA, 64 nt, Human
acaccacuuguugauuauuuucuuguuugagccccucccccaauaaagaauuuuuaucggguuu

SEQ ID NO: 77294 - RNA, 64 nt, Human
aaugcacacacagacccaccgggggccaccugcccucccccauccucucccacacacauuccag

SEQ ID NO: 77295 - RNA, 64 nt, Human
ccucauuuuccaaaccucuuguacccuccucucccucccccagcugguauguaagugucuugaa

SEQ ID NO: 77296 - RNA, 64 nt, Human
ccccgaggagucugcccugccuagagaagggccucucccccaacccucagccguuccuccaccu

SEQ ID NO: 77297 - RNA, 64 nt, Human
uccagaagggugacccggacagccuagcugggggcucccccauauucccaggcccagaagacag

SEQ ID NO: 77298 - RNA, 64 nt, Human
gggcaccucucccaggaagugguggggcaccggucucccccacccgacugcugaucugcauggg

SEQ ID NO: 77299 - RNA, 64 nt, Human
cagacccucguacccaaaggccccugccccacuucucccccacaaagcggggucucaagccaca

SEQ ID NO: 77300 - RNA, 64 nt, Human
cuuaauacagcugcuuuucucggugccaaccucccucccccaagcucagauccuccucuuaugc

SEQ ID NO: 77301 - RNA, 64 nt, Human
gggaccucucuccgggggcucccuggaggcaccccucccccauucccaauaucuucgcugaggu

SEQ ID NO: 77302 - RNA, 64 nt, Human
aacuuccccuccuccccuauuuaaaccacucugucucccccacaacccuccccuggcccucuga

SEQ ID NO: 77303 - RNA, 64 nt, Human
ggcccccugagccuucuuguaaauaccugccucccucccccaucaccgaacuuccccuccuccc

SEQ ID NO: 77304 - RNA, 64 nt, Human
ugugauucugccucagcuccugucuugcugagcccucccccaacccacgcuccaacacacacac

SEQ ID NO: 77305 - RNA, 64 nt, Human
ggggccaugccuuguccagcacuguucugucagucucccccaggggugggggguauggggacca

SEQ ID NO: 77306 - RNA, 64 nt, Human
cuuucccugaccccagaccgcugccaagccuguucucccccauuacaacauggucucacucagg

SEQ ID NO: 77307 - RNA, 64 nt, Human
agauaacugcuuuuugacaaagagagccuucccucucccccaccccuguguucuuggguaggaa

SEQ ID NO: 77308 - RNA, 64 nt, Human
ccuuugacauggaguugaccucggagugcgcuaccucccccaugugaggagcugagaacggaag

SEQ ID NO: 77309 - RNA, 64 nt, Human
uucucccccauguucugucccuugccccccuggccucccccacuuucuuucuuucuuuaaaaaa

SEQ ID NO: 77310 - RNA, 64 nt, Human
aggagcuccccuccccaacugaccaccuuuguuucucccccauguucugucccuugccccccug

SEQ ID NO: 77311 - RNA, 64 nt, Human
ugccugugugaggggcgggcccaggcccuagacccucccccaccauuccacauccccaccuucc

SEQ ID NO: 77312 - RNA, 64 nt, Human
ccuggggccugggccccggaaaaaucuaucugcccucccccacacuuuauauacgaauaaacgc

SEQ ID NO: 77313 - RNA, 64 nt, Human
ccaggcucaggugggaguucaaacugcuccuccccucccccaucuagagucuagacagacggca

SEQ ID NO: 77314 - RNA, 64 nt, Human
gucccuaucuauucaguuaacccaccucggcugccucccccacuccacugugcacgguugaguu

SEQ ID NO: 77315 - RNA, 64 nt, Human
uguuuuugggcauuuuucucugauuuuauuucuucucccccaccccuuuuucuaaaaaacaaac

SEQ ID NO: 77316 - RNA, 64 nt, Human
uuuaaauauuaguugccuuuguaaacaguuuccccucccccaccccuuuuucgauaauuuuagu

SEQ ID NO: 77317 - RNA, 64 nt, Human
cagagcaacaggaucugucacccaccucucucuucucccccagaucaagcgacgugccucagag

SEQ ID NO: 77318 - RNA, 64 nt, Human
cagcugcacaaggccagggcaagugcuagggccccucccccaucacauggucacacugggacag

SEQ ID NO: 77319 - RNA, 64 nt, Human
cccagguccucagcgcugccucugcuggugccuucucccccacuacuacuggagcgugcccuug

SEQ ID NO: 77320 - RNA, 64 nt, Human
cucaaccgagugccuccgaccccccuccucagcccucccccacccacaggcccagccuccucgg

SEQ ID NO: 77321 - RNA, 64 nt, Human
auaaaaaauaggauaauuuaaccuaccagcccuucucccccaauaacuguggucuauacagagu

SEQ ID NO: 77322 - RNA, 64 nt, Human
gguagauugccagcacagugaguuucccagccugcucccccauccacacuuggaaauugaggga

SEQ ID NO: 77323 - RNA, 64 nt, Human
cauugucuuucuucccacgcucauuucuaucauucucccccaugacccgucuggaaauuaugga

SEQ ID NO: 77324 - RNA, 64 nt, Human
cuucuagucugaucugauccacugacagauucaccucccccacaucccuagacagggauggaau

SEQ ID NO: 77325 - RNA, 64 nt, Human
uuggcggcccggccggagggcaggacccucaccucucccccaaggccacugcgcucuugggacc

SEQ ID NO: 77326 - RNA, 64 nt, Human
agaacguggcccagcccuggagggcaggcggccacucccccagccagaagucuuuuuuucuuuu

SEQ ID NO: 77327 - RNA, 61 nt, Human
ccccucccccaaccaacugagaagcugcucccucccccagcaagcccagcgccaggugcuc

SEQ ID NO: 77328 - RNA, 64 nt, Human
gcucuuuuguacugccccccgcucauuaaacagccucccccagcccugagugcacugauguccg

SEQ ID NO: 77329 - RNA, 64 nt, Human
ucccaccaaggaaugagauauguggaccucacugcucccccaacccagcgucaggcugggacac

SEQ ID NO: 77330 - RNA, 64 nt, Human
ggaugcaguguugcacugaugacuugaccagccccucccccaauaaacucgccucuuggaaaug

SEQ ID NO: 77331 - RNA, 64 nt, Human
uggacaaccuaaucugagcccagcccugaccagccucccccaacagaacgccugugccgccacu

SEQ ID NO: 77332 - RNA, 64 nt, Human
cuccugaugucaaggacaggcggacagggcuggccucccccaguccccaagccccacugugccu

SEQ ID NO: 77333 - RNA, 64 nt, Human
ucaccucccugcccucccgucauuugcccugggucucccccaccagaaugggagccaggagucc

SEQ ID NO: 77334 - RNA, 64 nt, Human
ucuccuccauccguaccuugccuagccucucccucucccccagcuagucccugagcaauacggc

SEQ ID NO: 77335 - RNA, 64 nt, Human
aaucagcgagcccagcuguaggguggggggcaggcucccccauggcaggguccuugggguaccc

SEQ ID NO: 77336 - RNA, 64 nt, Human
cucccucacaaguggguacccccaggaccagaagcucccccagcaaagcccccagagcccaggc

SEQ ID NO: 77337 - RNA, 64 nt, Human
gggguggauuuugguuuuguuccccuccuccacucucccccacccccuccccgcccuuuuuuuu

SEQ ID NO: 77338 - RNA, 64 nt, Human
cccagaggggccggguggcucagacgacccaccacucccccacccugaccgugcugaacagacc

SEQ ID NO: 77339 - RNA, 64 nt, Human
ccggggcuccagccagaccccugaaaggaaggugcucccccacuuccaggccuuaguuggggug

SEQ ID NO: 77340 - RNA, 64 nt, Human
agugacauaugccaacacggggucugggugggggcucccccacauccuuuccuugccuaugagc

SEQ ID NO: 77341 - RNA, 64 nt, Human
ccauuccccagccacuucccuuccgcacuuaccacucccccagccacgccccuccccgcugacc

SEQ ID NO: 77342 - RNA, 64 nt, Human
caucaccucugucuaguuacagaacgguuucuuucucccccaaagaaaccccaucgccaucagc

SEQ ID NO: 77343 - RNA, 64 nt, Human
aagaaaccccaucgccaucagcacucacuccccacucccccagccccuggcaaccacaaaucuu

SEQ ID NO: 77344 - RNA, 64 nt, Human
uggagcagggcccuccucucucaggcuuggcccacucccccagacaccuggacacguggccaca

SEQ ID NO: 77345 - RNA, 64 nt, Human
uugggguucucucacccucuuucucuuuccuucccucccccauucuccagaucucccucugucu

SEQ ID NO: 77346 - RNA, 64 nt, Human
uggccccugucucucuccauguuggggguccuaacucccccaccccauaucuacguguccuccg

SEQ ID NO: 77347 - RNA, 64 nt, Human
auuuuuuaagugggaaagaacucaccuugccuuccucccccaaaugugcaaccuguaaaagguc

SEQ ID NO: 77348 - RNA, 64 nt, Human
ugcgagccaggccccguggaagacgggcucccuccucccccaccuggccccuggucuagaagga

SEQ ID NO: 77349 - RNA, 64 nt, Human
gacuggcccugaggaguccuugcagaccugcugccucccccacgacaggcccaaagauggaccc

SEQ ID NO: 77350 - RNA, 64 nt, Human
cuuggaccacgagcccuuagcagggaaggcuggucucccccagccuaacccccagccccuccau

SEQ ID NO: 77351 - RNA, 64 nt, Human
gcuggagccagggcugccgguccgagucuccuaccucccccaacccugcccgccccugaaggcu

SEQ ID NO: 77352 - RNA, 64 nt, Human
ccccagcccuuagcacagagagggacacaugccccucccccagcugcguuuuuuuauaguagau

SEQ ID NO: 77353 - RNA, 64 nt, Human
aggcucccaggacccccacccucugggacaggcccucccccauguucuucugucuccaggaagg

SEQ ID NO: 77354 - RNA, 64 nt, Human
uguguguguugaugacuucucuguuccacaggcccucccccauucuugccuggguguggagccc

SEQ ID NO: 77355 - RNA, 64 nt, Human
aauuguagcauauuuaagggaggcaaugaacccucucccccaccucuucccugcccaaaucugu

SEQ ID NO: 77356 - RNA, 64 nt, Human
gugauucuccuagcuccaaauguuuucauuaucucucccccaacaaaacccauaccuaucaagc

SEQ ID NO: 77357 - RNA, 64 nt, Human
uaagcuccucuccagcccuggccacauccccauccucccccaaccuccagccccaacacccauc

SEQ ID NO: 77358 - RNA, 64 nt, Human
gacugagccggcuccucuccccaucugccuucuccucccccagaaaggaccucaaccacacucc

SEQ ID NO: 77359 - RNA, 64 nt, Human
aguggcugcccugccccccucauuugcauggcuccucccccacucaagcaauagggccccgcca

SEQ ID NO: 77360 - RNA, 64 nt, Human
cugucccgggaccugcugggagggacaagaggcccucccccaggcagaagagcaugcccuuugc

SEQ ID NO: 77361 - RNA, 64 nt, Human
ugccucuucccucgcccaccugccugcccccauacucccccagcggagagcaugauccgugccc

SEQ ID NO: 77362 - RNA, 64 nt, Human
cguuuuagcugagguuggcagaaacguucccaaacucccccagcccuggaccccagcagaugag

SEQ ID NO: 77363 - RNA, 64 nt, Human
gauacagagggaucuuguguacccuucacccagccucccccaauggcaacaucuugcaaaacua

SEQ ID NO: 77364 - RNA, 64 nt, Human
gacgcguuccugcccagccccuugcugucauccccucccccaaccuuggccacuugaguuuguc

SEQ ID NO: 77365 - RNA, 64 nt, Human
cuuuggcacagcagccggugucuccugcgcccgccucccccauggccccaugcagccccagggg

SEQ ID NO: 77366 - RNA, 64 nt, Human
gggucacuggauccugcugcuguaaugggaaccccucccccauuuacuucuccaccucccgucc

SEQ ID NO: 77367 - RNA, 64 nt, Human
ccagggaggaggccuuggaagaguccggccuggccucccccaggaccgagaucaccgcccagua

SEQ ID NO: 77368 - RNA, 64 nt, Human
auccuggugcuauugggguggggagcucccuccccucccccacaccagaaagggguauguuggg

SEQ ID NO: 77369 - RNA, 64 nt, Human
ggcaguggggacacauccagagugcugaaagaaccucccccaggucauccuauccccaagagug

SEQ ID NO: 77370 - RNA, 64 nt, Human
ccuaaacuuugggguccagcugccuucagccccccucccccagacuaacagacccuuggaggca

SEQ ID NO: 77371 - RNA, 64 nt, Human
ggcucccccagcgcugaagcacgggguucagcggcucccccagugcugcaggugccgccaggac

SEQ ID NO: 77372 - RNA, 64 nt, Human
ugcaugguuuguggcggaagacggggcccagcggcucccccagcgcugaagcacgggguucagc

SEQ ID NO: 77373 - RNA, 64 nt, Human
gcguccagccagcccgcugggcccugcugggggccucccccacgccccccaggacagugucccc

SEQ ID NO: 77374 - RNA, 64 nt, Human
uggggcagaccccugcuaauauaugcaauucucccucccccagcccuucccugaccccuaaguu

SEQ ID NO: 77375 - RNA, 64 nt, Human
gugacguagacaggaugccaggggccuggccagccucccccaaugcuggggagcaucccugggc

SEQ ID NO: 77376 - RNA, 64 nt, Human
cuccacccucacuccauccaccucggagaccacccucccccagccagauacggaauaaaacuac

SEQ ID NO: 77377 - RNA, 64 nt, Human
cuggaagaugaagcccaaacacccacaccucugucucccccagggcucgggaugucuccagcag

SEQ ID NO: 77378 - RNA, 64 nt, Human
gaaguccccuucucgcccccaaaccagcaagggacucccccaccugggucugugcccugccccg

SEQ ID NO: 77379 - RNA, 64 nt, Human
uuucuaagcgaacugccagaacgugugggugggucucccccagcccucccuccuggcgggucuc

SEQ ID NO: 77380 - RNA, 64 nt, Human
cugcccccucuccccccgcaugugggugcccccacucccccaucguggggucuguguagccuuc

SEQ ID NO: 77381 - RNA, 64 nt, Human
cugcccgccgcccacccccacugacccccgcugccucccccaacaccgacacccuccucggccu

SEQ ID NO: 77382 - RNA, 64 nt, Human
gacagcaucauccucugcugaccuguuccuugagcucccccauaucagcagcccagaguguggg

SEQ ID NO: 77383 - RNA, 64 nt, Human
ggaaggauggggagggacauagaggauucgguuccucccccaccuuguuucuugaguguuuccu

SEQ ID NO: 77384 - RNA, 64 nt, Human
gcuggcuggguccucugcccucucuggaguuugccucccccagcccccuccccaucaauaaaac

SEQ ID NO: 77385 - RNA, 64 nt, Human
ggggaauggggggccacagcugcagaccuaagcccucccccaccccuggaaaggucccucccca

SEQ ID NO: 77386 - RNA, 64 nt, Human
ggguggggcacagaccauagacggaccccucguccucccccagcggugguagggggacccgggg

SEQ ID NO: 77387 - RNA, 57 nt, Human
ggagccugaaggaagacugacccgucccucccccauccccccuccccacccccuccc

SEQ ID NO: 77388 - RNA, 64 nt, Human
gcuauggcgcccccaucugacuguccagcucucucucccccaccccucccgguguuguuauuaa

SEQ ID NO: 77389 - RNA, 64 nt, Human
cccacacagcugagggagaggcccagcccugagccucccccaccaggacugggccuccccggca

SEQ ID NO: 77390 - RNA, 64 nt, Human
ucauauguugaaaccuuacccccgugcccccccucucccccacaaugugaugguauuuggaggc

SEQ ID NO: 77391 - RNA, 64 nt, Human
cgggucggaacucuuuaggccucuggccuccacccucccccaacagcagggaugggucaggugg

SEQ ID NO: 77392 - RNA, 55 nt, Human
cucggccccuggugaaaugacgccccucccccaccugcccauggccugggacucu

SEQ ID NO: 77393 - RNA, 64 nt, Human
ucaugccuccaccuagaagcugaauagugacgcccucccccaagcccacccagccgcacacagg

SEQ ID NO: 77394 - RNA, 64 nt, Human
ugguaccagcacuccgcggcggggccgccgccagcucccccagacccccuccaccccccggcca

SEQ ID NO: 77395 - RNA, 64 nt, Human
cuccuccagcuuagcugucagcuguccaucaccucucccccacuuucucauuugugcuuuuuuc

SEQ ID NO: 77396 - RNA, 64 nt, Human
gggcugccuguuuuacucacccaccagcuuccgccucccccauccugggcgccccuccuccagc

SEQ ID NO: 77397 - RNA, 64 nt, Human
ggcacugacuuugccuugaacagaccccccgacccucccccacaagccuuuaauugagagccgc

SEQ ID NO: 77398 - RNA, 64 nt, Human
gggucaccuguugucgggaggggagccacuccuucucccccaacucccagcccugccuguggcc

SEQ ID NO: 77399 - RNA, 64 nt, Human
cugcacaccauggacccugcccugcgcuccccaacucccccaggcucccuguccacugcccucc

SEQ ID NO: 77400 - RNA, 64 nt, Human
gacaggggugcuuuugcuacuuugguuguggucacucccccacaccugccugccuccuucacgg

SEQ ID NO: 77401 - RNA, 64 nt, Human
ggcaccccaaacuuggagggaccugcccacuccccucccccauucccaagguucgcaccuccug

SEQ ID NO: 77402 - RNA, 64 nt, Human
ccuauuuugacaccaaauuaugguguagacagcccucccccaaccccaggccagucaggcacaa

SEQ ID NO: 77403 - RNA, 64 nt, Human
ugcucgccuaccugccucuccgagcuccucaauucucccccacccugaacaucccgcaggggga

SEQ ID NO: 77404 - RNA, 64 nt, Human
cuaggggggugucaggaacuaguccuugcacccccucccccauagacacacuaguggucauggc

SEQ ID NO: 77405 - RNA, 64 nt, Human
gcccccucccuggggccccuccugaagccauacccucccccaucugggggcccugggcucccau

SEQ ID NO: 77406 - RNA, 64 nt, Human
cccagaagcuggacaacuuaagccacuccuuggccucccccagccaggggccugggcaggaaag

SEQ ID NO: 77407 - RNA, 64 nt, Human
uuuggggggagaaaccucggaauuucuaugagaccucccccagggagggggucaguugggcccc

SEQ ID NO: 77408 - RNA, 64 nt, Human
ggaugaggaccuccuacccccuuggcccccuccccucccccagaccuccaccuccuccagaccc

SEQ ID NO: 77409 - RNA, 64 nt, Human
ccccagguuccugggcuccccuucucucuaccuucucccccaacgucugucccauccauauuug

SEQ ID NO: 77410 - RNA, 64 nt, Human
gggucacuguuacacucauccauguucagcuuuucucccccacgccuugcucccuccucggaau

SEQ ID NO: 77411 - RNA, 64 nt, Human
ccagaaggugccagguucuccccuugagcuccugcucccccaucccccauccucccagaccugg

SEQ ID NO: 77412 - RNA, 64 nt, Human
ccaacaucccagacccguuacccacuacccuucucucccccagcucaucaucagucgcugucuc

SEQ ID NO: 77413 - RNA, 64 nt, Human
gcacauuuugaaccugcaacuucagacauuccagcucccccacucgcccuccacuaccucugag

SEQ ID NO: 77414 - RNA, 64 nt, Human
gggggcaggcuccucuucccccagccccgggagccucccccagcuuccugcagccccgaccucu

SEQ ID NO: 77415 - RNA, 64 nt, Human
augaacucaaagguuugaagcuaccaccauugaacucccccauggugguuucaugaugcccccu

SEQ ID NO: 77416 - RNA, 64 nt, Human
gaggggcuccgggucacugcuguauauaacuccccucccccagaaaaauaaaugucacugccaa

SEQ ID NO: 77417 - RNA, 64 nt, Human
uccuccuccuucccacaggccggcuucuacaggacucccccaucuugcugacagcauggcaguc

SEQ ID NO: 77418 - RNA, 64 nt, Human
ggaauggucggucacuaugggccuggugucuccccucccccaccacccggugcugcccagcuca

SEQ ID NO: 77419 - RNA, 64 nt, Human
cacuaaggaguggggggcccuggacugccccuuccucccccaucgcccgcccccagaaccccug

SEQ ID NO: 77420 - RNA, 64 nt, Human
agcaccugguugucucuucugcaaagaaugcauucucccccaguccacccagaacacacagccu

SEQ ID NO: 77421 - RNA, 64 nt, Human
aagaagaggaggcaggggcagaaacccaagggggcucccccagccuuccaaggugaggccaucu

SEQ ID NO: 77422 - RNA, 64 nt, Human
caggcuuggugagguugcugccaacaguccuggccucccccaucccuaggcuaaagagccauga

SEQ ID NO: 77423 - RNA, 64 nt, Human
uggaccuccaggcuccagcacaucccccucuccucucccccagguuggggcuggguccacccug

SEQ ID NO: 77424 - RNA, 64 nt, Human
acuguaaauaucccuccccucucucccugguccccucccccauccccaccacugauaucauggg

SEQ ID NO: 77425 - RNA, 64 nt, Human
cagacguucuagaaaagaccccuccucucaugagcucccccaucccugcuacagaacacagcac

SEQ ID NO: 77426 - RNA, 64 nt, Human
cagcgagcaaauccuggcaagugacccagcucuucucccccaaacccacgcguguucugaaggu

SEQ ID NO: 77427 - RNA, 64 nt, Human
cuagaggccguuaggcaggcacccccuauuccugcucccccaacuggaucagguagaacaacaa

SEQ ID NO: 77428 - RNA, 64 nt, Human
ugaauaacuugccuucuaaaugaucaauuuacuucucccccaauuuuaaagaaguauguguaua

SEQ ID NO: 77429 - RNA, 64 nt, Human
uuuccaaguaauauaauggaagagaaaucucauacucccccacaguuugaugucauuaaugugu

SEQ ID NO: 77430 - RNA, 64 nt, Human
gggugcgcaugugguagaaggugugcgcucgugccucccccacagaaaggcuuuguugguuucu

SEQ ID NO: 77431 - RNA, 64 nt, Human
uugguggcccaggcucuccccugacccauccucgcucccccaccuccuugggucaugcccaccc

SEQ ID NO: 77432 - RNA, 64 nt, Human
uuggaacccccacuuuuacguugugucccuccgccucccccauggcgcaacaggagucagucuc

SEQ ID NO: 77433 - RNA, 64 nt, Human
ccagagugggagucagguggagccaccugcugggcucccccagaacuuugcacacaucuugcua

SEQ ID NO: 77434 - RNA, 64 nt, Human
cugcggacgaucgcaucuugugucgcugaagcgccucccccagggaccggcggaccccagccau

SEQ ID NO: 77435 - RNA, 64 nt, Human
ccagggggcaagaggaauuacgugcucugugggucucccccaacgcgccucgccggaucugagg

SEQ ID NO: 77436 - RNA, 64 nt, Human
cggguaccagaggaaagcuggcagcaggcgccuccucccccaacgcaucccagccagugccaug

SEQ ID NO: 77437 - RNA, 64 nt, Human
uacucacacccuucucuccuuucucguccccaugcucccccaccucagugcuccgugcuguaug

SEQ ID NO: 77438 - RNA, 64 nt, Human
aaaguuaucuccgugcugcaaggucacccucuuccucccccagccccugagaucagaucuuauu

SEQ ID NO: 77439 - RNA, 64 nt, Human
aacugcagaucauuuacauguccuuauuuuccaccucccccagucaaaaugcuuucuaaaucau

SEQ ID NO: 77440 - RNA, 64 nt, Human
cuccguaggguucuuucucgaggacucuacccuccucccccacguccugucucagcugcagucg

SEQ ID NO: 77441 - RNA, 64 nt, Human
gucucccgggccuguccccaacuccuccccaccccucccccaucuccucuuugaaagccagaac

SEQ ID NO: 77442 - RNA, 64 nt, Human
acgugcagacccugccaugcagacccaugccccccucccccaggcagcuccaagaaagcucccu

SEQ ID NO: 77443 - RNA, 64 nt, Human
cccagggaaacagggccagcacagaggggccuuccucccccacagagcccccaugacauagucu

SEQ ID NO: 77444 - RNA, 64 nt, Human
ucccgaugcacuuugagggguguuggagaggggacucccccacucgcacuuaacucaacggcuc

SEQ ID NO: 77445 - RNA, 64 nt, Human
guuauccugucuucuggauuccugccuaccccaacucccccagccuuguugagguucucuacug

SEQ ID NO: 77446 - RNA, 64 nt, Human
cucaccucugagggauuuucaggaaaugucuugacucccccauguacucuguaugugagcgaag

SEQ ID NO: 77447 - RNA, 64 nt, Human
ggauggagcccaggccacauggaugaugaugauucucccccacagguucgaaccucugacaugg

SEQ ID NO: 77448 - RNA, 64 nt, Human
cugccuuuggcugagagggcuaccugcccagccccucccccaacaagaucucuuggacucaggc

SEQ ID NO: 77449 - RNA, 64 nt, Human
accugagguucuggagcucagaaucugacagccucucccccauucugugugugucggggggaca

SEQ ID NO: 77450 - RNA, 64 nt, Human
ccuucucgucgaagcgggcuccgaugcagggcagcucccccaugcgaggauccgggucugccuc

SEQ ID NO: 77451 - RNA, 64 nt, Human
gccgaggguccuggcuccugaggggcaucugccccucccccaacccccaccccacacuuguucc

SEQ ID NO: 77452 - RNA, 64 nt, Human
cuucacugaugugggcaggagggguggugaaggccucccccagcccagacccuguggucccucc

SEQ ID NO: 77453 - RNA, 64 nt, Human
uccuguagagcagcgggguggggcggggucucugcucccccacuuugcauguucccagaguccc

SEQ ID NO: 77454 - RNA, 64 nt, Human
gaagaaaggggguggggaaccauauugccccucccucccccaucaaacuuccuucauuuaacuu

SEQ ID NO: 77455 - RNA, 64 nt, Human
ucuccauauccucucuugccagcuuuuucccgugcucccccaacuauguaucagauaagauucu

SEQ ID NO: 77456 - RNA, 64 nt, Human
acucagccaagaguucucuuuauucccuuugauccucccccaaggugagggcuuaggcagcugu

SEQ ID NO: 77457 - RNA, 64 nt, Human
aucuccugugaugcccugugaaauggcuugucuccucccccaucagggcccaccgaaagcucag

SEQ ID NO: 77458 - RNA, 64 nt, Human
ggcccaggggcacauugaacaggaggacggggcucucccccacaguggggaagcagaacgggga

SEQ ID NO: 77459 - RNA, 64 nt, Human
gggcugacauauaugaauacuggcuucuaagacccucccccaacagucugaccuuggcaguucc

SEQ ID NO: 77460 - RNA, 64 nt, Human
uaacggauguuguguggaguccuggcuggagguccucccccaguggccuuccucccuuccuuuc

SEQ ID NO: 77461 - RNA, 64 nt, Human
caacgcguuucccccgcggacccccuuuccugcccucccccaacccucccuuggcggcuggacg

SEQ ID NO: 77462 - RNA, 64 nt, Human
ugcauuuuuucguaucaaaaagucaccacuaacccucccccagaagcucacaaaggaaaacgga

SEQ ID NO: 77463 - RNA, 64 nt, Human
cggugaggaauucagggcuuuccccauaucuucucucccccaccuuuaucgaggggugcugcuu

SEQ ID NO: 77464 - RNA, 64 nt, Human
ggugcccccaguguccucugauccuguccggugccucccccaacccccacacccaugcagaacu

SEQ ID NO: 77465 - RNA, 64 nt, Human
cucccccgccagguguggccccgccugcucuuuccucccccaccaguauggccccaccugcucu

SEQ ID NO: 77466 - RNA, 64 nt, Human
guucaccucugucuagaugcaacuuuuguuccuccucccccacccccgcccccagcuucaugcu

SEQ ID NO: 77467 - RNA, 64 nt, Human
gcaaguuggggaguguuuguggggguccagagcccucccccagccaggagagaaccucccggag

SEQ ID NO: 77468 - RNA, 64 nt, Human
ggauguguauuucauuuauuuauggcccaccagucucccccaaauuaguacagaaauauccaug

SEQ ID NO: 77469 - RNA, 64 nt, Human
ucuucauggauagcucagagguauccucuuuuugcucccccauuuuaacuugccacaucccagu

SEQ ID NO: 77470 - RNA, 64 nt, Human
gaaaagaugcagguuuauauggaacccccacccccucccccacucucccacucuguucguucug

SEQ ID NO: 77471 - RNA, 64 nt, Human
gaaugucuucacgagcgugcaucagggcgccuggcucccccaccucagccagugagucagacac

SEQ ID NO: 77472 - RNA, 64 nt, Human
guggggcaggcucuuugucuuggggaccaggaugcucccccaguccuucccagaugauggcugc

SEQ ID NO: 77473 - RNA, 64 nt, Human
ucccagaugauggcugccugugggaccccagcuacucccccagacccaaguucugcagaacuaa

SEQ ID NO: 77474 - RNA, 64 nt, Human
acugggguggccagguggggcgggaccccagcaccucccccaacugacccuggacguccaggug

SEQ ID NO: 77475 - RNA, 64 nt, Human
gcacaugcuguuuuuuuuucucagcccacguguucucccccacgugggguagcagcaggacaga

SEQ ID NO: 77476 - RNA, 64 nt, Human
ggcugaggccggcucugacugggcagcucagccccucccccagagcccagggucuugcacaccc

SEQ ID NO: 77477 - RNA, 64 nt, Human
gcuccgggcaucaucuagacuuagcaugcauucacucccccaucacauauuccaauacacaccc

SEQ ID NO: 77478 - RNA, 64 nt, Human
cacagacccuccugcugccuggguccuggcccuccucccccaucugcacccccaucauagguag

SEQ ID NO: 77479 - RNA, 64 nt, Human
ugacagacuuucuuuauaaacauuuggaaguuuucucccccaucuucuuaagaagcaggggggc

SEQ ID NO: 77480 - RNA, 64 nt, Human
auugucauucuccugggaagcccagucucagucccucccccaacacuguccacacugccccucc

SEQ ID NO: 77481 - RNA, 64 nt, Human
agucgcugggcaccuggagguaucgucgaugccucucccccaucuuuagaaaauuuggcucuuc

SEQ ID NO: 77482 - RNA, 64 nt, Human
cguccuggccccgggcuguggcgagacagcccaacucccccagcccagcucccccagcccagag

SEQ ID NO: 77483 - RNA, 64 nt, Human
gcuguggcgagacagcccaacucccccagcccagcucccccagcccagagccagggaagaggaa

SEQ ID NO: 77484 - RNA, 64 nt, Human
acgagcgugucuuacuaaaacgcuccacuuugagcucccccacccccuccagguccucagaguu

SEQ ID NO: 77485 - RNA, 64 nt, Human
gccugcuccucguuuucccacauguccugcaucccucccccacuggagugauuucagugaauca

SEQ ID NO: 77486 - RNA, 64 nt, Human
caccccuggaacugaaccagggauagacggggagcucccccaggcuccucugugcuuuacuaag

SEQ ID NO: 77487 - RNA, 64 nt, Human
ugaggugccuccuuggcacagacuguggaugccucucccccagcagagccacacagccuucgug

SEQ ID NO: 77488 - RNA, 64 nt, Human
gcauuucuguucaguucguuuauguuauuuuuuacucccccauccccuguggcccucuaaugac

SEQ ID NO: 77489 - RNA, 64 nt, Human
uuggccccuuucccugacugucaaggacaacugacucccccaucagcucaaacauuaaggguac

SEQ ID NO: 77490 - RNA, 64 nt, Human
ccucuguccuuggaggugauuucccccugacccccucccccaggugagugaccaccugggugcc

SEQ ID NO: 77491 - RNA, 64 nt, Human
cuuaaauauaccagcuguucucuuucccugaacucucccccagguucuaggacaaauuuaauaa

SEQ ID NO: 77492 - RNA, 64 nt, Human; identical to SEQ ID NO: 77073

SEQ ID NO: 77493 - RNA, 64 nt, Human
caagaccaggagagggccaccucacugggccugccucccccaccuccugggccucucugaccuc

SEQ ID NO: 77494 - RNA, 64 nt, Human
gccccgggcuguugggcucugcuuccucccucugcucccccaugucucccugaguucucccacc

SEQ ID NO: 77495 - RNA, 64 nt, Human
ugaauggaagcuuuacauagaaccuuagguagaacucccccaaaucgccauauuuaaaaauuau

SEQ ID NO: 77496 - RNA, 64 nt, Human
caggaaggguauaaaugcauguuccugaggugcccucccccaaagaauguaccugcacucaaac

SEQ ID NO: 77497 - RNA, 64 nt, Human
gaccgugcuugguggggggaugugaacuuucucucucccccagcagugucugcucaggccugac

SEQ ID NO: 77498 - RNA, 64 nt, Human
ggccccccaguucacgauucuggcgcggacuucgcucccccaagacaacacucggaagccaggg

SEQ ID NO: 77499 - RNA, 64 nt, Human
cuguguuuuguuugggaacucggaggcccucccccucccccagcucagaccacagagguggcaa

SEQ ID NO: 77500 - RNA, 64 nt, Human
guuuuguaauagggauuuuuuuuuugguugaccacucccccacacuuccaaaauuaaacagugu

SEQ ID NO: 77501 - RNA, 64 nt, Human
ucuccgucaauauggaaaacucagcaguuuuccucucccccaguuguguucuuguaacguuguu

SEQ ID NO: 77502 - RNA, 64 nt, Human
gaaagguccacaugagugaacuuugaagcauauccucccccaguuuagccuuuagaugaggacc

SEQ ID NO: 77503 - RNA, 64 nt, Human
cagacugacugagggggccugaagcuacaugcaccucccccacugcugcccuccugucgagaau

SEQ ID NO: 77504 - RNA, 64 nt, Human
aaggcgaagguucugauggcugccuugcuccuugcucccccacccccugugaggacuucucuag

SEQ ID NO: 77505 - RNA, 64 nt, Human
ggacagaccuccaccacacugacaucagcuccagcucccccagguugggggggagggggcuccu

SEQ ID NO: 77506 - RNA, 64 nt, Human
gcagcccuucccccagugcccuuugcaucguccccucccccaccccugcuguggguucccauca

SEQ ID NO: 77507 - RNA, 64 nt, Human
ccgugcccaaccucacuugcuucuuauccuuacacucccccagccccagagaaacugccacaua

SEQ ID NO: 77508 - RNA, 64 nt, Human
uucucugaucacuccaucccucuccuaccccucccucccccaacccucaauguauaaauugcuu

SEQ ID NO: 77509 - RNA, 64 nt, Human
ugggggcuuggggguaaauccugaggcuuuggugcucccccacccacccauucccgcccuuugc

SEQ ID NO: 77510 - RNA, 64 nt, Human
ucaaucucucuguuucccuuugucagucucuucccucccccagucucucuucucaaucccccuu

SEQ ID NO: 77511 - RNA, 64 nt, Human
gaggggguagaagggugcccacucaggguuauuccucccccaucagaugcuccagcuccugcuc

SEQ ID NO: 77512 - RNA, 64 nt, Human
cuggguggaggcaccugaagacgucugucccaaacucccccagcccugagcugggagaugacag

SEQ ID NO: 77513 - RNA, 64 nt, Human
cccacagucacacagagcgccucaccugcauccucucccccacaagagccccaaagaucccacg

SEQ ID NO: 77514 - RNA, 64 nt, Human
ccacacuuucuccucaccagaugccaguugcacccucccccaaguugagacaaccaaaaauguc

SEQ ID NO: 77515 - RNA, 64 nt, Human
ucuucacuacauuuaauaguucuccuauuucccgcucccccauaucaauuuuccuuuugucucc

SEQ ID NO: 77516 - RNA, 64 nt, Human
agucaccaaccagcuuugggagacacagccgccacucccccagucuacuucuuuaaaaagcauu

SEQ ID NO: 77517 - RNA, 64 nt, Human
guucuuacuuuccugaaaauaucggggagguuuucucccccagacgccugauauugaaguaaaa

SEQ ID NO: 77518 - RNA, 64 nt, Human
aaggaagggauuugggggggaaucuuccugccgccucccccacuccaaguguuuauuuuugaua

SEQ ID NO: 77519 - RNA, 64 nt, Human
agccugaccuaaccuuuuagggugguuaggacaucucccccaccuccccacuuuuuuccccaag

SEQ ID NO: 77520 - RNA, 64 nt, Human
ccagggccccuguucccccgcuggcagccacccccucccccaucauauccuuugccccaaggcu

SEQ ID NO: 77521 - RNA, 64 nt, Human
auucaagccaauuuuuuuuguuucuucauuuccccucccccaauccaugaaagccuaaauguaa

SEQ ID NO: 77522 - RNA, 64 nt, Human
cagaauuugugagguuugguggauccacgccccucucccccacuuucccaugaugaaauaucac

SEQ ID NO: 77523 - RNA, 64 nt, Human
uguuuucaugguuaucauuauaucuaacuauaaccucccccauaguuaugaagaguaaccugaa

SEQ ID NO: 77524 - RNA, 64 nt, Human
aacucccuuucuagaucccauucauuuucugcaccucccccauaggcuuguuucucuccauugc

SEQ ID NO: 77525 - RNA, 64 nt, Human
uagauccuuuuuuucuguuuuaacauuccucuaacucccccauuuaucuuuugucuauuaauau

SEQ ID NO: 77526 - RNA, 64 nt, Human
agucccacaauagccccaauguuugccuauccaccucccccaagccccuuuaccuaugcugcug

SEQ ID NO: 77527 - RNA, 64 nt, Human
aaaauguaaaaugccagacaugucccagcccgaacucccccaccccauggccuggagguuucua

SEQ ID NO: 77528 - RNA, 64 nt, Human
gaggaaaagggacugugcauugaguugguuccugcucccccaaaccauguuaaacguggcuaac

SEQ ID NO: 77529 - RNA, 64 nt, Human
cccagauuuccuucccuuggaugcuuucgguccccucccccaaccccucccccuggggcuggcc

SEQ ID NO: 77530 - RNA, 64 nt, Human
gggucuccucaggaccaggguuggcaccuucccccucccccagccacuccccagccagccuggc

SEQ ID NO: 77531 - RNA, 64 nt, Human
acagggcugcugguuuccgcagccacugcuccaccucccccaaaucgucauggaaaggguggag

SEQ ID NO: 77532 - RNA, 64 nt, Human
cauggggcuaggucauuaaggccacauccacagucucccccacccuuguuccaguuguuaguua

SEQ ID NO: 77533 - RNA, 64 nt, Human
gugccccgucuacagcucccccagcuccccccaccucccccacucccaaccacguugggacagg

SEQ ID NO: 77534 - RNA, 64 nt, Human
cccguuuucggugccaucagugccccgucuacagcucccccagcuccccccaccucccccacuc

SEQ ID NO: 77535 - RNA, 64 nt, Human
ggccacccaccuagcacuccucucauuuuugcugcucccccaaaagccagcgcuguucuacaau

SEQ ID NO: 77536 - RNA, 64 nt, Human
uauauuucugaaaacuguugcuuuuucuuuuucccucccccauugacgacauagcggcccccgc

SEQ ID NO: 77537 - RNA, 64 nt, Human
gaggacugggcccccacgucccugacuaggccggcucccccagacucagagggcagcaggagca

SEQ ID NO: 77538 - RNA, 64 nt, Human
uuaagcaaacgguguggcauggguugaguguggccaccugcaggaugugcagggcugccucaga

SEQ ID NO: 77539 - RNA, 64 nt, Human
ccagccaccgaagccgccuguggacagccugagucaccugcagaaccuucuggagcugcccuag

SEQ ID NO: 77540 - RNA, 64 nt, Human
ugagcugggugggugcccaggagccggcccgcagcaccugcacacacgaaguccggacccacgc

SEQ ID NO: 77541 - RNA, 64 nt, Human
gccugugcgcaccugcccuccuugcagcccagcacaccugcagguguaagggacgauuggaguu

SEQ ID NO: 77542 - RNA, 64 nt, Human
caaggaaagcucacgaaccccaaaccuggcaagucaccugcagcccauggugagcucugggaag

SEQ ID NO: 77543 - RNA, 64 nt, Human
cuccagcuccaggccuggagaggcuucccagcaacaccugcaguccagccccccucuucuagga

SEQ ID NO: 77544 - RNA, 64 nt, Human
cucagaagccuuuucccuggaaguguccaugccucaccugcaacccaugugguucucagacuug

SEQ ID NO: 77545 - RNA, 64 nt, Human
cucaggucuggguccucccucuagccgaggaggccaccugcagccuccacccggcucucaccgc

SEQ ID NO: 77546 - RNA, 64 nt, Human
uugcuuguguacaucguacccauccauucggcuucaccugcagccaacggccuggaaucgcaaa

SEQ ID NO: 77547 - RNA, 64 nt, Human
ggacucuggugcccacccugccacccccgcgcuccaccugcaguguuucugcccuguaaauagg

SEQ ID NO: 77548 - RNA, 64 nt, Human
uuguuccuggccuaggacuuagcuucauaacuaucaccugcaccgacuaggcugaggugcuggu

SEQ ID NO: 77549 - RNA, 64 nt, Human
gggaauggcacgaucacagugagagagcugcacucaccugcagacccagucagauggcuuguca

SEQ ID NO: 77550 - RNA, 64 nt, Human
gagucacucaccucccucucucccuguaacuugccaccugcaguucuuagggcuguggggucag

SEQ ID NO: 77551 - RNA, 61 nt, Human
aggaagaugaaggcaacugaaucccaagaggcaccugcagccaggaaggaaaggugggggc

SEQ ID NO: 77552 - RNA, 64 nt, Human
caacaaauggaaauacaauccaaugaaaguacuucaccugcaagaugcacaauaauuuucaacu

SEQ ID NO: 77553 - RNA, 64 nt, Human
uaauucagugaaacgaagaugggcuuuuccagaucaccugcaauagcagcagugggauaaaaug

SEQ ID NO: 77554 - RNA, 64 nt, Human
ggaugguccuggacccuugaagcuucacuuccgacaccugcacuggcccgggaagccaauccca

SEQ ID NO: 77555 - RNA, 64 nt, Human
ccaaguucagagcucucugucucccccagccagacaccugcaucccuggcuccucuauuacuca

SEQ ID NO: 77556 - RNA, 64 nt, Human
cuuugugcuucccgugugccuccccaguagcccucaccugcauaccaaccccuccuuuacccac

SEQ ID NO: 77557 - RNA, 64 nt, Human
ugcccagccccuccucccugcccucgggucuccccaccugcacuccauccagcuacaggagaga

SEQ ID NO: 77558 - RNA, 64 nt, Human
ggccuggcagucugagaaaagcgucaguuaggcacaccugcaggccccucggugggacagcggc

SEQ ID NO: 77559 - RNA, 64 nt, Human
ggcugagcaccagcugcgcuucaccugccgcgugcaccugcaugacacacgcaaggagcaggag

SEQ ID NO: 77560 - RNA, 64 nt, Human
gaggucaggagcugaccaagccuuggcccggugacaccugcagcccucacuccugucaucccag

SEQ ID NO: 77561 - RNA, 64 nt, Human
agagguuaucugccuggccuggcuccccacgagucaccugcaagccccagggccugggggcagu

SEQ ID NO: 77562 - RNA, 64 nt, Human
guguggcuagcuguuuccagccagggggcugaggcaccugcagucacccacacucugggccugu

SEQ ID NO: 77563 - RNA, 64 nt, Human
ccgucugucucuugguauuggguaaaggagggggcaccugcaugucuccugcaaugagcaagga

SEQ ID NO: 77564 - RNA, 64 nt, Human
gggacugacuccuggaagacagccuggccuugcccaccugcacacagucuguuggauagguagg

SEQ ID NO: 77565 - RNA, 64 nt, Human
gcagaaggagaccacaaccuccugggaccacugccaccugcaagagcccugcccaggagauaga

SEQ ID NO: 77566 - RNA, 64 nt, Human
gaagcuucugggccaggaaggaaaaaaaaaugcccaccugcagcucuggugaagcuugggccug

SEQ ID NO: 77567 - RNA, 64 nt, Human
aaauacaguauccaaacauuggagauuagugacucaccugcaguugggagccagcuacaaccca

SEQ ID NO: 77568 - RNA, 64 nt, Human
aacuccagauuuauaauaauaugggcugcaaguacaccugcaaauaaaacuacuagaauacugc

SEQ ID NO: 77569 - RNA, 64 nt, Human
cugccucccucaacuugauccaugugaacauccgcaccugcacccaugcugaucaauaaaugcc

SEQ ID NO: 77570 - RNA, 64 nt, Human
cugcaacuuccguccagugcugugaugcccaugacaccugcaaaauaaguucugccugggcauu

SEQ ID NO: 77571 - RNA, 64 nt, Human
ucagcagugcuggugcugcuguguguggacugaacaccugcacuuugcagaggacacgcugcau

SEQ ID NO: 77572 - RNA, 64 nt, Human
ccuggucagugccugucuggccuagggccacucccaccugcaggacauuaaaaucuccaggccu

SEQ ID NO: 77573 - RNA, 64 nt, Human
ggagugcccaugcauacucugcugccgguccccucaccugcacuugaggggucugggcaguccc

SEQ ID NO: 77574 - RNA, 64 nt, Human
gggugagggccaugcaugcaguaugaggggucuacaccugcaaggacugagaggcuuuucuagc

SEQ ID NO: 77575 - RNA, 64 nt, Human
agugcaggcauugcacauggugugagaaggucuacaccugcaagggacgaguccccgggccugg

SEQ ID NO: 77576 - RNA, 64 nt, Human
uggcacaggcauugcacacggugugaggaguguacaccugcaagggcugaggcccugggcccag

SEQ ID NO: 77577 - RNA, 64 nt, Human
gguacaggcauugcacacagugugaaugggucuacaccugcaugggcugagucccugggcucag

SEQ ID NO: 77578 - RNA, 64 nt, Human
gggugcaggcauugcacacggugugaagggucuacaccugcacaggcugaguuccugggcucga

SEQ ID NO: 77579 - RNA, 64 nt, Human
ggccgggcggggaggcuggcucccccacaccucccaccugcauugcucucccucgugcucccca

SEQ ID NO: 77580 - RNA, 64 nt, Human
ccuuuuggcaugcuuaacuuccugguaacaccuucaccugcauugguuuucuuuuucuuuuuuc

SEQ ID NO: 77581 - RNA, 64 nt, Human
uguucugaaaaugucaaacgaggcuucuguuuugcaccugcagaucaccgaguugguuuucuuu

SEQ ID NO: 77582 - RNA, 64 nt, Human
gcuucuccuuucgguucccauggacccggcaccccaccugcaugacgauuuauuuguaucuggg

SEQ ID NO: 77583 - RNA, 64 nt, Human
aguuccucauaagcaggggccagaauaucucagccaccugcagugacauugcuggaccccugaa

SEQ ID NO: 77584 - RNA, 64 nt, Human
cuucgagaccccagucgugauguggaggaagagccaccugcaagauggacacgagccacaagcu

SEQ ID NO: 77585 - RNA, 64 nt, Human
uuaacucggucccuuccugucucuaguucaucagcaccugcagaugccugacucuuguuagccu

SEQ ID NO: 77586 - RNA, 51 nt, Human
cccagcagcuggcacacugagcaccugcacuaaauuacucaaaaugugcug

SEQ ID NO: 77587 - RNA, 64 nt, Human
agugugugaggaagggaggucaggcagcuaggaccaccugcaguguggcaggcuucaucccucu

SEQ ID NO: 77588 - RNA, 64 nt, Human
cuccagauaguguagcugaggaggcaccuacacucaccugcacuaacagaguggccguccuaac

SEQ ID NO: 77589 - RNA, 64 nt, Human
gaguggauucugggagccucuucccuuucucacucaccugcacaucucagucaagcaaagugug

SEQ ID NO: 77590 - RNA, 64 nt, Human
caaacgaaaaacauuucaaaagguauuuauugagcaccugcaggcgugaccugacagcccaagg

SEQ ID NO: 77591 - RNA, 64 nt, Human
agaaacaagaaggagcacccuccacauggacucccaccugcaaguggacagcgacauucagucc

SEQ ID NO: 77592 - RNA, 64 nt, Human
gcucaccguuggcuacccggucacggaggccggccaccugcagagccucuacacagguagugcc

SEQ ID NO: 77593 - RNA, 64 nt, Human
cuucggauggaggccuuucuguugagcugaaaugcaccugcagcugggugcugccagcagcuug

SEQ ID NO: 77594 - RNA, 64 nt, Human
acgguccacugaagcucugaauccucagggaugccaccugcacauucucauacucuguccgggg

SEQ ID NO: 77595 - RNA, 64 nt, Human
ggagguuuccaaaucucaauucuugacuucugugcaccugcaggcuuaacagcacauagaagcu

SEQ ID NO: 77596 - RNA, 64 nt, Human
gcccccuccugaccccaccuagaauggaagccuccaccugcagccccaggccucccucccccgg

SEQ ID NO: 77597 - RNA, 64 nt, Human
ggagcugaggggcagggccguagacucacggcugcaccugcagggagcagcacgccaaccccag

SEQ ID NO: 77598 - RNA, 64 nt, Human
ggcuggcagagguagggggcugcuuugggcuuugcaccugcacuuuggugacauuguucuucug

SEQ ID NO: 77599 - RNA, 64 nt, Human
caccacccuuugcugacucuuuuuggacucagcccaccugcacccaggugauuaaaaagcuuua

SEQ ID NO: 77600 - RNA, 64 nt, Human
aaagugcugcaguauggccagacgugguggcucacaccugcaaucccagcaccuuaggaggccg

SEQ ID NO: 77601 - RNA, 64 nt, Human
cagggaagagucccuggguuauguccaaacuuagcaccugcaauuguugggauguggauggaug

SEQ ID NO: 77602 - RNA, 64 nt, Human
gugaaggacccaugucccaggaaccgcgcugcgccaccugcacucaccccccucacauucucuu

SEQ ID NO: 77603 - RNA, 64 nt, Human
cauuaaacuuaccugggcauucuuguuucaauuccaccugcaaucaaguccuacaagcuaaaau

SEQ ID NO: 77604 - RNA, 64 nt, Human
uagaugaggaaaccaaggcucagaggggcaaagucaccugcaugguagcacauagugauagggu

SEQ ID NO: 77605 - RNA, 64 nt, Human
gguuggcgugcugcagcgacaggcggcagcacagcaccugcacgaacacccgccgaaacugcug

SEQ ID NO: 77606 - RNA, 64 nt, Human
ggcgaaaacauuaccaugugaaaagaauguauuucaccugcaaguuacaaaaaaauaguuugug

SEQ ID NO: 77607 - RNA, 64 nt, Human
auggauauuuuugaauuucugguuugccugaauccaccugcaguuaccccgauccguuugcaag

SEQ ID NO: 77608 - RNA, 63 nt, Human
ucccugcauuugaacucugaaaggauagcaugccaccugcaacucacugcaugacccuuucug

SEQ ID NO: 77609 - RNA, 64 nt, Human
cuggggacccugccagggaaggccacuggguguucaccugcaaaguuucugguugucacugcac

SEQ ID NO: 77610 - RNA, 64 nt, Human
gaaccuggcccaacagaaaaacccugccccaaugcaccugcaggcaagguacccgaagaagcag

SEQ ID NO: 77611 - RNA, 64 nt, Human
gcuaugggugacagaggcucucuccuggugccugcaccugcacucuagugacccugggugccgc

SEQ ID NO: 77612 - RNA, 64 nt, Human
gggccugagaagaucugaguccucaaucccaagccaccugcacaccuggaagccaaugaaggga

SEQ ID NO: 77613 - RNA, 64 nt, Human
cugggcccucauugcugcuuaucguaccccccaucaccugcacaugggacagaccgggcuggag

SEQ ID NO: 77614 - RNA, 64 nt, Human
gccccagcagauggaaaacuaaagcaaauguaaucaccugcauuuugaaaauagguguguuucu

SEQ ID NO: 77615 - RNA, 64 nt, Human
uugccuuagaugacagcugggcucuucuucacaccaccugcagccccucccugccccugcccua

SEQ ID NO: 77616 - RNA, 64 nt, Human
cuuuccucaucccuucugacaccacguccucacucaccugcacaagaaucccugcaucagguuc

SEQ ID NO: 77617 - RNA, 64 nt, Human
uaaugaugugagcagggagccuuccucccugggccaccugcagagagcuuucccaccaacuuug

SEQ ID NO: 77618 - RNA, 64 nt, Human
gucagcuucuuuuggaaacuggacaggccauugccaccugcacuuugaagaagugagcaaagac

SEQ ID NO: 77619 - RNA, 64 nt, Human
uuauggaaguucuaacaauauauggugguuccaacaccugcagugaguuuaaugacugacuuag

SEQ ID NO: 77620 - RNA, 64 nt, Human
ucacccuucgcugacucucuuuucggacucagcccaccugcacccaggugaaauaaacagcuuu

SEQ ID NO: 77621 - RNA, 64 nt, Human
guagccaguaucuuccacugccccaucuguuggccaccugcaggccagucucaacccuccccca

SEQ ID NO: 77622 - RNA, 59 nt, Human
uaugccucuggaacaccuaggcaggugcucaccugcaaacuucagucuggacuucuuuu

SEQ ID NO: 77623 - RNA, 64 nt, Human
agggcacgccuggcuuuccuuggauacccacugucaccugcacuaugaagugcugcuggcuggg

SEQ ID NO: 77624 - RNA, 64 nt, Human
ugccccccuuuggcuuaauuaagugugcugucugcaccugcaagguauggccacccaaucuucu

SEQ ID NO: 77625 - RNA, 64 nt, Human
ccucagugcccccuuuuggagagaugagcuguaucaccugcagaugugggguaaguggggagca

SEQ ID NO: 77626 - RNA, 64 nt, Human
ggcaccugaccaggugacgugggcguggucaccucaccugcaaggcuuuguggacucugcacac

SEQ ID NO: 77627 - RNA, 64 nt, Human
ggucaaccuggccguccggggcccccaggccccccaccugcaggacaacuuauaaugggaccca

SEQ ID NO: 77628 - RNA, 51 nt, Human
uggaugguugcaagcuguagccaccugcauggccccugcagcacucaccag

SEQ ID NO: 77629 - RNA, 64 nt, Human
ccacuuuuguuuauauaaauaagagcuucugccccaccugcagacauguuuacuaaugaucaua

SEQ ID NO: 77630 - RNA, 64 nt, Human
acuguaggcugagcuuggcccuggacucggaacacaccugcagucccaggcugggcugugaccc

SEQ ID NO: 77631 - RNA, 64 nt, Human
ggcgcugaguauggagcagccuggagacccaccccaccugcagggcugcccugagcgccuggau

SEQ ID NO: 77632 - RNA, 64 nt, Human
cacuuccuuuuaccugcccaaggaugcugucaagcaccugcaugugcugucacgcacaagggca

SEQ ID NO: 77633 - RNA, 64 nt, Human
cuuacacagggcgagggguuggugggaggguuggcaccugcacacuccaucuccugcucaccac

SEQ ID NO: 77634 - RNA, 64 nt, Human
cguuggguagcuggggccaggcuucucuccccaccaccugcagauuucuugcugcuuccacuga

SEQ ID NO: 77635 - RNA, 64 nt, Human
aagggaggaggagcacaagauccucagcaacgaacaccugcacuuagaaaaaguggacagcuuc

SEQ ID NO: 77636 - RNA, 64 nt, Human
cagucauguacuggagaguggcaaaagucugaggcaccugcauaucucuagucccuguguucug

SEQ ID NO: 77637 - RNA, 64 nt, Human
acaccugcaaggcugucaacagucuuggagaagccaccugcacagcagagcucauuguggaaac

SEQ ID NO: 77638 - RNA, 64 nt, Human
uuagugauguuugcggggaugacgaugccaaguacaccugcaaggcugucaacagucuuggaga

SEQ ID NO: 77639 - RNA, 64 nt, Human
aggggaggaaggcugccaggagcugaggggcuagcaccugcauugaggggagucugggugcauc

SEQ ID NO: 77640 - RNA, 64 nt, Human
ggugcuauguaaaucuaagguauuguaaacuguacaccugcauccagaugccccuucucguauu

SEQ ID NO: 77641 - RNA, 64 nt, Human
ugaggacaggcccccauuauccuaggggugcgcucaccugcagccccuccuccucgggcacaga

SEQ ID NO: 77642 - RNA, 64 nt, Human
caucuggggcugaggacacacagauacauaaugacaccugcagaaauguauucucugaggacac

SEQ ID NO: 77643 - RNA, 64 nt, Human
aguggaaggcaucagucccuauguauuugcaguucaccugcacuuaaggcacucuguuauuuag

SEQ ID NO: 77644 - RNA, 64 nt, Human
aagugcugaaugcucagucugaucaacaagugggcaccugcacuaccacuuuuuagaggaaauu

SEQ ID NO: 77645 - RNA, 64 nt, Human
aaagauucccugaugcugauauuuccacuaagaacaccugcauucuucccuuaucccugcucug

SEQ ID NO: 77646 - RNA, 64 nt, Human
ccagcuuuccacgcgcgcgcaagcacaguuaagccaccugcaggaauaaacacgcgagaacauc

SEQ ID NO: 77647 - RNA, 64 nt, Human
aagauccaugaaaauccauugaucagaagaacuucaccugcagaccucuucaagugacacuaug

SEQ ID NO: 77648 - RNA, 64 nt, Human
gacgcgcgucucaagccugcccuuccuagacggccaccugcaggaccccacacucacugcacug

SEQ ID NO: 77649 - RNA, 64 nt, Human
gauaauuguagucaauuguacaaacugauggagucaccugcaaucucauauccugguggaaugc

SEQ ID NO: 77650 - RNA, 64 nt, Human
ccucacaccucgugccucccccucacaggguggccaccugcaccagcgucagggcccagggugc

SEQ ID NO: 77651 - RNA, 64 nt, Human
aacaucauauggagaaguuuacauggugauuguucaccugcaguacuguggaguuuuaacauuu

SEQ ID NO: 77652 - RNA, 64 nt, Human
auuuccugaauggauguggaaaugaaagcuagcgcaccugcacuuugaauucuugcuucuuuuu

SEQ ID NO: 77653 - RNA, 64 nt, Human
ucugaaauaucugacacaauguaaacauugcaggcaccugcauuuuauguuuuuuuuuucaaca

SEQ ID NO: 77654 - RNA, 64 nt, Human
uuuggauaaaauaucucuuugcauucuucuuggccaccugcauagucugacacauacguaugua

SEQ ID NO: 77655 - RNA, 64 nt, Human
aaagauauuaggucuggccaggcgaagugacucacaccugcaaucccagcacuuugggaggccg

SEQ ID NO: 77656 - RNA, 64 nt, Human
uuaaaaaauuuuucaagcugggccuaguggcgcacaccugcaaucccaacacuuugggaggcca

SEQ ID NO: 77657 - RNA, 64 nt, Human
aguuucuguaauuuaaaaagaugugguggccugacaccugcaaucccaacauuuugggaggcca

SEQ ID NO: 77658 - RNA, 64 nt, Human
gcauuuaugaauucucucucaagaagcaagagaacaccugcaggaagugaaucaagaugcagaa

SEQ ID NO: 77659 - RNA, 64 nt, Human
agagcauaggcuugaacuuaaaucucagcucagucaccugcaggacuuuaggcaccagugauuu

SEQ ID NO: 77660 - RNA, 64 nt, Human
acugccuugccaucgggcccaguucuccgggccccaccugcaccccuuucuucccccugggaua

SEQ ID NO: 77661 - RNA, 64 nt, Human
gccuuugccccagggugggugcaggugcgagugucaccugcagcugccucagucauucagaguu

SEQ ID NO: 77662 - RNA, 64 nt, Human
accaucuccucacaccccagaguggaaaggugaacaccugcagcugaggcuuggaaacguuucu

SEQ ID NO: 77663 - RNA, 64 nt, Human
cucucccucacaccucccuucaucccaggguauccaccugcaccccacucccaaguagcuugaa

SEQ ID NO: 77664 - RNA, 64 nt, Human
ucuucuguaaccaccucauaggucucccuggugccaccugcagcauuucuagauaccgacaaua

SEQ ID NO: 77665 - RNA, 64 nt, Human
gguucuggggucuggcaaagaggaugcaguuugacaccugcagcccuuucucaaucccacuaau

SEQ ID NO: 77666 - RNA, 64 nt, Human
cacagcuccuuucacuccugccugacugccaagccaccugcaucccccgccccagaucucauga

SEQ ID NO: 77667 - RNA, 64 nt, Human
cucuuguuaauguauuaacaguuacuaguuuuggcaccugcaacuuucuguauagaccauacau

SEQ ID NO: 77668 - RNA, 64 nt, Human
gcgccagcccuaggcuacccuugccaaggccgcccaccugcaucagccucuggccagacggccc

SEQ ID NO: 77669 - RNA, 64 nt, Human
gacuugaagaacccugacuuuguuucugcaaaggcaccugcaugugucuguguucguguaggca

SEQ ID NO: 77670 - RNA, 64 nt, Human
gcccccaugaccuagugcuaggcguggacgggcgcaccugcauggagggguccccagagccccc

SEQ ID NO: 77671 - RNA, 64 nt, Human
gcauaggcucccacugccaccaccgccaucgccucaccugcagcucugaagacccaggccucac

SEQ ID NO: 77672 - RNA, 64 nt, Human
aagagaguggggccugcccucugccccaucauugcaccugcaggcuuagguccucacuucuguc

SEQ ID NO: 77673 - RNA, 64 nt, Human
augguucaacucugucugcaaauuaacagcugaacaccugcaacugcaaauguuuuuugauccg

SEQ ID NO: 77674 - RNA, 64 nt, Human
aggcucuucaaaauaacuccauggugcacaggagcaccugcauccaagagcaugcuuacauuuu

SEQ ID NO: 77675 - RNA, 64 nt, Human
uccuagaaauccagagagcaaagucagagccuggcaccugcagauaggauaacacuggugucug

SEQ ID NO: 77676 - RNA, 64 nt, Human
acccacaggaaaagaauucauuuuaucaaaaagacaccugcaccaauauguucauuacagugcu

SEQ ID NO: 77677 - RNA, 64 nt, Human
aagguuacauguuuuuguuuacugagaguaagaucaccugcaucuggaagacgggcugguaaau

SEQ ID NO: 77678 - RNA, 64 nt, Human
uuuuggcaaagccagaaaaagaucuuucauuuugcaccugcagccaagcaaaugccugccaaau

SEQ ID NO: 77679 - RNA, 64 nt, Human
cacccagagucaggggaagauuuagaaacagugacaccugcauauagaauuuugauuccuugaa

SEQ ID NO: 77680 - RNA, 64 nt, Human
gcuagcgacugacagaaauaacuacccugucucccaccugcaggaaugucuaacaaagcaucca

SEQ ID NO: 77681 - RNA, 64 nt, Human
caaauaaauaguugcucuucuacacuagggguuucaccugcagguuugacacgcaguugcucgc

SEQ ID NO: 77682 - RNA, 64 nt, Human
ucauucucuccugcacgcuguuaggcaguucuuucaccugcaugcuucuucuuuuaccuuuuug

SEQ ID NO: 77683 - RNA, 64 nt, Human
uggccaccgugggugaggccugaccaccuugggacaccugcaagacgacuccaacccaacaaca

SEQ ID NO: 77684 - RNA, 64 nt, Human
cacacacauacacacacacggaccaaaauacuuacaccugcaaaggaauaaagaugugagagua

SEQ ID NO: 77685 - RNA, 64 nt, Human
auggcaccgaagucagaugaguaucccuguaggucaccugcagccugcguugccacuugucuua

SEQ ID NO: 77686 - RNA, 64 nt, Human
caccuuuccccagagccccagcaucccuugcucacaccugcaguagcggugcugucccaggugg

SEQ ID NO: 77687 - RNA, 64 nt, Human
uguugaugggcuuugcaggcaguccagcagcccacaccugcaggcaggaugcugucgucaauga

SEQ ID NO: 77688 - RNA, 64 nt, Human
gccacauggagcaucccuuccuggucuugccaggcaccugcacagagcgucuccagccccaucu

SEQ ID NO: 77689 - RNA, 64 nt, Human
cuggcauccaggcacugggcccaugcagagaaggcaccugcagagagcagggcagcccggcgca

SEQ ID NO: 77690 - RNA, 64 nt, Human
agggcuacgaaggaagcugaacacgcguccaguccaccugcaccucuucaaugacugucugcug

SEQ ID NO: 77691 - RNA, 64 nt, Human
gucaacaucccaguuuuguucuaucuuucugucccaccugcacugggauguggcuucuacacuc

SEQ ID NO: 77692 - RNA, 64 nt, Human
uggcuuuuccucuauggacuuccucuuccugccccaccugcauaggcacacacaccuugaaucu

SEQ ID NO: 77693 - RNA, 64 nt, Human
ucucuacuaaaaauuagccaagugugguaauguucaccugcagucccagcuacuugggaggcca

SEQ ID NO: 77694 - RNA, 64 nt, Human
aaaaaugaugaaguugcaaauggcagugugcugucaccugcaacagaagugcguaccagaagua

SEQ ID NO: 77695 - RNA, 64 nt, Human
cuuuaucugauugacuccaaacaucccgaaaugucaccugcagauuucucgugggaaccaauau

SEQ ID NO: 77696 - RNA, 63 nt, Human
agcagacggccgcugugugaccccucggucgcccaccugcacagcuccccuguccuccuccac

SEQ ID NO: 77697 - RNA, 64 nt, Human
gggaggccggucggcagccacucccuccagggcgcaccugcaggucugccauccacggccuuuu

SEQ ID NO: 77698 - RNA, 64 nt, Human
uuguugauaggcuucugcugaacauaugccaacccaccugcauaauauauuuuuguugcuuuua

SEQ ID NO: 77699 - RNA, 64 nt, Human
accucugagccuggaaccgauugacauguaaaugcaccugcaccguuucugagccgggagagug

SEQ ID NO: 77700 - RNA, 64 nt, Human
agaggagcugagcccuguggagcagaacgggaaccaccugcagagguccccagacccaaagcag

SEQ ID NO: 77701 - RNA, 64 nt, Human
uaauugguugacuuaauauauuugcuuuuuuucucaccugcacuuagaggaaauuugaacaagu

SEQ ID NO: 77702 - RNA, 64 nt, Human
gcaagguagagaaguugugccgcucaaucacagacaccugcacccacaacauacuucuguuaca

SEQ ID NO: 77703 - RNA, 64 nt, Human
uucuccuuaaccagcuccacagcagccccugagucaccugcacaaggugcuugggaacugcugg

SEQ ID NO: 77704 - RNA, 64 nt, Human
gagagucugguccugccuagcucagauuucauggcaccugcacuugaagcaagucacuucuuua

SEQ ID NO: 77705 - RNA, 64 nt, Human
uucacugaccccagcucuucccuugcugcagccgcaccugcagcuccagggaguuaacucuucu

SEQ ID NO: 77706 - RNA, 64 nt, Human
gaagggcccggagggugucuccccaagccaggcacaccugcacaaacccagagccgacccucag

SEQ ID NO: 77707 - RNA, 64 nt, Human
gaauaacuuagcucagccugacacauacuaagggcaccugcagacacuuucugcaauaagcucu

SEQ ID NO: 77708 - RNA, 64 nt, Human
ccauugucaucaccauggaaacaacguuccucuccaccugcauuauguacuacaugacaggcau

SEQ ID NO: 77709 - RNA, 64 nt, Human
ccugguuagcacagauguggacugagugcuuugucaccugcaggguaguaacccagugauguuu

SEQ ID NO: 77710 - RNA, 64 nt, Human
uggugaaaaguaaaccuuuucaccuacaaaauuucaccugcaaaccuuaaaccugcaaaauuuu

SEQ ID NO: 77711 - RNA, 64 nt, Human
agaucaauccaccagugcaaaacagggcuaacggcaccugcaggacagcagcacgcuccauccc

SEQ ID NO: 77712 - RNA, 64 nt, Human
cacaaggagccugcacagcaagccagcggugacacaccugcaggugucaggcauggcacugggc

SEQ ID NO: 77713 - RNA, 64 nt, Human
uuuaauaggugauaaauguacaguaguuagauuucaccugcauauacauuuuuccauuuuaugc

SEQ ID NO: 77714 - RNA, 64 nt, Human
cuuucagagguuuaacgugcugcuuccgaugugccaccugcaguaguggaucauguggagugaa

SEQ ID NO: 77715 - RNA, 64 nt, Human
uccucagcagccuccguaacagcugcccugccuacaccugcagagcuggagguucuguccuccc

SEQ ID NO: 77716 - RNA, 64 nt, Human
ggccgccauccccaugucagauccccaggugcugcaccugcagggaggcagccagguacguguc

SEQ ID NO: 77717 - RNA, 64 nt, Human
uuacuuaacgcuuuuuucugagcacagggaugggcaccugcaccccagaaggugugagcugucu

SEQ ID NO: 77718 - RNA, 64 nt, Human
cugacugguugugaucgaaacagguggacagagacaccugcacuuggaacuggacuccacccac

SEQ ID NO: 77719 - RNA, 64 nt, Human
guggucagaccccacacgcccucucugggcccaccaccugcaucugcgacuagagagcacccgg

SEQ ID NO: 77720 - RNA, 64 nt, Human
gccugugcuccuggcaguguggcuucccggugcucaccugcacagcaguuaacagcagaggccg

SEQ ID NO: 77721 - RNA, 64 nt, Human
uggucaucugugucgccauccccuuccugcugcacaccugcaccacggccauggggaggcugcu

SEQ ID NO: 77722 - RNA, 64 nt, Human
uucuguuggcuccuaggggugugaaucaccacaucaccugcagggggcgcggcugucuuucuuc

SEQ ID NO: 77723 - RNA, 64 nt, Human
uacccgugcacaggcacacgugcuggucugcacacaccugcacacaccugcacacucgcuaugc

SEQ ID NO: 77724 - RNA, 64 nt, Human
caggcacacgugcuggucugcacacaccugcacacaccugcacacucgcuaugccaggccuccu

SEQ ID NO: 77725 - RNA, 64 nt, Human
uacagagcccggcaccccaugaggacaugcagagcaccugcagaggagcaggaggccggagcug

SEQ ID NO: 77726 - RNA, 64 nt, Human
gggggaagaggagcugccuuuuggaggcccccuucaccugcagcuaugaugcccuuccccuucu

SEQ ID NO: 77727 - RNA, 64 nt, Human
uuugagggacucguuauccagcucuugguagccacaccugcaauguaaaauggaagaaaaugca

SEQ ID NO: 77728 - RNA, 64 nt, Human
cccaucugcugaauggagacagcagcugcuacuccaccugcagcugggcuaggggcggggacug

SEQ ID NO: 77729 - RNA, 64 nt, Human
agaugcagccauucuuucagcaaagcuucauugacaccugcaccuguuaacuguguucgacauu

SEQ ID NO: 77730 - RNA, 64 nt, Human
uuaaguagcaaguguagguuucagcuggcaguuccaccugcauguucucugcuucgcugccuug

SEQ ID NO: 77731 - RNA, 64 nt, Human
ggcggaggacucguuccuugcagaggucaguccucaccugcaggugucggggugugggggggca

SEQ ID NO: 77732 - RNA, 64 nt, Human
agcugcgggcaugggaagggcuagcugagcucuucaccugcauccuggcugccgugaggauucc

SEQ ID NO: 77733 - RNA, 64 nt, Human
cggaagcucccuuggaggcagcccugccccgugccaccugcagcuuuaauauuuaugaucaggg

SEQ ID NO: 77734 - RNA, 64 nt, Human
gacuccccuccccaucucccucucaaccucaacccaccugcaugcaucucccccagaggaaaca

SEQ ID NO: 77735 - RNA, 64 nt, Human
cagucaguccuccgagcagcaggaaucaucccgucaccugcagccuucccaugcuuccgccuuu

SEQ ID NO: 77736 - RNA, 64 nt, Human
agauaaacagcucaggcauaauuugaaaaagccacaccugcaugauguguuuugaaggaaauga

SEQ ID NO: 77737 - RNA, 64 nt, Human
gguuuacucaggcagcaucuacuaagaaauucagcaccugcauaucucugugacauggucacuu

SEQ ID NO: 77738 - RNA, 64 nt, Human
uggagcuuugguaaagggaccagagagaaggagucaccugcagucuuuuguuuuuuuaaauacu

SEQ ID NO: 77739 - RNA, 64 nt, Human
agaagggcagauaguuuggcugcuccugugcugucaccugcaauucucccuuaucagggccauu

SEQ ID NO: 77740 - RNA, 64 nt, Human
acccucccugcccgucuugucccucugccccucccaccugcacaugucacacugaccacaucug

SEQ ID NO: 77741 - RNA, 64 nt, Human
uuauucagaugguuuucccaggcuaaaggaaagucaccugcaagagaucccggcacugaucugg

SEQ ID NO: 77742 - RNA, 64 nt, Human
cacacucaucagccugaaguuagccccugagugccaccugcaucgugccauaacccugaccgcc

SEQ ID NO: 77743 - RNA, 64 nt, Human
uccauugcucaagccagggaaugcauugcagaggcaccugcacaacgacaaacuugaguguuuc

SEQ ID NO: 77744 - RNA, 64 nt, Human
ucauccucaacaagccagggcucagguacaagcccaccugcaaccaggugagcccuuagcccac

SEQ ID NO: 77745 - RNA, 64 nt, Human
ucuccaccaccuggggauacgaugagaagauggccaccugcaagccaggaagacggcccucacc

SEQ ID NO: 77746 - RNA, 64 nt, Human
aagggauucauauucccagaacgcuuuaaguguacaccugcaggauaaagagauaccgguuaca

SEQ ID NO: 77747 - RNA, 64 nt, Human
ucugggaagcaucaaauagacacacggccccagccaccugcaacuuaugugcacuguuguaaac

SEQ ID NO: 77748 - RNA, 64 nt, Human
ggagagguggcccagagaacagcagagucaguuacaccugcagcucuugucuaaagugauuaga

SEQ ID NO: 77749 - RNA, 64 nt, Human
uuagguucaagaugcagauuucucaauuuggacacaccugcaucacguuggucaaauuuugcug

SEQ ID NO: 77750 - RNA, 64 nt, Human
agaaugcuagcccaucuggcugccgaucugcuaucaccugcaacucuuuuuuuaucaaggacau

SEQ ID NO: 77751 - RNA, 64 nt, Human
agcccccagcaggggaggcccacaccugccccagcaccugcaggaccaagugcagaggcucaug

SEQ ID NO: 77752 - RNA, 64 nt, Human
cucccgagagccugccuuuccugcccuuccccaccaccugcacugccccccacauucucccagc

SEQ ID NO: 77753 - RNA, 64 nt, Human
uaggauuuucuuaugcacugcacacucuggaccucaccugcagauacaguuccccccuugccag

SEQ ID NO: 77754 - RNA, 64 nt, Human
caaaauggggagaaaacuguuugccugugguagacaccugcacgcauaggauugaagacaguac

SEQ ID NO: 77755 - RNA, 64 nt, Human
cauucgggggaaagugggggaacgacacacacuucaccugcaagggccgacaacgcaggggaca

SEQ ID NO: 77756 - RNA, 64 nt, Human
ucacagggucagcugggccccccuggugcuucaccaccugcauccucuugcucagaaugccuuu

SEQ ID NO: 77757 - RNA, 64 nt, Human
agcccagcgcccuccucuucuccucaccgcauuccaccugcaucccccacaucacccugaagau

SEQ ID NO: 77758 - RNA, 64 nt, Human
ugaagcccguguccugccuugaugaagccugugccaccugcaagugcccgcccugccccugccc

SEQ ID NO: 77759 - RNA, 64 nt, Human
uaugcccaacacgaccacugccucccugcccccacaccugcacccaaacagacacaucaacgca

SEQ ID NO: 77760 - RNA, 64 nt, Human
agacaacaggcauuuucuuucuuuuuucucugaccaccugcagccuguugaaggacuacaggua

SEQ ID NO: 77761 - RNA, 64 nt, Human
uucugcagcggcauggucccucccauucuggcuccaccugcagccucccuggguggccuaggcu

SEQ ID NO: 77762 - RNA, 63 nt, Human
uugccaagggcggggcuuagagcucaacccagacaccugcaggugccggaagcugcgaaggug

SEQ ID NO: 77763 - RNA, 64 nt, Human
ggagcuccuggagcgcagccuggagagucgggaccaccugcaccgcgaacagcgggaguaccug

SEQ ID NO: 77764 - RNA, 64 nt, Human
guuuaccccucuagaacuggggucugcaaacucccaccugcagccaaaucuggcccaccuccuu

SEQ ID NO: 77765 - RNA, 64 nt, Human
cccccagcacccgggcucagggaccacagcaaggcaccugcagguugggccauacuggccucgc

SEQ ID NO: 77766 - RNA, 64 nt, Human
cuuuuccagcuggagcagcugggcaugagugucccaccugcaacaaggugggcguuuaagaggc

SEQ ID NO: 77767 - RNA, 64 nt, Human
uuuugccccaagauucugacuucuggcuacauuucaccugcaguuaccugggcuaucggccgug

SEQ ID NO: 77768 - RNA, 64 nt, Human
uugaauagcaaaaugcauuuaaauaugcacuguucaccugcagaguaaacaaucucagaaguau

SEQ ID NO: 77769 - RNA, 64 nt, Human
augcgguuuguagcuuccucccuacucucuccaacaccugcaugcaaagacuacugggaggcug

SEQ ID NO: 77770 - RNA, 64 nt, Human
ugaugcacuuuaaauaaucugcaugccauugagacaccugcaugucugguguuugugguucaag

SEQ ID NO: 77771 - RNA, 64 nt, Human
cugagucaguucgucccacacauccucccugaggcaccugcaccugcucuagcucaccauccau

SEQ ID NO: 77772 - RNA, 64 nt, Human
cuuuuccagcuggagcagcugggcauaagcgucccaccugcaacaaggugggcguuuaagaggc

SEQ ID NO: 77773 - RNA, 64 nt, Human
cgcagugaucaaaguccgaggggcgggacccaggcaccugcauuuuaaagcgccccgggagacu

SEQ ID NO: 77774 - RNA, 64 nt, Human
cuucccugcaccccauucccacccugaaguucugcaccugcaccuuuguugaauugugguagcu

SEQ ID NO: 77775 - RNA, 64 nt, Human
uuuccaguguguauaaauccaugaaaauaaacgccaccugcaccccacccacucaccccaugcc

SEQ ID NO: 77776 - RNA, 64 nt, Human
ucugaaucaguucaucccacacaucauccugaggcaccugcaccugcucuagcucaucauccau

SEQ ID NO: 77777 - RNA, 64 nt, Human
cuugaccacagggaccaagaaguggcaaugaggacaccugcaggaggggcuagccugacuccca

SEQ ID NO: 77778 - RNA, 64 nt, Human
ugcuuucugauuuuccucucccaggucacugucucaccugcacucuccaaacucagguuccggg

SEQ ID NO: 77779 - RNA, 64 nt, Human
gaaaguuuuacugugaaagucuucuucagauccccaccugcaucauuccgaauguguccuggaa

SEQ ID NO: 77780 - RNA, 64 nt, Human
ccggagcacggcaccgagggagccgccacacggucaccugcaaggacgucacgggccccucuaa

SEQ ID NO: 77781 - RNA, 64 nt, Human
uucuccuuuuucuaccuuuuuuucucuccuaagacaccugcaauaaaguguagcacccugguac

SEQ ID NO: 77782 - RNA, 64 nt, Human
auaaauaaauacauaaaaagcaaacaagcggggacaccugcagucuuagucacugacaaugggu

SEQ ID NO: 77783 - RNA, 64 nt, Human
uucauuuauuucuauacuuuuucuguuuuuuaaacaccugcauauuuuuauguaaaucucuaaa

SEQ ID NO: 77784 - RNA, 64 nt, Human
ggagaccuuuguuccugugggaaaauaucccucccaccugcaacagcugccccugcugacugcg

SEQ ID NO: 77785 - RNA, 64 nt, Human
agccgcaaucuggcuccuccuggaaaauuucccccaccugcagcgcugggccccaaggcuugcc

SEQ ID NO: 77786 - RNA, 64 nt, Human
gucccauacucccacuuugugccaaaugacuuugcaccugcaaauggugcuucaaugucguuuu

SEQ ID NO: 77787 - RNA, 64 nt, Human
gcccagucauuugcuuagaugguguuugugggaucaccugcagauuuaaagccuacucugccac

SEQ ID NO: 77788 - RNA, 64 nt, Human
cagcaguugagccccgaaggagaucaggcagccccaccugcaggagaacgucagcccuccaggg

SEQ ID NO: 77789 - RNA, 64 nt, Human
agcugagugcugagccuugggagccccugccagccaccugcaccuguggacagugggugggggc

SEQ ID NO: 77790 - RNA, 64 nt, Human
uugugaacuaauguugugaauuuuuguauacagucaccugcauaguuccuacaggcuaaugugg

SEQ ID NO: 77791 - RNA, 64 nt, Human
acagccacccacccucucccaccucaugcuccugcaccugcaccaccaagguugaugccggauu

SEQ ID NO: 77792 - RNA, 64 nt, Human
uuggaacacacagaaccaaaccagguguguucuacaccugcaugagugaaggauuuccacguag

SEQ ID NO: 77793 - RNA, 64 nt, Human
aaaaauacaaaaaucagccagacaugguggcaugcaccugcaaucccagcuacucgggaggcug

SEQ ID NO: 77794 - RNA, 64 nt, Human
auguuaacaugacauuuaccagcaacuugaacuucaccugcaaagcucuguggccacauuuuca

SEQ ID NO: 77795 - RNA, 64 nt, Human
ggaguuggccacggccaagaacgacaugaaccggcaccugcacgaguacauggagaugugcagc

SEQ ID NO: 77796 - RNA, 64 nt, Human
gauuccaaagacguuuaccaguaauaucaccaggcaccugcagaagaggaaaaucacuguuuuu

SEQ ID NO: 77797 - RNA, 64 nt, Human
gugacugccccaacuccuggaagcuguguccuugcaccugcauccguaguucccugaaaaccca

SEQ ID NO: 77798 - RNA, 64 nt, Human
caggagaaaugcauccauuccucagggacagagacaccugcaccuccccccacugcaggccccg

SEQ ID NO: 77799 - RNA, 64 nt, Human
guguguggggaugucaggucaggagcuggaaguucaccugcaggugccaaagagcaggccggcc

SEQ ID NO: 77800 - RNA, 64 nt, Human
aaaaguacaaaaauuagcugggcaugauggcacgcaccugcagucccagcuacuugggaggcug

SEQ ID NO: 77801 - RNA, 64 nt, Human
cuacagccauguccuauuccuugaucauccaaagcaccugcagaguccagugaaaugauauauu

SEQ ID NO: 77802 - RNA, 64 nt, Human
ggaccaagugcaauucagggccuuuuucuccacucaccugcacccagaagcagagaaaagcagg

SEQ ID NO: 77803 - RNA, 64 nt, Human
ugcuccuacccuuggugccuaaugcugugugaugcaccugcagggugugugcuagccucugugc

SEQ ID NO: 77804 - RNA, 64 nt, Human
cagcagacagaguacagagaagggccucagaggacaccugcaguacagcuauccagagagacug

SEQ ID NO: 77805 - RNA, 64 nt, Human
aguucaggcucugagacacaccccaacaugccugcaccugcagcgcgcacacgcacgcacacac

SEQ ID NO: 77806 - RNA, 64 nt, Human
uuuaggccucacucccaucagaacccugccugcccaccugcaacucccccccaacaaugccauu

SEQ ID NO: 77807 - RNA, 64 nt, Human
guugucaacacugcagaguugaggccucauaucucaccugcacugcugcaacagcuuacugguc

SEQ ID NO: 77808 - RNA, 64 nt, Human
ucaauauuaacuggaaugcugccucuuggguucucaccugcauggaugcuuugaguuggacgug

SEQ ID NO: 77809 - RNA, 64 nt, Human
guguucucagugaccuaccucccaggcuccucugcaccugcaaaggaacaggagugagucguga

SEQ ID NO: 77810 - RNA, 64 nt, Human
ugagcagacaccuucacagcuuccucgcugcugucaccugcacuauccaauuaguauuuucauu

SEQ ID NO: 77811 - RNA, 64 nt, Human
gccugagccucccagcugccaugugccuguugcacaccugcacacacgcccuggcacacauaca

SEQ ID NO: 77812 - RNA, 64 nt, Human
acuugcagaaaagaaacauguuaaaaucauggcacaccugcagaauuucagaugacaguguggu

SEQ ID NO: 77813 - RNA, 64 nt, Human
cagcugagccuccuuaccucccuucagccaagcccaccugcacgugaucugcuggccucaggcu

SEQ ID NO: 77814 - RNA, 64 nt, Human
ggauuucccuccucaauuggcuuauuuuuuagaucaccugcaauucauuugcaaauugcaauaa

SEQ ID NO: 77815 - RNA, 64 nt, Human
cccuugcccuugcagaggcagaagccugcgucugcaccugcaccucugaccguuucagcacccu

SEQ ID NO: 77816 - RNA, 64 nt, Human
cuuaacugccaagagcagguccuggaguucccuucaccugcagaguccuuuucaugaccuagga

SEQ ID NO: 77817 - RNA, 64 nt, Human
gccuacccuggagcaccuggagcuuaucccggagcaccugcaccuggagucuacccagggccac

SEQ ID NO: 77818 - RNA, 64 nt, Human
acaaaaacaaaaauuagccagggguggugguaugcaccugcagucccagcaacaugggaggcug

SEQ ID NO: 77819 - RNA, 64 nt, Human
aagauuaaaauccgucucccauuuguuacagccucaccugcaccaggauagaaagcacgugaug

SEQ ID NO: 77820 - RNA, 64 nt, Human
ccccucaguuugguagugccccaccucccgcccucaccugcagagaaacgcgcuccuuggcgga

SEQ ID NO: 77821 - RNA, 64 nt, Human
gggcaggaccuugagccugcagcacacacuaggccaccugcagucucacaggccaugcccuggg

SEQ ID NO: 77822 - RNA, 64 nt, Human
augaaaauauuugcaaaaaaguccaagcuggaagcaccugcagaauuaaucacaugcucuuauu

SEQ ID NO: 77823 - RNA, 64 nt, Human
ucugguagggauauggcaggacuccuggcagggccaccugcaggacccuguccugcagucccac

SEQ ID NO: 77824 - RNA, 64 nt, Human
caugcacucagagcacagagccgggcagacgcagcaccugcauggggagcccagugcccggcac

SEQ ID NO: 77825 - RNA, 64 nt, Human
ggccaucagaaaacuucuucccaaggccacaccacaccugcaaaaugccuaacaaccuucuucu

SEQ ID NO: 77826 - RNA, 64 nt, Human
cuggacuuccucccugauccccacccuuacucaucaccugcaguggccagaauuagggaaucag

SEQ ID NO: 77827 - RNA, 64 nt, Human
ucuccccaucucucagaugcacgggaacaagcagcaccugcagaaggacuucuuccuguacaac

SEQ ID NO: 77828 - RNA, 64 nt, Human
ugugaacucaaaugagguuuccuggguaaugugacaccugcagaaacuauagagcgucauuuau

SEQ ID NO: 77829 - RNA, 64 nt, Human
aaugugaucugagacuaaaguuuguccuuggaaacaccugcagcucauuguggauuaagaaccu

SEQ ID NO: 77830 - RNA, 64 nt, Human
uguacaguugugcagguuguucacugcacaagggcaccugcagcuaauggaggcuggaauucag

SEQ ID NO: 77831 - RNA, 64 nt, Human
uuauuuauaguccaaagaaaccaaagacuuagcucaccugcauucugacuuuguuuggagacac

SEQ ID NO: 77832 - RNA, 64 nt, Human
uaaggcaaaagggaaaguguucuagguuccagcacaccugcaaagauaaagugugccaagacug

SEQ ID NO: 77833 - RNA, 58 nt, Human
guaggaauugcauaaaaugagggagacccaccugcauguuguuuuguaagcaucuuca

SEQ ID NO: 77834 - RNA, 64 nt, Human
gucucugguaccugugugcgucagggaugcucugcaccugcaaccaggugucguccacgggcgg

SEQ ID NO: 77835 - RNA, 64 nt, Human
cugggcaggguguccaaacuuggggcuucccaggcaccugcagugugaacacugcuuggcuggc

SEQ ID NO: 77836 - RNA, 64 nt, Human
ccacggugccaucucuuguguaugcagggcuaugcaccugcaggcacguguguaugcacucccc

SEQ ID NO: 77837 - RNA, 64 nt, Human
acagccacauuuccauuugcaucauuacugccuucaccugcauagucacucuuuugaugcuggg

SEQ ID NO: 77838 - RNA, 64 nt, Human
agaucaaggcuacagugagccgcgacccaucgcacaccugcacuccaguccuggugcaacagau

SEQ ID NO: 77839 - RNA, 64 nt, Human
uagggccucaguucuagacgagucauaccugauucaccugcacugcuuccccugugugcugagc

SEQ ID NO: 77840 - RNA, 64 nt, Human
uuaccuuggcuuccuggcccagucccugccucuccaccugcacccugcuuccuggcccaguccc

SEQ ID NO: 77841 - RNA, 64 nt, Human
uccaccgaugacucgaggccuggcuggggcaugccaccugcagacccuggcucugaggaauggc

SEQ ID NO: 77842 - RNA, 64 nt, Human
aaaaaaacaagagauucccaccauuauuuagguucaccugcaaaacaaaaaucuuacuccagcc

SEQ ID NO: 77843 - RNA, 64 nt, Human
gaguguaagugacuacaguagucauuuuuuucugcaccugcauuauuuuauuuugcgaaagggg

SEQ ID NO: 77844 - RNA, 64 nt, Human
cguucuuaaucaggaguucugccagguuuaaggucaccugcacucccagccaaguggugaugua

SEQ ID NO: 77845 - RNA, 64 nt, Human
acggaaaaaaaugugucacauacuauuacauccacaccugcauacacacucgcaacaugucuac

SEQ ID NO: 77846 - RNA, 64 nt, Human
gcccuccccuccggacuggugcccuccucacucccaccugcaucuggggcccauacugguuggc

SEQ ID NO: 77847 - RNA, 64 nt, Human
cagagacaaggucaccugggcugugaugugaagacaccugcagccuuuggucuccuggaugggc

SEQ ID NO: 77848 - RNA, 64 nt, Human
gccugggauguugcugacacccagaaagucccaccaccugcacauguguagccccaccagcccu

SEQ ID NO: 77849 - RNA, 64 nt, Human
caggccagcccaugggcccggggccugaccccaacaccugcaugcuggguccagagccuucugu

SEQ ID NO: 77850 - RNA, 64 nt, Human
cugguuguccccagcugggacuguucacaguugucaccugcagaccugccucucccuggccuga

SEQ ID NO: 77851 - RNA, 64 nt, Human
ugccauccucuuuccuggcucuguggaggagaaccaccugcaggacccucacccaugguguccc

SEQ ID NO: 77852 - RNA, 64 nt, Human
augccacuggcccugcucccccagccgcaggccucaccugcaggugcuccucgauguccuugcg

SEQ ID NO: 77853 - RNA, 64 nt, Human
cucuaaccagcacagggcugaggccugcagugcacaccugcagggaggcccuucccaaggugug

SEQ ID NO: 77854 - RNA, 64 nt, Human
gugccucagccccucaccuggccaccugccagggcaccugcaacccuagcaauaccaugcucgc

SEQ ID NO: 77855 - RNA, 64 nt, Human
uguacaauuuguccugaagcuuuguguuuggcugcaccugcauaagcugcuacaaauagaauaa

SEQ ID NO: 77856 - RNA, 64 nt, Human
gugggcagcccgcaucauccagcacgagauggaccaccugcagggcugccuguuuauugacaaa

SEQ ID NO: 77857 - RNA, 64 nt, Human
uugcaggugaggggacagcuuucuagaaaagccacaccugcaucuggggacacacuuuggaaag

SEQ ID NO: 77858 - RNA, 64 nt, Human
cucgccccggaccugcccucccgccaggugcacccaccugcaauaaaugcagcgaagccgggag

SEQ ID NO: 77859 - RNA, 64 nt, Human
uccucccccaacccugcccaagccagacagacagcaccugcagacgcagggggacugcacaauu

SEQ ID NO: 77860 - RNA, 64 nt, Human
ccaaagggucccaggcugucaggggcguuugcgccaccugcaagggcgugggucagagaguuuu

SEQ ID NO: 77861 - RNA, 64 nt, Human
ccugcugucccggcuccaucuugguucuagccgccaccugcaugaacacaguggcccggcuuaa

SEQ ID NO: 77862 - RNA, 64 nt, Human
uccccucucacacaucugggaguagccccacugccaccugcagccgcagccuggacugcugccc

SEQ ID NO: 77863 - RNA, 64 nt, Human
cugcuccaaggccuuccucuacaccuucugccaccaccugcaccugccuacccacgacaaggag

SEQ ID NO: 77864 - RNA, 64 nt, Human
uagaaaauaagucugggccggcggcgguggcucacaccugcauaggcagugcuuuggccaggag

SEQ ID NO: 77865 - RNA, 64 nt, Human
gcagcauauguugaaauaaguuauuacugguacacaccugcauugccucaccaguguauuuauu

SEQ ID NO: 77866 - RNA, 64 nt, Human
agaaugguggggaccccuguacuugggggagacacaccugcaucuuccuccugccacagaugga

SEQ ID NO: 77867 - RNA, 64 nt, Human
ugguauggguuucucccaguucucuagggaaggccaccugcaggucacugaaacuucaagcacc

SEQ ID NO: 77868 - RNA, 64 nt, Human
cugauucagcauuguuuucaugucuuaaaauugccaccugcacuuuguuucugcacuauuaugu

SEQ ID NO: 77869 - RNA, 64 nt, Human
ggggugagacugggauucuggcuucucuuugaaccaccugcaucccagcccuucaggaagccug

SEQ ID NO: 77870 - RNA, 64 nt, Human
cccuccuugccgcugggagagccaaggccuaugccaccugcagcgucugagcggccgccugucc

SEQ ID NO: 77871 - RNA, 64 nt, Human
agcauuuaaacucaaaucuggauucagauaacagcaccugcacauccugcaccuccucccucuc

SEQ ID NO: 77872 - RNA, 64 nt, Human
cagccuuccugcaaagcccaggacccaggcaguccaccugcaccccuucugggcugggaggaaa

SEQ ID NO: 77873 - RNA, 64 nt, Human
agaggaggacauuuggugggcuuuggagcugucccaccugcacacguuugugagcucccagccg

SEQ ID NO: 77874 - RNA, 64 nt, Human
caggaagccaccaacaagaaaaucggcauuuucccaccugcaauuucuaucuccagcauccccc

SEQ ID NO: 77875 - RNA, 64 nt, Human
aguguucuggucaaaacuaaaggaacucccuccccaccugcaggacuccgaagacagugcgacu

SEQ ID NO: 77876 - RNA, 64 nt, Human
cacugagucagacaagugggagcuguaggaacugcaccugcagccucuucuuacuccccauuga

SEQ ID NO: 77877 - RNA, 64 nt, Human
guucuucccguuuccuuccgugcgucgccccucucaccugcagucagcucccagcccaguguag

SEQ ID NO: 77878 - RNA, 64 nt, Human
cuuccagacagggacccagggacaccccgaagcccaccugcaaucucccaccuccugcccaucc

SEQ ID NO: 77879 - RNA, 64 nt, Human
gggaauggcuggggcugggcaggacccucccacacaccugcacccuagcuucgugcuucucucu

SEQ ID NO: 77880 - RNA, 64 nt, Human
ggcaggcuucccccaacacaggaacgcucauggacaccugcacacuccacagaagacguuggca

SEQ ID NO: 77881 - RNA, 64 nt, Human
ugccaaaggaagaagcucccagggcugcuuccuucaccugcagaaagccccaagugagccacca

SEQ ID NO: 77882 - RNA, 64 nt, Human
agagaagaagcagugaccucucuccccacacccucaccugcacccuaggaccucacuggccaua

SEQ ID NO: 77883 - RNA, 64 nt, Human
ccugccaucacaucucacugccagauguauaaagcaccugcaugcucagacuucuuguggcgcc

SEQ ID NO: 77884 - RNA, 64 nt, Human
cugguucugaggagcaagugcaggguggagguggcaccugcaucaccuccuccucuugcagugg

SEQ ID NO: 77885 - RNA, 64 nt, Human
gucagcaaggaagacccugagcaggaccguggaucaccugcaacaagcucugauacuccagggg

SEQ ID NO: 77886 - RNA, 64 nt, Human
uauaauuuugaucauaggccggagugagucauuccaccugcaccuuucuguacaaauacuaauu

SEQ ID NO: 77887 - RNA, 64 nt, Human
guuccuugcucccuggguccgacauguguucccgcaccugcauggacugccccgguucuguguu

SEQ ID NO: 77888 - RNA, 64 nt, Human
caguggagaggccggaagugagacgggcagacggcaccugcagccugaaacgcaccgcuccugc

SEQ ID NO: 77889 - RNA, 64 nt, Human
gaggcgaggugagugauuccaucauuucaguucucaccugcaguuuuggugaagcaggagaugc

SEQ ID NO: 77890 - RNA, 64 nt, Human
cuguuguuggugucagggaggcuuacuggagccacaccugcaggcgcuguguucaggcaccacc

SEQ ID NO: 77891 - RNA, 64 nt, Human
gggugucagcccagaugacuccucacccauccaccaccugcagcuugagauguuaacuauuaga

SEQ ID NO: 77892 - RNA, 64 nt, Human
acugauaagaaucaacaaggucacccaucaccgccaccugcaccugggccuuuuccccaagcaa

SEQ ID NO: 77893 - RNA, 64 nt, Human
cagauuuuuccugaagaacacaucgucaauaaaucaccugcacccaaaucuccaucucaggcgc

SEQ ID NO: 77894 - RNA, 64 nt, Human
cacgacugguucaugcgggaauagcugcucuggccaccugcaggcagaaagugggggaaguggc

SEQ ID NO: 77895 - RNA, 64 nt, Human
agccuucaaaaagagagauucuccauuacacgaucaccugcaucacagcccauggugaauguau

SEQ ID NO: 77896 - RNA, 64 nt, Human
acaccgucacgccaaaggaagagaaagaucaacucaccugcaguuaaaccaucuaaagagaaga

SEQ ID NO: 77897 - RNA, 64 nt, Human
gacaucuugacccagcgaguggucuccuacacgucaccugcaacacucgcuccucuucugugua

SEQ ID NO: 77898 - RNA, 64 nt, Human
uuuggcuggcagcucuucccagugauguugagagcaccugcagcaaucugguccccagucgcac

SEQ ID NO: 77899 - RNA, 64 nt, Human
ugcaauuagucugucacuccauuuggaaaauguucaccugcagauguucugguaaacugauugc

SEQ ID NO: 77900 - RNA, 64 nt, Human
gcccagugcucaggccaccuccugguccagucaccaccugcagccucggcagggcagguacagg

SEQ ID NO: 77901 - RNA, 64 nt, Human
uggcaucgccuccgguugccuuacaccacgccuucaccugcagucgccuagaaaacuugcucuc

SEQ ID NO: 77902 - RNA, 64 nt, Human
cucuggaguacacuucggaguccaccaccgagaucaccugcagcuggccacaccacaggccccc

SEQ ID NO: 77903 - RNA, 64 nt, Human
uucgggaagauaaauccagugcgcuggccgcagccaccugcauucaaagcuuggaccagcgggu

SEQ ID NO: 77904 - RNA, 64 nt, Human
agcuuccccuagcuggggucucugguacucuucacaccugcaggggcgucuacacuguucgucu

SEQ ID NO: 77905 - RNA, 64 nt, Human
aaagaagacgagagauagugggugugguggcucacaccugcaaucccagcacuuuggaaggccg

SEQ ID NO: 77906 - RNA, 64 nt, Human
ccugacugcuggggacccucgccuucccuccucucaccugcaggcugauccuucuuuucacuuu

SEQ ID NO: 77907 - RNA, 64 nt, Human
ucucaccuacucacagacgggaugcuaagcagugcaccugcagugguuuaauggcagauaagcu

SEQ ID NO: 77908 - RNA, 64 nt, Human
agggaagacaggaugggaguguagccacagaacccaccugcacccugacaggcacaccccacug

SEQ ID NO: 77909 - RNA, 64 nt, Human
aauccucgggguguggucaaggggcacucagagacaccugcacuagaaauugcauugacauugu

SEQ ID NO: 77910 - RNA, 64 nt, Human
uauuacaccccgacccuccuccugucagcccccucaccugcagccuguugcccaauaaauuuaa

SEQ ID NO: 77911 - RNA, 64 nt, Human
caaugcugacccuaggauuuuccuucccugcccucaccugcaaaugaguuaaagaagaggcgug

SEQ ID NO: 77912 - RNA, 64 nt, Human
ggaagaugggccccaccacgcucucaagagaacgcaccugcaauaaaacagucuugucggccag

SEQ ID NO: 77913 - RNA, 64 nt, Human
aucugauugcgaggaaccugggcucugacucgaacaccugcaaaggacagggacugggaccguu

SEQ ID NO: 77914 - RNA, 64 nt, Human
ggguggguucauuggccugggcccagcgagcccccaccugcauugaccuuaggcccauagagag

SEQ ID NO: 77915 - RNA, 64 nt, Human
ucuuucacccucuaugagucccauuuuacuucuacaccugcaaguccugguuuauauuggaccc

SEQ ID NO: 77916 - RNA, 64 nt, Human
ggaugggugcucacuaucuaccccagaccaaugccaccugcagccuguggagucaacugcagaa

SEQ ID NO: 77917 - RNA, 64 nt, Human
ggagccagcccugcagcccuccccacccggcauccaccugcauccccucugggggcaggagccc

SEQ ID NO: 77918 - RNA, 64 nt, Human
ccaauaccauaaucaugauaaugaacguauccaucaccugcaaagcuaccucaugccccuuuac

SEQ ID NO: 77919 - RNA, 64 nt, Human
cugguguaagagcccucucaaccccauuguccugcaccugcaggaauuuacacuccacuggucu

SEQ ID NO: 77920 - RNA, 64 nt, Human
guuucugcauuucgggaagaguguuuuuauuauccaccugcagacuggacuggauucuucuagc

SEQ ID NO: 77921 - RNA, 64 nt, Human
cccuucugcucggugcccuccacgugaggcggggcaccugcaugcacugggagggggcggcugg

SEQ ID NO: 77922 - RNA, 64 nt, Human
gacggaagacuggaaacccucaaagcaucugacucaccugcaugaucacaagcuuucuuugacg

SEQ ID NO: 77923 - RNA, 64 nt, Human
ucuaaucuuuuuccagcuugagggaggcgguauccaccugcagcccuuuuagugguggugucuc

SEQ ID NO: 77924 - RNA, 64 nt, Human
uaggcaguaaacaaaguaugacugacagauugaacaccugcaaaacugcuagcguaaucucagc

SEQ ID NO: 77925 - RNA, 64 nt, Human
ggcacccaaaacucaugggggcacaauccuggggcaccugcaggaggagcuucgcauauuuaaa

SEQ ID NO: 77926 - RNA, 64 nt, Human
gccucaggcugggauggggaggccucccugcuuccaccugcauggugggcauggccuggcuuac

SEQ ID NO: 77927 - RNA, 64 nt, Human
ccaccaaaaccuuggccagguaaccuaccuuaggcaccugcaaagaacaggaagugauggcugu

SEQ ID NO: 77928 - RNA, 64 nt, Human
ggagugccugucugugucacacacuccugucgcccaccugcacccacacaaguggagcucacag

SEQ ID NO: 77929 - RNA, 64 nt, Human
caggggcagagccagugaaucaccggaccuccagcaccugcaggcagcuuggaaguuucuuccc

SEQ ID NO: 77930 - RNA, 64 nt, Human
gucuuagucauuggucuccucagauuucuggggccaccugcaagccccauuccauuccuacaga

SEQ ID NO: 77931 - RNA, 64 nt, Human
uuuccacuacuguguagacuccugcuucuucaagcaccugcagauucugauuuuuuuguuguug

SEQ ID NO: 77932 - RNA, 64 nt, Human
ugguggcccccacccugugggaggucuccccaugcaccugcagcaggagaagacagagaaggcu

SEQ ID NO: 77933 - RNA, 64 nt, Human
aguaauauaauuucccccuuggugguuuuucagacaccugcagcaagaagaaauacugacugac

SEQ ID NO: 77934 - RNA, 64 nt, Human
ugggguuucccgugugcuugggaugcuagagggucaccugcaggaggccuggggccggcgagaa

SEQ ID NO: 77935 - RNA, 64 nt, Human
ccucuggaggcacagcuguugcgucaggcaaggucaccugcauuuauuuauugagcagcagugc

SEQ ID NO: 77936 - RNA, 64 nt, Human
cucucugccaggaaaugggggaaggaacuagaaccaccugcaccuugagauguuucuguaaaug

SEQ ID NO: 77937 - RNA, 64 nt, Human
gacagcaagagcccaggugcacugcucacacccccaccugcauuuugaagucauauuauuuuuu

SEQ ID NO: 77938 - RNA, 64 nt, Human
ucugcacgugcacacaccugcacaccccugcacacaccugcacaccgucccucuccccggacaa

SEQ ID NO: 77939 - RNA, 64 nt, Human
uccugcccuagcaguuugccucugcacgugcacacaccugcacaccccugcacacaccugcaca

SEQ ID NO: 77940 - RNA, 61 nt, Human
ggccaacuaugccuuccugaagagcccucuccaccugcaaggugccaggacugggagggaa

SEQ ID NO: 77941 - RNA, 64 nt, Human
aauucuucuuuuguauguccagucuccugcacagcaccugcagcauuguaacugcuuaauaaau

SEQ ID NO: 77942 - RNA, 64 nt, Human
gagggggugaccuccggccaggugccuccugacacaccugcagccucccuccgcggcgggcccu

SEQ ID NO: 77943 - RNA, 64 nt, Human
ggcgacggagagcugacaguagcccagggcuuuccaccugcauggaacaagggccugucugccg

SEQ ID NO: 77944 - RNA, 64 nt, Human
uagaacgcucaacuugguugcgguaccaucagcccaccugcauuuggcuuucgacuugcuuguu

SEQ ID NO: 77945 - RNA, 64 nt, Human
guguuuagauccaugccauucacugacucacuaacaccugcaaaaucuuuaaggaaaaaagcug

SEQ ID NO: 77946 - RNA, 64 nt, Human
ccccgccgcgccgccccccuucauccuccucagccaccugcagcucuucaucaagagggugguc

SEQ ID NO: 77947 - RNA, 64 nt, Human
cagggcccucuggggcucagcccugagcuagugucaccugcacagggcccucugaggcucagcc

SEQ ID NO: 77948 - RNA, 64 nt, Human
cgccuccugccaaggccgagccacacacccgcuccaccugcauuuccucuaccgacucgccagc

SEQ ID NO: 77949 - RNA, 64 nt, Human
ggaacuugcccugagcacuccuggugcaggucuccaccugcacauuggguggggcuccugggag

SEQ ID NO: 77950 - RNA, 64 nt, Human
aaggagagacauggaaagggagacagccagguggcaccugcagcggcugcccucuggggccacu

SEQ ID NO: 77951 - RNA, 64 nt, Human
gccuccuccgcugcccaaucucucagacccaccccaccugcaggcccagaccacgugggacaga

SEQ ID NO: 77952 - RNA, 64 nt, Human
agagacccccuugucguccuggacaccacaggggcaccugcaggcugggagaccagguccucug

SEQ ID NO: 77953 - RNA, 64 nt, Human
guacacaugcuccagccccagcucugcauaccugcaccugcaccccagccuuggccccugccug

SEQ ID NO: 77954 - RNA, 58 nt, Human
cagagggguuggaggacugagcccacugcaccugcagccacaggcccaccccucccca

SEQ ID NO: 77955 - RNA, 64 nt, Human
aaagacccauuguaaggucauaaaaaaccucggccaccugcacaaagauggugccucacugcaa

SEQ ID NO: 77956 - RNA, 64 nt, Human
acccaccugacaccaucacgcggaggcccagcagcaccugcacccacuuccagcugcucuggcc

SEQ ID NO: 77957 - RNA, 64 nt, Human
gggcugugugguccccaugaaggcauucagaguccaccugcagacagcgagagccccaggaagg

SEQ ID NO: 77958 - RNA, 64 nt, Human
aaccccauccaggagacauauuuccagcagcuggcaccugcagcacggagcuccggcuucccaa

SEQ ID NO: 77959 - RNA, 64 nt, Human
ucucuauauacauguuuuauauaccucauucugacaccugcauauagugugggaaauugcucug

SEQ ID NO: 77960 - RNA, 64 nt, Human
ugcaccguugacucaguauaguuuaaaaaucugccaccugcacagguauuuuugaaagcaaaau

SEQ ID NO: 77961 - RNA, 64 nt, Human
agucccagcuaacucugaccugggagcccucaggcaccugcacuuacaggccuugcucacagcu

SEQ ID NO: 77962 - RNA, 64 nt, Human
gagcccuccuccggccuggugcugccuuuacaaacaccugcaggagaagggccacggaagcccc

SEQ ID NO: 77963 - RNA, 64 nt, Human
ggggugauucacagcacaaaagaccucaccaccacaccugcacucaccccaccuugcaugcacc

SEQ ID NO: 77964 - RNA, 64 nt, Human
uuguuccacugauuacucucucugacgaguccaucaccugcaacuuaaaugaacaagcuuacau

SEQ ID NO: 77965 - RNA, 64 nt, Human
cagggcuucuguggaacuuggaacgugccaggaccaccugcaaaagccagggugcguugaucau

SEQ ID NO: 77966 - RNA, 64 nt, Human
caaggccugauucccaagucuguccucucaauuucaccugcauugacaaguauuaauugaaccc

SEQ ID NO: 77967 - RNA, 64 nt, Human
uguauacgcacgcacccacacccuacagcagauccaccugcacaaacauagacagauguggaca

SEQ ID NO: 77968 - RNA, 64 nt, Human
ccaccucagaucuccaaacugaugucccugugaacaccugcacuaugagaagguuucccaacaa

SEQ ID NO: 77969 - RNA, 64 nt, Human
gauuuucaauaucgacuuugcuuaaaacagagcccaccugcauaguaacuguguuuugccaagg

SEQ ID NO: 77970 - RNA, 64 nt, Human
gccucacauacuucucaacagacaugauaaaauucaccugcaugaguuggcaggugggagaacc

SEQ ID NO: 77971 - RNA, 64 nt, Human
cacaugcacgcacacacacauauggggaccugcacaccugcaaaacgagggaacaacuaaggug

SEQ ID NO: 77972 - RNA, 64 nt, Human
cgcccagugggacccacagucacacagagcgccucaccugcauccucucccccacaagagcccc

SEQ ID NO: 77973 - RNA, 64 nt, Human
uguucccaccuugggauucugugugcugccaucccaccugcagcugcccuggaauucccuucgc

SEQ ID NO: 77974 - RNA, 64 nt, Human
aaguucuggcgacagguagcacguaucugagagacaccugcaagcacacacugucccagcuggu

SEQ ID NO: 77975 - RNA, 64 nt, Human
uucccacagacaucuuacacuugcucgacacugccaccugcagaagccuggcgggcucugguca

SEQ ID NO: 77976 - RNA, 64 nt, Human
gcauuucaagcgucacuuuauuucauucgggccccaccugcagcucccucaaagaggcaguugc

SEQ ID NO: 77977 - RNA, 64 nt, Human
auuaauugggugagccuuggagacaugugggaaacaccugcagacacaaaaugaguagucaucc

SEQ ID NO: 77978 - RNA, 64 nt, Human
uccuuugaccaugccugggguuucaaugccuuggcaccugcaaucuggaaguaaacagucugcu

SEQ ID NO: 77979 - RNA, 64 nt, Human
caaauggugaauaauucuuucccuaacucugguccaccugcaaccuaggaguuaaaauaaguau

SEQ ID NO: 77980 - RNA, 64 nt, Human
ugggcccugccucggccuccugcgccaauacugugacuuccaaacaauguuacugcugggcaca

SEQ ID NO: 77981 - RNA, 64 nt, Human
uagcugaauacguuagaaaaugacagaugguagagacuuccauagaauuaagaggguucucaug

SEQ ID NO: 77982 - RNA, 64 nt, Human
guauuagguaaugugcugucaugagaaaaauugagacuuccaagaaaacuggacaccaggugag

SEQ ID NO: 77983 - RNA, 64 nt, Human
acuggauuuguuaggugagggugaggccaagggugacuuccagguuccugacuuguguuauaag

SEQ ID NO: 77984 - RNA, 64 nt, Human
cuagugaaaggcuuugccuccggggggcaggugugacuuccauuucaucagugccugccagaag

SEQ ID NO: 77985 - RNA, 64 nt, Human
gaaacccacaaaaacaccugaaaaaacucaagcugacuuccacugcgaagggaaauuauugguu

SEQ ID NO: 77986 - RNA, 64 nt, Human
cuuugccacauggugcugauggacaucagacggagacuuccagcaaucuguugguuuugcaagu

SEQ ID NO: 77987 - RNA, 64 nt, Human
aagucccccguugcuucuggucagcccacuuguagacuuccaggggacacaucuuuauucuguu

SEQ ID NO: 77988 - RNA, 64 nt, Human
gaaaggaaccuugucuuucagggcauaaggcggcgacuuccaaggucaaugcuuuucccccaca

SEQ ID NO: 77989 - RNA, 64 nt, Human
cuuuuugguauugaaguaauggguaacuaaaauggacuuccauaguauugacuguagaaggagc

SEQ ID NO: 77990 - RNA, 64 nt, Human
aguguauggggcugcaguuggucucccuggaggggacuuccacaccuccugccuuuaggccaug

SEQ ID NO: 77991 - RNA, 64 nt, Human
cccgagguuagauucuuaagcaagagaagaguuggacuuccaggcugaaggggagaaagugacu

SEQ ID NO: 77992 - RNA, 64 nt, Human
aagaauuacucagaguucuaacgcacagaauccugacuuccauguagcuccagucauugugauc

SEQ ID NO: 77993 - RNA, 64 nt, Human
gggcuucacaagggcaggagagcccuccaucacugacuuccagaucagggacccugccaaguag

SEQ ID NO: 77994 - RNA, 64 nt, Human
gcccccgucuugccagugacacuugaagccucccgacuuccacagagugcuucaggacacauuu

SEQ ID NO: 77995 - RNA, 64 nt, Human
augggagggcaugaggcuccacucauugucuugugacuuccaucccugcugaauggggcugcaa

SEQ ID NO: 77996 - RNA, 64 nt, Human
uaggaggaaccauaugaaaaagaucaggcuuucugacuuccauccccaaaacacauuuaccagc

SEQ ID NO: 77997 - RNA, 64 nt, Human
uaaggaucucucaggagcacaggcagcuggaugagacuuccaaaccugacagaugucagccgag

SEQ ID NO: 77998 - RNA, 64 nt, Human
guggccagauugccuucaucauuucaccucuccagacuuccauuucuucacaaggaugaugaug

SEQ ID NO: 77999 - RNA, 64 nt, Human
ccagacuucuaucaguucuauugauucuacaucagacuuccaagcagccaagcaggaauguuuu

SEQ ID NO: 78000 - RNA, 64 nt, Human
cugauaucuugcaaauuuguauuaaauguauacagacuuccaagugugcuaauucuuuaccucc

SEQ ID NO: 78001 - RNA, 64 nt, Human
accuucuucagccaccucucuuuuucaguuggcugacuuccacaccuagcaucucaugagugcc

SEQ ID NO: 78002 - RNA, 64 nt, Human
gucuuuaggauaaggcagagaaacagauguugcagacuuccacggcacccgggggagugguggg

SEQ ID NO: 78003 - RNA, 64 nt, Human
cucugcuagaguugccgcucagaggcuucagccugacuuccagcggucccaagaacaccuacua

SEQ ID NO: 78004 - RNA, 64 nt, Human
gcuuauuuuuccauuugauauucauugauaucaugacuuccaauugagaggaaaaugagaucaa

SEQ ID NO: 78005 - RNA, 64 nt, Human
cucugcccuguccuuggcagcugaaggacaccuugacuuccagcuuuuacgagugagccaaaaa

SEQ ID NO: 78006 - RNA, 64 nt, Human
uccucaugcugccuacagagugccuggcacuugggacuuccauaaaggaugagccuggggucac

SEQ ID NO: 78007 - RNA, 64 nt, Human
uugugaguuugaccauuuuggagucaaaugagcagacuuccaaggaguugaccaguuugugacu

SEQ ID NO: 78008 - RNA, 64 nt, Human
cacuuugcauuucuucuugaauccauugcagauugacuuccacucccacuccuucacuaaaagg

SEQ ID NO: 78009 - RNA, 64 nt, Human
acccugagcaucugucucaaccugcugaggcacagacuuccaccaugugcaucaggaaacaccu

SEQ ID NO: 78010 - RNA, 64 nt, Human
cccuggacaugggcccggcuuuccuggauaucaggacuuccaauaaauaaagacucuguauacu

SEQ ID NO: 78011 - RNA, 64 nt, Human
gagggauaacggcucugcugaaaccuuaaucucagacuuccagccuccugaacgaagaaagaau

SEQ ID NO: 78012 - RNA, 64 nt, Human
cuuggccaccaucacccuggucggaccuguccuggacuuccaaccuugacugcugagcuccugg

SEQ ID NO: 78013 - RNA, 64 nt, Human
gauaugagauguagcaaauuccaauacauuauuggacuuccauuuggaaucauaugggauacug

SEQ ID NO: 78014 - RNA, 64 nt, Human
cacuucgauuaaaaauagcaauuugaccaaguuggacuuccacuacaaagcagcuguuuuccaa

SEQ ID NO: 78015 - RNA, 64 nt, Human
cagucccagagcauugcuauuuaucucaaaaagugacuuccaaacaacucuuaggauugacgua

SEQ ID NO: 78016 - RNA, 64 nt, Human
uauauagugcuaucaagcaaucccugguacuuuggacuuccauggcuuguuauauaaaauuaca

SEQ ID NO: 78017 - RNA, 64 nt, Human
ugauucccuauuagaauuaauuuuaaaacuugaagacuuccagacuuauccaacuuauaaauaa

SEQ ID NO: 78018 - RNA, 64 nt, Human
caggagcccagggcgcccugggagcugagccugggacuuccaggaccuccccucagguuguucu

SEQ ID NO: 78019 - RNA, 64 nt, Human
agccuacucagacuccaaacacggaacgaauucagacuuccagcacgagcugacugacaucacu

SEQ ID NO: 78020 - RNA, 64 nt, Human
aacucggaaaauauaauaacaucccugaauucaggacuuccacaagaugcagaacaaaauggau

SEQ ID NO: 78021 - RNA, 64 nt, Human
cugacccccuggcaccaacacccgccaguacugugacuuccaaagccagagccacaugugcuca

SEQ ID NO: 78022 - RNA, 64 nt, Human
agcggcagagccugcacucgaauucaggucuccugacuuccaguccagugcuccuucuacuaca

SEQ ID NO: 78023 - RNA, 64 nt, Human
uuuccuaucugcugaucauggugaccuuccuuaggacuuccagaguucaguuccuucuggcaga

SEQ ID NO: 78024 - RNA, 64 nt, Human
gugucauucagguugugcacauuguuuuucuucugacuuccagaaauaaaaguguuuccauggg

SEQ ID NO: 78025 - RNA, 64 nt, Human
cugugugugaauuccuuuagacuaagggcaggaagacuuccagcuuucucuuuguucuucaaug

SEQ ID NO: 78026 - RNA, 64 nt, Human
acaauggaauuggagcauuuaaccagcccaguaugacuuccaaaagaagagacuuaugauagag

SEQ ID NO: 78027 - RNA, 64 nt, Human
ugaagggcaagcaaaccugggguauuuauccacugacuuccaucugacacugguugaggaccac

SEQ ID NO: 78028 - RNA, 64 nt, Human
aggagcccacaggccaguugagguugggcaaggagacuuccaggacuuccagacagaguaccag

SEQ ID NO: 78029 - RNA, 64 nt, Human
caggccaguugagguugggcaaggagacuuccaggacuuccagacagaguaccagguuuuauuu

SEQ ID NO: 78030 - RNA, 64 nt, Human
ucauguaggaucuugaugggccuuuguucccaaggacuuccacauuuuugcacagauuaugcuc

SEQ ID NO: 78031 - RNA, 64 nt, Human
ggacagcugugugacauuuggagagggggccugggacuuccaugccuuaaaccuaccucccaca

SEQ ID NO: 78032 - RNA, 64 nt, Human
ugauggauggacccuggagggaaucuccccagccgacuuccacugggcugacagacuuugcuga

SEQ ID NO: 78033 - RNA, 64 nt, Human
uggcaaaacuuaauuuggagccugauuuccuacugacuuccaauuuagugcucccccaguaugc

SEQ ID NO: 78034 - RNA, 64 nt, Human
cuuauuucaugcccugccaaauucaaguuacacagacuuccauuuucuuaagauaaucaaucau

SEQ ID NO: 78035 - RNA, 64 nt, Human
uuacagacugcgaacaacggcuuucagaaugagggacuuccaucagacucuaaugauaauagua

SEQ ID NO: 78036 - RNA, 64 nt, Human
uuuggacuuaagagauauucauuggcagcucaaagacuuccacccuggagaccacacugcacac

SEQ ID NO: 78037 - RNA, 64 nt, Human
uggcaccuguaccugccagcaggagcaugauggggacuuccaugcuggaauugcucccugauua

SEQ ID NO: 78038 - RNA, 64 nt, Human
acacaguauugcucaaugccacuguccaaguuacgacuuccaaccaaacuauauuaagcagccc

SEQ ID NO: 78039 - RNA, 64 nt, Human
gcauuucuuguauccaaagaggaacuggagaaacgacuuccauugauguggacuuagaaauggc

SEQ ID NO: 78040 - RNA, 64 nt, Human
gucagauguagacaaaaauaacacaauaacaggagacuuccauaaguuuguguauuauguuagu

SEQ ID NO: 78041 - RNA, 64 nt, Human
ggcucaucuaauauuuuggcuggaauaaaucagagacuuccauaaucaaguaaauuuuaauuuu

SEQ ID NO: 78042 - RNA, 64 nt, Human
aaucugcuuuuuaaagaaugcucuuuacuucauggacuuccacugccauccucccaaggggccc

SEQ ID NO: 78043 - RNA, 64 nt, Human
guggaaaaggagaaaguccugcagaaucaaucccgacuuccauaccugcugcuggacuguacca

SEQ ID NO: 78044 - RNA, 64 nt, Human
cacaaagcaguuuaacagaaagagcacauuuguggacuuccagauggucaggagaugagcaaag

SEQ ID NO: 78045 - RNA, 64 nt, Human
agacugcggugagucuguaacucgagugcauugagacuuccagaucauuacucuuacacacaca

SEQ ID NO: 78046 - RNA, 64 nt, Human
ugucugcguguuuuccaccaaagaaugcaaagcagacuuccagguguuuaaauucuguucacuc

SEQ ID NO: 78047 - RNA, 64 nt, Human
cuuuucucuuccaaucaaaugucuaggcuuguuugacuuccacccccaaugguuuuucacucuu

SEQ ID NO: 78048 - RNA, 64 nt, Human
aauggcuguaccauuuugcauuccaagcagcaaagacuuccauuuucugugcguccuugaaagc

SEQ ID NO: 78049 - RNA, 64 nt, Human
gucaucagacaauagaauugucuuuacaauaaaggacuuccaaaaugacagaugagaaacugua

SEQ ID NO: 78050 - RNA, 64 nt, Human
uaggacaaguuguucauaauccagcaggccagaagacuuccagggaaacucauucaaggaggug

SEQ ID NO: 78051 - RNA, 64 nt, Human
cuacacuugaguugggaaccgaaagagaaaaauggacuuccaucuguuuuacugguaaaggaaa

SEQ ID NO: 78052 - RNA, 64 nt, Human
uccuaacuuuucuacguauaaacacucuugaauagacuuccacuuuguaauuagaaaauuuuau

SEQ ID NO: 78053 - RNA, 64 nt, Human
gccauggagccaggggcuuauagagaggggcagugacuuccagagucccauccgucagugaggg

SEQ ID NO: 78054 - RNA, 64 nt, Human
uuucugucucuucuguuccaaagccaggagagcugacuuccaggugaagggaugggaaaagugg

SEQ ID NO: 78055 - RNA, 64 nt, Human
caccauuggguuaaggggugccgagcacuagcuagacuuccacauagucccaccccaagugggc

SEQ ID NO: 78056 - RNA, 64 nt, Human
uuguagugauucauuguuuguuuuauauaccaaugacuuccauauuuuaaaagagaaaaacaac

SEQ ID NO: 78057 - RNA, 64 nt, Human
uaggacaaguuguucauaauccagcaggccagaagacuuccagggaaacucauuucaagaugaa

SEQ ID NO: 78058 - RNA, 64 nt, Human
uagaauaaauauuagauugauauagcugaaaugugacuuccaguucuuugauauuccccuuguu

SEQ ID NO: 78059 - RNA, 64 nt, Human
gucacauuuugccuugcuguguauguauucaagagacuuccaacuagacaaagaaaaaauuguu

SEQ ID NO: 78060 - RNA, 64 nt, Human
aacaugcauuuauggagauucuuuuucccuuuuagacuuccaucugaaugagucagucaccagg

SEQ ID NO: 78061 - RNA, 55 nt, Human
cugugugcaccaaggucugaaaaaugacuuccaggaaagguaggaugugucuaug

SEQ ID NO: 78062 - RNA, 64 nt, Human
agacacaaggugauuucagacugcagaggggaaagacuuccaucuagucacaaagacuccuucg

SEQ ID NO: 78063 - RNA, 64 nt, Human
agggcuccucugcaaugacugggcuccuucccuugacuuccagggagcacccccucgauuuggg

SEQ ID NO: 78064 - RNA, 64 nt, Human
cauuuucagaagaaauauguucaaccugggaucagacuuccaugcucuggggaauccaaguggu

SEQ ID NO: 78065 - RNA, 64 nt, Human
ucuaauagcucucccuuccucccauccccaguuugacuuccauguggauguuauauaccuucau

SEQ ID NO: 78066 - RNA, 64 nt, Human
uccuuccagaauuuucugauguacacaaauaacugacuuccacaagagggcuuuuccacacucg

SEQ ID NO: 78067 - RNA, 64 nt, Human
aaugggagcugaguuguuggagggagaagcuggagacuuccagcuccagcucccacucaagaua

SEQ ID NO: 78068 - RNA, 64 nt, Human
uuugccuugcggggagggggcuccugggccaugggacuuccagugcuaaaacugggaaagcccc

SEQ ID NO: 78069 - RNA, 64 nt, Human
ucuuggggugaaaaaauauuagauauggcuuguggacuuccaauaucauccuauccaccaaaau

SEQ ID NO: 78070 - RNA, 64 nt, Human
aaaucucuacugugcaaauaucauuauucacucagacuuccauaagaguaaauaaaaaugaaua

SEQ ID NO: 78071 - RNA, 64 nt, Human
guuuggacggauugauggcagugcguacauucuagacuuccaguauccguucucagccgugcag

SEQ ID NO: 78072 - RNA, 64 nt, Human
gccgcgggacagccaagcaccuccaaccaaauaagacuuccacucgaugaugcuucuauaauuu

SEQ ID NO: 78073 - RNA, 64 nt, Human
cugucucuguugcuuuuagcaucucauuccuugugacuuccacagcuuucuuuucuacagcugc

SEQ ID NO: 78074 - RNA, 64 nt, Human
auuguggucucgggccugggugagacaaugaagugacuuccaaccgacaguugcuagaauucac

SEQ ID NO: 78075 - RNA, 64 nt, Human
gugucagccuuuucuucagagcauuuguuugacugacuuccaaagcaaucaagagagccacguc

SEQ ID NO: 78076 - RNA, 64 nt, Human
ucaugaagauccccgcgauacuucaacgccuucugacuuccaggugaugacugggcccccaaua

SEQ ID NO: 78077 - RNA, 64 nt, Human
caagcucauuagcaagacugguggucagcggggggacuuccaucgggcuuagcaccugcccuuc

SEQ ID NO: 78078 - RNA, 64 nt, Human
acccuaggcccacgaacccacgagaauguccucugacuuccagccacauccaucuggcaguugu

SEQ ID NO: 78079 - RNA, 64 nt, Human
agaagaaaccaacccugccaacaccuugaucuuggacuuccagccuccaaaacuaugagaaaua

SEQ ID NO: 78080 - RNA, 64 nt, Human
auuuguuaaucaccaguaagauuugauguuuaaagacuuccacugcaauauauaaauacugaaa

SEQ ID NO: 78081 - RNA, 64 nt, Human
ccuauuuuucuuugguuugcaacaccagccuguagacuuccaguuuuucuuaaauugaagagcu

SEQ ID NO: 78082 - RNA, 64 nt, Human
acaagagucagcaucauuaaaggaaacguggcaggacuuccaucugugccauacuuguucugua

SEQ ID NO: 78083 - RNA, 64 nt, Human
cuccauagaagaugcuuuuucccaaggcuagaacgacuuccaccaugaugaauuugcuuuuuag

SEQ ID NO: 78084 - RNA, 64 nt, Human
guggaguauggccgugaguccccgccccagcaaagacuuccaugcggagcucugguuucagaug

SEQ ID NO: 78085 - RNA, 64 nt, Human
ugaaugugguugaguuuguccauugcuagggagagacuuccaguaauaaaauuuacuauucuag

SEQ ID NO: 78086 - RNA, 64 nt, Human
augggauuacaaguggacccugacuuucccuaaggacuuccacuuuguucaagaaagcuguauc

SEQ ID NO: 78087 - RNA, 64 nt, Human
uuggggagcuuaggggaccuggugggagagaggggacuuccaggguccuugggccaguucuggg

SEQ ID NO: 78088 - RNA, 64 nt, Human
ccaccugcgugucccuuccuccccgagucagggcgacuuccacagcagcagaacaagugccucc

SEQ ID NO: 78089 - RNA, 64 nt, Human
cagcuccagccaccuuugcgugucaccuucacgggacuuccagcuccagcuaccuuuguguguc

SEQ ID NO: 78090 - RNA, 64 nt, Human
augggggguuuuauuucagguaagcaguuuauaugacuuccaauaagauuuguaaaucaugggc

SEQ ID NO: 78091 - RNA, 64 nt, Human
caaaccauguaccuuaugaagaccuuuguuuuaagacuuccacacaccaaggcuacaaugacug

SEQ ID NO: 78092 - RNA, 64 nt, Human
agauggggucccugcggagggggcguucacugaagacuuccagggccuacgggcagagguggag

SEQ ID NO: 78093 - RNA, 64 nt, Human
uugcaauuacugaaaguggcugcaacagagaaaagacuuccauaaaggacgacaaaagaauugg

SEQ ID NO: 78094 - RNA, 64 nt, Human
aguugugugguaacaagcuaauaugcuuccaguugacuuccagucuacccugguguuagaaacc

SEQ ID NO: 78095 - RNA, 64 nt, Human
ccucuguccuuacaccacuagccaccccacgugggacuuccauggcuucugaguacaaggccag

SEQ ID NO: 78096 - RNA, 64 nt, Human
cuguuaccuaaaaucagagacugguguacaguaugacuuccaucugaacuugaaaaguauuaaa

SEQ ID NO: 78097 - RNA, 64 nt, Human
uauugucauuccauugcuauuuuuuuuccccagagacuuccauaauuuaaaauaaaauccuaga

SEQ ID NO: 78098 - RNA, 64 nt, Human
gcucuccuccccaacccccaccccacaauuuuaugacuuccauuuggcaauuguugaauuauaa

SEQ ID NO: 78099 - RNA, 64 nt, Human
gaagaccacuagucccaugaagucucaccuuguugacuuccaccagaacaaaaccuguuaauuc

SEQ ID NO: 78100 - RNA, 64 nt, Human
cucugcccucccucccuuugucccaucucccagcgacuuccaauauucauguuucugagaauug

SEQ ID NO: 78101 - RNA, 64 nt, Human
auuauuauguaguagguuagaucccucuuguuuugacuuccacugacucauucugaacccccua

SEQ ID NO: 78102 - RNA, 64 nt, Human
cuggucucuccaggcuuggcugagacggacgguagacuuccaccauguaccgaucacaucccag

SEQ ID NO: 78103 - RNA, 64 nt, Human
agcaggggauguaguuuguacccaccauggcgcagacuuccaaauaaauaguacuggucauuuc

SEQ ID NO: 78104 - RNA, 64 nt, Human
ucaaaagauuuauuauuuuaaaaaaaucaguguggacuuccauuccucuuucuuuugauucccc

SEQ ID NO: 78105 - RNA, 64 nt, Human
caaaaggaaucaaacuggaggaaucauauuaccugacuuccaauuauucaacagagcuacagua

SEQ ID NO: 78106 - RNA, 64 nt, Human
uguggguuuuaccggaaagguggccccagcuguugacuuccagucacugucccagacggcacaa

SEQ ID NO: 78107 - RNA, 64 nt, Human
gaauguauuagaacucuuuucuucuaaggacugagacuuccaggggauugccaucuuaccuguc

SEQ ID NO: 78108 - RNA, 64 nt, Human
caguggccagcagggagcccagcugcuccccagugacuuccaguguaacaguugugucaacgag

SEQ ID NO: 78109 - RNA, 64 nt, Human
aggggguuaucaaaaaaaaaaaaaugugacucaagacuuccagagccucaaaugagaaaauguc

SEQ ID NO: 78110 - RNA, 64 nt, Human
cugaugccuuaaggaaaagguuaagaugagaggggacuuccagagucaaugaacgucacccuuc

SEQ ID NO: 78111 - RNA, 64 nt, Human
uagcaggaagcgugucggugcuuaggaaaucuaggacuuccagcuucccucaugucagauagaa

SEQ ID NO: 78112 - RNA, 64 nt, Human
gagcccuaaagcauuguaccuagugguaccuagugacuuccaaccaaagccuuugaguaugcac

SEQ ID NO: 78113 - RNA, 64 nt, Human
ccugagccuuaggauccaaugaguggagaauggggacuuccaaaacccaagguuggcuauaauc

SEQ ID NO: 78114 - RNA, 64 nt, Human
cccuggacugagucccccaggccuuccuucacccgacuuccaaacucuuccuugugguaucagu

SEQ ID NO: 78115 - RNA, 64 nt, Human
cgcagcuccauuuucuuauugcgcugcuaccguugacuuccaggcacgguuuggaaauauucac

SEQ ID NO: 78116 - RNA, 64 nt, Human
cugggcagugcaggcggcugccaggcccagcccugacuuccacucuggcucagcaaccugguua

SEQ ID NO: 78117 - RNA, 64 nt, Human
accccugguuggggaacaggugaguucuauuugagacuuccagcccuagaaagcugccuccguc

SEQ ID NO: 78118 - RNA, 64 nt, Human
ggaaaaucaucuauuacaaugauaaccuucaagugacuuccauuauggcuggacaggcggugag

SEQ ID NO: 78119 - RNA, 64 nt, Human
gcacaaaagguuuaggaaggaaucuuuuuuuaaagacuuccaucuacugugguauuauacccaa

SEQ ID NO: 78120 - RNA, 64 nt, Human
ugcaguggggacacccuuugugguuacaguuugagacuuccaaaggucauccuuaauaacaaca

SEQ ID NO: 78121 - RNA, 64 nt, Human
ggccucagcuuucucgucuguauaauggaagcaagacuuccaaccucacggagacuuuguaauu

SEQ ID NO: 78122 - RNA, 64 nt, Human
gcuggcuuguccaggcauucagguugcuugcguagacuuccagggaagcaagccuguccuuccu

SEQ ID NO: 78123 - RNA, 64 nt, Human
ugaaauuagcuacucaccaagagugaggggcagagacuuccagucacugagucucccaggcccc

SEQ ID NO: 78124 - RNA, 64 nt, Human
guugaaaggauaaggaggagggguggcuuuuauggacuuccaugagagaaggaaagaaauauuu

SEQ ID NO: 78125 - RNA, 64 nt, Human
gggcccugcggauuuggagaagggagcggggcaggacuuccaggaggaccccaacccggcccgg

SEQ ID NO: 78126 - RNA, 64 nt, Human
ggacaucuagcgggcaggggaagacuccacuaaagacuuccacaaagaccuccccuaaaucuga

SEQ ID NO: 78127 - RNA, 64 nt, Human
ggagguggugaugagggaucccauauuguuuggagacuuccagauggcucugcacgaaggagaa

SEQ ID NO: 78128 - RNA, 64 nt, Human
guuaaaaagugauuuuuauguuauuggucuaagggacuuccaucuuggucugaaguccugagcu

SEQ ID NO: 78129 - RNA, 55 nt, Human
ccucugaagccacaaaaugacuuuagacuuccagggcucaccagguaaguugaga

SEQ ID NO: 78130 - RNA, 64 nt, Human
guacagccuacccaugcagggacugggauucgaggacuuccaggcgcauaggguagaaccaaau

SEQ ID NO: 78131 - RNA, 64 nt, Human
gagaaucaugcaaauuuuaaaaguucuuccaagagacuuccauguccugguuauuaacaaaaaa

SEQ ID NO: 78132 - RNA, 64 nt, Human
gcuaaaaguccagaaagaaaggguucaucuuuuugacuuccaacugauauugggaaguuugguu

SEQ ID NO: 78133 - RNA, 64 nt, Human
ugaagaaaauguggaaacucaaaaggucaggacagacuuccaagcacuugcaacugauguuacu

SEQ ID NO: 78134 - RNA, 64 nt, Human
aagauuuugaaaauuaaauauuacugaagauuucgacuuccacuguuaaauguacaagauacau

SEQ ID NO: 78135 - RNA, 64 nt, Human
gaauuugcuguggagauacuuuuuggcgagaaaugacuuccaaugauguuguagcuggauccga

SEQ ID NO: 78136 - RNA, 64 nt, Human
aauauuacugcauuagauguaauucuucauucuagacuuccaaguuuguuuucacuuuuuugug

SEQ ID NO: 78137 - RNA, 64 nt, Human
uuugaaagcauaucuuuuucuucagaacaauguagacuuccaaaaugguuaaccuaaggggucu

SEQ ID NO: 78138 - RNA, 64 nt, Human
gugggaggagcagcaccgaggucggagcugugaggacuuccagaacuggaaacgcaugaacgac

SEQ ID NO: 78139 - RNA, 64 nt, Human
ugacaugaacacaaaguugcuagaugcucuuguugacuuccagcagaugggaugggggaaacac

SEQ ID NO: 78140 - RNA, 64 nt, Human
accauuucagugagaagcuuuugaaaagucuucugacuuccagucuuucaccagaugacugcac

SEQ ID NO: 78141 - RNA, 64 nt, Human
cauuucuggaguauauuucucauaauucugcagagacuuccaguuuauugcauauaugcaguaa

SEQ ID NO: 78142 - RNA, 64 nt, Human
cagggcaaccgcgguacagacguggucucugugagacuuccaccugaccccaguuuuaaguggu

SEQ ID NO: 78143 - RNA, 64 nt, Human
aaaaucucaaauaaaacaugagauaacauuuuaagacuuccaaaucagagaagugcuucaaauu

SEQ ID NO: 78144 - RNA, 64 nt, Human
uaaaaggggaaaaaaaaaaaaagagaaacccuuugacuuccacgugcccaucucaagacauucc

SEQ ID NO: 78145 - RNA, 64 nt, Human
caaugaaaaagucaucuugaaguuggauuacucagacuuccaaauuguaaaauaauggccugaa

SEQ ID NO: 78146 - RNA, 55 nt, Human
uccgugacucuguggugugagagcugacuuccagaggacgcugcccuggcuucag

SEQ ID NO: 78147 - RNA, 64 nt, Human
guccgccugugcgcguggaacacuguggacgcucgacuuccaagggucuucucacccguaaugc

SEQ ID NO: 78148 - RNA, 64 nt, Human
ugcuugucuccgauagcuccccacaucucuaauugacuuccacaaaaucgaugcguugcuuugg

SEQ ID NO: 78149 - RNA, 64 nt, Human
cuuggaaacugggcggccaggggaugacaguauggacuuccagugaaguagugacggaagccug

SEQ ID NO: 78150 - RNA, 64 nt, Human
aaaaaaaauugaaauuguuucccaugcugccagggacuuccaacuagauagccaugugacgucc

SEQ ID NO: 78151 - RNA, 64 nt, Human
ggcucugcaugcuaugccaggcaugugcagucuggacuuccaccuccagugccagaaacuucca

SEQ ID NO: 78152 - RNA, 64 nt, Human
gugccccaagugcaacgcggccuuuggugcccacgacuuccaucguaucuacaucagcugaacc

SEQ ID NO: 78153 - RNA, 64 nt, Human
gccaggcaggcaacuuuagcacaugaugaaaacagacuuccaccucaguggccugugggcacgc

SEQ ID NO: 78154 - RNA, 64 nt, Human
cugggacagccccgcucccagauguaaagaacgcgacuuccacaaaccuggauuuuuuauguac

SEQ ID NO: 78155 - RNA, 64 nt, Human
ccguucccagaggcuccuccugcggugcucccaagacuuccauagaccaucuggaccaguagcc

SEQ ID NO: 78156 - RNA, 64 nt, Human
ugugacuucuguucuuagcacugccagggucauugacuuccaucuaagcuugcaucaggaagau

SEQ ID NO: 78157 - RNA, 64 nt, Human
gacaccagcgggaacagggcaccccuucugcacugacuuccagaucaugguucucccuuccucc

SEQ ID NO: 78158 - RNA, 64 nt, Human
aagaagggaaagaccgcaacucggacagcccagcgacuuccaaguccucucacagaagaaccac

SEQ ID NO: 78159 - RNA, 64 nt, Human
aaguuaguaaauccuuaaaggcuuuuuaauagcagacuuccaaaagauugcauuuaggauuucu

SEQ ID NO: 78160 - RNA, 64 nt, Human
auugagcaguucccaaggacagucagcauuucuagacuuccacaaaauuaugcugcauuuggcu

SEQ ID NO: 78161 - RNA, 64 nt, Human
gaaaugccgaagcagcuugcacaguugcuuuacagacuuccaagaggcugauucuggcuucaag

SEQ ID NO: 78162 - RNA, 64 nt, Human
cuaaaauggcaucucacuaaugaccucacuaucugacuuccauuguguuuuauugcuucucuaa

SEQ ID NO: 78163 - RNA, 64 nt, Human
gaggcguggcucaucagacugaaacuugcucacagacuuccaguuauuuauuuggggucugaag

SEQ ID NO: 78164 - RNA, 64 nt, Human
gagcggggguggcugccauuuccagcaugcaggugacuuccaaagaaugagucagguggcacug

SEQ ID NO: 78165 - RNA, 64 nt, Human
auaagcguuugucucaggggagccccagagggaugacuuccaguuccgucuguccuuuguccac

SEQ ID NO: 78166 - RNA, 64 nt, Human
auccaugggucagaguugaauucuuaugucuauagacuuccaaucagaagucucacuggugggg

SEQ ID NO: 78167 - RNA, 64 nt, Human
cggucaaauuaaaaguagaaaauuuuaaagcaaugacuuccaacccaacagucauuuagcaaca

SEQ ID NO: 78168 - RNA, 64 nt, Human
guauucuccauacuauuagacuguguagugaugugacuuccaaguagaauuuaaucuccccauu

SEQ ID NO: 78169 - RNA, 64 nt, Human
aaagauggggaaccugcuagugaacuaggagggagacuuccauagccucagacuuggauagggu

SEQ ID NO: 78170 - RNA, 64 nt, Human
cuggagaugcagcuacuggaaugguguuuugucagacuuccaaauccuggaaggacacagugau

SEQ ID NO: 78171 - RNA, 64 nt, Human
cugcuguccucagccucgacccucuucugugcuggacuuccacccacccacccuuuucaaguuu

SEQ ID NO: 78172 - RNA, 64 nt, Human
accuaaccaguccccaguuccccagcccugcugugacuuccauuuccaucguccuuucugaagg

SEQ ID NO: 78173 - RNA, 64 nt, Human
ugacuugucuuacugaacuacagccugguuuguagacuuccaacaucuacacugcugcucuuca

SEQ ID NO: 78174 - RNA, 64 nt, Human
cuuacuuauucuuccgucacauauacaaaagcaagacuuccagguagggccagcucacaagccc

SEQ ID NO: 78175 - RNA, 64 nt, Human
uaacucccaggcaguaucagguggucacuacagagacuuccacaaaaacuuuugaaugauguga

SEQ ID NO: 78176 - RNA, 64 nt, Human
gcacacguuugugagcucccagccggcaggccuggacuuccagugcucagagggcggggagaau

SEQ ID NO: 78177 - RNA, 64 nt, Human
ggcgaguguggugacuuccuggaaggaggaugcagacuuccagagagcccccccaacggacgug

SEQ ID NO: 78178 - RNA, 64 nt, Human
ugccugcccaucugcaucuuuugcagcccacucugacuuccaucugggggcugagaccacccuu

SEQ ID NO: 78179 - RNA, 64 nt, Human
cuuagagaagccuuggaaucagcugaaggugccugacuuccaggagcgugaaagcaucuuugcu

SEQ ID NO: 78180 - RNA, 64 nt, Human
uugcuugcaauaggugugcgucagaagcacccaggacuuccauuugcuuugucccggggcucca

SEQ ID NO: 78181 - RNA, 64 nt, Human
gcugaggccccagguggcagccauggaucauguagacuuccagauggucucccgaaccgccugg

SEQ ID NO: 78182 - RNA, 64 nt, Human
uguuguuuccaggagagaaugggagacaauccuagacuuccaccauaaugcaguuaccuguagg

SEQ ID NO: 78183 - RNA, 64 nt, Human
auauguugaugguggcuguaguuguuuaaauggagacuuccaaucaccagcuccugccaaauua

SEQ ID NO: 78184 - RNA, 64 nt, Human
cacuccuucaggaaaaagugaugaugauuuugcugacuuccacuccaguaaauuuucuuccaua

SEQ ID NO: 78185 - RNA, 64 nt, Human
aacuguaaauaugucacuagagaaauaaaauauggacuuccaaucuacguaaacuuauuuguuu

SEQ ID NO: 78186 - RNA, 64 nt, Human
ccccaaucccuguucuccaauauguguaugaugugacuuccauguagauauaaaaaugauugug

SEQ ID NO: 78187 - RNA, 64 nt, Human
ucccccuccgagcccguccgcucccgagcucggugacuuccacugucgcgguguaguuguccac

SEQ ID NO: 78188 - RNA, 64 nt, Human
uuugagaacuccuguguccaguuuagaagugagagacuuccauuuuuaguuccuuuacacucac

SEQ ID NO: 78189 - RNA, 64 nt, Human
ccuccucuacccuccagaacuuccuacagcugcagacuuccaggaguaaccgcuucuccuggau

SEQ ID NO: 78190 - RNA, 64 nt, Human
cagagguagcuggugauacccuguccuguggaaggacuuccacuucaacacuuccacuucaaca

SEQ ID NO: 78191 - RNA, 64 nt, Human
ccuguggccucuuugagugucugcagcagcccuggacuuccagacuucuaucacaugagaaaaa

SEQ ID NO: 78192 - RNA, 64 nt, Human
cacaucuguagugccaugaagcgauucugucuuugacuuccaauggcaaaccugggugaucggg

SEQ ID NO: 78193 - RNA, 64 nt, Human
uggcuguuggguuccagaugcugcagcuccaugugacuuccaagcaggcccuccgcccucccug

SEQ ID NO: 78194 - RNA, 64 nt, Human
cagcccugcccccgcagacucccccugccgccaagacuuccaauaaaacgugcguuccucucga

SEQ ID NO: 78195 - RNA, 64 nt, Human
auagagacugucaacguuguccucaugacaaccagacuuccaguucucaggaacuucucauugu

SEQ ID NO: 78196 - RNA, 64 nt, Human
uaauccugggugcuugaaggggauguggacucuugacuuccagcugggaugugugacuucuuau

SEQ ID NO: 78197 - RNA, 64 nt, Human
cuagcuguaagcggaacacccugccccagggccggacuuccagcccccagagcccucucccugu

SEQ ID NO: 78198 - RNA, 64 nt, Human
cagguuggguucucugccuaccauugcugucucugacuuccagagcucaacccccuccuuucuc

SEQ ID NO: 78199 - RNA, 64 nt, Human
aaauacaguaaccuucugagauauugagauuuaggacuuccaacauaugaauuuuagaagggaa

SEQ ID NO: 78200 - RNA, 64 nt, Human
gaguagcugaaaggaagacgcgauuagugguuaagacuuccaagccagaagacagaggguucga

SEQ ID NO: 78201 - RNA, 64 nt, Human
uccgccccugagccccaggagcacugcagcccgagacuuccaaccugaguggcggagaagcugg

SEQ ID NO: 78202 - RNA, 64 nt, Human
guuucuagagugagucccaguuacaucaaacagugacuuccaguuauuccccaguaagucugag

SEQ ID NO: 78203 - RNA, 64 nt, Human
ucaugcuagagcuaaugggagauguggccacacugacuuccauuuuaagcuuucuaccuucuuu

SEQ ID NO: 78204 - RNA, 64 nt, Human
agagggaugaugggagaugcagccuugaucaugugacuuccagcaugaucaccuacugccuucu

SEQ ID NO: 78205 - RNA, 64 nt, Human
ucuguguuuuuauuaaugaagaaaagggaagacagacuuccaagaguuacuguccacccggugg

SEQ ID NO: 78206 - RNA, 64 nt, Human
ccucccuggaguguugaggggguuguaccugccagacuuccaggggacgauggaauacccagaa

SEQ ID NO: 78207 - RNA, 64 nt, Human
agggauguucauuaaaaugcuggaaaacuguaaagacuuccaggucccauccaaggagauuuug

SEQ ID NO: 78208 - RNA, 64 nt, Human
ccaggcaaagcccagagcaucugagcacgucucugacuuccaguggcaacacaguuugaacgug

SEQ ID NO: 78209 - RNA, 64 nt, Human
agacccucugcagaaguauuaucagaguagagcugacuuccaguacccgggcagccagcucugu

SEQ ID NO: 78210 - RNA, 64 nt, Human
aaggaaggagggggaaaaaaaccgccaccgggcugacuuccaccucccaguggugagcaguggg

SEQ ID NO: 78211 - RNA, 64 nt, Human
auauauauauuuauuuuuuuuacugagagcuuaugacuuccagaaagugcuaaaggugggaggu

SEQ ID NO: 78212 - RNA, 64 nt, Human
agugcaauaaauuuuucuagaaaauggcaaagaugacuuccagguggauauugcucucuuacgg

SEQ ID NO: 78213 - RNA, 64 nt, Human
augaaaaugcgagagugggaaggacacagugugagacuuccacuagaaaaaagugaaaguuagg

SEQ ID NO: 78214 - RNA, 64 nt, Human
uggugagcauuuugguuuccuuaaggcccagcaagacuuccagggacaucucuggugaagccag

SEQ ID NO: 78215 - RNA, 64 nt, Human
gcagcaaggauucuagcugaaaauauguucgacugacuuccaggaguuccgaaaggcagaagug

SEQ ID NO: 78216 - RNA, 64 nt, Human
cuucuuaaacuguuuucuuuugggcuuggggugggacuuccagagauagggauggguugggggc

SEQ ID NO: 78217 - RNA, 64 nt, Human
uuacuuggccaagagaaugcuuauuuaaguguuagacuuccauucuggcaaaaucuugccuuau

SEQ ID NO: 78218 - RNA, 64 nt, Human
acuaggucuucagaauggacguccuucugccagagacuuccagcgggcggcuccaaaggcccaa

SEQ ID NO: 78219 - RNA, 64 nt, Human
cugagaaaagcccggaggagaugcuccuagcuaugacuuccagcuuucaagugcucuguugccu

SEQ ID NO: 78220 - RNA, 64 nt, Human
cuguuuuaaaaaggaacugcagcaaucuuugaaagacuuccaaagaauguuagagcacaguaca

SEQ ID NO: 78221 - RNA, 64 nt, Human
caggcaacagugccugcaaggccugaauuagagagacuuccauuggcuaaguaguuaagagccg

SEQ ID NO: 78222 - RNA, 64 nt, Human
guccaagauuccacugguuuaguggcagagccuagacuuccacucggaucuauuuagugcuugc

SEQ ID NO: 78223 - RNA, 64 nt, Human
gugaaauaugugguugguaggaagagguaccaaugacuuccaaacaugugauuccgucuuaaaa

SEQ ID NO: 78224 - RNA, 64 nt, Human
ugauaccacuuuucuuuucccccuguaccuaugggacuuccagaaagaaguuaaauugaguaaa

SEQ ID NO: 78225 - RNA, 64 nt, Human
ccuugauggagaguugcauggggugcuauaugcagacuuccaugguuuguguguagccaugaac

SEQ ID NO: 78226 - RNA, 64 nt, Human
cuacuaaugugcagccauugcccaagcagugacugcguugcauacauuuggcacugaguaggac

SEQ ID NO: 78227 - RNA, 64 nt, Human
uggagaggcagaauggcaggagguuucaugucccgcguugcaucuccuccugaaagaaaagcag

SEQ ID NO: 78228 - RNA, 64 nt, Human
ccauaauacagcuccuaaaaguugugugggauuugcguugcauaaauagccaugugaauuccac

SEQ ID NO: 78229 - RNA, 64 nt, Human
ucuggguggcccccugcagguggccccugacccugcguugcagcaggguccaccugugagcagg

SEQ ID NO: 78230 - RNA, 64 nt, Human
guuccugcucucccgggccccgggccuggggcaugcguugcaccugcccagcccgguggcugcg

SEQ ID NO: 78231 - RNA, 64 nt, Human
ugccaagaguucuuuaggugccuccugucuuauggcguugcaggccagguuaugccucaugcug

SEQ ID NO: 78232 - RNA, 64 nt, Human
ugcuaucuuugccucacuuagucaugugcaauucgcguugcagaguggcagaccauuaguugcu

SEQ ID NO: 78233 - RNA, 64 nt, Human
gagacccacaucaagaucggaagcccuuuggguggcguugcagaucucauugcucaguaggccg

SEQ ID NO: 78234 - RNA, 64 nt, Human
aaauguagaugccaaagauaaguggggaaggacagcguugcauagagggguaagcagaaauaug

SEQ ID NO: 78235 - RNA, 64 nt, Human
ggcguggucacugcugucaucaauugaauggucagcguugcaugucgugaccaacuagacauuc

SEQ ID NO: 78236 - RNA, 64 nt, Human
ugguuuuuuuguuauuguugguuuauacaagcaugcguugcacuucuuuuuugggagaugugug

SEQ ID NO: 78237 - RNA, 64 nt, Human
uggccacgcugguguuugagcugccucuugggaagcguugcauauuuuacagugcagcauaaug

SEQ ID NO: 78238 - RNA, 64 nt, Human
uucaaaguugcauguucuaugacaucugugacuugcguugcagaguguacaugaaacuguauaa

SEQ ID NO: 78239 - RNA, 64 nt, Human
aggcaaagcaggcugcagucagucccucaagccagcguugcauguuugggaugguggcuccugu

SEQ ID NO: 78240 - RNA, 64 nt, Human
gauauaagguguuuuccuuaagugacauggcccugcguugcaaagcugagaaguaauaugaagg

SEQ ID NO: 78241 - RNA, 64 nt, Human
cagugcugcacacuccugguuuggaacuuuaauagcguugcaacgaaauccuauauccaguuuc

SEQ ID NO: 78242 - RNA, 64 nt, Human
acagaggguaggagucuagccgaggcgccauggggcguugcaucagcaggacacuugugagagc

SEQ ID NO: 78243 - RNA, 64 nt, Human
aauuuuauucugaauucucuuucaucucauuuuggcguugcaucuauuguacaucagcccugag

SEQ ID NO: 78244 - RNA, 64 nt, Human
ugcuucccucagaaauaaaaggagcucagcugcagcguugcauugggcuucuuggccucccaac

SEQ ID NO: 78245 - RNA, 64 nt, Human
ucuuguaaaugcauugugaaaaauuuuauuuucggcguugcaaugcggggaggagaagucagau

SEQ ID NO: 78246 - RNA, 64 nt, Human
gggaauaccucguuagagaauggccugagacagugcguugcaacuuuuuaauuccauaucaaaa

SEQ ID NO: 78247 - RNA, 64 nt, Human
gagaaaagaaccuggggauaccucucagccuccagcguugcaagugcaaggccaguggaguuaa

SEQ ID NO: 78248 - RNA, 64 nt, Human
cagguuuagaagagaaaagagcaacagauuuucagcguugcagucacucgguuaucuaugaagg

SEQ ID NO: 78249 - RNA, 64 nt, Human
gcuaggaggaagggguuaaaaaaaaaauuuguccgcguugcaaacuauuauaaaugauugccac

SEQ ID NO: 78250 - RNA, 64 nt, Human
auguauacaauaauuuuuuuaaaaagugcaauuugcguugcagcaaucaguguuaaaucauuug

SEQ ID NO: 78251 - RNA, 64 nt, Human
cggccaguaccaccgccugaggcggggcucagcagcguugcauguacgggccucguacugccuc

SEQ ID NO: 78252 - RNA, 64 nt, Human
uguucuguuuauuuaauaagugggcagguugcaagcguugcacagaaauucugagauuuuacug

SEQ ID NO: 78253 - RNA, 64 nt, Human
cagccguuaccugccacugggaccagcaggugaagcguugcaacauagcccccuccaucauccu

SEQ ID NO: 78254 - RNA, 64 nt, Human
cgcgccguccuccgaggaacugggcgcuugcagugcguugcacacccucaccucccacccacug

SEQ ID NO: 78255 - RNA, 64 nt, Human
uguggcucugggguuagaaugggagauggggguggcguugcagagucgggaaggggcgggucac

SEQ ID NO: 78256 - RNA, 64 nt, Human
ccugcguuccgugcaagccgccucggcgcugccugcguugcaaacugggcuuuguagcgucugc

SEQ ID NO: 78257 - RNA, 64 nt, Human
auuuaaauaaauguugaagcucaaguuuaaagaagcguugcagaggcccacggucuccuggguc

SEQ ID NO: 78258 - RNA, 64 nt, Human
ugcuccugcuccccgugggaccugggaccuuaaagcguugcagguuccugauuuggacagaggu

SEQ ID NO: 78259 - RNA, 64 nt, Human
cuauuuuaauuaugucgaguguaaauuugacaucgcguugcauuuauuuuuauauuucugaaaa

SEQ ID NO: 78260 - RNA, 64 nt, Human
gguccucgggcaugaacgcgagcccaaagugccagucugcgauuggaaauuuccagccacuuua

SEQ ID NO: 78261 - RNA, 64 nt, Human
ugacugccagcacagggcaucucgggcuuggcuggucugcgaggccuugccccuguggaacucu

SEQ ID NO: 78262 - RNA, 64 nt, Human
ugcucucagccauagugaaggaccagcccuaggagucugcgagagccuccuugguuccaucgug

SEQ ID NO: 78263 - RNA, 64 nt, Human
caguuuugcugcuauaauucuauacuguugauucgucugcgauuuuaucuguuaaccaaauaaa

SEQ ID NO: 78264 - RNA, 64 nt, Human
augacgugcuccguagcucugcugcugauacugggucugcgaugcagcggcgugaggccugggc

SEQ ID NO: 78265 - RNA, 64 nt, Human
aagagagagagagaauaugugugugugugugugcgucugcgagcgcacacacaugcacaagugc

SEQ ID NO: 78266 - RNA, 64 nt, Human
agucagucauguuagguaggaggugguagagucggucugcgagguaucucguaagaggggaggu

SEQ ID NO: 78267 - RNA, 64 nt, Human
ccauuugucucuucggaggagcuagcuaugagaugucugcgaucacaucacgguaaagcccaag

SEQ ID NO: 78268 - RNA, 64 nt, Human
gcccaagguuuuagcugucuugugugcauccacagucugcgaagaagacaugauaaggacauca

SEQ ID NO: 78269 - RNA, 64 nt, Human
caccuuguugacagggagccaaggcgaggcggcugucugcgaccacagcagccucgaaacacca

SEQ ID NO: 78270 - RNA, 64 nt, Human
cuaaaggauccccagcccccaagaccuagccuuugucugcgauuuuggcuucaucucccacaaa

SEQ ID NO: 78271 - RNA, 64 nt, Human
caucaaaaggcucaacagacugaauggccucuuggucugcgaaaauucaguugcaaugaggaug

SEQ ID NO: 78272 - RNA, 64 nt, Human
gucccaggcacagcugaacaugccgcuguccgaggucugcgagggcuucgacgaggagggccgc

SEQ ID NO: 78273 - RNA, 64 nt, Human
guccugcugcuggcaaggaaugggaacaguggcugucugcgaucaggucuggcagcauggggca

SEQ ID NO: 78274 - RNA, 64 nt, Human
gcuaacaaggugcccuuuagccagaugcuaggcugucugcgaagaaggcuaggaguucauagaa

SEQ ID NO: 78275 - RNA, 64 nt, Human
cuugaaaagucacacugaaaggaugcaaauagccgucugcgauuuuggcggcccuccggauugu

SEQ ID NO: 78276 - RNA, 64 nt, Human
ggcccaggggaggcggcacuccaaccuaaccugugucugcgaaguccuauggaaacccgagggu

SEQ ID NO: 78277 - RNA, 64 nt, Human
ggaacacagauauaacaaugguuuugauguccuugucugcgaaucuuaucacuugggucaguuu

SEQ ID NO: 78278 - RNA, 64 nt, Human
gcuuggaaguggggaccccucacugcguccacgugucugcgaccuguguggagugucaccgcgu

SEQ ID NO: 78279 - RNA, 64 nt, Human
aauccgcuguuccucccucaucuccucugccugugucugcgacccccauccaugugccaaagug

SEQ ID NO: 78280 - RNA, 64 nt, Human
agagguucacacaggugcagcuucgaggcccacagucugcgaccuucuuguuuggagaugagaa

SEQ ID NO: 78281 - RNA, 64 nt, Human
gacgucucccaccugccccaauaagaucugcucugucugcgacaccaagauccagcuggggacu

SEQ ID NO: 78282 - RNA, 64 nt, Human
gcacccugauucuaccaaaugcaaacacaucugggucugcgauuaugcacagagacuuuggaca

SEQ ID NO: 78283 - RNA, 64 nt, Human
ccagccugcacuugcaggaguggugaugccccaagucugcgaauccagggugcacguggucaau

SEQ ID NO: 78284 - RNA, 64 nt, Human
acucuccucgcccaguuucugaggucagacgagugucugcgaugucuucccgcacucuauuccc

SEQ ID NO: 78285 - RNA, 64 nt, Human
gugccugcuuaccugccagauaaccaagugagaugucugcgaguggcuaguuuucacauucuua

SEQ ID NO: 78286 - RNA, 64 nt, Human
gcugccaagugccuaccuguccaccgccaccggggucugcgauggcacgccagugcuggagccg

SEQ ID NO: 78287 - RNA, 64 nt, Human
caggcgggagcggccccacacguguuugcuuaaagucugcgaguccgcaucguguccgccucuc

SEQ ID NO: 78288 - RNA, 64 nt, Human
uucccuuucagcaucugagaaccuuaaagccaaugucugcgaucuuuuuuuggauauuuauacu

SEQ ID NO: 78289 - RNA, 64 nt, Human
aaaauaaauaaauaaauaaauaaaaggcagcuugaguuuccaaacgugugauucacuugugaac

SEQ ID NO: 78290 - RNA, 64 nt, Human
aggcacaaguaugucucugggucccuugcccugcaguuuccagggggcucugcuccaaguuccc

SEQ ID NO: 78291 - RNA, 64 nt, Human
guuucaucaagaacacuacagagucgauacugugaguuuccaaccucagcccaucugugggcag

SEQ ID NO: 78292 - RNA, 64 nt, Human
guuaauagggauuuuuucagcuuauuuugguugcaguuuccaauuuuuaaaaauguugagguaa

SEQ ID NO: 78293 - RNA, 64 nt, Human
gcuaagaguucagaggccaucaaggagagcagcaaguuuccauuuggcauuagcccagcacaga

SEQ ID NO: 78294 - RNA, 64 nt, Human
uuaaaccuguccacauugguggugaugaugggugaguuuccaugguaacacaucccuaauuuua

SEQ ID NO: 78295 - RNA, 64 nt, Human
uuuaauaaauauuuaauaaaugaugaaugauagaaguuuccaucuacaauauauguuccuaaau

SEQ ID NO: 78296 - RNA, 64 nt, Human
ggagguguaaaacaauguccuucgcugaggccaaaguuuccauguaagcgggauccguuuuuug

SEQ ID NO: 78297 - RNA, 64 nt, Human
gggaaaaccuucuggguggacuuuguaagaauccaguuuccaagguuagauucacauccuuaau

SEQ ID NO: 78298 - RNA, 64 nt, Human
auggcgucuaaacccagcuacuuugcauuccagaaguuuccauucccuccaauuccaccuaauu

SEQ ID NO: 78299 - RNA, 64 nt, Human
aaccuaauuaucugugauaugagagaaucauuucaguuuccauugagagcucuguuaaagguau

SEQ ID NO: 78300 - RNA, 64 nt, Human
aucucaccugacaacacuguugcauuggcaguuaaguuuccacguaaacuuucggggacacauu

SEQ ID NO: 78301 - RNA, 64 nt, Human
uuuuaaaagucaaugguuuuuuuucuuguguucuaguuuccauaauaggagagaaaauauagaa

SEQ ID NO: 78302 - RNA, 64 nt, Human
uuugcucuguacagaaguaaguaaaaguaggaauaguuuccauggauauuuuuauuuuuauuaa

SEQ ID NO: 78303 - RNA, 64 nt, Human
caugaccugaacuuuuuagcaaauuauuauucucaguuuccauuaccuguuuggccaaacagau

SEQ ID NO: 78304 - RNA, 64 nt, Human
aaagaaugaagugagacaaacaguuguaaagaugaguuuccaccuacuuauaccagagugcuaa

SEQ ID NO: 78305 - RNA, 64 nt, Human
uuauuccugguuagggcaggugguccuagacagcaguuuccaguaaaagcugaacaaaagacua

SEQ ID NO: 78306 - RNA, 64 nt, Human
uaggccuggcugcuucucucauuuuuuuccucccaguuuccaaacaagcccucagugaacauca

SEQ ID NO: 78307 - RNA, 64 nt, Human
ucuggagcccaaggagagcccugaagucuuguggaguuuccagugaguccagucagggccaaug

SEQ ID NO: 78308 - RNA, 64 nt, Human
ugcacaacugcuuugagguacuguagacugcugaaguuuccacccucuuccccugggauugcac

SEQ ID NO: 78309 - RNA, 64 nt, Human
cccucaagaacucaugccagcucagcccuacaccaguuuccaccuggaguucaugcaagggcaa

SEQ ID NO: 78310 - RNA, 64 nt, Human
gauuaaaacaugcuaguucaaaauaagacugcucaguuuccaaggguuuucaagccuacuuacc

SEQ ID NO: 78311 - RNA, 64 nt, Human
gaaaaauuaacuuuuuuguggcaauuagugugacaguuuccaaauugcccuaugcugugcucca

SEQ ID NO: 78312 - RNA, 64 nt, Human
gguaacggggcuggccuggcauuagucauuauuuaguuuccaggccaaccauccagauagagau

SEQ ID NO: 78313 - RNA, 64 nt, Human
cagcggaaguuacuaauucggaccugacugaugcaguuuccauagcaacccauguuuccuggga

SEQ ID NO: 78314 - RNA, 64 nt, Human
guaaguuauuuaguucuaaccacaaauaacaaguaguuuccaaggaaauuucaguggcucucug

SEQ ID NO: 78315 - RNA, 64 nt, Human
uuuuugacgggaacacugcagagacaaugcugugaguuuccaaccucagcccaucugcgggcag

SEQ ID NO: 78316 - RNA, 64 nt, Human
uaagaaaacaaacaagcuacauucuguauuugccaguuuccacagcaugaaguacauagcuucc

SEQ ID NO: 78317 - RNA, 64 nt, Human
uauuuauaucacaauuuacgaaaccaaaaaguugaguuuccaauggaacccuuguuuuuuaaua

SEQ ID NO: 78318 - RNA, 64 nt, Human
uuccgaaacagccuucugaauacaaagaggauucaguuuccaucuucucaacuuuuuaacacag

SEQ ID NO: 78319 - RNA, 64 nt, Human
ccucccagauggacccuuccaugggaggaaauaaaguuuccaucgcaggugcugggagucuggu

SEQ ID NO: 78320 - RNA, 64 nt, Human
cucgacaagaagccuaacagcaacuucuacauuaaguuuccagauaaggcuucugagaacuaua

SEQ ID NO: 78321 - RNA, 64 nt, Human
cccugccuuguacauaauacuauuccauccacacaguuuccacccucaccugcccccucauacg

SEQ ID NO: 78322 - RNA, 64 nt, Human
agaacuccagccccgcuacuuacauggaucaucgaguuuccaccuaaaauaugauucuauuuau

SEQ ID NO: 78323 - RNA, 64 nt, Human
cugcagguuucccaaugcacucagaaagaaauccaguuuccauggcccuggauggucuggccca

SEQ ID NO: 78324 - RNA, 64 nt, Human
aaugccagugcugcucagcccucagcagaacuucaguuuccaugaaauaaacaaugacuauaua

SEQ ID NO: 78325 - RNA, 64 nt, Human
aauaaaaguuuucaacauauuucuaaauugugugaguuuccagcuguagcuuuugucuuuguca

SEQ ID NO: 78326 - RNA, 64 nt, Human
gucuggacuuaagaguuuaaaauuuuuaaacaucaguuuccaaguuuauaucauauuaauacau

SEQ ID NO: 78327 - RNA, 64 nt, Human
gucagaagacaugaacuugcuuuuccucuaguccaguuuccauucuucagucagaguaugauga

SEQ ID NO: 78328 - RNA, 64 nt, Human
cucuggggcuguugaagucaccuuguguguuccaaguuuccaaacaacagaaagucauuccuuc

SEQ ID NO: 78329 - RNA, 64 nt, Human
cuuugggagaauauacaaaggaaaaagcaggcauaguuuccacuuuaaagggaagaagggacuu

SEQ ID NO: 78330 - RNA, 64 nt, Human
gcauugauuuuuugacaagucuguagagccuaauaguuuccaucaaaggccuagaucucuuauu

SEQ ID NO: 78331 - RNA, 64 nt, Human
agaugauaccaaaauuccuuuugauaauuuuuuaaguuuccagcucuucaccgaaauguuguau

SEQ ID NO: 78332 - RNA, 64 nt, Human
aaauguauggcaucuuuuccuugcaaauucuuccaguuuccaagugagaaggggagcagguguu

SEQ ID NO: 78333 - RNA, 64 nt, Human
gcuaucucuaucuuagaaagcaaaaacaaacaggaguuuccagggagaaugggaaagccagggg

SEQ ID NO: 78334 - RNA, 64 nt, Human
ucggcuacuuaacuuuacauuccucuuauuuuucaguuuccagucaagauuauaaaaagcaaau

SEQ ID NO: 78335 - RNA, 64 nt, Human
gaauggggagaagguuaugagaagagcauuauuaaguuuccaaauuuaauuugaauuccaaauu

SEQ ID NO: 78336 - RNA, 64 nt, Human
caauaucaacaaugaggaaaauuacugaagaauaaguuuccauaagucuccuacauagcagugu

SEQ ID NO: 78337 - RNA, 64 nt, Human
gccugccuucuacuucucaaaucuuucuuguaaaaguuuccaauuuuuucacugaaaccugagu

SEQ ID NO: 78338 - RNA, 64 nt, Human
gauuacaggcaucagccaccacgccuggccugauaguuuccacauaguuuuucaugacuuagaa

SEQ ID NO: 78339 - RNA, 64 nt, Human
cucugugcuggaagaugcuagaucugaaagacagaguuuccacaguucagaaaucaucccacag

SEQ ID NO: 78340 - RNA, 64 nt, Human
auggacauuaauaguucuaggcuauuaugaauaaaguuuccaugaacaucuauguacaagucuu

SEQ ID NO: 78341 - RNA, 64 nt, Human
uguugagaauuaagagcuaacacuauauauguaaaguuuccaguacuagucccagaauuuagaa

SEQ ID NO: 78342 - RNA, 64 nt, Human
gcaaauaaccauugucauaagaauguuuaugaauaguuuccaaauuauggcaaauucauguaga

SEQ ID NO: 78343 - RNA, 64 nt, Human
uuagccugagcuugauucuuaggucuugagacucaguuuccaacaccuucauuauuaauguuaa

SEQ ID NO: 78344 - RNA, 64 nt, Human
aacggucagacaaccuccucaaagugggcauaccaguuuccacgggguuggguugccggucaga

SEQ ID NO: 78345 - RNA, 64 nt, Human
cuuuguuuauaaugaaaguggcgauuaggcaguuaguuuccauaaaguggccguaugggaauuu

SEQ ID NO: 78346 - RNA, 64 nt, Human
gacauuaagaauuuccaucaauaauuuaugaauaaguuuccagaacaaauuuccuaauaacaca

SEQ ID NO: 78347 - RNA, 64 nt, Human
uauacaaccuauggauuucauguguuacaauaucaguuuccagaauaaagugagggaaaucagg

SEQ ID NO: 78348 - RNA, 64 nt, Human
acuggaauuuuuauuaugcauaacugacaaaucaaguuuccaagcaaauguuacauaguguagg

SEQ ID NO: 78349 - RNA, 64 nt, Human
auuagugacuucaaagggaaaucaaggaaagaccaguuuccauuuaugcgaaaucugugguugu

SEQ ID NO: 78350 - RNA, 64 nt, Human
aaguaauuacuguuucuguugccuggacaguuacaguuuccaggaaacaucaggaaguaggaaa

SEQ ID NO: 78351 - RNA, 64 nt, Human
gaagaaaaaaaucuagcuaugucagaugcagcagaguuuccaaaucagauuccucaaaccaccu

SEQ ID NO: 78352 - RNA, 64 nt, Human
cuggcaguaggauuuaaaaagcagcccacugcucaguuuccaggaucagcuuccuccuucuguc

SEQ ID NO: 78353 - RNA, 64 nt, Human
ugugcauauuuagcaucccuggaaaucauaauaaaguuuccauuagaacaaaagaauaacauuu

SEQ ID NO: 78354 - RNA, 64 nt, Human
agaccauugagaucaagccuuuacucccuuugagaguuuccaacaucaguugauugagcuucag

SEQ ID NO: 78355 - RNA, 64 nt, Human
uuucccugucuggaggcucaccuuagagcuucugaguuuccaagcucugagucaccuccacauu

SEQ ID NO: 78356 - RNA, 64 nt, Human
acgcaguggcuaccugggcauuuguggucauuucaguuuccaucuccccagcgggggcucccug

SEQ ID NO: 78357 - RNA, 64 nt, Human
guagaucaaaaauuauuuauuacuaagaggauguaguuuccaaaggaaucccccauuuuuucug

SEQ ID NO: 78358 - RNA, 64 nt, Human
aacucuuuagccaaaagagaacccugaccuccugaguuuccaugcuccuuucuguaccagguuu

SEQ ID NO: 78359 - RNA, 64 nt, Human
ucaguuuaauguugaagaauugaccucagggcucaguuuccauuucccucccucaguauucuuc

SEQ ID NO: 78360 - RNA, 64 nt, Human
aacaaacaaacuuagaaacauaaaaggaaauguaaguuuccagauuuaaaggacaugcugggug

SEQ ID NO: 78361 - RNA, 64 nt, Human
agagaagcaaguaaaaaggcuaaauggaagggcaaguuuccaucaucuauagaaagcuauauaa

SEQ ID NO: 78362 - RNA, 64 nt, Human
caggcagcccugccaugucacaauaggccaggggaguuuccaaagauguggguggcaaaugccc

SEQ ID NO: 78363 - RNA, 64 nt, Human
uugagaaaaaucaaaacaucauguagggugaccuaguuuccaaaccaauaaauaaguaguauug

SEQ ID NO: 78364 - RNA, 64 nt, Human
aagacauuugcuaauuuuguaguuucaugugauuaguuuccaaagguuacagauaauaaagaaa

SEQ ID NO: 78365 - RNA, 64 nt, Human
uuucucagaauaucuauggccacagcagcauaccaguuuccauccuaauaggaaugaaauuaau

SEQ ID NO: 78366 - RNA, 64 nt, Human
cuuccagguuuaacagacaaaauaaacuuacucuaguuuccaucucuaucauuuuauaauaacc

SEQ ID NO: 78367 - RNA, 64 nt, Human
auuuuucauaauaaaaaaguuuuaaaaguccuccaguuuccaacacacucaagagagagcccca

SEQ ID NO: 78368 - RNA, 64 nt, Human
gggccuaccuuccuuggggauguucaugggccccaguuuccaguuucccuugccagacaagccc

SEQ ID NO: 78369 - RNA, 64 nt, Human
caaaagauacaaccacauaauguauauaauuccuaguuuccauauuuauccgcauguaaagggc

SEQ ID NO: 78370 - RNA, 64 nt, Human
uauuuauggcuagaagaacucguauguacacuuuaguuuccagaacuguuugguaaccuuucgu

SEQ ID NO: 78371 - RNA, 64 nt, Human
caacaggagaugagaguuccagauuguucuguccaguuuccaaagggcaguaaaguuuucgugc

SEQ ID NO: 78372 - RNA, 64 nt, Human
uauucucaaaguuuccuaaucagaaauuuuuaucaguuuccagucucaaaaauacaaaauaaaa

SEQ ID NO: 78373 - RNA, 64 nt, Human
ggcaaaauaauuagugaguuuaaaaaaaaucuauaguuuccaauaaacaacugaaaaauuauca

SEQ ID NO: 78374 - RNA, 64 nt, Human
cucugccuugucucucuuugucuuaaaaugcuuuaguuuccaucagguucaaguucuugacuau

SEQ ID NO: 78375 - RNA, 64 nt, Human
accaauuugcagaagcucacauagcaaguucauaaguuuccaaaaaggaagcccauacauaaca

SEQ ID NO: 78376 - RNA, 64 nt, Human
uccuauaguccuagcaauaagagaaauuuccucaaguuuccaugugcgguucuccuagcugcag

SEQ ID NO: 78377 - RNA, 64 nt, Human
uaccaguggugccacauguggcagcuccuguggaaguuuccaguucccaguauguggcccagag

SEQ ID NO: 78378 - RNA, 64 nt, Human
auuuuauaugacuaguuuacaaaauaggacauugaguuuccaaguauugagauaagggaauaua

SEQ ID NO: 78379 - RNA, 64 nt, Human
cagaucuguuuuucacuuauccugauuuaaugacaguuuccaacauuguuuuguuauuacaagu

SEQ ID NO: 78380 - RNA, 64 nt, Human
ccuaggacugaggucuuagcacauguacugguggaguuuccagaccaccaguaugaauaaaagc

SEQ ID NO: 78381 - RNA, 64 nt, Human
cacccagcaaguuaggagugaucagaaccagugaaguuuccauuuuucauccauugcugcccug

SEQ ID NO: 78382 - RNA, 64 nt, Human
uagauuaggaaugguaauuuuuaucugguguuuuaguuuccaaaacauuuacauauugaucuac

SEQ ID NO: 78383 - RNA, 64 nt, Human
auauucauuaucugucauuuaucauagucguauaaguuuccaugauuuuauuuucuguuauuuu

SEQ ID NO: 78384 - RNA, 64 nt, Human
uucgcuauucgccagcagacaucagaacacaccgaguuuccagaugcugguuuuuccccuuaaa

SEQ ID NO: 78385 - RNA, 64 nt, Human
gccauccaauuuaguucaauaaaauucaaauauaaguuuccaugcuuuuuuguaacaucaaaga

SEQ ID NO: 78386 - RNA, 64 nt, Human
guguagguccagcguguuuccugagccuccugugaguuuccacuugcuuuacauccaugcaaca

SEQ ID NO: 78387 - RNA, 64 nt, Human
caucaugaggccggaugaaacuucucaguccagcaguuuccaguccuaacaaaugcucccaccu

SEQ ID NO: 78388 - RNA, 64 nt, Human
caaaaugaauaaaaagggaucaccauucaauuugaguuuccagggggaagugcauguauaauga

SEQ ID NO: 78389 - RNA, 64 nt, Human
aucacuuuuuuaauacacaugacuuuccucucccaguuuccagacagggcucuuugaauguaug

SEQ ID NO: 78390 - RNA, 64 nt, Human
uuaacuugaaacucuuaucaaaauauauuuuaccaguuuccagaauuuccaguacaggaccgcc

SEQ ID NO: 78391 - RNA, 64 nt, Human
uguaagaccagaauuaucuuuguacuaaaagagaaguuuccagcaaaacccucaucagcauuac

SEQ ID NO: 78392 - RNA, 64 nt, Human
uaaauaugaaaauaacuuugauuuuuaauuguguaguuuccauuucuuagcuuuugccuuuuaa

SEQ ID NO: 78393 - RNA, 64 nt, Human
auccacaggggaagauaaagauggucacacaaacaguuuccauaaagauguacauauucauuau

SEQ ID NO: 78394 - RNA, 64 nt, Human
uaguuuaauuguuucagguggaaaguauucuuugaguuuccauauugaauguguuuggacuaaa

SEQ ID NO: 78395 - RNA, 64 nt, Human
cuauugcauauauuuuggggacacagauuuucauaguuuccauuuuuggggggcuuaaggauuu

SEQ ID NO: 78396 - RNA, 64 nt, Human
uggagcuuuuggacaaaauagagaggagcaagauaguuuccaccaugaggugcaaaacgagaca

SEQ ID NO: 78397 - RNA, 64 nt, Human
uucuguguucauuuuuuuuuuuuuuuuuggcuagaguuuccacuaucccaaucaaagaauuaca

SEQ ID NO: 78398 - RNA, 64 nt, Human
ggugaucuauucccacaugucauuucuaauguugaguuuccaugacugaacaaagagaauauau

SEQ ID NO: 78399 - RNA, 64 nt, Human
ccuucauuucauguauaguuuucccuauugaaucaguuuccaauuauuugacuuuaauuuaugu

SEQ ID NO: 78400 - RNA, 64 nt, Human
gcauuucuccuagcuuuucaucaggaaaucccaaaguuuccaaagcuuuuuguuuacagaauaa

SEQ ID NO: 78401 - RNA, 64 nt, Human
aucuagcacagcugugaggacagacagaaggcaaaguuuccauguggccuugagcaagucccau

SEQ ID NO: 78402 - RNA, 64 nt, Human
accuagcagcggauggcuuucuuuagcuuagcccaguuuccagggaagcauuguuuuuuccagg

SEQ ID NO: 78403 - RNA, 64 nt, Human
accauuugacuguucaaugauuauuuguauuuacaguuuccagaguuugucauuauaauaggaa

SEQ ID NO: 78404 - RNA, 64 nt, Human
guucauccugcaacagaagcauucucuaggucccaguuuccaguugauugcauauccuugauca

SEQ ID NO: 78405 - RNA, 64 nt, Human
uuaaaaaaaagugaguuugagagggaaauggaaaaguuuccagaguauuucuaguaauuuauuu

SEQ ID NO: 78406 - RNA, 64 nt, Human
aguuucacuuuguacuauuuaaauuuauggaacuaguuuccauacugacuuguaagguuuuggg

SEQ ID NO: 78407 - RNA, 64 nt, Human
gcgcucaggcggacggcgccgacucuuuucacugaguuuccagaggaagacuagcgcggccacc

SEQ ID NO: 78408 - RNA, 64 nt, Human
ccuguauuaagcugucaacuuuaacagucugcacaguuuccaaagcuuuacuacucuuagagga

SEQ ID NO: 78409 - RNA, 64 nt, Human
cuaauuuuuggucauagaaaaucugcaucaaaucaguuuccaugcaucaguaauauugaagguc

SEQ ID NO: 78410 - RNA, 63 nt, Human
aaggagaagccaacacuugauagcacuacuuggaguuuccaugaauaagauggagaaagcuca

SEQ ID NO: 78411 - RNA, 64 nt, Human
aauuccuguuauuaguuuuggaagcuuauccauaaguuuccaaagacaagaugauauaaaaguu

SEQ ID NO: 78412 - RNA, 64 nt, Human
aaucuuggaauaaauauauuuuuccuucccuuguaguuuccaugguagcugaaugugcucagau

SEQ ID NO: 78413 - RNA, 64 nt, Human
cuggucuugaacuccuggccucaagugauccuccaguuuccaucucccuaagagcugggauuac

SEQ ID NO: 78414 - RNA, 64 nt, Human
uuuuagauuugugcacccauuggcaaaacaggaaaguuuccagauagguauuguaucauugaga

SEQ ID NO: 78415 - RNA, 64 nt, Human
aaguuugaaaugguuaacaguaaauuauuauguuaguuuccaggcacuugaacugugcuacaag

SEQ ID NO: 78416 - RNA, 64 nt, Human
ccacucccauucccccguccccaauguguuugugaguuuccaguugauuuguagcaaaugccua

SEQ ID NO: 78417 - RNA, 64 nt, Human
ggaagucauuccacccucaauuuguugauccacaaguuuccaguuguccucuucuuuuuguuau

SEQ ID NO: 78418 - RNA, 64 nt, Human
caggcuuauaccuuccauuuccaucguauucuccaguuuccaggauagacguugcucaucgucu

SEQ ID NO: 78419 - RNA, 64 nt, Human
uuguaaaauacuguucuaaauuauucaggccuauaguuuccauuacuggaguccuccauugugu

SEQ ID NO: 78420 - RNA, 64 nt, Human
ugaucccuggucauccuaauaaugggaugagggaaguuuccagcagauuucaggcuguucuuaa

SEQ ID NO: 78421 - RNA, 64 nt, Human
caccuuaacuuuuccuuuagcagccauuuccacuaguuuccauuaaguaguguucuauaaacuu

SEQ ID NO: 78422 - RNA, 64 nt, Human
auugcuuauggccauguauaaccaauuaauucugaguuuccaaaaucaaagauuugaccuuaag

SEQ ID NO: 78423 - RNA, 64 nt, Human
uguagagcaugacugaauugcucaucauucugggaguuuccauguaguggcuaugcagugugga

SEQ ID NO: 78424 - RNA, 64 nt, Human
acugaaagaaacuaauuuauuucuguuucuguggaguuuccauuauuucuacugcuuacacuuu

SEQ ID NO: 78425 - RNA, 64 nt, Human
ccuccuguguacuuuuggagaaaacugaagauuuaguuuccauuuuucuuuauaauaaaauauu

SEQ ID NO: 78426 - RNA, 64 nt, Human
gcaaguaauuuuagagcacaguguagccauguacaguuuccauuauuuaaaauaaauaaaugug

SEQ ID NO: 78427 - RNA, 64 nt, Human
uccuaaccuuuucauaaccuuuucauaacaugauaguuuccauaacagagacagccuaacaaug

SEQ ID NO: 78428 - RNA, 64 nt, Human
gugacugcagcaaacuuugguguaaaauuccaccaguuuccagccaccuuccugacuucuaucu

SEQ ID NO: 78429 - RNA, 64 nt, Human
uuucacccuuuuuaaucucucagccacaaaccucaguuuccaaauauuuguuuuauaaguuaag

SEQ ID NO: 78430 - RNA, 64 nt, Human
uauccauuaccucaaagcagucauuccuuaguaaaguuuccaacaaauagaaauuaaugacacu

SEQ ID NO: 78431 - RNA, 64 nt, Human
aacccaagcaaggcccuucuaccuuuugggccucaguuuccaugucuguaccacaagaggguug

SEQ ID NO: 78432 - RNA, 64 nt, Human
aaggggaaagaaucucacuggcaaguguuuguggaguuuccauggugauguuuacauccaggga

SEQ ID NO: 78433 - RNA, 64 nt, Human
ugaaacugaggagagcauugcuuguaaaauccugaguuuccauaaggaaaaugaaaacuccuuu

SEQ ID NO: 78434 - RNA, 64 nt, Human
ucugagauucuaacauccuuguuuuagaauucuaaguuuccaacauuccucauucuaggauccu

SEQ ID NO: 78435 - RNA, 60 nt, Human
cacaucacuugcccaucugagcacuaaagaaguuuccauaaggaauaaaaccuugucuuc

SEQ ID NO: 78436 - RNA, 64 nt, Human
aguaagaugcauaaaaucaauccacuacugaaauaguuuccagucagacauuucugaguucaga

SEQ ID NO: 78437 - RNA, 64 nt, Human
ucaucugugguuucgugucccucugaaggaaacuaguuuccacuguguaacaggcagacaugua

SEQ ID NO: 78438 - RNA, 64 nt, Human
aagguuagucuuucaguacacguugcugguaaguaguuuccaaguuacguguugucacuggguu

SEQ ID NO: 78439 - RNA, 64 nt, Human
cuuauuaaaggaggcauucuagaaaauaugaauuaguuuccaaaugccuuaauuuuaaacuuug

SEQ ID NO: 78440 - RNA, 64 nt, Human
gggucagccagggccaggggucucccuggagugcaguuuccaaucccauagaugggucuggcug

SEQ ID NO: 78441 - RNA, 64 nt, Human
cccauaguuuuacuuccuugucauuugauuggauaguuuccaaggaagccccuccagauuggca

SEQ ID NO: 78442 - RNA, 64 nt, Human
ucucuguaguauuuucauuugagagaggaggcugaguuuccagagcuuugcuuucauuuauuuu

SEQ ID NO: 78443 - RNA, 64 nt, Human
uacaccaauccuuacuugaggugguucggauuacaguuuccaaaugcauucugggauugccuau

SEQ ID NO: 78444 - RNA, 64 nt, Human
uagauuuaagggcacucaaggggaaaacaaauguaguuuccacagugugaggauaaauguagaa

SEQ ID NO: 78445 - RNA, 64 nt, Human
uccacagaauucacuuuaugugagaucucccgagaguuuccaucccaacaugauggacuuuggu

SEQ ID NO: 78446 - RNA, 57 nt, Human
caaacccgaaaagagugugagcuaacuaguuuccaaagcggagacuuccgacuuccu

SEQ ID NO: 78447 - RNA, 64 nt, Human
acugauggcuccucugcucccauaguggguccccaguuuccaagucaccuaggccuugggcagu

SEQ ID NO: 78448 - RNA, 64 nt, Human
gcagauagcucccucugaggaaccaaaggaagcaaguuuccacgauuucugaagagcugguaua

SEQ ID NO: 78449 - RNA, 64 nt, Human
gagggagagagaaagacgaagggagagagaaagcaguuuccaaggauauguuucaugucccacc

SEQ ID NO: 78450 - RNA, 64 nt, Human
uaccuuccuuucucuuuccuaacuuaaaaauaacaguuuccauauaacaaguagaaauuuaagu

SEQ ID NO: 78451 - RNA, 64 nt, Human
uagucuucuagaagugaggaugcgaaaaagaaugaguuuccaauuacccugaugugacaauuac

SEQ ID NO: 78452 - RNA, 64 nt, Human
uugggggagaccaagaacguuaacauuucuagcaaguuuccaggugaugcuguuguugcugguc

SEQ ID NO: 78453 - RNA, 64 nt, Human
ucuuuuuuaaauuuaacuuucugauggacccuguaguuuccaguuaagugcagauuccuuacag

SEQ ID NO: 78454 - RNA, 64 nt, Human
ucaaaaagcauaucaaauauuuuggguacuaggcaguuuccaaaguagcaugguaguauuacuu

SEQ ID NO: 78455 - RNA, 64 nt, Human
ugauuucaucaucugggucccuuugguuuauaucaguuuccaacaugacuuguuuguggggcuu

SEQ ID NO: 78456 - RNA, 64 nt, Human
acuguaagcaaauugcuuagcuucucuagacaucaguuuccacaucugaaaaauaagaagauga

SEQ ID NO: 78457 - RNA, 64 nt, Human
agugcuugcuugugaaucuuaacauuuuggugacaguuuccagaugcuaucacagacucugcua

SEQ ID NO: 78458 - RNA, 64 nt, Human
cuguuuauugcuuauguguagaaggaaugaaacuaguuuccagaguuguuauuaauaugaauau

SEQ ID NO: 78459 - RNA, 64 nt, Human
cagugaaauaugugcccaaaguucagaaagaugaaguuuccagaaacuaagaagguagcacaau

SEQ ID NO: 78460 - RNA, 64 nt, Human
aagugucacaguuauuaauauguuacauuuguuuaguuuccacguaaucuuuaucucuaccuag

SEQ ID NO: 78461 - RNA, 64 nt, Human
uuacauuuaaauagauuagugggaaaacuuuaagaguuuccacauauuaguuuucauuuuuuga

SEQ ID NO: 78462 - RNA, 64 nt, Human
acuauuuguguuuaccagaguugggagauaagauaguuuccaugaagguguguauguuuuauac

SEQ ID NO: 78463 - RNA, 58 nt, Human
uucaagaauacaacaacuaagaaaaggaaguuuccagaaaagaaguuaacaugaacuc

SEQ ID NO: 78464 - RNA, 64 nt, Human
aggggucaauguucaugucacuagcuuucaauccaguuuccacugcaguggcuggagagugacc

SEQ ID NO: 78465 - RNA, 64 nt, Human
ccagucagggccgucaugacuacgcagcagcagcaguuuccaagacgggccagaaacgcaucca

SEQ ID NO: 78466 - RNA, 64 nt, Human
gggggguugcaggacagcugaaaaagaaaacgugaguuuccagaaaagcacaucgcccuuucuc

SEQ ID NO: 78467 - RNA, 64 nt, Human
ugcucucuucacaggcagagaagccuguggcuaaaguuuccacaucccauuaacucagugcuuu

SEQ ID NO: 78468 - RNA, 64 nt, Human
uugccucaagacuauagccaucgacuccugccugaguuuccagccugcuagucugcccuaugga

SEQ ID NO: 78469 - RNA, 64 nt, Human
cuaacuuuuuguucaguuaauaagugguugauaaaguuuccauauuuuucuggaaaaguuaaaa

SEQ ID NO: 78470 - RNA, 64 nt, Human
auuaguguuaacacaaaacugccaacuuugcacaaguuuccagaaaagaaaauacaauuaguca

SEQ ID NO: 78471 - RNA, 64 nt, Human
ccuuuccauauaacaggagggaggggaagaaggaaguuuccaugugcaggcaauacgugagagc

SEQ ID NO: 78472 - RNA, 64 nt, Human
cuuaacuaguuguauuuauuuuucaugucaugagaguuuccauauaaugugccauaacugcaua

SEQ ID NO: 78473 - RNA, 64 nt, Human
cacuuaaccccucagcuaugaaaaggcuuccaggaguuuccaugaaauaacaaaaaaaaauaca

SEQ ID NO: 78474 - RNA, 64 nt, Human
gcuuauaauuccucguuaugcaugauuuauccaaaguuuccauaguuuuauucaaaauaauaaa

SEQ ID NO: 78475 - RNA, 64 nt, Human
ccuguguccauaucaagccagguggagccuucucaguuuccagaaauggagggacucaagcugc

SEQ ID NO: 78476 - RNA, 64 nt, Human
cuucccccucucugggcacccuucugcccacaccaguuuccagugcggagucugagacccuuuc

SEQ ID NO: 78477 - RNA, 64 nt, Human
guuugcugccuuccuggccagccagguggaagaaaguuuccaagcuaggucuggcccguugggg

SEQ ID NO: 78478 - RNA, 64 nt, Human
auuaccaacaggaaugaggaaagaagaaaacuggaguuuccagucucugaguucuaccugaugu

SEQ ID NO: 78479 - RNA, 64 nt, Human
agguguagaugacagaaagcaaaccuggauacagaguuuccacccucaguuccuggaggggcuc

SEQ ID NO: 78480 - RNA, 64 nt, Human
cacaggucagucugcgugaaagcccuuuguggggaguuuccaagccagugucguuuuugcacug

SEQ ID NO: 78481 - RNA, 64 nt, Human
caccucacugucagauauuguucuuuugauaugcaguuuccagcccuccaaugaguccccagca

SEQ ID NO: 78482 - RNA, 64 nt, Human
ugagagugaaucuuacauuacuacuuucaaaaauaguuuccaauaaauuaauaauaccuaccua

SEQ ID NO: 78483 - RNA, 63 nt, Human
aucagauuaagaagauguagcuuucugacaaaaaguuuccauauguuauaucaacagauaguu

SEQ ID NO: 78484 - RNA, 64 nt, Human
gauauuaucauuggaauuaucuaaggugagccccaguuuccagggcagcugauugacaccgucc

SEQ ID NO: 78485 - RNA, 64 nt, Human
ccaucggacgcucucccgggaccgccgcaggaccaguuuccauagacugcggacuggggucuuc

SEQ ID NO: 78486 - RNA, 51 nt, Human
ucaucuucccagcaucuugacaguuuccagaagaaucuaugggauuuuccc

SEQ ID NO: 78487 - RNA, 64 nt, Human
agaaacgaaagccauucccacaaagugaaggaacaguuuccaaaaccccugcgaggcagaguua

SEQ ID NO: 78488 - RNA, 64 nt, Human
gaccuccauacaccacacaggcauuuguaagcacaguuuccacaagcaccuuguaggaauaugg

SEQ ID NO: 78489 - RNA, 64 nt, Human
cuggaggauguuuacagcuuugaggcuucaaauaaguuuccauaugcagggaguaacuuuaaac

SEQ ID NO: 78490 - RNA, 64 nt, Human
uuuuaaaaaucuaauuagaauuuccaaauaaaacaguuuccauaaggugucagcaacagcacua

SEQ ID NO: 78491 - RNA, 64 nt, Human
ggccaugggacagggaggauccugucuggccuucaguuuccauccccaggauccacuuggucug

SEQ ID NO: 78492 - RNA, 64 nt, Human
cagacacgaguggggaaagcaguucuuucuccucaguuuccaaaguaaauggggaaucccagcu

SEQ ID NO: 78493 - RNA, 64 nt, Human
ccacaggucugcuaccacaggccaucaaaauauaaguuuccaggcuuugcagaagaccuugucu

SEQ ID NO: 78494 - RNA, 64 nt, Human
uuuccaccaugguaugguaacuucucugagcuucaguuuccaagugaauuuccauguaauagga

SEQ ID NO: 78495 - RNA, 64 nt, Human
uuguuuuguuuuuuuaaccacagauaauugccaaaguuuccaccugaggacgguguuuggaggu

SEQ ID NO: 78496 - RNA, 64 nt, Human
cuuuauuuuuacuuuuucauuucaagaaauuuagaguuuccaaauuuagagcuucugcauacag

SEQ ID NO: 78497 - RNA, 64 nt, Human
gggacugagcaugaggccauagacagaucuaaaaaguuuccaccacccuacagaaguacacaca

SEQ ID NO: 78498 - RNA, 64 nt, Human
ugugaucgcugagauguaaaaaguuuuuaaugcuaguuuccaccaucuuucaaugauacccuga

SEQ ID NO: 78499 - RNA, 64 nt, Human
uucuuuuuaaaaucaagagacuucgagcgaucccaguuuccauuucaaucuguauucacucgua

SEQ ID NO: 78500 - RNA, 64 nt, Human
ucuacuaugauuuuuuccagauguuuccuaaagaaguuuccagaaacuuugacuugaaauguuu

SEQ ID NO: 78501 - RNA, 64 nt, Human
ucugacuugcuuucaguauucacaaguucuuuccaguuuccaagucuuuuccuagcaguaauuu

SEQ ID NO: 78502 - RNA, 64 nt, Human
auuuuuaacaaaagccuccagaagauuuccccucaguuuccauugacuuagaucagguuacaga

SEQ ID NO: 78503 - RNA, 64 nt, Human
augcuuuaauucuuucuuuucuguagaaaccaacaguuuccauuuaugucaaugcuaaauccaa

SEQ ID NO: 78504 - RNA, 64 nt, Human
guaaaaugaggauccuguuggugauccucauuccaguuuccaaagcgagaggagccuucugagc

SEQ ID NO: 78505 - RNA, 64 nt, Human
gaaggccuagacaaagaacuagaaaaaaaaaagcaguuuccaggcccauccauauuguaauuuu

SEQ ID NO: 78506 - RNA, 64 nt, Human
aggggcuugcagcuucgugaggggucucuggcccaguuuccaaugaauaaaguucucuugacag

SEQ ID NO: 78507 - RNA, 64 nt, Human
gggcucagggaaaagggucggggauucucagucgaguuuccagagcaggaggcccuacagacau

SEQ ID NO: 78508 - RNA, 64 nt, Human
uucccucucugggggcucucuaauucguccuggaaguuuccaguggucuuauagacuccauguu

SEQ ID NO: 78509 - RNA, 64 nt, Human
uccucuuccagcuguccccucagcuaaggggcuuaguuuccaugugggaugccaucacuugguu

SEQ ID NO: 78510 - RNA, 64 nt, Human
ccuguccuuccuaucuccccaaaguaccauagccaguuuccagaugggccacagacuggggagg

SEQ ID NO: 78511 - RNA, 64 nt, Human
gaugcaggcuguccggccucagggccagggagccaguuuccacugugcgggaacucugagucag

SEQ ID NO: 78512 - RNA, 64 nt, Human
caaugcuuacuguuacuacuaauugauuccuacuaguuuccagguuuggggggauauuguuuca

SEQ ID NO: 78513 - RNA, 64 nt, Human
cggcagacccuggggcuggcagagggagcucuccaguuuccaggcaaggcggcuuccgauugau

SEQ ID NO: 78514 - RNA, 64 nt, Human
uguaagaaaaauaguucaucaucagagaauggucaguuuccauucacccaucugaaagauuuua

SEQ ID NO: 78515 - RNA, 64 nt, Human
uagguuccuuauguuuuauuaacugucuuuucucaguuuccauuucauuuuuuuuuuucuaguu

SEQ ID NO: 78516 - RNA, 64 nt, Human
aguuauuauguauguacaccauauaugaauaaacaguuuccaaaaacuuaaaauacaaaauaua

SEQ ID NO: 78517 - RNA, 64 nt, Human
ucccggugaugggaaggguaucagguugcuggggaguuuccacucuucucuggugauuguuccu

SEQ ID NO: 78518 - RNA, 64 nt, Human
aggccccggcuucacugguugaguguugcucucuaguuuccagaggcuuaaucacaccguccuc

SEQ ID NO: 78519 - RNA, 64 nt, Human
auuuggaggcagauucuuagagugaaaaagccucaguuuccauauuaaaaauguuuuaaauauu

SEQ ID NO: 78520 - RNA, 64 nt, Human
aaugucuauugccguaaauuguuaauaaaauugaaguuuccauuuuaaaugucgagcugacuua

SEQ ID NO: 78521 - RNA, 64 nt, Human
cuguuuuuaucuaauaaaaugcuaaccugcccugaguuuccauuacugugggugggguuccccu

SEQ ID NO: 78522 - RNA, 64 nt, Human
cucuuccucucccucucucuuuucauuguguaucaguuuccaugaaagaccugaauaccacuua

SEQ ID NO: 78523 - RNA, 64 nt, Human
ccugcugaagucugaaccuuacuguguaacccucaguuuccacuauuaaagaguaucuuuugac

SEQ ID NO: 78524 - RNA, 64 nt, Human
gggcuuguaaaauauagcuggucccuacucccagaguuuccauuucaggaggucugggaucagg

SEQ ID NO: 78525 - RNA, 64 nt, Human
augccaacauuuucuuuucuguuaagguuguuuuaguuuccagauagggcuaauuacaaaaugu

SEQ ID NO: 78526 - RNA, 64 nt, Human
gcccucugcccagauguguccagcacguucucaaaguuuccacauuagcacucccuaaggacgc

SEQ ID NO: 78527 - RNA, 64 nt, Human
ccgucuuggcaaaauaguggagaacgcaggacacaguuuccaggacauggccguggaggugggu

SEQ ID NO: 78528 - RNA, 64 nt, Human
uguauauuuuaaaugcuaacauuugaugaauguaaguuuccacauuguugcuguuucugcauuu

SEQ ID NO: 78529 - RNA, 64 nt, Human
uagcggcccgggcgcugccuucacuccuggagugaguuuccauuuccagcuggaaucugcagcc

SEQ ID NO: 78530 - RNA, 64 nt, Human
cucaaaaugagaacauuaggcuaaaugauuuccgaguuuccagcuaguccuagaguucuauauu

SEQ ID NO: 78531 - RNA, 64 nt, Human
uuuuagccacuuuagagaaaccucauaggcacagaguuuccaagauuaauuuuaagaauaucuu

SEQ ID NO: 78532 - RNA, 64 nt, Human
agagccgggugugaacuaugguuuagaagguucaaguuuccaauuaaagucauugaagaaaacu

SEQ ID NO: 78533 - RNA, 64 nt, Human
ccccuguaugauguuggaugcuccucacaugcugaguuuccagccuuuucugaaacucaguagc

SEQ ID NO: 78534 - RNA, 64 nt, Human
cacacuuuauaagcaauuaaggccaauugaauuaaguuuccaaagaguaaucuaggaagugguc

SEQ ID NO: 78535 - RNA, 64 nt, Human
uuuuuuaaaaguuuguuaaaauaugcuugacuagaguuuccaguugaaaggcaaaaacuuccau

SEQ ID NO: 78536 - RNA, 64 nt, Human
aaaugcauuguucauaugaaugucaucucuuuucaguuuccaguauccuuuuuaaaaaauggca

SEQ ID NO: 78537 - RNA, 64 nt, Human
uuuuccuuuugccaagugauugagucuguuuaguaguuuccaucauucuagucuuuaaguaaaa

SEQ ID NO: 78538 - RNA, 64 nt, Human
ugcagcaucuucagcuugagaaaaugagguugucaguuuccagcaaggcugacauccaccagac

SEQ ID NO: 78539 - RNA, 64 nt, Human
auuuagggguuucugaaucaagcuuaauguuuacaguuuccaaauagccauuuugcaguguaua

SEQ ID NO: 78540 - RNA, 64 nt, Human
ucuccccagcggaaagugaccagaagaggugugcaguuuccaggccuggcccauacagaccucc

SEQ ID NO: 78541 - RNA, 64 nt, Human
ccugauuggacaaucacaucacagaucacacugcaguuuccauguuagcacuguggauggguuu

SEQ ID NO: 78542 - RNA, 64 nt, Human
auuguucuuacgguuucuagaaacuuuccuuuucaguuuccagaaauacaaguuagauaauugg

SEQ ID NO: 78543 - RNA, 64 nt, Human
caagcaggaagagcagcgcuguguugcagaauggaguuuccauggauuucuaccagaccacuga

SEQ ID NO: 78544 - RNA, 64 nt, Human
aaauguuuaucaguuguuuccaugaaagaauauuaguuuccaguaaauuuuagugauggcucac

SEQ ID NO: 78545 - RNA, 64 nt, Human
uacuuuccuaauuuuucuauauuuuaaaaacuacaguuuccaugauaaaaggaaaacguuuuga

SEQ ID NO: 78546 - RNA, 64 nt, Human
augaaguucaucucaaaauggagaccaugaccagaguuuccagaugauacacguucuuuucagc

SEQ ID NO: 78547 - RNA, 64 nt, Human
aagccuaaccuaaaacugccagcaacacaacuggaguuuccauuuaucauaauuaguuuuucua

SEQ ID NO: 78548 - RNA, 64 nt, Human
caaaauuauaaaagcacuaacucuuugauccaguaguuuccacuucuaggaacuuaaccuucag

SEQ ID NO: 78549 - RNA, 64 nt, Human
gccucugcuauuuccuuugaggaagguagaagugaguuuccauguuugcagaguauuuaaauac

SEQ ID NO: 78550 - RNA, 64 nt, Human
uuuuaagcuucauuagcuugucuauuauugaaauaguuuccaagaaauuuuagauauuaucaua

SEQ ID NO: 78551 - RNA, 64 nt, Human
cuuuagcagacagcguccacaaugugaauccuacaguuuccaggugaggcccuuucuccaguuu

SEQ ID NO: 78552 - RNA, 64 nt, Human
uguuggagaugaauugcuucucaucuuguucuccaguuuccauuguugguuuauugcagauuug

SEQ ID NO: 78553 - RNA, 64 nt, Human
agagaugugcuaaacugaugaaauacauugagaaaguuuccaucuuauucuuuuauaugggacu

SEQ ID NO: 78554 - RNA, 64 nt, Human
uuuggauauuaaaccaacuuugcauuccuggggcaguuuccauuugauuaugguauauaaaccu

SEQ ID NO: 78555 - RNA, 64 nt, Human
uuuugugcucugggcccuuucucuuuuuccagccaguuuccauucacuugccuuacagccugcc

SEQ ID NO: 78556 - RNA, 64 nt, Human
ugauaauaggcagacuauucccaacuuucugucuaguuuccagccauugaagugaacugcuaaa

SEQ ID NO: 78557 - RNA, 64 nt, Human
auauaacacuauuuuauuucagucauguuaguucaguuuccacaguuugaacuggguauagauu

SEQ ID NO: 78558 - RNA, 64 nt, Human
gagccaccuuaagaugagggcugcuucgcaguaaaguuuccagccugggccccucuugggccuu

SEQ ID NO: 78559 - RNA, 64 nt, Human
ccccauuccccagccucugcugguagcaugucgcaguuuccauguguuucaggaucuucgggcu

SEQ ID NO: 78560 - RNA, 64 nt, Human
aguucauggcaucacaucuuucacuggggaagccaguuuccacaggcagcaucccaagguucaa

SEQ ID NO: 78561 - RNA, 64 nt, Human
auuuuacauuuuucauggagucccugcuuagugcaguuuccauuggaauggguggaagaugaua

SEQ ID NO: 78562 - RNA, 64 nt, Human
ggccaagaguauuuucaaaaaagucuaaagguguaguuuccacuguaacuguugaguacuguua

SEQ ID NO: 78563 - RNA, 64 nt, Human
uguuccuccuccucucuccccacuugaaccaugaaguuuccaauaauuuuuuuuucuuuuuuuc

SEQ ID NO: 78564 - RNA, 64 nt, Human
ggggaggccagaagcucugugccuggucuguaacaguuuccaggccagcuggagaauguucacu

SEQ ID NO: 78565 - RNA, 64 nt, Human
cucuccaccugggccaggguugccucagaggccaaguuuccagaagccucuuaccugccguaaa

SEQ ID NO: 78566 - RNA, 64 nt, Human
uuccuaauaacagugaugacugagaaucuauuugaguuuccagcuggcagaauuaauuguuauu

SEQ ID NO: 78567 - RNA, 64 nt, Human
gccacugccuuucccaagaaucccuuguuguggaaguuuccagugcuggaaaagcagcgagcca

SEQ ID NO: 78568 - RNA, 64 nt, Human
gugagaacuccugacgucugaagcuugacucccaaguuuccauagcaacaggaaaaaaaaaaau

SEQ ID NO: 78569 - RNA, 64 nt, Human
gggacacucccuaucugguuggaagagaguaaccaguuuccagagagccagagagugagagaga

SEQ ID NO: 78570 - RNA, 64 nt, Human
cgugcuuccugucacaugggcuguaaucauuuguaguuuccaaagacacgucugcauuugaauu

SEQ ID NO: 78571 - RNA, 64 nt, Human
caggacguggucuccagcuucuucauccugccagaguuuccaaauggagcccggggcucugcag

SEQ ID NO: 78572 - RNA, 64 nt, Human
uuauuuaagucauuucugugauucuaucauguacaguuuccagaauugucacugugcauucaaa

SEQ ID NO: 78573 - RNA, 64 nt, Human
gaacaugggaagggcucacuauuggaaucccaugaguuuccauuuugucucuacccaaacguau

SEQ ID NO: 78574 - RNA, 64 nt, Human
cgagcugugguggcggcugguuuaaaagggauccaguuuccagcugcagguuuguuagagucug

SEQ ID NO: 78575 - RNA, 64 nt, Human
uuccuaguaucaggagcaauugagaccccucaggaguuuccacacugcuguggacgggauagcc

SEQ ID NO: 78576 - RNA, 64 nt, Human
caugcaggggccacauccaaaaaggggagagggaaguuuccagaaagaagagaggacacaucuc

SEQ ID NO: 78577 - RNA, 64 nt, Human
uauccuacguccuucucuccaucuaucggaccccaguuuccaucacuaucuccagagauguagc

SEQ ID NO: 78578 - RNA, 64 nt, Human
ugacugguccugucuuuugagucugggaaauacuaguuuccauuccuggaugcuuccugugccc

SEQ ID NO: 78579 - RNA, 64 nt, Human
uuugugacuuaaaaguuuggggguuuucuuugaaaguuuccagcccuauucagaaagcaacucu

SEQ ID NO: 78580 - RNA, 64 nt, Human
gucuucuguuggaagaaggaaccugccuuagcucaguuuccaggugguuccucugccuggcacc

SEQ ID NO: 78581 - RNA, 64 nt, Human
ucuucuagaaaugucuguugagauuucccccuuuaguuuccaaccuucuccccaacccuuggag

SEQ ID NO: 78582 - RNA, 64 nt, Human
cccuguccccugaaaaacugaucaaaaauaaacuaguuuccaguggaucaauggacugugucag

SEQ ID NO: 78583 - RNA, 64 nt, Human
uuuuggugugguuugucagaggcuaauucugcagaguuuccaaaaccagaagacaucguaugcu

SEQ ID NO: 78584 - RNA, 64 nt, Human
aaggcagggucagggcccacugagacccaugcagaguuuccaggugugcacuggaagugagguc

SEQ ID NO: 78585 - RNA, 64 nt, Human
gcgagagaucagguccgaaaugcugcauugcugcaguuuccaccacucuuauacaggaaaacug

SEQ ID NO: 78586 - RNA, 64 nt, Human
aggagcuuuucagaauagcgucugcagcagaaccaguuuccauucagagcgcguccuuggugga

SEQ ID NO: 78587 - RNA, 64 nt, Human
uguggugacauaaacuagacauggggugcccucaaguuuccaaggggaccaaugugccacuguu

SEQ ID NO: 78588 - RNA, 64 nt, Human
uggacacacccaggaaggcuuuugaagucaagccaguuuccagaagggcuggggugagauccug

SEQ ID NO: 78589 - RNA, 64 nt, Human
ggcuccucuuagcucagcugagcauggagacagcaguuuccagagaguggagagagcagggcua

SEQ ID NO: 78590 - RNA, 64 nt, Human
ggauggacccucagccccaugguacgcccugcccaguuuccaguugcccuguccacuuacccua

SEQ ID NO: 78591 - RNA, 64 nt, Human
ccgcaguuccucaguuguuguuuugacauauuucaguuuccaccucacguuuuuagagcagaac

SEQ ID NO: 78592 - RNA, 64 nt, Human
uuggcaaacauuuggccaugugaggcauguggucaguuuccauuuucuauuaccuggaaagggc

SEQ ID NO: 78593 - RNA, 64 nt, Human
uaagcaugucagaugaaaagcaauuaggauuaaaaguuuccauuuaauuucccuuaaacccuug

SEQ ID NO: 78594 - RNA, 64 nt, Human
uuuuaaaauagaaaacaaaacugacuucuguagaaguuuccagagggaggugcuguuaucucgu

SEQ ID NO: 78595 - RNA, 64 nt, Human
cgcuguaagcuccuuuguggagugcuggguaagcaguuuccaauaaacgcaagcugagcugggc

SEQ ID NO: 78596 - RNA, 64 nt, Human
ggcaugggcgaggauuuuucaauuuauuuuuuaaaguuuccauacccuuucuuugucuuucuug

SEQ ID NO: 78597 - RNA, 64 nt, Human
gaggcacgccugccuucuccccuccaagugaaugaguuuccagcuaagccugaugauggaaggg

SEQ ID NO: 78598 - RNA, 64 nt, Human
acaccaguacacaagccauucuaaauacuuagccaguuuccagccuuccagaugaucuuugccc

SEQ ID NO: 78599 - RNA, 64 nt, Human
ugagcuccucaccuggacagucuccuggacaaggaguuuccagcugcuggcuggagucucaggc

SEQ ID NO: 78600 - RNA, 64 nt, Human
ggaggugagcacauuuacagauauuuugcuucauaguuuccaugcccucugcccagcucaguuu

SEQ ID NO: 78601 - RNA, 64 nt, Human
ugaacauguauuuugaauauucuguaacagggcaaguuuccacucuaagcagcuauuuaaaaau

SEQ ID NO: 78602 - RNA, 64 nt, Human
caccuaauuuauauuguauuuuaacuacaguguaaguuuccauuaacaaaaccauccuaaagcg

SEQ ID NO: 78603 - RNA, 64 nt, Human
ccuaacauucaauuuuagguccuacuacauuguuaguuuccauaauucuacaagaauguuuccu

SEQ ID NO: 78604 - RNA, 64 nt, Human
uaggguccaccaggaguucucccaccaccucaccaguuuccaggugguaagcaccaggacgccc

SEQ ID NO: 78605 - RNA, 64 nt, Human
auaaaaacugcacaaaaggggagugagagagacuaguuuccacauccuucccuccuuuagugaa

SEQ ID NO: 78606 - RNA, 64 nt, Human
uccaccccccaggucuuccaagcucugcuuccucaguuuccaaaauggaaccaccucaccuccg

SEQ ID NO: 78607 - RNA, 64 nt, Human
auucgguuuguauguaauggaagcacggggcuagaguuuccacauaggccccaacauaaaggcc

SEQ ID NO: 78608 - RNA, 64 nt, Human
augucugggauagacuggucuagaauaaaaaugaaguuuccauugcuuuguuugcuuuaaaaau

SEQ ID NO: 78609 - RNA, 64 nt, Human
ggucacagauugguuuaugccacugacuugguuaaguuuccacccccuccaauuugugaaaaac

SEQ ID NO: 78610 - RNA, 64 nt, Human
aacacucccaaagauacccacaggaaguccagccaguuuccagguagaggauuccaccaguugg

SEQ ID NO: 78611 - RNA, 64 nt, Human
gcauguacauuguauuuauaaagauuauauauguaguuuccaaggaagaaacaaagaccuauac

SEQ ID NO: 78612 - RNA, 64 nt, Human
uuuuuggugacugcugcauucaucagcaaugaacaguuuccacuguauaguccuaggggucagg

SEQ ID NO: 78613 - RNA, 64 nt, Human
augugugauaaaagauagaguauccuuaugguugaguuuccauauaaguggaccagacacagaa

SEQ ID NO: 78614 - RNA, 64 nt, Human
guggaccaaaacacugcacacagugaaguguuccaguuuccacugggcaguugagguggcuucu

SEQ ID NO: 78615 - RNA, 64 nt, Human
uaccaccccccuccacacuucacgucagcuacauaguuuccacaggguaauucacuaagagcuu

SEQ ID NO: 78616 - RNA, 64 nt, Human
uaaguaaguauaccuaacaugcuguggaaucuugaguuuccaacaccgugcugcuugauagaau

SEQ ID NO: 78617 - RNA, 64 nt, Human
caagccaugaguggugaggacacagucuccuuacaguuuccauugccaacaacagccauccaua

SEQ ID NO: 78618 - RNA, 64 nt, Human
gacgaccaccauauucacugaggucuaaauuugcaguuuccacuaaugacauuuugauuuccca

SEQ ID NO: 78619 - RNA, 64 nt, Human
guggcuccuuuggcuuugggcagccuggcuguggaguuuccacggcgacacacagccucagugg

SEQ ID NO: 78620 - RNA, 64 nt, Human
uuuauuccuuguaauuaagucacaggcaggacccaguuuccagagagcaggcggggccgcccag

SEQ ID NO: 78621 - RNA, 64 nt, Human
agccguggaugggggcggagcugggguuuggugcaguuuccagggugcaguacagcagggccug

SEQ ID NO: 78622 - RNA, 64 nt, Human
uuuuacaggcuuuccgauuuuacaggccuuuccaaguuuccauucuccuuagagagagaacugu

SEQ ID NO: 78623 - RNA, 64 nt, Human
cgccacccuugccauccugcaacagcuggacucaaguuuccaggaaguggagauguguuucuag

SEQ ID NO: 78624 - RNA, 64 nt, Human
cccaguggaagggguuagagaccaaguaggggccaguuuccaauucacccugucagggagugag

SEQ ID NO: 78625 - RNA, 64 nt, Human
guccucccucuucauacuguuacauuggggaucaaguuuccaauaugugaauacagggaagcac

SEQ ID NO: 78626 - RNA, 64 nt, Human
agguagagucacucuuagugauguccaguuguccaguuuccaauagaagugggagauccagauu

SEQ ID NO: 78627 - RNA, 64 nt, Human
gagaagugagaagacucccagaaucugccuuuuaaguuuccaucaguguccucgggucagacug

SEQ ID NO: 78628 - RNA, 64 nt, Human
acagauggugggucagauuugacucacugcccauaguuuccagaccaugauguucagguucaug

SEQ ID NO: 78629 - RNA, 64 nt, Human
gaaauaaaauugauucuucauguggagaggacauaguuuccaggcugcaaugcugaaucuugcu

SEQ ID NO: 78630 - RNA, 64 nt, Human
cacgaaucuuuuucagcaucauuauacuuucaccaguuuccacgucuguuuuauuaccaaguaa

SEQ ID NO: 78631 - RNA, 64 nt, Human
gggccaggggaguggagagagcuccugaugucuuaguuuccacaguaagguuugccuguguaca

SEQ ID NO: 78632 - RNA, 64 nt, Human
aaaacauuuuuaaaauagcaaauguuaauauuccaguuuccauugguaggaaauuuuuuaggua

SEQ ID NO: 78633 - RNA, 64 nt, Human
gguugauagcuaccaaugggacaguguagaaacaaguuuccaccuuucuaaaaccaguuuggua

SEQ ID NO: 78634 - RNA, 64 nt, Human
ccaguccgccaaacacuccacccccuccagcuccaguuuccaaguuccugcacuccagaaucca

SEQ ID NO: 78635 - RNA, 64 nt, Human
gggacuacugaccaugugccucccacugaauggcaguuuccaggaccuccauuccacucaucuc

SEQ ID NO: 78636 - RNA, 64 nt, Human
gagagaaaccuuagaaaugugaagcaugugacaaaguuuccauuuggaaaucacaccuuaaaga

SEQ ID NO: 78637 - RNA, 64 nt, Human
gaacaugauuggaaugaagagcccuguaguagggaguuuccaccuuguacguaagcaaacacug

SEQ ID NO: 78638 - RNA, 64 nt, Human
gugguguuaagccagaauuugaccucccagagccaguuuccauuagcugccaugcucugcugcc

SEQ ID NO: 78639 - RNA, 64 nt, Human
uuuuuucucauuugauuuugcuugugcagaaaauaguuuccagcacauggauugaucugagaga

SEQ ID NO: 78640 - RNA, 64 nt, Human
gguccauagcacaguacaugcagcaucuaauaagaguuuccauuguagaauguuuucacauacu

SEQ ID NO: 78641 - RNA, 64 nt, Human
uggaugaagaauagcucugcaggacgaaugccuuaguuuccacuuuccagccuggauccccuca

SEQ ID NO: 78642 - RNA, 64 nt, Human
ggaugugaauguccuugcaggccgguuagucuccaguuuccacagagaccaccuacccaccacc

SEQ ID NO: 78643 - RNA, 64 nt, Human
cgucuguguuccgguggaggagcuguggaaccugaguuuccagaaccccaacccuagagagcau

SEQ ID NO: 78644 - RNA, 64 nt, Human
acugccccuccaucucaauccucuucucuucaccaguuuccaggacucaucugcaacauuugca

SEQ ID NO: 78645 - RNA, 64 nt, Human
ccucccucccccuaccucacacgcugcucaugaaaguuuccacccacgcugucuccacggaaca

SEQ ID NO: 78646 - RNA, 64 nt, Human
ugucuuucuucuuuuuugaagguacauacuucacaguuuccaucuuguauuuaccuaaauuugg

SEQ ID NO: 78647 - RNA, 64 nt, Human
aguuggaugaacccauuccacuguaugaggcaaaaguuuccauggaagcuguucagaaaaauca

SEQ ID NO: 78648 - RNA, 64 nt, Human
cugucagcuuucucaaacugugaagaugacccaaaguuuccaacuccuuuacaguauuaccggg

SEQ ID NO: 78649 - RNA, 64 nt, Human
cauacaugacggugggcagagaggccugucuuaaaguuuccauggaauuguuuuauaaaauauc

SEQ ID NO: 78650 - RNA, 64 nt, Human
aaccauaaagcuuggagugccuuaauuuuuaaccaguuuccaauaaaacgguuuacuaccugcg

SEQ ID NO: 78651 - RNA, 64 nt, Human
ugguucaucccggcccauguugagccaugaguggaguuuccaacagagggaggaaugugugccu

SEQ ID NO: 78652 - RNA, 64 nt, Human
uucacucagaguggggccacacacccaucuacccaguuuccacaagauguggcuccugccacac

SEQ ID NO: 78653 - RNA, 64 nt, Human
ccucggcugccucaggggagagugcuuuuccuguaguuuccaaggaauauucuuuguuuagagg

SEQ ID NO: 78654 - RNA, 64 nt, Human
gcuuuugcucaguaacugugucaugaauugcaagaguuuccacaaacacuagcaaauguguaga

SEQ ID NO: 78655 - RNA, 64 nt, Human
ucagagaacuugggcauaggaacaaucuggcagaaguuuccagaaggaggucacuuggcauuca

SEQ ID NO: 78656 - RNA, 64 nt, Human
uaacuacaccugacaccaggcucugcuggaugugaguuuccacugcaugggcugugggcugggc

SEQ ID NO: 78657 - RNA, 64 nt, Human
ggguaaacagaaagugguuuagacauucuugauuaguuuccauauuuuaaguagcugcagucuu

SEQ ID NO: 78658 - RNA, 64 nt, Human
guauuuuaucugucugauguugcaguauucuacaaguuuccagaaagagaauagccauauaaau

SEQ ID NO: 78659 - RNA, 64 nt, Human
ggcccugcagagauccccugagccaagccgaggcaguuuccacauaagccacauucaaugguau

SEQ ID NO: 78660 - RNA, 64 nt, Human
ucaugcacacaggagaaaaugcaauuugauaaucaguuuccacuacauucggaggucaagaaag

SEQ ID NO: 78661 - RNA, 64 nt, Human
uguucaauaaugacggacgcauugguugagaugaaguuuccaguaaggaagugacagugcaaug

SEQ ID NO: 78662 - RNA, 64 nt, Human
caaagccuuuccucagccuucacccaaccuuuccaguuuccacuggccccacauuccucaacua

SEQ ID NO: 78663 - RNA, 51 nt, Human
aaagcaauuaugaugucuaaaaguuuccagugauuuauuaccacauuauaa

SEQ ID NO: 78664 - RNA, 64 nt, Human
cacuuuuaccgaacucgggauuacagaaacacggaguuuccauuuggauuuuaaacaaaauuua

SEQ ID NO: 78665 - RNA, 64 nt, Human
uaauguacucuugcuuugucaagcuguuugcuauaguuuccaagguauuauguuacucuaacuc

SEQ ID NO: 78666 - RNA, 64 nt, Human
uugcaugugucucagggucuucaguuuuucuauaaguuuccauauccaaaguucagaauucaug

SEQ ID NO: 78667 - RNA, 64 nt, Human
uuuuucuauuacaguauaaauuccuuacagugucaguuuccaucugggaagacucuccuuucuu

SEQ ID NO: 78668 - RNA, 64 nt, Human
auuagaaaccauuggcuaaaaauguguuuuguugaguuuccaaauggaugaauuuucauuugga

SEQ ID NO: 78669 - RNA, 64 nt, Human
uugggccagugcaccuuccggggccccaucccuuaguuuccacugccuccugugacgugaggcc

SEQ ID NO: 78670 - RNA, 64 nt, Human
aaaauguggauugaaguauagauuccaguagccuaguuuccacagcacgauaacaccaugacgc

SEQ ID NO: 78671 - RNA, 64 nt, Human
aaccugcgcugugauuuuagccuccugagauuggaguuuccaucccauguugguuugucccagu

SEQ ID NO: 78672 - RNA, 64 nt, Human
gggaggccucauuggccacuuagagcgcagccugaguuuccaggccccuuccugggagaggcug

SEQ ID NO: 78673 - RNA, 64 nt, Human
uuugaaugcagaagggagcagcuccuccuaguuaaguuuccacuaaaucaucgccaaagaggac

SEQ ID NO: 78674 - RNA, 64 nt, Human
ugucuggagagaagcugugguguguaugcuguagaguuuccacauuucacaugcaguguacucc

SEQ ID NO: 78675 - RNA, 64 nt, Human
gauugcaguauucauuaucugcaucuaauuugguaguuuccacaaucguauuugaugaaagaaa

SEQ ID NO: 78676 - RNA, 64 nt, Human
gugucccuuaccuggcuuagcguucuguuucaccaguuuccaaguuuauugcccucaaaaucuu

SEQ ID NO: 78677 - RNA, 64 nt, Human
cuguccccauggagcugguggcugacaaagauguaguuuccaucagucaauaaaaccugagagg

SEQ ID NO: 78678 - RNA, 64 nt, Human
uuugaugccagagccaacaggcuauaucauaggcaguuuccaaacuuaauuaugccauuuaguu

SEQ ID NO: 78679 - RNA, 64 nt, Human
gaaacuugugcaaguuacuucaccucugagccuaaguuuccacaucuguaaaaggagauaauaa

SEQ ID NO: 78680 - RNA, 64 nt, Human
cauaggccugggugcuggcugcccagaccccucuggccaggauggaggggugguccugacucaa

SEQ ID NO: 78681 - RNA, 64 nt, Human
ggcuuuucaaaaucauuuagucuaacaacugcccaguuuccagucgggggaacugaggcagagc

SEQ ID NO: 78682 - RNA, 64 nt, Human
ucuuuucugaggcagcaguaagaaauugguucacaguuuccaacuuguaaguugaguagugcua

SEQ ID NO: 78683 - RNA, 64 nt, Human
uggcuuuuaaauuuaacuuuucuaguuuuuaagcaguuuccaccuugcuuuggucuaaugcuuu

SEQ ID NO: 78684 - RNA, 64 nt, Human
acccucucacaccagagacaguucuucucuguucaguuuccaauccccgauaauuugcuaaaau

SEQ ID NO: 78685 - RNA, 64 nt, Human
cuuuccauaucaagagacaugguauugacucaacaguuuccagucauggccaaauguucaauau

SEQ ID NO: 78686 - RNA, 64 nt, Human
cugggccagugcaccuuccaaggccccauccauuaguuuccacugccucgugugauaugaggcc

SEQ ID NO: 78687 - RNA, 64 nt, Human
cugggccagugcaccuuccggggccgcaucccuuaguuuccacugccuccugugacgugaggcc

SEQ ID NO: 78688 - RNA, 64 nt, Human
uaacugcaucagcaaauuggaauggcuggcuugaaguuuccauuauuuucuugaagagagguga

SEQ ID NO: 78689 - RNA, 64 nt, Human
uccacuuagccuacuacagggcuaugcacaucuuaguuuccaaaagucugcuuaauuucaaaag

SEQ ID NO: 78690 - RNA, 59 nt, Human
aucgcucuagcucagaaguugcagagcagccugggcaacauggugaaacccgucucuac

SEQ ID NO: 78691 - RNA, 59 nt, Human
ccugggauauguaugccucgcccgcccucccugggcacaugugcacacgugcccaggca

SEQ ID NO: 78692 - RNA, 59 nt, Human
ugagccaagguugugccacugcacuccagccugggcaaaaaagcaaaacuccaucucaa

SEQ ID NO: 78693 - RNA, 59 nt, Human
acugccgagaacagcauuggucccagagcccugggcaucagaccuuaaccaccaggccc

SEQ ID NO: 78694 - RNA, 59 nt, Human
caggcaggccaccauauucagugcuguggccugggcaagauaacgcacuucuaacuaga

SEQ ID NO: 78695 - RNA, 59 nt, Human
ucagaaauccacauaaaagugcucuccugccugggcagcaacaaccaagaacaaagccc

SEQ ID NO: 78696 - RNA, 59 nt, Human
ugcagugagauugcaccauugcauuccagccugggcaacaagagggaaacuccgucuca

SEQ ID NO: 78697 - RNA, 59 nt, Human
ugaguugagauuggaccacugcucuccagccugggcaacagaguaaaacucugucccaa

SEQ ID NO: 78698 - RNA, 64 nt, Human
aauucucuaugacacagcuuuaaccuucuucucuggccaggacagucgcaaucuuuguuuuaag

SEQ ID NO: 78699 - RNA, 59 nt, Human
ucccucagcggagggguuugggagucaggccugggcaggacccugcugacucguggcgc

SEQ ID NO: 78700 - RNA, 59 nt, Human
gguccccuugcugcugugggcucccugucccugggcaggagugcuggugaggaggugga

SEQ ID NO: 78701 - RNA, 59 nt, Human
auguccaaacacccagggcugcugcucauccugggcaagcugauccugcugcaccacaa

SEQ ID NO: 78702 - RNA, 59 nt, Human
gcacccacagccucagcuccugugcaguuccugggcagcacaguggaagugggagccug

SEQ ID NO: 78703 - RNA, 59 nt, Human
cagccccugcuacuggcuggacccucugcccugggcaggaggucaggggauucuguuuu

SEQ ID NO: 78704 - RNA, 59 nt, Human
uacgucugagcccaagaguucaagaucagccugggcaguauagcaagaccccaucucca

SEQ ID NO: 78705 - RNA, 59 nt, Human
gugccuggcucgcaccucucgagcugugcccugggcaucacugagcagaggggugcggc

SEQ ID NO: 78706 - RNA, 59 nt, Human
cccaugcuuuguaggugucucauagcuauccugggcauccuucuuucuaguucagcugc

SEQ ID NO: 78707 - RNA, 59 nt, Human
gccacaccaaucagagagccuagaacaucccugggcaaguggauggcccagcaggcagg

SEQ ID NO: 78708 - RNA, 59 nt, Human
uuucagaacccacuuuggggggccuccugccugggcaggcucuucaaguguggcccucu

SEQ ID NO: 78709 - RNA, 59 nt, Human
cugggggaugagagaaaggcauuuuauagccugggcauaagugaaaucagcagagccuc

SEQ ID NO: 78710 - RNA, 59 nt, Human
gcacaggaguuugaggcugcagugagcagccugggcaagagagugagacuccguuuugu

SEQ ID NO: 78711 - RNA, 59 nt, Human
gggucccagauggcucaggcugugaccucccugggcaccacccuccccaggcugggugu

SEQ ID NO: 78712 - RNA, 59 nt, Human
ugagcugagauugugccacugcacuccagccugggcaacaagagcaaaacucugucugg

SEQ ID NO: 78713 - RNA, 59 nt, Human
caauggaggccccuggcauaggggacagcccugggcaucuuccuuuggugucuggcugu

SEQ ID NO: 78714 - RNA, 59 nt, Human
auuuuucuguauauagaaaggaaaacuagccugggcaacaugaugaaaccccaucucca

SEQ ID NO: 78715 - RNA, 59 nt, Human
ggaacaaaaccagcuugcuuuguugcacgccugggcaauuucagccaggacauuaggac

SEQ ID NO: 78716 - RNA, 59 nt, Human
ggcuggccccucuagccuuuccgguccuuccugggcaaaucuaagccuuggccagggcc

SEQ ID NO: 78717 - RNA, 59 nt, Human
cauguaucccucggucugaauuagacauuccugggcacaggcucuugggugcauugcuc

SEQ ID NO: 78718 - RNA, 59 nt, Human
auggcuugaagccaguaguucaagaccagccugggcaacauaguaagaccccaucucua

SEQ ID NO: 78719 - RNA, 59 nt, Human
ugagcugugauugugccacuguuuuccagccugggcaauacagugagacccugucucaa

SEQ ID NO: 78720 - RNA, 59 nt, Human
auugcuugaguccaggaguuugagaugcgccugggcaacauagaaaccugugucuacaa

SEQ ID NO: 78721 - RNA, 59 nt, Human
ugagcugagaucgcaccauuacacuccagccugggcaacagagccagacucugucucaa

SEQ ID NO: 78722 - RNA, 59 nt, Human
aucacuugaguccagaaguuugagaucagccugggcaaugugauaaaaccccaucucua

SEQ ID NO: 78723 - RNA, 59 nt, Human
gggaauccuguccugccucgaaggagcagccugggcagccaucacaccacgaggacagg

SEQ ID NO: 78724 - RNA, 59 nt, Human
uccaaggaccuucccucuucuccccaguuccugggcaaucacuucaccuuggacaaagg

SEQ ID NO: 78725 - RNA, 59 nt, Human
cuuauaccuuggcauggagucccaaaggcccugggcacaggcagagagcccaccggcug

SEQ ID NO: 78726 - RNA, 59 nt, Human
gcaacuccuauuaguaucgccugguugggccugggcaaugggaaggagccagaaaugcc

SEQ ID NO: 78727 - RNA, 59 nt, Human
ugagccgagagugcaccauugcacuccagccugggcaaaaagagcaaaacuccgucuaa

SEQ ID NO: 78728 - RNA, 59 nt, Human
gcuggugccugccaccuucaaguucuggaccugggcaugacauccuuucuuuuaaugau

SEQ ID NO: 78729 - RNA, 59 nt, Human
gugaggaagcaccucugugucagggcucaccugggcauccaaagcggccacgcccacaa

SEQ ID NO: 78730 - RNA, 59 nt, Human
uucaaaccacaggagaaacucaaauuguuccugggcaaaucacaacauggggaauuuua

SEQ ID NO: 78731 - RNA, 59 nt, Human
ccacgugggagccuggaucccuggacuguccugggcauagguuucaggggccuccuuug

SEQ ID NO: 78732 - RNA, 59 nt, Human
gggcacccaguccagaaggagcaauggcaccugggcagugccagggcuuaaagcccgcu

SEQ ID NO: 78733 - RNA, 59 nt, Human
uaucuuuucuuuuauuuuucuaaugagguccugggcagagagugaaaaggccucuccug

SEQ ID NO: 78734 - RNA, 59 nt, Human
auugccugagcucaggaguucgaaaccacccugggcaacauggugaaacccccgucucu

SEQ ID NO: 78735 - RNA, 59 nt, Human
uuuuaaacuuuuaaguccugcucuauuuuccugggcagguuuauguugauguuuaccca

SEQ ID NO: 78736 - RNA, 59 nt, Human
ugggccaccgcccagcucauguaggugagccugggcagcuucuguuggcagagcuuuug

SEQ ID NO: 78737 - RNA, 59 nt, Human
ucccuacugcucauaugcacgcuggcuccccugggcacgcaaggaugaguaugggccau

SEQ ID NO: 78738 - RNA, 59 nt, Human
ugacccaagauugugccacugcacuccacccugggcaacagagcaagaccccaucucaa

SEQ ID NO: 78739 - RNA, 59 nt, Human
ucaucacugaccuggugguggggcugugaccugggcagcucaagacuggugccccuugc

SEQ ID NO: 78740 - RNA, 59 nt, Human
cugagcuucaugguggagaagggccccacccugggcaguauagagacgucggacuucac

SEQ ID NO: 78741 - RNA, 59 nt, Human
agccggccuggcuugaaguccgccaugacccugggcacaggggaagcccagccgugggc

SEQ ID NO: 78742 - RNA, 59 nt, Human
gaggagcuucccgcagccgccuggcccagccugggcacguucuccgaggcaugugucuc

SEQ ID NO: 78743 - RNA, 59 nt, Human
acacugacuucaggauagaugcugggaugccugggcauggccacauguuacauguacag

SEQ ID NO: 78744 - RNA, 59 nt, Human
ugaggagucccacugcuucuaaaggaaguccugggcaggagguggcuuuggugguuggu

SEQ ID NO: 78745 - RNA, 59 nt, Human
uuuccacacuccuccuccgacagcagcucccugggcaguggccuggucucaccgugugc

SEQ ID NO: 78746 - RNA, 59 nt, Human
ugagcugagauugcgccacugcacuccagccugggcaacagagcgagacuccgucucaa

SEQ ID NO: 78747 - RNA, 59 nt, Human
aggagccacggaguuugggggccacagcaccugggcacacacccgagcaccuguccauu

SEQ ID NO: 78748 - RNA, 59 nt, Human
ugagcccagaucgcgacacugcacuccagccugggcaacagagugacacucugucucaa

SEQ ID NO: 78749 - RNA, 59 nt, Human
ugagcugagaucacgccauugcacuccagccugggcaacaguguuaagacucugucuca

SEQ ID NO: 78750 - RNA, 59 nt, Human
ucccuguuccccagagagcccaccuccgcccugggcaggagccccucggaggcuguaua

SEQ ID NO: 78751 - RNA, 59 nt, Human
gccggcuguggagcaaaaggcagcucaccccugggcaggcgguccccauccccaccagc

SEQ ID NO: 78752 - RNA, 59 nt, Human
ugagccaaaaucacgccacugcacuccagccugggcaacagagugagacuccgucucaa

SEQ ID NO: 78753 - RNA, 59 nt, Human
uucuccaucuauccaggcuccaggagaccccugggcaucucccaccuguggccccuaaa

SEQ ID NO: 78754 - RNA, 59 nt, Human
ugagccaagauggcaccauugcacucuagccugggcagcagagcgagacccugucucaa

SEQ ID NO: 78755 - RNA, 59 nt, Human
auggcuugaguccaggaguucaagacuagccugggcaauguggcaaaaccgcguguuua

SEQ ID NO: 78756 - RNA, 59 nt, Human
gugggccauuagauuuggaggcuaccucaccugggcagggaugauggcagagccaggcu

SEQ ID NO: 78757 - RNA, 59 nt, Human
uauaauuaacaaaccuguguaugcuuaugccugggcaacuauuuuuuguaacucuugug

SEQ ID NO: 78758 - RNA, 59 nt, Human
gggcuggcccugcucagacaaaucugcucccugggcaucuuuggccaggcuucugcccu

SEQ ID NO: 78759 - RNA, 59 nt, Human
gugcgugcagucuggcagccuuaagcccaccugggcacuuuuagauaaaaaaaaaaaaa

SEQ ID NO: 78760 - RNA, 59 nt, Human
agagaaaaauguaagauaggaaguacuagccugggcaacguggcgaaacccugucucua

SEQ ID NO: 78761 - RNA, 59 nt, Human
aagguuucagugaacugagaucacuccaaccugggcaauaaagccagacucugucucaa

SEQ ID NO: 78762 - RNA, 59 nt, Human
gggggugcugggccuguuguuuuccuuugccugggcauucuccucauguuucccaccug

SEQ ID NO: 78763 - RNA, 59 nt, Human
cucauggugagggauacccaucccauaugccugggcagaaggaagacuucaucccucug

SEQ ID NO: 78764 - RNA, 59 nt, Human
acugcuugagcccaggaguucagaaucagccugggcaacauagcaauacuccgucucau

SEQ ID NO: 78765 - RNA, 59 nt, Human
accccaucuguacuaaaaauacaagauuaccugggcaugguggugcaugccuauaaucc

SEQ ID NO: 78766 - RNA, 59 nt, Human
caccgugccgaaggagcucugccagugggccugggcaggcagccacagagggcauguua

SEQ ID NO: 78767 - RNA, 59 nt, Human
auggcuugaacucaggaguucgagacuagccugggcaacgugaugagacuccgucucua

SEQ ID NO: 78768 - RNA, 59 nt, Human
ccauguguucucuuaaacugagaauugcaccugggcaauuccuguuuucuaaggugguc

SEQ ID NO: 78769 - RNA, 59 nt, Human
ugcgccuguuaccacggaugcccacagggccugggcaguugcuguggcgacaggaagag

SEQ ID NO: 78770 - RNA, 59 nt, Human
gcagacugagcucaggagcuugagaccagccugggcaacauggcaaaaacccaccucua

SEQ ID NO: 78771 - RNA, 59 nt, Human
cacugaggccuuucagagcucaguagaauccugggcaacuaccuaugguucaaaaaaua

SEQ ID NO: 78772 - RNA, 59 nt, Human
aucacuugaggccaggaguuugagaccagccugggcaacauagugagaucccaucucaa

SEQ ID NO: 78773 - RNA, 59 nt, Human
aucaguugaggccaggaguuuaagaccagccugggcaacauagugagaccccugucucc

SEQ ID NO: 78774 - RNA, 59 nt, Human
gaaggugcugggacucuggugcccccaacccugggcauccucaggcuuugaggagaaua

SEQ ID NO: 78775 - RNA, 59 nt, Human
ugcccaugacaccugcaaaauaaguucugccugggcauuuuguagauauuaacagguga

SEQ ID NO: 78776 - RNA, 59 nt, Human
ugagccaagaucaugccacaucacuccaaccugggcaacagaacaagaacccaucucaa

SEQ ID NO: 78777 - RNA, 59 nt, Human
gcagauacucaaggaggcacugggcucagccugggcauuaaagggacagagucagcuca

SEQ ID NO: 78778 - RNA, 59 nt, Human
ucugcugcugugaucugcacacccuccaaccugggcagggacuggggggaugcagugug

SEQ ID NO: 78779 - RNA, 59 nt, Human
ggcaggcuggggcugccaaccugauccugccugggcaacccuuuccugucccaggcccu

SEQ ID NO: 78780 - RNA, 59 nt, Human
gggaaguuguuuggugaaggaagccccucccugggcauuuucugccuaugcuggaauag

SEQ ID NO: 78781 - RNA, 59 nt, Human
ggccugcacucccccaguucccgggcccuccugggcaccccaggcagcuccuguuugga

SEQ ID NO: 78782 - RNA, 59 nt, Human
ugcaggcuggcaccugcggcagguaccagccugggcacugguggccgccucccuguccc

SEQ ID NO: 78783 - RNA, 59 nt, Human
aagccaagaucacaccacuggcacuccagccugggcaacagagugagacccugucucaa

SEQ ID NO: 78784 - RNA, 59 nt, Human
caucucuauuuaaaaaaugaacaaaauuaccugggcauagugguguauaccuguagucc

SEQ ID NO: 78785 - RNA, 59 nt, Human
agcauuuuuuaaauugaguuugagacuagccugggcaacauagugagaccccaucucua

SEQ ID NO: 78786 - RNA, 59 nt, Human
agggccccccagggccuaucgugggagagccugggcaggaucccaucagaaaggugcug

SEQ ID NO: 78787 - RNA, 59 nt, Human
ugagacuccuccuugugaagggccagggcccugggcaggccuccagcucgguccaggug

SEQ ID NO: 78788 - RNA, 59 nt, Human
uacagucucaguugcuugcucuugugccuccugggcaagggcugaaggaggccacucca

SEQ ID NO: 78789 - RNA, 59 nt, Human
ugagccgagaucacgccacugcacuccagccugggcaacagagcgagacucuaucucaa

SEQ ID NO: 78790 - RNA, 59 nt, Human
ugagcugagaucacaccauugcgcuucagccugggcaacaagagugaaacuccaucucc

SEQ ID NO: 78791 - RNA, 59 nt, Human
aucacuugagcucaggaguuugagaccagccugggcaauaucgugagaccccaucucua

SEQ ID NO: 78792 - RNA, 59 nt, Human
gagccagguuuugcugguuuggggcaugcccugggcaccagagcuuuaacauuugaagc

SEQ ID NO: 78793 - RNA, 59 nt, Human
uccuauaauaaaggggcuucugggaggugccugggcacagaugucuguucagcaggugu

SEQ ID NO: 78794 - RNA, 59 nt, Human
gaggugggcuccccucgugcacuuuauugccugggcaguuuugcuugaucuuuugugac

SEQ ID NO: 78795 - RNA, 59 nt, Human
auuucauaaaaaucccucuuccuccaaagccugggcagaaaugugcugcaaagaguuau

SEQ ID NO: 78796 - RNA, 59 nt, Human
ugagcugagaucgugccacugcacuccagccugggcaacaagagcaaaaaucccucuca

SEQ ID NO: 78797 - RNA, 59 nt, Human
ggaccaggccaccugagccaggccuucuaccugggcagcaccucugccgacgccguccc

SEQ ID NO: 78798 - RNA, 59 nt, Human
ccagauguguuccccccaugggugagaggccugggcaacugccuggugaaugugucuug

SEQ ID NO: 78799 - RNA, 59 nt, Human
uauuaaaaaauuacaaaggccuagaccagccugggcaacauggugaaaccccaucucua

SEQ ID NO: 78800 - RNA, 59 nt, Human
ugaaucaugaucaugccacuguacuccagccugggcaacagagaccaucuuaaaaaaaa

SEQ ID NO: 78801 - RNA, 59 nt, Human
ugagcagagaucgcaccacugcacuccagccugggcaagagugagacugugucucaaaa

SEQ ID NO: 78802 - RNA, 59 nt, Human
uggacacgagccacaagcugcacugugaaccugggcacuccgcgccgaugccaccggcc

SEQ ID NO: 78803 - RNA, 59 nt, Human
uucguccuguaggugcugugguggauggaccugggcagagggcacuucucucucuuacc

SEQ ID NO: 78804 - RNA, 59 nt, Human
aucacuuagguccaggaguucgagacuagccugggcaacauagugagacaccggaucua

SEQ ID NO: 78805 - RNA, 59 nt, Human
ugagccgugauugcaccacugcacuccagccugggcaacagagcaagacccugucuugg

SEQ ID NO: 78806 - RNA, 59 nt, Human
aucacuugagcucaggaauucaaggucagccugggcaacauggcuaaacucugucucua

SEQ ID NO: 78807 - RNA, 59 nt, Human
cucccgcccaccuuccccaguagcccaggccugggcagcaagcgcagccuggaggaaga

SEQ ID NO: 78808 - RNA, 59 nt, Human
augccuuccccugggcccugacauuggagccugggcauccucagguggucaggcguaga

SEQ ID NO: 78809 - RNA, 59 nt, Human
cuaaggccacccagcggcagcgcccguguccugggcacucagcgugcugggcagagcag

SEQ ID NO: 78810 - RNA, 59 nt, Human
ugagccaagaucacgacacugcacuccagccugggcaacggagacucugucucaaaaaa

SEQ ID NO: 78811 - RNA, 59 nt, Human
ugacuagggcaacgugccccccagaacucccugggcagagccagcucgggugaggggug

SEQ ID NO: 78812 - RNA, 59 nt, Human
cugggggagagcuuggggcagcagaggccccugggcagcccagccaggggagccacagc

SEQ ID NO: 78813 - RNA, 59 nt, Human
acugcuugagcucaggaguucgagaccagccugggcaacaaagugagacuccaucucua

SEQ ID NO: 78814 - RNA, 59 nt, Human
gugggagaaaaucugggcacauggggcccccugggcagugcaggacaacaucagcucac

SEQ ID NO: 78815 - RNA, 59 nt, Human
uguccccaacagcugggguggcacucugcccugggcacccaugacccucugcugucucu

SEQ ID NO: 78816 - RNA, 59 nt, Human
uuguaaugaaacucuucaccuuuaggagaccugggcaguccugucaggcagcagcgauu

SEQ ID NO: 78817 - RNA, 59 nt, Human
uaaaacauuuuucaaaauugaaauauuuuccugggcauuaaaaaccuuuacuauuggcu

SEQ ID NO: 78818 - RNA, 59 nt, Human
ugagccaugauggcaccacugcacucuagccugggcaagagaacaagauccugucucaa

SEQ ID NO: 78819 - RNA, 59 nt, Human
ugugccuacgaauagccacugcauaccaaccugggcaauauagcaagaucccaucucuu

SEQ ID NO: 78820 - RNA, 59 nt, Human
caguugcauaauaacugcaaaauuguguaccugggcaaucuguuuuuuaaccaccucug

SEQ ID NO: 78821 - RNA, 59 nt, Human
ugagcugggauuacaccauugcauuccagccugggcaacagagcaagacugucucaaaa

SEQ ID NO: 78822 - RNA, 59 nt, Human
cuucugcuuucuucccuccaagagcaaaaccugggcaaggggacuuacugagugggggu

SEQ ID NO: 78823 - RNA, 59 nt, Human
accgguugggggagccgggcaugugaggcccugggcaaggggauggggcugugggggcg

SEQ ID NO: 78824 - RNA, 59 nt, Human
guggccucugcgccuccugccacugaggcccugggcagaugcugcagcccgcccccuuc

SEQ ID NO: 78825 - RNA, 59 nt, Human
gggccagggaauccagcggcgucuggccuccugggcacugcuugccuggccucgugcuu

SEQ ID NO: 78826 - RNA, 59 nt, Human
ugagcagugcucucggcaucggaccaaagccugggcacacccugccucucuccccagag

SEQ ID NO: 78827 - RNA, 59 nt, Human
auggcgugcacaggacacagcgugggcggccugggcagaagggcggcuggcuguccugg

SEQ ID NO: 78828 - RNA, 59 nt, Human
ugagcgaagaucgagccacugcacuccagccugggcagcugaacaagacuccgucucaa

SEQ ID NO: 78829 - RNA, 59 nt, Human
cauagcuuuccccacagcucagccuggggccugggcagggcucccagccugcaccgccu

SEQ ID NO: 78830 - RNA, 59 nt, Human
auugcuuaagcccaggagcucaagucccaccugggcaacauaguaagaucuugucucuu

SEQ ID NO: 78831 - RNA, 59 nt, Human
gagggccucuccccugcagcaaacguuugccugggcauugaggcauuuccauacaucuu

SEQ ID NO: 78832 - RNA, 59 nt, Human
ccugucuccccagcauccucccugguggcccugggcaggugcacugacacccccaccuu

SEQ ID NO: 78833 - RNA, 59 nt, Human
uuugcuuguccugcucagaugcuggucauccugggcauguccccaguguggacucugga

SEQ ID NO: 78834 - RNA, 59 nt, Human
agaacuuaaggccacaauucacgucucguccugggcauugugauggauugacccuccau

SEQ ID NO: 78835 - RNA, 59 nt, Human
ggcucucaacccaugcgcuaccaaauacgccugggcagccgggacgggccggcgggcac

SEQ ID NO: 78836 - RNA, 59 nt, Human
acacggcuaugaccaaagggagaucccagccugggcaggcugcgcugcugaccacccuc

SEQ ID NO: 78837 - RNA, 59 nt, Human
gcagugagccgagaucgagccacugcacuccugggcaacagagcaagacuucgucucaa

SEQ ID NO: 78838 - RNA, 59 nt, Human
cucucuugagaauaggaguucaagaccagccugggcaacauagcaagauccugucucuc

SEQ ID NO: 78839 - RNA, 59 nt, Human
ugccugcuggcggcucucauggggaagcgccugggcacuggggauugcuuguggcccac

SEQ ID NO: 78840 - RNA, 59 nt, Human
gaucuuugacucuuuugccauuaaacuuaccugggcauucuuguuucaauuccaccugc

SEQ ID NO: 78841 - RNA, 59 nt, Human
agcauacggccaaugucacaacaaucagcccugggcagacacgagcaggagggagagac

SEQ ID NO: 78842 - RNA, 59 nt, Human
aucauuugagcucaggaguuccagaccagccugggcaacauagcaaaaucucaucucua

SEQ ID NO: 78843 - RNA, 59 nt, Human
ugagccaugaucaugccacugcacuccagccugggcaacagagugagacccugucucca

SEQ ID NO: 78844 - RNA, 59 nt, Human
aguucuaaauuuuaauugcaccugaaaaaccugggcaccuaagcaaugagccacagcaa

SEQ ID NO: 78845 - RNA, 59 nt, Human
ugagucgagauugcaccacuacacuccagccugggcaacagagagcgacucucucaaaa

SEQ ID NO: 78846 - RNA, 59 nt, Human
ugagccaacaucacaccauugcacuccagccugggcaacaagaguaaaacucugucuca

SEQ ID NO: 78847 - RNA, 59 nt, Human
gugagucucuucugcaugcaggaguuucuccugggcagcuggucacuccccagagaagc

SEQ ID NO: 78848 - RNA, 59 nt, Human
gcuggaccccugaacuuccucuccucuuaccugggcagaguguugucucuccccaaauu

SEQ ID NO: 78849 - RNA, 59 nt, Human
uuugcuugaggccagagguucaagaccagccugggcaacacagugacaccugacucuac

SEQ ID NO: 78850 - RNA, 59 nt, Human
aaaauuauauuaauagugaguuucaggccccugggcauuuuguaccauguaauuauccu

SEQ ID NO: 78851 - RNA, 59 nt, Human
ugagccaagaucacgccacugcacuccagccugggcaacagagcaagacucugucucaa

SEQ ID NO: 78852 - RNA, 59 nt, Human
ggaagaggggacuuggcacgcaguggcuaccugggcauuuguggucauuucaguuucca

SEQ ID NO: 78853 - RNA, 59 nt, Human
gggcagggcuccagaaagucagcagugugccugggcacccaccccauccucuaccugcc

SEQ ID NO: 78854 - RNA, 59 nt, Human
auugcuugaguccaggaguuugagaccagccugggcaacauggcgagacccuguuucua

SEQ ID NO: 78855 - RNA, 59 nt, Human
augcaugguaguguguuggggguggggguccugggcacuggcugugugaagggaucugg

SEQ ID NO: 78856 - RNA, 59 nt, Human
gcugggggucugcagcagaaagaaaggggccugggcagcagguguggccagucccucug

SEQ ID NO: 78857 - RNA, 59 nt, Human
ugagccaggaucgcgccauugcacuccagccugggcaacaagagcgaaacucuugucug

SEQ ID NO: 78858 - RNA, 56 nt, Human
agaagaaaggagagaaaugaagacauccugggcagcuugggcuggcgggcccugga

SEQ ID NO: 78859 - RNA, 59 nt, Human
caaucccaagagucuggccucccuccagcccugggcagacugaccagcaagguggaccu

SEQ ID NO: 78860 - RNA, 59 nt, Human
gaguugcagcucugcacccuaaaucacacccugggcauugucugggcugcagggcugcc

SEQ ID NO: 78861 - RNA, 59 nt, Human
uagucuguccuggucccuggcaacaggaaccugggcagcuuauccugcccacagguaag

SEQ ID NO: 78862 - RNA, 59 nt, Human
ugagccaagauugcgccguuguacuccagccugggcaacagagcaagacccaucucaaa

SEQ ID NO: 78863 - RNA, 59 nt, Human
uuuuaacacacgcuccagcccuucaucagccugggcagucuuaccaaaauguuuaaagu

SEQ ID NO: 78864 - RNA, 59 nt, Human
guuagucuccauccugcucagauaugacuccugggcaauucacuuaacuucuccauggc

SEQ ID NO: 78865 - RNA, 59 nt, Human
auugcuugagcccaggaguucaagaccagccugggcaacacagcgagaccccaucucuu

SEQ ID NO: 78866 - RNA, 55 nt, Human
ugaagauagccuguguguaguuuaaccugggcaggacacaucucccugcauuuuu

SEQ ID NO: 78867 - RNA, 59 nt, Human
cauuuuuucuacccuuuccuuuguaaguuccugggcaaccuuuuugauuucuuccagaa

SEQ ID NO: 78868 - RNA, 59 nt, Human
uuuuucccucugguggaaaaaaaauuaaaccugggcauuucauggguuuucuuucuuua

SEQ ID NO: 78869 - RNA, 59 nt, Human
cccagcccacugagggggugggcuuacucccugggcagucuugggggccagagcugagg

SEQ ID NO: 78870 - RNA, 59 nt, Human
aucacuugagcucaggaggucaagaucagccugggcaacauggugaaaccuggucucua

SEQ ID NO: 78871 - RNA, 59 nt, Human
gaucacuugagcccaggaguaaagaccagccugggcaacauagugagacuccgucucua

SEQ ID NO: 78872 - RNA, 59 nt, Human
aucacuugagcccagaaguucgagacuagccugggcaacauggagaagcccugucucua

SEQ ID NO: 78873 - RNA, 59 nt, Human
aaugugugaucuugugacaggccugaggcccugggcacagugacgguggccuggccagc

SEQ ID NO: 78874 - RNA, 59 nt, Human
agauggaguuggcagugagccaagauuagccugggcaacagugagugagacucggucuc

SEQ ID NO: 78875 - RNA, 59 nt, Human
gugggaccgguggagcagccccugggcucccugggcaggggaguucugaggcuccugcu

SEQ ID NO: 78876 - RNA, 59 nt, Human
ccccagccccuguaccaccccugcuguugccugggcagggggaagggggggcacggugc

SEQ ID NO: 78877 - RNA, 59 nt, Human
cagaaaacauagccaccauuuuguccaagccugggcauggguggggggccuugucugcu

SEQ ID NO: 78878 - RNA, 59 nt, Human
cuagagucucuguuacugcuugggcuauaccugggcauacuaauaaaguaugguauuga

SEQ ID NO: 78879 - RNA, 59 nt, Human
auugccugaggccaggaguuugacaccagccugggcaacauagugagaccuugucucua

SEQ ID NO: 78880 - RNA, 59 nt, Human
uacuucuaccacccugaacccacugcugcccugggcagugaguggcuuguuuuuucucc

SEQ ID NO: 78881 - RNA, 59 nt, Human
ugagcugagacugcaccauugcauuccagccugggcaacaagagugaaacugcaucuca

SEQ ID NO: 78882 - RNA, 59 nt, Human
gucgcuugaagcugagaguucaagaccaaccugggcaacauagugagacccccaucucu

SEQ ID NO: 78883 - RNA, 59 nt, Human
ugcugccccacuacaggccccacaccugcccugggcaugcccagccccugguggugggg

SEQ ID NO: 78884 - RNA, 59 nt, Human
gauaguugagcccaggaguucgagaccagccugggcaacauggcaagaccuugucucua

SEQ ID NO: 78885 - RNA, 59 nt, Human
gaggacugugugaccugcacaagcccacaccugggcaggcuguuggugucuccuugguc

SEQ ID NO: 78886 - RNA, 59 nt, Human
gacuggaaaggaccacagaccuggccaucccugggcagcagggccagugucaccugcug

SEQ ID NO: 78887 - RNA, 59 nt, Human
agcaaugaauauuaaggacucucuagcugccugggcauuacuguugcuaaaagaagaaa

SEQ ID NO: 78888 - RNA, 59 nt, Human
uaagcugagaucccaccauugcacuccagccugggcaacagagugagacuccaucucaa

SEQ ID NO: 78889 - RNA, 59 nt, Human
ugaugggcagugagacaagggauguucuaccugggcauguccccagcgaggggguuggg

SEQ ID NO: 78890 - RNA, 59 nt, Human
gcugcuggaaacugagaguucaagaccagccugggcaacauagugagacccugucucua

SEQ ID NO: 78891 - RNA, 59 nt, Human
acccaagggugaggagaggggcuggaagcccugggcauuaggagaagggagugggugcu

SEQ ID NO: 78892 - RNA, 59 nt, Human
agccacggccugcuguugcuucagccuggccugggcagcccuggaagcucggaggagag

SEQ ID NO: 78893 - RNA, 59 nt, Human
ccugaguucuuuuggucccagagaggcagccugggcagucuguuuacagcuggcaaaca

SEQ ID NO: 78894 - RNA, 59 nt, Human
aagggagaaggcagaacccauaggcagucccugggcaagggaggauuuucccggccgca

SEQ ID NO: 78895 - RNA, 59 nt, Human
aacuagagccccaaccacagcagaugcuuccugggcagccacuggccaggccguuguau

SEQ ID NO: 78896 - RNA, 59 nt, Human
aacucugucccacuucacgcacggacuguccugggcaaagguguucaccuuuccgagcc

SEQ ID NO: 78897 - RNA, 59 nt, Human
gcuaucacuuuguccagcccaaauaccuuccugggcaacuccuaccauuuguuugcagu

SEQ ID NO: 78898 - RNA, 59 nt, Human
uauauguucaagugggugugcccauagggccugggcacgugucucuagcaaaaccaggg

SEQ ID NO: 78899 - RNA, 59 nt, Human
agccccuagccccuggggggcagcuuuaaccugggcauguuuccuggguaccagugggg

SEQ ID NO: 78900 - RNA, 59 nt, Human
cuguggagcagcaggaccuggcccuucugccugggcagcagaauauauauuuuaccuau

SEQ ID NO: 78901 - RNA, 59 nt, Human
uaaggcucggauggcaaggacgcguucugccugggcauguaggggagguguuuuugcca

SEQ ID NO: 78902 - RNA, 59 nt, Human
uaucccuacaaaaaauuucugaaaaauuaccugggcauuguggggcacaccuguugucc

SEQ ID NO: 78903 - RNA, 59 nt, Human
aaccuggagaucuaguccuaagccacacaccugggcagccacuucauauaaagguuacu

SEQ ID NO: 78904 - RNA, 59 nt, Human
ugcaccugcgaauagccacugcacuccagccugggcaauauagcaagaccccauccuuu

SEQ ID NO: 78905 - RNA, 59 nt, Human
gaucccaugaucacacaucuguauuccagccugggcaauagagcaaguccccauuacua

SEQ ID NO: 78906 - RNA, 59 nt, Human
uagaggaaagcuccccagcauugcuugcuccugggcaaacauugcucuugaguuaagug

SEQ ID NO: 78907 - RNA, 59 nt, Human
ugcaggaucugcagugacggcagccucggccugggcaggcccaaggccacggucuagga

SEQ ID NO: 78908 - RNA, 59 nt, Human
ucugagacaggggcgcccccgccuugaccccugggcaccuccauccccucccaccuguc

SEQ ID NO: 78909 - RNA, 59 nt, Human
ccuccuugaggccaggaguucaggaccagccugggcaacauagcgagacccccauugcu

SEQ ID NO: 78910 - RNA, 59 nt, Human
ugagcugagauugugccaguucauuccacccugggcaacagggugagacucugucucaa

SEQ ID NO: 78911 - RNA, 59 nt, Human
ucauuugaguucaggaguucgaguuacagccugggcaauaaagugagacccugucacua

SEQ ID NO: 78912 - RNA, 59 nt, Human
auuguuugaggccagaaauuugagaccagccugggcaacauagcaaaacccugucucua

SEQ ID NO: 78913 - RNA, 59 nt, Human
ucaccuggugaaaacccuugggauucuucccugggcaugacugaugacaauuuccauuu

SEQ ID NO: 78914 - RNA, 59 nt, Human
gacaccauaucuucccauuucaagcacugccugggcacaccccaacaucccaggcugug

SEQ ID NO: 78915 - RNA, 59 nt, Human
gugacagacugggaggaaaccaggcuggaccugggcaggcgggauguguuggccacagg

SEQ ID NO: 78916 - RNA, 59 nt, Human
ccuccuucaugacucccacugcugccucuccugggcauggcuguuagcuguucugccuu

SEQ ID NO: 78917 - RNA, 59 nt, Human
ggaccccacgugcuuguggccaggcugccccugggcagggccauguggccucagaccac

SEQ ID NO: 78918 - RNA, 59 nt, Human
cgcacacacgcacaugcacagauaugccgccugggcacacagauaagcugcccaaaugc

SEQ ID NO: 78919 - RNA, 59 nt, Human
cacacgcacgcacacaugcagauaugcugccugggcacacacuuccggacacacaugca

SEQ ID NO: 78920 - RNA, 59 nt, Human
uagagcuggugccagaugugggcucagauccugggcaugaugggccgagccaccucgga

SEQ ID NO: 78921 - RNA, 59 nt, Human
uuggaagacacugcauuuuagccaguguaccugggcacagacucggggcugcccugaag

SEQ ID NO: 78922 - RNA, 52 nt, Human
uucacuuucaacagcagugagcccugggcagaugccccggccccagggcuuc

SEQ ID NO: 78923 - RNA, 59 nt, Human
ggauggccacugauguguguuuguggauaccugggcaucgacccagccugcaggugagc

SEQ ID NO: 78924 - RNA, 59 nt, Human
cauuuuuaguaaaugugcauugucacaauccugggcacaaagugccugaugucaaaaug

SEQ ID NO: 78925 - RNA, 59 nt, Human
uucgcuugggcccaagaguucgagaccagccugggcaacauggugaaacccuaucuccg

SEQ ID NO: 78926 - RNA, 59 nt, Human
cgaggucaugccacugcacuccagccuggccugggcaacagagcaagacccugucucaa

SEQ ID NO: 78927 - RNA, 59 nt, Human
ugagccuagaucaugccacugcacuccaaccugggcagcagagcaagacucugucucaa

SEQ ID NO: 78928 - RNA, 59 nt, Human
ggguucagaccucaccucucagggagcgaccugggcaaagacagagaagcucccagaag

SEQ ID NO: 78929 - RNA, 59 nt, Human
gcacugaaaaauuacucauucaaauuuccccugggcacguaaggcaaaauauugccggu

SEQ ID NO: 78930 - RNA, 59 nt, Human
ugaguggaaauugcgccacugcacuccagccugggcaacaaagugagacuccaucucaa

SEQ ID NO: 78931 - RNA, 59 nt, Human
ugagccaagaucgcaccacugcacuccagccugggcaacaaagagcgaaacucugucuc

SEQ ID NO: 78932 - RNA, 59 nt, Human
auagcuugaggccaggaguuccagaccagccugggcaacauagugagauccugucucua

SEQ ID NO: 78933 - RNA, 59 nt, Human
ugccagucccuccagccucaccuccccgcccugggcagcaggugugggcagcgugugag

SEQ ID NO: 78934 - RNA, 59 nt, Human
agcccgggaggagcucuccagccucggcgccugggcagagggcccggaaacccucggac

SEQ ID NO: 78935 - RNA, 59 nt, Human
ucgcagaggugaagagcuagaaccacuggccugggcaccuguccuccugcugugccguc

SEQ ID NO: 78936 - RNA, 59 nt, Human
aaaaggucuuggggaauucuguuuggcuaccugggcacgccagucugcaccaugugucc

SEQ ID NO: 78937 - RNA, 59 nt, Human
agauucgagggcucccuuugucccccugaccugggcacaggcaugggcgauggcucccu

SEQ ID NO: 78938 - RNA, 59 nt, Human
aucgggggugggcacacggcccuucggagccugggcagccuggccucacaggcagacuc

SEQ ID NO: 78939 - RNA, 59 nt, Human
uuugugauugcgccaccacugcacuccagccugggcaacagagugagacccugucucaa

SEQ ID NO: 78940 - RNA, 59 nt, Human
ugagcugagaucaugccauggcagucuagccugggcaacagagcgagacucuguuucaa

SEQ ID NO: 78941 - RNA, 59 nt, Human
ugagccgagauugcgccauugcacuccagccugggcaacgagugaaacuccgucucaaa

SEQ ID NO: 78942 - RNA, 59 nt, Human
cucaucuugauucagacugucagucuauuccugggcaguaguaugugauguccagcacc

SEQ ID NO: 78943 - RNA, 59 nt, Human
aagcacacuccuagcugcuccagucucagccugggcagcuucccccugccuuuugcacg

SEQ ID NO: 78944 - RNA, 59 nt, Human
ugagcuuugaucacaccacugcacuccagccugggcaacagagcaagaccccauccucc

SEQ ID NO: 78945 - RNA, 59 nt, Human
aucacuuaagcccaggagucugagaccagccugggcaacauagcaagacccccaucucu

SEQ ID NO: 78946 - RNA, 59 nt, Human
auugcuugaguucaggaguucaagaccagccugggcaacauagcaaaaccuuaucucua

SEQ ID NO: 78947 - RNA, 59 nt, Human
aucccuugugcccaggaguucaagaccagccugggcaacauggcgaaaccccauuucua

SEQ ID NO: 78948 - RNA, 59 nt, Human
aauacuaagggcccccauuacuguguggcccugggcauccucaguuuccucauuuggua

SEQ ID NO: 78949 - RNA, 59 nt, Human
ugagccgagaucgcgccacugugcuccagccugggcaacagagcaagacuccaucucaa

SEQ ID NO: 78950 - RNA, 59 nt, Human
aucacuugauccugggaguucgagaccagccugggcaacauggugaaacccugucggua

SEQ ID NO: 78951 - RNA, 59 nt, Human
ccaguucaucuauggcaguccagccagcuccugggcagcuugagagggcaaacccaaaa

SEQ ID NO: 78952 - RNA, 59 nt, Human
aaugaccaaagaugaccugugguaagcaaccugggcaucuuaggaagcagucccuggag

SEQ ID NO: 78953 - RNA, 59 nt, Human
aaagacgaaucuauaaaguaccgagacuuccugggcaaagaauggacaaucaguuuccu

SEQ ID NO: 78954 - RNA, 59 nt, Human
ugagccgagauugcaccauuguacuccagccugggcaauaagagcaaaacuccaucaaa

SEQ ID NO: 78955 - RNA, 59 nt, Human
uaaggcacagucucaucagaagucuaauaccugggcagguuuauaacauccugagagcc

SEQ ID NO: 78956 - RNA, 59 nt, Human
ggagcucugggccagaggaugcugagcugccugggcagagaccaagaggguuggagaca

SEQ ID NO: 78957 - RNA, 59 nt, Human
ccagcccuuagugcauucaggcuaaggccccugggcagggaugccaccccugcuccuuc

SEQ ID NO: 78958 - RNA, 59 nt, Human
uauacaccauuugggcuaucagagguaccccugggcaggagccucuacauccccuuccc

SEQ ID NO: 78959 - RNA, 59 nt, Human
ugagccaagauugugccauugcacuccagccugggcaacgagcgaaacuacaucucaaa

SEQ ID NO: 78960 - RNA, 59 nt, Human
cacaaacuuucugggccuccauccuaggaccugggcagacccacauggccugggcucug

SEQ ID NO: 78961 - RNA, 59 nt, Human
uugucugcuugucucuuugugucuguuauccugggcaggauggucauucucaaaaaccc

SEQ ID NO: 78962 - RNA, 59 nt, Human
uuccccuccuuugccuuucaagagcagggccugggcaaggccaagaaccaugcagaagc

SEQ ID NO: 78963 - RNA, 59 nt, Human
ugauggauggucgggauugaggcuguugaccugggcaguagcuccucccauggccagug

SEQ ID NO: 78964 - RNA, 59 nt, Human
aaccugcccugaacucaccgccuccccugccugggcacucccuccucccugcgcccaca

SEQ ID NO: 78965 - RNA, 59 nt, Human
uagagcccaagcuccaggugaggccuggcccugggcagggucuguggcugcgccccuca

SEQ ID NO: 78966 - RNA, 59 nt, Human
cagcggacaccacggggccuuccugcuuuccugggcagagggcagagugaggccaccug

SEQ ID NO: 78967 - RNA, 59 nt, Human
aucaccugagcucaggaguuugagaccagccugggcaacauggggaaacuccaucucua

SEQ ID NO: 78968 - RNA, 59 nt, Human
ugagccaagauggcgccacugcauuccagccugggcaacagagcaagacccugucuguc

SEQ ID NO: 78969 - RNA, 59 nt, Human
cuugagucccagauacacucaugggcugcccugggcagccagcauucauuguaaguucc

SEQ ID NO: 78970 - RNA, 59 nt, Human
ucacuacccacgaugaccuccggggguauccugggcaaaagggacaaagagggcaaaug

SEQ ID NO: 78971 - RNA, 59 nt, Human
gcccuccuggcccuucagucuuggugccaccugggcacaggggcaagcuuggugguugu

SEQ ID NO: 78972 - RNA, 59 nt, Human
cccugucucccugucucuagaagccuuagccugggcaccuggcucaaucuuguaacugc

SEQ ID NO: 78973 - RNA, 59 nt, Human
uuagcugagauccugccacugcacuccagccugggcaacagagugagacuaucucaaaa

SEQ ID NO: 78974 - RNA, 59 nt, Human
ccccaccuccagcccccgccaccgggcucccugggcacccagcaagaucuggggcugca

SEQ ID NO: 78975 - RNA, 59 nt, Human
aggugcauggccacagagcaugggcugggccugggcacaggaggagcagcugcuuuggu

SEQ ID NO: 78976 - RNA, 59 nt, Human
cccuaccccuaugaggggcuccgguagcaccugggcaccugccgcuggaagcuauuggg

SEQ ID NO: 78977 - RNA, 59 nt, Human
ugagcuguaauugcaucacugcacuccaaccugggcaacagaguaagaccuugucuuaa

SEQ ID NO: 78978 - RNA, 59 nt, Human
caugggccgucacaaaggcuugaucacugccugggcaguggcacaaccaucccccaugu

SEQ ID NO: 78979 - RNA, 59 nt, Human
ugguugaguaacuaaaggucuggcaagacccugggcacacagggagcugccuagcaucu

SEQ ID NO: 78980 - RNA, 57 nt, Human
aggagaaggaagacucuugaccuuuuuccugggcaacucuacagucccucccuccuu

SEQ ID NO: 78981 - RNA, 59 nt, Human
aucacuugaucccaggaguuugagaccagccugggcaccauggugaaaccucgucuuua

SEQ ID NO: 78982 - RNA, 59 nt, Human
aagugccgcauucuucaggaaggaagagaccugggcacccaagaccugguuuccuuuca

SEQ ID NO: 78983 - RNA, 59 nt, Human
cccugagucuucuggcugggggcagguugccugggcaagaacugcuucuucaauuccuu

SEQ ID NO: 78984 - RNA, 59 nt, Human
uagagguuuuugaaaaauccaacucucauccugggcagagguugccuaguugguauaga

SEQ ID NO: 78985 - RNA, 59 nt, Human
aaagcugaaagaucgcucugcucggggagccugggcagagcagcagcaacgugaggguc

SEQ ID NO: 78986 - RNA, 59 nt, Human
cuccagguggcccuaugcacccagguagcccugggcauggagcaccuguccaacaaccg

SEQ ID NO: 78987 - RNA, 59 nt, Human
gccgugaggagggagcccgcucaggauggccugggcaggggaggacaucucuagaggga

SEQ ID NO: 78988 - RNA, 59 nt, Human
ggaaccauaggaagugugugggcugccuuccugggcaaguauuucccagugggaaguug

SEQ ID NO: 78989 - RNA, 59 nt, Human
ugagcugagaucaugcuagugcgcuccagccugggcaacagagcgagacuucaucucag

SEQ ID NO: 78990 - RNA, 59 nt, Human
ugagcugagaucgcgccaccgcacuccagccugggcaacagagcgagacuccaucucaa

SEQ ID NO: 78991 - RNA, 59 nt, Human
aucaccugagcucaggaguccaagaccagccugggcaacauggcaaaacaccgucucua

SEQ ID NO: 78992 - RNA, 59 nt, Human
ucccaucaggagccucagccaaggaggggccugggcacacucagguccccaugguuguc

SEQ ID NO: 78993 - RNA, 59 nt, Human
gaugcugagaugccaccacugcacuccagccugggcaacagagcgagaaccugucucaa

SEQ ID NO: 78994 - RNA, 59 nt, Human
ugagccgagaucgcgcuacugcacuccagccugggcaacagagagagaccuugucucaa

SEQ ID NO: 78995 - RNA, 59 nt, Human
guguugguguuuccuuuagacuggccuagccugggcaucacuguaaaguaugugcaguu

SEQ ID NO: 78996 - RNA, 59 nt, Human
cucucacugaucacaaauggaaucaccucccugggcagcgagacgcaguugcucuggga

SEQ ID NO: 78997 - RNA, 59 nt, Human
cugucccuuagugcauucaggucauggcaccugggcaggggugucccuguauucugaau

SEQ ID NO: 78998 - RNA, 54 nt, Human
guuauuguauuggagggugaccacccugggcaugggguguuggcaggggucaaa

SEQ ID NO: 78999 - RNA, 59 nt, Human
guaaauacucccuuccacccaucccagccccugggcagccgggcagaagggaauccagg

SEQ ID NO: 79000 - RNA, 59 nt, Human
aguauguucauugccaccccugucccuccccugggcaccccucacuuucccugauccug

SEQ ID NO: 79001 - RNA, 59 nt, Human
aggccuucccuuuacagcucuccuccagcccugggcacauagcauaggcuggggacaca

SEQ ID NO: 79002 - RNA, 59 nt, Human
gcagagcccccagccaucacugcuggcagccugggcaaaccgggugagcaacaggagga

SEQ ID NO: 79003 - RNA, 59 nt, Human
agaaaugggcacuaccuccuggcccacucccugggcaccaugcccucuggugaccuguu

SEQ ID NO: 79004 - RNA, 59 nt, Human
uuugaagggacccagcacagggucuugggccugggcagucugaagacugauaacuuccc

SEQ ID NO: 79005 - RNA, 59 nt, Human
ugagcuaugauuucaccacugcauucuagccugggcaacagagugagauccugacucaa

SEQ ID NO: 79006 - RNA, 59 nt, Human
auugcuugaggccgaggguucaagacuagccugggcaacauagcgagacugcaucucua

SEQ ID NO: 79007 - RNA, 59 nt, Human
aguugcuguguuguauuccuacccaauuuccugggcaguugaugcaucucugggaaaaa

SEQ ID NO: 79008 - RNA, 59 nt, Human
gcgcucacugcuugggaagugcaggggguccugggcacauugccagcugggugcugagc

SEQ ID NO: 79009 - RNA, 59 nt, Human
ugagcacagaucacaccacugcacuccagccugggcaacagagugagacccuauuucaa

SEQ ID NO: 79010 - RNA, 59 nt, Human
auugcuuaagcccaggaguucaagaccagccugggcaacauggcuaaaccccaucucua

SEQ ID NO: 79011 - RNA, 59 nt, Human
ugagccaaggucacgucacugcacucuagccugggcaacagaguaagacaaaaaaauau

SEQ ID NO: 79012 - RNA, 59 nt, Human
auuacuugagcccaggaauucaagaccagccugggcaacauggugaaacccuguuucua

SEQ ID NO: 79013 - RNA, 59 nt, Human
ugagcugagauugcacuauugcacuccagccugggcaacaggaguaaaacuccccccca

SEQ ID NO: 79014 - RNA, 59 nt, Human
ugacccaagaucgugccacuucacuccagccugggcaaaagagcaaaacgccaucucaa

SEQ ID NO: 79015 - RNA, 59 nt, Human
cccacccagauggucucugagugcgccguccugggcagggcacacggucuggagcugag

SEQ ID NO: 79016 - RNA, 59 nt, Human
ccucuugucagcacggcugaaaggagcugccugggcaccugagguggcugaggcucauc

SEQ ID NO: 79017 - RNA, 59 nt, Human
acacggucuagcgggagcccagggcagccccugggcaggagacguggcugcugaacagc

SEQ ID NO: 79018 - RNA, 59 nt, Human
agacucagccuccugguuuacccccccggccugggcaucugaccucccccaccccagug

SEQ ID NO: 79019 - RNA, 59 nt, Human
ugagccaggauugcgccaccacacuccagccugggcaacagagacucugucucaaaaaa

SEQ ID NO: 79020 - RNA, 59 nt, Human
ugagccgagguugcaccacugcacucccuccugggcaacagaacaagacuccaucucaa

SEQ ID NO: 79021 - RNA, 59 nt, Human
uccucucauuuccagcuucucaguuucugccugggcaauggccaggggccaggaguggg

SEQ ID NO: 79022 - RNA, 59 nt, Human
gaccaccugaggguaggagucaagaucagccugggcaacauagugagacgcugucucua

SEQ ID NO: 79023 - RNA, 59 nt, Human
gugggaccugacauacaggcggcuccagcccugggcagcggcuucaagagccagagugg

SEQ ID NO: 79024 - RNA, 59 nt, Human
guacaguaggauaagccacucugucccuuccugggcaaagaagaaacggaggggaugga

SEQ ID NO: 79025 - RNA, 59 nt, Human
cgugccuguggcuagccacugugcuccagccugggcaacaccaucguaaaaauaaauaa

SEQ ID NO: 79026 - RNA, 59 nt, Human
ugauggagcugaugcuuucucuccuaaucccugggcacuaggcucuuaucagugugcuu

SEQ ID NO: 79027 - RNA, 59 nt, Human
aucauuugaggccaggaguuugagaccugccugggcaacauaaugaaacuuccuuucca

SEQ ID NO: 79028 - RNA, 59 nt, Human
cuccuccuccccucugggaauugggcagcccugggcaguuguacucaugggggcuuagg

SEQ ID NO: 79029 - RNA, 59 nt, Human
auugcuugaagcuaggaguuugagaccagccugggcaacaggguaagguccugucucua

SEQ ID NO: 79030 - RNA, 59 nt, Human
gugagcugugaugugcccuuaugcuauagccugggcaagagcgugagacccugucucaa

SEQ ID NO: 79031 - RNA, 59 nt, Human
gugcucaacccccagcccaccccacccucccugggcagggucuugaggcagccacugug

SEQ ID NO: 79032 - RNA, 59 nt, Human
gacaggggacagaugaccagguguguccaccugggcauauccaccaccucccucaccaa

SEQ ID NO: 79033 - RNA, 59 nt, Human
auugcuugaggccaggaguuugagaccagccugggcaacauagcgagaccccaucucua

SEQ ID NO: 79034 - RNA, 59 nt, Human
auugcuugagcccaggaguucaagaccagccugggcaacauaccaagacccccgucucu

SEQ ID NO: 79035 - RNA, 51 nt, Human
gucugaaguggacugugugagccugggcauucccagagaggaagggccgcu

SEQ ID NO: 79036 - RNA, 59 nt, Human
accgcuugaguccagggauucaaggccaaccugggcaauagagcgagacccugucucuu

SEQ ID NO: 79037 - RNA, 59 nt, Human
ugagcugagauagcgccauugcacuccagccugggcaacaagagcaaaacucugucuca

SEQ ID NO: 79038 - RNA, 59 nt, Human
gggacacuuuuuaaaaacacucuuaucagccugggcaacacagugagacuccaucucuu

SEQ ID NO: 79039 - RNA, 59 nt, Human
gugccacugaacuccaaccugcacuccagccugggcaacagagcgagacuccaucucua

SEQ ID NO: 79040 - RNA, 59 nt, Human
gaagaaccugucuaacuggaugcucauugccugggcaaggccuguuuaggccgguugcg

SEQ ID NO: 79041 - RNA, 59 nt, Human
gggaggauccauugagcccaggaguccagccugggcaaaauagcgagagacccugaauc

SEQ ID NO: 79042 - RNA, 59 nt, Human
uauagguccagcaacugaaccugccauuaccugggcaaggaaagaucccuuugcucuag

SEQ ID NO: 79043 - RNA, 59 nt, Human
cuucccagccagcccgggcccuggggagcccugggcacagcagcggccgaggggauguc

SEQ ID NO: 79044 - RNA, 59 nt, Human
caugagaccagggcagcguucagcacacuccugggcauggcggaagcaggaagcagacu

SEQ ID NO: 79045 - RNA, 59 nt, Human
caguccugccgcaggccuaacccuccugcccugggcacugccuccaugcagaagcgcuu

SEQ ID NO: 79046 - RNA, 59 nt, Human
aucacuugaggccaggaauuugaaaccagccugggcaaaacccugucucuacuaaaaau

SEQ ID NO: 79047 - RNA, 59 nt, Human
agaugggcacaggugcuggugaugccucuccugggcaaaacgccccauuuguggcacuu

SEQ ID NO: 79048 - RNA, 59 nt, Human
auugcuugaagucaggaguucaagaccaaccugggcaacauagcaacaccccccauguc

SEQ ID NO: 79049 - RNA, 59 nt, Human
uggcgcggggcauccuaugaggcaggcacccugggcagagagaugcagugggugcgggg

SEQ ID NO: 79050 - RNA, 59 nt, Human
uggacgaggaccagcugugaggcgggcgcccugggcagagagacucuguggcgcggggc

SEQ ID NO: 79051 - RNA, 59 nt, Human
acaggacacaucuguuuuuugucccucacccugggcaggccgcgucacaaucacagucc

SEQ ID NO: 79052 - RNA, 59 nt, Human
aucacuuggagccaggaguuugagaccagccugggcaacaaagugagacccccaucucu

SEQ ID NO: 79053 - RNA, 59 nt, Human
accucggcuucggagcacccugccaggccccugggcaucgccggacguccuacucaggc

SEQ ID NO: 79054 - RNA, 59 nt, Human
cggagcgguggagagggagaggcuggaggccugggcagaacagcgccgcccgggcagac

SEQ ID NO: 79055 - RNA, 53 nt, Human
aggcaaaggcgggcgaguagaugccugggcagggaccaggccagcgcugcaac

SEQ ID NO: 79056 - RNA, 59 nt, Human
ugagcugagaucgcgccauugcacuccagccugggcaacaagagcaaaacuccgucuca

SEQ ID NO: 79057 - RNA, 59 nt, Human
agugagccgugaucaccagugcacucuagccugggcaacagagaaagacccugucucaa

SEQ ID NO: 79058 - RNA, 59 nt, Human
aucgcuugaggccaggaguucgagaccacccugggcaacagagcgagaucccaucacua

SEQ ID NO: 79059 - RNA, 59 nt, Human
caucgaacaacuucauccuuaaucucugcccugggcaguuugcccucucccaucuggac

SEQ ID NO: 79060 - RNA, 59 nt, Human
cucacucagcugcccugggggcugcuuucccugggcacgggcuccagggaucaucucug

SEQ ID NO: 79061 - RNA, 59 nt, Human
ugagcugagaucacgccauuguacuccagccugggcaacaagagcaaaacuccgucuca

SEQ ID NO: 79062 - RNA, 59 nt, Human
cacuccugcucucuacagagccagccuggccugggcauuguaaacagcuuuuccuuuuu

SEQ ID NO: 79063 - RNA, 59 nt, Human
ugagcugagaucaugccacugcacuccagccugggcaacagagcgagacuccaucucaa

SEQ ID NO: 79064 - RNA, 59 nt, Human
ugagcugagauaaucccacugcauuccagccugggcaacagcgugagacuucaucucaa

SEQ ID NO: 79065 - RNA, 59 nt, Human
gacacccagauucccuccauggccucaccccugggcaaaauccaacucugagccaucuu

SEQ ID NO: 79066 - RNA, 59 nt, Human
agagaagcacguggugaggguggccugggccugggcacccuuggccugccggccuggcu

SEQ ID NO: 79067 - RNA, 59 nt, Human
aucguuugagcccaggaguugaagaccagccugggcaacacagugagacuucauuucua

SEQ ID NO: 79068 - RNA, 59 nt, Human
ugagccgagaucgcgccacuauacuccagccugggcaacagacauccugucucaaauaa

SEQ ID NO: 79069 - RNA, 59 nt, Human
aucgcuugagcucaggaguucgagaccagccugggcaacguggcgaaauccccgucuuu

SEQ ID NO: 79070 - RNA, 59 nt, Human
ucaccuugaggccaggaguuuaaggccagccugggcaacauagcaaaaccuagucccua

SEQ ID NO: 79071 - RNA, 59 nt, Human
gucacuugaacccaggaguuugacaucaaccugggcaacauggugaccucccgucucuc

SEQ ID NO: 79072 - RNA, 59 nt, Human
uaaaguaggaucaaaucuagauccucuagccugggcaguagaggaagaaaugcuagccu

SEQ ID NO: 79073 - RNA, 59 nt, Human
cagcccucuucuuuugauugacagaccacccugggcaccccaugcucaauaugaacacc

SEQ ID NO: 79074 - RNA, 59 nt, Human
aucaauugagccuagaaguucaagaccagccugggcaaaguagggagaccccuucucua

SEQ ID NO: 79075 - RNA, 59 nt, Human
auugcccgcgcucaggaggucaagaccagccugggcaacacggugaaaccccaucucua

SEQ ID NO: 79076 - RNA, 59 nt, Human
ugagccaagaucgcaccacugcacuccagccugggcaacagagugagacuccgucucaa

SEQ ID NO: 79077 - RNA, 59 nt, Human
uauuuuuuauuuuuugagacggaguccagccugggcaacagaguaacucuccuucucaa

SEQ ID NO: 79078 - RNA, 59 nt, Human
ugagcugagauuacgccacugcacucuagccugggcaacggugagacccugccucaaaa

SEQ ID NO: 79079 - RNA, 59 nt, Human
ucugaacccgucucagcagguccacagcaccugggcagaggucagagaccaggggaggc

SEQ ID NO: 79080 - RNA, 59 nt, Human
agcgggacuacacaguugcuggcuuugcuccugggcaaggaggagcaggccagagccuc

SEQ ID NO: 79081 - RNA, 59 nt, Human
gggggcugugagcagcggugccucaacacccugggcagcuacaagugcagcugugaccc

SEQ ID NO: 79082 - RNA, 59 nt, Human
ggagcgagaaauugcuuuuucucuuccucccugggcagaauguagcuuuucugcuucac

SEQ ID NO: 79083 - RNA, 59 nt, Human
aaaaaaggcaaggcacaacaaaaaaauauccugggcaauaaaaaaaauauuuuaaacca

SEQ ID NO: 79084 - RNA, 59 nt, Human
gcucugcaggccacugugagcgcuggcucccugggcagugcuccuccguguggacugug

SEQ ID NO: 79085 - RNA, 59 nt, Human
ucucuguucugacuccugggacuucugguccugggcacacuuuuugcaggcaacaaaau

SEQ ID NO: 79086 - RNA, 59 nt, Human
uaugcuuauggauuugaugacaggcauagccugggcauaucaccucauugguaaagggc

SEQ ID NO: 79087 - RNA, 59 nt, Human
gacacuuucaugguccagaaagcugaaggccugggcaucucuugugacauuuuucuaau

SEQ ID NO: 79088 - RNA, 59 nt, Human
ugagccgagaucgcaccauugcacuccugccugggcaacaagagugaaacuccaucucc

SEQ ID NO: 79089 - RNA, 59 nt, Human
auuauuugagcucaggaguuugagaccauccugggcaacauggcgaaacccuaucucua

SEQ ID NO: 79090 - RNA, 59 nt, Human
ccagcucugcugcugacgagcugugugguccugggcagaguggucuccgaguuccaguc

SEQ ID NO: 79091 - RNA, 59 nt, Human
gauuuuuaauggaaaguuguauccauuaaccugggcauuguugagguuaaguuucucuu

SEQ ID NO: 79092 - RNA, 59 nt, Human
aacuuaaaacuacuuuguugaaacaucaaccugggcagaaaaaaaaaaaaaaagacaug

SEQ ID NO: 79093 - RNA, 59 nt, Human
ugagccgagaugguaccucugcacugcagccugggcaacagaaugagacugugucuuca

SEQ ID NO: 79094 - RNA, 59 nt, Human
agcacgugcugagggcauggggccugcccccugggcacccauccacaagcugggccacg

SEQ ID NO: 79095 - RNA, 59 nt, Human
ugagcugagaucguggcauugcacucuagccugggcaaccaagagugaaacugucucaa

SEQ ID NO: 79096 - RNA, 59 nt, Human
cuucuggcccgcuccucacugagccacuaccugggcaucagucuggaucugcagcugca

SEQ ID NO: 79097 - RNA, 59 nt, Human
gauggccagggagccaugagaagacucuuccugggcacggcguggggacuggacagaaa

SEQ ID NO: 79098 - RNA, 51 nt, Human
cagaccccugugacuccugagccugggcagguggggaccccgcuccccaac

SEQ ID NO: 79099 - RNA, 59 nt, Human
aucacuugaggccagaaguucgagaccagccugggcaauguagugagaccccaucacua

SEQ ID NO: 79100 - RNA, 59 nt, Human
ugaaccgagaucacaccacugcauucccgccugggcagcagagcgagacuccgucucaa

SEQ ID NO: 79101 - RNA, 59 nt, Human
cgugaaguccuguguguggcuggucccuaccugggcagucucauuugcacccauagccc

SEQ ID NO: 79102 - RNA, 59 nt, Human
ugagcugagaucacaucauugcacuccagccugggcaacgggcgagacucugucucaaa

SEQ ID NO: 79103 - RNA, 59 nt, Human
gaguuuuuuuaagacucuuaaaaaaagagccugggcaauuuuuuuaagacucugucuua

SEQ ID NO: 79104 - RNA, 59 nt, Human
cgagccaagaucgugccacugcacuccagccugggcaagaguuuuuuuaagacucuuaa

SEQ ID NO: 79105 - RNA, 59 nt, Human
cacacuagccucuccaggaaugccuccucccugggcagaaaguggccaugccacccugu

SEQ ID NO: 79106 - RNA, 59 nt, Human
aggagguggauugcgccacugcacuccagccugggcaacagagugagacucccucucaa

SEQ ID NO: 79107 - RNA, 59 nt, Human
aucacucaaguccaggaguucgagaccagccugggcaacauggugaaauccugucucua

SEQ ID NO: 79108 - RNA, 59 nt, Human
acuaagguauuucaguuauguaaacucagccugggcacuuucugauaacuguaaaaugu

SEQ ID NO: 79109 - RNA, 59 nt, Human
cuacagggagaugcucucuuugagaggcuccugggcauugauuccauuucaaucucauu

SEQ ID NO: 79110 - RNA, 59 nt, Human
ugagccgagaucgcaccacugcacuccagccugggcagcagagcaaguaguaauaacca

SEQ ID NO: 79111 - RNA, 59 nt, Human
uucaugcaagacugcugccuucauguaacccugggcacaguguguauauagcugcuguu

SEQ ID NO: 79112 - RNA, 59 nt, Human
ugggcugugaucacaccacugcacuccagccugggcaacagagugagacccugucucug

SEQ ID NO: 79113 - RNA, 59 nt, Human
aucacuugagcccaggaguucaagaccagccugggcaacauagugagacuccugucucu

SEQ ID NO: 79114 - RNA, 59 nt, Human
gagcuuggaggggcagccucaggugugugccugggcaccgcucacagccucuugcaccc

SEQ ID NO: 79115 - RNA, 59 nt, Human
cacccugugaccgcagguugcuuucccacccugggcaaugcagugcagcaugggaaagg

SEQ ID NO: 79116 - RNA, 59 nt, Human
cagccccaggggaccaugccggggugcugccugggcaggccauguuggggagacuccag

SEQ ID NO: 79117 - RNA, 59 nt, Human
ugaagcuuucacagugcagagacugcuagccugggcacacacaccuccuuucuggccgu

SEQ ID NO: 79118 - RNA, 59 nt, Human
ugagacgagcuugugccacugcacuccagccugggcaacagaguaagacucagucucaa

SEQ ID NO: 79119 - RNA, 59 nt, Human
aaggacugacuguaguccuauuucagaccccugggcacuagugucaacuccuccuuugg

SEQ ID NO: 79120 - RNA, 59 nt, Human
gugguagagguggugagaagacaucagauccugggcacauucuuuucuucugcuucccu

SEQ ID NO: 79121 - RNA, 59 nt, Human
gucaugacccugauaguuucccauaacaaccugggcauuccuugggacucaggagcugc

SEQ ID NO: 79122 - RNA, 59 nt, Human
gccaucaucauggcaucauugcauuccagccugggcaacagagcaagaccucgucucaa

SEQ ID NO: 79123 - RNA, 59 nt, Human
uuugcuugagcccaggaguuccagaccagccugggcaacauggcgaaaccccaucucua

SEQ ID NO: 79124 - RNA, 59 nt, Human
aucgcuugagcucaggaguucaagacgagccugggcaacauggcaaaugccgucucugc

SEQ ID NO: 79125 - RNA, 59 nt, Human
cuggccaaggggugggccugugaaucaauccugggcaaucagacacccucuccuuaaaa

SEQ ID NO: 79126 - RNA, 59 nt, Human
cucagcggggacggccuccugcugcagguccugggcagcccacaguagugcuagcugag

SEQ ID NO: 79127 - RNA, 59 nt, Human
ccaggcugggccugguggugaagagcaguccugggcacaggcugugagccagggugcug

SEQ ID NO: 79128 - RNA, 59 nt, Human
agccguaugcugcacaagcguguacacccccugggcagccucaaaaccccgcuuacagc

SEQ ID NO: 79129 - RNA, 59 nt, Human
uucuuuugguuccauuguuuggagacauuccugggcacaguuugguccguuagaauuaa

SEQ ID NO: 79130 - RNA, 59 nt, Human
agggugcuaaagccaaccagccuuuggguccugggcaggugggagcugaaaaggaucga

SEQ ID NO: 79131 - RNA, 59 nt, Human
aggacaguggcugaguggaggcgcccagaccugggcaggcagcaggcucaggcccacac

SEQ ID NO: 79132 - RNA, 59 nt, Human
gcggcugcccaagcuugcagggaacaauaccugggcaaccuuguaacuguauucuccag

SEQ ID NO: 79133 - RNA, 59 nt, Human
agagaggggugggcuggggcaaggcuuauccugggcaggagagaacacacgagcacgua

SEQ ID NO: 79134 - RNA, 59 nt, Human
gugauagcugcuccccaucccaaagugggccugggcagucaggcuccagggcccuaugc

SEQ ID NO: 79135 - RNA, 59 nt, Human
auugcuugagcucaugaguucaagaccagccugggcaacauagcgagacuccaucucua

SEQ ID NO: 79136 - RNA, 59 nt, Human
uuuagaaccaguuucauuaaaguugccuuccugggcaccuguuuauccauuuccugaac

SEQ ID NO: 79137 - RNA, 59 nt, Human
aggugaggcaggugcuccucacacccagaccugggcaucuucauugagggaaagaaaac

SEQ ID NO: 79138 - RNA, 59 nt, Human
ccgagggggccuugacggcguuggcggggccugggcacaggggcagccgcagggaggca

SEQ ID NO: 79139 - RNA, 59 nt, Human
cccucuuguugccuucgauuucggcaaagccugggcaggugccaccgggaaggaauggc

SEQ ID NO: 79140 - RNA, 59 nt, Human
ugagccgagaucaugacacugcacuccagccugggcaacagagcgagaccaucucuuaa

SEQ ID NO: 79141 - RNA, 59 nt, Human
cagagguuucggauucgugacauccacccccugggcaagugagagcaucugcaaaaugc

SEQ ID NO: 79142 - RNA, 59 nt, Human
gaaagucaucgaugauggcucaggcucagccugggcacgccccagaggagagagaugga

SEQ ID NO: 79143 - RNA, 59 nt, Human
gacucuccuucaacauccucacccccaccccugggcaccauuuaggacaagacuuccuu

SEQ ID NO: 79144 - RNA, 59 nt, Human
aauacaaccagcccaaccaucgguccacaccugggcauuuggugagagucaaagcugac

SEQ ID NO: 79145 - RNA, 59 nt, Human
ugagcugagaucuugccacugcacaccagccugggcaacacagcaagacucugucucaa

SEQ ID NO: 79146 - RNA, 59 nt, Human
ugccacgcaggacagacuggagagagaagccugggcaauacugcccgccugucauggcc

SEQ ID NO: 79147 - RNA, 59 nt, Human
guguuucagcauagauuccaguuucgcacccugggcagacccccaggccccauccggga

SEQ ID NO: 79148 - RNA, 59 nt, Human
cgugucacuccugggccaugggggcaccuccugggcacuuagguguuucagcauagauu

SEQ ID NO: 79149 - RNA, 59 nt, Human
gcagcaaggucauggucugaguggggcuuccugggcaguuggggcggcccacgccagcu

SEQ ID NO: 79150 - RNA, 59 nt, Human
ugagccgagauugcaccuuuguacuccagccugggcaacgagcaaaaaacucugucuca

SEQ ID NO: 79151 - RNA, 59 nt, Human
acaguauuacucucgagaggcaauucaguccugggcaaagguauuaguacaauaagcgu

SEQ ID NO: 79152 - RNA, 59 nt, Human
gcuucuccccauagcacgaggauguguugccugggcacggugacugcgguuauuccugg

SEQ ID NO: 79153 - RNA, 59 nt, Human
ugagcugagaucaugccauugcacuccagccugggcaacgagagugaaacuccgucccc

SEQ ID NO: 79154 - RNA, 59 nt, Human
gcagauggagcccaaggcccccucggccuccugggcaacuugggguacacaggauacug

SEQ ID NO: 79155 - RNA, 59 nt, Human
ccggccacgucccccugccgcaucuuugaccugggcagcgacaacgaggaggugguggc

SEQ ID NO: 79156 - RNA, 59 nt, Human
gcuccuugaaccccuccagcccgcuucagccugggcaucacugcaggccccgugcuccu

SEQ ID NO: 79157 - RNA, 59 nt, Human
cacacauacucacagcccccgggcucuacccugggcacagcagagacagacuggugguu

SEQ ID NO: 79158 - RNA, 59 nt, Human
cccgccuccucccccaucccccugccuccccugggcacuguggcuuccuccugcgccug

SEQ ID NO: 79159 - RNA, 59 nt, Human
ugagccaagaucacggcacugcgcugcagccugggcaacacagugagacccugucaaaa

SEQ ID NO: 79160 - RNA, 59 nt, Human
guugcuugagcucaggaguuugagaccagccugggcaacauggcacaauugucucuaca

SEQ ID NO: 79161 - RNA, 59 nt, Human
ugugcaugugaauagccacugcacuccagccugggcaacauagcaagacuccaucucua

SEQ ID NO: 79162 - RNA, 59 nt, Human
aggagcuucccaagcuggucacagagucuccugggcacagguuauacagaccccagccc

SEQ ID NO: 79163 - RNA, 59 nt, Human
guuauauggaugggaacccuaacuuagggccugggcaggggaaagagaaagaaggugag

SEQ ID NO: 79164 - RNA, 59 nt, Human
ggaagaggccugcuccacuugucugggaaccugggcaggaggcacagaggaagccaagg

SEQ ID NO: 79165 - RNA, 59 nt, Human
auugcuugagcccaagaguuggagaccagccugggcaacauggugagaccaauugacug

SEQ ID NO: 79166 - RNA, 59 nt, Human
ugagccaagauugcgccccugcacuccagccugggcaacagagcaagacuccaucucaa

SEQ ID NO: 79167 - RNA, 59 nt, Human
ugagccaaagguacaccacuacacuccagccugggcaacagagcaagacucggucucaa

SEQ ID NO: 79168 - RNA, 59 nt, Human
cgccucuccucgguucaaggucacuguuuccugggcacgcacuggguugcgggacagag

SEQ ID NO: 79169 - RNA, 59 nt, Human
ccuccucugcccccauccccuggcucuccccugggcacagugccacucccuuggaaggg

SEQ ID NO: 79170 - RNA, 59 nt, Human
ccuggccaacauggugaaaccccaucucuccugggcauguagucccagcuacucgggag

SEQ ID NO: 79171 - RNA, 59 nt, Human
accacugugccacugacuugcugugugacccugggcaagucacuuaacuauaaggugcc

SEQ ID NO: 79172 - RNA, 59 nt, Human
gagcaguguacagccugcucaacaaccgcccugggcaggccgcuccugagcugcugucu

SEQ ID NO: 79173 - RNA, 59 nt, Human
ggggugagaggcuggugguugccucccguccugggcaggcugcagccucaugccauguc

SEQ ID NO: 79174 - RNA, 59 nt, Human
cucaggcuauucugagcucagaaaaguccccugggcacuagguaaagcccagugaaugu

SEQ ID NO: 79175 - RNA, 59 nt, Human
ugagccaagaucgcgccauuguacuccagccugggcaacaagagcaagauucugccuca

SEQ ID NO: 79176 - RNA, 59 nt, Human
aucaccugaaaucaggaguuccagaccagccugggcaacauggugaaaccccgucucua

SEQ ID NO: 79177 - RNA, 59 nt, Human
ccuaugugcagguacgugcagcacuacggccugggcagugccugugacaacguagagcg

SEQ ID NO: 79178 - RNA, 59 nt, Human
ugagccgaauaugcgccacugcacuccagccugggcaacagagcaagacuccgucucca

SEQ ID NO: 79179 - RNA, 59 nt, Human
ucagucaugauggcaccacugcacuccagccugggcaacagagcaagauccugucuuua

SEQ ID NO: 79180 - RNA, 59 nt, Human
aucucuugaggccaggaguuugagaccagccugggcagcauagcaagacacaucccuac

SEQ ID NO: 79181 - RNA, 59 nt, Human
ugagcugagauugugucauugcacuccagccugggcaacaagagcaaaacucugucuca

SEQ ID NO: 79182 - RNA, 59 nt, Human
auugccugagcucaggaguuugagaccagccugggcaacacggugaaaccccgucucua

SEQ ID NO: 79183 - RNA, 59 nt, Human
ugagcugagaucaugccacugcacuccagccugggcaacagagcaagacucugccucaa

SEQ ID NO: 79184 - RNA, 59 nt, Human
ccccaucucuacuaaacaugcaaaaauuaccugggcaugguggcaggugcuuauaaucc

SEQ ID NO: 79185 - RNA, 59 nt, Human
ggacgccugggggugccaggaccagucaaccugggcaaagccuagugaaggcuucucuc

SEQ ID NO: 79186 - RNA, 59 nt, Human
gauugagcugggggcaacagccaagcucaccugggcaggucucugccaccuccuugcuc

SEQ ID NO: 79187 - RNA, 59 nt, Human
ggggcuccacaugagagguccugcaugccccugggcacaacaaggacugauucaaucug

SEQ ID NO: 79188 - RNA, 59 nt, Human
auagacggcacaggccaccuggcccauucccugggcauucccugcuuugcauugcugcu

SEQ ID NO: 79189 - RNA, 59 nt, Human
ccccagguacuguggagagcauaguccagccugggcauuugucuccuagcagccuacac

SEQ ID NO: 79190 - RNA, 59 nt, Human
ugagccaagaucgugccacuacacuccagccugggcaacaaagcaagaccuugucucaa

SEQ ID NO: 79191 - RNA, 59 nt, Human
aucacuugagcccaggaguucgagagcagccugggcaacaugacgaaaccccgucucua

SEQ ID NO: 79192 - RNA, 59 nt, Human
uaaagaaaugucuguacaaaauaagauggccugggcagaguugguugucugagugagaa

SEQ ID NO: 79193 - RNA, 59 nt, Human
gcuggggugcaggucaucacaggacggcuccugggcagcugggcccuccuggguggggu

SEQ ID NO: 79194 - RNA, 59 nt, Human
cccccaggagaucaggauuccacugacguccugggcagccagugaauuuaauuuuccau

SEQ ID NO: 79195 - RNA, 59 nt, Human
aucacuugagcccaggaguuuaagaccagccugggcaacauagcaagacccugucucua

SEQ ID NO: 79196 - RNA, 59 nt, Human
cacauguguucccucuauccguccugcuuccugggcagcugguggugcugggaaugggg

SEQ ID NO: 79197 - RNA, 59 nt, Human
ugagccaggauugugccauugcacuccagccugggcaacaagaacaaaacuccaucuca

SEQ ID NO: 79198 - RNA, 59 nt, Human
ccccaccacaccccaucccagaggccuugccugggcaacccuaagccccugucccucgc

SEQ ID NO: 79199 - RNA, 59 nt, Human
uaagcuguauuugugaauugugcugguuuccugggcauugccacgccuaccacaggugg

SEQ ID NO: 79200 - RNA, 59 nt, Human
ccugcucuggggccugcugagccggcugcccugggcacccgguuccaggcagcacagac

SEQ ID NO: 79201 - RNA, 59 nt, Human
gcaacugccaaucccgcugaagaggccucccugggcacagcacaggcugcacggugcac

SEQ ID NO: 79202 - RNA, 59 nt, Human
cagaagcugcugccugagggcagggccuaccugggcacacagaagagcauaugggaggg

SEQ ID NO: 79203 - RNA, 59 nt, Human
gacggcuggaugggccugggcugggugggccugggcagcugggugggccugggcagcug

SEQ ID NO: 79204 - RNA, 59 nt, Human
ggcugggugggccugggcagcugggugggccugggcagcugggugggccugagcuaggg

SEQ ID NO: 79205 - RNA, 59 nt, Human
cauggaguagaggccuaaguugacacugcccugggcagacaagacaggagcugucgccc

SEQ ID NO: 79206 - RNA, 59 nt, Human
gguccauuuugcccuuccauagccuaaucccugggcauugcuuuccacugagguugggg

SEQ ID NO: 79207 - RNA, 59 nt, Human
aacugcacuugggcagggaauauagccuuccugggcacaacuagcugacaaugacaggu

SEQ ID NO: 79208 - RNA, 59 nt, Human
gauggggaaggguguggaguggggaggagccugggcagccugcugggugggccacacuc

SEQ ID NO: 79209 - RNA, 59 nt, Human
cucucaugcugccuccucugcccauggguccugggcacccaggccugcccugccugcug

SEQ ID NO: 79210 - RNA, 59 nt, Human
uguuccccucagcuuucccuccucgcuggccugggcacccuccugggagcaggccuucc

SEQ ID NO: 79211 - RNA, 59 nt, Human
cuuggggcuggggcaggcuugggcucaauccugggcacccaggggcagcccaccccuaa

SEQ ID NO: 79212 - RNA, 59 nt, Human
ugagccaugauuacuccacugcacuccagccugggcaacagagccaggcccuguaucaa

SEQ ID NO: 79213 - RNA, 59 nt, Human
uccaaaauccccuuuuuguucuuccuggaccugggcauucagccuccugcucuuaacug

SEQ ID NO: 79214 - RNA, 59 nt, Human
gacuggagcccccgugccuuggucuccccccugggcacacgugcucacucaggcccagc

SEQ ID NO: 79215 - RNA, 59 nt, Human
gccaaucaugaccuguuccuuccugaaguccugggcaugcaucugggacccccguggag

SEQ ID NO: 79216 - RNA, 59 nt, Human
auagcuugagcccaggagugcaagaccugccugggcaauauacugagaccccauucucc

SEQ ID NO: 79217 - RNA, 56 nt, Human
aagacaucgagcgguccugagagccuccugggcauguuugucugugugcuguaacc

SEQ ID NO: 79218 - RNA, 59 nt, Human
agcccgggacagggucuugcaagcagccuccugggcagucguaaggguugcggcgugau

SEQ ID NO: 79219 - RNA, 59 nt, Human
cagaggcagggucgcugaguccuccagguccugggcagccuucauauuugccauugugu

SEQ ID NO: 79220 - RNA, 59 nt, Human
agcugggccagccucgugcugggcucugcccugggcagacaggcagagggccagagcag

SEQ ID NO: 79221 - RNA, 59 nt, Human
aaugcuugagcccaagaguuuuagaccagccugggcaacacaguaagacccuguuucua

SEQ ID NO: 79222 - RNA, 59 nt, Human
aaaccccaggagacugaaacucaaacaacccugggcaaguaaugugcaaaagauggcag

SEQ ID NO: 79223 - RNA, 59 nt, Human
auggcuugagcucaggaguucgugaccagccugggcaacccugucucuacaaaaaauac

SEQ ID NO: 79224 - RNA, 59 nt, Human
acugcuugagcccaggaguuugagaccagccugggcaauguagcaagaccccaucucua

SEQ ID NO: 79225 - RNA, 59 nt, Human
auuacuugagcccaggaguuugaauccauccugggcagcauacugagacccugccuuua

SEQ ID NO: 79226 - RNA, 59 nt, Human
auugcuugagcccaggaguuagagaccagccugggcaacaugaugugaaaacccaucuc

SEQ ID NO: 79227 - RNA, 59 nt, Human
acugcuugagcccaggaguucaagaccagccugggcaacguaggaagacuccgucucua

SEQ ID NO: 79228 - RNA, 59 nt, Human
ggcucugucacugagcaaugguaacugcaccugggcagcuccucccugugcccccagcc

SEQ ID NO: 79229 - RNA, 59 nt, Human
uacgugccaucaucucuccagcccaggccccugggcaucucaugcuggggggaagggac

SEQ ID NO: 79230 - RNA, 59 nt, Human
cccuccacuguuccuaucagcagguggccccugggcaucagaacagccugcccugggca

SEQ ID NO: 79231 - RNA, 59 nt, Human
gguggccccugggcaucagaacagccugcccugggcaccagguggcagacacacucaga

SEQ ID NO: 79232 - RNA, 59 nt, Human
gguguaaaagagcugcccuuggugggugcccugggcauguugcaacgccugcuggugcc

SEQ ID NO: 79233 - RNA, 59 nt, Human
ugagucaagaucucaccacugcacuccagccugggcaacagagggagacucugucucaa

SEQ ID NO: 79234 - RNA, 59 nt, Human
ugagccgagaccgcgccacugcacuccagccugggcaacagagcaaaacuccaacucaa

SEQ ID NO: 79235 - RNA, 50 nt, Human
agaaccucacguccuucugaccugggcaagagcuguagccugucgguugc

SEQ ID NO: 79236 - RNA, 59 nt, Human
gcacagcccugacuugaacucugggugacccugggcacccacagaacugggagugaggg

SEQ ID NO: 79237 - RNA, 59 nt, Human
aucacuugaguccagaaauucaagacccgccugggcaucauaaugagaccccaucucua

SEQ ID NO: 79238 - RNA, 59 nt, Human
ugauccacgaucguaccacuacacuccagccugggcaacagagcaagacccugucucaa

SEQ ID NO: 79239 - RNA, 59 nt, Human
ggagccaagauugcgccacugcacuccagccugggcaacagagcgggacuccaucucaa

SEQ ID NO: 79240 - RNA, 59 nt, Human
ccccaacgcaggccccacucugagccugcccugggcagccucggacuaugacuggcuac

SEQ ID NO: 79241 - RNA, 59 nt, Human
uuuaugugcuagauuuuaauauccuugagccugggcaagugcacaagucuuuuuaaaag

SEQ ID NO: 79242 - RNA, 59 nt, Human
aucacuugaggccaggaguucaagaccagccugggcaacauagugagaaugcaucucua

SEQ ID NO: 79243 - RNA, 59 nt, Human
uacugugauuacaagcgugagccacggcaccugggcagaaaaguaucuuaauuaaugaa

SEQ ID NO: 79244 - RNA, 59 nt, Human
aggcaggggguggggggccuuccuuuccuccugggcaccccgugugcugugaucuccug

SEQ ID NO: 79245 - RNA, 59 nt, Human
gcccagccccauccgcaagccaggcugggccugggcauaacuucgcugggcucucccaa

SEQ ID NO: 79246 - RNA, 59 nt, Human
aaauguuaugggggagaucuuauaaauuuccugggcaagaguguaugcauacaaaguuu

SEQ ID NO: 79247 - RNA, 59 nt, Human
ucccagccagcaguucagagcugcccucuccugggcagcugccuccccuccucugcuug

SEQ ID NO: 79248 - RNA, 59 nt, Human
ccuggcuucccaggacccugggucaccuuccugggcagcccagagagacccugccaacu

SEQ ID NO: 79249 - RNA, 59 nt, Human
caucccgaaacuccacccguucccacugcccugggcagccaucuugaauaugggcggaa

SEQ ID NO: 79250 - RNA, 59 nt, Human
ucuuuuccucaagggguuuggggcaggagccugggcacuuacuccccguuuuugcuguu

SEQ ID NO: 79251 - RNA, 59 nt, Human
gucggauccugugaguaggcugggccuccccugggcaggguucuccaagggcccgguuu

SEQ ID NO: 79252 - RNA, 59 nt, Human
gcacgggggagucugugguggccaguuuaccugggcaucuggcugagaggaagaaaggc

SEQ ID NO: 79253 - RNA, 59 nt, Human
cggcaggggugggaggcagcaggggucagccugggcaggaaccucucccaacucugucc

SEQ ID NO: 79254 - RNA, 59 nt, Human
uguugggcuugggggaaaagagguggauuccugggcaagaaccuaaaguagcaggacuc

SEQ ID NO: 79255 - RNA, 59 nt, Human
ugagccgaaaucacgccacuacacuccagccugggcaacagagggagacuccaucucaa

SEQ ID NO: 79256 - RNA, 59 nt, Human
ugagccgagauugcaccauugcgcucuagccugggcaacaacagcaaaacuccaucuca

SEQ ID NO: 79257 - RNA, 59 nt, Human
ucccuagaggacuccauggcugagaggcuccugggcagauggggucaaggcugggccag

SEQ ID NO: 79258 - RNA, 59 nt, Human
agcuccuuaaacugacgcuagucaauaaaccugggcaagugaggcaagagaaaugagga

SEQ ID NO: 79259 - RNA, 59 nt, Human
ggugguguggaggggcugguccccugacaccugggcagauggggucuccuucagucucc

SEQ ID NO: 79260 - RNA, 59 nt, Human
cugccuucuccaugggguaaccacccucgccugggcaggggcagccaaggcugggaaau

SEQ ID NO: 79261 - RNA, 59 nt, Human
cucagcaggugccugggcuucuuaaggcuccugggcaaggcgugggaguuguccugacu

SEQ ID NO: 79262 - RNA, 59 nt, Human
ugagccgagaccgugccacugcacuccagccugggcaacacagcgagacuccgucucga

SEQ ID NO: 79263 - RNA, 59 nt, Human
guaugugugcccucccugugggcacaccaccugggcauuaggacugaaauuccugaguu

SEQ ID NO: 79264 - RNA, 59 nt, Human
cauuaccucuuccugcaacuaaacacgagccugggcagaaccucucagccuuccucuac

SEQ ID NO: 79265 - RNA, 59 nt, Human
cuggggggaucauugugaaggccuucuucccugggcaccugguaccuggggaccuacaa

SEQ ID NO: 79266 - RNA, 59 nt, Human
uucucugcuugaccugaagaagggccagaccugggcagaaagacuccagcaggugagcu

SEQ ID NO: 79267 - RNA, 59 nt, Human
uuggccaaccacaucucccugcuguguccccugggcauuucucuaccucccagguggaa

SEQ ID NO: 79268 - RNA, 59 nt, Human
gauaagaacccaggguggagagggagacuccugggcagccguuuuccucauccuuuccc

SEQ ID NO: 79269 - RNA, 59 nt, Human
agucucaguugcaaucagugugugcccagccugggcagacaggaaauuccucggauaca

SEQ ID NO: 79270 - RNA, 59 nt, Human
ucugggagaaacaggggacccccucaccuccugggcagugaccccuacuaggcucccau

SEQ ID NO: 79271 - RNA, 59 nt, Human
cugccaugggugcagacccugaacccacaccugggcaucagggccuuucuccuccccac

SEQ ID NO: 79272 - RNA, 59 nt, Human
ugagccgagaucacgccacugcacuccagccugggcaacaagagugaaacuccgucuca

SEQ ID NO: 79273 - RNA, 59 nt, Human
ucacaugagucugucuccuuacuuuagucccugggcaauccuugcuuaaugcuuuuguu

SEQ ID NO: 79274 - RNA, 59 nt, Human
uggcuuugggccuaguaguucgaguccagccugggcagcauagugugagacccugucuc

SEQ ID NO: 79275 - RNA, 59 nt, Human
ugagccgagaucguaccauugcacuccagccugggcaacaagagcgaaacuccauuuca

SEQ ID NO: 79276 - RNA, 59 nt, Human
ugagccaagauugcaccacuguacuccagccugggcaacagagggagacuccaucuaga

SEQ ID NO: 79277 - RNA, 59 nt, Human
cugaagacuugcuuuuaaacaaagaaaauccugggcacuucugcagggcugcugguucc

SEQ ID NO: 79278 - RNA, 59 nt, Human
caaguuguccagcagcagaguggcccuggccugggcaucacaagccagugaugcuccug

SEQ ID NO: 79279 - RNA, 59 nt, Human
accagcaucauccuggggcccagcucaggccugggcauauggaaagaaccaucaucuug

SEQ ID NO: 79280 - RNA, 59 nt, Human
ggaucacuugaguccagguucaagacuagccugggcaacauggcaagacccugucccua

SEQ ID NO: 79281 - RNA, 59 nt, Human
ugaacugagaucacgacacugcacuccagccugggcaacaguaaaaccuggucuccaaa

SEQ ID NO: 79282 - RNA, 59 nt, Human
aaggccuguggacgacgcuggcggcccagccugggcagguuucagggugccagugggaa

SEQ ID NO: 79283 - RNA, 59 nt, Human
auggcuugaacacagguguucaaggccagccugggcaacauaacaagauccugucucuc

SEQ ID NO: 79284 - RNA, 59 nt, Human
gaaguguguuucuuccccuuacucucacaccugggcaaacuuucuucaguguuuuucau

SEQ ID NO: 79285 - RNA, 59 nt, Human
uaagcugagaucgcgccacugcccuccagccugggcaacagagcaagacuccaucucaa

SEQ ID NO: 79286 - RNA, 59 nt, Human
gcaggcagauauuuugagcccaggaccagccugggcaacauggugaaagcucaucucua

SEQ ID NO: 79287 - RNA, 59 nt, Human
uuugcaauaccugcauccccagcacugguccugggcacuuccccaccccagccaggugu

SEQ ID NO: 79288 - RNA, 59 nt, Human
guuauaaccuauggggucaggauaugaguccugggcauuauuuauccaggacccauccu

SEQ ID NO: 79289 - RNA, 59 nt, Human
ugagcugggaacucaggcuccuggaaaaaccugggcagugggaggcucagcugcgggcc

SEQ ID NO: 79290 - RNA, 59 nt, Human
gggcagcuccucuucuucugacucagagcccugggcagaucagcagauacaugucagug

SEQ ID NO: 79291 - RNA, 59 nt, Human
ugagccuugauugugucacugcacuccagccugggcaacagguaagacucugucucaaa

SEQ ID NO: 79292 - RNA, 59 nt, Human
aucaccugaggucaggaguucaagaucagccugggcaacauggcgaaaccccgucucua

SEQ ID NO: 79293 - RNA, 59 nt, Human
auguuaagaaauuuaaaaaaaaaaaaaagccugggcaugauggcucaugcuuguaaucu

SEQ ID NO: 79294 - RNA, 59 nt, Human
guagccgagaucgcgccacugcauuccagccugggcaacaaaagcgaaacucugucuca

SEQ ID NO: 79295 - RNA, 59 nt, Human
ugagcugagaucgcaccauugcacuccagccugggcaacaagagcgaaacucugucuca

SEQ ID NO: 79296 - RNA, 59 nt, Human
ggagcccgggcagccaccgucuccagagcccugggcagcauuuuccagcaagauguaca

SEQ ID NO: 79297 - RNA, 59 nt, Human
acugcuugagcccaggaguucaagaucagccugggcaacagagugagauaagacccaau

SEQ ID NO: 79298 - RNA, 59 nt, Human
cuucggagcugucagcgcccggugccugcccugggcaccucccugcagucaucucuuug

SEQ ID NO: 79299 - RNA, 59 nt, Human
aggguggccagccccgccaggaggccuggccugggcacacgcacugacgugggccuggg

SEQ ID NO: 79300 - RNA, 59 nt, Human
ugagcugagauugcgccacugcacuccagccugggcaacaagagcaaaacuccgucuca

SEQ ID NO: 79301 - RNA, 59 nt, Human
ugagccgagaucacaccacugcacuccagccugggcaacaagagcaaaacuccgucuca

SEQ ID NO: 79302 - RNA, 59 nt, Human
agugcuugaggccaggaguucaagaccagccugggcaacauagggagacccccaucuuu

SEQ ID NO: 79303 - RNA, 59 nt, Human
cccuuuguguaucuuaccuaguguuuacuccugggcacccuuaaucuucagaggugcua

SEQ ID NO: 79304 - RNA, 59 nt, Human
ugagccgagaucaugccacugcacuccagccugggcaacagagcaagacuccaucucga

SEQ ID NO: 79305 - RNA, 59 nt, Human
uccuccucucccucccggugagcugcugcccugggcagaggggaggagaauuccaggac

SEQ ID NO: 79306 - RNA, 59 nt, Human
uagacguucccugcccugggacgcucaccccugggcaagaggcuggaaguucacaccau

SEQ ID NO: 79307 - RNA, 59 nt, Human
gcguucucggggcugucgauuuccugccaccugggcagauaaccuggagauuuucaccu

SEQ ID NO: 79308 - RNA, 59 nt, Human
gggccccacccagacuuaacaggcaagguccugggcauugcgcgacgcaggacucaaug

SEQ ID NO: 79309 - RNA, 59 nt, Human
auugcuucagcccaggaguuugagaccagccugggcaacauagcaaaaccccaucucua

SEQ ID NO: 79310 - RNA, 59 nt, Human
gaucucuugagguaagaauuugagaccagccugggcaaaauagaccccaugucuacaaa

SEQ ID NO: 79311 - RNA, 59 nt, Human
gagccaaguucacaccacugccauuuccuccugggcaacagagugagacccuaucacaa

SEQ ID NO: 79312 - RNA, 59 nt, Human
aaagcaauuuuaacuugcagaugugagccccugggcacaaugagccgcuaaaugggagc

SEQ ID NO: 79313 - RNA, 59 nt, Human
ugagccgagaucgcgccacugcacuccagccugggcaacagagugagacucugucucaa

SEQ ID NO: 79314 - RNA, 59 nt, Human
uugagaagugaaacgguuugcgcagggguccugggcacgccugcggggucgcucaagga

SEQ ID NO: 79315 - RNA, 59 nt, Human
aucgcuugagcccaggaguuugagaccagccugggcaacauggcaaaaccccaucucua

SEQ ID NO: 79316 - RNA, 59 nt, Human
auugcuugaggccaggaguuugagaccagccugggcaacauagggagacccagucucua

SEQ ID NO: 79317 - RNA, 59 nt, Human
ugagccgagaucgugccacugcacuccagccugggcaacagagugagacuucgucucaa

SEQ ID NO: 79318 - RNA, 59 nt, Human
gaggagucauguuggagguuggggaagaaccugggcauccuuccccucaagccugggcu

SEQ ID NO: 79319 - RNA, 59 nt, Human
ucguacuaguugggcgagaccuaaaauucccugggcacagguugcaccugggugugagc

SEQ ID NO: 79320 - RNA, 59 nt, Human
agcuauagagacaggugcauucagaacauccugggcaccagucaugagucuuacugugu

SEQ ID NO: 79321 - RNA, 59 nt, Human
acauguccgaugggggcaggagcucccauccugggcagccaaccaggcaacaccaagga

SEQ ID NO: 79322 - RNA, 59 nt, Human
uuggggaugaggguugggugcuauggcauccugggcaggugcuuccuuucugcacaagg

SEQ ID NO: 79323 - RNA, 59 nt, Human
ugaucuaagaucaugccacugcacuccagccugggcaacagagugagacccuguuucua

SEQ ID NO: 79324 - RNA, 59 nt, Human
accgcuugaguccacgaguuuaagaccagccugggcaacauggugaagccccaucucua

SEQ ID NO: 79325 - RNA, 59 nt, Human
gugacgggcagcaacgccgucaaugucuuccugggcaucggccuggccugguccguggc

SEQ ID NO: 79326 - RNA, 59 nt, Human
ugggagauugcuugaguccaggagaccagccugggcaacauagcaaaaccucaucucua

SEQ ID NO: 79327 - RNA, 59 nt, Human
ugagccaagauugcgccauugcacuccagccugggcaacaagagagaaacucugucuca

SEQ ID NO: 79328 - RNA, 59 nt, Human
uggcagugcuguaccccugggcagugcuaccugggcacacacguagacaagggcagcua

SEQ ID NO: 79329 - RNA, 59 nt, Human
uaagggcauuucaguggcagugcuguaccccugggcagugcuaccugggcacacacgua

SEQ ID NO: 79330 - RNA, 59 nt, Human
ugagccaagauugcaccacugugcucccaccugggcaacagugagacccugucucaaaa

SEQ ID NO: 79331 - RNA, 59 nt, Human
aucacugaagcucaggaguucaagaccagccugggcaacauggcgaaacuccauuucua

SEQ ID NO: 79332 - RNA, 59 nt, Human
ucggacaccaggcugagcccggcgcagcaccugggcaguguccccaccccaggcccucc

SEQ ID NO: 79333 - RNA, 59 nt, Human
uggaccaguauuuguaauaaucgagaaugccugggcauuuuacaaaacaagaaaaaaaa

SEQ ID NO: 79334 - RNA, 59 nt, Human
caccagcccugcugcuuccuaacuuauugccugggcagugcccaccaugcaccccugau

SEQ ID NO: 79335 - RNA, 59 nt, Human
aucacuugagcccaggaguuugaggccagccugggcaacauggugaaacccggugucua

SEQ ID NO: 79336 - RNA, 59 nt, Human
cccagaagugagaaggcagccuucgaaguccugggcauugggugagaaagugaugcuag

SEQ ID NO: 79337 - RNA, 59 nt, Human
ggauguugcugcaggacaguaagcccucaccugggcaaacaugaagcucuggccuccuu

SEQ ID NO: 79338 - RNA, 59 nt, Human
ugggucuguuuuaacgugggccaagccuaccugggcagcccauuugccagggcuugccu

SEQ ID NO: 79339 - RNA, 59 nt, Human
ugagccgagaucgcgccacugcacuccagccugggcaacaagagugaaacuccgucuca

SEQ ID NO: 79340 - RNA, 59 nt, Human
cacggucacaugugcaucgccuuugagcuccugggcaagaacaccuuugaguuccugaa

SEQ ID NO: 79341 - RNA, 59 nt, Human
ugagcugagaucacgccauugcacuccagccugggcaacaagagcaaaacucagucuca

SEQ ID NO: 79342 - RNA, 59 nt, Human
ggcaacuauaacaucgaagacuuugccgaccugggcauguuuccaccguuuucugagua

SEQ ID NO: 79343 - RNA, 59 nt, Human
auagcuugaguccaggaguuugagaccagccugggcaacauagugauaccccaucucuu

SEQ ID NO: 79344 - RNA, 59 nt, Human
gguuaauaauaaaugggcucauuuaguugccugggcaccuauucacaaauucauuuguc

SEQ ID NO: 79345 - RNA, 59 nt, Human
uaacgucuaccuuuacaucugcuguugaaccugggcacuaccuguuacagauccuguca

SEQ ID NO: 79346 - RNA, 59 nt, Human
ugucaccagugauacccacugcccugaccccugggcaggccccucucugcaucuacugg

SEQ ID NO: 79347 - RNA, 59 nt, Human
auugcuugaacucaggaguuggagaccagccugggcaacauggcaaaacgcagucugua

SEQ ID NO: 79348 - RNA, 59 nt, Human
ugagccgagaucgcaccacugcacuccagccugggcaacagagugagacucugucuaaa

SEQ ID NO: 79349 - RNA, 59 nt, Human
aggggcuccugaguauaggcuuuucagucccugggcaguguccuugaguuguuuuuuga

SEQ ID NO: 79350 - RNA, 59 nt, Human
cuucuaggccugcccugccgccguggagcccugggcaagcucuuuccccuuucugggcc

SEQ ID NO: 79351 - RNA, 59 nt, Human
acccaggccgggcuagggacauggcagggccugggcauccuggcgcuggacuugggcga

SEQ ID NO: 79352 - RNA, 59 nt, Human
uuccucucucuccugcagaugcaagagcuccugggcaggggugccugggccccagggug

SEQ ID NO: 79353 - RNA, 59 nt, Human
gucacugcaguauucccaauugcacuggcccugggcauggccuuacccagucuaagcug

SEQ ID NO: 79354 - RNA, 59 nt, Human
cugagaugaccgcuguguggcgcucucucccugggcaggguggaugccacaggccccuc

SEQ ID NO: 79355 - RNA, 59 nt, Human
ccggccaccgcugucagggauugcccaccccugggcaucauguguguggggccggggag

SEQ ID NO: 79356 - RNA, 59 nt, Human
cccuaccuggcguccugguccaggggagcccugggcagaagcccccggccccuauacau

SEQ ID NO: 79357 - RNA, 59 nt, Human
ugagucgagaucgcgccagugcacuccagccugggcaagaagagcgaaacugggucuca

SEQ ID NO: 79358 - RNA, 59 nt, Human
ugaggaaaauaugaacuacagcagaagccccugggcagcugugauggagccccugacau

SEQ ID NO: 79359 - RNA, 59 nt, Human
cguucugacccguguccccccaggcucugccugggcagaagacucaccuuggaggagug

SEQ ID NO: 79360 - RNA, 59 nt, Human
acagugagcugagauugcgccacuguacuccugggcaacagcgagacuccgucucaaaa

SEQ ID NO: 79361 - RNA, 59 nt, Human
gacuuugccacggugcucugcugcccccuccugggcacguccaggugagggagggcugg

SEQ ID NO: 79362 - RNA, 59 nt, Human
cuguagacccguccugucgacugugugccccugggcaugugugagccucaguuuccuca

SEQ ID NO: 79363 - RNA, 59 nt, Human
agccugggaggaaggcggccgcuggggcuccugggcauccucucuggggagcugcuggc

SEQ ID NO: 79364 - RNA, 59 nt, Human
cucggggccuuggggugcaugggugccgcccugggcagcuagagugucucagcccggug

SEQ ID NO: 79365 - RNA, 59 nt, Human
ggagccaagaugaugccauugcacuccagccugggcaacaagagagaagguccuucuca

SEQ ID NO: 79366 - RNA, 59 nt, Human
ugagcugagaucacaccauugcacuccagccugggcaaaaagagcaaaacucucccuaa

SEQ ID NO: 79367 - RNA, 59 nt, Human
aaaagccugcuuuaaaccgcaagauggggccugggcaugcgcaggaggagccaucgggu

SEQ ID NO: 79368 - RNA, 59 nt, Human
ggggugagaacaucaaucgucagcgacagccugggcacccgcggggccgucccgccugc

SEQ ID NO: 79369 - RNA, 59 nt, Human
aucgcuugagaccaggaguucgagaccagccugggcagcauagcaagauccccaucuuu

SEQ ID NO: 79370 - RNA, 59 nt, Human
aucgcugcagcccaggaguucgagacuagccugggcaacauagcgagaccucgucucua

SEQ ID NO: 79371 - RNA, 59 nt, Human
auugcuugagcccaggaguuugagaccagccugggcaacacagcgagaccuugucucuu

SEQ ID NO: 79372 - RNA, 59 nt, Human
ccauccucacccagcacccacaacuagcgccugggcagggcagggcuggcaccucucaa

SEQ ID NO: 79373 - RNA, 59 nt, Human
ugaaccgagauagugccauugcacuccggccugggcaacagaggaagacugccucaaac

SEQ ID NO: 79374 - RNA, 59 nt, Human
ugagccaagauugcgccauugcacuccagccugggcaacacagcgagacuccgucucaa

SEQ ID NO: 79375 - RNA, 59 nt, Human
aucacuuaagcucaggaguucaaggccagccugggcaacauggcaaaaccccauuucua

SEQ ID NO: 79376 - RNA, 59 nt, Human
gcucgccagggaugugggcagagcaccagccugggcaucaggaagccaaguuucaagga

SEQ ID NO: 79377 - RNA, 59 nt, Human
ccuucccagaaacugccaguagagggcagccugggcauccuaaugcuuacucugguugu

SEQ ID NO: 79378 - RNA, 59 nt, Human
cagggagagggggcuggugggugccuaggccugggcaguggauggccgugaaugggugc

SEQ ID NO: 79379 - RNA, 59 nt, Human
uuuauaccuaaauaaagaaaaaucuuuagccugggcaacauagggagacccuaucucua

SEQ ID NO: 79380 - RNA, 59 nt, Human
ugagccaagaucgcaccauugcacuccagccugggcaacaagagugaaacucugucuca

SEQ ID NO: 79381 - RNA, 59 nt, Human
ugagcugagauugugccacuguacuccagccugggcaacaagagcgagacuccguuucc

SEQ ID NO: 79382 - RNA, 59 nt, Human
cccuguuccuuucuugcacgcgcucccugccugggcacaccaaacugguugaaacacag

SEQ ID NO: 79383 - RNA, 59 nt, Human
ugcacugugggcuggcucucugccccaacccugggcacuggccccuggcugggccauuu

SEQ ID NO: 79384 - RNA, 59 nt, Human
uuaggguggguaccucugagucccagggaccugggcaggcccaagcccaccacgagcau

SEQ ID NO: 79385 - RNA, 59 nt, Human
cgcaggccauuguugaacuccucuauacuccugggcacugguugacaguacugaggcuu

SEQ ID NO: 79386 - RNA, 59 nt, Human
gacacauccuccuaccguccccaaugcccccugggcaggaggcaguggagaaccaagcc

SEQ ID NO: 79387 - RNA, 59 nt, Human
aucgcuugaggccaagaguucaagaccagccugggcaacauagcgagaccccuaucugu

SEQ ID NO: 79388 - RNA, 59 nt, Human
agauacuguagacuggacaagaaauucuaccugggcaccuaggugaugccuucuuucuu

SEQ ID NO: 79389 - RNA, 59 nt, Human
ccaccaagguuuccucucuucccccaggaccugggcagagcaggcaugagcugggcugu

SEQ ID NO: 79390 - RNA, 59 nt, Human
gauauuguguggucugguuccugugugacccugggcaguuccuuaccucccuggucccc

SEQ ID NO: 79391 - RNA, 59 nt, Human
gaggucccucacuccacgggacagaggccccugggcagcagaggaaaccuacagcucug

SEQ ID NO: 79392 - RNA, 59 nt, Human
cuuggcccagccuccccacaaagccugacccugggcaggugagugacggguguguccuc

SEQ ID NO: 79393 - RNA, 59 nt, Human
cccuugcacccggccgggcucaguucaggccugggcaccgagcuucacccugggugggu

SEQ ID NO: 79394 - RNA, 59 nt, Human
gguacagcgggcugugcccggccccacccccugggcagaugucccccacugcuaaggcu

SEQ ID NO: 79395 - RNA, 59 nt, Human
gggggucagcagcaugucccugggcaggcccugggcacccugucuccccuggucucacu

SEQ ID NO: 79396 - RNA, 59 nt, Human
gcaggguggcggggggucagcagcaugucccugggcaggcccugggcacccugucuccc

SEQ ID NO: 79397 - RNA, 59 nt, Human
auugcuugagcccaggaguucaagagcagccugggcaauauagaaagaccucuucccua

SEQ ID NO: 79398 - RNA, 59 nt, Human
ccugaaacucccuuuccaggacucucaucccugggcacagaauucaggaaacugcuaga

SEQ ID NO: 79399 - RNA, 59 nt, Human
gccagggaaucugcauuucuaacgcgcucccugggcaacgcuucagaugcguugaaguu

SEQ ID NO: 79400 - RNA, 59 nt, Human
ugagcuauaauugcaucauugcacuccagccugggcaacagagacccugucucaaccac

SEQ ID NO: 79401 - RNA, 59 nt, Human
caaggaauauaaaaaccaccacccuccagccugggcaacguaguaaaaccucaucuaua

SEQ ID NO: 79402 - RNA, 59 nt, Human
ugagccgagauugugccacugcacuccagccugggcaacagagcuagacucugugucaa

SEQ ID NO: 79403 - RNA, 59 nt, Human
ugaguugagauugugccauugcacuccagccugggcaacagagcaagacucugucucag

SEQ ID NO: 79404 - RNA, 59 nt, Human
gugccuuagaaucgccccuggacagaguuccugggcagaggggaaagcagcucccaggc

SEQ ID NO: 79405 - RNA, 59 nt, Human
aucauuugagcccaggaguucgagaccaaccugggcaacauagugagauucuguuaaaa

SEQ ID NO: 79406 - RNA, 59 nt, Human
gugcauucacacucuuguucccuagaaagccugggcaccucccacucgauuccugcucc

SEQ ID NO: 79407 - RNA, 59 nt, Human
cccaaauucagugucagugaaguucuuuuccugggcaaucuuaacaucuuuacucuuau

SEQ ID NO: 79408 - RNA, 59 nt, Human
ggccuaggggugcagggucagugcugaggccugggcagggccgcuagccucccugagcu

SEQ ID NO: 79409 - RNA, 59 nt, Human
cagguagauucagaccuuguccacaccuuccugggcaacccccaccaugaaccugucag

SEQ ID NO: 79410 - RNA, 59 nt, Human
cacaaucagaaccagccaaagaagcacuuccugggcacggccaccagcucucccgccuc

SEQ ID NO: 79411 - RNA, 59 nt, Human
gugaacggaccaugcuuccguagcucugaccugggcagcuuggaccuggucauccucua

SEQ ID NO: 79412 - RNA, 59 nt, Human
gauuugcugcugaugaaaauacucaguuuccugggcauuaagucuaagagagaggagcc

SEQ ID NO: 79413 - RNA, 59 nt, Human
aaaucccugccuucuugagcuaacauucuccugggcauccccacuccauuuucagauga

SEQ ID NO: 79414 - RNA, 59 nt, Human
caagugcccaguggagccugccgcccccgccugggcaccgggacccccucaccauccag

SEQ ID NO: 79415 - RNA, 59 nt, Human
uuccuuucuccugccccaagggcccagacccugggcaaacagagcuacugagacuugga

SEQ ID NO: 79416 - RNA, 59 nt, Human
ggcaccccagugguggcagagcuugggggccugggcaggggcccgcuuggcgggccggg

SEQ ID NO: 79417 - RNA, 59 nt, Human
uuggcugugggcugugaacauuccgggacccugggcaucuuaucuagguccgugcagcc

SEQ ID NO: 79418 - RNA, 59 nt, Human
agugggggaggaggagagggaagauggucccugggcacuguggcagcuaaccacaggaa

SEQ ID NO: 79419 - RNA, 59 nt, Human
aggcccuggagaccuccaggcuuuccugcccugggcagccccaccucacagccagaguc

SEQ ID NO: 79420 - RNA, 59 nt, Human
acaggcucagaggguguccugcaccggggccugggcaggagggaggugcuucuaguucu

SEQ ID NO: 79421 - RNA, 59 nt, Human
agaguggggcagcugugugagucccacauccugggcagagggccugguggggccccuug

SEQ ID NO: 79422 - RNA, 59 nt, Human
ugagccgagauccugccacugcacuccagccugggcaaccaagcgagacucugccuuaa

SEQ ID NO: 79423 - RNA, 59 nt, Human
ugagucaagaucacgccauugcacuccagccugggcaacaagagcgaaacuccaucuca

SEQ ID NO: 79424 - RNA, 59 nt, Human
auuacuugaaacccacaguuugagaccagccugggcaacauagugagacccugucucua

SEQ ID NO: 79425 - RNA, 59 nt, Human
agcagcaauuuccagcuguguaacacuauccugggcaaauguuuuacccuguccuccag

SEQ ID NO: 79426 - RNA, 59 nt, Human
caucuuggugacuuugaauuuaucuggcuccugggcaggucuucuccuccucuccaucc

SEQ ID NO: 79427 - RNA, 59 nt, Human
acaguagauguggaacaccuagcccagugccugggcaggucccuauuaucauaaaugaa

SEQ ID NO: 79428 - RNA, 59 nt, Human
auccaccaacagaaugugguuucugccauccugggcagaagcugaaggccagcuucaca

SEQ ID NO: 79429 - RNA, 59 nt, Human
gguggggggugcuucugugcccacgggucccugggcaacagucccuaggcuaagacagg

SEQ ID NO: 79430 - RNA, 59 nt, Human
ccaaggucggccuaaaggauggcgcagguccugggcaggaaagaauuuuuccuuuauca

SEQ ID NO: 79431 - RNA, 59 nt, Human
gacaggaauuaaggcaaugcccaggcgggccugggcacuguauucugagcaaaggccug

SEQ ID NO: 79432 - RNA, 59 nt, Human
ugagccgagauugcgccauugcacuccagccugggcaaaaagagugagacucugucuca

SEQ ID NO: 79433 - RNA, 59 nt, Human
gaggauugagaccaggaguucgagaagagccugggcaacauagugagaccccaucucua

SEQ ID NO: 79434 - RNA, 59 nt, Human
aucacuugagcucaggaguccuaaaccagccugggcaacauagugauaccuugucucua

SEQ ID NO: 79435 - RNA, 59 nt, Human
uguuuuacuuguuaacuuguucuugugccccugggcacuuggccuuugucugcucucag

SEQ ID NO: 79436 - RNA, 59 nt, Human
cgagcugagaucacgccacugugcuccagccugggcaacaaagugagacucugucucaa

SEQ ID NO: 79437 - RNA, 59 nt, Human
ucugcguggggcuccaccucacacccaccccugggcaucuuaggacuggaggggcuccu

SEQ ID NO: 79438 - RNA, 59 nt, Human
uugcccaccuuuggcugauacccagagaaccugggcacuugcugccugaugcccacccc

SEQ ID NO: 79439 - RNA, 59 nt, Human
caccugacuuggcuggggaggaccagggcccugggcagggcagggcagccugucacccg

SEQ ID NO: 79440 - RNA, 59 nt, Human
acaccucccuccccacaccucccuacuccccugggcaucuucuggcuugacuggaugga

SEQ ID NO: 79441 - RNA, 59 nt, Human
acacuggccccaggucucaggagggguguccugggcagggaaggucagugucacugaug

SEQ ID NO: 79442 - RNA, 59 nt, Human
uaagccaagaucaugccauugcacuccagccugggcaacacagggagacuccaucucaa

SEQ ID NO: 79443 - RNA, 59 nt, Human
gacugggacaucccugauagguucacaucccugggcagaguaccaggcugcugacccuc

SEQ ID NO: 79444 - RNA, 59 nt, Human
agcacguggagcucuuggcuggggcugacccugggcagggacuuuccugcagggccaga

SEQ ID NO: 79445 - RNA, 59 nt, Human
auguucucauuuaccacaggccuaccagcccugggcacagcagcuucauggcaagacau

SEQ ID NO: 79446 - RNA, 59 nt, Human
cucauguggggguguccugggcugaauuuccugggcacuucucaguggaacucucuagc

SEQ ID NO: 79447 - RNA, 59 nt, Human
ggggaggaaacucaccugcuggccccucaccugggcaccuggggagugggacagagucu

SEQ ID NO: 79448 - RNA, 59 nt, Human
gggaaccuggaaggaggcucuuugugagaccugggcaaaggauggggcagcucgucgau

SEQ ID NO: 79449 - RNA, 59 nt, Human
acauuugguugggaaaugucccucaaaauccugggcacuaugaaggaacccccugcccc

SEQ ID NO: 79450 - RNA, 59 nt, Human
ugggggaguguccuggcagcagcgagugaccugggcaguggccaggugggugcgaugac

SEQ ID NO: 79451 - RNA, 59 nt, Human
gggaggauccauugagcccagcaguccaaccugggcaaaauagugagagacccuguauc

SEQ ID NO: 79452 - RNA, 59 nt, Human
ugagcugagauugugccacugcacuccagccugggcaacaaagcaagacucugucucaa

SEQ ID NO: 79453 - RNA, 59 nt, Human
ugagccaagaucaugucacugcauuccagccugggcaacagaggaagacuccgucucaa

SEQ ID NO: 79454 - RNA, 59 nt, Human
auauucagcccacugcccaaugccugcuuccugggcauagccauggaacccugccaggc

SEQ ID NO: 79455 - RNA, 59 nt, Human
cuccuucuccucuuccugacccucccuccccugggcagaagaaacgcauguggaccaga

SEQ ID NO: 79456 - RNA, 59 nt, Human
gcuucucuuugugcaguguuaguauucacccugggcagugagugccaugcuuuuuggug

SEQ ID NO: 79457 - RNA, 59 nt, Human
aggaaauaaugggaaagguugaauuaauuccugggcauggacuaccagaugaccacaag

SEQ ID NO: 79458 - RNA, 59 nt, Human
ugagcccagauugcaccacugcucucuagccugggcaaaaaaacuaguuccaaaaaaga

SEQ ID NO: 79459 - RNA, 59 nt, Human
ucuaugaaagccuccucgagccaggugcuccugggcaccuucagaagugauguccugug

SEQ ID NO: 79460 - RNA, 59 nt, Human
cuguguguuaucucugccccacagcagccccugggcagcaccaguggccacugggcucc

SEQ ID NO: 79461 - RNA, 59 nt, Human
ggagaaaugaggaugucugucccugucugccugggcaggccagauuccuccccagcagc

SEQ ID NO: 79462 - RNA, 59 nt, Human
agcuuuuggugaaggaucugccaggguguccugggcagagugagcguggagggccggug

SEQ ID NO: 79463 - RNA, 59 nt, Human
ugagccaagaguacaccacugcacuccagccugggcaacagagcgagacuccgucuuaa

SEQ ID NO: 79464 - RNA, 59 nt, Human
ggcagugcucccggaggggcccaggaaggccugggcagagacccuguaggaugggguca

SEQ ID NO: 79465 - RNA, 59 nt, Human
cugggggagagcaguggguucugggggggccugggcaggaucccagcucccuccccucu

SEQ ID NO: 79466 - RNA, 59 nt, Human
aucacuugagcccaggaguucaaaaccagccugggcaauauagugagaccguaucacua

SEQ ID NO: 79467 - RNA, 51 nt, Human
uagaccccuguggccccugagccugggcagguggggacccaacuccacccc

SEQ ID NO: 79468 - RNA, 59 nt, Human
gucugaugcccuguccaaugugaggacugccugggcagggucugccccucccaccccuc

SEQ ID NO: 79469 - RNA, 59 nt, Human
ggaagagcgggcagaguggcccagcccccccugggcagggagagggccaaggacaauug

SEQ ID NO: 79470 - RNA, 52 nt, Human
acaagcuccugaaggagugaggccugggcagagcacacucagcaggauagag

SEQ ID NO: 79471 - RNA, 59 nt, Human
ucagggauaugagcagggccugcccagagccugggcaccuuugggagagggaaaaguga

SEQ ID NO: 79472 - RNA, 59 nt, Human
agaucgccacacucugugaggcagcagagccugggcagguguuuggcuuaguauuuguu

SEQ ID NO: 79473 - RNA, 59 nt, Human
gacccuacccccaccucagguugggcuucccugggcacucaugcuccacaccaaagcag

SEQ ID NO: 79474 - RNA, 59 nt, Human
cagcccucucaccccagggccuguggcugccugggcaccucucccaggaaguggugggg

SEQ ID NO: 79475 - RNA, 59 nt, Human
uugauugugccagcccaugccacccccauccugggcacaguuacacccucccaugcagu

SEQ ID NO: 79476 - RNA, 59 nt, Human
ugagccgagauugcaccauugcaccccagccugggcaacagagcgagacuccgucucaa

SEQ ID NO: 79477 - RNA, 59 nt, Human
gggauaguguucugcuccugcuuuucuguccugggcauggguccagggccugacacccc

SEQ ID NO: 79478 - RNA, 59 nt, Human
ccuggugccgauggccccacccucaccagccugggcagcagcaagaacuauuuauuaaa

SEQ ID NO: 79479 - RNA, 59 nt, Human
auggccucccugccccucugcuggcacagccugggcaaggggagaagguggucccugca

SEQ ID NO: 79480 - RNA, 59 nt, Human
auuccuugagcacaggaguuccagaccagccugggcaauguagcaagacgcugucucua

SEQ ID NO: 79481 - RNA, 59 nt, Human
gcagggaggaggcggagguggcaaauaaaccugggcaauuuuguuuauacaaaaaauag

SEQ ID NO: 79482 - RNA, 59 nt, Human
ugagccgagauugcgccacugcgcuccagccugggcaacagagcgagacuccaucucaa

SEQ ID NO: 79483 - RNA, 59 nt, Human
ucccaauucggggccugcuggaguuccggccugggcaccagcauuuggcagcacgcagg

SEQ ID NO: 79484 - RNA, 59 nt, Human
cuguccucucuccucucaggagagucuggccugggcaaauccacacuugucaauagccu

SEQ ID NO: 79485 - RNA, 59 nt, Human
uuccugagggccggccacauucccgcccuccugggcagauuggguagaaaggacauucu

SEQ ID NO: 79486 - RNA, 59 nt, Human
ugcuuguagcuuugauguggaacaggggcccugggcauuucugcugagaaccaaacugc

SEQ ID NO: 79487 - RNA, 59 nt, Human
aucgcuugagccugggaguucaagaccagccugggcaacauggcaagacccugucucua

SEQ ID NO: 79488 - RNA, 59 nt, Human
ccauugcagagcaagcugccacgaagaccccugggcaugauuuugcuuguauuuccgga

SEQ ID NO: 79489 - RNA, 59 nt, Human
acagggguugaggggaccuccucagaggcccugggcacgggaggggguggggcugggcg

SEQ ID NO: 79490 - RNA, 59 nt, Human
ggccaaggagggcuuuucugugggaugggccugggcacgcggcccucuccugucagugc

SEQ ID NO: 79491 - RNA, 59 nt, Human
aggaagaacauuuggugggaaugaacacuccugggcauaccgcugacuuuugucccuug

SEQ ID NO: 79492 - RNA, 59 nt, Human
aucacuugaggucaggaguucaagaccagccugggcaacauggcgaaacccugucucua

SEQ ID NO: 79493 - RNA, 59 nt, Human
ugagccaagaucacgccacugcacuccagccugggcaacggagugagacucugucucaa

SEQ ID NO: 79494 - RNA, 59 nt, Human
auugcuugaacccaggaguucaagaccagccugggcagcauggugaaacccuguaucua

SEQ ID NO: 79495 - RNA, 59 nt, Human
ugagcugugaaugcaccacggcacucaagccugggcaauguagcaagauccugucucua

SEQ ID NO: 79496 - RNA, 59 nt, Human
ugagccaagaucaugccacugcacuccagccugggcaacagagugagacuccgucucaa

SEQ ID NO: 79497 - RNA, 59 nt, Human
agugagccgagauugccacugcacuccagccugggcaacaagagcgaaacuccgucuca

SEQ ID NO: 79498 - RNA, 59 nt, Human
uggacacgcucaguggggcagaggcaguaccugggcaagcuggcggcuggggucccagc

SEQ ID NO: 79499 - RNA, 59 nt, Human
ugaccuuguuucuugaagguuuccucgucccugggcaauuccgcauuuaauucauggua

SEQ ID NO: 79500 - RNA, 59 nt, Human
ugaguugugauugcaccacugcccuccagccugggcaacagagugaaaccuugucucuc

SEQ ID NO: 79501 - RNA, 59 nt, Human
cacccgccacccacccuggagcccgccggccugggcaggggguccaggugggccacaca

SEQ ID NO: 79502 - RNA, 59 nt, Human
gaugggagggggugcugagcugugaauccccugggcagggggcgacaacuccguguagc

SEQ ID NO: 79503 - RNA, 59 nt, Human
caggagccccaucuccgggcgugucaccuccugggcaggguucugggacccucuguggg

SEQ ID NO: 79504 - RNA, 59 nt, Human
agccccaaggccagaccaaggcauguaggccugggcagguggcucggggccacuggcgg

SEQ ID NO: 79505 - RNA, 59 nt, Human
gagggugaaggagcuggggcaggccccauccugggcauuggagaugaugaaaccgagca

SEQ ID NO: 79506 - RNA, 59 nt, Human
ugauccaagaucaugccacugcacuccagccugggcaacaagagcaaaacuccgucuca

SEQ ID NO: 79507 - RNA, 59 nt, Human
ucagcucagauugcaccacugcacuccagccugggcaacagagcgagacccugucucca

SEQ ID NO: 79508 - RNA, 59 nt, Human
gagaccucccuucccugggccccuucucuccugggcagccacaccacagagcggggagg

SEQ ID NO: 79509 - RNA, 59 nt, Human
cucuagcuucagccagggcggguacacacccugggcacaggguccucagcccccgggaa

SEQ ID NO: 79510 - RNA, 59 nt, Human
ggaggggaaacuccaucaggaagugcuccccugggcagaggcgcccacugggugcugug

SEQ ID NO: 79511 - RNA, 59 nt, Human
cuuuugccgcuccggggaccagcagcaauccugggcagccaguggcucuuguagagaag

SEQ ID NO: 79512 - RNA, 59 nt, Human
gcucugcccgaggauguggccguucccugccugggcaggggcuccaaggaggggccauc

SEQ ID NO: 79513 - RNA, 59 nt, Human
caauaaugguguauacccucauucucauuccugggcagcccuuccuuccacccuggcac

SEQ ID NO: 79514 - RNA, 59 nt, Human
ugucagggggagagguggagggcagauguccugggcaaaccgggccccucugcccacac

SEQ ID NO: 79515 - RNA, 59 nt, Human
ugagcuaugauuaugccacugcuuuccagccugggcaacauaguaagaccccaucucuu

SEQ ID NO: 79516 - RNA, 59 nt, Human
ugagccaugaucgagccacugcacuccagccugggcaacagaugaagacccuauuucag

SEQ ID NO: 79517 - RNA, 59 nt, Human
ugagccgagguugcaccauuguacuccagccugggcaacaagagugaaacucugucuua

SEQ ID NO: 79518 - RNA, 59 nt, Human
gugagccgaggucacaccauucacuccagccugggcaacaagagcgaaacuccguuuca

SEQ ID NO: 79519 - RNA, 59 nt, Human
ugagccaagauugugccauugcacucuagccugggcaacaggagcaaaacuccgucuca

SEQ ID NO: 79520 - RNA, 59 nt, Human
cccugcccugagcugcaugguucccccacccugggcagccaggaaggaaucugaaugga

SEQ ID NO: 79521 - RNA, 59 nt, Human
ugggaggagguccuggggcgugcacccgcccugggcaguggggaggagaguggccugag

SEQ ID NO: 79522 - RNA, 59 nt, Human
aucacuuagagcuaggaguuugagaccagccugggcaauauagcaagaccccucacuac

SEQ ID NO: 79523 - RNA, 59 nt, Human
ugagccgagauugcgccacugcacuccagccugggcaacagagugaaacucugucucaa

SEQ ID NO: 79524 - RNA, 59 nt, Human
auugcuugaagccaggaguuugggaccagccugggcaacauagggggaucccaucucua

SEQ ID NO: 79525 - RNA, 59 nt, Human
ugagcuaugauuguaccacugcacuccagccugggcaacagagcaagaccuugucucaa

SEQ ID NO: 79526 - RNA, 59 nt, Human
gagacaccguggcgucucaugugaacuuuccugggcacugugguuuuauuuccuaauug

SEQ ID NO: 79527 - RNA, 59 nt, Human
cagagggccccugggcugcgcggccccagccugggcacccugauuuuuaagccauagac

SEQ ID NO: 79528 - RNA, 50 nt, Human
gggguaggguccggcagugaccugggcaggggccucgcuuucccaccucc

SEQ ID NO: 79529 - RNA, 59 nt, Human
ugagcugagaucgcgccauugcacuccagccugggcaacaagaguggcacuccaucuca

SEQ ID NO: 79530 - RNA, 59 nt, Human
gaagagauagcuauuaaaauaaucaguagccugggcauaguggcucacaccuguaaucc

SEQ ID NO: 79531 - RNA, 59 nt, Human
acugcuugaguccagaaguuuaagaccagccugggcaacacggggagacccugucucua

SEQ ID NO: 79532 - RNA, 59 nt, Human
gguacacgcgcguuuccagugcacaucugccugggcaggacacgguuuccucuugcugg

SEQ ID NO: 79533 - RNA, 59 nt, Human
augagcaagauugugccacugcacuccagccugggcaacagagcaagacucugucucaa

SEQ ID NO: 79534 - RNA, 59 nt, Human
cagcuuggccuugaugaccucuguuucuuccugggcagguccuggagcggcuguuccag

SEQ ID NO: 79535 - RNA, 59 nt, Human
ccaacacccccgacggccuccaggaggggccugggcagccccacagucccauuccucca

SEQ ID NO: 79536 - RNA, 59 nt, Human
ugaaccuagaucacgccacugcauuccagccugggcaacagagcgagacuccaucuuaa

SEQ ID NO: 79537 - RNA, 59 nt, Human
acuguggaaagacaggaguucgaaaccagccugggcaacauagugagacccugccucau

SEQ ID NO: 79538 - RNA, 59 nt, Human
ucccacuaaggccugcccaccaccgcccgccugggcagccaugaauguagcgccccagg

SEQ ID NO: 79539 - RNA, 59 nt, Human
agcccgccaugccacaaggugggggaggcccugggcaggauguucacucuauuuauugg

SEQ ID NO: 79540 - RNA, 59 nt, Human
aucacuuaaggccaggaguucgagaccagccugggcaacagcaagaccucaucucuaca

SEQ ID NO: 79541 - RNA, 59 nt, Human
gaggaucacucgagcucaagaauucaagaccugggcaagagagagagacuuugucucua

SEQ ID NO: 79542 - RNA, 59 nt, Human
auggcuugagcccaggaguucgagaccagccugggcaacacagcgagaucucuuggggg

SEQ ID NO: 79543 - RNA, 59 nt, Human
aguaggaguuaguuaggcauugaguuugcccugggcaaaagcccagaagugggaguaug

SEQ ID NO: 79544 - RNA, 59 nt, Human
ugagccgagaucgugccacuguacuccagccugggcaacaaggcgagacuccaucucaa

SEQ ID NO: 79545 - RNA, 59 nt, Human
agguggagcagcuggggcugggggcacagccugggcauucuguggggaggccguccucg

SEQ ID NO: 79546 - RNA, 59 nt, Human
aucguuugaggccaggaggucaauaccagccugggcaacauaguaagacccugucucua

SEQ ID NO: 79547 - RNA, 59 nt, Human
cucccagcugcuuuacuaaaggggaaguuccugggcaucuccguguuucucuuuguggg

SEQ ID NO: 79548 - RNA, 56 nt, Human
cuccauucaggguaaccugacugaguccugggcagaugauaacccccgacaccaug

SEQ ID NO: 79549 - RNA, 59 nt, Human
agaguccugcuguugauccucacauguuuccugggcaccuaacucugucagccacugcc

SEQ ID NO: 79550 - RNA, 59 nt, Human
ugagcugagaucucaccacugcacuccagccugggcaacagagcgagacucugucucaa

SEQ ID NO: 79551 - RNA, 59 nt, Human
aucuaaauguuuguggauuccugugucucccugggcaguugaccugcacagacaggaac

SEQ ID NO: 79552 - RNA, 59 nt, Human
auugccugagcucaggaguucaagaccagccugggcaacauggugaaaucccaugucua

SEQ ID NO: 79553 - RNA, 59 nt, Human
uucauuggaggccaggaguuagagaucagccugggcaacauagccagaccuccucucua

SEQ ID NO: 79554 - RNA, 59 nt, Human
aucccugaggccaugagggugggagccggccugggcagcuccaacuccagagaagggua

SEQ ID NO: 79555 - RNA, 59 nt, Human
ugagcugagaucacacuacugcacuccagccugggcaacagagcaagacugucucaaaa

SEQ ID NO: 79556 - RNA, 59 nt, Human
caucacuugaaccaggaguucaguacuaaccugggcaacaaagaggccccugucucuga

SEQ ID NO: 79557 - RNA, 59 nt, Human
gcuccuguugcuuucacguagagucucggccugggcagucacgugguggucacuccugg

SEQ ID NO: 79558 - RNA, 59 nt, Human
gggccaggccccgacccuguugugacccaccugggcaccuucccggaccagcuccgccu

SEQ ID NO: 79559 - RNA, 59 nt, Human
gagccuguccuggcugcuggcccauccugccugggcaucccuggugcuggggacugugc

SEQ ID NO: 79560 - RNA, 59 nt, Human
ugcucggaagagcucacugccagcugcggccugggcaccgcgggccauguguguuugca

SEQ ID NO: 79561 - RNA, 59 nt, Human
gcacgcaaugcuagcugccccuuucccguccugggcaccccgagucucccccgaccccg

SEQ ID NO: 79562 - RNA, 59 nt, Human
cacaaggaauccgagaccccgcacagcccccugggcacccggcauggggccuggggccc

SEQ ID NO: 79563 - RNA, 59 nt, Human
ugagccaagaucgcaccauugcacuccagccugggcaacaagagcgaaacucugucuca

SEQ ID NO: 79564 - RNA, 59 nt, Human
acccaccugggaggccgaggaggagguccccugggcacagggccucuuugggacuucag

SEQ ID NO: 79565 - RNA, 59 nt, Human
cguggacccccagguugcaaguuacauacccugggcauguccagaugaacgaagcgugc

SEQ ID NO: 79566 - RNA, 59 nt, Human
agagcuaugauugcaccacugcacuccagccugggcaacaaagcaagacccugucucuu

SEQ ID NO: 79567 - RNA, 59 nt, Human
gaagccuccuauaacaaagggugguguggccugggcauuggagucaauaaauuaugguc

SEQ ID NO: 79568 - RNA, 59 nt, Human
ugagcuugagccuagacguuaaagaccagccugggcaacacagcaagacccaucucuac

SEQ ID NO: 79569 - RNA, 59 nt, Human
cgcccccgccccgccccagagcugggcccccugggcagguuccccaccccgccccaccg

SEQ ID NO: 79570 - RNA, 59 nt, Human
acugcuuaagcccaggaguucaagaccagccugggcaacauagugagacucuguuauaa

SEQ ID NO: 79571 - RNA, 59 nt, Human
ugagccaagaucgcgccacugcacuccagccugggcagcaagagcaaaacaaccucugu

SEQ ID NO: 79572 - RNA, 59 nt, Human
auauuugcaggagcgugguucuaccacccccugggcauacauaaaucgacacaugccaa

SEQ ID NO: 79573 - RNA, 59 nt, Human
auugcuugaccucaggaauuugaggccugccugggcaaaauggugaaaccaugucucua

SEQ ID NO: 79574 - RNA, 59 nt, Human
augguuggaagaugguaucagagggccugccugggcagucugucuccgggccaggguca

SEQ ID NO: 79575 - RNA, 59 nt, Human
ccugugaagggaaaugagggcuuuaguuuccugggcagggaggggcagcuucugagguu

SEQ ID NO: 79576 - RNA, 59 nt, Human
gggcugguggcccaggccagggagggaacccugggcagggcucuggugggagagggaga

SEQ ID NO: 79577 - RNA, 59 nt, Human
aucgcuugagcccagagguucgagaucaaccugggcaagagagugagacccugacucua

SEQ ID NO: 79578 - RNA, 59 nt, Human
agagcuaugacugcaucacugcacuccagccugggcaacacagcaagauccugucuaaa

SEQ ID NO: 79579 - RNA, 59 nt, Human
acugcuuaagcucaggaguuugagaccagccugggcaacauagcaagacccccaccauc

SEQ ID NO: 79580 - RNA, 59 nt, Human
cccguucaacucccuguugucccuuccauccugggcaaaacugaaagggacccggagcu

SEQ ID NO: 79581 - RNA, 59 nt, Human
ggccuagcauugcuuacauccacccugugccugggcagccacuucuguucuuggacaga

SEQ ID NO: 79582 - RNA, 59 nt, Human
ugagccaagauugcgccuuugcacuccagccugggcaagagagcaagacucugucucaa

SEQ ID NO: 79583 - RNA, 59 nt, Human
caagguucgcaccuccuggagcagcagcgccugggcaguccucugggcuggccucggga

SEQ ID NO: 79584 - RNA, 59 nt, Human
ugagccgagaucacgccauugcacuccagccugggcaacaagagcaaaacucuaucuca

SEQ ID NO: 79585 - RNA, 59 nt, Human
ggccccccacucccaaugagcagcccaggccugggcaaaaagcgcaaaguguccuugcu

SEQ ID NO: 79586 - RNA, 59 nt, Human
aucacuggagcucgggaguucaagaccagccugggcaacauagugaaaccgucuccaca

SEQ ID NO: 79587 - RNA, 59 nt, Human
aucaguugagccccagaguucaagaccagccugggcaauguaguaagacccccaucgcu

SEQ ID NO: 79588 - RNA, 59 nt, Human
ugaaccaagaucaugccacugcacuccagccugggcaacacagcgagacuccgucucaa

SEQ ID NO: 79589 - RNA, 59 nt, Human
uuuggagauccuagauggcugccugcuuuccugggcacucauggugaaaugacaggcaa

SEQ ID NO: 79590 - RNA, 59 nt, Human
ugggccacuuuggagagacagaaucuaguccugggcaacuucacauccguccuccuguc

SEQ ID NO: 79591 - RNA, 59 nt, Human
gccacuccuuggccucccccagccaggggccugggcaggaaagauggggugguggacug

SEQ ID NO: 79592 - RNA, 59 nt, Human
ugagccgagauugagccauugcacuccagccugggcaacaacagcaaaacuccaucuca

SEQ ID NO: 79593 - RNA, 59 nt, Human
aucucuugagcucaggaguucaagaucagccugggcaacacagugagaccucaucucca

SEQ ID NO: 79594 - RNA, 59 nt, Human
auugcuugagcccaggaguucaagaccagccugggcaacauagugagaccugcccccua

SEQ ID NO: 79595 - RNA, 59 nt, Human
acugcuugaggccagaaguuggagaccagccugggcaaguggacaccucauuuuuacua

SEQ ID NO: 79596 - RNA, 59 nt, Human
ugagccaagauggcaccauugcacccuagccugggcaacagagcaagacaccgucuuaa

SEQ ID NO: 79597 - RNA, 59 nt, Human
ugagccgagauugugccacggcacuccagccugggcagcagagugagacucucucucaa

SEQ ID NO: 79598 - RNA, 59 nt, Human
ccugcucccccaucccccauccucccagaccugggcaggagcugugcugggagaaaggg

SEQ ID NO: 79599 - RNA, 59 nt, Human
ugagccgagauugcgccacugcacuccagccugggcagcagagcaacacucugucucaa

SEQ ID NO: 79600 - RNA, 59 nt, Human
ugagccaugauugcaccacugcacuccagccugggcaacagagggagcccccgucucaa

SEQ ID NO: 79601 - RNA, 59 nt, Human
auugauugaggccaggaguucaagaccagccugggcaacauggugagaccccaucucua

SEQ ID NO: 79602 - RNA, 59 nt, Human
ugagccgagaucgucccacugcacuccagccugggcaacagagugagacucuguuucua

SEQ ID NO: 79603 - RNA, 59 nt, Human
uggaucacaagucaggaguucaagaccagccugggcaagauggugaaaccccaucucua

SEQ ID NO: 79604 - RNA, 59 nt, Human
agaacugaguucaacuccaucuaugccagccugggcaacagagcgagacuccaacucag

SEQ ID NO: 79605 - RNA, 59 nt, Human
aucacuugagcccgcaaguuugagaccacccugggcaacauagcgagacuaccucuaca

SEQ ID NO: 79606 - RNA, 59 nt, Human
gugaggcaaaaucgugccacugcccucagccugggcaguagagucagucuccaucucaa

SEQ ID NO: 79607 - RNA, 59 nt, Human
gucacgugggccccgguacucaagaccagccugggcagaauggugaaaccaccuucucu

SEQ ID NO: 79608 - RNA, 59 nt, Human
uuaauggagaucauuccauuacacuccagccugggcaccaggaacgaaacucguucuca

SEQ ID NO: 79609 - RNA, 59 nt, Human
ugagccaagaucaugccacugcacuccagccugggcaacaagaacaaaacuccaucuaa

SEQ ID NO: 79610 - RNA, 59 nt, Human
ugagccaagaucgugccaaugcacuccauccugggcaaaaagagcaaaacuccaucuua

SEQ ID NO: 79611 - RNA, 59 nt, Human
gugagcgagaucaugccauugcacuccagccugggcaacaggagugaaacuccaucucc

SEQ ID NO: 79612 - RNA, 59 nt, Human
cacugcacuuccccaaaacggaaggggccccugggcaguggguuuugggcaaauucccu

SEQ ID NO: 79613 - RNA, 59 nt, Human
aucgcuugagcccaggaguucaagaccagccugggcaacauagugagaccccaucucua

SEQ ID NO: 79614 - RNA, 59 nt, Human
acuucugcccuggcucuuccccaucuaggccugggcaggaacauauauuauuuauuuaa

SEQ ID NO: 79615 - RNA, 59 nt, Human
ugugcaagacccagccugucacgacagagccugggcacuucagaggaggagccaggauc

SEQ ID NO: 79616 - RNA, 59 nt, Human
ugagccaauauugcaccauugcacuccugccugggcaacaagagcaaaauuucaucuca

SEQ ID NO: 79617 - RNA, 59 nt, Human
ucacuugagaccaggaguugugaggucaaccugggcaauauagggagauccugucucua

SEQ ID NO: 79618 - RNA, 59 nt, Human
auugcuugaggccaggaguuccagaucaaccugggcaacaugaugagaccccaucucua

SEQ ID NO: 79619 - RNA, 59 nt, Human
gugcucuuccaggaugcugccucuuacucccugggcaccucggccuggucccagcaggu

SEQ ID NO: 79620 - RNA, 59 nt, Human
ccugccucagccucccaaguagcugggagccugggcaugcaucgccacgucuggcuaau

SEQ ID NO: 79621 - RNA, 59 nt, Human
gaccucagauuugaccaggccucuggcugccugggcagccucauugccaaugggcugaa

SEQ ID NO: 79622 - RNA, 59 nt, Human
accccugaggauuaccagcgauuucuagaccugggcaucuccauugcugaaaaccgcag

SEQ ID NO: 79623 - RNA, 59 nt, Human
ccccaccccuccuuggcucuccagcacuuccugggcagccacggcccccuccccccaca

SEQ ID NO: 79624 - RNA, 59 nt, Human
ccacaaucacaccaaucacugcacuccagccugggcaauaaaguaacucuugacucaaa

SEQ ID NO: 79625 - RNA, 59 nt, Human
uccugugaggccugaagacauugaauaacccugggcagugguucuuaggcagauacucu

SEQ ID NO: 79626 - RNA, 59 nt, Human
ugagccgagauggugccacugcauuccagccugggcaacagagcgagacuccaucucaa

SEQ ID NO: 79627 - RNA, 59 nt, Human
uaagugcuucuggauucaugggugaguucccugggcagcccccaggaaggccuuccaga

SEQ ID NO: 79628 - RNA, 59 nt, Human
uguuguuguggugguuuuuuaacacaaagccugggcaacagagcaaaacucugucucaa

SEQ ID NO: 79629 - RNA, 59 nt, Human
cucgugcugcccagaggcugaucugcaaaccugggcaguauuccacacugaagcucagu

SEQ ID NO: 79630 - RNA, 59 nt, Human
uccgagugacggaccugaggugucuguuuccugggcaggccugaugcuccuguuugggu

SEQ ID NO: 79631 - RNA, 59 nt, Human
aucccuuuagcccaggaguuaaagaccagccugggcaacauagggagacccugucuuuu

SEQ ID NO: 79632 - RNA, 59 nt, Human
gugggaggaucccaggaguucaaauccugccugggcaacauagcaagacccugucucuu

SEQ ID NO: 79633 - RNA, 59 nt, Human
ugucuggcacccagcugccagccuucuguccugggcaaacuacucccuacuuaagggaa

SEQ ID NO: 79634 - RNA, 59 nt, Human
ggcgccucacugggaggugccccgccagcccugggcagugucaggcaggacucacucac

SEQ ID NO: 79635 - RNA, 59 nt, Human
aggggauuuggcugaaggcgugcauauuuccugggcacaaacuuccugagccucugaaa

SEQ ID NO: 79636 - RNA, 59 nt, Human
cacacgggcgagcuuucucuccgacuuccccugggcaagagaugggacaagcagucccu

SEQ ID NO: 79637 - RNA, 59 nt, Human
gguugcaccugugaauaacugcacuccagccugggcaacauagcgagaccucaucucca

SEQ ID NO: 79638 - RNA, 59 nt, Human
gaccuggggcuucacucggaucacgcccuccugggcacaggucacagcuaggacuccau

SEQ ID NO: 79639 - RNA, 59 nt, Human
ugagcuauuacagugccacugcaauccagccugggcaacagagcgaggucccguuucuu

SEQ ID NO: 79640 - RNA, 59 nt, Human
ugugugggggccgucccgucccacacuccccugggcauucuuggacucaaggccggggc

SEQ ID NO: 79641 - RNA, 59 nt, Human
ggaccaugagccggcugccagcacuagguccugggcagcuuuguuugucccacuuuucu

SEQ ID NO: 79642 - RNA, 59 nt, Human
ccucucucccuccuacagugcucucccucccugggcagauuggcaggacaagugggagc

SEQ ID NO: 79643 - RNA, 54 nt, Human
uugaguccacagaaaucugaucgaccugggcacucggcauuuugacacaugucc

SEQ ID NO: 79644 - RNA, 59 nt, Human
aucaccagaggccagcagguccacaccagccugggcaacacagcaagacaccgcaucua

SEQ ID NO: 79645 - RNA, 59 nt, Human
ccucuccucccucucuggcagggccccauccugggcagaggggccuggggcugggccca

SEQ ID NO: 79646 - RNA, 59 nt, Human
guggacuuuuuugguggagacguuucugcccugggcacccuccugcccccgauucauac

SEQ ID NO: 79647 - RNA, 59 nt, Human
ugagccaagaucgcgccaucgcacuccagccugggcaacaagagcaaaacuccaucuca

SEQ ID NO: 79648 - RNA, 59 nt, Human
uuguuacaggcuuagcaacaaagcugugcccugggcauggggggcuguaguguagcuac

SEQ ID NO: 79649 - RNA, 59 nt, Human
accccgcagauaguuaaugaauggucugcccugggcaagauggaggugggggcuggggg

SEQ ID NO: 79650 - RNA, 59 nt, Human
aggcagaucugugccccaugccuguccagccugggcagccaggcugccaaggccagagu

SEQ ID NO: 79651 - RNA, 59 nt, Human
aucacuugagcucaggagcuugagaccagccugggcaacauggugaaacccaguuucua

SEQ ID NO: 79652 - RNA, 59 nt, Human
uuucuaguagcugcauuacaaaaaagaagccugggcacuguggcucacuccuguaaucu

SEQ ID NO: 79653 - RNA, 59 nt, Human
ccuuuggacccaggcaaaggcuucugagcccugggcaggggugguggguaccagagaau

SEQ ID NO: 79654 - RNA, 59 nt, Human
gcugcacaccuagaaccccaauucagccuccugggcaccccagaggcaaggcugugcac

SEQ ID NO: 79655 - RNA, 59 nt, Human
ugagccaagguugcgccacugcacuccagccugggcaacaagaguaaaacuccaucuca

SEQ ID NO: 79656 - RNA, 59 nt, Human
cuccugagaggggaggccugguggcuuagccugggcaggucgugucuccuccugacccc

SEQ ID NO: 79657 - RNA, 59 nt, Human
cauuccuuugugcagaguguauaucucugccugggcaagaguguggaggugccgaggug

SEQ ID NO: 79658 - RNA, 59 nt, Human
uuggaccuccaggggcuggagcuucaucaccugggcagugucuuuucucagagagcagg

SEQ ID NO: 79659 - RNA, 59 nt, Human
ucaccgccccuggaacuggggccaccagcccugggcacgagauuugcucugacuuuauu

SEQ ID NO: 79660 - RNA, 59 nt, Human
guucucccgggacaccagcagauccacacccugggcaccuccguguuuggucuuuuuuu

SEQ ID NO: 79661 - RNA, 59 nt, Human
ucugcuuuaucagucaucacacaaccauuccugggcauugagacuguccugguuaggcu

SEQ ID NO: 79662 - RNA, 59 nt, Human
cucagccacgccucucucagcccaggucuccugggcaucuggcccugcugcccccuacc

SEQ ID NO: 79663 - RNA, 59 nt, Human
ggugggacacagagacccccgugccaaauccugggcauccccagcccccuggccccucc

SEQ ID NO: 79664 - RNA, 59 nt, Human
ccucccauggggccgcugaggcaugagcaccugggcacagguuggggcucugcaggaug

SEQ ID NO: 79665 - RNA, 59 nt, Human
gggcauggccgggcccugcugaggaggggccugggcagagggccuggaccugggaucaa

SEQ ID NO: 79666 - RNA, 59 nt, Human
caagggccgguccccacacucuugcuccuccugggcaucuggggacaggaacaccucuc

SEQ ID NO: 79667 - RNA, 59 nt, Human
ugugagugcacuugaccgggugcggagguccugggcagccugucccugagccggccccu

SEQ ID NO: 79668 - RNA, 59 nt, Human
aucgcuugagcucaggaguucgagagcagccugggcaacauggugaaagcccgucucua

SEQ ID NO: 79669 - RNA, 59 nt, Human
ccagggagauuaaauucauggugacaaguccugggcaguucugguaaacgguccaguua

SEQ ID NO: 79670 - RNA, 59 nt, Human
ugagucgagaucgcaccauugcauuccagccugggcaacaagagcgaaacuccgucuca

SEQ ID NO: 79671 - RNA, 59 nt, Human
cgcgggauccuugugcagggaagagcugcccugggcaccuggcaccacaagaccauguu

SEQ ID NO: 79672 - RNA, 59 nt, Human
ugagcuaagaucacgccauugcacuccagccugggcaacgagagggaaacucuguuuca

SEQ ID NO: 79673 - RNA, 59 nt, Human
gaacuaacccccagcaggccugguuccacccugggcagcacccccucuaguucuaauaa

SEQ ID NO: 79674 - RNA, 59 nt, Human
ugcaaugcgacauccugaaagcucagcugccugggcauuccugaagaguauggaauauu

SEQ ID NO: 79675 - RNA, 59 nt, Human
ucugcuugcuguccaaaccagcaaacuuuccugggcaaaucacaaucagugaguaaaua

SEQ ID NO: 79676 - RNA, 59 nt, Human
ggcucuuucugcuuuguucuggcgacuuuccugggcaggccuuuccaccuggggagcug

SEQ ID NO: 79677 - RNA, 59 nt, Human
uuuuucugucugagugugagcuccauccgccugggcaucugauuuuuugggaaagaagu

SEQ ID NO: 79678 - RNA, 59 nt, Human
cguccagccagcaaggcuuucccaagcguccugggcaggaggguugggcccugcuuucc

SEQ ID NO: 79679 - RNA, 59 nt, Human
ugcacuagcgcgaggucagaaaucacaagccugggcauggccugggucgcacccccucc

SEQ ID NO: 79680 - RNA, 59 nt, Human
caggugggcccagccuagggcaucccgggccugggcaucaggcagggugcagguggggc

SEQ ID NO: 79681 - RNA, 59 nt, Human
ugagcugagaucacgccacugcacuccagccugggcaacagagugagacucugucucaa

SEQ ID NO: 79682 - RNA, 59 nt, Human
ugagcugaagucccgccacugcacuccagccugggcaacagagcgagacucagucucaa

SEQ ID NO: 79683 - RNA, 59 nt, Human
gggcccugggucggggcggaucagcuuucccugggcacaucugccucauuccagaucuc

SEQ ID NO: 79684 - RNA, 59 nt, Human
ugucgagugggcucugggcuggggucggcccugggcaggcuucuccugcaccuuuuguc

SEQ ID NO: 79685 - RNA, 59 nt, Human
caggugggcuagaagguaacuggaacaggccugggcacuugugcacccauguaggagca

SEQ ID NO: 79686 - RNA, 59 nt, Human
uccugcggccauccugaguuggggugaggccugggcagccggagggcagggcucaggga

SEQ ID NO: 79687 - RNA, 59 nt, Human
cuguccuucugccacggaugcucaagguuccugggcagaccagcaccucuggaggacaa

SEQ ID NO: 79688 - RNA, 59 nt, Human
ccaggggaccagccaggccuggaaugcccccugggcaggacccugggcaggaccagagg

SEQ ID NO: 79689 - RNA, 59 nt, Human
ccaggccuggaaugcccccugggcaggacccugggcaggaccagaggcccacauggaug

SEQ ID NO: 79690 - RNA, 59 nt, Human
ccagacaccugggaccuggauacuugauaccugggcauuuaacccccuacucugucauc

SEQ ID NO: 79691 - RNA, 59 nt, Human
uggcuggaccgggacccauggcaagagcaccugggcaccaguguuuagcccuggucugc

SEQ ID NO: 79692 - RNA, 59 nt, Human
guuggccugaacaaaauaaaguguugacuccugggcaucugugccuucucuauggccuu

SEQ ID NO: 79693 - RNA, 59 nt, Human
cccccuggcuugcacugaacccucgaggaccugggcacggggucggauggacacacagc

SEQ ID NO: 79694 - RNA, 59 nt, Human
gcugcuguuccuaugacaggcccacucaaccugggcagaccgagaggcccgugcacuuu

SEQ ID NO: 79695 - RNA, 59 nt, Human
gcuggaagcauauuccccaagagcacugcccugggcaucaucucccuccugcgaggagc

SEQ ID NO: 79696 - RNA, 59 nt, Human
caaacccuuggcccagccugggcuggugaccugggcaccagagaccuugcaucccuccu

SEQ ID NO: 79697 - RNA, 59 nt, Human
cccauguuugcucucccaacucauuagcuccugggcagcauccuccugagccacaugug

SEQ ID NO: 79698 - RNA, 59 nt, Human
cagauggcagaugagaguguagucaagggccugggcacaggagggagagcugcagagug

SEQ ID NO: 79699 - RNA, 59 nt, Human
ccccaucuguuaggccuuggugaggaggcccugggcaaagaagggucuuucgcaaagcg

SEQ ID NO: 79700 - RNA, 59 nt, Human
cccugggaugggaaggacccagcccgaccccugggcauaacacuguguuugcaaaugga

SEQ ID NO: 79701 - RNA, 59 nt, Human
gcucagaguccagcaaugaggcccccuggccugggcacccagcugcaggccccugcccu

SEQ ID NO: 79702 - RNA, 59 nt, Human
ugagccgagaucgugcuacugcauuccaaccugggcaacaagagugaaacucugucuca

SEQ ID NO: 79703 - RNA, 59 nt, Human
guggacagcugagguuggggucaaugccuccugggcacccuugccucgccccagaccgg

SEQ ID NO: 79704 - RNA, 59 nt, Human
ugagcugagaucgcaccacugcacuccagccugggcaacauagcaaaauccugucucaa

SEQ ID NO: 79705 - RNA, 59 nt, Human
caggucuucugccuucugaguuggcucauccugggcagucacagacuguccugccugca

SEQ ID NO: 79706 - RNA, 59 nt, Human
ggcuucugggccacucaggccagugcaccccugggcagagccccuuaaagcugcuguca

SEQ ID NO: 79707 - RNA, 59 nt, Human
uucucaaccccccugcagggagaaggccuccugggcacuguccuuccaccugugccagc

SEQ ID NO: 79708 - RNA, 59 nt, Human
ugagcugagauugcaccauuucauuccagccugggcaacaugagugaaagucugacuca

SEQ ID NO: 79709 - RNA, 59 nt, Human
caagcuccaagacugagcccagcaccaccccugggcagcagcauccuccucucuggccu

SEQ ID NO: 79710 - RNA, 59 nt, Human
ugggcugugauugugccacugcacuccagccugggcaccaaugugagaaccugucuugg

SEQ ID NO: 79711 - RNA, 59 nt, Human
uuugcuguguucuacaagggggacgagugccugggcagcgggaagauccugcggcuggg

SEQ ID NO: 79712 - RNA, 59 nt, Human
caaaacccucccagacgucuccucuccugccugggcaaaguccagcuuggcaccccguc

SEQ ID NO: 79713 - RNA, 59 nt, Human
ugagcugagauugcgccauugcacuccagccugggcaacaagagcaaaauucugccuca

SEQ ID NO: 79714 - RNA, 59 nt, Human
ggcccuccgccugccuggagaggccuggcccugggcaaacagccgccaucaggguucac

SEQ ID NO: 79715 - RNA, 59 nt, Human
cuuuugccugacggacccuguugccugcuccugggcagugguuuuguugccugacacag

SEQ ID NO: 79716 - RNA, 59 nt, Human
gcuguccugcaccagcgccagcccagcucccugggcagaugugcccuguguccuggguc

SEQ ID NO: 79717 - RNA, 59 nt, Human
ggggccggggcugccgcaucugccuggagccugggcagcaccuccgggacugaccuucg

SEQ ID NO: 79718 - RNA, 59 nt, Human
gguguggggggugccccacaaggcccagcccugggcaaggaagcuuuggaagcagcaag

SEQ ID NO: 79719 - RNA, 59 nt, Human
aacuuggacuucuaaaggcggagggucucccugggcacccugcaggcaggcagaccacg

SEQ ID NO: 79720 - RNA, 59 nt, Human
cuucuccaaaaggaccugggagcuggcagccugggcaggggggcugaggcacgugguag

SEQ ID NO: 79721 - RNA, 59 nt, Human
gccuucuuguuuaugaucagcuccagcuaccugggcaguuguggugggguggaugggaa

SEQ ID NO: 79722 - RNA, 59 nt, Human
uuggcuggggucugagucugcgguucucgccugggcagucuugacgaggagcaaacccc

SEQ ID NO: 79723 - RNA, 59 nt, Human
ccaccucucccauuccauccccaguccagccugggcaaccccaccccugggagggauga

SEQ ID NO: 79724 - RNA, 59 nt, Human
cucaucaccugauugauuggcucugugguccugggcaggugccucauagguguguggau

SEQ ID NO: 79725 - RNA, 59 nt, Human
ugagcugagaucgugccacugcacuccagccugggcaacagagccagacuccgucucua

SEQ ID NO: 79726 - RNA, 59 nt, Human
aucaccugagaucaggaguucgggaccagccugggcaacauggugaaacccugucucua

SEQ ID NO: 79727 - RNA, 59 nt, Human
cuggagccagugaccucaguuucagcuuuccugggcaccagccuggaccuugcccaugg

SEQ ID NO: 79728 - RNA, 59 nt, Human
caugggcaggcucaggucugucccgcugcccugggcacgaggucuccugaggaccuggg

SEQ ID NO: 79729 - RNA, 59 nt, Human
cggccugggcuaggugagcugccucugccccugggcaaggaagcgaggcccucugggag

SEQ ID NO: 79730 - RNA, 59 nt, Human
cgaggggucaccgagccucuggugggacaccugggcaggagugcucucaccacgaggcu

SEQ ID NO: 79731 - RNA, 59 nt, Human
aagaaaaggaagcugagcaucucccgaguccugggcagggaaggggagggaaauugcug

SEQ ID NO: 79732 - RNA, 59 nt, Human
ugagccgagaucacgccauugcacuccagccugggcaacagagcaagacuccaucucaa

SEQ ID NO: 79733 - RNA, 59 nt, Human
ccugccugaagcaaaggaggcucccguguccugggcagcuucuguuucccucugcugcc

SEQ ID NO: 79734 - RNA, 59 nt, Human
uggugacaguuggugcuaauaagaauuugccugggcaguauagugagaucuuuucucua

SEQ ID NO: 79735 - RNA, 59 nt, Human
acgugggaacuaaagagaaaaaugaccagccugggcagcauagcaagacccugucucua

SEQ ID NO: 79736 - RNA, 59 nt, Human
aaggcaccuuguagcauguacuccccgugccugggcaaucagaugggcugccuuugucc

SEQ ID NO: 79737 - RNA, 59 nt, Human
ugagccgagaucacgccauugcauucuagccugggcaacgagagcgaaacucugucuca

SEQ ID NO: 79738 - RNA, 59 nt, Human
ugagccaagauugcgccacugcacuccagccugggcaaacagagggagacuccaucgcc

SEQ ID NO: 79739 - RNA, 59 nt, Human
caccugggcuacacggagaccgggcacugccugggcaaaccgaacccugcgcucgcacc

SEQ ID NO: 79740 - RNA, 59 nt, Human
cccaucauugggcaccucugggaguuuguccugggcacagacagcuuccaccugggcua

SEQ ID NO: 79741 - RNA, 59 nt, Human
auccccaugccugagggccccucggcuggccugggcaugugauggcuccucacugggag

SEQ ID NO: 79742 - RNA, 59 nt, Human
aucacuugaggccaggaguucaagaucagccugggcaauauagugaaaccccaucucuu

SEQ ID NO: 79743 - RNA, 59 nt, Human
ugcauaugaaucucuauuuuuuucauuacccugggcaauuuaaagaaaucauaucauag

SEQ ID NO: 79744 - RNA, 59 nt, Human
ggucuuugagcucaggaguucaagaccagccugggcagcaugacaaaacccugucucua

SEQ ID NO: 79745 - RNA, 59 nt, Human
ugagcuaagaucgcgccacuguacuccagccugggcaacagcgagacuccaucucaaaa

SEQ ID NO: 79746 - RNA, 59 nt, Human
aaccuagccccuuagcccccacccacuucccugggcaaaugaauggcucacuauggugc

SEQ ID NO: 79747 - RNA, 59 nt, Human
cuggucccaggguggcaccacccaggcccccugggcaccaagggagcgagggggaauaa

SEQ ID NO: 79748 - RNA, 59 nt, Human
caugugagucugggauauucuuuagcuuaccugggcacaaacagaauuuuccauuuauu

SEQ ID NO: 79749 - RNA, 59 nt, Human
ccuucuaaauucccaaauccuagacugcuccugggcauuagcaaggcagagccuuuuua

SEQ ID NO: 79750 - RNA, 59 nt, Human
aggggcuuuaucuuuuacuaguaggcaagccugggcauuucugcauuugugccagcuaa

SEQ ID NO: 79751 - RNA, 59 nt, Human
caaggucuaugcuaaauuauagcaagagcccugggcaaccccaaaccuaguccugguag

SEQ ID NO: 79752 - RNA, 59 nt, Human
ugagccgagaucucgccacugcacuccagccugggcaacagagcaagacucugucucaa

SEQ ID NO: 79753 - RNA, 59 nt, Human
gagcauaacguacaggcuguauguacaauccugggcauugacucugugacauuucuagc

SEQ ID NO: 79754 - RNA, 59 nt, Human
agugcuugagguuaggcguuccagaccagccugggcaacauagugagacucuugucucu

SEQ ID NO: 79755 - RNA, 59 nt, Human
auggcuugagaccaggaguucaagaccagccugggcaacauagugagacgccccccccc

SEQ ID NO: 79756 - RNA, 59 nt, Human
gaagauugagccuaggaguucgagaccgaccugggcagcauagcgagaccccaucucua

SEQ ID NO: 79757 - RNA, 59 nt, Human
ugagccaagaucuugccauugcacuccagccugggcaacaagagugaaauucugucuca

SEQ ID NO: 79758 - RNA, 59 nt, Human
ugagccgagaucacaccacugcacuccagccugggcaacagugaaacuccaucucaaaa

SEQ ID NO: 79759 - RNA, 59 nt, Human
augcuacugcgcccugggggcucccagggccugggcaacuuagcugcaacuggcaaagg

SEQ ID NO: 79760 - RNA, 59 nt, Human
agcucacuucaguucaagaaauuguucugccugggcaagaaauuagugaaugacuacac

SEQ ID NO: 79761 - RNA, 56 nt, Human
accuggccauggaacugugaggagggccugggcaggcugugggagccggggaggga

SEQ ID NO: 79762 - RNA, 59 nt, Human
uuuauugccaaaacccagcugcaccccuuccugggcacacgcugcucugccccagcuug

SEQ ID NO: 79763 - RNA, 59 nt, Human
gaaaaaaggggcaaggagccccgcggcggccugggcagcgccugugcagaccucccugc

SEQ ID NO: 79764 - RNA, 58 nt, Human
gugaugaauuucagagcugauguguucaccugggcagaucccccaaauccggaaguca

SEQ ID NO: 79765 - RNA, 56 nt, Human
ggccccccguuucccgcuaagccuggccugggcaaauggagcgaggucccacuuug

SEQ ID NO: 79766 - RNA, 52 nt, Human
ugaacccccacaagcucugagcccugggcacccaccuccacccccgccacgg

SEQ ID NO: 79767 - RNA, 59 nt, Human
auugcuugagccugggaguuugagacuggccugggcagcauagcgagaccccaucucua

SEQ ID NO: 79768 - RNA, 64 nt, Human; identical to SEQ ID NO: 7566

SEQ ID NO: 79769 - RNA, 64 nt, Human; identical to SEQ ID NO: 7567

SEQ ID NO: 79770 - RNA, 64 nt, Human; identical to SEQ ID NO: 7568

SEQ ID NO: 79771 - RNA, 64 nt, Human; identical to SEQ ID NO: 7569

SEQ ID NO: 79772 - RNA, 64 nt, Human; identical to SEQ ID NO: 7570

SEQ ID NO: 79773 - RNA, 64 nt, Human; identical to SEQ ID NO: 7571

SEQ ID NO: 79774 - RNA, 64 nt, Human; identical to SEQ ID NO: 7572

SEQ ID NO: 79775 - RNA, 64 nt, Human; identical to SEQ ID NO: 7573

SEQ ID NO: 79776 - RNA, 64 nt, Human; identical to SEQ ID NO: 7574

SEQ ID NO: 79777 - RNA, 64 nt, Human; identical to SEQ ID NO: 7575

SEQ ID NO: 79778 - RNA, 64 nt, Human; identical to SEQ ID NO: 7576

SEQ ID NO: 79779 - RNA, 64 nt, Human; identical to SEQ ID NO: 7577

SEQ ID NO: 79780 - RNA, 64 nt, Human; identical to SEQ ID NO: 7578

SEQ ID NO: 79781 - RNA, 64 nt, Human; identical to SEQ ID NO: 7579

SEQ ID NO: 79782 - RNA, 64 nt, Human; identical to SEQ ID NO: 7580

SEQ ID NO: 79783 - RNA, 64 nt, Human; identical to SEQ ID NO: 7581

SEQ ID NO: 79784 - RNA, 64 nt, Human; identical to SEQ ID NO: 7582

SEQ ID NO: 79785 - RNA, 64 nt, Human; identical to SEQ ID NO: 7583

SEQ ID NO: 79786 - RNA, 64 nt, Human; identical to SEQ ID NO: 7584

SEQ ID NO: 79787 - RNA, 64 nt, Human; identical to SEQ ID NO: 7585

SEQ ID NO: 79788 - RNA, 64 nt, Human; identical to SEQ ID NO: 7586

SEQ ID NO: 79789 - RNA, 64 nt, Human; identical to SEQ ID NO: 7587

SEQ ID NO: 79790 - RNA, 57 nt, Human; identical to SEQ ID NO: 7588

SEQ ID NO: 79791 - RNA, 64 nt, Human; identical to SEQ ID NO: 7589

SEQ ID NO: 79792 - RNA, 64 nt, Human; identical to SEQ ID NO: 7590

SEQ ID NO: 79793 - RNA, 64 nt, Human; identical to SEQ ID NO: 7591

SEQ ID NO: 79794 - RNA, 64 nt, Human; identical to SEQ ID NO: 7592

SEQ ID NO: 79795 - RNA, 64 nt, Human; identical to SEQ ID NO: 7593

SEQ ID NO: 79796 - RNA, 64 nt, Human; identical to SEQ ID NO: 7594

SEQ ID NO: 79797 - RNA, 64 nt, Human; identical to SEQ ID NO: 7595

SEQ ID NO: 79798 - RNA, 64 nt, Human; identical to SEQ ID NO: 7596

SEQ ID NO: 79799 - RNA, 64 nt, Human; identical to SEQ ID NO: 7597

SEQ ID NO: 79800 - RNA, 64 nt, Human; identical to SEQ ID NO: 7598

SEQ ID NO: 79801 - RNA, 64 nt, Human; identical to SEQ ID NO: 7599

SEQ ID NO: 79802 - RNA, 64 nt, Human; identical to SEQ ID NO: 7600

SEQ ID NO: 79803 - RNA, 64 nt, Human; identical to SEQ ID NO: 7601

SEQ ID NO: 79804 - RNA, 64 nt, Human; identical to SEQ ID NO: 7602

SEQ ID NO: 79805 - RNA, 64 nt, Human; identical to SEQ ID NO: 7603

SEQ ID NO: 79806 - RNA, 64 nt, Human; identical to SEQ ID NO: 7604

SEQ ID NO: 79807 - RNA, 64 nt, Human; identical to SEQ ID NO: 7605

SEQ ID NO: 79808 - RNA, 64 nt, Human; identical to SEQ ID NO: 7606

SEQ ID NO: 79809 - RNA, 64 nt, Human; identical to SEQ ID NO: 7607

SEQ ID NO: 79810 - RNA, 64 nt, Human; identical to SEQ ID NO: 7608

SEQ ID NO: 79811 - RNA, 64 nt, Human; identical to SEQ ID NO: 7609

SEQ ID NO: 79812 - RNA, 64 nt, Human; identical to SEQ ID NO: 7610

SEQ ID NO: 79813 - RNA, 64 nt, Human; identical to SEQ ID NO: 7611

SEQ ID NO: 79814 - RNA, 64 nt, Human; identical to SEQ ID NO: 7612

SEQ ID NO: 79815 - RNA, 64 nt, Human; identical to SEQ ID NO: 7613

SEQ ID NO: 79816 - RNA, 64 nt, Human; identical to SEQ ID NO: 7614

SEQ ID NO: 79817 - RNA, 64 nt, Human; identical to SEQ ID NO: 7615

SEQ ID NO: 79818 - RNA, 64 nt, Human; identical to SEQ ID NO: 7616

SEQ ID NO: 79819 - RNA, 64 nt, Human; identical to SEQ ID NO: 7617

SEQ ID NO: 79820 - RNA, 64 nt, Human; identical to SEQ ID NO: 7618

SEQ ID NO: 79821 - RNA, 64 nt, Human; identical to SEQ ID NO: 7619

SEQ ID NO: 79822 - RNA, 64 nt, Human; identical to SEQ ID NO: 7620

SEQ ID NO: 79823 - RNA, 64 nt, Human; identical to SEQ ID NO: 7621

SEQ ID NO: 79824 - RNA, 64 nt, Human; identical to SEQ ID NO: 7622

SEQ ID NO: 79825 - RNA, 64 nt, Human; identical to SEQ ID NO: 7623

SEQ ID NO: 79826 - RNA, 64 nt, Human; identical to SEQ ID NO: 7624

SEQ ID NO: 79827 - RNA, 64 nt, Human; identical to SEQ ID NO: 7625

SEQ ID NO: 79828 - RNA, 64 nt, Human; identical to SEQ ID NO: 7626

SEQ ID NO: 79829 - RNA, 64 nt, Human; identical to SEQ ID NO: 7627

SEQ ID NO: 79830 - RNA, 64 nt, Human; identical to SEQ ID NO: 7628

SEQ ID NO: 79831 - RNA, 64 nt, Human; identical to SEQ ID NO: 7629

SEQ ID NO: 79832 - RNA, 64 nt, Human; identical to SEQ ID NO: 7630

SEQ ID NO: 79833 - RNA, 64 nt, Human; identical to SEQ ID NO: 7631

SEQ ID NO: 79834 - RNA, 64 nt, Human; identical to SEQ ID NO: 7632

SEQ ID NO: 79835 - RNA, 64 nt, Human; identical to SEQ ID NO: 7633

SEQ ID NO: 79836 - RNA, 50 nt, Human; identical to SEQ ID NO: 7634

SEQ ID NO: 79837 - RNA, 64 nt, Human; identical to SEQ ID NO: 7635

SEQ ID NO: 79838 - RNA, 64 nt, Human; identical to SEQ ID NO: 7636

SEQ ID NO: 79839 - RNA, 64 nt, Human; identical to SEQ ID NO: 7637

SEQ ID NO: 79840 - RNA, 64 nt, Human; identical to SEQ ID NO: 7638

SEQ ID NO: 79841 - RNA, 64 nt, Human; identical to SEQ ID NO: 7639

SEQ ID NO: 79842 - RNA, 64 nt, Human; identical to SEQ ID NO: 7640

SEQ ID NO: 79843 - RNA, 64 nt, Human; identical to SEQ ID NO: 7641

SEQ ID NO: 79844 - RNA, 64 nt, Human; identical to SEQ ID NO: 7642

SEQ ID NO: 79845 - RNA, 64 nt, Human; identical to SEQ ID NO: 7643

SEQ ID NO: 79846 - RNA, 64 nt, Human; identical to SEQ ID NO: 7644

SEQ ID NO: 79847 - RNA, 64 nt, Human; identical to SEQ ID NO: 7645

SEQ ID NO: 79848 - RNA, 64 nt, Human; identical to SEQ ID NO: 7646

SEQ ID NO: 79849 - RNA, 64 nt, Human; identical to SEQ ID NO: 7647

SEQ ID NO: 79850 - RNA, 64 nt, Human; identical to SEQ ID NO: 7648

SEQ ID NO: 79851 - RNA, 64 nt, Human; identical to SEQ ID NO: 7649

SEQ ID NO: 79852 - RNA, 64 nt, Human; identical to SEQ ID NO: 7650

SEQ ID NO: 79853 - RNA, 64 nt, Human; identical to SEQ ID NO: 7651

SEQ ID NO: 79854 - RNA, 64 nt, Human; identical to SEQ ID NO: 7652

SEQ ID NO: 79855 - RNA, 64 nt, Human; identical to SEQ ID NO: 7653

SEQ ID NO: 79856 - RNA, 64 nt, Human; identical to SEQ ID NO: 7654

SEQ ID NO: 79857 - RNA, 64 nt, Human; identical to SEQ ID NO: 7655

SEQ ID NO: 79858 - RNA, 64 nt, Human; identical to SEQ ID NO: 7656

SEQ ID NO: 79859 - RNA, 64 nt, Human; identical to SEQ ID NO: 7657

SEQ ID NO: 79860 - RNA, 64 nt, Human; identical to SEQ ID NO: 7658

SEQ ID NO: 79861 - RNA, 64 nt, Human; identical to SEQ ID NO: 7659

SEQ ID NO: 79862 - RNA, 64 nt, Human; identical to SEQ ID NO: 7660

SEQ ID NO: 79863 - RNA, 64 nt, Human; identical to SEQ ID NO: 7661

SEQ ID NO: 79864 - RNA, 64 nt, Human; identical to SEQ ID NO: 7662

SEQ ID NO: 79865 - RNA, 64 nt, Human; identical to SEQ ID NO: 7663

SEQ ID NO: 79866 - RNA, 64 nt, Human; identical to SEQ ID NO: 7664

SEQ ID NO: 79867 - RNA, 64 nt, Human; identical to SEQ ID NO: 7665

SEQ ID NO: 79868 - RNA, 64 nt, Human; identical to SEQ ID NO: 7666

SEQ ID NO: 79869 - RNA, 64 nt, Human; identical to SEQ ID NO: 7667

SEQ ID NO: 79870 - RNA, 64 nt, Human; identical to SEQ ID NO: 7668

SEQ ID NO: 79871 - RNA, 64 nt, Human; identical to SEQ ID NO: 7669

SEQ ID NO: 79872 - RNA, 64 nt, Human; identical to SEQ ID NO: 7670

SEQ ID NO: 79873 - RNA, 64 nt, Human; identical to SEQ ID NO: 7671

SEQ ID NO: 79874 - RNA, 64 nt, Human; identical to SEQ ID NO: 7672

SEQ ID NO: 79875 - RNA, 64 nt, Human; identical to SEQ ID NO: 7673

SEQ ID NO: 79876 - RNA, 64 nt, Human; identical to SEQ ID NO: 7674

SEQ ID NO: 79877 - RNA, 64 nt, Human; identical to SEQ ID NO: 7675

SEQ ID NO: 79878 - RNA, 64 nt, Human; identical to SEQ ID NO: 7676

SEQ ID NO: 79879 - RNA, 64 nt, Human; identical to SEQ ID NO: 7677

SEQ ID NO: 79880 - RNA, 64 nt, Human; identical to SEQ ID NO: 7678

SEQ ID NO: 79881 - RNA, 64 nt, Human; identical to SEQ ID NO: 7679

SEQ ID NO: 79882 - RNA, 64 nt, Human; identical to SEQ ID NO: 7680

SEQ ID NO: 79883 - RNA, 64 nt, Human; identical to SEQ ID NO: 7681

SEQ ID NO: 79884 - RNA, 64 nt, Human; identical to SEQ ID NO: 7682

SEQ ID NO: 79885 - RNA, 64 nt, Human; identical to SEQ ID NO: 7683

SEQ ID NO: 79886 - RNA, 64 nt, Human; identical to SEQ ID NO: 7684

SEQ ID NO: 79887 - RNA, 64 nt, Human; identical to SEQ ID NO: 7685

SEQ ID NO: 79888 - RNA, 64 nt, Human; identical to SEQ ID NO: 7686

SEQ ID NO: 79889 - RNA, 64 nt, Human; identical to SEQ ID NO: 7687

SEQ ID NO: 79890 - RNA, 64 nt, Human; identical to SEQ ID NO: 7688

SEQ ID NO: 79891 - RNA, 64 nt, Human; identical to SEQ ID NO: 7689

SEQ ID NO: 79892 - RNA, 64 nt, Human; identical to SEQ ID NO: 7690

SEQ ID NO: 79893 - RNA, 64 nt, Human; identical to SEQ ID NO: 7691

SEQ ID NO: 79894 - RNA, 64 nt, Human; identical to SEQ ID NO: 7692

SEQ ID NO: 79895 - RNA, 64 nt, Human; identical to SEQ ID NO: 7693

SEQ ID NO: 79896 - RNA, 64 nt, Human; identical to SEQ ID NO: 7694

SEQ ID NO: 79897 - RNA, 64 nt, Human; identical to SEQ ID NO: 7695

SEQ ID NO: 79898 - RNA, 64 nt, Human; identical to SEQ ID NO: 7696

SEQ ID NO: 79899 - RNA, 64 nt, Human; identical to SEQ ID NO: 7697

SEQ ID NO: 79900 - RNA, 64 nt, Human; identical to SEQ ID NO: 7698

SEQ ID NO: 79901 - RNA, 64 nt, Human; identical to SEQ ID NO: 7699

SEQ ID NO: 79902 - RNA, 64 nt, Human; identical to SEQ ID NO: 7700

SEQ ID NO: 79903 - RNA, 64 nt, Human; identical to SEQ ID NO: 7701

SEQ ID NO: 79904 - RNA, 64 nt, Human; identical to SEQ ID NO: 7702

SEQ ID NO: 79905 - RNA, 64 nt, Human; identical to SEQ ID NO: 7703

SEQ ID NO: 79906 - RNA, 64 nt, Human; identical to SEQ ID NO: 7704

SEQ ID NO: 79907 - RNA, 64 nt, Human; identical to SEQ ID NO: 7705

SEQ ID NO: 79908 - RNA, 64 nt, Human; identical to SEQ ID NO: 7706

SEQ ID NO: 79909 - RNA, 64 nt, Human; identical to SEQ ID NO: 7707

SEQ ID NO: 79910 - RNA, 64 nt, Human; identical to SEQ ID NO: 7708

SEQ ID NO: 79911 - RNA, 64 nt, Human; identical to SEQ ID NO: 7709

SEQ ID NO: 79912 - RNA, 64 nt, Human; identical to SEQ ID NO: 7710

SEQ ID NO: 79913 - RNA, 63 nt, Human; identical to SEQ ID NO: 7711

SEQ ID NO: 79914 - RNA, 64 nt, Human; identical to SEQ ID NO: 7712

SEQ ID NO: 79915 - RNA, 64 nt, Human; identical to SEQ ID NO: 7713

SEQ ID NO: 79916 - RNA, 64 nt, Human; identical to SEQ ID NO: 7714

SEQ ID NO: 79917 - RNA, 64 nt, Human; identical to SEQ ID NO: 7715

SEQ ID NO: 79918 - RNA, 64 nt, Human; identical to SEQ ID NO: 7716

SEQ ID NO: 79919 - RNA, 64 nt, Human; identical to SEQ ID NO: 7717

SEQ ID NO: 79920 - RNA, 64 nt, Human; identical to SEQ ID NO: 7718

SEQ ID NO: 79921 - RNA, 64 nt, Human; identical to SEQ ID NO: 7719

SEQ ID NO: 79922 - RNA, 64 nt, Human; identical to SEQ ID NO: 7720

SEQ ID NO: 79923 - RNA, 64 nt, Human; identical to SEQ ID NO: 7721

SEQ ID NO: 79924 - RNA, 64 nt, Human; identical to SEQ ID NO: 7722

SEQ ID NO: 79925 - RNA, 64 nt, Human; identical to SEQ ID NO: 7723

SEQ ID NO: 79926 - RNA, 64 nt, Human; identical to SEQ ID NO: 7724

SEQ ID NO: 79927 - RNA, 64 nt, Human; identical to SEQ ID NO: 7725

SEQ ID NO: 79928 - RNA, 64 nt, Human; identical to SEQ ID NO: 7726

SEQ ID NO: 79929 - RNA, 64 nt, Human; identical to SEQ ID NO: 7727

SEQ ID NO: 79930 - RNA, 64 nt, Human; identical to SEQ ID NO: 7728

SEQ ID NO: 79931 - RNA, 64 nt, Human; identical to SEQ ID NO: 7729

SEQ ID NO: 79932 - RNA, 64 nt, Human; identical to SEQ ID NO: 7730

SEQ ID NO: 79933 - RNA, 64 nt, Human; identical to SEQ ID NO: 7731

SEQ ID NO: 79934 - RNA, 64 nt, Human; identical to SEQ ID NO: 7732

SEQ ID NO: 79935 - RNA, 64 nt, Human; identical to SEQ ID NO: 7733

SEQ ID NO: 79936 - RNA, 64 nt, Human; identical to SEQ ID NO: 7734

SEQ ID NO: 79937 - RNA, 64 nt, Human; identical to SEQ ID NO: 7735

SEQ ID NO: 79938 - RNA, 64 nt, Human; identical to SEQ ID NO: 7736

SEQ ID NO: 79939 - RNA, 64 nt, Human; identical to SEQ ID NO: 7737

SEQ ID NO: 79940 - RNA, 64 nt, Human; identical to SEQ ID NO: 7738

SEQ ID NO: 79941 - RNA, 64 nt, Human; identical to SEQ ID NO: 7739

SEQ ID NO: 79942 - RNA, 64 nt, Human; identical to SEQ ID NO: 7740

SEQ ID NO: 79943 - RNA, 64 nt, Human; identical to SEQ ID NO: 7741

SEQ ID NO: 79944 - RNA, 64 nt, Human; identical to SEQ ID NO: 7742

SEQ ID NO: 79945 - RNA, 64 nt, Human; identical to SEQ ID NO: 7743

SEQ ID NO: 79946 - RNA, 64 nt, Human; identical to SEQ ID NO: 7744

SEQ ID NO: 79947 - RNA, 64 nt, Human; identical to SEQ ID NO: 7745

SEQ ID NO: 79948 - RNA, 64 nt, Human; identical to SEQ ID NO: 7746

SEQ ID NO: 79949 - RNA, 64 nt, Human; identical to SEQ ID NO: 7747

SEQ ID NO: 79950 - RNA, 64 nt, Human; identical to SEQ ID NO: 7748

SEQ ID NO: 79951 - RNA, 64 nt, Human; identical to SEQ ID NO: 7749

SEQ ID NO: 79952 - RNA, 64 nt, Human; identical to SEQ ID NO: 7750

SEQ ID NO: 79953 - RNA, 64 nt, Human; identical to SEQ ID NO: 7751

SEQ ID NO: 79954 - RNA, 64 nt, Human; identical to SEQ ID NO: 7752

SEQ ID NO: 79955 - RNA, 64 nt, Human; identical to SEQ ID NO: 7753

SEQ ID NO: 79956 - RNA, 64 nt, Human; identical to SEQ ID NO: 7754

SEQ ID NO: 79957 - RNA, 64 nt, Human; identical to SEQ ID NO: 7755

SEQ ID NO: 79958 - RNA, 64 nt, Human; identical to SEQ ID NO: 7756

SEQ ID NO: 79959 - RNA, 64 nt, Human; identical to SEQ ID NO: 7757

SEQ ID NO: 79960 - RNA, 64 nt, Human; identical to SEQ ID NO: 7758

SEQ ID NO: 79961 - RNA, 64 nt, Human; identical to SEQ ID NO: 7759

SEQ ID NO: 79962 - RNA, 64 nt, Human; identical to SEQ ID NO: 7760

SEQ ID NO: 79963 - RNA, 64 nt, Human; identical to SEQ ID NO: 7761

SEQ ID NO: 79964 - RNA, 64 nt, Human; identical to SEQ ID NO: 7762

SEQ ID NO: 79965 - RNA, 64 nt, Human; identical to SEQ ID NO: 7763

SEQ ID NO: 79966 - RNA, 64 nt, Human; identical to SEQ ID NO: 7764

SEQ ID NO: 79967 - RNA, 64 nt, Human; identical to SEQ ID NO: 7765

SEQ ID NO: 79968 - RNA, 64 nt, Human; identical to SEQ ID NO: 7766

SEQ ID NO: 79969 - RNA, 64 nt, Human; identical to SEQ ID NO: 7767

SEQ ID NO: 79970 - RNA, 64 nt, Human; identical to SEQ ID NO: 7768

SEQ ID NO: 79971 - RNA, 64 nt, Human; identical to SEQ ID NO: 7769

SEQ ID NO: 79972 - RNA, 64 nt, Human; identical to SEQ ID NO: 7770

SEQ ID NO: 79973 - RNA, 64 nt, Human; identical to SEQ ID NO: 7771

SEQ ID NO: 79974 - RNA, 64 nt, Human; identical to SEQ ID NO: 7772

SEQ ID NO: 79975 - RNA, 64 nt, Human; identical to SEQ ID NO: 7773

SEQ ID NO: 79976 - RNA, 64 nt, Human; identical to SEQ ID NO: 7774

SEQ ID NO: 79977 - RNA, 64 nt, Human; identical to SEQ ID NO: 7775

SEQ ID NO: 79978 - RNA, 64 nt, Human; identical to SEQ ID NO: 7776

SEQ ID NO: 79979 - RNA, 64 nt, Human; identical to SEQ ID NO: 7777

SEQ ID NO: 79980 - RNA, 64 nt, Human; identical to SEQ ID NO: 7778

SEQ ID NO: 79981 - RNA, 64 nt, Human; identical to SEQ ID NO: 7779

SEQ ID NO: 79982 - RNA, 64 nt, Human; identical to SEQ ID NO: 7780

SEQ ID NO: 79983 - RNA, 64 nt, Human; identical to SEQ ID NO: 7781

SEQ ID NO: 79984 - RNA, 64 nt, Human; identical to SEQ ID NO: 7782

SEQ ID NO: 79985 - RNA, 64 nt, Human; identical to SEQ ID NO: 7783

SEQ ID NO: 79986 - RNA, 64 nt, Human; identical to SEQ ID NO: 7784

SEQ ID NO: 79987 - RNA, 64 nt, Human; identical to SEQ ID NO: 7785

SEQ ID NO: 79988 - RNA, 64 nt, Human; identical to SEQ ID NO: 7786

SEQ ID NO: 79989 - RNA, 64 nt, Human; identical to SEQ ID NO: 7787

SEQ ID NO: 79990 - RNA, 64 nt, Human; identical to SEQ ID NO: 7788

SEQ ID NO: 79991 - RNA, 64 nt, Human; identical to SEQ ID NO: 7789

SEQ ID NO: 79992 - RNA, 64 nt, Human; identical to SEQ ID NO: 7790

SEQ ID NO: 79993 - RNA, 64 nt, Human; identical to SEQ ID NO: 7791

SEQ ID NO: 79994 - RNA, 64 nt, Human; identical to SEQ ID NO: 7792

SEQ ID NO: 79995 - RNA, 64 nt, Human; identical to SEQ ID NO: 7793

SEQ ID NO: 79996 - RNA, 64 nt, Human; identical to SEQ ID NO: 7794

SEQ ID NO: 79997 - RNA, 64 nt, Human; identical to SEQ ID NO: 7795

SEQ ID NO: 79998 - RNA, 64 nt, Human; identical to SEQ ID NO: 7796

SEQ ID NO: 79999 - RNA, 64 nt, Human; identical to SEQ ID NO: 7797

SEQ ID NO: 80000 - RNA, 64 nt, Human; identical to SEQ ID NO: 7798

SEQ ID NO: 80001 - RNA, 64 nt, Human; identical to SEQ ID NO: 7799

SEQ ID NO: 80002 - RNA, 64 nt, Human; identical to SEQ ID NO: 7800

SEQ ID NO: 80003 - RNA, 64 nt, Human; identical to SEQ ID NO: 7801

SEQ ID NO: 80004 - RNA, 64 nt, Human; identical to SEQ ID NO: 7802

SEQ ID NO: 80005 - RNA, 64 nt, Human; identical to SEQ ID NO: 7803

SEQ ID NO: 80006 - RNA, 64 nt, Human; identical to SEQ ID NO: 7804

SEQ ID NO: 80007 - RNA, 64 nt, Human; identical to SEQ ID NO: 7805

SEQ ID NO: 80008 - RNA, 64 nt, Human; identical to SEQ ID NO: 7806

SEQ ID NO: 80009 - RNA, 64 nt, Human; identical to SEQ ID NO: 7807

SEQ ID NO: 80010 - RNA, 64 nt, Human; identical to SEQ ID NO: 7808

SEQ ID NO: 80011 - RNA, 64 nt, Human; identical to SEQ ID NO: 7809

SEQ ID NO: 80012 - RNA, 64 nt, Human; identical to SEQ ID NO: 7810

SEQ ID NO: 80013 - RNA, 64 nt, Human; identical to SEQ ID NO: 7811

SEQ ID NO: 80014 - RNA, 64 nt, Human; identical to SEQ ID NO: 7812

SEQ ID NO: 80015 - RNA, 64 nt, Human; identical to SEQ ID NO: 7813

SEQ ID NO: 80016 - RNA, 64 nt, Human; identical to SEQ ID NO: 7814

SEQ ID NO: 80017 - RNA, 64 nt, Human; identical to SEQ ID NO: 7815

SEQ ID NO: 80018 - RNA, 64 nt, Human; identical to SEQ ID NO: 7816

SEQ ID NO: 80019 - RNA, 64 nt, Human; identical to SEQ ID NO: 7817

SEQ ID NO: 80020 - RNA, 64 nt, Human; identical to SEQ ID NO: 7818

SEQ ID NO: 80021 - RNA, 64 nt, Human; identical to SEQ ID NO: 7819

SEQ ID NO: 80022 - RNA, 64 nt, Human; identical to SEQ ID NO: 7820

SEQ ID NO: 80023 - RNA, 64 nt, Human; identical to SEQ ID NO: 7821

SEQ ID NO: 80024 - RNA, 64 nt, Human; identical to SEQ ID NO: 7822

SEQ ID NO: 80025 - RNA, 64 nt, Human; identical to SEQ ID NO: 7823

SEQ ID NO: 80026 - RNA, 64 nt, Human; identical to SEQ ID NO: 7824

SEQ ID NO: 80027 - RNA, 64 nt, Human; identical to SEQ ID NO: 7825

SEQ ID NO: 80028 - RNA, 64 nt, Human; identical to SEQ ID NO: 7826

SEQ ID NO: 80029 - RNA, 64 nt, Human; identical to SEQ ID NO: 7827

SEQ ID NO: 80030 - RNA, 64 nt, Human; identical to SEQ ID NO: 7828

SEQ ID NO: 80031 - RNA, 64 nt, Human; identical to SEQ ID NO: 7829

SEQ ID NO: 80032 - RNA, 64 nt, Human; identical to SEQ ID NO: 7830

SEQ ID NO: 80033 - RNA, 64 nt, Human; identical to SEQ ID NO: 7831

SEQ ID NO: 80034 - RNA, 64 nt, Human; identical to SEQ ID NO: 7832

SEQ ID NO: 80035 - RNA, 64 nt, Human; identical to SEQ ID NO: 7833

SEQ ID NO: 80036 - RNA, 64 nt, Human; identical to SEQ ID NO: 7834

SEQ ID NO: 80037 - RNA, 64 nt, Human; identical to SEQ ID NO: 7835

SEQ ID NO: 80038 - RNA, 64 nt, Human; identical to SEQ ID NO: 7836

SEQ ID NO: 80039 - RNA, 64 nt, Human; identical to SEQ ID NO: 7837

SEQ ID NO: 80040 - RNA, 64 nt, Human; identical to SEQ ID NO: 7838

SEQ ID NO: 80041 - RNA, 64 nt, Human; identical to SEQ ID NO: 7839

SEQ ID NO: 80042 - RNA, 64 nt, Human; identical to SEQ ID NO: 7840

SEQ ID NO: 80043 - RNA, 64 nt, Human; identical to SEQ ID NO: 7841

SEQ ID NO: 80044 - RNA, 64 nt, Human; identical to SEQ ID NO: 7842

SEQ ID NO: 80045 - RNA, 64 nt, Human; identical to SEQ ID NO: 7843

SEQ ID NO: 80046 - RNA, 64 nt, Human; identical to SEQ ID NO: 7844

SEQ ID NO: 80047 - RNA, 64 nt, Human; identical to SEQ ID NO: 7845

SEQ ID NO: 80048 - RNA, 64 nt, Human; identical to SEQ ID NO: 7846

SEQ ID NO: 80049 - RNA, 64 nt, Human; identical to SEQ ID NO: 7847

SEQ ID NO: 80050 - RNA, 64 nt, Human; identical to SEQ ID NO: 7848

SEQ ID NO: 80051 - RNA, 64 nt, Human; identical to SEQ ID NO: 7849

SEQ ID NO: 80052 - RNA, 64 nt, Human; identical to SEQ ID NO: 7850

SEQ ID NO: 80053 - RNA, 64 nt, Human; identical to SEQ ID NO: 7851

SEQ ID NO: 80054 - RNA, 64 nt, Human; identical to SEQ ID NO: 7852

SEQ ID NO: 80055 - RNA, 64 nt, Human; identical to SEQ ID NO: 7853

SEQ ID NO: 80056 - RNA, 64 nt, Human; identical to SEQ ID NO: 7854

SEQ ID NO: 80057 - RNA, 64 nt, Human; identical to SEQ ID NO: 7855

SEQ ID NO: 80058 - RNA, 64 nt, Human; identical to SEQ ID NO: 7856

SEQ ID NO: 80059 - RNA, 64 nt, Human; identical to SEQ ID NO: 7857

SEQ ID NO: 80060 - RNA, 64 nt, Human; identical to SEQ ID NO: 7858

SEQ ID NO: 80061 - RNA, 64 nt, Human; identical to SEQ ID NO: 7859

SEQ ID NO: 80062 - RNA, 64 nt, Human; identical to SEQ ID NO: 7860

SEQ ID NO: 80063 - RNA, 64 nt, Human; identical to SEQ ID NO: 7861

SEQ ID NO: 80064 - RNA, 64 nt, Human; identical to SEQ ID NO: 7862

SEQ ID NO: 80065 - RNA, 64 nt, Human; identical to SEQ ID NO: 7863

SEQ ID NO: 80066 - RNA, 64 nt, Human; identical to SEQ ID NO: 7864

SEQ ID NO: 80067 - RNA, 64 nt, Human; identical to SEQ ID NO: 7865

SEQ ID NO: 80068 - RNA, 64 nt, Human; identical to SEQ ID NO: 7866

SEQ ID NO: 80069 - RNA, 64 nt, Human; identical to SEQ ID NO: 7867

SEQ ID NO: 80070 - RNA, 64 nt, Human; identical to SEQ ID NO: 7868

SEQ ID NO: 80071 - RNA, 64 nt, Human; identical to SEQ ID NO: 7869

SEQ ID NO: 80072 - RNA, 64 nt, Human; identical to SEQ ID NO: 7870

SEQ ID NO: 80073 - RNA, 64 nt, Human; identical to SEQ ID NO: 7871

SEQ ID NO: 80074 - RNA, 64 nt, Human; identical to SEQ ID NO: 7872

SEQ ID NO: 80075 - RNA, 64 nt, Human; identical to SEQ ID NO: 7873

SEQ ID NO: 80076 - RNA, 64 nt, Human; identical to SEQ ID NO: 7874

SEQ ID NO: 80077 - RNA, 64 nt, Human; identical to SEQ ID NO: 7875

SEQ ID NO: 80078 - RNA, 64 nt, Human; identical to SEQ ID NO: 7876

SEQ ID NO: 80079 - RNA, 64 nt, Human; identical to SEQ ID NO: 7877

SEQ ID NO: 80080 - RNA, 64 nt, Human; identical to SEQ ID NO: 7878

SEQ ID NO: 80081 - RNA, 64 nt, Human; identical to SEQ ID NO: 7879

SEQ ID NO: 80082 - RNA, 64 nt, Human; identical to SEQ ID NO: 7880

SEQ ID NO: 80083 - RNA, 64 nt, Human; identical to SEQ ID NO: 7881

SEQ ID NO: 80084 - RNA, 64 nt, Human; identical to SEQ ID NO: 7882

SEQ ID NO: 80085 - RNA, 64 nt, Human; identical to SEQ ID NO: 7883

SEQ ID NO: 80086 - RNA, 64 nt, Human; identical to SEQ ID NO: 7884

SEQ ID NO: 80087 - RNA, 64 nt, Human; identical to SEQ ID NO: 7885

SEQ ID NO: 80088 - RNA, 64 nt, Human; identical to SEQ ID NO: 7886

SEQ ID NO: 80089 - RNA, 64 nt, Human; identical to SEQ ID NO: 7887

SEQ ID NO: 80090 - RNA, 64 nt, Human; identical to SEQ ID NO: 7888

SEQ ID NO: 80091 - RNA, 64 nt, Human; identical to SEQ ID NO: 7889

SEQ ID NO: 80092 - RNA, 64 nt, Human; identical to SEQ ID NO: 7890

SEQ ID NO: 80093 - RNA, 64 nt, Human; identical to SEQ ID NO: 7891

SEQ ID NO: 80094 - RNA, 64 nt, Human; identical to SEQ ID NO: 7892

SEQ ID NO: 80095 - RNA, 64 nt, Human; identical to SEQ ID NO: 7893

SEQ ID NO: 80096 - RNA, 64 nt, Human; identical to SEQ ID NO: 7894

SEQ ID NO: 80097 - RNA, 64 nt, Human; identical to SEQ ID NO: 7895

SEQ ID NO: 80098 - RNA, 64 nt, Human; identical to SEQ ID NO: 7896

SEQ ID NO: 80099 - RNA, 64 nt, Human; identical to SEQ ID NO: 7897

SEQ ID NO: 80100 - RNA, 64 nt, Human; identical to SEQ ID NO: 7898

SEQ ID NO: 80101 - RNA, 64 nt, Human; identical to SEQ ID NO: 7899

SEQ ID NO: 80102 - RNA, 64 nt, Human; identical to SEQ ID NO: 7900

SEQ ID NO: 80103 - RNA, 64 nt, Human; identical to SEQ ID NO: 7901

SEQ ID NO: 80104 - RNA, 64 nt, Human; identical to SEQ ID NO: 7902

SEQ ID NO: 80105 - RNA, 64 nt, Human; identical to SEQ ID NO: 7903

SEQ ID NO: 80106 - RNA, 64 nt, Human; identical to SEQ ID NO: 7904

SEQ ID NO: 80107 - RNA, 64 nt, Human; identical to SEQ ID NO: 7905

SEQ ID NO: 80108 - RNA, 64 nt, Human; identical to SEQ ID NO: 7906

SEQ ID NO: 80109 - RNA, 64 nt, Human; identical to SEQ ID NO: 7907

SEQ ID NO: 80110 - RNA, 64 nt, Human; identical to SEQ ID NO: 7908

SEQ ID NO: 80111 - RNA, 64 nt, Human; identical to SEQ ID NO: 7909

SEQ ID NO: 80112 - RNA, 64 nt, Human; identical to SEQ ID NO: 7910

SEQ ID NO: 80113 - RNA, 64 nt, Human; identical to SEQ ID NO: 7911

SEQ ID NO: 80114 - RNA, 64 nt, Human; identical to SEQ ID NO: 7912

SEQ ID NO: 80115 - RNA, 64 nt, Human; identical to SEQ ID NO: 7913

SEQ ID NO: 80116 - RNA, 64 nt, Human; identical to SEQ ID NO: 7914

SEQ ID NO: 80117 - RNA, 64 nt, Human; identical to SEQ ID NO: 7915

SEQ ID NO: 80118 - RNA, 64 nt, Human; identical to SEQ ID NO: 7916

SEQ ID NO: 80119 - RNA, 64 nt, Human; identical to SEQ ID NO: 7917

SEQ ID NO: 80120 - RNA, 64 nt, Human; identical to SEQ ID NO: 7918

SEQ ID NO: 80121 - RNA, 64 nt, Human; identical to SEQ ID NO: 7919

SEQ ID NO: 80122 - RNA, 64 nt, Human; identical to SEQ ID NO: 7920

SEQ ID NO: 80123 - RNA, 64 nt, Human; identical to SEQ ID NO: 7921

SEQ ID NO: 80124 - RNA, 64 nt, Human; identical to SEQ ID NO: 7922

SEQ ID NO: 80125 - RNA, 64 nt, Human; identical to SEQ ID NO: 7923

SEQ ID NO: 80126 - RNA, 64 nt, Human; identical to SEQ ID NO: 7924

SEQ ID NO: 80127 - RNA, 64 nt, Human; identical to SEQ ID NO: 7925

SEQ ID NO: 80128 - RNA, 64 nt, Human; identical to SEQ ID NO: 7926

SEQ ID NO: 80129 - RNA, 64 nt, Human; identical to SEQ ID NO: 7927

SEQ ID NO: 80130 - RNA, 64 nt, Human; identical to SEQ ID NO: 7928

SEQ ID NO: 80131 - RNA, 64 nt, Human; identical to SEQ ID NO: 7929

SEQ ID NO: 80132 - RNA, 64 nt, Human; identical to SEQ ID NO: 7930

SEQ ID NO: 80133 - RNA, 64 nt, Human; identical to SEQ ID NO: 7931

SEQ ID NO: 80134 - RNA, 64 nt, Human; identical to SEQ ID NO: 7932

SEQ ID NO: 80135 - RNA, 64 nt, Human; identical to SEQ ID NO: 7933

SEQ ID NO: 80136 - RNA, 64 nt, Human; identical to SEQ ID NO: 7934

SEQ ID NO: 80137 - RNA, 64 nt, Human; identical to SEQ ID NO: 7935

SEQ ID NO: 80138 - RNA, 64 nt, Human; identical to SEQ ID NO: 7936

SEQ ID NO: 80139 - RNA, 64 nt, Human; identical to SEQ ID NO: 7937

SEQ ID NO: 80140 - RNA, 64 nt, Human; identical to SEQ ID NO: 7938

SEQ ID NO: 80141 - RNA, 64 nt, Human; identical to SEQ ID NO: 7939

SEQ ID NO: 80142 - RNA, 64 nt, Human; identical to SEQ ID NO: 7940

SEQ ID NO: 80143 - RNA, 64 nt, Human; identical to SEQ ID NO: 7941

SEQ ID NO: 80144 - RNA, 64 nt, Human; identical to SEQ ID NO: 7942

SEQ ID NO: 80145 - RNA, 64 nt, Human; identical to SEQ ID NO: 7943

SEQ ID NO: 80146 - RNA, 64 nt, Human; identical to SEQ ID NO: 7944

SEQ ID NO: 80147 - RNA, 64 nt, Human; identical to SEQ ID NO: 7945

SEQ ID NO: 80148 - RNA, 64 nt, Human; identical to SEQ ID NO: 7946

SEQ ID NO: 80149 - RNA, 64 nt, Human; identical to SEQ ID NO: 7947

SEQ ID NO: 80150 - RNA, 64 nt, Human; identical to SEQ ID NO: 7948

SEQ ID NO: 80151 - RNA, 64 nt, Human; identical to SEQ ID NO: 7949

SEQ ID NO: 80152 - RNA, 64 nt, Human; identical to SEQ ID NO: 7950

SEQ ID NO: 80153 - RNA, 64 nt, Human; identical to SEQ ID NO: 7951

SEQ ID NO: 80154 - RNA, 64 nt, Human; identical to SEQ ID NO: 7952

SEQ ID NO: 80155 - RNA, 64 nt, Human; identical to SEQ ID NO: 7953

SEQ ID NO: 80156 - RNA, 64 nt, Human; identical to SEQ ID NO: 7954

SEQ ID NO: 80157 - RNA, 64 nt, Human; identical to SEQ ID NO: 7955

SEQ ID NO: 80158 - RNA, 64 nt, Human; identical to SEQ ID NO: 7956

SEQ ID NO: 80159 - RNA, 64 nt, Human; identical to SEQ ID NO: 7957

SEQ ID NO: 80160 - RNA, 64 nt, Human; identical to SEQ ID NO: 7958

SEQ ID NO: 80161 - RNA, 64 nt, Human; identical to SEQ ID NO: 7959

SEQ ID NO: 80162 - RNA, 64 nt, Human; identical to SEQ ID NO: 7960

SEQ ID NO: 80163 - RNA, 64 nt, Human; identical to SEQ ID NO: 7961

SEQ ID NO: 80164 - RNA, 64 nt, Human; identical to SEQ ID NO: 7962

SEQ ID NO: 80165 - RNA, 64 nt, Human; identical to SEQ ID NO: 7963

SEQ ID NO: 80166 - RNA, 64 nt, Human; identical to SEQ ID NO: 7964

SEQ ID NO: 80167 - RNA, 64 nt, Human; identical to SEQ ID NO: 7965

SEQ ID NO: 80168 - RNA, 64 nt, Human; identical to SEQ ID NO: 7966

SEQ ID NO: 80169 - RNA, 64 nt, Human; identical to SEQ ID NO: 7967

SEQ ID NO: 80170 - RNA, 64 nt, Human; identical to SEQ ID NO: 7968

SEQ ID NO: 80171 - RNA, 64 nt, Human; identical to SEQ ID NO: 7969

SEQ ID NO: 80172 - RNA, 64 nt, Human; identical to SEQ ID NO: 7970

SEQ ID NO: 80173 - RNA, 64 nt, Human; identical to SEQ ID NO: 7971

SEQ ID NO: 80174 - RNA, 64 nt, Human; identical to SEQ ID NO: 7972

SEQ ID NO: 80175 - RNA, 64 nt, Human; identical to SEQ ID NO: 7973

SEQ ID NO: 80176 - RNA, 64 nt, Human; identical to SEQ ID NO: 7974

SEQ ID NO: 80177 - RNA, 64 nt, Human; identical to SEQ ID NO: 7975

SEQ ID NO: 80178 - RNA, 64 nt, Human; identical to SEQ ID NO: 7976

SEQ ID NO: 80179 - RNA, 64 nt, Human; identical to SEQ ID NO: 7977

SEQ ID NO: 80180 - RNA, 64 nt, Human; identical to SEQ ID NO: 7978

SEQ ID NO: 80181 - RNA, 64 nt, Human; identical to SEQ ID NO: 7979

SEQ ID NO: 80182 - RNA, 64 nt, Human; identical to SEQ ID NO: 7980

SEQ ID NO: 80183 - RNA, 64 nt, Human; identical to SEQ ID NO: 7981

SEQ ID NO: 80184 - RNA, 64 nt, Human; identical to SEQ ID NO: 7982

SEQ ID NO: 80185 - RNA, 64 nt, Human; identical to SEQ ID NO: 7983

SEQ ID NO: 80186 - RNA, 64 nt, Human; identical to SEQ ID NO: 7984

SEQ ID NO: 80187 - RNA, 64 nt, Human; identical to SEQ ID NO: 7985

SEQ ID NO: 80188 - RNA, 64 nt, Human; identical to SEQ ID NO: 7986

SEQ ID NO: 80189 - RNA, 64 nt, Human; identical to SEQ ID NO: 7987

SEQ ID NO: 80190 - RNA, 64 nt, Human; identical to SEQ ID NO: 7988

SEQ ID NO: 80191 - RNA, 64 nt, Human; identical to SEQ ID NO: 7989

SEQ ID NO: 80192 - RNA, 64 nt, Human; identical to SEQ ID NO: 7990

SEQ ID NO: 80193 - RNA, 64 nt, Human; identical to SEQ ID NO: 7991

SEQ ID NO: 80194 - RNA, 64 nt, Human; identical to SEQ ID NO: 7992

SEQ ID NO: 80195 - RNA, 64 nt, Human; identical to SEQ ID NO: 7993

SEQ ID NO: 80196 - RNA, 64 nt, Human; identical to SEQ ID NO: 7994

SEQ ID NO: 80197 - RNA, 64 nt, Human; identical to SEQ ID NO: 7995

SEQ ID NO: 80198 - RNA, 64 nt, Human; identical to SEQ ID NO: 7996

SEQ ID NO: 80199 - RNA, 64 nt, Human; identical to SEQ ID NO: 7997

SEQ ID NO: 80200 - RNA, 64 nt, Human; identical to SEQ ID NO: 7998

SEQ ID NO: 80201 - RNA, 64 nt, Human; identical to SEQ ID NO: 7999

SEQ ID NO: 80202 - RNA, 64 nt, Human; identical to SEQ ID NO: 8000

SEQ ID NO: 80203 - RNA, 64 nt, Human; identical to SEQ ID NO: 8001

SEQ ID NO: 80204 - RNA, 64 nt, Human; identical to SEQ ID NO: 8002

SEQ ID NO: 80205 - RNA, 64 nt, Human; identical to SEQ ID NO: 8003

SEQ ID NO: 80206 - RNA, 64 nt, Human; identical to SEQ ID NO: 8004

SEQ ID NO: 80207 - RNA, 64 nt, Human; identical to SEQ ID NO: 8005

SEQ ID NO: 80208 - RNA, 58 nt, Human; identical to SEQ ID NO: 8006

SEQ ID NO: 80209 - RNA, 64 nt, Human; identical to SEQ ID NO: 8007

SEQ ID NO: 80210 - RNA, 64 nt, Human; identical to SEQ ID NO: 8008

SEQ ID NO: 80211 - RNA, 64 nt, Human; identical to SEQ ID NO: 8009

SEQ ID NO: 80212 - RNA, 64 nt, Human; identical to SEQ ID NO: 8010

SEQ ID NO: 80213 - RNA, 64 nt, Human; identical to SEQ ID NO: 8011

SEQ ID NO: 80214 - RNA, 64 nt, Human; identical to SEQ ID NO: 8012

SEQ ID NO: 80215 - RNA, 64 nt, Human; identical to SEQ ID NO: 8013

SEQ ID NO: 80216 - RNA, 64 nt, Human; identical to SEQ ID NO: 8014

SEQ ID NO: 80217 - RNA, 64 nt, Human; identical to SEQ ID NO: 8015

SEQ ID NO: 80218 - RNA, 64 nt, Human; identical to SEQ ID NO: 8016

SEQ ID NO: 80219 - RNA, 64 nt, Human; identical to SEQ ID NO: 8017

SEQ ID NO: 80220 - RNA, 64 nt, Human; identical to SEQ ID NO: 8018

SEQ ID NO: 80221 - RNA, 64 nt, Human; identical to SEQ ID NO: 8019

SEQ ID NO: 80222 - RNA, 64 nt, Human; identical to SEQ ID NO: 8020

SEQ ID NO: 80223 - RNA, 64 nt, Human; identical to SEQ ID NO: 8021

SEQ ID NO: 80224 - RNA, 64 nt, Human; identical to SEQ ID NO: 8022

SEQ ID NO: 80225 - RNA, 64 nt, Human; identical to SEQ ID NO: 8023

SEQ ID NO: 80226 - RNA, 64 nt, Human; identical to SEQ ID NO: 8024

SEQ ID NO: 80227 - RNA, 64 nt, Human; identical to SEQ ID NO: 8025

SEQ ID NO: 80228 - RNA, 64 nt, Human; identical to SEQ ID NO: 8026

SEQ ID NO: 80229 - RNA, 64 nt, Human; identical to SEQ ID NO: 8027

SEQ ID NO: 80230 - RNA, 64 nt, Human; identical to SEQ ID NO: 8028

SEQ ID NO: 80231 - RNA, 64 nt, Human; identical to SEQ ID NO: 8029

SEQ ID NO: 80232 - RNA, 64 nt, Human; identical to SEQ ID NO: 8030

SEQ ID NO: 80233 - RNA, 64 nt, Human; identical to SEQ ID NO: 8031

SEQ ID NO: 80234 - RNA, 64 nt, Human; identical to SEQ ID NO: 8032

SEQ ID NO: 80235 - RNA, 64 nt, Human; identical to SEQ ID NO: 8033

SEQ ID NO: 80236 - RNA, 64 nt, Human; identical to SEQ ID NO: 8034

SEQ ID NO: 80237 - RNA, 64 nt, Human; identical to SEQ ID NO: 8035

SEQ ID NO: 80238 - RNA, 64 nt, Human; identical to SEQ ID NO: 8036

SEQ ID NO: 80239 - RNA, 64 nt, Human; identical to SEQ ID NO: 8037

SEQ ID NO: 80240 - RNA, 64 nt, Human; identical to SEQ ID NO: 8038

SEQ ID NO: 80241 - RNA, 64 nt, Human; identical to SEQ ID NO: 8039

SEQ ID NO: 80242 - RNA, 64 nt, Human; identical to SEQ ID NO: 8040

SEQ ID NO: 80243 - RNA, 64 nt, Human; identical to SEQ ID NO: 8041

SEQ ID NO: 80244 - RNA, 64 nt, Human; identical to SEQ ID NO: 8042

SEQ ID NO: 80245 - RNA, 64 nt, Human; identical to SEQ ID NO: 8043

SEQ ID NO: 80246 - RNA, 64 nt, Human; identical to SEQ ID NO: 8044

SEQ ID NO: 80247 - RNA, 64 nt, Human; identical to SEQ ID NO: 8045

SEQ ID NO: 80248 - RNA, 64 nt, Human; identical to SEQ ID NO: 8046

SEQ ID NO: 80249 - RNA, 61 nt, Human; identical to SEQ ID NO: 8047

SEQ ID NO: 80250 - RNA, 64 nt, Human; identical to SEQ ID NO: 8048

SEQ ID NO: 80251 - RNA, 64 nt, Human; identical to SEQ ID NO: 8049

SEQ ID NO: 80252 - RNA, 64 nt, Human; identical to SEQ ID NO: 8050

SEQ ID NO: 80253 - RNA, 64 nt, Human; identical to SEQ ID NO: 8051

SEQ ID NO: 80254 - RNA, 64 nt, Human; identical to SEQ ID NO: 8052

SEQ ID NO: 80255 - RNA, 64 nt, Human; identical to SEQ ID NO: 8053

SEQ ID NO: 80256 - RNA, 64 nt, Human; identical to SEQ ID NO: 8054

SEQ ID NO: 80257 - RNA, 64 nt, Human; identical to SEQ ID NO: 8055

SEQ ID NO: 80258 - RNA, 64 nt, Human; identical to SEQ ID NO: 8056

SEQ ID NO: 80259 - RNA, 64 nt, Human; identical to SEQ ID NO: 8057

SEQ ID NO: 80260 - RNA, 64 nt, Human; identical to SEQ ID NO: 8058

SEQ ID NO: 80261 - RNA, 64 nt, Human; identical to SEQ ID NO: 8059

SEQ ID NO: 80262 - RNA, 64 nt, Human; identical to SEQ ID NO: 8060

SEQ ID NO: 80263 - RNA, 64 nt, Human; identical to SEQ ID NO: 8061

SEQ ID NO: 80264 - RNA, 64 nt, Human; identical to SEQ ID NO: 8062

SEQ ID NO: 80265 - RNA, 64 nt, Human; identical to SEQ ID NO: 8063

SEQ ID NO: 80266 - RNA, 64 nt, Human; identical to SEQ ID NO: 8064

SEQ ID NO: 80267 - RNA, 64 nt, Human; identical to SEQ ID NO: 8065

SEQ ID NO: 80268 - RNA, 64 nt, Human; identical to SEQ ID NO: 8066

SEQ ID NO: 80269 - RNA, 64 nt, Human; identical to SEQ ID NO: 8067

SEQ ID NO: 80270 - RNA, 64 nt, Human; identical to SEQ ID NO: 8068

SEQ ID NO: 80271 - RNA, 64 nt, Human; identical to SEQ ID NO: 8069

SEQ ID NO: 80272 - RNA, 64 nt, Human; identical to SEQ ID NO: 8070

SEQ ID NO: 80273 - RNA, 64 nt, Human; identical to SEQ ID NO: 8071

SEQ ID NO: 80274 - RNA, 64 nt, Human; identical to SEQ ID NO: 8072

SEQ ID NO: 80275 - RNA, 64 nt, Human; identical to SEQ ID NO: 8073

SEQ ID NO: 80276 - RNA, 64 nt, Human; identical to SEQ ID NO: 8074

SEQ ID NO: 80277 - RNA, 64 nt, Human; identical to SEQ ID NO: 8075

SEQ ID NO: 80278 - RNA, 64 nt, Human; identical to SEQ ID NO: 8076

SEQ ID NO: 80279 - RNA, 64 nt, Human; identical to SEQ ID NO: 8077

SEQ ID NO: 80280 - RNA, 64 nt, Human; identical to SEQ ID NO: 8078

SEQ ID NO: 80281 - RNA, 64 nt, Human; identical to SEQ ID NO: 8079

SEQ ID NO: 80282 - RNA, 64 nt, Human; identical to SEQ ID NO: 8080

SEQ ID NO: 80283 - RNA, 64 nt, Human; identical to SEQ ID NO: 8081

SEQ ID NO: 80284 - RNA, 64 nt, Human; identical to SEQ ID NO: 8082

SEQ ID NO: 80285 - RNA, 64 nt, Human; identical to SEQ ID NO: 8083

SEQ ID NO: 80286 - RNA, 64 nt, Human; identical to SEQ ID NO: 8084

SEQ ID NO: 80287 - RNA, 64 nt, Human; identical to SEQ ID NO: 8085

SEQ ID NO: 80288 - RNA, 64 nt, Human; identical to SEQ ID NO: 8086

SEQ ID NO: 80289 - RNA, 64 nt, Human; identical to SEQ ID NO: 8087

SEQ ID NO: 80290 - RNA, 64 nt, Human; identical to SEQ ID NO: 8088

SEQ ID NO: 80291 - RNA, 64 nt, Human; identical to SEQ ID NO: 8089

SEQ ID NO: 80292 - RNA, 64 nt, Human; identical to SEQ ID NO: 8090

SEQ ID NO: 80293 - RNA, 64 nt, Human; identical to SEQ ID NO: 8091

SEQ ID NO: 80294 - RNA, 64 nt, Human; identical to SEQ ID NO: 8092

SEQ ID NO: 80295 - RNA, 64 nt, Human; identical to SEQ ID NO: 8093

SEQ ID NO: 80296 - RNA, 64 nt, Human; identical to SEQ ID NO: 8094

SEQ ID NO: 80297 - RNA, 64 nt, Human; identical to SEQ ID NO: 8095

SEQ ID NO: 80298 - RNA, 64 nt, Human; identical to SEQ ID NO: 8096

SEQ ID NO: 80299 - RNA, 64 nt, Human; identical to SEQ ID NO: 8097

SEQ ID NO: 80300 - RNA, 64 nt, Human; identical to SEQ ID NO: 8098

SEQ ID NO: 80301 - RNA, 64 nt, Human; identical to SEQ ID NO: 8099

SEQ ID NO: 80302 - RNA, 64 nt, Human; identical to SEQ ID NO: 8100

SEQ ID NO: 80303 - RNA, 64 nt, Human; identical to SEQ ID NO: 8101

SEQ ID NO: 80304 - RNA, 64 nt, Human
aucugcagauggccuaauacuuaguuguccaagucgcgaucaaggacucucucacacaggaaac

SEQ ID NO: 80305 - RNA, 64 nt, Human
ccccgacagacacugugaacggaagacagcaggccgcgaucagagucgcuguucauucagccgc

SEQ ID NO: 80306 - RNA, 64 nt, Human
gaguggcggcgccccugauaaaaggccgaggauucgcgaucagggugcaacuucacucccuccu

SEQ ID NO: 80307 - RNA, 64 nt, Human; identical to SEQ ID NO: 80304

SEQ ID NO: 80308 - RNA, 64 nt, Human; identical to SEQ ID NO: 80305

SEQ ID NO: 80309 - RNA, 64 nt, Human; identical to SEQ ID NO: 80306

SEQ ID NO: 80310 - RNA, 64 nt, Human
cgccaggaggccacgggccacgggaagaaccaagcggugccagccacgagacgucaccaagaaa

SEQ ID NO: 80311 - RNA, 64 nt, Human
caccuacacaggagucuucagacccagagaaggacggugccaagggccccaggggcagcaaggc

SEQ ID NO: 80312 - RNA, 64 nt, Human
acacucagagcuagucaguacaugaacaguggugcggugccagucuguguccguugugaucaca

SEQ ID NO: 80313 - RNA, 64 nt, Human
gacuguacaagcagaguacaacuacccgccuccccggugccagggcgccuguuggguuuggucc

SEQ ID NO: 80314 - RNA, 64 nt, Human
uccagaugaugauucagaagcuaauuuuaaaaaacggugccagguaccacaacaguaacagaac

SEQ ID NO: 80315 - RNA, 64 nt, Human
ugaaaaugcgccuccuccucggagacagacgcaucggugccaccuaguggcuggugggaguaac

SEQ ID NO: 80316 - RNA, 64 nt, Human
ccuuggaguuaggagccacccugggagguugugccggugccaugcuccucccugugucuuguau

SEQ ID NO: 80317 - RNA, 64 nt, Human
cccaacccagguuuaugcgucuccagggaagccucggugccagaguggugggcagaucugacca

SEQ ID NO: 80318 - RNA, 64 nt, Human
ucuuaguucuaaagaaucuuggguuauuuuguagcggugccaguauuucaguagaugggauuuc

SEQ ID NO: 80319 - RNA, 64 nt, Human
caccuccugcuggcuaccggggcaggcaugcacccggugccagccccgcucugggcaccaccug

SEQ ID NO: 80320 - RNA, 64 nt, Human
cacccaaaggagcuccgccuggacuuuggcucagcggugccacugaggacccgugugacucgcc

SEQ ID NO: 80321 - RNA, 64 nt, Human
uuuuuuaaagagauggaggcuggcucuguuggugcggugccaugaucauaguucacuauaaccu

SEQ ID NO: 80322 - RNA, 64 nt, Human
cugcagagugccuucaaaacucagcuguuccagccggugccaaccugugaacuucccaccauau

SEQ ID NO: 80323 - RNA, 64 nt, Human
uggaagcccggugucaugaaaugaaaccaaaccucggugccaucgcagaguauaaaaagaaggu

SEQ ID NO: 80324 - RNA, 64 nt, Human
cugggaaaaggagguacacagccaucaugcgagucggugccaggggaccccccggagauccuga

SEQ ID NO: 80325 - RNA, 64 nt, Human
ccacggccgaauagccgugagccggaauccugcacggugccaccuccacacucaccucaccucu

SEQ ID NO: 80326 - RNA, 64 nt, Human
guaaagguuaaacuugaaaagaaauucuuaaucacggugccaaaauucauuuucuaacaccaug

SEQ ID NO: 80327 - RNA, 64 nt, Human
guagcauuucauucuucucuagcuggugguuucacggugccagguuuucuggguguccaaagga

SEQ ID NO: 80328 - RNA, 64 nt, Human
ggaugagaaagccugaggugccuggcaugcccaccggugccacucugcagccuccaccccuggc

SEQ ID NO: 80329 - RNA, 64 nt, Human
uugaugucauuggccucucccaccgauuucauuacggugccacgcagucauggaucuggguagu

SEQ ID NO: 80330 - RNA, 64 nt, Human
acacuugcucaguucaggcagcucugcuggagggcggugccaugccuaagccugugcacaugca

SEQ ID NO: 80331 - RNA, 64 nt, Human
guuuccugacagccgcugcaauacacagucuugacggugccauccggguacucccuccucuuga

SEQ ID NO: 80332 - RNA, 64 nt, Human
accgggugagcaacaggaggacgaggggccggggcggugccaggcuaccacaagaaccugcguc

SEQ ID NO: 80333 - RNA, 64 nt, Human
ggcugugcccaccacccuucccagaacccucggacggugccagggccgcccgcguccucgccag

SEQ ID NO: 80334 - RNA, 64 nt, Human
cuccuucuucuguuccauuucaguucaguuucagcggugccaaccucuuugcguuuccuuuuug

SEQ ID NO: 80335 - RNA, 64 nt, Human
acuaacgacacauacaugaaauuuagcugguuaacggugccagaaaagucacuggacaaagaac

SEQ ID NO: 80336 - RNA, 64 nt, Human
ccccauggcaggaacagccacuugcaucuggucccggugccacacugcggugcuuggugugguu

SEQ ID NO: 80337 - RNA, 64 nt, Human
ugcaccuggggacccagagcgagauggguuuguucggugccagccgaccaagauugacuaguuu

SEQ ID NO: 80338 - RNA, 64 nt, Human
uuccgugcucgagccguuuuuacccagcuggguacggugccacguucaggcacgugcacccggc

SEQ ID NO: 80339 - RNA, 64 nt, Human
ucaaaaaaaaaauugguguucaugacucuguggucggugccagaggaaaauaggaacgacucua

SEQ ID NO: 80340 - RNA, 64 nt, Human
gagcaucauuccuuucuaucugcugccagagccacggugccauuuacuccaaggacucacuuuc

SEQ ID NO: 80341 - RNA, 64 nt, Human
aggaaggagacagacagcuggcaguuccucgccucggugccaucagggaggagccuuaaguucc

SEQ ID NO: 80342 - RNA, 64 nt, Human
uggacaggcgggcucggaggcuacccgcuguggccggugccagcugcccuugcaggguggguga

SEQ ID NO: 80343 - RNA, 64 nt, Human
uucugcacacucggccaguucccucuccaauguccggugccaucuuuccugaccuuuguuucuu

SEQ ID NO: 80344 - RNA, 64 nt, Human
aggguuccgaaggcgccauccccggaccuaggaccggugccagcccugacuccgccgccccucu

SEQ ID NO: 80345 - RNA, 64 nt, Human
aagaacagcaugaggacuugcugagacugccucacggugccaccaugcggaccggggggaggca

SEQ ID NO: 80346 - RNA, 64 nt, Human
gcagcuggagaggaagccuggggcacguccugugcggugccaccaaggccccaccccugccccu

SEQ ID NO: 80347 - RNA, 64 nt, Human
gugucuuuggaggugcugcuuaauaccaaacaugcggugccaugaagggacccuuuggggguug

SEQ ID NO: 80348 - RNA, 64 nt, Human
ccccgggcacggccccagcuccguggggcucucacggugccaaucacaagacccaggguugugc

SEQ ID NO: 80349 - RNA, 64 nt, Human
gauguugggaggagaaaccaucacaagauucccucggugccacagcugugcugaggaggccggg

SEQ ID NO: 80350 - RNA, 64 nt, Human
cuaaaccucgugcuugugaacuccauacagaaaacggugccaucccugaacacggcuggccacu

SEQ ID NO: 80351 - RNA, 64 nt, Human
uccuguggaaggcagaggcagugagggagguggacggugccagcugaggcugaggcaugcagca

SEQ ID NO: 80352 - RNA, 64 nt, Human
ugaaaaaaaaguuuguuguauagucaaaacaaaucggugccacccggccgugacaaauccuagu

SEQ ID NO: 80353 - RNA, 64 nt, Human
cuagcaaugaagguugggaagguuguucccuucccggugccagguccagauuucccuccaugau

SEQ ID NO: 80354 - RNA, 64 nt, Human
ugaaccgcucuggucugcuccucagagagggcagcggugccaggccucaggucagggagaaugu

SEQ ID NO: 80355 - RNA, 62 nt, Human
ucaaugaagaugagccguaacagcagccucggcggugccacccacugcacuggggccagcug

SEQ ID NO: 80356 - RNA, 64 nt, Human
uuaauccaucuaagugacauuuuugaaauuccagcggugccacccaaucaugcccagcuucugu

SEQ ID NO: 80357 - RNA, 64 nt, Human
cccucugcaacuacaaauagcagagugagccaggcggugccaaagcaagggcuaguugagacau

SEQ ID NO: 80358 - RNA, 64 nt, Human
auucacaucucuucuugcauguaccuaagaggggcggugccauuguuugggggcuuggggggcu

SEQ ID NO: 80359 - RNA, 64 nt, Human
gauguugcacuuggcuggcuuaugccucugagaucggugccacggcuguauuuauuucaguugu

SEQ ID NO: 80360 - RNA, 64 nt, Human
uaagaauaugucagaagagugcucgguuagcccacggugccaaaacuccaaacaaguuccccgg

SEQ ID NO: 80361 - RNA, 64 nt, Human
aggggacaggacagaaagccugcacugaggggugcggugccaacagggaaacucuucaccuccc

SEQ ID NO: 80362 - RNA, 64 nt, Human
guacucauaugggauucccagaaaaccugccuaacggugccacugcugacaauggugaugaugg

SEQ ID NO: 80363 - RNA, 64 nt, Human
ccacucucugugaauaccuacccccuucuggccacggugccauaccuguuucuuccugugacug

SEQ ID NO: 80364 - RNA, 64 nt, Human
ugaagaagaagaaguugugaggacagcugccgcccggugccaccucgugguagacuaugacggu

SEQ ID NO: 80365 - RNA, 64 nt, Human
gguaugugcaggauacaguguguuucaucuguuccggugccaagaaugagcaguguacuguggc

SEQ ID NO: 80366 - RNA, 64 nt, Human
ggggcucaucgagggucucaggccgaggccacugcggugccagugccccccugaggacuagggc

SEQ ID NO: 80367 - RNA, 64 nt, Human
gagcuccccuguuccccuucauugaaaaccaccacggugccaucucuuguguaugcagggcuau

SEQ ID NO: 80368 - RNA, 64 nt, Human
gaacaccugugccucccugcucggccagcggccacggugccagagucaccaccuugccggccac

SEQ ID NO: 80369 - RNA, 64 nt, Human
uguauuaagccuuaacacuuuucuuaagugcauucggugccaacauuuuuuagagcuguaccaa

SEQ ID NO: 80370 - RNA, 64 nt, Human
aagagcagagaaaucaucaccaccuugggccccacggugccacgggcucaggcagcacaguagg

SEQ ID NO: 80371 - RNA, 64 nt, Human
accugcaucuggggcccauacugguuggcucccgcggugccaugucugcagugugccccccagc

SEQ ID NO: 80372 - RNA, 64 nt, Human
cgggggugcagcuucaacucucucggcgguagggcggugccauccccacccauagggcuggcuc

SEQ ID NO: 80373 - RNA, 64 nt, Human
agcucagaaccacgggggucugugccggcagcaccggugccaucuuggcuuccacaaauuccag

SEQ ID NO: 80374 - RNA, 64 nt, Human
agucuuugguuggaguguugugaaaguggacccgcggugccacuagauggcacuuggugccuag

SEQ ID NO: 80375 - RNA, 64 nt, Human
auccccagacaucaccaggucuaauguuuacaaacggugccagcccggcucugaagccaagggc

SEQ ID NO: 80376 - RNA, 64 nt, Human
uuaggaagggugaguggcugguuccagggugggccggugccagcuccgggguggacugaacagc

SEQ ID NO: 80377 - RNA, 64 nt, Human
cacauugacauuuccauuacacacagcacugcugcggugccagggaccuagcgcaggacuuuug

SEQ ID NO: 80378 - RNA, 64 nt, Human
ucauaaagcuuccgugacuucuaaaccaucaggucggugccauaagagaugcucaaaaaagcau

SEQ ID NO: 80379 - RNA, 64 nt, Human
auggaguaauggauucaaagagauucugucuuaccggugccagucaguacuccagggaugggag

SEQ ID NO: 80380 - RNA, 64 nt, Human
gagaggaccccucucuuaauacagcugcuuuucucggugccaaccucccucccccaagcucaga

SEQ ID NO: 80381 - RNA, 64 nt, Human
cggggccugcaggccagucccacggcucugugcccggugccaucuuccauauccgggugcucaa

SEQ ID NO: 80382 - RNA, 64 nt, Human
ucuuuccuugaaggggcgggcaccaggcuagguccggugccaauaaauccuuguggaaucugac

SEQ ID NO: 80383 - RNA, 64 nt, Human
uggcaaaaggagccucacacccccaaggaggggacggugccacuuccagacaagacccacaaau

SEQ ID NO: 80384 - RNA, 64 nt, Human
ggccaucaucugcugcuggggcccccccaccacgcggugccaggcccagugucccccaggccgu

SEQ ID NO: 80385 - RNA, 64 nt, Human
aagggcaugaagcgaggacccgagggcagccucucggugccaagagccauccccgccaacagcc

SEQ ID NO: 80386 - RNA, 64 nt, Human
ggcagugccagccacgggaaccaggagcgagagacggugccagaacgccggggcccggggcaac

SEQ ID NO: 80387 - RNA, 64 nt, Human
guggacauagcuuccaaggagugcggccacaagccggugccagcaugagagcaggcacagaagg

SEQ ID NO: 80388 - RNA, 63 nt, Human
ucgacuuucuuuccaacugagggcgcgccggcgcggugccagcgccgucugcccggccccgcc

SEQ ID NO: 80389 - RNA, 64 nt, Human
uuccugucacucccggggcugucccuguacuacacggugccauggagccggggagagcggggaa

SEQ ID NO: 80390 - RNA, 64 nt, Human
caggacugccagggaucggagugcgggccgcgcacggugccaggauuccgccgaggggaagccg

SEQ ID NO: 80391 - RNA, 64 nt, Human
cagccucugagucccguggggccccggcucccaccggugccaaacccagccccugcggccguca

SEQ ID NO: 80392 - RNA, 64 nt, Human
agcgacagagcaguugagaggacacucccguuuucggugccaucagugccccgucuacagcucc

SEQ ID NO: 80393 - RNA, 64 nt, Human
cagcuuggagauccaggggcgcauggagaggccacggugccagagguucagggagaacagcugc

SEQ ID NO: 80394 - RNA, 64 nt, Human
auguucagaaagugauccugguuucuaggucuuugcucugcaggaucgggaucagagcguggga

SEQ ID NO: 80395 - RNA, 64 nt, Human
cuuucucuaaagccgcccgccagcccaggccgcugcucugcaccgagcuggugggcuuggguuu

SEQ ID NO: 80396 - RNA, 64 nt, Human
gggauucuguggaaguuuguaaauaaagcucagugcucugcagcucaagucccacgugugcugg

SEQ ID NO: 80397 - RNA, 64 nt, Human
aauccacuagcaccgaccccaccaccugguuccggcucugcacgcuuugggguguggaugucga

SEQ ID NO: 80398 - RNA, 64 nt, Human
cugagugguuaucaccucagugaaucuucccagggcucugcaguaaaaacaaaggacaacccag

SEQ ID NO: 80399 - RNA, 64 nt, Human
cuguauuccuacugccgcccagaaaaggggcagggcucugcagccgccaggacagacgagcacc

SEQ ID NO: 80400 - RNA, 64 nt, Human
cccagcucgacggcacugggccaguucccccucugcucugcagcucgguuuccuuuucuagaau

SEQ ID NO: 80401 - RNA, 64 nt, Human
gcugccugggaugcccccugcccccuccuggaaggcucugcagagaugacugggcuggggaagc

SEQ ID NO: 80402 - RNA, 64 nt, Human
cccuuuggggaggggaguucuccugggacagugggcucugcauguucuccacuuggauacauuu

SEQ ID NO: 80403 - RNA, 64 nt, Human
guacugagaccacagcuucuuggccucccuuccagcucugcagcuaaugagguccugccacaac

SEQ ID NO: 80404 - RNA, 64 nt, Human
uugaggugaaaugggggcaggaaagccacaucuugcucugcauuuauaaagaccguacaaacuc

SEQ ID NO: 80405 - RNA, 64 nt, Human
cacggggcugcugagggucuguggaacuccagcagcucugcacuggguagagcugggccuagag

SEQ ID NO: 80406 - RNA, 64 nt, Human
cugccuguuucuucucucuuucuccuucaaacuugcucugcagcuaaggaaggugagucuacuu

SEQ ID NO: 80407 - RNA, 64 nt, Human
uuccucuuuuuauuuaguuccuugaguugauucagcucugcaagaauugaagcaggacuaaaug

SEQ ID NO: 80408 - RNA, 64 nt, Human
gcuuucuuucccuuacucccuaucuaacacuuuugcucugcaggcagccuugcccauucucuaa

SEQ ID NO: 80409 - RNA, 64 nt, Human
augcugucuugagaauccaagagaaucacaugcagcucugcaacaguuuuugcucaaaaauguu

SEQ ID NO: 80410 - RNA, 64 nt, Human
uuuccuacuaccuuuacccaguuuguguguuugagcucugcauucaggcagcugcaacauucca

SEQ ID NO: 80411 - RNA, 64 nt, Human
guagagcugauuugaggccuccuucuggggcugggcucugcaggccagguggguguggccugug

SEQ ID NO: 80412 - RNA, 64 nt, Human
cuuggugacugagacccuuggguggcgcuucccagcucugcaggcccuccuggccuuuucugca

SEQ ID NO: 80413 - RNA, 64 nt, Human
cauggccgcuggaagagaggcgccuccuggccuggcucugcagaacccaggggcacgcucuggg

SEQ ID NO: 80414 - RNA, 64 nt, Human
ucaggggaaugggaccagcaggacauaugggcaagcucugcaggacagacagacagacaaaccc

SEQ ID NO: 80415 - RNA, 64 nt, Human
ugcauguauccucuggcgcgaaugcucucuguuggcucugcaguacaauauguaaccaauaaag

SEQ ID NO: 80416 - RNA, 64 nt, Human
cagcuggaccuaguuucacaaucuguugucuccagcucugcauaugucuggccagggggcuucu

SEQ ID NO: 80417 - RNA, 64 nt, Human
cucuggggacugucgggggguacagagggagaaggcucugcaagagcucccuggcaauaccccc

SEQ ID NO: 80418 - RNA, 64 nt, Human
uaaggccuggcucacaggcugugggguugaucuggcucugcagaggcccuaggcagcuuguuga

SEQ ID NO: 80419 - RNA, 60 nt, Human
aagaccaucccauuacuuagugacccaugagcucugcaucaaggguuauuccaggggcua

SEQ ID NO: 80420 - RNA, 64 nt, Human
acccacuuugucuuggugggaguggguccgcgcugcucugcagcaggggcuggggaguggacag

SEQ ID NO: 80421 - RNA, 64 nt, Human
caugagagcuuccugaguguucucgucaaguacagcucugcaccguuguggcucuagaucacug

SEQ ID NO: 80422 - RNA, 64 nt, Human
cucucccguauuucauuucugcacccagggggcggcucugcaggauugcuuacggagaacucug

SEQ ID NO: 80423 - RNA, 64 nt, Human
gcaaaugauaaaguaacugacucagugucuuugggcucugcaggcuuuagccuuguuuugguag

SEQ ID NO: 80424 - RNA, 64 nt, Human
gccuuccccagcugccucaacucugucucuggcagcucugcacccagggaccaugugcucucca

SEQ ID NO: 80425 - RNA, 64 nt, Human
ugucucugccucccucacccugagccccuuccuugcucugcacccccauauggucauagcccag

SEQ ID NO: 80426 - RNA, 64 nt, Human
ugaaggaaccccuggagcagaaggacuuacuguugcucugcaacucacccugcaucuccaaggg

SEQ ID NO: 80427 - RNA, 64 nt, Human
agacacagaccgggggacucgggcacugcuccuggcucugcagaaggugugggccuucugcuua

SEQ ID NO: 80428 - RNA, 64 nt, Human
gcuccuggccagaaccagccucugcggggcuugugcucugcaaagacucugcugcuggggauuc

SEQ ID NO: 80429 - RNA, 64 nt, Human
aaaaaaugcagauguauuucacucuccccggucagcucugcaucagguguuuucugagcaaacc

SEQ ID NO: 80430 - RNA, 64 nt, Human
uaagaaguggggcagauggcagggcugaggaugggcucugcaucccccaaagccaucccuuccc

SEQ ID NO: 80431 - RNA, 64 nt, Human
accuuucuuugugugccuccuacgcacaaagccagcucugcaguggaaucuggggauuauagcc

SEQ ID NO: 80432 - RNA, 64 nt, Human
uccuauccaggcaccuauucugaaucaccauguugcucugcagcuagaguugauaggagaaaau

SEQ ID NO: 80433 - RNA, 64 nt, Human
uccucagcaggggaagguggauguuuaggcuugggcucugcaugcaugugacuugcuucuuuuu

SEQ ID NO: 80434 - RNA, 64 nt, Human
ugugccucugccugucucccccaccgggcugggagcucugcagagcaggaaacaugacucguau

SEQ ID NO: 80435 - RNA, 64 nt, Human
gccuucugggcagggaccucggggggcuucaagggcucugcacggcuguggggcccugugccuu

SEQ ID NO: 80436 - RNA, 64 nt, Human
cuguaggaagaugauggcucauuuacacucagcugcucugcaagcagaaacuuuacaaccugau

SEQ ID NO: 80437 - RNA, 64 nt, Human
ucuaagaagugaaaaucuacacuccagugagacagcucugcauacucauuaggauggcuaguau

SEQ ID NO: 80438 - RNA, 64 nt, Human
cuagcugugucuaagaaccuauucagcucacccugcucugcaucugacaguacaggugcauggc

SEQ ID NO: 80439 - RNA, 64 nt, Human
caucagcucagccccugggaagggcguggcaggggcucugcaugcccgugacaguguuaggugu

SEQ ID NO: 80440 - RNA, 64 nt, Human
ugccucucugccagccgcuggugcccaccagcuggcucugcagcacauugcccugaggggccug

SEQ ID NO: 80441 - RNA, 64 nt, Human
gacuuggauagcuugaugucucaugacgagcggcgcucugcaucccucacccaugccuccuaac

SEQ ID NO: 80442 - RNA, 64 nt, Human
uugcuagcauguuaugauuucauauccugagauagcucugcagauaagaaaauauuuaaauaua

SEQ ID NO: 80443 - RNA, 64 nt, Human
gacacuaguacugugccuucuuucacugcccucugcucugcagcucucacccagcuuggcugcu

SEQ ID NO: 80444 - RNA, 64 nt, Human
guugcacugaggaaugcacugucucgcagcaccagcucugcagagcccuugccccagacucuuu

SEQ ID NO: 80445 - RNA, 52 nt, Human
caucuagugcugaagucugagggcucugcagcaucagacccaccucuaagag

SEQ ID NO: 80446 - RNA, 64 nt, Human
gcugggccucuaagaaccacagccacagagucaggcucugcagacccagagguaaggcugccug

SEQ ID NO: 80447 - RNA, 64 nt, Human
ucagguucuacaaaugccagacaccuagcgaagagcucugcaggcuuuccacugccuguauugg

SEQ ID NO: 80448 - RNA, 64 nt, Human
acuauuuuaaacuggauuguacuuaaauaaugaagcucugcauagaggaacuagucagaagugg

SEQ ID NO: 80449 - RNA, 64 nt, Human
ugugauacugccauggcacaggaucugaguugcagcucugcacccuaaaucacacccugggcau

SEQ ID NO: 80450 - RNA, 64 nt, Human
uauggcauuucccaggguucugugauuuccccaugcucugcauuucuaggauauuucuaggaca

SEQ ID NO: 80451 - RNA, 64 nt, Human
aaucuguaaagaaaagagguuuaauuggcucauggcucugcaggcuuuacaggaagcaugguac

SEQ ID NO: 80452 - RNA, 64 nt, Human
ucuggccagggcucugggacugcaguguacuugcgcucugcacgguccaggagcugugaugugg

SEQ ID NO: 80453 - RNA, 64 nt, Human
ugcugggcacucagguguguguguguugaguggggcucugcacacaccugucuuccccucauca

SEQ ID NO: 80454 - RNA, 64 nt, Human
ccagggugccgagaugggacagcaaagaugaugggcucugcacaccaacuccaggaaacucauu

SEQ ID NO: 80455 - RNA, 64 nt, Human
gucucugauaaaagggcaaaucugcaccuauguagcucugcaucuccugucuuuucagguuugu

SEQ ID NO: 80456 - RNA, 64 nt, Human
gggugcugcgaggguggggugcaccuaccgauuggcucugcagcccccuaaccugccucuggcc

SEQ ID NO: 80457 - RNA, 64 nt, Human
accaggugugagaggugugguagcagauugcaaugcucugcaccucuuccuugcaagugagcaa

SEQ ID NO: 80458 - RNA, 64 nt, Human
gucaugcuguagagccaggauuccuagacccagggcucugcacucucaaggcuggccccaugug

SEQ ID NO: 80459 - RNA, 64 nt, Human
acauggaaaaggaaaaaaauccacuauaucaugggcucugcagaacauaucaaaauaggauuuc

SEQ ID NO: 80460 - RNA, 64 nt, Human
uggguuuauuuuuacagaaucguacucauaaucagcucugcauacaucugaagaacaaaaacau

SEQ ID NO: 80461 - RNA, 64 nt, Human
acccccucacacacacuggaaagugagggugggggcucugcagucagacaaaccuaagaucaca

SEQ ID NO: 80462 - RNA, 64 nt, Human
gucacugcucucagaggacagcaagggacccugagcucugcaagcugugaucugucuggguuca

SEQ ID NO: 80463 - RNA, 64 nt, Human
cugaugccugagcaaacaaccugcuuccucuugugcucugcaggguuugauggagccucauuuc

SEQ ID NO: 80464 - RNA, 64 nt, Human
ucccuguguccaccuguggguguagccagguauggcucugcaccccucugcccucauuacuggg

SEQ ID NO: 80465 - RNA, 64 nt, Human
acccucccccacaguccaggcccuucagccaagggcucugcaccagcaccuuggaagcaccaau

SEQ ID NO: 80466 - RNA, 64 nt, Human
agcuauuagaagggcugaauaaagggaacaugcagcucugcagcaauauucugauaauguauug

SEQ ID NO: 80467 - RNA, 64 nt, Human
aagauaccugcacuaaucauucagacuucauugagcucugcaaacuuugccuguuugcuauugg

SEQ ID NO: 80468 - RNA, 64 nt, Human
acaaccucaguccuuagaaccccuccacacuucagcucugcacccacuuuccugucauuuauuu

SEQ ID NO: 80469 - RNA, 64 nt, Human
uggaaggugacaaagcuuaaacaccuuugcccuggcucugcauugucaccuagagagcaagagg

SEQ ID NO: 80470 - RNA, 64 nt, Human
uuggauucuuuccaaucuuuugcaaugacaaucagcucugcagugaauaaucuuguacaaaugu

SEQ ID NO: 80471 - RNA, 64 nt, Human
uccagugcccuggguucuucccggucauccuggggcucugcacagagcagcagagcuagagcca

SEQ ID NO: 80472 - RNA, 64 nt, Human
accggcaacuacagcagccgggugaagcucuggagcucugcauccuguggccuggcugcgggau

SEQ ID NO: 80473 - RNA, 64 nt, Human
aagugguauugaaguaccauauuuaaguugaacugcucugcauuaauuacagauuuaauauaaa

SEQ ID NO: 80474 - RNA, 64 nt, Human
cacacgaaggagggggacugcaccuuagaagccugcucugcauccauuuacccccccccaaggg

SEQ ID NO: 80475 - RNA, 64 nt, Human
agcagcugaagggcuaggagggaagccggcccccgcucugcagaagcugcauuucagcugaauc

SEQ ID NO: 80476 - RNA, 64 nt, Human
uugguuagucaugcguacaugugugccuuggggugcucugcacuccacggcccuucucagccac

SEQ ID NO: 80477 - RNA, 52 nt, Human
ccgagcccacgggcgacugacagcucugcaggagagauugcaacaccauccc

SEQ ID NO: 80478 - RNA, 64 nt, Human
cuguaucuaugccuuuuuuucacaguaguccuuggcucugcacggaauaaaugauacccucaaa

SEQ ID NO: 80479 - RNA, 64 nt, Human
uucuagaugaugcugcugaugacauuggagaugcgcucugcauacgcuuuucugugaguacuaa

SEQ ID NO: 80480 - RNA, 64 nt, Human
cugauugacaucuuauuaggccauagugagcuaugcucugcacaacugagaaauuagguauuua

SEQ ID NO: 80481 - RNA, 64 nt, Human
gcauccguugaucuguguuaacugcauagggagggcucugcauagcaccugcuauagcgguguc

SEQ ID NO: 80482 - RNA, 64 nt, Human
gugagaccauucugaggucagcgauagcccaaaggcucugcaguauucccuccaauggccaagg

SEQ ID NO: 80483 - RNA, 64 nt, Human
cagauggaggagaagagaagagccaaccagaagagcucugcacagggacccaucccaugguuuc

SEQ ID NO: 80484 - RNA, 64 nt, Human
aacaggaaaauuuuaaaaauacagauagauauaugcucugcauguuacauaagauaaaugugcu

SEQ ID NO: 80485 - RNA, 64 nt, Human
uuauucaucuccuggaauuuccaugugaaucacagcucugcaccuggauggaguuuucuuuugu

SEQ ID NO: 80486 - RNA, 64 nt, Human
aagacacuugagaaagaauccucuaaaaaucccggcucugcacauuauucaucuccuggaauuu

SEQ ID NO: 80487 - RNA, 64 nt, Human
guggggagcccauccucucgccaagccaucacaggcucugcauacacaugcacucaguguggac

SEQ ID NO: 80488 - RNA, 64 nt, Human
uccagccuauauucuuguuuaucaguucaaaaaugcucugcacuguuuuugacucuuuaaaaau

SEQ ID NO: 80489 - RNA, 64 nt, Human
gcaugcacuaccaugcccagcuuucucaccccaggcucugcagcuauuacuuaaacucguauuu

SEQ ID NO: 80490 - RNA, 64 nt, Human
cuagcagucucccagcucccaacagccuggggaagcucugcacagagugaccugagaccaggua

SEQ ID NO: 80491 - RNA, 64 nt, Human
cauucucccauauuuugaaggguguguaacuucagcucugcaggauugcaugggguaaaacuug

SEQ ID NO: 80492 - RNA, 64 nt, Human
aauuaagcaaguggaacauaugcccuuugccucugcucugcacagugaaaugaaaagucaaccu

SEQ ID NO: 80493 - RNA, 64 nt, Human
gcuccacguguacccccuucacucccucccaccagcucugcagccagccuauggcaauuauauu

SEQ ID NO: 80494 - RNA, 59 nt, Human
ucaacaacaugcagcagugauggcgccaggcucugcagggugggccugaucccagagug

SEQ ID NO: 80495 - RNA, 64 nt, Human
auuuucuuauauucugcuuuuuauacauuucagugcucugcauacauuuuaaauuaugaauguc

SEQ ID NO: 80496 - RNA, 64 nt, Human
guccccugcuccagucccacuccugucaccccacgcucugcacuggggagaaaacgggaggugc

SEQ ID NO: 80497 - RNA, 64 nt, Human
auggcacccggcgggccgagcaugccauggguccgcucugcaugcccugucugugccaugagug

SEQ ID NO: 80498 - RNA, 64 nt, Human
cagaagcaggugggaggcucugcuuccugcugccgcucugcagccuggaccuguggacccuggu

SEQ ID NO: 80499 - RNA, 64 nt, Human
uaaggcaaauaaauaaaacugugcuugcucuaaagcucugcacuacaaaagcaaauuuuccagu

SEQ ID NO: 80500 - RNA, 64 nt, Human
aagauacacugucucucuucauaggacuguuuaggcucugcaucaagauugcacaaaaaaaaaa

SEQ ID NO: 80501 - RNA, 64 nt, Human
gauaguagauuguuucuuuagaaacugggcagaagcucugcauucucacuuguacuuugauuuc

SEQ ID NO: 80502 - RNA, 64 nt, Human
accccagaaaagcauaacaccaaucccagggcuggcucugcacuaagagaaaauugcacuaaau

SEQ ID NO: 80503 - RNA, 64 nt, Human
uucugccacgcuuuaugcccuugccucucuggacgcucugcaccaaccccaggcuacugagcca

SEQ ID NO: 80504 - RNA, 64 nt, Human
gggcuugggccccucccuccggcccucaguguuggcucugcagaagcucugggguucccuucaa

SEQ ID NO: 80505 - RNA, 64 nt, Human
aguggccacgugugugugccaguauauggcccuggcucugcauuggaccugcuaugaggcuuug

SEQ ID NO: 80506 - RNA, 64 nt, Human
cacaaaggccucgaaaagaggucuccagcaaaaggcucugcaagugcaaagaccuugacaggaa

SEQ ID NO: 80507 - RNA, 64 nt, Human
ggaucuccaaauaaagauuuaguguuuauuuugagcucugcaucuuaacaagaugaucugaaca

SEQ ID NO: 80508 - RNA, 64 nt, Human
uggcuuacaguuugacauuuaauuuauuagcgcugcucugcaccccucccuugggagggagacu

SEQ ID NO: 80509 - RNA, 64 nt, Human
ugucagagccuuagacccagcacgccuuggauuagcucugcagagugucuugguugagagaaua

SEQ ID NO: 80510 - RNA, 64 nt, Human
uaucagagacuuagacccagcacuccuuggauuagcucugcagagugucuugguugagagaaua

SEQ ID NO: 80511 - RNA, 64 nt, Human
gcgcaggcaauuggcaggcagugggggagccagggcucugcagucuuagucccauuccccuuug

SEQ ID NO: 80512 - RNA, 64 nt, Human
ucucacccccccccgccccccucuaggagagcuggcucugcagugggggagggaugcagggaca

SEQ ID NO: 80513 - RNA, 64 nt, Human
agaccuucccuuuagcuguugacacaacuucccagcucugcaagugugcccccuggaucaaggc

SEQ ID NO: 80514 - RNA, 64 nt, Human
ugaggagccccagcuacccuuuuucuccagcugggcucugcaauuccccucugcugcugucccu

SEQ ID NO: 80515 - RNA, 64 nt, Human
acuaagugggaguggaggcaggcccuccacagaagcucugcagcaggggcugggagagcagaag

SEQ ID NO: 80516 - RNA, 64 nt, Human
uuaacgugggaguggaaccacaugagccugcucagcucugcauaaguaauucaagaaaugggag

SEQ ID NO: 80517 - RNA, 64 nt, Human
ggugccuguaggaaguggcuuguacauaaucccagcucugcaaagcucucucgacagcaaaugg

SEQ ID NO: 80518 - RNA, 64 nt, Human
uugcacuugaagaaaggugcauggacccccugcugcucugcagauucccuuuauuuaggaaaac

SEQ ID NO: 80519 - RNA, 64 nt, Human
aggucauccaaccucuuuccucucuggccacucugcucugcacauuagagggacagccaaaagu

SEQ ID NO: 80520 - RNA, 64 nt, Human
agacaggcuuucccaggccuggguauccagggaggcucugcagcccugcugaagggcccuaacu

SEQ ID NO: 80521 - RNA, 64 nt, Human
gcuuucuuuuuuucaacacuguaacuacauuucagcucugcagaauugcugaagagcaagauau

SEQ ID NO: 80522 - RNA, 64 nt, Human
gcuccuuuccuuuuugaccacgaccuuggccccagcucugcacucucuggaauaagggcccgau

SEQ ID NO: 80523 - RNA, 64 nt, Human
augacuuggggcucccugcucucccgaggaagaugcucugcaggaaaauaaaagucagccuuuu

SEQ ID NO: 80524 - RNA, 64 nt, Human
aggaugaagcagaagagaucuacccaucucaucugcucugcacccagcuucuaaguggacaaag

SEQ ID NO: 80525 - RNA, 64 nt, Human
cuggggcgggggcuggccgcaggguaggggagaggcucugcaguguggaguggagccucaucga

SEQ ID NO: 80526 - RNA, 64 nt, Human
gguuuuucugucccugucucccacaguuguucccgcucugcaccuguguuucaguuacucucuc

SEQ ID NO: 80527 - RNA, 64 nt, Human
cacaaggccaagaacuccuggccaggacugcaaggcucugcagccaaugcagaaaaugggucag

SEQ ID NO: 80528 - RNA, 64 nt, Human
gaguuaauccauacagaaaccaguguguccaugugcucugcacaaaaacagaccuguuguccau

SEQ ID NO: 80529 - RNA, 64 nt, Human
caaaaugcagguguuuucucaguaucacagaccagcucugcagcaggggauuggggagcccagg

SEQ ID NO: 80530 - RNA, 64 nt, Human
gaagaagcuguagaaaugccacuccuuacccagugcucugcaacaaguccugucugacccccaa

SEQ ID NO: 80531 - RNA, 64 nt, Human
uaauggcucucugaaagugacagacuuaaauauugcucugcagugcuuuucagaauguagagug

SEQ ID NO: 80532 - RNA, 64 nt, Human
cacacacccuggcuuugaaguggagucugugacugcucugcauucucugcuuuuaaaaaaacca

SEQ ID NO: 80533 - RNA, 64 nt, Human
acacccucucuguccaaucugcaagucccagggagcucugcauaccagggguuccccaggagag

SEQ ID NO: 80534 - RNA, 64 nt, Human
ggugacacagcugggcccagacccuggagagacagcucugcaguuucccacacugucagcuccc

SEQ ID NO: 80535 - RNA, 64 nt, Human
uaggcugcugcacaccaaggcccugcaucugucugcucugcauauaugucucuuuggaguugga

SEQ ID NO: 80536 - RNA, 64 nt, Human
cagcauguguguccacacauacauaggauggcuggcucugcaccuguaggauauuggaaugcac

SEQ ID NO: 80537 - RNA, 64 nt, Human
auuuuaggagaaaaugacucuuucguccagaagagcucugcagaaccagggcucccguuuaucu

SEQ ID NO: 80538 - RNA, 64 nt, Human
ggaucccuucccagcucugaggacgggcugcagagcucugcagguguggauucaccuuacgccc

SEQ ID NO: 80539 - RNA, 64 nt, Human
aaaaaaagggugggggagggagggaaagagaagagcucugcacuucccuuuguuguagucucac

SEQ ID NO: 80540 - RNA, 64 nt, Human
uaaggccuuggccccauccucucacagccuaggugcucugcaggcaugcugacuguccugauug

SEQ ID NO: 80541 - RNA, 64 nt, Human
auuccaggcccaugaggggaaagaggaucuuccagcucugcaaaaacaagaacaaacaacauca

SEQ ID NO: 80542 - RNA, 64 nt, Human
auuuucauccgaggacgcuuggaccccgcucuuggcucugcagcccucuggggagccugcggaa

SEQ ID NO: 80543 - RNA, 64 nt, Human
cucguuuuggguacuuucuaucucaucugucucggcucugcauguuuuccaggguguagccuac

SEQ ID NO: 80544 - RNA, 58 nt, Human
uccugugccagccuucaugacccagcccgcucugcagaccaccucuucuucugggagc

SEQ ID NO: 80545 - RNA, 64 nt, Human
uggugcacacauuguguucuuaaacugagacguggcucugcaggucuccugggcucauuccaug

SEQ ID NO: 80546 - RNA, 64 nt, Human
cggugcugcuucugcccacuuucaggagaacccugcucugcaccccagaaaaccucuuuguuuu

SEQ ID NO: 80547 - RNA, 64 nt, Human
ugaaaguaugugauaucugaacacauacuagaaagcucugcauguguguuguccuucagcauaa

SEQ ID NO: 80548 - RNA, 64 nt, Human
cuucaaggcccacuucuucucagaaaagaggccagcucugcagcccccucggggacgcccccac

SEQ ID NO: 80549 - RNA, 64 nt, Human
gguuugggcugucuuaccauaacaccgucccagggcucugcaggccacugugagcgcuggcucc

SEQ ID NO: 80550 - RNA, 64 nt, Human
ucuuuggauggacucuuaucuagaauacauagcagcucugcaaaggaacaguuuuuaaaaaugg

SEQ ID NO: 80551 - RNA, 64 nt, Human
gguguagguucuuccuguguagccauauacccaggcucugcaguaucgaaggaugcaaauguug

SEQ ID NO: 80552 - RNA, 64 nt, Human
cccagucuggacucucugcccucuggguccccgagcucugcagcgagcccugggaccacucauc

SEQ ID NO: 80553 - RNA, 64 nt, Human
ccauccucuaccaucacgaugacuuucaaauugugcucugcaguucugcagauuuucuagcagu

SEQ ID NO: 80554 - RNA, 64 nt, Human
ugacgucauuccucuccuuccuugcugcaaaauggcucugcaccagccggcccccaggaggucu

SEQ ID NO: 80555 - RNA, 64 nt, Human
uccccccaagaugagcugcagccccccagagagagcucugcacgucaccaaguaaccaggcccc

SEQ ID NO: 80556 - RNA, 64 nt, Human
cauacugaacagcuguggaccccgauuggugagggcucugcauaugccuguaugaaggagauac

SEQ ID NO: 80557 - RNA, 64 nt, Human
guucagccuuuaaaaauauuucuuaguggucauugcucugcagaacucaaaaagaaaauuguac

SEQ ID NO: 80558 - RNA, 64 nt, Human
aaaguuaaaaaaggauauccgggaauugagcucagcucugcaccaagcggaccuaggagacauc

SEQ ID NO: 80559 - RNA, 64 nt, Human
cuucugcuguagcuuaucauugcuuuguuuuguagcucugcauauuuugcccaccuugucuucc

SEQ ID NO: 80560 - RNA, 64 nt, Human
guggcaucggauggccacagggcggggcugccaggcucugcaggcacccaggguggggaggcca

SEQ ID NO: 80561 - RNA, 64 nt, Human
gcaccacccagcaaccugggccugcauuccauccgcucugcagccccaagcaucuuuccagugg

SEQ ID NO: 80562 - RNA, 64 nt, Human
ucugccguggccugaggcugccugcgcccaccccgcucugcaugcggcccagcccggcucccac

SEQ ID NO: 80563 - RNA, 64 nt, Human
ccagauuugagcugccuggagggaauccauaucagcucugcauaagauuauauacaaagcuguc

SEQ ID NO: 80564 - RNA, 64 nt, Human
ccuuugaacuggauguguucuauugaugaccugugcucugcaggggaaaccagaaggcaaaaug

SEQ ID NO: 80565 - RNA, 64 nt, Human
auauugugguucuuucaguuccaugauauguuuggcucugcaugccaaaguccagugauuaagc

SEQ ID NO: 80566 - RNA, 64 nt, Human
uaaaaguugaugccaucaaaccuugacaccgggugcucugcacacccacgcggauguugcaccu

SEQ ID NO: 80567 - RNA, 64 nt, Human
gcaggugcugggccuucaggcccagugugagccugcucugcaagaagggaggggacagcuggcu

SEQ ID NO: 80568 - RNA, 64 nt, Human
cacacaggcuauggggauggugggcuccaggucagcucugcaaggggcuugucucuguggcacc

SEQ ID NO: 80569 - RNA, 64 nt, Human
uggacagggucucugcugacugccaggggcgggggcucugcauagccaggaugacggcuuucau

SEQ ID NO: 80570 - RNA, 64 nt, Human
uugcccccaacuuggcucggcaugugaauucuuagcucugcaagguguuuaugccuuugcgggu

SEQ ID NO: 80571 - RNA, 64 nt, Human
ugguguugaacaaugcaacuuuuuauuuaaaaaagcucugcacugccauguaugaaagucucuu

SEQ ID NO: 80572 - RNA, 64 nt, Human
accguggggauuuagggcacgucacugcagacacgcucugcagcauucaccgacagucugucau

SEQ ID NO: 80573 - RNA, 64 nt, Human
agggcccuugguggucaccuuuuucuccccagcagcucugcagagguggccugcuuggcagugg

SEQ ID NO: 80574 - RNA, 64 nt, Human
cgaggacaucagugaagcagcagugaaaccaggggcucugcaggucacuugggacggacgccac

SEQ ID NO: 80575 - RNA, 64 nt, Human
cgguagacuuccaccauguaccgaucacaucccagcucugcauggccccugcuaaggcucaggu

SEQ ID NO: 80576 - RNA, 64 nt, Human
cuacacccuggcccagcuccccugcgccuccauggcucugcagauccucugggaagcggcccgc

SEQ ID NO: 80577 - RNA, 64 nt, Human
cucuguugaaugcugcugugcgcgugugagggccgcucugcacacagggcccuuggguugugug

SEQ ID NO: 80578 - RNA, 64 nt, Human
cgagccugccucccucuuggccucucauccauuggcucugcagggcaggggugaggcagguuuc

SEQ ID NO: 80579 - RNA, 64 nt, Human
ugggggcagucacagagccccccaacacccccgugcucugcaccagccucucccuccacacccg

SEQ ID NO: 80580 - RNA, 64 nt, Human
ugcagcagacaucauucaauccaaccagaaucucgcucugcacuccagccugggugacagaggg

SEQ ID NO: 80581 - RNA, 64 nt, Human
ccagcccacccaaccgccuugggucaagggggcugcucugcaagcccacuggccagcucuggcu

SEQ ID NO: 80582 - RNA, 64 nt, Human
cuccaucagcuguaagaagagacugggaagauaggcucugcacagauggauuugccugugccac

SEQ ID NO: 80583 - RNA, 64 nt, Human
gagaccgggcccuggguuccuccucuccuacucggcucugcaguccuacucaagcggguggcuc

SEQ ID NO: 80584 - RNA, 64 nt, Human
ucugcccaaacccuuucucuuucucccaggcagggcucugcagguccauaugggcucaauguca

SEQ ID NO: 80585 - RNA, 64 nt, Human
cagggccgggccugggcucgguucccagguuugagcucugcagccucucuccuggagugagggg

SEQ ID NO: 80586 - RNA, 64 nt, Human
auuuuauuuuguagaaaccgggugguauuuuauugcucugcaaagauguccagaagccauguau

SEQ ID NO: 80587 - RNA, 64 nt, Human
auuauuuuuuuuuuuugaaaaaagcucauuucaugcucugcaaaaggagagacucccaugaagc

SEQ ID NO: 80588 - RNA, 64 nt, Human
gcgcugccugcucugcguuuccucgucugggguggcucugcagccuccugcgggcgggcgucug

SEQ ID NO: 80589 - RNA, 64 nt, Human
agcguuugggcuucuaaccacccugucuccagcugcucugcacacauggacagggaccugggaa

SEQ ID NO: 80590 - RNA, 64 nt, Human
uguuuuuauguacaguuuauauacagaaaaguuugcucugcauuuuugaugaugguuuggaaca

SEQ ID NO: 80591 - RNA, 64 nt, Human
ccucugagcaggacucucagaagaaagacaagcugcucugcagccagcuucagguagcggauuu

SEQ ID NO: 80592 - RNA, 64 nt, Human
gacagaguacugcauugcaccaugagcaagaacugcucugcaagaaaaauaucugucccugugg

SEQ ID NO: 80593 - RNA, 64 nt, Human
aaaauauuuuauucaucauagcucucugcuuugggcucugcaggccaccagauacacaugaggc

SEQ ID NO: 80594 - RNA, 64 nt, Human
cugggcaaaaugccaccaggcuuugucccccauggcucugcaggaccugauggagaaggugaug

SEQ ID NO: 80595 - RNA, 64 nt, Human
gcacccaaaacucaagcaagaugagcugugcgcugcucugcaggcuggggaggugcugggggag

SEQ ID NO: 80596 - RNA, 64 nt, Human
cucggggaccaguucuuacuuccuuuuauuuuuagcucugcacuccaugugguuucaggguuca

SEQ ID NO: 80597 - RNA, 64 nt, Human
ugccuucucccuccauggaucugugaucuucccagcucugcaucaacacagcagccugcagaua

SEQ ID NO: 80598 - RNA, 64 nt, Human
guggaggucagagcaucucacgagagucccucaggcucugcaacacuagauucgaauaugagcc

SEQ ID NO: 80599 - RNA, 64 nt, Human
accauccaagaauguuguuagcuuuucaguucccgcucugcauugccugaaaaaacugguaugu

SEQ ID NO: 80600 - RNA, 64 nt, Human
ccccaaaugaggcagggugcagacagcacagucagcucugcagaguuuggaggggcucacugcc

SEQ ID NO: 80601 - RNA, 64 nt, Human
ccucaggcauccauuccaaucaagaaaugauggugcucugcaucagugguucagagccugguua

SEQ ID NO: 80602 - RNA, 64 nt, Human
guaauauguuuauucgggaaaacugaggccagaugcucugcaacacuuacgcuuuuucaacaau

SEQ ID NO: 80603 - RNA, 64 nt, Human
guggucagaggcugcucaccugagcacaaagacagcucugcacauucaccgcagcugccagcca

SEQ ID NO: 80604 - RNA, 64 nt, Human
uugaccccucugcucauguuucaucauauuuguagcucugcaucauuuagcauuuuuaugacuu

SEQ ID NO: 80605 - RNA, 64 nt, Human
aucaaaguauuugucguguguagaaaaaaaaacagcucugcaggcuuaauaaaaaugacagacu

SEQ ID NO: 80606 - RNA, 64 nt, Human
cuucuccuccagaacaagugcaauucagaaggcagcucugcauucuaccuugcuugacuggaau

SEQ ID NO: 80607 - RNA, 64 nt, Human
ccguggacuuggggucagagacugcuguguuugagcucugcagcccagggaccgaaaaguuggu

SEQ ID NO: 80608 - RNA, 64 nt, Human
cacauguacguugccucauuucauccuugcaacagcucugcagggccccgcagaugaggaaauc

SEQ ID NO: 80609 - RNA, 64 nt, Human
caggcccaggggcccccauugacaggagcugggagcucugcaccacgagcuucagucaccccga

SEQ ID NO: 80610 - RNA, 64 nt, Human
acucuuccucucagagaauguugcucuggaggcugcucugcaugaaaacccuaaugguuucuug

SEQ ID NO: 80611 - RNA, 64 nt, Human
guuuagaaaggauguuuaggggaacaugaggcuggcucugcagcaacaaccaggcuccccugca

SEQ ID NO: 80612 - RNA, 64 nt, Human
cucucagaauucuuuuuaauugaagaugucuugagcucugcaaagaucagagcaggugagcauc

SEQ ID NO: 80613 - RNA, 64 nt, Human
uugccuuucagcucuagaucccccuccccugccugcucugcagucguggguggggcccgugcgc

SEQ ID NO: 80614 - RNA, 64 nt, Human
uccucaaggaggaucggcacagcccccuucccuggcucugcagcggcugggucaccccuuacgc

SEQ ID NO: 80615 - RNA, 64 nt, Human
ccccaggaagaagcugccagaggggcagcucagugcucugcagagaggggcccuggggagaagc

SEQ ID NO: 80616 - RNA, 64 nt, Human
gaacacauuugcugccauaugcaguuauguugaugcucugcaaaccugugcugagcccuguugc

SEQ ID NO: 80617 - RNA, 64 nt, Human
uacaguacuugaaaauauuuaaggaagagaugaagcucugcaguuuuuucuaugugggaugauu

SEQ ID NO: 80618 - RNA, 64 nt, Human
ugcgauucagaaaauccuaaccagcuggccugcugcucugcacagcaccggcugcugugaagac

SEQ ID NO: 80619 - RNA, 64 nt, Human
ugggugcauggcagcguaacuguggaguggaugggcucugcauguaaggggugaugcaugaugg

SEQ ID NO: 80620 - RNA, 64 nt, Human
uucccccuuucuaaaaguuugaggaauauuucaagcucugcaacagggggcaaagauuaaucua

SEQ ID NO: 80621 - RNA, 64 nt, Human
cccaacucuucccacucccagaauccagaaguaagcucugcauguuccccuuccugggaggaaa

SEQ ID NO: 80622 - RNA, 64 nt, Human
acccuggcuuauucuugggaucuacugauugcgggcucugcaagacccuuggcaaacuggcuuc

SEQ ID NO: 80623 - RNA, 64 nt, Human
uggauggcguucuccuaucuaccuuccuucaacugcucugcauauaauaagcacucaauaaaug

SEQ ID NO: 80624 - RNA, 64 nt, Human
ugaggaaagaacaggaggggaggaggaggagugugcucugcacuugccuugcuccaggaugggg

SEQ ID NO: 80625 - RNA, 64 nt, Human
cuccccucagcagucugagugcaaccccguuggugcucugcaggagcugguggugcagaaaggc

SEQ ID NO: 80626 - RNA, 64 nt, Human
gaacuguccacccagccggccacugugugucauggcucugcaaccaccagggaggcagcccgug

SEQ ID NO: 80627 - RNA, 64 nt, Human
agggagaacguugcaaugcacccagcagcuccuggcucugcaggcggcacagccuggggcccug

SEQ ID NO: 80628 - RNA, 64 nt, Human
ggagaggccccagccgcuuggcgaugccagccaagcucugcagucccagcggugggaccuaggg

SEQ ID NO: 80629 - RNA, 64 nt, Human
ugaugacaauuaaaucaccuucucugaaguucuggcucugcagagaccaaaccuuacugacuug

SEQ ID NO: 80630 - RNA, 64 nt, Human
cacuaaguacucuuuuuguaagcagagguggcuggcucugcagccuuaaggccauuuuuuaagu

SEQ ID NO: 80631 - RNA, 64 nt, Human
gagggaucccauauuguuuggagacuuccagauggcucugcacgaaggagaaccacgcauuuau

SEQ ID NO: 80632 - RNA, 64 nt, Human
ccacauggucaggcucuugucuguggucucuagggcucugcagcagcaguggcucuucgauuag

SEQ ID NO: 80633 - RNA, 64 nt, Human
ggguggggcugcacagaggggaacaucagcugcagcucugcaccaggccggucccuggggacug

SEQ ID NO: 80634 - RNA, 64 nt, Human
gcuccgucgggcucacccuuaaccacuauuccuggcucugcaaaccccagacuuugcacacagc

SEQ ID NO: 80635 - RNA, 64 nt, Human
ugacugacuauaagaaaggacacaucuguacucugcucugcagccuccuguacucauuacuacu

SEQ ID NO: 80636 - RNA, 64 nt, Human
cagcuccauucuuuugaagccugacccuuccuaagcucugcaucauaaccacucugagaauugc

SEQ ID NO: 80637 - RNA, 64 nt, Human
cugaacacauuuggcccacuccccccaucagccggcucugcaaggccaacuccguguccgcugc

SEQ ID NO: 80638 - RNA, 64 nt, Human
ggauauggaacagaaagacuaugacucgcgcacagcucugcauguugcugcagcugaagguacu

SEQ ID NO: 80639 - RNA, 64 nt, Human
gagugaagagugacaugccaccgcaggauccuuugcucugcacgaguuaccuguuaaacuuugg

SEQ ID NO: 80640 - RNA, 64 nt, Human
aaggucugggaauuuaucgagaagcucuuugauagcucugcauuuguuuucccuuaggugaaca

SEQ ID NO: 80641 - RNA, 64 nt, Human
auauguccaauaguugccuuucuucucuuaggcagcucugcacuucauguucaguuuuuuaaaa

SEQ ID NO: 80642 - RNA, 64 nt, Human
gagaugaucuauuuuuuugcuagccaucucuccagcucugcaguuuucacuguauucaggaagc

SEQ ID NO: 80643 - RNA, 64 nt, Human
aguuacucagcguagauguguguucacacaaauugcucugcauucaguguucauugugaauugg

SEQ ID NO: 80644 - RNA, 64 nt, Human
cucgcaguguggaagccugaucauucuuccaucagcucugcaccaaaaagcuuuuccugagcuu

SEQ ID NO: 80645 - RNA, 64 nt, Human
uaggaccccacagaagagccccucccucuccauugcucugcaccccugcaucagcaaggccagc

SEQ ID NO: 80646 - RNA, 64 nt, Human
gcagcuggcucgggagccggcuuacaggagggcagcucugcaguugggaggggcaccguccgga

SEQ ID NO: 80647 - RNA, 64 nt, Human
caauuacuugaccugcagccccagcccacccucggcucugcagccgguucuccgggcccugguc

SEQ ID NO: 80648 - RNA, 64 nt, Human
acaacugguggaaaagagcaauaaauugcccggugcucugcagggcuggaauuucaaacagaaa

SEQ ID NO: 80649 - RNA, 64 nt, Human
ucuaucucagcuucugcugaugcccuagcucagggcucugcauuccgugccagggacgccucag

SEQ ID NO: 80650 - RNA, 64 nt, Human
aguccuuacugucucacucguucuguuacccagggcucugcagcaccucaccugagaccuccac

SEQ ID NO: 80651 - RNA, 64 nt, Human
ugugucuguccagccccaucugaauguguugggggcucugcacuugaaggcaggacccucagac

SEQ ID NO: 80652 - RNA, 64 nt, Human
aacacgucgauuuuucaccaaucgaugaagccaugcucugcaaugacaauauuaaugugauccg

SEQ ID NO: 80653 - RNA, 64 nt, Human
caaauaauuuauguagauacuccccacuuagugggcucugcauagugacuuccuugcagaguau

SEQ ID NO: 80654 - RNA, 64 nt, Human
aauagcuauuauaccugacacacucaucguaugggcucugcaaagggauauuccccaaccuguc

SEQ ID NO: 80655 - RNA, 64 nt, Human
cacagaaacccagcccacaugacuagcacgcugagcucugcagggaccagugccaggcacuggg

SEQ ID NO: 80656 - RNA, 64 nt, Human
aaugcucucuguacucuagucuccugccuccucagcucugcaaguaguuuaguaggaaugaagu

SEQ ID NO: 80657 - RNA, 64 nt, Human
auguucuuacccucuuaccucuccuguagcguuagcucugcagagcuaagcuuugggagaauga

SEQ ID NO: 80658 - RNA, 64 nt, Human
uuacuaccauaauuucuaccaccacccccauuuugcucugcauuauacacaguagagaagaacu

SEQ ID NO: 80659 - RNA, 64 nt, Human
gugugcugauccuguuacugagauuaauuacauggcucugcaguguaguuuacauaaaaaugau

SEQ ID NO: 80660 - RNA, 64 nt, Human
ugacuucaauuugcaaauguggggccuaaagaaagcucugcagcucugaaccucucacuggcca

SEQ ID NO: 80661 - RNA, 64 nt, Human
cggccuggccugguccguggccgccaucuacugggcucugcagggacaggaguuccacgugucg

SEQ ID NO: 80662 - RNA, 64 nt, Human
gaagggggcccugcuaccuguucuugggccucaggcucugcacagacaagcagcccuugcuuuc

SEQ ID NO: 80663 - RNA, 64 nt, Human
uucuccuccuugggagcugggcucuucugcccuggcucugcacauaaguguuagccagcagcuc

SEQ ID NO: 80664 - RNA, 64 nt, Human
ggcaguaaaugagguuggcagaguggcagugggggcucugcagagccagccuuggagccugcuc

SEQ ID NO: 80665 - RNA, 64 nt, Human
aagcaggguucuugccugguagcuccaggacccagcucugcaggcacccaaagacccucugugc

SEQ ID NO: 80666 - RNA, 64 nt, Human
cacaaaguuggagaucugcaaccucacggccgaugcucugcagucugacaagcuucagaccugg

SEQ ID NO: 80667 - RNA, 64 nt, Human
aaauggcugagauuuggugaucuccccacagcuggcucugcaaguuaccucuuucuccuugggc

SEQ ID NO: 80668 - RNA, 64 nt, Human
auuuguuuaugcaguacggccugacauugcuuuugcucugcaacagcagagucgagucauugca

SEQ ID NO: 80669 - RNA, 64 nt, Human
ugcgaauagagaggaagcuggaaaaguuccuggggcucugcagccaggaaggggaaccagggca

SEQ ID NO: 80670 - RNA, 64 nt, Human
cucccucgucgagcuggaugucccaccucucugagcucugcauuugucuauucuccagcugacc

SEQ ID NO: 80671 - RNA, 64 nt, Human
ucauacgugaguacuuaagaauauguacauucuugcucugcacuguaugugugagcuauauggu

SEQ ID NO: 80672 - RNA, 64 nt, Human
gggcccagcugcagccugcugccugcccuucauggcucugcacauggcccuuugcuugagggcu

SEQ ID NO: 80673 - RNA, 64 nt, Human
ccaucacucaggucuuuguaaagggugcagccaagcucugcagacuuuugcaggauugucuagc

SEQ ID NO: 80674 - RNA, 64 nt, Human
gccccucucaccucccagcucuccacgccacuuggcucugcagcgaccccuccuagacgcuccc

SEQ ID NO: 80675 - RNA, 64 nt, Human
augugcacuuucugaggaugccucacuucccugggcucugcagagaacacacagagagaagacu

SEQ ID NO: 80676 - RNA, 64 nt, Human
acguggcagaagcgggaagacuuuggucaccauggcucugcaggccuucugcaaaucagugcug

SEQ ID NO: 80677 - RNA, 64 nt, Human
uccccaccagguuccgaguagugucugagacucugcucugcagggccuaggguagcgcugggag

SEQ ID NO: 80678 - RNA, 64 nt, Human
uacuggacgcuguccugagaugagagguagccgggcucugcacccacgugcauucacauugacc

SEQ ID NO: 80679 - RNA, 64 nt, Human
ggggcagucucugguaccugugugcgucagggaugcucugcaccugcaaccaggugucguccac

SEQ ID NO: 80680 - RNA, 64 nt, Human
aaagugccuacagagacuuguaaaugaaaaugcagcucugcacgaguuugaaaccgucauaccu

SEQ ID NO: 80681 - RNA, 64 nt, Human
cccuccccugaccugggugugccucgcugcuggggcucugcaggggcagcacagcuggggugca

SEQ ID NO: 80682 - RNA, 64 nt, Human
cugccugguuggccugcagugccguggucugcgugcucugcagcugugagacgggggcggccug

SEQ ID NO: 80683 - RNA, 64 nt, Human
ugucucugcuuccccaggugcaaacucuacagcggcucugcagacugcaccaucauugugagug

SEQ ID NO: 80684 - RNA, 64 nt, Human
ccauuucccuuugaugcuuugguggccuugccccgcucugcagcacagacaggccagaugcauu

SEQ ID NO: 80685 - RNA, 64 nt, Human
gggcaguagcuggcuguuucguggcauuucuguggcucugcaguguuccuccaccccaggacca

SEQ ID NO: 80686 - RNA, 64 nt, Human
uaaacauacauuucacagaaaauaaucaagacuugcucugcagccacucaguagucuucugugg

SEQ ID NO: 80687 - RNA, 64 nt, Human
cccacacgugcucacccacccgcagccuaggcaggcucugcaugcuaugccaggcaugugcagu

SEQ ID NO: 80688 - RNA, 64 nt, Human
ccaguuuuuucauguuguaaaacuaaagaauuucgcucugcaguuugaaaaacuguggccacag

SEQ ID NO: 80689 - RNA, 64 nt, Human
uaucacuuugggguucggccugugucccccgaacgcucugcaccuucugacgcagccugagaau

SEQ ID NO: 80690 - RNA, 64 nt, Human
uggaggggacauagacacugcauggcccuauguggcucugcauucuagucagacaccuaacacc

SEQ ID NO: 80691 - RNA, 64 nt, Human
acuaacccgccgccaccacccucuguuccagcaggcucugcaugaaucuuugugcacuugcacc

SEQ ID NO: 80692 - RNA, 64 nt, Human
aagugucugguccuuucugagggaggcuggugccgcucugcaggguauuugaaccuguggaauu

SEQ ID NO: 80693 - RNA, 64 nt, Human
auaauuuugaacuugaccuacuuuaaacuuuuuugcucugcagccuuccuugcccuuccaccuc

SEQ ID NO: 80694 - RNA, 64 nt, Human
cagggaagcucuaccgcaaggaccuggagauugugcucugcagcgagccccccauguaaagugg

SEQ ID NO: 80695 - RNA, 64 nt, Human
gcuguucccacagggccucgguuuuuccuaacuugcucugcaugcugucagcggcugccccgcc

SEQ ID NO: 80696 - RNA, 64 nt, Human
ugagacccccggggccaggagccccuugagcagagcucugcacccagccugcccgcccacacca

SEQ ID NO: 80697 - RNA, 64 nt, Human
gcagcauuccaguccccuuugcagauccauagcugcucugcagggcggaagacaccuggggcgg

SEQ ID NO: 80698 - RNA, 64 nt, Human
uucauccugccagaguuuccaaauggagcccggggcucugcagcauuccaguccccuuugcaga

SEQ ID NO: 80699 - RNA, 64 nt, Human
gguaucuccuacgguaccucuucagaacccaagggcucugcaaaugccaguuugacaagcacug

SEQ ID NO: 80700 - RNA, 64 nt, Human
gggcagaguugcauuuuuccaggcuuuuuaggaagcucugcaacagaugugaucugaucauagg

SEQ ID NO: 80701 - RNA, 64 nt, Human
cucccugcagccacauguuucccaugaccugugggcucugcagauggaccucucuccgcuagag

SEQ ID NO: 80702 - RNA, 64 nt, Human
agcaaauauuuauugagcugaaaugauguuugacgcucugcaaguuuuacagcuuugccuagca

SEQ ID NO: 80703 - RNA, 64 nt, Human
ccaucguggguaacagccuuggggagggugcagagcucugcagagccaugggccagguggggcu

SEQ ID NO: 80704 - RNA, 64 nt, Human
ggaucuacugaggaccauccuggagccucacgcugcucugcacauggugggggcuuguccacug

SEQ ID NO: 80705 - RNA, 64 nt, Human
cagccccugcccagcacaaaaccccaggacccuggcucugcacgccuggggcagggacuuuuga

SEQ ID NO: 80706 - RNA, 64 nt, Human
agauccccccagacccccauucugacauccacaugcucugcaguccuggcccccucgucauuuu

SEQ ID NO: 80707 - RNA, 64 nt, Human
cuucccccuuuccauauuauaaucucauuugauugcucugcaguugggaacggugaucuucuug

SEQ ID NO: 80708 - RNA, 64 nt, Human
aaguauuuauuacuaugacugcuccccagcccuggcucugcaaugggcacugggaugagccgcu

SEQ ID NO: 80709 - RNA, 64 nt, Human
ggauuuggggcugaggggugggagggagggcagagcucugcacacucaaaggcuaaacuggugu

SEQ ID NO: 80710 - RNA, 64 nt, Human
gaugggggccgugccacccgugggaaugcugcccgcucugcagacugcugcuagagccagcaac

SEQ ID NO: 80711 - RNA, 64 nt, Human
uaaguggaacguucucuaccuucaacaugugcucgcucugcaugauuagugcaauaaaacuccc

SEQ ID NO: 80712 - RNA, 64 nt, Human
ccgcuagagagaggauugggaaaccccacugucagcucugcaucugcccccacuacccuccucu

SEQ ID NO: 80713 - RNA, 64 nt, Human
acaguggccaaagaggcccccacuaggcacuguggcucugcaugacaaacacacauccagccca

SEQ ID NO: 80714 - RNA, 64 nt, Human
cauggagcuaugaccacaccaggccauucaaauggcucugcauuaucuucccuuggaagguggc

SEQ ID NO: 80715 - RNA, 64 nt, Human
aagacucuggcaguggccuaugauccugaagacagcucugcagccaacuggugcuuuggccuuu

SEQ ID NO: 80716 - RNA, 64 nt, Human
ucuuccugggccacagaggggaggcaucaggaaagcucugcaguggggggcugguggcuccggg

SEQ ID NO: 80717 - RNA, 57 nt, Human
cccaggauguggggcacugaccucacagcucugcagaggauggagcuugcuccgggg

SEQ ID NO: 80718 - RNA, 64 nt, Human
gggugcagccuggcuguugcucacccaagugcuagcucugcacuucgugucugcugagagcaac

SEQ ID NO: 80719 - RNA, 64 nt, Human
uuccugucuccuggacucuccugggaaguucccugcucugcagcucuggcccaggagcugcagg

SEQ ID NO: 80720 - RNA, 64 nt, Human
guuauuggggcagcgccguggucgucacucagucgcucugcaugcucucugucauacagacagg

SEQ ID NO: 80721 - RNA, 64 nt, Human
aggggccgagccauuuuggggggccccccuccuugcucugcaggcaccuuaguggcuuuuuucc

SEQ ID NO: 80722 - RNA, 64 nt, Human
uggacugaacgugggcuccuaacugccuccggccgcucugcacaaacugggauggcccaggucc

SEQ ID NO: 80723 - RNA, 64 nt, Human
aaagcugccggcacagaacuuaaggauggagccagcucugcauuaucugaggucacagggccug

SEQ ID NO: 80724 - RNA, 64 nt, Human
augggcaucuuggcucucccugccagaaaaaugugcucugcaguguccucccaacugaaaacaa

SEQ ID NO: 80725 - RNA, 64 nt, Human
aguguaucguuacaguaagacaugauaauggccggcucugcaaauuuaucauauaguuuuuuuc

SEQ ID NO: 80726 - RNA, 64 nt, Human
gaugaacuggaugggccacuggagucucaauaaagcucugcaccauccucgcuguuucccaagg

SEQ ID NO: 80727 - RNA, 64 nt, Human
ccucugggcugaccuuucuccugcuucucuccaggcucugcaggggacagggcaggugcugcag

SEQ ID NO: 80728 - RNA, 64 nt, Human
ucuucagggacaggcgguaggaaccccggcccucgcucugcagcuggugcaaaagcuguggcug

SEQ ID NO: 80729 - RNA, 64 nt, Human
uuucaauuuuauuaucuggaaagggcacuggauugcucugcaaccaaagaaagcaauauggaau

SEQ ID NO: 80730 - RNA, 64 nt, Human
gcuucuuugccuuaaugauggccacaucugggcugcucugcacccacgggagaggcuggcccag

SEQ ID NO: 80731 - RNA, 61 nt, Human
aauacuugaauucuggcugaugguguaaacagcucugcaaacaaucccuuucauaccacaa

SEQ ID NO: 80732 - RNA, 64 nt, Human
ggguaacuucaggugugcagcccugagcuccaaggcucugcaccaugccacacacuugcuguaa

SEQ ID NO: 80733 - RNA, 64 nt, Human
guuuucauucagcaaacaaauuuaccaagugccugcucugcauaaggcacugugaggggugggu

SEQ ID NO: 80734 - RNA, 64 nt, Human
cgugccaucugucgauucagaggcacgcacacaugcucugcaggauguggccauccugucacca

SEQ ID NO: 80735 - RNA, 64 nt, Human
agccagcagugcauucaccccacuuuuguaaacugcucugcauauaaaccaagggcagaauguu

SEQ ID NO: 80736 - RNA, 64 nt, Human
gcuuuuaaaguucugacagggauaaauacaguaagcucugcaaaugacaucguagcugcauaua

SEQ ID NO: 80737 - RNA, 64 nt, Human
gcugcacaugaagcgggcgcacagcuaugcuggagcucugcaggagucugcaggucacccggag

SEQ ID NO: 80738 - RNA, 64 nt, Human
aagaucuuuuccagauuaugugguuuuggcuugugcucugcaguccacuuugggucaugcuugc

SEQ ID NO: 80739 - RNA, 64 nt, Human
cucucuuuaaauaucugccuguagguaaaagcaagcucugcauaucuguaccucuugagauagu

SEQ ID NO: 80740 - RNA, 64 nt, Human
cgacaguuccagaauuugcucucccacucagugugcucugcagcugugaggaaacagccuucgu

SEQ ID NO: 80741 - RNA, 64 nt, Human
ggaagcgccuucuccaggugccucucccucaccagcucugcaccccucuggggagccuucccca

SEQ ID NO: 80742 - RNA, 64 nt, Human
gcguuucugcuccaaacgaccauuuuaucuucgugcucugcaacuucuucaauuccagaguuuc

SEQ ID NO: 80743 - RNA, 64 nt, Human
agcuguuuuuccgaggcagugaggaacggugccggcucugcacggagcugaggacaggacagac

SEQ ID NO: 80744 - RNA, 64 nt, Human
auguacuuuugggacagaagcaaggugggagugugcucugcagccggguccagcuacuuccuuu

SEQ ID NO: 80745 - RNA, 64 nt, Human
cuuacacguggagcccccagcaugggaaugaggggcucugcaacugagcgaagcugcgggcuag

SEQ ID NO: 80746 - RNA, 64 nt, Human
gaucccugccccuccccacugggacggaauaaaugcucugcagaccuggccugccuguuuuccu

SEQ ID NO: 80747 - RNA, 64 nt, Human
gaaaguuaacaaggauauccaggaauugaacacagcucugcaccaagcggaccuaauagacauc

SEQ ID NO: 80748 - RNA, 64 nt, Human
ccccugucuucgacccagcccagcccccucuguugcucugcauauuggccgucugggguccauc

SEQ ID NO: 80749 - RNA, 64 nt, Human
ccaagaugcuaaaugggaaugcaaagcuugagcugcucugcaagagaaaauaagcaggacagag

SEQ ID NO: 80750 - RNA, 64 nt, Human
cucugccaccacuagguaccugcugagggcgcuggcucugcagaucagaacaacggaggauagc

SEQ ID NO: 80751 - RNA, 64 nt, Human
uccacuauaaguuucauucuucggagacacggaagcucugcacuggaggccgggacucaggcgu

SEQ ID NO: 80752 - RNA, 64 nt, Human
uauuuuaggugcugaaaauggugagggagugagugcucugcacccuugggcuuuucaacucuug

SEQ ID NO: 80753 - RNA, 64 nt, Human
gacugcccucacgaggggacuggguucgcucucagcucugcagcugucugcgguggggggaagg

SEQ ID NO: 80754 - RNA, 62 nt, Human
agcggugguagggggacccggggggcuccuccccgcucugcagccuggggacacugggcugg

SEQ ID NO: 80755 - RNA, 64 nt, Human
gacuggguuguguuucuuuuccugccucagcccagcucugcaaauccccucccccugcccccca

SEQ ID NO: 80756 - RNA, 64 nt, Human
gccccggugggaggcugcggaccauggggacucagcucugcauggcaggcagaggcccagggac

SEQ ID NO: 80757 - RNA, 64 nt, Human
caggaggaugggucugccugcucugggggugcaggcucugcagacaccccaauugcugcucugu

SEQ ID NO: 80758 - RNA, 64 nt, Human
ggaugacagccacccucaccgcggcuggaugggggcucugcacccagccccaagggguggccgu

SEQ ID NO: 80759 - RNA, 64 nt, Human
cacugcuccuuuaugacugcacuucuagccaguagcucugcacaaguuagcucuguagaaguaa

SEQ ID NO: 80760 - RNA, 64 nt, Human
cagagagcaggugcaggugucauccugaguucaggcucugcacggcauggagugggaaccccac

SEQ ID NO: 80761 - RNA, 64 nt, Human
gcuggucuucaucacgucuaugagcucugcaaucgcucugcagucgccucaacuccuggucucc

SEQ ID NO: 80762 - RNA, 64 nt, Human
ugcagugcccagcuggucuucaucacgucuaugagcucugcaaucgcucugcagucgccucaac

SEQ ID NO: 80763 - RNA, 64 nt, Human
ucaccugcccuguguguuuccacgucaacugccugcucugcaagguggggccugcagggacucc

SEQ ID NO: 80764 - RNA, 64 nt, Human
uaagaggcacgagaucaaggcgguagucacuuccgcucugcagcuagcauuucaaccauaugug

SEQ ID NO: 80765 - RNA, 64 nt, Human
caggcucaggcaggaaucggacgcuggggcccgggcucugcacagagagcugggcuugagugga

SEQ ID NO: 80766 - RNA, 64 nt, Human
cccagagugugguccuuggccgccuccugcuccugcucugcaagccugaaacuggcuugucugg

SEQ ID NO: 80767 - RNA, 64 nt, Human
ggaagacagaaauaagaauuugggaaccugaauagcucugcaaaaaacaccaaaggaccguuuu

SEQ ID NO: 80768 - RNA, 64 nt, Human
cuucacagcccccugcccccugcccucuguccuggcucugcaccugguauaugggucauggacc

SEQ ID NO: 80769 - RNA, 64 nt, Human
ccuugugugggcccauccucugcauccagagcaugcucugcagugggccuguuuuguggaagaa

SEQ ID NO: 80770 - RNA, 64 nt, Human
ugagacugacgggugauguugcucauaggcuccagcucugcauaagaccuuggcuuggagaccu

SEQ ID NO: 80771 - RNA, 64 nt, Human
aauucuccaucaaauauacagcauaaguaaaacugcucugcacuguuuaauccauuuccaaggg

SEQ ID NO: 80772 - RNA, 64 nt, Human
caugggcauugcaagugccaccgugcggggccuggcucugcacacccaggaaaagucugcagac

SEQ ID NO: 80773 - RNA, 64 nt, Human
uuccucccccagccccugagaucagaucuuauuugcucugcaaagaugaaucccugccucaggu

SEQ ID NO: 80774 - RNA, 64 nt, Human
ugugguagcccuggcugcccaggccagugcugcagcucugcagaauguucagcaugccauuucu

SEQ ID NO: 80775 - RNA, 64 nt, Human
uuuucacuuucauucagucaucaccccccaaaaugcucugcagccucucugcucuuugagaaag

SEQ ID NO: 80776 - RNA, 64 nt, Human
ccccuccgcuuuaagcacacgccucugccccauugcucugcagccagcuugggggcaggagucc

SEQ ID NO: 80777 - RNA, 64 nt, Human
cugggagcuccccaacuuggacccccaccuuguggcucugcacaccaaggagcccccucccaga

SEQ ID NO: 80778 - RNA, 64 nt, Human
ccaaggagggggccucauugugucucccgugcaugcucugcagcauugaaguaugguguguuca

SEQ ID NO: 80779 - RNA, 64 nt, Human
aggagaagacugguggcccuguguuccacggggggcucugcaccuucugaggggucuccuguug

SEQ ID NO: 80780 - RNA, 64 nt, Human
agauucuuccauccucagcuggccauggcccacagcucugcaucugcaucugagcuucucaaga

SEQ ID NO: 80781 - RNA, 64 nt, Human
cccuccucaggcuaauucugauuuaggaucuguggcucugcaccuaagcuggggaccaacggaa

SEQ ID NO: 80782 - RNA, 64 nt, Human
ugugcuuuacgaagguggcagcugacagacgugggcucugcaugccgccagccuaguagaaagu

SEQ ID NO: 80783 - RNA, 64 nt, Human
uuucaaaucgcccaagugaugaauaaaguaucuggcucugcacgagacugaggcugcccgugcc

SEQ ID NO: 80784 - RNA, 64 nt, Human
ccgcuucgccaugugcugugcacccgugccacgcgcucugcaugcuccucugccugugcccgcu

SEQ ID NO: 80785 - RNA, 64 nt, Human
ccgcugaggcaugagcaccugggcacagguuggggcucugcaggaugaggaagacaggccaauc

SEQ ID NO: 80786 - RNA, 64 nt, Human
gagcuagcagccaauccggccaugcucgaagccagcucugcagcucagccaaucagugacauca

SEQ ID NO: 80787 - RNA, 64 nt, Human
agucuuggcuuuugaagauuuuuuuuucuuuuuugcucugcauagcuagaccaucuuauuaaua

SEQ ID NO: 80788 - RNA, 64 nt, Human
ggcuguggauaugcacucagaggacuaagggggugcucugcaagcgagaggguucaccagaggg

SEQ ID NO: 80789 - RNA, 64 nt, Human
ccguguuuggcuacaggggcugccggggcucuuggcucugcagcgagaaagacacagcccagca

SEQ ID NO: 80790 - RNA, 64 nt, Human
guggcguuggggcuccccguccccgugugcagcagcucugcaucggccuugcaggaacaacacc

SEQ ID NO: 80791 - RNA, 64 nt, Human
auccccuuagaauuucaucuuucucgaugagcaggcucugcacccacucuuuuuuugccccccg

SEQ ID NO: 80792 - RNA, 64 nt, Human
aggaaaaagaagcuugaauuuuaagacugaggcugcucugcagauucuaguuuggcuuucagag

SEQ ID NO: 80793 - RNA, 64 nt, Human
ccuuccuugccagugagaacggugaccgccuccugcucugcacggucugcggcaguugccgcuu

SEQ ID NO: 80794 - RNA, 64 nt, Human
uuuccgugacugugguguggagacuggagcccaagcucugcagcgugucgcccucaagcuguag

SEQ ID NO: 80795 - RNA, 64 nt, Human
uugccccagucccuucucuccagcuucaugugaagcucugcacagacaagacacucaguguccu

SEQ ID NO: 80796 - RNA, 64 nt, Human
auguacacacagauguacacaugcuccagccccagcucugcauaccugcaccugcaccccagcc

SEQ ID NO: 80797 - RNA, 64 nt, Human
aguuuucguuuuuucuaaaagaugaauuccuauggcucugcaauugucaccgguuaacuguggc

SEQ ID NO: 80798 - RNA, 64 nt, Human
gagguugagcucuucacugugucuuuccaucugggcucugcagcccagcucuguggcaggaggc

SEQ ID NO: 80799 - RNA, 64 nt, Human
ggugccagggaaagggccaaacuaggccuaggcagcucugcaagccucucugcauggcuggggg

SEQ ID NO: 80800 - RNA, 64 nt, Human
guagguagcguccuaguguuuauaauacaaagcugcucugcacagcuuuucugauucuucuugc

SEQ ID NO: 80801 - RNA, 64 nt, Human
cucauucugacaccugcauauagugugggaaauugcucugcauuugacuuaauuaaaaaaaaaa

SEQ ID NO: 80802 - RNA, 64 nt, Human
gagcuggagccaguuggggagcacgguucugggagcucugcaaaaucaguagcaagugcuggaa

SEQ ID NO: 80803 - RNA, 64 nt, Human
cccccagcagugucugcucaggccugacagcucagcucugcacgauuucauguuccuaaaccca

SEQ ID NO: 80804 - RNA, 64 nt, Human
acaagggucagucuucggggucagcagcgagauugcucugcagccagugagggagguccccgcc

SEQ ID NO: 80805 - RNA, 64 nt, Human
aagcuuuuugugagaaagagauucuugccuugaggcucugcaguggcaaaugguaggggcaaua

SEQ ID NO: 80806 - RNA, 64 nt, Human
uuccucccucguuugcuuccaccucgugcacagcgcucugcacagacaacacgcucaauaaaag

SEQ ID NO: 80807 - RNA, 64 nt, Human
gcaucuucaugcaaaaaaaaaaaaaaaguugagugcucugcaggccugugaagggugccaccug

SEQ ID NO: 80808 - RNA, 64 nt, Human
ccacgcccacccccugcccaccucuccaggcucugcucugcagcacacccgugggugaccccuc

SEQ ID NO: 80809 - RNA, 64 nt, Human
cguauuuacagcucugacaaaucaucagacagcugcucugcaguacagauguguaucccaccaa

SEQ ID NO: 80810 - RNA, 64 nt, Human
uggaugggcaacagugacuuugauuacccuugcugcucugcauuugccaguuuauucuuuuguu

SEQ ID NO: 80811 - RNA, 64 nt, Human
uguagauacuggcagggcuauguuuguuuaugaugcucugcaaacauuucauauuggccaauaa

SEQ ID NO: 80812 - RNA, 64 nt, Human
ucuauuuaggaguuguucaaaucacugcaguagggcucugcaaauaaaauaauguaaccuauua

SEQ ID NO: 80813 - RNA, 64 nt, Human
gagagggcuccccacucccuaagccccacagccagcucugcaucaccacacacagccagagccu

SEQ ID NO: 80814 - RNA, 64 nt, Human
cuggaccacaaccggcggcuaccucagccccacggcucugcaggaucagggcucgggcaggccc

SEQ ID NO: 80815 - RNA, 64 nt, Human
cgccgacaacgcgggugcaggggggcgcggcugggcggugcagcuccgcccggcuccgccccug

SEQ ID NO: 80816 - RNA, 64 nt, Human
uaaaaaaaaaaaagccuauuaauaggguuucugcgcggugcaggguuguaaaccugcuuuaucu

SEQ ID NO: 80817 - RNA, 64 nt, Human
gagguagcuuaaacucuaggcacaggccggggcugcggugcaggcaccuggccaugcuggcugg

SEQ ID NO: 80818 - RNA, 64 nt, Human
ggcccccagggugguccaugcggggcaacccccugcggugcacaggcccccugucuggaguagg

SEQ ID NO: 80819 - RNA, 52 nt, Human
agcugggcggccacacguagcagcggugcacuaacgugugcagaaacagggc

SEQ ID NO: 80820 - RNA, 64 nt, Human
cccggcuggccgcgcuggcguguccaacauaguggcggugcaugccgcggugacggggcucucc

SEQ ID NO: 80821 - RNA, 64 nt, Human
guaaaaggugaccuaguguacugggcagcugguggcggugcagaaaagagucucagguuauuuu

SEQ ID NO: 80822 - RNA, 64 nt, Human
uguaccauguccuaagcugaggcaggcggcaggcgcggugcacaggaagucucagugugaaggg

SEQ ID NO: 80823 - RNA, 64 nt, Human
gugagauggugucuaacgagcagugcaauauuaggcggugcaauagaggcccuguuggcaagau

SEQ ID NO: 80824 - RNA, 64 nt, Human
cagcuucaggugagccaaggggucugcuccuguggcggugcaguggcaaaggauccagauagcc

SEQ ID NO: 80825 - RNA, 64 nt, Human
cuacgaagcagccugcaacaggcuggccaacaaggcggugcagcggggcucggccgacaacguc

SEQ ID NO: 80826 - RNA, 64 nt, Human
cgaugcccugaacacacaccuucccuuugcccaggcggugcaaacaauccacuucuucaagcuc

SEQ ID NO: 80827 - RNA, 64 nt, Human
cuuagcacccagaagggaccaaaagcagggcauggcggugcagaggaguuugggagguguaaac

SEQ ID NO: 80828 - RNA, 64 nt, Human
ccccugccccucccccugcucaaaggagggguuggcggugcaggggcaaccccucgaaagcggg

SEQ ID NO: 80829 - RNA, 64 nt, Human
gcagugacccacuucaaagauauucagaggcugagcggugcagggagugcucaguugcugggga

SEQ ID NO: 80830 - RNA, 64 nt, Human
ugggcagcagcuuucugacugaggacugcucucagcggugcaccugugccagcucacggauccu

SEQ ID NO: 80831 - RNA, 64 nt, Human
accaaaggcaaucacuagaccggacuugaggcacgcggugcacccccagacgcuggcgcuccac

SEQ ID NO: 80832 - RNA, 64 nt, Human
uccgcggaaggcguggcagggaggcagucgcccugcggugcaagcugcugcuccagagcauacc

SEQ ID NO: 80833 - RNA, 64 nt, Human
agacaaacauguggccccgcucgaggcacagcacgcggugcaccuccgcagccagcuccguccu

SEQ ID NO: 80834 - RNA, 64 nt, Human
cucuacuaaaauacaaaaaaauuagccggguguggcggugcacgccuguagucccagcuacuca

SEQ ID NO: 80835 - RNA, 64 nt, Human
cacaggaggagagcuggaccugagggccaccgcagcggugcacacauuccucugggcugacggc

SEQ ID NO: 80836 - RNA, 64 nt, Human
guacacgguuagcaaaaccaugggaaggggaauggcggugcauaucauuaacuaacacuccaaa

SEQ ID NO: 80837 - RNA, 64 nt, Human
ggacccagggagaggagccagugacacaggcagagcggugcagcccuccuucccuuccauuugg

SEQ ID NO: 80838 - RNA, 64 nt, Human
ugugaaagugagaaagcccuuuucacacuguggagcggugcagaugugggaaaccucaaagaug

SEQ ID NO: 80839 - RNA, 64 nt, Human
gagaaggguacuugcuagguauccugggucaguggcggugcaaacugguuuccucagcugccug

SEQ ID NO: 80840 - RNA, 64 nt, Human
uggcacuuuauuaaaacaucagcuguggaguguggcggugcacaccuguagucccagcugcuca

SEQ ID NO: 80841 - RNA, 64 nt, Human
ggguuggugggggucgagcgggcagcacggugcagcggugcaguggcaaggggggcuacuugug

SEQ ID NO: 80842 - RNA, 64 nt, Human
ucugggagcccggaaccguuagguacugccgaaugcggugcaaaauuucccccucucccccagu

SEQ ID NO: 80843 - RNA, 64 nt, Human
gggagaccccgacuuucucuaacccaguggcugugcggugcaggccacugacucccccccugcc

SEQ ID NO: 80844 - RNA, 64 nt, Human
gccguaccugucacccuccccaagcgccugcaccgcggugcaaggugagugcaucccaggaagg

SEQ ID NO: 80845 - RNA, 64 nt, Human
ggagggguggcagaggaucugcagcccuggccccgcggugcaugaggcugggugcaguucuaaa

SEQ ID NO: 80846 - RNA, 64 nt, Human
gucuaguuuuauaggcagcuguccugugaugucagcggugcagcgugugugccaccucauuauu

SEQ ID NO: 80847 - RNA, 64 nt, Human
cauucccugucugguuggacugagucaagggucugcggugcagcaucuucagcuugagaaaaug

SEQ ID NO: 80848 - RNA, 64 nt, Human
acuauauugcuacagcaucuaguguacugagccugcggugcauggcucaggccuuuucccaucg

SEQ ID NO: 80849 - RNA, 64 nt, Human
agagggugugaggcccaauggggcugggugggaggcggugcacucacuccugacugcccggcac

SEQ ID NO: 80850 - RNA, 64 nt, Human
cccacugugcaugccggcuugagacuggagccccgcggugcagggcaguucaccggguccugca

SEQ ID NO: 80851 - RNA, 64 nt, Human
agcuaucuguagacuuaggaauacuugaugggcagcggugcagaccccgggcaccugcgugcag

SEQ ID NO: 80852 - RNA, 64 nt, Human
ggggcagggcccaucugccgccuggggcuccggugcggugcacugguccgaggagugugcucag

SEQ ID NO: 80853 - RNA, 64 nt, Human
gcuuacacggccauuugucucuuuucccaaugcggcggugcacuuucgcucuugggggcugcac

SEQ ID NO: 80854 - RNA, 52 nt, Human
ugcugacaugcuccuggugagcgcggugcacgcggcuuuaagugugcugggc

SEQ ID NO: 80855 - RNA, 64 nt, Human
ccaggguggaagccguggggucccucaggccugggcggugcagcuuccagagagcgagcgcccu

SEQ ID NO: 80856 - RNA, 64 nt, Human
cucucacacagagcugucagcaggggccgcuguggcggugcacaggggaggcagguccuuggcg

SEQ ID NO: 80857 - RNA, 64 nt, Human
cucgccccgccccuccacaggacccuggaccagggcggugcagggcgcagcccugaggaggcag

SEQ ID NO: 80858 - RNA, 64 nt, Human
gauggucuuguucugucaaccaggcuagaaugcagcggugcaaucaugagucaaugcagccucc

SEQ ID NO: 80859 - RNA, 64 nt, Human
uucuccaccugcucugagcugggagcagccagaggcggugcaagcgcccagcuccccagagcuc

SEQ ID NO: 80860 - RNA, 64 nt, Human
ugagcacagccaacccaguucccggagggcuggggcggugcaggcucugggacccaggggccag

SEQ ID NO: 80861 - RNA, 64 nt, Human
gggcagagcuccccuuccugcaagagucugggaggcggugcaggcuguccuggcugcucugggg

SEQ ID NO: 80862 - RNA, 64 nt, Human
accuccccugucucgcacagugucccaggacccugcggugcaguagaggcgcaccaaaacuuug

SEQ ID NO: 80863 - RNA, 64 nt, Human
gagaccagcgagaggcccuggcccauucccuccagcggugcaaugaacuaucaugcuguggacc

SEQ ID NO: 80864 - RNA, 64 nt, Human
ccuccuuccuucuugcuucucauagccccggugugcggugcauacacccccaccuccugcaaua

SEQ ID NO: 80865 - RNA, 64 nt, Human
ccaggugccgagcgcgacccugcaggugcuggacgcggugcagcaggucacgaggcccccaugu

SEQ ID NO: 80866 - RNA, 64 nt, Human
gccggaacucaagaggcagaaaaagaccaguuaggcggugcagacggucugggacguggcagac

SEQ ID NO: 80867 - RNA, 64 nt, Human
uugguccaauugcuuccucucugcagaggaacaacccuaaaaccagaccacuccacgcaggaca

SEQ ID NO: 80868 - RNA, 64 nt, Human
cagccugugagauccaagcccccccacccaggcccccuaaaaaucagggccucagcaagcagag

SEQ ID NO: 80869 - RNA, 64 nt, Human
aagucagggucacagcuggucuguguguccaguucccuaaaagccuguucuguugggcagccug

SEQ ID NO: 80870 - RNA, 64 nt, Human
aaagccgaagaagguaccuagaaauuugaaacuucccuaaaaagcuccuaaugcccaccugcua

SEQ ID NO: 80871 - RNA, 64 nt, Human
uuauaaagaccguacaaacucagauccuugguaccccuaaaaagauugccaauuuucuucaucu

SEQ ID NO: 80872 - RNA, 64 nt, Human
acuaauaauauucuauauguacuuuauguaauuucccuaaaaagaaugaacuaccacuacacua

SEQ ID NO: 80873 - RNA, 64 nt, Human
aucagauugggagaggugacaagauuugccucagcccuaaaagcuggagacacagauguccaga

SEQ ID NO: 80874 - RNA, 64 nt, Human
ccucuucccuguacccucugccccagucgugacccccuaaaaguuaagggguaguuggcaccuc

SEQ ID NO: 80875 - RNA, 64 nt, Human
cagggacccuccagaaacacaguguuucaagagacccuaaaaaaccugccugucccaggacccu

SEQ ID NO: 80876 - RNA, 64 nt, Human
ccuggucacugaaucaugcaaaacuggccucagucccuaaaaaugauguggaaaggaaagccca

SEQ ID NO: 80877 - RNA, 64 nt, Human
augagagccuagauuagacaguuuggcuguccuucccuaaaacuuguuuucuccuauucacuac

SEQ ID NO: 80878 - RNA, 64 nt, Human
uagcuccacuaggaaaauauuauuaaauuuauaucccuaaaauuuuuagaaaucucucaaaauc

SEQ ID NO: 80879 - RNA, 64 nt, Human
gaucuccaaggauaaguguaacaguuggcaacaucccuaaaaacucagucucuucuaguucuca

SEQ ID NO: 80880 - RNA, 64 nt, Human
acuuuuuguauuuuaacuagguuuuacauggaagcccuaaaauaaggcaaaagacuuuuucuuu

SEQ ID NO: 80881 - RNA, 64 nt, Human
cugccaugcuuuuccccuugaccugcaccucuuccccuaaaacuucugcagggaagccccuggc

SEQ ID NO: 80882 - RNA, 64 nt, Human
cugccaggaaacuucccagccccaccagcagccccccuaaaaaaaucacucguguccccaggga

SEQ ID NO: 80883 - RNA, 64 nt, Human
ugcaccuuagaagccgaaggugcuuucaucagaacccuaaaauggucguugaaggcgccugggc

SEQ ID NO: 80884 - RNA, 64 nt, Human
acuguguuucccagagugugagccgcucuccucccccuaaaaagcugacucacugugagugacc

SEQ ID NO: 80885 - RNA, 64 nt, Human
ccuccuuucacgaggaaaagaccuuccccugaaccccuaaaaauguuuacagucucugcugguu

SEQ ID NO: 80886 - RNA, 64 nt, Human
cccugcagcuacucuucagaucuggcucucuguacccuaaaaccuaguaucuuuuucucuucua

SEQ ID NO: 80887 - RNA, 64 nt, Human
aauacaaaaaaauuagccaggcgugguggugcaccccuaaaaucccagcuacuugagagacuga

SEQ ID NO: 80888 - RNA, 64 nt, Human
ugcacccccuggaaagcuaagagauuuuuuucaacccuaaaagagaguaccuuucacugcauug

SEQ ID NO: 80889 - RNA, 64 nt, Human
cacauuuuagaauaacaagaacaccaagaauuaccccuaaaacagagacccuguauuuaaucua

SEQ ID NO: 80890 - RNA, 64 nt, Human
auuuuuguaaaccuguucauacuauuaaauuuugcccuaaaagaccucuuaauaaugauuguug

SEQ ID NO: 80891 - RNA, 64 nt, Human
uuaauuggugucuuccccccucauuugcucucuucccuaaaaugugucccagaugccuucauuu

SEQ ID NO: 80892 - RNA, 64 nt, Human
cugcuaugaaaauccacaaauuuuucagauagugcccuaaaaacaauuuuauaugccucacugg

SEQ ID NO: 80893 - RNA, 64 nt, Human
cuuuuuuuuuuuuuuuuuuaccuccugucuugcccccuaaaagaaauaaauagagcaaacaucu

SEQ ID NO: 80894 - RNA, 64 nt, Human
uacuguuggaaucugcugcaggggccuuugugugcccuaaaaacaaauccuguucauguuuguu

SEQ ID NO: 80895 - RNA, 64 nt, Human
uagguccuugcuuauauggcaaccacugcuagaacccuaaaagaaccaaaaaucugccacagcc

SEQ ID NO: 80896 - RNA, 64 nt, Human
uuuucauuuuguucuguacuaagaaaaauucuuacccuaaaacuuaaaguauaauaaaaaaaaa

SEQ ID NO: 80897 - RNA, 64 nt, Human
ugagacuaaacacaaaaacaguagauaaaucucucccuaaaagauggauucccccacauaccca

SEQ ID NO: 80898 - RNA, 64 nt, Human
auguccuucuagugguuugaaaauguuaaaacaucccuaaaaucuaaaucauauaaucagaauu

SEQ ID NO: 80899 - RNA, 64 nt, Human
acuauaacaucuaagcaucaucugauuugauauucccuaaaaaacauuuggaauauaugcuauc

SEQ ID NO: 80900 - RNA, 64 nt, Human
cagacaguucaguugggcuggggguugcuccacacccuaaaacaagccucagccaggcaacccg

SEQ ID NO: 80901 - RNA, 64 nt, Human
auuaguggaugcugaaagcauucagcaaauggcacccuaaaauaugccgcugguuugccacuga

SEQ ID NO: 80902 - RNA, 64 nt, Human
auuuacaguagaugugguuuuaauacaauuacugcccuaaaaugucucuggcaauguacagaaa

SEQ ID NO: 80903 - RNA, 64 nt, Human
gaauuuuaagaguagcaguauauaugucugugcucccuaaaaguuguacuucauuucuuuucca

SEQ ID NO: 80904 - RNA, 64 nt, Human
gaaacuuuguacaguauaugaaacaguauauuaacccuaaaaccuagauguuguccaccugaug

SEQ ID NO: 80905 - RNA, 64 nt, Human
ggaaauuugauugcucuaaauuuagaaauuauaucccuaaaaauuaaaacaugaauacugggug

SEQ ID NO: 80906 - RNA, 64 nt, Human
uacaauuauagaaucauacagaauaguuucacugcccuaaaacuucucuaugcuucaccuguuc

SEQ ID NO: 80907 - RNA, 64 nt, Human
gaaugaccaggcucuaugaauguacauggaaaaccccuaaaaauccccaaaacagaaacauaca

SEQ ID NO: 80908 - RNA, 64 nt, Human
uacuuaaaauaugcacuagaauaaauuugcaaggcccuaaaauaucacuguuauuuuuggagua

SEQ ID NO: 80909 - RNA, 64 nt, Human
auuaaaauauuauuuuaaagaaaccacuguuucccccuaaaaugucauaagagcacugaagaac

SEQ ID NO: 80910 - RNA, 64 nt, Human
ucgggggaaccggacagcagcuuggcaaaggccucccuaaaaggccgcauuucugaccugagcc

SEQ ID NO: 80911 - RNA, 64 nt, Human
uauccuuauaaauacugaucaaucccaguucucccccuaaaaaugaauacauaguaggacuaua

SEQ ID NO: 80912 - RNA, 64 nt, Human
gagcaauucauuucacuuuaaagucuuuccgucucccuaaaauaaaaaccagaaucauaauuuu

SEQ ID NO: 80913 - RNA, 64 nt, Human
guacccgcuaaccuuuuuucacccaugauuugagcccuaaaacaacagccuuuauguuuucagu

SEQ ID NO: 80914 - RNA, 64 nt, Human
gcucaaaaggguaaaugauagccacaguauugcucccuaaaauaugcauaaaguagaaauucac

SEQ ID NO: 80915 - RNA, 64 nt, Human
ucauuaauggccccauggacuuaaagugaucaggcccuaaaacguuguugugaugagguuucuu

SEQ ID NO: 80916 - RNA, 64 nt, Human
guggaaacgcauucuaguaaaaaagguaggaaaucccuaaaacuuccagccucacauagcacgg

SEQ ID NO: 80917 - RNA, 64 nt, Human
acccacauuaguauaugcguccagggucauaacccccuaaaauccaucaugcaaccuuauuaau

SEQ ID NO: 80918 - RNA, 64 nt, Human
auaaauaccuuucaagugugagcuuagacgucaacccuaaaauacuuaaccguaaugcuaauug

SEQ ID NO: 80919 - RNA, 64 nt, Human
uucugcaguuauuucucuuguucuggccaaacaacccuaaaaauccuuaccauuccacaaaguu

SEQ ID NO: 80920 - RNA, 64 nt, Human
guuguuauuguuuggguagagcaguuacaagaaacccuaaaacccuuggauauaaaagaaaucu

SEQ ID NO: 80921 - RNA, 64 nt, Human
guuugaauaagaggaucauggagaaaaaaugagacccuaaaaaguuucuagagagagaaaacaa

SEQ ID NO: 80922 - RNA, 64 nt, Human
caggccaggggcugggcagcguacucaucaucaacccuaaaaagcagagcuuugcuucucucuc

SEQ ID NO: 80923 - RNA, 64 nt, Human
ugcugggauuacaggcgugagccaccgugcccggcccuaaaaugaaauuauuaauguugguucu

SEQ ID NO: 80924 - RNA, 64 nt, Human
gcccuccagccuguuuguggggcugaaaccccaucccuaaaauauugcuguuguaaaaugccuu

SEQ ID NO: 80925 - RNA, 64 nt, Human
uaucacaaccaccguuacaaguauacuuauauuucccuaaaauacauuuaaaacuuaccuaagu

SEQ ID NO: 80926 - RNA, 64 nt, Human
gaauagcucuagcaacuauuauuauucccccaaacccuaaaauucuaccuauuaggugucaggu

SEQ ID NO: 80927 - RNA, 64 nt, Human
ugagcucuuccuaucccucuccuaacugccagcccccuaaaagcacuccugcuuaaucuucaaa

SEQ ID NO: 80928 - RNA, 64 nt, Human
uaaauccuuuuaccuuuuuuuuuucuugguaauccccuaaaauaacaguaugugggauauugaa

SEQ ID NO: 80929 - RNA, 64 nt, Human
agcggcuuucuggcccuucuuucagugacuucuucccuaaaauguagaaauucuaacuuaaugu

SEQ ID NO: 80930 - RNA, 64 nt, Human
cugccaggugaggguuacacugaagaugcacaaucccuaaaauaaagaucaccacuuccccaaa

SEQ ID NO: 80931 - RNA, 64 nt, Human
gucuccaacaauuaacuuuugaugcuuucuguuccccuaaaaccaaaaaaugaaccccuugugu

SEQ ID NO: 80932 - RNA, 64 nt, Human
uaaacagucaccagcagguuccucaggguuucagcccuaaaauguaaaaccuggauaaucagug

SEQ ID NO: 80933 - RNA, 64 nt, Human
uguucaccaagugcuggaaucuaaucugcugugccccuaaaauagcauuuagaaguuuuggaua

SEQ ID NO: 80934 - RNA, 64 nt, Human
gugcaacuugcccaacaucaaucuucacccucaucccuaaaaaaguaaaacagacaagguucug

SEQ ID NO: 80935 - RNA, 64 nt, Human
cuacuguccagcauguauuguuccaaauaugacucccuaaaauauauacacuuugcagaagcuc

SEQ ID NO: 80936 - RNA, 64 nt, Human
uuucuuaaauguauuugauugaugccucauuccucccuaaaauguauaaaaccaagcuguaccu

SEQ ID NO: 80937 - RNA, 64 nt, Human
cuucugagagggacagagaaagaauagaaaugugcccuaaaagcauaaaugaguaucaccugag

SEQ ID NO: 80938 - RNA, 64 nt, Human
uuuuucaucuuuaagaaugcuuaaaaaagcuaaucccuaaaauaguuagaucuuuguaaaugca

SEQ ID NO: 80939 - RNA, 64 nt, Human
ucaaauacugcaaaaauccccuugucccaggauacccuaaaauagaagugcuuaaacuuuguca

SEQ ID NO: 80940 - RNA, 64 nt, Human
cugcugacaauuucccacaccguguaaaccaaagcccuaaaauuccacugcguuguccacaaga

SEQ ID NO: 80941 - RNA, 64 nt, Human
agaguuugaguuuuacuguggauuaaaaagccuucccuaaaaagagagcaugccagucauagag

SEQ ID NO: 80942 - RNA, 64 nt, Human
gugugguagaauucagcaauaugagaaaaccagccccuaaaaugauagccacaagagauuaauu

SEQ ID NO: 80943 - RNA, 64 nt, Human
uuauuacuggccauuucuaaauagacaaaaacuacccuaaaauguggagauuuacuccuuuuga

SEQ ID NO: 80944 - RNA, 64 nt, Human
acaaccaaccaaccaaccaaccaaccacaaaccacccuaaaaugacagccgcugaugucugggc

SEQ ID NO: 80945 - RNA, 64 nt, Human
uuuuuuucuuuauguuuuaugaaaguguugcagucccuaaaauaaaaauauugaggaacauugc

SEQ ID NO: 80946 - RNA, 64 nt, Human
guuaccaucaccgaugaauaccuccuaggcuuaucccuaaaaaugcucgcucagagaauuaauu

SEQ ID NO: 80947 - RNA, 64 nt, Human
aacauuguuuauauuuuuucuauucaauaaaaagcccuaaaacaacuaaaaugauuuguauacc

SEQ ID NO: 80948 - RNA, 64 nt, Human
cauauguagcuaaccugcacguugugcacauguacccuaaaacuuaaaguauaauuuaaaaaaa

SEQ ID NO: 80949 - RNA, 64 nt, Human
uauuuuuccauuuaaagguggacaaaagcuaccucccuaaaaguaaauacaaagagaacuuauu

SEQ ID NO: 80950 - RNA, 64 nt, Human
gucuuagcacugauuauugguuuuacuuaauauucccuaaaaacuugaggaaggaagaugauag

SEQ ID NO: 80951 - RNA, 64 nt, Human
gauuuguauauguguaaauacaaguuccuugauacccuaaaaccuuggauuaaacagaaugugc

SEQ ID NO: 80952 - RNA, 64 nt, Human
uaauaauguauacuguagaacaugagucucuccucccuaaaauuuuaaauguagaaaugugcua

SEQ ID NO: 80953 - RNA, 51 nt, Human
ggcaggagucgaggcgcugaucccuaaaauggcgaacauguguuuucauca

SEQ ID NO: 80954 - RNA, 64 nt, Human
cacauaauuuuucacaaaauuuugggcccaauuccccuaaaagaauugaggauuagggagaaag

SEQ ID NO: 80955 - RNA, 64 nt, Human
ccugaaaccuguucuaccaauuauagaucaaaugcccuaaaauguagugacccgugaaaaggac

SEQ ID NO: 80956 - RNA, 64 nt, Human
acauuuuuuucuuccuguccccuccuaccccagucccuaaaagaaauggggaaaaaagaaaaca

SEQ ID NO: 80957 - RNA, 64 nt, Human
uccucccggaucccugcucucagcuaaggcuggucccuaaaacccacaccugccuuuggucucu

SEQ ID NO: 80958 - RNA, 64 nt, Human
uccguguccuaaauaauuuucaauaaucuauaaucccuaaaaugcaauaaaaacuaguauguuu

SEQ ID NO: 80959 - RNA, 64 nt, Human
caaggagucaggggaaagugacuggaagcaaacgcccuaaaaguuacccaucacguuucagugu

SEQ ID NO: 80960 - RNA, 64 nt, Human
cuauuauaacuagaguagaucugaaugaggauaacccuaaaaucaugaggaauggaagaaugga

SEQ ID NO: 80961 - RNA, 64 nt, Human
aucuauuuugccuuaccagaaaagaaaaaaaaaacccuaaaaccaaaaacuccuuuucccuagg

SEQ ID NO: 80962 - RNA, 64 nt, Human
gggaggcuacauuucacaacccucuucccuauuucccuaaaaguaucuccauggaaugaacugu

SEQ ID NO: 80963 - RNA, 64 nt, Human
uacuauaagggcuauuauuuccugaacuggaugucccuaaaagcaaauaaacugcccacuaucu

SEQ ID NO: 80964 - RNA, 64 nt, Human
cuacacccccacaacccaucacuucugguguuaacccuaaaauacccacauguauugagcuggu

SEQ ID NO: 80965 - RNA, 64 nt, Human
gggcuucugcccugacugggaagggugccuggcucccuaaaacaaugucaaagccaguccugcu

SEQ ID NO: 80966 - RNA, 64 nt, Human
acuuccugccucuccccucccccaguuucuccuccccuaaaauaaaaauaguggucaacuuuag

SEQ ID NO: 80967 - RNA, 64 nt, Human
ccuuaaaccgagaguuuugauguggccuuggcaacccuaaaaucagcuguguuagguaacaaaa

SEQ ID NO: 80968 - RNA, 64 nt, Human
aaagucugugaugugaccaguugcacauguuuuccccuaaaagcuuacucuagaaaggauauuu

SEQ ID NO: 80969 - RNA, 64 nt, Human
acccaggccuuauaggaauucacccuggaccaugcccuaaaauaaccucaccccaaauacaaua

SEQ ID NO: 80970 - RNA, 64 nt, Human
guuuguucauccuuucugucagcauggaucaagccccuaaaaugugguaaguguugucagagca

SEQ ID NO: 80971 - RNA, 64 nt, Human
aaggaaaaauuuuaccugaaaacaaacaaacaaacccuaaaacucagcaccacuaccauuucca

SEQ ID NO: 80972 - RNA, 64 nt, Human
gguaugauugggcacccuugccuacuguaagagacccuaaaaccuuggugcagugguggggacc

SEQ ID NO: 80973 - RNA, 64 nt, Human
uguucuuuuucugaagucaaacucuuaucaaaugcccuaaaauuauuaccacccaagagaaaca

SEQ ID NO: 80974 - RNA, 64 nt, Human
uauuuuaggguagaugaaucagacuauccugugucccuaaaaaagcaaucccgagaaguuguga

SEQ ID NO: 80975 - RNA, 64 nt, Human
uguagcgcccccaaccgagcaaccucgguuuggucccuaaaaccccgccuccucuauaagcacc

SEQ ID NO: 80976 - RNA, 64 nt, Human
aggaaguaaauuuuacagggcaccaagcuuugcccccuaaaaucccuuagguguucuuuguuca

SEQ ID NO: 80977 - RNA, 64 nt, Human
accaucaucucuggcccaagcuucuguaguagcucccuaaaauaauacccuaucaucugcuccu

SEQ ID NO: 80978 - RNA, 64 nt, Human
gacucucccugacgguggaauuuaaguuuagggucccuaaaagcauuugacacacaguuguuga

SEQ ID NO: 80979 - RNA, 64 nt, Human
acauacaguuucacuucaaaaauaaaaaaaaaaucccuaaaaacucucuauacucucuauaaca

SEQ ID NO: 80980 - RNA, 64 nt, Human
ggcaucuggugaguauugcagaucuucaggcugucccuaaaaggagguagguagccuucucugu

SEQ ID NO: 80981 - RNA, 64 nt, Human
ccauuuucuucuucccuuugaucucacauaugcucccuaaaaauccuuaaguugucaaucugau

SEQ ID NO: 80982 - RNA, 64 nt, Human
uacuugaauauucaaauuuaaaagacacuguauccccuaaaauauuucugauggugcacuacuc

SEQ ID NO: 80983 - RNA, 64 nt, Human
uaagaguucagacucacauucuauuaaaauuuagcccuaaaaugacaagccuucuuaaagccuu

SEQ ID NO: 80984 - RNA, 64 nt, Human
uuuauuggagcaugaccacggaggauaguaugagcccuaaaaauccagacucuuucgauaccca

SEQ ID NO: 80985 - RNA, 64 nt, Human
gcagcgggggcuucagccauguccuagcuccccgcccuaaaaggaggcagugaggaccaggcac

SEQ ID NO: 80986 - RNA, 64 nt, Human
uugaagugucucaaaaauauuuuacuaacuguaacccuaaaauugaugucuuuugguuuaugaa

SEQ ID NO: 80987 - RNA, 64 nt, Human
uaaucaaaaagaaucuucuuaagugauauaauaucccuaaaaaaaugaucauuacagauguuua

SEQ ID NO: 80988 - RNA, 64 nt, Human
ggggcuacaccuucacagccaccccagaggacuucccuaaaaagcacaaggcgccugucaucga

SEQ ID NO: 80989 - RNA, 64 nt, Human
gauugucugcugaugcagccguccauagcaguaccccuaaaaucccaccagaauacgggucccu

SEQ ID NO: 80990 - RNA, 64 nt, Human
auuaaauaacagugugugaccccaaaaguacuuacccuaaaacauguguugccuggaagcacau

SEQ ID NO: 80991 - RNA, 64 nt, Human
uaaggccagccugggcaacauagcaaaaccuagucccuaaaauuaaaaaaaaaaaaaaaaaaaa

SEQ ID NO: 80992 - RNA, 64 nt, Human
ugaucaaaucacugaaccaugucuccgcacauuucccuaaaaguacaauguuuagacugcuaug

SEQ ID NO: 80993 - RNA, 64 nt, Human
acugacacauguagacuaaauagaaaccccucagcccuaaaauagaaaaaagaacaguucugga

SEQ ID NO: 80994 - RNA, 64 nt, Human
uucaaaauguauucucuguucuuggaauacagugcccuaaaaugguguucuuaugaccugcaga

SEQ ID NO: 80995 - RNA, 64 nt, Human
uacuuacagguaccucucuuagggacucugugaucccuaaaauaucagaagaaaaugucugucu

SEQ ID NO: 80996 - RNA, 64 nt, Human
uguguucucuuuauuuuuuuccuacuacuuuaaucccuaaaagaacgcuguguggcugggaccu

SEQ ID NO: 80997 - RNA, 64 nt, Human
aauagggaaaaacaucuaccuaaaagaugguugucccuaaaaaacuggaaacaucugaaaugcu

SEQ ID NO: 80998 - RNA, 64 nt, Human
auuuauauguauuuuuaccacaauaaacaaaaaacccuaaaaaaacuuuaaugaaagguggaaa

SEQ ID NO: 80999 - RNA, 64 nt, Human
aguuaggauacagggugaacuguaacaaagaaaccccuaaaacagugacuaaaucaagagagga

SEQ ID NO: 81000 - RNA, 64 nt, Human
cccuuuacccaccagagacaguacagaaucccugcccuaaaaucccaggcuuaauugcccuaca

SEQ ID NO: 81001 - RNA, 64 nt, Human
caccugaaccuuaauuuuaauugguaauuacagccccuaaaaaaaacacauuucaaauaggcuu

SEQ ID NO: 81002 - RNA, 64 nt, Human
uauguacagaaccauaaagaaccaccucguuugccccuaaaaauggaaggaacuuauauaacaa

SEQ ID NO: 81003 - RNA, 64 nt, Human
gucuucuuggcaauucacaaugccucacuccacacccuaaaacuggagcguccccuauggucuc

SEQ ID NO: 81004 - RNA, 64 nt, Human
auuuuuuaaaaaaaagaaacaaaaauauuuuucccccuaaaauaggagagagccaaaacugacc

SEQ ID NO: 81005 - RNA, 62 nt, Human
uccuuucuagaugucccuaagugccagcucuccccuaaaaguuccagcucaucucgccuggc

SEQ ID NO: 81006 - RNA, 64 nt, Human
ccucacaacuggauagaccuuucucaaggguuagcccuaaaaugugacaagagaauugguuugg

SEQ ID NO: 81007 - RNA, 64 nt, Human
auucacugauuagcuaugacaugaggguucaggccccuaaaauaauuguaaaacuuuuuuucug

SEQ ID NO: 81008 - RNA, 64 nt, Human
acuugugaguaucaucuuguccuuuaauccuguacccuaaaauaagaaauacauuuuugacaga

SEQ ID NO: 81009 - RNA, 64 nt, Human
uucuugcuuucacaaauauaguugaacaagauuucccuaaaaauuccaccaggauuaaucucua

SEQ ID NO: 81010 - RNA, 64 nt, Human
ccauagauuuaagauaaaugaaugauuuacccaacccuaaaauuccauggguaaaaauuuugau

SEQ ID NO: 81011 - RNA, 64 nt, Human
uuacagccaguagcuuggucuuauucucuuggagcccuaaaauuaagccuuucauuccccuuug

SEQ ID NO: 81012 - RNA, 64 nt, Human
caacagacagucccucucauauaaaguuuauguacccuaaaaucuaacccaauaaccugucccg

SEQ ID NO: 81013 - RNA, 64 nt, Human
auuuucugaugcuaucagacucuaauguuuuuuucccuaaaauauuauugccaucaugcuuuag

SEQ ID NO: 81014 - RNA, 64 nt, Human
agaggauacugcucuauguggcauugccuugaaccccuaaaauuaucagacuuccuuuuuccaa

SEQ ID NO: 81015 - RNA, 64 nt, Human
ucugaugcacuauugugugucagcagcucaaaggcccuaaaacacugaagguucugcaucugaa

SEQ ID NO: 81016 - RNA, 64 nt, Human
ccaggcucucuaagcacauuucuccuuucauucccccuaaaaacagagugaccuggaaguagau

SEQ ID NO: 81017 - RNA, 64 nt, Human
aucaugccccucguugccugccuaaucugugacucccuaaaaacuaacugggcccauguagaug

SEQ ID NO: 81018 - RNA, 64 nt, Human
gucucccuuuuuguuccuuugccucuugccuguccccuaaaacuugacuguggcacucaggguc

SEQ ID NO: 81019 - RNA, 64 nt, Human
cccacccucacaucugcuuagccaguagccacaccccuaaaacaucagacucaccauccaggug

SEQ ID NO: 81020 - RNA, 64 nt, Human
cuuaauauccgccacagaaggcucaagaauccagcccuaaaauucucuccaacuccaguuuuuc

SEQ ID NO: 81021 - RNA, 64 nt, Human
cuggucugaacccucucccaguccucaucuuccacccuaaaacuagagugaucuuccuaaaacu

SEQ ID NO: 81022 - RNA, 64 nt, Human
aauaggaauccuuaccccuucaauuccuguucaacccuaaaaacugugauaaacgcucccaacc

SEQ ID NO: 81023 - RNA, 64 nt, Human
agcuguguugcuggcaguguugucucaacccucucccuaaaaugacugagcccuggguucaucu

SEQ ID NO: 81024 - RNA, 64 nt, Human
agggauacaauucuugguucagugggaaacagaacccuaaaacauccauuugauucaaggugcu

SEQ ID NO: 81025 - RNA, 64 nt, Human
uuugaaauaggauuccuuacuuuuaguuagaaaccccuaaaacgcuaauauugauuuuccugau

SEQ ID NO: 81026 - RNA, 64 nt, Human
gaaagacaucacuaaaggcccauuaaaaaucuggcccuaaaaguucaacuuuuguagaguuuau

SEQ ID NO: 81027 - RNA, 64 nt, Human
gguccauaguuggacuucagagggucuaugaaaccccuaaaacugucaguauuuaauguauuua

SEQ ID NO: 81028 - RNA, 64 nt, Human
ggucaauuggauucaacuuuaguccucuccuucccccuaaaagcgaauguuugugugugcagac

SEQ ID NO: 81029 - RNA, 64 nt, Human
uaccuuguccuuuaagucugcuaggcucucaguacccuaaaauaaacuagauuguguugcuauu

SEQ ID NO: 81030 - RNA, 64 nt, Human
uaauuuuuuucuuccagcaaaauaaacacugaggcccuaaaaauagauaaaguauaaaguagua

SEQ ID NO: 81031 - RNA, 64 nt, Human
gagugaaguauagccuuuaugccacacucuguggcccuaaaauggugaaucagagcauaucuag

SEQ ID NO: 81032 - RNA, 64 nt, Human
gguuuugcugacacagcggggacugcucagcacucccuaaaaacacaccauggaggccacuggu

SEQ ID NO: 81033 - RNA, 64 nt, Human
uuguuuuuaacaacaauagcaccuugaaaaucugcccuaaaacaguguacaguauuuuucucaa

SEQ ID NO: 81034 - RNA, 64 nt, Human
acucuuucuucauauacgguguuucuuauguguucccuaaaacaauacuuugcuuuuuccuagg

SEQ ID NO: 81035 - RNA, 64 nt, Human
gcaagguagggccaaauuaacucuuguggacagucccuaaaaguccaguucuacauuugugaaa

SEQ ID NO: 81036 - RNA, 64 nt, Human
cagcaucauuauguaaaagaaaauauauuuuagccccuaaaauuaggaagaauguaaucucaga

SEQ ID NO: 81037 - RNA, 64 nt, Human
aaaaagagcacuuugcccguacuuaggcuguggacccuaaaacagcaguguuucaacaagaugu

SEQ ID NO: 81038 - RNA, 64 nt, Human
cuacuccagcaucgucucauguaaaauaagaaagcccuaaaauacuauuggagagaaaaaauua

SEQ ID NO: 81039 - RNA, 64 nt, Human
cuggcagcagaguguggccuucggacaacucagucccuaaaaacacagacauucugccaggccc

SEQ ID NO: 81040 - RNA, 64 nt, Human
ugccgcagcucuuuccacacggggccgugauugacccuaaaaauugcagaccagcacauacacu

SEQ ID NO: 81041 - RNA, 64 nt, Human
guuggagcccugauguucugauucuucaaagucacccuaaaagaagaucugacaggaaagcugu

SEQ ID NO: 81042 - RNA, 64 nt, Human
ugauaggguagccuuauugcccccucuucuuauacccuaaaaccuucuacacuagugccauggg

SEQ ID NO: 81043 - RNA, 64 nt, Human
agccugguaucagggaaauugagacuuauuuuugcccuaaaacgucucccuagcuguucuucgu

SEQ ID NO: 81044 - RNA, 64 nt, Human
augggagguuaugaauuacuuuuucuuggguagacccuaaaaugucaguagcaugcaccagaau

SEQ ID NO: 81045 - RNA, 64 nt, Human
ccauugcuuguaguuaguugauccaugucaugcacccuaaaaauggcucugucacugugagugg

SEQ ID NO: 81046 - RNA, 64 nt, Human
ucugcaauuuagucuguagccuccucguucccuacccuaaaauucuaaggggaagggacccaua

SEQ ID NO: 81047 - RNA, 64 nt, Human
cuuaaccaagaggguauuuguaguuuacuauuuacccuaaaacuuucugugucuggguacccuc

SEQ ID NO: 81048 - RNA, 64 nt, Human
ucccagugaggagcccuaagcauugacuucucuacccuaaaacuguuugagagagggagagugg

SEQ ID NO: 81049 - RNA, 64 nt, Human
caacuacucaccagaagggggcuuaccaagaaagcccuaaaaagcuguugacuuaucugcgcuu

SEQ ID NO: 81050 - RNA, 64 nt, Human
aaaaaaauugauuuccauauuuuauuuuucaaaacccuaaaauauuacaaaauaagucccgcau

SEQ ID NO: 81051 - RNA, 64 nt, Human
caaggaaggaaaagaaagaagagaaggggagaaacccuaaaaagagaagaaucuuaaugaacac

SEQ ID NO: 81052 - RNA, 64 nt, Human
gugcggcaucugcaguuuacaggaacggcuccuucccuaaaaugagaaguccaaggucaucucu

SEQ ID NO: 81053 - RNA, 64 nt, Human
uuagaaggguucaggacuuugugaguuagcaugacccuaaaauucuaggggauuucugguggga

SEQ ID NO: 81054 - RNA, 64 nt, Human
ccacucuguccugacccucagaucugucauguaucccuaaaaggagggagcuggccacuggcug

SEQ ID NO: 81055 - RNA, 64 nt, Human
gccaguggggugggagggaggcaccauaaucccucccuaaaacccacagaagacuaaccugaua

SEQ ID NO: 81056 - RNA, 64 nt, Human
gauuaccucucaaucuauuuguuuuuaaagaaaucccuaaaaaaaaaaauuauccaauugaacg

SEQ ID NO: 81057 - RNA, 64 nt, Human
uauuuaucacuggcacaauugauguguuuugauucccuaaaacaaaauuagggagucaaacgug

SEQ ID NO: 81058 - RNA, 64 nt, Human
aggagucuaccuugccuucuuaugggaagggagacccuaaaaaacuuucuccucuuuguccucc

SEQ ID NO: 81059 - RNA, 64 nt, Human
uuauuucuuccccagauguggacuuucacccucucccuaaaaagaucaagaacagacgcaagaa

SEQ ID NO: 81060 - RNA, 64 nt, Human
uucucccugaguugauugauaggcuuaauggucacccuaaaaacacccacauaugcuuuucgau

SEQ ID NO: 81061 - RNA, 64 nt, Human
gcauucaucauaauaauuccagacauuuucaucacccuaaaaggaaacccugaaacccauuagc

SEQ ID NO: 81062 - RNA, 64 nt, Human
ucggauaauauagacaggauuuacaagcaggaggcccuaaaauuacacucaugucaaaaaucag

SEQ ID NO: 81063 - RNA, 64 nt, Human
uuuaauuuauguguaaguuuuguacaaggaaugccccuaaaauguuucagcaggcugucaccua

SEQ ID NO: 81064 - RNA, 64 nt, Human
uacucuuuccccugccgucuccucauccugcacccccuaaaaaaguaccaaacauuugcauucu

SEQ ID NO: 81065 - RNA, 64 nt, Human
ugggaaacccagauuuccucccuuugccauauuccccuaaaaugucuauaaauuaucagucugg

SEQ ID NO: 81066 - RNA, 64 nt, Human
cuugacaguggcucaugcugauuuaguucauuuucccuaaaagguuugucccaagaucugcucc

SEQ ID NO: 81067 - RNA, 64 nt, Human
gaccuugguucugugauuuggaugucaacaacuucccuaaaaagcaccaguguguuagguucua

SEQ ID NO: 81068 - RNA, 64 nt, Human
uaucuuauuucauuguguuagcaaaauaugaccucccuaaaacacugaagguuauuuuuuauuc

SEQ ID NO: 81069 - RNA, 64 nt, Human
cuucucagaagccaagcugaaauauucauaaagucccuaaaacucaacguuuaaaugacacacu

SEQ ID NO: 81070 - RNA, 64 nt, Human
gggaaaaacuggugaaaaagaaauauaaaaaggacccuaaaaagaauucugcaaaauaagagaa

SEQ ID NO: 81071 - RNA, 64 nt, Human
uaaaaccacacucagaaacgaggaccuagaagaucccuaaaacagaauaagaacaaaugugauu

SEQ ID NO: 81072 - RNA, 64 nt, Human
ccuagaugauaccccugaggauaaaaccuccauccccuaaaaugauuuuuuuuaaauaccacug

SEQ ID NO: 81073 - RNA, 64 nt, Human
ccucaauuuuauuuguaaagugauggaauaaaaccccuaaaaucuuacccaccucuaaagauau

SEQ ID NO: 81074 - RNA, 64 nt, Human
caaguuuacuuucauuccuuccuauguuuuaauccccuaaaauucucccuguagucaauguucc

SEQ ID NO: 81075 - RNA, 64 nt, Human
ggggaggaugcuacuuuacuggaguugagacacccccuaaaauucucacccucagcuauuuugu

SEQ ID NO: 81076 - RNA, 64 nt, Human
guaugccuagaaagugguugaaggauucuugaugcccuaaaaccaucuuguaagcuaaaugguc

SEQ ID NO: 81077 - RNA, 64 nt, Human
augaguuaaccaucuaaaaauaaaagaguggaagcccuaaaaugcuagaauaauaauaaaaagg

SEQ ID NO: 81078 - RNA, 64 nt, Human
caagauuguauugaaguuuuucugcauuauacaacccuaaaacacagagaucucacugacccgu

SEQ ID NO: 81079 - RNA, 64 nt, Human
ggccaaacugcuggacgucuuucuuuuuuucccccccuaaaauuuguggguuuuuuuuuuuaaa

SEQ ID NO: 81080 - RNA, 64 nt, Human
uguuuuuuauacccgaaguucauuuccuuugucucccuaaaacugaacuguaauuuugggaggu

SEQ ID NO: 81081 - RNA, 64 nt, Human
gguugacauagugcucuucaaauucaucccauuacccuaaaaguaauaacuuugaugcuugcuu

SEQ ID NO: 81082 - RNA, 64 nt, Human
aguagauugauuccaaguggagaauucacugcuucccuaaaaugcguuuuucuuaccuguaaug

SEQ ID NO: 81083 - RNA, 64 nt, Human
gcucuguucccuccgucuccccagacaucugacacccuaaaagccauccacagcuauggaaccu

SEQ ID NO: 81084 - RNA, 64 nt, Human
acuaacuucacugggauaaucagcagcguaacuacccuaaaagcauaucacuagccaaagaggg

SEQ ID NO: 81085 - RNA, 64 nt, Human
ucugauuuaaagcacuuuuaaaucuuauccugcccccuaaaaacaaaagguuuugaucacaagg

SEQ ID NO: 81086 - RNA, 64 nt, Human
acacaggucacuuuucaaaacacuugcaucauuacccuaaaaauaggcuguuaugcguuuugac

SEQ ID NO: 81087 - RNA, 64 nt, Human
ccuucccugugugcuggggagucucaucaccgcccccuaaaaaugacguuauuaaauguuguag

SEQ ID NO: 81088 - RNA, 64 nt, Human
cggcccacaauuaauuuuagaacauuuucaucaccccuaaaagaaacccugcacccauuagcag

SEQ ID NO: 81089 - RNA, 64 nt, Human
gcacaaacucaccaucugugcacgcaguggccuucccuaaaaucagggaauuguuuuaagucuu

SEQ ID NO: 81090 - RNA, 64 nt, Human
auuuuuguaaaccucuucauacuauuaaauuuugcccuaaaagaccucuuaauaaugauuguug

SEQ ID NO: 81091 - RNA, 64 nt, Human
aaauuuacuuaacuucuuucuuuugauuuuuuuucccuaaaacuaaacaucaaucauugcagga

SEQ ID NO: 81092 - RNA, 64 nt, Human
auauggguuagggauucuccauggacuccagaaacccuaaaauacaauuuugagguuuuccaau

SEQ ID NO: 81093 - RNA, 64 nt, Human
ccaccacuccugcuguuaggagcugagugugucucccuaaaauuucuauguugaagucuuaacc

SEQ ID NO: 81094 - RNA, 64 nt, Human
ugcacuccagccugggcaaaaagagcaaaacucucccuaaaaaaaaaauguagaauaucucuua

SEQ ID NO: 81095 - RNA, 64 nt, Human
guaauuuuuuauaaaucuucagauuauaaacagccccuaaaaacuuuacaacguuuacacaguu

SEQ ID NO: 81096 - RNA, 64 nt, Human
ugaaacuuccugagaaacuguagcauauccagcccccuaaaauguacaauguaacuuguucagu

SEQ ID NO: 81097 - RNA, 64 nt, Human
auuaaggggagagaggaaaacaaaaccaaccaaccccuaaaaucauuuucuuauuguacauaac

SEQ ID NO: 81098 - RNA, 64 nt, Human
cuaaauugcaagauaaggccauguguaagauuuucccuaaaacuagaauauauuaaugcauguu

SEQ ID NO: 81099 - RNA, 64 nt, Human
uaaaaugugucuuguccaaccuacaaaaguuuggcccuaaaaaaacccacaaaauauuuggacc

SEQ ID NO: 81100 - RNA, 64 nt, Human
aaccuacccauucaggaaggucagggcuuuggaacccuaaaaaguuggcccgaugacuuaaagg

SEQ ID NO: 81101 - RNA, 64 nt, Human
ucucccucaccaauuugcuuaaauuaguaugugccccuaaaauauucuauguuuguuaugagau

SEQ ID NO: 81102 - RNA, 64 nt, Human
uccuccaaguaggccgaccuucucggaaaauucacccuaaaagucucacaaaagaaugaguuca

SEQ ID NO: 81103 - RNA, 64 nt, Human
ccagcccuccccgcagugggaagugaauccuuaacccuaaaauuuuaaggccacggccuugugu

SEQ ID NO: 81104 - RNA, 64 nt, Human
guggcaggcagcuggaguagagcgagcccagcagcccuaaaaggcugccuucauggccaucuag

SEQ ID NO: 81105 - RNA, 64 nt, Human
acaacaccauguggucuggaggucccagcccccacccuaaaaagguuaucccugagaacuccac

SEQ ID NO: 81106 - RNA, 64 nt, Human
aaaccagcuaaauuugauaauuuaaacccccugccccuaaaacuucucacagagcuggggaguu

SEQ ID NO: 81107 - RNA, 64 nt, Human
cuccaagccagcgggaauggcagcugccacgccgcccuaaaagcacacucauccccucacuugc

SEQ ID NO: 81108 - RNA, 64 nt, Human
aacuguaggugccuuugcaaccuauccugggagacccuaaaacauauuuaguuuuagugccuag

SEQ ID NO: 81109 - RNA, 64 nt, Human
accaaacugcugcugugauaaccucuccuuuggccccuaaaaggaccuguuuuuaucuaccugu

SEQ ID NO: 81110 - RNA, 64 nt, Human
gcugaugauaaauacaccuuuuuuucccucuucccccuaaaaaugguaaaucugaucauaucua

SEQ ID NO: 81111 - RNA, 64 nt, Human
uucaaauuguaguaaaucuuaaaguuuuucaaaacccuaaaaucauauucgccaggaaauuuuc

SEQ ID NO: 81112 - RNA, 64 nt, Human
ccaacugucucuucccuaaggaagaguacaaguacccuaaaauugaaagguggucccuacacug

SEQ ID NO: 81113 - RNA, 64 nt, Human
gauuuauuccuacauuuucuguuuucuaauuugacccuaaaaucuauguguuuuagacuuagac

SEQ ID NO: 81114 - RNA, 64 nt, Human
acuuuuuacauacauugauucaugucucacgucucccuaaaaaugcguaagaccaagcugugcc

SEQ ID NO: 81115 - RNA, 64 nt, Human
uuuggugagcgagauaaaaguccacggugucaaccccuaaaacaugggugaccguacauuuuua

SEQ ID NO: 81116 - RNA, 64 nt, Human
gggcuuaacuuaaacagguaguguuuccuccguucccuaaaaagguuugucuuccuuuuuuuuu

SEQ ID NO: 81117 - RNA, 64 nt, Human
caaaugcugagagauuuugucaccaccaggccugcccuaaaagagcuccugaaggaagcacuaa

SEQ ID NO: 81118 - RNA, 64 nt, Human
auauguaacaaaccugcacguugugcacaugguacccuaaaacuuaaaguauaauuaaaaaaaa

SEQ ID NO: 81119 - RNA, 64 nt, Human
ggccacgggacaccucaggugccacccaccuuggcccuaaaacagccaccaggaaagcagccgg

SEQ ID NO: 81120 - RNA, 64 nt, Human
uuucuuuuaauauaaacauuuguguauagcuguucccuaaaauaaacauuaacauauuucauaa

SEQ ID NO: 81121 - RNA, 64 nt, Human
aaagauacgacucucagaagccuguuuaaggaagcccuaaaauguggacuggguuuccugucuu

SEQ ID NO: 81122 - RNA, 64 nt, Human
aagugcagcucccgaaagucccagagaugaaacucccuaaaaugccugagauggcugugccaga

SEQ ID NO: 81123 - RNA, 64 nt, Human
guccuaagccuccccacaaggcgaggggaguuaccccuaaaacaaagcuauuaaagggacagaa

SEQ ID NO: 81124 - RNA, 64 nt, Human
ugccccucccaaaccgggaaccucaagaucuccacccuaaaauaguucuguugaauuucacccu

SEQ ID NO: 81125 - RNA, 64 nt, Human
uugcagauucagccuaaaagcaaagaaaauauuucccuaaaauauuugcaaauaauguucacau

SEQ ID NO: 81126 - RNA, 64 nt, Human
uauuucucuuuuguggccuuuuagacuuuuguugcccuaaaauuccauuuuauugggaacccau

SEQ ID NO: 81127 - RNA, 64 nt, Human
cuggauugauaacccucaucugcaauauuuucaccccuaaaauuuuuaacaggguuuccuuuuu

SEQ ID NO: 81128 - RNA, 64 nt, Human
ccagcacugcccccguggcagcccacuuggaccccccuaaaaggagggaauaggaggagggcag

SEQ ID NO: 81129 - RNA, 64 nt, Human
caaggacuagaacuguauuuuuaagguuguuuuccccuaaaaggaccuuuaguaagcaaauuua

SEQ ID NO: 81130 - RNA, 64 nt, Human
guagauauuguccuaaguuggaauucucccacugcccuaaaacuuucccuaguaguccuuuaaa

SEQ ID NO: 81131 - RNA, 64 nt, Human
gaggcuguggaacaacugaaggagaacuuucagacccuaaaacaguuauauuacuuagauguua

SEQ ID NO: 81132 - RNA, 64 nt, Human
ggguuccccgccggagcuacaggggcauuuucuucccuaaaaccaacagugucccacugaccuc

SEQ ID NO: 81133 - RNA, 64 nt, Human
ccuagaaaacagcugcaaaugccagaaagaugaucccuaaaaauguugagggacuucuguucau

SEQ ID NO: 81134 - RNA, 64 nt, Human
auauauauauauaaaacuuagaguuuuuaucuuccccuaaaagaggccgugauauuugcagcag

SEQ ID NO: 81135 - RNA, 64 nt, Human
uaacggguuucaaggggacucuugaggaagugcccccuaaaauagaacacagcaauaacugggc

SEQ ID NO: 81136 - RNA, 64 nt, Human
uccuagggucccuuuuucugaugaagucuuaauucccuaaaagcgccucuuuggacacugaggc

SEQ ID NO: 81137 - RNA, 64 nt, Human
acuuauaugaauaaaugaaauuacaugccaagggcccuaaaaagcaaauuuuacgaaauugugu

SEQ ID NO: 81138 - RNA, 64 nt, Human
ucuucuuacauauauugauuaaugucuuaugucucccuaaaauguauaaaaccaagguaugccc

SEQ ID NO: 81139 - RNA, 64 nt, Human
ugggagcccagagcugcugagguguggucagcuccccuaaaaugggcacggcccagccuguccc

SEQ ID NO: 81140 - RNA, 64 nt, Human
ucuuggaaauuccucguggaccucgagaucuuuacccuaaaauaguucuguugaauuucacccu

SEQ ID NO: 81141 - RNA, 64 nt, Human
gauuguacuuuuaucuuaaaagggugguaguuuucccuaaaauacuuauuauguaagggucauu

SEQ ID NO: 81142 - RNA, 64 nt, Human
auacuuuuguaugucucaguguugguguuuuccucccuaaaacuaacauuagggcugugccacg

SEQ ID NO: 81143 - RNA, 64 nt, Human
uguuugcaacgugcuuugaaggccacauaaaaagcccuaaaaaugaguauuucuuuacaugacc

SEQ ID NO: 81144 - RNA, 64 nt, Human
uuaaaaaucagcagcucuuugcuuuuaacagacacccuaaaagucuucuuuucuacauaguuga

SEQ ID NO: 81145 - RNA, 64 nt, Human
ugaaacaagagaaaagguuuuuaacuuagaguagcccuaaaauauggaugugcuuauauaaucg

SEQ ID NO: 81146 - RNA, 64 nt, Human
aauugugaaaguauuuguuuaauaucugucuucucccuaaaaugucagccuacugaagaugaac

SEQ ID NO: 81147 - RNA, 64 nt, Human
uuuagcauguaacucgcuuaaaguugagguuucccccuaaaaucuacaaguuucccucuuucag

SEQ ID NO: 81148 - RNA, 64 nt, Human
gugugcuuuauaaaaaaaaguuguuuauaaaaaccccuaaaaacaaaacaaacacacacacaca

SEQ ID NO: 81149 - RNA, 64 nt, Human
auuuuuggaaaucauagcuuuuuauuuccaaggccccuaaaaacugcacaaaauagaugcugcu

SEQ ID NO: 81150 - RNA, 64 nt, Human
uaccacaaacagguacggcauucugggccccggccccuaaaacauucauuaagucuggggugaa

SEQ ID NO: 81151 - RNA, 64 nt, Human
uugauccacaguauuguaccugcauuuucuaccacccuaaaauugugugagacuucucccauug

SEQ ID NO: 81152 - RNA, 64 nt, Human
gggcaagaucccaguggaggccuucaagcaaauccccuaaaaggagcccuuugaugucaucuuu

SEQ ID NO: 81153 - RNA, 64 nt, Human
ggacugcaggcuuauuuugcuuaagucaacagugcccuaaaacuccaaacucaaaugcagucaa

SEQ ID NO: 81154 - RNA, 64 nt, Human
accaaaauggugauuuaacaguuuuucuuguguccccuaaaaaguggcucugcuucagaaguac

SEQ ID NO: 81155 - RNA, 64 nt, Human
aguguucaaaaccacagccacuuagugaucagcucccuaaaaccaugccuaaguacaggcggau

SEQ ID NO: 81156 - RNA, 64 nt, Human
aguggcuuucuggcccuucuuucaauggcuucuucccuaaaacguggagacucuaaguuaaugu

SEQ ID NO: 81157 - RNA, 64 nt, Human; identical to SEQ ID NO: 81156

SEQ ID NO: 81158 - RNA, 64 nt, Human
cacggguccggagguuaugucuucggugucucagcccuaaaaguccaguucccccgugcggcca

SEQ ID NO: 81159 - RNA, 64 nt, Human
agggccugcccuuggcuaaagucaauaaagucuauucuaagagcaauaaaaggcuggugucugc

SEQ ID NO: 81160 - RNA, 64 nt, Human
accaguuuuuauuauuuaacauuuuuauuugaauuucuaagaagccuauucucuaucuauuuug

SEQ ID NO: 81161 - RNA, 64 nt, Human
cuuacuagccagccuugggaacugccaacucaaauucuaagaaagccacugcuuucucaucauc

SEQ ID NO: 81162 - RNA, 64 nt, Human
ccagccucucugcccuggagaaucaugugcuauguucuaagaauuugagaacuagaguccucau

SEQ ID NO: 81163 - RNA, 64 nt, Human
uauguuuaaauuagaaaaccaaaaaucaugaacauucuaagagaaaauaaauauagaauuuaaa

SEQ ID NO: 81164 - RNA, 64 nt, Human
auaacccuuugguuuuuuucuucuguauuuuuuuuucuaagagaaguuauuuucuacagugguu

SEQ ID NO: 81165 - RNA, 64 nt, Human
agccuacuaacauauaauuaggugacuagggacuuucuaagaagauaccuacccccaaaaaaca

SEQ ID NO: 81166 - RNA, 64 nt, Human
cagauaacaaacuucucuucuaaacugguucugcuucuaagacaagcaucuccugcccucucuc

SEQ ID NO: 81167 - RNA, 64 nt, Human
acaaucauuuugaaucccucuuccucacuuuuuuuucuaagaaaauaaacauuuuacuguuuuu

SEQ ID NO: 81168 - RNA, 64 nt, Human
agaugguuugcuauuuuucucuccuggggguuuauucuaagauaccuuuguauuuuauuucaug

SEQ ID NO: 81169 - RNA, 64 nt, Human
gguuucuuuucacaucccagccucccaugggcacuucuaagaagagaggggauuucuuggaaaa

SEQ ID NO: 81170 - RNA, 64 nt, Human
augugacuuuuauaugcuuuuucucagaucugguuucuaagaguuuuggggggcggggcuguca

SEQ ID NO: 81171 - RNA, 64 nt, Human
cagucucuucuaguucucagagaaggguuucaucuucuaagauaucccuaagaaauucuucaaa

SEQ ID NO: 81172 - RNA, 64 nt, Human
cuucucucauucauuaaaagaaaacgcgacaucuuucuaagauucucugugggaaaaugacugu

SEQ ID NO: 81173 - RNA, 64 nt, Human
ccagaccugaauauuggggugcuucuugccaguauucuaagacauuugaguaauugcuguuugc

SEQ ID NO: 81174 - RNA, 64 nt, Human
uaaaauuuuaacacguuuagauagcuuauuuaaauucuaagacuguuuuuacagacuguauuau

SEQ ID NO: 81175 - RNA, 64 nt, Human
cuaucugguuuuucccaguaaaugaggcaagcaauucuaagaucuuccacaaaacaucuagcca

SEQ ID NO: 81176 - RNA, 64 nt, Human
uaucauuaaaaauuaccuuuaauuuuaaugcuguuucuaagaaaauguaguuagcuccauaaag

SEQ ID NO: 81177 - RNA, 64 nt, Human
uauauuucacuuaaaauacuauucauacuauacauucuaagacuggugcuucugcuuuugaagg

SEQ ID NO: 81178 - RNA, 64 nt, Human
cuggguuuauuuacuauuacucuguguugcuauuuucuaagaaagaauacagcacuagacuuca

SEQ ID NO: 81179 - RNA, 54 nt, Human
gagaggaagaagaugacuagaucauucuaagaccagauucucuaauguuucugg

SEQ ID NO: 81180 - RNA, 64 nt, Human
agcuuguuuucagcagaaagaucuugcucccuauuucuaagaggcugcucaauauugggaaaua

SEQ ID NO: 81181 - RNA, 64 nt, Human
uguugugaaauguuaagugucuggaaauuuuuuuuucuaagaaaaacuauuaaaguacuuccua

SEQ ID NO: 81182 - RNA, 64 nt, Human
aggacuacuuuucuagucacagauguuuucaaauuucuaagaaaaagaaaaugaggcucaagag

SEQ ID NO: 81183 - RNA, 64 nt, Human
aauacaguaguuccccuuaucugagcaguauauguucuaagaccccuaguagauucgcaaacca

SEQ ID NO: 81184 - RNA, 64 nt, Human
caaucuaccuggucauuauuuuauuucuauccaguucuaagaacugccuccacuguuuauauau

SEQ ID NO: 81185 - RNA, 64 nt, Human
aaacugcaagcauugccuguguuccugggaagaguucuaagaagcuugcauucauuuucuaccc

SEQ ID NO: 81186 - RNA, 64 nt, Human
gcagauguuaccauugucuuuucacuguauauacuucuaagacagcaagcgggacacugcagug

SEQ ID NO: 81187 - RNA, 64 nt, Human
gucacaaacuugcauccuaauccuugguggacucuucuaagaauacaguuugcuagucacaaag

SEQ ID NO: 81188 - RNA, 64 nt, Human
augcuaacgugucagaauccuuuacauucaacuuuucuaagaaaagcauuuucagucuuguagu

SEQ ID NO: 81189 - RNA, 64 nt, Human
acuguucuuugucgaugcuauauaagccagggaguucuaagacgccagcucuuugagauuugcu

SEQ ID NO: 81190 - RNA, 64 nt, Human
uaguuuaguuuuugugcuccguguucuuguguccuucuaagaaaaaugugggcugcucuugaaa

SEQ ID NO: 81191 - RNA, 64 nt, Human
gcuucauuugauuuuauuuuucagaguaugaacauucuaagagaaaguuaaaacaauagcaaau

SEQ ID NO: 81192 - RNA, 64 nt, Human
auucuaaugaaguaugggaacuaaauugcugguuuucuaagauaagauaugggauaugggucau

SEQ ID NO: 81193 - RNA, 64 nt, Human
uaagugcuaauuucaaagcuaucauuuucuauuuuucuaagauaaaguaaaugaauuccagguu

SEQ ID NO: 81194 - RNA, 64 nt, Human
ucuuccaaagccuuugucucugagaccucuuaaguucuaagauuaaaugccccucgcuguucuu

SEQ ID NO: 81195 - RNA, 64 nt, Human
ucucccgauuucccaggggcucugggagggacccuucuaagaagauugggcaguuggguuucug

SEQ ID NO: 81196 - RNA, 64 nt, Human
cuaucuuuccagauaucuuaaggguaaaagcuuauucuaagacagucuguccauugagaauauu

SEQ ID NO: 81197 - RNA, 64 nt, Human
uuacauucaacauauuuaauuuuaugccuucuaauucuaagaugcagaaaaaaauaaaugaaca

SEQ ID NO: 81198 - RNA, 64 nt, Human
uuucaacagugugacuaauguuugaaauuauuuuuucuaagaguuuuucuauaaccuuccaaaa

SEQ ID NO: 81199 - RNA, 64 nt, Human
uuuugguuacguagguagagaauacaacaaagaguucuaagacuuagaaaagacaauuuugugg

SEQ ID NO: 81200 - RNA, 64 nt, Human
cucaacuauguuuucaacaagcaaaaauauaguauucuaagauuaaaaugucauuacaaaauau

SEQ ID NO: 81201 - RNA, 64 nt, Human
accaagguguccaugaucccuccccacugaccuuuucuaagaaaauucuugugcccgcauuggu

SEQ ID NO: 81202 - RNA, 64 nt, Human
uuaacacauugguagagcuaugauuccuucccaguucuaagagauacgaucuguaagucccuau

SEQ ID NO: 81203 - RNA, 64 nt, Human
cugagaauuggcugcuguuucuaauauaauuauuuucuaagauagccagauaguuagaaaaaga

SEQ ID NO: 81204 - RNA, 64 nt, Human
cuucucucucuuuuaauuuucuugugagauaauauucuaagaggcucuagaaacaugaaauacu

SEQ ID NO: 81205 - RNA, 64 nt, Human
uaaugauuuaagcauuuuacugucuguaagagaauucuaagauuguacauaaagucauauauau

SEQ ID NO: 81206 - RNA, 64 nt, Human
uugucaagagaacuagcaagccccugacauuuuuuucuaagaguguuuaugggaugagaugugc

SEQ ID NO: 81207 - RNA, 64 nt, Human
uaucagaguacuuaguaaauguuauauaguuuaguucuaagauaguuccagggauuaaaagguu

SEQ ID NO: 81208 - RNA, 64 nt, Human
ucauuccagugauuaaaacugauugugcagaauauucuaagaggucagaaauugguguguauaa

SEQ ID NO: 81209 - RNA, 64 nt, Human
gcccauccugccccugagcccauggcacucuauguucuaagaagugaaaaucuacacuccagug

SEQ ID NO: 81210 - RNA, 64 nt, Human
caaugaagccauaugaacagcuguucaguugcacuucuaagacuuuacuuagcaguaaauuaua

SEQ ID NO: 81211 - RNA, 64 nt, Human
uugcagagccucauuguuugauuucuugugacuauucuaagaaugaaugcaaucagauuuuaaa

SEQ ID NO: 81212 - RNA, 64 nt, Human
uagaaaucauuuggguuaauauggcucuucauaauucuaagacuaaugcucucuagaaaccuaa

SEQ ID NO: 81213 - RNA, 64 nt, Human
ugaggccaugcaguugauggugagcugacaucaauucuaagacucauccuaauugagggguguu

SEQ ID NO: 81214 - RNA, 64 nt, Human
gaaauaaaucaucugguuguuccuccaggguacuuucuaagauaagccuuaaacagaaaccccu

SEQ ID NO: 81215 - RNA, 64 nt, Human
agcucccagugaucacucaagaaucuggcucucauucuaagaggcugugcugcccaguauggug

SEQ ID NO: 81216 - RNA, 64 nt, Human
auaaggauugucaccuucuguguguugcaacagcuucuaagauaauuagggacaaaugauguua

SEQ ID NO: 81217 - RNA, 54 nt, Human
uggggccauuuucauuuuagucuuuucuaagagucaaccacaggcauuuaaguc

SEQ ID NO: 81218 - RNA, 64 nt, Human
gugcauccugcuuauguacaauuguuuucaguguuucuaagaaugagucugaaugguucuugaa

SEQ ID NO: 81219 - RNA, 64 nt, Human
gugcacucuuggcuccuggggagauauaucugccuucuaagaaggcaggccaggucuugggcac

SEQ ID NO: 81220 - RNA, 64 nt, Human
aagcccgccugacagaaaccacggccacauuugguucuaagaaacccucugucauucgcuccca

SEQ ID NO: 81221 - RNA, 64 nt, Human
auccaaggucaagaagauuaaugccuguguuuucuucuaagaacuauacuuuuaguucucacaa

SEQ ID NO: 81222 - RNA, 64 nt, Human
aauaauugacaaacuuuuccuggacacuuuaccuuucuaagaccuccucccaagcacuucaaag

SEQ ID NO: 81223 - RNA, 64 nt, Human
aauuagucacguaucacuuaucaauggggauacguucuaagaaaugcauaguuagggaaucuug

SEQ ID NO: 81224 - RNA, 64 nt, Human
gaguauuuacacuaugauaaaguuguaaauaauuuucuaagacaguuuuuauauagucuacagu

SEQ ID NO: 81225 - RNA, 64 nt, Human
cugcuuaguauuagaagcagaucauuucccaaaauucuaagagcagcagcauauguuguugcuu

SEQ ID NO: 81226 - RNA, 64 nt, Human
uauucaauaccgcucaguauuuuaaaugaagugauucuaagauuugguuugggaucaauaggaa

SEQ ID NO: 81227 - RNA, 64 nt, Human
gaaauuaacauauuuuaaugacuuuacuuuuuauuucuaagaaaaguauuugaaaaauggaaua

SEQ ID NO: 81228 - RNA, 64 nt, Human
cuuauggugugguggggggugguaaaaauuaggcuucuaagaaaggaugggacucugcccucca

SEQ ID NO: 81229 - RNA, 64 nt, Human
uccuugagggucaguaguuucaaaaccaaaaauauucuaagaagucuuaggauggaguuccuuu

SEQ ID NO: 81230 - RNA, 64 nt, Human
ggugucauaacuagagcacgggcguuauguaaguuucuaagaauuuagaggauaaauaauaaag

SEQ ID NO: 81231 - RNA, 64 nt, Human
agcugaaugaggaggcccuauagcagaagucugauucuaagagcaguagaaacuuguaccagaa

SEQ ID NO: 81232 - RNA, 64 nt, Human
aaaaguaguucuuuaguaucaacuuuaauucuacuucuaagaaucauacucuacuucuaagaaa

SEQ ID NO: 81233 - RNA, 64 nt, Human
aacuuuaauucuacuucuaagaaucauacucuacuucuaagaaaauaauuagaaguagacaaag

SEQ ID NO: 81234 - RNA, 64 nt, Human
cuaguucaaugauuuggcuccuauugaagauggcuucuaagaaaacaagaugcacagaggacac

SEQ ID NO: 81235 - RNA, 64 nt, Human
uucuugaggaucuuuauugcacaaccagccuggguucuaagaaagccuagagaauuucuuauug

SEQ ID NO: 81236 - RNA, 64 nt, Human
gccauuuaguauuuuuauaguuuaggaaaauauuuucuaagaccaguuuuagaugacucuuauu

SEQ ID NO: 81237 - RNA, 64 nt, Human
uugaugaagaaaacuuuguucauuuguuucuacuuucuaagagaaauugccacgauuccucugc

SEQ ID NO: 81238 - RNA, 64 nt, Human
gcagcggacagucagaaugguuggaauuuuggcuuucuaagaaaaacuuuauuuugcauaagca

SEQ ID NO: 81239 - RNA, 64 nt, Human
uagcuuugaaaccccuaauuugccucaguugauuuucuaagaauuucaggagugauguaugucu

SEQ ID NO: 81240 - RNA, 64 nt, Human
aaauuucaaggaaauaugaaggcacuuccuuuuuuucuaagaaggaaguugcuagaugauuccu

SEQ ID NO: 81241 - RNA, 64 nt, Human
uugaauuguguuuuucuuucuucccauguuuauuuucuaagaucuaccugaacuuagagacuca

SEQ ID NO: 81242 - RNA, 64 nt, Human
uuaguggccuugagaguugcuuuuggcauuaauauucuaagagaauuaacuguauuuccuguca

SEQ ID NO: 81243 - RNA, 64 nt, Human
uuuugauuaagugguuacuuuguguuuuuuuaauuucuaagaaguuacuuuuuguagagagagc

SEQ ID NO: 81244 - RNA, 64 nt, Human
agcacacuucuguucucuuagaacuuagaaguguuucuaagagaacagaaguaauaagagaaac

SEQ ID NO: 81245 - RNA, 64 nt, Human
gauagagauaaaguuaucuaacaaauugguuauauucuaagaucugcuuuggaaauuauugccu

SEQ ID NO: 81246 - RNA, 64 nt, Human
gcauaagccuuauccugccagccaaggggauuuauucuaagagaagugcaugugaagaaugguu

SEQ ID NO: 81247 - RNA, 64 nt, Human
uguugauaaaauuuuuuuagaauugaaguuugaauucuaagacuugaaacaaccugaucacuga

SEQ ID NO: 81248 - RNA, 64 nt, Human
uuucuaguaugaaagagcacccucuagcuccauauucuaagaaucugaaauaugcuacuauacu

SEQ ID NO: 81249 - RNA, 64 nt, Human
uauucauuauacaaaaaguauuugcccauuccuauucuaagauuugcagaauaugucacccuau

SEQ ID NO: 81250 - RNA, 64 nt, Human
guaauguuuaauaaagaaauuacaaauucucacuuucuaagaagcuuucacuaaucauuaccua

SEQ ID NO: 81251 - RNA, 64 nt, Human
guacuacauuuccugccuuuuucuuucaguguuuuucuaagacuaaauaaauagcaaacuuuca

SEQ ID NO: 81252 - RNA, 64 nt, Human
uuguugccuaccaggagaaagcaguaggcuuccuuucuaagauacggacucagcuggucuauuu

SEQ ID NO: 81253 - RNA, 64 nt, Human
aaaaaaccggaaaaauacgccaagguuagguucauucuaagagucuaaaaauuucaaaaaccaa

SEQ ID NO: 81254 - RNA, 64 nt, Human
ugcacauauuggcaauagagguccugaauuguuuuucuaagacugaucugagagccauugggcc

SEQ ID NO: 81255 - RNA, 64 nt, Human
ggugcagucaaaggaacgccuuccccucaguuguuucuaagagcagagucucccgcugcaaucu

SEQ ID NO: 81256 - RNA, 64 nt, Human
cacugagggccuggcagggcucaucgcccccaccuucuaagaagcccuguggaaagggcacugg

SEQ ID NO: 81257 - RNA, 64 nt, Human
cacuaguaauuaaaaugugccuuuugaagauguuuucuaagagaaaggaaauacguugcaguga

SEQ ID NO: 81258 - RNA, 64 nt, Human
gucuggaugugauuaguaaggauacaagauaauguucuaagacugccuaaugcuuuuuguuuga

SEQ ID NO: 81259 - RNA, 64 nt, Human
guauaaauauaagucuauacuaaugcuuacaacuuucuaagaggguucuugcuuauguagcuuu

SEQ ID NO: 81260 - RNA, 64 nt, Human
uccuccugcucccagaauguccugugaugcaugauucuaagaacuggaagaaccuggugguucc

SEQ ID NO: 81261 - RNA, 64 nt, Human
uguguaggcagaaauaagcuuuguucuauaucucuucuaagacaguuguuauuacuguguauaa

SEQ ID NO: 81262 - RNA, 64 nt, Human
gugucacagguuuguaauacuugaagcccuacauuucuaagaauauauuucuugcucaguuguu

SEQ ID NO: 81263 - RNA, 64 nt, Human
uauucuaugaauaucaauugucaggugcuuugauuucuaagauaaaauauuuuagaauuauguu

SEQ ID NO: 81264 - RNA, 64 nt, Human
uaaauucuauuuuagaugcagguacugcauuuuauucuaagaauugauaucaauucaaaacaua

SEQ ID NO: 81265 - RNA, 64 nt, Human
ggccaugugugaaugggauuuuagcuuauuauguuucuaagacuuuuccuuacagcacacuuaa

SEQ ID NO: 81266 - RNA, 64 nt, Human
uagggaaaugauuuugguguuuuggguuaauugcuucuaagaaaaguuucauaguggacuguuu

SEQ ID NO: 81267 - RNA, 64 nt, Human
acuguuaaaaccuaauuaaauaugcuuuagaauuuucuaagacaguccucuggauccucuaaau

SEQ ID NO: 81268 - RNA, 64 nt, Human
cgaaggaaaagggcuuucucaauaagccucagcuuucuaagaucuaacaagauagccaccgaga

SEQ ID NO: 81269 - RNA, 64 nt, Human
gcaauauauaauggggaauuguauaccccacuauuucuaagauucccauuaguuuucccuuuuu

SEQ ID NO: 81270 - RNA, 64 nt, Human
acuaaaucuguaacaaugaaagacugccuuuguuuucuaagauguaaaucacucaaaguauaug

SEQ ID NO: 81271 - RNA, 64 nt, Human
uuuuauucauauauuuuagcauauucgaacuaauuucuaagaaauuuaguuauaacucuaugua

SEQ ID NO: 81272 - RNA, 64 nt, Human
cuccuagauuuucccuuuccuguuccugcuuagauucuaagaaugaagugcauccuucuccuuu

SEQ ID NO: 81273 - RNA, 64 nt, Human
caagaguuguaccuuaacauuggugaaacauuuuuucuaagauuuucaaaaggaauauguguaa

SEQ ID NO: 81274 - RNA, 64 nt, Human
cucauucaaucuccagaagauugggauuaucgucuucuaagagguugcuaaugccuuucaucuu

SEQ ID NO: 81275 - RNA, 64 nt, Human
gugagccacugugcccagcagggaugcuucaucuuucuaagaauuaucuuggcuuuggacuuua

SEQ ID NO: 81276 - RNA, 64 nt, Human
agugcaauaauccuuccucagaugauguuugcuuuucuaagauacauauacugauucuguguau

SEQ ID NO: 81277 - RNA, 64 nt, Human
agcuacuuucaaaugagacuugaauuuggcaaauuucuaagauggacauucauauccuuaaauu

SEQ ID NO: 81278 - RNA, 64 nt, Human
cuuuccuuccaaacuauaccacuguauuuaccacuucuaagagugacugacgacgggccagaug

SEQ ID NO: 81279 - RNA, 64 nt, Human
uguuagaaaugcauucaaauuuguuuuuucuguguucuaagaacucaggcaauuuuaaggauaa

SEQ ID NO: 81280 - RNA, 64 nt, Human
gaacaggccucuccauuugcucuucagaugccacuucuaagaaaagccuaaucacaguuuuucc

SEQ ID NO: 81281 - RNA, 64 nt, Human
gauugagaacucaacuguauuuugccauaaaugcuucuaagauauauccagcugggacuucuau

SEQ ID NO: 81282 - RNA, 64 nt, Human
uaaaaugaucucucuuucucucucucucucucuuuucuaagaaacaauuaugugcacuuugaua

SEQ ID NO: 81283 - RNA, 64 nt, Human
aaacuuagagacccuuugucucugagaagcauccuucuaagacauucuguuggaguucccucag

SEQ ID NO: 81284 - RNA, 64 nt, Human
ugauauguuuuggauuuagucauauuggcuuuauuucuaagauauucuauugauuuaaugugac

SEQ ID NO: 81285 - RNA, 64 nt, Human
gguggaaaguuaaccucuuauacauuauagauaauucuaagacagcacacaaacuuaucaauaa

SEQ ID NO: 81286 - RNA, 64 nt, Human
gccaggggcauaguugccaaggccauuuaccucuuucuaagaagaaacauuuaccccauguacu

SEQ ID NO: 81287 - RNA, 64 nt, Human
auuaguagaucaacaaucuaaacaaaucccucgguucuaagauacaauggauuccccauacugg

SEQ ID NO: 81288 - RNA, 64 nt, Human
uucaguugguugcccuaauauuuaaaauuuacacuucuaagacuagagacccacauuuuuuaaa

SEQ ID NO: 81289 - RNA, 64 nt, Human
uuucuagaugaaaaccaagcacagauuuuaaaacuucuaagauuauucuccucuauccacagca

SEQ ID NO: 81290 - RNA, 64 nt, Human
cuggucaaauccaaacccagagaacagaagcgcuuucuaagaaugaacaaauaugugaaauagg

SEQ ID NO: 81291 - RNA, 64 nt, Human
cucacuauaguccauaaugcuuccagaucaccuuuucuaagaugcaacaugugaguuuagugag

SEQ ID NO: 81292 - RNA, 64 nt, Human
aaccauaaaagaaaacaccgacagcuguaaaauguucuaagauaaaaaaacucgagcuacaaag

SEQ ID NO: 81293 - RNA, 64 nt, Human
guuuuacucuaaauguacuuuuaauacuugcagauucuaagauuacauuguaaaauuccagguu

SEQ ID NO: 81294 - RNA, 64 nt, Human
aaauauaucuuggcuuugaccuuauuucaacacauucuaagaagccuugacaaaguaaguauau

SEQ ID NO: 81295 - RNA, 64 nt, Human
gguagcucugauggaguuauuuuuuauuuccauguucuaagaagguguugguacucuguuuccc

SEQ ID NO: 81296 - RNA, 64 nt, Human
acuuugucgugguucuuaaauguuuauacuguauuucuaagaaguuguuugaggcaaauuaacu

SEQ ID NO: 81297 - RNA, 64 nt, Human
cacuauucauaacucuuaaaauuauucucuuuuuuucuaagagucccucccuuccaaaagugua

SEQ ID NO: 81298 - RNA, 64 nt, Human
ccuugagggauuggggaggacccaguccaggccuuucuaagauacuccuccagccgggcgcggu

SEQ ID NO: 81299 - RNA, 64 nt, Human
aaaccauuagcauugcaugcagguuucauauucuuucuaagauggaaaguaauaaaauauauuu

SEQ ID NO: 81300 - RNA, 64 nt, Human
ccaguaagguaaugagaugccauuuucagagacauucuaagaagauauuuugauucauuaaaac

SEQ ID NO: 81301 - RNA, 64 nt, Human
aauuaaaaggaguccaacauucccagcuccccaguucuaagaaacuuuugucaaacccaauagg

SEQ ID NO: 81302 - RNA, 64 nt, Human
cuuggacuagaggaccuuuaaguuuucuuucuguuucuaagacaacaguaugcugcuauagccg

SEQ ID NO: 81303 - RNA, 64 nt, Human
ugauuauuuaugaccugaaauaauauauuucuucuucuaagaagacauuuuguuacauaaggau

SEQ ID NO: 81304 - RNA, 64 nt, Human
uaccuggguaaaagcgcuaacgacccaaaggcucuucuaagagccacccauguugucauuuaaa

SEQ ID NO: 81305 - RNA, 64 nt, Human
uggucaucuggaccaucguacuugcuguggcuacuucuaagacaauguagaggguuauuaaacc

SEQ ID NO: 81306 - RNA, 64 nt, Human
caaguuuggagugcgcccccuucaguacugcgcguucuaagacuuuuggcggagacuuucuugg

SEQ ID NO: 81307 - RNA, 64 nt, Human
agccaggcugcacagcauuugcuuuccucugagauucuaagagaaggccuuuaauaaauuuaau

SEQ ID NO: 81308 - RNA, 64 nt, Human
uaugcucagaggguuaugauuuuccuuucuuuuuuucuaagaaaaaauuauuuucaggagaaua

SEQ ID NO: 81309 - RNA, 64 nt, Human
gaauucuaguacauguagguaaaucauaaaucuguucuaagacauaugaucaacagaugagaac

SEQ ID NO: 81310 - RNA, 64 nt, Human
cucguuaagccugauacauaagccauauuuaaaauucuaagaaauaauuaauguuaugauauau

SEQ ID NO: 81311 - RNA, 64 nt, Human
aguuuauuuuauucucagaguuuggacuacaauuuucuaagauguuucugguucaagacuguca

SEQ ID NO: 81312 - RNA, 64 nt, Human
acuuacuguagcaaauaauaccuacaaguugaacuucuaagaugcguauauguacaauuuggug

SEQ ID NO: 81313 - RNA, 64 nt, Human
agguuuucauaugcagcucggauggacauuuuucuucuaagauggaacuuauuuuucagauauu

SEQ ID NO: 81314 - RNA, 64 nt, Human
uucuuagauuacaauaguguacugugcuuauuuguucuaagagaagaauugcuucuuuauacag

SEQ ID NO: 81315 - RNA, 64 nt, Human
auguggaguguggagaggaaggaggcagauucauuucuaagacgcacucuggagccauguagcc

SEQ ID NO: 81316 - RNA, 64 nt, Human
auuaaacaaucuauauggaacaaacauucccaaauucuaagaauaaauuuuucuuuaaguuuuc

SEQ ID NO: 81317 - RNA, 64 nt, Human
cccuguucauccaaguuuuaaguccuccacccuguucuaagagacuguuccaacggcucugggc

SEQ ID NO: 81318 - RNA, 64 nt, Human
uauuuccccaaagacuuaucagaugcucauugcuuucuaagaucuaaaaugauacuguguuccc

SEQ ID NO: 81319 - RNA, 64 nt, Human
gucauaucucugugugcagauaauaaaagcauauuucuaagagguucucucgcugucuucuuag

SEQ ID NO: 81320 - RNA, 64 nt, Human
uuugccaaaugaaaaacacauccaacaaucaaguuucuaagaaggugucaaguggggaauaaua

SEQ ID NO: 81321 - RNA, 64 nt, Human
uuuggguauauuacuaaguaacaacauaugguuguucuaagaauuaaaaggaacugacauguaa

SEQ ID NO: 81322 - RNA, 64 nt, Human
gcuuaaugccagaaguugggggaaaguuacgcuuuucuaagaauaauggacucuuaaggcauug

SEQ ID NO: 81323 - RNA, 64 nt, Human
aaguaaaaggcuaccuaggaaauacuucagugaauucuaagaaggaaggaaggaagaaaggaag

SEQ ID NO: 81324 - RNA, 64 nt, Human
gccuggaccucuaaaauuuugcaaaaacaaaagguucuaagaugauuucaggaaauaaugugaa

SEQ ID NO: 81325 - RNA, 64 nt, Human
gggcugacagcacuaaacuuggugcuuauugauauucuaagaaauaucugugaaauaucaucac

SEQ ID NO: 81326 - RNA, 64 nt, Human
ucugauaaaagucuucuuugaaaaaaguuuuuacuucuaagauuugcauuuacaucauaaaauu

SEQ ID NO: 81327 - RNA, 64 nt, Human
uuuugccuguuugugcagauaagaacagaaacuuuucuaagacccacauuugguuauugaaggc

SEQ ID NO: 81328 - RNA, 64 nt, Human
augacuuugaugucauuaacugcuaaguguuauuuucuaagaggaauuuuaucuuuuuuuuaac

SEQ ID NO: 81329 - RNA, 64 nt, Human
uuguuggggcuuuacauacuuuaucaaugugucuuucuaagaaaucaaguaaugaauccaacug

SEQ ID NO: 81330 - RNA, 64 nt, Human
uguaacuguaugcauaaagccaauguaguccaguuucuaagaucauguuccaagcuaacugaau

SEQ ID NO: 81331 - RNA, 64 nt, Human
aacaucacauacauuugucauuuuuaaggaaguuuucuaagagcccucaauugccugccuguau

SEQ ID NO: 81332 - RNA, 64 nt, Human
gauugacaaaagcugugcaugaagaacugccuucuucuaagaucuaaccuucaggcuucucucc

SEQ ID NO: 81333 - RNA, 64 nt, Human
cuccaccucaguuuaucaacauuauaaguuacuguucuaagaaaaguaaauacaguuccagaug

SEQ ID NO: 81334 - RNA, 64 nt, Human
ucuuuucagaacucagccccuuuccugauuuuacuucuaagaggaaaauuauuuuggggaggaa

SEQ ID NO: 81335 - RNA, 64 nt, Human
aauugcacuacccugagcuaaacgugucugugcuuucuaagauaagagcuugaucccuuucuuc

SEQ ID NO: 81336 - RNA, 64 nt, Human
agggcuggccgcucacugcuugggcccccuugauuucuaagacaccugugaagggucccacaag

SEQ ID NO: 81337 - RNA, 64 nt, Human
uucaucuugguugcaauuguacuuuaggcuauauuucuaagagcgaaaugaccacagccaaagg

SEQ ID NO: 81338 - RNA, 64 nt, Human
auuaugucaguuuuaccagauuguccuguacaacuucuaagaucgggaucuguguguuucuaca

SEQ ID NO: 81339 - RNA, 64 nt, Human
augucuuucagaaaaagguuucuuugguuuuuguuucuaagaaagaggaagccaauuggauuuc

SEQ ID NO: 81340 - RNA, 64 nt, Human
augugucuggacagauugugggaguaagugauucuucuaagaauuagauacuugucacugccua

SEQ ID NO: 81341 - RNA, 64 nt, Human
uuagcuaaucaaccauuauuuuucauuuuguuuguucuaagaggauugaaaaucaguuuaguuu

SEQ ID NO: 81342 - RNA, 64 nt, Human
auguuugaacuaaaaugauugaauuuuacaguauuucuaagaauggaauugugguauuuuuuuc

SEQ ID NO: 81343 - RNA, 64 nt, Human
guuggucucaggcauuucauuaggaccagauugguucuaagaguuagucuggacuggcccuagg

SEQ ID NO: 81344 - RNA, 64 nt, Human
auccaaucacacugcugugauucagggaucuuucuucuaagacggacacauuugaaccucaggu

SEQ ID NO: 81345 - RNA, 64 nt, Human
gugauguuuuaaaaugugaucgaaaauauaaugcuucuaagaaggaacaguaguggaaugaaug

SEQ ID NO: 81346 - RNA, 64 nt, Human
agccuauuugaacaaagugagaaugaacuuuuguuucuaagaagucuuuaucuugaagcuauau

SEQ ID NO: 81347 - RNA, 64 nt, Human
aacauugagcaaaaaucauaaccacucaucuaauuucuaagaggcaccuccaucgagggccggu

SEQ ID NO: 81348 - RNA, 64 nt, Human
uuuucuucuacggugugcuacccuuucuaaacuguucuaagaagcaggcaguugauguauguuu

SEQ ID NO: 81349 - RNA, 64 nt, Human
uuuguuccacauuguauuuuugucuucaaauauuuucuaagagaaugaauuaucccccaaaaug

SEQ ID NO: 81350 - RNA, 64 nt, Human
uccugcagaaauauaacuguaaaaccacuuccauuucuaagacuaaauauaucaagacuauuua

SEQ ID NO: 81351 - RNA, 64 nt, Human
guguuuuauuguguguuuuuuuaauuuguaaguauucuaagaguuuccuaauacuaagguuaaa

SEQ ID NO: 81352 - RNA, 64 nt, Human
auugcauauggaagauaaguucauuuaucuuccuuucuaagacauauuuaauguagguuacaua

SEQ ID NO: 81353 - RNA, 64 nt, Human
cugugauuuugaccuccucuuccccacugccaucuucuaagagacuuuguagcugccuccuaga

SEQ ID NO: 81354 - RNA, 64 nt, Human
ugaacaaguuggaaaaaaacaauuuuuguuucaauucuaagaaacacuugcagcucuaguauuc

SEQ ID NO: 81355 - RNA, 64 nt, Human
cauguauucauuaauaucuaccagucccuuuucauucuaagacaaaacauuucuccuaaaucuc

SEQ ID NO: 81356 - RNA, 64 nt, Human
guauaaauuuaucuaggaaaaaaauccuucagaauucuaagaugaauuuaccaggugagaauga

SEQ ID NO: 81357 - RNA, 64 nt, Human
auauuuuagcacuuugguagcuuuuacacugaauuucuaagaaaauuguaaaauagucuucuuu

SEQ ID NO: 81358 - RNA, 64 nt, Human
guuuggaaaugcguggaauuaggauucaugugguuucuaagauuuggacaugucagaauuuugu

SEQ ID NO: 81359 - RNA, 64 nt, Human
guaauaacuaacauaacugaaagugcaaaugucauucuaagauucccauaucuuuugguuaggg

SEQ ID NO: 81360 - RNA, 64 nt, Human
uauguuuuguauuguugauaaauccuuuuuguccuucuaagauguccuauuguaaaaucacuua

SEQ ID NO: 81361 - RNA, 64 nt, Human
gccauagcauaauaugaagccuuuggugaauuccuucuaagauaaaaauaauaauaaaguguua

SEQ ID NO: 81362 - RNA, 64 nt, Human
aaaagucauugcauaucugaucaauaacuucagauucuaagaguggauuuuuuuuuuuuacaug

SEQ ID NO: 81363 - RNA, 64 nt, Human
ugaaauaucuuuaagacugaucuuaaaaacuaacuucuaagaugauuucaucuucucauaguau

SEQ ID NO: 81364 - RNA, 64 nt, Human
uagcgugguuacuuucuauaaugcuguacccagauucuaagaaccuggagaaggauuagcaguu

SEQ ID NO: 81365 - RNA, 64 nt, Human
ugcacauguaacagaugcagaacuguguuuguaauucuaagaaaauguaugucagaaaguauuu

SEQ ID NO: 81366 - RNA, 64 nt, Human
ugucaccaauuuuuuauaauagcagaguggccuguucuaagaaggccauauuuuuuaaguuauc

SEQ ID NO: 81367 - RNA, 64 nt, Human
agugcuaaauuuuaaaagcugaaacacaacagaauucuaagaaauauaguccaaacguugcaug

SEQ ID NO: 81368 - RNA, 64 nt, Human
uugaucacauguacuuaaaacaucugauacuguauucuaagacagguuguuuuugcaauuaaau

SEQ ID NO: 81369 - RNA, 64 nt, Human
agaaucaggcuagaauagcauuuuccaaagaauauucuaagagcuauuagcuccucuagauauu

SEQ ID NO: 81370 - RNA, 64 nt, Human
uacagucuaaagaauuaacucacccgguacuuuauucuaagaagggucuggcauccauaugagg

SEQ ID NO: 81371 - RNA, 64 nt, Human
uucagaaaaauccaggauccaaaauguggcguuuuucuaagaaugaaaauuauauguaagcuuu

SEQ ID NO: 81372 - RNA, 64 nt, Human
ccaauaaaaucuuacauuccaaauaaaguucuuuuucuaagaacauuacaugcccuuccuaaau

SEQ ID NO: 81373 - RNA, 64 nt, Human
aauguguuuuuuaaauggaacuaucuccaaauuuuucuaagacuacuaugaacaguuuucuuuu

SEQ ID NO: 81374 - RNA, 64 nt, Human
augaaauaacuguucucuuggaugguuaccuuauuucuaagaaacgccacugaggaacaggauc

SEQ ID NO: 81375 - RNA, 64 nt, Human
agagucauuugcuucagcaggauccuugugggccuucuaagaugaagccacccucagguccagg

SEQ ID NO: 81376 - RNA, 64 nt, Human
agaauggcuggccugcugugagcaggagaggagauucuaagaaggauaguccccccuacaacau

SEQ ID NO: 81377 - RNA, 64 nt, Human
ccuaaaagaguagucuuaacacauuacuaacuuuuucuaagagaaauugauuccuguuuuguca

SEQ ID NO: 81378 - RNA, 64 nt, Human
auggggugggaggggguuauaguucaugaggguuuucuaagaaauugcuaacaaagcacuuuug

SEQ ID NO: 81379 - RNA, 64 nt, Human
gaaauugcuuucacaaauuuguaccacaugguaauucuaagacuuguucuuuacccauggaaug

SEQ ID NO: 81380 - RNA, 64 nt, Human
caagcuaaucaaacauaagcuucauuaagugggauucuaagacagucuguguuuuuauauuuca

SEQ ID NO: 81381 - RNA, 64 nt, Human
ucagugugcuuuucccaaaugaugugugugguguuucuaagagaaacagggcccauaaccagug

SEQ ID NO: 81382 - RNA, 64 nt, Human
acuauguaauaauguacagaggaagcuguugguguucuaagacucuguguggcugugcaauuuc

SEQ ID NO: 81383 - RNA, 64 nt, Human
gaacaaagucaaguauaaauuuacagagaaaaaauucuaagacaguuggauguuguccuguugg

SEQ ID NO: 81384 - RNA, 64 nt, Human
ggguaggaggaugggcucgcccaccagugacuuuuucuaagagcucccggcgugguggaagagg

SEQ ID NO: 81385 - RNA, 64 nt, Human
aaaauuuaaggguauguuaacuaaaggauagcauuucuaagauauuuugaauauuagggucauu

SEQ ID NO: 81386 - RNA, 64 nt, Human
acaucaaacuugcuaagcggcggauacccccagcuucuaagaucccagcuucugcaguggaaau

SEQ ID NO: 81387 - RNA, 64 nt, Human
ucuagucuauucugaagauauuugauuaauauauuucuaagaagaccacuagucccaugaaguc

SEQ ID NO: 81388 - RNA, 64 nt, Human
aucaguuaagugccauuuaucaacugaauagaccuucuaagaagaaugcaguuuggccucuuuu

SEQ ID NO: 81389 - RNA, 64 nt, Human
aagucucccccuuugccaagccucggggacugguuucuaagacaaccgugggaaccacugugac

SEQ ID NO: 81390 - RNA, 64 nt, Human
uuuuuauagugugaagcaguauucuggaaaguuuuucuaagacuagugaagaacugaaggaguc

SEQ ID NO: 81391 - RNA, 64 nt, Human
aguaaauucucuugcauguuccauuauacgugucuucuaagagcuguucaauacaguauucacu

SEQ ID NO: 81392 - RNA, 64 nt, Human
gcucaugucugauucucuaaugcgaaaagccuuauucuaagacccaagguuuggaucugcuacc

SEQ ID NO: 81393 - RNA, 64 nt, Human
cacagcuuuaugauaucaaagacucauugcuuaauucuaagacuuuugaauuuucauuuuuuaa

SEQ ID NO: 81394 - RNA, 64 nt, Human
uaucugaauauaaacacaaucugauguuaauuuauucuaagaacaccaucauuuugauuguccu

SEQ ID NO: 81395 - RNA, 64 nt, Human
agugggaucuaccaauugauucuggcaaaacaauuucuaagauuuuuuugcuuuaugugggaaa

SEQ ID NO: 81396 - RNA, 64 nt, Human
auugguugugucuacugccaacauuuauauccaauucuaagauuucugaaaaaaaauucuuauc

SEQ ID NO: 81397 - RNA, 64 nt, Human
cauggcuguugcauaccaagacucuuggaaggacuucuaagauauauguugauugaucccuuuu

SEQ ID NO: 81398 - RNA, 64 nt, Human
ccauuuuguuuuuggaugauauuuauuaaauagcuucuaagaguccggcggcaucugucuuguc

SEQ ID NO: 81399 - RNA, 64 nt, Human
cguacguggaaacacaagagcccaccacuugaauuucuaagaccauuucauucugaaacuucuu

SEQ ID NO: 81400 - RNA, 64 nt, Human
auaucuaguuuaguucauugucaagacugcuauuuucuaagagacuucuaaagacgccacucaa

SEQ ID NO: 81401 - RNA, 64 nt, Human
ggauuuaggaauugcucuugucauacccccaaguuucuaagauuuaagauucuccuuacuacua

SEQ ID NO: 81402 - RNA, 64 nt, Human
uaagcuucuuucauguauucaaaucagcauuuuuuucuaagaaauugcuauagaauuuguggaa

SEQ ID NO: 81403 - RNA, 64 nt, Human
auggagaggcugagggacaggaucuauaggcagcuucuaagagcgaacuucacauaggaaggga

SEQ ID NO: 81404 - RNA, 64 nt, Human
cucuccaaucuagguucaguugaaggaauauuguuucuaagacuguuuugagacauguccagua

SEQ ID NO: 81405 - RNA, 64 nt, Human
uacugaauaggaaagggaaguuuuauuuggaaccuucuaagaggaaaucaaccaggaccaaaga

SEQ ID NO: 81406 - RNA, 64 nt, Human
guuucagugggcauuaacagaaugcuuuaaaaacuucuaagacaagaaucuauagcauuaguau

SEQ ID NO: 81407 - RNA, 64 nt, Human
guuaguuauuucuccaggggaaaaggcaauaauuuucuaagacccgugugaaugugaagaaaag

SEQ ID NO: 81408 - RNA, 64 nt, Human
ggaguacaggguccugugagcuguuugaccacuguucuaagacuaugugugcccaaaagcacau

SEQ ID NO: 81409 - RNA, 64 nt, Human
aaaggaugacuguaggccgugugcuggccuuucuuucuaagaagcugcuuugagcuccuggacu

SEQ ID NO: 81410 - RNA, 64 nt, Human
gugaaauucguuuucuuuuucauggugccuuucuuucuaagaaaagauagaaagaauggggcca

SEQ ID NO: 81411 - RNA, 64 nt, Human
cagccucuacaaugaaaugcagaagaguucauuuuucuaagaucuguuuuucauuagaaauauu

SEQ ID NO: 81412 - RNA, 64 nt, Human
gauaagauggaaagccaauaaaccugugauaaguuucuaagaauaugagaauauacguauauga

SEQ ID NO: 81413 - RNA, 64 nt, Human
uucuuuugcccccuuggaacacauuggucagcaguucuaagagacacugcccacaugauggcca

SEQ ID NO: 81414 - RNA, 64 nt, Human
gaaaauguuuaauaucaaucuauaaaucuugaauuucuaagaggcuuauuuuguucuuuuggcu

SEQ ID NO: 81415 - RNA, 64 nt, Human
caagcaucugagcaugaugauuuugcugugacaauucuaagaucaaccagguuacuuaaguccg

SEQ ID NO: 81416 - RNA, 64 nt, Human
agcccucagcugcugaccuugaggcagagacaacuucuaagaauuuggcugccagaccccaggc

SEQ ID NO: 81417 - RNA, 64 nt, Human
gcaugagccaccaugcccagccaauguaacugguuucuaagaguuuagccacaguagcuucuag

SEQ ID NO: 81418 - RNA, 64 nt, Human
aguguuuagacaugacaggaccuaucguugagguuucuaagacuuacuaugggcuguaaaccug

SEQ ID NO: 81419 - RNA, 64 nt, Human
cuggauuucuuuagacauugaagcaaacauuuuuuucuaagaauugcuucucagaugaugauau

SEQ ID NO: 81420 - RNA, 64 nt, Human
gcugaacguggcguguugagauuuggaaugagguuucuaagagccguguucuucauggaauuuu

SEQ ID NO: 81421 - RNA, 64 nt, Human
ccuuguaaauuuucuugauaaaugaggcaaacaguucuaagaucuuugauaaacaucugcucac

SEQ ID NO: 81422 - RNA, 64 nt, Human
ugaauaaauuaguuugucauucuagaauuuaaaguucuaagauuaguauaaagaguauauagau

SEQ ID NO: 81423 - RNA, 64 nt, Human
uaggaaauggaagcuuuuaauuuuaauuucuuuuuucuaagacagagucucacucugucgcgcc

SEQ ID NO: 81424 - RNA, 64 nt, Human
cacgcacaggaagccuuuccacauaucaccucauuucuaagaaauaaacuacaaggugccaaga

SEQ ID NO: 81425 - RNA, 64 nt, Human
ugcuuuccugauacucuuuggcgcugacuuggaauucuaagagccuuggacccgaguguguggc

SEQ ID NO: 81426 - RNA, 64 nt, Human
gaguuugccuuccuuucuccaggaccaauaaaauuucuaagagagcuacuaugagcacuguguu

SEQ ID NO: 81427 - RNA, 64 nt, Human
aagggaucaggaccagcaaccuuuauauucuagauucuaagacauuguacagagaaauucagaa

SEQ ID NO: 81428 - RNA, 64 nt, Human
uggcacaggaauuauuccuucuuguuccucuguauucuaagaauucauguggguguuucuuauc

SEQ ID NO: 81429 - RNA, 64 nt, Human
ccucagguuuccaucuguaaaaugagaguauugguucuaagauuucucaucuucucaucccuag

SEQ ID NO: 81430 - RNA, 64 nt, Human
ccuauccuguucuuuuaauugaaaguuuauaugcuucuaagagguagauaccagaauguugcuu

SEQ ID NO: 81431 - RNA, 64 nt, Human
aauauaauuuaacagaaguugugaaacuaaaauuuucuaagauuaacugguaguucauuguaaa

SEQ ID NO: 81432 - RNA, 64 nt, Human
uauaguuaauauuuguuugagcuugugaccugacuucuaagagcuacuucuaacacagccuuag

SEQ ID NO: 81433 - RNA, 64 nt, Human
uaauucaaaaaguacauauuccauguugauuuaauucuaagaugaaccaauaaagacauaauuc

SEQ ID NO: 81434 - RNA, 64 nt, Human
uagcccacaagaaucaugcacuuuuuaaaauuauuucuaagaagccauaacaaagcuguguacu

SEQ ID NO: 81435 - RNA, 64 nt, Human
ugaaaaaggacaagaucaauucuuuucuagucaguucuaagacugcuagagagagauaccaggc

SEQ ID NO: 81436 - RNA, 64 nt, Human
acucaaacuccucccuuuuaucuucuagccacaguucuaagacccaaagugggggguggacaca

SEQ ID NO: 81437 - RNA, 64 nt, Human
uauuuugauguagauacguuagcagauggagagguucuaagagauuggauacuuuggaaugucu

SEQ ID NO: 81438 - RNA, 64 nt, Human
ugaagcaggacucuaaagaaggaaugagugcaauuucuaagacuuugaaacucagcggaaucaa

SEQ ID NO: 81439 - RNA, 64 nt, Human
uuuaggggaauuauuugcgggcuuuccuaguguauucuaagaaguucuaacucuccaucaagaa

SEQ ID NO: 81440 - RNA, 64 nt, Human
uacaccugucuacaccauguacugagcuaaccacuucuaagaaacuccaaaaaaggaaacaugu

SEQ ID NO: 81441 - RNA, 64 nt, Human
cccaccacacaggagugaggccaggggcuaggaguucuaagaacagaggcuggggugagggugg

SEQ ID NO: 81442 - RNA, 64 nt, Human
guuaacuaaagagcacuuuauuucuuugaagccuuucuaagaaagaaaugggggugcgaguggc

SEQ ID NO: 81443 - RNA, 64 nt, Human
accauuucaggaaugaaaaagaaggaauacuacuuucuaagaaagaagaucuuauaauagacau

SEQ ID NO: 81444 - RNA, 64 nt, Human
uugacuacaagaggaaauucuacaggauuaggauuucuaagacuacuauaggaauugguuggca

SEQ ID NO: 81445 - RNA, 64 nt, Human
cccacacccacggcugcauaccugcacuuucaguuucuaagagggacugaggccucuucucagc

SEQ ID NO: 81446 - RNA, 64 nt, Human
ucucaaggaaguuccugaaaagauuuucuuccauuucuaagacuguuauuuacaauaggaaaau

SEQ ID NO: 81447 - RNA, 64 nt, Human
uagugggaggagaacggucagaaucaaagugacauucuaagaaaaacuguaccuuagagauuuu

SEQ ID NO: 81448 - RNA, 64 nt, Human
uuuuuacagaagcaggagcaaaauauggccuuucuucuaagagauauaauguucacuaaugugg

SEQ ID NO: 81449 - RNA, 64 nt, Human
cucccaauuguucugaaaguuuuuuuaccuucucuucuaagagaauauucuucuucacuucuuc

SEQ ID NO: 81450 - RNA, 64 nt, Human
aacuugagugcucuggauaacuauauggaaugcuuucuaagaacagcugaagcuaaucuaauuu

SEQ ID NO: 81451 - RNA, 64 nt, Human
gggccaauuuuaaucauaagccuuaauaagauuuuucuaagaaaugugaaauagaacaauuuuc

SEQ ID NO: 81452 - RNA, 64 nt, Human
cuaaaaaaaauaaugacauuggguaucuauuucuuucuaagacuacauuaguaggaaaauaagu

SEQ ID NO: 81453 - RNA, 64 nt, Human
accucacuugagugggguuuuccuuuucccccaauucuaagagaauauaauguguauacuaaaa

SEQ ID NO: 81454 - RNA, 64 nt, Human
cggccccacuagagccuuccagccuucugguguguucuaagagcaggcuccaccugggagccag

SEQ ID NO: 81455 - RNA, 64 nt, Human
uguauaagacccuguguucaggacugggugacuuuucuaagaaauaugggguuuagaauggggu

SEQ ID NO: 81456 - RNA, 64 nt, Human
ugaccaucaugggaagugucugcuggauuccauuuucuaagaguuucugagggugaggcucuua

SEQ ID NO: 81457 - RNA, 64 nt, Human
uagaauauuaugcauauguuuaaagaaucauauuuucuaagauuauuuggaagcauguuuggua

SEQ ID NO: 81458 - RNA, 64 nt, Human
cgcucucuccuguccauuugaccucuucuuuuccuucuaagaaagaacuaagcuuugggcauuu

SEQ ID NO: 81459 - RNA, 64 nt, Human
aagaaauauauauauauauuauauauauucuuaguucuaagauuuccuuuaauucuaugauucu

SEQ ID NO: 81460 - RNA, 64 nt, Human
uuaaguucacaaccuagggcaaguuacucugccuuucuaagacucacuuacaucuucugugaaa

SEQ ID NO: 81461 - RNA, 64 nt, Human
auuaauugauaaucauaccuaaagcacauugaacuucuaagagacaggugcuacguaagcacac

SEQ ID NO: 81462 - RNA, 64 nt, Human
gaaaggauuacaccagaagauuuaggaugccuccuucuaagaacuggaaguucucauuccccau

SEQ ID NO: 81463 - RNA, 64 nt, Human
acccucucacaguucggacuuuucuccccucucuuucuaagagaccugaacugggcagacugca

SEQ ID NO: 81464 - RNA, 64 nt, Human
gaaaggauuagaccagaggauuuaggaugccuccuucuaagaaccagaaguucucauuccccau

SEQ ID NO: 81465 - RNA, 64 nt, Human
ugucaggaggaauacaguuccuguucauccuguguucuaagaucuccauugaacagcacugauu

SEQ ID NO: 81466 - RNA, 64 nt, Human
agcaauuuuucaacugggcauugaauucuaacuuuucuaagauagcaauuuuugaagagacacg

SEQ ID NO: 81467 - RNA, 64 nt, Human
uaugauuauuuauuaguuuuuuuuuaaaugcuuguucuaagacauuucugaauguagaccauuu

SEQ ID NO: 81468 - RNA, 64 nt, Human
uugguccaaauaauauuuuauuuguauggguaucuucuaagacuaaauagguaguuguguucuu

SEQ ID NO: 81469 - RNA, 64 nt, Human
agccagcucucuguacauuugcuagcuuguaguuuucuaagacugaguaaacuucuuauuuuua

SEQ ID NO: 81470 - RNA, 64 nt, Human
gauauccuuaaaugauguuucaauuuuauauguuuucuaagauaauuggaucagguuuucuuug

SEQ ID NO: 81471 - RNA, 64 nt, Human
uuaacguguuuucugucauaguuagaugugauaauucuaagagugucuaugacuuauuuccuuc

SEQ ID NO: 81472 - RNA, 64 nt, Human
caauguuauuuauuugauuguguggucgauguuuuucuaagacaugaaauuuaaguuuuguuuu

SEQ ID NO: 81473 - RNA, 64 nt, Human
accggaaauaugcugccaaaaagaaaaucagcuuuucuaagaucaagccagaguugcuucucuu

SEQ ID NO: 81474 - RNA, 64 nt, Human
acucuauauauaaaguucgacuuaaucauggcuguucuaagaaguacuuauggagagcaagaac

SEQ ID NO: 81475 - RNA, 64 nt, Human
uaguggcuuucauuaaauacuugcuguaaagucuuucuaagaccaauuauuaucuuagcauguu

SEQ ID NO: 81476 - RNA, 64 nt, Human
cuuuuuuuaacaaaugccuucuuauagaaaaacuuucuaagaggcaacaauuuagaauggauau

SEQ ID NO: 81477 - RNA, 64 nt, Human
ucaccaagaagguuuacuuaauuaaauaccgcauuucuaagagaagauacuuuguguaagaaaa

SEQ ID NO: 81478 - RNA, 64 nt, Human
uacugaacaaaugucauucuaguuuagauagcauuucuaagauaacugauacuaauacuuguuu

SEQ ID NO: 81479 - RNA, 64 nt, Human
uugauaauuccauuacuguguauuuuucacuuguuucuaagaucaaacauuuuaauaugugcau

SEQ ID NO: 81480 - RNA, 64 nt, Human
ugccguuaguaucugagauguacuuacagcaggguucuaagagcucugaaagaagcgcucuguu

SEQ ID NO: 81481 - RNA, 64 nt, Human
guauuuagaaaaaauaaauuauagcaaguaugauuucuaagaauguuuuucuauaaauuacuaa

SEQ ID NO: 81482 - RNA, 64 nt, Human
uuuaggguuuggggcuaguguguuuguguuuccauucuaagauugagucuggcagucccuguuu

SEQ ID NO: 81483 - RNA, 64 nt, Human
gugauauuuaauguuaaagugccaugaaaaauauuucuaagaaagccuuaaauucccaguggau

SEQ ID NO: 81484 - RNA, 64 nt, Human
uccuugugcauugccuaauuugcuauuuaaaggcuucuaagaagcguauaccuaacuguaaaua

SEQ ID NO: 81485 - RNA, 64 nt, Human
auugaacauuuucaauuauaugcagacugacugauucuaagauaaauucuaaggagguuucuaa

SEQ ID NO: 81486 - RNA, 64 nt, Human
auuccaucauuuuccccuuuugacguaucaguacuucuaagaagggaucuaagcacaauuaagu

SEQ ID NO: 81487 - RNA, 64 nt, Human
ugaaaugacauuucacuaaaagucuccaaaacauuucuaagacuacuaaggccuuuuauguaau

SEQ ID NO: 81488 - RNA, 64 nt, Human
ggugcagauaaaaugucaaaugaacaaaccaguguucuaagaguguuacuaacauuuuguucua

SEQ ID NO: 81489 - RNA, 64 nt, Human
ugaaauuuacaaaucaaaaucuuaaucauuauccuucuaagaggauacaaauuuagugcucuua

SEQ ID NO: 81490 - RNA, 64 nt, Human
uuuuuggcuauguuuuaguuuguguguauaaaaguucuaagaaaacauuuuugcuauuuuaagu

SEQ ID NO: 81491 - RNA, 64 nt, Human
accgacuugauagggauguuuuuguaaguuaauuuucuaagacuuuuucacauccaaagugaug

SEQ ID NO: 81492 - RNA, 64 nt, Human
aaggacaugaugucaagaaguaucugcuugaccuuucuaagaaaaagggauucuuaucuuacuc

SEQ ID NO: 81493 - RNA, 63 nt, Human
cuucagcuacccuaggcugagauugcacucgccuucuaagaaccucaauaaagagacucuggg

SEQ ID NO: 81494 - RNA, 64 nt, Human
uguguuucuuauuccuucuauaccucaaaucugauucuaagaauuucuuacugugauaaucauu

SEQ ID NO: 81495 - RNA, 64 nt, Human
cuuucucuuaaaaguuucauuuggggagcuggucuucuaagaaacggauaaagccacauaauua

SEQ ID NO: 81496 - RNA, 64 nt, Human
aaaggaccaauuauuuauaguuucccaacaaaaguucuaagauuuuuuaccucugcaucagugc

SEQ ID NO: 81497 - RNA, 64 nt, Human
uaaugaugaaaucuuucuuucuucccguguguauuucuaagaaauagagccaacugauuuugua

SEQ ID NO: 81498 - RNA, 64 nt, Human
uccaaauuguaaaauaauggccugaauuuaaguuuucuaagauaaacucagugguuugguuuuu

SEQ ID NO: 81499 - RNA, 64 nt, Human
ugucacuuguuaacgagacugauauucaacaggcuucuaagaauauguaucuucauaaacugau

SEQ ID NO: 81500 - RNA, 64 nt, Human
acaggaugaccccuugauauuugcacagggauauuucuaagaaacgcagaggccagcguuccug

SEQ ID NO: 81501 - RNA, 64 nt, Human
agccggaaugggaaucgcugaggcucugauccacuucuaagacaggaaggaaagugaaggcaga

SEQ ID NO: 81502 - RNA, 64 nt, Human
caacagcaaguugauuucuugugaucccagaauuuucuaagaggaugaguugaaucuauagcag

SEQ ID NO: 81503 - RNA, 64 nt, Human
ggcagccgagaacagggagauaaacaucaucaucuucuaagagcugaucaagaaauuuaaaaca

SEQ ID NO: 81504 - RNA, 64 nt, Human
gcucagcaucugucagagcaagagaccagguaauuucuaagaacaggguucuagcgaugggacu

SEQ ID NO: 81505 - RNA, 64 nt, Human
uuaugauuugaugaguuucuuguaagguuaccguuucuaagaguugugcuuuauggccacugag

SEQ ID NO: 81506 - RNA, 64 nt, Human
acacucccaaagaaucauuuaaaaguaaagugacuucuaagagacaaggaaguaggaacauuuc

SEQ ID NO: 81507 - RNA, 64 nt, Human
agccauuuuacugguuuggcaugcgguauggaaauucuaagagagaaaguuuuaaggcaaugaa

SEQ ID NO: 81508 - RNA, 64 nt, Human
aggaaucaacagggcagcagaucuguauauuuuuuucuaagagaaaauguaaauaaaggauuuc

SEQ ID NO: 81509 - RNA, 64 nt, Human
aucugcuuuuagcaagaaaucacauaacuuuuauuucuaagagacaguuguuaggcaguuguug

SEQ ID NO: 81510 - RNA, 64 nt, Human
aucuguaaguuauuuuugaauuuucugaacuuuuuucuaagagauuacauaggagacuaaagaa

SEQ ID NO: 81511 - RNA, 64 nt, Human
ugaacaucaaauauguauugauuagauccaguccuucuaagaaaccuccuuuccuuuaacaaaa

SEQ ID NO: 81512 - RNA, 64 nt, Human
cugugagcauguaaaagcggaaaguuagugcuuguucuaagauuaccuucuuguugauaaacca

SEQ ID NO: 81513 - RNA, 64 nt, Human
agccgccacccaugaaagcauuucugaagccccuuucuaagacaaggcucagcaucuugauauu

SEQ ID NO: 81514 - RNA, 64 nt, Human
gguuuucuggcuagaaagcucauccguuuccgguuucuaagagucaguucaguggcagagccac

SEQ ID NO: 81515 - RNA, 64 nt, Human
auaauaauugguguugagaacaucaguugccuuauucuaagauuucauaaggcugaguuugcac

SEQ ID NO: 81516 - RNA, 64 nt, Human
aagacauucuuuuguaccuuguucaacuuuagaguucuaagaaagcuuauuuauuagcgauaua

SEQ ID NO: 81517 - RNA, 64 nt, Human
ugauuuauuaauauauauuaucuuuucauacauuuucuaagaaacauuuauauugauaagaucu

SEQ ID NO: 81518 - RNA, 64 nt, Human
agggcaauggcccugccacccuggaggccaccucuucuaagagucccaucugcuaugcccagcc

SEQ ID NO: 81519 - RNA, 64 nt, Human
accauuccauuucauuuuggugaaaugugucuguuucuaagaaauucuguuuucuuaguucucu

SEQ ID NO: 81520 - RNA, 64 nt, Human
uuggaaacuuuaaaauaaaugguuaacauggcauuucuaagaaggcauuuaauccaguaucucu

SEQ ID NO: 81521 - RNA, 64 nt, Human
guucccaaggaagcuccuuccuguuuguuuuguuuucuaagauguucauuuuuaaagccuggcu

SEQ ID NO: 81522 - RNA, 64 nt, Human
cagccagucuugaaggucucuuucaguaucaacauucuaagaugcugggacuuacugugucauc

SEQ ID NO: 81523 - RNA, 64 nt, Human
uuaaaauaugaugucgauauuacuagucuugaguuucuaagaggguucuuuauguuauaccagg

SEQ ID NO: 81524 - RNA, 64 nt, Human
gcuggucugcugggcagggcuuacauccacugaguucuaagauuccuuuccugaucugcaccua

SEQ ID NO: 81525 - RNA, 64 nt, Human
uggcuuuuuuuuuuuuuuugguuaaguuuguuuuuucuaagagauuugcaaugcaaggucuccu

SEQ ID NO: 81526 - RNA, 64 nt, Human
gugugacucauucugacauuucagauccuaagaauucuaagaacacuacuagaagcauuuguuc

SEQ ID NO: 81527 - RNA, 64 nt, Human
augcuuucuuguaguagaauaagaaucguguaaauucuaagagauuuuagcagguuuucuuucc

SEQ ID NO: 81528 - RNA, 64 nt, Human
ucugagucugaaucucccaaagagagaaaccaauuucuaagaggacuggauugcagaagacucg

SEQ ID NO: 81529 - RNA, 64 nt, Human
agagagaauggaagcucaucacccaacauucagcuucuaagaaguaggcuggacuuuccacauu

SEQ ID NO: 81530 - RNA, 64 nt, Human
gggaaacuaauuucaauuuauuaguuuuucauuauucuaagacuucuuccuuuguauaaacuua

SEQ ID NO: 81531 - RNA, 64 nt, Human
uagcccuacuuucagacuuugcuauucguuuuuguucuaagaugcauggaacuaaaauguggaa

SEQ ID NO: 81532 - RNA, 64 nt, Human
ggcauuuauuuugauaaguuuauagccaucauguuucuaagagacuuggagacaccagcaaacu

SEQ ID NO: 81533 - RNA, 64 nt, Human
gauucaaggacuccaggacaccucuuaagagccuuucuaagaacaugauaggcuuacuucugcu

SEQ ID NO: 81534 - RNA, 64 nt, Human
gcuuucuuuuccuuuuguagauucccaguuuauuuucuaagacugcaaagaucacuuugucacc

SEQ ID NO: 81535 - RNA, 64 nt, Human
accucugucuuuaaaaaucuauuuuuagguaauguucuaagaauuccauuugccucuaugaucu

SEQ ID NO: 81536 - RNA, 64 nt, Human
gcguguauguagucaccauuccagaaccucucuuuucuaagaugcacaacacuuaucaaagaua

SEQ ID NO: 81537 - RNA, 64 nt, Human
uacacagaaaccggcaccugccagacagagcugguucuaagauuuaauacagugcuuuuuuucc

SEQ ID NO: 81538 - RNA, 64 nt, Human
uugaaauuacauuauuuaauuacagacuuccucuuucuaagauuuugugaauugguugaauagu

SEQ ID NO: 81539 - RNA, 64 nt, Human
ccugagaaccgaauggccaugcuuucuaucacauuucuaagaugaguaauauuuuuuccaguag

SEQ ID NO: 81540 - RNA, 64 nt, Human
cuggacguugugagaauugugcuuucaccagaauuucuaagaauuucugcuaaauaucaccuag

SEQ ID NO: 81541 - RNA, 64 nt, Human
ugacaaagugagcucuaagaaaaugugaggcuacuucuaagauguguguucacaauagaccaua

SEQ ID NO: 81542 - RNA, 64 nt, Human
caugagccaccacaccuggcaaggguaccugacauucuaagauaucaagacacuuaauaugugg

SEQ ID NO: 81543 - RNA, 64 nt, Human
acaauggacaauucugcuuauucucucaaagagauucuaagaugcaccuuuagaacuauuaaua

SEQ ID NO: 81544 - RNA, 64 nt, Human
uuuggagcagccacggcccacaaucaccccccuuuucuaagacugccugauccgaaauaaagua

SEQ ID NO: 81545 - RNA, 64 nt, Human
agugucacacaggcacuuuguacacauccugguuuucuaagaagggaacuugccaucaagauuc

SEQ ID NO: 81546 - RNA, 64 nt, Human
gccuugcuuugucuggccucacgugucucagauuuucuaagaaccaaaaaaaaaaaaggaaaaa

SEQ ID NO: 81547 - RNA, 64 nt, Human
uuuugauaaagccucaagguuuuagguucuaaaguucuaagauucugauuuuaggagcuaaggc

SEQ ID NO: 81548 - RNA, 64 nt, Human
agaucauaaggcuucaaaauguuaucuucucaaguucuaagauucuaaugaugaucaauuauag

SEQ ID NO: 81549 - RNA, 64 nt, Human
aagagucuaaagauggaguuucuaagguccgguguucuaagaugugauauucuaagacuuacuc

SEQ ID NO: 81550 - RNA, 64 nt, Human
gaguuucuaagguccgguguucuaagaugugauauucuaagacuuacucuaagaucuuagauuc

SEQ ID NO: 81551 - RNA, 64 nt, Human
cauuucuaaaaucuuauaguucuaggcacuguaguucuaagacucaaauguucuaaguuucuaa

SEQ ID NO: 81552 - RNA, 64 nt, Human
ggcacuguaguucuaagacucaaauguucuaaguuucuaagauucuaaagguccacaggucuag

SEQ ID NO: 81553 - RNA, 64 nt, Human
ucacccccucugcccucccaacuuggguuguacuuucuaagaaggugauucccccugcccuugc

SEQ ID NO: 81554 - RNA, 64 nt, Human
ucugccgccagcccuagccaguaagaggugggauuucuaagaccgacuguaugagcucgccucu

SEQ ID NO: 81555 - RNA, 64 nt, Human
ccuucccugccucuagagccacuguucucacuacuucuaagaaaucagcuuuuuaagcuucccc

SEQ ID NO: 81556 - RNA, 64 nt, Human
gggucuagucaguaaaauucugcaacucuaggaauucuaagaucccauuggaaggaaugcucua

SEQ ID NO: 81557 - RNA, 64 nt, Human
ccguggguuugauuguauuacucuguuccacugguucuaagacgcagagcuucucacaucucaa

SEQ ID NO: 81558 - RNA, 64 nt, Human
aggcaaccugaguccaguggaaugcaggugcaacuucuaagaguuuuccuguaaguaauuaaga

SEQ ID NO: 81559 - RNA, 64 nt, Human
agccauugugccugaccuaguucugcuuuuuauguucuaagaaguauuauuuauucuaugcuga

SEQ ID NO: 81560 - RNA, 64 nt, Human
cgcaaaggcccugaggcugaaaugugcccauguguucuaagaaaugcagcgaugcuggugugcc

SEQ ID NO: 81561 - RNA, 64 nt, Human
aguguccucgggucagacugugggaaugcuguacuucuaagacaaagguucgcaucuuacaguu

SEQ ID NO: 81562 - RNA, 64 nt, Human
ggugcguggguuccucaagguggggauuucugaguucuaagaccaagucuccaucugagacucc

SEQ ID NO: 81563 - RNA, 64 nt, Human
gggaacuucuuggaacuuuaacuccugccagcccuucuaagacccacgagcggggugagagaag

SEQ ID NO: 81564 - RNA, 64 nt, Human
gaugucaccguagcuugcuuucuauucaacaucuuucuaagauuaccuuacuauuucuuuuguu

SEQ ID NO: 81565 - RNA, 64 nt, Human
gagcaauaagaugauuauuuuugcuugaaucuuuuucuaagagaaggaaaagagcuggcauugu

SEQ ID NO: 81566 - RNA, 64 nt, Human
aauuuauuaaacuugcugugaaaacacuuugauuuucuaagaggaagguacuuuaaguuccaga

SEQ ID NO: 81567 - RNA, 64 nt, Human
cugaccaagggugguuaagugacacauagaacuuuucuaagagaagacagacaaguugacaggc

SEQ ID NO: 81568 - RNA, 64 nt, Human
uuugaguguggcaauauuuuaauuguguauagauuucuaagaaccaacacuacucagucuccug

SEQ ID NO: 81569 - RNA, 64 nt, Human
uaaccuagagauuguuacagaagcugaaauugcguucuaagaggugaagugauuuuuuuucuga

SEQ ID NO: 81570 - RNA, 64 nt, Human
aggcauuugcucaugguuacaggcaucuuuuagauucuaagagugaguuacagaauucuuuuug

SEQ ID NO: 81571 - RNA, 64 nt, Human
guuuuauauagagaaacuugaguaauuuuuacauuucuaagacauuaaaucccauuuaaauucu

SEQ ID NO: 81572 - RNA, 64 nt, Human
aauuuucugucucguugucuguccagauaauugauucuaagacauguuagguauauaaggagug

SEQ ID NO: 81573 - RNA, 64 nt, Human
uggggguaagggggaccagagaggcgggcugguguucuaagagcccccgugcaaaucggagacc

SEQ ID NO: 81574 - RNA, 64 nt, Human
ucaagaaaauaaaacuaagcucuuugagaacugcuucuaagaugccagcauauacugaagucuu

SEQ ID NO: 81575 - RNA, 64 nt, Human
aauguucagagggcugacauauaugaauacuggcuucuaagacccucccccaacagucugaccu

SEQ ID NO: 81576 - RNA, 64 nt, Human
aacucaugggauuuguaaccagaugaaucaugauuucuaagacuucugaucaaaaauacuguga

SEQ ID NO: 81577 - RNA, 64 nt, Human
uuuauuuuuauugcuuuguauuuuugugguuaccuucuaagacaagugauugaucuaaaguucc

SEQ ID NO: 81578 - RNA, 64 nt, Human
auaugugaaagagucauauuuuccaaguuauauuuucuaagaagaagaauagaucauaaaucug

SEQ ID NO: 81579 - RNA, 64 nt, Human
ugccuauuuuaacauuaacuucuaaagaaguuuuuucuaagaaaauguuucaaggcaauauuuu

SEQ ID NO: 81580 - RNA, 64 nt, Human
cucauaauucaaauuguauaaaauaaagcuacauuucuaagagcuugguguagggcaauuggaa

SEQ ID NO: 81581 - RNA, 64 nt, Human
cugcccugggcaccuggcaccacaagaccauguuuucuaagaaccauuuuguucacugauacaa

SEQ ID NO: 81582 - RNA, 64 nt, Human
gauauugauuuaaaauuguucuacuugaagugguuucuaagauuuuuauauuaaaaauaggugu

SEQ ID NO: 81583 - RNA, 64 nt, Human
cauuuuccauuuccguuccuggaucuacggagucuucuaagagauuuugcaaugaggagaagca

SEQ ID NO: 81584 - RNA, 64 nt, Human
gcucccuacuccccaccacggcagagaauaggcuuucuaagaugcugcgaucccguucugcugc

SEQ ID NO: 81585 - RNA, 64 nt, Human
uaaaguuagucaguuuuucuucucuucuuugacauucuaagaacuuauagauaacuuaaaacuu

SEQ ID NO: 81586 - RNA, 64 nt, Human
gcauauuauuccauaucuuuguuuuaaccaguacuucuaagagcauagaacucaaaugcugggg

SEQ ID NO: 81587 - RNA, 64 nt, Human
uaugggaauuauacuguggggccuugugagcugcuucuaagaggcuaaccuggaaacuaagcuc

SEQ ID NO: 81588 - RNA, 64 nt, Human
cgcgacaccguaggacuugacuuuuguuuagucuuucuaagaaauagaucauggagccaaguga

SEQ ID NO: 81589 - RNA, 64 nt, Human
uaagcuacacuuuuauauuaguuuauauuuguuauucuaagacuuguguuucaucaauaaaguu

SEQ ID NO: 81590 - RNA, 64 nt, Human
uauccuugccaagugaucaugagugucauuuuuguucuaagacuaauauuuuuagaucuuuuua

SEQ ID NO: 81591 - RNA, 64 nt, Human
guaaaacuguaaaaaauuauauuuuuguuguacuuucuaagagaaagaguauuguuauguucuc

SEQ ID NO: 81592 - RNA, 64 nt, Human
ggccaucugcuuaguagagcuuuuugcauguaucuucuaagaauuuuaucuguuuuguacuuua

SEQ ID NO: 81593 - RNA, 64 nt, Human
guuccauguuugguuuuaugugcagcaccuugacuucuaagaaaugaaucaugucccuuugccc

SEQ ID NO: 81594 - RNA, 64 nt, Human
uuacuuaguaauaucuguuaaauuaagcauuaucuucuaagaccuuuuuuggauagucaaauau

SEQ ID NO: 81595 - RNA, 64 nt, Human
acgcauacacacauauaauggaagcaauaagccauucuaagagcuuguaugguuauggaggucu

SEQ ID NO: 81596 - RNA, 64 nt, Human
aguccauauuauugugaaucauuuccaugaaaauuucuaagaaaacuccaaacucucuaaauag

SEQ ID NO: 81597 - RNA, 64 nt, Human
uggauuuaucacauugaguuaugaaauuaccugguucuaagaauuuuugaguggcaaaaauaga

SEQ ID NO: 81598 - RNA, 64 nt, Human
gucagcuuugccuuaaugaguauuugcuuuaaauuucuaagaauuuauaucauaacuagagacc

SEQ ID NO: 81599 - RNA, 64 nt, Human
caugaaugcaauuuguuaaagcagacugauuuguuucuaagauauuuuugguuuuuuuaaaacu

SEQ ID NO: 81600 - RNA, 64 nt, Human
uugauaguuuuaauuaucauugcuaucaaauaauuucuaagauaaaagccugaauuugaaauau

SEQ ID NO: 81601 - RNA, 64 nt, Human
ugauugguuaaaaaauuuuaacaggucuuuagcguucuaagauaugcaaaugauaucucuaguu

SEQ ID NO: 81602 - RNA, 64 nt, Human
cuaucugauuuuucccagcaaaugaggcaggcaauucuaagaucuuccacaaaacaucuagcca

SEQ ID NO: 81603 - RNA, 64 nt, Human
uuuauuuacauauuuauucauguucaugguacucuucuaagacaaaaucagauugauaacuaug

SEQ ID NO: 81604 - RNA, 64 nt, Human
cacucuguuuucugcugugccuuuggaagcuuucuucuaagaugguuuucacagguacaugugg

SEQ ID NO: 81605 - RNA, 64 nt, Human
uuuggggaauuguaaugauguuggugcugcuuccuucuaagagcucagacaaguaaaguaugaa

SEQ ID NO: 81606 - RNA, 64 nt, Human
agagugguuuccaugccugcugggaauaggcugagcaugcaaugacaugagggccaaggcuugu

SEQ ID NO: 81607 - RNA, 64 nt, Human
uucuuggaaccuaaauugaacugccaaguacugcgcaugcaagagacccuuuauuggccuuaca

SEQ ID NO: 81608 - RNA, 64 nt, Human
aauuagguuacucuguucacaaugcucauuguuagcaugcaauugguauuugacuuggaagugu

SEQ ID NO: 81609 - RNA, 64 nt, Human
agaauuaccuaauaauccagaucacugagguacagcaugcaauugaccagcuuaagagaaaacu

SEQ ID NO: 81610 - RNA, 64 nt, Human
aaaaaauuaaaucacauuuagugcuguauaauuugcaugcaauaaaauucaauaaaauuaaaug

SEQ ID NO: 81611 - RNA, 64 nt, Human
uuuucuuggaugauugcaguuauuucaaaaauuugcaugcaaaauauacacucauccuacuuca

SEQ ID NO: 81612 - RNA, 64 nt, Human
aauuuauaggaagaagguuuuugcucaguaccuggcaugcaacagacauuggauaaauguuagu

SEQ ID NO: 81613 - RNA, 64 nt, Human
guggggcugugggaaacacauuuccacguugcaagcaugcaacuccaaagaaucugugaugcca

SEQ ID NO: 81614 - RNA, 64 nt, Human
uuuuuuuuuuguagagauggaguuucaccauguuggccaggauggucucgaucucuuaaccuug

SEQ ID NO: 81615 - RNA, 64 nt, Human
ugaugcuaaaauaaugugccucggccacaaaaaagcaugcaaagucauuguuacaacaggugag

SEQ ID NO: 81616 - RNA, 64 nt, Human
ccuuagcuggaccugcguugccgucuaugcaaaugcaugcaaauacuccaggcccugggaugug

SEQ ID NO: 81617 - RNA, 64 nt, Human
gccagaucaaugcuacaaucaugaaguucucauugcaugcaauuguguaggauugacaaggaac

SEQ ID NO: 81618 - RNA, 64 nt, Human
aagccaaaggguuauagggguacacuuagggguugcaugcaagcuguuaccaaaaaauuuuuaa

SEQ ID NO: 81619 - RNA, 64 nt, Human
gcagucugcuucagugcagugaaggaaccguggagcaugcaacacaucccggcacuguuuucgg

SEQ ID NO: 81620 - RNA, 64 nt, Human
cccuuuugauuucuuuuuuuuccucuguuuuuuagcaugcaaguauguugguacguuauguccu

SEQ ID NO: 81621 - RNA, 64 nt, Human
aaauaaacuuaacucuacaaaagcaaacucuaaugcaugcaagaaucauuagguuggcagguau

SEQ ID NO: 81622 - RNA, 64 nt, Human
uggugucuuuccaggcucuugauagggugucacugcaugcaagccaugaaucuguuuugagaau

SEQ ID NO: 81623 - RNA, 64 nt, Human
ggaaguuauuaacgggcauguauuaucacaucaagcaugcaauaaugugcaaauuuugcauuua

SEQ ID NO: 81624 - RNA, 64 nt, Human
guugguuggcugguuugaacgauagaaauaugcagcaugcaauauaugcuuauauuucauuuua

SEQ ID NO: 81625 - RNA, 64 nt, Human
aaaacagguuuguauguagcaccuuucaugcaaggcaugcaaaaagccuauuuuaaaaucacug

SEQ ID NO: 81626 - RNA, 64 nt, Human
cucauaaggaggcagccaucauaaccauugaauagcaugcaaggguaagaaugaguuuuuaacu

SEQ ID NO: 81627 - RNA, 64 nt, Human
uugauuuuguuguaaauuuuuaguuuuaaugaaagcaugcaacagggaucucacacccauguua

SEQ ID NO: 81628 - RNA, 64 nt, Human; identical to SEQ ID NO: 81622

SEQ ID NO: 81629 - RNA, 64 nt, Human
cccagccucucccagcacaaguggggcaaagccagcaugcaagcagaccccaccaccacagccc

SEQ ID NO: 81630 - RNA, 64 nt, Human
ccuguuuuauugcuuucuacccugugcaauauuagcaugcaagcuuggcuuacauagucauacu

SEQ ID NO: 81631 - RNA, 64 nt, Human
ccuguuuauaugcguacagccugguaacccccaggcaugcaaauauacaaucuguaacaacaca

SEQ ID NO: 81632 - RNA, 64 nt, Human
agaucuuucagaaauauaacacauuuuuuugcaugcaugcaaaugagcucugaaaucuucccau

SEQ ID NO: 81633 - RNA, 64 nt, Human
auucaucuguuguauuuagagaaccauauucauugcaugcaaauuuuauuguuaguguucuuaa

SEQ ID NO: 81634 - RNA, 64 nt, Human
guacgagagcgugguuguggugcuguaugugaacgcaugcaagcuugauucaccuucagggggc

SEQ ID NO: 81635 - RNA, 64 nt, Human
cuggcuacuaacuaacugggagaccuuaggcaaagcaugcaaucgcucugaauggcaguuuccu

SEQ ID NO: 81636 - RNA, 64 nt, Human
uuauuaaagaugcuauggaacauaaaguuguauugcaugcaauuugaaguaacuuauuugacua

SEQ ID NO: 81637 - RNA, 64 nt, Human
ccuuucuaguuuuccuuacaggacgugauaggcugcaugcaagaggcauacagaaaauggaaau

SEQ ID NO: 81638 - RNA, 64 nt, Human
uuaucaaagauuggccauguuccacuuggaaauggcaugcaaaagcaaucauagagaaaccugc

SEQ ID NO: 81639 - RNA, 64 nt, Human
ccaacauguuuauaucuugacuugacuuuuuuaugcaugcaaaucauuguuuuuacagaguuug

SEQ ID NO: 81640 - RNA, 60 nt, Human
uucaucagcagcaagauuaagucucugggggcaugcaaaugcaaauggucaauucagaag

SEQ ID NO: 81641 - RNA, 64 nt, Human
caccaugaucuucaucacagucuuugauaugucugcaugcaaaguggaacagaguugggcggca

SEQ ID NO: 81642 - RNA, 64 nt, Human
caagcaaaaacaaaaugggaugugaagaauugaggcaugcaacccaauagcauaaauguccuuu

SEQ ID NO: 81643 - RNA, 64 nt, Human
cuagauauuaaugucaaucauuuaagauuaaugggcaugcaauuaagucuccauuuaagauuaa

SEQ ID NO: 81644 - RNA, 64 nt, Human
ggcaugcaauuaagucuccauuuaagauuaaugggcaugcaaugaagucuccagcagacaauca

SEQ ID NO: 81645 - RNA, 64 nt, Human
ggcaaugagugugcacauacaaauggggcagugugcaugcaacacacuuaggggaggaguggcc

SEQ ID NO: 81646 - RNA, 56 nt, Human
cugaagacaucaagaaauaaaggagggcaugcaaguguggaguauuuacuugcuca

SEQ ID NO: 81647 - RNA, 64 nt, Human
gggcauccaacaguuaaucacuuauguuuuuagagcaugcaaucuuaacuuuguuaaacuauua

SEQ ID NO: 81648 - RNA, 64 nt, Human
uuuagacagcguuucgcucuuguugcccaggcuagcaugcaauggugugaccucggcuuacugc

SEQ ID NO: 81649 - RNA, 64 nt, Human
uaucaucccaacaaaguauccuuucaugaacggggcaugcaauagcuuaagaauugcuaggauu

SEQ ID NO: 81650 - RNA, 64 nt, Human
cuucauagccaugaaccaaaacguucuaugaggagcaugcaaguaagucaagccuccuauucug

SEQ ID NO: 81651 - RNA, 64 nt, Human
gaugacugucucacuuugacuauacccauguuuugcaugcaaugacucaugcaugguuuucuua

SEQ ID NO: 81652 - RNA, 64 nt, Human
aaggugcagcacguccaguggguagguacuuguugcaugcaaaagcuguaguguaucugguccu

SEQ ID NO: 81653 - RNA, 64 nt, Human
uugauuuguuugacuccccuccccccauuuacaugcaugcaaucagacaggccacuaagguaaa

SEQ ID NO: 81654 - RNA, 64 nt, Human
uagcauuucuaucccaucccucacguuauuggaagcaugcaacaguauuuauugcucagggucu

SEQ ID NO: 81655 - RNA, 64 nt, Human
accuggauugaagugcagaauuuggcauaucgaugcaugcaauggaaagaaaaaaaauuuguua

SEQ ID NO: 81656 - RNA, 64 nt, Human
caugccguccaggcccugccagaaaaggaaauuggcaugcaauucuaaacugcagugacuggga

SEQ ID NO: 81657 - RNA, 64 nt, Human
acuuucccuucccagcacagaggaauauuggcuggcaugcaaccugcaaaagaaaaaugcgaag

SEQ ID NO: 81658 - RNA, 64 nt, Human
guuauaaaaccauuuuaucagggcccaacauguggcaugcaaugaagagaaaauguaaagcuac

SEQ ID NO: 81659 - RNA, 64 nt, Human
ugcuuuuauguuaaauaagauaacaagaauuggagcaugcaaagaaugggacuuggauaaugac

SEQ ID NO: 81660 - RNA, 64 nt, Human
cuguaauaauacugagcucuuggaagcgaaucaugcaugcaauuagcucccuccuccucaccua

SEQ ID NO: 81661 - RNA, 64 nt, Human
uaaaggauuugacuuaccaccagagcauagaaaagcaugcaaggaagaccagaugggcuuagca

SEQ ID NO: 81662 - RNA, 64 nt, Human
aaaguuuagccaccugugcuuucugacucagagugcaugcaacaguuagaucaugcaacaguua

SEQ ID NO: 81663 - RNA, 64 nt, Human
cuggguugugcuaaaaauaaaugcaaugauugaugcaugcaauuuuuuauacaaauaauuuauu

SEQ ID NO: 81664 - RNA, 64 nt, Human
gcccuccuacauaaauaagcaauugcaguguuuugcaugcaaaauauaaaaaauuuaaauuguc

SEQ ID NO: 81665 - RNA, 64 nt, Human
uuuuucucacuuauuuuugcggugaaagucgagggcaugcaagaguuucucuuccagaagccaa

SEQ ID NO: 81666 - RNA, 64 nt, Human
cauuguauuuuacuuugugcaauaugaggggacugcaugcaagcucagggugcucccuccucag

SEQ ID NO: 81667 - RNA, 64 nt, Human
gcugguaucaacacagccugccauauuuuucacagcaugcaacaauggugcuaggauagcuauu

SEQ ID NO: 81668 - RNA, 64 nt, Human
cucugcugcucaugggaagaacagaauugcuccugcaugcaacuaauucaauaaaacugucuug

SEQ ID NO: 81669 - RNA, 64 nt, Human
gccuggagggcagggagugggagccaaugaacaggcaugcaagugagagcuuccugagcuuucu

SEQ ID NO: 81670 - RNA, 64 nt, Human
augaagaaaugucuuuugcccguuuugauuacgugcaugcaaacagcgauuugcaaagaccgua

SEQ ID NO: 81671 - RNA, 64 nt, Human
uaaggugacugaaagugcaaagaggaaauggacagcaugcaauucauccuaauguacaaaacgu

SEQ ID NO: 81672 - RNA, 64 nt, Human
cuuucucacauucuagacaaugauggacaaagacgcaugcaagacucagacccggggaauggug

SEQ ID NO: 81673 - RNA, 64 nt, Human
gguauugcauugguuuuuaugguaacuagguuuugcaugcaauuaaaaauccuuauuucuuguu

SEQ ID NO: 81674 - RNA, 64 nt, Human
ucuggcaucuagcauggugccuggugcauagugagcaugcaauaaauauuuggcaggugagugg

SEQ ID NO: 81675 - RNA, 64 nt, Human
agaaaugccucuauguaggugaaguguucucucugcaugcaacaguaaaaauuaauauaauauu

SEQ ID NO: 81676 - RNA, 64 nt, Human
uacccuuguuuugaaacuagaaaucuguccuguggcaugcaaaagaaagcaaauuauuuuuaaa

SEQ ID NO: 81677 - RNA, 64 nt, Human
auccaccccaggguuauuuugaggauucaaaaaggcaugcaacacaccuggagcacaauuccac

SEQ ID NO: 81678 - RNA, 64 nt, Human
aagauaucguguacauaggaacugguguagauaagcaugcaauuauggcaucauuuaggccugu

SEQ ID NO: 81679 - RNA, 64 nt, Human
cuggaauucugccaguguuucuuugcuaagccuugcaugcaaaauuugaaauuuuaacauuggc

SEQ ID NO: 81680 - RNA, 64 nt, Human
agcuuucagaguaaauuuuuuuuucuagcuauaagcaugcaauaauaaaucucaaacacugauu

SEQ ID NO: 81681 - RNA, 64 nt, Human
acuuaccgagcuuacuuugaucuguuugucaauagcaugcaaaaaaugcuuuguuugcccuuug

SEQ ID NO: 81682 - RNA, 64 nt, Human
gcccuccacagggaauacagcauccuuacagcuugcaugcaaucaaccucuuuuguaaauggaa

SEQ ID NO: 81683 - RNA, 64 nt, Human
gagaggaauguggcuguguggccugaguuauguagcaugcaacugcaacuucugcuuuuuccug

SEQ ID NO: 81684 - RNA, 64 nt, Human
auauuuacgggguaugugagauguuuugacacaggcaugcaaugugaaauacguguaucaugga

SEQ ID NO: 81685 - RNA, 64 nt, Human
aaaauaacucaaaguguuucuuaagggugaguuggcaugcaaaaaauuacauugauuacagugu

SEQ ID NO: 81686 - RNA, 64 nt, Human
agggggauguacauauauucucugaaacuaggaugcaugcaauuguguuggaaguguccuuggu

SEQ ID NO: 81687 - RNA, 64 nt, Human
auuucugacugcauguuuacuuaaucagguugcugcaugcaauaaauuuuauauccaaugucua

SEQ ID NO: 81688 - RNA, 64 nt, Human
gagugggacaggguuuuaaccacaaauaggagcagcaugcaauuccuagugacuugcugcacag

SEQ ID NO: 81689 - RNA, 64 nt, Human
ggaaggagcaaggccaccagguccagagaaccuggcaugcaauggacauggaagcugaaaauua

SEQ ID NO: 81690 - RNA, 64 nt, Human
aauguaacuugauuucuuaucuguguuuguguuggcaugcaagauuuagguacuuaucaaagau

SEQ ID NO: 81691 - RNA, 64 nt, Human
guuuguagcuuccucccuacucucuccaacaccugcaugcaaagacuacugggaggcugcugcc

SEQ ID NO: 81692 - RNA, 64 nt, Human
ccuggugucugcugcauggcauccuggaugcuuagcaugcaaguucccuccaucauugccaccu

SEQ ID NO: 81693 - RNA, 64 nt, Human
ggaguaucuuuaauguuuagauaguauauuagcagcaugcaauaauuacaucauaaguucucaa

SEQ ID NO: 81694 - RNA, 64 nt, Human
gggcaaagcuaucuuccccaaguggaaccucagugcaugcaaaucucugaugguggcuuccagg

SEQ ID NO: 81695 - RNA, 64 nt, Human
cacacaccuauggcuggcugggcaaggcgcucaggcaugcaaccaugggcaccaggcaauaccc

SEQ ID NO: 81696 - RNA, 64 nt, Human
aaaaaccgaauuggguuuagucaaucacugcacugcaugcaaacaagaaacgugucacacuugu

SEQ ID NO: 81697 - RNA, 64 nt, Human
caaauaaccuucugugucauggcuuggcuaauaagcaugcaauuccauauaucuauaccaucuu

SEQ ID NO: 81698 - RNA, 64 nt, Human
uucucauaggagcacaaauccuauugugaacucugcaugcaagggaucuaggcuaugcgcuccu

SEQ ID NO: 81699 - RNA, 64 nt, Human
cuguuucucuuccuggguuguugguguaacuccagcaugcaaguccacgagguggggugcaggc

SEQ ID NO: 81700 - RNA, 64 nt, Human
gggaagaagugacaugucaucccuugauaugucugcaugcaagguccacacccaaaagugucaa

SEQ ID NO: 81701 - RNA, 64 nt, Human
agacagggaaaaccagauauuuagagucgaagcagcaugcaaaaaauaauaauguuuuuaacua

SEQ ID NO: 81702 - RNA, 64 nt, Human
uguucccgcuuuccauauagcuuuggccaggaaagcaugcaauagacuugcucggagcccagca

SEQ ID NO: 81703 - RNA, 64 nt, Human
cuaaguacccugacuugaucauuacaccuucuaugcaugcaacaaaaugccacguguaccccau

SEQ ID NO: 81704 - RNA, 64 nt, Human
uuaaggcaugacagaugauuuaaacaaauaaauagcaugcaacaaaaugucuuuauugaaagaa

SEQ ID NO: 81705 - RNA, 64 nt, Human
augucguuaauuugcacguuaaagaccucuaaucgcaugcaagcauugaccuaccacaccuaca

SEQ ID NO: 81706 - RNA, 64 nt, Human
ggggaggugggcuggaucugugacugauugaaaugcaugcaaauaaaaaagacaauauuaaagu

SEQ ID NO: 81707 - RNA, 64 nt, Human
agaacaacacacagaagaauugguccaguuaagugcaugcaaaaagccaccaaaugaagggauu

SEQ ID NO: 81708 - RNA, 64 nt, Human
ggauggcccucauccacccucccaagcugugcgagcaugcaaggccccauggccucacacugca

SEQ ID NO: 81709 - RNA, 64 nt, Human
cguuguuucuugaugugggaggggagguguuagugcaugcaaggguugaacuagauagacccug

SEQ ID NO: 81710 - RNA, 64 nt, Human
aaauguucaacuguaguuuuauuaaggaagccaggcaugcaacagauuuugugcaugaaaugag

SEQ ID NO: 81711 - RNA, 64 nt, Human
uuagucugcucacugggagaagaagaguuccugcgcaugcaagcccugcuguguggcugucguu

SEQ ID NO: 81712 - RNA, 64 nt, Human
acggguacuuugcucauacgagcuuucauguucagcaugcaauggaaucaugcuuguccaugug

SEQ ID NO: 81713 - RNA, 64 nt, Human
uaggucaguguaaagaaauaugauuugagguggugcaugcaaguaacuaggguuuauucuauau

SEQ ID NO: 81714 - RNA, 64 nt, Human
cuagucuguccacacagggauuaccugucaucuugcaugcaaucaggagaaucucauaggggca

SEQ ID NO: 81715 - RNA, 64 nt, Human
ugccuuggccucccaaagugcugggacuacaggugcaugcaaccacaccuggcuaauuuucuuu

SEQ ID NO: 81716 - RNA, 64 nt, Human
aagaagacccauccugaacugggauggaauggcagcaugcaaacuuggaucagauagcaggagg

SEQ ID NO: 81717 - RNA, 64 nt, Human
uauucuuuaauuguugcuuuuacggugauauugugcaugcaaaccaggagcauuuugugucuua

SEQ ID NO: 81718 - RNA, 64 nt, Human
auugccuauaauacuugcaacuaaggacaaauuagcaugcaagcuuggucaaacuuuuuccagc

SEQ ID NO: 81719 - RNA, 64 nt, Human
caagaguccugaucuuucaugcugcacaauaugagcaugcaaaaagcuuuuuccagcagaacau

SEQ ID NO: 81720 - RNA, 64 nt, Human
acggcuagggguaaacucuuaguccaaaacccaagcaugcaauaaauaaaacucccuuauuuga

SEQ ID NO: 81721 - RNA, 64 nt, Human
cucagacacuucccccacccucauagaaccuguugcaugcaacuuaguuucacagcuuugccuc

SEQ ID NO: 81722 - RNA, 64 nt, Human
acggucuuuguuucugauuccuuuuaggggaauugcaugcaaacuagacugaaaugauacaaac

SEQ ID NO: 81723 - RNA, 64 nt, Human
agaaacuuauccaguuugaaaaucauucccuaaagcaugcaauaggaaaaagaaccuccuggcu

SEQ ID NO: 81724 - RNA, 64 nt, Human
ugccccucauaguguaggcuaaggugaguuuggugcaugcaaaccugugugcucacccacagag

SEQ ID NO: 81725 - RNA, 64 nt, Human
ccaaucaaaggggaaauguuuugaucuuuagauagcaugcaaaguaagacccagcauuuuaaaa

SEQ ID NO: 81726 - RNA, 64 nt, Human
gcaggaggggguguguuuccuuuuuguggguguugcaugcaaaucaaguggacaagaaaaaaua

SEQ ID NO: 81727 - RNA, 64 nt, Human
cucccccaggcagaagagcaugcccuuugccguugcaugcaaccagcccugugauuccacgugc

SEQ ID NO: 81728 - RNA, 64 nt, Human
aaacuugaugggaguuggggagggacugaaggaugcaugcaagguucugggaaggagugagaag

SEQ ID NO: 81729 - RNA, 64 nt, Human
ccccaggagaagccgccugagccacaaccuugcggcaugcaaaugagauggccgcuccaggccu

SEQ ID NO: 81730 - RNA, 64 nt, Human
ccuggcccggccagccaccguccccagcacccaagcaugcaauugccugucccccccggccagc

SEQ ID NO: 81731 - RNA, 64 nt, Human
ccaaccacccagggccaccaucagacaacucccugcaugcaaaccccuaguacccucucacacc

SEQ ID NO: 81732 - RNA, 64 nt, Human
uagccucaucaacauggcugcuugcuucaucaaggcaugcaagccaaaagggaggacagucugc

SEQ ID NO: 81733 - RNA, 64 nt, Human
acuuguucucacugucuguuuuaauuuaacccaggcaugcaaugcuagauaauaaaauugcucc

SEQ ID NO: 81734 - RNA, 64 nt, Human
aaagugugaaaugucaggcacuucccucuaacuggcaugcaacagccccaccugccugagagcc

SEQ ID NO: 81735 - RNA, 64 nt, Human
guccuggggugugugugugccugcgcacccaugcgcaugcaaguguguuugccagcucaggagc

SEQ ID NO: 81736 - RNA, 50 nt, Human
aagacugggcuaaauuuuaagcaugcaaaaauaccaaggaagaacuucuc

SEQ ID NO: 81737 - RNA, 64 nt, Human
ugccucagccuccuaagcagcugggacuacaggcgcaugcaaccauacccagcuaauuuauuuu

SEQ ID NO: 81738 - RNA, 64 nt, Human
ucuuauuuuuauacuuuuauauuguggaagaacagcaugcaacacucacauguaguguguggau

SEQ ID NO: 81739 - RNA, 64 nt, Human
cccagcccucccuggggccugcgggagcccuuuugcaugcaagggaggauggaggcuggccccu

SEQ ID NO: 81740 - RNA, 64 nt, Human
aauaugauuucauaaauguaaaaugcacagaaaugcaugcaauacuuauaagacuuaaaaauug

SEQ ID NO: 81741 - RNA, 64 nt, Human
aauuuuucugucuauuaaaugggacaaguguaaagcaugcaaaaguuagagaucuguuauauaa

SEQ ID NO: 81742 - RNA, 64 nt, Human
uccagauaguaagaugaguggaaguguuuaucgagcaugcaaaagaaacccucacggcuaaggg

SEQ ID NO: 81743 - RNA, 64 nt, Human
acuccuuuggacgcgaucgggcacuguaucaagagcaugcaaaacgucgcauugcagagcggga

SEQ ID NO: 81744 - RNA, 64 nt, Human
cuggguuuuugggaagggugugcgugucuuuggggcaugcaaguugggguuauaguggagaccc

SEQ ID NO: 81745 - RNA, 64 nt, Human
guggauuugcugguuguuucuacaggguucugaagcaugcaacauagaacagauaccuuuaaau

SEQ ID NO: 81746 - RNA, 64 nt, Human
aaggucuuacuaagcagucccaucucugugggaggcaugcaacgcgugcagggaguucaggugc

SEQ ID NO: 81747 - RNA, 64 nt, Human
agcugauaguguuucguuaagcaguacaucuugugcaugcaaaaaugaauucaccccucccacc

SEQ ID NO: 81748 - RNA, 64 nt, Human
guauuggagguagcagugcuagcucugccuucaggcaugcaauaugccagaacuacagacaaca

SEQ ID NO: 81749 - RNA, 64 nt, Human
uccuacgguccuuuggccugaggcagggcgggaggcaugcaagccagugggggaaaaccccucu

SEQ ID NO: 81750 - RNA, 64 nt, Human
caucagaaaggaaaaacaaacucuauauuguucagcaugcaauacauaccacgcuagggcuggc

SEQ ID NO: 81751 - RNA, 64 nt, Human
gagggccuggagauaaccagcuuuggauuaucccgcaugcaacauuccugugaucacauaaucc

SEQ ID NO: 81752 - RNA, 64 nt, Human
uaucuagagagccacauccuguugacugaaaguggcaugcaagauaaauuuauuugcuguuccu

SEQ ID NO: 81753 - RNA, 64 nt, Human
acccuaggcggcuucuuccugucagucggagguggcaugcaagaugaagcucucuuugcucuuc

SEQ ID NO: 81754 - RNA, 64 nt, Human
ggugggaaucaaugcuguuucacucaaaaguguugcaugcaaacacuucucuuuauucugcauu

SEQ ID NO: 81755 - RNA, 64 nt, Human
aacacugucugucaccuuccuguauuuccacagagcaugcaagaacuucuacaaaacuucuaua

SEQ ID NO: 81756 - RNA, 64 nt, Human
cuaccccugcuagaagguuacaguguauuauguagcaugcaauguguuauguagugcuuaauaa

SEQ ID NO: 81757 - RNA, 64 nt, Human
cugcgaguuuaaauguguuuguccuggauuuucggcaugcaaaucaaauauuacugaucaauuc

SEQ ID NO: 81758 - RNA, 64 nt, Human
guguggccuauuucccccgucagguugcacaggugcaugcaagagcauucuuaggagaccacug

SEQ ID NO: 81759 - RNA, 64 nt, Human
uguacuaguggcauggagaaugcaccauacucaugcaugcaaauuagacaaccaaguaugaauc

SEQ ID NO: 81760 - RNA, 64 nt, Human
ugugaaaucggguuaaagugaugaugauaaaauagcaugcaagaaacaagcuccuuccaucaga

SEQ ID NO: 81761 - RNA, 64 nt, Human
acccacugaggaacuugaaaauuuuuuucaaacauaacuccaggccuugcuuuuauuagugagu

SEQ ID NO: 81762 - RNA, 64 nt, Human
gccacaagauuguuuaauaggagacgaacgaauguaacuccauguuuacugcuaaaaaccaaag

SEQ ID NO: 81763 - RNA, 64 nt, Human
ucagagauaauuccuugguucuaugaucccuguuuaacuccaaauuacagucggacuuggauac

SEQ ID NO: 81764 - RNA, 64 nt, Human
cccugugguuaucccuagguggcucucgaggaguuaacuccaugagcccagggauccuagggcc

SEQ ID NO: 81765 - RNA, 64 nt, Human
ggucacagggauuccuccuuucccccccaaauauuaacuccagaaacuaggccugacuggggac

SEQ ID NO: 81766 - RNA, 64 nt, Human
uaccucaguuuccucaucccauuuacaguuuuucuaacuccaggguaguguuuaguguuaauau

SEQ ID NO: 81767 - RNA, 64 nt, Human
gaugcaaagcauuauaaugacugacacuuguaucuaacuccagucuuacagauaacuaaggcaa

SEQ ID NO: 81768 - RNA, 64 nt, Human
uuucuauuuggcauagcuaacuacacuuugauacuaacuccaguuuuacuauuauuauuuuggu

SEQ ID NO: 81769 - RNA, 64 nt, Human
uucucauaacauauaugagguauacaaaauuuucuaacuccagauuguagucauuuugagaggu

SEQ ID NO: 81770 - RNA, 51 nt, Human
uucaguuuguauauuuguagguaacuccagcuguugcauuuauacugggaa

SEQ ID NO: 81771 - RNA, 64 nt, Human
aaaaaaacuagcugggcaugguggcagaugccuguaacuccagcuacucgggagacugaaggac

SEQ ID NO: 81772 - RNA, 64 nt, Human
accauguauuacaagucuugacccaucccugucguaacuccaguaaaaguuacuguuacuagaa

SEQ ID NO: 81773 - RNA, 64 nt, Human
uggucugccugugagcucuucaaguucuaauccuuaacuccaggauuagcucccaagugcgcug

SEQ ID NO: 81774 - RNA, 64 nt, Human
gugaccaauaaauauaaaauaugguaauuggaauuaacuccacaccauaguaugcauuguuaua

SEQ ID NO: 81775 - RNA, 64 nt, Human
aaaccccuguccccagucagagauaacauccaacuaacuccagaagcggaagaggauauauuua

SEQ ID NO: 81776 - RNA, 64 nt, Human
gccagagaguucaccguaggcaucuuuaauaaacuaacuccagcaaaauguggguacguuacua

SEQ ID NO: 81777 - RNA, 64 nt, Human
cccagcucuaccgaaucaggaccacccugcugcuuaacuccacgcucacugccucgugaguggc

SEQ ID NO: 81778 - RNA, 64 nt, Human
gggugaugugagucaugugacagaaguacagacauaacuccaaugugagaaauguccuuuuuuc

SEQ ID NO: 81779 - RNA, 64 nt, Human
gggcuaccuuguuuuuaacaugagacuuaauuacuaacuccaaggggaggguuccccugcucca

SEQ ID NO: 81780 - RNA, 64 nt, Human
acuauuaaaccauaguuuguggcacccgcuuuucuaacuccaccuguuagaagcuauguguuug

SEQ ID NO: 81781 - RNA, 64 nt, Human
auccuuuuggagucagacagaugugguugcauccuaacuccaugucucugagcauuagauuucu

SEQ ID NO: 81782 - RNA, 64 nt, Human
aucuaaauuacaucaggacaaagagacagacuauuaacuccacaguuaauuaaggacguauguu

SEQ ID NO: 81783 - RNA, 64 nt, Human
uagcgauagguagccccugagaaauuuaucacuauaacuccacaggaaauaugacuuggaagug

SEQ ID NO: 81784 - RNA, 64 nt, Human
gaaaguucaaaaagucuacgcucuccuuucuuucuaacuccagugaaguaaugggguccugcuc

SEQ ID NO: 81785 - RNA, 64 nt, Human
uugggaauacccagccaacucuccaccaucaauguaacuccauggacauugcugcucuuggugg

SEQ ID NO: 81786 - RNA, 64 nt, Human
cgugagauuaagggcugugaaaagaaaucuagucuaacuccaacagaaaucugucucuguuaag

SEQ ID NO: 81787 - RNA, 64 nt, Human
auauuguuaaaugcaaaaaggagauaugauucuguaacuccaaucaguucagauguguaacuca

SEQ ID NO: 81788 - RNA, 64 nt, Human
aaugcgaaugaacuucacguucuccaaagcacuuuaacuccaaacuagauuuguugacuucacc

SEQ ID NO: 81789 - RNA, 64 nt, Human
uuuuauguaaacagaaggucuucaauaaguaaaguaacuccauauggagugauuguuucagucc

SEQ ID NO: 81790 - RNA, 64 nt, Human
auaucucuuuuuuucccuuuucauuugguuguccuaacuccaugaauagaaaagaaaauguauu

SEQ ID NO: 81791 - RNA, 64 nt, Human
cuuccuucugcaucucaccaccccuaguuacaaauaacuccauugaacagcaucuauucagaaa

SEQ ID NO: 81792 - RNA, 64 nt, Human
gacacuguacuuacuuuuuaagaauuagagacaguaacuccaaaaauaauuguccuuuuuucuu

SEQ ID NO: 81793 - RNA, 64 nt, Human
cugcaugcaugugacuugcuucuuuuugcauuguuaacuccauucucucuauucaccaacuucu

SEQ ID NO: 81794 - RNA, 64 nt, Human
acuuuauucuguaacucuccauucacuggucaaauaacuccaugaggcuaucaguggcuacagu

SEQ ID NO: 81795 - RNA, 64 nt, Human
auagaaaauuuaucuugguauguccuuuuuuagauaacuccagcaggaaacuguaacugcuaug

SEQ ID NO: 81796 - RNA, 64 nt, Human
ccaaacucuaucugaaaucccaacaaaaaaaauuuaacuccauauguguuccucuuguucuaau

SEQ ID NO: 81797 - RNA, 64 nt, Human
uuguuuuguuuuguuuuguuuuguuuugcauuuuuaacuccagauauccuaaagcucaauuguu

SEQ ID NO: 81798 - RNA, 64 nt, Human
ucauuugcuucagcuuacuaagaagcuucaaaucuaacuccauacugaacaaggggcuuuaugu

SEQ ID NO: 81799 - RNA, 64 nt, Human
uguugcugcauagaacucucccugcccuaccccuuaacuccaccuuagugccagggccgagggc

SEQ ID NO: 81800 - RNA, 64 nt, Human
gccucaaaaauacgauuacgagacuuaggagcauuaacuccagaugaaagauugaccccucuug

SEQ ID NO: 81801 - RNA, 64 nt, Human
uaagauccacccccugcccacaaaaaauugcuccuaacuccaccgccuaucccaaaccuacaag

SEQ ID NO: 81802 - RNA, 64 nt, Human
aacgacucacuccuuaaauucacacuuugccacuuaacuccaguguggaugacagagcgagacc

SEQ ID NO: 81803 - RNA, 64 nt, Human
gaccagugucuucugucucagggcuuauuauuuguaacuccaaaauagaaaugacaauuucaga

SEQ ID NO: 81804 - RNA, 64 nt, Human
aagucaagaugacagauaaggugagaguaaugacuaacuccaaagauggcuucacugaagaaaa

SEQ ID NO: 81805 - RNA, 64 nt, Human
agacauaugcagugguucuuacagaucaguuaauuaacuccagaaagcaaauguuagacuacac

SEQ ID NO: 81806 - RNA, 64 nt, Human
ccaccuaacccaacagacaauauuuguaauguauuaacuccauguuauguuuuuaagcugguuu

SEQ ID NO: 81807 - RNA, 64 nt, Human
gaggagacacaguuacccgaacccuucgccugaauaacuccagccccugugguaagacaugcau

SEQ ID NO: 81808 - RNA, 64 nt, Human
aaacugugcauuuaauggacacaagaauugacucuaacuccaugucugugguuucuuugaaccc

SEQ ID NO: 81809 - RNA, 64 nt, Human
aacagugagugauagagaauuucugccaugcuuuuaacuccaaagugaaagucucuuucucugg

SEQ ID NO: 81810 - RNA, 64 nt, Human
ugguagcugcuugcugaggucuuuuaguugguaauaacuccagagaagcagccuguguauauuc

SEQ ID NO: 81811 - RNA, 64 nt, Human
uccaggacucccucuaaguggaauagccucccuguaacuccagcucugcuccguaugccaagag

SEQ ID NO: 81812 - RNA, 64 nt, Human
ugaaauuauauacauacaauucuuguguggaauuuaacuccaugacugaauagcauaaggaaga

SEQ ID NO: 81813 - RNA, 64 nt, Human
ugaaaggaguugaacugccuuauguuugggcauguaacuccaaaauacuagguaguauaaggcu

SEQ ID NO: 81814 - RNA, 64 nt, Human
gaccaaucucuugaaucccauaucuacccagaauuaacuccauuccagucucugcauguaauca

SEQ ID NO: 81815 - RNA, 64 nt, Human
aguugauggugguaaacauucucucaggagacaauaacuccagugauguucuucaaagauuuua

SEQ ID NO: 81816 - RNA, 64 nt, Human
ucuuucaauucaauuaaauuuaaauagccacauuuaacuccagccuuggguuugaccugaugga

SEQ ID NO: 81817 - RNA, 64 nt, Human
ggagugaugaaucaucaccgguuguccccuuaucuaacuccauaaaagugggaauuucaaaaga

SEQ ID NO: 81818 - RNA, 64 nt, Human
gaguaaauacucugaauaagagaccgguacuagcuaacuccaagagaucguuagcagcaucagu

SEQ ID NO: 81819 - RNA, 64 nt, Human
gccagagcacagaccccagagucuugugguucucuaacuccagaaaggacaauguccccuauuc

SEQ ID NO: 81820 - RNA, 64 nt, Human
aauauaucccuugcucccuuuacacuugucccaguaacuccauccucacgaucuuuccuacccu

SEQ ID NO: 81821 - RNA, 64 nt, Human
uauauuuuagaaauaauauaucaaauaacucaacuaacuccaauuuuuaaucaauuauuaauuu

SEQ ID NO: 81822 - RNA, 64 nt, Human
uccccaccuuuuuuuugguuuaauuuuaggaauguaacuccauuggggcuuuccaggccggaug

SEQ ID NO: 81823 - RNA, 64 nt, Human
aauugauauuauauuaaacauacauaauacaauguaacuccacuguucuccugaauauuuuuug

SEQ ID NO: 81824 - RNA, 64 nt, Human
guaaugcuaccuuuugggaaacaaacugccccguuaacuccagaucauugcacuggaauguaau

SEQ ID NO: 81825 - RNA, 64 nt, Human
uuuuagcauugucuuguucugucccuuccacuucuaacuccacuggcuccaugauucucugagu

SEQ ID NO: 81826 - RNA, 64 nt, Human
auggcaugcaaaagcaaucauagagaaaccugcguaacuccaucugacaaauucaaaagagaga

SEQ ID NO: 81827 - RNA, 64 nt, Human
uuauuuuuuuaauauuguaugcaaucuuuauguguaacuccaaaacugaacuauaagauaauuc

SEQ ID NO: 81828 - RNA, 64 nt, Human
uacagugcaguguaaauaguucuguaguagagguuaacuccauauuucugugaggucacugagg

SEQ ID NO: 81829 - RNA, 64 nt, Human
ugaauugcuaggacaccaaaagaccuagcugggcuaacuccauccaaaugauuuuacaguuuua

SEQ ID NO: 81830 - RNA, 64 nt, Human
auuuuuacauuauacuuaauuuucuaaaaccauguaacuccauugaacacauuuuucaacuuaa

SEQ ID NO: 81831 - RNA, 64 nt, Human
aaaaaauaucguauaagugacucauccugucugcuaacuccagaccucccagcuugaagccaaa

SEQ ID NO: 81832 - RNA, 64 nt, Human
ccugacuuaacuguaugugcaacagcaaugaaauuaacuccagaagccuuccaccugcgucacc

SEQ ID NO: 81833 - RNA, 64 nt, Human
auuauuuucauucccauaagaggguguaaacaauuaacuccaggguuuuauuguauccugcaau

SEQ ID NO: 81834 - RNA, 55 nt, Human
agaggggagggaagcauuaaagagcuaacuccagagaucuauaaagcauauccuu

SEQ ID NO: 81835 - RNA, 64 nt, Human
uaguaugucaaaucaacuaagacuggcaggguauuaacuccauuccaggugacauggauaaaga

SEQ ID NO: 81836 - RNA, 64 nt, Human
ccauauuacauauugcaaccuaauuuguuaaaacuaacuccagcacuaaagcugaaaugccaca

SEQ ID NO: 81837 - RNA, 64 nt, Human
acagcaaaagucaggagcaguaaucugagaaaguuaacuccaggauagguagguuucuauuguu

SEQ ID NO: 81838 - RNA, 64 nt, Human
uaaaugcuauuguaagagaaauuucuuugucuauuaacuccauuuuaguagggauucacugacu

SEQ ID NO: 81839 - RNA, 64 nt, Human
guugaguuaauguaaguuaaauguguuuaugauauaacuccacuguacaucauccuuugaguag

SEQ ID NO: 81840 - RNA, 64 nt, Human
caggauggggaacagcuugaccuucauccaccccuaacuccaaaacuaucaagguacgacagug

SEQ ID NO: 81841 - RNA, 64 nt, Human
uuacuaauaagcacuacuguaauuuagcacaguuuaacuccacccucauuuaaacuuccuuuga

SEQ ID NO: 81842 - RNA, 64 nt, Human
ucuuuuaauagugauuucaaauagcuuauuaaaauaacuccauucaaauuuuacauuauaaagc

SEQ ID NO: 81843 - RNA, 64 nt, Human
cuuaacuggagcaaugauauaaaagcuacagagauaacuccaaguuuaauccagcucagcauga

SEQ ID NO: 81844 - RNA, 64 nt, Human
ucaucuaaucaagccauauuuaaauuucugaaguuaacuccaaauuucuuuauagcugauuauu

SEQ ID NO: 81845 - RNA, 64 nt, Human
uaucaguuaggauacaucacuaaaacauuuccacuaacuccacuguuucuauaauaaaucauaa

SEQ ID NO: 81846 - RNA, 64 nt, Human
aacacugacagauucuaaaauuaaguaguaaauuuaacuccaaguuucuccaugggcaaaguca

SEQ ID NO: 81847 - RNA, 64 nt, Human
ugcaggcaggcuggucccugcugugauuaacgaguaacuccaaguacaaggccgaccacaaugg

SEQ ID NO: 81848 - RNA, 64 nt, Human
uauaucgaccuaauggaaaugggaagagcaacaguaacuccaaagugucagaaaauaguuaaca

SEQ ID NO: 81849 - RNA, 64 nt, Human
cacccccauggagaacccaaagucuuacuguauauaacuccaggugacguuucuauauuuauag

SEQ ID NO: 81850 - RNA, 64 nt, Human
cugaauuaaucugaauagcaacugucugacuugauaacuccagugccaguauaguggcugcugc

SEQ ID NO: 81851 - RNA, 64 nt, Human
guucuuuuuacugucaucacuucuauagauuuccuaacuccaccaugccuauuucugguuauau

SEQ ID NO: 81852 - RNA, 64 nt, Human
uggauaaacuaccccugccccaaaccucuaccccuaacuccaggucaggggugcguagagguug

SEQ ID NO: 81853 - RNA, 64 nt, Human
uccuuguggguaguuaagaguggggucaccccuuuaacuccaagcacuacauuuuggcggcugc

SEQ ID NO: 81854 - RNA, 64 nt, Human
auaucgaucuuacacauucuguguauaaagaccuuaacuccacaggacggacauuuuagaguuu

SEQ ID NO: 81855 - RNA, 64 nt, Human
ugaggucccuuaguuacuaaaaagggacaugauuuaacuccaguuugaugaaccuccuccgagu

SEQ ID NO: 81856 - RNA, 64 nt, Human
aaacugccugcagacguuagcaggcucuucaaaauaacuccauggugcacaggagcaccugcau

SEQ ID NO: 81857 - RNA, 64 nt, Human
gugaauuuuugaccuuaucuuaauggaaaacgguuaacuccaaacacaaaagacucuacuggaa

SEQ ID NO: 81858 - RNA, 64 nt, Human
agaauuggaccuuggauuuuuauuuuggcaauuguaacuccaucuaaucaagaaagaauaaaag

SEQ ID NO: 81859 - RNA, 64 nt, Human
ucugccccugauucccaaugugccauaguuuuauuaacuccauuaaagaagccuguauguguuu

SEQ ID NO: 81860 - RNA, 64 nt, Human
acucugcuagaaugauaaaugucaugguggucuauaacuccaaauaaacaaugcaacguuccug

SEQ ID NO: 81861 - RNA, 64 nt, Human
auaaaaagccuguauauuuuuuaaaaacacaucuuaacuccacgcuuuacgauauuauaaaagu

SEQ ID NO: 81862 - RNA, 64 nt, Human
cuauuauguguaaagugguguuaguguaaacaguuaacuccaaauagauuuuuuaauguauuaa

SEQ ID NO: 81863 - RNA, 64 nt, Human
cggucaguuacagaagcaggauuucuaggauuucuaacuccagcuguucccauacugucuaguu

SEQ ID NO: 81864 - RNA, 64 nt, Human
uuauuaaaaaaaaaaaaagauuguagugguagucuaacuccauaacgcugaggaaauacaucau

SEQ ID NO: 81865 - RNA, 64 nt, Human
aaauccaaccauuuucauuaauucaggcauauuuuaacuccacugcuuaccuacuuucuucagg

SEQ ID NO: 81866 - RNA, 64 nt, Human
uggcuucaagggguacuguggcaaccaaauaaaauaacuccauuuucuaaaacuuucauguaac

SEQ ID NO: 81867 - RNA, 64 nt, Human
ugaugauucuguauuucagagucaguuucuugaguaacuccagugcuacaaaaagaauuaguaa

SEQ ID NO: 81868 - RNA, 64 nt, Human
acuucuuugauaaaagaaaaauaagucagauuguuaacuccaagauugaaaaaaaaaacucuug

SEQ ID NO: 81869 - RNA, 64 nt, Human
uaaaugaauauguucaguuuuugaauuuuaauaguaacuccaauucaguaaaugguaucacugu

SEQ ID NO: 81870 - RNA, 64 nt, Human
accauucggagaguucagaugugggacaagauucuaacuccagccuucucccaaaugguuaauu

SEQ ID NO: 81871 - RNA, 64 nt, Human
gaggaagauuuucccuugcuucugcauaaaauuuuaacuccauaacuuauaagcucacucuuua

SEQ ID NO: 81872 - RNA, 64 nt, Human
uuuucauucuacaugaacugagguaauauuaugguaacuccaauauuugguuaaaaaaacuaua

SEQ ID NO: 81873 - RNA, 64 nt, Human
uguucucaagggaaccccauucacaugccccuccuaacuccacaagcgaggguagcagaggcuc

SEQ ID NO: 81874 - RNA, 64 nt, Human
auggggauacaugaacuucauauacuaaggagccuaacuccaaagccugcguucucaucccagu

SEQ ID NO: 81875 - RNA, 64 nt, Human
cuugaaaacuaggacgauugggcaauaucggccuuaacuccaccugauggcaggugacccggau

SEQ ID NO: 81876 - RNA, 64 nt, Human
aaaguuucguguaaaaauaucuuuuuuucuuaaauaacuccauucauacaaauugggaugggaa

SEQ ID NO: 81877 - RNA, 64 nt, Human
aaaugagaaaguguugguugguuuuaaaaucugguaacuccaugaugaaaagaaauuuauuuua

SEQ ID NO: 81878 - RNA, 64 nt, Human
aggcuaauuaaggguugcaguccuccuucugggcuaacuccaagguccagcagaguguccagca

SEQ ID NO: 81879 - RNA, 64 nt, Human
auagcacuguccgugucauaugagucacuaauauuaacuccagggacuucuggauaggcuaaua

SEQ ID NO: 81880 - RNA, 64 nt, Human
caagaugcugccauauauuaagauagaauauaauuaacuccaugagaaugguuacucaggaacu

SEQ ID NO: 81881 - RNA, 64 nt, Human
ggaagcuuuucuuuggcgauucagugucacaaaauaacuccagaaagaagcacuuagcgugcug

SEQ ID NO: 81882 - RNA, 64 nt, Human
ccuuugaauggaccuaacuauacaucuuugcucuuaacuccaagucugcccuucuuuuuaggaa

SEQ ID NO: 81883 - RNA, 64 nt, Human
uaagcagacaggccaugauuuaguuggccagcacuaacuccaccucuguucuccuugaacagcu

SEQ ID NO: 81884 - RNA, 64 nt, Human
aaagauuuaaagucucuuaggaauauuauucauguaacuccauggcauaaauaguuguauuuuu

SEQ ID NO: 81885 - RNA, 64 nt, Human
cagaaacaugccgccaguucucaaguuuuccuccuaacuccauuugaauguaagggcagcuggc

SEQ ID NO: 81886 - RNA, 64 nt, Human
caccugucacuugcagcaucagaggguguugcauuaacuccauuuucuccagcagccauaaaau

SEQ ID NO: 81887 - RNA, 64 nt, Human
ucauguaucaguucagacagacgaggucucaauuuaacuccaggcuuagauccaguuucuuuug

SEQ ID NO: 81888 - RNA, 64 nt, Human
ucuuucuuaauuggccaaauauaaguuggugucguaacuccaggccacagugaguuaugggcaa

SEQ ID NO: 81889 - RNA, 64 nt, Human
caagggacacgguguggaaagaggggcucaaacuuaacuccagcccugaacaggcaccacuuac

SEQ ID NO: 81890 - RNA, 64 nt, Human
ccugaucaaacaucagucaacauacucuaaagaauaacuccaagucuuggccaggcgcaguggc

SEQ ID NO: 81891 - RNA, 64 nt, Human
uauuaauaaauugucacuuucauugucuuuauuguaacuccauugaucccguaucuuaacgguu

SEQ ID NO: 81892 - RNA, 64 nt, Human
gggaugcucuaauuggcugguugguuuggauuuguaacuccagaaacauucuauagugugccag

SEQ ID NO: 81893 - RNA, 64 nt, Human
ucauggucuuggugacguagaccguuugcuucuuuaacuccagccgcggaaugacauuagugga

SEQ ID NO: 81894 - RNA, 64 nt, Human
gcauucauuuuaaucuacugaacaaauauugggauaacuccaaaccgcaugaaaggguguaauu

SEQ ID NO: 81895 - RNA, 64 nt, Human
gcaaaguguuuuaggaugaacuuuguuauaguuuuaacuccaauaaaguucaucaguuuaauug

SEQ ID NO: 81896 - RNA, 64 nt, Human
gcuaaguugguucugugacucauuccucauacccuaacuccaucuccuuucuuuaaagucaaau

SEQ ID NO: 81897 - RNA, 64 nt, Human
cuuaaggcugcuugguacugaguauacuuaaauauaacuccagaauccagggacuugguguuaa

SEQ ID NO: 81898 - RNA, 64 nt, Human
cgcuaaguaagcaacuuaaguugcuuuaacaaacuaacuccaaaucucaguuuccugauaaaga

SEQ ID NO: 81899 - RNA, 64 nt, Human
aggcaaugaauguuauacugaguuucuaccucuuuaacuccaccuccaauuucugucaaucuac

SEQ ID NO: 81900 - RNA, 63 nt, Human
uuccaaauaaaggguaaaaacagaaccaaaguuauaacuccaacacacaaacauagugguugu

SEQ ID NO: 81901 - RNA, 64 nt, Human
gaguccuucuugggggaaauagcagagccccacuuaacuccauaaacugcuucccauuccgcag

SEQ ID NO: 81902 - RNA, 64 nt, Human
augucgggacaucaucuucaccucucucugaaguuaacuccacuuuaaaacucgcuuucuugag

SEQ ID NO: 81903 - RNA, 64 nt, Human
uucccgacgugaguuagaugagggagaguuuguguaacuccacacccaggaggguaagccacuu

SEQ ID NO: 81904 - RNA, 64 nt, Human
uugcauugggcauuaguguccccccuugaagcaauaacuccaagcagacuccagccccuggacc

SEQ ID NO: 81905 - RNA, 64 nt, Human
uuaguccugucuuuucauuagccauguaauaauauaacuccauguuccaugcaacuggauuuuu

SEQ ID NO: 81906 - RNA, 64 nt, Human
gggcccucuucuacucuccauuuaggccuguugauaacuccauuacccgcccaucacugcuguu

SEQ ID NO: 81907 - RNA, 64 nt, Human
gcauuucugaugacagccuuggaaaguauauuuguaacuccaugucugguaaugccaacccaag

SEQ ID NO: 81908 - RNA, 64 nt, Human
aaacaacagguuugaguccuauaaagccauaauuuaacuccaguagcugaugucagacaagcuu

SEQ ID NO: 81909 - RNA, 64 nt, Human
ggcgcaggagcccucccuccccacccccacccuguaacuccagcugccacuccaucuccagcug

SEQ ID NO: 81910 - RNA, 64 nt, Human
ggagcaugagaauugauccccagaagaaccauuuuaacuccaucugauacuccauugccuauga

SEQ ID NO: 81911 - RNA, 64 nt, Human
acaguuuaagauuuuaaguauuguuuccugagcauaacuccauaaguaagaaauuucuaguuca

SEQ ID NO: 81912 - RNA, 64 nt, Human
uagaacuguagcagugcagguggcuuaagugaaguaacuccauauguaauuacaugauuaugau

SEQ ID NO: 81913 - RNA, 64 nt, Human
ucucugccuccuuugugucuguuuuaaaggagacuaacuccaggaguaggaaaugauucaucau

SEQ ID NO: 81914 - RNA, 64 nt, Human
aguagcagaauuaggauucagacuuuguuaggccuaacuccaaagcccuggcuuuuuuuuuuuu

SEQ ID NO: 81915 - RNA, 64 nt, Human
uggggaauguguccccugcauaucuucucagcaauaacuccaugggcucugggacccuaccccu

SEQ ID NO: 81916 - RNA, 64 nt, Human
cagagccaugagccaagagcccucuucacgcugcuaacuccaggggacagacgaagggacaucu

SEQ ID NO: 81917 - RNA, 64 nt, Human
uccaccugccucugagcuuucaccucugacucccuaacuccaucagaccucuacgcaccauaag

SEQ ID NO: 81918 - RNA, 64 nt, Human
ccccaacuaaucuuuagaagcauauuggaacugauaacuccauuuuaaaaugagcaaagaauuu

SEQ ID NO: 81919 - RNA, 64 nt, Human
agagaaaaucgaugaagauuguauuuuugcaccuuaacuccacauugcuuuauugguuaauuua

SEQ ID NO: 81920 - RNA, 64 nt, Human
gcuaaauucaggcugcaggcuccuuccauccagauaacuccauccugucgaguaggcucuuucu

SEQ ID NO: 81921 - RNA, 64 nt, Human
gacauuuacacauuuuacagauuuuuguuugguuuaacuccagauuucucuugauauaucucug

SEQ ID NO: 81922 - RNA, 64 nt, Human
ggaucugggacccuuuccuuccuucccuggcuuguaacuccaccaacccaucagaaggagaagg

SEQ ID NO: 81923 - RNA, 64 nt, Human
cucuccggcuguuucucuuccuggguuguugguguaacuccagcaugcaaguccacgagguggg

SEQ ID NO: 81924 - RNA, 64 nt, Human
cacagugucugguacauuuguguuuaauaaaagcuaacuccauguucauaagagaggacugaac

SEQ ID NO: 81925 - RNA, 64 nt, Human
acacugaugccgaagaugaugcuccuacaaaacguaacuccaguccuccacccucucccaacaa

SEQ ID NO: 81926 - RNA, 64 nt, Human
gcgugaagggccuuaaugucacccaccagaaaacuaacuccaaauaaacgcuuacccuuuccuu

SEQ ID NO: 81927 - RNA, 64 nt, Human
uuugguguuaauauacaaacguacaccccaucuuuaacuccacagaccaagacuggaguaagac

SEQ ID NO: 81928 - RNA, 64 nt, Human
aauagugcuuuuuuuuuuuugacuaacaagaauguaacuccagauagagaaauagugacaagug

SEQ ID NO: 81929 - RNA, 64 nt, Human
aacggugagaauuccaacacuguucauguaacaguaacuccauagauggaagagcauuggcagg

SEQ ID NO: 81930 - RNA, 64 nt, Human
aaaagguagaagacuucauggcuuacuuguuccauaacuccaagugagucuguaauguuuguga

SEQ ID NO: 81931 - RNA, 64 nt, Human
uucaggaguaacagagauacaacagucuuggagguaacuccauuugcuacaggacaggcccuug

SEQ ID NO: 81932 - RNA, 64 nt, Human
ucagauacucucuuugccagaugaaguuacuugcuaacuccagaaauuccugcagacauccuac

SEQ ID NO: 81933 - RNA, 64 nt, Human
uuuacugucuuuuuuucugccauuucccaaauaauaacuccagauuucauaauuccaguuuuua

SEQ ID NO: 81934 - RNA, 64 nt, Human
ucugggacgguauuuauuaucagacuggcaagccuaacuccauagguuuacaggaaguagggau

SEQ ID NO: 81935 - RNA, 64 nt, Human
uaacuaaagcuaguuaaugucagugacauuaaacuaacuccaggauucaggaguuuuaauguua

SEQ ID NO: 81936 - RNA, 64 nt, Human
cuuugagaaauagagaaauauaaaaguguguucuuaacuccagaaccacucuuuuugcauaaau

SEQ ID NO: 81937 - RNA, 64 nt, Human
cugauggccaaccaaggggccacccagggaccucuaacuccacacauccuccacccgggggggu

SEQ ID NO: 81938 - RNA, 64 nt, Human
uccauuaggauuagagacaaguucuguuuagaaauaacuccaagauugggaggccgaccugggu

SEQ ID NO: 81939 - RNA, 64 nt, Human
gagguugagccgccccaggguaugaggagaugaauaacuccacagcuccuccuggacccugcgc

SEQ ID NO: 81940 - RNA, 64 nt, Human
uggagugcugggguggcugcaauaauuugggggcuaacuccauuugguuuccaagaucucacuu

SEQ ID NO: 81941 - RNA, 64 nt, Human
auguuaaggaaauacgaaucugaaagaaaaauguuaacuccagcucuugaaguaucuuaaauaa

SEQ ID NO: 81942 - RNA, 64 nt, Human
ucaagguuuuaauuaauucccauacugauaaaaauaacuccaugaauucuguaaaccauugcau

SEQ ID NO: 81943 - RNA, 64 nt, Human
uacaaaauuagccaggcaugguggugcaugccuguaacuccagauacuugggaugcugaggcag

SEQ ID NO: 81944 - RNA, 64 nt, Human
agggaccagggcuggcccugauccaccuaccugcuaacuccagauauuauuuuuaaguuggaga

SEQ ID NO: 81945 - RNA, 64 nt, Human
aaagcaagaaaaaaagauacuauggggucaaguguaacuccauggaaaugccacgucugcucuu

SEQ ID NO: 81946 - RNA, 64 nt, Human
aucugucagccuuaaugucaguggcaggaagucauaacuccagcuaaaaauuacagaguaaagu

SEQ ID NO: 81947 - RNA, 64 nt, Human
aaaguguggacacuuuugacagcuuggcagauuuuaacuccagaagcacuuuaugaaaugguac

SEQ ID NO: 81948 - RNA, 64 nt, Human
uuguuuguuuguuuuguuuuacccagaaauaagauaacuccaucucgccccuucccuuucaucu

SEQ ID NO: 81949 - RNA, 64 nt, Human
uguaaccaugaaacagcagaagaacuaacauaacuaacuccauuuuuguuuaaggggccuuuac

SEQ ID NO: 81950 - RNA, 64 nt, Human
agugaugucauagacaggauuguuuaaauuuaguuaacuccauacucuucagacugugauauug

SEQ ID NO: 81951 - RNA, 64 nt, Human
aaaauaaacaaaugacuuacagccucauccucccuaacuccauuugaacucaacuuagcucaca

SEQ ID NO: 81952 - RNA, 64 nt, Human
ucacaaucucguucaccacgugggccuggaacucuaacuccaucgcugaggggugggaaugaga

SEQ ID NO: 81953 - RNA, 56 nt, Human
ugcccucuucggggccguaggaccccuaacuccaccccccucccuggcagcaccuc

SEQ ID NO: 81954 - RNA, 64 nt, Human
ugcuauagcucuugcugccucucuugaauagcucuaacuccaaaccucuguccacaccuccaga

SEQ ID NO: 81955 - RNA, 64 nt, Human
gcuuuuuugccuccaccuuuuagcccacaucauuuaacuccacuacugugaaagcuugcuuaaa

SEQ ID NO: 81956 - RNA, 64 nt, Human
ggcacccuccucugucacuugcugcuuggagccuuaacuccagaugggggggucaccaagaggg

SEQ ID NO: 81957 - RNA, 64 nt, Human
ugucugccuucccucgucccuuuaccuggccagauaacuccagccgcugaauacaguguuagga

SEQ ID NO: 81958 - RNA, 64 nt, Human
auauguuaacuacuaauaaaugguuuauucuuucuaacuccauauaagcuuuuccagcaaagau

SEQ ID NO: 81959 - RNA, 64 nt, Human
gccccaacacccaucaucccccugagcucacccuuaacuccaauuuauccuccaagccuaucuc

SEQ ID NO: 81960 - RNA, 64 nt, Human
cugaagugacagauuaagaguucuugauauuagauaacuccaacuucuggcuguagagcaccca

SEQ ID NO: 81961 - RNA, 64 nt, Human
ccugggcucugggaccuccaugccgaccucauccuaacuccacucacgcagacccaaccuaacc

SEQ ID NO: 81962 - RNA, 64 nt, Human
cugcaagcuccuguuuuacuguagaagggacaauuaacuccauccuucuccaugacucugaaau

SEQ ID NO: 81963 - RNA, 64 nt, Human
ccagggacaggguauggaaagaggggcucacgcuuaacuccagcccccacccacacccccaucc

SEQ ID NO: 81964 - RNA, 64 nt, Human
ucagcagaccuucuuugguuuaacuaaucucauuuaacuccaaaaucaucucucucuuaggacu

SEQ ID NO: 81965 - RNA, 64 nt, Human
uaacuuaauucucuucguuauuuaucugacccucuaacuccaugucuaacuugcauuaaaaaaa

SEQ ID NO: 81966 - RNA, 64 nt, Human
guuugccucaagaaacuucaugagggucucuuacuaacuccauuacacucucucuccuggagcc

SEQ ID NO: 81967 - RNA, 64 nt, Human
uaccagcggucaaggcuuuggagccacucuuuuguaacuccagauuauuuaaagagaaaaguac

SEQ ID NO: 81968 - RNA, 64 nt, Human
ggagggaaaauaaggccagaaacuucugagcagauaacuccacaaauggaaauuuaguacuuuc

SEQ ID NO: 81969 - RNA, 64 nt, Human
uaugaaaauacaaauguuauuuuuuuuacugcuguaacuccaguuccuagaacaauuuccagca

SEQ ID NO: 81970 - RNA, 64 nt, Human
uucagggucaugaucaaaaaaugaaaagucugcuuaacuccaauuucucuuuuaaaaaagcaga

SEQ ID NO: 81971 - RNA, 64 nt, Human
uuaaccuucucuuuuauaaucuguucucagguuuuaacuccauguuuaccaucauuugcaaaaa

SEQ ID NO: 81972 - RNA, 64 nt, Human
auugagaacuagaaaugaggaaggacaguuacgcuaacuccaaaaggcugucuaggaugagcug

SEQ ID NO: 81973 - RNA, 64 nt, Human
auccucagccggagggcaggguaccagguaagcuuaacuccaucuuggguguuugugacaggcc

SEQ ID NO: 81974 - RNA, 64 nt, Human
agaaggacugaacuccaucgccaucuucuucccuuaacuccaagaacuugggauaagaguguga

SEQ ID NO: 81975 - RNA, 64 nt, Human
uacaaacacgccugagaguggcacuggggaaacauaacuccaucuacaccuuggauuuggacug

SEQ ID NO: 81976 - RNA, 64 nt, Human
caugguaacagagaauugauuuucauaugaaucuuaacuccacaguaaaauaguugacaucaua

SEQ ID NO: 81977 - RNA, 64 nt, Human
gcaugggaguaagguuauccuuagaaauuuaaaauaacuccacaguaaaauagguagaaucuga

SEQ ID NO: 81978 - RNA, 64 nt, Human
agagcaagcucauuuuuccguguccuccuuuauuuaacuccauuuauugcuuuugguauaauuu

SEQ ID NO: 81979 - RNA, 64 nt, Human
aaaaauuccuuuucucuuuuuuuuuuguaaagauuaacuccaccucaccaccacaaugagguau

SEQ ID NO: 81980 - RNA, 64 nt, Human
aagaccgggccccaaguggcaagggcuggccuggggcgggcagcuuggguccuggacguugaua

SEQ ID NO: 81981 - RNA, 64 nt, Human
ucaaggccaggccaaggccugguuggguccuuggggcgggcagggccagccucuccucugcuga

SEQ ID NO: 81982 - RNA, 64 nt, Human
ucacgccuguaauccaagcacuuggggaggccgaggcgggcagaucacgagaucaggaguucaa

SEQ ID NO: 81983 - RNA, 64 nt, Human
ggugcugccuggggaggcaaaucaugcucacuccggcgggcacagcuggcuggggcuguuccgg

SEQ ID NO: 81984 - RNA, 64 nt, Human
ucuacuaaaaauacagaaauuagccgggcgugguggcgggcaccuauagucccagcuacucaga

SEQ ID NO: 81985 - RNA, 64 nt, Human
gagacagcucccacccaccauccugucccccuggggcgggcauuggcccaggugguggagacag

SEQ ID NO: 81986 - RNA, 50 nt, Human
uccugcucuuccccgacuagggcgggcagaugcgcucgagccccacgggc

SEQ ID NO: 81987 - RNA, 64 nt, Human
gcccugagggguguccaccggggacagacccaggggcgggcagagagggaaggagggaggaggc

SEQ ID NO: 81988 - RNA, 64 nt, Human
gccuccucccagguggugcgggggcuggugggcgggcgggcaggcgugcugacagccggcaguu

SEQ ID NO: 81989 - RNA, 64 nt, Human
ugaaaccaaguuuacaaguagacaccccugggggggcgggcaguggacaaggauggcaaggggu

SEQ ID NO: 81990 - RNA, 64 nt, Human
ucacgccuguaaucccagcacuuugggaggccgaggcgggcagauuauugccugagcucaggag

SEQ ID NO: 81991 - RNA, 64 nt, Human
cagacaggagcaugggggcagcugucauggcuguggcgggcacuuuuccucagaguuucugccu

SEQ ID NO: 81992 - RNA, 64 nt, Human
ucacgccuguaaucccaguaguuugggaggccaaggcgggcagaucaccugaggucaggaguuu

SEQ ID NO: 81993 - RNA, 64 nt, Human
ccauccucccauccugcacuuuagccagcugcagggcgggcaaggcaaggaaagcugcuucccu

SEQ ID NO: 81994 - RNA, 64 nt, Human
gggcuuccuucauacuuuguugggggacuuuggaggcgggcaggggacagggcuauugauaagg

SEQ ID NO: 81995 - RNA, 64 nt, Human
ugcaaccagggagcugcaggggcaugggaaggugggcgggcaggggagggucagccagggccug

SEQ ID NO: 81996 - RNA, 64 nt, Human
cuacuaaaaauaagaaaaauuagcugggcgugguggcgggcaccuguaaucccagcuacuuggg

SEQ ID NO: 81997 - RNA, 64 nt, Human
gaaauccauucaagagcuaggagaucugagggcaggcgggcagcugcagggaggagaggugaga

SEQ ID NO: 81998 - RNA, 64 nt, Human
aggcaacugcuugaccacuggcccagcaagcagaggcgggcaggaggaucugggcauccugagc

SEQ ID NO: 81999 - RNA, 64 nt, Human
gcucaccuguaaucccagcacuuugggaggccaaggcgggcagaucaccugaggucaagaguuc

SEQ ID NO: 82000 - RNA, 64 nt, Human
ucaugccuguaaucccagcacuaugggaggcugaggcgggcagaucuccugagcucaggaguuc

SEQ ID NO: 82001 - RNA, 64 nt, Human
cccucuccuccauagggaccagaagccugacucuggcgggcagcgggagaggcgcucgcucggg

SEQ ID NO: 82002 - RNA, 64 nt, Human
uccugcccuucucagcccagaugccaugccccugggcgggcagcagcuccccaucuucucuggc

SEQ ID NO: 82003 - RNA, 64 nt, Human
aauaggaggaucccaggauaaacacugcugggcaggcgggcaggcaggccuggggcugcccugc

SEQ ID NO: 82004 - RNA, 64 nt, Human
gcuaccaaauacgccugggcagccgggacgggccggcgggcaccaggcuggggucuccuugucu

SEQ ID NO: 82005 - RNA, 64 nt, Human
gcaggugggccaagcucugggggcagguggagagggcgggcaggggagagacccagcggcacug

SEQ ID NO: 82006 - RNA, 64 nt, Human
ucacgccuguaaucucagcacuuugggaggcugaggcgggcagaucgcuugaggucaggaguuc

SEQ ID NO: 82007 - RNA, 64 nt, Human
aaggcccugccccagugagacccuggggccccuuggcgggcagcccagccucugucccucuuug

SEQ ID NO: 82008 - RNA, 64 nt, Human
aaggaauuucccuguguggaugcugagcugugauggcgggcacuggguacccaagugaagguuc

SEQ ID NO: 82009 - RNA, 64 nt, Human
ucacaccuguaaucccagcacguugggaggccaaggcgggcagaucacgaggucaagagaucaa

SEQ ID NO: 82010 - RNA, 64 nt, Human
cucccagaagaagagcgaucccucggacgguccgggcgggcacccucagccgggcucuuugcag

SEQ ID NO: 82011 - RNA, 64 nt, Human
caaugccugugaucccaguacuuugggagguugaggcgggcagaucacuugaggucaggaguuu

SEQ ID NO: 82012 - RNA, 64 nt, Human
gcccccacccaagauggccuggucugugggguguggcgggcagugccucgguugucucugcggc

SEQ ID NO: 82013 - RNA, 64 nt, Human
ccaccaggcugcuauuuugauggugaccggagcuggcgggcagcggguacgcgguggcaccccg

SEQ ID NO: 82014 - RNA, 64 nt, Human
ggauugugcugauguagugaccaagugcaauaugggcgggcagucgcugcagggagcaccacgg

SEQ ID NO: 82015 - RNA, 50 nt, Human
ccgugugcuucccaagcugaggcgggcaggggagccggaccagggaggac

SEQ ID NO: 82016 - RNA, 64 nt, Human
ucuacuaaaaauacaaaaauuaucugggcuugguggcgggcaccuguaaucccagccacuuggg

SEQ ID NO: 82017 - RNA, 64 nt, Human
uccacuaaaaauacaaaaauuagccaggcaugguggcgggcaccuguaaucccaguuacuuggg

SEQ ID NO: 82018 - RNA, 64 nt, Human
ccaggagcaacgccaguggcaacguagugacucaggcgggcaccaaggcaacggcaccauuggu

SEQ ID NO: 82019 - RNA, 64 nt, Human
acauuggaagggagaaggcgaacauuucauguuuggcgggcaugugagugcacaagauggaaag

SEQ ID NO: 82020 - RNA, 64 nt, Human
ucacgucuguaaucccagcacuuugggaggcugaggcgggcagaucaugaggucaggaguuuga

SEQ ID NO: 82021 - RNA, 64 nt, Human
ucacgccuguaaucccaacacuuuaggagaccaaggcgggcagaucacuugaggucagaaguuu

SEQ ID NO: 82022 - RNA, 64 nt, Human
ucauuccuguaaucccagcacuuugggaggccaaggcgggcagaucaccuuaggucacgaguuu

SEQ ID NO: 82023 - RNA, 61 nt, Human
aggaggagucgaugaugugaggcaggaggcaggcgggcagaaggcccugcccgggaccuca

SEQ ID NO: 82024 - RNA, 64 nt, Human
ucacgccgguaaucccagcacuuugggaggccgaggcgggcagaucauuaggucaggagaucga

SEQ ID NO: 82025 - RNA, 62 nt, Human
ucugugguggugaggacuagggccacagcuuuggcgggcacuucugccaagaaaugguuauc

SEQ ID NO: 82026 - RNA, 64 nt, Human
agacccccagcacuuggggguucaggcccggcagggcgggcagagggcuggaggcccaggcugg

SEQ ID NO: 82027 - RNA, 64 nt, Human
gcuccuagcagccuccccaggaagggacugcagaggcgggcaagcccucucuauguguuuuuau

SEQ ID NO: 82028 - RNA, 64 nt, Human
ucacgccuguaaucccagcacuuugggaggccaaggcgggcagaccaugaggucaggagauuga

SEQ ID NO: 82029 - RNA, 64 nt, Human
ucauaccuguaaugccagcacuuugggaggccaaggcgggcagaucacgaggucaggaguuuca

SEQ ID NO: 82030 - RNA, 64 nt, Human
ucuacuaaaaauacaaaaauuagccaggcuuaguggcgggcaucuguagucccagcuacucagg

SEQ ID NO: 82031 - RNA, 64 nt, Human
cucuacuaaaaguacaaauauuagccgacuauguggcgggcaccuguaaucccaccuacucggg

SEQ ID NO: 82032 - RNA, 64 nt, Human
ugggcggguacagcgcggaggaggagggaggccaggcgggcauggcguggaggaggagggaggc

SEQ ID NO: 82033 - RNA, 64 nt, Human
cugguuuguugaugaauugagcaacugagaacguggcgggcacuaaacugacaguuccuuccuu

SEQ ID NO: 82034 - RNA, 64 nt, Human
gccggccgggggcgggggguggcgggcggcgggcggcgggcaggcgggugggggcacaccccuc

SEQ ID NO: 82035 - RNA, 64 nt, Human
uagcaggcugcugggcaguucugcucuguggaggggcgggcaccagcgccacuuaugugccucu

SEQ ID NO: 82036 - RNA, 64 nt, Human
ucuugccuguaaucccagcacuuugggaggcugaggcgggcagaucaccugagaucgggaguuu

SEQ ID NO: 82037 - RNA, 64 nt, Human
gucccagaaaugaggccauggcucacuguuucugggcgggcagaaggcucuguagagggagaug

SEQ ID NO: 82038 - RNA, 64 nt, Human
agcagggccuggcccacccaaggugccuggggcaggcgggcaccgucauucgcugccauuggcu

SEQ ID NO: 82039 - RNA, 64 nt, Human
cugacaguaugaccgaucucugcgccuuucugggggcgggcaagcuggcgguagauuugugaug

SEQ ID NO: 82040 - RNA, 64 nt, Human
uuuacuaaaaauauaaaaauuagcugggugugguggcgggcaccuguaaucccagcuacucggg

SEQ ID NO: 82041 - RNA, 64 nt, Human
gcccggaggaggcgcccgagggaccaggccuuccggcgggcaaggaccagggcgagcccuggag

SEQ ID NO: 82042 - RNA, 64 nt, Human
ucacgccuguaaucccagcacuuugggaggcugaggcgggcagaucaccugaggucaggaguug

SEQ ID NO: 82043 - RNA, 64 nt, Human
uguuccccaucuucagccugcaggcauacccggaggcgggcacgaucgagggccuggccucgcu

SEQ ID NO: 82044 - RNA, 64 nt, Human
uuaugccuguaaucccugcacuuugggaagccaaggcgggcagcucaccugaggucaggcguuc

SEQ ID NO: 82045 - RNA, 64 nt, Human
ggucacacuucguugagaaccaggagacacguguggcgggcagugggacccauagaucuucuga

SEQ ID NO: 82046 - RNA, 64 nt, Human
ccggggguggggcugcuuuugcuuccuuuagaggggcgggcagggagaggaagcucuagcuccg

SEQ ID NO: 82047 - RNA, 64 nt, Human
ggcagcuggauccucuuucaggcgggaaugggagggcgggcacagggaggaggagaggaagaga

SEQ ID NO: 82048 - RNA, 64 nt, Human
ucacgccuauaaucccagcacuuagggaggccaaggcgggcagaucaccugaggucaauaguuc

SEQ ID NO: 82049 - RNA, 64 nt, Human
ccucccguccguccgcccgcccaccccgcugccuggcgggcagccccugcuggaccaaggugcg

SEQ ID NO: 82050 - RNA, 62 nt, Human
cugccuaugaccgucacugacccuuggagccaggcgggcaccaaacacugauggcaccuauu

SEQ ID NO: 82051 - RNA, 64 nt, Human
gacugauagaaaguauuggcagaccaggcgugguggcgggcacuuguaaucccagcuacuccca

SEQ ID NO: 82052 - RNA, 64 nt, Human
auggggcugaagccucuggaggcaguugguugggggcgggcaggcaggaggcccucccuccacc

SEQ ID NO: 82053 - RNA, 64 nt, Human
cauccgggccugguagggacggggcgggucacgcggcgggcaccccagcgcagccuggcgccgc

SEQ ID NO: 82054 - RNA, 64 nt, Human
cacgccuguaaucccagcacuuuucagaggccaaggcgggcaaaucaccugaggucaagaguuu

SEQ ID NO: 82055 - RNA, 64 nt, Human
gcagaaaacaacagcagugagccagaggagcacaggcgggcaggucacugcagagacugaugga

SEQ ID NO: 82056 - RNA, 64 nt, Human
ugcgcauagcgcugggcguggacaggccggugagggcgggcaaggggccccagccgcugcagca

SEQ ID NO: 82057 - RNA, 64 nt, Human
uccuaaucugcacagacuauuuuggguauuucugggcgggcaguuccuuugcauguuucgggag

SEQ ID NO: 82058 - RNA, 64 nt, Human
caauaugacugguguuccuuauaagagaagauagggcgggcaugguggcucacgccuguaaucc

SEQ ID NO: 82059 - RNA, 64 nt, Human
cuaaaaauacaaaaaaaauuuagccgggcgcgguggcgggcaccuguagucccagcuacuuggg

SEQ ID NO: 82060 - RNA, 64 nt, Human
ucacgccuguaaucccagcaccuugggaggcugaggcgggcagaucaugaggucagaagauaaa

SEQ ID NO: 82061 - RNA, 64 nt, Human
gagcucccucugccugcgggaugagaccuuggcaggcgggcagcggcggaaacucagcucaagg

SEQ ID NO: 82062 - RNA, 64 nt, Human
acucuuucuccugucuuggguuggcuggcacuggggcgggcaucuaggguacagccucugcuca

SEQ ID NO: 82063 - RNA, 64 nt, Human
gaccccaucugcccaggacggggccggccaggugggcgggcagcacagcaaggaggcuggcugg

SEQ ID NO: 82064 - RNA, 64 nt, Human
augguggacccagcgggcagguucugccugcuuuggcgggcagacacgcgggcgcgaucccaca

SEQ ID NO: 82065 - RNA, 64 nt, Human
gggagcgucugccccagugaggaggcagguggccggcgggcacuguguacaggagcaggcugag

SEQ ID NO: 82066 - RNA, 64 nt, Human
ccuccacccuggccugggauuggccagggagcagggcgggcauugggaccaguguggagccuga

SEQ ID NO: 82067 - RNA, 64 nt, Human
agacuccugcugggaggguggaggcccaggaaugggcgggcaggacacccucauccaguccugc

SEQ ID NO: 82068 - RNA, 62 nt, Human
acgccuaccuccaucagugaaggcaacacccaggcgggcagagaagggcucagggcaccagc

SEQ ID NO: 82069 - RNA, 64 nt, Human
ucacgccuguaaucccagcacuuugggaggcugaggcgggcagaucacgaagucaggagaucga

SEQ ID NO: 82070 - RNA, 64 nt, Human
cucagggaaaggaaugccugggagugggggugcaggcgggcagcacugagggacccugccccgc

SEQ ID NO: 82071 - RNA, 64 nt, Human
gcugccagugagacagcgucuccucugggagcugggcgggcacagcauccucaguucugugccc

SEQ ID NO: 82072 - RNA, 64 nt, Human
uuugacaugaaggacaagaagacgcauggcucauggcgggcacaugcggcugccagugagacag

SEQ ID NO: 82073 - RNA, 64 nt, Human
ucacgccuguaaucccagcccuuugggaggcugaggcgggcagaucaccagaggucagguguuc

SEQ ID NO: 82074 - RNA, 64 nt, Human
cuugagccagccagcugggggcagagagguggguggcgggcaccucaugccagcugagaccaag

SEQ ID NO: 82075 - RNA, 64 nt, Human
ucaugccuguaaucccagcacuuugggaggccgaggcgggcagaucacgaggucaggaguucga

SEQ ID NO: 82076 - RNA, 64 nt, Human
uugguggugguggguuugggguggggaagggaagggcgggcaaggaguggggagggagucuggg

SEQ ID NO: 82077 - RNA, 57 nt, Human
aggaggagagccagcuguaggggcgggggcgggcagggagguauuuauuuauuuauu

SEQ ID NO: 82078 - RNA, 64 nt, Human
cuccgaccuucaucacuauucuuaggauaaugcuggcgggcagagaugaucaaucaucauauua

SEQ ID NO: 82079 - RNA, 64 nt, Human
ggcaucugcagagaggccugccuuccggauuccaggcgggcaugcccugcaaaccccgccuggg

SEQ ID NO: 82080 - RNA, 64 nt, Human
aauuuauugcuuuguuccccaacauggggaugggggcgggcaggggcguggggagggcguuuug

SEQ ID NO: 82081 - RNA, 64 nt, Human
acccugucucuacuaaauauuagcggggugugguggcgggcaccuguaaucgcagccuuucagg

SEQ ID NO: 82082 - RNA, 64 nt, Human
agauuucaaaaaccuuuuucuaauugggaguaauggcgggcacuuucaccaagauguucuagaa

SEQ ID NO: 82083 - RNA, 64 nt, Human
ucacgccuguaaucccagcacuuugggaggcugaggcgggcagaucacuugaggccaggaguuc

SEQ ID NO: 82084 - RNA, 64 nt, Human
ucacgccuguaaucccagcacuuugggaggcugaggcgggcagaucacaagaucaggaguucga

SEQ ID NO: 82085 - RNA, 64 nt, Human
gccuagccccaggucuuuucuuugggacccugggggcgggcauggaaguggaaguaggggcaag

SEQ ID NO: 82086 - RNA, 64 nt, Human
ucaagccuguaauccuagcacuuugggaggcagaggcgggcagaucacuugaggucaggaguuc

SEQ ID NO: 82087 - RNA, 64 nt, Human
aagaaagaugcucaagucccauggcacagagcaaggcgggcagggaacgguuauuuuucuaaau

SEQ ID NO: 82088 - RNA, 64 nt, Human
caggagugugaggacuacacuagugaaagcgccuggcgggcagccggcgaugcccaauaaaugu

SEQ ID NO: 82089 - RNA, 64 nt, Human
cuggccgagucacgcggaggggcccggcgucuguggcgggcacaggggcuucagagugacuccc

SEQ ID NO: 82090 - RNA, 64 nt, Human
cauccaguguaaaaaggaaguuggaaugggaguuggcgggcagugaacgaguguggggaaggau

SEQ ID NO: 82091 - RNA, 64 nt, Human
gcaagggggacagccagcggagaugaggggagcuggcgggcacagcccuuucucaggguuggac

SEQ ID NO: 82092 - RNA, 64 nt, Human
gcaggaguucuggucuuagcacgaaaaggauuggggcgggcaagggggacagccagcggagaug

SEQ ID NO: 82093 - RNA, 64 nt, Human
cuacuaaaaagacaaaaaauuagcugggcgugguggcgggcaccuauaaucccaccuacuuggu

SEQ ID NO: 82094 - RNA, 64 nt, Human
acucacaccugugaucggcacuucggaaggccgaggcgggcagaucacugaagcucaggaguuc

SEQ ID NO: 82095 - RNA, 64 nt, Human
aggguggugggccuuggaacgcugccuccacugaggcgggcacacaaggcggacccuccugaaa

SEQ ID NO: 82096 - RNA, 64 nt, Human
cugccugaugucccugguggagcagguaccuccgggcgggcaagccucugauuugcacaccuga

SEQ ID NO: 82097 - RNA, 64 nt, Human
acucaccuagcgaccugacuuacucuggaaucuuggcgggcaucgccgacccuauuauuccauu

SEQ ID NO: 82098 - RNA, 64 nt, Human
aaaaaaaauuaaaaagggggcuuugggaggccaaggcgggcagaucaugagggcaggagauuga

SEQ ID NO: 82099 - RNA, 64 nt, Human
cgcacacugugauggaggagacugagcucccuggggcgggcagcugacacuaccagagagacuc

SEQ ID NO: 82100 - RNA, 64 nt, Human
ucccucagcuugcggggaggugcggagggagaggggcgggcaggaaccggggcugcgcgcagcg

SEQ ID NO: 82101 - RNA, 64 nt, Human
gggccaucgugggccaagggcuggcgagggugggggcgggcaagggaugcaggcaggacagcca

SEQ ID NO: 82102 - RNA, 64 nt, Human
uggugggcuggccgcugugccaggcgaggcccuuggcgggcacgggugucacggccaggcagau

SEQ ID NO: 82103 - RNA, 64 nt, Human
cccagcaguggcaauggcgagcacccugcagcugggcgggcaggcggcaggcgcggaacugacc

SEQ ID NO: 82104 - RNA, 64 nt, Human
ucacgcauguaaucccagcacucugggaggcugaggcgggcagaucaccugaggccaggaguuc

SEQ ID NO: 82105 - RNA, 64 nt, Human
ugagccggacaccaagcccgccuccagcaccaagggcgggcagcacccuccgacccucccaugc

SEQ ID NO: 82106 - RNA, 64 nt, Human
uggcccagccuccccucccuccccuagaccacggggcgggcagcucggguuccuggagggcugu

SEQ ID NO: 82107 - RNA, 64 nt, Human
ccuccuccgugcgccucagacucggggugagggaggcgggcagccucucgccagccuucccguc

SEQ ID NO: 82108 - RNA, 64 nt, Human
aggagcaaagcaaccuggaggcugcauauccaugggcgggcagcauaagagaaugugaagcccu

SEQ ID NO: 82109 - RNA, 64 nt, Human
guaaauacugacuuacgaaaguugaauugggugaggcgggcaaaucaccugaggucagcaguuu

SEQ ID NO: 82110 - RNA, 64 nt, Human
cacagggcuagaggcccuaagacccugaaaaaggggcgggcaguagggaagguggaggcacacu

SEQ ID NO: 82111 - RNA, 64 nt, Human
ucgccccgcucucugcgcucugccgccgccuccgggcgggcagcuacgugccuggggcgcccgg

SEQ ID NO: 82112 - RNA, 64 nt, Human
aaguggcugugucacugcuauggacacggaguggggcgggcaucuggagagagagagggagcgg

SEQ ID NO: 82113 - RNA, 64 nt, Human
aggucgaagcagccucccaccagcgaucccuuggggcgggcaccuggcagugagggacagagcu

SEQ ID NO: 82114 - RNA, 64 nt, Human
gcggcgcuggcugccuggaugcugaccccagcgcggcgggcagagcggggcccacucuucuuag

SEQ ID NO: 82115 - RNA, 61 nt, Human
agaaggacuggaaggacugagcccagccagaggcgggcagggcagacugacggacggacga

SEQ ID NO: 82116 - RNA, 64 nt, Human
ucuacuaaaaauacaaaaauuagcuggacguguuggcgggcaucuguaauaccagcuacuuggg

SEQ ID NO: 82117 - RNA, 64 nt, Human
cuacuaaaaauacaaaaaauuagccaggcaugguggcgggcaccuguagucccagcuacuuggg

SEQ ID NO: 82118 - RNA, 64 nt, Human
ucacgccuguaaucccagcacuuuggggagcccaggcgggcagauugcuugaacccaggaguuc

SEQ ID NO: 82119 - RNA, 64 nt, Human
aggguaaaaccaggaccaauggguaaaaguaacaggcgggcagauuuuggcuugaggaagagcu

SEQ ID NO: 82120 - RNA, 64 nt, Human
cuggccaugaguguugugacugauggucaacccaggcgggcauuuuaauaaauggccugugauu

SEQ ID NO: 82121 - RNA, 64 nt, Human
aaaaaaaaaguacaaaaaauuagccgggcgugguggcgggcaccuguagucccagcuacacggg

SEQ ID NO: 82122 - RNA, 64 nt, Human
cucuacaaauaaauaaaaaauuagcugggcaauuggcgggcauggaggugggugcuuguaguuc

SEQ ID NO: 82123 - RNA, 64 nt, Human
cagcggaccccggccgggcagcggagaccgcagaggcgggcaggguggggcaggcgaguggugu

SEQ ID NO: 82124 - RNA, 64 nt, Human
uucaugucuaucagucugagcagacggugaguagggcgggcacauucuccaggcccuucuuccu

SEQ ID NO: 82125 - RNA, 57 nt, Human
cagccaccccugccaggugaggggcauggcgggcaggaggccacaccaggccccccg

SEQ ID NO: 82126 - RNA, 64 nt, Human
cuacuaaaaauacaaaaaauuagccgggcgugguggcgggcaccuguagucccagcuacucggg

SEQ ID NO: 82127 - RNA, 64 nt, Human
uuaccccaccccacccuugggcuaaaagcccccaggcgggcagggggugaccccuggagcuagu

SEQ ID NO: 82128 - RNA, 64 nt, Human
gcccgggccggagcgugcccggcggggcugcccgggcgggcagggggugggggcugcuccuuuc

SEQ ID NO: 82129 - RNA, 61 nt, Human
ugcagcggcuccgcaggugaggagcccauggggcgggcagcccccagaaagcgggcagcag

SEQ ID NO: 82130 - RNA, 64 nt, Human
ucaugccuauaauccuagcacuuugggaggccgaggcgggcagaucaccugaggucaggaguuc

SEQ ID NO: 82131 - RNA, 64 nt, Human
uugggaucccauuuugaaguccagagcuggagcaggcgggcagugcccugggagaccccgcucu

SEQ ID NO: 82132 - RNA, 64 nt, Human
ccuguaagaugcgggaagugucagcucccggcguggcgggcaggcucaggggaggggcgcgcau

SEQ ID NO: 82133 - RNA, 64 nt, Human
ucacgccuguaaucccagcacuuugggaggccgaggcgggcagaucacgaggucaggagaucga

SEQ ID NO: 82134 - RNA, 64 nt, Human
ggccaggcuugcggggaguucucuuccgccguguggcgggcaccgcccuggccuuccgcacccu

SEQ ID NO: 82135 - RNA, 64 nt, Human
ggcacuccuccuuguuagugucuuuccuugaaggggcgggcaccaggcuagguccggugccaau

SEQ ID NO: 82136 - RNA, 64 nt, Human
ucacgccuguaauuccagcacuuugggaggccgaggcgggcagaucacgaguucaggagaucga

SEQ ID NO: 82137 - RNA, 64 nt, Human
cgugggggcacugaccaggcccaaggaggguccaggcgggcaagucauccuccuggugcccaca

SEQ ID NO: 82138 - RNA, 64 nt, Human
cuccccuucccuccccgccaagagcucugccaggggcgggcaaaaaaaaaaguaaaaagaaaag

SEQ ID NO: 82139 - RNA, 64 nt, Human
uccaauccuuccuaacagugccuaccguggcgggggcgggcagggguucccauuuucgcuuucc

SEQ ID NO: 82140 - RNA, 55 nt, Human
acgagugcggcugccgcuaacccggggcgggcagggacgcgggcccaacaauaaa

SEQ ID NO: 82141 - RNA, 64 nt, Human
uggugguggacgagugcggcugccgcuaacccggggcgggcagggacgcgggcccaacaauaaa

SEQ ID NO: 82142 - RNA, 64 nt, Human
ggugggagagggagaccuagagaucuggcuguggggcgggcauggggggugaagggccacuggg

SEQ ID NO: 82143 - RNA, 64 nt, Human
gggcuucuccccucaaagccauaccccgccucugggcgggcaugggggguggugggugccagcc

SEQ ID NO: 82144 - RNA, 61 nt, Human
ccagcccaggugggccuuaaauggaggacuuggcgggcagcaggaggcaaggguuccucca

SEQ ID NO: 82145 - RNA, 64 nt, Human
uacuaaaaauacaaaaaaauuagccgggugcgguggcgggcaccuguagucccagcuacucggg

SEQ ID NO: 82146 - RNA, 64 nt, Human
ucaccccuguaaucucagcacuuuggguggccaaggcgggcagaugacuugaggucaggaguuc

SEQ ID NO: 82147 - RNA, 64 nt, Human
uacuaaaaauaaaaaaaaauuagccaggcaugguggcgggcaccuguagucccagcuacucagg

SEQ ID NO: 82148 - RNA, 64 nt, Human
ucaugccuguaauaccagcacuuugggaggcggaggcgggcagaucgcgaggucaggagaucga

SEQ ID NO: 82149 - RNA, 64 nt, Human
cuaaaccagcauaggauugauaggggagacgguuggcgggcauuuccguuucuaugugaccaag

SEQ ID NO: 82150 - RNA, 64 nt, Human
gaagaagcgguagaagaggaggccugaggagcugggcgggcagggagagggucuuggggacagc

SEQ ID NO: 82151 - RNA, 64 nt, Human
agcgucugaccaccgcccgcgcccacccggccacggcgggcacucagcauuuccugaugacaga

SEQ ID NO: 82152 - RNA, 64 nt, Human
gucuuuguaaauugacccuucuggaguggggggcggcgggcagggcugcuuuucuuagucugau

SEQ ID NO: 82153 - RNA, 64 nt, Human
aagugagcuggcaccuuguggggcucuugggaugggcgggcacccaagcccuggcuuguccuuc

SEQ ID NO: 82154 - RNA, 64 nt, Human
ucacgccuguaaucccaggacuuugggaggccaaggcgggcagaucaccggaggucaggaguuc

SEQ ID NO: 82155 - RNA, 64 nt, Human
ggcgcgcgggccgcgggcgacgggcgggugcgcgggcgggcaggggaccuuggcuaaggcgaga

SEQ ID NO: 82156 - RNA, 64 nt, Human
aaaaaaaaaauacaaaaaauuagccgggcguuguggcgggcaccuggagucccagcuacuccgg

SEQ ID NO: 82157 - RNA, 64 nt, Human
cucacgcccauaauccagcacuuugggaagccgaggcgggcagaucaccugaggucaggaguuc

SEQ ID NO: 82158 - RNA, 64 nt, Human
ccaaucuuccaagguggguguggggcacggugggggcgggcagcucccaggcccuugggcaggc

SEQ ID NO: 82159 - RNA, 64 nt, Human
cguucauucagcauuuauugugcaccuacuauguggcgggcauuugggauaccaagauaaauug

SEQ ID NO: 82160 - RNA, 64 nt, Human
ucacgccuguaaucccagcacuuuggcaggcugaggcgggcagaucaccugagaucaggaguuc

SEQ ID NO: 82161 - RNA, 64 nt, Human
aguaguuguagcugcgggagggggagggggagugggcgggcaguggauaguaagacuuacugca

SEQ ID NO: 82162 - RNA, 64 nt, Human
agcuccagguuugaaagacccaacuggagcguggggcgggcaggcagggguuagugaaaggaca

SEQ ID NO: 82163 - RNA, 64 nt, Human
gacaccccugagauggguguguuuauuugcucagggcgggcagccuauggugaagaggagacag

SEQ ID NO: 82164 - RNA, 64 nt, Human
aaaggggcuguuggccagcaauggcagcagcagcggcgggcagucugcccaagugucuuaggaa

SEQ ID NO: 82165 - RNA, 64 nt, Human
ugacucacccacucccuucccgggagacgaggagggcgggcagggaggugggcaucaggcccca

SEQ ID NO: 82166 - RNA, 64 nt, Human
agcccguccugguggcuguggaacugcacuggguggcgggcagaugguggaaggcagcuuagga

SEQ ID NO: 82167 - RNA, 64 nt, Human
uguuucaugugggcacuaacacgugugcguuccuggcgggcacacucaggaccgugccucacag

SEQ ID NO: 82168 - RNA, 64 nt, Human
gucugguggucuggcugcggggaaggggcaagaaggcgggcaggccuucacugcagcacugagc

SEQ ID NO: 82169 - RNA, 64 nt, Human
gcacagaccaaagaccgcgguccagccccgcccaggcgggcaucucauggcagugcggacccgu

SEQ ID NO: 82170 - RNA, 64 nt, Human
ccaucucuacuaaaauacaaaaauuaggugugguggcgggcaccuguaauccuggcuacucggg

SEQ ID NO: 82171 - RNA, 64 nt, Human
uccugccuauaaucccaguacuuugggaggccgaggcgggcagaucacuugaggucaggaguuc

SEQ ID NO: 82172 - RNA, 64 nt, Human
ucaugccuguaacccuagcacuuugggaggcugaggcgggcagaucacuugagguuaggaguuu

SEQ ID NO: 82173 - RNA, 64 nt, Human
cauccaaguggccuccgucacuaccuggcugcggggcgggcacaccuccucccacugcccacug

SEQ ID NO: 82174 - RNA, 64 nt, Human
gacaaaucgcucuagcucagaaguugcagagcagccugggcaacauggugaaacccgucucuac

SEQ ID NO: 82175 - RNA, 64 nt, Human
cccucccugggauauguaugccucgcccgcccucccugggcacaugugcacacgugcccaggca

SEQ ID NO: 82176 - RNA, 64 nt, Human
uccagugagccaagguugugccacugcacuccagccugggcaaaaaagcaaaacuccaucucaa

SEQ ID NO: 82177 - RNA, 64 nt, Human
ugggcacugccgagaacagcauuggucccagagcccugggcaucagaccuuaaccaccaggccc

SEQ ID NO: 82178 - RNA, 64 nt, Human
gggcccaggcaggccaccauauucagugcuguggccugggcaagauaacgcacuucuaacuaga

SEQ ID NO: 82179 - RNA, 64 nt, Human
acaaaucagaaauccacauaaaagugcucuccugccugggcagcaacaaccaagaacaaagccc

SEQ ID NO: 82180 - RNA, 64 nt, Human
gagguugcagugagauugcaccauugcauuccagccugggcaacaagagggaaacuccgucuca

SEQ ID NO: 82181 - RNA, 64 nt, Human
ugccgugaguugagauuggaccacugcucuccagccugggcaacagaguaaaacucugucccaa

SEQ ID NO: 82182 - RNA, 64 nt, Human
ggcccucccucagcggagggguuugggagucaggccugggcaggacccugcugacucguggcgc

SEQ ID NO: 82183 - RNA, 64 nt, Human
cccgggguccccuugcugcugugggcucccugucccugggcaggagugcuggugaggaggugga

SEQ ID NO: 82184 - RNA, 64 nt, Human
uugagauguccaaacacccagggcugcugcucauccugggcaagcugauccugcugcaccacaa

SEQ ID NO: 82185 - RNA, 64 nt, Human
gccaggcacccacagccucagcuccugugcaguuccugggcagcacaguggaagugggagccug

SEQ ID NO: 82186 - RNA, 64 nt, Human
guccccagccccugcuacuggcuggacccucugcccugggcaggaggucaggggauucuguuuu

SEQ ID NO: 82187 - RNA, 64 nt, Human
aucgguacgucugagcccaagaguucaagaucagccugggcaguauagcaagaccccaucucca

SEQ ID NO: 82188 - RNA, 64 nt, Human
ccugagugccuggcucgcaccucucgagcugugcccugggcaucacugagcagaggggugcggc

SEQ ID NO: 82189 - RNA, 64 nt, Human
ggguucccaugcuuuguaggugucucauagcuauccugggcauccuucuuucuaguucagcugc

SEQ ID NO: 82190 - RNA, 64 nt, Human
acguugccacaccaaucagagagccuagaacaucccugggcaaguggauggcccagcaggcagg

SEQ ID NO: 82191 - RNA, 64 nt, Human
ggaaguuucagaacccacuuuggggggccuccugccugggcaggcucuucaaguguggcccucu

SEQ ID NO: 82192 - RNA, 64 nt, Human
cucuacugggggaugagagaaaggcauuuuauagccugggcauaagugaaaucagcagagccuc

SEQ ID NO: 82193 - RNA, 64 nt, Human
cuugagcacaggaguuugaggcugcagugagcagccugggcaagagagugagacuccguuuugu

SEQ ID NO: 82194 - RNA, 64 nt, Human
gaauggggucccagauggcucaggcugugaccucccugggcaccacccuccccaggcugggugu

SEQ ID NO: 82195 - RNA, 64 nt, Human
ugcacugagcugagauugugccacugcacuccagccugggcaacaagagcaaaacucugucugg

SEQ ID NO: 82196 - RNA, 64 nt, Human
uuccccaauggaggccccuggcauaggggacagcccugggcaucuuccuuuggugucuggcugu

SEQ ID NO: 82197 - RNA, 64 nt, Human
uuuaaauuuuucuguauauagaaaggaaaacuagccugggcaacaugaugaaaccccaucucca

SEQ ID NO: 82198 - RNA, 64 nt, Human
auucaggaacaaaaccagcuugcuuuguugcacgccugggcaauuucagccaggacauuaggac

SEQ ID NO: 82199 - RNA, 64 nt, Human
uggggggcuggccccucuagccuuuccgguccuuccugggcaaaucuaagccuuggccagggcc

SEQ ID NO: 82200 - RNA, 64 nt, Human
ccccacauguaucccucggucugaauuagacauuccugggcacaggcucuugggugcauugcuc

SEQ ID NO: 82201 - RNA, 64 nt, Human
ggaggauggcuugaagccaguaguucaagaccagccugggcaacauaguaagaccccaucucua

SEQ ID NO: 82202 - RNA, 64 nt, Human
ugcagugagcugugauugugccacuguuuuccagccugggcaauacagugagacccugucucaa

SEQ ID NO: 82203 - RNA, 64 nt, Human
ggagaauugcuugaguccaggaguuugagaugcgccugggcaacauagaaaccugugucuacaa

SEQ ID NO: 82204 - RNA, 64 nt, Human
ugcagugagcugagaucgcaccauuacacuccagccugggcaacagagccagacucugucucaa

SEQ ID NO: 82205 - RNA, 64 nt, Human
ggaggaucacuugaguccagaaguuugagaucagccugggcaaugugauaaaaccccaucucua

SEQ ID NO: 82206 - RNA, 64 nt, Human
cccaugggaauccuguccugccucgaaggagcagccugggcagccaucacaccacgaggacagg

SEQ ID NO: 82207 - RNA, 64 nt, Human
cccuguccaaggaccuucccucuucuccccaguuccugggcaaucacuucaccuuggacaaagg

SEQ ID NO: 82208 - RNA, 64 nt, Human
gagcccuuauaccuuggcauggagucccaaaggcccugggcacaggcagagagcccaccggcug

SEQ ID NO: 82209 - RNA, 64 nt, Human
acccugcaacuccuauuaguaucgccugguugggccugggcaaugggaaggagccagaaaugcc

SEQ ID NO: 82210 - RNA, 64 nt, Human
ugcagugagccgagagugcaccauugcacuccagccugggcaaaaagagcaaaacuccgucuaa

SEQ ID NO: 82211 - RNA, 64 nt, Human
ugcuugcuggugccugccaccuucaaguucuggaccugggcaugacauccuuucuuuuaaugau

SEQ ID NO: 82212 - RNA, 64 nt, Human
guaaugugaggaagcaccucugugucagggcucaccugggcauccaaagcggccacgcccacaa

SEQ ID NO: 82213 - RNA, 64 nt, Human
acacauucaaaccacaggagaaacucaaauuguuccugggcaaaucacaacauggggaauuuua

SEQ ID NO: 82214 - RNA, 64 nt, Human
gggacccacgugggagccuggaucccuggacuguccugggcauagguuucaggggccuccuuug

SEQ ID NO: 82215 - RNA, 64 nt, Human
ggccagggcacccaguccagaaggagcaauggcaccugggcagugccagggcuuaaagcccgcu

SEQ ID NO: 82216 - RNA, 64 nt, Human
uauguuaucuuuucuuuuauuuuucuaaugagguccugggcagagagugaaaaggccucuccug

SEQ ID NO: 82217 - RNA, 64 nt, Human
agauuauugccugagcucaggaguucgaaaccacccugggcaacauggugaaacccccgucucu

SEQ ID NO: 82218 - RNA, 64 nt, Human
ugguuuuuuaaacuuuuaaguccugcucuauuuuccugggcagguuuauguugauguuuaccca

SEQ ID NO: 82219 - RNA, 64 nt, Human
cuccaugggccaccgcccagcucauguaggugagccugggcagcuucuguuggcagagcuuuug

SEQ ID NO: 82220 - RNA, 64 nt, Human
ccacuucccuacugcucauaugcacgcuggcuccccugggcacgcaaggaugaguaugggccau

SEQ ID NO: 82221 - RNA, 64 nt, Human
ugcagugacccaagauugugccacugcacuccacccugggcaacagagcaagaccccaucucaa

SEQ ID NO: 82222 - RNA, 64 nt, Human
uaccuucaucacugaccuggugguggggcugugaccugggcagcucaagacuggugccccuugc

SEQ ID NO: 82223 - RNA, 64 nt, Human
ggcuccugagcuucaugguggagaagggccccacccugggcaguauagagacgucggacuucac

SEQ ID NO: 82224 - RNA, 64 nt, Human
ugggcagccggccuggcuugaaguccgccaugacccugggcacaggggaagcccagccgugggc

SEQ ID NO: 82225 - RNA, 64 nt, Human
cccgugaggagcuucccgcagccgccuggcccagccugggcacguucuccgaggcaugugucuc

SEQ ID NO: 82226 - RNA, 64 nt, Human
ucuuuacacugacuucaggauagaugcugggaugccugggcauggccacauguuacauguacag

SEQ ID NO: 82227 - RNA, 64 nt, Human
gcgcgugaggagucccacugcuucuaaaggaaguccugggcaggagguggcuuuggugguuggu

SEQ ID NO: 82228 - RNA, 64 nt, Human
ccccuuuuccacacuccuccuccgacagcagcucccugggcaguggccuggucucaccgugugc

SEQ ID NO: 82229 - RNA, 64 nt, Human
ugcagugagcugagauugcgccacugcacuccagccugggcaacagagcgagacuccgucucaa

SEQ ID NO: 82230 - RNA, 64 nt, Human
gcuugaggagccacggaguuugggggccacagcaccugggcacacacccgagcaccuguccauu

SEQ ID NO: 82231 - RNA, 64 nt, Human
uucagugagcccagaucgcgacacugcacuccagccugggcaacagagugacacucugucucaa

SEQ ID NO: 82232 - RNA, 64 nt, Human
ugcagugagcugagaucacgccauugcacuccagccugggcaacaguguuaagacucugucuca

SEQ ID NO: 82233 - RNA, 64 nt, Human
ucccuucccuguuccccagagagcccaccuccgcccugggcaggagccccucggaggcuguaua

SEQ ID NO: 82234 - RNA, 64 nt, Human
uuagugccggcuguggagcaaaaggcagcucaccccugggcaggcgguccccauccccaccagc

SEQ ID NO: 82235 - RNA, 64 nt, Human
ugcagugagccaaaaucacgccacugcacuccagccugggcaacagagugagacuccgucucaa

SEQ ID NO: 82236 - RNA, 64 nt, Human
uagaauucuccaucuauccaggcuccaggagaccccugggcaucucccaccuguggccccuaaa

SEQ ID NO: 82237 - RNA, 64 nt, Human
ugcagugagccaagauggcaccauugcacucuagccugggcagcagagcgagacccugucucaa

SEQ ID NO: 82238 - RNA, 64 nt, Human
ggcagauggcuugaguccaggaguucaagacuagccugggcaauguggcaaaaccgcguguuua

SEQ ID NO: 82239 - RNA, 64 nt, Human
cacuggugggccauuagauuuggaggcuaccucaccugggcagggaugauggcagagccaggcu

SEQ ID NO: 82240 - RNA, 64 nt, Human
auguguauaauuaacaaaccuguguaugcuuaugccugggcaacuauuuuuuguaacucuugug

SEQ ID NO: 82241 - RNA, 64 nt, Human
gccuggggcuggcccugcucagacaaaucugcucccugggcaucuuuggccaggcuucugcccu

SEQ ID NO: 82242 - RNA, 64 nt, Human
uagaugugcgugcagucuggcagccuuaagcccaccugggcacuuuuagauaaaaaaaaaaaaa

SEQ ID NO: 82243 - RNA, 64 nt, Human
gcaguagagaaaaauguaagauaggaaguacuagccugggcaacguggcgaaacccugucucua

SEQ ID NO: 82244 - RNA, 64 nt, Human
gugugaagguuucagugaacugagaucacuccaaccugggcaauaaagccagacucugucucaa

SEQ ID NO: 82245 - RNA, 64 nt, Human
uuggcgggggugcugggccuguuguuuuccuuugccugggcauucuccucauguuucccaccug

SEQ ID NO: 82246 - RNA, 64 nt, Human
gggagcucauggugagggauacccaucccauaugccugggcagaaggaagacuucaucccucug

SEQ ID NO: 82247 - RNA, 64 nt, Human
ggagaacugcuugagcccaggaguucagaaucagccugggcaacauagcaauacuccgucucau

SEQ ID NO: 82248 - RNA, 64 nt, Human
gugaaaccccaucuguacuaaaaauacaagauuaccugggcaugguggugcaugccuauaaucc

SEQ ID NO: 82249 - RNA, 64 nt, Human
cacuccaccgugccgaaggagcucugccagugggccugggcaggcagccacagagggcauguua

SEQ ID NO: 82250 - RNA, 64 nt, Human
ggaagauggcuugaacucaggaguucgagacuagccugggcaacgugaugagacuccgucucua

SEQ ID NO: 82251 - RNA, 64 nt, Human
cagccccauguguucucuuaaacugagaauugcaccugggcaauuccuguuuucuaaggugguc

SEQ ID NO: 82252 - RNA, 64 nt, Human
agcccugcgccuguuaccacggaugcccacagggccugggcaguugcuguggcgacaggaagag

SEQ ID NO: 82253 - RNA, 64 nt, Human
ggcaggcagacugagcucaggagcuugagaccagccugggcaacauggcaaaaacccaccucua

SEQ ID NO: 82254 - RNA, 64 nt, Human
uuggacacugaggccuuucagagcucaguagaauccugggcaacuaccuaugguucaaaaaaua

SEQ ID NO: 82255 - RNA, 64 nt, Human
ggaggaucacuugaggccaggaguuugagaccagccugggcaacauagugagaucccaucucaa

SEQ ID NO: 82256 - RNA, 64 nt, Human
agaggaucaguugaggccaggaguuuaagaccagccugggcaacauagugagaccccugucucc

SEQ ID NO: 82257 - RNA, 64 nt, Human
guuuugaaggugcugggacucuggugcccccaacccugggcauccucaggcuuugaggagaaua

SEQ ID NO: 82258 - RNA, 64 nt, Human
ugugaugcccaugacaccugcaaaauaaguucugccugggcauuuuguagauauuaacagguga

SEQ ID NO: 82259 - RNA, 64 nt, Human
ugcagugagccaagaucaugccacaucacuccaaccugggcaacagaacaagaacccaucucaa

SEQ ID NO: 82260 - RNA, 64 nt, Human
auggagcagauacucaaggaggcacugggcucagccugggcauuaaagggacagagucagcuca

SEQ ID NO: 82261 - RNA, 64 nt, Human
gcagcucugcugcugugaucugcacacccuccaaccugggcagggacuggggggaugcagugug

SEQ ID NO: 82262 - RNA, 64 nt, Human
gguggggcaggcuggggcugccaaccugauccugccugggcaacccuuuccugucccaggcccu

SEQ ID NO: 82263 - RNA, 64 nt, Human
uucccgggaaguuguuuggugaaggaagccccucccugggcauuuucugccuaugcuggaauag

SEQ ID NO: 82264 - RNA, 64 nt, Human
ccuccggccugcacucccccaguucccgggcccuccugggcaccccaggcagcuccuguuugga

SEQ ID NO: 82265 - RNA, 64 nt, Human
agaggugcaggcuggcaccugcggcagguaccagccugggcacugguggccgccucccuguccc

SEQ ID NO: 82266 - RNA, 64 nt, Human
gcaguaagccaagaucacaccacuggcacuccagccugggcaacagagugagacccugucucaa

SEQ ID NO: 82267 - RNA, 64 nt, Human
gaccccaucucuauuuaaaaaaugaacaaaauuaccugggcauagugguguauaccuguagucc

SEQ ID NO: 82268 - RNA, 64 nt, Human
agcuaagcauuuuuuaaauugaguuugagacuagccugggcaacauagugagaccccaucucua

SEQ ID NO: 82269 - RNA, 64 nt, Human
gggccagggccccccagggccuaucgugggagagccugggcaggaucccaucagaaaggugcug

SEQ ID NO: 82270 - RNA, 64 nt, Human
cccugugagacuccuccuugugaagggccagggcccugggcaggccuccagcucgguccaggug

SEQ ID NO: 82271 - RNA, 64 nt, Human
cucuguacagucucaguugcuugcucuugugccuccugggcaagggcugaaggaggccacucca

SEQ ID NO: 82272 - RNA, 64 nt, Human
cauggugagccgagaucacgccacugcacuccagccugggcaacagagcgagacucuaucucaa

SEQ ID NO: 82273 - RNA, 64 nt, Human
ugcagugagcugagaucacaccauugcgcuucagccugggcaacaagagugaaacuccaucucc

SEQ ID NO: 82274 - RNA, 64 nt, Human
gguggaucacuugagcucaggaguuugagaccagccugggcaauaucgugagaccccaucucua

SEQ ID NO: 82275 - RNA, 64 nt, Human
uugcagagccagguuuugcugguuuggggcaugcccugggcaccagagcuuuaacauuugaagc

SEQ ID NO: 82276 - RNA, 64 nt, Human
agauguccuauaauaaaggggcuucugggaggugccugggcacagaugucuguucagcaggugu

SEQ ID NO: 82277 - RNA, 64 nt, Human
cuggagaggugggcuccccucgugcacuuuauugccugggcaguuuugcuugaucuuuugugac

SEQ ID NO: 82278 - RNA, 64 nt, Human
auaucauuucauaaaaaucccucuuccuccaaagccugggcagaaaugugcugcaaagaguuau

SEQ ID NO: 82279 - RNA, 64 nt, Human
ugcggugagcugagaucgugccacugcacuccagccugggcaacaagagcaaaaaucccucuca

SEQ ID NO: 82280 - RNA, 63 nt, Human
cccuggaccaggccaccugagccaggccuucuaccugggcagcaccucugccgacgccguccc

SEQ ID NO: 82281 - RNA, 64 nt, Human
aguggccagauguguuccccccaugggugagaggccugggcaacugccuggugaaugugucuug

SEQ ID NO: 82282 - RNA, 64 nt, Human
aguguuauuaaaaaauuacaaaggccuagaccagccugggcaacauggugaaaccccaucucua

SEQ ID NO: 82283 - RNA, 64 nt, Human
ugcagugaaucaugaucaugccacuguacuccagccugggcaacagagaccaucuuaaaaaaaa

SEQ ID NO: 82284 - RNA, 64 nt, Human
ugcagugagcagagaucgcaccacugcacuccagccugggcaagagugagacugugucucaaaa

SEQ ID NO: 82285 - RNA, 64 nt, Human
caagauggacacgagccacaagcugcacugugaaccugggcacuccgcgccgaugccaccggcc

SEQ ID NO: 82286 - RNA, 64 nt, Human
ugcuauucguccuguaggugcugugguggauggaccugggcagagggcacuucucucucuuacc

SEQ ID NO: 82287 - RNA, 64 nt, Human
ggaggaucacuuagguccaggaguucgagacuagccugggcaacauagugagacaccggaucua

SEQ ID NO: 82288 - RNA, 64 nt, Human
ugcagugagccgugauugcaccacugcacuccagccugggcaacagagcaagacccugucuugg

SEQ ID NO: 82289 - RNA, 64 nt, Human
ggcggaucacuugagcucaggaauucaaggucagccugggcaacauggcuaaacucugucucua

SEQ ID NO: 82290 - RNA, 64 nt, Human
ccacgcucccgcccaccuuccccaguagcccaggccugggcagcaagcgcagccuggaggaaga

SEQ ID NO: 82291 - RNA, 64 nt, Human
cacggaugccuuccccugggcccugacauuggagccugggcauccucagguggucaggcguaga

SEQ ID NO: 82292 - RNA, 64 nt, Human
cgagccuaaggccacccagcggcagcgcccguguccugggcacucagcgugcugggcagagcag

SEQ ID NO: 82293 - RNA, 64 nt, Human
gcaguugagccaagaucacgacacugcacuccagccugggcaacggagacucugucucaaaaaa

SEQ ID NO: 82294 - RNA, 64 nt, Human
cagugugacuagggcaacgugccccccagaacucccugggcagagccagcucgggugaggggug

SEQ ID NO: 82295 - RNA, 64 nt, Human
ggcuucugggggagagcuuggggcagcagaggccccugggcagcccagccaggggagccacagc

SEQ ID NO: 82296 - RNA, 64 nt, Human
gggggacugcuugagcucaggaguucgagaccagccugggcaacaaagugagacuccaucucua

SEQ ID NO: 82297 - RNA, 64 nt, Human
cggaggugggagaaaaucugggcacauggggcccccugggcagugcaggacaacaucagcucac

SEQ ID NO: 82298 - RNA, 64 nt, Human
caugcuguccccaacagcugggguggcacucugcccugggcacccaugacccucugcugucucu

SEQ ID NO: 82299 - RNA, 64 nt, Human
cuuucuuguaaugaaacucuucaccuuuaggagaccugggcaguccugucaggcagcagcgauu

SEQ ID NO: 82300 - RNA, 64 nt, Human
augcauaaaacauuuuucaaaauugaaauauuuuccugggcauuaaaaaccuuuacuauuggcu

SEQ ID NO: 82301 - RNA, 64 nt, Human
ugcagugagccaugauggcaccacugcacucuagccugggcaagagaacaagauccugucucaa

SEQ ID NO: 82302 - RNA, 64 nt, Human
gugauugugccuacgaauagccacugcauaccaaccugggcaauauagcaagaucccaucucuu

SEQ ID NO: 82303 - RNA, 64 nt, Human
cuggccaguugcauaauaacugcaaaauuguguaccugggcaaucuguuuuuuaaccaccucug

SEQ ID NO: 82304 - RNA, 64 nt, Human
ugcagugagcugggauuacaccauugcauuccagccugggcaacagagcaagacugucucaaaa

SEQ ID NO: 82305 - RNA, 64 nt, Human
cuuuucuucugcuuucuucccuccaagagcaaaaccugggcaaggggacuuacugagugggggu

SEQ ID NO: 82306 - RNA, 64 nt, Human
gaaggaccgguugggggagccgggcaugugaggcccugggcaaggggauggggcugugggggcg

SEQ ID NO: 82307 - RNA, 64 nt, Human
agccuguggccucugcgccuccugccacugaggcccugggcagaugcugcagcccgcccccuuc

SEQ ID NO: 82308 - RNA, 64 nt, Human
gcugugggccagggaauccagcggcgucuggccuccugggcacugcuugccuggccucgugcuu

SEQ ID NO: 82309 - RNA, 64 nt, Human
aggccugagcagugcucucggcaucggaccaaagccugggcacacccugccucucuccccagag

SEQ ID NO: 82310 - RNA, 64 nt, Human
ugaagauggcgugcacaggacacagcgugggcggccugggcagaagggcggcuggcuguccugg

SEQ ID NO: 82311 - RNA, 64 nt, Human
ugcagugagcgaagaucgagccacugcacuccagccugggcagcugaacaagacuccgucucaa

SEQ ID NO: 82312 - RNA, 64 nt, Human
ugggucauagcuuuccccacagcucagccuggggccugggcagggcucccagccugcaccgccu

SEQ ID NO: 82313 - RNA, 64 nt, Human
ggaggauugcuuaagcccaggagcucaagucccaccugggcaacauaguaagaucuugucucuu

SEQ ID NO: 82314 - RNA, 64 nt, Human
gcugagagggccucuccccugcagcaaacguuugccugggcauugaggcauuuccauacaucuu

SEQ ID NO: 82315 - RNA, 64 nt, Human
caggcccugucuccccagcauccucccugguggcccugggcaggugcacugacacccccaccuu

SEQ ID NO: 82316 - RNA, 64 nt, Human
ucgucuuugcuuguccugcucagaugcuggucauccugggcauguccccaguguggacucugga

SEQ ID NO: 82317 - RNA, 64 nt, Human
ugaaaagaacuuaaggccacaauucacgucucguccugggcauugugauggauugacccuccau

SEQ ID NO: 82318 - RNA, 64 nt, Human
ccaguggcucucaacccaugcgcuaccaaauacgccugggcagccgggacgggccggcgggcac

SEQ ID NO: 82319 - RNA, 64 nt, Human
uggaaacacggcuaugaccaaagggagaucccagccugggcaggcugcgcugcugaccacccuc

SEQ ID NO: 82320 - RNA, 64 nt, Human
agguugcagugagccgagaucgagccacugcacuccugggcaacagagcaagacuucgucucaa

SEQ ID NO: 82321 - RNA, 64 nt, Human
ggaggcucucuugagaauaggaguucaagaccagccugggcaacauagcaagauccugucucuc

SEQ ID NO: 82322 - RNA, 64 nt, Human
accguugccugcuggcggcucucauggggaagcgccugggcacuggggauugcuuguggcccac

SEQ ID NO: 82323 - RNA, 64 nt, Human
gguccgaucuuugacucuuuugccauuaaacuuaccugggcauucuuguuucaauuccaccugc

SEQ ID NO: 82324 - RNA, 64 nt, Human
cauccagcauacggccaaugucacaacaaucagcccugggcagacacgagcaggagggagagac

SEQ ID NO: 82325 - RNA, 64 nt, Human
ggaggaucauuugagcucaggaguuccagaccagccugggcaacauagcaaaaucucaucucua

SEQ ID NO: 82326 - RNA, 64 nt, Human
uacugugagccaugaucaugccacugcacuccagccugggcaacagagugagacccugucucca

SEQ ID NO: 82327 - RNA, 64 nt, Human
gugguaguucuaaauuuuaauugcaccugaaaaaccugggcaccuaagcaaugagccacagcaa

SEQ ID NO: 82328 - RNA, 64 nt, Human
ugcagugagucgagauugcaccacuacacuccagccugggcaacagagagcgacucucucaaaa

SEQ ID NO: 82329 - RNA, 64 nt, Human
uguggugagccaacaucacaccauugcacuccagccugggcaacaagaguaaaacucugucuca

SEQ ID NO: 82330 - RNA, 64 nt, Human
aaccugugagucucuucugcaugcaggaguuucuccugggcagcuggucacuccccagagaagc

SEQ ID NO: 82331 - RNA, 64 nt, Human
ggacagcuggaccccugaacuuccucuccucuuaccugggcagaguguugucucuccccaaauu

SEQ ID NO: 82332 - RNA, 64 nt, Human
ggaguuuugcuugaggccagagguucaagaccagccugggcaacacagugacaccugacucuac

SEQ ID NO: 82333 - RNA, 64 nt, Human
cugccaaaauuauauuaauagugaguuucaggccccugggcauuuuguaccauguaauuauccu

SEQ ID NO: 82334 - RNA, 64 nt, Human
ugccgugagccaagaucacgccacugcacuccagccugggcaacagagcaagacucugucucaa

SEQ ID NO: 82335 - RNA, 64 nt, Human
cguggggaagaggggacuuggcacgcaguggcuaccugggcauuuguggucauuucaguuucca

SEQ ID NO: 82336 - RNA, 64 nt, Human
ggggugggcagggcuccagaaagucagcagugugccugggcacccaccccauccucuaccugcc

SEQ ID NO: 82337 - RNA, 64 nt, Human
ggaggauugcuugaguccaggaguuugagaccagccugggcaacauggcgagacccuguuucua

SEQ ID NO: 82338 - RNA, 64 nt, Human
cuaccaugcaugguaguguguuggggguggggguccugggcacuggcugugugaagggaucugg

SEQ ID NO: 82339 - RNA, 64 nt, Human
ggggugcugggggucugcagcagaaagaaaggggccugggcagcagguguggccagucccucug

SEQ ID NO: 82340 - RNA, 64 nt, Human
ugcagugagccaggaucgcgccauugcacuccagccugggcaacaagagcgaaacucuugucug

SEQ ID NO: 82341 - RNA, 56 nt, Human; identical to SEQ ID NO: 78858

SEQ ID NO: 82342 - RNA, 64 nt, Human
cucgccaaucccaagagucuggccucccuccagcccugggcagacugaccagcaagguggaccu

SEQ ID NO: 82343 - RNA, 64 nt, Human
gaucugaguugcagcucugcacccuaaaucacacccugggcauugucugggcugcagggcugcc

SEQ ID NO: 82344 - RNA, 64 nt, Human
cauccuagucuguccuggucccuggcaacaggaaccugggcagcuuauccugcccacagguaag

SEQ ID NO: 82345 - RNA, 64 nt, Human
ugcagugagccaagauugcgccguuguacuccagccugggcaacagagcaagacccaucucaaa

SEQ ID NO: 82346 - RNA, 64 nt, Human
cuuguuuuuaacacacgcuccagcccuucaucagccugggcagucuuaccaaaauguuuaaagu

SEQ ID NO: 82347 - RNA, 64 nt, Human
agaggguuagucuccauccugcucagauaugacuccugggcaauucacuuaacuucuccauggc

SEQ ID NO: 82348 - RNA, 64 nt, Human
gguggauugcuugagcccaggaguucaagaccagccugggcaacacagcgagaccccaucucuu

SEQ ID NO: 82349 - RNA, 55 nt, Human; identical to SEQ ID NO: 78866

SEQ ID NO: 82350 - RNA, 64 nt, Human
guauucauuuuuucuacccuuuccuuuguaaguuccugggcaaccuuuuugauuucuuccagaa

SEQ ID NO: 82351 - RNA, 64 nt, Human
ugcucuuuuucccucugguggaaaaaaaauuaaaccugggcauuucauggguuuucuuucuuua

SEQ ID NO: 82352 - RNA, 64 nt, Human
cugcccccagcccacugagggggugggcuuacucccugggcagucuugggggccagagcugagg

SEQ ID NO: 82353 - RNA, 64 nt, Human
ggcagaucacuugagcucaggaggucaagaucagccugggcaacauggugaaaccuggucucua

SEQ ID NO: 82354 - RNA, 64 nt, Human
gaggugaucacuugagcccaggaguaaagaccagccugggcaacauagugagacuccgucucua

SEQ ID NO: 82355 - RNA, 64 nt, Human
gaaggaucacuugagcccagaaguucgagacuagccugggcaacauggagaagcccugucucua

SEQ ID NO: 82356 - RNA, 62 nt, Human
ugcaaugugugaucuugugacaggccugaggcccugggcacagugacgguggccuggccagc

SEQ ID NO: 82357 - RNA, 64 nt, Human
ccaggagauggaguuggcagugagccaagauuagccugggcaacagugagugagacucggucuc

SEQ ID NO: 82358 - RNA, 64 nt, Human
uacaagugggaccgguggagcagccccugggcucccugggcaggggaguucugaggcuccugcu

SEQ ID NO: 82359 - RNA, 64 nt, Human
auaugccccagccccuguaccaccccugcuguugccugggcagggggaagggggggcacggugc

SEQ ID NO: 82360 - RNA, 64 nt, Human
uggcacagaaaacauagccaccauuuuguccaagccugggcauggguggggggccuugucugcu

SEQ ID NO: 82361 - RNA, 64 nt, Human
uaauucuagagucucuguuacugcuugggcuauaccugggcauacuaauaaaguaugguauuga

SEQ ID NO: 82362 - RNA, 64 nt, Human
ggaggauugccugaggccaggaguuugacaccagccugggcaacauagugagaccuugucucua

SEQ ID NO: 82363 - RNA, 64 nt, Human
acacguacuucuaccacccugaacccacugcugcccugggcagugaguggcuuguuuuuucucc

SEQ ID NO: 82364 - RNA, 64 nt, Human
ugcagugagcugagacugcaccauugcauuccagccugggcaacaagagugaaacugcaucuca

SEQ ID NO: 82365 - RNA, 64 nt, Human
uaagggucgcuugaagcugagaguucaagaccaaccugggcaacauagugagacccccaucucu

SEQ ID NO: 82366 - RNA, 64 nt, Human
guugcugcugccccacuacaggccccacaccugcccugggcaugcccagccccugguggugggg

SEQ ID NO: 82367 - RNA, 64 nt, Human
gggcggauaguugagcccaggaguucgagaccagccugggcaacauggcaagaccuugucucua

SEQ ID NO: 82368 - RNA, 64 nt, Human
cucaugaggacugugugaccugcacaagcccacaccugggcaggcuguuggugucuccuugguc

SEQ ID NO: 82369 - RNA, 64 nt, Human
ggacagacuggaaaggaccacagaccuggccaucccugggcagcagggccagugucaccugcug

SEQ ID NO: 82370 - RNA, 64 nt, Human
ugcuaagcaaugaauauuaaggacucucuagcugccugggcauuacuguugcuaaaagaagaaa

SEQ ID NO: 82371 - RNA, 64 nt, Human
ugcaguaagcugagaucccaccauugcacuccagccugggcaacagagugagacuccaucucaa

SEQ ID NO: 82372 - RNA, 64 nt, Human
ccuugugaugggcagugagacaagggauguucuaccugggcauguccccagcgaggggguuggg

SEQ ID NO: 82373 - RNA, 64 nt, Human
ggaaggcugcuggaaacugagaguucaagaccagccugggcaacauagugagacccugucucua

SEQ ID NO: 82374 - RNA, 64 nt, Human
ggaccacccaagggugaggagaggggcuggaagcccugggcauuaggagaagggagugggugcu

SEQ ID NO: 82375 - RNA, 64 nt, Human
ccaggagccacggccugcuguugcuucagccuggccugggcagcccuggaagcucggaggagag

SEQ ID NO: 82376 - RNA, 64 nt, Human
augccccugaguucuuuuggucccagagaggcagccugggcagucuguuuacagcuggcaaaca

SEQ ID NO: 82377 - RNA, 64 nt, Human
ugaggaagggagaaggcagaacccauaggcagucccugggcaagggaggauuuucccggccgca

SEQ ID NO: 82378 - RNA, 64 nt, Human
ccaggaacuagagccccaaccacagcagaugcuuccugggcagccacuggccaggccguuguau

SEQ ID NO: 82379 - RNA, 64 nt, Human
aaccaaacucugucccacuucacgcacggacuguccugggcaaagguguucaccuuuccgagcc

SEQ ID NO: 82380 - RNA, 64 nt, Human
ggguugcuaucacuuuguccagcccaaauaccuuccugggcaacuccuaccauuuguuugcagu

SEQ ID NO: 82381 - RNA, 64 nt, Human
cugaauauauguucaagugggugugcccauagggccugggcacgugucucuagcaaaaccaggg

SEQ ID NO: 82382 - RNA, 64 nt, Human
accucagccccuagccccuggggggcagcuuuaaccugggcauguuuccuggguaccagugggg

SEQ ID NO: 82383 - RNA, 64 nt, Human
gccggcuguggagcagcaggaccuggcccuucugccugggcagcagaauauauauuuuaccuau

SEQ ID NO: 82384 - RNA, 64 nt, Human
ggggguaaggcucggauggcaaggacgcguucugccugggcauguaggggagguguuuuugcca

SEQ ID NO: 82385 - RNA, 64 nt, Human
gacccuaucccuacaaaaaauuucugaaaaauuaccugggcauuguggggcacaccuguugucc

SEQ ID NO: 82386 - RNA, 64 nt, Human
ugugcaaccuggagaucuaguccuaagccacacaccugggcagccacuucauauaaagguuacu

SEQ ID NO: 82387 - RNA, 64 nt, Human
augauugcaccugcgaauagccacugcacuccagccugggcaauauagcaagaccccauccuuu

SEQ ID NO: 82388 - RNA, 64 nt, Human
gccaggaucccaugaucacacaucuguauuccagccugggcaauagagcaaguccccauuacua

SEQ ID NO: 82389 - RNA, 64 nt, Human
caaucuagaggaaagcuccccagcauugcuugcuccugggcaaacauugcucuugaguuaagug

SEQ ID NO: 82390 - RNA, 62 nt, Human
accugcaggaucugcagugacggcagccucggccugggcaggcccaaggccacggucuagga

SEQ ID NO: 82391 - RNA, 64 nt, Human
ugcucucugagacaggggcgcccccgccuugaccccugggcaccuccauccccucccaccuguc

SEQ ID NO: 82392 - RNA, 64 nt, Human
uagugccuccuugaggccaggaguucaggaccagccugggcaacauagcgagacccccauugcu

SEQ ID NO: 82393 - RNA, 64 nt, Human
ugcuaugagcugagauugugccaguucauuccacccugggcaacagggugagacucugucucaa

SEQ ID NO: 82394 - RNA, 64 nt, Human
gaagaucauuugaguucaggaguucgaguuacagccugggcaauaaagugagacccugucacua

SEQ ID NO: 82395 - RNA, 64 nt, Human
ggaggauuguuugaggccagaaauuugagaccagccugggcaacauagcaaaacccugucucua

SEQ ID NO: 82396 - RNA, 64 nt, Human
ccuggucaccuggugaaaacccuugggauucuucccugggcaugacugaugacaauuuccauuu

SEQ ID NO: 82397 - RNA, 64 nt, Human
cccaagacaccauaucuucccauuucaagcacugccugggcacaccccaacaucccaggcugug

SEQ ID NO: 82398 - RNA, 64 nt, Human
ccugggugacagacugggaggaaaccaggcuggaccugggcaggcgggauguguuggccacagg

SEQ ID NO: 82399 - RNA, 64 nt, Human
cccguccuccuucaugacucccacugcugccucuccugggcauggcuguuagcuguucugccuu

SEQ ID NO: 82400 - RNA, 64 nt, Human
gccuuggaccccacgugcuuguggccaggcugccccugggcagggccauguggccucagaccac

SEQ ID NO: 82401 - RNA, 64 nt, Human
acguacgcacacacgcacaugcacagauaugccgccugggcacacagauaagcugcccaaaugc

SEQ ID NO: 82402 - RNA, 64 nt, Human
ggauacacacgcacgcacacaugcagauaugcugccugggcacacacuuccggacacacaugca

SEQ ID NO: 82403 - RNA, 64 nt, Human
cuugguagagcuggugccagaugugggcucagauccugggcaugaugggccgagccaccucgga

SEQ ID NO: 82404 - RNA, 64 nt, Human
gcuauuuggaagacacugcauuuuagccaguguaccugggcacagacucggggcugcccugaag

SEQ ID NO: 82405 - RNA, 52 nt, Human; identical to SEQ ID NO: 78922

SEQ ID NO: 82406 - RNA, 64 nt, Human
ucugaggauggccacugauguguguuuguggauaccugggcaucgacccagccugcaggugagc

SEQ ID NO: 82407 - RNA, 64 nt, Human
ggauacauuuuuaguaaaugugcauugucacaauccugggcacaaagugccugaugucaaaaug

SEQ ID NO: 82408 - RNA, 64 nt, Human
ggcaguucgcuugggcccaagaguucgagaccagccugggcaacauggugaaacccuaucuccg

SEQ ID NO: 82409 - RNA, 64 nt, Human
ugagccgaggucaugccacugcacuccagccuggccugggcaacagagcaagacccugucucaa

SEQ ID NO: 82410 - RNA, 64 nt, Human
ugcagugagccuagaucaugccacugcacuccaaccugggcagcagagcaagacucugucucaa

SEQ ID NO: 82411 - RNA, 64 nt, Human
ccaguggguucagaccucaccucucagggagcgaccugggcaaagacagagaagcucccagaag

SEQ ID NO: 82412 - RNA, 64 nt, Human
aaguagcacugaaaaauuacucauucaaauuuccccugggcacguaaggcaaaauauugccggu

SEQ ID NO: 82413 - RNA, 64 nt, Human
ugcagugaguggaaauugcgccacugcacuccagccugggcaacaaagugagacuccaucucaa

SEQ ID NO: 82414 - RNA, 64 nt, Human
uccagugagccaagaucgcaccacugcacuccagccugggcaacaaagagcgaaacucugucuc

SEQ ID NO: 82415 - RNA, 64 nt, Human
ggaggauagcuugaggccaggaguuccagaccagccugggcaacauagugagauccugucucua

SEQ ID NO: 82416 - RNA, 64 nt, Human
caggcugccagucccuccagccucaccuccccgcccugggcagcaggugugggcagcgugugag

SEQ ID NO: 82417 - RNA, 64 nt, Human
guuguagcccgggaggagcucuccagccucggcgccugggcagagggcccggaaacccucggac

SEQ ID NO: 82418 - RNA, 59 nt, Human; identical to SEQ ID NO: 78935

SEQ ID NO: 82419 - RNA, 64 nt, Human
caaauaaaaggucuuggggaauucuguuuggcuaccugggcacgccagucugcaccaugugucc

SEQ ID NO: 82420 - RNA, 64 nt, Human
cuaucagauucgagggcucccuuugucccccugaccugggcacaggcaugggcgauggcucccu

SEQ ID NO: 82421 - RNA, 64 nt, Human
ccaucaucgggggugggcacacggcccuucggagccugggcagccuggccucacaggcagacuc

SEQ ID NO: 82422 - RNA, 64 nt, Human
ggugauuugugauugcgccaccacugcacuccagccugggcaacagagugagacccugucucaa

SEQ ID NO: 82423 - RNA, 64 nt, Human
gcaagugagcugagaucaugccauggcagucuagccugggcaacagagcgagacucuguuucaa

SEQ ID NO: 82424 - RNA, 64 nt, Human
ugcggugagccgagauugcgccauugcacuccagccugggcaacgagugaaacuccgucucaaa

SEQ ID NO: 82425 - RNA, 64 nt, Human
uaaaccucaucuugauucagacugucagucuauuccugggcaguaguaugugauguccagcacc

SEQ ID NO: 82426 - RNA, 64 nt, Human
uccccaagcacacuccuagcugcuccagucucagccugggcagcuucccccugccuuuugcacg

SEQ ID NO: 82427 - RNA, 64 nt, Human
ugcagugagcuuugaucacaccacugcacuccagccugggcaacagagcaagaccccauccucc

SEQ ID NO: 82428 - RNA, 64 nt, Human
agaggaucacuuaagcccaggagucugagaccagccugggcaacauagcaagacccccaucucu

SEQ ID NO: 82429 - RNA, 64 nt, Human
ggaggauugcuugaguucaggaguucaagaccagccugggcaacauagcaaaaccuuaucucua

SEQ ID NO: 82430 - RNA, 64 nt, Human
gguagaucccuugugcccaggaguucaagaccagccugggcaacauggcgaaaccccauuucua

SEQ ID NO: 82431 - RNA, 64 nt, Human
aacagaauacuaagggcccccauuacuguguggcccugggcauccucaguuuccucauuuggua

SEQ ID NO: 82432 - RNA, 64 nt, Human
uguagugagccgagaucgcgccacugugcuccagccugggcaacagagcaagacuccaucucaa

SEQ ID NO: 82433 - RNA, 64 nt, Human
ggagcaucacuugauccugggaguucgagaccagccugggcaacauggugaaacccugucggua

SEQ ID NO: 82434 - RNA, 64 nt, Human
cauuuccaguucaucuauggcaguccagccagcuccugggcagcuugagagggcaaacccaaaa

SEQ ID NO: 82435 - RNA, 64 nt, Human
uuuuaaaugaccaaagaugaccugugguaagcaaccugggcaucuuaggaagcagucccuggag

SEQ ID NO: 82436 - RNA, 64 nt, Human
gagguaaagacgaaucuauaaaguaccgagacuuccugggcaaagaauggacaaucaguuuccu

SEQ ID NO: 82437 - RNA, 64 nt, Human
ugcuuugagccgagauugcaccauuguacuccagccugggcaauaagagcaaaacuccaucaaa

SEQ ID NO: 82438 - RNA, 64 nt, Human
guccuuaaggcacagucucaucagaagucuaauaccugggcagguuuauaacauccugagagcc

SEQ ID NO: 82439 - RNA, 64 nt, Human
ggggaggagcucugggccagaggaugcugagcugccugggcagagaccaagaggguuggagaca

SEQ ID NO: 82440 - RNA, 64 nt, Human
aggggccagcccuuagugcauucaggcuaaggccccugggcagggaugccaccccugcuccuuc

SEQ ID NO: 82441 - RNA, 64 nt, Human
caauguauacaccauuugggcuaucagagguaccccugggcaggagccucuacauccccuuccc

SEQ ID NO: 82442 - RNA, 64 nt, Human
ugcggugagccaagauugugccauugcacuccagccugggcaacgagcgaaacuacaucucaaa

SEQ ID NO: 82443 - RNA, 64 nt, Human
augagcacaaacuuucugggccuccauccuaggaccugggcagacccacauggccugggcucug

SEQ ID NO: 82444 - RNA, 64 nt, Human
cccuguugucugcuugucucuuugugucuguuauccugggcaggauggucauucucaaaaaccc

SEQ ID NO: 82445 - RNA, 64 nt, Human
cccuuuuccccuccuuugccuuucaagagcagggccugggcaaggccaagaaccaugcagaagc

SEQ ID NO: 82446 - RNA, 64 nt, Human
gaggaugauggauggucgggauugaggcuguugaccugggcaguagcuccucccauggccagug

SEQ ID NO: 82447 - RNA, 64 nt, Human
ugagaaaccugcccugaacucaccgccuccccugccugggcacucccuccucccugcgcccaca

SEQ ID NO: 82448 - RNA, 64 nt, Human
gcagguagagcccaagcuccaggugaggccuggcccugggcagggucuguggcugcgccccuca

SEQ ID NO: 82449 - RNA, 64 nt, Human
gugugcagcggacaccacggggccuuccugcuuuccugggcagagggcagagugaggccaccug

SEQ ID NO: 82450 - RNA, 64 nt, Human
ggcggaucaccugagcucaggaguuugagaccagccugggcaacauggggaaacuccaucucua

SEQ ID NO: 82451 - RNA, 64 nt, Human
ugcagugagccaagauggcgccacugcauuccagccugggcaacagagcaagacccugucuguc

SEQ ID NO: 82452 - RNA, 64 nt, Human
uccagcuugagucccagauacacucaugggcugcccugggcagccagcauucauuguaaguucc

SEQ ID NO: 82453 - RNA, 64 nt, Human
cucuuucacuacccacgaugaccuccggggguauccugggcaaaagggacaaagagggcaaaug

SEQ ID NO: 82454 - RNA, 64 nt, Human
ccucagcccuccuggcccuucagucuuggugccaccugggcacaggggcaagcuuggugguugu

SEQ ID NO: 82455 - RNA, 64 nt, Human
uagugcccugucucccugucucuagaagccuuagccugggcaccuggcucaaucuuguaacugc

SEQ ID NO: 82456 - RNA, 64 nt, Human
ugcaguuagcugagauccugccacugcacuccagccugggcaacagagugagacuaucucaaaa

SEQ ID NO: 82457 - RNA, 64 nt, Human
ggaaaccccaccuccagcccccgccaccgggcucccugggcacccagcaagaucuggggcugca

SEQ ID NO: 82458 - RNA, 64 nt, Human
cugcuaggugcauggccacagagcaugggcugggccugggcacaggaggagcagcugcuuuggu

SEQ ID NO: 82459 - RNA, 64 nt, Human
ccugccccuaccccuaugaggggcuccgguagcaccugggcaccugccgcuggaagcuauuggg

SEQ ID NO: 82460 - RNA, 64 nt, Human
ugcagugagcuguaauugcaucacugcacuccaaccugggcaacagaguaagaccuugucuuaa

SEQ ID NO: 82461 - RNA, 64 nt, Human
agccccaugggccgucacaaaggcuugaucacugccugggcaguggcacaaccaucccccaugu

SEQ ID NO: 82462 - RNA, 64 nt, Human
agcuaugguugaguaacuaaaggucuggcaagacccugggcacacagggagcugccuagcaucu

SEQ ID NO: 82463 - RNA, 57 nt, Human; identical to SEQ ID NO: 78980

SEQ ID NO: 82464 - RNA, 64 nt, Human
ggcugaucacuugaucccaggaguuugagaccagccugggcaccauggugaaaccucgucuuua

SEQ ID NO: 82465 - RNA, 64 nt, Human
gaagcaagugccgcauucuucaggaaggaagagaccugggcacccaagaccugguuuccuuuca

SEQ ID NO: 82466 - RNA, 64 nt, Human
ccugccccugagucuucuggcugggggcagguugccugggcaagaacugcuucuucaauuccuu

SEQ ID NO: 82467 - RNA, 64 nt, Human
uaaauuagagguuuuugaaaaauccaacucucauccugggcagagguugccuaguugguauaga

SEQ ID NO: 82468 - RNA, 64 nt, Human
gcauuaaagcugaaagaucgcucugcucggggagccugggcagagcagcagcaacgugaggguc

SEQ ID NO: 82469 - RNA, 64 nt, Human
uaucucuccagguggcccuaugcacccagguagcccugggcauggagcaccuguccaacaaccg

SEQ ID NO: 82470 - RNA, 64 nt, Human
agcaagccgugaggagggagcccgcucaggauggccugggcaggggaggacaucucuagaggga

SEQ ID NO: 82471 - RNA, 64 nt, Human
cugugggaaccauaggaagugugugggcugccuuccugggcaaguauuucccagugggaaguug

SEQ ID NO: 82472 - RNA, 64 nt, Human
ugcauugagcugagaucaugcuagugcgcuccagccugggcaacagagcgagacuucaucucag

SEQ ID NO: 82473 - RNA, 64 nt, Human
uggagugagcugagaucgcgccaccgcacuccagccugggcaacagagcgagacuccaucucaa

SEQ ID NO: 82474 - RNA, 64 nt, Human
ggcagaucaccugagcucaggaguccaagaccagccugggcaacauggcaaaacaccgucucua

SEQ ID NO: 82475 - RNA, 64 nt, Human
cccagucccaucaggagccucagccaaggaggggccugggcacacucagguccccaugguuguc

SEQ ID NO: 82476 - RNA, 64 nt, Human
gucaagaugcugagaugccaccacugcacuccagccugggcaacagagcgagaaccugucucaa

SEQ ID NO: 82477 - RNA, 64 nt, Human
ugcaaugagccgagaucgcgcuacugcacuccagccugggcaacagagagagaccuugucucaa

SEQ ID NO: 82478 - RNA, 64 nt, Human
uuccuguguugguguuuccuuuagacuggccuagccugggcaucacuguaaaguaugugcaguu

SEQ ID NO: 82479 - RNA, 64 nt, Human
ucucccucucacugaucacaaauggaaucaccucccugggcagcgagacgcaguugcucuggga

SEQ ID NO: 82480 - RNA, 64 nt, Human
ggugccugucccuuagugcauucaggucauggcaccugggcaggggugucccuguauucugaau

SEQ ID NO: 82481 - RNA, 54 nt, Human; identical to SEQ ID NO: 78998

SEQ ID NO: 82482 - RNA, 64 nt, Human
gcucuguaaauacucccuuccacccaucccagccccugggcagccgggcagaagggaauccagg

SEQ ID NO: 82483 - RNA, 64 nt, Human
cacugaguauguucauugccaccccugucccuccccugggcaccccucacuuucccugauccug

SEQ ID NO: 82484 - RNA, 64 nt, Human
cccggaggccuucccuuuacagcucuccuccagcccugggcacauagcauaggcuggggacaca

SEQ ID NO: 82485 - RNA, 64 nt, Human
ggauagcagagcccccagccaucacugcuggcagccugggcaaaccgggugagcaacaggagga

SEQ ID NO: 82486 - RNA, 64 nt, Human
gccacagaaaugggcacuaccuccuggcccacucccugggcaccaugcccucuggugaccuguu

SEQ ID NO: 82487 - RNA, 64 nt, Human
cacccuuugaagggacccagcacagggucuugggccugggcagucugaagacugauaacuuccc

SEQ ID NO: 82488 - RNA, 64 nt, Human
ugcaaugagcuaugauuucaccacugcauucuagccugggcaacagagugagauccugacucaa

SEQ ID NO: 82489 - RNA, 64 nt, Human
ggaggauugcuugaggccgaggguucaagacuagccugggcaacauagcgagacugcaucucua

SEQ ID NO: 82490 - RNA, 64 nt, Human
ucuccaguugcuguguuguauuccuacccaauuuccugggcaguugaugcaucucugggaaaaa

SEQ ID NO: 82491 - RNA, 64 nt, Human
ggugugcgcucacugcuugggaagugcaggggguccugggcacauugccagcugggugcugagc

SEQ ID NO: 82492 - RNA, 64 nt, Human
ugcagugagcacagaucacaccacugcacuccagccugggcaacagagugagacccuauuucaa

SEQ ID NO: 82493 - RNA, 64 nt, Human
gguggauugcuuaagcccaggaguucaagaccagccugggcaacauggcuaaaccccaucucua

SEQ ID NO: 82494 - RNA, 64 nt, Human
ugcagugagccaaggucacgucacugcacucuagccugggcaacagaguaagacaaaaaaauau

SEQ ID NO: 82495 - RNA, 64 nt, Human
gguagauuacuugagcccaggaauucaagaccagccugggcaacauggugaaacccuguuucua

SEQ ID NO: 82496 - RNA, 64 nt, Human
ugcggugagcugagauugcacuauugcacuccagccugggcaacaggaguaaaacuccccccca

SEQ ID NO: 82497 - RNA, 64 nt, Human
ugcagugacccaagaucgugccacuucacuccagccugggcaaaagagcaaaacgccaucucaa

SEQ ID NO: 82498 - RNA, 64 nt, Human
ccacccccacccagauggucucugagugcgccguccugggcagggcacacggucuggagcugag

SEQ ID NO: 82499 - RNA, 64 nt, Human
cuaucccucuugucagcacggcugaaaggagcugccugggcaccugagguggcugaggcucauc

SEQ ID NO: 82500 - RNA, 64 nt, Human
gguggacacggucuagcgggagcccagggcagccccugggcaggagacguggcugcugaacagc

SEQ ID NO: 82501 - RNA, 64 nt, Human
ccuuaagacucagccuccugguuuacccccccggccugggcaucugaccucccccaccccagug

SEQ ID NO: 82502 - RNA, 64 nt, Human
ugcagugagccaggauugcgccaccacacuccagccugggcaacagagacucugucucaaaaaa

SEQ ID NO: 82503 - RNA, 64 nt, Human
ugcagugagccgagguugcaccacugcacucccuccugggcaacagaacaagacuccaucucaa

SEQ ID NO: 82504 - RNA, 64 nt, Human
cugauuccucucauuuccagcuucucaguuucugccugggcaauggccaggggccaggaguggg

SEQ ID NO: 82505 - RNA, 64 nt, Human
cagaagaccaccugaggguaggagucaagaucagccugggcaacauagugagacgcugucucua

SEQ ID NO: 82506 - RNA, 64 nt, Human
cccaggugggaccugacauacaggcggcuccagcccugggcagcggcuucaagagccagagugg

SEQ ID NO: 82507 - RNA, 64 nt, Human
ggcagguacaguaggauaagccacucugucccuuccugggcaaagaagaaacggaggggaugga

SEQ ID NO: 82508 - RNA, 64 nt, Human
augaucgugccuguggcuagccacugugcuccagccugggcaacaccaucguaaaaauaaauaa

SEQ ID NO: 82509 - RNA, 64 nt, Human
ugaccugauggagcugaugcuuucucuccuaaucccugggcacuaggcucuuaucagugugcuu

SEQ ID NO: 82510 - RNA, 64 nt, Human
ggaggaucauuugaggccaggaguuugagaccugccugggcaacauaaugaaacuuccuuucca

SEQ ID NO: 82511 - RNA, 64 nt, Human
ucucucuccuccuccccucugggaauugggcagcccugggcaguuguacucaugggggcuuagg

SEQ ID NO: 82512 - RNA, 64 nt, Human
ggaggauugcuugaagcuaggaguuugagaccagccugggcaacaggguaagguccugucucua

SEQ ID NO: 82513 - RNA, 64 nt, Human
cugcagugagcugugaugugcccuuaugcuauagccugggcaagagcgugagacccugucucaa

SEQ ID NO: 82514 - RNA, 64 nt, Human
gcuccgugcucaacccccagcccaccccacccucccugggcagggucuugaggcagccacugug

SEQ ID NO: 82515 - RNA, 63 nt, Human
gcaggacaggggacagaugaccagguguguccaccugggcauauccaccaccucccucaccaa

SEQ ID NO: 82516 - RNA, 64 nt, Human
ggaggauugcuugaggccaggaguuugagaccagccugggcaacauagcgagaccccaucucua

SEQ ID NO: 82517 - RNA, 64 nt, Human
ggaggauugcuugagcccaggaguucaagaccagccugggcaacauaccaagacccccgucucu

SEQ ID NO: 82518 - RNA, 51 nt, Human; identical to SEQ ID NO: 79035

SEQ ID NO: 82519 - RNA, 64 nt, Human
ggaggaccgcuugaguccagggauucaaggccaaccugggcaauagagcgagacccugucucuu

SEQ ID NO: 82520 - RNA, 64 nt, Human
ugcagugagcugagauagcgccauugcacuccagccugggcaacaagagcaaaacucugucuca

SEQ ID NO: 82521 - RNA, 64 nt, Human
caacagggacacuuuuuaaaaacacucuuaucagccugggcaacacagugagacuccaucucuu

SEQ ID NO: 82522 - RNA, 64 nt, Human
agauugugccacugaacuccaaccugcacuccagccugggcaacagagcgagacuccaucucua

SEQ ID NO: 82523 - RNA, 64 nt, Human
gccuugaagaaccugucuaacuggaugcucauugccugggcaaggccuguuuaggccgguugcg

SEQ ID NO: 82524 - RNA, 64 nt, Human
aggcagggaggauccauugagcccaggaguccagccugggcaaaauagcgagagacccugaauc

SEQ ID NO: 82525 - RNA, 64 nt, Human
guugcuauagguccagcaacugaaccugccauuaccugggcaaggaaagaucccuuugcucuag

SEQ ID NO: 82526 - RNA, 64 nt, Human
ccagucuucccagccagcccgggcccuggggagcccugggcacagcagcggccgaggggauguc

SEQ ID NO: 82527 - RNA, 64 nt, Human
agauacaugagaccagggcagcguucagcacacuccugggcauggcggaagcaggaagcagacu

SEQ ID NO: 82528 - RNA, 64 nt, Human
caccgcaguccugccgcaggccuaacccuccugcccugggcacugccuccaugcagaagcgcuu

SEQ ID NO: 82529 - RNA, 64 nt, Human
ggcggaucacuugaggccaggaauuugaaaccagccugggcaaaacccugucucuacuaaaaau

SEQ ID NO: 82530 - RNA, 64 nt, Human
ugggcagaugggcacaggugcuggugaugccucuccugggcaaaacgccccauuuguggcacuu

SEQ ID NO: 82531 - RNA, 64 nt, Human
gggggauugcuugaagucaggaguucaagaccaaccugggcaacauagcaacaccccccauguc

SEQ ID NO: 82532 - RNA, 64 nt, Human
cucuguggcgcggggcauccuaugaggcaggcacccugggcagagagaugcagugggugcgggg

SEQ ID NO: 82533 - RNA, 59 nt, Human; identical to SEQ ID NO: 79050

SEQ ID NO: 82534 - RNA, 64 nt, Human
cugaaacaggacacaucuguuuuuugucccucacccugggcaggccgcgucacaaucacagucc

SEQ ID NO: 82535 - RNA, 64 nt, Human
ggaggaucacuuggagccaggaguuugagaccagccugggcaacaaagugagacccccaucucu

SEQ ID NO: 82536 - RNA, 64 nt, Human
ugagcaccucggcuucggagcacccugccaggccccugggcaucgccggacguccuacucaggc

SEQ ID NO: 82537 - RNA, 64 nt, Human
cugagcggagcgguggagagggagaggcuggaggccugggcagaacagcgccgcccgggcagac

SEQ ID NO: 82538 - RNA, 53 nt, Human; identical to SEQ ID NO: 79055

SEQ ID NO: 82539 - RNA, 64 nt, Human
uguggugagcugagaucgcgccauugcacuccagccugggcaacaagagcaaaacuccgucuca

SEQ ID NO: 82540 - RNA, 64 nt, Human
gcuagagugagccgugaucaccagugcacucuagccugggcaacagagaaagacccugucucaa

SEQ ID NO: 82541 - RNA, 64 nt, Human
ggaggaucgcuugaggccaggaguucgagaccacccugggcaacagagcgagaucccaucacua

SEQ ID NO: 82542 - RNA, 64 nt, Human
uaauacaucgaacaacuucauccuuaaucucugcccugggcaguuugcccucucccaucuggac

SEQ ID NO: 82543 - RNA, 64 nt, Human
ugcugcucacucagcugcccugggggcugcuuucccugggcacgggcuccagggaucaucucug

SEQ ID NO: 82544 - RNA, 64 nt, Human
ugcagugagcugagaucacgccauuguacuccagccugggcaacaagagcaaaacuccgucuca

SEQ ID NO: 82545 - RNA, 64 nt, Human
gugcucacuccugcucucuacagagccagccuggccugggcauuguaaacagcuuuuccuuuuu

SEQ ID NO: 82546 - RNA, 64 nt, Human
ugcagugagcugagaucaugccacugcacuccagccugggcaacagagcgagacuccaucucaa

SEQ ID NO: 82547 - RNA, 64 nt, Human
ugcagugagcugagauaaucccacugcauuccagccugggcaacagcgugagacuucaucucaa

SEQ ID NO: 82548 - RNA, 64 nt, Human
acucagacacccagauucccuccauggccucaccccugggcaaaauccaacucugagccaucuu

SEQ ID NO: 82549 - RNA, 64 nt, Human
cucucagagaagcacguggugaggguggccugggccugggcacccuuggccugccggccuggcu

SEQ ID NO: 82550 - RNA, 64 nt, Human
ggaggaucguuugagcccaggaguugaagaccagccugggcaacacagugagacuucauuucua

SEQ ID NO: 82551 - RNA, 64 nt, Human
ugcacugagccgagaucgcgccacuauacuccagccugggcaacagacauccugucucaaauaa

SEQ ID NO: 82552 - RNA, 64 nt, Human
ggagaaucgcuugagcucaggaguucgagaccagccugggcaacguggcgaaauccccgucuuu

SEQ ID NO: 82553 - RNA, 64 nt, Human
aaggaucaccuugaggccaggaguuuaaggccagccugggcaacauagcaaaaccuagucccua

SEQ ID NO: 82554 - RNA, 64 nt, Human
ggugggucacuugaacccaggaguuugacaucaaccugggcaacauggugaccucccgucucuc

SEQ ID NO: 82555 - RNA, 64 nt, Human
uuccuuaaaguaggaucaaaucuagauccucuagccugggcaguagaggaagaaaugcuagccu

SEQ ID NO: 82556 - RNA, 64 nt, Human
agucacagcccucuucuuuugauugacagaccacccugggcaccccaugcucaauaugaacacc

SEQ ID NO: 82557 - RNA, 64 nt, Human
ggaggaucaauugagccuagaaguucaagaccagccugggcaaaguagggagaccccuucucua

SEQ ID NO: 82558 - RNA, 64 nt, Human
gguggauugcccgcgcucaggaggucaagaccagccugggcaacacggugaaaccccaucucua

SEQ ID NO: 82559 - RNA, 64 nt, Human
ugcagugagccaagaucgcaccacugcacuccagccugggcaacagagugagacuccgucucaa

SEQ ID NO: 82560 - RNA, 64 nt, Human
uauuuuauuuuuuauuuuuugagacggaguccagccugggcaacagaguaacucuccuucucaa

SEQ ID NO: 82561 - RNA, 64 nt, Human
ugcagugagcugagauuacgccacugcacucuagccugggcaacggugagacccugccucaaaa

SEQ ID NO: 82562 - RNA, 64 nt, Human
cgccuucugaacccgucucagcagguccacagcaccugggcagaggucagagaccaggggaggc

SEQ ID NO: 82563 - RNA, 64 nt, Human
cucacagcgggacuacacaguugcuggcuuugcuccugggcaaggaggagcaggccagagccuc

SEQ ID NO: 82564 - RNA, 64 nt, Human
accgcgggggcugugagcagcggugccucaacacccugggcagcuacaagugcagcugugaccc

SEQ ID NO: 82565 - RNA, 64 nt, Human
gaaggggagcgagaaauugcuuuuucucuuccucccugggcagaauguagcuuuucugcuucac

SEQ ID NO: 82566 - RNA, 64 nt, Human
caaaaaaaaaaggcaaggcacaacaaaaaaauauccugggcaauaaaaaaaauauuuuaaacca

SEQ ID NO: 82567 - RNA, 64 nt, Human
ccagggcucugcaggccacugugagcgcuggcucccugggcagugcuccuccguguggacugug

SEQ ID NO: 82568 - RNA, 64 nt, Human
gcccuucucuguucugacuccugggacuucugguccugggcacacuuuuugcaggcaacaaaau

SEQ ID NO: 82569 - RNA, 64 nt, Human
aucaguaugcuuauggauuugaugacaggcauagccugggcauaucaccucauugguaaagggc

SEQ ID NO: 82570 - RNA, 64 nt, Human
uuggugacacuuucaugguccagaaagcugaaggccugggcaucucuugugacauuuuucuaau

SEQ ID NO: 82571 - RNA, 64 nt, Human
ugcagugagccgagaucgcaccauugcacuccugccugggcaacaagagugaaacuccaucucc

SEQ ID NO: 82572 - RNA, 64 nt, Human
ggcagauuauuugagcucaggaguuugagaccauccugggcaacauggcgaaacccuaucucua

SEQ ID NO: 82573 - RNA, 64 nt, Human
aggccccagcucugcugcugacgagcugugugguccugggcagaguggucuccgaguuccaguc

SEQ ID NO: 82574 - RNA, 64 nt, Human
auuuugauuuuuaauggaaaguuguauccauuaaccugggcauuguugagguuaaguuucucuu

SEQ ID NO: 82575 - RNA, 64 nt, Human
gauggaacuuaaaacuacuuuguugaaacaucaaccugggcagaaaaaaaaaaaaaaagacaug

SEQ ID NO: 82576 - RNA, 64 nt, Human
ugcagugagccgagaugguaccucugcacugcagccugggcaacagaaugagacugugucuuca

SEQ ID NO: 82577 - RNA, 64 nt, Human
gugucagcacgugcugagggcauggggccugcccccugggcacccauccacaagcugggccacg

SEQ ID NO: 82578 - RNA, 64 nt, Human
uucagugagcugagaucguggcauugcacucuagccugggcaaccaagagugaaacugucucaa

SEQ ID NO: 82579 - RNA, 64 nt, Human
cccagcuucuggcccgcuccucacugagccacuaccugggcaucagucuggaucugcagcugca

SEQ ID NO: 82580 - RNA, 64 nt, Human
aggcggauggccagggagccaugagaagacucuuccugggcacggcguggggacuggacagaaa

SEQ ID NO: 82581 - RNA, 51 nt, Human; identical to SEQ ID NO: 79098

SEQ ID NO: 82582 - RNA, 64 nt, Human
ggaagaucacuugaggccagaaguucgagaccagccugggcaauguagugagaccccaucacua

SEQ ID NO: 82583 - RNA, 64 nt, Human
uacagugaaccgagaucacaccacugcauucccgccugggcagcagagcgagacuccgucucaa

SEQ ID NO: 82584 - RNA, 64 nt, Human
auccacgugaaguccuguguguggcuggucccuaccugggcagucucauuugcacccauagccc

SEQ ID NO: 82585 - RNA, 64 nt, Human
ugcagugagcugagaucacaucauugcacuccagccugggcaacgggcgagacucugucucaaa

SEQ ID NO: 82586 - RNA, 64 nt, Human
ggcaagaguuuuuuuaagacucuuaaaaaaagagccugggcaauuuuuuuaagacucugucuua

SEQ ID NO: 82587 - RNA, 64 nt, Human
ugcagcgagccaagaucgugccacugcacuccagccugggcaagaguuuuuuuaagacucuuaa

SEQ ID NO: 82588 - RNA, 64 nt, Human
gaaugcacacuagccucuccaggaaugccuccucccugggcagaaaguggccaugccacccugu

SEQ ID NO: 82589 - RNA, 64 nt, Human
aacccaggagguggauugcgccacugcacuccagccugggcaacagagugagacucccucucaa

SEQ ID NO: 82590 - RNA, 64 nt, Human
gguggaucacucaaguccaggaguucgagaccagccugggcaacauggugaaauccugucucua

SEQ ID NO: 82591 - RNA, 64 nt, Human
uuuguacuaagguauuucaguuauguaaacucagccugggcacuuucugauaacuguaaaaugu

SEQ ID NO: 82592 - RNA, 64 nt, Human
guuggcuacagggagaugcucucuuugagaggcuccugggcauugauuccauuucaaucucauu

SEQ ID NO: 82593 - RNA, 64 nt, Human
ugcagugagccgagaucgcaccacugcacuccagccugggcagcagagcaaguaguaauaacca

SEQ ID NO: 82594 - RNA, 64 nt, Human
cauccuucaugcaagacugcugccuucauguaacccugggcacaguguguauauagcugcuguu

SEQ ID NO: 82595 - RNA, 64 nt, Human
ugcagugggcugugaucacaccacugcacuccagccugggcaacagagugagacccugucucug

SEQ ID NO: 82596 - RNA, 64 nt, Human
ggaggaucacuugagcccaggaguucaagaccagccugggcaacauagugagacuccugucucu

SEQ ID NO: 82597 - RNA, 64 nt, Human
ucccggagcuuggaggggcagccucaggugugugccugggcaccgcucacagccucuugcaccc

SEQ ID NO: 82598 - RNA, 64 nt, Human
ccagucacccugugaccgcagguugcuuucccacccugggcaaugcagugcagcaugggaaagg

SEQ ID NO: 82599 - RNA, 64 nt, Human
agccccagccccaggggaccaugccggggugcugccugggcaggccauguuggggagacuccag

SEQ ID NO: 82600 - RNA, 64 nt, Human
aaggcugaagcuuucacagugcagagacugcuagccugggcacacacaccuccuuucuggccgu

SEQ ID NO: 82601 - RNA, 64 nt, Human
ugcagugagacgagcuugugccacugcacuccagccugggcaacagaguaagacucagucucaa

SEQ ID NO: 82602 - RNA, 64 nt, Human
gcagcaaggacugacuguaguccuauuucagaccccugggcacuagugucaacuccuccuuugg

SEQ ID NO: 82603 - RNA, 64 nt, Human
gguuagugguagagguggugagaagacaucagauccugggcacauucuuuucuucugcuucccu

SEQ ID NO: 82604 - RNA, 64 nt, Human
caacagucaugacccugauaguuucccauaacaaccugggcauuccuugggacucaggagcugc

SEQ ID NO: 82605 - RNA, 64 nt, Human
agugagccaucaucauggcaucauugcauuccagccugggcaacagagcaagaccucgucucaa

SEQ ID NO: 82606 - RNA, 64 nt, Human
ggagguuugcuugagcccaggaguuccagaccagccugggcaacauggcgaaaccccaucucua

SEQ ID NO: 82607 - RNA, 64 nt, Human
gguagaucgcuugagcucaggaguucaagacgagccugggcaacauggcaaaugccgucucugc

SEQ ID NO: 82608 - RNA, 64 nt, Human
gcauucuggccaaggggugggccugugaaucaauccugggcaaucagacacccucuccuuaaaa

SEQ ID NO: 82609 - RNA, 64 nt, Human
ucugccucagcggggacggccuccugcugcagguccugggcagcccacaguagugcuagcugag

SEQ ID NO: 82610 - RNA, 64 nt, Human
ggaacccaggcugggccugguggugaagagcaguccugggcacaggcugugagccagggugcug

SEQ ID NO: 82611 - RNA, 64 nt, Human
cuugcagccguaugcugcacaagcguguacacccccugggcagccucaaaaccccgcuuacagc

SEQ ID NO: 82612 - RNA, 64 nt, Human
uguguuucuuuugguuccauuguuuggagacauuccugggcacaguuugguccguuagaauuaa

SEQ ID NO: 82613 - RNA, 64 nt, Human
aaaacagggugcuaaagccaaccagccuuuggguccugggcaggugggagcugaaaaggaucga

SEQ ID NO: 82614 - RNA, 64 nt, Human
cugggaggacaguggcugaguggaggcgcccagaccugggcaggcagcaggcucaggcccacac

SEQ ID NO: 82615 - RNA, 64 nt, Human
ggaaugcggcugcccaagcuugcagggaacaauaccugggcaaccuuguaacuguauucuccag

SEQ ID NO: 82616 - RNA, 64 nt, Human
ccagaagagaggggugggcuggggcaaggcuuauccugggcaggagagaacacacgagcacgua

SEQ ID NO: 82617 - RNA, 64 nt, Human
gaggagugauagcugcuccccaucccaaagugggccugggcagucaggcuccagggcccuaugc

SEQ ID NO: 82618 - RNA, 64 nt, Human
ggaggauugcuugagcucaugaguucaagaccagccugggcaacauagcgagacuccaucucua

SEQ ID NO: 82619 - RNA, 64 nt, Human
uuuguuuuagaaccaguuucauuaaaguugccuuccugggcaccuguuuauccauuuccugaac

SEQ ID NO: 82620 - RNA, 64 nt, Human
acagcaggugaggcaggugcuccucacacccagaccugggcaucuucauugagggaaagaaaac

SEQ ID NO: 82621 - RNA, 64 nt, Human
cguggccgagggggccuugacggcguuggcggggccugggcacaggggcagccgcagggaggca

SEQ ID NO: 82622 - RNA, 64 nt, Human
ccucccccucuuguugccuucgauuucggcaaagccugggcaggugccaccgggaaggaauggc

SEQ ID NO: 82623 - RNA, 64 nt, Human
uguagugagccgagaucaugacacugcacuccagccugggcaacagagcgagaccaucucuuaa

SEQ ID NO: 82624 - RNA, 64 nt, Human
gaagccagagguuucggauucgugacauccacccccugggcaagugagagcaucugcaaaaugc

SEQ ID NO: 82625 - RNA, 64 nt, Human
ucagggaaagucaucgaugauggcucaggcucagccugggcacgccccagaggagagagaugga

SEQ ID NO: 82626 - RNA, 64 nt, Human
cugcugacucuccuucaacauccucacccccaccccugggcaccauuuaggacaagacuuccuu

SEQ ID NO: 82627 - RNA, 64 nt, Human
gcaucaauacaaccagcccaaccaucgguccacaccugggcauuuggugagagucaaagcugac

SEQ ID NO: 82628 - RNA, 64 nt, Human
ugcagugagcugagaucuugccacugcacaccagccugggcaacacagcaagacucugucucaa

SEQ ID NO: 82629 - RNA, 64 nt, Human
ggagaugccacgcaggacagacuggagagagaagccugggcaauacugcccgccugucauggcc

SEQ ID NO: 82630 - RNA, 64 nt, Human
cuuagguguuucagcauagauuccaguuucgcacccugggcagacccccaggccccauccggga

SEQ ID NO: 82631 - RNA, 64 nt, Human
ggagccgugucacuccugggccaugggggcaccuccugggcacuuagguguuucagcauagauu

SEQ ID NO: 82632 - RNA, 64 nt, Human
cacaggcagcaaggucauggucugaguggggcuuccugggcaguuggggcggcccacgccagcu

SEQ ID NO: 82633 - RNA, 64 nt, Human
uguggugagccgagauugcaccuuuguacuccagccugggcaacgagcaaaaaacucugucuca

SEQ ID NO: 82634 - RNA, 64 nt, Human
aggugacaguauuacucucgagaggcaauucaguccugggcaaagguauuaguacaauaagcgu

SEQ ID NO: 82635 - RNA, 64 nt, Human
cagaggcuucuccccauagcacgaggauguguugccugggcacggugacugcgguuauuccugg

SEQ ID NO: 82636 - RNA, 64 nt, Human
ugcaaugagcugagaucaugccauugcacuccagccugggcaacgagagugaaacuccgucccc

SEQ ID NO: 82637 - RNA, 64 nt, Human
ccagugcagauggagcccaaggcccccucggccuccugggcaacuugggguacacaggauacug

SEQ ID NO: 82638 - RNA, 64 nt, Human
gugacccggccacgucccccugccgcaucuuugaccugggcagcgacaacgaggaggugguggc

SEQ ID NO: 82639 - RNA, 64 nt, Human
auccagcuccuugaaccccuccagcccgcuucagccugggcaucacugcaggccccgugcuccu

SEQ ID NO: 82640 - RNA, 64 nt, Human
ggagccacacauacucacagcccccgggcucuacccugggcacagcagagacagacuggugguu

SEQ ID NO: 82641 - RNA, 64 nt, Human
ggccucccgccuccucccccaucccccugccuccccugggcacuguggcuuccuccugcgccug

SEQ ID NO: 82642 - RNA, 64 nt, Human
ugcagugagccaagaucacggcacugcgcugcagccugggcaacacagugagacccugucaaaa

SEQ ID NO: 82643 - RNA, 64 nt, Human
gguggguugcuugagcucaggaguuugagaccagccugggcaacauggcacaauugucucuaca

SEQ ID NO: 82644 - RNA, 64 nt, Human
augauugugcaugugaauagccacugcacuccagccugggcaacauagcaagacuccaucucua

SEQ ID NO: 82645 - RNA, 64 nt, Human
ccugcaggagcuucccaagcuggucacagagucuccugggcacagguuauacagaccccagccc

SEQ ID NO: 82646 - RNA, 64 nt, Human
ucuuuguuauauggaugggaacccuaacuuagggccugggcaggggaaagagaaagaaggugag

SEQ ID NO: 82647 - RNA, 64 nt, Human
acagaggaagaggccugcuccacuugucugggaaccugggcaggaggcacagaggaagccaagg

SEQ ID NO: 82648 - RNA, 64 nt, Human
ggaggauugcuugagcccaagaguuggagaccagccugggcaacauggugagaccaauugacug

SEQ ID NO: 82649 - RNA, 64 nt, Human
ugcagugagccaagauugcgccccugcacuccagccugggcaacagagcaagacuccaucucaa

SEQ ID NO: 82650 - RNA, 64 nt, Human
ugcagugagccaaagguacaccacuacacuccagccugggcaacagagcaagacucggucucaa

SEQ ID NO: 82651 - RNA, 64 nt, Human
cggcccgccucuccucgguucaaggucacuguuuccugggcacgcacuggguugcgggacagag

SEQ ID NO: 82652 - RNA, 64 nt, Human
gucucccuccucugcccccauccccuggcucuccccugggcacagugccacucccuuggaaggg

SEQ ID NO: 82653 - RNA, 64 nt, Human
accagccuggccaacauggugaaaccccaucucuccugggcauguagucccagcuacucgggag

SEQ ID NO: 82654 - RNA, 64 nt, Human
cuccaaccacugugccacugacuugcugugugacccugggcaagucacuuaacuauaaggugcc

SEQ ID NO: 82655 - RNA, 64 nt, Human
cccuugagcaguguacagccugcucaacaaccgcccugggcaggccgcuccugagcugcugucu

SEQ ID NO: 82656 - RNA, 64 nt, Human
agcugggggugagaggcuggugguugccucccguccugggcaggcugcagccucaugccauguc

SEQ ID NO: 82657 - RNA, 64 nt, Human
gaauucucaggcuauucugagcucagaaaaguccccugggcacuagguaaagcccagugaaugu

SEQ ID NO: 82658 - RNA, 64 nt, Human
uguggugagccaagaucgcgccauuguacuccagccugggcaacaagagcaagauucugccuca

SEQ ID NO: 82659 - RNA, 64 nt, Human
ggcggaucaccugaaaucaggaguuccagaccagccugggcaacauggugaaaccccgucucua

SEQ ID NO: 82660 - RNA, 64 nt, Human
ugcagccuaugugcagguacgugcagcacuacggccugggcagugccugugacaacguagagcg

SEQ ID NO: 82661 - RNA, 64 nt, Human
ugcagugagccgaauaugcgccacugcacuccagccugggcaacagagcaagacuccgucucca

SEQ ID NO: 82662 - RNA, 64 nt, Human
ugcagucagucaugauggcaccacugcacuccagccugggcaacagagcaagauccugucuuua

SEQ ID NO: 82663 - RNA, 64 nt, Human
ggagcaucucuugaggccaggaguuugagaccagccugggcagcauagcaagacacaucccuac

SEQ ID NO: 82664 - RNA, 64 nt, Human
ugcagugagcugagauugugucauugcacuccagccugggcaacaagagcaaaacucugucuca

SEQ ID NO: 82665 - RNA, 64 nt, Human
ggaagauugccugagcucaggaguuugagaccagccugggcaacacggugaaaccccgucucua

SEQ ID NO: 82666 - RNA, 64 nt, Human
ugcagugagcugagaucaugccacugcacuccagccugggcaacagagcaagacucugccucaa

SEQ ID NO: 82667 - RNA, 64 nt, Human
ugaaaccccaucucuacuaaacaugcaaaaauuaccugggcaugguggcaggugcuuauaaucc

SEQ ID NO: 82668 - RNA, 64 nt, Human
aagagggacgccugggggugccaggaccagucaaccugggcaaagccuagugaaggcuucucuc

SEQ ID NO: 82669 - RNA, 64 nt, Human
aggaagauugagcugggggcaacagccaagcucaccugggcaggucucugccaccuccuugcuc

SEQ ID NO: 82670 - RNA, 64 nt, Human
ccaaaggggcuccacaugagagguccugcaugccccugggcacaacaaggacugauucaaucug

SEQ ID NO: 82671 - RNA, 64 nt, Human
agcccauagacggcacaggccaccuggcccauucccugggcauucccugcuuugcauugcugcu

SEQ ID NO: 82672 - RNA, 64 nt, Human
gggggccccagguacuguggagagcauaguccagccugggcauuugucuccuagcagccuacac

SEQ ID NO: 82673 - RNA, 64 nt, Human
uguagugagccaagaucgugccacuacacuccagccugggcaacaaagcaagaccuugucucaa

SEQ ID NO: 82674 - RNA, 64 nt, Human
ggcagaucacuugagcccaggaguucgagagcagccugggcaacaugacgaaaccccgucucua

SEQ ID NO: 82675 - RNA, 64 nt, Human
gaugcuaaagaaaugucuguacaaaauaagauggccugggcagaguugguugucugagugagaa

SEQ ID NO: 82676 - RNA, 64 nt, Human
gcugggcuggggugcaggucaucacaggacggcuccugggcagcugggcccuccuggguggggu

SEQ ID NO: 82677 - RNA, 64 nt, Human
caccucccccaggagaucaggauuccacugacguccugggcagccagugaauuuaauuuuccau

SEQ ID NO: 82678 - RNA, 64 nt, Human
gcaagaucacuugagcccaggaguuuaagaccagccugggcaacauagcaagacccugucucua

SEQ ID NO: 82679 - RNA, 64 nt, Human
cauuccacauguguucccucuauccguccugcuuccugggcagcugguggugcugggaaugggg

SEQ ID NO: 82680 - RNA, 64 nt, Human
ugcagugagccaggauugugccauugcacuccagccugggcaacaagaacaaaacuccaucuca

SEQ ID NO: 82681 - RNA, 64 nt, Human
cccuaccccaccacaccccaucccagaggccuugccugggcaacccuaagccccugucccucgc

SEQ ID NO: 82682 - RNA, 64 nt, Human
uguccuaagcuguauuugugaauugugcugguuuccugggcauugccacgccuaccacaggugg

SEQ ID NO: 82683 - RNA, 64 nt, Human
cugccccugcucuggggccugcugagccggcugcccugggcacccgguuccaggcagcacagac

SEQ ID NO: 82684 - RNA, 64 nt, Human
gcacagcaacugccaaucccgcugaagaggccucccugggcacagcacaggcugcacggugcac

SEQ ID NO: 82685 - RNA, 64 nt, Human
guguucagaagcugcugccugagggcagggccuaccugggcacacagaagagcauaugggaggg

SEQ ID NO: 82686 - RNA, 64 nt, Human
gccuggacggcuggaugggccugggcugggugggccugggcagcugggugggccugggcagcug

SEQ ID NO: 82687 - RNA, 64 nt, Human
gccugggcugggugggccugggcagcugggugggccugggcagcugggugggccugagcuaggg

SEQ ID NO: 82688 - RNA, 64 nt, Human
acagccauggaguagaggccuaaguugacacugcccugggcagacaagacaggagcugucgccc

SEQ ID NO: 82689 - RNA, 64 nt, Human
gaauggguccauuuugcccuuccauagccuaaucccugggcauugcuuuccacugagguugggg

SEQ ID NO: 82690 - RNA, 64 nt, Human
gcgguaacugcacuugggcagggaauauagccuuccugggcacaacuagcugacaaugacaggu

SEQ ID NO: 82691 - RNA, 64 nt, Human
ggaaagauggggaaggguguggaguggggaggagccugggcagccugcugggugggccacacuc

SEQ ID NO: 82692 - RNA, 64 nt, Human
ugugccucucaugcugccuccucugcccauggguccugggcacccaggccugcccugccugcug

SEQ ID NO: 82693 - RNA, 64 nt, Human
accccuguuccccucagcuuucccuccucgcuggccugggcacccuccugggagcaggccuucc

SEQ ID NO: 82694 - RNA, 64 nt, Human
ucaggcuuggggcuggggcaggcuugggcucaauccugggcacccaggggcagcccaccccuaa

SEQ ID NO: 82695 - RNA, 64 nt, Human
ugaggugagccaugauuacuccacugcacuccagccugggcaacagagccaggcccuguaucaa

SEQ ID NO: 82696 - RNA, 64 nt, Human
cuaccuccaaaauccccuuuuuguucuuccuggaccugggcauucagccuccugcucuuaacug

SEQ ID NO: 82697 - RNA, 64 nt, Human
aucaggacuggagcccccgugccuuggucuccccccugggcacacgugcucacucaggcccagc

SEQ ID NO: 82698 - RNA, 64 nt, Human
ucucugccaaucaugaccuguuccuuccugaaguccugggcaugcaucugggacccccguggag

SEQ ID NO: 82699 - RNA, 64 nt, Human
ggaggauagcuugagcccaggagugcaagaccugccugggcaauauacugagaccccauucucc

SEQ ID NO: 82700 - RNA, 56 nt, Human; identical to SEQ ID NO: 79217

SEQ ID NO: 82701 - RNA, 64 nt, Human
gucucagcccgggacagggucuugcaagcagccuccugggcagucguaaggguugcggcgugau

SEQ ID NO: 82702 - RNA, 61 nt, Human
ggcagaggcagggucgcugaguccuccagguccugggcagccuucauauuugccauugugu

SEQ ID NO: 82703 - RNA, 64 nt, Human
uauccagcugggccagccucgugcugggcucugcccugggcagacaggcagagggccagagcag

SEQ ID NO: 82704 - RNA, 64 nt, Human
ggaggaaugcuugagcccaagaguuuuagaccagccugggcaacacaguaagacccuguuucua

SEQ ID NO: 82705 - RNA, 64 nt, Human
acuuuaaaccccaggagacugaaacucaaacaacccugggcaaguaaugugcaaaagauggcag

SEQ ID NO: 82706 - RNA, 64 nt, Human
gacagauggcuugagcucaggaguucgugaccagccugggcaacccugucucuacaaaaaauac

SEQ ID NO: 82707 - RNA, 64 nt, Human
ggaggacugcuugagcccaggaguuugagaccagccugggcaauguagcaagaccccaucucua

SEQ ID NO: 82708 - RNA, 64 nt, Human
agagaauuacuugagcccaggaguuugaauccauccugggcagcauacugagacccugccuuua

SEQ ID NO: 82709 - RNA, 64 nt, Human
gguagauugcuugagcccaggaguuagagaccagccugggcaacaugaugugaaaacccaucuc

SEQ ID NO: 82710 - RNA, 64 nt, Human
ggaagacugcuugagcccaggaguucaagaccagccugggcaacguaggaagacuccgucucua

SEQ ID NO: 82711 - RNA, 64 nt, Human
uuugaggcucugucacugagcaaugguaacugcaccugggcagcuccucccugugcccccagcc

SEQ ID NO: 82712 - RNA, 64 nt, Human
gaggguacgugccaucaucucuccagcccaggccccugggcaucucaugcuggggggaagggac

SEQ ID NO: 82713 - RNA, 64 nt, Human
caugucccuccacuguuccuaucagcagguggccccugggcaucagaacagccugcccugggca

SEQ ID NO: 82714 - RNA, 64 nt, Human
cagcagguggccccugggcaucagaacagccugcccugggcaccagguggcagacacacucaga

SEQ ID NO: 82715 - RNA, 64 nt, Human
cagaagguguaaaagagcugcccuuggugggugcccugggcauguugcaacgccugcuggugcc

SEQ ID NO: 82716 - RNA, 64 nt, Human
ugcagugagucaagaucucaccacugcacuccagccugggcaacagagggagacucugucucaa

SEQ ID NO: 82717 - RNA, 64 nt, Human
ugcagugagccgagaccgcgccacugcacuccagccugggcaacagagcaaaacuccaacucaa

SEQ ID NO: 82718 - RNA, 50 nt, Human; identical to SEQ ID NO: 79235

SEQ ID NO: 82719 - RNA, 64 nt, Human
gcuuggcacagcccugacuugaacucugggugacccugggcacccacagaacugggagugaggg

SEQ ID NO: 82720 - RNA, 64 nt, Human
ggaggaucacuugaguccagaaauucaagacccgccugggcaucauaaugagaccccaucucua

SEQ ID NO: 82721 - RNA, 64 nt, Human
uacagugauccacgaucguaccacuacacuccagccugggcaacagagcaagacccugucucaa

SEQ ID NO: 82722 - RNA, 64 nt, Human
gcaguggagccaagauugcgccacugcacuccagccugggcaacagagcgggacuccaucucaa

SEQ ID NO: 82723 - RNA, 64 nt, Human
aguguccccaacgcaggccccacucugagccugcccugggcagccucggacuaugacuggcuac

SEQ ID NO: 82724 - RNA, 64 nt, Human
ugggcuuuaugugcuagauuuuaauauccuugagccugggcaagugcacaagucuuuuuaaaag

SEQ ID NO: 82725 - RNA, 64 nt, Human
ggaggaucacuugaggccaggaguucaagaccagccugggcaacauagugagaaugcaucucua

SEQ ID NO: 82726 - RNA, 64 nt, Human
caaaguacugugauuacaagcgugagccacggcaccugggcagaaaaguaucuuaauuaaugaa

SEQ ID NO: 82727 - RNA, 64 nt, Human
cagggaggcaggggguggggggccuuccuuuccuccugggcaccccgugugcugugaucuccug

SEQ ID NO: 82728 - RNA, 64 nt, Human
gaccagcccagccccauccgcaagccaggcugggccugggcauaacuucgcugggcucucccaa

SEQ ID NO: 82729 - RNA, 64 nt, Human
acuauaaauguuaugggggagaucuuauaaauuuccugggcaagaguguaugcauacaaaguuu

SEQ ID NO: 82730 - RNA, 64 nt, Human
gcuggucccagccagcaguucagagcugcccucuccugggcagcugccuccccuccucugcuug

SEQ ID NO: 82731 - RNA, 64 nt, Human
ccucaccuggcuucccaggacccugggucaccuuccugggcagcccagagagacccugccaacu

SEQ ID NO: 82732 - RNA, 64 nt, Human
cuccacaucccgaaacuccacccguucccacugcccugggcagccaucuugaauaugggcggaa

SEQ ID NO: 82733 - RNA, 64 nt, Human
guuucucuuuuccucaagggguuuggggcaggagccugggcacuuacuccccguuuuugcuguu

SEQ ID NO: 82734 - RNA, 64 nt, Human
ggagugucggauccugugaguaggcugggccuccccugggcaggguucuccaagggcccgguuu

SEQ ID NO: 82735 - RNA, 64 nt, Human
acggagcacgggggagucugugguggccaguuuaccugggcaucuggcugagaggaagaaaggc

SEQ ID NO: 82736 - RNA, 64 nt, Human
uuccccggcaggggugggaggcagcaggggucagccugggcaggaaccucucccaacucugucc

SEQ ID NO: 82737 - RNA, 64 nt, Human
aggauuguugggcuugggggaaaagagguggauuccugggcaagaaccuaaaguagcaggacuc

SEQ ID NO: 82738 - RNA, 64 nt, Human
ugcagugagccgaaaucacgccacuacacuccagccugggcaacagagggagacuccaucucaa

SEQ ID NO: 82739 - RNA, 64 nt, Human
uguggugagccgagauugcaccauugcgcucuagccugggcaacaacagcaaaacuccaucuca

SEQ ID NO: 82740 - RNA, 64 nt, Human
gugccucccuagaggacuccauggcugagaggcuccugggcagauggggucaaggcugggccag

SEQ ID NO: 82741 - RNA, 64 nt, Human
aguccagcuccuuaaacugacgcuagucaauaaaccugggcaagugaggcaagagaaaugagga

SEQ ID NO: 82742 - RNA, 64 nt, Human
gcuagggugguguggaggggcugguccccugacaccugggcagauggggucuccuucagucucc

SEQ ID NO: 82743 - RNA, 64 nt, Human
aggcucugccuucuccaugggguaaccacccucgccugggcaggggcagccaaggcugggaaau

SEQ ID NO: 82744 - RNA, 64 nt, Human
uuucacucagcaggugccugggcuucuuaaggcuccugggcaaggcgugggaguuguccugacu

SEQ ID NO: 82745 - RNA, 64 nt, Human
ugcagugagccgagaccgugccacugcacuccagccugggcaacacagcgagacuccgucucga

SEQ ID NO: 82746 - RNA, 64 nt, Human
auaauguaugugugcccucccugugggcacaccaccugggcauuaggacugaaauuccugaguu

SEQ ID NO: 82747 - RNA, 64 nt, Human
ucugacauuaccucuuccugcaacuaaacacgagccugggcagaaccucucagccuuccucuac

SEQ ID NO: 82748 - RNA, 64 nt, Human
cugagcuggggggaucauugugaaggccuucuucccugggcaccugguaccuggggaccuacaa

SEQ ID NO: 82749 - RNA, 64 nt, Human
cauccuucucugcuugaccugaagaagggccagaccugggcagaaagacuccagcaggugagcu

SEQ ID NO: 82750 - RNA, 64 nt, Human
accccuuggccaaccacaucucccugcuguguccccugggcauuucucuaccucccagguggaa

SEQ ID NO: 82751 - RNA, 64 nt, Human
ggucugauaagaacccaggguggagagggagacuccugggcagccguuuuccucauccuuuccc

SEQ ID NO: 82752 - RNA, 64 nt, Human
agggcagucucaguugcaaucagugugugcccagccugggcagacaggaaauuccucggauaca

SEQ ID NO: 82753 - RNA, 64 nt, Human
aagguucugggagaaacaggggacccccucaccuccugggcagugaccccuacuaggcucccau

SEQ ID NO: 82754 - RNA, 64 nt, Human
uucuccugccaugggugcagacccugaacccacaccugggcaucagggccuuucuccuccccac

SEQ ID NO: 82755 - RNA, 64 nt, Human
ugcagugagccgagaucacgccacugcacuccagccugggcaacaagagugaaacuccgucuca

SEQ ID NO: 82756 - RNA, 64 nt, Human
cuuggucacaugagucugucuccuuacuuuagucccugggcaauccuugcuuaaugcuuuuguu

SEQ ID NO: 82757 - RNA, 64 nt, Human
gaggauggcuuugggccuaguaguucgaguccagccugggcagcauagugugagacccugucuc

SEQ ID NO: 82758 - RNA, 64 nt, Human
ugcagugagccgagaucguaccauugcacuccagccugggcaacaagagcgaaacuccauuuca

SEQ ID NO: 82759 - RNA, 64 nt, Human
ugcagugagccaagauugcaccacuguacuccagccugggcaacagagggagacuccaucuaga

SEQ ID NO: 82760 - RNA, 64 nt, Human
agacccugaagacuugcuuuuaaacaaagaaaauccugggcacuucugcagggcugcugguucc

SEQ ID NO: 82761 - RNA, 64 nt, Human
ucugccaaguuguccagcagcagaguggcccuggccugggcaucacaagccagugaugcuccug

SEQ ID NO: 82762 - RNA, 64 nt, Human
ccucuaccagcaucauccuggggcccagcucaggccugggcauauggaaagaaccaucaucuug

SEQ ID NO: 82763 - RNA, 64 nt, Human
ugggaggaucacuugaguccagguucaagacuagccugggcaacauggcaagacccugucccua

SEQ ID NO: 82764 - RNA, 64 nt, Human
ugcagugaacugagaucacgacacugcacuccagccugggcaacaguaaaaccuggucuccaaa

SEQ ID NO: 82765 - RNA, 64 nt, Human
uggccaaggccuguggacgacgcuggcggcccagccugggcagguuucagggugccagugggaa

SEQ ID NO: 82766 - RNA, 64 nt, Human
ggaggauggcuugaacacagguguucaaggccagccugggcaacauaacaagauccugucucuc

SEQ ID NO: 82767 - RNA, 64 nt, Human
cuggagaaguguguuucuuccccuuacucucacaccugggcaaacuuucuucaguguuuuucau

SEQ ID NO: 82768 - RNA, 64 nt, Human
ugcaguaagcugagaucgcgccacugcccuccagccugggcaacagagcaagacuccaucucaa

SEQ ID NO: 82769 - RNA, 64 nt, Human
cugaagcaggcagauauuuugagcccaggaccagccugggcaacauggugaaagcucaucucua

SEQ ID NO: 82770 - RNA, 64 nt, Human
uugccuuugcaauaccugcauccccagcacugguccugggcacuuccccaccccagccaggugu

SEQ ID NO: 82771 - RNA, 64 nt, Human
auucuguuauaaccuauggggucaggauaugaguccugggcauuauuuauccaggacccauccu

SEQ ID NO: 82772 - RNA, 64 nt, Human
ccccuugagcugggaacucaggcuccuggaaaaaccugggcagugggaggcucagcugcgggcc

SEQ ID NO: 82773 - RNA, 64 nt, Human
ggugggggcagcuccucuucuucugacucagagcccugggcagaucagcagauacaugucagug

SEQ ID NO: 82774 - RNA, 64 nt, Human
uacagugagccuugauugugucacugcacuccagccugggcaacagguaagacucugucucaaa

SEQ ID NO: 82775 - RNA, 64 nt, Human
ggaugaucaccugaggucaggaguucaagaucagccugggcaacauggcgaaaccccgucucua

SEQ ID NO: 82776 - RNA, 64 nt, Human
ugacaauguuaagaaauuuaaaaaaaaaaaaaagccugggcaugauggcucaugcuuguaaucu

SEQ ID NO: 82777 - RNA, 64 nt, Human
uuacaguagccgagaucgcgccacugcauuccagccugggcaacaaaagcgaaacucugucuca

SEQ ID NO: 82778 - RNA, 64 nt, Human
ugcagugagcugagaucgcaccauugcacuccagccugggcaacaagagcgaaacucugucuca

SEQ ID NO: 82779 - RNA, 64 nt, Human
ugaagggagcccgggcagccaccgucuccagagcccugggcagcauuuuccagcaagauguaca

SEQ ID NO: 82780 - RNA, 64 nt, Human
ggaggacugcuugagcccaggaguucaagaucagccugggcaacagagugagauaagacccaau

SEQ ID NO: 82781 - RNA, 64 nt, Human
aggcucuucggagcugucagcgcccggugccugcccugggcaccucccugcagucaucucuuug

SEQ ID NO: 82782 - RNA, 64 nt, Human
aggccaggguggccagccccgccaggaggccuggccugggcacacgcacugacgugggccuggg

SEQ ID NO: 82783 - RNA, 64 nt, Human
ugcagugagcugagauugcgccacugcacuccagccugggcaacaagagcaaaacuccgucuca

SEQ ID NO: 82784 - RNA, 64 nt, Human
ugcagugagccgagaucacaccacugcacuccagccugggcaacaagagcaaaacuccgucuca

SEQ ID NO: 82785 - RNA, 64 nt, Human
ggaggagugcuugaggccaggaguucaagaccagccugggcaacauagggagacccccaucuuu

SEQ ID NO: 82786 - RNA, 64 nt, Human
cucuucccuuuguguaucuuaccuaguguuuacuccugggcacccuuaaucuucagaggugcua

SEQ ID NO: 82787 - RNA, 64 nt, Human
ugcagugagccgagaucaugccacugcacuccagccugggcaacagagcaagacuccaucucga

SEQ ID NO: 82788 - RNA, 64 nt, Human
gcaguuccuccucucccucccggugagcugcugcccugggcagaggggaggagaauuccaggac

SEQ ID NO: 82789 - RNA, 64 nt, Human
cagguuagacguucccugcccugggacgcucaccccugggcaagaggcuggaaguucacaccau

SEQ ID NO: 82790 - RNA, 64 nt, Human
cacuugcguucucggggcugucgauuuccugccaccugggcagauaaccuggagauuuucaccu

SEQ ID NO: 82791 - RNA, 64 nt, Human
cauaggggccccacccagacuuaacaggcaagguccugggcauugcgcgacgcaggacucaaug

SEQ ID NO: 82792 - RNA, 64 nt, Human
ggaggauugcuucagcccaggaguuugagaccagccugggcaacauagcaaaaccccaucucua

SEQ ID NO: 82793 - RNA, 64 nt, Human
gggaagaucucuugagguaagaauuugagaccagccugggcaaaauagaccccaugucuacaaa

SEQ ID NO: 82794 - RNA, 64 nt, Human
gcagugagccaaguucacaccacugccauuuccuccugggcaacagagugagacccuaucacaa

SEQ ID NO: 82795 - RNA, 64 nt, Human
ugauaaaagcaauuuuaacuugcagaugugagccccugggcacaaugagccgcuaaaugggagc

SEQ ID NO: 82796 - RNA, 64 nt, Human
ugcagugagccgagaucgcgccacugcacuccagccugggcaacagagugagacucugucucaa

SEQ ID NO: 82797 - RNA, 64 nt, Human
caagauugagaagugaaacgguuugcgcagggguccugggcacgccugcggggucgcucaagga

SEQ ID NO: 82798 - RNA, 64 nt, Human
gauggaucgcuugagcccaggaguuugagaccagccugggcaacauggcaaaaccccaucucua

SEQ ID NO: 82799 - RNA, 64 nt, Human
ggaggauugcuugaggccaggaguuugagaccagccugggcaacauagggagacccagucucua

SEQ ID NO: 82800 - RNA, 64 nt, Human
cccagugagccgagaucgugccacugcacuccagccugggcaacagagugagacuucgucucaa

SEQ ID NO: 82801 - RNA, 64 nt, Human
ggagggaggagucauguuggagguuggggaagaaccugggcauccuuccccucaagccugggcu

SEQ ID NO: 82802 - RNA, 64 nt, Human
aggcaucguacuaguugggcgagaccuaaaauucccugggcacagguugcaccugggugugagc

SEQ ID NO: 82803 - RNA, 64 nt, Human
agcaaagcuauagagacaggugcauucagaacauccugggcaccagucaugagucuuacugugu

SEQ ID NO: 82804 - RNA, 64 nt, Human
uguuuacauguccgaugggggcaggagcucccauccugggcagccaaccaggcaacaccaagga

SEQ ID NO: 82805 - RNA, 64 nt, Human
uuuccuuggggaugaggguugggugcuauggcauccugggcaggugcuuccuuucugcacaagg

SEQ ID NO: 82806 - RNA, 64 nt, Human
uuuagugaucuaagaucaugccacugcacuccagccugggcaacagagugagacccuguuucua

SEQ ID NO: 82807 - RNA, 64 nt, Human
gguggaccgcuugaguccacgaguuuaagaccagccugggcaacauggugaagccccaucucua

SEQ ID NO: 82808 - RNA, 64 nt, Human
gcaacgugacgggcagcaacgccgucaaugucuuccugggcaucggccuggccugguccguggc

SEQ ID NO: 82809 - RNA, 64 nt, Human
ugaagugggagauugcuugaguccaggagaccagccugggcaacauagcaaaaccucaucucua

SEQ ID NO: 82810 - RNA, 64 nt, Human
ugcagugagccaagauugcgccauugcacuccagccugggcaacaagagagaaacucugucuca

SEQ ID NO: 82811 - RNA, 64 nt, Human
uucaguggcagugcuguaccccugggcagugcuaccugggcacacacguagacaagggcagcua

SEQ ID NO: 82812 - RNA, 64 nt, Human
cauguuaagggcauuucaguggcagugcuguaccccugggcagugcuaccugggcacacacgua

SEQ ID NO: 82813 - RNA, 64 nt, Human
ugcagugagccaagauugcaccacugugcucccaccugggcaacagugagacccugucucaaaa

SEQ ID NO: 82814 - RNA, 64 nt, Human
ggcagaucacugaagcucaggaguucaagaccagccugggcaacauggcgaaacuccauuucua

SEQ ID NO: 82815 - RNA, 64 nt, Human
gcagcucggacaccaggcugagcccggcgcagcaccugggcaguguccccaccccaggcccucc

SEQ ID NO: 82816 - RNA, 64 nt, Human
aaaaguggaccaguauuuguaauaaucgagaaugccugggcauuuuacaaaacaagaaaaaaaa

SEQ ID NO: 82817 - RNA, 64 nt, Human
cccgacaccagcccugcugcuuccuaacuuauugccugggcagugcccaccaugcaccccugau

SEQ ID NO: 82818 - RNA, 64 nt, Human
ggcagaucacuugagcccaggaguuugaggccagccugggcaacauggugaaacccggugucua

SEQ ID NO: 82819 - RNA, 64 nt, Human
ggugucccagaagugagaaggcagccuucgaaguccugggcauugggugagaaagugaugcuag

SEQ ID NO: 82820 - RNA, 64 nt, Human
cugugggauguugcugcaggacaguaagcccucaccugggcaaacaugaagcucuggccuccuu

SEQ ID NO: 82821 - RNA, 64 nt, Human
cugcgugggucuguuuuaacgugggccaagccuaccugggcagcccauuugccagggcuugccu

SEQ ID NO: 82822 - RNA, 64 nt, Human
uguggugagccgagaucgcgccacugcacuccagccugggcaacaagagugaaacuccgucuca

SEQ ID NO: 82823 - RNA, 64 nt, Human
acuuccacggucacaugugcaucgccuuugagcuccugggcaagaacaccuuugaguuccugaa

SEQ ID NO: 82824 - RNA, 64 nt, Human
ugcggugagcugagaucacgccauugcacuccagccugggcaacaagagcaaaacucagucuca

SEQ ID NO: 82825 - RNA, 64 nt, Human
ggacuggcaacuauaacaucgaagacuuugccgaccugggcauguuuccaccguuuucugagua

SEQ ID NO: 82826 - RNA, 64 nt, Human
gaaagauagcuugaguccaggaguuugagaccagccugggcaacauagugauaccccaucucuu

SEQ ID NO: 82827 - RNA, 64 nt, Human
augaagguuaauaauaaaugggcucauuuaguugccugggcaccuauucacaaauucauuuguc

SEQ ID NO: 82828 - RNA, 64 nt, Human
agaccuaacgucuaccuuuacaucugcuguugaaccugggcacuaccuguuacagauccuguca

SEQ ID NO: 82829 - RNA, 64 nt, Human
cuugaugucaccagugauacccacugcccugaccccugggcaggccccucucugcaucuacugg

SEQ ID NO: 82830 - RNA, 64 nt, Human
ggggaauugcuugaacucaggaguuggagaccagccugggcaacauggcaaaacgcagucugua

SEQ ID NO: 82831 - RNA, 64 nt, Human
ugcagugagccgagaucgcaccacugcacuccagccugggcaacagagugagacucugucuaaa

SEQ ID NO: 82832 - RNA, 64 nt, Human
accccaggggcuccugaguauaggcuuuucagucccugggcaguguccuugaguuguuuuuuga

SEQ ID NO: 82833 - RNA, 64 nt, Human
acccacuucuaggccugcccugccgccguggagcccugggcaagcucuuuccccuuucugggcc

SEQ ID NO: 82834 - RNA, 64 nt, Human
cugccacccaggccgggcuagggacauggcagggccugggcauccuggcgcuggacuugggcga

SEQ ID NO: 82835 - RNA, 64 nt, Human
uucuguuccucucucuccugcagaugcaagagcuccugggcaggggugccugggccccagggug

SEQ ID NO: 82836 - RNA, 64 nt, Human
cagaagucacugcaguauucccaauugcacuggcccugggcauggccuuacccagucuaagcug

SEQ ID NO: 82837 - RNA, 64 nt, Human
aggaccugagaugaccgcuguguggcgcucucucccugggcaggguggaugccacaggccccuc

SEQ ID NO: 82838 - RNA, 64 nt, Human
aagugccggccaccgcugucagggauugcccaccccugggcaucauguguguggggccggggag

SEQ ID NO: 82839 - RNA, 64 nt, Human
cccugcccuaccuggcguccugguccaggggagcccugggcagaagcccccggccccuauacau

SEQ ID NO: 82840 - RNA, 64 nt, Human
ugcagugagucgagaucgcgccagugcacuccagccugggcaagaagagcgaaacugggucuca

SEQ ID NO: 82841 - RNA, 64 nt, Human
gggaaugaggaaaauaugaacuacagcagaagccccugggcagcugugauggagccccugacau

SEQ ID NO: 82842 - RNA, 64 nt, Human
agccccguucugacccguguccccccaggcucugccugggcagaagacucaccuuggaggagug

SEQ ID NO: 82843 - RNA, 64 nt, Human
agcuuacagugagcugagauugcgccacuguacuccugggcaacagcgagacuccgucucaaaa

SEQ ID NO: 82844 - RNA, 64 nt, Human
ggacagacuuugccacggugcucugcugcccccuccugggcacguccaggugagggagggcugg

SEQ ID NO: 82845 - RNA, 64 nt, Human
uggaacuguagacccguccugucgacugugugccccugggcaugugugagccucaguuuccuca

SEQ ID NO: 82846 - RNA, 64 nt, Human
agcagagccugggaggaaggcggccgcuggggcuccugggcauccucucuggggagcugcuggc

SEQ ID NO: 82847 - RNA, 64 nt, Human
cagugcucggggccuuggggugcaugggugccgcccugggcagcuagagugucucagcccggug

SEQ ID NO: 82848 - RNA, 64 nt, Human
gaggcggagccaagaugaugccauugcacuccagccugggcaacaagagagaagguccuucuca

SEQ ID NO: 82849 - RNA, 64 nt, Human
ugcagugagcugagaucacaccauugcacuccagccugggcaaaaagagcaaaacucucccuaa

SEQ ID NO: 82850 - RNA, 64 nt, Human
gaccaaaaagccugcuuuaaaccgcaagauggggccugggcaugcgcaggaggagccaucgggu

SEQ ID NO: 82851 - RNA, 64 nt, Human
gggcgggggugagaacaucaaucgucagcgacagccugggcacccgcggggccgucccgccugc

SEQ ID NO: 82852 - RNA, 64 nt, Human
ggaggaucgcuugagaccaggaguucgagaccagccugggcagcauagcaagauccccaucuuu

SEQ ID NO: 82853 - RNA, 64 nt, Human
gaaggaucgcugcagcccaggaguucgagacuagccugggcaacauagcgagaccucgucucua

SEQ ID NO: 82854 - RNA, 64 nt, Human
ggaggauugcuugagcccaggaguuugagaccagccugggcaacacagcgagaccuugucucuu

SEQ ID NO: 82855 - RNA, 64 nt, Human
ugcugccauccucacccagcacccacaacuagcgccugggcagggcagggcuggcaccucucaa

SEQ ID NO: 82856 - RNA, 64 nt, Human
ugcaaugaaccgagauagugccauugcacuccggccugggcaacagaggaagacugccucaaac

SEQ ID NO: 82857 - RNA, 64 nt, Human
ugcagugagccaagauugcgccauugcacuccagccugggcaacacagcgagacuccgucucaa

SEQ ID NO: 82858 - RNA, 64 nt, Human
aguggaucacuuaagcucaggaguucaaggccagccugggcaacauggcaaaaccccauuucua

SEQ ID NO: 82859 - RNA, 64 nt, Human
gcccagcucgccagggaugugggcagagcaccagccugggcaucaggaagccaaguuucaagga

SEQ ID NO: 82860 - RNA, 64 nt, Human
gugguccuucccagaaacugccaguagagggcagccugggcauccuaaugcuuacucugguugu

SEQ ID NO: 82861 - RNA, 64 nt, Human
agccccagggagagggggcuggugggugccuaggccugggcaguggauggccgugaaugggugc

SEQ ID NO: 82862 - RNA, 64 nt, Human
auuuuuuuauaccuaaauaaagaaaaaucuuuagccugggcaacauagggagacccuaucucua

SEQ ID NO: 82863 - RNA, 64 nt, Human
ugcggugagccaagaucgcaccauugcacuccagccugggcaacaagagugaaacucugucuca

SEQ ID NO: 82864 - RNA, 64 nt, Human
ugcagugagcugagauugugccacuguacuccagccugggcaacaagagcgagacuccguuucc

SEQ ID NO: 82865 - RNA, 64 nt, Human
cccuucccuguuccuuucuugcacgcgcucccugccugggcacaccaaacugguugaaacacag

SEQ ID NO: 82866 - RNA, 64 nt, Human
uguucugcacugugggcuggcucucugccccaacccugggcacuggccccuggcugggccauuu

SEQ ID NO: 82867 - RNA, 64 nt, Human
ggaacuuaggguggguaccucugagucccagggaccugggcaggcccaagcccaccacgagcau

SEQ ID NO: 82868 - RNA, 64 nt, Human
gggaccgcaggccauuguugaacuccucuauacuccugggcacugguugacaguacugaggcuu

SEQ ID NO: 82869 - RNA, 64 nt, Human
ccuuagacacauccuccuaccguccccaaugcccccugggcaggaggcaguggagaaccaagcc

SEQ ID NO: 82870 - RNA, 64 nt, Human
ggaagaucgcuugaggccaagaguucaagaccagccugggcaacauagcgagaccccuaucugu

SEQ ID NO: 82871 - RNA, 64 nt, Human
aacuaagauacuguagacuggacaagaaauucuaccugggcaccuaggugaugccuucuuucuu

SEQ ID NO: 82872 - RNA, 64 nt, Human
accugccaccaagguuuccucucuucccccaggaccugggcagagcaggcaugagcugggcugu

SEQ ID NO: 82873 - RNA, 64 nt, Human
guggugauauuguguggucugguuccugugugacccugggcaguuccuuaccucccuggucccc

SEQ ID NO: 82874 - RNA, 64 nt, Human
ugugggaggucccucacuccacgggacagaggccccugggcagcagaggaaaccuacagcucug

SEQ ID NO: 82875 - RNA, 64 nt, Human
ucacccuuggcccagccuccccacaaagccugacccugggcaggugagugacggguguguccuc

SEQ ID NO: 82876 - RNA, 64 nt, Human
cucagcccuugcacccggccgggcucaguucaggccugggcaccgagcuucacccugggugggu

SEQ ID NO: 82877 - RNA, 64 nt, Human
ccucagguacagcgggcugugcccggccccacccccugggcagaugucccccacugcuaaggcu

SEQ ID NO: 82878 - RNA, 64 nt, Human
uggcggggggucagcagcaugucccugggcaggcccugggcacccugucuccccuggucucacu

SEQ ID NO: 82879 - RNA, 64 nt, Human
ggggugcaggguggcggggggucagcagcaugucccugggcaggcccugggcacccugucuccc

SEQ ID NO: 82880 - RNA, 64 nt, Human
gguggauugcuugagcccaggaguucaagagcagccugggcaauauagaaagaccucuucccua

SEQ ID NO: 82881 - RNA, 64 nt, Human
ccaggccugaaacucccuuuccaggacucucaucccugggcacagaauucaggaaacugcuaga

SEQ ID NO: 82882 - RNA, 64 nt, Human
auggggccagggaaucugcauuucuaacgcgcucccugggcaacgcuucagaugcguugaaguu

SEQ ID NO: 82883 - RNA, 64 nt, Human
ugcaaugagcuauaauugcaucauugcacuccagccugggcaacagagacccugucucaaccac

SEQ ID NO: 82884 - RNA, 64 nt, Human
ucacacaaggaauauaaaaaccaccacccuccagccugggcaacguaguaaaaccucaucuaua

SEQ ID NO: 82885 - RNA, 64 nt, Human
ugcagugagccgagauugugccacugcacuccagccugggcaacagagcuagacucugugucaa

SEQ ID NO: 82886 - RNA, 64 nt, Human
ugcagugaguugagauugugccauugcacuccagccugggcaacagagcaagacucugucucag

SEQ ID NO: 82887 - RNA, 64 nt, Human
ccacugugccuuagaaucgccccuggacagaguuccugggcagaggggaaagcagcucccaggc

SEQ ID NO: 82888 - RNA, 64 nt, Human
ggaggaucauuugagcccaggaguucgagaccaaccugggcaacauagugagauucuguuaaaa

SEQ ID NO: 82889 - RNA, 64 nt, Human
cgagagugcauucacacucuuguucccuagaaagccugggcaccucccacucgauuccugcucc

SEQ ID NO: 82890 - RNA, 64 nt, Human
uguugcccaaauucagugucagugaaguucuuuuccugggcaaucuuaacaucuuuacucuuau

SEQ ID NO: 82891 - RNA, 64 nt, Human
agcugggccuaggggugcagggucagugcugaggccugggcagggccgcuagccucccugagcu

SEQ ID NO: 82892 - RNA, 64 nt, Human
auagucagguagauucagaccuuguccacaccuuccugggcaacccccaccaugaaccugucag

SEQ ID NO: 82893 - RNA, 64 nt, Human
ccaaacacaaucagaaccagccaaagaagcacuuccugggcacggccaccagcucucccgccuc

SEQ ID NO: 82894 - RNA, 64 nt, Human
cguuggugaacggaccaugcuuccguagcucugaccugggcagcuuggaccuggucauccucua

SEQ ID NO: 82895 - RNA, 64 nt, Human
ucguagauuugcugcugaugaaaauacucaguuuccugggcauuaagucuaagagagaggagcc

SEQ ID NO: 82896 - RNA, 64 nt, Human
acauaaaaucccugccuucuugagcuaacauucuccugggcauccccacuccauuuucagauga

SEQ ID NO: 82897 - RNA, 64 nt, Human
cucagcaagugcccaguggagccugccgcccccgccugggcaccgggacccccucaccauccag

SEQ ID NO: 82898 - RNA, 64 nt, Human
gagccuuccuuucuccugccccaagggcccagacccugggcaaacagagcuacugagacuugga

SEQ ID NO: 82899 - RNA, 64 nt, Human
gggacggcaccccagugguggcagagcuugggggccugggcaggggcccgcuuggcgggccggg

SEQ ID NO: 82900 - RNA, 64 nt, Human
ucaccuuggcugugggcugugaacauuccgggacccugggcaucuuaucuagguccgugcagcc

SEQ ID NO: 82901 - RNA, 64 nt, Human
cuggcagugggggaggaggagagggaagauggucccugggcacuguggcagcuaaccacaggaa

SEQ ID NO: 82902 - RNA, 64 nt, Human
cucccaggcccuggagaccuccaggcuuuccugcccugggcagccccaccucacagccagaguc

SEQ ID NO: 82903 - RNA, 64 nt, Human
uccaaacaggcucagaggguguccugcaccggggccugggcaggagggaggugcuucuaguucu

SEQ ID NO: 82904 - RNA, 59 nt, Human; identical to SEQ ID NO: 79421

SEQ ID NO: 82905 - RNA, 64 nt, Human
ugcagugagccgagauccugccacugcacuccagccugggcaaccaagcgagacucugccuuaa

SEQ ID NO: 82906 - RNA, 64 nt, Human
ugcagugagucaagaucacgccauugcacuccagccugggcaacaagagcgaaacuccaucuca

SEQ ID NO: 82907 - RNA, 64 nt, Human
ggaggauuacuugaaacccacaguuugagaccagccugggcaacauagugagacccugucucua

SEQ ID NO: 82908 - RNA, 64 nt, Human
ccucuagcagcaauuuccagcuguguaacacuauccugggcaaauguuuuacccuguccuccag

SEQ ID NO: 82909 - RNA, 64 nt, Human
gucgccaucuuggugacuuugaauuuaucuggcuccugggcaggucuucuccuccucuccaucc

SEQ ID NO: 82910 - RNA, 64 nt, Human
augacacaguagauguggaacaccuagcccagugccugggcaggucccuauuaucauaaaugaa

SEQ ID NO: 82911 - RNA, 64 nt, Human
aaccaauccaccaacagaaugugguuucugccauccugggcagaagcugaaggccagcuucaca

SEQ ID NO: 82912 - RNA, 64 nt, Human
cgugggguggggggugcuucugugcccacgggucccugggcaacagucccuaggcuaagacagg

SEQ ID NO: 82913 - RNA, 64 nt, Human
ugugaccaaggucggccuaaaggauggcgcagguccugggcaggaaagaauuuuuccuuuauca

SEQ ID NO: 82914 - RNA, 64 nt, Human
ccucagacaggaauuaaggcaaugcccaggcgggccugggcacuguauucugagcaaaggccug

SEQ ID NO: 82915 - RNA, 64 nt, Human
ggcagugagccgagauugcgccauugcacuccagccugggcaaaaagagugagacucugucuca

SEQ ID NO: 82916 - RNA, 64 nt, Human
ggcaggaggauugagaccaggaguucgagaagagccugggcaacauagugagaccccaucucua

SEQ ID NO: 82917 - RNA, 64 nt, Human
ggcggaucacuugagcucaggaguccuaaaccagccugggcaacauagugauaccuugucucua

SEQ ID NO: 82918 - RNA, 64 nt, Human
cuaauuguuuuacuuguuaacuuguucuugugccccugggcacuuggccuuugucugcucucag

SEQ ID NO: 82919 - RNA, 64 nt, Human
ugcagcgagcugagaucacgccacugugcuccagccugggcaacaaagugagacucugucucaa

SEQ ID NO: 82920 - RNA, 64 nt, Human
cguacucugcguggggcuccaccucacacccaccccugggcaucuuaggacuggaggggcuccu

SEQ ID NO: 82921 - RNA, 64 nt, Human
cuuguuugcccaccuuuggcugauacccagagaaccugggcacuugcugccugaugcccacccc

SEQ ID NO: 82922 - RNA, 64 nt, Human
cugggcaccugacuuggcuggggaggaccagggcccugggcagggcagggcagccugucacccg

SEQ ID NO: 82923 - RNA, 64 nt, Human
ccccuacaccucccuccccacaccucccuacuccccugggcaucuucuggcuugacuggaugga

SEQ ID NO: 82924 - RNA, 64 nt, Human
ucaccacacuggccccaggucucaggagggguguccugggcagggaaggucagugucacugaug

SEQ ID NO: 82925 - RNA, 64 nt, Human
ugcaguaagccaagaucaugccauugcacuccagccugggcaacacagggagacuccaucucaa

SEQ ID NO: 82926 - RNA, 64 nt, Human
cuggagacugggacaucccugauagguucacaucccugggcagaguaccaggcugcugacccuc

SEQ ID NO: 82927 - RNA, 64 nt, Human
gggauagcacguggagcucuuggcuggggcugacccugggcagggacuuuccugcagggccaga

SEQ ID NO: 82928 - RNA, 64 nt, Human
aguguauguucucauuuaccacaggccuaccagcccugggcacagcagcuucauggcaagacau

SEQ ID NO: 82929 - RNA, 64 nt, Human
ccugccucauguggggguguccugggcugaauuuccugggcacuucucaguggaacucucuagc

SEQ ID NO: 82930 - RNA, 64 nt, Human
gaugaggggaggaaacucaccugcuggccccucaccugggcaccuggggagugggacagagucu

SEQ ID NO: 82931 - RNA, 64 nt, Human
cccacgggaaccuggaaggaggcucuuugugagaccugggcaaaggauggggcagcucgucgau

SEQ ID NO: 82932 - RNA, 64 nt, Human
gaauuacauuugguugggaaaugucccucaaaauccugggcacuaugaaggaacccccugcccc

SEQ ID NO: 82933 - RNA, 64 nt, Human
cugagugggggaguguccuggcagcagcgagugaccugggcaguggccaggugggugcgaugac

SEQ ID NO: 82934 - RNA, 64 nt, Human
aggcggggaggauccauugagcccagcaguccaaccugggcaaaauagugagagacccuguauc

SEQ ID NO: 82935 - RNA, 64 nt, Human
ugcagugagcugagauugugccacugcacuccagccugggcaacaaagcaagacucugucucaa

SEQ ID NO: 82936 - RNA, 64 nt, Human
ugcagugagccaagaucaugucacugcauuccagccugggcaacagaggaagacuccgucucaa

SEQ ID NO: 82937 - RNA, 64 nt, Human
cugagauauucagcccacugcccaaugccugcuuccugggcauagccauggaacccugccaggc

SEQ ID NO: 82938 - RNA, 64 nt, Human
gccaacuccuucuccucuuccugacccucccuccccugggcagaagaaacgcauguggaccaga

SEQ ID NO: 82939 - RNA, 64 nt, Human
uuacugcuucucuuugugcaguguuaguauucacccugggcagugagugccaugcuuuuuggug

SEQ ID NO: 82940 - RNA, 64 nt, Human
agaugaggaaauaaugggaaagguugaauuaauuccugggcauggacuaccagaugaccacaag

SEQ ID NO: 82941 - RNA, 64 nt, Human
ugcagugagcccagauugcaccacugcucucuagccugggcaaaaaaacuaguuccaaaaaaga

SEQ ID NO: 82942 - RNA, 64 nt, Human
cuccuucuaugaaagccuccucgagccaggugcuccugggcaccuucagaagugauguccugug

SEQ ID NO: 82943 - RNA, 64 nt, Human
uuccucuguguguuaucucugccccacagcagccccugggcagcaccaguggccacugggcucc

SEQ ID NO: 82944 - RNA, 64 nt, Human
cuguuggagaaaugaggaugucugucccugucugccugggcaggccagauuccuccccagcagc

SEQ ID NO: 82945 - RNA, 64 nt, Human
ucacuagcuuuuggugaaggaucugccaggguguccugggcagagugagcguggagggccggug

SEQ ID NO: 82946 - RNA, 64 nt, Human
ugcagugagccaagaguacaccacugcacuccagccugggcaacagagcgagacuccgucuuaa

SEQ ID NO: 82947 - RNA, 64 nt, Human
ccccuggcagugcucccggaggggcccaggaaggccugggcagagacccuguaggaugggguca

SEQ ID NO: 82948 - RNA, 64 nt, Human
gaagacugggggagagcaguggguucugggggggccugggcaggaucccagcucccuccccucu

SEQ ID NO: 82949 - RNA, 64 nt, Human
ggaggaucacuugagcccaggaguucaaaaccagccugggcaauauagugagaccguaucacua

SEQ ID NO: 82950 - RNA, 51 nt, Human; identical to SEQ ID NO: 79467

SEQ ID NO: 82951 - RNA, 64 nt, Human
augccgucugaugcccuguccaaugugaggacugccugggcagggucugccccucccaccccuc

SEQ ID NO: 82952 - RNA, 64 nt, Human
ucccaggaagagcgggcagaguggcccagcccccccugggcagggagagggccaaggacaauug

SEQ ID NO: 82953 - RNA, 52 nt, Human; identical to SEQ ID NO: 79470

SEQ ID NO: 82954 - RNA, 64 nt, Human
caugaucagggauaugagcagggccugcccagagccugggcaccuuugggagagggaaaaguga

SEQ ID NO: 82955 - RNA, 64 nt, Human
uauucagaucgccacacucugugaggcagcagagccugggcagguguuuggcuuaguauuuguu

SEQ ID NO: 82956 - RNA, 64 nt, Human
agggggacccuacccccaccucagguugggcuucccugggcacucaugcuccacaccaaagcag

SEQ ID NO: 82957 - RNA, 64 nt, Human
guuggcagcccucucaccccagggccuguggcugccugggcaccucucccaggaaguggugggg

SEQ ID NO: 82958 - RNA, 64 nt, Human
ugcccuugauugugccagcccaugccacccccauccugggcacaguuacacccucccaugcagu

SEQ ID NO: 82959 - RNA, 64 nt, Human
uucagugagccgagauugcaccauugcaccccagccugggcaacagagcgagacuccgucucaa

SEQ ID NO: 82960 - RNA, 64 nt, Human
uucuugggauaguguucugcuccugcuuuucuguccugggcauggguccagggccugacacccc

SEQ ID NO: 82961 - RNA, 64 nt, Human
ggaagccuggugccgauggccccacccucaccagccugggcagcagcaagaacuauuuauuaaa

SEQ ID NO: 82962 - RNA, 64 nt, Human
cucggauggccucccugccccucugcuggcacagccugggcaaggggagaagguggucccugca

SEQ ID NO: 82963 - RNA, 64 nt, Human
ggaagauuccuugagcacaggaguuccagaccagccugggcaauguagcaagacgcugucucua

SEQ ID NO: 82964 - RNA, 64 nt, Human
agcaggcagggaggaggcggagguggcaaauaaaccugggcaauuuuguuuauacaaaaaauag

SEQ ID NO: 82965 - RNA, 64 nt, Human
ugcagugagccgagauugcgccacugcgcuccagccugggcaacagagcgagacuccaucucaa

SEQ ID NO: 82966 - RNA, 64 nt, Human
uuaggucccaauucggggccugcuggaguuccggccugggcaccagcauuuggcagcacgcagg

SEQ ID NO: 82967 - RNA, 64 nt, Human
uugacuuuacccucaugguggcaggagagucuggccugggcaaauccacacuugucaauagccu

SEQ ID NO: 82968 - RNA, 64 nt, Human
ggcccuuccugagggccggccacauucccgcccuccugggcagauuggguagaaaggacauucu

SEQ ID NO: 82969 - RNA, 64 nt, Human
aacagugcuuguagcuuugauguggaacaggggcccugggcauuucugcugagaaccaaacugc

SEQ ID NO: 82970 - RNA, 64 nt, Human
ggaggaucgcuugagccugggaguucaagaccagccugggcaacauggcaagacccugucucua

SEQ ID NO: 82971 - RNA, 64 nt, Human
guuugccauugcagagcaagcugccacgaagaccccugggcaugauuuugcuuguauuuccgga

SEQ ID NO: 82972 - RNA, 64 nt, Human
accggacagggguugaggggaccuccucagaggcccugggcacgggaggggguggggcugggcg

SEQ ID NO: 82973 - RNA, 64 nt, Human
accauggccaaggagggcuuuucugugggaugggccugggcacgcggcccucuccugucagugc

SEQ ID NO: 82974 - RNA, 64 nt, Human
uuguuaggaagaacauuuggugggaaugaacacuccugggcauaccgcugacuuuugucccuug

SEQ ID NO: 82975 - RNA, 64 nt, Human
gguggaucacuugaggucaggaguucaagaccagccugggcaacauggcgaaacccugucucua

SEQ ID NO: 82976 - RNA, 64 nt, Human
ugcagugagccaagaucacgccacugcacuccagccugggcaacggagugagacucugucucaa

SEQ ID NO: 82977 - RNA, 64 nt, Human
ggcagauugcuugaacccaggaguucaagaccagccugggcagcauggugaaacccuguaucua

SEQ ID NO: 82978 - RNA, 64 nt, Human
ugcggugagcugugaaugcaccacggcacucaagccugggcaauguagcaagauccugucucua

SEQ ID NO: 82979 - RNA, 64 nt, Human
ugcagugagccaagaucaugccacugcacuccagccugggcaacagagugagacuccgucucaa

SEQ ID NO: 82980 - RNA, 64 nt, Human
guugcagugagccgagauugccacugcacuccagccugggcaacaagagcgaaacuccgucuca

SEQ ID NO: 82981 - RNA, 64 nt, Human
ccccuuggacacgcucaguggggcagaggcaguaccugggcaagcuggcggcuggggucccagc

SEQ ID NO: 82982 - RNA, 64 nt, Human
cccuuugaccuuguuucuugaagguuuccucgucccugggcaauuccgcauuuaauucauggua

SEQ ID NO: 82983 - RNA, 64 nt, Human
ugcagugaguugugauugcaccacugcccuccagccugggcaacagagugaaaccuugucucuc

SEQ ID NO: 82984 - RNA, 64 nt, Human
cuccccacccgccacccacccuggagcccgccggccugggcaggggguccaggugggccacaca

SEQ ID NO: 82985 - RNA, 64 nt, Human
gcgaggaugggagggggugcugagcugugaauccccugggcagggggcgacaacuccguguagc

SEQ ID NO: 82986 - RNA, 64 nt, Human
ucucucaggagccccaucuccgggcgugucaccuccugggcaggguucugggacccucuguggg

SEQ ID NO: 82987 - RNA, 64 nt, Human
agaccagccccaaggccagaccaaggcauguaggccugggcagguggcucggggccacuggcgg

SEQ ID NO: 82988 - RNA, 64 nt, Human
gagaagagggugaaggagcuggggcaggccccauccugggcauuggagaugaugaaaccgagca

SEQ ID NO: 82989 - RNA, 64 nt, Human
ugcagugauccaagaucaugccacugcacuccagccugggcaacaagagcaaaacuccgucuca

SEQ ID NO: 82990 - RNA, 64 nt, Human
ugcagucagcucagauugcaccacugcacuccagccugggcaacagagcgagacccugucucca

SEQ ID NO: 82991 - RNA, 64 nt, Human
ugccggagaccucccuucccugggccccuucucuccugggcagccacaccacagagcggggagg

SEQ ID NO: 82992 - RNA, 64 nt, Human
cgggccucuagcuucagccagggcggguacacacccugggcacaggguccucagcccccgggaa

SEQ ID NO: 82993 - RNA, 64 nt, Human
acaagggaggggaaacuccaucaggaagugcuccccugggcagaggcgcccacugggugcugug

SEQ ID NO: 82994 - RNA, 64 nt, Human
uaagccuuuugccgcuccggggaccagcagcaauccugggcagccaguggcucuuguagagaag

SEQ ID NO: 82995 - RNA, 64 nt, Human
ucuuggcucugcccgaggauguggccguucccugccugggcaggggcuccaaggaggggccauc

SEQ ID NO: 82996 - RNA, 64 nt, Human
ggaagcaauaaugguguauacccucauucucauuccugggcagcccuuccuuccacccuggcac

SEQ ID NO: 82997 - RNA, 64 nt, Human
gaugaugucagggggagagguggagggcagauguccugggcaaaccgggccccucugcccacac

SEQ ID NO: 82998 - RNA, 64 nt, Human
ugucgugagcuaugauuaugccacugcuuuccagccugggcaacauaguaagaccccaucucuu

SEQ ID NO: 82999 - RNA, 64 nt, Human
ugcagugagccaugaucgagccacugcacuccagccugggcaacagaugaagacccuauuucag

SEQ ID NO: 83000 - RNA, 64 nt, Human
ugcagugagccgagguugcaccauuguacuccagccugggcaacaagagugaaacucugucuua

SEQ ID NO: 83001 - RNA, 64 nt, Human
uugcagugagccgaggucacaccauucacuccagccugggcaacaagagcgaaacuccguuuca

SEQ ID NO: 83002 - RNA, 64 nt, Human
ugcagugagccaagauugugccauugcacucuagccugggcaacaggagcaaaacuccgucuca

SEQ ID NO: 83003 - RNA, 64 nt, Human
uccuccccugcccugagcugcaugguucccccacccugggcagccaggaaggaaucugaaugga

SEQ ID NO: 83004 - RNA, 64 nt, Human
gggccugggaggagguccuggggcgugcacccgcccugggcaguggggaggagaguggccugag

SEQ ID NO: 83005 - RNA, 64 nt, Human
gaaggaucacuuagagcuaggaguuugagaccagccugggcaauauagcaagaccccucacuac

SEQ ID NO: 83006 - RNA, 64 nt, Human
ugcagugagccgagauugcgccacugcacuccagccugggcaacagagugaaacucugucucaa

SEQ ID NO: 83007 - RNA, 64 nt, Human
ggaggauugcuugaagccaggaguuugggaccagccugggcaacauagggggaucccaucucua

SEQ ID NO: 83008 - RNA, 64 nt, Human
ugcagugagcuaugauuguaccacugcacuccagccugggcaacagagcaagaccuugucucaa

SEQ ID NO: 83009 - RNA, 64 nt, Human
ggcaagagacaccguggcgucucaugugaacuuuccugggcacugugguuuuauuuccuaauug

SEQ ID NO: 83010 - RNA, 64 nt, Human
guuuacagagggccccugggcugcgcggccccagccugggcacccugauuuuuaagccauagac

SEQ ID NO: 83011 - RNA, 50 nt, Human; identical to SEQ ID NO: 79528

SEQ ID NO: 83012 - RNA, 64 nt, Human
ugaagugagcugagaucgcgccauugcacuccagccugggcaacaagaguggcacuccaucuca

SEQ ID NO: 83013 - RNA, 64 nt, Human
cuguagaagagauagcuauuaaaauaaucaguagccugggcauaguggcucacaccuguaaucc

SEQ ID NO: 83014 - RNA, 64 nt, Human
ggaggacugcuugaguccagaaguuuaagaccagccugggcaacacggggagacccugucucua

SEQ ID NO: 83015 - RNA, 64 nt, Human
gcauggguacacgcgcguuuccagugcacaucugccugggcaggacacgguuuccucuugcugg

SEQ ID NO: 83016 - RNA, 64 nt, Human
uugcaaugagcaagauugugccacugcacuccagccugggcaacagagcaagacucugucucaa

SEQ ID NO: 83017 - RNA, 64 nt, Human
ucuugcagcuuggccuugaugaccucuguuucuuccugggcagguccuggagcggcuguuccag

SEQ ID NO: 83018 - RNA, 64 nt, Human
cugacccaacacccccgacggccuccaggaggggccugggcagccccacagucccauuccucca

SEQ ID NO: 83019 - RNA, 64 nt, Human
ugcagugaaccuagaucacgccacugcauuccagccugggcaacagagcgagacuccaucuuaa

SEQ ID NO: 83020 - RNA, 64 nt, Human
ccagcacuguggaaagacaggaguucgaaaccagccugggcaacauagugagacccugccucau

SEQ ID NO: 83021 - RNA, 64 nt, Human
acggcucccacuaaggccugcccaccaccgcccgccugggcagccaugaauguagcgccccagg

SEQ ID NO: 83022 - RNA, 64 nt, Human
gccccagcccgccaugccacaaggugggggaggcccugggcaggauguucacucuauuuauugg

SEQ ID NO: 83023 - RNA, 64 nt, Human
ggaggaucacuuaaggccaggaguucgagaccagccugggcaacagcaagaccucaucucuaca

SEQ ID NO: 83024 - RNA, 64 nt, Human
ggcaggaggaucacucgagcucaagaauucaagaccugggcaagagagagagacuuugucucua

SEQ ID NO: 83025 - RNA, 64 nt, Human
ggaugauggcuugagcccaggaguucgagaccagccugggcaacacagcgagaucucuuggggg

SEQ ID NO: 83026 - RNA, 64 nt, Human
ggaugaguaggaguuaguuaggcauugaguuugcccugggcaaaagcccagaagugggaguaug

SEQ ID NO: 83027 - RNA, 64 nt, Human
ugcagugagccgagaucgugccacuguacuccagccugggcaacaaggcgagacuccaucucaa

SEQ ID NO: 83028 - RNA, 64 nt, Human
gaaggagguggagcagcuggggcugggggcacagccugggcauucuguggggaggccguccucg

SEQ ID NO: 83029 - RNA, 64 nt, Human
ggaggaucguuugaggccaggaggucaauaccagccugggcaacauaguaagacccugucucua

SEQ ID NO: 83030 - RNA, 60 nt, Human
gcucccagcugcuuuacuaaaggggaaguuccugggcaucuccguguuucucuuuguggg

SEQ ID NO: 83031 - RNA, 56 nt, Human; identical to SEQ ID NO: 79548

SEQ ID NO: 83032 - RNA, 64 nt, Human
gggaaagaguccugcuguugauccucacauguuuccugggcaccuaacucugucagccacugcc

SEQ ID NO: 83033 - RNA, 64 nt, Human
ugcagugagcugagaucucaccacugcacuccagccugggcaacagagcgagacucugucucaa

SEQ ID NO: 83034 - RNA, 64 nt, Human
aaauaaucuaaauguuuguggauuccugugucucccugggcaguugaccugcacagacaggaac

SEQ ID NO: 83035 - RNA, 64 nt, Human
ggcggauugccugagcucaggaguucaagaccagccugggcaacauggugaaaucccaugucua

SEQ ID NO: 83036 - RNA, 64 nt, Human
ggugguucauuggaggccaggaguuagagaucagccugggcaacauagccagaccuccucucua

SEQ ID NO: 83037 - RNA, 64 nt, Human
uggauaucccugaggccaugagggugggagccggccugggcagcuccaacuccagagaagggua

SEQ ID NO: 83038 - RNA, 64 nt, Human
ugcagugagcugagaucacacuacugcacuccagccugggcaacagagcaagacugucucaaaa

SEQ ID NO: 83039 - RNA, 64 nt, Human
aggggcaucacuugaaccaggaguucaguacuaaccugggcaacaaagaggccccugucucuga

SEQ ID NO: 83040 - RNA, 64 nt, Human
cugcugcuccuguugcuuucacguagagucucggccugggcagucacgugguggucacuccugg

SEQ ID NO: 83041 - RNA, 64 nt, Human
acagcgggccaggccccgacccuguugugacccaccugggcaccuucccggaccagcuccgccu

SEQ ID NO: 83042 - RNA, 64 nt, Human
gacccgagccuguccuggcugcuggcccauccugccugggcaucccuggugcuggggacugugc

SEQ ID NO: 83043 - RNA, 64 nt, Human
gugccugcucggaagagcucacugccagcugcggccugggcaccgcgggccauguguguuugca

SEQ ID NO: 83044 - RNA, 64 nt, Human
ugcaugcacgcaaugcuagcugccccuuucccguccugggcaccccgagucucccccgaccccg

SEQ ID NO: 83045 - RNA, 64 nt, Human
uaggacacaaggaauccgagaccccgcacagcccccugggcacccggcauggggccuggggccc

SEQ ID NO: 83046 - RNA, 64 nt, Human
ugcggugagccaagaucgcaccauugcacuccagccugggcaacaagagcgaaacucugucuca

SEQ ID NO: 83047 - RNA, 64 nt, Human
gcaccacccaccugggaggccgaggaggagguccccugggcacagggccucuuugggacuucag

SEQ ID NO: 83048 - RNA, 64 nt, Human
guugucguggacccccagguugcaaguuacauacccugggcauguccagaugaacgaagcgugc

SEQ ID NO: 83049 - RNA, 64 nt, Human
uacagagagcuaugauugcaccacugcacuccagccugggcaacaaagcaagacccugucucuu

SEQ ID NO: 83050 - RNA, 64 nt, Human
aggcagaagccuccuauaacaaagggugguguggccugggcauuggagucaauaaauuaugguc

SEQ ID NO: 83051 - RNA, 64 nt, Human
gagcuugagcuugagccuagacguuaaagaccagccugggcaacacagcaagacccaucucuac

SEQ ID NO: 83052 - RNA, 64 nt, Human
ggaggcgcccccgccccgccccagagcugggcccccugggcagguuccccaccccgccccaccg

SEQ ID NO: 83053 - RNA, 64 nt, Human
gggggacugcuuaagcccaggaguucaagaccagccugggcaacauagugagacucuguuauaa

SEQ ID NO: 83054 - RNA, 64 nt, Human
ugcggugagccaagaucgcgccacugcacuccagccugggcagcaagagcaaaacaaccucugu

SEQ ID NO: 83055 - RNA, 64 nt, Human
cccuaauauuugcaggagcgugguucuaccacccccugggcauacauaaaucgacacaugccaa

SEQ ID NO: 83056 - RNA, 64 nt, Human
ggcaaauugcuugaccucaggaauuugaggccugccugggcaaaauggugaaaccaugucucua

SEQ ID NO: 83057 - RNA, 64 nt, Human
cugccaugguuggaagaugguaucagagggccugccugggcagucugucuccgggccaggguca

SEQ ID NO: 83058 - RNA, 64 nt, Human
ucuacccugugaagggaaaugagggcuuuaguuuccugggcagggaggggcagcuucugagguu

SEQ ID NO: 83059 - RNA, 64 nt, Human
accaggggcugguggcccaggccagggagggaacccugggcagggcucuggugggagagggaga

SEQ ID NO: 83060 - RNA, 64 nt, Human
ggaggaucgcuugagcccagagguucgagaucaaccugggcaagagagugagacccugacucua

SEQ ID NO: 83061 - RNA, 64 nt, Human
ugaagagagcuaugacugcaucacugcacuccagccugggcaacacagcaagauccugucuaaa

SEQ ID NO: 83062 - RNA, 64 nt, Human
ggaggacugcuuaagcucaggaguuugagaccagccugggcaacauagcaagacccccaccauc

SEQ ID NO: 83063 - RNA, 64 nt, Human
auuuccccguucaacucccuguugucccuuccauccugggcaaaacugaaagggacccggagcu

SEQ ID NO: 83064 - RNA, 64 nt, Human
gugguggccuagcauugcuuacauccacccugugccugggcagccacuucuguucuuggacaga

SEQ ID NO: 83065 - RNA, 64 nt, Human
ugcagugagccaagauugcgccuuugcacuccagccugggcaagagagcaagacucugucucaa

SEQ ID NO: 83066 - RNA, 64 nt, Human
auucccaagguucgcaccuccuggagcagcagcgccugggcaguccucugggcuggccucggga

SEQ ID NO: 83067 - RNA, 64 nt, Human
ugcagugagccgagaucacgccauugcacuccagccugggcaacaagagcaaaacucuaucuca

SEQ ID NO: 83068 - RNA, 64 nt, Human
gcccuggccccccacucccaaugagcagcccaggccugggcaaaaagcgcaaaguguccuugcu

SEQ ID NO: 83069 - RNA, 64 nt, Human
ggaggaucacuggagcucgggaguucaagaccagccugggcaacauagugaaaccgucuccaca

SEQ ID NO: 83070 - RNA, 64 nt, Human
ggaggaucaguugagccccagaguucaagaccagccugggcaauguaguaagacccccaucgcu

SEQ ID NO: 83071 - RNA, 64 nt, Human
ugcagugaaccaagaucaugccacugcacuccagccugggcaacacagcgagacuccgucucaa

SEQ ID NO: 83072 - RNA, 64 nt, Human
acucauuuggagauccuagauggcugccugcuuuccugggcacucauggugaaaugacaggcaa

SEQ ID NO: 83073 - RNA, 64 nt, Human
gggcuugggccacuuuggagagacagaaucuaguccugggcaacuucacauccguccuccuguc

SEQ ID NO: 83074 - RNA, 64 nt, Human
cuuaagccacuccuuggccucccccagccaggggccugggcaggaaagauggggugguggacug

SEQ ID NO: 83075 - RNA, 64 nt, Human
ggcggugagccgagauugagccauugcacuccagccugggcaacaacagcaaaacuccaucuca

SEQ ID NO: 83076 - RNA, 64 nt, Human
ggaagaucucuugagcucaggaguucaagaucagccugggcaacacagugagaccucaucucca

SEQ ID NO: 83077 - RNA, 64 nt, Human
ggaggauugcuugagcccaggaguucaagaccagccugggcaacauagugagaccugcccccua

SEQ ID NO: 83078 - RNA, 64 nt, Human
ggaggacugcuugaggccagaaguuggagaccagccugggcaaguggacaccucauuuuuacua

SEQ ID NO: 83079 - RNA, 64 nt, Human
ugcggugagccaagauggcaccauugcacccuagccugggcaacagagcaagacaccgucuuaa

SEQ ID NO: 83080 - RNA, 64 nt, Human
ugcaaugagccgagauugugccacggcacuccagccugggcagcagagugagacucucucucaa

SEQ ID NO: 83081 - RNA, 64 nt, Human
gagcuccugcucccccaucccccauccucccagaccugggcaggagcugugcugggagaaaggg

SEQ ID NO: 83082 - RNA, 64 nt, Human
ugcagugagccgagauugcgccacugcacuccagccugggcagcagagcaacacucugucucaa

SEQ ID NO: 83083 - RNA, 64 nt, Human
ugcauugagccaugauugcaccacugcacuccagccugggcaacagagggagcccccgucucaa

SEQ ID NO: 83084 - RNA, 64 nt, Human
gggggauugauugaggccaggaguucaagaccagccugggcaacauggugagaccccaucucua

SEQ ID NO: 83085 - RNA, 64 nt, Human
ugcagugagccgagaucgucccacugcacuccagccugggcaacagagugagacucuguuucua

SEQ ID NO: 83086 - RNA, 64 nt, Human
guggguggaucacaagucaggaguucaagaccagccugggcaagauggugaaaccccaucucua

SEQ ID NO: 83087 - RNA, 64 nt, Human
ccaagagaacugaguucaacuccaucuaugccagccugggcaacagagcgagacuccaacucag

SEQ ID NO: 83088 - RNA, 64 nt, Human
ggaagaucacuugagcccgcaaguuugagaccacccugggcaacauagcgagacuaccucuaca

SEQ ID NO: 83089 - RNA, 64 nt, Human
uugccgugaggcaaaaucgugccacugcccucagccugggcaguagagucagucuccaucucaa

SEQ ID NO: 83090 - RNA, 64 nt, Human
guugggucacgugggccccgguacucaagaccagccugggcagaauggugaaaccaccuucucu

SEQ ID NO: 83091 - RNA, 64 nt, Human
uucuauuaauggagaucauuccauuacacuccagccugggcaccaggaacgaaacucguucuca

SEQ ID NO: 83092 - RNA, 64 nt, Human
uguggugagccaagaucaugccacugcacuccagccugggcaacaagaacaaaacuccaucuaa

SEQ ID NO: 83093 - RNA, 64 nt, Human
ugcagugagccaagaucgugccaaugcacuccauccugggcaaaaagagcaaaacuccaucuua

SEQ ID NO: 83094 - RNA, 64 nt, Human
uugcagugagcgagaucaugccauugcacuccagccugggcaacaggagugaaacuccaucucc

SEQ ID NO: 83095 - RNA, 64 nt, Human
gagagcacugcacuuccccaaaacggaaggggccccugggcaguggguuuugggcaaauucccu

SEQ ID NO: 83096 - RNA, 64 nt, Human
ggaggaucgcuugagcccaggaguucaagaccagccugggcaacauagugagaccccaucucua

SEQ ID NO: 83097 - RNA, 64 nt, Human
cacagacuucugcccuggcucuuccccaucuaggccugggcaggaacauauauuauuuauuuaa

SEQ ID NO: 83098 - RNA, 64 nt, Human
guccuugugcaagacccagccugucacgacagagccugggcacuucagaggaggagccaggauc

SEQ ID NO: 83099 - RNA, 64 nt, Human
ugcagugagccaauauugcaccauugcacuccugccugggcaacaagagcaaaauuucaucuca

SEQ ID NO: 83100 - RNA, 64 nt, Human
gaggaucacuugagaccaggaguugugaggucaaccugggcaauauagggagauccugucucua

SEQ ID NO: 83101 - RNA, 64 nt, Human
gaaggauugcuugaggccaggaguuccagaucaaccugggcaacaugaugagaccccaucucua

SEQ ID NO: 83102 - RNA, 64 nt, Human
caucugugcucuuccaggaugcugccucuuacucccugggcaccucggccuggucccagcaggu

SEQ ID NO: 83103 - RNA, 64 nt, Human
auccuccugccucagccucccaaguagcugggagccugggcaugcaucgccacgucuggcuaau

SEQ ID NO: 83104 - RNA, 64 nt, Human
cugcagaccucagauuugaccaggccucuggcugccugggcagccucauugccaaugggcugaa

SEQ ID NO: 83105 - RNA, 64 nt, Human
uccugaccccugaggauuaccagcgauuucuagaccugggcaucuccauugcugaaaaccgcag

SEQ ID NO: 83106 - RNA, 64 nt, Human
ucucuccccaccccuccuuggcucuccagcacuuccugggcagccacggcccccuccccccaca

SEQ ID NO: 83107 - RNA, 64 nt, Human
gugagccacaaucacaccaaucacugcacuccagccugggcaauaaaguaacucuugacucaaa

SEQ ID NO: 83108 - RNA, 64 nt, Human
ccucauccugugaggccugaagacauugaauaacccugggcagugguucuuaggcagauacucu

SEQ ID NO: 83109 - RNA, 64 nt, Human
ugcagugagccgagauggugccacugcauuccagccugggcaacagagcgagacuccaucucaa

SEQ ID NO: 83110 - RNA, 64 nt, Human
aguguuaagugcuucuggauucaugggugaguucccugggcagcccccaggaaggccuuccaga

SEQ ID NO: 83111 - RNA, 64 nt, Human
uuuuuuguuguuguggugguuuuuuaacacaaagccugggcaacagagcaaaacucugucucaa

SEQ ID NO: 83112 - RNA, 64 nt, Human
cccugcucgugcugcccagaggcugaucugcaaaccugggcaguauuccacacugaagcucagu

SEQ ID NO: 83113 - RNA, 64 nt, Human
aggccuccgagugacggaccugaggugucuguuuccugggcaggccugaugcuccuguuugggu

SEQ ID NO: 83114 - RNA, 64 nt, Human
ggaggaucccuuuagcccaggaguuaaagaccagccugggcaacauagggagacccugucuuuu

SEQ ID NO: 83115 - RNA, 64 nt, Human
cugaggugggaggaucccaggaguucaaauccugccugggcaacauagcaagacccugucucuu

SEQ ID NO: 83116 - RNA, 64 nt, Human
gugggugucuggcacccagcugccagccuucuguccugggcaaacuacucccuacuuaagggaa

SEQ ID NO: 83117 - RNA, 64 nt, Human
auggaggcgccucacugggaggugccccgccagcccugggcagugucaggcaggacucacucac

SEQ ID NO: 83118 - RNA, 64 nt, Human
ggugcaggggauuuggcugaaggcgugcauauuuccugggcacaaacuuccugagccucugaaa

SEQ ID NO: 83119 - RNA, 64 nt, Human
acaugcacacgggcgagcuuucucuccgacuuccccugggcaagagaugggacaagcagucccu

SEQ ID NO: 83120 - RNA, 64 nt, Human
ccugugguugcaccugugaauaacugcacuccagccugggcaacauagcgagaccucaucucca

SEQ ID NO: 83121 - RNA, 64 nt, Human
ucugagaccuggggcuucacucggaucacgcccuccugggcacaggucacagcuaggacuccau

SEQ ID NO: 83122 - RNA, 64 nt, Human
ugcagugagcuauuacagugccacugcaauccagccugggcaacagagcgaggucccguuucuu

SEQ ID NO: 83123 - RNA, 64 nt, Human
cagccugugugggggccgucccgucccacacuccccugggcauucuuggacucaaggccggggc

SEQ ID NO: 83124 - RNA, 64 nt, Human
cauguggaccaugagccggcugccagcacuagguccugggcagcuuuguuugucccacuuuucu

SEQ ID NO: 83125 - RNA, 64 nt, Human
ccagaccucucucccuccuacagugcucucccucccugggcagauuggcaggacaagugggagc

SEQ ID NO: 83126 - RNA, 54 nt, Human; identical to SEQ ID NO: 79643

SEQ ID NO: 83127 - RNA, 64 nt, Human
ggaggaucaccagaggccagcagguccacaccagccugggcaacacagcaagacaccgcaucua

SEQ ID NO: 83128 - RNA, 64 nt, Human
ccaugccucuccucccucucuggcagggccccauccugggcagaggggccuggggcugggccca

SEQ ID NO: 83129 - RNA, 64 nt, Human
ggaagguggacuuuuuugguggagacguuucugcccugggcacccuccugcccccgauucauac

SEQ ID NO: 83130 - RNA, 64 nt, Human
uacagugagccaagaucgcgccaucgcacuccagccugggcaacaagagcaaaacuccaucuca

SEQ ID NO: 83131 - RNA, 64 nt, Human
gucuuuuguuacaggcuuagcaacaaagcugugcccugggcauggggggcuguaguguagcuac

SEQ ID NO: 83132 - RNA, 64 nt, Human
uguucaccccgcagauaguuaaugaauggucugcccugggcaagauggaggugggggcuggggg

SEQ ID NO: 83133 - RNA, 64 nt, Human
uggccaggcagaucugugccccaugccuguccagccugggcagccaggcugccaaggccagagu

SEQ ID NO: 83134 - RNA, 64 nt, Human
gguggaucacuugagcucaggagcuugagaccagccugggcaacauggugaaacccaguuucua

SEQ ID NO: 83135 - RNA, 64 nt, Human
aaauguuucuaguagcugcauuacaaaaaagaagccugggcacuguggcucacuccuguaaucu

SEQ ID NO: 83136 - RNA, 64 nt, Human
ccuggccuuuggacccaggcaaaggcuucugagcccugggcaggggugguggguaccagagaau

SEQ ID NO: 83137 - RNA, 64 nt, Human
ccaaggcugcacaccuagaaccccaauucagccuccugggcaccccagaggcaaggcugugcac

SEQ ID NO: 83138 - RNA, 64 nt, Human
uguggugagccaagguugcgccacugcacuccagccugggcaacaagaguaaaacuccaucuca

SEQ ID NO: 83139 - RNA, 64 nt, Human
ucccucuccugagaggggaggccugguggcuuagccugggcaggucgugucuccuccugacccc

SEQ ID NO: 83140 - RNA, 64 nt, Human
cuguucauuccuuugugcagaguguauaucucugccugggcaagaguguggaggugccgaggug

SEQ ID NO: 83141 - RNA, 64 nt, Human
ggguuuuggaccuccaggggcuggagcuucaucaccugggcagugucuuuucucagagagcagg

SEQ ID NO: 83142 - RNA, 64 nt, Human
ggacaucaccgccccuggaacuggggccaccagcccugggcacgagauuugcucugacuuuauu

SEQ ID NO: 83143 - RNA, 64 nt, Human
agcugguucucccgggacaccagcagauccacacccugggcaccuccguguuuggucuuuuuuu

SEQ ID NO: 83144 - RNA, 64 nt, Human
aaauuucugcuuuaucagucaucacacaaccauuccugggcauugagacuguccugguuaggcu

SEQ ID NO: 83145 - RNA, 64 nt, Human
ccucccucagccacgccucucucagcccaggucuccugggcaucuggcccugcugcccccuacc

SEQ ID NO: 83146 - RNA, 64 nt, Human
gagugggugggacacagagacccccgugccaaauccugggcauccccagcccccuggccccucc

SEQ ID NO: 83147 - RNA, 64 nt, Human
ucuuuccucccauggggccgcugaggcaugagcaccugggcacagguuggggcucugcaggaug

SEQ ID NO: 83148 - RNA, 64 nt, Human
ggagcgggcauggccgggcccugcugaggaggggccugggcagagggccuggaccugggaucaa

SEQ ID NO: 83149 - RNA, 64 nt, Human
aacggcaagggccgguccccacacucuugcuccuccugggcaucuggggacaggaacaccucuc

SEQ ID NO: 83150 - RNA, 64 nt, Human
gccccugugagugcacuugaccgggugcggagguccugggcagccugucccugagccggccccu

SEQ ID NO: 83151 - RNA, 64 nt, Human
gguggaucgcuugagcucaggaguucgagagcagccugggcaacauggugaaagcccgucucua

SEQ ID NO: 83152 - RNA, 64 nt, Human
aaaauccagggagauuaaauucauggugacaaguccugggcaguucugguaaacgguccaguua

SEQ ID NO: 83153 - RNA, 64 nt, Human
ugccgugagucgagaucgcaccauugcauuccagccugggcaacaagagcgaaacuccgucuca

SEQ ID NO: 83154 - RNA, 64 nt, Human
agcugcgcgggauccuugugcagggaagagcugcccugggcaccuggcaccacaagaccauguu

SEQ ID NO: 83155 - RNA, 64 nt, Human
uguggugagcuaagaucacgccauugcacuccagccugggcaacgagagggaaacucuguuuca

SEQ ID NO: 83156 - RNA, 64 nt, Human
cugcagaacuaacccccagcaggccugguuccacccugggcagcacccccucuaguucuaauaa

SEQ ID NO: 83157 - RNA, 64 nt, Human
uccucugcaaugcgacauccugaaagcucagcugccugggcauuccugaagaguauggaauauu

SEQ ID NO: 83158 - RNA, 64 nt, Human
uuggaucugcuugcuguccaaaccagcaaacuuuccugggcaaaucacaaucagugaguaaaua

SEQ ID NO: 83159 - RNA, 64 nt, Human
ccagcggcucuuucugcuuuguucuggcgacuuuccugggcaggccuuuccaccuggggagcug

SEQ ID NO: 83160 - RNA, 64 nt, Human
ugcuuuuuuucugucugagugugagcuccauccgccugggcaucugauuuuuugggaaagaagu

SEQ ID NO: 83161 - RNA, 64 nt, Human
cccuccguccagccagcaaggcuuucccaagcguccugggcaggaggguugggcccugcuuucc

SEQ ID NO: 83162 - RNA, 64 nt, Human
guaaaugcacuagcgcgaggucagaaaucacaagccugggcauggccugggucgcacccccucc

SEQ ID NO: 83163 - RNA, 64 nt, Human
acguccaggugggcccagccuagggcaucccgggccugggcaucaggcagggugcagguggggc

SEQ ID NO: 83164 - RNA, 64 nt, Human
ugcagugagcugagaucacgccacugcacuccagccugggcaacagagugagacucugucucaa

SEQ ID NO: 83165 - RNA, 64 nt, Human
agcagugagcugaagucccgccacugcacuccagccugggcaacagagcgagacucagucucaa

SEQ ID NO: 83166 - RNA, 64 nt, Human
ccggggggcccugggucggggcggaucagcuuucccugggcacaucugccucauuccagaucuc

SEQ ID NO: 83167 - RNA, 64 nt, Human
cuuagugucgagugggcucugggcuggggucggcccugggcaggcuucuccugcaccuuuuguc

SEQ ID NO: 83168 - RNA, 64 nt, Human
gcuaccaggugggcuagaagguaacuggaacaggccugggcacuugugcacccauguaggagca

SEQ ID NO: 83169 - RNA, 64 nt, Human
ugcccuccugcggccauccugaguuggggugaggccugggcagccggagggcagggcucaggga

SEQ ID NO: 83170 - RNA, 64 nt, Human
ccucacuguccuucugccacggaugcucaagguuccugggcagaccagcaccucuggaggacaa

SEQ ID NO: 83171 - RNA, 64 nt, Human
acgccccaggggaccagccaggccuggaaugcccccugggcaggacccugggcaggaccagagg

SEQ ID NO: 83172 - RNA, 64 nt, Human
accagccaggccuggaaugcccccugggcaggacccugggcaggaccagaggcccacauggaug

SEQ ID NO: 83173 - RNA, 64 nt, Human
caggaccagacaccugggaccuggauacuugauaccugggcauuuaacccccuacucugucauc

SEQ ID NO: 83174 - RNA, 64 nt, Human
augcuuggcuggaccgggacccauggcaagagcaccugggcaccaguguuuagcccuggucugc

SEQ ID NO: 83175 - RNA, 64 nt, Human
gugugguuggccugaacaaaauaaaguguugacuccugggcaucugugccuucucuauggccuu

SEQ ID NO: 83176 - RNA, 64 nt, Human
gggagcccccuggcuugcacugaacccucgaggaccugggcacggggucggauggacacacagc

SEQ ID NO: 83177 - RNA, 64 nt, Human
gccaagcugcuguuccuaugacaggcccacucaaccugggcagaccgagaggcccgugcacuuu

SEQ ID NO: 83178 - RNA, 64 nt, Human
gggaggcuggaagcauauuccccaagagcacugcccugggcaucaucucccuccugcgaggagc

SEQ ID NO: 83179 - RNA, 64 nt, Human
augaacaaacccuuggcccagccugggcuggugaccugggcaccagagaccuugcaucccuccu

SEQ ID NO: 83180 - RNA, 64 nt, Human
uaccucccauguuugcucucccaacucauuagcuccugggcagcauccuccugagccacaugug

SEQ ID NO: 83181 - RNA, 64 nt, Human
uagcucagauggcagaugagaguguagucaagggccugggcacaggagggagagcugcagagug

SEQ ID NO: 83182 - RNA, 64 nt, Human
cacauccccaucuguuaggccuuggugaggaggcccugggcaaagaagggucuuucgcaaagcg

SEQ ID NO: 83183 - RNA, 64 nt, Human
agcugcccugggaugggaaggacccagcccgaccccugggcauaacacuguguuugcaaaugga

SEQ ID NO: 83184 - RNA, 64 nt, Human
agugggcucagaguccagcaaugaggcccccuggccugggcacccagcugcaggccccugcccu

SEQ ID NO: 83185 - RNA, 64 nt, Human
uacagugagccgagaucgugcuacugcauuccaaccugggcaacaagagugaaacucugucuca

SEQ ID NO: 83186 - RNA, 64 nt, Human
cagccguggacagcugagguuggggucaaugccuccugggcacccuugccucgccccagaccgg

SEQ ID NO: 83187 - RNA, 64 nt, Human
uguagugagcugagaucgcaccacugcacuccagccugggcaacauagcaaaauccugucucaa

SEQ ID NO: 83188 - RNA, 64 nt, Human
ggagucaggucuucugccuucugaguuggcucauccugggcagucacagacuguccugccugca

SEQ ID NO: 83189 - RNA, 64 nt, Human
gccgaggcuucugggccacucaggccagugcaccccugggcagagccccuuaaagcugcuguca

SEQ ID NO: 83190 - RNA, 64 nt, Human
aaccguucucaaccccccugcagggagaaggccuccugggcacuguccuuccaccugugccagc

SEQ ID NO: 83191 - RNA, 64 nt, Human
ugcggugagcugagauugcaccauuucauuccagccugggcaacaugagugaaagucugacuca

SEQ ID NO: 83192 - RNA, 63 nt, Human
ccagcaagcuccaagacugagcccagcaccaccccugggcagcagcauccuccucucuggccu

SEQ ID NO: 83193 - RNA, 64 nt, Human
ugcagugggcugugauugugccacugcacuccagccugggcaccaaugugagaaccugucuugg

SEQ ID NO: 83194 - RNA, 64 nt, Human
uacaguuugcuguguucuacaagggggacgagugccugggcagcgggaagauccugcggcuggg

SEQ ID NO: 83195 - RNA, 64 nt, Human
ccagccaaaacccucccagacgucuccucuccugccugggcaaaguccagcuuggcaccccguc

SEQ ID NO: 83196 - RNA, 64 nt, Human
ugcagugagcugagauugcgccauugcacuccagccugggcaacaagagcaaaauucugccuca

SEQ ID NO: 83197 - RNA, 64 nt, Human
ggccuggcccuccgccugccuggagaggccuggcccugggcaaacagccgccaucaggguucac

SEQ ID NO: 83198 - RNA, 64 nt, Human
gcacccuuuugccugacggacccuguugccugcuccugggcagugguuuuguugccugacacag

SEQ ID NO: 83199 - RNA, 64 nt, Human
gaugugcuguccugcaccagcgccagcccagcucccugggcagaugugcccuguguccuggguc

SEQ ID NO: 83200 - RNA, 64 nt, Human
uggcuggggccggggcugccgcaucugccuggagccugggcagcaccuccgggacugaccuucg

SEQ ID NO: 83201 - RNA, 64 nt, Human
accacgguguggggggugccccacaaggcccagcccugggcaaggaagcuuuggaagcagcaag

SEQ ID NO: 83202 - RNA, 64 nt, Human
gaaagaacuuggacuucuaaaggcggagggucucccugggcacccugcaggcaggcagaccacg

SEQ ID NO: 83203 - RNA, 64 nt, Human
caguccuucuccaaaaggaccugggagcuggcagccugggcaggggggcugaggcacgugguag

SEQ ID NO: 83204 - RNA, 64 nt, Human
ccagagccuucuuguuuaugaucagcuccagcuaccugggcaguuguggugggguggaugggaa

SEQ ID NO: 83205 - RNA, 64 nt, Human
uccuuuuggcuggggucugagucugcgguucucgccugggcagucuugacgaggagcaaacccc

SEQ ID NO: 83206 - RNA, 64 nt, Human
cuccuccaccucucccauuccauccccaguccagccugggcaaccccaccccugggagggauga

SEQ ID NO: 83207 - RNA, 64 nt, Human
aaucacucaucaccugauugauuggcucugugguccugggcaggugccucauagguguguggau

SEQ ID NO: 83208 - RNA, 64 nt, Human
uguagugagcugagaucgugccacugcacuccagccugggcaacagagccagacuccgucucua

SEQ ID NO: 83209 - RNA, 64 nt, Human
ggcagaucaccugagaucaggaguucgggaccagccugggcaacauggugaaacccugucucua

SEQ ID NO: 83210 - RNA, 64 nt, Human
aaguccuggagccagugaccucaguuucagcuuuccugggcaccagccuggaccuugcccaugg

SEQ ID NO: 83211 - RNA, 64 nt, Human
guucucaugggcaggcucaggucugucccgcugcccugggcacgaggucuccugaggaccuggg

SEQ ID NO: 83212 - RNA, 64 nt, Human
agcuacggccugggcuaggugagcugccucugccccugggcaaggaagcgaggcccucugggag

SEQ ID NO: 83213 - RNA, 64 nt, Human
uuucucgaggggucaccgagccucuggugggacaccugggcaggagugcucucaccacgaggcu

SEQ ID NO: 83214 - RNA, 64 nt, Human
caaaaaagaaaaggaagcugagcaucucccgaguccugggcagggaaggggagggaaauugcug

SEQ ID NO: 83215 - RNA, 64 nt, Human
ugcagugagccgagaucacgccauugcacuccagccugggcaacagagcaagacuccaucucaa

SEQ ID NO: 83216 - RNA, 64 nt, Human
cccagccugccugaagcaaaggaggcucccguguccugggcagcuucuguuucccucugcugcc

SEQ ID NO: 83217 - RNA, 64 nt, Human
guuuguggugacaguuggugcuaauaagaauuugccugggcaguauagugagaucuuuucucua

SEQ ID NO: 83218 - RNA, 64 nt, Human
aauacacgugggaacuaaagagaaaaaugaccagccugggcagcauagcaagacccugucucua

SEQ ID NO: 83219 - RNA, 64 nt, Human
cuccaaaggcaccuuguagcauguacuccccgugccugggcaaucagaugggcugccuuugucc

SEQ ID NO: 83220 - RNA, 64 nt, Human
ugcagugagccgagaucacgccauugcauucuagccugggcaacgagagcgaaacucugucuca

SEQ ID NO: 83221 - RNA, 64 nt, Human
ugcggugagccaagauugcgccacugcacuccagccugggcaaacagagggagacuccaucgcc

SEQ ID NO: 83222 - RNA, 64 nt, Human
gcuuccaccugggcuacacggagaccgggcacugccugggcaaaccgaacccugcgcucgcacc

SEQ ID NO: 83223 - RNA, 64 nt, Human
augcucccaucauugggcaccucugggaguuuguccugggcacagacagcuuccaccugggcua

SEQ ID NO: 83224 - RNA, 64 nt, Human
cccagauccccaugccugagggccccucggcuggccugggcaugugauggcuccucacugggag

SEQ ID NO: 83225 - RNA, 64 nt, Human
ggaggaucacuugaggccaggaguucaagaucagccugggcaauauagugaaaccccaucucuu

SEQ ID NO: 83226 - RNA, 64 nt, Human
auauuugcauaugaaucucuauuuuuuucauuacccugggcaauuuaaagaaaucauaucauag

SEQ ID NO: 83227 - RNA, 64 nt, Human
gccgaggucuuugagcucaggaguucaagaccagccugggcagcaugacaaaacccugucucua

SEQ ID NO: 83228 - RNA, 64 nt, Human
ugcagugagcuaagaucgcgccacuguacuccagccugggcaacagcgagacuccaucucaaaa

SEQ ID NO: 83229 - RNA, 64 nt, Human
gaccaaaccuagccccuuagcccccacccacuucccugggcaaaugaauggcucacuauggugc

SEQ ID NO: 83230 - RNA, 64 nt, Human
uugggcuggucccaggguggcaccacccaggcccccugggcaccaagggagcgagggggaauaa

SEQ ID NO: 83231 - RNA, 64 nt, Human
guggucaugugagucugggauauucuuuagcuuaccugggcacaaacagaauuuuccauuuauu

SEQ ID NO: 83232 - RNA, 64 nt, Human
cacagccuucuaaauucccaaauccuagacugcuccugggcauuagcaaggcagagccuuuuua

SEQ ID NO: 83233 - RNA, 64 nt, Human
ggccaaggggcuuuaucuuuuacuaguaggcaagccugggcauuucugcauuugugccagcuaa

SEQ ID NO: 83234 - RNA, 64 nt, Human
cuccccaaggucuaugcuaaauuauagcaagagcccugggcaaccccaaaccuaguccugguag

SEQ ID NO: 83235 - RNA, 64 nt, Human
ugcagugagccgagaucucgccacugcacuccagccugggcaacagagcaagacucugucucaa

SEQ ID NO: 83236 - RNA, 64 nt, Human
gcaaggagcauaacguacaggcuguauguacaauccugggcauugacucugugacauuucuagc

SEQ ID NO: 83237 - RNA, 64 nt, Human
ggaggagugcuugagguuaggcguuccagaccagccugggcaacauagugagacucuugucucu

SEQ ID NO: 83238 - RNA, 64 nt, Human
gggagauggcuugagaccaggaguucaagaccagccugggcaacauagugagacgccccccccc

SEQ ID NO: 83239 - RNA, 64 nt, Human
ggcaggaagauugagccuaggaguucgagaccgaccugggcagcauagcgagaccccaucucua

SEQ ID NO: 83240 - RNA, 64 nt, Human
ugcagugagccaagaucuugccauugcacuccagccugggcaacaagagugaaauucugucuca

SEQ ID NO: 83241 - RNA, 64 nt, Human
ugcaaugagccgagaucacaccacugcacuccagccugggcaacagugaaacuccaucucaaaa

SEQ ID NO: 83242 - RNA, 64 nt, Human
cucuaaugcuacugcgcccugggggcucccagggccugggcaacuuagcugcaacuggcaaagg

SEQ ID NO: 83243 - RNA, 64 nt, Human
gggaaagcucacuucaguucaagaaauuguucugccugggcaagaaauuagugaaugacuacac

SEQ ID NO: 83244 - RNA, 56 nt, Human; identical to SEQ ID NO: 79761

SEQ ID NO: 83245 - RNA, 64 nt, Human
cccacuuuauugccaaaacccagcugcaccccuuccugggcacacgcugcucugccccagcuug

SEQ ID NO: 83246 - RNA, 64 nt, Human
aaaaagaaaaaaggggcaaggagccccgcggcggccugggcagcgccugugcagaccucccugc

SEQ ID NO: 83247 - RNA, 58 nt, Human; identical to SEQ ID NO: 79764

SEQ ID NO: 83248 - RNA, 56 nt, Human; identical to SEQ ID NO: 79765

SEQ ID NO: 83249 - RNA, 52 nt, Human; identical to SEQ ID NO: 79766

SEQ ID NO: 83250 - RNA, 64 nt, Human
gaaagauugcuugagccugggaguuugagacuggccugggcagcauagcgagaccccaucucua

SEQ ID NO: 83251 - RNA, 64 nt, Human
aaauauauauagaaauauauacgaacaaaacacacgcgcgcacacacacacauacacgaaagag

SEQ ID NO: 83252 - RNA, 64 nt, Human
ugcauaaccguucccagguguacgcacgcgcgcgcgcgcgcacagacacacacacacacacaca

SEQ ID NO: 83253 - RNA, 64 nt, Human
acagaccgagagaggaauggagagacagagggggcgcgcgcacaggagccugacuccgcuggga

SEQ ID NO: 83254 - RNA, 64 nt, Human
gcgaguucuucacgggcagcaagcugguggacuacgcgcgcagcgugcacgaggaguuuugagc

SEQ ID NO: 83255 - RNA, 64 nt, Human
ggggccgcagcaccaaagacgcccgccuccgccccgcgcgcagacaugcgccaccccucccagg

SEQ ID NO: 83256 - RNA, 64 nt, Human
aguauguaugugugugugugugugugugugugugcgcgcgcacgcacgccuugagcagucagca

SEQ ID NO: 83257 - RNA, 64 nt, Human
auaauugacucggaaaggaccccagcuuuccacgcgcgcgcaagcacaguuaagccaccugcag

SEQ ID NO: 83258 - RNA, 64 nt, Human
uucauaccagucaguauucccagccuugagcgcacgcgcgcacacacacacacacauacacaca

SEQ ID NO: 83259 - RNA, 64 nt, Human
cacgcaggcaaaugcacugaaacccaggggcacacgcgcgcagagugaacagugaguucccccg

SEQ ID NO: 83260 - RNA, 64 nt, Human
ucgcacucucgcucacgcucagacgcuacacacgcgcgcgcacagacacggugcaccuagguca

SEQ ID NO: 83261 - RNA, 64 nt, Human
uaauucucuuuucaaacacacacacacacgcgcgcgcgcgcacacacacucuucaaguuuuuuu

SEQ ID NO: 83262 - RNA, 64 nt, Human
aaugcacacccagacacacgcacgcacacacacgcgcgcgcacacacaugcuuuuuucuguucc

SEQ ID NO: 83263 - RNA, 64 nt, Human
uguguaugugugugugugagugugugugugugcgcgcgcgcaagcguguguguuuaagacucuu

SEQ ID NO: 83264 - RNA, 64 nt, Human
gguccacuucaugugccuuucagacuucaaagcgcgcgcgcaugugugugugugugugugugug

SEQ ID NO: 83265 - RNA, 64 nt, Human
guggggugugauacucucuauagccacuacagggcgcgcgcaggucgcggaucuccccaguugc

SEQ ID NO: 83266 - RNA, 64 nt, Human
cugaugguuuuacuccuuuuuuuaaaaacacaugcgcgcgcacacacacaugcuuuacaaguuu

SEQ ID NO: 83267 - RNA, 64 nt, Human
ugguuucuuuuuuaaccagucaucaagcgaggcucgcgcgcaggccccgcguuggaaaauggcg

SEQ ID NO: 83268 - RNA, 64 nt, Human
uggaggaaggugacugugugugugugugugugcgcgcgcgcacgcgcgagugugcuguauggcc

SEQ ID NO: 83269 - RNA, 64 nt, Human
aaggaguaaugcaacgccugugaagccagccccacgcgcgcaccagucgcguaagacaacagca

SEQ ID NO: 83270 - RNA, 64 nt, Human
gagaaggcggaguaagguggggugaggcggaucccgcgcgcaguuccagcagguguguccccag

SEQ ID NO: 83271 - RNA, 64 nt, Human
ccucccaggugcugggauuauaggcgugagccaccgcgcgcaccccauuuaauuauuuuuuaug

SEQ ID NO: 83272 - RNA, 64 nt, Human
ugugugugugugugugugugugugugugugugcgcgcgcgcacgugcacauguguguagguaga

SEQ ID NO: 83273 - RNA, 64 nt, Human
cgccugugcacacacacacacaugcacacacacgcgcgcgcacacacacacacacacauccacc

SEQ ID NO: 83274 - RNA, 53 nt, Human
gcugucgugugcagcccugaggucgcgcgcagcgcgugcacagcgcgggcgga

SEQ ID NO: 83275 - RNA, 64 nt, Human
ggcgaugcccguucucuugaucucucucuucucgcgcgcgcacucucucuucaacacuccccug

SEQ ID NO: 83276 - RNA, 64 nt, Human
ggcgcacccacccuguagcaggcuguggcucguccgcgcgcagcucccucagcuucgcagcgcc

SEQ ID NO: 83277 - RNA, 64 nt, Human
acucugugugugugugugugugugugugcgcgcgcgcgcgcacgcgcacacacucacgcacaca

SEQ ID NO: 83278 - RNA, 64 nt, Human
acacacacaugccacacagacacacaugcgcgcgcgcgcgcacacacacacacacacacacaca

SEQ ID NO: 83279 - RNA, 64 nt, Human
cacacaauacacauacaugcauauagacgcaucuauuggaaaugcaguuccacaggugagcaug

SEQ ID NO: 83280 - RNA, 64 nt, Human
uugcuugaguuacuccuguaucauugcucauaauauuggaaacuaaaauaaaaccuaguuggaa

SEQ ID NO: 83281 - RNA, 64 nt, Human
uaauaccauccugguuuggucagccauuccuuugauuggaaaggucagcuggggccaguggugc

SEQ ID NO: 83282 - RNA, 64 nt, Human
guuuuaaaauaagcuagaaccaggaugcuuccuuauuggaaaggcuuugccaguccuuaaggua

SEQ ID NO: 83283 - RNA, 64 nt, Human
agcuuuuggggguuauucuaccaacaaacaguccauuggaaagaaaacagucccuggaauuaac

SEQ ID NO: 83284 - RNA, 64 nt, Human
aagccagugcaaaauaaucugcuuaccuacucacauuggaaaaacccucugagcugaauaauuc

SEQ ID NO: 83285 - RNA, 64 nt, Human
aguuuuaagcuuguuugcacaguucuuuuuuuccauuggaaauggaauucauugccuuaggucu

SEQ ID NO: 83286 - RNA, 64 nt, Human
gggacagucaaagggcaauguuuuucuguaacauauuggaaaaagaaaaugcaguuauauuccu

SEQ ID NO: 83287 - RNA, 64 nt, Human
acauuucagaacuuuugaacuuuugacaaauugcauuggaaaaagaagucuguuaauagugauu

SEQ ID NO: 83288 - RNA, 64 nt, Human
cuauaaucuguugcuuuuucucaauauguguccuauuggaaauuccucaaaucguuggugccau

SEQ ID NO: 83289 - RNA, 64 nt, Human
aaccaguauuacuuuuuuuuaaaaaaagaaagaaauuggaaaucugugcuauacguaaugucau

SEQ ID NO: 83290 - RNA, 64 nt, Human
uaaaaauuaaaucuauaugccuuuaaaucagugaauuggaaacauauuacauguauuuuaauga

SEQ ID NO: 83291 - RNA, 64 nt, Human
caaaucacauugccagcugcagagcauauuguggauuggaaaggcugcgacagccccccaaaca

SEQ ID NO: 83292 - RNA, 64 nt, Human
caaaguaccauuaugguuuccauaugguaauuacauuggaaaguucugcaauaagauucuaguu

SEQ ID NO: 83293 - RNA, 64 nt, Human
gucuuagauuacaggaaugaagaacuguugccuaauuggaaagugccagcauuccagacuucaa

SEQ ID NO: 83294 - RNA, 64 nt, Human
auguguauauguguauauuugcauugauuaaauuauuggaaaacuuuucauugacagguaaugu

SEQ ID NO: 83295 - RNA, 64 nt, Human
cgcuacauuguguguauuuuuuguucagcuaagaauuggaaaaguauuugcuugccuuuuaagu

SEQ ID NO: 83296 - RNA, 64 nt, Human
agaggguugauaggcuggccguguccggggugaaauuggaaauccagcugccuaguggccagug

SEQ ID NO: 83297 - RNA, 64 nt, Human
uggcacacagaacaauggaaaaaaguuuguuuccauuggaaaauuauaucauuuuggguugcca

SEQ ID NO: 83298 - RNA, 64 nt, Human
ucuuuuugugacacaaguacaaucuaaaaguuauauuggaaaacauggaaauauuaaaauuuua

SEQ ID NO: 83299 - RNA, 64 nt, Human
gugagcagugaggagaaacaaggagcuagaaaacauuggaaaguuaagagaguucgagggaaga

SEQ ID NO: 83300 - RNA, 64 nt, Human
augcacaaacuuggcuucuuuaaccaagaauauuauuggaaaauucucuaaaaguuaauagggu

SEQ ID NO: 83301 - RNA, 64 nt, Human
ugggccaaagaaacauugccuugaggaagauaugauuggaaaaucaagaguguagaagaauaaa

SEQ ID NO: 83302 - RNA, 64 nt, Human
ccuccucauuucuguugaguaaaaugaagcaaagauuggaaacacuuucugaaaaagaaagcaa

SEQ ID NO: 83303 - RNA, 64 nt, Human
acugaauugauccuucuccaaauuaguauauacuauuggaaacuugucuuucccugcaguaagg

SEQ ID NO: 83304 - RNA, 64 nt, Human
gggcaugaacgcgagcccaaagugccagucugcgauuggaaauuuccagccacuuuaagccagu

SEQ ID NO: 83305 - RNA, 64 nt, Human
uccuuguaucucugcaguguggauugaacagaaaauuggaaaucauagucaaagggcuucccuu

SEQ ID NO: 83306 - RNA, 64 nt, Human
uggaggugcugaacacagggaaggucugguacauauuggaaauuaugagcagaacaaauacuca

SEQ ID NO: 83307 - RNA, 64 nt, Human
gccaggaugggucuccauucuguguggcaccuugauuggaaaauaauauccaugcguuucuucc

SEQ ID NO: 83308 - RNA, 64 nt, Human
ccucaccgcugcguccagcagacacugaaccagaauuggaaacgugcuugaaacaaucacacag

SEQ ID NO: 83309 - RNA, 64 nt, Human
aacucauuuaaaaauuuaugccacaguccuuauaauuggaaaaauacuggugcccagguuuucu

SEQ ID NO: 83310 - RNA, 64 nt, Human
cauuaucauuuuuauaaguccccaaaaguugaauauuggaaauuuuauuuccacccaauucaac

SEQ ID NO: 83311 - RNA, 64 nt, Human
uccagaaaggauauuuaagaaaauacaauaaacuauuggaaaguacuccccuaaccucuuuucu

SEQ ID NO: 83312 - RNA, 64 nt, Human
agccauguauucaacaucgagugugaaaagaucuauuggaaaacaacauggaauggaauucugg

SEQ ID NO: 83313 - RNA, 64 nt, Human
uauauauuuuuaaaaauguguuucucuuguaugaauuggaaauaaguauaaggaaacuaaauuu

SEQ ID NO: 83314 - RNA, 64 nt, Human
cguguuuccauuuuaaagugaguugaguucucaaauuggaaagaaagauuccuugagacguacu

SEQ ID NO: 83315 - RNA, 64 nt, Human
auagugucaccaauuccaccaagacagugcugagauuggaaaagggcacucauuuggauugccu

SEQ ID NO: 83316 - RNA, 64 nt, Human
gagagcuaaacaaaagaaaaccuaaacuaaugucauuggaaacaaaagcuugaaagaaacacau

SEQ ID NO: 83317 - RNA, 64 nt, Human
gauagaugcccaaagcaugaagcaaauaucuuuuauuggaaauaugcaaauucaauacuuuucc

SEQ ID NO: 83318 - RNA, 64 nt, Human
ugaagacauggacuuuauauguucaagugcaggaauuggaaaguuggacuuguuuucuaugauc

SEQ ID NO: 83319 - RNA, 64 nt, Human
gucucaauuuuggaauuucaaacaccagcaaaaaauuggaaaucgagauagguugcugacuuuu

SEQ ID NO: 83320 - RNA, 64 nt, Human
uuuauuugggacauggugggaauaaaggucacauauuggaaaauggaaaggcugaugaaacuau

SEQ ID NO: 83321 - RNA, 64 nt, Human
caucagugguucugaguguccgaggucauaagcaauuggaaaagggaaagacaaaguaguggga

SEQ ID NO: 83322 - RNA, 64 nt, Human
gccuacuagauaugggcaauauccagccuagaugauuggaaagauaccaguuuaaguaaacuug

SEQ ID NO: 83323 - RNA, 64 nt, Human
ucacuuuuaaaaccugucaggaucccacuguaaaauuggaaaugggcaguucugaauuuucacg

SEQ ID NO: 83324 - RNA, 64 nt, Human
gucugaggguugcagagcccgcuguggagguaagauuggaaacacaugaggcagagggaagaca

SEQ ID NO: 83325 - RNA, 64 nt, Human
cagugaguuuuauuaauagaaugcuucaccuuaaauuggaaaacaauaauagucuuggacuaag

SEQ ID NO: 83326 - RNA, 64 nt, Human
cauuauuccaguuuggaauuacuuauuaaggagaauuggaaauacauaugcccaugcuuaaauu

SEQ ID NO: 83327 - RNA, 64 nt, Human
cuuuauuuucucuuuagcugugcauauuuaaaauauuggaaaguaucagauuuacagauuuucu

SEQ ID NO: 83328 - RNA, 64 nt, Human
agaugaccucaaugccuuuguucaccugauugaaauuggaaauggucuugucaccuuucaacuu

SEQ ID NO: 83329 - RNA, 64 nt, Human
acucuaugcuuuguuagcugugugaaccucuccuauuggaaauucuguuccguguuuguguagg

SEQ ID NO: 83330 - RNA, 64 nt, Human
ugaugauauugauaagaugucgugacgcaaagaaauuggaaaacaugaugaaaauuuuggugga

SEQ ID NO: 83331 - RNA, 64 nt, Human
uaguaauugcgaggguaagauucauaguaggaauauuggaaauuuuggcacucugagaauaaau

SEQ ID NO: 83332 - RNA, 64 nt, Human
ugugucauucuccccacuuuauuaguuaauuuaaauuggaaaaaacccucaaacuaauauucuu

SEQ ID NO: 83333 - RNA, 64 nt, Human
uuccuaguuauuugucaccacauaauugguguugauuggaaacuuuuucugagaugggacagaa

SEQ ID NO: 83334 - RNA, 64 nt, Human
uacaguugcauaaaguggguuuuuauccuaauguauuggaaauaaaugauaaacuuuauuuugu

SEQ ID NO: 83335 - RNA, 64 nt, Human
cgcuaaaaccaacuugugccaaccagauuuacagauuggaaauacugcagaugaugugaaguua

SEQ ID NO: 83336 - RNA, 64 nt, Human
gaauaacacaaaaucucauucuaccugcaguuuaauuggaaagaugugugugugagaguaugua

SEQ ID NO: 83337 - RNA, 64 nt, Human
uauccuacucuuuugggcaaugcauguauuaugcauuggaaagguauuuuuuuuaaguucuguu

SEQ ID NO: 83338 - RNA, 64 nt, Human
aaccucuugagaaaaagaaaaguucauacugauuauuggaaaaggacuauauaugugagcaaga

SEQ ID NO: 83339 - RNA, 61 nt, Human
ccaguuuuggcaaaccuuaaucucccugcacauuggaaaugaauuacaggcagcuguucaa

SEQ ID NO: 83340 - RNA, 64 nt, Human
aagcacaugaguccuaaugccccagcagcuuccgauuggaaaaugcaaauuguuuuuauuuaaa

SEQ ID NO: 83341 - RNA, 64 nt, Human
agccccugcacaaaaugaaauaaaggaaguggaaauuggaaaaaacgcaaaccuaacuugcucu

SEQ ID NO: 83342 - RNA, 64 nt, Human
uuuacauuuucuacaaucaugugcuuauuaacauauuggaaaugcuucaguccucacaugauaa

SEQ ID NO: 83343 - RNA, 64 nt, Human
aacccacaagcauauuaaaucuguuuguuauaagauuggaaacaauuuuugagagggacuaauu

SEQ ID NO: 83344 - RNA, 64 nt, Human
guaccuuugucugccauugauccagcucagaacgauuggaaauaaauuugaaauguaaccgagc

SEQ ID NO: 83345 - RNA, 64 nt, Human
ucuaaaugugaaagcaauacauaauuuagggaaaauuggaaaauauaggaaacuuuaaacgaga

SEQ ID NO: 83346 - RNA, 64 nt, Human
acacaauuaauugucccuguuucaaacugaguaaauuggaaacauuuucuuucuuuuucuggaa

SEQ ID NO: 83347 - RNA, 64 nt, Human
auuuguauugauugaggccuaugaacugaccugaauuggaaaggaugugauuaauauaaauaau

SEQ ID NO: 83348 - RNA, 64 nt, Human
ucccucaacaucuucuaagguggcaggaaauaauauuggaaauaacauuuuaaaguaaaaauuu

SEQ ID NO: 83349 - RNA, 64 nt, Human
aaaaaaaaaaaaaagacuaagguggauuuuaaaaauuggaaacugacauaauguuagguuauaa

SEQ ID NO: 83350 - RNA, 64 nt, Human
cauucugauguuugcauuguguaaauacuguuguauuggaaaagcaugccaagauggauuauug

SEQ ID NO: 83351 - RNA, 64 nt, Human
gacaguuauagauaaggaauuuccuguacaccagauuggaaauggagugaaacaagcccuccca

SEQ ID NO: 83352 - RNA, 64 nt, Human
uucauugugaaacaugaauucagucauggugauaauuggaaacuccuuucagguuuuugcaagu

SEQ ID NO: 83353 - RNA, 64 nt, Human
auucugagagcuggcuaccauuacccuucuugcuauuggaaacucagcacauuugaacuugggu

SEQ ID NO: 83354 - RNA, 64 nt, Human
accugaaauucugaaacacugcauucaacugggaauuggaaacacacugaaauauuucauaguc

SEQ ID NO: 83355 - RNA, 64 nt, Human
uuauuguauuuguuucuggucuuuguuaaguucuauuggaaaaaccacugucuguguuuuuuug

SEQ ID NO: 83356 - RNA, 64 nt, Human
cauugccaaaaacuaaauggugcuuuauauuuagauuggaaagaauuucauaugcaaagcauau

SEQ ID NO: 83357 - RNA, 64 nt, Human
cuaaaugucugucucuaaaggguuaaauguaucaauuggaaaggaagaaaaaaggccuugaauu

SEQ ID NO: 83358 - RNA, 64 nt, Human
ugaaugugaauccagagucuauuuuucuaaauaaauuggaaaaaacauuuugaacucuauugcu

SEQ ID NO: 83359 - RNA, 64 nt, Human
uaaauauauuuugcaaauuguuguucaaaagauaauuggaaaaaauugaauauauuguaggauu

SEQ ID NO: 83360 - RNA, 59 nt, Human
cacuaauuaaagaagauugaauaaacuuuauuggaaaaugcuaaaauuuuaauauaguu

SEQ ID NO: 83361 - RNA, 64 nt, Human
agaucuuaaguccauacgcauuucaugaagaaccauuggaaagaggaaucugcaaucugggagc

SEQ ID NO: 83362 - RNA, 64 nt, Human
gcacaccauuuuguaaaugaaacuuaagaauugaauuggaaagacuucucaaagagaauuguau

SEQ ID NO: 83363 - RNA, 64 nt, Human
gcauaccuaauuguaaaauuuuuuuauuuacaacauuggaaauucagaaguuaauguuuuuuug

SEQ ID NO: 83364 - RNA, 64 nt, Human
aaauaaaaucgcaguuaaagcaugaaacacuugaauuggaaaaagaacucuguaguuugaggua

SEQ ID NO: 83365 - RNA, 64 nt, Human
gcacacuacuucauugucuaccaacuuuuuacauauuggaaaauagaaauugcaaauacauaca

SEQ ID NO: 83366 - RNA, 64 nt, Human
ggagaauagaagaacugguagccacaguggugaaauuggaaagagaacuuucuuccugaaaccu

SEQ ID NO: 83367 - RNA, 64 nt, Human
acauagauaugacauuugcugccucaguguagcaauuggaaauauuuauaaguuauaugaaagc

SEQ ID NO: 83368 - RNA, 64 nt, Human
aguacgguuuacuaaagucauguggaauaaagccauuggaaacaaauggaaagccugucgggac

SEQ ID NO: 83369 - RNA, 64 nt, Human
auuaauuucccuuauguugaggcauggaaaaaaaauuggaaaagaaaaacucaguuuaaauacg

SEQ ID NO: 83370 - RNA, 64 nt, Human
agauucugauucuaaauccgauuuuuacuauaaaauuggaaaauagaugggaggggugucauuc

SEQ ID NO: 83371 - RNA, 64 nt, Human
ucuuccuguaguggcaaaaaagaacaguguugaaauuggaaaggacuuuguguuauuuagguug

SEQ ID NO: 83372 - RNA, 64 nt, Human
aucugugagauuugacacuaaguuuuuguuagagauuggaaauuauacuaguccuuuuaagggg

SEQ ID NO: 83373 - RNA, 64 nt, Human
uucaaauaaacauauauucuugcuugcauccuagauuggaaauuaaaauuuuucaaagaacaaa

SEQ ID NO: 83374 - RNA, 64 nt, Human
uuaucuccuguuuagcaccaaaagagcuaauauuauuggaaacugaccuuuuaaaggccacugg

SEQ ID NO: 83375 - RNA, 64 nt, Human
cagacauuuuuuagaaaucaauacaugccccaauauuggaaagacuuguucuuccacggugacu

SEQ ID NO: 83376 - RNA, 64 nt, Human
gucuuauuaacaucugaaaaaauauauauuuuuuauuggaaaauucuaauuuguuaggccuuga

SEQ ID NO: 83377 - RNA, 64 nt, Human
aaagcuaaggguuucaccuucugauuuugacauaauuggaaauuuucuauaaugguaagauguu

SEQ ID NO: 83378 - RNA, 64 nt, Human
agccuggcagccucuggacagagaggaaggaaggauuggaaaaguccccgcagcacagcgacgg

SEQ ID NO: 83379 - RNA, 64 nt, Human
uauaugcuuuaccuucuaggucuuaaaaucacacauuggaaaaugacaauaucaacaaaacugu

SEQ ID NO: 83380 - RNA, 64 nt, Human
uagcgaagagcucugcaggcuuuccacugccuguauuggaaaucuugcaauucacauaauuauu

SEQ ID NO: 83381 - RNA, 64 nt, Human
gaaaauuuguugauaaaccauggcaacugcaagaauuggaaaaaugcugggacuuuucaugaac

SEQ ID NO: 83382 - RNA, 64 nt, Human
aaaaacaaaagcagcucggagucuguguugccugauuggaaaguagaagcucugguguaugcua

SEQ ID NO: 83383 - RNA, 64 nt, Human
ggcaaaaugcaucaccuuugaaaauauuucacauauuggaaaagugcuuuuuaauguguauaug

SEQ ID NO: 83384 - RNA, 64 nt, Human
caaauauugcuaacuaauguagcauuaacuaacgauuggaaacuacauuuacaacuucaaagcu

SEQ ID NO: 83385 - RNA, 64 nt, Human
cuaaauauggugugauaugaaccaguccauucacauuggaaaaacugaugguuuuaaauaaacu

SEQ ID NO: 83386 - RNA, 64 nt, Human
aauaaauaaauaaauagaagaaaucaugaguaaaauuggaaaacacuuuuaacugaaaaaaaca

SEQ ID NO: 83387 - RNA, 64 nt, Human
cuuuagaguauaaacuccauauaaauugauggcaauuggaaaucuuauaaaaacuagucaagcc

SEQ ID NO: 83388 - RNA, 64 nt, Human
ggcauuaguauagaccaaauaaaaagcugcagaaauuggaaaguuuauguuuuaaauaaaugac

SEQ ID NO: 83389 - RNA, 64 nt, Human
uguuugcugaugaaguacaaguugaaauguaguuauuggaaaagucuguaaccuguggaucaua

SEQ ID NO: 83390 - RNA, 64 nt, Human
aagacugagaaaauguuggguccagucgugcuugauuggaaauuguuguuucuaaaucuauaug

SEQ ID NO: 83391 - RNA, 64 nt, Human
guauauacugacagaagauauuugaaaguggaaaauuggaaaugaaauauguugcugggugcgu

SEQ ID NO: 83392 - RNA, 64 nt, Human
ggccaaauacugaauaaacaguugaaggaaagacauuggaaaaagcuuuugaggauaauguuac

SEQ ID NO: 83393 - RNA, 64 nt, Human
auauuaacaggguagcuccugagccuuucccuuuauuggaaacuuuaacugcaguguuaauaua

SEQ ID NO: 83394 - RNA, 64 nt, Human
uuaucuuuuuuuggagggguggaugcugcauuucauuggaaaugucauuuuuccaaaguuucua

SEQ ID NO: 83395 - RNA, 64 nt, Human
auuuuuuucuccaaauacaaaguauauucucuuuauuggaaaauaaauuaauaaauauauucug

SEQ ID NO: 83396 - RNA, 64 nt, Human
uuugacucuucuuggucucagcauguugacugggauuggaaauaaugagacugagcccucggcu

SEQ ID NO: 83397 - RNA, 64 nt, Human
gguggcucuggggggcaaguaggugguacaggggauuggaaacaugcuccgcgccuccagagaa

SEQ ID NO: 83398 - RNA, 64 nt, Human
auucagaaucuauagugaccagugaucaaggcuaauuggaaaagaguuaucggcccauagcuaa

SEQ ID NO: 83399 - RNA, 64 nt, Human
uuaacaaaacaagugcaagacugaaaacuacaaaauuggaaagaaauuaaagaaggcuuaaaua

SEQ ID NO: 83400 - RNA, 64 nt, Human
uccuauuaaacauuuuuaaagcccuaccccagacauuggaaauaggugacccaaguagggggag

SEQ ID NO: 83401 - RNA, 64 nt, Human
aacccaaagggggaggguagggcagggcaggcagauuggaaaucugccugcagauucuauuaaa

SEQ ID NO: 83402 - RNA, 64 nt, Human
ugcagacaucccuccguggugugugucuuggugcauuggaaaaggagucaggagccacugugag

SEQ ID NO: 83403 - RNA, 64 nt, Human
agcagcagggcgagagugcccagggcugauauauauuggaaauaucaccccugaagccaucgcu

SEQ ID NO: 83404 - RNA, 64 nt, Human
ugacuaucggggcgggccaaccccgagaaugaagauuggaaaaaggaaaaaaaaaaaaacacgu

SEQ ID NO: 83405 - RNA, 64 nt, Human
uuuggcuucauuucaaucauugaaguauauucuuauuggaaauguacuuuuggauaaguagggc

SEQ ID NO: 83406 - RNA, 64 nt, Human
ucuuaacuauauaguguuagugugaugcuauacuauuggaaaaauagcagcuuuuuucuauuuu

SEQ ID NO: 83407 - RNA, 64 nt, Human
ggaaaaguggaaacaaacauguauugaaauacauauuggaaauaaaaaugguuugagcgucagu

SEQ ID NO: 83408 - RNA, 64 nt, Human
aaugucagaauuaaaauaacagggcuaucccguaauuggaaauauuucuuuuuucaggaugcua

SEQ ID NO: 83409 - RNA, 64 nt, Human
uauaacaauacugugacuuaaaaaccaacucaguauuggaaauuuucuaaaguucuguccuaga

SEQ ID NO: 83410 - RNA, 64 nt, Human
uuuaacuaggaccaggugcagcaugcuagucuugauuggaaagauuugacaggaugcuaauuac

SEQ ID NO: 83411 - RNA, 64 nt, Human
gagcagcuuguuauaucugauuuucauguaacucauuggaaacucugccaugacucuuaaagua

SEQ ID NO: 83412 - RNA, 64 nt, Human
guucuuugccugcugucagaggagcagcuaucugauuggaaaccugccgacuuagugcggugau

SEQ ID NO: 83413 - RNA, 64 nt, Human
uauuauaaaaagagugucauauuccagcauuugaauuggaaagagaagagugaagauccaaguu

SEQ ID NO: 83414 - RNA, 64 nt, Human
ucuggagugagaucuauguacaaagugacauacaauuggaaauccauuuuuguuguaaagacau

SEQ ID NO: 83415 - RNA, 64 nt, Human
uacacuaucuaucugccuuuaccuacauaggcaaauuggaaauacacagaugauuaaacagacu

SEQ ID NO: 83416 - RNA, 64 nt, Human
auauauucaguuggugcauguuguggaagggggaauuggaaauuaaaugaaaaccuaugacuuu

SEQ ID NO: 83417 - RNA, 64 nt, Human
uuuuaaaaagaaauuauucucauugcuguauuauauuggaaaaguuuuaaacaaccaagcuaaa

SEQ ID NO: 83418 - RNA, 64 nt, Human
ucaaaccauuaaggguuaaaaauacaucuuaaacauuggaaagcucuucuagcugaaucugaaa

SEQ ID NO: 83419 - RNA, 64 nt, Human
uagccagccaggaagaugaauccuagcuucuuccauuggaaaauuuaagacaaguucaacaaca

SEQ ID NO: 83420 - RNA, 64 nt, Human
uauaauuuaaauguuaauagaaauuuugaguuuuauuggaaaugauuuccuucugaaaagagcu

SEQ ID NO: 83421 - RNA, 64 nt, Human
gaugaaugaggauucugcugcccugagggaguucauuggaaaccugcguucuccuaccucuucc

SEQ ID NO: 83422 - RNA, 64 nt, Human
aaaaaaaaagaaaaaaaaaucaaaauguauaaauauuggaaaucaaguuuuucagcuguuuugu

SEQ ID NO: 83423 - RNA, 64 nt, Human
uaaaauucaugcugaucuucauuaccguugcaugauuggaaauguuuaaaacauuguacaguuu

SEQ ID NO: 83424 - RNA, 64 nt, Human
acucauuucaauguuuuccugagguggagccuucauuggaaaggggaaagagggauucuagggu

SEQ ID NO: 83425 - RNA, 64 nt, Human
uuuuggucugacauuuuuguagccuucuguuauuauuggaaauagucucuuacauaagcugauu

SEQ ID NO: 83426 - RNA, 64 nt, Human
auuuuucuuuuucauugaaacuuuaaagguuauuauuggaaacauuacuuugagugcaguguuu

SEQ ID NO: 83427 - RNA, 64 nt, Human
acauuucuacccugaagaacuaaugacagcaaucauuggaaauacugauuaugacuggaaacag

SEQ ID NO: 83428 - RNA, 64 nt, Human
caggaucugucuagcuuauuaaagaugaaacugaauuggaaaaauagcuccauuuuuuggugcu

SEQ ID NO: 83429 - RNA, 64 nt, Human
cagccaucaagagccaucugcuuuccaggugaacauuggaaaugagaaucuuugaaacuuagca

SEQ ID NO: 83430 - RNA, 64 nt, Human
cugcauuaaccugcaugaucuguuucuacuauggauuggaaacuuguuucuugaacaagucuug

SEQ ID NO: 83431 - RNA, 64 nt, Human
uacuuucuucuggccacugcacuguagauaauucauuggaaacaagauuuacccacuacauaaa

SEQ ID NO: 83432 - RNA, 64 nt, Human
uaugucucuuuuauauuuuggcacaauuauacacauuggaaagggccaaccuauuagggcucaa

SEQ ID NO: 83433 - RNA, 64 nt, Human
uggaaucaguaaccauucaaucuuuuguccuaggauuggaaaaaaauguuaaagguuuaggaca

SEQ ID NO: 83434 - RNA, 64 nt, Human
uguuaagauaggaaugcuagugucucuuuaauuaauuggaaauagauggaggcuaaaaaugaag

SEQ ID NO: 83435 - RNA, 64 nt, Human
cccuucugcagacuguugccugucaucuaagcgaauuggaaaugcugagcuuccauaagucagc

SEQ ID NO: 83436 - RNA, 64 nt, Human
aggaagagucucauuagacaaugauuuuuaaagcauuggaaaaauauuuugccuguaaaaguua

SEQ ID NO: 83437 - RNA, 64 nt, Human
ugaugaagaaaaagucaaggaaggaggugauacaauuggaaauauucccaucaaaugguuaauc

SEQ ID NO: 83438 - RNA, 64 nt, Human
aucuaugaguacgugugaccuuuucccaaaccuuauuggaaaccuuaaguaaccaguggcuaaa

SEQ ID NO: 83439 - RNA, 64 nt, Human
gguuagugaaugucuggcaugauuauacacguguauuggaaauaucuaguuuuuuaaauuuuua

SEQ ID NO: 83440 - RNA, 64 nt, Human
aacucaauauugaauacuuugggauguuaaauucauuggaaaaacaaaccauuuguaaccucag

SEQ ID NO: 83441 - RNA, 64 nt, Human
uaacccucaagccaguugauuuuuaauauauuugauuggaaaagaacucucugguauuauuaag

SEQ ID NO: 83442 - RNA, 64 nt, Human
acauuaaaacaguuguauggugcaggaaaagaagauuggaaaaagaccaaaacacacuucucca

SEQ ID NO: 83443 - RNA, 64 nt, Human
uauauugaaugaaagccacugugcuuguguuuugauuggaaauuccuuuagugucaguuuuuug

SEQ ID NO: 83444 - RNA, 64 nt, Human
uucgcguaagcauuguuguucuguuuugaggguuauuggaaaacagagcagugaccacuuccug

SEQ ID NO: 83445 - RNA, 64 nt, Human
acagaacaaaauaauauguagcagcuucauugcuauuggaaaaaucaguuauuggaauuuccac

SEQ ID NO: 83446 - RNA, 64 nt, Human
caaucauccaaacagaucaauggaauagaauuucauuggaaauguaaaacacuuucccaacaau

SEQ ID NO: 83447 - RNA, 64 nt, Human
cuucucuucccauaccacccaaaaucauaaugccauuggaaagcaaaaaguuguuuuauccauu

SEQ ID NO: 83448 - RNA, 64 nt, Human
aauaauaaagucacuaucuuauguuuucuuuuggauuggaaagaaauaaagcuccuaguaaagu

SEQ ID NO: 83449 - RNA, 64 nt, Human
uguguuuuaaaagcgccaguaaaccaucggaucaauuggaaagaaggcaacucuucagccuuug

SEQ ID NO: 83450 - RNA, 64 nt, Human
uaaugaaauugguuuacagaaguaaaaaacaaaaauuggaaagcaaaguaauaaaacuuaguuu

SEQ ID NO: 83451 - RNA, 64 nt, Human
guugcuguauuuagaauuauaaacauuuuucauuauuggaaaguguaacggggaccuucugcau

SEQ ID NO: 83452 - RNA, 64 nt, Human
uccauucugugucacagacaccaacacaccacucauuggaaaauggaaaaaaaaaacaaaaaaa

SEQ ID NO: 83453 - RNA, 64 nt, Human
auuuuuucuaaauccuccccuacaaaauuuucagauuggaaauuacucuuguauuuguagaaga

SEQ ID NO: 83454 - RNA, 64 nt, Human
uauaccuaaaaauuuucccucccugcccaaggugauuggaaaguacugcaauugagcuaaaauu

SEQ ID NO: 83455 - RNA, 64 nt, Human
agaggaguauuauagccaaguuuucuuugaaaguauuggaaaacuaaaauuaaaugacaaggac

SEQ ID NO: 83456 - RNA, 64 nt, Human
guauuauggguggggaggaaauagaauugagucaauuggaaagacuauccaacuuaacaugaaa

SEQ ID NO: 83457 - RNA, 64 nt, Human
aggagaagcacugccauuuguuuuuauuucaacaauuggaaaaauuaccaauuuguacauuuua

SEQ ID NO: 83458 - RNA, 64 nt, Human
auaaccaugagaauuuuacuuccauuauacaucaauuggaaaucaauccuguuaagagauaauu

SEQ ID NO: 83459 - RNA, 64 nt, Human
uucuuucaagaaucuuuagagauaaggauugcacauuggaaaaguaaaccauguuucauuccuu

SEQ ID NO: 83460 - RNA, 64 nt, Human
cuuagccaguuuguuuuucagagccuguagucuuauuggaaaucuauuuuaucagugugcuuua

SEQ ID NO: 83461 - RNA, 64 nt, Human
ugugagcauaaaauuaugaccaugguauauuccuauuggaaacagagagguuuuucugaagaca

SEQ ID NO: 83462 - RNA, 64 nt, Human
auccauuguucguuaauauccauguaacaaucccauuggaaacaagauuuuuuuugaauccuag

SEQ ID NO: 83463 - RNA, 64 nt, Human
uuaaauuuucucucacugaugcccuuuggaaauuauuggaaauuucuggacuauccucuuugga

SEQ ID NO: 83464 - RNA, 63 nt, Human
augaaagugaagaacuuuaauaacuuuaccaacauuggaaaacagccaacuacaccauuagua

SEQ ID NO: 83465 - RNA, 64 nt, Human
gaaggggacauagcuucucucuuagagagaacagauuggaaagcaaucggaaaauugcaguuuu

SEQ ID NO: 83466 - RNA, 64 nt, Human
uugaaaauggugggauucauuggcccauagguacauuggaaaauguauaucucuccagcuguac

SEQ ID NO: 83467 - RNA, 64 nt, Human
agccugacauuagacagaauacccuuuguaauacauuggaaauuuuuacucaugccuuuuuguu

SEQ ID NO: 83468 - RNA, 64 nt, Human
agucaugacuaccuucugguguggagaaauugccauuggaaaauuugacaauuuugauucucac

SEQ ID NO: 83469 - RNA, 64 nt, Human
acuuguguagaugcuucucagaacaugaaaucaaauuggaaaucuguaacgcagcuuccguaag

SEQ ID NO: 83470 - RNA, 64 nt, Human
uaggguaggugaugguuuaaaucaauuaaguggcauuggaaaccuaggguuuccuuuugauuaa

SEQ ID NO: 83471 - RNA, 64 nt, Human
cugacaccaaacacauccaguuuauaaucaguacauuggaaagcugguauugauguagaaccag

SEQ ID NO: 83472 - RNA, 64 nt, Human
gccugggugauggagcaagaccucgucucagaaaauuggaaacuauugacuaagagaaguuucu

SEQ ID NO: 83473 - RNA, 64 nt, Human
uaugauggauaaaugcaugaguuucugugagagcauuggaaaggaguuugucacucaauaggug

SEQ ID NO: 83474 - RNA, 64 nt, Human
uaucagaaauuauacuauauuuuauagaaccaucauuggaaaugaaacugguaauaaaacugua

SEQ ID NO: 83475 - RNA, 64 nt, Human
acaaugguagacaugaaugagauauuuaaaguucauuggaaaucuucuucccuacagcaguaag

SEQ ID NO: 83476 - RNA, 64 nt, Human
auuauuccagcagucugaaaccuaaauauguuauauuggaaaucaugacugugagacuuuauug

SEQ ID NO: 83477 - RNA, 64 nt, Human
accaacauucagaaauucauuucagcauguuauuauuggaaauuauuuaaacuaauuuagauaa

SEQ ID NO: 83478 - RNA, 64 nt, Human
gacuguguucacaaccguaguaaaauuugguuucauuggaaaugaaacaaauucuaaaguaugc

SEQ ID NO: 83479 - RNA, 64 nt, Human
ggaauaugaaaaugacaccuuuuccaaauauuaaauuggaaaacaaggucuacaaaaucaugau

SEQ ID NO: 83480 - RNA, 64 nt, Human
ggagggaagugugagcgccuugguaugacuuaaaauuggaaaugucaucuaaccauuaagucau

SEQ ID NO: 83481 - RNA, 64 nt, Human
acuggcaaaauccuuaguguacggacaaaagcaaauuggaaaagccagccauuuacuaauucag

SEQ ID NO: 83482 - RNA, 64 nt, Human
acugaauugucacuuuaucuuuaguaucaugaugauuggaaaaaccugugaaguuguuaaggca

SEQ ID NO: 83483 - RNA, 64 nt, Human
aaaaucucuaagggacaggauuuuccagauccuaauuggaaauuuagcaauaaggagaggaguc

SEQ ID NO: 83484 - RNA, 64 nt, Human
ucugugauaauucuuacgggagaaagaggauuugauuggaaagcaguuugggaagaaagugcug

SEQ ID NO: 83485 - RNA, 64 nt, Human
cuucagguaugggaaacagcucucagauuuauaaauuggaaaucaccagguuacuugccaauau

SEQ ID NO: 83486 - RNA, 64 nt, Human
agucaguccuggggcuugcugacauggguggcccauuggaaaggagaaccaggucagaugaugu

SEQ ID NO: 83487 - RNA, 63 nt, Human
uagauuuuuuuguguguguggaaauaaaucugcaauuggaaacaaaaauguacugguaauugc

SEQ ID NO: 83488 - RNA, 64 nt, Human
ccuucaccccagccacaugccccagccaauacaaauuggaaaaucuggcccauuuuaggguuac

SEQ ID NO: 83489 - RNA, 64 nt, Human
gggaccuauuucguugacagaaacagugaggucuauuggaaaguuagccuucagugggaggagu

SEQ ID NO: 83490 - RNA, 64 nt, Human
uucccagaacuuauuagaaacgauuccggauggcauuggaaaacuaaagaaacugucaaucuug

SEQ ID NO: 83491 - RNA, 64 nt, Human
gaaauuguuauuuuaacagacccugccuaaaagcauuggaaaacuaaagaaguugagcaacuug

SEQ ID NO: 83492 - RNA, 64 nt, Human
ugaaaaaugaguuuagaaaggcuagcccacugacauuggaaaaagcugugaacagaguuguguc

SEQ ID NO: 83493 - RNA, 64 nt, Human
uugaacauuaaugaaagcccuauaaaauagaaagauuggaaaucaccauuguuuccuauuaucc

SEQ ID NO: 83494 - RNA, 64 nt, Human
gaaacauuuauuguaaccuaacagaccaucacagauuggaaacuugguagauagcagagcaugg

SEQ ID NO: 83495 - RNA, 64 nt, Human
uuuucucuguccugaacccccagguaugggugaaauuggaaauuacuaaucuauuggaaaucag

SEQ ID NO: 83496 - RNA, 64 nt, Human
cccagguaugggugaaauuggaaauuacuaaucuauuggaaaucaguuccugacauaguaaagu

SEQ ID NO: 83497 - RNA, 64 nt, Human
ugcaagaacagaaaaccacauacugcaucuucccauuggaaaguggcagcuaaacauuaaauuc

SEQ ID NO: 83498 - RNA, 64 nt, Human
gagaaauauccacacuaucucagugguauuuugcauuggaaaaaggaagcacuguguagcagug

SEQ ID NO: 83499 - RNA, 64 nt, Human
uaaacguuuuuuaauccccuguuuuaguuaaaaaauuggaaaagaaaccgacccauuuuuuucc

SEQ ID NO: 83500 - RNA, 64 nt, Human
uauuguccauauguauauuuucccaguaauugaaauuggaaaggaacuuaugggcauauuacug

SEQ ID NO: 83501 - RNA, 64 nt, Human
aaaagucaauucauguggccuuugaauuuuccucauuggaaaguacuaaauaaauaaaaauuca

SEQ ID NO: 83502 - RNA, 64 nt, Human
agcucagaauucaguggggaccagagagccugcaauuggaaauaugagaaauucuuugcccaga

SEQ ID NO: 83503 - RNA, 64 nt, Human
agagcugucagaagacuugggaagguuugccagcauuggaaaaagccacuuggacuucacagag

SEQ ID NO: 83504 - RNA, 64 nt, Human
agaugacugaagacuuccuguaagagaaauggaaauuggaaacuagacugaagugcaaaucuuc

SEQ ID NO: 83505 - RNA, 64 nt, Human
caugagccaccacaucuggccuaggaccuuaaauauuggaaagcauucucaaaacuguggguca

SEQ ID NO: 83506 - RNA, 64 nt, Human
uuuuuguccaguaaauaauuguuaggggaucuuuauuggaaaacuuuuuuggagaggcugguau

SEQ ID NO: 83507 - RNA, 64 nt, Human
uuacagcauugcaaaaucuguaaaaauaacuuuuauuggaaaaugucaugaagucauuuuucau

SEQ ID NO: 83508 - RNA, 64 nt, Human
caaauguuaaauuugugcuucaguaccuagauaaauuggaaagguuaauguucuaguuucugga

SEQ ID NO: 83509 - RNA, 64 nt, Human
aaaugaaaaugaauagcuuguuucugucaagcauauuggaaagugauuuuauuuuugcaaaaua

SEQ ID NO: 83510 - RNA, 64 nt, Human
aaaccuggaauguaucgacuuucuuucaggggauauuggaaagauaauggucauuauacuuaua

SEQ ID NO: 83511 - RNA, 64 nt, Human
cacagaaacaccuagaauaauguuugaccuuauaauuggaaaaucagagcaaaaguuaaaucuc

SEQ ID NO: 83512 - RNA, 64 nt, Human
cugugacaucuguugaacauaugugguuguauauauuggaaauguacauauccaauaugaaaua

SEQ ID NO: 83513 - RNA, 64 nt, Human
cugcaccuguauucauuguggaacuuccucuuucauuggaaacuuucuuacucaagaaugacgg

SEQ ID NO: 83514 - RNA, 64 nt, Human
gaaagagaugugaucauggauuaaacaccagcucauuggaaacucauuggaugagaucagaaaa

SEQ ID NO: 83515 - RNA, 64 nt, Human
acagugaucaaguuauuuuuaauuugguuuucacauuggaaacaagucagucauucagauauga

SEQ ID NO: 83516 - RNA, 64 nt, Human
ucugucucgguggcagguucccaccucgcaagcaauuggaaacaaaacuuuuggggaguuuuau

SEQ ID NO: 83517 - RNA, 64 nt, Human
agauuuuccugaaaacccuugccaugugcuaguaauuggaaaggcagcucuaaaugucaaucag

SEQ ID NO: 83518 - RNA, 64 nt, Human
acccauuucuacaauuucuuugccgcuuccuugaauuggaaaaauguacuuugaaagaaccguu

SEQ ID NO: 83519 - RNA, 64 nt, Human
gccagaaaucuuugccaagguccugguuaaaaaaauuggaaacgguuuucuuagccccagcuuu

SEQ ID NO: 83520 - RNA, 64 nt, Human
gauggcccugcuccuuuucugcugaacauuuaguauuggaaacuccuacuucccuuuucauuaa

SEQ ID NO: 83521 - RNA, 64 nt, Human
accugugcauguaccccuugaaccugaaauaaaaauuggaaaguaaaaaaaaguguguaaauau

SEQ ID NO: 83522 - RNA, 64 nt, Human
uagaccacacacaucguuuaaccugcucuuggucauuggaaauuuacacugaacaaagugcaau

SEQ ID NO: 83523 - RNA, 64 nt, Human
uuucucaucacauuguagagaggucugcauucucauuggaaaugucuguuuagcuuuauaaaac

SEQ ID NO: 83524 - RNA, 64 nt, Human
ucuaggugugaucccucacauccacaaaucucugauuggaaagaagggacagcagaaaacugcu

SEQ ID NO: 83525 - RNA, 64 nt, Human
ugggccgcuuaggaacaagaaccggagagaagugauuggaaaugaacucuugcccuggaauaau

SEQ ID NO: 83526 - RNA, 64 nt, Human
guaacaucaaagcaaaauccuauacguguccucuauuggaaaauuugggaguuuguuguugcau

SEQ ID NO: 83527 - RNA, 64 nt, Human
ucuuacuuugcuuuguuuauaaauaaauuaguagauuggaaaaacuaguguuagggaaagaaau

SEQ ID NO: 83528 - RNA, 64 nt, Human
acaaaauguuaagaaaugaucuuuuuaugaggcaauuggaaauuugaacacugaucaacuauag

SEQ ID NO: 83529 - RNA, 64 nt, Human
uauaagagguaagcuaauuaaugcagugaaugggauuggaaagcaucuacuuaaauaucuauug

SEQ ID NO: 83530 - RNA, 64 nt, Human
uuagcuaaaguuaaguuguuggaagaauuccuugauuggaaauuguaccuuuguguuuuguugc

SEQ ID NO: 83531 - RNA, 64 nt, Human
uacauguguggauguguaaauggagcuuguacauauuggaaaggucauuguggcuaucugcauu

SEQ ID NO: 83532 - RNA, 64 nt, Human
ucuaaaacucaagaacaaauucuauuuauuuauuauuggaaaaugaaaagcaacucaaaacaac

SEQ ID NO: 83533 - RNA, 64 nt, Human
aacgucacagcaguacuugcucaauaaaggucauauuggaaacauagucaauugcugagucuua

SEQ ID NO: 83534 - RNA, 64 nt, Human
gauggcucacugauuuuugaaaagccugaauaaaauuggaaagacuggaaaguuaggagaacug

SEQ ID NO: 83535 - RNA, 64 nt, Human
auagaaucaagagcaaaacugcacaaacuugcacauuggaaagugcaacaaguucccgugauug

SEQ ID NO: 83536 - RNA, 64 nt, Human
guauaacauaaguuguuggcaugaaauauuugagauuggaaacuucuugccuugaacagaacuu

SEQ ID NO: 83537 - RNA, 64 nt, Human
ugcaguggcuccucucugguugaggagagggaaaauuggaaaaacuggucgaguaauuaucaau

SEQ ID NO: 83538 - RNA, 64 nt, Human
auauauauauuuuaauuuaugagaauuuuggacaauuggaaagguagaaaagaaaagccaagau

SEQ ID NO: 83539 - RNA, 64 nt, Human
caaguucuugacauuggucuguuuugcugugaauauuggaaaugcuuaggaucuucagacccaa

SEQ ID NO: 83540 - RNA, 64 nt, Human
acuacuucuauaaugcuuauuaugguaaaauaaaauuggaaaaaauuaaaacugaccuauaaga

SEQ ID NO: 83541 - RNA, 64 nt, Human
aggaagcaacagcuucagaaagagcucaaaauaaauuggaaaugugaaucgcagcuguggguuu

SEQ ID NO: 83542 - RNA, 64 nt, Human
ggcaaauguuaagccuucuaaaaggaaaguguagauuggaaaaugauuuuuuuuccaaaugaug

SEQ ID NO: 83543 - RNA, 64 nt, Human
gggaagccuuggaaugcccuucugguucuggcacauuggaaagcacacucagaaggcuucauca

SEQ ID NO: 83544 - RNA, 64 nt, Human
ugcuuaccugguauuuuauuagaugcagaaacagauuggaaacagcuaaauuacaacuuuuaca

SEQ ID NO: 83545 - RNA, 64 nt, Human
auuucucccgcuucacucuguuucagauauuuuuauuggaaaauguuaggguagaggccugaga

SEQ ID NO: 83546 - RNA, 64 nt, Human
agcacaaaugaauuugucucaacuaugcaauuugauuggaaaaauguaugugcagcauguuaca

SEQ ID NO: 83547 - RNA, 64 nt, Human
uguuaagauaugcacagucuauuuuuuguauaguauuggaaaauaaaaaugcuauaauuugggu

SEQ ID NO: 83548 - RNA, 64 nt, Human
accaguguuaaaugugaguggaaggaguucuggaauuggaaaaccaucauuuuucaaccaucac

SEQ ID NO: 83549 - RNA, 64 nt, Human
uuagcaaacuggcaaaaucacauugcaggaacauauuggaaaaauuguacccuuuacuaaagaa

SEQ ID NO: 83550 - RNA, 64 nt, Human
acaucucacccagcuaguguuccucagaacaaagauuggaaaaagcuggccgagaaccauuuau

SEQ ID NO: 83551 - RNA, 64 nt, Human
auauaucuuguaugauuuuuuauuuuuuaauaacauuggaaauauauucaagagauuaugauuc

SEQ ID NO: 83552 - RNA, 64 nt, Human
uuuuucucagacagacauaguaguaucaacuagcauuggaaaauacauaucacuauucuuggaa

SEQ ID NO: 83553 - RNA, 64 nt, Human
caugacaaaccugcaaaauauuuuaucagcuguuauuggaaagugauuuuaagcaauugcuucc

SEQ ID NO: 83554 - RNA, 64 nt, Human
gcuuuaaguuguauguauuucugaacuuggcaaaauuggaaauuaaaauuuuuaaaaauuacaa

SEQ ID NO: 83555 - RNA, 64 nt, Human
gacaguuagacaugcacacagacgccauagcuggauuggaaacauugauguuuuaaaaauuuau

SEQ ID NO: 83556 - RNA, 64 nt, Human
uuuguaaccacuuucuaagcauuuuuuauucacaauuggaaacacaaauguaaugcaagaauaa

SEQ ID NO: 83557 - RNA, 64 nt, Human
cuucugcagagaugauuaaauauauccaagagacauuggaaaaccugcugaacauuuuacauug

SEQ ID NO: 83558 - RNA, 64 nt, Human
gcauaugaaaguguacauauuaugacugccaaguauuggaaaugaaaagaccuggagucuaugc

SEQ ID NO: 83559 - RNA, 64 nt, Human
guagacaaaacuauaauccagcaucuuuuauugcauuggaaagacuggcaaagucuuuuggaug

SEQ ID NO: 83560 - RNA, 64 nt, Human
uaagagauucuagaguagaacugaagaguauucuauuggaaaagugaaaggaaagaaauguaau

SEQ ID NO: 83561 - RNA, 64 nt, Human
guugucccccucuucucuggguguaagaagggaaauuggaaaaaaaauuauauauauauucucc

SEQ ID NO: 83562 - RNA, 64 nt, Human
ccguagcagccacuaaaagauuauuuaauuccagauuggaaaugacauuuuaguuuaucagauu

SEQ ID NO: 83563 - RNA, 64 nt, Human
aaguuauucacuguguuuuugaugaucuaucuguauuggaaauauguuccuggaaaaugcauuu

SEQ ID NO: 83564 - RNA, 64 nt, Human
aguuaguuaguucucuuguuaaauggaaaugggaauuggaaauuccugauaaagaauuggccug

SEQ ID NO: 83565 - RNA, 64 nt, Human
agggugauuaaaaucugaagcaaagaggccaaagauuggaaaccccccacccccaccucuuucc

SEQ ID NO: 83566 - RNA, 64 nt, Human
ggcucuggauguggccuagauauuugauauucuaauuggaaauuacagauuaaaaagcacccuu

SEQ ID NO: 83567 - RNA, 64 nt, Human; identical to SEQ ID NO: 83502

SEQ ID NO: 83568 - RNA, 64 nt, Human
cugcuuccagagauauuagaaacugacucacuugauuggaaaauggacaaaagugccuugacgu

SEQ ID NO: 83569 - RNA, 64 nt, Human
cuagauuuuuuuuaaaacuuuuuuuuuuuuucauauuggaaaaguaauucauauucaguagagg

SEQ ID NO: 83570 - RNA, 64 nt, Human
cucuuuaaaaucuguucccauauugaacaggcagauuggaaaagcuaugguucgauuucucaga

SEQ ID NO: 83571 - RNA, 64 nt, Human
aggguacaugcuuuaaaaccgacccgcaacaaguauuggaaaaauguauccagucugaagaugu

SEQ ID NO: 83572 - RNA, 64 nt, Human
aacaagauaccaggcacuuaaagccuuuuccugaauuggaaaggaaaagaggcccaagugcaaa

SEQ ID NO: 83573 - RNA, 64 nt, Human
uggagcacuuuaagggcgccuguuaguaacaugaauuggaaaucugugucgaguaccucugauc

SEQ ID NO: 83574 - RNA, 64 nt, Human
cucaguuauucagauauagcucaguuuuauucagauuggaaauuacacauuuucuacugucagg

SEQ ID NO: 83575 - RNA, 64 nt, Human
uaaugcuuauguaucugaagaaaaggucagaucuauuggaaaugacagcccgauacuugagccu

SEQ ID NO: 83576 - RNA, 64 nt, Human
cuaauuauagauguaaaaugaaauuucauuuguaauuggaaaaaauccaauaaaaaggauauuc

SEQ ID NO: 83577 - RNA, 64 nt, Human
uuuggggugacugaauucacagauuuuuuuuuuuauuggaaacggcuuuucuuggccaacagaa

SEQ ID NO: 83578 - RNA, 64 nt, Human
gggaggaggccgaaguuguucccauuuauccaguauuggaaaauauuugacccccuuggcugaa

SEQ ID NO: 83579 - RNA, 64 nt, Human
gcuccuggguuuucucuccaugauguuaugcccaauuggaaauaugcugucaguuugugcacca

SEQ ID NO: 83580 - RNA, 64 nt, Human
uguguuucuuaaauugagccuaagaauggaguuaauuggaaauauacaguauauauuaauaaug

SEQ ID NO: 83581 - RNA, 64 nt, Human
uacgucugucauacugggagcuuuaucacugcaaauuggaaagccaucuuauacaaaauuauuc

SEQ ID NO: 83582 - RNA, 64 nt, Human
caucaaagcagaagucuggcuuugcucuauuaagauuggaaauguacacuaccaaacacucagu

SEQ ID NO: 83583 - RNA, 64 nt, Human
ccucccaaggagaacaaauauucagaauauucauauuggaaaaaucacaauuuuuaauggcagc

SEQ ID NO: 83584 - RNA, 64 nt, Human
auauugagcuggagcuucuugagggcaggagaguauuggaaaaggaauccagaagacccucucc

SEQ ID NO: 83585 - RNA, 64 nt, Human
uacugucugaacccagggaucacaaauucuguucauuggaaaggguuuuaaacggagucggaac

SEQ ID NO: 83586 - RNA, 64 nt, Human
ggguggaauuuuuuucucacucuaaugacuuccuauuggaaaggcauugacagccagggacagg

SEQ ID NO: 83587 - RNA, 64 nt, Human
agcuugucaggauguuaagcaucucaggagaaauauuggaaaauuauauguauaaaaccaaagu

SEQ ID NO: 83588 - RNA, 64 nt, Human
ucuucccaccuggguaggcagcgcccuaauuggaauuggaaacagaaaauucgccaggccauac

SEQ ID NO: 83589 - RNA, 64 nt, Human
uuuccugggaagugcuaauuuuaccuguuuccaaauuggaaacacauuucucaaucauuccguu

SEQ ID NO: 83590 - RNA, 64 nt, Human
aaaaaaaauucagcuuucauguuucugauuccagauuggaaaauauuuuuauauggucuguugu

SEQ ID NO: 83591 - RNA, 64 nt, Human
uuuuccauuguaaauauuucuguaaauacuaccaauuggaaauuagaacaguagaguacuuuuc

SEQ ID NO: 83592 - RNA, 64 nt, Human
gaauguuuaaaauggaggcaacauuuuggccaacauuggaaagcacuagagggcaaugggauua

SEQ ID NO: 83593 - RNA, 64 nt, Human
ugacaacgaugaaaaugcuugguuauguaaagugauuggaaauguaauggauaauuggguaaua

SEQ ID NO: 83594 - RNA, 64 nt, Human
aucuuuucaaggcaccaacaaacaaaacugugauauuggaaauagccuaucccuccugacaguc

SEQ ID NO: 83595 - RNA, 64 nt, Human
gcagaauuucugaauguguagagacuacuacaaaauuggaaaaagauuggcaauucuuuguaaa

SEQ ID NO: 83596 - RNA, 64 nt, Human
caagcagaguagugcucugcucuggggaggggucauuggaaaccauaaugcagagugggccccc

SEQ ID NO: 83597 - RNA, 64 nt, Human
cuccacuuguauauauggaucagaggaguaaauaauuggaaaaguaaucagcauauguguaaag

SEQ ID NO: 83598 - RNA, 64 nt, Human
uggccggcuacaggcuccauuucucugccuucccauuggaaauaguuuauuuccacauucucca

SEQ ID NO: 83599 - RNA, 64 nt, Human
ggacaggauguguuugcuuucugaucaaggccuuauuggaaagcagucccccaacuacccccag

SEQ ID NO: 83600 - RNA, 64 nt, Human
uuuuuuuuuuuccuuugaacuuugaagcuagugcauuggaaaaaugcacccuuucccuccuuug

SEQ ID NO: 83601 - RNA, 64 nt, Human
ucucauuugggguuuugcuucugucugucuguuuauuggaaacuuguacuucaaguagggggaa

SEQ ID NO: 83602 - RNA, 64 nt, Human
acauauucccaaaaaauucuuaucucuguaugugauuggaaaagaaaagaucacauuuguauau

SEQ ID NO: 83603 - RNA, 64 nt, Human
gcaugauauguauauugcugaguugaaagcacuuauuggaaaauauuaaaaggcuaacauuaaa

SEQ ID NO: 83604 - RNA, 64 nt, Human
uauugacuucuugggaaaaaacggagaaauauuaauuggaaaguugauuuuuaugauaauaugg

SEQ ID NO: 83605 - RNA, 64 nt, Human
uuauucauaaaaacugugaaagcuagacugaaccauuggaaacauuuaacucagacucuggauu

SEQ ID NO: 83606 - RNA, 64 nt, Human
cucaugagacauagccuaaucaauuagaucuagaauuggaaaaauugucccgucugucacuugu

SEQ ID NO: 83607 - RNA, 64 nt, Human
auuaugcuggggucucgacuaaaacugaauuugaauuggaaaauucugguguugguuggaguuc

SEQ ID NO: 83608 - RNA, 64 nt, Human
uuccucacuacccccucccgcugucauuuguuuuauuggaaaacuucauguuaacuagagugua

SEQ ID NO: 83609 - RNA, 64 nt, Human
gcccucugggcauacgguagauauuaucugaugaauuggaaaggagcaaaccagaaauggcuuu

SEQ ID NO: 83610 - RNA, 64 nt, Human
uuagauuuuuauccauggguuccuacgccuugucauuggaaacacugccuuugucuuacuggca

SEQ ID NO: 83611 - RNA, 64 nt, Human
aaacaacccuaaauacacgucuguuuagcccgcaauuggaaaggauauauguggcaauauuaac

SEQ ID NO: 83612 - RNA, 64 nt, Human
accuaagaacacuuuaaaaagcaacauguaaaugauuggaaauuaauauaguacagaauauauu

SEQ ID NO: 83613 - RNA, 64 nt, Human
cuucauucuguccuucagggaaggcagaagaaacauuggaaagcaucuaguccagugggaagcc

SEQ ID NO: 83614 - RNA, 64 nt, Human
acuuaagguagaaguuccaagcuacuaguguuaaauuggaaaauaucaauaauuaagaguauuu

SEQ ID NO: 83615 - RNA, 64 nt, Human
ucgaaucccucuuucaugagaagucuuuuggauaauuggaaaccuucaucacugagguuggcca

SEQ ID NO: 83616 - RNA, 64 nt, Human
gaggaagagcaaguagaaaaguggcauuuucuugauuggaaagggggaaggaucuuauugcacu

SEQ ID NO: 83617 - RNA, 64 nt, Human
agcuaaaguugaguaaauucuuagcuaagaaaaaauuggaaauccaucaucuauauuagcaaca

SEQ ID NO: 83618 - RNA, 64 nt, Human
aggagagaauuaguagggcaagaucaaagcauacauuggaaauaaacaguagaaauaagcaaac

SEQ ID NO: 83619 - RNA, 64 nt, Human
ugggcucaaagaauuuauucaucucuaacaugauauuggaaaauaauggaugaaaauaggaaaa

SEQ ID NO: 83620 - RNA, 64 nt, Human
gcaaaacaacucauauguuaagaccauuuuccagauuggaaacacaaaucucuuaggaaguuaa

SEQ ID NO: 83621 - RNA, 64 nt, Human
ccuggccugaguuuauguuaacauguaacccucaauuggaaauuuuuggauucugggauggcag

SEQ ID NO: 83622 - RNA, 64 nt, Human
uaauuuaaugacccacuaauaggcugugaguggcauuggaaaaauaccugcuuguaagauaugc

SEQ ID NO: 83623 - RNA, 64 nt, Human
gucacaaugaaagaaaacuguuuauauagaccccauuggaaaagcaaaacgcucucacugagau

SEQ ID NO: 83624 - RNA, 64 nt, Human
cauaagguaucuccccucccuucaggaauaacuuauuggaaaacugaaaagaaucacugaaugg

SEQ ID NO: 83625 - RNA, 64 nt, Human
ugcuguacuucuugaaauguuucuaggggagagcauuggaaaauccccuucccccaucuagauc

SEQ ID NO: 83626 - RNA, 61 nt, Human
ugaauaagauuuaccuaugaguagaagcuuaauuggaaagaagagaagaauuacugacgua

SEQ ID NO: 83627 - RNA, 64 nt, Human
aaguguucuauuacacuguuauuuggagcaugccauuggaaaacccacccccacccccccucaa

SEQ ID NO: 83628 - RNA, 64 nt, Human
uaccacacuuuauauucaguucugugucuuacuuauuggaaaaauuuauuucuuagcuuucaca

SEQ ID NO: 83629 - RNA, 64 nt, Human
ucuuuucuucccuuuagugauuucaguaguuuauauuggaaagaaaaacaauuacaacaugugc

SEQ ID NO: 83630 - RNA, 64 nt, Human
uaguuaauggucauagacuuuauuccaaaacauaauuggaaaauagaaacugagccauugccaa

SEQ ID NO: 83631 - RNA, 56 nt, Human
aagagaugacagcuucuuaaaacuuuauuggaaaagacucuugacuuuuuauauac

SEQ ID NO: 83632 - RNA, 64 nt, Human
cacaguuccugugggacugggccgugaguuuuccauuggaaagaaguucaguggucccauuguu

SEQ ID NO: 83633 - RNA, 64 nt, Human
ccuuuuucugauggguaacuugcaggaauauucuauuggaaaagauaacaggaaguacaagugc

SEQ ID NO: 83634 - RNA, 64 nt, Human
auuuaugugagcaauaaagaagaaauuggcagauauuggaaaaauauuuugugaaaagcuguau

SEQ ID NO: 83635 - RNA, 64 nt, Human
guuauauacauuuggccauuaugaugugcaagcaauuggaaaaaaagucaaguaaaugcuuguu

SEQ ID NO: 83636 - RNA, 64 nt, Human
agcauuaauguaguugaacuuuuuaaauuuuugaauuggaaaaaaauucuaaugaaacccugau

SEQ ID NO: 83637 - RNA, 64 nt, Human
cgggccucgaaggccacaaacaaggcgucgaggaauuggaaagauuugcacacccuccagaaag

SEQ ID NO: 83638 - RNA, 64 nt, Human
uugaugaauuuaaacuuuaagucaggugcugcaaauuggaaagaagacuugugguguuuuaagu

SEQ ID NO: 83639 - RNA, 64 nt, Human
cacucuuggcauguaagaaauaagcauuuacauaauuggaaaaaucuggauuucugaugccaaa

SEQ ID NO: 83640 - RNA, 64 nt, Human
uuccuuccucuuuauucgagcauacuggcaaugcauuggaaaacagacagcucccacuaagauc

SEQ ID NO: 83641 - RNA, 64 nt, Human
aacaaauauuaauauuaaaaugcagaccguuaugauuggaaaauaaaucaaugaacaauauaau

SEQ ID NO: 83642 - RNA, 64 nt, Human
augagagugauucaaaugauucaaauuccaugacauuggaaaaaggucaucauagcucuaacuu

SEQ ID NO: 83643 - RNA, 64 nt, Human
guaguuaggcagcccagcugagguggaccaacuaauuggaaacacucuuccccuucuguucccc

SEQ ID NO: 83644 - RNA, 64 nt, Human
aaggaaaauaaaaaggauucuaaaaguuugaugcauuggaaaaauuuccuugaggcauuuagca

SEQ ID NO: 83645 - RNA, 64 nt, Human
cacuauaaaaagauauuuuuauuagcuaucuuagauuggaaauccacuuucugcuuacuguguc

SEQ ID NO: 83646 - RNA, 64 nt, Human
aucacuaacacaaggaaaaauacuuucuuuuucuauuggaaaugguuacaaguuauacuccaaa

SEQ ID NO: 83647 - RNA, 64 nt, Human
uaaaacaucaauugauauuaaaaaugaaaagauuauuggaaaguacauauugacuugugguuug

SEQ ID NO: 83648 - RNA, 64 nt, Human
uacaaacaaugaauggaaucuacugacacagcuaauuggaaaacagaugucuucuucuguccua

SEQ ID NO: 83649 - RNA, 64 nt, Human
caugauucuuaaccaggcuauauguuaaaaaaaaauuggaaaaugcaauacauuuuuuauuaua

SEQ ID NO: 83650 - RNA, 64 nt, Human
uuauaaagggguaauucauuaauuacacuuuaaaauuggaaagugggauaagaaaucuaaagua

SEQ ID NO: 83651 - RNA, 64 nt, Human
aguuacuuugauacgccucaucuuauccuacauuauuggaaaauaaaugagauguccacacaaa

SEQ ID NO: 83652 - RNA, 64 nt, Human
ccugagaggguaccugaagagauaccgggaaaauauuggaaacaugccaccaagcccucuucga

SEQ ID NO: 83653 - RNA, 64 nt, Human
acggauucaggaagagccacucaguccacaccccauuggaaaugugggcccuccuaucucaggg

SEQ ID NO: 83654 - RNA, 64 nt, Human
uaacauucauguuauggcaagaguuguccucuacauuggaaagcuaauccuaccuugucaguuu

SEQ ID NO: 83655 - RNA, 64 nt, Human
uguauaaaaugaguauucccauuaauagucacugauuggaaauuauucuguugcuguuugucaa

SEQ ID NO: 83656 - RNA, 64 nt, Human
gcuuuguuuuuguuuuucuuuuguaccuagucucauuggaaaugacuaguauucugccucauuu

SEQ ID NO: 83657 - RNA, 64 nt, Human
auauccuacugcucaaggucaucgccaaggugugauuggaaaaauucaaaaaauugcaaccuca

SEQ ID NO: 83658 - RNA, 64 nt, Human
cugcuccuuuacgauauuccaaauaguuuuuuacauuggaaaaacuaauucuugggauucuuuc

SEQ ID NO: 83659 - RNA, 64 nt, Human
acuauauauauauauacacacauaguuuuagcaaauuggaaauaauauauucauuuguauggca

SEQ ID NO: 83660 - RNA, 64 nt, Human
uacuuuuaucugugcaccagccacaaauacccacauuggaaagacccauuugugauggguaaac

SEQ ID NO: 83661 - RNA, 64 nt, Human
aacaaaacagcaucauacauagugaaugauguucauuggaaaauucuaaaauuuguccuugucu

SEQ ID NO: 83662 - RNA, 64 nt, Human
ugcuuucuaguuaaccugaugccaguacagugcaauuggaaaagcaggacuuuggugccugugc

SEQ ID NO: 83663 - RNA, 64 nt, Human
cagguuaugugcugcuguagauaaggacugugccauuggaaauuucauuacaaugaagugccaa

SEQ ID NO: 83664 - RNA, 64 nt, Human
uaaaaucaaggugguauauuugaagugaauggugauuggaaauuuuuagcuguaacaaaaagaa

SEQ ID NO: 83665 - RNA, 64 nt, Human
aguuuucaccuaucuggaaaaaaaaaaauaugagauuggaaaaaauuagacaagucuaguggaa

SEQ ID NO: 83666 - RNA, 64 nt, Human
guacaaaaaucuguuuuuacaucauaaugcaagaauuggaaauuuuucuaugguagccuaguua

SEQ ID NO: 83667 - RNA, 64 nt, Human
ccaugcgauacuaugugugcauuauuugaaaguuauuggaaauuuuauucaaaccguggaacaa

SEQ ID NO: 83668 - RNA, 64 nt, Human
auggaguauuuuauuuucaaaguuccugauaagcauuggaaagaaaucgacauggauaaugaag

SEQ ID NO: 83669 - RNA, 64 nt, Human
uucuuuuuaccagacuuagaaauggcuguugcguauuggaaauuaguguuaucuggaagguuua

SEQ ID NO: 83670 - RNA, 64 nt, Human
cacucugacagcauccagggugacuacagggcccauuggaaauggaucaucauucucucuucua

SEQ ID NO: 83671 - RNA, 64 nt, Human
ggcuccagugauuucaguguuuuguucauguuuuauuggaaaugcacgugguuucuuaggcuuu

SEQ ID NO: 83672 - RNA, 64 nt, Human
uuucaggguuaggguuuaaagaaaggagaaagccauuggaaaaaugaugggcuccauuaaggag

SEQ ID NO: 83673 - RNA, 64 nt, Human
ucuguucaaauuaggaauuagggacauggaugaaauuggaaaucuucauucucaguaaacuauc

SEQ ID NO: 83674 - RNA, 64 nt, Human
aaagacauuucuuuuucccucucaauuccaaggcauuggaaaaagagaggaacaagcagaagau

SEQ ID NO: 83675 - RNA, 64 nt, Human
uccauguucacuuauggcugguuuugcuauagaaauuggaaaauaaaggccacuuuuuugaaau

SEQ ID NO: 83676 - RNA, 64 nt, Human
caguugucuugaggguaugauaaguccacaaaaaauuggaaagcaucuuacccauuuucuucac

SEQ ID NO: 83677 - RNA, 64 nt, Human
ucugaaaacacuugcugagaaccaaauuuauuccauuggaaaaacccucuguggagcuauaagc

SEQ ID NO: 83678 - RNA, 64 nt, Human
agccaggccuccagcacccccagugcagcucgugauuggaaacucaccaucggcaggcaguggu

SEQ ID NO: 83679 - RNA, 64 nt, Human
gucagagagugguguuuuuguucaggugggaaggauuggaaacucuagucuuuucuagaaacag

SEQ ID NO: 83680 - RNA, 64 nt, Human
guucaaccuguugguuucuacaaugauuuuaaacauuggaaagccagccuuguguauauuuuua

SEQ ID NO: 83681 - RNA, 64 nt, Human
agaggccagauguuggcaccaccucuccaggaggauuggaaaggaggaguaaaggauucugauu

SEQ ID NO: 83682 - RNA, 64 nt, Human
cucacuguuuagacacauaacugugguacaguguauuggaaauuuuauaaacaaaagugaaagu

SEQ ID NO: 83683 - RNA, 64 nt, Human
gagaauuuggagaagugauugaacuuuucaagacauuggaaacaaauagaacacaauauaauuu

SEQ ID NO: 83684 - RNA, 64 nt, Human
uuaggauaggccagaacccuggccacuguauaaaauuggaaagucucuaagacacaggcaaacc

SEQ ID NO: 83685 - RNA, 64 nt, Human
uaugguucggaauuuguuacuauuuacagacaccauuggaaaguggauauauuagauugugaga

SEQ ID NO: 83686 - RNA, 64 nt, Human
gaacuuuugaugaaagauugccaacagcugcuuuauuggaaaugaggacucaucugauagaauc

SEQ ID NO: 83687 - RNA, 64 nt, Human
ggaauaauugaaaacaccagaagguugaaguuuaauuggaaacccagaauauacauacuuugcu

SEQ ID NO: 83688 - RNA, 64 nt, Human
uacaucugcauuaaggugccgaugcagaaggcaaauuggaaacacgcgccagcggcaguggggc

SEQ ID NO: 83689 - RNA, 64 nt, Human
gcuauucuggaggcugaggcaggaaucgcuugaaauuggaaagcagagguugcagugagcugag

SEQ ID NO: 83690 - RNA, 64 nt, Human
uguugcuaucugauuucauagcagcagucacuaaauuggaaacaaaagguugcaacgugacaaa

SEQ ID NO: 83691 - RNA, 64 nt, Human
ugggggaaaauuuagaaauauaauugacaggauuauuggaaauuuguuauaaugaaugaaacau

SEQ ID NO: 83692 - RNA, 64 nt, Human
cccaguuuugucugcuagccauaugggacaucuaauuggaaaagcaucugcauaaaaguuugga

SEQ ID NO: 83693 - RNA, 64 nt, Human
gaggccaagguuggaggaucauuugagcccaggaauuggaaagcagccuggccaacauaguggg

SEQ ID NO: 83694 - RNA, 64 nt, Human
aaauuuuggaaaugcuguucaacagcgcccuuaaauuggaaacaucuuugcagcucguuuuauu

SEQ ID NO: 83695 - RNA, 64 nt, Human
uucuuucaagugucgugagucgucuugauuguauauuggaaauaacuguguaacaaaucguauu

SEQ ID NO: 83696 - RNA, 64 nt, Human
ugguauaaaaaauuuugcuagcuuaguaaaacgaauuggaaaacuugacuaugaucuggaacag

SEQ ID NO: 83697 - RNA, 64 nt, Human
gaaaucacagauauuuguggguauuauaacaaucauuggaaagcauggagagcuacauuucaua

SEQ ID NO: 83698 - RNA, 64 nt, Human
uuuuguagauacaauaugaaucuuuucauguuuuauuggaaaugcuguucauacuuuaacauaa

SEQ ID NO: 83699 - RNA, 64 nt, Human
ugauggcacauaccuguaaucccagcuacuuggaauuggaaaucgccugaacccaggaggcgga

SEQ ID NO: 83700 - RNA, 64 nt, Human
aaaaaacaauuugguuuacugauaacaaaagauaauuggaaacaugagaguauuugagauuggc

SEQ ID NO: 83701 - RNA, 64 nt, Human
ccaaugagauuuauccgagacgcgauuauugcuaauuggaaauuuucccaauaccccaccguga

SEQ ID NO: 83702 - RNA, 64 nt, Human
auauguuggagcucuaaccccuaaugugacuguaauuggaaauaagaccuuuaaagaagugauu

SEQ ID NO: 83703 - RNA, 64 nt, Human
aguucagccuuucccuaucaaucacaaaucauguauuggaaauuauaaauggcaaccaaaaacu

SEQ ID NO: 83704 - RNA, 64 nt, Human
uuacaacacacauuauugugugucgagaggcagcauuggaaagagccugauuuucuaaaauaug

SEQ ID NO: 83705 - RNA, 64 nt, Human
uugacuacaaaauuuguaguuaaauuugacuacaauuggaaaugccaaaaacucacuaauaggg

SEQ ID NO: 83706 - RNA, 64 nt, Human
uguaguuaaauuugaccucagugcccugacuacaauuggaaaugccaaaaacucgagucuuuaa

SEQ ID NO: 83707 - RNA, 64 nt, Human
gucucugcccccaccccaugcagcgcuuugaggaauuggaaaagaaccugcuguuguaccuggg

SEQ ID NO: 83708 - RNA, 64 nt, Human
auauuauuuauaaaugauguaucccaugguaauuauuggaaaguauucaaauaaauaugguuug

SEQ ID NO: 83709 - RNA, 64 nt, Human
caugcgucgcauaagcacucuugucaaucauggaauuggaaaaaaagauguacauuuaguuaaa

SEQ ID NO: 83710 - RNA, 64 nt, Human
acugcuuucaagguucaacuucauuaucuucugcauuggaaaauauuugggccaugagaacuag

SEQ ID NO: 83711 - RNA, 64 nt, Human
cuggauuugggaugaaauacuuaaugaucuuuccauuggaaauaacuggaagugaagagguuuu

SEQ ID NO: 83712 - RNA, 64 nt, Human
ugaaauaagaaccuagcauuugguugagaggguuauuggaaagcuucaaacagagaauuagauu

SEQ ID NO: 83713 - RNA, 64 nt, Human
cuguaaaauugauuguggggaagacagagcuuucauuggaaaugccuauauugcuguggauugg

SEQ ID NO: 83714 - RNA, 64 nt, Human
agugacaaugcuuauggaaagccaguuaguuagaauuggaaaucugucuugucauuuuacaagc

SEQ ID NO: 83715 - RNA, 64 nt, Human
cacccagcgggaggugggaugugagacagcccacauuggaaaauccagaaaaccgggaacaggg

SEQ ID NO: 83716 - RNA, 64 nt, Human
gcauggcagaggcagguauaacacagcacuacauauuggaaauuuuuuauuuuucuaaauacca

SEQ ID NO: 83717 - RNA, 64 nt, Human
guucauugagagaugacaaugaagauuagaugaaauuggaaauaaaccaacauuguuuacauuc

SEQ ID NO: 83718 - RNA, 64 nt, Human
ccccaugagcuuccagccaaggaugcccuggccgauuggaaaugcuguaaaaugcaaacuaagu

SEQ ID NO: 83719 - RNA, 64 nt, Human
cucugggaccggcuuucucuccuggacaccgaggauuggaaauaagggccuggagcugaguagu

SEQ ID NO: 83720 - RNA, 64 nt, Human
aaaaaaaaaguugaauucaucucuaacuuaggccauuggaaaguguuuacuggauucauuuugu

SEQ ID NO: 83721 - RNA, 64 nt, Human
uuccucaggguggcagggguacagagagugccugauuggaaaaaaaaaaaaaagagagagagag

SEQ ID NO: 83722 - RNA, 64 nt, Human
acagcuaauuaauccaaagauaguauuugacuugauuggaaaauguuaggauggaccaaggugg

SEQ ID NO: 83723 - RNA, 64 nt, Human
auaguccuugcaaguaagucaagguuuuauccugauuggaaauagaagacauuuccgguugaga

SEQ ID NO: 83724 - RNA, 64 nt, Human
gucccaggaagcagggagaguuggggaaggcaagauuggaaagacaggaagaccaaggccucgg

SEQ ID NO: 83725 - RNA, 64 nt, Human
ggauugaagaaaagggacugggggaaggaaacuuauuggaaaacuugaugcgaaugaguuucug

SEQ ID NO: 83726 - RNA, 64 nt, Human
cuggcauuuccuggucucuggcacaucauaaccaauuggaaaccugcaguuugggguagggcug

SEQ ID NO: 83727 - RNA, 64 nt, Human
ccagucccaaugguccugacuuugggcgcuggguauuggaaauggaugcaaaguacaauguguu

SEQ ID NO: 83728 - RNA, 64 nt, Human
aaugauagcuuaaaagaaaaguuaaugccuucucauuggaaauguauaaucaaauaaguaguua

SEQ ID NO: 83729 - RNA, 64 nt, Human
agaccugccaugcaguuuauccucugagaauggaauuggaaaugaagaccuaaccagcuauugg

SEQ ID NO: 83730 - RNA, 64 nt, Human
caagauuuugcagagagaaggagcaaaccuuuucauuggaaaaacagaaacaacccuccccccc

SEQ ID NO: 83731 - RNA, 64 nt, Human
aguuuauuauacacuguacauuuuuuucacagcaauuggaaaaaaacaaccacuugcaaucauu

SEQ ID NO: 83732 - RNA, 64 nt, Human
aaagaaccaccacaagucaauagauuugaguuuaauuggaaaaaugugguguuuccuuugaguu

SEQ ID NO: 83733 - RNA, 64 nt, Human
aaguggcuggaugggacaucuccagacuacaaaaauuggaaagcuggacagccggauaacuggg

SEQ ID NO: 83734 - RNA, 64 nt, Human
uauaagcaauaaauauugugguuuuaucuacguuauuggaaagaaaaugacauuuaaauaaugu

SEQ ID NO: 83735 - RNA, 64 nt, Human
ggcaacaaccauaugguuguuccauuuucauaaaauuggaaacaaugcaguaauagcuuauugu

SEQ ID NO: 83736 - RNA, 64 nt, Human
gcgauuuuauuaucuugggggaugagaccaugagauuggaaaauguacauuacuucuaguuuua

SEQ ID NO: 83737 - RNA, 64 nt, Human
uacaaagguuuaaaugaacaagagaagcauucucauuggaaauuuagcauuguagugcuuugag

SEQ ID NO: 83738 - RNA, 64 nt, Human
cccuuuugugaaccuuguuuggggcacaguaggaauuggaaauaauuuaguuucuaucucuaag

SEQ ID NO: 83739 - RNA, 64 nt, Human
gcugucugcagccagaaagaaucugaauuuaugaauuggaaagauauauauaguguauuuguga

SEQ ID NO: 83740 - RNA, 64 nt, Human
ugccacugcagugucuuuuuaaacuggaaacagaauuggaaaacugccugacuuaucuugcauc

SEQ ID NO: 83741 - RNA, 64 nt, Human
augguugucacacuugauuauagguaauauucauauuggaaaaauuuccuacaaguaagaacaa

SEQ ID NO: 83742 - RNA, 64 nt, Human
acaauguaugaaaauuuacauuugaucauccggcauuggaaauaguuugaacuauuuccaaaaa

SEQ ID NO: 83743 - RNA, 64 nt, Human
uccuaaaucaugacuuaccugcuaauaaaaacucauuggaaaagugagacuaugcgugugaacg

SEQ ID NO: 83744 - RNA, 64 nt, Human
cuucgccaguaacaagaaaaauuaaguuguaaauauuggaaaggaacagacaaaaauagaugac

SEQ ID NO: 83745 - RNA, 64 nt, Human
aaaucauuuauuauauuuugccucaacuuuaaacauuggaaaacucauuucuggguuaauccua

SEQ ID NO: 83746 - RNA, 64 nt, Human
ucccuucccuccccccuugggggucgggggggacauuggaaaggagggaccccgccaccccagc

SEQ ID NO: 83747 - RNA, 64 nt, Human
cuaggucacguuggcccucaaagcgagccguugaauuggaaacugcuucuagaaacucuggcuc

SEQ ID NO: 83748 - RNA, 64 nt, Human
uuuauucacacaaaucaugucuguuggccuggaaauuggaaaaccaguuaaaccaaaaacauga

SEQ ID NO: 83749 - RNA, 64 nt, Human
ucucccuggaugcaaaaccuaugaguauauuaauauuggaaaauuuuucagugauucuucucuu

SEQ ID NO: 83750 - RNA, 64 nt, Human
uuuuaaaagaaauggauucuauuuauuaugcuuuauuggaaaaaauguuguaauaauuuaaugu

SEQ ID NO: 83751 - RNA, 64 nt, Human
cauguaaauugcagagaaaacaaaaccaaagcugauuggaaacaauuaauugugggugucugag

SEQ ID NO: 83752 - RNA, 64 nt, Human
auuuuauuuuaccugagaaaauuaaacaaaucacauuggaaauaaacucuauggcuugggcacg

SEQ ID NO: 83753 - RNA, 64 nt, Human
ucucucagcuccuugcacagacacaaaaggacucauuggaaagauacucuauaaauguguggaa

SEQ ID NO: 83754 - RNA, 64 nt, Human
caaaacguucagcagauuuuacacuuaauaguguauuggaaaauucauuuuacauuaaagugac

SEQ ID NO: 83755 - RNA, 64 nt, Human
aaauaacaaaaggauaauguuuucauaauuuuuuauuggaaaaugugcugauuuuuugaauguu

SEQ ID NO: 83756 - RNA, 64 nt, Human
aauaaucaaaaggauaauguuuucauaauuuuuuauuggaaaaugugcugauucuuugaauguu

SEQ ID NO: 83757 - RNA, 64 nt, Human
gccagccccuuucugcuccacaaaaaccacaguuauuggaaaagcucccugccuucccuugccg

SEQ ID NO: 83758 - RNA, 64 nt, Human
uuagguagucuggaagagagaauccagcguucucauuggaaauggauaaacagaaaugugauca

SEQ ID NO: 83759 - RNA, 64 nt, Human
aaaggauuauaugaaguaauaaaggauaaaaugcauuggaaaaagcugugaagcaugauuguuu

SEQ ID NO: 83760 - RNA, 64 nt, Human
uuugguucugaaguuuauggaauggaaguauuuaauuggaaagauuaaacauauugauuuuaau

SEQ ID NO: 83761 - RNA, 64 nt, Human
acacuaagugccuagacuuuaaauagaucuagcaauuggaaaguuaguaagccuaaguuuuuac

SEQ ID NO: 83762 - RNA, 64 nt, Human
uuagguauuaaacacuucagaauaucaauguaaaauuggaaaauaaggaacugggggcauuugu

SEQ ID NO: 83763 - RNA, 64 nt, Human
agccggcuucccugagggaggagaacacuggauuauuggaaauguuuuaaucacucuugccauu

SEQ ID NO: 83764 - RNA, 64 nt, Human
cuuguugcuguuugugauaacugauagauaacucauuggaaacgugcauacauuuauauucaga

SEQ ID NO: 83765 - RNA, 64 nt, Human
ucagaaaugaucuaaacacgaggaaacauuauucauuggaaaagugcaugguguguauuuuagg

SEQ ID NO: 83766 - RNA, 64 nt, Human
uuaaugaggucuaccuugcagagccauugugagcauuggaaaugaugaaugaaucauaccagaa

SEQ ID NO: 83767 - RNA, 64 nt, Human
ucuggcuucagcuaucagggcacccuccccagggauuggaaacggaugacgggccucuaggcgg

SEQ ID NO: 83768 - RNA, 64 nt, Human
ccuuuauauuuuuugucuguuuauuuacgcuuuuauuggaaaugugaauaaguaaagaauuacu

SEQ ID NO: 83769 - RNA, 64 nt, Human
gaagaagcuuaaaguccuggcuaauuguguggucauuggaaaacucugcaauacaauaauuuuc

SEQ ID NO: 83770 - RNA, 64 nt, Human
auuuugcagcgcuucaguguacguguuagagaauauuggaaaagcgucugugagccccgugcug

SEQ ID NO: 83771 - RNA, 64 nt, Human
uauugugaaaacccuuuucuuccagggaaaaauuauuggaaauuccuuaacugagcuauacuug

SEQ ID NO: 83772 - RNA, 64 nt, Human
ugagaguuguauuucagccacagauauuuucuccauuggaaagcuauuuucauuuuagaaaaau

SEQ ID NO: 83773 - RNA, 64 nt, Human
aaaauguaguugacagagauguauuuugaguuggauuggaaaggaauauuuuaagugccuuuua

SEQ ID NO: 83774 - RNA, 64 nt, Human
ucugcugaauggaauggcccagcauuagcccaguauuggaaaagacaccagcccaggggcccug

SEQ ID NO: 83775 - RNA, 64 nt, Human
auacaaucuuuuaauucugcucuaaugcuagcaaauuggaaaauguuuaagucuuugacacuua

SEQ ID NO: 83776 - RNA, 64 nt, Human
uauaauuuuugugaauuucaugggauguccuaugauuggaaaaauuauaacucuucugauucua

SEQ ID NO: 83777 - RNA, 64 nt, Human
ccaaccaacggcuggaaaugcaaaugaauaccgaauuggaaaaacagauuucuaaugaggcuga

SEQ ID NO: 83778 - RNA, 64 nt, Human
uguuucauguauuuauaaaaauuguauauugaacauuggaaauagaugauuagauuuuuguguc

SEQ ID NO: 83779 - RNA, 64 nt, Human
auguaugucuaaauuccuggagaagaugauauggauuggaaacugaaauucagagaaauggagu

SEQ ID NO: 83780 - RNA, 64 nt, Human
cuauuugauguguacagaguuggacuauguguauauuggaaauaaggaaaaacccuucucauug

SEQ ID NO: 83781 - RNA, 64 nt, Human
ucuuaauggguaaggggcugcuuacuucugggguauuggaaauguuuggggacuagguagaggu

SEQ ID NO: 83782 - RNA, 64 nt, Human
uuaacuaaucauugaaggcauucauccguccaucauuggaaagauuuacagugauucugaagga

SEQ ID NO: 83783 - RNA, 64 nt, Human
uugcugucuuuguaauuuuaaaacuuuaaaauaaauuggaaaagggagaaacugagcgguguau

SEQ ID NO: 83784 - RNA, 64 nt, Human
auuuccacugugcagguucccacuuaaaaauuaaauuggaaagcagguuucaaggaaguagaaa

SEQ ID NO: 83785 - RNA, 64 nt, Human
agggaagaaagcccuaagugaggacuguuggcugauuggaaaauaauaaaagaaucauuugcaa

SEQ ID NO: 83786 - RNA, 64 nt, Human
cauccaaguuuguucugccaccacuggauggaaaauuggaaauggacugggcgugguggcucac

SEQ ID NO: 83787 - RNA, 64 nt, Human
uccauucuggcaaaaucuugccuuaucagaagacauuggaaagagggauucccuuugguguuug

SEQ ID NO: 83788 - RNA, 64 nt, Human
gcccacuagucucauauuauuuuccuuuugagaaauuggaaacucuuucuguugcuauuauauu

SEQ ID NO: 83789 - RNA, 64 nt, Human
caguacuuauguuuuaaaauuaugauuuuuaagcauuggaaauagcaaaaagacauuuaaaauu

SEQ ID NO: 83790 - RNA, 64 nt, Human
aaagauaugcaguauugaauauauguaaggaaguauuggaaacauacuagccauuugaagacau

SEQ ID NO: 83791 - RNA, 64 nt, Human
gguauggauuucugcuuuugucacacgggcauccauuggaaaagagaagcaagaaugaacgugg

SEQ ID NO: 83792 - RNA, 64 nt, Human
uugcuucaaaauaauaagucuggauguuaagugcauuggaaauauugaugaaacgaaauuggcc

SEQ ID NO: 83793 - RNA, 64 nt, Human
cauaaagagacccuaauaugcauuuugauuuguaauuggaaauguaacuuucacugaaaguguc

SEQ ID NO: 83794 - RNA, 53 nt, Human
ucuauuuccacacccagugaagcauuggaaacccuauuuccccaccccagcuc

SEQ ID NO: 83795 - RNA, 64 nt, Human
ccugcucuagccauuugcaguuuuguuuuagaugauuggaaaguauaucaccaaaaaaaguaua

SEQ ID NO: 83796 - RNA, 64 nt, Human
gcuguucaucccagcacugucuaagcuaguaaaaauuggaaacaauuuaaguaucuagcacauu

SEQ ID NO: 83797 - RNA, 64 nt, Human
aaaagaaaaguguugggaaugaagcaagugauugauuggaaaacauacugaauggaagaaauau

SEQ ID NO: 83798 - RNA, 64 nt, Human
uucaacaaagcccuugucuaaaauaaaaggcauuauuggaaauauuugaaaacuagaaaaugau

SEQ ID NO: 83799 - RNA, 64 nt, Human
aaaauugcacugguguuagauauuaacgaagaugauuggaaaaaagucugaaagauacaucauu

SEQ ID NO: 83800 - RNA, 64 nt, Human
acuaagaaaauaauucaucagcauuaucucauagauuggaaaauuuucuccaaauacaauagag

SEQ ID NO: 83801 - RNA, 64 nt, Human
cccuccuucccuuccuuguagccuuuugacuuucauuggaaauuaggauguaaaucugcucagg

SEQ ID NO: 83802 - RNA, 64 nt, Human
ggggcaaaaguccuucauuccugguauuuauuggauuggaaaucuguagcaagaugcuguuuaa

SEQ ID NO: 83803 - RNA, 64 nt, Human
aacuuugaaauauauggucuaauguuuaagcagaauuggaaaagacuaagaucgguuaacaaau

SEQ ID NO: 83804 - RNA, 64 nt, Human
agaaaguguucuguuacaaaauguaacuguuaccauuggaaauuucacgucauaggaaguuagc

SEQ ID NO: 83805 - RNA, 64 nt, Human
gaaaauacuaguaguuuuauauuuggaugacauaauuggaaaagcagauuagcugcuacuacuu

SEQ ID NO: 83806 - RNA, 64 nt, Human
cauuacaucacuaaauucauuagauuuugucugcauuggaaagauacucuucuagcauaucuuu

SEQ ID NO: 83807 - RNA, 64 nt, Human
ggaugugcgugugugguccccagccccagacuggauuggaaaagugcauggugggggccucggg

SEQ ID NO: 83808 - RNA, 64 nt, Human
guaacauuuaccugguaucuacauccuuaccugcauuggaaaauguuugcuaccucacaacaac

SEQ ID NO: 83809 - RNA, 64 nt, Human
uuuuguaggaguuauuuagaacaggaaaagguaaauuggaaauuuuaccuagaaauauacaucu

SEQ ID NO: 83810 - RNA, 64 nt, Human
uaugugagccuucaguaaaaucuuugugugaaggauuggaaaaggcuauuuuccaacugaaguc

SEQ ID NO: 83811 - RNA, 64 nt, Human
aacuuuaaaaagcaaauuuacuccaaagacuuguauuggaaauuacauaccuuuuuuuuuuuuu

SEQ ID NO: 83812 - RNA, 64 nt, Human
cuguagcaucuggucucacggacucugaggaggaauuggaaauuggucucuuuugagugcagag

SEQ ID NO: 83813 - RNA, 64 nt, Human
uagccaguugaggaaguagaaggaauuuccagauauuggaaacaguaugcaugaagacaugaag

SEQ ID NO: 83814 - RNA, 64 nt, Human
uuguuuuaaugcuuguacguacauaugugaacucauuggaaauauuguguguuuaaugcaaaug

SEQ ID NO: 83815 - RNA, 64 nt, Human
ccuugccaggucccuuucauuugcuaucucuauuauuggaaaggaccuaaaaauugguguaaug

SEQ ID NO: 83816 - RNA, 64 nt, Human
acuauaacuuaaagaauaauacuuagaaggguuaauuggaaaucagaguuugaaauaaaacuug

SEQ ID NO: 83817 - RNA, 64 nt, Human
cauaacuaaggaaacaucaccuguccaaguucaaauuggaaaccauguugaagagcuccaguuu

SEQ ID NO: 83818 - RNA, 64 nt, Human
uugguaaagaauaacccacaaacaccugaucuugauuggaaagcauuguaggucauuagggaaa

SEQ ID NO: 83819 - RNA, 64 nt, Human
uggauuuugacccauuuuccaggucuauuuuucaauuggaaacuuucacacauuugcaugggaa

SEQ ID NO: 83820 - RNA, 64 nt, Human
uucagauuuucaauauuaaacuuguuauucuuacauuggaaaaaaauaaauuguuuuuaaaaag

SEQ ID NO: 83821 - RNA, 64 nt, Human
uccuggugcuggguuagcuaagagaauagacagaauuggaaaauacugcagacauuuccgaaga

SEQ ID NO: 83822 - RNA, 64 nt, Human
cuuuuuguuguuacacuguuggguggguauaacaauuggaaaaugaacaaacugauugauugug

SEQ ID NO: 83823 - RNA, 64 nt, Human
auguuaggauuacccucugguaauugauacagauauuggaaaaaagacaacauugauguuauuu

SEQ ID NO: 83824 - RNA, 64 nt, Human
ggaggcuuacaaacagcaaaucaaagaagauaauauuggaaaucagcugcugagaaagaugggu

SEQ ID NO: 83825 - RNA, 64 nt, Human
uggagagcuuaccauaguuuuauagcauuguucaauuggaaaaguacauuccaaguucuagauu

SEQ ID NO: 83826 - RNA, 64 nt, Human
auuuuuaaaccacugcuugugagauugcuuguugauuggaaagaguguuuuauucaccauuuaa

SEQ ID NO: 83827 - RNA, 64 nt, Human
aaccgaacaauaaguggcaaccaauuaucuuaacauuggaaauacuggggugccauuuuguuuu

SEQ ID NO: 83828 - RNA, 64 nt, Human
acacuaaugccucuuaauugcaucaguauuuccuauuggaaaauacaucuguuccagaaaaaca

SEQ ID NO: 83829 - RNA, 64 nt, Human
acgagaucaggaguucaagaccagccuggccaauaugaugaaaccccgucucuacuaaaaauac

SEQ ID NO: 83830 - RNA, 64 nt, Human
uaggagaucugucccuuuuagagacaccuuacuuaugaugaaguauuugggagagugguuuuuc

SEQ ID NO: 83831 - RNA, 64 nt, Human
uagauuuuuuggugcuaagggauacuuugucauuaugaugaaguaaguguuaagugucagauaa

SEQ ID NO: 83832 - RNA, 64 nt, Human
uuguuguucacuugugguucuacauuccuggugaaugaugaauguugcugucaaagggcugccc

SEQ ID NO: 83833 - RNA, 64 nt, Human
aggcccgcuaagccccaaaggcaggaucuagaugaugaugaacaugauuaugaagaaauacuug

SEQ ID NO: 83834 - RNA, 64 nt, Human
ugccugccugccugccugccugucugccuaugugaugaugaaaucucugcauggcugcaaugau

SEQ ID NO: 83835 - RNA, 64 nt, Human
gucaagaucaacauuccaggguugguaauguuggaugaugaaacauucauuuuuaccuugugga

SEQ ID NO: 83836 - RNA, 64 nt, Human
ucuguauauagaaaggaaaacuagccugggcaacaugaugaaaccccaucuccacugcaaaaaa

SEQ ID NO: 83837 - RNA, 64 nt, Human
acagugcucacugcauuuaauaaauauuuaauaaaugaugaaugauagaaguuuccaucuacaa

SEQ ID NO: 83838 - RNA, 64 nt, Human
uuuuaagguuucucaagauguggcucuaccuacuaugaugaaaauugaagugggucaaaagaau

SEQ ID NO: 83839 - RNA, 64 nt, Human
auuuagucauccugauaugaggagccaguguugcaugaugaaaagaugguaugauucuacauau

SEQ ID NO: 83840 - RNA, 64 nt, Human
ugaaaugguuacagcuauuauagucauuucacagaugaugaaacuaagauucagagcagcugau

SEQ ID NO: 83841 - RNA, 64 nt, Human
cguggugucucacucugaaaagcaggaauguaagaugaugaaagagacaauguaauacuguugg

SEQ ID NO: 83842 - RNA, 64 nt, Human
uuucuuaccugaacuguuaauucaagugaggaauaugaugaaauaaaagcauuaacuacagaca

SEQ ID NO: 83843 - RNA, 64 nt, Human
gugcagaacauucucaauuaagugauaaguccaaaugaugaaggaaauguuuuaauucacaaau

SEQ ID NO: 83844 - RNA, 64 nt, Human
uucaugccucuuguaauguucugaacaaacuugaaugaugaaaguauuaaagagauaucaguau

SEQ ID NO: 83845 - RNA, 64 nt, Human
aguauaauuagcuuguuccuggacuucauuuucaaugaugaaccaaauuccugaauuauuuaua

SEQ ID NO: 83846 - RNA, 64 nt, Human
augucugggaugugaagaggcaaggcagaaauggaugaugaacaucaaaaacugucagaggaca

SEQ ID NO: 83847 - RNA, 64 nt, Human
auauuacauagaacggguauuccagacacuucuuaugaugaaaguccaaaaguggcauccaauu

SEQ ID NO: 83848 - RNA, 64 nt, Human
auaggauguuuaaaacaucaacacauugcuuaaaaugaugaaaccaacccucaaaaaacagucu

SEQ ID NO: 83849 - RNA, 64 nt, Human
ugaaaaaguaaauuuuauaggaaaaaaggguaucaugaugaaauucaaaaucuuauuuucuaag

SEQ ID NO: 83850 - RNA, 64 nt, Human
acugaccggguugggggcuuccuuucauagcuacaugaugaaaacccucugcccuggccucauc

SEQ ID NO: 83851 - RNA, 64 nt, Human
guuuugcuauugcacgauuucauauuuugccucuaugaugaacggcaaccauuauuuguaacug

SEQ ID NO: 83852 - RNA, 64 nt, Human
uaaauuuauguugcggaaagguaaccacaaaguuaugaugaacugcaaacauccaaaggaugug

SEQ ID NO: 83853 - RNA, 64 nt, Human
cacauuaggucaccugugcacagccauggcuggaaugaugaaggggauacgcuggaguugcccu

SEQ ID NO: 83854 - RNA, 64 nt, Human
ugggagcaucaccacuuauuaaaacacacauagaaugaugaauuaaaaaaguuuucuaggauug

SEQ ID NO: 83855 - RNA, 55 nt, Human
auaugaaguucauuuuuuagacuugaugaugaaugaagaaugcauggaggacugc

SEQ ID NO: 83856 - RNA, 64 nt, Human
aauaugguguuaugggaaaacacauuuugugcgcaugaugaagagagcaccgugaaucuagucu

SEQ ID NO: 83857 - RNA, 64 nt, Human
uauggucguagcauagggcugaaguguugugaauaugaugaaaaugugaugagaccaaacaaac

SEQ ID NO: 83858 - RNA, 64 nt, Human
cuauucaaaagggaaaacaugccagccauuuuauaugaugaagucucuuauuccauagaaaacu

SEQ ID NO: 83859 - RNA, 64 nt, Human
caacuuuaaaaaaagauccaaggaacuauucauaaugaugaaauuucaacuacauacaaggagg

SEQ ID NO: 83860 - RNA, 64 nt, Human
acgaggucaagagaucgagaccauccuggccaacaugaugaaaccccguuucuacuaaaaauac

SEQ ID NO: 83861 - RNA, 64 nt, Human
aaugugauaugaaaauaucuggguuuuucuuuugaugaugaaguauugcuaauauuaccguggu

SEQ ID NO: 83862 - RNA, 64 nt, Human
ugcuauccugugggaagguaggaaugggcuaaguaugaugaauauauagguuagggaucuuuug

SEQ ID NO: 83863 - RNA, 64 nt, Human
uggcaugucugucuagccucuuccucccucccucaugaugaagugccauuucuguuacgucucc

SEQ ID NO: 83864 - RNA, 64 nt, Human
uucuccagaaggaacuugggagaugauggugcagaugaugaaacuggguucaucccaguuccaa

SEQ ID NO: 83865 - RNA, 64 nt, Human
gcuucugaauaaaucuugccaagauagacaaacaaugaugaaacucagauggagcuuccuacuc

SEQ ID NO: 83866 - RNA, 64 nt, Human
uauauaaauaaaggaauccccagaaguggucccuaugaugaacucccccaaagcaacgccguuu

SEQ ID NO: 83867 - RNA, 64 nt, Human
ugauuccuucaacacccagaaugagccagaagacaugaugaaaaaagagaaaaagucugaagcu

SEQ ID NO: 83868 - RNA, 64 nt, Human
uacuauaauauuucuagaaucuggaacugucaccaugaugaauggcccuuucaaugcauaguua

SEQ ID NO: 83869 - RNA, 64 nt, Human
aguuucccauaugaguaauuagaagugguuauauaugaugaaugcuaugcagauguugucuuua

SEQ ID NO: 83870 - RNA, 64 nt, Human
guucugucauuguaaucuuuguuguuagaaacaaaugaugaaaacauagggguucuguaaacuu

SEQ ID NO: 83871 - RNA, 64 nt, Human
gauaagaugucgugacgcaaagaaauuggaaaacaugaugaaaauuuugguggaguuaaaguga

SEQ ID NO: 83872 - RNA, 64 nt, Human
aauacugauaacgaaagguaguaaugaaauauauaugaugaaaagaauugagaaguucuaaauu

SEQ ID NO: 83873 - RNA, 64 nt, Human
gauauaucaauucauguguuuggcauaccagugaaugaugaagaacaugagauuaauuuaauuu

SEQ ID NO: 83874 - RNA, 64 nt, Human
uaguggggaauucugugacagcugauugaagaugaugaugaagaaccucugcauucuaguuacc

SEQ ID NO: 83875 - RNA, 64 nt, Human
aggacagcaucaaagagauggugcuaaaccauucaugaugaacucacccccaugauccaaucac

SEQ ID NO: 83876 - RNA, 64 nt, Human
uguauauacuucugcaauuauaagauguuuuuugaugaugaaagcuuuccuaagguaauucuuu

SEQ ID NO: 83877 - RNA, 64 nt, Human
agcuauaauggaugcuuuguuuaaugagccaaauaugaugaaacauuuuuuccaauucaaauuc

SEQ ID NO: 83878 - RNA, 64 nt, Human
uauuuuacuugcaauuuggaagaaggaaagucacaugaugaaacuccuuuugucuauaaccagg

SEQ ID NO: 83879 - RNA, 64 nt, Human
acauggcuuuaauuuuuacuguguguauagcuacaugaugaaauuaauuaaauauuaagaggua

SEQ ID NO: 83880 - RNA, 64 nt, Human
ccaauuuuuaaugguaaucaacucugcuacuggcaugaugaaauaguacauaacuggucauuaa

SEQ ID NO: 83881 - RNA, 64 nt, Human
aauuuucuuuguagguuugauccagaucgguuugaugaugaauuaguaaugaaaacuuuuuccu

SEQ ID NO: 83882 - RNA, 64 nt, Human
acuggugcaauuggaucaguguaugauauggaugaugaugaaauggaccccaauuaugccagag

SEQ ID NO: 83883 - RNA, 64 nt, Human
uaauaagaaaucuggacaaguucaguuacacaguaugaugaauacuugaauuaggaacauugug

SEQ ID NO: 83884 - RNA, 64 nt, Human
cuuguaauagcucauuauuuugaaagauuuauauaugaugaauucuggauauaugaccaauaaa

SEQ ID NO: 83885 - RNA, 64 nt, Human
augcucucacucugaaauuccaagguugggggcaaugaugaaacuuuguacaguauaugaaaca

SEQ ID NO: 83886 - RNA, 64 nt, Human
ggcuacaguuuaauaucuguauuuuuauaaaaguaugaugaaggguuugggguguuuuuauuug

SEQ ID NO: 83887 - RNA, 64 nt, Human
caagcaucugguucagcggaaaugggaugugagaaugaugaaacccgacagaaguaucucagcc

SEQ ID NO: 83888 - RNA, 64 nt, Human
uucaguauucaucucaaagagaaaccuugggaacaugaugaaugugaggaaaguuccuuuccaa

SEQ ID NO: 83889 - RNA, 64 nt, Human
agaaguucuaagcgggagaugacucccuacugggaugaugaaggauggcauccuagugaagaag

SEQ ID NO: 83890 - RNA, 64 nt, Human
uguaaaaucuuuuuagaaagugagccauuuuguaaugaugaagauguuaggacuucaaaggauu

SEQ ID NO: 83891 - RNA, 64 nt, Human
uauaaaagcacaauagaguuauggaaauguuuccaugaugaacugugcuguuaggauucuuauu

SEQ ID NO: 83892 - RNA, 64 nt, Human
caaauaaguauauucaguucaauaauuauuuucaaugaugaaucacuuagugugaaagacuugc

SEQ ID NO: 83893 - RNA, 64 nt, Human
aauguccagauguaggggaagagauguuuacaguaugaugaaaauaauuuuccaaguaaaguga

SEQ ID NO: 83894 - RNA, 64 nt, Human
ggaagaggagauuugcuuuuaauccuuccaaaaaaugaugaaccaccguuccauucaguaguuu

SEQ ID NO: 83895 - RNA, 64 nt, Human
cacaucagagaaagaaacugcauguuuguuguugaugaugaaauaaaaaugcuagcgacagucu

SEQ ID NO: 83896 - RNA, 64 nt, Human
cagaagcccucgggcaugcccagugcaccaugggaugaugaaauuaaggagaacagcugaguca

SEQ ID NO: 83897 - RNA, 64 nt, Human
uugaggucaggaguucgagagcagccuggccaauaugaugaaaccccaucucuacuaaaaauac

SEQ ID NO: 83898 - RNA, 64 nt, Human
cuggcaguugucaucaaacauaaugaugaguaagaugaugaaugagauguaaaugugccaagaa

SEQ ID NO: 83899 - RNA, 64 nt, Human
guaauacuaaccgcgugauaauggguuuucagacaugaugaaaaaaaaaaacuuuuacaaauga

SEQ ID NO: 83900 - RNA, 64 nt, Human
gaugagcagcaugacaccaucaaaauuuaagaccaugaugaaauuucaguuucauucaaauguu

SEQ ID NO: 83901 - RNA, 64 nt, Human
aagaagguaaaagaaaggaggcaagagaauaguuaugaugaauauguguuaagugccugcucug

SEQ ID NO: 83902 - RNA, 64 nt, Human
aagaaaugucagacacucuuuggauuugauucagaugaugaaagugccugaugaaaacgguuca

SEQ ID NO: 83903 - RNA, 64 nt, Human
ccagcaaacuaggauugugauagcaaugaaugguaugaugaagaaaguuugaccaaauuuguuu

SEQ ID NO: 83904 - RNA, 64 nt, Human
uauagaagauuaggaugacuaaauuaauggggaaaugaugaaggaguuugaaucucuucuuugu

SEQ ID NO: 83905 - RNA, 64 nt, Human
ccagugcagggggaaaauugccucugaauaaugaaugaugaaagccugacgccgugccccuccu

SEQ ID NO: 83906 - RNA, 64 nt, Human
uugucuaacaucauauaucagaauuuuauuguauaugaugaacaaaacuuaaaauuuuuuaaau

SEQ ID NO: 83907 - RNA, 64 nt, Human
uuuuuccaaggaaaucagugucuuuuacguuguuaugaugaaucccacauggggccggugaugg

SEQ ID NO: 83908 - RNA, 64 nt, Human
ccaggacuccacagcgcuuucucagucacaagccaugaugaauuggugacucagacgcuuugug

SEQ ID NO: 83909 - RNA, 64 nt, Human
uguagguguugagcuccugguuuucuguguuuggaugaugaagauuuggacccuuccauucaua

SEQ ID NO: 83910 - RNA, 64 nt, Human
acgaggucaagagaucgagaccauccuggccaacaugaugaaacuccgucucuacuaaaaauac

SEQ ID NO: 83911 - RNA, 64 nt, Human
ucaguggacucauucuaagggcaagacauugaaaaugaugaauuccaaucuggauacagucaug

SEQ ID NO: 83912 - RNA, 64 nt, Human
caugaagcugagauggaccugggaacuccaacauaugaugaaaaccccaugaaggugagugugg

SEQ ID NO: 83913 - RNA, 64 nt, Human
uugaagagguuuucacucucugcuaaagugguagaugaugaaauuuacuacuucagguaaagcu

SEQ ID NO: 83914 - RNA, 64 nt, Human
uggugaaagagagaugccguguuuugaaaguaagaugaugaaaugaauuuuuaauucaagaaac

SEQ ID NO: 83915 - RNA, 64 nt, Human
guaaaacauauuucuguauuuauaggucuuaaacaugaugaauuuuuucuauuacaaguuuauu

SEQ ID NO: 83916 - RNA, 64 nt, Human
aaaauguuuucuccugcugcaguaaauauuuugcaugaugaaauuccagggucacacuuuucca

SEQ ID NO: 83917 - RNA, 64 nt, Human
uugacaacaauccaaaaaaaauacggcuuuuccaaugaugaaauauaaucagaagaugaaaaau

SEQ ID NO: 83918 - RNA, 64 nt, Human
augugagggccuugauuguuauguaauauugccaaugaugaauucagguuguuuuuagcacaag

SEQ ID NO: 83919 - RNA, 64 nt, Human
uugagguccggaguuccagacaagccuggccaacaugaugaagcccugucucuacuaaaaauac

SEQ ID NO: 83920 - RNA, 64 nt, Human
acuagaaggucaagcuaaaaaaugaaguaaauguaugaugaauuuuaaguucguauuaguuuau

SEQ ID NO: 83921 - RNA, 64 nt, Human
gugaaaaugaagggauuucauuugaaauuacagcaugaugaauuuugcauggguggccagccag

SEQ ID NO: 83922 - RNA, 64 nt, Human
guugugcugggcacagucuggggcacaggccuccaugaugaagacgcgugggcugucggugcuu

SEQ ID NO: 83923 - RNA, 64 nt, Human
augacagcuaacagggacgggcuuucuuuggaagaugaugaaauuguggaaugaugguugcaca

SEQ ID NO: 83924 - RNA, 64 nt, Human
aggcaagccgccucuucucggccaucgacugcagaugaugaaagagcgggauucaacuuuguuu

SEQ ID NO: 83925 - RNA, 64 nt, Human
auauuuauuuauaaugaagacaucuaagaucccuaugaugaaugcaggaacucucuugguaguu

SEQ ID NO: 83926 - RNA, 64 nt, Human
uugaggucaggaguucaacaucagccuggccaacaugaugaaaccuugucuuuacuaaaaauac

SEQ ID NO: 83927 - RNA, 64 nt, Human
uuucuaguucccacaggaggaacacaaagggcccaugaugaaagccugcacacaguggguuaug

SEQ ID NO: 83928 - RNA, 64 nt, Human
uuaugugaaaccaauauuggcaaauaguacuuuaaugaugaaguaaaugaccagaaauuauaga

SEQ ID NO: 83929 - RNA, 64 nt, Human
aagugucagauacuaggcagguguuagggaugaaaugaugaaugaggcauggaccuguuccuca

SEQ ID NO: 83930 - RNA, 64 nt, Human
gauacacagugagguguuguguuuuguuuuuuuaaugaugaaaaguuacacauuuuuuggagag

SEQ ID NO: 83931 - RNA, 64 nt, Human
cuguuuguuuuuuaaacuaugcaccagguuucugaugaugaaauaaagcaccuguuuguuuuau

SEQ ID NO: 83932 - RNA, 64 nt, Human
aguugcagauagccuauuuauuauaaauuaugagaugaugaaaauaauaaagccaguggaaauu

SEQ ID NO: 83933 - RNA, 64 nt, Human
uuaaagauuguuucuguugccaagaccaaugaccaugaugaagaguuuuaugaucacagccuau

SEQ ID NO: 83934 - RNA, 64 nt, Human
uauuuuuaaaacucaaaauuaaugcaaaagauuuaugaugaacagaauauacaaauuuuaaaua

SEQ ID NO: 83935 - RNA, 64 nt, Human
auguaauuucguugcuauaguaguuugcuaaaagaugaugaaaaugcagaaugucuuuuuaaau

SEQ ID NO: 83936 - RNA, 56 nt, Human
ugguccugcaguugaaauaacuggaaaugaugaauaccaguccuaucagauuuuau

SEQ ID NO: 83937 - RNA, 64 nt, Human
aaaaaaacaaaauaaauuuugugugauaauuuugaugaugaaagguggaaguucuaccuagauu

SEQ ID NO: 83938 - RNA, 64 nt, Human
uaaaauuacugaauaucagaaaaaauguuaauugaugaugaagcuuauucccaaaaugccuuuu

SEQ ID NO: 83939 - RNA, 64 nt, Human
uuuguguguaguugauuacucuuccauugagugaaugaugaauaccugugaggauaggaaauua

SEQ ID NO: 83940 - RNA, 64 nt, Human
uagaugacuaucucaaaugaacuuuuuauagacaaugaugaaaacagaauuaaagucaauguuu

SEQ ID NO: 83941 - RNA, 64 nt, Human
ugaaguuuuuuaaauuuauggcuauuuuuacacgaugaugaauuuugacaguuugugcauuuuc

SEQ ID NO: 83942 - RNA, 64 nt, Human
ugucucaaaaguggaaaaauuauauugucuaauuaugaugaauuauuuucuuguaucaagcuga

SEQ ID NO: 83943 - RNA, 64 nt, Human
aauaauguuucuuagcauugugaugauaaagcucaugaugaacuuuaucacuaguuaugccacc

SEQ ID NO: 83944 - RNA, 64 nt, Human
aacgugauacauuuggauaaacaacauugagauuaugaugaaaaccuacauauuccauguuugg

SEQ ID NO: 83945 - RNA, 64 nt, Human
ucaaaaggaagagcaaccguguugaauacuaauaaugaugaauuaguauucaguguuuagaauc

SEQ ID NO: 83946 - RNA, 64 nt, Human
cuuuccacaaaaugucaccucgcugcacuaaaggaugaugaauccuaaucauuaaaggaauugu

SEQ ID NO: 83947 - RNA, 64 nt, Human
uuauuuuaaauguuguaucauuaaaaaccucagaaugaugaaaaauaugaaugaugcauuguuu

SEQ ID NO: 83948 - RNA, 64 nt, Human
aauuuuuuauuaaauuuauuugaaaaugcaucacaugaugaaaaauuauaguagcuuauaagag

SEQ ID NO: 83949 - RNA, 64 nt, Human
aagucaaaauuguugucaaauuuacauaugguaaaugaugaacuuuaaaaauguguccaggugu

SEQ ID NO: 83950 - RNA, 64 nt, Human
acuguuaaauauuauuguaaauaaaaaaguuugaaugaugaauacuguaaaucuuuuuggucag

SEQ ID NO: 83951 - RNA, 64 nt, Human
cuuggaagagcacccggagcugaagcugucccugaugaugaaggugaaacgucagcccuggcca

SEQ ID NO: 83952 - RNA, 64 nt, Human
cuauuugucaacuggguucuggaaaaaaacaaacaugaugaagcuuuugaauaauugugcaguu

SEQ ID NO: 83953 - RNA, 64 nt, Human
uuucaacuauguuuauccagacuccuucuccacaaugaugaauccacaguugguuaucugcuac

SEQ ID NO: 83954 - RNA, 64 nt, Human
auaaauuucagugccucuuguaagcauuaaacugaugaugaagaaaguuccugauuugagaaau

SEQ ID NO: 83955 - RNA, 64 nt, Human
uugugucuucaugucguuguucugccuuucacaaaugaugaaagugaagauguucuuuccaagu

SEQ ID NO: 83956 - RNA, 64 nt, Human
gaaugagcugcugcuacuuuaaaguguggucauuaugaugaaugugaaaagaguuuuggcuugu

SEQ ID NO: 83957 - RNA, 64 nt, Human
auuuuugugcccccucugcuuacugugacagucgaugaugaaucuugcguugccauuuucugcu

SEQ ID NO: 83958 - RNA, 64 nt, Human
gugaugugucuguaucuuuaauguaaauagagagaugaugaaaaaagagucuauuuuaguguua

SEQ ID NO: 83959 - RNA, 64 nt, Human
cuaaacuuauucucucauccgaaguccaaagaggaugaugaagcccugggcuuugccugguuug

SEQ ID NO: 83960 - RNA, 64 nt, Human
cuuuuuuaaaguuucagaugaacucccauaaugaaugaugaauuugugaugagggauaaccugg

SEQ ID NO: 83961 - RNA, 64 nt, Human
gcuugaacauguauuuaggggcaaguuucucaugaugaugaaaaaguaucaagucauauugcua

SEQ ID NO: 83962 - RNA, 64 nt, Human
uuaugauggagggaagugaggugaauccaggcacaugaugaacaccuggcucauccauagaguu

SEQ ID NO: 83963 - RNA, 64 nt, Human
gaccuccuuauagaugaguggaaaagccugaccuaugaugaagucaucagcuuugugccaccac

SEQ ID NO: 83964 - RNA, 64 nt, Human
acacauggagagaugccccauggugggcaggcagaugaugaaguacuggcagguaggcagccuu

SEQ ID NO: 83965 - RNA, 64 nt, Human
agaaacucucauuuauauugcagauugaauauauaugaugaaauucuuauguugaauauguuag

SEQ ID NO: 83966 - RNA, 64 nt, Human
aaauuguccagaguggaaaagccuucaagaugacaugaugaauuacucaguucaucugauuucu

SEQ ID NO: 83967 - RNA, 64 nt, Human
gcauauauaucauauuuuuuacaaggaacauuuuaugaugaaagaagaaacccuucucugccuu

SEQ ID NO: 83968 - RNA, 64 nt, Human
aggaaguggacuuuacauguauauauucaucaaaaugaugaacuauuuauuuuaaaguaucauu

SEQ ID NO: 83969 - RNA, 64 nt, Human
gaagggagcagggagugugggguggggauggauuaugaugaaaucauuuucaaucuuaaaauau

SEQ ID NO: 83970 - RNA, 64 nt, Human
gaccuuaagagggaagggaaaaaagugugaaaggaugaugaagaaaauaauuuuacuauuucuu

SEQ ID NO: 83971 - RNA, 64 nt, Human
uuuauucuuauggaaauagugaauuccaacaacuaugaugaacuauguucuuugcuauuucuuc

SEQ ID NO: 83972 - RNA, 63 nt, Human
aacaucucaucccauaugcaugagauacuaauuaaugaugaaauugaacucuuguacuguauc

SEQ ID NO: 83973 - RNA, 64 nt, Human
ggaaggaacccaugaaaacaucaguguuaagagcaugaugaaaggugucaauaaagccguagga

SEQ ID NO: 83974 - RNA, 64 nt, Human
aguguuaaugucuguucucauaagcagguauauuaugaugaaacauguaccaguucugucauca

SEQ ID NO: 83975 - RNA, 64 nt, Human
acugacugugcaccagagaaucugcacaauaaacaugaugaauguggagaugcuugcuucagca

SEQ ID NO: 83976 - RNA, 64 nt, Human
acauucaagggggaaccuucugccccagcuuugcaugaugaaaagcuuuccugcuuggcucuua

SEQ ID NO: 83977 - RNA, 64 nt, Human
uacuauuuucuuucagcuaaccccugcaucuacuaugaugaauacuucgacugugacauacaag

SEQ ID NO: 83978 - RNA, 64 nt, Human
uucccaaccugcucauuuuuuuuuuaucagagucaugaugaaucaguccuagaauguuucauuu

SEQ ID NO: 83979 - RNA, 64 nt, Human
aaggauagugcuuguaaagaguagagauguguacaugaugaaucauugagggaggguggauauu

SEQ ID NO: 83980 - RNA, 64 nt, Human
uaccuuaauaauuccuuuucugguaaucaggcacaugaugaacuuugauuaguaggucugugau

SEQ ID NO: 83981 - RNA, 64 nt, Human
uaucaugagacugcauuauaaaugacaugauuaaaugaugaauuuauuuugucagccucagcaa

SEQ ID NO: 83982 - RNA, 64 nt, Human
gugaugauauucagauuguuuuauuuugauucaaaugaugaaucuguugacaccuuauaacucc

SEQ ID NO: 83983 - RNA, 64 nt, Human
ggucagaaggguuaacucaacugucuauugucacaugaugaauaaauagaugaagugagauaca

SEQ ID NO: 83984 - RNA, 64 nt, Human
gaugcuuuuucccaaggcuagaacgacuuccaccaugaugaauuugcuuuuuaggucuuaauua

SEQ ID NO: 83985 - RNA, 64 nt, Human
aaagagacuuaaacuacaacaaacaauaugcuuaaugaugaaauagugaacauuucuccuaaga

SEQ ID NO: 83986 - RNA, 64 nt, Human
acucuaaaagguuaauuucugucaaaugcaguagaugaugaaagaaagguugguauuaucagga

SEQ ID NO: 83987 - RNA, 64 nt, Human
uuggaaucccuguugcuacauugacuaaaaggucaugaugaauggaauauguaagacuuggcuc

SEQ ID NO: 83988 - RNA, 64 nt, Human
ugagaaaguauuugaagaaacuguugcacaacauaugaugaaauuuugauuucucugaaucuca

SEQ ID NO: 83989 - RNA, 64 nt, Human
cccaacacuuaaucauggcagccaggaugggugaaugaugaaagcucuucugcaugagccgguu

SEQ ID NO: 83990 - RNA, 64 nt, Human
uaugaaagaauaaggacauuaaaauguaagaugcaugaugaaaaccugagugaagaggcuguuu

SEQ ID NO: 83991 - RNA, 64 nt, Human
uguggaagaguaagaacauuaaaaugaaagaugcaugaugaaaaucuaaguagagaggcucuug

SEQ ID NO: 83992 - RNA, 64 nt, Human
uugaggucaggaguucaggaccagccuggccaacaugaugaaacccugucucuacuaaauauac

SEQ ID NO: 83993 - RNA, 64 nt, Human
cagaggguccaucaugaagagaaagccuaugaguaugaugaauauggguuggccuauauuaaac

SEQ ID NO: 83994 - RNA, 64 nt, Human
aauagagcgagacccugucucuuaaaaaacgaugaugaugaacacagaggacggggcacugugc

SEQ ID NO: 83995 - RNA, 64 nt, Human
gcauauccugagucauuugaccaagacacagaagaugaugaaugggaaaaaaaacauagagauc

SEQ ID NO: 83996 - RNA, 64 nt, Human
uaagaaagaggaagccaauuggauuucaaguuauaugaugaaauucugaauuaaugaaacugga

SEQ ID NO: 83997 - RNA, 64 nt, Human
ggcuccuuacugcuuauuaaucuguauuguacacaugaugaaaugaagcagaagcugggagucg

SEQ ID NO: 83998 - RNA, 64 nt, Human
cuuaaaagccauucaguucagcuauugggaguucaugaugaauuagcauaugccagaaagguug

SEQ ID NO: 83999 - RNA, 64 nt, Human
aguuuugcuuuaguacaauaguauacauuuuauaaugaugaacuuauaaugauuaagggacauu

SEQ ID NO: 84000 - RNA, 64 nt, Human
aaauuuuuuccuguuaaaaccaugaacauuggcuaugaugaagauuauuacauaugaaaaaaaa

SEQ ID NO: 84001 - RNA, 64 nt, Human
gggcauucuaugauuuagacuucaaggaauuccaaugaugaagauuuuaaggaaaguauuuuau

SEQ ID NO: 84002 - RNA, 64 nt, Human
aucauaugacauuuacugaagaugaacuggguccaugaugaaguguguguauguccacguuugu

SEQ ID NO: 84003 - RNA, 64 nt, Human
guacagugccuucgagccuacaagccccgagagaaugaugaauuggcacuggagaaagccgacg

SEQ ID NO: 84004 - RNA, 64 nt, Human
guggccacauggcacaaaacaccaaauauugguuaugaugaaacaccacauuuuagcaaaacuu

SEQ ID NO: 84005 - RNA, 64 nt, Human
uuaggcuugggaugggguccuacaaguuuugaguaugaugaaacuauaucaugucuguuugauu

SEQ ID NO: 84006 - RNA, 64 nt, Human
aggaagggacaagacaaaaccaaaacuaguucaaaugaugaagaccaaagaccaaguuaucauc

SEQ ID NO: 84007 - RNA, 64 nt, Human
cuaauucuaugacaguguacauauaugaaaauaaaugaugaaaaaagaacuauaauauuuuuaa

SEQ ID NO: 84008 - RNA, 64 nt, Human
uuacagaacaguuuaagaaguggugacauuuugcaugaugaaugaccugacuuuuagccaccag

SEQ ID NO: 84009 - RNA, 64 nt, Human
aauuccuauuaaguacagccgcaagaaagaaaaaaugaugaaguugcaaauggcagugugcugu

SEQ ID NO: 84010 - RNA, 64 nt, Human
aauuuuaaaagaugcaauguagaggggaaaagagaugaugaaaauauuuaaaggcccuaucugu

SEQ ID NO: 84011 - RNA, 64 nt, Human
uucaagcucucagcuacuccugaaacgggcagagaugaugaacagaaguguauguaaauacagc

SEQ ID NO: 84012 - RNA, 64 nt, Human
auuugauucucaaacaaaaguuguuccaaacaaaaugaugaacuuugauuugaacaggugcauu

SEQ ID NO: 84013 - RNA, 64 nt, Human
caguugauuucugaagacuacauugccaagcagaaugaugaaaugacuuuuucguugucaggca

SEQ ID NO: 84014 - RNA, 64 nt, Human
uuuccaaaguguaaguuugugaauagauuuuagcaugaugaaacugucauaauggugaauguuc

SEQ ID NO: 84015 - RNA, 64 nt, Human
aucauauaaacauuuuauuuauaguuaauaaucuaugaugaagguaauuaaaguagauuauggc

SEQ ID NO: 84016 - RNA, 64 nt, Human
uuuuuuggaaguaaaggcaaacauaaauauuaccaugaugaauucuagugaaaugaccccuuga

SEQ ID NO: 84017 - RNA, 64 nt, Human
uuauuuguuuuucugauuugaagguauaaccuucaugaugaauuacuucuucaggguguuaagg

SEQ ID NO: 84018 - RNA, 64 nt, Human
gauugcuguccucucuuguccucuucccacuccaaugaugaaaaugauuuucucuaaaugccug

SEQ ID NO: 84019 - RNA, 64 nt, Human
uacaaguaucuuucuuauaugcacauucuaauaaaugaugaaauucaguccaacaugcuuauua

SEQ ID NO: 84020 - RNA, 64 nt, Human
gcacaaucugaagagaugugguauaugaucuuaaaugaugaacaugagaccgcaaaaauucacu

SEQ ID NO: 84021 - RNA, 64 nt, Human
gauaauauuugauuccuacuguaaaauuuagaaaaugaugaauucuuguccauuuuuguaauca

SEQ ID NO: 84022 - RNA, 64 nt, Human
auauuaccauucuucuauggaaagaaaacuuuugaugaugaaacaauaaagauuuuaaauaucu

SEQ ID NO: 84023 - RNA, 64 nt, Human
agcaggaagcccaagugaaauuaauauuaugcagaugaugaaagggaccucugaacaggauuuc

SEQ ID NO: 84024 - RNA, 64 nt, Human
aauauguauaacuagugccucauuuuuauauguaaugaugaaaacuaugaaaaaauguauuuuc

SEQ ID NO: 84025 - RNA, 64 nt, Human
cauaguaccagugcagucagagcugcccuuaggcaugaugaacauguggcccguuuuugccugg

SEQ ID NO: 84026 - RNA, 64 nt, Human
agcuuauucuguuguuguuuuuguuuacuuucauaugaugaaaaugcuguguuuaaguguuugu

SEQ ID NO: 84027 - RNA, 64 nt, Human
aaaguguugguugguuuuaaaaucugguaacuccaugaugaaaagaaauuuauuuuauacgugu

SEQ ID NO: 84028 - RNA, 64 nt, Human
ucaaucaagaaugagaagcuugaaugggcaguagaugaugaagagaaaaaaaagucucccucag

SEQ ID NO: 84029 - RNA, 64 nt, Human
acggaagacuuucuuaaaacgcaaccugaauugaaugaugaaauguuguauguguguuugcuua

SEQ ID NO: 84030 - RNA, 64 nt, Human
ucauuaaacgagacugucaaucauuacucaaagaaugaugaagguauuugguguaugccaaaga

SEQ ID NO: 84031 - RNA, 64 nt, Human
cuuuauugaccaguacuugauaaucucucuguauaugaugaauacauuuuuacacacuaacauu

SEQ ID NO: 84032 - RNA, 64 nt, Human
aaaauaggaacugucaagaagguuuaugguauaaaugaugaaguugaagugauguuugaaagau

SEQ ID NO: 84033 - RNA, 64 nt, Human
cugaggucaggaguucaagaccagccuggccaacaugaugaaaccccgucucuacuaaaaauac

SEQ ID NO: 84034 - RNA, 64 nt, Human
aauauaucaaagaucaguugacaucuccuagggaaugaugaaaacagcaggcuauuagaaaauu

SEQ ID NO: 84035 - RNA, 64 nt, Human
caauccuuauguagaccagaagcugcaauauacaaugaugaaaaugaaacgaaaaggaaguccc

SEQ ID NO: 84036 - RNA, 64 nt, Human
auuggggcgaaugaaccaaguuucgccaugcuggaugaugaaauggauucccaucccaaagucu

SEQ ID NO: 84037 - RNA, 64 nt, Human
ccacaucccacccccucguccaaucccauaauccaugaugaaaggugaggucacguggccuccc

SEQ ID NO: 84038 - RNA, 64 nt, Human
ugggaaauuugcugagcccccaccagggaaccggaugaugaaacagggauaccucacagcuugg

SEQ ID NO: 84039 - RNA, 64 nt, Human
uucuaaauaaucagugacgggaagauggaagggcaugaugaacucugccauagaaaacuuccuc

SEQ ID NO: 84040 - RNA, 64 nt, Human
uggcaccuucuguugauuuuuuaagccacaugcuaugaugaauaaacugauuuauuuucuacca

SEQ ID NO: 84041 - RNA, 64 nt, Human
uguugucuguuuggugucuuuuugugcacagauuaugaugaagauuagauuguguuaucacucu

SEQ ID NO: 84042 - RNA, 64 nt, Human
uuuauucagugcaaguuuuuuggugcuguaguauaugaugaaagauguaaagcugaauaaagca

SEQ ID NO: 84043 - RNA, 64 nt, Human
gauuaauauuauuaauauaauaaugaugaugaugaugaugaaaacuaaggauuuuucaagagau

SEQ ID NO: 84044 - RNA, 64 nt, Human
acggcaggccccucucuugggaggggccuuuggaaugaugaaauuccaacccugcugcccgguc

SEQ ID NO: 84045 - RNA, 64 nt, Human
cuuaauugaaauuuugucuuugguuuccaacaccaugaugaagcucuugcuuuuuaaaaaguag

SEQ ID NO: 84046 - RNA, 64 nt, Human
cugaggucaggaguuccagaccagccuggccaacaugaugaaacccugucucuacuaaaaauac

SEQ ID NO: 84047 - RNA, 64 nt, Human
guuuuccuauucccuaccccucccacuacuuucaaugaugaaauacccuaaguuaaguucuccu

SEQ ID NO: 84048 - RNA, 64 nt, Human
uccacaguuauggccauauacacagagguaguauaugaugaagagaagauuacagucuuuacag

SEQ ID NO: 84049 - RNA, 64 nt, Human
uagaagacaguccuguaagaucgagcaaccagucaugaugaaaccaagugguggccggaucagu

SEQ ID NO: 84050 - RNA, 64 nt, Human
uaccaagcauugugcuaaauacuuuauaugcauuaugaugaaucuugugcgguuuucuuucuuu

SEQ ID NO: 84051 - RNA, 64 nt, Human
caauuaugucuauaauuuauauucuuuuguuuacaugaugaaacuuuuuguuguugcuuguuug

SEQ ID NO: 84052 - RNA, 64 nt, Human
agagauaaagcuuacuugacuuucaaauggagagaugaugaaaacccacucauucacucuuuca

SEQ ID NO: 84053 - RNA, 64 nt, Human
aucuucuaguaaaacuuacaugcaggacaacaaaaugaugaaagauauccaaauaccagauaau

SEQ ID NO: 84054 - RNA, 64 nt, Human
gugagaaauauuuucaguauucguaacacuguauaugaugaaaggcuucuauuuggaggaagaa

SEQ ID NO: 84055 - RNA, 64 nt, Human
cuauuaccuuugcuguuuuacuuauuuaaucuguaugaugaaaauacuguauaauagugugcac

SEQ ID NO: 84056 - RNA, 64 nt, Human
aaauaaucauucuuauuucaugaaaauuguggggaugaugaaauaaguuaacaccuuuaaagug

SEQ ID NO: 84057 - RNA, 64 nt, Human
gaaagggauuuuugaaggacagaacaauuacuccaugaugaaucuuccuuucucugccuucuga

SEQ ID NO: 84058 - RNA, 64 nt, Human
uuugagcucaaaccuugccuguuguuuucuaaucaugaugaauacuuucucaguuucuuuuucc

SEQ ID NO: 84059 - RNA, 64 nt, Human
ccagcacacaaggaagaccagauguagcuacaggaugaugaaacaugguuucaaacgaguucuu

SEQ ID NO: 84060 - RNA, 64 nt, Human
cacuggcagcauucaguggggaccccccaguggcaugaugaauggagaggauggcuggaccccu

SEQ ID NO: 84061 - RNA, 64 nt, Human
ugcuaccaaacagucauguauuaacucucuuuggaugaugaaguuuaaagagucaauaaauaga

SEQ ID NO: 84062 - RNA, 64 nt, Human
uauuaucuaccucacaagcuuaugaaaacuaaacaugaugaaucaaaagcacuuggcaugugag

SEQ ID NO: 84063 - RNA, 63 nt, Human
ugagauguuaauauucauacauguaauaaauagaaugaugaagaaacuuuguuuguacuucuu

SEQ ID NO: 84064 - RNA, 64 nt, Human
uuauuauuuucuauguuaacuuuuaaaaaucaaaaugaugaaaucccaaaacauuuugaaauua

SEQ ID NO: 84065 - RNA, 64 nt, Human
uagaugcuacagcuagcuaacuguaucccuagaaaugaugaauaauuugccauuuggacaguua

SEQ ID NO: 84066 - RNA, 64 nt, Human
auucccguccggugucacaguucagucagugaggaugaugaaguagauacagucuucaggacac

SEQ ID NO: 84067 - RNA, 64 nt, Human
cggcguaauacccauggcaacuggucuuccacauaugaugaaauagccucugagagguuaaguc

SEQ ID NO: 84068 - RNA, 64 nt, Human
gaauuuggcuuuuugaaaaacaagcauuucaaaaaugaugaaggaagugaaaguauccuggauc

SEQ ID NO: 84069 - RNA, 64 nt, Human
auuuuuaugccucacuuucuggagucacugggccaugaugaaucauaagucuucaguggccuag

SEQ ID NO: 84070 - RNA, 64 nt, Human
cauuuaaggcauacaaaaacauauaaagaauaccaugaugaaaaucuaugacuguauuaccaag

SEQ ID NO: 84071 - RNA, 64 nt, Human
ucgggcugagcagcugcagggagcccccuuucugaugaugaaacugaugcuugagccccgaccg

SEQ ID NO: 84072 - RNA, 64 nt, Human
uaacaaagggagccugcugaauaacaaaauuaaaaugaugaaacaaaaguuugacagugauauu

SEQ ID NO: 84073 - RNA, 64 nt, Human
acccugcuagaugucaucucuggauugcacauggaugaugaaggaacucagcauugaaaguugg

SEQ ID NO: 84074 - RNA, 64 nt, Human
aaggccgacaaagaugaucacuuuaagguggauaaugaugaaaaugagaccaguuaucuuuaag

SEQ ID NO: 84075 - RNA, 64 nt, Human
aaaguaaaacuugcugcugcugcugaugaugaugaugaugaagaugaugaugaugaugaugacg

SEQ ID NO: 84076 - RNA, 64 nt, Human
aaacucauuauaguaguuaauaucuaaguaaaauaugaugaaauuuaauagagaauucacuccu

SEQ ID NO: 84077 - RNA, 64 nt, Human
gcugaaauucaaauggcugugacaauuuaccgaaaugaugaaguaaccaccauucccaccuuuc

SEQ ID NO: 84078 - RNA, 64 nt, Human
caucaaauuguugguuauuguuuacaaucuagaaaugaugaagcucuuucacuaauuccuaaua

SEQ ID NO: 84079 - RNA, 64 nt, Human
cuaaugaauuaggcaggggagcuauuuuuugaagaugaugaacuaaauguugaagacaaguuug

SEQ ID NO: 84080 - RNA, 64 nt, Human
acuugugauuggggagguuuguggaaauucaauuaugaugaaaaaccuaucuuuuuuguaaugu

SEQ ID NO: 84081 - RNA, 64 nt, Human
agccagcccaggauccguccucauuuuauuggugaugaugaaugggaaugaaaucagggggcug

SEQ ID NO: 84082 - RNA, 64 nt, Human
aagagacacuuuccugcuggugguaucuauggaaaugaugaaguuacccaccacauuaaaacaa

SEQ ID NO: 84083 - RNA, 64 nt, Human
gccccaagaaguguuuggauaaccacacaaaagcaugaugaaaaggcuucuuguagucccauaa

SEQ ID NO: 84084 - RNA, 64 nt, Human
uguaauuuaaugaaaagguacaacagaauaaugcaugaugaacucaccuaauuaugagguggga

SEQ ID NO: 84085 - RNA, 64 nt, Human
uuugggcaaugugagagguaaaauagcccuugacaugaugaacaucacuuauuucagcacuugg

SEQ ID NO: 84086 - RNA, 64 nt, Human
ugcuccucucuggaugagacagauaccauacaccaugaugaaguucgccugcuuugaacguacu

SEQ ID NO: 84087 - RNA, 64 nt, Human
uugugaaaugauacggaugguauucacugcacauaugaugaaaucaucagaauuguuaaaacuu

SEQ ID NO: 84088 - RNA, 64 nt, Human
gcccagaagcuuggggcagagguccuagcaggagaugaugaauucucguggcucucggccuucu

SEQ ID NO: 84089 - RNA, 64 nt, Human
ccuuuuggauuauaaaaauaugggggaaagugcuaugaugaauuuuaugcaauaaauguauaca

SEQ ID NO: 84090 - RNA, 64 nt, Human
gaaucaggagucagcucugacaaugaagaugaugaugaugaagaagaugggaauuaccuucauc

SEQ ID NO: 84091 - RNA, 64 nt, Human
aaaaaucguguuaagcuagaugaugacagugaugaugaugaagaaagcaaagaaggccaagaaa

SEQ ID NO: 84092 - RNA, 64 nt, Human
aaauacaaaaauacauaaaaauacauaaaaucugaugaugaauauaaaaaaguaaccaaccuca

SEQ ID NO: 84093 - RNA, 64 nt, Human
auuuaugaaaauaauuacuggauuggauuaucauaugaugaaagggaaaguaaguggaaaugga

SEQ ID NO: 84094 - RNA, 64 nt, Human
ucccuuccuaagaugcaucucgcauaggcugccuaugaugaaggaccgugcaccuccacuccaa

SEQ ID NO: 84095 - RNA, 64 nt, Human
ugcacuuguaaaacaggauuuucuaggugaauucaugaugaauaccagauuuacuauguauaug

SEQ ID NO: 84096 - RNA, 64 nt, Human
cauuucuacccagguuuugcuagagcagugugagaugaugaagguguauuuuugcugcuuuacg

SEQ ID NO: 84097 - RNA, 64 nt, Human
cugaggucaggaguucgagcccagccugaccaauaugaugaaaccccgucucuacuaaaaauac

SEQ ID NO: 84098 - RNA, 64 nt, Human
guacuguuccucuuucacagcuggaauaugucacaugaugaaguuguauagaaacagaaccaug

SEQ ID NO: 84099 - RNA, 64 nt, Human
aggagaguguuuaaauaaauuacaguaugucuauaugaugaaauguuauuuugccauuaaaauu

SEQ ID NO: 84100 - RNA, 64 nt, Human
gcauuugagauaggguuggaauauaguacucuagaugaugaauguguuugcuuuguguuuggua

SEQ ID NO: 84101 - RNA, 64 nt, Human
aauaaguuucuuccugagaagaaugauacuguuuaugaugaauccauagugaaaagacagugac

SEQ ID NO: 84102 - RNA, 64 nt, Human
uuccauccauagcauauuuccagaauaucccuagaugaugaauuuaaacaugccuucucagaaa

SEQ ID NO: 84103 - RNA, 64 nt, Human
cacuuucaaacuguguauuuucuuacaauaaaaaaugaugaaaaaaaaaaaggcuuuacuucuu

SEQ ID NO: 84104 - RNA, 64 nt, Human
gagaugauguuugcauuucuguuaugacagagagaugaugaaaguaggcagggcuguguuccuu

SEQ ID NO: 84105 - RNA, 64 nt, Human
ugugaaugguaugaacuuuuaaaccauauuauugaugaugaaaauuauuuccugggaacucagu

SEQ ID NO: 84106 - RNA, 64 nt, Human
ugccaaaaguuuguuuauauucagaagucugacuaugaugaauaaaucuuaaaugcuuuguuua

SEQ ID NO: 84107 - RNA, 64 nt, Human
ucauguuguuaaaauuaugaaucugauuuuuaugaugaugaaaauuuuaccagcagaaggauuu

SEQ ID NO: 84108 - RNA, 64 nt, Human
ggcccugacauaagcugucuggccucucugugacaugaugaaauugaaaucaauccacagucca

SEQ ID NO: 84109 - RNA, 64 nt, Human
auauauagauaaaauuauauauuacuuguaagguaugaugaauaacaacacuuaaaaacucauc

SEQ ID NO: 84110 - RNA, 64 nt, Human
auuuaauauauaaugguugacaugauacauguacaugaugaaugaccagaugcuuauggucuac

SEQ ID NO: 84111 - RNA, 57 nt, Human
acaugaugcccacuugguaaaaacugcaugaugaauagcaccuuaauuucaagcaaa

SEQ ID NO: 84112 - RNA, 64 nt, Human
agguuuuaguuguggacacaguggucccuccuuaaugaugaagaucacugccuugggcuucaug

SEQ ID NO: 84113 - RNA, 64 nt, Human
uauuuucaaauacuugugauuaauaaggcauucuaugaugaaauagccauggcuuauauauuuu

SEQ ID NO: 84114 - RNA, 64 nt, Human
uuuucuguaaucaagcagcuugcauagaaauuguaugaugaaauuuuacauagguucuuggugc

SEQ ID NO: 84115 - RNA, 64 nt, Human
cuuccuuaauauuugcuucuagcugcucuuggcaaugaugaauuguuauguaugcauuaauguu

SEQ ID NO: 84116 - RNA, 64 nt, Human
uaggcauacaaggaguaugauuuaacaguaugacaugaugaaaaaaauacaguuguuuuugaaa

SEQ ID NO: 84117 - RNA, 64 nt, Human
agcuucuccucucucaccccguaaacugacaagcaugaugaaaaaagaagcacauccaaguuuc

SEQ ID NO: 84118 - RNA, 64 nt, Human
gauggucccauuauucuagggucuuacucuuuguaugaugaaaagaauguguuaugaaucggug

SEQ ID NO: 84119 - RNA, 64 nt, Human
aaggcuugcauuucccucccuguuucaguaaaagaugaugaaagccacuaucaauccucacugc

SEQ ID NO: 84120 - RNA, 64 nt, Human
ugcaaccauugugguauucacuuuccucauguuuaugaugaauauuuugcacuuuuuuaguacu

SEQ ID NO: 84121 - RNA, 64 nt, Human
uuuacauuuuagauuguacuugucuuuauuuaaaaugaugaaucuagucugaaucagcuguuau

SEQ ID NO: 84122 - RNA, 64 nt, Human
uugucuuaaugcauuuauugagaacagcauugagaugaugaacaagggguuagcaauagcaaac

SEQ ID NO: 84123 - RNA, 64 nt, Human
uacuaguccaaaaaaugucauaaacugaacuaaaaugaugaacuauuuuauguagacauuagga

SEQ ID NO: 84124 - RNA, 64 nt, Human
ugucggucuugcaaagcgacagauucauaaaguaaugaugaaaucuuucuuucuucccgugugu

SEQ ID NO: 84125 - RNA, 64 nt, Human
aagaacaaagagccugagaaagcagcaagaggacaugaugaaaaauacguggaguugaugagaa

SEQ ID NO: 84126 - RNA, 64 nt, Human
uuugucucagaggacuuugaugcuucaauauuuaaugaugaauccgccacacuccauuuucccu

SEQ ID NO: 84127 - RNA, 64 nt, Human
aacauaacuguagccucacuaauggaaaaguaguaugaugaacaaucauucccaaugguguaca

SEQ ID NO: 84128 - RNA, 64 nt, Human
ggaggccucgugggucugguagauuauccugaugaugaugaagaugaugaugaggaugaagaua

SEQ ID NO: 84129 - RNA, 64 nt, Human
uugacaauuuuuagguauguacugaccuacauuuaugaugaagauccugagcggagguuaagau

SEQ ID NO: 84130 - RNA, 64 nt, Human
auuuugugcaguauuuaugugauugugccuaugcaugaugaaugaaugaauuucaguuguacau

SEQ ID NO: 84131 - RNA, 64 nt, Human
cugaagucaggaguuugagaccagccugaccaacaugaugaaaccucgauucuacuaaaaauac

SEQ ID NO: 84132 - RNA, 64 nt, Human
gaggaauagaaucgaggcuccuuugaccaucaaaaugaugaacuuuacuuaugugguacccaau

SEQ ID NO: 84133 - RNA, 64 nt, Human
ccacaguaaauuaaucuuccuucuguuuuguauuaugaugaacgguugcuauuauaucaagaua

SEQ ID NO: 84134 - RNA, 64 nt, Human
aaaucaauuuuaauuuaguuuaauugaaugauuuaugaugaaucuugggcaaaaaaauacaacu

SEQ ID NO: 84135 - RNA, 64 nt, Human
aaaaacguacgcaagaggacauggauccaaaaugaugaugaagcaucucccauggggaggugau

SEQ ID NO: 84136 - RNA, 64 nt, Human
cagaccuuacaacugugauaaaacuugaauguguaugaugaauaaggccauucaguuaacuuua

SEQ ID NO: 84137 - RNA, 64 nt, Human
ggugcggggcagcguggccccaccggacuagcacaugaugaauguaaaguuggcacaaugaaaa

SEQ ID NO: 84138 - RNA, 64 nt, Human
guauacucacuuaucucauccauggauguaaaugaugaugaaucaacauaguaacugaaaugaa

SEQ ID NO: 84139 - RNA, 64 nt, Human; identical to SEQ ID NO: 84130

SEQ ID NO: 84140 - RNA, 64 nt, Human
acuuugugcaauauuucugugauugugccuaugcaugaugaaugaaugcauuucaaucauacau

SEQ ID NO: 84141 - RNA, 64 nt, Human
uugggccaaugagaaaagaaccacacuggagaucaugaugaacuuuuggcugaaccucaucacu

SEQ ID NO: 84142 - RNA, 64 nt, Human
aguucucuuuuauuucuaguuuauugaguguuuuaugaugaaacgguguuagguuuugucaagu

SEQ ID NO: 84143 - RNA, 64 nt, Human
uuauuuauuuuucccaauugcccugagcaguacaaugaugaacacacguuucaagagcagacau

SEQ ID NO: 84144 - RNA, 64 nt, Human
augcaucacuuacauagguauuucucccacagaaaugaugaaagugaccagaaaaaaacaaaaa

SEQ ID NO: 84145 - RNA, 64 nt, Human
ggugaucccucuaagaaagaaaugaagaaagaaaaugaugaaaagaguaguucaagaaguucug

SEQ ID NO: 84146 - RNA, 64 nt, Human
acccauuuugacaguuuuuauauacuccuuuaaaaugaugaauguuacagguuaauaaaguuaa

SEQ ID NO: 84147 - RNA, 53 nt, Human
cgaacccaauggcaaagugaaguaugaugaauuuauccacaagaucacccuuc

SEQ ID NO: 84148 - RNA, 64 nt, Human
uucuuaaaguaggaaaaaaugaacaguaauaauuaugaugaagaugauaguagugcuaugggau

SEQ ID NO: 84149 - RNA, 64 nt, Human
cccacaugaguacauauuggccagcggcuccgagaugaugaacuccggggucugagagugggca

SEQ ID NO: 84150 - RNA, 64 nt, Human
uuuuuggucugacccacugcuuuuggucugugugaugaugaaaugaggucagagccugcaguua

SEQ ID NO: 84151 - RNA, 64 nt, Human
agcgcugaugcccaauaaagaugcccacugaggaaugaugaagcuuccuuucuggauucauuua

SEQ ID NO: 84152 - RNA, 64 nt, Human
guucccugaggugccaggcaggcaacuuuagcacaugaugaaaacagacuuccaccucaguggc

SEQ ID NO: 84153 - RNA, 64 nt, Human
uuaacucauguacagccucauccuguauaguuuaaugaugaaugugcaggggaccugucucagg

SEQ ID NO: 84154 - RNA, 64 nt, Human
uugagcucaggcguucgggaccagccuggccaacaugaugaaaccccgucucuaccaaaaauag

SEQ ID NO: 84155 - RNA, 64 nt, Human
uacucuguccuaagaaucuuuuuaaaacuauaucaugaugaauugaaaugaagauaaaauugcu

SEQ ID NO: 84156 - RNA, 64 nt, Human
cugaggucaggaguuugagaccagccuggccaacaugaugaaauguugucucuacugaaaaugc

SEQ ID NO: 84157 - RNA, 64 nt, Human
auuugucaugcuguagcauuuguaagauuuguaaaugaugaaauucaaagaaaacuuuuucuau

SEQ ID NO: 84158 - RNA, 64 nt, Human
uacuuggagcucuuugugacacaccaugucagucaugaugaaucggccaacagccagcccuugc

SEQ ID NO: 84159 - RNA, 64 nt, Human
gaagaagauguccgugagaacaucauuacuuaugaugaugaaggggguggggaagaagacacag

SEQ ID NO: 84160 - RNA, 64 nt, Human
cccucuuguggugcauugaaagaagagaugagaaaugaugaaaagguugccugaaaaaugggag

SEQ ID NO: 84161 - RNA, 64 nt, Human
aaacuaccuaucugguacuaugcuuuuuaucuggaugaugaaauaaucuguacaacaaacccug

SEQ ID NO: 84162 - RNA, 64 nt, Human
cugaggucagcaguuugagacuagccuggcaaacaugaugaaacccugucucuacuaaaaauac

SEQ ID NO: 84163 - RNA, 64 nt, Human
aagauggugcauuaguguggcacauuuguuacaaaugaugaaccaauauuaauuuauuauuaau

SEQ ID NO: 84164 - RNA, 64 nt, Human
cccucccuggccaugccuucuugccuuuggaaaaaugaugaagaaaaccuuggcuccuuccuug

SEQ ID NO: 84165 - RNA, 59 nt, Human
auaacuauuuucccaacugagcagaugacaugaugaaaggaacagaaacaguguuauua

SEQ ID NO: 84166 - RNA, 64 nt, Human
ucuauggagaacguugccuuauacucuacuucagaugaugaacacuguguacugugugugcuuu

SEQ ID NO: 84167 - RNA, 64 nt, Human
cugacggcuucugucuccaugaaucauuaucagcaugaugaaaggugugucuaaaaaacaauuc

SEQ ID NO: 84168 - RNA, 64 nt, Human
uucccugagacuuuucaggagagccagcccacagaugaugaagaaaugauggaaguucauuugg

SEQ ID NO: 84169 - RNA, 64 nt, Human
uugaggucaggaguucgagaccagccuggccaacaugaugaaaccccaucucuacuaaaaauac

SEQ ID NO: 84170 - RNA, 64 nt, Human
ggaguuggucugagugacaaggaauugguuucagaugaugaagaaagaggaacgggcuuggaag

SEQ ID NO: 84171 - RNA, 64 nt, Human
ggggcuagggauaugcucuggggcuuucaugggaaugaugaagaugauaaugagaaaaauguua

SEQ ID NO: 84172 - RNA, 64 nt, Human
ugggauuacagguguaugccaccacgccuggcuuaugaugaauauuucugagugggauguuugg

SEQ ID NO: 84173 - RNA, 64 nt, Human
cucuauuuuuagaagaaauauguuacacucagaaaugaugaaaccaaaucuuauauuaaaaggc

SEQ ID NO: 84174 - RNA, 64 nt, Human
auuuccuucuuucuucuggcuuuggaaaaaucucaugaugaaaauucauauuugccaacuuugu

SEQ ID NO: 84175 - RNA, 64 nt, Human
uagcuuucaguguauguuuaauaauauacauuuaaugaugaaaaauauuuucagcaaagcuuua

SEQ ID NO: 84176 - RNA, 64 nt, Human
acauauuucuuuugcuuucuuaaaacagcuuaaaaugaugaacuuuuauaauuuuaauuugaag

SEQ ID NO: 84177 - RNA, 64 nt, Human
aaguuuuugaacuaaaauuuuucuuuuucuuuuuaugaugaauaagguuaaaauaaaagccuua

SEQ ID NO: 84178 - RNA, 64 nt, Human
uuuuugaaagaugauggagacccaccacuacuauaugaugaauagcacuaauacccacugcuuc

SEQ ID NO: 84179 - RNA, 64 nt, Human
auuccuuauucccaggcaagcuauagucagacagaugaugaaaguaacaugaaaacuggugaug

SEQ ID NO: 84180 - RNA, 64 nt, Human
aagaauuucuucuuucccucaguaggaauauagaaugaugaauuuuauuagacaacuuuauuuu

SEQ ID NO: 84181 - RNA, 64 nt, Human
acuauguauuuuaaaauaugaucauggacacacaaugaugaauuuuuuggccauuuacauagac

SEQ ID NO: 84182 - RNA, 64 nt, Human
uuuuuuuccccaaguauuaaacucuaauguaccaaugaugaauuuaucagcguauuucaggguc

SEQ ID NO: 84183 - RNA, 64 nt, Human
gaaacuuugcucuuuuaauaauuauguucagccuaugaugaaguauuugauuauuagacagcaa

SEQ ID NO: 84184 - RNA, 64 nt, Human
caggaaagugguaugaaucauaucgucuaaguauaugaugaaucuuuaaagggugucucugugu

SEQ ID NO: 84185 - RNA, 64 nt, Human
aguuuggcaaaguguacuuucuuaauuucuauuuaugaugaaguauagucauaauuuauuugua

SEQ ID NO: 84186 - RNA, 64 nt, Human
ggagcuggggcaggccccauccugggcauuggagaugaugaaaccgagcagaccuggcccaugu

SEQ ID NO: 84187 - RNA, 64 nt, Human
cugaggucaggaguucaagacuggccugaucaauaugaugaaaccccugucucuacuaaaacua

SEQ ID NO: 84188 - RNA, 64 nt, Human
ccucgaagagccuggccagagagggaagacacagaugaugaagcuggagccagggcugccgguc

SEQ ID NO: 84189 - RNA, 64 nt, Human
uauaagaguuuguucacacacuuucaaaacacuaaugaugaacaugucaaaauugaugaccacu

SEQ ID NO: 84190 - RNA, 64 nt, Human
uauuuuugucaauuucaugauaugguuuuuaaucaugaugaauugccuggggucuguaagaaug

SEQ ID NO: 84191 - RNA, 64 nt, Human
cccaggguucaggcguguuuucugugaauguuggaugaugaauuuuugucucuucugguggagc

SEQ ID NO: 84192 - RNA, 64 nt, Human
ugccauucuggacauaagugcuggaaaagacuuaaugaugaacaccccaaagcaauugcaacaa

SEQ ID NO: 84193 - RNA, 64 nt, Human
uuuggacugaacaaugacccccaaaauucguaugaugaugaagcucucucuaaauauuuucuug

SEQ ID NO: 84194 - RNA, 64 nt, Human
uuuggaagaguaaggacauuaaaauguaacaugcaugaugaaaaucuaaguggagaugguauuu

SEQ ID NO: 84195 - RNA, 64 nt, Human
uuugcuaugaaaaagacauuaaaauaugagauguaugaugaaaaucuaagugaagagacuuuua

SEQ ID NO: 84196 - RNA, 64 nt, Human
cagaaauauuuuuaaaaaauuagagugaagaaaaaugaugaacauauuguaaugaugcuucugu

SEQ ID NO: 84197 - RNA, 64 nt, Human
ucuugugauccuccuuauugauuuuucccucacgaugaugaacaauuaucucccguuacucacc

SEQ ID NO: 84198 - RNA, 64 nt, Human
aagaccagaauauaaaaagcaaaauuuuaaaacuaugaugaaaguagaauccguuacuuuaggg

SEQ ID NO: 84199 - RNA, 64 nt, Human
acggggucaggagaucgagaccauccuggccaacaugaugaaacccuaucucuacuaaaaauac

SEQ ID NO: 84200 - RNA, 64 nt, Human
agucuuuauauuuuuccagagaaaauuaaauguuaugaugaauguuacauuuggauaauuuauu

SEQ ID NO: 84201 - RNA, 64 nt, Human
ucaacagcucaugaaggcaugaaauguggugaaaaugaugaauauuugagugcuuuuucuuaau

SEQ ID NO: 84202 - RNA, 64 nt, Human
gucugaauuagagagcacuuggaaagggcagaggaugaugaacuaugaugucacucaucauccu

SEQ ID NO: 84203 - RNA, 64 nt, Human
acauccaggcagugaaagaagaaaguaacagaaaaugaugaaauaaagagaccaucuuacaaua

SEQ ID NO: 84204 - RNA, 64 nt, Human
cuucaucucaggcaaccacaggugacaguuaaacaugaugaaaccgcaugcuauggcuuucuag

SEQ ID NO: 84205 - RNA, 64 nt, Human
ucacucuugccauuaccuacaucuauuagcauagaugaugaaaagcuguuacuggugauuauag

SEQ ID NO: 84206 - RNA, 64 nt, Human
cuacuaccucauaggguuguccuggggauccaguaugaugaagugcgccaggggcuuggcaugg

SEQ ID NO: 84207 - RNA, 64 nt, Human
ggucuaccuugcagagccauugugagcauuggaaaugaugaaugaaucauaccagaacgucuag

SEQ ID NO: 84208 - RNA, 64 nt, Human
agcaagaauugaggaagaauggugugggagagggaugaugaagagagagagggccugcuggaga

SEQ ID NO: 84209 - RNA, 64 nt, Human
acugaaauccagagagggucaggaauuuggccccaugaugaagccaaaucugaacccauguccu

SEQ ID NO: 84210 - RNA, 64 nt, Human
cugcugcugaccgaaccucagccucucagacuugaugaugaaguaggugguccugaaaguuaac

SEQ ID NO: 84211 - RNA, 64 nt, Human
uuaauacugagugcaaaaggucacccaaauuccuaugaugaaauuuuaaauuaaugggcaccuu

SEQ ID NO: 84212 - RNA, 64 nt, Human
guuugaguucgagccaaccaccucuguugguuagaugaugaauaaaaagguucugaagaaaagg

SEQ ID NO: 84213 - RNA, 64 nt, Human
ccacauccugucuuagccgcagucuccagaacccaugaugaacugugaucugccgugguccugc

SEQ ID NO: 84214 - RNA, 64 nt, Human
aagaaaacgaaaagaagaaacaaaagaaagcaucaugaugaauaaaaugucuuugcuuguaauu

SEQ ID NO: 84215 - RNA, 64 nt, Human
caacaaauagacuauugucauuuuauuaguaccaaugaugaaauuucaccaaacuauuaaucaa

SEQ ID NO: 84216 - RNA, 64 nt, Human
uccgggcaagugaaugucauuuuaaucaauaucaaugaugaaaauaaagccaaauuugaaguaa

SEQ ID NO: 84217 - RNA, 64 nt, Human
ccaacagggaauucuaaacaacuaaaaacuccagaugaugaaugcacaacauaaugaugguuaa

SEQ ID NO: 84218 - RNA, 64 nt, Human
ucagacaaaccuuggaaaucaagaaaguucuggaaugaugaagcuguucaugccaagaccgaaa

SEQ ID NO: 84219 - RNA, 64 nt, Human
gacgcuggggcccaagaucaucauugugaagcggaugaugaaggacgucuucuucuuccucuuc

SEQ ID NO: 84220 - RNA, 64 nt, Human
uaggugucuacugcagauauuucaucaaauaaggaugaugaagaaaacucuaugcacacuacgg

SEQ ID NO: 84221 - RNA, 64 nt, Human
aagauggcagaucaccuugaaggccuuuccagugaugaugaagaaacuucuacagauauuacua

SEQ ID NO: 84222 - RNA, 64 nt, Human
cuuuuccucaagggagcaacguuagcuuuccugaaugaugaaguuuggaauuugucaaauguac

SEQ ID NO: 84223 - RNA, 64 nt, Human
acuauucccuugcaagugagauuauauaguaaagaugaugaaccagcuguaaaacuacaacuac

SEQ ID NO: 84224 - RNA, 64 nt, Human
uuuguagauuacuuuugggggauauauuuugagaaugaugaaacggaauaaaauuguaaaaaau

SEQ ID NO: 84225 - RNA, 64 nt, Human
gcuuaauuuucucaaagccugaccuuucaaauccaugaugaaugccaucagucccuccugcugu

SEQ ID NO: 84226 - RNA, 64 nt, Human
aauucacugaagacacaggucccacagggagcggaugaugaagcagacccccuccugucaucac

SEQ ID NO: 84227 - RNA, 64 nt, Human
uauaaguguguacaagcauucaagaaacugaugaaugaugaaugaaugaaugagccaaagaaca

SEQ ID NO: 84228 - RNA, 64 nt, Human
ugcuuaaauuucuacaguauguaaaagugaaaaaaugaugaagacgggugcaccugucugaguu

SEQ ID NO: 84229 - RNA, 64 nt, Human
aagccauacaugaacuuuuauuuacuuuguguguaugaugaacagaugucuccuuucuucucuc

SEQ ID NO: 84230 - RNA, 64 nt, Human
uaguauuuagcauuuauuaacagguacucuaagaaugaugaagcauuguuuuuaaucuuaagac

SEQ ID NO: 84231 - RNA, 64 nt, Human
gaaccaacugacauucuaucguguuguacauagaaugaugaaggguuccacuguuguuguaugu

SEQ ID NO: 84232 - RNA, 64 nt, Human
uuuuuggcaaacauacauaauguuacaucauacuaugaugaacauccauguacuuuucacucaa

SEQ ID NO: 84233 - RNA, 64 nt, Human
aaaaaagagcuggcuggccuaaaaaccuaaauauaugaugaagauuguaggacugucuucccaa

SEQ ID NO: 84234 - RNA, 64 nt, Human
uccacacccugcuugcuccuguguaacagcucagaugaugaauaauaauaaaacuguacuuuuu

SEQ ID NO: 84235 - RNA, 64 nt, Human
augcauuauuuuuauuuacaacauuugcuccuuaaugaugaauuuaucuguguuacccuguuuu

SEQ ID NO: 84236 - RNA, 64 nt, Human
cccagugguguuucuuaagguucuaucuugugccaugaugaauaaaaaguuaagcaaaggcuuu

SEQ ID NO: 84237 - RNA, 64 nt, Human
ucucagcuucagguucuucaccucuaagauggggaugaugaaaacaguaccugucaugcagaau

SEQ ID NO: 84238 - RNA, 64 nt, Human
uuccuggagcuucggaagaaaugaaaauggaaacaugaugaagauauagucacugaaucaauga

SEQ ID NO: 84239 - RNA, 64 nt, Human
gaauuuccuaguuaaauaaaauuaguugcaguauaugaugaacaguguaugacucaaacagcug

SEQ ID NO: 84240 - RNA, 64 nt, Human
cuucuaggaauguacauacucacacauguacaaaaugaugaacauacaguauucauuaaugcag

SEQ ID NO: 84241 - RNA, 64 nt, Human
uugguggauccacgccccucucccccacuuucccaugaugaaauaucacuaauaaauccuguau

SEQ ID NO: 84242 - RNA, 64 nt, Human
acuaauguauuugugcacaagacaucaucuaugaaugaugaaguuuucucaccuucaaagucuu

SEQ ID NO: 84243 - RNA, 64 nt, Human
cccccaccuucaacaauauuucaacgcuucugcaaugaugaaaaagaaacauaguuguaguacu

SEQ ID NO: 84244 - RNA, 64 nt, Human
cacacagauuugacuuucucuagagagcugacuaaugaugaacggaagcaaauacaucagauug

SEQ ID NO: 84245 - RNA, 64 nt, Human
uguaaucuuacuucauacagaggacauuuauuuaaugaugaaagugccuuuuguugacuucuaa

SEQ ID NO: 84246 - RNA, 64 nt, Human
cauauuuacacacacaaccacaaauuuuaaacuuaugaugaaaauuuacaauaaccugaaagau

SEQ ID NO: 84247 - RNA, 64 nt, Human
cugaggucaggaguuugagaccagccuggccaacaugaugaaacccuugucucuauuaaaaaca

SEQ ID NO: 84248 - RNA, 64 nt, Human
accuuuuauguaguaauugacaugugccagggcaaugaugaaugagaaucuacccccagaucca

SEQ ID NO: 84249 - RNA, 63 nt, Human
cagaauaagagcgcaccagcuaacaaugugauacggccauaugucacuuaaggauggagauau

SEQ ID NO: 84250 - RNA, 63 nt, Human
ggaagcagaucagcugauguagaacagagaccucggccauaaaggugagaagacauagggauu

SEQ ID NO: 84251 - RNA, 63 nt, Human
agggaaggagaggggccagggaggccacaggcccggccauaugagcaucaugggucauuacgg

SEQ ID NO: 84252 - RNA, 63 nt, Human
agugcugggauuacaggcgugagucacagcccccggccauaauuuagcacuuuaaaaaauaau

SEQ ID NO: 84253 - RNA, 63 nt, Human
uccaagucccgggucucaacuuuaagauagaggcggccauaagaggugaucucugggaguuau

SEQ ID NO: 84254 - RNA, 63 nt, Human
aacuguaaacaaagacaaccauuucuacuacgucggccauaaacagcuauccugcuuuggaag

SEQ ID NO: 84255 - RNA, 63 nt, Human
auguaaguuuugagaaauacgagucugucagagcggccauaagccauaaagagucaaucucuu

SEQ ID NO: 84256 - RNA, 63 nt, Human
aagccagaagugacucccacugcuucuguugaucggccauagggcuuccauggguggaaacuu

SEQ ID NO: 84257 - RNA, 63 nt, Human
agugcugggauuacaagcaugagccacugcgcccggccauaaaugaauuauuuuuaagaggca

SEQ ID NO: 84258 - RNA, 63 nt, Human
aaccccgucucuauugggaguacaaaaauuagccggccauaguggcucgugccuguaaucuca

SEQ ID NO: 84259 - RNA, 63 nt, Human
gugugaauaggaauacuguuuaaugaaacuccacggccauaacaauauuuaacuuuaaaagcu

SEQ ID NO: 84260 - RNA, 63 nt, Human
gugcuucccuuccauuaagcugaaauugccccacggccauauccacccauugacucugccuuc

SEQ ID NO: 84261 - RNA, 63 nt, Human
cgugugcauggacgugccugagggguccgggcacggccauacgcaggaccccugugcccgggg

SEQ ID NO: 84262 - RNA, 63 nt, Human
gccaucccugagcacccugccaccaggugaccucggccauacucacugccccccuugggcacc

SEQ ID NO: 84263 - RNA, 63 nt, Human
uggacaccccauuuccuucaccagguccccccacggccauagcccuugcagccaaacuuugcc

SEQ ID NO: 84264 - RNA, 63 nt, Human
agcuggcaggccugagguguacauaguccuucccggccauauuaaccacacagccugagccug

SEQ ID NO: 84265 - RNA, 63 nt, Human
ucagcaggagcugggguggccccugagcuccaacggccauaacagcucugacucccacgugag

SEQ ID NO: 84266 - RNA, 63 nt, Human
gcucaacucuaccccugcucccauuccucccuccggccauacugccuuugcaguuggacucuc

SEQ ID NO: 84267 - RNA, 63 nt, Human
agugcugggauuacaagggugagccaccaugcccggccauaaaugauuuuauucauuuuuaug

SEQ ID NO: 84268 - RNA, 63 nt, Human
agugcugggauuauaggcaugaaccaccguguccggccauauauuuucgucuuuugaagacug

SEQ ID NO: 84269 - RNA, 62 nt, Human
gccgccagugguccaaggagggagacagagggucgucccaacagggggagguagggcuuuga

SEQ ID NO: 84270 - RNA, 62 nt, Human
caggggauggggugggguaccggauuucgguaucgucccagacccaagugagucacgcuucc

SEQ ID NO: 84271 - RNA, 62 nt, Human
aaugugcuuuuuuuguauaaagugcaaacauuucgucccaaagucuaaguacuuuagugcag

SEQ ID NO: 84272 - RNA, 62 nt, Human
cgugcagacgaccuugguucacuuuucaggggucgucccaacucuguaucuccagccacucc

SEQ ID NO: 84273 - RNA, 62 nt, Human
cagcuuugcgugugcccagccgugugcacagcucgucccaacuccugcggguggcaccugcc

SEQ ID NO: 84274 - RNA, 62 nt, Human
ccuggcgccaggaaggagcauguguuagcgucucgucccaccuggaauuguaauaaauacau

SEQ ID NO: 84275 - RNA, 62 nt, Human
gaaaaucuuuuuuaguuauuuguuuguuuacuucgucccaugugcuaacuaucuuauauaua

SEQ ID NO: 84276 - RNA, 62 nt, Human
uugcaaauggcuucagaggucaccaaguucagucgucccaaaacauggguguguuucaaaau

SEQ ID NO: 84277 - RNA, 62 nt, Human
ggccaucagggcuaaccacuucacaccuaccaucgucccauggggauccaagaccugagaua

SEQ ID NO: 84278 - RNA, 62 nt, Human
cucagccuggcagauguggaaacucaaauuucucgucccacuccagguuuuggcuagccaac

SEQ ID NO: 84279 - RNA, 62 nt, Human
aguucuuugggcugggucaaggcaaagcucagucgucccagcagcaccucagccaucuguag

SEQ ID NO: 84280 - RNA, 62 nt, Human
ccucagauuccacaaagccucucuccccucccucgucccacccccacccaggcaggaagccc

SEQ ID NO: 84281 - RNA, 62 nt, Human
cagcuggcaccugccucuaucccagacugcccucgucccagcucucuguccaacuguugauu

SEQ ID NO: 84282 - RNA, 62 nt, Human
cgcugcaguuccuuuaugaagaggcuuuucugucgucccaggcuagcagagauggauagcuu

SEQ ID NO: 84283 - RNA, 62 nt, Human
ucuccagccuggcucuaucuuccuccuugugaucgucccauccccacaucccgugcaccccc

SEQ ID NO: 84284 - RNA, 62 nt, Human
cacaggccuccagcugggccaugucagucucaucgucccaaggcuugaaauccagcaggaug

SEQ ID NO: 84285 - RNA, 62 nt, Human
gucuagggguucugccuggucaacguuauuugucgucccaucuuuuggcagcaaaaccaccu

SEQ ID NO: 84286 - RNA, 62 nt, Human
ccagccaugcggccaccccuuagcacaccugcucgucccauuuagcuuacccucccaguugg

SEQ ID NO: 84287 - RNA, 62 nt, Human
aggcugcaggagggcacuggagcugggaggucucgucccagcccuccccaucucggggcugc

SEQ ID NO: 84288 - RNA, 62 nt, Human
gcacccuggccacccugguccuuggauccccuucgucccaccugguccaccccagaugcuga

SEQ ID NO: 84289 - RNA, 62 nt, Human
ugaaagcauuucuuaugguucccugagucaguucgucccacacauccucccugaggcaccug

SEQ ID NO: 84290 - RNA, 62 nt, Human
ugccuuccugaaggugaccaagcuuccaaagcucgucccacuggccucuguacauuucccug

SEQ ID NO: 84291 - RNA, 62 nt, Human
ccgcccgccgggcucugcguccccacguccccucgucccauccccacguccccucaucccgu

SEQ ID NO: 84292 - RNA, 62 nt, Human
ccugacuggggcuugcgacucacaggauugcaucgucccagcugcuaacuuggggccggggc

SEQ ID NO: 84293 - RNA, 62 nt, Human
ccuggugacagguggcaccugucccacagcccucgucccauguggaacuuaccauugggauu

SEQ ID NO: 84294 - RNA, 62 nt, Human
gugcuggacugcaggcugcagugaucccucuuucgucccacccccucuucccucagcagccc

SEQ ID NO: 84295 - RNA, 62 nt, Human
ccagucagccgaggauguaguuguugcugccgucgucccaccaccucagggaccagagggcu

SEQ ID NO: 84296 - RNA, 62 nt, Human
auuuuucucuuuccuacuccuauuaaagaaccucgucccaguguuuccugcuuaagccuggu

SEQ ID NO: 84297 - RNA, 62 nt, Human
auugaauacugacaagagaauacccauacaaaucgucccaccgcccuagaggccacagaauu

SEQ ID NO: 84298 - RNA, 62 nt, Human
ucucuccaaccagggcagaaaggagggaggauucgucccauuacaauaaugaaauaaugaua

SEQ ID NO: 84299 - RNA, 62 nt, Human
cuuuuacuguuauagaauagccugagguccccucgucccauccagcuaccaccacggccacc

SEQ ID NO: 84300 - RNA, 62 nt, Human
aaaaauuagccgggugugguggugggcaccugucgucccagcuacuagggaggcugaggcag

SEQ ID NO: 84301 - RNA, 62 nt, Human
ugagacaggcacuggcugaagacaggcaacucucgucccaaccaucauucacccugagugac

SEQ ID NO: 84302 - RNA, 62 nt, Human
gaucuccagccucccagaagccugcugugcuuucgucccacagcuuucugcccauuguuucu

SEQ ID NO: 84303 - RNA, 62 nt, Human
agguucacugaggggcccuggucuccccgcagucgucccaggcugccggcuccccucgacag

SEQ ID NO: 84304 - RNA, 62 nt, Human
aggcucuagagagagggagaaacaaguggaccucgucccaucuucacucuucacuugaguug

SEQ ID NO: 84305 - RNA, 62 nt, Human
uccuggcuucauuuuuugcugaugguucccccucgucccaaaucucucucccaguacaccag

SEQ ID NO: 84306 - RNA, 62 nt, Human
gccgaugcucuggcccuccccaauacgcugcuucgucccacugcaccgccuggcugagggcg

SEQ ID NO: 84307 - RNA, 62 nt, Human
gugccgaccuuggguggcggggccugggucucucgucccacccggagggcacagacaccggc

SEQ ID NO: 84308 - RNA, 62 nt, Human
ccauggaccucuuuuguuuguauguuguauugucgucccaacggaaggagagcuccugacuc

SEQ ID NO: 84309 - RNA, 62 nt, Human
agcaaaggucuucuucccucgccccuucuccaucgucccaggaaucccagggggcagcacag

SEQ ID NO: 84310 - RNA, 62 nt, Human
cguaggaaaaagucggaaugcucucgacggccucgucccagccugggacaggcccccuuucc

SEQ ID NO: 84311 - RNA, 62 nt, Human
gcaucagggugagguccgggacucuugggucaucgucccacaguggcugaucggcugccaag

SEQ ID NO: 84312 - RNA, 62 nt, Human
guuuuugcgaaccccagaagagaccaaaggagucgucccaggcuccucgcgccucaggugga

SEQ ID NO: 84313 - RNA, 62 nt, Human
uuaaaaaacacguguagcuguggguaaggaagucgucccauuuuauggauguggaaacugag

SEQ ID NO: 84314 - RNA, 62 nt, Human
uuugcuggaguguucaccuguuguuaucugugucgucccacugagugcauucaccaccuuuu

SEQ ID NO: 84315 - RNA, 62 nt, Human
acccgggagguggagguugcagugagccgagaucgucccacugcacuccagccugggcaaca

SEQ ID NO: 84316 - RNA, 62 nt, Human
gugggacucaccugacucaaagaugacuaauaucgucccauuuuggaaauaaagcaacagac

SEQ ID NO: 84317 - RNA, 62 nt, Human
uggggacuaagguugcaggccuuagccucgucucgucccagaggcauuggaucaggagaaug

SEQ ID NO: 84318 - RNA, 62 nt, Human
acccuggagguggagguugcagugagcugagaucgucccacugcacuccagcccgggcaaca

SEQ ID NO: 84319 - RNA, 62 nt, Human
cuggagcagccugggcccuucagccccugugcucgucccacccuagggacucagccacuugc

SEQ ID NO: 84320 - RNA, 62 nt, Human
gaggacagcucuggcccuucuuaggccuagccucgucccaagcuaaauguaagccaguuggg

SEQ ID NO: 84321 - RNA, 62 nt, Human
ggagaaagggaagucaggguucuagggguuauucgucccaggaaauagaagugaaauugucu

SEQ ID NO: 84322 - RNA, 62 nt, Human
agguuugagucaggaggcucccuguacuggagucgucccacuauuccucaagaaaucuuaga

SEQ ID NO: 84323 - RNA, 62 nt, Human
cugcggagcuggagccguagauuccgugccugccgccgcagcgccgccgacaacgcgggugc

SEQ ID NO: 84324 - RNA, 64 nt, Human
uggugccaacucacugagccgccugccgcuggggccgccgcacccugcaccuuggaccggcauc

SEQ ID NO: 84325 - RNA, 64 nt, Human
gacacugaccccaucuccugccgccgcccuggggccgccgcagggaugccuugccuuuucagga

SEQ ID NO: 84326 - RNA, 64 nt, Human
gaguuccuuccccuccacccucgccccgucuccgccgccgcaccccuguccagcuguugagcug

SEQ ID NO: 84327 - RNA, 64 nt, Human
gcgugugcucagaggugguuguuggcggagaacgccgccgcaguguuugaccucuagcggugaa

SEQ ID NO: 84328 - RNA, 64 nt, Human
gcucaggggcugccccggaaucagcuccccggggccgccgcaacgaagguggauccgcaucuug

SEQ ID NO: 84329 - RNA, 64 nt, Human
uccggcugccuagcccuccccccagcucccugcaccgccgcagaagcagccccucgaggccuac

SEQ ID NO: 84330 - RNA, 64 nt, Human
gccuccggucccgcuuccaguuuccuugaagcgcccgccgcacacgcccuauucagcaccagcu

SEQ ID NO: 84331 - RNA, 64 nt, Human
ccgcaugcguguggaguguccgguggugcucgggccgccgcagugcagcgacugcccggcccuc

SEQ ID NO: 84332 - RNA, 64 nt, Human
cugcuggaacccacugagcccuucccgggguuucccgccgcacucaguguguuccuucaggcua

SEQ ID NO: 84333 - RNA, 64 nt, Human
ugucuccaccgcccgaggccugcgccgguggcucccgccgcaguugcguuugcuuuggaccuug

SEQ ID NO: 84334 - RNA, 64 nt, Human
gucaagcccugugcuccggccauggccgcuguguccgccgcaccagccaccccaaagcccuccu

SEQ ID NO: 84335 - RNA, 64 nt, Human
aaccuaaaaagcagacccaaguuuccuuucuccuccgccgcaaaggagaggcuucccagccccg

SEQ ID NO: 84336 - RNA, 64 nt, Human
cgaauguauauagcgaccagagcauucuuaauucccgccgcagaccuggcgcccccgccuuggc

SEQ ID NO: 84337 - RNA, 64 nt, Human
uaauaccuacuuguacguacauguaaaacaaaucccgccgcaacuguuuucuguucuguuguuu

SEQ ID NO: 84338 - RNA, 55 nt, Human
cgugccaguacaacagcugaccgccccgccgcaccacgcgggccggcggccggag

SEQ ID NO: 84339 - RNA, 64 nt, Human
cgugucugaggaaaccuccaggcugaggaggucuccgccgcagccuugcuggagccgggucggg

SEQ ID NO: 84340 - RNA, 64 nt, Human
ggcagcugauuugcugcagggauggagaggaccaccgccgcaggguucuuuuaccugugccacc

SEQ ID NO: 84341 - RNA, 60 nt, Human
ugcucuggcccagccgcugagcgcccgcacccgccgcaccccgaggccgccaauuguccg

SEQ ID NO: 84342 - RNA, 64 nt, Human
gguaaggagcgcaccaaagcgcagagcuugcugcccgccgcacgcacgcgcgccugcgugcggg

SEQ ID NO: 84343 - RNA, 64 nt, Human
ccagugaggagcucacagguccucccugguggucccgccgcaccucugcaucuccugggcguca

SEQ ID NO: 84344 - RNA, 64 nt, Human
ccucuuauggagccccucccauggagcucucuucccgccgcacuuucuaccccgggcagaggcg

SEQ ID NO: 84345 - RNA, 64 nt, Human
ggcuccugugacggcggcgaggcuugggaggaaaccgccgcaaugggggugucuucccucgggg

SEQ ID NO: 84346 - RNA, 64 nt, Human
agcagcugcacucagcaccuaggccaggguggggccgccgcagaugggcucaggaagccccagg

SEQ ID NO: 84347 - RNA, 50 nt, Human
ccaagcucgacgccaaguagccgccgcacuuuccagcagggaucggagga

SEQ ID NO: 84348 - RNA, 64 nt, Human
cugacucgcagccccaucggacgcucucccgggaccgccgcaggaccaguuuccauagacugcg

SEQ ID NO: 84349 - RNA, 64 nt, Human
gucuugggggggaagacccucgcugcgccgcuucccgccgcagcgcccgcgccuccgaggggac

SEQ ID NO: 84350 - RNA, 64 nt, Human
uuuaaaagcauaacuggcuaagucaccgccccacccgccgcauuacauuuccuaaaacauacug

SEQ ID NO: 84351 - RNA, 64 nt, Human
uagcgagcgcccgaacuggccaggacccccgcgcccgccgcacagcgcgcagccgggcgcucaa

SEQ ID NO: 84352 - RNA, 64 nt, Human
aggagaaagccaugaagguggauauggacaucugccgccgcaucgacaucaccgccaagcucug

SEQ ID NO: 84353 - RNA, 64 nt, Human
aagcuggugcagcggcagaugcuggggcuucagcccgccgcagacuucacagcuggccacaacg

SEQ ID NO: 84354 - RNA, 64 nt, Human
agccucccugugcgugugcgucucugccuuccguccgccgcacacccgccugccuggccgcagg

SEQ ID NO: 84355 - RNA, 64 nt, Human
ccuaaugacgaagcugcucagcaacuccaccugcccgccgcaggaaggagcaguccccugcuau

SEQ ID NO: 84356 - RNA, 55 nt, Human
ucaagccuugcgugaugugaggcugccgccgcaggcccuccuggugcaggcaggc

SEQ ID NO: 84357 - RNA, 64 nt, Human
caacccaugcccuggaccagccgcccagaucaugccgccgcagcugguugggggcaccaucugg

SEQ ID NO: 84358 - RNA, 64 nt, Human
uuguccugcuacagcuagugugcuuuuagacuuuccgccgcagacuacauuucuagaguuagag

SEQ ID NO: 84359 - RNA, 64 nt, Human
ugcggaaccagcccuacauccgcgcagacacaggccgccgcagugcccgucggcgucccccggg

SEQ ID NO: 84360 - RNA, 64 nt, Human
gugucaccuggagcugggcacuaaccauuccaagccgccgcaucgcuuguuuccaccuccuggg

SEQ ID NO: 84361 - RNA, 64 nt, Human
caugaguucagcugugacguuagcuucaguggcuccgccgcauccucacacugacgggggcucc

SEQ ID NO: 84362 - RNA, 64 nt, Human
aaguuuaaacacugaagugccgaaguggcccgugccgccgcacagagaccccgacuuuaguuug

SEQ ID NO: 84363 - RNA, 64 nt, Human
aggacuguccccaugcccacggaugcucagcagcccgccgcacuggggcagaugucuccccugc

SEQ ID NO: 84364 - RNA, 64 nt, Human
ugcuccgcagggcgcccagcgccguccggcggccccgccgcagaccagcuggcggguguggaga

SEQ ID NO: 84365 - RNA, 64 nt, Human
cuucgcagggacagcgcuggggaggugacggcgcccgccgcagguggggcgaggcugggggagg

SEQ ID NO: 84366 - RNA, 64 nt, Human
aguggccuucagaggcuccuccugggacugggaaccgccgcagggccaggcggacggcgugagg

SEQ ID NO: 84367 - RNA, 64 nt, Human
ccccuccuaggaaucacagcuccccguacuggugccgccgcaguggccaaguugcgacacugcc

SEQ ID NO: 84368 - RNA, 64 nt, Human
ugccaagcacugcggccacucagcagcuauguucccgccgcaguggggcccugacgcccaccuc

SEQ ID NO: 84369 - RNA, 64 nt, Human
caggugugagccacagcacccaaccuuuuuuuccccgccgcaccccaagauggugucucacucu

SEQ ID NO: 84370 - RNA, 64 nt, Human
cacucucuggucaucgccugggaggaagaugccaccgccgcagcaaggucccugcggccaccac

SEQ ID NO: 84371 - RNA, 64 nt, Human
agcuccuugccucccacaacaacuacgcccgcuaccgccgcaccugggcuggcugcgcggguuu

SEQ ID NO: 84372 - RNA, 64 nt, Human
ccaccgcugccuuuugcugcugcugcugcggcgaccgccgcagggacggggacuggcccucccu

SEQ ID NO: 84373 - RNA, 64 nt, Human
acccacgcugucugcgcuggcuccacccgggaacccgccgcacgcuguguucuaggcccgccca

SEQ ID NO: 84374 - RNA, 64 nt, Human
augacuaccgcucugcuacuuaggcacagggacuccgccgcacgcugacggaccacgagggcug

SEQ ID NO: 84375 - RNA, 62 nt, Human; identical to SEQ ID NO: 84323

SEQ ID NO: 84376 - RNA, 64 nt, Human; identical to SEQ ID NO: 84324

SEQ ID NO: 84377 - RNA, 64 nt, Human; identical to SEQ ID NO: 84325

SEQ ID NO: 84378 - RNA, 64 nt, Human; identical to SEQ ID NO: 84326

SEQ ID NO: 84379 - RNA, 64 nt, Human; identical to SEQ ID NO: 84327

SEQ ID NO: 84380 - RNA, 64 nt, Human; identical to SEQ ID NO: 84328

SEQ ID NO: 84381 - RNA, 64 nt, Human; identical to SEQ ID NO: 84329

SEQ ID NO: 84382 - RNA, 64 nt, Human; identical to SEQ ID NO: 84330

SEQ ID NO: 84383 - RNA, 64 nt, Human; identical to SEQ ID NO: 84331

SEQ ID NO: 84384 - RNA, 64 nt, Human; identical to SEQ ID NO: 84332

SEQ ID NO: 84385 - RNA, 64 nt, Human; identical to SEQ ID NO: 84333

SEQ ID NO: 84386 - RNA, 64 nt, Human; identical to SEQ ID NO: 84334

SEQ ID NO: 84387 - RNA, 64 nt, Human; identical to SEQ ID NO: 84335

SEQ ID NO: 84388 - RNA, 64 nt, Human; identical to SEQ ID NO: 84336

SEQ ID NO: 84389 - RNA, 64 nt, Human; identical to SEQ ID NO: 84337

SEQ ID NO: 84390 - RNA, 55 nt, Human; identical to SEQ ID NO: 84338

SEQ ID NO: 84391 - RNA, 64 nt, Human; identical to SEQ ID NO: 84339

SEQ ID NO: 84392 - RNA, 64 nt, Human; identical to SEQ ID NO: 84340

SEQ ID NO: 84393 - RNA, 60 nt, Human; identical to SEQ ID NO: 84341

SEQ ID NO: 84394 - RNA, 64 nt, Human; identical to SEQ ID NO: 84342

SEQ ID NO: 84395 - RNA, 64 nt, Human; identical to SEQ ID NO: 84343

SEQ ID NO: 84396 - RNA, 64 nt, Human; identical to SEQ ID NO: 84344

SEQ ID NO: 84397 - RNA, 64 nt, Human; identical to SEQ ID NO: 84345

SEQ ID NO: 84398 - RNA, 64 nt, Human; identical to SEQ ID NO: 84346

SEQ ID NO: 84399 - RNA, 50 nt, Human; identical to SEQ ID NO: 84347

SEQ ID NO: 84400 - RNA, 64 nt, Human; identical to SEQ ID NO: 84348

SEQ ID NO: 84401 - RNA, 64 nt, Human; identical to SEQ ID NO: 84349

SEQ ID NO: 84402 - RNA, 64 nt, Human; identical to SEQ ID NO: 84350

SEQ ID NO: 84403 - RNA, 64 nt, Human; identical to SEQ ID NO: 84351

SEQ ID NO: 84404 - RNA, 64 nt, Human; identical to SEQ ID NO: 84352

SEQ ID NO: 84405 - RNA, 64 nt, Human; identical to SEQ ID NO: 84353

SEQ ID NO: 84406 - RNA, 64 nt, Human; identical to SEQ ID NO: 84354

SEQ ID NO: 84407 - RNA, 64 nt, Human; identical to SEQ ID NO: 84355

SEQ ID NO: 84408 - RNA, 55 nt, Human; identical to SEQ ID NO: 84356

SEQ ID NO: 84409 - RNA, 64 nt, Human; identical to SEQ ID NO: 84357

SEQ ID NO: 84410 - RNA, 64 nt, Human; identical to SEQ ID NO: 84358

SEQ ID NO: 84411 - RNA, 64 nt, Human; identical to SEQ ID NO: 84359

SEQ ID NO: 84412 - RNA, 64 nt, Human; identical to SEQ ID NO: 84360

SEQ ID NO: 84413 - RNA, 64 nt, Human; identical to SEQ ID NO: 84361

SEQ ID NO: 84414 - RNA, 64 nt, Human; identical to SEQ ID NO: 84362

SEQ ID NO: 84415 - RNA, 64 nt, Human; identical to SEQ ID NO: 84363

SEQ ID NO: 84416 - RNA, 64 nt, Human; identical to SEQ ID NO: 84364

SEQ ID NO: 84417 - RNA, 64 nt, Human; identical to SEQ ID NO: 84365

SEQ ID NO: 84418 - RNA, 64 nt, Human; identical to SEQ ID NO: 84366

SEQ ID NO: 84419 - RNA, 64 nt, Human; identical to SEQ ID NO: 84367

SEQ ID NO: 84420 - RNA, 64 nt, Human; identical to SEQ ID NO: 84368

SEQ ID NO: 84421 - RNA, 64 nt, Human; identical to SEQ ID NO: 84369

SEQ ID NO: 84422 - RNA, 64 nt, Human; identical to SEQ ID NO: 84370

SEQ ID NO: 84423 - RNA, 64 nt, Human; identical to SEQ ID NO: 84371

SEQ ID NO: 84424 - RNA, 64 nt, Human; identical to SEQ ID NO: 84372

SEQ ID NO: 84425 - RNA, 64 nt, Human; identical to SEQ ID NO: 84373

SEQ ID NO: 84426 - RNA, 64 nt, Human; identical to SEQ ID NO: 84374

SEQ ID NO: 84427 - RNA, 63 nt, Human
ccuggccagugugccacauuaaauacccgugcaggcgcggagaagcaaccggcacccccuucc

SEQ ID NO: 84428 - RNA, 63 nt, Human
ggcgcgcgugggcccgcugccguggcucugggcggcgcggacgcgcguagcgcgggagcaggg

SEQ ID NO: 84429 - RNA, 63 nt, Human
ggacuagucucauuucucugagaagaaaacuaaggcgcggaaauuugucuaagaucacauaac

SEQ ID NO: 84430 - RNA, 63 nt, Human
ccucaccaaagcucugagcccugcuagccuugaggcgcggacccucccccauaccucccacag

SEQ ID NO: 84431 - RNA, 63 nt, Human
uccacggccuguacucgguuuacaccgcgggcgggcgcggagggaggcugcguuuccuccgcu

SEQ ID NO: 84432 - RNA, 63 nt, Human
gguuggggguuggguggggcuggacggggacgaggcgcggagaggcggcgggaaagagcuucg

SEQ ID NO: 84433 - RNA, 63 nt, Human
cgcgggccggcggccggagcggggaagggcgcgggcgcggaggacgcacgcggggccccggcu

SEQ ID NO: 84434 - RNA, 63 nt, Human
acacuaaggccccaacaucgcgggaccugcuguggcgcggauucuuaggaacgcuguucuagc

SEQ ID NO: 84435 - RNA, 63 nt, Human
agcgcccgaguggcggagcugcugcugcuccacggcgcggagcccaacugcgccgaccccgcc

SEQ ID NO: 84436 - RNA, 63 nt, Human
agcgcccgcguggcggagcugcugcugcuccacggcgcggagcccaacugcgcagacccugcc

SEQ ID NO: 84437 - RNA, 63 nt, Human
uacacccagcacuuugcgaccugcggcccagcaggcgcggaggauggcggggaggaagccagc

SEQ ID NO: 84438 - RNA, 63 nt, Human
ggggaguauugaauggugguggaaggguagagaggcgcggagugaaccccacgcccugucuaa

SEQ ID NO: 84439 - RNA, 62 nt, Human
ccucggaauccaagguguagggcccggcgcggggcgcggacuccgggcacggcuucccaggg

SEQ ID NO: 84440 - RNA, 63 nt, Human
cugguuauguugauagaaugauaaaaagggucgggcgcggaggcucacgccuguaaucccagc

SEQ ID NO: 84441 - RNA, 63 nt, Human
gaugcggcuugggcgcucuucggggaccuccguggcgcggaagacccgagccugccgggggga

SEQ ID NO: 84442 - RNA, 63 nt, Human
cccggcccggagagggaggaggaggccuccaggggcgcggagcucuggggaugggcgucgggc

SEQ ID NO: 84443 - RNA, 63 nt, Human
ucacgaaaaggucuaaaugaauugcgugugcagggcgcggauuuaaaguccaauuucucauga

SEQ ID NO: 84444 - RNA, 63 nt, Human
ccggaacauugugacuuggaccuuuucaggaguggcgcggauguuacaggaaaugcugucgga

SEQ ID NO: 84445 - RNA, 63 nt, Human
agcagcugagggggacccggggaggcuggacagggcgcggaacccugucauggaugacaaggc

SEQ ID NO: 84446 - RNA, 63 nt, Human
ggccccuugucuguucccacggacgggggcucgggcgcggacuaagcaggggggaucucccgc

SEQ ID NO: 84447 - RNA, 63 nt, Human
gcgagcacccugcagcugggcgggcaggcggcaggcgcggaacugacccucucgcgggacuga

SEQ ID NO: 84448 - RNA, 63 nt, Human
acugcacagccagucaccgcggucucagucaucggcgcggauggcuaugcuggggucccaggg

SEQ ID NO: 84449 - RNA, 63 nt, Human
cuggagagacucuccccaccucugucuggguggggcgcggaccccucacugugcgccugugca

SEQ ID NO: 84450 - RNA, 63 nt, Human
gagcugagcguggcgcaagcgggccagggcgcgggcgcggaccccgggccggugcugcuccgc

SEQ ID NO: 84451 - RNA, 63 nt, Human
ccagggcgccugacaaacaccauggugugugcaggcgcggagggcagaggcgcagaauccugu

SEQ ID NO: 84452 - RNA, 63 nt, Human
ccggaggagacgcugcaauaaagguugggagaaggcgcggaaaggagaggagcuggggccuug

SEQ ID NO: 84453 - RNA, 63 nt, Human
cucuccuugcugugugugagggcccagguggaaggcgcggaccugacagcauuccaauaaagc

SEQ ID NO: 84454 - RNA, 63 nt, Human
cuacaagucccgggccccccaguucacgauucuggcgcggacuucgcucccccaagacaacac

SEQ ID NO: 84455 - RNA, 63 nt, Human
ggacucuuagcugagguucgggauauaccccgaggcgcggaaccauagauauaacagugguaa

SEQ ID NO: 84456 - RNA, 64 nt, Human
gaagggcgaguaggggcaccuggacgcugaugguggccaggaugcucagcuggccaggagggca

SEQ ID NO: 84457 - RNA, 64 nt, Human
accuggacgcugaugguggccaggaugcucagcuggccaggagggcagcaccugcuggggacgg

SEQ ID NO: 84458 - RNA, 64 nt, Human
aaauggagucugcuccugagaagcuucaaauucaggccaggagagaagucuuaagaaaagaccu

SEQ ID NO: 84459 - RNA, 64 nt, Human
ucugugugcccuccugggagucagucagcgcucaggccaggacugugcagggccagccagccca

SEQ ID NO: 84460 - RNA, 64 nt, Human
uguguccccagcucagggauugccugaaccaagaggccaggagcccccaugggccgcccaguac

SEQ ID NO: 84461 - RNA, 64 nt, Human
uggggcuaggagggcagcaggguggccucugggaggccaggauggcacuguuggcaccgagguu

SEQ ID NO: 84462 - RNA, 64 nt, Human
uucccucugggagccuaaaccaggcugcaucggaggccaggacccggaucauucacugugauac

SEQ ID NO: 84463 - RNA, 63 nt, Human
uuguggucuuagaggauuaacuggggaucucagggccaggaguuauguuuugauuuggaauuu

SEQ ID NO: 84464 - RNA, 64 nt, Human
uuucuuuccucagaucauccagaaguuccucaagggccaggacuuuaucuaauaccucugugug

SEQ ID NO: 84465 - RNA, 64 nt, Human
agagguggggaagauggcaggcaaggguacccuuggccaggacucuggugcccacccugccacc

SEQ ID NO: 84466 - RNA, 64 nt, Human
guuuguuuuggaaauaacagaaaagauauuuauuggccaggaaguuggugcugcuaagaccgag

SEQ ID NO: 84467 - RNA, 64 nt, Human
ugcccugaagaccaccccagucuaccucggugcuggccaggaaaccuuucggcuaccucuccca

SEQ ID NO: 84468 - RNA, 64 nt, Human
ucuauuuuuaggagagaccgguuuucaccacguuggccaggauggucucgauauccugaucucg

SEQ ID NO: 84469 - RNA, 64 nt, Human
auaaaaaauaauaaaaauccuuaggauaacuugaggccaggaguuugagaccagugugaccuug

SEQ ID NO: 84470 - RNA, 64 nt, Human
ugccugcagcaauguagcugaggacuggucugaaggccaggagcccugugcucuugacaucacu

SEQ ID NO: 84471 - RNA, 64 nt, Human
ccuguugucucagcuaugugggaagaucacuugaggccaggaguucaaggcuauagugugcuau

SEQ ID NO: 84472 - RNA, 64 nt, Human
ugcauuuuuaguagagaugggguuucaccauguuggccaggauggucuugaucucuugaccucg

SEQ ID NO: 84473 - RNA, 64 nt, Human
gguggcugucuggggcaacaaguaaugccuugaaggccaggaggugggagugaggagcccauac

SEQ ID NO: 84474 - RNA, 59 nt, Human
cugucuggggcaacaaguagggccuugaaggccaggaggugggagugaggagcccauac

SEQ ID NO: 84475 - RNA, 59 nt, Human; identical to SEQ ID NO: 84474

SEQ ID NO: 84476 - RNA, 64 nt, Human
gagggaucccacgaaguuauucuuacgcagcuggggccaggagggucagaguggugccaggugc

SEQ ID NO: 84477 - RNA, 64 nt, Human; identical to SEQ ID NO: 42598

SEQ ID NO: 84478 - RNA, 64 nt, Human
uccuuucaccuauguaaccgcaucccucaggcauggccaggaggccgacuucauccuccuuccc

SEQ ID NO: 84479 - RNA, 64 nt, Human
cagagccauccacccugaggagugaugggcaaggggccaggaaggggacaggauugucugcugc

SEQ ID NO: 84480 - RNA, 64 nt, Human
ggguggagagucuuuccucacgcuccagcacaguggccaggaaaagaaauacugaauuugcccc

SEQ ID NO: 84481 - RNA, 64 nt, Human
caggaagagagagagagagguucuggggaggaagggccaggagagagaucuagaaaguggguuc

SEQ ID NO: 84482 - RNA, 64 nt, Human
ccuaccccucaccggaaagcuagacccgcuucagggccaggaguggcguuuccgcacaggauuu

SEQ ID NO: 84483 - RNA, 64 nt, Human; identical to SEQ ID NO: 45146

SEQ ID NO: 84484 - RNA, 64 nt, Human
ugccugcaucugccacuuucugcuacccuagggaggccaggaggagcuucggaggaccaucgcc

SEQ ID NO: 84485 - RNA, 64 nt, Human
aguuuagagauuugcggcaauggaccgaagaacgggccaggaaguccuccaauuuccuuugguc

SEQ ID NO: 84486 - RNA, 64 nt, Human
aaaaugggagugagaagaugccuggcgagguuuuggccaggaggacgugaaguccuuggggaag

SEQ ID NO: 84487 - RNA, 64 nt, Human
gaaucaccuuaagaaggacagggcuagggcauuuggccaggauggccacccuccugcuguugcc

SEQ ID NO: 84488 - RNA, 64 nt, Human
cccaucacaucagccuaccucccuccuggcugcuggccaggaugucgccagcauuaccuuccac

SEQ ID NO: 84489 - RNA, 64 nt, Human; identical to SEQ ID NO: 45165

SEQ ID NO: 84490 - RNA, 64 nt, Human
gcaugcagagcucgcgugggcuugccuucgugggggccaggacgggaggcaggguggggggcag

SEQ ID NO: 84491 - RNA, 64 nt, Human
caccucucccaccaagaggccaccugucacucauggccaggagagugacaccauggaggguaca

SEQ ID NO: 84492 - RNA, 64 nt, Human
cacuuugggaggccaaggcaggcagaucacuuaaggccaggaguucaagaccaccuggccaaca

SEQ ID NO: 84493 - RNA, 64 nt, Human
cuaggacccugcaagcaacucugcucugugaccaggccaggauuccuggagcuggccugagagg

SEQ ID NO: 84494 - RNA, 64 nt, Human
gaagggagagccggggaggauagggcaggagucuggccaggagcccaaggucaagucuggcugu

SEQ ID NO: 84495 - RNA, 64 nt, Human; identical to SEQ ID NO: 45203

SEQ ID NO: 84496 - RNA, 64 nt, Human
gggcuuggggaccagagcugccaccugccuguugggccaggagccuccugcccuuaccugccag

SEQ ID NO: 84497 - RNA, 64 nt, Human
ucagacagcccagcagugugaacacacaaugccaggccaggaacugggaccaccaucuugcuga

SEQ ID NO: 84498 - RNA, 64 nt, Human
ccagccccucaugcucuuaaggaugucaggaagaggccaggauggugguguggggaggggugcc

SEQ ID NO: 84499 - RNA, 64 nt, Human
uugaccucauaauggugcccacuuucucgacuuuggccaggauuuccuucaaagaaaacgacuu

SEQ ID NO: 84500 - RNA, 64 nt, Human
uaucccucuaaggcgcaaggugaagaagcuucugggccaggaaggaaaaaaaaaugcccaccug

SEQ ID NO: 84501 - RNA, 64 nt, Human; identical to SEQ ID NO: 45222

SEQ ID NO: 84502 - RNA, 64 nt, Human
uuugggccccuuacucaguauccugggaacccugggccaggagguuacaguggucaucauaauu

SEQ ID NO: 84503 - RNA, 64 nt, Human
cucgacucuccaacccuccugagcagccggcaggggccaggaucacacauucuucucacccuug

SEQ ID NO: 84504 - RNA, 64 nt, Human
uuauaggggaggcugaagcaggaggaucacuugaggccaggaguuugagaccagccugggcaac

SEQ ID NO: 84505 - RNA, 64 nt, Human
caccuucagaggcugaggugagaggaucaguugaggccaggaguuuaagaccagccugggcaac

SEQ ID NO: 84506 - RNA, 64 nt, Human
ggcgagcccgggggcucgcaggggggauuuuccaggccaggagaaccucguggagacacccgag

SEQ ID NO: 84507 - RNA, 64 nt, Human; identical to SEQ ID NO: 45241

SEQ ID NO: 84508 - RNA, 64 nt, Human
ccugggucacauguccacccugaccaaucacuguggccaggaggaugauacaugcuaauuugcu

SEQ ID NO: 84509 - RNA, 64 nt, Human
uaagauuauaccaacaguggaucagcuggguuuuggccaggaaguugucuuuguggacucugcc

SEQ ID NO: 84510 - RNA, 64 nt, Human
auacccagguauaacucaaaauccaaagggauagggccaggaucccuauuccuaccccaucuau

SEQ ID NO: 84511 - RNA, 64 nt, Human
cccuucuuccucacccaagaugcagggugguuggggccaggaguuuggacccucuaggucuugg

SEQ ID NO: 84512 - RNA, 64 nt, Human
ggcccaggagcaggccuuccuggcucgucucaaaggccaggacccuggggccccucaacugcag

SEQ ID NO: 84513 - RNA, 64 nt, Human; identical to SEQ ID NO: 45260

SEQ ID NO: 84514 - RNA, 64 nt, Human
cuguauccugggacagucagauucuucuaaaucaggccaggaaggaggggaaaagagugagaga

SEQ ID NO: 84515 - RNA, 64 nt, Human
cacuuugggaggcuacggugggcagaucaucugaggccaggaguucgagaccugccuggccaac

SEQ ID NO: 84516 - RNA, 64 nt, Human
ugguucuccccucccuucccuggccggcugccauggccaggagcuaagugccuuuuugugugca

SEQ ID NO: 84517 - RNA, 64 nt, Human
ggaccacauccaccccagccccacugcccuccagggccaggauucaggccucugaggagcccac

SEQ ID NO: 84518 - RNA, 64 nt, Human; identical to SEQ ID NO: 42598

SEQ ID NO: 84519 - RNA, 64 nt, Human; identical to SEQ ID NO: 45279

SEQ ID NO: 84520 - RNA, 64 nt, Human
gucagcaagcacaucagacucuagccuggacaguggccaggaccgucgagaccaccagagcuac

SEQ ID NO: 84521 - RNA, 64 nt, Human
aacugacuuucuaguucuagaaguuccgcugcaaggccaggaaagcuugagaaagguauugugg

SEQ ID NO: 84522 - RNA, 64 nt, Human
accugggggcgcgggcgggggaccccugcugggaggccaggagacugccccugcugccuucugc

SEQ ID NO: 84523 - RNA, 64 nt, Human
gcacagguuggguuugccaaacgccuaauuaccaggccaggaagcaugccaacaaagccacacg

SEQ ID NO: 84524 - RNA, 52 nt, Human
aucuuacagcuucccaaugagaggccaggaagugugaacauacugauagaaa

SEQ ID NO: 84525 - RNA, 64 nt, Human; identical to SEQ ID NO: 45298

SEQ ID NO: 84526 - RNA, 64 nt, Human
uacagcuggagcccuucccugagaaacucuuacaggccaggaagccaguacagaucuuugagag

SEQ ID NO: 84527 - RNA, 64 nt, Human
uaaaauuaugaaauugaaguucugcagcaugucaggccaggauuauuagggagauuccucgaaa

SEQ ID NO: 84528 - RNA, 64 nt, Human
cacuuugggaggccgaggcagguggaucacuugaggccaggaguuugaaaccagccuggccaac

SEQ ID NO: 84529 - RNA, 64 nt, Human
ucuuaggucugaggccggucugaggccggucagaggccaggauuggagagggggcaccgcguuc

SEQ ID NO: 84530 - RNA, 64 nt, Human
cacuuuggguggcugaggcagguggauuacuugaggccaggagauugagaccaguguggccaac

SEQ ID NO: 84531 - RNA, 64 nt, Human; identical to SEQ ID NO: 45317

SEQ ID NO: 84532 - RNA, 62 nt, Human
agccacggccagggagcuagugagggugauggggccaggaccugccccugaccaaugauacc

SEQ ID NO: 84533 - RNA, 64 nt, Human
gacagccccagagcaggguguugggauacugcagggccaggacugagccccgcagaccucccca

SEQ ID NO: 84534 - RNA, 64 nt, Human
acccucccuccccaaguggacacauggcugugcaggccaggaggcccacagauggacugagugc

SEQ ID NO: 84535 - RNA, 64 nt, Human
cugggagaggccugggggcggugcucacugggagggccaggacucaguuccugcucucauccuc

SEQ ID NO: 84536 - RNA, 64 nt, Human
ggagaggaaccgcagguggugagcggcuggggagggccaggacagccggggcugggugcugcag

SEQ ID NO: 84537 - RNA, 64 nt, Human; identical to SEQ ID NO: 45336

SEQ ID NO: 84538 - RNA, 64 nt, Human
uggaggccagaaagaaaagccuucuuuuucacuaggccaggacuacauugagagaugaagaaug

SEQ ID NO: 84539 - RNA, 64 nt, Human
cauauuguuugcagacacacaagaaaucuggcuuggccaggauuggcacuagcuaugaagggcu

SEQ ID NO: 84540 - RNA, 64 nt, Human
agucuugaacaucacuauucuaugcauaaaacuuggccaggaucuuaagggacuuugaaaauuc

SEQ ID NO: 84541 - RNA, 64 nt, Human
gcugaggauuggggaugguuucaucaacauaagaggccaggaacuugaccccuuugaauugugc

SEQ ID NO: 84542 - RNA, 64 nt, Human
cauuuugggaggcugaggugggcagaucacuugaggccaggaguucgagaccagccuggccaac

SEQ ID NO: 84543 - RNA, 64 nt, Human; identical to SEQ ID NO: 45355

SEQ ID NO: 84544 - RNA, 64 nt, Human
ccagaguaucgcccugggaugugguggggagcugggccaggagagggacugacugugacccucu

SEQ ID NO: 84545 - RNA, 64 nt, Human
cagcugcacccacccugcuugaucccaccugggaggccaggacacugaggagcucugaacccag

SEQ ID NO: 84546 - RNA, 64 nt, Human
ccacaaggcagcagaaagcgcggguccagaugagggccaggaaggggaggagagugagggccaa

SEQ ID NO: 84547 - RNA, 64 nt, Human; identical to SEQ ID NO: 45374

SEQ ID NO: 84548 - RNA, 64 nt, Human
ccgaccuuggggcuugugucgagcccuuggguggggccaggaggaggugauggcgucagaggag

SEQ ID NO: 84549 - RNA, 64 nt, Human
auaaaauauuuagccccucuguucugugcuuacuggccaggaaaugguaccaauuuuucagugu

SEQ ID NO: 84550 - RNA, 64 nt, Human
cggagcaacuuucccaacuacccaaccccaccauggccaggacaugugcaaugccagccccuuc

SEQ ID NO: 84551 - RNA, 64 nt, Human; identical to SEQ ID NO: 46060

SEQ ID NO: 84552 - RNA, 64 nt, Human
cccagaauuggggauggggcaguuagcauguuggggccaggaagggacaaguuagauaaggacu

SEQ ID NO: 84553 - RNA, 64 nt, Human
gguggugcggauagggcacugagggguggcgcgcggccaggagcacgcaugguauugacuuaaa

SEQ ID NO: 84554 - RNA, 64 nt, Human
cauguugagaggcugaggugggcagaucauuugaggccaggaguucaagaccagucuggccaau

SEQ ID NO: 84555 - RNA, 64 nt, Human; identical to SEQ ID NO: 46079

SEQ ID NO: 84556 - RNA, 64 nt, Human
uauaauuuuaguagagaugggguuucacugcguuggccaggaugaucucgaucucuugaccuug

SEQ ID NO: 84557 - RNA, 64 nt, Human
guccaagccacagcggucuggcuguugggaagauggccaggaauggacucauaccauuggcaca

SEQ ID NO: 84558 - RNA, 64 nt, Human
ugggcgccuagaaagaaaacacaaggacuugguaggccaggaagaaaagauuuuaaaauuuaga

SEQ ID NO: 84559 - RNA, 64 nt, Human
uacacuucucccauuuuguaucagguguguugcuggccaggagcugauggcucacugggcucuu

SEQ ID NO: 84560 - RNA, 64 nt, Human
aagccaucaccaguggguguacucagagcagaggggccaggacuucugccagccaagggaaagg

SEQ ID NO: 84561 - RNA, 64 nt, Human; identical to SEQ ID NO: 46117

SEQ ID NO: 84562 - RNA, 64 nt, Human
gccugcauaacagacugaaaugugcucaggcccuggccaggagggcccagggucauucuuuuaa

SEQ ID NO: 84563 - RNA, 64 nt, Human
gagaagacagagcacugacaaugagcuggcagcuggccaggaucagggcugucucaagcuucuu

SEQ ID NO: 84564 - RNA, 64 nt, Human
ccaaugcugaauacagaugauuuguguaaccugaggccaggauuaaggggaggcaaucaaugca

SEQ ID NO: 84565 - RNA, 64 nt, Human
uggacuguugagccccuggcugggcagccccaggggccaggagcucucuuggagacaagcaugu

SEQ ID NO: 84566 - RNA, 64 nt, Human
cccuggugaggagcugagggggauggguugcuggggccaggagggucucuccuccagccccugc

SEQ ID NO: 84567 - RNA, 64 nt, Human; identical to SEQ ID NO: 46136

SEQ ID NO: 84568 - RNA, 64 nt, Human
gugccgaacucaucccuguuccucaaggccaccuggccaggagcuucucugaugugauauccac

SEQ ID NO: 84569 - RNA, 64 nt, Human
caauuugggaggcugagacaggaggauugccugaggccaggaguuugacaccagccugggcaac

SEQ ID NO: 84570 - RNA, 64 nt, Human
agaaaccucugaugcaggucugcugccccgacggggccaggacuccacagcgcuuucucaguca

SEQ ID NO: 84571 - RNA, 64 nt, Human
gccgcaagggaagccucaggaaccagcaccuggaggccaggauagccaagcccugggugagcga

SEQ ID NO: 84572 - RNA, 64 nt, Human
accgugaguccaucgugugagccucggccuggcuggccaggacacacugaaaagcagccuuuuu

SEQ ID NO: 84573 - RNA, 64 nt, Human; identical to SEQ ID NO: 46155

SEQ ID NO: 84574 - RNA, 64 nt, Human
uuggaaaagguuuucuggggaggaggaggcuggaggccaggacacuguuuguuguggaacuagg

SEQ ID NO: 84575 - RNA, 64 nt, Human
ccuuaauggcacagaucugcugcuucuaacagauggccaggaggugacaccgauuucagccauu

SEQ ID NO: 84576 - RNA, 64 nt, Human
cuuuaaccugggcauguuuccuggguaccaguggggccaggagguggcucuggcucagagccgu

SEQ ID NO: 84577 - RNA, 64 nt, Human
aggucuuaagagccaaaggaaggaagugguugagggccaggaaagagaaggaaugucaugccag

SEQ ID NO: 84578 - RNA, 64 nt, Human
cagaagcuuccacugucagcucucaagagcccauggccaggaaggcccaugcugagcuuucagu

SEQ ID NO: 84579 - RNA, 64 nt, Human; identical to SEQ ID NO: 46174

SEQ ID NO: 84580 - RNA, 64 nt, Human
aaaauucuuucacuuggaacucuagcugauccuuggccaggaucagauccucaaaaggaaauau

SEQ ID NO: 84581 - RNA, 64 nt, Human
cgggcaccaggaucaagcucaucgacuuuggucuggccaggaggcuggguaaggcucaucugcc

SEQ ID NO: 84582 - RNA, 64 nt, Human
uaggcaccacagagaagaccuucuagugagccugggccaggagcccacagugccuguacaggaa

SEQ ID NO: 84583 - RNA, 64 nt, Human
guagcuguugucauucaaucuagugccuccuugaggccaggaguucaggaccagccugggcaac

SEQ ID NO: 84584 - RNA, 64 nt, Human
cacuuugggagggugaugcaggaggaucacuugaggccaggaguuggagaccagccuggccaac

SEQ ID NO: 84585 - RNA, 64 nt, Human; identical to SEQ ID NO: 46193

SEQ ID NO: 84586 - RNA, 64 nt, Human
ccuuggaagucacaguuuggggucacuugagaccggccaggaauguuugcaugaccuaccucag

SEQ ID NO: 84587 - RNA, 64 nt, Human
cucgggcggcgggcuccgggcccagccucgcagcggccaggagcgcgggccggcgaugcggcug

SEQ ID NO: 84588 - RNA, 64 nt, Human
ugugacauuucagccugaccaugaagacggcggaggccaggagacguucaacgccaccggaguc

SEQ ID NO: 84589 - RNA, 64 nt, Human; identical to SEQ ID NO: 46212

SEQ ID NO: 84590 - RNA, 64 nt, Human
guaauguaacgcauguaagaugcuuagggugccuggccaggacuccgugguuuccuguugugac

SEQ ID NO: 84591 - RNA, 64 nt, Human
uguauuuuuaguagaggcgggguuucaccauguuggccaggauggucucaaucuccuaaccuug

SEQ ID NO: 84592 - RNA, 64 nt, Human
gacaccaaacucuaaaaaagaagcaccacgagauggccaggacauuuguccacuuaaacucuca

SEQ ID NO: 84593 - RNA, 64 nt, Human; identical to SEQ ID NO: 46231

SEQ ID NO: 84594 - RNA, 64 nt, Human
uguauuuuuaguauagaugggguuucaccauguuggccaggauggucucgaucucuugaccuca

SEQ ID NO: 84595 - RNA, 64 nt, Human
uguauuuuuaguagagaugggguuucaccauguuggccaggauggucuugaucucuugaccucg

SEQ ID NO: 84596 - RNA, 64 nt, Human
uuuguugggaggccaaagcaggaggauagcuugaggccaggaguuccagaccagccugggcaac

SEQ ID NO: 84597 - RNA, 63 nt, Human; identical to SEQ ID NO: 46250

SEQ ID NO: 84598 - RNA, 62 nt, Human
acuucucagccaugagcuaacugcccccuggcggccaggaagagaaacagcuccuccccgac

SEQ ID NO: 84599 - RNA, 64 nt, Human
ugacguggugccaggggcagccccaacccacccgggccaggaacccccaggaagguggggccac

SEQ ID NO: 84600 - RNA, 64 nt, Human
gggugugggcacugacaguucucccccauuauuuggccaggaauugagcuuggcuuggcaaagu

SEQ ID NO: 84601 - RNA, 64 nt, Human; identical to SEQ ID NO: 46269

SEQ ID NO: 84602 - RNA, 64 nt, Human
uguauuuuuaguggagacgggguuucaccauguuggccaggauggucucaaucuccugacccug

SEQ ID NO: 84603 - RNA, 64 nt, Human
auugcaauggagaucaugacacuacuguuaauaaggccaggaaaacugccauuucaaguucuga

SEQ ID NO: 84604 - RNA, 64 nt, Human
uucuugccucugacaguagcuuauuugcucugggggccaggaauuggauucaguuuacacuauc

SEQ ID NO: 84605 - RNA, 64 nt, Human; identical to SEQ ID NO: 46307

SEQ ID NO: 84606 - RNA, 64 nt, Human
cucugugccaugggggaaaugaaucauuuagcuaggccaggaucuagugaaagccacagaguuu

SEQ ID NO: 84607 - RNA, 64 nt, Human
uuguauuuuagcagagacgggguuucaccauguuggccaggauggucucgaucuccugaccucg

SEQ ID NO: 84608 - RNA, 64 nt, Human
cgugaauggcccuagaacugugccuaguuccuguggccaggagguuggugacugaaacauucac

SEQ ID NO: 84609 - RNA, 64 nt, Human
cacuuugggaggcaaaggcgggaggaucacuugaggccaggacuuugagaccagccagggcaac

SEQ ID NO: 84610 - RNA, 64 nt, Human
cacccgccccagcuucugccacggcuucagucagggccaggaggaacacgugaaggagaaagag

SEQ ID NO: 84611 - RNA, 64 nt, Human; identical to SEQ ID NO: 46326

SEQ ID NO: 84612 - RNA, 64 nt, Human
uuguauuuucaguagagacggguuucaucaugguggccaggauggucuaucucuugaccucgug

SEQ ID NO: 84613 - RNA, 64 nt, Human
caacucagcccuacuuugcggauggacauauuaaggccaggaggggagggacuugccccagguc

SEQ ID NO: 84614 - RNA, 64 nt, Human
uguauuuuuaguagagaugggguuucaccauguuggccaggauggucucgaucucuugaccucg

SEQ ID NO: 84615 - RNA, 55 nt, Human
ucaguagcaguguugaauagcuugcggccaggacaaccugaauucuauaaguucu

SEQ ID NO: 84616 - RNA, 64 nt, Human
aggucgugggcccagcucugacaggauguggaguggccaggaccaagacagcaagcuacgcaau

SEQ ID NO: 84617 - RNA, 64 nt, Human; identical to SEQ ID NO: 46364

SEQ ID NO: 84618 - RNA, 64 nt, Human
ccuugcaaagccuccugcuccuacccaugcuacaggccaggaaccagagcccaucaucucagag

SEQ ID NO: 84619 - RNA, 64 nt, Human
aggcccaggugagacaggcaacgccaggucugcaggccaggagagaugcugcccaggccuccug

SEQ ID NO: 84620 - RNA, 64 nt, Human
ggaggccagccugccaugagagcacauguccucuggccaggaguaguggcugagcucugugauc

SEQ ID NO: 84621 - RNA, 64 nt, Human
ccccgcccgcucccaggcgccccauguccucacaggccaggacgccauggcaggauggagagga

SEQ ID NO: 84622 - RNA, 64 nt, Human
uguacuuuuaguacagaugaggguucacuauguuggccaggauggucucgaucucuugaccuca

SEQ ID NO: 84623 - RNA, 64 nt, Human; identical to SEQ ID NO: 46383

SEQ ID NO: 84624 - RNA, 64 nt, Human
uuccacugagggcaccuagacucuacagccaggcggccaggauucaacucccugccuggaucuc

SEQ ID NO: 84625 - RNA, 64 nt, Human
gaucacuguggccacugugcgagccguggaccccggccaggaaccacuccuguuguacaaagcu

SEQ ID NO: 84626 - RNA, 64 nt, Human
uaaauuugggacucuuugcugcgggaguuuggcuggccaggaacuugagugacauugaccucau

SEQ ID NO: 84627 - RNA, 64 nt, Human; identical to SEQ ID NO: 46935

SEQ ID NO: 84628 - RNA, 64 nt, Human
ucagcaggagggguggcgaguugcgggugggcagggccaggacgguguggcgccagccuugaag

SEQ ID NO: 84629 - RNA, 64 nt, Human
uauuuuuguuuuaccaagaaacugaaauaauucuggccaggaauaaauacuuccugaacaucuu

SEQ ID NO: 84630 - RNA, 64 nt, Human
cagcccaagguuccuccucuccuaccaagcaggaggccaggaacuucuuuggacuuggaaggug

SEQ ID NO: 84631 - RNA, 64 nt, Human; identical to SEQ ID NO: 48321

SEQ ID NO: 84632 - RNA, 64 nt, Human
ggugcuggagggaagagagaccuguguguuuagaggccaggaccacaguuaggauuggguuguu

SEQ ID NO: 84633 - RNA, 64 nt, Human
agggcgccgagacggugacuccagugcuggacccggccaggagacaaggguacgggccucucug

SEQ ID NO: 84634 - RNA, 64 nt, Human
uuuccagccaccuuccugacuucuaucugggcuuggccaggacuucuagucccucauaccagcc

SEQ ID NO: 84635 - RNA, 64 nt, Human; identical to SEQ ID NO: 50068

SEQ ID NO: 84636 - RNA, 64 nt, Human
gucuggguuuggcaggcacugccugcuacuugagggccaggaugcucccccagggaagaaacgg

SEQ ID NO: 84637 - RNA, 64 nt, Human
gugaucauuaucaccaacagcugguggguggccgggccaggaugcagcggggccuucugaugcc

SEQ ID NO: 84638 - RNA, 64 nt, Human
ggcacuucugaaaggcacaaggccaagaacuccuggccaggacugcaaggcucugcagccaaug

SEQ ID NO: 84639 - RNA, 64 nt, Human; identical to SEQ ID NO: 51847

SEQ ID NO: 84640 - RNA, 64 nt, Human
uauauaaaaagggaauuuaggauccaccaucgguggccaggaaaauagcagugacaauaaacaa

SEQ ID NO: 84641 - RNA, 64 nt, Human
gucagugugucuggccagcguggcuguggcacuuggccaggacgcuccguugaaugaagcucau

SEQ ID NO: 84642 - RNA, 64 nt, Human
uguaauuuuaguagagacagaguuucaccauguuggccaggauggucucgaucucuugaccuca

SEQ ID NO: 84643 - RNA, 56 nt, Human; identical to SEQ ID NO: 53163

SEQ ID NO: 84644 - RNA, 64 nt, Human
ccgcaggccgccgcgucuguguuggggagcgccuggccaggaccgagcucuuccugcuguuugc

SEQ ID NO: 84645 - RNA, 64 nt, Human
ggcuugacccgccaggggaguucuccaggccuagggccaggagagaggcccuggcacccuggcg

SEQ ID NO: 84646 - RNA, 64 nt, Human
cagcuucucaguuucugccugggcaauggccaggggccaggaguggggagaguugugauggagg

SEQ ID NO: 84647 - RNA, 64 nt, Human; identical to SEQ ID NO: 55060

SEQ ID NO: 84648 - RNA, 64 nt, Human
uguauuuuuaguagagacgggguuucacuguguuggccaggauggucucaaucucgaccucgug

SEQ ID NO: 84649 - RNA, 64 nt, Human
agauggugccgucauugcuggcuuaaagacaaggggccaggagccaacaccagaggccacucca

SEQ ID NO: 84650 - RNA, 64 nt, Human
caccuugggaggcugaggugggaggaucauuugaggccaggaguuugagaccugccugggcaac

SEQ ID NO: 84651 - RNA, 64 nt, Human; identical to SEQ ID NO: 58006

SEQ ID NO: 84652 - RNA, 64 nt, Human
uccaccugucugguccauagcucccuggaggcugggccaggaggcagccuccgaaccaugcccc

SEQ ID NO: 84653 - RNA, 64 nt, Human
ucuggaacuaauggccccacccccacugggcccaggccaggaggggcccugcccaugcccacac

SEQ ID NO: 84654 - RNA, 64 nt, Human
cacuuugggagucuguggcaggaggauugcuugaggccaggaguuugagaccagccugggcaac

SEQ ID NO: 84655 - RNA, 64 nt, Human
uacugaaaugagccucguggggagcaucagagaaggccaggaagaaugguguguuucccuagac

SEQ ID NO: 84656 - RNA, 64 nt, Human
auagcugggcuuacaggcaugagccaccacaccuggccaggauuugguuguuuaaauauaaauc

SEQ ID NO: 84657 - RNA, 64 nt, Human; identical to SEQ ID NO: 65173

SEQ ID NO: 84658 - RNA, 64 nt, Human
cacuuugugaggccaaggugggcggaucacuugaggccaggaauuugaaaccagccugggcaaa

SEQ ID NO: 84659 - RNA, 64 nt, Human
acucuggccaaagauacuuuuuuccagagacagaggccaggaggcagugaggggagccccgcgg

SEQ ID NO: 84660 - RNA, 64 nt, Human
caagaaaaucacaucacuaccuagagucaacucuggccaggaacucuaagguacacacuuucau

SEQ ID NO: 84661 - RNA, 64 nt, Human; identical to SEQ ID NO: 65191

SEQ ID NO: 84662 - RNA, 64 nt, Human
gaggagguucccuugcugggcaugcuucguagagggccaggagcagcaggucaugugcacaugc

SEQ ID NO: 84663 - RNA, 64 nt, Human
uguauuuuugguagagacgggguuucaccguguuggccaggauggucucaaucucgaccucgug

SEQ ID NO: 84664 - RNA, 64 nt, Human; identical to SEQ ID NO: 55060

SEQ ID NO: 84665 - RNA, 64 nt, Human; identical to SEQ ID NO: 65208

SEQ ID NO: 84666 - RNA, 64 nt, Human
cgugcaggccucugcagaaggagcacuuggcccuggccaggaaccccuggaacugaggccacga

SEQ ID NO: 84667 - RNA, 64 nt, Human
ccagaggggcugcaggaugguuuccccugggagaggccaggagggccugaucccaggagacacc

SEQ ID NO: 84668 - RNA, 64 nt, Human
cacuuugggaggcuaaggcgggaggaugacuugaggccaggaguuggagaccagccuggccaac

SEQ ID NO: 84669 - RNA, 64 nt, Human; identical to SEQ ID NO: 65226

SEQ ID NO: 84670 - RNA, 64 nt, Human
ccugugcccuggcgccgcugcaacagccccucauggccaggagccccccauggccuggggccuc

SEQ ID NO: 84671 - RNA, 64 nt, Human
augagaaaagcucaccgcaucagcugguugcccaggccaggaccugaaggguuguguggagucu

SEQ ID NO: 84672 - RNA, 64 nt, Human
cacuuugggaugcuaaggcaggcggaucacuugaggccaggaguucaagaccagccuggccaac

SEQ ID NO: 84673 - RNA, 64 nt, Human; identical to SEQ ID NO: 65262

SEQ ID NO: 84674 - RNA, 64 nt, Human
aaugaacaagugucagucgaguguuuacagauccggccaggaccccggcccccaaugcacuuua

SEQ ID NO: 84675 - RNA, 64 nt, Human
cacguugggaggccgaggcagguggaucacuugaggccaggaguucgagaccagccuggucaag

SEQ ID NO: 84676 - RNA, 64 nt, Human
ccaacaggggugucugcuucugcugcacuacacaggccaggaguggcauuccaugccacuaguu

SEQ ID NO: 84677 - RNA, 64 nt, Human; identical to SEQ ID NO: 65298

SEQ ID NO: 84678 - RNA, 64 nt, Human
caagaagcuuuuaaaggucaacacaaaaaaccaaggccaggagugaggggcucuuucuuaccgu

SEQ ID NO: 84679 - RNA, 64 nt, Human
ccacuuuucugucuucacagcuuuggggaauuuuggccaggagacccugaaacaugaaaccaaa

SEQ ID NO: 84680 - RNA, 64 nt, Human
ggagugaccccugccagcacacccugcagccaagggccaggaaguggacaagaacgaacccuuc

SEQ ID NO: 84681 - RNA, 64 nt, Human; identical to SEQ ID NO: 65316

SEQ ID NO: 84682 - RNA, 64 nt, Human
agaaacaguaagaaagaaacguuuucaugcuucuggccaggaauccugggucugcaacuuugga

SEQ ID NO: 84683 - RNA, 64 nt, Human
ucccacugccuuucauggggggugacuggguagaggccaggagaaaggaaagaguuguaaaaua

SEQ ID NO: 84684 - RNA, 64 nt, Human
gucuagacuggaccuaggagcuugaguugucaggggccaggacuggccccacugcagugcccag

SEQ ID NO: 84685 - RNA, 64 nt, Human; identical to SEQ ID NO: 65332

SEQ ID NO: 84686 - RNA, 64 nt, Human
gggcacucgcacuggggggcugugacagcagcugggccaggaggccguguaaugaccacacacu

SEQ ID NO: 84687 - RNA, 64 nt, Human
gcauuaagcaaaaaguuacuuagaguccaucugcggccaggaagugcuggucauggagcaaaau

SEQ ID NO: 84688 - RNA, 64 nt, Human
uauaaacagaacuccacugcaagagggggggccgggccaggagaaucuccgcuuguccaagaca

SEQ ID NO: 84689 - RNA, 64 nt, Human
aucccggccccgcccucgcggcgggcgcccccagggccaggagagagagacagggcuggcuccu

SEQ ID NO: 84690 - RNA, 64 nt, Human
aaugcaaaagaauacauuagaaauggacaaaaguggccaggagcgguagcucauacuuguaacc

SEQ ID NO: 84691 - RNA, 64 nt, Human; identical to SEQ ID NO: 66437

SEQ ID NO: 84692 - RNA, 64 nt, Human
gcuaauauaaaaaugcuaagugaaaaaaagacuuggccaggagaaauaauuuaaaaugcacauu

SEQ ID NO: 84693 - RNA, 64 nt, Human
ggugggccucagggaggauggggaucaagggacaggccaggagccaggaguggggaagggaggg

SEQ ID NO: 84694 - RNA, 64 nt, Human
auuaaaaauguuucauuguaucacauagaaauauggccaggaaggacuugagaagacaguuuga

SEQ ID NO: 84695 - RNA, 64 nt, Human; identical to SEQ ID NO: 70503

SEQ ID NO: 84696 - RNA, 64 nt, Human
uguauuuuuaguagacacaggguuucaccguguuggccaggauggucucgaucuccugaccucg

SEQ ID NO: 84697 - RNA, 64 nt, Human
cccaggaaggccuaggcuaggacguuggccucagggccaggaaggacagacuggccgggcaggc

SEQ ID NO: 84698 - RNA, 64 nt, Human
cacuuugggaggccgaggugggcagaucacuugaggccaggagauugagaccagccugaccguc

SEQ ID NO: 84699 - RNA, 64 nt, Human; identical to SEQ ID NO: 70521

SEQ ID NO: 84700 - RNA, 64 nt, Human
uguauuuuuaguagaaacgggguuucaccauguuggccaggaugauccucaaucuccugaccuc

SEQ ID NO: 84701 - RNA, 64 nt, Human
aggacuucucgcugcccuuccaagcccggcuuugggccaggaaaggcuuccccagguggcucuu

SEQ ID NO: 84702 - RNA, 64 nt, Human
gguggaggaggagggcucgcgccucuggucucggggccaggaauuccagguggcgugagaagua

SEQ ID NO: 84703 - RNA, 64 nt, Human; identical to SEQ ID NO: 70539

SEQ ID NO: 84704 - RNA, 64 nt, Human
ucccuugugggaaacugaggcccagcuuggggaaggccaggaccaugcagggagaaaaagcaga

SEQ ID NO: 84705 - RNA, 51 nt, Human
gcaucccccggcugcccuaggggccaggaccggcgugacagccuccaggua

SEQ ID NO: 84706 - RNA, 64 nt, Human
ugguagucauguggccccaccuggaugcagaggaggccaggaugugcagucuccacauaguggc

SEQ ID NO: 84707 - RNA, 64 nt, Human; identical to SEQ ID NO: 70574

SEQ ID NO: 84708 - RNA, 64 nt, Human
cagaugggugggugggugggcagguggccugccaggccaggagugggcuggagcugcugaggcc

SEQ ID NO: 84709 - RNA, 64 nt, Human
ccccucagccgcugagauccaguguccaagcugcggccaggaguccacccaccuccgcauccac

SEQ ID NO: 84710 - RNA, 64 nt, Human
ucauuugagucuucacacaaauaauaaccuaucuggccaggagaauuaucucagaacagaaguc

SEQ ID NO: 84711 - RNA, 64 nt, Human; identical to SEQ ID NO: 70592

SEQ ID NO: 84712 - RNA, 64 nt, Human
augaacggagugucggcuaggccacgggacagauggccaggaagggcccuggccucuaaacugg

SEQ ID NO: 84713 - RNA, 64 nt, Human
gcccagugaagccucugagggauugaggggcccuggccaggacccugaccuccgccccugcccc

SEQ ID NO: 84714 - RNA, 64 nt, Human
agaaggaggcccagcaaguguauggugggaaggaggccaggacggaggagaugaaguggcggca

SEQ ID NO: 84715 - RNA, 64 nt, Human; identical to SEQ ID NO: 70910

SEQ ID NO: 84716 - RNA, 64 nt, Human
cccacugugacuccggugcuguuugccguccccuggccaggaugguggagucugccccaggcac

SEQ ID NO: 84717 - RNA, 64 nt, Human
aggcuggaggaggguuugggcagagcgaagacccggccaggaccuuggugagauggggugccgc

SEQ ID NO: 84718 - RNA, 64 nt, Human
cacuuugggaggccaaagcagguggauuacccaaggccaggaguucaagaccagccuggccaac

SEQ ID NO: 84719 - RNA, 53 nt, Human; identical to SEQ ID NO: 75279

SEQ ID NO: 84720 - RNA, 64 nt, Human
gcaucaggcucucugggagaggaggggccuggagggccaggagucccagacucacgcacccugg

SEQ ID NO: 84721 - RNA, 64 nt, Human
ugagcacccacaggaagccgacccaggccugaggggccaggaacuugcugggucagaucugugu

SEQ ID NO: 84722 - RNA, 64 nt, Human
caaaggaacaccagcucugaaaacaugaccguggggccaggauguuucuggcaggcccagaagu

SEQ ID NO: 84723 - RNA, 64 nt, Human; identical to SEQ ID NO: 78680

SEQ ID NO: 84724 - RNA, 64 nt, Human
cugccauuccugcuuggggacugguggggaagagggccaggacaucuucugagccaggacgucc

SEQ ID NO: 84725 - RNA, 64 nt, Human
ugccugaggaaggcugcuagggauguuagaccucggccaggacccaccacauugcuuccuaaua

SEQ ID NO: 84726 - RNA, 64 nt, Human
accaagugagccugccacccuggagugagccccaggccaggaggcuguuccaggaguccugccc

SEQ ID NO: 84727 - RNA, 64 nt, Human; identical to SEQ ID NO: 78698

SEQ ID NO: 84728 - RNA, 64 nt, Human
agugcugggaauacaggcaugagccaccgcacucggccaggagcuaguuuuaccagcacccugc

SEQ ID NO: 84729 - RNA, 64 nt, Human
ccuggacgcagaggugacagugggagcuggccugggccaggacggcagguggcccuggagaugg

SEQ ID NO: 84730 - RNA, 64 nt, Human
ucaaacuuccaggagggccaguguuccuagugugggccaggaacaggacagggagaccuuguga

SEQ ID NO: 84731 - RNA, 64 nt, Human; identical to SEQ ID NO: 81614

SEQ ID NO: 84732 - RNA, 64 nt, Human
cacuuugggaggcugaggugggaggaucccuugaggccaggaguucaagguuacagugagcuau

SEQ ID NO: 84733 - RNA, 64 nt, Human
aguggcucacaccuauaaucccaacacuuugggaggccaggaguuuugagaccagccugggaaa

SEQ ID NO: 84734 - RNA, 64 nt, Human
cucccuaggagaccaaggcgggagcaucucuugaggccaggaguuugagaccagccugggcagc

SEQ ID NO: 84735 - RNA, 64 nt, Human
agagaguugcgaaucuaaaccugggacaggcuggggccaggaggcagaaacaccagccucugcc

SEQ ID NO: 84736 - RNA, 64 nt, Human
ccuugguggcuucccucugccaugacagccccuaggccaggaaccaucaggggggccagccggc

SEQ ID NO: 84737 - RNA, 64 nt, Human
cacuuuuggaggcugaggcggguggauugcuugaggccaggaguucgagaccagccuggccaac

SEQ ID NO: 84738 - RNA, 64 nt, Human
aagcagggauaacacuucccaaaucauuuugugaggccaggauuacccuaauaccaaagccagg

SEQ ID NO: 84739 - RNA, 64 nt, Human
ccuccgugagcaaauggugucuugggcaaucugaggccaggacagauguugccccacccacugg

SEQ ID NO: 84740 - RNA, 64 nt, Human
cugggguccccucauccacuugagggcgccugagggccaggagcagcaggcaaggagccugggu

SEQ ID NO: 84741 - RNA, 64 nt, Human
uggugugacauccccaccagccucagaugagacgggccaggacgcccagccacagcaagcccug

SEQ ID NO: 84742 - RNA, 64 nt, Human
cccccugcccacagaagggaaggccugcagagggggccaggaucuaccuaaccauuuccccacc

SEQ ID NO: 84743 - RNA, 64 nt, Human
uguauuuuuaguagagaugggguuucaccguguuggccaggauggucucaaucugaccuuguga

SEQ ID NO: 84744 - RNA, 64 nt, Human
cuugugaaaguuauggagcaugaaaagacugaagggccaggacaguuugcaugggcugaguuau

SEQ ID NO: 84745 - RNA, 64 nt, Human
agagcccugggacugggagugucugcuccucugaggccaggaggccggugcugggccagagagg

SEQ ID NO: 84746 - RNA, 64 nt, Human
cacugagccaguucagucacuagugcgccagccaggccaggagggagugcagagcaugucugcc

SEQ ID NO: 84747 - RNA, 64 nt, Human
cacuuugggaagccaaggcaggaggauuaccugaggccaggaguuuaagaccagccuuggcaac

SEQ ID NO: 84748 - RNA, 64 nt, Human
gcucccagggacaccugggagaaaucuggcuucuggccaggaagcuuuggugagaaccuggguu

SEQ ID NO: 84749 - RNA, 64 nt, Human
ccacgcuccaucgccgcccaaagggaggugccaaggccaggaacccaagccaccccggcucccc

SEQ ID NO: 84750 - RNA, 64 nt, Human
ccaggcccagcgauagaucaggaggcaucauugaggccaggagcucugcccgugaccuguaucc

SEQ ID NO: 84751 - RNA, 64 nt, Human
uacucuaucuuccauuccucgcccugcccccagaggccaggagcucugcccuugaccuguauuc

SEQ ID NO: 84752 - RNA, 64 nt, Human
cucagcaagaacagccugccugguggccuucuggggccaggaccccuggugggcaacguagcca

SEQ ID NO: 84753 - RNA, 64 nt, Human
cccaguggcagggcacagggccuggcccauguauggccaggaaguagcacaggcugagugcagg

SEQ ID NO: 84754 - RNA, 64 nt, Human
aauacuccuagggcucaggacaaguggcuccccuggccaggagagccacagccaugauacaggg

SEQ ID NO: 84755 - RNA, 64 nt, Human
uaccccugggccagucucuuugaacccugaggguggccaggaucuggagcugcaucucuaaggg

SEQ ID NO: 84756 - RNA, 64 nt, Human
uuucucuugaaacugccagugccugaacuguuggggccaggauuuucccuggucagaugccaag

SEQ ID NO: 84757 - RNA, 64 nt, Human
aaaaacucaagugacauauuucaguuaccaaaguggccaggaacuuuuugcuuuuaugaaaaua

SEQ ID NO: 84758 - RNA, 64 nt, Human
aucauauuggacucuugaaggcaauccuuccucuggccaggaaauuuuuuaaaaaauaauacug

SEQ ID NO: 84759 - RNA, 64 nt, Human
gguggcucaugccuguaaucccagcacuuugggaggccaggaguucgagaccagccuggccaac

SEQ ID NO: 84760 - RNA, 64 nt, Human
ccugugaaugcugugaaaagauuuauuccuuugaggccaggaagcucccaggcauauaugcuuc

SEQ ID NO: 84761 - RNA, 64 nt, Human
aucaaagccaagguugucaaagaacagccagugaggccaggaaagaaauuggucuugugguuuu

SEQ ID NO: 84762 - RNA, 64 nt, Human
uggccccaggggagaagaugaggccaucagagauggccaggagaagggccaggggaauagagcu

SEQ ID NO: 84763 - RNA, 64 nt, Human
uagcuuacacaguuaacuugauuuuaaaauccaaggccaggagagaagaauccaaaaagcaaua

SEQ ID NO: 84764 - RNA, 64 nt, Human
aagggcuccaggacccgucccaauaaccacccacggccaggagggccaaggccccgugcuggau

SEQ ID NO: 84765 - RNA, 64 nt, Human
ucgccggcgccuuuuucuuuuuagaugggaaggaggccaggaaagggucagcuuaaccauuucc

SEQ ID NO: 84766 - RNA, 64 nt, Human
agggucugcuccugcugaggaccagcuguggcugggccaggacagaggacucaacccugcuccu

SEQ ID NO: 84767 - RNA, 64 nt, Human
ucuacccuauggccacagcaggaggucagcccagggccaggagacacauggcuggacaaggcuu

SEQ ID NO: 84768 - RNA, 64 nt, Human
ucucaagcaccaagagaaacaucauuuuagcaaaggccaggaggaaaaauagaaauaaauuugu

SEQ ID NO: 84769 - RNA, 64 nt, Human
gggaaggagucacacgguaaaugggcgaaauccaggccaggagccucagagacugaagcagaac

SEQ ID NO: 84770 - RNA, 64 nt, Human
uguuuucacugucaugcagggagcccagcacuguggccaggauggcagagacuuccuugucauc

SEQ ID NO: 84771 - RNA, 64 nt, Human
ccuuccauaccccuuccuggaucuccagugccugggccaggaaagcccucuggguuccgggaag

SEQ ID NO: 84772 - RNA, 64 nt, Human
ccccaaagaccagaauauucuaccuaaauaucaaggccaggauuuucuaccuaaagaccaggac

SEQ ID NO: 84773 - RNA, 64 nt, Human
agugcugccucuuguaggugcuggcuaagggccaggccaggaugaguuuccccauggugaaugu

SEQ ID NO: 84774 - RNA, 64 nt, Human
ccaggccuauggauagaucaggaggcaucacugaggccaggagcucugcccaugaccuguaucc

SEQ ID NO: 84775 - RNA, 64 nt, Human
ucaucauccacccagacucgggcaaccucaccguggccaggaguguccccagccccaugaccuu

SEQ ID NO: 84776 - RNA, 64 nt, Human
gagccugagggugccugcccugcucuggagggagggccaggagcugccacacccccaaguccuc

SEQ ID NO: 84777 - RNA, 64 nt, Human
cccaaggaacacccauggugcaguccucaggcaaggccaggacggggcugaggcccugcgugga

SEQ ID NO: 84778 - RNA, 64 nt, Human
guauuuuuuaguagagacagaguuucaccauguuggccaggauggucucgaucuccugaccuug

SEQ ID NO: 84779 - RNA, 64 nt, Human
ugugaauucugcuccugccaugaggagcucagaaggccaggaagccagcaauaggggagagaau

SEQ ID NO: 84780 - RNA, 64 nt, Human
auuuucuagaaucccuucaguuuuagcuaccaacggccaggaaaagcccucaucuucucuuucu

SEQ ID NO: 84781 - RNA, 64 nt, Human
aaaauaaaaaaaauuagcuaggcauaguaccugaggccaggagguccaggccgcaaugagaugu

SEQ ID NO: 84782 - RNA, 64 nt, Human
cccuuuggaagguaaagacgggaggaucacuugaggccaggaguucaagaccagccugggcaac

SEQ ID NO: 84783 - RNA, 64 nt, Human
accaagacuugaaggugccuugcucaauggaagaggccaggacagagcugacaaaauuuugcuc

SEQ ID NO: 84784 - RNA, 64 nt, Human
gagauuaaaggacagggcauugauggaagguaagggccaggagaagaggccuuucugcuguguc

SEQ ID NO: 84785 - RNA, 64 nt, Human
uguauuuuuaguagagacgggguuucaccauguuggccaggauggucucgaucuccugaccuca

SEQ ID NO: 84786 - RNA, 64 nt, Human
ccuggguuagggguugggggucggccccuuccagggccaggagggcagguucccucucuggugc

SEQ ID NO: 84787 - RNA, 64 nt, Human
ggggaggggaggcugaggcguuuggccccggccuggccaggagaggcccauccccagggcaguu

SEQ ID NO: 84788 - RNA, 61 nt, Human
aaagagaaggggcuuugugaacauggugcaaggccaggaauuuugggagcaaaaaccaagu

SEQ ID NO: 84789 - RNA, 64 nt, Human
gccuuuaggcaggaagucaggagccagcagggcgggccaggagaaagaaggcuuaacauuaagu

SEQ ID NO: 84790 - RNA, 64 nt, Human
cagaggguucagagugggaggcggggccagcccaggccaggagcgccucaucuucccaggccuc

SEQ ID NO: 84791 - RNA, 64 nt, Human
cugccacggcaggcccaggccagccagugcccgaggccaggaaggccgggccguggagguccug

SEQ ID NO: 84792 - RNA, 64 nt, Human
uugauccaugaggaaaagaugcucucccaccuaaggccaggaaucugagagcaggacuggcuga

SEQ ID NO: 84793 - RNA, 64 nt, Human
cgcuuugggaggcugaggcaggaggauugcuugaggccaggaguuuaaguuacagaacuaugau

SEQ ID NO: 84794 - RNA, 64 nt, Human
ugagggggacucccugucuccugaggcccagcugggccaggacuccauccuuucagaugccccu

SEQ ID NO: 84795 - RNA, 64 nt, Human
uugagaucaagaaaaccuaaucuucugacucccaggccaggauguuuuauuucucacaucaugu

SEQ ID NO: 84796 - RNA, 64 nt, Human
uguguuuuuaguagagaggagguuucaccguguuggccaggauggucucaaucucuugaccuug

SEQ ID NO: 84797 - RNA, 64 nt, Human
uagcccugcccccucccaggagcccagccccucuggccaggacugaggaggaguggagggaagc

SEQ ID NO: 84798 - RNA, 64 nt, Human
gcauggcuccggaagcagacacaggccaggccugggccaggagucugccaggagccaggagcgc

SEQ ID NO: 84799 - RNA, 64 nt, Human
gcugggcaugggagagaaacgggcuggggagugaggccaggagugggauucagcugcagcaggg

SEQ ID NO: 84800 - RNA, 64 nt, Human
ggcccuaaauuguuuuuuguucccaucaguuucaggccaggacuggagaggccacauuaccaag

SEQ ID NO: 84801 - RNA, 64 nt, Human
gagacuaaaagucagagcugaagggagucgcuggggccaggacggcaugcaggccuguacccug

SEQ ID NO: 84802 - RNA, 64 nt, Human
gcugcuggcauauuccaggugcauccaggccuguggccaggagagaggccaggugacaggggcc

SEQ ID NO: 84803 - RNA, 64 nt, Human
uuuuauucuguaccuugcagccaugaccaguucuggccaggagcuggaggagcaggcagugggu

SEQ ID NO: 84804 - RNA, 64 nt, Human
acacaggaagcugccccacugggcagugcccucaggccaggauccccuuagcaggguccuuccc

SEQ ID NO: 84805 - RNA, 64 nt, Human
cgcgggagaccccuuguugcacugcccccugcuuggccaggaggugagagaaggaugggucccc

SEQ ID NO: 84806 - RNA, 64 nt, Human
ucacgagggcaggggguuuaaaacaagaaugauaggccaggaaggcaguggggauccaccauca

SEQ ID NO: 84807 - RNA, 64 nt, Human
gaggccuaccucucguuucugcccagcccucuguggccaggagcccuggcccgcaagagggaca

SEQ ID NO: 84808 - RNA, 64 nt, Human
ggaagucccgcgaaacccggugcaucuggcacguggccaggagccaugacaggggcgcuuggga

SEQ ID NO: 84809 - RNA, 64 nt, Human
uguauucuuaguagaaacgagguuucaacauguuggccaggauggucucaaucucuugaccucu

SEQ ID NO: 84810 - RNA, 64 nt, Human
gugugcugacuuuuuaacaugguauuaucaacugggccaggagguaguuucucaugacggcuuu

SEQ ID NO: 84811 - RNA, 64 nt, Human
ccgaggaggggggcagcuagcgagcgcccgaacuggccaggacccccgcgcccgccgcacagcg

SEQ ID NO: 84812 - RNA, 64 nt, Human
agacgucucugcaagaagccuggagucuguuucaggccaggaggaggggauuugcugagggcca

SEQ ID NO: 84813 - RNA, 64 nt, Human
aagcaaugggucugugacucaaaaauugagcccuggccaggaaaauguggagacaguucuucuc

SEQ ID NO: 84814 - RNA, 64 nt, Human
gacucacccaagcauauauaacuagcuagaagugggccaggacaggcccggcgcgguggcucac

SEQ ID NO: 84815 - RNA, 64 nt, Human
ucccagggauccucaggccuccccuuccuuagcuggccaggagugcccuaaggguaagagggag

SEQ ID NO: 84816 - RNA, 64 nt, Human
augaaguuguauagaaacagaaccauggauggauggccaggauugccguggucccuagcuagau

SEQ ID NO: 84817 - RNA, 64 nt, Human
ccucccuccaugcccacucccccugccuccagcaggccaggaagaaggcacaguccaggcaagu

SEQ ID NO: 84818 - RNA, 64 nt, Human
ggcacccauaggaaggggccucaggagcaggaagggccaggaccagaaccuugcccacggcaac

SEQ ID NO: 84819 - RNA, 64 nt, Human
agugcugggauuauaggcaugagccacugugcuuggccaggauuuuuuuuuuuuuuuuuuugag

SEQ ID NO: 84820 - RNA, 64 nt, Human
uggcuuuaguagucuggagaaaucuacuccccuuggccaggacaugcugcugcuacugcuaaca

SEQ ID NO: 84821 - RNA, 64 nt, Human
uuauugaucuucuacauacaagacuucaccauaaggccaggagcaguggcucacaccuuguaau

SEQ ID NO: 84822 - RNA, 64 nt, Human
guuuuucucccacugggucaccucaaggaucagaggccaggaaaaaaaaaaaaaagacucccug

SEQ ID NO: 84823 - RNA, 64 nt, Human
ucagucguguggccugggagaaccaggagccgccggccaggagacacaaaacuccgcucccacc

SEQ ID NO: 84824 - RNA, 64 nt, Human
gguugagcuuuuuuagaaagucgaagugaauguuggccaggaaaauggaaaagccauuguauaa

SEQ ID NO: 84825 - RNA, 64 nt, Human
uuaauguaauaaaucuuuauugagcacugcugguggccaggagugcggucuacuuggggaacug

SEQ ID NO: 84826 - RNA, 64 nt, Human
agcccgcuccugacccuuaucuucccagagaccaggccaggaaggcccgagauggagagcacua

SEQ ID NO: 84827 - RNA, 64 nt, Human
uuacagugggggcaccaagaccccaaagggcccaggccaggagacuguuaaagugaaaaggcaa

SEQ ID NO: 84828 - RNA, 64 nt, Human
cccagccugcuguucccgcuuuccauauagcuuuggccaggaaagcaugcaauagacuugcucg

SEQ ID NO: 84829 - RNA, 64 nt, Human
cccggcagacacagcaggacagggcucuaugugcggccaggacagcagaggcugaggggccggg

SEQ ID NO: 84830 - RNA, 64 nt, Human
cugaguccuuugacuuaguacugacuugcacugaggccaggaaaagaagcacuggaaagcagca

SEQ ID NO: 84831 - RNA, 64 nt, Human
cacuuugggaggcugaggcgggcagaucacuugaggccaggaguucaagaccagcccaaccaac

SEQ ID NO: 84832 - RNA, 64 nt, Human
cacuuugagaagcugaggugggaggagugcuugaggccaggaguucaagaccagccugggcaac

SEQ ID NO: 84833 - RNA, 64 nt, Human
uagugaccuugaaaaccacuggcuuuuagugaguggccaggaaugcuaaauguucugcaguguc

SEQ ID NO: 84834 - RNA, 64 nt, Human
uugagguuacuaaaugaauaaaaacucggaauuaggccaggagacauggaauaccauucauggg

SEQ ID NO: 84835 - RNA, 64 nt, Human
augagugucuggagcgcuucaguucagcuuuaaaggccaggacgggccacacguggcuggcggc

SEQ ID NO: 84836 - RNA, 64 nt, Human
gccaccuggucccuugugcugacucuagcacaguggccaggauccaauacgaguccagggguga

SEQ ID NO: 84837 - RNA, 64 nt, Human
cccuugcccaaacaagaauauucuuaguuccacuggccaggauuuuccuacauagucagaacuu

SEQ ID NO: 84838 - RNA, 64 nt, Human
ucauguggcuucccuuuucuuuguucaagaugagggccaggaggggaaacaucacaccugcccu

SEQ ID NO: 84839 - RNA, 64 nt, Human
uguauuuuuaguagagaugggguuucaccauguuggccaggauggucucgaucucuugaccugg

SEQ ID NO: 84840 - RNA, 64 nt, Human
aguccagggccagguggggcuagguguggcugggggccaggagagcaggaacagaacagagaaa

SEQ ID NO: 84841 - RNA, 64 nt, Human
ccuggagccagguguacaaccacuugccaugaagggccaggaugcccagaugcuuggccccugu

SEQ ID NO: 84842 - RNA, 64 nt, Human
cuacucaggaggcugaggugggaggaucaccuaaggccaggaggucaaggcugcggugagccgu

SEQ ID NO: 84843 - RNA, 64 nt, Human
cacuuuggagggcugaagcaggaggauugcuugaggccaggaguuugagaccagccugggcaac

SEQ ID NO: 84844 - RNA, 64 nt, Human
agaauaucuuacuuugcauaguuucaugagcacuggccaggagguuauaaacuggcauuuaggc

SEQ ID NO: 84845 - RNA, 64 nt, Human
augggaaaaaggcuggaaggaaagcaaggcagaaggccaggaguaagcccaagcuaagcugcag

SEQ ID NO: 84846 - RNA, 64 nt, Human
cccagugggauuucuggcugcugaaaccacuuugggccaggaagaacaaggaugaagagguucc

SEQ ID NO: 84847 - RNA, 64 nt, Human
cuaaaagacuaccuuugaaacaggauucuuguauggccaggauccugucugggaaccagaaacc

SEQ ID NO: 84848 - RNA, 64 nt, Human
aaagcugcagagcacauuccaugccagacgcucuggccaggaagcugaggccgggcuugagagg

SEQ ID NO: 84849 - RNA, 64 nt, Human
uccccuuuucccagguacugccuuacaaagcuguggccaggaaguggccgguauaaaggaugcc

SEQ ID NO: 84850 - RNA, 64 nt, Human
uggguacuuacagccuucucuugggaacagccggggccaggacugggucaccuaugagcugaau

SEQ ID NO: 84851 - RNA, 64 nt, Human
uggacccccugagacuaucauuauuaccuccuagggccaggaagccagguagguagucugaguc

SEQ ID NO: 84852 - RNA, 64 nt, Human
acuuccucuuugagagucuggggagagaaaagguggccaggauccuaggacugaaugacucgau

SEQ ID NO: 84853 - RNA, 63 nt, Human
gcccaggcuccaggaagugaccuugggcaguggggccaggaacacguggccugagagcugggc

SEQ ID NO: 84854 - RNA, 64 nt, Human
uggucagaugcuuagggggcauuugugcuccucuggccaggaaagggaacagaguccauccaag

SEQ ID NO: 84855 - RNA, 64 nt, Human
gaagaagccauauuuggcaugggugaagugaaagggccaggagguucuggaggccccuucacuu

SEQ ID NO: 84856 - RNA, 64 nt, Human
agcuagcuggccagguggggaggggcuggggaccggccaggaaggaggggugacuucaucccag

SEQ ID NO: 84857 - RNA, 64 nt, Human
gccaucuggaugaccagaauagcgaaguaaaacgggccaggauaaacccugacagcugagacuu

SEQ ID NO: 84858 - RNA, 64 nt, Human
ucccaggcaugcagagaaagauggugauauuuuaggccaggaguauaccuugcuauaaccuaag

SEQ ID NO: 84859 - RNA, 64 nt, Human
gugaccacguugacgggaguagaguagcgcuguuggccaggaggugucaggugugaguguauuc

SEQ ID NO: 84860 - RNA, 64 nt, Human
ugcagaaggacuucuuccuguacaacgccuccaaggccaggagcaaaaccuacaucaacaugcg

SEQ ID NO: 84861 - RNA, 64 nt, Human
gagcccuccaucaccuucacgcugucccaccaugggccaggaaccaaaccagcacuggguucua

SEQ ID NO: 84862 - RNA, 64 nt, Human
aucgcaggccgggaagcagugcccgccaggccugggccaggagagcuccaggaagggcacugag

SEQ ID NO: 84863 - RNA, 64 nt, Human
cuacuuuggaggcagggaugggaggaucacuugaggccaggaucucaggaccagccuagagaga

SEQ ID NO: 84864 - RNA, 64 nt, Human
gaauuccaggcacugugacugucaagcuggcaagggccaggauugggggaauggagcuggggcu

SEQ ID NO: 84865 - RNA, 64 nt, Human
uguauuuuuaguagagacgagguuucacuguguuggccaggauggucuccaucucuugaccucg

SEQ ID NO: 84866 - RNA, 55 nt, Human
ccuaccuggagaagcuuugaggaagggccaggagccccuucggaccugcccugcc

SEQ ID NO: 84867 - RNA, 64 nt, Human
cugugaaccacuuaggaugugaucacuuucagguggccaggaauguugaaugucuuuggcucag

SEQ ID NO: 84868 - RNA, 64 nt, Human
ggcucugggaauuccugcagagaagagcagggguggccaggagauagugagcagcucccaggug

SEQ ID NO: 84869 - RNA, 64 nt, Human
cuggguaucccccagccccaggaaauguggggucggccaggacccucacagcucugaauuugcu

SEQ ID NO: 84870 - RNA, 64 nt, Human
gaacauauuccuaggcccuuucugccugugucagggccaggaaguagaggcugggaacucuucu

SEQ ID NO: 84871 - RNA, 64 nt, Human
uguauuuuuaguagagacggggguucaccaaguuggccaggauggucucgaucucuugaccuug

SEQ ID NO: 84872 - RNA, 64 nt, Human
uuguauuuuuaguggagacagguuucaccauguuggccaggauggccucgaucucuugaccucg

SEQ ID NO: 84873 - RNA, 64 nt, Human
ccugccagagggaccucaggguguggcauuauagggccaggaaaagaaaaucgguguauccuau

SEQ ID NO: 84874 - RNA, 64 nt, Human
gguagccgugcaggagagggcuggguggggcagaggccaggaggggaccuggugugucaccugc

SEQ ID NO: 84875 - RNA, 64 nt, Human
ucucaggaucggauucuguuuuagaguguuucugggccaggauccgggccccugcccuccucug

SEQ ID NO: 84876 - RNA, 64 nt, Human
agugaggcuccagaggagacuuugaguugaugggggccaggacaccaguccagguaguguugag

SEQ ID NO: 84877 - RNA, 64 nt, Human
aacacaguggauccuuuuugaauguucguggaagggccaggaguuccugugaaaccaggauacu

SEQ ID NO: 84878 - RNA, 64 nt, Human
cccucugcuguuccccagggaccucucauacacuggccaggaggcugcagaacgugugucuccc

SEQ ID NO: 84879 - RNA, 64 nt, Human
uugcuggccccagcccugcuggggauccccgccuggccaggagcaggcacgggugguccccguu

SEQ ID NO: 84880 - RNA, 64 nt, Human
acaaacaagcuuccagaagagacuagagaccuuaggccaggagaugaaggaguucaguagcaaa

SEQ ID NO: 84881 - RNA, 64 nt, Human
uggccccggccccugcccaggugugggugguucuggccaggaaggcacaagguagcugugggcc

SEQ ID NO: 84882 - RNA, 64 nt, Human
ugcacgagagaguccugccccgagcccuagguggggccaggaggugccuuggagaagccagcca

SEQ ID NO: 84883 - RNA, 64 nt, Human
uccacacagcauggggcuucagcugcuggcccaaggccaggagcgcuggguucugcagcagggc

SEQ ID NO: 84884 - RNA, 64 nt, Human
ugcuccgggggguggaggugcuccccacaguccgggccaggacagccucaggggagagugaagg

SEQ ID NO: 84885 - RNA, 52 nt, Human
ccccacccgcucccaccuaggaggccaggaaagggggagcggggcgcccagg

SEQ ID NO: 84886 - RNA, 64 nt, Human
uguauuuuuaguagagaugaaguuucaccguguuggccaggauggucuugaucuccugaccgca

SEQ ID NO: 84887 - RNA, 64 nt, Human
acgaggaagguauccagccucaagucaucauuguggccaggaagauggaauacaccaaauggac

SEQ ID NO: 84888 - RNA, 64 nt, Human
cacuuucgguggccgggguggguggaucacuugaggccaggaguucaagaccacccugaccaac

SEQ ID NO: 84889 - RNA, 64 nt, Human
ucuugaagaccagcccgguaccucucuccccacuggccaggacucugagaucagagcuggggug

SEQ ID NO: 84890 - RNA, 64 nt, Human
gaggguccuugcaauuccagcgaaucggaggccaggccaggacguccuugcucccugcacccuc

SEQ ID NO: 84891 - RNA, 64 nt, Human
cuuggguuuccaacucugcagccuucaggucuggggccaggagugggacccaccauuugugggg

SEQ ID NO: 84892 - RNA, 64 nt, Human
cacuuugggaggccgaggcgggcggaucaccugaggccaggaguuggagaccagccaggccacc

SEQ ID NO: 84893 - RNA, 64 nt, Human
aagucugggggcagaaccugaguguggauggggcggccaggaagaggccccuuccugccggggu

SEQ ID NO: 84894 - RNA, 64 nt, Human
ugccugacucagugaccagugccugugagcauggggccaggaaagucugguaauaaaugugacu

SEQ ID NO: 84895 - RNA, 64 nt, Human
ugcuggugaugguuaaaacaaccugagauggagaggccaggagagaguauaaggggauagcagc

SEQ ID NO: 84896 - RNA, 50 nt, Human
gacaccgcuggagggauuagggccaggauggcccagcugcccuagugugu

SEQ ID NO: 84897 - RNA, 64 nt, Human
uccaacagcagaacuugggggaagcggucgggguggccaggaacauaaacuauguauaggggcc

SEQ ID NO: 84898 - RNA, 59 nt, Human
gguugggcggccagaagugagacccccggggccaggagccccuugagcagagcucugca

SEQ ID NO: 84899 - RNA, 64 nt, Human
cacucugggaggcugaggcgggcagaucaccugaggccaggaguucgagaccagccugccaaca

SEQ ID NO: 84900 - RNA, 64 nt, Human
cacuuugggaggcuaaggcagcuggaucacuugaggccaggaguucaagaccagccuggcaaac

SEQ ID NO: 84901 - RNA, 64 nt, Human
aggaaggcuggagcuuguuccugccccaggaauaggccaggagggaaggccgcagcaggacugc

SEQ ID NO: 84902 - RNA, 64 nt, Human
ccagugucaucuuguggccuggagucgaggucuuggccaggacauaacaagcuguggucugggg

SEQ ID NO: 84903 - RNA, 64 nt, Human
ucaguucucacgccuuccuguccaguggaaugggggccaggagugcuggcuccucguguuuggu

SEQ ID NO: 84904 - RNA, 64 nt, Human
acccugcuuccuguguaccacugaggggcagcugggccaggagcugugcccggugccugcagcc

SEQ ID NO: 84905 - RNA, 64 nt, Human
cugugccaccgcaggcagcgcuccagucgggaauggccaggauggcgcccucuuguuggaguuu

SEQ ID NO: 84906 - RNA, 64 nt, Human
ucuucagccacgcagaaagcucacgugccugcagggccaggaaagggaaaugaucguuucuuuu

SEQ ID NO: 84907 - RNA, 55 nt, Human
ugcucauagagaacaagugagcuggggccaggaggcagcagccgugcagagccug

SEQ ID NO: 84908 - RNA, 64 nt, Human
ucccggcagugcugacccugcagggcaagucaggggccaggaugcccucggaucagggccggga

SEQ ID NO: 84909 - RNA, 64 nt, Human
cuacacaucuugggcucacaagugaggcuguggaggccaggagguucaaguauggaggguagga

SEQ ID NO: 84910 - RNA, 64 nt, Human
gucggggagccccugcccuucaccuagcucccuuggccaggagcgagcgaagcuguggccuugg

SEQ ID NO: 84911 - RNA, 64 nt, Human
cauccugaugcugccuggaagcuuauuuucccguggccaggacgcauuucucugaguggaaaca

SEQ ID NO: 84912 - RNA, 64 nt, Human
accuggcggcaggaagccaaagagacugggccuaggccaggaguucccaaaugugaggggcgag

SEQ ID NO: 84913 - RNA, 64 nt, Human
cggcgguggcucacaccugcauaggcagugcuuuggccaggaggaucccuugaucccuuguggc

SEQ ID NO: 84914 - RNA, 64 nt, Human
gugcuuuggccaggaggaucccuugaucccuuguggccaggaguugggagaccagccuggggac

SEQ ID NO: 84915 - RNA, 64 nt, Human
cacuuuggggggcugagacaggcggaucaccugaggccaggaauucaagaccagccuggccaac

SEQ ID NO: 84916 - RNA, 64 nt, Human
gggugugacaccugcuugacagaggcagggcuguggccaggaccaaccuucaauuccauuccaa

SEQ ID NO: 84917 - RNA, 64 nt, Human
agcacugggauuacaggcaugagccaccaugccuggccaggacauauuugaaauggggagauuu

SEQ ID NO: 84918 - RNA, 64 nt, Human
ccagaguugggggcuaggggaggggggagccagaggccaggaugccugagcccccugaguuccc

SEQ ID NO: 84919 - RNA, 64 nt, Human
ugcucccacagccugggcugacgucagaggccgaggccaggaacugagugaggccccugguccu

SEQ ID NO: 84920 - RNA, 64 nt, Human
acagacuggagacaaugcagaugccagagcaaagggccaggaagggucaaaacauuuuauucuc

SEQ ID NO: 84921 - RNA, 64 nt, Human
ggcucugaaaucuugggcaaaaugacaaggggagggccaggauuccucucucaggucacuccag

SEQ ID NO: 84922 - RNA, 64 nt, Human
cacuuugggaggcugagguggguggaccacuugaggccaggaguucaagaccagcuuggccaac

SEQ ID NO: 84923 - RNA, 64 nt, Human
ggaagaaugauuggcugggaggccgcgggagggaggccaggaggcccggaccaguugggaggag

SEQ ID NO: 84924 - RNA, 64 nt, Human
uguauuuuuaguagagaugggguuucaccauguuggccaggauugucuccaucucuugaccuug

SEQ ID NO: 84925 - RNA, 64 nt, Human
gaagaaaaucagagggaagguuaagguuggcucuggccaggauuccaggcagcagguuggagug

SEQ ID NO: 84926 - RNA, 64 nt, Human
uggguucugcucugagauggucagagaagaugcgggccaggagacuuacucaggugggacuggg

SEQ ID NO: 84927 - RNA, 64 nt, Human
gaugauguccugugacugccccacagagauaaggggccaggagggauugaaaggcaucccaguu

SEQ ID NO: 84928 - RNA, 64 nt, Human
uaaaaaaaaaaaaacaacaaaagaguuuguguguggccaggacuaaacagcugcuucuuaauuu

SEQ ID NO: 84929 - RNA, 64 nt, Human
uuccuguccucucaccuagauuguaagcucccugggccaggacuucagccugccuccgaggguc

SEQ ID NO: 84930 - RNA, 64 nt, Human
cuugcccucugccacaccugucgguggaggcuguggccaggagagacuguagaagcucgguccc

SEQ ID NO: 84931 - RNA, 64 nt, Human
aucucugaggguaaagccggugggaggcucagcaggccaggaggcccaaggacaggacuugcga

SEQ ID NO: 84932 - RNA, 64 nt, Human
ccccacccagugucccaggccacaggagcuuauuggccaggagggaauaaugucccccaauacu

SEQ ID NO: 84933 - RNA, 64 nt, Human
guugugugggcugggcucuggugcccucuucccuggccaggacaccucuccuccugauucccuu

SEQ ID NO: 84934 - RNA, 64 nt, Human
cuccugcccaucccucucuugagggagcagcaggggccaggagcuaccccaggagugggccagg

SEQ ID NO: 84935 - RNA, 64 nt, Human
gcugggccagugcccaggagccauccuggcguggggccaggagcuuguccaaggccacaggccc

SEQ ID NO: 84936 - RNA, 64 nt, Human
cuagacugugcugugugcuggaaaaugaucccggggccaggacagacaaaccagagccucugcg

SEQ ID NO: 84937 - RNA, 64 nt, Human
cuccauagggaaaggcuucucuccaagugugccaggccaggacagcccucccagccaugaaucc

SEQ ID NO: 84938 - RNA, 64 nt, Human
aucauggcuuuuggagggaggugaguuuagggagggccaggaccauccuccuaccccucauacc

SEQ ID NO: 84939 - RNA, 64 nt, Human
cauauggccuauucugggcuagaccagauuugggggccaggagggaagaacuccauaugggaug

SEQ ID NO: 84940 - RNA, 64 nt, Human
augccucuuaggacuggugccuggcacagccgcgggccaggaggcugccacacggaagcaagca

SEQ ID NO: 84941 - RNA, 64 nt, Human
gcagcacagcgugggguccuggcacugcaggccaggccaggaugcccaccccgcccucuacacg

SEQ ID NO: 84942 - RNA, 64 nt, Human
cccaggcccucagaacugagccacaggcugcucuggccaggagagaaacagcucuguuguucug

SEQ ID NO: 84943 - RNA, 64 nt, Human
cauuuugggaggccaagguggguggaucacuugaggccaggaguucaagaccagccuggccaac

SEQ ID NO: 84944 - RNA, 64 nt, Human
augccaagguagggaaugugccuuuuucagaguuggccaggagcuccuggcugggacacggaga

SEQ ID NO: 84945 - RNA, 64 nt, Human
gggaaggagaggacugguuuccuggguucucaggggccaggaggaguaacagaaccaggucugc

SEQ ID NO: 84946 - RNA, 64 nt, Human
aaauacgguggggguagggggcuggaggagcccaggccaggacucugcagccucagagacauca

SEQ ID NO: 84947 - RNA, 64 nt, Human
ccccugcccgagagagcucuggccccgcuagcggggccaggagccgggccucccaccgcagcgu

SEQ ID NO: 84948 - RNA, 64 nt, Human
cgcuaggucaaccccacuguagacaggaaagccaggccaggagaguccgaaugagaauuuauug

SEQ ID NO: 84949 - RNA, 64 nt, Human
gaaauagugugauuagaacacugaucgugugcgaggccaggagaucaagaccauccugacuaac

SEQ ID NO: 84950 - RNA, 64 nt, Human
ccuggguccucuccccaggggcugccagcauccaggccaggaagccuggagccaagaaccuucu

SEQ ID NO: 84951 - RNA, 64 nt, Human
uucuuccccuuaccuuucuucaccuugguuauuuggccaggaauacguaaauucaaacuuguac

SEQ ID NO: 84952 - RNA, 64 nt, Human
uccagugcuguccaugcuucucaucuugugaaauggccaggauccucuccuuugaaaccugcuc

SEQ ID NO: 84953 - RNA, 64 nt, Human
acuauuaugagggaggcauggcuuuccaccgucgggccaggaagagcaccuguugcugcaagcu

SEQ ID NO: 84954 - RNA, 64 nt, Human
caaggugcgcccucgacucccgauuucauuugcuggccaggaaaaucgaaagggaaacacccuc

SEQ ID NO: 84955 - RNA, 64 nt, Human
gaaaggcuggcaagugggagggagucaguggggaggccaggauagaacuagagcugguguccca

SEQ ID NO: 84956 - RNA, 64 nt, Human
aagcagagggugagcaggggcugccccuccaccuggccaggacccccuucggcacccaguugcc

SEQ ID NO: 84957 - RNA, 64 nt, Human
cacuuugggaggccaagacaggaggaucacuugaggccaggagucugagacaagccuaggcaac

SEQ ID NO: 84958 - RNA, 64 nt, Human
gcuggacagccggauaacuggggucauggccaugggccaggagaagacugugcuggguugauuu

SEQ ID NO: 84959 - RNA, 64 nt, Human
ggccugggcaggggguccaggugggccacacaggggccaggauggcggaagauacgggugggga

SEQ ID NO: 84960 - RNA, 64 nt, Human
uaguccuggaaauguuugaggcuagacggggaggggccaggacccacccacugcuccuggggga

SEQ ID NO: 84961 - RNA, 64 nt, Human
ugggcugaguucacccccagggcuggccagauggggccaggagggacagagcaaggggggugaa

SEQ ID NO: 84962 - RNA, 64 nt, Human
gucacugggaagccgacgugggaggguagcuugaggccaggagcucgaaaccaguccgggccac

SEQ ID NO: 84963 - RNA, 64 nt, Human
auugucuuccaagauaggaagccaaguggguccaggccaggagauggggggggcgggggcagcu

SEQ ID NO: 84964 - RNA, 64 nt, Human
ccccugaaacacugacucaggagguuugguugggggccaggagucuguuccuaaauauuccagg

SEQ ID NO: 84965 - RNA, 64 nt, Human
cagccgcagccucugggccggggcggcccccaggggccaggagagagcccuggagucccgcagc

SEQ ID NO: 84966 - RNA, 64 nt, Human
acagugaacacccacguuuauuccugccugcuccggccaggacugaaccccuucuccacaccug

SEQ ID NO: 84967 - RNA, 64 nt, Human
gccugggacaggcccccuuuccccucucucugcaggccaggagggccuccuuccugccacgagg

SEQ ID NO: 84968 - RNA, 64 nt, Human
guuggcuuucgccuguaaucccaacacuuugggaggccaggacagaucacuugaggucaggagu

SEQ ID NO: 84969 - RNA, 64 nt, Human
cacuuuggaaggccgaggugggcagaucaucugaggccaggaguucaagaccagccuggcuaac

SEQ ID NO: 84970 - RNA, 64 nt, Human
ucuguggggcagcggcgggcgcaggcucgacccgggccaggaggcccggggcgcugagcucagg

SEQ ID NO: 84971 - RNA, 64 nt, Human
gaccccacgaggggacauccacccucugggguguggccaggaaaagacaagcucuucagcuugg

SEQ ID NO: 84972 - RNA, 64 nt, Human
ggaaggugcuuuuggccccauugcgaggggccuuggccaggacuggcccuguggccaggaggcg

SEQ ID NO: 84973 - RNA, 64 nt, Human
cauugcgaggggccuuggccaggacuggcccuguggccaggaggcgagaagguggcuguucccg

SEQ ID NO: 84974 - RNA, 64 nt, Human
augugcaaccuguaaaaggucucuccacaccaggggccaggauccaguucccucaucucuggca

SEQ ID NO: 84975 - RNA, 64 nt, Human
agugccaguccugccucagcaucugggucacgucggccaggaguagggugcaggccuccagcag

SEQ ID NO: 84976 - RNA, 64 nt, Human
cacuuugggaagcugaggcagguggaucaccugaggccaggaguucgagaccagccuggccaac

SEQ ID NO: 84977 - RNA, 64 nt, Human
gcugcaccugcugcccuucgauccuuccacacauggccaggacacugccacaauccucggggug

SEQ ID NO: 84978 - RNA, 64 nt, Human
gcaggcgguagaaacaccuggagcgauggaauccggccaggacuccccuggcaccugacaucuc

SEQ ID NO: 84979 - RNA, 64 nt, Human
uguauuuucauuagagaugggguuucaccacguuggccaggauggucucgaucucuugaccucg

SEQ ID NO: 84980 - RNA, 64 nt, Human
cacuuuggaaggcugaggaaggaggaucgcuugaggccaggaguuugagacuagccuaggcaac

SEQ ID NO: 84981 - RNA, 64 nt, Human
cuacuucagaggcugagguggaaggaucacuugaggccaggaguuugaggcugcagugaguuau

SEQ ID NO: 84982 - RNA, 64 nt, Human
ggggcaggcucucuccucucucucuuuguggguuggccaggagguucccccgaccagguugggg

SEQ ID NO: 84983 - RNA, 64 nt, Human
ugcuuugggagacugaggcaggaggaucacuuaaggccaggaguucgagaccagccugggcaac

SEQ ID NO: 84984 - RNA, 64 nt, Human
uugggggcgccggcuagaaaaaguagggugcgguggccaggagggccccugccgcgcggggggc

SEQ ID NO: 84985 - RNA, 64 nt, Human
gugcugcgccaccggaagcagcacgugugagcugggccaggagcccugcccaccuccgugcagc

SEQ ID NO: 84986 - RNA, 64 nt, Human
gcuucugcccguugucuuccugccagcuggguuuggccaggauuucuccgugugggggcuacau

SEQ ID NO: 84987 - RNA, 64 nt, Human
gcucaguccugacgcuugccaccugcuccuacccggccaggauggcugagggcggagucuauuu

SEQ ID NO: 84988 - RNA, 64 nt, Human
gcggggcagggaugaggcccgaggugggggcgguggccaggacaacgggcuggagggucugggc

SEQ ID NO: 84989 - RNA, 64 nt, Human
cacuuugggaggccaaggcaggaggaucguuugaggccaggaggucaauaccagccugggcaac

SEQ ID NO: 84990 - RNA, 64 nt, Human
cuguuugcucccuaguguuuauuacagcuugugaggccaggaguuugagaccauccuaggcaac

SEQ ID NO: 84991 - RNA, 64 nt, Human
agcagaggugaggaccugggaccccugaggggcaggccaggaggagcucgggcgcaggccaggc

SEQ ID NO: 84992 - RNA, 64 nt, Human
acuuugagaccacuaaggcagguggaucaccugaggccaggaguucgagaccagccuggccaac

SEQ ID NO: 84993 - RNA, 64 nt, Human
agugcugggauuacgggcgugagccaccgcgccuggccaggauuucuauuuuuaauauuuuugg

SEQ ID NO: 84994 - RNA, 64 nt, Human
cugaugcuuugggaggacaaggugguucauuggaggccaggaguuagagaucagccugggcaac

SEQ ID NO: 84995 - RNA, 64 nt, Human
cucaucucaccauuuggucaaauuggaagcccagggccaggacccggagguuuagaagaugcuu

SEQ ID NO: 84996 - RNA, 64 nt, Human
uagaagcaaguucaaguccuucccauacucaaguggccaggaccucacaggguauggcugucaa

SEQ ID NO: 84997 - RNA, 64 nt, Human
ggccccggagccccauccugggccugcccuggcuggccaggaccccagcgguucuugguccugu

SEQ ID NO: 84998 - RNA, 64 nt, Human
gaccaccuggggaacaccccuggacccaggcaucggccaggaccccauagagcaccccggucug

SEQ ID NO: 84999 - RNA, 64 nt, Human
cacuuugggaggccgaggcggaaggaaggcuugaggccaggaguucaagaccagccagggcaac

SEQ ID NO: 85000 - RNA, 64 nt, Human
ucucagagggccggcccggcggggggcgccgcggggccaggacugcgcucaggaucccgccccg

SEQ ID NO: 85001 - RNA, 64 nt, Human
acucccccugggacgguaagaccgguaggcguggggccaggacagccagccagcccagcgcccg

SEQ ID NO: 85002 - RNA, 64 nt, Human
cagcacugcaaauaacccaucuuccgggaagggaggccaggaugccucaguguuaaaaugacau

SEQ ID NO: 85003 - RNA, 64 nt, Human
cccagccuguggcugcccccgacaccaggaggagggccaggagaguuccagggggcugaggcac

SEQ ID NO: 85004 - RNA, 64 nt, Human
caucauuucauuucacacccccgaagggaggggaggccaggaggggagcugcuccugccagaag

SEQ ID NO: 85005 - RNA, 64 nt, Human
cccagagcugucaggaccaugaagccaggacagaggccaggagccagcccugcagcccucccca

SEQ ID NO: 85006 - RNA, 64 nt, Human
cacuuugggaggacaagguggguggaucacuugaggccaggaguuugagaccaaccugguuaac

SEQ ID NO: 85007 - RNA, 64 nt, Human
uguaauguugcugcccaacuucaacauucauaauggccaggagaccacacaacagagacauuua

SEQ ID NO: 85008 - RNA, 64 nt, Human
ggugggcaugccugccucaccuucaucaggggguggccaggaggggcccagacugugaauccug

SEQ ID NO: 85009 - RNA, 64 nt, Human
aauauuuuuaguagagacaggguuucaccauuuuggccaggauggucuugaucuccugaccuca

SEQ ID NO: 85010 - RNA, 64 nt, Human
uguauuuuuaguagagacaggguuucaccauguuggccaggauggucucgaucuccugaccuug

SEQ ID NO: 85011 - RNA, 64 nt, Human
ccuggaguccccugggccuggaccgcuucccagaggccaggaaucugccauuacucugcggugg

SEQ ID NO: 85012 - RNA, 64 nt, Human
cacucugggagaccgaggaagggggauugauugaggccaggaguucaagaccagccugggcaac

SEQ ID NO: 85013 - RNA, 64 nt, Human
agcagaguccccaggagccgagggggccacccgaggccaggauggaggugggaggccgagccaa

SEQ ID NO: 85014 - RNA, 64 nt, Human
uagaaacaccagcucagcauggcagcagugcggaggccaggaaacccugaucgccaguuucuaa

SEQ ID NO: 85015 - RNA, 64 nt, Human
cuacucagaaggcugaggcggaaggauugcuugaggccaggaguuccagaucaaccugggcaac

SEQ ID NO: 85016 - RNA, 64 nt, Human
guguuuugggagacuaaggcaagaacauccuggaggccaggaguucgacacuguauaacagaua

SEQ ID NO: 85017 - RNA, 64 nt, Human
ugaagaaccgccuggaagaggaaggccaggguuuggccaggagaacuaagaaggucucaacucc

SEQ ID NO: 85018 - RNA, 61 nt, Human
ccaccacagaggacgaguaggggccacccagggccaggagaacaggaacagaacugagcag

SEQ ID NO: 85019 - RNA, 64 nt, Human
gccaucuuuucuucugcuacuuuggggaguugauggccaggaaagaagccagcacaggguuaaa

SEQ ID NO: 85020 - RNA, 64 nt, Human
aaugcacgugacaccgacugacuucagggaucugggccaggagugugguggacauuggacaaag

SEQ ID NO: 85021 - RNA, 64 nt, Human
gggguuagggucccaguucccaguggaagaaacaggccaggagaagugcgugccgagcugaggc

SEQ ID NO: 85022 - RNA, 64 nt, Human
cugacuucuggagauggauccuuccaucuuguggggccaggaccauggccgaagccccuuggag

SEQ ID NO: 85023 - RNA, 64 nt, Human
gcaaccucuucucaucggcucuuaugcaaguuggggccaggauaggggaggggugcuccucaag

SEQ ID NO: 85024 - RNA, 64 nt, Human
uguuucuguauaauaaagugucugccggcucgcgggccaggauccucucggugggaugggcacc

SEQ ID NO: 85025 - RNA, 64 nt, Human
gggccuggucuccagcaccugcccgaguggccguggccaggauggggugcgcauuccgugugcu

SEQ ID NO: 85026 - RNA, 64 nt, Human
cgcugcuggugcggcugcugcaggcgcugcgcguggccaggaugcccgggcuggagcggagcgu

SEQ ID NO: 85027 - RNA, 64 nt, Human
ggccacggagaugagccuggacccuggagaaggaggccaggagccagccacuggcuggacaggg

SEQ ID NO: 85028 - RNA, 64 nt, Human
ccugacggcuucucggcucuacccucacccuucuggccaggaucccgcagggcaacagccccau

SEQ ID NO: 85029 - RNA, 64 nt, Human
augcccugaacccugaguagacagccccaagcauggccaggaaggccugccccuccucuucugg

SEQ ID NO: 85030 - RNA, 64 nt, Human
accagcuaguguggccagggccugguggccugguggccaggaaguuucagguugaagggaaaug

SEQ ID NO: 85031 - RNA, 64 nt, Human
uuuagcccucccagauagcugccccugccacgcaggccaggagucuucacacucaggcaccagg

SEQ ID NO: 85032 - RNA, 64 nt, Human
cugggcagccaggcugccaaggccagaguggccuggccaggagcucuucaggccucccucucuc

SEQ ID NO: 85033 - RNA, 64 nt, Human
ccuugugagagcccauucccaccauucuaccugaggccaggacgucugggguguggggauuggu

SEQ ID NO: 85034 - RNA, 57 nt, Human
ggccagggcaagccaacuagacaggcuggccaggacccaaccccuagaucccaccaa

SEQ ID NO: 85035 - RNA, 64 nt, Human
ucagcaugccccaagugcccagcauggggcggauggccaggaaugagugaaaacuucccuuccu

SEQ ID NO: 85036 - RNA, 64 nt, Human
ccaugugggugauuuccagcagaccugugguauuggccaggaggccugagaaagcaagcacgca

SEQ ID NO: 85037 - RNA, 64 nt, Human
gccaaguuuuucuggauccuccauugcucgccuuggccaggaaccagcagaccaacugccuuuu

SEQ ID NO: 85038 - RNA, 64 nt, Human
ggcauggggauggguucaggccaggucuuuugauggccaggaguagaugacagggaguugccuu

SEQ ID NO: 85039 - RNA, 64 nt, Human
gggugagcccccguggagucugcagagaggccuuggccaggagcggcgggcuuucccgaggggc

SEQ ID NO: 85040 - RNA, 64 nt, Human
accccuccaugauuccaagggcccagaggggcggggccaggauggcguguccccugccugugag

SEQ ID NO: 85041 - RNA, 64 nt, Human
aaggagaauucgucaugucauucaacacucgugaggccaggaagcuauuaaagggauguuucaa

SEQ ID NO: 85042 - RNA, 64 nt, Human
acuuuugggaggccaagacaggaggaucacuucaggccaggaguucaagaucaaccaaccuggg

SEQ ID NO: 85043 - RNA, 64 nt, Human
cccccagaaaccagggcuucucucuccugagccuggccaggacucaggcuguuccugggcccug

SEQ ID NO: 85044 - RNA, 62 nt, Human
gcucccgccuggccugcugaggccucugcucaggccaggaguccagcugcugaugggcacgu

SEQ ID NO: 85045 - RNA, 64 nt, Human
auguaacugaucacuauauuacaucauuucagugggccaggaaaauagaugucuugcuguuuuc

SEQ ID NO: 85046 - RNA, 64 nt, Human
aagagcaugcaaaacgucgcauugcagagcgggaggccaggaggacucgucguagacaagccag

SEQ ID NO: 85047 - RNA, 64 nt, Human
cccggccaccguccuggggccgagggcgcccgacggccaggaucucgcuguaggucaggcccgc

SEQ ID NO: 85048 - RNA, 62 nt, Human
gcucccgcccggccugcugaggccucugcucaggccaggaguccagcugcugaugggcaccc

SEQ ID NO: 85049 - RNA, 62 nt, Human
gcucccgccuggccugcugaggccucugcucaggccaggaguccaguugcugaugugcacau

SEQ ID NO: 85050 - RNA, 64 nt, Human
ccauguucucuaacagggccagcugagcagcacaggccaggaggccacaguguaagcaauaaca

SEQ ID NO: 85051 - RNA, 64 nt, Human
cugagaucccuagguccugcccuccugguccgugggccaggaugugcagaacaaccacucaggc

SEQ ID NO: 85052 - RNA, 64 nt, Human
aaucgccaggauccccugaagggucugggaugggggccaggagauuagcaacaaggauucauuc

SEQ ID NO: 85053 - RNA, 64 nt, Human
cacuuugggaggcugaggaggguggaucacuugaggccaggaauucgagaccagccuggccaac

SEQ ID NO: 85054 - RNA, 64 nt, Human
ccuagccagccuggguggcucccuagccccaagaggccaggaagggcuggaaggcagggccugc

SEQ ID NO: 85055 - RNA, 64 nt, Human
aagcugugaagaagaaaaaaaccccuggccuuugggccaggaggaaucuguuacucgaauccac

SEQ ID NO: 85056 - RNA, 64 nt, Human
gguuuugaagagucccuuaauaugugguggaacaggccaggaguuagagaaagggcuggcuucu

SEQ ID NO: 85057 - RNA, 64 nt, Human
cagacuuccuccuggaaaacgcuuugguagauuuggccaggagcuuucuuuuauguaaauugga

SEQ ID NO: 85058 - RNA, 64 nt, Human
guuuacagacaauugcacaagcguggggugggcaggccaggacugcuuuuuuuuaaugcuccca

SEQ ID NO: 85059 - RNA, 64 nt, Human
cagggcagccaccaggagagauaugccuggcaggggccaggacaaaaugcaaacuuuuuuuuuu

SEQ ID NO: 85060 - RNA, 64 nt, Human
uguauuuuuaauagagaugggguuucaccauguuggccaggauggucucgaucuccugaccucu

SEQ ID NO: 85061 - RNA, 64 nt, Human
uagagaggaggcuugaaggaaccagcaaugagaaggccaggaaaagaaagagcugaaaauggag

SEQ ID NO: 85062 - RNA, 64 nt, Human
ucaacucagguggcauuuggggugacaucucaaaggccaggaauuccguugacuuguuggcugc

SEQ ID NO: 85063 - RNA, 64 nt, Human
caagugccucagugcccacugggucggcccccauggccaggagggcucaggacaauccucuauu

SEQ ID NO: 85064 - RNA, 64 nt, Human
ccuucaguggggagggggugccaccagggcugucggccaggauugccacuccuguuucagagga

SEQ ID NO: 85065 - RNA, 64 nt, Human
ucuggguggcccuuaugacugccaagacugcuguggccaggaggugccacuggagugugcgugg

SEQ ID NO: 85066 - RNA, 64 nt, Human
acagagaugagaaccagggaagcugugauccacuggccaggacaagucaacaugggugaggguu

SEQ ID NO: 85067 - RNA, 64 nt, Human
acccaccccacgacccgugacuacugugcaagcuggccaggagguagguggagggcaaggccac

SEQ ID NO: 85068 - RNA, 64 nt, Human
ucccaggcaggggugaggguggccuggcccaggaggccaggaaggagggcccugucugccucca

SEQ ID NO: 85069 - RNA, 64 nt, Human
cugggguggggaaagguggcccaguggagccgguggccaggaaggcugaagcccgcuucccaug

SEQ ID NO: 85070 - RNA, 64 nt, Human
gggcaggacccugagaugccaccaggaccugaugggccaggaagggcguggacauggaggcugu

SEQ ID NO: 85071 - RNA, 64 nt, Human
uauuuuaagggugcaggaggacagcagcuaacaaggccaggaaauacucacuucccuccacccu

SEQ ID NO: 85072 - RNA, 64 nt, Human
cagggccccaggggcggggaaggcauggcuugcuggccaggauauucagagguaggcagccaaa

SEQ ID NO: 85073 - RNA, 64 nt, Human
augggaggguuccgcuuaaagaccgccucuuacuggccaggaguggacuugguuagggcuaccu

SEQ ID NO: 85074 - RNA, 64 nt, Human
uguauuuuuaguacagacgggguuucaccauguuggccaggauggucucgaucucuugaccucg

SEQ ID NO: 85075 - RNA, 64 nt, Human
augccaaagccccauggauucaggugcagaagagggccaggacuaggucuucugcccuuucuau

SEQ ID NO: 85076 - RNA, 64 nt, Human
ucagcggggaaguucaccagauuucggcugcuggggccaggacaggcgucuccuagguugugcc

SEQ ID NO: 85077 - RNA, 64 nt, Human
cugcaggacuuccguggcugaggcugugaccggaggccaggaaugccguuggguggauugugag

SEQ ID NO: 85078 - RNA, 64 nt, Human
uagaggggaggugugcaggaaccagcaaugagaaggccaggaaaagaaagagcugaaaaugcag

SEQ ID NO: 85079 - RNA, 64 nt, Human
uagagggggagcuugcaggaaccagcaaugagaaggccaggaaaagaaagagcugaaaauggag

SEQ ID NO: 85080 - RNA, 64 nt, Human
cagugcagccaccagggcagaaaugccgggcacaggccaggacaaaaugcagacuuuuuuuuuu

SEQ ID NO: 85081 - RNA, 64 nt, Human
guugauggucuuuucuguacuggaggccuccugaggccaggaacgugcaaauuugcaggugcug

SEQ ID NO: 85082 - RNA, 64 nt, Human
ggugcuggccaacugaccaucuaccugcccguggggccaggagcacccaagaccacagaaaaga

SEQ ID NO: 85083 - RNA, 64 nt, Human
aggagauagugucucgagcuggacagugaggcaaggccaggagugcccaccagcuugccccgcu

SEQ ID NO: 85084 - RNA, 64 nt, Human
aaaccaagcggcuagaagcccuacagcugccuucggccaggaagugaggauggugugggcccuc

SEQ ID NO: 85085 - RNA, 64 nt, Human
gugugagaauaacacuggcuuuggguagugccauggccaggaguggguuucccugcgucuccuc

SEQ ID NO: 85086 - RNA, 64 nt, Human
augccugugagacuggggcaggaggaucacuugaggccaggaguucaagaucagccugggcaau

SEQ ID NO: 85087 - RNA, 64 nt, Human
uuuucaugacaggucuauauuucuaccugggccaggccaggaaagagacuauuuaagaaaaaaa

SEQ ID NO: 85088 - RNA, 64 nt, Human
aguaacuugccaccuuaaggcagggucauccccgggccaggaggaugagguuguccugaggggc

SEQ ID NO: 85089 - RNA, 64 nt, Human
agugcuaggauuacaggcaugaaccaccgugcccggccaggaauaagcuuuugacuuacccaau

SEQ ID NO: 85090 - RNA, 64 nt, Human
auggcccugagcucccuuuuccucaacucagugaggccaggauuugcucuccaaaaggcuuugc

SEQ ID NO: 85091 - RNA, 63 nt, Human
agggcaaaagugucuguuaaaaaugccccauuaggccaggaucugcugacauaauugccuagu

SEQ ID NO: 85092 - RNA, 64 nt, Human
ucuauugggaguccgaggcagguggauugcuugaggccaggaguuagagaccagccuggccaac

SEQ ID NO: 85093 - RNA, 64 nt, Human
guucgccucaucugaggcccagauaauggugagaggccaggagaccuugucuggaaggcccugg

SEQ ID NO: 85094 - RNA, 64 nt, Human
aucuacuccucuacuccaaauuucucauucuucaggccaggaaaccgagacacagagguaaagu

SEQ ID NO: 85095 - RNA, 64 nt, Human
cacuuugggaggccgaaguggguggaucacuugaggccaggaguuugagaccagccuggccaac

SEQ ID NO: 85096 - RNA, 64 nt, Human
uaacuaucaucaguccugcauuucuuugguggggggccaggagggugcauccaauuuaacuuaa

SEQ ID NO: 85097 - RNA, 64 nt, Human
cacucugggaaccuggguugggaggauugcuuaaggccaggaguuugagaccagcuugggcaac

SEQ ID NO: 85098 - RNA, 64 nt, Human
uuuuuucccccuuccuuuggcuaugaaaacccaaagcccggagugauuguuuucuccuugcuuu

SEQ ID NO: 85099 - RNA, 64 nt, Human
ccuagauuccggauuaggggaugacaucccaaacagcccggaguauuugcagaaggcucaggca

SEQ ID NO: 85100 - RNA, 64 nt, Human
uggacuaucugaucuugguccuggccgagcaaacagcccggagguaagguucagaaaguccccc

SEQ ID NO: 85101 - RNA, 64 nt, Human
ccaccaagguggacgcugggccccgccaggcuggagcccggagggucugcugggcgagcagggc

SEQ ID NO: 85102 - RNA, 64 nt, Human
cugaaagaggcuguccaccuggcggaaccaccggagcccggaggcuugggggcuccgcccuggg

SEQ ID NO: 85103 - RNA, 64 nt, Human
ggucaucgagauggagcuacgaaaggaugagcagagcccggagcuccggccugcugucaagucc

SEQ ID NO: 85104 - RNA, 64 nt, Human
gcuacuugagaggcugaagcagaagaaucucuugagcccggaaggcagagguugcagugagcug

SEQ ID NO: 85105 - RNA, 64 nt, Human
ggcacggcucccccuccuggaccagucccccgcgagcccggagaaggggagacccgugucccac

SEQ ID NO: 85106 - RNA, 64 nt, Human
cguaccagaggcagaucuggaacucgucaacaacagcccggaucacaugcuguuacuggacugc

SEQ ID NO: 85107 - RNA, 64 nt, Human
cacacacaaagcacauugggccaacuauuuaguaagcccggauagacuuauugccaaaaacaaa

SEQ ID NO: 85108 - RNA, 64 nt, Human
ugguccucagagcauugcgugugugucuugcuguagcccggaaaagguuuuguguaaagauucu

SEQ ID NO: 85109 - RNA, 64 nt, Human
cugauucccggccacacuuugcauuucaacacucagcccggaaagaugcucguucgguuguugg

SEQ ID NO: 85110 - RNA, 64 nt, Human
uauuuuacuuuucugauuauauuaaggggcugccagcccggagaaauacuuaagauauggguga

SEQ ID NO: 85111 - RNA, 64 nt, Human
uggggguaaaagcccacccuacagaaaguggaacagcccggagccugaugugaaaggaccacgg

SEQ ID NO: 85112 - RNA, 64 nt, Human
ggccccacgaccugcagcgucgaguccgggagagagcccggagcggcgugccaucucggcucgg

SEQ ID NO: 85113 - RNA, 64 nt, Human
cggccaagcacaaacugggggagaggaggccgccagcccggaggcugcagcccagaaacucuac

SEQ ID NO: 85114 - RNA, 64 nt, Human
ccgcaccucccccaugcaccccacccucccccaaagcccggaucccgagaaagauuuaguagga

SEQ ID NO: 85115 - RNA, 64 nt, Human
acuccacacaugcaggaggcggguggcacgcugcagcccggaguccccguucacacugaggaac

SEQ ID NO: 85116 - RNA, 64 nt, Human
cucuccccagccuggcacaggccgaggcaggaggagcccggacggcggguaggacggagaugaa

SEQ ID NO: 85117 - RNA, 64 nt, Human
ugcaggaacagcacagacccagacgaggggaugcagcccggagccaguaacccggcgccuccuc

SEQ ID NO: 85118 - RNA, 64 nt, Human
accuccucccuccuccccacucacuccaguuuuuagcccggagccuccugugguugacuaucag

SEQ ID NO: 85119 - RNA, 56 nt, Human
augagacugccgccaaguaaagccuuagcccggaugcccaccccugcugccgccac

SEQ ID NO: 85120 - RNA, 64 nt, Human
ugcucccaucugggggcuuccgcagcuucaggggagcccggagcuuugcaagcgucugugcauu

SEQ ID NO: 85121 - RNA, 52 nt, Human
agagcguggaugacuacugaccagcccggacccccagccccugggcuguagg

SEQ ID NO: 85122 - RNA, 64 nt, Human
uuccccgaggcugcgucggaggagcugcagggcgagcccggacggcugccgucuccgccagagg

SEQ ID NO: 85123 - RNA, 63 nt, Human
auuguuucuccuacgguuaauucuucaggaugcagcccggaggaacguggauuugacuuaaag

SEQ ID NO: 85124 - RNA, 64 nt, Human
aucuacgccucggcaccacggggugugggaccccagcccggagagaacagagggaaggagccgc

SEQ ID NO: 85125 - RNA, 64 nt, Human
gcaccuccagagcccacccuaccaccagacacagagcccggaccaccuggaccuacccuccagc

SEQ ID NO: 85126 - RNA, 64 nt, Human
ugcuggagccugggacccauggcacaggccaggcagcccggaggcuggguggggccucaguggg

SEQ ID NO: 85127 - RNA, 64 nt, Human
cgccgcagcaguuaaccuaugaccgugcagagggagcccggaguccgagucaagcauugugaau

SEQ ID NO: 85128 - RNA, 64 nt, Human
ccaccaugcucugcgugccccugaaccucugugcagcccggaaggcugauguacagguguaccu

SEQ ID NO: 85129 - RNA, 64 nt, Human
cacgcaggaggacugacuugacagacgaaagacaagcccggaugacacagggugagaagaguca

SEQ ID NO: 85130 - RNA, 64 nt, Human
aggcugggccuaagcgaagggucaucgcagccccagcccggagcguggagcccuuggggggugg

SEQ ID NO: 85131 - RNA, 64 nt, Human
uucagaccuugaacaaacuuaaaaccuucuugggagcccggacguccaaagagaugucuucugg

SEQ ID NO: 85132 - RNA, 64 nt, Human
uugcuuggucauagagccauagaaggaagcugucagcccggagugccugccaccuagacacuga

SEQ ID NO: 85133 - RNA, 64 nt, Human
gucuguagcagagcaguccaacccagauuagugcagcccggaggcuuagggugcagccucccug

SEQ ID NO: 85134 - RNA, 64 nt, Human
auugcugggauuacaggcaugagccaccacacccagcccggacagcuucuuugggagugcugcu

SEQ ID NO: 85135 - RNA, 64 nt, Human
aaacacccggcccacgcgugcugcagauguggggagcccggaaacaccuggcccaugccuguuc

SEQ ID NO: 85136 - RNA, 64 nt, Human
gaggcagcugagaagugguggccucaggacugagagcccggacguugcuguacugucuuguuua

SEQ ID NO: 85137 - RNA, 64 nt, Human
cuggaguuuaaggccaaggcuuucuccaaaagugagcccggauccuccugggagugaguggugg

SEQ ID NO: 85138 - RNA, 64 nt, Human
gccauggaugggacaggagucuuugucccugcucagcccggaggcugugcacggcccucgucac

SEQ ID NO: 85139 - RNA, 64 nt, Human
acuguccuaacucuccucgcugacccuaucugggagcccggaaccguuagguacugccgaaugc

SEQ ID NO: 85140 - RNA, 57 nt, Human
gguggccaagggccccaugaagcugggagcccggaagcuggacugaaccguggcggu

SEQ ID NO: 85141 - RNA, 64 nt, Human
cacuuggacaugggccccagauaccaugaugcugagcccggaaacuccacauccugugggaccu

SEQ ID NO: 85142 - RNA, 64 nt, Human
aguggcaugacuggagcacagccuccugccucccagcccggacccaaugcacuuucuugucucc

SEQ ID NO: 85143 - RNA, 64 nt, Human
gaacaaacgcaaggaaauaauuuuuauuguuuaaagcccggaaugacuguaacuuucacacaag

SEQ ID NO: 85144 - RNA, 64 nt, Human
ucaaggcaaaagagaacuuuaaguuccuuguuccagcccggaguuuugggaaagaaagaaagga

SEQ ID NO: 85145 - RNA, 64 nt, Human
gacgagcucuguucuggugcgggcaggaggcgggagcccggaucugugcgacugaaggugggag

SEQ ID NO: 85146 - RNA, 64 nt, Human
cagccuggggccucggauaccugcugcccagagcagcccggacccgaaaccuuucaggccccgc

SEQ ID NO: 85147 - RNA, 64 nt, Human
gggcccccuuggccccuaaggaaaugccagagcuagcccggaaggaggagcaagagccaggggg

SEQ ID NO: 85148 - RNA, 64 nt, Human
gucaucugcacuugaugacugcuccccgacccccagcccggacaccucauuccccucccacuac

SEQ ID NO: 85149 - RNA, 64 nt, Human
aucugccaggacgagguaaugucagagcuccaucagcccggacagugggaacuaacuggugcau

SEQ ID NO: 85150 - RNA, 64 nt, Human
gcuccugugguaguccucccaagcugugcugggaagcccggacugaccaaaucacccaauccca

SEQ ID NO: 85151 - RNA, 64 nt, Human
ugcacuuuggggagaaggcugacucugagaaccaagcccggaaguacaugaacgcaguacgaaa

SEQ ID NO: 85152 - RNA, 64 nt, Human
ucaaguaaagaagccauuuccacuacagugagaaagcccggaucccaacaguugucaaauugau

SEQ ID NO: 85153 - RNA, 64 nt, Human
uagaaacucagcagaagcugguaaaaacauggggagcccggaggacaggcugcuguccagggca

SEQ ID NO: 85154 - RNA, 64 nt, Human
cccgccagacuguuagaaaauggacacugugcccagcccggaccuuggcagcccaggccggggu

SEQ ID NO: 85155 - RNA, 64 nt, Human
gcccaggaagacccaccccauucccacuccucugagcccggaggggacaccccaagcuccaagc

SEQ ID NO: 85156 - RNA, 64 nt, Human
ucagagacaggaagucuucagggaaggucaccugagcccggaugcuucuccaugagacacaucu

SEQ ID NO: 85157 - RNA, 64 nt, Human
ugacuauagggaggcacuccugauuccauggagcagcccggacuuugagaaugggcucugguuu

SEQ ID NO: 85158 - RNA, 64 nt, Human
aguuauguuucggaaagagggaaaagaguccccgagcccggaucuugugcugcuuuucucacug

SEQ ID NO: 85159 - RNA, 64 nt, Human
ugcuucuggagacaagagcaaagccuuuuccggcagcccggaaccugggaugagaaacgacagg

SEQ ID NO: 85160 - RNA, 64 nt, Human
acucaggggucagaagcagggacuggggcaggcgagcccggacagggaagaggggcuccgauca

SEQ ID NO: 85161 - RNA, 64 nt, Human
auggauuacuaugagaccaacagccagugcuccaagcccggaauuguguaggugguacacacac

SEQ ID NO: 85162 - RNA, 64 nt, Human
gccucgggagaggugccgcccagcuucccaugccagcccggagcccacagugcugcccagcgua

SEQ ID NO: 85163 - RNA, 64 nt, Human
aucugucccugaggaagccccacuucucuguaggagcccggacucucucaggcaugccccauuc

SEQ ID NO: 85164 - RNA, 64 nt, Human
accaugucaggaccaccuuccucuagagcucgggagcccggagggucuucacccacuccuacuc

SEQ ID NO: 85165 - RNA, 64 nt, Human
cugaagaauuugguuccugaguguacaaacucagagcccggaagccaagaaggguccuuggccu

SEQ ID NO: 85166 - RNA, 64 nt, Human
agagucuaauuuauaugccacggacacuccuuagagcccggauucggaccacuuggggauccca

SEQ ID NO: 85167 - RNA, 64 nt, Human
gcuaguuugcccugggggggcccagcacagccccagcccggagcccagcccccugccccggccc

SEQ ID NO: 85168 - RNA, 64 nt, Human
gagggcagggcuggaccaugggugagggcaggggagcccggagcuuccucuggucaccuggucc

SEQ ID NO: 85169 - RNA, 64 nt, Human
guagaguguuuccucugcucaaggcaauuuccagagcccggaugccaguuucuggccugaauuu

SEQ ID NO: 85170 - RNA, 64 nt, Human
cccagauccccuuggggagccucugcccuccuccagcccggauggcucuccuccauuuugguuu

SEQ ID NO: 85171 - RNA, 64 nt, Human
ugugcaguuacaggcugguggcuuuuaaaccaggagcccggaggaagggugaaagagaaagccu

SEQ ID NO: 85172 - RNA, 64 nt, Human
acgguugggaagggggcucagaagcccccuccccagcccggaacugaccccuccuuccucccuc

SEQ ID NO: 85173 - RNA, 64 nt, Human
agugcugggauuacuggcaugagccacugugcccagcccggauauuuuuuuuuuaauuauuuau

SEQ ID NO: 85174 - RNA, 64 nt, Human
ugcccguguccuggccccuuaccccgcugccugaagcccggaggccacgccuguuggggcugau

SEQ ID NO: 85175 - RNA, 64 nt, Human
uuuucuccaucagggcacgugggcggcuuccucaagcccggaggagcucccaggcgcacagggg

SEQ ID NO: 85176 - RNA, 64 nt, Human
gcucgcuacacuacuccugaggaugcuacucccgagcccggagaggacccacgcgugacccggg

SEQ ID NO: 85177 - RNA, 64 nt, Human
ccugcggguccucagcugcucccacacuugugccagcccggaggggacuggucccggucaccgc

SEQ ID NO: 85178 - RNA, 64 nt, Human
ccccgggacagaaccccgggagcacugcccuaggagcccggaccccacgagcucagucccagcu

SEQ ID NO: 85179 - RNA, 64 nt, Human
gggggaccgaggggcagcagauaggagagcacugagcccggauaguucucagccuggcaagugg

SEQ ID NO: 85180 - RNA, 64 nt, Human
cccaccagggccuuccgggcugcucucuucccugagcccggaaccggcgacgcacaugugucuu

SEQ ID NO: 85181 - RNA, 64 nt, Human
uaccgacagugagcagggcaggcagacucaacuaagcccggaccugugguggcacacugggcag

SEQ ID NO: 85182 - RNA, 64 nt, Human
aagugccuguaggaaaauggcgauggcugagaaaagcccggaggagaugcuccuagcuaugacu

SEQ ID NO: 85183 - RNA, 64 nt, Human
gggcgcggcgcuggguugccacacuugggaaagcagcccggagcugggugcuggggaaggcggg

SEQ ID NO: 85184 - RNA, 64 nt, Human
aaaagaagccaauggagggagagggagcgucagaagcccggaggagcugguggugggagaauga

SEQ ID NO: 85185 - RNA, 64 nt, Human
cgcagucugcagagccgccgccgccgcccgaaccagcccggaucugagggcccuguccagcugc

SEQ ID NO: 85186 - RNA, 64 nt, Human
uggccgcggaccccucccaccccugccuugccggccccugcacauuuaggauaugcuccugggu

SEQ ID NO: 85187 - RNA, 64 nt, Human
gcgcggcugggcggugcagcuccgcccggcuccgccccugcagcccacacagcacaacgucuua

SEQ ID NO: 85188 - RNA, 64 nt, Human
caagauaucacugacuucaacccagaggaucgagccccugcacccugccuggggcccuggggug

SEQ ID NO: 85189 - RNA, 64 nt, Human
ugugcuguccuagggggagggagagcagagcucgccccugcacugcagccuugugggggagggc

SEQ ID NO: 85190 - RNA, 64 nt, Human
cuucuuaaacuuggaaugauagaugaaauucacaccccugcagaucagaaaaaacaaauagaag

SEQ ID NO: 85191 - RNA, 64 nt, Human
agagggugucugcccuucacaaacaccucucucuccccugcacuagcugucccaagcuuacaua

SEQ ID NO: 85192 - RNA, 64 nt, Human
agaacccuccaucagaguggaaaucagacgggacccccugcagcuucccugaccacgccacuga

SEQ ID NO: 85193 - RNA, 64 nt, Human
cccaggggaacugcagcgcccuccuccccacugcccccugcagccccugagauauuuugcucac

SEQ ID NO: 85194 - RNA, 64 nt, Human
gccccuguccuccccucuguccccccaaccgcccccccugcaugcagccaaauggagcaucucu

SEQ ID NO: 85195 - RNA, 64 nt, Human
gggcacuaggugucauugugcccgaugucuggcuccccugcaggagggaggcuccaggguaaga

SEQ ID NO: 85196 - RNA, 64 nt, Human
aggauuuggcuaugacaugagcacacccaacgcaccccugcacuacuaugagaccguucgcaug

SEQ ID NO: 85197 - RNA, 64 nt, Human
agcccagccccagucacugucagggucgggccagccccugcacugccucgcagaguggccuggg

SEQ ID NO: 85198 - RNA, 64 nt, Human
auggggcagaggcuuccguguccucucccccaacccccugcaagaagcgccgacucccugaguc

SEQ ID NO: 85199 - RNA, 64 nt, Human
ggaagugcucagucauguucauagggucccugguccccugcauggagagcauaaugacagaaga

SEQ ID NO: 85200 - RNA, 64 nt, Human
ggacacaggcuggaccagaugcuguggaugucgaccccugcacugacuauuggauaaagacuuc

SEQ ID NO: 85201 - RNA, 64 nt, Human
uccuuggagccucccgcucccugaagugucucgcccccugcacagcacuggccuuucggaagca

SEQ ID NO: 85202 - RNA, 64 nt, Human
uuccuucuuauuuuguuaugcuggcagccauuugccccugcaugguaugggaucaaagaggaca

SEQ ID NO: 85203 - RNA, 64 nt, Human
gggccaggcaaggccucuggugcccgcugccgucccccugcagugggcucugcuaggccugugc

SEQ ID NO: 85204 - RNA, 64 nt, Human
agcucccauuggcugaagacacugaaguagcccaccccugcaggcagguccugauugaagggga

SEQ ID NO: 85205 - RNA, 64 nt, Human
agggcaggaccucuucccaagcccugcacacccaccccugcagcccuuuuggcuccccuuuucc

SEQ ID NO: 85206 - RNA, 64 nt, Human
ggggucugucaggaaaaaguagaagaaaagccacccccugcacccuccauagccaccaaaccug

SEQ ID NO: 85207 - RNA, 64 nt, Human
ggcauguuggguuugcaggacuggcccacacaguccccugcagguggcagcccucuuuucuguu

SEQ ID NO: 85208 - RNA, 64 nt, Human
ggcucccgaguggaaauguggaacuugaugccacccccugcaauggagagacugauuuaggagc

SEQ ID NO: 85209 - RNA, 64 nt, Human
aucugucccuggaguucccagguucccagcucccccccugcaagccuugaagccuccagcaacg

SEQ ID NO: 85210 - RNA, 55 nt, Human
acaucaaggaugaguucugauguucccccugcaggagcagguucuugggagcgug

SEQ ID NO: 85211 - RNA, 64 nt, Human
ugccuaggcuggagugcaguggcgcgaucuuggcccccugcaaccuccgccucccggguucgag

SEQ ID NO: 85212 - RNA, 64 nt, Human
guggcggugcgcacgggccuccagccgugccuucccccugcaggccccgucugcugggccugcu

SEQ ID NO: 85213 - RNA, 64 nt, Human
ggaaagccuggccagggcuccuuugggccugggcccccugcacugccugguccagaaggggugg

SEQ ID NO: 85214 - RNA, 64 nt, Human
gcugcgugcacaggagcccccaggcagucagcagccccugcagagccuggaagaggaggaggau

SEQ ID NO: 85215 - RNA, 64 nt, Human
auuuccaggccccugaggacuggagaccgcuucaccccugcacuucagacaccguuuguccccc

SEQ ID NO: 85216 - RNA, 64 nt, Human
acuggggacuuuauuuauuucuaguucuuuccucccccugcaacuuccgcugaggggucucgga

SEQ ID NO: 85217 - RNA, 64 nt, Human
gggaaaccucccgaccccugcaccuucguuggagccccugcauccccuggguccagcccccucu

SEQ ID NO: 85218 - RNA, 64 nt, Human
caggauaagccucaggcccugggaaaccucccgaccccugcaccuucguuggagccccugcauc

SEQ ID NO: 85219 - RNA, 64 nt, Human
ccugucccuggcccuaccuccuucccuguccccaccccugcauaaggcaguuguugguuuucuu

SEQ ID NO: 85220 - RNA, 64 nt, Human
ccuccccacaccuggacuccagaauucacccucuccccugcagucuggguucccagacugaguc

SEQ ID NO: 85221 - RNA, 64 nt, Human
accuacccugacucaccguauuuccagucuucuaccccugcaguuauccuaguccagcaaaguc

SEQ ID NO: 85222 - RNA, 64 nt, Human
auggagugggccagcaguagcugccagucuuucuccccugcagcuuccucugcuucuggaauga

SEQ ID NO: 85223 - RNA, 64 nt, Human
gggauaucagucggugacgaucaggcccugggccccccugcaucuuuuauagcagugggugucc

SEQ ID NO: 85224 - RNA, 64 nt, Human
cacgcagcugcuggguucuugcccuaacggcccuccccugcaacauccgucuuggaggagaggc

SEQ ID NO: 85225 - RNA, 64 nt, Human
uuggccaccauuaaacacggggugggggugagggccccugcaauucacggugcaauauucacca

SEQ ID NO: 85226 - RNA, 64 nt, Human
auggagcagaauacuuaagccuggcccccaaaugccccugcacacacacgugccacaccugcgc

SEQ ID NO: 85227 - RNA, 64 nt, Human
aaugugucuauauccuccuucuaacagcaccuucccccugcagcuacucuucagaucuggcucu

SEQ ID NO: 85228 - RNA, 64 nt, Human
agggaugcugccaaaccugccuugcacaggacagccccugcaacaaagaauuauccagacaaaa

SEQ ID NO: 85229 - RNA, 64 nt, Human
gcucacuugaauccagcucagugcucuggguggcccccugcagguggccccugacccugcguug

SEQ ID NO: 85230 - RNA, 64 nt, Human
agugccuuggucuuguuucugugguugguucuagccccugcagagccugggagcugcaggaacu

SEQ ID NO: 85231 - RNA, 64 nt, Human
gagcucugagaacaagaaagaguggacacccguuccccugcaucaucugucuugcgugcuauuu

SEQ ID NO: 85232 - RNA, 64 nt, Human
auccuacaagacacagugaccauacuaauuauacccccugcaaagcccagcuugaaaccuucac

SEQ ID NO: 85233 - RNA, 64 nt, Human
cuaccuccagugcccugagccuccaguccgucucccccugcaugccccaugugggaggugcuga

SEQ ID NO: 85234 - RNA, 64 nt, Human
uggauguggagcuccugcuggaugcgugcccugaccccugcaccagcccuucccugcuuugagg

SEQ ID NO: 85235 - RNA, 64 nt, Human
gggcuagagggagaaugggaaccacccccucaguccccugcacugacucacuccccgacauauc

SEQ ID NO: 85236 - RNA, 64 nt, Human
uucacaguucaagcaccccaaaccugcccuuucuccccugcagacuggcaggugggauuggcuc

SEQ ID NO: 85237 - RNA, 64 nt, Human
accugagguccuggcuccccacccuggcccccugccccugcacucccaugggaaugccgcaggg

SEQ ID NO: 85238 - RNA, 64 nt, Human
caugggaccuuggagaaaacugaacuguuacaaaccccugcacagugccugucaaacagaugca

SEQ ID NO: 85239 - RNA, 64 nt, Human
gacaaacuauggagaacaagcaaaguaugcaggcccccugcagccucccaggacaggcuggcaa

SEQ ID NO: 85240 - RNA, 64 nt, Human
ucugaauguaacucaccauguggugugcaagguuccccugcauuguauugcucacugcagcccc

SEQ ID NO: 85241 - RNA, 61 nt, Human
ucaccaagucugcccacuaagcuccccccgaccccugcaggcugucacaugacucauugag

SEQ ID NO: 85242 - RNA, 64 nt, Human
cagugagugccaaagggcagccccaacaugugcaccccugcauuuccugucaugccacagacug

SEQ ID NO: 85243 - RNA, 64 nt, Human
aacaauggcccuuucacaagcucuugccucacaaccccugcagaaguccuucaacaaaacuaau

SEQ ID NO: 85244 - RNA, 64 nt, Human
agcugcuggaugucaccaagaaggggcucgagugccccugcaggggaggguccaaucuccggug

SEQ ID NO: 85245 - RNA, 64 nt, Human
gagcaaggcuuuucucuguuuccaguaaucggagccccugcacaaaaugaaauaaaggaagugg

SEQ ID NO: 85246 - RNA, 64 nt, Human
agaaccuacggccuauucucagaggauuauguaaccccugcaguggaaacugagccagcuaacu

SEQ ID NO: 85247 - RNA, 64 nt, Human
aaaacuggacaugaaugacugcccccacgccccuccccugcagaguggccagauggaguccuga

SEQ ID NO: 85248 - RNA, 64 nt, Human
uggucuuucuaaugugugaaucagagcacagcagccccugcacaaagcccuuccaugucgccuc

SEQ ID NO: 85249 - RNA, 64 nt, Human
gugacuagacguccuaacugggcagcccaacccuccccugcaaguuuguagcucaaguuguaau

SEQ ID NO: 85250 - RNA, 64 nt, Human
accauuaggaaaauauggccauacugcuuuuuuaccccugcacuauuucagugcaccacagaau

SEQ ID NO: 85251 - RNA, 64 nt, Human
aacugcuuuauccuccugucagcacccccucccaccccugcaacaaagacuugcuuuaaauaga

SEQ ID NO: 85252 - RNA, 64 nt, Human
cgggaggcagagguugcagugagccgagauugugccccugcacuccagccugagcgacagugag

SEQ ID NO: 85253 - RNA, 64 nt, Human
gauggcccagcaggccuggcccagcucccaguucccccugcaccagccccaccccuagaguccc

SEQ ID NO: 85254 - RNA, 64 nt, Human
gcacauuagugcuuuaccugugaaauuccccgccccccugcacacacacccacuuuaguacagu

SEQ ID NO: 85255 - RNA, 64 nt, Human
uccucugcugucuccccacuaggaucauuccacaccccugcaccugaccaagggaccaaugagg

SEQ ID NO: 85256 - RNA, 64 nt, Human
uggccuggaggccggaggcucuccugagugucugccccugcaguggcuucuugucgccugcugc

SEQ ID NO: 85257 - RNA, 64 nt, Human
gaugcuugaguagagugaagaggggagcacgugcccccugcauccauucucucuuucucuugau

SEQ ID NO: 85258 - RNA, 64 nt, Human
cagcgagugugcacccccaguuuccuucccuggaccccugcagagcucacagggcccaggacac

SEQ ID NO: 85259 - RNA, 64 nt, Human
uuuguuuccugcucccagacauaagcccaaggggccccugcacccaagggacccugucccucgg

SEQ ID NO: 85260 - RNA, 64 nt, Human
ggggaggggcugcguggcacagcuagugggccucccccugcacagcccugcauguacuagcacc

SEQ ID NO: 85261 - RNA, 64 nt, Human
aagaaugaacgagcaaaagguauccccgccgugaccccugcagauagcaccggucuuugauccg

SEQ ID NO: 85262 - RNA, 64 nt, Human
agagguucucuccccugccgcugagagggccucuccccugcagcaaacguuugccugggcauug

SEQ ID NO: 85263 - RNA, 64 nt, Human
ugcuucucuggcugccuggucagugcagaggugcccccugcagauguucaauaaaggagacaag

SEQ ID NO: 85264 - RNA, 64 nt, Human
ccucgacgggagauccccgaucacuggcauucacccccugcaaaaaucggggcgacaauagcuc

SEQ ID NO: 85265 - RNA, 64 nt, Human
cccugaaccccuggguggguggcacagcagugccccccugcagccuuccccucuacacaggaca

SEQ ID NO: 85266 - RNA, 64 nt, Human
uuuuuggucuuggcucguauacuaggcuuaggguccccugcaugcccugaaccccugggugggu

SEQ ID NO: 85267 - RNA, 64 nt, Human
gggcugacucccugcuuccuccaagcugcugccuccccugcagccagggucugggcagggugca

SEQ ID NO: 85268 - RNA, 64 nt, Human
aauugaugaucccugaagguugaacccacacacaccccugcagccuccccagaugaaguaggug

SEQ ID NO: 85269 - RNA, 64 nt, Human
cuguggaguggggagguugggccuggacccucaaccccugcaaccuucccuagcccccucaaua

SEQ ID NO: 85270 - RNA, 64 nt, Human
cagcccagccccaguacugccaccuuuacaccuaccccugcaaguccccagagggcugcccacg

SEQ ID NO: 85271 - RNA, 64 nt, Human
cuuugaccucaucccccuguuacccuugccaaagccccugcagaauuaccuacuuuuggagcca

SEQ ID NO: 85272 - RNA, 64 nt, Human
ccuccacaggcauggaguccccgcaaaaaccuggccccugcaggagucaggccuggucucacgc

SEQ ID NO: 85273 - RNA, 64 nt, Human
acaugccaggucaccaggucaccgucuccuuccaccccugcagugugcuguugugcacgucagg

SEQ ID NO: 85274 - RNA, 64 nt, Human
gaccuaggauauaacaaagcucuucacuucaaaaccccugcaauagcuggguuuacagacauuu

SEQ ID NO: 85275 - RNA, 64 nt, Human
agugggaaggagaggagugagugaaguagccuguccccugcagguccucugcgauggcauuguc

SEQ ID NO: 85276 - RNA, 64 nt, Human
gagccagaucaaccucauugauaagaaauggaagccccugcaagguguggggaaccuggcagca

SEQ ID NO: 85277 - RNA, 64 nt, Human
augccauuuuucugaaguagccucacauguggucccccugcaguucagcaguuaacagaugacu

SEQ ID NO: 85278 - RNA, 64 nt, Human
auauauaaaauaucuauauucuauacacacccugccccugcaaagacaguauuuauuggugggu

SEQ ID NO: 85279 - RNA, 64 nt, Human
gaaaggagggugguuuccgugggggcucauccaaccccugcacaggucacagcaggugcccugc

SEQ ID NO: 85280 - RNA, 64 nt, Human
ccacagccacugugcccugccguuuccugcugggccccugcauaugccccugagccuggggcug

SEQ ID NO: 85281 - RNA, 64 nt, Human
uggguugcuggggccaggagggucucuccuccagccccugcacacucccacccaggacagcccc

SEQ ID NO: 85282 - RNA, 64 nt, Human
aacccuggcaguucugcucccuuccuaggaucugccccugcauuguagcuugcuuaacggagca

SEQ ID NO: 85283 - RNA, 64 nt, Human
uuuugauauuaguaauuucucuaagaaaacuagcccccugcaacuugaguuugugguuuaucua

SEQ ID NO: 85284 - RNA, 64 nt, Human
gacguccugucuuggaaggacuacuacucaauggccccugcacuacucuacuuccucuuaccua

SEQ ID NO: 85285 - RNA, 64 nt, Human
cuguucaucccacaucguguggggcaguguccauccccugcagcuacuuggugacuuaacaacu

SEQ ID NO: 85286 - RNA, 64 nt, Human
ggcuucuguuggcauuuaagccuaaagacacucaccccugcagugcaugggacagccuggcaca

SEQ ID NO: 85287 - RNA, 62 nt, Human
uggaugguugcaagcuguagccaccugcauggccccugcagcacucaccaguugcaucuugu

SEQ ID NO: 85288 - RNA, 64 nt, Human
uaaacgcuuaccauuguuguguucaugucucuagccccugcacacugcaggccccucucagcuu

SEQ ID NO: 85289 - RNA, 64 nt, Human
aaugaggcugaguguuuguuucuacugaucaaugccccugcagguugcauuuauuguaaugaaa

SEQ ID NO: 85290 - RNA, 64 nt, Human
ucuaaaaauguuuaaauauauaccaaacaguggcccccugcauuaguuuucuguugccacugca

SEQ ID NO: 85291 - RNA, 64 nt, Human
acaacuccuggccaggcccuguccuccccacguaccccugcauccccagccucgacccagggac

SEQ ID NO: 85292 - RNA, 64 nt, Human
ccugcagagggucgguggaggggucauucaccugccccugcagcaagcaaaaguugucuguggu

SEQ ID NO: 85293 - RNA, 64 nt, Human
ccucagaagugucaucucucucugagcacgcauuccccugcagcagucgaggacugagcagauu

SEQ ID NO: 85294 - RNA, 64 nt, Human
augcaucuggugggagaggguggggagguuguggccccugcaggggcagaguauccuagggugu

SEQ ID NO: 85295 - RNA, 64 nt, Human
agggguugugguccccaaccugccuucugcucugccccugcacaggacccaaaggccccaggcc

SEQ ID NO: 85296 - RNA, 64 nt, Human
guggugggcaggccaguggcagggccggccccagccccugcauggauuccuuguggcuuuucug

SEQ ID NO: 85297 - RNA, 64 nt, Human
aauggcagaguuagcaccccacucucccaagccaccccugcaagcagcacagcagggcauauac

SEQ ID NO: 85298 - RNA, 64 nt, Human
gaaggagcugugcccacccuguacacuuggcuucccccugcaacugcagggccgcuucuggggc

SEQ ID NO: 85299 - RNA, 64 nt, Human
ggagcuucaggugagcacugcucauguguggaugccccugcaacaggcuucccugucuguagag

SEQ ID NO: 85300 - RNA, 64 nt, Human
caauggcagauuaucgacaucuuugaagcuggggccccugcaaccucggggagugccacuucgg

SEQ ID NO: 85301 - RNA, 64 nt, Human
uaucuucuucauggagccuuuuuuccucccccauccccugcagcugccuuuuuuugggggcagg

SEQ ID NO: 85302 - RNA, 64 nt, Human
caagccacauccacgucccugguuaaaggugcucccccugcaggaaacacaugugcacuuggga

SEQ ID NO: 85303 - RNA, 64 nt, Human
ggaguuggggccuccuccagcagagacccucggaccccugcagggccuggacuuggggugaaca

SEQ ID NO: 85304 - RNA, 64 nt, Human
ucagccgccucuguugcucucggagccccggcuuccccugcaccgggaaagcgcccccucucga

SEQ ID NO: 85305 - RNA, 64 nt, Human
ugcucucucucucucugaagucugcugagagcuuccccugcacaauaaaacuuggccuccacaa

SEQ ID NO: 85306 - RNA, 64 nt, Human
gcgggcaggggagccggaccagggaggacgguggccccugcaucuggccugcugcuccccaggu

SEQ ID NO: 85307 - RNA, 64 nt, Human
uaaaggaaacauugcucaacucuucagcccccucccccugcacaccuguuuucucauuugcccu

SEQ ID NO: 85308 - RNA, 64 nt, Human
gccgagcugccugccccuuccagcugggcagaguccccugcaaggaggcagggcccagcuucca

SEQ ID NO: 85309 - RNA, 64 nt, Human
cagggcggggccgacacccugagcucacagguggccccugcauucagguggauguccauccuug

SEQ ID NO: 85310 - RNA, 64 nt, Human
gggugggcgggagggggucccccagcaggugcggccccugcaccugccggcgacacuccugccg

SEQ ID NO: 85311 - RNA, 64 nt, Human
ucuacacauuuguguucuuuagaaaaaggcccacccccugcacaagcacagccucuugggcaga

SEQ ID NO: 85312 - RNA, 64 nt, Human
acacuuaauguaccuuuucaguccuucucccaacccccugcaaauugucuuuaaaacaacaaca

SEQ ID NO: 85313 - RNA, 64 nt, Human
acaaggcccagaaaaccagcagguccuccagcauccccugcagcgguucccuggacgggcggga

SEQ ID NO: 85314 - RNA, 52 nt, Human
cugucagggcgagcugguagacccccugcaaccgcugcugcaagacacugga

SEQ ID NO: 85315 - RNA, 64 nt, Human
uccaauuguguagacgauauacucccugcccuucccccugcaaaaagaaaaaaagaaaagaaaa

SEQ ID NO: 85316 - RNA, 64 nt, Human
cugagacgaaauucagauuaggagauauuuuaggccccugcaacuggggaaggcuacuguuugu

SEQ ID NO: 85317 - RNA, 64 nt, Human
aagauauucugaguucaagaacccuguccagugcccccugcauugcuuuuccuuuuaaaaagua

SEQ ID NO: 85318 - RNA, 64 nt, Human
gugaugcacuaagccuuaauccuggacaccaguaccccugcagcauggcuugcucaacaacagu

SEQ ID NO: 85319 - RNA, 64 nt, Human
caugcuggacaucccuuguaacccgguaugggcgccccugcauugcugggauguuucugcccac

SEQ ID NO: 85320 - RNA, 64 nt, Human
aaccuccccuucugaggcugcuuucccaaaacucccccugcaucuuuaucucuucaucuauccc

SEQ ID NO: 85321 - RNA, 62 nt, Human
caggaggcagagauugcagugagccaagaucacgccccugcacuccagccugggugacagag

SEQ ID NO: 85322 - RNA, 64 nt, Human
uuaagagcuugaucugugauuucuucucccuccuccccugcaagagugguccuaggagaggacc

SEQ ID NO: 85323 - RNA, 64 nt, Human
cuccaugucuggauggggccggcagguccuguguccccugcaccuggaggagagcaggcuagag

SEQ ID NO: 85324 - RNA, 64 nt, Human
agggcaggggccgugcagggccagucauggcuguccccugcaaguggacgugggcuccagggac

SEQ ID NO: 85325 - RNA, 64 nt, Human
gcccagcgucuaucaccuugugauggauuuaaagccccugcaccuggaacuguuugcuuuccug

SEQ ID NO: 85326 - RNA, 64 nt, Human
augugguggggacagcgcauugcgaccuccaccaccccugcagugggcugccagcugagccacc

SEQ ID NO: 85327 - RNA, 64 nt, Human
cacagagagacaguucucagucagcacuuccuguccccugcagaggcucauaggggacagcccc

SEQ ID NO: 85328 - RNA, 64 nt, Human
caagcaggugcugcaggagauuggcaucccccagccccugcaguuagaaaccccgaagucuucc

SEQ ID NO: 85329 - RNA, 64 nt, Human
aaaugcccaguucacuucuuugcagagccuuuuaccccugcacaguuuagaacagagggaccaa

SEQ ID NO: 85330 - RNA, 64 nt, Human
acuguuggaaguucacacuggggaaacucauuuuccccugcagcucccccaaggugcaggaggg

SEQ ID NO: 85331 - RNA, 64 nt, Human
cacuccacccuggccugcucagagccucaguuuaccccugcauuaaaaugguggggggacuggu

SEQ ID NO: 85332 - RNA, 64 nt, Human
ugacaagccacguccccucccaccucuccccaaaccccugcaucccuguauucacacgggucac

SEQ ID NO: 85333 - RNA, 64 nt, Human
cagggucagcccagcgaggagucccugcaauaagccccugcauuugccaagcuccaaagacucc

SEQ ID NO: 85334 - RNA, 64 nt, Human
gggaaggggcaggacucaucaggaccucccuggaccccugcagggcaggcagcuugggcccgag

SEQ ID NO: 85335 - RNA, 64 nt, Human
ggagcaggggucugugucuacagaugggcuguggccccugcaggcagcuguugaacacuggagg

SEQ ID NO: 85336 - RNA, 64 nt, Human
uacucuccccacgagggcuggcuggccucacccaccccugcacaguugaagggaggggcugugu

SEQ ID NO: 85337 - RNA, 64 nt, Human
acauaugaauuuuggaaggacauaagcauucaacccccugcacaugucuucuuuccuacuuccu

SEQ ID NO: 85338 - RNA, 64 nt, Human
ucugacuugcucaaaccagaggaggaaacagaaaccccugcacaucuuuuuaggggguucuuug

SEQ ID NO: 85339 - RNA, 64 nt, Human
caggaggcggagguugcagugaguugcagucacaccccugcacuccagccugggugacagcuag

SEQ ID NO: 85340 - RNA, 64 nt, Human
cuaauauauggaccuagcuugaggcaauuuuaauccccugcacuaggcagguaauaauaaaggu

SEQ ID NO: 85341 - RNA, 64 nt, Human
auauagucaucuauagggggauugguuccaggauccccugcagaugccaaaauacauggaugcc

SEQ ID NO: 85342 - RNA, 64 nt, Human
uuagagcuggggggggugggggguggggcuuguuccccugcaguaucuguucugugaaguuugu

SEQ ID NO: 85343 - RNA, 64 nt, Human
uucagccccugaacuccccgguggugaccccucaccccugcacugagcccccuuagaucuacug

SEQ ID NO: 85344 - RNA, 64 nt, Human
cugagccucugucgggggcuaagccagccuggcgccccugcagauuccagcagggucccucuga

SEQ ID NO: 85345 - RNA, 64 nt, Human
cauuugaacgccagguaucuccccuccucucucuccccugcagaggcauguagggaacagcagg

SEQ ID NO: 85346 - RNA, 64 nt, Human
cauuggucccagaguagcugaagggaagccaaccccccugcagcacaaauaggccccccagucc

SEQ ID NO: 85347 - RNA, 64 nt, Human
gugggcaggugauucugugggcaggggaugugcuccccugcaccucuggggugcagaaaccucu

SEQ ID NO: 85348 - RNA, 64 nt, Human
agaugggacagccagcccugccuaucuggacaggccccugcagccucuguccccuggccuagcc

SEQ ID NO: 85349 - RNA, 64 nt, Human
uuggacuuggaaggugugcggggacuggccgaggccccugcacccugcgcaucaggacugcuuc

SEQ ID NO: 85350 - RNA, 64 nt, Human
cuguuaacacuguguccugggggggcugggaaguccccugcaucccaugguacccugguauugg

SEQ ID NO: 85351 - RNA, 64 nt, Human
cauugauuuaggccacuggcuuagaguacuccuuccccugcaugacacugauuacaaauacuuu

SEQ ID NO: 85352 - RNA, 64 nt, Human
ugcacuccggcugcaaucguauggcuuucucuaaccccugcagucacuuccagaugccugugcu

SEQ ID NO: 85353 - RNA, 64 nt, Human
uucguucagaauagugcuguguguuaccacgucuccccugcaccccauuccuaccuuguagcuc

SEQ ID NO: 85354 - RNA, 64 nt, Human
aaccacuuaggcauguuacgggguaaaguccucaccccugcauuugagaaauauuuuauuauuu

SEQ ID NO: 85355 - RNA, 64 nt, Human
cccaugcaacacccucuucuaguuaccacggcaaccccugcagcuccucugccuuugugcucug

SEQ ID NO: 85356 - RNA, 64 nt, Human
guacaguucuucaguggacaugaccccacccagcccccugcagcccugcugcaccaucucacca

SEQ ID NO: 85357 - RNA, 64 nt, Human
acuuuugugcaugaucugucccucccucuucccaccccugcaguccucugaagagaggccaaca

SEQ ID NO: 85358 - RNA, 50 nt, Human
uacuauuuucuuucagcuaaccccugcaucuacuaugaugaauacuucga

SEQ ID NO: 85359 - RNA, 64 nt, Human
aggccaccaggguagggucuccccagggcuccucccccugcacaacacuccugcacacgugcaa

SEQ ID NO: 85360 - RNA, 64 nt, Human
ucucagauaugugccugauauuuuguggauaccuccccugcacuggcaaaacacuaugcuuuug

SEQ ID NO: 85361 - RNA, 64 nt, Human
ggugauguccuuggcugcugccgucagaggcagcccccugcacagggaggggcugauccugccu

SEQ ID NO: 85362 - RNA, 64 nt, Human
ggcugcugcccccuccuugcccuccacgcccugcccccugcauccccuagagacagcugacuag

SEQ ID NO: 85363 - RNA, 64 nt, Human
caguggaccgggcagguguccaccagcagcucagccccugcagucaucucagagccccuucccg

SEQ ID NO: 85364 - RNA, 64 nt, Human
auguaguaguugggcauauaauccuuccacacagccccugcagggaaaggcuaaucuuacggau

SEQ ID NO: 85365 - RNA, 64 nt, Human
aucccuugguauacuccagggauugguuucaggaccccugcauuuaccaaaauuugugcacacu

SEQ ID NO: 85366 - RNA, 64 nt, Human
agugaauaauuuaaagucuucuccucccccacugccccugcaguaaagugcuuuggcccccacc

SEQ ID NO: 85367 - RNA, 64 nt, Human
cugcacuggcccuuggccuccacacucaguggugccccugcaguugggugggguacgccagcaa

SEQ ID NO: 85368 - RNA, 64 nt, Human
gcagcucccacggagcgggcuugaacagggaccaccccugcagagccagccagggcggagagcc

SEQ ID NO: 85369 - RNA, 64 nt, Human
aggacagugagacgaugccacugcgccacgcucgccccugcacacucacauauguggcaacccu

SEQ ID NO: 85370 - RNA, 64 nt, Human
gguccugaggggacugcugccccucacucggcauccccugcagagucaggacugcucccggggc

SEQ ID NO: 85371 - RNA, 64 nt, Human
aaugaaggaaguucagucuugucuuugauaucagccccugcaaggcgcucaaugggaagguugu

SEQ ID NO: 85372 - RNA, 64 nt, Human
gaaaucacugaauguaaagagguuucaucuaugcccccugcaguuggggaaauacuaguagcuu

SEQ ID NO: 85373 - RNA, 64 nt, Human
aagguguacuugaaaacgaauaucuaucauaugaccccugcacucccucuguaucaucucagga

SEQ ID NO: 85374 - RNA, 64 nt, Human
auaauugcuaugccguacauucagagugcccccuccccugcaaggccuugccaugauuaacaag

SEQ ID NO: 85375 - RNA, 64 nt, Human
ugaagauguuuauauaggguauuuuuuccaacugccccugcauugugccugaaccaauugaauc

SEQ ID NO: 85376 - RNA, 64 nt, Human
aaaaaaaaaucauacagcucuucuucccggaacgccccugcaccucugcuccggugcacaaaug

SEQ ID NO: 85377 - RNA, 64 nt, Human
cugaucugugcccuuggucccaggucaggcccacccccugcaccuccaccugccccagccccug

SEQ ID NO: 85378 - RNA, 64 nt, Human
cugccagcacucugucugguaccuuccccuccugccccugcaccagcuuuggagaauggauuug

SEQ ID NO: 85379 - RNA, 64 nt, Human
uuccugcucuggcccccguggggcugggccuccgccccugcaccagucacaugcacuggacgag

SEQ ID NO: 85380 - RNA, 52 nt, Human
agagggccacacccaccugaggccccugcagccggacaccagcuccaggguc

SEQ ID NO: 85381 - RNA, 64 nt, Human
gagugccgccucuauccccuuccccacguuccagccccugcagcccacauuuuaaguauauucc

SEQ ID NO: 85382 - RNA, 64 nt, Human
ugggagcccuuuggagaacgccagucucccaggcccccugcaucuaucgaguuugcaaugucac

SEQ ID NO: 85383 - RNA, 64 nt, Human
agggcagggcuugucucuuacacaucuuuauaauccccugcagcggcuuucaguauuuuguacu

SEQ ID NO: 85384 - RNA, 64 nt, Human
gagcccucccugaaccccugcaacccucccugaaccccugcaaaugaaaccaaacguccaccug

SEQ ID NO: 85385 - RNA, 64 nt, Human
cuuccccgguugugggacaagagcccucccugaaccccugcaacccucccugaaccccugcaaa

SEQ ID NO: 85386 - RNA, 64 nt, Human
cucucccacuuccaucuggcaucccacgcguuguccccugcacuucuggaaggcacagggugcu

SEQ ID NO: 85387 - RNA, 64 nt, Human
cucucccacuuccaucuggcgucccacaccuuguccccugcacuucuggaugacacagggugcu

SEQ ID NO: 85388 - RNA, 64 nt, Human
ugugagcaccgcacccagcggcaaagagcccuccccccugcagggcuccacccaucacccuccc

SEQ ID NO: 85389 - RNA, 64 nt, Human
augcggcccagccccgaaugccuugaagaagugcccccugcaccaggacuccugagucuccuuu

SEQ ID NO: 85390 - RNA, 64 nt, Human
acgagccauauggggucugcacaagagacccucuccccugcaguaaagccaggggcccuggccu

SEQ ID NO: 85391 - RNA, 64 nt, Human
cgcaaggaaugagguccuuuaugaaagaaagaccccccugcauagccuaagugcuauaucgauc

SEQ ID NO: 85392 - RNA, 64 nt, Human
gcuugggucucucucggccccugucuguucccagccccugcagauucugagcaaaggcccuggg

SEQ ID NO: 85393 - RNA, 64 nt, Human
cagggcagggcgagcugcaggaaucaccccucugccccugcagcuggaaugugccacagaggcc

SEQ ID NO: 85394 - RNA, 64 nt, Human
gccaagaggcgggcggggccagaaauaccucaugccccugcaccagccccuccgucuccaggcc

SEQ ID NO: 85395 - RNA, 64 nt, Human
gcugccucccagcugucuugacugaaggccaccgccccugcaggagcuuggguccucaucuggg

SEQ ID NO: 85396 - RNA, 64 nt, Human
agccuggacucccgagcccacgaggcuguugaggccccugcagccgggcccagcucuucugucc

SEQ ID NO: 85397 - RNA, 64 nt, Human
acccaguucaccuggacaugagugcacacucucaccccugcacaugcauaaacgggcacacccc

SEQ ID NO: 85398 - RNA, 64 nt, Human
ucuguagagaacuauuuuuguuuguauucacuguccccugcaagggggacggggcgggagcacu

SEQ ID NO: 85399 - RNA, 64 nt, Human
ccacgggacguuuggggauggaccucggcccccgccccugcagucagcgucagugcucaucuac

SEQ ID NO: 85400 - RNA, 64 nt, Human
accacgguccaauccagccuucuucccccaggguccccugcauggcugagagggugugggugcc

SEQ ID NO: 85401 - RNA, 64 nt, Human
ccgucauucacagggacauggaaaaagcuccccaccccugcagaacgcggcuggcugcaccccu

SEQ ID NO: 85402 - RNA, 64 nt, Human
gggucgaugauauuucacugaugguagaucgcagccccugcaacguagccuuuguuacaugaag

SEQ ID NO: 85403 - RNA, 64 nt, Human
uguggagcucugagacaccugaaccccuacccauccccugcaccucccuacucucccugccgag

SEQ ID NO: 85404 - RNA, 64 nt, Human
gaugucacaaaguuuggccguggggacucugcauccccugcacccgcuaccacaccagcucagc

SEQ ID NO: 85405 - RNA, 64 nt, Human
uggucaccccagaaccucacugagccuugaccucccccugcagccugagccuucuuacugugaa

SEQ ID NO: 85406 - RNA, 64 nt, Human
ucggucucuuugaggcagccaccgucccugagggccccugcacagagcagcugugggccuguaa

SEQ ID NO: 85407 - RNA, 64 nt, Human
ggaguccgaugguuuucagcaggagacgggguguccccugcagggggcuaaacugcaggggccu

SEQ ID NO: 85408 - RNA, 64 nt, Human
gguuccagccccuggcagggcuuccuuccaagggccccugcagccuacaaacugggccucgggc

SEQ ID NO: 85409 - RNA, 64 nt, Human
ucugucacuggccucagacacaggccccugguguccccugcagggggcucagcuggacccuccc

SEQ ID NO: 85410 - RNA, 64 nt, Human
acccccgaaccuuugugccaggacaccuccugguccccugcaccucuccuguucgguuuagacc

SEQ ID NO: 85411 - RNA, 64 nt, Human
uuacacugacuuuuuagagguucuuccccccccgccccugcagaggaaugaaacuacuuacaac

SEQ ID NO: 85412 - RNA, 64 nt, Human
ucuccucuguuccagcuugucugccagaagccuuccccugcaaggugcccaccugcccggagac

SEQ ID NO: 85413 - RNA, 64 nt, Human
gcuccuguggcugccaggagggcuugacucagacccccugcagcucaagcaugucugcaggaca

SEQ ID NO: 85414 - RNA, 64 nt, Human
uggaaggaagagguugcagugagccaagauugcgccccugcacuccagccugggcaacagagca

SEQ ID NO: 85415 - RNA, 64 nt, Human
auuuguuuuuguacccauuaaccauccccaccucccccugcaaccgucaguacccuuaccagcc

SEQ ID NO: 85416 - RNA, 64 nt, Human
cauguccaguacaucacaaaggagaucggggcgaccccugcagauguggagccauuagcccagu

SEQ ID NO: 85417 - RNA, 64 nt, Human
ugaaguucaaccccuccagggaagcuccugauuuccccugcauaauugaaaauaggauauuucu

SEQ ID NO: 85418 - RNA, 64 nt, Human
ugaggugacgguggccucaggauucagggcccagccccugcaggggcccaggcugccucucauc

SEQ ID NO: 85419 - RNA, 64 nt, Human
ugcccagcccuccagacccggccuuucugguuaaccccugcaugccaagcugccugcugcccca

SEQ ID NO: 85420 - RNA, 64 nt, Human
auucaauuacaaaagcggcagcagccaaugcacgccccugcaugcagcccucccgcccgcccuu

SEQ ID NO: 85421 - RNA, 64 nt, Human
ccucaagucuuucucuuucccuggucccuuguauccccugcaggcugagugcauuuggagggag

SEQ ID NO: 85422 - RNA, 64 nt, Human
guccaguguggcguugaauagauguguauuuccuccccugcagaaaauaagcacagaaaauuau

SEQ ID NO: 85423 - RNA, 64 nt, Human
agaaagcguagacccggggcccagggucugcccgccccugcagccuggccuccccgcacaggcu

SEQ ID NO: 85424 - RNA, 64 nt, Human
gggugaagggcguccgcuggccacucugcaggggccccugcaggauuccaggcaccucccguuu

SEQ ID NO: 85425 - RNA, 59 nt, Human
gauuuggccuuuuugauuaaauuccugcuccccugcaaauaaagccuuuuuacacaucu

SEQ ID NO: 85426 - RNA, 64 nt, Human
caaggugcaccugggugcccgggccucggggcagccccugcagcacugggcagacaugcuggcc

SEQ ID NO: 85427 - RNA, 64 nt, Human
ccuggggcauccauggggucucucacagacaggaccccugcaguuccccuggaagcagugccca

SEQ ID NO: 85428 - RNA, 64 nt, Human
guggauuaacuuucccugaugccgacgccccugcccccugcagcaauaagaugcucggauucac

SEQ ID NO: 85429 - RNA, 64 nt, Human
gaucuauagcacaguuuuguaauucagaucaucaccccugcacuuuguaccacaugggcguauu

SEQ ID NO: 85430 - RNA, 64 nt, Human
aaauaggguguuuucugccuucaaauaaaagucaccccugcauggugaagucuucccucugcuu

SEQ ID NO: 85431 - RNA, 64 nt, Human
cugccuuuuugccuucaccucuuuucuuccccgcccccugcacauucggggucucagcccccag

SEQ ID NO: 85432 - RNA, 64 nt, Human
guggcugggaacucacagccagcauagggacaucccccugcagccuucugaccugcaaucaagg

SEQ ID NO: 85433 - RNA, 64 nt, Human
uggacaucagagucaaaagcacuggcaaaggguaccccugcaaacaacuguggugggggcuggc

SEQ ID NO: 85434 - RNA, 64 nt, Human
cagggacgccuucccuccccuccccuccagcccaccccugcacagccccuccuccuucccgcuu

SEQ ID NO: 85435 - RNA, 64 nt, Human
ugggccaucccccuccacccccacccugaggcucccccugcagguggggggguacccgcaccgg

SEQ ID NO: 85436 - RNA, 64 nt, Human
uggcggccgccugagaccugagcugcugugaaagccccugcacaaucagccagggagaacuggg

SEQ ID NO: 85437 - RNA, 64 nt, Human
agacaaaaaugcaagaagcagcggccuccccuguccccugcagcuuccguggugccuuugcugc

SEQ ID NO: 85438 - RNA, 64 nt, Human
agagcccaugcucaaccacuguggcguucugcugccccugcaguuggcagaaaggauguuuugu

SEQ ID NO: 85439 - RNA, 64 nt, Human
gacucgggaugggguaaccuggggaccagucuagccccugcacccucuucccugccucugcucc

SEQ ID NO: 85440 - RNA, 64 nt, Human
cucgaggcagcaguggguucaggcccaucagcuaccccugcagcuggggaagacuuaugccauc

SEQ ID NO: 85441 - RNA, 64 nt, Human
uugugauccuaauucaaggaauaucaagucccagccccugcaacccaggcugcugcuuaauuuu

SEQ ID NO: 85442 - RNA, 64 nt, Human
cuccuagcccuggggccagccuguuccacaggcaccccugcaggaggcgcugccaggagagccu

SEQ ID NO: 85443 - RNA, 64 nt, Human
cccccaugcccucccugcugccaggcucccacugccccugcaccugcuucucagcgcaacagcu

SEQ ID NO: 85444 - RNA, 64 nt, Human
ccaggcagaacaggcaagaggggagggaaggagaccccugcaggcucccuccacccaccuugag

SEQ ID NO: 85445 - RNA, 64 nt, Human
ucaacguggcccagggaggccaaaagauuggacaccccugcaaacuaaucacaucaaucucucu

SEQ ID NO: 85446 - RNA, 64 nt, Human
agacugacaccaagaacagccaguagguucuucuccccugcacucugcucccugcgcgguaacc

SEQ ID NO: 85447 - RNA, 64 nt, Human
guuuguauugaaacaaaguggugucaaaauaaagccccugcagggccuggcucccuguuggucu

SEQ ID NO: 85448 - RNA, 64 nt, Human
aggguggggauuaugucucuguuuaauaugcagcccccugcacugugggguuuggggcauguuc

SEQ ID NO: 85449 - RNA, 64 nt, Human
acauuuccuuucuacucuuucugccaagagccugccccugcauuuguccugggaaacacgguau

SEQ ID NO: 85450 - RNA, 64 nt, Human
aacaugaggcuggcucugcagcaacaaccaggcuccccugcaucccugggcccagggaguuuac

SEQ ID NO: 85451 - RNA, 64 nt, Human
gcccagcugggccaggacuccauccuuucagaugccccugcaggccuggggcuccuucugggaa

SEQ ID NO: 85452 - RNA, 64 nt, Human
uguaugaaauaaaugcugagugagccccagcccgccccugcaguucccggccucgucaagugaa

SEQ ID NO: 85453 - RNA, 64 nt, Human
cuagauuccaggaaguccagggcgauacuguuuuccccugcagggugggauuugagcugugagu

SEQ ID NO: 85454 - RNA, 64 nt, Human
gggaggcagugucuggaugaugcugugcuaccuaccccugcacaagccaugcuggcucagucug

SEQ ID NO: 85455 - RNA, 64 nt, Human
cucccuagccuucaucagcagagcacccuccaucccccugcauugcucuucugugaaagcaaau

SEQ ID NO: 85456 - RNA, 64 nt, Human
cccagggcuucuacucugccccuggggaauguguccccugcauaucuucucagcaauaacucca

SEQ ID NO: 85457 - RNA, 64 nt, Human
ccagguuccggagcaccaucccacgguggccuucccccugcacgcucugcggggagaaaaggag

SEQ ID NO: 85458 - RNA, 64 nt, Human
aucuguaaauagcccggagggccugcucccggccccccugcacucugccucacaaaggucuaua

SEQ ID NO: 85459 - RNA, 64 nt, Human
cuuugugucaccugccugcgcucuccagauaugaccccugcacccaccccccacagccugcccu

SEQ ID NO: 85460 - RNA, 64 nt, Human
agaggcggguggagcgugaagcaggcuggaggugccccugcacgggagguggcguuugcuaacc

SEQ ID NO: 85461 - RNA, 64 nt, Human
gggugguggaagcaggugucacggugcaagucucccccugcaccccucccccagcuugagccgu

SEQ ID NO: 85462 - RNA, 64 nt, Human
agaugagggagcagcuuggauucuucucaguuguccccugcauggggagauacacuaaccccca

SEQ ID NO: 85463 - RNA, 64 nt, Human
agccugcagcccaggacgacugaagcucuugcagccccugcagacgagagucaggccagcaccc

SEQ ID NO: 85464 - RNA, 64 nt, Human
gcagaggccugaggacaaggaagagcuuugccauccccugcaugugccccugccucuaccuguc

SEQ ID NO: 85465 - RNA, 64 nt, Human
gccuuuagauggccucagccccagccaccauauaccccugcaguuugcacuuuaauugauggua

SEQ ID NO: 85466 - RNA, 64 nt, Human
gagacuuguuuuggaugcccccuaauccccuucuccccugcacuguaaaaugugggauuauggg

SEQ ID NO: 85467 - RNA, 64 nt, Human
ucuucucuccaaggaaaaugaggacugccccuucccccugcaggauuggcccccagccugcgca

SEQ ID NO: 85468 - RNA, 64 nt, Human
agggugccaugccugacagcacgcaucucccugaccccugcacuucccccagcgccuggggcaa

SEQ ID NO: 85469 - RNA, 64 nt, Human
gggauucaggaaaaggccuggggugacccggcacccccugcagcuuguagccagccggggcgag

SEQ ID NO: 85470 - RNA, 64 nt, Human
gucuccuuucuccaguggaagagccgggaccuucccccugcacccccgacauccagggacgggg

SEQ ID NO: 85471 - RNA, 64 nt, Human
uuauuuauccagguuggagauuuacaguaugccuccccugcaacugucucucgauguggaaugg

SEQ ID NO: 85472 - RNA, 64 nt, Human
agagacaagggauuucuuugauggacaagccuucccccugcaacgcauugcagggagauggcgc

SEQ ID NO: 85473 - RNA, 64 nt, Human
agccagagguauuagcugcugagcccugcaagggccccugcaauccugucccugcccuccucac

SEQ ID NO: 85474 - RNA, 64 nt, Human
cagggggcagagguugcagugagccgagauugcaccccugcacuccaggcugggcaacaguacg

SEQ ID NO: 85475 - RNA, 64 nt, Human
gggcgggagaccucagccgcagccgccgcccccuccccugcagcgacucggacccgcuacugcc

SEQ ID NO: 85476 - RNA, 64 nt, Human
gaaagaugagcccaaguccaccugucuucauccuccccugcacuccagacugaucugccuaaag

SEQ ID NO: 85477 - RNA, 64 nt, Human
acuuguucaucuucugaccguuugcugggcuauuccccugcagugcagacaucgucaaaauuca

SEQ ID NO: 85478 - RNA, 64 nt, Human
cacagaagagccccucccucuccauugcucugcaccccugcaucagcaaggccagccccagaag

SEQ ID NO: 85479 - RNA, 64 nt, Human
ccaucugcaggaaaguuuuugagccuuuccauuuccccugcaaaagccagagaugaaucacuuc

SEQ ID NO: 85480 - RNA, 64 nt, Human
cgagacucucaugucacaggcgugccuugcugccccccugcagcacugugcaggacguggacca

SEQ ID NO: 85481 - RNA, 64 nt, Human
cuggguggaggcucugccuugccucaagaaccauccccugcagagcauccagggagguuucucg

SEQ ID NO: 85482 - RNA, 64 nt, Human
ggaucugucucugagaccaaugugcuguuucagcccccugcagcuaagaauuguauugacuguc

SEQ ID NO: 85483 - RNA, 64 nt, Human
gcugcugggcauccuccuccuccuuggaguuccgccccugcaaggcuggauuugggggccauua

SEQ ID NO: 85484 - RNA, 64 nt, Human
caccucagggugucgguuaagagacaggccuccaccccugcaccagagccugcucuuagcuccc

SEQ ID NO: 85485 - RNA, 64 nt, Human
agcauagccuccuugcaggcagaaggcaguagggccccugcacacucaguuucucucguuuucc

SEQ ID NO: 85486 - RNA, 64 nt, Human
uacaaaaauugcaacgauacagagauuagcauggccccugcacaaggaugacucgcaaauucau

SEQ ID NO: 85487 - RNA, 64 nt, Human
gaggugcuagcccgguccaccgggcugcugcccaccccugcaugccccaguugcccaccccgcc

SEQ ID NO: 85488 - RNA, 64 nt, Human
gagcugaaucagcaucuccuccugagucccagggccccugcaguucccagucucuucuguccug

SEQ ID NO: 85489 - RNA, 64 nt, Human
ggacugcaggguccccaggggaucuuuccucccuccccugcaugaggcagaggcaagcugccug

SEQ ID NO: 85490 - RNA, 64 nt, Human
gcuccuccaaagccagagcccaagccuaaaaaggccccugcaaagaagggagagaagguaccca

SEQ ID NO: 85491 - RNA, 64 nt, Human
ucacagccugucaugcugcucagugugguucucaccccugcaagcucaaauucaguucccugaa

SEQ ID NO: 85492 - RNA, 64 nt, Human
uuagcauacuguugauccaucucagucacuuuuuccccugcaaugcgucuugugaaauugugua

SEQ ID NO: 85493 - RNA, 64 nt, Human
gcugggcuugcaacgcagcugauucugagacaggccccugcagagggaugccuuaaagcugucc

SEQ ID NO: 85494 - RNA, 64 nt, Human
acauuccugacuucugaauacagcacagcugagcccccugcagcucccaucuccagcuauuccu

SEQ ID NO: 85495 - RNA, 64 nt, Human
cuguguguccccaggcgcaucauugcuccacucuccccugcagccgcggcugcucggccacuga

SEQ ID NO: 85496 - RNA, 64 nt, Human
ccucaguuucugguaaaacacaaggucuggagugccccugcaaaggguauugauggacuuccug

SEQ ID NO: 85497 - RNA, 64 nt, Human
aagcuauuauucagcagugucccggcacuacuaaccccugcaacaagccagaugaggaacauaa

SEQ ID NO: 85498 - RNA, 64 nt, Human
guccuaaggguuugauccagaaacccuggugcuuccccugcagaauacuguacuucauuuaaca

SEQ ID NO: 85499 - RNA, 64 nt, Human
accauguggcaggaaacagccauugccuggccucccccugcauuccugucugggugaagaggag

SEQ ID NO: 85500 - RNA, 64 nt, Human
aauauuccucugggcucacgggguguuuuccaccccccugcagcaacuaagauggugggggaga

SEQ ID NO: 85501 - RNA, 64 nt, Human
agaacccccaggagcgcccaggcuugggcagcaaccccugcauccccauuuuuuacugagcuca

SEQ ID NO: 85502 - RNA, 64 nt, Human
gcaucagacccauccaggggcuacagggccugccccccugcagguagaaacacaguauacccgu

SEQ ID NO: 85503 - RNA, 64 nt, Human
uaaaaagcuucacccccuggcugagugaggugguccccugcaaucacuguuuguccccuaccca

SEQ ID NO: 85504 - RNA, 64 nt, Human
gugagcuggagacagcagagggaccccaggguguccccugcagaucccaccagggccgcaucca

SEQ ID NO: 85505 - RNA, 64 nt, Human
cugugugagagggagagcagcuccccucgccccgccccugcagugugaaugugugaaacauccc

SEQ ID NO: 85506 - RNA, 64 nt, Human
ggugaugcgguuguaagauuuucacguggcagagccccugcagcugacccacgcuugggcauca

SEQ ID NO: 85507 - RNA, 64 nt, Human
caagagaacucgcgcucaguaaacgggaacaugcccccugcagacacgucuuguggccuccgag

SEQ ID NO: 85508 - RNA, 64 nt, Human
gcugugagguccaggccggucuuggcgccgagagccccugcacucaaggccacauucccucgac

SEQ ID NO: 85509 - RNA, 64 nt, Human
gcccuggccgugucugucuggugugugcugugaaccccugcacccaaccccacaucuggguggc

SEQ ID NO: 85510 - RNA, 64 nt, Human
cccccaugcaccucuccccaacaacacacacagcccccugcaccgcccgccccccgcccccacc

SEQ ID NO: 85511 - RNA, 64 nt, Human
ggucuguggaaacauaagcgguuuuuuuaaugggccccugcaucaauaccaaacauggggguuu

SEQ ID NO: 85512 - RNA, 64 nt, Human
uagagggcacugggucgccgugccccacggcaggccccugcaggaaaacugaggcccuugggca

SEQ ID NO: 85513 - RNA, 64 nt, Human
uggagccugacccuggagggcacugagcuggaggccccugcaaggguaggggacaagauguagg

SEQ ID NO: 85514 - RNA, 64 nt, Human
ugccuccaccccccagaaccuguccuugcacacuccccugcacuggaguccagucucuucugcu

SEQ ID NO: 85515 - RNA, 64 nt, Human
cccagggacucaagccagccacccccuucuuuccccccugcacugauaucucuggggguuucuc

SEQ ID NO: 85516 - RNA, 64 nt, Human
agauguugguaucugcagggauccuggaaccaaaccccugcagauacuaagggcugacgaucua

SEQ ID NO: 85517 - RNA, 64 nt, Human
cacuggcaccaagugcggguccggcagcuucugcccccugcagaaccggagagccagcuaaggg

SEQ ID NO: 85518 - RNA, 64 nt, Human
cggccgaggucacucugggccuggggacccaaacccccugcagcccaggccagucagacgccag

SEQ ID NO: 85519 - RNA, 64 nt, Human
gaggggucuccuccucucugcugcccaguccuggccccugcacaagacaacagaauccaucagg

SEQ ID NO: 85520 - RNA, 64 nt, Human
caaguuuugcuccuugagagcagauuggcugaugccccugcaaccccagcccaagcucugccuc

SEQ ID NO: 85521 - RNA, 64 nt, Human
gcuccaccagccacugaugccagcccuggcacugccccugcacaggagacaagugcguucaggg

SEQ ID NO: 85522 - RNA, 64 nt, Human
gcuccaccagccacugaugccagcccuggcacugccccugcacaggagacaagugcauuuaggg

SEQ ID NO: 85523 - RNA, 64 nt, Human
auagaggaugggcagcuggggggcuguccugagcccccugcacccaccccugcccaggcagucu

SEQ ID NO: 85524 - RNA, 64 nt, Human
gacaugccacuccccggccucguggcagugauggccccugcagaggcagccugaggucaccggg

SEQ ID NO: 85525 - RNA, 64 nt, Human
acuucauccacacugacgucacccgcgggggcucccccugcacauuugcacacgauccggagag

SEQ ID NO: 85526 - RNA, 64 nt, Human
cuggaagauaccucucuggccccggcacaugucaccccugcacuccugccuucccgugggcacu

SEQ ID NO: 85527 - RNA, 64 nt, Human
guggucccaccuucuccacccugcccugccaaguccccugcaugcccaccgcucuccauccucc

SEQ ID NO: 85528 - RNA, 64 nt, Human
cccgccacccgaagggagcucuggacccucagagccccugcagaggacggaucuagcuccugua

SEQ ID NO: 85529 - RNA, 64 nt, Human
acgccuccgugccuccagaccccgccuccuccagccccugcaccugucauuuauucuuccacug

SEQ ID NO: 85530 - RNA, 64 nt, Human
ggagccgguucuggaacuuuucuucaugccacggccccugcaaggaaauagaugcugaggcagu

SEQ ID NO: 85531 - RNA, 64 nt, Human
cuggcuccucguguuuggugaggguggagugaggccccugcagagcugcugaugaggugggcac

SEQ ID NO: 85532 - RNA, 64 nt, Human
gucaggguaugcuguuugcugaugggcagggacaccccugcagggucucgggcucugagcccag

SEQ ID NO: 85533 - RNA, 64 nt, Human
augguaccgaugcaggaggaagcaagcgugucuuccccugcagcacacagcgacuugcguugac

SEQ ID NO: 85534 - RNA, 64 nt, Human
gggcuggggcugucccacacuggacccagcucucccccugcagccaggcuucccgggccgcccc

SEQ ID NO: 85535 - RNA, 64 nt, Human
uuguagugcugagccugcaucugugccucccagcccccugcacugagggagcaaguugcccaca

SEQ ID NO: 85536 - RNA, 64 nt, Human
gagggggccuggaugcccccuguggaugcugcugccccugcacagcaggcugccagugccuggg

SEQ ID NO: 85537 - RNA, 64 nt, Human
ugccaucauggcucuccacucagacugugccuggccccugcacuuacaacuuccugccgcucug

SEQ ID NO: 85538 - RNA, 64 nt, Human
caaauauauauaaacguguguggucuuauucuucccccugcaguuucuugcuuucuucagcaca

SEQ ID NO: 85539 - RNA, 64 nt, Human
cgggaaauggaacugugacggucccggccugaggccccugcagccacgcaccucccggugagaa

SEQ ID NO: 85540 - RNA, 64 nt, Human
ccccucacucuggccucagccgacugcacagcggccccugcauccccuuggcugugaggccccu

SEQ ID NO: 85541 - RNA, 64 nt, Human
ccgcaggacgggccuacaggggggucuccccucaccccugcacccccagcugggggagcuggcu

SEQ ID NO: 85542 - RNA, 64 nt, Human
cagcuggcacugacagccugggggggccgcucucccccugcagccgugcaggacucuagcucau

SEQ ID NO: 85543 - RNA, 64 nt, Human
caaagagccucccaccagagccgggaggaaaaggccccugcaauguggugacaccucccccuuu

SEQ ID NO: 85544 - RNA, 64 nt, Human
cgcacccggacacuugaucgauccccaccgacgcccccugcaccgccuccaaccaguuccacca

SEQ ID NO: 85545 - RNA, 64 nt, Human
gagcaauuuuagccccacccugcucccaucugccccccugcaacagucgcaggcugcuuccucu

SEQ ID NO: 85546 - RNA, 64 nt, Human
gcuuccugugggaguccccuccagaccuggcuggccccugcagccacagaaaccacgauggcaa

SEQ ID NO: 85547 - RNA, 64 nt, Human
ucagcgaugacuccagucugggugucccagcgagccccugcagggacaguauggcugaggguca

SEQ ID NO: 85548 - RNA, 64 nt, Human
caaggauauggggcaggaggcucccucugcugacccccugcagccuggagccagcccggggacu

SEQ ID NO: 85549 - RNA, 64 nt, Human
aaggagggacuuggcuguccuuccccuuccccguccccugcagccugggucuggaugggaggag

SEQ ID NO: 85550 - RNA, 64 nt, Human
uugccaggagcaugucugugcagcaguguuuuugccccugcacauuccagaagcccucauggga

SEQ ID NO: 85551 - RNA, 51 nt, Human
aagacgaggcugcauccugagccccugcaugcacccagggccacccggcag

SEQ ID NO: 85552 - RNA, 64 nt, Human
caucucagggaauguccaucuggagcuggcaagaccccugcagaccucauagagccucaucugg

SEQ ID NO: 85553 - RNA, 64 nt, Human
uucugaagccauggggcucgucuucugggguguuccccugcaggugcuggugaagguaaccugg

SEQ ID NO: 85554 - RNA, 64 nt, Human
gcuguuuggcugucccuguaccccaguccugaagccccugcaguggcgggacucaagcuccuga

SEQ ID NO: 85555 - RNA, 64 nt, Human
gaagcagccccaacucaucacugggaaagaacucccccugcaaaccagcuaaauuugauaauuu

SEQ ID NO: 85556 - RNA, 64 nt, Human
uagccagaugcccugcuccuggccaccuuuaaagccccugcauaugacacagguuaacuaaagu

SEQ ID NO: 85557 - RNA, 64 nt, Human
acuuguuugcccucaggcagccaaagcacuuuaaccccugcauagggagcagagggcgguacgg

SEQ ID NO: 85558 - RNA, 64 nt, Human
cuccaugauucugaagcaugcacaccucugaagaccccugcaugaaaauaaccuccaaggaccc

SEQ ID NO: 85559 - RNA, 64 nt, Human
gaaauuggaacaaggaugguacuaccacaaucacccccugcaaaaaaaaagagaccaagaaacu

SEQ ID NO: 85560 - RNA, 64 nt, Human
aggagcugaaaacaacguagaggcuggaaaguguccccugcauucuggaggggaggggagauaa

SEQ ID NO: 85561 - RNA, 64 nt, Human
aaacaggcacugcccugguggcccucuccccugcccccugcaggaaggagcugccuggacccgu

SEQ ID NO: 85562 - RNA, 64 nt, Human
acccauuccuucccagaggggccugccaccuggaccccugcauuggaacuggaggcagggaaca

SEQ ID NO: 85563 - RNA, 64 nt, Human
cucgccuugggguucugcgagugccaguccacauccccugcagagcccucuccuccucuggagu

SEQ ID NO: 85564 - RNA, 64 nt, Human
guaggguuaggacuacuuaaccucuauucccacuccccugcaaacuggggguugugggaaguga

SEQ ID NO: 85565 - RNA, 64 nt, Human
gcuuuaauuggguucagcagaugccuccucugccccccugcaggcaggcccaaguaggacugcu

SEQ ID NO: 85566 - RNA, 64 nt, Human
agccggguccggccucucccugccuguggccccuccccugcagacggaugcccauuccugccug

SEQ ID NO: 85567 - RNA, 64 nt, Human
caccguuuucacagggagaagcaggucuaggacuccccugcaccuuugccaccauaauggccca

SEQ ID NO: 85568 - RNA, 64 nt, Human
ccucucccaggcaggaggacccccagacccuguuccccugcagaccucacuucugggagacaga

SEQ ID NO: 85569 - RNA, 64 nt, Human
gggguggccgggcugccucucgcaucucugucuuccccugcaggcgcugugugagcuggcccug

SEQ ID NO: 85570 - RNA, 64 nt, Human
uucuuccuacucugugccuggagcaucauguccaccccugcagauccuuggaaaagaaaauguu

SEQ ID NO: 85571 - RNA, 64 nt, Human
aggggcagagcacaccccagugcuuacgccuccaccccugcagccuccuggcccgcucaccuuc

SEQ ID NO: 85572 - RNA, 64 nt, Human
cucccuuuuccccaggaaugaaccgaggccgucgccccugcacacgcacacgcacacagccugg

SEQ ID NO: 85573 - RNA, 64 nt, Human
uggggggucgugggccaguccccgaggagcugggccccugcacaggcacacagggcccggccac

SEQ ID NO: 85574 - RNA, 59 nt, Human
cccccaaccaguaccagugacccagugggccccugcacgucccgccuguggucccccca

SEQ ID NO: 85575 - RNA, 64 nt, Human
ugccugcuacgcauugacuuggaucuccaggaguccccugcacauaccuucuccaucgugucag

SEQ ID NO: 85576 - RNA, 64 nt, Human
uguucucaucugucgcaccccuguauuugccucaccccugcauggucggaaaucuucguuucag

SEQ ID NO: 85577 - RNA, 64 nt, Human
gauuggaugacugggaagcgcuggcccggaacagccccugcaacuguggggccugcacacagcc

SEQ ID NO: 85578 - RNA, 64 nt, Human
cugcuccagugggccaaguugggcaggacccccgccccugcagggcccaugcaccagagccacu

SEQ ID NO: 85579 - RNA, 64 nt, Human
ccaguucuuuuaggccuucucuuugauuuauuuuccccugcaugugagaagcaguucagaaaaa

SEQ ID NO: 85580 - RNA, 64 nt, Human
ccugaccuccccgcggggagggugggugcuguggccccugcagguguggcagagauggggcaug

SEQ ID NO: 85581 - RNA, 64 nt, Human
ucuagacggggcgaaccaggggucauugaccugcccccugcacagggcagggaccgagugagcc

SEQ ID NO: 85582 - RNA, 64 nt, Human
uucucucuugccugcuccugucccuccagcacguccccugcaccacggcauagcuuaggugcgc

SEQ ID NO: 85583 - RNA, 64 nt, Human
gggccuugcggcacaggacugugcccugugcuguccccugcaccccggcucagcugagcugggg

SEQ ID NO: 85584 - RNA, 64 nt, Human
cagccccucccagucagcccucccguccucggggccccugcagccacccaacgucaccuccagc

SEQ ID NO: 85585 - RNA, 64 nt, Human
gaacuaauaagaggcgucggggccagcuuccgguccccugcagugauagagggcuuggugccua

SEQ ID NO: 85586 - RNA, 64 nt, Human
cuccccgacccccgacccacugcaaauccccguuccccugcacuccucuucucccagcccaucc

SEQ ID NO: 85587 - RNA, 64 nt, Human
cagguguuccagaggcuuccuugcagacaaagcaccccugcaccuccuauggcucaggaugagg

SEQ ID NO: 85588 - RNA, 64 nt, Human
cgggugggggugccaacaggccuggcccuuuccuccccugcauccagccaugggggccucugcg

SEQ ID NO: 85589 - RNA, 64 nt, Human
ggccccugccucuugcugcuguccuguccccgagccccugcagguccccccccgcccccccacu

SEQ ID NO: 85590 - RNA, 64 nt, Human
cuugccccagaaccucaagaaggcaugaagccagccccugcagugccguccacccgccccucug

SEQ ID NO: 85591 - RNA, 64 nt, Human
agcagggaggguggcuggggccaagccccgagggccccugcaagcacuuuacuuccuguuccuc

SEQ ID NO: 85592 - RNA, 64 nt, Human
ccaggauccuacggauugagguccucaggccacgccccugcagauccaggucuccaggccuugc

SEQ ID NO: 85593 - RNA, 64 nt, Human
cucucuccccgaccaugagagccccuggcccuggccccugcacaccaguaggcccagaauaacc

SEQ ID NO: 85594 - RNA, 64 nt, Human
ccacagcugacaaagucugcauguccgaggacggccccugcacuggagcugggcgccagagcug

SEQ ID NO: 85595 - RNA, 64 nt, Human
ggcugggcugggaucggaggccgugagccucccgccccugcagacccucccugcacuggcuccc

SEQ ID NO: 85596 - RNA, 64 nt, Human
gugcuccugcccacccggguuccgcacuguccgaccccugcacaccacucaugucaccacggcg

SEQ ID NO: 85597 - RNA, 64 nt, Human
auggugagaucagagcagcucuuccugcugcuggccccugcaaucaguuguugggaugccagug

SEQ ID NO: 85598 - RNA, 64 nt, Human
cggcccagcacccccagcauccccguguauggccccccugcaccuccuugucucauccccgaag

SEQ ID NO: 85599 - RNA, 64 nt, Human
agaagugacggcugggggcacagugggcugggcgccccugcagaacaugaaccuuccgcuccug

SEQ ID NO: 85600 - RNA, 64 nt, Human
ggggagacaggucagggccccccacccucuccagccccugcagcaaaugacuacugcaccugga

SEQ ID NO: 85601 - RNA, 64 nt, Human
ucugucugggaggggggagugaaggggcccuagcccccugcacuccgccgccucagagccaugc

SEQ ID NO: 85602 - RNA, 64 nt, Human
ccacuucaugaggggaggggcgaggggaagcccaccccugcaugcuucuggcuggagcaccucc

SEQ ID NO: 85603 - RNA, 64 nt, Human
ugcugcacucaggagggccccauccaaucccgggccccugcagggaaaagcgcugggugugugu

SEQ ID NO: 85604 - RNA, 64 nt, Human
acccacccuuuuuuuggggugccuagguugguuuccccugcacucccgaccuuagcuuauugau

SEQ ID NO: 85605 - RNA, 64 nt, Human
cucccaccuucaccuuuagcuucuugaaaaugggccccugcagaauaaaucugccaguuuuuau

SEQ ID NO: 85606 - RNA, 64 nt, Human
gcagcacucuggcauuuaucacccccaccuggguccccugcaaccucccaucaaaggaugaccc

SEQ ID NO: 85607 - RNA, 51 nt, Human
cccggcgcuguccuggcugagccccugcaggagccccggccacacacagca

SEQ ID NO: 85608 - RNA, 64 nt, Human
ucgggggcgccggcuuccaccacucgccgccccaccccugcacuccgugaccucugagaaccca

SEQ ID NO: 85609 - RNA, 64 nt, Human
gggcuucgucuaugaaaaguugccaagugugacuccccugcaugauguuagccauggguccuuu

SEQ ID NO: 85610 - RNA, 64 nt, Human
uucuuccuaccccauucccggcuucccuccuccuccccugcagccugguuagguggauaccugc

SEQ ID NO: 85611 - RNA, 64 nt, Human
ugcccgccucgccgccccaccggaccucguccucccccugcacggaugccgacggccgggcccc

SEQ ID NO: 85612 - RNA, 64 nt, Human
cucuacacagccuccacgcuggccuucaccuucaccccugcaucgucggugacccugggacccu

SEQ ID NO: 85613 - RNA, 64 nt, Human
gauguccagaaaaaauaucuuucaggaaaguucuccccugcagaauuuuuuuuccuuguuaaau

SEQ ID NO: 85614 - RNA, 64 nt, Human
gggugagacggagccggaaguuauuuauugggaaccccugcagggcccuggcuggggggaugga

SEQ ID NO: 85615 - RNA, 64 nt, Human
cugggagugcuaugggagacuggggucuauuucaccccugcagucucgaccauaagagauggcu

SEQ ID NO: 85616 - RNA, 64 nt, Human
ucuggauuccaaggugggauggugaucccuuugaccccugcagacccucuacuugcgaaaagca

SEQ ID NO: 85617 - RNA, 64 nt, Human
cgugguuuuaaguccucccugcccucucuccucuccccugcagcagggcagggaccccucuccc

SEQ ID NO: 85618 - RNA, 64 nt, Human
aggggcagcauagccccaggccacccuagcccagccccugcauugccguuuccccagagguggc

SEQ ID NO: 85619 - RNA, 64 nt, Human
ucaucugagccagcaccgccggcuuucagggcagccccugcagacgucuggcccuggcgggugg

SEQ ID NO: 85620 - RNA, 64 nt, Human
uggagacucccauucucccccucucccugagaguccccugcaguuucuggguaacagggcacac

SEQ ID NO: 85621 - RNA, 64 nt, Human
accauccaggccugguucccaagacccgauccuuccccugcaaccagacagucuacaacugccc

SEQ ID NO: 85622 - RNA, 64 nt, Human
auuacaacccucagaauaggggacaguggugugcccccugcaauacaaugguuucuaucuccug

SEQ ID NO: 85623 - RNA, 64 nt, Human
cguucuuugaguuugugauugauccacauuuuucccccugcauuauggaaaaugucucucagca

SEQ ID NO: 85624 - RNA, 64 nt, Human
agggaggggcacagcuacacacucaccaaaggccccccugcacauuguaucucugaucuugggc

SEQ ID NO: 85625 - RNA, 64 nt, Human
cugcagagacucaggccuguuugagggcucacgaccccugcagcaaagaagcccgagacugauu

SEQ ID NO: 85626 - RNA, 64 nt, Human
gcaugaacgccuccaacuucguggaagccaggguccccugcagcugagggacgccaagcagaca

SEQ ID NO: 85627 - RNA, 64 nt, Human
uacccacccccgccacggccacaagcccuggcauccccugcaaauauuuauugggggccauggg

SEQ ID NO: 85628 - RNA, 64 nt, Human
ggagguaucccugugccaaaggcuccaggccucuccccugcaacucaggacccaagcccagcuc

SEQ ID NO: 85629 - RNA, 64 nt, Human
ccagagcagggaggugucguggaacuggguagacccccugcagcguuaggggcccauuuguggg

SEQ ID NO: 85630 - RNA, 64 nt, Human
ccccugggcugcugcucugagcccaucuguucucccccugcaagaaggggcaaugcucuugugu

SEQ ID NO: 85631 - RNA, 64 nt, Human
ucccagcaucugauugagucaguguuugcuguuuccccugcacuuuccuaguucuuaagcauuu

SEQ ID NO: 85632 - RNA, 64 nt, Human
uugaauccuggcuauaaaacucaagggacucuuuccccugcacacuguagaugacuaggacaag

SEQ ID NO: 85633 - RNA, 64 nt, Human
aaaaccacagcugggcagggugagaagcuagaugccccugcaguuuggcccuggagccagggca

SEQ ID NO: 85634 - RNA, 64 nt, Human
uaaguuuuaaaaaccaaagcauccaggaugcacaccccugcaccauuugcugugcgaauuaaua

SEQ ID NO: 85635 - RNA, 64 nt, Human
aagcuagacauugaugaacgagucuuguuucucuccccugcaaggaagguccaagcaggcccuu

SEQ ID NO: 85636 - RNA, 64 nt, Human
cucccgcuaggagaguccucuucuaagcaaagugccccugcaggccggguucugccgccaggac

SEQ ID NO: 85637 - RNA, 64 nt, Human
cucaaucaggaagcuggagguguuagacaccagcccccugcauccuucaguagaccucccucug

SEQ ID NO: 85638 - RNA, 64 nt, Human
acugacugggcauagcuccccgcuucugccugcaccccugcaguuugagacaggagaccuggca

SEQ ID NO: 85639 - RNA, 64 nt, Human
uuacacugguaccuucugguaucuucuuuagagcccccugcaagcugcaacucuaggcuuuuau

SEQ ID NO: 85640 - RNA, 64 nt, Human
gucagacccgcgucggucguaacccucuguggcuccccugcaucagcaccgucccaccaccaag

SEQ ID NO: 85641 - RNA, 64 nt, Human
agaggagcaggucuggagguuuguggaacccaguccccugcagaaucuguaaaaccuaauaaau

SEQ ID NO: 85642 - RNA, 64 nt, Human
ucuuagccacaaaagaggggggagacuggaggcaccccugcagcaggggcacuucccuagggcu

SEQ ID NO: 85643 - RNA, 64 nt, Human
aggccucaccagucucuuucucuuuccugcuucaccccugcaaugagccaagaaccaacacuac

SEQ ID NO: 85644 - RNA, 64 nt, Human
cgcgcucgccccaccggcgcgcucuucgcgcccgccccugcagcacggacaauaaaccuccgcc

SEQ ID NO: 85645 - RNA, 64 nt, Human
cugaaaggacacaaacuggaauuuucaggucuguccccugcauggggacucagaacccagguuu

SEQ ID NO: 85646 - RNA, 64 nt, Human
ugggaagggcuccagaagaagguccagccuaggcccccugcaaggcuggcagcccccaccccca

SEQ ID NO: 85647 - RNA, 64 nt, Human
uggaggaaaggggcuccaagccuugcuuuuaacaccccugcaaaacccccacccucccaagaug

SEQ ID NO: 85648 - RNA, 64 nt, Human
agauugaggcucuugggggucacugcucugcugcccccugcaaccuccuucaggggccucuggc

SEQ ID NO: 85649 - RNA, 64 nt, Human
guuuccaauaccaagaugucuucacagggcacagccccugcagagcaucuuggucauuuggaag

SEQ ID NO: 85650 - RNA, 64 nt, Human
ucaccaccuuuccuccagaggaggaaaauuaucuccccugcaaagcccgguucuacacagauuu

SEQ ID NO: 85651 - RNA, 64 nt, Human
gcaguuugccucugcacgugcacacaccugcacaccccugcacacaccugcacaccgucccucu

SEQ ID NO: 85652 - RNA, 64 nt, Human
ccuaggacacagccaaccccggccccuggucaggccccugcagcugccucacaccgccccuugu

SEQ ID NO: 85653 - RNA, 64 nt, Human
ccuggcagggcaggcagagcucagcacagccucaccccugcaggcgguauccagaggugaggga

SEQ ID NO: 85654 - RNA, 64 nt, Human
gaccuggcaguggagggaggcugugcugugugucccccugcaggugugaccccgccugcucuuu

SEQ ID NO: 85655 - RNA, 64 nt, Human
agagucacacccagggaccacgggaggauccugaccccugcagggcucaggggucagcagggac

SEQ ID NO: 85656 - RNA, 64 nt, Human
cccuguccucguggugagucgcugaccacggcuuccccugcaggagccgccgggcgugagacgc

SEQ ID NO: 85657 - RNA, 64 nt, Human
cccucguccuaagcaggcauugccucggcuggcuccccugcagcccuggcccaucaugggggga

SEQ ID NO: 85658 - RNA, 64 nt, Human
ugccugucccuggccugccuugauuucagccacaccccugcagcccugcaucccagcucugggg

SEQ ID NO: 85659 - RNA, 64 nt, Human
ugagaacgcagugucaggugugggacuccuucugccccugcaguggguguuacgggcggugugc

SEQ ID NO: 85660 - RNA, 64 nt, Human
ucaccucaaauuaggaaaagcuuuuuaacuuguuccccugcauccuggcaugucccuucaagaa

SEQ ID NO: 85661 - RNA, 64 nt, Human
uggggugggcuccugccccuucugcccugccuugccccugcacuaugcucuuggcuccugugga

SEQ ID NO: 85662 - RNA, 64 nt, Human
guugggcaccacaccggccagcaucuuccgcacaccccugcagcucgacccgcagcaggagcag

SEQ ID NO: 85663 - RNA, 62 nt, Human
cccgggacucaccucccuagcccuggcccagcccccugcagggggguguucuacagccagca

SEQ ID NO: 85664 - RNA, 64 nt, Human
cugcuggucuccacacccucaaccguucucaaccccccugcagggagaaggccuccugggcacu

SEQ ID NO: 85665 - RNA, 64 nt, Human
gccuucuuguggcuuuagcaugugccaugcugucccccugcagacugccauucuccuugcagac

SEQ ID NO: 85666 - RNA, 64 nt, Human
gccacgcccauggggucacaugcucaggggucacccccugcagggaccugaugcccucgggugg

SEQ ID NO: 85667 - RNA, 64 nt, Human
ccccaauaccccuccgcuugccgcugcuagcgcaccccugcaguccagcgugcauccaccccac

SEQ ID NO: 85668 - RNA, 64 nt, Human
cccacagggauggcucaggggacuguccaccucaccccugcaccucucagccucugccgccggg

SEQ ID NO: 85669 - RNA, 64 nt, Human
gcccuugccuuggggccgagggagcccucguccaccccugcacagcagcugggcacagaggagc

SEQ ID NO: 85670 - RNA, 64 nt, Human
cauucaaaguaaaaugguuuuguuuggugaagggccccugcagacaucaaacagccgucaugua

SEQ ID NO: 85671 - RNA, 64 nt, Human
augcacgaagggagcaccguggagaagacgguggccccugcagaauguucauagguucccagcc

SEQ ID NO: 85672 - RNA, 64 nt, Human
cgggccccuccccacagaaagcugcuccuggaugccccugcagaagaccccaauuaccugcccc

SEQ ID NO: 85673 - RNA, 64 nt, Human
uuuguaaccuccugucccuccuaaaacacgccaaccccugcagucaaaucacauuaguaaucug

SEQ ID NO: 85674 - RNA, 64 nt, Human
auacuagacagauggagaguggcuuggcuguuucccccugcauauugggguugaaaacuuaaau

SEQ ID NO: 85675 - RNA, 64 nt, Human
gcugccucugaaauagcgcccuggaacaacccugccccugcacccagcaugcuccgacacagca

SEQ ID NO: 85676 - RNA, 63 nt, Human
guuugaugauuccacugugagccaucccacgagccccugcauuggagucagagguacagaucu

SEQ ID NO: 85677 - RNA, 52 nt, Human
ccccuacugaagugacgugagaccccugcaaaugggacagccccccaguuca

SEQ ID NO: 85678 - RNA, 59 nt, Human
uccagcaaguggugaccugaggaacugccccccugcaaagcagggcccaccuccuggac

SEQ ID NO: 85679 - RNA, 64 nt, Human
ccucccggcuggagagcucaggugcuggucccguccccugcagggcucaguuugcacugcugug

SEQ ID NO: 85680 - RNA, 64 nt, Human
ggaagugcuccugacacucuguccccugccccguccccugcagggccuuuuccugccacucauc

SEQ ID NO: 85681 - RNA, 64 nt, Human
gauggggucgcucuuugggggaaacgggcuccuuccccugcaccuggccugggccacaccugag

SEQ ID NO: 85682 - RNA, 64 nt, Human
uuuccuuucccggccccaccuggccggcccucugccccugcagagcugaggcagccugggguug

SEQ ID NO: 85683 - RNA, 64 nt, Human
acacauucacucccuugaugucauguuaaaauguccccugcagugguucaaucgugacucggaa

SEQ ID NO: 85684 - RNA, 64 nt, Human
gaagcccuguugugccacagaguguagccaggucccccugcagcuaguccuagugaaccucacc

SEQ ID NO: 85685 - RNA, 64 nt, Human
uucacccaucaagagguagaaucuauuucuucaaccccugcaacugagcuuggcuauuuuguug

SEQ ID NO: 85686 - RNA, 64 nt, Human
accaauggaggccuggggacaucuggcauggucaccccugcacaugaucugaggccagcucccc

SEQ ID NO: 85687 - RNA, 64 nt, Human
cucucugaugugugccuuuuguucaacacaguaaccccugcauucugcucugcucuaauacacu

SEQ ID NO: 85688 - RNA, 64 nt, Human
ggagacagcagcacccacccaugcacgcaccccgccccugcaugccuggccccuccuccuagaa

SEQ ID NO: 85689 - RNA, 64 nt, Human
cucugcccaggagguggcguccagcaguccaggaccccugcagcugcagacaucugcuucacca

SEQ ID NO: 85690 - RNA, 64 nt, Human
aggacacccucaguuugcuccacauggccgccacccccugcaccagcccacauccccacugccc

SEQ ID NO: 85691 - RNA, 64 nt, Human
aguuugacaucgucacaccuaaaugcugucugguccccugcacaauaauggagaguacuccuga

SEQ ID NO: 85692 - RNA, 64 nt, Human
ugauugcugacauaccugugcacucauguguauaccccugcauguggaaacaugaagauguuuu

SEQ ID NO: 85693 - RNA, 64 nt, Human
aaguauuuacauugagaauaaagaagaaaagacaccccugcaaguggccaaagguggccugggu

SEQ ID NO: 85694 - RNA, 64 nt, Human
auuuucauagggaccgacuucaguagcacaccugccccugcauuucagugggaugucaauacac

SEQ ID NO: 85695 - RNA, 64 nt, Human
gcagguggggggcucagccugcacccacuuggagccccugcaaggagcgaaccggucagcacca

SEQ ID NO: 85696 - RNA, 64 nt, Human
uaggggacaagaguuugaacucaagggacugugaccccugcacacuggaguggcucauuguggc

SEQ ID NO: 85697 - RNA, 64 nt, Human
gauuggaggcagacagacugcaccaccccuucccccccugcaucucaagaauaaagcaagcugc

SEQ ID NO: 85698 - RNA, 64 nt, Human
gccuccuggccgcuccuuggccgcucuccguccaccccugcaaagccaagacccuucugcagcc

SEQ ID NO: 85699 - RNA, 64 nt, Human
auugguagguuuucauaagcauuguuucuuuaaggcauggaaagggaagaaugcucaagcaagu

SEQ ID NO: 85700 - RNA, 64 nt, Human
uccggcgggcacagcuggcuggggcuguuccggggcauggaagauucccagucacccacucacu

SEQ ID NO: 85701 - RNA, 64 nt, Human
agaauguggcuuugccugagcacagacagagucagcauggaaugcucuuggccaaggguacugg

SEQ ID NO: 85702 - RNA, 64 nt, Human
agcucggugagugauggcagaacgaugccugcaggcauggaacuuuuuccguuaucacccaggc

SEQ ID NO: 85703 - RNA, 64 nt, Human
gacauacuacugaccccauuggaagaagaaccaggcauggaaagauggggagcucuggaggugu

SEQ ID NO: 85704 - RNA, 64 nt, Human
gaccgcaaaagccaggcuaguccuuguagggugagcauggaauuggaaugugucacaguggaua

SEQ ID NO: 85705 - RNA, 64 nt, Human
aaagacugcuuugcccucacgucaguuguacauggcauggaacuuuaaaaauuuuaauauaaac

SEQ ID NO: 85706 - RNA, 64 nt, Human
cuuuugcuuuaugauauucuaucuguaguaugaggcauggaauaguuuuguaucgggaauuucu

SEQ ID NO: 85707 - RNA, 64 nt, Human
uacuguauguccuguagcccagugcggcuccacagcauggaaucugauguaugauaugauagaa

SEQ ID NO: 85708 - RNA, 64 nt, Human
ugucuugcacuuacaaauaaggucuaugggaguagcauggaaaacguuugcuguuuuucccuuu

SEQ ID NO: 85709 - RNA, 64 nt, Human
gccugcuggggccuggcugggaguccugugggcagcauggaacaugcagcugggcuuccuguga

SEQ ID NO: 85710 - RNA, 64 nt, Human
acuaacguaaucuaccauuuccuacacuauuugagcauggaaaucauaguccccacucugugaa

SEQ ID NO: 85711 - RNA, 64 nt, Human
aagacaggauuaccuaggcuugccugaacuuugggcauggaagaaagacuggaaacuaguugga

SEQ ID NO: 85712 - RNA, 64 nt, Human
uccuuuauuuacaaagcugugcuccuauucaugagcauggaauguuuuuccauuuguuugugac

SEQ ID NO: 85713 - RNA, 64 nt, Human
uagucaguguguucuacaguguguaucugguucugcauggaaagcaauaguugugcaagugacu

SEQ ID NO: 85714 - RNA, 64 nt, Human
uuuagaacuaaacacaucuguaaaacuaaauauagcauggaaaauccaauuugaauaagucaug

SEQ ID NO: 85715 - RNA, 64 nt, Human
cacauaugauguguguucuguagagguuauuucugcauggaaacucaacuucuuggauuagccg

SEQ ID NO: 85716 - RNA, 64 nt, Human
auuugggaaauuccaacuccuauaccuuaccagagcauggaagagcccagaucugaauguaaaa

SEQ ID NO: 85717 - RNA, 64 nt, Human
agaaagaagcuccauugaccgaagccacagggcagcauggaaguuuaaauuuucucuaaaauua

SEQ ID NO: 85718 - RNA, 64 nt, Human
uagacuggaagaagaaaccacuauuucaugaaaagcauggaauauuauauuuuauuguucauaa

SEQ ID NO: 85719 - RNA, 64 nt, Human
aauccuguagcguguaauaaaagaagaggaaauggcauggaaucacugccuccugugauuugaa

SEQ ID NO: 85720 - RNA, 64 nt, Human
gcaccuaccccggaaggcuggaaauacagaaacagcauggaauugcaaguccucugaagacaau

SEQ ID NO: 85721 - RNA, 64 nt, Human
gcaggcagugucuuaaggagacugguaggaggaggcauggaaaccaaaaggccguguguuuaga

SEQ ID NO: 85722 - RNA, 64 nt, Human
gaagucagagcaucaccagaauggucuuuaaugagcauggaaccugagcaaagggaauaggugg

SEQ ID NO: 85723 - RNA, 64 nt, Human
ugucagggugaccguauguggccgcagcuguguggcauggaacuuggucaggguugaauuccag

SEQ ID NO: 85724 - RNA, 64 nt, Human
ugggacagcacaccauagcauaaagcuaggggaugcauggaaauagcagcuugaaacuaggagg

SEQ ID NO: 85725 - RNA, 64 nt, Human
cuccacauaugauaguguuauaaauacuguaaaagcauggaaggugcaaaacucaguauuucua

SEQ ID NO: 85726 - RNA, 64 nt, Human
ccauuuucacgauauugauucuuccuacccaugagcauggaauguucuucuauuuguuuguauc

SEQ ID NO: 85727 - RNA, 64 nt, Human
ggacacugagggcauccugcucaucucacacccugcauggaaucaggcuccucagccaggacac

SEQ ID NO: 85728 - RNA, 64 nt, Human
ccuuugccugguacaguauggggguuguaaauuggcauggaaauuuaaagcagguucuuguuag

SEQ ID NO: 85729 - RNA, 64 nt, Human
cagcccccacugccuuugaccugccucccuucaugcauggaaauucccuucaucuggaaccauc

SEQ ID NO: 85730 - RNA, 64 nt, Human
cagaaauuaacugauuaauuucccuuauguugaggcauggaaaaaaaauuggaaaagaaaaacu

SEQ ID NO: 85731 - RNA, 64 nt, Human
auaacagaacgagcaaaguaaccuauacaggccagcauggaacagcaucuccccugggcuugcu

SEQ ID NO: 85732 - RNA, 64 nt, Human
aaaaccccaccuuguugcaaaagcugaccucguugcauggaauuaaaagagaaggaaaaacaca

SEQ ID NO: 85733 - RNA, 64 nt, Human
uguuuuuuuuuuuuuucuuggacuaaauucaacugcauggaagcgguggucagaagguuguuuu

SEQ ID NO: 85734 - RNA, 64 nt, Human
gucugcagcagcuggacaucacauuucauguccugcauggaaccaguggcugugaguggcaugu

SEQ ID NO: 85735 - RNA, 64 nt, Human
ggucuuaagcuguucuugcauaggcucuuaagcagcauggaaaaaugguugauggaaaauaaac

SEQ ID NO: 85736 - RNA, 64 nt, Human
ugugaccuucaggcuugggucaucaagaugcacagcauggaacacaagcuccucuggauccugc

SEQ ID NO: 85737 - RNA, 64 nt, Human
uacaggagugagccaccaugcccggcuggcaguugcauggaagagaacaccucuuuauggcuua

SEQ ID NO: 85738 - RNA, 64 nt, Human
uuccuuuuuuaaaaucagcaugaugugccugugagcauggaagaguccucucagaagaauguug

SEQ ID NO: 85739 - RNA, 64 nt, Human
uuucuuggcuaacauuaaauauucuuguaccagagcauggaaaaucguuuauaauuguuaauag

SEQ ID NO: 85740 - RNA, 64 nt, Human
uuccaugugaugcuugugagaauugagaaaauaugcauggaaauauccagaugaauuucuuaca

SEQ ID NO: 85741 - RNA, 64 nt, Human
cuggcuggcucuguuagaacucuguccaaaaagugcauggaauauaacuuguaaagcuucccac

SEQ ID NO: 85742 - RNA, 64 nt, Human
uuaaaauuaaugguuuuucuccugaaauguuugugcauggaagaacugcccugcuuuuuuaccc

SEQ ID NO: 85743 - RNA, 64 nt, Human
uggccaauggugccaggcagccuggccuccagaggcauggaagcagcuucucugugugccgggg

SEQ ID NO: 85744 - RNA, 64 nt, Human
uuuuaaaaauacuuauuagaagcaaacugcccuugcauggaaaacuguuuauuuuuuucaguga

SEQ ID NO: 85745 - RNA, 64 nt, Human
agacgcaaacccagggcuuaaccugcuagaaaaugcauggaaugugaacacaaguuaauuauuu

SEQ ID NO: 85746 - RNA, 64 nt, Human
uaaaaaaaaaagccagaccauaguuugacugguggcauggaauuuguguaucaaauaaaugcau

SEQ ID NO: 85747 - RNA, 64 nt, Human
gaaugcgccccucguggagagccuauaaacggaugcauggaaggcgccuguccauauggauaag

SEQ ID NO: 85748 - RNA, 64 nt, Human
uuauuuugauacugcgaugaguaaggguaagggcgcauggaauggggcuaaggugggagugaac

SEQ ID NO: 85749 - RNA, 64 nt, Human
ccucaacaggcacagcucucacaaagcucuucaagcauggaagugggaguuguguuguacuuca

SEQ ID NO: 85750 - RNA, 64 nt, Human
ugugagcugggcuucuguccuccucugugucccggcauggaagccaguauaagcauuuccaaau

SEQ ID NO: 85751 - RNA, 64 nt, Human
cuucccacgcagcucugggaugcagcagccgcucgcauggaagugccgcccagaggcaugcagg

SEQ ID NO: 85752 - RNA, 64 nt, Human
auuggggucuucugucuaaacuggggucacuguugcauggaacauuguucuuaauaguugagaa

SEQ ID NO: 85753 - RNA, 64 nt, Human
gcuugcagguuuuuugggguguuuugagaaaguggcauggaaacaugcaguaguuaaugaguuu

SEQ ID NO: 85754 - RNA, 64 nt, Human
uauuccugaggcugggggccagagaagcuuuuacgcauggaaaaacacuaaucaugccaaggug

SEQ ID NO: 85755 - RNA, 64 nt, Human
aacugguauaagaagacuuuccuuuuuucuuuaugcauggaagcaucaauaaauuguuuaaaaa

SEQ ID NO: 85756 - RNA, 64 nt, Human
uaaaaauguagucacaugggcacaccaccuaucugcauggaaggcugggaaauguugaucggua

SEQ ID NO: 85757 - RNA, 64 nt, Human
aaugugacuucaucuaaaggcagcauuagguacugcauggaaauaggucauuaacuugaaacuc

SEQ ID NO: 85758 - RNA, 64 nt, Human
ccaucacacagaagagggcuguggugaaggaccagcauggaaaacgcauugacuuggagcaccu

SEQ ID NO: 85759 - RNA, 64 nt, Human
auacccucacacauuauaggggcaucagagaauggcauggaagagacagucuacagagagcuuu

SEQ ID NO: 85760 - RNA, 64 nt, Human
gaaacaaggaaaacugauuaagagaaaugagcacgcauggaaaaguuucccagucuucagcaga

SEQ ID NO: 85761 - RNA, 64 nt, Human
guaaauaagugugaccacuuaaagcugcucguuagcauggaagacuucuccauucuaucuuugu

SEQ ID NO: 85762 - RNA, 64 nt, Human
gauuuuuguucucuucccugaagugcuuuacagugcauggaaucuccaucauuguuauuuuaac

SEQ ID NO: 85763 - RNA, 64 nt, Human
aagaacaagcuacagacaaggaaauguuugcaaugcauggaacugucaaaggauucguaucugg

SEQ ID NO: 85764 - RNA, 64 nt, Human
ggauucccauaauuucacuuuacuuucuguuuaggcauggaaaaauuuaucagucagaauugcu

SEQ ID NO: 85765 - RNA, 64 nt, Human
auuuguaacaacuuguuuuuaaccaaacuuuguagcauggaaaaaauuuuccauccacaaauac

SEQ ID NO: 85766 - RNA, 64 nt, Human
cucacagaggggaaagauacugacggugaaaccagcauggaaaacgucuuuaccaugugguucc

SEQ ID NO: 85767 - RNA, 64 nt, Human
auuauuuguuauuuguacaguucaguuccucuuugcauggaauuuguaaguuuaugucuaaaga

SEQ ID NO: 85768 - RNA, 64 nt, Human
ucuacccucuaggccuggaggccucucucgcagagcauggaaggcaggagaggugggcuggccu

SEQ ID NO: 85769 - RNA, 64 nt, Human
aauaugaacuccuuuuucguauugccaucggguugcauggaaguuuuauucucuuguuuugcug

SEQ ID NO: 85770 - RNA, 64 nt, Human
acaauaccuaguuuggagggaggggaauggaagggcauggaaguuuuuuuaaauaauuaaaaaa

SEQ ID NO: 85771 - RNA, 64 nt, Human
ggggugcucacggugggcggugggcaagaagccagcauggaagaaagaagggagaaaacuuugg

SEQ ID NO: 85772 - RNA, 64 nt, Human
cauuuacaguguagaguaacacauaacauuguaugcauggaaacauggaggaacaguauuacag

SEQ ID NO: 85773 - RNA, 64 nt, Human
ucuaaacaacucccagguuugcuguggacaaucagcauggaauguuuucugcacucucagucau

SEQ ID NO: 85774 - RNA, 64 nt, Human
cuaagcuaucuuaaaaugcauauauauacuucuugcauggaagagcaaaacaaauucaaguugu

SEQ ID NO: 85775 - RNA, 64 nt, Human
ccccuguauaguuaggauagcauuuuugauuuaugcauggaaaccugaaaaaaaguuuacaagu

SEQ ID NO: 85776 - RNA, 64 nt, Human
uaguuucugcagaucaagcaaagaugugucuugggcauggaaccaaaguuacaaugaaauauuc

SEQ ID NO: 85777 - RNA, 64 nt, Human
cucccaacucaaagaucccaacaaugaauaggaggcauggaaguagaugugccaauggggaggg

SEQ ID NO: 85778 - RNA, 64 nt, Human
ccaaauguguaaauggcacuguugcccugacagugcauggaaaggacguuggcauccaauuggc

SEQ ID NO: 85779 - RNA, 64 nt, Human
uugguguggcacgugcgggguguuggcaccggaggcauggaaaagcacaggcuguacugccagg

SEQ ID NO: 85780 - RNA, 64 nt, Human
aaacucgaaccaagcaaaaggcuucacggaaauagcauggaaaaacaaugcuuccaguggccac

SEQ ID NO: 85781 - RNA, 64 nt, Human
uccuuggugauuccgcagugagagaguggcuggggcauggaaggcaagauugugucccauuccc

SEQ ID NO: 85782 - RNA, 64 nt, Human
aguucagcgguugaggagaauugcggcgagacaagcauggaaaaucagugacaucugauuggca

SEQ ID NO: 85783 - RNA, 64 nt, Human
uucucaauaguacaugaaaucaagaugcuuaugagcauggaaauguauuuaaaguuuuugcuug

SEQ ID NO: 85784 - RNA, 64 nt, Human
ucuacgugugaguauaaaagacaaaaguugaacagcauggaaucucauugccaaauuauuagug

SEQ ID NO: 85785 - RNA, 64 nt, Human
aggggcaaaaagcaugacugcuuuuuccugucuggcauggaaucacgcagucaccuugggcauu

SEQ ID NO: 85786 - RNA, 64 nt, Human
ccauuccggguucgagcaucacaagcuuuugagcgcauggaacuccauaaacuaacaaauuaca

SEQ ID NO: 85787 - RNA, 64 nt, Human
gauguuaugcaaaaaaaagucuauggccagguaugcauggaaaaugugggaauuaagcaaaauc

SEQ ID NO: 85788 - RNA, 64 nt, Human
augaacuguuggaugucuuccuuagaaaggguaggcauggaaaauuccacgaggcucauucuca

SEQ ID NO: 85789 - RNA, 64 nt, Human
acaucuucaguaacuugccaggcucuagcauguggcauggaauuuuggcaucuagcuaaaauuc

SEQ ID NO: 85790 - RNA, 64 nt, Human
gcccauucuucuuguguacuugugacucuuagcagcauggaagagaaguguaaccaugcaaaua

SEQ ID NO: 85791 - RNA, 64 nt, Human
ggcaccugagguggcugaggcucaucuuugaggagcauggaacucgaggggagaagucgcgccc

SEQ ID NO: 85792 - RNA, 64 nt, Human
auaaaucuauaagguuaaguauguccccagaacugcauggaacaugcuuaaucuaaacaaugau

SEQ ID NO: 85793 - RNA, 64 nt, Human
cucucccagguccuugucaccugcuugggcacgugcauggaacccgagccaacuucaccccacc

SEQ ID NO: 85794 - RNA, 64 nt, Human
gcucuuccaaagcuccugcgucuguuuuuaaagagcauggaaaaauacugccuagaaaaugcaa

SEQ ID NO: 85795 - RNA, 64 nt, Human
ugucuauaauggaaacauuuacaauaaauauucugcauggaaauacuguuaucucuguggaugu

SEQ ID NO: 85796 - RNA, 64 nt, Human
gaacauugcugcuccuuauuuauuguagugugcugcauggaacguauuuauuugaaagcauuaa

SEQ ID NO: 85797 - RNA, 64 nt, Human
uuuauaaagaauuaugccuuuuccaucaauuuuagcauggaaaaauaauuucaggcaauaugcu

SEQ ID NO: 85798 - RNA, 64 nt, Human
uauacauauauauauauauauauguaugaaacccgcauggaauuaucuguaugaaaucaaggug

SEQ ID NO: 85799 - RNA, 64 nt, Human
cagaagucauguuguuucugcacuuuauaauaaagcauggaagaaauuaucuuaguaggcaauu

SEQ ID NO: 85800 - RNA, 64 nt, Human
ccucuauuggguuauaggcaaggccuuuucucuggcauggaauuguuaauuuucugacacgucu

SEQ ID NO: 85801 - RNA, 64 nt, Human
cacccuguuagcacagcguucucaucgggagacagcauggaacucucucucgcagugcucgagg

SEQ ID NO: 85802 - RNA, 64 nt, Human
cgggccaucucagauacuuggcugacggugaaccgcauggaacagugcaggacggaauauagag

SEQ ID NO: 85803 - RNA, 64 nt, Human
uuggucuucuggauuuggaggcaaucagcggacagcauggaagaugugugcucuggcucggaua

SEQ ID NO: 85804 - RNA, 64 nt, Human
caaauuggauccauuuuuuuaaaaaaaugguuuugcauggaaccuggaccaaggcaaaugucuu

SEQ ID NO: 85805 - RNA, 64 nt, Human
gucgccucccucugcaucggccaaauuggggagggcauggaagauccagcggaaaguugaaaau

SEQ ID NO: 85806 - RNA, 64 nt, Human
uauaaggugcuuuauucccucgaauguccauuaagcauggaauuuaccaugcaguugugcuaug

SEQ ID NO: 85807 - RNA, 64 nt, Human
cucuauuggauuuguccaaacaggugcuggcccagcauggaaucugaugaaaauauucugauug

SEQ ID NO: 85808 - RNA, 64 nt, Human
aucaguaacuggucauggucaugcaucuaaaagugcauggaagaucauuuauuacuuuuuccuu

SEQ ID NO: 85809 - RNA, 64 nt, Human
ucuacgcauagcucaccuuucuaaacccaguuaagcauggaagagagguaguagguaggugcag

SEQ ID NO: 85810 - RNA, 64 nt, Human
ugggacagagaacgguguggcuuuggcugccucugcauggaaucuugccccggacuccugaaga

SEQ ID NO: 85811 - RNA, 64 nt, Human
uuuacccccacccaggaaaaccugcauugugcuagcauggaagaaucaugggcuuuggaauuaa

SEQ ID NO: 85812 - RNA, 64 nt, Human
aaagaugaguugaauuugugauaccauggguaaggcauggaagaacucuugaauguguuggcca

SEQ ID NO: 85813 - RNA, 64 nt, Human
gggagugggccgccucaugcucugcuggggccuggcauggaacgugagaccuguaagcuguccc

SEQ ID NO: 85814 - RNA, 64 nt, Human
ggaggguaccuccuguucccugucugagcauccugcauggaagucaaaggaaaucccuuucuug

SEQ ID NO: 85815 - RNA, 64 nt, Human
acacacacacacccacagagagagagcugcaagagcauggaauucauguguuuaaagauaaucc

SEQ ID NO: 85816 - RNA, 64 nt, Human
aacuggaaauuuuuaugugaguuuuccuuuuggugcauggaacugugguugccaagguauuuaa

SEQ ID NO: 85817 - RNA, 64 nt, Human
caggauugagaaagucacucaaaaccgcucaacugcauggaaacaggacaagcugcuccugaau

SEQ ID NO: 85818 - RNA, 64 nt, Human
ugaagccaccccacagaggaugcagcccccagcugcauggaagguggaggacagaagcccugug

SEQ ID NO: 85819 - RNA, 64 nt, Human
gcuuccccgaaagucugggaccagguccaggugggcauggaaugcugaugacuuggagcaggcc

SEQ ID NO: 85820 - RNA, 64 nt, Human
cuaacagguaauuauuaguuguaauagcuuuaaugcauggaaaaacuucaguuacugaccaguc

SEQ ID NO: 85821 - RNA, 64 nt, Human
ucaagccagggagaaggguucuuggugaugcagggcauggaaccuggacacccucagcucuccu

SEQ ID NO: 85822 - RNA, 64 nt, Human
aauauugccugguggguuggcugccugguauugggcauggaaauuugaauugcugauugguaga

SEQ ID NO: 85823 - RNA, 64 nt, Human
agguuucucaacucuugcuuugguguuugccgcagcauggaaaacagggcgccuaaggcuggga

SEQ ID NO: 85824 - RNA, 64 nt, Human
cuaguuuuauugguuuaguauucuuguuguuuacgcauggaaucacuauuccugguuaucucac

SEQ ID NO: 85825 - RNA, 64 nt, Human
aaguucagcuaacaaucacagcauagguucugaugcauggaaaggugguuggugaaugaaaaag

SEQ ID NO: 85826 - RNA, 64 nt, Human
aagacuucaguucuuaauguaacuguacccuucugcauggaaaaucauaaccaacauggcugca

SEQ ID NO: 85827 - RNA, 64 nt, Human
caaaugccuucaauuucugagaaaaugaggcagagcauggaaaaggaauaggaaggagaaauua

SEQ ID NO: 85828 - RNA, 64 nt, Human
cagguuagauuauggaccagaucugugagggucagcauggaaauucacauucaacaagguagca

SEQ ID NO: 85829 - RNA, 64 nt, Human
aggccccgaggagcccgaagucugcugcugugcagcauggaauuccuuuaaaaaggugcacuac

SEQ ID NO: 85830 - RNA, 64 nt, Human
guugagucauggaauaauguuuaaguuguuauuugcauggaaauuaaguaggcuguuuauuuau

SEQ ID NO: 85831 - RNA, 64 nt, Human
cacaacacccucaauagucagggcaacugguggagcauggaagucgaauuuccuuuucuguuag

SEQ ID NO: 85832 - RNA, 64 nt, Human
gccaacuaccuaacucguuaucagagcugauagagcauggaaaagucuguccagcgaucaguug

SEQ ID NO: 85833 - RNA, 64 nt, Human
cuuaguuaccaguucuggaucagucaguguuucugcauggaauaacaaccauuaaaaaaagcac

SEQ ID NO: 85834 - RNA, 64 nt, Human
agugcauucaguucaacacagcaagugcuucauugcauggaaaacacuuugaagacaaaaaaga

SEQ ID NO: 85835 - RNA, 64 nt, Human
auacucacuugacuuacugcucauuuuacuuuuugcauggaauacagccauuuaguccuaauau

SEQ ID NO: 85836 - RNA, 64 nt, Human
ccacauuuuaauuuagcaugagccaauuuacagagcauggaaaucacuuucauuuccggauugg

SEQ ID NO: 85837 - RNA, 64 nt, Human
aguuugcauauuucagaaaugaucuggugugagugcauggaaauauugcuuaauuuuucuucaa

SEQ ID NO: 85838 - RNA, 64 nt, Human
uauuauuaccaccaugcucaguaaguccauuuuugcauggaauauggagccuuaaaacauguca

SEQ ID NO: 85839 - RNA, 64 nt, Human
aauuacccucucucugcagacaugcugggaacucgcauggaacaggagggcagcagggcacuaa

SEQ ID NO: 85840 - RNA, 64 nt, Human
aaagcucauuaucucuguuugaauuaacauuucagcauggaacuaacugggcggaggaaggauc

SEQ ID NO: 85841 - RNA, 64 nt, Human
uacauugugggaacccucagaagauaggaaaaaagcauggaauagauucucccucagaguucca

SEQ ID NO: 85842 - RNA, 64 nt, Human
cugggauuugccaguugcuggcaauguagagcaggcauggaauuuuauaugcuagugagucaua

SEQ ID NO: 85843 - RNA, 64 nt, Human
gaaccugagggugguggggaggagaagguuguaggcauggaagagagccaggcagccccgaaag

SEQ ID NO: 85844 - RNA, 64 nt, Human
ccuaacacaugcuaccaugcagaccuuccaggcagcauggaaaauaccagcgccaucuuucaga

SEQ ID NO: 85845 - RNA, 64 nt, Human
cucugccuucaaacaaaggcaguucaguccacaggcauggaagcugugaggggacaggccugug

SEQ ID NO: 85846 - RNA, 64 nt, Human
accagagggaauaaggaucuuuuuuuuaaagacagcauggaaaguuuaagauuuaggaacuucu

SEQ ID NO: 85847 - RNA, 64 nt, Human
gcuuauaauggaacuaagguguacaugugcaugugcauggaaggauaaaagaucuagucugggc

SEQ ID NO: 85848 - RNA, 64 nt, Human
aauggaugaauuucuaaaauauccuccaaugugugcauggaacaaauaaucaaaagaaccagac

SEQ ID NO: 85849 - RNA, 50 nt, Human
augucuaugucuccccaugagcauggaaaggagccaccuccaccccuuuc

SEQ ID NO: 85850 - RNA, 64 nt, Human
ucauggcuagaguauccaugcaaggugucuuguugcauggaagggauaguuuggcucccuugga

SEQ ID NO: 85851 - RNA, 64 nt, Human
augaaaagccaauaggcugagacauccaauugcugcauggaaauugauguacauucaggggacg

SEQ ID NO: 85852 - RNA, 64 nt, Human
guccugggacaugguaugcuuuggggcugggguagcauggaaucccucugaggaccuggauacu

SEQ ID NO: 85853 - RNA, 64 nt, Human
gcaggaggggggcuggguaagagcacagguuagggcauggaaggcuucuccgcccauucugacc

SEQ ID NO: 85854 - RNA, 64 nt, Human
acugucaaaugaugugcaaaaccuuuuacugguugcauggaaaucagccaaguuuuauaauccu

SEQ ID NO: 85855 - RNA, 64 nt, Human
ccuguuagcuuucagucaucagccaugguuccaagcauggaacuaccauuuccuccucauaugc

SEQ ID NO: 85856 - RNA, 64 nt, Human
aguugucucagugcugaggaaccucaucagagaagcauggaagaugccaaaggauuuuuggaag

SEQ ID NO: 85857 - RNA, 64 nt, Human
ccuaguccugugugccuugaguccagaacucagggcauggaagcccuuuggcaggggccagccu

SEQ ID NO: 85858 - RNA, 64 nt, Human
caaaagccaaguuaaagcugagagcacaagugcugcauggaaaggcaauaucucugguggaaaa

SEQ ID NO: 85859 - RNA, 64 nt, Human
auaaauuuaaugcaccuucuauccugaauaacuagcauggaaaagugaauauaugugugagcag

SEQ ID NO: 85860 - RNA, 64 nt, Human
guuuaaagcaauguguaaagaugaguuuuuuuaagcauggaauuuaggguugggguacaauuug

SEQ ID NO: 85861 - RNA, 64 nt, Human
caaaaguuggauuaaaggguuguaacugacuacagcauggaaaaaaauaguucuuuuaauucuu

SEQ ID NO: 85862 - RNA, 64 nt, Human
gcacguuguuuagaaaguuggguggcuucauucagcauggaacaagcuaauggcacaggagaca

SEQ ID NO: 85863 - RNA, 64 nt, Human
aagaaaugaauuggauaauccacauaaacaaaaagcauggaaaauuuauccaccagaauuugcu

SEQ ID NO: 85864 - RNA, 64 nt, Human
accuugccugguacaguauggggguuguaaauuggcauggaaauuuaaagcagguucuuguugg

SEQ ID NO: 85865 - RNA, 64 nt, Human
aacuguaaagcuguguauagaacuguuuuguguagcauggaaauauucugucagcuuuuuaaag

SEQ ID NO: 85866 - RNA, 64 nt, Human
auugggcuuuugccuuauguugaguucaguguaagcauggaagcuagugauucugaaugauaua

SEQ ID NO: 85867 - RNA, 64 nt, Human
acagcuacauaugacauuuuaugagcuguuuacggcauggaaagaaaaucagugggaauuaaga

SEQ ID NO: 85868 - RNA, 64 nt, Human
cuucugacaaaaaacaaaaagugcugcauggcucgcauggaauccacgcgcuccagggacucug

SEQ ID NO: 85869 - RNA, 64 nt, Human
gcccuuggaagaaguggaguugguggaugggugggcauggaacaggaugggcagagaaagggua

SEQ ID NO: 85870 - RNA, 64 nt, Human
agaaaccacugggcagcaucugccuucucucuuggcauggaaucaaaggcucugguccuuguca

SEQ ID NO: 85871 - RNA, 64 nt, Human
gccccaggucuuuucuuugggacccugggggcgggcauggaaguggaaguaggggcaagcucuu

SEQ ID NO: 85872 - RNA, 64 nt, Human
uagcuguagcuuuaaaauucaacguauauaauuggcauggaaacuuaauuugcagucuuuucaa

SEQ ID NO: 85873 - RNA, 64 nt, Human
aggcuuuugaccgugauucaucacaugaguucaggcauggaaauuuucauuuggagcaucaugu

SEQ ID NO: 85874 - RNA, 64 nt, Human
ucucuuccacugcucucuauguuuuaagcaaagagcauggaauugguagaagucuugggaucuu

SEQ ID NO: 85875 - RNA, 64 nt, Human
agagugauguuggccaacauucaauuugaacagagcauggaagaccuuucaguucaucgggaaa

SEQ ID NO: 85876 - RNA, 64 nt, Human
uguuacaguuuugacuuucaacuucucuccccgugcauggaaguccugguaaaggaucuaacau

SEQ ID NO: 85877 - RNA, 64 nt, Human
gcaauguaaaugaacaaggcuccaugugacuggagcauggaagugaaugcuacuuucuuaauuu

SEQ ID NO: 85878 - RNA, 64 nt, Human
cuucaugcccuuuugggauaagaaaccacaaaacgcauggaacaacuauccauggcucuuagcc

SEQ ID NO: 85879 - RNA, 64 nt, Human
uuauuuuuuaaaaaaacaaauguuagacuugugugcauggaaguaauuaagguacaucauuauu

SEQ ID NO: 85880 - RNA, 64 nt, Human
ucaguaguguuuggggaacaaguaguguuugguugcauggaaaaguucuucaguggugauuucu

SEQ ID NO: 85881 - RNA, 64 nt, Human
auuuuauuaacuaccgugaguccggcccuuucaagcauggaaggagccugcgguuuggagucug

SEQ ID NO: 85882 - RNA, 64 nt, Human
caccucucuuuugaauucuacauuugagaaauaagcauggaaauauuagcugccccgucugcca

SEQ ID NO: 85883 - RNA, 64 nt, Human
accuggaaacuuugugucuggggaagacuguuuggcauggaauagggaagggauuccuauugac

SEQ ID NO: 85884 - RNA, 64 nt, Human
caaguguccaccaacuaccugcuaagagccgggagcauggaacguguugggauuuagagaacau

SEQ ID NO: 85885 - RNA, 64 nt, Human
gcuaauccuccugagugcuggaccucauuaaagugcauggaaaucacuggugugcaucgcugug

SEQ ID NO: 85886 - RNA, 64 nt, Human
gggcuuuccugcuggccacggagacucugcuccugcauggaaagggagccugggagccagcagc

SEQ ID NO: 85887 - RNA, 64 nt, Human
gaagcaccaugaauuaaaggugccagagcuccaugcauggaaaaguggccuguugguucaacgu

SEQ ID NO: 85888 - RNA, 64 nt, Human
caugcccagcuguauggcugggggcuccucguaugcauggaacccccagaauaaauaugcucag

SEQ ID NO: 85889 - RNA, 64 nt, Human
gagggaggcagccauccaucugggaugguccuaagcauggaauccuaacuccugauuccgucuc

SEQ ID NO: 85890 - RNA, 64 nt, Human
caaauaaaaguauuuguuauauauuugaaguuaugcauggaaaggaguguguuuaaauuguuac

SEQ ID NO: 85891 - RNA, 55 nt, Human
ccccagagccuggcuuauagagcuagcauggaacucacaccacagcuucccuggu

SEQ ID NO: 85892 - RNA, 64 nt, Human
ugcauuccaaaugaaauguguaacauuuaaaguagcauggaaccuacgucuuucccuacugcuu

SEQ ID NO: 85893 - RNA, 64 nt, Human; identical to SEQ ID NO: 85885

SEQ ID NO: 85894 - RNA, 64 nt, Human
uagcaucgauucaaagcagaguuuuaaccugacggcauggaauguauaaaugaggguggguccu

SEQ ID NO: 85895 - RNA, 64 nt, Human
aaagaauuucauagccuguaucuaucauuuagaugcauggaaaaaaaugggcuuugcacacaau

SEQ ID NO: 85896 - RNA, 64 nt, Human
gucauucucccuagcagagccacuugggucuccugcauggaagccaucacacuugggcaggugu

SEQ ID NO: 85897 - RNA, 64 nt, Human
accaucuacaccagugacgccgcugugugucuuagcauggaaauaaauaaaccugaauguacgu

SEQ ID NO: 85898 - RNA, 64 nt, Human
gaaccgcagacacuggggccuaccugaggucggagcauggaaggagggugaggaucaaaaaacu

SEQ ID NO: 85899 - RNA, 64 nt, Human
uuauuauugcuguuguugucaucguuaacugugggcauggaaugcgugaggcuggcuucugggu

SEQ ID NO: 85900 - RNA, 64 nt, Human
gccgcgugcgaccagaggugggaggccccugguggcauggaagagggagggucagugccaaguc

SEQ ID NO: 85901 - RNA, 64 nt, Human
uuucauuauuggcaacuagaggguuguuuuuaaugcauggaaacuaaacagauuccucggggag

SEQ ID NO: 85902 - RNA, 64 nt, Human
aauggcaggugcuacaaaaaugguacccacgugggcauggaaauggggcagauuaggggaccac

SEQ ID NO: 85903 - RNA, 64 nt, Human
cagcgagaaggaguguaugagugugagugugugugcauggaaguuggggcacugggcgucugac

SEQ ID NO: 85904 - RNA, 64 nt, Human
ggcucgcguggacagguggacggacgcuguggccgcauggaaccuugagaacccagggacgagc

SEQ ID NO: 85905 - RNA, 64 nt, Human
gauacagaaucuguauuguucuuacugaaacacagcauggaauuaacauuaaacuuaaauaaaa

SEQ ID NO: 85906 - RNA, 64 nt, Human
gagaggagcagagguccaaggacccaggaauuuggcauggaacaggugguaggagagccccagg

SEQ ID NO: 85907 - RNA, 64 nt, Human
gaacagcaucugcuguccuccggggucaagaaaagcauggaaagacaauauaugauguacccag

SEQ ID NO: 85908 - RNA, 64 nt, Human
gagucucccuucacacagaccauuauuuacagaugcauggaaaacaaagucuccaagaaaacac

SEQ ID NO: 85909 - RNA, 64 nt, Human
uuucagacuuugcuauucguuuuuguucuaagaugcauggaacuaaaauguggaaagaaaagaa

SEQ ID NO: 85910 - RNA, 64 nt, Human
uaccucccgagaggcugucccuggacccuggcuggcauggaaauacagugggaaaaccagucgg

SEQ ID NO: 85911 - RNA, 64 nt, Human
auguuugaauccaaaggaagucaaggaagaaaaagcauggaaaggaagagaacugauuccuacu

SEQ ID NO: 85912 - RNA, 64 nt, Human
agaaguuaggaggcaacuuugggauggugcuagagcauggaaagcacagagaauuggacaaaca

SEQ ID NO: 85913 - RNA, 64 nt, Human
acuuaauuuuuuuauugccgaauacuauuccauugcauggaaaagaccuauuuuauuucuaggu

SEQ ID NO: 85914 - RNA, 64 nt, Human
ggaaagccuucagaucagccucgcaccuucaaaugcauggaaggacucacacuggagaaaaacc

SEQ ID NO: 85915 - RNA, 64 nt, Human
ggaaagccgucagaucagccucaagacuucaaaugcauggaagcacucacacuuggcagaaacu

SEQ ID NO: 85916 - RNA, 64 nt, Human
cacuguauauuuagugucuuacuuaaggauuuaugcauggaauuuaauguaguacaagcuucgg

SEQ ID NO: 85917 - RNA, 64 nt, Human
gggacugucgcugguuggagagccacugcgcagggcauggaagguucuggacacccucaugugc

SEQ ID NO: 85918 - RNA, 64 nt, Human
ccccacaagccauggagacucaggaccccagaaggcauggaagcugccuccaguagacaucacu

SEQ ID NO: 85919 - RNA, 64 nt, Human
ucuaguguucagaaguuuggcugugaugugcguggcauggaaguuuuuggguguauucuauuug

SEQ ID NO: 85920 - RNA, 64 nt, Human
ugucuugcuucauuaaaauguaaggcuaaggagagcauggaauuugucaguuuuguucacuaaa

SEQ ID NO: 85921 - RNA, 64 nt, Human
auaugaggacccccuguucuuccucccaacgaaagcauggaagcccuaagcuuaucccccaacc

SEQ ID NO: 85922 - RNA, 64 nt, Human
ccugucuuccucuaccaagcggcucucugcaagagcauggaaaugugaguggggaaaauuuuca

SEQ ID NO: 85923 - RNA, 64 nt, Human
ggaacacacggggcuaccagaagccgagauagaagcauggaacauauguucuaguaagaagugu

SEQ ID NO: 85924 - RNA, 64 nt, Human
ggaauugagccaugccaccaaagccaagaggagcgcauggaaacccgguagucuagaacuaauc

SEQ ID NO: 85925 - RNA, 64 nt, Human
gaauugccaggggcgaggcccuuccucuuugguggcauggaaggggcuucuggaccuagggugg

SEQ ID NO: 85926 - RNA, 64 nt, Human
auccuggcagacagagguuguguccagacagccagcauggaaguuucgggaaugggaacuggug

SEQ ID NO: 85927 - RNA, 64 nt, Human
uuauucuccuguuuauuuuugcuguuacuuugaagcauggaaauucuuguuugggggaucuugg

SEQ ID NO: 85928 - RNA, 64 nt, Human
ugccagcugaggaaggagcacacgccucaucaaugcauggaagaacgugcaaugcaucagaaua

SEQ ID NO: 85929 - RNA, 64 nt, Human
acaaccagcauuuuaaaaaaugaaauagaauacagcauggaaaauaucaguguauuguuuuaug

SEQ ID NO: 85930 - RNA, 64 nt, Human
caaccccaggucuaaguccagucugucuuuguaagcauggaaauaugguguccacguggcagcu

SEQ ID NO: 85931 - RNA, 64 nt, Human
guuacaggacuucugugcauuguaaacauaaacagcauggaaaagguuaaauaccuguguucag

SEQ ID NO: 85932 - RNA, 64 nt, Human
uuauuaauaauacucugaaaaaaaugauuucaaggcauggaaguucucugugauacaacaauag

SEQ ID NO: 85933 - RNA, 64 nt, Human
cugccuuucaaggacaguucagacaaagggcccugcauggaaagagugaccucccuuugccuuu

SEQ ID NO: 85934 - RNA, 64 nt, Human
cggagagcugacaguagcccagggcuuuccaccugcauggaacaagggccugucugccgccagc

SEQ ID NO: 85935 - RNA, 64 nt, Human
uuguuuauauuuucaguaagcccuggggaauauagcauggaauugagcuacuaaaugguuuugg

SEQ ID NO: 85936 - RNA, 64 nt, Human
aaagucgcauuauuuucccauucuacucuagaaagcauggaaauuaaguguuucguacaaaaau

SEQ ID NO: 85937 - RNA, 64 nt, Human
uagcaagguugugugacuaagcccuggccaguaggcauggaagugaagacuguaauguccaagu

SEQ ID NO: 85938 - RNA, 64 nt, Human
cccuccccagggagcccaaggcaggggaggcucagcauggaaugaaacaggggagugagggaca

SEQ ID NO: 85939 - RNA, 64 nt, Human
ugggccaagcacgccagcucucagcagguuuucugcauggaagggaagguggggugauagggag

SEQ ID NO: 85940 - RNA, 64 nt, Human
uuagcaucugggguuauagcaagaagaguggggagcauggaacuccugggcucuuguggggacg

SEQ ID NO: 85941 - RNA, 64 nt, Human
gggagacaaaaccagauuggggggcccaaggggagcauggaaaaggccggcuccccugucuuuc

SEQ ID NO: 85942 - RNA, 64 nt, Human
aggcaccuggaagguuuccauguggcccagcccagcauggaagcagggugggaacucugcugug

SEQ ID NO: 85943 - RNA, 64 nt, Human
ggaaaccggguggcagcgcccagccuggccccaagcauggaaacgcacaaccccuaaucgcccu

SEQ ID NO: 85944 - RNA, 64 nt, Human
ugugaugauaauuaucagcgaucugagguacucagcauggaaaucaacauccugaacguccuca

SEQ ID NO: 85945 - RNA, 64 nt, Human
cuaccuuagaaaacaaguauugucgguuaccucugcauggaacagcauuacccuccucucuccc

SEQ ID NO: 85946 - RNA, 64 nt, Human
cugcagugggccgggaucguacuacugcacuccagcauggaagacagcgagacuccgucuccaa

SEQ ID NO: 85947 - RNA, 64 nt, Human
auuaugauuagcuuugucacuguuucacuacucagcauggaaacaagaugaaauuccauuugua

SEQ ID NO: 85948 - RNA, 64 nt, Human
ugagacaagacaaggggggcauggugugagaaaggcauggaaguaggaacccucuuccuaugac

SEQ ID NO: 85949 - RNA, 64 nt, Human
uguaaguuucugucagcaguaguuucacccauuugcauggaaaaauuuaaagcuaauaaagcaa

SEQ ID NO: 85950 - RNA, 64 nt, Human
gcucuauauuuuaguagaggauuuucacccaugugcauggaaaagauguucaugguacauugua

SEQ ID NO: 85951 - RNA, 64 nt, Human
guguggcauguuuucugagcguuccuacuuuaaagcauggaacaugcaggugauuugggaagug

SEQ ID NO: 85952 - RNA, 64 nt, Human
agaaauaagcacauagauaaccuuauugugugcugcauggaaaggaacugaauacauuugccuu

SEQ ID NO: 85953 - RNA, 64 nt, Human
cuaccuuagaaaacaaguauugucaguuaccucugcauggaacagcauuacccuccucucuccc

SEQ ID NO: 85954 - RNA, 64 nt, Human
gaacuuaaccuguuucuggcuggcuagccaaccagcauggaaaacagauuagguuagauguuca

SEQ ID NO: 85955 - RNA, 64 nt, Human
cuuuugacagcuggucccugccucgguugauugugcauggaacuaaaauguuauugccuaauca

SEQ ID NO: 85956 - RNA, 64 nt, Human
gcucuauauuuuaguagaggauuuucacccaugugcauggaaaagauguucaugacacauugua

SEQ ID NO: 85957 - RNA, 64 nt, Human
gcucugucuuuuaguagaggauuuucacccaugugcauggaauaaauguucaugguacauugua

SEQ ID NO: 85958 - RNA, 64 nt, Human
guaaguuucugucagcaggagaguuuuaccuauugcauggaaagaugcucauuauauauuguga

SEQ ID NO: 85959 - RNA, 64 nt, Human
cuggcugcggggauccagacagggcacauugggggcauggaagugccagggugguuuucaggag

SEQ ID NO: 85960 - RNA, 64 nt, Human
uagcuagguuuccauuuagaucuucauaucuguugcauggaagaaaguuggguucuuggcauag

SEQ ID NO: 85961 - RNA, 64 nt, Human
ggcaauggagcaggccaccagcagcagcugugcagcauggaacucaggccaggcuccgaggcug

SEQ ID NO: 85962 - RNA, 64 nt, Human
aauaaaacucucaguuguuuauuauccugaucaagcauggaacaaagcauguuucaggaucaga

SEQ ID NO: 85963 - RNA, 64 nt, Human; identical to SEQ ID NO: 42454

SEQ ID NO: 85964 - RNA, 64 nt, Human; identical to SEQ ID NO: 42455

SEQ ID NO: 85965 - RNA, 64 nt, Human; identical to SEQ ID NO: 42456

SEQ ID NO: 85966 - RNA, 64 nt, Human; identical to SEQ ID NO: 42457

SEQ ID NO: 85967 - RNA, 64 nt, Human; identical to SEQ ID NO: 42458

SEQ ID NO: 85968 - RNA, 64 nt, Human; identical to SEQ ID NO: 42459

SEQ ID NO: 85969 - RNA, 64 nt, Human; identical to SEQ ID NO: 42460

SEQ ID NO: 85970 - RNA, 64 nt, Human; identical to SEQ ID NO: 42461

SEQ ID NO: 85971 - RNA, 64 nt, Human; identical to SEQ ID NO: 42462

SEQ ID NO: 85972 - RNA, 64 nt, Human; identical to SEQ ID NO: 42463

SEQ ID NO: 85973 - RNA, 64 nt, Human; identical to SEQ ID NO: 42464

SEQ ID NO: 85974 - RNA, 64 nt, Human; identical to SEQ ID NO: 42465

SEQ ID NO: 85975 - RNA, 64 nt, Human; identical to SEQ ID NO: 42466

SEQ ID NO: 85976 - RNA, 64 nt, Human; identical to SEQ ID NO: 42467

SEQ ID NO: 85977 - RNA, 64 nt, Human; identical to SEQ ID NO: 42468

SEQ ID NO: 85978 - RNA, 64 nt, Human; identical to SEQ ID NO: 42469

SEQ ID NO: 85979 - RNA, 64 nt, Human; identical to SEQ ID NO: 42470

SEQ ID NO: 85980 - RNA, 64 nt, Human; identical to SEQ ID NO: 42471

SEQ ID NO: 85981 - RNA, 64 nt, Human; identical to SEQ ID NO: 42472

SEQ ID NO: 85982 - RNA, 64 nt, Human; identical to SEQ ID NO: 42473

SEQ ID NO: 85983 - RNA, 64 nt, Human; identical to SEQ ID NO: 42474

SEQ ID NO: 85984 - RNA, 64 nt, Human; identical to SEQ ID NO: 42475

SEQ ID NO: 85985 - RNA, 64 nt, Human; identical to SEQ ID NO: 42476

SEQ ID NO: 85986 - RNA, 64 nt, Human; identical to SEQ ID NO: 42477

SEQ ID NO: 85987 - RNA, 64 nt, Human; identical to SEQ ID NO: 42478

SEQ ID NO: 85988 - RNA, 64 nt, Human; identical to SEQ ID NO: 42479

SEQ ID NO: 85989 - RNA, 64 nt, Human; identical to SEQ ID NO: 42480

SEQ ID NO: 85990 - RNA, 64 nt, Human; identical to SEQ ID NO: 42481

SEQ ID NO: 85991 - RNA, 64 nt, Human; identical to SEQ ID NO: 42482

SEQ ID NO: 85992 - RNA, 64 nt, Human; identical to SEQ ID NO: 42483

SEQ ID NO: 85993 - RNA, 64 nt, Human; identical to SEQ ID NO: 42484

SEQ ID NO: 85994 - RNA, 64 nt, Human; identical to SEQ ID NO: 42485

SEQ ID NO: 85995 - RNA, 64 nt, Human; identical to SEQ ID NO: 42486

SEQ ID NO: 85996 - RNA, 64 nt, Human; identical to SEQ ID NO: 42487

SEQ ID NO: 85997 - RNA, 64 nt, Human; identical to SEQ ID NO: 42488

SEQ ID NO: 85998 - RNA, 64 nt, Human; identical to SEQ ID NO: 42489

SEQ ID NO: 85999 - RNA, 64 nt, Human; identical to SEQ ID NO: 42490

SEQ ID NO: 86000 - RNA, 64 nt, Human; identical to SEQ ID NO: 42491

SEQ ID NO: 86001 - RNA, 64 nt, Human; identical to SEQ ID NO: 42492

SEQ ID NO: 86002 - RNA, 64 nt, Human; identical to SEQ ID NO: 42493

SEQ ID NO: 86003 - RNA, 64 nt, Human; identical to SEQ ID NO: 42494

SEQ ID NO: 86004 - RNA, 64 nt, Human; identical to SEQ ID NO: 42495

SEQ ID NO: 86005 - RNA, 64 nt, Human; identical to SEQ ID NO: 42496

SEQ ID NO: 86006 - RNA, 64 nt, Human; identical to SEQ ID NO: 42497

SEQ ID NO: 86007 - RNA, 64 nt, Human; identical to SEQ ID NO: 42498

SEQ ID NO: 86008 - RNA, 64 nt, Human; identical to SEQ ID NO: 42499

SEQ ID NO: 86009 - RNA, 64 nt, Human; identical to SEQ ID NO: 42500

SEQ ID NO: 86010 - RNA, 64 nt, Human; identical to SEQ ID NO: 42501

SEQ ID NO: 86011 - RNA, 64 nt, Human; identical to SEQ ID NO: 42502

SEQ ID NO: 86012 - RNA, 64 nt, Human; identical to SEQ ID NO: 42503

SEQ ID NO: 86013 - RNA, 50 nt, Human; identical to SEQ ID NO: 42504

SEQ ID NO: 86014 - RNA, 64 nt, Human; identical to SEQ ID NO: 42505

SEQ ID NO: 86015 - RNA, 64 nt, Human; identical to SEQ ID NO: 42506

SEQ ID NO: 86016 - RNA, 64 nt, Human; identical to SEQ ID NO: 42507

SEQ ID NO: 86017 - RNA, 64 nt, Human; identical to SEQ ID NO: 42508

SEQ ID NO: 86018 - RNA, 64 nt, Human; identical to SEQ ID NO: 42509

SEQ ID NO: 86019 - RNA, 64 nt, Human; identical to SEQ ID NO: 42510

SEQ ID NO: 86020 - RNA, 64 nt, Human; identical to SEQ ID NO: 42511

SEQ ID NO: 86021 - RNA, 64 nt, Human; identical to SEQ ID NO: 42512

SEQ ID NO: 86022 - RNA, 64 nt, Human; identical to SEQ ID NO: 42513

SEQ ID NO: 86023 - RNA, 64 nt, Human; identical to SEQ ID NO: 42514

SEQ ID NO: 86024 - RNA, 64 nt, Human; identical to SEQ ID NO: 42515

SEQ ID NO: 86025 - RNA, 64 nt, Human; identical to SEQ ID NO: 42516

SEQ ID NO: 86026 - RNA, 64 nt, Human; identical to SEQ ID NO: 42517

SEQ ID NO: 86027 - RNA, 64 nt, Human; identical to SEQ ID NO: 42518

SEQ ID NO: 86028 - RNA, 64 nt, Human; identical to SEQ ID NO: 42519

SEQ ID NO: 86029 - RNA, 64 nt, Human; identical to SEQ ID NO: 42520

SEQ ID NO: 86030 - RNA, 64 nt, Human; identical to SEQ ID NO: 42521

SEQ ID NO: 86031 - RNA, 64 nt, Human; identical to SEQ ID NO: 42522

SEQ ID NO: 86032 - RNA, 64 nt, Human; identical to SEQ ID NO: 42523

SEQ ID NO: 86033 - RNA, 64 nt, Human; identical to SEQ ID NO: 42524

SEQ ID NO: 86034 - RNA, 64 nt, Human; identical to SEQ ID NO: 42525

SEQ ID NO: 86035 - RNA, 64 nt, Human; identical to SEQ ID NO: 84735

SEQ ID NO: 86036 - RNA, 64 nt, Human; identical to SEQ ID NO: 84739

SEQ ID NO: 86037 - RNA, 64 nt, Human; identical to SEQ ID NO: 42454

SEQ ID NO: 86038 - RNA, 64 nt, Human; identical to SEQ ID NO: 42455

SEQ ID NO: 86039 - RNA, 64 nt, Human; identical to SEQ ID NO: 42456

SEQ ID NO: 86040 - RNA, 64 nt, Human; identical to SEQ ID NO: 42457

SEQ ID NO: 86041 - RNA, 64 nt, Human; identical to SEQ ID NO: 42458

SEQ ID NO: 86042 - RNA, 64 nt, Human; identical to SEQ ID NO: 42459

SEQ ID NO: 86043 - RNA, 64 nt, Human; identical to SEQ ID NO: 42460

SEQ ID NO: 86044 - RNA, 64 nt, Human; identical to SEQ ID NO: 42461

SEQ ID NO: 86045 - RNA, 64 nt, Human; identical to SEQ ID NO: 42462

SEQ ID NO: 86046 - RNA, 64 nt, Human; identical to SEQ ID NO: 42463

SEQ ID NO: 86047 - RNA, 64 nt, Human; identical to SEQ ID NO: 42464

SEQ ID NO: 86048 - RNA, 64 nt, Human; identical to SEQ ID NO: 42465

SEQ ID NO: 86049 - RNA, 64 nt, Human; identical to SEQ ID NO: 42466

SEQ ID NO: 86050 - RNA, 64 nt, Human; identical to SEQ ID NO: 42467

SEQ ID NO: 86051 - RNA, 64 nt, Human; identical to SEQ ID NO: 42468

SEQ ID NO: 86052 - RNA, 64 nt, Human; identical to SEQ ID NO: 42469

SEQ ID NO: 86053 - RNA, 64 nt, Human; identical to SEQ ID NO: 42470

SEQ ID NO: 86054 - RNA, 64 nt, Human; identical to SEQ ID NO: 42471

SEQ ID NO: 86055 - RNA, 64 nt, Human; identical to SEQ ID NO: 42472

SEQ ID NO: 86056 - RNA, 64 nt, Human; identical to SEQ ID NO: 42473

SEQ ID NO: 86057 - RNA, 64 nt, Human; identical to SEQ ID NO: 42474

SEQ ID NO: 86058 - RNA, 64 nt, Human; identical to SEQ ID NO: 42475

SEQ ID NO: 86059 - RNA, 64 nt, Human; identical to SEQ ID NO: 42476

SEQ ID NO: 86060 - RNA, 64 nt, Human; identical to SEQ ID NO: 42477

SEQ ID NO: 86061 - RNA, 64 nt, Human; identical to SEQ ID NO: 42478

SEQ ID NO: 86062 - RNA, 64 nt, Human; identical to SEQ ID NO: 42479

SEQ ID NO: 86063 - RNA, 64 nt, Human; identical to SEQ ID NO: 42480

SEQ ID NO: 86064 - RNA, 64 nt, Human; identical to SEQ ID NO: 42481

SEQ ID NO: 86065 - RNA, 64 nt, Human; identical to SEQ ID NO: 42482

SEQ ID NO: 86066 - RNA, 64 nt, Human; identical to SEQ ID NO: 42483

SEQ ID NO: 86067 - RNA, 64 nt, Human; identical to SEQ ID NO: 42484

SEQ ID NO: 86068 - RNA, 64 nt, Human; identical to SEQ ID NO: 42485

SEQ ID NO: 86069 - RNA, 64 nt, Human; identical to SEQ ID NO: 42486

SEQ ID NO: 86070 - RNA, 64 nt, Human; identical to SEQ ID NO: 42487

SEQ ID NO: 86071 - RNA, 64 nt, Human; identical to SEQ ID NO: 42488

SEQ ID NO: 86072 - RNA, 64 nt, Human; identical to SEQ ID NO: 42489

SEQ ID NO: 86073 - RNA, 64 nt, Human; identical to SEQ ID NO: 42490

SEQ ID NO: 86074 - RNA, 64 nt, Human; identical to SEQ ID NO: 42491

SEQ ID NO: 86075 - RNA, 64 nt, Human; identical to SEQ ID NO: 42492

SEQ ID NO: 86076 - RNA, 64 nt, Human; identical to SEQ ID NO: 42493

SEQ ID NO: 86077 - RNA, 64 nt, Human; identical to SEQ ID NO: 42494

SEQ ID NO: 86078 - RNA, 64 nt, Human; identical to SEQ ID NO: 42495

SEQ ID NO: 86079 - RNA, 64 nt, Human; identical to SEQ ID NO: 42496

SEQ ID NO: 86080 - RNA, 64 nt, Human; identical to SEQ ID NO: 42497

SEQ ID NO: 86081 - RNA, 64 nt, Human; identical to SEQ ID NO: 42498

SEQ ID NO: 86082 - RNA, 64 nt, Human; identical to SEQ ID NO: 42499

SEQ ID NO: 86083 - RNA, 64 nt, Human; identical to SEQ ID NO: 42500

SEQ ID NO: 86084 - RNA, 64 nt, Human; identical to SEQ ID NO: 42501

SEQ ID NO: 86085 - RNA, 64 nt, Human; identical to SEQ ID NO: 42502

SEQ ID NO: 86086 - RNA, 64 nt, Human; identical to SEQ ID NO: 42503

SEQ ID NO: 86087 - RNA, 50 nt, Human; identical to SEQ ID NO: 42504

SEQ ID NO: 86088 - RNA, 64 nt, Human; identical to SEQ ID NO: 42505

SEQ ID NO: 86089 - RNA, 64 nt, Human; identical to SEQ ID NO: 42506

SEQ ID NO: 86090 - RNA, 64 nt, Human; identical to SEQ ID NO: 42507

SEQ ID NO: 86091 - RNA, 64 nt, Human; identical to SEQ ID NO: 42508

SEQ ID NO: 86092 - RNA, 64 nt, Human; identical to SEQ ID NO: 42509

SEQ ID NO: 86093 - RNA, 64 nt, Human; identical to SEQ ID NO: 42510

SEQ ID NO: 86094 - RNA, 64 nt, Human; identical to SEQ ID NO: 42511

SEQ ID NO: 86095 - RNA, 64 nt, Human; identical to SEQ ID NO: 42512

SEQ ID NO: 86096 - RNA, 64 nt, Human; identical to SEQ ID NO: 42513

SEQ ID NO: 86097 - RNA, 64 nt, Human; identical to SEQ ID NO: 42514

SEQ ID NO: 86098 - RNA, 64 nt, Human; identical to SEQ ID NO: 42515

SEQ ID NO: 86099 - RNA, 64 nt, Human; identical to SEQ ID NO: 42516

SEQ ID NO: 86100 - RNA, 64 nt, Human; identical to SEQ ID NO: 42517

SEQ ID NO: 86101 - RNA, 64 nt, Human; identical to SEQ ID NO: 42518

SEQ ID NO: 86102 - RNA, 64 nt, Human; identical to SEQ ID NO: 42519

SEQ ID NO: 86103 - RNA, 64 nt, Human; identical to SEQ ID NO: 42520

SEQ ID NO: 86104 - RNA, 64 nt, Human; identical to SEQ ID NO: 42521

SEQ ID NO: 86105 - RNA, 64 nt, Human; identical to SEQ ID NO: 42522

SEQ ID NO: 86106 - RNA, 64 nt, Human; identical to SEQ ID NO: 42523

SEQ ID NO: 86107 - RNA, 64 nt, Human; identical to SEQ ID NO: 42524

SEQ ID NO: 86108 - RNA, 64 nt, Human; identical to SEQ ID NO: 42525

SEQ ID NO: 86109 - RNA, 64 nt, Human; identical to SEQ ID NO: 84743

SEQ ID NO: 86110 - RNA, 64 nt, Human
ugcaaguuuuaaauuuccaaccuuaagugaauuuguggaccaaauuucaaaggaacuuuuugug

SEQ ID NO: 86111 - RNA, 64 nt, Human
gcguggugcgcccuaguacgacuccgcccaguguguggaccaaccaaauagcauucuuugcugu

SEQ ID NO: 86112 - RNA, 64 nt, Human
ugucaggucgaugucucagaacacucucccagcuguggaccacguggaccacuuagcagacuca

SEQ ID NO: 86113 - RNA, 64 nt, Human
gaugucucagaacacucucccagcuguggaccacguggaccacuuagcagacucaggggguagu

SEQ ID NO: 86114 - RNA, 64 nt, Human
cccucuaccccuuccccccacguagggcacuguaguggaccaagcacggggacagccauggguc

SEQ ID NO: 86115 - RNA, 64 nt, Human
caguaauuauuacugaguuaaauugaaaaguccaguggaccaggcauuucuuauauaaauaaaa

SEQ ID NO: 86116 - RNA, 64 nt, Human
gauacugggccucuuccuugucaugucugaagcuguggaccagagaccuggacuuuugucugcu

SEQ ID NO: 86117 - RNA, 64 nt, Human
ugcccagcgcuggggugaggcugccguugucagcguggaccacuaaccagcccgucuucucucu

SEQ ID NO: 86118 - RNA, 64 nt, Human
ccagguucuagcccccacgcaccccagaccccagguggaccauccucccaaacuagggcccucc

SEQ ID NO: 86119 - RNA, 64 nt, Human
uguagaauccuccucugccugggaguggcucuguguggaccagucccucacuggcccauucuuu

SEQ ID NO: 86120 - RNA, 64 nt, Human
aaacauacauaacauugaaacagaaggaaaugcuguggaccacagaacuccaagaauuguuuaa

SEQ ID NO: 86121 - RNA, 64 nt, Human
uacaguuacuuuauuuauauagguguuaagcuuuguggaccagguguuuuucuuuuggggcgaa

SEQ ID NO: 86122 - RNA, 64 nt, Human
uuuguuggcaugggcagggguugagucagcagaaguggaccaaaggauuccucugaauaaaguu

SEQ ID NO: 86123 - RNA, 64 nt, Human
uuuccuucauuucccuaagccuguggcccaaaugguggaccagaaugauggugggagggggcaa

SEQ ID NO: 86124 - RNA, 64 nt, Human
agauuuuuaucuuuuguuaaaauguguauaccccguggaccaacauaauauuaaaguauguaua

SEQ ID NO: 86125 - RNA, 64 nt, Human
agaaauggauucaguauaaggauaaggagggaagguggaccagaaugaaaacuguaaauauuuu

SEQ ID NO: 86126 - RNA, 64 nt, Human
auaauauugugucauagaauuaauuuucagccauguggaccauauuuuguauccaaggauccuu

SEQ ID NO: 86127 - RNA, 64 nt, Human
cacagauggggagaaccuaucugcauggaccucuguggaccacagcguaccugccccuuucugc

SEQ ID NO: 86128 - RNA, 64 nt, Human
agcaucccauuugcccacacugugggaagacggaguggaccaggcuguuuuugaaguaagggaa

SEQ ID NO: 86129 - RNA, 64 nt, Human
auaaucauggcuaaauauuuauggagggccuacuguggaccaggcacugggcuaaauacuuaca

SEQ ID NO: 86130 - RNA, 64 nt, Human
uugaacuagcuuaaggcccaggacuguggaguguguggaccaccccacagaggagggacucaga

SEQ ID NO: 86131 - RNA, 64 nt, Human
uaacacucccaaacacagacauacuuuuguagaaguggaccaacuucaaagcucuggacaggag

SEQ ID NO: 86132 - RNA, 64 nt, Human
cccaccugccauucugacuuuauuaaaucaacauguggaccagaguguuaaugagauguuauug

SEQ ID NO: 86133 - RNA, 64 nt, Human
uauugauugcuucagaaucccaaaagaaaaccuuguggaccaugugacauggaauauuugggau

SEQ ID NO: 86134 - RNA, 64 nt, Human
ccuuuaauuuuacagauaccacuugcuguaggcuguggaccaagauguccagaauuauucuuga

SEQ ID NO: 86135 - RNA, 64 nt, Human
uuuuuuagagagcuguucccaaauuuucuaacgaguggaccauuaucacuuuaaagcccuuuau

SEQ ID NO: 86136 - RNA, 64 nt, Human
auaaucgaauucauuuaacaugaaucuugaguacguggaccauugcuugcauguuaacuuuuug

SEQ ID NO: 86137 - RNA, 64 nt, Human
uuccuggguaauggugggucuuaauggaggcuggguggaccacugcccguccacucuucaacag

SEQ ID NO: 86138 - RNA, 64 nt, Human
aaacucugcuuucugcccaccuuggaugggaacuguggaccaagcaauuaccaucgccuuggaa

SEQ ID NO: 86139 - RNA, 64 nt, Human
ccuagccuaguagaaaugggggaaaagcauugcuguggaccauuguuaaagugacaggaguugu

SEQ ID NO: 86140 - RNA, 64 nt, Human
ggccuaacuguuccagagcagaggccaugauuuaguggaccaugaaugauugagauuuugccug

SEQ ID NO: 86141 - RNA, 64 nt, Human
ggccugugcuccccaugggugaccucuggaggcaguggaccaagaugcagcaaggagaggaugc

SEQ ID NO: 86142 - RNA, 64 nt, Human
cuguugagggacuaggggagugguggggaggugaguggaccaaaggauauaggccccaggcaug

SEQ ID NO: 86143 - RNA, 64 nt, Human
ugcucauagugguuucccggagccaguagucacgguggaccauucccuacuugcuuuuccuugg

SEQ ID NO: 86144 - RNA, 64 nt, Human
gcuuccuuccaggaacagucccucaggagaggcaguggaccagaagagauggcgaaacgugagc

SEQ ID NO: 86145 - RNA, 64 nt, Human
ugccccugugggggagccuguaaaugcgggcucaguggaccacuggugacugggcucaugccuc

SEQ ID NO: 86146 - RNA, 64 nt, Human
guaaccuucuaugguguuuuguggcucuuaucuuguggaccauaaauaacacggcccaauaacu

SEQ ID NO: 86147 - RNA, 64 nt, Human
uguaaagggccagauuguaaauauuucagacuguguggaccaaaaggccacauacagucucugu

SEQ ID NO: 86148 - RNA, 64 nt, Human
ccaggguuucccacuaaagguauuaauaaguccaguggaccacagagggcccaaucccucuugg

SEQ ID NO: 86149 - RNA, 64 nt, Human
cuuggggacucagcaggcuggagcuuggggccugguggaccaucaccuggugucuguaggugga

SEQ ID NO: 86150 - RNA, 64 nt, Human
uugacacucucuccaaaaauccauuccauugucuguggaccaagauguucuauguaauucagaa

SEQ ID NO: 86151 - RNA, 64 nt, Human
gccuggagaccacggucacuuguugacugucucuguggaccagagugcuugaggcaucucaggc

SEQ ID NO: 86152 - RNA, 64 nt, Human
cugccaaaaccaaaucuuuuaagaaaauuaaacuguggaccaugcccaucagcucagucagguu

SEQ ID NO: 86153 - RNA, 64 nt, Human
cugcaacuauugcaccucucuauuugaauuuacuguggaccauguguggugucucuaugcccuu

SEQ ID NO: 86154 - RNA, 64 nt, Human
uauauguguuggaagacugaguauugaugggggaguggaccagacaaagagguaagaugaaaca

SEQ ID NO: 86155 - RNA, 64 nt, Human
cguuacuacagcaucugccaggacacugccuuggguggaccaggcuuccaagaaagaggaggag

SEQ ID NO: 86156 - RNA, 64 nt, Human
aaagcaggguuccucugccugcuaacaagcccacguggaccagucugaaugucuuuccuuuaca

SEQ ID NO: 86157 - RNA, 64 nt, Human
gauggacgucgaggaccgggcacucccgggauggguggaccaaacccuuagcagcccagcauuu

SEQ ID NO: 86158 - RNA, 64 nt, Human
ugagaaacuucuuagauuuuuauauguaaaugcuguggaccacugggagcacaaugcccacauc

SEQ ID NO: 86159 - RNA, 64 nt, Human
uacuguugacaguuuccgcagaaauccuauuucaguggaccaacauuguggcauggcagcaaau

SEQ ID NO: 86160 - RNA, 64 nt, Human
auaauuccaacauuguggauuucaucuuauaucuguggaccauccuaguuuauucucccauaag

SEQ ID NO: 86161 - RNA, 64 nt, Human
uucccucacuuuacacaaucauuauucuucaauaguggaccauauccuucaccagguauccuau

SEQ ID NO: 86162 - RNA, 64 nt, Human
cgccgcgcuuaagaacauugccucugggugucauguggaccagacuucugaauagagaauauuu

SEQ ID NO: 86163 - RNA, 64 nt, Human
augauccccaagugugaacaaaagaugcucuucuguggaccacugcaugagcuuuuauacuacc

SEQ ID NO: 86164 - RNA, 64 nt, Human
uguugacuuaauuccaaaugggaucuccauaccuguggaccaaaccaacaaguaaguuuugaca

SEQ ID NO: 86165 - RNA, 64 nt, Human
ccuguaaucccagcacuuugggaggccaagguggguggaccacaugaggucaggaguuugagau

SEQ ID NO: 86166 - RNA, 64 nt, Human
caacuuauuuuuuaaaguagguuuucuuacuuugguggaccagaagugagagauuguuauauuu

SEQ ID NO: 86167 - RNA, 64 nt, Human
uacuggacaagcugguacagccaacccccuagguguggaccagcugaggcaggugggcagauau

SEQ ID NO: 86168 - RNA, 64 nt, Human
ccugugaucccagcacuuugggaggccgagguggguggaccaccugagaucagguguucaagac

SEQ ID NO: 86169 - RNA, 64 nt, Human
uggauaaaaaguuaugaacuauuaaaaaugugauguggaccaaaggcuagguuguaaucuugau

SEQ ID NO: 86170 - RNA, 64 nt, Human
auuucacucuugugguuuuuuggccucacucuuuguggaccacuaagguaaauaaaaaugcaua

SEQ ID NO: 86171 - RNA, 64 nt, Human
agugucuuuuggccaaauugaaccuacuuguaauguggaccaacuuacuuuacacauuuucauc

SEQ ID NO: 86172 - RNA, 64 nt, Human
aaggaggcccagcuguggggguugaggguagaggguggaccagaggcugaggacugagccaccc

SEQ ID NO: 86173 - RNA, 64 nt, Human
gaagggggugugagggggaggguauuucuggaaaguggaccagcaugugcaaaaauauggaacu

SEQ ID NO: 86174 - RNA, 64 nt, Human
cagcuuuuuuccucuuuuggcucaguauuuaaaaguggaccaacuugcucuuaaucacagggcc

SEQ ID NO: 86175 - RNA, 64 nt, Human
ugaaagaaaauaucucugaccaacuucuguauucguggaccaaacugaagcuauauuuuucaca

SEQ ID NO: 86176 - RNA, 64 nt, Human
auuguaaagugaagauuguucuacugcaugugaaguggaccaugcagauuucuguauguucuca

SEQ ID NO: 86177 - RNA, 64 nt, Human
cgucucccgcaaugggcagagagagcagagacagguggaccaacagacagcuggccccuggagg

SEQ ID NO: 86178 - RNA, 64 nt, Human
uaauauauauaucauugagggugacuaaucuucaguggaccaaaucucuacccuuccccaaccc

SEQ ID NO: 86179 - RNA, 64 nt, Human
uccuucacuuuuguuguccaugugguucccuuccguggaccagccguaauaaagagccaaggua

SEQ ID NO: 86180 - RNA, 64 nt, Human
agccacccuggagcccuuaaugguuacagaaauuguggaccagggcuuuauuuaccacuauaca

SEQ ID NO: 86181 - RNA, 64 nt, Human
ccccuucugcaccgcuggcuuccacuccaagaagguggaccagggucugcaaguucaacgguca

SEQ ID NO: 86182 - RNA, 64 nt, Human
acagacacagcaggaggagagggagguggcgcugguggaccaaggaucugugcuacccgcuccc

SEQ ID NO: 86183 - RNA, 64 nt, Human
ucguaaaaccuucagaaggaaaggagaauguuuuguggaccacuuugguuuucuuuuuugcgug

SEQ ID NO: 86184 - RNA, 64 nt, Human
cuuuacuucugguuccugaaaucauauuuuuccaguggaccauccuccaguggcugugguuguu

SEQ ID NO: 86185 - RNA, 64 nt, Human
cagccaaucuuaaaacauuccgaagaauuccauaguggaccacuuggaaauaaaccauuggaca

SEQ ID NO: 86186 - RNA, 64 nt, Human
aucagcacuugaggccuugccccacgccuucucuguggaccauucaggaccuccagugggggug

SEQ ID NO: 86187 - RNA, 64 nt, Human
ggacuuauuccgcuuuccacaccgaacacuaaauguggaccaguaucaagaacccuccuguccc

SEQ ID NO: 86188 - RNA, 64 nt, Human
cagggaguguuuuccugugaggccucccccaucaguggaccagagggagaagcccgaugcccca

SEQ ID NO: 86189 - RNA, 64 nt, Human
aaucaucagaaauauugacacuugagggucacugguggaccaugcuaguauuuuggugcugagu

SEQ ID NO: 86190 - RNA, 64 nt, Human
gaggaugaaggcgaguaugugacacuggagaaaaguggaccaggcaugucuuuugcuuugaucu

SEQ ID NO: 86191 - RNA, 64 nt, Human
uugucucaguuauacaaguggcaagaagaggacaguggaccagcuccugggaccuuccaaaaca

SEQ ID NO: 86192 - RNA, 64 nt, Human
ggucugaacgucuccuagccaaucagaacuggcuguggaccacccuagcacggccaccucucag

SEQ ID NO: 86193 - RNA, 64 nt, Human
uaugguugacacuagcccaaugaaaugaauuaaaguggaccaauagggcugagcucucuguggg

SEQ ID NO: 86194 - RNA, 64 nt, Human
agagaaagaacuggaauuucgcucuggaggggauguggaccacaguacucuagucacccucuuc

SEQ ID NO: 86195 - RNA, 64 nt, Human
caggcccucuucagaccgcaguccaugccccauuguggaccacccacacugagaccaccugccc

SEQ ID NO: 86196 - RNA, 64 nt, Human
ugcuuuugaaaaaugcuuguuacaugaauaauuuguggaccagggauugcuuuucugaaggcag

SEQ ID NO: 86197 - RNA, 64 nt, Human
gugcaugcgugcguguaugcgugugugaaagcagguggaccauuccacuuuuuagcuccuauug

SEQ ID NO: 86198 - RNA, 64 nt, Human
ugaguuagcucagggccgguggacauguucacugguggaccaguuggcauugaccuaaacggac

SEQ ID NO: 86199 - RNA, 62 nt, Human
auguaauccaaaauaacugagcuguggcaguuguggaccauaugacacagcuuguccccauc

SEQ ID NO: 86200 - RNA, 64 nt, Human
gaagaauauauggaaaggguggcauuugcgucacguggaccagggacagugcugaaaucagcag

SEQ ID NO: 86201 - RNA, 64 nt, Human
gaaaucaaggcauguacuugcuguucgaggcccuguggaccaacaucggcuucucagauggcuu

SEQ ID NO: 86202 - RNA, 64 nt, Human
uuccauucugcaggaguuuuagcuauuugagaucguggaccaucaguuuugcacuuuagagagu

SEQ ID NO: 86203 - RNA, 64 nt, Human
uuacgugggugcccucuccaaaggcgggguggcgguggaccaaaggaaggaagcaagcaucucc

SEQ ID NO: 86204 - RNA, 64 nt, Human
ccaaugccugaugguucccagaucuaugaaaugaguggaccauuaaccuuacauguaaagauua

SEQ ID NO: 86205 - RNA, 64 nt, Human
cuuuuuuuuucuuauuuuaauuuuaaugaacaagguggaccaaagggcugaaccagccccucaa

SEQ ID NO: 86206 - RNA, 64 nt, Human
ggugugggugcccuguugaccuacccuggaccgaguggaccacgaccucguccauuuaaacccg

SEQ ID NO: 86207 - RNA, 64 nt, Human
uccucucugaagaugauuuggccgagcggaagguguggaccaccggaaaguucuuaaaaguugc

SEQ ID NO: 86208 - RNA, 64 nt, Human
acacacaaaacaaauuaaaaacaaauuauuccagguggaccaagaauucacaguuuaauaaucu

SEQ ID NO: 86209 - RNA, 64 nt, Human
gcuguuuccuccuggugcccugagcgggcaggagguggaccacccuggcugaaaugacacaccu

SEQ ID NO: 86210 - RNA, 64 nt, Human
ggcaggaagaggugagaagaucagaugguccaaaguggaccacacuugguccauuuuacacuuu

SEQ ID NO: 86211 - RNA, 64 nt, Human
cuagucuucccuuaccucaaaggcucucacuaccguggaccaccuagucuguaacucuuucuga

SEQ ID NO: 86212 - RNA, 64 nt, Human
ggaucuucaggaacuucugaccucaccaagucaaguggaccacucuccacuccacgaggaugug

SEQ ID NO: 86213 - RNA, 64 nt, Human
acgccugccauuggucaggcugaccuggccucccguggaccacucgcugccuuaggugccuucu

SEQ ID NO: 86214 - RNA, 64 nt, Human
gucaagguugguuggcugauugguggaaaguaggguggaccaaaggaggccacgugagcaguca

SEQ ID NO: 86215 - RNA, 64 nt, Human
gucauggcugccguaaaccgagcucuuacagugcguggaccauguuuuaauaauccaaaauaau

SEQ ID NO: 86216 - RNA, 64 nt, Human
gugcaucuuuuguaucucaggcguggcuucuucaguggaccaagcugcaaugcaguauugacuu

SEQ ID NO: 86217 - RNA, 64 nt, Human
uaugaccagagccuugcaacucaaaguguggucuguggaccagcagcggcagugacaccuggga

SEQ ID NO: 86218 - RNA, 64 nt, Human
gccuugucauggccuccugggggcagaaggcgauguggaccacgggauuuguagccagccagcu

SEQ ID NO: 86219 - RNA, 64 nt, Human
cuguuaguaagaguugggggaggugcccagguggguggaccaguacuccaggugauggggcaug

SEQ ID NO: 86220 - RNA, 64 nt, Human
auguaaccccucucaccugccgugcguacuggcuguggaccaguaggacucaagguggacgugc

SEQ ID NO: 86221 - RNA, 64 nt, Human
ucaguugagggaaaagcucaagugccuuaggcccguggaccacagucuuggcugagaucaaagg

SEQ ID NO: 86222 - RNA, 64 nt, Human
acgaggagagcgugcauagcgacacucgggaccuguggaccacgaccacgcugucccaggcaca

SEQ ID NO: 86223 - RNA, 64 nt, Human
uuuggugaugucacugcugggagguggcuauccuguggaccaccuggccuccagacccacacuc

SEQ ID NO: 86224 - RNA, 64 nt, Human
ccgaagcguccugaugggccgcugcuuugcgcugguggaccacaggcaucuacacagccuggac

SEQ ID NO: 86225 - RNA, 64 nt, Human
cagccaacugccaugguguucccugcacuuggguguggaccaucuucuucuucucccucggcug

SEQ ID NO: 86226 - RNA, 64 nt, Human
caugugauuucaggguugccgcagugucaccucaguggaccagccugggggaaggagcuuaauu

SEQ ID NO: 86227 - RNA, 64 nt, Human
ugaauaguauacuucuuaacuagguuuacaacugguggaccacacaccaggcacuaaucaccug

SEQ ID NO: 86228 - RNA, 64 nt, Human
cagccgacugccacgauguucccugcacuuggguguggaccaucuucuucuucucccugggcug

SEQ ID NO: 86229 - RNA, 64 nt, Human
acuggguuugaaccaaaugccguagugacuugcuguggaccaaguccuuccaucuaauagaagc

SEQ ID NO: 86230 - RNA, 64 nt, Human
ucccuggacgccaugguguucccugcacuuggguguggaccaucuucuucuucucccugggcug

SEQ ID NO: 86231 - RNA, 64 nt, Human
gcacaagacagguagggaaaggggacuugugguaguggaccauaccuggggaccaaaagagacc

SEQ ID NO: 86232 - RNA, 64 nt, Human
cuuucacugacaauuccaacauucuuuacuuacaguggaccaauggauaagucuaugcaucuau

SEQ ID NO: 86233 - RNA, 64 nt, Human
ccuuccuggaccaggccugaagaggguccuggggguggaccaaaguccaacuugguuucagugc

SEQ ID NO: 86234 - RNA, 64 nt, Human
ucaccaaaaucaguaguuaggcagcccagcugagguggaccaacuaauuggaaacacucuuccc

SEQ ID NO: 86235 - RNA, 64 nt, Human
accuggacaacaagagcgaaacuccgucuuagaaguggaccaggacaggaccagauuuuggagu

SEQ ID NO: 86236 - RNA, 64 nt, Human
cacccuggaccugguccaaauacagacuuacacaguggaccauucuuuccugagcuagccaaca

SEQ ID NO: 86237 - RNA, 64 nt, Human
gcuacucggccaaaccuagccagggucuguucuuguggaccagagccagccuagucauuauuug

SEQ ID NO: 86238 - RNA, 64 nt, Human
agcaaguaauggaauugcacauauuaguaacccaguggaccauaauuggcagucacuggaaguc

SEQ ID NO: 86239 - RNA, 64 nt, Human
gugggcccaagggcagaccuuucuuugggacuguguggaccaaggagcuuccaucuagugacaa

SEQ ID NO: 86240 - RNA, 64 nt, Human
cuugcaacaccgagguuuuggguguugacauaaaguggaccacacaccacaucugcugccgucu

SEQ ID NO: 86241 - RNA, 64 nt, Human
aucauuaaacaagccaguaggucaccuggcuuccguggaccaauucaucuuucagacaagcuuu

SEQ ID NO: 86242 - RNA, 64 nt, Human
aucauuaaacaagccaguaggucaccuggcuuccguggaccaauucaucuuucagacaaucuuu

SEQ ID NO: 86243 - RNA, 64 nt, Human
cuuccuuccacugaaggucuucacgggccuccagguggaccaaagggaugcacaggcggcucgc

SEQ ID NO: 86244 - RNA, 64 nt, Human
gaggaggagcagagggccuaggaggaccccgggcguggaccacccgcccuggcaguugaauggg

SEQ ID NO: 86245 - RNA, 64 nt, Human
uuuggggucugggaacuuuuugaaaauuuaauuuguggaccaauguuuugugaaagcuaaagag

SEQ ID NO: 86246 - RNA, 64 nt, Human
uccugucuauucauucagcuggcugugcugugcuguggaccagcuguguggaucucuagcccag

SEQ ID NO: 86247 - RNA, 64 nt, Human
uugguugguccaagacacagugaguaggagcucuguggaccaagacaaagcuggacuagagagu

SEQ ID NO: 86248 - RNA, 64 nt, Human
uugcaccaaguaauugacauguuuuuuaauacauguggaccaugaacaguauucauucuacuuu

SEQ ID NO: 86249 - RNA, 64 nt, Human
ugccuugcugccccccugcagcacugugcaggacguggaccagcuggagcugcugcccagcaca

SEQ ID NO: 86250 - RNA, 64 nt, Human
uguauuguuuuguuacaucaaauaaacaucuucuguggaccaggccccuuugaucagcuuuuau

SEQ ID NO: 86251 - RNA, 64 nt, Human
gggggguuggguugggcuggauaucuuuguagauguggaccaccaagggguuguugaaaacuaa

SEQ ID NO: 86252 - RNA, 64 nt, Human
ccauuuguguuuauggguuuagggggccauuuguguggaccaaucuacucggggaauuccaggc

SEQ ID NO: 86253 - RNA, 64 nt, Human
ucuucaggguggguggcagggggauauagugaggguggaccagggagaaugaccauagggcacu

SEQ ID NO: 86254 - RNA, 64 nt, Human
uaauuuacaagugcugguacaucuuuuuucuuuuguggaccacaggaaggaagauuuauuuuga

SEQ ID NO: 86255 - RNA, 64 nt, Human
cugcuggcguuucgaauaccgaaaagucaacccuguggaccacgacagggcagaaggaguuucu

SEQ ID NO: 86256 - RNA, 64 nt, Human
ccggcagaagaaugaggugacccucagcauucccguggaccacccagucagaaagcucuuccag

SEQ ID NO: 86257 - RNA, 64 nt, Human
cuugagaaguuauauugggcaguggcuccaaucuguggaccaguauuucagcuuucccugaaga

SEQ ID NO: 86258 - RNA, 64 nt, Human
aauuucucuccaccuggcucccaaauuuaaagauguggaccaaggccuguggguacuccagggg

SEQ ID NO: 86259 - RNA, 64 nt, Human
uucgcagccauugaacuucuauagggaaggguuuguggaccagaacuuugaccuugugaaugca

SEQ ID NO: 86260 - RNA, 64 nt, Human
cauagcuaggagaugucaaaagcccauaugaggaguggaccaagcagcaguggcgguuucuccu

SEQ ID NO: 86261 - RNA, 64 nt, Human
uuauauauauuaaaauuucuugauuacuguaaaaguggaccaguauuuguaauaaucgagaaug

SEQ ID NO: 86262 - RNA, 64 nt, Human
uucggacagagcaaacagcaacaaggagcuggguguggaccaggagucagaggagggcaaaggc

SEQ ID NO: 86263 - RNA, 64 nt, Human
cagacucccugggguuggcaggggcuccaucucaguggaccaggaagcaagaggggaagcggga

SEQ ID NO: 86264 - RNA, 64 nt, Human
acugcacaggcaguuauuucugcagauccagcucguggaccagcugcagcaccagagaaaagag

SEQ ID NO: 86265 - RNA, 64 nt, Human
acaguggcuggugggugacuuagucugaugguuuguggaccauagaagucuucaccucugguuu

SEQ ID NO: 86266 - RNA, 64 nt, Human
cuucagugaggccccaaggcagagucggcugggcguggaccaggggccauggacacgugaugug

SEQ ID NO: 86267 - RNA, 64 nt, Human
gaacuuaaggagucugauucuccgacacaggcugguggaccaccuaccccacugagaccaccuc

SEQ ID NO: 86268 - RNA, 64 nt, Human
cagccucuccugaagcccucuuguggcaagaacuguggaccaugccagucccgucugguuucca

SEQ ID NO: 86269 - RNA, 64 nt, Human
cccgaucucccuccccaccuccgaagucuccuccguggaccacagguggaucuuugugcgaaca

SEQ ID NO: 86270 - RNA, 64 nt, Human
uggcuucugcaggggaaauuucaaggccacuggcguggaccaucuggguguccucagccccugu

SEQ ID NO: 86271 - RNA, 64 nt, Human
aaauguggccuuugaagagguugcugaggcugcuguggaccaguugcugcagucccaugaagaa

SEQ ID NO: 86272 - RNA, 64 nt, Human
gagcucugggagguggaagcauggggugggaucgguggaccagggugguaagugucugcacauc

SEQ ID NO: 86273 - RNA, 64 nt, Human
uuagauccugcaucugggugaagaaacgggagcuguggaccacaggccagccagugaaccuccu

SEQ ID NO: 86274 - RNA, 64 nt, Human
gaaaaauuuaugccuuuuuauucauaacccagcuguggaccacugccugaaagguuuguacaga

SEQ ID NO: 86275 - RNA, 64 nt, Human
gaggcaucaaagcuagaaugugaauauaacuuuuguggaccaauacuaagaauaacaagaagcc

SEQ ID NO: 86276 - RNA, 64 nt, Human
ccauucuucuugcuacaccccuuuuccaguugcuguggaccaaugcaucucuuuaaaggcaaau

SEQ ID NO: 86277 - RNA, 64 nt, Human
ccuauaaucccagcacuuugggaggcugagguggguggaccacuugaggccaggaguucaagac

SEQ ID NO: 86278 - RNA, 64 nt, Human
ugggggcuguggcccugcccuuggcaccaccaggguggaccaggccuggagggcacuuccucca

SEQ ID NO: 86279 - RNA, 64 nt, Human
gccuugcacaacccauuugugagcaaaagcagaaguggaccaccaucagcucccacccacccag

SEQ ID NO: 86280 - RNA, 64 nt, Human
ucuucucuuucucucugguuguuucuguuucugaguggaccaacagcagaacccacgaggauuu

SEQ ID NO: 86281 - RNA, 64 nt, Human
cucagugaaguugcugcuucucccaggcaaggcuguggaccauggaguggcagcccagccagcg

SEQ ID NO: 86282 - RNA, 64 nt, Human
cugacccucccuccccugggcagaagaaacgcauguggaccagaagacuuucccugcugccuua

SEQ ID NO: 86283 - RNA, 64 nt, Human
gauggcgaucccuacugaacgcuugugucucaggguggaccacucugugucugucuccaagcag

SEQ ID NO: 86284 - RNA, 64 nt, Human
ccagccccuagcugcucuggagugggggagguugguggaccauggagucccuggugcugccccu

SEQ ID NO: 86285 - RNA, 64 nt, Human
uggguugagcaagccuacgcagacaaguguguguguggaccauccgcaccuccagcccccaccc

SEQ ID NO: 86286 - RNA, 64 nt, Human
caaagugcuaggauuacaggugugagccacugcaguggaccaauuuuuguauuuuuuuaaaugc

SEQ ID NO: 86287 - RNA, 64 nt, Human
cuaaaccauacaaaguguuggcaacguagggaugguggaccacagaaggcuauaaaggccacca

SEQ ID NO: 86288 - RNA, 64 nt, Human
ccuggcuaaggcagacacacugacaccucccgaaguggaccacaagaaacgcaaagugagggaa

SEQ ID NO: 86289 - RNA, 64 nt, Human
ucucuacccccuuuuguuaaugguugagagaaauguggaccagugauucucaguuuggugccca

SEQ ID NO: 86290 - RNA, 64 nt, Human
ucugagaguagggcgggcuugaaggcccugauggguggaccaccagccugggcgcaguggugcu

SEQ ID NO: 86291 - RNA, 64 nt, Human
cuacaaagcacuagagaaugcacagauauacuuuguggaccaauuauugauauauauuauaaau

SEQ ID NO: 86292 - RNA, 64 nt, Human
gauagaguauccuuaugguugaguuuccauauaaguggaccagacacagaaacaaacagaauga

SEQ ID NO: 86293 - RNA, 64 nt, Human
ccaugcuauugaaaaaguucagaaaacauacaccguggaccagaggucuuaauccuaucuaugg

SEQ ID NO: 86294 - RNA, 64 nt, Human
cauuuuaaaggaagaaaaaagcagcuaaaaaagaguggaccaaaacacugcacacagugaagug

SEQ ID NO: 86295 - RNA, 64 nt, Human
caagguaaacuaacagcucaaauucccaauauaaguggaccaguuccucauaaacugucaaaug

SEQ ID NO: 86296 - RNA, 64 nt, Human
cucuuaucacuacuauugauucuaguuccaguugguggaccaacugggugaucccugccaucuc

SEQ ID NO: 86297 - RNA, 64 nt, Human
ggaccugcuccgugagauaaugugaaauacgacuguggaccaaacgcaauaaaaccucuguuug

SEQ ID NO: 86298 - RNA, 64 nt, Human
ucuaccucaaccgcgagaccuaugcaaggacgguguggaccaacucgcgcccgcggcauggugc

SEQ ID NO: 86299 - RNA, 64 nt, Human
ucgaggcugcaggauaugcucagacucuagaggcguggaccaaggggcauggagcuucacuccu

SEQ ID NO: 86300 - RNA, 64 nt, Human
ccaccccccaccuccaugcauacaccagagcucuguggaccaaggggucauuccuggucacaca

SEQ ID NO: 86301 - RNA, 64 nt, Human
caguucucagucagacgugcagcauggcugcaggguggaccagcugccuggcauucaggcccag

SEQ ID NO: 86302 - RNA, 64 nt, Human
ugugccggagguacacugcugaaggugcguggcgguggaccagccagcugcuguccaugugcag

SEQ ID NO: 86303 - RNA, 64 nt, Human
cauuuauagguuuguaauaccaauauuuauacugguggaccauucagaaaaagugggaaacguu

SEQ ID NO: 86304 - RNA, 64 nt, Human
ggagagaauguguuaugggccuagugggccucugguggaccagagauuaccccucucaacaggc

SEQ ID NO: 86305 - RNA, 64 nt, Human
uggguuucauuagugcuuagcaauugggagcuugguggaccaucucuugguuuuggaccaucuc

SEQ ID NO: 86306 - RNA, 64 nt, Human
uaugaggcaaauuuauauuuuuuaauaucgggggguggaccacgccgcccuccauccgugcugc

SEQ ID NO: 86307 - RNA, 64 nt, Human
agagcucaaggauuucuggaccuuucuaccaguuguggaccaugagagggugggagggcccagg

SEQ ID NO: 86308 - RNA, 64 nt, Human
ggugggccgaggccgcuguuggggguuucccuguguggaccauggggaucagagucuggccugc

SEQ ID NO: 86309 - RNA, 62 nt, Human
guguauauccacaaauaaaacgcgcguggcguccguggaccagacugacugugacucgccuc

SEQ ID NO: 86310 - RNA, 64 nt, Human
guccaccauagucuucugcucugguccuccacggguggaccaggauggagucuccugccuaccu

SEQ ID NO: 86311 - RNA, 64 nt, Human
cuguaguuucagugccacucuccacuguccccuuguggaccagcuuccacucacugucacgucc

SEQ ID NO: 86312 - RNA, 64 nt, Human
uaugccaacuucaaguaagcggcaacaaggguccguggaccaggaggauugccuuuaauauuuu

SEQ ID NO: 86313 - RNA, 55 nt, Human
cugcugugaagauagacugauuggaguggaccacggccaagcuugcuccguccuc

SEQ ID NO: 86314 - RNA, 64 nt, Human
ccuguaauccuagcacuuugggaggccgagguggguggaccaccugagguuaggacuucaagac

SEQ ID NO: 86315 - RNA, 64 nt, Human
ugggaggccggcagccaggccacagaauccacacguggaccauugugggucccugggaggccgg

SEQ ID NO: 86316 - RNA, 64 nt, Human
ugggaggccggcagccaggccacggaauccacacguggaccauugugggucccuugggaggcca

SEQ ID NO: 86317 - RNA, 64 nt, Human
ugggaggccagcagccagacuacggaauccacauguggaccaugggaagucagucucuugcgug

SEQ ID NO: 86318 - RNA, 64 nt, Human
gggcccccagcugaccccuacugcagauccgcauguggaccaugagccggcugccagcacuagg

SEQ ID NO: 86319 - RNA, 64 nt, Human
cccuugccagguggcuuuucaguuacagaguccaguggaccauuuuguagaaccaugcagcucc

SEQ ID NO: 86320 - RNA, 64 nt, Human
caaaccaauuuguucugugcaacaaacucaaaauguggaccaguucccucagcccucauuaaac

SEQ ID NO: 86321 - RNA, 64 nt, Human
guguaccagggaagagaccuugugccucuaagcaguggaccauggucaccuugcuggguagagc

SEQ ID NO: 86322 - RNA, 64 nt, Human
cuuucucuuggcugagugacagguggcuguucagguggaccaaagcaccuugacacaaggacuc

SEQ ID NO: 86323 - RNA, 64 nt, Human
gggaggucaggagcgcggcgggcgagggcccuguguggaccaccuccaccaagcucagagauuu

SEQ ID NO: 86324 - RNA, 64 nt, Human
gaggucuagggaaccacaacccuuauuguccuggguggaccaauccaaaggcuaagugauagug

SEQ ID NO: 86325 - RNA, 64 nt, Human
aguaauagugacccuuucacguccuggagcccgaguggaccaaucggaagccuaagugacgaug

SEQ ID NO: 86326 - RNA, 64 nt, Human
agacacguagggggcagugaggaaacgggguaaaguggaccaugcaggcugcagagggugggcc

SEQ ID NO: 86327 - RNA, 64 nt, Human
aauacuagcugguauguuucauaaaugucaagcuguggaccaacauauauagccuuuuauuauu

SEQ ID NO: 86328 - RNA, 64 nt, Human
gagcuggguuucucuucccuuuuuaucugcugguguggaccacaccugggccuggccggaggaa

SEQ ID NO: 86329 - RNA, 64 nt, Human
cugaccacagggugagacagcagggcccaggggaguggaccagcccccagcaaauuaucaccau

SEQ ID NO: 86330 - RNA, 64 nt, Human
ccugggaggugaguuagacagcccaggggaccagguggaccaggugguggccagagaggcucca

SEQ ID NO: 86331 - RNA, 64 nt, Human
ugccagcagccccgucugcccaccauucccggccguggaccauagucgggaugucagcagacac

SEQ ID NO: 86332 - RNA, 64 nt, Human
gacaagugccaaaggccacaggcaugagggaggcguggaccacugggccagcaccgcugagucc

SEQ ID NO: 86333 - RNA, 64 nt, Human
gauagauugugaauaucaggaggcagggaucacuguggaccaucuuagcaguugaccuaacaca

SEQ ID NO: 86334 - RNA, 64 nt, Human
aucuucacccccauuccagagcagaggagucucuguggaccaugaauugcacugucucccuccu

SEQ ID NO: 86335 - RNA, 64 nt, Human
guggaagugggugaauucuacuuuuuauguuggaguggaccaaugucuaucaagagugacaaau

SEQ ID NO: 86336 - RNA, 56 nt, Human
ccaagagcaagaagaacugaggagugguggaccaggcucgaacacuggccgaggag

SEQ ID NO: 86337 - RNA, 64 nt, Human
aguaguggacccaguucuauuguuggcuucagcgguggaccaagcacugguguuggcuucugca

SEQ ID NO: 86338 - RNA, 64 nt, Human
agcgguggaccaagcacugguguuggcuucugcaguggaccaagcaccaguggcuucagcggug

SEQ ID NO: 86339 - RNA, 64 nt, Human
agcgguggaccgagcacaggagcuggcuucggcgguggaccaaacacuggugcuggcuuuggug

SEQ ID NO: 86340 - RNA, 64 nt, Human
ccuggcagccaaaucgagucucucauuuucucuuguggaccaguuaguuuugcccauaacgcag

SEQ ID NO: 86341 - RNA, 64 nt, Human
aguggggagcauguugggugugagggaacacaguguggaccaucucucaguuccuguucuauug

SEQ ID NO: 86342 - RNA, 64 nt, Human
ucugcuagccaggaugggaucucugcagucuucuguggaccaaggagauagacccggcuucugg

SEQ ID NO: 86343 - RNA, 64 nt, Human
auuuuugugauaggagggauauuuacauauuuuaguggaccacauuuuaaguuggauggugugc

SEQ ID NO: 86344 - RNA, 64 nt, Human
uuuuaacaguuaugcuugcauuaauaauuucaauguggaccagacauucuaauuauauuuuaaa

SEQ ID NO: 86345 - RNA, 64 nt, Human
gugcccaucggcaaaucgcaauggcagcaugugaguggaccauucagaaacuucugcuuggugg

SEQ ID NO: 86346 - RNA, 64 nt, Human
ccaugcuaggcaguggcugcuccaugagcccuuuguggaccacauguuaaaggccugggguuua

SEQ ID NO: 86347 - RNA, 61 nt, Human
cucagccuccugaguagcugggaucauaggcacgcgccaccacacccagcuaauuuuuugu

SEQ ID NO: 86348 - RNA, 61 nt, Human
cuguucagcuguuggccggcccugcuaccugacgcgccagaagcacccagcccugcccagc

SEQ ID NO: 86349 - RNA, 61 nt, Human
uaccuggcuguccccagcaccuuccugaaggacgcgccaggggaguuccugcuccgagucu

SEQ ID NO: 86350 - RNA, 61 nt, Human
auauuggagauguccugaauuuuaauaggguacgcgccauuagggcuuuuugcgcuaaagg

SEQ ID NO: 86351 - RNA, 61 nt, Human
aggccaggccugaucccaccucacuuccugcacgcgccacuccgccuaggggcccucgggg

SEQ ID NO: 86352 - RNA, 61 nt, Human
cucagccucccguguagcugggacuacaggcacgcgccaccaugcccggcuaauuuuugua

SEQ ID NO: 86353 - RNA, 61 nt, Human
cucacccaccugugauagugggcuuggggcuacgcgccaggagagucuccccccacccacc

SEQ ID NO: 86354 - RNA, 61 nt, Human
cagggggcgcccgcgggagcccggcgggggcacgcgccacguggccgggagacgcacaggg

SEQ ID NO: 86355 - RNA, 61 nt, Human
gccgugaagggacccugccuuucagggcacuacgcgccaccaguucccgguacccagggag

SEQ ID NO: 86356 - RNA, 61 nt, Human
cucagccucuugaguagcugggauuacaggaacgcgccaccacgcccagcuaauuccugua

SEQ ID NO: 86357 - RNA, 61 nt, Human
gggacauuguaguucgcaugguucucuggaaacgcgccaggaaaagcuuccgugccaguga

SEQ ID NO: 86358 - RNA, 61 nt, Human
cucagccucccaaguagcuggcacuacagacacgcgccaccaugcccggcuaauuuuugua

SEQ ID NO: 86359 - RNA, 61 nt, Human
cacugaaacacacaauugacuggacagguccacgcgccaugacaaaacuauaaucaaguua

SEQ ID NO: 86360 - RNA, 61 nt, Human
gaucucugacuucuuauuaccuccgauuggaacgcgccacaaaucauccugcuuucuuuau

SEQ ID NO: 86361 - RNA, 61 nt, Human
cuauucacuggacaaguucucugcucccaugacgcgccaggcacaguucugcaaguauauu

SEQ ID NO: 86362 - RNA, 61 nt, Human
aaggugccgaugcagaaggcaaauuggaaacacgcgccagcggcaguggggcucaaagccg

SEQ ID NO: 86363 - RNA, 61 nt, Human
auguagacuuugcauuauaaauucuggaacaacgcgccagacgugugaauuucaagcuuca

SEQ ID NO: 86364 - RNA, 61 nt, Human
cucagcuuccccagcagcugggacuacaggcacgcgccaccacagccggcuaauuuuuuau

SEQ ID NO: 86365 - RNA, 61 nt, Human
ugcagaggccugcagggccucugucaauuguacgcgccaccgagugccuucaacacagcuu

SEQ ID NO: 86366 - RNA, 61 nt, Human
cucagccuugugaauaccugggacuucaggcacgcgccacuacacccagcuaauuuuuaaa

SEQ ID NO: 86367 - RNA, 61 nt, Human
gccuggugacggcacccggaggcccaccaggacgcgccaccggugaaugugccucuggugg

SEQ ID NO: 86368 - RNA, 61 nt, Human
cucagccuccugaguagcugggacugcaggcacgcgccaccacgcccagcuaauuuuugua

SEQ ID NO: 86369 - RNA, 61 nt, Human
ggcuggugacugggucuugggaucccaggccacgcgccagccaggcugugggcagggcggg

SEQ ID NO: 86370 - RNA, 61 nt, Human
ggcggcgaggaggccauggccggggccuacgacgcgccaccccccguacgacacgcguccu

SEQ ID NO: 86371 - RNA, 61 nt, Human
cucagccucccaaguagccaggauuacaggcacgcgccaccaagccaggcuaauuuuugua

SEQ ID NO: 86372 - RNA, 61 nt, Human
cucagccucccaaguagcugggauuacaggcacgcgccaccacaccuggcugauuuuguau

SEQ ID NO: 86373 - RNA, 61 nt, Human
gagcgucuuccaggguggcuggagagcacagacgcgccagggagcccccucugugcuccuc

SEQ ID NO: 86374 - RNA, 61 nt, Human
cucagccucccaaguagcugggauuacaggcacgcgccaccacaccuggcuaauucuauuu

SEQ ID NO: 86375 - RNA, 64 nt, Human
cucuguguugagguugccggggguagggguggggccacacaaaucuccaggagccaccacucaa

SEQ ID NO: 86376 - RNA, 64 nt, Human; identical to SEQ ID NO: 84747

SEQ ID NO: 86377 - RNA, 64 nt, Human
aggucagcuggggccaguggugccucaggcaggcccacacaacuggccaccucuucccguuaau

SEQ ID NO: 86378 - RNA, 64 nt, Human
aaacuccauccuuuauaaauagucaagguuugggccacacaaaguauauuuuuaucauggaaaa

SEQ ID NO: 86379 - RNA, 64 nt, Human
cgauuacaauccaauuaccuauugucgacucagcccacacaagcuuuucuccuccucuugcagg

SEQ ID NO: 86380 - RNA, 64 nt, Human
caucaaaggcauuagcugacaggcugguaacaguccacacaagaugguauaggccugaacagug

SEQ ID NO: 86381 - RNA, 64 nt, Human
cacucagucuauuagaggucuggauauaagguagccacacaauaacucuaacuugacuucuaac

SEQ ID NO: 86382 - RNA, 64 nt, Human
aagcagacacaacagcagcacagaggucuggaggccacacaaaaagugaugcucgcccugggcu

SEQ ID NO: 86383 - RNA, 64 nt, Human
uaaccgugaacguagagacuuguucugaggacauccacacaauaguaggaaucuccccaaccaa

SEQ ID NO: 86384 - RNA, 64 nt, Human
gugcugcacagcagugaaccaacacuagagggagccacacaagccuccucuccccagucugccc

SEQ ID NO: 86385 - RNA, 64 nt, Human
aaaaagaggcugagaugagcagugaacuaagaggccacacaaaagcagagguuugggaauucca

SEQ ID NO: 86386 - RNA, 64 nt, Human
acguuugcaacaugaucaagguguuaguucuccaccacacaaguuguauucuucuuuugccacc

SEQ ID NO: 86387 - RNA, 64 nt, Human
ucugggaggagcuauuucaucuuccagcucagcuccacacaaagcugcagaaggacgaaaugaa

SEQ ID NO: 86388 - RNA, 64 nt, Human
uucaaaaucauaguuuuaauguguuuugaaaaggccacacaauuauacuuuaucuuuucuuaau

SEQ ID NO: 86389 - RNA, 64 nt, Human
uugugcuuagaauugcuggaugcauuuuuacccuccacacaaaccuaaaaauuuugugaccccu

SEQ ID NO: 86390 - RNA, 64 nt, Human
ggacuagaagccucaguuuccccauuuuacccuuccacacaauagccucuguagguuaggcugc

SEQ ID NO: 86391 - RNA, 64 nt, Human
cugcucucaucacacccccacagagggggucuuaccacacaaagggagagugggccuucaggag

SEQ ID NO: 86392 - RNA, 64 nt, Human
aaggcccuguugacuagcaauggccuuagcugucccacacaacucaguggccugaacacacacc

SEQ ID NO: 86393 - RNA, 64 nt, Human
augcuauuguucugcuauuaccagauuuauugugccacacaaaaggaucaugugugucagcagg

SEQ ID NO: 86394 - RNA, 64 nt, Human
aaaguaaaugugaaccuugucuaaguacuguaauccacacaacacauuauaagaagcaaaccag

SEQ ID NO: 86395 - RNA, 64 nt, Human
caucguuauggcaugugcagaaaaacagaguuauccacacaagucaggagcaaaacccaaguag

SEQ ID NO: 86396 - RNA, 64 nt, Human
uuuuaaauuuuucucaguuccagugauagaaaacccacacaauacauccucugccagucuuaau

SEQ ID NO: 86397 - RNA, 64 nt, Human
ggcccccagccacucccuccagcagccugguucaccacacaaacucugccuggaccccauuguc

SEQ ID NO: 86398 - RNA, 64 nt, Human
auuccucagguguuuugagaaacaugacuaauaaccacacaauuaaguagagucauuccaaguc

SEQ ID NO: 86399 - RNA, 64 nt, Human
ugugguacuucaggauccuaauacuuggccaucuccacacaaguuugauccagaucgguuugau

SEQ ID NO: 86400 - RNA, 64 nt, Human
auguauaacuuuaacuucuguuuuaccagcauacccacacaaauaacaagaauacuacuuauga

SEQ ID NO: 86401 - RNA, 64 nt, Human
gcaacgccuuguguuuguuucauuuuuuuaaaacccacacaaagccgcugucucacuuuuuccu

SEQ ID NO: 86402 - RNA, 64 nt, Human
acagaacccaguuagcagcagggagacgagaacaccacacaagacauuuuucuacaguauuuca

SEQ ID NO: 86403 - RNA, 64 nt, Human
ucccggaucaucagcacaauugugaaacuugucaccacacaauaaaaagcagucuuagagagug

SEQ ID NO: 86404 - RNA, 64 nt, Human
gacuuauuuguuuuaauguacagaugugggaaaaccacacaaauuccgcaguuuauucuggaug

SEQ ID NO: 86405 - RNA, 64 nt, Human
uuuuaagugguauggauauauuuagcauauugaaccacacaagugcuuaauucauuguuaugua

SEQ ID NO: 86406 - RNA, 64 nt, Human
aaugcaaacuauuguugaaaagcaguuagcauuuccacacaaccgcuguccccagagauaacug

SEQ ID NO: 86407 - RNA, 64 nt, Human
auauuuuuggguuuuguagaauauugcaaauuaaccacacaaaaaauguuuaauuuaugcaaca

SEQ ID NO: 86408 - RNA, 64 nt, Human
agaagccuuacucccugcacauucccucaugcucccacacaaguccagcaauggaaaugcuugg

SEQ ID NO: 86409 - RNA, 64 nt, Human
aucaauuucccauuuuuuuuuucagcuuaaguaaccacacaauuuuaggccucaauuuuuuuuu

SEQ ID NO: 86410 - RNA, 64 nt, Human
uacaucuucaguuuuucucugaauugaauucauaccacacaaacaaagugucugcugcucuaga

SEQ ID NO: 86411 - RNA, 64 nt, Human
uggguuagcuacugucaucaguuagcaaauucauccacacaaacacaauuagaguuugguuuuu

SEQ ID NO: 86412 - RNA, 64 nt, Human
acaggucuuacuauggacaccaggucaggugcaaccacacaaaacaaagccaguuccaugagcu

SEQ ID NO: 86413 - RNA, 64 nt, Human
cagaacccucuccagccugcugacccaaacccaaccacacaaugguuugucucaaucugaccca

SEQ ID NO: 86414 - RNA, 64 nt, Human
ugaugucuuuuuuucaaaauugcuuaugaaauuuccacacaaucguagcuuauaagauuggaac

SEQ ID NO: 86415 - RNA, 64 nt, Human
uuugcauuuuaaaaaugaaauuuuccaaugucugccacacaaacguauguaaauguauauaccc

SEQ ID NO: 86416 - RNA, 64 nt, Human
agcaggcaagcuucaguuugggcuguggacgcugccacacaagccugaguagagcccaugcaaa

SEQ ID NO: 86417 - RNA, 64 nt, Human
aaauccaaguaacaccuucugaguagcugcugucccacacaauaggguaugaagcugcgcuccu

SEQ ID NO: 86418 - RNA, 64 nt, Human
aucauaugauuuaagugcaugaauaagcauuuucccacacaaugaacauuugaacuguguuuau

SEQ ID NO: 86419 - RNA, 64 nt, Human
aaagugcuggaauuacaggcaugagccaccacacccacacaagacuaucauuuuuaaugaccaa

SEQ ID NO: 86420 - RNA, 64 nt, Human
ggcugugccugcucagagcuuuggacuguucaacccacacaagaacaaacgcuaacuaauauuu

SEQ ID NO: 86421 - RNA, 64 nt, Human
uuuucucaccaccccaagccccauuugugcccugccacacaaauacaccuacagcuuuuggucc

SEQ ID NO: 86422 - RNA, 64 nt, Human
ucuccugcuaguacugugccgcuucccccuccccccacacaaaauaaaaacaguaucugccuuc

SEQ ID NO: 86423 - RNA, 64 nt, Human
ucuguaauucucccaggagcugugauagagcaggccacacaaagucccuacgccucccugcugc

SEQ ID NO: 86424 - RNA, 64 nt, Human
gcaugaccaaagugauaaauuccuguugaccuucccacacaaucccuguacucugacccauagc

SEQ ID NO: 86425 - RNA, 64 nt, Human
caggucuaugcccaagagaauugaaaacauccauccacacaauaccugugcucccgcguucaua

SEQ ID NO: 86426 - RNA, 64 nt, Human
cuaguguuuguuaaaaacaaaaauaaaaacaaaaccacacaaggagaacccaauuuuguuucaa

SEQ ID NO: 86427 - RNA, 64 nt, Human
uuucuuaauaaugggcagacagaaaaauguaaaaccacacaaaacggacugcugauaauauuuu

SEQ ID NO: 86428 - RNA, 64 nt, Human
uauugaaauuuauuauucuaauccaaaaguuaccccacacaaaaguuacugagcuuccuuaugu

SEQ ID NO: 86429 - RNA, 64 nt, Human
uauacauuguuuacacuucaacuacggggauguuccacacaaacuuaaauuacuguuggcaaaa

SEQ ID NO: 86430 - RNA, 64 nt, Human
cuggugaaggacagucaggugaaggacuguaagcccacacaagcucuucuuaucucuacuagaa

SEQ ID NO: 86431 - RNA, 57 nt, Human
uggguaagggcagugccugauaauaccccacacaaguucacuugauuaauugcauca

SEQ ID NO: 86432 - RNA, 64 nt, Human
cagauuugaaacuaacccagaacuucuaacuugaccacacaaggcaguugcccaaaccauucug

SEQ ID NO: 86433 - RNA, 64 nt, Human
ucuucugccauuaucauuuaugucucccuauuuaccacacaauaauguaaaugcagagaaugag

SEQ ID NO: 86434 - RNA, 64 nt, Human
ugaagguggucauuccuucaaaacuguguuuugaccacacaaggugggcauuaacaaaccaaau

SEQ ID NO: 86435 - RNA, 64 nt, Human
uaucucuugccuucccccaugaacuucagccuguccacacaaaagccacauaaacucaagcaag

SEQ ID NO: 86436 - RNA, 64 nt, Human
agaaccuauuuuugugcaucauuuaccaaucaugccacacaagcauuuauuuuuaguacauuuu

SEQ ID NO: 86437 - RNA, 64 nt, Human
gcgccuggcacauuucagggagaaacuccaaaguccacacaaagauuuucuaaggaaugcacaa

SEQ ID NO: 86438 - RNA, 64 nt, Human
cagagauaucugagaccucucuggggaucaggaaccacacaauccccaggguuccugagacccc

SEQ ID NO: 86439 - RNA, 64 nt, Human
acuccuagggccuggcuucugucugaucaaggcaccacacaacccagaaaggagcugauggggc

SEQ ID NO: 86440 - RNA, 62 nt, Human
gaagucuugaggaaauguaauuaaagauauuaccacacaacaucaaguggccuugaagagac

SEQ ID NO: 86441 - RNA, 64 nt, Human
acagauccugucauuguuuaagcugagcaaaaaaccacacaaaaguuguguaagagaugagaua

SEQ ID NO: 86442 - RNA, 64 nt, Human
caaaagcacuggcucauccgcccuacuucccaucccacacaaacccaauuguaaauaacauaug

SEQ ID NO: 86443 - RNA, 64 nt, Human
uaacagcuguuuuuucuacauuagaaauaagaugccacacaaggaacuacauuccagauuuaaa

SEQ ID NO: 86444 - RNA, 64 nt, Human
uuacauuccuuuuuugauggcuaaaauacuaccaccacacaaucaucuuuuuuuuccugaagaa

SEQ ID NO: 86445 - RNA, 64 nt, Human
ucaagguuuuccaugguuaaguuuggagaaaauaccacacaaaacaaugaauugccaaauuguu

SEQ ID NO: 86446 - RNA, 64 nt, Human
uacagaagaagcuccugaaucccuuucaguuuguccacacaagacagcagagccaucugcgaca

SEQ ID NO: 86447 - RNA, 64 nt, Human
uuguuauauauguuucuauagaauaauaacauacccacacaauuaauauaagggauauguuguu

SEQ ID NO: 86448 - RNA, 64 nt, Human
ucaaauaaaaugacuaacagcaucuaucauaaagccacacaagccuuauguucucaucucaaaa

SEQ ID NO: 86449 - RNA, 64 nt, Human
aaggcuaaucuuacggauaauccacgugagauuuccacacaagagaaaagcacacgcauaguga

SEQ ID NO: 86450 - RNA, 64 nt, Human
gaccagacccugugacuuacucgguaauaacaguccacacaagccucguugauauuaaaaaaaa

SEQ ID NO: 86451 - RNA, 64 nt, Human
cugucccugacaaccccuucguccggacccucccccacacaacuaugucuggucaccagcuccc

SEQ ID NO: 86452 - RNA, 64 nt, Human
guagagacauuggagggaagggaagggcuuuucuccacacaagggcagagaguccgucuagauu

SEQ ID NO: 86453 - RNA, 64 nt, Human
guuagauguuuccuaagaaugcaaacugccuuuuccacacaaaggcugggaauaaaauucuggg

SEQ ID NO: 86454 - RNA, 64 nt, Human
agugacuuaaaauaagccaacagacucucccagaccacacaacuaguggaaugauuccuccuuu

SEQ ID NO: 86455 - RNA, 64 nt, Human
guccugaggguuucagcaccaggguucucugcagccacacaaucagcccggcucgggagcaaac

SEQ ID NO: 86456 - RNA, 64 nt, Human
agaacuuuccuuucugccucuucaauccaucuuaccacacaauauuucaugauucaaauucuuc

SEQ ID NO: 86457 - RNA, 64 nt, Human
ccuccaaaguagcuggcacuacaaguguacacccccacacaaggcuaaguuuuguauuuuuugu

SEQ ID NO: 86458 - RNA, 64 nt, Human
ccuggcugccuuuuugggggucccugccuuagccccacacaaggcuuucugaacugccaagagg

SEQ ID NO: 86459 - RNA, 64 nt, Human
ccuuggccaaucccugucuugguuucugcucuucccacacaaaguuuugggaaucaauucauac

SEQ ID NO: 86460 - RNA, 64 nt, Human
cgcggggccugugagcggagaggggcccugcuucccacacaaauccgccccggugcacccccgg

SEQ ID NO: 86461 - RNA, 64 nt, Human
auccuggaugcuggauggaguauuucucugaggcccacacaaagcuggacacccccaggcucua

SEQ ID NO: 86462 - RNA, 64 nt, Human
ugacucauugggggccauugauggaacaaucuuaccacacaaggacaaauuauaauuuauccuu

SEQ ID NO: 86463 - RNA, 64 nt, Human
uuguaucuuccauauaauaaccacacacagauaaccacacaaaaaauccuuuguaaaauuucug

SEQ ID NO: 86464 - RNA, 64 nt, Human
gggagagcagccauccccugcuggcaccauagacccacacaaggagccugcacagcaagccagc

SEQ ID NO: 86465 - RNA, 64 nt, Human
cugguccccuguccgccacacaggccguggucauccacacaacucacugucugcagcugccugu

SEQ ID NO: 86466 - RNA, 64 nt, Human
cucccuguuguucacagagagggaaggucgugggccacacaaugcugugugacccucuccgugu

SEQ ID NO: 86467 - RNA, 64 nt, Human
acucauagguauauacuuaaaagaaaugaaaaauccacacaaaaaccucugcaugaauguucau

SEQ ID NO: 86468 - RNA, 64 nt, Human
gugauuaugaugaggaagcccccucugcuuuaauccacacaaggaacguaaccugaaguaaccu

SEQ ID NO: 86469 - RNA, 64 nt, Human
aauccaagaugguagaacuagguuaggaaaaauuccacacaaccaaacagucugccuuaaaagu

SEQ ID NO: 86470 - RNA, 64 nt, Human
gugaaaguccaggggauuucuccuccaaguccuaccacacaaaggaaagucucaagccucuauu

SEQ ID NO: 86471 - RNA, 64 nt, Human
gcucuaggcagagucccgggaccauggccuccugccacacaacacgcagagaggacucaagacu

SEQ ID NO: 86472 - RNA, 64 nt, Human
uaucgauuagcugugucacuuuuaaauaagaaguccacacaagcaagccaaauuuuuagaugac

SEQ ID NO: 86473 - RNA, 64 nt, Human
cccucgaagacaccucaauucacagacucucagcccacacaaugccccaguguccccagcuccg

SEQ ID NO: 86474 - RNA, 64 nt, Human
acugggaacaaagaucuacaggcaagcaagaugcccacacaacaggcuuauuuucugugaagga

SEQ ID NO: 86475 - RNA, 64 nt, Human
cuguuuacauccugguggcaccucucacccugacccacacaaagguucuggagauuacuggaga

SEQ ID NO: 86476 - RNA, 64 nt, Human
cucccacugcucagcgcgggccauugcaagggugccacacaaugucuuguccacccugggacac

SEQ ID NO: 86477 - RNA, 64 nt, Human
uaaucaccagcauuuguuccccauagucacagggccacacaagggaacauuuaggacaaacuuu

SEQ ID NO: 86478 - RNA, 64 nt, Human
guggaccucagacauggcucagccauaggaccugccacacaagcagccguggacacaacgccca

SEQ ID NO: 86479 - RNA, 64 nt, Human
agcccuggggcugggggcuggaauccaccuccucccacacaagcucgguggugacucuucggcc

SEQ ID NO: 86480 - RNA, 64 nt, Human
uaaccaccauccauggucaagaccucuccuagcuccacacaagcaguagagucucagcuccaca

SEQ ID NO: 86481 - RNA, 64 nt, Human
aaucuuagacuuagccagucuuaggccuacgaugccacacaaagguuguucagggagaaggggg

SEQ ID NO: 86482 - RNA, 64 nt, Human
auaggugagaaaaaaacaaucuggaagaaaaaaaccacacaaagacauugauucagccuguuug

SEQ ID NO: 86483 - RNA, 64 nt, Human
ggggaugaggauauggcagggaagcuuucaccagccacacaaggguccuuucuccaauccguuc

SEQ ID NO: 86484 - RNA, 64 nt, Human
acagacagaagagaaggaagccauagugucacuuccacacaauuauuuauuucaugucuuuacu

SEQ ID NO: 86485 - RNA, 64 nt, Human
aacugaccaaaguggcccccucuggggguccccaccacacaaguguuuguaaacugggcugcua

SEQ ID NO: 86486 - RNA, 64 nt, Human
uugauggaccagacaaauaggaugauggcugcccccacacaauaaaugguaacauaggagacau

SEQ ID NO: 86487 - RNA, 64 nt, Human
agucuccacagccauccuggcccacacaggcaccccacacaaaccuauuuauugaaucugcugg

SEQ ID NO: 86488 - RNA, 64 nt, Human
ggcuuuuuaacuccccuguuucaaucacuguccuccacacaagggaaggacagaaaggagagug

SEQ ID NO: 86489 - RNA, 64 nt, Human
auauacacauacccguaggugagccugggcugugccacacaagcacuucaucggggguuuugag

SEQ ID NO: 86490 - RNA, 64 nt, Human
aaagggagggaagguccuacaggucuccggccacccacacaaggaggaggaagaggaaauggug

SEQ ID NO: 86491 - RNA, 64 nt, Human
uaugcccuguggcauuucugcgucuuacuggcaaccacacaacucagggaaaggaaugccuggg

SEQ ID NO: 86492 - RNA, 64 nt, Human
guggugggcaguauaaagaaaucugucuccacagccacacaaccagagggugcacaugacuuga

SEQ ID NO: 86493 - RNA, 64 nt, Human
caaccugcaucuguuaagauguuugaucuuuaacccacacaauguaaggguacuguugucauug

SEQ ID NO: 86494 - RNA, 64 nt, Human
ggacucuucucgucauuggagcucaagucaccagccacacaaccagaugagaggucaucuaagu

SEQ ID NO: 86495 - RNA, 64 nt, Human
caauaaauucaagacucuucuuauugguaauuuuccacacaaucccucugaaauaagggagagg

SEQ ID NO: 86496 - RNA, 64 nt, Human
aaagucacuagugaacaauucggugguaaaaguaccacacaaacuaugggauccaaggggcagu

SEQ ID NO: 86497 - RNA, 64 nt, Human
uugagagaaaauccaguuggccucucuccucuauccacacaauucaacuugauaacuggacuuu

SEQ ID NO: 86498 - RNA, 64 nt, Human
ugaccuuggacaaauucucgaacccauucaccaaccacacaaguuuguugugagucauaaaugg

SEQ ID NO: 86499 - RNA, 64 nt, Human
gguuguauuuuugccccaagaaguguuuggauaaccacacaaaagcaugaugaaaaggcuucuu

SEQ ID NO: 86500 - RNA, 64 nt, Human
ucguaaggcacaggcugacaguuccacucccaccccacacaacgcagacggugcgccugugcag

SEQ ID NO: 86501 - RNA, 64 nt, Human
cuuugcuuacuauuuaugcagcuucucuaccccaccacacaaauuucccauuucccccccgaaa

SEQ ID NO: 86502 - RNA, 64 nt, Human
aaauauuuauugagugccuaccagaugccagucaccacacaaggcacuggguauaugguauccc

SEQ ID NO: 86503 - RNA, 64 nt, Human
gaucggaauuucuuguuaucaccauuccacguugccacacaaggugcacaggcuggaagucuuu

SEQ ID NO: 86504 - RNA, 64 nt, Human
cuggggaaaggagaaccggcuaggugggcucuagccacacaaagggaagcaggccugccaugag

SEQ ID NO: 86505 - RNA, 64 nt, Human
ugcauggugccccaggaccagcucaggacagaugccacacaaggauagaugcuggcccagggcc

SEQ ID NO: 86506 - RNA, 64 nt, Human
cacuuucuuagguaauucacugcagguuaagaauccacacaaccaaguucaugggaauuuugug

SEQ ID NO: 86507 - RNA, 64 nt, Human
cuuauccuacauuauuggaaaauaaaugagauguccacacaaauggauuauccacauaaucaaa

SEQ ID NO: 86508 - RNA, 64 nt, Human
augaucauccugaggaucugagcuucccuagacuccacacaauaaccuuggggcacccuuuuag

SEQ ID NO: 86509 - RNA, 64 nt, Human
ugccuuuuggacauguaaaauauuuaggauuugaccacacaauggcuaugaaaaugcaaguagu

SEQ ID NO: 86510 - RNA, 64 nt, Human
ucaccugucaucauaacuggcuucugcuugucauccacacaacaccaggacuuaagacaaaugg

SEQ ID NO: 86511 - RNA, 64 nt, Human
aguuggauuaaauucugggugaaacccuuuucucccacacaaaauaguuuuagugauuuuuuuc

SEQ ID NO: 86512 - RNA, 64 nt, Human
ccaguugaccugccuuggagucgucuggcaucucccacacaagacccaaguagcugcuaccuuc

SEQ ID NO: 86513 - RNA, 64 nt, Human
cccaagaugaaucuuccuuccaaauguguuuucuccacacaagccuugugaucugaaugugugc

SEQ ID NO: 86514 - RNA, 64 nt, Human
ccccagaugccuccucuguccucauucuucucucccacacaagcagucuuuuucuacagccagu

SEQ ID NO: 86515 - RNA, 64 nt, Human
cucaccacaucucaccacaccacagcacaccucaccacacaacacaccacaccccacaccgcac

SEQ ID NO: 86516 - RNA, 64 nt, Human
guagcaagagagaaaaaaucaacagcaaacaaaaccacacaaaccaaaccgucaacagcauaau

SEQ ID NO: 86517 - RNA, 64 nt, Human
cuagaggccuauugcuacaucaagggguucuaagccacacaacagagccuccagcagggcaggc

SEQ ID NO: 86518 - RNA, 64 nt, Human
ccugcagaggcuguuucagcucacacagagucauccacacaaacccacggcucccaguugacag

SEQ ID NO: 86519 - RNA, 64 nt, Human
cuuugggcaaaucauuucacuccucaaagcccccccacacaagcuggauucccacuucuuaccu

SEQ ID NO: 86520 - RNA, 64 nt, Human
caggaggagagaggaaaagggagggcgagaaugaccacacaacacagccuuggaccaugagcag

SEQ ID NO: 86521 - RNA, 64 nt, Human
uuauuuaaaagaaaagaagaaaaaaaacacccaaccacacaaagaacaaaaccaguaacaaaca

SEQ ID NO: 86522 - RNA, 64 nt, Human
gggacaaaaacucaagaagaaauaagagcugacgccacacaagucuuggcugcuuuuguuacua

SEQ ID NO: 86523 - RNA, 64 nt, Human
gcucucaccccagggaccuaggaacagccugucaccacacaauuacuuuuauaacccuggagau

SEQ ID NO: 86524 - RNA, 64 nt, Human
aucaggcgcgcucauaguuguccccauugucuacccacacaaauccucaggaaaccaaccaccg

SEQ ID NO: 86525 - RNA, 64 nt, Human
uauggagauggaugacauaaaaauguaaacaucuccacacaaaaaaaaaaaugucuuaaccaac

SEQ ID NO: 86526 - RNA, 64 nt, Human
cugauuauaccucucaaacauucuucugucaauuccacacaauccuucuaccucugcuaugcug

SEQ ID NO: 86527 - RNA, 64 nt, Human
uacccaguauaguucagguuaugaggaggaucagccacacaauccagugcuucaguuugaaaau

SEQ ID NO: 86528 - RNA, 64 nt, Human
guccaggggucugggccuccuucccucaaggcugccacacaaaguagcagaaauaggaugaugu

SEQ ID NO: 86529 - RNA, 64 nt, Human
agcugugauaucucagaugcugcugcuugacaauccacacaaagaaccuauccgcuuacgguac

SEQ ID NO: 86530 - RNA, 64 nt, Human
cgacagcgagacucuaucucaaaaaaaaaaaaacccacacaaccuuaugagguagaauuccauu

SEQ ID NO: 86531 - RNA, 64 nt, Human
guaucaccagaagacauuagggggcaguaggcccccacacaaaaccuucaggcuugaauuuuaa

SEQ ID NO: 86532 - RNA, 64 nt, Human
ucggagugccacacaugcccagaccuucucacacccacacaaauaggcucugccgugcacuccu

SEQ ID NO: 86533 - RNA, 64 nt, Human
uggcuuguugcaagaggaguagaugcccccucacccacacaaaccccacucagucuccacccaa

SEQ ID NO: 86534 - RNA, 64 nt, Human
uauccccaaccccagacccccaucacuugaugggccacacaaguuugagagugguacaagggag

SEQ ID NO: 86535 - RNA, 64 nt, Human
auuucacucuucuucccagguucuucugaagcacccacacaaaaugcacacucugcgauaugua

SEQ ID NO: 86536 - RNA, 64 nt, Human
ucugcauaaaaagcauuaauugcacagcuaccauccacacaaauacauaguuuuucugacuuca

SEQ ID NO: 86537 - RNA, 64 nt, Human
uauaaguugcuguaaaauuuguguaaauuuguauccacacaaauucagucucugaauacacagu

SEQ ID NO: 86538 - RNA, 64 nt, Human
cugccacccuggcaucggcuuucugugccgccucccacacaaaucagccccagaaggccccggg

SEQ ID NO: 86539 - RNA, 64 nt, Human
ucgguuacaaauccauaacaaaugacuggaaaagccacacaacucuuacauacugauauuuaga

SEQ ID NO: 86540 - RNA, 64 nt, Human
ggggaucugcaucuagccugcauaucacauugacccacacaaaagauuuuuaaguacgaaguaa

SEQ ID NO: 86541 - RNA, 64 nt, Human
ccuuugcccgccuccugcaaaccucacaggguccccacacaacagugcccuccagaagcagccc

SEQ ID NO: 86542 - RNA, 64 nt, Human
ugaugacaguucuguguccacaacccagaccccuccacacaaacccagauggggcugugccgcu

SEQ ID NO: 86543 - RNA, 64 nt, Human
aaggacccucugaccccaucgaccugggcccugcccacacaacagucugagcaagagaccugca

SEQ ID NO: 86544 - RNA, 64 nt, Human
aagaccaacauccacaggcuaacaccccuucaguccacacaaagaagcuucauauuuuuuuuau

SEQ ID NO: 86545 - RNA, 64 nt, Human
cuggccugugacuggggcggcggccgcgguccugccacacaagcugggcggcggaggccacgca

SEQ ID NO: 86546 - RNA, 64 nt, Human
ccuagucauagcucauccccaucucuaaauguguccacacaaccacaucugccuuuuccacaag

SEQ ID NO: 86547 - RNA, 64 nt, Human
uauauguagagagagcaacaugacuggggcugcaccacacaaggguccccagggcccccaggug

SEQ ID NO: 86548 - RNA, 64 nt, Human
cgauguaaagccaugcuaaggugguuuucagauuccacacaaaaugucacacuuguuucuuguu

SEQ ID NO: 86549 - RNA, 64 nt, Human
ccaccaaaauauuacuuuuaaaaacaaugacaaaccacacaauuguuguugaguaaaccacgca

SEQ ID NO: 86550 - RNA, 64 nt, Human
aaguccugagugacuuacaaagagacuuacacucccacacaauaauaaugggagacuuaaacac

SEQ ID NO: 86551 - RNA, 64 nt, Human
accaaggauuguuggagaguccagugagauggaaccacacaaccaguucccuaccagugucuug

SEQ ID NO: 86552 - RNA, 64 nt, Human
ggauccuggaccucuacgucuuaaccacuggaucccacacaaaucagugaauggaucccaacac

SEQ ID NO: 86553 - RNA, 64 nt, Human
cuugaaucgcucauaggcaugggacuccuggaucccacacaagcgcaccuaugggugccucggg

SEQ ID NO: 86554 - RNA, 64 nt, Human
accucaccccugccccuacccgaaggcccucuguccacacaacaugaaccuaggcugugaccuu

SEQ ID NO: 86555 - RNA, 64 nt, Human
agagccucccacagcugucaccaugcuccaacucccacacaaacgcuucuaccccuuccagaac

SEQ ID NO: 86556 - RNA, 64 nt, Human
cugcccaacuucaacauucauaauggccaggagaccacacaacagagacauuuaaugagagggg

SEQ ID NO: 86557 - RNA, 64 nt, Human
uuugcaggcauuaaaaucuacguauuugauggaaccacacaaauguaauguguaagagcauccu

SEQ ID NO: 86558 - RNA, 64 nt, Human
aguccugggaucagacaccccuucacguguauccccacacaaaugcaagcucaccaaggucccc

SEQ ID NO: 86559 - RNA, 64 nt, Human
ucuugcaaagggucuggcccagggcagggcugccccacacaagggugcacugagugucguggcu

SEQ ID NO: 86560 - RNA, 64 nt, Human
gucugugucacacacuccugucgcccaccugcacccacacaaguggagcucacaggguagcugu

SEQ ID NO: 86561 - RNA, 64 nt, Human
gacaauauuuuauuauuuuuucauagauguucugccacacaaagaacuugggguguaaggauaa

SEQ ID NO: 86562 - RNA, 64 nt, Human
caggaagccacccugccugcuggggaggagggacccacacaagcccccucggcaguuugucccc

SEQ ID NO: 86563 - RNA, 64 nt, Human
accuaauauagccccacaggacuaugugauuggcccacacaagguuucccaaaaauuugacuug

SEQ ID NO: 86564 - RNA, 64 nt, Human
cuugacccucaggcaggagggcacugaccacaccccacacaaccucaaagggucagugcgucag

SEQ ID NO: 86565 - RNA, 64 nt, Human
cagugccggccagcagagaagcagagagccagcgccacacaacaucaagaaggccgacaaccag

SEQ ID NO: 86566 - RNA, 64 nt, Human
agaagaucuaaguaggaugggagaaugauuuggcccacacaaggaagcaacuuuauucuauaua

SEQ ID NO: 86567 - RNA, 64 nt, Human
cugcaagguccaguaugaaauaagaauaagcagcccacacaacugggcauagugguucaugccu

SEQ ID NO: 86568 - RNA, 64 nt, Human
ggaagcaggccgagagacuugcaccuuggccaagccacacaaucaguggggcagccagagcuca

SEQ ID NO: 86569 - RNA, 64 nt, Human
agccugggcuguguaugccugcggaugcagugucccacacaaggacacuuccucuaggaugcca

SEQ ID NO: 86570 - RNA, 60 nt, Human
auucuggggagaagcuauagaaagaggagcccacacaaagcuugaaagccugugccagau

SEQ ID NO: 86571 - RNA, 64 nt, Human
ccacagccuuugugcaggccaugauggaggggucccacacaaaagcagaccugcgagaucucuu

SEQ ID NO: 86572 - RNA, 64 nt, Human
guaaguuuuguuaaaugaaugaaugaauuuagaaccacacaaugccaagauagaauuaauuuaa

SEQ ID NO: 86573 - RNA, 64 nt, Human
uuuaauuucagacuucuuccucugcauuuacacaccacacaacacacacacacacacacacaca

SEQ ID NO: 86574 - RNA, 64 nt, Human
aguugugcuuguuuacagcacuacucugugccagccacacaaacguuuacuuaucuuaugccac

SEQ ID NO: 86575 - RNA, 64 nt, Human
uggggggcauauauuggguuccauucucaccuauccacacaacauauccguauauauccccucu

SEQ ID NO: 86576 - RNA, 64 nt, Human
uaugaaaauaaccauaguacaggaugauuucuguccacacaaagguuaaauuagauugcacagu

SEQ ID NO: 86577 - RNA, 64 nt, Human
agcauagcaaugcuacucuuaaaaagaugcuaugccacacaaccagaggacuuucuuguuagca

SEQ ID NO: 86578 - RNA, 64 nt, Human
acccucagaaggcuugucucaccuccaccggcauccacacaaaaccaaacaggagcaggcguca

SEQ ID NO: 86579 - RNA, 64 nt, Human
aauuacaauggaaguuuaaacauuucuuucugugccacacaauggauggcucuccuuaagugaa

SEQ ID NO: 86580 - RNA, 61 nt, Human
ugcucuguacaaagauauaaagucaugugggccacacaagugcaguagugcaguucaccau

SEQ ID NO: 86581 - RNA, 64 nt, Human
augugucaccccacauuggcaccuccuacuaccaccacacaaacuuaguucauaugcucuuacu

SEQ ID NO: 86582 - RNA, 64 nt, Human
aggagcuccauacacacgcugccuucgguacccaccacacaacauccaaguggccuccgucacu

SEQ ID NO: 86583 - RNA, 64 nt, Human
gaaaacagaaaaaacacuccagucugccauaucaccacacaauaggaucccccuucuugcccuc

SEQ ID NO: 86584 - RNA, 64 nt, Human
gugggaauugaguucaaauauaguguuuuaucuuccacacaaaucaucucuauaggaguuaaau

SEQ ID NO: 86585 - RNA, 64 nt, Human
gggccgcccgagcguccacuccaagccugagcauccacacaauuccagugggcccucggugccu

SEQ ID NO: 86586 - RNA, 64 nt, Human; identical to SEQ ID NO: 59030

SEQ ID NO: 86587 - RNA, 64 nt, Human; identical to SEQ ID NO: 59031

SEQ ID NO: 86588 - RNA, 64 nt, Human; identical to SEQ ID NO: 59032

SEQ ID NO: 86589 - RNA, 64 nt, Human; identical to SEQ ID NO: 59033

SEQ ID NO: 86590 - RNA, 64 nt, Human; identical to SEQ ID NO: 59034

SEQ ID NO: 86591 - RNA, 64 nt, Human; identical to SEQ ID NO: 59035

SEQ ID NO: 86592 - RNA, 64 nt, Human; identical to SEQ ID NO: 59036

SEQ ID NO: 86593 - RNA, 64 nt, Human; identical to SEQ ID NO: 59037

SEQ ID NO: 86594 - RNA, 57 nt, Human; identical to SEQ ID NO: 59038

SEQ ID NO: 86595 - RNA, 64 nt, Human; identical to SEQ ID NO: 59039

SEQ ID NO: 86596 - RNA, 64 nt, Human; identical to SEQ ID NO: 59040

SEQ ID NO: 86597 - RNA, 64 nt, Human; identical to SEQ ID NO: 59041

SEQ ID NO: 86598 - RNA, 64 nt, Human; identical to SEQ ID NO: 59042

SEQ ID NO: 86599 - RNA, 64 nt, Human; identical to SEQ ID NO: 59043

SEQ ID NO: 86600 - RNA, 64 nt, Human; identical to SEQ ID NO: 59044

SEQ ID NO: 86601 - RNA, 64 nt, Human; identical to SEQ ID NO: 59045

SEQ ID NO: 86602 - RNA, 64 nt, Human; identical to SEQ ID NO: 59046

SEQ ID NO: 86603 - RNA, 64 nt, Human; identical to SEQ ID NO: 59047

SEQ ID NO: 86604 - RNA, 64 nt, Human; identical to SEQ ID NO: 59048

SEQ ID NO: 86605 - RNA, 64 nt, Human; identical to SEQ ID NO: 59049

SEQ ID NO: 86606 - RNA, 64 nt, Human; identical to SEQ ID NO: 59050

SEQ ID NO: 86607 - RNA, 64 nt, Human; identical to SEQ ID NO: 59051

SEQ ID NO: 86608 - RNA, 64 nt, Human; identical to SEQ ID NO: 59052

SEQ ID NO: 86609 - RNA, 64 nt, Human; identical to SEQ ID NO: 59053

SEQ ID NO: 86610 - RNA, 64 nt, Human; identical to SEQ ID NO: 59054

SEQ ID NO: 86611 - RNA, 64 nt, Human; identical to SEQ ID NO: 59055

SEQ ID NO: 86612 - RNA, 64 nt, Human; identical to SEQ ID NO: 59056

SEQ ID NO: 86613 - RNA, 64 nt, Human; identical to SEQ ID NO: 59057

SEQ ID NO: 86614 - RNA, 64 nt, Human; identical to SEQ ID NO: 59058

SEQ ID NO: 86615 - RNA, 64 nt, Human; identical to SEQ ID NO: 59059

SEQ ID NO: 86616 - RNA, 64 nt, Human; identical to SEQ ID NO: 59060

SEQ ID NO: 86617 - RNA, 64 nt, Human; identical to SEQ ID NO: 59061

SEQ ID NO: 86618 - RNA, 64 nt, Human; identical to SEQ ID NO: 59062

SEQ ID NO: 86619 - RNA, 64 nt, Human; identical to SEQ ID NO: 59063

SEQ ID NO: 86620 - RNA, 64 nt, Human; identical to SEQ ID NO: 59064

SEQ ID NO: 86621 - RNA, 64 nt, Human; identical to SEQ ID NO: 59065

SEQ ID NO: 86622 - RNA, 64 nt, Human; identical to SEQ ID NO: 59066

SEQ ID NO: 86623 - RNA, 64 nt, Human; identical to SEQ ID NO: 59067

SEQ ID NO: 86624 - RNA, 64 nt, Human; identical to SEQ ID NO: 59068

SEQ ID NO: 86625 - RNA, 64 nt, Human; identical to SEQ ID NO: 59069

SEQ ID NO: 86626 - RNA, 64 nt, Human; identical to SEQ ID NO: 59070

SEQ ID NO: 86627 - RNA, 64 nt, Human; identical to SEQ ID NO: 59071

SEQ ID NO: 86628 - RNA, 64 nt, Human; identical to SEQ ID NO: 59072

SEQ ID NO: 86629 - RNA, 64 nt, Human; identical to SEQ ID NO: 59073

SEQ ID NO: 86630 - RNA, 64 nt, Human; identical to SEQ ID NO: 59074

SEQ ID NO: 86631 - RNA, 64 nt, Human; identical to SEQ ID NO: 59075

SEQ ID NO: 86632 - RNA, 64 nt, Human; identical to SEQ ID NO: 59076

SEQ ID NO: 86633 - RNA, 64 nt, Human; identical to SEQ ID NO: 59077

SEQ ID NO: 86634 - RNA, 64 nt, Human; identical to SEQ ID NO: 59078

SEQ ID NO: 86635 - RNA, 64 nt, Human; identical to SEQ ID NO: 59079

SEQ ID NO: 86636 - RNA, 64 nt, Human; identical to SEQ ID NO: 59080

SEQ ID NO: 86637 - RNA, 64 nt, Human
gcauuuggugcagcaggaaacauggggacugccuaggcucgaaucuguggcacccugagcaauu

SEQ ID NO: 86638 - RNA, 64 nt, Human
cuguuagcucgugguccucaaggacucagaaaccaggcucgaggccuaucccagcaagugcugc

SEQ ID NO: 86639 - RNA, 64 nt, Human
acgagacuuucagcauccaguagaugggaccucgaggcucgagcugaagcaggcgagagagaaa

SEQ ID NO: 86640 - RNA, 64 nt, Human
augcccuuuuggccuuugugagggagcgaggaacaggcucgaaggcuccgggguaucugccuuc

SEQ ID NO: 86641 - RNA, 64 nt, Human
gaauuuaugggacccacgugagcagaccugaggaaggcucgauuucuuuuguuucuugguccac

SEQ ID NO: 86642 - RNA, 64 nt, Human
ccggcaccagcaggcccuuggggggcucaccugaaggcucgaaggcacugcacacuuguauauu

SEQ ID NO: 86643 - RNA, 64 nt, Human
aauaagacaaaaucagcuuuacaacaaucccuagaggcucgaccacagaauaaugccagucacc

SEQ ID NO: 86644 - RNA, 64 nt, Human
auacgccuuuuuuuuuuuucuuuuccugucgccaaggcucgacugagagaagucagaacagaga

SEQ ID NO: 86645 - RNA, 64 nt, Human
cugaggcugcugccaggcccggcaugaggccccgaggcucgagcucggggcugggggcugcagg

SEQ ID NO: 86646 - RNA, 64 nt, Human
gugguugaucauagcucccgggcuguagucucccaggcucgagcaauccucccacuucacccuc

SEQ ID NO: 86647 - RNA, 64 nt, Human
gacuuuagucugcugggcuguauugaccucuggcaggcucgaagccucacuggguaugcaguca

SEQ ID NO: 86648 - RNA, 64 nt, Human
gcugaccgaucucccuccuccucaccccaagugaaggcucgagacuuccugccccacccagugg

SEQ ID NO: 86649 - RNA, 64 nt, Human
aauucaccugccccucccccaucccagguuguggaggcucgaggaagcugacuucuuaggcuaa

SEQ ID NO: 86650 - RNA, 64 nt, Human
ccucucacccuccuccagucccacuucaggcagcaggcucgaguuugaggccauacaucagggg

SEQ ID NO: 86651 - RNA, 64 nt, Human
aaaaagauauauuaaaaauauaaaacugcguuaaaggcucgauuuuguaucugcaggcagacac

SEQ ID NO: 86652 - RNA, 64 nt, Human
gaggggcuaggggagaagcugcagcuggagcugaaggcucgaucuugugaaccccuaaauccgc

SEQ ID NO: 86653 - RNA, 64 nt, Human
gauugaucauggcucacuguaaccucugccucccaggcucgauccucccaugucagccucccaa

SEQ ID NO: 86654 - RNA, 64 nt, Human
uuccucuauggcuuugccuuucugauuuucucagaggcucgagucuuuaauauaaccccaaaug

SEQ ID NO: 86655 - RNA, 64 nt, Human
ggauccacuguguaagaagacuguuggcaguggaaggcucgaguugauuaagugacaaagaggu

SEQ ID NO: 86656 - RNA, 64 nt, Human
ggucccggcccuggcccagccagcccagcccucgaggcucgaugccugugccaaggccaggggc

SEQ ID NO: 86657 - RNA, 64 nt, Human
ggcgcccgcacccacccggcccggccccgagagcaggcucgaccgccgccccauggaccccucg

SEQ ID NO: 86658 - RNA, 64 nt, Human
caggcuggacaaaugaccacuauguuagacccccaggcucgacuucaggggucaguguuccugu

SEQ ID NO: 86659 - RNA, 64 nt, Human
agccugcaggcuggggacccugggugcaggugccaggcucgaggcuguucccuguccugccuca

SEQ ID NO: 86660 - RNA, 64 nt, Human
uucuuucauucgucuccuccuagccugggggaccaggcucgaacugacccuggacaucaaagga

SEQ ID NO: 86661 - RNA, 64 nt, Human
uuuuugggcugagcuguuagaggggcuucuccagaggcucgagagcaggccauuucccaagaag

SEQ ID NO: 86662 - RNA, 64 nt, Human
ccaggucaaauuacuuuccuuuggccucugccugaggcucgauuugccucucugguccaauggg

SEQ ID NO: 86663 - RNA, 64 nt, Human
aagcucaacuugagggcguguaguaaguuguagaaggcucgaggggacguggacuuauuugccu

SEQ ID NO: 86664 - RNA, 64 nt, Human
cccagcucaggccggcugaccgugguggugcuggaggcucgaggccugcguccaggacuugcag

SEQ ID NO: 86665 - RNA, 64 nt, Human
gcacgccagugcuguuucccggccuccagacacaaggcucgagguuauggcagugacuuucagc

SEQ ID NO: 86666 - RNA, 64 nt, Human
gagggccaggggcgugcaugccaggccgggccggaggcucgaaagucccgcgcgagcgccacgg

SEQ ID NO: 86667 - RNA, 64 nt, Human
cagcccaucuuccuaaaagggaccagcuuauggaaggcucgaccuugaggggaaaguuuuacug

SEQ ID NO: 86668 - RNA, 62 nt, Human
agaagcggaaaggccguuaaucacuuuuaugaaggcucgaguucugcuguucuguaaaagag

SEQ ID NO: 86669 - RNA, 64 nt, Human
cuuugcaaguuugccaccaguagauaccggccacaggcucgacaaauaguggucuuuguuauua

SEQ ID NO: 86670 - RNA, 64 nt, Human
caacagaaagauggggcugucccagccguaagucaggcucgagggagacugauccccugaccaa

SEQ ID NO: 86671 - RNA, 64 nt, Human
agacaacagcacacaggcagccagccguggccagaggcucgaggggcucagggccucaggcacc

SEQ ID NO: 86672 - RNA, 64 nt, Human
gaguacuaacauuuauugcucugucaauaaugaaaggcucgauguaauauagcuguaauuuacu

SEQ ID NO: 86673 - RNA, 64 nt, Human
aauauauuuuuuucaacugccaaucaaggcuaggaggcucgaccaccucaacauuggagacauc

SEQ ID NO: 86674 - RNA, 64 nt, Human
cauaaagucagggguucccuuuuuuggcugcugaaggcucgagcaugccuggauggggcugcac

SEQ ID NO: 86675 - RNA, 64 nt, Human
ccuagaagcagccggcacaggagggaagguggccaggcucgaagcagucucuguuuccagcacu

SEQ ID NO: 86676 - RNA, 64 nt, Human
aauguacaccuacucuaucagagaaaaacaggaaaggcucgaaauacaagccauucuaaggaaa

SEQ ID NO: 86677 - RNA, 64 nt, Human
uccuauccccgacccccuccggggaacaccgggaaggcucgacgcuccaggacaggaccagcca

SEQ ID NO: 86678 - RNA, 64 nt, Human
accggcuggggaucuguggggcagcggcgggcgcaggcucgacccgggccaggaggcccggggc

SEQ ID NO: 86679 - RNA, 64 nt, Human
auaaauguagugagugugggaaagcuuuuagcaaaggcucgaaucuuacugcccaucaaagagu

SEQ ID NO: 86680 - RNA, 64 nt, Human
ucgccccugggggcguagcacagcgucuucucggaggcucgaggucuaagagaaacgcugaguu

SEQ ID NO: 86681 - RNA, 63 nt, Human
ccaagagcaagaagaacugaggagugguggaccaggcucgaacacuggccgaggaggagcucu

SEQ ID NO: 86682 - RNA, 64 nt, Human
cggcuuuggggagaugggcgauaaguguugagguaggcucgagaacugcuccccaaaucaguga

SEQ ID NO: 86683 - RNA, 64 nt, Human
cuaauucauuuauuaaguauauuuguaaaagcuaaggcucgaguuaaaacaaugaaguguuuua

SEQ ID NO: 86684 - RNA, 64 nt, Human
gaggagaguagaaaccacagcucuuaguaguaauggcauacagucuagaggaccauucaugcaa

SEQ ID NO: 86685 - RNA, 64 nt, Human
uuuacuaaaagagaaugucuccauacgcguucuaggcauacaaggggguaacucaugaugagaa

SEQ ID NO: 86686 - RNA, 64 nt, Human
uccugccucagccucccaaguagcugggauuacaggcauacaccaccacgccccacuaauuuuu

SEQ ID NO: 86687 - RNA, 64 nt, Human
cagagaggugaucacagggcagggacacauguguggcauacaguuccuaguuaagaucccaaau

SEQ ID NO: 86688 - RNA, 64 nt, Human
ccuuucuugccaagccagugcucuuuugguauauggcauacagcuccauuggaggggacacauc

SEQ ID NO: 86689 - RNA, 64 nt, Human
gccccaaagccuggaagauuacucuuuggucaagggcauacaaauagaaaguuaauaaagggga

SEQ ID NO: 86690 - RNA, 64 nt, Human
gcaauauuucccuggaauuuaauucaaaguuuguggcauacaaccugagccuuuucuuauauaa

SEQ ID NO: 86691 - RNA, 64 nt, Human
aauaguugaaaucugccuuuuucucauucaagaaggcauacaaauaucugagagugacuuuguu

SEQ ID NO: 86692 - RNA, 64 nt, Human
gcccaggccaggcagccaaaucuugccugugcugggcauacaacccucugcuuucacaucucug

SEQ ID NO: 86693 - RNA, 64 nt, Human
cccuggggaggaacaguggcuucucagagccuggggcauacagaagaaggcaggaguugauuuu

SEQ ID NO: 86694 - RNA, 64 nt, Human
aaugaaacuuuaaaaaaacugaauuuuuauacauggcauacauuuuucuaguuccuucugcuug

SEQ ID NO: 86695 - RNA, 64 nt, Human
aaggauaaauucaaaaaauagccucaugagacuuggcauacacacucgugggauuccaguuauu

SEQ ID NO: 86696 - RNA, 64 nt, Human
aaaggaaauauucuuucucauaaaacugugacuaggcauacacuguaguuuuugaaaauuaugc

SEQ ID NO: 86697 - RNA, 64 nt, Human
acuuugucuuuaggggaggagggcugaggaagaaggcauacauaauuacuucaguguaauccuu

SEQ ID NO: 86698 - RNA, 64 nt, Human
auaagauagguuguguuuauaaaauacaaacuguggcauacauucucuauacaaacuugaaauu

SEQ ID NO: 86699 - RNA, 64 nt, Human
acauacuuucagauuggccuguuuuugucgguaaggcauacagccuucagaagccaacauuuuu

SEQ ID NO: 86700 - RNA, 64 nt, Human
ucccaaggggcaauucugaaccccaucuuuggcaggcauacauauuucacuguuuccaaagcua

SEQ ID NO: 86701 - RNA, 64 nt, Human
aguauaugauccucagauacagggagaaggacaaggcauacagcuuauugauuagagcuggcaa

SEQ ID NO: 86702 - RNA, 64 nt, Human
cugggcauacagugucuggacgcugccacaucugggcauacagugucuggacacugccacaugg

SEQ ID NO: 86703 - RNA, 64 nt, Human
cagccacacagcuggacggaugcugccacaucugggcauacagugucuggacgcugccacaucu

SEQ ID NO: 86704 - RNA, 64 nt, Human
acuuccagagaggaaauccaaugacaaugguacuggcauacacagggagccucccuucaaaaag

SEQ ID NO: 86705 - RNA, 64 nt, Human
aaaaugccuccauggcagaagucaacgccucgguggcauacagacuggggacccuggacaugcg

SEQ ID NO: 86706 - RNA, 64 nt, Human
uuuccuuacaggacgugauaggcugcaugcaagaggcauacagaaaauggaaauaguauuucgc

SEQ ID NO: 86707 - RNA, 64 nt, Human
ucucugggggucgcacguugcgggcagagcgcaaggcauacaccagaaaacgcuguccuguggu

SEQ ID NO: 86708 - RNA, 64 nt, Human
auuucuuuuacccuuuugugaagcagcuauacguggcauacauguauuuaaagaaaaaaaaaua

SEQ ID NO: 86709 - RNA, 64 nt, Human
uuaauuucaagggaauauugaaagguuuuaaaauggcauacagauaauggaaaauaagcuuuau

SEQ ID NO: 86710 - RNA, 64 nt, Human
cuacugagaaaugggagcacaguacugggaaaugggcauacaguacugagaaaugggagcacac

SEQ ID NO: 86711 - RNA, 64 nt, Human
gccugcuggacugguuggaaccagaacaggcuaaggcauacaguucuugacuuuggacaaucca

SEQ ID NO: 86712 - RNA, 64 nt, Human
cugugaugauacgggaugacaucauuucagguugggcauacaaaaaaguaaggaagcuaaacua

SEQ ID NO: 86713 - RNA, 64 nt, Human
cuccugccucagccucccaaguagcuggauuacaggcauacaccaccacgccuggcuauguuuu

SEQ ID NO: 86714 - RNA, 64 nt, Human
auuuuuaucauuuuaaaauauuuuuuuuccauuuggcauacaucguucuuuguuguaauuaaau

SEQ ID NO: 86715 - RNA, 64 nt, Human
agcuuacuuacacacauucuacagaguuauuuaaggcauacauuauaaucucccagccccauuc

SEQ ID NO: 86716 - RNA, 64 nt, Human
accuugaugaugcgugaaucccgagggagccgguggcauacaccguuagcuuaaccuuagcuua

SEQ ID NO: 86717 - RNA, 64 nt, Human
gccccagccugcaaucuguggaugcccaggggaaggcauacaggccucauccaccaggcaauag

SEQ ID NO: 86718 - RNA, 64 nt, Human
guaagucugccagaaaggugaauaguguuagacaggcauacauuugccaucuuuuaaacagaau

SEQ ID NO: 86719 - RNA, 64 nt, Human
uucucugauagaggaggaccacgcuucagucaaaggcauacaaguaucuaucuggacuucccug

SEQ ID NO: 86720 - RNA, 64 nt, Human
uggaaaacuaaaggaaaaauacaaguguuuucggggcauacauuuuuuuucugggugugcaucu

SEQ ID NO: 86721 - RNA, 64 nt, Human
caugcacacauacacaugcaugcacacauacacaggcauacaugcaugcacacacacaugcacg

SEQ ID NO: 86722 - RNA, 64 nt, Human
auguggaaaggugucauucaaaaaaaaaguaauuggcauacauauuccacaucaucgauccucu

SEQ ID NO: 86723 - RNA, 64 nt, Human
gcccaugcuccucucagggcaggcacauguacggggcauacaaggcacagcgccuguuggaaca

SEQ ID NO: 86724 - RNA, 64 nt, Human
caggaagccagagccccaagcaggacgaaaaagaggcauacacacagcagugugaauagccugg

SEQ ID NO: 86725 - RNA, 64 nt, Human
ugcccaaucuuugaugacauugaaaacguuuuggggcauacacacucaaaaagcaggauccaau

SEQ ID NO: 86726 - RNA, 64 nt, Human
aucuuccuuaacuagauaguuugacagaaagaauggcauacaaagaggaaaggggaaaaaugac

SEQ ID NO: 86727 - RNA, 64 nt, Human
gcuugcuuuaaaaaucuacacucuugcauucuuaggcauacaggggaaauguugaaaaggaagg

SEQ ID NO: 86728 - RNA, 64 nt, Human
uuuguaagaggccauccagguacuaaggacccaaggcauacagauucacaaaauuaacuaaucu

SEQ ID NO: 86729 - RNA, 64 nt, Human
aguacaaagaggcagaacagugucugguuuacuuggcauacacagaaucugcacugccgguucc

SEQ ID NO: 86730 - RNA, 64 nt, Human
auauuuucuuuucuuacagucauugccagacagaggcauacaagucuguuugcugcauacacau

SEQ ID NO: 86731 - RNA, 64 nt, Human
aguguuauuagaaugaaaaguaauuaguuagaagggcauacaucucaguggcaugagcauugug

SEQ ID NO: 86732 - RNA, 64 nt, Human
uuucaucaaguagcguuggagacauacacaaaugggcauacaaguuuagccuggggggugugau

SEQ ID NO: 86733 - RNA, 64 nt, Human
uucaccagacucaaggacacccuggcccugcugaggcauacagagcuucagcccagcacagaag

SEQ ID NO: 86734 - RNA, 64 nt, Human
cugaacuuguuucaaagauuuauauuaaauauuuggcauacaagagauaugaauucuuauaugu

SEQ ID NO: 86735 - RNA, 64 nt, Human
guuuuugaagauaguaggaaauggaguacagaaaggcauacaguauuauguuacaguggagugc

SEQ ID NO: 86736 - RNA, 64 nt, Human
uauccaaacaucuuccaauuuauuuuguuuguucggcauacaaauaauaccuauaucuuaauug

SEQ ID NO: 86737 - RNA, 64 nt, Human
ugagaaagcaaagcacugguacaguuauuuaacaggcauacacaagcagggaaaagauaaucca

SEQ ID NO: 86738 - RNA, 64 nt, Human
agaacugguagcucggucguuucgcacacuagguggcauacaggcagcagcagguguucauauc

SEQ ID NO: 86739 - RNA, 64 nt, Human
aaauaauuuuugaaaaaucauuauucaugaucauggcauacaguauauucucuuuuuuuucuuu

SEQ ID NO: 86740 - RNA, 64 nt, Human
gaaauucugugaaccagaaugagacaaggcagcaggcauacagaagguuuguccugcucuggga

SEQ ID NO: 86741 - RNA, 64 nt, Human
aagacgucaucacugaaagacagaaugccaucugggcauacaaauaagaaguuugucacagcac

SEQ ID NO: 86742 - RNA, 64 nt, Human
auuacuuaaaacguuuuuauugugcaacauuuaaggcauacaaaaacauauaaagaauaccaug

SEQ ID NO: 86743 - RNA, 64 nt, Human
caugccccucuccuaguggucaugguuucauaugggcauacaacugcuacugaaguuauauagc

SEQ ID NO: 86744 - RNA, 64 nt, Human
ccuuugauauaguugaaagaauguauuguaaauuggcauacaauacugccuuuaauagaaaacc

SEQ ID NO: 86745 - RNA, 64 nt, Human
ggcacgcucuggccccaggcuugugccccacccuggcauacagccccugacaccuccuccccag

SEQ ID NO: 86746 - RNA, 64 nt, Human
guuuucauacuucuuuuuuuugcaucagugauaaggcauacauuugcgcagaugagcuaggaag

SEQ ID NO: 86747 - RNA, 64 nt, Human
uuagaucaugaucucaacaauauucuuccaaaauggcauacaucuuuuguacaaagaacuugaa

SEQ ID NO: 86748 - RNA, 64 nt, Human
aauugccauuuuucuuguuucauuacguauuuagggcauacauguuagccaaaucuacacucag

SEQ ID NO: 86749 - RNA, 64 nt, Human
ugcaauuguauuaaagucaaaagcugauuuuuauggcauacacaagaaugccacuuuuucuuuu

SEQ ID NO: 86750 - RNA, 64 nt, Human
uuugguauagcaaaacugugaaaaagccaaauuaggcauacaaggaguaugauuuaacaguaug

SEQ ID NO: 86751 - RNA, 64 nt, Human
caccuuucccuggcuuuuugccuccauuccaugaggcauacaguaaggcugccugcuaguaagc

SEQ ID NO: 86752 - RNA, 64 nt, Human
gggaaagaaaagcagaauacuugagaugaaaguuggcauacaaauaggauacuaucgccaguag

SEQ ID NO: 86753 - RNA, 64 nt, Human
cuuuguacucuucagaugaauauauagacacuguggcauacauuuuuuuucauuaaaaacuuau

SEQ ID NO: 86754 - RNA, 64 nt, Human
augauucuuauuguaguauuuauauuacaaaguuggcauacagggucaauaucuaauuuacugu

SEQ ID NO: 86755 - RNA, 64 nt, Human
uauaaauacagucauugagaauaagucgauuugaggcauacaagaguaguuucuuacacaguuu

SEQ ID NO: 86756 - RNA, 64 nt, Human
ggguacuucuuccuauuuuucuucuguuuuuggaggcauacacauuaugcauaaccaaaacaau

SEQ ID NO: 86757 - RNA, 59 nt, Human
ugaagaaaacucugacuuaggcacucagaggcauacacuuuuuacagauggacaaaagc

SEQ ID NO: 86758 - RNA, 64 nt, Human
agcauucaagugauucugaugcaggugagcugggggcauacagggaggaacacugcccuggacu

SEQ ID NO: 86759 - RNA, 64 nt, Human
gaaauccuuuaagaguucaaaugucccuggaacaggcauacaggcucuagucaagaaugaauua

SEQ ID NO: 86760 - RNA, 64 nt, Human
gaaauccuuuaagaguuuaaaugucucugaaacaggcauacaggcucuagucaagaaugaauua

SEQ ID NO: 86761 - RNA, 52 nt, Human
cagcaacagcagcacaguaaagggcauacauuuccugcuuucaccaauuaac

SEQ ID NO: 86762 - RNA, 64 nt, Human
guccaucagcugccuccagcauccaguggcugcuggcauacagccucauccccacgucccaacc

SEQ ID NO: 86763 - RNA, 64 nt, Human
uuuuguuuuaaaguggucccuccaagaauaauguggcauacacaguggguuugguuguaaggca

SEQ ID NO: 86764 - RNA, 64 nt, Human
uguuuaucaacuucgcuagaaaaaaaaaacacuuggcauacaaaauauuuaagugaaggagaag

SEQ ID NO: 86765 - RNA, 64 nt, Human
cuaaccugcaaguugauuuugaggguuaaauaaaggcauacaugaaaaugccuggcaaauuacc

SEQ ID NO: 86766 - RNA, 64 nt, Human
uugucuuggggaggguucuggguggaagcuggcaggcauacagcacccucuacccuccguggcc

SEQ ID NO: 86767 - RNA, 64 nt, Human
uucuguuuuggccaccaggaaaugggguggggugggcauacacagagaggaccccucucuuaau

SEQ ID NO: 86768 - RNA, 64 nt, Human
uauuccucuaucuuaaauaaauuuuaauuuuugaggcauacaaauaauauacgggcauuguguc

SEQ ID NO: 86769 - RNA, 64 nt, Human
agagauggaggaggaggcaauugggauggcgcuaggcauacaaguagggguugugggugaccag

SEQ ID NO: 86770 - RNA, 64 nt, Human
cuacuaaaaauacaaaaaauuagcuggaugugguggcauacacuuguagucccagcuacuuggc

SEQ ID NO: 86771 - RNA, 64 nt, Human
aauauuugcaggagcgugguucuaccacccccugggcauacauaaaucgacacaugccaagucc

SEQ ID NO: 86772 - RNA, 64 nt, Human
agcuaacaaaagcuucucagcugaggacacucaaggcauacaugaugacagucuuuuuuuuuuu

SEQ ID NO: 86773 - RNA, 64 nt, Human
uaugaauauuucauaguuuugcauaucagauguaggcauacagacaaauacauaaaccaaugaa

SEQ ID NO: 86774 - RNA, 64 nt, Human
aguacacauacgugcauacacaugccugcauacaggcauacacaugcacgcuuacauguacacg

SEQ ID NO: 86775 - RNA, 64 nt, Human
gaauuuagggugauuuuaaagaacagugagaaagggcauacauccacagauucacuuuguuuau

SEQ ID NO: 86776 - RNA, 64 nt, Human
ugcuguuuauauguaagaauuuuauugcuuauguggcauacaauauuuauaacuauaaacuuua

SEQ ID NO: 86777 - RNA, 64 nt, Human
aauuucuauuuuugaaauaagggauggucuaugaggcauacaguagauuugaugugauccuuuu

SEQ ID NO: 86778 - RNA, 64 nt, Human
uauguacaguuuacaugaauguuccucaggacauggcauacaauggccuuggagguccaaauaa

SEQ ID NO: 86779 - RNA, 64 nt, Human
agugcguuuagagguacaccccaugucuccacagggcauacagcauccgauuuaaucuggaucc

SEQ ID NO: 86780 - RNA, 64 nt, Human
uuccucuagauacuccccauguuucgguaaucuuggcauacauuuuuuagaugaccucuuuccu

SEQ ID NO: 86781 - RNA, 64 nt, Human
uaagauggccucagucuccacugugggcuugaguggcauacacuguuauucaugguuaagguaa

SEQ ID NO: 86782 - RNA, 64 nt, Human
gucuggcacaggugcgauggcaccccaugcuccaggcauacagaugugguuucucggcugcacc

SEQ ID NO: 86783 - RNA, 64 nt, Human
aaaauggaagcccacuucucagauuuuucugaagggcauacaaugaaaagugaaggggaaacac

SEQ ID NO: 86784 - RNA, 64 nt, Human
uauccuugaguuuguaaucuaguuacagaaguaaggcauacacacacacaaagauaacaguacc

SEQ ID NO: 86785 - RNA, 64 nt, Human
ccuuucucuaauuucccccuuaacaugccuggggggcauacaauccaacccgcgcccucuccuc

SEQ ID NO: 86786 - RNA, 64 nt, Human
ugaagagacuuuccuuucaaggcuucccauggguccgcgccacacagggccggugcugcuuuau

SEQ ID NO: 86787 - RNA, 64 nt, Human
gggugggcuggaggccggcgcagcuuggggccccccgcgccagcugucucagccaccaccugug

SEQ ID NO: 86788 - RNA, 64 nt, Human
cuccaagguggugcugugggccgagagccgccugccgcgccagacguggagcaucagugaaucg

SEQ ID NO: 86789 - RNA, 64 nt, Human
gggcaggggaauguacugaaaggagccugcucuuccgcgccacacuucaauggcacugauagaa

SEQ ID NO: 86790 - RNA, 64 nt, Human
gcugccgagccaccaugcuugccugaagcuucggccgcgccacccgggcaaggguccucuuuuc

SEQ ID NO: 86791 - RNA, 64 nt, Human
caaaccagagugcccaaccccggccugugggcagccgcgccagcugccgggacacugcugccag

SEQ ID NO: 86792 - RNA, 64 nt, Human
uugcuugggcggcuguugguagagugggcagugcccgcgccauggggugcucugugggcuucuc

SEQ ID NO: 86793 - RNA, 64 nt, Human
cggcuccgacacgccgcuaaccggccgcucguccccgcgccacgguccgcccaccgccgccgcc

SEQ ID NO: 86794 - RNA, 64 nt, Human
aagauugugucccauucccccagugcggccagcuccgcgccaggauggcgcaggaacucaauaa

SEQ ID NO: 86795 - RNA, 64 nt, Human
cguguguuuugcaugcaugcuucuuuuccccaugccgcgccaguauuuuucacugccauaugcu

SEQ ID NO: 86796 - RNA, 64 nt, Human
caguucggaucgccuugauccaggggccgccgggccgcgccaaggaccugcaagggacugaagg

SEQ ID NO: 86797 - RNA, 64 nt, Human
gcucuguagacuaacucucggcugcugccccagcccgcgccagacagcccacggauccguucuc

SEQ ID NO: 86798 - RNA, 64 nt, Human
cugagggcgguauacggugcggggccugggaugcccgcgccacccgcagcccccucacucggcg

SEQ ID NO: 86799 - RNA, 64 nt, Human
uacugcccgccgugauggccuugaggcugccugcccgcgccaggauguuuggcacaaagagcag

SEQ ID NO: 86800 - RNA, 64 nt, Human
aagccucagcccgacucagagugccugaacccugccgcgccagucccccguuuauugcauauug

SEQ ID NO: 86801 - RNA, 64 nt, Human
cuggacagcgagggcacagggucccaaaccgaggccgcgccaagauggcagaggauggaggcuc

SEQ ID NO: 86802 - RNA, 64 nt, Human
gcggcaggcuggguucauuccccggcccuccgagccgcgccaacgcacgcaacccuugcugcug

SEQ ID NO: 86803 - RNA, 64 nt, Human
uggcugggcucggggaccacaucuggcccccggcccgcgccaucccccaggauccuccggccug

SEQ ID NO: 86804 - RNA, 64 nt, Human
gcgcuccuccuggccucugagggaugcguccuacccgcgccaucgccccguggcccaggacggg

SEQ ID NO: 86805 - RNA, 64 nt, Human
gaacccgggaggcagagguugcagugagccgagaccgcgccacugcacuccagccugggcaaca

SEQ ID NO: 86806 - RNA, 64 nt, Human
cagcgcggcccucccgaguuaaggugggcccggcccgcgccacaggacccucgccggacccucu

SEQ ID NO: 86807 - RNA, 64 nt, Human
aacgcuggaggaggagccggcccucacgcccgccccgcgccacgcuguggaacggggcuccggc

SEQ ID NO: 86808 - RNA, 64 nt, Human
accccgggggcuggaggggcguguacccaaauccccgcgccaucagccuggaugggcauaagua

SEQ ID NO: 86809 - RNA, 64 nt, Human
acgugugugcaggaagcggaggcgcaggaccucaccgcgccagcgugaaguucccgggcauggu

SEQ ID NO: 86810 - RNA, 64 nt, Human
cugauugugcaggcccagcacuguggcuggacugccgcgccacgggcaccaggaccccuaagac

SEQ ID NO: 86811 - RNA, 64 nt, Human
agcggggccugccgaggaagccgagugcccgccgccgcgccagccucagcccgcgcagaaugug

SEQ ID NO: 86812 - RNA, 64 nt, Human
gcagugagcgcgaggaucccgaugaggggauggaccgcgccaucccagggcuggggaggagcgg

SEQ ID NO: 86813 - RNA, 64 nt, Human
ccgaggaccgugcugccgccguccacgaaaagacccgcgccaucggccuccaguuugcgucgag

SEQ ID NO: 86814 - RNA, 64 nt, Human
caggucaguccaggcaggaagcagcaccugccccccgcgccagcccagccccagccugagugca

SEQ ID NO: 86815 - RNA, 64 nt, Human
ggaagccaaggucaagagggccaucccuaagccuccgcgccaggcccugaaucggaaaaagggc

SEQ ID NO: 86816 - RNA, 64 nt, Human
aagcugcccauggggcuucggcgccaaaggugacccgcgccaaccucccucccccccagugccu

SEQ ID NO: 86817 - RNA, 64 nt, Human
ccaggagccgggccucccaccgcagcgucccccgccgcgccaguccccgcuagugguaguaucu

SEQ ID NO: 86818 - RNA, 64 nt, Human
ccugcagcccguguccaggagccccgccaggugcccgcgccaggcccucagucuuccugccggu

SEQ ID NO: 86819 - RNA, 64 nt, Human
ccucacaaggaccuccuggcuggugaggagggggccgcgccaggcucccaggccuccacagagu

SEQ ID NO: 86820 - RNA, 64 nt, Human
gacugaggccugagcgcuccugccgcagagcuggccgcgccaaauaaugucucugugagacucg

SEQ ID NO: 86821 - RNA, 64 nt, Human
uagucuucccucuguucuuccugccuccagccgcccgcgccagauuuugaaaucucggagacaa

SEQ ID NO: 86822 - RNA, 61 nt, Human
agcgccaguucaacuacugagcguccaccggccgcgccacgaaccccuugccgaucccgau

SEQ ID NO: 86823 - RNA, 64 nt, Human
gguagccccggcugcccacccuggagggcugcgcccgcgccaggcgcggggacguguuucuggg

SEQ ID NO: 86824 - RNA, 64 nt, Human
gccgggacagcugcuuugcugcccggagaguaguccgcgccaggaagagagcaacgaggaaagg

SEQ ID NO: 86825 - RNA, 62 nt, Human
ucaucaccaacgggaggugacccgcuggccgcccgcgccaggagccuggacccggccucccg

SEQ ID NO: 86826 - RNA, 64 nt, Human
gcuguauuauauccgcucccgcuguacugcagccccgcgccagcugguggggaacuguaagcaa

SEQ ID NO: 86827 - RNA, 64 nt, Human
ugaaacgccuggccgccaacuuccacccugacggccgcgccauggccaccaaguuugcacacuu

SEQ ID NO: 86828 - RNA, 64 nt, Human
caaguucaagugaguaagccgcgucccccaacuacagcuggagacggggccagcucggcggccu

SEQ ID NO: 86829 - RNA, 64 nt, Human
cuggggugggcgugguguggccugagagacugcccagcuggagaggccuuccuuuacaaggcca

SEQ ID NO: 86830 - RNA, 64 nt, Human
ucggccuugagguugcugacucucaggcguuaggcagcuggaugacuucccgcuucacgcagca

SEQ ID NO: 86831 - RNA, 64 nt, Human
gguagauggggagcaggauugggaccugcucugacagcuggacacaugagcccuggaugaguau

SEQ ID NO: 86832 - RNA, 64 nt, Human
cugggcccguggccugaacccuccugcacuccuccagcuggagucucaccgcggaucccaggaa

SEQ ID NO: 86833 - RNA, 64 nt, Human
ugggcacacggccccugccguggggcucacucugcagcuggagagacagcauaccugaaaccug

SEQ ID NO: 86834 - RNA, 64 nt, Human
auuugcuccugaccuugauuaacuuaacaguucccagcuggaagggacacuuucaggacccagu

SEQ ID NO: 86835 - RNA, 64 nt, Human
ugugcugggggugguagaaaggaugcugcugaggcagcuggaggagugggaguagcucagaggg

SEQ ID NO: 86836 - RNA, 64 nt, Human
guggcuggcugaggugcaugggccccacacaggacagcuggagaaugggccguccacuuggccu

SEQ ID NO: 86837 - RNA, 64 nt, Human
ggucguccgccacggguugcacugccguggcagacagcuggacuugagcagagggaacgaccug

SEQ ID NO: 86838 - RNA, 58 nt, Human
gagaaaccaccagcaacuaagcugcauucagcuggaguuccucggaacgggaggacuc

SEQ ID NO: 86839 - RNA, 64 nt, Human
ggacaguggcugaggggcuuccuguugcagccuucagcuggacucaggguuggggucacuggag

SEQ ID NO: 86840 - RNA, 64 nt, Human
gccccccuggcagcaguauuggaggggcuacaggcagcuggagaaaggggcccagccgcugacc

SEQ ID NO: 86841 - RNA, 64 nt, Human
cucgggggaucugccccuaccccucauggaaagacagcuggauguggugaaaggcuguggcuuc

SEQ ID NO: 86842 - RNA, 64 nt, Human
augauuacuuuagaccuagcccaggcuuggaggccagcuggaggaagaagggucuaaauccugg

SEQ ID NO: 86843 - RNA, 64 nt, Human
caccauggucaucaccacccuuccagggccugagcagcuggaucugguacaaagcaaucggaca

SEQ ID NO: 86844 - RNA, 64 nt, Human
ugaucauggaagcuuggcucugaccccacggccccagcuggagcuggcugagagcaguccugca

SEQ ID NO: 86845 - RNA, 64 nt, Human
gccucacuuuuauuuauugcugguuuuccugggacagcuggagcugugucccuuagccuuucag

SEQ ID NO: 86846 - RNA, 64 nt, Human
acccuccucugcugggaaccuagcacaccugaaucagcuggacauacugcuggaguccagugcu

SEQ ID NO: 86847 - RNA, 64 nt, Human
cccucaucagcuccccacaccagucaaggcuucucagcuggagaaccggggagcagcuggacac

SEQ ID NO: 86848 - RNA, 64 nt, Human
ccagucaaggcuucucagcuggagaaccggggagcagcuggacacccagccaaggcccugccaa

SEQ ID NO: 86849 - RNA, 64 nt, Human
cuccaucaccaccugcccucacauccuggggcagcagcuggacagccauuagaccucagugcca

SEQ ID NO: 86850 - RNA, 64 nt, Human
cccauacucagccugcugcccaggcugugcagcgcagcuggacucugcaucccagcaccugccu

SEQ ID NO: 86851 - RNA, 64 nt, Human; identical to SEQ ID NO: 86850

SEQ ID NO: 86852 - RNA, 64 nt, Human; identical to SEQ ID NO: 86850

SEQ ID NO: 86853 - RNA, 64 nt, Human
ggaugcguccacaccccuuuuugaaccuuccaagcagcuggaggguuuuuggaucccugucccc

SEQ ID NO: 86854 - RNA, 64 nt, Human
cugggccagcucaguggaccguguggaacaggaacagcuggaguggaguugaggacuauuagaa

SEQ ID NO: 86855 - RNA, 64 nt, Human
gugaccugacaccugccgcugcuugaguggacagcagcuggacugggugggccccacagugguc

SEQ ID NO: 86856 - RNA, 64 nt, Human
agugugggagaaaggagcuaguuugcaauaaaaacagcuggaugcaggagcccagugucuucau

SEQ ID NO: 86857 - RNA, 64 nt, Human
cugccucucuccugggaccgugggguuggaaagucagcuggaccucauggggccuggggcucac

SEQ ID NO: 86858 - RNA, 64 nt, Human
aauauaggcaggauguucaacaucaguuuacuugcagcuggaagcauuuguuuuugaaguugua

SEQ ID NO: 86859 - RNA, 64 nt, Human
gaaacuaagauucagagcagcugaucuugugaggcagcuggaauuggaacucagauuuguugaa

SEQ ID NO: 86860 - RNA, 64 nt, Human
cuuucuuccauacagaaaagggcuaaccauaccacagcuggaaucucugaauauuuccuauuaa

SEQ ID NO: 86861 - RNA, 64 nt, Human
accagugugggagagcuggagccguggcugagcucagcuggagggagccuggccccuugcccgg

SEQ ID NO: 86862 - RNA, 64 nt, Human
gagcucugauccuggaaccccucccucugcgccgcagcuggacgccaccuccgacggacacagc

SEQ ID NO: 86863 - RNA, 64 nt, Human
ccggaauauacguccuaacuacaccccuuccuaucagcuggauucuauccaagugacucuauug

SEQ ID NO: 86864 - RNA, 64 nt, Human
gggccacugcacaugcccgcugcagcccugggaucagcuggaagcugccugucaucuccugccc

SEQ ID NO: 86865 - RNA, 64 nt, Human
gugagaagaucugcaccguccaguugguggguaacagcuggaccccuggcuaccccgagaccca

SEQ ID NO: 86866 - RNA, 64 nt, Human
gcaaggggaccccgagaacccugagcaggguccacagcuggaaaguugggccccugaggagcuu

SEQ ID NO: 86867 - RNA, 64 nt, Human
ccaccccucagggagcuagguuuucucagaggcucagcuggacagcacuuuuuagaaaaguuug

SEQ ID NO: 86868 - RNA, 64 nt, Human
uaacuggaucuaacuggguaccugagauauuuuacagcuggaccuaguuucacaaucuguuguc

SEQ ID NO: 86869 - RNA, 63 nt, Human
ggucccacucaagguccuaacuggcuauggccacagcuggaacuacccgagaagucuuuugua

SEQ ID NO: 86870 - RNA, 64 nt, Human
cagcagggaguccagcccuaccuucuucccuuggcagcuggagaaaucugguuucaauauaacu

SEQ ID NO: 86871 - RNA, 64 nt, Human
uggugaggcucagagaacugcuaaggggaaagaacagcuggaguuucuguugaugugaagaagg

SEQ ID NO: 86872 - RNA, 64 nt, Human
ugaaggugacacuguucuguauauucccuauaggcagcuggagagaucugugugacacaagaug

SEQ ID NO: 86873 - RNA, 64 nt, Human
ugccugcuuccuggaccggggccuuggucccagacagcuggacccauuugccaggauuggcaca

SEQ ID NO: 86874 - RNA, 64 nt, Human
uccuaagggaagggacaguuccuggaaggcccuccagcuggaugcuggggaucagcgauaggug

SEQ ID NO: 86875 - RNA, 64 nt, Human
cccagcagcccuaaggaucucucaggagcacaggcagcuggaugagacuuccaaaccugacaga

SEQ ID NO: 86876 - RNA, 64 nt, Human
ucagugguacacuccuugggcccaagggcuuuagcagcuggauaugggguuccuugauuuuccu

SEQ ID NO: 86877 - RNA, 64 nt, Human
uauauuuuugacugagugcguaguacccauuagacagcuggagaugcagagcacuauggagcaa

SEQ ID NO: 86878 - RNA, 64 nt, Human
ccgcucguuccugcagccagaaaggaacucugggcagcuggaggcgcaggagccugugcccaua

SEQ ID NO: 86879 - RNA, 64 nt, Human
agugugggcaaaauuuguauguugucuuuucccucagcuggaguuauuggaaccacuuuguagu

SEQ ID NO: 86880 - RNA, 64 nt, Human
agaaagugaaucauugguagauauccugcacaagcagcuggacuuuccaguaauagcuuucuug

SEQ ID NO: 86881 - RNA, 64 nt, Human
auauaauaauagcauuuaauuggaauauacuaggcagcuggaaaaguauuugaaacuaaauuga

SEQ ID NO: 86882 - RNA, 64 nt, Human
aauugcucagugauguuccauaacccggcuggcucagcuggagugcugggagaugagggccucc

SEQ ID NO: 86883 - RNA, 64 nt, Human
gauaguacuagguccccuucccuccgcaucccgucagcuggaaaaggccuguggcccagaggcu

SEQ ID NO: 86884 - RNA, 64 nt, Human
gggaagaggaaauagaugucugcacuccuggcugcagcuggacaacagaagccccaugccgccu

SEQ ID NO: 86885 - RNA, 64 nt, Human
aguaggcuccagacaggaggagugggacagacagcagcuggacuugaagguuugaugccaaagc

SEQ ID NO: 86886 - RNA, 64 nt, Human
caucccuauccucgucagccccacccuacugccucagcuggacccagggcuuugacacaaaccc

SEQ ID NO: 86887 - RNA, 64 nt, Human
gagaaucccccacacgcucugaaggacccacuuucagcuggacacaggcgcggccucauguaaa

SEQ ID NO: 86888 - RNA, 64 nt, Human
cucaggugcuggauugugggguuaguggcauuuccagcuggauuccuccuguuguaguugccau

SEQ ID NO: 86889 - RNA, 64 nt, Human
auaaucucaugaagcaaaccuaacuauuuaacaucagcuggaaagaagggaacauuuauauugc

SEQ ID NO: 86890 - RNA, 64 nt, Human
gcuggaagucuguaucuugacaauuuuaauaaaucagcuggaacugauagaaacucgcaucgcc

SEQ ID NO: 86891 - RNA, 64 nt, Human
aaggagagcaggagcaauuggcugccugcaaagccagcuggaggugaagugcaggaaaggaaag

SEQ ID NO: 86892 - RNA, 64 nt, Human
ccagacauuuuccuuuuugagccgccugaaaguacagcuggagcccuucccugagaaacucuua

SEQ ID NO: 86893 - RNA, 64 nt, Human
gguggugagcacaucugggaggcuggucucccuccagcuggaauugcugcucucugagggagag

SEQ ID NO: 86894 - RNA, 64 nt, Human
gggugaugaugaccaagaauuacaaguagaauggcagcuggaauuuaaggagggacaagaauca

SEQ ID NO: 86895 - RNA, 64 nt, Human
cugacccgauggagcagccgguaagugaagagcacagcuggaagcagagacaccuuaugacuca

SEQ ID NO: 86896 - RNA, 64 nt, Human
aacuucuguucccugcaaaaugguuagaaagaaacagcuggauuacguuccucuaaaaaccacc

SEQ ID NO: 86897 - RNA, 64 nt, Human
uugcagaaacaucaggauaacacauucuacaaaucagcuggaugccaacuuaaauuuguaacau

SEQ ID NO: 86898 - RNA, 64 nt, Human
uacaaguuagauguuacuauaccuaccauuuauucagcuggauugcugaacacaguucuggauu

SEQ ID NO: 86899 - RNA, 64 nt, Human
gugugaugccuuacaaaagcaccacucagaugggcagcuggacucugguguccugagacucugc

SEQ ID NO: 86900 - RNA, 64 nt, Human
uaucuuuugaccuguggugcaaaagcagaaaauacagcuggauuggguuaugaauauuuacguu

SEQ ID NO: 86901 - RNA, 64 nt, Human
uaagaucguucucugccucacauagcuuacaagccagcuggagaaauaugguacucauuaaaaa

SEQ ID NO: 86902 - RNA, 64 nt, Human
ggaauuacuccugcagaagguugccugccaccaccagcuggaccugagcuugggcaacagcauu

SEQ ID NO: 86903 - RNA, 64 nt, Human
ugucuuggcuggaaauucucugacgucuuggaggcagcuggaauggaaaggagaauucagguua

SEQ ID NO: 86904 - RNA, 64 nt, Human
aacccuauaaauucagugaauauagaagggcuuucagcuggagugcagacaucacuggaacuua

SEQ ID NO: 86905 - RNA, 64 nt, Human
gcucagaaccagcuggcucacgcacuccacuugucagcuggacuucugccuugugaaauggaag

SEQ ID NO: 86906 - RNA, 64 nt, Human
cggaucugucuccuccucuagccagcaguauggacagcuggaccccugaacuuccucuccucuu

SEQ ID NO: 86907 - RNA, 64 nt, Human
cccgagguggucuuuuguuuuaaacagggggcaacagcuggaucuccaaguacauauggauuuu

SEQ ID NO: 86908 - RNA, 64 nt, Human
uuuaaucuacuucuuugacuaccaguggagauuucagcuggacuauguugaugggguuuguugu

SEQ ID NO: 86909 - RNA, 64 nt, Human
acaacccauauuggggacccccugugacuaguagcagcuggaaaauucugguuuuuaucacuug

SEQ ID NO: 86910 - RNA, 64 nt, Human
ccccacccagagaauagcccccuucgauacacaucagcuggauuuucaaaagcuucaaagucuu

SEQ ID NO: 86911 - RNA, 64 nt, Human
agcugggugggggaggucccuccugcccuaagugcagcuggacuguacagaacacuccaagggc

SEQ ID NO: 86912 - RNA, 64 nt, Human
cgaggcuccugcucuccugugccuccgaggcccccagcuggaagugccuuguugccucugcccu

SEQ ID NO: 86913 - RNA, 64 nt, Human
ggcuuucguguuuuugguuuucuccuucccaaggcagcuggauugaaaaaacaaaacaaaacaa

SEQ ID NO: 86914 - RNA, 64 nt, Human
aaccaucagcaugucaguggcauuuaaagccaugcagcuggaggggccacugagauugucucug

SEQ ID NO: 86915 - RNA, 64 nt, Human
agugcggaugcaagagcaccuggccaagcgagagcagcuggauuuuauggagagcaugcuaucc

SEQ ID NO: 86916 - RNA, 64 nt, Human
cugaggcuccgccccagcccucagccccaggccccagcuggagaaaaaacauugcccagggauu

SEQ ID NO: 86917 - RNA, 64 nt, Human
ccuggagaugccaacuucacagacacgucugcagcagcuggacaucacauuucauguccugcau

SEQ ID NO: 86918 - RNA, 64 nt, Human
auaucucuuuaccacugaaguagaauugauuguucagcuggagcccagagaauuuaauuuaaug

SEQ ID NO: 86919 - RNA, 64 nt, Human
cagaaagaggaaucaggcaaguacugucccaaggcagcuggagggugagggcugagugcccugg

SEQ ID NO: 86920 - RNA, 64 nt, Human
acaagcagcaguagcaccacuuggcuagacggaccagcuggaaagaucaugaugguggcccagc

SEQ ID NO: 86921 - RNA, 64 nt, Human
cagcucugucaugcaggccuguccuccccaaccccagcuggaugugccucccaggccugcugug

SEQ ID NO: 86922 - RNA, 64 nt, Human
uugaaucacaguauacgcuccaucgcugucaucucagcuggaucuccauucucucaggcuugcu

SEQ ID NO: 86923 - RNA, 64 nt, Human
agcccgcccucucugguccucccaaaccccaaagcagcuggagagacuuuggggacuuuuuuau

SEQ ID NO: 86924 - RNA, 64 nt, Human
uggggccaggccaggaccacacaguccccagacucagcuggaagucuaccugcuggacagccuc

SEQ ID NO: 86925 - RNA, 64 nt, Human
ggggcugccaguccucucugggccgcagcggacccagcuggaacacaggaaguuggagcaguag

SEQ ID NO: 86926 - RNA, 64 nt, Human
ucaccucuauugccuucuugcacugaggauuuuucagcuggauuucugcaauccaagcuacuca

SEQ ID NO: 86927 - RNA, 64 nt, Human
cucaugauuuuuccuuugugaaaucccugguuuucagcuggaagcgguggguaaaugaggucug

SEQ ID NO: 86928 - RNA, 64 nt, Human
gcggcagagucugagggucccggggcccgguuggcagcuggagaaagaggcaaaaagcccguag

SEQ ID NO: 86929 - RNA, 64 nt, Human
gaccggggagaagccgugugcucuucauuauuuucagcuggaggacagagcucagugccugacu

SEQ ID NO: 86930 - RNA, 64 nt, Human
gaucccaucuagauuucuucuugcuuuugacucacagcuggaaguuagaaaagccucgauuuca

SEQ ID NO: 86931 - RNA, 64 nt, Human
ccuaccucggcaagaucaccagcacugaggggcccagcuggagaaugauucugcuacaaaagga

SEQ ID NO: 86932 - RNA, 64 nt, Human
ccccuaugcugaccucacucuugagcagcgcuuucagcuggaccacucaggccuggacagccuc

SEQ ID NO: 86933 - RNA, 64 nt, Human
aguaaauguuguguugucugucuucauuuuguaacagcuggaccuuccauucuagaauuaugag

SEQ ID NO: 86934 - RNA, 64 nt, Human
cuuguggacagcuuguaguuugccaggauuuuuucagcuggaaagauacgccauccuuucaaac

SEQ ID NO: 86935 - RNA, 64 nt, Human
ugucauaagagcauagauuuuuuguuuuucacaacagcuggaauaaguuccugcauuauaagua

SEQ ID NO: 86936 - RNA, 64 nt, Human
auuuucucaaaagcauuuaucauucuuguugccacagcuggagcucucaaacuaaaagacauuu

SEQ ID NO: 86937 - RNA, 64 nt, Human
uagaaacacaaacuuggaaauugugccagugguccagcuggagcacaacguuuggugaauaugc

SEQ ID NO: 86938 - RNA, 64 nt, Human
ucgccugugccaacaaguugauauuacucaaaaacagcuggaagaagaaauugcuagauuaccc

SEQ ID NO: 86939 - RNA, 64 nt, Human
aggaaaucccugguuuuaaguaucaauccuuguucagcuggacaauaugaaucuuuuccacuga

SEQ ID NO: 86940 - RNA, 64 nt, Human
agcagaccucaaguagaaauugcccaauuuuuaccagcuggagggacacccuuggguuuuugua

SEQ ID NO: 86941 - RNA, 64 nt, Human
augaugugaaacaaagcaggacuaauuugaacuacagcuggacuccguuugugugauggugaua

SEQ ID NO: 86942 - RNA, 64 nt, Human
aggaaggaagccccugggauggagugcagggagccagcuggaagggaaggagaggggccaggga

SEQ ID NO: 86943 - RNA, 64 nt, Human
ggacuguccccuguccccgcaucuccccugggaccagcuggagggccacaugcacacacagccu

SEQ ID NO: 86944 - RNA, 64 nt, Human
cacccuggaugggaagaccuggagggcagccacacagcuggacggaugcugccacaucugggca

SEQ ID NO: 86945 - RNA, 64 nt, Human
ucacccagucgcacccuggaggggacaucagccccagcuggacuugggcccccacugucccucc

SEQ ID NO: 86946 - RNA, 64 nt, Human
cacuuccccuuuucccaguauuacugaauagucccagcuggagaguccaggcccugggaauggg

SEQ ID NO: 86947 - RNA, 64 nt, Human
gccuguucccugcccuucucugugcucuuagacccagcuggagccagcacccucuggcugcugg

SEQ ID NO: 86948 - RNA, 64 nt, Human
cagcaggcaccaccuccauaucccggcccacauccagcuggacccccugucauacagcagccaa

SEQ ID NO: 86949 - RNA, 64 nt, Human
ucagagacccaaauuauauuuuuuaaaaauuuaacagcuggaaacuuggacuagagcuuuaaua

SEQ ID NO: 86950 - RNA, 64 nt, Human
cagcaguggcuccucucugccuuugagcccugcacagcuggacccauccuaagugccagugagu

SEQ ID NO: 86951 - RNA, 64 nt, Human
cccaggauuuaaacagaaacuacuucuaugauuucagcuggagucugaagauacuuguuucugu

SEQ ID NO: 86952 - RNA, 64 nt, Human
aggguuuuuggucacucacaaccugaauucaccacagcuggaauagcuguggaaaacaaaauaa

SEQ ID NO: 86953 - RNA, 64 nt, Human
gauagaacaagggaauaaccgcgaaugcucugugcagcuggacucuguuuccggaaaguaaaug

SEQ ID NO: 86954 - RNA, 64 nt, Human
cucuuuuuaucucccccuugcccucauucuugaacagcuggaggaauacauuuuauucugucca

SEQ ID NO: 86955 - RNA, 64 nt, Human
gccccugucugcagacagcgccgcuggaugcucccagcuggacuucaaccccacuccucucagu

SEQ ID NO: 86956 - RNA, 64 nt, Human
aacacugccauucacaagucaaggaacccagggccagcuggaaguguggagcacacaugcugug

SEQ ID NO: 86957 - RNA, 64 nt, Human
gaucucagguacagcuccaggggcaggcagugcccagcuggaccugguggcccuuuccuagugc

SEQ ID NO: 86958 - RNA, 64 nt, Human
agacaaauuaaaggaggggcuaggggagaagcugcagcuggagcugaaggcucgaucuugugaa

SEQ ID NO: 86959 - RNA, 64 nt, Human
gaaaaugaaaaagagaacagcagcuuucuagggacagcuggaaaggacuuaauguguuugacua

SEQ ID NO: 86960 - RNA, 64 nt, Human
uuuagcagagaauauuuuaauaaaugcaaaacaacagcuggacugcuguacaucaaggacagau

SEQ ID NO: 86961 - RNA, 64 nt, Human
uuggaaucccacuuaucaaaucauucaaaacuuucagcuggagugggguuugcuuuuguuuugu

SEQ ID NO: 86962 - RNA, 64 nt, Human
gaaguccuggcacaguuuuuguaaagcccuugcacagcuggagaaauggcaucauuauaagcua

SEQ ID NO: 86963 - RNA, 64 nt, Human
ggaaugggggugaguggagggcuccgacucagggcagcuggaaaucuucucgcuccagcaagcu

SEQ ID NO: 86964 - RNA, 64 nt, Human
uuugugugugagggcaggucuugacucuaggucucagcuggaaccccacccuuucuccuccucc

SEQ ID NO: 86965 - RNA, 64 nt, Human
accucucaguacuugagacuuaaagugcuacaggcagcuggaucuguuugcaugcaggaugaag

SEQ ID NO: 86966 - RNA, 64 nt, Human
aggccccaccuccuccuccauacguucagaggugcagcuggaggcugcuguggggaccacacug

SEQ ID NO: 86967 - RNA, 64 nt, Human
cccagaggacuuuauucggaccaagcagagcucacagcuggacagguguuguauauagagugga

SEQ ID NO: 86968 - RNA, 64 nt, Human
agcagcauccugaccacagcuggcagucaagccacagcuggagggucagccaccaagcugggag

SEQ ID NO: 86969 - RNA, 64 nt, Human
acuagaagccacuugcacgguguggccagagccucagcuggaugagaggcugagauggguggcc

SEQ ID NO: 86970 - RNA, 64 nt, Human
ccacaguggggaagaaaacuuaaacccugugccucagcuggacauuggaaccuuggagaauguc

SEQ ID NO: 86971 - RNA, 64 nt, Human
ugguaaagcugcguccuggcgauuccaggagacccagcuggaaaccuggcuucuccaugugagg

SEQ ID NO: 86972 - RNA, 64 nt, Human
ggcagagccgaggcuuagggucuggcaccccccacagcuggagacggaggcucuccuggggcug

SEQ ID NO: 86973 - RNA, 64 nt, Human
auuuuuucagucauauaaaagcuauggugagaugcagcuggaaaagggucuugggaaauaugaa

SEQ ID NO: 86974 - RNA, 64 nt, Human
cuguaaauaacuuuuuuugagaaggaaauaaaaucagcuggaacugaacccuaaaucuugacuu

SEQ ID NO: 86975 - RNA, 64 nt, Human
ggguccccugaaugcugcaucauuguguucagugcagcuggacugauugcaccuguguauuugc

SEQ ID NO: 86976 - RNA, 64 nt, Human
gcggcuucccagcaccugggaggggcugcagccccagcuggacuccagccugucccucuuagca

SEQ ID NO: 86977 - RNA, 64 nt, Human
gggaaugggggcccugcucaagaagggggccaggcagcuggaaucaggggagugcaucauccuc

SEQ ID NO: 86978 - RNA, 64 nt, Human
guagaacgggaggcugcugaagugaguagcugagcagcuggagccaucccaagcaucagugucu

SEQ ID NO: 86979 - RNA, 64 nt, Human
uggggaagcugccgcccacgggcucugccccuuccagcuggagccgcccgugccuccaggggcc

SEQ ID NO: 86980 - RNA, 64 nt, Human
ucugcagaggggcuacgaaccaggugcagggucccagcuggagaccccuuugaccuugagcagu

SEQ ID NO: 86981 - RNA, 64 nt, Human
ccgguuccauuuuuuuuuuuuccagacaaucacucagcuggaaugucugcucucuauuggugcc

SEQ ID NO: 86982 - RNA, 64 nt, Human
uuuuguuaugaggagcugcagauuagcuaggggacagcuggaauuaugcuggcuucugauaauu

SEQ ID NO: 86983 - RNA, 64 nt, Human
gccugucagaguuuucaacggugcuuauagcugccagcuggauuccaaacagguaccacauugu

SEQ ID NO: 86984 - RNA, 64 nt, Human
uuagagguuucuagcaugcgcccgggguugacaacagcuggacaaacuugaaaagucaauucau

SEQ ID NO: 86985 - RNA, 64 nt, Human
accuaaggaagauauugacgucucuauucugccccagcuggagcauugcagcuccaggaagaug

SEQ ID NO: 86986 - RNA, 64 nt, Human
uauuguauaucccacugcacugagagggcucaaucagcuggauuugaguucuggaacacacauc

SEQ ID NO: 86987 - RNA, 64 nt, Human
ccuucccaccuggacagugguguguguagaaagccagcuggauguuugugguggggccucaugg

SEQ ID NO: 86988 - RNA, 64 nt, Human
gugccaccacguggcccugagccacauccaggugcagcuggagcuggacagcacacgccaugcc

SEQ ID NO: 86989 - RNA, 64 nt, Human
ugacaaucaguuccauggacauggugaccacagccagcuggaaccugaagucuaaacaccauuc

SEQ ID NO: 86990 - RNA, 64 nt, Human
auugaguuuagaugccuacuuuuaugaguaccaucagcuggacacagugucucauaccuguauu

SEQ ID NO: 86991 - RNA, 64 nt, Human
aaggguaugaucaaucauuuucuucugcuccaaacagcuggaguaaaauucaugggaaauggcc

SEQ ID NO: 86992 - RNA, 64 nt, Human
agcucuguggcuucccacccaaaccuucucaguccagcuggaggcuggagggagacacaggccc

SEQ ID NO: 86993 - RNA, 64 nt, Human
gaugccugugccaaggccaggggcagccagagggcagcuggauggccacgugcaggggucaagg

SEQ ID NO: 86994 - RNA, 64 nt, Human
ggaccuaaccauugcuucacuuacacuucacccacagcuggaguucauucaacucuugcuuuuc

SEQ ID NO: 86995 - RNA, 64 nt, Human
auuuuacaguugacucucaugagcugauuggagucagcuggaacauaccacugccucuagacua

SEQ ID NO: 86996 - RNA, 64 nt, Human
agcggcagcaucggaugucagcccccugcggccccagcuggagauggauaugagacuagucaag

SEQ ID NO: 86997 - RNA, 64 nt, Human
gugcugugaccuccgagcccuccuggugggaagacagcuggaaaggcugggaggagaagggagg

SEQ ID NO: 86998 - RNA, 64 nt, Human
cagaggcuucaggugcuuuguguagaguccagggcagcuggagcuuuguuggggagacuucugg

SEQ ID NO: 86999 - RNA, 64 nt, Human
caugcaccuggccggccaccugccacugggcccacagcuggagcagcuggacagagguuucugg

SEQ ID NO: 87000 - RNA, 64 nt, Human
ggccggccaccugccacugggcccacagcuggagcagcuggacagagguuucugggagaccuac

SEQ ID NO: 87001 - RNA, 53 nt, Human
ccuuucucaguggacagugacagcagcuggagccagcuccgagcagcccgggg

SEQ ID NO: 87002 - RNA, 64 nt, Human
aggauuuccaauuuccaagccugaugggaucucccagcuggaacaggaucuacaggucuuugau

SEQ ID NO: 87003 - RNA, 64 nt, Human
gaaugugaucucuuugcagagcuauagauagaaacagcuggaaaacuaaaggaaaaauacaagu

SEQ ID NO: 87004 - RNA, 64 nt, Human
gcuuacuuuuagugacuuuauguacuuauauuaacagcuggaaauagguuguuggguuuugagc

SEQ ID NO: 87005 - RNA, 64 nt, Human
cacuuucccauguauugauacuggucccacuucacagcuggagacaccggaguaugugcagugu

SEQ ID NO: 87006 - RNA, 64 nt, Human
cuagagcagugucacaagcuucaguaaggccagucagcuggaagucagucuaccguauaguaac

SEQ ID NO: 87007 - RNA, 64 nt, Human
uggucucccaugcccaagggaugccauguagccccagcuggaagugacuuccgcaggaauugag

SEQ ID NO: 87008 - RNA, 64 nt, Human
gaggggccaaagcagggacaguggccccucccugcagcuggaaccagcaucucugauuuaugcc

SEQ ID NO: 87009 - RNA, 64 nt, Human
gaaauacuaguucuauuuaaugugguuauggaaccagcuggaaacacaaaacaaacagugauug

SEQ ID NO: 87010 - RNA, 58 nt, Human
gugcccuugggggcaggugaugggagcacagcuggaacaaugugcucggcccccagug

SEQ ID NO: 87011 - RNA, 64 nt, Human
ggaggggugggggcaucuggucucagaaauggaccagcuggaugcagggcaggggacugagggu

SEQ ID NO: 87012 - RNA, 64 nt, Human
cugccucccguacccggccugcggagggaggggacagcuggacccgcaggggaggucccuuucu

SEQ ID NO: 87013 - RNA, 64 nt, Human
cccucaaccugccuuagcugcacucucuuaccuacagcuggacaguaccugucuguuuccuguc

SEQ ID NO: 87014 - RNA, 64 nt, Human
guuuuuucugugguugccgcauuuauuccaccuccagcuggaccccccacugcaaauagagaac

SEQ ID NO: 87015 - RNA, 64 nt, Human
ggcauuggugguuaggccgguuggcugucuugaacagcuggagggaagaugcaggggugggaag

SEQ ID NO: 87016 - RNA, 64 nt, Human
cuaugaguucuucaaguacuuucucaccaagcgccagcuggaaaaucgagcuccauacuaaagg

SEQ ID NO: 87017 - RNA, 64 nt, Human
cccaccccuaccccuggcuguacugcucaggcugcagcuggacagaggggacucugggcuaugg

SEQ ID NO: 87018 - RNA, 64 nt, Human
ccacaauggcccgagcccucuuugcaugggcagccagcuggacuaggagugggaagggccugga

SEQ ID NO: 87019 - RNA, 64 nt, Human
aacugcccccagauguuccugggcuggguaaaagcagcuggagugaagcacucauuuuccauaa

SEQ ID NO: 87020 - RNA, 64 nt, Human
ccaucaucaauuccacuuacuauuguaauaccuucagcuggagccugugucuuucuccauuccu

SEQ ID NO: 87021 - RNA, 64 nt, Human
aagccaaaaacucucaagaaagcaaauugcaccucagcuggauugauuuccaaaugcuagcaug

SEQ ID NO: 87022 - RNA, 64 nt, Human
cccacagaugggcagucucagccauacucuguuccagcuggaguagccuccugaccagccuggc

SEQ ID NO: 87023 - RNA, 64 nt, Human
agccagccagacucaccugcccuucccgugcccacagcuggagcagggccagagccuugggccg

SEQ ID NO: 87024 - RNA, 64 nt, Human
gaggucgcccugccucacuggcacccugggggcacagcuggaagagaggccuggcccaugcucc

SEQ ID NO: 87025 - RNA, 64 nt, Human
gucuacuugaucuggagggcauugacaccuggcucagcuggaacaguggggacaggaggaggca

SEQ ID NO: 87026 - RNA, 64 nt, Human
acugcccugcccaaaugaacugccacagcagggacagcuggaccgcagaguuuauuuuuguauu

SEQ ID NO: 87027 - RNA, 64 nt, Human
ggccuuggcuucccugagcccgcacuccaaccagcagcuggauuccugggaacuggaggaucag

SEQ ID NO: 87028 - RNA, 64 nt, Human
gacuuucucagaggugacagagaugauggaugagcagcuggauuuucgugaugaaggacggaag

SEQ ID NO: 87029 - RNA, 64 nt, Human
uccuguagcacgcugccugccaaaguaguccuggcagcuggaccaucucuguaggaucguaaaa

SEQ ID NO: 87030 - RNA, 64 nt, Human
gucaggccaggcccguggguaggucccuggcucccagcuggagauaggaggcccagguggcagg

SEQ ID NO: 87031 - RNA, 64 nt, Human
cuugccaggcuugucaaauagcaaggccagggcacagcuggagacgaucuugcuggcagggccu

SEQ ID NO: 87032 - RNA, 64 nt, Human
ccccaggucccggaggggaagugaagcaacagcccagcuggaagggcgucuucugcggagaaau

SEQ ID NO: 87033 - RNA, 64 nt, Human
ccucccugucucuccgccagcucugagucccaggcagcuggacaucuccaggaaaccaggccau

SEQ ID NO: 87034 - RNA, 64 nt, Human
ugaucccacaggagcaccucaagccaugaagugucagcuggagaacaguggugggcauggagag

SEQ ID NO: 87035 - RNA, 64 nt, Human
ccaggcaggacaguagaucccuaugguuggaucucagcuggaaguucuguuuggagcccauuuc

SEQ ID NO: 87036 - RNA, 64 nt, Human
aacuucuguucgcugcaaaaugguuagaaagaaacagcuggauuacguuccucuaaaaaccacc

SEQ ID NO: 87037 - RNA, 64 nt, Human
uaccaaugugcaccaauaugccuaacuagcuagccagcuggagauaauuuaccagggaauguuu

SEQ ID NO: 87038 - RNA, 64 nt, Human
gcaccagcuuggaggcccccuagaccagcucuuccagcuggauggagcacacacaggccuccag

SEQ ID NO: 87039 - RNA, 57 nt, Human
cagcugcauggcgcuccuaggcggucccagcuggaauuacccaaccccaugacggac

SEQ ID NO: 87040 - RNA, 64 nt, Human
agggcgagcugcaggaaucaccccucugccccugcagcuggaaugugccacagaggccccaccu

SEQ ID NO: 87041 - RNA, 64 nt, Human
gcacaggcugugagccagggugcugggaaacucacagcuggacucaggggacacggccuguggc

SEQ ID NO: 87042 - RNA, 64 nt, Human
gcucugcggugcgguccacgggagagcaggccuccagcuggaaaggccaggccuggagcuugcc

SEQ ID NO: 87043 - RNA, 64 nt, Human
uuuagcaagauggcagcaguccagcuguucuuugcagcuggagaugaacuuuuaaaaauccccu

SEQ ID NO: 87044 - RNA, 64 nt, Human
ucuuuuauggaaacgaucuguggcuguuuagaggcagcuggauccucuuucaggcgggaauggg

SEQ ID NO: 87045 - RNA, 64 nt, Human
ucugccuccuccuggccaggccugcgagaagacccagcuggaguucaugucgcaacagugcgcc

SEQ ID NO: 87046 - RNA, 64 nt, Human
gggccacagacgucggaagaaacucccguauuugcagcuggaacugcagcccacggcgccccgg

SEQ ID NO: 87047 - RNA, 64 nt, Human
aaccgcuccccggccugacagacccagggagcugcagcuggagcccguucccgugcguguuagu

SEQ ID NO: 87048 - RNA, 64 nt, Human
ccagcagugcugccuucagcggccgugacggggccagcuggacacacggugagauuuucucgua

SEQ ID NO: 87049 - RNA, 64 nt, Human
uguauugguuaaaaauuauuuuccauugcagaagcagcuggacuaugcaaaaaguauuucucug

SEQ ID NO: 87050 - RNA, 64 nt, Human
ucucaguacuuuuuucccgaucacccugugggaccagcuggaccugaggcugcagucuucucuc

SEQ ID NO: 87051 - RNA, 64 nt, Human
aaaaaacuagacaaggagagaggcacuagaacuccagcuggaagucacggaguggcucgagcag

SEQ ID NO: 87052 - RNA, 64 nt, Human
guucaggagcugugccaagcacuuuccucuuuuacagcuggagaucacuggaaaggugucucag

SEQ ID NO: 87053 - RNA, 64 nt, Human
guggaggcaguggagacugacuucuuccugcugacagcuggaugucacacaugaaggucuggcc

SEQ ID NO: 87054 - RNA, 64 nt, Human
gcugcggggcucuuguuggccgcacguggcagugcagcuggagaggaagccuggggcacguccu

SEQ ID NO: 87055 - RNA, 64 nt, Human
ggaaaagauccaggcccuccacuucuccuugaggcagcuggagagcuaucccccgccccucaag

SEQ ID NO: 87056 - RNA, 64 nt, Human
cuggcgucugacccuucagugcaggccagccuggcagcuggaagccucccccacgccgaggcuu

SEQ ID NO: 87057 - RNA, 64 nt, Human
gggacggaguccaaggcguuauugggccaccugacagcuggacagaaaaggggcagacacaccg

SEQ ID NO: 87058 - RNA, 64 nt, Human
agacacaggccccugguguccccugcagggggcucagcuggacccuccccgggcucgagggcag

SEQ ID NO: 87059 - RNA, 64 nt, Human
cuugagauuaaguucagcagguuaaagaugguugcagcuggagggggcggaaaaaggccaaaac

SEQ ID NO: 87060 - RNA, 64 nt, Human
caugaaacaaaggcuuaggggccaacaaggcuuccagcuggauguguguguagcauguaccuua

SEQ ID NO: 87061 - RNA, 64 nt, Human
uauuaagaucugguagagguaccagcuuccuuuccagcuggagaggccccaacacuggaugguu

SEQ ID NO: 87062 - RNA, 64 nt, Human
ccaggcccgggguuguuggggagagaggcagaggcagcuggagcgccguucucuccugcuggga

SEQ ID NO: 87063 - RNA, 64 nt, Human
cuagguaggcuuccccuuccuuccucacucucuccagcuggauucuggagcuguucuccaucca

SEQ ID NO: 87064 - RNA, 64 nt, Human
gauaaggguuccagcagccuggggcaguaugucucagcuggaauggaaagaaugugagauggaa

SEQ ID NO: 87065 - RNA, 64 nt, Human
uaaagcgucuguggcgauuggugaacagcauaaacagcuggaccucagcaagggucaggcaaac

SEQ ID NO: 87066 - RNA, 64 nt, Human
cucugagccccauccaagggcaagacuuggugcccagcuggaaggacgaaagcacacuuuguga

SEQ ID NO: 87067 - RNA, 64 nt, Human
ggacagggaaccugccgggcucacagugugggagcagcuggacaccaggcuucuuggugaaccg

SEQ ID NO: 87068 - RNA, 64 nt, Human
ugacagaagccugggcgaggcccucggagggcagcagcuggacaggggcuacuggguuuggccu

SEQ ID NO: 87069 - RNA, 64 nt, Human
acuuguagugagccaagaucacgccacugcacuccagcuggagugacagagccaaacuccguca

SEQ ID NO: 87070 - RNA, 64 nt, Human
caggcuccccggggccuuccuauuauguaaaucccagcuggacagacagcccuggagccaggug

SEQ ID NO: 87071 - RNA, 64 nt, Human
guugaucgccuuucccaggugcuacacccuuuuccagcuggaugagaauuugagugcucugauc

SEQ ID NO: 87072 - RNA, 64 nt, Human
cagcaaaggggccugcugagcucugguuagguuacagcuggagguguguauauauacacacaca

SEQ ID NO: 87073 - RNA, 64 nt, Human
ucuguaucucuggagcagccaggcgcucuggagccagcuggagagagagagauccugauaccuc

SEQ ID NO: 87074 - RNA, 64 nt, Human
cugcacagaaguucugggccugacagguagauuccagcuggaaggcaggcccgugccugguuuu

SEQ ID NO: 87075 - RNA, 64 nt, Human
aggauuggagucuaccuaucucuuccauuugucccagcuggaguucuggaacuuuccuccucgg

SEQ ID NO: 87076 - RNA, 64 nt, Human
caccacaaagcaggagaaagggaacauuuuucuacagcuggaaagugaguccuauccuuugagg

SEQ ID NO: 87077 - RNA, 64 nt, Human
gucaagagugaauucccucacucgucucccccaacagcuggacccugaccagcucccccucccu

SEQ ID NO: 87078 - RNA, 64 nt, Human
ccucucauuuagccuguccugucaucaucauggccagcuggaggcaggggcuuccuggugcugg

SEQ ID NO: 87079 - RNA, 64 nt, Human
ccugcauccaggagaugcuguguuccccgugaugcagcuggaacccaagcugcagcaggagaug

SEQ ID NO: 87080 - RNA, 64 nt, Human
auucaggacagagacucucacaaaguucagaaaacagcuggacuuaccaguaaaaucaaaugag

SEQ ID NO: 87081 - RNA, 64 nt, Human
gaccucaaagaugcccccuguccaagccaucccacagcuggaagguaggggaugggggugccca

SEQ ID NO: 87082 - RNA, 64 nt, Human
ugggcccccuacuccauuucccagcaaaaggcuccagcuggagggauggguuguggggcaaccu

SEQ ID NO: 87083 - RNA, 64 nt, Human
ggguagccagcuguuuucaguggucccugggagccagcuggagacaggugguccuguaaaagcu

SEQ ID NO: 87084 - RNA, 64 nt, Human
gugcuuagucuuugccuuuguagcauuuacaguacagcuggagacccaugaugauuacauauaa

SEQ ID NO: 87085 - RNA, 64 nt, Human
cuuuuuucuaagacagagucucacucugucgcgccagcuggagugcagugccaugaucucaggu

SEQ ID NO: 87086 - RNA, 64 nt, Human
aggauuuauuguucauacuuggcggugaggagggcagcuggagaucuuaagauuccauuuugga

SEQ ID NO: 87087 - RNA, 64 nt, Human
caggcugccaggagcgggggcggcgggggcgggccagcuggacgggcugccggccgcugcgccg

SEQ ID NO: 87088 - RNA, 64 nt, Human
gggccggcuggcgcggcuggagcuggagcgggcacagcuggagaugcagagccagcagcugcgc

SEQ ID NO: 87089 - RNA, 64 nt, Human
gaugcagagccagcagcugcgcgaguccaaccagcagcuggaccugagcgccugccggcugacc

SEQ ID NO: 87090 - RNA, 64 nt, Human
ccacucagcucugucugaugcccucuccauagcccagcuggagccgugaacacugggguccccu

SEQ ID NO: 87091 - RNA, 64 nt, Human
gcagaccgccaccacucaggggcucuggaggggucagcuggagcccaccaagcugucacugcug

SEQ ID NO: 87092 - RNA, 64 nt, Human
aguggcugagacugugagcugggagcaguucucucagcuggagagacucgggaugggguaaccu

SEQ ID NO: 87093 - RNA, 64 nt, Human
gagcuccugaacccacuugaaguccugucuuuuccagcuggagcagcugggcaugaguguccca

SEQ ID NO: 87094 - RNA, 64 nt, Human
guuccaaagacucagacuaacauacaggacaguccagcuggaugugauaaagauuuuaucaccu

SEQ ID NO: 87095 - RNA, 64 nt, Human
uuuuuuuuugagacggagucuugcacuguagccccagcuggacugcaguggcgugaucuuggcu

SEQ ID NO: 87096 - RNA, 64 nt, Human
ccagucucuaccugucaggaugacuccaggaagacagcuggaguacugcauuuguguuuagggu

SEQ ID NO: 87097 - RNA, 64 nt, Human
cuauaagcaguccuugauggguuuuugauugcaucagcuggaaagccucaaaucuaagagggcu

SEQ ID NO: 87098 - RNA, 64 nt, Human
gccgagaugcggagggcgcagaugucccacugcacagcuggaaugaauggaguucauccccucc

SEQ ID NO: 87099 - RNA, 64 nt, Human
gagcuccugaacccacuugcaguccugucuuuuccagcuggagcagcugggcauaagcguccca

SEQ ID NO: 87100 - RNA, 62 nt, Human
gucucagugaccucuacugacuucucugauaccagcuggagguugagcucuucuuaaaguau

SEQ ID NO: 87101 - RNA, 64 nt, Human
ugcaaagauuggaccauguuacaugaaauagugccagcuggagguucuuugccagcaccaugcc

SEQ ID NO: 87102 - RNA, 64 nt, Human
uugcugggcucuccagagcugggcuuggcucuuccagcuggagaaggacugagccccaguaacc

SEQ ID NO: 87103 - RNA, 64 nt, Human
gccggggcugcaccagggacccaugggggcugcccagcuggacagauggcuuccugcuccccag

SEQ ID NO: 87104 - RNA, 64 nt, Human
ggccaggaaggccgggccguggagguccuguccacagcuggacaggagagacaccgccugcggu

SEQ ID NO: 87105 - RNA, 64 nt, Human
cccaggagcgggccugagccacguccucuaggagcagcuggagauggccaaaagagugagcuca

SEQ ID NO: 87106 - RNA, 64 nt, Human
uaaugacuuugaacugugcuguaaauaaauaauacagcuggaccuuauaccuguguguugcuuc

SEQ ID NO: 87107 - RNA, 64 nt, Human
accugaagagggauggaaccucugggucaggaaacagcuggaauccacacucaccucauuccca

SEQ ID NO: 87108 - RNA, 64 nt, Human
gccaagagggugcugcucaguugcagggccuccgcagcuggacagagagugggggagggaggga

SEQ ID NO: 87109 - RNA, 64 nt, Human
uuugaagcauguuaauaaaugucacugauuaaaacagcuggagcauuuccuucccuuuccagug

SEQ ID NO: 87110 - RNA, 64 nt, Human
accucaagaucauggcaggcagcaagugaagccccagcuggacucauggaugugcacccuuugc

SEQ ID NO: 87111 - RNA, 64 nt, Human
gucagagaagaacucucauggcugcuggagguaccagcuggacaagguguuuggggcaugcugc

SEQ ID NO: 87112 - RNA, 64 nt, Human
gaacagauccagggcaacguccaggccaaugugccagcuggaggccaggcccaggugcgugccu

SEQ ID NO: 87113 - RNA, 64 nt, Human
auauauaauugucaguccaaaugaauaugugaaacagcuggaauuguacaaauuuugguuguau

SEQ ID NO: 87114 - RNA, 64 nt, Human
uugagagagggaaagcaaaaugaauggaaguacccagcuggagguuucagggcuucuggaggau

SEQ ID NO: 87115 - RNA, 64 nt, Human
ggguaguuuguaauuucauuuaaauucuuuucagcagcuggaaauauugcacuaucugaaacac

SEQ ID NO: 87116 - RNA, 64 nt, Human
cagacuuuucaaccugcugccggauuucuccauucagcuggaugauccucaggacugaccaguu

SEQ ID NO: 87117 - RNA, 64 nt, Human
gacuugggucucagugcuaggguauugagucaggcagcuggaggguuguggcccgaggcugcag

SEQ ID NO: 87118 - RNA, 64 nt, Human
uuccuauucucaggcuguucugacucugagccaacagcuggaccgugucucauccccagaacau

SEQ ID NO: 87119 - RNA, 64 nt, Human
cgcugccuucacuccuggagugaguuuccauuuccagcuggaaucugcagccacccccauuucc

SEQ ID NO: 87120 - RNA, 64 nt, Human
cugcugggaaccucuggagagccacaggcacccccagcuggaggccagacuccucucuugugcu

SEQ ID NO: 87121 - RNA, 64 nt, Human
uaaggcaggggcgagcacggaacaauggggccuucagcuggagcuguggacuuuuguacauaca

SEQ ID NO: 87122 - RNA, 64 nt, Human
agcuggaggcuacgcauggccucugcagcacacgcagcuggagagggcuucugucccugucagc

SEQ ID NO: 87123 - RNA, 64 nt, Human
cuaacuggcccaggcacuggaguggaauagaaugcagcuggaggcuacgcauggccucugcagc

SEQ ID NO: 87124 - RNA, 64 nt, Human
ucauuaauuuucauagugccuuuuucacaugagucagcuggaaagucugcaauaaacaguauuu

SEQ ID NO: 87125 - RNA, 64 nt, Human
uucagucccacauuucuguacuguuccucuuucacagcuggaauaugucacaugaugaaguugu

SEQ ID NO: 87126 - RNA, 64 nt, Human
aggcucucauucagccuaucuugcgaggcccgggcagcuggaaaguccuccuccagcuccaccu

SEQ ID NO: 87127 - RNA, 64 nt, Human
augaaauuaagagugaacuucuuaugggaggcugcagcuggaucagaggaaaaauccaguguga

SEQ ID NO: 87128 - RNA, 64 nt, Human
aggaacgauccgaccaccucacaggccugcccugcagcuggaagacucggcgcucuaaggccug

SEQ ID NO: 87129 - RNA, 64 nt, Human
uuuauuuuuugagauggagucuugcucuguugcccagcuggagugcaguggugugaucucagcu

SEQ ID NO: 87130 - RNA, 53 nt, Human
gggccaaccccaguuggugaucccagcuggagggagaacccaaagagacagcu

SEQ ID NO: 87131 - RNA, 64 nt, Human
uuuuuuuugagacggaguuucgcucuugucaccccagcuggagugcaguagcacgaucuuggcu

SEQ ID NO: 87132 - RNA, 64 nt, Human
cuuagcacuccuuucuccuugugagaucucuccucagcuggaaugaggaauguaguccaucuaa

SEQ ID NO: 87133 - RNA, 64 nt, Human
gcucugcucucaggaagcgacgugaccccugccccagcuggaaccuggcagaggccuuaggacc

SEQ ID NO: 87134 - RNA, 64 nt, Human
guuaugcacuuaauuuuaugacugccgggggggucagcuggagugcugcuuaacaaguaucucu

SEQ ID NO: 87135 - RNA, 64 nt, Human
caaggaggccagccuggcccugagcugcuggauacagcuggaccugaauuccugaugcccaugu

SEQ ID NO: 87136 - RNA, 64 nt, Human
uuugagguucugagaaggucaagggcagccccagcagcuggauucucaggcugggccccucacc

SEQ ID NO: 87137 - RNA, 64 nt, Human
uccagcccaggcuagaagcccccauggcuucuggcagcuggacaucagccccagguauuggggu

SEQ ID NO: 87138 - RNA, 64 nt, Human
ugaagaccagcaggggcuuccuaaaaagcagcagcagcuggaauuccaaggccaaguccugcag

SEQ ID NO: 87139 - RNA, 64 nt, Human
acuguugcuaugacaacagggagaaccccaucuccagcuggaacgugaagguaauggcuccucu

SEQ ID NO: 87140 - RNA, 64 nt, Human
uagggaaguuucaggguacgcugguuccccucuccagcuggaggccgaguuucuggggacugca

SEQ ID NO: 87141 - RNA, 64 nt, Human
acugcagcccuuguccuucaccuccacacaggaccagcuggaagcagaaagaagaaaggccaau

SEQ ID NO: 87142 - RNA, 64 nt, Human
cuuccuuugucuucuguccaccaggccuucucuccagcuggacacaaaccuccuuugaagggaa

SEQ ID NO: 87143 - RNA, 64 nt, Human
gacaucuucuuccuucuuugucuucauuuuuauccagcuggagauuauccgucuuguucuuuuu

SEQ ID NO: 87144 - RNA, 64 nt, Human
gcuuaucaggccuacgauccuucugauuuaaguacagcuggaaaguauuaucuaauuaaguuca

SEQ ID NO: 87145 - RNA, 64 nt, Human
aggguaucauugauuuaugauggaaaaccggccucagcuggagaugacugugauguugcugaug

SEQ ID NO: 87146 - RNA, 64 nt, Human
acugccuccugcaccuucagcacaucccugugcacagcuggaagggugcauggcccgcucaccu

SEQ ID NO: 87147 - RNA, 64 nt, Human
aaauguccuucagccucccuaccacgacauccaacagcuggaacuuccauccaguccuucacau

SEQ ID NO: 87148 - RNA, 64 nt, Human
aguguuggcuucucaauagaguguuguugcugaccagcuggagugagggccucagagccugacc

SEQ ID NO: 87149 - RNA, 64 nt, Human
aaaagcacugcaagaaaauaggguagaauuguuacagcuggacuuguaaaaauaugucuuuuua

SEQ ID NO: 87150 - RNA, 64 nt, Human
gcugccccccugcagcacugugcaggacguggaccagcuggagcugcugcccagcacagaggag

SEQ ID NO: 87151 - RNA, 64 nt, Human
ccagugcuccuuuggcuucauauaugagcgugagcagcuggaggcaacuuguccccagugucac

SEQ ID NO: 87152 - RNA, 64 nt, Human
gaaagagauuagagauaauugucuaguuagggggcagcuggagaaaauaagcuaaguuugcaau

SEQ ID NO: 87153 - RNA, 64 nt, Human
agcaugaucgaacugaaggaucucugaaaggccacagcuggagcaauuugaguaacaaaauaaa

SEQ ID NO: 87154 - RNA, 64 nt, Human
acaggaugaaugagguggguauggacaguggaggcagcuggaauggcaagugcagaaaauagga

SEQ ID NO: 87155 - RNA, 64 nt, Human
uuccaagcagggacccugguuuccauacugcccucagcuggaguuuggauccaaaggcucuggc

SEQ ID NO: 87156 - RNA, 64 nt, Human
uucugccuagcccuggcggaggugcaggcccugucagcuggaacuggacagaccuugguuuguu

SEQ ID NO: 87157 - RNA, 64 nt, Human
acaggcucaagcaauucuguccccaucaaggggucagcuggagagacccaagacccuaucuguu

SEQ ID NO: 87158 - RNA, 64 nt, Human
cucgccccuugacuggcuaaguggggcccggccccagcuggaucgaagggcggguugcaguccc

SEQ ID NO: 87159 - RNA, 64 nt, Human
aucuguacuuuaggguagaauucaauauuuucugcagcuggaaacagcuagucuaucucuugcc

SEQ ID NO: 87160 - RNA, 64 nt, Human
ugguuugaauauguccauaagcccagcacagaaacagcuggauucuucuacguuuaauuguaga

SEQ ID NO: 87161 - RNA, 64 nt, Human
acacauggauuuugauauguaaauauugcauguccagcuggauucuggccugccaaagaagaug

SEQ ID NO: 87162 - RNA, 64 nt, Human
cagauucacugcccgcugugugccaguacucaggcagcuggagagaagagaaggcagcagcaga

SEQ ID NO: 87163 - RNA, 64 nt, Human
uucugcugcucaccaggacccagcucugggagugcagcuggaauggaacccagcauuggagaga

SEQ ID NO: 87164 - RNA, 64 nt, Human
aggugcccagcuauaccugugccucggcuuuucucagcuggaugauggucuucagccucuuucu

SEQ ID NO: 87165 - RNA, 64 nt, Human
aauauguaauuuguguauuagugagaggugaagccagcuggacuuccugggucgaguggggccu

SEQ ID NO: 87166 - RNA, 64 nt, Human
cuccaaaccuagugguguagggagcaagagaaugcagcuggaaggcacaaggggaggacauugu

SEQ ID NO: 87167 - RNA, 64 nt, Human
agguucaucccucaguuggggggaacguaggacccagcuggagccucuugagggagaugagagg

SEQ ID NO: 87168 - RNA, 64 nt, Human
ucuaggggcacauccagucuccaucgugcugcagcagcuggacugagggcagagccuguaggug

SEQ ID NO: 87169 - RNA, 64 nt, Human
ucaguucccuccugugucaaguagcuaacugcagcagcuggacugagggcagagucugugggug

SEQ ID NO: 87170 - RNA, 64 nt, Human
gggacaugcugggcaguugucagauguaaaggcacagcuggagcagagggcaugucaguaauga

SEQ ID NO: 87171 - RNA, 64 nt, Human
aaugggcaagcagagugcacagcccucguucugccagcuggagccaagaagcacagagacacag

SEQ ID NO: 87172 - RNA, 64 nt, Human
ugccuccuuacacaguggccuuugcuugcaccuccagcuggagaugggugugccccagaaguaa

SEQ ID NO: 87173 - RNA, 64 nt, Human
ugaugauuuguuuuuguauuuuuaauggggguagcagcuggacuacccacguucucacacccac

SEQ ID NO: 87174 - RNA, 64 nt, Human
gaagacaaugaagagaaugccgauacucagacugcagcuggaccggcaagcuggcuguguacag

SEQ ID NO: 87175 - RNA, 64 nt, Human
uuguguuuauagcuuugucaaguaaauuuggacgcagcuggagcacaggcccuguuuguuugca

SEQ ID NO: 87176 - RNA, 64 nt, Human
guuugaugcccccuuguccaucagcaagagagagcagcuggaacagcaggugggagggguggga

SEQ ID NO: 87177 - RNA, 64 nt, Human
ggcaaauggaggggaacgugcugacugggacucccagcuggagcugggaggagagguccacuuc

SEQ ID NO: 87178 - RNA, 64 nt, Human
cagggagggaccuccccacaccuacuccaaagaacagcuggacggagcugagaggagacccuag

SEQ ID NO: 87179 - RNA, 64 nt, Human
uggcaaucucuccaucagaauccaccuuaggccucagcuggagggcugcagagccccucccaau

SEQ ID NO: 87180 - RNA, 64 nt, Human
cucgagaggcagggcccaauccuuccagacccaccagcuggaaaagugaaggaagcauguccac

SEQ ID NO: 87181 - RNA, 64 nt, Human
guaguaggagcacuaggcuuucugggaguccauccagcuggaguggcuuugagugaguuacaca

SEQ ID NO: 87182 - RNA, 64 nt, Human
uuuaagcuaaacuucuucaccccugagagcaugucagcuggagaaaagcaguucuuccuugccc

SEQ ID NO: 87183 - RNA, 64 nt, Human
uucauucuuuagagugaacuuuccaaacccaguccagcuggaaacagcuuaucuauaaucugaa

SEQ ID NO: 87184 - RNA, 60 nt, Human
uugggguggggcuguccugaugcacgcagacagcuggaagggucuugguuuucugaaacu

SEQ ID NO: 87185 - RNA, 64 nt, Human
acugcagccuugacccccucccugaccuccccgccagcuggacuccagccauccuccugccuca

SEQ ID NO: 87186 - RNA, 64 nt, Human
ggcuggggccugcgucccuccucgugaccucggccagcuggacccacaugagggccaccucugg

SEQ ID NO: 87187 - RNA, 64 nt, Human
gugaccccucgggacugccuggugcaggugguggcagcuggagggacccaugcagcacccaggu

SEQ ID NO: 87188 - RNA, 64 nt, Human
aggucagagcagacccuccccugccggccugcgccagcuggaccugauggcccccuguggcgcc

SEQ ID NO: 87189 - RNA, 64 nt, Human
ugccuuuucccuccaagcuccuauuuuacugugucagcuggaaggaaaccuuucccucuuggga

SEQ ID NO: 87190 - RNA, 64 nt, Human
acugucccaagcagucacuagguggcggccgggccagcuggaacccagcccauccucucaggca

SEQ ID NO: 87191 - RNA, 64 nt, Human
ggugcucccuccuccccacguaccauugcgcgugcagcuggagcagaauacccucauuuuuagg

SEQ ID NO: 87192 - RNA, 64 nt, Human
ccuugacuagaaauagagacugagagugagcaaccagcuggaagguacuaugccaguccuagca

SEQ ID NO: 87193 - RNA, 64 nt, Human
aauuaaaaaguccagaaguaucugccuuuaggcacagcuggauccaagggcacaaaugauguca

SEQ ID NO: 87194 - RNA, 64 nt, Human
uggaaccaggcuugccugggacggcugagcugggcagcuggaaguggcucugggguccucacau

SEQ ID NO: 87195 - RNA, 64 nt, Human
agaagccgcccagcuggccgaggaccugaaggugcagcuggagcacgugcagacucggcugcgg

SEQ ID NO: 87196 - RNA, 64 nt, Human
aagcucugugccuggucuguaacaguuuccaggccagcuggagaauguucacugguucggggcu

SEQ ID NO: 87197 - RNA, 64 nt, Human
uggggcuuguagcagaaggcaagcaccaggcucacagcuggaacccuggugucuccuccagcgu

SEQ ID NO: 87198 - RNA, 64 nt, Human
ugccugcuucagcaaaaacggagauucaggccagcagcuggauaugggggucucucuucagacu

SEQ ID NO: 87199 - RNA, 64 nt, Human
cagaggaaaacgcuucuuucuccuccagcugaaucagcuggaucccaguguccuggcuguuugg

SEQ ID NO: 87200 - RNA, 64 nt, Human
aucgcucaaacaccuguuugcagaccccaugcaccagcuggaggggccguaacugcaggacugc

SEQ ID NO: 87201 - RNA, 64 nt, Human
ugccuaggguacuguccccacaucugucccaacccagcuggaggccuggucucuccuuacaacc

SEQ ID NO: 87202 - RNA, 64 nt, Human
ccugggcacugguugacaguacugaggcuuaaggcagcuggacucucuugcuggugaccuggca

SEQ ID NO: 87203 - RNA, 64 nt, Human
cuggacugagcugcucucccacaggguuucugugcagcuggauuuucucuguugcauacaugcc

SEQ ID NO: 87204 - RNA, 64 nt, Human
acaaaggcagaugauacacuuauaaaacugggaacagcuggaaugcuucuugauuuuauuuuuu

SEQ ID NO: 87205 - RNA, 64 nt, Human
cagcagucaacaagcaccuuccucuccacagaagcagcuggaagagaacucgaggggcugugcu

SEQ ID NO: 87206 - RNA, 64 nt, Human
gcaccugccugacccuugagcuccaggcuccugccagcuggaggugaaacugugcuuguauccc

SEQ ID NO: 87207 - RNA, 64 nt, Human
ggacgucuagguggggacaggguaucuuggcucccagcuggaccagagugcccugcuugccucu

SEQ ID NO: 87208 - RNA, 59 nt, Human
aggcccagggccccaagugaagcugcucgcagcuggagugagaggcagguggcggccgg

SEQ ID NO: 87209 - RNA, 64 nt, Human
auagcaauuccccuacaucaaaugcucaagcccccagcuggaaguuaagagaaagucaccugcc

SEQ ID NO: 87210 - RNA, 64 nt, Human
cagaaggcacuaagcuuccugggccccucacccccagcuggaaauuaagaaaaagucgcccgaa

SEQ ID NO: 87211 - RNA, 64 nt, Human
ucccugccguggguugcuggccucacacuugcagcagcuggacagugauuuuagaaggccacca

SEQ ID NO: 87212 - RNA, 64 nt, Human
augccuguaaucccaacacuuugggaggcuaaggcagcuggaucacuugaggccaggaguucaa

SEQ ID NO: 87213 - RNA, 64 nt, Human
cuuuccacauuugccugauuuguucucagcaauccagcuggagugucuuaucaauccagaugaa

SEQ ID NO: 87214 - RNA, 64 nt, Human
uaaugauuuggccaugaggcgcugcuauuauaagcagcuggaaaugaauauuaauggcagagau

SEQ ID NO: 87215 - RNA, 64 nt, Human
ucuuuguuggcucagaaaauaccuuagcuucacucagcuggacugcauugaaggcgaggcugcc

SEQ ID NO: 87216 - RNA, 64 nt, Human
ccuagcaggauuggauuaaaaccacaggcuuuugcagcuggaaugggguucagugaacaucucc

SEQ ID NO: 87217 - RNA, 64 nt, Human
aguggaaccuucuggagcuggccaucauccuggccagcuggagcgcccuggcgguguuugugaa

SEQ ID NO: 87218 - RNA, 64 nt, Human
ugagugaccacagggccucccagcccaacaucuccagcuggaucccagggaaauaucagccuug

SEQ ID NO: 87219 - RNA, 64 nt, Human
uucugucuacagggaggggcccugggucuaugcacagcuggagcucugagccuuccacagcccg

SEQ ID NO: 87220 - RNA, 64 nt, Human
uugcagucccaguauauugugcgugcaccagccccagcuggagcaaccaaaacugcuucugguu

SEQ ID NO: 87221 - RNA, 64 nt, Human
ccuuguacaccccaaucccaugucucccucccuucagcuggaccgugugccccuuugggaggaa

SEQ ID NO: 87222 - RNA, 64 nt, Human
cucucugagggaaucagaguccagcauccagccccagcuggaacagcugaagucacaagccucc

SEQ ID NO: 87223 - RNA, 64 nt, Human
gguucaagcaauucuccugccucagccucucgagcagcuggaauuacaggcacgugccacgaca

SEQ ID NO: 87224 - RNA, 64 nt, Human
gauauuugcgucuuuugcccaccccccuggcauucagcuggacccaacuaggccaucaugagug

SEQ ID NO: 87225 - RNA, 64 nt, Human
ccccugcccugaagaucuuccauuugcuuccacucagcuggaggcucaagagggcuugauggcu

SEQ ID NO: 87226 - RNA, 64 nt, Human
cguuuaccuggugcugcgucuugcuuuugguuuccagcuggagaaaagaagacaagaaagucuu

SEQ ID NO: 87227 - RNA, 64 nt, Human
uucaugagccccaagccaaaaccagcuccagucacagcuggacugggucugcccaccucuuggg

SEQ ID NO: 87228 - RNA, 64 nt, Human
ccccaccacuaccauggacuggacaccuucacuccagcuggacaaagacucuggagagagagcc

SEQ ID NO: 87229 - RNA, 64 nt, Human
augcccccgaugaggaccaagggcaccuggaggacagcuggaccgguaucugccauccugggcc

SEQ ID NO: 87230 - RNA, 64 nt, Human
ugcaccuacgccuggucuguaugguggaauuugucagcuggaacucagaaacaacaacuugaaa

SEQ ID NO: 87231 - RNA, 64 nt, Human
gagggcagguaaugacuccaucgcacccucaguucagcuggacagaggcucaggugaccccagc

SEQ ID NO: 87232 - RNA, 64 nt, Human
ggagaggcaauagccccuguggcaauugcaggaccagcuggagcaggguugcggugucuccacg

SEQ ID NO: 87233 - RNA, 64 nt, Human
gggcagugcugagggcugggaugcucugugaccccagcuggagcccacaccuaagggcuggcau

SEQ ID NO: 87234 - RNA, 64 nt, Human
ggcuggggccuuaaugugaaaagacaguggcaggcagcuggaguagagcgagcccagcagcccu

SEQ ID NO: 87235 - RNA, 64 nt, Human
aggguccccggccucuccuuuaagauucucuccccagcuggaaggccgaugacuggguggucgg

SEQ ID NO: 87236 - RNA, 64 nt, Human
gauccggggcccccccacccccaaaucacgagugcagcuggagcuugcucccccuuguucggaa

SEQ ID NO: 87237 - RNA, 64 nt, Human
uuccuccaagcccagaugcagagauggucaugggcagcuggaggguaggcucagaaaugaaggg

SEQ ID NO: 87238 - RNA, 64 nt, Human
gagugcugggauuacaauugugagccaccacguccagcuggaagggucaacaucuuuuacauuc

SEQ ID NO: 87239 - RNA, 64 nt, Human
auuaaaggauuuaaauuugaaccuggcuuucucacagcuggacauaauucuaggaaaauaaaau

SEQ ID NO: 87240 - RNA, 64 nt, Human
ucuucacccuucagagagcaguccuuucucugugcagcuggagacgcuggugaggagagccggg

SEQ ID NO: 87241 - RNA, 64 nt, Human
cuggcacuaguaggucuacagucccauauguuggcagcuggagccgaagagcaccacucccugu

SEQ ID NO: 87242 - RNA, 64 nt, Human
acuggaagauccccucuccugcccaagcacuucacagcuggacccugcuucacccucacccccu

SEQ ID NO: 87243 - RNA, 64 nt, Human
aaggccagaacccagggauccaggagucggcucucagcuggagcuuccauaccuucugggcucc

SEQ ID NO: 87244 - RNA, 64 nt, Human
auuuauaaaaagaugaucgcuguauuuugaguuucagcuggaaacuucuguaaggggcagcagu

SEQ ID NO: 87245 - RNA, 64 nt, Human
cuuccuugccagagaugaucugacccggugggggcagcuggaaagcaacacuggcccccagcug

SEQ ID NO: 87246 - RNA, 64 nt, Human
gaagcacgggggagugagacaggcuggguccugccagcuggaucgcugcacauggccugagcau

SEQ ID NO: 87247 - RNA, 64 nt, Human
gaagugugaguuaucagccacucaggcuccgagccagcuggauucucugccugccacugucagg

SEQ ID NO: 87248 - RNA, 64 nt, Human
gcgcagcgggaaugagcggggaugccgcgggcagcagcuggagcuaaaggaagggcaggcccac

SEQ ID NO: 87249 - RNA, 64 nt, Human
cgaugauggacuugagcgccguguucuucagccucagcuggaaggggaaaagucagggccuucc

SEQ ID NO: 87250 - RNA, 64 nt, Human
ucccuaaucuuuaagcccgacuugaggcugagagcagcuggaaguuuggguuuggugguuuggg

SEQ ID NO: 87251 - RNA, 64 nt, Human
ggagccugcuggaccccagaucguccccuccucccagcuggaaagcuagggcaggucuccccag

SEQ ID NO: 87252 - RNA, 64 nt, Human
gggaaccuggucugauuccuuccaacgugcacuucagcuggagaaagaaaccaagaagggaagc

SEQ ID NO: 87253 - RNA, 64 nt, Human
ggguccagggugacucuccaaagaaauuggccuucagcuggagaaaacauuggguggagacucu

SEQ ID NO: 87254 - RNA, 64 nt, Human
ccgcauuagcucuagcaaugagguucacuggauacagcuggauacuggggugagucucuugccu

SEQ ID NO: 87255 - RNA, 64 nt, Human
agcuuggggcuggaugaaggggucuccgccagcucagcuggagccggagccggggagacucuga

SEQ ID NO: 87256 - RNA, 64 nt, Human
cuuggcccggcagcaccacgcugacuauagcaaccagcuggacccggccucuggcacccgaaac

SEQ ID NO: 87257 - RNA, 64 nt, Human
ugacacuugugagaaggcauuugccaaaccaagccagcuggagcgccacagccgcauacauaca

SEQ ID NO: 87258 - RNA, 64 nt, Human
ccaugaagagauguucucacagaacagaaccccacagcuggauaaggcccguauauauauauuu

SEQ ID NO: 87259 - RNA, 64 nt, Human
uuuugccuuuaacaguuggauggauuuugucaaucagcuggauaugcuguuuaguuuuuacaac

SEQ ID NO: 87260 - RNA, 64 nt, Human
aucaauauuuugcugaaaugaguugaucuuucaccagcuggacuaccauugugagaacucaguu

SEQ ID NO: 87261 - RNA, 64 nt, Human
gccgccucaacgcacuucgcggaccucagcccugcagcuggagggcaacaggcugccgggcccc

SEQ ID NO: 87262 - RNA, 64 nt, Human
ccaaggacuggacuccaggcaagucccugcgcuccagcuggacggcccuguuccagggaggagg

SEQ ID NO: 87263 - RNA, 64 nt, Human
ucccucugggcaacuggacagaucugggagccagcagcuggaugcuguggcuggccagagacac

SEQ ID NO: 87264 - RNA, 64 nt, Human
ccuuuauuuucaggcauagacuccucuguggucacagcuggagcacagagagggacccugggaa

SEQ ID NO: 87265 - RNA, 64 nt, Human
ucucccuccuccccucgcccucggccugguucugcagcuggaccgaccucauucaucgccugcc

SEQ ID NO: 87266 - RNA, 64 nt, Human
gggccguagcggcaggcgaacggugccugcuacccagcuggaagccacaagguggcuggcucca

SEQ ID NO: 87267 - RNA, 64 nt, Human
ccgcucuggauaagacacccaaccccaacuccagcagcuggacucugggcccacaaggggaggg

SEQ ID NO: 87268 - RNA, 64 nt, Human
gcccagaauaaccgccacccuugccauccugcaacagcuggacucaaguuuccaggaaguggag

SEQ ID NO: 87269 - RNA, 64 nt, Human
ccuguguccuggaggagaaaagcauuagagggggcagcuggacaagcucccaacugcagagucc

SEQ ID NO: 87270 - RNA, 64 nt, Human
cuucugaaacgauggcaucagagcccuggagagccagcuggagacacaggcgucuggccuucag

SEQ ID NO: 87271 - RNA, 64 nt, Human
gaggggcguugugcaauuuguggcaaggcuggcccagcuggaugccugggucccaguauuuuua

SEQ ID NO: 87272 - RNA, 64 nt, Human
guuucugagugacaaagugacugcccggucagaucagcuggaucucagcggggagccacgucuc

SEQ ID NO: 87273 - RNA, 64 nt, Human
agguagccggcaagggguggagcuggaggagucucagcuggaugaugagaagggcugaaauguu

SEQ ID NO: 87274 - RNA, 64 nt, Human
ccuggaccggcagcuggcgcaccaggcccagcagcagcuggaggaggaggaggaggauacgcca

SEQ ID NO: 87275 - RNA, 64 nt, Human
cacccaauuuuucaugggaguugacaccaaaacacagcuggauuccaucaggaaagcugcauug

SEQ ID NO: 87276 - RNA, 64 nt, Human
gccccuuguccucugccuucugcuggcagaggagcagcuggacuggggccuuuggcacagcagc

SEQ ID NO: 87277 - RNA, 64 nt, Human
gaggcuguucuguccccaggaggggguccgccagcagcuggagcugggccgcuuccugaggagc

SEQ ID NO: 87278 - RNA, 64 nt, Human
cauguaacuggaggaugugcuaugaguuugcaaacagcuggacugucaggcugcuuuuuuucca

SEQ ID NO: 87279 - RNA, 64 nt, Human
ucucaaaaccggguugccagcucccauguaccagcagcuggacucugaaggcgugagucugcau

SEQ ID NO: 87280 - RNA, 64 nt, Human
ucucaaaacuggguugccagcuccaauguaccagcagcuggaaucugaaggcgugagucugcau

SEQ ID NO: 87281 - RNA, 64 nt, Human
ucucaaaaccggguugccagcucccauguaccagcagcuggaaucugaaggcgugagucugcau

SEQ ID NO: 87282 - RNA, 64 nt, Human
ucucaaaaccgaguugccagcucccauguaccagcagcuggaaucugaaggcgugagucuucau

SEQ ID NO: 87283 - RNA, 64 nt, Human
ucucaaaaccggguugccagcucccauguaccagcagcuggaaucugaaggcaucagucuucau

SEQ ID NO: 87284 - RNA, 64 nt, Human
ucucaaaaccagguugccagauccaaugaaccagcagcuggaaucugaaggcaucagucugcau

SEQ ID NO: 87285 - RNA, 64 nt, Human
aagaggugugguccaaggaaguagcuuuugugaccagcuggaguuucuggugacucuuuuggca

SEQ ID NO: 87286 - RNA, 64 nt, Human
ugaggaacccugaugagcacaaggugauucaggccagcuggagaagcuuccagaagggcccugc

SEQ ID NO: 87287 - RNA, 64 nt, Human
ggcucaagcgauccucccaccucagccuccacagcagcuggaacuccaggugugaaucaccaug

SEQ ID NO: 87288 - RNA, 64 nt, Human
aaaaaccucuggcgccuccaauccagacccaccacagcuggagggccaggccuccucuucccca

SEQ ID NO: 87289 - RNA, 64 nt, Human
cgggaggggacaacgggcuguugcgggugcgcggcagcuggagacacucccccgcagggccaac

SEQ ID NO: 87290 - RNA, 64 nt, Human
cagagucagcugcugcuugaggaagcagaacacacagcuggaggcuuggaacaugugggucccu

SEQ ID NO: 87291 - RNA, 64 nt, Human
aagggccgagcaggcuccaggaggccuccagagucagcuggaccuugcugugucgcccgcaggc

SEQ ID NO: 87292 - RNA, 64 nt, Human
aggcugaaaugucauaucugaaggaagaaagcagcagcuggacaauguuucuuugcaaagcaac

SEQ ID NO: 87293 - RNA, 64 nt, Human
uggcagacggcagacaaggggagaagagacgaagcagcuggacaucggagacuacaguugaacu

SEQ ID NO: 87294 - RNA, 64 nt, Human
gcagcuacagaaagguaguagugagacgugaagccagcuggacuuccuggguugaauggggacc

SEQ ID NO: 87295 - RNA, 64 nt, Human
agcagggaagggggacccaaggcaggagguacaccagcuggacaaauugcagggaggggaggga

SEQ ID NO: 87296 - RNA, 64 nt, Human
cugggguaggagggccugccugagucccagcucccagcuggagaauccaccagcacaagaagag

SEQ ID NO: 87297 - RNA, 64 nt, Human
caggugguggccuggccgguuggcgaucucccgacagcuggauccggcaaugugaagcuuuugu

SEQ ID NO: 87298 - RNA, 64 nt, Human
uuccauuguccuccccuggccaggccuccuggcucagcuggaagugcauggcuucuuucucccu

SEQ ID NO: 87299 - RNA, 56 nt, Human
uuggcaguuuggcagcuugacuucugcagcuggaggaggccccucaggccggggau

SEQ ID NO: 87300 - RNA, 64 nt, Human
accccacuugcaccccaccccagccauggaagagcagcuggaggguggauggggaggccagagg

SEQ ID NO: 87301 - RNA, 64 nt, Human
ugagcgggugaagugccacugggucaccgcagggcagcuggaauggcagcaugguagcaccucc

SEQ ID NO: 87302 - RNA, 64 nt, Human
auauccaaagccuguucucccagccguccuccugcagcuggagccuucaggccguauucucacg

SEQ ID NO: 87303 - RNA, 64 nt, Human
ggauaucgcaacaagugcguuugaagguucagcacagcuggaauuguacgguagugagcucuuc

SEQ ID NO: 87304 - RNA, 64 nt, Human
guuugaggacaagaaagaugaagcuuggaggucacagcuggaucugcuuguugcauuuccagcu

SEQ ID NO: 87305 - RNA, 64 nt, Human
cucuauagauauugacucuguguucccucuuuuacagcuggacagaaagaagucaaugucacga

SEQ ID NO: 87306 - RNA, 64 nt, Human
uggguugucaacuuuucuuuaacuggcuacgccacagcuggacacacaugcagccccuggaggg

SEQ ID NO: 87307 - RNA, 64 nt, Human
caucuaaggaacagauguggucguuccgcccucucagcuggaugagacuguccuggaggaucca

SEQ ID NO: 87308 - RNA, 64 nt, Human
cugugauagcggcaguggcuuuuucugguaccugcagcuggaaaggccacuuggcccugugcug

SEQ ID NO: 87309 - RNA, 64 nt, Human
cagcugccuucagcccugugacgucuccucagggcagcuggacaggcuuggcacugcccgggaa

SEQ ID NO: 87310 - RNA, 64 nt, Human
cucuuggccucacccagggaccgucuggcuuccccagcuggacugggaggucaggaagccaggc

SEQ ID NO: 87311 - RNA, 64 nt, Human
cagcuuugcuaccaaagcaccuuagcuggcauuacagcuggagaagacccuccccgcacccccc

SEQ ID NO: 87312 - RNA, 64 nt, Human
aucaucgcuguuaaggacccucggagcccagaugcagcuggagccaccauccuguagagcagcg

SEQ ID NO: 87313 - RNA, 64 nt, Human
gccugaaugaggccaggcccugagaaggagccaccagcuggaggaaaggggcuccaagccuugc

SEQ ID NO: 87314 - RNA, 64 nt, Human
cacucaccuuuuccuccugagccugcucucugaucagcuggauccccacgugagcaacagcugg

SEQ ID NO: 87315 - RNA, 64 nt, Human
ccuuggccgcccccuuccuaaacacaaggauccccagcuggacuccccacccccuggcuucccc

SEQ ID NO: 87316 - RNA, 64 nt, Human
acgucuuuccuccccaugggggugggagggcccccagcuggaagagcagacucccagcugcuac

SEQ ID NO: 87317 - RNA, 64 nt, Human
ccugaggccaagcaggggagaggaaugaggggagcagcuggacaugggccuccugaggccucgg

SEQ ID NO: 87318 - RNA, 64 nt, Human
ccuuggacgcccagugcuggccuuggaggacggucagcuggaggauggcggugggggaggcugu

SEQ ID NO: 87319 - RNA, 64 nt, Human
gguccugaguaaauguguucuguauaaacaaaugcagcuggaaucgcucaagaaucuuauuuuu

SEQ ID NO: 87320 - RNA, 64 nt, Human
cccuccccagacugccugcugucaaaccacggagcagcuggagccugcccuguccacggcccgu

SEQ ID NO: 87321 - RNA, 64 nt, Human
acuaugcaaagagaggagguugagaguguucuggcagcuggagcucuuuuccuuguccuuccug

SEQ ID NO: 87322 - RNA, 64 nt, Human
guuacaacugcaugagcuuccucucgcacaagaccagcuggaacugagcaugagacgcugucaa

SEQ ID NO: 87323 - RNA, 64 nt, Human
uaaguguccucaccuuuaugcaugacugcaaagccagcuggagcauuuucuauggagccuccgu

SEQ ID NO: 87324 - RNA, 64 nt, Human
ccuucauacgcuuuucuccaggaggagguucuugcagcuggaaacagccuauuuuguggucacu

SEQ ID NO: 87325 - RNA, 64 nt, Human
aauuaggcaaaucuuuggcugcaggcagcaaaaacagcuggacuuauuuaaaacaacuuguuuu

SEQ ID NO: 87326 - RNA, 64 nt, Human
cacuuggaugaggaggugggcgauuuggcucugacagcuggagaugaaggcacacucauaccac

SEQ ID NO: 87327 - RNA, 64 nt, Human
ccccacccucccaucgguccuacauggggcugugcagcuggagccaaaaaggcaagguagaaag

SEQ ID NO: 87328 - RNA, 64 nt, Human
ccaccgagaucucccucaggcuggccagguuuugcagcuggaauucuccucuuggucccagggc
